United States Patent 11,369,692 (MATERIALS AND METHODS FOR TREATMENT OF DUCHENNE MUSCULAR DYSTROPHY) - sequence listing, part 37

SEQ ID NO: 1224421 - DNA, 22 bp, Artificial Sequence
  chemically synthesized
ggaagacaattgtaactttata

SEQ ID NO: 1224422 - DNA, 22 bp, Artificial Sequence
  chemically synthesized
taactttatagttattgtaatt

SEQ ID NO: 1224423 - DNA, 22 bp, Artificial Sequence
  chemically synthesized
tatagttattgtaattttatct

SEQ ID NO: 1224424 - DNA, 22 bp, Artificial Sequence
  chemically synthesized
atagttattgtaattttatctg

SEQ ID NO: 1224425 - DNA, 22 bp, Artificial Sequence
  chemically synthesized
tagttattgtaattttatctgc

SEQ ID NO: 1224426 - DNA, 22 bp, Artificial Sequence
  chemically synthesized
ttgtaattttatctgcatcttt

SEQ ID NO: 1224427 - DNA, 22 bp, Artificial Sequence
  chemically synthesized
gaaatatgtacaaaagatgcag

SEQ ID NO: 1224428 - DNA, 22 bp, Artificial Sequence
  chemically synthesized
agaaatatgtacaaaagatgca

SEQ ID NO: 1224429 - DNA, 22 bp, Artificial Sequence
  chemically synthesized
taattttatctgcatcttttgt

SEQ ID NO: 1224430 - DNA, 22 bp, Artificial Sequence
  chemically synthesized
cttagaaatatgtacaaaagat

SEQ ID NO: 1224431 - DNA, 22 bp, Artificial Sequence
  chemically synthesized
tatctgcatcttttgtacatat

SEQ ID NO: 1224432 - DNA, 22 bp, Artificial Sequence
  chemically synthesized
atctgcatcttttgtacatatt

SEQ ID NO: 1224433 - DNA, 22 bp, Artificial Sequence
  chemically synthesized
tctgcatcttttgtacatattt

SEQ ID NO: 1224434 - DNA, 22 bp, Artificial Sequence
  chemically synthesized
catcttttgtacatatttctaa

SEQ ID NO: 1224435 - DNA, 22 bp, Artificial Sequence
  chemically synthesized
ttgtacatatttctaagcaatt

SEQ ID NO: 1224436 - DNA, 22 bp, Artificial Sequence
  chemically synthesized
aaacccaatgataattgcttag

SEQ ID NO: 1224437 - DNA, 22 bp, Artificial Sequence
  chemically synthesized
tgtacatatttctaagcaatta

SEQ ID NO: 1224438 - DNA, 22 bp, Artificial Sequence
  chemically synthesized
gtacatatttctaagcaattat

SEQ ID NO: 1224439 - DNA, 22 bp, Artificial Sequence
  chemically synthesized
tacatatttctaagcaattatc

SEQ ID NO: 1224440 - DNA, 22 bp, Artificial Sequence
  chemically synthesized
tgttaaaacccaatgataattg

SEQ ID NO: 1224441 - DNA, 22 bp, Artificial Sequence
  chemically synthesized
gtgttaaaacccaatgataatt

SEQ ID NO: 1224442 - DNA, 22 bp, Artificial Sequence
  chemically synthesized
tgtgttaaaacccaatgataat

SEQ ID NO: 1224443 - DNA, 22 bp, Artificial Sequence
  chemically synthesized
ttgtgttaaaacccaatgataa

SEQ ID NO: 1224444 - DNA, 22 bp, Artificial Sequence
  chemically synthesized
tttgtgttaaaacccaatgata

SEQ ID NO: 1224445 - DNA, 22 bp, Artificial Sequence
  chemically synthesized
ctaagcaattatcattgggttt

SEQ ID NO: 1224446 - DNA, 22 bp, Artificial Sequence
  chemically synthesized
ctttttgtgttaaaacccaatg

SEQ ID NO: 1224447 - DNA, 22 bp, Artificial Sequence
  chemically synthesized
taagcaattatcattgggtttt

SEQ ID NO: 1224448 - DNA, 22 bp, Artificial Sequence
  chemically synthesized
tactttttgtgttaaaacccaa

SEQ ID NO: 1224449 - DNA, 22 bp, Artificial Sequence
  chemically synthesized
agcaattatcattgggttttaa

SEQ ID NO: 1224450 - DNA, 22 bp, Artificial Sequence
  chemically synthesized
ctactttttgtgttaaaaccca

SEQ ID NO: 1224451 - DNA, 22 bp, Artificial Sequence
  chemically synthesized
tcattgggttttaacacaaaaa

SEQ ID NO: 1224452 - DNA, 22 bp, Artificial Sequence
  chemically synthesized
ggttttaacacaaaaagtagaa

SEQ ID NO: 1224453 - DNA, 22 bp, Artificial Sequence
  chemically synthesized
aaaggaagccagatttctactt

SEQ ID NO: 1224454 - DNA, 22 bp, Artificial Sequence
  chemically synthesized
caaaggaagccagatttctact

SEQ ID NO: 1224455 - DNA, 22 bp, Artificial Sequence
  chemically synthesized
taacacaaaaagtagaaatctg

SEQ ID NO: 1224456 - DNA, 22 bp, Artificial Sequence
  chemically synthesized
aacacaaaaagtagaaatctgg

SEQ ID NO: 1224457 - DNA, 22 bp, Artificial Sequence
  chemically synthesized
acacaaaaagtagaaatctggc

SEQ ID NO: 1224458 - DNA, 22 bp, Artificial Sequence
  chemically synthesized
caatacccttcaaaggaagcca

SEQ ID NO: 1224459 - DNA, 22 bp, Artificial Sequence
  chemically synthesized
gcttcctttgaagggtattgta

SEQ ID NO: 1224460 - DNA, 22 bp, Artificial Sequence
  chemically synthesized
cctttgaagggtattgtagtgg

SEQ ID NO: 1224461 - DNA, 22 bp, Artificial Sequence
  chemically synthesized
ctttgaagggtattgtagtgga

SEQ ID NO: 1224462 - DNA, 22 bp, Artificial Sequence
  chemically synthesized
tgaagggtattgtagtggactt

SEQ ID NO: 1224463 - DNA, 22 bp, Artificial Sequence
  chemically synthesized
gaagggtattgtagtggacttt

SEQ ID NO: 1224464 - DNA, 22 bp, Artificial Sequence
  chemically synthesized
aagggtattgtagtggactttg

SEQ ID NO: 1224465 - DNA, 22 bp, Artificial Sequence
  chemically synthesized
tgtgataaaacgcaaagtccac

SEQ ID NO: 1224466 - DNA, 22 bp, Artificial Sequence
  chemically synthesized
aaagttgtgtgataaaacgcaa

SEQ ID NO: 1224467 - DNA, 22 bp, Artificial Sequence
  chemically synthesized
tagtggactttgcgttttatca

SEQ ID NO: 1224468 - DNA, 22 bp, Artificial Sequence
  chemically synthesized
tgcgttttatcacacaactttt

SEQ ID NO: 1224469 - DNA, 22 bp, Artificial Sequence
  chemically synthesized
gcgttttatcacacaactttta

SEQ ID NO: 1224470 - DNA, 22 bp, Artificial Sequence
  chemically synthesized
cgttttatcacacaacttttaa

SEQ ID NO: 1224471 - DNA, 22 bp, Artificial Sequence
  chemically synthesized
agtgtcatggcagttaaaagtt

SEQ ID NO: 1224472 - DNA, 22 bp, Artificial Sequence
  chemically synthesized
tatcacacaacttttaactgcc

SEQ ID NO: 1224473 - DNA, 22 bp, Artificial Sequence
  chemically synthesized
actaagtgtcatggcagttaaa

SEQ ID NO: 1224474 - DNA, 22 bp, Artificial Sequence
  chemically synthesized
atcacacaacttttaactgcca

SEQ ID NO: 1224475 - DNA, 22 bp, Artificial Sequence
  chemically synthesized
tcacacaacttttaactgccat

SEQ ID NO: 1224476 - DNA, 22 bp, Artificial Sequence
  chemically synthesized
ttaactgccatgacacttagtc

SEQ ID NO: 1224477 - DNA, 22 bp, Artificial Sequence
  chemically synthesized
taactgccatgacacttagtca

SEQ ID NO: 1224478 - DNA, 22 bp, Artificial Sequence
  chemically synthesized
aactgccatgacacttagtcaa

SEQ ID NO: 1224479 - DNA, 22 bp, Artificial Sequence
  chemically synthesized
actgccatgacacttagtcaat

SEQ ID NO: 1224480 - DNA, 22 bp, Artificial Sequence
  chemically synthesized
atatagagcataaggattgact

SEQ ID NO: 1224481 - DNA, 22 bp, Artificial Sequence
  chemically synthesized
ccatgacacttagtcaatcctt

SEQ ID NO: 1224482 - DNA, 22 bp, Artificial Sequence
  chemically synthesized
agtcaatccttatgctctatat

SEQ ID NO: 1224483 - DNA, 22 bp, Artificial Sequence
  chemically synthesized
gtcaatccttatgctctatatt

SEQ ID NO: 1224484 - DNA, 22 bp, Artificial Sequence
  chemically synthesized
atgctctatattaactacatgt

SEQ ID NO: 1224485 - DNA, 22 bp, Artificial Sequence
  chemically synthesized
tacagaacaaagacatgtagtt

SEQ ID NO: 1224486 - DNA, 22 bp, Artificial Sequence
  chemically synthesized
tgctctatattaactacatgtc

SEQ ID NO: 1224487 - DNA, 22 bp, Artificial Sequence
  chemically synthesized
aactatacagaacaaagacatg

SEQ ID NO: 1224488 - DNA, 22 bp, Artificial Sequence
  chemically synthesized
tatattaactacatgtctttgt

SEQ ID NO: 1224489 - DNA, 22 bp, Artificial Sequence
  chemically synthesized
tattaactacatgtctttgttc

SEQ ID NO: 1224490 - DNA, 22 bp, Artificial Sequence
  chemically synthesized
actacatgtctttgttctgtat

SEQ ID NO: 1224491 - DNA, 22 bp, Artificial Sequence
  chemically synthesized
agtggttcaactatacagaaca

SEQ ID NO: 1224492 - DNA, 22 bp, Artificial Sequence
  chemically synthesized
catgtctttgttctgtatagtt

SEQ ID NO: 1224493 - DNA, 22 bp, Artificial Sequence
  chemically synthesized
aataattgagtggttcaactat

SEQ ID NO: 1224494 - DNA, 22 bp, Artificial Sequence
  chemically synthesized
caataattgagtggttcaacta

SEQ ID NO: 1224495 - DNA, 22 bp, Artificial Sequence
  chemically synthesized
tgttctgtatagttgaaccact

SEQ ID NO: 1224496 - DNA, 22 bp, Artificial Sequence
  chemically synthesized
gttctgtatagttgaaccactc

SEQ ID NO: 1224497 - DNA, 22 bp, Artificial Sequence
  chemically synthesized
atttcaataattgagtggttca

SEQ ID NO: 1224498 - DNA, 22 bp, Artificial Sequence
  chemically synthesized
ttctgtatagttgaaccactca

SEQ ID NO: 1224499 - DNA, 22 bp, Artificial Sequence
  chemically synthesized
tgtatagttgaaccactcaatt

SEQ ID NO: 1224500 - DNA, 22 bp, Artificial Sequence
  chemically synthesized
tatagttgaaccactcaattat

SEQ ID NO: 1224501 - DNA, 22 bp, Artificial Sequence
  chemically synthesized
aaccactcaattattgaaatga

SEQ ID NO: 1224502 - DNA, 22 bp, Artificial Sequence
  chemically synthesized
ggaatgtcatgaggtgccctca

SEQ ID NO: 1224503 - DNA, 22 bp, Artificial Sequence
  chemically synthesized
aattattgaaatgagggcacct

SEQ ID NO: 1224504 - DNA, 22 bp, Artificial Sequence
  chemically synthesized
ttgaaatgagggcacctcatga

SEQ ID NO: 1224505 - DNA, 22 bp, Artificial Sequence
  chemically synthesized
aaatgagggcacctcatgacat

SEQ ID NO: 1224506 - DNA, 22 bp, Artificial Sequence
  chemically synthesized
gcacaattaggaatgtcatgag

SEQ ID NO: 1224507 - DNA, 22 bp, Artificial Sequence
  chemically synthesized
tcgttggcacaattaggaatgt

SEQ ID NO: 1224508 - DNA, 22 bp, Artificial Sequence
  chemically synthesized
atgacattcctaattgtgccaa

SEQ ID NO: 1224509 - DNA, 22 bp, Artificial Sequence
  chemically synthesized
catagcgattgtcgttggcaca

SEQ ID NO: 1224510 - DNA, 22 bp, Artificial Sequence
  chemically synthesized
ttccatagcgattgtcgttggc

SEQ ID NO: 1224511 - DNA, 22 bp, Artificial Sequence
  chemically synthesized
tgttccatagcgattgtcgttg

SEQ ID NO: 1224512 - DNA, 22 bp, Artificial Sequence
  chemically synthesized
ctaattgtgccaacgacaatcg

SEQ ID NO: 1224513 - DNA, 22 bp, Artificial Sequence
  chemically synthesized
tctgttccatagcgattgtcgt

SEQ ID NO: 1224514 - DNA, 22 bp, Artificial Sequence
  chemically synthesized
attgtgccaacgacaatcgcta

SEQ ID NO: 1224515 - DNA, 22 bp, Artificial Sequence
  chemically synthesized
aactctctgttccatagcgatt

SEQ ID NO: 1224516 - DNA, 22 bp, Artificial Sequence
  chemically synthesized
tgccaacgacaatcgctatgga

SEQ ID NO: 1224517 - DNA, 22 bp, Artificial Sequence
  chemically synthesized
aagaaaaaaatggttgaactct

SEQ ID NO: 1224518 - DNA, 22 bp, Artificial Sequence
  chemically synthesized
tggaacagagagttcaaccatt

SEQ ID NO: 1224519 - DNA, 22 bp, Artificial Sequence
  chemically synthesized
tctaaagaaaaaaatggttgaa

SEQ ID NO: 1224520 - DNA, 22 bp, Artificial Sequence
  chemically synthesized
atctaaagaaaaaaatggttga

SEQ ID NO: 1224521 - DNA, 22 bp, Artificial Sequence
  chemically synthesized
tatctaaagaaaaaaatggttg

SEQ ID NO: 1224522 - DNA, 22 bp, Artificial Sequence
  chemically synthesized
tttatctaaagaaaaaaatggt

SEQ ID NO: 1224523 - DNA, 22 bp, Artificial Sequence
  chemically synthesized
atattctttatctaaagaaaaa

SEQ ID NO: 1224524 - DNA, 22 bp, Artificial Sequence
  chemically synthesized
aaccatttttttctttagataa

SEQ ID NO: 1224525 - DNA, 22 bp, Artificial Sequence
  chemically synthesized
gcagatgttcatattctttatc

SEQ ID NO: 1224526 - DNA, 22 bp, Artificial Sequence
  chemically synthesized
ggcagatgttcatattctttat

SEQ ID NO: 1224527 - DNA, 22 bp, Artificial Sequence
  chemically synthesized
ttttctttagataaagaatatg

SEQ ID NO: 1224528 - DNA, 22 bp, Artificial Sequence
  chemically synthesized
tttctttagataaagaatatga

SEQ ID NO: 1224529 - DNA, 22 bp, Artificial Sequence
  chemically synthesized
ttctttagataaagaatatgaa

SEQ ID NO: 1224530 - DNA, 22 bp, Artificial Sequence
  chemically synthesized
tctttagataaagaatatgaac

SEQ ID NO: 1224531 - DNA, 22 bp, Artificial Sequence
  chemically synthesized
tatttggcagatgttcatattc

SEQ ID NO: 1224532 - DNA, 22 bp, Artificial Sequence
  chemically synthesized
ctttagataaagaatatgaaca

SEQ ID NO: 1224533 - DNA, 22 bp, Artificial Sequence
  chemically synthesized
gtatttggcagatgttcatatt

SEQ ID NO: 1224534 - DNA, 22 bp, Artificial Sequence
  chemically synthesized
tttagataaagaatatgaacat

SEQ ID NO: 1224535 - DNA, 22 bp, Artificial Sequence
  chemically synthesized
tgtatttggcagatgttcatat

SEQ ID NO: 1224536 - DNA, 22 bp, Artificial Sequence
  chemically synthesized
ttgtatttggcagatgttcata

SEQ ID NO: 1224537 - DNA, 22 bp, Artificial Sequence
  chemically synthesized
tagataaagaatatgaacatct

SEQ ID NO: 1224538 - DNA, 22 bp, Artificial Sequence
  chemically synthesized
tttgtatttggcagatgttcat

SEQ ID NO: 1224539 - DNA, 22 bp, Artificial Sequence
  chemically synthesized
agataaagaatatgaacatctg

SEQ ID NO: 1224540 - DNA, 22 bp, Artificial Sequence
  chemically synthesized
gataaagaatatgaacatctgc

SEQ ID NO: 1224541 - DNA, 22 bp, Artificial Sequence
  chemically synthesized
tttttgtatttggcagatgttc

SEQ ID NO: 1224542 - DNA, 22 bp, Artificial Sequence
  chemically synthesized
ctttttgtatttggcagatgtt

SEQ ID NO: 1224543 - DNA, 22 bp, Artificial Sequence
  chemically synthesized
ccccttctttttgtatttggca

SEQ ID NO: 1224544 - DNA, 22 bp, Artificial Sequence
  chemically synthesized
atgaatcatctcccccttcttt

SEQ ID NO: 1224545 - DNA, 22 bp, Artificial Sequence
  chemically synthesized
catgaatcatctcccccttctt

SEQ ID NO: 1224546 - DNA, 22 bp, Artificial Sequence
  chemically synthesized
ccaaatacaaaaagaaggggga

SEQ ID NO: 1224547 - DNA, 22 bp, Artificial Sequence
  chemically synthesized
tcatgaatcatctcccccttct

SEQ ID NO: 1224548 - DNA, 22 bp, Artificial Sequence
  chemically synthesized
tttcatgaatcatctccccctt

SEQ ID NO: 1224549 - DNA, 22 bp, Artificial Sequence
  chemically synthesized
atgttctttcatgaatcatctc

SEQ ID NO: 1224550 - DNA, 22 bp, Artificial Sequence
  chemically synthesized
aatgttctttcatgaatcatct

SEQ ID NO: 1224551 - DNA, 22 bp, Artificial Sequence
  chemically synthesized
tttaatgttctttcatgaatca

SEQ ID NO: 1224552 - DNA, 22 bp, Artificial Sequence
  chemically synthesized
acagttgtttaatgttctttca

SEQ ID NO: 1224553 - DNA, 22 bp, Artificial Sequence
  chemically synthesized
cacagttgtttaatgttctttc

SEQ ID NO: 1224554 - DNA, 22 bp, Artificial Sequence
  chemically synthesized
ttcacagttgtttaatgttctt

SEQ ID NO: 1224555 - DNA, 22 bp, Artificial Sequence
  chemically synthesized
atgaaagaacattaaacaactg

SEQ ID NO: 1224556 - DNA, 22 bp, Artificial Sequence
  chemically synthesized
aagaggttcttcacagttgttt

SEQ ID NO: 1224557 - DNA, 22 bp, Artificial Sequence
  chemically synthesized
caagaggttcttcacagttgtt

SEQ ID NO: 1224558 - DNA, 22 bp, Artificial Sequence
  chemically synthesized
tcaagaggttcttcacagttgt

SEQ ID NO: 1224559 - DNA, 22 bp, Artificial Sequence
  chemically synthesized
ttcaagaggttcttcacagttg

SEQ ID NO: 1224560 - DNA, 22 bp, Artificial Sequence
  chemically synthesized
cttttcaagaggttcttcacag

SEQ ID NO: 1224561 - DNA, 22 bp, Artificial Sequence
  chemically synthesized
aacaactgtgaagaacctcttg

SEQ ID NO: 1224562 - DNA, 22 bp, Artificial Sequence
  chemically synthesized
catggttacttttcaagaggtt

SEQ ID NO: 1224563 - DNA, 22 bp, Artificial Sequence
  chemically synthesized
tgaagaacctcttgaaaagtaa

SEQ ID NO: 1224564 - DNA, 22 bp, Artificial Sequence
  chemically synthesized
tgtattacatggttacttttca

SEQ ID NO: 1224565 - DNA, 22 bp, Artificial Sequence
  chemically synthesized
atgtattacatggttacttttc

SEQ ID NO: 1224566 - DNA, 22 bp, Artificial Sequence
  chemically synthesized
tatgtattacatggttactttt

SEQ ID NO: 1224567 - DNA, 22 bp, Artificial Sequence
  chemically synthesized
tttatgtattacatggttactt

SEQ ID NO: 1224568 - DNA, 22 bp, Artificial Sequence
  chemically synthesized
tctttatgtattacatggttac

SEQ ID NO: 1224569 - DNA, 22 bp, Artificial Sequence
  chemically synthesized
ttgaaaagtaaccatgtaatac

SEQ ID NO: 1224570 - DNA, 22 bp, Artificial Sequence
  chemically synthesized
gaaaagtaaccatgtaatacat

SEQ ID NO: 1224571 - DNA, 22 bp, Artificial Sequence
  chemically synthesized
aaaagtaaccatgtaatacata

SEQ ID NO: 1224572 - DNA, 22 bp, Artificial Sequence
  chemically synthesized
gatgaatcatcagtaactctct

SEQ ID NO: 1224573 - DNA, 22 bp, Artificial Sequence
  chemically synthesized
tcatattggatgaatcatcagt

SEQ ID NO: 1224574 - DNA, 22 bp, Artificial Sequence
  chemically synthesized
ctgtcatattggatgaatcatc

SEQ ID NO: 1224575 - DNA, 22 bp, Artificial Sequence
  chemically synthesized
tcctgtcatattggatgaatca

SEQ ID NO: 1224576 - DNA, 22 bp, Artificial Sequence
  chemically synthesized
tctcctgtcatattggatgaat

SEQ ID NO: 1224577 - DNA, 22 bp, Artificial Sequence
  chemically synthesized
ctgatgattcatccaatatgac

SEQ ID NO: 1224578 - DNA, 22 bp, Artificial Sequence
  chemically synthesized
tatactctctcctgtcatattg

SEQ ID NO: 1224579 - DNA, 22 bp, Artificial Sequence
  chemically synthesized
atatactctctcctgtcatatt

SEQ ID NO: 1224580 - DNA, 22 bp, Artificial Sequence
  chemically synthesized
atgattcatccaatatgacagg

SEQ ID NO: 1224581 - DNA, 22 bp, Artificial Sequence
  chemically synthesized
atttatatactctctcctgtca

SEQ ID NO: 1224582 - DNA, 22 bp, Artificial Sequence
  chemically synthesized
atccaatatgacaggagagagt

SEQ ID NO: 1224583 - DNA, 22 bp, Artificial Sequence
  chemically synthesized
tcaaaatatcctcatttatata

SEQ ID NO: 1224584 - DNA, 22 bp, Artificial Sequence
  chemically synthesized
tgtcaaaatatcctcatttata

SEQ ID NO: 1224585 - DNA, 22 bp, Artificial Sequence
  chemically synthesized
tctgtcaaaatatcctcattta

SEQ ID NO: 1224586 - DNA, 22 bp, Artificial Sequence
  chemically synthesized
ctctgtcaaaatatcctcattt

SEQ ID NO: 1224587 - DNA, 22 bp, Artificial Sequence
  chemically synthesized
tctctgtcaaaatatcctcatt

SEQ ID NO: 1224588 - DNA, 22 bp, Artificial Sequence
  chemically synthesized
tttctctgtcaaaatatcctca

SEQ ID NO: 1224589 - DNA, 22 bp, Artificial Sequence
  chemically synthesized
acccactctttctctgtcaaaa

SEQ ID NO: 1224590 - DNA, 22 bp, Artificial Sequence
  chemically synthesized
tccctgacccactctttctctg

SEQ ID NO: 1224591 - DNA, 22 bp, Artificial Sequence
  chemically synthesized
tctgtccctgacccactctttc

SEQ ID NO: 1224592 - DNA, 22 bp, Artificial Sequence
  chemically synthesized
atctgtccctgacccactcttt

SEQ ID NO: 1224593 - DNA, 22 bp, Artificial Sequence
  chemically synthesized
tatctgtccctgacccactctt

SEQ ID NO: 1224594 - DNA, 22 bp, Artificial Sequence
  chemically synthesized
tgacagagaaagagtgggtcag

SEQ ID NO: 1224595 - DNA, 22 bp, Artificial Sequence
  chemically synthesized
ttttatctgtccctgacccact

SEQ ID NO: 1224596 - DNA, 22 bp, Artificial Sequence
  chemically synthesized
gacagagaaagagtgggtcagg

SEQ ID NO: 1224597 - DNA, 22 bp, Artificial Sequence
  chemically synthesized
acagagaaagagtgggtcaggg

SEQ ID NO: 1224598 - DNA, 22 bp, Artificial Sequence
  chemically synthesized
ccctgttttatctgtccctgac

SEQ ID NO: 1224599 - DNA, 22 bp, Artificial Sequence
  chemically synthesized
taggtaatacagtaaacatacc

SEQ ID NO: 1224600 - DNA, 22 bp, Artificial Sequence
  chemically synthesized
gtaggtaatacagtaaacatac

SEQ ID NO: 1224601 - DNA, 22 bp, Artificial Sequence
  chemically synthesized
aatacatttgtaggtaatacag

SEQ ID NO: 1224602 - DNA, 22 bp, Artificial Sequence
  chemically synthesized
gggtatgtttactgtattacct

SEQ ID NO: 1224603 - DNA, 22 bp, Artificial Sequence
  chemically synthesized
ggtatgtttactgtattaccta

SEQ ID NO: 1224604 - DNA, 22 bp, Artificial Sequence
  chemically synthesized
tgaatacatttgtaggtaatac

SEQ ID NO: 1224605 - DNA, 22 bp, Artificial Sequence
  chemically synthesized
ctgaatacatttgtaggtaata

SEQ ID NO: 1224606 - DNA, 22 bp, Artificial Sequence
  chemically synthesized
atgatttctgaatacatttgta

SEQ ID NO: 1224607 - DNA, 22 bp, Artificial Sequence
  chemically synthesized
actgtattacctacaaatgtat

SEQ ID NO: 1224608 - DNA, 22 bp, Artificial Sequence
  chemically synthesized
aatgatttctgaatacatttgt

SEQ ID NO: 1224609 - DNA, 22 bp, Artificial Sequence
  chemically synthesized
ctgtattacctacaaatgtatt

SEQ ID NO: 1224610 - DNA, 22 bp, Artificial Sequence
  chemically synthesized
tttaatgatttctgaatacatt

SEQ ID NO: 1224611 - DNA, 22 bp, Artificial Sequence
  chemically synthesized
tattacctacaaatgtattcag

SEQ ID NO: 1224612 - DNA, 22 bp, Artificial Sequence
  chemically synthesized
tatttaatgatttctgaataca

SEQ ID NO: 1224613 - DNA, 22 bp, Artificial Sequence
  chemically synthesized
cctacaaatgtattcagaaatc

SEQ ID NO: 1224614 - DNA, 22 bp, Artificial Sequence
  chemically synthesized
atattctatttaatgatttctg

SEQ ID NO: 1224615 - DNA, 22 bp, Artificial Sequence
  chemically synthesized
caaatgtattcagaaatcatta

SEQ ID NO: 1224616 - DNA, 22 bp, Artificial Sequence
  chemically synthesized
ttaatattctatttaatgattt

SEQ ID NO: 1224617 - DNA, 22 bp, Artificial Sequence
  chemically synthesized
gttaatattctatttaatgatt

SEQ ID NO: 1224618 - DNA, 22 bp, Artificial Sequence
  chemically synthesized
tatttgttaatattctatttaa

SEQ ID NO: 1224619 - DNA, 22 bp, Artificial Sequence
  chemically synthesized
tatatttgttaatattctattt

SEQ ID NO: 1224620 - DNA, 22 bp, Artificial Sequence
  chemically synthesized
agaaatcattaaatagaatatt

SEQ ID NO: 1224621 - DNA, 22 bp, Artificial Sequence
  chemically synthesized
ccactctatatttgttaatatt

SEQ ID NO: 1224622 - DNA, 22 bp, Artificial Sequence
  chemically synthesized
aatagaatattaacaaatatag

SEQ ID NO: 1224623 - DNA, 22 bp, Artificial Sequence
  chemically synthesized
caagcatgttcccactctatat

SEQ ID NO: 1224624 - DNA, 22 bp, Artificial Sequence
  chemically synthesized
aatcctgcaagcatgttcccac

SEQ ID NO: 1224625 - DNA, 22 bp, Artificial Sequence
  chemically synthesized
acaaatatagagtgggaacatg

SEQ ID NO: 1224626 - DNA, 22 bp, Artificial Sequence
  chemically synthesized
caatcctgcaagcatgttccca

SEQ ID NO: 1224627 - DNA, 22 bp, Artificial Sequence
  chemically synthesized
aagtggaagacttcaatcctgc

SEQ ID NO: 1224628 - DNA, 22 bp, Artificial Sequence
  chemically synthesized
caagtggaagacttcaatcctg

SEQ ID NO: 1224629 - DNA, 22 bp, Artificial Sequence
  chemically synthesized
ccttcaagtggaagacttcaat

SEQ ID NO: 1224630 - DNA, 22 bp, Artificial Sequence
  chemically synthesized
cccttcaagtggaagacttcaa

SEQ ID NO: 1224631 - DNA, 22 bp, Artificial Sequence
  chemically synthesized
tcccttcaagtggaagacttca

SEQ ID NO: 1224632 - DNA, 22 bp, Artificial Sequence
  chemically synthesized
ttcccttcaagtggaagacttc

SEQ ID NO: 1224633 - DNA, 22 bp, Artificial Sequence
  chemically synthesized
gcaggattgaagtcttccactt

SEQ ID NO: 1224634 - DNA, 22 bp, Artificial Sequence
  chemically synthesized
caggattgaagtcttccacttg

SEQ ID NO: 1224635 - DNA, 22 bp, Artificial Sequence
  chemically synthesized
acgtttttcccttcaagtggaa

SEQ ID NO: 1224636 - DNA, 22 bp, Artificial Sequence
  chemically synthesized
taacgtttttcccttcaagtgg

SEQ ID NO: 1224637 - DNA, 22 bp, Artificial Sequence
  chemically synthesized
tctaacgtttttcccttcaagt

SEQ ID NO: 1224638 - DNA, 22 bp, Artificial Sequence
  chemically synthesized
aagtcttccacttgaagggaaa

SEQ ID NO: 1224639 - DNA, 22 bp, Artificial Sequence
  chemically synthesized
gctctctaacgtttttcccttc

SEQ ID NO: 1224640 - DNA, 22 bp, Artificial Sequence
  chemically synthesized
ttggctctctaacgtttttccc

SEQ ID NO: 1224641 - DNA, 22 bp, Artificial Sequence
  chemically synthesized
gttggctctctaacgtttttcc

SEQ ID NO: 1224642 - DNA, 22 bp, Artificial Sequence
  chemically synthesized
ccacttgaagggaaaaacgtta

SEQ ID NO: 1224643 - DNA, 22 bp, Artificial Sequence
  chemically synthesized
cacttgaagggaaaaacgttag

SEQ ID NO: 1224644 - DNA, 22 bp, Artificial Sequence
  chemically synthesized
gaagggaaaaacgttagagagc

SEQ ID NO: 1224645 - DNA, 22 bp, Artificial Sequence
  chemically synthesized
aagggaaaaacgttagagagcc

SEQ ID NO: 1224646 - DNA, 22 bp, Artificial Sequence
  chemically synthesized
tgtggtccttgttggctctcta

SEQ ID NO: 1224647 - DNA, 22 bp, Artificial Sequence
  chemically synthesized
gagagccaacaaggaccacata

SEQ ID NO: 1224648 - DNA, 22 bp, Artificial Sequence
  chemically synthesized
cagatgaataaaaatatcaagg

SEQ ID NO: 1224649 - DNA, 22 bp, Artificial Sequence
  chemically synthesized
gcagatgaataaaaatatcaag

SEQ ID NO: 1224650 - DNA, 22 bp, Artificial Sequence
  chemically synthesized
atccttgatatttttattcatc

SEQ ID NO: 1224651 - DNA, 22 bp, Artificial Sequence
  chemically synthesized
atgtacacatttgcagatgaat

SEQ ID NO: 1224652 - DNA, 22 bp, Artificial Sequence
  chemically synthesized
gatatttttattcatctgcaaa

SEQ ID NO: 1224653 - DNA, 22 bp, Artificial Sequence
  chemically synthesized
ttcatgtacacatttgcagatg

SEQ ID NO: 1224654 - DNA, 22 bp, Artificial Sequence
  chemically synthesized
atatttttattcatctgcaaat

SEQ ID NO: 1224655 - DNA, 22 bp, Artificial Sequence
  chemically synthesized
ctgttcatgtacacatttgcag

SEQ ID NO: 1224656 - DNA, 22 bp, Artificial Sequence
  chemically synthesized
gctgttcatgtacacatttgca

SEQ ID NO: 1224657 - DNA, 22 bp, Artificial Sequence
  chemically synthesized
tgctgttcatgtacacatttgc

SEQ ID NO: 1224658 - DNA, 22 bp, Artificial Sequence
  chemically synthesized
ttattcatctgcaaatgtgtac

SEQ ID NO: 1224659 - DNA, 22 bp, Artificial Sequence
  chemically synthesized
tattcatctgcaaatgtgtaca

SEQ ID NO: 1224660 - DNA, 22 bp, Artificial Sequence
  chemically synthesized
attcatctgcaaatgtgtacat

SEQ ID NO: 1224661 - DNA, 22 bp, Artificial Sequence
  chemically synthesized
attttgctgttcatgtacacat

SEQ ID NO: 1224662 - DNA, 22 bp, Artificial Sequence
  chemically synthesized
ttcatctgcaaatgtgtacatg

SEQ ID NO: 1224663 - DNA, 22 bp, Artificial Sequence
  chemically synthesized
atctgcaaatgtgtacatgaac

SEQ ID NO: 1224664 - DNA, 22 bp, Artificial Sequence
  chemically synthesized
caaatgtgtacatgaacagcaa

SEQ ID NO: 1224665 - DNA, 22 bp, Artificial Sequence
  chemically synthesized
agggcccgaaaatattgatttt

SEQ ID NO: 1224666 - DNA, 22 bp, Artificial Sequence
  chemically synthesized
acactaagggcccgaaaatatt

SEQ ID NO: 1224667 - DNA, 22 bp, Artificial Sequence
  chemically synthesized
aacactaagggcccgaaaatat

SEQ ID NO: 1224668 - DNA, 22 bp, Artificial Sequence
  chemically synthesized
tgcagccacatgcttaacacta

SEQ ID NO: 1224669 - DNA, 22 bp, Artificial Sequence
  chemically synthesized
atgcagccacatgcttaacact

SEQ ID NO: 1224670 - DNA, 22 bp, Artificial Sequence
  chemically synthesized
tcgggcccttagtgttaagcat

SEQ ID NO: 1224671 - DNA, 22 bp, Artificial Sequence
  chemically synthesized
cgggcccttagtgttaagcatg

SEQ ID NO: 1224672 - DNA, 22 bp, Artificial Sequence
  chemically synthesized
gggcccttagtgttaagcatgt

SEQ ID NO: 1224673 - DNA, 22 bp, Artificial Sequence
  chemically synthesized
atttatgcagccacatgcttaa

SEQ ID NO: 1224674 - DNA, 22 bp, Artificial Sequence
  chemically synthesized
agtgttaagcatgtggctgcat

SEQ ID NO: 1224675 - DNA, 22 bp, Artificial Sequence
  chemically synthesized
gtgttaagcatgtggctgcata

SEQ ID NO: 1224676 - DNA, 22 bp, Artificial Sequence
  chemically synthesized
agtcaatgctcatttatgcagc

SEQ ID NO: 1224677 - DNA, 22 bp, Artificial Sequence
  chemically synthesized
aagtcaatgctcatttatgcag

SEQ ID NO: 1224678 - DNA, 22 bp, Artificial Sequence
  chemically synthesized
taagtcaatgctcatttatgca

SEQ ID NO: 1224679 - DNA, 22 bp, Artificial Sequence
  chemically synthesized
agcatgtggctgcataaatgag

SEQ ID NO: 1224680 - DNA, 22 bp, Artificial Sequence
  chemically synthesized
tgttttaagtcaatgctcattt

SEQ ID NO: 1224681 - DNA, 22 bp, Artificial Sequence
  chemically synthesized
tctgtgttttaagtcaatgctc

SEQ ID NO: 1224682 - DNA, 22 bp, Artificial Sequence
  chemically synthesized
tgtctgtgttttaagtcaatgc

SEQ ID NO: 1224683 - DNA, 22 bp, Artificial Sequence
  chemically synthesized
cataaatgagcattgacttaaa

SEQ ID NO: 1224684 - DNA, 22 bp, Artificial Sequence
  chemically synthesized
acttaaaacacagacagaatgt

SEQ ID NO: 1224685 - DNA, 22 bp, Artificial Sequence
  chemically synthesized
aaaacacagacagaatgtctct

SEQ ID NO: 1224686 - DNA, 22 bp, Artificial Sequence
  chemically synthesized
aaacacagacagaatgtctcta

SEQ ID NO: 1224687 - DNA, 22 bp, Artificial Sequence
  chemically synthesized
gatgagaagggatagagacatt

SEQ ID NO: 1224688 - DNA, 22 bp, Artificial Sequence
  chemically synthesized
aatacagttagatgagaaggga

SEQ ID NO: 1224689 - DNA, 22 bp, Artificial Sequence
  chemically synthesized
cacagcctcaatacagttagat

SEQ ID NO: 1224690 - DNA, 22 bp, Artificial Sequence
  chemically synthesized
tatcccttctcatctaactgta

SEQ ID NO: 1224691 - DNA, 22 bp, Artificial Sequence
  chemically synthesized
ccacagcctcaatacagttaga

SEQ ID NO: 1224692 - DNA, 22 bp, Artificial Sequence
  chemically synthesized
tcccttctcatctaactgtatt

SEQ ID NO: 1224693 - DNA, 22 bp, Artificial Sequence
  chemically synthesized
ctcatctaactgtattgaggct

SEQ ID NO: 1224694 - DNA, 22 bp, Artificial Sequence
  chemically synthesized
tcatctaactgtattgaggctg

SEQ ID NO: 1224695 - DNA, 22 bp, Artificial Sequence
  chemically synthesized
atctaactgtattgaggctgtg

SEQ ID NO: 1224696 - DNA, 22 bp, Artificial Sequence
  chemically synthesized
actgtattgaggctgtggaaac

SEQ ID NO: 1224697 - DNA, 22 bp, Artificial Sequence
  chemically synthesized
tattgaggctgtggaaacattt

SEQ ID NO: 1224698 - DNA, 22 bp, Artificial Sequence
  chemically synthesized
gtatgacagaagaaaatgtttc

SEQ ID NO: 1224699 - DNA, 22 bp, Artificial Sequence
  chemically synthesized
tcgtatgacagaagaaaatgtt

SEQ ID NO: 1224700 - DNA, 22 bp, Artificial Sequence
  chemically synthesized
ctcgtatgacagaagaaaatgt

SEQ ID NO: 1224701 - DNA, 22 bp, Artificial Sequence
  chemically synthesized
aggctgtggaaacattttcttc

SEQ ID NO: 1224702 - DNA, 22 bp, Artificial Sequence
  chemically synthesized
tttctcgtatgacagaagaaaa

SEQ ID NO: 1224703 - DNA, 22 bp, Artificial Sequence
  chemically synthesized
tggaaacattttcttctgtcat

SEQ ID NO: 1224704 - DNA, 22 bp, Artificial Sequence
  chemically synthesized
acacattgtttctcgtatgaca

SEQ ID NO: 1224705 - DNA, 22 bp, Artificial Sequence
  chemically synthesized
tcttctgtcatacgagaaacaa

SEQ ID NO: 1224706 - DNA, 22 bp, Artificial Sequence
  chemically synthesized
cttctgtcatacgagaaacaat

SEQ ID NO: 1224707 - DNA, 22 bp, Artificial Sequence
  chemically synthesized
ttctgtcatacgagaaacaatg

SEQ ID NO: 1224708 - DNA, 22 bp, Artificial Sequence
  chemically synthesized
agcagcgttaacacattgtttc

SEQ ID NO: 1224709 - DNA, 22 bp, Artificial Sequence
  chemically synthesized
ctgtcatacgagaaacaatgtg

SEQ ID NO: 1224710 - DNA, 22 bp, Artificial Sequence
  chemically synthesized
tgtcatacgagaaacaatgtgt

SEQ ID NO: 1224711 - DNA, 22 bp, Artificial Sequence
  chemically synthesized
tcatacgagaaacaatgtgtta

SEQ ID NO: 1224712 - DNA, 22 bp, Artificial Sequence
  chemically synthesized
aaatgtcacgttaagcagcgtt

SEQ ID NO: 1224713 - DNA, 22 bp, Artificial Sequence
  chemically synthesized
acgctgcttaacgtgacatttg

SEQ ID NO: 1224714 - DNA, 22 bp, Artificial Sequence
  chemically synthesized
cttaacgtgacatttgaatgca

SEQ ID NO: 1224715 - DNA, 22 bp, Artificial Sequence
  chemically synthesized
aacgtgacatttgaatgcatgt

SEQ ID NO: 1224716 - DNA, 22 bp, Artificial Sequence
  chemically synthesized
gaacagaggcagacatgcattc

SEQ ID NO: 1224717 - DNA, 22 bp, Artificial Sequence
  chemically synthesized
acgtgacatttgaatgcatgtc

SEQ ID NO: 1224718 - DNA, 22 bp, Artificial Sequence
  chemically synthesized
agaacagaggcagacatgcatt

SEQ ID NO: 1224719 - DNA, 22 bp, Artificial Sequence
  chemically synthesized
atttagaacagaggcagacatg

SEQ ID NO: 1224720 - DNA, 22 bp, Artificial Sequence
  chemically synthesized
gaatgcatgtctgcctctgttc

SEQ ID NO: 1224721 - DNA, 22 bp, Artificial Sequence
  chemically synthesized
aatgcatgtctgcctctgttct

SEQ ID NO: 1224722 - DNA, 22 bp, Artificial Sequence
  chemically synthesized
agcaacctgatttagaacagag

SEQ ID NO: 1224723 - DNA, 22 bp, Artificial Sequence
  chemically synthesized
ctcagcaacctgatttagaaca

SEQ ID NO: 1224724 - DNA, 22 bp, Artificial Sequence
  chemically synthesized
cctctgttctaaatcaggttgc

SEQ ID NO: 1224725 - DNA, 22 bp, Artificial Sequence
  chemically synthesized
caggtgaattactcagcaacct

SEQ ID NO: 1224726 - DNA, 22 bp, Artificial Sequence
  chemically synthesized
tgttctaaatcaggttgctgag

SEQ ID NO: 1224727 - DNA, 22 bp, Artificial Sequence
  chemically synthesized
ccaggtgaattactcagcaacc

SEQ ID NO: 1224728 - DNA, 22 bp, Artificial Sequence
  chemically synthesized
ttctaaatcaggttgctgagta

SEQ ID NO: 1224729 - DNA, 22 bp, Artificial Sequence
  chemically synthesized
taaatcaggttgctgagtaatt

SEQ ID NO: 1224730 - DNA, 22 bp, Artificial Sequence
  chemically synthesized
ggtttccaggtgaattactcag

SEQ ID NO: 1224731 - DNA, 22 bp, Artificial Sequence
  chemically synthesized
aatcaggttgctgagtaattca

SEQ ID NO: 1224732 - DNA, 22 bp, Artificial Sequence
  chemically synthesized
ctgagtaattcacctggaaacc

SEQ ID NO: 1224733 - DNA, 22 bp, Artificial Sequence
  chemically synthesized
agtaattcacctggaaacccag

SEQ ID NO: 1224734 - DNA, 22 bp, Artificial Sequence
  chemically synthesized
accccatcccgactgggtttcc

SEQ ID NO: 1224735 - DNA, 22 bp, Artificial Sequence
  chemically synthesized
attaaccccatcccgactgggt

SEQ ID NO: 1224736 - DNA, 22 bp, Artificial Sequence
  chemically synthesized
aattaaccccatcccgactggg

SEQ ID NO: 1224737 - DNA, 22 bp, Artificial Sequence
  chemically synthesized
acctggaaacccagtcgggatg

SEQ ID NO: 1224738 - DNA, 22 bp, Artificial Sequence
  chemically synthesized
gatttaattaaccccatcccga

SEQ ID NO: 1224739 - DNA, 22 bp, Artificial Sequence
  chemically synthesized
gaaacccagtcgggatggggtt

SEQ ID NO: 1224740 - DNA, 22 bp, Artificial Sequence
  chemically synthesized
cagctggatttaattaacccca

SEQ ID NO: 1224741 - DNA, 22 bp, Artificial Sequence
  chemically synthesized
ctccagctggatttaattaacc

SEQ ID NO: 1224742 - DNA, 22 bp, Artificial Sequence
  chemically synthesized
gctccagctggatttaattaac

SEQ ID NO: 1224743 - DNA, 22 bp, Artificial Sequence
  chemically synthesized
tcaggtgtcttgctccagctgg

SEQ ID NO: 1224744 - DNA, 22 bp, Artificial Sequence
  chemically synthesized
gtcaggtgtcttgctccagctg

SEQ ID NO: 1224745 - DNA, 22 bp, Artificial Sequence
  chemically synthesized
tgtcaggtgtcttgctccagct

SEQ ID NO: 1224746 - DNA, 22 bp, Artificial Sequence
  chemically synthesized
attaaatccagctggagcaaga

SEQ ID NO: 1224747 - DNA, 22 bp, Artificial Sequence
  chemically synthesized
aatccagctggagcaagacacc

SEQ ID NO: 1224748 - DNA, 22 bp, Artificial Sequence
  chemically synthesized
aaataagcatctttgtcaggtg

SEQ ID NO: 1224749 - DNA, 22 bp, Artificial Sequence
  chemically synthesized
caaataagcatctttgtcaggt

SEQ ID NO: 1224750 - DNA, 22 bp, Artificial Sequence
  chemically synthesized
gagcaagacacctgacaaagat

SEQ ID NO: 1224751 - DNA, 22 bp, Artificial Sequence
  chemically synthesized
acaaagatgcttatttgaaatg

SEQ ID NO: 1224752 - DNA, 22 bp, Artificial Sequence
  chemically synthesized
agtccaagagcaaacacatttc

SEQ ID NO: 1224753 - DNA, 22 bp, Artificial Sequence
  chemically synthesized
atttgaaatgtgtttgctcttg

SEQ ID NO: 1224754 - DNA, 22 bp, Artificial Sequence
  chemically synthesized
tttgaaatgtgtttgctcttgg

SEQ ID NO: 1224755 - DNA, 22 bp, Artificial Sequence
  chemically synthesized
aggtaaagctcagtccaagagc

SEQ ID NO: 1224756 - DNA, 22 bp, Artificial Sequence
  chemically synthesized
gaaatgtgtttgctcttggact

SEQ ID NO: 1224757 - DNA, 22 bp, Artificial Sequence
  chemically synthesized
aaatgtgtttgctcttggactg

SEQ ID NO: 1224758 - DNA, 22 bp, Artificial Sequence
  chemically synthesized
taaggtaaagctcagtccaaga

SEQ ID NO: 1224759 - DNA, 22 bp, Artificial Sequence
  chemically synthesized
tctaaggtaaagctcagtccaa

SEQ ID NO: 1224760 - DNA, 22 bp, Artificial Sequence
  chemically synthesized
ctctaaggtaaagctcagtcca

SEQ ID NO: 1224761 - DNA, 22 bp, Artificial Sequence
  chemically synthesized
tctctaaggtaaagctcagtcc

SEQ ID NO: 1224762 - DNA, 22 bp, Artificial Sequence
  chemically synthesized
attttctctaaggtaaagctca

SEQ ID NO: 1224763 - DNA, 22 bp, Artificial Sequence
  chemically synthesized
gctcttggactgagctttacct

SEQ ID NO: 1224764 - DNA, 22 bp, Artificial Sequence
  chemically synthesized
ctcttggactgagctttacctt

SEQ ID NO: 1224765 - DNA, 22 bp, Artificial Sequence
  chemically synthesized
ttggactgagctttaccttaga

SEQ ID NO: 1224766 - DNA, 22 bp, Artificial Sequence
  chemically synthesized
ggactgagctttaccttagaga

SEQ ID NO: 1224767 - DNA, 22 bp, Artificial Sequence
  chemically synthesized
gactgagctttaccttagagaa

SEQ ID NO: 1224768 - DNA, 22 bp, Artificial Sequence
  chemically synthesized
agaatattaattttctctaagg

SEQ ID NO: 1224769 - DNA, 22 bp, Artificial Sequence
  chemically synthesized
agctttaccttagagaaaatta

SEQ ID NO: 1224770 - DNA, 22 bp, Artificial Sequence
  chemically synthesized
gaaaagctaagaatattaattt

SEQ ID NO: 1224771 - DNA, 22 bp, Artificial Sequence
  chemically synthesized
taccttagagaaaattaatatt

SEQ ID NO: 1224772 - DNA, 22 bp, Artificial Sequence
  chemically synthesized
accttagagaaaattaatattc

SEQ ID NO: 1224773 - DNA, 22 bp, Artificial Sequence
  chemically synthesized
tagaaaagctaagaatattaat

SEQ ID NO: 1224774 - DNA, 22 bp, Artificial Sequence
  chemically synthesized
ccttagagaaaattaatattct

SEQ ID NO: 1224775 - DNA, 22 bp, Artificial Sequence
  chemically synthesized
ctagaaaagctaagaatattaa

SEQ ID NO: 1224776 - DNA, 22 bp, Artificial Sequence
  chemically synthesized
cttctagaaaagctaagaatat

SEQ ID NO: 1224777 - DNA, 22 bp, Artificial Sequence
  chemically synthesized
agagaaaattaatattcttagc

SEQ ID NO: 1224778 - DNA, 22 bp, Artificial Sequence
  chemically synthesized
gagaaaattaatattcttagct

SEQ ID NO: 1224779 - DNA, 22 bp, Artificial Sequence
  chemically synthesized
tgccaatcctgcttctagaaaa

SEQ ID NO: 1224780 - DNA, 22 bp, Artificial Sequence
  chemically synthesized
atattcttagcttttctagaag

SEQ ID NO: 1224781 - DNA, 22 bp, Artificial Sequence
  chemically synthesized
ctatgccaatcctgcttctaga

SEQ ID NO: 1224782 - DNA, 22 bp, Artificial Sequence
  chemically synthesized
cctatgccaatcctgcttctag

SEQ ID NO: 1224783 - DNA, 22 bp, Artificial Sequence
  chemically synthesized
tcctatgccaatcctgcttcta

SEQ ID NO: 1224784 - DNA, 22 bp, Artificial Sequence
  chemically synthesized
ttagcttttctagaagcaggat

SEQ ID NO: 1224785 - DNA, 22 bp, Artificial Sequence
  chemically synthesized
agcttttctagaagcaggattg

SEQ ID NO: 1224786 - DNA, 22 bp, Artificial Sequence
  chemically synthesized
gcttttctagaagcaggattgg

SEQ ID NO: 1224787 - DNA, 22 bp, Artificial Sequence
  chemically synthesized
ccattttcctatgccaatcctg

SEQ ID NO: 1224788 - DNA, 22 bp, Artificial Sequence
  chemically synthesized
taccattttcctatgccaatcc

SEQ ID NO: 1224789 - DNA, 22 bp, Artificial Sequence
  chemically synthesized
ttctagaagcaggattggcata

SEQ ID NO: 1224790 - DNA, 22 bp, Artificial Sequence
  chemically synthesized
tctagaagcaggattggcatag

SEQ ID NO: 1224791 - DNA, 22 bp, Artificial Sequence
  chemically synthesized
ctagaagcaggattggcatagg

SEQ ID NO: 1224792 - DNA, 22 bp, Artificial Sequence
  chemically synthesized
tagaagcaggattggcatagga

SEQ ID NO: 1224793 - DNA, 22 bp, Artificial Sequence
  chemically synthesized
gaagcaggattggcataggaaa

SEQ ID NO: 1224794 - DNA, 22 bp, Artificial Sequence
  chemically synthesized
accactctaccattttcctatg

SEQ ID NO: 1224795 - DNA, 22 bp, Artificial Sequence
  chemically synthesized
gaccactctaccattttcctat

SEQ ID NO: 1224796 - DNA, 22 bp, Artificial Sequence
  chemically synthesized
tgaccactctaccattttccta

SEQ ID NO: 1224797 - DNA, 22 bp, Artificial Sequence
  chemically synthesized
ttgaccactctaccattttcct

SEQ ID NO: 1224798 - DNA, 22 bp, Artificial Sequence
  chemically synthesized
tttgaccactctaccattttcc

SEQ ID NO: 1224799 - DNA, 22 bp, Artificial Sequence
  chemically synthesized
ttttgaccactctaccattttc

SEQ ID NO: 1224800 - DNA, 22 bp, Artificial Sequence
  chemically synthesized
tttttgaccactctaccatttt

SEQ ID NO: 1224801 - DNA, 22 bp, Artificial Sequence
  chemically synthesized
ttttttgaccactctaccattt

SEQ ID NO: 1224802 - DNA, 22 bp, Artificial Sequence
  chemically synthesized
tttttttgaccactctaccatt

SEQ ID NO: 1224803 - DNA, 22 bp, Artificial Sequence
  chemically synthesized
ttttttttgaccactctaccat

SEQ ID NO: 1224804 - DNA, 22 bp, Artificial Sequence
  chemically synthesized
tttttttttgaccactctacca

SEQ ID NO: 1224805 - DNA, 22 bp, Artificial Sequence
  chemically synthesized
gcataggaaaatggtagagtgg

SEQ ID NO: 1224806 - DNA, 22 bp, Artificial Sequence
  chemically synthesized
ttttttttttgaccactctacc

SEQ ID NO: 1224807 - DNA, 22 bp, Artificial Sequence
  chemically synthesized
tttttttttttgaccactctac

SEQ ID NO: 1224808 - DNA, 22 bp, Artificial Sequence
  chemically synthesized
ttttttttttttgaccactcta

SEQ ID NO: 1224809 - DNA, 22 bp, Artificial Sequence
  chemically synthesized
atttttttttttttttgaccac

SEQ ID NO: 1224810 - DNA, 22 bp, Artificial Sequence
  chemically synthesized
gatttttttttttttttgacca

SEQ ID NO: 1224811 - DNA, 22 bp, Artificial Sequence
  chemically synthesized
tgatttttttttttttttgacc

SEQ ID NO: 1224812 - DNA, 22 bp, Artificial Sequence
  chemically synthesized
actttgattttttttttttttt

SEQ ID NO: 1224813 - DNA, 22 bp, Artificial Sequence
  chemically synthesized
tcactttgattttttttttttt

SEQ ID NO: 1224814 - DNA, 22 bp, Artificial Sequence
  chemically synthesized
ctcactttgatttttttttttt

SEQ ID NO: 1224815 - DNA, 22 bp, Artificial Sequence
  chemically synthesized
tctcactttgattttttttttt

SEQ ID NO: 1224816 - DNA, 22 bp, Artificial Sequence
  chemically synthesized
tgttttctcactttgatttttt

SEQ ID NO: 1224817 - DNA, 22 bp, Artificial Sequence
  chemically synthesized
agtgcaagttatgttttctcac

SEQ ID NO: 1224818 - DNA, 22 bp, Artificial Sequence
  chemically synthesized
cagtgcaagttatgttttctca

SEQ ID NO: 1224819 - DNA, 22 bp, Artificial Sequence
  chemically synthesized
tcagtgcaagttatgttttctc

SEQ ID NO: 1224820 - DNA, 22 bp, Artificial Sequence
  chemically synthesized
attttcagtgcaagttatgttt

SEQ ID NO: 1224821 - DNA, 22 bp, Artificial Sequence
  chemically synthesized
cctaattttcagtgcaagttat

SEQ ID NO: 1224822 - DNA, 22 bp, Artificial Sequence
  chemically synthesized
gcctaattttcagtgcaagtta

SEQ ID NO: 1224823 - DNA, 22 bp, Artificial Sequence
  chemically synthesized
catcttgcctaattttcagtgc

SEQ ID NO: 1224824 - DNA, 22 bp, Artificial Sequence
  chemically synthesized
gactgcatcttgcctaattttc

SEQ ID NO: 1224825 - DNA, 22 bp, Artificial Sequence
  chemically synthesized
gcactgaaaattaggcaagatg

SEQ ID NO: 1224826 - DNA, 22 bp, Artificial Sequence
  chemically synthesized
cactgaaaattaggcaagatgc

SEQ ID NO: 1224827 - DNA, 22 bp, Artificial Sequence
  chemically synthesized
aaatgtcactggactgcatctt

SEQ ID NO: 1224828 - DNA, 22 bp, Artificial Sequence
  chemically synthesized
aaaatgtcactggactgcatct

SEQ ID NO: 1224829 - DNA, 22 bp, Artificial Sequence
  chemically synthesized
aaaattaggcaagatgcagtcc

SEQ ID NO: 1224830 - DNA, 22 bp, Artificial Sequence
  chemically synthesized
tttaaaatgtcactggactgca

SEQ ID NO: 1224831 - DNA, 22 bp, Artificial Sequence
  chemically synthesized
actgtttaaaatgtcactggac

SEQ ID NO: 1224832 - DNA, 22 bp, Artificial Sequence
  chemically synthesized
ggcaagatgcagtccagtgaca

SEQ ID NO: 1224833 - DNA, 22 bp, Artificial Sequence
  chemically synthesized
attaactgtttaaaatgtcact

SEQ ID NO: 1224834 - DNA, 22 bp, Artificial Sequence
  chemically synthesized
cctaattaactgtttaaaatgt

SEQ ID NO: 1224835 - DNA, 22 bp, Artificial Sequence
  chemically synthesized
aatgcattgcctaattaactgt

SEQ ID NO: 1224836 - DNA, 22 bp, Artificial Sequence
  chemically synthesized
taaacagttaattaggcaatgc

SEQ ID NO: 1224837 - DNA, 22 bp, Artificial Sequence
  chemically synthesized
aaacagttaattaggcaatgca

SEQ ID NO: 1224838 - DNA, 22 bp, Artificial Sequence
  chemically synthesized
aacagttaattaggcaatgcat

SEQ ID NO: 1224839 - DNA, 22 bp, Artificial Sequence
  chemically synthesized
cccaacccagggctaaatgcat

SEQ ID NO: 1224840 - DNA, 22 bp, Artificial Sequence
  chemically synthesized
acccaacccagggctaaatgca

SEQ ID NO: 1224841 - DNA, 22 bp, Artificial Sequence
  chemically synthesized
attaggcaatgcatttagccct

SEQ ID NO: 1224842 - DNA, 22 bp, Artificial Sequence
  chemically synthesized
atttacccaacccagggctaaa

SEQ ID NO: 1224843 - DNA, 22 bp, Artificial Sequence
  chemically synthesized
catttacccaacccagggctaa

SEQ ID NO: 1224844 - DNA, 22 bp, Artificial Sequence
  chemically synthesized
ggcaatgcatttagccctgggt

SEQ ID NO: 1224845 - DNA, 22 bp, Artificial Sequence
  chemically synthesized
cccgtttcatttacccaaccca

SEQ ID NO: 1224846 - DNA, 22 bp, Artificial Sequence
  chemically synthesized
ttacccgtttcatttacccaac

SEQ ID NO: 1224847 - DNA, 22 bp, Artificial Sequence
  chemically synthesized
ctgttacccgtttcatttaccc

SEQ ID NO: 1224848 - DNA, 22 bp, Artificial Sequence
  chemically synthesized
agccctgggttgggtaaatgaa

SEQ ID NO: 1224849 - DNA, 22 bp, Artificial Sequence
  chemically synthesized
cctgttacccgtttcatttacc

SEQ ID NO: 1224850 - DNA, 22 bp, Artificial Sequence
  chemically synthesized
gccctgggttgggtaaatgaaa

SEQ ID NO: 1224851 - DNA, 22 bp, Artificial Sequence
  chemically synthesized
gtcttcctgttacccgtttcat

SEQ ID NO: 1224852 - DNA, 22 bp, Artificial Sequence
  chemically synthesized
ggtcttcctgttacccgtttca

SEQ ID NO: 1224853 - DNA, 22 bp, Artificial Sequence
  chemically synthesized
ggttgggtaaatgaaacgggta

SEQ ID NO: 1224854 - DNA, 22 bp, Artificial Sequence
  chemically synthesized
tggtcttcctgttacccgtttc

SEQ ID NO: 1224855 - DNA, 22 bp, Artificial Sequence
  chemically synthesized
ttttggtcttcctgttacccgt

SEQ ID NO: 1224856 - DNA, 22 bp, Artificial Sequence
  chemically synthesized
attttggtcttcctgttacccg

SEQ ID NO: 1224857 - DNA, 22 bp, Artificial Sequence
  chemically synthesized
ggtaaatgaaacgggtaacagg

SEQ ID NO: 1224858 - DNA, 22 bp, Artificial Sequence
  chemically synthesized
tattttggtcttcctgttaccc

SEQ ID NO: 1224859 - DNA, 22 bp, Artificial Sequence
  chemically synthesized
cagtcactttattttggtcttc

SEQ ID NO: 1224860 - DNA, 22 bp, Artificial Sequence
  chemically synthesized
agagagagggactacagtcact

SEQ ID NO: 1224861 - DNA, 22 bp, Artificial Sequence
  chemically synthesized
gagagagagggactacagtcac

SEQ ID NO: 1224862 - DNA, 22 bp, Artificial Sequence
  chemically synthesized
tgtgtgtgtatttgagagagag

SEQ ID NO: 1224863 - DNA, 22 bp, Artificial Sequence
  chemically synthesized
gtgtgtgtgtatttgagagaga

SEQ ID NO: 1224864 - DNA, 22 bp, Artificial Sequence
  chemically synthesized
tagtccctctctctcaaataca

SEQ ID NO: 1224865 - DNA, 22 bp, Artificial Sequence
  chemically synthesized
tctctcaaatacacacacacaa

SEQ ID NO: 1224866 - DNA, 22 bp, Artificial Sequence
  chemically synthesized
tctcaaatacacacacacaagc

SEQ ID NO: 1224867 - DNA, 22 bp, Artificial Sequence
  chemically synthesized
tcaaatacacacacacaagcat

SEQ ID NO: 1224868 - DNA, 22 bp, Artificial Sequence
  chemically synthesized
aaatacacacacacaagcatat

SEQ ID NO: 1224869 - DNA, 22 bp, Artificial Sequence
  chemically synthesized
tatatgtatatatatgtgtgtg

SEQ ID NO: 1224870 - DNA, 22 bp, Artificial Sequence
  chemically synthesized
tatatatgtatatatatgtgtg

SEQ ID NO: 1224871 - DNA, 22 bp, Artificial Sequence
  chemically synthesized
tactctatatatgtatatatat

SEQ ID NO: 1224872 - DNA, 22 bp, Artificial Sequence
  chemically synthesized
atactctatatatgtatatata

SEQ ID NO: 1224873 - DNA, 22 bp, Artificial Sequence
  chemically synthesized
caccatttatactctatatatg

SEQ ID NO: 1224874 - DNA, 22 bp, Artificial Sequence
  chemically synthesized
tatgccatatatactacaccat

SEQ ID NO: 1224875 - DNA, 22 bp, Artificial Sequence
  chemically synthesized
gagatacaatatatactatatg

SEQ ID NO: 1224876 - DNA, 22 bp, Artificial Sequence
  chemically synthesized
agagatacaatatatactatat

SEQ ID NO: 1224877 - DNA, 22 bp, Artificial Sequence
  chemically synthesized
tatctctaagtgtatgtgtaca

SEQ ID NO: 1224878 - DNA, 22 bp, Artificial Sequence
  chemically synthesized
taagtgtatgtgtacatataca

SEQ ID NO: 1224879 - DNA, 22 bp, Artificial Sequence
  chemically synthesized
agtgtatgtgtacatatacata

SEQ ID NO: 1224880 - DNA, 22 bp, Artificial Sequence
  chemically synthesized
aagaaaaagcaaagcagtgtag

SEQ ID NO: 1224881 - DNA, 22 bp, Artificial Sequence
  chemically synthesized
ataacagttcaagaaaaagcaa

SEQ ID NO: 1224882 - DNA, 22 bp, Artificial Sequence
  chemically synthesized
cctacactgctttgctttttct

SEQ ID NO: 1224883 - DNA, 22 bp, Artificial Sequence
  chemically synthesized
ctacactgctttgctttttctt

SEQ ID NO: 1224884 - DNA, 22 bp, Artificial Sequence
  chemically synthesized
cactgctttgctttttcttgaa

SEQ ID NO: 1224885 - DNA, 22 bp, Artificial Sequence
  chemically synthesized
ctttgctttttcttgaactgtt

SEQ ID NO: 1224886 - DNA, 22 bp, Artificial Sequence
  chemically synthesized
tgctttttcttgaactgttatt

SEQ ID NO: 1224887 - DNA, 22 bp, Artificial Sequence
  chemically synthesized
agtaaatgaattaataacagtt

SEQ ID NO: 1224888 - DNA, 22 bp, Artificial Sequence
  chemically synthesized
gctttttcttgaactgttatta

SEQ ID NO: 1224889 - DNA, 22 bp, Artificial Sequence
  chemically synthesized
ctttttcttgaactgttattaa

SEQ ID NO: 1224890 - DNA, 22 bp, Artificial Sequence
  chemically synthesized
tttcttgaactgttattaattc

SEQ ID NO: 1224891 - DNA, 22 bp, Artificial Sequence
  chemically synthesized
ttcttgaactgttattaattca

SEQ ID NO: 1224892 - DNA, 22 bp, Artificial Sequence
  chemically synthesized
tcttgaactgttattaattcat

SEQ ID NO: 1224893 - DNA, 22 bp, Artificial Sequence
  chemically synthesized
cttgaactgttattaattcatt

SEQ ID NO: 1224894 - DNA, 22 bp, Artificial Sequence
  chemically synthesized
ttgaactgttattaattcattt

SEQ ID NO: 1224895 - DNA, 22 bp, Artificial Sequence
  chemically synthesized
tgtaaagttcagtaaatgaatt

SEQ ID NO: 1224896 - DNA, 22 bp, Artificial Sequence
  chemically synthesized
gaactgttattaattcatttac

SEQ ID NO: 1224897 - DNA, 22 bp, Artificial Sequence
  chemically synthesized
gtgtaaagttcagtaaatgaat

SEQ ID NO: 1224898 - DNA, 22 bp, Artificial Sequence
  chemically synthesized
aactgttattaattcatttact

SEQ ID NO: 1224899 - DNA, 22 bp, Artificial Sequence
  chemically synthesized
ttgtgtaaagttcagtaaatga

SEQ ID NO: 1224900 - DNA, 22 bp, Artificial Sequence
  chemically synthesized
cttgtgtaaagttcagtaaatg

SEQ ID NO: 1224901 - DNA, 22 bp, Artificial Sequence
  chemically synthesized
tcttgtgtaaagttcagtaaat

SEQ ID NO: 1224902 - DNA, 22 bp, Artificial Sequence
  chemically synthesized
ttcttgtgtaaagttcagtaaa

SEQ ID NO: 1224903 - DNA, 22 bp, Artificial Sequence
  chemically synthesized
ttattaattcatttactgaact

SEQ ID NO: 1224904 - DNA, 22 bp, Artificial Sequence
  chemically synthesized
cttttcttgtgtaaagttcagt

SEQ ID NO: 1224905 - DNA, 22 bp, Artificial Sequence
  chemically synthesized
ttaattcatttactgaacttta

SEQ ID NO: 1224906 - DNA, 22 bp, Artificial Sequence
  chemically synthesized
gcttttcttgtgtaaagttcag

SEQ ID NO: 1224907 - DNA, 22 bp, Artificial Sequence
  chemically synthesized
tgcttttcttgtgtaaagttca

SEQ ID NO: 1224908 - DNA, 22 bp, Artificial Sequence
  chemically synthesized
ttgcttttcttgtgtaaagttc

SEQ ID NO: 1224909 - DNA, 22 bp, Artificial Sequence
  chemically synthesized
attcatttactgaactttacac

SEQ ID NO: 1224910 - DNA, 22 bp, Artificial Sequence
  chemically synthesized
tttgcttttcttgtgtaaagtt

SEQ ID NO: 1224911 - DNA, 22 bp, Artificial Sequence
  chemically synthesized
ttttgcttttcttgtgtaaagt

SEQ ID NO: 1224912 - DNA, 22 bp, Artificial Sequence
  chemically synthesized
tttttgcttttcttgtgtaaag

SEQ ID NO: 1224913 - DNA, 22 bp, Artificial Sequence
  chemically synthesized
atttactgaactttacacaaga

SEQ ID NO: 1224914 - DNA, 22 bp, Artificial Sequence
  chemically synthesized
actgaactttacacaagaaaag

SEQ ID NO: 1224915 - DNA, 22 bp, Artificial Sequence
  chemically synthesized
ctgaactttacacaagaaaagc

SEQ ID NO: 1224916 - DNA, 22 bp, Artificial Sequence
  chemically synthesized
aactttacacaagaaaagcaaa

SEQ ID NO: 1224917 - DNA, 22 bp, Artificial Sequence
  chemically synthesized
tacacaagaaaagcaaaaaaaa

SEQ ID NO: 1224918 - DNA, 22 bp, Artificial Sequence
  chemically synthesized
agatgaaaaagattttttttgc

SEQ ID NO: 1224919 - DNA, 22 bp, Artificial Sequence
  chemically synthesized
acacaagaaaagcaaaaaaaat

SEQ ID NO: 1224920 - DNA, 22 bp, Artificial Sequence
  chemically synthesized
aagatgaaaaagattttttttg

SEQ ID NO: 1224921 - DNA, 22 bp, Artificial Sequence
  chemically synthesized
cacaagaaaagcaaaaaaaatc

SEQ ID NO: 1224922 - DNA, 22 bp, Artificial Sequence
  chemically synthesized
ttaagatgaaaaagattttttt

SEQ ID NO: 1224923 - DNA, 22 bp, Artificial Sequence
  chemically synthesized
cttaagatgaaaaagatttttt

SEQ ID NO: 1224924 - DNA, 22 bp, Artificial Sequence
  chemically synthesized
tatttcttaagatgaaaaagat

SEQ ID NO: 1224925 - DNA, 22 bp, Artificial Sequence
  chemically synthesized
aacattatatttcttaagatga

SEQ ID NO: 1224926 - DNA, 22 bp, Artificial Sequence
  chemically synthesized
cattcaacattatatttcttaa

SEQ ID NO: 1224927 - DNA, 22 bp, Artificial Sequence
  chemically synthesized
tttcatcttaagaaatataatg

SEQ ID NO: 1224928 - DNA, 22 bp, Artificial Sequence
  chemically synthesized
tattccattcaacattatattt

SEQ ID NO: 1224929 - DNA, 22 bp, Artificial Sequence
  chemically synthesized
ttcatcttaagaaatataatgt

SEQ ID NO: 1224930 - DNA, 22 bp, Artificial Sequence
  chemically synthesized
tcatcttaagaaatataatgtt

SEQ ID NO: 1224931 - DNA, 22 bp, Artificial Sequence
  chemically synthesized
catcttaagaaatataatgttg

SEQ ID NO: 1224932 - DNA, 22 bp, Artificial Sequence
  chemically synthesized
atcttaagaaatataatgttga

SEQ ID NO: 1224933 - DNA, 22 bp, Artificial Sequence
  chemically synthesized
actatattccattcaacattat

SEQ ID NO: 1224934 - DNA, 22 bp, Artificial Sequence
  chemically synthesized
aactatattccattcaacatta

SEQ ID NO: 1224935 - DNA, 22 bp, Artificial Sequence
  chemically synthesized
aagaaatataatgttgaatgga

SEQ ID NO: 1224936 - DNA, 22 bp, Artificial Sequence
  chemically synthesized
agaaatataatgttgaatggaa

SEQ ID NO: 1224937 - DNA, 22 bp, Artificial Sequence
  chemically synthesized
aatggaatatagttaaggactt

SEQ ID NO: 1224938 - DNA, 22 bp, Artificial Sequence
  chemically synthesized
taatacagtgaaccaaagtcct

SEQ ID NO: 1224939 - DNA, 22 bp, Artificial Sequence
  chemically synthesized
actgtaatacagtgaaccaaag

SEQ ID NO: 1224940 - DNA, 22 bp, Artificial Sequence
  chemically synthesized
aggactttggttcactgtatta

SEQ ID NO: 1224941 - DNA, 22 bp, Artificial Sequence
  chemically synthesized
ataaaaagaattcactgtaata

SEQ ID NO: 1224942 - DNA, 22 bp, Artificial Sequence
  chemically synthesized
aataaaaagaattcactgtaat

SEQ ID NO: 1224943 - DNA, 22 bp, Artificial Sequence
  chemically synthesized
tggttcactgtattacagtgaa

SEQ ID NO: 1224944 - DNA, 22 bp, Artificial Sequence
  chemically synthesized
taataaaaagaattcactgtaa

SEQ ID NO: 1224945 - DNA, 22 bp, Artificial Sequence
  chemically synthesized
ggttcactgtattacagtgaat

SEQ ID NO: 1224946 - DNA, 22 bp, Artificial Sequence
  chemically synthesized
gttcactgtattacagtgaatt

SEQ ID NO: 1224947 - DNA, 22 bp, Artificial Sequence
  chemically synthesized
actgtattacagtgaattcttt

SEQ ID NO: 1224948 - DNA, 22 bp, Artificial Sequence
  chemically synthesized
tggattttaataaaaagaattc

SEQ ID NO: 1224949 - DNA, 22 bp, Artificial Sequence
  chemically synthesized
gtggattttaataaaaagaatt

SEQ ID NO: 1224950 - DNA, 22 bp, Artificial Sequence
  chemically synthesized
tgtggattttaataaaaagaat

SEQ ID NO: 1224951 - DNA, 22 bp, Artificial Sequence
  chemically synthesized
tattacagtgaattctttttat

SEQ ID NO: 1224952 - DNA, 22 bp, Artificial Sequence
  chemically synthesized
ttgtggattttaataaaaagaa

SEQ ID NO: 1224953 - DNA, 22 bp, Artificial Sequence
  chemically synthesized
cagtgaattctttttattaaaa

SEQ ID NO: 1224954 - DNA, 22 bp, Artificial Sequence
  chemically synthesized
tttttattaaaatccacaaaag

SEQ ID NO: 1224955 - DNA, 22 bp, Artificial Sequence
  chemically synthesized
tttattaaaatccacaaaagat

SEQ ID NO: 1224956 - DNA, 22 bp, Artificial Sequence
  chemically synthesized
ttattaaaatccacaaaagatc

SEQ ID NO: 1224957 - DNA, 22 bp, Artificial Sequence
  chemically synthesized
tattaaaatccacaaaagatct

SEQ ID NO: 1224958 - DNA, 22 bp, Artificial Sequence
  chemically synthesized
attaaaatccacaaaagatctc

SEQ ID NO: 1224959 - DNA, 22 bp, Artificial Sequence
  chemically synthesized
taaagcaagagagagatctttt

SEQ ID NO: 1224960 - DNA, 22 bp, Artificial Sequence
  chemically synthesized
ttaaaatccacaaaagatctct

SEQ ID NO: 1224961 - DNA, 22 bp, Artificial Sequence
  chemically synthesized
ctataaagcaagagagagatct

SEQ ID NO: 1224962 - DNA, 22 bp, Artificial Sequence
  chemically synthesized
aaatccacaaaagatctctctc

SEQ ID NO: 1224963 - DNA, 22 bp, Artificial Sequence
  chemically synthesized
gaacagcaaatcaattgctata

SEQ ID NO: 1224964 - DNA, 22 bp, Artificial Sequence
  chemically synthesized
tctcttgctttatagcaattga

SEQ ID NO: 1224965 - DNA, 22 bp, Artificial Sequence
  chemically synthesized
tcttgctttatagcaattgatt

SEQ ID NO: 1224966 - DNA, 22 bp, Artificial Sequence
  chemically synthesized
cactggaacagcaaatcaattg

SEQ ID NO: 1224967 - DNA, 22 bp, Artificial Sequence
  chemically synthesized
ttgctttatagcaattgatttg

SEQ ID NO: 1224968 - DNA, 22 bp, Artificial Sequence
  chemically synthesized
gctttatagcaattgatttgct

SEQ ID NO: 1224969 - DNA, 22 bp, Artificial Sequence
  chemically synthesized
ctttatagcaattgatttgctg

SEQ ID NO: 1224970 - DNA, 22 bp, Artificial Sequence
  chemically synthesized
tatagcaattgatttgctgttc

SEQ ID NO: 1224971 - DNA, 22 bp, Artificial Sequence
  chemically synthesized
atagcaattgatttgctgttcc

SEQ ID NO: 1224972 - DNA, 22 bp, Artificial Sequence
  chemically synthesized
tagcaattgatttgctgttcca

SEQ ID NO: 1224973 - DNA, 22 bp, Artificial Sequence
  chemically synthesized
atttgctgttccagtgcaattg

SEQ ID NO: 1224974 - DNA, 22 bp, Artificial Sequence
  chemically synthesized
aataccaacagaaacaattgca

SEQ ID NO: 1224975 - DNA, 22 bp, Artificial Sequence
  chemically synthesized
gaataccaacagaaacaattgc

SEQ ID NO: 1224976 - DNA, 22 bp, Artificial Sequence
  chemically synthesized
gctgttccagtgcaattgtttc

SEQ ID NO: 1224977 - DNA, 22 bp, Artificial Sequence
  chemically synthesized
tgaataccaacagaaacaattg

SEQ ID NO: 1224978 - DNA, 22 bp, Artificial Sequence
  chemically synthesized
ctgttccagtgcaattgtttct

SEQ ID NO: 1224979 - DNA, 22 bp, Artificial Sequence
  chemically synthesized
ttccagtgcaattgtttctgtt

SEQ ID NO: 1224980 - DNA, 22 bp, Artificial Sequence
  chemically synthesized
cagtgcaattgtttctgttggt

SEQ ID NO: 1224981 - DNA, 22 bp, Artificial Sequence
  chemically synthesized
tatgacacaatgttttgaatac

SEQ ID NO: 1224982 - DNA, 22 bp, Artificial Sequence
  chemically synthesized
tttctgttggtattcaaaacat

SEQ ID NO: 1224983 - DNA, 22 bp, Artificial Sequence
  chemically synthesized
attatatgacacaatgttttga

SEQ ID NO: 1224984 - DNA, 22 bp, Artificial Sequence
  chemically synthesized
ctgttggtattcaaaacattgt

SEQ ID NO: 1224985 - DNA, 22 bp, Artificial Sequence
  chemically synthesized
tgttggtattcaaaacattgtg

SEQ ID NO: 1224986 - DNA, 22 bp, Artificial Sequence
  chemically synthesized
ttggtattcaaaacattgtgtc

SEQ ID NO: 1224987 - DNA, 22 bp, Artificial Sequence
  chemically synthesized
gtattcaaaacattgtgtcata

SEQ ID NO: 1224988 - DNA, 22 bp, Artificial Sequence
  chemically synthesized
aaaacattgtgtcatataatta

SEQ ID NO: 1224989 - DNA, 22 bp, Artificial Sequence
  chemically synthesized
tgtcatataattaattgtgttc

SEQ ID NO: 1224990 - DNA, 22 bp, Artificial Sequence
  chemically synthesized
gtaaccaagacaaagagcagaa

SEQ ID NO: 1224991 - DNA, 22 bp, Artificial Sequence
  chemically synthesized
agtaaccaagacaaagagcaga

SEQ ID NO: 1224992 - DNA, 22 bp, Artificial Sequence
  chemically synthesized
tagtaaccaagacaaagagcag

SEQ ID NO: 1224993 - DNA, 22 bp, Artificial Sequence
  chemically synthesized
ttagtaaccaagacaaagagca

SEQ ID NO: 1224994 - DNA, 22 bp, Artificial Sequence
  chemically synthesized
attgtgttctgctctttgtctt

SEQ ID NO: 1224995 - DNA, 22 bp, Artificial Sequence
  chemically synthesized
tgttctgctctttgtcttggtt

SEQ ID NO: 1224996 - DNA, 22 bp, Artificial Sequence
  chemically synthesized
agagcatttttagtaaccaaga

SEQ ID NO: 1224997 - DNA, 22 bp, Artificial Sequence
  chemically synthesized
tgctctttgtcttggttactaa

SEQ ID NO: 1224998 - DNA, 22 bp, Artificial Sequence
  chemically synthesized
ctctttgtcttggttactaaaa

SEQ ID NO: 1224999 - DNA, 22 bp, Artificial Sequence
  chemically synthesized
tttgtcttggttactaaaaatg

SEQ ID NO: 1225000 - DNA, 22 bp, Artificial Sequence
  chemically synthesized
tgtcttggttactaaaaatgct

SEQ ID NO: 1225001 - DNA, 22 bp, Artificial Sequence
  chemically synthesized
gtcttggttactaaaaatgctc

SEQ ID NO: 1225002 - DNA, 22 bp, Artificial Sequence
  chemically synthesized
tcttggttactaaaaatgctct

SEQ ID NO: 1225003 - DNA, 22 bp, Artificial Sequence
  chemically synthesized
ggttactaaaaatgctctgagc

SEQ ID NO: 1225004 - DNA, 22 bp, Artificial Sequence
  chemically synthesized
gttactaaaaatgctctgagca

SEQ ID NO: 1225005 - DNA, 22 bp, Artificial Sequence
  chemically synthesized
agggtcataagatgctcagagc

SEQ ID NO: 1225006 - DNA, 22 bp, Artificial Sequence
  chemically synthesized
ctaaaaatgctctgagcatctt

SEQ ID NO: 1225007 - DNA, 22 bp, Artificial Sequence
  chemically synthesized
gttcagggtcataagatgctca

SEQ ID NO: 1225008 - DNA, 22 bp, Artificial Sequence
  chemically synthesized
tagttcagggtcataagatgct

SEQ ID NO: 1225009 - DNA, 22 bp, Artificial Sequence
  chemically synthesized
aaaatgctctgagcatcttatg

SEQ ID NO: 1225010 - DNA, 22 bp, Artificial Sequence
  chemically synthesized
ttctagttcagggtcataagat

SEQ ID NO: 1225011 - DNA, 22 bp, Artificial Sequence
  chemically synthesized
gttctagttcagggtcataaga

SEQ ID NO: 1225012 - DNA, 22 bp, Artificial Sequence
  chemically synthesized
tgttctagttcagggtcataag

SEQ ID NO: 1225013 - DNA, 22 bp, Artificial Sequence
  chemically synthesized
tgagcatcttatgaccctgaac

SEQ ID NO: 1225014 - DNA, 22 bp, Artificial Sequence
  chemically synthesized
agcatcttatgaccctgaacta

SEQ ID NO: 1225015 - DNA, 22 bp, Artificial Sequence
  chemically synthesized
tatactttgttctagttcaggg

SEQ ID NO: 1225016 - DNA, 22 bp, Artificial Sequence
  chemically synthesized
atgaccctgaactagaacaaag

SEQ ID NO: 1225017 - DNA, 22 bp, Artificial Sequence
  chemically synthesized
tgaccctgaactagaacaaagt

SEQ ID NO: 1225018 - DNA, 22 bp, Artificial Sequence
  chemically synthesized
aactagaacaaagtatacaggg

SEQ ID NO: 1225019 - DNA, 22 bp, Artificial Sequence
  chemically synthesized
gaacaaagtatacagggcttta

SEQ ID NO: 1225020 - DNA, 22 bp, Artificial Sequence
  chemically synthesized
atatcaaacaccataaagccct

SEQ ID NO: 1225021 - DNA, 22 bp, Artificial Sequence
  chemically synthesized
gatatcaaacaccataaagccc

SEQ ID NO: 1225022 - DNA, 22 bp, Artificial Sequence
  chemically synthesized
tgatatcaaacaccataaagcc

SEQ ID NO: 1225023 - DNA, 22 bp, Artificial Sequence
  chemically synthesized
tcagatacacactttgatatca

SEQ ID NO: 1225024 - DNA, 22 bp, Artificial Sequence
  chemically synthesized
atcagatacacactttgatatc

SEQ ID NO: 1225025 - DNA, 22 bp, Artificial Sequence
  chemically synthesized
tatggtgtttgatatcaaagtg

SEQ ID NO: 1225026 - DNA, 22 bp, Artificial Sequence
  chemically synthesized
atggtgtttgatatcaaagtgt

SEQ ID NO: 1225027 - DNA, 22 bp, Artificial Sequence
  chemically synthesized
tggtgtttgatatcaaagtgtg

SEQ ID NO: 1225028 - DNA, 22 bp, Artificial Sequence
  chemically synthesized
tcttatcagatacacactttga

SEQ ID NO: 1225029 - DNA, 22 bp, Artificial Sequence
  chemically synthesized
gatatcaaagtgtgtatctgat

SEQ ID NO: 1225030 - DNA, 22 bp, Artificial Sequence
  chemically synthesized
atatcaaagtgtgtatctgata

SEQ ID NO: 1225031 - DNA, 22 bp, Artificial Sequence
  chemically synthesized
ataagacagatgtttctttctc

SEQ ID NO: 1225032 - DNA, 22 bp, Artificial Sequence
  chemically synthesized
ccatcatcagatacgtagtgtg

SEQ ID NO: 1225033 - DNA, 22 bp, Artificial Sequence
  chemically synthesized
attaccatcatcagatacgtag

SEQ ID NO: 1225034 - DNA, 22 bp, Artificial Sequence
  chemically synthesized
ctttctccacactacgtatctg

SEQ ID NO: 1225035 - DNA, 22 bp, Artificial Sequence
  chemically synthesized
tttctccacactacgtatctga

SEQ ID NO: 1225036 - DNA, 22 bp, Artificial Sequence
  chemically synthesized
tctccacactacgtatctgatg

SEQ ID NO: 1225037 - DNA, 22 bp, Artificial Sequence
  chemically synthesized
ctccacactacgtatctgatga

SEQ ID NO: 1225038 - DNA, 22 bp, Artificial Sequence
  chemically synthesized
aattaattaccatcatcagata

SEQ ID NO: 1225039 - DNA, 22 bp, Artificial Sequence
  chemically synthesized
tccacactacgtatctgatgat

SEQ ID NO: 1225040 - DNA, 22 bp, Artificial Sequence
  chemically synthesized
cacactacgtatctgatgatgg

SEQ ID NO: 1225041 - DNA, 22 bp, Artificial Sequence
  chemically synthesized
tagttaaattaattaccatcat

SEQ ID NO: 1225042 - DNA, 22 bp, Artificial Sequence
  chemically synthesized
cgtatctgatgatggtaattaa

SEQ ID NO: 1225043 - DNA, 22 bp, Artificial Sequence
  chemically synthesized
atgatggtaattaatttaacta

SEQ ID NO: 1225044 - DNA, 22 bp, Artificial Sequence
  chemically synthesized
atgtgagtagttgtagttaaat

SEQ ID NO: 1225045 - DNA, 22 bp, Artificial Sequence
  chemically synthesized
gatctcatgtgagtagttgtag

SEQ ID NO: 1225046 - DNA, 22 bp, Artificial Sequence
  chemically synthesized
atttaactacaactactcacat

SEQ ID NO: 1225047 - DNA, 22 bp, Artificial Sequence
  chemically synthesized
aactacaactactcacatgaga

SEQ ID NO: 1225048 - DNA, 22 bp, Artificial Sequence
  chemically synthesized
actacaactactcacatgagat

SEQ ID NO: 1225049 - DNA, 22 bp, Artificial Sequence
  chemically synthesized
caactactcacatgagatctag

SEQ ID NO: 1225050 - DNA, 22 bp, Artificial Sequence
  chemically synthesized
tacaggtaaaaatgatactaga

SEQ ID NO: 1225051 - DNA, 22 bp, Artificial Sequence
  chemically synthesized
ctcacatgagatctagtatcat

SEQ ID NO: 1225052 - DNA, 22 bp, Artificial Sequence
  chemically synthesized
acatgagatctagtatcatttt

SEQ ID NO: 1225053 - DNA, 22 bp, Artificial Sequence
  chemically synthesized
aactatacaggtaaaaatgata

SEQ ID NO: 1225054 - DNA, 22 bp, Artificial Sequence
  chemically synthesized
tataagcctaaactatacaggt

SEQ ID NO: 1225055 - DNA, 22 bp, Artificial Sequence
  chemically synthesized
gtatcatttttacctgtatagt

SEQ ID NO: 1225056 - DNA, 22 bp, Artificial Sequence
  chemically synthesized
gtataagcctaaactatacagg

SEQ ID NO: 1225057 - DNA, 22 bp, Artificial Sequence
  chemically synthesized
ttacctgtatagtttaggctta

SEQ ID NO: 1225058 - DNA, 22 bp, Artificial Sequence
  chemically synthesized
tacctgtatagtttaggcttat

SEQ ID NO: 1225059 - DNA, 22 bp, Artificial Sequence
  chemically synthesized
acctgtatagtttaggcttata

SEQ ID NO: 1225060 - DNA, 22 bp, Artificial Sequence
  chemically synthesized
cctgtatagtttaggcttatac

SEQ ID NO: 1225061 - DNA, 22 bp, Artificial Sequence
  chemically synthesized
tatagtttaggcttatacaaac

SEQ ID NO: 1225062 - DNA, 22 bp, Artificial Sequence
  chemically synthesized
tacagataatgtgtttgtataa

SEQ ID NO: 1225063 - DNA, 22 bp, Artificial Sequence
  chemically synthesized
atacagataatgtgtttgtata

SEQ ID NO: 1225064 - DNA, 22 bp, Artificial Sequence
  chemically synthesized
tatacagataatgtgtttgtat

SEQ ID NO: 1225065 - DNA, 22 bp, Artificial Sequence
  chemically synthesized
ttatacagataatgtgtttgta

SEQ ID NO: 1225066 - DNA, 22 bp, Artificial Sequence
  chemically synthesized
tttatacagataatgtgtttgt

SEQ ID NO: 1225067 - DNA, 22 bp, Artificial Sequence
  chemically synthesized
aggcttatacaaacacattatc

SEQ ID NO: 1225068 - DNA, 22 bp, Artificial Sequence
  chemically synthesized
ggcttatacaaacacattatct

SEQ ID NO: 1225069 - DNA, 22 bp, Artificial Sequence
  chemically synthesized
gtctttttatacagataatgtg

SEQ ID NO: 1225070 - DNA, 22 bp, Artificial Sequence
  chemically synthesized
atacaaacacattatctgtata

SEQ ID NO: 1225071 - DNA, 22 bp, Artificial Sequence
  chemically synthesized
tacaaacacattatctgtataa

SEQ ID NO: 1225072 - DNA, 22 bp, Artificial Sequence
  chemically synthesized
ccgagaatggtgttggtctttt

SEQ ID NO: 1225073 - DNA, 22 bp, Artificial Sequence
  chemically synthesized
gccgagaatggtgttggtcttt

SEQ ID NO: 1225074 - DNA, 22 bp, Artificial Sequence
  chemically synthesized
tgccgagaatggtgttggtctt

SEQ ID NO: 1225075 - DNA, 22 bp, Artificial Sequence
  chemically synthesized
tctgtataaaaagaccaacacc

SEQ ID NO: 1225076 - DNA, 22 bp, Artificial Sequence
  chemically synthesized
actttgccgagaatggtgttgg

SEQ ID NO: 1225077 - DNA, 22 bp, Artificial Sequence
  chemically synthesized
tataaaaagaccaacaccattc

SEQ ID NO: 1225078 - DNA, 22 bp, Artificial Sequence
  chemically synthesized
taactttgccgagaatggtgtt

SEQ ID NO: 1225079 - DNA, 22 bp, Artificial Sequence
  chemically synthesized
tattctaactttgccgagaatg

SEQ ID NO: 1225080 - DNA, 22 bp, Artificial Sequence
  chemically synthesized
tcggcaaagttagaatacaacc

SEQ ID NO: 1225081 - DNA, 22 bp, Artificial Sequence
  chemically synthesized
ggcaaagttagaatacaacctg

SEQ ID NO: 1225082 - DNA, 22 bp, Artificial Sequence
  chemically synthesized
ggaatcccagtaaatccaggtt

SEQ ID NO: 1225083 - DNA, 22 bp, Artificial Sequence
  chemically synthesized
gaatacaacctggatttactgg

SEQ ID NO: 1225084 - DNA, 22 bp, Artificial Sequence
  chemically synthesized
acactgggaatcccagtaaatc

SEQ ID NO: 1225085 - DNA, 22 bp, Artificial Sequence
  chemically synthesized
gacactgggaatcccagtaaat

SEQ ID NO: 1225086 - DNA, 22 bp, Artificial Sequence
  chemically synthesized
gatttactgggattcccagtgt

SEQ ID NO: 1225087 - DNA, 22 bp, Artificial Sequence
  chemically synthesized
actgggattcccagtgtcaaac

SEQ ID NO: 1225088 - DNA, 22 bp, Artificial Sequence
  chemically synthesized
ctgggattcccagtgtcaaaca

SEQ ID NO: 1225089 - DNA, 22 bp, Artificial Sequence
  chemically synthesized
ggattcccagtgtcaaacatat

SEQ ID NO: 1225090 - DNA, 22 bp, Artificial Sequence
  chemically synthesized
ccagtgtcaaacatattgatac

SEQ ID NO: 1225091 - DNA, 22 bp, Artificial Sequence
  chemically synthesized
tagtggagggggagagtatcaa

SEQ ID NO: 1225092 - DNA, 22 bp, Artificial Sequence
  chemically synthesized
atactctccccctccactataa

SEQ ID NO: 1225093 - DNA, 22 bp, Artificial Sequence
  chemically synthesized
gcggagcgtgaaagtggttata

SEQ ID NO: 1225094 - DNA, 22 bp, Artificial Sequence
  chemically synthesized
tccccctccactataaccactt

SEQ ID NO: 1225095 - DNA, 22 bp, Artificial Sequence
  chemically synthesized
cccctccactataaccactttc

SEQ ID NO: 1225096 - DNA, 22 bp, Artificial Sequence
  chemically synthesized
acattagcggagcgtgaaagtg

SEQ ID NO: 1225097 - DNA, 22 bp, Artificial Sequence
  chemically synthesized
cactataaccactttcacgctc

SEQ ID NO: 1225098 - DNA, 22 bp, Artificial Sequence
  chemically synthesized
taaccactttcacgctccgcta

SEQ ID NO: 1225099 - DNA, 22 bp, Artificial Sequence
  chemically synthesized
aaacattaacattagcggagcg

SEQ ID NO: 1225100 - DNA, 22 bp, Artificial Sequence
  chemically synthesized
ttgaaacattaacattagcgga

SEQ ID NO: 1225101 - DNA, 22 bp, Artificial Sequence
  chemically synthesized
agttgttgaaacattaacatta

SEQ ID NO: 1225102 - DNA, 22 bp, Artificial Sequence
  chemically synthesized
tcacgctccgctaatgttaatg

SEQ ID NO: 1225103 - DNA, 22 bp, Artificial Sequence
  chemically synthesized
cacgctccgctaatgttaatgt

SEQ ID NO: 1225104 - DNA, 22 bp, Artificial Sequence
  chemically synthesized
acgctccgctaatgttaatgtt

SEQ ID NO: 1225105 - DNA, 22 bp, Artificial Sequence
  chemically synthesized
cgctaatgttaatgtttcaaca

SEQ ID NO: 1225106 - DNA, 22 bp, Artificial Sequence
  chemically synthesized
atgttaatgtttcaacaactga

SEQ ID NO: 1225107 - DNA, 22 bp, Artificial Sequence
  chemically synthesized
tgggatacatataattcagttg

SEQ ID NO: 1225108 - DNA, 22 bp, Artificial Sequence
  chemically synthesized
tatgggatacatataattcagt

SEQ ID NO: 1225109 - DNA, 22 bp, Artificial Sequence
  chemically synthesized
atgtttcaacaactgaattata

SEQ ID NO: 1225110 - DNA, 22 bp, Artificial Sequence
  chemically synthesized
caacaactgaattatatgtatc

SEQ ID NO: 1225111 - DNA, 22 bp, Artificial Sequence
  chemically synthesized
aacaactgaattatatgtatcc

SEQ ID NO: 1225112 - DNA, 22 bp, Artificial Sequence
  chemically synthesized
cagtgttctatgggatacatat

SEQ ID NO: 1225113 - DNA, 22 bp, Artificial Sequence
  chemically synthesized
ccagtgttctatgggatacata

SEQ ID NO: 1225114 - DNA, 22 bp, Artificial Sequence
  chemically synthesized
tccagtgttctatgggatacat

SEQ ID NO: 1225115 - DNA, 22 bp, Artificial Sequence
  chemically synthesized
aattatatgtatcccatagaac

SEQ ID NO: 1225116 - DNA, 22 bp, Artificial Sequence
  chemically synthesized
agaatattttccagtgttctat

SEQ ID NO: 1225117 - DNA, 22 bp, Artificial Sequence
  chemically synthesized
tatgtatcccatagaacactgg

SEQ ID NO: 1225118 - DNA, 22 bp, Artificial Sequence
  chemically synthesized
attaagaatattttccagtgtt

SEQ ID NO: 1225119 - DNA, 22 bp, Artificial Sequence
  chemically synthesized
gaatgaactaattaagaatatt

SEQ ID NO: 1225120 - DNA, 22 bp, Artificial Sequence
  chemically synthesized
cattggaatgaactaattaaga

SEQ ID NO: 1225121 - DNA, 22 bp, Artificial Sequence
  chemically synthesized
gaaaatattcttaattagttca

SEQ ID NO: 1225122 - DNA, 22 bp, Artificial Sequence
  chemically synthesized
acgttccattggaatgaactaa

SEQ ID NO: 1225123 - DNA, 22 bp, Artificial Sequence
  chemically synthesized
atctaacgttccattggaatga

SEQ ID NO: 1225124 - DNA, 22 bp, Artificial Sequence
  chemically synthesized
ttaattagttcattccaatgga

SEQ ID NO: 1225125 - DNA, 22 bp, Artificial Sequence
  chemically synthesized
aattagttcattccaatggaac

SEQ ID NO: 1225126 - DNA, 22 bp, Artificial Sequence
  chemically synthesized
attagttcattccaatggaacg

SEQ ID NO: 1225127 - DNA, 22 bp, Artificial Sequence
  chemically synthesized
accacattgatctaacgttcca

SEQ ID NO: 1225128 - DNA, 22 bp, Artificial Sequence
  chemically synthesized
gttcattccaatggaacgttag

SEQ ID NO: 1225129 - DNA, 22 bp, Artificial Sequence
  chemically synthesized
attccaatggaacgttagatca

SEQ ID NO: 1225130 - DNA, 22 bp, Artificial Sequence
  chemically synthesized
caatggaacgttagatcaatgt

SEQ ID NO: 1225131 - DNA, 22 bp, Artificial Sequence
  chemically synthesized
tgtacattgaccacattgatct

SEQ ID NO: 1225132 - DNA, 22 bp, Artificial Sequence
  chemically synthesized
caacatgttatgtacattgacc

SEQ ID NO: 1225133 - DNA, 22 bp, Artificial Sequence
  chemically synthesized
acaacatgttatgtacattgac

SEQ ID NO: 1225134 - DNA, 22 bp, Artificial Sequence
  chemically synthesized
tacaacatgttatgtacattga

SEQ ID NO: 1225135 - DNA, 22 bp, Artificial Sequence
  chemically synthesized
gatcaatgtggtcaatgtacat

SEQ ID NO: 1225136 - DNA, 22 bp, Artificial Sequence
  chemically synthesized
ctttacaacatgttatgtacat

SEQ ID NO: 1225137 - DNA, 22 bp, Artificial Sequence
  chemically synthesized
cagatcatgtcctactttacaa

SEQ ID NO: 1225138 - DNA, 22 bp, Artificial Sequence
  chemically synthesized
cccagtatggttccagatcatg

SEQ ID NO: 1225139 - DNA, 22 bp, Artificial Sequence
  chemically synthesized
ccccagtatggttccagatcat

SEQ ID NO: 1225140 - DNA, 22 bp, Artificial Sequence
  chemically synthesized
taaagtaggacatgatctggaa

SEQ ID NO: 1225141 - DNA, 22 bp, Artificial Sequence
  chemically synthesized
tccccagtatggttccagatca

SEQ ID NO: 1225142 - DNA, 22 bp, Artificial Sequence
  chemically synthesized
ttccccagtatggttccagatc

SEQ ID NO: 1225143 - DNA, 22 bp, Artificial Sequence
  chemically synthesized
atgacatatttttccccagtat

SEQ ID NO: 1225144 - DNA, 22 bp, Artificial Sequence
  chemically synthesized
tgatgacatatttttccccagt

SEQ ID NO: 1225145 - DNA, 22 bp, Artificial Sequence
  chemically synthesized
gaaccatactggggaaaaatat

SEQ ID NO: 1225146 - DNA, 22 bp, Artificial Sequence
  chemically synthesized
gactctgatgacatatttttcc

SEQ ID NO: 1225147 - DNA, 22 bp, Artificial Sequence
  chemically synthesized
agactctgatgacatatttttc

SEQ ID NO: 1225148 - DNA, 22 bp, Artificial Sequence
  chemically synthesized
gggaaaaatatgtcatcagagt

SEQ ID NO: 1225149 - DNA, 22 bp, Artificial Sequence
  chemically synthesized
taaaagtggtgatttagactct

SEQ ID NO: 1225150 - DNA, 22 bp, Artificial Sequence
  chemically synthesized
gtaaaagtggtgatttagactc

SEQ ID NO: 1225151 - DNA, 22 bp, Artificial Sequence
  chemically synthesized
aataacttgtaaaagtggtgat

SEQ ID NO: 1225152 - DNA, 22 bp, Artificial Sequence
  chemically synthesized
agacattaaataacttgtaaaa

SEQ ID NO: 1225153 - DNA, 22 bp, Artificial Sequence
  chemically synthesized
aatcaccacttttacaagttat

SEQ ID NO: 1225154 - DNA, 22 bp, Artificial Sequence
  chemically synthesized
ctgagacattaaataacttgta

SEQ ID NO: 1225155 - DNA, 22 bp, Artificial Sequence
  chemically synthesized
ttacaagttatttaatgtctca

SEQ ID NO: 1225156 - DNA, 22 bp, Artificial Sequence
  chemically synthesized
tacaagttatttaatgtctcag

SEQ ID NO: 1225157 - DNA, 22 bp, Artificial Sequence
  chemically synthesized
acaagttatttaatgtctcagt

SEQ ID NO: 1225158 - DNA, 22 bp, Artificial Sequence
  chemically synthesized
caagttatttaatgtctcagta

SEQ ID NO: 1225159 - DNA, 22 bp, Artificial Sequence
  chemically synthesized
tttaatgtctcagtaatcttct

SEQ ID NO: 1225160 - DNA, 22 bp, Artificial Sequence
  chemically synthesized
aatgtctcagtaatcttcttac

SEQ ID NO: 1225161 - DNA, 22 bp, Artificial Sequence
  chemically synthesized
atgtctcagtaatcttcttacc

SEQ ID NO: 1225162 - DNA, 22 bp, Artificial Sequence
  chemically synthesized
atccatagtcataggtaagaag

SEQ ID NO: 1225163 - DNA, 22 bp, Artificial Sequence
  chemically synthesized
tcatccatagtcataggtaaga

SEQ ID NO: 1225164 - DNA, 22 bp, Artificial Sequence
  chemically synthesized
agtaatcttcttacctatgact

SEQ ID NO: 1225165 - DNA, 22 bp, Artificial Sequence
  chemically synthesized
aatgctctcatccatagtcata

SEQ ID NO: 1225166 - DNA, 22 bp, Artificial Sequence
  chemically synthesized
gaatgctctcatccatagtcat

SEQ ID NO: 1225167 - DNA, 22 bp, Artificial Sequence
  chemically synthesized
tgaatgctctcatccatagtca

SEQ ID NO: 1225168 - DNA, 22 bp, Artificial Sequence
  chemically synthesized
cttacctatgactatggatgag

SEQ ID NO: 1225169 - DNA, 22 bp, Artificial Sequence
  chemically synthesized
gctttgaatgctctcatccata

SEQ ID NO: 1225170 - DNA, 22 bp, Artificial Sequence
  chemically synthesized
ttacctatgactatggatgaga

SEQ ID NO: 1225171 - DNA, 22 bp, Artificial Sequence
  chemically synthesized
acctatgactatggatgagagc

SEQ ID NO: 1225172 - DNA, 22 bp, Artificial Sequence
  chemically synthesized
cctatgactatggatgagagca

SEQ ID NO: 1225173 - DNA, 22 bp, Artificial Sequence
  chemically synthesized
tgactatggatgagagcattca

SEQ ID NO: 1225174 - DNA, 22 bp, Artificial Sequence
  chemically synthesized
atggcctggctttgaatgctct

SEQ ID NO: 1225175 - DNA, 22 bp, Artificial Sequence
  chemically synthesized
gtctgatggcctggctttgaat

SEQ ID NO: 1225176 - DNA, 22 bp, Artificial Sequence
  chemically synthesized
tggatgagagcattcaaagcca

SEQ ID NO: 1225177 - DNA, 22 bp, Artificial Sequence
  chemically synthesized
accaccagctggtctgatggcc

SEQ ID NO: 1225178 - DNA, 22 bp, Artificial Sequence
  chemically synthesized
caccaccagctggtctgatggc

SEQ ID NO: 1225179 - DNA, 22 bp, Artificial Sequence
  chemically synthesized
aaagccaggccatcagaccagc

SEQ ID NO: 1225180 - DNA, 22 bp, Artificial Sequence
  chemically synthesized
atgtaatcaacttcaccaccag

SEQ ID NO: 1225181 - DNA, 22 bp, Artificial Sequence
  chemically synthesized
tccacaggttaatgtaatcaac

SEQ ID NO: 1225182 - DNA, 22 bp, Artificial Sequence
  chemically synthesized
gtggtgaagttgattacattaa

SEQ ID NO: 1225183 - DNA, 22 bp, Artificial Sequence
  chemically synthesized
gtaattatccacaggttaatgt

SEQ ID NO: 1225184 - DNA, 22 bp, Artificial Sequence
  chemically synthesized
attacattaacctgtggataat

SEQ ID NO: 1225185 - DNA, 22 bp, Artificial Sequence
  chemically synthesized
cattaacctgtggataattacg

SEQ ID NO: 1225186 - DNA, 22 bp, Artificial Sequence
  chemically synthesized
ggtccgacaatcaactcgtaat

SEQ ID NO: 1225187 - DNA, 22 bp, Artificial Sequence
  chemically synthesized
acctgtggataattacgagttg

SEQ ID NO: 1225188 - DNA, 22 bp, Artificial Sequence
  chemically synthesized
agctgggtccgacaatcaactc

SEQ ID NO: 1225189 - DNA, 22 bp, Artificial Sequence
  chemically synthesized
tggataattacgagttgattgt

SEQ ID NO: 1225190 - DNA, 22 bp, Artificial Sequence
  chemically synthesized
ctgagctgggtccgacaatcaa

SEQ ID NO: 1225191 - DNA, 22 bp, Artificial Sequence
  chemically synthesized
tcctgagctgggtccgacaatc

SEQ ID NO: 1225192 - DNA, 22 bp, Artificial Sequence
  chemically synthesized
cgagttgattgtcggacccagc

SEQ ID NO: 1225193 - DNA, 22 bp, Artificial Sequence
  chemically synthesized
attgtcggacccagctcaggag

SEQ ID NO: 1225194 - DNA, 22 bp, Artificial Sequence
  chemically synthesized
tcggacccagctcaggagaatc

SEQ ID NO: 1225195 - DNA, 22 bp, Artificial Sequence
  chemically synthesized
caacaaaccaacagtgaaaaga

SEQ ID NO: 1225196 - DNA, 22 bp, Artificial Sequence
  chemically synthesized
aggagaatcttttcactgttgg

SEQ ID NO: 1225197 - DNA, 22 bp, Artificial Sequence
  chemically synthesized
gattgcaacaaaccaacagtga

SEQ ID NO: 1225198 - DNA, 22 bp, Artificial Sequence
  chemically synthesized
ttcactgttggtttgttgcaat

SEQ ID NO: 1225199 - DNA, 22 bp, Artificial Sequence
  chemically synthesized
tcactgttggtttgttgcaatc

SEQ ID NO: 1225200 - DNA, 22 bp, Artificial Sequence
  chemically synthesized
cactgttggtttgttgcaatcc

SEQ ID NO: 1225201 - DNA, 22 bp, Artificial Sequence
  chemically synthesized
actgttggtttgttgcaatcca

SEQ ID NO: 1225202 - DNA, 22 bp, Artificial Sequence
  chemically synthesized
ttggtttgttgcaatccagcca

SEQ ID NO: 1225203 - DNA, 22 bp, Artificial Sequence
  chemically synthesized
gtttgttgcaatccagccatga

SEQ ID NO: 1225204 - DNA, 22 bp, Artificial Sequence
  chemically synthesized
gttgcaatccagccatgatatt

SEQ ID NO: 1225205 - DNA, 22 bp, Artificial Sequence
  chemically synthesized
ttgcaatccagccatgatattt

SEQ ID NO: 1225206 - DNA, 22 bp, Artificial Sequence
  chemically synthesized
caatccagccatgatatttttc

SEQ ID NO: 1225207 - DNA, 22 bp, Artificial Sequence
  chemically synthesized
cacatgtaggtcaaaaatgtaa

SEQ ID NO: 1225208 - DNA, 22 bp, Artificial Sequence
  chemically synthesized
ccacatgtaggtcaaaaatgta

SEQ ID NO: 1225209 - DNA, 22 bp, Artificial Sequence
  chemically synthesized
tttccacatgtaggtcaaaaat

SEQ ID NO: 1225210 - DNA, 22 bp, Artificial Sequence
  chemically synthesized
atttccacatgtaggtcaaaaa

SEQ ID NO: 1225211 - DNA, 22 bp, Artificial Sequence
  chemically synthesized
ttcattacatttttgacctaca

SEQ ID NO: 1225212 - DNA, 22 bp, Artificial Sequence
  chemically synthesized
tcattacatttttgacctacat

SEQ ID NO: 1225213 - DNA, 22 bp, Artificial Sequence
  chemically synthesized
cattacatttttgacctacatg

SEQ ID NO: 1225214 - DNA, 22 bp, Artificial Sequence
  chemically synthesized
attacatttttgacctacatgt

SEQ ID NO: 1225215 - DNA, 22 bp, Artificial Sequence
  chemically synthesized
tgaaaatttatttccacatgta

SEQ ID NO: 1225216 - DNA, 22 bp, Artificial Sequence
  chemically synthesized
catttttgacctacatgtggaa

SEQ ID NO: 1225217 - DNA, 22 bp, Artificial Sequence
  chemically synthesized
atgaaaatttatttccacatgt

SEQ ID NO: 1225218 - DNA, 22 bp, Artificial Sequence
  chemically synthesized
ttatgaaaatttatttccacat

SEQ ID NO: 1225219 - DNA, 22 bp, Artificial Sequence
  chemically synthesized
cttatgaaaatttatttccaca

SEQ ID NO: 1225220 - DNA, 22 bp, Artificial Sequence
  chemically synthesized
tcttatgaaaatttatttccac

SEQ ID NO: 1225221 - DNA, 22 bp, Artificial Sequence
  chemically synthesized
ttgacctacatgtggaaataaa

SEQ ID NO: 1225222 - DNA, 22 bp, Artificial Sequence
  chemically synthesized
tgacctacatgtggaaataaat

SEQ ID NO: 1225223 - DNA, 22 bp, Artificial Sequence
  chemically synthesized
gacctacatgtggaaataaatt

SEQ ID NO: 1225224 - DNA, 22 bp, Artificial Sequence
  chemically synthesized
acctacatgtggaaataaattt

SEQ ID NO: 1225225 - DNA, 22 bp, Artificial Sequence
  chemically synthesized
catgtggaaataaattttcata

SEQ ID NO: 1225226 - DNA, 22 bp, Artificial Sequence
  chemically synthesized
aaggaatgcattttcttatgaa

SEQ ID NO: 1225227 - DNA, 22 bp, Artificial Sequence
  chemically synthesized
ctcaaggaatgcattttcttat

SEQ ID NO: 1225228 - DNA, 22 bp, Artificial Sequence
  chemically synthesized
gctcaaggaatgcattttctta

SEQ ID NO: 1225229 - DNA, 22 bp, Artificial Sequence
  chemically synthesized
ttgctcaaggaatgcattttct

SEQ ID NO: 1225230 - DNA, 22 bp, Artificial Sequence
  chemically synthesized
tcataagaaaatgcattccttg

SEQ ID NO: 1225231 - DNA, 22 bp, Artificial Sequence
  chemically synthesized
cataagaaaatgcattccttga

SEQ ID NO: 1225232 - DNA, 22 bp, Artificial Sequence
  chemically synthesized
catggttcttgctcaaggaatg

SEQ ID NO: 1225233 - DNA, 22 bp, Artificial Sequence
  chemically synthesized
ataagaaaatgcattccttgag

SEQ ID NO: 1225234 - DNA, 22 bp, Artificial Sequence
  chemically synthesized
gcatggttcttgctcaaggaat

SEQ ID NO: 1225235 - DNA, 22 bp, Artificial Sequence
  chemically synthesized
agtttgcatggttcttgctcaa

SEQ ID NO: 1225236 - DNA, 22 bp, Artificial Sequence
  chemically synthesized
aagtttgcatggttcttgctca

SEQ ID NO: 1225237 - DNA, 22 bp, Artificial Sequence
  chemically synthesized
atatttaagtttgcatggttct

SEQ ID NO: 1225238 - DNA, 22 bp, Artificial Sequence
  chemically synthesized
cttgagcaagaaccatgcaaac

SEQ ID NO: 1225239 - DNA, 22 bp, Artificial Sequence
  chemically synthesized
gagcaagaaccatgcaaactta

SEQ ID NO: 1225240 - DNA, 22 bp, Artificial Sequence
  chemically synthesized
agcaagaaccatgcaaacttaa

SEQ ID NO: 1225241 - DNA, 22 bp, Artificial Sequence
  chemically synthesized
aagatcaaggacattcatattt

SEQ ID NO: 1225242 - DNA, 22 bp, Artificial Sequence
  chemically synthesized
tcactgaagatcaaggacattc

SEQ ID NO: 1225243 - DNA, 22 bp, Artificial Sequence
  chemically synthesized
atcactgaagatcaaggacatt

SEQ ID NO: 1225244 - DNA, 22 bp, Artificial Sequence
  chemically synthesized
tttatcactgaagatcaaggac

SEQ ID NO: 1225245 - DNA, 22 bp, Artificial Sequence
  chemically synthesized
aaatatgaatgtccttgatctt

SEQ ID NO: 1225246 - DNA, 22 bp, Artificial Sequence
  chemically synthesized
tatttatcactgaagatcaagg

SEQ ID NO: 1225247 - DNA, 22 bp, Artificial Sequence
  chemically synthesized
aatatgaatgtccttgatcttc

SEQ ID NO: 1225248 - DNA, 22 bp, Artificial Sequence
  chemically synthesized
ctatttatcactgaagatcaag

SEQ ID NO: 1225249 - DNA, 22 bp, Artificial Sequence
  chemically synthesized
aaatttctatttatcactgaag

SEQ ID NO: 1225250 - DNA, 22 bp, Artificial Sequence
  chemically synthesized
gccctaaaatttctatttatca

SEQ ID NO: 1225251 - DNA, 22 bp, Artificial Sequence
  chemically synthesized
gatcttcagtgataaatagaaa

SEQ ID NO: 1225252 - DNA, 22 bp, Artificial Sequence
  chemically synthesized
atcttcagtgataaatagaaat

SEQ ID NO: 1225253 - DNA, 22 bp, Artificial Sequence
  chemically synthesized
attggccctaaaatttctattt

SEQ ID NO: 1225254 - DNA, 22 bp, Artificial Sequence
  chemically synthesized
ctaattggccctaaaatttcta

SEQ ID NO: 1225255 - DNA, 22 bp, Artificial Sequence
  chemically synthesized
cagtgataaatagaaattttag

SEQ ID NO: 1225256 - DNA, 22 bp, Artificial Sequence
  chemically synthesized
agtgataaatagaaattttagg

SEQ ID NO: 1225257 - DNA, 22 bp, Artificial Sequence
  chemically synthesized
attactaattggccctaaaatt

SEQ ID NO: 1225258 - DNA, 22 bp, Artificial Sequence
  chemically synthesized
tgtctcattactaattggccct

SEQ ID NO: 1225259 - DNA, 22 bp, Artificial Sequence
  chemically synthesized
ttatgtctcattactaattggc

SEQ ID NO: 1225260 - DNA, 22 bp, Artificial Sequence
  chemically synthesized
tagggccaattagtaatgagac

SEQ ID NO: 1225261 - DNA, 22 bp, Artificial Sequence
  chemically synthesized
agggccaattagtaatgagaca

SEQ ID NO: 1225262 - DNA, 22 bp, Artificial Sequence
  chemically synthesized
gggccaattagtaatgagacat

SEQ ID NO: 1225263 - DNA, 22 bp, Artificial Sequence
  chemically synthesized
gtagaatctattatgtctcatt

SEQ ID NO: 1225264 - DNA, 22 bp, Artificial Sequence
  chemically synthesized
tggtagaatctattatgtctca

SEQ ID NO: 1225265 - DNA, 22 bp, Artificial Sequence
  chemically synthesized
ctggtagaatctattatgtctc

SEQ ID NO: 1225266 - DNA, 22 bp, Artificial Sequence
  chemically synthesized
acttctggtagaatctattatg

SEQ ID NO: 1225267 - DNA, 22 bp, Artificial Sequence
  chemically synthesized
aacttctggtagaatctattat

SEQ ID NO: 1225268 - DNA, 22 bp, Artificial Sequence
  chemically synthesized
gtaatgagacataatagattct

SEQ ID NO: 1225269 - DNA, 22 bp, Artificial Sequence
  chemically synthesized
agaatagacttaacttctggta

SEQ ID NO: 1225270 - DNA, 22 bp, Artificial Sequence
  chemically synthesized
gagaatagacttaacttctggt

SEQ ID NO: 1225271 - DNA, 22 bp, Artificial Sequence
  chemically synthesized
tgagaatagacttaacttctgg

SEQ ID NO: 1225272 - DNA, 22 bp, Artificial Sequence
  chemically synthesized
gcctttgagaatagacttaact

SEQ ID NO: 1225273 - DNA, 22 bp, Artificial Sequence
  chemically synthesized
ctagcctttgagaatagactta

SEQ ID NO: 1225274 - DNA, 22 bp, Artificial Sequence
  chemically synthesized
taccagaagttaagtctattct

SEQ ID NO: 1225275 - DNA, 22 bp, Artificial Sequence
  chemically synthesized
ccagaagttaagtctattctca

SEQ ID NO: 1225276 - DNA, 22 bp, Artificial Sequence
  chemically synthesized
agtctattctcaaaggctagga

SEQ ID NO: 1225277 - DNA, 22 bp, Artificial Sequence
  chemically synthesized
ttctcaaaggctaggagtctat

SEQ ID NO: 1225278 - DNA, 22 bp, Artificial Sequence
  chemically synthesized
tcaaaggctaggagtctattct

SEQ ID NO: 1225279 - DNA, 22 bp, Artificial Sequence
  chemically synthesized
aaaggctaggagtctattctga

SEQ ID NO: 1225280 - DNA, 22 bp, Artificial Sequence
  chemically synthesized
ggagtctattctgattcattgg

SEQ ID NO: 1225281 - DNA, 22 bp, Artificial Sequence
  chemically synthesized
ttctgattcattggtatctatg

SEQ ID NO: 1225282 - DNA, 22 bp, Artificial Sequence
  chemically synthesized
agtaaatggtatggcatagata

SEQ ID NO: 1225283 - DNA, 22 bp, Artificial Sequence
  chemically synthesized
tgattcattggtatctatgcca

SEQ ID NO: 1225284 - DNA, 22 bp, Artificial Sequence
  chemically synthesized
attcattggtatctatgccata

SEQ ID NO: 1225285 - DNA, 22 bp, Artificial Sequence
  chemically synthesized
attggtatctatgccataccat

SEQ ID NO: 1225286 - DNA, 22 bp, Artificial Sequence
  chemically synthesized
gtatctatgccataccatttac

SEQ ID NO: 1225287 - DNA, 22 bp, Artificial Sequence
  chemically synthesized
tgccataccatttactgaatgt

SEQ ID NO: 1225288 - DNA, 22 bp, Artificial Sequence
  chemically synthesized
actgaatgtgttcactattact

SEQ ID NO: 1225289 - DNA, 22 bp, Artificial Sequence
  chemically synthesized
ctgaatgtgttcactattactc

SEQ ID NO: 1225290 - DNA, 22 bp, Artificial Sequence
  chemically synthesized
aatgtgttcactattactcctg

SEQ ID NO: 1225291 - DNA, 22 bp, Artificial Sequence
  chemically synthesized
atatggcagaatccaggagtaa

SEQ ID NO: 1225292 - DNA, 22 bp, Artificial Sequence
  chemically synthesized
ggtctaatatggcagaatccag

SEQ ID NO: 1225293 - DNA, 22 bp, Artificial Sequence
  chemically synthesized
actattactcctggattctgcc

SEQ ID NO: 1225294 - DNA, 22 bp, Artificial Sequence
  chemically synthesized
ttactcctggattctgccatat

SEQ ID NO: 1225295 - DNA, 22 bp, Artificial Sequence
  chemically synthesized
ctcctggattctgccatattag

SEQ ID NO: 1225296 - DNA, 22 bp, Artificial Sequence
  chemically synthesized
ctggattctgccatattagacc

SEQ ID NO: 1225297 - DNA, 22 bp, Artificial Sequence
  chemically synthesized
gattctgccatattagacccaa

SEQ ID NO: 1225298 - DNA, 22 bp, Artificial Sequence
  chemically synthesized
taaacagtaaatgttgggtcta

SEQ ID NO: 1225299 - DNA, 22 bp, Artificial Sequence
  chemically synthesized
tataaacagtaaatgttgggtc

SEQ ID NO: 1225300 - DNA, 22 bp, Artificial Sequence
  chemically synthesized
tgccatattagacccaacattt

SEQ ID NO: 1225301 - DNA, 22 bp, Artificial Sequence
  chemically synthesized
ccatattagacccaacatttac

SEQ ID NO: 1225302 - DNA, 22 bp, Artificial Sequence
  chemically synthesized
gacccaacatttactgtttata

SEQ ID NO: 1225303 - DNA, 22 bp, Artificial Sequence
  chemically synthesized
gaaggtgagcaattctataaac

SEQ ID NO: 1225304 - DNA, 22 bp, Artificial Sequence
  chemically synthesized
aaagctagaaggtgagcaattc

SEQ ID NO: 1225305 - DNA, 22 bp, Artificial Sequence
  chemically synthesized
actgtttatagaattgctcacc

SEQ ID NO: 1225306 - DNA, 22 bp, Artificial Sequence
  chemically synthesized
ctgtttatagaattgctcacct

SEQ ID NO: 1225307 - DNA, 22 bp, Artificial Sequence
  chemically synthesized
attgaaagctagaaggtgagca

SEQ ID NO: 1225308 - DNA, 22 bp, Artificial Sequence
  chemically synthesized
tttatagaattgctcaccttct

SEQ ID NO: 1225309 - DNA, 22 bp, Artificial Sequence
  chemically synthesized
ttcattgaaagctagaaggtga

SEQ ID NO: 1225310 - DNA, 22 bp, Artificial Sequence
  chemically synthesized
gttcattgaaagctagaaggtg

SEQ ID NO: 1225311 - DNA, 22 bp, Artificial Sequence
  chemically synthesized
atagaattgctcaccttctagc

SEQ ID NO: 1225312 - DNA, 22 bp, Artificial Sequence
  chemically synthesized
tagaattgctcaccttctagct

SEQ ID NO: 1225313 - DNA, 22 bp, Artificial Sequence
  chemically synthesized
gcttgttcattgaaagctagaa

SEQ ID NO: 1225314 - DNA, 22 bp, Artificial Sequence
  chemically synthesized
tagcttgttcattgaaagctag

SEQ ID NO: 1225315 - DNA, 22 bp, Artificial Sequence
  chemically synthesized
tctagcttgttcattgaaagct

SEQ ID NO: 1225316 - DNA, 22 bp, Artificial Sequence
  chemically synthesized
ctctagcttgttcattgaaagc

SEQ ID NO: 1225317 - DNA, 22 bp, Artificial Sequence
  chemically synthesized
ctcaccttctagctttcaatga

SEQ ID NO: 1225318 - DNA, 22 bp, Artificial Sequence
  chemically synthesized
accttctagctttcaatgaaca

SEQ ID NO: 1225319 - DNA, 22 bp, Artificial Sequence
  chemically synthesized
tcttctctagcttgttcattga

SEQ ID NO: 1225320 - DNA, 22 bp, Artificial Sequence
  chemically synthesized
ctagctttcaatgaacaagcta

SEQ ID NO: 1225321 - DNA, 22 bp, Artificial Sequence
  chemically synthesized
tagctttcaatgaacaagctag

SEQ ID NO: 1225322 - DNA, 22 bp, Artificial Sequence
  chemically synthesized
tacactgtcttctctagcttgt

SEQ ID NO: 1225323 - DNA, 22 bp, Artificial Sequence
  chemically synthesized
gctttcaatgaacaagctagag

SEQ ID NO: 1225324 - DNA, 22 bp, Artificial Sequence
  chemically synthesized
atacactgtcttctctagcttg

SEQ ID NO: 1225325 - DNA, 22 bp, Artificial Sequence
  chemically synthesized
tatacactgtcttctctagctt

SEQ ID NO: 1225326 - DNA, 22 bp, Artificial Sequence
  chemically synthesized
tcaatgaacaagctagagaaga

SEQ ID NO: 1225327 - DNA, 22 bp, Artificial Sequence
  chemically synthesized
caatgaacaagctagagaagac

SEQ ID NO: 1225328 - DNA, 22 bp, Artificial Sequence
  chemically synthesized
aatgaacaagctagagaagaca

SEQ ID NO: 1225329 - DNA, 22 bp, Artificial Sequence
  chemically synthesized
atgttttatacactgtcttctc

SEQ ID NO: 1225330 - DNA, 22 bp, Artificial Sequence
  chemically synthesized
gagaagacagtgtataaaacat

SEQ ID NO: 1225331 - DNA, 22 bp, Artificial Sequence
  chemically synthesized
acaataagtctaatgttttata

SEQ ID NO: 1225332 - DNA, 22 bp, Artificial Sequence
  chemically synthesized
gttaacaataagtctaatgttt

SEQ ID NO: 1225333 - DNA, 22 bp, Artificial Sequence
  chemically synthesized
ggttaacaataagtctaatgtt

SEQ ID NO: 1225334 - DNA, 22 bp, Artificial Sequence
  chemically synthesized
agtccttggttaacaataagtc

SEQ ID NO: 1225335 - DNA, 22 bp, Artificial Sequence
  chemically synthesized
aagtccttggttaacaataagt

SEQ ID NO: 1225336 - DNA, 22 bp, Artificial Sequence
  chemically synthesized
tatcttaagtccttggttaaca

SEQ ID NO: 1225337 - DNA, 22 bp, Artificial Sequence
  chemically synthesized
atatcttaagtccttggttaac

SEQ ID NO: 1225338 - DNA, 22 bp, Artificial Sequence
  chemically synthesized
tatatcttaagtccttggttaa

SEQ ID NO: 1225339 - DNA, 22 bp, Artificial Sequence
  chemically synthesized
ttatatcttaagtccttggtta

SEQ ID NO: 1225340 - DNA, 22 bp, Artificial Sequence
  chemically synthesized
gacttattgttaaccaaggact

SEQ ID NO: 1225341 - DNA, 22 bp, Artificial Sequence
  chemically synthesized
attgttaaccaaggacttaaga

SEQ ID NO: 1225342 - DNA, 22 bp, Artificial Sequence
  chemically synthesized
ttgttaaccaaggacttaagat

SEQ ID NO: 1225343 - DNA, 22 bp, Artificial Sequence
  chemically synthesized
ttaaccaaggacttaagatata

SEQ ID NO: 1225344 - DNA, 22 bp, Artificial Sequence
  chemically synthesized
accaaggacttaagatataaaa

SEQ ID NO: 1225345 - DNA, 22 bp, Artificial Sequence
  chemically synthesized
tccaaaaagcgcttttatatct

SEQ ID NO: 1225346 - DNA, 22 bp, Artificial Sequence
  chemically synthesized
ctatccaaaaagcgcttttata

SEQ ID NO: 1225347 - DNA, 22 bp, Artificial Sequence
  chemically synthesized
ctcctatccaaaaagcgctttt

SEQ ID NO: 1225348 - DNA, 22 bp, Artificial Sequence
  chemically synthesized
aagatataaaagcgctttttgg

SEQ ID NO: 1225349 - DNA, 22 bp, Artificial Sequence
  chemically synthesized
agatataaaagcgctttttgga

SEQ ID NO: 1225350 - DNA, 22 bp, Artificial Sequence
  chemically synthesized
tagtattcctcctatccaaaaa

SEQ ID NO: 1225351 - DNA, 22 bp, Artificial Sequence
  chemically synthesized
tctatagtattcctcctatcca

SEQ ID NO: 1225352 - DNA, 22 bp, Artificial Sequence
  chemically synthesized
tttggataggaggaatactata

SEQ ID NO: 1225353 - DNA, 22 bp, Artificial Sequence
  chemically synthesized
ttggataggaggaatactatag

SEQ ID NO: 1225354 - DNA, 22 bp, Artificial Sequence
  chemically synthesized
aaaaacaattatctatagtatt

SEQ ID NO: 1225355 - DNA, 22 bp, Artificial Sequence
  chemically synthesized
tggataggaggaatactataga

SEQ ID NO: 1225356 - DNA, 22 bp, Artificial Sequence
  chemically synthesized
aaaaaacaattatctatagtat

SEQ ID NO: 1225357 - DNA, 22 bp, Artificial Sequence
  chemically synthesized
ggataggaggaatactatagat

SEQ ID NO: 1225358 - DNA, 22 bp, Artificial Sequence
  chemically synthesized
taaaaaacaattatctatagta

SEQ ID NO: 1225359 - DNA, 22 bp, Artificial Sequence
  chemically synthesized
gataggaggaatactatagata

SEQ ID NO: 1225360 - DNA, 22 bp, Artificial Sequence
  chemically synthesized
aacatatactttaaaaaacaat

SEQ ID NO: 1225361 - DNA, 22 bp, Artificial Sequence
  chemically synthesized
gaacatatactttaaaaaacaa

SEQ ID NO: 1225362 - DNA, 22 bp, Artificial Sequence
  chemically synthesized
tagataattgttttttaaagta

SEQ ID NO: 1225363 - DNA, 22 bp, Artificial Sequence
  chemically synthesized
ttttttaaagtatatgttcaaa

SEQ ID NO: 1225364 - DNA, 22 bp, Artificial Sequence
  chemically synthesized
tttaaagtatatgttcaaattt

SEQ ID NO: 1225365 - DNA, 22 bp, Artificial Sequence
  chemically synthesized
atagcaaaggcaaaatttgaac

SEQ ID NO: 1225366 - DNA, 22 bp, Artificial Sequence
  chemically synthesized
ttaaagtatatgttcaaatttt

SEQ ID NO: 1225367 - DNA, 22 bp, Artificial Sequence
  chemically synthesized
taaagtatatgttcaaattttg

SEQ ID NO: 1225368 - DNA, 22 bp, Artificial Sequence
  chemically synthesized
aaagtatatgttcaaattttgc

SEQ ID NO: 1225369 - DNA, 22 bp, Artificial Sequence
  chemically synthesized
aagtatatgttcaaattttgcc

SEQ ID NO: 1225370 - DNA, 22 bp, Artificial Sequence
  chemically synthesized
ccacaattaatagcaaaggcaa

SEQ ID NO: 1225371 - DNA, 22 bp, Artificial Sequence
  chemically synthesized
aaattttgcctttgctattaat

SEQ ID NO: 1225372 - DNA, 22 bp, Artificial Sequence
  chemically synthesized
tccaattaccacaattaatagc

SEQ ID NO: 1225373 - DNA, 22 bp, Artificial Sequence
  chemically synthesized
gtccaattaccacaattaatag

SEQ ID NO: 1225374 - DNA, 22 bp, Artificial Sequence
  chemically synthesized
tgcctttgctattaattgtggt

SEQ ID NO: 1225375 - DNA, 22 bp, Artificial Sequence
  chemically synthesized
gcctttgctattaattgtggta

SEQ ID NO: 1225376 - DNA, 22 bp, Artificial Sequence
  chemically synthesized
cctttgctattaattgtggtaa

SEQ ID NO: 1225377 - DNA, 22 bp, Artificial Sequence
  chemically synthesized
agcaacttgtccaattaccaca

SEQ ID NO: 1225378 - DNA, 22 bp, Artificial Sequence
  chemically synthesized
tgctattaattgtggtaattgg

SEQ ID NO: 1225379 - DNA, 22 bp, Artificial Sequence
  chemically synthesized
gctattaattgtggtaattgga

SEQ ID NO: 1225380 - DNA, 22 bp, Artificial Sequence
  chemically synthesized
ctattaattgtggtaattggac

SEQ ID NO: 1225381 - DNA, 22 bp, Artificial Sequence
  chemically synthesized
ttaattgtggtaattggacaag

SEQ ID NO: 1225382 - DNA, 22 bp, Artificial Sequence
  chemically synthesized
attgtggtaattggacaagttg

SEQ ID NO: 1225383 - DNA, 22 bp, Artificial Sequence
  chemically synthesized
gaagaggttaagcaacttgtcc

SEQ ID NO: 1225384 - DNA, 22 bp, Artificial Sequence
  chemically synthesized
tggtaattggacaagttgctta

SEQ ID NO: 1225385 - DNA, 22 bp, Artificial Sequence
  chemically synthesized
gacaagttgcttaacctcttct

SEQ ID NO: 1225386 - DNA, 22 bp, Artificial Sequence
  chemically synthesized
cttaacctcttctaggcctcat

SEQ ID NO: 1225387 - DNA, 22 bp, Artificial Sequence
  chemically synthesized
aacctcttctaggcctcatttc

SEQ ID NO: 1225388 - DNA, 22 bp, Artificial Sequence
  chemically synthesized
acctcttctaggcctcatttct

SEQ ID NO: 1225389 - DNA, 22 bp, Artificial Sequence
  chemically synthesized
catgtaagatacacagaaatga

SEQ ID NO: 1225390 - DNA, 22 bp, Artificial Sequence
  chemically synthesized
gcatgtaagatacacagaaatg

SEQ ID NO: 1225391 - DNA, 22 bp, Artificial Sequence
  chemically synthesized
ttctaggcctcatttctgtgta

SEQ ID NO: 1225392 - DNA, 22 bp, Artificial Sequence
  chemically synthesized
ctaggcctcatttctgtgtatc

SEQ ID NO: 1225393 - DNA, 22 bp, Artificial Sequence
  chemically synthesized
taggcctcatttctgtgtatct

SEQ ID NO: 1225394 - DNA, 22 bp, Artificial Sequence
  chemically synthesized
accttgcatgtaagatacacag

SEQ ID NO: 1225395 - DNA, 22 bp, Artificial Sequence
  chemically synthesized
ggcctcatttctgtgtatctta

SEQ ID NO: 1225396 - DNA, 22 bp, Artificial Sequence
  chemically synthesized
cactaaccttgcatgtaagata

SEQ ID NO: 1225397 - DNA, 22 bp, Artificial Sequence
  chemically synthesized
acactaaccttgcatgtaagat

SEQ ID NO: 1225398 - DNA, 22 bp, Artificial Sequence
  chemically synthesized
atttctgtgtatcttacatgca

SEQ ID NO: 1225399 - DNA, 22 bp, Artificial Sequence
  chemically synthesized
atcttacactaaccttgcatgt

SEQ ID NO: 1225400 - DNA, 22 bp, Artificial Sequence
  chemically synthesized
ctgtgtatcttacatgcaaggt

SEQ ID NO: 1225401 - DNA, 22 bp, Artificial Sequence
  chemically synthesized
gatcttacactaaccttgcatg

SEQ ID NO: 1225402 - DNA, 22 bp, Artificial Sequence
  chemically synthesized
tgtgtatcttacatgcaaggtt

SEQ ID NO: 1225403 - DNA, 22 bp, Artificial Sequence
  chemically synthesized
tgatcttacactaaccttgcat

SEQ ID NO: 1225404 - DNA, 22 bp, Artificial Sequence
  chemically synthesized
tgtatcttacatgcaaggttag

SEQ ID NO: 1225405 - DNA, 22 bp, Artificial Sequence
  chemically synthesized
tactttgatcttacactaacct

SEQ ID NO: 1225406 - DNA, 22 bp, Artificial Sequence
  chemically synthesized
gtactttgatcttacactaacc

SEQ ID NO: 1225407 - DNA, 22 bp, Artificial Sequence
  chemically synthesized
tgtactttgatcttacactaac

SEQ ID NO: 1225408 - DNA, 22 bp, Artificial Sequence
  chemically synthesized
acatgcaaggttagtgtaagat

SEQ ID NO: 1225409 - DNA, 22 bp, Artificial Sequence
  chemically synthesized
catgcaaggttagtgtaagatc

SEQ ID NO: 1225410 - DNA, 22 bp, Artificial Sequence
  chemically synthesized
accatattttgtactttgatct

SEQ ID NO: 1225411 - DNA, 22 bp, Artificial Sequence
  chemically synthesized
tctgaccatattttgtactttg

SEQ ID NO: 1225412 - DNA, 22 bp, Artificial Sequence
  chemically synthesized
atctgaccatattttgtacttt

SEQ ID NO: 1225413 - DNA, 22 bp, Artificial Sequence
  chemically synthesized
tatctgaccatattttgtactt

SEQ ID NO: 1225414 - DNA, 22 bp, Artificial Sequence
  chemically synthesized
gtgtaagatcaaagtacaaaat

SEQ ID NO: 1225415 - DNA, 22 bp, Artificial Sequence
  chemically synthesized
aatgatggtatgaaatcagggg

SEQ ID NO: 1225416 - DNA, 22 bp, Artificial Sequence
  chemically synthesized
cgttaaatgatggtatgaaatc

SEQ ID NO: 1225417 - DNA, 22 bp, Artificial Sequence
  chemically synthesized
gcgttaaatgatggtatgaaat

SEQ ID NO: 1225418 - DNA, 22 bp, Artificial Sequence
  chemically synthesized
atttcataccatcatttaacgc

SEQ ID NO: 1225419 - DNA, 22 bp, Artificial Sequence
  chemically synthesized
cataccatcatttaacgcaagc

SEQ ID NO: 1225420 - DNA, 22 bp, Artificial Sequence
  chemically synthesized
ataccatcatttaacgcaagct

SEQ ID NO: 1225421 - DNA, 22 bp, Artificial Sequence
  chemically synthesized
agccaataaatatagcttgcgt

SEQ ID NO: 1225422 - DNA, 22 bp, Artificial Sequence
  chemically synthesized
agttcagccaataaatatagct

SEQ ID NO: 1225423 - DNA, 22 bp, Artificial Sequence
  chemically synthesized
cagttcagccaataaatatagc

SEQ ID NO: 1225424 - DNA, 22 bp, Artificial Sequence
  chemically synthesized
tcagttcagccaataaatatag

SEQ ID NO: 1225425 - DNA, 22 bp, Artificial Sequence
  chemically synthesized
ttcagttcagccaataaatata

SEQ ID NO: 1225426 - DNA, 22 bp, Artificial Sequence
  chemically synthesized
ttttcagttcagccaataaata

SEQ ID NO: 1225427 - DNA, 22 bp, Artificial Sequence
  chemically synthesized
aacgcaagctatatttattggc

SEQ ID NO: 1225428 - DNA, 22 bp, Artificial Sequence
  chemically synthesized
cttttcagttcagccaataaat

SEQ ID NO: 1225429 - DNA, 22 bp, Artificial Sequence
  chemically synthesized
acgcaagctatatttattggct

SEQ ID NO: 1225430 - DNA, 22 bp, Artificial Sequence
  chemically synthesized
tcttcttttcagttcagccaat

SEQ ID NO: 1225431 - DNA, 22 bp, Artificial Sequence
  chemically synthesized
tgtcttcttttcagttcagcca

SEQ ID NO: 1225432 - DNA, 22 bp, Artificial Sequence
  chemically synthesized
ctgtcttcttttcagttcagcc

SEQ ID NO: 1225433 - DNA, 22 bp, Artificial Sequence
  chemically synthesized
tatttattggctgaactgaaaa

SEQ ID NO: 1225434 - DNA, 22 bp, Artificial Sequence
  chemically synthesized
attggctgaactgaaaagaaga

SEQ ID NO: 1225435 - DNA, 22 bp, Artificial Sequence
  chemically synthesized
ttggctgaactgaaaagaagac

SEQ ID NO: 1225436 - DNA, 22 bp, Artificial Sequence
  chemically synthesized
gctgaactgaaaagaagacaga

SEQ ID NO: 1225437 - DNA, 22 bp, Artificial Sequence
  chemically synthesized
ggtaggcaaacatttctgtctt

SEQ ID NO: 1225438 - DNA, 22 bp, Artificial Sequence
  chemically synthesized
aggtaggcaaacatttctgtct

SEQ ID NO: 1225439 - DNA, 22 bp, Artificial Sequence
  chemically synthesized
aactgaaaagaagacagaaatg

SEQ ID NO: 1225440 - DNA, 22 bp, Artificial Sequence
  chemically synthesized
taggtaggcaaacatttctgtc

SEQ ID NO: 1225441 - DNA, 22 bp, Artificial Sequence
  chemically synthesized
ttttaggtaggcaaacatttct

SEQ ID NO: 1225442 - DNA, 22 bp, Artificial Sequence
  chemically synthesized
attttaggtaggcaaacatttc

SEQ ID NO: 1225443 - DNA, 22 bp, Artificial Sequence
  chemically synthesized
aaaagaagacagaaatgtttgc

SEQ ID NO: 1225444 - DNA, 22 bp, Artificial Sequence
  chemically synthesized
tattttaggtaggcaaacattt

SEQ ID NO: 1225445 - DNA, 22 bp, Artificial Sequence
  chemically synthesized
tttattttaggtaggcaaacat

SEQ ID NO: 1225446 - DNA, 22 bp, Artificial Sequence
  chemically synthesized
ctttattttaggtaggcaaaca

SEQ ID NO: 1225447 - DNA, 22 bp, Artificial Sequence
  chemically synthesized
tctttattttaggtaggcaaac

SEQ ID NO: 1225448 - DNA, 22 bp, Artificial Sequence
  chemically synthesized
ttctttattttaggtaggcaaa

SEQ ID NO: 1225449 - DNA, 22 bp, Artificial Sequence
  chemically synthesized
tttctttattttaggtaggcaa

SEQ ID NO: 1225450 - DNA, 22 bp, Artificial Sequence
  chemically synthesized
ttttctttattttaggtaggca

SEQ ID NO: 1225451 - DNA, 22 bp, Artificial Sequence
  chemically synthesized
tttttctttattttaggtaggc

SEQ ID NO: 1225452 - DNA, 22 bp, Artificial Sequence
  chemically synthesized
ttttttttctttattttaggta

SEQ ID NO: 1225453 - DNA, 22 bp, Artificial Sequence
  chemically synthesized
ttgttttttttctttattttag

SEQ ID NO: 1225454 - DNA, 22 bp, Artificial Sequence
  chemically synthesized
gttgttttttttctttatttta

SEQ ID NO: 1225455 - DNA, 22 bp, Artificial Sequence
  chemically synthesized
tgttgttttttttctttatttt

SEQ ID NO: 1225456 - DNA, 22 bp, Artificial Sequence
  chemically synthesized
ctttgttgttttttttctttat

SEQ ID NO: 1225457 - DNA, 22 bp, Artificial Sequence
  chemically synthesized
gcctacctaaaataaagaaaaa

SEQ ID NO: 1225458 - DNA, 22 bp, Artificial Sequence
  chemically synthesized
cctttgttgttttttttcttta

SEQ ID NO: 1225459 - DNA, 22 bp, Artificial Sequence
  chemically synthesized
cctacctaaaataaagaaaaaa

SEQ ID NO: 1225460 - DNA, 22 bp, Artificial Sequence
  chemically synthesized
cttcctttgttgttttttttct

SEQ ID NO: 1225461 - DNA, 22 bp, Artificial Sequence
  chemically synthesized
ccttcctttgttgttttttttc

SEQ ID NO: 1225462 - DNA, 22 bp, Artificial Sequence
  chemically synthesized
cctaaaataaagaaaaaaaaca

SEQ ID NO: 1225463 - DNA, 22 bp, Artificial Sequence
  chemically synthesized
aaataaagaaaaaaaacaacaa

SEQ ID NO: 1225464 - DNA, 22 bp, Artificial Sequence
  chemically synthesized
gggataaatatttccttccttt

SEQ ID NO: 1225465 - DNA, 22 bp, Artificial Sequence
  chemically synthesized
agggataaatatttccttcctt

SEQ ID NO: 1225466 - DNA, 22 bp, Artificial Sequence
  chemically synthesized
ttagggataaatatttccttcc

SEQ ID NO: 1225467 - DNA, 22 bp, Artificial Sequence
  chemically synthesized
catatgtacacctcttagggat

SEQ ID NO: 1225468 - DNA, 22 bp, Artificial Sequence
  chemically synthesized
atccctaagaggtgtacatatg

SEQ ID NO: 1225469 - DNA, 22 bp, Artificial Sequence
  chemically synthesized
tccctaagaggtgtacatatgt

SEQ ID NO: 1225470 - DNA, 22 bp, Artificial Sequence
  chemically synthesized
agaggtgtacatatgtagcctt

SEQ ID NO: 1225471 - DNA, 22 bp, Artificial Sequence
  chemically synthesized
ggttctattttcattacttggt

SEQ ID NO: 1225472 - DNA, 22 bp, Artificial Sequence
  chemically synthesized
gttctattttcattacttggtt

SEQ ID NO: 1225473 - DNA, 22 bp, Artificial Sequence
  chemically synthesized
tattttcattacttggtttcca

SEQ ID NO: 1225474 - DNA, 22 bp, Artificial Sequence
  chemically synthesized
ttttcattacttggtttccatg

SEQ ID NO: 1225475 - DNA, 22 bp, Artificial Sequence
  chemically synthesized
tcattacttggtttccatgtat

SEQ ID NO: 1225476 - DNA, 22 bp, Artificial Sequence
  chemically synthesized
tgagacaatcaaatacatggaa

SEQ ID NO: 1225477 - DNA, 22 bp, Artificial Sequence
  chemically synthesized
cattacttggtttccatgtatt

SEQ ID NO: 1225478 - DNA, 22 bp, Artificial Sequence
  chemically synthesized
attacttggtttccatgtattt

SEQ ID NO: 1225479 - DNA, 22 bp, Artificial Sequence
  chemically synthesized
cttggtttccatgtatttgatt

SEQ ID NO: 1225480 - DNA, 22 bp, Artificial Sequence
  chemically synthesized
ggtttccatgtatttgattgtc

SEQ ID NO: 1225481 - DNA, 22 bp, Artificial Sequence
  chemically synthesized
gtttccatgtatttgattgtct

SEQ ID NO: 1225482 - DNA, 22 bp, Artificial Sequence
  chemically synthesized
ccatgtatttgattgtctcata

SEQ ID NO: 1225483 - DNA, 22 bp, Artificial Sequence
  chemically synthesized
catgtatttgattgtctcatag

SEQ ID NO: 1225484 - DNA, 22 bp, Artificial Sequence
  chemically synthesized
cacatgcacgaagcctatgaga

SEQ ID NO: 1225485 - DNA, 22 bp, Artificial Sequence
  chemically synthesized
gattgtctcataggcttcgtgc

SEQ ID NO: 1225486 - DNA, 22 bp, Artificial Sequence
  chemically synthesized
attgtctcataggcttcgtgca

SEQ ID NO: 1225487 - DNA, 22 bp, Artificial Sequence
  chemically synthesized
aataacatctgcacatgcacga

SEQ ID NO: 1225488 - DNA, 22 bp, Artificial Sequence
  chemically synthesized
tctcataggcttcgtgcatgtg

SEQ ID NO: 1225489 - DNA, 22 bp, Artificial Sequence
  chemically synthesized
ttgaataacatctgcacatgca

SEQ ID NO: 1225490 - DNA, 22 bp, Artificial Sequence
  chemically synthesized
ataggcttcgtgcatgtgcaga

SEQ ID NO: 1225491 - DNA, 22 bp, Artificial Sequence
  chemically synthesized
ataatctgttgaataacatctg

SEQ ID NO: 1225492 - DNA, 22 bp, Artificial Sequence
  chemically synthesized
gataatctgttgaataacatct

SEQ ID NO: 1225493 - DNA, 22 bp, Artificial Sequence
  chemically synthesized
cgtgcatgtgcagatgttattc

SEQ ID NO: 1225494 - DNA, 22 bp, Artificial Sequence
  chemically synthesized
gtgcatgtgcagatgttattca

SEQ ID NO: 1225495 - DNA, 22 bp, Artificial Sequence
  chemically synthesized
aacttgataatctgttgaataa

SEQ ID NO: 1225496 - DNA, 22 bp, Artificial Sequence
  chemically synthesized
agaagaattaaacttgataatc

SEQ ID NO: 1225497 - DNA, 22 bp, Artificial Sequence
  chemically synthesized
ttcaacagattatcaagtttaa

SEQ ID NO: 1225498 - DNA, 22 bp, Artificial Sequence
  chemically synthesized
aacagattatcaagtttaattc

SEQ ID NO: 1225499 - DNA, 22 bp, Artificial Sequence
  chemically synthesized
catcagatgactcagaagaatt

SEQ ID NO: 1225500 - DNA, 22 bp, Artificial Sequence
  chemically synthesized
tgcatcagatgactcagaagaa

SEQ ID NO: 1225501 - DNA, 22 bp, Artificial Sequence
  chemically synthesized
ctgcatcagatgactcagaaga

SEQ ID NO: 1225502 - DNA, 22 bp, Artificial Sequence
  chemically synthesized
tcaagtttaattcttctgagtc

SEQ ID NO: 1225503 - DNA, 22 bp, Artificial Sequence
  chemically synthesized
aattcttctgagtcatctgatg

SEQ ID NO: 1225504 - DNA, 22 bp, Artificial Sequence
  chemically synthesized
attcttctgagtcatctgatgc

SEQ ID NO: 1225505 - DNA, 22 bp, Artificial Sequence
  chemically synthesized
gaatggatttctgcatcagatg

SEQ ID NO: 1225506 - DNA, 22 bp, Artificial Sequence
  chemically synthesized
agaatggatttctgcatcagat

SEQ ID NO: 1225507 - DNA, 22 bp, Artificial Sequence
  chemically synthesized
ttctgagtcatctgatgcagaa

SEQ ID NO: 1225508 - DNA, 22 bp, Artificial Sequence
  chemically synthesized
ctgagtcatctgatgcagaaat

SEQ ID NO: 1225509 - DNA, 22 bp, Artificial Sequence
  chemically synthesized
tgagtcatctgatgcagaaatc

SEQ ID NO: 1225510 - DNA, 22 bp, Artificial Sequence
  chemically synthesized
agtcatctgatgcagaaatcca

SEQ ID NO: 1225511 - DNA, 22 bp, Artificial Sequence
  chemically synthesized
gaaaaaatgcttagaatggatt

SEQ ID NO: 1225512 - DNA, 22 bp, Artificial Sequence
  chemically synthesized
agaaaaaatgcttagaatggat

SEQ ID NO: 1225513 - DNA, 22 bp, Artificial Sequence
  chemically synthesized
atgcagaaatccattctaagca

SEQ ID NO: 1225514 - DNA, 22 bp, Artificial Sequence
  chemically synthesized
atgaaacttagaaaaaatgctt

SEQ ID NO: 1225515 - DNA, 22 bp, Artificial Sequence
  chemically synthesized
cattcatgaaacttagaaaaaa

SEQ ID NO: 1225516 - DNA, 22 bp, Artificial Sequence
  chemically synthesized
taagcattttttctaagtttca

SEQ ID NO: 1225517 - DNA, 22 bp, Artificial Sequence
  chemically synthesized
agcattttttctaagtttcatg

SEQ ID NO: 1225518 - DNA, 22 bp, Artificial Sequence
  chemically synthesized
tgaagcgtcactgcattcatga

SEQ ID NO: 1225519 - DNA, 22 bp, Artificial Sequence
  chemically synthesized
tttctaagtttcatgaatgcag

SEQ ID NO: 1225520 - DNA, 22 bp, Artificial Sequence
  chemically synthesized
tatgaagcgtcactgcattcat

SEQ ID NO: 1225521 - DNA, 22 bp, Artificial Sequence
  chemically synthesized
ttctaagtttcatgaatgcagt

SEQ ID NO: 1225522 - DNA, 22 bp, Artificial Sequence
  chemically synthesized
ctatgaagcgtcactgcattca

SEQ ID NO: 1225523 - DNA, 22 bp, Artificial Sequence
  chemically synthesized
tctaagtttcatgaatgcagtg

SEQ ID NO: 1225524 - DNA, 22 bp, Artificial Sequence
  chemically synthesized
tctatgaagcgtcactgcattc

SEQ ID NO: 1225525 - DNA, 22 bp, Artificial Sequence
  chemically synthesized
ctaagtttcatgaatgcagtga

SEQ ID NO: 1225526 - DNA, 22 bp, Artificial Sequence
  chemically synthesized
ttctatgaagcgtcactgcatt

SEQ ID NO: 1225527 - DNA, 22 bp, Artificial Sequence
  chemically synthesized
taagtttcatgaatgcagtgac

SEQ ID NO: 1225528 - DNA, 22 bp, Artificial Sequence
  chemically synthesized
tttctatgaagcgtcactgcat

SEQ ID NO: 1225529 - DNA, 22 bp, Artificial Sequence
  chemically synthesized
agtttcatgaatgcagtgacgc

SEQ ID NO: 1225530 - DNA, 22 bp, Artificial Sequence
  chemically synthesized
catgaatgcagtgacgcttcat

SEQ ID NO: 1225531 - DNA, 22 bp, Artificial Sequence
  chemically synthesized
atgaatgcagtgacgcttcata

SEQ ID NO: 1225532 - DNA, 22 bp, Artificial Sequence
  chemically synthesized
ataaaagatgtagacagttttt

SEQ ID NO: 1225533 - DNA, 22 bp, Artificial Sequence
  chemically synthesized
aataaaagatgtagacagtttt

SEQ ID NO: 1225534 - DNA, 22 bp, Artificial Sequence
  chemically synthesized
taataaaagatgtagacagttt

SEQ ID NO: 1225535 - DNA, 22 bp, Artificial Sequence
  chemically synthesized
tttaataaaagatgtagacagt

SEQ ID NO: 1225536 - DNA, 22 bp, Artificial Sequence
  chemically synthesized
catagaaaaaactgtctacatc

SEQ ID NO: 1225537 - DNA, 22 bp, Artificial Sequence
  chemically synthesized
atagaaaaaactgtctacatct

SEQ ID NO: 1225538 - DNA, 22 bp, Artificial Sequence
  chemically synthesized
ataaataataattctttaataa

SEQ ID NO: 1225539 - DNA, 22 bp, Artificial Sequence
  chemically synthesized
aataaataataattctttaata

SEQ ID NO: 1225540 - DNA, 22 bp, Artificial Sequence
  chemically synthesized
tctacatcttttattaaagaat

SEQ ID NO: 1225541 - DNA, 22 bp, Artificial Sequence
  chemically synthesized
taataaataataattctttaat

SEQ ID NO: 1225542 - DNA, 22 bp, Artificial Sequence
  chemically synthesized
catcttttattaaagaattatt

SEQ ID NO: 1225543 - DNA, 22 bp, Artificial Sequence
  chemically synthesized
ttattaaagaattattatttat

SEQ ID NO: 1225544 - DNA, 22 bp, Artificial Sequence
  chemically synthesized
tattaaagaattattatttatt

SEQ ID NO: 1225545 - DNA, 22 bp, Artificial Sequence
  chemically synthesized
attaaagaattattatttatta

SEQ ID NO: 1225546 - DNA, 22 bp, Artificial Sequence
  chemically synthesized
aaaagcagtctttaataaataa

SEQ ID NO: 1225547 - DNA, 22 bp, Artificial Sequence
  chemically synthesized
ttaaagaattattatttattaa

SEQ ID NO: 1225548 - DNA, 22 bp, Artificial Sequence
  chemically synthesized
aaaaagcagtctttaataaata

SEQ ID NO: 1225549 - DNA, 22 bp, Artificial Sequence
  chemically synthesized
aagaattattatttattaaaga

SEQ ID NO: 1225550 - DNA, 22 bp, Artificial Sequence
  chemically synthesized
tatttaaaaagcagtctttaat

SEQ ID NO: 1225551 - DNA, 22 bp, Artificial Sequence
  chemically synthesized
atatttaaaaagcagtctttaa

SEQ ID NO: 1225552 - DNA, 22 bp, Artificial Sequence
  chemically synthesized
ttatttattaaagactgctttt

SEQ ID NO: 1225553 - DNA, 22 bp, Artificial Sequence
  chemically synthesized
tttattaaagactgctttttaa

SEQ ID NO: 1225554 - DNA, 22 bp, Artificial Sequence
  chemically synthesized
attaaagactgctttttaaata

SEQ ID NO: 1225555 - DNA, 22 bp, Artificial Sequence
  chemically synthesized
ataaggggcttatatttaaaaa

SEQ ID NO: 1225556 - DNA, 22 bp, Artificial Sequence
  chemically synthesized
ttaaagactgctttttaaatat

SEQ ID NO: 1225557 - DNA, 22 bp, Artificial Sequence
  chemically synthesized
aagactgctttttaaatataag

SEQ ID NO: 1225558 - DNA, 22 bp, Artificial Sequence
  chemically synthesized
cagcatctcataaggggcttat

SEQ ID NO: 1225559 - DNA, 22 bp, Artificial Sequence
  chemically synthesized
ccagcatctcataaggggctta

SEQ ID NO: 1225560 - DNA, 22 bp, Artificial Sequence
  chemically synthesized
ctttttaaatataagcccctta

SEQ ID NO: 1225561 - DNA, 22 bp, Artificial Sequence
  chemically synthesized
ttccagcatctcataaggggct

SEQ ID NO: 1225562 - DNA, 22 bp, Artificial Sequence
  chemically synthesized
cttccagcatctcataaggggc

SEQ ID NO: 1225563 - DNA, 22 bp, Artificial Sequence
  chemically synthesized
tttaaatataagccccttatga

SEQ ID NO: 1225564 - DNA, 22 bp, Artificial Sequence
  chemically synthesized
ttaaatataagccccttatgag

SEQ ID NO: 1225565 - DNA, 22 bp, Artificial Sequence
  chemically synthesized
taaatataagccccttatgaga

SEQ ID NO: 1225566 - DNA, 22 bp, Artificial Sequence
  chemically synthesized
aaatataagccccttatgagat

SEQ ID NO: 1225567 - DNA, 22 bp, Artificial Sequence
  chemically synthesized
aatataagccccttatgagatg

SEQ ID NO: 1225568 - DNA, 22 bp, Artificial Sequence
  chemically synthesized
catagatgtcttcttccagcat

SEQ ID NO: 1225569 - DNA, 22 bp, Artificial Sequence
  chemically synthesized
acatagatgtcttcttccagca

SEQ ID NO: 1225570 - DNA, 22 bp, Artificial Sequence
  chemically synthesized
tacatagatgtcttcttccagc

SEQ ID NO: 1225571 - DNA, 22 bp, Artificial Sequence
  chemically synthesized
ttacatagatgtcttcttccag

SEQ ID NO: 1225572 - DNA, 22 bp, Artificial Sequence
  chemically synthesized
atgagatgctggaagaagacat

SEQ ID NO: 1225573 - DNA, 22 bp, Artificial Sequence
  chemically synthesized
tgagatgctggaagaagacatc

SEQ ID NO: 1225574 - DNA, 22 bp, Artificial Sequence
  chemically synthesized
atcacttttacatagatgtctt

SEQ ID NO: 1225575 - DNA, 22 bp, Artificial Sequence
  chemically synthesized
gaagaagacatctatgtaaaag

SEQ ID NO: 1225576 - DNA, 22 bp, Artificial Sequence
  chemically synthesized
gtggtacagactgatcactttt

SEQ ID NO: 1225577 - DNA, 22 bp, Artificial Sequence
  chemically synthesized
agtggtacagactgatcacttt

SEQ ID NO: 1225578 - DNA, 22 bp, Artificial Sequence
  chemically synthesized
tgtaaaagtgatcagtctgtac

SEQ ID NO: 1225579 - DNA, 22 bp, Artificial Sequence
  chemically synthesized
ccagaaggaaagtgcttagtgg

SEQ ID NO: 1225580 - DNA, 22 bp, Artificial Sequence
  chemically synthesized
cccagaaggaaagtgcttagtg

SEQ ID NO: 1225581 - DNA, 22 bp, Artificial Sequence
  chemically synthesized
accttcccagaaggaaagtgct

SEQ ID NO: 1225582 - DNA, 22 bp, Artificial Sequence
  chemically synthesized
aaccttcccagaaggaaagtgc

SEQ ID NO: 1225583 - DNA, 22 bp, Artificial Sequence
  chemically synthesized
taccactaagcactttccttct

SEQ ID NO: 1225584 - DNA, 22 bp, Artificial Sequence
  chemically synthesized
agcactttccttctgggaaggt

SEQ ID NO: 1225585 - DNA, 22 bp, Artificial Sequence
  chemically synthesized
atagtatatgaaccttaacctt

SEQ ID NO: 1225586 - DNA, 22 bp, Artificial Sequence
  chemically synthesized
tccttctgggaaggttaaggtt

SEQ ID NO: 1225587 - DNA, 22 bp, Artificial Sequence
  chemically synthesized
ccttctgggaaggttaaggttc

SEQ ID NO: 1225588 - DNA, 22 bp, Artificial Sequence
  chemically synthesized
cttctgggaaggttaaggttca

SEQ ID NO: 1225589 - DNA, 22 bp, Artificial Sequence
  chemically synthesized
ctgggaaggttaaggttcatat

SEQ ID NO: 1225590 - DNA, 22 bp, Artificial Sequence
  chemically synthesized
tgggaaggttaaggttcatata

SEQ ID NO: 1225591 - DNA, 22 bp, Artificial Sequence
  chemically synthesized
ggaaggttaaggttcatatact

SEQ ID NO: 1225592 - DNA, 22 bp, Artificial Sequence
  chemically synthesized
atcaaatgttgatagtatatga

SEQ ID NO: 1225593 - DNA, 22 bp, Artificial Sequence
  chemically synthesized
aggttcatatactatcaacatt

SEQ ID NO: 1225594 - DNA, 22 bp, Artificial Sequence
  chemically synthesized
atcatctgatcaaatgttgata

SEQ ID NO: 1225595 - DNA, 22 bp, Artificial Sequence
  chemically synthesized
atatactatcaacatttgatca

SEQ ID NO: 1225596 - DNA, 22 bp, Artificial Sequence
  chemically synthesized
tcaacatttgatcagatgatga

SEQ ID NO: 1225597 - DNA, 22 bp, Artificial Sequence
  chemically synthesized
gaatgcacaataaatattcatc

SEQ ID NO: 1225598 - DNA, 22 bp, Artificial Sequence
  chemically synthesized
agaatgcacaataaatattcat

SEQ ID NO: 1225599 - DNA, 22 bp, Artificial Sequence
  chemically synthesized
gatcagatgatgaatatttatt

SEQ ID NO: 1225600 - DNA, 22 bp, Artificial Sequence
  chemically synthesized
atcagatgatgaatatttattg

SEQ ID NO: 1225601 - DNA, 22 bp, Artificial Sequence
  chemically synthesized
tcatatttagaatgcacaataa

SEQ ID NO: 1225602 - DNA, 22 bp, Artificial Sequence
  chemically synthesized
attgtgcattctaaatatgaca

SEQ ID NO: 1225603 - DNA, 22 bp, Artificial Sequence
  chemically synthesized
ttgtgcattctaaatatgacaa

SEQ ID NO: 1225604 - DNA, 22 bp, Artificial Sequence
  chemically synthesized
tgcattctaaatatgacaattt

SEQ ID NO: 1225605 - DNA, 22 bp, Artificial Sequence
  chemically synthesized
tatggatgaaaaaataaaattg

SEQ ID NO: 1225606 - DNA, 22 bp, Artificial Sequence
  chemically synthesized
tatatggatgaaaaaataaaat

SEQ ID NO: 1225607 - DNA, 22 bp, Artificial Sequence
  chemically synthesized
taaatatgacaattttattttt

SEQ ID NO: 1225608 - DNA, 22 bp, Artificial Sequence
  chemically synthesized
ctatatggatgaaaaaataaaa

SEQ ID NO: 1225609 - DNA, 22 bp, Artificial Sequence
  chemically synthesized
aatatgacaattttattttttc

SEQ ID NO: 1225610 - DNA, 22 bp, Artificial Sequence
  chemically synthesized
acttctatatggatgaaaaaat

SEQ ID NO: 1225611 - DNA, 22 bp, Artificial Sequence
  chemically synthesized
ttaacttctatatggatgaaaa

SEQ ID NO: 1225612 - DNA, 22 bp, Artificial Sequence
  chemically synthesized
gttaacttctatatggatgaaa

SEQ ID NO: 1225613 - DNA, 22 bp, Artificial Sequence
  chemically synthesized
tattttttcatccatatagaag

SEQ ID NO: 1225614 - DNA, 22 bp, Artificial Sequence
  chemically synthesized
attttttcatccatatagaagt

SEQ ID NO: 1225615 - DNA, 22 bp, Artificial Sequence
  chemically synthesized
ttttttcatccatatagaagtt

SEQ ID NO: 1225616 - DNA, 22 bp, Artificial Sequence
  chemically synthesized
tttcatccatatagaagttaac

SEQ ID NO: 1225617 - DNA, 22 bp, Artificial Sequence
  chemically synthesized
ttcatccatatagaagttaaca

SEQ ID NO: 1225618 - DNA, 22 bp, Artificial Sequence
  chemically synthesized
tcatccatatagaagttaacaa

SEQ ID NO: 1225619 - DNA, 22 bp, Artificial Sequence
  chemically synthesized
ccccaaaggcatttgttaactt

SEQ ID NO: 1225620 - DNA, 22 bp, Artificial Sequence
  chemically synthesized
catccatatagaagttaacaaa

SEQ ID NO: 1225621 - DNA, 22 bp, Artificial Sequence
  chemically synthesized
accccaaaggcatttgttaact

SEQ ID NO: 1225622 - DNA, 22 bp, Artificial Sequence
  chemically synthesized
atccatatagaagttaacaaat

SEQ ID NO: 1225623 - DNA, 22 bp, Artificial Sequence
  chemically synthesized
aaatatgcatttaccccaaagg

SEQ ID NO: 1225624 - DNA, 22 bp, Artificial Sequence
  chemically synthesized
acaaatgcctttggggtaaatg

SEQ ID NO: 1225625 - DNA, 22 bp, Artificial Sequence
  chemically synthesized
gagatgttaaaatatgcattta

SEQ ID NO: 1225626 - DNA, 22 bp, Artificial Sequence
  chemically synthesized
acattggagatgttaaaatatg

SEQ ID NO: 1225627 - DNA, 22 bp, Artificial Sequence
  chemically synthesized
tggggtaaatgcatattttaac

SEQ ID NO: 1225628 - DNA, 22 bp, Artificial Sequence
  chemically synthesized
ggggtaaatgcatattttaaca

SEQ ID NO: 1225629 - DNA, 22 bp, Artificial Sequence
  chemically synthesized
gggtaaatgcatattttaacat

SEQ ID NO: 1225630 - DNA, 22 bp, Artificial Sequence
  chemically synthesized
ataaaaagatgactaacattgg

SEQ ID NO: 1225631 - DNA, 22 bp, Artificial Sequence
  chemically synthesized
aataaaaagatgactaacattg

SEQ ID NO: 1225632 - DNA, 22 bp, Artificial Sequence
  chemically synthesized
taataaaaagatgactaacatt

SEQ ID NO: 1225633 - DNA, 22 bp, Artificial Sequence
  chemically synthesized
ttaataaaaagatgactaacat

SEQ ID NO: 1225634 - DNA, 22 bp, Artificial Sequence
  chemically synthesized
taacatctccaatgttagtcat

SEQ ID NO: 1225635 - DNA, 22 bp, Artificial Sequence
  chemically synthesized
tttaataaaaagatgactaaca

SEQ ID NO: 1225636 - DNA, 22 bp, Artificial Sequence
  chemically synthesized
aacatctccaatgttagtcatc

SEQ ID NO: 1225637 - DNA, 22 bp, Artificial Sequence
  chemically synthesized
acatctccaatgttagtcatct

SEQ ID NO: 1225638 - DNA, 22 bp, Artificial Sequence
  chemically synthesized
ctttttaataaaaagatgacta

SEQ ID NO: 1225639 - DNA, 22 bp, Artificial Sequence
  chemically synthesized
actttttaataaaaagatgact

SEQ ID NO: 1225640 - DNA, 22 bp, Artificial Sequence
  chemically synthesized
caatgttagtcatctttttatt

SEQ ID NO: 1225641 - DNA, 22 bp, Artificial Sequence
  chemically synthesized
catttactttttaataaaaaga

SEQ ID NO: 1225642 - DNA, 22 bp, Artificial Sequence
  chemically synthesized
gcatttactttttaataaaaag

SEQ ID NO: 1225643 - DNA, 22 bp, Artificial Sequence
  chemically synthesized
aaatttgcatttactttttaat

SEQ ID NO: 1225644 - DNA, 22 bp, Artificial Sequence
  chemically synthesized
gtcatctttttattaaaaagta

SEQ ID NO: 1225645 - DNA, 22 bp, Artificial Sequence
  chemically synthesized
tttattaaaaagtaaatgcaaa

SEQ ID NO: 1225646 - DNA, 22 bp, Artificial Sequence
  chemically synthesized
ttattaaaaagtaaatgcaaat

SEQ ID NO: 1225647 - DNA, 22 bp, Artificial Sequence
  chemically synthesized
tattaaaaagtaaatgcaaatt

SEQ ID NO: 1225648 - DNA, 22 bp, Artificial Sequence
  chemically synthesized
attaaaaagtaaatgcaaattt

SEQ ID NO: 1225649 - DNA, 22 bp, Artificial Sequence
  chemically synthesized
ttaaaaagtaaatgcaaatttt

SEQ ID NO: 1225650 - DNA, 22 bp, Artificial Sequence
  chemically synthesized
gtagtatatcctaaaatttgca

SEQ ID NO: 1225651 - DNA, 22 bp, Artificial Sequence
  chemically synthesized
agtagtatatcctaaaatttgc

SEQ ID NO: 1225652 - DNA, 22 bp, Artificial Sequence
  chemically synthesized
aaaagtaaatgcaaattttagg

SEQ ID NO: 1225653 - DNA, 22 bp, Artificial Sequence
  chemically synthesized
aaatgagatttagtagtatatc

SEQ ID NO: 1225654 - DNA, 22 bp, Artificial Sequence
  chemically synthesized
taggatatactactaaatctca

SEQ ID NO: 1225655 - DNA, 22 bp, Artificial Sequence
  chemically synthesized
aggatatactactaaatctcat

SEQ ID NO: 1225656 - DNA, 22 bp, Artificial Sequence
  chemically synthesized
ggatatactactaaatctcatt

SEQ ID NO: 1225657 - DNA, 22 bp, Artificial Sequence
  chemically synthesized
aaagtatgttaaaatgagattt

SEQ ID NO: 1225658 - DNA, 22 bp, Artificial Sequence
  chemically synthesized
aaaagtatgttaaaatgagatt

SEQ ID NO: 1225659 - DNA, 22 bp, Artificial Sequence
  chemically synthesized
taaaagtatgttaaaatgagat

SEQ ID NO: 1225660 - DNA, 22 bp, Artificial Sequence
  chemically synthesized
ttaaaagtatgttaaaatgaga

SEQ ID NO: 1225661 - DNA, 22 bp, Artificial Sequence
  chemically synthesized
ctaaatctcattttaacatact

SEQ ID NO: 1225662 - DNA, 22 bp, Artificial Sequence
  chemically synthesized
aaatcttttaaaagtatgttaa

SEQ ID NO: 1225663 - DNA, 22 bp, Artificial Sequence
  chemically synthesized
aatctcattttaacatactttt

SEQ ID NO: 1225664 - DNA, 22 bp, Artificial Sequence
  chemically synthesized
attttaacatacttttaaaaga

SEQ ID NO: 1225665 - DNA, 22 bp, Artificial Sequence
  chemically synthesized
taacatacttttaaaagatttg

SEQ ID NO: 1225666 - DNA, 22 bp, Artificial Sequence
  chemically synthesized
aacatacttttaaaagatttga

SEQ ID NO: 1225667 - DNA, 22 bp, Artificial Sequence
  chemically synthesized
caaagcatcatctcaaatcttt

SEQ ID NO: 1225668 - DNA, 22 bp, Artificial Sequence
  chemically synthesized
acatacttttaaaagatttgag

SEQ ID NO: 1225669 - DNA, 22 bp, Artificial Sequence
  chemically synthesized
acaaagcatcatctcaaatctt

SEQ ID NO: 1225670 - DNA, 22 bp, Artificial Sequence
  chemically synthesized
tgtttacaaagcatcatctcaa

SEQ ID NO: 1225671 - DNA, 22 bp, Artificial Sequence
  chemically synthesized
ttaaaagatttgagatgatgct

SEQ ID NO: 1225672 - DNA, 22 bp, Artificial Sequence
  chemically synthesized
ctgtgtttacaaagcatcatct

SEQ ID NO: 1225673 - DNA, 22 bp, Artificial Sequence
  chemically synthesized
taaaagatttgagatgatgctt

SEQ ID NO: 1225674 - DNA, 22 bp, Artificial Sequence
  chemically synthesized
aaaagatttgagatgatgcttt

SEQ ID NO: 1225675 - DNA, 22 bp, Artificial Sequence
  chemically synthesized
aaagatttgagatgatgctttg

SEQ ID NO: 1225676 - DNA, 22 bp, Artificial Sequence
  chemically synthesized
cgaatcgttactgtgtttacaa

SEQ ID NO: 1225677 - DNA, 22 bp, Artificial Sequence
  chemically synthesized
gagatgatgctttgtaaacaca

SEQ ID NO: 1225678 - DNA, 22 bp, Artificial Sequence
  chemically synthesized
agatgatgctttgtaaacacag

SEQ ID NO: 1225679 - DNA, 22 bp, Artificial Sequence
  chemically synthesized
atatctccgaatcgttactgtg

SEQ ID NO: 1225680 - DNA, 22 bp, Artificial Sequence
  chemically synthesized
catatctccgaatcgttactgt

SEQ ID NO: 1225681 - DNA, 22 bp, Artificial Sequence
  chemically synthesized
tgtaaacacagtaacgattcgg

SEQ ID NO: 1225682 - DNA, 22 bp, Artificial Sequence
  chemically synthesized
gtaaacacagtaacgattcgga

SEQ ID NO: 1225683 - DNA, 22 bp, Artificial Sequence
  chemically synthesized
taaacacagtaacgattcggag

SEQ ID NO: 1225684 - DNA, 22 bp, Artificial Sequence
  chemically synthesized
tgacagatacatgcaaagattt

SEQ ID NO: 1225685 - DNA, 22 bp, Artificial Sequence
  chemically synthesized
ggagatatgaaatctttgcatg

SEQ ID NO: 1225686 - DNA, 22 bp, Artificial Sequence
  chemically synthesized
tcaagggattgtgacagataca

SEQ ID NO: 1225687 - DNA, 22 bp, Artificial Sequence
  chemically synthesized
gttatcaagggattgtgacaga

SEQ ID NO: 1225688 - DNA, 22 bp, Artificial Sequence
  chemically synthesized
agttatcaagggattgtgacag

SEQ ID NO: 1225689 - DNA, 22 bp, Artificial Sequence
  chemically synthesized
tgcatgtatctgtcacaatccc

SEQ ID NO: 1225690 - DNA, 22 bp, Artificial Sequence
  chemically synthesized
gcatgtatctgtcacaatccct

SEQ ID NO: 1225691 - DNA, 22 bp, Artificial Sequence
  chemically synthesized
catgtatctgtcacaatccctt

SEQ ID NO: 1225692 - DNA, 22 bp, Artificial Sequence
  chemically synthesized
aataataggcttagttatcaag

SEQ ID NO: 1225693 - DNA, 22 bp, Artificial Sequence
  chemically synthesized
tcacaatcccttgataactaag

SEQ ID NO: 1225694 - DNA, 22 bp, Artificial Sequence
  chemically synthesized
ctaaataataggcttagttatc

SEQ ID NO: 1225695 - DNA, 22 bp, Artificial Sequence
  chemically synthesized
gataactaagcctattatttag

SEQ ID NO: 1225696 - DNA, 22 bp, Artificial Sequence
  chemically synthesized
gataatccactcctaaataata

SEQ ID NO: 1225697 - DNA, 22 bp, Artificial Sequence
  chemically synthesized
ataactaagcctattatttagg

SEQ ID NO: 1225698 - DNA, 22 bp, Artificial Sequence
  chemically synthesized
ggataatccactcctaaataat

SEQ ID NO: 1225699 - DNA, 22 bp, Artificial Sequence
  chemically synthesized
agcctattatttaggagtggat

SEQ ID NO: 1225700 - DNA, 22 bp, Artificial Sequence
  chemically synthesized
ggaaaacttggataatccactc

SEQ ID NO: 1225701 - DNA, 22 bp, Artificial Sequence
  chemically synthesized
ttatttaggagtggattatcca

SEQ ID NO: 1225702 - DNA, 22 bp, Artificial Sequence
  chemically synthesized
tttaggagtggattatccaagt

SEQ ID NO: 1225703 - DNA, 22 bp, Artificial Sequence
  chemically synthesized
aggagtggattatccaagtttt

SEQ ID NO: 1225704 - DNA, 22 bp, Artificial Sequence
  chemically synthesized
ggagtggattatccaagttttc

SEQ ID NO: 1225705 - DNA, 22 bp, Artificial Sequence
  chemically synthesized
tccaagttttcctaattccttc

SEQ ID NO: 1225706 - DNA, 22 bp, Artificial Sequence
  chemically synthesized
aataagtaggtcaagaaggaat

SEQ ID NO: 1225707 - DNA, 22 bp, Artificial Sequence
  chemically synthesized
actaaataagtaggtcaagaag

SEQ ID NO: 1225708 - DNA, 22 bp, Artificial Sequence
  chemically synthesized
tcctaattccttcttgacctac

SEQ ID NO: 1225709 - DNA, 22 bp, Artificial Sequence
  chemically synthesized
cctaattccttcttgacctact

SEQ ID NO: 1225710 - DNA, 22 bp, Artificial Sequence
  chemically synthesized
ctaattccttcttgacctactt

SEQ ID NO: 1225711 - DNA, 22 bp, Artificial Sequence
  chemically synthesized
attccttcttgacctacttatt

SEQ ID NO: 1225712 - DNA, 22 bp, Artificial Sequence
  chemically synthesized
agtaactgactaaataagtagg

SEQ ID NO: 1225713 - DNA, 22 bp, Artificial Sequence
  chemically synthesized
cttcttgacctacttatttagt

SEQ ID NO: 1225714 - DNA, 22 bp, Artificial Sequence
  chemically synthesized
actgagtaactgactaaataag

SEQ ID NO: 1225715 - DNA, 22 bp, Artificial Sequence
  chemically synthesized
cttgacctacttatttagtcag

SEQ ID NO: 1225716 - DNA, 22 bp, Artificial Sequence
  chemically synthesized
ttgacctacttatttagtcagt

SEQ ID NO: 1225717 - DNA, 22 bp, Artificial Sequence
  chemically synthesized
tattcactgagtaactgactaa

SEQ ID NO: 1225718 - DNA, 22 bp, Artificial Sequence
  chemically synthesized
gacctacttatttagtcagtta

SEQ ID NO: 1225719 - DNA, 22 bp, Artificial Sequence
  chemically synthesized
acctacttatttagtcagttac

SEQ ID NO: 1225720 - DNA, 22 bp, Artificial Sequence
  chemically synthesized
acctgtattcactgagtaactg

SEQ ID NO: 1225721 - DNA, 22 bp, Artificial Sequence
  chemically synthesized
gacctgtattcactgagtaact

SEQ ID NO: 1225722 - DNA, 22 bp, Artificial Sequence
  chemically synthesized
cttatttagtcagttactcagt

SEQ ID NO: 1225723 - DNA, 22 bp, Artificial Sequence
  chemically synthesized
tttgacctgtattcactgagta

SEQ ID NO: 1225724 - DNA, 22 bp, Artificial Sequence
  chemically synthesized
atttagtcagttactcagtgaa

SEQ ID NO: 1225725 - DNA, 22 bp, Artificial Sequence
  chemically synthesized
tttagtcagttactcagtgaat

SEQ ID NO: 1225726 - DNA, 22 bp, Artificial Sequence
  chemically synthesized
agtcagttactcagtgaataca

SEQ ID NO: 1225727 - DNA, 22 bp, Artificial Sequence
  chemically synthesized
gtcagttactcagtgaatacag

SEQ ID NO: 1225728 - DNA, 22 bp, Artificial Sequence
  chemically synthesized
cgtaattatttgacctgtattc

SEQ ID NO: 1225729 - DNA, 22 bp, Artificial Sequence
  chemically synthesized
ctcagtgaatacaggtcaaata

SEQ ID NO: 1225730 - DNA, 22 bp, Artificial Sequence
  chemically synthesized
agtgaatacaggtcaaataatt

SEQ ID NO: 1225731 - DNA, 22 bp, Artificial Sequence
  chemically synthesized
gaatatgagacaaattacgtaa

SEQ ID NO: 1225732 - DNA, 22 bp, Artificial Sequence
  chemically synthesized
agaatatgagacaaattacgta

SEQ ID NO: 1225733 - DNA, 22 bp, Artificial Sequence
  chemically synthesized
tagaatatgagacaaattacgt

SEQ ID NO: 1225734 - DNA, 22 bp, Artificial Sequence
  chemically synthesized
taattttagaatatgagacaaa

SEQ ID NO: 1225735 - DNA, 22 bp, Artificial Sequence
  chemically synthesized
ataattttagaatatgagacaa

SEQ ID NO: 1225736 - DNA, 22 bp, Artificial Sequence
  chemically synthesized
cgtaatttgtctcatattctaa

SEQ ID NO: 1225737 - DNA, 22 bp, Artificial Sequence
  chemically synthesized
agcaatttataattttagaata

SEQ ID NO: 1225738 - DNA, 22 bp, Artificial Sequence
  chemically synthesized
gtctcatattctaaaattataa

SEQ ID NO: 1225739 - DNA, 22 bp, Artificial Sequence
  chemically synthesized
tctcatattctaaaattataaa

SEQ ID NO: 1225740 - DNA, 22 bp, Artificial Sequence
  chemically synthesized
atattctaaaattataaattgc

SEQ ID NO: 1225741 - DNA, 22 bp, Artificial Sequence
  chemically synthesized
tacataaaggttgagcaattta

SEQ ID NO: 1225742 - DNA, 22 bp, Artificial Sequence
  chemically synthesized
taaaattataaattgctcaacc

SEQ ID NO: 1225743 - DNA, 22 bp, Artificial Sequence
  chemically synthesized
aaattataaattgctcaacctt

SEQ ID NO: 1225744 - DNA, 22 bp, Artificial Sequence
  chemically synthesized
cagtcactgtacataaaggttg

SEQ ID NO: 1225745 - DNA, 22 bp, Artificial Sequence
  chemically synthesized
taaattgctcaacctttatgta

SEQ ID NO: 1225746 - DNA, 22 bp, Artificial Sequence
  chemically synthesized
ctgcagtcactgtacataaagg

SEQ ID NO: 1225747 - DNA, 22 bp, Artificial Sequence
  chemically synthesized
ctcaacctttatgtacagtgac

SEQ ID NO: 1225748 - DNA, 22 bp, Artificial Sequence
  chemically synthesized
aacctttatgtacagtgactgc

SEQ ID NO: 1225749 - DNA, 22 bp, Artificial Sequence
  chemically synthesized
tatgtacagtgactgcaggagg

SEQ ID NO: 1225750 - DNA, 22 bp, Artificial Sequence
  chemically synthesized
atgtacagtgactgcaggaggt

SEQ ID NO: 1225751 - DNA, 22 bp, Artificial Sequence
  chemically synthesized
tgtacagtgactgcaggaggtg

SEQ ID NO: 1225752 - DNA, 22 bp, Artificial Sequence
  chemically synthesized
gcacaggacacaaaatacacct

SEQ ID NO: 1225753 - DNA, 22 bp, Artificial Sequence
  chemically synthesized
agcacaggacacaaaatacacc

SEQ ID NO: 1225754 - DNA, 22 bp, Artificial Sequence
  chemically synthesized
caggaggtgtattttgtgtcct

SEQ ID NO: 1225755 - DNA, 22 bp, Artificial Sequence
  chemically synthesized
caaccgtaatttagcacaggac

SEQ ID NO: 1225756 - DNA, 22 bp, Artificial Sequence
  chemically synthesized
attccaaccgtaatttagcaca

SEQ ID NO: 1225757 - DNA, 22 bp, Artificial Sequence
  chemically synthesized
ctgattccaaccgtaatttagc

SEQ ID NO: 1225758 - DNA, 22 bp, Artificial Sequence
  chemically synthesized
tgtgtcctgtgctaaattacgg

SEQ ID NO: 1225759 - DNA, 22 bp, Artificial Sequence
  chemically synthesized
gtgtcctgtgctaaattacggt

SEQ ID NO: 1225760 - DNA, 22 bp, Artificial Sequence
  chemically synthesized
tgtcctgtgctaaattacggtt

SEQ ID NO: 1225761 - DNA, 22 bp, Artificial Sequence
  chemically synthesized
tctgctgattccaaccgtaatt

SEQ ID NO: 1225762 - DNA, 22 bp, Artificial Sequence
  chemically synthesized
tgctaaattacggttggaatca

SEQ ID NO: 1225763 - DNA, 22 bp, Artificial Sequence
  chemically synthesized
agccactatctgctgattccaa

SEQ ID NO: 1225764 - DNA, 22 bp, Artificial Sequence
  chemically synthesized
aattacggttggaatcagcaga

SEQ ID NO: 1225765 - DNA, 22 bp, Artificial Sequence
  chemically synthesized
cggttggaatcagcagatagtg

SEQ ID NO: 1225766 - DNA, 22 bp, Artificial Sequence
  chemically synthesized
ccaccattaagccactatctgc

SEQ ID NO: 1225767 - DNA, 22 bp, Artificial Sequence
  chemically synthesized
gaatcagcagatagtggcttaa

SEQ ID NO: 1225768 - DNA, 22 bp, Artificial Sequence
  chemically synthesized
caaatccattaccaccattaag

SEQ ID NO: 1225769 - DNA, 22 bp, Artificial Sequence
  chemically synthesized
ttgcaaatccattaccaccatt

SEQ ID NO: 1225770 - DNA, 22 bp, Artificial Sequence
  chemically synthesized
attattgcaaatccattaccac

SEQ ID NO: 1225771 - DNA, 22 bp, Artificial Sequence
  chemically synthesized
gattattgcaaatccattacca

SEQ ID NO: 1225772 - DNA, 22 bp, Artificial Sequence
  chemically synthesized
cttgattattgcaaatccatta

SEQ ID NO: 1225773 - DNA, 22 bp, Artificial Sequence
  chemically synthesized
aatggtggtaatggatttgcaa

SEQ ID NO: 1225774 - DNA, 22 bp, Artificial Sequence
  chemically synthesized
atggtggtaatggatttgcaat

SEQ ID NO: 1225775 - DNA, 22 bp, Artificial Sequence
  chemically synthesized
gaggattgcttgattattgcaa

SEQ ID NO: 1225776 - DNA, 22 bp, Artificial Sequence
  chemically synthesized
atcattggaggattgcttgatt

SEQ ID NO: 1225777 - DNA, 22 bp, Artificial Sequence
  chemically synthesized
gcaataatcaagcaatcctcca

SEQ ID NO: 1225778 - DNA, 22 bp, Artificial Sequence
  chemically synthesized
caataatcaagcaatcctccaa

SEQ ID NO: 1225779 - DNA, 22 bp, Artificial Sequence
  chemically synthesized
acaaatgaatcacattcatcat

SEQ ID NO: 1225780 - DNA, 22 bp, Artificial Sequence
  chemically synthesized
cacaaatgaatcacattcatca

SEQ ID NO: 1225781 - DNA, 22 bp, Artificial Sequence
  chemically synthesized
caatgatgaatgtgattcattt

SEQ ID NO: 1225782 - DNA, 22 bp, Artificial Sequence
  chemically synthesized
gccaagcatttcacaaatgaat

SEQ ID NO: 1225783 - DNA, 22 bp, Artificial Sequence
  chemically synthesized
atttgtgaaatgcttggccagt

SEQ ID NO: 1225784 - DNA, 22 bp, Artificial Sequence
  chemically synthesized
gtgaaatgcttggccagtctgc

SEQ ID NO: 1225785 - DNA, 22 bp, Artificial Sequence
  chemically synthesized
tgcacatagagggcagactggc

SEQ ID NO: 1225786 - DNA, 22 bp, Artificial Sequence
  chemically synthesized
tgaaatgcttggccagtctgcc

SEQ ID NO: 1225787 - DNA, 22 bp, Artificial Sequence
  chemically synthesized
acgttatgcacatagagggcag

SEQ ID NO: 1225788 - DNA, 22 bp, Artificial Sequence
  chemically synthesized
aacgttatgcacatagagggca

SEQ ID NO: 1225789 - DNA, 22 bp, Artificial Sequence
  chemically synthesized
taacgttatgcacatagagggc

SEQ ID NO: 1225790 - DNA, 22 bp, Artificial Sequence
  chemically synthesized
ggccagtctgccctctatgtgc

SEQ ID NO: 1225791 - DNA, 22 bp, Artificial Sequence
  chemically synthesized
gccagtctgccctctatgtgca

SEQ ID NO: 1225792 - DNA, 22 bp, Artificial Sequence
  chemically synthesized
tcctttaacgttatgcacatag

SEQ ID NO: 1225793 - DNA, 22 bp, Artificial Sequence
  chemically synthesized
ttgtcctttaacgttatgcaca

SEQ ID NO: 1225794 - DNA, 22 bp, Artificial Sequence
  chemically synthesized
gttgtcctttaacgttatgcac

SEQ ID NO: 1225795 - DNA, 22 bp, Artificial Sequence
  chemically synthesized
tgttgtcctttaacgttatgca

SEQ ID NO: 1225796 - DNA, 22 bp, Artificial Sequence
  chemically synthesized
ccctctatgtgcataacgttaa

SEQ ID NO: 1225797 - DNA, 22 bp, Artificial Sequence
  chemically synthesized
aatactttgttgtcctttaacg

SEQ ID NO: 1225798 - DNA, 22 bp, Artificial Sequence
  chemically synthesized
tatgtgcataacgttaaaggac

SEQ ID NO: 1225799 - DNA, 22 bp, Artificial Sequence
  chemically synthesized
tgtgcataacgttaaaggacaa

SEQ ID NO: 1225800 - DNA, 22 bp, Artificial Sequence
  chemically synthesized
gattgaatactttgttgtcctt

SEQ ID NO: 1225801 - DNA, 22 bp, Artificial Sequence
  chemically synthesized
ggattgaatactttgttgtcct

SEQ ID NO: 1225802 - DNA, 22 bp, Artificial Sequence
  chemically synthesized
tggattgaatactttgttgtcc

SEQ ID NO: 1225803 - DNA, 22 bp, Artificial Sequence
  chemically synthesized
aaggacaacaaagtattcaatc

SEQ ID NO: 1225804 - DNA, 22 bp, Artificial Sequence
  chemically synthesized
taaaggagttttggattgaata

SEQ ID NO: 1225805 - DNA, 22 bp, Artificial Sequence
  chemically synthesized
aatccaaaactcctttatagca

SEQ ID NO: 1225806 - DNA, 22 bp, Artificial Sequence
  chemically synthesized
gtgacataatgatgctataaag

SEQ ID NO: 1225807 - DNA, 22 bp, Artificial Sequence
  chemically synthesized
aattagtgacataatgatgcta

SEQ ID NO: 1225808 - DNA, 22 bp, Artificial Sequence
  chemically synthesized
ctttatagcatcattatgtcac

SEQ ID NO: 1225809 - DNA, 22 bp, Artificial Sequence
  chemically synthesized
ataagctgaattagtgacataa

SEQ ID NO: 1225810 - DNA, 22 bp, Artificial Sequence
  chemically synthesized
tatagcatcattatgtcactaa

SEQ ID NO: 1225811 - DNA, 22 bp, Artificial Sequence
  chemically synthesized
atagcatcattatgtcactaat

SEQ ID NO: 1225812 - DNA, 22 bp, Artificial Sequence
  chemically synthesized
tagcatcattatgtcactaatt

SEQ ID NO: 1225813 - DNA, 22 bp, Artificial Sequence
  chemically synthesized
aggctgataagctgaattagtg

SEQ ID NO: 1225814 - DNA, 22 bp, Artificial Sequence
  chemically synthesized
tgtcactaattcagcttatcag

SEQ ID NO: 1225815 - DNA, 22 bp, Artificial Sequence
  chemically synthesized
attcagcttatcagcctcagcc

SEQ ID NO: 1225816 - DNA, 22 bp, Artificial Sequence
  chemically synthesized
agcttatcagcctcagcctcgc

SEQ ID NO: 1225817 - DNA, 22 bp, Artificial Sequence
  chemically synthesized
agtagaagcaataacagcgagg

SEQ ID NO: 1225818 - DNA, 22 bp, Artificial Sequence
  chemically synthesized
atcagcctcagcctcgctgtta

SEQ ID NO: 1225819 - DNA, 22 bp, Artificial Sequence
  chemically synthesized
tcagcctcagcctcgctgttat

SEQ ID NO: 1225820 - DNA, 22 bp, Artificial Sequence
  chemically synthesized
cacctaagtagaagcaataaca

SEQ ID NO: 1225821 - DNA, 22 bp, Artificial Sequence
  chemically synthesized
gcacctaagtagaagcaataac

SEQ ID NO: 1225822 - DNA, 22 bp, Artificial Sequence
  chemically synthesized
agcctcgctgttattgcttcta

SEQ ID NO: 1225823 - DNA, 22 bp, Artificial Sequence
  chemically synthesized
gctgttattgcttctacttagg

SEQ ID NO: 1225824 - DNA, 22 bp, Artificial Sequence
  chemically synthesized
agcaacatttgcacctaagtag

SEQ ID NO: 1225825 - DNA, 22 bp, Artificial Sequence
  chemically synthesized
ttattgcttctacttaggtgca

SEQ ID NO: 1225826 - DNA, 22 bp, Artificial Sequence
  chemically synthesized
tctgagcaacatttgcacctaa

SEQ ID NO: 1225827 - DNA, 22 bp, Artificial Sequence
  chemically synthesized
gtctgagcaacatttgcaccta

SEQ ID NO: 1225828 - DNA, 22 bp, Artificial Sequence
  chemically synthesized
ttgcttctacttaggtgcaaat

SEQ ID NO: 1225829 - DNA, 22 bp, Artificial Sequence
  chemically synthesized
tgtctgagcaacatttgcacct

SEQ ID NO: 1225830 - DNA, 22 bp, Artificial Sequence
  chemically synthesized
ttgtctgagcaacatttgcacc

SEQ ID NO: 1225831 - DNA, 22 bp, Artificial Sequence
  chemically synthesized
tttgtctgagcaacatttgcac

SEQ ID NO: 1225832 - DNA, 22 bp, Artificial Sequence
  chemically synthesized
cttctacttaggtgcaaatgtt

SEQ ID NO: 1225833 - DNA, 22 bp, Artificial Sequence
  chemically synthesized
ttttgtctgagcaacatttgca

SEQ ID NO: 1225834 - DNA, 22 bp, Artificial Sequence
  chemically synthesized
tttttgtctgagcaacatttgc

SEQ ID NO: 1225835 - DNA, 22 bp, Artificial Sequence
  chemically synthesized
ttttttgtctgagcaacatttg

SEQ ID NO: 1225836 - DNA, 22 bp, Artificial Sequence
  chemically synthesized
ctacttaggtgcaaatgttgct

SEQ ID NO: 1225837 - DNA, 22 bp, Artificial Sequence
  chemically synthesized
tacttaggtgcaaatgttgctc

SEQ ID NO: 1225838 - DNA, 22 bp, Artificial Sequence
  chemically synthesized
tttttttttgtctgagcaacat

SEQ ID NO: 1225839 - DNA, 22 bp, Artificial Sequence
  chemically synthesized
cttaggtgcaaatgttgctcag

SEQ ID NO: 1225840 - DNA, 22 bp, Artificial Sequence
  chemically synthesized
ttatttttttttgtctgagcaa

SEQ ID NO: 1225841 - DNA, 22 bp, Artificial Sequence
  chemically synthesized
aggtgcaaatgttgctcagaca

SEQ ID NO: 1225842 - DNA, 22 bp, Artificial Sequence
  chemically synthesized
attatttttttttgtctgagca

SEQ ID NO: 1225843 - DNA, 22 bp, Artificial Sequence
  chemically synthesized
ggtgcaaatgttgctcagacaa

SEQ ID NO: 1225844 - DNA, 22 bp, Artificial Sequence
  chemically synthesized
tattatttttttttgtctgagc

SEQ ID NO: 1225845 - DNA, 22 bp, Artificial Sequence
  chemically synthesized
ccctttattatttttttttgtc

SEQ ID NO: 1225846 - DNA, 22 bp, Artificial Sequence
  chemically synthesized
ctcagacaaaaaaaaataataa

SEQ ID NO: 1225847 - DNA, 22 bp, Artificial Sequence
  chemically synthesized
tcatacattgccctttattatt

SEQ ID NO: 1225848 - DNA, 22 bp, Artificial Sequence
  chemically synthesized
agacaaaaaaaaataataaagg

SEQ ID NO: 1225849 - DNA, 22 bp, Artificial Sequence
  chemically synthesized
tgtaggaaaaggagacatgatt

SEQ ID NO: 1225850 - DNA, 22 bp, Artificial Sequence
  chemically synthesized
atgtaggaaaaggagacatgat

SEQ ID NO: 1225851 - DNA, 22 bp, Artificial Sequence
  chemically synthesized
tatgtaggaaaaggagacatga

SEQ ID NO: 1225852 - DNA, 22 bp, Artificial Sequence
  chemically synthesized
ttatgtaggaaaaggagacatg

SEQ ID NO: 1225853 - DNA, 22 bp, Artificial Sequence
  chemically synthesized
ccttttatgtaggaaaaggaga

SEQ ID NO: 1225854 - DNA, 22 bp, Artificial Sequence
  chemically synthesized
ataactgccttttatgtaggaa

SEQ ID NO: 1225855 - DNA, 22 bp, Artificial Sequence
  chemically synthesized
gataactgccttttatgtagga

SEQ ID NO: 1225856 - DNA, 22 bp, Artificial Sequence
  chemically synthesized
tgataactgccttttatgtagg

SEQ ID NO: 1225857 - DNA, 22 bp, Artificial Sequence
  chemically synthesized
ttgataactgccttttatgtag

SEQ ID NO: 1225858 - DNA, 22 bp, Artificial Sequence
  chemically synthesized
tttgataactgccttttatgta

SEQ ID NO: 1225859 - DNA, 22 bp, Artificial Sequence
  chemically synthesized
cttttcctacataaaaggcagt

SEQ ID NO: 1225860 - DNA, 22 bp, Artificial Sequence
  chemically synthesized
ttcctacataaaaggcagttat

SEQ ID NO: 1225861 - DNA, 22 bp, Artificial Sequence
  chemically synthesized
aatgattttttgataactgcct

SEQ ID NO: 1225862 - DNA, 22 bp, Artificial Sequence
  chemically synthesized
tcctacataaaaggcagttatc

SEQ ID NO: 1225863 - DNA, 22 bp, Artificial Sequence
  chemically synthesized
cctacataaaaggcagttatca

SEQ ID NO: 1225864 - DNA, 22 bp, Artificial Sequence
  chemically synthesized
ctacataaaaggcagttatcaa

SEQ ID NO: 1225865 - DNA, 22 bp, Artificial Sequence
  chemically synthesized
cataaaaggcagttatcaaaaa

SEQ ID NO: 1225866 - DNA, 22 bp, Artificial Sequence
  chemically synthesized
gggaccagctcaatgatttttt

SEQ ID NO: 1225867 - DNA, 22 bp, Artificial Sequence
  chemically synthesized
ggggaccagctcaatgattttt

SEQ ID NO: 1225868 - DNA, 22 bp, Artificial Sequence
  chemically synthesized
tggggaccagctcaatgatttt

SEQ ID NO: 1225869 - DNA, 22 bp, Artificial Sequence
  chemically synthesized
acctttggggaccagctcaatg

SEQ ID NO: 1225870 - DNA, 22 bp, Artificial Sequence
  chemically synthesized
tcaaaaaatcattgagctggtc

SEQ ID NO: 1225871 - DNA, 22 bp, Artificial Sequence
  chemically synthesized
caggctcacctttggggaccag

SEQ ID NO: 1225872 - DNA, 22 bp, Artificial Sequence
  chemically synthesized
acaggctcacctttggggacca

SEQ ID NO: 1225873 - DNA, 22 bp, Artificial Sequence
  chemically synthesized
tttacaggctcacctttgggga

SEQ ID NO: 1225874 - DNA, 22 bp, Artificial Sequence
  chemically synthesized
tgtttacaggctcacctttggg

SEQ ID NO: 1225875 - DNA, 22 bp, Artificial Sequence
  chemically synthesized
ctgtttacaggctcacctttgg

SEQ ID NO: 1225876 - DNA, 22 bp, Artificial Sequence
  chemically synthesized
tctgtttacaggctcacctttg

SEQ ID NO: 1225877 - DNA, 22 bp, Artificial Sequence
  chemically synthesized
agctggtccccaaaggtgagcc

SEQ ID NO: 1225878 - DNA, 22 bp, Artificial Sequence
  chemically synthesized
gtccccaaaggtgagcctgtaa

SEQ ID NO: 1225879 - DNA, 22 bp, Artificial Sequence
  chemically synthesized
aggacgggacagttttctgttt

SEQ ID NO: 1225880 - DNA, 22 bp, Artificial Sequence
  chemically synthesized
taaacagaaaactgtcccgtcc

SEQ ID NO: 1225881 - DNA, 22 bp, Artificial Sequence
  chemically synthesized
gagacagtgagacctgaggacg

SEQ ID NO: 1225882 - DNA, 22 bp, Artificial Sequence
  chemically synthesized
agagacagtgagacctgaggac

SEQ ID NO: 1225883 - DNA, 22 bp, Artificial Sequence
  chemically synthesized
tagagacagtgagacctgagga

SEQ ID NO: 1225884 - DNA, 22 bp, Artificial Sequence
  chemically synthesized
ctttagagacagtgagacctga

SEQ ID NO: 1225885 - DNA, 22 bp, Artificial Sequence
  chemically synthesized
tcccgtcctcaggtctcactgt

SEQ ID NO: 1225886 - DNA, 22 bp, Artificial Sequence
  chemically synthesized
agcctcctttagagacagtgag

SEQ ID NO: 1225887 - DNA, 22 bp, Artificial Sequence
  chemically synthesized
aattgagcctcctttagagaca

SEQ ID NO: 1225888 - DNA, 22 bp, Artificial Sequence
  chemically synthesized
aaattgagcctcctttagagac

SEQ ID NO: 1225889 - DNA, 22 bp, Artificial Sequence
  chemically synthesized
aggtctcactgtctctaaagga

SEQ ID NO: 1225890 - DNA, 22 bp, Artificial Sequence
  chemically synthesized
tttaaattgagcctcctttaga

SEQ ID NO: 1225891 - DNA, 22 bp, Artificial Sequence
  chemically synthesized
actgtctctaaaggaggctcaa

SEQ ID NO: 1225892 - DNA, 22 bp, Artificial Sequence
  chemically synthesized
tctctaaaggaggctcaattta

SEQ ID NO: 1225893 - DNA, 22 bp, Artificial Sequence
  chemically synthesized
taaaggaggctcaatttaaaca

SEQ ID NO: 1225894 - DNA, 22 bp, Artificial Sequence
  chemically synthesized
aaggaggctcaatttaaacaga

SEQ ID NO: 1225895 - DNA, 22 bp, Artificial Sequence
  chemically synthesized
aatttaaacagatgtatttgtg

SEQ ID NO: 1225896 - DNA, 22 bp, Artificial Sequence
  chemically synthesized
tatgcgcgcacacacacaaata

SEQ ID NO: 1225897 - DNA, 22 bp, Artificial Sequence
  chemically synthesized
aaacagatgtatttgtgtgtgt

SEQ ID NO: 1225898 - DNA, 22 bp, Artificial Sequence
  chemically synthesized
aacagatgtatttgtgtgtgtg

SEQ ID NO: 1225899 - DNA, 22 bp, Artificial Sequence
  chemically synthesized
tagttgtatgcgcgcacacaca

SEQ ID NO: 1225900 - DNA, 22 bp, Artificial Sequence
  chemically synthesized
atagttgtatgcgcgcacacac

SEQ ID NO: 1225901 - DNA, 22 bp, Artificial Sequence
  chemically synthesized
atttatagttgtatgcgcgcac

SEQ ID NO: 1225902 - DNA, 22 bp, Artificial Sequence
  chemically synthesized
gtgtgtgtgcgcgcatacaact

SEQ ID NO: 1225903 - DNA, 22 bp, Artificial Sequence
  chemically synthesized
tgtgtgtgcgcgcatacaacta

SEQ ID NO: 1225904 - DNA, 22 bp, Artificial Sequence
  chemically synthesized
aaaattgatttatagttgtatg

SEQ ID NO: 1225905 - DNA, 22 bp, Artificial Sequence
  chemically synthesized
aaaaattgatttatagttgtat

SEQ ID NO: 1225906 - DNA, 22 bp, Artificial Sequence
  chemically synthesized
taaaaattgatttatagttgta

SEQ ID NO: 1225907 - DNA, 22 bp, Artificial Sequence
  chemically synthesized
ttaaaaattgatttatagttgt

SEQ ID NO: 1225908 - DNA, 22 bp, Artificial Sequence
  chemically synthesized
cttttaaaaattgatttatagt

SEQ ID NO: 1225909 - DNA, 22 bp, Artificial Sequence
  chemically synthesized
ccttttaaaaattgatttatag

SEQ ID NO: 1225910 - DNA, 22 bp, Artificial Sequence
  chemically synthesized
tccttttaaaaattgatttata

SEQ ID NO: 1225911 - DNA, 22 bp, Artificial Sequence
  chemically synthesized
ttccttttaaaaattgatttat

SEQ ID NO: 1225912 - DNA, 22 bp, Artificial Sequence
  chemically synthesized
tttccttttaaaaattgattta

SEQ ID NO: 1225913 - DNA, 22 bp, Artificial Sequence
  chemically synthesized
ttttccttttaaaaattgattt

SEQ ID NO: 1225914 - DNA, 22 bp, Artificial Sequence
  chemically synthesized
aacttttttccttttaaaaatt

SEQ ID NO: 1225915 - DNA, 22 bp, Artificial Sequence
  chemically synthesized
caacttttttccttttaaaaat

SEQ ID NO: 1225916 - DNA, 22 bp, Artificial Sequence
  chemically synthesized
taaatcaatttttaaaaggaaa

SEQ ID NO: 1225917 - DNA, 22 bp, Artificial Sequence
  chemically synthesized
aaagacatttcaacttttttcc

SEQ ID NO: 1225918 - DNA, 22 bp, Artificial Sequence
  chemically synthesized
ctcaaagacatttcaacttttt

SEQ ID NO: 1225919 - DNA, 22 bp, Artificial Sequence
  chemically synthesized
ttaaaaggaaaaaagttgaaat

SEQ ID NO: 1225920 - DNA, 22 bp, Artificial Sequence
  chemically synthesized
taaaaggaaaaaagttgaaatg

SEQ ID NO: 1225921 - DNA, 22 bp, Artificial Sequence
  chemically synthesized
aaaaggaaaaaagttgaaatgt

SEQ ID NO: 1225922 - DNA, 22 bp, Artificial Sequence
  chemically synthesized
aaaggaaaaaagttgaaatgtc

SEQ ID NO: 1225923 - DNA, 22 bp, Artificial Sequence
  chemically synthesized
aaaatcactgctcaaagacatt

SEQ ID NO: 1225924 - DNA, 22 bp, Artificial Sequence
  chemically synthesized
aaaaatcactgctcaaagacat

SEQ ID NO: 1225925 - DNA, 22 bp, Artificial Sequence
  chemically synthesized
taaaaatcactgctcaaagaca

SEQ ID NO: 1225926 - DNA, 22 bp, Artificial Sequence
  chemically synthesized
ttaaaaatcactgctcaaagac

SEQ ID NO: 1225927 - DNA, 22 bp, Artificial Sequence
  chemically synthesized
gtcatttttaaaaatcactgct

SEQ ID NO: 1225928 - DNA, 22 bp, Artificial Sequence
  chemically synthesized
aaatgtctttgagcagtgattt

SEQ ID NO: 1225929 - DNA, 22 bp, Artificial Sequence
  chemically synthesized
ctagtcatttttaaaaatcact

SEQ ID NO: 1225930 - DNA, 22 bp, Artificial Sequence
  chemically synthesized
actcctagtcatttttaaaaat

SEQ ID NO: 1225931 - DNA, 22 bp, Artificial Sequence
  chemically synthesized
tgagcagtgatttttaaaaatg

SEQ ID NO: 1225932 - DNA, 22 bp, Artificial Sequence
  chemically synthesized
gagcagtgatttttaaaaatga

SEQ ID NO: 1225933 - DNA, 22 bp, Artificial Sequence
  chemically synthesized
agcagtgatttttaaaaatgac

SEQ ID NO: 1225934 - DNA, 22 bp, Artificial Sequence
  chemically synthesized
gcccagttaactcctagtcatt

SEQ ID NO: 1225935 - DNA, 22 bp, Artificial Sequence
  chemically synthesized
ggcccagttaactcctagtcat

SEQ ID NO: 1225936 - DNA, 22 bp, Artificial Sequence
  chemically synthesized
ttggcccagttaactcctagtc

SEQ ID NO: 1225937 - DNA, 22 bp, Artificial Sequence
  chemically synthesized
cttggcccagttaactcctagt

SEQ ID NO: 1225938 - DNA, 22 bp, Artificial Sequence
  chemically synthesized
ttaaaaatgactaggagttaac

SEQ ID NO: 1225939 - DNA, 22 bp, Artificial Sequence
  chemically synthesized
taaaaatgactaggagttaact

SEQ ID NO: 1225940 - DNA, 22 bp, Artificial Sequence
  chemically synthesized
aaaaatgactaggagttaactg

SEQ ID NO: 1225941 - DNA, 22 bp, Artificial Sequence
  chemically synthesized
aaaatgactaggagttaactgg

SEQ ID NO: 1225942 - DNA, 22 bp, Artificial Sequence
  chemically synthesized
ggagttaactgggccaagaagg

SEQ ID NO: 1225943 - DNA, 22 bp, Artificial Sequence
  chemically synthesized
catgtccatcatgccttcttgg

SEQ ID NO: 1225944 - DNA, 22 bp, Artificial Sequence
  chemically synthesized
actgggccaagaaggcatgatg

SEQ ID NO: 1225945 - DNA, 22 bp, Artificial Sequence
  chemically synthesized
ggccaagaaggcatgatggaca

SEQ ID NO: 1225946 - DNA, 22 bp, Artificial Sequence
  chemically synthesized
gtggtgcacctccatgtccatc

SEQ ID NO: 1225947 - DNA, 22 bp, Artificial Sequence
  chemically synthesized
ggtggtgcacctccatgtccat

SEQ ID NO: 1225948 - DNA, 22 bp, Artificial Sequence
  chemically synthesized
aaggtcaatcttggtggtgcac

SEQ ID NO: 1225949 - DNA, 22 bp, Artificial Sequence
  chemically synthesized
gaaggtcaatcttggtggtgca

SEQ ID NO: 1225950 - DNA, 22 bp, Artificial Sequence
  chemically synthesized
cttgaaggtcaatcttggtggt

SEQ ID NO: 1225951 - DNA, 22 bp, Artificial Sequence
  chemically synthesized
ccttgaaggtcaatcttggtgg

SEQ ID NO: 1225952 - DNA, 22 bp, Artificial Sequence
  chemically synthesized
gagcaacaagcccttccttgaa

SEQ ID NO: 1225953 - DNA, 22 bp, Artificial Sequence
  chemically synthesized
accttcaaggaagggcttgttg

SEQ ID NO: 1225954 - DNA, 22 bp, Artificial Sequence
  chemically synthesized
accacagctggagcaacaagcc

SEQ ID NO: 1225955 - DNA, 22 bp, Artificial Sequence
  chemically synthesized
caaggaagggcttgttgctcca

SEQ ID NO: 1225956 - DNA, 22 bp, Artificial Sequence
  chemically synthesized
cctgaccacagctggagcaaca

SEQ ID NO: 1225957 - DNA, 22 bp, Artificial Sequence
  chemically synthesized
aaggaagggcttgttgctccag

SEQ ID NO: 1225958 - DNA, 22 bp, Artificial Sequence
  chemically synthesized
gaagctgcctgaccacagctgg

SEQ ID NO: 1225959 - DNA, 22 bp, Artificial Sequence
  chemically synthesized
gttgctccagctgtggtcaggc

SEQ ID NO: 1225960 - DNA, 22 bp, Artificial Sequence
  chemically synthesized
ttgctccagctgtggtcaggca

SEQ ID NO: 1225961 - DNA, 22 bp, Artificial Sequence
  chemically synthesized
acaactagaagctgcctgacca

SEQ ID NO: 1225962 - DNA, 22 bp, Artificial Sequence
  chemically synthesized
ctccagctgtggtcaggcagct

SEQ ID NO: 1225963 - DNA, 22 bp, Artificial Sequence
  chemically synthesized
cagctgtggtcaggcagcttct

SEQ ID NO: 1225964 - DNA, 22 bp, Artificial Sequence
  chemically synthesized
agagaactaacaactagaagct

SEQ ID NO: 1225965 - DNA, 22 bp, Artificial Sequence
  chemically synthesized
tggtcaggcagcttctagttgt

SEQ ID NO: 1225966 - DNA, 22 bp, Artificial Sequence
  chemically synthesized
aggtggtacctgagagaactaa

SEQ ID NO: 1225967 - DNA, 22 bp, Artificial Sequence
  chemically synthesized
ctagttgttagttctctcaggt

SEQ ID NO: 1225968 - DNA, 22 bp, Artificial Sequence
  chemically synthesized
tagttgttagttctctcaggta

SEQ ID NO: 1225969 - DNA, 22 bp, Artificial Sequence
  chemically synthesized
caactcaggtggtacctgagag

SEQ ID NO: 1225970 - DNA, 22 bp, Artificial Sequence
  chemically synthesized
gttgttagttctctcaggtacc

SEQ ID NO: 1225971 - DNA, 22 bp, Artificial Sequence
  chemically synthesized
tgcaactcaggtggtacctgag

SEQ ID NO: 1225972 - DNA, 22 bp, Artificial Sequence
  chemically synthesized
ttagttctctcaggtaccacct

SEQ ID NO: 1225973 - DNA, 22 bp, Artificial Sequence
  chemically synthesized
gttctctcaggtaccacctgag

SEQ ID NO: 1225974 - DNA, 22 bp, Artificial Sequence
  chemically synthesized
gcaggactctgcaactcaggtg

SEQ ID NO: 1225975 - DNA, 22 bp, Artificial Sequence
  chemically synthesized
tctcaggtaccacctgagttgc

SEQ ID NO: 1225976 - DNA, 22 bp, Artificial Sequence
  chemically synthesized
tcaggtaccacctgagttgcag

SEQ ID NO: 1225977 - DNA, 22 bp, Artificial Sequence
  chemically synthesized
gctggcaggactctgcaactca

SEQ ID NO: 1225978 - DNA, 22 bp, Artificial Sequence
  chemically synthesized
aggtaccacctgagttgcagag

SEQ ID NO: 1225979 - DNA, 22 bp, Artificial Sequence
  chemically synthesized
agttgcagagtcctgccagcca

SEQ ID NO: 1225980 - DNA, 22 bp, Artificial Sequence
  chemically synthesized
gagagggtgtgacattggctgg

SEQ ID NO: 1225981 - DNA, 22 bp, Artificial Sequence
  chemically synthesized
cagagtcctgccagccaatgtc

SEQ ID NO: 1225982 - DNA, 22 bp, Artificial Sequence
  chemically synthesized
ccctagagagggtgtgacattg

SEQ ID NO: 1225983 - DNA, 22 bp, Artificial Sequence
  chemically synthesized
ccagccaatgtcacaccctctc

SEQ ID NO: 1225984 - DNA, 22 bp, Artificial Sequence
  chemically synthesized
atcagtcaatagtagtgggttg

SEQ ID NO: 1225985 - DNA, 22 bp, Artificial Sequence
  chemically synthesized
catcagtcaatagtagtgggtt

SEQ ID NO: 1225986 - DNA, 22 bp, Artificial Sequence
  chemically synthesized
tctagggcaacccactactatt

SEQ ID NO: 1225987 - DNA, 22 bp, Artificial Sequence
  chemically synthesized
tagggcaacccactactattga

SEQ ID NO: 1225988 - DNA, 22 bp, Artificial Sequence
  chemically synthesized
ccccttcatcagtcaatagtag

SEQ ID NO: 1225989 - DNA, 22 bp, Artificial Sequence
  chemically synthesized
gggcaacccactactattgact

SEQ ID NO: 1225990 - DNA, 22 bp, Artificial Sequence
  chemically synthesized
tgccccttcatcagtcaatagt

SEQ ID NO: 1225991 - DNA, 22 bp, Artificial Sequence
  chemically synthesized
tactctgccccttcatcagtca

SEQ ID NO: 1225992 - DNA, 22 bp, Artificial Sequence
  chemically synthesized
atactctgccccttcatcagtc

SEQ ID NO: 1225993 - DNA, 22 bp, Artificial Sequence
  chemically synthesized
ctattgactgatgaaggggcag

SEQ ID NO: 1225994 - DNA, 22 bp, Artificial Sequence
  chemically synthesized
agtgtttatactctgccccttc

SEQ ID NO: 1225995 - DNA, 22 bp, Artificial Sequence
  chemically synthesized
ttgactgatgaaggggcagagt

SEQ ID NO: 1225996 - DNA, 22 bp, Artificial Sequence
  chemically synthesized
actgatgaaggggcagagtata

SEQ ID NO: 1225997 - DNA, 22 bp, Artificial Sequence
  chemically synthesized
aaatggctgagtgtttatactc

SEQ ID NO: 1225998 - DNA, 22 bp, Artificial Sequence
  chemically synthesized
atgaaggggcagagtataaaca

SEQ ID NO: 1225999 - DNA, 22 bp, Artificial Sequence
  chemically synthesized
aaatggggttaaaatggctgag

SEQ ID NO: 1226000 - DNA, 22 bp, Artificial Sequence
  chemically synthesized
tctcaaatggggttaaaatggc

SEQ ID NO: 1226001 - DNA, 22 bp, Artificial Sequence
  chemically synthesized
agagttgtctcaaatggggtta

SEQ ID NO: 1226002 - DNA, 22 bp, Artificial Sequence
  chemically synthesized
agccattttaaccccatttgag

SEQ ID NO: 1226003 - DNA, 22 bp, Artificial Sequence
  chemically synthesized
taaccccatttgagacaactct

SEQ ID NO: 1226004 - DNA, 22 bp, Artificial Sequence
  chemically synthesized
ggatgacccctcagagttgtct

SEQ ID NO: 1226005 - DNA, 22 bp, Artificial Sequence
  chemically synthesized
aaccccatttgagacaactctg

SEQ ID NO: 1226006 - DNA, 22 bp, Artificial Sequence
  chemically synthesized
accccatttgagacaactctga

SEQ ID NO: 1226007 - DNA, 22 bp, Artificial Sequence
  chemically synthesized
cagctaggatgacccctcagag

SEQ ID NO: 1226008 - DNA, 22 bp, Artificial Sequence
  chemically synthesized
gcagctaggatgacccctcaga

SEQ ID NO: 1226009 - DNA, 22 bp, Artificial Sequence
  chemically synthesized
gagacaactctgaggggtcatc

SEQ ID NO: 1226010 - DNA, 22 bp, Artificial Sequence
  chemically synthesized
agacaactctgaggggtcatcc

SEQ ID NO: 1226011 - DNA, 22 bp, Artificial Sequence
  chemically synthesized
tgaggggtcatcctagctgcaa

SEQ ID NO: 1226012 - DNA, 22 bp, Artificial Sequence
  chemically synthesized
aggggtcatcctagctgcaagt

SEQ ID NO: 1226013 - DNA, 22 bp, Artificial Sequence
  chemically synthesized
aaaccccatagacaacttgcag

SEQ ID NO: 1226014 - DNA, 22 bp, Artificial Sequence
  chemically synthesized
ttcaaaccccatagacaacttg

SEQ ID NO: 1226015 - DNA, 22 bp, Artificial Sequence
  chemically synthesized
attcaaaccccatagacaactt

SEQ ID NO: 1226016 - DNA, 22 bp, Artificial Sequence
  chemically synthesized
gctgcaagttgtctatggggtt

SEQ ID NO: 1226017 - DNA, 22 bp, Artificial Sequence
  chemically synthesized
tgacacgcttattcaaacccca

SEQ ID NO: 1226018 - DNA, 22 bp, Artificial Sequence
  chemically synthesized
caagttgtctatggggtttgaa

SEQ ID NO: 1226019 - DNA, 22 bp, Artificial Sequence
  chemically synthesized
tctatggggtttgaataagcgt

SEQ ID NO: 1226020 - DNA, 22 bp, Artificial Sequence
  chemically synthesized
tggggtttgaataagcgtgtca

SEQ ID NO: 1226021 - DNA, 22 bp, Artificial Sequence
  chemically synthesized
tgacgtagaccctatgacacgc

SEQ ID NO: 1226022 - DNA, 22 bp, Artificial Sequence
  chemically synthesized
gaataagcgtgtcatagggtct

SEQ ID NO: 1226023 - DNA, 22 bp, Artificial Sequence
  chemically synthesized
gagctgtgacgtagaccctatg

SEQ ID NO: 1226024 - DNA, 22 bp, Artificial Sequence
  chemically synthesized
aataagcgtgtcatagggtcta

SEQ ID NO: 1226025 - DNA, 22 bp, Artificial Sequence
  chemically synthesized
cgtcacagctctagttcttcct

SEQ ID NO: 1226026 - DNA, 22 bp, Artificial Sequence
  chemically synthesized
tagttcttcctctttccactcc

SEQ ID NO: 1226027 - DNA, 22 bp, Artificial Sequence
  chemically synthesized
gttcttcctctttccactcctg

SEQ ID NO: 1226028 - DNA, 22 bp, Artificial Sequence
  chemically synthesized
ttcctctttccactcctgtcac

SEQ ID NO: 1226029 - DNA, 22 bp, Artificial Sequence
  chemically synthesized
tagaagggcagaggtgacagga

SEQ ID NO: 1226030 - DNA, 22 bp, Artificial Sequence
  chemically synthesized
cctctttccactcctgtcacct

SEQ ID NO: 1226031 - DNA, 22 bp, Artificial Sequence
  chemically synthesized
ctctttccactcctgtcacctc

SEQ ID NO: 1226032 - DNA, 22 bp, Artificial Sequence
  chemically synthesized
tttccactcctgtcacctctgc

SEQ ID NO: 1226033 - DNA, 22 bp, Artificial Sequence
  chemically synthesized
tccactcctgtcacctctgccc

SEQ ID NO: 1226034 - DNA, 22 bp, Artificial Sequence
  chemically synthesized
ccactcctgtcacctctgccct

SEQ ID NO: 1226035 - DNA, 22 bp, Artificial Sequence
  chemically synthesized
cactcctgtcacctctgccctt

SEQ ID NO: 1226036 - DNA, 22 bp, Artificial Sequence
  chemically synthesized
ctgtcacctctgcccttctaca

SEQ ID NO: 1226037 - DNA, 22 bp, Artificial Sequence
  chemically synthesized
tcacctctgcccttctacaggt

SEQ ID NO: 1226038 - DNA, 22 bp, Artificial Sequence
  chemically synthesized
tgcccttctacaggtgtttttt

SEQ ID NO: 1226039 - DNA, 22 bp, Artificial Sequence
  chemically synthesized
cccttctacaggtgtttttttt

SEQ ID NO: 1226040 - DNA, 22 bp, Artificial Sequence
  chemically synthesized
gaaaaaaaaaaaaaaaaaaaaa

SEQ ID NO: 1226041 - DNA, 22 bp, Artificial Sequence
  chemically synthesized
ctacaggtgttttttttttttt

SEQ ID NO: 1226042 - DNA, 22 bp, Artificial Sequence
  chemically synthesized
tacaggtgtttttttttttttt

SEQ ID NO: 1226043 - DNA, 22 bp, Artificial Sequence
  chemically synthesized
caggtgtttttttttttttttt

SEQ ID NO: 1226044 - DNA, 22 bp, Artificial Sequence
  chemically synthesized
agccatgccctggaaaaaaaaa

SEQ ID NO: 1226045 - DNA, 22 bp, Artificial Sequence
  chemically synthesized
ttttttttttttttttttccag

SEQ ID NO: 1226046 - DNA, 22 bp, Artificial Sequence
  chemically synthesized
ttaagccatgccctggaaaaaa

SEQ ID NO: 1226047 - DNA, 22 bp, Artificial Sequence
  chemically synthesized
tttttttttttttttttccagg

SEQ ID NO: 1226048 - DNA, 22 bp, Artificial Sequence
  chemically synthesized
attaagccatgccctggaaaaa

SEQ ID NO: 1226049 - DNA, 22 bp, Artificial Sequence
  chemically synthesized
ttttttttttttttttccaggg

SEQ ID NO: 1226050 - DNA, 22 bp, Artificial Sequence
  chemically synthesized
tttttttttttttttccagggc

SEQ ID NO: 1226051 - DNA, 22 bp, Artificial Sequence
  chemically synthesized
ttttttttttttttccagggca

SEQ ID NO: 1226052 - DNA, 22 bp, Artificial Sequence
  chemically synthesized
tttttttttttttccagggcat

SEQ ID NO: 1226053 - DNA, 22 bp, Artificial Sequence
  chemically synthesized
ttttttttttttccagggcatg

SEQ ID NO: 1226054 - DNA, 22 bp, Artificial Sequence
  chemically synthesized
tttttttttttccagggcatgg

SEQ ID NO: 1226055 - DNA, 22 bp, Artificial Sequence
  chemically synthesized
ttttttttttccagggcatggc

SEQ ID NO: 1226056 - DNA, 22 bp, Artificial Sequence
  chemically synthesized
tttttttttccagggcatggct

SEQ ID NO: 1226057 - DNA, 22 bp, Artificial Sequence
  chemically synthesized
ttttttttccagggcatggctt

SEQ ID NO: 1226058 - DNA, 22 bp, Artificial Sequence
  chemically synthesized
tttttttccagggcatggctta

SEQ ID NO: 1226059 - DNA, 22 bp, Artificial Sequence
  chemically synthesized
ttttttccagggcatggcttaa

SEQ ID NO: 1226060 - DNA, 22 bp, Artificial Sequence
  chemically synthesized
tttttccagggcatggcttaat

SEQ ID NO: 1226061 - DNA, 22 bp, Artificial Sequence
  chemically synthesized
ttttccagggcatggcttaata

SEQ ID NO: 1226062 - DNA, 22 bp, Artificial Sequence
  chemically synthesized
tttccagggcatggcttaataa

SEQ ID NO: 1226063 - DNA, 22 bp, Artificial Sequence
  chemically synthesized
ttccagggcatggcttaataaa

SEQ ID NO: 1226064 - DNA, 22 bp, Artificial Sequence
  chemically synthesized
gcaggcagcatgtttattaagc

SEQ ID NO: 1226065 - DNA, 22 bp, Artificial Sequence
  chemically synthesized
tccagggcatggcttaataaac

SEQ ID NO: 1226066 - DNA, 22 bp, Artificial Sequence
  chemically synthesized
ggcaggcagcatgtttattaag

SEQ ID NO: 1226067 - DNA, 22 bp, Artificial Sequence
  chemically synthesized
ccagggcatggcttaataaaca

SEQ ID NO: 1226068 - DNA, 22 bp, Artificial Sequence
  chemically synthesized
cagggcatggcttaataaacat

SEQ ID NO: 1226069 - DNA, 22 bp, Artificial Sequence
  chemically synthesized
agtttggcaggcagcatgttta

SEQ ID NO: 1226070 - DNA, 22 bp, Artificial Sequence
  chemically synthesized
ggagttgagtttggcaggcagc

SEQ ID NO: 1226071 - DNA, 22 bp, Artificial Sequence
  chemically synthesized
cggagttgagtttggcaggcag

SEQ ID NO: 1226072 - DNA, 22 bp, Artificial Sequence
  chemically synthesized
aataaacatgctgcctgccaaa

SEQ ID NO: 1226073 - DNA, 22 bp, Artificial Sequence
  chemically synthesized
ataaacatgctgcctgccaaac

SEQ ID NO: 1226074 - DNA, 22 bp, Artificial Sequence
  chemically synthesized
gggagtagacttcggagttgag

SEQ ID NO: 1226075 - DNA, 22 bp, Artificial Sequence
  chemically synthesized
tggggagtagacttcggagttg

SEQ ID NO: 1226076 - DNA, 22 bp, Artificial Sequence
  chemically synthesized
cctgccaaactcaactccgaag

SEQ ID NO: 1226077 - DNA, 22 bp, Artificial Sequence
  chemically synthesized
ccaaactcaactccgaagtcta

SEQ ID NO: 1226078 - DNA, 22 bp, Artificial Sequence
  chemically synthesized
ggttctggggagtagacttcgg

SEQ ID NO: 1226079 - DNA, 22 bp, Artificial Sequence
  chemically synthesized
aactccgaagtctactccccag

SEQ ID NO: 1226080 - DNA, 22 bp, Artificial Sequence
  chemically synthesized
atcacagtctgggttctgggga

SEQ ID NO: 1226081 - DNA, 22 bp, Artificial Sequence
  chemically synthesized
aatcacagtctgggttctgggg

SEQ ID NO: 1226082 - DNA, 22 bp, Artificial Sequence
  chemically synthesized
cgaagtctactccccagaaccc

SEQ ID NO: 1226083 - DNA, 22 bp, Artificial Sequence
  chemically synthesized
taatcacagtctgggttctggg

SEQ ID NO: 1226084 - DNA, 22 bp, Artificial Sequence
  chemically synthesized
ttaatcacagtctgggttctgg

SEQ ID NO: 1226085 - DNA, 22 bp, Artificial Sequence
  chemically synthesized
ttttaatcacagtctgggttct

SEQ ID NO: 1226086 - DNA, 22 bp, Artificial Sequence
  chemically synthesized
cttttaatcacagtctgggttc

SEQ ID NO: 1226087 - DNA, 22 bp, Artificial Sequence
  chemically synthesized
ctccccagaacccagactgtga

SEQ ID NO: 1226088 - DNA, 22 bp, Artificial Sequence
  chemically synthesized
caacttcttttaatcacagtct

SEQ ID NO: 1226089 - DNA, 22 bp, Artificial Sequence
  chemically synthesized
cccagaacccagactgtgatta

SEQ ID NO: 1226090 - DNA, 22 bp, Artificial Sequence
  chemically synthesized
ctgcaacttcttttaatcacag

SEQ ID NO: 1226091 - DNA, 22 bp, Artificial Sequence
  chemically synthesized
tgctgcaacttcttttaatcac

SEQ ID NO: 1226092 - DNA, 22 bp, Artificial Sequence
  chemically synthesized
ctctgctgcaacttcttttaat

SEQ ID NO: 1226093 - DNA, 22 bp, Artificial Sequence
  chemically synthesized
ttcctctgctgcaacttctttt

SEQ ID NO: 1226094 - DNA, 22 bp, Artificial Sequence
  chemically synthesized
tattcctctgctgcaacttctt

SEQ ID NO: 1226095 - DNA, 22 bp, Artificial Sequence
  chemically synthesized
ctattcctctgctgcaacttct

SEQ ID NO: 1226096 - DNA, 22 bp, Artificial Sequence
  chemically synthesized
tgattaaaagaagttgcagcag

SEQ ID NO: 1226097 - DNA, 22 bp, Artificial Sequence
  chemically synthesized
atttctattcctctgctgcaac

SEQ ID NO: 1226098 - DNA, 22 bp, Artificial Sequence
  chemically synthesized
catttctattcctctgctgcaa

SEQ ID NO: 1226099 - DNA, 22 bp, Artificial Sequence
  chemically synthesized
ttcatttctattcctctgctgc

SEQ ID NO: 1226100 - DNA, 22 bp, Artificial Sequence
  chemically synthesized
aaagaagttgcagcagaggaat

SEQ ID NO: 1226101 - DNA, 22 bp, Artificial Sequence
  chemically synthesized
ccctcttcatttctattcctct

SEQ ID NO: 1226102 - DNA, 22 bp, Artificial Sequence
  chemically synthesized
ctaccctcttcatttctattcc

SEQ ID NO: 1226103 - DNA, 22 bp, Artificial Sequence
  chemically synthesized
ttcctaccctcttcatttctat

SEQ ID NO: 1226104 - DNA, 22 bp, Artificial Sequence
  chemically synthesized
cagcagaggaatagaaatgaag

SEQ ID NO: 1226105 - DNA, 22 bp, Artificial Sequence
  chemically synthesized
ccatataagattattcctaccc

SEQ ID NO: 1226106 - DNA, 22 bp, Artificial Sequence
  chemically synthesized
accatataagattattcctacc

SEQ ID NO: 1226107 - DNA, 22 bp, Artificial Sequence
  chemically synthesized
tccttaccatataagattattc

SEQ ID NO: 1226108 - DNA, 22 bp, Artificial Sequence
  chemically synthesized
acagaaactatccttaccatat

SEQ ID NO: 1226109 - DNA, 22 bp, Artificial Sequence
  chemically synthesized
cacagaaactatccttaccata

SEQ ID NO: 1226110 - DNA, 22 bp, Artificial Sequence
  chemically synthesized
cagagcttcacagaaactatcc

SEQ ID NO: 1226111 - DNA, 22 bp, Artificial Sequence
  chemically synthesized
tgcagagcttcacagaaactat

SEQ ID NO: 1226112 - DNA, 22 bp, Artificial Sequence
  chemically synthesized
atatggtaaggatagtttctgt

SEQ ID NO: 1226113 - DNA, 22 bp, Artificial Sequence
  chemically synthesized
ctgcagagcttcacagaaacta

SEQ ID NO: 1226114 - DNA, 22 bp, Artificial Sequence
  chemically synthesized
tatggtaaggatagtttctgtg

SEQ ID NO: 1226115 - DNA, 22 bp, Artificial Sequence
  chemically synthesized
ttctgcagagcttcacagaaac

SEQ ID NO: 1226116 - DNA, 22 bp, Artificial Sequence
  chemically synthesized
ctcttctgcagagcttcacaga

SEQ ID NO: 1226117 - DNA, 22 bp, Artificial Sequence
  chemically synthesized
tgctcttctgcagagcttcaca

SEQ ID NO: 1226118 - DNA, 22 bp, Artificial Sequence
  chemically synthesized
ctctgctcttctgcagagcttc

SEQ ID NO: 1226119 - DNA, 22 bp, Artificial Sequence
  chemically synthesized
gctctgctcttctgcagagctt

SEQ ID NO: 1226120 - DNA, 22 bp, Artificial Sequence
  chemically synthesized
ttgctctgctcttctgcagagc

SEQ ID NO: 1226121 - DNA, 22 bp, Artificial Sequence
  chemically synthesized
ctgtgaagctctgcagaagagc

SEQ ID NO: 1226122 - DNA, 22 bp, Artificial Sequence
  chemically synthesized
tgtgaagctctgcagaagagca

SEQ ID NO: 1226123 - DNA, 22 bp, Artificial Sequence
  chemically synthesized
tgaagctctgcagaagagcaga

SEQ ID NO: 1226124 - DNA, 22 bp, Artificial Sequence
  chemically synthesized
tgcaagacagttcttgctctgc

SEQ ID NO: 1226125 - DNA, 22 bp, Artificial Sequence
  chemically synthesized
tgtgcaagacagttcttgctct

SEQ ID NO: 1226126 - DNA, 22 bp, Artificial Sequence
  chemically synthesized
tgcagaagagcagagcaagaac

SEQ ID NO: 1226127 - DNA, 22 bp, Artificial Sequence
  chemically synthesized
ctgtgcaagacagttcttgctc

SEQ ID NO: 1226128 - DNA, 22 bp, Artificial Sequence
  chemically synthesized
cagaagagcagagcaagaactg

SEQ ID NO: 1226129 - DNA, 22 bp, Artificial Sequence
  chemically synthesized
ccaagtcacttctgtgcaagac

SEQ ID NO: 1226130 - DNA, 22 bp, Artificial Sequence
  chemically synthesized
cctaccaagtcacttctgtgca

SEQ ID NO: 1226131 - DNA, 22 bp, Artificial Sequence
  chemically synthesized
ctgcctaccaagtcacttctgt

SEQ ID NO: 1226132 - DNA, 22 bp, Artificial Sequence
  chemically synthesized
tcttgcacagaagtgacttggt

SEQ ID NO: 1226133 - DNA, 22 bp, Artificial Sequence
  chemically synthesized
taaattcctgcctaccaagtca

SEQ ID NO: 1226134 - DNA, 22 bp, Artificial Sequence
  chemically synthesized
gcacagaagtgacttggtaggc

SEQ ID NO: 1226135 - DNA, 22 bp, Artificial Sequence
  chemically synthesized
cacagaagtgacttggtaggca

SEQ ID NO: 1226136 - DNA, 22 bp, Artificial Sequence
  chemically synthesized
aaagccatccctgtaaattcct

SEQ ID NO: 1226137 - DNA, 22 bp, Artificial Sequence
  chemically synthesized
ctgaaagccatccctgtaaatt

SEQ ID NO: 1226138 - DNA, 22 bp, Artificial Sequence
  chemically synthesized
ggtaggcaggaatttacaggga

SEQ ID NO: 1226139 - DNA, 22 bp, Artificial Sequence
  chemically synthesized
gtaggcaggaatttacagggat

SEQ ID NO: 1226140 - DNA, 22 bp, Artificial Sequence
  chemically synthesized
gcactgctgaaagccatccctg

SEQ ID NO: 1226141 - DNA, 22 bp, Artificial Sequence
  chemically synthesized
acagggatggctttcagcagtg

SEQ ID NO: 1226142 - DNA, 22 bp, Artificial Sequence
  chemically synthesized
cagggatggctttcagcagtgc

SEQ ID NO: 1226143 - DNA, 22 bp, Artificial Sequence
  chemically synthesized
caggagaatgatgacgttcgca

SEQ ID NO: 1226144 - DNA, 22 bp, Artificial Sequence
  chemically synthesized
tcagcagtgcgaacgtcatcat

SEQ ID NO: 1226145 - DNA, 22 bp, Artificial Sequence
  chemically synthesized
cagcagtgcgaacgtcatcatt

SEQ ID NO: 1226146 - DNA, 22 bp, Artificial Sequence
  chemically synthesized
caattacaggagaatgatgacg

SEQ ID NO: 1226147 - DNA, 22 bp, Artificial Sequence
  chemically synthesized
agcagtgcgaacgtcatcattc

SEQ ID NO: 1226148 - DNA, 22 bp, Artificial Sequence
  chemically synthesized
gcaattacaggagaatgatgac

SEQ ID NO: 1226149 - DNA, 22 bp, Artificial Sequence
  chemically synthesized
atacaatttgcaattacaggag

SEQ ID NO: 1226150 - DNA, 22 bp, Artificial Sequence
  chemically synthesized
ttgatacaatttgcaattacag

SEQ ID NO: 1226151 - DNA, 22 bp, Artificial Sequence
  chemically synthesized
atattattgatacaatttgcaa

SEQ ID NO: 1226152 - DNA, 22 bp, Artificial Sequence
  chemically synthesized
tcctgtaattgcaaattgtatc

SEQ ID NO: 1226153 - DNA, 22 bp, Artificial Sequence
  chemically synthesized
ctgtaattgcaaattgtatcaa

SEQ ID NO: 1226154 - DNA, 22 bp, Artificial Sequence
  chemically synthesized
gaatgttcatattattgataca

SEQ ID NO: 1226155 - DNA, 22 bp, Artificial Sequence
  chemically synthesized
taattgcaaattgtatcaataa

SEQ ID NO: 1226156 - DNA, 22 bp, Artificial Sequence
  chemically synthesized
agaatgttcatattattgatac

SEQ ID NO: 1226157 - DNA, 22 bp, Artificial Sequence
  chemically synthesized
tagaatgttcatattattgata

SEQ ID NO: 1226158 - DNA, 22 bp, Artificial Sequence
  chemically synthesized
actttagaatgttcatattatt

SEQ ID NO: 1226159 - DNA, 22 bp, Artificial Sequence
  chemically synthesized
caaattgtatcaataatatgaa

SEQ ID NO: 1226160 - DNA, 22 bp, Artificial Sequence
  chemically synthesized
attcactttagaatgttcatat

SEQ ID NO: 1226161 - DNA, 22 bp, Artificial Sequence
  chemically synthesized
tatcaataatatgaacattcta

SEQ ID NO: 1226162 - DNA, 22 bp, Artificial Sequence
  chemically synthesized
atggcaacgctaattcacttta

SEQ ID NO: 1226163 - DNA, 22 bp, Artificial Sequence
  chemically synthesized
aatggcaacgctaattcacttt

SEQ ID NO: 1226164 - DNA, 22 bp, Artificial Sequence
  chemically synthesized
taaagtgaattagcgttgccat

SEQ ID NO: 1226165 - DNA, 22 bp, Artificial Sequence
  chemically synthesized
aagtgaattagcgttgccatta

SEQ ID NO: 1226166 - DNA, 22 bp, Artificial Sequence
  chemically synthesized
aagggatgtacttaatggcaac

SEQ ID NO: 1226167 - DNA, 22 bp, Artificial Sequence
  chemically synthesized
gacaattcaagggatgtactta

SEQ ID NO: 1226168 - DNA, 22 bp, Artificial Sequence
  chemically synthesized
gcgttgccattaagtacatccc

SEQ ID NO: 1226169 - DNA, 22 bp, Artificial Sequence
  chemically synthesized
ctggacaattcaagggatgtac

SEQ ID NO: 1226170 - DNA, 22 bp, Artificial Sequence
  chemically synthesized
actggacaattcaagggatgta

SEQ ID NO: 1226171 - DNA, 22 bp, Artificial Sequence
  chemically synthesized
tactggacaattcaagggatgt

SEQ ID NO: 1226172 - DNA, 22 bp, Artificial Sequence
  chemically synthesized
ttactggacaattcaagggatg

SEQ ID NO: 1226173 - DNA, 22 bp, Artificial Sequence
  chemically synthesized
ccattaagtacatcccttgaat

SEQ ID NO: 1226174 - DNA, 22 bp, Artificial Sequence
  chemically synthesized
agtacatcccttgaattgtcca

SEQ ID NO: 1226175 - DNA, 22 bp, Artificial Sequence
  chemically synthesized
gaattgtccagtaaaagtatgg

SEQ ID NO: 1226176 - DNA, 22 bp, Artificial Sequence
  chemically synthesized
aattgtccagtaaaagtatgga

SEQ ID NO: 1226177 - DNA, 22 bp, Artificial Sequence
  chemically synthesized
tcagaagtcaggtccatacttt

SEQ ID NO: 1226178 - DNA, 22 bp, Artificial Sequence
  chemically synthesized
tccagtaaaagtatggacctga

SEQ ID NO: 1226179 - DNA, 22 bp, Artificial Sequence
  chemically synthesized
acagtggtgagctatcagaagt

SEQ ID NO: 1226180 - DNA, 22 bp, Artificial Sequence
  chemically synthesized
ctaacagtggtgagctatcaga

SEQ ID NO: 1226181 - DNA, 22 bp, Artificial Sequence
  chemically synthesized
gctaacagtggtgagctatcag

SEQ ID NO: 1226182 - DNA, 22 bp, Artificial Sequence
  chemically synthesized
acttctgatagctcaccactgt

SEQ ID NO: 1226183 - DNA, 22 bp, Artificial Sequence
  chemically synthesized
ctgatagctcaccactgttagc

SEQ ID NO: 1226184 - DNA, 22 bp, Artificial Sequence
  chemically synthesized
tgatagctcaccactgttagca

SEQ ID NO: 1226185 - DNA, 22 bp, Artificial Sequence
  chemically synthesized
taataacaaatcttgctaacag

SEQ ID NO: 1226186 - DNA, 22 bp, Artificial Sequence
  chemically synthesized
atagctcaccactgttagcaag

SEQ ID NO: 1226187 - DNA, 22 bp, Artificial Sequence
  chemically synthesized
gttgtaataacaaatcttgcta

SEQ ID NO: 1226188 - DNA, 22 bp, Artificial Sequence
  chemically synthesized
accactgttagcaagatttgtt

SEQ ID NO: 1226189 - DNA, 22 bp, Artificial Sequence
  chemically synthesized
ttagcaagatttgttattacaa

SEQ ID NO: 1226190 - DNA, 22 bp, Artificial Sequence
  chemically synthesized
gcaaccagctggttgtaataac

SEQ ID NO: 1226191 - DNA, 22 bp, Artificial Sequence
  chemically synthesized
tggcaaccagctggttgtaata

SEQ ID NO: 1226192 - DNA, 22 bp, Artificial Sequence
  chemically synthesized
gcaagatttgttattacaacca

SEQ ID NO: 1226193 - DNA, 22 bp, Artificial Sequence
  chemically synthesized
gctctggcaaccagctggttgt

SEQ ID NO: 1226194 - DNA, 22 bp, Artificial Sequence
  chemically synthesized
ggctctggcaaccagctggttg

SEQ ID NO: 1226195 - DNA, 22 bp, Artificial Sequence
  chemically synthesized
gttattacaaccagctggttgc

SEQ ID NO: 1226196 - DNA, 22 bp, Artificial Sequence
  chemically synthesized
aacttggctctggcaaccagct

SEQ ID NO: 1226197 - DNA, 22 bp, Artificial Sequence
  chemically synthesized
ttattacaaccagctggttgcc

SEQ ID NO: 1226198 - DNA, 22 bp, Artificial Sequence
  chemically synthesized
ttacaaccagctggttgccaga

SEQ ID NO: 1226199 - DNA, 22 bp, Artificial Sequence
  chemically synthesized
caaccagctggttgccagagcc

SEQ ID NO: 1226200 - DNA, 22 bp, Artificial Sequence
  chemically synthesized
ggagtgctaaacttggctctgg

SEQ ID NO: 1226201 - DNA, 22 bp, Artificial Sequence
  chemically synthesized
cggagtgctaaacttggctctg

SEQ ID NO: 1226202 - DNA, 22 bp, Artificial Sequence
  chemically synthesized
tcggagtgctaaacttggctct

SEQ ID NO: 1226203 - DNA, 22 bp, Artificial Sequence
  chemically synthesized
ttcggagtgctaaacttggctc

SEQ ID NO: 1226204 - DNA, 22 bp, Artificial Sequence
  chemically synthesized
tttcggagtgctaaacttggct

SEQ ID NO: 1226205 - DNA, 22 bp, Artificial Sequence
  chemically synthesized
ttttcggagtgctaaacttggc

SEQ ID NO: 1226206 - DNA, 22 bp, Artificial Sequence
  chemically synthesized
tttttcggagtgctaaacttgg

SEQ ID NO: 1226207 - DNA, 22 bp, Artificial Sequence
  chemically synthesized
ttttttcggagtgctaaacttg

SEQ ID NO: 1226208 - DNA, 22 bp, Artificial Sequence
  chemically synthesized
gttgccagagccaagtttagca

SEQ ID NO: 1226209 - DNA, 22 bp, Artificial Sequence
  chemically synthesized
tttttttcggagtgctaaactt

SEQ ID NO: 1226210 - DNA, 22 bp, Artificial Sequence
  chemically synthesized
tttttttttcggagtgctaaac

SEQ ID NO: 1226211 - DNA, 22 bp, Artificial Sequence
  chemically synthesized
ccagagccaagtttagcactcc

SEQ ID NO: 1226212 - DNA, 22 bp, Artificial Sequence
  chemically synthesized
agtgcaattctttttttttcgg

SEQ ID NO: 1226213 - DNA, 22 bp, Artificial Sequence
  chemically synthesized
aagtgcaattctttttttttcg

SEQ ID NO: 1226214 - DNA, 22 bp, Artificial Sequence
  chemically synthesized
ttaagtgcaattcttttttttt

SEQ ID NO: 1226215 - DNA, 22 bp, Artificial Sequence
  chemically synthesized
cttaagtgcaattctttttttt

SEQ ID NO: 1226216 - DNA, 22 bp, Artificial Sequence
  chemically synthesized
agcactccgaaaaaaaaagaat

SEQ ID NO: 1226217 - DNA, 22 bp, Artificial Sequence
  chemically synthesized
gcactccgaaaaaaaaagaatt

SEQ ID NO: 1226218 - DNA, 22 bp, Artificial Sequence
  chemically synthesized
cttcttaagtgcaattcttttt

SEQ ID NO: 1226219 - DNA, 22 bp, Artificial Sequence
  chemically synthesized
ccttcttaagtgcaattctttt

SEQ ID NO: 1226220 - DNA, 22 bp, Artificial Sequence
  chemically synthesized
ttccttcttaagtgcaattctt

SEQ ID NO: 1226221 - DNA, 22 bp, Artificial Sequence
  chemically synthesized
cttccttcttaagtgcaattct

SEQ ID NO: 1226222 - DNA, 22 bp, Artificial Sequence
  chemically synthesized
tcttccttcttaagtgcaattc

SEQ ID NO: 1226223 - DNA, 22 bp, Artificial Sequence
  chemically synthesized
cgaaaaaaaaagaattgcactt

SEQ ID NO: 1226224 - DNA, 22 bp, Artificial Sequence
  chemically synthesized
ttcttccttcttaagtgcaatt

SEQ ID NO: 1226225 - DNA, 22 bp, Artificial Sequence
  chemically synthesized
tttcttccttcttaagtgcaat

SEQ ID NO: 1226226 - DNA, 22 bp, Artificial Sequence
  chemically synthesized
gcatctttttcttccttcttaa

SEQ ID NO: 1226227 - DNA, 22 bp, Artificial Sequence
  chemically synthesized
ggcatctttttcttccttctta

SEQ ID NO: 1226228 - DNA, 22 bp, Artificial Sequence
  chemically synthesized
cacttaagaaggaagaaaaaga

SEQ ID NO: 1226229 - DNA, 22 bp, Artificial Sequence
  chemically synthesized
aagaaggaagaaaaagatgcca

SEQ ID NO: 1226230 - DNA, 22 bp, Artificial Sequence
  chemically synthesized
agaaggaagaaaaagatgccaa

SEQ ID NO: 1226231 - DNA, 22 bp, Artificial Sequence
  chemically synthesized
caaagcatataacatgtgtttg

SEQ ID NO: 1226232 - DNA, 22 bp, Artificial Sequence
  chemically synthesized
aacaaaattgcaaagcatataa

SEQ ID NO: 1226233 - DNA, 22 bp, Artificial Sequence
  chemically synthesized
gaacaaaattgcaaagcatata

SEQ ID NO: 1226234 - DNA, 22 bp, Artificial Sequence
  chemically synthesized
tatgctttgcaattttgttcaa

SEQ ID NO: 1226235 - DNA, 22 bp, Artificial Sequence
  chemically synthesized
taacataggcaggtttgaacaa

SEQ ID NO: 1226236 - DNA, 22 bp, Artificial Sequence
  chemically synthesized
gtaacataggcaggtttgaaca

SEQ ID NO: 1226237 - DNA, 22 bp, Artificial Sequence
  chemically synthesized
tgtaacataggcaggtttgaac

SEQ ID NO: 1226238 - DNA, 22 bp, Artificial Sequence
  chemically synthesized
tgcaattttgttcaaacctgcc

SEQ ID NO: 1226239 - DNA, 22 bp, Artificial Sequence
  chemically synthesized
gcaattttgttcaaacctgcct

SEQ ID NO: 1226240 - DNA, 22 bp, Artificial Sequence
  chemically synthesized
caattttgttcaaacctgccta

SEQ ID NO: 1226241 - DNA, 22 bp, Artificial Sequence
  chemically synthesized
tgttcaaacctgcctatgttac

SEQ ID NO: 1226242 - DNA, 22 bp, Artificial Sequence
  chemically synthesized
gttcaaacctgcctatgttaca

SEQ ID NO: 1226243 - DNA, 22 bp, Artificial Sequence
  chemically synthesized
ttcaaacctgcctatgttacaa

SEQ ID NO: 1226244 - DNA, 22 bp, Artificial Sequence
  chemically synthesized
aaacctgcctatgttacaaaat

SEQ ID NO: 1226245 - DNA, 22 bp, Artificial Sequence
  chemically synthesized
aaacagtaacgcatattttgta

SEQ ID NO: 1226246 - DNA, 22 bp, Artificial Sequence
  chemically synthesized
cctatgttacaaaatatgcgtt

SEQ ID NO: 1226247 - DNA, 22 bp, Artificial Sequence
  chemically synthesized
gcctaaaacagtaacgcatatt

SEQ ID NO: 1226248 - DNA, 22 bp, Artificial Sequence
  chemically synthesized
ctagcctaaaacagtaacgcat

SEQ ID NO: 1226249 - DNA, 22 bp, Artificial Sequence
  chemically synthesized
tgttacaaaatatgcgttactg

SEQ ID NO: 1226250 - DNA, 22 bp, Artificial Sequence
  chemically synthesized
caaaatatgcgttactgtttta

SEQ ID NO: 1226251 - DNA, 22 bp, Artificial Sequence
  chemically synthesized
aaataaaattgctagcctaaaa

SEQ ID NO: 1226252 - DNA, 22 bp, Artificial Sequence
  chemically synthesized
tccatctcaaataaaattgcta

SEQ ID NO: 1226253 - DNA, 22 bp, Artificial Sequence
  chemically synthesized
ctgttttaggctagcaatttta

SEQ ID NO: 1226254 - DNA, 22 bp, Artificial Sequence
  chemically synthesized
ctgtccatctcaaataaaattg

SEQ ID NO: 1226255 - DNA, 22 bp, Artificial Sequence
  chemically synthesized
ttttaggctagcaattttattt

SEQ ID NO: 1226256 - DNA, 22 bp, Artificial Sequence
  chemically synthesized
tactgtccatctcaaataaaat

SEQ ID NO: 1226257 - DNA, 22 bp, Artificial Sequence
  chemically synthesized
ctactgtccatctcaaataaaa

SEQ ID NO: 1226258 - DNA, 22 bp, Artificial Sequence
  chemically synthesized
taggctagcaattttatttgag

SEQ ID NO: 1226259 - DNA, 22 bp, Artificial Sequence
  chemically synthesized
tctactgtccatctcaaataaa

SEQ ID NO: 1226260 - DNA, 22 bp, Artificial Sequence
  chemically synthesized
aggctagcaattttatttgaga

SEQ ID NO: 1226261 - DNA, 22 bp, Artificial Sequence
  chemically synthesized
ttctactgtccatctcaaataa

SEQ ID NO: 1226262 - DNA, 22 bp, Artificial Sequence
  chemically synthesized
ggctagcaattttatttgagat

SEQ ID NO: 1226263 - DNA, 22 bp, Artificial Sequence
  chemically synthesized
tttttctactgtccatctcaaa

SEQ ID NO: 1226264 - DNA, 22 bp, Artificial Sequence
  chemically synthesized
gcaattttatttgagatggaca

SEQ ID NO: 1226265 - DNA, 22 bp, Artificial Sequence
  chemically synthesized
ctgtttttctactgtccatctc

SEQ ID NO: 1226266 - DNA, 22 bp, Artificial Sequence
  chemically synthesized
ttactgtttttctactgtccat

SEQ ID NO: 1226267 - DNA, 22 bp, Artificial Sequence
  chemically synthesized
ctattactgtttttctactgtc

SEQ ID NO: 1226268 - DNA, 22 bp, Artificial Sequence
  chemically synthesized
tatttgagatggacagtagaaa

SEQ ID NO: 1226269 - DNA, 22 bp, Artificial Sequence
  chemically synthesized
cctattactgtttttctactgt

SEQ ID NO: 1226270 - DNA, 22 bp, Artificial Sequence
  chemically synthesized
atttgagatggacagtagaaaa

SEQ ID NO: 1226271 - DNA, 22 bp, Artificial Sequence
  chemically synthesized
tcctattactgtttttctactg

SEQ ID NO: 1226272 - DNA, 22 bp, Artificial Sequence
  chemically synthesized
tttgagatggacagtagaaaaa

SEQ ID NO: 1226273 - DNA, 22 bp, Artificial Sequence
  chemically synthesized
ttttcctattactgtttttcta

SEQ ID NO: 1226274 - DNA, 22 bp, Artificial Sequence
  chemically synthesized
gagatggacagtagaaaaacag

SEQ ID NO: 1226275 - DNA, 22 bp, Artificial Sequence
  chemically synthesized
agatggacagtagaaaaacagt

SEQ ID NO: 1226276 - DNA, 22 bp, Artificial Sequence
  chemically synthesized
tgttttcctattactgtttttc

SEQ ID NO: 1226277 - DNA, 22 bp, Artificial Sequence
  chemically synthesized
aggaatgcaaactctgttttcc

SEQ ID NO: 1226278 - DNA, 22 bp, Artificial Sequence
  chemically synthesized
tgaaaactcaggaatgcaaact

SEQ ID NO: 1226279 - DNA, 22 bp, Artificial Sequence
  chemically synthesized
gtgaaaactcaggaatgcaaac

SEQ ID NO: 1226280 - DNA, 22 bp, Artificial Sequence
  chemically synthesized
aacttgtgaaaactcaggaatg

SEQ ID NO: 1226281 - DNA, 22 bp, Artificial Sequence
  chemically synthesized
attgaacttgtgaaaactcagg

SEQ ID NO: 1226282 - DNA, 22 bp, Artificial Sequence
  chemically synthesized
tcattgaacttgtgaaaactca

SEQ ID NO: 1226283 - DNA, 22 bp, Artificial Sequence
  chemically synthesized
ctcattgaacttgtgaaaactc

SEQ ID NO: 1226284 - DNA, 22 bp, Artificial Sequence
  chemically synthesized
gcattcctgagttttcacaagt

SEQ ID NO: 1226285 - DNA, 22 bp, Artificial Sequence
  chemically synthesized
cattcctgagttttcacaagtt

SEQ ID NO: 1226286 - DNA, 22 bp, Artificial Sequence
  chemically synthesized
ctgagttttcacaagttcaatg

SEQ ID NO: 1226287 - DNA, 22 bp, Artificial Sequence
  chemically synthesized
agttttcacaagttcaatgaga

SEQ ID NO: 1226288 - DNA, 22 bp, Artificial Sequence
  chemically synthesized
tcacaagttcaatgagaagtcc

SEQ ID NO: 1226289 - DNA, 22 bp, Artificial Sequence
  chemically synthesized
cacaagttcaatgagaagtcct

SEQ ID NO: 1226290 - DNA, 22 bp, Artificial Sequence
  chemically synthesized
atagtgccatggaggacttctc

SEQ ID NO: 1226291 - DNA, 22 bp, Artificial Sequence
  chemically synthesized
acaagttcaatgagaagtcctc

SEQ ID NO: 1226292 - DNA, 22 bp, Artificial Sequence
  chemically synthesized
ttaatagtgccatggaggactt

SEQ ID NO: 1226293 - DNA, 22 bp, Artificial Sequence
  chemically synthesized
tgttattaatagtgccatggag

SEQ ID NO: 1226294 - DNA, 22 bp, Artificial Sequence
  chemically synthesized
aatgagaagtcctccatggcac

SEQ ID NO: 1226295 - DNA, 22 bp, Artificial Sequence
  chemically synthesized
atgcaacatactatgttattaa

SEQ ID NO: 1226296 - DNA, 22 bp, Artificial Sequence
  chemically synthesized
catggcactattaataacatag

SEQ ID NO: 1226297 - DNA, 22 bp, Artificial Sequence
  chemically synthesized
taatgcaacatactatgttatt

SEQ ID NO: 1226298 - DNA, 22 bp, Artificial Sequence
  chemically synthesized
ctaatgcaacatactatgttat

SEQ ID NO: 1226299 - DNA, 22 bp, Artificial Sequence
  chemically synthesized
tctaatgcaacatactatgtta

SEQ ID NO: 1226300 - DNA, 22 bp, Artificial Sequence
  chemically synthesized
ttctaatgcaacatactatgtt

SEQ ID NO: 1226301 - DNA, 22 bp, Artificial Sequence
  chemically synthesized
tttctaatgcaacatactatgt

SEQ ID NO: 1226302 - DNA, 22 bp, Artificial Sequence
  chemically synthesized
ttaataacatagtatgttgcat

SEQ ID NO: 1226303 - DNA, 22 bp, Artificial Sequence
  chemically synthesized
gcccctttttctaatgcaacat

SEQ ID NO: 1226304 - DNA, 22 bp, Artificial Sequence
  chemically synthesized
ataacatagtatgttgcattag

SEQ ID NO: 1226305 - DNA, 22 bp, Artificial Sequence
  chemically synthesized
cagatagaaccatgttggcccc

SEQ ID NO: 1226306 - DNA, 22 bp, Artificial Sequence
  chemically synthesized
cattagaaaaaggggccaacat

SEQ ID NO: 1226307 - DNA, 22 bp, Artificial Sequence
  chemically synthesized
acagatagaaccatgttggccc

SEQ ID NO: 1226308 - DNA, 22 bp, Artificial Sequence
  chemically synthesized
gaaaaaggggccaacatggttc

SEQ ID NO: 1226309 - DNA, 22 bp, Artificial Sequence
  chemically synthesized
tcagataacgagcggcatttac

SEQ ID NO: 1226310 - DNA, 22 bp, Artificial Sequence
  chemically synthesized
gatctatcagataacgagcggc

SEQ ID NO: 1226311 - DNA, 22 bp, Artificial Sequence
  chemically synthesized
tatctgtaaatgccgctcgtta

SEQ ID NO: 1226312 - DNA, 22 bp, Artificial Sequence
  chemically synthesized
tagatctatcagataacgagcg

SEQ ID NO: 1226313 - DNA, 22 bp, Artificial Sequence
  chemically synthesized
tctgtaaatgccgctcgttatc

SEQ ID NO: 1226314 - DNA, 22 bp, Artificial Sequence
  chemically synthesized
taaatgccgctcgttatctgat

SEQ ID NO: 1226315 - DNA, 22 bp, Artificial Sequence
  chemically synthesized
atgtacattctagatctatcag

SEQ ID NO: 1226316 - DNA, 22 bp, Artificial Sequence
  chemically synthesized
aatgtacattctagatctatca

SEQ ID NO: 1226317 - DNA, 22 bp, Artificial Sequence
  chemically synthesized
gttatctgatagatctagaatg

SEQ ID NO: 1226318 - DNA, 22 bp, Artificial Sequence
  chemically synthesized
gtcaacttaatgtacattctag

SEQ ID NO: 1226319 - DNA, 22 bp, Artificial Sequence
  chemically synthesized
ggtcaacttaatgtacattcta

SEQ ID NO: 1226320 - DNA, 22 bp, Artificial Sequence
  chemically synthesized
tctgatagatctagaatgtaca

SEQ ID NO: 1226321 - DNA, 22 bp, Artificial Sequence
  chemically synthesized
tggtcaacttaatgtacattct

SEQ ID NO: 1226322 - DNA, 22 bp, Artificial Sequence
  chemically synthesized
atagatctagaatgtacattaa

SEQ ID NO: 1226323 - DNA, 22 bp, Artificial Sequence
  chemically synthesized
aaggacattttggtcaacttaa

SEQ ID NO: 1226324 - DNA, 22 bp, Artificial Sequence
  chemically synthesized
gaatgtacattaagttgaccaa

SEQ ID NO: 1226325 - DNA, 22 bp, Artificial Sequence
  chemically synthesized
agcaaagattaaaggacatttt

SEQ ID NO: 1226326 - DNA, 22 bp, Artificial Sequence
  chemically synthesized
cagcaaagattaaaggacattt

SEQ ID NO: 1226327 - DNA, 22 bp, Artificial Sequence
  chemically synthesized
agttgaccaaaatgtcctttaa

SEQ ID NO: 1226328 - DNA, 22 bp, Artificial Sequence
  chemically synthesized
aatttcagcaaagattaaagga

SEQ ID NO: 1226329 - DNA, 22 bp, Artificial Sequence
  chemically synthesized
gaatttcagcaaagattaaagg

SEQ ID NO: 1226330 - DNA, 22 bp, Artificial Sequence
  chemically synthesized
accaaaatgtcctttaatcttt

SEQ ID NO: 1226331 - DNA, 22 bp, Artificial Sequence
  chemically synthesized
taatctttgctgaaattcaagg

SEQ ID NO: 1226332 - DNA, 22 bp, Artificial Sequence
  chemically synthesized
aatggtagaagcccttgaattt

SEQ ID NO: 1226333 - DNA, 22 bp, Artificial Sequence
  chemically synthesized
aatctttgctgaaattcaaggg

SEQ ID NO: 1226334 - DNA, 22 bp, Artificial Sequence
  chemically synthesized
atctttgctgaaattcaagggc

SEQ ID NO: 1226335 - DNA, 22 bp, Artificial Sequence
  chemically synthesized
ttaaatggtagaagcccttgaa

SEQ ID NO: 1226336 - DNA, 22 bp, Artificial Sequence
  chemically synthesized
ctattaaatggtagaagccctt

SEQ ID NO: 1226337 - DNA, 22 bp, Artificial Sequence
  chemically synthesized
tgctgaaattcaagggcttcta

SEQ ID NO: 1226338 - DNA, 22 bp, Artificial Sequence
  chemically synthesized
cctattaaatggtagaagccct

SEQ ID NO: 1226339 - DNA, 22 bp, Artificial Sequence
  chemically synthesized
gctgaaattcaagggcttctac

SEQ ID NO: 1226340 - DNA, 22 bp, Artificial Sequence
  chemically synthesized
ctgaaattcaagggcttctacc

SEQ ID NO: 1226341 - DNA, 22 bp, Artificial Sequence
  chemically synthesized
ttcctattaaatggtagaagcc

SEQ ID NO: 1226342 - DNA, 22 bp, Artificial Sequence
  chemically synthesized
cttcctattaaatggtagaagc

SEQ ID NO: 1226343 - DNA, 22 bp, Artificial Sequence
  chemically synthesized
tcttcctattaaatggtagaag

SEQ ID NO: 1226344 - DNA, 22 bp, Artificial Sequence
  chemically synthesized
aaattcaagggcttctaccatt

SEQ ID NO: 1226345 - DNA, 22 bp, Artificial Sequence
  chemically synthesized
aagggcttctaccatttaatag

SEQ ID NO: 1226346 - DNA, 22 bp, Artificial Sequence
  chemically synthesized
catattttcttcctattaaatg

SEQ ID NO: 1226347 - DNA, 22 bp, Artificial Sequence
  chemically synthesized
ctaccatttaataggaagaaaa

SEQ ID NO: 1226348 - DNA, 22 bp, Artificial Sequence
  chemically synthesized
taccatttaataggaagaaaat

SEQ ID NO: 1226349 - DNA, 22 bp, Artificial Sequence
  chemically synthesized
ccatttaataggaagaaaatat

SEQ ID NO: 1226350 - DNA, 22 bp, Artificial Sequence
  chemically synthesized
caccaacattacatattttctt

SEQ ID NO: 1226351 - DNA, 22 bp, Artificial Sequence
  chemically synthesized
acaccaacattacatattttct

SEQ ID NO: 1226352 - DNA, 22 bp, Artificial Sequence
  chemically synthesized
tacaccaacattacatattttc

SEQ ID NO: 1226353 - DNA, 22 bp, Artificial Sequence
  chemically synthesized
ttacaccaacattacatatttt

SEQ ID NO: 1226354 - DNA, 22 bp, Artificial Sequence
  chemically synthesized
tttacaccaacattacatattt

SEQ ID NO: 1226355 - DNA, 22 bp, Artificial Sequence
  chemically synthesized
ttttacaccaacattacatatt

SEQ ID NO: 1226356 - DNA, 22 bp, Artificial Sequence
  chemically synthesized
aataggaagaaaatatgtaatg

SEQ ID NO: 1226357 - DNA, 22 bp, Artificial Sequence
  chemically synthesized
tttttacaccaacattacatat

SEQ ID NO: 1226358 - DNA, 22 bp, Artificial Sequence
  chemically synthesized
ataggaagaaaatatgtaatgt

SEQ ID NO: 1226359 - DNA, 22 bp, Artificial Sequence
  chemically synthesized
ttttttacaccaacattacata

SEQ ID NO: 1226360 - DNA, 22 bp, Artificial Sequence
  chemically synthesized
tttttttacaccaacattacat

SEQ ID NO: 1226361 - DNA, 22 bp, Artificial Sequence
  chemically synthesized
ttttttttacaccaacattaca

SEQ ID NO: 1226362 - DNA, 22 bp, Artificial Sequence
  chemically synthesized
tttttttttacaccaacattac

SEQ ID NO: 1226363 - DNA, 22 bp, Artificial Sequence
  chemically synthesized
ttttttttttacaccaacatta

SEQ ID NO: 1226364 - DNA, 22 bp, Artificial Sequence
  chemically synthesized
tttttttttttacaccaacatt

SEQ ID NO: 1226365 - DNA, 22 bp, Artificial Sequence
  chemically synthesized
ttttttttttttacaccaacat

SEQ ID NO: 1226366 - DNA, 22 bp, Artificial Sequence
  chemically synthesized
tttttttttttttacaccaaca

SEQ ID NO: 1226367 - DNA, 22 bp, Artificial Sequence
  chemically synthesized
ttttttttttttttacaccaac

SEQ ID NO: 1226368 - DNA, 22 bp, Artificial Sequence
  chemically synthesized
tttttttttttttttacaccaa

SEQ ID NO: 1226369 - DNA, 22 bp, Artificial Sequence
  chemically synthesized
ttttttttttttttttacacca

SEQ ID NO: 1226370 - DNA, 22 bp, Artificial Sequence
  chemically synthesized
ttttttttttttttttttacac

SEQ ID NO: 1226371 - DNA, 22 bp, Artificial Sequence
  chemically synthesized
cttttttttttttttttttaca

SEQ ID NO: 1226372 - DNA, 22 bp, Artificial Sequence
  chemically synthesized
tcttttttttttttttttttac

SEQ ID NO: 1226373 - DNA, 22 bp, Artificial Sequence
  chemically synthesized
ttctttttttttttttttttta

SEQ ID NO: 1226374 - DNA, 22 bp, Artificial Sequence
  chemically synthesized
gtgtaaaaaaaaaaaaaaaaaa

SEQ ID NO: 1226375 - DNA, 22 bp, Artificial Sequence
  chemically synthesized
aaaatgtgtttttctttttttt

SEQ ID NO: 1226376 - DNA, 22 bp, Artificial Sequence
  chemically synthesized
atcataatccagtgaatctaaa

SEQ ID NO: 1226377 - DNA, 22 bp, Artificial Sequence
  chemically synthesized
agtgttcatcataatccagtga

SEQ ID NO: 1226378 - DNA, 22 bp, Artificial Sequence
  chemically synthesized
ctcagtgttcatcataatccag

SEQ ID NO: 1226379 - DNA, 22 bp, Artificial Sequence
  chemically synthesized
gctcagtgttcatcataatcca

SEQ ID NO: 1226380 - DNA, 22 bp, Artificial Sequence
  chemically synthesized
ttagattcactggattatgatg

SEQ ID NO: 1226381 - DNA, 22 bp, Artificial Sequence
  chemically synthesized
tagattcactggattatgatga

SEQ ID NO: 1226382 - DNA, 22 bp, Artificial Sequence
  chemically synthesized
agattcactggattatgatgaa

SEQ ID NO: 1226383 - DNA, 22 bp, Artificial Sequence
  chemically synthesized
tcttgctcagtgttcatcataa

SEQ ID NO: 1226384 - DNA, 22 bp, Artificial Sequence
  chemically synthesized
gattcactggattatgatgaac

SEQ ID NO: 1226385 - DNA, 22 bp, Artificial Sequence
  chemically synthesized
actggattatgatgaacactga

SEQ ID NO: 1226386 - DNA, 22 bp, Artificial Sequence
  chemically synthesized
aaaaattatcttgctcagtgtt

SEQ ID NO: 1226387 - DNA, 22 bp, Artificial Sequence
  chemically synthesized
gaaaaattatcttgctcagtgt

SEQ ID NO: 1226388 - DNA, 22 bp, Artificial Sequence
  chemically synthesized
gattatgatgaacactgagcaa

SEQ ID NO: 1226389 - DNA, 22 bp, Artificial Sequence
  chemically synthesized
tgaaaaattatcttgctcagtg

SEQ ID NO: 1226390 - DNA, 22 bp, Artificial Sequence
  chemically synthesized
tgatgaacactgagcaagataa

SEQ ID NO: 1226391 - DNA, 22 bp, Artificial Sequence
  chemically synthesized
agcacactttgaaaaattatct

SEQ ID NO: 1226392 - DNA, 22 bp, Artificial Sequence
  chemically synthesized
ttaagcacactttgaaaaatta

SEQ ID NO: 1226393 - DNA, 22 bp, Artificial Sequence
  chemically synthesized
agcaagataatttttcaaagtg

SEQ ID NO: 1226394 - DNA, 22 bp, Artificial Sequence
  chemically synthesized
aaactattaagcacactttgaa

SEQ ID NO: 1226395 - DNA, 22 bp, Artificial Sequence
  chemically synthesized
taaaactattaagcacactttg

SEQ ID NO: 1226396 - DNA, 22 bp, Artificial Sequence
  chemically synthesized
ttctaaaactattaagcacact

SEQ ID NO: 1226397 - DNA, 22 bp, Artificial Sequence
  chemically synthesized
ccctgttctaaaactattaagc

SEQ ID NO: 1226398 - DNA, 22 bp, Artificial Sequence
  chemically synthesized
ttcaaagtgtgcttaatagttt

SEQ ID NO: 1226399 - DNA, 22 bp, Artificial Sequence
  chemically synthesized
tcaaagtgtgcttaatagtttt

SEQ ID NO: 1226400 - DNA, 22 bp, Artificial Sequence
  chemically synthesized
caaagtgtgcttaatagtttta

SEQ ID NO: 1226401 - DNA, 22 bp, Artificial Sequence
  chemically synthesized
aaagtgtgcttaatagttttag

SEQ ID NO: 1226402 - DNA, 22 bp, Artificial Sequence
  chemically synthesized
tatcacactgccctgttctaaa

SEQ ID NO: 1226403 - DNA, 22 bp, Artificial Sequence
  chemically synthesized
atatcacactgccctgttctaa

SEQ ID NO: 1226404 - DNA, 22 bp, Artificial Sequence
  chemically synthesized
ttatatcacactgccctgttct

SEQ ID NO: 1226405 - DNA, 22 bp, Artificial Sequence
  chemically synthesized
tcttatatcacactgccctgtt

SEQ ID NO: 1226406 - DNA, 22 bp, Artificial Sequence
  chemically synthesized
aatagttttagaacagggcagt

SEQ ID NO: 1226407 - DNA, 22 bp, Artificial Sequence
  chemically synthesized
atagttttagaacagggcagtg

SEQ ID NO: 1226408 - DNA, 22 bp, Artificial Sequence
  chemically synthesized
atctctcttatatcacactgcc

SEQ ID NO: 1226409 - DNA, 22 bp, Artificial Sequence
  chemically synthesized
tagaacagggcagtgtgatata

SEQ ID NO: 1226410 - DNA, 22 bp, Artificial Sequence
  chemically synthesized
tctcatctctcttatatcacac

SEQ ID NO: 1226411 - DNA, 22 bp, Artificial Sequence
  chemically synthesized
agaacagggcagtgtgatataa

SEQ ID NO: 1226412 - DNA, 22 bp, Artificial Sequence
  chemically synthesized
atctcatctctcttatatcaca

SEQ ID NO: 1226413 - DNA, 22 bp, Artificial Sequence
  chemically synthesized
gaacagggcagtgtgatataag

SEQ ID NO: 1226414 - DNA, 22 bp, Artificial Sequence
  chemically synthesized
cttatctcatctctcttatatc

SEQ ID NO: 1226415 - DNA, 22 bp, Artificial Sequence
  chemically synthesized
acttatctcatctctcttatat

SEQ ID NO: 1226416 - DNA, 22 bp, Artificial Sequence
  chemically synthesized
cttacttatctcatctctctta

SEQ ID NO: 1226417 - DNA, 22 bp, Artificial Sequence
  chemically synthesized
tgcttacttatctcatctctct

SEQ ID NO: 1226418 - DNA, 22 bp, Artificial Sequence
  chemically synthesized
ccagcctctgcttacttatctc

SEQ ID NO: 1226419 - DNA, 22 bp, Artificial Sequence
  chemically synthesized
cccagcctctgcttacttatct

SEQ ID NO: 1226420 - DNA, 22 bp, Artificial Sequence
  chemically synthesized
ttcccagcctctgcttacttat

SEQ ID NO: 1226421 - DNA, 22 bp, Artificial Sequence
  chemically synthesized
tagactcttcccagcctctgct

SEQ ID NO: 1226422 - DNA, 22 bp, Artificial Sequence
  chemically synthesized
caagactgtagactcttcccag

SEQ ID NO: 1226423 - DNA, 22 bp, Artificial Sequence
  chemically synthesized
agactgcaagactgtagactct

SEQ ID NO: 1226424 - DNA, 22 bp, Artificial Sequence
  chemically synthesized
gagactgcaagactgtagactc

SEQ ID NO: 1226425 - DNA, 22 bp, Artificial Sequence
  chemically synthesized
ggaagagtctacagtcttgcag

SEQ ID NO: 1226426 - DNA, 22 bp, Artificial Sequence
  chemically synthesized
aatcaccatatccttgagactg

SEQ ID NO: 1226427 - DNA, 22 bp, Artificial Sequence
  chemically synthesized
gaatcaccatatccttgagact

SEQ ID NO: 1226428 - DNA, 22 bp, Artificial Sequence
  chemically synthesized
cagtcttgcagtctcaaggata

SEQ ID NO: 1226429 - DNA, 22 bp, Artificial Sequence
  chemically synthesized
tgcccttgaatcaccatatcct

SEQ ID NO: 1226430 - DNA, 22 bp, Artificial Sequence
  chemically synthesized
atgcccttgaatcaccatatcc

SEQ ID NO: 1226431 - DNA, 22 bp, Artificial Sequence
  chemically synthesized
gcagtctcaaggatatggtgat

SEQ ID NO: 1226432 - DNA, 22 bp, Artificial Sequence
  chemically synthesized
cagtctcaaggatatggtgatt

SEQ ID NO: 1226433 - DNA, 22 bp, Artificial Sequence
  chemically synthesized
atttatgcccttgaatcaccat

SEQ ID NO: 1226434 - DNA, 22 bp, Artificial Sequence
  chemically synthesized
catttatgcccttgaatcacca

SEQ ID NO: 1226435 - DNA, 22 bp, Artificial Sequence
  chemically synthesized
tcatttatgcccttgaatcacc

SEQ ID NO: 1226436 - DNA, 22 bp, Artificial Sequence
  chemically synthesized
ttcatttatgcccttgaatcac

SEQ ID NO: 1226437 - DNA, 22 bp, Artificial Sequence
  chemically synthesized
aaggatatggtgattcaagggc

SEQ ID NO: 1226438 - DNA, 22 bp, Artificial Sequence
  chemically synthesized
tttttcatttatgcccttgaat

SEQ ID NO: 1226439 - DNA, 22 bp, Artificial Sequence
  chemically synthesized
ttgtttttcatttatgcccttg

SEQ ID NO: 1226440 - DNA, 22 bp, Artificial Sequence
  chemically synthesized
tagcctgttgtttttcatttat

SEQ ID NO: 1226441 - DNA, 22 bp, Artificial Sequence
  chemically synthesized
atagcctgttgtttttcattta

SEQ ID NO: 1226442 - DNA, 22 bp, Artificial Sequence
  chemically synthesized
ttatagcctgttgtttttcatt

SEQ ID NO: 1226443 - DNA, 22 bp, Artificial Sequence
  chemically synthesized
tcttatagcctgttgtttttca

SEQ ID NO: 1226444 - DNA, 22 bp, Artificial Sequence
  chemically synthesized
aagggcataaatgaaaaacaac

SEQ ID NO: 1226445 - DNA, 22 bp, Artificial Sequence
  chemically synthesized
agacctctcttatagcctgttg

SEQ ID NO: 1226446 - DNA, 22 bp, Artificial Sequence
  chemically synthesized
tctgagacctctcttatagcct

SEQ ID NO: 1226447 - DNA, 22 bp, Artificial Sequence
  chemically synthesized
gtctgagacctctcttatagcc

SEQ ID NO: 1226448 - DNA, 22 bp, Artificial Sequence
  chemically synthesized
tgtctgagacctctcttatagc

SEQ ID NO: 1226449 - DNA, 22 bp, Artificial Sequence
  chemically synthesized
tttgtctgagacctctcttata

SEQ ID NO: 1226450 - DNA, 22 bp, Artificial Sequence
  chemically synthesized
ctttgtctgagacctctcttat

SEQ ID NO: 1226451 - DNA, 22 bp, Artificial Sequence
  chemically synthesized
tctttgtctgagacctctctta

SEQ ID NO: 1226452 - DNA, 22 bp, Artificial Sequence
  chemically synthesized
aatctttctttgtctgagacct

SEQ ID NO: 1226453 - DNA, 22 bp, Artificial Sequence
  chemically synthesized
aaatctttctttgtctgagacc

SEQ ID NO: 1226454 - DNA, 22 bp, Artificial Sequence
  chemically synthesized
taaatctttctttgtctgagac

SEQ ID NO: 1226455 - DNA, 22 bp, Artificial Sequence
  chemically synthesized
ttaaatctttctttgtctgaga

SEQ ID NO: 1226456 - DNA, 22 bp, Artificial Sequence
  chemically synthesized
tttaaatctttctttgtctgag

SEQ ID NO: 1226457 - DNA, 22 bp, Artificial Sequence
  chemically synthesized
taagagaggtctcagacaaaga

SEQ ID NO: 1226458 - DNA, 22 bp, Artificial Sequence
  chemically synthesized
agacaaagaaagatttaaaaag

SEQ ID NO: 1226459 - DNA, 22 bp, Artificial Sequence
  chemically synthesized
caatgaggaatatcagaaggaa

SEQ ID NO: 1226460 - DNA, 22 bp, Artificial Sequence
  chemically synthesized
gcaatgaggaatatcagaagga

SEQ ID NO: 1226461 - DNA, 22 bp, Artificial Sequence
  chemically synthesized
tgcaatgaggaatatcagaagg

SEQ ID NO: 1226462 - DNA, 22 bp, Artificial Sequence
  chemically synthesized
ttgcaatgaggaatatcagaag

SEQ ID NO: 1226463 - DNA, 22 bp, Artificial Sequence
  chemically synthesized
aaaaagcattccttctgatatt

SEQ ID NO: 1226464 - DNA, 22 bp, Artificial Sequence
  chemically synthesized
aaaagcattccttctgatattc

SEQ ID NO: 1226465 - DNA, 22 bp, Artificial Sequence
  chemically synthesized
cttctgatattcctcattgcaa

SEQ ID NO: 1226466 - DNA, 22 bp, Artificial Sequence
  chemically synthesized
ctgatattcctcattgcaaaag

SEQ ID NO: 1226467 - DNA, 22 bp, Artificial Sequence
  chemically synthesized
tgatattcctcattgcaaaagc

SEQ ID NO: 1226468 - DNA, 22 bp, Artificial Sequence
  chemically synthesized
gcatgtggaggcgcttttgcaa

SEQ ID NO: 1226469 - DNA, 22 bp, Artificial Sequence
  chemically synthesized
atattcctcattgcaaaagcgc

SEQ ID NO: 1226470 - DNA, 22 bp, Artificial Sequence
  chemically synthesized
ttagcatgtggaggcgcttttg

SEQ ID NO: 1226471 - DNA, 22 bp, Artificial Sequence
  chemically synthesized
attattagcatgtggaggcgct

SEQ ID NO: 1226472 - DNA, 22 bp, Artificial Sequence
  chemically synthesized
ctcattgcaaaagcgcctccac

SEQ ID NO: 1226473 - DNA, 22 bp, Artificial Sequence
  chemically synthesized
cattattagcatgtggaggcgc

SEQ ID NO: 1226474 - DNA, 22 bp, Artificial Sequence
  chemically synthesized
tcattattagcatgtggaggcg

SEQ ID NO: 1226475 - DNA, 22 bp, Artificial Sequence
  chemically synthesized
ttcattattagcatgtggaggc

SEQ ID NO: 1226476 - DNA, 22 bp, Artificial Sequence
  chemically synthesized
attgcaaaagcgcctccacatg

SEQ ID NO: 1226477 - DNA, 22 bp, Artificial Sequence
  chemically synthesized
caaaagcgcctccacatgctaa

SEQ ID NO: 1226478 - DNA, 22 bp, Artificial Sequence
  chemically synthesized
cacatgctaataatgaaaaatg

SEQ ID NO: 1226479 - DNA, 22 bp, Artificial Sequence
  chemically synthesized
ataatgaaaaatgggctgggtg

SEQ ID NO: 1226480 - DNA, 22 bp, Artificial Sequence
  chemically synthesized
caggcgtgagccaccgcaccca

SEQ ID NO: 1226481 - DNA, 22 bp, Artificial Sequence
  chemically synthesized
gattacaggcgtgagccaccgc

SEQ ID NO: 1226482 - DNA, 22 bp, Artificial Sequence
  chemically synthesized
ggattacaggcgtgagccaccg

SEQ ID NO: 1226483 - DNA, 22 bp, Artificial Sequence
  chemically synthesized
ggtgcggtggctcacgcctgta

SEQ ID NO: 1226484 - DNA, 22 bp, Artificial Sequence
  chemically synthesized
ccaaagtgtttggattacaggc

SEQ ID NO: 1226485 - DNA, 22 bp, Artificial Sequence
  chemically synthesized
ggcctcccaaagtgtttggatt

SEQ ID NO: 1226486 - DNA, 22 bp, Artificial Sequence
  chemically synthesized
acgcctgtaatccaaacacttt

SEQ ID NO: 1226487 - DNA, 22 bp, Artificial Sequence
  chemically synthesized
taatccaaacactttgggaggc

SEQ ID NO: 1226488 - DNA, 22 bp, Artificial Sequence
  chemically synthesized
tgatccgcccgtctcggcctcc

SEQ ID NO: 1226489 - DNA, 22 bp, Artificial Sequence
  chemically synthesized
gtgatccgcccgtctcggcctc

SEQ ID NO: 1226490 - DNA, 22 bp, Artificial Sequence
  chemically synthesized
accttgtgatccgcccgtctcg

SEQ ID NO: 1226491 - DNA, 22 bp, Artificial Sequence
  chemically synthesized
ctgaccttgtgatccgcccgtc

SEQ ID NO: 1226492 - DNA, 22 bp, Artificial Sequence
  chemically synthesized
tgggaggccgagacgggcggat

SEQ ID NO: 1226493 - DNA, 22 bp, Artificial Sequence
  chemically synthesized
gggaggccgagacgggcggatc

SEQ ID NO: 1226494 - DNA, 22 bp, Artificial Sequence
  chemically synthesized
ggaggccgagacgggcggatca

SEQ ID NO: 1226495 - DNA, 22 bp, Artificial Sequence
  chemically synthesized
gatctcctgaccttgtgatccg

SEQ ID NO: 1226496 - DNA, 22 bp, Artificial Sequence
  chemically synthesized
gccaggatggtctcgatctcct

SEQ ID NO: 1226497 - DNA, 22 bp, Artificial Sequence
  chemically synthesized
accgtgttagccaggatggtct

SEQ ID NO: 1226498 - DNA, 22 bp, Artificial Sequence
  chemically synthesized
caccgtgttagccaggatggtc

SEQ ID NO: 1226499 - DNA, 22 bp, Artificial Sequence
  chemically synthesized
agtagagatggggtttcaccgt

SEQ ID NO: 1226500 - DNA, 22 bp, Artificial Sequence
  chemically synthesized
ttcagtagagatggggtttcac

SEQ ID NO: 1226501 - DNA, 22 bp, Artificial Sequence
  chemically synthesized
gttcagtagagatggggtttca

SEQ ID NO: 1226502 - DNA, 22 bp, Artificial Sequence
  chemically synthesized
tgttcagtagagatggggtttc

SEQ ID NO: 1226503 - DNA, 22 bp, Artificial Sequence
  chemically synthesized
gctaacacggtgaaaccccatc

SEQ ID NO: 1226504 - DNA, 22 bp, Artificial Sequence
  chemically synthesized
acacggtgaaaccccatctcta

SEQ ID NO: 1226505 - DNA, 22 bp, Artificial Sequence
  chemically synthesized
tattttgttcagtagagatggg

SEQ ID NO: 1226506 - DNA, 22 bp, Artificial Sequence
  chemically synthesized
gtattttgttcagtagagatgg

SEQ ID NO: 1226507 - DNA, 22 bp, Artificial Sequence
  chemically synthesized
tgtattttgttcagtagagatg

SEQ ID NO: 1226508 - DNA, 22 bp, Artificial Sequence
  chemically synthesized
ttgtattttgttcagtagagat

SEQ ID NO: 1226509 - DNA, 22 bp, Artificial Sequence
  chemically synthesized
tttgtattttgttcagtagaga

SEQ ID NO: 1226510 - DNA, 22 bp, Artificial Sequence
  chemically synthesized
attttttgtattttgttcagta

SEQ ID NO: 1226511 - DNA, 22 bp, Artificial Sequence
  chemically synthesized
tactgaacaaaatacaaaaaat

SEQ ID NO: 1226512 - DNA, 22 bp, Artificial Sequence
  chemically synthesized
ctgaacaaaatacaaaaaatta

SEQ ID NO: 1226513 - DNA, 22 bp, Artificial Sequence
  chemically synthesized
aacaaaatacaaaaaattagcc

SEQ ID NO: 1226514 - DNA, 22 bp, Artificial Sequence
  chemically synthesized
caggcgcccgccaccacgcccg

SEQ ID NO: 1226515 - DNA, 22 bp, Artificial Sequence
  chemically synthesized
ggactacaggcgcccgccacca

SEQ ID NO: 1226516 - DNA, 22 bp, Artificial Sequence
  chemically synthesized
gccgggcgtggtggcgggcgcc

SEQ ID NO: 1226517 - DNA, 22 bp, Artificial Sequence
  chemically synthesized
ccaagtagctgggactacaggc

SEQ ID NO: 1226518 - DNA, 22 bp, Artificial Sequence
  chemically synthesized
agcctcccaagtagctgggact

SEQ ID NO: 1226519 - DNA, 22 bp, Artificial Sequence
  chemically synthesized
cctcagcctcccaagtagctgg

SEQ ID NO: 1226520 - DNA, 22 bp, Artificial Sequence
  chemically synthesized
gcctcagcctcccaagtagctg

SEQ ID NO: 1226521 - DNA, 22 bp, Artificial Sequence
  chemically synthesized
ttgcctcagcctcccaagtagc

SEQ ID NO: 1226522 - DNA, 22 bp, Artificial Sequence
  chemically synthesized
tcttgcctcagcctcccaagta

SEQ ID NO: 1226523 - DNA, 22 bp, Artificial Sequence
  chemically synthesized
tagtcccagctacttgggaggc

SEQ ID NO: 1226524 - DNA, 22 bp, Artificial Sequence
  chemically synthesized
atgccattctcttgcctcagcc

SEQ ID NO: 1226525 - DNA, 22 bp, Artificial Sequence
  chemically synthesized
cttgggaggctgaggcaagaga

SEQ ID NO: 1226526 - DNA, 22 bp, Artificial Sequence
  chemically synthesized
ggttcatgccattctcttgcct

SEQ ID NO: 1226527 - DNA, 22 bp, Artificial Sequence
  chemically synthesized
gggaggctgaggcaagagaatg

SEQ ID NO: 1226528 - DNA, 22 bp, Artificial Sequence
  chemically synthesized
ctgggttcatgccattctcttg

SEQ ID NO: 1226529 - DNA, 22 bp, Artificial Sequence
  chemically synthesized
ggaggctgaggcaagagaatgg

SEQ ID NO: 1226530 - DNA, 22 bp, Artificial Sequence
  chemically synthesized
cgcctcctgggttcatgccatt

SEQ ID NO: 1226531 - DNA, 22 bp, Artificial Sequence
  chemically synthesized
aggcaagagaatggcatgaacc

SEQ ID NO: 1226532 - DNA, 22 bp, Artificial Sequence
  chemically synthesized
caagctccgcctcctgggttca

SEQ ID NO: 1226533 - DNA, 22 bp, Artificial Sequence
  chemically synthesized
actgcaagctccgcctcctggg

SEQ ID NO: 1226534 - DNA, 22 bp, Artificial Sequence
  chemically synthesized
ctcactgcaagctccgcctcct

SEQ ID NO: 1226535 - DNA, 22 bp, Artificial Sequence
  chemically synthesized
tgctcactgcaagctccgcctc

SEQ ID NO: 1226536 - DNA, 22 bp, Artificial Sequence
  chemically synthesized
gagtgcagtggcgcgatctctg

SEQ ID NO: 1226537 - DNA, 22 bp, Artificial Sequence
  chemically synthesized
gcagtgagcagagatcgcgcca

SEQ ID NO: 1226538 - DNA, 22 bp, Artificial Sequence
  chemically synthesized
cagtgagcagagatcgcgccac

SEQ ID NO: 1226539 - DNA, 22 bp, Artificial Sequence
  chemically synthesized
tcacccaggctggagtgcagtg

SEQ ID NO: 1226540 - DNA, 22 bp, Artificial Sequence
  chemically synthesized
tgtcacccaggctggagtgcag

SEQ ID NO: 1226541 - DNA, 22 bp, Artificial Sequence
  chemically synthesized
gctctgtcacccaggctggagt

SEQ ID NO: 1226542 - DNA, 22 bp, Artificial Sequence
  chemically synthesized
cactccagcctgggtgacagag

SEQ ID NO: 1226543 - DNA, 22 bp, Artificial Sequence
  chemically synthesized
agacagagtctcgctctgtcac

SEQ ID NO: 1226544 - DNA, 22 bp, Artificial Sequence
  chemically synthesized
gagacagagtctcgctctgtca

SEQ ID NO: 1226545 - DNA, 22 bp, Artificial Sequence
  chemically synthesized
tgagacagagtctcgctctgtc

SEQ ID NO: 1226546 - DNA, 22 bp, Artificial Sequence
  chemically synthesized
ttgagacagagtctcgctctgt

SEQ ID NO: 1226547 - DNA, 22 bp, Artificial Sequence
  chemically synthesized
cagcctgggtgacagagcgaga

SEQ ID NO: 1226548 - DNA, 22 bp, Artificial Sequence
  chemically synthesized
tttttgagacagagtctcgctc

SEQ ID NO: 1226549 - DNA, 22 bp, Artificial Sequence
  chemically synthesized
atttttgagacagagtctcgct

SEQ ID NO: 1226550 - DNA, 22 bp, Artificial Sequence
  chemically synthesized
tatttttgagacagagtctcgc

SEQ ID NO: 1226551 - DNA, 22 bp, Artificial Sequence
  chemically synthesized
ttatttttgagacagagtctcg

SEQ ID NO: 1226552 - DNA, 22 bp, Artificial Sequence
  chemically synthesized
tttatttttgagacagagtctc

SEQ ID NO: 1226553 - DNA, 22 bp, Artificial Sequence
  chemically synthesized
ggtgacagagcgagactctgtc

SEQ ID NO: 1226554 - DNA, 22 bp, Artificial Sequence
  chemically synthesized
ttttttatttttgagacagagt

SEQ ID NO: 1226555 - DNA, 22 bp, Artificial Sequence
  chemically synthesized
attttttatttttgagacagag

SEQ ID NO: 1226556 - DNA, 22 bp, Artificial Sequence
  chemically synthesized
tattttttatttttgagacaga

SEQ ID NO: 1226557 - DNA, 22 bp, Artificial Sequence
  chemically synthesized
ttattttttatttttgagacag

SEQ ID NO: 1226558 - DNA, 22 bp, Artificial Sequence
  chemically synthesized
tttattttttatttttgagaca

SEQ ID NO: 1226559 - DNA, 22 bp, Artificial Sequence
  chemically synthesized
ttttattttttatttttgagac

SEQ ID NO: 1226560 - DNA, 22 bp, Artificial Sequence
  chemically synthesized
tttttttattttttatttttga

SEQ ID NO: 1226561 - DNA, 22 bp, Artificial Sequence
  chemically synthesized
ttatttttttattttttatttt

SEQ ID NO: 1226562 - DNA, 22 bp, Artificial Sequence
  chemically synthesized
ttattatttttttattttttat

SEQ ID NO: 1226563 - DNA, 22 bp, Artificial Sequence
  chemically synthesized
attattatttttttatttttta

SEQ ID NO: 1226564 - DNA, 22 bp, Artificial Sequence
  chemically synthesized
tgtctcaaaaataaaaaataaa

SEQ ID NO: 1226565 - DNA, 22 bp, Artificial Sequence
  chemically synthesized
tctcaaaaataaaaaataaaaa

SEQ ID NO: 1226566 - DNA, 22 bp, Artificial Sequence
  chemically synthesized
atttattattatttttttattt

SEQ ID NO: 1226567 - DNA, 22 bp, Artificial Sequence
  chemically synthesized
aaaaataaaaaataaaaaaata

SEQ ID NO: 1226568 - DNA, 22 bp, Artificial Sequence
  chemically synthesized
ttcatttattattattttttta

SEQ ID NO: 1226569 - DNA, 22 bp, Artificial Sequence
  chemically synthesized
caagttgttcatttattattat

SEQ ID NO: 1226570 - DNA, 22 bp, Artificial Sequence
  chemically synthesized
gcaagttgttcatttattatta

SEQ ID NO: 1226571 - DNA, 22 bp, Artificial Sequence
  chemically synthesized
cttgcaagttgttcatttatta

SEQ ID NO: 1226572 - DNA, 22 bp, Artificial Sequence
  chemically synthesized
gcttgcaagttgttcatttatt

SEQ ID NO: 1226573 - DNA, 22 bp, Artificial Sequence
  chemically synthesized
acttgcttgcaagttgttcatt

SEQ ID NO: 1226574 - DNA, 22 bp, Artificial Sequence
  chemically synthesized
cacttgcttgcaagttgttcat

SEQ ID NO: 1226575 - DNA, 22 bp, Artificial Sequence
  chemically synthesized
ttcacttgcttgcaagttgttc

SEQ ID NO: 1226576 - DNA, 22 bp, Artificial Sequence
  chemically synthesized
cttcacttgcttgcaagttgtt

SEQ ID NO: 1226577 - DNA, 22 bp, Artificial Sequence
  chemically synthesized
ataatttcttcacttgcttgca

SEQ ID NO: 1226578 - DNA, 22 bp, Artificial Sequence
  chemically synthesized
tgtctgataatttcttcacttg

SEQ ID NO: 1226579 - DNA, 22 bp, Artificial Sequence
  chemically synthesized
ttatgtctgataatttcttcac

SEQ ID NO: 1226580 - DNA, 22 bp, Artificial Sequence
  chemically synthesized
gcaagcaagtgaagaaattatc

SEQ ID NO: 1226581 - DNA, 22 bp, Artificial Sequence
  chemically synthesized
caagcaagtgaagaaattatca

SEQ ID NO: 1226582 - DNA, 22 bp, Artificial Sequence
  chemically synthesized
aagactattatgtctgataatt

SEQ ID NO: 1226583 - DNA, 22 bp, Artificial Sequence
  chemically synthesized
caagactattatgtctgataat

SEQ ID NO: 1226584 - DNA, 22 bp, Artificial Sequence
  chemically synthesized
tcaagactattatgtctgataa

SEQ ID NO: 1226585 - DNA, 22 bp, Artificial Sequence
  chemically synthesized
tcagacataatagtcttgaaag

SEQ ID NO: 1226586 - DNA, 22 bp, Artificial Sequence
  chemically synthesized
gtccaagataagctttcaagac

SEQ ID NO: 1226587 - DNA, 22 bp, Artificial Sequence
  chemically synthesized
aactagtccaagataagctttc

SEQ ID NO: 1226588 - DNA, 22 bp, Artificial Sequence
  chemically synthesized
catctgaactagtccaagataa

SEQ ID NO: 1226589 - DNA, 22 bp, Artificial Sequence
  chemically synthesized
gaaagcttatcttggactagtt

SEQ ID NO: 1226590 - DNA, 22 bp, Artificial Sequence
  chemically synthesized
caactccatctgaactagtcca

SEQ ID NO: 1226591 - DNA, 22 bp, Artificial Sequence
  chemically synthesized
aaagcttatcttggactagttc

SEQ ID NO: 1226592 - DNA, 22 bp, Artificial Sequence
  chemically synthesized
ccaactccatctgaactagtcc

SEQ ID NO: 1226593 - DNA, 22 bp, Artificial Sequence
  chemically synthesized
tccaactccatctgaactagtc

SEQ ID NO: 1226594 - DNA, 22 bp, Artificial Sequence
  chemically synthesized
atcttggactagttcagatgga

SEQ ID NO: 1226595 - DNA, 22 bp, Artificial Sequence
  chemically synthesized
tcttggactagttcagatggag

SEQ ID NO: 1226596 - DNA, 22 bp, Artificial Sequence
  chemically synthesized
aagccctttccaactccatctg

SEQ ID NO: 1226597 - DNA, 22 bp, Artificial Sequence
  chemically synthesized
ggactagttcagatggagttgg

SEQ ID NO: 1226598 - DNA, 22 bp, Artificial Sequence
  chemically synthesized
gactagttcagatggagttgga

SEQ ID NO: 1226599 - DNA, 22 bp, Artificial Sequence
  chemically synthesized
gttcagatggagttggaaaggg

SEQ ID NO: 1226600 - DNA, 22 bp, Artificial Sequence
  chemically synthesized
aaaatatcctgaagccctttcc

SEQ ID NO: 1226601 - DNA, 22 bp, Artificial Sequence
  chemically synthesized
aaaaatatcctgaagccctttc

SEQ ID NO: 1226602 - DNA, 22 bp, Artificial Sequence
  chemically synthesized
agatggagttggaaagggcttc

SEQ ID NO: 1226603 - DNA, 22 bp, Artificial Sequence
  chemically synthesized
taaaaatatcctgaagcccttt

SEQ ID NO: 1226604 - DNA, 22 bp, Artificial Sequence
  chemically synthesized
ttaaaaatatcctgaagccctt

SEQ ID NO: 1226605 - DNA, 22 bp, Artificial Sequence
  chemically synthesized
ccatttttaaaaatatcctgaa

SEQ ID NO: 1226606 - DNA, 22 bp, Artificial Sequence
  chemically synthesized
accatttttaaaaatatcctga

SEQ ID NO: 1226607 - DNA, 22 bp, Artificial Sequence
  chemically synthesized
gaaagggcttcaggatattttt

SEQ ID NO: 1226608 - DNA, 22 bp, Artificial Sequence
  chemically synthesized
tatgatcttaccatttttaaaa

SEQ ID NO: 1226609 - DNA, 22 bp, Artificial Sequence
  chemically synthesized
atatgatcttaccatttttaaa

SEQ ID NO: 1226610 - DNA, 22 bp, Artificial Sequence
  chemically synthesized
ttatatgatcttaccattttta

SEQ ID NO: 1226611 - DNA, 22 bp, Artificial Sequence
  chemically synthesized
caggatatttttaaaaatggta

SEQ ID NO: 1226612 - DNA, 22 bp, Artificial Sequence
  chemically synthesized
cttatatgatcttaccattttt

SEQ ID NO: 1226613 - DNA, 22 bp, Artificial Sequence
  chemically synthesized
aggatatttttaaaaatggtaa

SEQ ID NO: 1226614 - DNA, 22 bp, Artificial Sequence
  chemically synthesized
cttcttatatgatcttaccatt

SEQ ID NO: 1226615 - DNA, 22 bp, Artificial Sequence
  chemically synthesized
tactacttcttatatgatctta

SEQ ID NO: 1226616 - DNA, 22 bp, Artificial Sequence
  chemically synthesized
atactacttcttatatgatctt

SEQ ID NO: 1226617 - DNA, 22 bp, Artificial Sequence
  chemically synthesized
ttaaaaatggtaagatcatata

SEQ ID NO: 1226618 - DNA, 22 bp, Artificial Sequence
  chemically synthesized
taaaaatggtaagatcatataa

SEQ ID NO: 1226619 - DNA, 22 bp, Artificial Sequence
  chemically synthesized
aaaaatggtaagatcatataag

SEQ ID NO: 1226620 - DNA, 22 bp, Artificial Sequence
  chemically synthesized
tttatactacttcttatatgat

SEQ ID NO: 1226621 - DNA, 22 bp, Artificial Sequence
  chemically synthesized
aaaatggtaagatcatataaga

SEQ ID NO: 1226622 - DNA, 22 bp, Artificial Sequence
  chemically synthesized
ttgtttatactacttcttatat

SEQ ID NO: 1226623 - DNA, 22 bp, Artificial Sequence
  chemically synthesized
attgtttatactacttcttata

SEQ ID NO: 1226624 - DNA, 22 bp, Artificial Sequence
  chemically synthesized
tatttattgtttatactacttc

SEQ ID NO: 1226625 - DNA, 22 bp, Artificial Sequence
  chemically synthesized
aactgtatttattgtttatact

SEQ ID NO: 1226626 - DNA, 22 bp, Artificial Sequence
  chemically synthesized
tgaactgtatttattgtttata

SEQ ID NO: 1226627 - DNA, 22 bp, Artificial Sequence
  chemically synthesized
caaaaggcactctgaactgtat

SEQ ID NO: 1226628 - DNA, 22 bp, Artificial Sequence
  chemically synthesized
aagcatgcacagagctccaaaa

SEQ ID NO: 1226629 - DNA, 22 bp, Artificial Sequence
  chemically synthesized
agagtgccttttggagctctgt

SEQ ID NO: 1226630 - DNA, 22 bp, Artificial Sequence
  chemically synthesized
ttggagctctgtgcatgcttga

SEQ ID NO: 1226631 - DNA, 22 bp, Artificial Sequence
  chemically synthesized
tggagctctgtgcatgcttgag

SEQ ID NO: 1226632 - DNA, 22 bp, Artificial Sequence
  chemically synthesized
ggagctctgtgcatgcttgagt

SEQ ID NO: 1226633 - DNA, 22 bp, Artificial Sequence
  chemically synthesized
gagctctgtgcatgcttgagtt

SEQ ID NO: 1226634 - DNA, 22 bp, Artificial Sequence
  chemically synthesized
acaaagccagcagaagaactca

SEQ ID NO: 1226635 - DNA, 22 bp, Artificial Sequence
  chemically synthesized
gacaaagccagcagaagaactc

SEQ ID NO: 1226636 - DNA, 22 bp, Artificial Sequence
  chemically synthesized
tgtgcatgcttgagttcttctg

SEQ ID NO: 1226637 - DNA, 22 bp, Artificial Sequence
  chemically synthesized
tgacaaagccagcagaagaact

SEQ ID NO: 1226638 - DNA, 22 bp, Artificial Sequence
  chemically synthesized
tgcatgcttgagttcttctgct

SEQ ID NO: 1226639 - DNA, 22 bp, Artificial Sequence
  chemically synthesized
gagttcttctgctggctttgtc

SEQ ID NO: 1226640 - DNA, 22 bp, Artificial Sequence
  chemically synthesized
agttcttctgctggctttgtca

SEQ ID NO: 1226641 - DNA, 22 bp, Artificial Sequence
  chemically synthesized
ttctgctggctttgtcaaaact

SEQ ID NO: 1226642 - DNA, 22 bp, Artificial Sequence
  chemically synthesized
ctgctggctttgtcaaaactta

SEQ ID NO: 1226643 - DNA, 22 bp, Artificial Sequence
  chemically synthesized
tgctggctttgtcaaaacttac

SEQ ID NO: 1226644 - DNA, 22 bp, Artificial Sequence
  chemically synthesized
cgtaagacagatgtaagttttg

SEQ ID NO: 1226645 - DNA, 22 bp, Artificial Sequence
  chemically synthesized
gcgtaagacagatgtaagtttt

SEQ ID NO: 1226646 - DNA, 22 bp, Artificial Sequence
  chemically synthesized
ctggctttgtcaaaacttacat

SEQ ID NO: 1226647 - DNA, 22 bp, Artificial Sequence
  chemically synthesized
tgcgtaagacagatgtaagttt

SEQ ID NO: 1226648 - DNA, 22 bp, Artificial Sequence
  chemically synthesized
gctttgtcaaaacttacatctg

SEQ ID NO: 1226649 - DNA, 22 bp, Artificial Sequence
  chemically synthesized
tgtcaaaacttacatctgtctt

SEQ ID NO: 1226650 - DNA, 22 bp, Artificial Sequence
  chemically synthesized
gtcaaaacttacatctgtctta

SEQ ID NO: 1226651 - DNA, 22 bp, Artificial Sequence
  chemically synthesized
tcaaaacttacatctgtcttac

SEQ ID NO: 1226652 - DNA, 22 bp, Artificial Sequence
  chemically synthesized
cagatcccgctttgcgtaagac

SEQ ID NO: 1226653 - DNA, 22 bp, Artificial Sequence
  chemically synthesized
gcagatcccgctttgcgtaaga

SEQ ID NO: 1226654 - DNA, 22 bp, Artificial Sequence
  chemically synthesized
acatctgtcttacgcaaagcgg

SEQ ID NO: 1226655 - DNA, 22 bp, Artificial Sequence
  chemically synthesized
catctgtcttacgcaaagcggg

SEQ ID NO: 1226656 - DNA, 22 bp, Artificial Sequence
  chemically synthesized
tcttacgcaaagcgggatctgc

SEQ ID NO: 1226657 - DNA, 22 bp, Artificial Sequence
  chemically synthesized
gagtgaatccagtttgcagatc

SEQ ID NO: 1226658 - DNA, 22 bp, Artificial Sequence
  chemically synthesized
acgcaaagcgggatctgcaaac

SEQ ID NO: 1226659 - DNA, 22 bp, Artificial Sequence
  chemically synthesized
cgcaaagcgggatctgcaaact

SEQ ID NO: 1226660 - DNA, 22 bp, Artificial Sequence
  chemically synthesized
ctagagtgaatccagtttgcag

SEQ ID NO: 1226661 - DNA, 22 bp, Artificial Sequence
  chemically synthesized
caaactggattcactctaggaa

SEQ ID NO: 1226662 - DNA, 22 bp, Artificial Sequence
  chemically synthesized
tggcatagtaacaaataattcc

SEQ ID NO: 1226663 - DNA, 22 bp, Artificial Sequence
  chemically synthesized
gattcactctaggaattatttg

SEQ ID NO: 1226664 - DNA, 22 bp, Artificial Sequence
  chemically synthesized
atggcatagtaacaaataattc

SEQ ID NO: 1226665 - DNA, 22 bp, Artificial Sequence
  chemically synthesized
tcttatggcatagtaacaaata

SEQ ID NO: 1226666 - DNA, 22 bp, Artificial Sequence
  chemically synthesized
actctaggaattatttgttact

SEQ ID NO: 1226667 - DNA, 22 bp, Artificial Sequence
  chemically synthesized
atcttatggcatagtaacaaat

SEQ ID NO: 1226668 - DNA, 22 bp, Artificial Sequence
  chemically synthesized
tatcttatggcatagtaacaaa

SEQ ID NO: 1226669 - DNA, 22 bp, Artificial Sequence
  chemically synthesized
taggaattatttgttactatgc

SEQ ID NO: 1226670 - DNA, 22 bp, Artificial Sequence
  chemically synthesized
actttatcttatggcatagtaa

SEQ ID NO: 1226671 - DNA, 22 bp, Artificial Sequence
  chemically synthesized
ggaattatttgttactatgcca

SEQ ID NO: 1226672 - DNA, 22 bp, Artificial Sequence
  chemically synthesized
ttgactttatcttatggcatag

SEQ ID NO: 1226673 - DNA, 22 bp, Artificial Sequence
  chemically synthesized
tttgttactatgccataagata

SEQ ID NO: 1226674 - DNA, 22 bp, Artificial Sequence
  chemically synthesized
aattgttgactttatcttatgg

SEQ ID NO: 1226675 - DNA, 22 bp, Artificial Sequence
  chemically synthesized
tgaattgttgactttatcttat

SEQ ID NO: 1226676 - DNA, 22 bp, Artificial Sequence
  chemically synthesized
gttactatgccataagataaag

SEQ ID NO: 1226677 - DNA, 22 bp, Artificial Sequence
  chemically synthesized
ttactatgccataagataaagt

SEQ ID NO: 1226678 - DNA, 22 bp, Artificial Sequence
  chemically synthesized
ctatgccataagataaagtcaa

SEQ ID NO: 1226679 - DNA, 22 bp, Artificial Sequence
  chemically synthesized
tgccataagataaagtcaacaa

SEQ ID NO: 1226680 - DNA, 22 bp, Artificial Sequence
  chemically synthesized
atgcactctgaattgttgactt

SEQ ID NO: 1226681 - DNA, 22 bp, Artificial Sequence
  chemically synthesized
gatgcactctgaattgttgact

SEQ ID NO: 1226682 - DNA, 22 bp, Artificial Sequence
  chemically synthesized
ttgatgcactctgaattgttga

SEQ ID NO: 1226683 - DNA, 22 bp, Artificial Sequence
  chemically synthesized
cttgatgcactctgaattgttg

SEQ ID NO: 1226684 - DNA, 22 bp, Artificial Sequence
  chemically synthesized
cataagtttcttgatgcactct

SEQ ID NO: 1226685 - DNA, 22 bp, Artificial Sequence
  chemically synthesized
taaaatcgctacataagtttct

SEQ ID NO: 1226686 - DNA, 22 bp, Artificial Sequence
  chemically synthesized
agagtgcatcaagaaacttatg

SEQ ID NO: 1226687 - DNA, 22 bp, Artificial Sequence
  chemically synthesized
tgtaaaatcgctacataagttt

SEQ ID NO: 1226688 - DNA, 22 bp, Artificial Sequence
  chemically synthesized
gacataaatggtactctgtaaa

SEQ ID NO: 1226689 - DNA, 22 bp, Artificial Sequence
  chemically synthesized
atgtagcgattttacagagtac

SEQ ID NO: 1226690 - DNA, 22 bp, Artificial Sequence
  chemically synthesized
tgtagcgattttacagagtacc

SEQ ID NO: 1226691 - DNA, 22 bp, Artificial Sequence
  chemically synthesized
aatacattagacataaatggta

SEQ ID NO: 1226692 - DNA, 22 bp, Artificial Sequence
  chemically synthesized
ttaaatacattagacataaatg

SEQ ID NO: 1226693 - DNA, 22 bp, Artificial Sequence
  chemically synthesized
tacagagtaccatttatgtcta

SEQ ID NO: 1226694 - DNA, 22 bp, Artificial Sequence
  chemically synthesized
acagagtaccatttatgtctaa

SEQ ID NO: 1226695 - DNA, 22 bp, Artificial Sequence
  chemically synthesized
ttattaaatacattagacataa

SEQ ID NO: 1226696 - DNA, 22 bp, Artificial Sequence
  chemically synthesized
cagagtaccatttatgtctaat

SEQ ID NO: 1226697 - DNA, 22 bp, Artificial Sequence
  chemically synthesized
attattaaatacattagacata

SEQ ID NO: 1226698 - DNA, 22 bp, Artificial Sequence
  chemically synthesized
tattattaaatacattagacat

SEQ ID NO: 1226699 - DNA, 22 bp, Artificial Sequence
  chemically synthesized
ctttattattaaatacattaga

SEQ ID NO: 1226700 - DNA, 22 bp, Artificial Sequence
  chemically synthesized
ctcctttattattaaatacatt

SEQ ID NO: 1226701 - DNA, 22 bp, Artificial Sequence
  chemically synthesized
cctcctttattattaaatacat

SEQ ID NO: 1226702 - DNA, 22 bp, Artificial Sequence
  chemically synthesized
atgtctaatgtatttaataata

SEQ ID NO: 1226703 - DNA, 22 bp, Artificial Sequence
  chemically synthesized
tgtctaatgtatttaataataa

SEQ ID NO: 1226704 - DNA, 22 bp, Artificial Sequence
  chemically synthesized
atgtatttaataataaaggagg

SEQ ID NO: 1226705 - DNA, 22 bp, Artificial Sequence
  chemically synthesized
aataataaaggaggaagcatgg

SEQ ID NO: 1226706 - DNA, 22 bp, Artificial Sequence
  chemically synthesized
ataataaaggaggaagcatggg

SEQ ID NO: 1226707 - DNA, 22 bp, Artificial Sequence
  chemically synthesized
caaaaataagatgcccaacacc

SEQ ID NO: 1226708 - DNA, 22 bp, Artificial Sequence
  chemically synthesized
ggcatcttatttttgtaacgct

SEQ ID NO: 1226709 - DNA, 22 bp, Artificial Sequence
  chemically synthesized
atttttgtaacgctttggtttt

SEQ ID NO: 1226710 - DNA, 22 bp, Artificial Sequence
  chemically synthesized
tttttgtaacgctttggtttta

SEQ ID NO: 1226711 - DNA, 22 bp, Artificial Sequence
  chemically synthesized
tatgtaagatagaataaaacca

SEQ ID NO: 1226712 - DNA, 22 bp, Artificial Sequence
  chemically synthesized
ttgtaacgctttggttttattc

SEQ ID NO: 1226713 - DNA, 22 bp, Artificial Sequence
  chemically synthesized
tgtaacgctttggttttattct

SEQ ID NO: 1226714 - DNA, 22 bp, Artificial Sequence
  chemically synthesized
gtaacgctttggttttattcta

SEQ ID NO: 1226715 - DNA, 22 bp, Artificial Sequence
  chemically synthesized
taacgctttggttttattctat

SEQ ID NO: 1226716 - DNA, 22 bp, Artificial Sequence
  chemically synthesized
atccattgtatgtaagatagaa

SEQ ID NO: 1226717 - DNA, 22 bp, Artificial Sequence
  chemically synthesized
tggttttattctatcttacata

SEQ ID NO: 1226718 - DNA, 22 bp, Artificial Sequence
  chemically synthesized
ggttttattctatcttacatac

SEQ ID NO: 1226719 - DNA, 22 bp, Artificial Sequence
  chemically synthesized
ccctaatccattgtatgtaaga

SEQ ID NO: 1226720 - DNA, 22 bp, Artificial Sequence
  chemically synthesized
gttttattctatcttacataca

SEQ ID NO: 1226721 - DNA, 22 bp, Artificial Sequence
  chemically synthesized
cccctaatccattgtatgtaag

SEQ ID NO: 1226722 - DNA, 22 bp, Artificial Sequence
  chemically synthesized
tcccctaatccattgtatgtaa

SEQ ID NO: 1226723 - DNA, 22 bp, Artificial Sequence
  chemically synthesized
ttcccctaatccattgtatgta

SEQ ID NO: 1226724 - DNA, 22 bp, Artificial Sequence
  chemically synthesized
tattctatcttacatacaatgg

SEQ ID NO: 1226725 - DNA, 22 bp, Artificial Sequence
  chemically synthesized
attctatcttacatacaatgga

SEQ ID NO: 1226726 - DNA, 22 bp, Artificial Sequence
  chemically synthesized
ttctatcttacatacaatggat

SEQ ID NO: 1226727 - DNA, 22 bp, Artificial Sequence
  chemically synthesized
tatcttacatacaatggattag

SEQ ID NO: 1226728 - DNA, 22 bp, Artificial Sequence
  chemically synthesized
tcttacatacaatggattaggg

SEQ ID NO: 1226729 - DNA, 22 bp, Artificial Sequence
  chemically synthesized
acatacaatggattaggggaaa

SEQ ID NO: 1226730 - DNA, 22 bp, Artificial Sequence
  chemically synthesized
catacaatggattaggggaaaa

SEQ ID NO: 1226731 - DNA, 22 bp, Artificial Sequence
  chemically synthesized
aggaaggaacacttttccccta

SEQ ID NO: 1226732 - DNA, 22 bp, Artificial Sequence
  chemically synthesized
gaggaaggaacacttttcccct

SEQ ID NO: 1226733 - DNA, 22 bp, Artificial Sequence
  chemically synthesized
aaaatatcttgaggaaggaaca

SEQ ID NO: 1226734 - DNA, 22 bp, Artificial Sequence
  chemically synthesized
tcaaaatatcttgaggaaggaa

SEQ ID NO: 1226735 - DNA, 22 bp, Artificial Sequence
  chemically synthesized
ggggaaaagtgttccttcctca

SEQ ID NO: 1226736 - DNA, 22 bp, Artificial Sequence
  chemically synthesized
ctcaaaatatcttgaggaagga

SEQ ID NO: 1226737 - DNA, 22 bp, Artificial Sequence
  chemically synthesized
agtacttctcaaaatatcttga

SEQ ID NO: 1226738 - DNA, 22 bp, Artificial Sequence
  chemically synthesized
ctcagtacttctcaaaatatct

SEQ ID NO: 1226739 - DNA, 22 bp, Artificial Sequence
  chemically synthesized
cttcctcaagatattttgagaa

SEQ ID NO: 1226740 - DNA, 22 bp, Artificial Sequence
  chemically synthesized
cctcaagatattttgagaagta

SEQ ID NO: 1226741 - DNA, 22 bp, Artificial Sequence
  chemically synthesized
ctcaagatattttgagaagtac

SEQ ID NO: 1226742 - DNA, 22 bp, Artificial Sequence
  chemically synthesized
atatgttgctcagtacttctca

SEQ ID NO: 1226743 - DNA, 22 bp, Artificial Sequence
  chemically synthesized
catatgttgctcagtacttctc

SEQ ID NO: 1226744 - DNA, 22 bp, Artificial Sequence
  chemically synthesized
tcatatgttgctcagtacttct

SEQ ID NO: 1226745 - DNA, 22 bp, Artificial Sequence
  chemically synthesized
aagatattttgagaagtactga

SEQ ID NO: 1226746 - DNA, 22 bp, Artificial Sequence
  chemically synthesized
ttcatatgttgctcagtacttc

SEQ ID NO: 1226747 - DNA, 22 bp, Artificial Sequence
  chemically synthesized
cttttcatatgttgctcagtac

SEQ ID NO: 1226748 - DNA, 22 bp, Artificial Sequence
  chemically synthesized
tgagaagtactgagcaacatat

SEQ ID NO: 1226749 - DNA, 22 bp, Artificial Sequence
  chemically synthesized
gagaagtactgagcaacatatg

SEQ ID NO: 1226750 - DNA, 22 bp, Artificial Sequence
  chemically synthesized
agaagtactgagcaacatatga

SEQ ID NO: 1226751 - DNA, 22 bp, Artificial Sequence
  chemically synthesized
cccaaactgcttttcatatgtt

SEQ ID NO: 1226752 - DNA, 22 bp, Artificial Sequence
  chemically synthesized
tccccaaactgcttttcatatg

SEQ ID NO: 1226753 - DNA, 22 bp, Artificial Sequence
  chemically synthesized
agcaacatatgaaaagcagttt

SEQ ID NO: 1226754 - DNA, 22 bp, Artificial Sequence
  chemically synthesized
ggggagagatgcggtatgttgc

SEQ ID NO: 1226755 - DNA, 22 bp, Artificial Sequence
  chemically synthesized
gggagagatgcggtatgttgct

SEQ ID NO: 1226756 - DNA, 22 bp, Artificial Sequence
  chemically synthesized
catatagtgatggtgtcaaata

SEQ ID NO: 1226757 - DNA, 22 bp, Artificial Sequence
  chemically synthesized
cttgctggttctatttgacacc

SEQ ID NO: 1226758 - DNA, 22 bp, Artificial Sequence
  chemically synthesized
gctggttctatttgacaccatc

SEQ ID NO: 1226759 - DNA, 22 bp, Artificial Sequence
  chemically synthesized
ctggttctatttgacaccatca

SEQ ID NO: 1226760 - DNA, 22 bp, Artificial Sequence
  chemically synthesized
gttctatttgacaccatcacta

SEQ ID NO: 1226761 - DNA, 22 bp, Artificial Sequence
  chemically synthesized
agcccgttccatatagtgatgg

SEQ ID NO: 1226762 - DNA, 22 bp, Artificial Sequence
  chemically synthesized
cagcccgttccatatagtgatg

SEQ ID NO: 1226763 - DNA, 22 bp, Artificial Sequence
  chemically synthesized
tcagcccgttccatatagtgat

SEQ ID NO: 1226764 - DNA, 22 bp, Artificial Sequence
  chemically synthesized
tatttgacaccatcactatatg

SEQ ID NO: 1226765 - DNA, 22 bp, Artificial Sequence
  chemically synthesized
tttgacaccatcactatatgga

SEQ ID NO: 1226766 - DNA, 22 bp, Artificial Sequence
  chemically synthesized
gacaccatcactatatggaacg

SEQ ID NO: 1226767 - DNA, 22 bp, Artificial Sequence
  chemically synthesized
acaccatcactatatggaacgg

SEQ ID NO: 1226768 - DNA, 22 bp, Artificial Sequence
  chemically synthesized
gccgattttcagcccgttccat

SEQ ID NO: 1226769 - DNA, 22 bp, Artificial Sequence
  chemically synthesized
tatggaacgggctgaaaatcgg

SEQ ID NO: 1226770 - DNA, 22 bp, Artificial Sequence
  chemically synthesized
agtgagcccaagttggccgatt

SEQ ID NO: 1226771 - DNA, 22 bp, Artificial Sequence
  chemically synthesized
aagtgagcccaagttggccgat

SEQ ID NO: 1226772 - DNA, 22 bp, Artificial Sequence
  chemically synthesized
aaaatcggccaacttgggctca

SEQ ID NO: 1226773 - DNA, 22 bp, Artificial Sequence
  chemically synthesized
ataggagccttaagtgagccca

SEQ ID NO: 1226774 - DNA, 22 bp, Artificial Sequence
  chemically synthesized
gggctcacttaaggctcctatg

SEQ ID NO: 1226775 - DNA, 22 bp, Artificial Sequence
  chemically synthesized
ggctcacttaaggctcctatga

SEQ ID NO: 1226776 - DNA, 22 bp, Artificial Sequence
  chemically synthesized
gcaacaaagaatagctcatagg

SEQ ID NO: 1226777 - DNA, 22 bp, Artificial Sequence
  chemically synthesized
acttaaggctcctatgagctat

SEQ ID NO: 1226778 - DNA, 22 bp, Artificial Sequence
  chemically synthesized
aaggctcctatgagctattctt

SEQ ID NO: 1226779 - DNA, 22 bp, Artificial Sequence
  chemically synthesized
aggctcctatgagctattcttt

SEQ ID NO: 1226780 - DNA, 22 bp, Artificial Sequence
  chemically synthesized
atatgtgctggcaacaaagaat

SEQ ID NO: 1226781 - DNA, 22 bp, Artificial Sequence
  chemically synthesized
ctatgagctattctttgttgcc

SEQ ID NO: 1226782 - DNA, 22 bp, Artificial Sequence
  chemically synthesized
tgagctattctttgttgccagc

SEQ ID NO: 1226783 - DNA, 22 bp, Artificial Sequence
  chemically synthesized
ttctttgttgccagcacatatt

SEQ ID NO: 1226784 - DNA, 22 bp, Artificial Sequence
  chemically synthesized
tttgttgccagcacatattaat

SEQ ID NO: 1226785 - DNA, 22 bp, Artificial Sequence
  chemically synthesized
tgttgccagcacatattaattc

SEQ ID NO: 1226786 - DNA, 22 bp, Artificial Sequence
  chemically synthesized
gttgccagcacatattaattcc

SEQ ID NO: 1226787 - DNA, 22 bp, Artificial Sequence
  chemically synthesized
ttgccagcacatattaattccc

SEQ ID NO: 1226788 - DNA, 22 bp, Artificial Sequence
  chemically synthesized
ccagcacatattaattcccgct

SEQ ID NO: 1226789 - DNA, 22 bp, Artificial Sequence
  chemically synthesized
attcccgctctttctcttcccc

SEQ ID NO: 1226790 - DNA, 22 bp, Artificial Sequence
  chemically synthesized
ccgctctttctcttcccctctc

SEQ ID NO: 1226791 - DNA, 22 bp, Artificial Sequence
  chemically synthesized
acaacagtaagcggggagaggg

SEQ ID NO: 1226792 - DNA, 22 bp, Artificial Sequence
  chemically synthesized
cacaacagtaagcggggagagg

SEQ ID NO: 1226793 - DNA, 22 bp, Artificial Sequence
  chemically synthesized
tttctcttcccctctccccgct

SEQ ID NO: 1226794 - DNA, 22 bp, Artificial Sequence
  chemically synthesized
cttcacaacagtaagcggggag

SEQ ID NO: 1226795 - DNA, 22 bp, Artificial Sequence
  chemically synthesized
tctcttcccctctccccgctta

SEQ ID NO: 1226796 - DNA, 22 bp, Artificial Sequence
  chemically synthesized
ctcttcccctctccccgcttac

SEQ ID NO: 1226797 - DNA, 22 bp, Artificial Sequence
  chemically synthesized
tcttcccctctccccgcttact

SEQ ID NO: 1226798 - DNA, 22 bp, Artificial Sequence
  chemically synthesized
ttcccctctccccgcttactgt

SEQ ID NO: 1226799 - DNA, 22 bp, Artificial Sequence
  chemically synthesized
atgctacttcacaacagtaagc

SEQ ID NO: 1226800 - DNA, 22 bp, Artificial Sequence
  chemically synthesized
cccctctccccgcttactgttg

SEQ ID NO: 1226801 - DNA, 22 bp, Artificial Sequence
  chemically synthesized
aatgctacttcacaacagtaag

SEQ ID NO: 1226802 - DNA, 22 bp, Artificial Sequence
  chemically synthesized
ccctctccccgcttactgttgt

SEQ ID NO: 1226803 - DNA, 22 bp, Artificial Sequence
  chemically synthesized
tccccgcttactgttgtgaagt

SEQ ID NO: 1226804 - DNA, 22 bp, Artificial Sequence
  chemically synthesized
cccgcttactgttgtgaagtag

SEQ ID NO: 1226805 - DNA, 22 bp, Artificial Sequence
  chemically synthesized
aacaggcttaatgctacttcac

SEQ ID NO: 1226806 - DNA, 22 bp, Artificial Sequence
  chemically synthesized
tgaacaggcttaatgctacttc

SEQ ID NO: 1226807 - DNA, 22 bp, Artificial Sequence
  chemically synthesized
tctgaacaggcttaatgctact

SEQ ID NO: 1226808 - DNA, 22 bp, Artificial Sequence
  chemically synthesized
actgttgtgaagtagcattaag

SEQ ID NO: 1226809 - DNA, 22 bp, Artificial Sequence
  chemically synthesized
ctgttgtgaagtagcattaagc

SEQ ID NO: 1226810 - DNA, 22 bp, Artificial Sequence
  chemically synthesized
ttgtgaagtagcattaagcctg

SEQ ID NO: 1226811 - DNA, 22 bp, Artificial Sequence
  chemically synthesized
caaattctctgaacaggcttaa

SEQ ID NO: 1226812 - DNA, 22 bp, Artificial Sequence
  chemically synthesized
tgaagtagcattaagcctgttc

SEQ ID NO: 1226813 - DNA, 22 bp, Artificial Sequence
  chemically synthesized
ttccaaattctctgaacaggct

SEQ ID NO: 1226814 - DNA, 22 bp, Artificial Sequence
  chemically synthesized
attccaaattctctgaacaggc

SEQ ID NO: 1226815 - DNA, 22 bp, Artificial Sequence
  chemically synthesized
tattccaaattctctgaacagg

SEQ ID NO: 1226816 - DNA, 22 bp, Artificial Sequence
  chemically synthesized
ttattccaaattctctgaacag

SEQ ID NO: 1226817 - DNA, 22 bp, Artificial Sequence
  chemically synthesized
agcctgttcagagaatttggaa

SEQ ID NO: 1226818 - DNA, 22 bp, Artificial Sequence
  chemically synthesized
gcccccatatatttttattcca

SEQ ID NO: 1226819 - DNA, 22 bp, Artificial Sequence
  chemically synthesized
ttcagagaatttggaataaaaa

SEQ ID NO: 1226820 - DNA, 22 bp, Artificial Sequence
  chemically synthesized
agagaatttggaataaaaatat

SEQ ID NO: 1226821 - DNA, 22 bp, Artificial Sequence
  chemically synthesized
attggcccccatatatttttat

SEQ ID NO: 1226822 - DNA, 22 bp, Artificial Sequence
  chemically synthesized
ctaattggcccccatatatttt

SEQ ID NO: 1226823 - DNA, 22 bp, Artificial Sequence
  chemically synthesized
tcctaattggcccccatatatt

SEQ ID NO: 1226824 - DNA, 22 bp, Artificial Sequence
  chemically synthesized
ctctcctaattggcccccatat

SEQ ID NO: 1226825 - DNA, 22 bp, Artificial Sequence
  chemically synthesized
ggaataaaaatatatgggggcc

SEQ ID NO: 1226826 - DNA, 22 bp, Artificial Sequence
  chemically synthesized
gaataaaaatatatgggggcca

SEQ ID NO: 1226827 - DNA, 22 bp, Artificial Sequence
  chemically synthesized
agcagccatgttgctctcctaa

SEQ ID NO: 1226828 - DNA, 22 bp, Artificial Sequence
  chemically synthesized
aattcagcagccatgttgctct

SEQ ID NO: 1226829 - DNA, 22 bp, Artificial Sequence
  chemically synthesized
ttaaattcagcagccatgttgc

SEQ ID NO: 1226830 - DNA, 22 bp, Artificial Sequence
  chemically synthesized
ggagagcaacatggctgctgaa

SEQ ID NO: 1226831 - DNA, 22 bp, Artificial Sequence
  chemically synthesized
ctgaatttaataggtactcttt

SEQ ID NO: 1226832 - DNA, 22 bp, Artificial Sequence
  chemically synthesized
aatttaataggtactctttgtg

SEQ ID NO: 1226833 - DNA, 22 bp, Artificial Sequence
  chemically synthesized
aataggtactctttgtgtctac

SEQ ID NO: 1226834 - DNA, 22 bp, Artificial Sequence
  chemically synthesized
ataggtactctttgtgtctact

SEQ ID NO: 1226835 - DNA, 22 bp, Artificial Sequence
  chemically synthesized
agagtcaaatagtgagtagaca

SEQ ID NO: 1226836 - DNA, 22 bp, Artificial Sequence
  chemically synthesized
ctcagagtcaaatagtgagtag

SEQ ID NO: 1226837 - DNA, 22 bp, Artificial Sequence
  chemically synthesized
gctcagagtcaaatagtgagta

SEQ ID NO: 1226838 - DNA, 22 bp, Artificial Sequence
  chemically synthesized
ttgctcagagtcaaatagtgag

SEQ ID NO: 1226839 - DNA, 22 bp, Artificial Sequence
  chemically synthesized
tttgtgtctactcactatttga

SEQ ID NO: 1226840 - DNA, 22 bp, Artificial Sequence
  chemically synthesized
ctcttgctcagagtcaaatagt

SEQ ID NO: 1226841 - DNA, 22 bp, Artificial Sequence
  chemically synthesized
tgtgtctactcactatttgact

SEQ ID NO: 1226842 - DNA, 22 bp, Artificial Sequence
  chemically synthesized
gtgtctactcactatttgactc

SEQ ID NO: 1226843 - DNA, 22 bp, Artificial Sequence
  chemically synthesized
tgtctactcactatttgactct

SEQ ID NO: 1226844 - DNA, 22 bp, Artificial Sequence
  chemically synthesized
tagattgctcttgctcagagtc

SEQ ID NO: 1226845 - DNA, 22 bp, Artificial Sequence
  chemically synthesized
ctcactatttgactctgagcaa

SEQ ID NO: 1226846 - DNA, 22 bp, Artificial Sequence
  chemically synthesized
actatttgactctgagcaagag

SEQ ID NO: 1226847 - DNA, 22 bp, Artificial Sequence
  chemically synthesized
aattgtagattgctcttgctca

SEQ ID NO: 1226848 - DNA, 22 bp, Artificial Sequence
  chemically synthesized
gaattgtagattgctcttgctc

SEQ ID NO: 1226849 - DNA, 22 bp, Artificial Sequence
  chemically synthesized
tttgactctgagcaagagcaat

SEQ ID NO: 1226850 - DNA, 22 bp, Artificial Sequence
  chemically synthesized
acttgaattgtagattgctctt

SEQ ID NO: 1226851 - DNA, 22 bp, Artificial Sequence
  chemically synthesized
aacttgaattgtagattgctct

SEQ ID NO: 1226852 - DNA, 22 bp, Artificial Sequence
  chemically synthesized
gactctgagcaagagcaatcta

SEQ ID NO: 1226853 - DNA, 22 bp, Artificial Sequence
  chemically synthesized
taacttgaattgtagattgctc

SEQ ID NO: 1226854 - DNA, 22 bp, Artificial Sequence
  chemically synthesized
actctgagcaagagcaatctac

SEQ ID NO: 1226855 - DNA, 22 bp, Artificial Sequence
  chemically synthesized
tgagcaagagcaatctacaatt

SEQ ID NO: 1226856 - DNA, 22 bp, Artificial Sequence
  chemically synthesized
aattttaacttgaattgtagat

SEQ ID NO: 1226857 - DNA, 22 bp, Artificial Sequence
  chemically synthesized
gaattttaacttgaattgtaga

SEQ ID NO: 1226858 - DNA, 22 bp, Artificial Sequence
  chemically synthesized
agcaagagcaatctacaattca

SEQ ID NO: 1226859 - DNA, 22 bp, Artificial Sequence
  chemically synthesized
cgcccggcttgaattttaactt

SEQ ID NO: 1226860 - DNA, 22 bp, Artificial Sequence
  chemically synthesized
caattcaagttaaaattcaagc

SEQ ID NO: 1226861 - DNA, 22 bp, Artificial Sequence
  chemically synthesized
aagttaaaattcaagccgggcg

SEQ ID NO: 1226862 - DNA, 22 bp, Artificial Sequence
  chemically synthesized
caggcatgagccactgcgcccg

SEQ ID NO: 1226863 - DNA, 22 bp, Artificial Sequence
  chemically synthesized
aaattcaagccgggcgcagtgg

SEQ ID NO: 1226864 - DNA, 22 bp, Artificial Sequence
  chemically synthesized
ggattgcaggcatgagccactg

SEQ ID NO: 1226865 - DNA, 22 bp, Artificial Sequence
  chemically synthesized
aagccgggcgcagtggctcatg

SEQ ID NO: 1226866 - DNA, 22 bp, Artificial Sequence
  chemically synthesized
ccaaagtgctgggattgcaggc

SEQ ID NO: 1226867 - DNA, 22 bp, Artificial Sequence
  chemically synthesized
ggcctcccaaagtgctgggatt

SEQ ID NO: 1226868 - DNA, 22 bp, Artificial Sequence
  chemically synthesized
atgcctgcaatcccagcacttt

SEQ ID NO: 1226869 - DNA, 22 bp, Artificial Sequence
  chemically synthesized
cctcggcctcccaaagtgctgg

SEQ ID NO: 1226870 - DNA, 22 bp, Artificial Sequence
  chemically synthesized
ctgcctcggcctcccaaagtgc

SEQ ID NO: 1226871 - DNA, 22 bp, Artificial Sequence
  chemically synthesized
caatcccagcactttgggaggc

SEQ ID NO: 1226872 - DNA, 22 bp, Artificial Sequence
  chemically synthesized
gtgatcctcctgcctcggcctc

SEQ ID NO: 1226873 - DNA, 22 bp, Artificial Sequence
  chemically synthesized
acctcgtgatcctcctgcctcg

SEQ ID NO: 1226874 - DNA, 22 bp, Artificial Sequence
  chemically synthesized
ctgacctcgtgatcctcctgcc

SEQ ID NO: 1226875 - DNA, 22 bp, Artificial Sequence
  chemically synthesized
tgggaggccgaggcaggaggat

SEQ ID NO: 1226876 - DNA, 22 bp, Artificial Sequence
  chemically synthesized
gggaggccgaggcaggaggatc

SEQ ID NO: 1226877 - DNA, 22 bp, Artificial Sequence
  chemically synthesized
ggaggccgaggcaggaggatca

SEQ ID NO: 1226878 - DNA, 22 bp, Artificial Sequence
  chemically synthesized
gatctcctgacctcgtgatcct

SEQ ID NO: 1226879 - DNA, 22 bp, Artificial Sequence
  chemically synthesized
gccaggatggtctcgatctcct

SEQ ID NO: 1226880 - DNA, 22 bp, Artificial Sequence
  chemically synthesized
accgtgttagccaggatggtct

SEQ ID NO: 1226881 - DNA, 22 bp, Artificial Sequence
  chemically synthesized
caccgtgttagccaggatggtc

SEQ ID NO: 1226882 - DNA, 22 bp, Artificial Sequence
  chemically synthesized
gtagagacggggtttcaccgtg

SEQ ID NO: 1226883 - DNA, 22 bp, Artificial Sequence
  chemically synthesized
agtagagacggggtttcaccgt

SEQ ID NO: 1226884 - DNA, 22 bp, Artificial Sequence
  chemically synthesized
tagtagagacggggtttcaccg

SEQ ID NO: 1226885 - DNA, 22 bp, Artificial Sequence
  chemically synthesized
ttagtagagacggggtttcacc

SEQ ID NO: 1226886 - DNA, 22 bp, Artificial Sequence
  chemically synthesized
gctaacacggtgaaaccccgtc

SEQ ID NO: 1226887 - DNA, 22 bp, Artificial Sequence
  chemically synthesized
tatttttagtagagacggggtt

SEQ ID NO: 1226888 - DNA, 22 bp, Artificial Sequence
  chemically synthesized
gtatttttagtagagacggggt

SEQ ID NO: 1226889 - DNA, 22 bp, Artificial Sequence
  chemically synthesized
tgtatttttagtagagacgggg

SEQ ID NO: 1226890 - DNA, 22 bp, Artificial Sequence
  chemically synthesized
acacggtgaaaccccgtctcta

SEQ ID NO: 1226891 - DNA, 22 bp, Artificial Sequence
  chemically synthesized
ttgtatttttagtagagacggg

SEQ ID NO: 1226892 - DNA, 22 bp, Artificial Sequence
  chemically synthesized
tttgtatttttagtagagacgg

SEQ ID NO: 1226893 - DNA, 22 bp, Artificial Sequence
  chemically synthesized
ttttgtatttttagtagagacg

SEQ ID NO: 1226894 - DNA, 22 bp, Artificial Sequence
  chemically synthesized
tttttgtatttttagtagagac

SEQ ID NO: 1226895 - DNA, 22 bp, Artificial Sequence
  chemically synthesized
ttttttgtatttttagtagaga

SEQ ID NO: 1226896 - DNA, 22 bp, Artificial Sequence
  chemically synthesized
atttttttttgtatttttagta

SEQ ID NO: 1226897 - DNA, 22 bp, Artificial Sequence
  chemically synthesized
tactaaaaatacaaaaaaaaat

SEQ ID NO: 1226898 - DNA, 22 bp, Artificial Sequence
  chemically synthesized
ctaaaaatacaaaaaaaaatta

SEQ ID NO: 1226899 - DNA, 22 bp, Artificial Sequence
  chemically synthesized
aaaatacaaaaaaaaattagcc

SEQ ID NO: 1226900 - DNA, 22 bp, Artificial Sequence
  chemically synthesized
caggcgcccccccaccacgccc

SEQ ID NO: 1226901 - DNA, 22 bp, Artificial Sequence
  chemically synthesized
ggactacaggcgcccccccacc

SEQ ID NO: 1226902 - DNA, 22 bp, Artificial Sequence
  chemically synthesized
gccgggcgtggtgggggggcgc

SEQ ID NO: 1226903 - DNA, 22 bp, Artificial Sequence
  chemically synthesized
ccgagtagctgggactacaggc

SEQ ID NO: 1226904 - DNA, 22 bp, Artificial Sequence
  chemically synthesized
agcctcccgagtagctgggact

SEQ ID NO: 1226905 - DNA, 22 bp, Artificial Sequence
  chemically synthesized
cctcagcctcccgagtagctgg

SEQ ID NO: 1226906 - DNA, 22 bp, Artificial Sequence
  chemically synthesized
ctgcctcagcctcccgagtagc

SEQ ID NO: 1226907 - DNA, 22 bp, Artificial Sequence
  chemically synthesized
tcctgcctcagcctcccgagta

SEQ ID NO: 1226908 - DNA, 22 bp, Artificial Sequence
  chemically synthesized
tagtcccagctactcgggaggc

SEQ ID NO: 1226909 - DNA, 22 bp, Artificial Sequence
  chemically synthesized
acgccattctcctgcctcagcc

SEQ ID NO: 1226910 - DNA, 22 bp, Artificial Sequence
  chemically synthesized
ctcgggaggctgaggcaggaga

SEQ ID NO: 1226911 - DNA, 22 bp, Artificial Sequence
  chemically synthesized
gggaggctgaggcaggagaatg

SEQ ID NO: 1226912 - DNA, 22 bp, Artificial Sequence
  chemically synthesized
ccggattcacgccattctcctg

SEQ ID NO: 1226913 - DNA, 22 bp, Artificial Sequence
  chemically synthesized
cgcctcccggattcacgccatt

SEQ ID NO: 1226914 - DNA, 22 bp, Artificial Sequence
  chemically synthesized
aggcaggagaatggcgtgaatc

SEQ ID NO: 1226915 - DNA, 22 bp, Artificial Sequence
  chemically synthesized
caagctccgcctcccggattca

SEQ ID NO: 1226916 - DNA, 22 bp, Artificial Sequence
  chemically synthesized
actgcaagctccgcctcccgga

SEQ ID NO: 1226917 - DNA, 22 bp, Artificial Sequence
  chemically synthesized
ggctcactgcaagctccgcctc

SEQ ID NO: 1226918 - DNA, 22 bp, Artificial Sequence
  chemically synthesized
gagtgcagtggcgcgatctcgg

SEQ ID NO: 1226919 - DNA, 22 bp, Artificial Sequence
  chemically synthesized
gcagtgagccgagatcgcgcca

SEQ ID NO: 1226920 - DNA, 22 bp, Artificial Sequence
  chemically synthesized
cagtgagccgagatcgcgccac

SEQ ID NO: 1226921 - DNA, 22 bp, Artificial Sequence
  chemically synthesized
tcgcccaggctggagtgcagtg

SEQ ID NO: 1226922 - DNA, 22 bp, Artificial Sequence
  chemically synthesized
tgtcgcccaggctggagtgcag

SEQ ID NO: 1226923 - DNA, 22 bp, Artificial Sequence
  chemically synthesized
ctctgtcgcccaggctggagtg

SEQ ID NO: 1226924 - DNA, 22 bp, Artificial Sequence
  chemically synthesized
gctctgtcgcccaggctggagt

SEQ ID NO: 1226925 - DNA, 22 bp, Artificial Sequence
  chemically synthesized
cactccagcctgggcgacagag

SEQ ID NO: 1226926 - DNA, 22 bp, Artificial Sequence
  chemically synthesized
agacagagtcttgctctgtcgc

SEQ ID NO: 1226927 - DNA, 22 bp, Artificial Sequence
  chemically synthesized
gagacagagtcttgctctgtcg

SEQ ID NO: 1226928 - DNA, 22 bp, Artificial Sequence
  chemically synthesized
tgagacagagtcttgctctgtc

SEQ ID NO: 1226929 - DNA, 22 bp, Artificial Sequence
  chemically synthesized
cagcctgggcgacagagcaaga

SEQ ID NO: 1226930 - DNA, 22 bp, Artificial Sequence
  chemically synthesized
ttttgagacagagtcttgctct

SEQ ID NO: 1226931 - DNA, 22 bp, Artificial Sequence
  chemically synthesized
attttgagacagagtcttgctc

SEQ ID NO: 1226932 - DNA, 22 bp, Artificial Sequence
  chemically synthesized
tattttgagacagagtcttgct

SEQ ID NO: 1226933 - DNA, 22 bp, Artificial Sequence
  chemically synthesized
ttattttgagacagagtcttgc

SEQ ID NO: 1226934 - DNA, 22 bp, Artificial Sequence
  chemically synthesized
ggcgacagagcaagactctgtc

SEQ ID NO: 1226935 - DNA, 22 bp, Artificial Sequence
  chemically synthesized
tttttattttgagacagagtct

SEQ ID NO: 1226936 - DNA, 22 bp, Artificial Sequence
  chemically synthesized
atttttattttgagacagagtc

SEQ ID NO: 1226937 - DNA, 22 bp, Artificial Sequence
  chemically synthesized
tatttttattttgagacagagt

SEQ ID NO: 1226938 - DNA, 22 bp, Artificial Sequence
  chemically synthesized
ttatttttattttgagacagag

SEQ ID NO: 1226939 - DNA, 22 bp, Artificial Sequence
  chemically synthesized
tttatttttattttgagacaga

SEQ ID NO: 1226940 - DNA, 22 bp, Artificial Sequence
  chemically synthesized
ttttatttttattttgagacag

SEQ ID NO: 1226941 - DNA, 22 bp, Artificial Sequence
  chemically synthesized
tttttatttttattttgagaca

SEQ ID NO: 1226942 - DNA, 22 bp, Artificial Sequence
  chemically synthesized
ttttttatttttattttgagac

SEQ ID NO: 1226943 - DNA, 22 bp, Artificial Sequence
  chemically synthesized
tttttttttatttttattttga

SEQ ID NO: 1226944 - DNA, 22 bp, Artificial Sequence
  chemically synthesized
atttttttttatttttattttg

SEQ ID NO: 1226945 - DNA, 22 bp, Artificial Sequence
  chemically synthesized
tatttttttttatttttatttt

SEQ ID NO: 1226946 - DNA, 22 bp, Artificial Sequence
  chemically synthesized
ttatttttttttatttttattt

SEQ ID NO: 1226947 - DNA, 22 bp, Artificial Sequence
  chemically synthesized
tttttatttttttttattttta

SEQ ID NO: 1226948 - DNA, 22 bp, Artificial Sequence
  chemically synthesized
atttttatttttttttattttt

SEQ ID NO: 1226949 - DNA, 22 bp, Artificial Sequence
  chemically synthesized
tgtctcaaaataaaaataaaaa

SEQ ID NO: 1226950 - DNA, 22 bp, Artificial Sequence
  chemically synthesized
tatttttatttttttttatttt

SEQ ID NO: 1226951 - DNA, 22 bp, Artificial Sequence
  chemically synthesized
ttatttttatttttttttattt

SEQ ID NO: 1226952 - DNA, 22 bp, Artificial Sequence
  chemically synthesized
tctcaaaataaaaataaaaaaa

SEQ ID NO: 1226953 - DNA, 22 bp, Artificial Sequence
  chemically synthesized
tttatttttatttttttttatt

SEQ ID NO: 1226954 - DNA, 22 bp, Artificial Sequence
  chemically synthesized
ttttttatttttattttttttt

SEQ ID NO: 1226955 - DNA, 22 bp, Artificial Sequence
  chemically synthesized
aaaataaaaataaaaaaaaata

SEQ ID NO: 1226956 - DNA, 22 bp, Artificial Sequence
  chemically synthesized
attttttatttttatttttttt

SEQ ID NO: 1226957 - DNA, 22 bp, Artificial Sequence
  chemically synthesized
tattttttatttttattttttt

SEQ ID NO: 1226958 - DNA, 22 bp, Artificial Sequence
  chemically synthesized
ttattttttatttttatttttt

SEQ ID NO: 1226959 - DNA, 22 bp, Artificial Sequence
  chemically synthesized
tttattttttatttttattttt

SEQ ID NO: 1226960 - DNA, 22 bp, Artificial Sequence
  chemically synthesized
ttttattttttatttttatttt

SEQ ID NO: 1226961 - DNA, 22 bp, Artificial Sequence
  chemically synthesized
aatttttttattttttattttt

SEQ ID NO: 1226962 - DNA, 22 bp, Artificial Sequence
  chemically synthesized
gaatttttttattttttatttt

SEQ ID NO: 1226963 - DNA, 22 bp, Artificial Sequence
  chemically synthesized
ggtaaacttgaatttttttatt

SEQ ID NO: 1226964 - DNA, 22 bp, Artificial Sequence
  chemically synthesized
attcggtaaacttgaatttttt

SEQ ID NO: 1226965 - DNA, 22 bp, Artificial Sequence
  chemically synthesized
cattcggtaaacttgaattttt

SEQ ID NO: 1226966 - DNA, 22 bp, Artificial Sequence
  chemically synthesized
tagcagatatcatggcttcatt

SEQ ID NO: 1226967 - DNA, 22 bp, Artificial Sequence
  chemically synthesized
aagtttaccgaatgaagccatg

SEQ ID NO: 1226968 - DNA, 22 bp, Artificial Sequence
  chemically synthesized
ttgtagcagatatcatggcttc

SEQ ID NO: 1226969 - DNA, 22 bp, Artificial Sequence
  chemically synthesized
accgaatgaagccatgatatct

SEQ ID NO: 1226970 - DNA, 22 bp, Artificial Sequence
  chemically synthesized
ccgaatgaagccatgatatctg

SEQ ID NO: 1226971 - DNA, 22 bp, Artificial Sequence
  chemically synthesized
agatccagccctattgtagcag

SEQ ID NO: 1226972 - DNA, 22 bp, Artificial Sequence
  chemically synthesized
ctacaatagggctggatctgaa

SEQ ID NO: 1226973 - DNA, 22 bp, Artificial Sequence
  chemically synthesized
caatagggctggatctgaacta

SEQ ID NO: 1226974 - DNA, 22 bp, Artificial Sequence
  chemically synthesized
caatgagggtaatagttcagat

SEQ ID NO: 1226975 - DNA, 22 bp, Artificial Sequence
  chemically synthesized
gcaatgagggtaatagttcaga

SEQ ID NO: 1226976 - DNA, 22 bp, Artificial Sequence
  chemically synthesized
ttgcaatgagggtaatagttca

SEQ ID NO: 1226977 - DNA, 22 bp, Artificial Sequence
  chemically synthesized
cttgcaatgagggtaatagttc

SEQ ID NO: 1226978 - DNA, 22 bp, Artificial Sequence
  chemically synthesized
gcttcttgcaatgagggtaata

SEQ ID NO: 1226979 - DNA, 22 bp, Artificial Sequence
  chemically synthesized
gatctgaactattaccctcatt

SEQ ID NO: 1226980 - DNA, 22 bp, Artificial Sequence
  chemically synthesized
tgtctggcttcttgcaatgagg

SEQ ID NO: 1226981 - DNA, 22 bp, Artificial Sequence
  chemically synthesized
gtgtctggcttcttgcaatgag

SEQ ID NO: 1226982 - DNA, 22 bp, Artificial Sequence
  chemically synthesized
tgtgtctggcttcttgcaatga

SEQ ID NO: 1226983 - DNA, 22 bp, Artificial Sequence
  chemically synthesized
aactattaccctcattgcaaga

SEQ ID NO: 1226984 - DNA, 22 bp, Artificial Sequence
  chemically synthesized
ttgtgtctggcttcttgcaatg

SEQ ID NO: 1226985 - DNA, 22 bp, Artificial Sequence
  chemically synthesized
ttttgtgtctggcttcttgcaa

SEQ ID NO: 1226986 - DNA, 22 bp, Artificial Sequence
  chemically synthesized
ttaccctcattgcaagaagcca

SEQ ID NO: 1226987 - DNA, 22 bp, Artificial Sequence
  chemically synthesized
ccctcattgcaagaagccagac

SEQ ID NO: 1226988 - DNA, 22 bp, Artificial Sequence
  chemically synthesized
attgcaagaagccagacacaaa

SEQ ID NO: 1226989 - DNA, 22 bp, Artificial Sequence
  chemically synthesized
caagaagccagacacaaaagaa

SEQ ID NO: 1226990 - DNA, 22 bp, Artificial Sequence
  chemically synthesized
tatcaatataatacatgttctt

SEQ ID NO: 1226991 - DNA, 22 bp, Artificial Sequence
  chemically synthesized
atatcaatataatacatgttct

SEQ ID NO: 1226992 - DNA, 22 bp, Artificial Sequence
  chemically synthesized
tatatcaatataatacatgttc

SEQ ID NO: 1226993 - DNA, 22 bp, Artificial Sequence
  chemically synthesized
gatattttatatcaatataata

SEQ ID NO: 1226994 - DNA, 22 bp, Artificial Sequence
  chemically synthesized
ggatattttatatcaatataat

SEQ ID NO: 1226995 - DNA, 22 bp, Artificial Sequence
  chemically synthesized
tggatattttatatcaatataa

SEQ ID NO: 1226996 - DNA, 22 bp, Artificial Sequence
  chemically synthesized
ttggatattttatatcaatata

SEQ ID NO: 1226997 - DNA, 22 bp, Artificial Sequence
  chemically synthesized
tttggatattttatatcaatat

SEQ ID NO: 1226998 - DNA, 22 bp, Artificial Sequence
  chemically synthesized
cctttttggatattttatatca

SEQ ID NO: 1226999 - DNA, 22 bp, Artificial Sequence
  chemically synthesized
gcctttttggatattttatatc

SEQ ID NO: 1227000 - DNA, 22 bp, Artificial Sequence
  chemically synthesized
tattgatataaaatatccaaaa

SEQ ID NO: 1227001 - DNA, 22 bp, Artificial Sequence
  chemically synthesized
atataaaatatccaaaaaggca

SEQ ID NO: 1227002 - DNA, 22 bp, Artificial Sequence
  chemically synthesized
tccatatgtatttgcctttttg

SEQ ID NO: 1227003 - DNA, 22 bp, Artificial Sequence
  chemically synthesized
tgtccatatgtatttgcctttt

SEQ ID NO: 1227004 - DNA, 22 bp, Artificial Sequence
  chemically synthesized
ctgtccatatgtatttgccttt

SEQ ID NO: 1227005 - DNA, 22 bp, Artificial Sequence
  chemically synthesized
tttctgtccatatgtatttgcc

SEQ ID NO: 1227006 - DNA, 22 bp, Artificial Sequence
  chemically synthesized
tcaatctatttctgtccatatg

SEQ ID NO: 1227007 - DNA, 22 bp, Artificial Sequence
  chemically synthesized
ggcaattgtcaatctatttctg

SEQ ID NO: 1227008 - DNA, 22 bp, Artificial Sequence
  chemically synthesized
ccaccccagccctaggcaattg

SEQ ID NO: 1227009 - DNA, 22 bp, Artificial Sequence
  chemically synthesized
actcccaccccagccctaggca

SEQ ID NO: 1227010 - DNA, 22 bp, Artificial Sequence
  chemically synthesized
cactcccaccccagccctaggc

SEQ ID NO: 1227011 - DNA, 22 bp, Artificial Sequence
  chemically synthesized
tcactcccaccccagccctagg

SEQ ID NO: 1227012 - DNA, 22 bp, Artificial Sequence
  chemically synthesized
ttcactcccaccccagccctag

SEQ ID NO: 1227013 - DNA, 22 bp, Artificial Sequence
  chemically synthesized
acaattgcctagggctggggtg

SEQ ID NO: 1227014 - DNA, 22 bp, Artificial Sequence
  chemically synthesized
cagtcatttttcactcccaccc

SEQ ID NO: 1227015 - DNA, 22 bp, Artificial Sequence
  chemically synthesized
acagtcatttttcactcccacc

SEQ ID NO: 1227016 - DNA, 22 bp, Artificial Sequence
  chemically synthesized
cctagggctggggtgggagtga

SEQ ID NO: 1227017 - DNA, 22 bp, Artificial Sequence
  chemically synthesized
gggctggggtgggagtgaaaaa

SEQ ID NO: 1227018 - DNA, 22 bp, Artificial Sequence
  chemically synthesized
catttacagtcatttttcactc

SEQ ID NO: 1227019 - DNA, 22 bp, Artificial Sequence
  chemically synthesized
tccatttacagtcatttttcac

SEQ ID NO: 1227020 - DNA, 22 bp, Artificial Sequence
  chemically synthesized
ctccatttacagtcatttttca

SEQ ID NO: 1227021 - DNA, 22 bp, Artificial Sequence
  chemically synthesized
ttctccatttacagtcattttt

SEQ ID NO: 1227022 - DNA, 22 bp, Artificial Sequence
  chemically synthesized
gggtgggagtgaaaaatgactg

SEQ ID NO: 1227023 - DNA, 22 bp, Artificial Sequence
  chemically synthesized
cttctccatttacagtcatttt

SEQ ID NO: 1227024 - DNA, 22 bp, Artificial Sequence
  chemically synthesized
aaaagaagtttcttctccattt

SEQ ID NO: 1227025 - DNA, 22 bp, Artificial Sequence
  chemically synthesized
aaaaagaagtttcttctccatt

SEQ ID NO: 1227026 - DNA, 22 bp, Artificial Sequence
  chemically synthesized
caccaccttaaaaagaagtttc

SEQ ID NO: 1227027 - DNA, 22 bp, Artificial Sequence
  chemically synthesized
taaatggagaagaaacttcttt

SEQ ID NO: 1227028 - DNA, 22 bp, Artificial Sequence
  chemically synthesized
ccaccaccttaaaaagaagttt

SEQ ID NO: 1227029 - DNA, 22 bp, Artificial Sequence
  chemically synthesized
tccaccaccttaaaaagaagtt

SEQ ID NO: 1227030 - DNA, 22 bp, Artificial Sequence
  chemically synthesized
ttccaccaccttaaaaagaagt

SEQ ID NO: 1227031 - DNA, 22 bp, Artificial Sequence
  chemically synthesized
gcacttttccaccaccttaaaa

SEQ ID NO: 1227032 - DNA, 22 bp, Artificial Sequence
  chemically synthesized
ggcacttttccaccaccttaaa

SEQ ID NO: 1227033 - DNA, 22 bp, Artificial Sequence
  chemically synthesized
tggcacttttccaccaccttaa

SEQ ID NO: 1227034 - DNA, 22 bp, Artificial Sequence
  chemically synthesized
attttggcacttttccaccacc

SEQ ID NO: 1227035 - DNA, 22 bp, Artificial Sequence
  chemically synthesized
ctttttaaggtggtggaaaagt

SEQ ID NO: 1227036 - DNA, 22 bp, Artificial Sequence
  chemically synthesized
tttttaaggtggtggaaaagtg

SEQ ID NO: 1227037 - DNA, 22 bp, Artificial Sequence
  chemically synthesized
tttaaggtggtggaaaagtgcc

SEQ ID NO: 1227038 - DNA, 22 bp, Artificial Sequence
  chemically synthesized
ttaaggtggtggaaaagtgcca

SEQ ID NO: 1227039 - DNA, 22 bp, Artificial Sequence
  chemically synthesized
taaggtggtggaaaagtgccaa

SEQ ID NO: 1227040 - DNA, 22 bp, Artificial Sequence
  chemically synthesized
aaggtggtggaaaagtgccaaa

SEQ ID NO: 1227041 - DNA, 22 bp, Artificial Sequence
  chemically synthesized
aggtggtggaaaagtgccaaaa

SEQ ID NO: 1227042 - DNA, 22 bp, Artificial Sequence
  chemically synthesized
tatagccatcatagcgatctaa

SEQ ID NO: 1227043 - DNA, 22 bp, Artificial Sequence
  chemically synthesized
cagagttatatagccatcatag

SEQ ID NO: 1227044 - DNA, 22 bp, Artificial Sequence
  chemically synthesized
acagagttatatagccatcata

SEQ ID NO: 1227045 - DNA, 22 bp, Artificial Sequence
  chemically synthesized
gatcgctatgatggctatataa

SEQ ID NO: 1227046 - DNA, 22 bp, Artificial Sequence
  chemically synthesized
caggatatttacagagttatat

SEQ ID NO: 1227047 - DNA, 22 bp, Artificial Sequence
  chemically synthesized
gcaggatatttacagagttata

SEQ ID NO: 1227048 - DNA, 22 bp, Artificial Sequence
  chemically synthesized
tgatggctatataactctgtaa

SEQ ID NO: 1227049 - DNA, 22 bp, Artificial Sequence
  chemically synthesized
aaatttgcaggatatttacaga

SEQ ID NO: 1227050 - DNA, 22 bp, Artificial Sequence
  chemically synthesized
attaaaatttgcaggatattta

SEQ ID NO: 1227051 - DNA, 22 bp, Artificial Sequence
  chemically synthesized
tataactctgtaaatatcctgc

SEQ ID NO: 1227052 - DNA, 22 bp, Artificial Sequence
  chemically synthesized
tgtaaatatcctgcaaatttta

SEQ ID NO: 1227053 - DNA, 22 bp, Artificial Sequence
  chemically synthesized
taaatatcctgcaaattttaat

SEQ ID NO: 1227054 - DNA, 22 bp, Artificial Sequence
  chemically synthesized
ccccccaccacgttcattaaaa

SEQ ID NO: 1227055 - DNA, 22 bp, Artificial Sequence
  chemically synthesized
caaattttaatgaacgtggtgg

SEQ ID NO: 1227056 - DNA, 22 bp, Artificial Sequence
  chemically synthesized
taatgaacgtggtgggggggag

SEQ ID NO: 1227057 - DNA, 22 bp, Artificial Sequence
  chemically synthesized
agggatgaataactccccccca

SEQ ID NO: 1227058 - DNA, 22 bp, Artificial Sequence
  chemically synthesized
aatgaacgtggtgggggggagt

SEQ ID NO: 1227059 - DNA, 22 bp, Artificial Sequence
  chemically synthesized
gagggatgaataactccccccc

SEQ ID NO: 1227060 - DNA, 22 bp, Artificial Sequence
  chemically synthesized
atgaacgtggtgggggggagtt

SEQ ID NO: 1227061 - DNA, 22 bp, Artificial Sequence
  chemically synthesized
tgagggatgaataactcccccc

SEQ ID NO: 1227062 - DNA, 22 bp, Artificial Sequence
  chemically synthesized
ttttgagggatgaataactccc

SEQ ID NO: 1227063 - DNA, 22 bp, Artificial Sequence
  chemically synthesized
aaactattttgagggatgaata

SEQ ID NO: 1227064 - DNA, 22 bp, Artificial Sequence
  chemically synthesized
tcaaactattttgagggatgaa

SEQ ID NO: 1227065 - DNA, 22 bp, Artificial Sequence
  chemically synthesized
gtagcctctcaaactattttga

SEQ ID NO: 1227066 - DNA, 22 bp, Artificial Sequence
  chemically synthesized
ggtagcctctcaaactattttg

SEQ ID NO: 1227067 - DNA, 22 bp, Artificial Sequence
  chemically synthesized
ttggtagcctctcaaactattt

SEQ ID NO: 1227068 - DNA, 22 bp, Artificial Sequence
  chemically synthesized
ttcatccctcaaaatagtttga

SEQ ID NO: 1227069 - DNA, 22 bp, Artificial Sequence
  chemically synthesized
atccctcaaaatagtttgagag

SEQ ID NO: 1227070 - DNA, 22 bp, Artificial Sequence
  chemically synthesized
gttcttggtagcctctcaaact

SEQ ID NO: 1227071 - DNA, 22 bp, Artificial Sequence
  chemically synthesized
tggttcttggtagcctctcaaa

SEQ ID NO: 1227072 - DNA, 22 bp, Artificial Sequence
  chemically synthesized
gttctggttcttggtagcctct

SEQ ID NO: 1227073 - DNA, 22 bp, Artificial Sequence
  chemically synthesized
aaaatagtttgagaggctacca

SEQ ID NO: 1227074 - DNA, 22 bp, Artificial Sequence
  chemically synthesized
agttctggttcttggtagcctc

SEQ ID NO: 1227075 - DNA, 22 bp, Artificial Sequence
  chemically synthesized
gtttagttctggttcttggtag

SEQ ID NO: 1227076 - DNA, 22 bp, Artificial Sequence
  chemically synthesized
gagaggctaccaagaaccagaa

SEQ ID NO: 1227077 - DNA, 22 bp, Artificial Sequence
  chemically synthesized
agaggctaccaagaaccagaac

SEQ ID NO: 1227078 - DNA, 22 bp, Artificial Sequence
  chemically synthesized
catcaatctggtttagttctgg

SEQ ID NO: 1227079 - DNA, 22 bp, Artificial Sequence
  chemically synthesized
gcatcaatctggtttagttctg

SEQ ID NO: 1227080 - DNA, 22 bp, Artificial Sequence
  chemically synthesized
ccaagaaccagaactaaaccag

SEQ ID NO: 1227081 - DNA, 22 bp, Artificial Sequence
  chemically synthesized
aatttgcatcaatctggtttag

SEQ ID NO: 1227082 - DNA, 22 bp, Artificial Sequence
  chemically synthesized
agtgtaaaattcaatttgcatc

SEQ ID NO: 1227083 - DNA, 22 bp, Artificial Sequence
  chemically synthesized
taagtgtaaaattcaatttgca

SEQ ID NO: 1227084 - DNA, 22 bp, Artificial Sequence
  chemically synthesized
aaccagattgatgcaaattgaa

SEQ ID NO: 1227085 - DNA, 22 bp, Artificial Sequence
  chemically synthesized
attctaagtgtaaaattcaatt

SEQ ID NO: 1227086 - DNA, 22 bp, Artificial Sequence
  chemically synthesized
atgcaaattgaattttacactt

SEQ ID NO: 1227087 - DNA, 22 bp, Artificial Sequence
  chemically synthesized
gaccatcaatgtactcattcta

SEQ ID NO: 1227088 - DNA, 22 bp, Artificial Sequence
  chemically synthesized
aattttacacttagaatgagta

SEQ ID NO: 1227089 - DNA, 22 bp, Artificial Sequence
  chemically synthesized
ttagaccatcaatgtactcatt

SEQ ID NO: 1227090 - DNA, 22 bp, Artificial Sequence
  chemically synthesized
tacacttagaatgagtacattg

SEQ ID NO: 1227091 - DNA, 22 bp, Artificial Sequence
  chemically synthesized
acacttagaatgagtacattga

SEQ ID NO: 1227092 - DNA, 22 bp, Artificial Sequence
  chemically synthesized
cacttagaatgagtacattgat

SEQ ID NO: 1227093 - DNA, 22 bp, Artificial Sequence
  chemically synthesized
agaatgagtacattgatggtct

SEQ ID NO: 1227094 - DNA, 22 bp, Artificial Sequence
  chemically synthesized
gaatgagtacattgatggtcta

SEQ ID NO: 1227095 - DNA, 22 bp, Artificial Sequence
  chemically synthesized
aaatgtaattgttagaccatca

SEQ ID NO: 1227096 - DNA, 22 bp, Artificial Sequence
  chemically synthesized
gaaatgtaattgttagaccatc

SEQ ID NO: 1227097 - DNA, 22 bp, Artificial Sequence
  chemically synthesized
tgaaatgtaattgttagaccat

SEQ ID NO: 1227098 - DNA, 22 bp, Artificial Sequence
  chemically synthesized
ttgaaatgtaattgttagacca

SEQ ID NO: 1227099 - DNA, 22 bp, Artificial Sequence
  chemically synthesized
atggtctaacaattacatttca

SEQ ID NO: 1227100 - DNA, 22 bp, Artificial Sequence
  chemically synthesized
taaatcagcgtttttgaaatgt

SEQ ID NO: 1227101 - DNA, 22 bp, Artificial Sequence
  chemically synthesized
ataaatcagcgtttttgaaatg

SEQ ID NO: 1227102 - DNA, 22 bp, Artificial Sequence
  chemically synthesized
tataaatcagcgtttttgaaat

SEQ ID NO: 1227103 - DNA, 22 bp, Artificial Sequence
  chemically synthesized
ttataaatcagcgtttttgaaa

SEQ ID NO: 1227104 - DNA, 22 bp, Artificial Sequence
  chemically synthesized
tttataaatcagcgtttttgaa

SEQ ID NO: 1227105 - DNA, 22 bp, Artificial Sequence
  chemically synthesized
ttttataaatcagcgtttttga

SEQ ID NO: 1227106 - DNA, 22 bp, Artificial Sequence
  chemically synthesized
acaattacatttcaaaaacgct

SEQ ID NO: 1227107 - DNA, 22 bp, Artificial Sequence
  chemically synthesized
cttttttataaatcagcgtttt

SEQ ID NO: 1227108 - DNA, 22 bp, Artificial Sequence
  chemically synthesized
catttcaaaaacgctgatttat

SEQ ID NO: 1227109 - DNA, 22 bp, Artificial Sequence
  chemically synthesized
caaaaacgctgatttataaaaa

SEQ ID NO: 1227110 - DNA, 22 bp, Artificial Sequence
  chemically synthesized
gtcgggattacttttttataaa

SEQ ID NO: 1227111 - DNA, 22 bp, Artificial Sequence
  chemically synthesized
aaaaacgctgatttataaaaaa

SEQ ID NO: 1227112 - DNA, 22 bp, Artificial Sequence
  chemically synthesized
ctggtcgggattacttttttat

SEQ ID NO: 1227113 - DNA, 22 bp, Artificial Sequence
  chemically synthesized
actggtcgggattactttttta

SEQ ID NO: 1227114 - DNA, 22 bp, Artificial Sequence
  chemically synthesized
tactggtcgggattactttttt

SEQ ID NO: 1227115 - DNA, 22 bp, Artificial Sequence
  chemically synthesized
ttactggtcgggattacttttt

SEQ ID NO: 1227116 - DNA, 22 bp, Artificial Sequence
  chemically synthesized
tttttactggtcgggattactt

SEQ ID NO: 1227117 - DNA, 22 bp, Artificial Sequence
  chemically synthesized
atttataaaaaagtaatcccga

SEQ ID NO: 1227118 - DNA, 22 bp, Artificial Sequence
  chemically synthesized
ctgtttttactggtcgggatta

SEQ ID NO: 1227119 - DNA, 22 bp, Artificial Sequence
  chemically synthesized
ataaaaaagtaatcccgaccag

SEQ ID NO: 1227120 - DNA, 22 bp, Artificial Sequence
  chemically synthesized
taaaaaagtaatcccgaccagt

SEQ ID NO: 1227121 - DNA, 22 bp, Artificial Sequence
  chemically synthesized
agaaatgactgctgtttttact

SEQ ID NO: 1227122 - DNA, 22 bp, Artificial Sequence
  chemically synthesized
gaggctgagaaatgactgctgt

SEQ ID NO: 1227123 - DNA, 22 bp, Artificial Sequence
  chemically synthesized
ggaggctgagaaatgactgctg

SEQ ID NO: 1227124 - DNA, 22 bp, Artificial Sequence
  chemically synthesized
aaaaatttggaggctgagaaat

SEQ ID NO: 1227125 - DNA, 22 bp, Artificial Sequence
  chemically synthesized
aaaaaatttggaggctgagaaa

SEQ ID NO: 1227126 - DNA, 22 bp, Artificial Sequence
  chemically synthesized
atttaaaaaatttggaggctga

SEQ ID NO: 1227127 - DNA, 22 bp, Artificial Sequence
  chemically synthesized
cactcatttaaaaaatttggag

SEQ ID NO: 1227128 - DNA, 22 bp, Artificial Sequence
  chemically synthesized
ccactcatttaaaaaatttgga

SEQ ID NO: 1227129 - DNA, 22 bp, Artificial Sequence
  chemically synthesized
tccactcatttaaaaaatttgg

SEQ ID NO: 1227130 - DNA, 22 bp, Artificial Sequence
  chemically synthesized
ctcagcctccaaattttttaaa

SEQ ID NO: 1227131 - DNA, 22 bp, Artificial Sequence
  chemically synthesized
tcagcctccaaattttttaaat

SEQ ID NO: 1227132 - DNA, 22 bp, Artificial Sequence
  chemically synthesized
aagttttccactcatttaaaaa

SEQ ID NO: 1227133 - DNA, 22 bp, Artificial Sequence
  chemically synthesized
agcctccaaattttttaaatga

SEQ ID NO: 1227134 - DNA, 22 bp, Artificial Sequence
  chemically synthesized
aaagttttccactcatttaaaa

SEQ ID NO: 1227135 - DNA, 22 bp, Artificial Sequence
  chemically synthesized
cttaaagttttccactcattta

SEQ ID NO: 1227136 - DNA, 22 bp, Artificial Sequence
  chemically synthesized
caaattttttaaatgagtggaa

SEQ ID NO: 1227137 - DNA, 22 bp, Artificial Sequence
  chemically synthesized
attgcttaaagttttccactca

SEQ ID NO: 1227138 - DNA, 22 bp, Artificial Sequence
  chemically synthesized
tattgattgcttaaagttttcc

SEQ ID NO: 1227139 - DNA, 22 bp, Artificial Sequence
  chemically synthesized
tttaaatgagtggaaaacttta

SEQ ID NO: 1227140 - DNA, 22 bp, Artificial Sequence
  chemically synthesized
gtattgattgcttaaagttttc

SEQ ID NO: 1227141 - DNA, 22 bp, Artificial Sequence
  chemically synthesized
ttaaatgagtggaaaactttaa

SEQ ID NO: 1227142 - DNA, 22 bp, Artificial Sequence
  chemically synthesized
taaatgagtggaaaactttaag

SEQ ID NO: 1227143 - DNA, 22 bp, Artificial Sequence
  chemically synthesized
aaatgagtggaaaactttaagc

SEQ ID NO: 1227144 - DNA, 22 bp, Artificial Sequence
  chemically synthesized
aatgagtggaaaactttaagca

SEQ ID NO: 1227145 - DNA, 22 bp, Artificial Sequence
  chemically synthesized
aggtgtatcatatgacttgtat

SEQ ID NO: 1227146 - DNA, 22 bp, Artificial Sequence
  chemically synthesized
gaggtgtatcatatgacttgta

SEQ ID NO: 1227147 - DNA, 22 bp, Artificial Sequence
  chemically synthesized
taagcaatcaatacaagtcata

SEQ ID NO: 1227148 - DNA, 22 bp, Artificial Sequence
  chemically synthesized
aagcaatcaatacaagtcatat

SEQ ID NO: 1227149 - DNA, 22 bp, Artificial Sequence
  chemically synthesized
agcaatcaatacaagtcatatg

SEQ ID NO: 1227150 - DNA, 22 bp, Artificial Sequence
  chemically synthesized
tttgaggtgtatcatatgactt

SEQ ID NO: 1227151 - DNA, 22 bp, Artificial Sequence
  chemically synthesized
atttgaggtgtatcatatgact

SEQ ID NO: 1227152 - DNA, 22 bp, Artificial Sequence
  chemically synthesized
tatttgaggtgtatcatatgac

SEQ ID NO: 1227153 - DNA, 22 bp, Artificial Sequence
  chemically synthesized
ttatttgaggtgtatcatatga

SEQ ID NO: 1227154 - DNA, 22 bp, Artificial Sequence
  chemically synthesized
agtgtagtataccacttttatt

SEQ ID NO: 1227155 - DNA, 22 bp, Artificial Sequence
  chemically synthesized
caaggcactcagtgtagtatac

SEQ ID NO: 1227156 - DNA, 22 bp, Artificial Sequence
  chemically synthesized
aaataaaagtggtatactacac

SEQ ID NO: 1227157 - DNA, 22 bp, Artificial Sequence
  chemically synthesized
agtgggagaatatctgcaaggc

SEQ ID NO: 1227158 - DNA, 22 bp, Artificial Sequence
  chemically synthesized
cactgagtgccttgcagatatt

SEQ ID NO: 1227159 - DNA, 22 bp, Artificial Sequence
  chemically synthesized
agtgccttgcagatattctccc

SEQ ID NO: 1227160 - DNA, 22 bp, Artificial Sequence
  chemically synthesized
tcacgattaagtgggagaatat

SEQ ID NO: 1227161 - DNA, 22 bp, Artificial Sequence
  chemically synthesized
atcacgattaagtgggagaata

SEQ ID NO: 1227162 - DNA, 22 bp, Artificial Sequence
  chemically synthesized
ttatcacgattaagtgggagaa

SEQ ID NO: 1227163 - DNA, 22 bp, Artificial Sequence
  chemically synthesized
cttatcacgattaagtgggaga

SEQ ID NO: 1227164 - DNA, 22 bp, Artificial Sequence
  chemically synthesized
gcagatattctcccacttaatc

SEQ ID NO: 1227165 - DNA, 22 bp, Artificial Sequence
  chemically synthesized
cagatattctcccacttaatcg

SEQ ID NO: 1227166 - DNA, 22 bp, Artificial Sequence
  chemically synthesized
tcccacttaatcgtgataagaa

SEQ ID NO: 1227167 - DNA, 22 bp, Artificial Sequence
  chemically synthesized
ccacttaatcgtgataagaaat

SEQ ID NO: 1227168 - DNA, 22 bp, Artificial Sequence
  chemically synthesized
aatcgtgataagaaatacatac

SEQ ID NO: 1227169 - DNA, 22 bp, Artificial Sequence
  chemically synthesized
atcgtgataagaaatacataca

SEQ ID NO: 1227170 - DNA, 22 bp, Artificial Sequence
  chemically synthesized
tcaaaagagtaaaaataaaaat

SEQ ID NO: 1227171 - DNA, 22 bp, Artificial Sequence
  chemically synthesized
actatcaaaagagtaaaaataa

SEQ ID NO: 1227172 - DNA, 22 bp, Artificial Sequence
  chemically synthesized
cactatcaaaagagtaaaaata

SEQ ID NO: 1227173 - DNA, 22 bp, Artificial Sequence
  chemically synthesized
atttttatttttactcttttga

SEQ ID NO: 1227174 - DNA, 22 bp, Artificial Sequence
  chemically synthesized
tttttatttttactcttttgat

SEQ ID NO: 1227175 - DNA, 22 bp, Artificial Sequence
  chemically synthesized
ttatttttactcttttgatagt

SEQ ID NO: 1227176 - DNA, 22 bp, Artificial Sequence
  chemically synthesized
tatttttactcttttgatagtg

SEQ ID NO: 1227177 - DNA, 22 bp, Artificial Sequence
  chemically synthesized
atttttactcttttgatagtga

SEQ ID NO: 1227178 - DNA, 22 bp, Artificial Sequence
  chemically synthesized
tttttactcttttgatagtgaa

SEQ ID NO: 1227179 - DNA, 22 bp, Artificial Sequence
  chemically synthesized
ggccatggtcccttcactatca

SEQ ID NO: 1227180 - DNA, 22 bp, Artificial Sequence
  chemically synthesized
tgggccatggtcccttcactat

SEQ ID NO: 1227181 - DNA, 22 bp, Artificial Sequence
  chemically synthesized
ttactcttttgatagtgaaggg

SEQ ID NO: 1227182 - DNA, 22 bp, Artificial Sequence
  chemically synthesized
tactcttttgatagtgaaggga

SEQ ID NO: 1227183 - DNA, 22 bp, Artificial Sequence
  chemically synthesized
actcttttgatagtgaagggac

SEQ ID NO: 1227184 - DNA, 22 bp, Artificial Sequence
  chemically synthesized
ttctgggccatggtcccttcac

SEQ ID NO: 1227185 - DNA, 22 bp, Artificial Sequence
  chemically synthesized
ctcttttgatagtgaagggacc

SEQ ID NO: 1227186 - DNA, 22 bp, Artificial Sequence
  chemically synthesized
ttttgatagtgaagggaccatg

SEQ ID NO: 1227187 - DNA, 22 bp, Artificial Sequence
  chemically synthesized
ttgatagtgaagggaccatggc

SEQ ID NO: 1227188 - DNA, 22 bp, Artificial Sequence
  chemically synthesized
tgatagtgaagggaccatggcc

SEQ ID NO: 1227189 - DNA, 22 bp, Artificial Sequence
  chemically synthesized
gatagtgaagggaccatggccc

SEQ ID NO: 1227190 - DNA, 22 bp, Artificial Sequence
  chemically synthesized
atagtgaagggaccatggccca

SEQ ID NO: 1227191 - DNA, 22 bp, Artificial Sequence
  chemically synthesized
ccacccctgttctgggccatgg

SEQ ID NO: 1227192 - DNA, 22 bp, Artificial Sequence
  chemically synthesized
gtatattgccacccctgttctg

SEQ ID NO: 1227193 - DNA, 22 bp, Artificial Sequence
  chemically synthesized
ggtatattgccacccctgttct

SEQ ID NO: 1227194 - DNA, 22 bp, Artificial Sequence
  chemically synthesized
gtggcatttggtatattgccac

SEQ ID NO: 1227195 - DNA, 22 bp, Artificial Sequence
  chemically synthesized
agtggcatttggtatattgcca

SEQ ID NO: 1227196 - DNA, 22 bp, Artificial Sequence
  chemically synthesized
ccatcttagtggcatttggtat

SEQ ID NO: 1227197 - DNA, 22 bp, Artificial Sequence
  chemically synthesized
cacggttaccatcttagtggca

SEQ ID NO: 1227198 - DNA, 22 bp, Artificial Sequence
  chemically synthesized
ccacggttaccatcttagtggc

SEQ ID NO: 1227199 - DNA, 22 bp, Artificial Sequence
  chemically synthesized
aacttccacggttaccatctta

SEQ ID NO: 1227200 - DNA, 22 bp, Artificial Sequence
  chemically synthesized
aaacttccacggttaccatctt

SEQ ID NO: 1227201 - DNA, 22 bp, Artificial Sequence
  chemically synthesized
aatttaaacttccacggttacc

SEQ ID NO: 1227202 - DNA, 22 bp, Artificial Sequence
  chemically synthesized
gaatttaaacttccacggttac

SEQ ID NO: 1227203 - DNA, 22 bp, Artificial Sequence
  chemically synthesized
agatggtaaccgtggaagttta

SEQ ID NO: 1227204 - DNA, 22 bp, Artificial Sequence
  chemically synthesized
aaattcaagttcatgttggtat

SEQ ID NO: 1227205 - DNA, 22 bp, Artificial Sequence
  chemically synthesized
aattcaagttcatgttggtata

SEQ ID NO: 1227206 - DNA, 22 bp, Artificial Sequence
  chemically synthesized
aagttcatgttggtatatatat

SEQ ID NO: 1227207 - DNA, 22 bp, Artificial Sequence
  chemically synthesized
atgttggtatatatatatacac

SEQ ID NO: 1227208 - DNA, 22 bp, Artificial Sequence
  chemically synthesized
gtatatatatatacacatacat

SEQ ID NO: 1227209 - DNA, 22 bp, Artificial Sequence
  chemically synthesized
tacacatatgtataaatatgta

SEQ ID NO: 1227210 - DNA, 22 bp, Artificial Sequence
  chemically synthesized
gttatacacatatgtataaata

SEQ ID NO: 1227211 - DNA, 22 bp, Artificial Sequence
  chemically synthesized
atacatatgtgtataacgagtt

SEQ ID NO: 1227212 - DNA, 22 bp, Artificial Sequence
  chemically synthesized
tacatatgtgtataacgagtta

SEQ ID NO: 1227213 - DNA, 22 bp, Artificial Sequence
  chemically synthesized
tatatatatacgtaatagtaac

SEQ ID NO: 1227214 - DNA, 22 bp, Artificial Sequence
  chemically synthesized
attgtatatatatacgtaatag

SEQ ID NO: 1227215 - DNA, 22 bp, Artificial Sequence
  chemically synthesized
cactcattgtatatatatacgt

SEQ ID NO: 1227216 - DNA, 22 bp, Artificial Sequence
  chemically synthesized
ccactcattgtatatatatacg

SEQ ID NO: 1227217 - DNA, 22 bp, Artificial Sequence
  chemically synthesized
tccactcattgtatatatatac

SEQ ID NO: 1227218 - DNA, 22 bp, Artificial Sequence
  chemically synthesized
ctattacgtatatatatacaat

SEQ ID NO: 1227219 - DNA, 22 bp, Artificial Sequence
  chemically synthesized
atattttccactcattgtatat

SEQ ID NO: 1227220 - DNA, 22 bp, Artificial Sequence
  chemically synthesized
ttacgtatatatatacaatgag

SEQ ID NO: 1227221 - DNA, 22 bp, Artificial Sequence
  chemically synthesized
cgtatatatatacaatgagtgg

SEQ ID NO: 1227222 - DNA, 22 bp, Artificial Sequence
  chemically synthesized
tatccactaatattttccactc

SEQ ID NO: 1227223 - DNA, 22 bp, Artificial Sequence
  chemically synthesized
atatccactaatattttccact

SEQ ID NO: 1227224 - DNA, 22 bp, Artificial Sequence
  chemically synthesized
gtggatataagttcatgtatga

SEQ ID NO: 1227225 - DNA, 22 bp, Artificial Sequence
  chemically synthesized
atgtatgattatgtatacatat

SEQ ID NO: 1227226 - DNA, 22 bp, Artificial Sequence
  chemically synthesized
tgtatacatattatgattatac

SEQ ID NO: 1227227 - DNA, 22 bp, Artificial Sequence
  chemically synthesized
tatacatatacataatagtata

SEQ ID NO: 1227228 - DNA, 22 bp, Artificial Sequence
  chemically synthesized
attgtatacatatacataatag

SEQ ID NO: 1227229 - DNA, 22 bp, Artificial Sequence
  chemically synthesized
tgattatactattatgtatatg

SEQ ID NO: 1227230 - DNA, 22 bp, Artificial Sequence
  chemically synthesized
tccactcattgtatacatatac

SEQ ID NO: 1227231 - DNA, 22 bp, Artificial Sequence
  chemically synthesized
tactattatgtatatgtataca

SEQ ID NO: 1227232 - DNA, 22 bp, Artificial Sequence
  chemically synthesized
atattatccactcattgtatac

SEQ ID NO: 1227233 - DNA, 22 bp, Artificial Sequence
  chemically synthesized
ttatgtatatgtatacaatgag

SEQ ID NO: 1227234 - DNA, 22 bp, Artificial Sequence
  chemically synthesized
tgtatatgtatacaatgagtgg

SEQ ID NO: 1227235 - DNA, 22 bp, Artificial Sequence
  chemically synthesized
tatccactaatattatccactc

SEQ ID NO: 1227236 - DNA, 22 bp, Artificial Sequence
  chemically synthesized
atatccactaatattatccact

SEQ ID NO: 1227237 - DNA, 22 bp, Artificial Sequence
  chemically synthesized
gtggatataagttcatgttggt

SEQ ID NO: 1227238 - DNA, 22 bp, Artificial Sequence
  chemically synthesized
tatatgtatatataagaccaac

SEQ ID NO: 1227239 - DNA, 22 bp, Artificial Sequence
  chemically synthesized
atgttggtcttatatatacata

SEQ ID NO: 1227240 - DNA, 22 bp, Artificial Sequence
  chemically synthesized
atatccacacattatatatgta

SEQ ID NO: 1227241 - DNA, 22 bp, Artificial Sequence
  chemically synthesized
gtcttatatatacatatataat

SEQ ID NO: 1227242 - DNA, 22 bp, Artificial Sequence
  chemically synthesized
atatatacatatataatgtgtg

SEQ ID NO: 1227243 - DNA, 22 bp, Artificial Sequence
  chemically synthesized
tatatacatatataatgtgtgg

SEQ ID NO: 1227244 - DNA, 22 bp, Artificial Sequence
  chemically synthesized
tatatgtatatatatacacact

SEQ ID NO: 1227245 - DNA, 22 bp, Artificial Sequence
  chemically synthesized
atatccacacattatatatgta

SEQ ID NO: 1227246 - DNA, 22 bp, Artificial Sequence
  chemically synthesized
tatatacacacatatatacaat

SEQ ID NO: 1227247 - DNA, 22 bp, Artificial Sequence
  chemically synthesized
tatatatgtgtgtatatataga

SEQ ID NO: 1227248 - DNA, 22 bp, Artificial Sequence
  chemically synthesized
tatatatacgcatatatactac

SEQ ID NO: 1227249 - DNA, 22 bp, Artificial Sequence
  chemically synthesized
cacacacacacacacgggtgtg

SEQ ID NO: 1227250 - DNA, 22 bp, Artificial Sequence
  chemically synthesized
tggaaaagatacagacacacac

SEQ ID NO: 1227251 - DNA, 22 bp, Artificial Sequence
  chemically synthesized
gtggaaaagatacagacacaca

SEQ ID NO: 1227252 - DNA, 22 bp, Artificial Sequence
  chemically synthesized
aaggatttgtggaaaagataca

SEQ ID NO: 1227253 - DNA, 22 bp, Artificial Sequence
  chemically synthesized
caaaatgggttgaaggatttgt

SEQ ID NO: 1227254 - DNA, 22 bp, Artificial Sequence
  chemically synthesized
tatcttttccacaaatccttca

SEQ ID NO: 1227255 - DNA, 22 bp, Artificial Sequence
  chemically synthesized
tgcaaaatgggttgaaggattt

SEQ ID NO: 1227256 - DNA, 22 bp, Artificial Sequence
  chemically synthesized
acctctgcaaaatgggttgaag

SEQ ID NO: 1227257 - DNA, 22 bp, Artificial Sequence
  chemically synthesized
ttccacaaatccttcaacccat

SEQ ID NO: 1227258 - DNA, 22 bp, Artificial Sequence
  chemically synthesized
gacctctgcaaaatgggttgaa

SEQ ID NO: 1227259 - DNA, 22 bp, Artificial Sequence
  chemically synthesized
tccacaaatccttcaacccatt

SEQ ID NO: 1227260 - DNA, 22 bp, Artificial Sequence
  chemically synthesized
ccacaaatccttcaacccattt

SEQ ID NO: 1227261 - DNA, 22 bp, Artificial Sequence
  chemically synthesized
cacaaatccttcaacccatttt

SEQ ID NO: 1227262 - DNA, 22 bp, Artificial Sequence
  chemically synthesized
tttgacctctgcaaaatgggtt

SEQ ID NO: 1227263 - DNA, 22 bp, Artificial Sequence
  chemically synthesized
tctatttgacctctgcaaaatg

SEQ ID NO: 1227264 - DNA, 22 bp, Artificial Sequence
  chemically synthesized
cgactgtctatttgacctctgc

SEQ ID NO: 1227265 - DNA, 22 bp, Artificial Sequence
  chemically synthesized
caacccattttgcagaggtcaa

SEQ ID NO: 1227266 - DNA, 22 bp, Artificial Sequence
  chemically synthesized
ccgactgtctatttgacctctg

SEQ ID NO: 1227267 - DNA, 22 bp, Artificial Sequence
  chemically synthesized
aacccattttgcagaggtcaaa

SEQ ID NO: 1227268 - DNA, 22 bp, Artificial Sequence
  chemically synthesized
tgcagaggtcaaatagacagtc

SEQ ID NO: 1227269 - DNA, 22 bp, Artificial Sequence
  chemically synthesized
gcagaggtcaaatagacagtcg

SEQ ID NO: 1227270 - DNA, 22 bp, Artificial Sequence
  chemically synthesized
cagaggtcaaatagacagtcgg

SEQ ID NO: 1227271 - DNA, 22 bp, Artificial Sequence
  chemically synthesized
agcatagggtcttccgactgtc

SEQ ID NO: 1227272 - DNA, 22 bp, Artificial Sequence
  chemically synthesized
agtcacctgagcatagggtctt

SEQ ID NO: 1227273 - DNA, 22 bp, Artificial Sequence
  chemically synthesized
aagtcacctgagcatagggtct

SEQ ID NO: 1227274 - DNA, 22 bp, Artificial Sequence
  chemically synthesized
taagtcacctgagcatagggtc

SEQ ID NO: 1227275 - DNA, 22 bp, Artificial Sequence
  chemically synthesized
ttaagtcacctgagcatagggt

SEQ ID NO: 1227276 - DNA, 22 bp, Artificial Sequence
  chemically synthesized
tttttaagtcacctgagcatag

SEQ ID NO: 1227277 - DNA, 22 bp, Artificial Sequence
  chemically synthesized
gaaattatttttaagtcacctg

SEQ ID NO: 1227278 - DNA, 22 bp, Artificial Sequence
  chemically synthesized
ggaaattatttttaagtcacct

SEQ ID NO: 1227279 - DNA, 22 bp, Artificial Sequence
  chemically synthesized
tgctcaggtgacttaaaaataa

SEQ ID NO: 1227280 - DNA, 22 bp, Artificial Sequence
  chemically synthesized
aggtgacttaaaaataatttcc

SEQ ID NO: 1227281 - DNA, 22 bp, Artificial Sequence
  chemically synthesized
cataatgtgatttggaaattat

SEQ ID NO: 1227282 - DNA, 22 bp, Artificial Sequence
  chemically synthesized
aaaaataatttccaaatcacat

SEQ ID NO: 1227283 - DNA, 22 bp, Artificial Sequence
  chemically synthesized
aaaataatttccaaatcacatt

SEQ ID NO: 1227284 - DNA, 22 bp, Artificial Sequence
  chemically synthesized
ccaaatcacattatggagtttg

SEQ ID NO: 1227285 - DNA, 22 bp, Artificial Sequence
  chemically synthesized
caaatcacattatggagtttgt

SEQ ID NO: 1227286 - DNA, 22 bp, Artificial Sequence
  chemically synthesized
tcaataaatgtgtgtaatacat

SEQ ID NO: 1227287 - DNA, 22 bp, Artificial Sequence
  chemically synthesized
tggagtttgtatgtattacaca

SEQ ID NO: 1227288 - DNA, 22 bp, Artificial Sequence
  chemically synthesized
tatcaataaatgtgtgtaatac

SEQ ID NO: 1227289 - DNA, 22 bp, Artificial Sequence
  chemically synthesized
gtatgtattacacacatttatt

SEQ ID NO: 1227290 - DNA, 22 bp, Artificial Sequence
  chemically synthesized
tatgtattacacacatttattg

SEQ ID NO: 1227291 - DNA, 22 bp, Artificial Sequence
  chemically synthesized
cacacatttattgatagagata

SEQ ID NO: 1227292 - DNA, 22 bp, Artificial Sequence
  chemically synthesized
gtagaatatgggtatctctatc

SEQ ID NO: 1227293 - DNA, 22 bp, Artificial Sequence
  chemically synthesized
attgatagagatacccatattc

SEQ ID NO: 1227294 - DNA, 22 bp, Artificial Sequence
  chemically synthesized
ttgatagagatacccatattct

SEQ ID NO: 1227295 - DNA, 22 bp, Artificial Sequence
  chemically synthesized
atagagatacccatattctact

SEQ ID NO: 1227296 - DNA, 22 bp, Artificial Sequence
  chemically synthesized
ccaataaaagattagtagaata

SEQ ID NO: 1227297 - DNA, 22 bp, Artificial Sequence
  chemically synthesized
ttgccaataaaagattagtaga

SEQ ID NO: 1227298 - DNA, 22 bp, Artificial Sequence
  chemically synthesized
acataaattattgccaataaaa

SEQ ID NO: 1227299 - DNA, 22 bp, Artificial Sequence
  chemically synthesized
aacataaattattgccaataaa

SEQ ID NO: 1227300 - DNA, 22 bp, Artificial Sequence
  chemically synthesized
ttaacataaattattgccaata

SEQ ID NO: 1227301 - DNA, 22 bp, Artificial Sequence
  chemically synthesized
tactaatcttttattggcaata

SEQ ID NO: 1227302 - DNA, 22 bp, Artificial Sequence
  chemically synthesized
ctaatcttttattggcaataat

SEQ ID NO: 1227303 - DNA, 22 bp, Artificial Sequence
  chemically synthesized
atcttttattggcaataattta

SEQ ID NO: 1227304 - DNA, 22 bp, Artificial Sequence
  chemically synthesized
ggtattcttaacataaattatt

SEQ ID NO: 1227305 - DNA, 22 bp, Artificial Sequence
  chemically synthesized
gggtattcttaacataaattat

SEQ ID NO: 1227306 - DNA, 22 bp, Artificial Sequence
  chemically synthesized
ttattggcaataatttatgtta

SEQ ID NO: 1227307 - DNA, 22 bp, Artificial Sequence
  chemically synthesized
tattggcaataatttatgttaa

SEQ ID NO: 1227308 - DNA, 22 bp, Artificial Sequence
  chemically synthesized
attggcaataatttatgttaag

SEQ ID NO: 1227309 - DNA, 22 bp, Artificial Sequence
  chemically synthesized
ttggcaataatttatgttaaga

SEQ ID NO: 1227310 - DNA, 22 bp, Artificial Sequence
  chemically synthesized
agtcttgggtattcttaacata

SEQ ID NO: 1227311 - DNA, 22 bp, Artificial Sequence
  chemically synthesized
tcagtcttgggtattcttaaca

SEQ ID NO: 1227312 - DNA, 22 bp, Artificial Sequence
  chemically synthesized
gcaataatttatgttaagaata

SEQ ID NO: 1227313 - DNA, 22 bp, Artificial Sequence
  chemically synthesized
ctcagtcttgggtattcttaac

SEQ ID NO: 1227314 - DNA, 22 bp, Artificial Sequence
  chemically synthesized
tctcagtcttgggtattcttaa

SEQ ID NO: 1227315 - DNA, 22 bp, Artificial Sequence
  chemically synthesized
atgttaagaatacccaagactg

SEQ ID NO: 1227316 - DNA, 22 bp, Artificial Sequence
  chemically synthesized
tgttaagaatacccaagactga

SEQ ID NO: 1227317 - DNA, 22 bp, Artificial Sequence
  chemically synthesized
agaatacccaagactgagaaag

SEQ ID NO: 1227318 - DNA, 22 bp, Artificial Sequence
  chemically synthesized
ccaaaggaatgaggctttctca

SEQ ID NO: 1227319 - DNA, 22 bp, Artificial Sequence
  chemically synthesized
atcactaccaaaggaatgaggc

SEQ ID NO: 1227320 - DNA, 22 bp, Artificial Sequence
  chemically synthesized
aatcactaccaaaggaatgagg

SEQ ID NO: 1227321 - DNA, 22 bp, Artificial Sequence
  chemically synthesized
taatcactaccaaaggaatgag

SEQ ID NO: 1227322 - DNA, 22 bp, Artificial Sequence
  chemically synthesized
ttttaatcactaccaaaggaat

SEQ ID NO: 1227323 - DNA, 22 bp, Artificial Sequence
  chemically synthesized
attttaatcactaccaaaggaa

SEQ ID NO: 1227324 - DNA, 22 bp, Artificial Sequence
  chemically synthesized
agaaagcctcattcctttggta

SEQ ID NO: 1227325 - DNA, 22 bp, Artificial Sequence
  chemically synthesized
tattttaatcactaccaaagga

SEQ ID NO: 1227326 - DNA, 22 bp, Artificial Sequence
  chemically synthesized
gtatgttttattttaatcacta

SEQ ID NO: 1227327 - DNA, 22 bp, Artificial Sequence
  chemically synthesized
agtatgttttattttaatcact

SEQ ID NO: 1227328 - DNA, 22 bp, Artificial Sequence
  chemically synthesized
attcctttggtagtgattaaaa

SEQ ID NO: 1227329 - DNA, 22 bp, Artificial Sequence
  chemically synthesized
atttagtatgttttattttaat

SEQ ID NO: 1227330 - DNA, 22 bp, Artificial Sequence
  chemically synthesized
ctttggtagtgattaaaataaa

SEQ ID NO: 1227331 - DNA, 22 bp, Artificial Sequence
  chemically synthesized
tggtagtgattaaaataaaaca

SEQ ID NO: 1227332 - DNA, 22 bp, Artificial Sequence
  chemically synthesized
ggtagtgattaaaataaaacat

SEQ ID NO: 1227333 - DNA, 22 bp, Artificial Sequence
  chemically synthesized
gtagtgattaaaataaaacata

SEQ ID NO: 1227334 - DNA, 22 bp, Artificial Sequence
  chemically synthesized
taagttaatttagtatgtttta

SEQ ID NO: 1227335 - DNA, 22 bp, Artificial Sequence
  chemically synthesized
tctataagttaatttagtatgt

SEQ ID NO: 1227336 - DNA, 22 bp, Artificial Sequence
  chemically synthesized
gtctataagttaatttagtatg

SEQ ID NO: 1227337 - DNA, 22 bp, Artificial Sequence
  chemically synthesized
aaataaaacatactaaattaac

SEQ ID NO: 1227338 - DNA, 22 bp, Artificial Sequence
  chemically synthesized
taacttgtctataagttaattt

SEQ ID NO: 1227339 - DNA, 22 bp, Artificial Sequence
  chemically synthesized
tataacttgtctataagttaat

SEQ ID NO: 1227340 - DNA, 22 bp, Artificial Sequence
  chemically synthesized
aattaacttatagacaagttat

SEQ ID NO: 1227341 - DNA, 22 bp, Artificial Sequence
  chemically synthesized
acaaatgtatgttctataactt

SEQ ID NO: 1227342 - DNA, 22 bp, Artificial Sequence
  chemically synthesized
cacaaatgtatgttctataact

SEQ ID NO: 1227343 - DNA, 22 bp, Artificial Sequence
  chemically synthesized
acttatagacaagttatagaac

SEQ ID NO: 1227344 - DNA, 22 bp, Artificial Sequence
  chemically synthesized
tcacaaatgtatgttctataac

SEQ ID NO: 1227345 - DNA, 22 bp, Artificial Sequence
  chemically synthesized
ttcacaaatgtatgttctataa

SEQ ID NO: 1227346 - DNA, 22 bp, Artificial Sequence
  chemically synthesized
tttcacaaatgtatgttctata

SEQ ID NO: 1227347 - DNA, 22 bp, Artificial Sequence
  chemically synthesized
ttttcacaaatgtatgttctat

SEQ ID NO: 1227348 - DNA, 22 bp, Artificial Sequence
  chemically synthesized
atagacaagttatagaacatac

SEQ ID NO: 1227349 - DNA, 22 bp, Artificial Sequence
  chemically synthesized
tagacaagttatagaacataca

SEQ ID NO: 1227350 - DNA, 22 bp, Artificial Sequence
  chemically synthesized
tagaacatacatttgtgaaaaa

SEQ ID NO: 1227351 - DNA, 22 bp, Artificial Sequence
  chemically synthesized
gtgaaaaaaattactcacctat

SEQ ID NO: 1227352 - DNA, 22 bp, Artificial Sequence
  chemically synthesized
tgaaaaaaattactcacctatg

SEQ ID NO: 1227353 - DNA, 22 bp, Artificial Sequence
  chemically synthesized
ctcacctatgattgggactttg

SEQ ID NO: 1227354 - DNA, 22 bp, Artificial Sequence
  chemically synthesized
acctatgattgggactttgtat

SEQ ID NO: 1227355 - DNA, 22 bp, Artificial Sequence
  chemically synthesized
tgattgggactttgtattttta

SEQ ID NO: 1227356 - DNA, 22 bp, Artificial Sequence
  chemically synthesized
agtaagtataaggtaaaaatac

SEQ ID NO: 1227357 - DNA, 22 bp, Artificial Sequence
  chemically synthesized
attgagtaagtataaggtaaaa

SEQ ID NO: 1227358 - DNA, 22 bp, Artificial Sequence
  chemically synthesized
ggactttgtatttttaccttat

SEQ ID NO: 1227359 - DNA, 22 bp, Artificial Sequence
  chemically synthesized
cattgagtaagtataaggtaaa

SEQ ID NO: 1227360 - DNA, 22 bp, Artificial Sequence
  chemically synthesized
tttcattgagtaagtataaggt

SEQ ID NO: 1227361 - DNA, 22 bp, Artificial Sequence
  chemically synthesized
atttcattgagtaagtataagg

SEQ ID NO: 1227362 - DNA, 22 bp, Artificial Sequence
  chemically synthesized
tatttcattgagtaagtataag

SEQ ID NO: 1227363 - DNA, 22 bp, Artificial Sequence
  chemically synthesized
tgtatttttaccttatacttac

SEQ ID NO: 1227364 - DNA, 22 bp, Artificial Sequence
  chemically synthesized
gtatttttaccttatacttact

SEQ ID NO: 1227365 - DNA, 22 bp, Artificial Sequence
  chemically synthesized
tatttttaccttatacttactc

SEQ ID NO: 1227366 - DNA, 22 bp, Artificial Sequence
  chemically synthesized
aaaattttatttcattgagtaa

SEQ ID NO: 1227367 - DNA, 22 bp, Artificial Sequence
  chemically synthesized
ttaccttatacttactcaatga

SEQ ID NO: 1227368 - DNA, 22 bp, Artificial Sequence
  chemically synthesized
caaaattttatttcattgagta

SEQ ID NO: 1227369 - DNA, 22 bp, Artificial Sequence
  chemically synthesized
taccttatacttactcaatgaa

SEQ ID NO: 1227370 - DNA, 22 bp, Artificial Sequence
  chemically synthesized
tcaaaattttatttcattgagt

SEQ ID NO: 1227371 - DNA, 22 bp, Artificial Sequence
  chemically synthesized
accttatacttactcaatgaaa

SEQ ID NO: 1227372 - DNA, 22 bp, Artificial Sequence
  chemically synthesized
ttcaaaattttatttcattgag

SEQ ID NO: 1227373 - DNA, 22 bp, Artificial Sequence
  chemically synthesized
ccttatacttactcaatgaaat

SEQ ID NO: 1227374 - DNA, 22 bp, Artificial Sequence
  chemically synthesized
atacttactcaatgaaataaaa

SEQ ID NO: 1227375 - DNA, 22 bp, Artificial Sequence
  chemically synthesized
tacttactcaatgaaataaaat

SEQ ID NO: 1227376 - DNA, 22 bp, Artificial Sequence
  chemically synthesized
actcaatgaaataaaattttga

SEQ ID NO: 1227377 - DNA, 22 bp, Artificial Sequence
  chemically synthesized
caggaatatttttcaaaatttt

SEQ ID NO: 1227378 - DNA, 22 bp, Artificial Sequence
  chemically synthesized
ctcaatgaaataaaattttgaa

SEQ ID NO: 1227379 - DNA, 22 bp, Artificial Sequence
  chemically synthesized
acaggaatatttttcaaaattt

SEQ ID NO: 1227380 - DNA, 22 bp, Artificial Sequence
  chemically synthesized
aatgaaataaaattttgaaaaa

SEQ ID NO: 1227381 - DNA, 22 bp, Artificial Sequence
  chemically synthesized
gtacatttacaggaatattttt

SEQ ID NO: 1227382 - DNA, 22 bp, Artificial Sequence
  chemically synthesized
tggtacatttacaggaatattt

SEQ ID NO: 1227383 - DNA, 22 bp, Artificial Sequence
  chemically synthesized
tgaaaaatattcctgtaaatgt

SEQ ID NO: 1227384 - DNA, 22 bp, Artificial Sequence
  chemically synthesized
gaaaaatattcctgtaaatgta

SEQ ID NO: 1227385 - DNA, 22 bp, Artificial Sequence
  chemically synthesized
aaaaatattcctgtaaatgtac

SEQ ID NO: 1227386 - DNA, 22 bp, Artificial Sequence
  chemically synthesized
ctgtaaatgtaccagaacctat

SEQ ID NO: 1227387 - DNA, 22 bp, Artificial Sequence
  chemically synthesized
taaatgtaccagaacctatttt

SEQ ID NO: 1227388 - DNA, 22 bp, Artificial Sequence
  chemically synthesized
aggatcatcacggtataaaata

SEQ ID NO: 1227389 - DNA, 22 bp, Artificial Sequence
  chemically synthesized
aaatgttaaggatcatcacggt

SEQ ID NO: 1227390 - DNA, 22 bp, Artificial Sequence
  chemically synthesized
ttttataccgtgatgatcctta

SEQ ID NO: 1227391 - DNA, 22 bp, Artificial Sequence
  chemically synthesized
tataccgtgatgatccttaaca

SEQ ID NO: 1227392 - DNA, 22 bp, Artificial Sequence
  chemically synthesized
ataccgtgatgatccttaacat

SEQ ID NO: 1227393 - DNA, 22 bp, Artificial Sequence
  chemically synthesized
taccgtgatgatccttaacatt

SEQ ID NO: 1227394 - DNA, 22 bp, Artificial Sequence
  chemically synthesized
ccatgtcgtctgaaatgttaag

SEQ ID NO: 1227395 - DNA, 22 bp, Artificial Sequence
  chemically synthesized
acactaccatgtcgtctgaaat

SEQ ID NO: 1227396 - DNA, 22 bp, Artificial Sequence
  chemically synthesized
aattgacactaccatgtcgtct

SEQ ID NO: 1227397 - DNA, 22 bp, Artificial Sequence
  chemically synthesized
aaattgacactaccatgtcgtc

SEQ ID NO: 1227398 - DNA, 22 bp, Artificial Sequence
  chemically synthesized
taaattgacactaccatgtcgt

SEQ ID NO: 1227399 - DNA, 22 bp, Artificial Sequence
  chemically synthesized
ttaaattgacactaccatgtcg

SEQ ID NO: 1227400 - DNA, 22 bp, Artificial Sequence
  chemically synthesized
aacatttcagacgacatggtag

SEQ ID NO: 1227401 - DNA, 22 bp, Artificial Sequence
  chemically synthesized
tttaaattgacactaccatgtc

SEQ ID NO: 1227402 - DNA, 22 bp, Artificial Sequence
  chemically synthesized
acatttcagacgacatggtagt

SEQ ID NO: 1227403 - DNA, 22 bp, Artificial Sequence
  chemically synthesized
ctttttaaattgacactaccat

SEQ ID NO: 1227404 - DNA, 22 bp, Artificial Sequence
  chemically synthesized
cagacgacatggtagtgtcaat

SEQ ID NO: 1227405 - DNA, 22 bp, Artificial Sequence
  chemically synthesized
agacgacatggtagtgtcaatt

SEQ ID NO: 1227406 - DNA, 22 bp, Artificial Sequence
  chemically synthesized
catagtgctgctttttaaattg

SEQ ID NO: 1227407 - DNA, 22 bp, Artificial Sequence
  chemically synthesized
ctccatagtgctgctttttaaa

SEQ ID NO: 1227408 - DNA, 22 bp, Artificial Sequence
  chemically synthesized
aaaaagcagcactatggagcag

SEQ ID NO: 1227409 - DNA, 22 bp, Artificial Sequence
  chemically synthesized
aaaagcagcactatggagcagg

SEQ ID NO: 1227410 - DNA, 22 bp, Artificial Sequence
  chemically synthesized
acaataacaaaccctgctccat

SEQ ID NO: 1227411 - DNA, 22 bp, Artificial Sequence
  chemically synthesized
taacaataacaaaccctgctcc

SEQ ID NO: 1227412 - DNA, 22 bp, Artificial Sequence
  chemically synthesized
ctaacaataacaaaccctgctc

SEQ ID NO: 1227413 - DNA, 22 bp, Artificial Sequence
  chemically synthesized
tggagcagggtttgttattgtt

SEQ ID NO: 1227414 - DNA, 22 bp, Artificial Sequence
  chemically synthesized
gttattgttagaaatacacatt

SEQ ID NO: 1227415 - DNA, 22 bp, Artificial Sequence
  chemically synthesized
acgtgtgaaacaaatgtgtatt

SEQ ID NO: 1227416 - DNA, 22 bp, Artificial Sequence
  chemically synthesized
ttattgttagaaatacacattt

SEQ ID NO: 1227417 - DNA, 22 bp, Artificial Sequence
  chemically synthesized
gacgtgtgaaacaaatgtgtat

SEQ ID NO: 1227418 - DNA, 22 bp, Artificial Sequence
  chemically synthesized
ttgttagaaatacacatttgtt

SEQ ID NO: 1227419 - DNA, 22 bp, Artificial Sequence
  chemically synthesized
cccttgacgtgtgaaacaaatg

SEQ ID NO: 1227420 - DNA, 22 bp, Artificial Sequence
  chemically synthesized
ttagaaatacacatttgtttca

SEQ ID NO: 1227421 - DNA, 22 bp, Artificial Sequence
  chemically synthesized
acccttgacgtgtgaaacaaat

SEQ ID NO: 1227422 - DNA, 22 bp, Artificial Sequence
  chemically synthesized
tacccttgacgtgtgaaacaaa

SEQ ID NO: 1227423 - DNA, 22 bp, Artificial Sequence
  chemically synthesized
ttacccttgacgtgtgaaacaa

SEQ ID NO: 1227424 - DNA, 22 bp, Artificial Sequence
  chemically synthesized
gaaatacacatttgtttcacac

SEQ ID NO: 1227425 - DNA, 22 bp, Artificial Sequence
  chemically synthesized
atttttacccttgacgtgtgaa

SEQ ID NO: 1227426 - DNA, 22 bp, Artificial Sequence
  chemically synthesized
aatttttacccttgacgtgtga

SEQ ID NO: 1227427 - DNA, 22 bp, Artificial Sequence
  chemically synthesized
taatttttacccttgacgtgtg

SEQ ID NO: 1227428 - DNA, 22 bp, Artificial Sequence
  chemically synthesized
ttaatttttacccttgacgtgt

SEQ ID NO: 1227429 - DNA, 22 bp, Artificial Sequence
  chemically synthesized
tttaatttttacccttgacgtg

SEQ ID NO: 1227430 - DNA, 22 bp, Artificial Sequence
  chemically synthesized
ttttttaatttttacccttgac

SEQ ID NO: 1227431 - DNA, 22 bp, Artificial Sequence
  chemically synthesized
gttttttaatttttacccttga

SEQ ID NO: 1227432 - DNA, 22 bp, Artificial Sequence
  chemically synthesized
gtttcacacgtcaagggtaaaa

SEQ ID NO: 1227433 - DNA, 22 bp, Artificial Sequence
  chemically synthesized
tttcacacgtcaagggtaaaaa

SEQ ID NO: 1227434 - DNA, 22 bp, Artificial Sequence
  chemically synthesized
atcttgttttttaatttttacc

SEQ ID NO: 1227435 - DNA, 22 bp, Artificial Sequence
  chemically synthesized
cacacgtcaagggtaaaaatta

SEQ ID NO: 1227436 - DNA, 22 bp, Artificial Sequence
  chemically synthesized
acacgtcaagggtaaaaattaa

SEQ ID NO: 1227437 - DNA, 22 bp, Artificial Sequence
  chemically synthesized
ggtaacattaatcttgtttttt

SEQ ID NO: 1227438 - DNA, 22 bp, Artificial Sequence
  chemically synthesized
gggtaacattaatcttgttttt

SEQ ID NO: 1227439 - DNA, 22 bp, Artificial Sequence
  chemically synthesized
tgggtaacattaatcttgtttt

SEQ ID NO: 1227440 - DNA, 22 bp, Artificial Sequence
  chemically synthesized
ttgggtaacattaatcttgttt

SEQ ID NO: 1227441 - DNA, 22 bp, Artificial Sequence
  chemically synthesized
cttttgggtaacattaatcttg

SEQ ID NO: 1227442 - DNA, 22 bp, Artificial Sequence
  chemically synthesized
ccttttgggtaacattaatctt

SEQ ID NO: 1227443 - DNA, 22 bp, Artificial Sequence
  chemically synthesized
aaaaacaagattaatgttaccc

SEQ ID NO: 1227444 - DNA, 22 bp, Artificial Sequence
  chemically synthesized
atgaatggtttccttttgggta

SEQ ID NO: 1227445 - DNA, 22 bp, Artificial Sequence
  chemically synthesized
atgttacccaaaaggaaaccat

SEQ ID NO: 1227446 - DNA, 22 bp, Artificial Sequence
  chemically synthesized
cccaaaaggaaaccattcatca

SEQ ID NO: 1227447 - DNA, 22 bp, Artificial Sequence
  chemically synthesized
gcaggtaagaatcctgatgaat

SEQ ID NO: 1227448 - DNA, 22 bp, Artificial Sequence
  chemically synthesized
cactggcaggtaagaatcctga

SEQ ID NO: 1227449 - DNA, 22 bp, Artificial Sequence
  chemically synthesized
atcaggattcttacctgccagt

SEQ ID NO: 1227450 - DNA, 22 bp, Artificial Sequence
  chemically synthesized
gaatataatcctccactggcag

SEQ ID NO: 1227451 - DNA, 22 bp, Artificial Sequence
  chemically synthesized
ggaatataatcctccactggca

SEQ ID NO: 1227452 - DNA, 22 bp, Artificial Sequence
  chemically synthesized
atttggaatataatcctccact

SEQ ID NO: 1227453 - DNA, 22 bp, Artificial Sequence
  chemically synthesized
gatttggaatataatcctccac

SEQ ID NO: 1227454 - DNA, 22 bp, Artificial Sequence
  chemically synthesized
ttacctgccagtggaggattat

SEQ ID NO: 1227455 - DNA, 22 bp, Artificial Sequence
  chemically synthesized
acctgccagtggaggattatat

SEQ ID NO: 1227456 - DNA, 22 bp, Artificial Sequence
  chemically synthesized
gtttgatttggaatataatcct

SEQ ID NO: 1227457 - DNA, 22 bp, Artificial Sequence
  chemically synthesized
cctgccagtggaggattatatt

SEQ ID NO: 1227458 - DNA, 22 bp, Artificial Sequence
  chemically synthesized
ggtttgatttggaatataatcc

SEQ ID NO: 1227459 - DNA, 22 bp, Artificial Sequence
  chemically synthesized
ttggtttgatttggaatataat

SEQ ID NO: 1227460 - DNA, 22 bp, Artificial Sequence
  chemically synthesized
ccagtggaggattatattccaa

SEQ ID NO: 1227461 - DNA, 22 bp, Artificial Sequence
  chemically synthesized
actcttggtttgatttggaata

SEQ ID NO: 1227462 - DNA, 22 bp, Artificial Sequence
  chemically synthesized
tattccaaatcaaaccaagagt

SEQ ID NO: 1227463 - DNA, 22 bp, Artificial Sequence
  chemically synthesized
caaatcaaaccaagagtcagtt

SEQ ID NO: 1227464 - DNA, 22 bp, Artificial Sequence
  chemically synthesized
acatcgtagatggaaatcataa

SEQ ID NO: 1227465 - DNA, 22 bp, Artificial Sequence
  chemically synthesized
gaagtactgacatcgtagatgg

SEQ ID NO: 1227466 - DNA, 22 bp, Artificial Sequence
  chemically synthesized
atgatttccatctacgatgtca

SEQ ID NO: 1227467 - DNA, 22 bp, Artificial Sequence
  chemically synthesized
tgatttccatctacgatgtcag

SEQ ID NO: 1227468 - DNA, 22 bp, Artificial Sequence
  chemically synthesized
gtgaatattggaagtactgaca

SEQ ID NO: 1227469 - DNA, 22 bp, Artificial Sequence
  chemically synthesized
agtgaatattggaagtactgac

SEQ ID NO: 1227470 - DNA, 22 bp, Artificial Sequence
  chemically synthesized
ccatctacgatgtcagtacttc

SEQ ID NO: 1227471 - DNA, 22 bp, Artificial Sequence
  chemically synthesized
catctacgatgtcagtacttcc

SEQ ID NO: 1227472 - DNA, 22 bp, Artificial Sequence
  chemically synthesized
atttagtgaatattggaagtac

SEQ ID NO: 1227473 - DNA, 22 bp, Artificial Sequence
  chemically synthesized
cgatgtcagtacttccaatatt

SEQ ID NO: 1227474 - DNA, 22 bp, Artificial Sequence
  chemically synthesized
acaggttgatttagtgaatatt

SEQ ID NO: 1227475 - DNA, 22 bp, Artificial Sequence
  chemically synthesized
aacaggttgatttagtgaatat

SEQ ID NO: 1227476 - DNA, 22 bp, Artificial Sequence
  chemically synthesized
taacaggttgatttagtgaata

SEQ ID NO: 1227477 - DNA, 22 bp, Artificial Sequence
  chemically synthesized
tttaacaggttgatttagtgaa

SEQ ID NO: 1227478 - DNA, 22 bp, Artificial Sequence
  chemically synthesized
ctttaacaggttgatttagtga

SEQ ID NO: 1227479 - DNA, 22 bp, Artificial Sequence
  chemically synthesized
tctttaacaggttgatttagtg

SEQ ID NO: 1227480 - DNA, 22 bp, Artificial Sequence
  chemically synthesized
ccaatattcactaaatcaacct

SEQ ID NO: 1227481 - DNA, 22 bp, Artificial Sequence
  chemically synthesized
caatattcactaaatcaacctg

SEQ ID NO: 1227482 - DNA, 22 bp, Artificial Sequence
  chemically synthesized
cccctttctttaacaggttgat

SEQ ID NO: 1227483 - DNA, 22 bp, Artificial Sequence
  chemically synthesized
acccctttctttaacaggttga

SEQ ID NO: 1227484 - DNA, 22 bp, Artificial Sequence
  chemically synthesized
tacccctttctttaacaggttg

SEQ ID NO: 1227485 - DNA, 22 bp, Artificial Sequence
  chemically synthesized
actaaatcaacctgttaaagaa

SEQ ID NO: 1227486 - DNA, 22 bp, Artificial Sequence
  chemically synthesized
aaatgttttacccctttcttta

SEQ ID NO: 1227487 - DNA, 22 bp, Artificial Sequence
  chemically synthesized
aatcaacctgttaaagaaaggg

SEQ ID NO: 1227488 - DNA, 22 bp, Artificial Sequence
  chemically synthesized
caaatgttttacccctttcttt

SEQ ID NO: 1227489 - DNA, 22 bp, Artificial Sequence
  chemically synthesized
ccttcaaatgttttaccccttt

SEQ ID NO: 1227490 - DNA, 22 bp, Artificial Sequence
  chemically synthesized
accttcaaatgttttacccctt

SEQ ID NO: 1227491 - DNA, 22 bp, Artificial Sequence
  chemically synthesized
ttaccttcaaatgttttacccc

SEQ ID NO: 1227492 - DNA, 22 bp, Artificial Sequence
  chemically synthesized
ttaaagaaaggggtaaaacatt

SEQ ID NO: 1227493 - DNA, 22 bp, Artificial Sequence
  chemically synthesized
gtctcttaccttcaaatgtttt

SEQ ID NO: 1227494 - DNA, 22 bp, Artificial Sequence
  chemically synthesized
aagaaaggggtaaaacatttga

SEQ ID NO: 1227495 - DNA, 22 bp, Artificial Sequence
  chemically synthesized
ggtctcttaccttcaaatgttt

SEQ ID NO: 1227496 - DNA, 22 bp, Artificial Sequence
  chemically synthesized
ggcatttggtctcttaccttca

SEQ ID NO: 1227497 - DNA, 22 bp, Artificial Sequence
  chemically synthesized
caactaggcatttggtctctta

SEQ ID NO: 1227498 - DNA, 22 bp, Artificial Sequence
  chemically synthesized
ttgcaactaggcatttggtctc

SEQ ID NO: 1227499 - DNA, 22 bp, Artificial Sequence
  chemically synthesized
ttattgcaactaggcatttggt

SEQ ID NO: 1227500 - DNA, 22 bp, Artificial Sequence
  chemically synthesized
gaaggtaagagaccaaatgcct

SEQ ID NO: 1227501 - DNA, 22 bp, Artificial Sequence
  chemically synthesized
aaggtaagagaccaaatgccta

SEQ ID NO: 1227502 - DNA, 22 bp, Artificial Sequence
  chemically synthesized
ttattattgcaactaggcattt

SEQ ID NO: 1227503 - DNA, 22 bp, Artificial Sequence
  chemically synthesized
ttattattattgcaactaggca

SEQ ID NO: 1227504 - DNA, 22 bp, Artificial Sequence
  chemically synthesized
ttattattattattgcaactag

SEQ ID NO: 1227505 - DNA, 22 bp, Artificial Sequence
  chemically synthesized
attattattattattgcaacta

SEQ ID NO: 1227506 - DNA, 22 bp, Artificial Sequence
  chemically synthesized
tattattattattattgcaact

SEQ ID NO: 1227507 - DNA, 22 bp, Artificial Sequence
  chemically synthesized
ttattattattattattgcaac

SEQ ID NO: 1227508 - DNA, 22 bp, Artificial Sequence
  chemically synthesized
acgtttttattattattattat

SEQ ID NO: 1227509 - DNA, 22 bp, Artificial Sequence
  chemically synthesized
cacgtttttattattattatta

SEQ ID NO: 1227510 - DNA, 22 bp, Artificial Sequence
  chemically synthesized
ccttcacgtttttattattatt

SEQ ID NO: 1227511 - DNA, 22 bp, Artificial Sequence
  chemically synthesized
gttgcaataataataataataa

SEQ ID NO: 1227512 - DNA, 22 bp, Artificial Sequence
  chemically synthesized
caataataataataataaaaac

SEQ ID NO: 1227513 - DNA, 22 bp, Artificial Sequence
  chemically synthesized
aatgcaattaccttcacgtttt

SEQ ID NO: 1227514 - DNA, 22 bp, Artificial Sequence
  chemically synthesized
aaaatagctaaatgcaattacc

SEQ ID NO: 1227515 - DNA, 22 bp, Artificial Sequence
  chemically synthesized
tgaaaatagctaaatgcaatta

SEQ ID NO: 1227516 - DNA, 22 bp, Artificial Sequence
  chemically synthesized
agtctctgaaaatagctaaatg

SEQ ID NO: 1227517 - DNA, 22 bp, Artificial Sequence
  chemically synthesized
aatgctaagtctctgaaaatag

SEQ ID NO: 1227518 - DNA, 22 bp, Artificial Sequence
  chemically synthesized
caatgctaagtctctgaaaata

SEQ ID NO: 1227519 - DNA, 22 bp, Artificial Sequence
  chemically synthesized
catttagctattttcagagact

SEQ ID NO: 1227520 - DNA, 22 bp, Artificial Sequence
  chemically synthesized
agctattttcagagacttagca

SEQ ID NO: 1227521 - DNA, 22 bp, Artificial Sequence
  chemically synthesized
aaaaagcttcaatgctaagtct

SEQ ID NO: 1227522 - DNA, 22 bp, Artificial Sequence
  chemically synthesized
gctattttcagagacttagcat

SEQ ID NO: 1227523 - DNA, 22 bp, Artificial Sequence
  chemically synthesized
caaaaagcttcaatgctaagtc

SEQ ID NO: 1227524 - DNA, 22 bp, Artificial Sequence
  chemically synthesized
tcaaaaagcttcaatgctaagt

SEQ ID NO: 1227525 - DNA, 22 bp, Artificial Sequence
  chemically synthesized
ttttcagagacttagcattgaa

SEQ ID NO: 1227526 - DNA, 22 bp, Artificial Sequence
  chemically synthesized
ttttcaaaaagcttcaatgcta

SEQ ID NO: 1227527 - DNA, 22 bp, Artificial Sequence
  chemically synthesized
tcagagacttagcattgaagct

SEQ ID NO: 1227528 - DNA, 22 bp, Artificial Sequence
  chemically synthesized
cagagacttagcattgaagctt

SEQ ID NO: 1227529 - DNA, 22 bp, Artificial Sequence
  chemically synthesized
agagacttagcattgaagcttt

SEQ ID NO: 1227530 - DNA, 22 bp, Artificial Sequence
  chemically synthesized
gattattttcaaaaagcttcaa

SEQ ID NO: 1227531 - DNA, 22 bp, Artificial Sequence
  chemically synthesized
agattattttcaaaaagcttca

SEQ ID NO: 1227532 - DNA, 22 bp, Artificial Sequence
  chemically synthesized
tagattattttcaaaaagcttc

SEQ ID NO: 1227533 - DNA, 22 bp, Artificial Sequence
  chemically synthesized
ttagattattttcaaaaagctt

SEQ ID NO: 1227534 - DNA, 22 bp, Artificial Sequence
  chemically synthesized
atttttagattattttcaaaaa

SEQ ID NO: 1227535 - DNA, 22 bp, Artificial Sequence
  chemically synthesized
agcattgaagctttttgaaaat

SEQ ID NO: 1227536 - DNA, 22 bp, Artificial Sequence
  chemically synthesized
aatttttagattattttcaaaa

SEQ ID NO: 1227537 - DNA, 22 bp, Artificial Sequence
  chemically synthesized
gcattgaagctttttgaaaata

SEQ ID NO: 1227538 - DNA, 22 bp, Artificial Sequence
  chemically synthesized
tttaatttttagattattttca

SEQ ID NO: 1227539 - DNA, 22 bp, Artificial Sequence
  chemically synthesized
gtttaatttttagattattttc

SEQ ID NO: 1227540 - DNA, 22 bp, Artificial Sequence
  chemically synthesized
tgtttaatttttagattatttt

SEQ ID NO: 1227541 - DNA, 22 bp, Artificial Sequence
  chemically synthesized
aagctttttgaaaataatctaa

SEQ ID NO: 1227542 - DNA, 22 bp, Artificial Sequence
  chemically synthesized
tttgaaaataatctaaaaatta

SEQ ID NO: 1227543 - DNA, 22 bp, Artificial Sequence
  chemically synthesized
ttgaaaataatctaaaaattaa

SEQ ID NO: 1227544 - DNA, 22 bp, Artificial Sequence
  chemically synthesized
tgaaaataatctaaaaattaaa

SEQ ID NO: 1227545 - DNA, 22 bp, Artificial Sequence
  chemically synthesized
gaaaataatctaaaaattaaac

SEQ ID NO: 1227546 - DNA, 22 bp, Artificial Sequence
  chemically synthesized
cacatgcattttgtttaatttt

SEQ ID NO: 1227547 - DNA, 22 bp, Artificial Sequence
  chemically synthesized
aaaataatctaaaaattaaaca

SEQ ID NO: 1227548 - DNA, 22 bp, Artificial Sequence
  chemically synthesized
acacatgcattttgtttaattt

SEQ ID NO: 1227549 - DNA, 22 bp, Artificial Sequence
  chemically synthesized
tacacatgcattttgtttaatt

SEQ ID NO: 1227550 - DNA, 22 bp, Artificial Sequence
  chemically synthesized
aaaattaaacaaaatgcatgtg

SEQ ID NO: 1227551 - DNA, 22 bp, Artificial Sequence
  chemically synthesized
tggaaagtgattttacacatgc

SEQ ID NO: 1227552 - DNA, 22 bp, Artificial Sequence
  chemically synthesized
ttatggaaagtgattttacaca

SEQ ID NO: 1227553 - DNA, 22 bp, Artificial Sequence
  chemically synthesized
aacaaaatgcatgtgtaaaatc

SEQ ID NO: 1227554 - DNA, 22 bp, Artificial Sequence
  chemically synthesized
gttatggaaagtgattttacac

SEQ ID NO: 1227555 - DNA, 22 bp, Artificial Sequence
  chemically synthesized
tttgttatggaaagtgatttta

SEQ ID NO: 1227556 - DNA, 22 bp, Artificial Sequence
  chemically synthesized
gtttgttatggaaagtgatttt

SEQ ID NO: 1227557 - DNA, 22 bp, Artificial Sequence
  chemically synthesized
gggtgcttgtttgttatggaaa

SEQ ID NO: 1227558 - DNA, 22 bp, Artificial Sequence
  chemically synthesized
ggggtgcttgtttgttatggaa

SEQ ID NO: 1227559 - DNA, 22 bp, Artificial Sequence
  chemically synthesized
tccataacaaacaagcacccca

SEQ ID NO: 1227560 - DNA, 22 bp, Artificial Sequence
  chemically synthesized
ccataacaaacaagcaccccaa

SEQ ID NO: 1227561 - DNA, 22 bp, Artificial Sequence
  chemically synthesized
cataacaaacaagcaccccaaa

SEQ ID NO: 1227562 - DNA, 22 bp, Artificial Sequence
  chemically synthesized
aaagtaaatatatttggggtgc

SEQ ID NO: 1227563 - DNA, 22 bp, Artificial Sequence
  chemically synthesized
atgtgctgaaagtaaatatatt

SEQ ID NO: 1227564 - DNA, 22 bp, Artificial Sequence
  chemically synthesized
ttcatgtgctgaaagtaaatat

SEQ ID NO: 1227565 - DNA, 22 bp, Artificial Sequence
  chemically synthesized
cagtaatctattcatgtgctga

SEQ ID NO: 1227566 - DNA, 22 bp, Artificial Sequence
  chemically synthesized
atctgcagtaatctattcatgt

SEQ ID NO: 1227567 - DNA, 22 bp, Artificial Sequence
  chemically synthesized
aatctgcagtaatctattcatg

SEQ ID NO: 1227568 - DNA, 22 bp, Artificial Sequence
  chemically synthesized
taatctgcagtaatctattcat

SEQ ID NO: 1227569 - DNA, 22 bp, Artificial Sequence
  chemically synthesized
actttcagcacatgaatagatt

SEQ ID NO: 1227570 - DNA, 22 bp, Artificial Sequence
  chemically synthesized
ctttcagcacatgaatagatta

SEQ ID NO: 1227571 - DNA, 22 bp, Artificial Sequence
  chemically synthesized
tttaatctgcagtaatctattc

SEQ ID NO: 1227572 - DNA, 22 bp, Artificial Sequence
  chemically synthesized
tcagcacatgaatagattactg

SEQ ID NO: 1227573 - DNA, 22 bp, Artificial Sequence
  chemically synthesized
cagcacatgaatagattactgc

SEQ ID NO: 1227574 - DNA, 22 bp, Artificial Sequence
  chemically synthesized
agcacatgaatagattactgca

SEQ ID NO: 1227575 - DNA, 22 bp, Artificial Sequence
  chemically synthesized
acctctttaatctgcagtaatc

SEQ ID NO: 1227576 - DNA, 22 bp, Artificial Sequence
  chemically synthesized
cagttgacctctttaatctgca

SEQ ID NO: 1227577 - DNA, 22 bp, Artificial Sequence
  chemically synthesized
gagatactccagttgacctctt

SEQ ID NO: 1227578 - DNA, 22 bp, Artificial Sequence
  chemically synthesized
ggagatactccagttgacctct

SEQ ID NO: 1227579 - DNA, 22 bp, Artificial Sequence
  chemically synthesized
ctgcagattaaagaggtcaact

SEQ ID NO: 1227580 - DNA, 22 bp, Artificial Sequence
  chemically synthesized
tttggagatactccagttgacc

SEQ ID NO: 1227581 - DNA, 22 bp, Artificial Sequence
  chemically synthesized
cagattaaagaggtcaactgga

SEQ ID NO: 1227582 - DNA, 22 bp, Artificial Sequence
  chemically synthesized
atttggagatactccagttgac

SEQ ID NO: 1227583 - DNA, 22 bp, Artificial Sequence
  chemically synthesized
tatttggagatactccagttga

SEQ ID NO: 1227584 - DNA, 22 bp, Artificial Sequence
  chemically synthesized
aagaggtcaactggagtatctc

SEQ ID NO: 1227585 - DNA, 22 bp, Artificial Sequence
  chemically synthesized
tgacattttatttggagatact

SEQ ID NO: 1227586 - DNA, 22 bp, Artificial Sequence
  chemically synthesized
atgacattttatttggagatac

SEQ ID NO: 1227587 - DNA, 22 bp, Artificial Sequence
  chemically synthesized
tatgacattttatttggagata

SEQ ID NO: 1227588 - DNA, 22 bp, Artificial Sequence
  chemically synthesized
gagtatctccaaataaaatgtc

SEQ ID NO: 1227589 - DNA, 22 bp, Artificial Sequence
  chemically synthesized
aacatactttatgacattttat

SEQ ID NO: 1227590 - DNA, 22 bp, Artificial Sequence
  chemically synthesized
aaacatactttatgacatttta

SEQ ID NO: 1227591 - DNA, 22 bp, Artificial Sequence
  chemically synthesized
taaacatactttatgacatttt

SEQ ID NO: 1227592 - DNA, 22 bp, Artificial Sequence
  chemically synthesized
attttaaacatactttatgaca

SEQ ID NO: 1227593 - DNA, 22 bp, Artificial Sequence
  chemically synthesized
aattttaaacatactttatgac

SEQ ID NO: 1227594 - DNA, 22 bp, Artificial Sequence
  chemically synthesized
caaataaaatgtcataaagtat

SEQ ID NO: 1227595 - DNA, 22 bp, Artificial Sequence
  chemically synthesized
gaaagcatatcttaattttaaa

SEQ ID NO: 1227596 - DNA, 22 bp, Artificial Sequence
  chemically synthesized
catactagaaagcatatcttaa

SEQ ID NO: 1227597 - DNA, 22 bp, Artificial Sequence
  chemically synthesized
taattccatactagaaagcata

SEQ ID NO: 1227598 - DNA, 22 bp, Artificial Sequence
  chemically synthesized
aaaattaagatatgctttctag

SEQ ID NO: 1227599 - DNA, 22 bp, Artificial Sequence
  chemically synthesized
aaattaagatatgctttctagt

SEQ ID NO: 1227600 - DNA, 22 bp, Artificial Sequence
  chemically synthesized
agttgtaattccatactagaaa

SEQ ID NO: 1227601 - DNA, 22 bp, Artificial Sequence
  chemically synthesized
tgagttgtaattccatactaga

SEQ ID NO: 1227602 - DNA, 22 bp, Artificial Sequence
  chemically synthesized
ctgagttgtaattccatactag

SEQ ID NO: 1227603 - DNA, 22 bp, Artificial Sequence
  chemically synthesized
agatatgctttctagtatggaa

SEQ ID NO: 1227604 - DNA, 22 bp, Artificial Sequence
  chemically synthesized
tctgagttgtaattccatacta

SEQ ID NO: 1227605 - DNA, 22 bp, Artificial Sequence
  chemically synthesized
ttctgagttgtaattccatact

SEQ ID NO: 1227606 - DNA, 22 bp, Artificial Sequence
  chemically synthesized
gtgaatttttctgagttgtaat

SEQ ID NO: 1227607 - DNA, 22 bp, Artificial Sequence
  chemically synthesized
tctagtatggaattacaactca

SEQ ID NO: 1227608 - DNA, 22 bp, Artificial Sequence
  chemically synthesized
ctagtatggaattacaactcag

SEQ ID NO: 1227609 - DNA, 22 bp, Artificial Sequence
  chemically synthesized
tagtatggaattacaactcaga

SEQ ID NO: 1227610 - DNA, 22 bp, Artificial Sequence
  chemically synthesized
gtatggaattacaactcagaaa

SEQ ID NO: 1227611 - DNA, 22 bp, Artificial Sequence
  chemically synthesized
ggtggaagtactggtgaatttt

SEQ ID NO: 1227612 - DNA, 22 bp, Artificial Sequence
  chemically synthesized
caactcagaaaaattcaccagt

SEQ ID NO: 1227613 - DNA, 22 bp, Artificial Sequence
  chemically synthesized
gagctaggtggaagtactggtg

SEQ ID NO: 1227614 - DNA, 22 bp, Artificial Sequence
  chemically synthesized
ggagctaggtggaagtactggt

SEQ ID NO: 1227615 - DNA, 22 bp, Artificial Sequence
  chemically synthesized
agaaaaattcaccagtacttcc

SEQ ID NO: 1227616 - DNA, 22 bp, Artificial Sequence
  chemically synthesized
cttggagctaggtggaagtact

SEQ ID NO: 1227617 - DNA, 22 bp, Artificial Sequence
  chemically synthesized
accagtacttccacctagctcc

SEQ ID NO: 1227618 - DNA, 22 bp, Artificial Sequence
  chemically synthesized
taatggcactccttggagctag

SEQ ID NO: 1227619 - DNA, 22 bp, Artificial Sequence
  chemically synthesized
attataatggcactccttggag

SEQ ID NO: 1227620 - DNA, 22 bp, Artificial Sequence
  chemically synthesized
aattataatggcactccttgga

SEQ ID NO: 1227621 - DNA, 22 bp, Artificial Sequence
  chemically synthesized
ccacctagctccaaggagtgcc

SEQ ID NO: 1227622 - DNA, 22 bp, Artificial Sequence
  chemically synthesized
cacctagctccaaggagtgcca

SEQ ID NO: 1227623 - DNA, 22 bp, Artificial Sequence
  chemically synthesized
gctccaaggagtgccattataa

SEQ ID NO: 1227624 - DNA, 22 bp, Artificial Sequence
  chemically synthesized
caaggagtgccattataattaa

SEQ ID NO: 1227625 - DNA, 22 bp, Artificial Sequence
  chemically synthesized
aaatgcagtcagccttaattat

SEQ ID NO: 1227626 - DNA, 22 bp, Artificial Sequence
  chemically synthesized
ctaaaatgcagtcagccttaat

SEQ ID NO: 1227627 - DNA, 22 bp, Artificial Sequence
  chemically synthesized
actaaaatgcagtcagccttaa

SEQ ID NO: 1227628 - DNA, 22 bp, Artificial Sequence
  chemically synthesized
tactaaaatgcagtcagcctta

SEQ ID NO: 1227629 - DNA, 22 bp, Artificial Sequence
  chemically synthesized
taattaaggctgactgcatttt

SEQ ID NO: 1227630 - DNA, 22 bp, Artificial Sequence
  chemically synthesized
aggctgactgcattttagtaaa

SEQ ID NO: 1227631 - DNA, 22 bp, Artificial Sequence
  chemically synthesized
aaacagaggcgttttactaaaa

SEQ ID NO: 1227632 - DNA, 22 bp, Artificial Sequence
  chemically synthesized
taaaacagaggcgttttactaa

SEQ ID NO: 1227633 - DNA, 22 bp, Artificial Sequence
  chemically synthesized
actgcattttagtaaaacgcct

SEQ ID NO: 1227634 - DNA, 22 bp, Artificial Sequence
  chemically synthesized
attctaaaacagaggcgtttta

SEQ ID NO: 1227635 - DNA, 22 bp, Artificial Sequence
  chemically synthesized
cattttagtaaaacgcctctgt

SEQ ID NO: 1227636 - DNA, 22 bp, Artificial Sequence
  chemically synthesized
acattcattctaaaacagaggc

SEQ ID NO: 1227637 - DNA, 22 bp, Artificial Sequence
  chemically synthesized
tagtaaaacgcctctgttttag

SEQ ID NO: 1227638 - DNA, 22 bp, Artificial Sequence
  chemically synthesized
agtaaaacgcctctgttttaga

SEQ ID NO: 1227639 - DNA, 22 bp, Artificial Sequence
  chemically synthesized
gtaaaacgcctctgttttagaa

SEQ ID NO: 1227640 - DNA, 22 bp, Artificial Sequence
  chemically synthesized
gagacctaacattcattctaaa

SEQ ID NO: 1227641 - DNA, 22 bp, Artificial Sequence
  chemically synthesized
ttagagacctaacattcattct

SEQ ID NO: 1227642 - DNA, 22 bp, Artificial Sequence
  chemically synthesized
attagagacctaacattcattc

SEQ ID NO: 1227643 - DNA, 22 bp, Artificial Sequence
  chemically synthesized
tttattagagacctaacattca

SEQ ID NO: 1227644 - DNA, 22 bp, Artificial Sequence
  chemically synthesized
tgttttagaatgaatgttaggt

SEQ ID NO: 1227645 - DNA, 22 bp, Artificial Sequence
  chemically synthesized
ttttagaatgaatgttaggtct

SEQ ID NO: 1227646 - DNA, 22 bp, Artificial Sequence
  chemically synthesized
cattgtttattagagacctaac

SEQ ID NO: 1227647 - DNA, 22 bp, Artificial Sequence
  chemically synthesized
tagaatgaatgttaggtctcta

SEQ ID NO: 1227648 - DNA, 22 bp, Artificial Sequence
  chemically synthesized
agaatgaatgttaggtctctaa

SEQ ID NO: 1227649 - DNA, 22 bp, Artificial Sequence
  chemically synthesized
ctccattgtttattagagacct

SEQ ID NO: 1227650 - DNA, 22 bp, Artificial Sequence
  chemically synthesized
gaatgaatgttaggtctctaat

SEQ ID NO: 1227651 - DNA, 22 bp, Artificial Sequence
  chemically synthesized
gctccattgtttattagagacc

SEQ ID NO: 1227652 - DNA, 22 bp, Artificial Sequence
  chemically synthesized
gcagtttgctccattgtttatt

SEQ ID NO: 1227653 - DNA, 22 bp, Artificial Sequence
  chemically synthesized
ggtctctaataaacaatggagc

SEQ ID NO: 1227654 - DNA, 22 bp, Artificial Sequence
  chemically synthesized
taataaacaatggagcaaactg

SEQ ID NO: 1227655 - DNA, 22 bp, Artificial Sequence
  chemically synthesized
ataaacaatggagcaaactgcc

SEQ ID NO: 1227656 - DNA, 22 bp, Artificial Sequence
  chemically synthesized
gacagagataagagagctggca

SEQ ID NO: 1227657 - DNA, 22 bp, Artificial Sequence
  chemically synthesized
ccagctctcttatctctgtcta

SEQ ID NO: 1227658 - DNA, 22 bp, Artificial Sequence
  chemically synthesized
caaacacagtcctagacagaga

SEQ ID NO: 1227659 - DNA, 22 bp, Artificial Sequence
  chemically synthesized
ccaaacacagtcctagacagag

SEQ ID NO: 1227660 - DNA, 22 bp, Artificial Sequence
  chemically synthesized
atttccaaacacagtcctagac

SEQ ID NO: 1227661 - DNA, 22 bp, Artificial Sequence
  chemically synthesized
catttccaaacacagtcctaga

SEQ ID NO: 1227662 - DNA, 22 bp, Artificial Sequence
  chemically synthesized
tcttatctctgtctaggactgt

SEQ ID NO: 1227663 - DNA, 22 bp, Artificial Sequence
  chemically synthesized
tcatttccaaacacagtcctag

SEQ ID NO: 1227664 - DNA, 22 bp, Artificial Sequence
  chemically synthesized
ttatctctgtctaggactgtgt

SEQ ID NO: 1227665 - DNA, 22 bp, Artificial Sequence
  chemically synthesized
atctctgtctaggactgtgttt

SEQ ID NO: 1227666 - DNA, 22 bp, Artificial Sequence
  chemically synthesized
tctctgtctaggactgtgtttg

SEQ ID NO: 1227667 - DNA, 22 bp, Artificial Sequence
  chemically synthesized
ccagattttcatttccaaacac

SEQ ID NO: 1227668 - DNA, 22 bp, Artificial Sequence
  chemically synthesized
tgtctaggactgtgtttggaaa

SEQ ID NO: 1227669 - DNA, 22 bp, Artificial Sequence
  chemically synthesized
tctaggactgtgtttggaaatg

SEQ ID NO: 1227670 - DNA, 22 bp, Artificial Sequence
  chemically synthesized
ggactgtgtttggaaatgaaaa

SEQ ID NO: 1227671 - DNA, 22 bp, Artificial Sequence
  chemically synthesized
tgtttggaaatgaaaatctggc

SEQ ID NO: 1227672 - DNA, 22 bp, Artificial Sequence
  chemically synthesized
aggcaaataaaaccctgccaga

SEQ ID NO: 1227673 - DNA, 22 bp, Artificial Sequence
  chemically synthesized
ggaaatgaaaatctggcagggt

SEQ ID NO: 1227674 - DNA, 22 bp, Artificial Sequence
  chemically synthesized
gaaatgaaaatctggcagggtt

SEQ ID NO: 1227675 - DNA, 22 bp, Artificial Sequence
  chemically synthesized
attaaggcaaataaaaccctgc

SEQ ID NO: 1227676 - DNA, 22 bp, Artificial Sequence
  chemically synthesized
gattaaggcaaataaaaccctg

SEQ ID NO: 1227677 - DNA, 22 bp, Artificial Sequence
  chemically synthesized
ccttgattaaggcaaataaaac

SEQ ID NO: 1227678 - DNA, 22 bp, Artificial Sequence
  chemically synthesized
gccttgattaaggcaaataaaa

SEQ ID NO: 1227679 - DNA, 22 bp, Artificial Sequence
  chemically synthesized
gcagggttttatttgccttaat

SEQ ID NO: 1227680 - DNA, 22 bp, Artificial Sequence
  chemically synthesized
tatttgccttaatcaaggcaaa

SEQ ID NO: 1227681 - DNA, 22 bp, Artificial Sequence
  chemically synthesized
atttgccttaatcaaggcaaat

SEQ ID NO: 1227682 - DNA, 22 bp, Artificial Sequence
  chemically synthesized
tttgccttaatcaaggcaaatc

SEQ ID NO: 1227683 - DNA, 22 bp, Artificial Sequence
  chemically synthesized
gccttaatcaaggcaaatctct

SEQ ID NO: 1227684 - DNA, 22 bp, Artificial Sequence
  chemically synthesized
ccttaatcaaggcaaatctctg

SEQ ID NO: 1227685 - DNA, 22 bp, Artificial Sequence
  chemically synthesized
aatcaaggcaaatctctgtgtc

SEQ ID NO: 1227686 - DNA, 22 bp, Artificial Sequence
  chemically synthesized
atcaaggcaaatctctgtgtct

SEQ ID NO: 1227687 - DNA, 22 bp, Artificial Sequence
  chemically synthesized
aggagtgtgaaggacaggagac

SEQ ID NO: 1227688 - DNA, 22 bp, Artificial Sequence
  chemically synthesized
gaggagtgtgaaggacaggaga

SEQ ID NO: 1227689 - DNA, 22 bp, Artificial Sequence
  chemically synthesized
aacatttgaggagtgtgaagga

SEQ ID NO: 1227690 - DNA, 22 bp, Artificial Sequence
  chemically synthesized
tgtgtctcctgtccttcacact

SEQ ID NO: 1227691 - DNA, 22 bp, Artificial Sequence
  chemically synthesized
aaacatttgaggagtgtgaagg

SEQ ID NO: 1227692 - DNA, 22 bp, Artificial Sequence
  chemically synthesized
tgtctcctgtccttcacactcc

SEQ ID NO: 1227693 - DNA, 22 bp, Artificial Sequence
  chemically synthesized
caccttaaacatttgaggagtg

SEQ ID NO: 1227694 - DNA, 22 bp, Artificial Sequence
  chemically synthesized
ctgtccttcacactcctcaaat

SEQ ID NO: 1227695 - DNA, 22 bp, Artificial Sequence
  chemically synthesized
ctccaccttaaacatttgagga

SEQ ID NO: 1227696 - DNA, 22 bp, Artificial Sequence
  chemically synthesized
actccaccttaaacatttgagg

SEQ ID NO: 1227697 - DNA, 22 bp, Artificial Sequence
  chemically synthesized
tccttcacactcctcaaatgtt

SEQ ID NO: 1227698 - DNA, 22 bp, Artificial Sequence
  chemically synthesized
tactccaccttaaacatttgag

SEQ ID NO: 1227699 - DNA, 22 bp, Artificial Sequence
  chemically synthesized
actttactccaccttaaacatt

SEQ ID NO: 1227700 - DNA, 22 bp, Artificial Sequence
  chemically synthesized
cacactcctcaaatgtttaagg

SEQ ID NO: 1227701 - DNA, 22 bp, Artificial Sequence
  chemically synthesized
aactttactccaccttaaacat

SEQ ID NO: 1227702 - DNA, 22 bp, Artificial Sequence
  chemically synthesized
acactcctcaaatgtttaaggt

SEQ ID NO: 1227703 - DNA, 22 bp, Artificial Sequence
  chemically synthesized
tgtttaactttactccacctta

SEQ ID NO: 1227704 - DNA, 22 bp, Artificial Sequence
  chemically synthesized
gtgtttaactttactccacctt

SEQ ID NO: 1227705 - DNA, 22 bp, Artificial Sequence
  chemically synthesized
ctcaaatgtttaaggtggagta

SEQ ID NO: 1227706 - DNA, 22 bp, Artificial Sequence
  chemically synthesized
aaatgtttaaggtggagtaaag

SEQ ID NO: 1227707 - DNA, 22 bp, Artificial Sequence
  chemically synthesized
agatgcttgtgtttaactttac

SEQ ID NO: 1227708 - DNA, 22 bp, Artificial Sequence
  chemically synthesized
cagatgcttgtgtttaacttta

SEQ ID NO: 1227709 - DNA, 22 bp, Artificial Sequence
  chemically synthesized
tcagatgcttgtgtttaacttt

SEQ ID NO: 1227710 - DNA, 22 bp, Artificial Sequence
  chemically synthesized
ttcagatgcttgtgtttaactt

SEQ ID NO: 1227711 - DNA, 22 bp, Artificial Sequence
  chemically synthesized
aaggtggagtaaagttaaacac

SEQ ID NO: 1227712 - DNA, 22 bp, Artificial Sequence
  chemically synthesized
aggtggagtaaagttaaacaca

SEQ ID NO: 1227713 - DNA, 22 bp, Artificial Sequence
  chemically synthesized
cttttcagatgcttgtgtttaa

SEQ ID NO: 1227714 - DNA, 22 bp, Artificial Sequence
  chemically synthesized
gcttttcagatgcttgtgttta

SEQ ID NO: 1227715 - DNA, 22 bp, Artificial Sequence
  chemically synthesized
atatgcttgcttttcagatgct

SEQ ID NO: 1227716 - DNA, 22 bp, Artificial Sequence
  chemically synthesized
catatgcttgcttttcagatgc

SEQ ID NO: 1227717 - DNA, 22 bp, Artificial Sequence
  chemically synthesized
tcatatgcttgcttttcagatg

SEQ ID NO: 1227718 - DNA, 22 bp, Artificial Sequence
  chemically synthesized
ttcatatgcttgcttttcagat

SEQ ID NO: 1227719 - DNA, 22 bp, Artificial Sequence
  chemically synthesized
aacacaagcatctgaaaagcaa

SEQ ID NO: 1227720 - DNA, 22 bp, Artificial Sequence
  chemically synthesized
aacatcttttcatatgcttgct

SEQ ID NO: 1227721 - DNA, 22 bp, Artificial Sequence
  chemically synthesized
aaaagcaagcatatgaaaagat

SEQ ID NO: 1227722 - DNA, 22 bp, Artificial Sequence
  chemically synthesized
aaaacattgaacatcttttcat

SEQ ID NO: 1227723 - DNA, 22 bp, Artificial Sequence
  chemically synthesized
gctaaaaacattgaacatcttt

SEQ ID NO: 1227724 - DNA, 22 bp, Artificial Sequence
  chemically synthesized
ttggctaaaaacattgaacatc

SEQ ID NO: 1227725 - DNA, 22 bp, Artificial Sequence
  chemically synthesized
tattggctaaaaacattgaaca

SEQ ID NO: 1227726 - DNA, 22 bp, Artificial Sequence
  chemically synthesized
ctctattggctaaaaacattga

SEQ ID NO: 1227727 - DNA, 22 bp, Artificial Sequence
  chemically synthesized
cattcctctattggctaaaaac

SEQ ID NO: 1227728 - DNA, 22 bp, Artificial Sequence
  chemically synthesized
gcattcctctattggctaaaaa

SEQ ID NO: 1227729 - DNA, 22 bp, Artificial Sequence
  chemically synthesized
caatttgcattcctctattggc

SEQ ID NO: 1227730 - DNA, 22 bp, Artificial Sequence
  chemically synthesized
aatgtttttagccaatagagga

SEQ ID NO: 1227731 - DNA, 22 bp, Artificial Sequence
  chemically synthesized
tggttacaatttgcattcctct

SEQ ID NO: 1227732 - DNA, 22 bp, Artificial Sequence
  chemically synthesized
ttagccaatagaggaatgcaaa

SEQ ID NO: 1227733 - DNA, 22 bp, Artificial Sequence
  chemically synthesized
ttgtggttacaatttgcattcc

SEQ ID NO: 1227734 - DNA, 22 bp, Artificial Sequence
  chemically synthesized
tagccaatagaggaatgcaaat

SEQ ID NO: 1227735 - DNA, 22 bp, Artificial Sequence
  chemically synthesized
agccaatagaggaatgcaaatt

SEQ ID NO: 1227736 - DNA, 22 bp, Artificial Sequence
  chemically synthesized
gccaatagaggaatgcaaattg

SEQ ID NO: 1227737 - DNA, 22 bp, Artificial Sequence
  chemically synthesized
tgataaatgtgcagtgatacat

SEQ ID NO: 1227738 - DNA, 22 bp, Artificial Sequence
  chemically synthesized
taaccacaataatgtatcactg

SEQ ID NO: 1227739 - DNA, 22 bp, Artificial Sequence
  chemically synthesized
accattatgataaatgtgcagt

SEQ ID NO: 1227740 - DNA, 22 bp, Artificial Sequence
  chemically synthesized
aaccattatgataaatgtgcag

SEQ ID NO: 1227741 - DNA, 22 bp, Artificial Sequence
  chemically synthesized
taaccattatgataaatgtgca

SEQ ID NO: 1227742 - DNA, 22 bp, Artificial Sequence
  chemically synthesized
attttaaccattatgataaatg

SEQ ID NO: 1227743 - DNA, 22 bp, Artificial Sequence
  chemically synthesized
aattttaaccattatgataaat

SEQ ID NO: 1227744 - DNA, 22 bp, Artificial Sequence
  chemically synthesized
taattttaaccattatgataaa

SEQ ID NO: 1227745 - DNA, 22 bp, Artificial Sequence
  chemically synthesized
ttaattttaaccattatgataa

SEQ ID NO: 1227746 - DNA, 22 bp, Artificial Sequence
  chemically synthesized
tttaattttaaccattatgata

SEQ ID NO: 1227747 - DNA, 22 bp, Artificial Sequence
  chemically synthesized
ttttttaattttaaccattatg

SEQ ID NO: 1227748 - DNA, 22 bp, Artificial Sequence
  chemically synthesized
cacatttatcataatggttaaa

SEQ ID NO: 1227749 - DNA, 22 bp, Artificial Sequence
  chemically synthesized
tggcactattttttaattttaa

SEQ ID NO: 1227750 - DNA, 22 bp, Artificial Sequence
  chemically synthesized
atggcactattttttaatttta

SEQ ID NO: 1227751 - DNA, 22 bp, Artificial Sequence
  chemically synthesized
atcataatggttaaaattaaaa

SEQ ID NO: 1227752 - DNA, 22 bp, Artificial Sequence
  chemically synthesized
tatggcactattttttaatttt

SEQ ID NO: 1227753 - DNA, 22 bp, Artificial Sequence
  chemically synthesized
tcataatggttaaaattaaaaa

SEQ ID NO: 1227754 - DNA, 22 bp, Artificial Sequence
  chemically synthesized
accagcattttatggcactatt

SEQ ID NO: 1227755 - DNA, 22 bp, Artificial Sequence
  chemically synthesized
aaattaaaaaatagtgccataa

SEQ ID NO: 1227756 - DNA, 22 bp, Artificial Sequence
  chemically synthesized
aaaaatagtgccataaaatgct

SEQ ID NO: 1227757 - DNA, 22 bp, Artificial Sequence
  chemically synthesized
cacaccctcaccagcattttat

SEQ ID NO: 1227758 - DNA, 22 bp, Artificial Sequence
  chemically synthesized
tccacaccctcaccagcatttt

SEQ ID NO: 1227759 - DNA, 22 bp, Artificial Sequence
  chemically synthesized
ctccacaccctcaccagcattt

SEQ ID NO: 1227760 - DNA, 22 bp, Artificial Sequence
  chemically synthesized
agtcatccagtttctccacacc

SEQ ID NO: 1227761 - DNA, 22 bp, Artificial Sequence
  chemically synthesized
gtgagggtgtggagaaactgga

SEQ ID NO: 1227762 - DNA, 22 bp, Artificial Sequence
  chemically synthesized
gcaggggttgagtcatccagtt

SEQ ID NO: 1227763 - DNA, 22 bp, Artificial Sequence
  chemically synthesized
cactagcaggggttgagtcatc

SEQ ID NO: 1227764 - DNA, 22 bp, Artificial Sequence
  chemically synthesized
ccactagcaggggttgagtcat

SEQ ID NO: 1227765 - DNA, 22 bp, Artificial Sequence
  chemically synthesized
agtttccactagcaggggttga

SEQ ID NO: 1227766 - DNA, 22 bp, Artificial Sequence
  chemically synthesized
gagtttccactagcaggggttg

SEQ ID NO: 1227767 - DNA, 22 bp, Artificial Sequence
  chemically synthesized
gatgactcaacccctgctagtg

SEQ ID NO: 1227768 - DNA, 22 bp, Artificial Sequence
  chemically synthesized
tatcatttgagtttccactagc

SEQ ID NO: 1227769 - DNA, 22 bp, Artificial Sequence
  chemically synthesized
aacccctgctagtggaaactca

SEQ ID NO: 1227770 - DNA, 22 bp, Artificial Sequence
  chemically synthesized
caaagtggctatatcatttgag

SEQ ID NO: 1227771 - DNA, 22 bp, Artificial Sequence
  chemically synthesized
ccaaagtggctatatcatttga

SEQ ID NO: 1227772 - DNA, 22 bp, Artificial Sequence
  chemically synthesized
ctagtggaaactcaaatgatat

SEQ ID NO: 1227773 - DNA, 22 bp, Artificial Sequence
  chemically synthesized
tccaaagtggctatatcatttg

SEQ ID NO: 1227774 - DNA, 22 bp, Artificial Sequence
  chemically synthesized
gtggaaactcaaatgatatagc

SEQ ID NO: 1227775 - DNA, 22 bp, Artificial Sequence
  chemically synthesized
ttttccaaagtggctatatcat

SEQ ID NO: 1227776 - DNA, 22 bp, Artificial Sequence
  chemically synthesized
ccagactgttttccaaagtggc

SEQ ID NO: 1227777 - DNA, 22 bp, Artificial Sequence
  chemically synthesized
aaatgatatagccactttggaa

SEQ ID NO: 1227778 - DNA, 22 bp, Artificial Sequence
  chemically synthesized
tgagaaactgccagactgtttt

SEQ ID NO: 1227779 - DNA, 22 bp, Artificial Sequence
  chemically synthesized
gtgagaaactgccagactgttt

SEQ ID NO: 1227780 - DNA, 22 bp, Artificial Sequence
  chemically synthesized
tgtgagaaactgccagactgtt

SEQ ID NO: 1227781 - DNA, 22 bp, Artificial Sequence
  chemically synthesized
agttttgtgagaaactgccaga

SEQ ID NO: 1227782 - DNA, 22 bp, Artificial Sequence
  chemically synthesized
tggaaaacagtctggcagtttc

SEQ ID NO: 1227783 - DNA, 22 bp, Artificial Sequence
  chemically synthesized
ggaaaacagtctggcagtttct

SEQ ID NO: 1227784 - DNA, 22 bp, Artificial Sequence
  chemically synthesized
gaaaacagtctggcagtttctc

SEQ ID NO: 1227785 - DNA, 22 bp, Artificial Sequence
  chemically synthesized
gcagtttctcacaaaactgaac

SEQ ID NO: 1227786 - DNA, 22 bp, Artificial Sequence
  chemically synthesized
tataataagtacatgttcagtt

SEQ ID NO: 1227787 - DNA, 22 bp, Artificial Sequence
  chemically synthesized
ctcacaaaactgaacatgtact

SEQ ID NO: 1227788 - DNA, 22 bp, Artificial Sequence
  chemically synthesized
tcacaaaactgaacatgtactt

SEQ ID NO: 1227789 - DNA, 22 bp, Artificial Sequence
  chemically synthesized
acaaaactgaacatgtacttat

SEQ ID NO: 1227790 - DNA, 22 bp, Artificial Sequence
  chemically synthesized
ccagattgtataataagtacat

SEQ ID NO: 1227791 - DNA, 22 bp, Artificial Sequence
  chemically synthesized
aacatgtacttattatacaatc

SEQ ID NO: 1227792 - DNA, 22 bp, Artificial Sequence
  chemically synthesized
aagagcccaattaccagattgt

SEQ ID NO: 1227793 - DNA, 22 bp, Artificial Sequence
  chemically synthesized
attatacaatctggtaattggg

SEQ ID NO: 1227794 - DNA, 22 bp, Artificial Sequence
  chemically synthesized
ttatacaatctggtaattgggc

SEQ ID NO: 1227795 - DNA, 22 bp, Artificial Sequence
  chemically synthesized
tacaatctggtaattgggctct

SEQ ID NO: 1227796 - DNA, 22 bp, Artificial Sequence
  chemically synthesized
agataaatgctcaagagcccaa

SEQ ID NO: 1227797 - DNA, 22 bp, Artificial Sequence
  chemically synthesized
gagataaatgctcaagagccca

SEQ ID NO: 1227798 - DNA, 22 bp, Artificial Sequence
  chemically synthesized
cttgagataaatgctcaagagc

SEQ ID NO: 1227799 - DNA, 22 bp, Artificial Sequence
  chemically synthesized
ccttgagataaatgctcaagag

SEQ ID NO: 1227800 - DNA, 22 bp, Artificial Sequence
  chemically synthesized
gtaattgggctcttgagcattt

SEQ ID NO: 1227801 - DNA, 22 bp, Artificial Sequence
  chemically synthesized
atttccttgagataaatgctca

SEQ ID NO: 1227802 - DNA, 22 bp, Artificial Sequence
  chemically synthesized
catttccttgagataaatgctc

SEQ ID NO: 1227803 - DNA, 22 bp, Artificial Sequence
  chemically synthesized
tcatttccttgagataaatgct

SEQ ID NO: 1227804 - DNA, 22 bp, Artificial Sequence
  chemically synthesized
ggctcttgagcatttatctcaa

SEQ ID NO: 1227805 - DNA, 22 bp, Artificial Sequence
  chemically synthesized
ttgagcatttatctcaaggaaa

SEQ ID NO: 1227806 - DNA, 22 bp, Artificial Sequence
  chemically synthesized
gagcatttatctcaaggaaatg

SEQ ID NO: 1227807 - DNA, 22 bp, Artificial Sequence
  chemically synthesized
agcatttatctcaaggaaatga

SEQ ID NO: 1227808 - DNA, 22 bp, Artificial Sequence
  chemically synthesized
tgtacacatgtgttttcatttc

SEQ ID NO: 1227809 - DNA, 22 bp, Artificial Sequence
  chemically synthesized
gtgtacacatgtgttttcattt

SEQ ID NO: 1227810 - DNA, 22 bp, Artificial Sequence
  chemically synthesized
tgtgtacacatgtgttttcatt

SEQ ID NO: 1227811 - DNA, 22 bp, Artificial Sequence
  chemically synthesized
ttgtgtacacatgtgttttcat

SEQ ID NO: 1227812 - DNA, 22 bp, Artificial Sequence
  chemically synthesized
atctcaaggaaatgaaaacaca

SEQ ID NO: 1227813 - DNA, 22 bp, Artificial Sequence
  chemically synthesized
tctcaaggaaatgaaaacacat

SEQ ID NO: 1227814 - DNA, 22 bp, Artificial Sequence
  chemically synthesized
aaggaaatgaaaacacatgtgt

SEQ ID NO: 1227815 - DNA, 22 bp, Artificial Sequence
  chemically synthesized
ggtgcaggtttttgtgtacaca

SEQ ID NO: 1227816 - DNA, 22 bp, Artificial Sequence
  chemically synthesized
aggtgcaggtttttgtgtacac

SEQ ID NO: 1227817 - DNA, 22 bp, Artificial Sequence
  chemically synthesized
caaataaacgtagtatgaacac

SEQ ID NO: 1227818 - DNA, 22 bp, Artificial Sequence
  chemically synthesized
ttacaaataaacgtagtatgaa

SEQ ID NO: 1227819 - DNA, 22 bp, Artificial Sequence
  chemically synthesized
cacctaagtgttcatactacgt

SEQ ID NO: 1227820 - DNA, 22 bp, Artificial Sequence
  chemically synthesized
gggctattacaaataaacgtag

SEQ ID NO: 1227821 - DNA, 22 bp, Artificial Sequence
  chemically synthesized
ggggctattacaaataaacgta

SEQ ID NO: 1227822 - DNA, 22 bp, Artificial Sequence
  chemically synthesized
agtgttcatactacgtttattt

SEQ ID NO: 1227823 - DNA, 22 bp, Artificial Sequence
  chemically synthesized
ccagtttggggctattacaaat

SEQ ID NO: 1227824 - DNA, 22 bp, Artificial Sequence
  chemically synthesized
atactacgtttatttgtaatag

SEQ ID NO: 1227825 - DNA, 22 bp, Artificial Sequence
  chemically synthesized
ggttcccagtttggggctatta

SEQ ID NO: 1227826 - DNA, 22 bp, Artificial Sequence
  chemically synthesized
cgtttatttgtaatagccccaa

SEQ ID NO: 1227827 - DNA, 22 bp, Artificial Sequence
  chemically synthesized
atttgtaatagccccaaactgg

SEQ ID NO: 1227828 - DNA, 22 bp, Artificial Sequence
  chemically synthesized
tttgtaatagccccaaactggg

SEQ ID NO: 1227829 - DNA, 22 bp, Artificial Sequence
  chemically synthesized
agggcatctgggttcccagttt

SEQ ID NO: 1227830 - DNA, 22 bp, Artificial Sequence
  chemically synthesized
gtaatagccccaaactgggaac

SEQ ID NO: 1227831 - DNA, 22 bp, Artificial Sequence
  chemically synthesized
taatagccccaaactgggaacc

SEQ ID NO: 1227832 - DNA, 22 bp, Artificial Sequence
  chemically synthesized
cccctgagggcatctgggttcc

SEQ ID NO: 1227833 - DNA, 22 bp, Artificial Sequence
  chemically synthesized
tctacccctgagggcatctggg

SEQ ID NO: 1227834 - DNA, 22 bp, Artificial Sequence
  chemically synthesized
atctacccctgagggcatctgg

SEQ ID NO: 1227835 - DNA, 22 bp, Artificial Sequence
  chemically synthesized
tttatctacccctgagggcatc

SEQ ID NO: 1227836 - DNA, 22 bp, Artificial Sequence
  chemically synthesized
gtttatctacccctgagggcat

SEQ ID NO: 1227837 - DNA, 22 bp, Artificial Sequence
  chemically synthesized
ggaacccagatgccctcagggg

SEQ ID NO: 1227838 - DNA, 22 bp, Artificial Sequence
  chemically synthesized
tggtttgtttatctacccctga

SEQ ID NO: 1227839 - DNA, 22 bp, Artificial Sequence
  chemically synthesized
tactatggtttgtttatctacc

SEQ ID NO: 1227840 - DNA, 22 bp, Artificial Sequence
  chemically synthesized
aggggtagataaacaaaccata

SEQ ID NO: 1227841 - DNA, 22 bp, Artificial Sequence
  chemically synthesized
catggtgtggctgtactatggt

SEQ ID NO: 1227842 - DNA, 22 bp, Artificial Sequence
  chemically synthesized
ttccatggtgtggctgtactat

SEQ ID NO: 1227843 - DNA, 22 bp, Artificial Sequence
  chemically synthesized
atgagtgttattccatggtgtg

SEQ ID NO: 1227844 - DNA, 22 bp, Artificial Sequence
  chemically synthesized
attgatgagtgttattccatgg

SEQ ID NO: 1227845 - DNA, 22 bp, Artificial Sequence
  chemically synthesized
cattgatgagtgttattccatg

SEQ ID NO: 1227846 - DNA, 22 bp, Artificial Sequence
  chemically synthesized
tcattgatgagtgttattccat

SEQ ID NO: 1227847 - DNA, 22 bp, Artificial Sequence
  chemically synthesized
ttcattgatgagtgttattcca

SEQ ID NO: 1227848 - DNA, 22 bp, Artificial Sequence
  chemically synthesized
ttttcattgatgagtgttattc

SEQ ID NO: 1227849 - DNA, 22 bp, Artificial Sequence
  chemically synthesized
ttcttttcattgatgagtgtta

SEQ ID NO: 1227850 - DNA, 22 bp, Artificial Sequence
  chemically synthesized
gttcttttcattgatgagtgtt

SEQ ID NO: 1227851 - DNA, 22 bp, Artificial Sequence
  chemically synthesized
catgtatcaatagtttgttctt

SEQ ID NO: 1227852 - DNA, 22 bp, Artificial Sequence
  chemically synthesized
atcaatgaaaagaacaaactat

SEQ ID NO: 1227853 - DNA, 22 bp, Artificial Sequence
  chemically synthesized
ctgcatgtatcaatagtttgtt

SEQ ID NO: 1227854 - DNA, 22 bp, Artificial Sequence
  chemically synthesized
gctgcatgtatcaatagtttgt

SEQ ID NO: 1227855 - DNA, 22 bp, Artificial Sequence
  chemically synthesized
atccaatttgctgcatgtatca

SEQ ID NO: 1227856 - DNA, 22 bp, Artificial Sequence
  chemically synthesized
ttgatacatgcagcaaattgga

SEQ ID NO: 1227857 - DNA, 22 bp, Artificial Sequence
  chemically synthesized
atacatgcagcaaattggatga

SEQ ID NO: 1227858 - DNA, 22 bp, Artificial Sequence
  chemically synthesized
gcataatgcccatgaaattcat

SEQ ID NO: 1227859 - DNA, 22 bp, Artificial Sequence
  chemically synthesized
agcataatgcccatgaaattca

SEQ ID NO: 1227860 - DNA, 22 bp, Artificial Sequence
  chemically synthesized
cccacttagcataatgcccatg

SEQ ID NO: 1227861 - DNA, 22 bp, Artificial Sequence
  chemically synthesized
ccccacttagcataatgcccat

SEQ ID NO: 1227862 - DNA, 22 bp, Artificial Sequence
  chemically synthesized
tccccacttagcataatgccca

SEQ ID NO: 1227863 - DNA, 22 bp, Artificial Sequence
  chemically synthesized
gatgaatttcatgggcattatg

SEQ ID NO: 1227864 - DNA, 22 bp, Artificial Sequence
  chemically synthesized
ttccccacttagcataatgccc

SEQ ID NO: 1227865 - DNA, 22 bp, Artificial Sequence
  chemically synthesized
tttccccacttagcataatgcc

SEQ ID NO: 1227866 - DNA, 22 bp, Artificial Sequence
  chemically synthesized
catgggcattatgctaagtggg

SEQ ID NO: 1227867 - DNA, 22 bp, Artificial Sequence
  chemically synthesized
atgggcattatgctaagtgggg

SEQ ID NO: 1227868 - DNA, 22 bp, Artificial Sequence
  chemically synthesized
agaatgactttttccccactta

SEQ ID NO: 1227869 - DNA, 22 bp, Artificial Sequence
  chemically synthesized
cagaatgactttttccccactt

SEQ ID NO: 1227870 - DNA, 22 bp, Artificial Sequence
  chemically synthesized
tcagaatgactttttccccact

SEQ ID NO: 1227871 - DNA, 22 bp, Artificial Sequence
  chemically synthesized
ccctttcagaatgactttttcc

SEQ ID NO: 1227872 - DNA, 22 bp, Artificial Sequence
  chemically synthesized
tgctaagtggggaaaaagtcat

SEQ ID NO: 1227873 - DNA, 22 bp, Artificial Sequence
  chemically synthesized
agtggggaaaaagtcattctga

SEQ ID NO: 1227874 - DNA, 22 bp, Artificial Sequence
  chemically synthesized
atacagtatgctaccctttcag

SEQ ID NO: 1227875 - DNA, 22 bp, Artificial Sequence
  chemically synthesized
tgaaagggtagcatactgtatg

SEQ ID NO: 1227876 - DNA, 22 bp, Artificial Sequence
  chemically synthesized
atagatacggattcatacagta

SEQ ID NO: 1227877 - DNA, 22 bp, Artificial Sequence
  chemically synthesized
aaagggtagcatactgtatgaa

SEQ ID NO: 1227878 - DNA, 22 bp, Artificial Sequence
  chemically synthesized
tcatagatacggattcatacag

SEQ ID NO: 1227879 - DNA, 22 bp, Artificial Sequence
  chemically synthesized
aagactctcatagatacggatt

SEQ ID NO: 1227880 - DNA, 22 bp, Artificial Sequence
  chemically synthesized
caagactctcatagatacggat

SEQ ID NO: 1227881 - DNA, 22 bp, Artificial Sequence
  chemically synthesized
tcaagactctcatagatacgga

SEQ ID NO: 1227882 - DNA, 22 bp, Artificial Sequence
  chemically synthesized
ttcaagactctcatagatacgg

SEQ ID NO: 1227883 - DNA, 22 bp, Artificial Sequence
  chemically synthesized
tcttttcaagactctcatagat

SEQ ID NO: 1227884 - DNA, 22 bp, Artificial Sequence
  chemically synthesized
tatgaatccgtatctatgagag

SEQ ID NO: 1227885 - DNA, 22 bp, Artificial Sequence
  chemically synthesized
gtcttttcaagactctcataga

SEQ ID NO: 1227886 - DNA, 22 bp, Artificial Sequence
  chemically synthesized
tgtcttttcaagactctcatag

SEQ ID NO: 1227887 - DNA, 22 bp, Artificial Sequence
  chemically synthesized
taactttgtcttttcaagactc

SEQ ID NO: 1227888 - DNA, 22 bp, Artificial Sequence
  chemically synthesized
tgtaactttgtcttttcaagac

SEQ ID NO: 1227889 - DNA, 22 bp, Artificial Sequence
  chemically synthesized
ctgtaactttgtcttttcaaga

SEQ ID NO: 1227890 - DNA, 22 bp, Artificial Sequence
  chemically synthesized
tttctgtaactttgtcttttca

SEQ ID NO: 1227891 - DNA, 22 bp, Artificial Sequence
  chemically synthesized
tatttctgtaactttgtctttt

SEQ ID NO: 1227892 - DNA, 22 bp, Artificial Sequence
  chemically synthesized
tgagagtcttgaaaagacaaag

SEQ ID NO: 1227893 - DNA, 22 bp, Artificial Sequence
  chemically synthesized
tctatttctgtaactttgtctt

SEQ ID NO: 1227894 - DNA, 22 bp, Artificial Sequence
  chemically synthesized
ttctctatttctgtaactttgt

SEQ ID NO: 1227895 - DNA, 22 bp, Artificial Sequence
  chemically synthesized
tgttctctatttctgtaacttt

SEQ ID NO: 1227896 - DNA, 22 bp, Artificial Sequence
  chemically synthesized
ttctgttctctatttctgtaac

SEQ ID NO: 1227897 - DNA, 22 bp, Artificial Sequence
  chemically synthesized
gaaaagacaaagttacagaaat

SEQ ID NO: 1227898 - DNA, 22 bp, Artificial Sequence
  chemically synthesized
aaaagacaaagttacagaaata

SEQ ID NO: 1227899 - DNA, 22 bp, Artificial Sequence
  chemically synthesized
ctattctgttctctatttctgt

SEQ ID NO: 1227900 - DNA, 22 bp, Artificial Sequence
  chemically synthesized
ccaactgctattctgttctcta

SEQ ID NO: 1227901 - DNA, 22 bp, Artificial Sequence
  chemically synthesized
tgccaactgctattctgttctc

SEQ ID NO: 1227902 - DNA, 22 bp, Artificial Sequence
  chemically synthesized
cagaaatagagaacagaatagc

SEQ ID NO: 1227903 - DNA, 22 bp, Artificial Sequence
  chemically synthesized
acctctgccaactgctattctg

SEQ ID NO: 1227904 - DNA, 22 bp, Artificial Sequence
  chemically synthesized
ctgacctctgccaactgctatt

SEQ ID NO: 1227905 - DNA, 22 bp, Artificial Sequence
  chemically synthesized
ccattcctgacctctgccaact

SEQ ID NO: 1227906 - DNA, 22 bp, Artificial Sequence
  chemically synthesized
ctcccattcctgacctctgcca

SEQ ID NO: 1227907 - DNA, 22 bp, Artificial Sequence
  chemically synthesized
actcccattcctgacctctgcc

SEQ ID NO: 1227908 - DNA, 22 bp, Artificial Sequence
  chemically synthesized
ccccacatcttactcccattcc

SEQ ID NO: 1227909 - DNA, 22 bp, Artificial Sequence
  chemically synthesized
gcagaggtcaggaatgggagta

SEQ ID NO: 1227910 - DNA, 22 bp, Artificial Sequence
  chemically synthesized
agctaccccacatcttactccc

SEQ ID NO: 1227911 - DNA, 22 bp, Artificial Sequence
  chemically synthesized
taagaacattcagctaccccac

SEQ ID NO: 1227912 - DNA, 22 bp, Artificial Sequence
  chemically synthesized
ataagaacattcagctacccca

SEQ ID NO: 1227913 - DNA, 22 bp, Artificial Sequence
  chemically synthesized
tataagaacattcagctacccc

SEQ ID NO: 1227914 - DNA, 22 bp, Artificial Sequence
  chemically synthesized
ttataagaacattcagctaccc

SEQ ID NO: 1227915 - DNA, 22 bp, Artificial Sequence
  chemically synthesized
cccttttataagaacattcagc

SEQ ID NO: 1227916 - DNA, 22 bp, Artificial Sequence
  chemically synthesized
atattgcccttttataagaaca

SEQ ID NO: 1227917 - DNA, 22 bp, Artificial Sequence
  chemically synthesized
aatgttcttataaaagggcaat

SEQ ID NO: 1227918 - DNA, 22 bp, Artificial Sequence
  chemically synthesized
caagggtccctcatattgccct

SEQ ID NO: 1227919 - DNA, 22 bp, Artificial Sequence
  chemically synthesized
ttataaaagggcaatatgaggg

SEQ ID NO: 1227920 - DNA, 22 bp, Artificial Sequence
  chemically synthesized
ataaaagggcaatatgagggac

SEQ ID NO: 1227921 - DNA, 22 bp, Artificial Sequence
  chemically synthesized
taaaagggcaatatgagggacc

SEQ ID NO: 1227922 - DNA, 22 bp, Artificial Sequence
  chemically synthesized
caccattacaagggtccctcat

SEQ ID NO: 1227923 - DNA, 22 bp, Artificial Sequence
  chemically synthesized
gtaatggtggaactgttctgca

SEQ ID NO: 1227924 - DNA, 22 bp, Artificial Sequence
  chemically synthesized
taatggtggaactgttctgcat

SEQ ID NO: 1227925 - DNA, 22 bp, Artificial Sequence
  chemically synthesized
taaatccaccatcagagtcaat

SEQ ID NO: 1227926 - DNA, 22 bp, Artificial Sequence
  chemically synthesized
gtaaatccaccatcagagtcaa

SEQ ID NO: 1227927 - DNA, 22 bp, Artificial Sequence
  chemically synthesized
ttctgcatattgactctgatgg

SEQ ID NO: 1227928 - DNA, 22 bp, Artificial Sequence
  chemically synthesized
tgcatattgactctgatggtgg

SEQ ID NO: 1227929 - DNA, 22 bp, Artificial Sequence
  chemically synthesized
catattgactctgatggtggat

SEQ ID NO: 1227930 - DNA, 22 bp, Artificial Sequence
  chemically synthesized
cgtgtgtaggtttgtaaatcca

SEQ ID NO: 1227931 - DNA, 22 bp, Artificial Sequence
  chemically synthesized
actctgatggtggatttacaaa

SEQ ID NO: 1227932 - DNA, 22 bp, Artificial Sequence
  chemically synthesized
ttacgtgtgtaggtttgtaaat

SEQ ID NO: 1227933 - DNA, 22 bp, Artificial Sequence
  chemically synthesized
tgatggtggatttacaaaccta

SEQ ID NO: 1227934 - DNA, 22 bp, Artificial Sequence
  chemically synthesized
atggtggatttacaaacctaca

SEQ ID NO: 1227935 - DNA, 22 bp, Artificial Sequence
  chemically synthesized
tgcaacattattacgtgtgtag

SEQ ID NO: 1227936 - DNA, 22 bp, Artificial Sequence
  chemically synthesized
tatgcaacattattacgtgtgt

SEQ ID NO: 1227937 - DNA, 22 bp, Artificial Sequence
  chemically synthesized
acaaacctacacacgtaataat

SEQ ID NO: 1227938 - DNA, 22 bp, Artificial Sequence
  chemically synthesized
gttctatgcaacattattacgt

SEQ ID NO: 1227939 - DNA, 22 bp, Artificial Sequence
  chemically synthesized
caaacctacacacgtaataatg

SEQ ID NO: 1227940 - DNA, 22 bp, Artificial Sequence
  chemically synthesized
agttctatgcaacattattacg

SEQ ID NO: 1227941 - DNA, 22 bp, Artificial Sequence
  chemically synthesized
cacacgtaataatgttgcatag

SEQ ID NO: 1227942 - DNA, 22 bp, Artificial Sequence
  chemically synthesized
catagaactaaatacacacata

SEQ ID NO: 1227943 - DNA, 22 bp, Artificial Sequence
  chemically synthesized
tgtgtatgtgtgcatgcatatg

SEQ ID NO: 1227944 - DNA, 22 bp, Artificial Sequence
  chemically synthesized
atgtgtatgtgtgcatgcatat

SEQ ID NO: 1227945 - DNA, 22 bp, Artificial Sequence
  chemically synthesized
aatacacacatatgcatgcaca

SEQ ID NO: 1227946 - DNA, 22 bp, Artificial Sequence
  chemically synthesized
atatttatgtgtatgtgtgcat

SEQ ID NO: 1227947 - DNA, 22 bp, Artificial Sequence
  chemically synthesized
ctcatatttatgtgtatgtgtg

SEQ ID NO: 1227948 - DNA, 22 bp, Artificial Sequence
  chemically synthesized
actcatatttatgtgtatgtgt

SEQ ID NO: 1227949 - DNA, 22 bp, Artificial Sequence
  chemically synthesized
tactcatatttatgtgtatgtg

SEQ ID NO: 1227950 - DNA, 22 bp, Artificial Sequence
  chemically synthesized
ccagctttactcatatttatgt

SEQ ID NO: 1227951 - DNA, 22 bp, Artificial Sequence
  chemically synthesized
cccagctttactcatatttatg

SEQ ID NO: 1227952 - DNA, 22 bp, Artificial Sequence
  chemically synthesized
tcccagctttactcatatttat

SEQ ID NO: 1227953 - DNA, 22 bp, Artificial Sequence
  chemically synthesized
agattttcccagctttactcat

SEQ ID NO: 1227954 - DNA, 22 bp, Artificial Sequence
  chemically synthesized
ataaaaccaccaatagtattca

SEQ ID NO: 1227955 - DNA, 22 bp, Artificial Sequence
  chemically synthesized
ggaaaatctgaatactattggt

SEQ ID NO: 1227956 - DNA, 22 bp, Artificial Sequence
  chemically synthesized
aatactattggtggttttatga

SEQ ID NO: 1227957 - DNA, 22 bp, Artificial Sequence
  chemically synthesized
ttggtggttttatgaatgttga

SEQ ID NO: 1227958 - DNA, 22 bp, Artificial Sequence
  chemically synthesized
gtggttttatgaatgttgacat

SEQ ID NO: 1227959 - DNA, 22 bp, Artificial Sequence
  chemically synthesized
tatgaatgttgacatcttggtc

SEQ ID NO: 1227960 - DNA, 22 bp, Artificial Sequence
  chemically synthesized
atgaatgttgacatcttggtca

SEQ ID NO: 1227961 - DNA, 22 bp, Artificial Sequence
  chemically synthesized
tgaatgttgacatcttggtcat

SEQ ID NO: 1227962 - DNA, 22 bp, Artificial Sequence
  chemically synthesized
aaatacgatatcatgaccaaga

SEQ ID NO: 1227963 - DNA, 22 bp, Artificial Sequence
  chemically synthesized
taaaactaaaatacgatatcat

SEQ ID NO: 1227964 - DNA, 22 bp, Artificial Sequence
  chemically synthesized
acatcttggtcatgatatcgta

SEQ ID NO: 1227965 - DNA, 22 bp, Artificial Sequence
  chemically synthesized
ataaaactaaaatacgatatca

SEQ ID NO: 1227966 - DNA, 22 bp, Artificial Sequence
  chemically synthesized
ggtcatgatatcgtattttagt

SEQ ID NO: 1227967 - DNA, 22 bp, Artificial Sequence
  chemically synthesized
gtcatgatatcgtattttagtt

SEQ ID NO: 1227968 - DNA, 22 bp, Artificial Sequence
  chemically synthesized
gatgtagtaacatcttataaaa

SEQ ID NO: 1227969 - DNA, 22 bp, Artificial Sequence
  chemically synthesized
cgatgtagtaacatcttataaa

SEQ ID NO: 1227970 - DNA, 22 bp, Artificial Sequence
  chemically synthesized
cccttcgatgtagtaacatctt

SEQ ID NO: 1227971 - DNA, 22 bp, Artificial Sequence
  chemically synthesized
tagttttataagatgttactac

SEQ ID NO: 1227972 - DNA, 22 bp, Artificial Sequence
  chemically synthesized
agttttataagatgttactaca

SEQ ID NO: 1227973 - DNA, 22 bp, Artificial Sequence
  chemically synthesized
gttttataagatgttactacat

SEQ ID NO: 1227974 - DNA, 22 bp, Artificial Sequence
  chemically synthesized
tataagatgttactacatcgaa

SEQ ID NO: 1227975 - DNA, 22 bp, Artificial Sequence
  chemically synthesized
ataagatgttactacatcgaag

SEQ ID NO: 1227976 - DNA, 22 bp, Artificial Sequence
  chemically synthesized
taagatgttactacatcgaagg

SEQ ID NO: 1227977 - DNA, 22 bp, Artificial Sequence
  chemically synthesized
aatgatcaatctccccttcgat

SEQ ID NO: 1227978 - DNA, 22 bp, Artificial Sequence
  chemically synthesized
gaatgatcaatctccccttcga

SEQ ID NO: 1227979 - DNA, 22 bp, Artificial Sequence
  chemically synthesized
ttgaatgatcaatctccccttc

SEQ ID NO: 1227980 - DNA, 22 bp, Artificial Sequence
  chemically synthesized
ttcttgaatgatcaatctcccc

SEQ ID NO: 1227981 - DNA, 22 bp, Artificial Sequence
  chemically synthesized
attcttgaatgatcaatctccc

SEQ ID NO: 1227982 - DNA, 22 bp, Artificial Sequence
  chemically synthesized
ctacatcgaaggggagattgat

SEQ ID NO: 1227983 - DNA, 22 bp, Artificial Sequence
  chemically synthesized
ttattcttgaatgatcaatctc

SEQ ID NO: 1227984 - DNA, 22 bp, Artificial Sequence
  chemically synthesized
cttattcttgaatgatcaatct

SEQ ID NO: 1227985 - DNA, 22 bp, Artificial Sequence
  chemically synthesized
catcgaaggggagattgatcat

SEQ ID NO: 1227986 - DNA, 22 bp, Artificial Sequence
  chemically synthesized
tcttattcttgaatgatcaatc

SEQ ID NO: 1227987 - DNA, 22 bp, Artificial Sequence
  chemically synthesized
atcattcaagaataagaaagca

SEQ ID NO: 1227988 - DNA, 22 bp, Artificial Sequence
  chemically synthesized
aagaataagaaagcatcatcat

SEQ ID NO: 1227989 - DNA, 22 bp, Artificial Sequence
  chemically synthesized
ccatatgaggaatccccagatg

SEQ ID NO: 1227990 - DNA, 22 bp, Artificial Sequence
  chemically synthesized
ctgccatatgaggaatccccag

SEQ ID NO: 1227991 - DNA, 22 bp, Artificial Sequence
  chemically synthesized
tactgccatatgaggaatcccc

SEQ ID NO: 1227992 - DNA, 22 bp, Artificial Sequence
  chemically synthesized
catcatcatctggggattcctc

SEQ ID NO: 1227993 - DNA, 22 bp, Artificial Sequence
  chemically synthesized
ctctactgccatatgaggaatc

SEQ ID NO: 1227994 - DNA, 22 bp, Artificial Sequence
  chemically synthesized
tcctctactgccatatgaggaa

SEQ ID NO: 1227995 - DNA, 22 bp, Artificial Sequence
  chemically synthesized
tctcctctactgccatatgagg

SEQ ID NO: 1227996 - DNA, 22 bp, Artificial Sequence
  chemically synthesized
ctctcctctactgccatatgag

SEQ ID NO: 1227997 - DNA, 22 bp, Artificial Sequence
  chemically synthesized
gggattcctcatatggcagtag

SEQ ID NO: 1227998 - DNA, 22 bp, Artificial Sequence
  chemically synthesized
tggaggaatttctctcctctac

SEQ ID NO: 1227999 - DNA, 22 bp, Artificial Sequence
  chemically synthesized
ctcatatggcagtagaggagag

SEQ ID NO: 1228000 - DNA, 22 bp, Artificial Sequence
  chemically synthesized
atggaggaatttctctcctcta

SEQ ID NO: 1228001 - DNA, 22 bp, Artificial Sequence
  chemically synthesized
atatggcagtagaggagagaaa

SEQ ID NO: 1228002 - DNA, 22 bp, Artificial Sequence
  chemically synthesized
cttatggaggaatttctctcct

SEQ ID NO: 1228003 - DNA, 22 bp, Artificial Sequence
  chemically synthesized
ccttatggaggaatttctctcc

SEQ ID NO: 1228004 - DNA, 22 bp, Artificial Sequence
  chemically synthesized
tccttatggaggaatttctctc

SEQ ID NO: 1228005 - DNA, 22 bp, Artificial Sequence
  chemically synthesized
ttccttatggaggaatttctct

SEQ ID NO: 1228006 - DNA, 22 bp, Artificial Sequence
  chemically synthesized
atagtggcttttccttatggag

SEQ ID NO: 1228007 - DNA, 22 bp, Artificial Sequence
  chemically synthesized
ctccataaggaaaagccactat

SEQ ID NO: 1228008 - DNA, 22 bp, Artificial Sequence
  chemically synthesized
cataaggaaaagccactatgaa

SEQ ID NO: 1228009 - DNA, 22 bp, Artificial Sequence
  chemically synthesized
gtgaatcaatgaatcaatagat

SEQ ID NO: 1228010 - DNA, 22 bp, Artificial Sequence
  chemically synthesized
tgaatttatctattgattcatt

SEQ ID NO: 1228011 - DNA, 22 bp, Artificial Sequence
  chemically synthesized
agttagtgaatcaatgaatcaa

SEQ ID NO: 1228012 - DNA, 22 bp, Artificial Sequence
  chemically synthesized
ttgagttagtgaatcaatgaat

SEQ ID NO: 1228013 - DNA, 22 bp, Artificial Sequence
  chemically synthesized
gttgagttagtgaatcaatgaa

SEQ ID NO: 1228014 - DNA, 22 bp, Artificial Sequence
  chemically synthesized
atctattgattcattgattcac

SEQ ID NO: 1228015 - DNA, 22 bp, Artificial Sequence
  chemically synthesized
tctattgattcattgattcact

SEQ ID NO: 1228016 - DNA, 22 bp, Artificial Sequence
  chemically synthesized
ttgattcattgattcactaact

SEQ ID NO: 1228017 - DNA, 22 bp, Artificial Sequence
  chemically synthesized
attcattgattcactaactcaa

SEQ ID NO: 1228018 - DNA, 22 bp, Artificial Sequence
  chemically synthesized
attgattcactaactcaacaag

SEQ ID NO: 1228019 - DNA, 22 bp, Artificial Sequence
  chemically synthesized
attcactaactcaacaagtacc

SEQ ID NO: 1228020 - DNA, 22 bp, Artificial Sequence
  chemically synthesized
gcagatagccaaaaggtacttg

SEQ ID NO: 1228021 - DNA, 22 bp, Artificial Sequence
  chemically synthesized
actaactcaacaagtacctttt

SEQ ID NO: 1228022 - DNA, 22 bp, Artificial Sequence
  chemically synthesized
cctggcagatagccaaaaggta

SEQ ID NO: 1228023 - DNA, 22 bp, Artificial Sequence
  chemically synthesized
actcaacaagtaccttttggct

SEQ ID NO: 1228024 - DNA, 22 bp, Artificial Sequence
  chemically synthesized
attgcctggcagatagccaaaa

SEQ ID NO: 1228025 - DNA, 22 bp, Artificial Sequence
  chemically synthesized
cattgcctggcagatagccaaa

SEQ ID NO: 1228026 - DNA, 22 bp, Artificial Sequence
  chemically synthesized
aacaagtaccttttggctatct

SEQ ID NO: 1228027 - DNA, 22 bp, Artificial Sequence
  chemically synthesized
cttcattgcctggcagatagcc

SEQ ID NO: 1228028 - DNA, 22 bp, Artificial Sequence
  chemically synthesized
ttacttcattgcctggcagata

SEQ ID NO: 1228029 - DNA, 22 bp, Artificial Sequence
  chemically synthesized
attacttcattgcctggcagat

SEQ ID NO: 1228030 - DNA, 22 bp, Artificial Sequence
  chemically synthesized
ttattacttcattgcctggcag

SEQ ID NO: 1228031 - DNA, 22 bp, Artificial Sequence
  chemically synthesized
ttggctatctgccaggcaatga

SEQ ID NO: 1228032 - DNA, 22 bp, Artificial Sequence
  chemically synthesized
tggctatctgccaggcaatgaa

SEQ ID NO: 1228033 - DNA, 22 bp, Artificial Sequence
  chemically synthesized
ggctatctgccaggcaatgaag

SEQ ID NO: 1228034 - DNA, 22 bp, Artificial Sequence
  chemically synthesized
gctatctgccaggcaatgaagt

SEQ ID NO: 1228035 - DNA, 22 bp, Artificial Sequence
  chemically synthesized
catgctcttattacttcattgc

SEQ ID NO: 1228036 - DNA, 22 bp, Artificial Sequence
  chemically synthesized
acatgctcttattacttcattg

SEQ ID NO: 1228037 - DNA, 22 bp, Artificial Sequence
  chemically synthesized
tacatgctcttattacttcatt

SEQ ID NO: 1228038 - DNA, 22 bp, Artificial Sequence
  chemically synthesized
ttacatgctcttattacttcat

SEQ ID NO: 1228039 - DNA, 22 bp, Artificial Sequence
  chemically synthesized
tctgccaggcaatgaagtaata

SEQ ID NO: 1228040 - DNA, 22 bp, Artificial Sequence
  chemically synthesized
cttttacatgctcttattactt

SEQ ID NO: 1228041 - DNA, 22 bp, Artificial Sequence
  chemically synthesized
acttttacatgctcttattact

SEQ ID NO: 1228042 - DNA, 22 bp, Artificial Sequence
  chemically synthesized
ccaggcaatgaagtaataagag

SEQ ID NO: 1228043 - DNA, 22 bp, Artificial Sequence
  chemically synthesized
tacttttacatgctcttattac

SEQ ID NO: 1228044 - DNA, 22 bp, Artificial Sequence
  chemically synthesized
ttacttttacatgctcttatta

SEQ ID NO: 1228045 - DNA, 22 bp, Artificial Sequence
  chemically synthesized
atgaaagcagaaggtttttact

SEQ ID NO: 1228046 - DNA, 22 bp, Artificial Sequence
  chemically synthesized
catgaaagcagaaggtttttac

SEQ ID NO: 1228047 - DNA, 22 bp, Artificial Sequence
  chemically synthesized
agtttcatgaaagcagaaggtt

SEQ ID NO: 1228048 - DNA, 22 bp, Artificial Sequence
  chemically synthesized
gaattaagtttcatgaaagcag

SEQ ID NO: 1228049 - DNA, 22 bp, Artificial Sequence
  chemically synthesized
tcactagaattaagtttcatga

SEQ ID NO: 1228050 - DNA, 22 bp, Artificial Sequence
  chemically synthesized
ctgctttcatgaaacttaattc

SEQ ID NO: 1228051 - DNA, 22 bp, Artificial Sequence
  chemically synthesized
tcactatcactagaattaagtt

SEQ ID NO: 1228052 - DNA, 22 bp, Artificial Sequence
  chemically synthesized
tgctttcatgaaacttaattct

SEQ ID NO: 1228053 - DNA, 22 bp, Artificial Sequence
  chemically synthesized
ctttcatgaaacttaattctag

SEQ ID NO: 1228054 - DNA, 22 bp, Artificial Sequence
  chemically synthesized
attgtcactatcactagaatta

SEQ ID NO: 1228055 - DNA, 22 bp, Artificial Sequence
  chemically synthesized
tcatgaaacttaattctagtga

SEQ ID NO: 1228056 - DNA, 22 bp, Artificial Sequence
  chemically synthesized
catgaaacttaattctagtgat

SEQ ID NO: 1228057 - DNA, 22 bp, Artificial Sequence
  chemically synthesized
atgaaacttaattctagtgata

SEQ ID NO: 1228058 - DNA, 22 bp, Artificial Sequence
  chemically synthesized
tatcatctgattgtcactatca

SEQ ID NO: 1228059 - DNA, 22 bp, Artificial Sequence
  chemically synthesized
aattctagtgatagtgacaatc

SEQ ID NO: 1228060 - DNA, 22 bp, Artificial Sequence
  chemically synthesized
attctagtgatagtgacaatca

SEQ ID NO: 1228061 - DNA, 22 bp, Artificial Sequence
  chemically synthesized
gtgctatatcatctgattgtca

SEQ ID NO: 1228062 - DNA, 22 bp, Artificial Sequence
  chemically synthesized
agtgctatatcatctgattgtc

SEQ ID NO: 1228063 - DNA, 22 bp, Artificial Sequence
  chemically synthesized
tagtgctatatcatctgattgt

SEQ ID NO: 1228064 - DNA, 22 bp, Artificial Sequence
  chemically synthesized
tagtgatagtgacaatcagatg

SEQ ID NO: 1228065 - DNA, 22 bp, Artificial Sequence
  chemically synthesized
gtgatagtgacaatcagatgat

SEQ ID NO: 1228066 - DNA, 22 bp, Artificial Sequence
  chemically synthesized
agtctttagtgctatatcatct

SEQ ID NO: 1228067 - DNA, 22 bp, Artificial Sequence
  chemically synthesized
gagtctttagtgctatatcatc

SEQ ID NO: 1228068 - DNA, 22 bp, Artificial Sequence
  chemically synthesized
cttgagtctttagtgctatatc

SEQ ID NO: 1228069 - DNA, 22 bp, Artificial Sequence
  chemically synthesized
actgcttgagtctttagtgcta

SEQ ID NO: 1228070 - DNA, 22 bp, Artificial Sequence
  chemically synthesized
aactgcttgagtctttagtgct

SEQ ID NO: 1228071 - DNA, 22 bp, Artificial Sequence
  chemically synthesized
cttaactgcttgagtctttagt

SEQ ID NO: 1228072 - DNA, 22 bp, Artificial Sequence
  chemically synthesized
tgcttaactgcttgagtcttta

SEQ ID NO: 1228073 - DNA, 22 bp, Artificial Sequence
  chemically synthesized
tctgcttaactgcttgagtctt

SEQ ID NO: 1228074 - DNA, 22 bp, Artificial Sequence
  chemically synthesized
aagactcaagcagttaagcaga

SEQ ID NO: 1228075 - DNA, 22 bp, Artificial Sequence
  chemically synthesized
aaaatagcatattctctgctta

SEQ ID NO: 1228076 - DNA, 22 bp, Artificial Sequence
  chemically synthesized
ctaaaaatagcatattctctgc

SEQ ID NO: 1228077 - DNA, 22 bp, Artificial Sequence
  chemically synthesized
cctaaaaatagcatattctctg

SEQ ID NO: 1228078 - DNA, 22 bp, Artificial Sequence
  chemically synthesized
aagcagttaagcagagaatatg

SEQ ID NO: 1228079 - DNA, 22 bp, Artificial Sequence
  chemically synthesized
agcagagaatatgctattttta

SEQ ID NO: 1228080 - DNA, 22 bp, Artificial Sequence
  chemically synthesized
ccgcagtatgagtgagtatgtt

SEQ ID NO: 1228081 - DNA, 22 bp, Artificial Sequence
  chemically synthesized
cccgcagtatgagtgagtatgt

SEQ ID NO: 1228082 - DNA, 22 bp, Artificial Sequence
  chemically synthesized
tttttaggaaacatactcactc

SEQ ID NO: 1228083 - DNA, 22 bp, Artificial Sequence
  chemically synthesized
ttaggaaacatactcactcata

SEQ ID NO: 1228084 - DNA, 22 bp, Artificial Sequence
  chemically synthesized
taggaaacatactcactcatac

SEQ ID NO: 1228085 - DNA, 22 bp, Artificial Sequence
  chemically synthesized
aggaaacatactcactcatact

SEQ ID NO: 1228086 - DNA, 22 bp, Artificial Sequence
  chemically synthesized
ggaaacatactcactcatactg

SEQ ID NO: 1228087 - DNA, 22 bp, Artificial Sequence
  chemically synthesized
ccagcagtgcttcccgcagtat

SEQ ID NO: 1228088 - DNA, 22 bp, Artificial Sequence
  chemically synthesized
actcatactgcgggaagcactg

SEQ ID NO: 1228089 - DNA, 22 bp, Artificial Sequence
  chemically synthesized
atactgcgggaagcactgctgg

SEQ ID NO: 1228090 - DNA, 22 bp, Artificial Sequence
  chemically synthesized
cgggaagcactgctggtagata

SEQ ID NO: 1228091 - DNA, 22 bp, Artificial Sequence
  chemically synthesized
ctggtagatacgttttgggttg

SEQ ID NO: 1228092 - DNA, 22 bp, Artificial Sequence
  chemically synthesized
gtagatacgttttgggttgcca

SEQ ID NO: 1228093 - DNA, 22 bp, Artificial Sequence
  chemically synthesized
cccagagtcaggtccatggcaa

SEQ ID NO: 1228094 - DNA, 22 bp, Artificial Sequence
  chemically synthesized
agtctccccagagtcaggtcca

SEQ ID NO: 1228095 - DNA, 22 bp, Artificial Sequence
  chemically synthesized
tgggttgccatggacctgactc

SEQ ID NO: 1228096 - DNA, 22 bp, Artificial Sequence
  chemically synthesized
gggttgccatggacctgactct

SEQ ID NO: 1228097 - DNA, 22 bp, Artificial Sequence
  chemically synthesized
ggttgccatggacctgactctg

SEQ ID NO: 1228098 - DNA, 22 bp, Artificial Sequence
  chemically synthesized
atctaagtctccccagagtcag

SEQ ID NO: 1228099 - DNA, 22 bp, Artificial Sequence
  chemically synthesized
gatctaagtctccccagagtca

SEQ ID NO: 1228100 - DNA, 22 bp, Artificial Sequence
  chemically synthesized
ccatggacctgactctggggag

SEQ ID NO: 1228101 - DNA, 22 bp, Artificial Sequence
  chemically synthesized
cttgatctaagtctccccagag

SEQ ID NO: 1228102 - DNA, 22 bp, Artificial Sequence
  chemically synthesized
ttacttgatctaagtctcccca

SEQ ID NO: 1228103 - DNA, 22 bp, Artificial Sequence
  chemically synthesized
ctattacttgatctaagtctcc

SEQ ID NO: 1228104 - DNA, 22 bp, Artificial Sequence
  chemically synthesized
actctggggagacttagatcaa

SEQ ID NO: 1228105 - DNA, 22 bp, Artificial Sequence
  chemically synthesized
agttcctattacttgatctaag

SEQ ID NO: 1228106 - DNA, 22 bp, Artificial Sequence
  chemically synthesized
tggggagacttagatcaagtaa

SEQ ID NO: 1228107 - DNA, 22 bp, Artificial Sequence
  chemically synthesized
gggagacttagatcaagtaata

SEQ ID NO: 1228108 - DNA, 22 bp, Artificial Sequence
  chemically synthesized
gaatctaagttcctattacttg

SEQ ID NO: 1228109 - DNA, 22 bp, Artificial Sequence
  chemically synthesized
ctggaatctaagttcctattac

SEQ ID NO: 1228110 - DNA, 22 bp, Artificial Sequence
  chemically synthesized
agatcaagtaataggaacttag

SEQ ID NO: 1228111 - DNA, 22 bp, Artificial Sequence
  chemically synthesized
gatcaagtaataggaacttaga

SEQ ID NO: 1228112 - DNA, 22 bp, Artificial Sequence
  chemically synthesized
tgacagtggataaggggttact

SEQ ID NO: 1228113 - DNA, 22 bp, Artificial Sequence
  chemically synthesized
atgacagtggataaggggttac

SEQ ID NO: 1228114 - DNA, 22 bp, Artificial Sequence
  chemically synthesized
agattccagtaaccccttatcc

SEQ ID NO: 1228115 - DNA, 22 bp, Artificial Sequence
  chemically synthesized
gattccagtaaccccttatcca

SEQ ID NO: 1228116 - DNA, 22 bp, Artificial Sequence
  chemically synthesized
cagtaaccccttatccactgtc

SEQ ID NO: 1228117 - DNA, 22 bp, Artificial Sequence
  chemically synthesized
cacagtgacaagtcttatgaca

SEQ ID NO: 1228118 - DNA, 22 bp, Artificial Sequence
  chemically synthesized
acacagtgacaagtcttatgac

SEQ ID NO: 1228119 - DNA, 22 bp, Artificial Sequence
  chemically synthesized
cttacacagtgacaagtcttat

SEQ ID NO: 1228120 - DNA, 22 bp, Artificial Sequence
  chemically synthesized
atccactgtcataagacttgtc

SEQ ID NO: 1228121 - DNA, 22 bp, Artificial Sequence
  chemically synthesized
tccactgtcataagacttgtca

SEQ ID NO: 1228122 - DNA, 22 bp, Artificial Sequence
  chemically synthesized
ctgcttacacagtgacaagtct

SEQ ID NO: 1228123 - DNA, 22 bp, Artificial Sequence
  chemically synthesized
cctgcttacacagtgacaagtc

SEQ ID NO: 1228124 - DNA, 22 bp, Artificial Sequence
  chemically synthesized
tcttcctgcttacacagtgaca

SEQ ID NO: 1228125 - DNA, 22 bp, Artificial Sequence
  chemically synthesized
tcataagacttgtcactgtgta

SEQ ID NO: 1228126 - DNA, 22 bp, Artificial Sequence
  chemically synthesized
gtcactgtgtaagcaggaagat

SEQ ID NO: 1228127 - DNA, 22 bp, Artificial Sequence
  chemically synthesized
tcactgtgtaagcaggaagata

SEQ ID NO: 1228128 - DNA, 22 bp, Artificial Sequence
  chemically synthesized
tgtaagcaggaagatagttcct

SEQ ID NO: 1228129 - DNA, 22 bp, Artificial Sequence
  chemically synthesized
tgaggacaaggaaatggaggaa

SEQ ID NO: 1228130 - DNA, 22 bp, Artificial Sequence
  chemically synthesized
atgaggacaaggaaatggagga

SEQ ID NO: 1228131 - DNA, 22 bp, Artificial Sequence
  chemically synthesized
tatgaggacaaggaaatggagg

SEQ ID NO: 1228132 - DNA, 22 bp, Artificial Sequence
  chemically synthesized
ttatgaggacaaggaaatggag

SEQ ID NO: 1228133 - DNA, 22 bp, Artificial Sequence
  chemically synthesized
tgagaccttttatgaggacaag

SEQ ID NO: 1228134 - DNA, 22 bp, Artificial Sequence
  chemically synthesized
atgagaccttttatgaggacaa

SEQ ID NO: 1228135 - DNA, 22 bp, Artificial Sequence
  chemically synthesized
ctccatttccttgtcctcataa

SEQ ID NO: 1228136 - DNA, 22 bp, Artificial Sequence
  chemically synthesized
catttccttgtcctcataaaag

SEQ ID NO: 1228137 - DNA, 22 bp, Artificial Sequence
  chemically synthesized
gaccttatgagaccttttatga

SEQ ID NO: 1228138 - DNA, 22 bp, Artificial Sequence
  chemically synthesized
ccttgtcctcataaaaggtctc

SEQ ID NO: 1228139 - DNA, 22 bp, Artificial Sequence
  chemically synthesized
cttgtcctcataaaaggtctca

SEQ ID NO: 1228140 - DNA, 22 bp, Artificial Sequence
  chemically synthesized
gtcctcataaaaggtctcataa

SEQ ID NO: 1228141 - DNA, 22 bp, Artificial Sequence
  chemically synthesized
tcctcataaaaggtctcataag

SEQ ID NO: 1228142 - DNA, 22 bp, Artificial Sequence
  chemically synthesized
ataaaaggtctcataaggtcca

SEQ ID NO: 1228143 - DNA, 22 bp, Artificial Sequence
  chemically synthesized
aatatagtggaaattggacctt

SEQ ID NO: 1228144 - DNA, 22 bp, Artificial Sequence
  chemically synthesized
ataaggtccaatttccactata

SEQ ID NO: 1228145 - DNA, 22 bp, Artificial Sequence
  chemically synthesized
agcccagtacctgaatatagtg

SEQ ID NO: 1228146 - DNA, 22 bp, Artificial Sequence
  chemically synthesized
tcaggtctgagcccagtacctg

SEQ ID NO: 1228147 - DNA, 22 bp, Artificial Sequence
  chemically synthesized
atcaggtctgagcccagtacct

SEQ ID NO: 1228148 - DNA, 22 bp, Artificial Sequence
  chemically synthesized
ccactatattcaggtactgggc

SEQ ID NO: 1228149 - DNA, 22 bp, Artificial Sequence
  chemically synthesized
tatcaggtctgagcccagtacc

SEQ ID NO: 1228150 - DNA, 22 bp, Artificial Sequence
  chemically synthesized
cactatattcaggtactgggct

SEQ ID NO: 1228151 - DNA, 22 bp, Artificial Sequence
  chemically synthesized
ctttatcaggtctgagcccagt

SEQ ID NO: 1228152 - DNA, 22 bp, Artificial Sequence
  chemically synthesized
cctttatcaggtctgagcccag

SEQ ID NO: 1228153 - DNA, 22 bp, Artificial Sequence
  chemically synthesized
tcctttatcaggtctgagccca

SEQ ID NO: 1228154 - DNA, 22 bp, Artificial Sequence
  chemically synthesized
tattcaggtactgggctcagac

SEQ ID NO: 1228155 - DNA, 22 bp, Artificial Sequence
  chemically synthesized
ctttcctttatcaggtctgagc

SEQ ID NO: 1228156 - DNA, 22 bp, Artificial Sequence
  chemically synthesized
actttcctttatcaggtctgag

SEQ ID NO: 1228157 - DNA, 22 bp, Artificial Sequence
  chemically synthesized
aggtactgggctcagacctgat

SEQ ID NO: 1228158 - DNA, 22 bp, Artificial Sequence
  chemically synthesized
ggctcagacctgataaaggaaa

SEQ ID NO: 1228159 - DNA, 22 bp, Artificial Sequence
  chemically synthesized
agacctgataaaggaaagtaag

SEQ ID NO: 1228160 - DNA, 22 bp, Artificial Sequence
  chemically synthesized
ggggggtagtaccttactttcc

SEQ ID NO: 1228161 - DNA, 22 bp, Artificial Sequence
  chemically synthesized
acactgggggggtagtacctta

SEQ ID NO: 1228162 - DNA, 22 bp, Artificial Sequence
  chemically synthesized
ataaaggaaagtaaggtactac

SEQ ID NO: 1228163 - DNA, 22 bp, Artificial Sequence
  chemically synthesized
gacactgggggggtagtacctt

SEQ ID NO: 1228164 - DNA, 22 bp, Artificial Sequence
  chemically synthesized
tgacactgggggggtagtacct

SEQ ID NO: 1228165 - DNA, 22 bp, Artificial Sequence
  chemically synthesized
ttgacactgggggggtagtacc

SEQ ID NO: 1228166 - DNA, 22 bp, Artificial Sequence
  chemically synthesized
tttgacactgggggggtagtac

SEQ ID NO: 1228167 - DNA, 22 bp, Artificial Sequence
  chemically synthesized
tgaactttttgacactgggggg

SEQ ID NO: 1228168 - DNA, 22 bp, Artificial Sequence
  chemically synthesized
ttgtgaactttttgacactggg

SEQ ID NO: 1228169 - DNA, 22 bp, Artificial Sequence
  chemically synthesized
tgttgtgaactttttgacactg

SEQ ID NO: 1228170 - DNA, 22 bp, Artificial Sequence
  chemically synthesized
ctgttgtgaactttttgacact

SEQ ID NO: 1228171 - DNA, 22 bp, Artificial Sequence
  chemically synthesized
cccccccagtgtcaaaaagttc

SEQ ID NO: 1228172 - DNA, 22 bp, Artificial Sequence
  chemically synthesized
tgtgaccttctgttgtgaactt

SEQ ID NO: 1228173 - DNA, 22 bp, Artificial Sequence
  chemically synthesized
ttatgtgaccttctgttgtgaa

SEQ ID NO: 1228174 - DNA, 22 bp, Artificial Sequence
  chemically synthesized
attatgtgaccttctgttgtga

SEQ ID NO: 1228175 - DNA, 22 bp, Artificial Sequence
  chemically synthesized
tattatgtgaccttctgttgtg

SEQ ID NO: 1228176 - DNA, 22 bp, Artificial Sequence
  chemically synthesized
ttattatgtgaccttctgttgt

SEQ ID NO: 1228177 - DNA, 22 bp, Artificial Sequence
  chemically synthesized
tttattatgtgaccttctgttg

SEQ ID NO: 1228178 - DNA, 22 bp, Artificial Sequence
  chemically synthesized
ttttattatgtgaccttctgtt

SEQ ID NO: 1228179 - DNA, 22 bp, Artificial Sequence
  chemically synthesized
acaacagaaggtcacataataa

SEQ ID NO: 1228180 - DNA, 22 bp, Artificial Sequence
  chemically synthesized
atggtagatacttttttattat

SEQ ID NO: 1228181 - DNA, 22 bp, Artificial Sequence
  chemically synthesized
gagcctaatggtagatactttt

SEQ ID NO: 1228182 - DNA, 22 bp, Artificial Sequence
  chemically synthesized
ctagagcctaatggtagatact

SEQ ID NO: 1228183 - DNA, 22 bp, Artificial Sequence
  chemically synthesized
ccattaggctctagcaattcta

SEQ ID NO: 1228184 - DNA, 22 bp, Artificial Sequence
  chemically synthesized
taaacatagaggtagaattgct

SEQ ID NO: 1228185 - DNA, 22 bp, Artificial Sequence
  chemically synthesized
gttataaacatagaggtagaat

SEQ ID NO: 1228186 - DNA, 22 bp, Artificial Sequence
  chemically synthesized
ggttataaacatagaggtagaa

SEQ ID NO: 1228187 - DNA, 22 bp, Artificial Sequence
  chemically synthesized
ggctctagcaattctacctcta

SEQ ID NO: 1228188 - DNA, 22 bp, Artificial Sequence
  chemically synthesized
tggttataaacatagaggtaga

SEQ ID NO: 1228189 - DNA, 22 bp, Artificial Sequence
  chemically synthesized
ttttggttataaacatagaggt

SEQ ID NO: 1228190 - DNA, 22 bp, Artificial Sequence
  chemically synthesized
tagcaattctacctctatgttt

SEQ ID NO: 1228191 - DNA, 22 bp, Artificial Sequence
  chemically synthesized
gcaattctacctctatgtttat

SEQ ID NO: 1228192 - DNA, 22 bp, Artificial Sequence
  chemically synthesized
attattttggttataaacatag

SEQ ID NO: 1228193 - DNA, 22 bp, Artificial Sequence
  chemically synthesized
aattattttggttataaacata

SEQ ID NO: 1228194 - DNA, 22 bp, Artificial Sequence
  chemically synthesized
taattattttggttataaacat

SEQ ID NO: 1228195 - DNA, 22 bp, Artificial Sequence
  chemically synthesized
ttaattattttggttataaaca

SEQ ID NO: 1228196 - DNA, 22 bp, Artificial Sequence
  chemically synthesized
tttttaattattttggttataa

SEQ ID NO: 1228197 - DNA, 22 bp, Artificial Sequence
  chemically synthesized
tacctctatgtttataaccaaa

SEQ ID NO: 1228198 - DNA, 22 bp, Artificial Sequence
  chemically synthesized
tgtttttaattattttggttat

SEQ ID NO: 1228199 - DNA, 22 bp, Artificial Sequence
  chemically synthesized
cctctatgtttataaccaaaat

SEQ ID NO: 1228200 - DNA, 22 bp, Artificial Sequence
  chemically synthesized
tatgtttataaccaaaataatt

SEQ ID NO: 1228201 - DNA, 22 bp, Artificial Sequence
  chemically synthesized
atctctgtttttaattattttg

SEQ ID NO: 1228202 - DNA, 22 bp, Artificial Sequence
  chemically synthesized
aatctctgtttttaattatttt

SEQ ID NO: 1228203 - DNA, 22 bp, Artificial Sequence
  chemically synthesized
tgtttataaccaaaataattaa

SEQ ID NO: 1228204 - DNA, 22 bp, Artificial Sequence
  chemically synthesized
ataaccaaaataattaaaaaca

SEQ ID NO: 1228205 - DNA, 22 bp, Artificial Sequence
  chemically synthesized
taaccaaaataattaaaaacag

SEQ ID NO: 1228206 - DNA, 22 bp, Artificial Sequence
  chemically synthesized
ccaatatcttaatctctgtttt

SEQ ID NO: 1228207 - DNA, 22 bp, Artificial Sequence
  chemically synthesized
gtctaccaatatcttaatctct

SEQ ID NO: 1228208 - DNA, 22 bp, Artificial Sequence
  chemically synthesized
aaaacagagattaagatattgg

SEQ ID NO: 1228209 - DNA, 22 bp, Artificial Sequence
  chemically synthesized
tgataattggtctaccaatatc

SEQ ID NO: 1228210 - DNA, 22 bp, Artificial Sequence
  chemically synthesized
ctatgataattggtctaccaat

SEQ ID NO: 1228211 - DNA, 22 bp, Artificial Sequence
  chemically synthesized
agatattggtagaccaattatc

SEQ ID NO: 1228212 - DNA, 22 bp, Artificial Sequence
  chemically synthesized
tgaataatgttactatgataat

SEQ ID NO: 1228213 - DNA, 22 bp, Artificial Sequence
  chemically synthesized
ttgtgaataatgttactatgat

SEQ ID NO: 1228214 - DNA, 22 bp, Artificial Sequence
  chemically synthesized
gtagaccaattatcatagtaac

SEQ ID NO: 1228215 - DNA, 22 bp, Artificial Sequence
  chemically synthesized
gctattgtgaataatgttacta

SEQ ID NO: 1228216 - DNA, 22 bp, Artificial Sequence
  chemically synthesized
ggctattgtgaataatgttact

SEQ ID NO: 1228217 - DNA, 22 bp, Artificial Sequence
  chemically synthesized
tggctattgtgaataatgttac

SEQ ID NO: 1228218 - DNA, 22 bp, Artificial Sequence
  chemically synthesized
acattttggctattgtgaataa

SEQ ID NO: 1228219 - DNA, 22 bp, Artificial Sequence
  chemically synthesized
tcatagtaacattattcacaat

SEQ ID NO: 1228220 - DNA, 22 bp, Artificial Sequence
  chemically synthesized
tcacattttggctattgtgaat

SEQ ID NO: 1228221 - DNA, 22 bp, Artificial Sequence
  chemically synthesized
ggtgttctcacattttggctat

SEQ ID NO: 1228222 - DNA, 22 bp, Artificial Sequence
  chemically synthesized
gggtgttctcacattttggcta

SEQ ID NO: 1228223 - DNA, 22 bp, Artificial Sequence
  chemically synthesized
ttcacaatagccaaaatgtgag

SEQ ID NO: 1228224 - DNA, 22 bp, Artificial Sequence
  chemically synthesized
acaatagccaaaatgtgagaac

SEQ ID NO: 1228225 - DNA, 22 bp, Artificial Sequence
  chemically synthesized
tagatggacatttgggtgttct

SEQ ID NO: 1228226 - DNA, 22 bp, Artificial Sequence
  chemically synthesized
tctgtagatggacatttgggtg

SEQ ID NO: 1228227 - DNA, 22 bp, Artificial Sequence
  chemically synthesized
atctgtagatggacatttgggt

SEQ ID NO: 1228228 - DNA, 22 bp, Artificial Sequence
  chemically synthesized
tccatttatctgtagatggaca

SEQ ID NO: 1228229 - DNA, 22 bp, Artificial Sequence
  chemically synthesized
atccatttatctgtagatggac

SEQ ID NO: 1228230 - DNA, 22 bp, Artificial Sequence
  chemically synthesized
tttatccatttatctgtagatg

SEQ ID NO: 1228231 - DNA, 22 bp, Artificial Sequence
  chemically synthesized
gtttatccatttatctgtagat

SEQ ID NO: 1228232 - DNA, 22 bp, Artificial Sequence
  chemically synthesized
tgtttatccatttatctgtaga

SEQ ID NO: 1228233 - DNA, 22 bp, Artificial Sequence
  chemically synthesized
cagataaatggataaacaaaat

SEQ ID NO: 1228234 - DNA, 22 bp, Artificial Sequence
  chemically synthesized
tatgtacataccacattttgtt

SEQ ID NO: 1228235 - DNA, 22 bp, Artificial Sequence
  chemically synthesized
cgttgtatgtacataccacatt

SEQ ID NO: 1228236 - DNA, 22 bp, Artificial Sequence
  chemically synthesized
aaaatattccgttgtatgtaca

SEQ ID NO: 1228237 - DNA, 22 bp, Artificial Sequence
  chemically synthesized
aggctgaaaatattccgttgta

SEQ ID NO: 1228238 - DNA, 22 bp, Artificial Sequence
  chemically synthesized
aaggctgaaaatattccgttgt

SEQ ID NO: 1228239 - DNA, 22 bp, Artificial Sequence
  chemically synthesized
taaggctgaaaatattccgttg

SEQ ID NO: 1228240 - DNA, 22 bp, Artificial Sequence
  chemically synthesized
ttaaggctgaaaatattccgtt

SEQ ID NO: 1228241 - DNA, 22 bp, Artificial Sequence
  chemically synthesized
tttaaggctgaaaatattccgt

SEQ ID NO: 1228242 - DNA, 22 bp, Artificial Sequence
  chemically synthesized
ctttttaaggctgaaaatattc

SEQ ID NO: 1228243 - DNA, 22 bp, Artificial Sequence
  chemically synthesized
attcctttttaaggctgaaaat

SEQ ID NO: 1228244 - DNA, 22 bp, Artificial Sequence
  chemically synthesized
cattcctttttaaggctgaaaa

SEQ ID NO: 1228245 - DNA, 22 bp, Artificial Sequence
  chemically synthesized
tatcagaatttcattccttttt

SEQ ID NO: 1228246 - DNA, 22 bp, Artificial Sequence
  chemically synthesized
gtatcagaatttcattcctttt

SEQ ID NO: 1228247 - DNA, 22 bp, Artificial Sequence
  chemically synthesized
tcagccttaaaaaggaatgaaa

SEQ ID NO: 1228248 - DNA, 22 bp, Artificial Sequence
  chemically synthesized
cagccttaaaaaggaatgaaat

SEQ ID NO: 1228249 - DNA, 22 bp, Artificial Sequence
  chemically synthesized
agccttaaaaaggaatgaaatt

SEQ ID NO: 1228250 - DNA, 22 bp, Artificial Sequence
  chemically synthesized
tagtttgtatcagaatttcatt

SEQ ID NO: 1228251 - DNA, 22 bp, Artificial Sequence
  chemically synthesized
aaaaaggaatgaaattctgata

SEQ ID NO: 1228252 - DNA, 22 bp, Artificial Sequence
  chemically synthesized
tgttgtagtttgtatcagaatt

SEQ ID NO: 1228253 - DNA, 22 bp, Artificial Sequence
  chemically synthesized
aaaaggaatgaaattctgatac

SEQ ID NO: 1228254 - DNA, 22 bp, Artificial Sequence
  chemically synthesized
atgttgtagtttgtatcagaat

SEQ ID NO: 1228255 - DNA, 22 bp, Artificial Sequence
  chemically synthesized
atttatgttgtagtttgtatca

SEQ ID NO: 1228256 - DNA, 22 bp, Artificial Sequence
  chemically synthesized
caaggttcatttatgttgtagt

SEQ ID NO: 1228257 - DNA, 22 bp, Artificial Sequence
  chemically synthesized
ccaaggttcatttatgttgtag

SEQ ID NO: 1228258 - DNA, 22 bp, Artificial Sequence
  chemically synthesized
tgatacaaactacaacataaat

SEQ ID NO: 1228259 - DNA, 22 bp, Artificial Sequence
  chemically synthesized
atacaaactacaacataaatga

SEQ ID NO: 1228260 - DNA, 22 bp, Artificial Sequence
  chemically synthesized
gcatatgtttccaaggttcatt

SEQ ID NO: 1228261 - DNA, 22 bp, Artificial Sequence
  chemically synthesized
agcatatgtttccaaggttcat

SEQ ID NO: 1228262 - DNA, 22 bp, Artificial Sequence
  chemically synthesized
caacataaatgaaccttggaaa

SEQ ID NO: 1228263 - DNA, 22 bp, Artificial Sequence
  chemically synthesized
acttagcatatgtttccaaggt

SEQ ID NO: 1228264 - DNA, 22 bp, Artificial Sequence
  chemically synthesized
cacttagcatatgtttccaagg

SEQ ID NO: 1228265 - DNA, 22 bp, Artificial Sequence
  chemically synthesized
tttcacttagcatatgtttcca

SEQ ID NO: 1228266 - DNA, 22 bp, Artificial Sequence
  chemically synthesized
atttcacttagcatatgtttcc

SEQ ID NO: 1228267 - DNA, 22 bp, Artificial Sequence
  chemically synthesized
cttatttcacttagcatatgtt

SEQ ID NO: 1228268 - DNA, 22 bp, Artificial Sequence
  chemically synthesized
gcttatttcacttagcatatgt

SEQ ID NO: 1228269 - DNA, 22 bp, Artificial Sequence
  chemically synthesized
tgtcttgcttatttcacttagc

SEQ ID NO: 1228270 - DNA, 22 bp, Artificial Sequence
  chemically synthesized
atgtcttgcttatttcacttag

SEQ ID NO: 1228271 - DNA, 22 bp, Artificial Sequence
  chemically synthesized
ggaaacatatgctaagtgaaat

SEQ ID NO: 1228272 - DNA, 22 bp, Artificial Sequence
  chemically synthesized
tatgtcttgcttatttcactta

SEQ ID NO: 1228273 - DNA, 22 bp, Artificial Sequence
  chemically synthesized
gaaacatatgctaagtgaaata

SEQ ID NO: 1228274 - DNA, 22 bp, Artificial Sequence
  chemically synthesized
tcattttatgtcttgcttattt

SEQ ID NO: 1228275 - DNA, 22 bp, Artificial Sequence
  chemically synthesized
gtcattttatgtcttgcttatt

SEQ ID NO: 1228276 - DNA, 22 bp, Artificial Sequence
  chemically synthesized
agtgaaataagcaagacataaa

SEQ ID NO: 1228277 - DNA, 22 bp, Artificial Sequence
  chemically synthesized
atataagtagaatcatacaata

SEQ ID NO: 1228278 - DNA, 22 bp, Artificial Sequence
  chemically synthesized
ggtacctcatataagtagaatc

SEQ ID NO: 1228279 - DNA, 22 bp, Artificial Sequence
  chemically synthesized
aggtacctcatataagtagaat

SEQ ID NO: 1228280 - DNA, 22 bp, Artificial Sequence
  chemically synthesized
taggtacctcatataagtagaa

SEQ ID NO: 1228281 - DNA, 22 bp, Artificial Sequence
  chemically synthesized
ttttaggtacctcatataagta

SEQ ID NO: 1228282 - DNA, 22 bp, Artificial Sequence
  chemically synthesized
tatgattctacttatatgaggt

SEQ ID NO: 1228283 - DNA, 22 bp, Artificial Sequence
  chemically synthesized
gctattttaggtacctcatata

SEQ ID NO: 1228284 - DNA, 22 bp, Artificial Sequence
  chemically synthesized
ggctattttaggtacctcatat

SEQ ID NO: 1228285 - DNA, 22 bp, Artificial Sequence
  chemically synthesized
tacttatatgaggtacctaaaa

SEQ ID NO: 1228286 - DNA, 22 bp, Artificial Sequence
  chemically synthesized
tgaatttggctattttaggtac

SEQ ID NO: 1228287 - DNA, 22 bp, Artificial Sequence
  chemically synthesized
cttatatgaggtacctaaaata

SEQ ID NO: 1228288 - DNA, 22 bp, Artificial Sequence
  chemically synthesized
tatgaatttggctattttaggt

SEQ ID NO: 1228289 - DNA, 22 bp, Artificial Sequence
  chemically synthesized
tctatgaatttggctattttag

SEQ ID NO: 1228290 - DNA, 22 bp, Artificial Sequence
  chemically synthesized
atatgaggtacctaaaatagcc

SEQ ID NO: 1228291 - DNA, 22 bp, Artificial Sequence
  chemically synthesized
ctctatgaatttggctatttta

SEQ ID NO: 1228292 - DNA, 22 bp, Artificial Sequence
  chemically synthesized
tatgaggtacctaaaatagcca

SEQ ID NO: 1228293 - DNA, 22 bp, Artificial Sequence
  chemically synthesized
tctctatgaatttggctatttt

SEQ ID NO: 1228294 - DNA, 22 bp, Artificial Sequence
  chemically synthesized
ttctctatgaatttggctattt

SEQ ID NO: 1228295 - DNA, 22 bp, Artificial Sequence
  chemically synthesized
tttctctatgaatttggctatt

SEQ ID NO: 1228296 - DNA, 22 bp, Artificial Sequence
  chemically synthesized
cattttttctctatgaatttgg

SEQ ID NO: 1228297 - DNA, 22 bp, Artificial Sequence
  chemically synthesized
ccattttttctctatgaatttg

SEQ ID NO: 1228298 - DNA, 22 bp, Artificial Sequence
  chemically synthesized
aaatagccaaattcatagagaa

SEQ ID NO: 1228299 - DNA, 22 bp, Artificial Sequence
  chemically synthesized
ataacttccattttttctctat

SEQ ID NO: 1228300 - DNA, 22 bp, Artificial Sequence
  chemically synthesized
aataacttccattttttctcta

SEQ ID NO: 1228301 - DNA, 22 bp, Artificial Sequence
  chemically synthesized
taataacttccattttttctct

SEQ ID NO: 1228302 - DNA, 22 bp, Artificial Sequence
  chemically synthesized
gcctttaataacttccattttt

SEQ ID NO: 1228303 - DNA, 22 bp, Artificial Sequence
  chemically synthesized
atagagaaaaaatggaagttat

SEQ ID NO: 1228304 - DNA, 22 bp, Artificial Sequence
  chemically synthesized
ccctagcctttaataacttcca

SEQ ID NO: 1228305 - DNA, 22 bp, Artificial Sequence
  chemically synthesized
acctcccctagcctttaataac

SEQ ID NO: 1228306 - DNA, 22 bp, Artificial Sequence
  chemically synthesized
cacctcccctagcctttaataa

SEQ ID NO: 1228307 - DNA, 22 bp, Artificial Sequence
  chemically synthesized
tcacctcccctagcctttaata

SEQ ID NO: 1228308 - DNA, 22 bp, Artificial Sequence
  chemically synthesized
cattttcacctcccctagcctt

SEQ ID NO: 1228309 - DNA, 22 bp, Artificial Sequence
  chemically synthesized
tccattttcacctcccctagcc

SEQ ID NO: 1228310 - DNA, 22 bp, Artificial Sequence
  chemically synthesized
ctctccattttcacctccccta

SEQ ID NO: 1228311 - DNA, 22 bp, Artificial Sequence
  chemically synthesized
ttaaaggctaggggaggtgaaa

SEQ ID NO: 1228312 - DNA, 22 bp, Artificial Sequence
  chemically synthesized
aaggctaggggaggtgaaaatg

SEQ ID NO: 1228313 - DNA, 22 bp, Artificial Sequence
  chemically synthesized
aacgattactctccattttcac

SEQ ID NO: 1228314 - DNA, 22 bp, Artificial Sequence
  chemically synthesized
attaaacgattactctccattt

SEQ ID NO: 1228315 - DNA, 22 bp, Artificial Sequence
  chemically synthesized
ggggaggtgaaaatggagagta

SEQ ID NO: 1228316 - DNA, 22 bp, Artificial Sequence
  chemically synthesized
atactgattaaacgattactct

SEQ ID NO: 1228317 - DNA, 22 bp, Artificial Sequence
  chemically synthesized
aattcatactgattaaacgatt

SEQ ID NO: 1228318 - DNA, 22 bp, Artificial Sequence
  chemically synthesized
atcatcccaagttgaattcata

SEQ ID NO: 1228319 - DNA, 22 bp, Artificial Sequence
  chemically synthesized
catcatcccaagttgaattcat

SEQ ID NO: 1228320 - DNA, 22 bp, Artificial Sequence
  chemically synthesized
aatcagtatgaattcaacttgg

SEQ ID NO: 1228321 - DNA, 22 bp, Artificial Sequence
  chemically synthesized
atcagtatgaattcaacttggg

SEQ ID NO: 1228322 - DNA, 22 bp, Artificial Sequence
  chemically synthesized
gaatgatttcatcatcccaagt

SEQ ID NO: 1228323 - DNA, 22 bp, Artificial Sequence
  chemically synthesized
tagaatgatttcatcatcccaa

SEQ ID NO: 1228324 - DNA, 22 bp, Artificial Sequence
  chemically synthesized
tccatctctagaatgatttcat

SEQ ID NO: 1228325 - DNA, 22 bp, Artificial Sequence
  chemically synthesized
aacttgggatgatgaaatcatt

SEQ ID NO: 1228326 - DNA, 22 bp, Artificial Sequence
  chemically synthesized
gggatgatgaaatcattctaga

SEQ ID NO: 1228327 - DNA, 22 bp, Artificial Sequence
  chemically synthesized
ggatgatgaaatcattctagag

SEQ ID NO: 1228328 - DNA, 22 bp, Artificial Sequence
  chemically synthesized
ggtagtcatcaccgctatccat

SEQ ID NO: 1228329 - DNA, 22 bp, Artificial Sequence
  chemically synthesized
ttgggtagtcatcaccgctatc

SEQ ID NO: 1228330 - DNA, 22 bp, Artificial Sequence
  chemically synthesized
ttgttgggtagtcatcaccgct

SEQ ID NO: 1228331 - DNA, 22 bp, Artificial Sequence
  chemically synthesized
tagagatggatagcggtgatga

SEQ ID NO: 1228332 - DNA, 22 bp, Artificial Sequence
  chemically synthesized
tgttgttgggtagtcatcaccg

SEQ ID NO: 1228333 - DNA, 22 bp, Artificial Sequence
  chemically synthesized
gagatggatagcggtgatgact

SEQ ID NO: 1228334 - DNA, 22 bp, Artificial Sequence
  chemically synthesized
ctgttgttgggtagtcatcacc

SEQ ID NO: 1228335 - DNA, 22 bp, Artificial Sequence
  chemically synthesized
agtatatttctgttgttgggta

SEQ ID NO: 1228336 - DNA, 22 bp, Artificial Sequence
  chemically synthesized
aagtatatttctgttgttgggt

SEQ ID NO: 1228337 - DNA, 22 bp, Artificial Sequence
  chemically synthesized
taagtatatttctgttgttggg

SEQ ID NO: 1228338 - DNA, 22 bp, Artificial Sequence
  chemically synthesized
agtggctttaagtatatttctg

SEQ ID NO: 1228339 - DNA, 22 bp, Artificial Sequence
  chemically synthesized
cccaacaacagaaatatactta

SEQ ID NO: 1228340 - DNA, 22 bp, Artificial Sequence
  chemically synthesized
gtgtataattcagtggctttaa

SEQ ID NO: 1228341 - DNA, 22 bp, Artificial Sequence
  chemically synthesized
agtgtataattcagtggcttta

SEQ ID NO: 1228342 - DNA, 22 bp, Artificial Sequence
  chemically synthesized
tagtgtataattcagtggcttt

SEQ ID NO: 1228343 - DNA, 22 bp, Artificial Sequence
  chemically synthesized
ttagtgtataattcagtggctt

SEQ ID NO: 1228344 - DNA, 22 bp, Artificial Sequence
  chemically synthesized
tttagtgtataattcagtggct

SEQ ID NO: 1228345 - DNA, 22 bp, Artificial Sequence
  chemically synthesized
ttttagtgtataattcagtggc

SEQ ID NO: 1228346 - DNA, 22 bp, Artificial Sequence
  chemically synthesized
tttttttagtgtataattcagt

SEQ ID NO: 1228347 - DNA, 22 bp, Artificial Sequence
  chemically synthesized
tatttttttagtgtataattca

SEQ ID NO: 1228348 - DNA, 22 bp, Artificial Sequence
  chemically synthesized
ctatttttttagtgtataattc

SEQ ID NO: 1228349 - DNA, 22 bp, Artificial Sequence
  chemically synthesized
tctatttttttagtgtataatt

SEQ ID NO: 1228350 - DNA, 22 bp, Artificial Sequence
  chemically synthesized
ttctatttttttagtgtataat

SEQ ID NO: 1228351 - DNA, 22 bp, Artificial Sequence
  chemically synthesized
aaagccactgaattatacacta

SEQ ID NO: 1228352 - DNA, 22 bp, Artificial Sequence
  chemically synthesized
tttctatttttttagtgtataa

SEQ ID NO: 1228353 - DNA, 22 bp, Artificial Sequence
  chemically synthesized
aagccactgaattatacactaa

SEQ ID NO: 1228354 - DNA, 22 bp, Artificial Sequence
  chemically synthesized
aattatacactaaaaaaataga

SEQ ID NO: 1228355 - DNA, 22 bp, Artificial Sequence
  chemically synthesized
aggtatcattttttctattttt

SEQ ID NO: 1228356 - DNA, 22 bp, Artificial Sequence
  chemically synthesized
gaggtatcattttttctatttt

SEQ ID NO: 1228357 - DNA, 22 bp, Artificial Sequence
  chemically synthesized
tacactaaaaaaatagaaaaaa

SEQ ID NO: 1228358 - DNA, 22 bp, Artificial Sequence
  chemically synthesized
aaaaaatagaaaaaatgatacc

SEQ ID NO: 1228359 - DNA, 22 bp, Artificial Sequence
  chemically synthesized
gatagggtttgaggtatcattt

SEQ ID NO: 1228360 - DNA, 22 bp, Artificial Sequence
  chemically synthesized
ccctagatagggtttgaggtat

SEQ ID NO: 1228361 - DNA, 22 bp, Artificial Sequence
  chemically synthesized
attgccctagatagggtttgag

SEQ ID NO: 1228362 - DNA, 22 bp, Artificial Sequence
  chemically synthesized
aggttcattgccctagataggg

SEQ ID NO: 1228363 - DNA, 22 bp, Artificial Sequence
  chemically synthesized
ttcaggttcattgccctagata

SEQ ID NO: 1228364 - DNA, 22 bp, Artificial Sequence
  chemically synthesized
aaaccctatctagggcaatgaa

SEQ ID NO: 1228365 - DNA, 22 bp, Artificial Sequence
  chemically synthesized
agaaatgtctattcaggttcat

SEQ ID NO: 1228366 - DNA, 22 bp, Artificial Sequence
  chemically synthesized
gagaaatgtctattcaggttca

SEQ ID NO: 1228367 - DNA, 22 bp, Artificial Sequence
  chemically synthesized
tgagaaatgtctattcaggttc

SEQ ID NO: 1228368 - DNA, 22 bp, Artificial Sequence
  chemically synthesized
tctagggcaatgaacctgaata

SEQ ID NO: 1228369 - DNA, 22 bp, Artificial Sequence
  chemically synthesized
ttgagaaatgtctattcaggtt

SEQ ID NO: 1228370 - DNA, 22 bp, Artificial Sequence
  chemically synthesized
ttttgagaaatgtctattcagg

SEQ ID NO: 1228371 - DNA, 22 bp, Artificial Sequence
  chemically synthesized
cttttgagaaatgtctattcag

SEQ ID NO: 1228372 - DNA, 22 bp, Artificial Sequence
  chemically synthesized
gggcaatgaacctgaatagaca

SEQ ID NO: 1228373 - DNA, 22 bp, Artificial Sequence
  chemically synthesized
tcttcttttgagaaatgtctat

SEQ ID NO: 1228374 - DNA, 22 bp, Artificial Sequence
  chemically synthesized
gtcttcttttgagaaatgtcta

SEQ ID NO: 1228375 - DNA, 22 bp, Artificial Sequence
  chemically synthesized
gtttgtcttcttttgagaaatg

SEQ ID NO: 1228376 - DNA, 22 bp, Artificial Sequence
  chemically synthesized
aatagacatttctcaaaagaag

SEQ ID NO: 1228377 - DNA, 22 bp, Artificial Sequence
  chemically synthesized
gccgttggtttgtcttcttttg

SEQ ID NO: 1228378 - DNA, 22 bp, Artificial Sequence
  chemically synthesized
tgtgctggccgttggtttgtct

SEQ ID NO: 1228379 - DNA, 22 bp, Artificial Sequence
  chemically synthesized
atgtgctggccgttggtttgtc

SEQ ID NO: 1228380 - DNA, 22 bp, Artificial Sequence
  chemically synthesized
ctcaaaagaagacaaaccaacg

SEQ ID NO: 1228381 - DNA, 22 bp, Artificial Sequence
  chemically synthesized
tcaaaagaagacaaaccaacgg

SEQ ID NO: 1228382 - DNA, 22 bp, Artificial Sequence
  chemically synthesized
atttatgtgctggccgttggtt

SEQ ID NO: 1228383 - DNA, 22 bp, Artificial Sequence
  chemically synthesized
aaaagaagacaaaccaacggcc

SEQ ID NO: 1228384 - DNA, 22 bp, Artificial Sequence
  chemically synthesized
catttatgtgctggccgttggt

SEQ ID NO: 1228385 - DNA, 22 bp, Artificial Sequence
  chemically synthesized
tttcatttatgtgctggccgtt

SEQ ID NO: 1228386 - DNA, 22 bp, Artificial Sequence
  chemically synthesized
aacattatttcatttatgtgct

SEQ ID NO: 1228387 - DNA, 22 bp, Artificial Sequence
  chemically synthesized
gtgatgttcaacattatttcat

SEQ ID NO: 1228388 - DNA, 22 bp, Artificial Sequence
  chemically synthesized
atgattagtgatgttcaacatt

SEQ ID NO: 1228389 - DNA, 22 bp, Artificial Sequence
  chemically synthesized
tgatgattagtgatgttcaaca

SEQ ID NO: 1228390 - DNA, 22 bp, Artificial Sequence
  chemically synthesized
tctgatgattagtgatgttcaa

SEQ ID NO: 1228391 - DNA, 22 bp, Artificial Sequence
  chemically synthesized
ctctgatgattagtgatgttca

SEQ ID NO: 1228392 - DNA, 22 bp, Artificial Sequence
  chemically synthesized
catttctctgatgattagtgat

SEQ ID NO: 1228393 - DNA, 22 bp, Artificial Sequence
  chemically synthesized
gcatttctctgatgattagtga

SEQ ID NO: 1228394 - DNA, 22 bp, Artificial Sequence
  chemically synthesized
atttgcatttctctgatgatta

SEQ ID NO: 1228395 - DNA, 22 bp, Artificial Sequence
  chemically synthesized
aatttgcatttctctgatgatt

SEQ ID NO: 1228396 - DNA, 22 bp, Artificial Sequence
  chemically synthesized
taatttgcatttctctgatgat

SEQ ID NO: 1228397 - DNA, 22 bp, Artificial Sequence
  chemically synthesized
aacatcactaatcatcagagaa

SEQ ID NO: 1228398 - DNA, 22 bp, Artificial Sequence
  chemically synthesized
tagttttaatttgcatttctct

SEQ ID NO: 1228399 - DNA, 22 bp, Artificial Sequence
  chemically synthesized
attgtagttttaatttgcattt

SEQ ID NO: 1228400 - DNA, 22 bp, Artificial Sequence
  chemically synthesized
cattgtagttttaatttgcatt

SEQ ID NO: 1228401 - DNA, 22 bp, Artificial Sequence
  chemically synthesized
atcatcagagaaatgcaaatta

SEQ ID NO: 1228402 - DNA, 22 bp, Artificial Sequence
  chemically synthesized
tgtgatgtaatatttcattgta

SEQ ID NO: 1228403 - DNA, 22 bp, Artificial Sequence
  chemically synthesized
tgtgtgatgtaatatttcattg

SEQ ID NO: 1228404 - DNA, 22 bp, Artificial Sequence
  chemically synthesized
aaactacaatgaaatattacat

SEQ ID NO: 1228405 - DNA, 22 bp, Artificial Sequence
  chemically synthesized
caatgaaatattacatcacaca

SEQ ID NO: 1228406 - DNA, 22 bp, Artificial Sequence
  chemically synthesized
ataatagccattctgtgtgatg

SEQ ID NO: 1228407 - DNA, 22 bp, Artificial Sequence
  chemically synthesized
gataatagccattctgtgtgat

SEQ ID NO: 1228408 - DNA, 22 bp, Artificial Sequence
  chemically synthesized
tgataatagccattctgtgtga

SEQ ID NO: 1228409 - DNA, 22 bp, Artificial Sequence
  chemically synthesized
ttgataatagccattctgtgtg

SEQ ID NO: 1228410 - DNA, 22 bp, Artificial Sequence
  chemically synthesized
tttgataatagccattctgtgt

SEQ ID NO: 1228411 - DNA, 22 bp, Artificial Sequence
  chemically synthesized
tctttttgataatagccattct

SEQ ID NO: 1228412 - DNA, 22 bp, Artificial Sequence
  chemically synthesized
gtctttttgataatagccattc

SEQ ID NO: 1228413 - DNA, 22 bp, Artificial Sequence
  chemically synthesized
tgtctttttgataatagccatt

SEQ ID NO: 1228414 - DNA, 22 bp, Artificial Sequence
  chemically synthesized
ttgtctttttgataatagccat

SEQ ID NO: 1228415 - DNA, 22 bp, Artificial Sequence
  chemically synthesized
catcacacagaatggctattat

SEQ ID NO: 1228416 - DNA, 22 bp, Artificial Sequence
  chemically synthesized
ccttttgtctttttgataatag

SEQ ID NO: 1228417 - DNA, 22 bp, Artificial Sequence
  chemically synthesized
accttttgtctttttgataata

SEQ ID NO: 1228418 - DNA, 22 bp, Artificial Sequence
  chemically synthesized
ccacaacttaccttttgtcttt

SEQ ID NO: 1228419 - DNA, 22 bp, Artificial Sequence
  chemically synthesized
gccacaacttaccttttgtctt

SEQ ID NO: 1228420 - DNA, 22 bp, Artificial Sequence
  chemically synthesized
tgccacaacttaccttttgtct

SEQ ID NO: 1228421 - DNA, 22 bp, Artificial Sequence
  chemically synthesized
ttatcaaaaagacaaaaggtaa

SEQ ID NO: 1228422 - DNA, 22 bp, Artificial Sequence
  chemically synthesized
tcaaaaagacaaaaggtaagtt

SEQ ID NO: 1228423 - DNA, 22 bp, Artificial Sequence
  chemically synthesized
cacatctttgccacaacttacc

SEQ ID NO: 1228424 - DNA, 22 bp, Artificial Sequence
  chemically synthesized
tccacatctttgccacaactta

SEQ ID NO: 1228425 - DNA, 22 bp, Artificial Sequence
  chemically synthesized
ctccacatctttgccacaactt

SEQ ID NO: 1228426 - DNA, 22 bp, Artificial Sequence
  chemically synthesized
tctccacatctttgccacaact

SEQ ID NO: 1228427 - DNA, 22 bp, Artificial Sequence
  chemically synthesized
ttctccacatctttgccacaac

SEQ ID NO: 1228428 - DNA, 22 bp, Artificial Sequence
  chemically synthesized
tttctccacatctttgccacaa

SEQ ID NO: 1228429 - DNA, 22 bp, Artificial Sequence
  chemically synthesized
ctttttctccacatctttgcca

SEQ ID NO: 1228430 - DNA, 22 bp, Artificial Sequence
  chemically synthesized
tgcaaagattcctttttctcca

SEQ ID NO: 1228431 - DNA, 22 bp, Artificial Sequence
  chemically synthesized
tggcaaagatgtggagaaaaag

SEQ ID NO: 1228432 - DNA, 22 bp, Artificial Sequence
  chemically synthesized
caccaacactgtgcaaagattc

SEQ ID NO: 1228433 - DNA, 22 bp, Artificial Sequence
  chemically synthesized
ccaccaacactgtgcaaagatt

SEQ ID NO: 1228434 - DNA, 22 bp, Artificial Sequence
  chemically synthesized
catttccaccaacactgtgcaa

SEQ ID NO: 1228435 - DNA, 22 bp, Artificial Sequence
  chemically synthesized
acatttccaccaacactgtgca

SEQ ID NO: 1228436 - DNA, 22 bp, Artificial Sequence
  chemically synthesized
caataatttacatttccaccaa

SEQ ID NO: 1228437 - DNA, 22 bp, Artificial Sequence
  chemically synthesized
tgcacagtgttggtggaaatgt

SEQ ID NO: 1228438 - DNA, 22 bp, Artificial Sequence
  chemically synthesized
gcacagtgttggtggaaatgta

SEQ ID NO: 1228439 - DNA, 22 bp, Artificial Sequence
  chemically synthesized
cacagtgttggtggaaatgtaa

SEQ ID NO: 1228440 - DNA, 22 bp, Artificial Sequence
  chemically synthesized
atgactacaataatttacattt

SEQ ID NO: 1228441 - DNA, 22 bp, Artificial Sequence
  chemically synthesized
catgactacaataatttacatt

SEQ ID NO: 1228442 - DNA, 22 bp, Artificial Sequence
  chemically synthesized
tcatgactacaataatttacat

SEQ ID NO: 1228443 - DNA, 22 bp, Artificial Sequence
  chemically synthesized
ttcatgactacaataatttaca

SEQ ID NO: 1228444 - DNA, 22 bp, Artificial Sequence
  chemically synthesized
tttttcatgactacaataattt

SEQ ID NO: 1228445 - DNA, 22 bp, Artificial Sequence
  chemically synthesized
gtggaaatgtaaattattgtag

SEQ ID NO: 1228446 - DNA, 22 bp, Artificial Sequence
  chemically synthesized
catactgtttttcatgactaca

SEQ ID NO: 1228447 - DNA, 22 bp, Artificial Sequence
  chemically synthesized
agaaacctccatactgtttttc

SEQ ID NO: 1228448 - DNA, 22 bp, Artificial Sequence
  chemically synthesized
gagaaacctccatactgttttt

SEQ ID NO: 1228449 - DNA, 22 bp, Artificial Sequence
  chemically synthesized
ttgtagtcatgaaaaacagtat

SEQ ID NO: 1228450 - DNA, 22 bp, Artificial Sequence
  chemically synthesized
tgagaaacctccatactgtttt

SEQ ID NO: 1228451 - DNA, 22 bp, Artificial Sequence
  chemically synthesized
ttgagaaacctccatactgttt

SEQ ID NO: 1228452 - DNA, 22 bp, Artificial Sequence
  chemically synthesized
tttgagaaacctccatactgtt

SEQ ID NO: 1228453 - DNA, 22 bp, Artificial Sequence
  chemically synthesized
tagtcatgaaaaacagtatgga

SEQ ID NO: 1228454 - DNA, 22 bp, Artificial Sequence
  chemically synthesized
taattttttgagaaacctccat

SEQ ID NO: 1228455 - DNA, 22 bp, Artificial Sequence
  chemically synthesized
gtaattttttgagaaacctcca

SEQ ID NO: 1228456 - DNA, 22 bp, Artificial Sequence
  chemically synthesized
tttgtaattttttgagaaacct

SEQ ID NO: 1228457 - DNA, 22 bp, Artificial Sequence
  chemically synthesized
atttgtaattttttgagaaacc

SEQ ID NO: 1228458 - DNA, 22 bp, Artificial Sequence
  chemically synthesized
tatttgtaattttttgagaaac

SEQ ID NO: 1228459 - DNA, 22 bp, Artificial Sequence
  chemically synthesized
tatggtagttttatttgtaatt

SEQ ID NO: 1228460 - DNA, 22 bp, Artificial Sequence
  chemically synthesized
ctcaaaaaattacaaataaaac

SEQ ID NO: 1228461 - DNA, 22 bp, Artificial Sequence
  chemically synthesized
aattatatggtagttttatttg

SEQ ID NO: 1228462 - DNA, 22 bp, Artificial Sequence
  chemically synthesized
tcaaaaaattacaaataaaact

SEQ ID NO: 1228463 - DNA, 22 bp, Artificial Sequence
  chemically synthesized
aaaaaattacaaataaaactac

SEQ ID NO: 1228464 - DNA, 22 bp, Artificial Sequence
  chemically synthesized
ctgaattatatggtagttttat

SEQ ID NO: 1228465 - DNA, 22 bp, Artificial Sequence
  chemically synthesized
caaataaaactaccatataatt

SEQ ID NO: 1228466 - DNA, 22 bp, Artificial Sequence
  chemically synthesized
ccatataattcaggaattctac

SEQ ID NO: 1228467 - DNA, 22 bp, Artificial Sequence
  chemically synthesized
gaatatatacccagcagtagaa

SEQ ID NO: 1228468 - DNA, 22 bp, Artificial Sequence
  chemically synthesized
ggaatatatacccagcagtaga

SEQ ID NO: 1228469 - DNA, 22 bp, Artificial Sequence
  chemically synthesized
tggaatatatacccagcagtag

SEQ ID NO: 1228470 - DNA, 22 bp, Artificial Sequence
  chemically synthesized
ctttggaatatatacccagcag

SEQ ID NO: 1228471 - DNA, 22 bp, Artificial Sequence
  chemically synthesized
cctttggaatatatacccagca

SEQ ID NO: 1228472 - DNA, 22 bp, Artificial Sequence
  chemically synthesized
aggaattctactgctgggtata

SEQ ID NO: 1228473 - DNA, 22 bp, Artificial Sequence
  chemically synthesized
tttcctttggaatatataccca

SEQ ID NO: 1228474 - DNA, 22 bp, Artificial Sequence
  chemically synthesized
gtttcctttggaatatataccc

SEQ ID NO: 1228475 - DNA, 22 bp, Artificial Sequence
  chemically synthesized
atttgtttcctttggaatatat

SEQ ID NO: 1228476 - DNA, 22 bp, Artificial Sequence
  chemically synthesized
tactgctgggtatatattccaa

SEQ ID NO: 1228477 - DNA, 22 bp, Artificial Sequence
  chemically synthesized
ctgctgggtatatattccaaag

SEQ ID NO: 1228478 - DNA, 22 bp, Artificial Sequence
  chemically synthesized
ctgggtatatattccaaaggaa

SEQ ID NO: 1228479 - DNA, 22 bp, Artificial Sequence
  chemically synthesized
acatattgatttgtttcctttg

SEQ ID NO: 1228480 - DNA, 22 bp, Artificial Sequence
  chemically synthesized
ggtatatattccaaaggaaaca

SEQ ID NO: 1228481 - DNA, 22 bp, Artificial Sequence
  chemically synthesized
gacatattgatttgtttccttt

SEQ ID NO: 1228482 - DNA, 22 bp, Artificial Sequence
  chemically synthesized
tgacatattgatttgtttcctt

SEQ ID NO: 1228483 - DNA, 22 bp, Artificial Sequence
  chemically synthesized
tttgacatattgatttgtttcc

SEQ ID NO: 1228484 - DNA, 22 bp, Artificial Sequence
  chemically synthesized
ctttgacatattgatttgtttc

SEQ ID NO: 1228485 - DNA, 22 bp, Artificial Sequence
  chemically synthesized
tttctttgacatattgatttgt

SEQ ID NO: 1228486 - DNA, 22 bp, Artificial Sequence
  chemically synthesized
caaaggaaacaaatcaatatgt

SEQ ID NO: 1228487 - DNA, 22 bp, Artificial Sequence
  chemically synthesized
aagtgcagttatttctttgaca

SEQ ID NO: 1228488 - DNA, 22 bp, Artificial Sequence
  chemically synthesized
caatatacattgaagtgcagtt

SEQ ID NO: 1228489 - DNA, 22 bp, Artificial Sequence
  chemically synthesized
agtagcactacaatatacattg

SEQ ID NO: 1228490 - DNA, 22 bp, Artificial Sequence
  chemically synthesized
gagtagcactacaatatacatt

SEQ ID NO: 1228491 - DNA, 22 bp, Artificial Sequence
  chemically synthesized
tgagtagcactacaatatacat

SEQ ID NO: 1228492 - DNA, 22 bp, Artificial Sequence
  chemically synthesized
ttttgagtagcactacaatata

SEQ ID NO: 1228493 - DNA, 22 bp, Artificial Sequence
  chemically synthesized
cacttcaatgtatattgtagtg

SEQ ID NO: 1228494 - DNA, 22 bp, Artificial Sequence
  chemically synthesized
gctattttgagtagcactacaa

SEQ ID NO: 1228495 - DNA, 22 bp, Artificial Sequence
  chemically synthesized
cgctattttgagtagcactaca

SEQ ID NO: 1228496 - DNA, 22 bp, Artificial Sequence
  chemically synthesized
caatgtatattgtagtgctact

SEQ ID NO: 1228497 - DNA, 22 bp, Artificial Sequence
  chemically synthesized
aatgtatattgtagtgctactc

SEQ ID NO: 1228498 - DNA, 22 bp, Artificial Sequence
  chemically synthesized
tcttcgctattttgagtagcac

SEQ ID NO: 1228499 - DNA, 22 bp, Artificial Sequence
  chemically synthesized
ctatcttcgctattttgagtag

SEQ ID NO: 1228500 - DNA, 22 bp, Artificial Sequence
  chemically synthesized
cctatcttcgctattttgagta

SEQ ID NO: 1228501 - DNA, 22 bp, Artificial Sequence
  chemically synthesized
atttcctatcttcgctattttg

SEQ ID NO: 1228502 - DNA, 22 bp, Artificial Sequence
  chemically synthesized
tagtgctactcaaaatagcgaa

SEQ ID NO: 1228503 - DNA, 22 bp, Artificial Sequence
  chemically synthesized
agttgatttcctatcttcgcta

SEQ ID NO: 1228504 - DNA, 22 bp, Artificial Sequence
  chemically synthesized
aagttgatttcctatcttcgct

SEQ ID NO: 1228505 - DNA, 22 bp, Artificial Sequence
  chemically synthesized
ctcaaaatagcgaagataggaa

SEQ ID NO: 1228506 - DNA, 22 bp, Artificial Sequence
  chemically synthesized
aaaatagcgaagataggaaatc

SEQ ID NO: 1228507 - DNA, 22 bp, Artificial Sequence
  chemically synthesized
atggacacttaagttgatttcc

SEQ ID NO: 1228508 - DNA, 22 bp, Artificial Sequence
  chemically synthesized
ctgatggacacttaagttgatt

SEQ ID NO: 1228509 - DNA, 22 bp, Artificial Sequence
  chemically synthesized
atctactgatggacacttaagt

SEQ ID NO: 1228510 - DNA, 22 bp, Artificial Sequence
  chemically synthesized
catctactgatggacacttaag

SEQ ID NO: 1228511 - DNA, 22 bp, Artificial Sequence
  chemically synthesized
tcatctactgatggacacttaa

SEQ ID NO: 1228512 - DNA, 22 bp, Artificial Sequence
  chemically synthesized
tttcatctactgatggacactt

SEQ ID NO: 1228513 - DNA, 22 bp, Artificial Sequence
  chemically synthesized
ttctttcatctactgatggaca

SEQ ID NO: 1228514 - DNA, 22 bp, Artificial Sequence
  chemically synthesized
attctttcatctactgatggac

SEQ ID NO: 1228515 - DNA, 22 bp, Artificial Sequence
  chemically synthesized
tattctttcatctactgatgga

SEQ ID NO: 1228516 - DNA, 22 bp, Artificial Sequence
  chemically synthesized
tttattctttcatctactgatg

SEQ ID NO: 1228517 - DNA, 22 bp, Artificial Sequence
  chemically synthesized
ctttattctttcatctactgat

SEQ ID NO: 1228518 - DNA, 22 bp, Artificial Sequence
  chemically synthesized
tctttattctttcatctactga

SEQ ID NO: 1228519 - DNA, 22 bp, Artificial Sequence
  chemically synthesized
aagtgtccatcagtagatgaaa

SEQ ID NO: 1228520 - DNA, 22 bp, Artificial Sequence
  chemically synthesized
agtgtccatcagtagatgaaag

SEQ ID NO: 1228521 - DNA, 22 bp, Artificial Sequence
  chemically synthesized
cattttctttattctttcatct

SEQ ID NO: 1228522 - DNA, 22 bp, Artificial Sequence
  chemically synthesized
tatacctgcattttctttattc

SEQ ID NO: 1228523 - DNA, 22 bp, Artificial Sequence
  chemically synthesized
cagtgtgtgtgtgtgtaggtct

SEQ ID NO: 1228524 - DNA, 22 bp, Artificial Sequence
  chemically synthesized
agtccgagtagtattccagtgt

SEQ ID NO: 1228525 - DNA, 22 bp, Artificial Sequence
  chemically synthesized
aagtccgagtagtattccagtg

SEQ ID NO: 1228526 - DNA, 22 bp, Artificial Sequence
  chemically synthesized
taagtccgagtagtattccagt

SEQ ID NO: 1228527 - DNA, 22 bp, Artificial Sequence
  chemically synthesized
cacacacacacactggaatact

SEQ ID NO: 1228528 - DNA, 22 bp, Artificial Sequence
  chemically synthesized
ttaagtccgagtagtattccag

SEQ ID NO: 1228529 - DNA, 22 bp, Artificial Sequence
  chemically synthesized
tttaagtccgagtagtattcca

SEQ ID NO: 1228530 - DNA, 22 bp, Artificial Sequence
  chemically synthesized
ctttttaagtccgagtagtatt

SEQ ID NO: 1228531 - DNA, 22 bp, Artificial Sequence
  chemically synthesized
tgctttttaagtccgagtagta

SEQ ID NO: 1228532 - DNA, 22 bp, Artificial Sequence
  chemically synthesized
tctgctttttaagtccgagtag

SEQ ID NO: 1228533 - DNA, 22 bp, Artificial Sequence
  chemically synthesized
gaatactactcggacttaaaaa

SEQ ID NO: 1228534 - DNA, 22 bp, Artificial Sequence
  chemically synthesized
ctcggacttaaaaagcagagaa

SEQ ID NO: 1228535 - DNA, 22 bp, Artificial Sequence
  chemically synthesized
caaatgagaggattctctgctt

SEQ ID NO: 1228536 - DNA, 22 bp, Artificial Sequence
  chemically synthesized
ggacttaaaaagcagagaatcc

SEQ ID NO: 1228537 - DNA, 22 bp, Artificial Sequence
  chemically synthesized
attgcaaatgagaggattctct

SEQ ID NO: 1228538 - DNA, 22 bp, Artificial Sequence
  chemically synthesized
cattgcaaatgagaggattctc

SEQ ID NO: 1228539 - DNA, 22 bp, Artificial Sequence
  chemically synthesized
aaaaagcagagaatcctctcat

SEQ ID NO: 1228540 - DNA, 22 bp, Artificial Sequence
  chemically synthesized
atttcattgcaaatgagaggat

SEQ ID NO: 1228541 - DNA, 22 bp, Artificial Sequence
  chemically synthesized
aaaagcagagaatcctctcatt

SEQ ID NO: 1228542 - DNA, 22 bp, Artificial Sequence
  chemically synthesized
attaatttcattgcaaatgaga

SEQ ID NO: 1228543 - DNA, 22 bp, Artificial Sequence
  chemically synthesized
gattcattaatttcattgcaaa

SEQ ID NO: 1228544 - DNA, 22 bp, Artificial Sequence
  chemically synthesized
tagattcattaatttcattgca

SEQ ID NO: 1228545 - DNA, 22 bp, Artificial Sequence
  chemically synthesized
tcatttgcaatgaaattaatga

SEQ ID NO: 1228546 - DNA, 22 bp, Artificial Sequence
  chemically synthesized
atttgcaatgaaattaatgaat

SEQ ID NO: 1228547 - DNA, 22 bp, Artificial Sequence
  chemically synthesized
gcaatgaaattaatgaatctag

SEQ ID NO: 1228548 - DNA, 22 bp, Artificial Sequence
  chemically synthesized
acgtaacgtactctagattcat

SEQ ID NO: 1228549 - DNA, 22 bp, Artificial Sequence
  chemically synthesized
caatgaaattaatgaatctaga

SEQ ID NO: 1228550 - DNA, 22 bp, Artificial Sequence
  chemically synthesized
gacgtaacgtactctagattca

SEQ ID NO: 1228551 - DNA, 22 bp, Artificial Sequence
  chemically synthesized
tgtcatttgacgtaacgtactc

SEQ ID NO: 1228552 - DNA, 22 bp, Artificial Sequence
  chemically synthesized
atgtcatttgacgtaacgtact

SEQ ID NO: 1228553 - DNA, 22 bp, Artificial Sequence
  chemically synthesized
atgaatctagagtacgttacgt

SEQ ID NO: 1228554 - DNA, 22 bp, Artificial Sequence
  chemically synthesized
gcttatgtcatttgacgtaacg

SEQ ID NO: 1228555 - DNA, 22 bp, Artificial Sequence
  chemically synthesized
tgcctggcttatgtcatttgac

SEQ ID NO: 1228556 - DNA, 22 bp, Artificial Sequence
  chemically synthesized
gagtacgttacgtcaaatgaca

SEQ ID NO: 1228557 - DNA, 22 bp, Artificial Sequence
  chemically synthesized
tgtgcctggcttatgtcatttg

SEQ ID NO: 1228558 - DNA, 22 bp, Artificial Sequence
  chemically synthesized
ctgtgcctggcttatgtcattt

SEQ ID NO: 1228559 - DNA, 22 bp, Artificial Sequence
  chemically synthesized
tctgtgcctggcttatgtcatt

SEQ ID NO: 1228560 - DNA, 22 bp, Artificial Sequence
  chemically synthesized
tctttctgtgcctggcttatgt

SEQ ID NO: 1228561 - DNA, 22 bp, Artificial Sequence
  chemically synthesized
gtctttctgtgcctggcttatg

SEQ ID NO: 1228562 - DNA, 22 bp, Artificial Sequence
  chemically synthesized
cgtcaaatgacataagccaggc

SEQ ID NO: 1228563 - DNA, 22 bp, Artificial Sequence
  chemically synthesized
atatacaagtgacatgatgtaa

SEQ ID NO: 1228564 - DNA, 22 bp, Artificial Sequence
  chemically synthesized
catatacaagtgacatgatgta

SEQ ID NO: 1228565 - DNA, 22 bp, Artificial Sequence
  chemically synthesized
aaatttcatatacaagtgacat

SEQ ID NO: 1228566 - DNA, 22 bp, Artificial Sequence
  chemically synthesized
aaaatttcatatacaagtgaca

SEQ ID NO: 1228567 - DNA, 22 bp, Artificial Sequence
  chemically synthesized
taaaatttcatatacaagtgac

SEQ ID NO: 1228568 - DNA, 22 bp, Artificial Sequence
  chemically synthesized
catcatgtcacttgtatatgaa

SEQ ID NO: 1228569 - DNA, 22 bp, Artificial Sequence
  chemically synthesized
aacattttaaaatttcatatac

SEQ ID NO: 1228570 - DNA, 22 bp, Artificial Sequence
  chemically synthesized
tgagctcaacattttaaaattt

SEQ ID NO: 1228571 - DNA, 22 bp, Artificial Sequence
  chemically synthesized
tatgagctcaacattttaaaat

SEQ ID NO: 1228572 - DNA, 22 bp, Artificial Sequence
  chemically synthesized
gtatatgaaattttaaaatgtt

SEQ ID NO: 1228573 - DNA, 22 bp, Artificial Sequence
  chemically synthesized
tatatgaaattttaaaatgttg

SEQ ID NO: 1228574 - DNA, 22 bp, Artificial Sequence
  chemically synthesized
aattctatgagctcaacatttt

SEQ ID NO: 1228575 - DNA, 22 bp, Artificial Sequence
  chemically synthesized
tcaattctatgagctcaacatt

SEQ ID NO: 1228576 - DNA, 22 bp, Artificial Sequence
  chemically synthesized
ctctcaattctatgagctcaac

SEQ ID NO: 1228577 - DNA, 22 bp, Artificial Sequence
  chemically synthesized
actctcaattctatgagctcaa

SEQ ID NO: 1228578 - DNA, 22 bp, Artificial Sequence
  chemically synthesized
tactctcaattctatgagctca

SEQ ID NO: 1228579 - DNA, 22 bp, Artificial Sequence
  chemically synthesized
taaaatgttgagctcatagaat

SEQ ID NO: 1228580 - DNA, 22 bp, Artificial Sequence
  chemically synthesized
aaaatgttgagctcatagaatt

SEQ ID NO: 1228581 - DNA, 22 bp, Artificial Sequence
  chemically synthesized
aaatgttgagctcatagaattg

SEQ ID NO: 1228582 - DNA, 22 bp, Artificial Sequence
  chemically synthesized
accaacattttactctcaattc

SEQ ID NO: 1228583 - DNA, 22 bp, Artificial Sequence
  chemically synthesized
ctaaccaacattttactctcaa

SEQ ID NO: 1228584 - DNA, 22 bp, Artificial Sequence
  chemically synthesized
agctcatagaattgagagtaaa

SEQ ID NO: 1228585 - DNA, 22 bp, Artificial Sequence
  chemically synthesized
atagaattgagagtaaaatgtt

SEQ ID NO: 1228586 - DNA, 22 bp, Artificial Sequence
  chemically synthesized
tcccctgctaaccaacatttta

SEQ ID NO: 1228587 - DNA, 22 bp, Artificial Sequence
  chemically synthesized
tatcccctgctaaccaacattt

SEQ ID NO: 1228588 - DNA, 22 bp, Artificial Sequence
  chemically synthesized
agagtaaaatgttggttagcag

SEQ ID NO: 1228589 - DNA, 22 bp, Artificial Sequence
  chemically synthesized
caagctctatcccctgctaacc

SEQ ID NO: 1228590 - DNA, 22 bp, Artificial Sequence
  chemically synthesized
ctccaagctctatcccctgcta

SEQ ID NO: 1228591 - DNA, 22 bp, Artificial Sequence
  chemically synthesized
ctcctccaagctctatcccctg

SEQ ID NO: 1228592 - DNA, 22 bp, Artificial Sequence
  chemically synthesized
accctcctcctccaagctctat

SEQ ID NO: 1228593 - DNA, 22 bp, Artificial Sequence
  chemically synthesized
gttagcaggggatagagcttgg

SEQ ID NO: 1228594 - DNA, 22 bp, Artificial Sequence
  chemically synthesized
cctaaccctcctcctccaagct

SEQ ID NO: 1228595 - DNA, 22 bp, Artificial Sequence
  chemically synthesized
gcaggggatagagcttggagga

SEQ ID NO: 1228596 - DNA, 22 bp, Artificial Sequence
  chemically synthesized
accaacatctgcctaaccctcc

SEQ ID NO: 1228597 - DNA, 22 bp, Artificial Sequence
  chemically synthesized
gaccaacatctgcctaaccctc

SEQ ID NO: 1228598 - DNA, 22 bp, Artificial Sequence
  chemically synthesized
ggaggaggagggttaggcagat

SEQ ID NO: 1228599 - DNA, 22 bp, Artificial Sequence
  chemically synthesized
gaggaggagggttaggcagatg

SEQ ID NO: 1228600 - DNA, 22 bp, Artificial Sequence
  chemically synthesized
gtatcatttgaccaacatctgc

SEQ ID NO: 1228601 - DNA, 22 bp, Artificial Sequence
  chemically synthesized
agtatcatttgaccaacatctg

SEQ ID NO: 1228602 - DNA, 22 bp, Artificial Sequence
  chemically synthesized
ggcagatgttggtcaaatgata

SEQ ID NO: 1228603 - DNA, 22 bp, Artificial Sequence
  chemically synthesized
aatgtaatttagtatcatttga

SEQ ID NO: 1228604 - DNA, 22 bp, Artificial Sequence
  chemically synthesized
ttaaatgtaatttagtatcatt

SEQ ID NO: 1228605 - DNA, 22 bp, Artificial Sequence
  chemically synthesized
ctattaaatgtaatttagtatc

SEQ ID NO: 1228606 - DNA, 22 bp, Artificial Sequence
  chemically synthesized
ttcctattaaatgtaatttagt

SEQ ID NO: 1228607 - DNA, 22 bp, Artificial Sequence
  chemically synthesized
attcctattaaatgtaatttag

SEQ ID NO: 1228608 - DNA, 22 bp, Artificial Sequence
  chemically synthesized
gtcaaatgatactaaattacat

SEQ ID NO: 1228609 - DNA, 22 bp, Artificial Sequence
  chemically synthesized
aatttattcctattaaatgtaa

SEQ ID NO: 1228610 - DNA, 22 bp, Artificial Sequence
  chemically synthesized
gaatttattcctattaaatgta

SEQ ID NO: 1228611 - DNA, 22 bp, Artificial Sequence
  chemically synthesized
ttgaatttattcctattaaatg

SEQ ID NO: 1228612 - DNA, 22 bp, Artificial Sequence
  chemically synthesized
aattacatttaataggaataaa

SEQ ID NO: 1228613 - DNA, 22 bp, Artificial Sequence
  chemically synthesized
catttaataggaataaattcaa

SEQ ID NO: 1228614 - DNA, 22 bp, Artificial Sequence
  chemically synthesized
tacagtagatctcttgaattta

SEQ ID NO: 1228615 - DNA, 22 bp, Artificial Sequence
  chemically synthesized
aataggaataaattcaagagat

SEQ ID NO: 1228616 - DNA, 22 bp, Artificial Sequence
  chemically synthesized
ataggaataaattcaagagatc

SEQ ID NO: 1228617 - DNA, 22 bp, Artificial Sequence
  chemically synthesized
accaaagtcagcatgttgtaca

SEQ ID NO: 1228618 - DNA, 22 bp, Artificial Sequence
  chemically synthesized
aagagatctactgtacaacatg

SEQ ID NO: 1228619 - DNA, 22 bp, Artificial Sequence
  chemically synthesized
ttaaccaaagtcagcatgttgt

SEQ ID NO: 1228620 - DNA, 22 bp, Artificial Sequence
  chemically synthesized
ttattaaccaaagtcagcatgt

SEQ ID NO: 1228621 - DNA, 22 bp, Artificial Sequence
  chemically synthesized
ctgtacaacatgctgactttgg

SEQ ID NO: 1228622 - DNA, 22 bp, Artificial Sequence
  chemically synthesized
tacaacatgctgactttggtta

SEQ ID NO: 1228623 - DNA, 22 bp, Artificial Sequence
  chemically synthesized
aaaatacaatattgttattaac

SEQ ID NO: 1228624 - DNA, 22 bp, Artificial Sequence
  chemically synthesized
caaaatacaatattgttattaa

SEQ ID NO: 1228625 - DNA, 22 bp, Artificial Sequence
  chemically synthesized
tcaaaatacaatattgttatta

SEQ ID NO: 1228626 - DNA, 22 bp, Artificial Sequence
  chemically synthesized
actttggttaataacaatattg

SEQ ID NO: 1228627 - DNA, 22 bp, Artificial Sequence
  chemically synthesized
gcaattttcaaaatacaatatt

SEQ ID NO: 1228628 - DNA, 22 bp, Artificial Sequence
  chemically synthesized
tggttaataacaatattgtatt

SEQ ID NO: 1228629 - DNA, 22 bp, Artificial Sequence
  chemically synthesized
agcaattttcaaaatacaatat

SEQ ID NO: 1228630 - DNA, 22 bp, Artificial Sequence
  chemically synthesized
ggttaataacaatattgtattt

SEQ ID NO: 1228631 - DNA, 22 bp, Artificial Sequence
  chemically synthesized
gttaataacaatattgtatttt

SEQ ID NO: 1228632 - DNA, 22 bp, Artificial Sequence
  chemically synthesized
ttagcaattttcaaaatacaat

SEQ ID NO: 1228633 - DNA, 22 bp, Artificial Sequence
  chemically synthesized
tcttagcaattttcaaaataca

SEQ ID NO: 1228634 - DNA, 22 bp, Artificial Sequence
  chemically synthesized
ataacaatattgtattttgaaa

SEQ ID NO: 1228635 - DNA, 22 bp, Artificial Sequence
  chemically synthesized
ttctcttagcaattttcaaaat

SEQ ID NO: 1228636 - DNA, 22 bp, Artificial Sequence
  chemically synthesized
aaatctattctcttagcaattt

SEQ ID NO: 1228637 - DNA, 22 bp, Artificial Sequence
  chemically synthesized
aaaatctattctcttagcaatt

SEQ ID NO: 1228638 - DNA, 22 bp, Artificial Sequence
  chemically synthesized
tattttgaaaattgctaagaga

SEQ ID NO: 1228639 - DNA, 22 bp, Artificial Sequence
  chemically synthesized
tgaaaattgctaagagaataga

SEQ ID NO: 1228640 - DNA, 22 bp, Artificial Sequence
  chemically synthesized
gaaaattgctaagagaatagat

SEQ ID NO: 1228641 - DNA, 22 bp, Artificial Sequence
  chemically synthesized
aggacacttaaaatctattctc

SEQ ID NO: 1228642 - DNA, 22 bp, Artificial Sequence
  chemically synthesized
aaaattgctaagagaatagatt

SEQ ID NO: 1228643 - DNA, 22 bp, Artificial Sequence
  chemically synthesized
gggttgaggacacttaaaatct

SEQ ID NO: 1228644 - DNA, 22 bp, Artificial Sequence
  chemically synthesized
ggggttgaggacacttaaaatc

SEQ ID NO: 1228645 - DNA, 22 bp, Artificial Sequence
  chemically synthesized
ctaagagaatagattttaagtg

SEQ ID NO: 1228646 - DNA, 22 bp, Artificial Sequence
  chemically synthesized
agagaatagattttaagtgtcc

SEQ ID NO: 1228647 - DNA, 22 bp, Artificial Sequence
  chemically synthesized
tcatttggggttgaggacactt

SEQ ID NO: 1228648 - DNA, 22 bp, Artificial Sequence
  chemically synthesized
atcatttggggttgaggacact

SEQ ID NO: 1228649 - DNA, 22 bp, Artificial Sequence
  chemically synthesized
tatgtttatcatttggggttga

SEQ ID NO: 1228650 - DNA, 22 bp, Artificial Sequence
  chemically synthesized
atatgtttatcatttggggttg

SEQ ID NO: 1228651 - DNA, 22 bp, Artificial Sequence
  chemically synthesized
taagtgtcctcaaccccaaatg

SEQ ID NO: 1228652 - DNA, 22 bp, Artificial Sequence
  chemically synthesized
aagtgtcctcaaccccaaatga

SEQ ID NO: 1228653 - DNA, 22 bp, Artificial Sequence
  chemically synthesized
agtgtcctcaaccccaaatgat

SEQ ID NO: 1228654 - DNA, 22 bp, Artificial Sequence
  chemically synthesized
acttatatgtttatcatttggg

SEQ ID NO: 1228655 - DNA, 22 bp, Artificial Sequence
  chemically synthesized
aaccccaaatgataaacatata

SEQ ID NO: 1228656 - DNA, 22 bp, Artificial Sequence
  chemically synthesized
ataaacatatacattaacttat

SEQ ID NO: 1228657 - DNA, 22 bp, Artificial Sequence
  chemically synthesized
aagctaataaacatatacatta

SEQ ID NO: 1228658 - DNA, 22 bp, Artificial Sequence
  chemically synthesized
caagctaataaacatatacatt

SEQ ID NO: 1228659 - DNA, 22 bp, Artificial Sequence
  chemically synthesized
tggaatgcttcaagctaataaa

SEQ ID NO: 1228660 - DNA, 22 bp, Artificial Sequence
  chemically synthesized
atgtatatgtttattagcttga

SEQ ID NO: 1228661 - DNA, 22 bp, Artificial Sequence
  chemically synthesized
gatgttgtggaatgcttcaagc

SEQ ID NO: 1228662 - DNA, 22 bp, Artificial Sequence
  chemically synthesized
attagcttgaagcattccacaa

SEQ ID NO: 1228663 - DNA, 22 bp, Artificial Sequence
  chemically synthesized
ttagcttgaagcattccacaac

SEQ ID NO: 1228664 - DNA, 22 bp, Artificial Sequence
  chemically synthesized
aaatatctagatgttgtggaat

SEQ ID NO: 1228665 - DNA, 22 bp, Artificial Sequence
  chemically synthesized
aaaatatctagatgttgtggaa

SEQ ID NO: 1228666 - DNA, 22 bp, Artificial Sequence
  chemically synthesized
taaaatatctagatgttgtgga

SEQ ID NO: 1228667 - DNA, 22 bp, Artificial Sequence
  chemically synthesized
gcttgaagcattccacaacatc

SEQ ID NO: 1228668 - DNA, 22 bp, Artificial Sequence
  chemically synthesized
ttaaaatatctagatgttgtgg

SEQ ID NO: 1228669 - DNA, 22 bp, Artificial Sequence
  chemically synthesized
tttaaaatatctagatgttgtg

SEQ ID NO: 1228670 - DNA, 22 bp, Artificial Sequence
  chemically synthesized
gaagcattccacaacatctaga

SEQ ID NO: 1228671 - DNA, 22 bp, Artificial Sequence
  chemically synthesized
aagcattccacaacatctagat

SEQ ID NO: 1228672 - DNA, 22 bp, Artificial Sequence
  chemically synthesized
cacaacatctagatattttaaa

SEQ ID NO: 1228673 - DNA, 22 bp, Artificial Sequence
  chemically synthesized
gatattttaaaaaatcatatgc

SEQ ID NO: 1228674 - DNA, 22 bp, Artificial Sequence
  chemically synthesized
tatataccatgtagcatatgat

SEQ ID NO: 1228675 - DNA, 22 bp, Artificial Sequence
  chemically synthesized
taaaaaatcatatgctacatgg

SEQ ID NO: 1228676 - DNA, 22 bp, Artificial Sequence
  chemically synthesized
aaaaaatcatatgctacatggt

SEQ ID NO: 1228677 - DNA, 22 bp, Artificial Sequence
  chemically synthesized
aaaaatcatatgctacatggta

SEQ ID NO: 1228678 - DNA, 22 bp, Artificial Sequence
  chemically synthesized
gcaaaaaaaattgtatatacca

SEQ ID NO: 1228679 - DNA, 22 bp, Artificial Sequence
  chemically synthesized
attagcaaaaaaaattgtatat

SEQ ID NO: 1228680 - DNA, 22 bp, Artificial Sequence
  chemically synthesized
aattagcaaaaaaaattgtata

SEQ ID NO: 1228681 - DNA, 22 bp, Artificial Sequence
  chemically synthesized
taattagcaaaaaaaattgtat

SEQ ID NO: 1228682 - DNA, 22 bp, Artificial Sequence
  chemically synthesized
ttaattagcaaaaaaaattgta

SEQ ID NO: 1228683 - DNA, 22 bp, Artificial Sequence
  chemically synthesized
tttaattagcaaaaaaaattgt

SEQ ID NO: 1228684 - DNA, 22 bp, Artificial Sequence
  chemically synthesized
catggtatatacaatttttttt

SEQ ID NO: 1228685 - DNA, 22 bp, Artificial Sequence
  chemically synthesized
ttttttaattagcaaaaaaaat

SEQ ID NO: 1228686 - DNA, 22 bp, Artificial Sequence
  chemically synthesized
attttttaattagcaaaaaaaa

SEQ ID NO: 1228687 - DNA, 22 bp, Artificial Sequence
  chemically synthesized
tattttttaattagcaaaaaaa

SEQ ID NO: 1228688 - DNA, 22 bp, Artificial Sequence
  chemically synthesized
ttattttttaattagcaaaaaa

SEQ ID NO: 1228689 - DNA, 22 bp, Artificial Sequence
  chemically synthesized
tttattttttaattagcaaaaa

SEQ ID NO: 1228690 - DNA, 22 bp, Artificial Sequence
  chemically synthesized
ttttttattttttaattagcaa

SEQ ID NO: 1228691 - DNA, 22 bp, Artificial Sequence
  chemically synthesized
tttttgctaattaaaaaataaa

SEQ ID NO: 1228692 - DNA, 22 bp, Artificial Sequence
  chemically synthesized
ttttgctaattaaaaaataaaa

SEQ ID NO: 1228693 - DNA, 22 bp, Artificial Sequence
  chemically synthesized
tttgctaattaaaaaataaaaa

SEQ ID NO: 1228694 - DNA, 22 bp, Artificial Sequence
  chemically synthesized
ccatataactattttttatttt

SEQ ID NO: 1228695 - DNA, 22 bp, Artificial Sequence
  chemically synthesized
ttgctaattaaaaaataaaaaa

SEQ ID NO: 1228696 - DNA, 22 bp, Artificial Sequence
  chemically synthesized
accatataactattttttattt

SEQ ID NO: 1228697 - DNA, 22 bp, Artificial Sequence
  chemically synthesized
tgctaattaaaaaataaaaaat

SEQ ID NO: 1228698 - DNA, 22 bp, Artificial Sequence
  chemically synthesized
gctaattaaaaaataaaaaata

SEQ ID NO: 1228699 - DNA, 22 bp, Artificial Sequence
  chemically synthesized
ctaattaaaaaataaaaaatag

SEQ ID NO: 1228700 - DNA, 22 bp, Artificial Sequence
  chemically synthesized
attaaaaaataaaaaatagtta

SEQ ID NO: 1228701 - DNA, 22 bp, Artificial Sequence
  chemically synthesized
aaaaataaaaaatagttatatg

SEQ ID NO: 1228702 - DNA, 22 bp, Artificial Sequence
  chemically synthesized
tggtaaaatacaaatgatgtaa

SEQ ID NO: 1228703 - DNA, 22 bp, Artificial Sequence
  chemically synthesized
tatggtaaattttacatcattt

SEQ ID NO: 1228704 - DNA, 22 bp, Artificial Sequence
  chemically synthesized
ttgtggtaaaatacaaatgatg

SEQ ID NO: 1228705 - DNA, 22 bp, Artificial Sequence
  chemically synthesized
attgtggtaaaatacaaatgat

SEQ ID NO: 1228706 - DNA, 22 bp, Artificial Sequence
  chemically synthesized
tattgtggtaaaatacaaatga

SEQ ID NO: 1228707 - DNA, 22 bp, Artificial Sequence
  chemically synthesized
ttattgtggtaaaatacaaatg

SEQ ID NO: 1228708 - DNA, 22 bp, Artificial Sequence
  chemically synthesized
tttattgtggtaaaatacaaat

SEQ ID NO: 1228709 - DNA, 22 bp, Artificial Sequence
  chemically synthesized
ttttttattgtggtaaaataca

SEQ ID NO: 1228710 - DNA, 22 bp, Artificial Sequence
  chemically synthesized
attttttattgtggtaaaatac

SEQ ID NO: 1228711 - DNA, 22 bp, Artificial Sequence
  chemically synthesized
tacatcatttgtattttaccac

SEQ ID NO: 1228712 - DNA, 22 bp, Artificial Sequence
  chemically synthesized
acatcatttgtattttaccaca

SEQ ID NO: 1228713 - DNA, 22 bp, Artificial Sequence
  chemically synthesized
catcatttgtattttaccacaa

SEQ ID NO: 1228714 - DNA, 22 bp, Artificial Sequence
  chemically synthesized
caatgacttattttttattgtg

SEQ ID NO: 1228715 - DNA, 22 bp, Artificial Sequence
  chemically synthesized
gtattttaccacaataaaaaat

SEQ ID NO: 1228716 - DNA, 22 bp, Artificial Sequence
  chemically synthesized
tattttaccacaataaaaaata

SEQ ID NO: 1228717 - DNA, 22 bp, Artificial Sequence
  chemically synthesized
taccacaataaaaaataagtca

SEQ ID NO: 1228718 - DNA, 22 bp, Artificial Sequence
  chemically synthesized
accacaataaaaaataagtcat

SEQ ID NO: 1228719 - DNA, 22 bp, Artificial Sequence
  chemically synthesized
ccacaataaaaaataagtcatt

SEQ ID NO: 1228720 - DNA, 22 bp, Artificial Sequence
  chemically synthesized
gaacacacatcgcacccccccc

SEQ ID NO: 1228721 - DNA, 22 bp, Artificial Sequence
  chemically synthesized
tgtgtgtgtgtgtgtggggggg

SEQ ID NO: 1228722 - DNA, 22 bp, Artificial Sequence
  chemically synthesized
ctgtgtgtgtgtgtgtgtgggg

SEQ ID NO: 1228723 - DNA, 22 bp, Artificial Sequence
  chemically synthesized
ctgctgtgtgtgtgtgtgtgtg

SEQ ID NO: 1228724 - DNA, 22 bp, Artificial Sequence
  chemically synthesized
tggctgctgctgtgtgtgtgtg

SEQ ID NO: 1228725 - DNA, 22 bp, Artificial Sequence
  chemically synthesized
tctgtggctgctgctgtgtgtg

SEQ ID NO: 1228726 - DNA, 22 bp, Artificial Sequence
  chemically synthesized
ggtattatctgtggctgctgct

SEQ ID NO: 1228727 - DNA, 22 bp, Artificial Sequence
  chemically synthesized
aggtattatctgtggctgctgc

SEQ ID NO: 1228728 - DNA, 22 bp, Artificial Sequence
  chemically synthesized
tttaggtattatctgtggctgc

SEQ ID NO: 1228729 - DNA, 22 bp, Artificial Sequence
  chemically synthesized
atttaggtattatctgtggctg

SEQ ID NO: 1228730 - DNA, 22 bp, Artificial Sequence
  chemically synthesized
gaaaaaaaccatgaacatttat

SEQ ID NO: 1228731 - DNA, 22 bp, Artificial Sequence
  chemically synthesized
ttggaaaaaaaccatgaacatt

SEQ ID NO: 1228732 - DNA, 22 bp, Artificial Sequence
  chemically synthesized
attggaaaaaaaccatgaacat

SEQ ID NO: 1228733 - DNA, 22 bp, Artificial Sequence
  chemically synthesized
tattggaaaaaaaccatgaaca

SEQ ID NO: 1228734 - DNA, 22 bp, Artificial Sequence
  chemically synthesized
aataaatgttcatggttttttt

SEQ ID NO: 1228735 - DNA, 22 bp, Artificial Sequence
  chemically synthesized
atggtttttttccaataaaatt

SEQ ID NO: 1228736 - DNA, 22 bp, Artificial Sequence
  chemically synthesized
tggatatagataaattttattg

SEQ ID NO: 1228737 - DNA, 22 bp, Artificial Sequence
  chemically synthesized
ctgtggatatagataaatttta

SEQ ID NO: 1228738 - DNA, 22 bp, Artificial Sequence
  chemically synthesized
cctgtggatatagataaatttt

SEQ ID NO: 1228739 - DNA, 22 bp, Artificial Sequence
  chemically synthesized
tcctgtggatatagataaattt

SEQ ID NO: 1228740 - DNA, 22 bp, Artificial Sequence
  chemically synthesized
ttcctgtggatatagataaatt

SEQ ID NO: 1228741 - DNA, 22 bp, Artificial Sequence
  chemically synthesized
ttttccaataaaatttatctat

SEQ ID NO: 1228742 - DNA, 22 bp, Artificial Sequence
  chemically synthesized
tttccaataaaatttatctata

SEQ ID NO: 1228743 - DNA, 22 bp, Artificial Sequence
  chemically synthesized
ttccaataaaatttatctatat

SEQ ID NO: 1228744 - DNA, 22 bp, Artificial Sequence
  chemically synthesized
tttttcctgtggatatagataa

SEQ ID NO: 1228745 - DNA, 22 bp, Artificial Sequence
  chemically synthesized
tccaataaaatttatctatatc

SEQ ID NO: 1228746 - DNA, 22 bp, Artificial Sequence
  chemically synthesized
ccaataaaatttatctatatcc

SEQ ID NO: 1228747 - DNA, 22 bp, Artificial Sequence
  chemically synthesized
caataaaatttatctatatcca

SEQ ID NO: 1228748 - DNA, 22 bp, Artificial Sequence
  chemically synthesized
attgtttttcctgtggatatag

SEQ ID NO: 1228749 - DNA, 22 bp, Artificial Sequence
  chemically synthesized
cctaattgtttttcctgtggat

SEQ ID NO: 1228750 - DNA, 22 bp, Artificial Sequence
  chemically synthesized
cctacctaattgtttttcctgt

SEQ ID NO: 1228751 - DNA, 22 bp, Artificial Sequence
  chemically synthesized
atctatatccacaggaaaaaca

SEQ ID NO: 1228752 - DNA, 22 bp, Artificial Sequence
  chemically synthesized
tctatatccacaggaaaaacaa

SEQ ID NO: 1228753 - DNA, 22 bp, Artificial Sequence
  chemically synthesized
tatccacaggaaaaacaattag

SEQ ID NO: 1228754 - DNA, 22 bp, Artificial Sequence
  chemically synthesized
cgtgagacacagttgcctacct

SEQ ID NO: 1228755 - DNA, 22 bp, Artificial Sequence
  chemically synthesized
ccgtgagacacagttgcctacc

SEQ ID NO: 1228756 - DNA, 22 bp, Artificial Sequence
  chemically synthesized
ggcttccgtgagacacagttgc

SEQ ID NO: 1228757 - DNA, 22 bp, Artificial Sequence
  chemically synthesized
gggcttccgtgagacacagttg

SEQ ID NO: 1228758 - DNA, 22 bp, Artificial Sequence
  chemically synthesized
ggtaggcaactgtgtctcacgg

SEQ ID NO: 1228759 - DNA, 22 bp, Artificial Sequence
  chemically synthesized
ccccttgggcttccgtgagaca

SEQ ID NO: 1228760 - DNA, 22 bp, Artificial Sequence
  chemically synthesized
accccttgggcttccgtgagac

SEQ ID NO: 1228761 - DNA, 22 bp, Artificial Sequence
  chemically synthesized
ttaccccttgggcttccgtgag

SEQ ID NO: 1228762 - DNA, 22 bp, Artificial Sequence
  chemically synthesized
cttaccccttgggcttccgtga

SEQ ID NO: 1228763 - DNA, 22 bp, Artificial Sequence
  chemically synthesized
tcttaccccttgggcttccgtg

SEQ ID NO: 1228764 - DNA, 22 bp, Artificial Sequence
  chemically synthesized
ttcttaccccttgggcttccgt

SEQ ID NO: 1228765 - DNA, 22 bp, Artificial Sequence
  chemically synthesized
tttcttaccccttgggcttccg

SEQ ID NO: 1228766 - DNA, 22 bp, Artificial Sequence
  chemically synthesized
ctttttcttaccccttgggctt

SEQ ID NO: 1228767 - DNA, 22 bp, Artificial Sequence
  chemically synthesized
cctttttcttaccccttgggct

SEQ ID NO: 1228768 - DNA, 22 bp, Artificial Sequence
  chemically synthesized
tgtctcacggaagcccaagggg

SEQ ID NO: 1228769 - DNA, 22 bp, Artificial Sequence
  chemically synthesized
cttcctttttcttaccccttgg

SEQ ID NO: 1228770 - DNA, 22 bp, Artificial Sequence
  chemically synthesized
acggaagcccaaggggtaagaa

SEQ ID NO: 1228771 - DNA, 22 bp, Artificial Sequence
  chemically synthesized
acaatgttacttcctttttctt

SEQ ID NO: 1228772 - DNA, 22 bp, Artificial Sequence
  chemically synthesized
cacaatgttacttcctttttct

SEQ ID NO: 1228773 - DNA, 22 bp, Artificial Sequence
  chemically synthesized
tcacaatgttacttcctttttc

SEQ ID NO: 1228774 - DNA, 22 bp, Artificial Sequence
  chemically synthesized
ttcacaatgttacttccttttt

SEQ ID NO: 1228775 - DNA, 22 bp, Artificial Sequence
  chemically synthesized
tcttttcacaatgttacttcct

SEQ ID NO: 1228776 - DNA, 22 bp, Artificial Sequence
  chemically synthesized
atcttttcacaatgttacttcc

SEQ ID NO: 1228777 - DNA, 22 bp, Artificial Sequence
  chemically synthesized
cttatcttttcacaatgttact

SEQ ID NO: 1228778 - DNA, 22 bp, Artificial Sequence
  chemically synthesized
gcttatcttttcacaatgttac

SEQ ID NO: 1228779 - DNA, 22 bp, Artificial Sequence
  chemically synthesized
tgcttatcttttcacaatgtta

SEQ ID NO: 1228780 - DNA, 22 bp, Artificial Sequence
  chemically synthesized
ttgcttatcttttcacaatgtt

SEQ ID NO: 1228781 - DNA, 22 bp, Artificial Sequence
  chemically synthesized
tgtcttttgcttatcttttcac

SEQ ID NO: 1228782 - DNA, 22 bp, Artificial Sequence
  chemically synthesized
atgtcttttgcttatcttttca

SEQ ID NO: 1228783 - DNA, 22 bp, Artificial Sequence
  chemically synthesized
tgaaaagataagcaaaagacat

SEQ ID NO: 1228784 - DNA, 22 bp, Artificial Sequence
  chemically synthesized
agtacatgaatatatcttatgt

SEQ ID NO: 1228785 - DNA, 22 bp, Artificial Sequence
  chemically synthesized
atcaatactgagtacatgaata

SEQ ID NO: 1228786 - DNA, 22 bp, Artificial Sequence
  chemically synthesized
aatcaatactgagtacatgaat

SEQ ID NO: 1228787 - DNA, 22 bp, Artificial Sequence
  chemically synthesized
cagatttaatcaatactgagta

SEQ ID NO: 1228788 - DNA, 22 bp, Artificial Sequence
  chemically synthesized
acagatttaatcaatactgagt

SEQ ID NO: 1228789 - DNA, 22 bp, Artificial Sequence
  chemically synthesized
tacagatttaatcaatactgag

SEQ ID NO: 1228790 - DNA, 22 bp, Artificial Sequence
  chemically synthesized
tttacagatttaatcaatactg

SEQ ID NO: 1228791 - DNA, 22 bp, Artificial Sequence
  chemically synthesized
ctttacagatttaatcaatact

SEQ ID NO: 1228792 - DNA, 22 bp, Artificial Sequence
  chemically synthesized
tctttacagatttaatcaatac

SEQ ID NO: 1228793 - DNA, 22 bp, Artificial Sequence
  chemically synthesized
ttctttacagatttaatcaata

SEQ ID NO: 1228794 - DNA, 22 bp, Artificial Sequence
  chemically synthesized
tttctttacagatttaatcaat

SEQ ID NO: 1228795 - DNA, 22 bp, Artificial Sequence
  chemically synthesized
atgtactcagtattgattaaat

SEQ ID NO: 1228796 - DNA, 22 bp, Artificial Sequence
  chemically synthesized
ttttttctttacagatttaatc

SEQ ID NO: 1228797 - DNA, 22 bp, Artificial Sequence
  chemically synthesized
agtattgattaaatctgtaaag

SEQ ID NO: 1228798 - DNA, 22 bp, Artificial Sequence
  chemically synthesized
caatctattttttctttacaga

SEQ ID NO: 1228799 - DNA, 22 bp, Artificial Sequence
  chemically synthesized
attccaatctattttttcttta

SEQ ID NO: 1228800 - DNA, 22 bp, Artificial Sequence
  chemically synthesized
cattccaatctattttttcttt

SEQ ID NO: 1228801 - DNA, 22 bp, Artificial Sequence
  chemically synthesized
attaaatctgtaaagaaaaaat

SEQ ID NO: 1228802 - DNA, 22 bp, Artificial Sequence
  chemically synthesized
ttcattccaatctattttttct

SEQ ID NO: 1228803 - DNA, 22 bp, Artificial Sequence
  chemically synthesized
cttcattccaatctattttttc

SEQ ID NO: 1228804 - DNA, 22 bp, Artificial Sequence
  chemically synthesized
tcttcattccaatctatttttt

SEQ ID NO: 1228805 - DNA, 22 bp, Artificial Sequence
  chemically synthesized
aatctgtaaagaaaaaatagat

SEQ ID NO: 1228806 - DNA, 22 bp, Artificial Sequence
  chemically synthesized
ttcttcattccaatctattttt

SEQ ID NO: 1228807 - DNA, 22 bp, Artificial Sequence
  chemically synthesized
taaagaaaaaatagattggaat

SEQ ID NO: 1228808 - DNA, 22 bp, Artificial Sequence
  chemically synthesized
atacttttcttcattccaatct

SEQ ID NO: 1228809 - DNA, 22 bp, Artificial Sequence
  chemically synthesized
cacctgatacttttcttcattc

SEQ ID NO: 1228810 - DNA, 22 bp, Artificial Sequence
  chemically synthesized
tccacctgatacttttcttcat

SEQ ID NO: 1228811 - DNA, 22 bp, Artificial Sequence
  chemically synthesized
ctccacctgatacttttcttca

SEQ ID NO: 1228812 - DNA, 22 bp, Artificial Sequence
  chemically synthesized
tctccacctgatacttttcttc

SEQ ID NO: 1228813 - DNA, 22 bp, Artificial Sequence
  chemically synthesized
gaatgaagaaaagtatcaggtg

SEQ ID NO: 1228814 - DNA, 22 bp, Artificial Sequence
  chemically synthesized
gcatgctttctccacctgatac

SEQ ID NO: 1228815 - DNA, 22 bp, Artificial Sequence
  chemically synthesized
tggcatgctttctccacctgat

SEQ ID NO: 1228816 - DNA, 22 bp, Artificial Sequence
  chemically synthesized
ctggcatgctttctccacctga

SEQ ID NO: 1228817 - DNA, 22 bp, Artificial Sequence
  chemically synthesized
tctggcatgctttctccacctg

SEQ ID NO: 1228818 - DNA, 22 bp, Artificial Sequence
  chemically synthesized
aatgctttctggcatgctttct

SEQ ID NO: 1228819 - DNA, 22 bp, Artificial Sequence
  chemically synthesized
gtgatctgaatgctttctggca

SEQ ID NO: 1228820 - DNA, 22 bp, Artificial Sequence
  chemically synthesized
ccccctagtgatctgaatgctt

SEQ ID NO: 1228821 - DNA, 22 bp, Artificial Sequence
  chemically synthesized
attaccccctagtgatctgaat

SEQ ID NO: 1228822 - DNA, 22 bp, Artificial Sequence
  chemically synthesized
ccaatcagttaattacccccta

SEQ ID NO: 1228823 - DNA, 22 bp, Artificial Sequence
  chemically synthesized
agatcactagggggtaattaac

SEQ ID NO: 1228824 - DNA, 22 bp, Artificial Sequence
  chemically synthesized
caattcccaatcagttaattac

SEQ ID NO: 1228825 - DNA, 22 bp, Artificial Sequence
  chemically synthesized
gggggtaattaactgattggga

SEQ ID NO: 1228826 - DNA, 22 bp, Artificial Sequence
  chemically synthesized
aatataatatctccaattccca

SEQ ID NO: 1228827 - DNA, 22 bp, Artificial Sequence
  chemically synthesized
actgattgggaattggagatat

SEQ ID NO: 1228828 - DNA, 22 bp, Artificial Sequence
  chemically synthesized
tccctgaatataatatctccaa

SEQ ID NO: 1228829 - DNA, 22 bp, Artificial Sequence
  chemically synthesized
tgtccctgaatataatatctcc

SEQ ID NO: 1228830 - DNA, 22 bp, Artificial Sequence
  chemically synthesized
attgggaattggagatattata

SEQ ID NO: 1228831 - DNA, 22 bp, Artificial Sequence
  chemically synthesized
ggaattggagatattatattca

SEQ ID NO: 1228832 - DNA, 22 bp, Artificial Sequence
  chemically synthesized
aatacaattctgtccctgaata

SEQ ID NO: 1228833 - DNA, 22 bp, Artificial Sequence
  chemically synthesized
gagatattatattcagggacag

SEQ ID NO: 1228834 - DNA, 22 bp, Artificial Sequence
  chemically synthesized
ccactgaatacaattctgtccc

SEQ ID NO: 1228835 - DNA, 22 bp, Artificial Sequence
  chemically synthesized
tctgccactgaatacaattctg

SEQ ID NO: 1228836 - DNA, 22 bp, Artificial Sequence
  chemically synthesized
tattcagggacagaattgtatt

SEQ ID NO: 1228837 - DNA, 22 bp, Artificial Sequence
  chemically synthesized
agggacagaattgtattcagtg

SEQ ID NO: 1228838 - DNA, 22 bp, Artificial Sequence
  chemically synthesized
aaaaagagtagctgtctgccac

SEQ ID NO: 1228839 - DNA, 22 bp, Artificial Sequence
  chemically synthesized
tattcagtggcagacagctact

SEQ ID NO: 1228840 - DNA, 22 bp, Artificial Sequence
  chemically synthesized
agtggcagacagctactctttt

SEQ ID NO: 1228841 - DNA, 22 bp, Artificial Sequence
  chemically synthesized
atataaaagttaaaaaagagta

SEQ ID NO: 1228842 - DNA, 22 bp, Artificial Sequence
  chemically synthesized
aacctaatataaaagttaaaaa

SEQ ID NO: 1228843 - DNA, 22 bp, Artificial Sequence
  chemically synthesized
ctgaacctaatataaaagttaa

SEQ ID NO: 1228844 - DNA, 22 bp, Artificial Sequence
  chemically synthesized
ctcttttttaacttttatatta

SEQ ID NO: 1228845 - DNA, 22 bp, Artificial Sequence
  chemically synthesized
ttttttaacttttatattaggt

SEQ ID NO: 1228846 - DNA, 22 bp, Artificial Sequence
  chemically synthesized
ttttaacttttatattaggttc

SEQ ID NO: 1228847 - DNA, 22 bp, Artificial Sequence
  chemically synthesized
tttaacttttatattaggttca

SEQ ID NO: 1228848 - DNA, 22 bp, Artificial Sequence
  chemically synthesized
cacatgtactcctgaacctaat

SEQ ID NO: 1228849 - DNA, 22 bp, Artificial Sequence
  chemically synthesized
ttaacttttatattaggttcag

SEQ ID NO: 1228850 - DNA, 22 bp, Artificial Sequence
  chemically synthesized
taacttttatattaggttcagg

SEQ ID NO: 1228851 - DNA, 22 bp, Artificial Sequence
  chemically synthesized
aacttttatattaggttcagga

SEQ ID NO: 1228852 - DNA, 22 bp, Artificial Sequence
  chemically synthesized
acttttatattaggttcaggag

SEQ ID NO: 1228853 - DNA, 22 bp, Artificial Sequence
  chemically synthesized
ttatattaggttcaggagtaca

SEQ ID NO: 1228854 - DNA, 22 bp, Artificial Sequence
  chemically synthesized
tatattaggttcaggagtacat

SEQ ID NO: 1228855 - DNA, 22 bp, Artificial Sequence
  chemically synthesized
atattaggttcaggagtacatg

SEQ ID NO: 1228856 - DNA, 22 bp, Artificial Sequence
  chemically synthesized
tattaggttcaggagtacatgt

SEQ ID NO: 1228857 - DNA, 22 bp, Artificial Sequence
  chemically synthesized
tgtaacaaacctgcacatgtac

SEQ ID NO: 1228858 - DNA, 22 bp, Artificial Sequence
  chemically synthesized
ggttcaggagtacatgtgcagg

SEQ ID NO: 1228859 - DNA, 22 bp, Artificial Sequence
  chemically synthesized
cctatgtaacaaacctgcacat

SEQ ID NO: 1228860 - DNA, 22 bp, Artificial Sequence
  chemically synthesized
acctatgtaacaaacctgcaca

SEQ ID NO: 1228861 - DNA, 22 bp, Artificial Sequence
  chemically synthesized
aggagtacatgtgcaggtttgt

SEQ ID NO: 1228862 - DNA, 22 bp, Artificial Sequence
  chemically synthesized
aacccccatgacacgcaattta

SEQ ID NO: 1228863 - DNA, 22 bp, Artificial Sequence
  chemically synthesized
gttacataggtaaattgcgtgt

SEQ ID NO: 1228864 - DNA, 22 bp, Artificial Sequence
  chemically synthesized
ttacataggtaaattgcgtgtc

SEQ ID NO: 1228865 - DNA, 22 bp, Artificial Sequence
  chemically synthesized
cataggtaaattgcgtgtcatg

SEQ ID NO: 1228866 - DNA, 22 bp, Artificial Sequence
  chemically synthesized
cgtgtcatgggggtttaatgta

SEQ ID NO: 1228867 - DNA, 22 bp, Artificial Sequence
  chemically synthesized
ggcgatgaaataatgtgtacat

SEQ ID NO: 1228868 - DNA, 22 bp, Artificial Sequence
  chemically synthesized
cctgggcgatgaaataatgtgt

SEQ ID NO: 1228869 - DNA, 22 bp, Artificial Sequence
  chemically synthesized
ttacctgggcgatgaaataatg

SEQ ID NO: 1228870 - DNA, 22 bp, Artificial Sequence
  chemically synthesized
attacctgggcgatgaaataat

SEQ ID NO: 1228871 - DNA, 22 bp, Artificial Sequence
  chemically synthesized
aatgtacacattatttcatcgc

SEQ ID NO: 1228872 - DNA, 22 bp, Artificial Sequence
  chemically synthesized
atgtacacattatttcatcgcc

SEQ ID NO: 1228873 - DNA, 22 bp, Artificial Sequence
  chemically synthesized
tcaggcaccatacttattacct

SEQ ID NO: 1228874 - DNA, 22 bp, Artificial Sequence
  chemically synthesized
tttcatcgcccaggtaataagt

SEQ ID NO: 1228875 - DNA, 22 bp, Artificial Sequence
  chemically synthesized
catcgcccaggtaataagtatg

SEQ ID NO: 1228876 - DNA, 22 bp, Artificial Sequence
  chemically synthesized
cctatcaggcaccatacttatt

SEQ ID NO: 1228877 - DNA, 22 bp, Artificial Sequence
  chemically synthesized
atcgcccaggtaataagtatgg

SEQ ID NO: 1228878 - DNA, 22 bp, Artificial Sequence
  chemically synthesized
ataggtagtttttctgatcctc

SEQ ID NO: 1228879 - DNA, 22 bp, Artificial Sequence
  chemically synthesized
ttctgatcctctccctcctccc

SEQ ID NO: 1228880 - DNA, 22 bp, Artificial Sequence
  chemically synthesized
tctgatcctctccctcctccca

SEQ ID NO: 1228881 - DNA, 22 bp, Artificial Sequence
  chemically synthesized
aagagtaaaaggtgggaggagg

SEQ ID NO: 1228882 - DNA, 22 bp, Artificial Sequence
  chemically synthesized
ctgatcctctccctcctcccac

SEQ ID NO: 1228883 - DNA, 22 bp, Artificial Sequence
  chemically synthesized
tgatcctctccctcctcccacc

SEQ ID NO: 1228884 - DNA, 22 bp, Artificial Sequence
  chemically synthesized
ctcaagagtaaaaggtgggagg

SEQ ID NO: 1228885 - DNA, 22 bp, Artificial Sequence
  chemically synthesized
atcctctccctcctcccacctt

SEQ ID NO: 1228886 - DNA, 22 bp, Artificial Sequence
  chemically synthesized
tccctcctcccaccttttactc

SEQ ID NO: 1228887 - DNA, 22 bp, Artificial Sequence
  chemically synthesized
gagcctactcaagagtaaaagg

SEQ ID NO: 1228888 - DNA, 22 bp, Artificial Sequence
  chemically synthesized
cctcctcccaccttttactctt

SEQ ID NO: 1228889 - DNA, 22 bp, Artificial Sequence
  chemically synthesized
ctcccaccttttactcttgagt

SEQ ID NO: 1228890 - DNA, 22 bp, Artificial Sequence
  chemically synthesized
ccaccttttactcttgagtagg

SEQ ID NO: 1228891 - DNA, 22 bp, Artificial Sequence
  chemically synthesized
ttactcttgagtaggctccagt

SEQ ID NO: 1228892 - DNA, 22 bp, Artificial Sequence
  chemically synthesized
tactcttgagtaggctccagtg

SEQ ID NO: 1228893 - DNA, 22 bp, Artificial Sequence
  chemically synthesized
actcttgagtaggctccagtgt

SEQ ID NO: 1228894 - DNA, 22 bp, Artificial Sequence
  chemically synthesized
ctcttgagtaggctccagtgtc

SEQ ID NO: 1228895 - DNA, 22 bp, Artificial Sequence
  chemically synthesized
ttgagtaggctccagtgtctgt

SEQ ID NO: 1228896 - DNA, 22 bp, Artificial Sequence
  chemically synthesized
gagtaggctccagtgtctgttg

SEQ ID NO: 1228897 - DNA, 22 bp, Artificial Sequence
  chemically synthesized
agtaggctccagtgtctgttgt

SEQ ID NO: 1228898 - DNA, 22 bp, Artificial Sequence
  chemically synthesized
cagtgtctgttgttccccactt

SEQ ID NO: 1228899 - DNA, 22 bp, Artificial Sequence
  chemically synthesized
ttgttccccactttatatccat

SEQ ID NO: 1228900 - DNA, 22 bp, Artificial Sequence
  chemically synthesized
ataacaagaacacatggatata

SEQ ID NO: 1228901 - DNA, 22 bp, Artificial Sequence
  chemically synthesized
ttccccactttatatccatgtg

SEQ ID NO: 1228902 - DNA, 22 bp, Artificial Sequence
  chemically synthesized
cccactttatatccatgtgttc

SEQ ID NO: 1228903 - DNA, 22 bp, Artificial Sequence
  chemically synthesized
tatatccatgtgttcttgttat

SEQ ID NO: 1228904 - DNA, 22 bp, Artificial Sequence
  chemically synthesized
atatccatgtgttcttgttatt

SEQ ID NO: 1228905 - DNA, 22 bp, Artificial Sequence
  chemically synthesized
tatccatgtgttcttgttatta

SEQ ID NO: 1228906 - DNA, 22 bp, Artificial Sequence
  chemically synthesized
aaaaaaaaaaaaaaaaagggga

SEQ ID NO: 1228907 - DNA, 22 bp, Artificial Sequence
  chemically synthesized
ttgttattaactcccctttttt

SEQ ID NO: 1228908 - DNA, 22 bp, Artificial Sequence
  chemically synthesized
gttattaactcccctttttttt

SEQ ID NO: 1228909 - DNA, 22 bp, Artificial Sequence
  chemically synthesized
ttattaactccccttttttttt

SEQ ID NO: 1228910 - DNA, 22 bp, Artificial Sequence
  chemically synthesized
cacctcaaaaaaaaaaaaaaaa

SEQ ID NO: 1228911 - DNA, 22 bp, Artificial Sequence
  chemically synthesized
ttaactcccctttttttttttt

SEQ ID NO: 1228912 - DNA, 22 bp, Artificial Sequence
  chemically synthesized
actccccttttttttttttttt

SEQ ID NO: 1228913 - DNA, 22 bp, Artificial Sequence
  chemically synthesized
ccctttttttttttttttttga

SEQ ID NO: 1228914 - DNA, 22 bp, Artificial Sequence
  chemically synthesized
tttttttttttttttgaggtgg

SEQ ID NO: 1228915 - DNA, 22 bp, Artificial Sequence
  chemically synthesized
ttttttttttttttgaggtgga

SEQ ID NO: 1228916 - DNA, 22 bp, Artificial Sequence
  chemically synthesized
tttttttttttttgaggtggag

SEQ ID NO: 1228917 - DNA, 22 bp, Artificial Sequence
  chemically synthesized
ttttttttttttgaggtggagt

SEQ ID NO: 1228918 - DNA, 22 bp, Artificial Sequence
  chemically synthesized
tttttttttttgaggtggagtt

SEQ ID NO: 1228919 - DNA, 22 bp, Artificial Sequence
  chemically synthesized
ttttttttttgaggtggagttt

SEQ ID NO: 1228920 - DNA, 22 bp, Artificial Sequence
  chemically synthesized
tttttttttgaggtggagtttc

SEQ ID NO: 1228921 - DNA, 22 bp, Artificial Sequence
  chemically synthesized
ggcaacaagagcgaaactccac

SEQ ID NO: 1228922 - DNA, 22 bp, Artificial Sequence
  chemically synthesized
ttttttttgaggtggagtttcg

SEQ ID NO: 1228923 - DNA, 22 bp, Artificial Sequence
  chemically synthesized
tttttttgaggtggagtttcgc

SEQ ID NO: 1228924 - DNA, 22 bp, Artificial Sequence
  chemically synthesized
ttttttgaggtggagtttcgct

SEQ ID NO: 1228925 - DNA, 22 bp, Artificial Sequence
  chemically synthesized
tttttgaggtggagtttcgctc

SEQ ID NO: 1228926 - DNA, 22 bp, Artificial Sequence
  chemically synthesized
ttttgaggtggagtttcgctct

SEQ ID NO: 1228927 - DNA, 22 bp, Artificial Sequence
  chemically synthesized
tttgaggtggagtttcgctctt

SEQ ID NO: 1228928 - DNA, 22 bp, Artificial Sequence
  chemically synthesized
ttgaggtggagtttcgctcttg

SEQ ID NO: 1228929 - DNA, 22 bp, Artificial Sequence
  chemically synthesized
cagtctgggcaacaagagcgaa

SEQ ID NO: 1228930 - DNA, 22 bp, Artificial Sequence
  chemically synthesized
tgaggtggagtttcgctcttgt

SEQ ID NO: 1228931 - DNA, 22 bp, Artificial Sequence
  chemically synthesized
gaggtggagtttcgctcttgtt

SEQ ID NO: 1228932 - DNA, 22 bp, Artificial Sequence
  chemically synthesized
aggtggagtttcgctcttgttg

SEQ ID NO: 1228933 - DNA, 22 bp, Artificial Sequence
  chemically synthesized
cactccagtctgggcaacaaga

SEQ ID NO: 1228934 - DNA, 22 bp, Artificial Sequence
  chemically synthesized
cgctcttgttgcccagactgga

SEQ ID NO: 1228935 - DNA, 22 bp, Artificial Sequence
  chemically synthesized
gctcttgttgcccagactggag

SEQ ID NO: 1228936 - DNA, 22 bp, Artificial Sequence
  chemically synthesized
ttgttgcccagactggagtgca

SEQ ID NO: 1228937 - DNA, 22 bp, Artificial Sequence
  chemically synthesized
gttgcccagactggagtgcagt

SEQ ID NO: 1228938 - DNA, 22 bp, Artificial Sequence
  chemically synthesized
ttgcccagactggagtgcagtg

SEQ ID NO: 1228939 - DNA, 22 bp, Artificial Sequence
  chemically synthesized
cccagactggagtgcagtggca

SEQ ID NO: 1228940 - DNA, 22 bp, Artificial Sequence
  chemically synthesized
tggtgagccgagatcgtgccac

SEQ ID NO: 1228941 - DNA, 22 bp, Artificial Sequence
  chemically synthesized
gagtgcagtggcacgatctcgg

SEQ ID NO: 1228942 - DNA, 22 bp, Artificial Sequence
  chemically synthesized
gggaggcggaggttgtggtgag

SEQ ID NO: 1228943 - DNA, 22 bp, Artificial Sequence
  chemically synthesized
aaactcgggaggcggaggttgt

SEQ ID NO: 1228944 - DNA, 22 bp, Artificial Sequence
  chemically synthesized
gaaactcgggaggcggaggttg

SEQ ID NO: 1228945 - DNA, 22 bp, Artificial Sequence
  chemically synthesized
ggctcaccacaacctccgcctc

SEQ ID NO: 1228946 - DNA, 22 bp, Artificial Sequence
  chemically synthesized
accacaacctccgcctcccgag

SEQ ID NO: 1228947 - DNA, 22 bp, Artificial Sequence
  chemically synthesized
aggcaggagaatcgcttgaaac

SEQ ID NO: 1228948 - DNA, 22 bp, Artificial Sequence
  chemically synthesized
cgcctcccgagtttcaagcgat

SEQ ID NO: 1228949 - DNA, 22 bp, Artificial Sequence
  chemically synthesized
ccgagtttcaagcgattctcct

SEQ ID NO: 1228950 - DNA, 22 bp, Artificial Sequence
  chemically synthesized
ggaggctgaggcaggagaatcg

SEQ ID NO: 1228951 - DNA, 22 bp, Artificial Sequence
  chemically synthesized
gggaggctgaggcaggagaatc

SEQ ID NO: 1228952 - DNA, 22 bp, Artificial Sequence
  chemically synthesized
cttgggaggctgaggcaggaga

SEQ ID NO: 1228953 - DNA, 22 bp, Artificial Sequence
  chemically synthesized
caagcgattctcctgcctcagc

SEQ ID NO: 1228954 - DNA, 22 bp, Artificial Sequence
  chemically synthesized
aagcgattctcctgcctcagcc

SEQ ID NO: 1228955 - DNA, 22 bp, Artificial Sequence
  chemically synthesized
taatcccagctacttgggaggc

SEQ ID NO: 1228956 - DNA, 22 bp, Artificial Sequence
  chemically synthesized
tcctgcctcagcctcccaagta

SEQ ID NO: 1228957 - DNA, 22 bp, Artificial Sequence
  chemically synthesized
ctgcctcagcctcccaagtagc

SEQ ID NO: 1228958 - DNA, 22 bp, Artificial Sequence
  chemically synthesized
cctcagcctcccaagtagctgg

SEQ ID NO: 1228959 - DNA, 22 bp, Artificial Sequence
  chemically synthesized
agcctcccaagtagctgggatt

SEQ ID NO: 1228960 - DNA, 22 bp, Artificial Sequence
  chemically synthesized
ccaagtagctgggattacaggc

SEQ ID NO: 1228961 - DNA, 22 bp, Artificial Sequence
  chemically synthesized
gccaggcgtggtggcgcatgcc

SEQ ID NO: 1228962 - DNA, 22 bp, Artificial Sequence
  chemically synthesized
ggattacaggcatgcgccacca

SEQ ID NO: 1228963 - DNA, 22 bp, Artificial Sequence
  chemically synthesized
caggcatgcgccaccacgcctg

SEQ ID NO: 1228964 - DNA, 22 bp, Artificial Sequence
  chemically synthesized
aaaatacaaaattagccaggcg

SEQ ID NO: 1228965 - DNA, 22 bp, Artificial Sequence
  chemically synthesized
ctaaaaatacaaaattagccag

SEQ ID NO: 1228966 - DNA, 22 bp, Artificial Sequence
  chemically synthesized
tactaaaaatacaaaattagcc

SEQ ID NO: 1228967 - DNA, 22 bp, Artificial Sequence
  chemically synthesized
gctaattttgtatttttagtag

SEQ ID NO: 1228968 - DNA, 22 bp, Artificial Sequence
  chemically synthesized
attttgtatttttagtagagac

SEQ ID NO: 1228969 - DNA, 22 bp, Artificial Sequence
  chemically synthesized
tgtatttttagtagagacgggg

SEQ ID NO: 1228970 - DNA, 22 bp, Artificial Sequence
  chemically synthesized
gtatttttagtagagacggggt

SEQ ID NO: 1228971 - DNA, 22 bp, Artificial Sequence
  chemically synthesized
tatttttagtagagacggggtt

SEQ ID NO: 1228972 - DNA, 22 bp, Artificial Sequence
  chemically synthesized
accaacatggagaaaccccgtc

SEQ ID NO: 1228973 - DNA, 22 bp, Artificial Sequence
  chemically synthesized
ttagtagagacggggtttctcc

SEQ ID NO: 1228974 - DNA, 22 bp, Artificial Sequence
  chemically synthesized
tagtagagacggggtttctcca

SEQ ID NO: 1228975 - DNA, 22 bp, Artificial Sequence
  chemically synthesized
agtagagacggggtttctccat

SEQ ID NO: 1228976 - DNA, 22 bp, Artificial Sequence
  chemically synthesized
gtagagacggggtttctccatg

SEQ ID NO: 1228977 - DNA, 22 bp, Artificial Sequence
  chemically synthesized
gagaccagcctgaccaacatgg

SEQ ID NO: 1228978 - DNA, 22 bp, Artificial Sequence
  chemically synthesized
ctccatgttggtcaggctggtc

SEQ ID NO: 1228979 - DNA, 22 bp, Artificial Sequence
  chemically synthesized
tccatgttggtcaggctggtct

SEQ ID NO: 1228980 - DNA, 22 bp, Artificial Sequence
  chemically synthesized
catgttggtcaggctggtctcg

SEQ ID NO: 1228981 - DNA, 22 bp, Artificial Sequence
  chemically synthesized
aggtcgggagttcgagaccagc

SEQ ID NO: 1228982 - DNA, 22 bp, Artificial Sequence
  chemically synthesized
gtcaggctggtctcgaactccc

SEQ ID NO: 1228983 - DNA, 22 bp, Artificial Sequence
  chemically synthesized
gtctcgaactcccgacctcagg

SEQ ID NO: 1228984 - DNA, 22 bp, Artificial Sequence
  chemically synthesized
gaactcccgacctcaggtgatc

SEQ ID NO: 1228985 - DNA, 22 bp, Artificial Sequence
  chemically synthesized
ccgacctcaggtgatcccgctc

SEQ ID NO: 1228986 - DNA, 22 bp, Artificial Sequence
  chemically synthesized
ggaggccgaggcgagcgggatc

SEQ ID NO: 1228987 - DNA, 22 bp, Artificial Sequence
  chemically synthesized
gggaggccgaggcgagcgggat

SEQ ID NO: 1228988 - DNA, 22 bp, Artificial Sequence
  chemically synthesized
tgggaggccgaggcgagcggga

SEQ ID NO: 1228989 - DNA, 22 bp, Artificial Sequence
  chemically synthesized
aggtgatcccgctcgcctcggc

SEQ ID NO: 1228990 - DNA, 22 bp, Artificial Sequence
  chemically synthesized
gtactttgggaggccgaggcga

SEQ ID NO: 1228991 - DNA, 22 bp, Artificial Sequence
  chemically synthesized
taacctagtactttgggaggcc

SEQ ID NO: 1228992 - DNA, 22 bp, Artificial Sequence
  chemically synthesized
tacctgtaacctagtactttgg

SEQ ID NO: 1228993 - DNA, 22 bp, Artificial Sequence
  chemically synthesized
gcctcggcctcccaaagtacta

SEQ ID NO: 1228994 - DNA, 22 bp, Artificial Sequence
  chemically synthesized
atacctgtaacctagtactttg

SEQ ID NO: 1228995 - DNA, 22 bp, Artificial Sequence
  chemically synthesized
ggcctcccaaagtactaggtta

SEQ ID NO: 1228996 - DNA, 22 bp, Artificial Sequence
  chemically synthesized
ccaaagtactaggttacaggta

SEQ ID NO: 1228997 - DNA, 22 bp, Artificial Sequence
  chemically synthesized
ggcgcagtggcttatacctgta

SEQ ID NO: 1228998 - DNA, 22 bp, Artificial Sequence
  chemically synthesized
ggctgggcgcagtggcttatac

SEQ ID NO: 1228999 - DNA, 22 bp, Artificial Sequence
  chemically synthesized
ggttacaggtataagccactgc

SEQ ID NO: 1229000 - DNA, 22 bp, Artificial Sequence
  chemically synthesized
caggtataagccactgcgccca

SEQ ID NO: 1229001 - DNA, 22 bp, Artificial Sequence
  chemically synthesized
taagtgggagttaggctgggcg

SEQ ID NO: 1229002 - DNA, 22 bp, Artificial Sequence
  chemically synthesized
ataagtgggagttaggctgggc

SEQ ID NO: 1229003 - DNA, 22 bp, Artificial Sequence
  chemically synthesized
acttataagtgggagttaggct

SEQ ID NO: 1229004 - DNA, 22 bp, Artificial Sequence
  chemically synthesized
tcacttataagtgggagttagg

SEQ ID NO: 1229005 - DNA, 22 bp, Artificial Sequence
  chemically synthesized
cgcccagcctaactcccactta

SEQ ID NO: 1229006 - DNA, 22 bp, Artificial Sequence
  chemically synthesized
actcccacttataagtgagaac

SEQ ID NO: 1229007 - DNA, 22 bp, Artificial Sequence
  chemically synthesized
ccacttataagtgagaacatgt

SEQ ID NO: 1229008 - DNA, 22 bp, Artificial Sequence
  chemically synthesized
ataagtgagaacatgtgatatt

SEQ ID NO: 1229009 - DNA, 22 bp, Artificial Sequence
  chemically synthesized
taagtgagaacatgtgatattt

SEQ ID NO: 1229010 - DNA, 22 bp, Artificial Sequence
  chemically synthesized
gtgcatgaacagaaaaccaaat

SEQ ID NO: 1229011 - DNA, 22 bp, Artificial Sequence
  chemically synthesized
gcaaactagtgcatgaacagaa

SEQ ID NO: 1229012 - DNA, 22 bp, Artificial Sequence
  chemically synthesized
agcaaactagtgcatgaacaga

SEQ ID NO: 1229013 - DNA, 22 bp, Artificial Sequence
  chemically synthesized
tccttagcaaactagtgcatga

SEQ ID NO: 1229014 - DNA, 22 bp, Artificial Sequence
  chemically synthesized
ggttttctgttcatgcactagt

SEQ ID NO: 1229015 - DNA, 22 bp, Artificial Sequence
  chemically synthesized
gttttctgttcatgcactagtt

SEQ ID NO: 1229016 - DNA, 22 bp, Artificial Sequence
  chemically synthesized
tctgttcatgcactagtttgct

SEQ ID NO: 1229017 - DNA, 22 bp, Artificial Sequence
  chemically synthesized
ctgttcatgcactagtttgcta

SEQ ID NO: 1229018 - DNA, 22 bp, Artificial Sequence
  chemically synthesized
tgttcatgcactagtttgctaa

SEQ ID NO: 1229019 - DNA, 22 bp, Artificial Sequence
  chemically synthesized
gagccgttatccttagcaaact

SEQ ID NO: 1229020 - DNA, 22 bp, Artificial Sequence
  chemically synthesized
ttcatgcactagtttgctaagg

SEQ ID NO: 1229021 - DNA, 22 bp, Artificial Sequence
  chemically synthesized
atgcactagtttgctaaggata

SEQ ID NO: 1229022 - DNA, 22 bp, Artificial Sequence
  chemically synthesized
gtttgctaaggataacggctcc

SEQ ID NO: 1229023 - DNA, 22 bp, Artificial Sequence
  chemically synthesized
gctaaggataacggctccagct

SEQ ID NO: 1229024 - DNA, 22 bp, Artificial Sequence
  chemically synthesized
ctaaggataacggctccagctg

SEQ ID NO: 1229025 - DNA, 22 bp, Artificial Sequence
  chemically synthesized
tagcaacatggatgcagctgga

SEQ ID NO: 1229026 - DNA, 22 bp, Artificial Sequence
  chemically synthesized
aggataacggctccagctgcat

SEQ ID NO: 1229027 - DNA, 22 bp, Artificial Sequence
  chemically synthesized
cagctgcatccatgttgctaca

SEQ ID NO: 1229028 - DNA, 22 bp, Artificial Sequence
  chemically synthesized
catccatgttgctacaatctta

SEQ ID NO: 1229029 - DNA, 22 bp, Artificial Sequence
  chemically synthesized
ctacaatcttatttttgtctgg

SEQ ID NO: 1229030 - DNA, 22 bp, Artificial Sequence
  chemically synthesized
caatcttatttttgtctgggtt

SEQ ID NO: 1229031 - DNA, 22 bp, Artificial Sequence
  chemically synthesized
atttttgtctgggttgtattcc

SEQ ID NO: 1229032 - DNA, 22 bp, Artificial Sequence
  chemically synthesized
catatacaccatggaatacaac

SEQ ID NO: 1229033 - DNA, 22 bp, Artificial Sequence
  chemically synthesized
tttttgtctgggttgtattcca

SEQ ID NO: 1229034 - DNA, 22 bp, Artificial Sequence
  chemically synthesized
ttgtctgggttgtattccatgg

SEQ ID NO: 1229035 - DNA, 22 bp, Artificial Sequence
  chemically synthesized
tgtctgggttgtattccatggt

SEQ ID NO: 1229036 - DNA, 22 bp, Artificial Sequence
  chemically synthesized
gtctgggttgtattccatggtg

SEQ ID NO: 1229037 - DNA, 22 bp, Artificial Sequence
  chemically synthesized
tctgggttgtattccatggtgt

SEQ ID NO: 1229038 - DNA, 22 bp, Artificial Sequence
  chemically synthesized
ggttgtattccatggtgtatat

SEQ ID NO: 1229039 - DNA, 22 bp, Artificial Sequence
  chemically synthesized
agaaaatatgctacatatacac

SEQ ID NO: 1229040 - DNA, 22 bp, Artificial Sequence
  chemically synthesized
tattccatggtgtatatgtagc

SEQ ID NO: 1229041 - DNA, 22 bp, Artificial Sequence
  chemically synthesized
attaagaaaatatgctacatat

SEQ ID NO: 1229042 - DNA, 22 bp, Artificial Sequence
  chemically synthesized
catggtgtatatgtagcatatt

SEQ ID NO: 1229043 - DNA, 22 bp, Artificial Sequence
  chemically synthesized
tcttaatcagtctactgttgat

SEQ ID NO: 1229044 - DNA, 22 bp, Artificial Sequence
  chemically synthesized
cttaatcagtctactgttgatg

SEQ ID NO: 1229045 - DNA, 22 bp, Artificial Sequence
  chemically synthesized
ttaatcagtctactgttgatgg

SEQ ID NO: 1229046 - DNA, 22 bp, Artificial Sequence
  chemically synthesized
aatcagtctactgttgatggac

SEQ ID NO: 1229047 - DNA, 22 bp, Artificial Sequence
  chemically synthesized
atcagtctactgttgatggaca

SEQ ID NO: 1229048 - DNA, 22 bp, Artificial Sequence
  chemically synthesized
ctgttgatggacatttatgttg

SEQ ID NO: 1229049 - DNA, 22 bp, Artificial Sequence
  chemically synthesized
ttgatggacatttatgttgatt

SEQ ID NO: 1229050 - DNA, 22 bp, Artificial Sequence
  chemically synthesized
atggacatttatgttgattccc

SEQ ID NO: 1229051 - DNA, 22 bp, Artificial Sequence
  chemically synthesized
acagtagcaaagatggggaatc

SEQ ID NO: 1229052 - DNA, 22 bp, Artificial Sequence
  chemically synthesized
ttcacagtagcaaagatgggga

SEQ ID NO: 1229053 - DNA, 22 bp, Artificial Sequence
  chemically synthesized
atgttgattccccatctttgct

SEQ ID NO: 1229054 - DNA, 22 bp, Artificial Sequence
  chemically synthesized
tgttgattccccatctttgcta

SEQ ID NO: 1229055 - DNA, 22 bp, Artificial Sequence
  chemically synthesized
cagcactattcacagtagcaaa

SEQ ID NO: 1229056 - DNA, 22 bp, Artificial Sequence
  chemically synthesized
attccccatctttgctactgtg

SEQ ID NO: 1229057 - DNA, 22 bp, Artificial Sequence
  chemically synthesized
ttgcagcactattcacagtagc

SEQ ID NO: 1229058 - DNA, 22 bp, Artificial Sequence
  chemically synthesized
attgcagcactattcacagtag

SEQ ID NO: 1229059 - DNA, 22 bp, Artificial Sequence
  chemically synthesized
cccatctttgctactgtgaata

SEQ ID NO: 1229060 - DNA, 22 bp, Artificial Sequence
  chemically synthesized
tgctactgtgaatagtgctgca

SEQ ID NO: 1229061 - DNA, 22 bp, Artificial Sequence
  chemically synthesized
gctactgtgaatagtgctgcaa

SEQ ID NO: 1229062 - DNA, 22 bp, Artificial Sequence
  chemically synthesized
ctactgtgaatagtgctgcaat

SEQ ID NO: 1229063 - DNA, 22 bp, Artificial Sequence
  chemically synthesized
ctgtgaatagtgctgcaataaa

SEQ ID NO: 1229064 - DNA, 22 bp, Artificial Sequence
  chemically synthesized
tgaatagtgctgcaataaacat

SEQ ID NO: 1229065 - DNA, 22 bp, Artificial Sequence
  chemically synthesized
cgataaagacacatgcacatat

SEQ ID NO: 1229066 - DNA, 22 bp, Artificial Sequence
  chemically synthesized
caataaacatatatgtgcatgt

SEQ ID NO: 1229067 - DNA, 22 bp, Artificial Sequence
  chemically synthesized
tacgataaagacacatgcacat

SEQ ID NO: 1229068 - DNA, 22 bp, Artificial Sequence
  chemically synthesized
ttctacgataaagacacatgca

SEQ ID NO: 1229069 - DNA, 22 bp, Artificial Sequence
  chemically synthesized
tatcgtagaacaatttatattc

SEQ ID NO: 1229070 - DNA, 22 bp, Artificial Sequence
  chemically synthesized
atcgtagaacaatttatattcc

SEQ ID NO: 1229071 - DNA, 22 bp, Artificial Sequence
  chemically synthesized
tcgtagaacaatttatattcct

SEQ ID NO: 1229072 - DNA, 22 bp, Artificial Sequence
  chemically synthesized
gtatatacccaaaggaatataa

SEQ ID NO: 1229073 - DNA, 22 bp, Artificial Sequence
  chemically synthesized
ggtatatacccaaaggaatata

SEQ ID NO: 1229074 - DNA, 22 bp, Artificial Sequence
  chemically synthesized
tttggtatatacccaaaggaat

SEQ ID NO: 1229075 - DNA, 22 bp, Artificial Sequence
  chemically synthesized
attatttggtatatacccaaag

SEQ ID NO: 1229076 - DNA, 22 bp, Artificial Sequence
  chemically synthesized
atattcctttgggtatatacca

SEQ ID NO: 1229077 - DNA, 22 bp, Artificial Sequence
  chemically synthesized
tattcctttgggtatataccaa

SEQ ID NO: 1229078 - DNA, 22 bp, Artificial Sequence
  chemically synthesized
ctttgggtatataccaaataat

SEQ ID NO: 1229079 - DNA, 22 bp, Artificial Sequence
  chemically synthesized
aacccagcaacctcattatttg

SEQ ID NO: 1229080 - DNA, 22 bp, Artificial Sequence
  chemically synthesized
tgggtatataccaaataatgag

SEQ ID NO: 1229081 - DNA, 22 bp, Artificial Sequence
  chemically synthesized
gggtatataccaaataatgagg

SEQ ID NO: 1229082 - DNA, 22 bp, Artificial Sequence
  chemically synthesized
ggtatataccaaataatgaggt

SEQ ID NO: 1229083 - DNA, 22 bp, Artificial Sequence
  chemically synthesized
aaacagaaataccattcaaccc

SEQ ID NO: 1229084 - DNA, 22 bp, Artificial Sequence
  chemically synthesized
ctgggttgaatggtatttctgt

SEQ ID NO: 1229085 - DNA, 22 bp, Artificial Sequence
  chemically synthesized
aaagaagttaaaacagaaatac

SEQ ID NO: 1229086 - DNA, 22 bp, Artificial Sequence
  chemically synthesized
ggttgaatggtatttctgtttt

SEQ ID NO: 1229087 - DNA, 22 bp, Artificial Sequence
  chemically synthesized
ctcaaagaagttaaaacagaaa

SEQ ID NO: 1229088 - DNA, 22 bp, Artificial Sequence
  chemically synthesized
aatggtatttctgttttaactt

SEQ ID NO: 1229089 - DNA, 22 bp, Artificial Sequence
  chemically synthesized
ctgttttaacttctttgaggaa

SEQ ID NO: 1229090 - DNA, 22 bp, Artificial Sequence
  chemically synthesized
tgttttaacttctttgaggaat

SEQ ID NO: 1229091 - DNA, 22 bp, Artificial Sequence
  chemically synthesized
ttttaacttctttgaggaatca

SEQ ID NO: 1229092 - DNA, 22 bp, Artificial Sequence
  chemically synthesized
taacttctttgaggaatcacca

SEQ ID NO: 1229093 - DNA, 22 bp, Artificial Sequence
  chemically synthesized
tggaaagcagtgtggtgattcc

SEQ ID NO: 1229094 - DNA, 22 bp, Artificial Sequence
  chemically synthesized
aacttctttgaggaatcaccac

SEQ ID NO: 1229095 - DNA, 22 bp, Artificial Sequence
  chemically synthesized
acttctttgaggaatcaccaca

SEQ ID NO: 1229096 - DNA, 22 bp, Artificial Sequence
  chemically synthesized
ctttgaggaatcaccacactgc

SEQ ID NO: 1229097 - DNA, 22 bp, Artificial Sequence
  chemically synthesized
ccattgtggaaagcagtgtggt

SEQ ID NO: 1229098 - DNA, 22 bp, Artificial Sequence
  chemically synthesized
tttgaggaatcaccacactgct

SEQ ID NO: 1229099 - DNA, 22 bp, Artificial Sequence
  chemically synthesized
tgccattgtggaaagcagtgtg

SEQ ID NO: 1229100 - DNA, 22 bp, Artificial Sequence
  chemically synthesized
tgaggaatcaccacactgcttt

SEQ ID NO: 1229101 - DNA, 22 bp, Artificial Sequence
  chemically synthesized
gaggaatcaccacactgctttc

SEQ ID NO: 1229102 - DNA, 22 bp, Artificial Sequence
  chemically synthesized
aggaatcaccacactgctttcc

SEQ ID NO: 1229103 - DNA, 22 bp, Artificial Sequence
  chemically synthesized
atcaattctgccattgtggaaa

SEQ ID NO: 1229104 - DNA, 22 bp, Artificial Sequence
  chemically synthesized
ctttccacaatggcagaattga

SEQ ID NO: 1229105 - DNA, 22 bp, Artificial Sequence
  chemically synthesized
gtgggaatgttaatcaattctg

SEQ ID NO: 1229106 - DNA, 22 bp, Artificial Sequence
  chemically synthesized
tccacaatggcagaattgatta

SEQ ID NO: 1229107 - DNA, 22 bp, Artificial Sequence
  chemically synthesized
ccacaatggcagaattgattaa

SEQ ID NO: 1229108 - DNA, 22 bp, Artificial Sequence
  chemically synthesized
ctggtgggaatgttaatcaatt

SEQ ID NO: 1229109 - DNA, 22 bp, Artificial Sequence
  chemically synthesized
cacaatggcagaattgattaac

SEQ ID NO: 1229110 - DNA, 22 bp, Artificial Sequence
  chemically synthesized
attaacattcccaccagcagtc

SEQ ID NO: 1229111 - DNA, 22 bp, Artificial Sequence
  chemically synthesized
gccaggtgtggtgactgctggt

SEQ ID NO: 1229112 - DNA, 22 bp, Artificial Sequence
  chemically synthesized
acattcccaccagcagtcacca

SEQ ID NO: 1229113 - DNA, 22 bp, Artificial Sequence
  chemically synthesized
ccaccagcagtcaccacacctg

SEQ ID NO: 1229114 - DNA, 22 bp, Artificial Sequence
  chemically synthesized
aaaatgtatgcataagatattg

SEQ ID NO: 1229115 - DNA, 22 bp, Artificial Sequence
  chemically synthesized
gccaatatcttatgcatacatt

SEQ ID NO: 1229116 - DNA, 22 bp, Artificial Sequence
  chemically synthesized
atgcatacattttcagatactg

SEQ ID NO: 1229117 - DNA, 22 bp, Artificial Sequence
  chemically synthesized
tgcatacattttcagatactga

SEQ ID NO: 1229118 - DNA, 22 bp, Artificial Sequence
  chemically synthesized
taataacagtagaagcatcagt

SEQ ID NO: 1229119 - DNA, 22 bp, Artificial Sequence
  chemically synthesized
ttataataacagtagaagcatc

SEQ ID NO: 1229120 - DNA, 22 bp, Artificial Sequence
  chemically synthesized
tcagatactgatgcttctactg

SEQ ID NO: 1229121 - DNA, 22 bp, Artificial Sequence
  chemically synthesized
cagatactgatgcttctactgt

SEQ ID NO: 1229122 - DNA, 22 bp, Artificial Sequence
  chemically synthesized
agatactgatgcttctactgtt

SEQ ID NO: 1229123 - DNA, 22 bp, Artificial Sequence
  chemically synthesized
tgaattgttataataacagtag

SEQ ID NO: 1229124 - DNA, 22 bp, Artificial Sequence
  chemically synthesized
atgcttctactgttattataac

SEQ ID NO: 1229125 - DNA, 22 bp, Artificial Sequence
  chemically synthesized
ctactgttattataacaattca

SEQ ID NO: 1229126 - DNA, 22 bp, Artificial Sequence
  chemically synthesized
tactgttattataacaattcac

SEQ ID NO: 1229127 - DNA, 22 bp, Artificial Sequence
  chemically synthesized
ctgttattataacaattcacag

SEQ ID NO: 1229128 - DNA, 22 bp, Artificial Sequence
  chemically synthesized
ttattataacaattcacaggat

SEQ ID NO: 1229129 - DNA, 22 bp, Artificial Sequence
  chemically synthesized
atccagtatatacatcctgtga

SEQ ID NO: 1229130 - DNA, 22 bp, Artificial Sequence
  chemically synthesized
ttataacaattcacaggatgta

SEQ ID NO: 1229131 - DNA, 22 bp, Artificial Sequence
  chemically synthesized
tgatccagtatatacatcctgt

SEQ ID NO: 1229132 - DNA, 22 bp, Artificial Sequence
  chemically synthesized
taacaattcacaggatgtatat

SEQ ID NO: 1229133 - DNA, 22 bp, Artificial Sequence
  chemically synthesized
acaggatgtatatactggatca

SEQ ID NO: 1229134 - DNA, 22 bp, Artificial Sequence
  chemically synthesized
gatcagagtgtgtgtatacaca

SEQ ID NO: 1229135 - DNA, 22 bp, Artificial Sequence
  chemically synthesized
gagcagagtgtgtgtgtgtgtg

SEQ ID NO: 1229136 - DNA, 22 bp, Artificial Sequence
  chemically synthesized
ctagagcagagtgtgtgtgtgt

SEQ ID NO: 1229137 - DNA, 22 bp, Artificial Sequence
  chemically synthesized
tgctctagtagatacatctata

SEQ ID NO: 1229138 - DNA, 22 bp, Artificial Sequence
  chemically synthesized
ctctagtagatacatctataca

SEQ ID NO: 1229139 - DNA, 22 bp, Artificial Sequence
  chemically synthesized
tagtagatacatctatacatat

SEQ ID NO: 1229140 - DNA, 22 bp, Artificial Sequence
  chemically synthesized
gtagatacatctatacatatat

SEQ ID NO: 1229141 - DNA, 22 bp, Artificial Sequence
  chemically synthesized
aaatgatgcgtatatatatatg

SEQ ID NO: 1229142 - DNA, 22 bp, Artificial Sequence
  chemically synthesized
cctgaaatgatgcgtatatata

SEQ ID NO: 1229143 - DNA, 22 bp, Artificial Sequence
  chemically synthesized
tacatatatatatacgcatcat

SEQ ID NO: 1229144 - DNA, 22 bp, Artificial Sequence
  chemically synthesized
tatctccctgaaatgatgcgta

SEQ ID NO: 1229145 - DNA, 22 bp, Artificial Sequence
  chemically synthesized
tatagatatgtctatatctccc

SEQ ID NO: 1229146 - DNA, 22 bp, Artificial Sequence
  chemically synthesized
gtatagatatgtctatatctcc

SEQ ID NO: 1229147 - DNA, 22 bp, Artificial Sequence
  chemically synthesized
cagggagatatagacatatcta

SEQ ID NO: 1229148 - DNA, 22 bp, Artificial Sequence
  chemically synthesized
agggagatatagacatatctat

SEQ ID NO: 1229149 - DNA, 22 bp, Artificial Sequence
  chemically synthesized
tacaagtatatgtgtatctaca

SEQ ID NO: 1229150 - DNA, 22 bp, Artificial Sequence
  chemically synthesized
cacatatacacatatatatcta

SEQ ID NO: 1229151 - DNA, 22 bp, Artificial Sequence
  chemically synthesized
tacatctatacacatatataca

SEQ ID NO: 1229152 - DNA, 22 bp, Artificial Sequence
  chemically synthesized
tacacatatatacatatgtata

SEQ ID NO: 1229153 - DNA, 22 bp, Artificial Sequence
  chemically synthesized
tacacatatatacatatgtata

SEQ ID NO: 1229154 - DNA, 22 bp, Artificial Sequence
  chemically synthesized
tatacatatatacatacacaca

SEQ ID NO: 1229155 - DNA, 22 bp, Artificial Sequence
  chemically synthesized
catatatatgtgtatatatgtg

SEQ ID NO: 1229156 - DNA, 22 bp, Artificial Sequence
  chemically synthesized
aaattacatatatatgtgtata

SEQ ID NO: 1229157 - DNA, 22 bp, Artificial Sequence
  chemically synthesized
ctaaaattacatatatatgtgt

SEQ ID NO: 1229158 - DNA, 22 bp, Artificial Sequence
  chemically synthesized
ggaaggcaggtggaaacaccta

SEQ ID NO: 1229159 - DNA, 22 bp, Artificial Sequence
  chemically synthesized
taggaaggcaggtggaaacacc

SEQ ID NO: 1229160 - DNA, 22 bp, Artificial Sequence
  chemically synthesized
ctaggaaggcaggtggaaacac

SEQ ID NO: 1229161 - DNA, 22 bp, Artificial Sequence
  chemically synthesized
tttctaggaaggcaggtggaaa

SEQ ID NO: 1229162 - DNA, 22 bp, Artificial Sequence
  chemically synthesized
tagtaggtgtttccacctgcct

SEQ ID NO: 1229163 - DNA, 22 bp, Artificial Sequence
  chemically synthesized
agtaggtgtttccacctgcctt

SEQ ID NO: 1229164 - DNA, 22 bp, Artificial Sequence
  chemically synthesized
gtaggtgtttccacctgccttc

SEQ ID NO: 1229165 - DNA, 22 bp, Artificial Sequence
  chemically synthesized
aattgtttctaggaaggcaggt

SEQ ID NO: 1229166 - DNA, 22 bp, Artificial Sequence
  chemically synthesized
taaattgtttctaggaaggcag

SEQ ID NO: 1229167 - DNA, 22 bp, Artificial Sequence
  chemically synthesized
ccacctgccttcctagaaacaa

SEQ ID NO: 1229168 - DNA, 22 bp, Artificial Sequence
  chemically synthesized
cacctgccttcctagaaacaat

SEQ ID NO: 1229169 - DNA, 22 bp, Artificial Sequence
  chemically synthesized
aaatatgtaattctaaattgtt

SEQ ID NO: 1229170 - DNA, 22 bp, Artificial Sequence
  chemically synthesized
ccttcctagaaacaatttagaa

SEQ ID NO: 1229171 - DNA, 22 bp, Artificial Sequence
  chemically synthesized
gttaaaatatgtaattctaaat

SEQ ID NO: 1229172 - DNA, 22 bp, Artificial Sequence
  chemically synthesized
cctagaaacaatttagaattac

SEQ ID NO: 1229173 - DNA, 22 bp, Artificial Sequence
  chemically synthesized
tggttaaaatatgtaattctaa

SEQ ID NO: 1229174 - DNA, 22 bp, Artificial Sequence
  chemically synthesized
ctagaaacaatttagaattaca

SEQ ID NO: 1229175 - DNA, 22 bp, Artificial Sequence
  chemically synthesized
gaaacaatttagaattacatat

SEQ ID NO: 1229176 - DNA, 22 bp, Artificial Sequence
  chemically synthesized
tacattctggttaaaatatgta

SEQ ID NO: 1229177 - DNA, 22 bp, Artificial Sequence
  chemically synthesized
atacattctggttaaaatatgt

SEQ ID NO: 1229178 - DNA, 22 bp, Artificial Sequence
  chemically synthesized
ttatacattctggttaaaatat

SEQ ID NO: 1229179 - DNA, 22 bp, Artificial Sequence
  chemically synthesized
ttcttatacattctggttaaaa

SEQ ID NO: 1229180 - DNA, 22 bp, Artificial Sequence
  chemically synthesized
agaattacatattttaaccaga

SEQ ID NO: 1229181 - DNA, 22 bp, Artificial Sequence
  chemically synthesized
gaattacatattttaaccagaa

SEQ ID NO: 1229182 - DNA, 22 bp, Artificial Sequence
  chemically synthesized
catattttaaccagaatgtata

SEQ ID NO: 1229183 - DNA, 22 bp, Artificial Sequence
  chemically synthesized
taaccagaatgtataagaatag

SEQ ID NO: 1229184 - DNA, 22 bp, Artificial Sequence
  chemically synthesized
aaccagaatgtataagaatagg

SEQ ID NO: 1229185 - DNA, 22 bp, Artificial Sequence
  chemically synthesized
gtgagagaagagcctattctta

SEQ ID NO: 1229186 - DNA, 22 bp, Artificial Sequence
  chemically synthesized
accagaatgtataagaataggc

SEQ ID NO: 1229187 - DNA, 22 bp, Artificial Sequence
  chemically synthesized
ctggtgagagaagagcctattc

SEQ ID NO: 1229188 - DNA, 22 bp, Artificial Sequence
  chemically synthesized
cctggtgagagaagagcctatt

SEQ ID NO: 1229189 - DNA, 22 bp, Artificial Sequence
  chemically synthesized
ttctctcaccaggaaatttttg

SEQ ID NO: 1229190 - DNA, 22 bp, Artificial Sequence
  chemically synthesized
ctctcaccaggaaatttttgtt

SEQ ID NO: 1229191 - DNA, 22 bp, Artificial Sequence
  chemically synthesized
tctcaccaggaaatttttgttt

SEQ ID NO: 1229192 - DNA, 22 bp, Artificial Sequence
  chemically synthesized
tcaccaggaaatttttgttttg

SEQ ID NO: 1229193 - DNA, 22 bp, Artificial Sequence
  chemically synthesized
aaagaatcaaaaacaaaacaaa

SEQ ID NO: 1229194 - DNA, 22 bp, Artificial Sequence
  chemically synthesized
accaggaaatttttgttttgtt

SEQ ID NO: 1229195 - DNA, 22 bp, Artificial Sequence
  chemically synthesized
ttgttttgtttttgattctttt

SEQ ID NO: 1229196 - DNA, 22 bp, Artificial Sequence
  chemically synthesized
tgttttgtttttgattctttta

SEQ ID NO: 1229197 - DNA, 22 bp, Artificial Sequence
  chemically synthesized
gttttgtttttgattcttttag

SEQ ID NO: 1229198 - DNA, 22 bp, Artificial Sequence
  chemically synthesized
ttttgtttttgattcttttagt

SEQ ID NO: 1229199 - DNA, 22 bp, Artificial Sequence
  chemically synthesized
atcatacaaacaaaactaaaag

SEQ ID NO: 1229200 - DNA, 22 bp, Artificial Sequence
  chemically synthesized
tgtttttgattcttttagtttt

SEQ ID NO: 1229201 - DNA, 22 bp, Artificial Sequence
  chemically synthesized
gatcatacaaacaaaactaaaa

SEQ ID NO: 1229202 - DNA, 22 bp, Artificial Sequence
  chemically synthesized
gtttttgattcttttagttttg

SEQ ID NO: 1229203 - DNA, 22 bp, Artificial Sequence
  chemically synthesized
tttttgattcttttagttttgt

SEQ ID NO: 1229204 - DNA, 22 bp, Artificial Sequence
  chemically synthesized
ttgattcttttagttttgtttg

SEQ ID NO: 1229205 - DNA, 22 bp, Artificial Sequence
  chemically synthesized
tgattcttttagttttgtttgt

SEQ ID NO: 1229206 - DNA, 22 bp, Artificial Sequence
  chemically synthesized
gattcttttagttttgtttgta

SEQ ID NO: 1229207 - DNA, 22 bp, Artificial Sequence
  chemically synthesized
attcttttagttttgtttgtat

SEQ ID NO: 1229208 - DNA, 22 bp, Artificial Sequence
  chemically synthesized
ttttagttttgtttgtatgatc

SEQ ID NO: 1229209 - DNA, 22 bp, Artificial Sequence
  chemically synthesized
ttagttttgtttgtatgatcaa

SEQ ID NO: 1229210 - DNA, 22 bp, Artificial Sequence
  chemically synthesized
tagttttgtttgtatgatcaaa

SEQ ID NO: 1229211 - DNA, 22 bp, Artificial Sequence
  chemically synthesized
agttttgtttgtatgatcaaat

SEQ ID NO: 1229212 - DNA, 22 bp, Artificial Sequence
  chemically synthesized
acaaagtgatgtatttgatcat

SEQ ID NO: 1229213 - DNA, 22 bp, Artificial Sequence
  chemically synthesized
gttttgtttgtatgatcaaata

SEQ ID NO: 1229214 - DNA, 22 bp, Artificial Sequence
  chemically synthesized
tgtttgtatgatcaaatacatc

SEQ ID NO: 1229215 - DNA, 22 bp, Artificial Sequence
  chemically synthesized
gtttgtatgatcaaatacatca

SEQ ID NO: 1229216 - DNA, 22 bp, Artificial Sequence
  chemically synthesized
tttgtatgatcaaatacatcac

SEQ ID NO: 1229217 - DNA, 22 bp, Artificial Sequence
  chemically synthesized
gtatgatcaaatacatcacttt

SEQ ID NO: 1229218 - DNA, 22 bp, Artificial Sequence
  chemically synthesized
tatgatcaaatacatcactttg

SEQ ID NO: 1229219 - DNA, 22 bp, Artificial Sequence
  chemically synthesized
tgttaacttttatttccatgat

SEQ ID NO: 1229220 - DNA, 22 bp, Artificial Sequence
  chemically synthesized
gttaacttttatttccatgatt

SEQ ID NO: 1229221 - DNA, 22 bp, Artificial Sequence
  chemically synthesized
aaatgcacaaggaatcatggaa

SEQ ID NO: 1229222 - DNA, 22 bp, Artificial Sequence
  chemically synthesized
ttaacttttatttccatgattc

SEQ ID NO: 1229223 - DNA, 22 bp, Artificial Sequence
  chemically synthesized
acttttatttccatgattcctt

SEQ ID NO: 1229224 - DNA, 22 bp, Artificial Sequence
  chemically synthesized
ttatttccatgattccttgtgc

SEQ ID NO: 1229225 - DNA, 22 bp, Artificial Sequence
  chemically synthesized
tatttccatgattccttgtgca

SEQ ID NO: 1229226 - DNA, 22 bp, Artificial Sequence
  chemically synthesized
atttccatgattccttgtgcat

SEQ ID NO: 1229227 - DNA, 22 bp, Artificial Sequence
  chemically synthesized
tttccatgattccttgtgcatt

SEQ ID NO: 1229228 - DNA, 22 bp, Artificial Sequence
  chemically synthesized
ccatgattccttgtgcatttga

SEQ ID NO: 1229229 - DNA, 22 bp, Artificial Sequence
  chemically synthesized
catgattccttgtgcatttgaa

SEQ ID NO: 1229230 - DNA, 22 bp, Artificial Sequence
  chemically synthesized
cttgtgcatttgaatatatttt

SEQ ID NO: 1229231 - DNA, 22 bp, Artificial Sequence
  chemically synthesized
gtgcatttgaatatatttttgt

SEQ ID NO: 1229232 - DNA, 22 bp, Artificial Sequence
  chemically synthesized
tgcatttgaatatatttttgta

SEQ ID NO: 1229233 - DNA, 22 bp, Artificial Sequence
  chemically synthesized
taataggtcagtgatacaaaaa

SEQ ID NO: 1229234 - DNA, 22 bp, Artificial Sequence
  chemically synthesized
gaatatatttttgtatcactga

SEQ ID NO: 1229235 - DNA, 22 bp, Artificial Sequence
  chemically synthesized
aatatatttttgtatcactgac

SEQ ID NO: 1229236 - DNA, 22 bp, Artificial Sequence
  chemically synthesized
acacatggaattgtaataggtc

SEQ ID NO: 1229237 - DNA, 22 bp, Artificial Sequence
  chemically synthesized
ttgtatcactgacctattacaa

SEQ ID NO: 1229238 - DNA, 22 bp, Artificial Sequence
  chemically synthesized
tgtatcactgacctattacaat

SEQ ID NO: 1229239 - DNA, 22 bp, Artificial Sequence
  chemically synthesized
gtatcactgacctattacaatt

SEQ ID NO: 1229240 - DNA, 22 bp, Artificial Sequence
  chemically synthesized
tatcactgacctattacaattc

SEQ ID NO: 1229241 - DNA, 22 bp, Artificial Sequence
  chemically synthesized
acagacaattcacacatggaat

SEQ ID NO: 1229242 - DNA, 22 bp, Artificial Sequence
  chemically synthesized
acctattacaattccatgtgtg

SEQ ID NO: 1229243 - DNA, 22 bp, Artificial Sequence
  chemically synthesized
ttacaattccatgtgtgaattg

SEQ ID NO: 1229244 - DNA, 22 bp, Artificial Sequence
  chemically synthesized
caattccatgtgtgaattgtct

SEQ ID NO: 1229245 - DNA, 22 bp, Artificial Sequence
  chemically synthesized
catgtgtgaattgtctgttaat

SEQ ID NO: 1229246 - DNA, 22 bp, Artificial Sequence
  chemically synthesized
atgagcaaaacatattaacaga

SEQ ID NO: 1229247 - DNA, 22 bp, Artificial Sequence
  chemically synthesized
tctgttaatatgttttgctcat

SEQ ID NO: 1229248 - DNA, 22 bp, Artificial Sequence
  chemically synthesized
ccatatagaaattaatgagcaa

SEQ ID NO: 1229249 - DNA, 22 bp, Artificial Sequence
  chemically synthesized
ttaatatgttttgctcattaat

SEQ ID NO: 1229250 - DNA, 22 bp, Artificial Sequence
  chemically synthesized
atatgttttgctcattaatttc

SEQ ID NO: 1229251 - DNA, 22 bp, Artificial Sequence
  chemically synthesized
tgctcattaatttctatatggt

SEQ ID NO: 1229252 - DNA, 22 bp, Artificial Sequence
  chemically synthesized
gctcattaatttctatatggta

SEQ ID NO: 1229253 - DNA, 22 bp, Artificial Sequence
  chemically synthesized
ctcattaatttctatatggtag

SEQ ID NO: 1229254 - DNA, 22 bp, Artificial Sequence
  chemically synthesized
attaatttctatatggtagttt

SEQ ID NO: 1229255 - DNA, 22 bp, Artificial Sequence
  chemically synthesized
aagaaggaaaagaaaactacca

SEQ ID NO: 1229256 - DNA, 22 bp, Artificial Sequence
  chemically synthesized
atttctatatggtagttttctt

SEQ ID NO: 1229257 - DNA, 22 bp, Artificial Sequence
  chemically synthesized
aaattcaagaaggaaaagaaaa

SEQ ID NO: 1229258 - DNA, 22 bp, Artificial Sequence
  chemically synthesized
ctatatggtagttttcttttcc

SEQ ID NO: 1229259 - DNA, 22 bp, Artificial Sequence
  chemically synthesized
aaaattcaagaaggaaaagaaa

SEQ ID NO: 1229260 - DNA, 22 bp, Artificial Sequence
  chemically synthesized
tatatggtagttttcttttcct

SEQ ID NO: 1229261 - DNA, 22 bp, Artificial Sequence
  chemically synthesized
ttaaaattcaagaaggaaaaga

SEQ ID NO: 1229262 - DNA, 22 bp, Artificial Sequence
  chemically synthesized
tatggtagttttcttttccttc

SEQ ID NO: 1229263 - DNA, 22 bp, Artificial Sequence
  chemically synthesized
ccaagagctcttaaaattcaag

SEQ ID NO: 1229264 - DNA, 22 bp, Artificial Sequence
  chemically synthesized
accaagagctcttaaaattcaa

SEQ ID NO: 1229265 - DNA, 22 bp, Artificial Sequence
  chemically synthesized
tcttttccttcttgaattttaa

SEQ ID NO: 1229266 - DNA, 22 bp, Artificial Sequence
  chemically synthesized
cttttccttcttgaattttaag

SEQ ID NO: 1229267 - DNA, 22 bp, Artificial Sequence
  chemically synthesized
ttttccttcttgaattttaaga

SEQ ID NO: 1229268 - DNA, 22 bp, Artificial Sequence
  chemically synthesized
tttaccaagagctcttaaaatt

SEQ ID NO: 1229269 - DNA, 22 bp, Artificial Sequence
  chemically synthesized
atttaccaagagctcttaaaat

SEQ ID NO: 1229270 - DNA, 22 bp, Artificial Sequence
  chemically synthesized
ttccttcttgaattttaagagc

SEQ ID NO: 1229271 - DNA, 22 bp, Artificial Sequence
  chemically synthesized
tccttcttgaattttaagagct

SEQ ID NO: 1229272 - DNA, 22 bp, Artificial Sequence
  chemically synthesized
ttatttaccaagagctcttaaa

SEQ ID NO: 1229273 - DNA, 22 bp, Artificial Sequence
  chemically synthesized
ccttcttgaattttaagagctc

SEQ ID NO: 1229274 - DNA, 22 bp, Artificial Sequence
  chemically synthesized
cttcttgaattttaagagctct

SEQ ID NO: 1229275 - DNA, 22 bp, Artificial Sequence
  chemically synthesized
tctcttatttaccaagagctct

SEQ ID NO: 1229276 - DNA, 22 bp, Artificial Sequence
  chemically synthesized
cttgaattttaagagctcttgg

SEQ ID NO: 1229277 - DNA, 22 bp, Artificial Sequence
  chemically synthesized
ttgaattttaagagctcttggt

SEQ ID NO: 1229278 - DNA, 22 bp, Artificial Sequence
  chemically synthesized
gaattttaagagctcttggtaa

SEQ ID NO: 1229279 - DNA, 22 bp, Artificial Sequence
  chemically synthesized
aattttaagagctcttggtaaa

SEQ ID NO: 1229280 - DNA, 22 bp, Artificial Sequence
  chemically synthesized
caaatgttatctcttatttacc

SEQ ID NO: 1229281 - DNA, 22 bp, Artificial Sequence
  chemically synthesized
taagagctcttggtaaataaga

SEQ ID NO: 1229282 - DNA, 22 bp, Artificial Sequence
  chemically synthesized
aagagctcttggtaaataagag

SEQ ID NO: 1229283 - DNA, 22 bp, Artificial Sequence
  chemically synthesized
tacaaatgttatctcttattta

SEQ ID NO: 1229284 - DNA, 22 bp, Artificial Sequence
  chemically synthesized
agagctcttggtaaataagaga

SEQ ID NO: 1229285 - DNA, 22 bp, Artificial Sequence
  chemically synthesized
ttggtaaataagagataacatt

SEQ ID NO: 1229286 - DNA, 22 bp, Artificial Sequence
  chemically synthesized
ggtaaataagagataacatttg

SEQ ID NO: 1229287 - DNA, 22 bp, Artificial Sequence
  chemically synthesized
gtaaataagagataacatttgt

SEQ ID NO: 1229288 - DNA, 22 bp, Artificial Sequence
  chemically synthesized
caagtggtaagcattctacaaa

SEQ ID NO: 1229289 - DNA, 22 bp, Artificial Sequence
  chemically synthesized
gcaagtggtaagcattctacaa

SEQ ID NO: 1229290 - DNA, 22 bp, Artificial Sequence
  chemically synthesized
tgcaagtggtaagcattctaca

SEQ ID NO: 1229291 - DNA, 22 bp, Artificial Sequence
  chemically synthesized
gtagaatgcttaccacttgcaa

SEQ ID NO: 1229292 - DNA, 22 bp, Artificial Sequence
  chemically synthesized
tagaatgcttaccacttgcaaa

SEQ ID NO: 1229293 - DNA, 22 bp, Artificial Sequence
  chemically synthesized
taagaaatataatcacattttg

SEQ ID NO: 1229294 - DNA, 22 bp, Artificial Sequence
  chemically synthesized
accacttgcaaaatgtgattat

SEQ ID NO: 1229295 - DNA, 22 bp, Artificial Sequence
  chemically synthesized
ccacttgcaaaatgtgattata

SEQ ID NO: 1229296 - DNA, 22 bp, Artificial Sequence
  chemically synthesized
aattataagaaatataatcaca

SEQ ID NO: 1229297 - DNA, 22 bp, Artificial Sequence
  chemically synthesized
ttgaattataagaaatataatc

SEQ ID NO: 1229298 - DNA, 22 bp, Artificial Sequence
  chemically synthesized
gttgaattataagaaatataat

SEQ ID NO: 1229299 - DNA, 22 bp, Artificial Sequence
  chemically synthesized
tgttgaattataagaaatataa

SEQ ID NO: 1229300 - DNA, 22 bp, Artificial Sequence
  chemically synthesized
gcaaaatgtgattatatttctt

SEQ ID NO: 1229301 - DNA, 22 bp, Artificial Sequence
  chemically synthesized
caaaatgtgattatatttctta

SEQ ID NO: 1229302 - DNA, 22 bp, Artificial Sequence
  chemically synthesized
tatttcttataattcaacaaaa

SEQ ID NO: 1229303 - DNA, 22 bp, Artificial Sequence
  chemically synthesized
aatgaaatacaaaattttgttg

SEQ ID NO: 1229304 - DNA, 22 bp, Artificial Sequence
  chemically synthesized
gaatgaaatacaaaattttgtt

SEQ ID NO: 1229305 - DNA, 22 bp, Artificial Sequence
  chemically synthesized
tgaatgaaatacaaaattttgt

SEQ ID NO: 1229306 - DNA, 22 bp, Artificial Sequence
  chemically synthesized
cttataattcaacaaaattttg

SEQ ID NO: 1229307 - DNA, 22 bp, Artificial Sequence
  chemically synthesized
ttgaatgaaatacaaaattttg

SEQ ID NO: 1229308 - DNA, 22 bp, Artificial Sequence
  chemically synthesized
ttataattcaacaaaattttgt

SEQ ID NO: 1229309 - DNA, 22 bp, Artificial Sequence
  chemically synthesized
ataattcaacaaaattttgtat

SEQ ID NO: 1229310 - DNA, 22 bp, Artificial Sequence
  chemically synthesized
cttttgaatgaaatacaaaatt

SEQ ID NO: 1229311 - DNA, 22 bp, Artificial Sequence
  chemically synthesized
taattcaacaaaattttgtatt

SEQ ID NO: 1229312 - DNA, 22 bp, Artificial Sequence
  chemically synthesized
acttttgaatgaaatacaaaat

SEQ ID NO: 1229313 - DNA, 22 bp, Artificial Sequence
  chemically synthesized
tacttttgaatgaaatacaaaa

SEQ ID NO: 1229314 - DNA, 22 bp, Artificial Sequence
  chemically synthesized
aacaaaattttgtatttcattc

SEQ ID NO: 1229315 - DNA, 22 bp, Artificial Sequence
  chemically synthesized
taagacagttttacttttgaat

SEQ ID NO: 1229316 - DNA, 22 bp, Artificial Sequence
  chemically synthesized
tgtatttcattcaaaagtaaaa

SEQ ID NO: 1229317 - DNA, 22 bp, Artificial Sequence
  chemically synthesized
gtatttcattcaaaagtaaaac

SEQ ID NO: 1229318 - DNA, 22 bp, Artificial Sequence
  chemically synthesized
tatttcattcaaaagtaaaact

SEQ ID NO: 1229319 - DNA, 22 bp, Artificial Sequence
  chemically synthesized
cattcaaaagtaaaactgtctt

SEQ ID NO: 1229320 - DNA, 22 bp, Artificial Sequence
  chemically synthesized
attcaaaagtaaaactgtctta

SEQ ID NO: 1229321 - DNA, 22 bp, Artificial Sequence
  chemically synthesized
aaaagtaaaactgtcttacaga

SEQ ID NO: 1229322 - DNA, 22 bp, Artificial Sequence
  chemically synthesized
tcttacagatttatgatctttg

SEQ ID NO: 1229323 - DNA, 22 bp, Artificial Sequence
  chemically synthesized
acagtcaaaaagcaaagatcat

SEQ ID NO: 1229324 - DNA, 22 bp, Artificial Sequence
  chemically synthesized
aacagtcaaaaagcaaagatca

SEQ ID NO: 1229325 - DNA, 22 bp, Artificial Sequence
  chemically synthesized
acagatttatgatctttgcttt

SEQ ID NO: 1229326 - DNA, 22 bp, Artificial Sequence
  chemically synthesized
cagatttatgatctttgctttt

SEQ ID NO: 1229327 - DNA, 22 bp, Artificial Sequence
  chemically synthesized
tacttaacagtcaaaaagcaaa

SEQ ID NO: 1229328 - DNA, 22 bp, Artificial Sequence
  chemically synthesized
gtacttaacagtcaaaaagcaa

SEQ ID NO: 1229329 - DNA, 22 bp, Artificial Sequence
  chemically synthesized
tgtacttaacagtcaaaaagca

SEQ ID NO: 1229330 - DNA, 22 bp, Artificial Sequence
  chemically synthesized
atgatctttgctttttgactgt

SEQ ID NO: 1229331 - DNA, 22 bp, Artificial Sequence
  chemically synthesized
tgatctttgctttttgactgtt

SEQ ID NO: 1229332 - DNA, 22 bp, Artificial Sequence
  chemically synthesized
acctttgtacttaacagtcaaa

SEQ ID NO: 1229333 - DNA, 22 bp, Artificial Sequence
  chemically synthesized
tgctttttgactgttaagtaca

SEQ ID NO: 1229334 - DNA, 22 bp, Artificial Sequence
  chemically synthesized
gctttttgactgttaagtacaa

SEQ ID NO: 1229335 - DNA, 22 bp, Artificial Sequence
  chemically synthesized
ctttttgactgttaagtacaaa

SEQ ID NO: 1229336 - DNA, 22 bp, Artificial Sequence
  chemically synthesized
tttgactgttaagtacaaaggt

SEQ ID NO: 1229337 - DNA, 22 bp, Artificial Sequence
  chemically synthesized
ttgactgttaagtacaaaggtt

SEQ ID NO: 1229338 - DNA, 22 bp, Artificial Sequence
  chemically synthesized
tgatgtcaggttaacctttgta

SEQ ID NO: 1229339 - DNA, 22 bp, Artificial Sequence
  chemically synthesized
tgactgttaagtacaaaggtta

SEQ ID NO: 1229340 - DNA, 22 bp, Artificial Sequence
  chemically synthesized
gtgatgtcaggttaacctttgt

SEQ ID NO: 1229341 - DNA, 22 bp, Artificial Sequence
  chemically synthesized
gactgttaagtacaaaggttaa

SEQ ID NO: 1229342 - DNA, 22 bp, Artificial Sequence
  chemically synthesized
tgtgatgtcaggttaacctttg

SEQ ID NO: 1229343 - DNA, 22 bp, Artificial Sequence
  chemically synthesized
actgttaagtacaaaggttaac

SEQ ID NO: 1229344 - DNA, 22 bp, Artificial Sequence
  chemically synthesized
ttgtgatgtcaggttaaccttt

SEQ ID NO: 1229345 - DNA, 22 bp, Artificial Sequence
  chemically synthesized
cttttgtgatgtcaggttaacc

SEQ ID NO: 1229346 - DNA, 22 bp, Artificial Sequence
  chemically synthesized
ttaagtacaaaggttaacctga

SEQ ID NO: 1229347 - DNA, 22 bp, Artificial Sequence
  chemically synthesized
agtacaaaggttaacctgacat

SEQ ID NO: 1229348 - DNA, 22 bp, Artificial Sequence
  chemically synthesized
cacaattccttttgtgatgtca

SEQ ID NO: 1229349 - DNA, 22 bp, Artificial Sequence
  chemically synthesized
acctgacatcacaaaaggaatt

SEQ ID NO: 1229350 - DNA, 22 bp, Artificial Sequence
  chemically synthesized
acatcacaaaaggaattgtgga

SEQ ID NO: 1229351 - DNA, 22 bp, Artificial Sequence
  chemically synthesized
caaagcatatgaaaagaaaaaa

SEQ ID NO: 1229352 - DNA, 22 bp, Artificial Sequence
  chemically synthesized
ttccaaagcatatgaaaagaaa

SEQ ID NO: 1229353 - DNA, 22 bp, Artificial Sequence
  chemically synthesized
tggagtttttttcttttcatat

SEQ ID NO: 1229354 - DNA, 22 bp, Artificial Sequence
  chemically synthesized
agctattccaaagcatatgaaa

SEQ ID NO: 1229355 - DNA, 22 bp, Artificial Sequence
  chemically synthesized
aagctattccaaagcatatgaa

SEQ ID NO: 1229356 - DNA, 22 bp, Artificial Sequence
  chemically synthesized
taagctattccaaagcatatga

SEQ ID NO: 1229357 - DNA, 22 bp, Artificial Sequence
  chemically synthesized
ttttcttttcatatgctttgga

SEQ ID NO: 1229358 - DNA, 22 bp, Artificial Sequence
  chemically synthesized
tttcttttcatatgctttggaa

SEQ ID NO: 1229359 - DNA, 22 bp, Artificial Sequence
  chemically synthesized
ttcttttcatatgctttggaat

SEQ ID NO: 1229360 - DNA, 22 bp, Artificial Sequence
  chemically synthesized
tcttttcatatgctttggaata

SEQ ID NO: 1229361 - DNA, 22 bp, Artificial Sequence
  chemically synthesized
tatactttaagctattccaaag

SEQ ID NO: 1229362 - DNA, 22 bp, Artificial Sequence
  chemically synthesized
cttttcatatgctttggaatag

SEQ ID NO: 1229363 - DNA, 22 bp, Artificial Sequence
  chemically synthesized
atatactttaagctattccaaa

SEQ ID NO: 1229364 - DNA, 22 bp, Artificial Sequence
  chemically synthesized
ttttcatatgctttggaatagc

SEQ ID NO: 1229365 - DNA, 22 bp, Artificial Sequence
  chemically synthesized
ttcatatgctttggaatagctt

SEQ ID NO: 1229366 - DNA, 22 bp, Artificial Sequence
  chemically synthesized
tcatatgctttggaatagctta

SEQ ID NO: 1229367 - DNA, 22 bp, Artificial Sequence
  chemically synthesized
catatgctttggaatagcttaa

SEQ ID NO: 1229368 - DNA, 22 bp, Artificial Sequence
  chemically synthesized
atatgctttggaatagcttaaa

SEQ ID NO: 1229369 - DNA, 22 bp, Artificial Sequence
  chemically synthesized
aagaataatttatatactttaa

SEQ ID NO: 1229370 - DNA, 22 bp, Artificial Sequence
  chemically synthesized
aaagaataatttatatacttta

SEQ ID NO: 1229371 - DNA, 22 bp, Artificial Sequence
  chemically synthesized
tggaatagcttaaagtatataa

SEQ ID NO: 1229372 - DNA, 22 bp, Artificial Sequence
  chemically synthesized
ggaatagcttaaagtatataaa

SEQ ID NO: 1229373 - DNA, 22 bp, Artificial Sequence
  chemically synthesized
gaatagcttaaagtatataaat

SEQ ID NO: 1229374 - DNA, 22 bp, Artificial Sequence
  chemically synthesized
acgtaacccttaaagaataatt

SEQ ID NO: 1229375 - DNA, 22 bp, Artificial Sequence
  chemically synthesized
aacgtaacccttaaagaataat

SEQ ID NO: 1229376 - DNA, 22 bp, Artificial Sequence
  chemically synthesized
aaagtatataaattattcttta

SEQ ID NO: 1229377 - DNA, 22 bp, Artificial Sequence
  chemically synthesized
aagtatataaattattctttaa

SEQ ID NO: 1229378 - DNA, 22 bp, Artificial Sequence
  chemically synthesized
caaatgaatttaacgtaaccct

SEQ ID NO: 1229379 - DNA, 22 bp, Artificial Sequence
  chemically synthesized
acaaatgaatttaacgtaaccc

SEQ ID NO: 1229380 - DNA, 22 bp, Artificial Sequence
  chemically synthesized
tacaaatgaatttaacgtaacc

SEQ ID NO: 1229381 - DNA, 22 bp, Artificial Sequence
  chemically synthesized
tttacaaatgaatttaacgtaa

SEQ ID NO: 1229382 - DNA, 22 bp, Artificial Sequence
  chemically synthesized
ttctttaagggttacgttaaat

SEQ ID NO: 1229383 - DNA, 22 bp, Artificial Sequence
  chemically synthesized
tttaagggttacgttaaattca

SEQ ID NO: 1229384 - DNA, 22 bp, Artificial Sequence
  chemically synthesized
taagggttacgttaaattcatt

SEQ ID NO: 1229385 - DNA, 22 bp, Artificial Sequence
  chemically synthesized
aagggttacgttaaattcattt

SEQ ID NO: 1229386 - DNA, 22 bp, Artificial Sequence
  chemically synthesized
agggttacgttaaattcatttg

SEQ ID NO: 1229387 - DNA, 22 bp, Artificial Sequence
  chemically synthesized
cgttaaattcatttgtaaagaa

SEQ ID NO: 1229388 - DNA, 22 bp, Artificial Sequence
  chemically synthesized
aagagtgtagtaggattcttta

SEQ ID NO: 1229389 - DNA, 22 bp, Artificial Sequence
  chemically synthesized
aattcatttgtaaagaatccta

SEQ ID NO: 1229390 - DNA, 22 bp, Artificial Sequence
  chemically synthesized
ttgaagagtgtagtaggattct

SEQ ID NO: 1229391 - DNA, 22 bp, Artificial Sequence
  chemically synthesized
atttgtaaagaatcctactaca

SEQ ID NO: 1229392 - DNA, 22 bp, Artificial Sequence
  chemically synthesized
gtaaagaatcctactacactct

SEQ ID NO: 1229393 - DNA, 22 bp, Artificial Sequence
  chemically synthesized
taaagaatcctactacactctt

SEQ ID NO: 1229394 - DNA, 22 bp, Artificial Sequence
  chemically synthesized
aaggtgtactgttgaagagtgt

SEQ ID NO: 1229395 - DNA, 22 bp, Artificial Sequence
  chemically synthesized
ttaaaggtgtactgttgaagag

SEQ ID NO: 1229396 - DNA, 22 bp, Artificial Sequence
  chemically synthesized
ctacactcttcaacagtacacc

SEQ ID NO: 1229397 - DNA, 22 bp, Artificial Sequence
  chemically synthesized
gtaggttattaaaggtgtactg

SEQ ID NO: 1229398 - DNA, 22 bp, Artificial Sequence
  chemically synthesized
agtaggttattaaaggtgtact

SEQ ID NO: 1229399 - DNA, 22 bp, Artificial Sequence
  chemically synthesized
cactcttcaacagtacaccttt

SEQ ID NO: 1229400 - DNA, 22 bp, Artificial Sequence
  chemically synthesized
ttcaacagtacacctttaataa

SEQ ID NO: 1229401 - DNA, 22 bp, Artificial Sequence
  chemically synthesized
caacagtacacctttaataacc

SEQ ID NO: 1229402 - DNA, 22 bp, Artificial Sequence
  chemically synthesized
aacagtacacctttaataacct

SEQ ID NO: 1229403 - DNA, 22 bp, Artificial Sequence
  chemically synthesized
agaaaacatttagtaggttatt

SEQ ID NO: 1229404 - DNA, 22 bp, Artificial Sequence
  chemically synthesized
cagaaaacatttagtaggttat

SEQ ID NO: 1229405 - DNA, 22 bp, Artificial Sequence
  chemically synthesized
cttcagaaaacatttagtaggt

SEQ ID NO: 1229406 - DNA, 22 bp, Artificial Sequence
  chemically synthesized
attacttcagaaaacatttagt

SEQ ID NO: 1229407 - DNA, 22 bp, Artificial Sequence
  chemically synthesized
taataacctactaaatgttttc

SEQ ID NO: 1229408 - DNA, 22 bp, Artificial Sequence
  chemically synthesized
aataacctactaaatgttttct

SEQ ID NO: 1229409 - DNA, 22 bp, Artificial Sequence
  chemically synthesized
ataacctactaaatgttttctg

SEQ ID NO: 1229410 - DNA, 22 bp, Artificial Sequence
  chemically synthesized
gactgattacttcagaaaacat

SEQ ID NO: 1229411 - DNA, 22 bp, Artificial Sequence
  chemically synthesized
ctaaatgttttctgaagtaatc

SEQ ID NO: 1229412 - DNA, 22 bp, Artificial Sequence
  chemically synthesized
aatgttttctgaagtaatcagt

SEQ ID NO: 1229413 - DNA, 22 bp, Artificial Sequence
  chemically synthesized
tctgaagtaatcagtctaattt

SEQ ID NO: 1229414 - DNA, 22 bp, Artificial Sequence
  chemically synthesized
ctgaagtaatcagtctaatttt

SEQ ID NO: 1229415 - DNA, 22 bp, Artificial Sequence
  chemically synthesized
tgaagtaatcagtctaattttc

SEQ ID NO: 1229416 - DNA, 22 bp, Artificial Sequence
  chemically synthesized
aagtaatcagtctaattttcca

SEQ ID NO: 1229417 - DNA, 22 bp, Artificial Sequence
  chemically synthesized
agataagaataagtggaaaatt

SEQ ID NO: 1229418 - DNA, 22 bp, Artificial Sequence
  chemically synthesized
aaattgagataagaataagtgg

SEQ ID NO: 1229419 - DNA, 22 bp, Artificial Sequence
  chemically synthesized
attttccacttattcttatctc

SEQ ID NO: 1229420 - DNA, 22 bp, Artificial Sequence
  chemically synthesized
tccacttattcttatctcaatt

SEQ ID NO: 1229421 - DNA, 22 bp, Artificial Sequence
  chemically synthesized
ccacttattcttatctcaattt

SEQ ID NO: 1229422 - DNA, 22 bp, Artificial Sequence
  chemically synthesized
cacttattcttatctcaatttt

SEQ ID NO: 1229423 - DNA, 22 bp, Artificial Sequence
  chemically synthesized
attcttatctcaattttagtga

SEQ ID NO: 1229424 - DNA, 22 bp, Artificial Sequence
  chemically synthesized
gtacaatacaaatcactaaaat

SEQ ID NO: 1229425 - DNA, 22 bp, Artificial Sequence
  chemically synthesized
ttcttatctcaattttagtgat

SEQ ID NO: 1229426 - DNA, 22 bp, Artificial Sequence
  chemically synthesized
tcgtacaatacaaatcactaaa

SEQ ID NO: 1229427 - DNA, 22 bp, Artificial Sequence
  chemically synthesized
ctcgtacaatacaaatcactaa

SEQ ID NO: 1229428 - DNA, 22 bp, Artificial Sequence
  chemically synthesized
ttatctcaattttagtgatttg

SEQ ID NO: 1229429 - DNA, 22 bp, Artificial Sequence
  chemically synthesized
tctcgtacaatacaaatcacta

SEQ ID NO: 1229430 - DNA, 22 bp, Artificial Sequence
  chemically synthesized
atctcaattttagtgatttgta

SEQ ID NO: 1229431 - DNA, 22 bp, Artificial Sequence
  chemically synthesized
tctcaattttagtgatttgtat

SEQ ID NO: 1229432 - DNA, 22 bp, Artificial Sequence
  chemically synthesized
attttctcgtacaatacaaatc

SEQ ID NO: 1229433 - DNA, 22 bp, Artificial Sequence
  chemically synthesized
gattttctcgtacaatacaaat

SEQ ID NO: 1229434 - DNA, 22 bp, Artificial Sequence
  chemically synthesized
aattttagtgatttgtattgta

SEQ ID NO: 1229435 - DNA, 22 bp, Artificial Sequence
  chemically synthesized
tagtgatttgtattgtacgaga

SEQ ID NO: 1229436 - DNA, 22 bp, Artificial Sequence
  chemically synthesized
agtgatttgtattgtacgagaa

SEQ ID NO: 1229437 - DNA, 22 bp, Artificial Sequence
  chemically synthesized
gaaaacttgattttctcgtaca

SEQ ID NO: 1229438 - DNA, 22 bp, Artificial Sequence
  chemically synthesized
gtgatttgtattgtacgagaaa

SEQ ID NO: 1229439 - DNA, 22 bp, Artificial Sequence
  chemically synthesized
tggaaaacttgattttctcgta

SEQ ID NO: 1229440 - DNA, 22 bp, Artificial Sequence
  chemically synthesized
gtattgtacgagaaaatcaagt

SEQ ID NO: 1229441 - DNA, 22 bp, Artificial Sequence
  chemically synthesized
tattgtacgagaaaatcaagtt

SEQ ID NO: 1229442 - DNA, 22 bp, Artificial Sequence
  chemically synthesized
caaaattctggaaaacttgatt

SEQ ID NO: 1229443 - DNA, 22 bp, Artificial Sequence
  chemically synthesized
gcaaaattctggaaaacttgat

SEQ ID NO: 1229444 - DNA, 22 bp, Artificial Sequence
  chemically synthesized
tgcaaaattctggaaaacttga

SEQ ID NO: 1229445 - DNA, 22 bp, Artificial Sequence
  chemically synthesized
tacgagaaaatcaagttttcca

SEQ ID NO: 1229446 - DNA, 22 bp, Artificial Sequence
  chemically synthesized
taacaattttgcaaaattctgg

SEQ ID NO: 1229447 - DNA, 22 bp, Artificial Sequence
  chemically synthesized
ataacaattttgcaaaattctg

SEQ ID NO: 1229448 - DNA, 22 bp, Artificial Sequence
  chemically synthesized
tataacaattttgcaaaattct

SEQ ID NO: 1229449 - DNA, 22 bp, Artificial Sequence
  chemically synthesized
tccagaattttgcaaaattgtt

SEQ ID NO: 1229450 - DNA, 22 bp, Artificial Sequence
  chemically synthesized
ccagaattttgcaaaattgtta

SEQ ID NO: 1229451 - DNA, 22 bp, Artificial Sequence
  chemically synthesized
aaagcaattttataacaatttt

SEQ ID NO: 1229452 - DNA, 22 bp, Artificial Sequence
  chemically synthesized
cagaattttgcaaaattgttat

SEQ ID NO: 1229453 - DNA, 22 bp, Artificial Sequence
  chemically synthesized
tgcaaaattgttataaaattgc

SEQ ID NO: 1229454 - DNA, 22 bp, Artificial Sequence
  chemically synthesized
gcaaaattgttataaaattgct

SEQ ID NO: 1229455 - DNA, 22 bp, Artificial Sequence
  chemically synthesized
caaaattgttataaaattgctt

SEQ ID NO: 1229456 - DNA, 22 bp, Artificial Sequence
  chemically synthesized
ttataaaattgcttttagtttc

SEQ ID NO: 1229457 - DNA, 22 bp, Artificial Sequence
  chemically synthesized
taaaattgcttttagtttccac

SEQ ID NO: 1229458 - DNA, 22 bp, Artificial Sequence
  chemically synthesized
cttttagtttccacttcatttc

SEQ ID NO: 1229459 - DNA, 22 bp, Artificial Sequence
  chemically synthesized
ttagtttccacttcatttcttc

SEQ ID NO: 1229460 - DNA, 22 bp, Artificial Sequence
  chemically synthesized
tagtttccacttcatttcttct

SEQ ID NO: 1229461 - DNA, 22 bp, Artificial Sequence
  chemically synthesized
agtttccacttcatttcttctg

SEQ ID NO: 1229462 - DNA, 22 bp, Artificial Sequence
  chemically synthesized
gtttccacttcatttcttctgt

SEQ ID NO: 1229463 - DNA, 22 bp, Artificial Sequence
  chemically synthesized
ccacttcatttcttctgtatct

SEQ ID NO: 1229464 - DNA, 22 bp, Artificial Sequence
  chemically synthesized
cacttcatttcttctgtatctg

SEQ ID NO: 1229465 - DNA, 22 bp, Artificial Sequence
  chemically synthesized
catttcttctgtatctgctgtc

SEQ ID NO: 1229466 - DNA, 22 bp, Artificial Sequence
  chemically synthesized
atttcttctgtatctgctgtca

SEQ ID NO: 1229467 - DNA, 22 bp, Artificial Sequence
  chemically synthesized
cttctgtatctgctgtcatgcg

SEQ ID NO: 1229468 - DNA, 22 bp, Artificial Sequence
  chemically synthesized
ttctgtatctgctgtcatgcgt

SEQ ID NO: 1229469 - DNA, 22 bp, Artificial Sequence
  chemically synthesized
ctgtatctgctgtcatgcgtct

SEQ ID NO: 1229470 - DNA, 22 bp, Artificial Sequence
  chemically synthesized
tgtatctgctgtcatgcgtctt

SEQ ID NO: 1229471 - DNA, 22 bp, Artificial Sequence
  chemically synthesized
tatctgctgtcatgcgtctttt

SEQ ID NO: 1229472 - DNA, 22 bp, Artificial Sequence
  chemically synthesized
gacgagataaatgagaaaagac

SEQ ID NO: 1229473 - DNA, 22 bp, Artificial Sequence
  chemically synthesized
ctgtcatgcgtcttttctcatt

SEQ ID NO: 1229474 - DNA, 22 bp, Artificial Sequence
  chemically synthesized
tcatgcgtcttttctcatttat

SEQ ID NO: 1229475 - DNA, 22 bp, Artificial Sequence
  chemically synthesized
gaataaaaactagacgagataa

SEQ ID NO: 1229476 - DNA, 22 bp, Artificial Sequence
  chemically synthesized
agaataaaaactagacgagata

SEQ ID NO: 1229477 - DNA, 22 bp, Artificial Sequence
  chemically synthesized
ttctcatttatctcgtctagtt

SEQ ID NO: 1229478 - DNA, 22 bp, Artificial Sequence
  chemically synthesized
tctcatttatctcgtctagttt

SEQ ID NO: 1229479 - DNA, 22 bp, Artificial Sequence
  chemically synthesized
ctcatttatctcgtctagtttt

SEQ ID NO: 1229480 - DNA, 22 bp, Artificial Sequence
  chemically synthesized
tcatttatctcgtctagttttt

SEQ ID NO: 1229481 - DNA, 22 bp, Artificial Sequence
  chemically synthesized
atttatctcgtctagtttttat

SEQ ID NO: 1229482 - DNA, 22 bp, Artificial Sequence
  chemically synthesized
atctcgtctagtttttattcta

SEQ ID NO: 1229483 - DNA, 22 bp, Artificial Sequence
  chemically synthesized
tctcgtctagtttttattctaa

SEQ ID NO: 1229484 - DNA, 22 bp, Artificial Sequence
  chemically synthesized
gtctagtttttattctaagttt

SEQ ID NO: 1229485 - DNA, 22 bp, Artificial Sequence
  chemically synthesized
gtttttattctaagttttcttt

SEQ ID NO: 1229486 - DNA, 22 bp, Artificial Sequence
  chemically synthesized
tcccagtcataacaaagaaaac

SEQ ID NO: 1229487 - DNA, 22 bp, Artificial Sequence
  chemically synthesized
ttattctaagttttctttgtta

SEQ ID NO: 1229488 - DNA, 22 bp, Artificial Sequence
  chemically synthesized
tattctaagttttctttgttat

SEQ ID NO: 1229489 - DNA, 22 bp, Artificial Sequence
  chemically synthesized
attctaagttttctttgttatg

SEQ ID NO: 1229490 - DNA, 22 bp, Artificial Sequence
  chemically synthesized
ttctaagttttctttgttatga

SEQ ID NO: 1229491 - DNA, 22 bp, Artificial Sequence
  chemically synthesized
taagttttctttgttatgactg

SEQ ID NO: 1229492 - DNA, 22 bp, Artificial Sequence
  chemically synthesized
agttttctttgttatgactggg

SEQ ID NO: 1229493 - DNA, 22 bp, Artificial Sequence
  chemically synthesized
tctttgttatgactgggatagg

SEQ ID NO: 1229494 - DNA, 22 bp, Artificial Sequence
  chemically synthesized
ctttgttatgactgggataggt

SEQ ID NO: 1229495 - DNA, 22 bp, Artificial Sequence
  chemically synthesized
tttgttatgactgggataggtt

SEQ ID NO: 1229496 - DNA, 22 bp, Artificial Sequence
  chemically synthesized
acaaaataggtaaacctatccc

SEQ ID NO: 1229497 - DNA, 22 bp, Artificial Sequence
  chemically synthesized
tgttatgactgggataggttta

SEQ ID NO: 1229498 - DNA, 22 bp, Artificial Sequence
  chemically synthesized
gttatgactgggataggtttac

SEQ ID NO: 1229499 - DNA, 22 bp, Artificial Sequence
  chemically synthesized
ttatgactgggataggtttacc

SEQ ID NO: 1229500 - DNA, 22 bp, Artificial Sequence
  chemically synthesized
tgactgggataggtttacctat

SEQ ID NO: 1229501 - DNA, 22 bp, Artificial Sequence
  chemically synthesized
aaaagattaacaaaataggtaa

SEQ ID NO: 1229502 - DNA, 22 bp, Artificial Sequence
  chemically synthesized
gaaaagattaacaaaataggta

SEQ ID NO: 1229503 - DNA, 22 bp, Artificial Sequence
  chemically synthesized
ttgaaaagattaacaaaatagg

SEQ ID NO: 1229504 - DNA, 22 bp, Artificial Sequence
  chemically synthesized
ggataggtttacctattttgtt

SEQ ID NO: 1229505 - DNA, 22 bp, Artificial Sequence
  chemically synthesized
acctattttgttaatcttttca

SEQ ID NO: 1229506 - DNA, 22 bp, Artificial Sequence
  chemically synthesized
cctattttgttaatcttttcaa

SEQ ID NO: 1229507 - DNA, 22 bp, Artificial Sequence
  chemically synthesized
aaaagtgagctcttgaaaagat

SEQ ID NO: 1229508 - DNA, 22 bp, Artificial Sequence
  chemically synthesized
ttttgttaatcttttcaagagc

SEQ ID NO: 1229509 - DNA, 22 bp, Artificial Sequence
  chemically synthesized
tgttaatcttttcaagagctca

SEQ ID NO: 1229510 - DNA, 22 bp, Artificial Sequence
  chemically synthesized
gttaatcttttcaagagctcac

SEQ ID NO: 1229511 - DNA, 22 bp, Artificial Sequence
  chemically synthesized
ttaatcttttcaagagctcact

SEQ ID NO: 1229512 - DNA, 22 bp, Artificial Sequence
  chemically synthesized
atcttttcaagagctcactttt

SEQ ID NO: 1229513 - DNA, 22 bp, Artificial Sequence
  chemically synthesized
ttcaagagctcacttttgaatg

SEQ ID NO: 1229514 - DNA, 22 bp, Artificial Sequence
  chemically synthesized
tcaagagctcacttttgaatgg

SEQ ID NO: 1229515 - DNA, 22 bp, Artificial Sequence
  chemically synthesized
aataagaataatccattcaaaa

SEQ ID NO: 1229516 - DNA, 22 bp, Artificial Sequence
  chemically synthesized
caagagctcacttttgaatgga

SEQ ID NO: 1229517 - DNA, 22 bp, Artificial Sequence
  chemically synthesized
aagagctcacttttgaatggat

SEQ ID NO: 1229518 - DNA, 22 bp, Artificial Sequence
  chemically synthesized
acttttgaatggattattctta

SEQ ID NO: 1229519 - DNA, 22 bp, Artificial Sequence
  chemically synthesized
ttgaatggattattcttattca

SEQ ID NO: 1229520 - DNA, 22 bp, Artificial Sequence
  chemically synthesized
aacgtagaaaattgaataagaa

SEQ ID NO: 1229521 - DNA, 22 bp, Artificial Sequence
  chemically synthesized
tgaatggattattcttattcaa

SEQ ID NO: 1229522 - DNA, 22 bp, Artificial Sequence
  chemically synthesized
gaatggattattcttattcaat

SEQ ID NO: 1229523 - DNA, 22 bp, Artificial Sequence
  chemically synthesized
aatggattattcttattcaatt

SEQ ID NO: 1229524 - DNA, 22 bp, Artificial Sequence
  chemically synthesized
tattcaacgtagaaaattgaat

SEQ ID NO: 1229525 - DNA, 22 bp, Artificial Sequence
  chemically synthesized
ttcttattcaattttctacgtt

SEQ ID NO: 1229526 - DNA, 22 bp, Artificial Sequence
  chemically synthesized
ttattcaattttctacgttgaa

SEQ ID NO: 1229527 - DNA, 22 bp, Artificial Sequence
  chemically synthesized
attcaattttctacgttgaata

SEQ ID NO: 1229528 - DNA, 22 bp, Artificial Sequence
  chemically synthesized
ttcaattttctacgttgaatac

SEQ ID NO: 1229529 - DNA, 22 bp, Artificial Sequence
  chemically synthesized
aattttctacgttgaatacaat

SEQ ID NO: 1229530 - DNA, 22 bp, Artificial Sequence
  chemically synthesized
tctacgttgaatacaattttta

SEQ ID NO: 1229531 - DNA, 22 bp, Artificial Sequence
  chemically synthesized
ctacgttgaatacaatttttat

SEQ ID NO: 1229532 - DNA, 22 bp, Artificial Sequence
  chemically synthesized
tacgttgaatacaatttttatt

SEQ ID NO: 1229533 - DNA, 22 bp, Artificial Sequence
  chemically synthesized
cgttgaatacaatttttatttt

SEQ ID NO: 1229534 - DNA, 22 bp, Artificial Sequence
  chemically synthesized
taaaaatagaaacaaaaataaa

SEQ ID NO: 1229535 - DNA, 22 bp, Artificial Sequence
  chemically synthesized
aatacaatttttatttttgttt

SEQ ID NO: 1229536 - DNA, 22 bp, Artificial Sequence
  chemically synthesized
agaaattgtaaaaatagaaaca

SEQ ID NO: 1229537 - DNA, 22 bp, Artificial Sequence
  chemically synthesized
aagaaattgtaaaaatagaaac

SEQ ID NO: 1229538 - DNA, 22 bp, Artificial Sequence
  chemically synthesized
ttatttttgtttctatttttac

SEQ ID NO: 1229539 - DNA, 22 bp, Artificial Sequence
  chemically synthesized
tatttttgtttctatttttaca

SEQ ID NO: 1229540 - DNA, 22 bp, Artificial Sequence
  chemically synthesized
atttttgtttctatttttacaa

SEQ ID NO: 1229541 - DNA, 22 bp, Artificial Sequence
  chemically synthesized
tttttgtttctatttttacaat

SEQ ID NO: 1229542 - DNA, 22 bp, Artificial Sequence
  chemically synthesized
ttgtttctatttttacaatttc

SEQ ID NO: 1229543 - DNA, 22 bp, Artificial Sequence
  chemically synthesized
tgtttctatttttacaatttct

SEQ ID NO: 1229544 - DNA, 22 bp, Artificial Sequence
  chemically synthesized
gtttctatttttacaatttctt

SEQ ID NO: 1229545 - DNA, 22 bp, Artificial Sequence
  chemically synthesized
tttctatttttacaatttctta

SEQ ID NO: 1229546 - DNA, 22 bp, Artificial Sequence
  chemically synthesized
ctatttttacaatttcttaaga

SEQ ID NO: 1229547 - DNA, 22 bp, Artificial Sequence
  chemically synthesized
tatttttacaatttcttaagat

SEQ ID NO: 1229548 - DNA, 22 bp, Artificial Sequence
  chemically synthesized
tttttacaatttcttaagatgc

SEQ ID NO: 1229549 - DNA, 22 bp, Artificial Sequence
  chemically synthesized
ttacaatttcttaagatgcata

SEQ ID NO: 1229550 - DNA, 22 bp, Artificial Sequence
  chemically synthesized
tacaatttcttaagatgcatac

SEQ ID NO: 1229551 - DNA, 22 bp, Artificial Sequence
  chemically synthesized
acaatttcttaagatgcatact

SEQ ID NO: 1229552 - DNA, 22 bp, Artificial Sequence
  chemically synthesized
caatttcttaagatgcatactt

SEQ ID NO: 1229553 - DNA, 22 bp, Artificial Sequence
  chemically synthesized
aaagatggaaataaaagaagta

SEQ ID NO: 1229554 - DNA, 22 bp, Artificial Sequence
  chemically synthesized
cttaagatgcatacttctttta

SEQ ID NO: 1229555 - DNA, 22 bp, Artificial Sequence
  chemically synthesized
aaaagatggaaataaaagaagt

SEQ ID NO: 1229556 - DNA, 22 bp, Artificial Sequence
  chemically synthesized
ttaagatgcatacttcttttat

SEQ ID NO: 1229557 - DNA, 22 bp, Artificial Sequence
  chemically synthesized
taaaagatggaaataaaagaag

SEQ ID NO: 1229558 - DNA, 22 bp, Artificial Sequence
  chemically synthesized
ttaaaagatggaaataaaagaa

SEQ ID NO: 1229559 - DNA, 22 bp, Artificial Sequence
  chemically synthesized
aagatgcatacttcttttattt

SEQ ID NO: 1229560 - DNA, 22 bp, Artificial Sequence
  chemically synthesized
agatgcatacttcttttatttc

SEQ ID NO: 1229561 - DNA, 22 bp, Artificial Sequence
  chemically synthesized
cttttatttccatcttttaaaa

SEQ ID NO: 1229562 - DNA, 22 bp, Artificial Sequence
  chemically synthesized
ttttatttccatcttttaaaaa

SEQ ID NO: 1229563 - DNA, 22 bp, Artificial Sequence
  chemically synthesized
tatagccataagatttttaaaa

SEQ ID NO: 1229564 - DNA, 22 bp, Artificial Sequence
  chemically synthesized
ttatttccatcttttaaaaatc

SEQ ID NO: 1229565 - DNA, 22 bp, Artificial Sequence
  chemically synthesized
tatttccatcttttaaaaatct

SEQ ID NO: 1229566 - DNA, 22 bp, Artificial Sequence
  chemically synthesized
atttccatcttttaaaaatctt

SEQ ID NO: 1229567 - DNA, 22 bp, Artificial Sequence
  chemically synthesized
tttccatcttttaaaaatctta

SEQ ID NO: 1229568 - DNA, 22 bp, Artificial Sequence
  chemically synthesized
ccatcttttaaaaatcttatgg

SEQ ID NO: 1229569 - DNA, 22 bp, Artificial Sequence
  chemically synthesized
catcttttaaaaatcttatggc

SEQ ID NO: 1229570 - DNA, 22 bp, Artificial Sequence
  chemically synthesized
agagagaactgtatagccataa

SEQ ID NO: 1229571 - DNA, 22 bp, Artificial Sequence
  chemically synthesized
ttaaaaatcttatggctataca

SEQ ID NO: 1229572 - DNA, 22 bp, Artificial Sequence
  chemically synthesized
taaaaatcttatggctatacag

SEQ ID NO: 1229573 - DNA, 22 bp, Artificial Sequence
  chemically synthesized
aaaaatcttatggctatacagt

SEQ ID NO: 1229574 - DNA, 22 bp, Artificial Sequence
  chemically synthesized
tattcagagagaactgtatagc

SEQ ID NO: 1229575 - DNA, 22 bp, Artificial Sequence
  chemically synthesized
aaaatcttatggctatacagtt

SEQ ID NO: 1229576 - DNA, 22 bp, Artificial Sequence
  chemically synthesized
atggctatacagttctctctga

SEQ ID NO: 1229577 - DNA, 22 bp, Artificial Sequence
  chemically synthesized
tggctatacagttctctctgaa

SEQ ID NO: 1229578 - DNA, 22 bp, Artificial Sequence
  chemically synthesized
tacagttctctctgaatacaga

SEQ ID NO: 1229579 - DNA, 22 bp, Artificial Sequence
  chemically synthesized
tctctgaatacagatttcacta

SEQ ID NO: 1229580 - DNA, 22 bp, Artificial Sequence
  chemically synthesized
atgatgtaggcatagtgaaatc

SEQ ID NO: 1229581 - DNA, 22 bp, Artificial Sequence
  chemically synthesized
tctgaatacagatttcactatg

SEQ ID NO: 1229582 - DNA, 22 bp, Artificial Sequence
  chemically synthesized
taatgatgtaggcatagtgaaa

SEQ ID NO: 1229583 - DNA, 22 bp, Artificial Sequence
  chemically synthesized
tgaatacagatttcactatgcc

SEQ ID NO: 1229584 - DNA, 22 bp, Artificial Sequence
  chemically synthesized
aatacagatttcactatgccta

SEQ ID NO: 1229585 - DNA, 22 bp, Artificial Sequence
  chemically synthesized
atacatactctaatgatgtagg

SEQ ID NO: 1229586 - DNA, 22 bp, Artificial Sequence
  chemically synthesized
cactatgcctacatcattagag

SEQ ID NO: 1229587 - DNA, 22 bp, Artificial Sequence
  chemically synthesized
actatgcctacatcattagagt

SEQ ID NO: 1229588 - DNA, 22 bp, Artificial Sequence
  chemically synthesized
tatagctcatacatactctaat

SEQ ID NO: 1229589 - DNA, 22 bp, Artificial Sequence
  chemically synthesized
atatagctcatacatactctaa

SEQ ID NO: 1229590 - DNA, 22 bp, Artificial Sequence
  chemically synthesized
tgcctacatcattagagtatgt

SEQ ID NO: 1229591 - DNA, 22 bp, Artificial Sequence
  chemically synthesized
catcattagagtatgtatgagc

SEQ ID NO: 1229592 - DNA, 22 bp, Artificial Sequence
  chemically synthesized
gtaaaatttatatagctcatac

SEQ ID NO: 1229593 - DNA, 22 bp, Artificial Sequence
  chemically synthesized
ggtaaaatttatatagctcata

SEQ ID NO: 1229594 - DNA, 22 bp, Artificial Sequence
  chemically synthesized
ttggtaaaatttatatagctca

SEQ ID NO: 1229595 - DNA, 22 bp, Artificial Sequence
  chemically synthesized
gagtatgtatgagctatataaa

SEQ ID NO: 1229596 - DNA, 22 bp, Artificial Sequence
  chemically synthesized
atgaactcttggtaaaatttat

SEQ ID NO: 1229597 - DNA, 22 bp, Artificial Sequence
  chemically synthesized
tataaattttaccaagagttca

SEQ ID NO: 1229598 - DNA, 22 bp, Artificial Sequence
  chemically synthesized
taccaagagttcatgaacattt

SEQ ID NO: 1229599 - DNA, 22 bp, Artificial Sequence
  chemically synthesized
accaagagttcatgaacatttt

SEQ ID NO: 1229600 - DNA, 22 bp, Artificial Sequence
  chemically synthesized
ccaagagttcatgaacatttta

SEQ ID NO: 1229601 - DNA, 22 bp, Artificial Sequence
  chemically synthesized
gtaaaatgcacataaatgtaaa

SEQ ID NO: 1229602 - DNA, 22 bp, Artificial Sequence
  chemically synthesized
ggtaaaatgcacataaatgtaa

SEQ ID NO: 1229603 - DNA, 22 bp, Artificial Sequence
  chemically synthesized
ttggtaaaatgcacataaatgt

SEQ ID NO: 1229604 - DNA, 22 bp, Artificial Sequence
  chemically synthesized
atgaacattttacatttatgtg

SEQ ID NO: 1229605 - DNA, 22 bp, Artificial Sequence
  chemically synthesized
cctcttggtaaaatgcacataa

SEQ ID NO: 1229606 - DNA, 22 bp, Artificial Sequence
  chemically synthesized
ccctcttggtaaaatgcacata

SEQ ID NO: 1229607 - DNA, 22 bp, Artificial Sequence
  chemically synthesized
tttccctcttggtaaaatgcac

SEQ ID NO: 1229608 - DNA, 22 bp, Artificial Sequence
  chemically synthesized
tgtttccctcttggtaaaatgc

SEQ ID NO: 1229609 - DNA, 22 bp, Artificial Sequence
  chemically synthesized
tacatttatgtgcattttacca

SEQ ID NO: 1229610 - DNA, 22 bp, Artificial Sequence
  chemically synthesized
acatttatgtgcattttaccaa

SEQ ID NO: 1229611 - DNA, 22 bp, Artificial Sequence
  chemically synthesized
catttatgtgcattttaccaag

SEQ ID NO: 1229612 - DNA, 22 bp, Artificial Sequence
  chemically synthesized
atactctgtttccctcttggta

SEQ ID NO: 1229613 - DNA, 22 bp, Artificial Sequence
  chemically synthesized
gatactctgtttccctcttggt

SEQ ID NO: 1229614 - DNA, 22 bp, Artificial Sequence
  chemically synthesized
atgtgcattttaccaagaggga

SEQ ID NO: 1229615 - DNA, 22 bp, Artificial Sequence
  chemically synthesized
tgatactctgtttccctcttgg

SEQ ID NO: 1229616 - DNA, 22 bp, Artificial Sequence
  chemically synthesized
tgtgcattttaccaagagggaa

SEQ ID NO: 1229617 - DNA, 22 bp, Artificial Sequence
  chemically synthesized
tctttgatactctgtttccctc

SEQ ID NO: 1229618 - DNA, 22 bp, Artificial Sequence
  chemically synthesized
atctttgatactctgtttccct

SEQ ID NO: 1229619 - DNA, 22 bp, Artificial Sequence
  chemically synthesized
atttatctttgatactctgttt

SEQ ID NO: 1229620 - DNA, 22 bp, Artificial Sequence
  chemically synthesized
taccaagagggaaacagagtat

SEQ ID NO: 1229621 - DNA, 22 bp, Artificial Sequence
  chemically synthesized
catttatctttgatactctgtt

SEQ ID NO: 1229622 - DNA, 22 bp, Artificial Sequence
  chemically synthesized
accaagagggaaacagagtatc

SEQ ID NO: 1229623 - DNA, 22 bp, Artificial Sequence
  chemically synthesized
ccaagagggaaacagagtatca

SEQ ID NO: 1229624 - DNA, 22 bp, Artificial Sequence
  chemically synthesized
tggaagcttcatttatctttga

SEQ ID NO: 1229625 - DNA, 22 bp, Artificial Sequence
  chemically synthesized
gtggaagcttcatttatctttg

SEQ ID NO: 1229626 - DNA, 22 bp, Artificial Sequence
  chemically synthesized
aatcagaccttgtggaagcttc

SEQ ID NO: 1229627 - DNA, 22 bp, Artificial Sequence
  chemically synthesized
aaatcagaccttgtggaagctt

SEQ ID NO: 1229628 - DNA, 22 bp, Artificial Sequence
  chemically synthesized
taaatcagaccttgtggaagct

SEQ ID NO: 1229629 - DNA, 22 bp, Artificial Sequence
  chemically synthesized
tccagacatagttttaaatcag

SEQ ID NO: 1229630 - DNA, 22 bp, Artificial Sequence
  chemically synthesized
tatccagacatagttttaaatc

SEQ ID NO: 1229631 - DNA, 22 bp, Artificial Sequence
  chemically synthesized
ccacaaggtctgatttaaaact

SEQ ID NO: 1229632 - DNA, 22 bp, Artificial Sequence
  chemically synthesized
ctatccagacatagttttaaat

SEQ ID NO: 1229633 - DNA, 22 bp, Artificial Sequence
  chemically synthesized
cacaaggtctgatttaaaacta

SEQ ID NO: 1229634 - DNA, 22 bp, Artificial Sequence
  chemically synthesized
atttaaaactatgtctggatag

SEQ ID NO: 1229635 - DNA, 22 bp, Artificial Sequence
  chemically synthesized
atgaaatatcttctatccagac

SEQ ID NO: 1229636 - DNA, 22 bp, Artificial Sequence
  chemically synthesized
aaaactatgtctggatagaaga

SEQ ID NO: 1229637 - DNA, 22 bp, Artificial Sequence
  chemically synthesized
aaactatgtctggatagaagat

SEQ ID NO: 1229638 - DNA, 22 bp, Artificial Sequence
  chemically synthesized
gatgtaattaatgaaatatctt

SEQ ID NO: 1229639 - DNA, 22 bp, Artificial Sequence
  chemically synthesized
tgtctggatagaagatatttca

SEQ ID NO: 1229640 - DNA, 22 bp, Artificial Sequence
  chemically synthesized
actagatgtaattaatgaaata

SEQ ID NO: 1229641 - DNA, 22 bp, Artificial Sequence
  chemically synthesized
gatagaagatatttcattaatt

SEQ ID NO: 1229642 - DNA, 22 bp, Artificial Sequence
  chemically synthesized
tggagaattcactagatgtaat

SEQ ID NO: 1229643 - DNA, 22 bp, Artificial Sequence
  chemically synthesized
gtggagaattcactagatgtaa

SEQ ID NO: 1229644 - DNA, 22 bp, Artificial Sequence
  chemically synthesized
tgtggagaattcactagatgta

SEQ ID NO: 1229645 - DNA, 22 bp, Artificial Sequence
  chemically synthesized
ttgtggagaattcactagatgt

SEQ ID NO: 1229646 - DNA, 22 bp, Artificial Sequence
  chemically synthesized
tttgtggagaattcactagatg

SEQ ID NO: 1229647 - DNA, 22 bp, Artificial Sequence
  chemically synthesized
cattaattacatctagtgaatt

SEQ ID NO: 1229648 - DNA, 22 bp, Artificial Sequence
  chemically synthesized
attaattacatctagtgaattc

SEQ ID NO: 1229649 - DNA, 22 bp, Artificial Sequence
  chemically synthesized
aagctttttgtggagaattcac

SEQ ID NO: 1229650 - DNA, 22 bp, Artificial Sequence
  chemically synthesized
aaagctttttgtggagaattca

SEQ ID NO: 1229651 - DNA, 22 bp, Artificial Sequence
  chemically synthesized
attacatctagtgaattctcca

SEQ ID NO: 1229652 - DNA, 22 bp, Artificial Sequence
  chemically synthesized
ttaaagctttttgtggagaatt

SEQ ID NO: 1229653 - DNA, 22 bp, Artificial Sequence
  chemically synthesized
catctagtgaattctccacaaa

SEQ ID NO: 1229654 - DNA, 22 bp, Artificial Sequence
  chemically synthesized
gtgaattctccacaaaaagctt

SEQ ID NO: 1229655 - DNA, 22 bp, Artificial Sequence
  chemically synthesized
gagagagagcctcttaaagctt

SEQ ID NO: 1229656 - DNA, 22 bp, Artificial Sequence
  chemically synthesized
ggagagagagcctcttaaagct

SEQ ID NO: 1229657 - DNA, 22 bp, Artificial Sequence
  chemically synthesized
tccacaaaaagctttaagaggc

SEQ ID NO: 1229658 - DNA, 22 bp, Artificial Sequence
  chemically synthesized
acttggagagagagcctcttaa

SEQ ID NO: 1229659 - DNA, 22 bp, Artificial Sequence
  chemically synthesized
cacaaaaagctttaagaggctc

SEQ ID NO: 1229660 - DNA, 22 bp, Artificial Sequence
  chemically synthesized
ttaacttggagagagagcctct

SEQ ID NO: 1229661 - DNA, 22 bp, Artificial Sequence
  chemically synthesized
attaacttggagagagagcctc

SEQ ID NO: 1229662 - DNA, 22 bp, Artificial Sequence
  chemically synthesized
taagaggctctctctccaagtt

SEQ ID NO: 1229663 - DNA, 22 bp, Artificial Sequence
  chemically synthesized
aagaggctctctctccaagtta

SEQ ID NO: 1229664 - DNA, 22 bp, Artificial Sequence
  chemically synthesized
agaggctctctctccaagttaa

SEQ ID NO: 1229665 - DNA, 22 bp, Artificial Sequence
  chemically synthesized
tctctccaagttaataaacatt

SEQ ID NO: 1229666 - DNA, 22 bp, Artificial Sequence
  chemically synthesized
tatcatggtgtgaaatgtttat

SEQ ID NO: 1229667 - DNA, 22 bp, Artificial Sequence
  chemically synthesized
tctccaagttaataaacatttc

SEQ ID NO: 1229668 - DNA, 22 bp, Artificial Sequence
  chemically synthesized
tccaagttaataaacatttcac

SEQ ID NO: 1229669 - DNA, 22 bp, Artificial Sequence
  chemically synthesized
tctgtatcatggtgtgaaatgt

SEQ ID NO: 1229670 - DNA, 22 bp, Artificial Sequence
  chemically synthesized
caagttaataaacatttcacac

SEQ ID NO: 1229671 - DNA, 22 bp, Artificial Sequence
  chemically synthesized
gtctgtatcatggtgtgaaatg

SEQ ID NO: 1229672 - DNA, 22 bp, Artificial Sequence
  chemically synthesized
ataaacatttcacaccatgata

SEQ ID NO: 1229673 - DNA, 22 bp, Artificial Sequence
  chemically synthesized
cacaccatgatacagacaagga

SEQ ID NO: 1229674 - DNA, 22 bp, Artificial Sequence
  chemically synthesized
acaccatgatacagacaaggat

SEQ ID NO: 1229675 - DNA, 22 bp, Artificial Sequence
  chemically synthesized
ttatttattttggttgtgtttt

SEQ ID NO: 1229676 - DNA, 22 bp, Artificial Sequence
  chemically synthesized
tttattttggttgtgttttgtc

SEQ ID NO: 1229677 - DNA, 22 bp, Artificial Sequence
  chemically synthesized
attttggttgtgttttgtctct

SEQ ID NO: 1229678 - DNA, 22 bp, Artificial Sequence
  chemically synthesized
ttttggttgtgttttgtctctt

SEQ ID NO: 1229679 - DNA, 22 bp, Artificial Sequence
  chemically synthesized
aagaagacatgtacaagagaca

SEQ ID NO: 1229680 - DNA, 22 bp, Artificial Sequence
  chemically synthesized
tggttgtgttttgtctcttgta

SEQ ID NO: 1229681 - DNA, 22 bp, Artificial Sequence
  chemically synthesized
gaagaagacatgtacaagagac

SEQ ID NO: 1229682 - DNA, 22 bp, Artificial Sequence
  chemically synthesized
ggttgtgttttgtctcttgtac

SEQ ID NO: 1229683 - DNA, 22 bp, Artificial Sequence
  chemically synthesized
gttgtgttttgtctcttgtaca

SEQ ID NO: 1229684 - DNA, 22 bp, Artificial Sequence
  chemically synthesized
tgttttgtctcttgtacatgtc

SEQ ID NO: 1229685 - DNA, 22 bp, Artificial Sequence
  chemically synthesized
gtagtttgaagaagacatgtac

SEQ ID NO: 1229686 - DNA, 22 bp, Artificial Sequence
  chemically synthesized
ggtagtttgaagaagacatgta

SEQ ID NO: 1229687 - DNA, 22 bp, Artificial Sequence
  chemically synthesized
tgtctcttgtacatgtcttctt

SEQ ID NO: 1229688 - DNA, 22 bp, Artificial Sequence
  chemically synthesized
cttggtagtttgaagaagacat

SEQ ID NO: 1229689 - DNA, 22 bp, Artificial Sequence
  chemically synthesized
gtctcttgtacatgtcttcttc

SEQ ID NO: 1229690 - DNA, 22 bp, Artificial Sequence
  chemically synthesized
tctcttgtacatgtcttcttca

SEQ ID NO: 1229691 - DNA, 22 bp, Artificial Sequence
  chemically synthesized
cactccttggtagtttgaagaa

SEQ ID NO: 1229692 - DNA, 22 bp, Artificial Sequence
  chemically synthesized
ttgtacatgtcttcttcaaact

SEQ ID NO: 1229693 - DNA, 22 bp, Artificial Sequence
  chemically synthesized
acactccttggtagtttgaaga

SEQ ID NO: 1229694 - DNA, 22 bp, Artificial Sequence
  chemically synthesized
gtacatgtcttcttcaaactac

SEQ ID NO: 1229695 - DNA, 22 bp, Artificial Sequence
  chemically synthesized
ttacactccttggtagtttgaa

SEQ ID NO: 1229696 - DNA, 22 bp, Artificial Sequence
  chemically synthesized
tacatgtcttcttcaaactacc

SEQ ID NO: 1229697 - DNA, 22 bp, Artificial Sequence
  chemically synthesized
cttacactccttggtagtttga

SEQ ID NO: 1229698 - DNA, 22 bp, Artificial Sequence
  chemically synthesized
gcatttcttacactccttggta

SEQ ID NO: 1229699 - DNA, 22 bp, Artificial Sequence
  chemically synthesized
cttcaaactaccaaggagtgta

SEQ ID NO: 1229700 - DNA, 22 bp, Artificial Sequence
  chemically synthesized
ttcaaactaccaaggagtgtaa

SEQ ID NO: 1229701 - DNA, 22 bp, Artificial Sequence
  chemically synthesized
caaactaccaaggagtgtaaga

SEQ ID NO: 1229702 - DNA, 22 bp, Artificial Sequence
  chemically synthesized
tcaattagcatttcttacactc

SEQ ID NO: 1229703 - DNA, 22 bp, Artificial Sequence
  chemically synthesized
aaactaccaaggagtgtaagaa

SEQ ID NO: 1229704 - DNA, 22 bp, Artificial Sequence
  chemically synthesized
ccaaggagtgtaagaaatgcta

SEQ ID NO: 1229705 - DNA, 22 bp, Artificial Sequence
  chemically synthesized
atggttatcaattagcatttct

SEQ ID NO: 1229706 - DNA, 22 bp, Artificial Sequence
  chemically synthesized
catggttatcaattagcatttc

SEQ ID NO: 1229707 - DNA, 22 bp, Artificial Sequence
  chemically synthesized
gagtcttcatggttatcaatta

SEQ ID NO: 1229708 - DNA, 22 bp, Artificial Sequence
  chemically synthesized
tagagtcttcatggttatcaat

SEQ ID NO: 1229709 - DNA, 22 bp, Artificial Sequence
  chemically synthesized
ctctagagtcttcatggttatc

SEQ ID NO: 1229710 - DNA, 22 bp, Artificial Sequence
  chemically synthesized
cctcctctagagtcttcatggt

SEQ ID NO: 1229711 - DNA, 22 bp, Artificial Sequence
  chemically synthesized
attgataaccatgaagactcta

SEQ ID NO: 1229712 - DNA, 22 bp, Artificial Sequence
  chemically synthesized
ataaccatgaagactctagagg

SEQ ID NO: 1229713 - DNA, 22 bp, Artificial Sequence
  chemically synthesized
aggcatgacaaatacctccctc

SEQ ID NO: 1229714 - DNA, 22 bp, Artificial Sequence
  chemically synthesized
caggcatgacaaatacctccct

SEQ ID NO: 1229715 - DNA, 22 bp, Artificial Sequence
  chemically synthesized
tcaggcatgacaaatacctccc

SEQ ID NO: 1229716 - DNA, 22 bp, Artificial Sequence
  chemically synthesized
tagaggagggaggtatttgtca

SEQ ID NO: 1229717 - DNA, 22 bp, Artificial Sequence
  chemically synthesized
gaggagggaggtatttgtcatg

SEQ ID NO: 1229718 - DNA, 22 bp, Artificial Sequence
  chemically synthesized
gtcatgcctgaaagggtattgt

SEQ ID NO: 1229719 - DNA, 22 bp, Artificial Sequence
  chemically synthesized
tcatgcctgaaagggtattgtt

SEQ ID NO: 1229720 - DNA, 22 bp, Artificial Sequence
  chemically synthesized
aaagggtattgttcatggcatt

SEQ ID NO: 1229721 - DNA, 22 bp, Artificial Sequence
  chemically synthesized
aagagtaatataaatgccatga

SEQ ID NO: 1229722 - DNA, 22 bp, Artificial Sequence
  chemically synthesized
ttcatggcatttatattactct

SEQ ID NO: 1229723 - DNA, 22 bp, Artificial Sequence
  chemically synthesized
atggcatttatattactcttca

SEQ ID NO: 1229724 - DNA, 22 bp, Artificial Sequence
  chemically synthesized
atattactcttcaatgcctcac

SEQ ID NO: 1229725 - DNA, 22 bp, Artificial Sequence
  chemically synthesized
tattactcttcaatgcctcaca

SEQ ID NO: 1229726 - DNA, 22 bp, Artificial Sequence
  chemically synthesized
ctcttcaatgcctcacattgac

SEQ ID NO: 1229727 - DNA, 22 bp, Artificial Sequence
  chemically synthesized
ttcaatgcctcacattgacggt

SEQ ID NO: 1229728 - DNA, 22 bp, Artificial Sequence
  chemically synthesized
caatgcctcacattgacggtct

SEQ ID NO: 1229729 - DNA, 22 bp, Artificial Sequence
  chemically synthesized
aatgcctcacattgacggtctg

SEQ ID NO: 1229730 - DNA, 22 bp, Artificial Sequence
  chemically synthesized
atggccaaaacagaccagaccg

SEQ ID NO: 1229731 - DNA, 22 bp, Artificial Sequence
  chemically synthesized
acattgacggtctggtctgttt

SEQ ID NO: 1229732 - DNA, 22 bp, Artificial Sequence
  chemically synthesized
tgagaattcatggccaaaacag

SEQ ID NO: 1229733 - DNA, 22 bp, Artificial Sequence
  chemically synthesized
atgagaattcatggccaaaaca

SEQ ID NO: 1229734 - DNA, 22 bp, Artificial Sequence
  chemically synthesized
acggtctggtctgttttggcca

SEQ ID NO: 1229735 - DNA, 22 bp, Artificial Sequence
  chemically synthesized
gtctgttttggccatgaattct

SEQ ID NO: 1229736 - DNA, 22 bp, Artificial Sequence
  chemically synthesized
ttttggccatgaattctcataa

SEQ ID NO: 1229737 - DNA, 22 bp, Artificial Sequence
  chemically synthesized
taagagcaacaagcttatgaga

SEQ ID NO: 1229738 - DNA, 22 bp, Artificial Sequence
  chemically synthesized
tggccatgaattctcataagct

SEQ ID NO: 1229739 - DNA, 22 bp, Artificial Sequence
  chemically synthesized
ggccatgaattctcataagctt

SEQ ID NO: 1229740 - DNA, 22 bp, Artificial Sequence
  chemically synthesized
gccatgaattctcataagcttg

SEQ ID NO: 1229741 - DNA, 22 bp, Artificial Sequence
  chemically synthesized
tcataagcttgttgctcttata

SEQ ID NO: 1229742 - DNA, 22 bp, Artificial Sequence
  chemically synthesized
ataagcttgttgctcttataat

SEQ ID NO: 1229743 - DNA, 22 bp, Artificial Sequence
  chemically synthesized
atagtaagaaatacagcattat

SEQ ID NO: 1229744 - DNA, 22 bp, Artificial Sequence
  chemically synthesized
gttgctcttataatgctgtatt

SEQ ID NO: 1229745 - DNA, 22 bp, Artificial Sequence
  chemically synthesized
ttgctcttataatgctgtattt

SEQ ID NO: 1229746 - DNA, 22 bp, Artificial Sequence
  chemically synthesized
cagctaatagtaagaaatacag

SEQ ID NO: 1229747 - DNA, 22 bp, Artificial Sequence
  chemically synthesized
ctcttataatgctgtatttctt

SEQ ID NO: 1229748 - DNA, 22 bp, Artificial Sequence
  chemically synthesized
acagctaatagtaagaaataca

SEQ ID NO: 1229749 - DNA, 22 bp, Artificial Sequence
  chemically synthesized
ttataatgctgtatttcttact

SEQ ID NO: 1229750 - DNA, 22 bp, Artificial Sequence
  chemically synthesized
ataatgctgtatttcttactat

SEQ ID NO: 1229751 - DNA, 22 bp, Artificial Sequence
  chemically synthesized
taatgctgtatttcttactatt

SEQ ID NO: 1229752 - DNA, 22 bp, Artificial Sequence
  chemically synthesized
tgacttacagctaatagtaaga

SEQ ID NO: 1229753 - DNA, 22 bp, Artificial Sequence
  chemically synthesized
tatttcttactattagctgtaa

SEQ ID NO: 1229754 - DNA, 22 bp, Artificial Sequence
  chemically synthesized
agaaaaatgttatgacttacag

SEQ ID NO: 1229755 - DNA, 22 bp, Artificial Sequence
  chemically synthesized
cttactattagctgtaagtcat

SEQ ID NO: 1229756 - DNA, 22 bp, Artificial Sequence
  chemically synthesized
ttactattagctgtaagtcata

SEQ ID NO: 1229757 - DNA, 22 bp, Artificial Sequence
  chemically synthesized
actattagctgtaagtcataac

SEQ ID NO: 1229758 - DNA, 22 bp, Artificial Sequence
  chemically synthesized
ctattagctgtaagtcataaca

SEQ ID NO: 1229759 - DNA, 22 bp, Artificial Sequence
  chemically synthesized
aattcagaaaaatgttatgact

SEQ ID NO: 1229760 - DNA, 22 bp, Artificial Sequence
  chemically synthesized
ttagctgtaagtcataacattt

SEQ ID NO: 1229761 - DNA, 22 bp, Artificial Sequence
  chemically synthesized
gctgtaagtcataacatttttc

SEQ ID NO: 1229762 - DNA, 22 bp, Artificial Sequence
  chemically synthesized
taagtcataacatttttctgaa

SEQ ID NO: 1229763 - DNA, 22 bp, Artificial Sequence
  chemically synthesized
agaggaaatagtactgaattca

SEQ ID NO: 1229764 - DNA, 22 bp, Artificial Sequence
  chemically synthesized
aagaggaaatagtactgaattc

SEQ ID NO: 1229765 - DNA, 22 bp, Artificial Sequence
  chemically synthesized
tttaagaggaaatagtactgaa

SEQ ID NO: 1229766 - DNA, 22 bp, Artificial Sequence
  chemically synthesized
ttctgaattcagtactatttcc

SEQ ID NO: 1229767 - DNA, 22 bp, Artificial Sequence
  chemically synthesized
tctgaattcagtactatttcct

SEQ ID NO: 1229768 - DNA, 22 bp, Artificial Sequence
  chemically synthesized
ctgaattcagtactatttcctc

SEQ ID NO: 1229769 - DNA, 22 bp, Artificial Sequence
  chemically synthesized
tgaattcagtactatttcctct

SEQ ID NO: 1229770 - DNA, 22 bp, Artificial Sequence
  chemically synthesized
aattcagtactatttcctctta

SEQ ID NO: 1229771 - DNA, 22 bp, Artificial Sequence
  chemically synthesized
agtactatttcctcttaaataa

SEQ ID NO: 1229772 - DNA, 22 bp, Artificial Sequence
  chemically synthesized
tatggcagggtgatgattattt

SEQ ID NO: 1229773 - DNA, 22 bp, Artificial Sequence
  chemically synthesized
tttcctcttaaataatcatcac

SEQ ID NO: 1229774 - DNA, 22 bp, Artificial Sequence
  chemically synthesized
ctgtatggcagggtgatgatta

SEQ ID NO: 1229775 - DNA, 22 bp, Artificial Sequence
  chemically synthesized
cctcttaaataatcatcaccct

SEQ ID NO: 1229776 - DNA, 22 bp, Artificial Sequence
  chemically synthesized
ctcttaaataatcatcaccctg

SEQ ID NO: 1229777 - DNA, 22 bp, Artificial Sequence
  chemically synthesized
ttaaataatcatcaccctgcca

SEQ ID NO: 1229778 - DNA, 22 bp, Artificial Sequence
  chemically synthesized
aaataatcatcaccctgccata

SEQ ID NO: 1229779 - DNA, 22 bp, Artificial Sequence
  chemically synthesized
aataatcatcaccctgccatac

SEQ ID NO: 1229780 - DNA, 22 bp, Artificial Sequence
  chemically synthesized
ccatacagtaacttctctttta

SEQ ID NO: 1229781 - DNA, 22 bp, Artificial Sequence
  chemically synthesized
gaaaaaaaaacataaaagagaa

SEQ ID NO: 1229782 - DNA, 22 bp, Artificial Sequence
  chemically synthesized
gaatgtgtattagaaaaaaaaa

SEQ ID NO: 1229783 - DNA, 22 bp, Artificial Sequence
  chemically synthesized
ctcttttatgtttttttttcta

SEQ ID NO: 1229784 - DNA, 22 bp, Artificial Sequence
  chemically synthesized
tggaatgtgtattagaaaaaaa

SEQ ID NO: 1229785 - DNA, 22 bp, Artificial Sequence
  chemically synthesized
tcttttatgtttttttttctaa

SEQ ID NO: 1229786 - DNA, 22 bp, Artificial Sequence
  chemically synthesized
ttttatgtttttttttctaata

SEQ ID NO: 1229787 - DNA, 22 bp, Artificial Sequence
  chemically synthesized
ttatgtttttttttctaataca

SEQ ID NO: 1229788 - DNA, 22 bp, Artificial Sequence
  chemically synthesized
tatgtttttttttctaatacac

SEQ ID NO: 1229789 - DNA, 22 bp, Artificial Sequence
  chemically synthesized
atgtttttttttctaatacaca

SEQ ID NO: 1229790 - DNA, 22 bp, Artificial Sequence
  chemically synthesized
tgtttttttttctaatacacat

SEQ ID NO: 1229791 - DNA, 22 bp, Artificial Sequence
  chemically synthesized
ttttttctaatacacattccag

SEQ ID NO: 1229792 - DNA, 22 bp, Artificial Sequence
  chemically synthesized
aaagacataattctggaatgtg

SEQ ID NO: 1229793 - DNA, 22 bp, Artificial Sequence
  chemically synthesized
tttttctaatacacattccaga

SEQ ID NO: 1229794 - DNA, 22 bp, Artificial Sequence
  chemically synthesized
gaaagacataattctggaatgt

SEQ ID NO: 1229795 - DNA, 22 bp, Artificial Sequence
  chemically synthesized
ttttctaatacacattccagaa

SEQ ID NO: 1229796 - DNA, 22 bp, Artificial Sequence
  chemically synthesized
tttctaatacacattccagaat

SEQ ID NO: 1229797 - DNA, 22 bp, Artificial Sequence
  chemically synthesized
ttgaaagacataattctggaat

SEQ ID NO: 1229798 - DNA, 22 bp, Artificial Sequence
  chemically synthesized
ttctaatacacattccagaatt

SEQ ID NO: 1229799 - DNA, 22 bp, Artificial Sequence
  chemically synthesized
tctaatacacattccagaatta

SEQ ID NO: 1229800 - DNA, 22 bp, Artificial Sequence
  chemically synthesized
ctaatacacattccagaattat

SEQ ID NO: 1229801 - DNA, 22 bp, Artificial Sequence
  chemically synthesized
taatacacattccagaattatg

SEQ ID NO: 1229802 - DNA, 22 bp, Artificial Sequence
  chemically synthesized
atacacattccagaattatgtc

SEQ ID NO: 1229803 - DNA, 22 bp, Artificial Sequence
  chemically synthesized
ataattcttgaaagacataatt

SEQ ID NO: 1229804 - DNA, 22 bp, Artificial Sequence
  chemically synthesized
gactgataattcttgaaagaca

SEQ ID NO: 1229805 - DNA, 22 bp, Artificial Sequence
  chemically synthesized
cagaattatgtctttcaagaat

SEQ ID NO: 1229806 - DNA, 22 bp, Artificial Sequence
  chemically synthesized
gcaattagactgataattcttg

SEQ ID NO: 1229807 - DNA, 22 bp, Artificial Sequence
  chemically synthesized
agcaattagactgataattctt

SEQ ID NO: 1229808 - DNA, 22 bp, Artificial Sequence
  chemically synthesized
tttagcaattagactgataatt

SEQ ID NO: 1229809 - DNA, 22 bp, Artificial Sequence
  chemically synthesized
tgtctttcaagaattatcagtc

SEQ ID NO: 1229810 - DNA, 22 bp, Artificial Sequence
  chemically synthesized
agttatttagcaattagactga

SEQ ID NO: 1229811 - DNA, 22 bp, Artificial Sequence
  chemically synthesized
tcaagaattatcagtctaattg

SEQ ID NO: 1229812 - DNA, 22 bp, Artificial Sequence
  chemically synthesized
caagaattatcagtctaattgc

SEQ ID NO: 1229813 - DNA, 22 bp, Artificial Sequence
  chemically synthesized
aagaattatcagtctaattgct

SEQ ID NO: 1229814 - DNA, 22 bp, Artificial Sequence
  chemically synthesized
ccattcagttatttagcaatta

SEQ ID NO: 1229815 - DNA, 22 bp, Artificial Sequence
  chemically synthesized
accattcagttatttagcaatt

SEQ ID NO: 1229816 - DNA, 22 bp, Artificial Sequence
  chemically synthesized
taccattcagttatttagcaat

SEQ ID NO: 1229817 - DNA, 22 bp, Artificial Sequence
  chemically synthesized
ttaccattcagttatttagcaa

SEQ ID NO: 1229818 - DNA, 22 bp, Artificial Sequence
  chemically synthesized
tcagtctaattgctaaataact

SEQ ID NO: 1229819 - DNA, 22 bp, Artificial Sequence
  chemically synthesized
atatttttaccattcagttatt

SEQ ID NO: 1229820 - DNA, 22 bp, Artificial Sequence
  chemically synthesized
aatatttttaccattcagttat

SEQ ID NO: 1229821 - DNA, 22 bp, Artificial Sequence
  chemically synthesized
taatatttttaccattcagtta

SEQ ID NO: 1229822 - DNA, 22 bp, Artificial Sequence
  chemically synthesized
attgctaaataactgaatggta

SEQ ID NO: 1229823 - DNA, 22 bp, Artificial Sequence
  chemically synthesized
ctaaataactgaatggtaaaaa

SEQ ID NO: 1229824 - DNA, 22 bp, Artificial Sequence
  chemically synthesized
aaaggttttaatatttttacca

SEQ ID NO: 1229825 - DNA, 22 bp, Artificial Sequence
  chemically synthesized
aaaaggttttaatatttttacc

SEQ ID NO: 1229826 - DNA, 22 bp, Artificial Sequence
  chemically synthesized
aataactgaatggtaaaaatat

SEQ ID NO: 1229827 - DNA, 22 bp, Artificial Sequence
  chemically synthesized
taaaaggttttaatatttttac

SEQ ID NO: 1229828 - DNA, 22 bp, Artificial Sequence
  chemically synthesized
aatggtaaaaatattaaaacct

SEQ ID NO: 1229829 - DNA, 22 bp, Artificial Sequence
  chemically synthesized
acacagattttaaaaggtttta

SEQ ID NO: 1229830 - DNA, 22 bp, Artificial Sequence
  chemically synthesized
cacacagattttaaaaggtttt

SEQ ID NO: 1229831 - DNA, 22 bp, Artificial Sequence
  chemically synthesized
acttcacacagattttaaaagg

SEQ ID NO: 1229832 - DNA, 22 bp, Artificial Sequence
  chemically synthesized
aaaccttttaaaatctgtgtga

SEQ ID NO: 1229833 - DNA, 22 bp, Artificial Sequence
  chemically synthesized
ttaaaatctgtgtgaagtgaat

SEQ ID NO: 1229834 - DNA, 22 bp, Artificial Sequence
  chemically synthesized
taaaatctgtgtgaagtgaatg

SEQ ID NO: 1229835 - DNA, 22 bp, Artificial Sequence
  chemically synthesized
aaaatctgtgtgaagtgaatga

SEQ ID NO: 1229836 - DNA, 22 bp, Artificial Sequence
  chemically synthesized
aaatctgtgtgaagtgaatgat

SEQ ID NO: 1229837 - DNA, 22 bp, Artificial Sequence
  chemically synthesized
gtagacagatgtaatcattcac

SEQ ID NO: 1229838 - DNA, 22 bp, Artificial Sequence
  chemically synthesized
agtagacagatgtaatcattca

SEQ ID NO: 1229839 - DNA, 22 bp, Artificial Sequence
  chemically synthesized
cttagtagacagatgtaatcat

SEQ ID NO: 1229840 - DNA, 22 bp, Artificial Sequence
  chemically synthesized
gcttagtagacagatgtaatca

SEQ ID NO: 1229841 - DNA, 22 bp, Artificial Sequence
  chemically synthesized
tgtgaagtgaatgattacatct

SEQ ID NO: 1229842 - DNA, 22 bp, Artificial Sequence
  chemically synthesized
tgcttagtagacagatgtaatc

SEQ ID NO: 1229843 - DNA, 22 bp, Artificial Sequence
  chemically synthesized
ttttgcttagtagacagatgta

SEQ ID NO: 1229844 - DNA, 22 bp, Artificial Sequence
  chemically synthesized
tgttttgcttagtagacagatg

SEQ ID NO: 1229845 - DNA, 22 bp, Artificial Sequence
  chemically synthesized
ctgttttgcttagtagacagat

SEQ ID NO: 1229846 - DNA, 22 bp, Artificial Sequence
  chemically synthesized
tctgttttgcttagtagacaga

SEQ ID NO: 1229847 - DNA, 22 bp, Artificial Sequence
  chemically synthesized
atgttttctgttttgcttagta

SEQ ID NO: 1229848 - DNA, 22 bp, Artificial Sequence
  chemically synthesized
catctgtctactaagcaaaaca

SEQ ID NO: 1229849 - DNA, 22 bp, Artificial Sequence
  chemically synthesized
tctactaagcaaaacagaaaac

SEQ ID NO: 1229850 - DNA, 22 bp, Artificial Sequence
  chemically synthesized
ctaagcaaaacagaaaacatta

SEQ ID NO: 1229851 - DNA, 22 bp, Artificial Sequence
  chemically synthesized
agcaaaacagaaaacattaata

SEQ ID NO: 1229852 - DNA, 22 bp, Artificial Sequence
  chemically synthesized
acatacatgtcatattaatgtt

SEQ ID NO: 1229853 - DNA, 22 bp, Artificial Sequence
  chemically synthesized
gtacattaacatacatgtcata

SEQ ID NO: 1229854 - DNA, 22 bp, Artificial Sequence
  chemically synthesized
atatgacatgtatgttaatgta

SEQ ID NO: 1229855 - DNA, 22 bp, Artificial Sequence
  chemically synthesized
atacacacagtaggctcgtaca

SEQ ID NO: 1229856 - DNA, 22 bp, Artificial Sequence
  chemically synthesized
atgtacgagcctactgtgtgta

SEQ ID NO: 1229857 - DNA, 22 bp, Artificial Sequence
  chemically synthesized
tcacaacactgatacacacagt

SEQ ID NO: 1229858 - DNA, 22 bp, Artificial Sequence
  chemically synthesized
gtcacaacactgatacacacag

SEQ ID NO: 1229859 - DNA, 22 bp, Artificial Sequence
  chemically synthesized
ctgtgtgtatcagtgttgtgac

SEQ ID NO: 1229860 - DNA, 22 bp, Artificial Sequence
  chemically synthesized
tgtgtatcagtgttgtgacaag

SEQ ID NO: 1229861 - DNA, 22 bp, Artificial Sequence
  chemically synthesized
caaccatagagtgcttgtcaca

SEQ ID NO: 1229862 - DNA, 22 bp, Artificial Sequence
  chemically synthesized
ccaaccatagagtgcttgtcac

SEQ ID NO: 1229863 - DNA, 22 bp, Artificial Sequence
  chemically synthesized
atttccaaccatagagtgcttg

SEQ ID NO: 1229864 - DNA, 22 bp, Artificial Sequence
  chemically synthesized
aatttccaaccatagagtgctt

SEQ ID NO: 1229865 - DNA, 22 bp, Artificial Sequence
  chemically synthesized
tttaatttccaaccatagagtg

SEQ ID NO: 1229866 - DNA, 22 bp, Artificial Sequence
  chemically synthesized
ctatttaatttccaaccataga

SEQ ID NO: 1229867 - DNA, 22 bp, Artificial Sequence
  chemically synthesized
tgacaagcactctatggttgga

SEQ ID NO: 1229868 - DNA, 22 bp, Artificial Sequence
  chemically synthesized
tatggttggaaattaaatagta

SEQ ID NO: 1229869 - DNA, 22 bp, Artificial Sequence
  chemically synthesized
tggttggaaattaaatagtagg

SEQ ID NO: 1229870 - DNA, 22 bp, Artificial Sequence
  chemically synthesized
ggtaaccacagtgaccctacta

SEQ ID NO: 1229871 - DNA, 22 bp, Artificial Sequence
  chemically synthesized
gggtaaccacagtgaccctact

SEQ ID NO: 1229872 - DNA, 22 bp, Artificial Sequence
  chemically synthesized
tgggtaaccacagtgaccctac

SEQ ID NO: 1229873 - DNA, 22 bp, Artificial Sequence
  chemically synthesized
gaaattaaatagtagggtcact

SEQ ID NO: 1229874 - DNA, 22 bp, Artificial Sequence
  chemically synthesized
aatagtagggtcactgtggtta

SEQ ID NO: 1229875 - DNA, 22 bp, Artificial Sequence
  chemically synthesized
tgcaaaacaggaaagcagaact

SEQ ID NO: 1229876 - DNA, 22 bp, Artificial Sequence
  chemically synthesized
tggttacccaaagttctgcttt

SEQ ID NO: 1229877 - DNA, 22 bp, Artificial Sequence
  chemically synthesized
attgtgcaaaacaggaaagcag

SEQ ID NO: 1229878 - DNA, 22 bp, Artificial Sequence
  chemically synthesized
cattgtgcaaaacaggaaagca

SEQ ID NO: 1229879 - DNA, 22 bp, Artificial Sequence
  chemically synthesized
tcattgtgcaaaacaggaaagc

SEQ ID NO: 1229880 - DNA, 22 bp, Artificial Sequence
  chemically synthesized
cccaaagttctgctttcctgtt

SEQ ID NO: 1229881 - DNA, 22 bp, Artificial Sequence
  chemically synthesized
tgctttcctgttttgcacaatg

SEQ ID NO: 1229882 - DNA, 22 bp, Artificial Sequence
  chemically synthesized
ctttcctgttttgcacaatgaa

SEQ ID NO: 1229883 - DNA, 22 bp, Artificial Sequence
  chemically synthesized
gtatcagatgttttcattgtgc

SEQ ID NO: 1229884 - DNA, 22 bp, Artificial Sequence
  chemically synthesized
ggtatcagatgttttcattgtg

SEQ ID NO: 1229885 - DNA, 22 bp, Artificial Sequence
  chemically synthesized
tggtatcagatgttttcattgt

SEQ ID NO: 1229886 - DNA, 22 bp, Artificial Sequence
  chemically synthesized
tcctgttttgcacaatgaaaac

SEQ ID NO: 1229887 - DNA, 22 bp, Artificial Sequence
  chemically synthesized
cctgttttgcacaatgaaaaca

SEQ ID NO: 1229888 - DNA, 22 bp, Artificial Sequence
  chemically synthesized
ctgttttgcacaatgaaaacat

SEQ ID NO: 1229889 - DNA, 22 bp, Artificial Sequence
  chemically synthesized
ttttggtatcagatgttttcat

SEQ ID NO: 1229890 - DNA, 22 bp, Artificial Sequence
  chemically synthesized
ttttgcacaatgaaaacatctg

SEQ ID NO: 1229891 - DNA, 22 bp, Artificial Sequence
  chemically synthesized
tgcacaatgaaaacatctgata

SEQ ID NO: 1229892 - DNA, 22 bp, Artificial Sequence
  chemically synthesized
gcacaatgaaaacatctgatac

SEQ ID NO: 1229893 - DNA, 22 bp, Artificial Sequence
  chemically synthesized
acacctattttggtatcagatg

SEQ ID NO: 1229894 - DNA, 22 bp, Artificial Sequence
  chemically synthesized
cacaatgaaaacatctgatacc

SEQ ID NO: 1229895 - DNA, 22 bp, Artificial Sequence
  chemically synthesized
cacacctattttggtatcagat

SEQ ID NO: 1229896 - DNA, 22 bp, Artificial Sequence
  chemically synthesized
tcacacctattttggtatcaga

SEQ ID NO: 1229897 - DNA, 22 bp, Artificial Sequence
  chemically synthesized
ataccaaaataggtgtgaaaat

SEQ ID NO: 1229898 - DNA, 22 bp, Artificial Sequence
  chemically synthesized
acacagaatatcaattttcaca

SEQ ID NO: 1229899 - DNA, 22 bp, Artificial Sequence
  chemically synthesized
cacacagaatatcaattttcac

SEQ ID NO: 1229900 - DNA, 22 bp, Artificial Sequence
  chemically synthesized
tcacacagaatatcaattttca

SEQ ID NO: 1229901 - DNA, 22 bp, Artificial Sequence
  chemically synthesized
cattttcacacagaatatcaat

SEQ ID NO: 1229902 - DNA, 22 bp, Artificial Sequence
  chemically synthesized
ttacattttcacacagaatatc

SEQ ID NO: 1229903 - DNA, 22 bp, Artificial Sequence
  chemically synthesized
aaggcatgttattacattttca

SEQ ID NO: 1229904 - DNA, 22 bp, Artificial Sequence
  chemically synthesized
atattctgtgtgaaaatgtaat

SEQ ID NO: 1229905 - DNA, 22 bp, Artificial Sequence
  chemically synthesized
tgtgtgaaaatgtaataacatg

SEQ ID NO: 1229906 - DNA, 22 bp, Artificial Sequence
  chemically synthesized
caaaaactcaaggcatgttatt

SEQ ID NO: 1229907 - DNA, 22 bp, Artificial Sequence
  chemically synthesized
tgtgaaaatgtaataacatgcc

SEQ ID NO: 1229908 - DNA, 22 bp, Artificial Sequence
  chemically synthesized
tgcaaaaactcaaggcatgtta

SEQ ID NO: 1229909 - DNA, 22 bp, Artificial Sequence
  chemically synthesized
ctgcaaaaactcaaggcatgtt

SEQ ID NO: 1229910 - DNA, 22 bp, Artificial Sequence
  chemically synthesized
tttctgcaaaaactcaaggcat

SEQ ID NO: 1229911 - DNA, 22 bp, Artificial Sequence
  chemically synthesized
atttctgcaaaaactcaaggca

SEQ ID NO: 1229912 - DNA, 22 bp, Artificial Sequence
  chemically synthesized
acttatttctgcaaaaactcaa

SEQ ID NO: 1229913 - DNA, 22 bp, Artificial Sequence
  chemically synthesized
aacttatttctgcaaaaactca

SEQ ID NO: 1229914 - DNA, 22 bp, Artificial Sequence
  chemically synthesized
cgtagtttaacttatttctgca

SEQ ID NO: 1229915 - DNA, 22 bp, Artificial Sequence
  chemically synthesized
gagtttttgcagaaataagtta

SEQ ID NO: 1229916 - DNA, 22 bp, Artificial Sequence
  chemically synthesized
tgctgcgtagtttaacttattt

SEQ ID NO: 1229917 - DNA, 22 bp, Artificial Sequence
  chemically synthesized
agtttttgcagaaataagttaa

SEQ ID NO: 1229918 - DNA, 22 bp, Artificial Sequence
  chemically synthesized
ttgcagaaataagttaaactac

SEQ ID NO: 1229919 - DNA, 22 bp, Artificial Sequence
  chemically synthesized
tgcagaaataagttaaactacg

SEQ ID NO: 1229920 - DNA, 22 bp, Artificial Sequence
  chemically synthesized
gcagaaataagttaaactacgc

SEQ ID NO: 1229921 - DNA, 22 bp, Artificial Sequence
  chemically synthesized
cagaaataagttaaactacgca

SEQ ID NO: 1229922 - DNA, 22 bp, Artificial Sequence
  chemically synthesized
caaaagccaattgtgctgcgta

SEQ ID NO: 1229923 - DNA, 22 bp, Artificial Sequence
  chemically synthesized
aactacgcagcacaattggctt

SEQ ID NO: 1229924 - DNA, 22 bp, Artificial Sequence
  chemically synthesized
acaggaactacaaaagccaatt

SEQ ID NO: 1229925 - DNA, 22 bp, Artificial Sequence
  chemically synthesized
ttgacaggaactacaaaagcca

SEQ ID NO: 1229926 - DNA, 22 bp, Artificial Sequence
  chemically synthesized
cgcagcacaattggcttttgta

SEQ ID NO: 1229927 - DNA, 22 bp, Artificial Sequence
  chemically synthesized
ggcctgttgacaggaactacaa

SEQ ID NO: 1229928 - DNA, 22 bp, Artificial Sequence
  chemically synthesized
aggcctgttgacaggaactaca

SEQ ID NO: 1229929 - DNA, 22 bp, Artificial Sequence
  chemically synthesized
gcttttgtagttcctgtcaaca

SEQ ID NO: 1229930 - DNA, 22 bp, Artificial Sequence
  chemically synthesized
ttgtagttcctgtcaacaggcc

SEQ ID NO: 1229931 - DNA, 22 bp, Artificial Sequence
  chemically synthesized
tgtagttcctgtcaacaggcct

SEQ ID NO: 1229932 - DNA, 22 bp, Artificial Sequence
  chemically synthesized
gtagttcctgtcaacaggccta

SEQ ID NO: 1229933 - DNA, 22 bp, Artificial Sequence
  chemically synthesized
tgagtaaaatcttaggcctgtt

SEQ ID NO: 1229934 - DNA, 22 bp, Artificial Sequence
  chemically synthesized
tagttcctgtcaacaggcctaa

SEQ ID NO: 1229935 - DNA, 22 bp, Artificial Sequence
  chemically synthesized
atgagtaaaatcttaggcctgt

SEQ ID NO: 1229936 - DNA, 22 bp, Artificial Sequence
  chemically synthesized
tatgagtaaaatcttaggcctg

SEQ ID NO: 1229937 - DNA, 22 bp, Artificial Sequence
  chemically synthesized
ctttatgagtaaaatcttaggc

SEQ ID NO: 1229938 - DNA, 22 bp, Artificial Sequence
  chemically synthesized
ctgtcaacaggcctaagatttt

SEQ ID NO: 1229939 - DNA, 22 bp, Artificial Sequence
  chemically synthesized
tcaacaggcctaagattttact

SEQ ID NO: 1229940 - DNA, 22 bp, Artificial Sequence
  chemically synthesized
agattttactcataaagtaaca

SEQ ID NO: 1229941 - DNA, 22 bp, Artificial Sequence
  chemically synthesized
agacagcatcccatgttacttt

SEQ ID NO: 1229942 - DNA, 22 bp, Artificial Sequence
  chemically synthesized
tgagacagcatcccatgttact

SEQ ID NO: 1229943 - DNA, 22 bp, Artificial Sequence
  chemically synthesized
tactcataaagtaacatgggat

SEQ ID NO: 1229944 - DNA, 22 bp, Artificial Sequence
  chemically synthesized
actcataaagtaacatgggatg

SEQ ID NO: 1229945 - DNA, 22 bp, Artificial Sequence
  chemically synthesized
ctcataaagtaacatgggatgc

SEQ ID NO: 1229946 - DNA, 22 bp, Artificial Sequence
  chemically synthesized
ataaagtaacatgggatgctgt

SEQ ID NO: 1229947 - DNA, 22 bp, Artificial Sequence
  chemically synthesized
cgaagataacagtgtaaaactc

SEQ ID NO: 1229948 - DNA, 22 bp, Artificial Sequence
  chemically synthesized
ccgaagataacagtgtaaaact

SEQ ID NO: 1229949 - DNA, 22 bp, Artificial Sequence
  chemically synthesized
tctcagagttttacactgttat

SEQ ID NO: 1229950 - DNA, 22 bp, Artificial Sequence
  chemically synthesized
agagttttacactgttatcttc

SEQ ID NO: 1229951 - DNA, 22 bp, Artificial Sequence
  chemically synthesized
aataaagcaacttccgaagata

SEQ ID NO: 1229952 - DNA, 22 bp, Artificial Sequence
  chemically synthesized
gaataaagcaacttccgaagat

SEQ ID NO: 1229953 - DNA, 22 bp, Artificial Sequence
  chemically synthesized
tacactgttatcttcggaagtt

SEQ ID NO: 1229954 - DNA, 22 bp, Artificial Sequence
  chemically synthesized
acactgttatcttcggaagttg

SEQ ID NO: 1229955 - DNA, 22 bp, Artificial Sequence
  chemically synthesized
cactgttatcttcggaagttgc

SEQ ID NO: 1229956 - DNA, 22 bp, Artificial Sequence
  chemically synthesized
catttgaataaagcaacttccg

SEQ ID NO: 1229957 - DNA, 22 bp, Artificial Sequence
  chemically synthesized
ttatcttcggaagttgctttat

SEQ ID NO: 1229958 - DNA, 22 bp, Artificial Sequence
  chemically synthesized
tcttcggaagttgctttattca

SEQ ID NO: 1229959 - DNA, 22 bp, Artificial Sequence
  chemically synthesized
caaaattacatttgaataaagc

SEQ ID NO: 1229960 - DNA, 22 bp, Artificial Sequence
  chemically synthesized
cggaagttgctttattcaaatg

SEQ ID NO: 1229961 - DNA, 22 bp, Artificial Sequence
  chemically synthesized
ggaagttgctttattcaaatgt

SEQ ID NO: 1229962 - DNA, 22 bp, Artificial Sequence
  chemically synthesized
tcctccaaaattacatttgaat

SEQ ID NO: 1229963 - DNA, 22 bp, Artificial Sequence
  chemically synthesized
tatcctccaaaattacatttga

SEQ ID NO: 1229964 - DNA, 22 bp, Artificial Sequence
  chemically synthesized
ctatcctccaaaattacatttg

SEQ ID NO: 1229965 - DNA, 22 bp, Artificial Sequence
  chemically synthesized
tctatcctccaaaattacattt

SEQ ID NO: 1229966 - DNA, 22 bp, Artificial Sequence
  chemically synthesized
ctttattcaaatgtaattttgg

SEQ ID NO: 1229967 - DNA, 22 bp, Artificial Sequence
  chemically synthesized
tattcaaatgtaattttggagg

SEQ ID NO: 1229968 - DNA, 22 bp, Artificial Sequence
  chemically synthesized
attcaaatgtaattttggagga

SEQ ID NO: 1229969 - DNA, 22 bp, Artificial Sequence
  chemically synthesized
ttcaaatgtaattttggaggat

SEQ ID NO: 1229970 - DNA, 22 bp, Artificial Sequence
  chemically synthesized
aaatgtaattttggaggataga

SEQ ID NO: 1229971 - DNA, 22 bp, Artificial Sequence
  chemically synthesized
tggaggatagaaaacctccatg

SEQ ID NO: 1229972 - DNA, 22 bp, Artificial Sequence
  chemically synthesized
ggaggatagaaaacctccatgg

SEQ ID NO: 1229973 - DNA, 22 bp, Artificial Sequence
  chemically synthesized
tgtcaaagcaaaccatggaggt

SEQ ID NO: 1229974 - DNA, 22 bp, Artificial Sequence
  chemically synthesized
gaggatagaaaacctccatggt

SEQ ID NO: 1229975 - DNA, 22 bp, Artificial Sequence
  chemically synthesized
cattatgtcaaagcaaaccatg

SEQ ID NO: 1229976 - DNA, 22 bp, Artificial Sequence
  chemically synthesized
ccattatgtcaaagcaaaccat

SEQ ID NO: 1229977 - DNA, 22 bp, Artificial Sequence
  chemically synthesized
catggtttgctttgacataatg

SEQ ID NO: 1229978 - DNA, 22 bp, Artificial Sequence
  chemically synthesized
gagtcacaataagtttccatta

SEQ ID NO: 1229979 - DNA, 22 bp, Artificial Sequence
  chemically synthesized
gctttgacataatggaaactta

SEQ ID NO: 1229980 - DNA, 22 bp, Artificial Sequence
  chemically synthesized
ctggagtcacaataagtttcca

SEQ ID NO: 1229981 - DNA, 22 bp, Artificial Sequence
  chemically synthesized
ctttgacataatggaaacttat

SEQ ID NO: 1229982 - DNA, 22 bp, Artificial Sequence
  chemically synthesized
tactggagtcacaataagtttc

SEQ ID NO: 1229983 - DNA, 22 bp, Artificial Sequence
  chemically synthesized
tgacataatggaaacttattgt

SEQ ID NO: 1229984 - DNA, 22 bp, Artificial Sequence
  chemically synthesized
gacataatggaaacttattgtg

SEQ ID NO: 1229985 - DNA, 22 bp, Artificial Sequence
  chemically synthesized
acataatggaaacttattgtga

SEQ ID NO: 1229986 - DNA, 22 bp, Artificial Sequence
  chemically synthesized
atattctactggagtcacaata

SEQ ID NO: 1229987 - DNA, 22 bp, Artificial Sequence
  chemically synthesized
aatattctactggagtcacaat

SEQ ID NO: 1229988 - DNA, 22 bp, Artificial Sequence
  chemically synthesized
taatattctactggagtcacaa

SEQ ID NO: 1229989 - DNA, 22 bp, Artificial Sequence
  chemically synthesized
acattttaatattctactggag

SEQ ID NO: 1229990 - DNA, 22 bp, Artificial Sequence
  chemically synthesized
attgtgactccagtagaatatt

SEQ ID NO: 1229991 - DNA, 22 bp, Artificial Sequence
  chemically synthesized
ttgtgactccagtagaatatta

SEQ ID NO: 1229992 - DNA, 22 bp, Artificial Sequence
  chemically synthesized
aagagttcacattttaatattc

SEQ ID NO: 1229993 - DNA, 22 bp, Artificial Sequence
  chemically synthesized
tgactccagtagaatattaaaa

SEQ ID NO: 1229994 - DNA, 22 bp, Artificial Sequence
  chemically synthesized
taaagagttcacattttaatat

SEQ ID NO: 1229995 - DNA, 22 bp, Artificial Sequence
  chemically synthesized
ctaaagagttcacattttaata

SEQ ID NO: 1229996 - DNA, 22 bp, Artificial Sequence
  chemically synthesized
cagtagaatattaaaatgtgaa

SEQ ID NO: 1229997 - DNA, 22 bp, Artificial Sequence
  chemically synthesized
aggtgtttctaaagagttcaca

SEQ ID NO: 1229998 - DNA, 22 bp, Artificial Sequence
  chemically synthesized
gaggtgtttctaaagagttcac

SEQ ID NO: 1229999 - DNA, 22 bp, Artificial Sequence
  chemically synthesized
taacttgaggtgtttctaaaga

SEQ ID NO: 1230000 - DNA, 22 bp, Artificial Sequence
  chemically synthesized
aaatgtgaactctttagaaaca

SEQ ID NO: 1230001 - DNA, 22 bp, Artificial Sequence
  chemically synthesized
ttgtaacttgaggtgtttctaa

SEQ ID NO: 1230002 - DNA, 22 bp, Artificial Sequence
  chemically synthesized
attgtaacttgaggtgtttcta

SEQ ID NO: 1230003 - DNA, 22 bp, Artificial Sequence
  chemically synthesized
cttattgtaacttgaggtgttt

SEQ ID NO: 1230004 - DNA, 22 bp, Artificial Sequence
  chemically synthesized
tttagaaacacctcaagttaca

SEQ ID NO: 1230005 - DNA, 22 bp, Artificial Sequence
  chemically synthesized
cagactgcttattgtaacttga

SEQ ID NO: 1230006 - DNA, 22 bp, Artificial Sequence
  chemically synthesized
acagactgcttattgtaacttg

SEQ ID NO: 1230007 - DNA, 22 bp, Artificial Sequence
  chemically synthesized
tagaaacacctcaagttacaat

SEQ ID NO: 1230008 - DNA, 22 bp, Artificial Sequence
  chemically synthesized
agaaacacctcaagttacaata

SEQ ID NO: 1230009 - DNA, 22 bp, Artificial Sequence
  chemically synthesized
ttacagactgcttattgtaact

SEQ ID NO: 1230010 - DNA, 22 bp, Artificial Sequence
  chemically synthesized
gaaacacctcaagttacaataa

SEQ ID NO: 1230011 - DNA, 22 bp, Artificial Sequence
  chemically synthesized
tgtgcaattcttacagactgct

SEQ ID NO: 1230012 - DNA, 22 bp, Artificial Sequence
  chemically synthesized
aagttacaataagcagtctgta

SEQ ID NO: 1230013 - DNA, 22 bp, Artificial Sequence
  chemically synthesized
tatgtgcaattcttacagactg

SEQ ID NO: 1230014 - DNA, 22 bp, Artificial Sequence
  chemically synthesized
ctatgtgcaattcttacagact

SEQ ID NO: 1230015 - DNA, 22 bp, Artificial Sequence
  chemically synthesized
tctatgtgcaattcttacagac

SEQ ID NO: 1230016 - DNA, 22 bp, Artificial Sequence
  chemically synthesized
caataagcagtctgtaagaatt

SEQ ID NO: 1230017 - DNA, 22 bp, Artificial Sequence
  chemically synthesized
ggttttctatgtgcaattctta

SEQ ID NO: 1230018 - DNA, 22 bp, Artificial Sequence
  chemically synthesized
atgtattaggttttctatgtgc

SEQ ID NO: 1230019 - DNA, 22 bp, Artificial Sequence
  chemically synthesized
aatgtattaggttttctatgtg

SEQ ID NO: 1230020 - DNA, 22 bp, Artificial Sequence
  chemically synthesized
taagaattgcacatagaaaacc

SEQ ID NO: 1230021 - DNA, 22 bp, Artificial Sequence
  chemically synthesized
aagaataatttaatgtattagg

SEQ ID NO: 1230022 - DNA, 22 bp, Artificial Sequence
  chemically synthesized
cacatagaaaacctaatacatt

SEQ ID NO: 1230023 - DNA, 22 bp, Artificial Sequence
  chemically synthesized
catactaaagaataatttaatg

SEQ ID NO: 1230024 - DNA, 22 bp, Artificial Sequence
  chemically synthesized
ctccatactaaagaataattta

SEQ ID NO: 1230025 - DNA, 22 bp, Artificial Sequence
  chemically synthesized
atacattaaattattctttagt

SEQ ID NO: 1230026 - DNA, 22 bp, Artificial Sequence
  chemically synthesized
aattattctttagtatggagta

SEQ ID NO: 1230027 - DNA, 22 bp, Artificial Sequence
  chemically synthesized
ttctttagtatggagtagtctc

SEQ ID NO: 1230028 - DNA, 22 bp, Artificial Sequence
  chemically synthesized
aaatagacagcaggagactact

SEQ ID NO: 1230029 - DNA, 22 bp, Artificial Sequence
  chemically synthesized
aaaatagacagcaggagactac

SEQ ID NO: 1230030 - DNA, 22 bp, Artificial Sequence
  chemically synthesized
tttagtatggagtagtctcctg

SEQ ID NO: 1230031 - DNA, 22 bp, Artificial Sequence
  chemically synthesized
taaaatagacagcaggagacta

SEQ ID NO: 1230032 - DNA, 22 bp, Artificial Sequence
  chemically synthesized
tagtatggagtagtctcctgct

SEQ ID NO: 1230033 - DNA, 22 bp, Artificial Sequence
  chemically synthesized
agtatggagtagtctcctgctg

SEQ ID NO: 1230034 - DNA, 22 bp, Artificial Sequence
  chemically synthesized
gtatggagtagtctcctgctgt

SEQ ID NO: 1230035 - DNA, 22 bp, Artificial Sequence
  chemically synthesized
tgcctttaaaatagacagcagg

SEQ ID NO: 1230036 - DNA, 22 bp, Artificial Sequence
  chemically synthesized
tcctatgcctttaaaatagaca

SEQ ID NO: 1230037 - DNA, 22 bp, Artificial Sequence
  chemically synthesized
gtcctatgcctttaaaatagac

SEQ ID NO: 1230038 - DNA, 22 bp, Artificial Sequence
  chemically synthesized
ttgtcctatgcctttaaaatag

SEQ ID NO: 1230039 - DNA, 22 bp, Artificial Sequence
  chemically synthesized
ctgctgtctattttaaaggcat

SEQ ID NO: 1230040 - DNA, 22 bp, Artificial Sequence
  chemically synthesized
agttcttgtcctatgcctttaa

SEQ ID NO: 1230041 - DNA, 22 bp, Artificial Sequence
  chemically synthesized
aagttcttgtcctatgccttta

SEQ ID NO: 1230042 - DNA, 22 bp, Artificial Sequence
  chemically synthesized
ctgtctattttaaaggcatagg

SEQ ID NO: 1230043 - DNA, 22 bp, Artificial Sequence
  chemically synthesized
tctattttaaaggcataggaca

SEQ ID NO: 1230044 - DNA, 22 bp, Artificial Sequence
  chemically synthesized
ttttaaaggcataggacaagaa

SEQ ID NO: 1230045 - DNA, 22 bp, Artificial Sequence
  chemically synthesized
taaaggcataggacaagaactt

SEQ ID NO: 1230046 - DNA, 22 bp, Artificial Sequence
  chemically synthesized
aaaggcataggacaagaactta

SEQ ID NO: 1230047 - DNA, 22 bp, Artificial Sequence
  chemically synthesized
aaggcataggacaagaacttaa

SEQ ID NO: 1230048 - DNA, 22 bp, Artificial Sequence
  chemically synthesized
gcgatagaagagggaccccctt

SEQ ID NO: 1230049 - DNA, 22 bp, Artificial Sequence
  chemically synthesized
gtctggcgatagaagagggacc

SEQ ID NO: 1230050 - DNA, 22 bp, Artificial Sequence
  chemically synthesized
aagggggtccctcttctatcgc

SEQ ID NO: 1230051 - DNA, 22 bp, Artificial Sequence
  chemically synthesized
agggggtccctcttctatcgcc

SEQ ID NO: 1230052 - DNA, 22 bp, Artificial Sequence
  chemically synthesized
taagtactagtctggcgataga

SEQ ID NO: 1230053 - DNA, 22 bp, Artificial Sequence
  chemically synthesized
tgtattgtaagtactagtctgg

SEQ ID NO: 1230054 - DNA, 22 bp, Artificial Sequence
  chemically synthesized
ttctatcgccagactagtactt

SEQ ID NO: 1230055 - DNA, 22 bp, Artificial Sequence
  chemically synthesized
ctatcgccagactagtacttac

SEQ ID NO: 1230056 - DNA, 22 bp, Artificial Sequence
  chemically synthesized
tatcgccagactagtacttaca

SEQ ID NO: 1230057 - DNA, 22 bp, Artificial Sequence
  chemically synthesized
tcgccagactagtacttacaat

SEQ ID NO: 1230058 - DNA, 22 bp, Artificial Sequence
  chemically synthesized
tacaaaattatgtattgtaagt

SEQ ID NO: 1230059 - DNA, 22 bp, Artificial Sequence
  chemically synthesized
ttatacaaaattatgtattgta

SEQ ID NO: 1230060 - DNA, 22 bp, Artificial Sequence
  chemically synthesized
gtacttacaatacataattttg

SEQ ID NO: 1230061 - DNA, 22 bp, Artificial Sequence
  chemically synthesized
aatatatattgttatacaaaat

SEQ ID NO: 1230062 - DNA, 22 bp, Artificial Sequence
  chemically synthesized
acaatacataattttgtataac

SEQ ID NO: 1230063 - DNA, 22 bp, Artificial Sequence
  chemically synthesized
caatacataattttgtataaca

SEQ ID NO: 1230064 - DNA, 22 bp, Artificial Sequence
  chemically synthesized
ctaaatatatattgttatacaa

SEQ ID NO: 1230065 - DNA, 22 bp, Artificial Sequence
  chemically synthesized
gaattactaaatatatattgtt

SEQ ID NO: 1230066 - DNA, 22 bp, Artificial Sequence
  chemically synthesized
agaattactaaatatatattgt

SEQ ID NO: 1230067 - DNA, 22 bp, Artificial Sequence
  chemically synthesized
atcttagaattactaaatatat

SEQ ID NO: 1230068 - DNA, 22 bp, Artificial Sequence
  chemically synthesized
tgtataacaatatatatttagt

SEQ ID NO: 1230069 - DNA, 22 bp, Artificial Sequence
  chemically synthesized
gtataacaatatatatttagta

SEQ ID NO: 1230070 - DNA, 22 bp, Artificial Sequence
  chemically synthesized
tataacaatatatatttagtaa

SEQ ID NO: 1230071 - DNA, 22 bp, Artificial Sequence
  chemically synthesized
tatattaatcttagaattacta

SEQ ID NO: 1230072 - DNA, 22 bp, Artificial Sequence
  chemically synthesized
aaatgattatatattaatctta

SEQ ID NO: 1230073 - DNA, 22 bp, Artificial Sequence
  chemically synthesized
agtaattctaagattaatatat

SEQ ID NO: 1230074 - DNA, 22 bp, Artificial Sequence
  chemically synthesized
cctgaaatgattatatattaat

SEQ ID NO: 1230075 - DNA, 22 bp, Artificial Sequence
  chemically synthesized
gtaattctaagattaatatata

SEQ ID NO: 1230076 - DNA, 22 bp, Artificial Sequence
  chemically synthesized
taagattaatatataatcattt

SEQ ID NO: 1230077 - DNA, 22 bp, Artificial Sequence
  chemically synthesized
agattaatatataatcatttca

SEQ ID NO: 1230078 - DNA, 22 bp, Artificial Sequence
  chemically synthesized
gaagtaaatgctccctgaaatg

SEQ ID NO: 1230079 - DNA, 22 bp, Artificial Sequence
  chemically synthesized
atatataatcatttcagggagc

SEQ ID NO: 1230080 - DNA, 22 bp, Artificial Sequence
  chemically synthesized
ggaggtagagtacctggaagta

SEQ ID NO: 1230081 - DNA, 22 bp, Artificial Sequence
  chemically synthesized
cagggagcatttacttccaggt

SEQ ID NO: 1230082 - DNA, 22 bp, Artificial Sequence
  chemically synthesized
aggaggtagagtacctggaagt

SEQ ID NO: 1230083 - DNA, 22 bp, Artificial Sequence
  chemically synthesized
agggagcatttacttccaggta

SEQ ID NO: 1230084 - DNA, 22 bp, Artificial Sequence
  chemically synthesized
acttccaggtactctacctcct

SEQ ID NO: 1230085 - DNA, 22 bp, Artificial Sequence
  chemically synthesized
cttccaggtactctacctccta

SEQ ID NO: 1230086 - DNA, 22 bp, Artificial Sequence
  chemically synthesized
atagcccagtcatttaggaggt

SEQ ID NO: 1230087 - DNA, 22 bp, Artificial Sequence
  chemically synthesized
ccaggtactctacctcctaaat

SEQ ID NO: 1230088 - DNA, 22 bp, Artificial Sequence
  chemically synthesized
caggtactctacctcctaaatg

SEQ ID NO: 1230089 - DNA, 22 bp, Artificial Sequence
  chemically synthesized
ctcatagcccagtcatttagga

SEQ ID NO: 1230090 - DNA, 22 bp, Artificial Sequence
  chemically synthesized
ttcctcatagcccagtcattta

SEQ ID NO: 1230091 - DNA, 22 bp, Artificial Sequence
  chemically synthesized
tacctcctaaatgactgggcta

SEQ ID NO: 1230092 - DNA, 22 bp, Artificial Sequence
  chemically synthesized
cctcctaaatgactgggctatg

SEQ ID NO: 1230093 - DNA, 22 bp, Artificial Sequence
  chemically synthesized
ctaaatgactgggctatgagga

SEQ ID NO: 1230094 - DNA, 22 bp, Artificial Sequence
  chemically synthesized
aatgactgggctatgaggaaca

SEQ ID NO: 1230095 - DNA, 22 bp, Artificial Sequence
  chemically synthesized
ggctatgaggaacaattctcgt

SEQ ID NO: 1230096 - DNA, 22 bp, Artificial Sequence
  chemically synthesized
gaacaagcaaatgacgagaatt

SEQ ID NO: 1230097 - DNA, 22 bp, Artificial Sequence
  chemically synthesized
tgaggaacaattctcgtcattt

SEQ ID NO: 1230098 - DNA, 22 bp, Artificial Sequence
  chemically synthesized
tctcgaacaagcaaatgacgag

SEQ ID NO: 1230099 - DNA, 22 bp, Artificial Sequence
  chemically synthesized
cctgtctcgaacaagcaaatga

SEQ ID NO: 1230100 - DNA, 22 bp, Artificial Sequence
  chemically synthesized
gcctgtctcgaacaagcaaatg

SEQ ID NO: 1230101 - DNA, 22 bp, Artificial Sequence
  chemically synthesized
tgcctgtctcgaacaagcaaat

SEQ ID NO: 1230102 - DNA, 22 bp, Artificial Sequence
  chemically synthesized
ttgcctgtctcgaacaagcaaa

SEQ ID NO: 1230103 - DNA, 22 bp, Artificial Sequence
  chemically synthesized
tttgcctgtctcgaacaagcaa

SEQ ID NO: 1230104 - DNA, 22 bp, Artificial Sequence
  chemically synthesized
tcgtcatttgcttgttcgagac

SEQ ID NO: 1230105 - DNA, 22 bp, Artificial Sequence
  chemically synthesized
gtcatttgcttgttcgagacag

SEQ ID NO: 1230106 - DNA, 22 bp, Artificial Sequence
  chemically synthesized
gcttgttcgagacaggcaaaaa

SEQ ID NO: 1230107 - DNA, 22 bp, Artificial Sequence
  chemically synthesized
cttgttcgagacaggcaaaaaa

SEQ ID NO: 1230108 - DNA, 22 bp, Artificial Sequence
  chemically synthesized
gttcgagacaggcaaaaaacct

SEQ ID NO: 1230109 - DNA, 22 bp, Artificial Sequence
  chemically synthesized
ttcgagacaggcaaaaaacctc

SEQ ID NO: 1230110 - DNA, 22 bp, Artificial Sequence
  chemically synthesized
gagacaggcaaaaaacctcgct

SEQ ID NO: 1230111 - DNA, 22 bp, Artificial Sequence
  chemically synthesized
aaggaaagtgggataaaagaaa

SEQ ID NO: 1230112 - DNA, 22 bp, Artificial Sequence
  chemically synthesized
ctgaaggaaagtgggataaaag

SEQ ID NO: 1230113 - DNA, 22 bp, Artificial Sequence
  chemically synthesized
gctgttttcttttatcccactt

SEQ ID NO: 1230114 - DNA, 22 bp, Artificial Sequence
  chemically synthesized
ttttcttttatcccactttcct

SEQ ID NO: 1230115 - DNA, 22 bp, Artificial Sequence
  chemically synthesized
tcttttatcccactttccttca

SEQ ID NO: 1230116 - DNA, 22 bp, Artificial Sequence
  chemically synthesized
catccatgttcctgaaggaaag

SEQ ID NO: 1230117 - DNA, 22 bp, Artificial Sequence
  chemically synthesized
cttttatcccactttccttcag

SEQ ID NO: 1230118 - DNA, 22 bp, Artificial Sequence
  chemically synthesized
ttttatcccactttccttcagg

SEQ ID NO: 1230119 - DNA, 22 bp, Artificial Sequence
  chemically synthesized
ttatcccactttccttcaggaa

SEQ ID NO: 1230120 - DNA, 22 bp, Artificial Sequence
  chemically synthesized
tatcccactttccttcaggaac

SEQ ID NO: 1230121 - DNA, 22 bp, Artificial Sequence
  chemically synthesized
atcccactttccttcaggaaca

SEQ ID NO: 1230122 - DNA, 22 bp, Artificial Sequence
  chemically synthesized
tcccactttccttcaggaacat

SEQ ID NO: 1230123 - DNA, 22 bp, Artificial Sequence
  chemically synthesized
tccttcaggaacatggatgtaa

SEQ ID NO: 1230124 - DNA, 22 bp, Artificial Sequence
  chemically synthesized
ccttcaggaacatggatgtaat

SEQ ID NO: 1230125 - DNA, 22 bp, Artificial Sequence
  chemically synthesized
acgatggtagaaattacatcca

SEQ ID NO: 1230126 - DNA, 22 bp, Artificial Sequence
  chemically synthesized
cttcaggaacatggatgtaatt

SEQ ID NO: 1230127 - DNA, 22 bp, Artificial Sequence
  chemically synthesized
caggaacatggatgtaatttct

SEQ ID NO: 1230128 - DNA, 22 bp, Artificial Sequence
  chemically synthesized
aggaacatggatgtaatttcta

SEQ ID NO: 1230129 - DNA, 22 bp, Artificial Sequence
  chemically synthesized
aataaaatattgacgatggtag

SEQ ID NO: 1230130 - DNA, 22 bp, Artificial Sequence
  chemically synthesized
gaataaaatattgacgatggta

SEQ ID NO: 1230131 - DNA, 22 bp, Artificial Sequence
  chemically synthesized
gcttgaataaaatattgacgat

SEQ ID NO: 1230132 - DNA, 22 bp, Artificial Sequence
  chemically synthesized
agcttgaataaaatattgacga

SEQ ID NO: 1230133 - DNA, 22 bp, Artificial Sequence
  chemically synthesized
atcttagcttgaataaaatatt

SEQ ID NO: 1230134 - DNA, 22 bp, Artificial Sequence
  chemically synthesized
ctaccatcgtcaatattttatt

SEQ ID NO: 1230135 - DNA, 22 bp, Artificial Sequence
  chemically synthesized
taccatcgtcaatattttattc

SEQ ID NO: 1230136 - DNA, 22 bp, Artificial Sequence
  chemically synthesized
ccatcgtcaatattttattcaa

SEQ ID NO: 1230137 - DNA, 22 bp, Artificial Sequence
  chemically synthesized
tattcaagctaagattagatat

SEQ ID NO: 1230138 - DNA, 22 bp, Artificial Sequence
  chemically synthesized
attcaagctaagattagatatc

SEQ ID NO: 1230139 - DNA, 22 bp, Artificial Sequence
  chemically synthesized
ttcaagctaagattagatatcc

SEQ ID NO: 1230140 - DNA, 22 bp, Artificial Sequence
  chemically synthesized
taaaccatcatgggatatctaa

SEQ ID NO: 1230141 - DNA, 22 bp, Artificial Sequence
  chemically synthesized
aagctaagattagatatcccat

SEQ ID NO: 1230142 - DNA, 22 bp, Artificial Sequence
  chemically synthesized
ctgtaaaccatcatgggatatc

SEQ ID NO: 1230143 - DNA, 22 bp, Artificial Sequence
  chemically synthesized
actgtaaaccatcatgggatat

SEQ ID NO: 1230144 - DNA, 22 bp, Artificial Sequence
  chemically synthesized
tactgtaaaccatcatgggata

SEQ ID NO: 1230145 - DNA, 22 bp, Artificial Sequence
  chemically synthesized
ttactgtaaaccatcatgggat

SEQ ID NO: 1230146 - DNA, 22 bp, Artificial Sequence
  chemically synthesized
agattagatatcccatgatggt

SEQ ID NO: 1230147 - DNA, 22 bp, Artificial Sequence
  chemically synthesized
gatatcccatgatggtttacag

SEQ ID NO: 1230148 - DNA, 22 bp, Artificial Sequence
  chemically synthesized
acagtaaaaggatttatactta

SEQ ID NO: 1230149 - DNA, 22 bp, Artificial Sequence
  chemically synthesized
cagtaaaaggatttatacttat

SEQ ID NO: 1230150 - DNA, 22 bp, Artificial Sequence
  chemically synthesized
aatatatcaatataataagtat

SEQ ID NO: 1230151 - DNA, 22 bp, Artificial Sequence
  chemically synthesized
gaatatatcaatataataagta

SEQ ID NO: 1230152 - DNA, 22 bp, Artificial Sequence
  chemically synthesized
aatcttgaatatatcaatataa

SEQ ID NO: 1230153 - DNA, 22 bp, Artificial Sequence
  chemically synthesized
aaatcttgaatatatcaatata

SEQ ID NO: 1230154 - DNA, 22 bp, Artificial Sequence
  chemically synthesized
ttaaatcttgaatatatcaata

SEQ ID NO: 1230155 - DNA, 22 bp, Artificial Sequence
  chemically synthesized
atacttattatattgatatatt

SEQ ID NO: 1230156 - DNA, 22 bp, Artificial Sequence
  chemically synthesized
tacttattatattgatatattc

SEQ ID NO: 1230157 - DNA, 22 bp, Artificial Sequence
  chemically synthesized
agtattcttaaatcttgaatat

SEQ ID NO: 1230158 - DNA, 22 bp, Artificial Sequence
  chemically synthesized
attatattgatatattcaagat

SEQ ID NO: 1230159 - DNA, 22 bp, Artificial Sequence
  chemically synthesized
aagtattcttaaatcttgaata

SEQ ID NO: 1230160 - DNA, 22 bp, Artificial Sequence
  chemically synthesized
ttatattgatatattcaagatt

SEQ ID NO: 1230161 - DNA, 22 bp, Artificial Sequence
  chemically synthesized
ttaagtattcttaaatcttgaa

SEQ ID NO: 1230162 - DNA, 22 bp, Artificial Sequence
  chemically synthesized
cttaagtattcttaaatcttga

SEQ ID NO: 1230163 - DNA, 22 bp, Artificial Sequence
  chemically synthesized
tattgatatattcaagatttaa

SEQ ID NO: 1230164 - DNA, 22 bp, Artificial Sequence
  chemically synthesized
tcttaagtattcttaaatcttg

SEQ ID NO: 1230165 - DNA, 22 bp, Artificial Sequence
  chemically synthesized
ttcttaagtattcttaaatctt

SEQ ID NO: 1230166 - DNA, 22 bp, Artificial Sequence
  chemically synthesized
atatattcaagatttaagaata

SEQ ID NO: 1230167 - DNA, 22 bp, Artificial Sequence
  chemically synthesized
agtttttcttaagtattcttaa

SEQ ID NO: 1230168 - DNA, 22 bp, Artificial Sequence
  chemically synthesized
aagtttttcttaagtattctta

SEQ ID NO: 1230169 - DNA, 22 bp, Artificial Sequence
  chemically synthesized
atcttaagtttttcttaagtat

SEQ ID NO: 1230170 - DNA, 22 bp, Artificial Sequence
  chemically synthesized
aagatttaagaatacttaagaa

SEQ ID NO: 1230171 - DNA, 22 bp, Artificial Sequence
  chemically synthesized
catcttaagtttttcttaagta

SEQ ID NO: 1230172 - DNA, 22 bp, Artificial Sequence
  chemically synthesized
tcatcttaagtttttcttaagt

SEQ ID NO: 1230173 - DNA, 22 bp, Artificial Sequence
  chemically synthesized
ctttcatcttaagtttttctta

SEQ ID NO: 1230174 - DNA, 22 bp, Artificial Sequence
  chemically synthesized
actttcatcttaagtttttctt

SEQ ID NO: 1230175 - DNA, 22 bp, Artificial Sequence
  chemically synthesized
aagaatacttaagaaaaactta

SEQ ID NO: 1230176 - DNA, 22 bp, Artificial Sequence
  chemically synthesized
agaatacttaagaaaaacttaa

SEQ ID NO: 1230177 - DNA, 22 bp, Artificial Sequence
  chemically synthesized
aggtttactttcatcttaagtt

SEQ ID NO: 1230178 - DNA, 22 bp, Artificial Sequence
  chemically synthesized
caggtttactttcatcttaagt

SEQ ID NO: 1230179 - DNA, 22 bp, Artificial Sequence
  chemically synthesized
aagaaaaacttaagatgaaagt

SEQ ID NO: 1230180 - DNA, 22 bp, Artificial Sequence
  chemically synthesized
agaaaaacttaagatgaaagta

SEQ ID NO: 1230181 - DNA, 22 bp, Artificial Sequence
  chemically synthesized
aagatgaaagtaaacctgaaat

SEQ ID NO: 1230182 - DNA, 22 bp, Artificial Sequence
  chemically synthesized
agatgaaagtaaacctgaaata

SEQ ID NO: 1230183 - DNA, 22 bp, Artificial Sequence
  chemically synthesized
agaaaaccatcatatttcaggt

SEQ ID NO: 1230184 - DNA, 22 bp, Artificial Sequence
  chemically synthesized
cagaaaaccatcatatttcagg

SEQ ID NO: 1230185 - DNA, 22 bp, Artificial Sequence
  chemically synthesized
tcagaaaaccatcatatttcag

SEQ ID NO: 1230186 - DNA, 22 bp, Artificial Sequence
  chemically synthesized
tcaataatctttcagaaaacca

SEQ ID NO: 1230187 - DNA, 22 bp, Artificial Sequence
  chemically synthesized
ctgtcaataatctttcagaaaa

SEQ ID NO: 1230188 - DNA, 22 bp, Artificial Sequence
  chemically synthesized
aaatatgatggttttctgaaag

SEQ ID NO: 1230189 - DNA, 22 bp, Artificial Sequence
  chemically synthesized
ttcctgtcaataatctttcaga

SEQ ID NO: 1230190 - DNA, 22 bp, Artificial Sequence
  chemically synthesized
gttcctgtcaataatctttcag

SEQ ID NO: 1230191 - DNA, 22 bp, Artificial Sequence
  chemically synthesized
acttgttcctgtcaataatctt

SEQ ID NO: 1230192 - DNA, 22 bp, Artificial Sequence
  chemically synthesized
tctgaaagattattgacaggaa

SEQ ID NO: 1230193 - DNA, 22 bp, Artificial Sequence
  chemically synthesized
ctgaaagattattgacaggaac

SEQ ID NO: 1230194 - DNA, 22 bp, Artificial Sequence
  chemically synthesized
tgaaagattattgacaggaaca

SEQ ID NO: 1230195 - DNA, 22 bp, Artificial Sequence
  chemically synthesized
aaagattattgacaggaacaag

SEQ ID NO: 1230196 - DNA, 22 bp, Artificial Sequence
  chemically synthesized
ttgacaggaacaagttagtgtt

SEQ ID NO: 1230197 - DNA, 22 bp, Artificial Sequence
  chemically synthesized
acaggaacaagttagtgttatt

SEQ ID NO: 1230198 - DNA, 22 bp, Artificial Sequence
  chemically synthesized
taaagcaaatcaaaaataacac

SEQ ID NO: 1230199 - DNA, 22 bp, Artificial Sequence
  chemically synthesized
tgtaaagcaaatcaaaaataac

SEQ ID NO: 1230200 - DNA, 22 bp, Artificial Sequence
  chemically synthesized
ctgtaaagcaaatcaaaaataa

SEQ ID NO: 1230201 - DNA, 22 bp, Artificial Sequence
  chemically synthesized
tctgtaaagcaaatcaaaaata

SEQ ID NO: 1230202 - DNA, 22 bp, Artificial Sequence
  chemically synthesized
tttctgtaaagcaaatcaaaaa

SEQ ID NO: 1230203 - DNA, 22 bp, Artificial Sequence
  chemically synthesized
ctttctgtaaagcaaatcaaaa

SEQ ID NO: 1230204 - DNA, 22 bp, Artificial Sequence
  chemically synthesized
ttctttctgtaaagcaaatcaa

SEQ ID NO: 1230205 - DNA, 22 bp, Artificial Sequence
  chemically synthesized
gtgttatttttgatttgcttta

SEQ ID NO: 1230206 - DNA, 22 bp, Artificial Sequence
  chemically synthesized
ttcttctttctgtaaagcaaat

SEQ ID NO: 1230207 - DNA, 22 bp, Artificial Sequence
  chemically synthesized
ctattcttctttctgtaaagca

SEQ ID NO: 1230208 - DNA, 22 bp, Artificial Sequence
  chemically synthesized
tttttgatttgctttacagaaa

SEQ ID NO: 1230209 - DNA, 22 bp, Artificial Sequence
  chemically synthesized
gtctgctattcttctttctgta

SEQ ID NO: 1230210 - DNA, 22 bp, Artificial Sequence
  chemically synthesized
ttgatttgctttacagaaagaa

SEQ ID NO: 1230211 - DNA, 22 bp, Artificial Sequence
  chemically synthesized
tgatttgctttacagaaagaag

SEQ ID NO: 1230212 - DNA, 22 bp, Artificial Sequence
  chemically synthesized
gatttgctttacagaaagaaga

SEQ ID NO: 1230213 - DNA, 22 bp, Artificial Sequence
  chemically synthesized
atttgctttacagaaagaagaa

SEQ ID NO: 1230214 - DNA, 22 bp, Artificial Sequence
  chemically synthesized
gctttacagaaagaagaatagc

SEQ ID NO: 1230215 - DNA, 22 bp, Artificial Sequence
  chemically synthesized
ctttacagaaagaagaatagca

SEQ ID NO: 1230216 - DNA, 22 bp, Artificial Sequence
  chemically synthesized
atgaaccctagtctgctattct

SEQ ID NO: 1230217 - DNA, 22 bp, Artificial Sequence
  chemically synthesized
gatgaaccctagtctgctattc

SEQ ID NO: 1230218 - DNA, 22 bp, Artificial Sequence
  chemically synthesized
tacagaaagaagaatagcagac

SEQ ID NO: 1230219 - DNA, 22 bp, Artificial Sequence
  chemically synthesized
acagaaagaagaatagcagact

SEQ ID NO: 1230220 - DNA, 22 bp, Artificial Sequence
  chemically synthesized
cagaaagaagaatagcagacta

SEQ ID NO: 1230221 - DNA, 22 bp, Artificial Sequence
  chemically synthesized
tttgatgaaccctagtctgcta

SEQ ID NO: 1230222 - DNA, 22 bp, Artificial Sequence
  chemically synthesized
tgtttgatgaaccctagtctgc

SEQ ID NO: 1230223 - DNA, 22 bp, Artificial Sequence
  chemically synthesized
ctgtttgatgaaccctagtctg

SEQ ID NO: 1230224 - DNA, 22 bp, Artificial Sequence
  chemically synthesized
tctgtttgatgaaccctagtct

SEQ ID NO: 1230225 - DNA, 22 bp, Artificial Sequence
  chemically synthesized
ttttctgtttgatgaaccctag

SEQ ID NO: 1230226 - DNA, 22 bp, Artificial Sequence
  chemically synthesized
ctattttctgtttgatgaaccc

SEQ ID NO: 1230227 - DNA, 22 bp, Artificial Sequence
  chemically synthesized
actattttctgtttgatgaacc

SEQ ID NO: 1230228 - DNA, 22 bp, Artificial Sequence
  chemically synthesized
tttactattttctgtttgatga

SEQ ID NO: 1230229 - DNA, 22 bp, Artificial Sequence
  chemically synthesized
atttactattttctgtttgatg

SEQ ID NO: 1230230 - DNA, 22 bp, Artificial Sequence
  chemically synthesized
gggttcatcaaacagaaaatag

SEQ ID NO: 1230231 - DNA, 22 bp, Artificial Sequence
  chemically synthesized
acgtcttatttactattttctg

SEQ ID NO: 1230232 - DNA, 22 bp, Artificial Sequence
  chemically synthesized
tgacgtcttatttactattttc

SEQ ID NO: 1230233 - DNA, 22 bp, Artificial Sequence
  chemically synthesized
atcaaacagaaaatagtaaata

SEQ ID NO: 1230234 - DNA, 22 bp, Artificial Sequence
  chemically synthesized
attctgacgtcttatttactat

SEQ ID NO: 1230235 - DNA, 22 bp, Artificial Sequence
  chemically synthesized
catgcccctcattctgacgtct

SEQ ID NO: 1230236 - DNA, 22 bp, Artificial Sequence
  chemically synthesized
aagttacatgcccctcattctg

SEQ ID NO: 1230237 - DNA, 22 bp, Artificial Sequence
  chemically synthesized
caagttacatgcccctcattct

SEQ ID NO: 1230238 - DNA, 22 bp, Artificial Sequence
  chemically synthesized
tcaagttacatgcccctcattc

SEQ ID NO: 1230239 - DNA, 22 bp, Artificial Sequence
  chemically synthesized
ttttcaagttacatgcccctca

SEQ ID NO: 1230240 - DNA, 22 bp, Artificial Sequence
  chemically synthesized
aaattattttcaagttacatgc

SEQ ID NO: 1230241 - DNA, 22 bp, Artificial Sequence
  chemically synthesized
ttgaaattattttcaagttaca

SEQ ID NO: 1230242 - DNA, 22 bp, Artificial Sequence
  chemically synthesized
gttattgaaattattttcaagt

SEQ ID NO: 1230243 - DNA, 22 bp, Artificial Sequence
  chemically synthesized
ggttattgaaattattttcaag

SEQ ID NO: 1230244 - DNA, 22 bp, Artificial Sequence
  chemically synthesized
acttggttattgaaattatttt

SEQ ID NO: 1230245 - DNA, 22 bp, Artificial Sequence
  chemically synthesized
gacttggttattgaaattattt

SEQ ID NO: 1230246 - DNA, 22 bp, Artificial Sequence
  chemically synthesized
tttgacttggttattgaaatta

SEQ ID NO: 1230247 - DNA, 22 bp, Artificial Sequence
  chemically synthesized
attatttgacttggttattgaa

SEQ ID NO: 1230248 - DNA, 22 bp, Artificial Sequence
  chemically synthesized
cattatttgacttggttattga

SEQ ID NO: 1230249 - DNA, 22 bp, Artificial Sequence
  chemically synthesized
tcattatttgacttggttattg

SEQ ID NO: 1230250 - DNA, 22 bp, Artificial Sequence
  chemically synthesized
gaaaataatttcaataaccaag

SEQ ID NO: 1230251 - DNA, 22 bp, Artificial Sequence
  chemically synthesized
aaaataatttcaataaccaagt

SEQ ID NO: 1230252 - DNA, 22 bp, Artificial Sequence
  chemically synthesized
cattttcattatttgacttggt

SEQ ID NO: 1230253 - DNA, 22 bp, Artificial Sequence
  chemically synthesized
ccattttcattatttgacttgg

SEQ ID NO: 1230254 - DNA, 22 bp, Artificial Sequence
  chemically synthesized
caataaccaagtcaaataatga

SEQ ID NO: 1230255 - DNA, 22 bp, Artificial Sequence
  chemically synthesized
aataaccaagtcaaataatgaa

SEQ ID NO: 1230256 - DNA, 22 bp, Artificial Sequence
  chemically synthesized
agaacttccattttcattattt

SEQ ID NO: 1230257 - DNA, 22 bp, Artificial Sequence
  chemically synthesized
ccctaagaacttccattttcat

SEQ ID NO: 1230258 - DNA, 22 bp, Artificial Sequence
  chemically synthesized
tgccctaagaacttccattttc

SEQ ID NO: 1230259 - DNA, 22 bp, Artificial Sequence
  chemically synthesized
ctctgccctaagaacttccatt

SEQ ID NO: 1230260 - DNA, 22 bp, Artificial Sequence
  chemically synthesized
tgctctgccctaagaacttcca

SEQ ID NO: 1230261 - DNA, 22 bp, Artificial Sequence
  chemically synthesized
ctgctctgccctaagaacttcc

SEQ ID NO: 1230262 - DNA, 22 bp, Artificial Sequence
  chemically synthesized
cttctgctctgccctaagaact

SEQ ID NO: 1230263 - DNA, 22 bp, Artificial Sequence
  chemically synthesized
tccttctgctctgccctaagaa

SEQ ID NO: 1230264 - DNA, 22 bp, Artificial Sequence
  chemically synthesized
tctccttctgctctgccctaag

SEQ ID NO: 1230265 - DNA, 22 bp, Artificial Sequence
  chemically synthesized
tctctccttctgctctgcccta

SEQ ID NO: 1230266 - DNA, 22 bp, Artificial Sequence
  chemically synthesized
tctctctccttctgctctgccc

SEQ ID NO: 1230267 - DNA, 22 bp, Artificial Sequence
  chemically synthesized
ctctctctccttctgctctgcc

SEQ ID NO: 1230268 - DNA, 22 bp, Artificial Sequence
  chemically synthesized
ccttctctctctccttctgctc

SEQ ID NO: 1230269 - DNA, 22 bp, Artificial Sequence
  chemically synthesized
cccttctctctctccttctgct

SEQ ID NO: 1230270 - DNA, 22 bp, Artificial Sequence
  chemically synthesized
tcccttctctctctccttctgc

SEQ ID NO: 1230271 - DNA, 22 bp, Artificial Sequence
  chemically synthesized
ttagggcagagcagaaggagag

SEQ ID NO: 1230272 - DNA, 22 bp, Artificial Sequence
  chemically synthesized
agggcagagcagaaggagagag

SEQ ID NO: 1230273 - DNA, 22 bp, Artificial Sequence
  chemically synthesized
gggcagagcagaaggagagaga

SEQ ID NO: 1230274 - DNA, 22 bp, Artificial Sequence
  chemically synthesized
atcattttcccttctctctctc

SEQ ID NO: 1230275 - DNA, 22 bp, Artificial Sequence
  chemically synthesized
ttcatcattttcccttctctct

SEQ ID NO: 1230276 - DNA, 22 bp, Artificial Sequence
  chemically synthesized
attcatcattttcccttctctc

SEQ ID NO: 1230277 - DNA, 22 bp, Artificial Sequence
  chemically synthesized
tattcatcattttcccttctct

SEQ ID NO: 1230278 - DNA, 22 bp, Artificial Sequence
  chemically synthesized
gttttattcatcattttccctt

SEQ ID NO: 1230279 - DNA, 22 bp, Artificial Sequence
  chemically synthesized
agttttattcatcattttccct

SEQ ID NO: 1230280 - DNA, 22 bp, Artificial Sequence
  chemically synthesized
ttagttttattcatcattttcc

SEQ ID NO: 1230281 - DNA, 22 bp, Artificial Sequence
  chemically synthesized
caggaatgtaactcttagtttt

SEQ ID NO: 1230282 - DNA, 22 bp, Artificial Sequence
  chemically synthesized
acaggaatgtaactcttagttt

SEQ ID NO: 1230283 - DNA, 22 bp, Artificial Sequence
  chemically synthesized
agagttacattcctgtaagata

SEQ ID NO: 1230284 - DNA, 22 bp, Artificial Sequence
  chemically synthesized
cattcctgtaagatatttacgt

SEQ ID NO: 1230285 - DNA, 22 bp, Artificial Sequence
  chemically synthesized
ctgtaagatatttacgtgtgtg

SEQ ID NO: 1230286 - DNA, 22 bp, Artificial Sequence
  chemically synthesized
taagatatttacgtgtgtgtgt

SEQ ID NO: 1230287 - DNA, 22 bp, Artificial Sequence
  chemically synthesized
acgtgtgtgtgtgtgtgtgtgt

SEQ ID NO: 1230288 - DNA, 22 bp, Artificial Sequence
  chemically synthesized
cgtgtgtgtgtgtgtgtgtgtg

SEQ ID NO: 1230289 - DNA, 22 bp, Artificial Sequence
  chemically synthesized
atacacaaaccacacatcacac

SEQ ID NO: 1230290 - DNA, 22 bp, Artificial Sequence
  chemically synthesized
tcatacacaaaccacacatcac

SEQ ID NO: 1230291 - DNA, 22 bp, Artificial Sequence
  chemically synthesized
tctcatacacaaaccacacatc

SEQ ID NO: 1230292 - DNA, 22 bp, Artificial Sequence
  chemically synthesized
tctctcatacacaaaccacaca

SEQ ID NO: 1230293 - DNA, 22 bp, Artificial Sequence
  chemically synthesized
tctctctcatacacaaaccaca

SEQ ID NO: 1230294 - DNA, 22 bp, Artificial Sequence
  chemically synthesized
ctctctctcatacacaaaccac

SEQ ID NO: 1230295 - DNA, 22 bp, Artificial Sequence
  chemically synthesized
tctctctctcatacacaaacca

SEQ ID NO: 1230296 - DNA, 22 bp, Artificial Sequence
  chemically synthesized
ttctctctctcatacacaaacc

SEQ ID NO: 1230297 - DNA, 22 bp, Artificial Sequence
  chemically synthesized
tttctctctctcatacacaaac

SEQ ID NO: 1230298 - DNA, 22 bp, Artificial Sequence
  chemically synthesized
tctttttctctctctcatacac

SEQ ID NO: 1230299 - DNA, 22 bp, Artificial Sequence
  chemically synthesized
tcacctgtctttttctctctct

SEQ ID NO: 1230300 - DNA, 22 bp, Artificial Sequence
  chemically synthesized
gtcacctgtctttttctctctc

SEQ ID NO: 1230301 - DNA, 22 bp, Artificial Sequence
  chemically synthesized
tgtcacctgtctttttctctct

SEQ ID NO: 1230302 - DNA, 22 bp, Artificial Sequence
  chemically synthesized
gtgtatgagagagagaaaaaga

SEQ ID NO: 1230303 - DNA, 22 bp, Artificial Sequence
  chemically synthesized
tgtatgagagagagaaaaagac

SEQ ID NO: 1230304 - DNA, 22 bp, Artificial Sequence
  chemically synthesized
tcagaactttgtcacctgtctt

SEQ ID NO: 1230305 - DNA, 22 bp, Artificial Sequence
  chemically synthesized
gtcagaactttgtcacctgtct

SEQ ID NO: 1230306 - DNA, 22 bp, Artificial Sequence
  chemically synthesized
tgtcagaactttgtcacctgtc

SEQ ID NO: 1230307 - DNA, 22 bp, Artificial Sequence
  chemically synthesized
aagctttgtcagaactttgtca

SEQ ID NO: 1230308 - DNA, 22 bp, Artificial Sequence
  chemically synthesized
attaaagctttgtcagaacttt

SEQ ID NO: 1230309 - DNA, 22 bp, Artificial Sequence
  chemically synthesized
tatgaaaaaattcattaaagct

SEQ ID NO: 1230310 - DNA, 22 bp, Artificial Sequence
  chemically synthesized
tgacaaagctttaatgaatttt

SEQ ID NO: 1230311 - DNA, 22 bp, Artificial Sequence
  chemically synthesized
acaaagctttaatgaatttttt

SEQ ID NO: 1230312 - DNA, 22 bp, Artificial Sequence
  chemically synthesized
acaaaaataaaattgtatgaaa

SEQ ID NO: 1230313 - DNA, 22 bp, Artificial Sequence
  chemically synthesized
taatgaattttttcatacaatt

SEQ ID NO: 1230314 - DNA, 22 bp, Artificial Sequence
  chemically synthesized
aatgaattttttcatacaattt

SEQ ID NO: 1230315 - DNA, 22 bp, Artificial Sequence
  chemically synthesized
atgaattttttcatacaatttt

SEQ ID NO: 1230316 - DNA, 22 bp, Artificial Sequence
  chemically synthesized
catctaacaaaaataaaattgt

SEQ ID NO: 1230317 - DNA, 22 bp, Artificial Sequence
  chemically synthesized
tgcatctaacaaaaataaaatt

SEQ ID NO: 1230318 - DNA, 22 bp, Artificial Sequence
  chemically synthesized
tctgcatctaacaaaaataaaa

SEQ ID NO: 1230319 - DNA, 22 bp, Artificial Sequence
  chemically synthesized
tttcatacaattttatttttgt

SEQ ID NO: 1230320 - DNA, 22 bp, Artificial Sequence
  chemically synthesized
tctctgcatctaacaaaaataa

SEQ ID NO: 1230321 - DNA, 22 bp, Artificial Sequence
  chemically synthesized
ttcatacaattttatttttgtt

SEQ ID NO: 1230322 - DNA, 22 bp, Artificial Sequence
  chemically synthesized
tcatacaattttatttttgtta

SEQ ID NO: 1230323 - DNA, 22 bp, Artificial Sequence
  chemically synthesized
catacaattttatttttgttag

SEQ ID NO: 1230324 - DNA, 22 bp, Artificial Sequence
  chemically synthesized
atacaattttatttttgttaga

SEQ ID NO: 1230325 - DNA, 22 bp, Artificial Sequence
  chemically synthesized
aacatccatctctctctgcatc

SEQ ID NO: 1230326 - DNA, 22 bp, Artificial Sequence
  chemically synthesized
tatttttgttagatgcagagag

SEQ ID NO: 1230327 - DNA, 22 bp, Artificial Sequence
  chemically synthesized
atttttgttagatgcagagaga

SEQ ID NO: 1230328 - DNA, 22 bp, Artificial Sequence
  chemically synthesized
taaacatccatctctctctgca

SEQ ID NO: 1230329 - DNA, 22 bp, Artificial Sequence
  chemically synthesized
tttttgttagatgcagagagag

SEQ ID NO: 1230330 - DNA, 22 bp, Artificial Sequence
  chemically synthesized
ttgttagatgcagagagagatg

SEQ ID NO: 1230331 - DNA, 22 bp, Artificial Sequence
  chemically synthesized
tgttagatgcagagagagatgg

SEQ ID NO: 1230332 - DNA, 22 bp, Artificial Sequence
  chemically synthesized
gttagatgcagagagagatgga

SEQ ID NO: 1230333 - DNA, 22 bp, Artificial Sequence
  chemically synthesized
ttagatgcagagagagatggat

SEQ ID NO: 1230334 - DNA, 22 bp, Artificial Sequence
  chemically synthesized
gatgcagagagagatggatgtt

SEQ ID NO: 1230335 - DNA, 22 bp, Artificial Sequence
  chemically synthesized
aatgatacacaaaactctaaac

SEQ ID NO: 1230336 - DNA, 22 bp, Artificial Sequence
  chemically synthesized
aaatgatacacaaaactctaaa

SEQ ID NO: 1230337 - DNA, 22 bp, Artificial Sequence
  chemically synthesized
agagttttgtgtatcatttaag

SEQ ID NO: 1230338 - DNA, 22 bp, Artificial Sequence
  chemically synthesized
aaaccgcaaatgcttaaatgat

SEQ ID NO: 1230339 - DNA, 22 bp, Artificial Sequence
  chemically synthesized
gagttttgtgtatcatttaagc

SEQ ID NO: 1230340 - DNA, 22 bp, Artificial Sequence
  chemically synthesized
tgtgtatcatttaagcatttgc

SEQ ID NO: 1230341 - DNA, 22 bp, Artificial Sequence
  chemically synthesized
caagttaaaaccgcaaatgctt

SEQ ID NO: 1230342 - DNA, 22 bp, Artificial Sequence
  chemically synthesized
gtgtatcatttaagcatttgcg

SEQ ID NO: 1230343 - DNA, 22 bp, Artificial Sequence
  chemically synthesized
ccaagttaaaaccgcaaatgct

SEQ ID NO: 1230344 - DNA, 22 bp, Artificial Sequence
  chemically synthesized
tgtatcatttaagcatttgcgg

SEQ ID NO: 1230345 - DNA, 22 bp, Artificial Sequence
  chemically synthesized
caacttccaagttaaaaccgca

SEQ ID NO: 1230346 - DNA, 22 bp, Artificial Sequence
  chemically synthesized
tgcaacttccaagttaaaaccg

SEQ ID NO: 1230347 - DNA, 22 bp, Artificial Sequence
  chemically synthesized
ctgcaacttccaagttaaaacc

SEQ ID NO: 1230348 - DNA, 22 bp, Artificial Sequence
  chemically synthesized
tctgcaacttccaagttaaaac

SEQ ID NO: 1230349 - DNA, 22 bp, Artificial Sequence
  chemically synthesized
aagcatttgcggttttaacttg

SEQ ID NO: 1230350 - DNA, 22 bp, Artificial Sequence
  chemically synthesized
agcatttgcggttttaacttgg

SEQ ID NO: 1230351 - DNA, 22 bp, Artificial Sequence
  chemically synthesized
gcggttttaacttggaagttgc

SEQ ID NO: 1230352 - DNA, 22 bp, Artificial Sequence
  chemically synthesized
cggttttaacttggaagttgca

SEQ ID NO: 1230353 - DNA, 22 bp, Artificial Sequence
  chemically synthesized
taacttggaagttgcagaaagt

SEQ ID NO: 1230354 - DNA, 22 bp, Artificial Sequence
  chemically synthesized
aacttggaagttgcagaaagtt

SEQ ID NO: 1230355 - DNA, 22 bp, Artificial Sequence
  chemically synthesized
tgaatgagatataactttctgc

SEQ ID NO: 1230356 - DNA, 22 bp, Artificial Sequence
  chemically synthesized
acttggaagttgcagaaagtta

SEQ ID NO: 1230357 - DNA, 22 bp, Artificial Sequence
  chemically synthesized
ggaagttgcagaaagttatatc

SEQ ID NO: 1230358 - DNA, 22 bp, Artificial Sequence
  chemically synthesized
ccctgtgaatgagatataactt

SEQ ID NO: 1230359 - DNA, 22 bp, Artificial Sequence
  chemically synthesized
gaagttgcagaaagttatatct

SEQ ID NO: 1230360 - DNA, 22 bp, Artificial Sequence
  chemically synthesized
cagaaagttatatctcattcac

SEQ ID NO: 1230361 - DNA, 22 bp, Artificial Sequence
  chemically synthesized
taaagatgatggttcccctgtg

SEQ ID NO: 1230362 - DNA, 22 bp, Artificial Sequence
  chemically synthesized
tatctcattcacaggggaacca

SEQ ID NO: 1230363 - DNA, 22 bp, Artificial Sequence
  chemically synthesized
attcacaggggaaccatcatct

SEQ ID NO: 1230364 - DNA, 22 bp, Artificial Sequence
  chemically synthesized
acaggggaaccatcatctttat

SEQ ID NO: 1230365 - DNA, 22 bp, Artificial Sequence
  chemically synthesized
tataatatatggtgtctgcctc

SEQ ID NO: 1230366 - DNA, 22 bp, Artificial Sequence
  chemically synthesized
aaaaggcaagaagaggcagaca

SEQ ID NO: 1230367 - DNA, 22 bp, Artificial Sequence
  chemically synthesized
ataatatatggtgtctgcctct

SEQ ID NO: 1230368 - DNA, 22 bp, Artificial Sequence
  chemically synthesized
taatatatggtgtctgcctctt

SEQ ID NO: 1230369 - DNA, 22 bp, Artificial Sequence
  chemically synthesized
tctaaaaaggcaagaagaggca

SEQ ID NO: 1230370 - DNA, 22 bp, Artificial Sequence
  chemically synthesized
gttgtctaaaaaggcaagaaga

SEQ ID NO: 1230371 - DNA, 22 bp, Artificial Sequence
  chemically synthesized
tcactggttgtctaaaaaggca

SEQ ID NO: 1230372 - DNA, 22 bp, Artificial Sequence
  chemically synthesized
gtcactggttgtctaaaaaggc

SEQ ID NO: 1230373 - DNA, 22 bp, Artificial Sequence
  chemically synthesized
cctcttcttgcctttttagaca

SEQ ID NO: 1230374 - DNA, 22 bp, Artificial Sequence
  chemically synthesized
ttcttgcctttttagacaacca

SEQ ID NO: 1230375 - DNA, 22 bp, Artificial Sequence
  chemically synthesized
cttgcctttttagacaaccagt

SEQ ID NO: 1230376 - DNA, 22 bp, Artificial Sequence
  chemically synthesized
ttgcctttttagacaaccagtg

SEQ ID NO: 1230377 - DNA, 22 bp, Artificial Sequence
  chemically synthesized
aaatgtccttgtcactggttgt

SEQ ID NO: 1230378 - DNA, 22 bp, Artificial Sequence
  chemically synthesized
gcctttttagacaaccagtgac

SEQ ID NO: 1230379 - DNA, 22 bp, Artificial Sequence
  chemically synthesized
tgaaatgtccttgtcactggtt

SEQ ID NO: 1230380 - DNA, 22 bp, Artificial Sequence
  chemically synthesized
cctttttagacaaccagtgaca

SEQ ID NO: 1230381 - DNA, 22 bp, Artificial Sequence
  chemically synthesized
tttagacaaccagtgacaagga

SEQ ID NO: 1230382 - DNA, 22 bp, Artificial Sequence
  chemically synthesized
ttagacaaccagtgacaaggac

SEQ ID NO: 1230383 - DNA, 22 bp, Artificial Sequence
  chemically synthesized
tagctctgaaatgtccttgtca

SEQ ID NO: 1230384 - DNA, 22 bp, Artificial Sequence
  chemically synthesized
tagacaaccagtgacaaggaca

SEQ ID NO: 1230385 - DNA, 22 bp, Artificial Sequence
  chemically synthesized
agacaaccagtgacaaggacat

SEQ ID NO: 1230386 - DNA, 22 bp, Artificial Sequence
  chemically synthesized
gacaaccagtgacaaggacatt

SEQ ID NO: 1230387 - DNA, 22 bp, Artificial Sequence
  chemically synthesized
gagcctgtagctctgaaatgtc

SEQ ID NO: 1230388 - DNA, 22 bp, Artificial Sequence
  chemically synthesized
attagagcctgtagctctgaaa

SEQ ID NO: 1230389 - DNA, 22 bp, Artificial Sequence
  chemically synthesized
cattagagcctgtagctctgaa

SEQ ID NO: 1230390 - DNA, 22 bp, Artificial Sequence
  chemically synthesized
tcattagagcctgtagctctga

SEQ ID NO: 1230391 - DNA, 22 bp, Artificial Sequence
  chemically synthesized
cagagctacaggctctaatgaa

SEQ ID NO: 1230392 - DNA, 22 bp, Artificial Sequence
  chemically synthesized
agagctacaggctctaatgaaa

SEQ ID NO: 1230393 - DNA, 22 bp, Artificial Sequence
  chemically synthesized
aatgacgcaggacgtgttttca

SEQ ID NO: 1230394 - DNA, 22 bp, Artificial Sequence
  chemically synthesized
caggctctaatgaaaacacgtc

SEQ ID NO: 1230395 - DNA, 22 bp, Artificial Sequence
  chemically synthesized
gctgaatgacgcaggacgtgtt

SEQ ID NO: 1230396 - DNA, 22 bp, Artificial Sequence
  chemically synthesized
taatgaaaacacgtcctgcgtc

SEQ ID NO: 1230397 - DNA, 22 bp, Artificial Sequence
  chemically synthesized
aattggctgaatgacgcaggac

SEQ ID NO: 1230398 - DNA, 22 bp, Artificial Sequence
  chemically synthesized
caattggctgaatgacgcagga

SEQ ID NO: 1230399 - DNA, 22 bp, Artificial Sequence
  chemically synthesized
atgaaaacacgtcctgcgtcat

SEQ ID NO: 1230400 - DNA, 22 bp, Artificial Sequence
  chemically synthesized
atttcaattggctgaatgacgc

SEQ ID NO: 1230401 - DNA, 22 bp, Artificial Sequence
  chemically synthesized
gtctaatttcaattggctgaat

SEQ ID NO: 1230402 - DNA, 22 bp, Artificial Sequence
  chemically synthesized
agtctaatttcaattggctgaa

SEQ ID NO: 1230403 - DNA, 22 bp, Artificial Sequence
  chemically synthesized
tagtctaatttcaattggctga

SEQ ID NO: 1230404 - DNA, 22 bp, Artificial Sequence
  chemically synthesized
ctttagtctaatttcaattggc

SEQ ID NO: 1230405 - DNA, 22 bp, Artificial Sequence
  chemically synthesized
cgtcattcagccaattgaaatt

SEQ ID NO: 1230406 - DNA, 22 bp, Artificial Sequence
  chemically synthesized
agccaattgaaattagactaaa

SEQ ID NO: 1230407 - DNA, 22 bp, Artificial Sequence
  chemically synthesized
aaattagactaaagcaggtcgt

SEQ ID NO: 1230408 - DNA, 22 bp, Artificial Sequence
  chemically synthesized
aaacaaatgtgagaaacgacct

SEQ ID NO: 1230409 - DNA, 22 bp, Artificial Sequence
  chemically synthesized
gaaacaaatgtgagaaacgacc

SEQ ID NO: 1230410 - DNA, 22 bp, Artificial Sequence
  chemically synthesized
tgaaacaaatgtgagaaacgac

SEQ ID NO: 1230411 - DNA, 22 bp, Artificial Sequence
  chemically synthesized
gactaaagcaggtcgtttctca

SEQ ID NO: 1230412 - DNA, 22 bp, Artificial Sequence
  chemically synthesized
ctttgaaacaaatgtgagaaac

SEQ ID NO: 1230413 - DNA, 22 bp, Artificial Sequence
  chemically synthesized
aagcaggtcgtttctcacattt

SEQ ID NO: 1230414 - DNA, 22 bp, Artificial Sequence
  chemically synthesized
ggagaaccaattcctttgaaac

SEQ ID NO: 1230415 - DNA, 22 bp, Artificial Sequence
  chemically synthesized
ctcacatttgtttcaaaggaat

SEQ ID NO: 1230416 - DNA, 22 bp, Artificial Sequence
  chemically synthesized
tcacatttgtttcaaaggaatt

SEQ ID NO: 1230417 - DNA, 22 bp, Artificial Sequence
  chemically synthesized
acatttgtttcaaaggaattgg

SEQ ID NO: 1230418 - DNA, 22 bp, Artificial Sequence
  chemically synthesized
aaatgatctgggagaaccaatt

SEQ ID NO: 1230419 - DNA, 22 bp, Artificial Sequence
  chemically synthesized
gtttcaaaggaattggttctcc

SEQ ID NO: 1230420 - DNA, 22 bp, Artificial Sequence
  chemically synthesized
tgaaatgatctgggagaaccaa

SEQ ID NO: 1230421 - DNA, 22 bp, Artificial Sequence
  chemically synthesized
tttcaaaggaattggttctccc

SEQ ID NO: 1230422 - DNA, 22 bp, Artificial Sequence
  chemically synthesized
caaaggaattggttctcccaga

SEQ ID NO: 1230423 - DNA, 22 bp, Artificial Sequence
  chemically synthesized
aaaggaattggttctcccagat

SEQ ID NO: 1230424 - DNA, 22 bp, Artificial Sequence
  chemically synthesized
gttctcccagatcatttcagag

SEQ ID NO: 1230425 - DNA, 22 bp, Artificial Sequence
  chemically synthesized
ggacaaatatcaaactctgaaa

SEQ ID NO: 1230426 - DNA, 22 bp, Artificial Sequence
  chemically synthesized
aggacaaatatcaaactctgaa

SEQ ID NO: 1230427 - DNA, 22 bp, Artificial Sequence
  chemically synthesized
tcccagatcatttcagagtttg

SEQ ID NO: 1230428 - DNA, 22 bp, Artificial Sequence
  chemically synthesized
ttaggacaaatatcaaactctg

SEQ ID NO: 1230429 - DNA, 22 bp, Artificial Sequence
  chemically synthesized
ccagatcatttcagagtttgat

SEQ ID NO: 1230430 - DNA, 22 bp, Artificial Sequence
  chemically synthesized
cttaggacaaatatcaaactct

SEQ ID NO: 1230431 - DNA, 22 bp, Artificial Sequence
  chemically synthesized
cttcttaggacaaatatcaaac

SEQ ID NO: 1230432 - DNA, 22 bp, Artificial Sequence
  chemically synthesized
cagagtttgatatttgtcctaa

SEQ ID NO: 1230433 - DNA, 22 bp, Artificial Sequence
  chemically synthesized
agagtttgatatttgtcctaag

SEQ ID NO: 1230434 - DNA, 22 bp, Artificial Sequence
  chemically synthesized
gatatttgtcctaagaaggagt

SEQ ID NO: 1230435 - DNA, 22 bp, Artificial Sequence
  chemically synthesized
atatttgtcctaagaaggagtc

SEQ ID NO: 1230436 - DNA, 22 bp, Artificial Sequence
  chemically synthesized
gtcctaagaaggagtcactttt

SEQ ID NO: 1230437 - DNA, 22 bp, Artificial Sequence
  chemically synthesized
tcctaagaaggagtcacttttg

SEQ ID NO: 1230438 - DNA, 22 bp, Artificial Sequence
  chemically synthesized
catatgagggaacaaaagtgac

SEQ ID NO: 1230439 - DNA, 22 bp, Artificial Sequence
  chemically synthesized
agaaggagtcacttttgttccc

SEQ ID NO: 1230440 - DNA, 22 bp, Artificial Sequence
  chemically synthesized
cactgcatatgagggaacaaaa

SEQ ID NO: 1230441 - DNA, 22 bp, Artificial Sequence
  chemically synthesized
acactgcatatgagggaacaaa

SEQ ID NO: 1230442 - DNA, 22 bp, Artificial Sequence
  chemically synthesized
tacactgcatatgagggaacaa

SEQ ID NO: 1230443 - DNA, 22 bp, Artificial Sequence
  chemically synthesized
tattttacactgcatatgaggg

SEQ ID NO: 1230444 - DNA, 22 bp, Artificial Sequence
  chemically synthesized
gtattttacactgcatatgagg

SEQ ID NO: 1230445 - DNA, 22 bp, Artificial Sequence
  chemically synthesized
ttgttccctcatatgcagtgta

SEQ ID NO: 1230446 - DNA, 22 bp, Artificial Sequence
  chemically synthesized
tgttccctcatatgcagtgtaa

SEQ ID NO: 1230447 - DNA, 22 bp, Artificial Sequence
  chemically synthesized
gttccctcatatgcagtgtaaa

SEQ ID NO: 1230448 - DNA, 22 bp, Artificial Sequence
  chemically synthesized
ttccctcatatgcagtgtaaaa

SEQ ID NO: 1230449 - DNA, 22 bp, Artificial Sequence
  chemically synthesized
aaaatgcttgtattttacactg

SEQ ID NO: 1230450 - DNA, 22 bp, Artificial Sequence
  chemically synthesized
aaaaatgcttgtattttacact

SEQ ID NO: 1230451 - DNA, 22 bp, Artificial Sequence
  chemically synthesized
taaaaatgcttgtattttacac

SEQ ID NO: 1230452 - DNA, 22 bp, Artificial Sequence
  chemically synthesized
cctcatatgcagtgtaaaatac

SEQ ID NO: 1230453 - DNA, 22 bp, Artificial Sequence
  chemically synthesized
attttaaaaatgcttgtatttt

SEQ ID NO: 1230454 - DNA, 22 bp, Artificial Sequence
  chemically synthesized
atatgcagtgtaaaatacaagc

SEQ ID NO: 1230455 - DNA, 22 bp, Artificial Sequence
  chemically synthesized
gctaattttaaaaatgcttgta

SEQ ID NO: 1230456 - DNA, 22 bp, Artificial Sequence
  chemically synthesized
agctaattttaaaaatgcttgt

SEQ ID NO: 1230457 - DNA, 22 bp, Artificial Sequence
  chemically synthesized
ccttagctaattttaaaaatgc

SEQ ID NO: 1230458 - DNA, 22 bp, Artificial Sequence
  chemically synthesized
tccccctcccttagctaatttt

SEQ ID NO: 1230459 - DNA, 22 bp, Artificial Sequence
  chemically synthesized
atccccctcccttagctaattt

SEQ ID NO: 1230460 - DNA, 22 bp, Artificial Sequence
  chemically synthesized
cccttatccccctcccttagct

SEQ ID NO: 1230461 - DNA, 22 bp, Artificial Sequence
  chemically synthesized
acccttatccccctcccttagc

SEQ ID NO: 1230462 - DNA, 22 bp, Artificial Sequence
  chemically synthesized
ttaaaattagctaagggagggg

SEQ ID NO: 1230463 - DNA, 22 bp, Artificial Sequence
  chemically synthesized
taaaattagctaagggaggggg

SEQ ID NO: 1230464 - DNA, 22 bp, Artificial Sequence
  chemically synthesized
aaaattagctaagggaggggga

SEQ ID NO: 1230465 - DNA, 22 bp, Artificial Sequence
  chemically synthesized
aaattagctaagggagggggat

SEQ ID NO: 1230466 - DNA, 22 bp, Artificial Sequence
  chemically synthesized
gctaagggagggggataagggt

SEQ ID NO: 1230467 - DNA, 22 bp, Artificial Sequence
  chemically synthesized
agggagggggataagggtaagc

SEQ ID NO: 1230468 - DNA, 22 bp, Artificial Sequence
  chemically synthesized
agtgaaaaggtagcttaccctt

SEQ ID NO: 1230469 - DNA, 22 bp, Artificial Sequence
  chemically synthesized
aaatcaccaagactgagtgaaa

SEQ ID NO: 1230470 - DNA, 22 bp, Artificial Sequence
  chemically synthesized
gttaaaatcaccaagactgagt

SEQ ID NO: 1230471 - DNA, 22 bp, Artificial Sequence
  chemically synthesized
ccttttcactcagtcttggtga

SEQ ID NO: 1230472 - DNA, 22 bp, Artificial Sequence
  chemically synthesized
atatctagttaaaatcaccaag

SEQ ID NO: 1230473 - DNA, 22 bp, Artificial Sequence
  chemically synthesized
catatctagttaaaatcaccaa

SEQ ID NO: 1230474 - DNA, 22 bp, Artificial Sequence
  chemically synthesized
ttcactcagtcttggtgatttt

SEQ ID NO: 1230475 - DNA, 22 bp, Artificial Sequence
  chemically synthesized
tcactcagtcttggtgatttta

SEQ ID NO: 1230476 - DNA, 22 bp, Artificial Sequence
  chemically synthesized
cactcagtcttggtgattttaa

SEQ ID NO: 1230477 - DNA, 22 bp, Artificial Sequence
  chemically synthesized
actcagtcttggtgattttaac

SEQ ID NO: 1230478 - DNA, 22 bp, Artificial Sequence
  chemically synthesized
agtcttggtgattttaactaga

SEQ ID NO: 1230479 - DNA, 22 bp, Artificial Sequence
  chemically synthesized
taccatttcatatctagttaaa

SEQ ID NO: 1230480 - DNA, 22 bp, Artificial Sequence
  chemically synthesized
gtaccatttcatatctagttaa

SEQ ID NO: 1230481 - DNA, 22 bp, Artificial Sequence
  chemically synthesized
ggtgattttaactagatatgaa

SEQ ID NO: 1230482 - DNA, 22 bp, Artificial Sequence
  chemically synthesized
gtgattttaactagatatgaaa

SEQ ID NO: 1230483 - DNA, 22 bp, Artificial Sequence
  chemically synthesized
taatagtttgtaccatttcata

SEQ ID NO: 1230484 - DNA, 22 bp, Artificial Sequence
  chemically synthesized
ataatagtttgtaccatttcat

SEQ ID NO: 1230485 - DNA, 22 bp, Artificial Sequence
  chemically synthesized
tataatagtttgtaccatttca

SEQ ID NO: 1230486 - DNA, 22 bp, Artificial Sequence
  chemically synthesized
taactagatatgaaatggtaca

SEQ ID NO: 1230487 - DNA, 22 bp, Artificial Sequence
  chemically synthesized
aactagatatgaaatggtacaa

SEQ ID NO: 1230488 - DNA, 22 bp, Artificial Sequence
  chemically synthesized
ttttataatagtttgtaccatt

SEQ ID NO: 1230489 - DNA, 22 bp, Artificial Sequence
  chemically synthesized
actagatatgaaatggtacaaa

SEQ ID NO: 1230490 - DNA, 22 bp, Artificial Sequence
  chemically synthesized
gatatgaaatggtacaaactat

SEQ ID NO: 1230491 - DNA, 22 bp, Artificial Sequence
  chemically synthesized
tgaaattattttataatagttt

SEQ ID NO: 1230492 - DNA, 22 bp, Artificial Sequence
  chemically synthesized
gtgaaattattttataatagtt

SEQ ID NO: 1230493 - DNA, 22 bp, Artificial Sequence
  chemically synthesized
tgtgaaattattttataatagt

SEQ ID NO: 1230494 - DNA, 22 bp, Artificial Sequence
  chemically synthesized
ttgtgaaattattttataatag

SEQ ID NO: 1230495 - DNA, 22 bp, Artificial Sequence
  chemically synthesized
tttgtgaaattattttataata

SEQ ID NO: 1230496 - DNA, 22 bp, Artificial Sequence
  chemically synthesized
agaatctttttgtgaaattatt

SEQ ID NO: 1230497 - DNA, 22 bp, Artificial Sequence
  chemically synthesized
cagaatctttttgtgaaattat

SEQ ID NO: 1230498 - DNA, 22 bp, Artificial Sequence
  chemically synthesized
tcagaatctttttgtgaaatta

SEQ ID NO: 1230499 - DNA, 22 bp, Artificial Sequence
  chemically synthesized
ctttcagaatctttttgtgaaa

SEQ ID NO: 1230500 - DNA, 22 bp, Artificial Sequence
  chemically synthesized
ttataaaataatttcacaaaaa

SEQ ID NO: 1230501 - DNA, 22 bp, Artificial Sequence
  chemically synthesized
taaaataatttcacaaaaagat

SEQ ID NO: 1230502 - DNA, 22 bp, Artificial Sequence
  chemically synthesized
agggttcctttcagaatctttt

SEQ ID NO: 1230503 - DNA, 22 bp, Artificial Sequence
  chemically synthesized
cagggttcctttcagaatcttt

SEQ ID NO: 1230504 - DNA, 22 bp, Artificial Sequence
  chemically synthesized
cacaaaaagattctgaaaggaa

SEQ ID NO: 1230505 - DNA, 22 bp, Artificial Sequence
  chemically synthesized
acaaaaagattctgaaaggaac

SEQ ID NO: 1230506 - DNA, 22 bp, Artificial Sequence
  chemically synthesized
aggatatttcagggttcctttc

SEQ ID NO: 1230507 - DNA, 22 bp, Artificial Sequence
  chemically synthesized
aaggatatttcagggttccttt

SEQ ID NO: 1230508 - DNA, 22 bp, Artificial Sequence
  chemically synthesized
taaggatatttcagggttcctt

SEQ ID NO: 1230509 - DNA, 22 bp, Artificial Sequence
  chemically synthesized
ttaaggatatttcagggttcct

SEQ ID NO: 1230510 - DNA, 22 bp, Artificial Sequence
  chemically synthesized
aaacttttaaggatatttcagg

SEQ ID NO: 1230511 - DNA, 22 bp, Artificial Sequence
  chemically synthesized
tgaaaggaaccctgaaatatcc

SEQ ID NO: 1230512 - DNA, 22 bp, Artificial Sequence
  chemically synthesized
aaaggaaccctgaaatatcctt

SEQ ID NO: 1230513 - DNA, 22 bp, Artificial Sequence
  chemically synthesized
aggaaatcaactcaaactttta

SEQ ID NO: 1230514 - DNA, 22 bp, Artificial Sequence
  chemically synthesized
aaggaaatcaactcaaactttt

SEQ ID NO: 1230515 - DNA, 22 bp, Artificial Sequence
  chemically synthesized
aaatatccttaaaagtttgagt

SEQ ID NO: 1230516 - DNA, 22 bp, Artificial Sequence
  chemically synthesized
tttaaggaaatcaactcaaact

SEQ ID NO: 1230517 - DNA, 22 bp, Artificial Sequence
  chemically synthesized
tgtttaaggaaatcaactcaaa

SEQ ID NO: 1230518 - DNA, 22 bp, Artificial Sequence
  chemically synthesized
agattctgtttaaggaaatcaa

SEQ ID NO: 1230519 - DNA, 22 bp, Artificial Sequence
  chemically synthesized
aaaagtttgagttgatttcctt

SEQ ID NO: 1230520 - DNA, 22 bp, Artificial Sequence
  chemically synthesized
aagattctgtttaaggaaatca

SEQ ID NO: 1230521 - DNA, 22 bp, Artificial Sequence
  chemically synthesized
aaagtttgagttgatttcctta

SEQ ID NO: 1230522 - DNA, 22 bp, Artificial Sequence
  chemically synthesized
tttaagattctgtttaaggaaa

SEQ ID NO: 1230523 - DNA, 22 bp, Artificial Sequence
  chemically synthesized
ttgtttaagattctgtttaagg

SEQ ID NO: 1230524 - DNA, 22 bp, Artificial Sequence
  chemically synthesized
gagttgatttccttaaacagaa

SEQ ID NO: 1230525 - DNA, 22 bp, Artificial Sequence
  chemically synthesized
agttgatttccttaaacagaat

SEQ ID NO: 1230526 - DNA, 22 bp, Artificial Sequence
  chemically synthesized
gttattgtttaagattctgttt

SEQ ID NO: 1230527 - DNA, 22 bp, Artificial Sequence
  chemically synthesized
agttattgtttaagattctgtt

SEQ ID NO: 1230528 - DNA, 22 bp, Artificial Sequence
  chemically synthesized
tagttattgtttaagattctgt

SEQ ID NO: 1230529 - DNA, 22 bp, Artificial Sequence
  chemically synthesized
ttagttattgtttaagattctg

SEQ ID NO: 1230530 - DNA, 22 bp, Artificial Sequence
  chemically synthesized
atttccttaaacagaatcttaa

SEQ ID NO: 1230531 - DNA, 22 bp, Artificial Sequence
  chemically synthesized
ccttttagttattgtttaagat

SEQ ID NO: 1230532 - DNA, 22 bp, Artificial Sequence
  chemically synthesized
ccttaaacagaatcttaaacaa

SEQ ID NO: 1230533 - DNA, 22 bp, Artificial Sequence
  chemically synthesized
cccttttagttattgtttaaga

SEQ ID NO: 1230534 - DNA, 22 bp, Artificial Sequence
  chemically synthesized
cttaaacagaatcttaaacaat

SEQ ID NO: 1230535 - DNA, 22 bp, Artificial Sequence
  chemically synthesized
aaacagaatcttaaacaataac

SEQ ID NO: 1230536 - DNA, 22 bp, Artificial Sequence
  chemically synthesized
aacagaatcttaaacaataact

SEQ ID NO: 1230537 - DNA, 22 bp, Artificial Sequence
  chemically synthesized
aatgcatgggatttccctttta

SEQ ID NO: 1230538 - DNA, 22 bp, Artificial Sequence
  chemically synthesized
caatgcatgggatttccctttt

SEQ ID NO: 1230539 - DNA, 22 bp, Artificial Sequence
  chemically synthesized
aaacaataactaaaagggaaat

SEQ ID NO: 1230540 - DNA, 22 bp, Artificial Sequence
  chemically synthesized
tcaatgcatgggatttcccttt

SEQ ID NO: 1230541 - DNA, 22 bp, Artificial Sequence
  chemically synthesized
aacaataactaaaagggaaatc

SEQ ID NO: 1230542 - DNA, 22 bp, Artificial Sequence
  chemically synthesized
cataataattttcaatgcatgg

SEQ ID NO: 1230543 - DNA, 22 bp, Artificial Sequence
  chemically synthesized
aaagggaaatcccatgcattga

SEQ ID NO: 1230544 - DNA, 22 bp, Artificial Sequence
  chemically synthesized
acataataattttcaatgcatg

SEQ ID NO: 1230545 - DNA, 22 bp, Artificial Sequence
  chemically synthesized
agtgtcaggaaggatatttaca

SEQ ID NO: 1230546 - DNA, 22 bp, Artificial Sequence
  chemically synthesized
cagtgtcaggaaggatatttac

SEQ ID NO: 1230547 - DNA, 22 bp, Artificial Sequence
  chemically synthesized
aaaattattatgtaaatatcct

SEQ ID NO: 1230548 - DNA, 22 bp, Artificial Sequence
  chemically synthesized
aggtttcagtgtcaggaaggat

SEQ ID NO: 1230549 - DNA, 22 bp, Artificial Sequence
  chemically synthesized
gaggtttcagtgtcaggaagga

SEQ ID NO: 1230550 - DNA, 22 bp, Artificial Sequence
  chemically synthesized
ttatgtaaatatccttcctgac

SEQ ID NO: 1230551 - DNA, 22 bp, Artificial Sequence
  chemically synthesized
tgtaaatatccttcctgacact

SEQ ID NO: 1230552 - DNA, 22 bp, Artificial Sequence
  chemically synthesized
cctgacactgaaacctcaagca

SEQ ID NO: 1230553 - DNA, 22 bp, Artificial Sequence
  chemically synthesized
ctgacactgaaacctcaagcat

SEQ ID NO: 1230554 - DNA, 22 bp, Artificial Sequence
  chemically synthesized
acactgaaacctcaagcatgta

SEQ ID NO: 1230555 - DNA, 22 bp, Artificial Sequence
  chemically synthesized
aaacctcaagcatgtacttcca

SEQ ID NO: 1230556 - DNA, 22 bp, Artificial Sequence
  chemically synthesized
aagcatgtacttccaccatcta

SEQ ID NO: 1230557 - DNA, 22 bp, Artificial Sequence
  chemically synthesized
ccaccatctatttggttctttc

SEQ ID NO: 1230558 - DNA, 22 bp, Artificial Sequence
  chemically synthesized
caccatctatttggttctttca

SEQ ID NO: 1230559 - DNA, 22 bp, Artificial Sequence
  chemically synthesized
tttggttctttcatttcttttc

SEQ ID NO: 1230560 - DNA, 22 bp, Artificial Sequence
  chemically synthesized
ggttctttcatttcttttcatt

SEQ ID NO: 1230561 - DNA, 22 bp, Artificial Sequence
  chemically synthesized
gttctttcatttcttttcattt

SEQ ID NO: 1230562 - DNA, 22 bp, Artificial Sequence
  chemically synthesized
tgagaacgaaatgaaatgaaaa

SEQ ID NO: 1230563 - DNA, 22 bp, Artificial Sequence
  chemically synthesized
atgagaacgaaatgaaatgaaa

SEQ ID NO: 1230564 - DNA, 22 bp, Artificial Sequence
  chemically synthesized
tatgagaacgaaatgaaatgaa

SEQ ID NO: 1230565 - DNA, 22 bp, Artificial Sequence
  chemically synthesized
tttcatttcttttcatttcatt

SEQ ID NO: 1230566 - DNA, 22 bp, Artificial Sequence
  chemically synthesized
tcatttcttttcatttcatttc

SEQ ID NO: 1230567 - DNA, 22 bp, Artificial Sequence
  chemically synthesized
catttcttttcatttcatttcg

SEQ ID NO: 1230568 - DNA, 22 bp, Artificial Sequence
  chemically synthesized
atttcttttcatttcatttcgt

SEQ ID NO: 1230569 - DNA, 22 bp, Artificial Sequence
  chemically synthesized
cttttcatttcatttcgttctc

SEQ ID NO: 1230570 - DNA, 22 bp, Artificial Sequence
  chemically synthesized
tatatattttatgagaacgaaa

SEQ ID NO: 1230571 - DNA, 22 bp, Artificial Sequence
  chemically synthesized
ttttcatttcatttcgttctca

SEQ ID NO: 1230572 - DNA, 22 bp, Artificial Sequence
  chemically synthesized
atatatattttatgagaacgaa

SEQ ID NO: 1230573 - DNA, 22 bp, Artificial Sequence
  chemically synthesized
ttcatttcatttcgttctcata

SEQ ID NO: 1230574 - DNA, 22 bp, Artificial Sequence
  chemically synthesized
tcatttcatttcgttctcataa

SEQ ID NO: 1230575 - DNA, 22 bp, Artificial Sequence
  chemically synthesized
catttcatttcgttctcataaa

SEQ ID NO: 1230576 - DNA, 22 bp, Artificial Sequence
  chemically synthesized
atttcatttcgttctcataaaa

SEQ ID NO: 1230577 - DNA, 22 bp, Artificial Sequence
  chemically synthesized
ggtttatatatattttatgaga

SEQ ID NO: 1230578 - DNA, 22 bp, Artificial Sequence
  chemically synthesized
tcggtttatatatattttatga

SEQ ID NO: 1230579 - DNA, 22 bp, Artificial Sequence
  chemically synthesized
ctcggtttatatatattttatg

SEQ ID NO: 1230580 - DNA, 22 bp, Artificial Sequence
  chemically synthesized
catttcgttctcataaaatata

SEQ ID NO: 1230581 - DNA, 22 bp, Artificial Sequence
  chemically synthesized
atttcgttctcataaaatatat

SEQ ID NO: 1230582 - DNA, 22 bp, Artificial Sequence
  chemically synthesized
cgttctcataaaatatatataa

SEQ ID NO: 1230583 - DNA, 22 bp, Artificial Sequence
  chemically synthesized
gttctcataaaatatatataaa

SEQ ID NO: 1230584 - DNA, 22 bp, Artificial Sequence
  chemically synthesized
gaaggaacttctcggtttatat

SEQ ID NO: 1230585 - DNA, 22 bp, Artificial Sequence
  chemically synthesized
tcataaaatatatataaaccga

SEQ ID NO: 1230586 - DNA, 22 bp, Artificial Sequence
  chemically synthesized
ataaaatatatataaaccgaga

SEQ ID NO: 1230587 - DNA, 22 bp, Artificial Sequence
  chemically synthesized
gaatgttggaaggaacttctcg

SEQ ID NO: 1230588 - DNA, 22 bp, Artificial Sequence
  chemically synthesized
tctagaatgttggaaggaactt

SEQ ID NO: 1230589 - DNA, 22 bp, Artificial Sequence
  chemically synthesized
atctagaatgttggaaggaact

SEQ ID NO: 1230590 - DNA, 22 bp, Artificial Sequence
  chemically synthesized
tttatctagaatgttggaagga

SEQ ID NO: 1230591 - DNA, 22 bp, Artificial Sequence
  chemically synthesized
tgtttatctagaatgttggaag

SEQ ID NO: 1230592 - DNA, 22 bp, Artificial Sequence
  chemically synthesized
cttccaacattctagataaaca

SEQ ID NO: 1230593 - DNA, 22 bp, Artificial Sequence
  chemically synthesized
aaaagcaaattctgtttatcta

SEQ ID NO: 1230594 - DNA, 22 bp, Artificial Sequence
  chemically synthesized
aaaaagcaaattctgtttatct

SEQ ID NO: 1230595 - DNA, 22 bp, Artificial Sequence
  chemically synthesized
ccaacattctagataaacagaa

SEQ ID NO: 1230596 - DNA, 22 bp, Artificial Sequence
  chemically synthesized
caacattctagataaacagaat

SEQ ID NO: 1230597 - DNA, 22 bp, Artificial Sequence
  chemically synthesized
acatgtttaaaaagcaaattct

SEQ ID NO: 1230598 - DNA, 22 bp, Artificial Sequence
  chemically synthesized
aacatgtttaaaaagcaaattc

SEQ ID NO: 1230599 - DNA, 22 bp, Artificial Sequence
  chemically synthesized
tagataaacagaatttgctttt

SEQ ID NO: 1230600 - DNA, 22 bp, Artificial Sequence
  chemically synthesized
gataaacagaatttgcttttta

SEQ ID NO: 1230601 - DNA, 22 bp, Artificial Sequence
  chemically synthesized
taaaagacatttaacatgttta

SEQ ID NO: 1230602 - DNA, 22 bp, Artificial Sequence
  chemically synthesized
ataaaagacatttaacatgttt

SEQ ID NO: 1230603 - DNA, 22 bp, Artificial Sequence
  chemically synthesized
gctttttaaacatgttaaatgt

SEQ ID NO: 1230604 - DNA, 22 bp, Artificial Sequence
  chemically synthesized
ctttttaaacatgttaaatgtc

SEQ ID NO: 1230605 - DNA, 22 bp, Artificial Sequence
  chemically synthesized
tttaaacatgttaaatgtcttt

SEQ ID NO: 1230606 - DNA, 22 bp, Artificial Sequence
  chemically synthesized
ttaaacatgttaaatgtctttt

SEQ ID NO: 1230607 - DNA, 22 bp, Artificial Sequence
  chemically synthesized
taaacatgttaaatgtctttta

SEQ ID NO: 1230608 - DNA, 22 bp, Artificial Sequence
  chemically synthesized
aaacatgttaaatgtcttttat

SEQ ID NO: 1230609 - DNA, 22 bp, Artificial Sequence
  chemically synthesized
aacatgttaaatgtcttttata

SEQ ID NO: 1230610 - DNA, 22 bp, Artificial Sequence
  chemically synthesized
catgatggcagacatcttataa

SEQ ID NO: 1230611 - DNA, 22 bp, Artificial Sequence
  chemically synthesized
aatgtcttttataagatgtctg

SEQ ID NO: 1230612 - DNA, 22 bp, Artificial Sequence
  chemically synthesized
gctacatgatggcagacatctt

SEQ ID NO: 1230613 - DNA, 22 bp, Artificial Sequence
  chemically synthesized
ggctacatgatggcagacatct

SEQ ID NO: 1230614 - DNA, 22 bp, Artificial Sequence
  chemically synthesized
gcttggctacatgatggcagac

SEQ ID NO: 1230615 - DNA, 22 bp, Artificial Sequence
  chemically synthesized
agcttggctacatgatggcaga

SEQ ID NO: 1230616 - DNA, 22 bp, Artificial Sequence
  chemically synthesized
tagcttggctacatgatggcag

SEQ ID NO: 1230617 - DNA, 22 bp, Artificial Sequence
  chemically synthesized
ttataagatgtctgccatcatg

SEQ ID NO: 1230618 - DNA, 22 bp, Artificial Sequence
  chemically synthesized
tataagatgtctgccatcatgt

SEQ ID NO: 1230619 - DNA, 22 bp, Artificial Sequence
  chemically synthesized
ataagatgtctgccatcatgta

SEQ ID NO: 1230620 - DNA, 22 bp, Artificial Sequence
  chemically synthesized
taagatgtctgccatcatgtag

SEQ ID NO: 1230621 - DNA, 22 bp, Artificial Sequence
  chemically synthesized
ccatcatgtagccaagctaaag

SEQ ID NO: 1230622 - DNA, 22 bp, Artificial Sequence
  chemically synthesized
aatatggagaagtctttagctt

SEQ ID NO: 1230623 - DNA, 22 bp, Artificial Sequence
  chemically synthesized
gaatatggagaagtctttagct

SEQ ID NO: 1230624 - DNA, 22 bp, Artificial Sequence
  chemically synthesized
ttgaatatggagaagtctttag

SEQ ID NO: 1230625 - DNA, 22 bp, Artificial Sequence
  chemically synthesized
tcttgaatatggagaagtcttt

SEQ ID NO: 1230626 - DNA, 22 bp, Artificial Sequence
  chemically synthesized
ctcttgaatatggagaagtctt

SEQ ID NO: 1230627 - DNA, 22 bp, Artificial Sequence
  chemically synthesized
agaagtttctcttgaatatgga

SEQ ID NO: 1230628 - DNA, 22 bp, Artificial Sequence
  chemically synthesized
gagaagtttctcttgaatatgg

SEQ ID NO: 1230629 - DNA, 22 bp, Artificial Sequence
  chemically synthesized
aagacttctccatattcaagag

SEQ ID NO: 1230630 - DNA, 22 bp, Artificial Sequence
  chemically synthesized
ctccatattcaagagaaacttc

SEQ ID NO: 1230631 - DNA, 22 bp, Artificial Sequence
  chemically synthesized
tccatattcaagagaaacttct

SEQ ID NO: 1230632 - DNA, 22 bp, Artificial Sequence
  chemically synthesized
tatgaatacttgagaagtttct

SEQ ID NO: 1230633 - DNA, 22 bp, Artificial Sequence
  chemically synthesized
catattcaagagaaacttctca

SEQ ID NO: 1230634 - DNA, 22 bp, Artificial Sequence
  chemically synthesized
aagagaaacttctcaagtattc

SEQ ID NO: 1230635 - DNA, 22 bp, Artificial Sequence
  chemically synthesized
gaaggattgtatgaatacttga

SEQ ID NO: 1230636 - DNA, 22 bp, Artificial Sequence
  chemically synthesized
agaaggattgtatgaatacttg

SEQ ID NO: 1230637 - DNA, 22 bp, Artificial Sequence
  chemically synthesized
tatttagaaggattgtatgaat

SEQ ID NO: 1230638 - DNA, 22 bp, Artificial Sequence
  chemically synthesized
ctcaagtattcatacaatcctt

SEQ ID NO: 1230639 - DNA, 22 bp, Artificial Sequence
  chemically synthesized
tcaagtattcatacaatccttc

SEQ ID NO: 1230640 - DNA, 22 bp, Artificial Sequence
  chemically synthesized
aagtattcatacaatccttcta

SEQ ID NO: 1230641 - DNA, 22 bp, Artificial Sequence
  chemically synthesized
aaatgcattatatttagaagga

SEQ ID NO: 1230642 - DNA, 22 bp, Artificial Sequence
  chemically synthesized
aaaatgcattatatttagaagg

SEQ ID NO: 1230643 - DNA, 22 bp, Artificial Sequence
  chemically synthesized
taaaatgcattatatttagaag

SEQ ID NO: 1230644 - DNA, 22 bp, Artificial Sequence
  chemically synthesized
ttaaaatgcattatatttagaa

SEQ ID NO: 1230645 - DNA, 22 bp, Artificial Sequence
  chemically synthesized
tttaaaatgcattatatttaga

SEQ ID NO: 1230646 - DNA, 22 bp, Artificial Sequence
  chemically synthesized
atacaatccttctaaatataat

SEQ ID NO: 1230647 - DNA, 22 bp, Artificial Sequence
  chemically synthesized
tctttttaaaatgcattatatt

SEQ ID NO: 1230648 - DNA, 22 bp, Artificial Sequence
  chemically synthesized
atctttttaaaatgcattatat

SEQ ID NO: 1230649 - DNA, 22 bp, Artificial Sequence
  chemically synthesized
tatctttttaaaatgcattata

SEQ ID NO: 1230650 - DNA, 22 bp, Artificial Sequence
  chemically synthesized
ttatctttttaaaatgcattat

SEQ ID NO: 1230651 - DNA, 22 bp, Artificial Sequence
  chemically synthesized
tttatctttttaaaatgcatta

SEQ ID NO: 1230652 - DNA, 22 bp, Artificial Sequence
  chemically synthesized
ctaaatataatgcattttaaaa

SEQ ID NO: 1230653 - DNA, 22 bp, Artificial Sequence
  chemically synthesized
tattttttatctttttaaaatg

SEQ ID NO: 1230654 - DNA, 22 bp, Artificial Sequence
  chemically synthesized
taaatataatgcattttaaaaa

SEQ ID NO: 1230655 - DNA, 22 bp, Artificial Sequence
  chemically synthesized
aatataatgcattttaaaaaga

SEQ ID NO: 1230656 - DNA, 22 bp, Artificial Sequence
  chemically synthesized
ctgtattttttatctttttaaa

SEQ ID NO: 1230657 - DNA, 22 bp, Artificial Sequence
  chemically synthesized
cctgtattttttatctttttaa

SEQ ID NO: 1230658 - DNA, 22 bp, Artificial Sequence
  chemically synthesized
tcctgtattttttatcttttta

SEQ ID NO: 1230659 - DNA, 22 bp, Artificial Sequence
  chemically synthesized
cctttcctgtattttttatctt

SEQ ID NO: 1230660 - DNA, 22 bp, Artificial Sequence
  chemically synthesized
gcctttcctgtattttttatct

SEQ ID NO: 1230661 - DNA, 22 bp, Artificial Sequence
  chemically synthesized
tgcctttcctgtattttttatc

SEQ ID NO: 1230662 - DNA, 22 bp, Artificial Sequence
  chemically synthesized
ctttgcctttcctgtatttttt

SEQ ID NO: 1230663 - DNA, 22 bp, Artificial Sequence
  chemically synthesized
taaaaagataaaaaatacagga

SEQ ID NO: 1230664 - DNA, 22 bp, Artificial Sequence
  chemically synthesized
aaaaagataaaaaatacaggaa

SEQ ID NO: 1230665 - DNA, 22 bp, Artificial Sequence
  chemically synthesized
aaaagataaaaaatacaggaaa

SEQ ID NO: 1230666 - DNA, 22 bp, Artificial Sequence
  chemically synthesized
cagggcaatgaaactactttgc

SEQ ID NO: 1230667 - DNA, 22 bp, Artificial Sequence
  chemically synthesized
cattgccctgcagcatgtgctt

SEQ ID NO: 1230668 - DNA, 22 bp, Artificial Sequence
  chemically synthesized
aatgtggtgtaaaagcacatgc

SEQ ID NO: 1230669 - DNA, 22 bp, Artificial Sequence
  chemically synthesized
attgccctgcagcatgtgcttt

SEQ ID NO: 1230670 - DNA, 22 bp, Artificial Sequence
  chemically synthesized
aaatgtggtgtaaaagcacatg

SEQ ID NO: 1230671 - DNA, 22 bp, Artificial Sequence
  chemically synthesized
ccctgcagcatgtgcttttaca

SEQ ID NO: 1230672 - DNA, 22 bp, Artificial Sequence
  chemically synthesized
cagcatgtgcttttacaccaca

SEQ ID NO: 1230673 - DNA, 22 bp, Artificial Sequence
  chemically synthesized
aacagtgtaaatcttaaatgtg

SEQ ID NO: 1230674 - DNA, 22 bp, Artificial Sequence
  chemically synthesized
aaacagtgtaaatcttaaatgt

SEQ ID NO: 1230675 - DNA, 22 bp, Artificial Sequence
  chemically synthesized
taaacagtgtaaatcttaaatg

SEQ ID NO: 1230676 - DNA, 22 bp, Artificial Sequence
  chemically synthesized
ttacaccacatttaagatttac

SEQ ID NO: 1230677 - DNA, 22 bp, Artificial Sequence
  chemically synthesized
tacaccacatttaagatttaca

SEQ ID NO: 1230678 - DNA, 22 bp, Artificial Sequence
  chemically synthesized
acaccacatttaagatttacac

SEQ ID NO: 1230679 - DNA, 22 bp, Artificial Sequence
  chemically synthesized
aaattttaaacagtgtaaatct

SEQ ID NO: 1230680 - DNA, 22 bp, Artificial Sequence
  chemically synthesized
caccacatttaagatttacact

SEQ ID NO: 1230681 - DNA, 22 bp, Artificial Sequence
  chemically synthesized
gaaattttaaacagtgtaaatc

SEQ ID NO: 1230682 - DNA, 22 bp, Artificial Sequence
  chemically synthesized
aagatttacactgtttaaaatt

SEQ ID NO: 1230683 - DNA, 22 bp, Artificial Sequence
  chemically synthesized
agatttacactgtttaaaattt

SEQ ID NO: 1230684 - DNA, 22 bp, Artificial Sequence
  chemically synthesized
tgcccataagtcttgaaatttt

SEQ ID NO: 1230685 - DNA, 22 bp, Artificial Sequence
  chemically synthesized
atgcccataagtcttgaaattt

SEQ ID NO: 1230686 - DNA, 22 bp, Artificial Sequence
  chemically synthesized
acactgtttaaaatttcaagac

SEQ ID NO: 1230687 - DNA, 22 bp, Artificial Sequence
  chemically synthesized
cactgtttaaaatttcaagact

SEQ ID NO: 1230688 - DNA, 22 bp, Artificial Sequence
  chemically synthesized
tttaaaatttcaagacttatgg

SEQ ID NO: 1230689 - DNA, 22 bp, Artificial Sequence
  chemically synthesized
aaaatttcaagacttatgggca

SEQ ID NO: 1230690 - DNA, 22 bp, Artificial Sequence
  chemically synthesized
aaatttcaagacttatgggcat

SEQ ID NO: 1230691 - DNA, 22 bp, Artificial Sequence
  chemically synthesized
caagacttatgggcataaatca

SEQ ID NO: 1230692 - DNA, 22 bp, Artificial Sequence
  chemically synthesized
aagacttatgggcataaatcat

SEQ ID NO: 1230693 - DNA, 22 bp, Artificial Sequence
  chemically synthesized
aatggaagaaaataggtatgat

SEQ ID NO: 1230694 - DNA, 22 bp, Artificial Sequence
  chemically synthesized
atgggcataaatcatacctatt

SEQ ID NO: 1230695 - DNA, 22 bp, Artificial Sequence
  chemically synthesized
tcaatggaagaaaataggtatg

SEQ ID NO: 1230696 - DNA, 22 bp, Artificial Sequence
  chemically synthesized
tgggcataaatcatacctattt

SEQ ID NO: 1230697 - DNA, 22 bp, Artificial Sequence
  chemically synthesized
aatacatgcatctctcaatgga

SEQ ID NO: 1230698 - DNA, 22 bp, Artificial Sequence
  chemically synthesized
ttttcttccattgagagatgca

SEQ ID NO: 1230699 - DNA, 22 bp, Artificial Sequence
  chemically synthesized
tcttccattgagagatgcatgt

SEQ ID NO: 1230700 - DNA, 22 bp, Artificial Sequence
  chemically synthesized
cttccattgagagatgcatgta

SEQ ID NO: 1230701 - DNA, 22 bp, Artificial Sequence
  chemically synthesized
ttccattgagagatgcatgtat

SEQ ID NO: 1230702 - DNA, 22 bp, Artificial Sequence
  chemically synthesized
ccattgagagatgcatgtattg

SEQ ID NO: 1230703 - DNA, 22 bp, Artificial Sequence
  chemically synthesized
cattgagagatgcatgtattga

SEQ ID NO: 1230704 - DNA, 22 bp, Artificial Sequence
  chemically synthesized
ataagaaaaagattcaatacat

SEQ ID NO: 1230705 - DNA, 22 bp, Artificial Sequence
  chemically synthesized
aataagaaaaagattcaataca

SEQ ID NO: 1230706 - DNA, 22 bp, Artificial Sequence
  chemically synthesized
agagatgcatgtattgaatctt

SEQ ID NO: 1230707 - DNA, 22 bp, Artificial Sequence
  chemically synthesized
tgatttaataagaaaaagattc

SEQ ID NO: 1230708 - DNA, 22 bp, Artificial Sequence
  chemically synthesized
atgatttaataagaaaaagatt

SEQ ID NO: 1230709 - DNA, 22 bp, Artificial Sequence
  chemically synthesized
aatctttttcttattaaatcat

SEQ ID NO: 1230710 - DNA, 22 bp, Artificial Sequence
  chemically synthesized
tatatatcgacgtatttatgat

SEQ ID NO: 1230711 - DNA, 22 bp, Artificial Sequence
  chemically synthesized
tttcttattaaatcataaatac

SEQ ID NO: 1230712 - DNA, 22 bp, Artificial Sequence
  chemically synthesized
ttcttattaaatcataaatacg

SEQ ID NO: 1230713 - DNA, 22 bp, Artificial Sequence
  chemically synthesized
tcttattaaatcataaatacgt

SEQ ID NO: 1230714 - DNA, 22 bp, Artificial Sequence
  chemically synthesized
cttattaaatcataaatacgtc

SEQ ID NO: 1230715 - DNA, 22 bp, Artificial Sequence
  chemically synthesized
ttattaaatcataaatacgtcg

SEQ ID NO: 1230716 - DNA, 22 bp, Artificial Sequence
  chemically synthesized
ggttgtatatatcgacgtattt

SEQ ID NO: 1230717 - DNA, 22 bp, Artificial Sequence
  chemically synthesized
aggttgtatatatcgacgtatt

SEQ ID NO: 1230718 - DNA, 22 bp, Artificial Sequence
  chemically synthesized
attaaatcataaatacgtcgat

SEQ ID NO: 1230719 - DNA, 22 bp, Artificial Sequence
  chemically synthesized
ttaaatcataaatacgtcgata

SEQ ID NO: 1230720 - DNA, 22 bp, Artificial Sequence
  chemically synthesized
aatcataaatacgtcgatatat

SEQ ID NO: 1230721 - DNA, 22 bp, Artificial Sequence
  chemically synthesized
aacggtgggccatattgccact

SEQ ID NO: 1230722 - DNA, 22 bp, Artificial Sequence
  chemically synthesized
gaaatccaggtccacagtggca

SEQ ID NO: 1230723 - DNA, 22 bp, Artificial Sequence
  chemically synthesized
tcattggaaatccaggtccaca

SEQ ID NO: 1230724 - DNA, 22 bp, Artificial Sequence
  chemically synthesized
ccactgtggacctggatttcca

SEQ ID NO: 1230725 - DNA, 22 bp, Artificial Sequence
  chemically synthesized
tggacctggatttccaatgaca

SEQ ID NO: 1230726 - DNA, 22 bp, Artificial Sequence
  chemically synthesized
gatttccaatgacagcttttta

SEQ ID NO: 1230727 - DNA, 22 bp, Artificial Sequence
  chemically synthesized
ccaatgacagctttttattccc

SEQ ID NO: 1230728 - DNA, 22 bp, Artificial Sequence
  chemically synthesized
caatgacagctttttattccct

SEQ ID NO: 1230729 - DNA, 22 bp, Artificial Sequence
  chemically synthesized
aaatacggagataaggaaggga

SEQ ID NO: 1230730 - DNA, 22 bp, Artificial Sequence
  chemically synthesized
gaaatacggagataaggaaggg

SEQ ID NO: 1230731 - DNA, 22 bp, Artificial Sequence
  chemically synthesized
ttgaaatacggagataaggaag

SEQ ID NO: 1230732 - DNA, 22 bp, Artificial Sequence
  chemically synthesized
tttattcccttccttatctccg

SEQ ID NO: 1230733 - DNA, 22 bp, Artificial Sequence
  chemically synthesized
ttattcccttccttatctccgt

SEQ ID NO: 1230734 - DNA, 22 bp, Artificial Sequence
  chemically synthesized
tattcccttccttatctccgta

SEQ ID NO: 1230735 - DNA, 22 bp, Artificial Sequence
  chemically synthesized
attcccttccttatctccgtat

SEQ ID NO: 1230736 - DNA, 22 bp, Artificial Sequence
  chemically synthesized
ttcccttccttatctccgtatt

SEQ ID NO: 1230737 - DNA, 22 bp, Artificial Sequence
  chemically synthesized
ccttccttatctccgtatttca

SEQ ID NO: 1230738 - DNA, 22 bp, Artificial Sequence
  chemically synthesized
ccttatctccgtatttcaagaa

SEQ ID NO: 1230739 - DNA, 22 bp, Artificial Sequence
  chemically synthesized
aatcaaaaataattcttgaaat

SEQ ID NO: 1230740 - DNA, 22 bp, Artificial Sequence
  chemically synthesized
cttatctccgtatttcaagaat

SEQ ID NO: 1230741 - DNA, 22 bp, Artificial Sequence
  chemically synthesized
atctccgtatttcaagaattat

SEQ ID NO: 1230742 - DNA, 22 bp, Artificial Sequence
  chemically synthesized
tctccgtatttcaagaattatt

SEQ ID NO: 1230743 - DNA, 22 bp, Artificial Sequence
  chemically synthesized
tatctgaatcaaaaataattct

SEQ ID NO: 1230744 - DNA, 22 bp, Artificial Sequence
  chemically synthesized
tatatctgaatcaaaaataatt

SEQ ID NO: 1230745 - DNA, 22 bp, Artificial Sequence
  chemically synthesized
cgtatttcaagaattatttttg

SEQ ID NO: 1230746 - DNA, 22 bp, Artificial Sequence
  chemically synthesized
ctatatctgaatcaaaaataat

SEQ ID NO: 1230747 - DNA, 22 bp, Artificial Sequence
  chemically synthesized
caagaattatttttgattcaga

SEQ ID NO: 1230748 - DNA, 22 bp, Artificial Sequence
  chemically synthesized
aagaattatttttgattcagat

SEQ ID NO: 1230749 - DNA, 22 bp, Artificial Sequence
  chemically synthesized
atgtaaatttctatatctgaat

SEQ ID NO: 1230750 - DNA, 22 bp, Artificial Sequence
  chemically synthesized
tctaatgtaaatttctatatct

SEQ ID NO: 1230751 - DNA, 22 bp, Artificial Sequence
  chemically synthesized
tttttgattcagatatagaaat

SEQ ID NO: 1230752 - DNA, 22 bp, Artificial Sequence
  chemically synthesized
ttgattcagatatagaaattta

SEQ ID NO: 1230753 - DNA, 22 bp, Artificial Sequence
  chemically synthesized
tgattcagatatagaaatttac

SEQ ID NO: 1230754 - DNA, 22 bp, Artificial Sequence
  chemically synthesized
gattcagatatagaaatttaca

SEQ ID NO: 1230755 - DNA, 22 bp, Artificial Sequence
  chemically synthesized
attcagatatagaaatttacat

SEQ ID NO: 1230756 - DNA, 22 bp, Artificial Sequence
  chemically synthesized
aaaaattatctaatgtaaattt

SEQ ID NO: 1230757 - DNA, 22 bp, Artificial Sequence
  chemically synthesized
caaaaattatctaatgtaaatt

SEQ ID NO: 1230758 - DNA, 22 bp, Artificial Sequence
  chemically synthesized
agatatagaaatttacattaga

SEQ ID NO: 1230759 - DNA, 22 bp, Artificial Sequence
  chemically synthesized
aggtcaaaatgtgcttcaaaaa

SEQ ID NO: 1230760 - DNA, 22 bp, Artificial Sequence
  chemically synthesized
acattagataatttttgaagca

SEQ ID NO: 1230761 - DNA, 22 bp, Artificial Sequence
  chemically synthesized
cattagataatttttgaagcac

SEQ ID NO: 1230762 - DNA, 22 bp, Artificial Sequence
  chemically synthesized
gataatttttgaagcacatttt

SEQ ID NO: 1230763 - DNA, 22 bp, Artificial Sequence
  chemically synthesized
taatatagttgaggtcaaaatg

SEQ ID NO: 1230764 - DNA, 22 bp, Artificial Sequence
  chemically synthesized
gtaatatagttgaggtcaaaat

SEQ ID NO: 1230765 - DNA, 22 bp, Artificial Sequence
  chemically synthesized
ttgaagcacattttgacctcaa

SEQ ID NO: 1230766 - DNA, 22 bp, Artificial Sequence
  chemically synthesized
tgaagcacattttgacctcaac

SEQ ID NO: 1230767 - DNA, 22 bp, Artificial Sequence
  chemically synthesized
gaagcacattttgacctcaact

SEQ ID NO: 1230768 - DNA, 22 bp, Artificial Sequence
  chemically synthesized
aagcacattttgacctcaacta

SEQ ID NO: 1230769 - DNA, 22 bp, Artificial Sequence
  chemically synthesized
aatcttgtaatatagttgaggt

SEQ ID NO: 1230770 - DNA, 22 bp, Artificial Sequence
  chemically synthesized
tgacctcaactatattacaaga

SEQ ID NO: 1230771 - DNA, 22 bp, Artificial Sequence
  chemically synthesized
gacctcaactatattacaagat

SEQ ID NO: 1230772 - DNA, 22 bp, Artificial Sequence
  chemically synthesized
acctcaactatattacaagatt

SEQ ID NO: 1230773 - DNA, 22 bp, Artificial Sequence
  chemically synthesized
aactatattacaagatttaatt

SEQ ID NO: 1230774 - DNA, 22 bp, Artificial Sequence
  chemically synthesized
tagtgagtacccagaattaaat

SEQ ID NO: 1230775 - DNA, 22 bp, Artificial Sequence
  chemically synthesized
gtagtgagtacccagaattaaa

SEQ ID NO: 1230776 - DNA, 22 bp, Artificial Sequence
  chemically synthesized
tgtagtgagtacccagaattaa

SEQ ID NO: 1230777 - DNA, 22 bp, Artificial Sequence
  chemically synthesized
tattacaagatttaattctggg

SEQ ID NO: 1230778 - DNA, 22 bp, Artificial Sequence
  chemically synthesized
caagatttaattctgggtactc

SEQ ID NO: 1230779 - DNA, 22 bp, Artificial Sequence
  chemically synthesized
aattctgggtactcactacaaa

SEQ ID NO: 1230780 - DNA, 22 bp, Artificial Sequence
  chemically synthesized
attctgggtactcactacaaag

SEQ ID NO: 1230781 - DNA, 22 bp, Artificial Sequence
  chemically synthesized
tgggtactcactacaaagatac

SEQ ID NO: 1230782 - DNA, 22 bp, Artificial Sequence
  chemically synthesized
aaggtagagatagtatctttgt

SEQ ID NO: 1230783 - DNA, 22 bp, Artificial Sequence
  chemically synthesized
ggtactcactacaaagatacta

SEQ ID NO: 1230784 - DNA, 22 bp, Artificial Sequence
  chemically synthesized
atcattgaaggtagagatagta

SEQ ID NO: 1230785 - DNA, 22 bp, Artificial Sequence
  chemically synthesized
aatcattgaaggtagagatagt

SEQ ID NO: 1230786 - DNA, 22 bp, Artificial Sequence
  chemically synthesized
actacaaagatactatctctac

SEQ ID NO: 1230787 - DNA, 22 bp, Artificial Sequence
  chemically synthesized
caaagatactatctctaccttc

SEQ ID NO: 1230788 - DNA, 22 bp, Artificial Sequence
  chemically synthesized
aatatgtaaaacttaatcattg

SEQ ID NO: 1230789 - DNA, 22 bp, Artificial Sequence
  chemically synthesized
tctctaccttcaatgattaagt

SEQ ID NO: 1230790 - DNA, 22 bp, Artificial Sequence
  chemically synthesized
taccttcaatgattaagtttta

SEQ ID NO: 1230791 - DNA, 22 bp, Artificial Sequence
  chemically synthesized
ccttcaatgattaagttttaca

SEQ ID NO: 1230792 - DNA, 22 bp, Artificial Sequence
  chemically synthesized
aagaatgactaaatatgtaaaa

SEQ ID NO: 1230793 - DNA, 22 bp, Artificial Sequence
  chemically synthesized
caatgattaagttttacatatt

SEQ ID NO: 1230794 - DNA, 22 bp, Artificial Sequence
  chemically synthesized
aatgattaagttttacatattt

SEQ ID NO: 1230795 - DNA, 22 bp, Artificial Sequence
  chemically synthesized
agttttacatatttagtcattc

SEQ ID NO: 1230796 - DNA, 22 bp, Artificial Sequence
  chemically synthesized
tacatatttagtcattctttaa

SEQ ID NO: 1230797 - DNA, 22 bp, Artificial Sequence
  chemically synthesized
acatatttagtcattctttaac

SEQ ID NO: 1230798 - DNA, 22 bp, Artificial Sequence
  chemically synthesized
catatttagtcattctttaact

SEQ ID NO: 1230799 - DNA, 22 bp, Artificial Sequence
  chemically synthesized
agtcattctttaactatttttg

SEQ ID NO: 1230800 - DNA, 22 bp, Artificial Sequence
  chemically synthesized
gtcattctttaactatttttga

SEQ ID NO: 1230801 - DNA, 22 bp, Artificial Sequence
  chemically synthesized
tttaactatttttgaccactca

SEQ ID NO: 1230802 - DNA, 22 bp, Artificial Sequence
  chemically synthesized
taactatttttgaccactcact

SEQ ID NO: 1230803 - DNA, 22 bp, Artificial Sequence
  chemically synthesized
tgcgtggcatatagtgagtggt

SEQ ID NO: 1230804 - DNA, 22 bp, Artificial Sequence
  chemically synthesized
aactatttttgaccactcacta

SEQ ID NO: 1230805 - DNA, 22 bp, Artificial Sequence
  chemically synthesized
actatttttgaccactcactat

SEQ ID NO: 1230806 - DNA, 22 bp, Artificial Sequence
  chemically synthesized
tatgcgtggcatatagtgagtg

SEQ ID NO: 1230807 - DNA, 22 bp, Artificial Sequence
  chemically synthesized
tttttgaccactcactatatgc

SEQ ID NO: 1230808 - DNA, 22 bp, Artificial Sequence
  chemically synthesized
acattctatgcgtggcatatag

SEQ ID NO: 1230809 - DNA, 22 bp, Artificial Sequence
  chemically synthesized
ttgaccactcactatatgccac

SEQ ID NO: 1230810 - DNA, 22 bp, Artificial Sequence
  chemically synthesized
aacattctatgcgtggcatata

SEQ ID NO: 1230811 - DNA, 22 bp, Artificial Sequence
  chemically synthesized
tgaccactcactatatgccacg

SEQ ID NO: 1230812 - DNA, 22 bp, Artificial Sequence
  chemically synthesized
gaccactcactatatgccacgc

SEQ ID NO: 1230813 - DNA, 22 bp, Artificial Sequence
  chemically synthesized
ttaacattctatgcgtggcata

SEQ ID NO: 1230814 - DNA, 22 bp, Artificial Sequence
  chemically synthesized
accactcactatatgccacgca

SEQ ID NO: 1230815 - DNA, 22 bp, Artificial Sequence
  chemically synthesized
ttcttaacattctatgcgtggc

SEQ ID NO: 1230816 - DNA, 22 bp, Artificial Sequence
  chemically synthesized
attcttaacattctatgcgtgg

SEQ ID NO: 1230817 - DNA, 22 bp, Artificial Sequence
  chemically synthesized
actatatgccacgcatagaatg

SEQ ID NO: 1230818 - DNA, 22 bp, Artificial Sequence
  chemically synthesized
aatttattcttaacattctatg

SEQ ID NO: 1230819 - DNA, 22 bp, Artificial Sequence
  chemically synthesized
aaatttattcttaacattctat

SEQ ID NO: 1230820 - DNA, 22 bp, Artificial Sequence
  chemically synthesized
taaatttattcttaacattcta

SEQ ID NO: 1230821 - DNA, 22 bp, Artificial Sequence
  chemically synthesized
tatgccacgcatagaatgttaa

SEQ ID NO: 1230822 - DNA, 22 bp, Artificial Sequence
  chemically synthesized
ttaaatttattcttaacattct

SEQ ID NO: 1230823 - DNA, 22 bp, Artificial Sequence
  chemically synthesized
tttaaatttattcttaacattc

SEQ ID NO: 1230824 - DNA, 22 bp, Artificial Sequence
  chemically synthesized
ttttttaaatttattcttaaca

SEQ ID NO: 1230825 - DNA, 22 bp, Artificial Sequence
  chemically synthesized
aaagtctattttttaaatttat

SEQ ID NO: 1230826 - DNA, 22 bp, Artificial Sequence
  chemically synthesized
ttgaaagtctattttttaaatt

SEQ ID NO: 1230827 - DNA, 22 bp, Artificial Sequence
  chemically synthesized
gttgaaagtctattttttaaat

SEQ ID NO: 1230828 - DNA, 22 bp, Artificial Sequence
  chemically synthesized
agaataaatttaaaaaatagac

SEQ ID NO: 1230829 - DNA, 22 bp, Artificial Sequence
  chemically synthesized
tccataagcaatttgttgaaag

SEQ ID NO: 1230830 - DNA, 22 bp, Artificial Sequence
  chemically synthesized
gtccataagcaatttgttgaaa

SEQ ID NO: 1230831 - DNA, 22 bp, Artificial Sequence
  chemically synthesized
aaaaaatagactttcaacaaat

SEQ ID NO: 1230832 - DNA, 22 bp, Artificial Sequence
  chemically synthesized
aaaaatagactttcaacaaatt

SEQ ID NO: 1230833 - DNA, 22 bp, Artificial Sequence
  chemically synthesized
acttgtccataagcaatttgtt

SEQ ID NO: 1230834 - DNA, 22 bp, Artificial Sequence
  chemically synthesized
cacttgtccataagcaatttgt

SEQ ID NO: 1230835 - DNA, 22 bp, Artificial Sequence
  chemically synthesized
acatttcacttgtccataagca

SEQ ID NO: 1230836 - DNA, 22 bp, Artificial Sequence
  chemically synthesized
aacatttcacttgtccataagc

SEQ ID NO: 1230837 - DNA, 22 bp, Artificial Sequence
  chemically synthesized
tcaacaaattgcttatggacaa

SEQ ID NO: 1230838 - DNA, 22 bp, Artificial Sequence
  chemically synthesized
caacaaattgcttatggacaag

SEQ ID NO: 1230839 - DNA, 22 bp, Artificial Sequence
  chemically synthesized
aacaaattgcttatggacaagt

SEQ ID NO: 1230840 - DNA, 22 bp, Artificial Sequence
  chemically synthesized
cttatggacaagtgaaatgtta

SEQ ID NO: 1230841 - DNA, 22 bp, Artificial Sequence
  chemically synthesized
atggacaagtgaaatgttaaat

SEQ ID NO: 1230842 - DNA, 22 bp, Artificial Sequence
  chemically synthesized
tggacaagtgaaatgttaaatt

SEQ ID NO: 1230843 - DNA, 22 bp, Artificial Sequence
  chemically synthesized
aaatatagaggaaatttaacat

SEQ ID NO: 1230844 - DNA, 22 bp, Artificial Sequence
  chemically synthesized
aatttcctctatatttcagata

SEQ ID NO: 1230845 - DNA, 22 bp, Artificial Sequence
  chemically synthesized
cctctatatttcagatatgttt

SEQ ID NO: 1230846 - DNA, 22 bp, Artificial Sequence
  chemically synthesized
ctctatatttcagatatgttta

SEQ ID NO: 1230847 - DNA, 22 bp, Artificial Sequence
  chemically synthesized
tatatttcagatatgtttatga

SEQ ID NO: 1230848 - DNA, 22 bp, Artificial Sequence
  chemically synthesized
tatttcagatatgtttatgatc

SEQ ID NO: 1230849 - DNA, 22 bp, Artificial Sequence
  chemically synthesized
caatgtatcagagtgatcataa

SEQ ID NO: 1230850 - DNA, 22 bp, Artificial Sequence
  chemically synthesized
cagatatgtttatgatcactct

SEQ ID NO: 1230851 - DNA, 22 bp, Artificial Sequence
  chemically synthesized
ctgcaatgtatcagagtgatca

SEQ ID NO: 1230852 - DNA, 22 bp, Artificial Sequence
  chemically synthesized
agatatgtttatgatcactctg

SEQ ID NO: 1230853 - DNA, 22 bp, Artificial Sequence
  chemically synthesized
tcctgcaatgtatcagagtgat

SEQ ID NO: 1230854 - DNA, 22 bp, Artificial Sequence
  chemically synthesized
atgatcactctgatacattgca

SEQ ID NO: 1230855 - DNA, 22 bp, Artificial Sequence
  chemically synthesized
tgatcactctgatacattgcag

SEQ ID NO: 1230856 - DNA, 22 bp, Artificial Sequence
  chemically synthesized
aaaataattctcctgcaatgta

SEQ ID NO: 1230857 - DNA, 22 bp, Artificial Sequence
  chemically synthesized
cattaaaaataattctcctgca

SEQ ID NO: 1230858 - DNA, 22 bp, Artificial Sequence
  chemically synthesized
tgatacattgcaggagaattat

SEQ ID NO: 1230859 - DNA, 22 bp, Artificial Sequence
  chemically synthesized
atacattgcaggagaattattt

SEQ ID NO: 1230860 - DNA, 22 bp, Artificial Sequence
  chemically synthesized
caggagaattatttttaatgga

SEQ ID NO: 1230861 - DNA, 22 bp, Artificial Sequence
  chemically synthesized
tttttaatggagtcatgttttc

SEQ ID NO: 1230862 - DNA, 22 bp, Artificial Sequence
  chemically synthesized
ttaatggagtcatgttttcatt

SEQ ID NO: 1230863 - DNA, 22 bp, Artificial Sequence
  chemically synthesized
taatggagtcatgttttcattt

SEQ ID NO: 1230864 - DNA, 22 bp, Artificial Sequence
  chemically synthesized
aatggagtcatgttttcatttg

SEQ ID NO: 1230865 - DNA, 22 bp, Artificial Sequence
  chemically synthesized
atggagtcatgttttcatttgt

SEQ ID NO: 1230866 - DNA, 22 bp, Artificial Sequence
  chemically synthesized
tcaaagaggcagtatataaaca

SEQ ID NO: 1230867 - DNA, 22 bp, Artificial Sequence
  chemically synthesized
ttgtcaaagaggcagtatataa

SEQ ID NO: 1230868 - DNA, 22 bp, Artificial Sequence
  chemically synthesized
attgtcaaagaggcagtatata

SEQ ID NO: 1230869 - DNA, 22 bp, Artificial Sequence
  chemically synthesized
tattgtcaaagaggcagtatat

SEQ ID NO: 1230870 - DNA, 22 bp, Artificial Sequence
  chemically synthesized
tcatttgtttatatactgcctc

SEQ ID NO: 1230871 - DNA, 22 bp, Artificial Sequence
  chemically synthesized
tttattgtcaaagaggcagtat

SEQ ID NO: 1230872 - DNA, 22 bp, Artificial Sequence
  chemically synthesized
catttgtttatatactgcctct

SEQ ID NO: 1230873 - DNA, 22 bp, Artificial Sequence
  chemically synthesized
atttgtttatatactgcctctt

SEQ ID NO: 1230874 - DNA, 22 bp, Artificial Sequence
  chemically synthesized
aattctttattgtcaaagaggc

SEQ ID NO: 1230875 - DNA, 22 bp, Artificial Sequence
  chemically synthesized
gtttatatactgcctctttgac

SEQ ID NO: 1230876 - DNA, 22 bp, Artificial Sequence
  chemically synthesized
tttatatactgcctctttgaca

SEQ ID NO: 1230877 - DNA, 22 bp, Artificial Sequence
  chemically synthesized
cctcaattctttattgtcaaag

SEQ ID NO: 1230878 - DNA, 22 bp, Artificial Sequence
  chemically synthesized
atatactgcctctttgacaata

SEQ ID NO: 1230879 - DNA, 22 bp, Artificial Sequence
  chemically synthesized
tatactgcctctttgacaataa

SEQ ID NO: 1230880 - DNA, 22 bp, Artificial Sequence
  chemically synthesized
actgcctcaattctttattgtc

SEQ ID NO: 1230881 - DNA, 22 bp, Artificial Sequence
  chemically synthesized
cctctttgacaataaagaattg

SEQ ID NO: 1230882 - DNA, 22 bp, Artificial Sequence
  chemically synthesized
tattaactgcctcaattcttta

SEQ ID NO: 1230883 - DNA, 22 bp, Artificial Sequence
  chemically synthesized
gtattaactgcctcaattcttt

SEQ ID NO: 1230884 - DNA, 22 bp, Artificial Sequence
  chemically synthesized
tttgacaataaagaattgaggc

SEQ ID NO: 1230885 - DNA, 22 bp, Artificial Sequence
  chemically synthesized
tgacaataaagaattgaggcag

SEQ ID NO: 1230886 - DNA, 22 bp, Artificial Sequence
  chemically synthesized
gacaataaagaattgaggcagt

SEQ ID NO: 1230887 - DNA, 22 bp, Artificial Sequence
  chemically synthesized
acaataaagaattgaggcagtt

SEQ ID NO: 1230888 - DNA, 22 bp, Artificial Sequence
  chemically synthesized
tgagacacttgtattaactgcc

SEQ ID NO: 1230889 - DNA, 22 bp, Artificial Sequence
  chemically synthesized
ggattatgagacacttgtatta

SEQ ID NO: 1230890 - DNA, 22 bp, Artificial Sequence
  chemically synthesized
aggattatgagacacttgtatt

SEQ ID NO: 1230891 - DNA, 22 bp, Artificial Sequence
  chemically synthesized
ttaggattatgagacacttgta

SEQ ID NO: 1230892 - DNA, 22 bp, Artificial Sequence
  chemically synthesized
cttaggattatgagacacttgt

SEQ ID NO: 1230893 - DNA, 22 bp, Artificial Sequence
  chemically synthesized
aggcagttaatacaagtgtctc

SEQ ID NO: 1230894 - DNA, 22 bp, Artificial Sequence
  chemically synthesized
tcttaggattatgagacacttg

SEQ ID NO: 1230895 - DNA, 22 bp, Artificial Sequence
  chemically synthesized
atattttcttaggattatgaga

SEQ ID NO: 1230896 - DNA, 22 bp, Artificial Sequence
  chemically synthesized
atacaagtgtctcataatccta

SEQ ID NO: 1230897 - DNA, 22 bp, Artificial Sequence
  chemically synthesized
aatgttcatattttcttaggat

SEQ ID NO: 1230898 - DNA, 22 bp, Artificial Sequence
  chemically synthesized
ataatcctaagaaaatatgaac

SEQ ID NO: 1230899 - DNA, 22 bp, Artificial Sequence
  chemically synthesized
atgccattaaatgttcatattt

SEQ ID NO: 1230900 - DNA, 22 bp, Artificial Sequence
  chemically synthesized
catgccattaaatgttcatatt

SEQ ID NO: 1230901 - DNA, 22 bp, Artificial Sequence
  chemically synthesized
tcatgccattaaatgttcatat

SEQ ID NO: 1230902 - DNA, 22 bp, Artificial Sequence
  chemically synthesized
agaaaatatgaacatttaatgg

SEQ ID NO: 1230903 - DNA, 22 bp, Artificial Sequence
  chemically synthesized
atgtctttcatgccattaaatg

SEQ ID NO: 1230904 - DNA, 22 bp, Artificial Sequence
  chemically synthesized
aatgtctttcatgccattaaat

SEQ ID NO: 1230905 - DNA, 22 bp, Artificial Sequence
  chemically synthesized
taatgtctttcatgccattaaa

SEQ ID NO: 1230906 - DNA, 22 bp, Artificial Sequence
  chemically synthesized
ttttaatgtctttcatgccatt

SEQ ID NO: 1230907 - DNA, 22 bp, Artificial Sequence
  chemically synthesized
gttttaatgtctttcatgccat

SEQ ID NO: 1230908 - DNA, 22 bp, Artificial Sequence
  chemically synthesized
ataaatttgttttaatgtcttt

SEQ ID NO: 1230909 - DNA, 22 bp, Artificial Sequence
  chemically synthesized
gataaatttgttttaatgtctt

SEQ ID NO: 1230910 - DNA, 22 bp, Artificial Sequence
  chemically synthesized
tgataaatttgttttaatgtct

SEQ ID NO: 1230911 - DNA, 22 bp, Artificial Sequence
  chemically synthesized
aatggcatgaaagacattaaaa

SEQ ID NO: 1230912 - DNA, 22 bp, Artificial Sequence
  chemically synthesized
atggcatgaaagacattaaaac

SEQ ID NO: 1230913 - DNA, 22 bp, Artificial Sequence
  chemically synthesized
ttttgataaatttgttttaatg

SEQ ID NO: 1230914 - DNA, 22 bp, Artificial Sequence
  chemically synthesized
tattttgataaatttgttttaa

SEQ ID NO: 1230915 - DNA, 22 bp, Artificial Sequence
  chemically synthesized
ctattttgataaatttgtttta

SEQ ID NO: 1230916 - DNA, 22 bp, Artificial Sequence
  chemically synthesized
tatcaaaacttctattttgata

SEQ ID NO: 1230917 - DNA, 22 bp, Artificial Sequence
  chemically synthesized
aaacaaatttatcaaaatagaa

SEQ ID NO: 1230918 - DNA, 22 bp, Artificial Sequence
  chemically synthesized
cctgtatcaaaacttctatttt

SEQ ID NO: 1230919 - DNA, 22 bp, Artificial Sequence
  chemically synthesized
atcaaaatagaagttttgatac

SEQ ID NO: 1230920 - DNA, 22 bp, Artificial Sequence
  chemically synthesized
tcaaaatagaagttttgataca

SEQ ID NO: 1230921 - DNA, 22 bp, Artificial Sequence
  chemically synthesized
aaccagattacctgtatcaaaa

SEQ ID NO: 1230922 - DNA, 22 bp, Artificial Sequence
  chemically synthesized
atacgttcaaccagattacctg

SEQ ID NO: 1230923 - DNA, 22 bp, Artificial Sequence
  chemically synthesized
ttaatacgttcaaccagattac

SEQ ID NO: 1230924 - DNA, 22 bp, Artificial Sequence
  chemically synthesized
attaatacgttcaaccagatta

SEQ ID NO: 1230925 - DNA, 22 bp, Artificial Sequence
  chemically synthesized
tattaatacgttcaaccagatt

SEQ ID NO: 1230926 - DNA, 22 bp, Artificial Sequence
  chemically synthesized
tgatacaggtaatctggttgaa

SEQ ID NO: 1230927 - DNA, 22 bp, Artificial Sequence
  chemically synthesized
gatacaggtaatctggttgaac

SEQ ID NO: 1230928 - DNA, 22 bp, Artificial Sequence
  chemically synthesized
atacaggtaatctggttgaacg

SEQ ID NO: 1230929 - DNA, 22 bp, Artificial Sequence
  chemically synthesized
cattttattaatacgttcaacc

SEQ ID NO: 1230930 - DNA, 22 bp, Artificial Sequence
  chemically synthesized
gcattttattaatacgttcaac

SEQ ID NO: 1230931 - DNA, 22 bp, Artificial Sequence
  chemically synthesized
gtttgcattttattaatacgtt

SEQ ID NO: 1230932 - DNA, 22 bp, Artificial Sequence
  chemically synthesized
agtttgcattttattaatacgt

SEQ ID NO: 1230933 - DNA, 22 bp, Artificial Sequence
  chemically synthesized
gttgaacgtattaataaaatgc

SEQ ID NO: 1230934 - DNA, 22 bp, Artificial Sequence
  chemically synthesized
aacgtattaataaaatgcaaac

SEQ ID NO: 1230935 - DNA, 22 bp, Artificial Sequence
  chemically synthesized
ccaaaaagtttagtttgcattt

SEQ ID NO: 1230936 - DNA, 22 bp, Artificial Sequence
  chemically synthesized
cccaaaaagtttagtttgcatt

SEQ ID NO: 1230937 - DNA, 22 bp, Artificial Sequence
  chemically synthesized
tcccaaaaagtttagtttgcat

SEQ ID NO: 1230938 - DNA, 22 bp, Artificial Sequence
  chemically synthesized
ctttcccaaaaagtttagtttg

SEQ ID NO: 1230939 - DNA, 22 bp, Artificial Sequence
  chemically synthesized
ataaaatgcaaactaaactttt

SEQ ID NO: 1230940 - DNA, 22 bp, Artificial Sequence
  chemically synthesized
aaagagctactttcccaaaaag

SEQ ID NO: 1230941 - DNA, 22 bp, Artificial Sequence
  chemically synthesized
gttaaaagagctactttcccaa

SEQ ID NO: 1230942 - DNA, 22 bp, Artificial Sequence
  chemically synthesized
agttaaaagagctactttccca

SEQ ID NO: 1230943 - DNA, 22 bp, Artificial Sequence
  chemically synthesized
aactttttgggaaagtagctct

SEQ ID NO: 1230944 - DNA, 22 bp, Artificial Sequence
  chemically synthesized
agtttagttaaaagagctactt

SEQ ID NO: 1230945 - DNA, 22 bp, Artificial Sequence
  chemically synthesized
ttgagtttagttaaaagagcta

SEQ ID NO: 1230946 - DNA, 22 bp, Artificial Sequence
  chemically synthesized
gttgagtttagttaaaagagct

SEQ ID NO: 1230947 - DNA, 22 bp, Artificial Sequence
  chemically synthesized
tttgggaaagtagctcttttaa

SEQ ID NO: 1230948 - DNA, 22 bp, Artificial Sequence
  chemically synthesized
tgttgagtttagttaaaagagc

SEQ ID NO: 1230949 - DNA, 22 bp, Artificial Sequence
  chemically synthesized
ttgggaaagtagctcttttaac

SEQ ID NO: 1230950 - DNA, 22 bp, Artificial Sequence
  chemically synthesized
tgggaaagtagctcttttaact

SEQ ID NO: 1230951 - DNA, 22 bp, Artificial Sequence
  chemically synthesized
gggaaagtagctcttttaacta

SEQ ID NO: 1230952 - DNA, 22 bp, Artificial Sequence
  chemically synthesized
ggaaagtagctcttttaactaa

SEQ ID NO: 1230953 - DNA, 22 bp, Artificial Sequence
  chemically synthesized
tataaggaattttgttgagttt

SEQ ID NO: 1230954 - DNA, 22 bp, Artificial Sequence
  chemically synthesized
tatataaggaattttgttgagt

SEQ ID NO: 1230955 - DNA, 22 bp, Artificial Sequence
  chemically synthesized
ttttaactaaactcaacaaaat

SEQ ID NO: 1230956 - DNA, 22 bp, Artificial Sequence
  chemically synthesized
ttaactaaactcaacaaaattc

SEQ ID NO: 1230957 - DNA, 22 bp, Artificial Sequence
  chemically synthesized
taactaaactcaacaaaattcc

SEQ ID NO: 1230958 - DNA, 22 bp, Artificial Sequence
  chemically synthesized
aactaaactcaacaaaattcct

SEQ ID NO: 1230959 - DNA, 22 bp, Artificial Sequence
  chemically synthesized
actaaactcaacaaaattcctt

SEQ ID NO: 1230960 - DNA, 22 bp, Artificial Sequence
  chemically synthesized
atatatattctatataaggaat

SEQ ID NO: 1230961 - DNA, 22 bp, Artificial Sequence
  chemically synthesized
aactcaacaaaattccttatat

SEQ ID NO: 1230962 - DNA, 22 bp, Artificial Sequence
  chemically synthesized
taatatatattctatataagga

SEQ ID NO: 1230963 - DNA, 22 bp, Artificial Sequence
  chemically synthesized
aacaaaattccttatatagaat

SEQ ID NO: 1230964 - DNA, 22 bp, Artificial Sequence
  chemically synthesized
aggcaatgccctctaatatata

SEQ ID NO: 1230965 - DNA, 22 bp, Artificial Sequence
  chemically synthesized
cttatatagaatatatattaga

SEQ ID NO: 1230966 - DNA, 22 bp, Artificial Sequence
  chemically synthesized
ctcaggcaatgccctctaatat

SEQ ID NO: 1230967 - DNA, 22 bp, Artificial Sequence
  chemically synthesized
atatagaatatatattagaggg

SEQ ID NO: 1230968 - DNA, 22 bp, Artificial Sequence
  chemically synthesized
actcaggcaatgccctctaata

SEQ ID NO: 1230969 - DNA, 22 bp, Artificial Sequence
  chemically synthesized
tatagaatatatattagagggc

SEQ ID NO: 1230970 - DNA, 22 bp, Artificial Sequence
  chemically synthesized
aggacagtgtccatttactcag

SEQ ID NO: 1230971 - DNA, 22 bp, Artificial Sequence
  chemically synthesized
gagggcattgcctgagtaaatg

SEQ ID NO: 1230972 - DNA, 22 bp, Artificial Sequence
  chemically synthesized
cctgagtaaatggacactgtcc

SEQ ID NO: 1230973 - DNA, 22 bp, Artificial Sequence
  chemically synthesized
tgaaagtattgaggacagtgtc

SEQ ID NO: 1230974 - DNA, 22 bp, Artificial Sequence
  chemically synthesized
agtaaatggacactgtcctcaa

SEQ ID NO: 1230975 - DNA, 22 bp, Artificial Sequence
  chemically synthesized
aattgtgaaagtattgaggaca

SEQ ID NO: 1230976 - DNA, 22 bp, Artificial Sequence
  chemically synthesized
atactaaattgtgaaagtattg

SEQ ID NO: 1230977 - DNA, 22 bp, Artificial Sequence
  chemically synthesized
catactaaattgtgaaagtatt

SEQ ID NO: 1230978 - DNA, 22 bp, Artificial Sequence
  chemically synthesized
tcatactaaattgtgaaagtat

SEQ ID NO: 1230979 - DNA, 22 bp, Artificial Sequence
  chemically synthesized
tcctcaatactttcacaattta

SEQ ID NO: 1230980 - DNA, 22 bp, Artificial Sequence
  chemically synthesized
aatactttcacaatttagtatg

SEQ ID NO: 1230981 - DNA, 22 bp, Artificial Sequence
  chemically synthesized
aaagtatatatatctttcatac

SEQ ID NO: 1230982 - DNA, 22 bp, Artificial Sequence
  chemically synthesized
tcacaatttagtatgaaagata

SEQ ID NO: 1230983 - DNA, 22 bp, Artificial Sequence
  chemically synthesized
cacaatttagtatgaaagatat

SEQ ID NO: 1230984 - DNA, 22 bp, Artificial Sequence
  chemically synthesized
acaatttagtatgaaagatata

SEQ ID NO: 1230985 - DNA, 22 bp, Artificial Sequence
  chemically synthesized
agtatgaaagatatatatactt

SEQ ID NO: 1230986 - DNA, 22 bp, Artificial Sequence
  chemically synthesized
gtatgaaagatatatatacttt

SEQ ID NO: 1230987 - DNA, 22 bp, Artificial Sequence
  chemically synthesized
aataatatactgaaagtatata

SEQ ID NO: 1230988 - DNA, 22 bp, Artificial Sequence
  chemically synthesized
aaattaaataatatactgaaag

SEQ ID NO: 1230989 - DNA, 22 bp, Artificial Sequence
  chemically synthesized
caaaaattcaaattaaataata

SEQ ID NO: 1230990 - DNA, 22 bp, Artificial Sequence
  chemically synthesized
tcagtatattatttaatttgaa

SEQ ID NO: 1230991 - DNA, 22 bp, Artificial Sequence
  chemically synthesized
cagtatattatttaatttgaat

SEQ ID NO: 1230992 - DNA, 22 bp, Artificial Sequence
  chemically synthesized
agtatattatttaatttgaatt

SEQ ID NO: 1230993 - DNA, 22 bp, Artificial Sequence
  chemically synthesized
tttaatttgaatttttgtaatt

SEQ ID NO: 1230994 - DNA, 22 bp, Artificial Sequence
  chemically synthesized
aatttgaatttttgtaattacg

SEQ ID NO: 1230995 - DNA, 22 bp, Artificial Sequence
  chemically synthesized
atttgaatttttgtaattacgt

SEQ ID NO: 1230996 - DNA, 22 bp, Artificial Sequence
  chemically synthesized
ccagataaaagatacgtaatta

SEQ ID NO: 1230997 - DNA, 22 bp, Artificial Sequence
  chemically synthesized
gaatttttgtaattacgtatct

SEQ ID NO: 1230998 - DNA, 22 bp, Artificial Sequence
  chemically synthesized
aatttttgtaattacgtatctt

SEQ ID NO: 1230999 - DNA, 22 bp, Artificial Sequence
  chemically synthesized
tattgccagataaaagatacgt

SEQ ID NO: 1231000 - DNA, 22 bp, Artificial Sequence
  chemically synthesized
ttgtaattacgtatcttttatc

SEQ ID NO: 1231001 - DNA, 22 bp, Artificial Sequence
  chemically synthesized
tgtaattacgtatcttttatct

SEQ ID NO: 1231002 - DNA, 22 bp, Artificial Sequence
  chemically synthesized
gtaattacgtatcttttatctg

SEQ ID NO: 1231003 - DNA, 22 bp, Artificial Sequence
  chemically synthesized
taattacgtatcttttatctgg

SEQ ID NO: 1231004 - DNA, 22 bp, Artificial Sequence
  chemically synthesized
catcctatattgccagataaaa

SEQ ID NO: 1231005 - DNA, 22 bp, Artificial Sequence
  chemically synthesized
cgtatcttttatctggcaatat

SEQ ID NO: 1231006 - DNA, 22 bp, Artificial Sequence
  chemically synthesized
aagttacatcctatattgccag

SEQ ID NO: 1231007 - DNA, 22 bp, Artificial Sequence
  chemically synthesized
tcgttaaagttacatcctatat

SEQ ID NO: 1231008 - DNA, 22 bp, Artificial Sequence
  chemically synthesized
gtcgttaaagttacatcctata

SEQ ID NO: 1231009 - DNA, 22 bp, Artificial Sequence
  chemically synthesized
ttatctggcaatataggatgta

SEQ ID NO: 1231010 - DNA, 22 bp, Artificial Sequence
  chemically synthesized
tgtcgttaaagttacatcctat

SEQ ID NO: 1231011 - DNA, 22 bp, Artificial Sequence
  chemically synthesized
tatctggcaatataggatgtaa

SEQ ID NO: 1231012 - DNA, 22 bp, Artificial Sequence
  chemically synthesized
ttgtcgttaaagttacatccta

SEQ ID NO: 1231013 - DNA, 22 bp, Artificial Sequence
  chemically synthesized
atctggcaatataggatgtaac

SEQ ID NO: 1231014 - DNA, 22 bp, Artificial Sequence
  chemically synthesized
tctggcaatataggatgtaact

SEQ ID NO: 1231015 - DNA, 22 bp, Artificial Sequence
  chemically synthesized
atttttgtcgttaaagttacat

SEQ ID NO: 1231016 - DNA, 22 bp, Artificial Sequence
  chemically synthesized
gcaatataggatgtaactttaa

SEQ ID NO: 1231017 - DNA, 22 bp, Artificial Sequence
  chemically synthesized
tatgggttgatttttgtcgtta

SEQ ID NO: 1231018 - DNA, 22 bp, Artificial Sequence
  chemically synthesized
gggctatatgggttgatttttg

SEQ ID NO: 1231019 - DNA, 22 bp, Artificial Sequence
  chemically synthesized
taacgacaaaaatcaacccata

SEQ ID NO: 1231020 - DNA, 22 bp, Artificial Sequence
  chemically synthesized
aacgacaaaaatcaacccatat

SEQ ID NO: 1231021 - DNA, 22 bp, Artificial Sequence
  chemically synthesized
acgacaaaaatcaacccatata

SEQ ID NO: 1231022 - DNA, 22 bp, Artificial Sequence
  chemically synthesized
aaaagttggggctatatgggtt

SEQ ID NO: 1231023 - DNA, 22 bp, Artificial Sequence
  chemically synthesized
aaaaagttggggctatatgggt

SEQ ID NO: 1231024 - DNA, 22 bp, Artificial Sequence
  chemically synthesized
agcttaaaaagttggggctata

SEQ ID NO: 1231025 - DNA, 22 bp, Artificial Sequence
  chemically synthesized
gagcttaaaaagttggggctat

SEQ ID NO: 1231026 - DNA, 22 bp, Artificial Sequence
  chemically synthesized
gtatacgtgacttgagcttaaa

SEQ ID NO: 1231027 - DNA, 22 bp, Artificial Sequence
  chemically synthesized
aaattagtatacgtgacttgag

SEQ ID NO: 1231028 - DNA, 22 bp, Artificial Sequence
  chemically synthesized
gaaattagtatacgtgacttga

SEQ ID NO: 1231029 - DNA, 22 bp, Artificial Sequence
  chemically synthesized
cttgaaattagtatacgtgact

SEQ ID NO: 1231030 - DNA, 22 bp, Artificial Sequence
  chemically synthesized
acttgaaattagtatacgtgac

SEQ ID NO: 1231031 - DNA, 22 bp, Artificial Sequence
  chemically synthesized
tttaagctcaagtcacgtatac

SEQ ID NO: 1231032 - DNA, 22 bp, Artificial Sequence
  chemically synthesized
tacttgaaattagtatacgtga

SEQ ID NO: 1231033 - DNA, 22 bp, Artificial Sequence
  chemically synthesized
ttaagctcaagtcacgtatact

SEQ ID NO: 1231034 - DNA, 22 bp, Artificial Sequence
  chemically synthesized
ttacttgaaattagtatacgtg

SEQ ID NO: 1231035 - DNA, 22 bp, Artificial Sequence
  chemically synthesized
taagctcaagtcacgtatacta

SEQ ID NO: 1231036 - DNA, 22 bp, Artificial Sequence
  chemically synthesized
tttacttgaaattagtatacgt

SEQ ID NO: 1231037 - DNA, 22 bp, Artificial Sequence
  chemically synthesized
aagctcaagtcacgtatactaa

SEQ ID NO: 1231038 - DNA, 22 bp, Artificial Sequence
  chemically synthesized
ttttacttgaaattagtatacg

SEQ ID NO: 1231039 - DNA, 22 bp, Artificial Sequence
  chemically synthesized
agctcaagtcacgtatactaat

SEQ ID NO: 1231040 - DNA, 22 bp, Artificial Sequence
  chemically synthesized
tttttacttgaaattagtatac

SEQ ID NO: 1231041 - DNA, 22 bp, Artificial Sequence
  chemically synthesized
ttttttacttgaaattagtata

SEQ ID NO: 1231042 - DNA, 22 bp, Artificial Sequence
  chemically synthesized
tttttttacttgaaattagtat

SEQ ID NO: 1231043 - DNA, 22 bp, Artificial Sequence
  chemically synthesized
ttttttttacttgaaattagta

SEQ ID NO: 1231044 - DNA, 22 bp, Artificial Sequence
  chemically synthesized
tttttttttacttgaaattagt

SEQ ID NO: 1231045 - DNA, 22 bp, Artificial Sequence
  chemically synthesized
aagtcacgtatactaatttcaa

SEQ ID NO: 1231046 - DNA, 22 bp, Artificial Sequence
  chemically synthesized
ttttttttttacttgaaattag

SEQ ID NO: 1231047 - DNA, 22 bp, Artificial Sequence
  chemically synthesized
tttttttttttacttgaaatta

SEQ ID NO: 1231048 - DNA, 22 bp, Artificial Sequence
  chemically synthesized
ttttttttttttacttgaaatt

SEQ ID NO: 1231049 - DNA, 22 bp, Artificial Sequence
  chemically synthesized
tttttttttttttacttgaaat

SEQ ID NO: 1231050 - DNA, 22 bp, Artificial Sequence
  chemically synthesized
ttttttttttttttacttgaaa

SEQ ID NO: 1231051 - DNA, 22 bp, Artificial Sequence
  chemically synthesized
tttttttttttttttacttgaa

SEQ ID NO: 1231052 - DNA, 22 bp, Artificial Sequence
  chemically synthesized
ttttttttttttttttacttga

SEQ ID NO: 1231053 - DNA, 22 bp, Artificial Sequence
  chemically synthesized
cttttttttttttttttttact

SEQ ID NO: 1231054 - DNA, 22 bp, Artificial Sequence
  chemically synthesized
ttgctttttttttttttttttt

SEQ ID NO: 1231055 - DNA, 22 bp, Artificial Sequence
  chemically synthesized
atttcaagtaaaaaaaaaaaaa

SEQ ID NO: 1231056 - DNA, 22 bp, Artificial Sequence
  chemically synthesized
tagctattgctttttttttttt

SEQ ID NO: 1231057 - DNA, 22 bp, Artificial Sequence
  chemically synthesized
caagtaaaaaaaaaaaaaaaaa

SEQ ID NO: 1231058 - DNA, 22 bp, Artificial Sequence
  chemically synthesized
aagtaaaaaaaaaaaaaaaaaa

SEQ ID NO: 1231059 - DNA, 22 bp, Artificial Sequence
  chemically synthesized
ttgtagctattgcttttttttt

SEQ ID NO: 1231060 - DNA, 22 bp, Artificial Sequence
  chemically synthesized
attgtagctattgctttttttt

SEQ ID NO: 1231061 - DNA, 22 bp, Artificial Sequence
  chemically synthesized
tattgtagctattgcttttttt

SEQ ID NO: 1231062 - DNA, 22 bp, Artificial Sequence
  chemically synthesized
ttattgtagctattgctttttt

SEQ ID NO: 1231063 - DNA, 22 bp, Artificial Sequence
  chemically synthesized
agatttttattgtagctattgc

SEQ ID NO: 1231064 - DNA, 22 bp, Artificial Sequence
  chemically synthesized
aagatttttattgtagctattg

SEQ ID NO: 1231065 - DNA, 22 bp, Artificial Sequence
  chemically synthesized
taagatttttattgtagctatt

SEQ ID NO: 1231066 - DNA, 22 bp, Artificial Sequence
  chemically synthesized
ttaagatttttattgtagctat

SEQ ID NO: 1231067 - DNA, 22 bp, Artificial Sequence
  chemically synthesized
aagtatcttttaagatttttat

SEQ ID NO: 1231068 - DNA, 22 bp, Artificial Sequence
  chemically synthesized
caataaaaatcttaaaagatac

SEQ ID NO: 1231069 - DNA, 22 bp, Artificial Sequence
  chemically synthesized
taatgtcactcaagtatctttt

SEQ ID NO: 1231070 - DNA, 22 bp, Artificial Sequence
  chemically synthesized
ataatgtcactcaagtatcttt

SEQ ID NO: 1231071 - DNA, 22 bp, Artificial Sequence
  chemically synthesized
ttataatgtcactcaagtatct

SEQ ID NO: 1231072 - DNA, 22 bp, Artificial Sequence
  chemically synthesized
cttataatgtcactcaagtatc

SEQ ID NO: 1231073 - DNA, 22 bp, Artificial Sequence
  chemically synthesized
aaaagatacttgagtgacatta

SEQ ID NO: 1231074 - DNA, 22 bp, Artificial Sequence
  chemically synthesized
aaagatacttgagtgacattat

SEQ ID NO: 1231075 - DNA, 22 bp, Artificial Sequence
  chemically synthesized
aaaatatttcttataatgtcac

SEQ ID NO: 1231076 - DNA, 22 bp, Artificial Sequence
  chemically synthesized
aaaaatatttcttataatgtca

SEQ ID NO: 1231077 - DNA, 22 bp, Artificial Sequence
  chemically synthesized
tttaaaaatatttcttataatg

SEQ ID NO: 1231078 - DNA, 22 bp, Artificial Sequence
  chemically synthesized
gagtgacattataagaaatatt

SEQ ID NO: 1231079 - DNA, 22 bp, Artificial Sequence
  chemically synthesized
agtgacattataagaaatattt

SEQ ID NO: 1231080 - DNA, 22 bp, Artificial Sequence
  chemically synthesized
taaatagtactgtttaaaaata

SEQ ID NO: 1231081 - DNA, 22 bp, Artificial Sequence
  chemically synthesized
taagaaatatttttaaacagta

SEQ ID NO: 1231082 - DNA, 22 bp, Artificial Sequence
  chemically synthesized
tataactataaatagtactgtt

SEQ ID NO: 1231083 - DNA, 22 bp, Artificial Sequence
  chemically synthesized
ttaaacagtactatttatagtt

SEQ ID NO: 1231084 - DNA, 22 bp, Artificial Sequence
  chemically synthesized
taaacagtactatttatagtta

SEQ ID NO: 1231085 - DNA, 22 bp, Artificial Sequence
  chemically synthesized
aaacagtactatttatagttat

SEQ ID NO: 1231086 - DNA, 22 bp, Artificial Sequence
  chemically synthesized
aacagtactatttatagttata

SEQ ID NO: 1231087 - DNA, 22 bp, Artificial Sequence
  chemically synthesized
ggataataattatataactata

SEQ ID NO: 1231088 - DNA, 22 bp, Artificial Sequence
  chemically synthesized
ctgggataataattatataact

SEQ ID NO: 1231089 - DNA, 22 bp, Artificial Sequence
  chemically synthesized
tttatagttatataattattat

SEQ ID NO: 1231090 - DNA, 22 bp, Artificial Sequence
  chemically synthesized
atagttatataattattatccc

SEQ ID NO: 1231091 - DNA, 22 bp, Artificial Sequence
  chemically synthesized
tagttatataattattatccca

SEQ ID NO: 1231092 - DNA, 22 bp, Artificial Sequence
  chemically synthesized
acatatggaggtctgctgggat

SEQ ID NO: 1231093 - DNA, 22 bp, Artificial Sequence
  chemically synthesized
tataattattatcccagcagac

SEQ ID NO: 1231094 - DNA, 22 bp, Artificial Sequence
  chemically synthesized
tgttcacatatggaggtctgct

SEQ ID NO: 1231095 - DNA, 22 bp, Artificial Sequence
  chemically synthesized
ttatgttcacatatggaggtct

SEQ ID NO: 1231096 - DNA, 22 bp, Artificial Sequence
  chemically synthesized
ttatcccagcagacctccatat

SEQ ID NO: 1231097 - DNA, 22 bp, Artificial Sequence
  chemically synthesized
cctattatgttcacatatggag

SEQ ID NO: 1231098 - DNA, 22 bp, Artificial Sequence
  chemically synthesized
tcccagcagacctccatatgtg

SEQ ID NO: 1231099 - DNA, 22 bp, Artificial Sequence
  chemically synthesized
agatagccagttacctattatg

SEQ ID NO: 1231100 - DNA, 22 bp, Artificial Sequence
  chemically synthesized
catatgtgaacataataggtaa

SEQ ID NO: 1231101 - DNA, 22 bp, Artificial Sequence
  chemically synthesized
aaattgagatagccagttacct

SEQ ID NO: 1231102 - DNA, 22 bp, Artificial Sequence
  chemically synthesized
caaattgagatagccagttacc

SEQ ID NO: 1231103 - DNA, 22 bp, Artificial Sequence
  chemically synthesized
aacttcaaattgagatagccag

SEQ ID NO: 1231104 - DNA, 22 bp, Artificial Sequence
  chemically synthesized
tatattcaacttcaaattgaga

SEQ ID NO: 1231105 - DNA, 22 bp, Artificial Sequence
  chemically synthesized
gtatattcaacttcaaattgag

SEQ ID NO: 1231106 - DNA, 22 bp, Artificial Sequence
  chemically synthesized
ttgtatattcaacttcaaattg

SEQ ID NO: 1231107 - DNA, 22 bp, Artificial Sequence
  chemically synthesized
cttgtatattcaacttcaaatt

SEQ ID NO: 1231108 - DNA, 22 bp, Artificial Sequence
  chemically synthesized
gctatctcaatttgaagttgaa

SEQ ID NO: 1231109 - DNA, 22 bp, Artificial Sequence
  chemically synthesized
tctcaatttgaagttgaatata

SEQ ID NO: 1231110 - DNA, 22 bp, Artificial Sequence
  chemically synthesized
acacatttcttgtatattcaac

SEQ ID NO: 1231111 - DNA, 22 bp, Artificial Sequence
  chemically synthesized
aatttgaagttgaatatacaag

SEQ ID NO: 1231112 - DNA, 22 bp, Artificial Sequence
  chemically synthesized
gtattgacacatttcttgtata

SEQ ID NO: 1231113 - DNA, 22 bp, Artificial Sequence
  chemically synthesized
gaagttgaatatacaagaaatg

SEQ ID NO: 1231114 - DNA, 22 bp, Artificial Sequence
  chemically synthesized
aagttgaatatacaagaaatgt

SEQ ID NO: 1231115 - DNA, 22 bp, Artificial Sequence
  chemically synthesized
aatatacaagaaatgtgtcaat

SEQ ID NO: 1231116 - DNA, 22 bp, Artificial Sequence
  chemically synthesized
agggaaattagtattgacacat

SEQ ID NO: 1231117 - DNA, 22 bp, Artificial Sequence
  chemically synthesized
aagggaaattagtattgacaca

SEQ ID NO: 1231118 - DNA, 22 bp, Artificial Sequence
  chemically synthesized
taagggaaattagtattgacac

SEQ ID NO: 1231119 - DNA, 22 bp, Artificial Sequence
  chemically synthesized
ctttaagggaaattagtattga

SEQ ID NO: 1231120 - DNA, 22 bp, Artificial Sequence
  chemically synthesized
gctttaagggaaattagtattg

SEQ ID NO: 1231121 - DNA, 22 bp, Artificial Sequence
  chemically synthesized
ttgctttaagggaaattagtat

SEQ ID NO: 1231122 - DNA, 22 bp, Artificial Sequence
  chemically synthesized
gtatacctcttgctttaaggga

SEQ ID NO: 1231123 - DNA, 22 bp, Artificial Sequence
  chemically synthesized
agtatacctcttgctttaaggg

SEQ ID NO: 1231124 - DNA, 22 bp, Artificial Sequence
  chemically synthesized
atttcccttaaagcaagaggta

SEQ ID NO: 1231125 - DNA, 22 bp, Artificial Sequence
  chemically synthesized
ccatcccccttagtatacctct

SEQ ID NO: 1231126 - DNA, 22 bp, Artificial Sequence
  chemically synthesized
cccttaaagcaagaggtatact

SEQ ID NO: 1231127 - DNA, 22 bp, Artificial Sequence
  chemically synthesized
cccatcccccttagtatacctc

SEQ ID NO: 1231128 - DNA, 22 bp, Artificial Sequence
  chemically synthesized
ccttaaagcaagaggtatacta

SEQ ID NO: 1231129 - DNA, 22 bp, Artificial Sequence
  chemically synthesized
ttcccatcccccttagtatacc

SEQ ID NO: 1231130 - DNA, 22 bp, Artificial Sequence
  chemically synthesized
aaagcaagaggtatactaaggg

SEQ ID NO: 1231131 - DNA, 22 bp, Artificial Sequence
  chemically synthesized
ttcttcccatcccccttagtat

SEQ ID NO: 1231132 - DNA, 22 bp, Artificial Sequence
  chemically synthesized
aagcaagaggtatactaagggg

SEQ ID NO: 1231133 - DNA, 22 bp, Artificial Sequence
  chemically synthesized
attcttcccatcccccttagta

SEQ ID NO: 1231134 - DNA, 22 bp, Artificial Sequence
  chemically synthesized
tttattcttcccatccccctta

SEQ ID NO: 1231135 - DNA, 22 bp, Artificial Sequence
  chemically synthesized
ggtgagttgtttattcttccca

SEQ ID NO: 1231136 - DNA, 22 bp, Artificial Sequence
  chemically synthesized
tgggtgagttgtttattcttcc

SEQ ID NO: 1231137 - DNA, 22 bp, Artificial Sequence
  chemically synthesized
ctgggtgagttgtttattcttc

SEQ ID NO: 1231138 - DNA, 22 bp, Artificial Sequence
  chemically synthesized
tctgggtgagttgtttattctt

SEQ ID NO: 1231139 - DNA, 22 bp, Artificial Sequence
  chemically synthesized
agggggatgggaagaataaaca

SEQ ID NO: 1231140 - DNA, 22 bp, Artificial Sequence
  chemically synthesized
aaataattttctgggtgagttg

SEQ ID NO: 1231141 - DNA, 22 bp, Artificial Sequence
  chemically synthesized
aaaataattttctgggtgagtt

SEQ ID NO: 1231142 - DNA, 22 bp, Artificial Sequence
  chemically synthesized
atttaaaataattttctgggtg

SEQ ID NO: 1231143 - DNA, 22 bp, Artificial Sequence
  chemically synthesized
tcatttaaaataattttctggg

SEQ ID NO: 1231144 - DNA, 22 bp, Artificial Sequence
  chemically synthesized
cagcatgttctcatttaaaata

SEQ ID NO: 1231145 - DNA, 22 bp, Artificial Sequence
  chemically synthesized
acccagaaaattattttaaatg

SEQ ID NO: 1231146 - DNA, 22 bp, Artificial Sequence
  chemically synthesized
aattgcagcatgttctcattta

SEQ ID NO: 1231147 - DNA, 22 bp, Artificial Sequence
  chemically synthesized
aaattgcagcatgttctcattt

SEQ ID NO: 1231148 - DNA, 22 bp, Artificial Sequence
  chemically synthesized
ttaaattgcagcatgttctcat

SEQ ID NO: 1231149 - DNA, 22 bp, Artificial Sequence
  chemically synthesized
ctcttaaattgcagcatgttct

SEQ ID NO: 1231150 - DNA, 22 bp, Artificial Sequence
  chemically synthesized
ttttaaatgagaacatgctgca

SEQ ID NO: 1231151 - DNA, 22 bp, Artificial Sequence
  chemically synthesized
taaatgagaacatgctgcaatt

SEQ ID NO: 1231152 - DNA, 22 bp, Artificial Sequence
  chemically synthesized
aaatgagaacatgctgcaattt

SEQ ID NO: 1231153 - DNA, 22 bp, Artificial Sequence
  chemically synthesized
aatgagaacatgctgcaattta

SEQ ID NO: 1231154 - DNA, 22 bp, Artificial Sequence
  chemically synthesized
caaggtaatataactactctta

SEQ ID NO: 1231155 - DNA, 22 bp, Artificial Sequence
  chemically synthesized
agttgcaaggtaatataactac

SEQ ID NO: 1231156 - DNA, 22 bp, Artificial Sequence
  chemically synthesized
caatttaagagtagttatatta

SEQ ID NO: 1231157 - DNA, 22 bp, Artificial Sequence
  chemically synthesized
acattcagttgcaaggtaatat

SEQ ID NO: 1231158 - DNA, 22 bp, Artificial Sequence
  chemically synthesized
aagagtagttatattaccttgc

SEQ ID NO: 1231159 - DNA, 22 bp, Artificial Sequence
  chemically synthesized
agagtagttatattaccttgca

SEQ ID NO: 1231160 - DNA, 22 bp, Artificial Sequence
  chemically synthesized
aactcacattcagttgcaaggt

SEQ ID NO: 1231161 - DNA, 22 bp, Artificial Sequence
  chemically synthesized
attaaactcacattcagttgca

SEQ ID NO: 1231162 - DNA, 22 bp, Artificial Sequence
  chemically synthesized
tattaccttgcaactgaatgtg

SEQ ID NO: 1231163 - DNA, 22 bp, Artificial Sequence
  chemically synthesized
gtattcattaaactcacattca

SEQ ID NO: 1231164 - DNA, 22 bp, Artificial Sequence
  chemically synthesized
ccttgcaactgaatgtgagttt

SEQ ID NO: 1231165 - DNA, 22 bp, Artificial Sequence
  chemically synthesized
gcaactgaatgtgagtttaatg

SEQ ID NO: 1231166 - DNA, 22 bp, Artificial Sequence
  chemically synthesized
caactgaatgtgagtttaatga

SEQ ID NO: 1231167 - DNA, 22 bp, Artificial Sequence
  chemically synthesized
aatgtgagtttaatgaatacga

SEQ ID NO: 1231168 - DNA, 22 bp, Artificial Sequence
  chemically synthesized
aatgaatacgagattatgtttg

SEQ ID NO: 1231169 - DNA, 22 bp, Artificial Sequence
  chemically synthesized
atgaatacgagattatgtttgt

SEQ ID NO: 1231170 - DNA, 22 bp, Artificial Sequence
  chemically synthesized
tggaagatacaaatatacaaac

SEQ ID NO: 1231171 - DNA, 22 bp, Artificial Sequence
  chemically synthesized
ttatggaagatacaaatataca

SEQ ID NO: 1231172 - DNA, 22 bp, Artificial Sequence
  chemically synthesized
gttatggaagatacaaatatac

SEQ ID NO: 1231173 - DNA, 22 bp, Artificial Sequence
  chemically synthesized
tgtttgtatatttgtatcttcc

SEQ ID NO: 1231174 - DNA, 22 bp, Artificial Sequence
  chemically synthesized
aaaatacttgttatggaagata

SEQ ID NO: 1231175 - DNA, 22 bp, Artificial Sequence
  chemically synthesized
caaaatacttgttatggaagat

SEQ ID NO: 1231176 - DNA, 22 bp, Artificial Sequence
  chemically synthesized
tcaaaatacttgttatggaaga

SEQ ID NO: 1231177 - DNA, 22 bp, Artificial Sequence
  chemically synthesized
gtatatttgtatcttccataac

SEQ ID NO: 1231178 - DNA, 22 bp, Artificial Sequence
  chemically synthesized
tatatttgtatcttccataaca

SEQ ID NO: 1231179 - DNA, 22 bp, Artificial Sequence
  chemically synthesized
tttcaaaatacttgttatggaa

SEQ ID NO: 1231180 - DNA, 22 bp, Artificial Sequence
  chemically synthesized
ctttcaaaatacttgttatgga

SEQ ID NO: 1231181 - DNA, 22 bp, Artificial Sequence
  chemically synthesized
acttctttcaaaatacttgtta

SEQ ID NO: 1231182 - DNA, 22 bp, Artificial Sequence
  chemically synthesized
gtatcttccataacaagtattt

SEQ ID NO: 1231183 - DNA, 22 bp, Artificial Sequence
  chemically synthesized
tatcttccataacaagtatttt

SEQ ID NO: 1231184 - DNA, 22 bp, Artificial Sequence
  chemically synthesized
ccataacaagtattttgaaaga

SEQ ID NO: 1231185 - DNA, 22 bp, Artificial Sequence
  chemically synthesized
cataacaagtattttgaaagaa

SEQ ID NO: 1231186 - DNA, 22 bp, Artificial Sequence
  chemically synthesized
atagtaaatgttcacttctttc

SEQ ID NO: 1231187 - DNA, 22 bp, Artificial Sequence
  chemically synthesized
tgaaagaagtgaacatttacta

SEQ ID NO: 1231188 - DNA, 22 bp, Artificial Sequence
  chemically synthesized
gaaagaagtgaacatttactat

SEQ ID NO: 1231189 - DNA, 22 bp, Artificial Sequence
  chemically synthesized
cgaaatgcattaatagtaaatg

SEQ ID NO: 1231190 - DNA, 22 bp, Artificial Sequence
  chemically synthesized
aaagaagtgaacatttactatt

SEQ ID NO: 1231191 - DNA, 22 bp, Artificial Sequence
  chemically synthesized
tcatctgcgaaatgcattaata

SEQ ID NO: 1231192 - DNA, 22 bp, Artificial Sequence
  chemically synthesized
atcatctgcgaaatgcattaat

SEQ ID NO: 1231193 - DNA, 22 bp, Artificial Sequence
  chemically synthesized
tatcatctgcgaaatgcattaa

SEQ ID NO: 1231194 - DNA, 22 bp, Artificial Sequence
  chemically synthesized
actttatcatctgcgaaatgca

SEQ ID NO: 1231195 - DNA, 22 bp, Artificial Sequence
  chemically synthesized
actattaatgcatttcgcagat

SEQ ID NO: 1231196 - DNA, 22 bp, Artificial Sequence
  chemically synthesized
actcactttatcatctgcgaaa

SEQ ID NO: 1231197 - DNA, 22 bp, Artificial Sequence
  chemically synthesized
ctattaatgcatttcgcagatg

SEQ ID NO: 1231198 - DNA, 22 bp, Artificial Sequence
  chemically synthesized
gactcactttatcatctgcgaa

SEQ ID NO: 1231199 - DNA, 22 bp, Artificial Sequence
  chemically synthesized
tgactcactttatcatctgcga

SEQ ID NO: 1231200 - DNA, 22 bp, Artificial Sequence
  chemically synthesized
ttaatgcatttcgcagatgata

SEQ ID NO: 1231201 - DNA, 22 bp, Artificial Sequence
  chemically synthesized
atgcatttcgcagatgataaag

SEQ ID NO: 1231202 - DNA, 22 bp, Artificial Sequence
  chemically synthesized
cgtgactttgactcactttatc

SEQ ID NO: 1231203 - DNA, 22 bp, Artificial Sequence
  chemically synthesized
cgcagatgataaagtgagtcaa

SEQ ID NO: 1231204 - DNA, 22 bp, Artificial Sequence
  chemically synthesized
gcagatgataaagtgagtcaaa

SEQ ID NO: 1231205 - DNA, 22 bp, Artificial Sequence
  chemically synthesized
ccaaatgattccgtgactttga

SEQ ID NO: 1231206 - DNA, 22 bp, Artificial Sequence
  chemically synthesized
gccaaatgattccgtgactttg

SEQ ID NO: 1231207 - DNA, 22 bp, Artificial Sequence
  chemically synthesized
tgccaaatgattccgtgacttt

SEQ ID NO: 1231208 - DNA, 22 bp, Artificial Sequence
  chemically synthesized
tagggtctttgccaaatgattc

SEQ ID NO: 1231209 - DNA, 22 bp, Artificial Sequence
  chemically synthesized
tcaactatagggtctttgccaa

SEQ ID NO: 1231210 - DNA, 22 bp, Artificial Sequence
  chemically synthesized
atcaactatagggtctttgcca

SEQ ID NO: 1231211 - DNA, 22 bp, Artificial Sequence
  chemically synthesized
taacttatcaactatagggtct

SEQ ID NO: 1231212 - DNA, 22 bp, Artificial Sequence
  chemically synthesized
tgtaacttatcaactatagggt

SEQ ID NO: 1231213 - DNA, 22 bp, Artificial Sequence
  chemically synthesized
actctgtaacttatcaactata

SEQ ID NO: 1231214 - DNA, 22 bp, Artificial Sequence
  chemically synthesized
ggcaaagaccctatagttgata

SEQ ID NO: 1231215 - DNA, 22 bp, Artificial Sequence
  chemically synthesized
gcaaagaccctatagttgataa

SEQ ID NO: 1231216 - DNA, 22 bp, Artificial Sequence
  chemically synthesized
ttaactctgtaacttatcaact

SEQ ID NO: 1231217 - DNA, 22 bp, Artificial Sequence
  chemically synthesized
gttaactctgtaacttatcaac

SEQ ID NO: 1231218 - DNA, 22 bp, Artificial Sequence
  chemically synthesized
tagttgataagttacagagtta

SEQ ID NO: 1231219 - DNA, 22 bp, Artificial Sequence
  chemically synthesized
ataagttacagagttaacaaga

SEQ ID NO: 1231220 - DNA, 22 bp, Artificial Sequence
  chemically synthesized
cagaagaggtagatcttgttaa

SEQ ID NO: 1231221 - DNA, 22 bp, Artificial Sequence
  chemically synthesized
gcagaagaggtagatcttgtta

SEQ ID NO: 1231222 - DNA, 22 bp, Artificial Sequence
  chemically synthesized
cagagttaacaagatctacctc

SEQ ID NO: 1231223 - DNA, 22 bp, Artificial Sequence
  chemically synthesized
aagtttgcagaagaggtagatc

SEQ ID NO: 1231224 - DNA, 22 bp, Artificial Sequence
  chemically synthesized
tcaagtttgcagaagaggtaga

SEQ ID NO: 1231225 - DNA, 22 bp, Artificial Sequence
  chemically synthesized
attctcaagtttgcagaagagg

SEQ ID NO: 1231226 - DNA, 22 bp, Artificial Sequence
  chemically synthesized
acaagatctacctcttctgcaa

SEQ ID NO: 1231227 - DNA, 22 bp, Artificial Sequence
  chemically synthesized
tatgtattaattctcaagtttg

SEQ ID NO: 1231228 - DNA, 22 bp, Artificial Sequence
  chemically synthesized
atatgtattaattctcaagttt

SEQ ID NO: 1231229 - DNA, 22 bp, Artificial Sequence
  chemically synthesized
tatatgtattaattctcaagtt

SEQ ID NO: 1231230 - DNA, 22 bp, Artificial Sequence
  chemically synthesized
cctcttctgcaaacttgagaat

SEQ ID NO: 1231231 - DNA, 22 bp, Artificial Sequence
  chemically synthesized
ttctgcaaacttgagaattaat

SEQ ID NO: 1231232 - DNA, 22 bp, Artificial Sequence
  chemically synthesized
cactttatatgtattaattctc

SEQ ID NO: 1231233 - DNA, 22 bp, Artificial Sequence
  chemically synthesized
gcactttatatgtattaattct

SEQ ID NO: 1231234 - DNA, 22 bp, Artificial Sequence
  chemically synthesized
ctgcaaacttgagaattaatac

SEQ ID NO: 1231235 - DNA, 22 bp, Artificial Sequence
  chemically synthesized
tgcaaacttgagaattaataca

SEQ ID NO: 1231236 - DNA, 22 bp, Artificial Sequence
  chemically synthesized
caaacttgagaattaatacata

SEQ ID NO: 1231237 - DNA, 22 bp, Artificial Sequence
  chemically synthesized
taaaatatttgcactttatatg

SEQ ID NO: 1231238 - DNA, 22 bp, Artificial Sequence
  chemically synthesized
gagaattaatacatataaagtg

SEQ ID NO: 1231239 - DNA, 22 bp, Artificial Sequence
  chemically synthesized
agaattaatacatataaagtgc

SEQ ID NO: 1231240 - DNA, 22 bp, Artificial Sequence
  chemically synthesized
atacatataaagtgcaaatatt

SEQ ID NO: 1231241 - DNA, 22 bp, Artificial Sequence
  chemically synthesized
tcagtccacacaataggcctgt

SEQ ID NO: 1231242 - DNA, 22 bp, Artificial Sequence
  chemically synthesized
cacaaaattgtcagtccacaca

SEQ ID NO: 1231243 - DNA, 22 bp, Artificial Sequence
  chemically synthesized
tacaggcctattgtgtggactg

SEQ ID NO: 1231244 - DNA, 22 bp, Artificial Sequence
  chemically synthesized
acacaaaattgtcagtccacac

SEQ ID NO: 1231245 - DNA, 22 bp, Artificial Sequence
  chemically synthesized
acaggcctattgtgtggactga

SEQ ID NO: 1231246 - DNA, 22 bp, Artificial Sequence
  chemically synthesized
caggcctattgtgtggactgac

SEQ ID NO: 1231247 - DNA, 22 bp, Artificial Sequence
  chemically synthesized
ttacacaaaattgtcagtccac

SEQ ID NO: 1231248 - DNA, 22 bp, Artificial Sequence
  chemically synthesized
cttacacaaaattgtcagtcca

SEQ ID NO: 1231249 - DNA, 22 bp, Artificial Sequence
  chemically synthesized
ttgtgtggactgacaattttgt

SEQ ID NO: 1231250 - DNA, 22 bp, Artificial Sequence
  chemically synthesized
tgtggactgacaattttgtgta

SEQ ID NO: 1231251 - DNA, 22 bp, Artificial Sequence
  chemically synthesized
gacaagtatttcttacacaaaa

SEQ ID NO: 1231252 - DNA, 22 bp, Artificial Sequence
  chemically synthesized
ttagacaagtatttcttacaca

SEQ ID NO: 1231253 - DNA, 22 bp, Artificial Sequence
  chemically synthesized
gttagacaagtatttcttacac

SEQ ID NO: 1231254 - DNA, 22 bp, Artificial Sequence
  chemically synthesized
acaattttgtgtaagaaatact

SEQ ID NO: 1231255 - DNA, 22 bp, Artificial Sequence
  chemically synthesized
atttgttagacaagtatttctt

SEQ ID NO: 1231256 - DNA, 22 bp, Artificial Sequence
  chemically synthesized
aatttgttagacaagtatttct

SEQ ID NO: 1231257 - DNA, 22 bp, Artificial Sequence
  chemically synthesized
tgtgtaagaaatacttgtctaa

SEQ ID NO: 1231258 - DNA, 22 bp, Artificial Sequence
  chemically synthesized
gtgtaagaaatacttgtctaac

SEQ ID NO: 1231259 - DNA, 22 bp, Artificial Sequence
  chemically synthesized
caaatttaatttgttagacaag

SEQ ID NO: 1231260 - DNA, 22 bp, Artificial Sequence
  chemically synthesized
tgtaagaaatacttgtctaaca

SEQ ID NO: 1231261 - DNA, 22 bp, Artificial Sequence
  chemically synthesized
agtacaaattccaaatttaatt

SEQ ID NO: 1231262 - DNA, 22 bp, Artificial Sequence
  chemically synthesized
aagtacaaattccaaatttaat

SEQ ID NO: 1231263 - DNA, 22 bp, Artificial Sequence
  chemically synthesized
gtctaacaaattaaatttggaa

SEQ ID NO: 1231264 - DNA, 22 bp, Artificial Sequence
  chemically synthesized
tctaacaaattaaatttggaat

SEQ ID NO: 1231265 - DNA, 22 bp, Artificial Sequence
  chemically synthesized
gtatttaagtacaaattccaaa

SEQ ID NO: 1231266 - DNA, 22 bp, Artificial Sequence
  chemically synthesized
acaaattaaatttggaatttgt

SEQ ID NO: 1231267 - DNA, 22 bp, Artificial Sequence
  chemically synthesized
aatttggaatttgtacttaaat

SEQ ID NO: 1231268 - DNA, 22 bp, Artificial Sequence
  chemically synthesized
ataaaatctagtatttaagtac

SEQ ID NO: 1231269 - DNA, 22 bp, Artificial Sequence
  chemically synthesized
ctcataaaatctagtatttaag

SEQ ID NO: 1231270 - DNA, 22 bp, Artificial Sequence
  chemically synthesized
ggaatttgtacttaaatactag

SEQ ID NO: 1231271 - DNA, 22 bp, Artificial Sequence
  chemically synthesized
gaatttgtacttaaatactaga

SEQ ID NO: 1231272 - DNA, 22 bp, Artificial Sequence
  chemically synthesized
ttactcataaaatctagtattt

SEQ ID NO: 1231273 - DNA, 22 bp, Artificial Sequence
  chemically synthesized
attactcataaaatctagtatt

SEQ ID NO: 1231274 - DNA, 22 bp, Artificial Sequence
  chemically synthesized
tttattactcataaaatctagt

SEQ ID NO: 1231275 - DNA, 22 bp, Artificial Sequence
  chemically synthesized
gtacttaaatactagattttat

SEQ ID NO: 1231276 - DNA, 22 bp, Artificial Sequence
  chemically synthesized
tatttattactcataaaatcta

SEQ ID NO: 1231277 - DNA, 22 bp, Artificial Sequence
  chemically synthesized
tacttaaatactagattttatg

SEQ ID NO: 1231278 - DNA, 22 bp, Artificial Sequence
  chemically synthesized
ctatttattactcataaaatct

SEQ ID NO: 1231279 - DNA, 22 bp, Artificial Sequence
  chemically synthesized
cttctatttattactcataaaa

SEQ ID NO: 1231280 - DNA, 22 bp, Artificial Sequence
  chemically synthesized
aaatactagattttatgagtaa

SEQ ID NO: 1231281 - DNA, 22 bp, Artificial Sequence
  chemically synthesized
aatactagattttatgagtaat

SEQ ID NO: 1231282 - DNA, 22 bp, Artificial Sequence
  chemically synthesized
taaactacttctatttattact

SEQ ID NO: 1231283 - DNA, 22 bp, Artificial Sequence
  chemically synthesized
gattttatgagtaataaataga

SEQ ID NO: 1231284 - DNA, 22 bp, Artificial Sequence
  chemically synthesized
actataaactacttctatttat

SEQ ID NO: 1231285 - DNA, 22 bp, Artificial Sequence
  chemically synthesized
gactataaactacttctattta

SEQ ID NO: 1231286 - DNA, 22 bp, Artificial Sequence
  chemically synthesized
tatgagtaataaatagaagtag

SEQ ID NO: 1231287 - DNA, 22 bp, Artificial Sequence
  chemically synthesized
atgagtaataaatagaagtagt

SEQ ID NO: 1231288 - DNA, 22 bp, Artificial Sequence
  chemically synthesized
tgagtaataaatagaagtagtt

SEQ ID NO: 1231289 - DNA, 22 bp, Artificial Sequence
  chemically synthesized
gagcatgtcagaatatatttga

SEQ ID NO: 1231290 - DNA, 22 bp, Artificial Sequence
  chemically synthesized
ggagcatgtcagaatatatttg

SEQ ID NO: 1231291 - DNA, 22 bp, Artificial Sequence
  chemically synthesized
tggagcatgtcagaatatattt

SEQ ID NO: 1231292 - DNA, 22 bp, Artificial Sequence
  chemically synthesized
atagtcaaatatattctgacat

SEQ ID NO: 1231293 - DNA, 22 bp, Artificial Sequence
  chemically synthesized
tagtcaaatatattctgacatg

SEQ ID NO: 1231294 - DNA, 22 bp, Artificial Sequence
  chemically synthesized
tgacatgctccaaaatatgtat

SEQ ID NO: 1231295 - DNA, 22 bp, Artificial Sequence
  chemically synthesized
aatagccatataatacatattt

SEQ ID NO: 1231296 - DNA, 22 bp, Artificial Sequence
  chemically synthesized
aaatagccatataatacatatt

SEQ ID NO: 1231297 - DNA, 22 bp, Artificial Sequence
  chemically synthesized
acatgctccaaaatatgtatta

SEQ ID NO: 1231298 - DNA, 22 bp, Artificial Sequence
  chemically synthesized
agaaacttaaatagccatataa

SEQ ID NO: 1231299 - DNA, 22 bp, Artificial Sequence
  chemically synthesized
caaaatatgtattatatggcta

SEQ ID NO: 1231300 - DNA, 22 bp, Artificial Sequence
  chemically synthesized
agtattcagaaacttaaatagc

SEQ ID NO: 1231301 - DNA, 22 bp, Artificial Sequence
  chemically synthesized
aagtattcagaaacttaaatag

SEQ ID NO: 1231302 - DNA, 22 bp, Artificial Sequence
  chemically synthesized
taagtattcagaaacttaaata

SEQ ID NO: 1231303 - DNA, 22 bp, Artificial Sequence
  chemically synthesized
tatggctatttaagtttctgaa

SEQ ID NO: 1231304 - DNA, 22 bp, Artificial Sequence
  chemically synthesized
tgtgtcctttaagtattcagaa

SEQ ID NO: 1231305 - DNA, 22 bp, Artificial Sequence
  chemically synthesized
atgtgtcctttaagtattcaga

SEQ ID NO: 1231306 - DNA, 22 bp, Artificial Sequence
  chemically synthesized
tatgtgtcctttaagtattcag

SEQ ID NO: 1231307 - DNA, 22 bp, Artificial Sequence
  chemically synthesized
tttaagtttctgaatacttaaa

SEQ ID NO: 1231308 - DNA, 22 bp, Artificial Sequence
  chemically synthesized
aagtttctgaatacttaaagga

SEQ ID NO: 1231309 - DNA, 22 bp, Artificial Sequence
  chemically synthesized
gtattttatgtgtcctttaagt

SEQ ID NO: 1231310 - DNA, 22 bp, Artificial Sequence
  chemically synthesized
agtttctgaatacttaaaggac

SEQ ID NO: 1231311 - DNA, 22 bp, Artificial Sequence
  chemically synthesized
ctgaatacttaaaggacacata

SEQ ID NO: 1231312 - DNA, 22 bp, Artificial Sequence
  chemically synthesized
aaactagtattttatgtgtcct

SEQ ID NO: 1231313 - DNA, 22 bp, Artificial Sequence
  chemically synthesized
tgaatacttaaaggacacataa

SEQ ID NO: 1231314 - DNA, 22 bp, Artificial Sequence
  chemically synthesized
aaaactagtattttatgtgtcc

SEQ ID NO: 1231315 - DNA, 22 bp, Artificial Sequence
  chemically synthesized
taaaactagtattttatgtgtc

SEQ ID NO: 1231316 - DNA, 22 bp, Artificial Sequence
  chemically synthesized
aatacttaaaggacacataaaa

SEQ ID NO: 1231317 - DNA, 22 bp, Artificial Sequence
  chemically synthesized
tttaaaactagtattttatgtg

SEQ ID NO: 1231318 - DNA, 22 bp, Artificial Sequence
  chemically synthesized
aaaggacacataaaatactagt

SEQ ID NO: 1231319 - DNA, 22 bp, Artificial Sequence
  chemically synthesized
aaggacacataaaatactagtt

SEQ ID NO: 1231320 - DNA, 22 bp, Artificial Sequence
  chemically synthesized
aaatgttctttaaaactagtat

SEQ ID NO: 1231321 - DNA, 22 bp, Artificial Sequence
  chemically synthesized
taaaatgttctttaaaactagt

SEQ ID NO: 1231322 - DNA, 22 bp, Artificial Sequence
  chemically synthesized
gataaagaggattctaaaatgt

SEQ ID NO: 1231323 - DNA, 22 bp, Artificial Sequence
  chemically synthesized
gttttaaagaacattttagaat

SEQ ID NO: 1231324 - DNA, 22 bp, Artificial Sequence
  chemically synthesized
taaagaacattttagaatcctc

SEQ ID NO: 1231325 - DNA, 22 bp, Artificial Sequence
  chemically synthesized
aaagaacattttagaatcctct

SEQ ID NO: 1231326 - DNA, 22 bp, Artificial Sequence
  chemically synthesized
aagaacattttagaatcctctt

SEQ ID NO: 1231327 - DNA, 22 bp, Artificial Sequence
  chemically synthesized
gcatataatgttagataaagag

SEQ ID NO: 1231328 - DNA, 22 bp, Artificial Sequence
  chemically synthesized
tagaatcctctttatctaacat

SEQ ID NO: 1231329 - DNA, 22 bp, Artificial Sequence
  chemically synthesized
agaatcctctttatctaacatt

SEQ ID NO: 1231330 - DNA, 22 bp, Artificial Sequence
  chemically synthesized
gaatcctctttatctaacatta

SEQ ID NO: 1231331 - DNA, 22 bp, Artificial Sequence
  chemically synthesized
acatgctggcatataatgttag

SEQ ID NO: 1231332 - DNA, 22 bp, Artificial Sequence
  chemically synthesized
ttcacatgctggcatataatgt

SEQ ID NO: 1231333 - DNA, 22 bp, Artificial Sequence
  chemically synthesized
tttatctaacattatatgccag

SEQ ID NO: 1231334 - DNA, 22 bp, Artificial Sequence
  chemically synthesized
tatctaacattatatgccagca

SEQ ID NO: 1231335 - DNA, 22 bp, Artificial Sequence
  chemically synthesized
atctaacattatatgccagcat

SEQ ID NO: 1231336 - DNA, 22 bp, Artificial Sequence
  chemically synthesized
tctaacattatatgccagcatg

SEQ ID NO: 1231337 - DNA, 22 bp, Artificial Sequence
  chemically synthesized
acattatatgccagcatgtgaa

SEQ ID NO: 1231338 - DNA, 22 bp, Artificial Sequence
  chemically synthesized
aaaaatgatatactgttcacat

SEQ ID NO: 1231339 - DNA, 22 bp, Artificial Sequence
  chemically synthesized
tatgccagcatgtgaacagtat

SEQ ID NO: 1231340 - DNA, 22 bp, Artificial Sequence
  chemically synthesized
atctgaaaaatgatatactgtt

SEQ ID NO: 1231341 - DNA, 22 bp, Artificial Sequence
  chemically synthesized
tcagatgtcactgatctgaaaa

SEQ ID NO: 1231342 - DNA, 22 bp, Artificial Sequence
  chemically synthesized
aatggttgtcagatgtcactga

SEQ ID NO: 1231343 - DNA, 22 bp, Artificial Sequence
  chemically synthesized
gattgaatggttgtcagatgtc

SEQ ID NO: 1231344 - DNA, 22 bp, Artificial Sequence
  chemically synthesized
ttcagatcagtgacatctgaca

SEQ ID NO: 1231345 - DNA, 22 bp, Artificial Sequence
  chemically synthesized
tcagatcagtgacatctgacaa

SEQ ID NO: 1231346 - DNA, 22 bp, Artificial Sequence
  chemically synthesized
cagatcagtgacatctgacaac

SEQ ID NO: 1231347 - DNA, 22 bp, Artificial Sequence
  chemically synthesized
agatcagtgacatctgacaacc

SEQ ID NO: 1231348 - DNA, 22 bp, Artificial Sequence
  chemically synthesized
aattagattgaatggttgtcag

SEQ ID NO: 1231349 - DNA, 22 bp, Artificial Sequence
  chemically synthesized
aaaatagtcactgaattagatt

SEQ ID NO: 1231350 - DNA, 22 bp, Artificial Sequence
  chemically synthesized
acaaccattcaatctaattcag

SEQ ID NO: 1231351 - DNA, 22 bp, Artificial Sequence
  chemically synthesized
aatctaattcagtgactatttt

SEQ ID NO: 1231352 - DNA, 22 bp, Artificial Sequence
  chemically synthesized
accccatcattgaaaatagtca

SEQ ID NO: 1231353 - DNA, 22 bp, Artificial Sequence
  chemically synthesized
aaccccatcattgaaaatagtc

SEQ ID NO: 1231354 - DNA, 22 bp, Artificial Sequence
  chemically synthesized
acttaaccccatcattgaaaat

SEQ ID NO: 1231355 - DNA, 22 bp, Artificial Sequence
  chemically synthesized
attcagtgactattttcaatga

SEQ ID NO: 1231356 - DNA, 22 bp, Artificial Sequence
  chemically synthesized
agtgactattttcaatgatggg

SEQ ID NO: 1231357 - DNA, 22 bp, Artificial Sequence
  chemically synthesized
aaatattcacttaaccccatca

SEQ ID NO: 1231358 - DNA, 22 bp, Artificial Sequence
  chemically synthesized
ttttcaatgatggggttaagtg

SEQ ID NO: 1231359 - DNA, 22 bp, Artificial Sequence
  chemically synthesized
tgttcaaatattcacttaaccc

SEQ ID NO: 1231360 - DNA, 22 bp, Artificial Sequence
  chemically synthesized
tcaatgatggggttaagtgaat

SEQ ID NO: 1231361 - DNA, 22 bp, Artificial Sequence
  chemically synthesized
caatgatggggttaagtgaata

SEQ ID NO: 1231362 - DNA, 22 bp, Artificial Sequence
  chemically synthesized
aatgatggggttaagtgaatat

SEQ ID NO: 1231363 - DNA, 22 bp, Artificial Sequence
  chemically synthesized
agatgacagctatgttcaaata

SEQ ID NO: 1231364 - DNA, 22 bp, Artificial Sequence
  chemically synthesized
agtgaatatttgaacatagctg

SEQ ID NO: 1231365 - DNA, 22 bp, Artificial Sequence
  chemically synthesized
gggtggaaattcagatgacagc

SEQ ID NO: 1231366 - DNA, 22 bp, Artificial Sequence
  chemically synthesized
gaacatagctgtcatctgaatt

SEQ ID NO: 1231367 - DNA, 22 bp, Artificial Sequence
  chemically synthesized
aacatagctgtcatctgaattt

SEQ ID NO: 1231368 - DNA, 22 bp, Artificial Sequence
  chemically synthesized
aaaagcctagggtggaaattca

SEQ ID NO: 1231369 - DNA, 22 bp, Artificial Sequence
  chemically synthesized
aaaaagcctagggtggaaattc

SEQ ID NO: 1231370 - DNA, 22 bp, Artificial Sequence
  chemically synthesized
tcatctgaatttccaccctagg

SEQ ID NO: 1231371 - DNA, 22 bp, Artificial Sequence
  chemically synthesized
aatttccaccctaggcttttta

SEQ ID NO: 1231372 - DNA, 22 bp, Artificial Sequence
  chemically synthesized
ccaccctaggctttttaaatac

SEQ ID NO: 1231373 - DNA, 22 bp, Artificial Sequence
  chemically synthesized
caccctaggctttttaaatact

SEQ ID NO: 1231374 - DNA, 22 bp, Artificial Sequence
  chemically synthesized
aatcacaaatccaaggtgagta

SEQ ID NO: 1231375 - DNA, 22 bp, Artificial Sequence
  chemically synthesized
ggctttttaaatactcaccttg

SEQ ID NO: 1231376 - DNA, 22 bp, Artificial Sequence
  chemically synthesized
tttaaatactcaccttggattt

SEQ ID NO: 1231377 - DNA, 22 bp, Artificial Sequence
  chemically synthesized
ttaaatactcaccttggatttg

SEQ ID NO: 1231378 - DNA, 22 bp, Artificial Sequence
  chemically synthesized
tacattaaatcacaaatccaag

SEQ ID NO: 1231379 - DNA, 22 bp, Artificial Sequence
  chemically synthesized
taaatactcaccttggatttgt

SEQ ID NO: 1231380 - DNA, 22 bp, Artificial Sequence
  chemically synthesized
aaatactcaccttggatttgtg

SEQ ID NO: 1231381 - DNA, 22 bp, Artificial Sequence
  chemically synthesized
aatactcaccttggatttgtga

SEQ ID NO: 1231382 - DNA, 22 bp, Artificial Sequence
  chemically synthesized
ctatacattaaatcacaaatcc

SEQ ID NO: 1231383 - DNA, 22 bp, Artificial Sequence
  chemically synthesized
accttggatttgtgatttaatg

SEQ ID NO: 1231384 - DNA, 22 bp, Artificial Sequence
  chemically synthesized
ggatttgtgatttaatgtatag

SEQ ID NO: 1231385 - DNA, 22 bp, Artificial Sequence
  chemically synthesized
gatttgtgatttaatgtatagc

SEQ ID NO: 1231386 - DNA, 22 bp, Artificial Sequence
  chemically synthesized
gtgatttaatgtatagcaatga

SEQ ID NO: 1231387 - DNA, 22 bp, Artificial Sequence
  chemically synthesized
caaagcaaatagtcattgctat

SEQ ID NO: 1231388 - DNA, 22 bp, Artificial Sequence
  chemically synthesized
tgatttaatgtatagcaatgac

SEQ ID NO: 1231389 - DNA, 22 bp, Artificial Sequence
  chemically synthesized
aatgtatagcaatgactatttg

SEQ ID NO: 1231390 - DNA, 22 bp, Artificial Sequence
  chemically synthesized
atgtatagcaatgactatttgc

SEQ ID NO: 1231391 - DNA, 22 bp, Artificial Sequence
  chemically synthesized
caatgtgggatactacaaagca

SEQ ID NO: 1231392 - DNA, 22 bp, Artificial Sequence
  chemically synthesized
aaatctacaatgtgggatacta

SEQ ID NO: 1231393 - DNA, 22 bp, Artificial Sequence
  chemically synthesized
caaatctacaatgtgggatact

SEQ ID NO: 1231394 - DNA, 22 bp, Artificial Sequence
  chemically synthesized
tttgctttgtagtatcccacat

SEQ ID NO: 1231395 - DNA, 22 bp, Artificial Sequence
  chemically synthesized
gctttgtagtatcccacattgt

SEQ ID NO: 1231396 - DNA, 22 bp, Artificial Sequence
  chemically synthesized
ctttgtagtatcccacattgta

SEQ ID NO: 1231397 - DNA, 22 bp, Artificial Sequence
  chemically synthesized
tgtagtatcccacattgtagat

SEQ ID NO: 1231398 - DNA, 22 bp, Artificial Sequence
  chemically synthesized
gtagtatcccacattgtagatt

SEQ ID NO: 1231399 - DNA, 22 bp, Artificial Sequence
  chemically synthesized
tagtatcccacattgtagattt

SEQ ID NO: 1231400 - DNA, 22 bp, Artificial Sequence
  chemically synthesized
ccaagtaacttcaaatctacaa

SEQ ID NO: 1231401 - DNA, 22 bp, Artificial Sequence
  chemically synthesized
accaagtaacttcaaatctaca

SEQ ID NO: 1231402 - DNA, 22 bp, Artificial Sequence
  chemically synthesized
taccaagtaacttcaaatctac

SEQ ID NO: 1231403 - DNA, 22 bp, Artificial Sequence
  chemically synthesized
ttaccaagtaacttcaaatcta

SEQ ID NO: 1231404 - DNA, 22 bp, Artificial Sequence
  chemically synthesized
tagatttgaagttacttggtaa

SEQ ID NO: 1231405 - DNA, 22 bp, Artificial Sequence
  chemically synthesized
tcacaaggtggtaagtttttac

SEQ ID NO: 1231406 - DNA, 22 bp, Artificial Sequence
  chemically synthesized
gaagttacttggtaaaaactta

SEQ ID NO: 1231407 - DNA, 22 bp, Artificial Sequence
  chemically synthesized
aagttacttggtaaaaacttac

SEQ ID NO: 1231408 - DNA, 22 bp, Artificial Sequence
  chemically synthesized
tctatcacaaggtggtaagttt

SEQ ID NO: 1231409 - DNA, 22 bp, Artificial Sequence
  chemically synthesized
cttggtaaaaacttaccacctt

SEQ ID NO: 1231410 - DNA, 22 bp, Artificial Sequence
  chemically synthesized
ggtaaaaacttaccaccttgtg

SEQ ID NO: 1231411 - DNA, 22 bp, Artificial Sequence
  chemically synthesized
gtaaaaacttaccaccttgtga

SEQ ID NO: 1231412 - DNA, 22 bp, Artificial Sequence
  chemically synthesized
atcaattgtctatcacaaggtg

SEQ ID NO: 1231413 - DNA, 22 bp, Artificial Sequence
  chemically synthesized
taccagctcatcaattgtctat

SEQ ID NO: 1231414 - DNA, 22 bp, Artificial Sequence
  chemically synthesized
accaccttgtgatagacaattg

SEQ ID NO: 1231415 - DNA, 22 bp, Artificial Sequence
  chemically synthesized
ccaccttgtgatagacaattga

SEQ ID NO: 1231416 - DNA, 22 bp, Artificial Sequence
  chemically synthesized
attgtaccagctcatcaattgt

SEQ ID NO: 1231417 - DNA, 22 bp, Artificial Sequence
  chemically synthesized
gtgatagacaattgatgagctg

SEQ ID NO: 1231418 - DNA, 22 bp, Artificial Sequence
  chemically synthesized
tgttcattgtaccagctcatca

SEQ ID NO: 1231419 - DNA, 22 bp, Artificial Sequence
  chemically synthesized
tgatagacaattgatgagctgg

SEQ ID NO: 1231420 - DNA, 22 bp, Artificial Sequence
  chemically synthesized
ataattatgttcattgtaccag

SEQ ID NO: 1231421 - DNA, 22 bp, Artificial Sequence
  chemically synthesized
atgagctggtacaatgaacata

SEQ ID NO: 1231422 - DNA, 22 bp, Artificial Sequence
  chemically synthesized
tagatctaataattatgttcat

SEQ ID NO: 1231423 - DNA, 22 bp, Artificial Sequence
  chemically synthesized
gtacaatgaacataattattag

SEQ ID NO: 1231424 - DNA, 22 bp, Artificial Sequence
  chemically synthesized
acacagttgtagatctaataat

SEQ ID NO: 1231425 - DNA, 22 bp, Artificial Sequence
  chemically synthesized
actgacacagttgtagatctaa

SEQ ID NO: 1231426 - DNA, 22 bp, Artificial Sequence
  chemically synthesized
atattaactgacacagttgtag

SEQ ID NO: 1231427 - DNA, 22 bp, Artificial Sequence
  chemically synthesized
aatattaactgacacagttgta

SEQ ID NO: 1231428 - DNA, 22 bp, Artificial Sequence
  chemically synthesized
ttagatctacaactgtgtcagt

SEQ ID NO: 1231429 - DNA, 22 bp, Artificial Sequence
  chemically synthesized
gatctacaactgtgtcagttaa

SEQ ID NO: 1231430 - DNA, 22 bp, Artificial Sequence
  chemically synthesized
atataatttaatattaactgac

SEQ ID NO: 1231431 - DNA, 22 bp, Artificial Sequence
  chemically synthesized
aatataatttaatattaactga

SEQ ID NO: 1231432 - DNA, 22 bp, Artificial Sequence
  chemically synthesized
caactgtgtcagttaatattaa

SEQ ID NO: 1231433 - DNA, 22 bp, Artificial Sequence
  chemically synthesized
acttaatataatttaatattaa

SEQ ID NO: 1231434 - DNA, 22 bp, Artificial Sequence
  chemically synthesized
gctgacttaatataatttaata

SEQ ID NO: 1231435 - DNA, 22 bp, Artificial Sequence
  chemically synthesized
cgctgacttaatataatttaat

SEQ ID NO: 1231436 - DNA, 22 bp, Artificial Sequence
  chemically synthesized
tgtcagttaatattaaattata

SEQ ID NO: 1231437 - DNA, 22 bp, Artificial Sequence
  chemically synthesized
ccaagacttcgctgacttaata

SEQ ID NO: 1231438 - DNA, 22 bp, Artificial Sequence
  chemically synthesized
atattaaattatattaagtcag

SEQ ID NO: 1231439 - DNA, 22 bp, Artificial Sequence
  chemically synthesized
aattatattaagtcagcgaagt

SEQ ID NO: 1231440 - DNA, 22 bp, Artificial Sequence
  chemically synthesized
ggaacattaccaagacttcgct

SEQ ID NO: 1231441 - DNA, 22 bp, Artificial Sequence
  chemically synthesized
tattaagtcagcgaagtcttgg

SEQ ID NO: 1231442 - DNA, 22 bp, Artificial Sequence
  chemically synthesized
agtcagcgaagtcttggtaatg

SEQ ID NO: 1231443 - DNA, 22 bp, Artificial Sequence
  chemically synthesized
aaatataccctaggaacattac

SEQ ID NO: 1231444 - DNA, 22 bp, Artificial Sequence
  chemically synthesized
ggtaatgttcctagggtatatt

SEQ ID NO: 1231445 - DNA, 22 bp, Artificial Sequence
  chemically synthesized
gtaatgttcctagggtatattt

SEQ ID NO: 1231446 - DNA, 22 bp, Artificial Sequence
  chemically synthesized
atacaaaaggtatagtgttgaa

SEQ ID NO: 1231447 - DNA, 22 bp, Artificial Sequence
  chemically synthesized
ctagggtatatttcaacactat

SEQ ID NO: 1231448 - DNA, 22 bp, Artificial Sequence
  chemically synthesized
gggtatatttcaacactatacc

SEQ ID NO: 1231449 - DNA, 22 bp, Artificial Sequence
  chemically synthesized
taaagattcatacaaaaggtat

SEQ ID NO: 1231450 - DNA, 22 bp, Artificial Sequence
  chemically synthesized
ataaagattcatacaaaaggta

SEQ ID NO: 1231451 - DNA, 22 bp, Artificial Sequence
  chemically synthesized
tataaagattcatacaaaaggt

SEQ ID NO: 1231452 - DNA, 22 bp, Artificial Sequence
  chemically synthesized
ttataaagattcatacaaaagg

SEQ ID NO: 1231453 - DNA, 22 bp, Artificial Sequence
  chemically synthesized
caacactataccttttgtatga

SEQ ID NO: 1231454 - DNA, 22 bp, Artificial Sequence
  chemically synthesized
aacactataccttttgtatgaa

SEQ ID NO: 1231455 - DNA, 22 bp, Artificial Sequence
  chemically synthesized
cgatcccttttataaagattca

SEQ ID NO: 1231456 - DNA, 22 bp, Artificial Sequence
  chemically synthesized
taccttttgtatgaatctttat

SEQ ID NO: 1231457 - DNA, 22 bp, Artificial Sequence
  chemically synthesized
ttgtatgaatctttataaaagg

SEQ ID NO: 1231458 - DNA, 22 bp, Artificial Sequence
  chemically synthesized
tgaattccgatcccttttataa

SEQ ID NO: 1231459 - DNA, 22 bp, Artificial Sequence
  chemically synthesized
tgtatgaatctttataaaaggg

SEQ ID NO: 1231460 - DNA, 22 bp, Artificial Sequence
  chemically synthesized
atgaattccgatcccttttata

SEQ ID NO: 1231461 - DNA, 22 bp, Artificial Sequence
  chemically synthesized
gtatgaatctttataaaaggga

SEQ ID NO: 1231462 - DNA, 22 bp, Artificial Sequence
  chemically synthesized
tatgaattccgatcccttttat

SEQ ID NO: 1231463 - DNA, 22 bp, Artificial Sequence
  chemically synthesized
tatgaatctttataaaagggat

SEQ ID NO: 1231464 - DNA, 22 bp, Artificial Sequence
  chemically synthesized
cattttatgaattccgatccct

SEQ ID NO: 1231465 - DNA, 22 bp, Artificial Sequence
  chemically synthesized
acattttatgaattccgatccc

SEQ ID NO: 1231466 - DNA, 22 bp, Artificial Sequence
  chemically synthesized
cttacattttatgaattccgat

SEQ ID NO: 1231467 - DNA, 22 bp, Artificial Sequence
  chemically synthesized
gcttacattttatgaattccga

SEQ ID NO: 1231468 - DNA, 22 bp, Artificial Sequence
  chemically synthesized
tataaaagggatcggaattcat

SEQ ID NO: 1231469 - DNA, 22 bp, Artificial Sequence
  chemically synthesized
ataaaagggatcggaattcata

SEQ ID NO: 1231470 - DNA, 22 bp, Artificial Sequence
  chemically synthesized
taaaagggatcggaattcataa

SEQ ID NO: 1231471 - DNA, 22 bp, Artificial Sequence
  chemically synthesized
cttgcttacattttatgaattc

SEQ ID NO: 1231472 - DNA, 22 bp, Artificial Sequence
  chemically synthesized
ccttgcttacattttatgaatt

SEQ ID NO: 1231473 - DNA, 22 bp, Artificial Sequence
  chemically synthesized
tgatttccttgcttacatttta

SEQ ID NO: 1231474 - DNA, 22 bp, Artificial Sequence
  chemically synthesized
atgatttccttgcttacatttt

SEQ ID NO: 1231475 - DNA, 22 bp, Artificial Sequence
  chemically synthesized
ttatgatttccttgcttacatt

SEQ ID NO: 1231476 - DNA, 22 bp, Artificial Sequence
  chemically synthesized
cctcttatgatttccttgctta

SEQ ID NO: 1231477 - DNA, 22 bp, Artificial Sequence
  chemically synthesized
ccctcttatgatttccttgctt

SEQ ID NO: 1231478 - DNA, 22 bp, Artificial Sequence
  chemically synthesized
ataaaatgtaagcaaggaaatc

SEQ ID NO: 1231479 - DNA, 22 bp, Artificial Sequence
  chemically synthesized
gtcttccctcttatgatttcct

SEQ ID NO: 1231480 - DNA, 22 bp, Artificial Sequence
  chemically synthesized
tgtcctcgtcttccctcttatg

SEQ ID NO: 1231481 - DNA, 22 bp, Artificial Sequence
  chemically synthesized
gtgtcctcgtcttccctcttat

SEQ ID NO: 1231482 - DNA, 22 bp, Artificial Sequence
  chemically synthesized
caagcttgtgtcctcgtcttcc

SEQ ID NO: 1231483 - DNA, 22 bp, Artificial Sequence
  chemically synthesized
tccaagcttgtgtcctcgtctt

SEQ ID NO: 1231484 - DNA, 22 bp, Artificial Sequence
  chemically synthesized
ctccaagcttgtgtcctcgtct

SEQ ID NO: 1231485 - DNA, 22 bp, Artificial Sequence
  chemically synthesized
tctccaagcttgtgtcctcgtc

SEQ ID NO: 1231486 - DNA, 22 bp, Artificial Sequence
  chemically synthesized
ctttctccaagcttgtgtcctc

SEQ ID NO: 1231487 - DNA, 22 bp, Artificial Sequence
  chemically synthesized
cctttctccaagcttgtgtcct

SEQ ID NO: 1231488 - DNA, 22 bp, Artificial Sequence
  chemically synthesized
tcttcctttctccaagcttgtg

SEQ ID NO: 1231489 - DNA, 22 bp, Artificial Sequence
  chemically synthesized
tgatctgtcttcctttctccaa

SEQ ID NO: 1231490 - DNA, 22 bp, Artificial Sequence
  chemically synthesized
ggagaaaggaagacagatcata

SEQ ID NO: 1231491 - DNA, 22 bp, Artificial Sequence
  chemically synthesized
cccaagatgtattatgatctgt

SEQ ID NO: 1231492 - DNA, 22 bp, Artificial Sequence
  chemically synthesized
gagaaaggaagacagatcataa

SEQ ID NO: 1231493 - DNA, 22 bp, Artificial Sequence
  chemically synthesized
ccccccgctccccaagatgtat

SEQ ID NO: 1231494 - DNA, 22 bp, Artificial Sequence
  chemically synthesized
aactaccccccgctccccaaga

SEQ ID NO: 1231495 - DNA, 22 bp, Artificial Sequence
  chemically synthesized
aaactaccccccgctccccaag

SEQ ID NO: 1231496 - DNA, 22 bp, Artificial Sequence
  chemically synthesized
taaactaccccccgctccccaa

SEQ ID NO: 1231497 - DNA, 22 bp, Artificial Sequence
  chemically synthesized
tggtgctttaaactaccccccg

SEQ ID NO: 1231498 - DNA, 22 bp, Artificial Sequence
  chemically synthesized
actgtggtgctttaaactaccc

SEQ ID NO: 1231499 - DNA, 22 bp, Artificial Sequence
  chemically synthesized
aactgtggtgctttaaactacc

SEQ ID NO: 1231500 - DNA, 22 bp, Artificial Sequence
  chemically synthesized
ggggagcggggggtagtttaaa

SEQ ID NO: 1231501 - DNA, 22 bp, Artificial Sequence
  chemically synthesized
gggagcggggggtagtttaaag

SEQ ID NO: 1231502 - DNA, 22 bp, Artificial Sequence
  chemically synthesized
atagagatttaactgtggtgct

SEQ ID NO: 1231503 - DNA, 22 bp, Artificial Sequence
  chemically synthesized
gatagagatttaactgtggtgc

SEQ ID NO: 1231504 - DNA, 22 bp, Artificial Sequence
  chemically synthesized
caaatttgatagagatttaact

SEQ ID NO: 1231505 - DNA, 22 bp, Artificial Sequence
  chemically synthesized
aaagcaccacagttaaatctct

SEQ ID NO: 1231506 - DNA, 22 bp, Artificial Sequence
  chemically synthesized
aagcaccacagttaaatctcta

SEQ ID NO: 1231507 - DNA, 22 bp, Artificial Sequence
  chemically synthesized
gaaattacaaatttgatagaga

SEQ ID NO: 1231508 - DNA, 22 bp, Artificial Sequence
  chemically synthesized
agaaattacaaatttgatagag

SEQ ID NO: 1231509 - DNA, 22 bp, Artificial Sequence
  chemically synthesized
aatctctatcaaatttgtaatt

SEQ ID NO: 1231510 - DNA, 22 bp, Artificial Sequence
  chemically synthesized
gtaaaggaacttagaaattaca

SEQ ID NO: 1231511 - DNA, 22 bp, Artificial Sequence
  chemically synthesized
tatcaaatttgtaatttctaag

SEQ ID NO: 1231512 - DNA, 22 bp, Artificial Sequence
  chemically synthesized
tctggtaaaggaacttagaaat

SEQ ID NO: 1231513 - DNA, 22 bp, Artificial Sequence
  chemically synthesized
tcaaatttgtaatttctaagtt

SEQ ID NO: 1231514 - DNA, 22 bp, Artificial Sequence
  chemically synthesized
gtctggtaaaggaacttagaaa

SEQ ID NO: 1231515 - DNA, 22 bp, Artificial Sequence
  chemically synthesized
tgtctggtaaaggaacttagaa

SEQ ID NO: 1231516 - DNA, 22 bp, Artificial Sequence
  chemically synthesized
ttgtctggtaaaggaacttaga

SEQ ID NO: 1231517 - DNA, 22 bp, Artificial Sequence
  chemically synthesized
tttgtctggtaaaggaacttag

SEQ ID NO: 1231518 - DNA, 22 bp, Artificial Sequence
  chemically synthesized
attttttgtctggtaaaggaac

SEQ ID NO: 1231519 - DNA, 22 bp, Artificial Sequence
  chemically synthesized
gtaatttctaagttcctttacc

SEQ ID NO: 1231520 - DNA, 22 bp, Artificial Sequence
  chemically synthesized
taatttctaagttcctttacca

SEQ ID NO: 1231521 - DNA, 22 bp, Artificial Sequence
  chemically synthesized
atgattaattttttgtctggta

SEQ ID NO: 1231522 - DNA, 22 bp, Artificial Sequence
  chemically synthesized
ctaagttcctttaccagacaaa

SEQ ID NO: 1231523 - DNA, 22 bp, Artificial Sequence
  chemically synthesized
aatgattaattttttgtctggt

SEQ ID NO: 1231524 - DNA, 22 bp, Artificial Sequence
  chemically synthesized
taagttcctttaccagacaaaa

SEQ ID NO: 1231525 - DNA, 22 bp, Artificial Sequence
  chemically synthesized
agttcctttaccagacaaaaaa

SEQ ID NO: 1231526 - DNA, 22 bp, Artificial Sequence
  chemically synthesized
gtttaatgattaattttttgtc

SEQ ID NO: 1231527 - DNA, 22 bp, Artificial Sequence
  chemically synthesized
ctttaccagacaaaaaattaat

SEQ ID NO: 1231528 - DNA, 22 bp, Artificial Sequence
  chemically synthesized
tgtctagtttaatgattaattt

SEQ ID NO: 1231529 - DNA, 22 bp, Artificial Sequence
  chemically synthesized
taccagacaaaaaattaatcat

SEQ ID NO: 1231530 - DNA, 22 bp, Artificial Sequence
  chemically synthesized
gtgtctagtttaatgattaatt

SEQ ID NO: 1231531 - DNA, 22 bp, Artificial Sequence
  chemically synthesized
accagacaaaaaattaatcatt

SEQ ID NO: 1231532 - DNA, 22 bp, Artificial Sequence
  chemically synthesized
tgtgtctagtttaatgattaat

SEQ ID NO: 1231533 - DNA, 22 bp, Artificial Sequence
  chemically synthesized
ccagacaaaaaattaatcatta

SEQ ID NO: 1231534 - DNA, 22 bp, Artificial Sequence
  chemically synthesized
ataattttgtgtctagtttaat

SEQ ID NO: 1231535 - DNA, 22 bp, Artificial Sequence
  chemically synthesized
aataattttgtgtctagtttaa

SEQ ID NO: 1231536 - DNA, 22 bp, Artificial Sequence
  chemically synthesized
taataattttgtgtctagttta

SEQ ID NO: 1231537 - DNA, 22 bp, Artificial Sequence
  chemically synthesized
ttaataattttgtgtctagttt

SEQ ID NO: 1231538 - DNA, 22 bp, Artificial Sequence
  chemically synthesized
cacttttaataattttgtgtct

SEQ ID NO: 1231539 - DNA, 22 bp, Artificial Sequence
  chemically synthesized
atcattaaactagacacaaaat

SEQ ID NO: 1231540 - DNA, 22 bp, Artificial Sequence
  chemically synthesized
gcacttttaataattttgtgtc

SEQ ID NO: 1231541 - DNA, 22 bp, Artificial Sequence
  chemically synthesized
aactagacacaaaattattaaa

SEQ ID NO: 1231542 - DNA, 22 bp, Artificial Sequence
  chemically synthesized
gatatttgcacttttaataatt

SEQ ID NO: 1231543 - DNA, 22 bp, Artificial Sequence
  chemically synthesized
ttagatatttgcacttttaata

SEQ ID NO: 1231544 - DNA, 22 bp, Artificial Sequence
  chemically synthesized
gacacaaaattattaaaagtgc

SEQ ID NO: 1231545 - DNA, 22 bp, Artificial Sequence
  chemically synthesized
tattagatatttgcacttttaa

SEQ ID NO: 1231546 - DNA, 22 bp, Artificial Sequence
  chemically synthesized
tctattagatatttgcactttt

SEQ ID NO: 1231547 - DNA, 22 bp, Artificial Sequence
  chemically synthesized
ttaaaagtgcaaatatctaata

SEQ ID NO: 1231548 - DNA, 22 bp, Artificial Sequence
  chemically synthesized
aaagtgcaaatatctaatagag

SEQ ID NO: 1231549 - DNA, 22 bp, Artificial Sequence
  chemically synthesized
atcagtgagtattctctattag

SEQ ID NO: 1231550 - DNA, 22 bp, Artificial Sequence
  chemically synthesized
taatcagtgagtattctctatt

SEQ ID NO: 1231551 - DNA, 22 bp, Artificial Sequence
  chemically synthesized
agttctaatcagtgagtattct

SEQ ID NO: 1231552 - DNA, 22 bp, Artificial Sequence
  chemically synthesized
atagagaatactcactgattag

SEQ ID NO: 1231553 - DNA, 22 bp, Artificial Sequence
  chemically synthesized
gatataactaagttctaatcag

SEQ ID NO: 1231554 - DNA, 22 bp, Artificial Sequence
  chemically synthesized
ggatataactaagttctaatca

SEQ ID NO: 1231555 - DNA, 22 bp, Artificial Sequence
  chemically synthesized
cttggatataactaagttctaa

SEQ ID NO: 1231556 - DNA, 22 bp, Artificial Sequence
  chemically synthesized
ccttggatataactaagttcta

SEQ ID NO: 1231557 - DNA, 22 bp, Artificial Sequence
  chemically synthesized
tccttggatataactaagttct

SEQ ID NO: 1231558 - DNA, 22 bp, Artificial Sequence
  chemically synthesized
actgattagaacttagttatat

SEQ ID NO: 1231559 - DNA, 22 bp, Artificial Sequence
  chemically synthesized
aactttccttggatataactaa

SEQ ID NO: 1231560 - DNA, 22 bp, Artificial Sequence
  chemically synthesized
aaactttccttggatataacta

SEQ ID NO: 1231561 - DNA, 22 bp, Artificial Sequence
  chemically synthesized
attagaacttagttatatccaa

SEQ ID NO: 1231562 - DNA, 22 bp, Artificial Sequence
  chemically synthesized
gaacttagttatatccaaggaa

SEQ ID NO: 1231563 - DNA, 22 bp, Artificial Sequence
  chemically synthesized
atgggtaatttaaactttcctt

SEQ ID NO: 1231564 - DNA, 22 bp, Artificial Sequence
  chemically synthesized
aatgggtaatttaaactttcct

SEQ ID NO: 1231565 - DNA, 22 bp, Artificial Sequence
  chemically synthesized
agttatatccaaggaaagttta

SEQ ID NO: 1231566 - DNA, 22 bp, Artificial Sequence
  chemically synthesized
gttatatccaaggaaagtttaa

SEQ ID NO: 1231567 - DNA, 22 bp, Artificial Sequence
  chemically synthesized
tatccaaggaaagtttaaatta

SEQ ID NO: 1231568 - DNA, 22 bp, Artificial Sequence
  chemically synthesized
aaagatatttaatgggtaattt

SEQ ID NO: 1231569 - DNA, 22 bp, Artificial Sequence
  chemically synthesized
tcaaagatatttaatgggtaat

SEQ ID NO: 1231570 - DNA, 22 bp, Artificial Sequence
  chemically synthesized
tctcaaagatatttaatgggta

SEQ ID NO: 1231571 - DNA, 22 bp, Artificial Sequence
  chemically synthesized
ttctctcaaagatatttaatgg

SEQ ID NO: 1231572 - DNA, 22 bp, Artificial Sequence
  chemically synthesized
tattctctcaaagatatttaat

SEQ ID NO: 1231573 - DNA, 22 bp, Artificial Sequence
  chemically synthesized
aaattacccattaaatatcttt

SEQ ID NO: 1231574 - DNA, 22 bp, Artificial Sequence
  chemically synthesized
aattacccattaaatatctttg

SEQ ID NO: 1231575 - DNA, 22 bp, Artificial Sequence
  chemically synthesized
actctattctctcaaagatatt

SEQ ID NO: 1231576 - DNA, 22 bp, Artificial Sequence
  chemically synthesized
aactctattctctcaaagatat

SEQ ID NO: 1231577 - DNA, 22 bp, Artificial Sequence
  chemically synthesized
cccattaaatatctttgagaga

SEQ ID NO: 1231578 - DNA, 22 bp, Artificial Sequence
  chemically synthesized
cacttaactctattctctcaaa

SEQ ID NO: 1231579 - DNA, 22 bp, Artificial Sequence
  chemically synthesized
tacacttaactctattctctca

SEQ ID NO: 1231580 - DNA, 22 bp, Artificial Sequence
  chemically synthesized
aatatctttgagagaatagagt

SEQ ID NO: 1231581 - DNA, 22 bp, Artificial Sequence
  chemically synthesized
agttctacacttaactctattc

SEQ ID NO: 1231582 - DNA, 22 bp, Artificial Sequence
  chemically synthesized
aattcagttctacacttaactc

SEQ ID NO: 1231583 - DNA, 22 bp, Artificial Sequence
  chemically synthesized
aaattcagttctacacttaact

SEQ ID NO: 1231584 - DNA, 22 bp, Artificial Sequence
  chemically synthesized
tgagagaatagagttaagtgta

SEQ ID NO: 1231585 - DNA, 22 bp, Artificial Sequence
  chemically synthesized
taaattcagttctacacttaac

SEQ ID NO: 1231586 - DNA, 22 bp, Artificial Sequence
  chemically synthesized
gagagaatagagttaagtgtag

SEQ ID NO: 1231587 - DNA, 22 bp, Artificial Sequence
  chemically synthesized
agagaatagagttaagtgtaga

SEQ ID NO: 1231588 - DNA, 22 bp, Artificial Sequence
  chemically synthesized
ggcattttaaattcagttctac

SEQ ID NO: 1231589 - DNA, 22 bp, Artificial Sequence
  chemically synthesized
attaggcattttaaattcagtt

SEQ ID NO: 1231590 - DNA, 22 bp, Artificial Sequence
  chemically synthesized
cattaggcattttaaattcagt

SEQ ID NO: 1231591 - DNA, 22 bp, Artificial Sequence
  chemically synthesized
tcattaggcattttaaattcag

SEQ ID NO: 1231592 - DNA, 22 bp, Artificial Sequence
  chemically synthesized
agtgtagaactgaatttaaaat

SEQ ID NO: 1231593 - DNA, 22 bp, Artificial Sequence
  chemically synthesized
taagtagtgcctttcattaggc

SEQ ID NO: 1231594 - DNA, 22 bp, Artificial Sequence
  chemically synthesized
gtaagtagtgcctttcattagg

SEQ ID NO: 1231595 - DNA, 22 bp, Artificial Sequence
  chemically synthesized
aatttaaaatgcctaatgaaag

SEQ ID NO: 1231596 - DNA, 22 bp, Artificial Sequence
  chemically synthesized
tttgtaagtagtgcctttcatt

SEQ ID NO: 1231597 - DNA, 22 bp, Artificial Sequence
  chemically synthesized
gtttgtaagtagtgcctttcat

SEQ ID NO: 1231598 - DNA, 22 bp, Artificial Sequence
  chemically synthesized
tgtttgtaagtagtgcctttca

SEQ ID NO: 1231599 - DNA, 22 bp, Artificial Sequence
  chemically synthesized
aaaatgcctaatgaaaggcact

SEQ ID NO: 1231600 - DNA, 22 bp, Artificial Sequence
  chemically synthesized
ttgtttgtaagtagtgcctttc

SEQ ID NO: 1231601 - DNA, 22 bp, Artificial Sequence
  chemically synthesized
aaatgcctaatgaaaggcacta

SEQ ID NO: 1231602 - DNA, 22 bp, Artificial Sequence
  chemically synthesized
tcccacttttgtttgtaagtag

SEQ ID NO: 1231603 - DNA, 22 bp, Artificial Sequence
  chemically synthesized
atgaaaggcactacttacaaac

SEQ ID NO: 1231604 - DNA, 22 bp, Artificial Sequence
  chemically synthesized
ccctgtcccacttttgtttgta

SEQ ID NO: 1231605 - DNA, 22 bp, Artificial Sequence
  chemically synthesized
gccctgtcccacttttgtttgt

SEQ ID NO: 1231606 - DNA, 22 bp, Artificial Sequence
  chemically synthesized
tgccctgtcccacttttgtttg

SEQ ID NO: 1231607 - DNA, 22 bp, Artificial Sequence
  chemically synthesized
tttgccctgtcccacttttgtt

SEQ ID NO: 1231608 - DNA, 22 bp, Artificial Sequence
  chemically synthesized
ctttgccctgtcccacttttgt

SEQ ID NO: 1231609 - DNA, 22 bp, Artificial Sequence
  chemically synthesized
tttctttgccctgtcccacttt

SEQ ID NO: 1231610 - DNA, 22 bp, Artificial Sequence
  chemically synthesized
cttacaaacaaaagtgggacag

SEQ ID NO: 1231611 - DNA, 22 bp, Artificial Sequence
  chemically synthesized
ttatttctttgccctgtcccac

SEQ ID NO: 1231612 - DNA, 22 bp, Artificial Sequence
  chemically synthesized
acaaacaaaagtgggacagggc

SEQ ID NO: 1231613 - DNA, 22 bp, Artificial Sequence
  chemically synthesized
tattatttctttgccctgtccc

SEQ ID NO: 1231614 - DNA, 22 bp, Artificial Sequence
  chemically synthesized
caaacaaaagtgggacagggca

SEQ ID NO: 1231615 - DNA, 22 bp, Artificial Sequence
  chemically synthesized
tacagccattctattatttctt

SEQ ID NO: 1231616 - DNA, 22 bp, Artificial Sequence
  chemically synthesized
atacagccattctattatttct

SEQ ID NO: 1231617 - DNA, 22 bp, Artificial Sequence
  chemically synthesized
ttatacagccattctattattt

SEQ ID NO: 1231618 - DNA, 22 bp, Artificial Sequence
  chemically synthesized
ggatgaaacatctcttatacag

SEQ ID NO: 1231619 - DNA, 22 bp, Artificial Sequence
  chemically synthesized
tataagagatgtttcatcctag

SEQ ID NO: 1231620 - DNA, 22 bp, Artificial Sequence
  chemically synthesized
aaggtaaagcaaatcccagcta

SEQ ID NO: 1231621 - DNA, 22 bp, Artificial Sequence
  chemically synthesized
gaaggtaaagcaaatcccagct

SEQ ID NO: 1231622 - DNA, 22 bp, Artificial Sequence
  chemically synthesized
tgaaggtaaagcaaatcccagc

SEQ ID NO: 1231623 - DNA, 22 bp, Artificial Sequence
  chemically synthesized
ttgaaggtaaagcaaatcccag

SEQ ID NO: 1231624 - DNA, 22 bp, Artificial Sequence
  chemically synthesized
catcctagctgggatttgcttt

SEQ ID NO: 1231625 - DNA, 22 bp, Artificial Sequence
  chemically synthesized
atcctagctgggatttgcttta

SEQ ID NO: 1231626 - DNA, 22 bp, Artificial Sequence
  chemically synthesized
caagtttttgaaggtaaagcaa

SEQ ID NO: 1231627 - DNA, 22 bp, Artificial Sequence
  chemically synthesized
acaagtttttgaaggtaaagca

SEQ ID NO: 1231628 - DNA, 22 bp, Artificial Sequence
  chemically synthesized
gctgggatttgctttaccttca

SEQ ID NO: 1231629 - DNA, 22 bp, Artificial Sequence
  chemically synthesized
tttacaagtttttgaaggtaaa

SEQ ID NO: 1231630 - DNA, 22 bp, Artificial Sequence
  chemically synthesized
atttacaagtttttgaaggtaa

SEQ ID NO: 1231631 - DNA, 22 bp, Artificial Sequence
  chemically synthesized
tatttacaagtttttgaaggta

SEQ ID NO: 1231632 - DNA, 22 bp, Artificial Sequence
  chemically synthesized
ttatttacaagtttttgaaggt

SEQ ID NO: 1231633 - DNA, 22 bp, Artificial Sequence
  chemically synthesized
ggatttgctttaccttcaaaaa

SEQ ID NO: 1231634 - DNA, 22 bp, Artificial Sequence
  chemically synthesized
tttatttacaagtttttgaagg

SEQ ID NO: 1231635 - DNA, 22 bp, Artificial Sequence
  chemically synthesized
tttttatttacaagtttttgaa

SEQ ID NO: 1231636 - DNA, 22 bp, Artificial Sequence
  chemically synthesized
ctttttatttacaagtttttga

SEQ ID NO: 1231637 - DNA, 22 bp, Artificial Sequence
  chemically synthesized
gctttaccttcaaaaacttgta

SEQ ID NO: 1231638 - DNA, 22 bp, Artificial Sequence
  chemically synthesized
ctttaccttcaaaaacttgtaa

SEQ ID NO: 1231639 - DNA, 22 bp, Artificial Sequence
  chemically synthesized
taccttcaaaaacttgtaaata

SEQ ID NO: 1231640 - DNA, 22 bp, Artificial Sequence
  chemically synthesized
accttcaaaaacttgtaaataa

SEQ ID NO: 1231641 - DNA, 22 bp, Artificial Sequence
  chemically synthesized
ccttcaaaaacttgtaaataaa

SEQ ID NO: 1231642 - DNA, 22 bp, Artificial Sequence
  chemically synthesized
caaaaacttgtaaataaaaaga

SEQ ID NO: 1231643 - DNA, 22 bp, Artificial Sequence
  chemically synthesized
aaaaacttgtaaataaaaagaa

SEQ ID NO: 1231644 - DNA, 22 bp, Artificial Sequence
  chemically synthesized
gtaaataaaaagaagctgtgga

SEQ ID NO: 1231645 - DNA, 22 bp, Artificial Sequence
  chemically synthesized
ggtaaaaatgtatccacagctt

SEQ ID NO: 1231646 - DNA, 22 bp, Artificial Sequence
  chemically synthesized
taaataaaaagaagctgtggat

SEQ ID NO: 1231647 - DNA, 22 bp, Artificial Sequence
  chemically synthesized
taggtaaaaatgtatccacagc

SEQ ID NO: 1231648 - DNA, 22 bp, Artificial Sequence
  chemically synthesized
catcagctctaggtaaaaatgt

SEQ ID NO: 1231649 - DNA, 22 bp, Artificial Sequence
  chemically synthesized
tacatcagctctaggtaaaaat

SEQ ID NO: 1231650 - DNA, 22 bp, Artificial Sequence
  chemically synthesized
tctctacatcagctctaggtaa

SEQ ID NO: 1231651 - DNA, 22 bp, Artificial Sequence
  chemically synthesized
tggatacatttttacctagagc

SEQ ID NO: 1231652 - DNA, 22 bp, Artificial Sequence
  chemically synthesized
gtctctacatcagctctaggta

SEQ ID NO: 1231653 - DNA, 22 bp, Artificial Sequence
  chemically synthesized
ttgtctctacatcagctctagg

SEQ ID NO: 1231654 - DNA, 22 bp, Artificial Sequence
  chemically synthesized
ttcttgtctctacatcagctct

SEQ ID NO: 1231655 - DNA, 22 bp, Artificial Sequence
  chemically synthesized
ttacctagagctgatgtagaga

SEQ ID NO: 1231656 - DNA, 22 bp, Artificial Sequence
  chemically synthesized
tacctagagctgatgtagagac

SEQ ID NO: 1231657 - DNA, 22 bp, Artificial Sequence
  chemically synthesized
acctagagctgatgtagagaca

SEQ ID NO: 1231658 - DNA, 22 bp, Artificial Sequence
  chemically synthesized
agtggttattcttgtctctaca

SEQ ID NO: 1231659 - DNA, 22 bp, Artificial Sequence
  chemically synthesized
cctagagctgatgtagagacaa

SEQ ID NO: 1231660 - DNA, 22 bp, Artificial Sequence
  chemically synthesized
ctaagtggttattcttgtctct

SEQ ID NO: 1231661 - DNA, 22 bp, Artificial Sequence
  chemically synthesized
gagctgatgtagagacaagaat

SEQ ID NO: 1231662 - DNA, 22 bp, Artificial Sequence
  chemically synthesized
tgctactaagtggttattcttg

SEQ ID NO: 1231663 - DNA, 22 bp, Artificial Sequence
  chemically synthesized
atgtagagacaagaataaccac

SEQ ID NO: 1231664 - DNA, 22 bp, Artificial Sequence
  chemically synthesized
agaaatgggagactatgctact

SEQ ID NO: 1231665 - DNA, 22 bp, Artificial Sequence
  chemically synthesized
agtagcatagtctcccatttct

SEQ ID NO: 1231666 - DNA, 22 bp, Artificial Sequence
  chemically synthesized
gtagcatagtctcccatttctc

SEQ ID NO: 1231667 - DNA, 22 bp, Artificial Sequence
  chemically synthesized
ccatttctcaggattttgtatt

SEQ ID NO: 1231668 - DNA, 22 bp, Artificial Sequence
  chemically synthesized
aaaagcgaacaaaatacaaaat

SEQ ID NO: 1231669 - DNA, 22 bp, Artificial Sequence
  chemically synthesized
aaaaagcgaacaaaatacaaaa

SEQ ID NO: 1231670 - DNA, 22 bp, Artificial Sequence
  chemically synthesized
taaaaagcgaacaaaatacaaa

SEQ ID NO: 1231671 - DNA, 22 bp, Artificial Sequence
  chemically synthesized
ctcaggattttgtattttgttc

SEQ ID NO: 1231672 - DNA, 22 bp, Artificial Sequence
  chemically synthesized
tcaggattttgtattttgttcg

SEQ ID NO: 1231673 - DNA, 22 bp, Artificial Sequence
  chemically synthesized
tgattttaaaaagcgaacaaaa

SEQ ID NO: 1231674 - DNA, 22 bp, Artificial Sequence
  chemically synthesized
aggattttgtattttgttcgct

SEQ ID NO: 1231675 - DNA, 22 bp, Artificial Sequence
  chemically synthesized
gttgtgattttaaaaagcgaac

SEQ ID NO: 1231676 - DNA, 22 bp, Artificial Sequence
  chemically synthesized
tgtattttgttcgctttttaaa

SEQ ID NO: 1231677 - DNA, 22 bp, Artificial Sequence
  chemically synthesized
gtattttgttcgctttttaaaa

SEQ ID NO: 1231678 - DNA, 22 bp, Artificial Sequence
  chemically synthesized
tattttgttcgctttttaaaat

SEQ ID NO: 1231679 - DNA, 22 bp, Artificial Sequence
  chemically synthesized
taatagttggttgtgattttaa

SEQ ID NO: 1231680 - DNA, 22 bp, Artificial Sequence
  chemically synthesized
gtaatagttggttgtgatttta

SEQ ID NO: 1231681 - DNA, 22 bp, Artificial Sequence
  chemically synthesized
tgttcgctttttaaaatcacaa

SEQ ID NO: 1231682 - DNA, 22 bp, Artificial Sequence
  chemically synthesized
gttcgctttttaaaatcacaac

SEQ ID NO: 1231683 - DNA, 22 bp, Artificial Sequence
  chemically synthesized
ttcgctttttaaaatcacaacc

SEQ ID NO: 1231684 - DNA, 22 bp, Artificial Sequence
  chemically synthesized
atttgtaatagttggttgtgat

SEQ ID NO: 1231685 - DNA, 22 bp, Artificial Sequence
  chemically synthesized
gctttttaaaatcacaaccaac

SEQ ID NO: 1231686 - DNA, 22 bp, Artificial Sequence
  chemically synthesized
tttaaaatcacaaccaactatt

SEQ ID NO: 1231687 - DNA, 22 bp, Artificial Sequence
  chemically synthesized
ttaaaatcacaaccaactatta

SEQ ID NO: 1231688 - DNA, 22 bp, Artificial Sequence
  chemically synthesized
taaaatcacaaccaactattac

SEQ ID NO: 1231689 - DNA, 22 bp, Artificial Sequence
  chemically synthesized
aaaatcacaaccaactattaca

SEQ ID NO: 1231690 - DNA, 22 bp, Artificial Sequence
  chemically synthesized
aaatcacaaccaactattacaa

SEQ ID NO: 1231691 - DNA, 22 bp, Artificial Sequence
  chemically synthesized
agagcaaagctcatttgtaata

SEQ ID NO: 1231692 - DNA, 22 bp, Artificial Sequence
  chemically synthesized
ctgagagcaaagctcatttgta

SEQ ID NO: 1231693 - DNA, 22 bp, Artificial Sequence
  chemically synthesized
gctgagagcaaagctcatttgt

SEQ ID NO: 1231694 - DNA, 22 bp, Artificial Sequence
  chemically synthesized
cggtatttgctgagagcaaagc

SEQ ID NO: 1231695 - DNA, 22 bp, Artificial Sequence
  chemically synthesized
ttacaaatgagctttgctctca

SEQ ID NO: 1231696 - DNA, 22 bp, Artificial Sequence
  chemically synthesized
ttgcggtatttgctgagagcaa

SEQ ID NO: 1231697 - DNA, 22 bp, Artificial Sequence
  chemically synthesized
attgcggtatttgctgagagca

SEQ ID NO: 1231698 - DNA, 22 bp, Artificial Sequence
  chemically synthesized
caaatgagctttgctctcagca

SEQ ID NO: 1231699 - DNA, 22 bp, Artificial Sequence
  chemically synthesized
tattgcggtatttgctgagagc

SEQ ID NO: 1231700 - DNA, 22 bp, Artificial Sequence
  chemically synthesized
tgctctcagcaaataccgcaat

SEQ ID NO: 1231701 - DNA, 22 bp, Artificial Sequence
  chemically synthesized
gctctcagcaaataccgcaata

SEQ ID NO: 1231702 - DNA, 22 bp, Artificial Sequence
  chemically synthesized
ctctcagcaaataccgcaataa

SEQ ID NO: 1231703 - DNA, 22 bp, Artificial Sequence
  chemically synthesized
tcagcaaataccgcaataaagt

SEQ ID NO: 1231704 - DNA, 22 bp, Artificial Sequence
  chemically synthesized
agtgcagtgataactttattgc

SEQ ID NO: 1231705 - DNA, 22 bp, Artificial Sequence
  chemically synthesized
agcaaataccgcaataaagtta

SEQ ID NO: 1231706 - DNA, 22 bp, Artificial Sequence
  chemically synthesized
taagtgcagtgataactttatt

SEQ ID NO: 1231707 - DNA, 22 bp, Artificial Sequence
  chemically synthesized
ctaagtgcagtgataactttat

SEQ ID NO: 1231708 - DNA, 22 bp, Artificial Sequence
  chemically synthesized
agaagaaagtacttctaagtgc

SEQ ID NO: 1231709 - DNA, 22 bp, Artificial Sequence
  chemically synthesized
ttgagaagaaagtacttctaag

SEQ ID NO: 1231710 - DNA, 22 bp, Artificial Sequence
  chemically synthesized
attgagaagaaagtacttctaa

SEQ ID NO: 1231711 - DNA, 22 bp, Artificial Sequence
  chemically synthesized
tcactgcacttagaagtacttt

SEQ ID NO: 1231712 - DNA, 22 bp, Artificial Sequence
  chemically synthesized
cacttagaagtactttcttctc

SEQ ID NO: 1231713 - DNA, 22 bp, Artificial Sequence
  chemically synthesized
gaaagccacttattgagaagaa

SEQ ID NO: 1231714 - DNA, 22 bp, Artificial Sequence
  chemically synthesized
ggaaagccacttattgagaaga

SEQ ID NO: 1231715 - DNA, 22 bp, Artificial Sequence
  chemically synthesized
tggaaagccacttattgagaag

SEQ ID NO: 1231716 - DNA, 22 bp, Artificial Sequence
  chemically synthesized
agaagtactttcttctcaataa

SEQ ID NO: 1231717 - DNA, 22 bp, Artificial Sequence
  chemically synthesized
gaagtactttcttctcaataag

SEQ ID NO: 1231718 - DNA, 22 bp, Artificial Sequence
  chemically synthesized
tcttctcaataagtggctttcc

SEQ ID NO: 1231719 - DNA, 22 bp, Artificial Sequence
  chemically synthesized
cttctcaataagtggctttcca

SEQ ID NO: 1231720 - DNA, 22 bp, Artificial Sequence
  chemically synthesized
ttctcaataagtggctttccaa

SEQ ID NO: 1231721 - DNA, 22 bp, Artificial Sequence
  chemically synthesized
tcaataatgtattttggaaagc

SEQ ID NO: 1231722 - DNA, 22 bp, Artificial Sequence
  chemically synthesized
ctcaataagtggctttccaaaa

SEQ ID NO: 1231723 - DNA, 22 bp, Artificial Sequence
  chemically synthesized
tcaataagtggctttccaaaat

SEQ ID NO: 1231724 - DNA, 22 bp, Artificial Sequence
  chemically synthesized
ctgtcaataatgtattttggaa

SEQ ID NO: 1231725 - DNA, 22 bp, Artificial Sequence
  chemically synthesized
aataagtggctttccaaaatac

SEQ ID NO: 1231726 - DNA, 22 bp, Artificial Sequence
  chemically synthesized
tccctgctgtcaataatgtatt

SEQ ID NO: 1231727 - DNA, 22 bp, Artificial Sequence
  chemically synthesized
tccaaaatacattattgacagc

SEQ ID NO: 1231728 - DNA, 22 bp, Artificial Sequence
  chemically synthesized
ccaaaatacattattgacagca

SEQ ID NO: 1231729 - DNA, 22 bp, Artificial Sequence
  chemically synthesized
caaaatacattattgacagcag

SEQ ID NO: 1231730 - DNA, 22 bp, Artificial Sequence
  chemically synthesized
gcatgaagttatccctgctgtc

SEQ ID NO: 1231731 - DNA, 22 bp, Artificial Sequence
  chemically synthesized
agcatgaagttatccctgctgt

SEQ ID NO: 1231732 - DNA, 22 bp, Artificial Sequence
  chemically synthesized
tagcatgaagttatccctgctg

SEQ ID NO: 1231733 - DNA, 22 bp, Artificial Sequence
  chemically synthesized
ttttagcatgaagttatccctg

SEQ ID NO: 1231734 - DNA, 22 bp, Artificial Sequence
  chemically synthesized
ttgacagcagggataacttcat

SEQ ID NO: 1231735 - DNA, 22 bp, Artificial Sequence
  chemically synthesized
acagcagggataacttcatgct

SEQ ID NO: 1231736 - DNA, 22 bp, Artificial Sequence
  chemically synthesized
tggtggctgttttagcatgaag

SEQ ID NO: 1231737 - DNA, 22 bp, Artificial Sequence
  chemically synthesized
gtggtggctgttttagcatgaa

SEQ ID NO: 1231738 - DNA, 22 bp, Artificial Sequence
  chemically synthesized
tgtggtggctgttttagcatga

SEQ ID NO: 1231739 - DNA, 22 bp, Artificial Sequence
  chemically synthesized
tttgtggtggctgttttagcat

SEQ ID NO: 1231740 - DNA, 22 bp, Artificial Sequence
  chemically synthesized
cattctttgtggtggctgtttt

SEQ ID NO: 1231741 - DNA, 22 bp, Artificial Sequence
  chemically synthesized
gcattctttgtggtggctgttt

SEQ ID NO: 1231742 - DNA, 22 bp, Artificial Sequence
  chemically synthesized
catgctaaaacagccaccacaa

SEQ ID NO: 1231743 - DNA, 22 bp, Artificial Sequence
  chemically synthesized
atgctaaaacagccaccacaaa

SEQ ID NO: 1231744 - DNA, 22 bp, Artificial Sequence
  chemically synthesized
caatttgcattctttgtggtgg

SEQ ID NO: 1231745 - DNA, 22 bp, Artificial Sequence
  chemically synthesized
tgttccaatttgcattctttgt

SEQ ID NO: 1231746 - DNA, 22 bp, Artificial Sequence
  chemically synthesized
aaacagccaccacaaagaatgc

SEQ ID NO: 1231747 - DNA, 22 bp, Artificial Sequence
  chemically synthesized
cgtctgtgttccaatttgcatt

SEQ ID NO: 1231748 - DNA, 22 bp, Artificial Sequence
  chemically synthesized
agacactacgtctgtgttccaa

SEQ ID NO: 1231749 - DNA, 22 bp, Artificial Sequence
  chemically synthesized
tagagctcagacactacgtctg

SEQ ID NO: 1231750 - DNA, 22 bp, Artificial Sequence
  chemically synthesized
tatctgtagagctcagacacta

SEQ ID NO: 1231751 - DNA, 22 bp, Artificial Sequence
  chemically synthesized
gaacacagacgtagtgtctgag

SEQ ID NO: 1231752 - DNA, 22 bp, Artificial Sequence
  chemically synthesized
atatctgtagagctcagacact

SEQ ID NO: 1231753 - DNA, 22 bp, Artificial Sequence
  chemically synthesized
agcttatatctgtagagctcag

SEQ ID NO: 1231754 - DNA, 22 bp, Artificial Sequence
  chemically synthesized
aatgccactcagcttatatctg

SEQ ID NO: 1231755 - DNA, 22 bp, Artificial Sequence
  chemically synthesized
gaatgccactcagcttatatct

SEQ ID NO: 1231756 - DNA, 22 bp, Artificial Sequence
  chemically synthesized
agctctacagatataagctgag

SEQ ID NO: 1231757 - DNA, 22 bp, Artificial Sequence
  chemically synthesized
acttgaatgccactcagcttat

SEQ ID NO: 1231758 - DNA, 22 bp, Artificial Sequence
  chemically synthesized
tacagatataagctgagtggca

SEQ ID NO: 1231759 - DNA, 22 bp, Artificial Sequence
  chemically synthesized
tcctcacttgaatgccactcag

SEQ ID NO: 1231760 - DNA, 22 bp, Artificial Sequence
  chemically synthesized
cagatataagctgagtggcatt

SEQ ID NO: 1231761 - DNA, 22 bp, Artificial Sequence
  chemically synthesized
ttatcctcacttgaatgccact

SEQ ID NO: 1231762 - DNA, 22 bp, Artificial Sequence
  chemically synthesized
acctgttatcctcacttgaatg

SEQ ID NO: 1231763 - DNA, 22 bp, Artificial Sequence
  chemically synthesized
aacctgttatcctcacttgaat

SEQ ID NO: 1231764 - DNA, 22 bp, Artificial Sequence
  chemically synthesized
agtggcattcaagtgaggataa

SEQ ID NO: 1231765 - DNA, 22 bp, Artificial Sequence
  chemically synthesized
gcgtttaacctgttatcctcac

SEQ ID NO: 1231766 - DNA, 22 bp, Artificial Sequence
  chemically synthesized
tcctggcgtttaacctgttatc

SEQ ID NO: 1231767 - DNA, 22 bp, Artificial Sequence
  chemically synthesized
cctgtcctggcgtttaacctgt

SEQ ID NO: 1231768 - DNA, 22 bp, Artificial Sequence
  chemically synthesized
aagtgaggataacaggttaaac

SEQ ID NO: 1231769 - DNA, 22 bp, Artificial Sequence
  chemically synthesized
ccctgtcctggcgtttaacctg

SEQ ID NO: 1231770 - DNA, 22 bp, Artificial Sequence
  chemically synthesized
tccctgtcctggcgtttaacct

SEQ ID NO: 1231771 - DNA, 22 bp, Artificial Sequence
  chemically synthesized
ctttccctgtcctggcgtttaa

SEQ ID NO: 1231772 - DNA, 22 bp, Artificial Sequence
  chemically synthesized
cctttccctgtcctggcgttta

SEQ ID NO: 1231773 - DNA, 22 bp, Artificial Sequence
  chemically synthesized
tcctttccctgtcctggcgttt

SEQ ID NO: 1231774 - DNA, 22 bp, Artificial Sequence
  chemically synthesized
tttcctttccctgtcctggcgt

SEQ ID NO: 1231775 - DNA, 22 bp, Artificial Sequence
  chemically synthesized
ctttcctttccctgtcctggcg

SEQ ID NO: 1231776 - DNA, 22 bp, Artificial Sequence
  chemically synthesized
agtttctttcctttccctgtcc

SEQ ID NO: 1231777 - DNA, 22 bp, Artificial Sequence
  chemically synthesized
ctcagtttctttcctttccctg

SEQ ID NO: 1231778 - DNA, 22 bp, Artificial Sequence
  chemically synthesized
aacgccaggacagggaaaggaa

SEQ ID NO: 1231779 - DNA, 22 bp, Artificial Sequence
  chemically synthesized
ttcctcagtttctttcctttcc

SEQ ID NO: 1231780 - DNA, 22 bp, Artificial Sequence
  chemically synthesized
accctgttcctcagtttctttc

SEQ ID NO: 1231781 - DNA, 22 bp, Artificial Sequence
  chemically synthesized
aaccctgttcctcagtttcttt

SEQ ID NO: 1231782 - DNA, 22 bp, Artificial Sequence
  chemically synthesized
agtttaaccctgttcctcagtt

SEQ ID NO: 1231783 - DNA, 22 bp, Artificial Sequence
  chemically synthesized
ctcagtttaaccctgttcctca

SEQ ID NO: 1231784 - DNA, 22 bp, Artificial Sequence
  chemically synthesized
gctcctcagtttaaccctgttc

SEQ ID NO: 1231785 - DNA, 22 bp, Artificial Sequence
  chemically synthesized
aactagctcctcagtttaaccc

SEQ ID NO: 1231786 - DNA, 22 bp, Artificial Sequence
  chemically synthesized
taaactagctcctcagtttaac

SEQ ID NO: 1231787 - DNA, 22 bp, Artificial Sequence
  chemically synthesized
aggaacagggttaaactgagga

SEQ ID NO: 1231788 - DNA, 22 bp, Artificial Sequence
  chemically synthesized
tagttctaaactagctcctcag

SEQ ID NO: 1231789 - DNA, 22 bp, Artificial Sequence
  chemically synthesized
tgtagttctaaactagctcctc

SEQ ID NO: 1231790 - DNA, 22 bp, Artificial Sequence
  chemically synthesized
aactgaggagctagtttagaac

SEQ ID NO: 1231791 - DNA, 22 bp, Artificial Sequence
  chemically synthesized
gcatattctgtagttctaaact

SEQ ID NO: 1231792 - DNA, 22 bp, Artificial Sequence
  chemically synthesized
tagcatattctgtagttctaaa

SEQ ID NO: 1231793 - DNA, 22 bp, Artificial Sequence
  chemically synthesized
aggagctagtttagaactacag

SEQ ID NO: 1231794 - DNA, 22 bp, Artificial Sequence
  chemically synthesized
gttctagcatattctgtagttc

SEQ ID NO: 1231795 - DNA, 22 bp, Artificial Sequence
  chemically synthesized
gtttagaactacagaatatgct

SEQ ID NO: 1231796 - DNA, 22 bp, Artificial Sequence
  chemically synthesized
agaactacagaatatgctagaa

SEQ ID NO: 1231797 - DNA, 22 bp, Artificial Sequence
  chemically synthesized
gaactacagaatatgctagaac

SEQ ID NO: 1231798 - DNA, 22 bp, Artificial Sequence
  chemically synthesized
ccataaatcactagttctagca

SEQ ID NO: 1231799 - DNA, 22 bp, Artificial Sequence
  chemically synthesized
tgccataaatcactagttctag

SEQ ID NO: 1231800 - DNA, 22 bp, Artificial Sequence
  chemically synthesized
cagaatatgctagaactagtga

SEQ ID NO: 1231801 - DNA, 22 bp, Artificial Sequence
  chemically synthesized
tccctctgccataaatcactag

SEQ ID NO: 1231802 - DNA, 22 bp, Artificial Sequence
  chemically synthesized
gcctgtccctctgccataaatc

SEQ ID NO: 1231803 - DNA, 22 bp, Artificial Sequence
  chemically synthesized
agcctgtccctctgccataaat

SEQ ID NO: 1231804 - DNA, 22 bp, Artificial Sequence
  chemically synthesized
tagcctgtccctctgccataaa

SEQ ID NO: 1231805 - DNA, 22 bp, Artificial Sequence
  chemically synthesized
gaactagtgatttatggcagag

SEQ ID NO: 1231806 - DNA, 22 bp, Artificial Sequence
  chemically synthesized
cattttagcctgtccctctgcc

SEQ ID NO: 1231807 - DNA, 22 bp, Artificial Sequence
  chemically synthesized
gtgatttatggcagagggacag

SEQ ID NO: 1231808 - DNA, 22 bp, Artificial Sequence
  chemically synthesized
ctccattttagcctgtccctct

SEQ ID NO: 1231809 - DNA, 22 bp, Artificial Sequence
  chemically synthesized
atggcagagggacaggctaaaa

SEQ ID NO: 1231810 - DNA, 22 bp, Artificial Sequence
  chemically synthesized
gggtctcctccattttagcctg

SEQ ID NO: 1231811 - DNA, 22 bp, Artificial Sequence
  chemically synthesized
tggcagagggacaggctaaaat

SEQ ID NO: 1231812 - DNA, 22 bp, Artificial Sequence
  chemically synthesized
agggtctcctccattttagcct

SEQ ID NO: 1231813 - DNA, 22 bp, Artificial Sequence
  chemically synthesized
cttagggtctcctccattttag

SEQ ID NO: 1231814 - DNA, 22 bp, Artificial Sequence
  chemically synthesized
ccttagggtctcctccatttta

SEQ ID NO: 1231815 - DNA, 22 bp, Artificial Sequence
  chemically synthesized
tccttagggtctcctccatttt

SEQ ID NO: 1231816 - DNA, 22 bp, Artificial Sequence
  chemically synthesized
ttccttagggtctcctccattt

SEQ ID NO: 1231817 - DNA, 22 bp, Artificial Sequence
  chemically synthesized
ttttccttagggtctcctccat

SEQ ID NO: 1231818 - DNA, 22 bp, Artificial Sequence
  chemically synthesized
tcttttccttagggtctcctcc

SEQ ID NO: 1231819 - DNA, 22 bp, Artificial Sequence
  chemically synthesized
tctcttttccttagggtctcct

SEQ ID NO: 1231820 - DNA, 22 bp, Artificial Sequence
  chemically synthesized
ctctcttttccttagggtctcc

SEQ ID NO: 1231821 - DNA, 22 bp, Artificial Sequence
  chemically synthesized
tcttctctcttttccttagggt

SEQ ID NO: 1231822 - DNA, 22 bp, Artificial Sequence
  chemically synthesized
aaatggaggagaccctaaggaa

SEQ ID NO: 1231823 - DNA, 22 bp, Artificial Sequence
  chemically synthesized
gtcttctctcttttccttaggg

SEQ ID NO: 1231824 - DNA, 22 bp, Artificial Sequence
  chemically synthesized
tgtcttctctcttttccttagg

SEQ ID NO: 1231825 - DNA, 22 bp, Artificial Sequence
  chemically synthesized
agtcaaggtcattttgtcttct

SEQ ID NO: 1231826 - DNA, 22 bp, Artificial Sequence
  chemically synthesized
aggaaaagagagaagacaaaat

SEQ ID NO: 1231827 - DNA, 22 bp, Artificial Sequence
  chemically synthesized
gatcattaagtcaaggtcattt

SEQ ID NO: 1231828 - DNA, 22 bp, Artificial Sequence
  chemically synthesized
tggatcattaagtcaaggtcat

SEQ ID NO: 1231829 - DNA, 22 bp, Artificial Sequence
  chemically synthesized
ctggatcattaagtcaaggtca

SEQ ID NO: 1231830 - DNA, 22 bp, Artificial Sequence
  chemically synthesized
gtaatttctggatcattaagtc

SEQ ID NO: 1231831 - DNA, 22 bp, Artificial Sequence
  chemically synthesized
ggtaatttctggatcattaagt

SEQ ID NO: 1231832 - DNA, 22 bp, Artificial Sequence
  chemically synthesized
tggtaatttctggatcattaag

SEQ ID NO: 1231833 - DNA, 22 bp, Artificial Sequence
  chemically synthesized
ttggtaatttctggatcattaa

SEQ ID NO: 1231834 - DNA, 22 bp, Artificial Sequence
  chemically synthesized
tttggtaatttctggatcatta

SEQ ID NO: 1231835 - DNA, 22 bp, Artificial Sequence
  chemically synthesized
gacttaatgatccagaaattac

SEQ ID NO: 1231836 - DNA, 22 bp, Artificial Sequence
  chemically synthesized
acttaatgatccagaaattacc

SEQ ID NO: 1231837 - DNA, 22 bp, Artificial Sequence
  chemically synthesized
aaaatgatactttttggtaatt

SEQ ID NO: 1231838 - DNA, 22 bp, Artificial Sequence
  chemically synthesized
aatgatccagaaattaccaaaa

SEQ ID NO: 1231839 - DNA, 22 bp, Artificial Sequence
  chemically synthesized
caaaatgatactttttggtaat

SEQ ID NO: 1231840 - DNA, 22 bp, Artificial Sequence
  chemically synthesized
atgatccagaaattaccaaaaa

SEQ ID NO: 1231841 - DNA, 22 bp, Artificial Sequence
  chemically synthesized
tcaaaatgatactttttggtaa

SEQ ID NO: 1231842 - DNA, 22 bp, Artificial Sequence
  chemically synthesized
ttcaaaatgatactttttggta

SEQ ID NO: 1231843 - DNA, 22 bp, Artificial Sequence
  chemically synthesized
gaagtgtcttttcaaaatgata

SEQ ID NO: 1231844 - DNA, 22 bp, Artificial Sequence
  chemically synthesized
ccaaaaagtatcattttgaaaa

SEQ ID NO: 1231845 - DNA, 22 bp, Artificial Sequence
  chemically synthesized
aaggaatattagaagtgtcttt

SEQ ID NO: 1231846 - DNA, 22 bp, Artificial Sequence
  chemically synthesized
aaaggaatattagaagtgtctt

SEQ ID NO: 1231847 - DNA, 22 bp, Artificial Sequence
  chemically synthesized
taaaggaatattagaagtgtct

SEQ ID NO: 1231848 - DNA, 22 bp, Artificial Sequence
  chemically synthesized
ttaaaggaatattagaagtgtc

SEQ ID NO: 1231849 - DNA, 22 bp, Artificial Sequence
  chemically synthesized
atttttaaaggaatattagaag

SEQ ID NO: 1231850 - DNA, 22 bp, Artificial Sequence
  chemically synthesized
tgaaaagacacttctaatattc

SEQ ID NO: 1231851 - DNA, 22 bp, Artificial Sequence
  chemically synthesized
tgatttttaaaggaatattaga

SEQ ID NO: 1231852 - DNA, 22 bp, Artificial Sequence
  chemically synthesized
gaaaagacacttctaatattcc

SEQ ID NO: 1231853 - DNA, 22 bp, Artificial Sequence
  chemically synthesized
aaaagacacttctaatattcct

SEQ ID NO: 1231854 - DNA, 22 bp, Artificial Sequence
  chemically synthesized
gccctctgatttttaaaggaat

SEQ ID NO: 1231855 - DNA, 22 bp, Artificial Sequence
  chemically synthesized
agccctctgatttttaaaggaa

SEQ ID NO: 1231856 - DNA, 22 bp, Artificial Sequence
  chemically synthesized
ctaatattcctttaaaaatcag

SEQ ID NO: 1231857 - DNA, 22 bp, Artificial Sequence
  chemically synthesized
taatattcctttaaaaatcaga

SEQ ID NO: 1231858 - DNA, 22 bp, Artificial Sequence
  chemically synthesized
aaaatttagccctctgattttt

SEQ ID NO: 1231859 - DNA, 22 bp, Artificial Sequence
  chemically synthesized
atattcctttaaaaatcagagg

SEQ ID NO: 1231860 - DNA, 22 bp, Artificial Sequence
  chemically synthesized
ctttaaaaatcagagggctaaa

SEQ ID NO: 1231861 - DNA, 22 bp, Artificial Sequence
  chemically synthesized
taaaaatcagagggctaaattt

SEQ ID NO: 1231862 - DNA, 22 bp, Artificial Sequence
  chemically synthesized
aaaaatcagagggctaaatttt

SEQ ID NO: 1231863 - DNA, 22 bp, Artificial Sequence
  chemically synthesized
aaaaaatcactcaaaatttagc

SEQ ID NO: 1231864 - DNA, 22 bp, Artificial Sequence
  chemically synthesized
aaaatcagagggctaaattttg

SEQ ID NO: 1231865 - DNA, 22 bp, Artificial Sequence
  chemically synthesized
aaaaaaatcactcaaaatttag

SEQ ID NO: 1231866 - DNA, 22 bp, Artificial Sequence
  chemically synthesized
gtttaaaaaaatcactcaaaat

SEQ ID NO: 1231867 - DNA, 22 bp, Artificial Sequence
  chemically synthesized
aattttgagtgatttttttaaa

SEQ ID NO: 1231868 - DNA, 22 bp, Artificial Sequence
  chemically synthesized
tgaaaagaaaccctggtttaaa

SEQ ID NO: 1231869 - DNA, 22 bp, Artificial Sequence
  chemically synthesized
tgagtgatttttttaaaccagg

SEQ ID NO: 1231870 - DNA, 22 bp, Artificial Sequence
  chemically synthesized
gagtgatttttttaaaccaggg

SEQ ID NO: 1231871 - DNA, 22 bp, Artificial Sequence
  chemically synthesized
agtgatttttttaaaccagggt

SEQ ID NO: 1231872 - DNA, 22 bp, Artificial Sequence
  chemically synthesized
taaacctatgaaaagaaaccct

SEQ ID NO: 1231873 - DNA, 22 bp, Artificial Sequence
  chemically synthesized
tataaacctatgaaaagaaacc

SEQ ID NO: 1231874 - DNA, 22 bp, Artificial Sequence
  chemically synthesized
ttttaaaccagggtttcttttc

SEQ ID NO: 1231875 - DNA, 22 bp, Artificial Sequence
  chemically synthesized
tttaaaccagggtttcttttca

SEQ ID NO: 1231876 - DNA, 22 bp, Artificial Sequence
  chemically synthesized
ttaaaccagggtttcttttcat

SEQ ID NO: 1231877 - DNA, 22 bp, Artificial Sequence
  chemically synthesized
taaaccagggtttcttttcata

SEQ ID NO: 1231878 - DNA, 22 bp, Artificial Sequence
  chemically synthesized
attctataaacctatgaaaaga

SEQ ID NO: 1231879 - DNA, 22 bp, Artificial Sequence
  chemically synthesized
aaaccagggtttcttttcatag

SEQ ID NO: 1231880 - DNA, 22 bp, Artificial Sequence
  chemically synthesized
aaccagggtttcttttcatagg

SEQ ID NO: 1231881 - DNA, 22 bp, Artificial Sequence
  chemically synthesized
ctaattctataaacctatgaaa

SEQ ID NO: 1231882 - DNA, 22 bp, Artificial Sequence
  chemically synthesized
cttttcataggtttatagaatt

SEQ ID NO: 1231883 - DNA, 22 bp, Artificial Sequence
  chemically synthesized
ttttcataggtttatagaatta

SEQ ID NO: 1231884 - DNA, 22 bp, Artificial Sequence
  chemically synthesized
ttcataggtttatagaattagg

SEQ ID NO: 1231885 - DNA, 22 bp, Artificial Sequence
  chemically synthesized
tcataggtttatagaattagga

SEQ ID NO: 1231886 - DNA, 22 bp, Artificial Sequence
  chemically synthesized
cataggtttatagaattaggag

SEQ ID NO: 1231887 - DNA, 22 bp, Artificial Sequence
  chemically synthesized
ataggtttatagaattaggagg

SEQ ID NO: 1231888 - DNA, 22 bp, Artificial Sequence
  chemically synthesized
atagaattaggaggctgttcat

SEQ ID NO: 1231889 - DNA, 22 bp, Artificial Sequence
  chemically synthesized
atagaaaatcatatgaacagcc

SEQ ID NO: 1231890 - DNA, 22 bp, Artificial Sequence
  chemically synthesized
tagaattaggaggctgttcata

SEQ ID NO: 1231891 - DNA, 22 bp, Artificial Sequence
  chemically synthesized
ctaatagaaaatcatatgaaca

SEQ ID NO: 1231892 - DNA, 22 bp, Artificial Sequence
  chemically synthesized
ggaggctgttcatatgattttc

SEQ ID NO: 1231893 - DNA, 22 bp, Artificial Sequence
  chemically synthesized
ataattgctaatagaaaatcat

SEQ ID NO: 1231894 - DNA, 22 bp, Artificial Sequence
  chemically synthesized
ttcatatgattttctattagca

SEQ ID NO: 1231895 - DNA, 22 bp, Artificial Sequence
  chemically synthesized
atatgattttctattagcaatt

SEQ ID NO: 1231896 - DNA, 22 bp, Artificial Sequence
  chemically synthesized
tctattagcaattatcaatttc

SEQ ID NO: 1231897 - DNA, 22 bp, Artificial Sequence
  chemically synthesized
tccacacaccaagaaattgata

SEQ ID NO: 1231898 - DNA, 22 bp, Artificial Sequence
  chemically synthesized
ctattagcaattatcaatttct

SEQ ID NO: 1231899 - DNA, 22 bp, Artificial Sequence
  chemically synthesized
gtccacacaccaagaaattgat

SEQ ID NO: 1231900 - DNA, 22 bp, Artificial Sequence
  chemically synthesized
tattagcaattatcaatttctt

SEQ ID NO: 1231901 - DNA, 22 bp, Artificial Sequence
  chemically synthesized
ttagcaattatcaatttcttgg

SEQ ID NO: 1231902 - DNA, 22 bp, Artificial Sequence
  chemically synthesized
gcaattatcaatttcttggtgt

SEQ ID NO: 1231903 - DNA, 22 bp, Artificial Sequence
  chemically synthesized
tcaatttcttggtgtgtggaca

SEQ ID NO: 1231904 - DNA, 22 bp, Artificial Sequence
  chemically synthesized
aataccagtgataagtttgtcc

SEQ ID NO: 1231905 - DNA, 22 bp, Artificial Sequence
  chemically synthesized
gaataccagtgataagtttgtc

SEQ ID NO: 1231906 - DNA, 22 bp, Artificial Sequence
  chemically synthesized
cttggtgtgtggacaaacttat

SEQ ID NO: 1231907 - DNA, 22 bp, Artificial Sequence
  chemically synthesized
tgaataccagtgataagtttgt

SEQ ID NO: 1231908 - DNA, 22 bp, Artificial Sequence
  chemically synthesized
ttggtgtgtggacaaacttatc

SEQ ID NO: 1231909 - DNA, 22 bp, Artificial Sequence
  chemically synthesized
ttgaataccagtgataagtttg

SEQ ID NO: 1231910 - DNA, 22 bp, Artificial Sequence
  chemically synthesized
tttgaataccagtgataagttt

SEQ ID NO: 1231911 - DNA, 22 bp, Artificial Sequence
  chemically synthesized
ggtgtgtggacaaacttatcac

SEQ ID NO: 1231912 - DNA, 22 bp, Artificial Sequence
  chemically synthesized
ttttgaataccagtgataagtt

SEQ ID NO: 1231913 - DNA, 22 bp, Artificial Sequence
  chemically synthesized
gtgtgtggacaaacttatcact

SEQ ID NO: 1231914 - DNA, 22 bp, Artificial Sequence
  chemically synthesized
tttttgaataccagtgataagt

SEQ ID NO: 1231915 - DNA, 22 bp, Artificial Sequence
  chemically synthesized
ttttttgaataccagtgataag

SEQ ID NO: 1231916 - DNA, 22 bp, Artificial Sequence
  chemically synthesized
atcactggtattcaaaaaaaaa

SEQ ID NO: 1231917 - DNA, 22 bp, Artificial Sequence
  chemically synthesized
caaaaaaaaaaatttttttttg

SEQ ID NO: 1231918 - DNA, 22 bp, Artificial Sequence
  chemically synthesized
tcactggtattcaaaaaaaaat

SEQ ID NO: 1231919 - DNA, 22 bp, Artificial Sequence
  chemically synthesized
tctccaaaaaaaaaaatttttt

SEQ ID NO: 1231920 - DNA, 22 bp, Artificial Sequence
  chemically synthesized
gtctccaaaaaaaaaaattttt

SEQ ID NO: 1231921 - DNA, 22 bp, Artificial Sequence
  chemically synthesized
gtattcaaaaaaaaattttttt

SEQ ID NO: 1231922 - DNA, 22 bp, Artificial Sequence
  chemically synthesized
aaaaaaaaatttttttttttgg

SEQ ID NO: 1231923 - DNA, 22 bp, Artificial Sequence
  chemically synthesized
ggggatcgagcaagacttgtct

SEQ ID NO: 1231924 - DNA, 22 bp, Artificial Sequence
  chemically synthesized
ttttttttggagacaagtcttg

SEQ ID NO: 1231925 - DNA, 22 bp, Artificial Sequence
  chemically synthesized
tttttttggagacaagtcttgc

SEQ ID NO: 1231926 - DNA, 22 bp, Artificial Sequence
  chemically synthesized
ttttttggagacaagtcttgct

SEQ ID NO: 1231927 - DNA, 22 bp, Artificial Sequence
  chemically synthesized
tttttggagacaagtcttgctc

SEQ ID NO: 1231928 - DNA, 22 bp, Artificial Sequence
  chemically synthesized
gtctgggggatcgagcaagact

SEQ ID NO: 1231929 - DNA, 22 bp, Artificial Sequence
  chemically synthesized
ttttggagacaagtcttgctcg

SEQ ID NO: 1231930 - DNA, 22 bp, Artificial Sequence
  chemically synthesized
tttggagacaagtcttgctcga

SEQ ID NO: 1231931 - DNA, 22 bp, Artificial Sequence
  chemically synthesized
tagtctgggggatcgagcaaga

SEQ ID NO: 1231932 - DNA, 22 bp, Artificial Sequence
  chemically synthesized
ttggagacaagtcttgctcgat

SEQ ID NO: 1231933 - DNA, 22 bp, Artificial Sequence
  chemically synthesized
tggagacaagtcttgctcgatc

SEQ ID NO: 1231934 - DNA, 22 bp, Artificial Sequence
  chemically synthesized
ggagacaagtcttgctcgatcc

SEQ ID NO: 1231935 - DNA, 22 bp, Artificial Sequence
  chemically synthesized
gagacaagtcttgctcgatccc

SEQ ID NO: 1231936 - DNA, 22 bp, Artificial Sequence
  chemically synthesized
cactctagtctgggggatcgag

SEQ ID NO: 1231937 - DNA, 22 bp, Artificial Sequence
  chemically synthesized
gctcgatcccccagactagagt

SEQ ID NO: 1231938 - DNA, 22 bp, Artificial Sequence
  chemically synthesized
ctcgatcccccagactagagtg

SEQ ID NO: 1231939 - DNA, 22 bp, Artificial Sequence
  chemically synthesized
gatcccccagactagagtgcag

SEQ ID NO: 1231940 - DNA, 22 bp, Artificial Sequence
  chemically synthesized
agaggtgatcataccactgcac

SEQ ID NO: 1231941 - DNA, 22 bp, Artificial Sequence
  chemically synthesized
cactgagaggtgatcataccac

SEQ ID NO: 1231942 - DNA, 22 bp, Artificial Sequence
  chemically synthesized
gagtgcagtggtatgatcacct

SEQ ID NO: 1231943 - DNA, 22 bp, Artificial Sequence
  chemically synthesized
aacccatgaggcggaggttgca

SEQ ID NO: 1231944 - DNA, 22 bp, Artificial Sequence
  chemically synthesized
gaacccatgaggcggaggttgc

SEQ ID NO: 1231945 - DNA, 22 bp, Artificial Sequence
  chemically synthesized
tcagtgcaacctccgcctcatg

SEQ ID NO: 1231946 - DNA, 22 bp, Artificial Sequence
  chemically synthesized
agtgcaacctccgcctcatggg

SEQ ID NO: 1231947 - DNA, 22 bp, Artificial Sequence
  chemically synthesized
aggcatgagaatcacttgaacc

SEQ ID NO: 1231948 - DNA, 22 bp, Artificial Sequence
  chemically synthesized
cgcctcatgggttcaagtgatt

SEQ ID NO: 1231949 - DNA, 22 bp, Artificial Sequence
  chemically synthesized
atgggttcaagtgattctcatg

SEQ ID NO: 1231950 - DNA, 22 bp, Artificial Sequence
  chemically synthesized
gggaggctgaggcatgagaatc

SEQ ID NO: 1231951 - DNA, 22 bp, Artificial Sequence
  chemically synthesized
ctggggaggctgaggcatgaga

SEQ ID NO: 1231952 - DNA, 22 bp, Artificial Sequence
  chemically synthesized
aagtgattctcatgcctcagcc

SEQ ID NO: 1231953 - DNA, 22 bp, Artificial Sequence
  chemically synthesized
cagctactggggaggctgaggc

SEQ ID NO: 1231954 - DNA, 22 bp, Artificial Sequence
  chemically synthesized
taattccagctactggggaggc

SEQ ID NO: 1231955 - DNA, 22 bp, Artificial Sequence
  chemically synthesized
tcatgcctcagcctccccagta

SEQ ID NO: 1231956 - DNA, 22 bp, Artificial Sequence
  chemically synthesized
atgcctcagcctccccagtagc

SEQ ID NO: 1231957 - DNA, 22 bp, Artificial Sequence
  chemically synthesized
gcgcctgtaattccagctactg

SEQ ID NO: 1231958 - DNA, 22 bp, Artificial Sequence
  chemically synthesized
agcctccccagtagctggaatt

SEQ ID NO: 1231959 - DNA, 22 bp, Artificial Sequence
  chemically synthesized
cccagtagctggaattacaggc

SEQ ID NO: 1231960 - DNA, 22 bp, Artificial Sequence
  chemically synthesized
gacgggtgtggtggctggcgcc

SEQ ID NO: 1231961 - DNA, 22 bp, Artificial Sequence
  chemically synthesized
gaattacaggcgccagccacca

SEQ ID NO: 1231962 - DNA, 22 bp, Artificial Sequence
  chemically synthesized
caggcgccagccaccacacccg

SEQ ID NO: 1231963 - DNA, 22 bp, Artificial Sequence
  chemically synthesized
aaaaaaaaaaaattagacgggt

SEQ ID NO: 1231964 - DNA, 22 bp, Artificial Sequence
  chemically synthesized
ctaaaaaaaaaaaaattagacg

SEQ ID NO: 1231965 - DNA, 22 bp, Artificial Sequence
  chemically synthesized
tactaaaaaaaaaaaaattaga

SEQ ID NO: 1231966 - DNA, 22 bp, Artificial Sequence
  chemically synthesized
atttttttttttttagtagaga

SEQ ID NO: 1231967 - DNA, 22 bp, Artificial Sequence
  chemically synthesized
ttttttttttagtagagacggg

SEQ ID NO: 1231968 - DNA, 22 bp, Artificial Sequence
  chemically synthesized
tttttttttagtagagacgggg

SEQ ID NO: 1231969 - DNA, 22 bp, Artificial Sequence
  chemically synthesized
ttttttttagtagagacggggt

SEQ ID NO: 1231970 - DNA, 22 bp, Artificial Sequence
  chemically synthesized
tttttttagtagagacggggtt

SEQ ID NO: 1231971 - DNA, 22 bp, Artificial Sequence
  chemically synthesized
ttttttagtagagacggggttt

SEQ ID NO: 1231972 - DNA, 22 bp, Artificial Sequence
  chemically synthesized
gccaacatggcaaaaccccgtc

SEQ ID NO: 1231973 - DNA, 22 bp, Artificial Sequence
  chemically synthesized
tttttagtagagacggggtttt

SEQ ID NO: 1231974 - DNA, 22 bp, Artificial Sequence
  chemically synthesized
ttttagtagagacggggttttg

SEQ ID NO: 1231975 - DNA, 22 bp, Artificial Sequence
  chemically synthesized
tttagtagagacggggttttgc

SEQ ID NO: 1231976 - DNA, 22 bp, Artificial Sequence
  chemically synthesized
ttagtagagacggggttttgcc

SEQ ID NO: 1231977 - DNA, 22 bp, Artificial Sequence
  chemically synthesized
tagtagagacggggttttgcca

SEQ ID NO: 1231978 - DNA, 22 bp, Artificial Sequence
  chemically synthesized
agtagagacggggttttgccat

SEQ ID NO: 1231979 - DNA, 22 bp, Artificial Sequence
  chemically synthesized
gtagagacggggttttgccatg

SEQ ID NO: 1231980 - DNA, 22 bp, Artificial Sequence
  chemically synthesized
gagaccatcctggccaacatgg

SEQ ID NO: 1231981 - DNA, 22 bp, Artificial Sequence
  chemically synthesized
tgccatgttggccaggatggtc

SEQ ID NO: 1231982 - DNA, 22 bp, Artificial Sequence
  chemically synthesized
gccatgttggccaggatggtct

SEQ ID NO: 1231983 - DNA, 22 bp, Artificial Sequence
  chemically synthesized
ccatgttggccaggatggtctc

SEQ ID NO: 1231984 - DNA, 22 bp, Artificial Sequence
  chemically synthesized
aggtcaggagttcgagaccatc

SEQ ID NO: 1231985 - DNA, 22 bp, Artificial Sequence
  chemically synthesized
gccaggatggtctcgaactcct

SEQ ID NO: 1231986 - DNA, 22 bp, Artificial Sequence
  chemically synthesized
gggcgggcagatcacctgaggt

SEQ ID NO: 1231987 - DNA, 22 bp, Artificial Sequence
  chemically synthesized
gaactcctgacctcaggtgatc

SEQ ID NO: 1231988 - DNA, 22 bp, Artificial Sequence
  chemically synthesized
ggaggctggggcgggcagatca

SEQ ID NO: 1231989 - DNA, 22 bp, Artificial Sequence
  chemically synthesized
ctgacctcaggtgatctgcccg

SEQ ID NO: 1231990 - DNA, 22 bp, Artificial Sequence
  chemically synthesized
gggaggctggggcgggcagatc

SEQ ID NO: 1231991 - DNA, 22 bp, Artificial Sequence
  chemically synthesized
tgggaggctggggcgggcagat

SEQ ID NO: 1231992 - DNA, 22 bp, Artificial Sequence
  chemically synthesized
acctcaggtgatctgcccgccc

SEQ ID NO: 1231993 - DNA, 22 bp, Artificial Sequence
  chemically synthesized
aggtgatctgcccgccccagcc

SEQ ID NO: 1231994 - DNA, 22 bp, Artificial Sequence
  chemically synthesized
taatcccagcactttgggaggc

SEQ ID NO: 1231995 - DNA, 22 bp, Artificial Sequence
  chemically synthesized
cccgccccagcctcccaaagtg

SEQ ID NO: 1231996 - DNA, 22 bp, Artificial Sequence
  chemically synthesized
acacctgtaatcccagcacttt

SEQ ID NO: 1231997 - DNA, 22 bp, Artificial Sequence
  chemically synthesized
ccaaagtgctgggattacaggt

SEQ ID NO: 1231998 - DNA, 22 bp, Artificial Sequence
  chemically synthesized
aggccgagcgtggtggctcaca

SEQ ID NO: 1231999 - DNA, 22 bp, Artificial Sequence
  chemically synthesized
ggattacaggtgtgagccacca

SEQ ID NO: 1232000 - DNA, 22 bp, Artificial Sequence
  chemically synthesized
caggtgtgagccaccacgctcg

SEQ ID NO: 1232001 - DNA, 22 bp, Artificial Sequence
  chemically synthesized
taaaaaatgaagttgaggccga

SEQ ID NO: 1232002 - DNA, 22 bp, Artificial Sequence
  chemically synthesized
ttataaaaaatgaagttgaggc

SEQ ID NO: 1232003 - DNA, 22 bp, Artificial Sequence
  chemically synthesized
attataaaaaatgaagttgagg

SEQ ID NO: 1232004 - DNA, 22 bp, Artificial Sequence
  chemically synthesized
ggcctcaacttcattttttata

SEQ ID NO: 1232005 - DNA, 22 bp, Artificial Sequence
  chemically synthesized
aacttcattttttataataaac

SEQ ID NO: 1232006 - DNA, 22 bp, Artificial Sequence
  chemically synthesized
cattttttataataaacatata

SEQ ID NO: 1232007 - DNA, 22 bp, Artificial Sequence
  chemically synthesized
cacagaaatacatatatgttta

SEQ ID NO: 1232008 - DNA, 22 bp, Artificial Sequence
  chemically synthesized
attttttataataaacatatat

SEQ ID NO: 1232009 - DNA, 22 bp, Artificial Sequence
  chemically synthesized
acacagaaatacatatatgttt

SEQ ID NO: 1232010 - DNA, 22 bp, Artificial Sequence
  chemically synthesized
tacacagaaatacatatatgtt

SEQ ID NO: 1232011 - DNA, 22 bp, Artificial Sequence
  chemically synthesized
tttataataaacatatatgtat

SEQ ID NO: 1232012 - DNA, 22 bp, Artificial Sequence
  chemically synthesized
ttataataaacatatatgtatt

SEQ ID NO: 1232013 - DNA, 22 bp, Artificial Sequence
  chemically synthesized
tataataaacatatatgtattt

SEQ ID NO: 1232014 - DNA, 22 bp, Artificial Sequence
  chemically synthesized
ataataaacatatatgtatttc

SEQ ID NO: 1232015 - DNA, 22 bp, Artificial Sequence
  chemically synthesized
taataaacatatatgtatttct

SEQ ID NO: 1232016 - DNA, 22 bp, Artificial Sequence
  chemically synthesized
ctgtgtaaaacccgtttttggt

SEQ ID NO: 1232017 - DNA, 22 bp, Artificial Sequence
  chemically synthesized
tgtgtaaaacccgtttttggtt

SEQ ID NO: 1232018 - DNA, 22 bp, Artificial Sequence
  chemically synthesized
tgtaaaacccgtttttggtttc

SEQ ID NO: 1232019 - DNA, 22 bp, Artificial Sequence
  chemically synthesized
agtatgagatatagaaaccaaa

SEQ ID NO: 1232020 - DNA, 22 bp, Artificial Sequence
  chemically synthesized
ttggtttctatatctcatactt

SEQ ID NO: 1232021 - DNA, 22 bp, Artificial Sequence
  chemically synthesized
tggtttctatatctcatactta

SEQ ID NO: 1232022 - DNA, 22 bp, Artificial Sequence
  chemically synthesized
ggtttctatatctcatacttaa

SEQ ID NO: 1232023 - DNA, 22 bp, Artificial Sequence
  chemically synthesized
gtttctatatctcatacttaat

SEQ ID NO: 1232024 - DNA, 22 bp, Artificial Sequence
  chemically synthesized
ctatatctcatacttaatattt

SEQ ID NO: 1232025 - DNA, 22 bp, Artificial Sequence
  chemically synthesized
aaaatggaagggaaatattaag

SEQ ID NO: 1232026 - DNA, 22 bp, Artificial Sequence
  chemically synthesized
tatatctcatacttaatatttc

SEQ ID NO: 1232027 - DNA, 22 bp, Artificial Sequence
  chemically synthesized
aaaaatggaagggaaatattaa

SEQ ID NO: 1232028 - DNA, 22 bp, Artificial Sequence
  chemically synthesized
tatctcatacttaatatttccc

SEQ ID NO: 1232029 - DNA, 22 bp, Artificial Sequence
  chemically synthesized
atacttaatatttcccttccat

SEQ ID NO: 1232030 - DNA, 22 bp, Artificial Sequence
  chemically synthesized
aatatttcccttccatttttaa

SEQ ID NO: 1232031 - DNA, 22 bp, Artificial Sequence
  chemically synthesized
atatttcccttccatttttaaa

SEQ ID NO: 1232032 - DNA, 22 bp, Artificial Sequence
  chemically synthesized
cccttccatttttaaactgcat

SEQ ID NO: 1232033 - DNA, 22 bp, Artificial Sequence
  chemically synthesized
ccttccatttttaaactgcata

SEQ ID NO: 1232034 - DNA, 22 bp, Artificial Sequence
  chemically synthesized
ccatttttaaactgcatacatt

SEQ ID NO: 1232035 - DNA, 22 bp, Artificial Sequence
  chemically synthesized
catttttaaactgcatacattt

SEQ ID NO: 1232036 - DNA, 22 bp, Artificial Sequence
  chemically synthesized
ttaaactgcatacatttgtttt

SEQ ID NO: 1232037 - DNA, 22 bp, Artificial Sequence
  chemically synthesized
taaactgcatacatttgttttt

SEQ ID NO: 1232038 - DNA, 22 bp, Artificial Sequence
  chemically synthesized
aaactgcatacatttgtttttc

SEQ ID NO: 1232039 - DNA, 22 bp, Artificial Sequence
  chemically synthesized
aactgcatacatttgtttttct

SEQ ID NO: 1232040 - DNA, 22 bp, Artificial Sequence
  chemically synthesized
catacatttgtttttctccctc

SEQ ID NO: 1232041 - DNA, 22 bp, Artificial Sequence
  chemically synthesized
tgaatgtgatccagacaaggag

SEQ ID NO: 1232042 - DNA, 22 bp, Artificial Sequence
  chemically synthesized
atgaatgtgatccagacaagga

SEQ ID NO: 1232043 - DNA, 22 bp, Artificial Sequence
  chemically synthesized
gtttttctccctccttgtctgg

SEQ ID NO: 1232044 - DNA, 22 bp, Artificial Sequence
  chemically synthesized
tttttctccctccttgtctgga

SEQ ID NO: 1232045 - DNA, 22 bp, Artificial Sequence
  chemically synthesized
ttctccctccttgtctggatca

SEQ ID NO: 1232046 - DNA, 22 bp, Artificial Sequence
  chemically synthesized
tctccctccttgtctggatcac

SEQ ID NO: 1232047 - DNA, 22 bp, Artificial Sequence
  chemically synthesized
ctccctccttgtctggatcaca

SEQ ID NO: 1232048 - DNA, 22 bp, Artificial Sequence
  chemically synthesized
atatcttatgaatgtgatccag

SEQ ID NO: 1232049 - DNA, 22 bp, Artificial Sequence
  chemically synthesized
tccctccttgtctggatcacat

SEQ ID NO: 1232050 - DNA, 22 bp, Artificial Sequence
  chemically synthesized
cctccttgtctggatcacattc

SEQ ID NO: 1232051 - DNA, 22 bp, Artificial Sequence
  chemically synthesized
cttgtctggatcacattcataa

SEQ ID NO: 1232052 - DNA, 22 bp, Artificial Sequence
  chemically synthesized
gtctggatcacattcataagat

SEQ ID NO: 1232053 - DNA, 22 bp, Artificial Sequence
  chemically synthesized
tctggatcacattcataagata

SEQ ID NO: 1232054 - DNA, 22 bp, Artificial Sequence
  chemically synthesized
gatcacattcataagatattaa

SEQ ID NO: 1232055 - DNA, 22 bp, Artificial Sequence
  chemically synthesized
taatatgaaatagattaatatc

SEQ ID NO: 1232056 - DNA, 22 bp, Artificial Sequence
  chemically synthesized
ataatatgaaatagattaatat

SEQ ID NO: 1232057 - DNA, 22 bp, Artificial Sequence
  chemically synthesized
cttataatatgaaatagattaa

SEQ ID NO: 1232058 - DNA, 22 bp, Artificial Sequence
  chemically synthesized
ataagatattaatctatttcat

SEQ ID NO: 1232059 - DNA, 22 bp, Artificial Sequence
  chemically synthesized
gttccttataatatgaaataga

SEQ ID NO: 1232060 - DNA, 22 bp, Artificial Sequence
  chemically synthesized
atctatttcatattataaggaa

SEQ ID NO: 1232061 - DNA, 22 bp, Artificial Sequence
  chemically synthesized
tttcatattataaggaactagc

SEQ ID NO: 1232062 - DNA, 22 bp, Artificial Sequence
  chemically synthesized
gataaaatatacagctagttcc

SEQ ID NO: 1232063 - DNA, 22 bp, Artificial Sequence
  chemically synthesized
catattataaggaactagctgt

SEQ ID NO: 1232064 - DNA, 22 bp, Artificial Sequence
  chemically synthesized
atattataaggaactagctgta

SEQ ID NO: 1232065 - DNA, 22 bp, Artificial Sequence
  chemically synthesized
taaggaactagctgtatatttt

SEQ ID NO: 1232066 - DNA, 22 bp, Artificial Sequence
  chemically synthesized
gctgtatattttatctagtgtt

SEQ ID NO: 1232067 - DNA, 22 bp, Artificial Sequence
  chemically synthesized
tatattttatctagtgtttctt

SEQ ID NO: 1232068 - DNA, 22 bp, Artificial Sequence
  chemically synthesized
aagataaagaaatagaagaaac

SEQ ID NO: 1232069 - DNA, 22 bp, Artificial Sequence
  chemically synthesized
tatctagtgtttcttctatttc

SEQ ID NO: 1232070 - DNA, 22 bp, Artificial Sequence
  chemically synthesized
atctagtgtttcttctatttct

SEQ ID NO: 1232071 - DNA, 22 bp, Artificial Sequence
  chemically synthesized
tctagtgtttcttctatttctt

SEQ ID NO: 1232072 - DNA, 22 bp, Artificial Sequence
  chemically synthesized
gtgtttcttctatttctttatc

SEQ ID NO: 1232073 - DNA, 22 bp, Artificial Sequence
  chemically synthesized
cttctatttctttatctttagt

SEQ ID NO: 1232074 - DNA, 22 bp, Artificial Sequence
  chemically synthesized
aggaaagcaggaactaaagata

SEQ ID NO: 1232075 - DNA, 22 bp, Artificial Sequence
  chemically synthesized
ttctatttctttatctttagtt

SEQ ID NO: 1232076 - DNA, 22 bp, Artificial Sequence
  chemically synthesized
aaggaaagcaggaactaaagat

SEQ ID NO: 1232077 - DNA, 22 bp, Artificial Sequence
  chemically synthesized
taaggaaagcaggaactaaaga

SEQ ID NO: 1232078 - DNA, 22 bp, Artificial Sequence
  chemically synthesized
ctatttctttatctttagttcc

SEQ ID NO: 1232079 - DNA, 22 bp, Artificial Sequence
  chemically synthesized
tatttctttatctttagttcct

SEQ ID NO: 1232080 - DNA, 22 bp, Artificial Sequence
  chemically synthesized
tttctttatctttagttcctgc

SEQ ID NO: 1232081 - DNA, 22 bp, Artificial Sequence
  chemically synthesized
ctttatctttagttcctgcttt

SEQ ID NO: 1232082 - DNA, 22 bp, Artificial Sequence
  chemically synthesized
tttatctttagttcctgctttc

SEQ ID NO: 1232083 - DNA, 22 bp, Artificial Sequence
  chemically synthesized
tatctttagttcctgctttcct

SEQ ID NO: 1232084 - DNA, 22 bp, Artificial Sequence
  chemically synthesized
atctttagttcctgctttcctt

SEQ ID NO: 1232085 - DNA, 22 bp, Artificial Sequence
  chemically synthesized
caaaaatgctttaaggaaagca

SEQ ID NO: 1232086 - DNA, 22 bp, Artificial Sequence
  chemically synthesized
tctttagttcctgctttcctta

SEQ ID NO: 1232087 - DNA, 22 bp, Artificial Sequence
  chemically synthesized
tagttcctgctttccttaaagc

SEQ ID NO: 1232088 - DNA, 22 bp, Artificial Sequence
  chemically synthesized
agttcctgctttccttaaagca

SEQ ID NO: 1232089 - DNA, 22 bp, Artificial Sequence
  chemically synthesized
gttcctgctttccttaaagcat

SEQ ID NO: 1232090 - DNA, 22 bp, Artificial Sequence
  chemically synthesized
ctgctttccttaaagcattttt

SEQ ID NO: 1232091 - DNA, 22 bp, Artificial Sequence
  chemically synthesized
ctttccttaaagcatttttgta

SEQ ID NO: 1232092 - DNA, 22 bp, Artificial Sequence
  chemically synthesized
aaataaaaatgttacaaaaatg

SEQ ID NO: 1232093 - DNA, 22 bp, Artificial Sequence
  chemically synthesized
caaataaaaatgttacaaaaat

SEQ ID NO: 1232094 - DNA, 22 bp, Artificial Sequence
  chemically synthesized
tcaaataaaaatgttacaaaaa

SEQ ID NO: 1232095 - DNA, 22 bp, Artificial Sequence
  chemically synthesized
tccttaaagcatttttgtaaca

SEQ ID NO: 1232096 - DNA, 22 bp, Artificial Sequence
  chemically synthesized
ccttaaagcatttttgtaacat

SEQ ID NO: 1232097 - DNA, 22 bp, Artificial Sequence
  chemically synthesized
cttaaagcatttttgtaacatt

SEQ ID NO: 1232098 - DNA, 22 bp, Artificial Sequence
  chemically synthesized
aaagcatttttgtaacattttt

SEQ ID NO: 1232099 - DNA, 22 bp, Artificial Sequence
  chemically synthesized
aagcatttttgtaacattttta

SEQ ID NO: 1232100 - DNA, 22 bp, Artificial Sequence
  chemically synthesized
aatcaagctttcaaataaaaat

SEQ ID NO: 1232101 - DNA, 22 bp, Artificial Sequence
  chemically synthesized
ttgtaacatttttatttgaaag

SEQ ID NO: 1232102 - DNA, 22 bp, Artificial Sequence
  chemically synthesized
tgtaacatttttatttgaaagc

SEQ ID NO: 1232103 - DNA, 22 bp, Artificial Sequence
  chemically synthesized
gtaacatttttatttgaaagct

SEQ ID NO: 1232104 - DNA, 22 bp, Artificial Sequence
  chemically synthesized
taacatttttatttgaaagctt

SEQ ID NO: 1232105 - DNA, 22 bp, Artificial Sequence
  chemically synthesized
aaaagataaattgaatcaagct

SEQ ID NO: 1232106 - DNA, 22 bp, Artificial Sequence
  chemically synthesized
ttatttgaaagcttgattcaat

SEQ ID NO: 1232107 - DNA, 22 bp, Artificial Sequence
  chemically synthesized
tatttgaaagcttgattcaatt

SEQ ID NO: 1232108 - DNA, 22 bp, Artificial Sequence
  chemically synthesized
attaaaaagataaattgaatca

SEQ ID NO: 1232109 - DNA, 22 bp, Artificial Sequence
  chemically synthesized
atttgaaagcttgattcaattt

SEQ ID NO: 1232110 - DNA, 22 bp, Artificial Sequence
  chemically synthesized
cattaaaaagataaattgaatc

SEQ ID NO: 1232111 - DNA, 22 bp, Artificial Sequence
  chemically synthesized
tttgaaagcttgattcaattta

SEQ ID NO: 1232112 - DNA, 22 bp, Artificial Sequence
  chemically synthesized
gaaagcttgattcaatttatct

SEQ ID NO: 1232113 - DNA, 22 bp, Artificial Sequence
  chemically synthesized
aaagcttgattcaatttatctt

SEQ ID NO: 1232114 - DNA, 22 bp, Artificial Sequence
  chemically synthesized
atcttcattaaaaagataaatt

SEQ ID NO: 1232115 - DNA, 22 bp, Artificial Sequence
  chemically synthesized
gatcttcattaaaaagataaat

SEQ ID NO: 1232116 - DNA, 22 bp, Artificial Sequence
  chemically synthesized
tgatcttcattaaaaagataaa

SEQ ID NO: 1232117 - DNA, 22 bp, Artificial Sequence
  chemically synthesized
attttgatcttcattaaaaaga

SEQ ID NO: 1232118 - DNA, 22 bp, Artificial Sequence
  chemically synthesized
gattcaatttatctttttaatg

SEQ ID NO: 1232119 - DNA, 22 bp, Artificial Sequence
  chemically synthesized
gattttgatcttcattaaaaag

SEQ ID NO: 1232120 - DNA, 22 bp, Artificial Sequence
  chemically synthesized
attcaatttatctttttaatga

SEQ ID NO: 1232121 - DNA, 22 bp, Artificial Sequence
  chemically synthesized
tgattttgatcttcattaaaaa

SEQ ID NO: 1232122 - DNA, 22 bp, Artificial Sequence
  chemically synthesized
aatttatctttttaatgaagat

SEQ ID NO: 1232123 - DNA, 22 bp, Artificial Sequence
  chemically synthesized
tctttgattttgatcttcatta

SEQ ID NO: 1232124 - DNA, 22 bp, Artificial Sequence
  chemically synthesized
gtctttgattttgatcttcatt

SEQ ID NO: 1232125 - DNA, 22 bp, Artificial Sequence
  chemically synthesized
tgtctttgattttgatcttcat

SEQ ID NO: 1232126 - DNA, 22 bp, Artificial Sequence
  chemically synthesized
ttgtctttgattttgatcttca

SEQ ID NO: 1232127 - DNA, 22 bp, Artificial Sequence
  chemically synthesized
atctttttaatgaagatcaaaa

SEQ ID NO: 1232128 - DNA, 22 bp, Artificial Sequence
  chemically synthesized
tctttttaatgaagatcaaaat

SEQ ID NO: 1232129 - DNA, 22 bp, Artificial Sequence
  chemically synthesized
aatttttgtctttgattttgat

SEQ ID NO: 1232130 - DNA, 22 bp, Artificial Sequence
  chemically synthesized
gaatttttgtctttgattttga

SEQ ID NO: 1232131 - DNA, 22 bp, Artificial Sequence
  chemically synthesized
tttaatgaagatcaaaatcaaa

SEQ ID NO: 1232132 - DNA, 22 bp, Artificial Sequence
  chemically synthesized
ttaatgaagatcaaaatcaaag

SEQ ID NO: 1232133 - DNA, 22 bp, Artificial Sequence
  chemically synthesized
taatgaagatcaaaatcaaaga

SEQ ID NO: 1232134 - DNA, 22 bp, Artificial Sequence
  chemically synthesized
aatgaagatcaaaatcaaagac

SEQ ID NO: 1232135 - DNA, 22 bp, Artificial Sequence
  chemically synthesized
atgaagatcaaaatcaaagaca

SEQ ID NO: 1232136 - DNA, 22 bp, Artificial Sequence
  chemically synthesized
agagtttgaatttttgtctttg

SEQ ID NO: 1232137 - DNA, 22 bp, Artificial Sequence
  chemically synthesized
tactgagagtttgaatttttgt

SEQ ID NO: 1232138 - DNA, 22 bp, Artificial Sequence
  chemically synthesized
aggctgtactgagagtttgaat

SEQ ID NO: 1232139 - DNA, 22 bp, Artificial Sequence
  chemically synthesized
aaactctcagtacagcctgagc

SEQ ID NO: 1232140 - DNA, 22 bp, Artificial Sequence
  chemically synthesized
tcagtacagcctgagccatttc

SEQ ID NO: 1232141 - DNA, 22 bp, Artificial Sequence
  chemically synthesized
agtacagcctgagccatttctc

SEQ ID NO: 1232142 - DNA, 22 bp, Artificial Sequence
  chemically synthesized
catatgaaaacccatgagaaat

SEQ ID NO: 1232143 - DNA, 22 bp, Artificial Sequence
  chemically synthesized
agccatttctcatgggttttca

SEQ ID NO: 1232144 - DNA, 22 bp, Artificial Sequence
  chemically synthesized
ctcatgggttttcatatggaat

SEQ ID NO: 1232145 - DNA, 22 bp, Artificial Sequence
  chemically synthesized
tcatgggttttcatatggaatg

SEQ ID NO: 1232146 - DNA, 22 bp, Artificial Sequence
  chemically synthesized
tgaaggaaaaagcattccatat

SEQ ID NO: 1232147 - DNA, 22 bp, Artificial Sequence
  chemically synthesized
gtgaaggaaaaagcattccata

SEQ ID NO: 1232148 - DNA, 22 bp, Artificial Sequence
  chemically synthesized
atgggttttcatatggaatgct

SEQ ID NO: 1232149 - DNA, 22 bp, Artificial Sequence
  chemically synthesized
catttgtgaaggaaaaagcatt

SEQ ID NO: 1232150 - DNA, 22 bp, Artificial Sequence
  chemically synthesized
tcatatggaatgctttttcctt

SEQ ID NO: 1232151 - DNA, 22 bp, Artificial Sequence
  chemically synthesized
catatggaatgctttttccttc

SEQ ID NO: 1232152 - DNA, 22 bp, Artificial Sequence
  chemically synthesized
atatggaatgctttttccttca

SEQ ID NO: 1232153 - DNA, 22 bp, Artificial Sequence
  chemically synthesized
tttccttcacaaatgtagtttt

SEQ ID NO: 1232154 - DNA, 22 bp, Artificial Sequence
  chemically synthesized
aaccaagagtataaaactacat

SEQ ID NO: 1232155 - DNA, 22 bp, Artificial Sequence
  chemically synthesized
ttccttcacaaatgtagtttta

SEQ ID NO: 1232156 - DNA, 22 bp, Artificial Sequence
  chemically synthesized
tccttcacaaatgtagttttat

SEQ ID NO: 1232157 - DNA, 22 bp, Artificial Sequence
  chemically synthesized
ccttcacaaatgtagttttata

SEQ ID NO: 1232158 - DNA, 22 bp, Artificial Sequence
  chemically synthesized
ttaaaccaagagtataaaacta

SEQ ID NO: 1232159 - DNA, 22 bp, Artificial Sequence
  chemically synthesized
cttcacaaatgtagttttatac

SEQ ID NO: 1232160 - DNA, 22 bp, Artificial Sequence
  chemically synthesized
gttaaaccaagagtataaaact

SEQ ID NO: 1232161 - DNA, 22 bp, Artificial Sequence
  chemically synthesized
cacaaatgtagttttatactct

SEQ ID NO: 1232162 - DNA, 22 bp, Artificial Sequence
  chemically synthesized
acaaatgtagttttatactctt

SEQ ID NO: 1232163 - DNA, 22 bp, Artificial Sequence
  chemically synthesized
aggtttgttaaaccaagagtat

SEQ ID NO: 1232164 - DNA, 22 bp, Artificial Sequence
  chemically synthesized
attaaggtttgttaaaccaaga

SEQ ID NO: 1232165 - DNA, 22 bp, Artificial Sequence
  chemically synthesized
gattaaggtttgttaaaccaag

SEQ ID NO: 1232166 - DNA, 22 bp, Artificial Sequence
  chemically synthesized
agtttgattaaggtttgttaaa

SEQ ID NO: 1232167 - DNA, 22 bp, Artificial Sequence
  chemically synthesized
tatactcttggtttaacaaacc

SEQ ID NO: 1232168 - DNA, 22 bp, Artificial Sequence
  chemically synthesized
atactcttggtttaacaaacct

SEQ ID NO: 1232169 - DNA, 22 bp, Artificial Sequence
  chemically synthesized
tactcttggtttaacaaacctt

SEQ ID NO: 1232170 - DNA, 22 bp, Artificial Sequence
  chemically synthesized
taaattaagtttgattaaggtt

SEQ ID NO: 1232171 - DNA, 22 bp, Artificial Sequence
  chemically synthesized
ttggtttaacaaaccttaatca

SEQ ID NO: 1232172 - DNA, 22 bp, Artificial Sequence
  chemically synthesized
ataaattaagtttgattaaggt

SEQ ID NO: 1232173 - DNA, 22 bp, Artificial Sequence
  chemically synthesized
ggtttaacaaaccttaatcaaa

SEQ ID NO: 1232174 - DNA, 22 bp, Artificial Sequence
  chemically synthesized
gtttaacaaaccttaatcaaac

SEQ ID NO: 1232175 - DNA, 22 bp, Artificial Sequence
  chemically synthesized
aacaaaccttaatcaaacttaa

SEQ ID NO: 1232176 - DNA, 22 bp, Artificial Sequence
  chemically synthesized
acaaaccttaatcaaacttaat

SEQ ID NO: 1232177 - DNA, 22 bp, Artificial Sequence
  chemically synthesized
ataatatacttataaattaagt

SEQ ID NO: 1232178 - DNA, 22 bp, Artificial Sequence
  chemically synthesized
aatcaaacttaatttataagta

SEQ ID NO: 1232179 - DNA, 22 bp, Artificial Sequence
  chemically synthesized
atcaaacttaatttataagtat

SEQ ID NO: 1232180 - DNA, 22 bp, Artificial Sequence
  chemically synthesized
aatttataagtatattattagt

SEQ ID NO: 1232181 - DNA, 22 bp, Artificial Sequence
  chemically synthesized
ataacagtagaaactaataata

SEQ ID NO: 1232182 - DNA, 22 bp, Artificial Sequence
  chemically synthesized
atttataagtatattattagtt

SEQ ID NO: 1232183 - DNA, 22 bp, Artificial Sequence
  chemically synthesized
aataacagtagaaactaataat

SEQ ID NO: 1232184 - DNA, 22 bp, Artificial Sequence
  chemically synthesized
tttaataacagtagaaactaat

SEQ ID NO: 1232185 - DNA, 22 bp, Artificial Sequence
  chemically synthesized
ataagtatattattagtttcta

SEQ ID NO: 1232186 - DNA, 22 bp, Artificial Sequence
  chemically synthesized
taagtatattattagtttctac

SEQ ID NO: 1232187 - DNA, 22 bp, Artificial Sequence
  chemically synthesized
atgttatttaataacagtagaa

SEQ ID NO: 1232188 - DNA, 22 bp, Artificial Sequence
  chemically synthesized
ttagtttctactgttattaaat

SEQ ID NO: 1232189 - DNA, 22 bp, Artificial Sequence
  chemically synthesized
aaaattcatgttatttaataac

SEQ ID NO: 1232190 - DNA, 22 bp, Artificial Sequence
  chemically synthesized
caaaattcatgttatttaataa

SEQ ID NO: 1232191 - DNA, 22 bp, Artificial Sequence
  chemically synthesized
tcaaaattcatgttatttaata

SEQ ID NO: 1232192 - DNA, 22 bp, Artificial Sequence
  chemically synthesized
gtttctactgttattaaataac

SEQ ID NO: 1232193 - DNA, 22 bp, Artificial Sequence
  chemically synthesized
ctactgttattaaataacatga

SEQ ID NO: 1232194 - DNA, 22 bp, Artificial Sequence
  chemically synthesized
tactgttattaaataacatgaa

SEQ ID NO: 1232195 - DNA, 22 bp, Artificial Sequence
  chemically synthesized
ctgttattaaataacatgaatt

SEQ ID NO: 1232196 - DNA, 22 bp, Artificial Sequence
  chemically synthesized
ttattaaataacatgaattttg

SEQ ID NO: 1232197 - DNA, 22 bp, Artificial Sequence
  chemically synthesized
ttaaataacatgaattttgaaa

SEQ ID NO: 1232198 - DNA, 22 bp, Artificial Sequence
  chemically synthesized
aatacacacaaactttcaaaat

SEQ ID NO: 1232199 - DNA, 22 bp, Artificial Sequence
  chemically synthesized
aataacatgaattttgaaagtt

SEQ ID NO: 1232200 - DNA, 22 bp, Artificial Sequence
  chemically synthesized
tgaaagtttgtgtgtatttaat

SEQ ID NO: 1232201 - DNA, 22 bp, Artificial Sequence
  chemically synthesized
gaaagtttgtgtgtatttaatg

SEQ ID NO: 1232202 - DNA, 22 bp, Artificial Sequence
  chemically synthesized
aaagtttgtgtgtatttaatga

SEQ ID NO: 1232203 - DNA, 22 bp, Artificial Sequence
  chemically synthesized
aatgcagtgaaaatgtcattaa

SEQ ID NO: 1232204 - DNA, 22 bp, Artificial Sequence
  chemically synthesized
gaatgcagtgaaaatgtcatta

SEQ ID NO: 1232205 - DNA, 22 bp, Artificial Sequence
  chemically synthesized
gtgtgtatttaatgacattttc

SEQ ID NO: 1232206 - DNA, 22 bp, Artificial Sequence
  chemically synthesized
tgtgtatttaatgacattttca

SEQ ID NO: 1232207 - DNA, 22 bp, Artificial Sequence
  chemically synthesized
aatgacattttcactgcattca

SEQ ID NO: 1232208 - DNA, 22 bp, Artificial Sequence
  chemically synthesized
atgacattttcactgcattcaa

SEQ ID NO: 1232209 - DNA, 22 bp, Artificial Sequence
  chemically synthesized
taaacgggcaatatatttgaat

SEQ ID NO: 1232210 - DNA, 22 bp, Artificial Sequence
  chemically synthesized
tcactgcattcaaatatattgc

SEQ ID NO: 1232211 - DNA, 22 bp, Artificial Sequence
  chemically synthesized
cactgcattcaaatatattgcc

SEQ ID NO: 1232212 - DNA, 22 bp, Artificial Sequence
  chemically synthesized
actgcattcaaatatattgccc

SEQ ID NO: 1232213 - DNA, 22 bp, Artificial Sequence
  chemically synthesized
cattcaaatatattgcccgttt

SEQ ID NO: 1232214 - DNA, 22 bp, Artificial Sequence
  chemically synthesized
aaatatattgcccgtttataat

SEQ ID NO: 1232215 - DNA, 22 bp, Artificial Sequence
  chemically synthesized
ccacatacacaaattataaacg

SEQ ID NO: 1232216 - DNA, 22 bp, Artificial Sequence
  chemically synthesized
ctgccacatacacaaattataa

SEQ ID NO: 1232217 - DNA, 22 bp, Artificial Sequence
  chemically synthesized
cctgccacatacacaaattata

SEQ ID NO: 1232218 - DNA, 22 bp, Artificial Sequence
  chemically synthesized
cccgtttataatttgtgtatgt

SEQ ID NO: 1232219 - DNA, 22 bp, Artificial Sequence
  chemically synthesized
ataatttgtgtatgtggcagga

SEQ ID NO: 1232220 - DNA, 22 bp, Artificial Sequence
  chemically synthesized
taatttgtgtatgtggcaggaa

SEQ ID NO: 1232221 - DNA, 22 bp, Artificial Sequence
  chemically synthesized
gtgtatgtggcaggaaattttt

SEQ ID NO: 1232222 - DNA, 22 bp, Artificial Sequence
  chemically synthesized
tgtatgtggcaggaaatttttt

SEQ ID NO: 1232223 - DNA, 22 bp, Artificial Sequence
  chemically synthesized
ggaaaatagtaaaaaaaatttc

SEQ ID NO: 1232224 - DNA, 22 bp, Artificial Sequence
  chemically synthesized
aggaaaatagtaaaaaaaattt

SEQ ID NO: 1232225 - DNA, 22 bp, Artificial Sequence
  chemically synthesized
aaggcttaggaaaatagtaaaa

SEQ ID NO: 1232226 - DNA, 22 bp, Artificial Sequence
  chemically synthesized
ttaaaggcttaggaaaatagta

SEQ ID NO: 1232227 - DNA, 22 bp, Artificial Sequence
  chemically synthesized
gttaaaggcttaggaaaatagt

SEQ ID NO: 1232228 - DNA, 22 bp, Artificial Sequence
  chemically synthesized
tttttactattttcctaagcct

SEQ ID NO: 1232229 - DNA, 22 bp, Artificial Sequence
  chemically synthesized
ttttactattttcctaagcctt

SEQ ID NO: 1232230 - DNA, 22 bp, Artificial Sequence
  chemically synthesized
tttactattttcctaagccttt

SEQ ID NO: 1232231 - DNA, 22 bp, Artificial Sequence
  chemically synthesized
ttactattttcctaagccttta

SEQ ID NO: 1232232 - DNA, 22 bp, Artificial Sequence
  chemically synthesized
tactattttcctaagcctttaa

SEQ ID NO: 1232233 - DNA, 22 bp, Artificial Sequence
  chemically synthesized
gtcgtaaacttgttaaaggctt

SEQ ID NO: 1232234 - DNA, 22 bp, Artificial Sequence
  chemically synthesized
actattttcctaagcctttaac

SEQ ID NO: 1232235 - DNA, 22 bp, Artificial Sequence
  chemically synthesized
cgtcgtaaacttgttaaaggct

SEQ ID NO: 1232236 - DNA, 22 bp, Artificial Sequence
  chemically synthesized
ctattttcctaagcctttaaca

SEQ ID NO: 1232237 - DNA, 22 bp, Artificial Sequence
  chemically synthesized
ttcgtcgtaaacttgttaaagg

SEQ ID NO: 1232238 - DNA, 22 bp, Artificial Sequence
  chemically synthesized
ttttcctaagcctttaacaagt

SEQ ID NO: 1232239 - DNA, 22 bp, Artificial Sequence
  chemically synthesized
ctcttcgtcgtaaacttgttaa

SEQ ID NO: 1232240 - DNA, 22 bp, Artificial Sequence
  chemically synthesized
tcctaagcctttaacaagttta

SEQ ID NO: 1232241 - DNA, 22 bp, Artificial Sequence
  chemically synthesized
cctaagcctttaacaagtttac

SEQ ID NO: 1232242 - DNA, 22 bp, Artificial Sequence
  chemically synthesized
ctaagcctttaacaagtttacg

SEQ ID NO: 1232243 - DNA, 22 bp, Artificial Sequence
  chemically synthesized
agcctttaacaagtttacgacg

SEQ ID NO: 1232244 - DNA, 22 bp, Artificial Sequence
  chemically synthesized
ggatatctgctcttcgtcgtaa

SEQ ID NO: 1232245 - DNA, 22 bp, Artificial Sequence
  chemically synthesized
cggatatctgctcttcgtcgta

SEQ ID NO: 1232246 - DNA, 22 bp, Artificial Sequence
  chemically synthesized
taacaagtttacgacgaagagc

SEQ ID NO: 1232247 - DNA, 22 bp, Artificial Sequence
  chemically synthesized
aacaagtttacgacgaagagca

SEQ ID NO: 1232248 - DNA, 22 bp, Artificial Sequence
  chemically synthesized
acaagtttacgacgaagagcag

SEQ ID NO: 1232249 - DNA, 22 bp, Artificial Sequence
  chemically synthesized
agagtcacttcggatatctgct

SEQ ID NO: 1232250 - DNA, 22 bp, Artificial Sequence
  chemically synthesized
acgacgaagagcagatatccga

SEQ ID NO: 1232251 - DNA, 22 bp, Artificial Sequence
  chemically synthesized
cgacgaagagcagatatccgaa

SEQ ID NO: 1232252 - DNA, 22 bp, Artificial Sequence
  chemically synthesized
tcagcgtgtctttcttttctgg

SEQ ID NO: 1232253 - DNA, 22 bp, Artificial Sequence
  chemically synthesized
gagacaaccagagccagaaaag

SEQ ID NO: 1232254 - DNA, 22 bp, Artificial Sequence
  chemically synthesized
agcgtgtctttcttttctggct

SEQ ID NO: 1232255 - DNA, 22 bp, Artificial Sequence
  chemically synthesized
tggagacaaccagagccagaaa

SEQ ID NO: 1232256 - DNA, 22 bp, Artificial Sequence
  chemically synthesized
ctggagacaaccagagccagaa

SEQ ID NO: 1232257 - DNA, 22 bp, Artificial Sequence
  chemically synthesized
ttctggagacaaccagagccag

SEQ ID NO: 1232258 - DNA, 22 bp, Artificial Sequence
  chemically synthesized
ttcttctggagacaaccagagc

SEQ ID NO: 1232259 - DNA, 22 bp, Artificial Sequence
  chemically synthesized
tcttttctggctctggttgtct

SEQ ID NO: 1232260 - DNA, 22 bp, Artificial Sequence
  chemically synthesized
ctattcttctggagacaaccag

SEQ ID NO: 1232261 - DNA, 22 bp, Artificial Sequence
  chemically synthesized
cttttctggctctggttgtctc

SEQ ID NO: 1232262 - DNA, 22 bp, Artificial Sequence
  chemically synthesized
cctattcttctggagacaacca

SEQ ID NO: 1232263 - DNA, 22 bp, Artificial Sequence
  chemically synthesized
ttttctggctctggttgtctcc

SEQ ID NO: 1232264 - DNA, 22 bp, Artificial Sequence
  chemically synthesized
ttctggctctggttgtctccag

SEQ ID NO: 1232265 - DNA, 22 bp, Artificial Sequence
  chemically synthesized
cttcctattcttctggagacaa

SEQ ID NO: 1232266 - DNA, 22 bp, Artificial Sequence
  chemically synthesized
tctggctctggttgtctccaga

SEQ ID NO: 1232267 - DNA, 22 bp, Artificial Sequence
  chemically synthesized
ctggctctggttgtctccagaa

SEQ ID NO: 1232268 - DNA, 22 bp, Artificial Sequence
  chemically synthesized
tggctctggttgtctccagaag

SEQ ID NO: 1232269 - DNA, 22 bp, Artificial Sequence
  chemically synthesized
gctctggttgtctccagaagaa

SEQ ID NO: 1232270 - DNA, 22 bp, Artificial Sequence
  chemically synthesized
aggactccttcctattcttctg

SEQ ID NO: 1232271 - DNA, 22 bp, Artificial Sequence
  chemically synthesized
tggttgtctccagaagaatagg

SEQ ID NO: 1232272 - DNA, 22 bp, Artificial Sequence
  chemically synthesized
gttgtctccagaagaataggaa

SEQ ID NO: 1232273 - DNA, 22 bp, Artificial Sequence
  chemically synthesized
gggactaaggactccttcctat

SEQ ID NO: 1232274 - DNA, 22 bp, Artificial Sequence
  chemically synthesized
tctccagaagaataggaaggag

SEQ ID NO: 1232275 - DNA, 22 bp, Artificial Sequence
  chemically synthesized
ggggactaaggactccttccta

SEQ ID NO: 1232276 - DNA, 22 bp, Artificial Sequence
  chemically synthesized
cagaagaataggaaggagtcct

SEQ ID NO: 1232277 - DNA, 22 bp, Artificial Sequence
  chemically synthesized
atttggggactaaggactcctt

SEQ ID NO: 1232278 - DNA, 22 bp, Artificial Sequence
  chemically synthesized
gctaatttggggactaaggact

SEQ ID NO: 1232279 - DNA, 22 bp, Artificial Sequence
  chemically synthesized
tggctaatttggggactaagga

SEQ ID NO: 1232280 - DNA, 22 bp, Artificial Sequence
  chemically synthesized
ctggctaatttggggactaagg

SEQ ID NO: 1232281 - DNA, 22 bp, Artificial Sequence
  chemically synthesized
agtccccaaattagccagaaac

SEQ ID NO: 1232282 - DNA, 22 bp, Artificial Sequence
  chemically synthesized
gtccccaaattagccagaaacc

SEQ ID NO: 1232283 - DNA, 22 bp, Artificial Sequence
  chemically synthesized
atgacagagagtagacgtggtt

SEQ ID NO: 1232284 - DNA, 22 bp, Artificial Sequence
  chemically synthesized
gatgacagagagtagacgtggt

SEQ ID NO: 1232285 - DNA, 22 bp, Artificial Sequence
  chemically synthesized
tttgatgacagagagtagacgt

SEQ ID NO: 1232286 - DNA, 22 bp, Artificial Sequence
  chemically synthesized
gccagaaaccacgtctactctc

SEQ ID NO: 1232287 - DNA, 22 bp, Artificial Sequence
  chemically synthesized
tatttgatgacagagagtagac

SEQ ID NO: 1232288 - DNA, 22 bp, Artificial Sequence
  chemically synthesized
ctatttgatgacagagagtaga

SEQ ID NO: 1232289 - DNA, 22 bp, Artificial Sequence
  chemically synthesized
aggccataccacttctatttga

SEQ ID NO: 1232290 - DNA, 22 bp, Artificial Sequence
  chemically synthesized
gaggccataccacttctatttg

SEQ ID NO: 1232291 - DNA, 22 bp, Artificial Sequence
  chemically synthesized
ctctctgtcatcaaatagaagt

SEQ ID NO: 1232292 - DNA, 22 bp, Artificial Sequence
  chemically synthesized
tgaggccataccacttctattt

SEQ ID NO: 1232293 - DNA, 22 bp, Artificial Sequence
  chemically synthesized
tctgtcatcaaatagaagtggt

SEQ ID NO: 1232294 - DNA, 22 bp, Artificial Sequence
  chemically synthesized
tgtcatcaaatagaagtggtat

SEQ ID NO: 1232295 - DNA, 22 bp, Artificial Sequence
  chemically synthesized
tcatcaaatagaagtggtatgg

SEQ ID NO: 1232296 - DNA, 22 bp, Artificial Sequence
  chemically synthesized
gatgcatcaggaagccagtcac

SEQ ID NO: 1232297 - DNA, 22 bp, Artificial Sequence
  chemically synthesized
ttggatgcatcaggaagccagt

SEQ ID NO: 1232298 - DNA, 22 bp, Artificial Sequence
  chemically synthesized
gttggatgcatcaggaagccag

SEQ ID NO: 1232299 - DNA, 22 bp, Artificial Sequence
  chemically synthesized
aaaggtgactggcttcctgatg

SEQ ID NO: 1232300 - DNA, 22 bp, Artificial Sequence
  chemically synthesized
gggcccagtcttgttggatgca

SEQ ID NO: 1232301 - DNA, 22 bp, Artificial Sequence
  chemically synthesized
gcttcctgatgcatccaacaag

SEQ ID NO: 1232302 - DNA, 22 bp, Artificial Sequence
  chemically synthesized
gctagggcccagtcttgttgga

SEQ ID NO: 1232303 - DNA, 22 bp, Artificial Sequence
  chemically synthesized
cctgatgcatccaacaagactg

SEQ ID NO: 1232304 - DNA, 22 bp, Artificial Sequence
  chemically synthesized
ctgatgcatccaacaagactgg

SEQ ID NO: 1232305 - DNA, 22 bp, Artificial Sequence
  chemically synthesized
atgttggctagggcccagtctt

SEQ ID NO: 1232306 - DNA, 22 bp, Artificial Sequence
  chemically synthesized
atgcatccaacaagactgggcc

SEQ ID NO: 1232307 - DNA, 22 bp, Artificial Sequence
  chemically synthesized
tgatgttggctagggcccagtc

SEQ ID NO: 1232308 - DNA, 22 bp, Artificial Sequence
  chemically synthesized
catgccgagaactctgatgttg

SEQ ID NO: 1232309 - DNA, 22 bp, Artificial Sequence
  chemically synthesized
ggccctagccaacatcagagtt

SEQ ID NO: 1232310 - DNA, 22 bp, Artificial Sequence
  chemically synthesized
agaatctgcatgccgagaactc

SEQ ID NO: 1232311 - DNA, 22 bp, Artificial Sequence
  chemically synthesized
gagaatctgcatgccgagaact

SEQ ID NO: 1232312 - DNA, 22 bp, Artificial Sequence
  chemically synthesized
gccaacatcagagttctcggca

SEQ ID NO: 1232313 - DNA, 22 bp, Artificial Sequence
  chemically synthesized
tgcgaaatgaggacttgagaat

SEQ ID NO: 1232314 - DNA, 22 bp, Artificial Sequence
  chemically synthesized
tcggcatgcagattctcaagtc

SEQ ID NO: 1232315 - DNA, 22 bp, Artificial Sequence
  chemically synthesized
tgtgcgaaatgaggacttgaga

SEQ ID NO: 1232316 - DNA, 22 bp, Artificial Sequence
  chemically synthesized
ggcatgcagattctcaagtcct

SEQ ID NO: 1232317 - DNA, 22 bp, Artificial Sequence
  chemically synthesized
ctgtgcgaaatgaggacttgag

SEQ ID NO: 1232318 - DNA, 22 bp, Artificial Sequence
  chemically synthesized
tttctgtgcgaaatgaggactt

SEQ ID NO: 1232319 - DNA, 22 bp, Artificial Sequence
  chemically synthesized
gtttctgtgcgaaatgaggact

SEQ ID NO: 1232320 - DNA, 22 bp, Artificial Sequence
  chemically synthesized
tgtttctgtgcgaaatgaggac

SEQ ID NO: 1232321 - DNA, 22 bp, Artificial Sequence
  chemically synthesized
ttttgtttctgtgcgaaatgag

SEQ ID NO: 1232322 - DNA, 22 bp, Artificial Sequence
  chemically synthesized
tgttttgtttctgtgcgaaatg

SEQ ID NO: 1232323 - DNA, 22 bp, Artificial Sequence
  chemically synthesized
tcaagtcctcatttcgcacaga

SEQ ID NO: 1232324 - DNA, 22 bp, Artificial Sequence
  chemically synthesized
gttctgttttgtttctgtgcga

SEQ ID NO: 1232325 - DNA, 22 bp, Artificial Sequence
  chemically synthesized
aagtcctcatttcgcacagaaa

SEQ ID NO: 1232326 - DNA, 22 bp, Artificial Sequence
  chemically synthesized
atttcgcacagaaacaaaacag

SEQ ID NO: 1232327 - DNA, 22 bp, Artificial Sequence
  chemically synthesized
caggtatctagttctgttttgt

SEQ ID NO: 1232328 - DNA, 22 bp, Artificial Sequence
  chemically synthesized
cgcacagaaacaaaacagaact

SEQ ID NO: 1232329 - DNA, 22 bp, Artificial Sequence
  chemically synthesized
gcacagaaacaaaacagaacta

SEQ ID NO: 1232330 - DNA, 22 bp, Artificial Sequence
  chemically synthesized
gatacctggaatgccgattata

SEQ ID NO: 1232331 - DNA, 22 bp, Artificial Sequence
  chemically synthesized
gaatgccgattataccgttttc

SEQ ID NO: 1232332 - DNA, 22 bp, Artificial Sequence
  chemically synthesized
gtgaagtaggagtggaaaacgg

SEQ ID NO: 1232333 - DNA, 22 bp, Artificial Sequence
  chemically synthesized
gtgggttagtgaagtaggagtg

SEQ ID NO: 1232334 - DNA, 22 bp, Artificial Sequence
  chemically synthesized
ggtgggttagtgaagtaggagt

SEQ ID NO: 1232335 - DNA, 22 bp, Artificial Sequence
  chemically synthesized
taccgttttccactcctacttc

SEQ ID NO: 1232336 - DNA, 22 bp, Artificial Sequence
  chemically synthesized
tccactcctacttcactaaccc

SEQ ID NO: 1232337 - DNA, 22 bp, Artificial Sequence
  chemically synthesized
ccactcctacttcactaaccca

SEQ ID NO: 1232338 - DNA, 22 bp, Artificial Sequence
  chemically synthesized
cactcctacttcactaacccac

SEQ ID NO: 1232339 - DNA, 22 bp, Artificial Sequence
  chemically synthesized
ctacttcactaacccaccaaac

SEQ ID NO: 1232340 - DNA, 22 bp, Artificial Sequence
  chemically synthesized
cttcactaacccaccaaacttc

SEQ ID NO: 1232341 - DNA, 22 bp, Artificial Sequence
  chemically synthesized
cactaacccaccaaacttcttc

SEQ ID NO: 1232342 - DNA, 22 bp, Artificial Sequence
  chemically synthesized
actaacccaccaaacttcttca

SEQ ID NO: 1232343 - DNA, 22 bp, Artificial Sequence
  chemically synthesized
acccaccaaacttcttcacctc

SEQ ID NO: 1232344 - DNA, 22 bp, Artificial Sequence
  chemically synthesized
cttcacctcttctttgtatgtg

SEQ ID NO: 1232345 - DNA, 22 bp, Artificial Sequence
  chemically synthesized
ttcacctcttctttgtatgtga

SEQ ID NO: 1232346 - DNA, 22 bp, Artificial Sequence
  chemically synthesized
cacctcttctttgtatgtgatg

SEQ ID NO: 1232347 - DNA, 22 bp, Artificial Sequence
  chemically synthesized
acctcttctttgtatgtgatga

SEQ ID NO: 1232348 - DNA, 22 bp, Artificial Sequence
  chemically synthesized
caggtgatgtagtcatcacata

SEQ ID NO: 1232349 - DNA, 22 bp, Artificial Sequence
  chemically synthesized
ttctttgtatgtgatgactaca

SEQ ID NO: 1232350 - DNA, 22 bp, Artificial Sequence
  chemically synthesized
ctttgtatgtgatgactacatc

SEQ ID NO: 1232351 - DNA, 22 bp, Artificial Sequence
  chemically synthesized
tttgtatgtgatgactacatca

SEQ ID NO: 1232352 - DNA, 22 bp, Artificial Sequence
  chemically synthesized
agagattccaggtgatgtagtc

SEQ ID NO: 1232353 - DNA, 22 bp, Artificial Sequence
  chemically synthesized
tgtatgtgatgactacatcacc

SEQ ID NO: 1232354 - DNA, 22 bp, Artificial Sequence
  chemically synthesized
gtatgtgatgactacatcacct

SEQ ID NO: 1232355 - DNA, 22 bp, Artificial Sequence
  chemically synthesized
tatgtgatgactacatcacctg

SEQ ID NO: 1232356 - DNA, 22 bp, Artificial Sequence
  chemically synthesized
catcacctggaatctcttaacc

SEQ ID NO: 1232357 - DNA, 22 bp, Artificial Sequence
  chemically synthesized
accagaagtccaaggttaagag

SEQ ID NO: 1232358 - DNA, 22 bp, Artificial Sequence
  chemically synthesized
gtctaaccagaagtccaaggtt

SEQ ID NO: 1232359 - DNA, 22 bp, Artificial Sequence
  chemically synthesized
agtctaaccagaagtccaaggt

SEQ ID NO: 1232360 - DNA, 22 bp, Artificial Sequence
  chemically synthesized
gaatctcttaaccttggacttc

SEQ ID NO: 1232361 - DNA, 22 bp, Artificial Sequence
  chemically synthesized
gtttagtctaaccagaagtcca

SEQ ID NO: 1232362 - DNA, 22 bp, Artificial Sequence
  chemically synthesized
agtttagtctaaccagaagtcc

SEQ ID NO: 1232363 - DNA, 22 bp, Artificial Sequence
  chemically synthesized
cttagtttagtctaaccagaag

SEQ ID NO: 1232364 - DNA, 22 bp, Artificial Sequence
  chemically synthesized
ttaaccttggacttctggttag

SEQ ID NO: 1232365 - DNA, 22 bp, Artificial Sequence
  chemically synthesized
aaccttggacttctggttagac

SEQ ID NO: 1232366 - DNA, 22 bp, Artificial Sequence
  chemically synthesized
accttggacttctggttagact

SEQ ID NO: 1232367 - DNA, 22 bp, Artificial Sequence
  chemically synthesized
ggacttctggttagactaaact

SEQ ID NO: 1232368 - DNA, 22 bp, Artificial Sequence
  chemically synthesized
gacttctggttagactaaacta

SEQ ID NO: 1232369 - DNA, 22 bp, Artificial Sequence
  chemically synthesized
ccagtgccgctccttagtttag

SEQ ID NO: 1232370 - DNA, 22 bp, Artificial Sequence
  chemically synthesized
gccagtgccgctccttagttta

SEQ ID NO: 1232371 - DNA, 22 bp, Artificial Sequence
  chemically synthesized
tgccagtgccgctccttagttt

SEQ ID NO: 1232372 - DNA, 22 bp, Artificial Sequence
  chemically synthesized
ctggttagactaaactaaggag

SEQ ID NO: 1232373 - DNA, 22 bp, Artificial Sequence
  chemically synthesized
tggttagactaaactaaggagc

SEQ ID NO: 1232374 - DNA, 22 bp, Artificial Sequence
  chemically synthesized
gttagactaaactaaggagcgg

SEQ ID NO: 1232375 - DNA, 22 bp, Artificial Sequence
  chemically synthesized
gactaaactaaggagcggcact

SEQ ID NO: 1232376 - DNA, 22 bp, Artificial Sequence
  chemically synthesized
cagtgttttgccagtgccgctc

SEQ ID NO: 1232377 - DNA, 22 bp, Artificial Sequence
  chemically synthesized
aactaaggagcggcactggcaa

SEQ ID NO: 1232378 - DNA, 22 bp, Artificial Sequence
  chemically synthesized
aggagcggcactggcaaaacac

SEQ ID NO: 1232379 - DNA, 22 bp, Artificial Sequence
  chemically synthesized
catagaatcctccagtgttttg

SEQ ID NO: 1232380 - DNA, 22 bp, Artificial Sequence
  chemically synthesized
tccatagaatcctccagtgttt

SEQ ID NO: 1232381 - DNA, 22 bp, Artificial Sequence
  chemically synthesized
gtctctccatagaatcctccag

SEQ ID NO: 1232382 - DNA, 22 bp, Artificial Sequence
  chemically synthesized
agtctctccatagaatcctcca

SEQ ID NO: 1232383 - DNA, 22 bp, Artificial Sequence
  chemically synthesized
gcaaaacactggaggattctat

SEQ ID NO: 1232384 - DNA, 22 bp, Artificial Sequence
  chemically synthesized
gaggattctatggagagactaa

SEQ ID NO: 1232385 - DNA, 22 bp, Artificial Sequence
  chemically synthesized
agagaagtgataccttagtctc

SEQ ID NO: 1232386 - DNA, 22 bp, Artificial Sequence
  chemically synthesized
tatggagagactaaggtatcac

SEQ ID NO: 1232387 - DNA, 22 bp, Artificial Sequence
  chemically synthesized
tggagagactaaggtatcactt

SEQ ID NO: 1232388 - DNA, 22 bp, Artificial Sequence
  chemically synthesized
gtgaagttgagagaagtgatac

SEQ ID NO: 1232389 - DNA, 22 bp, Artificial Sequence
  chemically synthesized
cctggtgaagttgagagaagtg

SEQ ID NO: 1232390 - DNA, 22 bp, Artificial Sequence
  chemically synthesized
aggtatcacttctctcaacttc

SEQ ID NO: 1232391 - DNA, 22 bp, Artificial Sequence
  chemically synthesized
aaatcattgcctggtgaagttg

SEQ ID NO: 1232392 - DNA, 22 bp, Artificial Sequence
  chemically synthesized
caaatcattgcctggtgaagtt

SEQ ID NO: 1232393 - DNA, 22 bp, Artificial Sequence
  chemically synthesized
gtttcaaatcattgcctggtga

SEQ ID NO: 1232394 - DNA, 22 bp, Artificial Sequence
  chemically synthesized
ctctcaacttcaccaggcaatg

SEQ ID NO: 1232395 - DNA, 22 bp, Artificial Sequence
  chemically synthesized
ttagtttcaaatcattgcctgg

SEQ ID NO: 1232396 - DNA, 22 bp, Artificial Sequence
  chemically synthesized
tctcaacttcaccaggcaatga

SEQ ID NO: 1232397 - DNA, 22 bp, Artificial Sequence
  chemically synthesized
tcaacttcaccaggcaatgatt

SEQ ID NO: 1232398 - DNA, 22 bp, Artificial Sequence
  chemically synthesized
aacttcaccaggcaatgatttg

SEQ ID NO: 1232399 - DNA, 22 bp, Artificial Sequence
  chemically synthesized
caccaggcaatgatttgaaact

SEQ ID NO: 1232400 - DNA, 22 bp, Artificial Sequence
  chemically synthesized
aagaatgctgttagtttcaaat

SEQ ID NO: 1232401 - DNA, 22 bp, Artificial Sequence
  chemically synthesized
accaggcaatgatttgaaacta

SEQ ID NO: 1232402 - DNA, 22 bp, Artificial Sequence
  chemically synthesized
ggtatctaaagaatgctgttag

SEQ ID NO: 1232403 - DNA, 22 bp, Artificial Sequence
  chemically synthesized
gaaactaacagcattctttaga

SEQ ID NO: 1232404 - DNA, 22 bp, Artificial Sequence
  chemically synthesized
agcccctaggtatctaaagaat

SEQ ID NO: 1232405 - DNA, 22 bp, Artificial Sequence
  chemically synthesized
aaactaacagcattctttagat

SEQ ID NO: 1232406 - DNA, 22 bp, Artificial Sequence
  chemically synthesized
acagcattctttagatacctag

SEQ ID NO: 1232407 - DNA, 22 bp, Artificial Sequence
  chemically synthesized
tgaactgagcccctaggtatct

SEQ ID NO: 1232408 - DNA, 22 bp, Artificial Sequence
  chemically synthesized
tttagatacctaggggctcagt

SEQ ID NO: 1232409 - DNA, 22 bp, Artificial Sequence
  chemically synthesized
gacacaactgtgaactgagccc

SEQ ID NO: 1232410 - DNA, 22 bp, Artificial Sequence
  chemically synthesized
tagatacctaggggctcagttc

SEQ ID NO: 1232411 - DNA, 22 bp, Artificial Sequence
  chemically synthesized
agatacctaggggctcagttca

SEQ ID NO: 1232412 - DNA, 22 bp, Artificial Sequence
  chemically synthesized
gatacctaggggctcagttcac

SEQ ID NO: 1232413 - DNA, 22 bp, Artificial Sequence
  chemically synthesized
ggggctcagttcacagttgtgt

SEQ ID NO: 1232414 - DNA, 22 bp, Artificial Sequence
  chemically synthesized
ggagagcgccactggacacaac

SEQ ID NO: 1232415 - DNA, 22 bp, Artificial Sequence
  chemically synthesized
agttcacagttgtgtccagtgg

SEQ ID NO: 1232416 - DNA, 22 bp, Artificial Sequence
  chemically synthesized
atgttgggagagcgccactgga

SEQ ID NO: 1232417 - DNA, 22 bp, Artificial Sequence
  chemically synthesized
acagttgtgtccagtggcgctc

SEQ ID NO: 1232418 - DNA, 22 bp, Artificial Sequence
  chemically synthesized
tgtccagtggcgctctcccaac

SEQ ID NO: 1232419 - DNA, 22 bp, Artificial Sequence
  chemically synthesized
ataaaatccctcatgttgggag

SEQ ID NO: 1232420 - DNA, 22 bp, Artificial Sequence
  chemically synthesized
gataaaatccctcatgttggga

SEQ ID NO: 1232421 - DNA, 22 bp, Artificial Sequence
  chemically synthesized
atttgataaaatccctcatgtt

SEQ ID NO: 1232422 - DNA, 22 bp, Artificial Sequence
  chemically synthesized
ttaatttgataaaatccctcat

SEQ ID NO: 1232423 - DNA, 22 bp, Artificial Sequence
  chemically synthesized
tcccaacatgagggattttatc

SEQ ID NO: 1232424 - DNA, 22 bp, Artificial Sequence
  chemically synthesized
ccaacatgagggattttatcaa

SEQ ID NO: 1232425 - DNA, 22 bp, Artificial Sequence
  chemically synthesized
agcagtcaaggggagagggcta

SEQ ID NO: 1232426 - DNA, 22 bp, Artificial Sequence
  chemically synthesized
tatcaaattaatagccctctcc

SEQ ID NO: 1232427 - DNA, 22 bp, Artificial Sequence
  chemically synthesized
atcaaattaatagccctctccc

SEQ ID NO: 1232428 - DNA, 22 bp, Artificial Sequence
  chemically synthesized
tcaaattaatagccctctcccc

SEQ ID NO: 1232429 - DNA, 22 bp, Artificial Sequence
  chemically synthesized
aacctaagcagtcaaggggaga

SEQ ID NO: 1232430 - DNA, 22 bp, Artificial Sequence
  chemically synthesized
atagccctctccccttgactgc

SEQ ID NO: 1232431 - DNA, 22 bp, Artificial Sequence
  chemically synthesized
catctaaacctaagcagtcaag

SEQ ID NO: 1232432 - DNA, 22 bp, Artificial Sequence
  chemically synthesized
ctacatctaaacctaagcagtc

SEQ ID NO: 1232433 - DNA, 22 bp, Artificial Sequence
  chemically synthesized
actacatctaaacctaagcagt

SEQ ID NO: 1232434 - DNA, 22 bp, Artificial Sequence
  chemically synthesized
tactacatctaaacctaagcag

SEQ ID NO: 1232435 - DNA, 22 bp, Artificial Sequence
  chemically synthesized
tccccttgactgcttaggttta

SEQ ID NO: 1232436 - DNA, 22 bp, Artificial Sequence
  chemically synthesized
cccttgactgcttaggtttaga

SEQ ID NO: 1232437 - DNA, 22 bp, Artificial Sequence
  chemically synthesized
ataacctttactacatctaaac

SEQ ID NO: 1232438 - DNA, 22 bp, Artificial Sequence
  chemically synthesized
gactgcttaggtttagatgtag

SEQ ID NO: 1232439 - DNA, 22 bp, Artificial Sequence
  chemically synthesized
actgcttaggtttagatgtagt

SEQ ID NO: 1232440 - DNA, 22 bp, Artificial Sequence
  chemically synthesized
cttaggtttagatgtagtaaag

SEQ ID NO: 1232441 - DNA, 22 bp, Artificial Sequence
  chemically synthesized
aggtttagatgtagtaaaggtt

SEQ ID NO: 1232442 - DNA, 22 bp, Artificial Sequence
  chemically synthesized
acatgagttaataacctttact

SEQ ID NO: 1232443 - DNA, 22 bp, Artificial Sequence
  chemically synthesized
ggtttagatgtagtaaaggtta

SEQ ID NO: 1232444 - DNA, 22 bp, Artificial Sequence
  chemically synthesized
agatgtagtaaaggttattaac

SEQ ID NO: 1232445 - DNA, 22 bp, Artificial Sequence
  chemically synthesized
gatgtagtaaaggttattaact

SEQ ID NO: 1232446 - DNA, 22 bp, Artificial Sequence
  chemically synthesized
tggtgaagaatgcagggattca

SEQ ID NO: 1232447 - DNA, 22 bp, Artificial Sequence
  chemically synthesized
ttaactcatgtgaatccctgca

SEQ ID NO: 1232448 - DNA, 22 bp, Artificial Sequence
  chemically synthesized
actcatgtgaatccctgcattc

SEQ ID NO: 1232449 - DNA, 22 bp, Artificial Sequence
  chemically synthesized
atgtgaatccctgcattcttca

SEQ ID NO: 1232450 - DNA, 22 bp, Artificial Sequence
  chemically synthesized
aaggaagaaactatggtgaaga

SEQ ID NO: 1232451 - DNA, 22 bp, Artificial Sequence
  chemically synthesized
cattcttcaccatagtttcttc

SEQ ID NO: 1232452 - DNA, 22 bp, Artificial Sequence
  chemically synthesized
ttcaccatagtttcttccttta

SEQ ID NO: 1232453 - DNA, 22 bp, Artificial Sequence
  chemically synthesized
caccatagtttcttcctttaat

SEQ ID NO: 1232454 - DNA, 22 bp, Artificial Sequence
  chemically synthesized
accatagtttcttcctttaatc

SEQ ID NO: 1232455 - DNA, 22 bp, Artificial Sequence
  chemically synthesized
tagaaacgtggggaggattaaa

SEQ ID NO: 1232456 - DNA, 22 bp, Artificial Sequence
  chemically synthesized
atagaaacgtggggaggattaa

SEQ ID NO: 1232457 - DNA, 22 bp, Artificial Sequence
  chemically synthesized
cttcctttaatcctccccacgt

SEQ ID NO: 1232458 - DNA, 22 bp, Artificial Sequence
  chemically synthesized
ttcctttaatcctccccacgtt

SEQ ID NO: 1232459 - DNA, 22 bp, Artificial Sequence
  chemically synthesized
cctttaatcctccccacgtttc

SEQ ID NO: 1232460 - DNA, 22 bp, Artificial Sequence
  chemically synthesized
ctttaatcctccccacgtttct

SEQ ID NO: 1232461 - DNA, 22 bp, Artificial Sequence
  chemically synthesized
taatcctccccacgtttctata

SEQ ID NO: 1232462 - DNA, 22 bp, Artificial Sequence
  chemically synthesized
aatcctccccacgtttctataa

SEQ ID NO: 1232463 - DNA, 22 bp, Artificial Sequence
  chemically synthesized
atcctccccacgtttctataaa

SEQ ID NO: 1232464 - DNA, 22 bp, Artificial Sequence
  chemically synthesized
cccacgtttctataaatattcc

SEQ ID NO: 1232465 - DNA, 22 bp, Artificial Sequence
  chemically synthesized
aagagagtgtaatcaggggaat

SEQ ID NO: 1232466 - DNA, 22 bp, Artificial Sequence
  chemically synthesized
ctataaatattcccctgattac

SEQ ID NO: 1232467 - DNA, 22 bp, Artificial Sequence
  chemically synthesized
tataaatattcccctgattaca

SEQ ID NO: 1232468 - DNA, 22 bp, Artificial Sequence
  chemically synthesized
taaatattcccctgattacact

SEQ ID NO: 1232469 - DNA, 22 bp, Artificial Sequence
  chemically synthesized
ccctgattacactctcttcaac

SEQ ID NO: 1232470 - DNA, 22 bp, Artificial Sequence
  chemically synthesized
attacactctcttcaacttttt

SEQ ID NO: 1232471 - DNA, 22 bp, Artificial Sequence
  chemically synthesized
cactctcttcaactttttctgt

SEQ ID NO: 1232472 - DNA, 22 bp, Artificial Sequence
  chemically synthesized
aacacgtggcatacagaaaaag

SEQ ID NO: 1232473 - DNA, 22 bp, Artificial Sequence
  chemically synthesized
tcttcaactttttctgtatgcc

SEQ ID NO: 1232474 - DNA, 22 bp, Artificial Sequence
  chemically synthesized
atattaaacacgtggcatacag

SEQ ID NO: 1232475 - DNA, 22 bp, Artificial Sequence
  chemically synthesized
ttcaactttttctgtatgccac

SEQ ID NO: 1232476 - DNA, 22 bp, Artificial Sequence
  chemically synthesized
caactttttctgtatgccacgt

SEQ ID NO: 1232477 - DNA, 22 bp, Artificial Sequence
  chemically synthesized
aactttttctgtatgccacgtg

SEQ ID NO: 1232478 - DNA, 22 bp, Artificial Sequence
  chemically synthesized
tcctgatattaaacacgtggca

SEQ ID NO: 1232479 - DNA, 22 bp, Artificial Sequence
  chemically synthesized
tttctgtatgccacgtgtttaa

SEQ ID NO: 1232480 - DNA, 22 bp, Artificial Sequence
  chemically synthesized
actgtcctgatattaaacacgt

SEQ ID NO: 1232481 - DNA, 22 bp, Artificial Sequence
  chemically synthesized
ttctgtatgccacgtgtttaat

SEQ ID NO: 1232482 - DNA, 22 bp, Artificial Sequence
  chemically synthesized
tctgtatgccacgtgtttaata

SEQ ID NO: 1232483 - DNA, 22 bp, Artificial Sequence
  chemically synthesized
ctgtatgccacgtgtttaatat

SEQ ID NO: 1232484 - DNA, 22 bp, Artificial Sequence
  chemically synthesized
tgtatgccacgtgtttaatatc

SEQ ID NO: 1232485 - DNA, 22 bp, Artificial Sequence
  chemically synthesized
tatgccacgtgtttaatatcag

SEQ ID NO: 1232486 - DNA, 22 bp, Artificial Sequence
  chemically synthesized
tgaagtcaagtgtattaactgt

SEQ ID NO: 1232487 - DNA, 22 bp, Artificial Sequence
  chemically synthesized
gtgaagtcaagtgtattaactg

SEQ ID NO: 1232488 - DNA, 22 bp, Artificial Sequence
  chemically synthesized
aatatcaggacagttaatacac

SEQ ID NO: 1232489 - DNA, 22 bp, Artificial Sequence
  chemically synthesized
atatcaggacagttaatacact

SEQ ID NO: 1232490 - DNA, 22 bp, Artificial Sequence
  chemically synthesized
aggtatcttgtgaagtcaagtg

SEQ ID NO: 1232491 - DNA, 22 bp, Artificial Sequence
  chemically synthesized
aaggtatcttgtgaagtcaagt

SEQ ID NO: 1232492 - DNA, 22 bp, Artificial Sequence
  chemically synthesized
taaggtatcttgtgaagtcaag

SEQ ID NO: 1232493 - DNA, 22 bp, Artificial Sequence
  chemically synthesized
atacacttgacttcacaagata

SEQ ID NO: 1232494 - DNA, 22 bp, Artificial Sequence
  chemically synthesized
tacaattttaaggtatcttgtg

SEQ ID NO: 1232495 - DNA, 22 bp, Artificial Sequence
  chemically synthesized
actatacaattttaaggtatct

SEQ ID NO: 1232496 - DNA, 22 bp, Artificial Sequence
  chemically synthesized
gacttcacaagataccttaaaa

SEQ ID NO: 1232497 - DNA, 22 bp, Artificial Sequence
  chemically synthesized
acttcacaagataccttaaaat

SEQ ID NO: 1232498 - DNA, 22 bp, Artificial Sequence
  chemically synthesized
cacaagataccttaaaattgta

SEQ ID NO: 1232499 - DNA, 22 bp, Artificial Sequence
  chemically synthesized
acaagataccttaaaattgtat

SEQ ID NO: 1232500 - DNA, 22 bp, Artificial Sequence
  chemically synthesized
aaaattgtatagtgaatgtatc

SEQ ID NO: 1232501 - DNA, 22 bp, Artificial Sequence
  chemically synthesized
aggcaaccaagtgatacattca

SEQ ID NO: 1232502 - DNA, 22 bp, Artificial Sequence
  chemically synthesized
aaattgtatagtgaatgtatca

SEQ ID NO: 1232503 - DNA, 22 bp, Artificial Sequence
  chemically synthesized
attgaggcaaccaagtgataca

SEQ ID NO: 1232504 - DNA, 22 bp, Artificial Sequence
  chemically synthesized
tatagtgaatgtatcacttggt

SEQ ID NO: 1232505 - DNA, 22 bp, Artificial Sequence
  chemically synthesized
agttcattgaggcaaccaagtg

SEQ ID NO: 1232506 - DNA, 22 bp, Artificial Sequence
  chemically synthesized
cagttcattgaggcaaccaagt

SEQ ID NO: 1232507 - DNA, 22 bp, Artificial Sequence
  chemically synthesized
tcagttcattgaggcaaccaag

SEQ ID NO: 1232508 - DNA, 22 bp, Artificial Sequence
  chemically synthesized
attttcagttcattgaggcaac

SEQ ID NO: 1232509 - DNA, 22 bp, Artificial Sequence
  chemically synthesized
cattttcagttcattgaggcaa

SEQ ID NO: 1232510 - DNA, 22 bp, Artificial Sequence
  chemically synthesized
tcattttcagttcattgaggca

SEQ ID NO: 1232511 - DNA, 22 bp, Artificial Sequence
  chemically synthesized
ggttgcctcaatgaactgaaaa

SEQ ID NO: 1232512 - DNA, 22 bp, Artificial Sequence
  chemically synthesized
gttgcctcaatgaactgaaaat

SEQ ID NO: 1232513 - DNA, 22 bp, Artificial Sequence
  chemically synthesized
cctcaatgaactgaaaatgaaa

SEQ ID NO: 1232514 - DNA, 22 bp, Artificial Sequence
  chemically synthesized
atagggcaaaagcattttcatt

SEQ ID NO: 1232515 - DNA, 22 bp, Artificial Sequence
  chemically synthesized
aatgaactgaaaatgaaaatgc

SEQ ID NO: 1232516 - DNA, 22 bp, Artificial Sequence
  chemically synthesized
catagggcaaaagcattttcat

SEQ ID NO: 1232517 - DNA, 22 bp, Artificial Sequence
  chemically synthesized
tcatagggcaaaagcattttca

SEQ ID NO: 1232518 - DNA, 22 bp, Artificial Sequence
  chemically synthesized
aaaatgaaaatgcttttgccct

SEQ ID NO: 1232519 - DNA, 22 bp, Artificial Sequence
  chemically synthesized
agtagatccacatggtgtcttt

SEQ ID NO: 1232520 - DNA, 22 bp, Artificial Sequence
  chemically synthesized
ttgccctatgaaagacaccatg

SEQ ID NO: 1232521 - DNA, 22 bp, Artificial Sequence
  chemically synthesized
tgccctatgaaagacaccatgt

SEQ ID NO: 1232522 - DNA, 22 bp, Artificial Sequence
  chemically synthesized
gccctatgaaagacaccatgtg

SEQ ID NO: 1232523 - DNA, 22 bp, Artificial Sequence
  chemically synthesized
ccctatgaaagacaccatgtgg

SEQ ID NO: 1232524 - DNA, 22 bp, Artificial Sequence
  chemically synthesized
tgaaagacaccatgtggatcta

SEQ ID NO: 1232525 - DNA, 22 bp, Artificial Sequence
  chemically synthesized
tggaatggccagagctcagtag

SEQ ID NO: 1232526 - DNA, 22 bp, Artificial Sequence
  chemically synthesized
agcctatggaatggccagagct

SEQ ID NO: 1232527 - DNA, 22 bp, Artificial Sequence
  chemically synthesized
ccctgagcctatggaatggcca

SEQ ID NO: 1232528 - DNA, 22 bp, Artificial Sequence
  chemically synthesized
tcccctgagcctatggaatggc

SEQ ID NO: 1232529 - DNA, 22 bp, Artificial Sequence
  chemically synthesized
ctgagctctggccattccatag

SEQ ID NO: 1232530 - DNA, 22 bp, Artificial Sequence
  chemically synthesized
agctctggccattccataggct

SEQ ID NO: 1232531 - DNA, 22 bp, Artificial Sequence
  chemically synthesized
ggaatgctctcccctgagccta

SEQ ID NO: 1232532 - DNA, 22 bp, Artificial Sequence
  chemically synthesized
tggccattccataggctcaggg

SEQ ID NO: 1232533 - DNA, 22 bp, Artificial Sequence
  chemically synthesized
gccattccataggctcagggga

SEQ ID NO: 1232534 - DNA, 22 bp, Artificial Sequence
  chemically synthesized
ttgggaatgctctcccctgagc

SEQ ID NO: 1232535 - DNA, 22 bp, Artificial Sequence
  chemically synthesized
tcattattgggaatgctctccc

SEQ ID NO: 1232536 - DNA, 22 bp, Artificial Sequence
  chemically synthesized
cataggctcaggggagagcatt

SEQ ID NO: 1232537 - DNA, 22 bp, Artificial Sequence
  chemically synthesized
aggggagagcattcccaataat

SEQ ID NO: 1232538 - DNA, 22 bp, Artificial Sequence
  chemically synthesized
agaaaatcgtatgtctgtcatt

SEQ ID NO: 1232539 - DNA, 22 bp, Artificial Sequence
  chemically synthesized
ccaataatgacagacatacgat

SEQ ID NO: 1232540 - DNA, 22 bp, Artificial Sequence
  chemically synthesized
aacaaggcattcagaaaatcgt

SEQ ID NO: 1232541 - DNA, 22 bp, Artificial Sequence
  chemically synthesized
tcaacaaggcattcagaaaatc

SEQ ID NO: 1232542 - DNA, 22 bp, Artificial Sequence
  chemically synthesized
aactctcaacaaggcattcaga

SEQ ID NO: 1232543 - DNA, 22 bp, Artificial Sequence
  chemically synthesized
aagtctgaactctcaacaaggc

SEQ ID NO: 1232544 - DNA, 22 bp, Artificial Sequence
  chemically synthesized
tctgaatgccttgttgagagtt

SEQ ID NO: 1232545 - DNA, 22 bp, Artificial Sequence
  chemically synthesized
aattcaagtctgaactctcaac

SEQ ID NO: 1232546 - DNA, 22 bp, Artificial Sequence
  chemically synthesized
ctgaatgccttgttgagagttc

SEQ ID NO: 1232547 - DNA, 22 bp, Artificial Sequence
  chemically synthesized
tgaatgccttgttgagagttca

SEQ ID NO: 1232548 - DNA, 22 bp, Artificial Sequence
  chemically synthesized
aatgccttgttgagagttcaga

SEQ ID NO: 1232549 - DNA, 22 bp, Artificial Sequence
  chemically synthesized
actaaattcaagtctgaactct

SEQ ID NO: 1232550 - DNA, 22 bp, Artificial Sequence
  chemically synthesized
cattaactaaattcaagtctga

SEQ ID NO: 1232551 - DNA, 22 bp, Artificial Sequence
  chemically synthesized
gttgagagttcagacttgaatt

SEQ ID NO: 1232552 - DNA, 22 bp, Artificial Sequence
  chemically synthesized
ttgagagttcagacttgaattt

SEQ ID NO: 1232553 - DNA, 22 bp, Artificial Sequence
  chemically synthesized
agttacattaactaaattcaag

SEQ ID NO: 1232554 - DNA, 22 bp, Artificial Sequence
  chemically synthesized
cagttacattaactaaattcaa

SEQ ID NO: 1232555 - DNA, 22 bp, Artificial Sequence
  chemically synthesized
agagttcagacttgaatttagt

SEQ ID NO: 1232556 - DNA, 22 bp, Artificial Sequence
  chemically synthesized
aaaatttcagttacattaacta

SEQ ID NO: 1232557 - DNA, 22 bp, Artificial Sequence
  chemically synthesized
agacttgaatttagttaatgta

SEQ ID NO: 1232558 - DNA, 22 bp, Artificial Sequence
  chemically synthesized
aaaaatttcagttacattaact

SEQ ID NO: 1232559 - DNA, 22 bp, Artificial Sequence
  chemically synthesized
gaatttagttaatgtaactgaa

SEQ ID NO: 1232560 - DNA, 22 bp, Artificial Sequence
  chemically synthesized
aatttagttaatgtaactgaaa

SEQ ID NO: 1232561 - DNA, 22 bp, Artificial Sequence
  chemically synthesized
agttaatgtaactgaaattttt

SEQ ID NO: 1232562 - DNA, 22 bp, Artificial Sequence
  chemically synthesized
gttaatgtaactgaaattttta

SEQ ID NO: 1232563 - DNA, 22 bp, Artificial Sequence
  chemically synthesized
atgtaactgaaatttttaaact

SEQ ID NO: 1232564 - DNA, 22 bp, Artificial Sequence
  chemically synthesized
gatgtgcaagaagagcaatagt

SEQ ID NO: 1232565 - DNA, 22 bp, Artificial Sequence
  chemically synthesized
aaatttttaaactattgctctt

SEQ ID NO: 1232566 - DNA, 22 bp, Artificial Sequence
  chemically synthesized
ttaaactattgctcttcttgca

SEQ ID NO: 1232567 - DNA, 22 bp, Artificial Sequence
  chemically synthesized
tgaagttggatgtgcaagaaga

SEQ ID NO: 1232568 - DNA, 22 bp, Artificial Sequence
  chemically synthesized
taaactattgctcttcttgcac

SEQ ID NO: 1232569 - DNA, 22 bp, Artificial Sequence
  chemically synthesized
aaactattgctcttcttgcaca

SEQ ID NO: 1232570 - DNA, 22 bp, Artificial Sequence
  chemically synthesized
aactattgctcttcttgcacat

SEQ ID NO: 1232571 - DNA, 22 bp, Artificial Sequence
  chemically synthesized
cctatgaagttggatgtgcaag

SEQ ID NO: 1232572 - DNA, 22 bp, Artificial Sequence
  chemically synthesized
ttgctcttcttgcacatccaac

SEQ ID NO: 1232573 - DNA, 22 bp, Artificial Sequence
  chemically synthesized
ctcttcttgcacatccaacttc

SEQ ID NO: 1232574 - DNA, 22 bp, Artificial Sequence
  chemically synthesized
ttcttgcacatccaacttcata

SEQ ID NO: 1232575 - DNA, 22 bp, Artificial Sequence
  chemically synthesized
cttgcacatccaacttcatagg

SEQ ID NO: 1232576 - DNA, 22 bp, Artificial Sequence
  chemically synthesized
tcaataaatctccctatgaagt

SEQ ID NO: 1232577 - DNA, 22 bp, Artificial Sequence
  chemically synthesized
ttgcacatccaacttcataggg

SEQ ID NO: 1232578 - DNA, 22 bp, Artificial Sequence
  chemically synthesized
gcacatccaacttcatagggag

SEQ ID NO: 1232579 - DNA, 22 bp, Artificial Sequence
  chemically synthesized
cacatccaacttcatagggaga

SEQ ID NO: 1232580 - DNA, 22 bp, Artificial Sequence
  chemically synthesized
catagggagatttattgataat

SEQ ID NO: 1232581 - DNA, 22 bp, Artificial Sequence
  chemically synthesized
taaaatatgagcattatcaata

SEQ ID NO: 1232582 - DNA, 22 bp, Artificial Sequence
  chemically synthesized
atagggagatttattgataatg

SEQ ID NO: 1232583 - DNA, 22 bp, Artificial Sequence
  chemically synthesized
tataaaatatgagcattatcaa

SEQ ID NO: 1232584 - DNA, 22 bp, Artificial Sequence
  chemically synthesized
ctataaaatatgagcattatca

SEQ ID NO: 1232585 - DNA, 22 bp, Artificial Sequence
  chemically synthesized
attgataatgctcatattttat

SEQ ID NO: 1232586 - DNA, 22 bp, Artificial Sequence
  chemically synthesized
ttgataatgctcatattttata

SEQ ID NO: 1232587 - DNA, 22 bp, Artificial Sequence
  chemically synthesized
ataatgctcatattttatagaa

SEQ ID NO: 1232588 - DNA, 22 bp, Artificial Sequence
  chemically synthesized
aagcatagtagatacttctata

SEQ ID NO: 1232589 - DNA, 22 bp, Artificial Sequence
  chemically synthesized
atattttatagaagtatctact

SEQ ID NO: 1232590 - DNA, 22 bp, Artificial Sequence
  chemically synthesized
aacactaaagcatagtagatac

SEQ ID NO: 1232591 - DNA, 22 bp, Artificial Sequence
  chemically synthesized
tatagaagtatctactatgctt

SEQ ID NO: 1232592 - DNA, 22 bp, Artificial Sequence
  chemically synthesized
atagaagtatctactatgcttt

SEQ ID NO: 1232593 - DNA, 22 bp, Artificial Sequence
  chemically synthesized
tatctcaacactaaagcatagt

SEQ ID NO: 1232594 - DNA, 22 bp, Artificial Sequence
  chemically synthesized
tagaagtatctactatgcttta

SEQ ID NO: 1232595 - DNA, 22 bp, Artificial Sequence
  chemically synthesized
tgtatctcaacactaaagcata

SEQ ID NO: 1232596 - DNA, 22 bp, Artificial Sequence
  chemically synthesized
ctgtatctcaacactaaagcat

SEQ ID NO: 1232597 - DNA, 22 bp, Artificial Sequence
  chemically synthesized
tctgtatctcaacactaaagca

SEQ ID NO: 1232598 - DNA, 22 bp, Artificial Sequence
  chemically synthesized
ctatgctttagtgttgagatac

SEQ ID NO: 1232599 - DNA, 22 bp, Artificial Sequence
  chemically synthesized
atagtgattttctgtatctcaa

SEQ ID NO: 1232600 - DNA, 22 bp, Artificial Sequence
  chemically synthesized
aatagtgattttctgtatctca

SEQ ID NO: 1232601 - DNA, 22 bp, Artificial Sequence
  chemically synthesized
tgctttagtgttgagatacaga

SEQ ID NO: 1232602 - DNA, 22 bp, Artificial Sequence
  chemically synthesized
tagtgttgagatacagaaaatc

SEQ ID NO: 1232603 - DNA, 22 bp, Artificial Sequence
  chemically synthesized
agtgttgagatacagaaaatca

SEQ ID NO: 1232604 - DNA, 22 bp, Artificial Sequence
  chemically synthesized
taggtttaatagtgattttctg

SEQ ID NO: 1232605 - DNA, 22 bp, Artificial Sequence
  chemically synthesized
gtgttgagatacagaaaatcac

SEQ ID NO: 1232606 - DNA, 22 bp, Artificial Sequence
  chemically synthesized
agatacagaaaatcactattaa

SEQ ID NO: 1232607 - DNA, 22 bp, Artificial Sequence
  chemically synthesized
agagtacaaataactgtaggtt

SEQ ID NO: 1232608 - DNA, 22 bp, Artificial Sequence
  chemically synthesized
ttaaacctacagttatttgtac

SEQ ID NO: 1232609 - DNA, 22 bp, Artificial Sequence
  chemically synthesized
aacctacagttatttgtactct

SEQ ID NO: 1232610 - DNA, 22 bp, Artificial Sequence
  chemically synthesized
acagcaaaagattgagagtaca

SEQ ID NO: 1232611 - DNA, 22 bp, Artificial Sequence
  chemically synthesized
aacagcaaaagattgagagtac

SEQ ID NO: 1232612 - DNA, 22 bp, Artificial Sequence
  chemically synthesized
cagttatttgtactctcaatct

SEQ ID NO: 1232613 - DNA, 22 bp, Artificial Sequence
  chemically synthesized
tttgtactctcaatcttttgct

SEQ ID NO: 1232614 - DNA, 22 bp, Artificial Sequence
  chemically synthesized
tgacatatttaacagcaaaaga

SEQ ID NO: 1232615 - DNA, 22 bp, Artificial Sequence
  chemically synthesized
atgacatatttaacagcaaaag

SEQ ID NO: 1232616 - DNA, 22 bp, Artificial Sequence
  chemically synthesized
gtactctcaatcttttgctgtt

SEQ ID NO: 1232617 - DNA, 22 bp, Artificial Sequence
  chemically synthesized
tactctcaatcttttgctgtta

SEQ ID NO: 1232618 - DNA, 22 bp, Artificial Sequence
  chemically synthesized
tcaatcttttgctgttaaatat

SEQ ID NO: 1232619 - DNA, 22 bp, Artificial Sequence
  chemically synthesized
tcaagtttatgacatatttaac

SEQ ID NO: 1232620 - DNA, 22 bp, Artificial Sequence
  chemically synthesized
aatcttttgctgttaaatatgt

SEQ ID NO: 1232621 - DNA, 22 bp, Artificial Sequence
  chemically synthesized
ttgctgttaaatatgtcataaa

SEQ ID NO: 1232622 - DNA, 22 bp, Artificial Sequence
  chemically synthesized
accactgtcaagtttatgacat

SEQ ID NO: 1232623 - DNA, 22 bp, Artificial Sequence
  chemically synthesized
tgctgttaaatatgtcataaac

SEQ ID NO: 1232624 - DNA, 22 bp, Artificial Sequence
  chemically synthesized
gctgttaaatatgtcataaact

SEQ ID NO: 1232625 - DNA, 22 bp, Artificial Sequence
  chemically synthesized
ctgttaaatatgtcataaactt

SEQ ID NO: 1232626 - DNA, 22 bp, Artificial Sequence
  chemically synthesized
attcaccactgtcaagtttatg

SEQ ID NO: 1232627 - DNA, 22 bp, Artificial Sequence
  chemically synthesized
ttaaatatgtcataaacttgac

SEQ ID NO: 1232628 - DNA, 22 bp, Artificial Sequence
  chemically synthesized
aatatgtcataaacttgacagt

SEQ ID NO: 1232629 - DNA, 22 bp, Artificial Sequence
  chemically synthesized
gagccattaattcaccactgtc

SEQ ID NO: 1232630 - DNA, 22 bp, Artificial Sequence
  chemically synthesized
agagccattaattcaccactgt

SEQ ID NO: 1232631 - DNA, 22 bp, Artificial Sequence
  chemically synthesized
tagagccattaattcaccactg

SEQ ID NO: 1232632 - DNA, 22 bp, Artificial Sequence
  chemically synthesized
ttagagccattaattcaccact

SEQ ID NO: 1232633 - DNA, 22 bp, Artificial Sequence
  chemically synthesized
gacagtggtgaattaatggctc

SEQ ID NO: 1232634 - DNA, 22 bp, Artificial Sequence
  chemically synthesized
acagtggtgaattaatggctct

SEQ ID NO: 1232635 - DNA, 22 bp, Artificial Sequence
  chemically synthesized
atggaaatatatttttagagcc

SEQ ID NO: 1232636 - DNA, 22 bp, Artificial Sequence
  chemically synthesized
atggctctaaaaatatatttcc

SEQ ID NO: 1232637 - DNA, 22 bp, Artificial Sequence
  chemically synthesized
taaaaatatatttccatcaatt

SEQ ID NO: 1232638 - DNA, 22 bp, Artificial Sequence
  chemically synthesized
aaaatatatttccatcaatttt

SEQ ID NO: 1232639 - DNA, 22 bp, Artificial Sequence
  chemically synthesized
aatccatgaagaaaaattgatg

SEQ ID NO: 1232640 - DNA, 22 bp, Artificial Sequence
  chemically synthesized
ctaaatccatgaagaaaaattg

SEQ ID NO: 1232641 - DNA, 22 bp, Artificial Sequence
  chemically synthesized
ccatcaatttttcttcatggat

SEQ ID NO: 1232642 - DNA, 22 bp, Artificial Sequence
  chemically synthesized
catcaatttttcttcatggatt

SEQ ID NO: 1232643 - DNA, 22 bp, Artificial Sequence
  chemically synthesized
ttcttcatggatttagcagcat

SEQ ID NO: 1232644 - DNA, 22 bp, Artificial Sequence
  chemically synthesized
tcttcatggatttagcagcatt

SEQ ID NO: 1232645 - DNA, 22 bp, Artificial Sequence
  chemically synthesized
cttcatggatttagcagcattt

SEQ ID NO: 1232646 - DNA, 22 bp, Artificial Sequence
  chemically synthesized
ttcatggatttagcagcatttc

SEQ ID NO: 1232647 - DNA, 22 bp, Artificial Sequence
  chemically synthesized
catggatttagcagcatttcta

SEQ ID NO: 1232648 - DNA, 22 bp, Artificial Sequence
  chemically synthesized
atggatttagcagcatttctac

SEQ ID NO: 1232649 - DNA, 22 bp, Artificial Sequence
  chemically synthesized
agcagcatttctactgtgcgat

SEQ ID NO: 1232650 - DNA, 22 bp, Artificial Sequence
  chemically synthesized
gcagcatttctactgtgcgata

SEQ ID NO: 1232651 - DNA, 22 bp, Artificial Sequence
  chemically synthesized
cagtcaataacgaaaacgtatc

SEQ ID NO: 1232652 - DNA, 22 bp, Artificial Sequence
  chemically synthesized
ctactgtgcgatacgttttcgt

SEQ ID NO: 1232653 - DNA, 22 bp, Artificial Sequence
  chemically synthesized
tactgtgcgatacgttttcgtt

SEQ ID NO: 1232654 - DNA, 22 bp, Artificial Sequence
  chemically synthesized
ctgtgcgatacgttttcgttat

SEQ ID NO: 1232655 - DNA, 22 bp, Artificial Sequence
  chemically synthesized
tgcgatacgttttcgttattga

SEQ ID NO: 1232656 - DNA, 22 bp, Artificial Sequence
  chemically synthesized
aagaaagttacagtcaataacg

SEQ ID NO: 1232657 - DNA, 22 bp, Artificial Sequence
  chemically synthesized
ttcaagaaagttacagtcaata

SEQ ID NO: 1232658 - DNA, 22 bp, Artificial Sequence
  chemically synthesized
attcaagaaagttacagtcaat

SEQ ID NO: 1232659 - DNA, 22 bp, Artificial Sequence
  chemically synthesized
tattcaagaaagttacagtcaa

SEQ ID NO: 1232660 - DNA, 22 bp, Artificial Sequence
  chemically synthesized
tcgttattgactgtaactttct

SEQ ID NO: 1232661 - DNA, 22 bp, Artificial Sequence
  chemically synthesized
cgttattgactgtaactttctt

SEQ ID NO: 1232662 - DNA, 22 bp, Artificial Sequence
  chemically synthesized
gttattgactgtaactttcttg

SEQ ID NO: 1232663 - DNA, 22 bp, Artificial Sequence
  chemically synthesized
gagtgtcattttattcaagaaa

SEQ ID NO: 1232664 - DNA, 22 bp, Artificial Sequence
  chemically synthesized
ttgactgtaactttcttgaata

SEQ ID NO: 1232665 - DNA, 22 bp, Artificial Sequence
  chemically synthesized
agagtgtcattttattcaagaa

SEQ ID NO: 1232666 - DNA, 22 bp, Artificial Sequence
  chemically synthesized
actgtaactttcttgaataaaa

SEQ ID NO: 1232667 - DNA, 22 bp, Artificial Sequence
  chemically synthesized
taactttcttgaataaaatgac

SEQ ID NO: 1232668 - DNA, 22 bp, Artificial Sequence
  chemically synthesized
acaaacttagagtgtcatttta

SEQ ID NO: 1232669 - DNA, 22 bp, Artificial Sequence
  chemically synthesized
tcttgaataaaatgacactcta

SEQ ID NO: 1232670 - DNA, 22 bp, Artificial Sequence
  chemically synthesized
cttgaataaaatgacactctaa

SEQ ID NO: 1232671 - DNA, 22 bp, Artificial Sequence
  chemically synthesized
ttgaataaaatgacactctaag

SEQ ID NO: 1232672 - DNA, 22 bp, Artificial Sequence
  chemically synthesized
gaataaaatgacactctaagtt

SEQ ID NO: 1232673 - DNA, 22 bp, Artificial Sequence
  chemically synthesized
aataaaatgacactctaagttt

SEQ ID NO: 1232674 - DNA, 22 bp, Artificial Sequence
  chemically synthesized
taagtttgttagtattctatca

SEQ ID NO: 1232675 - DNA, 22 bp, Artificial Sequence
  chemically synthesized
agtttgttagtattctatcact

SEQ ID NO: 1232676 - DNA, 22 bp, Artificial Sequence
  chemically synthesized
gttagtattctatcactgattt

SEQ ID NO: 1232677 - DNA, 22 bp, Artificial Sequence
  chemically synthesized
ttagtattctatcactgatttt

SEQ ID NO: 1232678 - DNA, 22 bp, Artificial Sequence
  chemically synthesized
gtattctatcactgatttttca

SEQ ID NO: 1232679 - DNA, 22 bp, Artificial Sequence
  chemically synthesized
tatcactgatttttcattttgt

SEQ ID NO: 1232680 - DNA, 22 bp, Artificial Sequence
  chemically synthesized
tcactgatttttcattttgtct

SEQ ID NO: 1232681 - DNA, 22 bp, Artificial Sequence
  chemically synthesized
atttttcattttgtctgatttt

SEQ ID NO: 1232682 - DNA, 22 bp, Artificial Sequence
  chemically synthesized
ttcattttgtctgatttttcct

SEQ ID NO: 1232683 - DNA, 22 bp, Artificial Sequence
  chemically synthesized
tcattttgtctgatttttcctg

SEQ ID NO: 1232684 - DNA, 22 bp, Artificial Sequence
  chemically synthesized
cattttgtctgatttttcctgt

SEQ ID NO: 1232685 - DNA, 22 bp, Artificial Sequence
  chemically synthesized
attttgtctgatttttcctgtt

SEQ ID NO: 1232686 - DNA, 22 bp, Artificial Sequence
  chemically synthesized
tgtctgatttttcctgttttat

SEQ ID NO: 1232687 - DNA, 22 bp, Artificial Sequence
  chemically synthesized
gtctgatttttcctgttttata

SEQ ID NO: 1232688 - DNA, 22 bp, Artificial Sequence
  chemically synthesized
tctgatttttcctgttttatat

SEQ ID NO: 1232689 - DNA, 22 bp, Artificial Sequence
  chemically synthesized
aagaataataaaaaatataaaa

SEQ ID NO: 1232690 - DNA, 22 bp, Artificial Sequence
  chemically synthesized
aaagaataataaaaaatataaa

SEQ ID NO: 1232691 - DNA, 22 bp, Artificial Sequence
  chemically synthesized
atttttcctgttttatattttt

SEQ ID NO: 1232692 - DNA, 22 bp, Artificial Sequence
  chemically synthesized
ttcctgttttatattttttatt

SEQ ID NO: 1232693 - DNA, 22 bp, Artificial Sequence
  chemically synthesized
tcctgttttatattttttatta

SEQ ID NO: 1232694 - DNA, 22 bp, Artificial Sequence
  chemically synthesized
cctgttttatattttttattat

SEQ ID NO: 1232695 - DNA, 22 bp, Artificial Sequence
  chemically synthesized
ctgttttatattttttattatt

SEQ ID NO: 1232696 - DNA, 22 bp, Artificial Sequence
  chemically synthesized
ttttatattttttattattctt

SEQ ID NO: 1232697 - DNA, 22 bp, Artificial Sequence
  chemically synthesized
tatattttttattattctttaa

SEQ ID NO: 1232698 - DNA, 22 bp, Artificial Sequence
  chemically synthesized
atattttttattattctttaag

SEQ ID NO: 1232699 - DNA, 22 bp, Artificial Sequence
  chemically synthesized
tattttttattattctttaagt

SEQ ID NO: 1232700 - DNA, 22 bp, Artificial Sequence
  chemically synthesized
cacatgtaccccagaacttaaa

SEQ ID NO: 1232701 - DNA, 22 bp, Artificial Sequence
  chemically synthesized
tttattattctttaagttctgg

SEQ ID NO: 1232702 - DNA, 22 bp, Artificial Sequence
  chemically synthesized
ttattattctttaagttctggg

SEQ ID NO: 1232703 - DNA, 22 bp, Artificial Sequence
  chemically synthesized
tattattctttaagttctgggg

SEQ ID NO: 1232704 - DNA, 22 bp, Artificial Sequence
  chemically synthesized
attattctttaagttctggggt

SEQ ID NO: 1232705 - DNA, 22 bp, Artificial Sequence
  chemically synthesized
ttattctttaagttctggggta

SEQ ID NO: 1232706 - DNA, 22 bp, Artificial Sequence
  chemically synthesized
ttctttaagttctggggtacat

SEQ ID NO: 1232707 - DNA, 22 bp, Artificial Sequence
  chemically synthesized
tttaagttctggggtacatgtg

SEQ ID NO: 1232708 - DNA, 22 bp, Artificial Sequence
  chemically synthesized
tgtaacaaacctgcacatgtac

SEQ ID NO: 1232709 - DNA, 22 bp, Artificial Sequence
  chemically synthesized
taagttctggggtacatgtgca

SEQ ID NO: 1232710 - DNA, 22 bp, Artificial Sequence
  chemically synthesized
aagttctggggtacatgtgcag

SEQ ID NO: 1232711 - DNA, 22 bp, Artificial Sequence
  chemically synthesized
agttctggggtacatgtgcagg

SEQ ID NO: 1232712 - DNA, 22 bp, Artificial Sequence
  chemically synthesized
tggggtacatgtgcaggtttgt

SEQ ID NO: 1232713 - DNA, 22 bp, Artificial Sequence
  chemically synthesized
gggtacatgtgcaggtttgtta

SEQ ID NO: 1232714 - DNA, 22 bp, Artificial Sequence
  chemically synthesized
tcgcaggtgtataactatgtaa

SEQ ID NO: 1232715 - DNA, 22 bp, Artificial Sequence
  chemically synthesized
gttacatagttatacacctgcg

SEQ ID NO: 1232716 - DNA, 22 bp, Artificial Sequence
  chemically synthesized
ttacatagttatacacctgcga

SEQ ID NO: 1232717 - DNA, 22 bp, Artificial Sequence
  chemically synthesized
catagttatacacctgcgatag

SEQ ID NO: 1232718 - DNA, 22 bp, Artificial Sequence
  chemically synthesized
tgggtacagcaaaccactatcg

SEQ ID NO: 1232719 - DNA, 22 bp, Artificial Sequence
  chemically synthesized
tacacctgcgatagtggtttgc

SEQ ID NO: 1232720 - DNA, 22 bp, Artificial Sequence
  chemically synthesized
cgatagtggtttgctgtaccca

SEQ ID NO: 1232721 - DNA, 22 bp, Artificial Sequence
  chemically synthesized
atgtaggtgacgggtctatggg

SEQ ID NO: 1232722 - DNA, 22 bp, Artificial Sequence
  chemically synthesized
gctgtacccatagacccgtcac

SEQ ID NO: 1232723 - DNA, 22 bp, Artificial Sequence
  chemically synthesized
ctgtacccatagacccgtcacc

SEQ ID NO: 1232724 - DNA, 22 bp, Artificial Sequence
  chemically synthesized
tacccatagacccgtcacctac

SEQ ID NO: 1232725 - DNA, 22 bp, Artificial Sequence
  chemically synthesized
ggagaaatacctaatgtaggtg

SEQ ID NO: 1232726 - DNA, 22 bp, Artificial Sequence
  chemically synthesized
ggggagggatagaattaggaga

SEQ ID NO: 1232727 - DNA, 22 bp, Artificial Sequence
  chemically synthesized
cattaggtatttctcctaattc

SEQ ID NO: 1232728 - DNA, 22 bp, Artificial Sequence
  chemically synthesized
ggtatttctcctaattctatcc

SEQ ID NO: 1232729 - DNA, 22 bp, Artificial Sequence
  chemically synthesized
ctcctaattctatccctcccct

SEQ ID NO: 1232730 - DNA, 22 bp, Artificial Sequence
  chemically synthesized
tcctaattctatccctccccta

SEQ ID NO: 1232731 - DNA, 22 bp, Artificial Sequence
  chemically synthesized
ctaattctatccctcccctagc

SEQ ID NO: 1232732 - DNA, 22 bp, Artificial Sequence
  chemically synthesized
tcagagggtggggggctagggg

SEQ ID NO: 1232733 - DNA, 22 bp, Artificial Sequence
  chemically synthesized
attctatccctcccctagcccc

SEQ ID NO: 1232734 - DNA, 22 bp, Artificial Sequence
  chemically synthesized
tatccctcccctagccccccac

SEQ ID NO: 1232735 - DNA, 22 bp, Artificial Sequence
  chemically synthesized
tccctcccctagccccccaccc

SEQ ID NO: 1232736 - DNA, 22 bp, Artificial Sequence
  chemically synthesized
ccctagccccccaccctctgac

SEQ ID NO: 1232737 - DNA, 22 bp, Artificial Sequence
  chemically synthesized
gccccccaccctctgacaggcc

SEQ ID NO: 1232738 - DNA, 22 bp, Artificial Sequence
  chemically synthesized
ggaggggaacgtcacacaccat

SEQ ID NO: 1232739 - DNA, 22 bp, Artificial Sequence
  chemically synthesized
tgacaggccatggtgtgtgacg

SEQ ID NO: 1232740 - DNA, 22 bp, Artificial Sequence
  chemically synthesized
acaggccatggtgtgtgacgtt

SEQ ID NO: 1232741 - DNA, 22 bp, Artificial Sequence
  chemically synthesized
aacaatgagaacatatggacat

SEQ ID NO: 1232742 - DNA, 22 bp, Artificial Sequence
  chemically synthesized
ccctcctaatgtccatatgttc

SEQ ID NO: 1232743 - DNA, 22 bp, Artificial Sequence
  chemically synthesized
ctaatgtccatatgttctcatt

SEQ ID NO: 1232744 - DNA, 22 bp, Artificial Sequence
  chemically synthesized
atgtccatatgttctcattgtt

SEQ ID NO: 1232745 - DNA, 22 bp, Artificial Sequence
  chemically synthesized
ataagtggtagctgaacaatga

SEQ ID NO: 1232746 - DNA, 22 bp, Artificial Sequence
  chemically synthesized
actcataagtggtagctgaaca

SEQ ID NO: 1232747 - DNA, 22 bp, Artificial Sequence
  chemically synthesized
tgactcataagtggtagctgaa

SEQ ID NO: 1232748 - DNA, 22 bp, Artificial Sequence
  chemically synthesized
tcattgttcagctaccacttat

SEQ ID NO: 1232749 - DNA, 22 bp, Artificial Sequence
  chemically synthesized
attgttcagctaccacttatga

SEQ ID NO: 1232750 - DNA, 22 bp, Artificial Sequence
  chemically synthesized
ttcagctaccacttatgagtca

SEQ ID NO: 1232751 - DNA, 22 bp, Artificial Sequence
  chemically synthesized
agctaccacttatgagtcagaa

SEQ ID NO: 1232752 - DNA, 22 bp, Artificial Sequence
  chemically synthesized
ccacttatgagtcagaacatgc

SEQ ID NO: 1232753 - DNA, 22 bp, Artificial Sequence
  chemically synthesized
atgagtcagaacatgcggtgtt

SEQ ID NO: 1232754 - DNA, 22 bp, Artificial Sequence
  chemically synthesized
tgagtcagaacatgcggtgttt

SEQ ID NO: 1232755 - DNA, 22 bp, Artificial Sequence
  chemically synthesized
acacaagaacagaaaaccaaac

SEQ ID NO: 1232756 - DNA, 22 bp, Artificial Sequence
  chemically synthesized
agcaaactaacacaagaacaga

SEQ ID NO: 1232757 - DNA, 22 bp, Artificial Sequence
  chemically synthesized
tcagcaaactaacacaagaaca

SEQ ID NO: 1232758 - DNA, 22 bp, Artificial Sequence
  chemically synthesized
ggttttctgttcttgtgttagt

SEQ ID NO: 1232759 - DNA, 22 bp, Artificial Sequence
  chemically synthesized
gttttctgttcttgtgttagtt

SEQ ID NO: 1232760 - DNA, 22 bp, Artificial Sequence
  chemically synthesized
tctgttcttgtgttagtttgct

SEQ ID NO: 1232761 - DNA, 22 bp, Artificial Sequence
  chemically synthesized
ctgttcttgtgttagtttgctg

SEQ ID NO: 1232762 - DNA, 22 bp, Artificial Sequence
  chemically synthesized
tgttcttgtgttagtttgctga

SEQ ID NO: 1232763 - DNA, 22 bp, Artificial Sequence
  chemically synthesized
gaaaccatcattctcagcaaac

SEQ ID NO: 1232764 - DNA, 22 bp, Artificial Sequence
  chemically synthesized
ttcttgtgttagtttgctgaga

SEQ ID NO: 1232765 - DNA, 22 bp, Artificial Sequence
  chemically synthesized
ttgtgttagtttgctgagaatg

SEQ ID NO: 1232766 - DNA, 22 bp, Artificial Sequence
  chemically synthesized
gtgttagtttgctgagaatgat

SEQ ID NO: 1232767 - DNA, 22 bp, Artificial Sequence
  chemically synthesized
tgttagtttgctgagaatgatg

SEQ ID NO: 1232768 - DNA, 22 bp, Artificial Sequence
  chemically synthesized
gtttgctgagaatgatggtttc

SEQ ID NO: 1232769 - DNA, 22 bp, Artificial Sequence
  chemically synthesized
gctgagaatgatggtttccagc

SEQ ID NO: 1232770 - DNA, 22 bp, Artificial Sequence
  chemically synthesized
ctgagaatgatggtttccagct

SEQ ID NO: 1232771 - DNA, 22 bp, Artificial Sequence
  chemically synthesized
agaatgatggtttccagcttca

SEQ ID NO: 1232772 - DNA, 22 bp, Artificial Sequence
  chemically synthesized
cagggacatggatgaagctgga

SEQ ID NO: 1232773 - DNA, 22 bp, Artificial Sequence
  chemically synthesized
gcagggacatggatgaagctgg

SEQ ID NO: 1232774 - DNA, 22 bp, Artificial Sequence
  chemically synthesized
tgcagggacatggatgaagctg

SEQ ID NO: 1232775 - DNA, 22 bp, Artificial Sequence
  chemically synthesized
atgtcctttgcagggacatgga

SEQ ID NO: 1232776 - DNA, 22 bp, Artificial Sequence
  chemically synthesized
ccagcttcatccatgtccctgc

SEQ ID NO: 1232777 - DNA, 22 bp, Artificial Sequence
  chemically synthesized
cagcttcatccatgtccctgca

SEQ ID NO: 1232778 - DNA, 22 bp, Artificial Sequence
  chemically synthesized
catccatgtccctgcaaaggac

SEQ ID NO: 1232779 - DNA, 22 bp, Artificial Sequence
  chemically synthesized
atccatgtccctgcaaaggaca

SEQ ID NO: 1232780 - DNA, 22 bp, Artificial Sequence
  chemically synthesized
caaaggacatgaactcattctt

SEQ ID NO: 1232781 - DNA, 22 bp, Artificial Sequence
  chemically synthesized
tgcagccataaaaaaagaatga

SEQ ID NO: 1232782 - DNA, 22 bp, Artificial Sequence
  chemically synthesized
attctttttttatggctgcata

SEQ ID NO: 1232783 - DNA, 22 bp, Artificial Sequence
  chemically synthesized
tttttttatggctgcatagtat

SEQ ID NO: 1232784 - DNA, 22 bp, Artificial Sequence
  chemically synthesized
tttttatggctgcatagtattc

SEQ ID NO: 1232785 - DNA, 22 bp, Artificial Sequence
  chemically synthesized
ttttatggctgcatagtattcc

SEQ ID NO: 1232786 - DNA, 22 bp, Artificial Sequence
  chemically synthesized
tttatggctgcatagtattcca

SEQ ID NO: 1232787 - DNA, 22 bp, Artificial Sequence
  chemically synthesized
ttatggctgcatagtattccat

SEQ ID NO: 1232788 - DNA, 22 bp, Artificial Sequence
  chemically synthesized
tatggctgcatagtattccatg

SEQ ID NO: 1232789 - DNA, 22 bp, Artificial Sequence
  chemically synthesized
atggctgcatagtattccatgg

SEQ ID NO: 1232790 - DNA, 22 bp, Artificial Sequence
  chemically synthesized
tggctgcatagtattccatggt

SEQ ID NO: 1232791 - DNA, 22 bp, Artificial Sequence
  chemically synthesized
catagtattccatggtgtatat

SEQ ID NO: 1232792 - DNA, 22 bp, Artificial Sequence
  chemically synthesized
agaaaatgtggtacatatacac

SEQ ID NO: 1232793 - DNA, 22 bp, Artificial Sequence
  chemically synthesized
gattaagaaaatgtggtacata

SEQ ID NO: 1232794 - DNA, 22 bp, Artificial Sequence
  chemically synthesized
catggtgtatatgtaccacatt

SEQ ID NO: 1232795 - DNA, 22 bp, Artificial Sequence
  chemically synthesized
tcttaatccagtctatcactga

SEQ ID NO: 1232796 - DNA, 22 bp, Artificial Sequence
  chemically synthesized
gccaaatgtccatcagtgatag

SEQ ID NO: 1232797 - DNA, 22 bp, Artificial Sequence
  chemically synthesized
cttaatccagtctatcactgat

SEQ ID NO: 1232798 - DNA, 22 bp, Artificial Sequence
  chemically synthesized
ttaatccagtctatcactgatg

SEQ ID NO: 1232799 - DNA, 22 bp, Artificial Sequence
  chemically synthesized
aatccagtctatcactgatgga

SEQ ID NO: 1232800 - DNA, 22 bp, Artificial Sequence
  chemically synthesized
atccagtctatcactgatggac

SEQ ID NO: 1232801 - DNA, 22 bp, Artificial Sequence
  chemically synthesized
gtatgtatgttggccaaatgtc

SEQ ID NO: 1232802 - DNA, 22 bp, Artificial Sequence
  chemically synthesized
cgtatgtatgttggccaaatgt

SEQ ID NO: 1232803 - DNA, 22 bp, Artificial Sequence
  chemically synthesized
tcgtatgtatgttggccaaatg

SEQ ID NO: 1232804 - DNA, 22 bp, Artificial Sequence
  chemically synthesized
tcactgatggacatttggccaa

SEQ ID NO: 1232805 - DNA, 22 bp, Artificial Sequence
  chemically synthesized
ttcgtatgtatgttggccaaat

SEQ ID NO: 1232806 - DNA, 22 bp, Artificial Sequence
  chemically synthesized
tttcgtatgtatgttggccaaa

SEQ ID NO: 1232807 - DNA, 22 bp, Artificial Sequence
  chemically synthesized
atggacatttggccaacataca

SEQ ID NO: 1232808 - DNA, 22 bp, Artificial Sequence
  chemically synthesized
ggccaacatacatacgaaaaaa

SEQ ID NO: 1232809 - DNA, 22 bp, Artificial Sequence
  chemically synthesized
gccaacatacatacgaaaaaat

SEQ ID NO: 1232810 - DNA, 22 bp, Artificial Sequence
  chemically synthesized
atgacaagtgataagcattttt

SEQ ID NO: 1232811 - DNA, 22 bp, Artificial Sequence
  chemically synthesized
taatgacaagtgataagcattt

SEQ ID NO: 1232812 - DNA, 22 bp, Artificial Sequence
  chemically synthesized
ctaatgacaagtgataagcatt

SEQ ID NO: 1232813 - DNA, 22 bp, Artificial Sequence
  chemically synthesized
tctaatgacaagtgataagcat

SEQ ID NO: 1232814 - DNA, 22 bp, Artificial Sequence
  chemically synthesized
ttctaatgacaagtgataagca

SEQ ID NO: 1232815 - DNA, 22 bp, Artificial Sequence
  chemically synthesized
catttttctaatgacaagtgat

SEQ ID NO: 1232816 - DNA, 22 bp, Artificial Sequence
  chemically synthesized
gcatttttctaatgacaagtga

SEQ ID NO: 1232817 - DNA, 22 bp, Artificial Sequence
  chemically synthesized
atttgcatttttctaatgacaa

SEQ ID NO: 1232818 - DNA, 22 bp, Artificial Sequence
  chemically synthesized
gatttgcatttttctaatgaca

SEQ ID NO: 1232819 - DNA, 22 bp, Artificial Sequence
  chemically synthesized
tgatttgcatttttctaatgac

SEQ ID NO: 1232820 - DNA, 22 bp, Artificial Sequence
  chemically synthesized
atcacttgtcattagaaaaatg

SEQ ID NO: 1232821 - DNA, 22 bp, Artificial Sequence
  chemically synthesized
tcacttgtcattagaaaaatgc

SEQ ID NO: 1232822 - DNA, 22 bp, Artificial Sequence
  chemically synthesized
tggttttgatttgcatttttct

SEQ ID NO: 1232823 - DNA, 22 bp, Artificial Sequence
  chemically synthesized
attgtggttttgatttgcattt

SEQ ID NO: 1232824 - DNA, 22 bp, Artificial Sequence
  chemically synthesized
gtcattagaaaaatgcaaatca

SEQ ID NO: 1232825 - DNA, 22 bp, Artificial Sequence
  chemically synthesized
tcattagaaaaatgcaaatcaa

SEQ ID NO: 1232826 - DNA, 22 bp, Artificial Sequence
  chemically synthesized
gaaaaatgcaaatcaaaaccac

SEQ ID NO: 1232827 - DNA, 22 bp, Artificial Sequence
  chemically synthesized
aatggtatctcattgtggtttt

SEQ ID NO: 1232828 - DNA, 22 bp, Artificial Sequence
  chemically synthesized
ttaaatggtatctcattgtggt

SEQ ID NO: 1232829 - DNA, 22 bp, Artificial Sequence
  chemically synthesized
ttgttaaatggtatctcattgt

SEQ ID NO: 1232830 - DNA, 22 bp, Artificial Sequence
  chemically synthesized
actgttgttaaatggtatctca

SEQ ID NO: 1232831 - DNA, 22 bp, Artificial Sequence
  chemically synthesized
taactgttgttaaatggtatct

SEQ ID NO: 1232832 - DNA, 22 bp, Artificial Sequence
  chemically synthesized
ccattctaactgttgttaaatg

SEQ ID NO: 1232833 - DNA, 22 bp, Artificial Sequence
  chemically synthesized
atgattgccattctaactgttg

SEQ ID NO: 1232834 - DNA, 22 bp, Artificial Sequence
  chemically synthesized
aatgattgccattctaactgtt

SEQ ID NO: 1232835 - DNA, 22 bp, Artificial Sequence
  chemically synthesized
taatgattgccattctaactgt

SEQ ID NO: 1232836 - DNA, 22 bp, Artificial Sequence
  chemically synthesized
ttaatgattgccattctaactg

SEQ ID NO: 1232837 - DNA, 22 bp, Artificial Sequence
  chemically synthesized
tttaatgattgccattctaact

SEQ ID NO: 1232838 - DNA, 22 bp, Artificial Sequence
  chemically synthesized
actttttaatgattgccattct

SEQ ID NO: 1232839 - DNA, 22 bp, Artificial Sequence
  chemically synthesized
aacaacagttagaatggcaatc

SEQ ID NO: 1232840 - DNA, 22 bp, Artificial Sequence
  chemically synthesized
acaacagttagaatggcaatca

SEQ ID NO: 1232841 - DNA, 22 bp, Artificial Sequence
  chemically synthesized
ctgactttttaatgattgccat

SEQ ID NO: 1232842 - DNA, 22 bp, Artificial Sequence
  chemically synthesized
gctgactttttaatgattgcca

SEQ ID NO: 1232843 - DNA, 22 bp, Artificial Sequence
  chemically synthesized
tgctgactttttaatgattgcc

SEQ ID NO: 1232844 - DNA, 22 bp, Artificial Sequence
  chemically synthesized
ttgctgactttttaatgattgc

SEQ ID NO: 1232845 - DNA, 22 bp, Artificial Sequence
  chemically synthesized
gaatggcaatcattaaaaagtc

SEQ ID NO: 1232846 - DNA, 22 bp, Artificial Sequence
  chemically synthesized
cagcatcttttgctgacttttt

SEQ ID NO: 1232847 - DNA, 22 bp, Artificial Sequence
  chemically synthesized
tccagcatcttttgctgacttt

SEQ ID NO: 1232848 - DNA, 22 bp, Artificial Sequence
  chemically synthesized
tctccagcatcttttgctgact

SEQ ID NO: 1232849 - DNA, 22 bp, Artificial Sequence
  chemically synthesized
catattctctccagcatctttt

SEQ ID NO: 1232850 - DNA, 22 bp, Artificial Sequence
  chemically synthesized
aaaagtcagcaaaagatgctgg

SEQ ID NO: 1232851 - DNA, 22 bp, Artificial Sequence
  chemically synthesized
tccatattctctccagcatctt

SEQ ID NO: 1232852 - DNA, 22 bp, Artificial Sequence
  chemically synthesized
ctccatattctctccagcatct

SEQ ID NO: 1232853 - DNA, 22 bp, Artificial Sequence
  chemically synthesized
tttctccatattctctccagca

SEQ ID NO: 1232854 - DNA, 22 bp, Artificial Sequence
  chemically synthesized
ctatttctccatattctctcca

SEQ ID NO: 1232855 - DNA, 22 bp, Artificial Sequence
  chemically synthesized
gagagaatatggagaaatagga

SEQ ID NO: 1232856 - DNA, 22 bp, Artificial Sequence
  chemically synthesized
ccaccaacagtgtaaaagcatt

SEQ ID NO: 1232857 - DNA, 22 bp, Artificial Sequence
  chemically synthesized
cattcccaccaacagtgtaaaa

SEQ ID NO: 1232858 - DNA, 22 bp, Artificial Sequence
  chemically synthesized
acattcccaccaacagtgtaaa

SEQ ID NO: 1232859 - DNA, 22 bp, Artificial Sequence
  chemically synthesized
atttacattcccaccaacagtg

SEQ ID NO: 1232860 - DNA, 22 bp, Artificial Sequence
  chemically synthesized
aactaatttacattcccaccaa

SEQ ID NO: 1232861 - DNA, 22 bp, Artificial Sequence
  chemically synthesized
ttacactgttggtgggaatgta

SEQ ID NO: 1232862 - DNA, 22 bp, Artificial Sequence
  chemically synthesized
tacactgttggtgggaatgtaa

SEQ ID NO: 1232863 - DNA, 22 bp, Artificial Sequence
  chemically synthesized
acactgttggtgggaatgtaaa

SEQ ID NO: 1232864 - DNA, 22 bp, Artificial Sequence
  chemically synthesized
cactgttggtgggaatgtaaat

SEQ ID NO: 1232865 - DNA, 22 bp, Artificial Sequence
  chemically synthesized
cacaatggttgaactaatttac

SEQ ID NO: 1232866 - DNA, 22 bp, Artificial Sequence
  chemically synthesized
ttggtgggaatgtaaattagtt

SEQ ID NO: 1232867 - DNA, 22 bp, Artificial Sequence
  chemically synthesized
ccacaatggttgaactaattta

SEQ ID NO: 1232868 - DNA, 22 bp, Artificial Sequence
  chemically synthesized
gtgggaatgtaaattagttcaa

SEQ ID NO: 1232869 - DNA, 22 bp, Artificial Sequence
  chemically synthesized
tcttccacaatggttgaactaa

SEQ ID NO: 1232870 - DNA, 22 bp, Artificial Sequence
  chemically synthesized
gttcaaccattgtggaagacag

SEQ ID NO: 1232871 - DNA, 22 bp, Artificial Sequence
  chemically synthesized
aggaatcaccacactgtcttcc

SEQ ID NO: 1232872 - DNA, 22 bp, Artificial Sequence
  chemically synthesized
gaggaatcaccacactgtcttc

SEQ ID NO: 1232873 - DNA, 22 bp, Artificial Sequence
  chemically synthesized
aaccattgtggaagacagtgtg

SEQ ID NO: 1232874 - DNA, 22 bp, Artificial Sequence
  chemically synthesized
cagatccttgaggaatcaccac

SEQ ID NO: 1232875 - DNA, 22 bp, Artificial Sequence
  chemically synthesized
tggaagacagtgtggtgattcc

SEQ ID NO: 1232876 - DNA, 22 bp, Artificial Sequence
  chemically synthesized
gttccagatccttgaggaatca

SEQ ID NO: 1232877 - DNA, 22 bp, Artificial Sequence
  chemically synthesized
tagttccagatccttgaggaat

SEQ ID NO: 1232878 - DNA, 22 bp, Artificial Sequence
  chemically synthesized
ctagttccagatccttgaggaa

SEQ ID NO: 1232879 - DNA, 22 bp, Artificial Sequence
  chemically synthesized
ctcaaggatctggaactagaaa

SEQ ID NO: 1232880 - DNA, 22 bp, Artificial Sequence
  chemically synthesized
ggtcaaatggtatttctagttc

SEQ ID NO: 1232881 - DNA, 22 bp, Artificial Sequence
  chemically synthesized
aaggatctggaactagaaatac

SEQ ID NO: 1232882 - DNA, 22 bp, Artificial Sequence
  chemically synthesized
ctgggtcaaatggtatttctag

SEQ ID NO: 1232883 - DNA, 22 bp, Artificial Sequence
  chemically synthesized
gaactagaaataccatttgacc

SEQ ID NO: 1232884 - DNA, 22 bp, Artificial Sequence
  chemically synthesized
gaaataccatttgacccagcaa

SEQ ID NO: 1232885 - DNA, 22 bp, Artificial Sequence
  chemically synthesized
gatatatacccagtaacaggat

SEQ ID NO: 1232886 - DNA, 22 bp, Artificial Sequence
  chemically synthesized
ggatatatacccagtaacagga

SEQ ID NO: 1232887 - DNA, 22 bp, Artificial Sequence
  chemically synthesized
tggatatatacccagtaacagg

SEQ ID NO: 1232888 - DNA, 22 bp, Artificial Sequence
  chemically synthesized
gacccagcaatcctgttactgg

SEQ ID NO: 1232889 - DNA, 22 bp, Artificial Sequence
  chemically synthesized
acccagcaatcctgttactggg

SEQ ID NO: 1232890 - DNA, 22 bp, Artificial Sequence
  chemically synthesized
taatcctttggatatataccca

SEQ ID NO: 1232891 - DNA, 22 bp, Artificial Sequence
  chemically synthesized
ataatcctttggatatataccc

SEQ ID NO: 1232892 - DNA, 22 bp, Artificial Sequence
  chemically synthesized
ttactgggtatatatccaaagg

SEQ ID NO: 1232893 - DNA, 22 bp, Artificial Sequence
  chemically synthesized
ctgggtatatatccaaaggatt

SEQ ID NO: 1232894 - DNA, 22 bp, Artificial Sequence
  chemically synthesized
ggtatatatccaaaggattata

SEQ ID NO: 1232895 - DNA, 22 bp, Artificial Sequence
  chemically synthesized
atagtagaatgatttataatcc

SEQ ID NO: 1232896 - DNA, 22 bp, Artificial Sequence
  chemically synthesized
catagtagaatgatttataatc

SEQ ID NO: 1232897 - DNA, 22 bp, Artificial Sequence
  chemically synthesized
taaatcattctactatgaagac

SEQ ID NO: 1232898 - DNA, 22 bp, Artificial Sequence
  chemically synthesized
tactatgaagacacatgcacac

SEQ ID NO: 1232899 - DNA, 22 bp, Artificial Sequence
  chemically synthesized
ctatgaagacacatgcacacat

SEQ ID NO: 1232900 - DNA, 22 bp, Artificial Sequence
  chemically synthesized
tgaagacacatgcacacatctg

SEQ ID NO: 1232901 - DNA, 22 bp, Artificial Sequence
  chemically synthesized
tgaatagtgccacaatgaacag

SEQ ID NO: 1232902 - DNA, 22 bp, Artificial Sequence
  chemically synthesized
ttgtgaatagtgccacaatgaa

SEQ ID NO: 1232903 - DNA, 22 bp, Artificial Sequence
  chemically synthesized
ctattgtgaatagtgccacaat

SEQ ID NO: 1232904 - DNA, 22 bp, Artificial Sequence
  chemically synthesized
gctattgtgaatagtgccacaa

SEQ ID NO: 1232905 - DNA, 22 bp, Artificial Sequence
  chemically synthesized
tgctattgtgaatagtgccaca

SEQ ID NO: 1232906 - DNA, 22 bp, Artificial Sequence
  chemically synthesized
ttcattgtggcactattcacaa

SEQ ID NO: 1232907 - DNA, 22 bp, Artificial Sequence
  chemically synthesized
caagtctttgctattgtgaata

SEQ ID NO: 1232908 - DNA, 22 bp, Artificial Sequence
  chemically synthesized
attgtggcactattcacaatag

SEQ ID NO: 1232909 - DNA, 22 bp, Artificial Sequence
  chemically synthesized
tggcactattcacaatagcaaa

SEQ ID NO: 1232910 - DNA, 22 bp, Artificial Sequence
  chemically synthesized
ttcacaatagcaaagacttgga

SEQ ID NO: 1232911 - DNA, 22 bp, Artificial Sequence
  chemically synthesized
acaatagcaaagacttggaact

SEQ ID NO: 1232912 - DNA, 22 bp, Artificial Sequence
  chemically synthesized
aaaatcagtaatagttccaagt

SEQ ID NO: 1232913 - DNA, 22 bp, Artificial Sequence
  chemically synthesized
aaaaatcagtaatagttccaag

SEQ ID NO: 1232914 - DNA, 22 bp, Artificial Sequence
  chemically synthesized
taaaaatcagtaatagttccaa

SEQ ID NO: 1232915 - DNA, 22 bp, Artificial Sequence
  chemically synthesized
ttttaaaaatcagtaatagttc

SEQ ID NO: 1232916 - DNA, 22 bp, Artificial Sequence
  chemically synthesized
ggaactattactgatttttaaa

SEQ ID NO: 1232917 - DNA, 22 bp, Artificial Sequence
  chemically synthesized
gaactattactgatttttaaaa

SEQ ID NO: 1232918 - DNA, 22 bp, Artificial Sequence
  chemically synthesized
ttactgatttttaaaataacct

SEQ ID NO: 1232919 - DNA, 22 bp, Artificial Sequence
  chemically synthesized
ctgatttttaaaataacctgac

SEQ ID NO: 1232920 - DNA, 22 bp, Artificial Sequence
  chemically synthesized
aatgggtcataagtcaggttat

SEQ ID NO: 1232921 - DNA, 22 bp, Artificial Sequence
  chemically synthesized
atttttaaaataacctgactta

SEQ ID NO: 1232922 - DNA, 22 bp, Artificial Sequence
  chemically synthesized
ttaaaataacctgacttatgac

SEQ ID NO: 1232923 - DNA, 22 bp, Artificial Sequence
  chemically synthesized
gaaattaaatgggtcataagtc

SEQ ID NO: 1232924 - DNA, 22 bp, Artificial Sequence
  chemically synthesized
taaaataacctgacttatgacc

SEQ ID NO: 1232925 - DNA, 22 bp, Artificial Sequence
  chemically synthesized
aaaataacctgacttatgaccc

SEQ ID NO: 1232926 - DNA, 22 bp, Artificial Sequence
  chemically synthesized
aaataacctgacttatgaccca

SEQ ID NO: 1232927 - DNA, 22 bp, Artificial Sequence
  chemically synthesized
ctagaaattaaatgggtcataa

SEQ ID NO: 1232928 - DNA, 22 bp, Artificial Sequence
  chemically synthesized
acttatgacccatttaatttct

SEQ ID NO: 1232929 - DNA, 22 bp, Artificial Sequence
  chemically synthesized
aaaaaacactactagaaattaa

SEQ ID NO: 1232930 - DNA, 22 bp, Artificial Sequence
  chemically synthesized
atgacccatttaatttctagta

SEQ ID NO: 1232931 - DNA, 22 bp, Artificial Sequence
  chemically synthesized
tgacccatttaatttctagtag

SEQ ID NO: 1232932 - DNA, 22 bp, Artificial Sequence
  chemically synthesized
aatttctagtagtgttttttta

SEQ ID NO: 1232933 - DNA, 22 bp, Artificial Sequence
  chemically synthesized
atttctagtagtgtttttttag

SEQ ID NO: 1232934 - DNA, 22 bp, Artificial Sequence
  chemically synthesized
ctagtagtgtttttttagtcat

SEQ ID NO: 1232935 - DNA, 22 bp, Artificial Sequence
  chemically synthesized
aatgagatgacaatgactaaaa

SEQ ID NO: 1232936 - DNA, 22 bp, Artificial Sequence
  chemically synthesized
tagtagtgtttttttagtcatt

SEQ ID NO: 1232937 - DNA, 22 bp, Artificial Sequence
  chemically synthesized
gtagtgtttttttagtcattgt

SEQ ID NO: 1232938 - DNA, 22 bp, Artificial Sequence
  chemically synthesized
aggtctaaatgagatgacaatg

SEQ ID NO: 1232939 - DNA, 22 bp, Artificial Sequence
  chemically synthesized
ttttagtcattgtcatctcatt

SEQ ID NO: 1232940 - DNA, 22 bp, Artificial Sequence
  chemically synthesized
gactcaggtctaaatgagatga

SEQ ID NO: 1232941 - DNA, 22 bp, Artificial Sequence
  chemically synthesized
tttagtcattgtcatctcattt

SEQ ID NO: 1232942 - DNA, 22 bp, Artificial Sequence
  chemically synthesized
ggactcaggtctaaatgagatg

SEQ ID NO: 1232943 - DNA, 22 bp, Artificial Sequence
  chemically synthesized
ttagtcattgtcatctcattta

SEQ ID NO: 1232944 - DNA, 22 bp, Artificial Sequence
  chemically synthesized
tagtcattgtcatctcatttag

SEQ ID NO: 1232945 - DNA, 22 bp, Artificial Sequence
  chemically synthesized
agtcattgtcatctcatttaga

SEQ ID NO: 1232946 - DNA, 22 bp, Artificial Sequence
  chemically synthesized
gtcattgtcatctcatttagac

SEQ ID NO: 1232947 - DNA, 22 bp, Artificial Sequence
  chemically synthesized
gcatttggactcaggtctaaat

SEQ ID NO: 1232948 - DNA, 22 bp, Artificial Sequence
  chemically synthesized
ttggcatttggactcaggtcta

SEQ ID NO: 1232949 - DNA, 22 bp, Artificial Sequence
  chemically synthesized
tcatctcatttagacctgagtc

SEQ ID NO: 1232950 - DNA, 22 bp, Artificial Sequence
  chemically synthesized
atttagacctgagtccaaatgc

SEQ ID NO: 1232951 - DNA, 22 bp, Artificial Sequence
  chemically synthesized
agacctgagtccaaatgccaac

SEQ ID NO: 1232952 - DNA, 22 bp, Artificial Sequence
  chemically synthesized
gacctgagtccaaatgccaaca

SEQ ID NO: 1232953 - DNA, 22 bp, Artificial Sequence
  chemically synthesized
agtccaaatgccaacaatggct

SEQ ID NO: 1232954 - DNA, 22 bp, Artificial Sequence
  chemically synthesized
accatgctttcttcttctcacc

SEQ ID NO: 1232955 - DNA, 22 bp, Artificial Sequence
  chemically synthesized
tcttcttctcacccccacctta

SEQ ID NO: 1232956 - DNA, 22 bp, Artificial Sequence
  chemically synthesized
cttcttctcacccccaccttac

SEQ ID NO: 1232957 - DNA, 22 bp, Artificial Sequence
  chemically synthesized
ttcttctcacccccaccttact

SEQ ID NO: 1232958 - DNA, 22 bp, Artificial Sequence
  chemically synthesized
cttctcacccccaccttactac

SEQ ID NO: 1232959 - DNA, 22 bp, Artificial Sequence
  chemically synthesized
ttctcacccccaccttactacc

SEQ ID NO: 1232960 - DNA, 22 bp, Artificial Sequence
  chemically synthesized
ctcacccccaccttactacctc

SEQ ID NO: 1232961 - DNA, 22 bp, Artificial Sequence
  chemically synthesized
tcacccccaccttactacctct

SEQ ID NO: 1232962 - DNA, 22 bp, Artificial Sequence
  chemically synthesized
acccccaccttactacctctct

SEQ ID NO: 1232963 - DNA, 22 bp, Artificial Sequence
  chemically synthesized
actacctctctgctcccctatc

SEQ ID NO: 1232964 - DNA, 22 bp, Artificial Sequence
  chemically synthesized
ctacctctctgctcccctatct

SEQ ID NO: 1232965 - DNA, 22 bp, Artificial Sequence
  chemically synthesized
cctctctgctcccctatctctg

SEQ ID NO: 1232966 - DNA, 22 bp, Artificial Sequence
  chemically synthesized
tctgctcccctatctctgctat

SEQ ID NO: 1232967 - DNA, 22 bp, Artificial Sequence
  chemically synthesized
tgctcccctatctctgctatgt

SEQ ID NO: 1232968 - DNA, 22 bp, Artificial Sequence
  chemically synthesized
gagataaaggaaacatagcaga

SEQ ID NO: 1232969 - DNA, 22 bp, Artificial Sequence
  chemically synthesized
agagataaaggaaacatagcag

SEQ ID NO: 1232970 - DNA, 22 bp, Artificial Sequence
  chemically synthesized
ctcccctatctctgctatgttt

SEQ ID NO: 1232971 - DNA, 22 bp, Artificial Sequence
  chemically synthesized
ccctatctctgctatgtttcct

SEQ ID NO: 1232972 - DNA, 22 bp, Artificial Sequence
  chemically synthesized
tctctgctatgtttcctttatc

SEQ ID NO: 1232973 - DNA, 22 bp, Artificial Sequence
  chemically synthesized
tgctatgtttcctttatctcta

SEQ ID NO: 1232974 - DNA, 22 bp, Artificial Sequence
  chemically synthesized
ctatgtttcctttatctctaaa

SEQ ID NO: 1232975 - DNA, 22 bp, Artificial Sequence
  chemically synthesized
tgtttcctttatctctaaactc

SEQ ID NO: 1232976 - DNA, 22 bp, Artificial Sequence
  chemically synthesized
cctttatctctaaactcactct

SEQ ID NO: 1232977 - DNA, 22 bp, Artificial Sequence
  chemically synthesized
agcaagtggagtagagtgagtt

SEQ ID NO: 1232978 - DNA, 22 bp, Artificial Sequence
  chemically synthesized
ctttatctctaaactcactcta

SEQ ID NO: 1232979 - DNA, 22 bp, Artificial Sequence
  chemically synthesized
tatctctaaactcactctactc

SEQ ID NO: 1232980 - DNA, 22 bp, Artificial Sequence
  chemically synthesized
atctctaaactcactctactcc

SEQ ID NO: 1232981 - DNA, 22 bp, Artificial Sequence
  chemically synthesized
tctctaaactcactctactcca

SEQ ID NO: 1232982 - DNA, 22 bp, Artificial Sequence
  chemically synthesized
taaactcactctactccacttg

SEQ ID NO: 1232983 - DNA, 22 bp, Artificial Sequence
  chemically synthesized
aactcactctactccacttgct

SEQ ID NO: 1232984 - DNA, 22 bp, Artificial Sequence
  chemically synthesized
gaatgaggcctcagcaagtgga

SEQ ID NO: 1232985 - DNA, 22 bp, Artificial Sequence
  chemically synthesized
ggaatgaggcctcagcaagtgg

SEQ ID NO: 1232986 - DNA, 22 bp, Artificial Sequence
  chemically synthesized
actctactccacttgctgaggc

SEQ ID NO: 1232987 - DNA, 22 bp, Artificial Sequence
  chemically synthesized
tactccacttgctgaggcctca

SEQ ID NO: 1232988 - DNA, 22 bp, Artificial Sequence
  chemically synthesized
ctccacttgctgaggcctcatt

SEQ ID NO: 1232989 - DNA, 22 bp, Artificial Sequence
  chemically synthesized
cacttgctgaggcctcattcca

SEQ ID NO: 1232990 - DNA, 22 bp, Artificial Sequence
  chemically synthesized
aggtgaaaaagcatttggaatg

SEQ ID NO: 1232991 - DNA, 22 bp, Artificial Sequence
  chemically synthesized
aaggtgaaaaagcatttggaat

SEQ ID NO: 1232992 - DNA, 22 bp, Artificial Sequence
  chemically synthesized
gctgaggcctcattccaaatgc

SEQ ID NO: 1232993 - DNA, 22 bp, Artificial Sequence
  chemically synthesized
ctgaggcctcattccaaatgct

SEQ ID NO: 1232994 - DNA, 22 bp, Artificial Sequence
  chemically synthesized
aggcctcattccaaatgctttt

SEQ ID NO: 1232995 - DNA, 22 bp, Artificial Sequence
  chemically synthesized
attccaaatgctttttcacctt

SEQ ID NO: 1232996 - DNA, 22 bp, Artificial Sequence
  chemically synthesized
caaatgctttttcaccttaagg

SEQ ID NO: 1232997 - DNA, 22 bp, Artificial Sequence
  chemically synthesized
ggcacggtaataaagaccttaa

SEQ ID NO: 1232998 - DNA, 22 bp, Artificial Sequence
  chemically synthesized
tttcaccttaaggtctttatta

SEQ ID NO: 1232999 - DNA, 22 bp, Artificial Sequence
  chemically synthesized
ttcaccttaaggtctttattac

SEQ ID NO: 1233000 - DNA, 22 bp, Artificial Sequence
  chemically synthesized
tcaccttaaggtctttattacc

SEQ ID NO: 1233001 - DNA, 22 bp, Artificial Sequence
  chemically synthesized
caccttaaggtctttattaccg

SEQ ID NO: 1233002 - DNA, 22 bp, Artificial Sequence
  chemically synthesized
accttaaggtctttattaccgt

SEQ ID NO: 1233003 - DNA, 22 bp, Artificial Sequence
  chemically synthesized
aaggtctttattaccgtgccta

SEQ ID NO: 1233004 - DNA, 22 bp, Artificial Sequence
  chemically synthesized
aggtctttattaccgtgcctaa

SEQ ID NO: 1233005 - DNA, 22 bp, Artificial Sequence
  chemically synthesized
taggaaggtgggttaggcacgg

SEQ ID NO: 1233006 - DNA, 22 bp, Artificial Sequence
  chemically synthesized
tctataggaaggtgggttaggc

SEQ ID NO: 1233007 - DNA, 22 bp, Artificial Sequence
  chemically synthesized
tattaccgtgcctaacccacct

SEQ ID NO: 1233008 - DNA, 22 bp, Artificial Sequence
  chemically synthesized
attaccgtgcctaacccacctt

SEQ ID NO: 1233009 - DNA, 22 bp, Artificial Sequence
  chemically synthesized
ttaccgtgcctaacccaccttc

SEQ ID NO: 1233010 - DNA, 22 bp, Artificial Sequence
  chemically synthesized
gaattgtctataggaaggtggg

SEQ ID NO: 1233011 - DNA, 22 bp, Artificial Sequence
  chemically synthesized
ggaattgtctataggaaggtgg

SEQ ID NO: 1233012 - DNA, 22 bp, Artificial Sequence
  chemically synthesized
ccgtgcctaacccaccttccta

SEQ ID NO: 1233013 - DNA, 22 bp, Artificial Sequence
  chemically synthesized
acccaccttcctatagacaatt

SEQ ID NO: 1233014 - DNA, 22 bp, Artificial Sequence
  chemically synthesized
cctatagacaattccaaggctc

SEQ ID NO: 1233015 - DNA, 22 bp, Artificial Sequence
  chemically synthesized
gagaaagggagtgagccttgga

SEQ ID NO: 1233016 - DNA, 22 bp, Artificial Sequence
  chemically synthesized
ctatagacaattccaaggctca

SEQ ID NO: 1233017 - DNA, 22 bp, Artificial Sequence
  chemically synthesized
tagacaattccaaggctcactc

SEQ ID NO: 1233018 - DNA, 22 bp, Artificial Sequence
  chemically synthesized
caaggctcactccctttctcca

SEQ ID NO: 1233019 - DNA, 22 bp, Artificial Sequence
  chemically synthesized
tatgagcagagacctggagaaa

SEQ ID NO: 1233020 - DNA, 22 bp, Artificial Sequence
  chemically synthesized
ctatatgagcagagacctggag

SEQ ID NO: 1233021 - DNA, 22 bp, Artificial Sequence
  chemically synthesized
actccctttctccaggtctctg

SEQ ID NO: 1233022 - DNA, 22 bp, Artificial Sequence
  chemically synthesized
agttcctatatgagcagagacc

SEQ ID NO: 1233023 - DNA, 22 bp, Artificial Sequence
  chemically synthesized
cctttctccaggtctctgctca

SEQ ID NO: 1233024 - DNA, 22 bp, Artificial Sequence
  chemically synthesized
gttcagttcctatatgagcaga

SEQ ID NO: 1233025 - DNA, 22 bp, Artificial Sequence
  chemically synthesized
ggttcagttcctatatgagcag

SEQ ID NO: 1233026 - DNA, 22 bp, Artificial Sequence
  chemically synthesized
tctccaggtctctgctcatata

SEQ ID NO: 1233027 - DNA, 22 bp, Artificial Sequence
  chemically synthesized
tggttcagttcctatatgagca

SEQ ID NO: 1233028 - DNA, 22 bp, Artificial Sequence
  chemically synthesized
ctccaggtctctgctcatatag

SEQ ID NO: 1233029 - DNA, 22 bp, Artificial Sequence
  chemically synthesized
ttggttcagttcctatatgagc

SEQ ID NO: 1233030 - DNA, 22 bp, Artificial Sequence
  chemically synthesized
tccaggtctctgctcatatagg

SEQ ID NO: 1233031 - DNA, 22 bp, Artificial Sequence
  chemically synthesized
caggtctctgctcatataggaa

SEQ ID NO: 1233032 - DNA, 22 bp, Artificial Sequence
  chemically synthesized
agaagaccttttggttcagttc

SEQ ID NO: 1233033 - DNA, 22 bp, Artificial Sequence
  chemically synthesized
tgctcatataggaactgaacca

SEQ ID NO: 1233034 - DNA, 22 bp, Artificial Sequence
  chemically synthesized
ctcatataggaactgaaccaaa

SEQ ID NO: 1233035 - DNA, 22 bp, Artificial Sequence
  chemically synthesized
atataggaactgaaccaaaagg

SEQ ID NO: 1233036 - DNA, 22 bp, Artificial Sequence
  chemically synthesized
aaccaaaaggtcttctcagacc

SEQ ID NO: 1233037 - DNA, 22 bp, Artificial Sequence
  chemically synthesized
ctcagacctcttattctatgta

SEQ ID NO: 1233038 - DNA, 22 bp, Artificial Sequence
  chemically synthesized
tcagacctcttattctatgtat

SEQ ID NO: 1233039 - DNA, 22 bp, Artificial Sequence
  chemically synthesized
agacctcttattctatgtatct

SEQ ID NO: 1233040 - DNA, 22 bp, Artificial Sequence
  chemically synthesized
agtgaataaaaaagagatacat

SEQ ID NO: 1233041 - DNA, 22 bp, Artificial Sequence
  chemically synthesized
ttattctatgtatctctttttt

SEQ ID NO: 1233042 - DNA, 22 bp, Artificial Sequence
  chemically synthesized
attctatgtatctcttttttat

SEQ ID NO: 1233043 - DNA, 22 bp, Artificial Sequence
  chemically synthesized
ttctatgtatctcttttttatt

SEQ ID NO: 1233044 - DNA, 22 bp, Artificial Sequence
  chemically synthesized
ggaacagttaagtgaataaaaa

SEQ ID NO: 1233045 - DNA, 22 bp, Artificial Sequence
  chemically synthesized
tatgtatctcttttttattcac

SEQ ID NO: 1233046 - DNA, 22 bp, Artificial Sequence
  chemically synthesized
aggaacagttaagtgaataaaa

SEQ ID NO: 1233047 - DNA, 22 bp, Artificial Sequence
  chemically synthesized
tgtatctcttttttattcactt

SEQ ID NO: 1233048 - DNA, 22 bp, Artificial Sequence
  chemically synthesized
ttttttattcacttaactgttc

SEQ ID NO: 1233049 - DNA, 22 bp, Artificial Sequence
  chemically synthesized
ttttattcacttaactgttcct

SEQ ID NO: 1233050 - DNA, 22 bp, Artificial Sequence
  chemically synthesized
tttattcacttaactgttccta

SEQ ID NO: 1233051 - DNA, 22 bp, Artificial Sequence
  chemically synthesized
ttattcacttaactgttcctaa

SEQ ID NO: 1233052 - DNA, 22 bp, Artificial Sequence
  chemically synthesized
tattcacttaactgttcctaag

SEQ ID NO: 1233053 - DNA, 22 bp, Artificial Sequence
  chemically synthesized
attcacttaactgttcctaagt

SEQ ID NO: 1233054 - DNA, 22 bp, Artificial Sequence
  chemically synthesized
ttcacttaactgttcctaagta

SEQ ID NO: 1233055 - DNA, 22 bp, Artificial Sequence
  chemically synthesized
acttaactgttcctaagtatat

SEQ ID NO: 1233056 - DNA, 22 bp, Artificial Sequence
  chemically synthesized
aactgttcctaagtatatatgc

SEQ ID NO: 1233057 - DNA, 22 bp, Artificial Sequence
  chemically synthesized
actgttcctaagtatatatgct

SEQ ID NO: 1233058 - DNA, 22 bp, Artificial Sequence
  chemically synthesized
ttcctaagtatatatgcttcat

SEQ ID NO: 1233059 - DNA, 22 bp, Artificial Sequence
  chemically synthesized
ctaagtatatatgcttcatatt

SEQ ID NO: 1233060 - DNA, 22 bp, Artificial Sequence
  chemically synthesized
agtatatatgcttcatattgcc

SEQ ID NO: 1233061 - DNA, 22 bp, Artificial Sequence
  chemically synthesized
cagccacatggtaggcaatatg

SEQ ID NO: 1233062 - DNA, 22 bp, Artificial Sequence
  chemically synthesized
catattgcctaccatgtggctg

SEQ ID NO: 1233063 - DNA, 22 bp, Artificial Sequence
  chemically synthesized
atattgcctaccatgtggctgt

SEQ ID NO: 1233064 - DNA, 22 bp, Artificial Sequence
  chemically synthesized
tgtgtcagagattacagccaca

SEQ ID NO: 1233065 - DNA, 22 bp, Artificial Sequence
  chemically synthesized
gtgtgtcagagattacagccac

SEQ ID NO: 1233066 - DNA, 22 bp, Artificial Sequence
  chemically synthesized
tgtgtgtcagagattacagcca

SEQ ID NO: 1233067 - DNA, 22 bp, Artificial Sequence
  chemically synthesized
cctaccatgtggctgtaatctc

SEQ ID NO: 1233068 - DNA, 22 bp, Artificial Sequence
  chemically synthesized
ccatgtggctgtaatctctgac

SEQ ID NO: 1233069 - DNA, 22 bp, Artificial Sequence
  chemically synthesized
taatctctgacacacaaagggt

SEQ ID NO: 1233070 - DNA, 22 bp, Artificial Sequence
  chemically synthesized
gtgtcagagcaaacacaaccct

SEQ ID NO: 1233071 - DNA, 22 bp, Artificial Sequence
  chemically synthesized
tgacacacaaagggttgtgttt

SEQ ID NO: 1233072 - DNA, 22 bp, Artificial Sequence
  chemically synthesized
acacacaaagggttgtgtttgc

SEQ ID NO: 1233073 - DNA, 22 bp, Artificial Sequence
  chemically synthesized
attggtgtcagagcaaacacaa

SEQ ID NO: 1233074 - DNA, 22 bp, Artificial Sequence
  chemically synthesized
attgattggtgtcagagcaaac

SEQ ID NO: 1233075 - DNA, 22 bp, Artificial Sequence
  chemically synthesized
tgtttgctctgacaccaatcaa

SEQ ID NO: 1233076 - DNA, 22 bp, Artificial Sequence
  chemically synthesized
gctctgacaccaatcaatcaac

SEQ ID NO: 1233077 - DNA, 22 bp, Artificial Sequence
  chemically synthesized
acaggtatataagttgattgat

SEQ ID NO: 1233078 - DNA, 22 bp, Artificial Sequence
  chemically synthesized
ctctgacaccaatcaatcaact

SEQ ID NO: 1233079 - DNA, 22 bp, Artificial Sequence
  chemically synthesized
tgacaccaatcaatcaacttat

SEQ ID NO: 1233080 - DNA, 22 bp, Artificial Sequence
  chemically synthesized
acaccaatcaatcaacttatat

SEQ ID NO: 1233081 - DNA, 22 bp, Artificial Sequence
  chemically synthesized
aaattcacaggtatataagttg

SEQ ID NO: 1233082 - DNA, 22 bp, Artificial Sequence
  chemically synthesized
aaaattcacaggtatataagtt

SEQ ID NO: 1233083 - DNA, 22 bp, Artificial Sequence
  chemically synthesized
taaaattcacaggtatataagt

SEQ ID NO: 1233084 - DNA, 22 bp, Artificial Sequence
  chemically synthesized
ttaaaattcacaggtatataag

SEQ ID NO: 1233085 - DNA, 22 bp, Artificial Sequence
  chemically synthesized
cttttaaaattcacaggtatat

SEQ ID NO: 1233086 - DNA, 22 bp, Artificial Sequence
  chemically synthesized
ccttttaaaattcacaggtata

SEQ ID NO: 1233087 - DNA, 22 bp, Artificial Sequence
  chemically synthesized
tccaaatttccttttaaaattc

SEQ ID NO: 1233088 - DNA, 22 bp, Artificial Sequence
  chemically synthesized
atatacctgtgaattttaaaag

SEQ ID NO: 1233089 - DNA, 22 bp, Artificial Sequence
  chemically synthesized
tatacctgtgaattttaaaagg

SEQ ID NO: 1233090 - DNA, 22 bp, Artificial Sequence
  chemically synthesized
tgaattttaaaaggaaatttgg

SEQ ID NO: 1233091 - DNA, 22 bp, Artificial Sequence
  chemically synthesized
aagaagtcctatccaaatttcc

SEQ ID NO: 1233092 - DNA, 22 bp, Artificial Sequence
  chemically synthesized
taaaaggaaatttggataggac

SEQ ID NO: 1233093 - DNA, 22 bp, Artificial Sequence
  chemically synthesized
aaaaggaaatttggataggact

SEQ ID NO: 1233094 - DNA, 22 bp, Artificial Sequence
  chemically synthesized
aaaggaaatttggataggactt

SEQ ID NO: 1233095 - DNA, 22 bp, Artificial Sequence
  chemically synthesized
ggataggacttcttcaatgtga

SEQ ID NO: 1233096 - DNA, 22 bp, Artificial Sequence
  chemically synthesized
gataggacttcttcaatgtgat

SEQ ID NO: 1233097 - DNA, 22 bp, Artificial Sequence
  chemically synthesized
tgcaggatataaataatcacat

SEQ ID NO: 1233098 - DNA, 22 bp, Artificial Sequence
  chemically synthesized
cttcaatgtgattatttatatc

SEQ ID NO: 1233099 - DNA, 22 bp, Artificial Sequence
  chemically synthesized
ttcaatgtgattatttatatcc

SEQ ID NO: 1233100 - DNA, 22 bp, Artificial Sequence
  chemically synthesized
caatgtgattatttatatcctg

SEQ ID NO: 1233101 - DNA, 22 bp, Artificial Sequence
  chemically synthesized
aatgtgattatttatatcctgc

SEQ ID NO: 1233102 - DNA, 22 bp, Artificial Sequence
  chemically synthesized
tatcaataagcctgtgcaggat

SEQ ID NO: 1233103 - DNA, 22 bp, Artificial Sequence
  chemically synthesized
tatatcaataagcctgtgcagg

SEQ ID NO: 1233104 - DNA, 22 bp, Artificial Sequence
  chemically synthesized
tttatatcctgcacaggcttat

SEQ ID NO: 1233105 - DNA, 22 bp, Artificial Sequence
  chemically synthesized
atatcctgcacaggcttattga

SEQ ID NO: 1233106 - DNA, 22 bp, Artificial Sequence
  chemically synthesized
tatcctgcacaggcttattgat

SEQ ID NO: 1233107 - DNA, 22 bp, Artificial Sequence
  chemically synthesized
ggtgtgttctatatcaataagc

SEQ ID NO: 1233108 - DNA, 22 bp, Artificial Sequence
  chemically synthesized
gggtgtgttctatatcaataag

SEQ ID NO: 1233109 - DNA, 22 bp, Artificial Sequence
  chemically synthesized
agcttgggtgtgttctatatca

SEQ ID NO: 1233110 - DNA, 22 bp, Artificial Sequence
  chemically synthesized
cacaggcttattgatatagaac

SEQ ID NO: 1233111 - DNA, 22 bp, Artificial Sequence
  chemically synthesized
aagttgagcttgggtgtgttct

SEQ ID NO: 1233112 - DNA, 22 bp, Artificial Sequence
  chemically synthesized
taaagttgagcttgggtgtgtt

SEQ ID NO: 1233113 - DNA, 22 bp, Artificial Sequence
  chemically synthesized
ctaaagttgagcttgggtgtgt

SEQ ID NO: 1233114 - DNA, 22 bp, Artificial Sequence
  chemically synthesized
attgatatagaacacacccaag

SEQ ID NO: 1233115 - DNA, 22 bp, Artificial Sequence
  chemically synthesized
tctaaagttgagcttgggtgtg

SEQ ID NO: 1233116 - DNA, 22 bp, Artificial Sequence
  chemically synthesized
ttgatatagaacacacccaagc

SEQ ID NO: 1233117 - DNA, 22 bp, Artificial Sequence
  chemically synthesized
ttctaaagttgagcttgggtgt

SEQ ID NO: 1233118 - DNA, 22 bp, Artificial Sequence
  chemically synthesized
tttctaaagttgagcttgggtg

SEQ ID NO: 1233119 - DNA, 22 bp, Artificial Sequence
  chemically synthesized
ttttctaaagttgagcttgggt

SEQ ID NO: 1233120 - DNA, 22 bp, Artificial Sequence
  chemically synthesized
atatagaacacacccaagctca

SEQ ID NO: 1233121 - DNA, 22 bp, Artificial Sequence
  chemically synthesized
tttttctaaagttgagcttggg

SEQ ID NO: 1233122 - DNA, 22 bp, Artificial Sequence
  chemically synthesized
aagcaggattttttttctaaag

SEQ ID NO: 1233123 - DNA, 22 bp, Artificial Sequence
  chemically synthesized
aactttagaaaaaaaatcctgc

SEQ ID NO: 1233124 - DNA, 22 bp, Artificial Sequence
  chemically synthesized
tagaaaaaaaatcctgcttgag

SEQ ID NO: 1233125 - DNA, 22 bp, Artificial Sequence
  chemically synthesized
agaaaaaaaatcctgcttgagc

SEQ ID NO: 1233126 - DNA, 22 bp, Artificial Sequence
  chemically synthesized
gaaaaaaaatcctgcttgagca

SEQ ID NO: 1233127 - DNA, 22 bp, Artificial Sequence
  chemically synthesized
ggaagaataaatcaaaatgctc

SEQ ID NO: 1233128 - DNA, 22 bp, Artificial Sequence
  chemically synthesized
ttaggaagaataaatcaaaatg

SEQ ID NO: 1233129 - DNA, 22 bp, Artificial Sequence
  chemically synthesized
attaggaagaataaatcaaaat

SEQ ID NO: 1233130 - DNA, 22 bp, Artificial Sequence
  chemically synthesized
cttattaggaagaataaatcaa

SEQ ID NO: 1233131 - DNA, 22 bp, Artificial Sequence
  chemically synthesized
gcttattaggaagaataaatca

SEQ ID NO: 1233132 - DNA, 22 bp, Artificial Sequence
  chemically synthesized
cttgagcattttgatttattct

SEQ ID NO: 1233133 - DNA, 22 bp, Artificial Sequence
  chemically synthesized
gagcattttgatttattcttcc

SEQ ID NO: 1233134 - DNA, 22 bp, Artificial Sequence
  chemically synthesized
gtttgcttattaggaagaataa

SEQ ID NO: 1233135 - DNA, 22 bp, Artificial Sequence
  chemically synthesized
agcattttgatttattcttcct

SEQ ID NO: 1233136 - DNA, 22 bp, Artificial Sequence
  chemically synthesized
agtttgcttattaggaagaata

SEQ ID NO: 1233137 - DNA, 22 bp, Artificial Sequence
  chemically synthesized
tagtttgcttattaggaagaat

SEQ ID NO: 1233138 - DNA, 22 bp, Artificial Sequence
  chemically synthesized
tgatttattcttcctaataagc

SEQ ID NO: 1233139 - DNA, 22 bp, Artificial Sequence
  chemically synthesized
gatttattcttcctaataagca

SEQ ID NO: 1233140 - DNA, 22 bp, Artificial Sequence
  chemically synthesized
atttattcttcctaataagcaa

SEQ ID NO: 1233141 - DNA, 22 bp, Artificial Sequence
  chemically synthesized
attcttcctaataagcaaacta

SEQ ID NO: 1233142 - DNA, 22 bp, Artificial Sequence
  chemically synthesized
ttcttcctaataagcaaactaa

SEQ ID NO: 1233143 - DNA, 22 bp, Artificial Sequence
  chemically synthesized
ttcctaataagcaaactaaagt

SEQ ID NO: 1233144 - DNA, 22 bp, Artificial Sequence
  chemically synthesized
cctaataagcaaactaaagttg

SEQ ID NO: 1233145 - DNA, 22 bp, Artificial Sequence
  chemically synthesized
ctaataagcaaactaaagttgt

SEQ ID NO: 1233146 - DNA, 22 bp, Artificial Sequence
  chemically synthesized
ataagcaaactaaagttgtact

SEQ ID NO: 1233147 - DNA, 22 bp, Artificial Sequence
  chemically synthesized
aagttgtacttatggatgtttt

SEQ ID NO: 1233148 - DNA, 22 bp, Artificial Sequence
  chemically synthesized
tacttatggatgttttccattt

SEQ ID NO: 1233149 - DNA, 22 bp, Artificial Sequence
  chemically synthesized
tcataagtataaacaaaaatgg

SEQ ID NO: 1233150 - DNA, 22 bp, Artificial Sequence
  chemically synthesized
atggatgttttccatttttgtt

SEQ ID NO: 1233151 - DNA, 22 bp, Artificial Sequence
  chemically synthesized
gtcataagtataaacaaaaatg

SEQ ID NO: 1233152 - DNA, 22 bp, Artificial Sequence
  chemically synthesized
tggatgttttccatttttgttt

SEQ ID NO: 1233153 - DNA, 22 bp, Artificial Sequence
  chemically synthesized
tgtcataagtataaacaaaaat

SEQ ID NO: 1233154 - DNA, 22 bp, Artificial Sequence
  chemically synthesized
cattttgtcataagtataaaca

SEQ ID NO: 1233155 - DNA, 22 bp, Artificial Sequence
  chemically synthesized
tccattttgtcataagtataaa

SEQ ID NO: 1233156 - DNA, 22 bp, Artificial Sequence
  chemically synthesized
tccatttttgtttatacttatg

SEQ ID NO: 1233157 - DNA, 22 bp, Artificial Sequence
  chemically synthesized
ccatttttgtttatacttatga

SEQ ID NO: 1233158 - DNA, 22 bp, Artificial Sequence
  chemically synthesized
catttttgtttatacttatgac

SEQ ID NO: 1233159 - DNA, 22 bp, Artificial Sequence
  chemically synthesized
taattctccattttgtcataag

SEQ ID NO: 1233160 - DNA, 22 bp, Artificial Sequence
  chemically synthesized
ataattctccattttgtcataa

SEQ ID NO: 1233161 - DNA, 22 bp, Artificial Sequence
  chemically synthesized
ttgtttatacttatgacaaaat

SEQ ID NO: 1233162 - DNA, 22 bp, Artificial Sequence
  chemically synthesized
tgtttatacttatgacaaaatg

SEQ ID NO: 1233163 - DNA, 22 bp, Artificial Sequence
  chemically synthesized
gtttatacttatgacaaaatgg

SEQ ID NO: 1233164 - DNA, 22 bp, Artificial Sequence
  chemically synthesized
tcttataattctccattttgtc

SEQ ID NO: 1233165 - DNA, 22 bp, Artificial Sequence
  chemically synthesized
tttatacttatgacaaaatgga

SEQ ID NO: 1233166 - DNA, 22 bp, Artificial Sequence
  chemically synthesized
atacttatgacaaaatggagaa

SEQ ID NO: 1233167 - DNA, 22 bp, Artificial Sequence
  chemically synthesized
tacttatgacaaaatggagaat

SEQ ID NO: 1233168 - DNA, 22 bp, Artificial Sequence
  chemically synthesized
atgacaaaatggagaattataa

SEQ ID NO: 1233169 - DNA, 22 bp, Artificial Sequence
  chemically synthesized
tgacaaaatggagaattataag

SEQ ID NO: 1233170 - DNA, 22 bp, Artificial Sequence
  chemically synthesized
taagataatgcatttttttttt

SEQ ID NO: 1233171 - DNA, 22 bp, Artificial Sequence
  chemically synthesized
gccacagagtgaaaaaaaaaaa

SEQ ID NO: 1233172 - DNA, 22 bp, Artificial Sequence
  chemically synthesized
cagcctggccacagagtgaaaa

SEQ ID NO: 1233173 - DNA, 22 bp, Artificial Sequence
  chemically synthesized
cactccagcctggccacagagt

SEQ ID NO: 1233174 - DNA, 22 bp, Artificial Sequence
  chemically synthesized
tttttttttcactctgtggcca

SEQ ID NO: 1233175 - DNA, 22 bp, Artificial Sequence
  chemically synthesized
ttttttttcactctgtggccag

SEQ ID NO: 1233176 - DNA, 22 bp, Artificial Sequence
  chemically synthesized
tttttttcactctgtggccagg

SEQ ID NO: 1233177 - DNA, 22 bp, Artificial Sequence
  chemically synthesized
ttttttcactctgtggccaggc

SEQ ID NO: 1233178 - DNA, 22 bp, Artificial Sequence
  chemically synthesized
tttttcactctgtggccaggct

SEQ ID NO: 1233179 - DNA, 22 bp, Artificial Sequence
  chemically synthesized
ttttcactctgtggccaggctg

SEQ ID NO: 1233180 - DNA, 22 bp, Artificial Sequence
  chemically synthesized
tttcactctgtggccaggctgg

SEQ ID NO: 1233181 - DNA, 22 bp, Artificial Sequence
  chemically synthesized
ttcactctgtggccaggctgga

SEQ ID NO: 1233182 - DNA, 22 bp, Artificial Sequence
  chemically synthesized
tcactctgtggccaggctggag

SEQ ID NO: 1233183 - DNA, 22 bp, Artificial Sequence
  chemically synthesized
cactctgtggccaggctggagt

SEQ ID NO: 1233184 - DNA, 22 bp, Artificial Sequence
  chemically synthesized
actctgtggccaggctggagtg

SEQ ID NO: 1233185 - DNA, 22 bp, Artificial Sequence
  chemically synthesized
tgtggccaggctggagtgcagt

SEQ ID NO: 1233186 - DNA, 22 bp, Artificial Sequence
  chemically synthesized
tggccaggctggagtgcagtgg

SEQ ID NO: 1233187 - DNA, 22 bp, Artificial Sequence
  chemically synthesized
cagtgagtggagatcgtgccac

SEQ ID NO: 1233188 - DNA, 22 bp, Artificial Sequence
  chemically synthesized
gagtgcagtggcacgatctcca

SEQ ID NO: 1233189 - DNA, 22 bp, Artificial Sequence
  chemically synthesized
ggagcagaggttgcagtgagtg

SEQ ID NO: 1233190 - DNA, 22 bp, Artificial Sequence
  chemically synthesized
cactcactgcaacctctgctcc

SEQ ID NO: 1233191 - DNA, 22 bp, Artificial Sequence
  chemically synthesized
actgcaacctctgctcccaggt

SEQ ID NO: 1233192 - DNA, 22 bp, Artificial Sequence
  chemically synthesized
caacctctgctcccaggttcac

SEQ ID NO: 1233193 - DNA, 22 bp, Artificial Sequence
  chemically synthesized
aggcaggagaatcacgtgaacc

SEQ ID NO: 1233194 - DNA, 22 bp, Artificial Sequence
  chemically synthesized
tgctcccaggttcacgtgattc

SEQ ID NO: 1233195 - DNA, 22 bp, Artificial Sequence
  chemically synthesized
ctcccaggttcacgtgattctc

SEQ ID NO: 1233196 - DNA, 22 bp, Artificial Sequence
  chemically synthesized
ccaggttcacgtgattctcctg

SEQ ID NO: 1233197 - DNA, 22 bp, Artificial Sequence
  chemically synthesized
atgaggctgaggcaggagaatc

SEQ ID NO: 1233198 - DNA, 22 bp, Artificial Sequence
  chemically synthesized
ctcatgaggctgaggcaggaga

SEQ ID NO: 1233199 - DNA, 22 bp, Artificial Sequence
  chemically synthesized
acgtgattctcctgcctcagcc

SEQ ID NO: 1233200 - DNA, 22 bp, Artificial Sequence
  chemically synthesized
tagtcccagctactcatgaggc

SEQ ID NO: 1233201 - DNA, 22 bp, Artificial Sequence
  chemically synthesized
tcctgcctcagcctcatgagta

SEQ ID NO: 1233202 - DNA, 22 bp, Artificial Sequence
  chemically synthesized
ctgcctcagcctcatgagtagc

SEQ ID NO: 1233203 - DNA, 22 bp, Artificial Sequence
  chemically synthesized
cctcagcctcatgagtagctgg

SEQ ID NO: 1233204 - DNA, 22 bp, Artificial Sequence
  chemically synthesized
agcctcatgagtagctgggact

SEQ ID NO: 1233205 - DNA, 22 bp, Artificial Sequence
  chemically synthesized
atgagtagctgggactacagat

SEQ ID NO: 1233206 - DNA, 22 bp, Artificial Sequence
  chemically synthesized
agcgtggtggtgtgcatctgta

SEQ ID NO: 1233207 - DNA, 22 bp, Artificial Sequence
  chemically synthesized
gctgagcgtggtggtgtgcatc

SEQ ID NO: 1233208 - DNA, 22 bp, Artificial Sequence
  chemically synthesized
ggactacagatgcacaccacca

SEQ ID NO: 1233209 - DNA, 22 bp, Artificial Sequence
  chemically synthesized
cagatgcacaccaccacgctca

SEQ ID NO: 1233210 - DNA, 22 bp, Artificial Sequence
  chemically synthesized
aaaacacaaaaattagctgagc

SEQ ID NO: 1233211 - DNA, 22 bp, Artificial Sequence
  chemically synthesized
ctaaaaacacaaaaattagctg

SEQ ID NO: 1233212 - DNA, 22 bp, Artificial Sequence
  chemically synthesized
tactaaaaacacaaaaattagc

SEQ ID NO: 1233213 - DNA, 22 bp, Artificial Sequence
  chemically synthesized
agctaatttttgtgtttttagt

SEQ ID NO: 1233214 - DNA, 22 bp, Artificial Sequence
  chemically synthesized
atttttgtgtttttagtagaga

SEQ ID NO: 1233215 - DNA, 22 bp, Artificial Sequence
  chemically synthesized
ttgtgtttttagtagagatggg

SEQ ID NO: 1233216 - DNA, 22 bp, Artificial Sequence
  chemically synthesized
tgtgtttttagtagagatgggg

SEQ ID NO: 1233217 - DNA, 22 bp, Artificial Sequence
  chemically synthesized
gtgtttttagtagagatggggt

SEQ ID NO: 1233218 - DNA, 22 bp, Artificial Sequence
  chemically synthesized
tgtttttagtagagatggggtt

SEQ ID NO: 1233219 - DNA, 22 bp, Artificial Sequence
  chemically synthesized
gccaacatggtgaaaccccatc

SEQ ID NO: 1233220 - DNA, 22 bp, Artificial Sequence
  chemically synthesized
ttagtagagatggggtttcacc

SEQ ID NO: 1233221 - DNA, 22 bp, Artificial Sequence
  chemically synthesized
tagtagagatggggtttcacca

SEQ ID NO: 1233222 - DNA, 22 bp, Artificial Sequence
  chemically synthesized
agtagagatggggtttcaccat

SEQ ID NO: 1233223 - DNA, 22 bp, Artificial Sequence
  chemically synthesized
gtagagatggggtttcaccatg

SEQ ID NO: 1233224 - DNA, 22 bp, Artificial Sequence
  chemically synthesized
agaccatcctggccaacatggt

SEQ ID NO: 1233225 - DNA, 22 bp, Artificial Sequence
  chemically synthesized
caccatgttggccaggatggtc

SEQ ID NO: 1233226 - DNA, 22 bp, Artificial Sequence
  chemically synthesized
accatgttggccaggatggtct

SEQ ID NO: 1233227 - DNA, 22 bp, Artificial Sequence
  chemically synthesized
gccaggatggtctcaatttctt

SEQ ID NO: 1233228 - DNA, 22 bp, Artificial Sequence
  chemically synthesized
aatttcttgacatcatgatcca

SEQ ID NO: 1233229 - DNA, 22 bp, Artificial Sequence
  chemically synthesized
ggtggtccaggcgggtggatca

SEQ ID NO: 1233230 - DNA, 22 bp, Artificial Sequence
  chemically synthesized
gggtggtccaggcgggtggatc

SEQ ID NO: 1233231 - DNA, 22 bp, Artificial Sequence
  chemically synthesized
cttgacatcatgatccacccgc

SEQ ID NO: 1233232 - DNA, 22 bp, Artificial Sequence
  chemically synthesized
tgggtggtccaggcgggtggat

SEQ ID NO: 1233233 - DNA, 22 bp, Artificial Sequence
  chemically synthesized
ttgacatcatgatccacccgcc

SEQ ID NO: 1233234 - DNA, 22 bp, Artificial Sequence
  chemically synthesized
gacatcatgatccacccgcctg

SEQ ID NO: 1233235 - DNA, 22 bp, Artificial Sequence
  chemically synthesized
acatcatgatccacccgcctgg

SEQ ID NO: 1233236 - DNA, 22 bp, Artificial Sequence
  chemically synthesized
taataccagcactttgggtggt

SEQ ID NO: 1233237 - DNA, 22 bp, Artificial Sequence
  chemically synthesized
atgcctgtaataccagcacttt

SEQ ID NO: 1233238 - DNA, 22 bp, Artificial Sequence
  chemically synthesized
gaccacccaaagtgctggtatt

SEQ ID NO: 1233239 - DNA, 22 bp, Artificial Sequence
  chemically synthesized
ggcgcggtggctcatgcctgta

SEQ ID NO: 1233240 - DNA, 22 bp, Artificial Sequence
  chemically synthesized
ggctgggcgcggtggctcatgc

SEQ ID NO: 1233241 - DNA, 22 bp, Artificial Sequence
  chemically synthesized
gtattacaggcatgagccaccg

SEQ ID NO: 1233242 - DNA, 22 bp, Artificial Sequence
  chemically synthesized
caggcatgagccaccgcgccca

SEQ ID NO: 1233243 - DNA, 22 bp, Artificial Sequence
  chemically synthesized
aaaagtaaatctaggctgggcg

SEQ ID NO: 1233244 - DNA, 22 bp, Artificial Sequence
  chemically synthesized
caaaagtaaatctaggctgggc

SEQ ID NO: 1233245 - DNA, 22 bp, Artificial Sequence
  chemically synthesized
tcaaaagtaaatctaggctggg

SEQ ID NO: 1233246 - DNA, 22 bp, Artificial Sequence
  chemically synthesized
aacaataacacatggattttca

SEQ ID NO: 1233247 - DNA, 22 bp, Artificial Sequence
  chemically synthesized
gatttacttttgaaaatccatg

SEQ ID NO: 1233248 - DNA, 22 bp, Artificial Sequence
  chemically synthesized
tggctgaacaataacacatgga

SEQ ID NO: 1233249 - DNA, 22 bp, Artificial Sequence
  chemically synthesized
acttttgaaaatccatgtgtta

SEQ ID NO: 1233250 - DNA, 22 bp, Artificial Sequence
  chemically synthesized
cttttgaaaatccatgtgttat

SEQ ID NO: 1233251 - DNA, 22 bp, Artificial Sequence
  chemically synthesized
ttgaaaatccatgtgttattgt

SEQ ID NO: 1233252 - DNA, 22 bp, Artificial Sequence
  chemically synthesized
gcctgtggctgaacaataacac

SEQ ID NO: 1233253 - DNA, 22 bp, Artificial Sequence
  chemically synthesized
tgaaaatccatgtgttattgtt

SEQ ID NO: 1233254 - DNA, 22 bp, Artificial Sequence
  chemically synthesized
agcctgtggctgaacaataaca

SEQ ID NO: 1233255 - DNA, 22 bp, Artificial Sequence
  chemically synthesized
gaaaatccatgtgttattgttc

SEQ ID NO: 1233256 - DNA, 22 bp, Artificial Sequence
  chemically synthesized
aaaatccatgtgttattgttca

SEQ ID NO: 1233257 - DNA, 22 bp, Artificial Sequence
  chemically synthesized
ccttagcctgtggctgaacaat

SEQ ID NO: 1233258 - DNA, 22 bp, Artificial Sequence
  chemically synthesized
accttagcctgtggctgaacaa

SEQ ID NO: 1233259 - DNA, 22 bp, Artificial Sequence
  chemically synthesized
taccttagcctgtggctgaaca

SEQ ID NO: 1233260 - DNA, 22 bp, Artificial Sequence
  chemically synthesized
ttgttcagccacaggctaaggt

SEQ ID NO: 1233261 - DNA, 22 bp, Artificial Sequence
  chemically synthesized
ttcagccacaggctaaggtaaa

SEQ ID NO: 1233262 - DNA, 22 bp, Artificial Sequence
  chemically synthesized
gaacaaaggaacctttacctta

SEQ ID NO: 1233263 - DNA, 22 bp, Artificial Sequence
  chemically synthesized
ggaacaaaggaacctttacctt

SEQ ID NO: 1233264 - DNA, 22 bp, Artificial Sequence
  chemically synthesized
agccacaggctaaggtaaaggt

SEQ ID NO: 1233265 - DNA, 22 bp, Artificial Sequence
  chemically synthesized
aggtaaaggttcctttgttcca

SEQ ID NO: 1233266 - DNA, 22 bp, Artificial Sequence
  chemically synthesized
atgcagaaaccaaacttggaac

SEQ ID NO: 1233267 - DNA, 22 bp, Artificial Sequence
  chemically synthesized
tcatgcagaaaccaaacttgga

SEQ ID NO: 1233268 - DNA, 22 bp, Artificial Sequence
  chemically synthesized
ctttgttccaagtttggtttct

SEQ ID NO: 1233269 - DNA, 22 bp, Artificial Sequence
  chemically synthesized
tgttccaagtttggtttctgca

SEQ ID NO: 1233270 - DNA, 22 bp, Artificial Sequence
  chemically synthesized
aagacattctcatgcagaaacc

SEQ ID NO: 1233271 - DNA, 22 bp, Artificial Sequence
  chemically synthesized
gttccaagtttggtttctgcat

SEQ ID NO: 1233272 - DNA, 22 bp, Artificial Sequence
  chemically synthesized
ttccaagtttggtttctgcatg

SEQ ID NO: 1233273 - DNA, 22 bp, Artificial Sequence
  chemically synthesized
caagtttggtttctgcatgaga

SEQ ID NO: 1233274 - DNA, 22 bp, Artificial Sequence
  chemically synthesized
ggtttctgcatgagaatgtctt

SEQ ID NO: 1233275 - DNA, 22 bp, Artificial Sequence
  chemically synthesized
gtttctgcatgagaatgtcttg

SEQ ID NO: 1233276 - DNA, 22 bp, Artificial Sequence
  chemically synthesized
gaggacaaaacctcaagacatt

SEQ ID NO: 1233277 - DNA, 22 bp, Artificial Sequence
  chemically synthesized
ctgcatgagaatgtcttgaggt

SEQ ID NO: 1233278 - DNA, 22 bp, Artificial Sequence
  chemically synthesized
tgcatgagaatgtcttgaggtt

SEQ ID NO: 1233279 - DNA, 22 bp, Artificial Sequence
  chemically synthesized
catgagaatgtcttgaggtttt

SEQ ID NO: 1233280 - DNA, 22 bp, Artificial Sequence
  chemically synthesized
tgcgttagaggacaaaacctca

SEQ ID NO: 1233281 - DNA, 22 bp, Artificial Sequence
  chemically synthesized
gcctatgcgttagaggacaaaa

SEQ ID NO: 1233282 - DNA, 22 bp, Artificial Sequence
  chemically synthesized
gaggttttgtcctctaacgcat

SEQ ID NO: 1233283 - DNA, 22 bp, Artificial Sequence
  chemically synthesized
aggttttgtcctctaacgcata

SEQ ID NO: 1233284 - DNA, 22 bp, Artificial Sequence
  chemically synthesized
cataagatgctggcctatgcgt

SEQ ID NO: 1233285 - DNA, 22 bp, Artificial Sequence
  chemically synthesized
tgtcctctaacgcataggccag

SEQ ID NO: 1233286 - DNA, 22 bp, Artificial Sequence
  chemically synthesized
gtcctctaacgcataggccagc

SEQ ID NO: 1233287 - DNA, 22 bp, Artificial Sequence
  chemically synthesized
tcctctaacgcataggccagca

SEQ ID NO: 1233288 - DNA, 22 bp, Artificial Sequence
  chemically synthesized
taacgcataggccagcatctta

SEQ ID NO: 1233289 - DNA, 22 bp, Artificial Sequence
  chemically synthesized
atggggagctgcataagatgct

SEQ ID NO: 1233290 - DNA, 22 bp, Artificial Sequence
  chemically synthesized
acgcataggccagcatcttatg

SEQ ID NO: 1233291 - DNA, 22 bp, Artificial Sequence
  chemically synthesized
aatggggagctgcataagatgc

SEQ ID NO: 1233292 - DNA, 22 bp, Artificial Sequence
  chemically synthesized
taatggggagctgcataagatg

SEQ ID NO: 1233293 - DNA, 22 bp, Artificial Sequence
  chemically synthesized
gagctttaatggggagctgcat

SEQ ID NO: 1233294 - DNA, 22 bp, Artificial Sequence
  chemically synthesized
agctagagctttaatggggagc

SEQ ID NO: 1233295 - DNA, 22 bp, Artificial Sequence
  chemically synthesized
atctgagctagagctttaatgg

SEQ ID NO: 1233296 - DNA, 22 bp, Artificial Sequence
  chemically synthesized
catctgagctagagctttaatg

SEQ ID NO: 1233297 - DNA, 22 bp, Artificial Sequence
  chemically synthesized
atgcagctccccattaaagctc

SEQ ID NO: 1233298 - DNA, 22 bp, Artificial Sequence
  chemically synthesized
tcatctgagctagagctttaat

SEQ ID NO: 1233299 - DNA, 22 bp, Artificial Sequence
  chemically synthesized
tgcagctccccattaaagctct

SEQ ID NO: 1233300 - DNA, 22 bp, Artificial Sequence
  chemically synthesized
cccattaaagctctagctcaga

SEQ ID NO: 1233301 - DNA, 22 bp, Artificial Sequence
  chemically synthesized
acaatgctttcatctgagctag

SEQ ID NO: 1233302 - DNA, 22 bp, Artificial Sequence
  chemically synthesized
aagctctagctcagatgaaagc

SEQ ID NO: 1233303 - DNA, 22 bp, Artificial Sequence
  chemically synthesized
tagctcagatgaaagcattgtt

SEQ ID NO: 1233304 - DNA, 22 bp, Artificial Sequence
  chemically synthesized
aaaagcagatattaacaatgct

SEQ ID NO: 1233305 - DNA, 22 bp, Artificial Sequence
  chemically synthesized
gctcagatgaaagcattgttaa

SEQ ID NO: 1233306 - DNA, 22 bp, Artificial Sequence
  chemically synthesized
ttcaaaagcagatattaacaat

SEQ ID NO: 1233307 - DNA, 22 bp, Artificial Sequence
  chemically synthesized
agatgaaagcattgttaatatc

SEQ ID NO: 1233308 - DNA, 22 bp, Artificial Sequence
  chemically synthesized
agaaggagttgttcaaaagcag

SEQ ID NO: 1233309 - DNA, 22 bp, Artificial Sequence
  chemically synthesized
gagaaggagttgttcaaaagca

SEQ ID NO: 1233310 - DNA, 22 bp, Artificial Sequence
  chemically synthesized
ttaatatctgcttttgaacaac

SEQ ID NO: 1233311 - DNA, 22 bp, Artificial Sequence
  chemically synthesized
aatttgagaaggagttgttcaa

SEQ ID NO: 1233312 - DNA, 22 bp, Artificial Sequence
  chemically synthesized
aaatttgagaaggagttgttca

SEQ ID NO: 1233313 - DNA, 22 bp, Artificial Sequence
  chemically synthesized
atatctgcttttgaacaactcc

SEQ ID NO: 1233314 - DNA, 22 bp, Artificial Sequence
  chemically synthesized
cttttgaacaactccttctcaa

SEQ ID NO: 1233315 - DNA, 22 bp, Artificial Sequence
  chemically synthesized
ttgaacaactccttctcaaatt

SEQ ID NO: 1233316 - DNA, 22 bp, Artificial Sequence
  chemically synthesized
tgaacaactccttctcaaattt

SEQ ID NO: 1233317 - DNA, 22 bp, Artificial Sequence
  chemically synthesized
gaacaactccttctcaaattta

SEQ ID NO: 1233318 - DNA, 22 bp, Artificial Sequence
  chemically synthesized
aacaactccttctcaaatttaa

SEQ ID NO: 1233319 - DNA, 22 bp, Artificial Sequence
  chemically synthesized
cttctcaaatttaagccattat

SEQ ID NO: 1233320 - DNA, 22 bp, Artificial Sequence
  chemically synthesized
ctcaaatttaagccattatttt

SEQ ID NO: 1233321 - DNA, 22 bp, Artificial Sequence
  chemically synthesized
tcaaatttaagccattattttg

SEQ ID NO: 1233322 - DNA, 22 bp, Artificial Sequence
  chemically synthesized
aaatttaagccattattttggg

SEQ ID NO: 1233323 - DNA, 22 bp, Artificial Sequence
  chemically synthesized
gtagggaaaaggccccaaaata

SEQ ID NO: 1233324 - DNA, 22 bp, Artificial Sequence
  chemically synthesized
agtagggaaaaggccccaaaat

SEQ ID NO: 1233325 - DNA, 22 bp, Artificial Sequence
  chemically synthesized
tagtagggaaaaggccccaaaa

SEQ ID NO: 1233326 - DNA, 22 bp, Artificial Sequence
  chemically synthesized
aagccattattttggggccttt

SEQ ID NO: 1233327 - DNA, 22 bp, Artificial Sequence
  chemically synthesized
agccattattttggggcctttt

SEQ ID NO: 1233328 - DNA, 22 bp, Artificial Sequence
  chemically synthesized
atgttttagtagggaaaaggcc

SEQ ID NO: 1233329 - DNA, 22 bp, Artificial Sequence
  chemically synthesized
ctaatgttttagtagggaaaag

SEQ ID NO: 1233330 - DNA, 22 bp, Artificial Sequence
  chemically synthesized
ttttggggccttttccctacta

SEQ ID NO: 1233331 - DNA, 22 bp, Artificial Sequence
  chemically synthesized
tggggccttttccctactaaaa

SEQ ID NO: 1233332 - DNA, 22 bp, Artificial Sequence
  chemically synthesized
ggggccttttccctactaaaac

SEQ ID NO: 1233333 - DNA, 22 bp, Artificial Sequence
  chemically synthesized
gggccttttccctactaaaaca

SEQ ID NO: 1233334 - DNA, 22 bp, Artificial Sequence
  chemically synthesized
ttccctactaaaacattaggag

SEQ ID NO: 1233335 - DNA, 22 bp, Artificial Sequence
  chemically synthesized
tccctactaaaacattaggagg

SEQ ID NO: 1233336 - DNA, 22 bp, Artificial Sequence
  chemically synthesized
ccctactaaaacattaggaggt

SEQ ID NO: 1233337 - DNA, 22 bp, Artificial Sequence
  chemically synthesized
cctactaaaacattaggaggtt

SEQ ID NO: 1233338 - DNA, 22 bp, Artificial Sequence
  chemically synthesized
cagaaaatatagaacctcctaa

SEQ ID NO: 1233339 - DNA, 22 bp, Artificial Sequence
  chemically synthesized
acagaaaatatagaacctccta

SEQ ID NO: 1233340 - DNA, 22 bp, Artificial Sequence
  chemically synthesized
ttacagaaaatatagaacctcc

SEQ ID NO: 1233341 - DNA, 22 bp, Artificial Sequence
  chemically synthesized
ctaaaacattaggaggttctat

SEQ ID NO: 1233342 - DNA, 22 bp, Artificial Sequence
  chemically synthesized
cttacagaaaatatagaacctc

SEQ ID NO: 1233343 - DNA, 22 bp, Artificial Sequence
  chemically synthesized
aaacattaggaggttctatatt

SEQ ID NO: 1233344 - DNA, 22 bp, Artificial Sequence
  chemically synthesized
ggaggttctatattttctgtaa

SEQ ID NO: 1233345 - DNA, 22 bp, Artificial Sequence
  chemically synthesized
agggaaggccacatttcttaca

SEQ ID NO: 1233346 - DNA, 22 bp, Artificial Sequence
  chemically synthesized
cagggaaggccacatttcttac

SEQ ID NO: 1233347 - DNA, 22 bp, Artificial Sequence
  chemically synthesized
tatattttctgtaagaaatgtg

SEQ ID NO: 1233348 - DNA, 22 bp, Artificial Sequence
  chemically synthesized
ttcagggaaggccacatttctt

SEQ ID NO: 1233349 - DNA, 22 bp, Artificial Sequence
  chemically synthesized
tattttctgtaagaaatgtggc

SEQ ID NO: 1233350 - DNA, 22 bp, Artificial Sequence
  chemically synthesized
tctgtaagaaatgtggccttcc

SEQ ID NO: 1233351 - DNA, 22 bp, Artificial Sequence
  chemically synthesized
ctgtaagaaatgtggccttccc

SEQ ID NO: 1233352 - DNA, 22 bp, Artificial Sequence
  chemically synthesized
tgtaagaaatgtggccttccct

SEQ ID NO: 1233353 - DNA, 22 bp, Artificial Sequence
  chemically synthesized
taagaaatgtggccttccctga

SEQ ID NO: 1233354 - DNA, 22 bp, Artificial Sequence
  chemically synthesized
gaatatgatgtcatatgaatct

SEQ ID NO: 1233355 - DNA, 22 bp, Artificial Sequence
  chemically synthesized
ccctgaagagattcatatgaca

SEQ ID NO: 1233356 - DNA, 22 bp, Artificial Sequence
  chemically synthesized
cctgaagagattcatatgacat

SEQ ID NO: 1233357 - DNA, 22 bp, Artificial Sequence
  chemically synthesized
aagagattcatatgacatcata

SEQ ID NO: 1233358 - DNA, 22 bp, Artificial Sequence
  chemically synthesized
atatgacatcatattctaattt

SEQ ID NO: 1233359 - DNA, 22 bp, Artificial Sequence
  chemically synthesized
aatgaatataagtgaatataaa

SEQ ID NO: 1233360 - DNA, 22 bp, Artificial Sequence
  chemically synthesized
ttaaatgaatataagtgaatat

SEQ ID NO: 1233361 - DNA, 22 bp, Artificial Sequence
  chemically synthesized
taattttatattcacttatatt

SEQ ID NO: 1233362 - DNA, 22 bp, Artificial Sequence
  chemically synthesized
attttatattcacttatattca

SEQ ID NO: 1233363 - DNA, 22 bp, Artificial Sequence
  chemically synthesized
atgaaattattaaatgaatata

SEQ ID NO: 1233364 - DNA, 22 bp, Artificial Sequence
  chemically synthesized
tatattcacttatattcattta

SEQ ID NO: 1233365 - DNA, 22 bp, Artificial Sequence
  chemically synthesized
taatgaaattattaaatgaata

SEQ ID NO: 1233366 - DNA, 22 bp, Artificial Sequence
  chemically synthesized
atattcacttatattcatttaa

SEQ ID NO: 1233367 - DNA, 22 bp, Artificial Sequence
  chemically synthesized
ctaatgaaattattaaatgaat

SEQ ID NO: 1233368 - DNA, 22 bp, Artificial Sequence
  chemically synthesized
tattcacttatattcatttaat

SEQ ID NO: 1233369 - DNA, 22 bp, Artificial Sequence
  chemically synthesized
tctaatgaaattattaaatgaa

SEQ ID NO: 1233370 - DNA, 22 bp, Artificial Sequence
  chemically synthesized
acttatattcatttaataattt

SEQ ID NO: 1233371 - DNA, 22 bp, Artificial Sequence
  chemically synthesized
atattcatttaataatttcatt

SEQ ID NO: 1233372 - DNA, 22 bp, Artificial Sequence
  chemically synthesized
tattcatttaataatttcatta

SEQ ID NO: 1233373 - DNA, 22 bp, Artificial Sequence
  chemically synthesized
atttaataatttcattagaaaa

SEQ ID NO: 1233374 - DNA, 22 bp, Artificial Sequence
  chemically synthesized
atcatagaccccatgttttcta

SEQ ID NO: 1233375 - DNA, 22 bp, Artificial Sequence
  chemically synthesized
aataatttcattagaaaacatg

SEQ ID NO: 1233376 - DNA, 22 bp, Artificial Sequence
  chemically synthesized
ataatttcattagaaaacatgg

SEQ ID NO: 1233377 - DNA, 22 bp, Artificial Sequence
  chemically synthesized
cattagaaaacatggggtctat

SEQ ID NO: 1233378 - DNA, 22 bp, Artificial Sequence
  chemically synthesized
attagaaaacatggggtctatg

SEQ ID NO: 1233379 - DNA, 22 bp, Artificial Sequence
  chemically synthesized
gaaaacatggggtctatgatca

SEQ ID NO: 1233380 - DNA, 22 bp, Artificial Sequence
  chemically synthesized
cacgggccatatatagaaatct

SEQ ID NO: 1233381 - DNA, 22 bp, Artificial Sequence
  chemically synthesized
tgatcagatttctatatatggc

SEQ ID NO: 1233382 - DNA, 22 bp, Artificial Sequence
  chemically synthesized
cgaaactccacgggccatatat

SEQ ID NO: 1233383 - DNA, 22 bp, Artificial Sequence
  chemically synthesized
aaacctccgaaactccacgggc

SEQ ID NO: 1233384 - DNA, 22 bp, Artificial Sequence
  chemically synthesized
aaaacctccgaaactccacggg

SEQ ID NO: 1233385 - DNA, 22 bp, Artificial Sequence
  chemically synthesized
ctatatatggcccgtggagttt

SEQ ID NO: 1233386 - DNA, 22 bp, Artificial Sequence
  chemically synthesized
tatatatggcccgtggagtttc

SEQ ID NO: 1233387 - DNA, 22 bp, Artificial Sequence
  chemically synthesized
tatatggcccgtggagtttcgg

SEQ ID NO: 1233388 - DNA, 22 bp, Artificial Sequence
  chemically synthesized
tgaagggaacttaaaacctccg

SEQ ID NO: 1233389 - DNA, 22 bp, Artificial Sequence
  chemically synthesized
atgaagggaacttaaaacctcc

SEQ ID NO: 1233390 - DNA, 22 bp, Artificial Sequence
  chemically synthesized
cggaggttttaagttcccttca

SEQ ID NO: 1233391 - DNA, 22 bp, Artificial Sequence
  chemically synthesized
ggaggttttaagttcccttcat

SEQ ID NO: 1233392 - DNA, 22 bp, Artificial Sequence
  chemically synthesized
aaagaggaacttatgaagggaa

SEQ ID NO: 1233393 - DNA, 22 bp, Artificial Sequence
  chemically synthesized
aattaaaagaggaacttatgaa

SEQ ID NO: 1233394 - DNA, 22 bp, Artificial Sequence
  chemically synthesized
caattaaaagaggaacttatga

SEQ ID NO: 1233395 - DNA, 22 bp, Artificial Sequence
  chemically synthesized
taagttcccttcataagttcct

SEQ ID NO: 1233396 - DNA, 22 bp, Artificial Sequence
  chemically synthesized
aagttcccttcataagttcctc

SEQ ID NO: 1233397 - DNA, 22 bp, Artificial Sequence
  chemically synthesized
agttcccttcataagttcctct

SEQ ID NO: 1233398 - DNA, 22 bp, Artificial Sequence
  chemically synthesized
cacttcaattaaaagaggaact

SEQ ID NO: 1233399 - DNA, 22 bp, Artificial Sequence
  chemically synthesized
ccttcataagttcctcttttaa

SEQ ID NO: 1233400 - DNA, 22 bp, Artificial Sequence
  chemically synthesized
cataagttcctcttttaattga

SEQ ID NO: 1233401 - DNA, 22 bp, Artificial Sequence
  chemically synthesized
ataagttcctcttttaattgaa

SEQ ID NO: 1233402 - DNA, 22 bp, Artificial Sequence
  chemically synthesized
tatgcatattccacttcaatta

SEQ ID NO: 1233403 - DNA, 22 bp, Artificial Sequence
  chemically synthesized
tatatgcatattccacttcaat

SEQ ID NO: 1233404 - DNA, 22 bp, Artificial Sequence
  chemically synthesized
ctatatgcatattccacttcaa

SEQ ID NO: 1233405 - DNA, 22 bp, Artificial Sequence
  chemically synthesized
tctatatgcatattccacttca

SEQ ID NO: 1233406 - DNA, 22 bp, Artificial Sequence
  chemically synthesized
ttctatatgcatattccacttc

SEQ ID NO: 1233407 - DNA, 22 bp, Artificial Sequence
  chemically synthesized
ctcttttaattgaagtggaata

SEQ ID NO: 1233408 - DNA, 22 bp, Artificial Sequence
  chemically synthesized
ttttaattgaagtggaatatgc

SEQ ID NO: 1233409 - DNA, 22 bp, Artificial Sequence
  chemically synthesized
ttaattgaagtggaatatgcat

SEQ ID NO: 1233410 - DNA, 22 bp, Artificial Sequence
  chemically synthesized
taattgaagtggaatatgcata

SEQ ID NO: 1233411 - DNA, 22 bp, Artificial Sequence
  chemically synthesized
aattgaagtggaatatgcatat

SEQ ID NO: 1233412 - DNA, 22 bp, Artificial Sequence
  chemically synthesized
attgaagtggaatatgcatata

SEQ ID NO: 1233413 - DNA, 22 bp, Artificial Sequence
  chemically synthesized
tgtatatttttctatatgcata

SEQ ID NO: 1233414 - DNA, 22 bp, Artificial Sequence
  chemically synthesized
atgtatatttttctatatgcat

SEQ ID NO: 1233415 - DNA, 22 bp, Artificial Sequence
  chemically synthesized
aagtggaatatgcatatagaaa

SEQ ID NO: 1233416 - DNA, 22 bp, Artificial Sequence
  chemically synthesized
tacacttatgtatatttttcta

SEQ ID NO: 1233417 - DNA, 22 bp, Artificial Sequence
  chemically synthesized
taagaaaacgcatcaagttgta

SEQ ID NO: 1233418 - DNA, 22 bp, Artificial Sequence
  chemically synthesized
ctgtaagaaaacgcatcaagtt

SEQ ID NO: 1233419 - DNA, 22 bp, Artificial Sequence
  chemically synthesized
actgtaagaaaacgcatcaagt

SEQ ID NO: 1233420 - DNA, 22 bp, Artificial Sequence
  chemically synthesized
cacatgtgtatttactgtaaga

SEQ ID NO: 1233421 - DNA, 22 bp, Artificial Sequence
  chemically synthesized
gatgcgttttcttacagtaaat

SEQ ID NO: 1233422 - DNA, 22 bp, Artificial Sequence
  chemically synthesized
ttacacatgtgtatttactgta

SEQ ID NO: 1233423 - DNA, 22 bp, Artificial Sequence
  chemically synthesized
atgcgttttcttacagtaaata

SEQ ID NO: 1233424 - DNA, 22 bp, Artificial Sequence
  chemically synthesized
atagctgttacacatgtgtatt

SEQ ID NO: 1233425 - DNA, 22 bp, Artificial Sequence
  chemically synthesized
tcttacagtaaatacacatgtg

SEQ ID NO: 1233426 - DNA, 22 bp, Artificial Sequence
  chemically synthesized
cttacagtaaatacacatgtgt

SEQ ID NO: 1233427 - DNA, 22 bp, Artificial Sequence
  chemically synthesized
ttacagtaaatacacatgtgta

SEQ ID NO: 1233428 - DNA, 22 bp, Artificial Sequence
  chemically synthesized
acctgatagctgttacacatgt

SEQ ID NO: 1233429 - DNA, 22 bp, Artificial Sequence
  chemically synthesized
acagtaaatacacatgtgtaac

SEQ ID NO: 1233430 - DNA, 22 bp, Artificial Sequence
  chemically synthesized
gacctgatagctgttacacatg

SEQ ID NO: 1233431 - DNA, 22 bp, Artificial Sequence
  chemically synthesized
cagtaaatacacatgtgtaaca

SEQ ID NO: 1233432 - DNA, 22 bp, Artificial Sequence
  chemically synthesized
tgacctgatagctgttacacat

SEQ ID NO: 1233433 - DNA, 22 bp, Artificial Sequence
  chemically synthesized
catgttttgacctgatagctgt

SEQ ID NO: 1233434 - DNA, 22 bp, Artificial Sequence
  chemically synthesized
ttccatgttttgacctgatagc

SEQ ID NO: 1233435 - DNA, 22 bp, Artificial Sequence
  chemically synthesized
actgttccatgttttgacctga

SEQ ID NO: 1233436 - DNA, 22 bp, Artificial Sequence
  chemically synthesized
cggtgctcactgttccatgttt

SEQ ID NO: 1233437 - DNA, 22 bp, Artificial Sequence
  chemically synthesized
tgcggtgctcactgttccatgt

SEQ ID NO: 1233438 - DNA, 22 bp, Artificial Sequence
  chemically synthesized
ctgcggtgctcactgttccatg

SEQ ID NO: 1233439 - DNA, 22 bp, Artificial Sequence
  chemically synthesized
tcaggtcaaaacatggaacagt

SEQ ID NO: 1233440 - DNA, 22 bp, Artificial Sequence
  chemically synthesized
gaaggagtaagtcagtaaaacg

SEQ ID NO: 1233441 - DNA, 22 bp, Artificial Sequence
  chemically synthesized
ggaaggagtaagtcagtaaaac

SEQ ID NO: 1233442 - DNA, 22 bp, Artificial Sequence
  chemically synthesized
tggaaggagtaagtcagtaaaa

SEQ ID NO: 1233443 - DNA, 22 bp, Artificial Sequence
  chemically synthesized
ttggaaggagtaagtcagtaaa

SEQ ID NO: 1233444 - DNA, 22 bp, Artificial Sequence
  chemically synthesized
tcttatgcgttttactgactta

SEQ ID NO: 1233445 - DNA, 22 bp, Artificial Sequence
  chemically synthesized
ttatgcgttttactgacttact

SEQ ID NO: 1233446 - DNA, 22 bp, Artificial Sequence
  chemically synthesized
acttttggaaggagtaagtcag

SEQ ID NO: 1233447 - DNA, 22 bp, Artificial Sequence
  chemically synthesized
atgcgttttactgacttactcc

SEQ ID NO: 1233448 - DNA, 22 bp, Artificial Sequence
  chemically synthesized
tgcgttttactgacttactcct

SEQ ID NO: 1233449 - DNA, 22 bp, Artificial Sequence
  chemically synthesized
tactgacttactccttccaaaa

SEQ ID NO: 1233450 - DNA, 22 bp, Artificial Sequence
  chemically synthesized
actgacttactccttccaaaag

SEQ ID NO: 1233451 - DNA, 22 bp, Artificial Sequence
  chemically synthesized
ctgacttactccttccaaaagt

SEQ ID NO: 1233452 - DNA, 22 bp, Artificial Sequence
  chemically synthesized
aagagagtggttaacttttgga

SEQ ID NO: 1233453 - DNA, 22 bp, Artificial Sequence
  chemically synthesized
acttactccttccaaaagttaa

SEQ ID NO: 1233454 - DNA, 22 bp, Artificial Sequence
  chemically synthesized
actccttccaaaagttaaccac

SEQ ID NO: 1233455 - DNA, 22 bp, Artificial Sequence
  chemically synthesized
aaattgaagagagtggttaact

SEQ ID NO: 1233456 - DNA, 22 bp, Artificial Sequence
  chemically synthesized
ctccttccaaaagttaaccact

SEQ ID NO: 1233457 - DNA, 22 bp, Artificial Sequence
  chemically synthesized
aaaattgaagagagtggttaac

SEQ ID NO: 1233458 - DNA, 22 bp, Artificial Sequence
  chemically synthesized
cttccaaaagttaaccactctc

SEQ ID NO: 1233459 - DNA, 22 bp, Artificial Sequence
  chemically synthesized
ccaaaagttaaccactctcttc

SEQ ID NO: 1233460 - DNA, 22 bp, Artificial Sequence
  chemically synthesized
caaaagttaaccactctcttca

SEQ ID NO: 1233461 - DNA, 22 bp, Artificial Sequence
  chemically synthesized
catgggtttaaaattgaagaga

SEQ ID NO: 1233462 - DNA, 22 bp, Artificial Sequence
  chemically synthesized
ccatgggtttaaaattgaagag

SEQ ID NO: 1233463 - DNA, 22 bp, Artificial Sequence
  chemically synthesized
accactctcttcaattttaaac

SEQ ID NO: 1233464 - DNA, 22 bp, Artificial Sequence
  chemically synthesized
tcttcaattttaaacccatgga

SEQ ID NO: 1233465 - DNA, 22 bp, Artificial Sequence
  chemically synthesized
ttcaattttaaacccatggaaa

SEQ ID NO: 1233466 - DNA, 22 bp, Artificial Sequence
  chemically synthesized
caattttaaacccatggaaaca

SEQ ID NO: 1233467 - DNA, 22 bp, Artificial Sequence
  chemically synthesized
aattttaaacccatggaaacat

SEQ ID NO: 1233468 - DNA, 22 bp, Artificial Sequence
  chemically synthesized
aaaaacgggcaaaatgtttcca

SEQ ID NO: 1233469 - DNA, 22 bp, Artificial Sequence
  chemically synthesized
caaaaacgggcaaaatgtttcc

SEQ ID NO: 1233470 - DNA, 22 bp, Artificial Sequence
  chemically synthesized
taaacccatggaaacattttgc

SEQ ID NO: 1233471 - DNA, 22 bp, Artificial Sequence
  chemically synthesized
aaacccatggaaacattttgcc

SEQ ID NO: 1233472 - DNA, 22 bp, Artificial Sequence
  chemically synthesized
aacccatggaaacattttgccc

SEQ ID NO: 1233473 - DNA, 22 bp, Artificial Sequence
  chemically synthesized
aatttcaaaaacgggcaaaatg

SEQ ID NO: 1233474 - DNA, 22 bp, Artificial Sequence
  chemically synthesized
aattaaatttcaaaaacgggca

SEQ ID NO: 1233475 - DNA, 22 bp, Artificial Sequence
  chemically synthesized
caattaaatttcaaaaacgggc

SEQ ID NO: 1233476 - DNA, 22 bp, Artificial Sequence
  chemically synthesized
tcaattaaatttcaaaaacggg

SEQ ID NO: 1233477 - DNA, 22 bp, Artificial Sequence
  chemically synthesized
tttcaattaaatttcaaaaacg

SEQ ID NO: 1233478 - DNA, 22 bp, Artificial Sequence
  chemically synthesized
ctttcaattaaatttcaaaaac

SEQ ID NO: 1233479 - DNA, 22 bp, Artificial Sequence
  chemically synthesized
tgatttctttcaattaaatttc

SEQ ID NO: 1233480 - DNA, 22 bp, Artificial Sequence
  chemically synthesized
tgcccgtttttgaaatttaatt

SEQ ID NO: 1233481 - DNA, 22 bp, Artificial Sequence
  chemically synthesized
gcccgtttttgaaatttaattg

SEQ ID NO: 1233482 - DNA, 22 bp, Artificial Sequence
  chemically synthesized
cccgtttttgaaatttaattga

SEQ ID NO: 1233483 - DNA, 22 bp, Artificial Sequence
  chemically synthesized
ctatgatttctttcaattaaat

SEQ ID NO: 1233484 - DNA, 22 bp, Artificial Sequence
  chemically synthesized
tacctactatgatttctttcaa

SEQ ID NO: 1233485 - DNA, 22 bp, Artificial Sequence
  chemically synthesized
ttgaaatttaattgaaagaaat

SEQ ID NO: 1233486 - DNA, 22 bp, Artificial Sequence
  chemically synthesized
tgaaatttaattgaaagaaatc

SEQ ID NO: 1233487 - DNA, 22 bp, Artificial Sequence
  chemically synthesized
gaaatttaattgaaagaaatca

SEQ ID NO: 1233488 - DNA, 22 bp, Artificial Sequence
  chemically synthesized
aaatttaattgaaagaaatcat

SEQ ID NO: 1233489 - DNA, 22 bp, Artificial Sequence
  chemically synthesized
aattgaaagaaatcatagtagg

SEQ ID NO: 1233490 - DNA, 22 bp, Artificial Sequence
  chemically synthesized
attgaaagaaatcatagtaggt

SEQ ID NO: 1233491 - DNA, 22 bp, Artificial Sequence
  chemically synthesized
aaagaaatcatagtaggtataa

SEQ ID NO: 1233492 - DNA, 22 bp, Artificial Sequence
  chemically synthesized
agtgaaataaatcagacaaatt

SEQ ID NO: 1233493 - DNA, 22 bp, Artificial Sequence
  chemically synthesized
gagtgaaataaatcagacaaat

SEQ ID NO: 1233494 - DNA, 22 bp, Artificial Sequence
  chemically synthesized
aaatgtatttgagtgaaataaa

SEQ ID NO: 1233495 - DNA, 22 bp, Artificial Sequence
  chemically synthesized
gtctgatttatttcactcaaat

SEQ ID NO: 1233496 - DNA, 22 bp, Artificial Sequence
  chemically synthesized
tctgatttatttcactcaaata

SEQ ID NO: 1233497 - DNA, 22 bp, Artificial Sequence
  chemically synthesized
atttatttcactcaaatacatt

SEQ ID NO: 1233498 - DNA, 22 bp, Artificial Sequence
  chemically synthesized
atttcactcaaatacattttaa

SEQ ID NO: 1233499 - DNA, 22 bp, Artificial Sequence
  chemically synthesized
tttcactcaaatacattttaac

SEQ ID NO: 1233500 - DNA, 22 bp, Artificial Sequence
  chemically synthesized
cactcaaatacattttaacgac

SEQ ID NO: 1233501 - DNA, 22 bp, Artificial Sequence
  chemically synthesized
actcaaatacattttaacgact

SEQ ID NO: 1233502 - DNA, 22 bp, Artificial Sequence
  chemically synthesized
aaatacattttaacgacttcat

SEQ ID NO: 1233503 - DNA, 22 bp, Artificial Sequence
  chemically synthesized
cacacaatatacaagatgaagt

SEQ ID NO: 1233504 - DNA, 22 bp, Artificial Sequence
  chemically synthesized
taacgacttcatcttgtatatt

SEQ ID NO: 1233505 - DNA, 22 bp, Artificial Sequence
  chemically synthesized
aacgacttcatcttgtatattg

SEQ ID NO: 1233506 - DNA, 22 bp, Artificial Sequence
  chemically synthesized
acgacttcatcttgtatattgt

SEQ ID NO: 1233507 - DNA, 22 bp, Artificial Sequence
  chemically synthesized
catcttgtatattgtgtgtagc

SEQ ID NO: 1233508 - DNA, 22 bp, Artificial Sequence
  chemically synthesized
atcttgtatattgtgtgtagct

SEQ ID NO: 1233509 - DNA, 22 bp, Artificial Sequence
  chemically synthesized
gtatattgtgtgtagctatcat

SEQ ID NO: 1233510 - DNA, 22 bp, Artificial Sequence
  chemically synthesized
tatattgtgtgtagctatcatt

SEQ ID NO: 1233511 - DNA, 22 bp, Artificial Sequence
  chemically synthesized
tgtgtagctatcatttggtcat

SEQ ID NO: 1233512 - DNA, 22 bp, Artificial Sequence
  chemically synthesized
cagagcaatgaaaatgaccaaa

SEQ ID NO: 1233513 - DNA, 22 bp, Artificial Sequence
  chemically synthesized
tcatttggtcattttcattgct

SEQ ID NO: 1233514 - DNA, 22 bp, Artificial Sequence
  chemically synthesized
atgatgggatattacagagcaa

SEQ ID NO: 1233515 - DNA, 22 bp, Artificial Sequence
  chemically synthesized
ggtcattttcattgctctgtaa

SEQ ID NO: 1233516 - DNA, 22 bp, Artificial Sequence
  chemically synthesized
gtcattttcattgctctgtaat

SEQ ID NO: 1233517 - DNA, 22 bp, Artificial Sequence
  chemically synthesized
tcatgatgggatattacagagc

SEQ ID NO: 1233518 - DNA, 22 bp, Artificial Sequence
  chemically synthesized
tcattgctctgtaatatcccat

SEQ ID NO: 1233519 - DNA, 22 bp, Artificial Sequence
  chemically synthesized
cattgctctgtaatatcccatc

SEQ ID NO: 1233520 - DNA, 22 bp, Artificial Sequence
  chemically synthesized
attgctctgtaatatcccatca

SEQ ID NO: 1233521 - DNA, 22 bp, Artificial Sequence
  chemically synthesized
tgatacattctcatgatgggat

SEQ ID NO: 1233522 - DNA, 22 bp, Artificial Sequence
  chemically synthesized
ctctgtaatatcccatcatgag

SEQ ID NO: 1233523 - DNA, 22 bp, Artificial Sequence
  chemically synthesized
tgtaatatcccatcatgagaat

SEQ ID NO: 1233524 - DNA, 22 bp, Artificial Sequence
  chemically synthesized
taatatcccatcatgagaatgt

SEQ ID NO: 1233525 - DNA, 22 bp, Artificial Sequence
  chemically synthesized
gaagtgactatgatacattctc

SEQ ID NO: 1233526 - DNA, 22 bp, Artificial Sequence
  chemically synthesized
tgatagcccaaactggaagtga

SEQ ID NO: 1233527 - DNA, 22 bp, Artificial Sequence
  chemically synthesized
gtgatagcccaaactggaagtg

SEQ ID NO: 1233528 - DNA, 22 bp, Artificial Sequence
  chemically synthesized
atttgtgatagcccaaactgga

SEQ ID NO: 1233529 - DNA, 22 bp, Artificial Sequence
  chemically synthesized
catttgtgatagcccaaactgg

SEQ ID NO: 1233530 - DNA, 22 bp, Artificial Sequence
  chemically synthesized
atagcagtttcatttgtgatag

SEQ ID NO: 1233531 - DNA, 22 bp, Artificial Sequence
  chemically synthesized
ccagtttgggctatcacaaatg

SEQ ID NO: 1233532 - DNA, 22 bp, Artificial Sequence
  chemically synthesized
cagtttgggctatcacaaatga

SEQ ID NO: 1233533 - DNA, 22 bp, Artificial Sequence
  chemically synthesized
gggctatcacaaatgaaactgc

SEQ ID NO: 1233534 - DNA, 22 bp, Artificial Sequence
  chemically synthesized
ggctatcacaaatgaaactgct

SEQ ID NO: 1233535 - DNA, 22 bp, Artificial Sequence
  chemically synthesized
tcacaaatgaaactgctatgaa

SEQ ID NO: 1233536 - DNA, 22 bp, Artificial Sequence
  chemically synthesized
ctatgaacattctcacatatat

SEQ ID NO: 1233537 - DNA, 22 bp, Artificial Sequence
  chemically synthesized
ccaaaaacacatatatatgtga

SEQ ID NO: 1233538 - DNA, 22 bp, Artificial Sequence
  chemically synthesized
gccaaaaacacatatatatgtg

SEQ ID NO: 1233539 - DNA, 22 bp, Artificial Sequence
  chemically synthesized
tgaacattctcacatatatatg

SEQ ID NO: 1233540 - DNA, 22 bp, Artificial Sequence
  chemically synthesized
ccagtttgccaaaaacacatat

SEQ ID NO: 1233541 - DNA, 22 bp, Artificial Sequence
  chemically synthesized
cccagtttgccaaaaacacata

SEQ ID NO: 1233542 - DNA, 22 bp, Artificial Sequence
  chemically synthesized
tcacatatatatgtgtttttgg

SEQ ID NO: 1233543 - DNA, 22 bp, Artificial Sequence
  chemically synthesized
acatatatatgtgtttttggca

SEQ ID NO: 1233544 - DNA, 22 bp, Artificial Sequence
  chemically synthesized
cagaaatacatttcccagtttg

SEQ ID NO: 1233545 - DNA, 22 bp, Artificial Sequence
  chemically synthesized
ttggcaaactgggaaatgtatt

SEQ ID NO: 1233546 - DNA, 22 bp, Artificial Sequence
  chemically synthesized
tggcaaactgggaaatgtattt

SEQ ID NO: 1233547 - DNA, 22 bp, Artificial Sequence
  chemically synthesized
ggcaaactgggaaatgtatttc

SEQ ID NO: 1233548 - DNA, 22 bp, Artificial Sequence
  chemically synthesized
gcaaactgggaaatgtatttct

SEQ ID NO: 1233549 - DNA, 22 bp, Artificial Sequence
  chemically synthesized
tagacatacaagttacagaaat

SEQ ID NO: 1233550 - DNA, 22 bp, Artificial Sequence
  chemically synthesized
ttgtagacatacaagttacaga

SEQ ID NO: 1233551 - DNA, 22 bp, Artificial Sequence
  chemically synthesized
ggaaatgtatttctgtaacttg

SEQ ID NO: 1233552 - DNA, 22 bp, Artificial Sequence
  chemically synthesized
tattgtagacatacaagttaca

SEQ ID NO: 1233553 - DNA, 22 bp, Artificial Sequence
  chemically synthesized
ctgtaacttgtatgtctacaat

SEQ ID NO: 1233554 - DNA, 22 bp, Artificial Sequence
  chemically synthesized
tgtaacttgtatgtctacaata

SEQ ID NO: 1233555 - DNA, 22 bp, Artificial Sequence
  chemically synthesized
taacttgtatgtctacaataga

SEQ ID NO: 1233556 - DNA, 22 bp, Artificial Sequence
  chemically synthesized
ccacccagcaattctattgtag

SEQ ID NO: 1233557 - DNA, 22 bp, Artificial Sequence
  chemically synthesized
accacccagcaattctattgta

SEQ ID NO: 1233558 - DNA, 22 bp, Artificial Sequence
  chemically synthesized
ttaccacccagcaattctattg

SEQ ID NO: 1233559 - DNA, 22 bp, Artificial Sequence
  chemically synthesized
cttaccacccagcaattctatt

SEQ ID NO: 1233560 - DNA, 22 bp, Artificial Sequence
  chemically synthesized
gtatgtctacaatagaattgct

SEQ ID NO: 1233561 - DNA, 22 bp, Artificial Sequence
  chemically synthesized
tatgtctacaatagaattgctg

SEQ ID NO: 1233562 - DNA, 22 bp, Artificial Sequence
  chemically synthesized
caatagaattgctgggtggtaa

SEQ ID NO: 1233563 - DNA, 22 bp, Artificial Sequence
  chemically synthesized
aatgtgaaaatgcacatttctt

SEQ ID NO: 1233564 - DNA, 22 bp, Artificial Sequence
  chemically synthesized
ctgggtggtaagaaatgtgcat

SEQ ID NO: 1233565 - DNA, 22 bp, Artificial Sequence
  chemically synthesized
ctaaatgtgaaaatgcacattt

SEQ ID NO: 1233566 - DNA, 22 bp, Artificial Sequence
  chemically synthesized
ggtggtaagaaatgtgcatttt

SEQ ID NO: 1233567 - DNA, 22 bp, Artificial Sequence
  chemically synthesized
ggcatgatctactaaatgtgaa

SEQ ID NO: 1233568 - DNA, 22 bp, Artificial Sequence
  chemically synthesized
aagagttgggcatgatctacta

SEQ ID NO: 1233569 - DNA, 22 bp, Artificial Sequence
  chemically synthesized
attaaagagttgggcatgatct

SEQ ID NO: 1233570 - DNA, 22 bp, Artificial Sequence
  chemically synthesized
tcacatttagtagatcatgccc

SEQ ID NO: 1233571 - DNA, 22 bp, Artificial Sequence
  chemically synthesized
cacatttagtagatcatgccca

SEQ ID NO: 1233572 - DNA, 22 bp, Artificial Sequence
  chemically synthesized
acatttagtagatcatgcccaa

SEQ ID NO: 1233573 - DNA, 22 bp, Artificial Sequence
  chemically synthesized
agtagatcatgcccaactcttt

SEQ ID NO: 1233574 - DNA, 22 bp, Artificial Sequence
  chemically synthesized
aggcaactaattaaagagttgg

SEQ ID NO: 1233575 - DNA, 22 bp, Artificial Sequence
  chemically synthesized
gtagatcatgcccaactcttta

SEQ ID NO: 1233576 - DNA, 22 bp, Artificial Sequence
  chemically synthesized
gaaatataattcaggcaactaa

SEQ ID NO: 1233577 - DNA, 22 bp, Artificial Sequence
  chemically synthesized
tggaaatataattcaggcaact

SEQ ID NO: 1233578 - DNA, 22 bp, Artificial Sequence
  chemically synthesized
ctggaaatataattcaggcaac

SEQ ID NO: 1233579 - DNA, 22 bp, Artificial Sequence
  chemically synthesized
tttaattagttgcctgaattat

SEQ ID NO: 1233580 - DNA, 22 bp, Artificial Sequence
  chemically synthesized
acttctggaaatataattcagg

SEQ ID NO: 1233581 - DNA, 22 bp, Artificial Sequence
  chemically synthesized
taattagttgcctgaattatat

SEQ ID NO: 1233582 - DNA, 22 bp, Artificial Sequence
  chemically synthesized
aattagttgcctgaattatatt

SEQ ID NO: 1233583 - DNA, 22 bp, Artificial Sequence
  chemically synthesized
attagttgcctgaattatattt

SEQ ID NO: 1233584 - DNA, 22 bp, Artificial Sequence
  chemically synthesized
acaattaacttctggaaatata

SEQ ID NO: 1233585 - DNA, 22 bp, Artificial Sequence
  chemically synthesized
gttgcctgaattatatttccag

SEQ ID NO: 1233586 - DNA, 22 bp, Artificial Sequence
  chemically synthesized
cctgaattatatttccagaagt

SEQ ID NO: 1233587 - DNA, 22 bp, Artificial Sequence
  chemically synthesized
gaaatctcacaattaacttctg

SEQ ID NO: 1233588 - DNA, 22 bp, Artificial Sequence
  chemically synthesized
aattatatttccagaagttaat

SEQ ID NO: 1233589 - DNA, 22 bp, Artificial Sequence
  chemically synthesized
tatttccagaagttaattgtga

SEQ ID NO: 1233590 - DNA, 22 bp, Artificial Sequence
  chemically synthesized
ccagaagttaattgtgagattt

SEQ ID NO: 1233591 - DNA, 22 bp, Artificial Sequence
  chemically synthesized
cagaagttaattgtgagatttc

SEQ ID NO: 1233592 - DNA, 22 bp, Artificial Sequence
  chemically synthesized
atgaggacatggatcaactgga

SEQ ID NO: 1233593 - DNA, 22 bp, Artificial Sequence
  chemically synthesized
attgtgagatttccagttgatc

SEQ ID NO: 1233594 - DNA, 22 bp, Artificial Sequence
  chemically synthesized
tgagatttccagttgatccatg

SEQ ID NO: 1233595 - DNA, 22 bp, Artificial Sequence
  chemically synthesized
ccagttgatccatgtcctcatc

SEQ ID NO: 1233596 - DNA, 22 bp, Artificial Sequence
  chemically synthesized
atgccaaatgttgatgaggaca

SEQ ID NO: 1233597 - DNA, 22 bp, Artificial Sequence
  chemically synthesized
cagttgatccatgtcctcatca

SEQ ID NO: 1233598 - DNA, 22 bp, Artificial Sequence
  chemically synthesized
ctaatgccaaatgttgatgagg

SEQ ID NO: 1233599 - DNA, 22 bp, Artificial Sequence
  chemically synthesized
atccatgtcctcatcaacattt

SEQ ID NO: 1233600 - DNA, 22 bp, Artificial Sequence
  chemically synthesized
gactactaatgccaaatgttga

SEQ ID NO: 1233601 - DNA, 22 bp, Artificial Sequence
  chemically synthesized
aactagactactaatgccaaat

SEQ ID NO: 1233602 - DNA, 22 bp, Artificial Sequence
  chemically synthesized
atcaacatttggcattagtagt

SEQ ID NO: 1233603 - DNA, 22 bp, Artificial Sequence
  chemically synthesized
ccaaaatgactgaactagacta

SEQ ID NO: 1233604 - DNA, 22 bp, Artificial Sequence
  chemically synthesized
ggcattagtagtctagttcagt

SEQ ID NO: 1233605 - DNA, 22 bp, Artificial Sequence
  chemically synthesized
gcattagtagtctagttcagtc

SEQ ID NO: 1233606 - DNA, 22 bp, Artificial Sequence
  chemically synthesized
gtagtctagttcagtcattttg

SEQ ID NO: 1233607 - DNA, 22 bp, Artificial Sequence
  chemically synthesized
gttcagtcattttggtaatttt

SEQ ID NO: 1233608 - DNA, 22 bp, Artificial Sequence
  chemically synthesized
agtcattttggtaattttgtac

SEQ ID NO: 1233609 - DNA, 22 bp, Artificial Sequence
  chemically synthesized
taatgagataccagtacaaaat

SEQ ID NO: 1233610 - DNA, 22 bp, Artificial Sequence
  chemically synthesized
gagctgtaatgagataccagta

SEQ ID NO: 1233611 - DNA, 22 bp, Artificial Sequence
  chemically synthesized
tggtaattttgtactggtatct

SEQ ID NO: 1233612 - DNA, 22 bp, Artificial Sequence
  chemically synthesized
ggtaattttgtactggtatctc

SEQ ID NO: 1233613 - DNA, 22 bp, Artificial Sequence
  chemically synthesized
gtaattttgtactggtatctca

SEQ ID NO: 1233614 - DNA, 22 bp, Artificial Sequence
  chemically synthesized
aattagagctgtaatgagatac

SEQ ID NO: 1233615 - DNA, 22 bp, Artificial Sequence
  chemically synthesized
aaattagagctgtaatgagata

SEQ ID NO: 1233616 - DNA, 22 bp, Artificial Sequence
  chemically synthesized
tgtactggtatctcattacagc

SEQ ID NO: 1233617 - DNA, 22 bp, Artificial Sequence
  chemically synthesized
gtactggtatctcattacagct

SEQ ID NO: 1233618 - DNA, 22 bp, Artificial Sequence
  chemically synthesized
tactggtatctcattacagctc

SEQ ID NO: 1233619 - DNA, 22 bp, Artificial Sequence
  chemically synthesized
aggaaatttaaattagagctgt

SEQ ID NO: 1233620 - DNA, 22 bp, Artificial Sequence
  chemically synthesized
gaggaaatttaaattagagctg

SEQ ID NO: 1233621 - DNA, 22 bp, Artificial Sequence
  chemically synthesized
gtatctcattacagctctaatt

SEQ ID NO: 1233622 - DNA, 22 bp, Artificial Sequence
  chemically synthesized
attacagctctaatttaaattt

SEQ ID NO: 1233623 - DNA, 22 bp, Artificial Sequence
  chemically synthesized
agcagtaacttgaggaaattta

SEQ ID NO: 1233624 - DNA, 22 bp, Artificial Sequence
  chemically synthesized
cagctctaatttaaatttcctc

SEQ ID NO: 1233625 - DNA, 22 bp, Artificial Sequence
  chemically synthesized
acctcagcagtaacttgaggaa

SEQ ID NO: 1233626 - DNA, 22 bp, Artificial Sequence
  chemically synthesized
aacctcagcagtaacttgagga

SEQ ID NO: 1233627 - DNA, 22 bp, Artificial Sequence
  chemically synthesized
taatttaaatttcctcaagtta

SEQ ID NO: 1233628 - DNA, 22 bp, Artificial Sequence
  chemically synthesized
atttaaatttcctcaagttact

SEQ ID NO: 1233629 - DNA, 22 bp, Artificial Sequence
  chemically synthesized
aaatttcctcaagttactgctg

SEQ ID NO: 1233630 - DNA, 22 bp, Artificial Sequence
  chemically synthesized
aatttcctcaagttactgctga

SEQ ID NO: 1233631 - DNA, 22 bp, Artificial Sequence
  chemically synthesized
agaaatgtttaacctcagcagt

SEQ ID NO: 1233632 - DNA, 22 bp, Artificial Sequence
  chemically synthesized
aagaaatgtttaacctcagcag

SEQ ID NO: 1233633 - DNA, 22 bp, Artificial Sequence
  chemically synthesized
cctcaagttactgctgaggtta

SEQ ID NO: 1233634 - DNA, 22 bp, Artificial Sequence
  chemically synthesized
ctcaagttactgctgaggttaa

SEQ ID NO: 1233635 - DNA, 22 bp, Artificial Sequence
  chemically synthesized
aagttactgctgaggttaaaca

SEQ ID NO: 1233636 - DNA, 22 bp, Artificial Sequence
  chemically synthesized
ctgctgaggttaaacatttctt

SEQ ID NO: 1233637 - DNA, 22 bp, Artificial Sequence
  chemically synthesized
aagaatcatatttaagaaatgt

SEQ ID NO: 1233638 - DNA, 22 bp, Artificial Sequence
  chemically synthesized
ctgaggttaaacatttcttaaa

SEQ ID NO: 1233639 - DNA, 22 bp, Artificial Sequence
  chemically synthesized
aggttaaacatttcttaaatat

SEQ ID NO: 1233640 - DNA, 22 bp, Artificial Sequence
  chemically synthesized
acaaattcaagaatcatattta

SEQ ID NO: 1233641 - DNA, 22 bp, Artificial Sequence
  chemically synthesized
aacatttcttaaatatgattct

SEQ ID NO: 1233642 - DNA, 22 bp, Artificial Sequence
  chemically synthesized
cttaaatatgattcttgaattt

SEQ ID NO: 1233643 - DNA, 22 bp, Artificial Sequence
  chemically synthesized
ttaaatatgattcttgaatttg

SEQ ID NO: 1233644 - DNA, 22 bp, Artificial Sequence
  chemically synthesized
aaatatgattcttgaatttgtg

SEQ ID NO: 1233645 - DNA, 22 bp, Artificial Sequence
  chemically synthesized
aatatgattcttgaatttgtga

SEQ ID NO: 1233646 - DNA, 22 bp, Artificial Sequence
  chemically synthesized
aacaggaacacaaaaggtgttc

SEQ ID NO: 1233647 - DNA, 22 bp, Artificial Sequence
  chemically synthesized
ttgaatttgtgaacaccttttg

SEQ ID NO: 1233648 - DNA, 22 bp, Artificial Sequence
  chemically synthesized
gaatttgtgaacaccttttgtg

SEQ ID NO: 1233649 - DNA, 22 bp, Artificial Sequence
  chemically synthesized
aatttgtgaacaccttttgtgt

SEQ ID NO: 1233650 - DNA, 22 bp, Artificial Sequence
  chemically synthesized
aaattgaacaggaacacaaaag

SEQ ID NO: 1233651 - DNA, 22 bp, Artificial Sequence
  chemically synthesized
gtgaacaccttttgtgttcctg

SEQ ID NO: 1233652 - DNA, 22 bp, Artificial Sequence
  chemically synthesized
tgaacaccttttgtgttcctgt

SEQ ID NO: 1233653 - DNA, 22 bp, Artificial Sequence
  chemically synthesized
gaatgagaaactgaaattgaac

SEQ ID NO: 1233654 - DNA, 22 bp, Artificial Sequence
  chemically synthesized
ttgtgttcctgttcaatttcag

SEQ ID NO: 1233655 - DNA, 22 bp, Artificial Sequence
  chemically synthesized
tagaatgagaaactgaaattga

SEQ ID NO: 1233656 - DNA, 22 bp, Artificial Sequence
  chemically synthesized
tgtgttcctgttcaatttcagt

SEQ ID NO: 1233657 - DNA, 22 bp, Artificial Sequence
  chemically synthesized
ctagaatgagaaactgaaattg

SEQ ID NO: 1233658 - DNA, 22 bp, Artificial Sequence
  chemically synthesized
gtgttcctgttcaatttcagtt

SEQ ID NO: 1233659 - DNA, 22 bp, Artificial Sequence
  chemically synthesized
tctagaatgagaaactgaaatt

SEQ ID NO: 1233660 - DNA, 22 bp, Artificial Sequence
  chemically synthesized
tgttcctgttcaatttcagttt

SEQ ID NO: 1233661 - DNA, 22 bp, Artificial Sequence
  chemically synthesized
ggttttctagaatgagaaactg

SEQ ID NO: 1233662 - DNA, 22 bp, Artificial Sequence
  chemically synthesized
ctgttcaatttcagtttctcat

SEQ ID NO: 1233663 - DNA, 22 bp, Artificial Sequence
  chemically synthesized
aggttttctagaatgagaaact

SEQ ID NO: 1233664 - DNA, 22 bp, Artificial Sequence
  chemically synthesized
taggttttctagaatgagaaac

SEQ ID NO: 1233665 - DNA, 22 bp, Artificial Sequence
  chemically synthesized
ttcaatttcagtttctcattct

SEQ ID NO: 1233666 - DNA, 22 bp, Artificial Sequence
  chemically synthesized
aatttcagtttctcattctaga

SEQ ID NO: 1233667 - DNA, 22 bp, Artificial Sequence
  chemically synthesized
aattttaggttttctagaatga

SEQ ID NO: 1233668 - DNA, 22 bp, Artificial Sequence
  chemically synthesized
aaattttaggttttctagaatg

SEQ ID NO: 1233669 - DNA, 22 bp, Artificial Sequence
  chemically synthesized
taaattttaggttttctagaat

SEQ ID NO: 1233670 - DNA, 22 bp, Artificial Sequence
  chemically synthesized
ttaaattttaggttttctagaa

SEQ ID NO: 1233671 - DNA, 22 bp, Artificial Sequence
  chemically synthesized
tttaaattttaggttttctaga

SEQ ID NO: 1233672 - DNA, 22 bp, Artificial Sequence
  chemically synthesized
cagtttctcattctagaaaacc

SEQ ID NO: 1233673 - DNA, 22 bp, Artificial Sequence
  chemically synthesized
ttttaaattttaggttttctag

SEQ ID NO: 1233674 - DNA, 22 bp, Artificial Sequence
  chemically synthesized
agtttctcattctagaaaacct

SEQ ID NO: 1233675 - DNA, 22 bp, Artificial Sequence
  chemically synthesized
tttttaaattttaggttttcta

SEQ ID NO: 1233676 - DNA, 22 bp, Artificial Sequence
  chemically synthesized
ttttttaaattttaggttttct

SEQ ID NO: 1233677 - DNA, 22 bp, Artificial Sequence
  chemically synthesized
tttttttaaattttaggttttc

SEQ ID NO: 1233678 - DNA, 22 bp, Artificial Sequence
  chemically synthesized
ctcattctagaaaacctaaaat

SEQ ID NO: 1233679 - DNA, 22 bp, Artificial Sequence
  chemically synthesized
tcattctagaaaacctaaaatt

SEQ ID NO: 1233680 - DNA, 22 bp, Artificial Sequence
  chemically synthesized
attttttttttaaattttaggt

SEQ ID NO: 1233681 - DNA, 22 bp, Artificial Sequence
  chemically synthesized
gattttttttttaaattttagg

SEQ ID NO: 1233682 - DNA, 22 bp, Artificial Sequence
  chemically synthesized
attctagaaaacctaaaattta

SEQ ID NO: 1233683 - DNA, 22 bp, Artificial Sequence
  chemically synthesized
ttgattttttttttaaatttta

SEQ ID NO: 1233684 - DNA, 22 bp, Artificial Sequence
  chemically synthesized
cttgattttttttttaaatttt

SEQ ID NO: 1233685 - DNA, 22 bp, Artificial Sequence
  chemically synthesized
tcttgattttttttttaaattt

SEQ ID NO: 1233686 - DNA, 22 bp, Artificial Sequence
  chemically synthesized
tagaaaacctaaaatttaaaaa

SEQ ID NO: 1233687 - DNA, 22 bp, Artificial Sequence
  chemically synthesized
ttcttgattttttttttaaatt

SEQ ID NO: 1233688 - DNA, 22 bp, Artificial Sequence
  chemically synthesized
gaaaacctaaaatttaaaaaaa

SEQ ID NO: 1233689 - DNA, 22 bp, Artificial Sequence
  chemically synthesized
tttttcttgattttttttttaa

SEQ ID NO: 1233690 - DNA, 22 bp, Artificial Sequence
  chemically synthesized
tgtttttcttgatttttttttt

SEQ ID NO: 1233691 - DNA, 22 bp, Artificial Sequence
  chemically synthesized
ctgtttttcttgattttttttt

SEQ ID NO: 1233692 - DNA, 22 bp, Artificial Sequence
  chemically synthesized
aaatttaaaaaaaaaatcaaga

SEQ ID NO: 1233693 - DNA, 22 bp, Artificial Sequence
  chemically synthesized
aaaaaaaaaatcaagaaaaaca

SEQ ID NO: 1233694 - DNA, 22 bp, Artificial Sequence
  chemically synthesized
aaaaaaaaatcaagaaaaacag

SEQ ID NO: 1233695 - DNA, 22 bp, Artificial Sequence
  chemically synthesized
catatggagtatcccagtcttc

SEQ ID NO: 1233696 - DNA, 22 bp, Artificial Sequence
  chemically synthesized
acatatggagtatcccagtctt

SEQ ID NO: 1233697 - DNA, 22 bp, Artificial Sequence
  chemically synthesized
acacatttacatatggagtatc

SEQ ID NO: 1233698 - DNA, 22 bp, Artificial Sequence
  chemically synthesized
ggatactccatatgtaaatgtg

SEQ ID NO: 1233699 - DNA, 22 bp, Artificial Sequence
  chemically synthesized
tagagaataactgacacattta

SEQ ID NO: 1233700 - DNA, 22 bp, Artificial Sequence
  chemically synthesized
catatgtaaatgtgtcagttat

SEQ ID NO: 1233701 - DNA, 22 bp, Artificial Sequence
  chemically synthesized
aatctatagagaataactgaca

SEQ ID NO: 1233702 - DNA, 22 bp, Artificial Sequence
  chemically synthesized
agttaaatctatagagaataac

SEQ ID NO: 1233703 - DNA, 22 bp, Artificial Sequence
  chemically synthesized
acattgagttaaatctatagag

SEQ ID NO: 1233704 - DNA, 22 bp, Artificial Sequence
  chemically synthesized
ttctctatagatttaactcaat

SEQ ID NO: 1233705 - DNA, 22 bp, Artificial Sequence
  chemically synthesized
agtatgattaacattgagttaa

SEQ ID NO: 1233706 - DNA, 22 bp, Artificial Sequence
  chemically synthesized
aagtatgattaacattgagtta

SEQ ID NO: 1233707 - DNA, 22 bp, Artificial Sequence
  chemically synthesized
taagtatgattaacattgagtt

SEQ ID NO: 1233708 - DNA, 22 bp, Artificial Sequence
  chemically synthesized
tctatagatttaactcaatgtt

SEQ ID NO: 1233709 - DNA, 22 bp, Artificial Sequence
  chemically synthesized
tatagatttaactcaatgttaa

SEQ ID NO: 1233710 - DNA, 22 bp, Artificial Sequence
  chemically synthesized
attttaagtatgattaacattg

SEQ ID NO: 1233711 - DNA, 22 bp, Artificial Sequence
  chemically synthesized
tagatttaactcaatgttaatc

SEQ ID NO: 1233712 - DNA, 22 bp, Artificial Sequence
  chemically synthesized
aactcaatgttaatcatactta

SEQ ID NO: 1233713 - DNA, 22 bp, Artificial Sequence
  chemically synthesized
actcaatgttaatcatacttaa

SEQ ID NO: 1233714 - DNA, 22 bp, Artificial Sequence
  chemically synthesized
catgtacattcattttaagtat

SEQ ID NO: 1233715 - DNA, 22 bp, Artificial Sequence
  chemically synthesized
acatgtacattcattttaagta

SEQ ID NO: 1233716 - DNA, 22 bp, Artificial Sequence
  chemically synthesized
aatgttaatcatacttaaaatg

SEQ ID NO: 1233717 - DNA, 22 bp, Artificial Sequence
  chemically synthesized
catttacatgtacattcatttt

SEQ ID NO: 1233718 - DNA, 22 bp, Artificial Sequence
  chemically synthesized
ccatttacatgtacattcattt

SEQ ID NO: 1233719 - DNA, 22 bp, Artificial Sequence
  chemically synthesized
tccatttacatgtacattcatt

SEQ ID NO: 1233720 - DNA, 22 bp, Artificial Sequence
  chemically synthesized
atcatacttaaaatgaatgtac

SEQ ID NO: 1233721 - DNA, 22 bp, Artificial Sequence
  chemically synthesized
ttccatttacatgtacattcat

SEQ ID NO: 1233722 - DNA, 22 bp, Artificial Sequence
  chemically synthesized
taatcttttccatttacatgta

SEQ ID NO: 1233723 - DNA, 22 bp, Artificial Sequence
  chemically synthesized
gtaatcttttccatttacatgt

SEQ ID NO: 1233724 - DNA, 22 bp, Artificial Sequence
  chemically synthesized
aaaatgaatgtacatgtaaatg

SEQ ID NO: 1233725 - DNA, 22 bp, Artificial Sequence
  chemically synthesized
tgtaatcttttccatttacatg

SEQ ID NO: 1233726 - DNA, 22 bp, Artificial Sequence
  chemically synthesized
aaatgaatgtacatgtaaatgg

SEQ ID NO: 1233727 - DNA, 22 bp, Artificial Sequence
  chemically synthesized
ttttgtaatcttttccatttac

SEQ ID NO: 1233728 - DNA, 22 bp, Artificial Sequence
  chemically synthesized
gttttgtaatcttttccattta

SEQ ID NO: 1233729 - DNA, 22 bp, Artificial Sequence
  chemically synthesized
tatttgttttgtaatcttttcc

SEQ ID NO: 1233730 - DNA, 22 bp, Artificial Sequence
  chemically synthesized
gtatttgttttgtaatcttttc

SEQ ID NO: 1233731 - DNA, 22 bp, Artificial Sequence
  chemically synthesized
tgtatttgttttgtaatctttt

SEQ ID NO: 1233732 - DNA, 22 bp, Artificial Sequence
  chemically synthesized
ttgtatttgttttgtaatcttt

SEQ ID NO: 1233733 - DNA, 22 bp, Artificial Sequence
  chemically synthesized
tttttgtatttgttttgtaatc

SEQ ID NO: 1233734 - DNA, 22 bp, Artificial Sequence
  chemically synthesized
tatttttgtatttgttttgtaa

SEQ ID NO: 1233735 - DNA, 22 bp, Artificial Sequence
  chemically synthesized
ctatttttgtatttgttttgta

SEQ ID NO: 1233736 - DNA, 22 bp, Artificial Sequence
  chemically synthesized
tctatttttgtatttgttttgt

SEQ ID NO: 1233737 - DNA, 22 bp, Artificial Sequence
  chemically synthesized
gccctttctatttttgtatttg

SEQ ID NO: 1233738 - DNA, 22 bp, Artificial Sequence
  chemically synthesized
ttggccctttctatttttgtat

SEQ ID NO: 1233739 - DNA, 22 bp, Artificial Sequence
  chemically synthesized
caaaacaaatacaaaaatagaa

SEQ ID NO: 1233740 - DNA, 22 bp, Artificial Sequence
  chemically synthesized
gttattggccctttctattttt

SEQ ID NO: 1233741 - DNA, 22 bp, Artificial Sequence
  chemically synthesized
ttggttattggccctttctatt

SEQ ID NO: 1233742 - DNA, 22 bp, Artificial Sequence
  chemically synthesized
attggttattggccctttctat

SEQ ID NO: 1233743 - DNA, 22 bp, Artificial Sequence
  chemically synthesized
tattggttattggccctttcta

SEQ ID NO: 1233744 - DNA, 22 bp, Artificial Sequence
  chemically synthesized
gagattttattggttattggcc

SEQ ID NO: 1233745 - DNA, 22 bp, Artificial Sequence
  chemically synthesized
ttcgagattttattggttattg

SEQ ID NO: 1233746 - DNA, 22 bp, Artificial Sequence
  chemically synthesized
gttcgagattttattggttatt

SEQ ID NO: 1233747 - DNA, 22 bp, Artificial Sequence
  chemically synthesized
tgttcgagattttattggttat

SEQ ID NO: 1233748 - DNA, 22 bp, Artificial Sequence
  chemically synthesized
ccactttgttcgagattttatt

SEQ ID NO: 1233749 - DNA, 22 bp, Artificial Sequence
  chemically synthesized
tcccactttgttcgagatttta

SEQ ID NO: 1233750 - DNA, 22 bp, Artificial Sequence
  chemically synthesized
ggttctcccactttgttcgaga

SEQ ID NO: 1233751 - DNA, 22 bp, Artificial Sequence
  chemically synthesized
gtgaactaggttctcccacttt

SEQ ID NO: 1233752 - DNA, 22 bp, Artificial Sequence
  chemically synthesized
gtatctggtgaactaggttctc

SEQ ID NO: 1233753 - DNA, 22 bp, Artificial Sequence
  chemically synthesized
gaacaaagtgggagaacctagt

SEQ ID NO: 1233754 - DNA, 22 bp, Artificial Sequence
  chemically synthesized
taatacagcctagtatctggtg

SEQ ID NO: 1233755 - DNA, 22 bp, Artificial Sequence
  chemically synthesized
ataatacagcctagtatctggt

SEQ ID NO: 1233756 - DNA, 22 bp, Artificial Sequence
  chemically synthesized
tataatacagcctagtatctgg

SEQ ID NO: 1233757 - DNA, 22 bp, Artificial Sequence
  chemically synthesized
gttcaccagatactaggctgta

SEQ ID NO: 1233758 - DNA, 22 bp, Artificial Sequence
  chemically synthesized
accagatactaggctgtattat

SEQ ID NO: 1233759 - DNA, 22 bp, Artificial Sequence
  chemically synthesized
ggctgtattataaaactacatt

SEQ ID NO: 1233760 - DNA, 22 bp, Artificial Sequence
  chemically synthesized
tattataaaactacattactcc

SEQ ID NO: 1233761 - DNA, 22 bp, Artificial Sequence
  chemically synthesized
taaaactacattactccacatt

SEQ ID NO: 1233762 - DNA, 22 bp, Artificial Sequence
  chemically synthesized
cacacacaaatatcatgtaatg

SEQ ID NO: 1233763 - DNA, 22 bp, Artificial Sequence
  chemically synthesized
cattactccacattacatgata

SEQ ID NO: 1233764 - DNA, 22 bp, Artificial Sequence
  chemically synthesized
tacacacacaaatatcatgtaa

SEQ ID NO: 1233765 - DNA, 22 bp, Artificial Sequence
  chemically synthesized
tctacacacacaaatatcatgt

SEQ ID NO: 1233766 - DNA, 22 bp, Artificial Sequence
  chemically synthesized
tctctacacacacaaatatcat

SEQ ID NO: 1233767 - DNA, 22 bp, Artificial Sequence
  chemically synthesized
ctccacattacatgatatttgt

SEQ ID NO: 1233768 - DNA, 22 bp, Artificial Sequence
  chemically synthesized
tctctctacacacacaaatatc

SEQ ID NO: 1233769 - DNA, 22 bp, Artificial Sequence
  chemically synthesized
cacattacatgatatttgtgtg

SEQ ID NO: 1233770 - DNA, 22 bp, Artificial Sequence
  chemically synthesized
tctctctctacacacacaaata

SEQ ID NO: 1233771 - DNA, 22 bp, Artificial Sequence
  chemically synthesized
tctctctctctacacacacaaa

SEQ ID NO: 1233772 - DNA, 22 bp, Artificial Sequence
  chemically synthesized
ttctctctctctctacacacac

SEQ ID NO: 1233773 - DNA, 22 bp, Artificial Sequence
  chemically synthesized
catgatatttgtgtgtgtagag

SEQ ID NO: 1233774 - DNA, 22 bp, Artificial Sequence
  chemically synthesized
cattgttctctctctctctaca

SEQ ID NO: 1233775 - DNA, 22 bp, Artificial Sequence
  chemically synthesized
gcattgttctctctctctctac

SEQ ID NO: 1233776 - DNA, 22 bp, Artificial Sequence
  chemically synthesized
ttgcattgttctctctctctct

SEQ ID NO: 1233777 - DNA, 22 bp, Artificial Sequence
  chemically synthesized
tcttgcattgttctctctctct

SEQ ID NO: 1233778 - DNA, 22 bp, Artificial Sequence
  chemically synthesized
gtgtgtgtagagagagagagaa

SEQ ID NO: 1233779 - DNA, 22 bp, Artificial Sequence
  chemically synthesized
tgtgtgtagagagagagagaac

SEQ ID NO: 1233780 - DNA, 22 bp, Artificial Sequence
  chemically synthesized
aattctcttgcattgttctctc

SEQ ID NO: 1233781 - DNA, 22 bp, Artificial Sequence
  chemically synthesized
caattctcttgcattgttctct

SEQ ID NO: 1233782 - DNA, 22 bp, Artificial Sequence
  chemically synthesized
cacttcaattctcttgcattgt

SEQ ID NO: 1233783 - DNA, 22 bp, Artificial Sequence
  chemically synthesized
gcacttcaattctcttgcattg

SEQ ID NO: 1233784 - DNA, 22 bp, Artificial Sequence
  chemically synthesized
tgcacttcaattctcttgcatt

SEQ ID NO: 1233785 - DNA, 22 bp, Artificial Sequence
  chemically synthesized
ttgcacttcaattctcttgcat

SEQ ID NO: 1233786 - DNA, 22 bp, Artificial Sequence
  chemically synthesized
tttttgcacttcaattctcttg

SEQ ID NO: 1233787 - DNA, 22 bp, Artificial Sequence
  chemically synthesized
tccgtacatatgtgggtctgtt

SEQ ID NO: 1233788 - DNA, 22 bp, Artificial Sequence
  chemically synthesized
gtccgtacatatgtgggtctgt

SEQ ID NO: 1233789 - DNA, 22 bp, Artificial Sequence
  chemically synthesized
aagtgcaaaaacagacccacat

SEQ ID NO: 1233790 - DNA, 22 bp, Artificial Sequence
  chemically synthesized
aaaatttgtccgtacatatgtg

SEQ ID NO: 1233791 - DNA, 22 bp, Artificial Sequence
  chemically synthesized
agtgtgtcattaaaaatttgtc

SEQ ID NO: 1233792 - DNA, 22 bp, Artificial Sequence
  chemically synthesized
acagtactaagtgtgtcattaa

SEQ ID NO: 1233793 - DNA, 22 bp, Artificial Sequence
  chemically synthesized
cacagtactaagtgtgtcatta

SEQ ID NO: 1233794 - DNA, 22 bp, Artificial Sequence
  chemically synthesized
cttcacagtactaagtgtgtca

SEQ ID NO: 1233795 - DNA, 22 bp, Artificial Sequence
  chemically synthesized
attgcttcacagtactaagtgt

SEQ ID NO: 1233796 - DNA, 22 bp, Artificial Sequence
  chemically synthesized
ctcattgcttcacagtactaag

SEQ ID NO: 1233797 - DNA, 22 bp, Artificial Sequence
  chemically synthesized
ttaatgacacacttagtactgt

SEQ ID NO: 1233798 - DNA, 22 bp, Artificial Sequence
  chemically synthesized
cctcattgcttcacagtactaa

SEQ ID NO: 1233799 - DNA, 22 bp, Artificial Sequence
  chemically synthesized
taatgacacacttagtactgtg

SEQ ID NO: 1233800 - DNA, 22 bp, Artificial Sequence
  chemically synthesized
aatgacacacttagtactgtga

SEQ ID NO: 1233801 - DNA, 22 bp, Artificial Sequence
  chemically synthesized
atgacacacttagtactgtgaa

SEQ ID NO: 1233802 - DNA, 22 bp, Artificial Sequence
  chemically synthesized
aaaataatgcttcctcattgct

SEQ ID NO: 1233803 - DNA, 22 bp, Artificial Sequence
  chemically synthesized
agtactgtgaagcaatgaggaa

SEQ ID NO: 1233804 - DNA, 22 bp, Artificial Sequence
  chemically synthesized
gtactgtgaagcaatgaggaag

SEQ ID NO: 1233805 - DNA, 22 bp, Artificial Sequence
  chemically synthesized
ttaaaaataatgcttcctcatt

SEQ ID NO: 1233806 - DNA, 22 bp, Artificial Sequence
  chemically synthesized
attaaaaataatgcttcctcat

SEQ ID NO: 1233807 - DNA, 22 bp, Artificial Sequence
  chemically synthesized
tgaagcaatgaggaagcattat

SEQ ID NO: 1233808 - DNA, 22 bp, Artificial Sequence
  chemically synthesized
acacaccatttattaaaaataa

SEQ ID NO: 1233809 - DNA, 22 bp, Artificial Sequence
  chemically synthesized
attaacacaccatttattaaaa

SEQ ID NO: 1233810 - DNA, 22 bp, Artificial Sequence
  chemically synthesized
aagtctaattaacacaccattt

SEQ ID NO: 1233811 - DNA, 22 bp, Artificial Sequence
  chemically synthesized
gaagtctaattaacacaccatt

SEQ ID NO: 1233812 - DNA, 22 bp, Artificial Sequence
  chemically synthesized
tttttaataaatggtgtgttaa

SEQ ID NO: 1233813 - DNA, 22 bp, Artificial Sequence
  chemically synthesized
tttgaagtctaattaacacacc

SEQ ID NO: 1233814 - DNA, 22 bp, Artificial Sequence
  chemically synthesized
atttgaagtctaattaacacac

SEQ ID NO: 1233815 - DNA, 22 bp, Artificial Sequence
  chemically synthesized
tatttgaagtctaattaacaca

SEQ ID NO: 1233816 - DNA, 22 bp, Artificial Sequence
  chemically synthesized
ttaataaatggtgtgttaatta

SEQ ID NO: 1233817 - DNA, 22 bp, Artificial Sequence
  chemically synthesized
taataaatggtgtgttaattag

SEQ ID NO: 1233818 - DNA, 22 bp, Artificial Sequence
  chemically synthesized
aataaatggtgtgttaattaga

SEQ ID NO: 1233819 - DNA, 22 bp, Artificial Sequence
  chemically synthesized
ttttatttgaagtctaattaac

SEQ ID NO: 1233820 - DNA, 22 bp, Artificial Sequence
  chemically synthesized
ataaatggtgtgttaattagac

SEQ ID NO: 1233821 - DNA, 22 bp, Artificial Sequence
  chemically synthesized
attttatttgaagtctaattaa

SEQ ID NO: 1233822 - DNA, 22 bp, Artificial Sequence
  chemically synthesized
agtatttattttatttgaagtc

SEQ ID NO: 1233823 - DNA, 22 bp, Artificial Sequence
  chemically synthesized
agactcagtatttattttattt

SEQ ID NO: 1233824 - DNA, 22 bp, Artificial Sequence
  chemically synthesized
attagacttcaaataaaataaa

SEQ ID NO: 1233825 - DNA, 22 bp, Artificial Sequence
  chemically synthesized
gacttcaaataaaataaatact

SEQ ID NO: 1233826 - DNA, 22 bp, Artificial Sequence
  chemically synthesized
caaataaaataaatactgagtc

SEQ ID NO: 1233827 - DNA, 22 bp, Artificial Sequence
  chemically synthesized
aaataaaataaatactgagtct

SEQ ID NO: 1233828 - DNA, 22 bp, Artificial Sequence
  chemically synthesized
catatggtgtgaggaataggtt

SEQ ID NO: 1233829 - DNA, 22 bp, Artificial Sequence
  chemically synthesized
ttgcatatggtgtgaggaatag

SEQ ID NO: 1233830 - DNA, 22 bp, Artificial Sequence
  chemically synthesized
agtcttaacctattcctcacac

SEQ ID NO: 1233831 - DNA, 22 bp, Artificial Sequence
  chemically synthesized
attattgcatatggtgtgagga

SEQ ID NO: 1233832 - DNA, 22 bp, Artificial Sequence
  chemically synthesized
aacctattcctcacaccatatg

SEQ ID NO: 1233833 - DNA, 22 bp, Artificial Sequence
  chemically synthesized
acctattcctcacaccatatgc

SEQ ID NO: 1233834 - DNA, 22 bp, Artificial Sequence
  chemically synthesized
aaattgattattgcatatggtg

SEQ ID NO: 1233835 - DNA, 22 bp, Artificial Sequence
  chemically synthesized
cctgaaattgattattgcatat

SEQ ID NO: 1233836 - DNA, 22 bp, Artificial Sequence
  chemically synthesized
ttcctcacaccatatgcaataa

SEQ ID NO: 1233837 - DNA, 22 bp, Artificial Sequence
  chemically synthesized
acctgaaattgattattgcata

SEQ ID NO: 1233838 - DNA, 22 bp, Artificial Sequence
  chemically synthesized
tacctgaaattgattattgcat

SEQ ID NO: 1233839 - DNA, 22 bp, Artificial Sequence
  chemically synthesized
ctcacaccatatgcaataatca

SEQ ID NO: 1233840 - DNA, 22 bp, Artificial Sequence
  chemically synthesized
ttttacctgaaattgattattg

SEQ ID NO: 1233841 - DNA, 22 bp, Artificial Sequence
  chemically synthesized
acaccatatgcaataatcaatt

SEQ ID NO: 1233842 - DNA, 22 bp, Artificial Sequence
  chemically synthesized
gatctgttttacctgaaattga

SEQ ID NO: 1233843 - DNA, 22 bp, Artificial Sequence
  chemically synthesized
ggatctgttttacctgaaattg

SEQ ID NO: 1233844 - DNA, 22 bp, Artificial Sequence
  chemically synthesized
tggatctgttttacctgaaatt

SEQ ID NO: 1233845 - DNA, 22 bp, Artificial Sequence
  chemically synthesized
ttggatctgttttacctgaaat

SEQ ID NO: 1233846 - DNA, 22 bp, Artificial Sequence
  chemically synthesized
tttttggatctgttttacctga

SEQ ID NO: 1233847 - DNA, 22 bp, Artificial Sequence
  chemically synthesized
gtttttggatctgttttacctg

SEQ ID NO: 1233848 - DNA, 22 bp, Artificial Sequence
  chemically synthesized
tgtttttggatctgttttacct

SEQ ID NO: 1233849 - DNA, 22 bp, Artificial Sequence
  chemically synthesized
ccattttgtttttggatctgtt

SEQ ID NO: 1233850 - DNA, 22 bp, Artificial Sequence
  chemically synthesized
accattttgtttttggatctgt

SEQ ID NO: 1233851 - DNA, 22 bp, Artificial Sequence
  chemically synthesized
taccattttgtttttggatctg

SEQ ID NO: 1233852 - DNA, 22 bp, Artificial Sequence
  chemically synthesized
caggtaaaacagatccaaaaac

SEQ ID NO: 1233853 - DNA, 22 bp, Artificial Sequence
  chemically synthesized
aggtaaaacagatccaaaaaca

SEQ ID NO: 1233854 - DNA, 22 bp, Artificial Sequence
  chemically synthesized
tcgttttaccattttgtttttg

SEQ ID NO: 1233855 - DNA, 22 bp, Artificial Sequence
  chemically synthesized
tagaaccattatcgttttacca

SEQ ID NO: 1233856 - DNA, 22 bp, Artificial Sequence
  chemically synthesized
tctatagaaccattatcgtttt

SEQ ID NO: 1233857 - DNA, 22 bp, Artificial Sequence
  chemically synthesized
ttatctatagaaccattatcgt

SEQ ID NO: 1233858 - DNA, 22 bp, Artificial Sequence
  chemically synthesized
ggttattatctatagaaccatt

SEQ ID NO: 1233859 - DNA, 22 bp, Artificial Sequence
  chemically synthesized
tattaggttattatctatagaa

SEQ ID NO: 1233860 - DNA, 22 bp, Artificial Sequence
  chemically synthesized
tgatactatattaggttattat

SEQ ID NO: 1233861 - DNA, 22 bp, Artificial Sequence
  chemically synthesized
tatagataataacctaatatag

SEQ ID NO: 1233862 - DNA, 22 bp, Artificial Sequence
  chemically synthesized
tagataataacctaatatagta

SEQ ID NO: 1233863 - DNA, 22 bp, Artificial Sequence
  chemically synthesized
cccaaagccattatgatactat

SEQ ID NO: 1233864 - DNA, 22 bp, Artificial Sequence
  chemically synthesized
gcctacccaaagccattatgat

SEQ ID NO: 1233865 - DNA, 22 bp, Artificial Sequence
  chemically synthesized
atatagtatcataatggctttg

SEQ ID NO: 1233866 - DNA, 22 bp, Artificial Sequence
  chemically synthesized
aagaaatactggcctacccaaa

SEQ ID NO: 1233867 - DNA, 22 bp, Artificial Sequence
  chemically synthesized
ttgaagaaatactggcctaccc

SEQ ID NO: 1233868 - DNA, 22 bp, Artificial Sequence
  chemically synthesized
tgacctgttgaagaaatactgg

SEQ ID NO: 1233869 - DNA, 22 bp, Artificial Sequence
  chemically synthesized
atgacctgttgaagaaatactg

SEQ ID NO: 1233870 - DNA, 22 bp, Artificial Sequence
  chemically synthesized
tatgacctgttgaagaaatact

SEQ ID NO: 1233871 - DNA, 22 bp, Artificial Sequence
  chemically synthesized
ttatgacctgttgaagaaatac

SEQ ID NO: 1233872 - DNA, 22 bp, Artificial Sequence
  chemically synthesized
tgggtaggccagtatttcttca

SEQ ID NO: 1233873 - DNA, 22 bp, Artificial Sequence
  chemically synthesized
gggtaggccagtatttcttcaa

SEQ ID NO: 1233874 - DNA, 22 bp, Artificial Sequence
  chemically synthesized
ggtaggccagtatttcttcaac

SEQ ID NO: 1233875 - DNA, 22 bp, Artificial Sequence
  chemically synthesized
tatttttatgacctgttgaaga

SEQ ID NO: 1233876 - DNA, 22 bp, Artificial Sequence
  chemically synthesized
atatttttatgacctgttgaag

SEQ ID NO: 1233877 - DNA, 22 bp, Artificial Sequence
  chemically synthesized
tatatttttatgacctgttgaa

SEQ ID NO: 1233878 - DNA, 22 bp, Artificial Sequence
  chemically synthesized
aaactttatatttttatgacct

SEQ ID NO: 1233879 - DNA, 22 bp, Artificial Sequence
  chemically synthesized
aaaactttatatttttatgacc

SEQ ID NO: 1233880 - DNA, 22 bp, Artificial Sequence
  chemically synthesized
taaaactttatatttttatgac

SEQ ID NO: 1233881 - DNA, 22 bp, Artificial Sequence
  chemically synthesized
tttaaaactttatatttttatg

SEQ ID NO: 1233882 - DNA, 22 bp, Artificial Sequence
  chemically synthesized
cttcaacaggtcataaaaatat

SEQ ID NO: 1233883 - DNA, 22 bp, Artificial Sequence
  chemically synthesized
ttcaacaggtcataaaaatata

SEQ ID NO: 1233884 - DNA, 22 bp, Artificial Sequence
  chemically synthesized
ttctttaaaactttatattttt

SEQ ID NO: 1233885 - DNA, 22 bp, Artificial Sequence
  chemically synthesized
caacaggtcataaaaatataaa

SEQ ID NO: 1233886 - DNA, 22 bp, Artificial Sequence
  chemically synthesized
attctttaaaactttatatttt

SEQ ID NO: 1233887 - DNA, 22 bp, Artificial Sequence
  chemically synthesized
aacaggtcataaaaatataaag

SEQ ID NO: 1233888 - DNA, 22 bp, Artificial Sequence
  chemically synthesized
gatatagtttattctttaaaac

SEQ ID NO: 1233889 - DNA, 22 bp, Artificial Sequence
  chemically synthesized
ggatatagtttattctttaaaa

SEQ ID NO: 1233890 - DNA, 22 bp, Artificial Sequence
  chemically synthesized
cacttggatatagtttattctt

SEQ ID NO: 1233891 - DNA, 22 bp, Artificial Sequence
  chemically synthesized
tccacttggatatagtttattc

SEQ ID NO: 1233892 - DNA, 22 bp, Artificial Sequence
  chemically synthesized
taaagaataaactatatccaag

SEQ ID NO: 1233893 - DNA, 22 bp, Artificial Sequence
  chemically synthesized
aaagaataaactatatccaagt

SEQ ID NO: 1233894 - DNA, 22 bp, Artificial Sequence
  chemically synthesized
aagaataaactatatccaagtg

SEQ ID NO: 1233895 - DNA, 22 bp, Artificial Sequence
  chemically synthesized
ataaaaacaagttctccacttg

SEQ ID NO: 1233896 - DNA, 22 bp, Artificial Sequence
  chemically synthesized
atattaataaaaacaagttctc

SEQ ID NO: 1233897 - DNA, 22 bp, Artificial Sequence
  chemically synthesized
tatccaagtggagaacttgttt

SEQ ID NO: 1233898 - DNA, 22 bp, Artificial Sequence
  chemically synthesized
aatggttaatattaataaaaac

SEQ ID NO: 1233899 - DNA, 22 bp, Artificial Sequence
  chemically synthesized
caatggttaatattaataaaaa

SEQ ID NO: 1233900 - DNA, 22 bp, Artificial Sequence
  chemically synthesized
acttcaatggttaatattaata

SEQ ID NO: 1233901 - DNA, 22 bp, Artificial Sequence
  chemically synthesized
ctcacttcaatggttaatatta

SEQ ID NO: 1233902 - DNA, 22 bp, Artificial Sequence
  chemically synthesized
actcacttcaatggttaatatt

SEQ ID NO: 1233903 - DNA, 22 bp, Artificial Sequence
  chemically synthesized
tactcacttcaatggttaatat

SEQ ID NO: 1233904 - DNA, 22 bp, Artificial Sequence
  chemically synthesized
ttactcacttcaatggttaata

SEQ ID NO: 1233905 - DNA, 22 bp, Artificial Sequence
  chemically synthesized
gtttttattaatattaaccatt

SEQ ID NO: 1233906 - DNA, 22 bp, Artificial Sequence
  chemically synthesized
tttactcacttcaatggttaat

SEQ ID NO: 1233907 - DNA, 22 bp, Artificial Sequence
  chemically synthesized
tttttattaatattaaccattg

SEQ ID NO: 1233908 - DNA, 22 bp, Artificial Sequence
  chemically synthesized
ttattaatattaaccattgaag

SEQ ID NO: 1233909 - DNA, 22 bp, Artificial Sequence
  chemically synthesized
cctttttactcacttcaatggt

SEQ ID NO: 1233910 - DNA, 22 bp, Artificial Sequence
  chemically synthesized
tattaatattaaccattgaagt

SEQ ID NO: 1233911 - DNA, 22 bp, Artificial Sequence
  chemically synthesized
attaatattaaccattgaagtg

SEQ ID NO: 1233912 - DNA, 22 bp, Artificial Sequence
  chemically synthesized
ttaatattaaccattgaagtga

SEQ ID NO: 1233913 - DNA, 22 bp, Artificial Sequence
  chemically synthesized
atattaaccattgaagtgagta

SEQ ID NO: 1233914 - DNA, 22 bp, Artificial Sequence
  chemically synthesized
tggattacctttttactcactt

SEQ ID NO: 1233915 - DNA, 22 bp, Artificial Sequence
  chemically synthesized
tgtggattacctttttactcac

SEQ ID NO: 1233916 - DNA, 22 bp, Artificial Sequence
  chemically synthesized
ctgtggattacctttttactca

SEQ ID NO: 1233917 - DNA, 22 bp, Artificial Sequence
  chemically synthesized
tctgtggattacctttttactc

SEQ ID NO: 1233918 - DNA, 22 bp, Artificial Sequence
  chemically synthesized
accattgaagtgagtaaaaagg

SEQ ID NO: 1233919 - DNA, 22 bp, Artificial Sequence
  chemically synthesized
ttctgtggattacctttttact

SEQ ID NO: 1233920 - DNA, 22 bp, Artificial Sequence
  chemically synthesized
cttttctgtggattaccttttt

SEQ ID NO: 1233921 - DNA, 22 bp, Artificial Sequence
  chemically synthesized
ccttttctgtggattacctttt

SEQ ID NO: 1233922 - DNA, 22 bp, Artificial Sequence
  chemically synthesized
tccttttctgtggattaccttt

SEQ ID NO: 1233923 - DNA, 22 bp, Artificial Sequence
  chemically synthesized
aagtgagtaaaaaggtaatcca

SEQ ID NO: 1233924 - DNA, 22 bp, Artificial Sequence
  chemically synthesized
caaatgtattttccttttctgt

SEQ ID NO: 1233925 - DNA, 22 bp, Artificial Sequence
  chemically synthesized
agttgcaaatgtattttccttt

SEQ ID NO: 1233926 - DNA, 22 bp, Artificial Sequence
  chemically synthesized
gagttgcaaatgtattttcctt

SEQ ID NO: 1233927 - DNA, 22 bp, Artificial Sequence
  chemically synthesized
tgagttgcaaatgtattttcct

SEQ ID NO: 1233928 - DNA, 22 bp, Artificial Sequence
  chemically synthesized
ttttgagttgcaaatgtatttt

SEQ ID NO: 1233929 - DNA, 22 bp, Artificial Sequence
  chemically synthesized
gttttgagttgcaaatgtattt

SEQ ID NO: 1233930 - DNA, 22 bp, Artificial Sequence
  chemically synthesized
tgttttgagttgcaaatgtatt

SEQ ID NO: 1233931 - DNA, 22 bp, Artificial Sequence
  chemically synthesized
gatatgagccctttgttttgag

SEQ ID NO: 1233932 - DNA, 22 bp, Artificial Sequence
  chemically synthesized
tggatatgagccctttgttttg

SEQ ID NO: 1233933 - DNA, 22 bp, Artificial Sequence
  chemically synthesized
tattctggatatgagccctttg

SEQ ID NO: 1233934 - DNA, 22 bp, Artificial Sequence
  chemically synthesized
gcaactcaaaacaaagggctca

SEQ ID NO: 1233935 - DNA, 22 bp, Artificial Sequence
  chemically synthesized
caactcaaaacaaagggctcat

SEQ ID NO: 1233936 - DNA, 22 bp, Artificial Sequence
  chemically synthesized
ctatattctggatatgagccct

SEQ ID NO: 1233937 - DNA, 22 bp, Artificial Sequence
  chemically synthesized
ttgctatattctggatatgagc

SEQ ID NO: 1233938 - DNA, 22 bp, Artificial Sequence
  chemically synthesized
aaaacaaagggctcatatccag

SEQ ID NO: 1233939 - DNA, 22 bp, Artificial Sequence
  chemically synthesized
agttattgctatattctggata

SEQ ID NO: 1233940 - DNA, 22 bp, Artificial Sequence
  chemically synthesized
atcaaaattgagttattgctat

SEQ ID NO: 1233941 - DNA, 22 bp, Artificial Sequence
  chemically synthesized
atatccagaatatagcaataac

SEQ ID NO: 1233942 - DNA, 22 bp, Artificial Sequence
  chemically synthesized
catcaaaattgagttattgcta

SEQ ID NO: 1233943 - DNA, 22 bp, Artificial Sequence
  chemically synthesized
gacttcatcaaaattgagttat

SEQ ID NO: 1233944 - DNA, 22 bp, Artificial Sequence
  chemically synthesized
ggacttcatcaaaattgagtta

SEQ ID NO: 1233945 - DNA, 22 bp, Artificial Sequence
  chemically synthesized
acttggacttcatcaaaattga

SEQ ID NO: 1233946 - DNA, 22 bp, Artificial Sequence
  chemically synthesized
aattttgatgaagtccaagtta

SEQ ID NO: 1233947 - DNA, 22 bp, Artificial Sequence
  chemically synthesized
aaaaagagaaaagttaacttgg

SEQ ID NO: 1233948 - DNA, 22 bp, Artificial Sequence
  chemically synthesized
caaaaagagaaaagttaacttg

SEQ ID NO: 1233949 - DNA, 22 bp, Artificial Sequence
  chemically synthesized
tgatgaagtccaagttaacttt

SEQ ID NO: 1233950 - DNA, 22 bp, Artificial Sequence
  chemically synthesized
gatgaagtccaagttaactttt

SEQ ID NO: 1233951 - DNA, 22 bp, Artificial Sequence
  chemically synthesized
atgaagtccaagttaacttttc

SEQ ID NO: 1233952 - DNA, 22 bp, Artificial Sequence
  chemically synthesized
aatccaaagcatgtttcaaaaa

SEQ ID NO: 1233953 - DNA, 22 bp, Artificial Sequence
  chemically synthesized
acttttctctttttgaaacatg

SEQ ID NO: 1233954 - DNA, 22 bp, Artificial Sequence
  chemically synthesized
ttctctttttgaaacatgcttt

SEQ ID NO: 1233955 - DNA, 22 bp, Artificial Sequence
  chemically synthesized
tctctttttgaaacatgctttg

SEQ ID NO: 1233956 - DNA, 22 bp, Artificial Sequence
  chemically synthesized
ctctttttgaaacatgctttgg

SEQ ID NO: 1233957 - DNA, 22 bp, Artificial Sequence
  chemically synthesized
tgatacctgaatccaaagcatg

SEQ ID NO: 1233958 - DNA, 22 bp, Artificial Sequence
  chemically synthesized
tctttttgaaacatgctttgga

SEQ ID NO: 1233959 - DNA, 22 bp, Artificial Sequence
  chemically synthesized
atgatacctgaatccaaagcat

SEQ ID NO: 1233960 - DNA, 22 bp, Artificial Sequence
  chemically synthesized
tttttgaaacatgctttggatt

SEQ ID NO: 1233961 - DNA, 22 bp, Artificial Sequence
  chemically synthesized
tttgaaacatgctttggattca

SEQ ID NO: 1233962 - DNA, 22 bp, Artificial Sequence
  chemically synthesized
ttgaaacatgctttggattcag

SEQ ID NO: 1233963 - DNA, 22 bp, Artificial Sequence
  chemically synthesized
tgaaacatgctttggattcagg

SEQ ID NO: 1233964 - DNA, 22 bp, Artificial Sequence
  chemically synthesized
gaaacatgctttggattcaggt

SEQ ID NO: 1233965 - DNA, 22 bp, Artificial Sequence
  chemically synthesized
aaacatgctttggattcaggta

SEQ ID NO: 1233966 - DNA, 22 bp, Artificial Sequence
  chemically synthesized
ggataggcaagtatttatgata

SEQ ID NO: 1233967 - DNA, 22 bp, Artificial Sequence
  chemically synthesized
gggataggcaagtatttatgat

SEQ ID NO: 1233968 - DNA, 22 bp, Artificial Sequence
  chemically synthesized
tggattcaggtatcataaatac

SEQ ID NO: 1233969 - DNA, 22 bp, Artificial Sequence
  chemically synthesized
tgggataggcaagtatttatga

SEQ ID NO: 1233970 - DNA, 22 bp, Artificial Sequence
  chemically synthesized
ggattcaggtatcataaatact

SEQ ID NO: 1233971 - DNA, 22 bp, Artificial Sequence
  chemically synthesized
gattcaggtatcataaatactt

SEQ ID NO: 1233972 - DNA, 22 bp, Artificial Sequence
  chemically synthesized
aggtatcataaatacttgccta

SEQ ID NO: 1233973 - DNA, 22 bp, Artificial Sequence
  chemically synthesized
tatgactttgggataggcaagt

SEQ ID NO: 1233974 - DNA, 22 bp, Artificial Sequence
  chemically synthesized
atatgactttgggataggcaag

SEQ ID NO: 1233975 - DNA, 22 bp, Artificial Sequence
  chemically synthesized
gcctatcccaaagtcatataaa

SEQ ID NO: 1233976 - DNA, 22 bp, Artificial Sequence
  chemically synthesized
cctatcccaaagtcatataaat

SEQ ID NO: 1233977 - DNA, 22 bp, Artificial Sequence
  chemically synthesized
tcccaaagtcatataaatttcc

SEQ ID NO: 1233978 - DNA, 22 bp, Artificial Sequence
  chemically synthesized
gcaataaaacatatagaaggaa

SEQ ID NO: 1233979 - DNA, 22 bp, Artificial Sequence
  chemically synthesized
ccttctatatgttttattgcca

SEQ ID NO: 1233980 - DNA, 22 bp, Artificial Sequence
  chemically synthesized
cttctatatgttttattgccag

SEQ ID NO: 1233981 - DNA, 22 bp, Artificial Sequence
  chemically synthesized
ctatatgttttattgccaggat

SEQ ID NO: 1233982 - DNA, 22 bp, Artificial Sequence
  chemically synthesized
tatatgttttattgccaggatt

SEQ ID NO: 1233983 - DNA, 22 bp, Artificial Sequence
  chemically synthesized
tatgttttattgccaggatttt

SEQ ID NO: 1233984 - DNA, 22 bp, Artificial Sequence
  chemically synthesized
caagggaaccagaaaaatcctg

SEQ ID NO: 1233985 - DNA, 22 bp, Artificial Sequence
  chemically synthesized
ctccaagggaaccagaaaaatc

SEQ ID NO: 1233986 - DNA, 22 bp, Artificial Sequence
  chemically synthesized
tattgccaggatttttctggtt

SEQ ID NO: 1233987 - DNA, 22 bp, Artificial Sequence
  chemically synthesized
attgccaggatttttctggttc

SEQ ID NO: 1233988 - DNA, 22 bp, Artificial Sequence
  chemically synthesized
cctactccaagggaaccagaaa

SEQ ID NO: 1233989 - DNA, 22 bp, Artificial Sequence
  chemically synthesized
ttgccaggatttttctggttcc

SEQ ID NO: 1233990 - DNA, 22 bp, Artificial Sequence
  chemically synthesized
ccaggatttttctggttccctt

SEQ ID NO: 1233991 - DNA, 22 bp, Artificial Sequence
  chemically synthesized
tctgcctactccaagggaacca

SEQ ID NO: 1233992 - DNA, 22 bp, Artificial Sequence
  chemically synthesized
gctatctgcctactccaaggga

SEQ ID NO: 1233993 - DNA, 22 bp, Artificial Sequence
  chemically synthesized
tggctatctgcctactccaagg

SEQ ID NO: 1233994 - DNA, 22 bp, Artificial Sequence
  chemically synthesized
ctggctatctgcctactccaag

SEQ ID NO: 1233995 - DNA, 22 bp, Artificial Sequence
  chemically synthesized
ttctggttcccttggagtaggc

SEQ ID NO: 1233996 - DNA, 22 bp, Artificial Sequence
  chemically synthesized
tctggttcccttggagtaggca

SEQ ID NO: 1233997 - DNA, 22 bp, Artificial Sequence
  chemically synthesized
ctggttcccttggagtaggcag

SEQ ID NO: 1233998 - DNA, 22 bp, Artificial Sequence
  chemically synthesized
atttctggctatctgcctactc

SEQ ID NO: 1233999 - DNA, 22 bp, Artificial Sequence
  chemically synthesized
tggttcccttggagtaggcaga

SEQ ID NO: 1234000 - DNA, 22 bp, Artificial Sequence
  chemically synthesized
gttcccttggagtaggcagata

SEQ ID NO: 1234001 - DNA, 22 bp, Artificial Sequence
  chemically synthesized
ctcatttctggctatctgccta

SEQ ID NO: 1234002 - DNA, 22 bp, Artificial Sequence
  chemically synthesized
ccttggagtaggcagatagcca

SEQ ID NO: 1234003 - DNA, 22 bp, Artificial Sequence
  chemically synthesized
cctgctcatttctggctatctg

SEQ ID NO: 1234004 - DNA, 22 bp, Artificial Sequence
  chemically synthesized
gcctgctcatttctggctatct

SEQ ID NO: 1234005 - DNA, 22 bp, Artificial Sequence
  chemically synthesized
ggagtaggcagatagccagaaa

SEQ ID NO: 1234006 - DNA, 22 bp, Artificial Sequence
  chemically synthesized
gagtaggcagatagccagaaat

SEQ ID NO: 1234007 - DNA, 22 bp, Artificial Sequence
  chemically synthesized
ccttgcctgctcatttctggct

SEQ ID NO: 1234008 - DNA, 22 bp, Artificial Sequence
  chemically synthesized
aatggggctcccttgcctgctc

SEQ ID NO: 1234009 - DNA, 22 bp, Artificial Sequence
  chemically synthesized
tcaatggggctcccttgcctgc

SEQ ID NO: 1234010 - DNA, 22 bp, Artificial Sequence
  chemically synthesized
ctcaatggggctcccttgcctg

SEQ ID NO: 1234011 - DNA, 22 bp, Artificial Sequence
  chemically synthesized
tctcaatggggctcccttgcct

SEQ ID NO: 1234012 - DNA, 22 bp, Artificial Sequence
  chemically synthesized
ttctcaatggggctcccttgcc

SEQ ID NO: 1234013 - DNA, 22 bp, Artificial Sequence
  chemically synthesized
ttttctcaatggggctcccttg

SEQ ID NO: 1234014 - DNA, 22 bp, Artificial Sequence
  chemically synthesized
cttttctcaatggggctccctt

SEQ ID NO: 1234015 - DNA, 22 bp, Artificial Sequence
  chemically synthesized
aggacttcttttctcaatgggg

SEQ ID NO: 1234016 - DNA, 22 bp, Artificial Sequence
  chemically synthesized
caggacttcttttctcaatggg

SEQ ID NO: 1234017 - DNA, 22 bp, Artificial Sequence
  chemically synthesized
agtgaaacagcatcttcaggac

SEQ ID NO: 1234018 - DNA, 22 bp, Artificial Sequence
  chemically synthesized
agaaaagaagtcctgaagatgc

SEQ ID NO: 1234019 - DNA, 22 bp, Artificial Sequence
  chemically synthesized
actcagtgaaacagcatcttca

SEQ ID NO: 1234020 - DNA, 22 bp, Artificial Sequence
  chemically synthesized
aagatgctgtttcactgagtca

SEQ ID NO: 1234021 - DNA, 22 bp, Artificial Sequence
  chemically synthesized
tcaacaggcagcactgactcag

SEQ ID NO: 1234022 - DNA, 22 bp, Artificial Sequence
  chemically synthesized
attgtcaacaggcagcactgac

SEQ ID NO: 1234023 - DNA, 22 bp, Artificial Sequence
  chemically synthesized
tttcactgagtcagtgctgcct

SEQ ID NO: 1234024 - DNA, 22 bp, Artificial Sequence
  chemically synthesized
gctgattgtcaacaggcagcac

SEQ ID NO: 1234025 - DNA, 22 bp, Artificial Sequence
  chemically synthesized
cgctgattgtcaacaggcagca

SEQ ID NO: 1234026 - DNA, 22 bp, Artificial Sequence
  chemically synthesized
cactgagtcagtgctgcctgtt

SEQ ID NO: 1234027 - DNA, 22 bp, Artificial Sequence
  chemically synthesized
actgagtcagtgctgcctgttg

SEQ ID NO: 1234028 - DNA, 22 bp, Artificial Sequence
  chemically synthesized
agtcagtgctgcctgttgacaa

SEQ ID NO: 1234029 - DNA, 22 bp, Artificial Sequence
  chemically synthesized
tccgtttcgctgattgtcaaca

SEQ ID NO: 1234030 - DNA, 22 bp, Artificial Sequence
  chemically synthesized
attgtccgtttcgctgattgtc

SEQ ID NO: 1234031 - DNA, 22 bp, Artificial Sequence
  chemically synthesized
cctgttgacaatcagcgaaacg

SEQ ID NO: 1234032 - DNA, 22 bp, Artificial Sequence
  chemically synthesized
ttgacaatcagcgaaacggaca

SEQ ID NO: 1234033 - DNA, 22 bp, Artificial Sequence
  chemically synthesized
acaatcagcgaaacggacaatg

SEQ ID NO: 1234034 - DNA, 22 bp, Artificial Sequence
  chemically synthesized
gacataatcagtgtggacagtg

SEQ ID NO: 1234035 - DNA, 22 bp, Artificial Sequence
  chemically synthesized
tccacactgattatgtctagcc

SEQ ID NO: 1234036 - DNA, 22 bp, Artificial Sequence
  chemically synthesized
gaggagcccaaccacaaggcta

SEQ ID NO: 1234037 - DNA, 22 bp, Artificial Sequence
  chemically synthesized
attatgtctagccttgtggttg

SEQ ID NO: 1234038 - DNA, 22 bp, Artificial Sequence
  chemically synthesized
gggctagaggagcccaaccaca

SEQ ID NO: 1234039 - DNA, 22 bp, Artificial Sequence
  chemically synthesized
ggggctagaggagcccaaccac

SEQ ID NO: 1234040 - DNA, 22 bp, Artificial Sequence
  chemically synthesized
tgtctagccttgtggttgggct

SEQ ID NO: 1234041 - DNA, 22 bp, Artificial Sequence
  chemically synthesized
tggggctagaggagcccaacca

SEQ ID NO: 1234042 - DNA, 22 bp, Artificial Sequence
  chemically synthesized
gccttgtggttgggctcctcta

SEQ ID NO: 1234043 - DNA, 22 bp, Artificial Sequence
  chemically synthesized
gtggttgggctcctctagcccc

SEQ ID NO: 1234044 - DNA, 22 bp, Artificial Sequence
  chemically synthesized
tggttgggctcctctagcccca

SEQ ID NO: 1234045 - DNA, 22 bp, Artificial Sequence
  chemically synthesized
agaagtcccctttggggctaga

SEQ ID NO: 1234046 - DNA, 22 bp, Artificial Sequence
  chemically synthesized
ggctcctctagccccaaagggg

SEQ ID NO: 1234047 - DNA, 22 bp, Artificial Sequence
  chemically synthesized
ctctagccccaaaggggacttc

SEQ ID NO: 1234048 - DNA, 22 bp, Artificial Sequence
  chemically synthesized
gcgagggcctgagaagtcccct

SEQ ID NO: 1234049 - DNA, 22 bp, Artificial Sequence
  chemically synthesized
tggcgagggcctgagaagtccc

SEQ ID NO: 1234050 - DNA, 22 bp, Artificial Sequence
  chemically synthesized
tagccccaaaggggacttctca

SEQ ID NO: 1234051 - DNA, 22 bp, Artificial Sequence
  chemically synthesized
gccccaaaggggacttctcagg

SEQ ID NO: 1234052 - DNA, 22 bp, Artificial Sequence
  chemically synthesized
tctctggcgagggcctgagaag

SEQ ID NO: 1234053 - DNA, 22 bp, Artificial Sequence
  chemically synthesized
gcgtggttatctctggcgaggg

SEQ ID NO: 1234054 - DNA, 22 bp, Artificial Sequence
  chemically synthesized
ctcaggccctcgccagagataa

SEQ ID NO: 1234055 - DNA, 22 bp, Artificial Sequence
  chemically synthesized
tcaggccctcgccagagataac

SEQ ID NO: 1234056 - DNA, 22 bp, Artificial Sequence
  chemically synthesized
aggccctcgccagagataacca

SEQ ID NO: 1234057 - DNA, 22 bp, Artificial Sequence
  chemically synthesized
gccagagataaccacgctaggg

SEQ ID NO: 1234058 - DNA, 22 bp, Artificial Sequence
  chemically synthesized
tcagtggggaaaatccctagcg

SEQ ID NO: 1234059 - DNA, 22 bp, Artificial Sequence
  chemically synthesized
gtcagtggggaaaatccctagc

SEQ ID NO: 1234060 - DNA, 22 bp, Artificial Sequence
  chemically synthesized
gggattttccccactgacaagc

SEQ ID NO: 1234061 - DNA, 22 bp, Artificial Sequence
  chemically synthesized
gaggagtgtgtgcatgcttgtc

SEQ ID NO: 1234062 - DNA, 22 bp, Artificial Sequence
  chemically synthesized
ggaggagtgtgtgcatgcttgt

SEQ ID NO: 1234063 - DNA, 22 bp, Artificial Sequence
  chemically synthesized
tggaggagtgtgtgcatgcttg

SEQ ID NO: 1234064 - DNA, 22 bp, Artificial Sequence
  chemically synthesized
ttggaggagtgtgtgcatgctt

SEQ ID NO: 1234065 - DNA, 22 bp, Artificial Sequence
  chemically synthesized
tccccactgacaagcatgcaca

SEQ ID NO: 1234066 - DNA, 22 bp, Artificial Sequence
  chemically synthesized
ccccactgacaagcatgcacac

SEQ ID NO: 1234067 - DNA, 22 bp, Artificial Sequence
  chemically synthesized
cccactgacaagcatgcacaca

SEQ ID NO: 1234068 - DNA, 22 bp, Artificial Sequence
  chemically synthesized
acaagcatgcacacactcctcc

SEQ ID NO: 1234069 - DNA, 22 bp, Artificial Sequence
  chemically synthesized
caatgagcaaaagaatagggca

SEQ ID NO: 1234070 - DNA, 22 bp, Artificial Sequence
  chemically synthesized
ctccaaaaacttgccctattct

SEQ ID NO: 1234071 - DNA, 22 bp, Artificial Sequence
  chemically synthesized
ttacaatgagcaaaagaatagg

SEQ ID NO: 1234072 - DNA, 22 bp, Artificial Sequence
  chemically synthesized
caaaaacttgccctattctttt

SEQ ID NO: 1234073 - DNA, 22 bp, Artificial Sequence
  chemically synthesized
cactattacaatgagcaaaaga

SEQ ID NO: 1234074 - DNA, 22 bp, Artificial Sequence
  chemically synthesized
acactattacaatgagcaaaag

SEQ ID NO: 1234075 - DNA, 22 bp, Artificial Sequence
  chemically synthesized
tttacactattacaatgagcaa

SEQ ID NO: 1234076 - DNA, 22 bp, Artificial Sequence
  chemically synthesized
gccctattcttttgctcattgt

SEQ ID NO: 1234077 - DNA, 22 bp, Artificial Sequence
  chemically synthesized
gtttacactattacaatgagca

SEQ ID NO: 1234078 - DNA, 22 bp, Artificial Sequence
  chemically synthesized
ccctattcttttgctcattgta

SEQ ID NO: 1234079 - DNA, 22 bp, Artificial Sequence
  chemically synthesized
tttgtttacactattacaatga

SEQ ID NO: 1234080 - DNA, 22 bp, Artificial Sequence
  chemically synthesized
gtttgtttacactattacaatg

SEQ ID NO: 1234081 - DNA, 22 bp, Artificial Sequence
  chemically synthesized
ttcttttgctcattgtaatagt

SEQ ID NO: 1234082 - DNA, 22 bp, Artificial Sequence
  chemically synthesized
tttgtttgtttacactattaca

SEQ ID NO: 1234083 - DNA, 22 bp, Artificial Sequence
  chemically synthesized
gtttgtttgtttacactattac

SEQ ID NO: 1234084 - DNA, 22 bp, Artificial Sequence
  chemically synthesized
ttttgctcattgtaatagtgta

SEQ ID NO: 1234085 - DNA, 22 bp, Artificial Sequence
  chemically synthesized
ttgctcattgtaatagtgtaaa

SEQ ID NO: 1234086 - DNA, 22 bp, Artificial Sequence
  chemically synthesized
tttgtttgtttgtttacactat

SEQ ID NO: 1234087 - DNA, 22 bp, Artificial Sequence
  chemically synthesized
tgctcattgtaatagtgtaaac

SEQ ID NO: 1234088 - DNA, 22 bp, Artificial Sequence
  chemically synthesized
gtttgtttgtttgtttacacta

SEQ ID NO: 1234089 - DNA, 22 bp, Artificial Sequence
  chemically synthesized
gctcattgtaatagtgtaaaca

SEQ ID NO: 1234090 - DNA, 22 bp, Artificial Sequence
  chemically synthesized
tgtttgtttgtttgtttacact

SEQ ID NO: 1234091 - DNA, 22 bp, Artificial Sequence
  chemically synthesized
ctcattgtaatagtgtaaacaa

SEQ ID NO: 1234092 - DNA, 22 bp, Artificial Sequence
  chemically synthesized
ttgtttgtttgtttgtttacac

SEQ ID NO: 1234093 - DNA, 22 bp, Artificial Sequence
  chemically synthesized
tttgtttgtttgtttgtttaca

SEQ ID NO: 1234094 - DNA, 22 bp, Artificial Sequence
  chemically synthesized
ttttgtttgtttgtttgtttac

SEQ ID NO: 1234095 - DNA, 22 bp, Artificial Sequence
  chemically synthesized
attgtaatagtgtaaacaaaca

SEQ ID NO: 1234096 - DNA, 22 bp, Artificial Sequence
  chemically synthesized
taatagtgtaaacaaacaaaca

SEQ ID NO: 1234097 - DNA, 22 bp, Artificial Sequence
  chemically synthesized
cacccaggggtgtgtgggtttt

SEQ ID NO: 1234098 - DNA, 22 bp, Artificial Sequence
  chemically synthesized
aaatctccacccaggggtgtgt

SEQ ID NO: 1234099 - DNA, 22 bp, Artificial Sequence
  chemically synthesized
gcatctaaaatctccacccagg

SEQ ID NO: 1234100 - DNA, 22 bp, Artificial Sequence
  chemically synthesized
attggcatctaaaatctccacc

SEQ ID NO: 1234101 - DNA, 22 bp, Artificial Sequence
  chemically synthesized
ggtggagattttagatgccaat

SEQ ID NO: 1234102 - DNA, 22 bp, Artificial Sequence
  chemically synthesized
gcacacataccacatctcattg

SEQ ID NO: 1234103 - DNA, 22 bp, Artificial Sequence
  chemically synthesized
tagatgccaatgagatgtggta

SEQ ID NO: 1234104 - DNA, 22 bp, Artificial Sequence
  chemically synthesized
agatgccaatgagatgtggtat

SEQ ID NO: 1234105 - DNA, 22 bp, Artificial Sequence
  chemically synthesized
gatgccaatgagatgtggtatg

SEQ ID NO: 1234106 - DNA, 22 bp, Artificial Sequence
  chemically synthesized
tacatgctagcacacataccac

SEQ ID NO: 1234107 - DNA, 22 bp, Artificial Sequence
  chemically synthesized
gttgtacatgctagcacacata

SEQ ID NO: 1234108 - DNA, 22 bp, Artificial Sequence
  chemically synthesized
tggttgtacatgctagcacaca

SEQ ID NO: 1234109 - DNA, 22 bp, Artificial Sequence
  chemically synthesized
ggcacacatgctctggttgtac

SEQ ID NO: 1234110 - DNA, 22 bp, Artificial Sequence
  chemically synthesized
gggcacacatgctctggttgta

SEQ ID NO: 1234111 - DNA, 22 bp, Artificial Sequence
  chemically synthesized
tgggcacacatgctctggttgt

SEQ ID NO: 1234112 - DNA, 22 bp, Artificial Sequence
  chemically synthesized
ttgggcacacatgctctggttg

SEQ ID NO: 1234113 - DNA, 22 bp, Artificial Sequence
  chemically synthesized
tttgggcacacatgctctggtt

SEQ ID NO: 1234114 - DNA, 22 bp, Artificial Sequence
  chemically synthesized
gcatgtacaaccagagcatgtg

SEQ ID NO: 1234115 - DNA, 22 bp, Artificial Sequence
  chemically synthesized
ggaggttttttgggcacacatg

SEQ ID NO: 1234116 - DNA, 22 bp, Artificial Sequence
  chemically synthesized
gggaggttttttgggcacacat

SEQ ID NO: 1234117 - DNA, 22 bp, Artificial Sequence
  chemically synthesized
tgggaggttttttgggcacaca

SEQ ID NO: 1234118 - DNA, 22 bp, Artificial Sequence
  chemically synthesized
caagtatgttttgggaggtttt

SEQ ID NO: 1234119 - DNA, 22 bp, Artificial Sequence
  chemically synthesized
gcaagtatgttttgggaggttt

SEQ ID NO: 1234120 - DNA, 22 bp, Artificial Sequence
  chemically synthesized
cttgcaagtatgttttgggagg

SEQ ID NO: 1234121 - DNA, 22 bp, Artificial Sequence
  chemically synthesized
acttgcaagtatgttttgggag

SEQ ID NO: 1234122 - DNA, 22 bp, Artificial Sequence
  chemically synthesized
ccaaaacatacttgcaagtaag

SEQ ID NO: 1234123 - DNA, 22 bp, Artificial Sequence
  chemically synthesized
gcaagtaagaccccccccatac

SEQ ID NO: 1234124 - DNA, 22 bp, Artificial Sequence
  chemically synthesized
caagtaagaccccccccataca

SEQ ID NO: 1234125 - DNA, 22 bp, Artificial Sequence
  chemically synthesized
cgtgataaatcatgaaagggtg

SEQ ID NO: 1234126 - DNA, 22 bp, Artificial Sequence
  chemically synthesized
ctacgtgataaatcatgaaagg

SEQ ID NO: 1234127 - DNA, 22 bp, Artificial Sequence
  chemically synthesized
agactcctacgtgataaatcat

SEQ ID NO: 1234128 - DNA, 22 bp, Artificial Sequence
  chemically synthesized
gagactcctacgtgataaatca

SEQ ID NO: 1234129 - DNA, 22 bp, Artificial Sequence
  chemically synthesized
tgagactcctacgtgataaatc

SEQ ID NO: 1234130 - DNA, 22 bp, Artificial Sequence
  chemically synthesized
tcatgatttatcacgtaggagt

SEQ ID NO: 1234131 - DNA, 22 bp, Artificial Sequence
  chemically synthesized
gggaactttgagactcctacgt

SEQ ID NO: 1234132 - DNA, 22 bp, Artificial Sequence
  chemically synthesized
catgatttatcacgtaggagtc

SEQ ID NO: 1234133 - DNA, 22 bp, Artificial Sequence
  chemically synthesized
atgatttatcacgtaggagtct

SEQ ID NO: 1234134 - DNA, 22 bp, Artificial Sequence
  chemically synthesized
gtgctggggaactttgagactc

SEQ ID NO: 1234135 - DNA, 22 bp, Artificial Sequence
  chemically synthesized
atcacgtaggagtctcaaagtt

SEQ ID NO: 1234136 - DNA, 22 bp, Artificial Sequence
  chemically synthesized
tcacgtaggagtctcaaagttc

SEQ ID NO: 1234137 - DNA, 22 bp, Artificial Sequence
  chemically synthesized
aaagttccccagcactagctgc

SEQ ID NO: 1234138 - DNA, 22 bp, Artificial Sequence
  chemically synthesized
cccagcactagctgctgctggc

SEQ ID NO: 1234139 - DNA, 22 bp, Artificial Sequence
  chemically synthesized
gctgctgctggctctttgttcc

SEQ ID NO: 1234140 - DNA, 22 bp, Artificial Sequence
  chemically synthesized
ctgctggctctttgttcccttg

SEQ ID NO: 1234141 - DNA, 22 bp, Artificial Sequence
  chemically synthesized
aatgcacacgaacacaagggaa

SEQ ID NO: 1234142 - DNA, 22 bp, Artificial Sequence
  chemically synthesized
ctggctctttgttcccttgtgt

SEQ ID NO: 1234143 - DNA, 22 bp, Artificial Sequence
  chemically synthesized
gctctttgttcccttgtgttcg

SEQ ID NO: 1234144 - DNA, 22 bp, Artificial Sequence
  chemically synthesized
aacactgaatgcacacgaacac

SEQ ID NO: 1234145 - DNA, 22 bp, Artificial Sequence
  chemically synthesized
tttgttcccttgtgttcgtgtg

SEQ ID NO: 1234146 - DNA, 22 bp, Artificial Sequence
  chemically synthesized
tgttcccttgtgttcgtgtgca

SEQ ID NO: 1234147 - DNA, 22 bp, Artificial Sequence
  chemically synthesized
gttcccttgtgttcgtgtgcat

SEQ ID NO: 1234148 - DNA, 22 bp, Artificial Sequence
  chemically synthesized
ttcccttgtgttcgtgtgcatt

SEQ ID NO: 1234149 - DNA, 22 bp, Artificial Sequence
  chemically synthesized
ccttgtgttcgtgtgcattcag

SEQ ID NO: 1234150 - DNA, 22 bp, Artificial Sequence
  chemically synthesized
gtgttcgtgtgcattcagtgtt

SEQ ID NO: 1234151 - DNA, 22 bp, Artificial Sequence
  chemically synthesized
tgttcgtgtgcattcagtgttt

SEQ ID NO: 1234152 - DNA, 22 bp, Artificial Sequence
  chemically synthesized
aataagtacgagctaaacactg

SEQ ID NO: 1234153 - DNA, 22 bp, Artificial Sequence
  chemically synthesized
tcaataagtacgagctaaacac

SEQ ID NO: 1234154 - DNA, 22 bp, Artificial Sequence
  chemically synthesized
gtgtgcattcagtgtttagctc

SEQ ID NO: 1234155 - DNA, 22 bp, Artificial Sequence
  chemically synthesized
agtgtttagctcgtacttattg

SEQ ID NO: 1234156 - DNA, 22 bp, Artificial Sequence
  chemically synthesized
agctcgtacttattgagaatat

SEQ ID NO: 1234157 - DNA, 22 bp, Artificial Sequence
  chemically synthesized
gctcgtacttattgagaatatg

SEQ ID NO: 1234158 - DNA, 22 bp, Artificial Sequence
  chemically synthesized
gtacttattgagaatatgtgtt

SEQ ID NO: 1234159 - DNA, 22 bp, Artificial Sequence
  chemically synthesized
attgagaatatgtgttattcgg

SEQ ID NO: 1234160 - DNA, 22 bp, Artificial Sequence
  chemically synthesized
ttgagaatatgtgttattcggt

SEQ ID NO: 1234161 - DNA, 22 bp, Artificial Sequence
  chemically synthesized
agaatatgtgttattcggtttt

SEQ ID NO: 1234162 - DNA, 22 bp, Artificial Sequence
  chemically synthesized
acacagaaacagaaaaccgaat

SEQ ID NO: 1234163 - DNA, 22 bp, Artificial Sequence
  chemically synthesized
agtaaactaacacagaaacaga

SEQ ID NO: 1234164 - DNA, 22 bp, Artificial Sequence
  chemically synthesized
ttcggttttctgtttctgtgtt

SEQ ID NO: 1234165 - DNA, 22 bp, Artificial Sequence
  chemically synthesized
tcctaagtaaactaacacagaa

SEQ ID NO: 1234166 - DNA, 22 bp, Artificial Sequence
  chemically synthesized
ggttttctgtttctgtgttagt

SEQ ID NO: 1234167 - DNA, 22 bp, Artificial Sequence
  chemically synthesized
tctgtttctgtgttagtttact

SEQ ID NO: 1234168 - DNA, 22 bp, Artificial Sequence
  chemically synthesized
ctgtttctgtgttagtttactt

SEQ ID NO: 1234169 - DNA, 22 bp, Artificial Sequence
  chemically synthesized
tgtttctgtgttagtttactta

SEQ ID NO: 1234170 - DNA, 22 bp, Artificial Sequence
  chemically synthesized
gaggtcattatcctaagtaaac

SEQ ID NO: 1234171 - DNA, 22 bp, Artificial Sequence
  chemically synthesized
tttctgtgttagtttacttagg

SEQ ID NO: 1234172 - DNA, 22 bp, Artificial Sequence
  chemically synthesized
ctgtgttagtttacttaggata

SEQ ID NO: 1234173 - DNA, 22 bp, Artificial Sequence
  chemically synthesized
tgtgttagtttacttaggataa

SEQ ID NO: 1234174 - DNA, 22 bp, Artificial Sequence
  chemically synthesized
tgttagtttacttaggataatg

SEQ ID NO: 1234175 - DNA, 22 bp, Artificial Sequence
  chemically synthesized
gtttacttaggataatgacctc

SEQ ID NO: 1234176 - DNA, 22 bp, Artificial Sequence
  chemically synthesized
acttaggataatgacctccaga

SEQ ID NO: 1234177 - DNA, 22 bp, Artificial Sequence
  chemically synthesized
cttaggataatgacctccagac

SEQ ID NO: 1234178 - DNA, 22 bp, Artificial Sequence
  chemically synthesized
aggataatgacctccagactca

SEQ ID NO: 1234179 - DNA, 22 bp, Artificial Sequence
  chemically synthesized
cagcaacatggatgagtctgga

SEQ ID NO: 1234180 - DNA, 22 bp, Artificial Sequence
  chemically synthesized
ggataatgacctccagactcat

SEQ ID NO: 1234181 - DNA, 22 bp, Artificial Sequence
  chemically synthesized
gcagcaacatggatgagtctgg

SEQ ID NO: 1234182 - DNA, 22 bp, Artificial Sequence
  chemically synthesized
tgcagcaacatggatgagtctg

SEQ ID NO: 1234183 - DNA, 22 bp, Artificial Sequence
  chemically synthesized
cagactcatccatgttgctgca

SEQ ID NO: 1234184 - DNA, 22 bp, Artificial Sequence
  chemically synthesized
gatcatgtcctttgcagcaaca

SEQ ID NO: 1234185 - DNA, 22 bp, Artificial Sequence
  chemically synthesized
atccatgttgctgcaaaggaca

SEQ ID NO: 1234186 - DNA, 22 bp, Artificial Sequence
  chemically synthesized
ctgcaaaggacatgatctaatt

SEQ ID NO: 1234187 - DNA, 22 bp, Artificial Sequence
  chemically synthesized
caaaggacatgatctaattctt

SEQ ID NO: 1234188 - DNA, 22 bp, Artificial Sequence
  chemically synthesized
tgcagccacagaaaagaattag

SEQ ID NO: 1234189 - DNA, 22 bp, Artificial Sequence
  chemically synthesized
attcttttctgtggctgcatag

SEQ ID NO: 1234190 - DNA, 22 bp, Artificial Sequence
  chemically synthesized
ttttctgtggctgcatagtatt

SEQ ID NO: 1234191 - DNA, 22 bp, Artificial Sequence
  chemically synthesized
ttctgtggctgcatagtattgt

SEQ ID NO: 1234192 - DNA, 22 bp, Artificial Sequence
  chemically synthesized
tctgtggctgcatagtattgta

SEQ ID NO: 1234193 - DNA, 22 bp, Artificial Sequence
  chemically synthesized
ctgtggctgcatagtattgtat

SEQ ID NO: 1234194 - DNA, 22 bp, Artificial Sequence
  chemically synthesized
tgtggctgcatagtattgtatt

SEQ ID NO: 1234195 - DNA, 22 bp, Artificial Sequence
  chemically synthesized
tggctgcatagtattgtatttc

SEQ ID NO: 1234196 - DNA, 22 bp, Artificial Sequence
  chemically synthesized
gtacatatacagcatgaaatac

SEQ ID NO: 1234197 - DNA, 22 bp, Artificial Sequence
  chemically synthesized
ggtacatatacagcatgaaata

SEQ ID NO: 1234198 - DNA, 22 bp, Artificial Sequence
  chemically synthesized
catagtattgtatttcatgctg

SEQ ID NO: 1234199 - DNA, 22 bp, Artificial Sequence
  chemically synthesized
tatttcatgctgtatatgtacc

SEQ ID NO: 1234200 - DNA, 22 bp, Artificial Sequence
  chemically synthesized
catgctgtatatgtaccaaatt

SEQ ID NO: 1234201 - DNA, 22 bp, Artificial Sequence
  chemically synthesized
atgctgtatatgtaccaaatta

SEQ ID NO: 1234202 - DNA, 22 bp, Artificial Sequence
  chemically synthesized
tatatgtaccaaattattatta

SEQ ID NO: 1234203 - DNA, 22 bp, Artificial Sequence
  chemically synthesized
catatcaaaaaaaaaaataata

SEQ ID NO: 1234204 - DNA, 22 bp, Artificial Sequence
  chemically synthesized
ttattatttttttttttgatat

SEQ ID NO: 1234205 - DNA, 22 bp, Artificial Sequence
  chemically synthesized
ttatttttttttttgatatgga

SEQ ID NO: 1234206 - DNA, 22 bp, Artificial Sequence
  chemically synthesized
tttttttttttgatatggaatc

SEQ ID NO: 1234207 - DNA, 22 bp, Artificial Sequence
  chemically synthesized
ggaggcagagcgagattccata

SEQ ID NO: 1234208 - DNA, 22 bp, Artificial Sequence
  chemically synthesized
ttttttttgatatggaatctcg

SEQ ID NO: 1234209 - DNA, 22 bp, Artificial Sequence
  chemically synthesized
tttttttgatatggaatctcgc

SEQ ID NO: 1234210 - DNA, 22 bp, Artificial Sequence
  chemically synthesized
ttttttgatatggaatctcgct

SEQ ID NO: 1234211 - DNA, 22 bp, Artificial Sequence
  chemically synthesized
tttttgatatggaatctcgctc

SEQ ID NO: 1234212 - DNA, 22 bp, Artificial Sequence
  chemically synthesized
ttttgatatggaatctcgctct

SEQ ID NO: 1234213 - DNA, 22 bp, Artificial Sequence
  chemically synthesized
tttgatatggaatctcgctctg

SEQ ID NO: 1234214 - DNA, 22 bp, Artificial Sequence
  chemically synthesized
cagcctgggaggcagagcgaga

SEQ ID NO: 1234215 - DNA, 22 bp, Artificial Sequence
  chemically synthesized
ttgatatggaatctcgctctgc

SEQ ID NO: 1234216 - DNA, 22 bp, Artificial Sequence
  chemically synthesized
tgatatggaatctcgctctgcc

SEQ ID NO: 1234217 - DNA, 22 bp, Artificial Sequence
  chemically synthesized
gatatggaatctcgctctgcct

SEQ ID NO: 1234218 - DNA, 22 bp, Artificial Sequence
  chemically synthesized
atatggaatctcgctctgcctc

SEQ ID NO: 1234219 - DNA, 22 bp, Artificial Sequence
  chemically synthesized
cactccagcctgggaggcagag

SEQ ID NO: 1234220 - DNA, 22 bp, Artificial Sequence
  chemically synthesized
gctctgcctcccaggctggagt

SEQ ID NO: 1234221 - DNA, 22 bp, Artificial Sequence
  chemically synthesized
tgcctcccaggctggagtgcag

SEQ ID NO: 1234222 - DNA, 22 bp, Artificial Sequence
  chemically synthesized
cctcccaggctggagtgcagtg

SEQ ID NO: 1234223 - DNA, 22 bp, Artificial Sequence
  chemically synthesized
ccaggctggagtgcagtggcac

SEQ ID NO: 1234224 - DNA, 22 bp, Artificial Sequence
  chemically synthesized
cagtgagtggagatcgtgccac

SEQ ID NO: 1234225 - DNA, 22 bp, Artificial Sequence
  chemically synthesized
gagtgcagtggcacgatctcca

SEQ ID NO: 1234226 - DNA, 22 bp, Artificial Sequence
  chemically synthesized
aggttgcagtgagtggagatcg

SEQ ID NO: 1234227 - DNA, 22 bp, Artificial Sequence
  chemically synthesized
aacccagaggctgaggttgcag

SEQ ID NO: 1234228 - DNA, 22 bp, Artificial Sequence
  chemically synthesized
gaacccagaggctgaggttgca

SEQ ID NO: 1234229 - DNA, 22 bp, Artificial Sequence
  chemically synthesized
cttgaacccagaggctgaggtt

SEQ ID NO: 1234230 - DNA, 22 bp, Artificial Sequence
  chemically synthesized
cactcactgcaacctcagcctc

SEQ ID NO: 1234231 - DNA, 22 bp, Artificial Sequence
  chemically synthesized
actgcaacctcagcctctgggt

SEQ ID NO: 1234232 - DNA, 22 bp, Artificial Sequence
  chemically synthesized
caacctcagcctctgggttcaa

SEQ ID NO: 1234233 - DNA, 22 bp, Artificial Sequence
  chemically synthesized
aggtaggagaattgcttgaacc

SEQ ID NO: 1234234 - DNA, 22 bp, Artificial Sequence
  chemically synthesized
agcctctgggttcaagcaattc

SEQ ID NO: 1234235 - DNA, 22 bp, Artificial Sequence
  chemically synthesized
gggaggctgaggtaggagaatt

SEQ ID NO: 1234236 - DNA, 22 bp, Artificial Sequence
  chemically synthesized
tgggttcaagcaattctcctac

SEQ ID NO: 1234237 - DNA, 22 bp, Artificial Sequence
  chemically synthesized
ggttcaagcaattctcctacct

SEQ ID NO: 1234238 - DNA, 22 bp, Artificial Sequence
  chemically synthesized
ctcgggaggctgaggtaggaga

SEQ ID NO: 1234239 - DNA, 22 bp, Artificial Sequence
  chemically synthesized
aagcaattctcctacctcagcc

SEQ ID NO: 1234240 - DNA, 22 bp, Artificial Sequence
  chemically synthesized
taatcccagctactcgggaggc

SEQ ID NO: 1234241 - DNA, 22 bp, Artificial Sequence
  chemically synthesized
tcctacctcagcctcccgagta

SEQ ID NO: 1234242 - DNA, 22 bp, Artificial Sequence
  chemically synthesized
ctacctcagcctcccgagtagc

SEQ ID NO: 1234243 - DNA, 22 bp, Artificial Sequence
  chemically synthesized
cctcagcctcccgagtagctgg

SEQ ID NO: 1234244 - DNA, 22 bp, Artificial Sequence
  chemically synthesized
agcctcccgagtagctgggatt

SEQ ID NO: 1234245 - DNA, 22 bp, Artificial Sequence
  chemically synthesized
gtgcatgcctgtaatcccagct

SEQ ID NO: 1234246 - DNA, 22 bp, Artificial Sequence
  chemically synthesized
ccgagtagctgggattacaggc

SEQ ID NO: 1234247 - DNA, 22 bp, Artificial Sequence
  chemically synthesized
agtatgctggtgcatgcctgta

SEQ ID NO: 1234248 - DNA, 22 bp, Artificial Sequence
  chemically synthesized
gctgagtatgctggtgcatgcc

SEQ ID NO: 1234249 - DNA, 22 bp, Artificial Sequence
  chemically synthesized
ggattacaggcatgcaccagca

SEQ ID NO: 1234250 - DNA, 22 bp, Artificial Sequence
  chemically synthesized
caggcatgcaccagcatactca

SEQ ID NO: 1234251 - DNA, 22 bp, Artificial Sequence
  chemically synthesized
aaaaatacaaaaattagctgag

SEQ ID NO: 1234252 - DNA, 22 bp, Artificial Sequence
  chemically synthesized
ctaaaaaatacaaaaattagct

SEQ ID NO: 1234253 - DNA, 22 bp, Artificial Sequence
  chemically synthesized
tactaaaaaatacaaaaattag

SEQ ID NO: 1234254 - DNA, 22 bp, Artificial Sequence
  chemically synthesized
agctaatttttgtattttttag

SEQ ID NO: 1234255 - DNA, 22 bp, Artificial Sequence
  chemically synthesized
atttttgtattttttagtagag

SEQ ID NO: 1234256 - DNA, 22 bp, Artificial Sequence
  chemically synthesized
ttgtattttttagtagagacgg

SEQ ID NO: 1234257 - DNA, 22 bp, Artificial Sequence
  chemically synthesized
tgtattttttagtagagacggg

SEQ ID NO: 1234258 - DNA, 22 bp, Artificial Sequence
  chemically synthesized
gtattttttagtagagacgggg

SEQ ID NO: 1234259 - DNA, 22 bp, Artificial Sequence
  chemically synthesized
tattttttagtagagacggggt

SEQ ID NO: 1234260 - DNA, 22 bp, Artificial Sequence
  chemically synthesized
gccaccatggcgaaaccccgtc

SEQ ID NO: 1234261 - DNA, 22 bp, Artificial Sequence
  chemically synthesized
tttagtagagacggggtttcgc

SEQ ID NO: 1234262 - DNA, 22 bp, Artificial Sequence
  chemically synthesized
ttagtagagacggggtttcgcc

SEQ ID NO: 1234263 - DNA, 22 bp, Artificial Sequence
  chemically synthesized
tagtagagacggggtttcgcca

SEQ ID NO: 1234264 - DNA, 22 bp, Artificial Sequence
  chemically synthesized
agtagagacggggtttcgccat

SEQ ID NO: 1234265 - DNA, 22 bp, Artificial Sequence
  chemically synthesized
gtagagacggggtttcgccatg

SEQ ID NO: 1234266 - DNA, 22 bp, Artificial Sequence
  chemically synthesized
gagaccagcctggccaccatgg

SEQ ID NO: 1234267 - DNA, 22 bp, Artificial Sequence
  chemically synthesized
cgccatggtggccaggctggtc

SEQ ID NO: 1234268 - DNA, 22 bp, Artificial Sequence
  chemically synthesized
gccatggtggccaggctggtct

SEQ ID NO: 1234269 - DNA, 22 bp, Artificial Sequence
  chemically synthesized
gcagatcaccagaggtcaggag

SEQ ID NO: 1234270 - DNA, 22 bp, Artificial Sequence
  chemically synthesized
gtctcgaactcctgacctctgg

SEQ ID NO: 1234271 - DNA, 22 bp, Artificial Sequence
  chemically synthesized
gaactcctgacctctggtgatc

SEQ ID NO: 1234272 - DNA, 22 bp, Artificial Sequence
  chemically synthesized
ctgacctctggtgatctgccag

SEQ ID NO: 1234273 - DNA, 22 bp, Artificial Sequence
  chemically synthesized
tgggaggccgaggctggcagat

SEQ ID NO: 1234274 - DNA, 22 bp, Artificial Sequence
  chemically synthesized
acctctggtgatctgccagcct

SEQ ID NO: 1234275 - DNA, 22 bp, Artificial Sequence
  chemically synthesized
tggtgatctgccagcctcggcc

SEQ ID NO: 1234276 - DNA, 22 bp, Artificial Sequence
  chemically synthesized
gtgatctgccagcctcggcctc

SEQ ID NO: 1234277 - DNA, 22 bp, Artificial Sequence
  chemically synthesized
taatcccagcactgtgggaggc

SEQ ID NO: 1234278 - DNA, 22 bp, Artificial Sequence
  chemically synthesized
ccagcctcggcctcccacagtg

SEQ ID NO: 1234279 - DNA, 22 bp, Artificial Sequence
  chemically synthesized
atgcctgtaatcccagcactgt

SEQ ID NO: 1234280 - DNA, 22 bp, Artificial Sequence
  chemically synthesized
ggcctcccacagtgctgggatt

SEQ ID NO: 1234281 - DNA, 22 bp, Artificial Sequence
  chemically synthesized
ccacagtgctgggattacaggc

SEQ ID NO: 1234282 - DNA, 22 bp, Artificial Sequence
  chemically synthesized
ggattacaggcatgagcaccgc

SEQ ID NO: 1234283 - DNA, 22 bp, Artificial Sequence
  chemically synthesized
caggcatgagcaccgcgcccga

SEQ ID NO: 1234284 - DNA, 22 bp, Artificial Sequence
  chemically synthesized
cataaagaaaatgcggtacagg

SEQ ID NO: 1234285 - DNA, 22 bp, Artificial Sequence
  chemically synthesized
aatcctgcataaagaaaatgcg

SEQ ID NO: 1234286 - DNA, 22 bp, Artificial Sequence
  chemically synthesized
taaaactcaatcctgcataaag

SEQ ID NO: 1234287 - DNA, 22 bp, Artificial Sequence
  chemically synthesized
taccgcattttctttatgcagg

SEQ ID NO: 1234288 - DNA, 22 bp, Artificial Sequence
  chemically synthesized
ggatatcctgtaaaactcaatc

SEQ ID NO: 1234289 - DNA, 22 bp, Artificial Sequence
  chemically synthesized
tctttatgcaggattgagtttt

SEQ ID NO: 1234290 - DNA, 22 bp, Artificial Sequence
  chemically synthesized
gggatatcctgtaaaactcaat

SEQ ID NO: 1234291 - DNA, 22 bp, Artificial Sequence
  chemically synthesized
ctttatgcaggattgagtttta

SEQ ID NO: 1234292 - DNA, 22 bp, Artificial Sequence
  chemically synthesized
tgggatatcctgtaaaactcaa

SEQ ID NO: 1234293 - DNA, 22 bp, Artificial Sequence
  chemically synthesized
tttatgcaggattgagttttac

SEQ ID NO: 1234294 - DNA, 22 bp, Artificial Sequence
  chemically synthesized
tatgcaggattgagttttacag

SEQ ID NO: 1234295 - DNA, 22 bp, Artificial Sequence
  chemically synthesized
atgcaggattgagttttacagg

SEQ ID NO: 1234296 - DNA, 22 bp, Artificial Sequence
  chemically synthesized
tgcaggattgagttttacagga

SEQ ID NO: 1234297 - DNA, 22 bp, Artificial Sequence
  chemically synthesized
aaaaaacaaactttgggatatc

SEQ ID NO: 1234298 - DNA, 22 bp, Artificial Sequence
  chemically synthesized
aaaaaaacaaactttgggatat

SEQ ID NO: 1234299 - DNA, 22 bp, Artificial Sequence
  chemically synthesized
agttttacaggatatcccaaag

SEQ ID NO: 1234300 - DNA, 22 bp, Artificial Sequence
  chemically synthesized
tacaggatatcccaaagtttgt

SEQ ID NO: 1234301 - DNA, 22 bp, Artificial Sequence
  chemically synthesized
acaggatatcccaaagtttgtt

SEQ ID NO: 1234302 - DNA, 22 bp, Artificial Sequence
  chemically synthesized
caggatatcccaaagtttgttt

SEQ ID NO: 1234303 - DNA, 22 bp, Artificial Sequence
  chemically synthesized
tccccagcaagaaaatgtcatt

SEQ ID NO: 1234304 - DNA, 22 bp, Artificial Sequence
  chemically synthesized
gtttttttaaatgacattttct

SEQ ID NO: 1234305 - DNA, 22 bp, Artificial Sequence
  chemically synthesized
tttttttaaatgacattttctt

SEQ ID NO: 1234306 - DNA, 22 bp, Artificial Sequence
  chemically synthesized
actgtccccagcaagaaaatgt

SEQ ID NO: 1234307 - DNA, 22 bp, Artificial Sequence
  chemically synthesized
gactgtccccagcaagaaaatg

SEQ ID NO: 1234308 - DNA, 22 bp, Artificial Sequence
  chemically synthesized
ttttaaatgacattttcttgct

SEQ ID NO: 1234309 - DNA, 22 bp, Artificial Sequence
  chemically synthesized
tttaaatgacattttcttgctg

SEQ ID NO: 1234310 - DNA, 22 bp, Artificial Sequence
  chemically synthesized
ttaaatgacattttcttgctgg

SEQ ID NO: 1234311 - DNA, 22 bp, Artificial Sequence
  chemically synthesized
taaatgacattttcttgctggg

SEQ ID NO: 1234312 - DNA, 22 bp, Artificial Sequence
  chemically synthesized
aaatgacattttcttgctgggg

SEQ ID NO: 1234313 - DNA, 22 bp, Artificial Sequence
  chemically synthesized
tagcttgactgtccccagcaag

SEQ ID NO: 1234314 - DNA, 22 bp, Artificial Sequence
  chemically synthesized
aatgacattttcttgctgggga

SEQ ID NO: 1234315 - DNA, 22 bp, Artificial Sequence
  chemically synthesized
gtagcttgactgtccccagcaa

SEQ ID NO: 1234316 - DNA, 22 bp, Artificial Sequence
  chemically synthesized
tttgtagcttgactgtccccag

SEQ ID NO: 1234317 - DNA, 22 bp, Artificial Sequence
  chemically synthesized
atttgtagcttgactgtcccca

SEQ ID NO: 1234318 - DNA, 22 bp, Artificial Sequence
  chemically synthesized
atttatttgtagcttgactgtc

SEQ ID NO: 1234319 - DNA, 22 bp, Artificial Sequence
  chemically synthesized
aatttatttgtagcttgactgt

SEQ ID NO: 1234320 - DNA, 22 bp, Artificial Sequence
  chemically synthesized
tcttgctggggacagtcaagct

SEQ ID NO: 1234321 - DNA, 22 bp, Artificial Sequence
  chemically synthesized
cttgctggggacagtcaagcta

SEQ ID NO: 1234322 - DNA, 22 bp, Artificial Sequence
  chemically synthesized
ttgctggggacagtcaagctac

SEQ ID NO: 1234323 - DNA, 22 bp, Artificial Sequence
  chemically synthesized
gctggggacagtcaagctacaa

SEQ ID NO: 1234324 - DNA, 22 bp, Artificial Sequence
  chemically synthesized
gatttaatttatttgtagcttg

SEQ ID NO: 1234325 - DNA, 22 bp, Artificial Sequence
  chemically synthesized
ctggggacagtcaagctacaaa

SEQ ID NO: 1234326 - DNA, 22 bp, Artificial Sequence
  chemically synthesized
ttagatttaatttatttgtagc

SEQ ID NO: 1234327 - DNA, 22 bp, Artificial Sequence
  chemically synthesized
gggacagtcaagctacaaataa

SEQ ID NO: 1234328 - DNA, 22 bp, Artificial Sequence
  chemically synthesized
caaataaattaaatctaataat

SEQ ID NO: 1234329 - DNA, 22 bp, Artificial Sequence
  chemically synthesized
aatctaataattctgtgttccg

SEQ ID NO: 1234330 - DNA, 22 bp, Artificial Sequence
  chemically synthesized
ataattctgtgttccgctcttt

SEQ ID NO: 1234331 - DNA, 22 bp, Artificial Sequence
  chemically synthesized
aaaatgtagcagtgaagaaaag

SEQ ID NO: 1234332 - DNA, 22 bp, Artificial Sequence
  chemically synthesized
tgtgttccgctcttttcttcac

SEQ ID NO: 1234333 - DNA, 22 bp, Artificial Sequence
  chemically synthesized
caaaatgtagcagtgaagaaaa

SEQ ID NO: 1234334 - DNA, 22 bp, Artificial Sequence
  chemically synthesized
tgttccgctcttttcttcactg

SEQ ID NO: 1234335 - DNA, 22 bp, Artificial Sequence
  chemically synthesized
tttcaaaatgtagcagtgaaga

SEQ ID NO: 1234336 - DNA, 22 bp, Artificial Sequence
  chemically synthesized
tgtttcaaaatgtagcagtgaa

SEQ ID NO: 1234337 - DNA, 22 bp, Artificial Sequence
  chemically synthesized
cgctcttttcttcactgctaca

SEQ ID NO: 1234338 - DNA, 22 bp, Artificial Sequence
  chemically synthesized
ttttcttcactgctacattttg

SEQ ID NO: 1234339 - DNA, 22 bp, Artificial Sequence
  chemically synthesized
ttcttcactgctacattttgaa

SEQ ID NO: 1234340 - DNA, 22 bp, Artificial Sequence
  chemically synthesized
tcttcactgctacattttgaaa

SEQ ID NO: 1234341 - DNA, 22 bp, Artificial Sequence
  chemically synthesized
cttcactgctacattttgaaac

SEQ ID NO: 1234342 - DNA, 22 bp, Artificial Sequence
  chemically synthesized
ttcactgctacattttgaaaca

SEQ ID NO: 1234343 - DNA, 22 bp, Artificial Sequence
  chemically synthesized
cactgctacattttgaaacaga

SEQ ID NO: 1234344 - DNA, 22 bp, Artificial Sequence
  chemically synthesized
actgctacattttgaaacagaa

SEQ ID NO: 1234345 - DNA, 22 bp, Artificial Sequence
  chemically synthesized
ctacattttgaaacagaatatg

SEQ ID NO: 1234346 - DNA, 22 bp, Artificial Sequence
  chemically synthesized
aaatatcaaaatatcatattct

SEQ ID NO: 1234347 - DNA, 22 bp, Artificial Sequence
  chemically synthesized
cattttgaaacagaatatgata

SEQ ID NO: 1234348 - DNA, 22 bp, Artificial Sequence
  chemically synthesized
gaaatatcaaaatatcatattc

SEQ ID NO: 1234349 - DNA, 22 bp, Artificial Sequence
  chemically synthesized
tgaaatatcaaaatatcatatt

SEQ ID NO: 1234350 - DNA, 22 bp, Artificial Sequence
  chemically synthesized
tgaaacagaatatgatattttg

SEQ ID NO: 1234351 - DNA, 22 bp, Artificial Sequence
  chemically synthesized
gaaacagaatatgatattttga

SEQ ID NO: 1234352 - DNA, 22 bp, Artificial Sequence
  chemically synthesized
aaacagaatatgatattttgat

SEQ ID NO: 1234353 - DNA, 22 bp, Artificial Sequence
  chemically synthesized
cacaaagaaaatgtctttgaaa

SEQ ID NO: 1234354 - DNA, 22 bp, Artificial Sequence
  chemically synthesized
aagttacacaaagaaaatgtct

SEQ ID NO: 1234355 - DNA, 22 bp, Artificial Sequence
  chemically synthesized
tgatatttcaaagacattttct

SEQ ID NO: 1234356 - DNA, 22 bp, Artificial Sequence
  chemically synthesized
gatatttcaaagacattttctt

SEQ ID NO: 1234357 - DNA, 22 bp, Artificial Sequence
  chemically synthesized
atatttcaaagacattttcttt

SEQ ID NO: 1234358 - DNA, 22 bp, Artificial Sequence
  chemically synthesized
caaagacattttctttgtgtaa

SEQ ID NO: 1234359 - DNA, 22 bp, Artificial Sequence
  chemically synthesized
acaatattaaagttacacaaag

SEQ ID NO: 1234360 - DNA, 22 bp, Artificial Sequence
  chemically synthesized
aaagacattttctttgtgtaac

SEQ ID NO: 1234361 - DNA, 22 bp, Artificial Sequence
  chemically synthesized
ttaacaatattaaagttacaca

SEQ ID NO: 1234362 - DNA, 22 bp, Artificial Sequence
  chemically synthesized
tctttgtgtaactttaatattg

SEQ ID NO: 1234363 - DNA, 22 bp, Artificial Sequence
  chemically synthesized
ctttgtgtaactttaatattgt

SEQ ID NO: 1234364 - DNA, 22 bp, Artificial Sequence
  chemically synthesized
tgagaattgttaacaatattaa

SEQ ID NO: 1234365 - DNA, 22 bp, Artificial Sequence
  chemically synthesized
tttgtgtaactttaatattgtt

SEQ ID NO: 1234366 - DNA, 22 bp, Artificial Sequence
  chemically synthesized
tgtgtaactttaatattgttaa

SEQ ID NO: 1234367 - DNA, 22 bp, Artificial Sequence
  chemically synthesized
gtgtaactttaatattgttaac

SEQ ID NO: 1234368 - DNA, 22 bp, Artificial Sequence
  chemically synthesized
tgtaactttaatattgttaaca

SEQ ID NO: 1234369 - DNA, 22 bp, Artificial Sequence
  chemically synthesized
acattatgagaattgttaacaa

SEQ ID NO: 1234370 - DNA, 22 bp, Artificial Sequence
  chemically synthesized
taatattgttaacaattctcat

SEQ ID NO: 1234371 - DNA, 22 bp, Artificial Sequence
  chemically synthesized
aatattgttaacaattctcata

SEQ ID NO: 1234372 - DNA, 22 bp, Artificial Sequence
  chemically synthesized
atattgttaacaattctcataa

SEQ ID NO: 1234373 - DNA, 22 bp, Artificial Sequence
  chemically synthesized
ttaacaattctcataatgtcaa

SEQ ID NO: 1234374 - DNA, 22 bp, Artificial Sequence
  chemically synthesized
acaattctcataatgtcaatga

SEQ ID NO: 1234375 - DNA, 22 bp, Artificial Sequence
  chemically synthesized
gaaatatcagtgtcattgacat

SEQ ID NO: 1234376 - DNA, 22 bp, Artificial Sequence
  chemically synthesized
ggaaatatcagtgtcattgaca

SEQ ID NO: 1234377 - DNA, 22 bp, Artificial Sequence
  chemically synthesized
tggaaatatcagtgtcattgac

SEQ ID NO: 1234378 - DNA, 22 bp, Artificial Sequence
  chemically synthesized
tttggaaatatcagtgtcattg

SEQ ID NO: 1234379 - DNA, 22 bp, Artificial Sequence
  chemically synthesized
tcataatgtcaatgacactgat

SEQ ID NO: 1234380 - DNA, 22 bp, Artificial Sequence
  chemically synthesized
ataatgtcaatgacactgatat

SEQ ID NO: 1234381 - DNA, 22 bp, Artificial Sequence
  chemically synthesized
gtccgatggactctttggaaat

SEQ ID NO: 1234382 - DNA, 22 bp, Artificial Sequence
  chemically synthesized
ttagtccgatggactctttgga

SEQ ID NO: 1234383 - DNA, 22 bp, Artificial Sequence
  chemically synthesized
attagtccgatggactctttgg

SEQ ID NO: 1234384 - DNA, 22 bp, Artificial Sequence
  chemically synthesized
tttattagtccgatggactctt

SEQ ID NO: 1234385 - DNA, 22 bp, Artificial Sequence
  chemically synthesized
gtttattagtccgatggactct

SEQ ID NO: 1234386 - DNA, 22 bp, Artificial Sequence
  chemically synthesized
atatttccaaagagtccatcgg

SEQ ID NO: 1234387 - DNA, 22 bp, Artificial Sequence
  chemically synthesized
ttgtttattagtccgatggact

SEQ ID NO: 1234388 - DNA, 22 bp, Artificial Sequence
  chemically synthesized
cttgtttattagtccgatggac

SEQ ID NO: 1234389 - DNA, 22 bp, Artificial Sequence
  chemically synthesized
tcttgtttattagtccgatgga

SEQ ID NO: 1234390 - DNA, 22 bp, Artificial Sequence
  chemically synthesized
ccaaagagtccatcggactaat

SEQ ID NO: 1234391 - DNA, 22 bp, Artificial Sequence
  chemically synthesized
attttcttgtttattagtccga

SEQ ID NO: 1234392 - DNA, 22 bp, Artificial Sequence
  chemically synthesized
caaagagtccatcggactaata

SEQ ID NO: 1234393 - DNA, 22 bp, Artificial Sequence
  chemically synthesized
tgagctgattttcttgtttatt

SEQ ID NO: 1234394 - DNA, 22 bp, Artificial Sequence
  chemically synthesized
ataaacaagaaaatcagctcat

SEQ ID NO: 1234395 - DNA, 22 bp, Artificial Sequence
  chemically synthesized
cgcagccagaataatctatgag

SEQ ID NO: 1234396 - DNA, 22 bp, Artificial Sequence
  chemically synthesized
actccgcagccagaataatcta

SEQ ID NO: 1234397 - DNA, 22 bp, Artificial Sequence
  chemically synthesized
cactccgcagccagaataatct

SEQ ID NO: 1234398 - DNA, 22 bp, Artificial Sequence
  chemically synthesized
tcactccgcagccagaataatc

SEQ ID NO: 1234399 - DNA, 22 bp, Artificial Sequence
  chemically synthesized
ttcactccgcagccagaataat

SEQ ID NO: 1234400 - DNA, 22 bp, Artificial Sequence
  chemically synthesized
gatttttcactccgcagccaga

SEQ ID NO: 1234401 - DNA, 22 bp, Artificial Sequence
  chemically synthesized
atagattattctggctgcggag

SEQ ID NO: 1234402 - DNA, 22 bp, Artificial Sequence
  chemically synthesized
actagatttttcactccgcagc

SEQ ID NO: 1234403 - DNA, 22 bp, Artificial Sequence
  chemically synthesized
ttctggctgcggagtgaaaaat

SEQ ID NO: 1234404 - DNA, 22 bp, Artificial Sequence
  chemically synthesized
tggctgcggagtgaaaaatcta

SEQ ID NO: 1234405 - DNA, 22 bp, Artificial Sequence
  chemically synthesized
ggaagaaattaactagattttt

SEQ ID NO: 1234406 - DNA, 22 bp, Artificial Sequence
  chemically synthesized
gctgcggagtgaaaaatctagt

SEQ ID NO: 1234407 - DNA, 22 bp, Artificial Sequence
  chemically synthesized
aggaagaaattaactagatttt

SEQ ID NO: 1234408 - DNA, 22 bp, Artificial Sequence
  chemically synthesized
cggagtgaaaaatctagttaat

SEQ ID NO: 1234409 - DNA, 22 bp, Artificial Sequence
  chemically synthesized
tcttaggaagaaattaactaga

SEQ ID NO: 1234410 - DNA, 22 bp, Artificial Sequence
  chemically synthesized
gtcttaggaagaaattaactag

SEQ ID NO: 1234411 - DNA, 22 bp, Artificial Sequence
  chemically synthesized
cagagatgtttgtcttaggaag

SEQ ID NO: 1234412 - DNA, 22 bp, Artificial Sequence
  chemically synthesized
acagagatgtttgtcttaggaa

SEQ ID NO: 1234413 - DNA, 22 bp, Artificial Sequence
  chemically synthesized
tacagagatgtttgtcttagga

SEQ ID NO: 1234414 - DNA, 22 bp, Artificial Sequence
  chemically synthesized
gttaatttcttcctaagacaaa

SEQ ID NO: 1234415 - DNA, 22 bp, Artificial Sequence
  chemically synthesized
ttttacagagatgtttgtctta

SEQ ID NO: 1234416 - DNA, 22 bp, Artificial Sequence
  chemically synthesized
atttcttcctaagacaaacatc

SEQ ID NO: 1234417 - DNA, 22 bp, Artificial Sequence
  chemically synthesized
cttcctaagacaaacatctctg

SEQ ID NO: 1234418 - DNA, 22 bp, Artificial Sequence
  chemically synthesized
ttcctaagacaaacatctctgt

SEQ ID NO: 1234419 - DNA, 22 bp, Artificial Sequence
  chemically synthesized
tgaaagttattttacagagatg

SEQ ID NO: 1234420 - DNA, 22 bp, Artificial Sequence
  chemically synthesized
cctaagacaaacatctctgtaa

SEQ ID NO: 1234421 - DNA, 22 bp, Artificial Sequence
  chemically synthesized
ctaagacaaacatctctgtaaa

SEQ ID NO: 1234422 - DNA, 22 bp, Artificial Sequence
  chemically synthesized
agacaaacatctctgtaaaata

SEQ ID NO: 1234423 - DNA, 22 bp, Artificial Sequence
  chemically synthesized
acctatgaaagttattttacag

SEQ ID NO: 1234424 - DNA, 22 bp, Artificial Sequence
  chemically synthesized
aacctatgaaagttattttaca

SEQ ID NO: 1234425 - DNA, 22 bp, Artificial Sequence
  chemically synthesized
taacctatgaaagttattttac

SEQ ID NO: 1234426 - DNA, 22 bp, Artificial Sequence
  chemically synthesized
tcacctttaacctatgaaagtt

SEQ ID NO: 1234427 - DNA, 22 bp, Artificial Sequence
  chemically synthesized
tgtaaaataactttcataggtt

SEQ ID NO: 1234428 - DNA, 22 bp, Artificial Sequence
  chemically synthesized
taaaataactttcataggttaa

SEQ ID NO: 1234429 - DNA, 22 bp, Artificial Sequence
  chemically synthesized
agggtcattgtcacctttaacc

SEQ ID NO: 1234430 - DNA, 22 bp, Artificial Sequence
  chemically synthesized
tcataggttaaaggtgacaatg

SEQ ID NO: 1234431 - DNA, 22 bp, Artificial Sequence
  chemically synthesized
tgaattcagggtcattgtcacc

SEQ ID NO: 1234432 - DNA, 22 bp, Artificial Sequence
  chemically synthesized
cataggttaaaggtgacaatga

SEQ ID NO: 1234433 - DNA, 22 bp, Artificial Sequence
  chemically synthesized
atgaattcagggtcattgtcac

SEQ ID NO: 1234434 - DNA, 22 bp, Artificial Sequence
  chemically synthesized
ataggttaaaggtgacaatgac

SEQ ID NO: 1234435 - DNA, 22 bp, Artificial Sequence
  chemically synthesized
tatgaattcagggtcattgtca

SEQ ID NO: 1234436 - DNA, 22 bp, Artificial Sequence
  chemically synthesized
attttatgaattcagggtcatt

SEQ ID NO: 1234437 - DNA, 22 bp, Artificial Sequence
  chemically synthesized
aaggtgacaatgaccctgaatt

SEQ ID NO: 1234438 - DNA, 22 bp, Artificial Sequence
  chemically synthesized
gctgattttatgaattcagggt

SEQ ID NO: 1234439 - DNA, 22 bp, Artificial Sequence
  chemically synthesized
attggctgattttatgaattca

SEQ ID NO: 1234440 - DNA, 22 bp, Artificial Sequence
  chemically synthesized
tgcagcaattaattggctgatt

SEQ ID NO: 1234441 - DNA, 22 bp, Artificial Sequence
  chemically synthesized
aattcataaaatcagccaatta

SEQ ID NO: 1234442 - DNA, 22 bp, Artificial Sequence
  chemically synthesized
ataaaatcagccaattaattgc

SEQ ID NO: 1234443 - DNA, 22 bp, Artificial Sequence
  chemically synthesized
cataagatatggaaatggaaac

SEQ ID NO: 1234444 - DNA, 22 bp, Artificial Sequence
  chemically synthesized
attgctgcacagtttccatttc

SEQ ID NO: 1234445 - DNA, 22 bp, Artificial Sequence
  chemically synthesized
ctgcacagtttccatttccata

SEQ ID NO: 1234446 - DNA, 22 bp, Artificial Sequence
  chemically synthesized
cacagtttccatttccatatct

SEQ ID NO: 1234447 - DNA, 22 bp, Artificial Sequence
  chemically synthesized
ccatttccatatcttatgtaat

SEQ ID NO: 1234448 - DNA, 22 bp, Artificial Sequence
  chemically synthesized
catttccatatcttatgtaatg

SEQ ID NO: 1234449 - DNA, 22 bp, Artificial Sequence
  chemically synthesized
gcagggagatgacattacataa

SEQ ID NO: 1234450 - DNA, 22 bp, Artificial Sequence
  chemically synthesized
tctggcagggagatgacattac

SEQ ID NO: 1234451 - DNA, 22 bp, Artificial Sequence
  chemically synthesized
ccatatcttatgtaatgtcatc

SEQ ID NO: 1234452 - DNA, 22 bp, Artificial Sequence
  chemically synthesized
atctggcagggagatgacatta

SEQ ID NO: 1234453 - DNA, 22 bp, Artificial Sequence
  chemically synthesized
catatcttatgtaatgtcatct

SEQ ID NO: 1234454 - DNA, 22 bp, Artificial Sequence
  chemically synthesized
agcttatctggcagggagatga

SEQ ID NO: 1234455 - DNA, 22 bp, Artificial Sequence
  chemically synthesized
ctcagcttatctggcagggaga

SEQ ID NO: 1234456 - DNA, 22 bp, Artificial Sequence
  chemically synthesized
atgtaatgtcatctccctgcca

SEQ ID NO: 1234457 - DNA, 22 bp, Artificial Sequence
  chemically synthesized
tgtaatgtcatctccctgccag

SEQ ID NO: 1234458 - DNA, 22 bp, Artificial Sequence
  chemically synthesized
ccccaaatgttgctcagcttat

SEQ ID NO: 1234459 - DNA, 22 bp, Artificial Sequence
  chemically synthesized
cctgccagataagctgagcaac

SEQ ID NO: 1234460 - DNA, 22 bp, Artificial Sequence
  chemically synthesized
ccagataagctgagcaacattt

SEQ ID NO: 1234461 - DNA, 22 bp, Artificial Sequence
  chemically synthesized
ataataacatgtactcccccaa

SEQ ID NO: 1234462 - DNA, 22 bp, Artificial Sequence
  chemically synthesized
agcaacatttgggggagtacat

SEQ ID NO: 1234463 - DNA, 22 bp, Artificial Sequence
  chemically synthesized
gggggagtacatgttattatta

SEQ ID NO: 1234464 - DNA, 22 bp, Artificial Sequence
  chemically synthesized
ggggagtacatgttattattaa

SEQ ID NO: 1234465 - DNA, 22 bp, Artificial Sequence
  chemically synthesized
aaataaccataagcagggatag

SEQ ID NO: 1234466 - DNA, 22 bp, Artificial Sequence
  chemically synthesized
aaaataaccataagcagggata

SEQ ID NO: 1234467 - DNA, 22 bp, Artificial Sequence
  chemically synthesized
ttaaaataaccataagcaggga

SEQ ID NO: 1234468 - DNA, 22 bp, Artificial Sequence
  chemically synthesized
ttattaatctatccctgcttat

SEQ ID NO: 1234469 - DNA, 22 bp, Artificial Sequence
  chemically synthesized
ctcttaaaataaccataagcag

SEQ ID NO: 1234470 - DNA, 22 bp, Artificial Sequence
  chemically synthesized
ttaatctatccctgcttatggt

SEQ ID NO: 1234471 - DNA, 22 bp, Artificial Sequence
  chemically synthesized
actcttaaaataaccataagca

SEQ ID NO: 1234472 - DNA, 22 bp, Artificial Sequence
  chemically synthesized
atctatccctgcttatggttat

SEQ ID NO: 1234473 - DNA, 22 bp, Artificial Sequence
  chemically synthesized
atcacttactcttaaaataacc

SEQ ID NO: 1234474 - DNA, 22 bp, Artificial Sequence
  chemically synthesized
tccctgcttatggttattttaa

SEQ ID NO: 1234475 - DNA, 22 bp, Artificial Sequence
  chemically synthesized
cttatggttattttaagagtaa

SEQ ID NO: 1234476 - DNA, 22 bp, Artificial Sequence
  chemically synthesized
agtacgttgatcacttactctt

SEQ ID NO: 1234477 - DNA, 22 bp, Artificial Sequence
  chemically synthesized
atggttattttaagagtaagtg

SEQ ID NO: 1234478 - DNA, 22 bp, Artificial Sequence
  chemically synthesized
tggttattttaagagtaagtga

SEQ ID NO: 1234479 - DNA, 22 bp, Artificial Sequence
  chemically synthesized
ttttaagagtaagtgatcaacg

SEQ ID NO: 1234480 - DNA, 22 bp, Artificial Sequence
  chemically synthesized
aagtacattgagtacgttgatc

SEQ ID NO: 1234481 - DNA, 22 bp, Artificial Sequence
  chemically synthesized
taagagtaagtgatcaacgtac

SEQ ID NO: 1234482 - DNA, 22 bp, Artificial Sequence
  chemically synthesized
aagagtaagtgatcaacgtact

SEQ ID NO: 1234483 - DNA, 22 bp, Artificial Sequence
  chemically synthesized
agagtaagtgatcaacgtactc

SEQ ID NO: 1234484 - DNA, 22 bp, Artificial Sequence
  chemically synthesized
aaagataaactcaagtacattg

SEQ ID NO: 1234485 - DNA, 22 bp, Artificial Sequence
  chemically synthesized
caaagataaactcaagtacatt

SEQ ID NO: 1234486 - DNA, 22 bp, Artificial Sequence
  chemically synthesized
tcaaagataaactcaagtacat

SEQ ID NO: 1234487 - DNA, 22 bp, Artificial Sequence
  chemically synthesized
tttcaaagataaactcaagtac

SEQ ID NO: 1234488 - DNA, 22 bp, Artificial Sequence
  chemically synthesized
tctttcaaagataaactcaagt

SEQ ID NO: 1234489 - DNA, 22 bp, Artificial Sequence
  chemically synthesized
tctctttcaaagataaactcaa

SEQ ID NO: 1234490 - DNA, 22 bp, Artificial Sequence
  chemically synthesized
cctctctctttcaaagataaac

SEQ ID NO: 1234491 - DNA, 22 bp, Artificial Sequence
  chemically synthesized
aatgtacttgagtttatctttg

SEQ ID NO: 1234492 - DNA, 22 bp, Artificial Sequence
  chemically synthesized
cattacctctctctttcaaaga

SEQ ID NO: 1234493 - DNA, 22 bp, Artificial Sequence
  chemically synthesized
attacattacctctctctttca

SEQ ID NO: 1234494 - DNA, 22 bp, Artificial Sequence
  chemically synthesized
gagtttatctttgaaagagaga

SEQ ID NO: 1234495 - DNA, 22 bp, Artificial Sequence
  chemically synthesized
agtttatctttgaaagagagag

SEQ ID NO: 1234496 - DNA, 22 bp, Artificial Sequence
  chemically synthesized
cctaattacattacctctctct

SEQ ID NO: 1234497 - DNA, 22 bp, Artificial Sequence
  chemically synthesized
atctttgaaagagagaggtaat

SEQ ID NO: 1234498 - DNA, 22 bp, Artificial Sequence
  chemically synthesized
tctttgaaagagagaggtaatg

SEQ ID NO: 1234499 - DNA, 22 bp, Artificial Sequence
  chemically synthesized
gtagctccctaattacattacc

SEQ ID NO: 1234500 - DNA, 22 bp, Artificial Sequence
  chemically synthesized
tgaaagagagaggtaatgtaat

SEQ ID NO: 1234501 - DNA, 22 bp, Artificial Sequence
  chemically synthesized
agtagctccctaattacattac

SEQ ID NO: 1234502 - DNA, 22 bp, Artificial Sequence
  chemically synthesized
gaaagagagaggtaatgtaatt

SEQ ID NO: 1234503 - DNA, 22 bp, Artificial Sequence
  chemically synthesized
aaagagagaggtaatgtaatta

SEQ ID NO: 1234504 - DNA, 22 bp, Artificial Sequence
  chemically synthesized
accaggcacttagtagctccct

SEQ ID NO: 1234505 - DNA, 22 bp, Artificial Sequence
  chemically synthesized
caccaggcacttagtagctccc

SEQ ID NO: 1234506 - DNA, 22 bp, Artificial Sequence
  chemically synthesized
gggagctactaagtgcctggtg

SEQ ID NO: 1234507 - DNA, 22 bp, Artificial Sequence
  chemically synthesized
atcgaccaatacatttcaccag

SEQ ID NO: 1234508 - DNA, 22 bp, Artificial Sequence
  chemically synthesized
ctaagtgcctggtgaaatgtat

SEQ ID NO: 1234509 - DNA, 22 bp, Artificial Sequence
  chemically synthesized
tctaatcgaccaatacatttca

SEQ ID NO: 1234510 - DNA, 22 bp, Artificial Sequence
  chemically synthesized
agtgcctggtgaaatgtattgg

SEQ ID NO: 1234511 - DNA, 22 bp, Artificial Sequence
  chemically synthesized
aaatctgtctaatcgaccaata

SEQ ID NO: 1234512 - DNA, 22 bp, Artificial Sequence
  chemically synthesized
gtgaaatgtattggtcgattag

SEQ ID NO: 1234513 - DNA, 22 bp, Artificial Sequence
  chemically synthesized
acatcctaaaatctgtctaatc

SEQ ID NO: 1234514 - DNA, 22 bp, Artificial Sequence
  chemically synthesized
ttaacatcctaaaatctgtcta

SEQ ID NO: 1234515 - DNA, 22 bp, Artificial Sequence
  chemically synthesized
attaacatcctaaaatctgtct

SEQ ID NO: 1234516 - DNA, 22 bp, Artificial Sequence
  chemically synthesized
ttattaacatcctaaaatctgt

SEQ ID NO: 1234517 - DNA, 22 bp, Artificial Sequence
  chemically synthesized
cttattaacatcctaaaatctg

SEQ ID NO: 1234518 - DNA, 22 bp, Artificial Sequence
  chemically synthesized
tcttattaacatcctaaaatct

SEQ ID NO: 1234519 - DNA, 22 bp, Artificial Sequence
  chemically synthesized
gtcgattagacagattttagga

SEQ ID NO: 1234520 - DNA, 22 bp, Artificial Sequence
  chemically synthesized
ctttcttattaacatcctaaaa

SEQ ID NO: 1234521 - DNA, 22 bp, Artificial Sequence
  chemically synthesized
cctttcttattaacatcctaaa

SEQ ID NO: 1234522 - DNA, 22 bp, Artificial Sequence
  chemically synthesized
gacagattttaggatgttaata

SEQ ID NO: 1234523 - DNA, 22 bp, Artificial Sequence
  chemically synthesized
gaggcagccttcctttcttatt

SEQ ID NO: 1234524 - DNA, 22 bp, Artificial Sequence
  chemically synthesized
taggatgttaataagaaaggaa

SEQ ID NO: 1234525 - DNA, 22 bp, Artificial Sequence
  chemically synthesized
aggatgttaataagaaaggaag

SEQ ID NO: 1234526 - DNA, 22 bp, Artificial Sequence
  chemically synthesized
ggatgttaataagaaaggaagg

SEQ ID NO: 1234527 - DNA, 22 bp, Artificial Sequence
  chemically synthesized
ataagaaaggaaggctgcctcc

SEQ ID NO: 1234528 - DNA, 22 bp, Artificial Sequence
  chemically synthesized
tgtcatggcattggaggcagcc

SEQ ID NO: 1234529 - DNA, 22 bp, Artificial Sequence
  chemically synthesized
ccctgtgtcatggcattggagg

SEQ ID NO: 1234530 - DNA, 22 bp, Artificial Sequence
  chemically synthesized
cccctgtgtcatggcattggag

SEQ ID NO: 1234531 - DNA, 22 bp, Artificial Sequence
  chemically synthesized
ttcccctgtgtcatggcattgg

SEQ ID NO: 1234532 - DNA, 22 bp, Artificial Sequence
  chemically synthesized
gtgactcttcccctgtgtcatg

SEQ ID NO: 1234533 - DNA, 22 bp, Artificial Sequence
  chemically synthesized
ggtgactcttcccctgtgtcat

SEQ ID NO: 1234534 - DNA, 22 bp, Artificial Sequence
  chemically synthesized
cctccaatgccatgacacaggg

SEQ ID NO: 1234535 - DNA, 22 bp, Artificial Sequence
  chemically synthesized
caatgccatgacacaggggaag

SEQ ID NO: 1234536 - DNA, 22 bp, Artificial Sequence
  chemically synthesized
aaccacttggtgactcttcccc

SEQ ID NO: 1234537 - DNA, 22 bp, Artificial Sequence
  chemically synthesized
tgaaccacttggtgactcttcc

SEQ ID NO: 1234538 - DNA, 22 bp, Artificial Sequence
  chemically synthesized
ctctgaaccacttggtgactct

SEQ ID NO: 1234539 - DNA, 22 bp, Artificial Sequence
  chemically synthesized
atctcctctgaaccacttggtg

SEQ ID NO: 1234540 - DNA, 22 bp, Artificial Sequence
  chemically synthesized
taatctcctctgaaccacttgg

SEQ ID NO: 1234541 - DNA, 22 bp, Artificial Sequence
  chemically synthesized
agaggagattagaattcctctg

SEQ ID NO: 1234542 - DNA, 22 bp, Artificial Sequence
  chemically synthesized
aaccaagtaggcaggtcagagg

SEQ ID NO: 1234543 - DNA, 22 bp, Artificial Sequence
  chemically synthesized
gaattcctctgacctgcctact

SEQ ID NO: 1234544 - DNA, 22 bp, Artificial Sequence
  chemically synthesized
ctctgacctgcctacttggttt

SEQ ID NO: 1234545 - DNA, 22 bp, Artificial Sequence
  chemically synthesized
tgacctgcctacttggtttagc

SEQ ID NO: 1234546 - DNA, 22 bp, Artificial Sequence
  chemically synthesized
acctgcctacttggtttagctg

SEQ ID NO: 1234547 - DNA, 22 bp, Artificial Sequence
  chemically synthesized
cctacttggtttagctgtgact

SEQ ID NO: 1234548 - DNA, 22 bp, Artificial Sequence
  chemically synthesized
gaagaagtaaacagtcacagct

SEQ ID NO: 1234549 - DNA, 22 bp, Artificial Sequence
  chemically synthesized
cttggtttagctgtgactgttt

SEQ ID NO: 1234550 - DNA, 22 bp, Artificial Sequence
  chemically synthesized
cattagaagaagtaaacagtca

SEQ ID NO: 1234551 - DNA, 22 bp, Artificial Sequence
  chemically synthesized
ggtttagctgtgactgtttact

SEQ ID NO: 1234552 - DNA, 22 bp, Artificial Sequence
  chemically synthesized
gtttagctgtgactgtttactt

SEQ ID NO: 1234553 - DNA, 22 bp, Artificial Sequence
  chemically synthesized
agctgtgactgtttacttcttc

SEQ ID NO: 1234554 - DNA, 22 bp, Artificial Sequence
  chemically synthesized
gctgtgactgtttacttcttct

SEQ ID NO: 1234555 - DNA, 22 bp, Artificial Sequence
  chemically synthesized
tgactgtttacttcttctaatg

SEQ ID NO: 1234556 - DNA, 22 bp, Artificial Sequence
  chemically synthesized
aaatacgtgtgttgcattagaa

SEQ ID NO: 1234557 - DNA, 22 bp, Artificial Sequence
  chemically synthesized
tttacttcttctaatgcaacac

SEQ ID NO: 1234558 - DNA, 22 bp, Artificial Sequence
  chemically synthesized
gattaaaatacgtgtgttgcat

SEQ ID NO: 1234559 - DNA, 22 bp, Artificial Sequence
  chemically synthesized
acttcttctaatgcaacacacg

SEQ ID NO: 1234560 - DNA, 22 bp, Artificial Sequence
  chemically synthesized
cttcttctaatgcaacacacgt

SEQ ID NO: 1234561 - DNA, 22 bp, Artificial Sequence
  chemically synthesized
actggattaaaatacgtgtgtt

SEQ ID NO: 1234562 - DNA, 22 bp, Artificial Sequence
  chemically synthesized
aactggattaaaatacgtgtgt

SEQ ID NO: 1234563 - DNA, 22 bp, Artificial Sequence
  chemically synthesized
cttctaatgcaacacacgtatt

SEQ ID NO: 1234564 - DNA, 22 bp, Artificial Sequence
  chemically synthesized
ttctaatgcaacacacgtattt

SEQ ID NO: 1234565 - DNA, 22 bp, Artificial Sequence
  chemically synthesized
ctaatgcaacacacgtatttta

SEQ ID NO: 1234566 - DNA, 22 bp, Artificial Sequence
  chemically synthesized
taatgcaacacacgtattttaa

SEQ ID NO: 1234567 - DNA, 22 bp, Artificial Sequence
  chemically synthesized
gatttaactggattaaaatacg

SEQ ID NO: 1234568 - DNA, 22 bp, Artificial Sequence
  chemically synthesized
agatttaactggattaaaatac

SEQ ID NO: 1234569 - DNA, 22 bp, Artificial Sequence
  chemically synthesized
atgcaacacacgtattttaatc

SEQ ID NO: 1234570 - DNA, 22 bp, Artificial Sequence
  chemically synthesized
gtttagatttaactggattaaa

SEQ ID NO: 1234571 - DNA, 22 bp, Artificial Sequence
  chemically synthesized
ggtttagatttaactggattaa

SEQ ID NO: 1234572 - DNA, 22 bp, Artificial Sequence
  chemically synthesized
tggtttagatttaactggatta

SEQ ID NO: 1234573 - DNA, 22 bp, Artificial Sequence
  chemically synthesized
ttggtttagatttaactggatt

SEQ ID NO: 1234574 - DNA, 22 bp, Artificial Sequence
  chemically synthesized
tttggtttagatttaactggat

SEQ ID NO: 1234575 - DNA, 22 bp, Artificial Sequence
  chemically synthesized
ttttggtttagatttaactgga

SEQ ID NO: 1234576 - DNA, 22 bp, Artificial Sequence
  chemically synthesized
tttttttggtttagatttaact

SEQ ID NO: 1234577 - DNA, 22 bp, Artificial Sequence
  chemically synthesized
gtttttttggtttagatttaac

SEQ ID NO: 1234578 - DNA, 22 bp, Artificial Sequence
  chemically synthesized
taatccagttaaatctaaacca

SEQ ID NO: 1234579 - DNA, 22 bp, Artificial Sequence
  chemically synthesized
aatccagttaaatctaaaccaa

SEQ ID NO: 1234580 - DNA, 22 bp, Artificial Sequence
  chemically synthesized
atccagttaaatctaaaccaaa

SEQ ID NO: 1234581 - DNA, 22 bp, Artificial Sequence
  chemically synthesized
aatctaaaccaaaaaaacaaat

SEQ ID NO: 1234582 - DNA, 22 bp, Artificial Sequence
  chemically synthesized
gggtatgaatggcagatttgtt

SEQ ID NO: 1234583 - DNA, 22 bp, Artificial Sequence
  chemically synthesized
ggggtatgaatggcagatttgt

SEQ ID NO: 1234584 - DNA, 22 bp, Artificial Sequence
  chemically synthesized
aaccaaaaaaacaaatctgcca

SEQ ID NO: 1234585 - DNA, 22 bp, Artificial Sequence
  chemically synthesized
cttggggtatgaatggcagatt

SEQ ID NO: 1234586 - DNA, 22 bp, Artificial Sequence
  chemically synthesized
acttggggtatgaatggcagat

SEQ ID NO: 1234587 - DNA, 22 bp, Artificial Sequence
  chemically synthesized
tacttggggtatgaatggcaga

SEQ ID NO: 1234588 - DNA, 22 bp, Artificial Sequence
  chemically synthesized
ttacttggggtatgaatggcag

SEQ ID NO: 1234589 - DNA, 22 bp, Artificial Sequence
  chemically synthesized
tttttacttggggtatgaatgg

SEQ ID NO: 1234590 - DNA, 22 bp, Artificial Sequence
  chemically synthesized
ccattcataccccaagtaaaaa

SEQ ID NO: 1234591 - DNA, 22 bp, Artificial Sequence
  chemically synthesized
tacagaaacatcactattttta

SEQ ID NO: 1234592 - DNA, 22 bp, Artificial Sequence
  chemically synthesized
ataccccaagtaaaaatagtga

SEQ ID NO: 1234593 - DNA, 22 bp, Artificial Sequence
  chemically synthesized
caagcatataaattatacagaa

SEQ ID NO: 1234594 - DNA, 22 bp, Artificial Sequence
  chemically synthesized
tctccaagcatataaattatac

SEQ ID NO: 1234595 - DNA, 22 bp, Artificial Sequence
  chemically synthesized
aacgctgtctccaagcatataa

SEQ ID NO: 1234596 - DNA, 22 bp, Artificial Sequence
  chemically synthesized
ctgtataatttatatgcttgga

SEQ ID NO: 1234597 - DNA, 22 bp, Artificial Sequence
  chemically synthesized
ttaaacgctgtctccaagcata

SEQ ID NO: 1234598 - DNA, 22 bp, Artificial Sequence
  chemically synthesized
tgtataatttatatgcttggag

SEQ ID NO: 1234599 - DNA, 22 bp, Artificial Sequence
  chemically synthesized
attaaacgctgtctccaagcat

SEQ ID NO: 1234600 - DNA, 22 bp, Artificial Sequence
  chemically synthesized
tataatttatatgcttggagac

SEQ ID NO: 1234601 - DNA, 22 bp, Artificial Sequence
  chemically synthesized
atatgcttggagacagcgttta

SEQ ID NO: 1234602 - DNA, 22 bp, Artificial Sequence
  chemically synthesized
tatgcttggagacagcgtttaa

SEQ ID NO: 1234603 - DNA, 22 bp, Artificial Sequence
  chemically synthesized
aatcaagccaacacttattaaa

SEQ ID NO: 1234604 - DNA, 22 bp, Artificial Sequence
  chemically synthesized
aaatcaagccaacacttattaa

SEQ ID NO: 1234605 - DNA, 22 bp, Artificial Sequence
  chemically synthesized
ggagacagcgtttaataagtgt

SEQ ID NO: 1234606 - DNA, 22 bp, Artificial Sequence
  chemically synthesized
gagacagcgtttaataagtgtt

SEQ ID NO: 1234607 - DNA, 22 bp, Artificial Sequence
  chemically synthesized
tttaaatcaagccaacacttat

SEQ ID NO: 1234608 - DNA, 22 bp, Artificial Sequence
  chemically synthesized
gtttaaatcaagccaacactta

SEQ ID NO: 1234609 - DNA, 22 bp, Artificial Sequence
  chemically synthesized
aataagtgttggcttgatttaa

SEQ ID NO: 1234610 - DNA, 22 bp, Artificial Sequence
  chemically synthesized
ataagtgttggcttgatttaaa

SEQ ID NO: 1234611 - DNA, 22 bp, Artificial Sequence
  chemically synthesized
ataatgatgtttgtttaaatca

SEQ ID NO: 1234612 - DNA, 22 bp, Artificial Sequence
  chemically synthesized
aaacctgataatgatgtttgtt

SEQ ID NO: 1234613 - DNA, 22 bp, Artificial Sequence
  chemically synthesized
gcttgatttaaacaaacatcat

SEQ ID NO: 1234614 - DNA, 22 bp, Artificial Sequence
  chemically synthesized
gatttaaacaaacatcattatc

SEQ ID NO: 1234615 - DNA, 22 bp, Artificial Sequence
  chemically synthesized
atttaaacaaacatcattatca

SEQ ID NO: 1234616 - DNA, 22 bp, Artificial Sequence
  chemically synthesized
aatgtgttcaaacctgataatg

SEQ ID NO: 1234617 - DNA, 22 bp, Artificial Sequence
  chemically synthesized
aaacaaacatcattatcaggtt

SEQ ID NO: 1234618 - DNA, 22 bp, Artificial Sequence
  chemically synthesized
aacaaacatcattatcaggttt

SEQ ID NO: 1234619 - DNA, 22 bp, Artificial Sequence
  chemically synthesized
tgtactaaatgtgttcaaacct

SEQ ID NO: 1234620 - DNA, 22 bp, Artificial Sequence
  chemically synthesized
atgtactaaatgtgttcaaacc

SEQ ID NO: 1234621 - DNA, 22 bp, Artificial Sequence
  chemically synthesized
tcaggtttgaacacatttagta

SEQ ID NO: 1234622 - DNA, 22 bp, Artificial Sequence
  chemically synthesized
taccaaatatttatgtactaaa

SEQ ID NO: 1234623 - DNA, 22 bp, Artificial Sequence
  chemically synthesized
tataccaaatatttatgtacta

SEQ ID NO: 1234624 - DNA, 22 bp, Artificial Sequence
  chemically synthesized
ctataccaaatatttatgtact

SEQ ID NO: 1234625 - DNA, 22 bp, Artificial Sequence
  chemically synthesized
tctataccaaatatttatgtac

SEQ ID NO: 1234626 - DNA, 22 bp, Artificial Sequence
  chemically synthesized
gaacacatttagtacataaata

SEQ ID NO: 1234627 - DNA, 22 bp, Artificial Sequence
  chemically synthesized
ttctataccaaatatttatgta

SEQ ID NO: 1234628 - DNA, 22 bp, Artificial Sequence
  chemically synthesized
aacacatttagtacataaatat

SEQ ID NO: 1234629 - DNA, 22 bp, Artificial Sequence
  chemically synthesized
agtacataaatatttggtatag

SEQ ID NO: 1234630 - DNA, 22 bp, Artificial Sequence
  chemically synthesized
gtacataaatatttggtataga

SEQ ID NO: 1234631 - DNA, 22 bp, Artificial Sequence
  chemically synthesized
tgcaacaaacggatttttctat

SEQ ID NO: 1234632 - DNA, 22 bp, Artificial Sequence
  chemically synthesized
gtgcaacaaacggatttttcta

SEQ ID NO: 1234633 - DNA, 22 bp, Artificial Sequence
  chemically synthesized
tgtgcaacaaacggatttttct

SEQ ID NO: 1234634 - DNA, 22 bp, Artificial Sequence
  chemically synthesized
ggtatagaaaaatccgtttgtt

SEQ ID NO: 1234635 - DNA, 22 bp, Artificial Sequence
  chemically synthesized
gtatagaaaaatccgtttgttg

SEQ ID NO: 1234636 - DNA, 22 bp, Artificial Sequence
  chemically synthesized
cggcagtgttttgtgcaacaaa

SEQ ID NO: 1234637 - DNA, 22 bp, Artificial Sequence
  chemically synthesized
acggcagtgttttgtgcaacaa

SEQ ID NO: 1234638 - DNA, 22 bp, Artificial Sequence
  chemically synthesized
ttacggcagtgttttgtgcaac

SEQ ID NO: 1234639 - DNA, 22 bp, Artificial Sequence
  chemically synthesized
cttacggcagtgttttgtgcaa

SEQ ID NO: 1234640 - DNA, 22 bp, Artificial Sequence
  chemically synthesized
tttcttacggcagtgttttgtg

SEQ ID NO: 1234641 - DNA, 22 bp, Artificial Sequence
  chemically synthesized
tgtttcttacggcagtgttttg

SEQ ID NO: 1234642 - DNA, 22 bp, Artificial Sequence
  chemically synthesized
gttgcacaaaacactgccgtaa

SEQ ID NO: 1234643 - DNA, 22 bp, Artificial Sequence
  chemically synthesized
ttgcacaaaacactgccgtaag

SEQ ID NO: 1234644 - DNA, 22 bp, Artificial Sequence
  chemically synthesized
cacaaaacactgccgtaagaaa

SEQ ID NO: 1234645 - DNA, 22 bp, Artificial Sequence
  chemically synthesized
ccgtaagaaacagagttcaccg

SEQ ID NO: 1234646 - DNA, 22 bp, Artificial Sequence
  chemically synthesized
caggcgtgagccaccgtgcccg

SEQ ID NO: 1234647 - DNA, 22 bp, Artificial Sequence
  chemically synthesized
agattacaggcgtgagccaccg

SEQ ID NO: 1234648 - DNA, 22 bp, Artificial Sequence
  chemically synthesized
accgggcacggtggctcacgcc

SEQ ID NO: 1234649 - DNA, 22 bp, Artificial Sequence
  chemically synthesized
ccgaagtgctgagattacaggc

SEQ ID NO: 1234650 - DNA, 22 bp, Artificial Sequence
  chemically synthesized
agcctcccgaagtgctgagatt

SEQ ID NO: 1234651 - DNA, 22 bp, Artificial Sequence
  chemically synthesized
acgcctgtaatctcagcacttc

SEQ ID NO: 1234652 - DNA, 22 bp, Artificial Sequence
  chemically synthesized
cctcagcctcccgaagtgctga

SEQ ID NO: 1234653 - DNA, 22 bp, Artificial Sequence
  chemically synthesized
taatctcagcacttcgggaggc

SEQ ID NO: 1234654 - DNA, 22 bp, Artificial Sequence
  chemically synthesized
agcacttcgggaggctgaggca

SEQ ID NO: 1234655 - DNA, 22 bp, Artificial Sequence
  chemically synthesized
aggtgatccacctgcctcagcc

SEQ ID NO: 1234656 - DNA, 22 bp, Artificial Sequence
  chemically synthesized
acctcaggtgatccacctgcct

SEQ ID NO: 1234657 - DNA, 22 bp, Artificial Sequence
  chemically synthesized
cgggaggctgaggcaggtggat

SEQ ID NO: 1234658 - DNA, 22 bp, Artificial Sequence
  chemically synthesized
gggaggctgaggcaggtggatc

SEQ ID NO: 1234659 - DNA, 22 bp, Artificial Sequence
  chemically synthesized
ctgacctcaggtgatccacctg

SEQ ID NO: 1234660 - DNA, 22 bp, Artificial Sequence
  chemically synthesized
gaactcctgacctcaggtgatc

SEQ ID NO: 1234661 - DNA, 22 bp, Artificial Sequence
  chemically synthesized
aggcaggtggatcacctgaggt

SEQ ID NO: 1234662 - DNA, 22 bp, Artificial Sequence
  chemically synthesized
gtctcgaactcctgacctcagg

SEQ ID NO: 1234663 - DNA, 22 bp, Artificial Sequence
  chemically synthesized
gccaaggctagtctcgaactcc

SEQ ID NO: 1234664 - DNA, 22 bp, Artificial Sequence
  chemically synthesized
aggtcaggagttcgagactagc

SEQ ID NO: 1234665 - DNA, 22 bp, Artificial Sequence
  chemically synthesized
accatgttggccaaggctagtc

SEQ ID NO: 1234666 - DNA, 22 bp, Artificial Sequence
  chemically synthesized
caccatgttggccaaggctagt

SEQ ID NO: 1234667 - DNA, 22 bp, Artificial Sequence
  chemically synthesized
gagactagccttggccaacatg

SEQ ID NO: 1234668 - DNA, 22 bp, Artificial Sequence
  chemically synthesized
gtagagacagggtttcaccatg

SEQ ID NO: 1234669 - DNA, 22 bp, Artificial Sequence
  chemically synthesized
gccttggccaacatggtgaaac

SEQ ID NO: 1234670 - DNA, 22 bp, Artificial Sequence
  chemically synthesized
agtagagacagggtttcaccat

SEQ ID NO: 1234671 - DNA, 22 bp, Artificial Sequence
  chemically synthesized
tagtagagacagggtttcacca

SEQ ID NO: 1234672 - DNA, 22 bp, Artificial Sequence
  chemically synthesized
ttagtagagacagggtttcacc

SEQ ID NO: 1234673 - DNA, 22 bp, Artificial Sequence
  chemically synthesized
ggccaacatggtgaaaccctgt

SEQ ID NO: 1234674 - DNA, 22 bp, Artificial Sequence
  chemically synthesized
gccaacatggtgaaaccctgtc

SEQ ID NO: 1234675 - DNA, 22 bp, Artificial Sequence
  chemically synthesized
tatttttagtagagacagggtt

SEQ ID NO: 1234676 - DNA, 22 bp, Artificial Sequence
  chemically synthesized
gtatttttagtagagacagggt

SEQ ID NO: 1234677 - DNA, 22 bp, Artificial Sequence
  chemically synthesized
tgtatttttagtagagacaggg

SEQ ID NO: 1234678 - DNA, 22 bp, Artificial Sequence
  chemically synthesized
ttgtatttttagtagagacagg

SEQ ID NO: 1234679 - DNA, 22 bp, Artificial Sequence
  chemically synthesized
atttttgtatttttagtagaga

SEQ ID NO: 1234680 - DNA, 22 bp, Artificial Sequence
  chemically synthesized
tggccagctaatttttgtattt

SEQ ID NO: 1234681 - DNA, 22 bp, Artificial Sequence
  chemically synthesized
tctctactaaaaatacaaaaat

SEQ ID NO: 1234682 - DNA, 22 bp, Artificial Sequence
  chemically synthesized
tactaaaaatacaaaaattagc

SEQ ID NO: 1234683 - DNA, 22 bp, Artificial Sequence
  chemically synthesized
ctaaaaatacaaaaattagctg

SEQ ID NO: 1234684 - DNA, 22 bp, Artificial Sequence
  chemically synthesized
aaaatacaaaaattagctggcc

SEQ ID NO: 1234685 - DNA, 22 bp, Artificial Sequence
  chemically synthesized
caggcacatgccactatggcca

SEQ ID NO: 1234686 - DNA, 22 bp, Artificial Sequence
  chemically synthesized
ggattacaggcacatgccacta

SEQ ID NO: 1234687 - DNA, 22 bp, Artificial Sequence
  chemically synthesized
gctggccatagtggcatgtgcc

SEQ ID NO: 1234688 - DNA, 22 bp, Artificial Sequence
  chemically synthesized
gccatagtggcatgtgcctgta

SEQ ID NO: 1234689 - DNA, 22 bp, Artificial Sequence
  chemically synthesized
ccgagtagctgggattacaggc

SEQ ID NO: 1234690 - DNA, 22 bp, Artificial Sequence
  chemically synthesized
agcctcccgagtagctgggatt

SEQ ID NO: 1234691 - DNA, 22 bp, Artificial Sequence
  chemically synthesized
tctcagcctcccgagtagctgg

SEQ ID NO: 1234692 - DNA, 22 bp, Artificial Sequence
  chemically synthesized
ctgtctcagcctcccgagtagc

SEQ ID NO: 1234693 - DNA, 22 bp, Artificial Sequence
  chemically synthesized
tcctgtctcagcctcccgagta

SEQ ID NO: 1234694 - DNA, 22 bp, Artificial Sequence
  chemically synthesized
taatcccagctactcgggaggc

SEQ ID NO: 1234695 - DNA, 22 bp, Artificial Sequence
  chemically synthesized
ttctcctgtctcagcctcccga

SEQ ID NO: 1234696 - DNA, 22 bp, Artificial Sequence
  chemically synthesized
agctattctcctgtctcagcct

SEQ ID NO: 1234697 - DNA, 22 bp, Artificial Sequence
  chemically synthesized
aagctattctcctgtctcagcc

SEQ ID NO: 1234698 - DNA, 22 bp, Artificial Sequence
  chemically synthesized
ctcgggaggctgagacaggaga

SEQ ID NO: 1234699 - DNA, 22 bp, Artificial Sequence
  chemically synthesized
caggtttaagctattctcctgt

SEQ ID NO: 1234700 - DNA, 22 bp, Artificial Sequence
  chemically synthesized
gggaggctgagacaggagaata

SEQ ID NO: 1234701 - DNA, 22 bp, Artificial Sequence
  chemically synthesized
ccaggtttaagctattctcctg

SEQ ID NO: 1234702 - DNA, 22 bp, Artificial Sequence
  chemically synthesized
ccttccaggtttaagctattct

SEQ ID NO: 1234703 - DNA, 22 bp, Artificial Sequence
  chemically synthesized
tgccttccaggtttaagctatt

SEQ ID NO: 1234704 - DNA, 22 bp, Artificial Sequence
  chemically synthesized
agacaggagaatagcttaaacc

SEQ ID NO: 1234705 - DNA, 22 bp, Artificial Sequence
  chemically synthesized
caaactctgccttccaggttta

SEQ ID NO: 1234706 - DNA, 22 bp, Artificial Sequence
  chemically synthesized
actgcaaactctgccttccagg

SEQ ID NO: 1234707 - DNA, 22 bp, Artificial Sequence
  chemically synthesized
ggctcactgcaaactctgcctt

SEQ ID NO: 1234708 - DNA, 22 bp, Artificial Sequence
  chemically synthesized
aaacctggaaggcagagtttgc

SEQ ID NO: 1234709 - DNA, 22 bp, Artificial Sequence
  chemically synthesized
aacctggaaggcagagtttgca

SEQ ID NO: 1234710 - DNA, 22 bp, Artificial Sequence
  chemically synthesized
gaaggcagagtttgcagtgagc

SEQ ID NO: 1234711 - DNA, 22 bp, Artificial Sequence
  chemically synthesized
gagtgcagtggcgtgatctcgg

SEQ ID NO: 1234712 - DNA, 22 bp, Artificial Sequence
  chemically synthesized
gcagtgagccgagatcacgcca

SEQ ID NO: 1234713 - DNA, 22 bp, Artificial Sequence
  chemically synthesized
cagtgagccgagatcacgccac

SEQ ID NO: 1234714 - DNA, 22 bp, Artificial Sequence
  chemically synthesized
tcccaggctggagtgcagtggc

SEQ ID NO: 1234715 - DNA, 22 bp, Artificial Sequence
  chemically synthesized
tgtcccaggctggagtgcagtg

SEQ ID NO: 1234716 - DNA, 22 bp, Artificial Sequence
  chemically synthesized
ctgtcccaggctggagtgcagt

SEQ ID NO: 1234717 - DNA, 22 bp, Artificial Sequence
  chemically synthesized
ttctgtcccaggctggagtgca

SEQ ID NO: 1234718 - DNA, 22 bp, Artificial Sequence
  chemically synthesized
gctcttctgtcccaggctggag

SEQ ID NO: 1234719 - DNA, 22 bp, Artificial Sequence
  chemically synthesized
cactccagcctgggacagaaga

SEQ ID NO: 1234720 - DNA, 22 bp, Artificial Sequence
  chemically synthesized
agatggagtctcgctcttctgt

SEQ ID NO: 1234721 - DNA, 22 bp, Artificial Sequence
  chemically synthesized
gagatggagtctcgctcttctg

SEQ ID NO: 1234722 - DNA, 22 bp, Artificial Sequence
  chemically synthesized
tgagatggagtctcgctcttct

SEQ ID NO: 1234723 - DNA, 22 bp, Artificial Sequence
  chemically synthesized
cagcctgggacagaagagcgag

SEQ ID NO: 1234724 - DNA, 22 bp, Artificial Sequence
  chemically synthesized
ttgagatggagtctcgctcttc

SEQ ID NO: 1234725 - DNA, 22 bp, Artificial Sequence
  chemically synthesized
tttgagatggagtctcgctctt

SEQ ID NO: 1234726 - DNA, 22 bp, Artificial Sequence
  chemically synthesized
ttttgagatggagtctcgctct

SEQ ID NO: 1234727 - DNA, 22 bp, Artificial Sequence
  chemically synthesized
tttttgagatggagtctcgctc

SEQ ID NO: 1234728 - DNA, 22 bp, Artificial Sequence
  chemically synthesized
ttttttgagatggagtctcgct

SEQ ID NO: 1234729 - DNA, 22 bp, Artificial Sequence
  chemically synthesized
tttttttgagatggagtctcgc

SEQ ID NO: 1234730 - DNA, 22 bp, Artificial Sequence
  chemically synthesized
ttttttttgagatggagtctcg

SEQ ID NO: 1234731 - DNA, 22 bp, Artificial Sequence
  chemically synthesized
ggacagaagagcgagactccat

SEQ ID NO: 1234732 - DNA, 22 bp, Artificial Sequence
  chemically synthesized
tttttttttgagatggagtctc

SEQ ID NO: 1234733 - DNA, 22 bp, Artificial Sequence
  chemically synthesized
ttttttttttgagatggagtct

SEQ ID NO: 1234734 - DNA, 22 bp, Artificial Sequence
  chemically synthesized
tttttttttttgagatggagtc

SEQ ID NO: 1234735 - DNA, 22 bp, Artificial Sequence
  chemically synthesized
ttttttttttttgagatggagt

SEQ ID NO: 1234736 - DNA, 22 bp, Artificial Sequence
  chemically synthesized
tttttttttttttgagatggag

SEQ ID NO: 1234737 - DNA, 22 bp, Artificial Sequence
  chemically synthesized
tttttttttttttttgagatgg

SEQ ID NO: 1234738 - DNA, 22 bp, Artificial Sequence
  chemically synthesized
ctttttttttttttttgagatg

SEQ ID NO: 1234739 - DNA, 22 bp, Artificial Sequence
  chemically synthesized
tctttttttttttttttgagat

SEQ ID NO: 1234740 - DNA, 22 bp, Artificial Sequence
  chemically synthesized
ttctttttttttttttttgaga

SEQ ID NO: 1234741 - DNA, 22 bp, Artificial Sequence
  chemically synthesized
ttttctttttttttttttttga

SEQ ID NO: 1234742 - DNA, 22 bp, Artificial Sequence
  chemically synthesized
cttttctttttttttttttttg

SEQ ID NO: 1234743 - DNA, 22 bp, Artificial Sequence
  chemically synthesized
tcttttcttttttttttttttt

SEQ ID NO: 1234744 - DNA, 22 bp, Artificial Sequence
  chemically synthesized
ttcttttctttttttttttttt

SEQ ID NO: 1234745 - DNA, 22 bp, Artificial Sequence
  chemically synthesized
ttttcttttctttttttttttt

SEQ ID NO: 1234746 - DNA, 22 bp, Artificial Sequence
  chemically synthesized
cttttcttttcttttttttttt

SEQ ID NO: 1234747 - DNA, 22 bp, Artificial Sequence
  chemically synthesized
tcttttcttttctttttttttt

SEQ ID NO: 1234748 - DNA, 22 bp, Artificial Sequence
  chemically synthesized
catctcaaaaaaaaaaaaaaag

SEQ ID NO: 1234749 - DNA, 22 bp, Artificial Sequence
  chemically synthesized
ttcttttcttttcttttttttt

SEQ ID NO: 1234750 - DNA, 22 bp, Artificial Sequence
  chemically synthesized
ttttcttttcttttcttttttt

SEQ ID NO: 1234751 - DNA, 22 bp, Artificial Sequence
  chemically synthesized
cttttcttttcttttctttttt

SEQ ID NO: 1234752 - DNA, 22 bp, Artificial Sequence
  chemically synthesized
tcttttcttttcttttcttttt

SEQ ID NO: 1234753 - DNA, 22 bp, Artificial Sequence
  chemically synthesized
ttcttttcttttcttttctttt

SEQ ID NO: 1234754 - DNA, 22 bp, Artificial Sequence
  chemically synthesized
aaaaaaaaaaaaaaagaaaaga

SEQ ID NO: 1234755 - DNA, 22 bp, Artificial Sequence
  chemically synthesized
ttttcttttcttttcttttctt

SEQ ID NO: 1234756 - DNA, 22 bp, Artificial Sequence
  chemically synthesized
cttttcttttcttttcttttct

SEQ ID NO: 1234757 - DNA, 22 bp, Artificial Sequence
  chemically synthesized
tcttttcttttcttttcttttc

SEQ ID NO: 1234758 - DNA, 22 bp, Artificial Sequence
  chemically synthesized
ttcttttcttttcttttctttt

SEQ ID NO: 1234759 - DNA, 22 bp, Artificial Sequence
  chemically synthesized
tttcttttcttttcttttcttt

SEQ ID NO: 1234760 - DNA, 22 bp, Artificial Sequence
  chemically synthesized
ttttcttttcttttcttttctt

SEQ ID NO: 1234761 - DNA, 22 bp, Artificial Sequence
  chemically synthesized
ttttttcttttcttttcttttc

SEQ ID NO: 1234762 - DNA, 22 bp, Artificial Sequence
  chemically synthesized
cttttttcttttcttttctttt

SEQ ID NO: 1234763 - DNA, 22 bp, Artificial Sequence
  chemically synthesized
tcttttttcttttcttttcttt

SEQ ID NO: 1234764 - DNA, 22 bp, Artificial Sequence
  chemically synthesized
ttcttttttcttttcttttctt

SEQ ID NO: 1234765 - DNA, 22 bp, Artificial Sequence
  chemically synthesized
tttcttttttcttttcttttct

SEQ ID NO: 1234766 - DNA, 22 bp, Artificial Sequence
  chemically synthesized
tttttcttttttcttttctttt

SEQ ID NO: 1234767 - DNA, 22 bp, Artificial Sequence
  chemically synthesized
ctttttcttttttcttttcttt

SEQ ID NO: 1234768 - DNA, 22 bp, Artificial Sequence
  chemically synthesized
tctttttcttttttcttttctt

SEQ ID NO: 1234769 - DNA, 22 bp, Artificial Sequence
  chemically synthesized
ttctttttcttttttcttttct

SEQ ID NO: 1234770 - DNA, 22 bp, Artificial Sequence
  chemically synthesized
cttttctttttcttttttcttt

SEQ ID NO: 1234771 - DNA, 22 bp, Artificial Sequence
  chemically synthesized
gcttttctttttcttttttctt

SEQ ID NO: 1234772 - DNA, 22 bp, Artificial Sequence
  chemically synthesized
tgcttttctttttcttttttct

SEQ ID NO: 1234773 - DNA, 22 bp, Artificial Sequence
  chemically synthesized
ctttgcttttctttttcttttt

SEQ ID NO: 1234774 - DNA, 22 bp, Artificial Sequence
  chemically synthesized
actttgcttttctttttctttt

SEQ ID NO: 1234775 - DNA, 22 bp, Artificial Sequence
  chemically synthesized
ttactttgcttttctttttctt

SEQ ID NO: 1234776 - DNA, 22 bp, Artificial Sequence
  chemically synthesized
cttactttgcttttctttttct

SEQ ID NO: 1234777 - DNA, 22 bp, Artificial Sequence
  chemically synthesized
tcttactttgcttttctttttc

SEQ ID NO: 1234778 - DNA, 22 bp, Artificial Sequence
  chemically synthesized
ttcttactttgcttttcttttt

SEQ ID NO: 1234779 - DNA, 22 bp, Artificial Sequence
  chemically synthesized
ttttcttactttgcttttcttt

SEQ ID NO: 1234780 - DNA, 22 bp, Artificial Sequence
  chemically synthesized
cttttcttactttgcttttctt

SEQ ID NO: 1234781 - DNA, 22 bp, Artificial Sequence
  chemically synthesized
ggtttcttttcttactttgctt

SEQ ID NO: 1234782 - DNA, 22 bp, Artificial Sequence
  chemically synthesized
cagtcaactcggtttcttttct

SEQ ID NO: 1234783 - DNA, 22 bp, Artificial Sequence
  chemically synthesized
gtggacaaagtcctgcagtcaa

SEQ ID NO: 1234784 - DNA, 22 bp, Artificial Sequence
  chemically synthesized
ggtggacaaagtcctgcagtca

SEQ ID NO: 1234785 - DNA, 22 bp, Artificial Sequence
  chemically synthesized
tgtttggtggacaaagtcctgc

SEQ ID NO: 1234786 - DNA, 22 bp, Artificial Sequence
  chemically synthesized
actgcaggactttgtccaccaa

SEQ ID NO: 1234787 - DNA, 22 bp, Artificial Sequence
  chemically synthesized
atgaagctgtgtttggtggaca

SEQ ID NO: 1234788 - DNA, 22 bp, Artificial Sequence
  chemically synthesized
catgaagctgtgtttggtggac

SEQ ID NO: 1234789 - DNA, 22 bp, Artificial Sequence
  chemically synthesized
caggactttgtccaccaaacac

SEQ ID NO: 1234790 - DNA, 22 bp, Artificial Sequence
  chemically synthesized
cttcatgaagctgtgtttggtg

SEQ ID NO: 1234791 - DNA, 22 bp, Artificial Sequence
  chemically synthesized
acttcatgaagctgtgtttggt

SEQ ID NO: 1234792 - DNA, 22 bp, Artificial Sequence
  chemically synthesized
tacttcatgaagctgtgtttgg

SEQ ID NO: 1234793 - DNA, 22 bp, Artificial Sequence
  chemically synthesized
tgtccaccaaacacagcttcat

SEQ ID NO: 1234794 - DNA, 22 bp, Artificial Sequence
  chemically synthesized
agattttacttcatgaagctgt

SEQ ID NO: 1234795 - DNA, 22 bp, Artificial Sequence
  chemically synthesized
gtccaccaaacacagcttcatg

SEQ ID NO: 1234796 - DNA, 22 bp, Artificial Sequence
  chemically synthesized
cagattttacttcatgaagctg

SEQ ID NO: 1234797 - DNA, 22 bp, Artificial Sequence
  chemically synthesized
tccaccaaacacagcttcatga

SEQ ID NO: 1234798 - DNA, 22 bp, Artificial Sequence
  chemically synthesized
tcagattttacttcatgaagct

SEQ ID NO: 1234799 - DNA, 22 bp, Artificial Sequence
  chemically synthesized
ttttcagattttacttcatgaa

SEQ ID NO: 1234800 - DNA, 22 bp, Artificial Sequence
  chemically synthesized
cctgttttcagattttacttca

SEQ ID NO: 1234801 - DNA, 22 bp, Artificial Sequence
  chemically synthesized
ctccctgttttcagattttact

SEQ ID NO: 1234802 - DNA, 22 bp, Artificial Sequence
  chemically synthesized
catgaagtaaaatctgaaaaca

SEQ ID NO: 1234803 - DNA, 22 bp, Artificial Sequence
  chemically synthesized
atgaagtaaaatctgaaaacag

SEQ ID NO: 1234804 - DNA, 22 bp, Artificial Sequence
  chemically synthesized
ataggctgctccctgttttcag

SEQ ID NO: 1234805 - DNA, 22 bp, Artificial Sequence
  chemically synthesized
acctgataggctgctccctgtt

SEQ ID NO: 1234806 - DNA, 22 bp, Artificial Sequence
  chemically synthesized
aaaacagggagcagcctatcag

SEQ ID NO: 1234807 - DNA, 22 bp, Artificial Sequence
  chemically synthesized
tcaggtcaggtctatgtctttt

SEQ ID NO: 1234808 - DNA, 22 bp, Artificial Sequence
  chemically synthesized
ccacagagggaagggaaaagac

SEQ ID NO: 1234809 - DNA, 22 bp, Artificial Sequence
  chemically synthesized
tgtcttttcccttccctctgtg

SEQ ID NO: 1234810 - DNA, 22 bp, Artificial Sequence
  chemically synthesized
ttcccttccctctgtggcagca

SEQ ID NO: 1234811 - DNA, 22 bp, Artificial Sequence
  chemically synthesized
tcccttccctctgtggcagcat

SEQ ID NO: 1234812 - DNA, 22 bp, Artificial Sequence
  chemically synthesized
cccttccctctgtggcagcatg

SEQ ID NO: 1234813 - DNA, 22 bp, Artificial Sequence
  chemically synthesized
aggaagcaaatgcatgctgcca

SEQ ID NO: 1234814 - DNA, 22 bp, Artificial Sequence
  chemically synthesized
ccttccctctgtggcagcatgc

SEQ ID NO: 1234815 - DNA, 22 bp, Artificial Sequence
  chemically synthesized
ccctctgtggcagcatgcattt

SEQ ID NO: 1234816 - DNA, 22 bp, Artificial Sequence
  chemically synthesized
cctctgtggcagcatgcatttg

SEQ ID NO: 1234817 - DNA, 22 bp, Artificial Sequence
  chemically synthesized
atataattcaggaagcaaatgc

SEQ ID NO: 1234818 - DNA, 22 bp, Artificial Sequence
  chemically synthesized
tgtggcagcatgcatttgcttc

SEQ ID NO: 1234819 - DNA, 22 bp, Artificial Sequence
  chemically synthesized
tggcagcatgcatttgcttcct

SEQ ID NO: 1234820 - DNA, 22 bp, Artificial Sequence
  chemically synthesized
tggctaatataattcaggaagc

SEQ ID NO: 1234821 - DNA, 22 bp, Artificial Sequence
  chemically synthesized
attgtggctaatataattcagg

SEQ ID NO: 1234822 - DNA, 22 bp, Artificial Sequence
  chemically synthesized
gcttcctgaattatattagcca

SEQ ID NO: 1234823 - DNA, 22 bp, Artificial Sequence
  chemically synthesized
cttcctgaattatattagccac

SEQ ID NO: 1234824 - DNA, 22 bp, Artificial Sequence
  chemically synthesized
gtgtatgcctgattgtggctaa

SEQ ID NO: 1234825 - DNA, 22 bp, Artificial Sequence
  chemically synthesized
cctgaattatattagccacaat

SEQ ID NO: 1234826 - DNA, 22 bp, Artificial Sequence
  chemically synthesized
ctgaattatattagccacaatc

SEQ ID NO: 1234827 - DNA, 22 bp, Artificial Sequence
  chemically synthesized
aattatattagccacaatcagg

SEQ ID NO: 1234828 - DNA, 22 bp, Artificial Sequence
  chemically synthesized
taattcgtgtatgcctgattgt

SEQ ID NO: 1234829 - DNA, 22 bp, Artificial Sequence
  chemically synthesized
tattagccacaatcaggcatac

SEQ ID NO: 1234830 - DNA, 22 bp, Artificial Sequence
  chemically synthesized
gccacaatcaggcatacacgaa

SEQ ID NO: 1234831 - DNA, 22 bp, Artificial Sequence
  chemically synthesized
agagcacatgttgtaattcgtg

SEQ ID NO: 1234832 - DNA, 22 bp, Artificial Sequence
  chemically synthesized
ctgagagcacatgttgtaattc

SEQ ID NO: 1234833 - DNA, 22 bp, Artificial Sequence
  chemically synthesized
actgagagcacatgttgtaatt

SEQ ID NO: 1234834 - DNA, 22 bp, Artificial Sequence
  chemically synthesized
ttactgagagcacatgttgtaa

SEQ ID NO: 1234835 - DNA, 22 bp, Artificial Sequence
  chemically synthesized
caacatgtgctctcagtaagaa

SEQ ID NO: 1234836 - DNA, 22 bp, Artificial Sequence
  chemically synthesized
taaatcagaccagttcttactg

SEQ ID NO: 1234837 - DNA, 22 bp, Artificial Sequence
  chemically synthesized
gtaaatcagaccagttcttact

SEQ ID NO: 1234838 - DNA, 22 bp, Artificial Sequence
  chemically synthesized
ttgtaaatcagaccagttctta

SEQ ID NO: 1234839 - DNA, 22 bp, Artificial Sequence
  chemically synthesized
tcttgtaaatcagaccagttct

SEQ ID NO: 1234840 - DNA, 22 bp, Artificial Sequence
  chemically synthesized
tcagtaagaactggtctgattt

SEQ ID NO: 1234841 - DNA, 22 bp, Artificial Sequence
  chemically synthesized
aaattctcttgtaaatcagacc

SEQ ID NO: 1234842 - DNA, 22 bp, Artificial Sequence
  chemically synthesized
caaattctcttgtaaatcagac

SEQ ID NO: 1234843 - DNA, 22 bp, Artificial Sequence
  chemically synthesized
agtaagaactggtctgatttac

SEQ ID NO: 1234844 - DNA, 22 bp, Artificial Sequence
  chemically synthesized
gtctgatttacaagagaatttg

SEQ ID NO: 1234845 - DNA, 22 bp, Artificial Sequence
  chemically synthesized
atttacaagagaatttgaaata

SEQ ID NO: 1234846 - DNA, 22 bp, Artificial Sequence
  chemically synthesized
acaagagaatttgaaatacttt

SEQ ID NO: 1234847 - DNA, 22 bp, Artificial Sequence
  chemically synthesized
caagagaatttgaaatactttc

SEQ ID NO: 1234848 - DNA, 22 bp, Artificial Sequence
  chemically synthesized
gccccaaatgcagagaaagtat

SEQ ID NO: 1234849 - DNA, 22 bp, Artificial Sequence
  chemically synthesized
ggccccaaatgcagagaaagta

SEQ ID NO: 1234850 - DNA, 22 bp, Artificial Sequence
  chemically synthesized
tggccccaaatgcagagaaagt

SEQ ID NO: 1234851 - DNA, 22 bp, Artificial Sequence
  chemically synthesized
gaaatactttctctgcatttgg

SEQ ID NO: 1234852 - DNA, 22 bp, Artificial Sequence
  chemically synthesized
aaatactttctctgcatttggg

SEQ ID NO: 1234853 - DNA, 22 bp, Artificial Sequence
  chemically synthesized
agtgagggctttggccccaaat

SEQ ID NO: 1234854 - DNA, 22 bp, Artificial Sequence
  chemically synthesized
gagtgagggctttggccccaaa

SEQ ID NO: 1234855 - DNA, 22 bp, Artificial Sequence
  chemically synthesized
tctctgcatttggggccaaagc

SEQ ID NO: 1234856 - DNA, 22 bp, Artificial Sequence
  chemically synthesized
ctctgcatttggggccaaagcc

SEQ ID NO: 1234857 - DNA, 22 bp, Artificial Sequence
  chemically synthesized
tctgcatttggggccaaagccc

SEQ ID NO: 1234858 - DNA, 22 bp, Artificial Sequence
  chemically synthesized
atgtttgagtgagggctttggc

SEQ ID NO: 1234859 - DNA, 22 bp, Artificial Sequence
  chemically synthesized
catgtttgagtgagggctttgg

SEQ ID NO: 1234860 - DNA, 22 bp, Artificial Sequence
  chemically synthesized
tgcatttggggccaaagccctc

SEQ ID NO: 1234861 - DNA, 22 bp, Artificial Sequence
  chemically synthesized
catttggggccaaagccctcac

SEQ ID NO: 1234862 - DNA, 22 bp, Artificial Sequence
  chemically synthesized
ggggccaaagccctcactcaaa

SEQ ID NO: 1234863 - DNA, 22 bp, Artificial Sequence
  chemically synthesized
gggccaaagccctcactcaaac

SEQ ID NO: 1234864 - DNA, 22 bp, Artificial Sequence
  chemically synthesized
tgacacagcatgcttcatgttt

SEQ ID NO: 1234865 - DNA, 22 bp, Artificial Sequence
  chemically synthesized
gatgctgtgacacagcatgctt

SEQ ID NO: 1234866 - DNA, 22 bp, Artificial Sequence
  chemically synthesized
actcaaacatgaagcatgctgt

SEQ ID NO: 1234867 - DNA, 22 bp, Artificial Sequence
  chemically synthesized
aaacatgaagcatgctgtgtca

SEQ ID NO: 1234868 - DNA, 22 bp, Artificial Sequence
  chemically synthesized
gacaaggtctggatgctgtgac

SEQ ID NO: 1234869 - DNA, 22 bp, Artificial Sequence
  chemically synthesized
tgtcacagcatccagaccttgt

SEQ ID NO: 1234870 - DNA, 22 bp, Artificial Sequence
  chemically synthesized
cagaacaataatgtaagtagta

SEQ ID NO: 1234871 - DNA, 22 bp, Artificial Sequence
  chemically synthesized
gcagaacaataatgtaagtagt

SEQ ID NO: 1234872 - DNA, 22 bp, Artificial Sequence
  chemically synthesized
tgcagaacaataatgtaagtag

SEQ ID NO: 1234873 - DNA, 22 bp, Artificial Sequence
  chemically synthesized
gtccagggtactacttacatta

SEQ ID NO: 1234874 - DNA, 22 bp, Artificial Sequence
  chemically synthesized
tccagggtactacttacattat

SEQ ID NO: 1234875 - DNA, 22 bp, Artificial Sequence
  chemically synthesized
cgggttttgcagaacaataatg

SEQ ID NO: 1234876 - DNA, 22 bp, Artificial Sequence
  chemically synthesized
cttacattattgttctgcaaaa

SEQ ID NO: 1234877 - DNA, 22 bp, Artificial Sequence
  chemically synthesized
acattattgttctgcaaaaccc

SEQ ID NO: 1234878 - DNA, 22 bp, Artificial Sequence
  chemically synthesized
cattattgttctgcaaaacccg

SEQ ID NO: 1234879 - DNA, 22 bp, Artificial Sequence
  chemically synthesized
ttgttctgcaaaacccgcagtg

SEQ ID NO: 1234880 - DNA, 22 bp, Artificial Sequence
  chemically synthesized
ttctgcaaaacccgcagtgcct

SEQ ID NO: 1234881 - DNA, 22 bp, Artificial Sequence
  chemically synthesized
aacaatgtcaacaaggcactgc

SEQ ID NO: 1234882 - DNA, 22 bp, Artificial Sequence
  chemically synthesized
tgcaaaacccgcagtgccttgt

SEQ ID NO: 1234883 - DNA, 22 bp, Artificial Sequence
  chemically synthesized
caaaacccgcagtgccttgttg

SEQ ID NO: 1234884 - DNA, 22 bp, Artificial Sequence
  chemically synthesized
atgccctgaacaatgtcaacaa

SEQ ID NO: 1234885 - DNA, 22 bp, Artificial Sequence
  chemically synthesized
gttgacattgttcagggcatga

SEQ ID NO: 1234886 - DNA, 22 bp, Artificial Sequence
  chemically synthesized
ttgacattgttcagggcatgaa

SEQ ID NO: 1234887 - DNA, 22 bp, Artificial Sequence
  chemically synthesized
acattgttcagggcatgaactc

SEQ ID NO: 1234888 - DNA, 22 bp, Artificial Sequence
  chemically synthesized
ttcagggcatgaactcttgtgg

SEQ ID NO: 1234889 - DNA, 22 bp, Artificial Sequence
  chemically synthesized
agggcatgaactcttgtggatc

SEQ ID NO: 1234890 - DNA, 22 bp, Artificial Sequence
  chemically synthesized
agccaaaagaaaaaggatccac

SEQ ID NO: 1234891 - DNA, 22 bp, Artificial Sequence
  chemically synthesized
tcagccaaaagaaaaaggatcc

SEQ ID NO: 1234892 - DNA, 22 bp, Artificial Sequence
  chemically synthesized
ttctcagccaaaagaaaaagga

SEQ ID NO: 1234893 - DNA, 22 bp, Artificial Sequence
  chemically synthesized
gttctcagccaaaagaaaaagg

SEQ ID NO: 1234894 - DNA, 22 bp, Artificial Sequence
  chemically synthesized
tgttctcagccaaaagaaaaag

SEQ ID NO: 1234895 - DNA, 22 bp, Artificial Sequence
  chemically synthesized
ttgtggatcctttttcttttgg

SEQ ID NO: 1234896 - DNA, 22 bp, Artificial Sequence
  chemically synthesized
ttttgttctcagccaaaagaaa

SEQ ID NO: 1234897 - DNA, 22 bp, Artificial Sequence
  chemically synthesized
gttttgttctcagccaaaagaa

SEQ ID NO: 1234898 - DNA, 22 bp, Artificial Sequence
  chemically synthesized
gtggatcctttttcttttggct

SEQ ID NO: 1234899 - DNA, 22 bp, Artificial Sequence
  chemically synthesized
tgttttgttctcagccaaaaga

SEQ ID NO: 1234900 - DNA, 22 bp, Artificial Sequence
  chemically synthesized
tggatcctttttcttttggctg

SEQ ID NO: 1234901 - DNA, 22 bp, Artificial Sequence
  chemically synthesized
ttgttttgttctcagccaaaag

SEQ ID NO: 1234902 - DNA, 22 bp, Artificial Sequence
  chemically synthesized
ttttgttttgttctcagccaaa

SEQ ID NO: 1234903 - DNA, 22 bp, Artificial Sequence
  chemically synthesized
tttcttttggctgagaacaaaa

SEQ ID NO: 1234904 - DNA, 22 bp, Artificial Sequence
  chemically synthesized
ttcttttggctgagaacaaaac

SEQ ID NO: 1234905 - DNA, 22 bp, Artificial Sequence
  chemically synthesized
tcttttggctgagaacaaaaca

SEQ ID NO: 1234906 - DNA, 22 bp, Artificial Sequence
  chemically synthesized
cttttggctgagaacaaaacaa

SEQ ID NO: 1234907 - DNA, 22 bp, Artificial Sequence
  chemically synthesized
ttttggctgagaacaaaacaaa

SEQ ID NO: 1234908 - DNA, 22 bp, Artificial Sequence
  chemically synthesized
ttggctgagaacaaaacaaaag

SEQ ID NO: 1234909 - DNA, 22 bp, Artificial Sequence
  chemically synthesized
tggctgagaacaaaacaaaaga

SEQ ID NO: 1234910 - DNA, 22 bp, Artificial Sequence
  chemically synthesized
gtcagtgaacactcttttgttt

SEQ ID NO: 1234911 - DNA, 22 bp, Artificial Sequence
  chemically synthesized
ggctgagaacaaaacaaaagag

SEQ ID NO: 1234912 - DNA, 22 bp, Artificial Sequence
  chemically synthesized
gctgagaacaaaacaaaagagt

SEQ ID NO: 1234913 - DNA, 22 bp, Artificial Sequence
  chemically synthesized
ctggtcagtgaacactcttttg

SEQ ID NO: 1234914 - DNA, 22 bp, Artificial Sequence
  chemically synthesized
tgctggtcagtgaacactcttt

SEQ ID NO: 1234915 - DNA, 22 bp, Artificial Sequence
  chemically synthesized
agaacaaaacaaaagagtgttc

SEQ ID NO: 1234916 - DNA, 22 bp, Artificial Sequence
  chemically synthesized
tctgctggtcagtgaacactct

SEQ ID NO: 1234917 - DNA, 22 bp, Artificial Sequence
  chemically synthesized
tcggtctctctgctggtcagtg

SEQ ID NO: 1234918 - DNA, 22 bp, Artificial Sequence
  chemically synthesized
gtagattgtcggtctctctgct

SEQ ID NO: 1234919 - DNA, 22 bp, Artificial Sequence
  chemically synthesized
tagtagattgtcggtctctctg

SEQ ID NO: 1234920 - DNA, 22 bp, Artificial Sequence
  chemically synthesized
ctagtagattgtcggtctctct

SEQ ID NO: 1234921 - DNA, 22 bp, Artificial Sequence
  chemically synthesized
actgaccagcagagagaccgac

SEQ ID NO: 1234922 - DNA, 22 bp, Artificial Sequence
  chemically synthesized
atttctagtagattgtcggtct

SEQ ID NO: 1234923 - DNA, 22 bp, Artificial Sequence
  chemically synthesized
catttctagtagattgtcggtc

SEQ ID NO: 1234924 - DNA, 22 bp, Artificial Sequence
  chemically synthesized
accagcagagagaccgacaatc

SEQ ID NO: 1234925 - DNA, 22 bp, Artificial Sequence
  chemically synthesized
taaatggtttcatttctagtag

SEQ ID NO: 1234926 - DNA, 22 bp, Artificial Sequence
  chemically synthesized
atagtgaaattataaatggttt

SEQ ID NO: 1234927 - DNA, 22 bp, Artificial Sequence
  chemically synthesized
aatagtgaaattataaatggtt

SEQ ID NO: 1234928 - DNA, 22 bp, Artificial Sequence
  chemically synthesized
ctagaaatgaaaccatttataa

SEQ ID NO: 1234929 - DNA, 22 bp, Artificial Sequence
  chemically synthesized
gaaatgaaaccatttataattt

SEQ ID NO: 1234930 - DNA, 22 bp, Artificial Sequence
  chemically synthesized
aagcttaatagtgaaattataa

SEQ ID NO: 1234931 - DNA, 22 bp, Artificial Sequence
  chemically synthesized
caatattcaagcttaatagtga

SEQ ID NO: 1234932 - DNA, 22 bp, Artificial Sequence
  chemically synthesized
acaatattcaagcttaatagtg

SEQ ID NO: 1234933 - DNA, 22 bp, Artificial Sequence
  chemically synthesized
gtttacaatattcaagcttaat

SEQ ID NO: 1234934 - DNA, 22 bp, Artificial Sequence
  chemically synthesized
ataatttcactattaagcttga

SEQ ID NO: 1234935 - DNA, 22 bp, Artificial Sequence
  chemically synthesized
taatttcactattaagcttgaa

SEQ ID NO: 1234936 - DNA, 22 bp, Artificial Sequence
  chemically synthesized
ttcgtttacaatattcaagctt

SEQ ID NO: 1234937 - DNA, 22 bp, Artificial Sequence
  chemically synthesized
tgttcgtttacaatattcaagc

SEQ ID NO: 1234938 - DNA, 22 bp, Artificial Sequence
  chemically synthesized
cactattaagcttgaatattgt

SEQ ID NO: 1234939 - DNA, 22 bp, Artificial Sequence
  chemically synthesized
actattaagcttgaatattgta

SEQ ID NO: 1234940 - DNA, 22 bp, Artificial Sequence
  chemically synthesized
ttaagcttgaatattgtaaacg

SEQ ID NO: 1234941 - DNA, 22 bp, Artificial Sequence
  chemically synthesized
acaggctctgttcgtttacaat

SEQ ID NO: 1234942 - DNA, 22 bp, Artificial Sequence
  chemically synthesized
agcttgaatattgtaaacgaac

SEQ ID NO: 1234943 - DNA, 22 bp, Artificial Sequence
  chemically synthesized
atgcctcacaggctctgttcgt

SEQ ID NO: 1234944 - DNA, 22 bp, Artificial Sequence
  chemically synthesized
gaatattgtaaacgaacagagc

SEQ ID NO: 1234945 - DNA, 22 bp, Artificial Sequence
  chemically synthesized
aatattgtaaacgaacagagcc

SEQ ID NO: 1234946 - DNA, 22 bp, Artificial Sequence
  chemically synthesized
tattaatgcctcacaggctctg

SEQ ID NO: 1234947 - DNA, 22 bp, Artificial Sequence
  chemically synthesized
taaacgaacagagcctgtgagg

SEQ ID NO: 1234948 - DNA, 22 bp, Artificial Sequence
  chemically synthesized
attatattaatgcctcacaggc

SEQ ID NO: 1234949 - DNA, 22 bp, Artificial Sequence
  chemically synthesized
gattcattatattaatgcctca

SEQ ID NO: 1234950 - DNA, 22 bp, Artificial Sequence
  chemically synthesized
agattcattatattaatgcctc

SEQ ID NO: 1234951 - DNA, 22 bp, Artificial Sequence
  chemically synthesized
tgaggcattaatataatgaatc

SEQ ID NO: 1234952 - DNA, 22 bp, Artificial Sequence
  chemically synthesized
gcgcaaagtatttagattcatt

SEQ ID NO: 1234953 - DNA, 22 bp, Artificial Sequence
  chemically synthesized
atataatgaatctaaatacttt

SEQ ID NO: 1234954 - DNA, 22 bp, Artificial Sequence
  chemically synthesized
aatactttgcgctaattgtcct

SEQ ID NO: 1234955 - DNA, 22 bp, Artificial Sequence
  chemically synthesized
aaaacgtaccaggccaaggaca

SEQ ID NO: 1234956 - DNA, 22 bp, Artificial Sequence
  chemically synthesized
tgcgctaattgtccttggcctg

SEQ ID NO: 1234957 - DNA, 22 bp, Artificial Sequence
  chemically synthesized
gcgctaattgtccttggcctgg

SEQ ID NO: 1234958 - DNA, 22 bp, Artificial Sequence
  chemically synthesized
cgctaattgtccttggcctggt

SEQ ID NO: 1234959 - DNA, 22 bp, Artificial Sequence
  chemically synthesized
tgctaaaaacgtaccaggccaa

SEQ ID NO: 1234960 - DNA, 22 bp, Artificial Sequence
  chemically synthesized
atgctaaaaacgtaccaggcca

SEQ ID NO: 1234961 - DNA, 22 bp, Artificial Sequence
  chemically synthesized
attgtccttggcctggtacgtt

SEQ ID NO: 1234962 - DNA, 22 bp, Artificial Sequence
  chemically synthesized
gtttatgctaaaaacgtaccag

SEQ ID NO: 1234963 - DNA, 22 bp, Artificial Sequence
  chemically synthesized
tccttggcctggtacgttttta

SEQ ID NO: 1234964 - DNA, 22 bp, Artificial Sequence
  chemically synthesized
ggcctggtacgtttttagcata

SEQ ID NO: 1234965 - DNA, 22 bp, Artificial Sequence
  chemically synthesized
gagtggttggtttatgctaaaa

SEQ ID NO: 1234966 - DNA, 22 bp, Artificial Sequence
  chemically synthesized
gcctggtacgtttttagcataa

SEQ ID NO: 1234967 - DNA, 22 bp, Artificial Sequence
  chemically synthesized
agagtggttggtttatgctaaa

SEQ ID NO: 1234968 - DNA, 22 bp, Artificial Sequence
  chemically synthesized
ttagagtggttggtttatgcta

SEQ ID NO: 1234969 - DNA, 22 bp, Artificial Sequence
  chemically synthesized
gtacgtttttagcataaaccaa

SEQ ID NO: 1234970 - DNA, 22 bp, Artificial Sequence
  chemically synthesized
ccattcttagagtggttggttt

SEQ ID NO: 1234971 - DNA, 22 bp, Artificial Sequence
  chemically synthesized
ttagcataaaccaaccactcta

SEQ ID NO: 1234972 - DNA, 22 bp, Artificial Sequence
  chemically synthesized
tagcataaaccaaccactctaa

SEQ ID NO: 1234973 - DNA, 22 bp, Artificial Sequence
  chemically synthesized
agcataaaccaaccactctaag

SEQ ID NO: 1234974 - DNA, 22 bp, Artificial Sequence
  chemically synthesized
gcataaaccaaccactctaaga

SEQ ID NO: 1234975 - DNA, 22 bp, Artificial Sequence
  chemically synthesized
taaagaaaaagtgttgccattc

SEQ ID NO: 1234976 - DNA, 22 bp, Artificial Sequence
  chemically synthesized
gtaaagaaaaagtgttgccatt

SEQ ID NO: 1234977 - DNA, 22 bp, Artificial Sequence
  chemically synthesized
tgtaaagaaaaagtgttgccat

SEQ ID NO: 1234978 - DNA, 22 bp, Artificial Sequence
  chemically synthesized
taagaatggcaacactttttct

SEQ ID NO: 1234979 - DNA, 22 bp, Artificial Sequence
  chemically synthesized
agaatggcaacactttttcttt

SEQ ID NO: 1234980 - DNA, 22 bp, Artificial Sequence
  chemically synthesized
tttctttacaaagcctattttg

SEQ ID NO: 1234981 - DNA, 22 bp, Artificial Sequence
  chemically synthesized
ttctttacaaagcctattttgg

SEQ ID NO: 1234982 - DNA, 22 bp, Artificial Sequence
  chemically synthesized
tctttacaaagcctattttggt

SEQ ID NO: 1234983 - DNA, 22 bp, Artificial Sequence
  chemically synthesized
ctttacaaagcctattttggta

SEQ ID NO: 1234984 - DNA, 22 bp, Artificial Sequence
  chemically synthesized
tttacaaagcctattttggtat

SEQ ID NO: 1234985 - DNA, 22 bp, Artificial Sequence
  chemically synthesized
tacaaagcctattttggtatga

SEQ ID NO: 1234986 - DNA, 22 bp, Artificial Sequence
  chemically synthesized
acaaagcctattttggtatgat

SEQ ID NO: 1234987 - DNA, 22 bp, Artificial Sequence
  chemically synthesized
caaagcctattttggtatgatt

SEQ ID NO: 1234988 - DNA, 22 bp, Artificial Sequence
  chemically synthesized
tagaatgaagaaacaatcatac

SEQ ID NO: 1234989 - DNA, 22 bp, Artificial Sequence
  chemically synthesized
ggctatagaatgaagaaacaat

SEQ ID NO: 1234990 - DNA, 22 bp, Artificial Sequence
  chemically synthesized
ttttggtatgattgtttcttca

SEQ ID NO: 1234991 - DNA, 22 bp, Artificial Sequence
  chemically synthesized
tggtatgattgtttcttcattc

SEQ ID NO: 1234992 - DNA, 22 bp, Artificial Sequence
  chemically synthesized
ggtatgattgtttcttcattct

SEQ ID NO: 1234993 - DNA, 22 bp, Artificial Sequence
  chemically synthesized
gtatgattgtttcttcattcta

SEQ ID NO: 1234994 - DNA, 22 bp, Artificial Sequence
  chemically synthesized
tttcttcattctatagcccagt

SEQ ID NO: 1234995 - DNA, 22 bp, Artificial Sequence
  chemically synthesized
cttcattctatagcccagttgg

SEQ ID NO: 1234996 - DNA, 22 bp, Artificial Sequence
  chemically synthesized
ttcattctatagcccagttggg

SEQ ID NO: 1234997 - DNA, 22 bp, Artificial Sequence
  chemically synthesized
cattctatagcccagttgggga

SEQ ID NO: 1234998 - DNA, 22 bp, Artificial Sequence
  chemically synthesized
attctatagcccagttggggat

SEQ ID NO: 1234999 - DNA, 22 bp, Artificial Sequence
  chemically synthesized
gtggtcatgcagtaatccccaa

SEQ ID NO: 1235000 - DNA, 22 bp, Artificial Sequence
  chemically synthesized
tatagcccagttggggattact

SEQ ID NO: 1235001 - DNA, 22 bp, Artificial Sequence
  chemically synthesized
tagcccagttggggattactgc

SEQ ID NO: 1235002 - DNA, 22 bp, Artificial Sequence
  chemically synthesized
tcattggtggtcatgcagtaat

SEQ ID NO: 1235003 - DNA, 22 bp, Artificial Sequence
  chemically synthesized
tgtcattggtggtcatgcagta

SEQ ID NO: 1235004 - DNA, 22 bp, Artificial Sequence
  chemically synthesized
ctgtcattggtggtcatgcagt

SEQ ID NO: 1235005 - DNA, 22 bp, Artificial Sequence
  chemically synthesized
gggattactgcatgaccaccaa

SEQ ID NO: 1235006 - DNA, 22 bp, Artificial Sequence
  chemically synthesized
atgtttctgtcattggtggtca

SEQ ID NO: 1235007 - DNA, 22 bp, Artificial Sequence
  chemically synthesized
ctgcatgaccaccaatgacaga

SEQ ID NO: 1235008 - DNA, 22 bp, Artificial Sequence
  chemically synthesized
tgcatgctgatgtttctgtcat

SEQ ID NO: 1235009 - DNA, 22 bp, Artificial Sequence
  chemically synthesized
catgaccaccaatgacagaaac

SEQ ID NO: 1235010 - DNA, 22 bp, Artificial Sequence
  chemically synthesized
atgcatgctgatgtttctgtca

SEQ ID NO: 1235011 - DNA, 22 bp, Artificial Sequence
  chemically synthesized
tatgcatgctgatgtttctgtc

SEQ ID NO: 1235012 - DNA, 22 bp, Artificial Sequence
  chemically synthesized
ttatgcatgctgatgtttctgt

SEQ ID NO: 1235013 - DNA, 22 bp, Artificial Sequence
  chemically synthesized
gaaaatgtttttatgcatgctg

SEQ ID NO: 1235014 - DNA, 22 bp, Artificial Sequence
  chemically synthesized
ctagaaaatgtttttatgcatg

SEQ ID NO: 1235015 - DNA, 22 bp, Artificial Sequence
  chemically synthesized
actagaaaatgtttttatgcat

SEQ ID NO: 1235016 - DNA, 22 bp, Artificial Sequence
  chemically synthesized
tcttactagaaaatgtttttat

SEQ ID NO: 1235017 - DNA, 22 bp, Artificial Sequence
  chemically synthesized
tatcttactagaaaatgttttt

SEQ ID NO: 1235018 - DNA, 22 bp, Artificial Sequence
  chemically synthesized
ctatcttactagaaaatgtttt

SEQ ID NO: 1235019 - DNA, 22 bp, Artificial Sequence
  chemically synthesized
tctatcttactagaaaatgttt

SEQ ID NO: 1235020 - DNA, 22 bp, Artificial Sequence
  chemically synthesized
ttctatcttactagaaaatgtt

SEQ ID NO: 1235021 - DNA, 22 bp, Artificial Sequence
  chemically synthesized
tttttctatcttactagaaaat

SEQ ID NO: 1235022 - DNA, 22 bp, Artificial Sequence
  chemically synthesized
ggaattgtttttctatcttact

SEQ ID NO: 1235023 - DNA, 22 bp, Artificial Sequence
  chemically synthesized
gggaattgtttttctatcttac

SEQ ID NO: 1235024 - DNA, 22 bp, Artificial Sequence
  chemically synthesized
tctagtaagatagaaaaacaat

SEQ ID NO: 1235025 - DNA, 22 bp, Artificial Sequence
  chemically synthesized
aaaagtttgggaattgtttttc

SEQ ID NO: 1235026 - DNA, 22 bp, Artificial Sequence
  chemically synthesized
ctagtaagatagaaaaacaatt

SEQ ID NO: 1235027 - DNA, 22 bp, Artificial Sequence
  chemically synthesized
tagtaagatagaaaaacaattc

SEQ ID NO: 1235028 - DNA, 22 bp, Artificial Sequence
  chemically synthesized
taaaaagtttgggaattgtttt

SEQ ID NO: 1235029 - DNA, 22 bp, Artificial Sequence
  chemically synthesized
ctaaaaagtttgggaattgttt

SEQ ID NO: 1235030 - DNA, 22 bp, Artificial Sequence
  chemically synthesized
gtaagatagaaaaacaattccc

SEQ ID NO: 1235031 - DNA, 22 bp, Artificial Sequence
  chemically synthesized
tctaaaaagtttgggaattgtt

SEQ ID NO: 1235032 - DNA, 22 bp, Artificial Sequence
  chemically synthesized
ttctaaaaagtttgggaattgt

SEQ ID NO: 1235033 - DNA, 22 bp, Artificial Sequence
  chemically synthesized
gatttttctaaaaagtttggga

SEQ ID NO: 1235034 - DNA, 22 bp, Artificial Sequence
  chemically synthesized
agatttttctaaaaagtttggg

SEQ ID NO: 1235035 - DNA, 22 bp, Artificial Sequence
  chemically synthesized
tagatttttctaaaaagtttgg

SEQ ID NO: 1235036 - DNA, 22 bp, Artificial Sequence
  chemically synthesized
ctttagatttttctaaaaagtt

SEQ ID NO: 1235037 - DNA, 22 bp, Artificial Sequence
  chemically synthesized
ccaaactttttagaaaaatcta

SEQ ID NO: 1235038 - DNA, 22 bp, Artificial Sequence
  chemically synthesized
gagtcaaatctcctttagattt

SEQ ID NO: 1235039 - DNA, 22 bp, Artificial Sequence
  chemically synthesized
ctagagtcaaatctcctttaga

SEQ ID NO: 1235040 - DNA, 22 bp, Artificial Sequence
  chemically synthesized
gctagagtcaaatctcctttag

SEQ ID NO: 1235041 - DNA, 22 bp, Artificial Sequence
  chemically synthesized
tttagaaaaatctaaaggagat

SEQ ID NO: 1235042 - DNA, 22 bp, Artificial Sequence
  chemically synthesized
tgctagagtcaaatctccttta

SEQ ID NO: 1235043 - DNA, 22 bp, Artificial Sequence
  chemically synthesized
ttagaaaaatctaaaggagatt

SEQ ID NO: 1235044 - DNA, 22 bp, Artificial Sequence
  chemically synthesized
tagaaaaatctaaaggagattt

SEQ ID NO: 1235045 - DNA, 22 bp, Artificial Sequence
  chemically synthesized
agaaaaatctaaaggagatttg

SEQ ID NO: 1235046 - DNA, 22 bp, Artificial Sequence
  chemically synthesized
gaaaaatctaaaggagatttga

SEQ ID NO: 1235047 - DNA, 22 bp, Artificial Sequence
  chemically synthesized
tataattttgctagagtcaaat

SEQ ID NO: 1235048 - DNA, 22 bp, Artificial Sequence
  chemically synthesized
aaggagatttgactctagcaaa

SEQ ID NO: 1235049 - DNA, 22 bp, Artificial Sequence
  chemically synthesized
gcattatataattttgctagag

SEQ ID NO: 1235050 - DNA, 22 bp, Artificial Sequence
  chemically synthesized
ggcattatataattttgctaga

SEQ ID NO: 1235051 - DNA, 22 bp, Artificial Sequence
  chemically synthesized
tttggcattatataattttgct

SEQ ID NO: 1235052 - DNA, 22 bp, Artificial Sequence
  chemically synthesized
gactctagcaaaattatataat

SEQ ID NO: 1235053 - DNA, 22 bp, Artificial Sequence
  chemically synthesized
accctatttggcattatataat

SEQ ID NO: 1235054 - DNA, 22 bp, Artificial Sequence
  chemically synthesized
actctagcaaaattatataatg

SEQ ID NO: 1235055 - DNA, 22 bp, Artificial Sequence
  chemically synthesized
aaccctatttggcattatataa

SEQ ID NO: 1235056 - DNA, 22 bp, Artificial Sequence
  chemically synthesized
taaccctatttggcattatata

SEQ ID NO: 1235057 - DNA, 22 bp, Artificial Sequence
  chemically synthesized
tagcaaaattatataatgccaa

SEQ ID NO: 1235058 - DNA, 22 bp, Artificial Sequence
  chemically synthesized
ctttaaccctatttggcattat

SEQ ID NO: 1235059 - DNA, 22 bp, Artificial Sequence
  chemically synthesized
cctttaaccctatttggcatta

SEQ ID NO: 1235060 - DNA, 22 bp, Artificial Sequence
  chemically synthesized
gcaaaattatataatgccaaat

SEQ ID NO: 1235061 - DNA, 22 bp, Artificial Sequence
  chemically synthesized
tataatgccaaatagggttaaa

SEQ ID NO: 1235062 - DNA, 22 bp, Artificial Sequence
  chemically synthesized
acagaaaaggtttcctttaacc

SEQ ID NO: 1235063 - DNA, 22 bp, Artificial Sequence
  chemically synthesized
cacagaaaaggtttcctttaac

SEQ ID NO: 1235064 - DNA, 22 bp, Artificial Sequence
  chemically synthesized
aggtaatcttcacagaaaaggt

SEQ ID NO: 1235065 - DNA, 22 bp, Artificial Sequence
  chemically synthesized
aaggaaaccttttctgtgaaga

SEQ ID NO: 1235066 - DNA, 22 bp, Artificial Sequence
  chemically synthesized
ttctgtgaagattaccttaatt

SEQ ID NO: 1235067 - DNA, 22 bp, Artificial Sequence
  chemically synthesized
agtgacaaggacaattaaggta

SEQ ID NO: 1235068 - DNA, 22 bp, Artificial Sequence
  chemically synthesized
tctgtgaagattaccttaattg

SEQ ID NO: 1235069 - DNA, 22 bp, Artificial Sequence
  chemically synthesized
cagtgacaaggacaattaaggt

SEQ ID NO: 1235070 - DNA, 22 bp, Artificial Sequence
  chemically synthesized
ctgtgaagattaccttaattgt

SEQ ID NO: 1235071 - DNA, 22 bp, Artificial Sequence
  chemically synthesized
tgtgaagattaccttaattgtc

SEQ ID NO: 1235072 - DNA, 22 bp, Artificial Sequence
  chemically synthesized
tgaagattaccttaattgtcct

SEQ ID NO: 1235073 - DNA, 22 bp, Artificial Sequence
  chemically synthesized
gagcttcagtgacaaggacaat

SEQ ID NO: 1235074 - DNA, 22 bp, Artificial Sequence
  chemically synthesized
agagcttcagtgacaaggacaa

SEQ ID NO: 1235075 - DNA, 22 bp, Artificial Sequence
  chemically synthesized
ccttaattgtccttgtcactga

SEQ ID NO: 1235076 - DNA, 22 bp, Artificial Sequence
  chemically synthesized
aggtttagagcttcagtgacaa

SEQ ID NO: 1235077 - DNA, 22 bp, Artificial Sequence
  chemically synthesized
aattgtccttgtcactgaagct

SEQ ID NO: 1235078 - DNA, 22 bp, Artificial Sequence
  chemically synthesized
attgtccttgtcactgaagctc

SEQ ID NO: 1235079 - DNA, 22 bp, Artificial Sequence
  chemically synthesized
tccttgtcactgaagctctaaa

SEQ ID NO: 1235080 - DNA, 22 bp, Artificial Sequence
  chemically synthesized
gtcactgaagctctaaacctca

SEQ ID NO: 1235081 - DNA, 22 bp, Artificial Sequence
  chemically synthesized
tcactgaagctctaaacctcaa

SEQ ID NO: 1235082 - DNA, 22 bp, Artificial Sequence
  chemically synthesized
gggaaccaaagtgattgaggtt

SEQ ID NO: 1235083 - DNA, 22 bp, Artificial Sequence
  chemically synthesized
aagctctaaacctcaatcactt

SEQ ID NO: 1235084 - DNA, 22 bp, Artificial Sequence
  chemically synthesized
taaacctcaatcactttggttc

SEQ ID NO: 1235085 - DNA, 22 bp, Artificial Sequence
  chemically synthesized
aacctcaatcactttggttccc

SEQ ID NO: 1235086 - DNA, 22 bp, Artificial Sequence
  chemically synthesized
agaataaaattagggaaccaaa

SEQ ID NO: 1235087 - DNA, 22 bp, Artificial Sequence
  chemically synthesized
aatcactttggttccctaattt

SEQ ID NO: 1235088 - DNA, 22 bp, Artificial Sequence
  chemically synthesized
ggattgagaataaaattaggga

SEQ ID NO: 1235089 - DNA, 22 bp, Artificial Sequence
  chemically synthesized
gggattgagaataaaattaggg

SEQ ID NO: 1235090 - DNA, 22 bp, Artificial Sequence
  chemically synthesized
tgggattgagaataaaattagg

SEQ ID NO: 1235091 - DNA, 22 bp, Artificial Sequence
  chemically synthesized
ttgggattgagaataaaattag

SEQ ID NO: 1235092 - DNA, 22 bp, Artificial Sequence
  chemically synthesized
tggttccctaattttattctca

SEQ ID NO: 1235093 - DNA, 22 bp, Artificial Sequence
  chemically synthesized
ggttccctaattttattctcaa

SEQ ID NO: 1235094 - DNA, 22 bp, Artificial Sequence
  chemically synthesized
gttccctaattttattctcaat

SEQ ID NO: 1235095 - DNA, 22 bp, Artificial Sequence
  chemically synthesized
cctaattttattctcaatccca

SEQ ID NO: 1235096 - DNA, 22 bp, Artificial Sequence
  chemically synthesized
attttattctcaatcccaaaag

SEQ ID NO: 1235097 - DNA, 22 bp, Artificial Sequence
  chemically synthesized
caggataagatacaacttttgg

SEQ ID NO: 1235098 - DNA, 22 bp, Artificial Sequence
  chemically synthesized
tattctcaatcccaaaagttgt

SEQ ID NO: 1235099 - DNA, 22 bp, Artificial Sequence
  chemically synthesized
attctcaatcccaaaagttgta

SEQ ID NO: 1235100 - DNA, 22 bp, Artificial Sequence
  chemically synthesized
ttctcaatcccaaaagttgtat

SEQ ID NO: 1235101 - DNA, 22 bp, Artificial Sequence
  chemically synthesized
tcaatcccaaaagttgtatctt

SEQ ID NO: 1235102 - DNA, 22 bp, Artificial Sequence
  chemically synthesized
aaaattacaggataagatacaa

SEQ ID NO: 1235103 - DNA, 22 bp, Artificial Sequence
  chemically synthesized
aatcccaaaagttgtatcttat

SEQ ID NO: 1235104 - DNA, 22 bp, Artificial Sequence
  chemically synthesized
aaaaattacaggataagataca

SEQ ID NO: 1235105 - DNA, 22 bp, Artificial Sequence
  chemically synthesized
gtttaaaaattacaggataaga

SEQ ID NO: 1235106 - DNA, 22 bp, Artificial Sequence
  chemically synthesized
tatcttatcctgtaatttttaa

SEQ ID NO: 1235107 - DNA, 22 bp, Artificial Sequence
  chemically synthesized
tgcagatgttggtttaaaaatt

SEQ ID NO: 1235108 - DNA, 22 bp, Artificial Sequence
  chemically synthesized
atcctgtaatttttaaaccaac

SEQ ID NO: 1235109 - DNA, 22 bp, Artificial Sequence
  chemically synthesized
tcctgtaatttttaaaccaaca

SEQ ID NO: 1235110 - DNA, 22 bp, Artificial Sequence
  chemically synthesized
caatgaactatgcagatgttgg

SEQ ID NO: 1235111 - DNA, 22 bp, Artificial Sequence
  chemically synthesized
taatttttaaaccaacatctgc

SEQ ID NO: 1235112 - DNA, 22 bp, Artificial Sequence
  chemically synthesized
ttaaaccaacatctgcatagtt

SEQ ID NO: 1235113 - DNA, 22 bp, Artificial Sequence
  chemically synthesized
tatattacaatgaactatgcag

SEQ ID NO: 1235114 - DNA, 22 bp, Artificial Sequence
  chemically synthesized
taaaccaacatctgcatagttc

SEQ ID NO: 1235115 - DNA, 22 bp, Artificial Sequence
  chemically synthesized
gtatattacaatgaactatgca

SEQ ID NO: 1235116 - DNA, 22 bp, Artificial Sequence
  chemically synthesized
aaaccaacatctgcatagttca

SEQ ID NO: 1235117 - DNA, 22 bp, Artificial Sequence
  chemically synthesized
aaccaacatctgcatagttcat

SEQ ID NO: 1235118 - DNA, 22 bp, Artificial Sequence
  chemically synthesized
atttgtatattacaatgaacta

SEQ ID NO: 1235119 - DNA, 22 bp, Artificial Sequence
  chemically synthesized
catagttcattgtaatatacaa

SEQ ID NO: 1235120 - DNA, 22 bp, Artificial Sequence
  chemically synthesized
ataaatgagttaatttgtatat

SEQ ID NO: 1235121 - DNA, 22 bp, Artificial Sequence
  chemically synthesized
aataaatgagttaatttgtata

SEQ ID NO: 1235122 - DNA, 22 bp, Artificial Sequence
  chemically synthesized
attgtaatatacaaattaactc

SEQ ID NO: 1235123 - DNA, 22 bp, Artificial Sequence
  chemically synthesized
caacttaataaatgagttaatt

SEQ ID NO: 1235124 - DNA, 22 bp, Artificial Sequence
  chemically synthesized
tacaacttaataaatgagttaa

SEQ ID NO: 1235125 - DNA, 22 bp, Artificial Sequence
  chemically synthesized
taatatacaaattaactcattt

SEQ ID NO: 1235126 - DNA, 22 bp, Artificial Sequence
  chemically synthesized
aaactctacaacttaataaatg

SEQ ID NO: 1235127 - DNA, 22 bp, Artificial Sequence
  chemically synthesized
taaaactctacaacttaataaa

SEQ ID NO: 1235128 - DNA, 22 bp, Artificial Sequence
  chemically synthesized
ctaaaactctacaacttaataa

SEQ ID NO: 1235129 - DNA, 22 bp, Artificial Sequence
  chemically synthesized
actcatttattaagttgtagag

SEQ ID NO: 1235130 - DNA, 22 bp, Artificial Sequence
  chemically synthesized
atttattaagttgtagagtttt

SEQ ID NO: 1235131 - DNA, 22 bp, Artificial Sequence
  chemically synthesized
attaagttgtagagttttagaa

SEQ ID NO: 1235132 - DNA, 22 bp, Artificial Sequence
  chemically synthesized
ttaagttgtagagttttagaaa

SEQ ID NO: 1235133 - DNA, 22 bp, Artificial Sequence
  chemically synthesized
tcataatggtagaatttctaaa

SEQ ID NO: 1235134 - DNA, 22 bp, Artificial Sequence
  chemically synthesized
agttgtagagttttagaaattc

SEQ ID NO: 1235135 - DNA, 22 bp, Artificial Sequence
  chemically synthesized
tagagttttagaaattctacca

SEQ ID NO: 1235136 - DNA, 22 bp, Artificial Sequence
  chemically synthesized
tagaaattctaccattatgata

SEQ ID NO: 1235137 - DNA, 22 bp, Artificial Sequence
  chemically synthesized
agaaattctaccattatgataa

SEQ ID NO: 1235138 - DNA, 22 bp, Artificial Sequence
  chemically synthesized
gaaattctaccattatgataac

SEQ ID NO: 1235139 - DNA, 22 bp, Artificial Sequence
  chemically synthesized
taccattatgataacctgtttt

SEQ ID NO: 1235140 - DNA, 22 bp, Artificial Sequence
  chemically synthesized
ccattatgataacctgttttat

SEQ ID NO: 1235141 - DNA, 22 bp, Artificial Sequence
  chemically synthesized
tgataacctgttttatttactc

SEQ ID NO: 1235142 - DNA, 22 bp, Artificial Sequence
  chemically synthesized
ttttatttactctcattttcat

SEQ ID NO: 1235143 - DNA, 22 bp, Artificial Sequence
  chemically synthesized
tatttactctcattttcatttc

SEQ ID NO: 1235144 - DNA, 22 bp, Artificial Sequence
  chemically synthesized
atttactctcattttcatttct

SEQ ID NO: 1235145 - DNA, 22 bp, Artificial Sequence
  chemically synthesized
tagtaaggtaaaagaaatgaaa

SEQ ID NO: 1235146 - DNA, 22 bp, Artificial Sequence
  chemically synthesized
tttactctcattttcatttctt

SEQ ID NO: 1235147 - DNA, 22 bp, Artificial Sequence
  chemically synthesized
gtagtaaggtaaaagaaatgaa

SEQ ID NO: 1235148 - DNA, 22 bp, Artificial Sequence
  chemically synthesized
actctcattttcatttctttta

SEQ ID NO: 1235149 - DNA, 22 bp, Artificial Sequence
  chemically synthesized
ctctcattttcatttcttttac

SEQ ID NO: 1235150 - DNA, 22 bp, Artificial Sequence
  chemically synthesized
tcattttcatttcttttacctt

SEQ ID NO: 1235151 - DNA, 22 bp, Artificial Sequence
  chemically synthesized
attttcatttcttttaccttac

SEQ ID NO: 1235152 - DNA, 22 bp, Artificial Sequence
  chemically synthesized
ataagggcttgtagtaaggtaa

SEQ ID NO: 1235153 - DNA, 22 bp, Artificial Sequence
  chemically synthesized
tcatttcttttaccttactaca

SEQ ID NO: 1235154 - DNA, 22 bp, Artificial Sequence
  chemically synthesized
catttcttttaccttactacaa

SEQ ID NO: 1235155 - DNA, 22 bp, Artificial Sequence
  chemically synthesized
atttcttttaccttactacaag

SEQ ID NO: 1235156 - DNA, 22 bp, Artificial Sequence
  chemically synthesized
cttttaccttactacaagccct

SEQ ID NO: 1235157 - DNA, 22 bp, Artificial Sequence
  chemically synthesized
ttttaccttactacaagccctt

SEQ ID NO: 1235158 - DNA, 22 bp, Artificial Sequence
  chemically synthesized
ggcaatagctaataagggcttg

SEQ ID NO: 1235159 - DNA, 22 bp, Artificial Sequence
  chemically synthesized
ttaccttactacaagcccttat

SEQ ID NO: 1235160 - DNA, 22 bp, Artificial Sequence
  chemically synthesized
taccttactacaagcccttatt

SEQ ID NO: 1235161 - DNA, 22 bp, Artificial Sequence
  chemically synthesized
tgggcaatagctaataagggct

SEQ ID NO: 1235162 - DNA, 22 bp, Artificial Sequence
  chemically synthesized
accttactacaagcccttatta

SEQ ID NO: 1235163 - DNA, 22 bp, Artificial Sequence
  chemically synthesized
ccttactacaagcccttattag

SEQ ID NO: 1235164 - DNA, 22 bp, Artificial Sequence
  chemically synthesized
tctgggcaatagctaataaggg

SEQ ID NO: 1235165 - DNA, 22 bp, Artificial Sequence
  chemically synthesized
ctctgggcaatagctaataagg

SEQ ID NO: 1235166 - DNA, 22 bp, Artificial Sequence
  chemically synthesized
actacaagcccttattagctat

SEQ ID NO: 1235167 - DNA, 22 bp, Artificial Sequence
  chemically synthesized
ctacaagcccttattagctatt

SEQ ID NO: 1235168 - DNA, 22 bp, Artificial Sequence
  chemically synthesized
gatttctctgggcaatagctaa

SEQ ID NO: 1235169 - DNA, 22 bp, Artificial Sequence
  chemically synthesized
caagcccttattagctattgcc

SEQ ID NO: 1235170 - DNA, 22 bp, Artificial Sequence
  chemically synthesized
attagctattgcccagagaaat

SEQ ID NO: 1235171 - DNA, 22 bp, Artificial Sequence
  chemically synthesized
ttagctattgcccagagaaatc

SEQ ID NO: 1235172 - DNA, 22 bp, Artificial Sequence
  chemically synthesized
gctattgcccagagaaatctaa

SEQ ID NO: 1235173 - DNA, 22 bp, Artificial Sequence
  chemically synthesized
ttgcccagagaaatctaacctc

SEQ ID NO: 1235174 - DNA, 22 bp, Artificial Sequence
  chemically synthesized
cccagagaaatctaacctcttt

SEQ ID NO: 1235175 - DNA, 22 bp, Artificial Sequence
  chemically synthesized
acctctttcccttctccactca

SEQ ID NO: 1235176 - DNA, 22 bp, Artificial Sequence
  chemically synthesized
tttcccttctccactcactcac

SEQ ID NO: 1235177 - DNA, 22 bp, Artificial Sequence
  chemically synthesized
tcccttctccactcactcacca

SEQ ID NO: 1235178 - DNA, 22 bp, Artificial Sequence
  chemically synthesized
cccttctccactcactcaccat

SEQ ID NO: 1235179 - DNA, 22 bp, Artificial Sequence
  chemically synthesized
ccttctccactcactcaccatt

SEQ ID NO: 1235180 - DNA, 22 bp, Artificial Sequence
  chemically synthesized
ctccactcactcaccatttttt

SEQ ID NO: 1235181 - DNA, 22 bp, Artificial Sequence
  chemically synthesized
tccactcactcaccattttttt

SEQ ID NO: 1235182 - DNA, 22 bp, Artificial Sequence
  chemically synthesized
cactcactcaccatttttttca

SEQ ID NO: 1235183 - DNA, 22 bp, Artificial Sequence
  chemically synthesized
actcaccatttttttcatcctt

SEQ ID NO: 1235184 - DNA, 22 bp, Artificial Sequence
  chemically synthesized
atggtatgaaggaaggatgaaa

SEQ ID NO: 1235185 - DNA, 22 bp, Artificial Sequence
  chemically synthesized
ttgatggtatgaaggaaggatg

SEQ ID NO: 1235186 - DNA, 22 bp, Artificial Sequence
  chemically synthesized
accatttttttcatccttcctt

SEQ ID NO: 1235187 - DNA, 22 bp, Artificial Sequence
  chemically synthesized
ttttcatccttccttcatacca

SEQ ID NO: 1235188 - DNA, 22 bp, Artificial Sequence
  chemically synthesized
tttcatccttccttcataccat

SEQ ID NO: 1235189 - DNA, 22 bp, Artificial Sequence
  chemically synthesized
ttcatccttccttcataccatc

SEQ ID NO: 1235190 - DNA, 22 bp, Artificial Sequence
  chemically synthesized
tcatccttccttcataccatca

SEQ ID NO: 1235191 - DNA, 22 bp, Artificial Sequence
  chemically synthesized
catccttccttcataccatcaa

SEQ ID NO: 1235192 - DNA, 22 bp, Artificial Sequence
  chemically synthesized
atccttccttcataccatcaac

SEQ ID NO: 1235193 - DNA, 22 bp, Artificial Sequence
  chemically synthesized
aggaacgtcattgttgatggta

SEQ ID NO: 1235194 - DNA, 22 bp, Artificial Sequence
  chemically synthesized
caggaacgtcattgttgatggt

SEQ ID NO: 1235195 - DNA, 22 bp, Artificial Sequence
  chemically synthesized
cttcaggaacgtcattgttgat

SEQ ID NO: 1235196 - DNA, 22 bp, Artificial Sequence
  chemically synthesized
acttcaggaacgtcattgttga

SEQ ID NO: 1235197 - DNA, 22 bp, Artificial Sequence
  chemically synthesized
ccttcataccatcaacaatgac

SEQ ID NO: 1235198 - DNA, 22 bp, Artificial Sequence
  chemically synthesized
cttcataccatcaacaatgacg

SEQ ID NO: 1235199 - DNA, 22 bp, Artificial Sequence
  chemically synthesized
cataccatcaacaatgacgttc

SEQ ID NO: 1235200 - DNA, 22 bp, Artificial Sequence
  chemically synthesized
ataccatcaacaatgacgttcc

SEQ ID NO: 1235201 - DNA, 22 bp, Artificial Sequence
  chemically synthesized
gcagtgggcttacttcaggaac

SEQ ID NO: 1235202 - DNA, 22 bp, Artificial Sequence
  chemically synthesized
cattggcagtgggcttacttca

SEQ ID NO: 1235203 - DNA, 22 bp, Artificial Sequence
  chemically synthesized
gcattggcagtgggcttacttc

SEQ ID NO: 1235204 - DNA, 22 bp, Artificial Sequence
  chemically synthesized
ctgaagtaagcccactgccaat

SEQ ID NO: 1235205 - DNA, 22 bp, Artificial Sequence
  chemically synthesized
caagtggtttgcattggcagtg

SEQ ID NO: 1235206 - DNA, 22 bp, Artificial Sequence
  chemically synthesized
gcaagtggtttgcattggcagt

SEQ ID NO: 1235207 - DNA, 22 bp, Artificial Sequence
  chemically synthesized
tgcaagtggtttgcattggcag

SEQ ID NO: 1235208 - DNA, 22 bp, Artificial Sequence
  chemically synthesized
aagtaagcccactgccaatgca

SEQ ID NO: 1235209 - DNA, 22 bp, Artificial Sequence
  chemically synthesized
ggtgagaactttgcaagtggtt

SEQ ID NO: 1235210 - DNA, 22 bp, Artificial Sequence
  chemically synthesized
aggtgagaactttgcaagtggt

SEQ ID NO: 1235211 - DNA, 22 bp, Artificial Sequence
  chemically synthesized
ccaatgcaaaccacttgcaaag

SEQ ID NO: 1235212 - DNA, 22 bp, Artificial Sequence
  chemically synthesized
taatcacccaaatgtttaggtg

SEQ ID NO: 1235213 - DNA, 22 bp, Artificial Sequence
  chemically synthesized
gcaaagttctcacctaaacatt

SEQ ID NO: 1235214 - DNA, 22 bp, Artificial Sequence
  chemically synthesized
caaagttctcacctaaacattt

SEQ ID NO: 1235215 - DNA, 22 bp, Artificial Sequence
  chemically synthesized
cctataatcacccaaatgttta

SEQ ID NO: 1235216 - DNA, 22 bp, Artificial Sequence
  chemically synthesized
ttacctataatcacccaaatgt

SEQ ID NO: 1235217 - DNA, 22 bp, Artificial Sequence
  chemically synthesized
tcacctaaacatttgggtgatt

SEQ ID NO: 1235218 - DNA, 22 bp, Artificial Sequence
  chemically synthesized
actgttacctataatcacccaa

SEQ ID NO: 1235219 - DNA, 22 bp, Artificial Sequence
  chemically synthesized
aactgttacctataatcaccca

SEQ ID NO: 1235220 - DNA, 22 bp, Artificial Sequence
  chemically synthesized
acctaaacatttgggtgattat

SEQ ID NO: 1235221 - DNA, 22 bp, Artificial Sequence
  chemically synthesized
cccttaactgttacctataatc

SEQ ID NO: 1235222 - DNA, 22 bp, Artificial Sequence
  chemically synthesized
aacatttgggtgattataggta

SEQ ID NO: 1235223 - DNA, 22 bp, Artificial Sequence
  chemically synthesized
gcccttaactgttacctataat

SEQ ID NO: 1235224 - DNA, 22 bp, Artificial Sequence
  chemically synthesized
ttgcccttaactgttacctata

SEQ ID NO: 1235225 - DNA, 22 bp, Artificial Sequence
  chemically synthesized
gggtgattataggtaacagtta

SEQ ID NO: 1235226 - DNA, 22 bp, Artificial Sequence
  chemically synthesized
ggtgattataggtaacagttaa

SEQ ID NO: 1235227 - DNA, 22 bp, Artificial Sequence
  chemically synthesized
tagctcttgcccttaactgtta

SEQ ID NO: 1235228 - DNA, 22 bp, Artificial Sequence
  chemically synthesized
gtagctcttgcccttaactgtt

SEQ ID NO: 1235229 - DNA, 22 bp, Artificial Sequence
  chemically synthesized
tgtagctcttgcccttaactgt

SEQ ID NO: 1235230 - DNA, 22 bp, Artificial Sequence
  chemically synthesized
taggtaacagttaagggcaaga

SEQ ID NO: 1235231 - DNA, 22 bp, Artificial Sequence
  chemically synthesized
aacccaggcagtcagctttgta

SEQ ID NO: 1235232 - DNA, 22 bp, Artificial Sequence
  chemically synthesized
agggcaagagctacaaagctga

SEQ ID NO: 1235233 - DNA, 22 bp, Artificial Sequence
  chemically synthesized
acaattgaacccaggcagtcag

SEQ ID NO: 1235234 - DNA, 22 bp, Artificial Sequence
  chemically synthesized
caaagctgactgcctgggttca

SEQ ID NO: 1235235 - DNA, 22 bp, Artificial Sequence
  chemically synthesized
actgcctgggttcaattgtcag

SEQ ID NO: 1235236 - DNA, 22 bp, Artificial Sequence
  chemically synthesized
cctgggttcaattgtcagctct

SEQ ID NO: 1235237 - DNA, 22 bp, Artificial Sequence
  chemically synthesized
ggttcaattgtcagctctgctg

SEQ ID NO: 1235238 - DNA, 22 bp, Artificial Sequence
  chemically synthesized
aattgtcagctctgctgttttt

SEQ ID NO: 1235239 - DNA, 22 bp, Artificial Sequence
  chemically synthesized
tcagctctgctgtttttgtgct

SEQ ID NO: 1235240 - DNA, 22 bp, Artificial Sequence
  chemically synthesized
tgtaggccagacagcacaaaaa

SEQ ID NO: 1235241 - DNA, 22 bp, Artificial Sequence
  chemically synthesized
atgtaggccagacagcacaaaa

SEQ ID NO: 1235242 - DNA, 22 bp, Artificial Sequence
  chemically synthesized
tatgtaggccagacagcacaaa

SEQ ID NO: 1235243 - DNA, 22 bp, Artificial Sequence
  chemically synthesized
ttatgtaggccagacagcacaa

SEQ ID NO: 1235244 - DNA, 22 bp, Artificial Sequence
  chemically synthesized
tttatgtaggccagacagcaca

SEQ ID NO: 1235245 - DNA, 22 bp, Artificial Sequence
  chemically synthesized
tgctgtttttgtgctgtctggc

SEQ ID NO: 1235246 - DNA, 22 bp, Artificial Sequence
  chemically synthesized
ctgtttttgtgctgtctggcct

SEQ ID NO: 1235247 - DNA, 22 bp, Artificial Sequence
  chemically synthesized
aattttttatgtaggccagaca

SEQ ID NO: 1235248 - DNA, 22 bp, Artificial Sequence
  chemically synthesized
tttttgtgctgtctggcctaca

SEQ ID NO: 1235249 - DNA, 22 bp, Artificial Sequence
  chemically synthesized
ttgtgctgtctggcctacataa

SEQ ID NO: 1235250 - DNA, 22 bp, Artificial Sequence
  chemically synthesized
tgtgctgtctggcctacataaa

SEQ ID NO: 1235251 - DNA, 22 bp, Artificial Sequence
  chemically synthesized
gtgctgtctggcctacataaaa

SEQ ID NO: 1235252 - DNA, 22 bp, Artificial Sequence
  chemically synthesized
tgctgtctggcctacataaaaa

SEQ ID NO: 1235253 - DNA, 22 bp, Artificial Sequence
  chemically synthesized
tctggcctacataaaaaattta

SEQ ID NO: 1235254 - DNA, 22 bp, Artificial Sequence
  chemically synthesized
gtatacagggagattaaatttt

SEQ ID NO: 1235255 - DNA, 22 bp, Artificial Sequence
  chemically synthesized
gcctacataaaaaatttaatct

SEQ ID NO: 1235256 - DNA, 22 bp, Artificial Sequence
  chemically synthesized
cataaaaaatttaatctccctg

SEQ ID NO: 1235257 - DNA, 22 bp, Artificial Sequence
  chemically synthesized
acagatgagaaaactggtatac

SEQ ID NO: 1235258 - DNA, 22 bp, Artificial Sequence
  chemically synthesized
aacagatgagaaaactggtata

SEQ ID NO: 1235259 - DNA, 22 bp, Artificial Sequence
  chemically synthesized
taacagatgagaaaactggtat

SEQ ID NO: 1235260 - DNA, 22 bp, Artificial Sequence
  chemically synthesized
aatctccctgtataccagtttt

SEQ ID NO: 1235261 - DNA, 22 bp, Artificial Sequence
  chemically synthesized
ttaacagatgagaaaactggta

SEQ ID NO: 1235262 - DNA, 22 bp, Artificial Sequence
  chemically synthesized
atctccctgtataccagttttc

SEQ ID NO: 1235263 - DNA, 22 bp, Artificial Sequence
  chemically synthesized
cctgtataccagttttctcatc

SEQ ID NO: 1235264 - DNA, 22 bp, Artificial Sequence
  chemically synthesized
agtccatttttaacagatgaga

SEQ ID NO: 1235265 - DNA, 22 bp, Artificial Sequence
  chemically synthesized
tataccagttttctcatctgtt

SEQ ID NO: 1235266 - DNA, 22 bp, Artificial Sequence
  chemically synthesized
attaagtccatttttaacagat

SEQ ID NO: 1235267 - DNA, 22 bp, Artificial Sequence
  chemically synthesized
cattaagtccatttttaacaga

SEQ ID NO: 1235268 - DNA, 22 bp, Artificial Sequence
  chemically synthesized
tcattaagtccatttttaacag

SEQ ID NO: 1235269 - DNA, 22 bp, Artificial Sequence
  chemically synthesized
tctcatctgttaaaaatggact

SEQ ID NO: 1235270 - DNA, 22 bp, Artificial Sequence
  chemically synthesized
atattttcattaagtccatttt

SEQ ID NO: 1235271 - DNA, 22 bp, Artificial Sequence
  chemically synthesized
ctcatctgttaaaaatggactt

SEQ ID NO: 1235272 - DNA, 22 bp, Artificial Sequence
  chemically synthesized
tcatctgttaaaaatggactta

SEQ ID NO: 1235273 - DNA, 22 bp, Artificial Sequence
  chemically synthesized
ctaatattttcattaagtccat

SEQ ID NO: 1235274 - DNA, 22 bp, Artificial Sequence
  chemically synthesized
atctgttaaaaatggacttaat

SEQ ID NO: 1235275 - DNA, 22 bp, Artificial Sequence
  chemically synthesized
gctaatattttcattaagtcca

SEQ ID NO: 1235276 - DNA, 22 bp, Artificial Sequence
  chemically synthesized
ttgctaatattttcattaagtc

SEQ ID NO: 1235277 - DNA, 22 bp, Artificial Sequence
  chemically synthesized
ttaaaaatggacttaatgaaaa

SEQ ID NO: 1235278 - DNA, 22 bp, Artificial Sequence
  chemically synthesized
aaaatggacttaatgaaaatat

SEQ ID NO: 1235279 - DNA, 22 bp, Artificial Sequence
  chemically synthesized
tgtatgcctcttgctaatattt

SEQ ID NO: 1235280 - DNA, 22 bp, Artificial Sequence
  chemically synthesized
gtgtatgcctcttgctaatatt

SEQ ID NO: 1235281 - DNA, 22 bp, Artificial Sequence
  chemically synthesized
aatgaaaatattagcaagaggc

SEQ ID NO: 1235282 - DNA, 22 bp, Artificial Sequence
  chemically synthesized
taacttgtgtatgcctcttgct

SEQ ID NO: 1235283 - DNA, 22 bp, Artificial Sequence
  chemically synthesized
atgaaaatattagcaagaggca

SEQ ID NO: 1235284 - DNA, 22 bp, Artificial Sequence
  chemically synthesized
gcaagaggcatacacaagttac

SEQ ID NO: 1235285 - DNA, 22 bp, Artificial Sequence
  chemically synthesized
agagcacatgttgtaacttgtg

SEQ ID NO: 1235286 - DNA, 22 bp, Artificial Sequence
  chemically synthesized
ttgagagcacatgttgtaactt

SEQ ID NO: 1235287 - DNA, 22 bp, Artificial Sequence
  chemically synthesized
ttattgagagcacatgttgtaa

SEQ ID NO: 1235288 - DNA, 22 bp, Artificial Sequence
  chemically synthesized
caacatgtgctctcaataacaa

SEQ ID NO: 1235289 - DNA, 22 bp, Artificial Sequence
  chemically synthesized
taaatcagagcagttgttattg

SEQ ID NO: 1235290 - DNA, 22 bp, Artificial Sequence
  chemically synthesized
gtaaatcagagcagttgttatt

SEQ ID NO: 1235291 - DNA, 22 bp, Artificial Sequence
  chemically synthesized
ttgtaaatcagagcagttgtta

SEQ ID NO: 1235292 - DNA, 22 bp, Artificial Sequence
  chemically synthesized
tcttgtaaatcagagcagttgt

SEQ ID NO: 1235293 - DNA, 22 bp, Artificial Sequence
  chemically synthesized
tcaataacaactgctctgattt

SEQ ID NO: 1235294 - DNA, 22 bp, Artificial Sequence
  chemically synthesized
aataacaactgctctgatttac

SEQ ID NO: 1235295 - DNA, 22 bp, Artificial Sequence
  chemically synthesized
ctctgatttacaagagaattcg

SEQ ID NO: 1235296 - DNA, 22 bp, Artificial Sequence
  chemically synthesized
tgatttacaagagaattcgaca

SEQ ID NO: 1235297 - DNA, 22 bp, Artificial Sequence
  chemically synthesized
atttacaagagaattcgacata

SEQ ID NO: 1235298 - DNA, 22 bp, Artificial Sequence
  chemically synthesized
acaagagaattcgacatacttt

SEQ ID NO: 1235299 - DNA, 22 bp, Artificial Sequence
  chemically synthesized
caagagaattcgacatactttc

SEQ ID NO: 1235300 - DNA, 22 bp, Artificial Sequence
  chemically synthesized
aaatgcagagaagaaagtatgt

SEQ ID NO: 1235301 - DNA, 22 bp, Artificial Sequence
  chemically synthesized
acctcaaatgcagagaagaaag

SEQ ID NO: 1235302 - DNA, 22 bp, Artificial Sequence
  chemically synthesized
gacctcaaatgcagagaagaaa

SEQ ID NO: 1235303 - DNA, 22 bp, Artificial Sequence
  chemically synthesized
tgacctcaaatgcagagaagaa

SEQ ID NO: 1235304 - DNA, 22 bp, Artificial Sequence
  chemically synthesized
gacatactttcttctctgcatt

SEQ ID NO: 1235305 - DNA, 22 bp, Artificial Sequence
  chemically synthesized
agtgagggctttgacctcaaat

SEQ ID NO: 1235306 - DNA, 22 bp, Artificial Sequence
  chemically synthesized
gagtgagggctttgacctcaaa

SEQ ID NO: 1235307 - DNA, 22 bp, Artificial Sequence
  chemically synthesized
tcttctctgcatttgaggtcaa

SEQ ID NO: 1235308 - DNA, 22 bp, Artificial Sequence
  chemically synthesized
cttctctgcatttgaggtcaaa

SEQ ID NO: 1235309 - DNA, 22 bp, Artificial Sequence
  chemically synthesized
ttctctgcatttgaggtcaaag

SEQ ID NO: 1235310 - DNA, 22 bp, Artificial Sequence
  chemically synthesized
ctctgcatttgaggtcaaagcc

SEQ ID NO: 1235311 - DNA, 22 bp, Artificial Sequence
  chemically synthesized
tctgcatttgaggtcaaagccc

SEQ ID NO: 1235312 - DNA, 22 bp, Artificial Sequence
  chemically synthesized
atgtttgagtgagggctttgac

SEQ ID NO: 1235313 - DNA, 22 bp, Artificial Sequence
  chemically synthesized
catgtttgagtgagggctttga

SEQ ID NO: 1235314 - DNA, 22 bp, Artificial Sequence
  chemically synthesized
tgcatttgaggtcaaagccctc

SEQ ID NO: 1235315 - DNA, 22 bp, Artificial Sequence
  chemically synthesized
catttgaggtcaaagccctcac

SEQ ID NO: 1235316 - DNA, 22 bp, Artificial Sequence
  chemically synthesized
gaggtcaaagccctcactcaaa

SEQ ID NO: 1235317 - DNA, 22 bp, Artificial Sequence
  chemically synthesized
aggtcaaagccctcactcaaac

SEQ ID NO: 1235318 - DNA, 22 bp, Artificial Sequence
  chemically synthesized
tgagacagcatgcttcatgttt

SEQ ID NO: 1235319 - DNA, 22 bp, Artificial Sequence
  chemically synthesized
gatcctgtgagacagcatgctt

SEQ ID NO: 1235320 - DNA, 22 bp, Artificial Sequence
  chemically synthesized
actcaaacatgaagcatgctgt

SEQ ID NO: 1235321 - DNA, 22 bp, Artificial Sequence
  chemically synthesized
aaacatgaagcatgctgtctca

SEQ ID NO: 1235322 - DNA, 22 bp, Artificial Sequence
  chemically synthesized
gacaaggtctggatcctgtgag

SEQ ID NO: 1235323 - DNA, 22 bp, Artificial Sequence
  chemically synthesized
tctcacaggatccagaccttgt

SEQ ID NO: 1235324 - DNA, 22 bp, Artificial Sequence
  chemically synthesized
acaggatccagaccttgtccag

SEQ ID NO: 1235325 - DNA, 22 bp, Artificial Sequence
  chemically synthesized
agcaatatgaacaataagtagt

SEQ ID NO: 1235326 - DNA, 22 bp, Artificial Sequence
  chemically synthesized
gagcaatatgaacaataagtag

SEQ ID NO: 1235327 - DNA, 22 bp, Artificial Sequence
  chemically synthesized
gtccagggcactacttattgtt

SEQ ID NO: 1235328 - DNA, 22 bp, Artificial Sequence
  chemically synthesized
tccagggcactacttattgttc

SEQ ID NO: 1235329 - DNA, 22 bp, Artificial Sequence
  chemically synthesized
cttattgttcatattgctcaaa

SEQ ID NO: 1235330 - DNA, 22 bp, Artificial Sequence
  chemically synthesized
attgttcatattgctcaaacca

SEQ ID NO: 1235331 - DNA, 22 bp, Artificial Sequence
  chemically synthesized
ttgttcatattgctcaaaccat

SEQ ID NO: 1235332 - DNA, 22 bp, Artificial Sequence
  chemically synthesized
ttcatattgctcaaaccattgt

SEQ ID NO: 1235333 - DNA, 22 bp, Artificial Sequence
  chemically synthesized
atattgctcaaaccattgtaca

SEQ ID NO: 1235334 - DNA, 22 bp, Artificial Sequence
  chemically synthesized
ccagaaaccatatgtacaatgg

SEQ ID NO: 1235335 - DNA, 22 bp, Artificial Sequence
  chemically synthesized
tgccagaaaccatatgtacaat

SEQ ID NO: 1235336 - DNA, 22 bp, Artificial Sequence
  chemically synthesized
ctcaaaccattgtacatatggt

SEQ ID NO: 1235337 - DNA, 22 bp, Artificial Sequence
  chemically synthesized
aattctgccagaaaccatatgt

SEQ ID NO: 1235338 - DNA, 22 bp, Artificial Sequence
  chemically synthesized
aaaccattgtacatatggtttc

SEQ ID NO: 1235339 - DNA, 22 bp, Artificial Sequence
  chemically synthesized
tacatatggtttctggcagaat

SEQ ID NO: 1235340 - DNA, 22 bp, Artificial Sequence
  chemically synthesized
tgcatatcgacacactgaattc

SEQ ID NO: 1235341 - DNA, 22 bp, Artificial Sequence
  chemically synthesized
atgcatatcgacacactgaatt

SEQ ID NO: 1235342 - DNA, 22 bp, Artificial Sequence
  chemically synthesized
tatgcatatcgacacactgaat

SEQ ID NO: 1235343 - DNA, 22 bp, Artificial Sequence
  chemically synthesized
ctggcagaattcagtgtgtcga

SEQ ID NO: 1235344 - DNA, 22 bp, Artificial Sequence
  chemically synthesized
tggcagaattcagtgtgtcgat

SEQ ID NO: 1235345 - DNA, 22 bp, Artificial Sequence
  chemically synthesized
gtgctttatgcatatcgacaca

SEQ ID NO: 1235346 - DNA, 22 bp, Artificial Sequence
  chemically synthesized
gcagaattcagtgtgtcgatat

SEQ ID NO: 1235347 - DNA, 22 bp, Artificial Sequence
  chemically synthesized
agtgctttatgcatatcgacac

SEQ ID NO: 1235348 - DNA, 22 bp, Artificial Sequence
  chemically synthesized
agtgtgtcgatatgcataaagc

SEQ ID NO: 1235349 - DNA, 22 bp, Artificial Sequence
  chemically synthesized
tgtgacaagcaccaatcttagt

SEQ ID NO: 1235350 - DNA, 22 bp, Artificial Sequence
  chemically synthesized
gaccaactatgtgacaagcacc

SEQ ID NO: 1235351 - DNA, 22 bp, Artificial Sequence
  chemically synthesized
tgttggaccaactatgtgacaa

SEQ ID NO: 1235352 - DNA, 22 bp, Artificial Sequence
  chemically synthesized
atgttggaccaactatgtgaca

SEQ ID NO: 1235353 - DNA, 22 bp, Artificial Sequence
  chemically synthesized
agattggtgcttgtcacatagt

SEQ ID NO: 1235354 - DNA, 22 bp, Artificial Sequence
  chemically synthesized
gtgcttgtcacatagttggtcc

SEQ ID NO: 1235355 - DNA, 22 bp, Artificial Sequence
  chemically synthesized
gtcacatagttggtccaacata

SEQ ID NO: 1235356 - DNA, 22 bp, Artificial Sequence
  chemically synthesized
tcacatagttggtccaacataa

SEQ ID NO: 1235357 - DNA, 22 bp, Artificial Sequence
  chemically synthesized
cgaagtcaataatatttatgtt

SEQ ID NO: 1235358 - DNA, 22 bp, Artificial Sequence
  chemically synthesized
gtccaacataaatattattgac

SEQ ID NO: 1235359 - DNA, 22 bp, Artificial Sequence
  chemically synthesized
gcacatactacgaagtcaataa

SEQ ID NO: 1235360 - DNA, 22 bp, Artificial Sequence
  chemically synthesized
ggcacatactacgaagtcaata

SEQ ID NO: 1235361 - DNA, 22 bp, Artificial Sequence
  chemically synthesized
aaagtacttggcacatactacg

SEQ ID NO: 1235362 - DNA, 22 bp, Artificial Sequence
  chemically synthesized
ttgacttcgtagtatgtgccaa

SEQ ID NO: 1235363 - DNA, 22 bp, Artificial Sequence
  chemically synthesized
acttcgtagtatgtgccaagta

SEQ ID NO: 1235364 - DNA, 22 bp, Artificial Sequence
  chemically synthesized
cgtagtatgtgccaagtacttt

SEQ ID NO: 1235365 - DNA, 22 bp, Artificial Sequence
  chemically synthesized
gtagtatgtgccaagtactttg

SEQ ID NO: 1235366 - DNA, 22 bp, Artificial Sequence
  chemically synthesized
aaggtagtgcattcaaagtact

SEQ ID NO: 1235367 - DNA, 22 bp, Artificial Sequence
  chemically synthesized
caaggcggggattaaaggtagt

SEQ ID NO: 1235368 - DNA, 22 bp, Artificial Sequence
  chemically synthesized
gcaaggcggggattaaaggtag

SEQ ID NO: 1235369 - DNA, 22 bp, Artificial Sequence
  chemically synthesized
tgaatgcactacctttaatccc

SEQ ID NO: 1235370 - DNA, 22 bp, Artificial Sequence
  chemically synthesized
ccttgcaaggcggggattaaag

SEQ ID NO: 1235371 - DNA, 22 bp, Artificial Sequence
  chemically synthesized
gaatgcactacctttaatcccc

SEQ ID NO: 1235372 - DNA, 22 bp, Artificial Sequence
  chemically synthesized
aatgcactacctttaatccccg

SEQ ID NO: 1235373 - DNA, 22 bp, Artificial Sequence
  chemically synthesized
actgccttgcaaggcggggatt

SEQ ID NO: 1235374 - DNA, 22 bp, Artificial Sequence
  chemically synthesized
cctttaatccccgccttgcaag

SEQ ID NO: 1235375 - DNA, 22 bp, Artificial Sequence
  chemically synthesized
taatccccgccttgcaaggcag

SEQ ID NO: 1235376 - DNA, 22 bp, Artificial Sequence
  chemically synthesized
aatccccgccttgcaaggcagt

SEQ ID NO: 1235377 - DNA, 22 bp, Artificial Sequence
  chemically synthesized
atccccgccttgcaaggcagtt

SEQ ID NO: 1235378 - DNA, 22 bp, Artificial Sequence
  chemically synthesized
tacaatagggatgaaactaact

SEQ ID NO: 1235379 - DNA, 22 bp, Artificial Sequence
  chemically synthesized
tgtacaatagggatgaaactaa

SEQ ID NO: 1235380 - DNA, 22 bp, Artificial Sequence
  chemically synthesized
ctgtacaatagggatgaaacta

SEQ ID NO: 1235381 - DNA, 22 bp, Artificial Sequence
  chemically synthesized
gcaaggcagttagtttcatccc

SEQ ID NO: 1235382 - DNA, 22 bp, Artificial Sequence
  chemically synthesized
caaggcagttagtttcatccct

SEQ ID NO: 1235383 - DNA, 22 bp, Artificial Sequence
  chemically synthesized
acttctgtacaatagggatgaa

SEQ ID NO: 1235384 - DNA, 22 bp, Artificial Sequence
  chemically synthesized
aggttcacttctgtacaatagg

SEQ ID NO: 1235385 - DNA, 22 bp, Artificial Sequence
  chemically synthesized
gtttcatccctattgtacagaa

SEQ ID NO: 1235386 - DNA, 22 bp, Artificial Sequence
  chemically synthesized
acctgaggttcacttctgtaca

SEQ ID NO: 1235387 - DNA, 22 bp, Artificial Sequence
  chemically synthesized
aacctgaggttcacttctgtac

SEQ ID NO: 1235388 - DNA, 22 bp, Artificial Sequence
  chemically synthesized
taacctgaggttcacttctgta

SEQ ID NO: 1235389 - DNA, 22 bp, Artificial Sequence
  chemically synthesized
catccctattgtacagaagtga

SEQ ID NO: 1235390 - DNA, 22 bp, Artificial Sequence
  chemically synthesized
atccctattgtacagaagtgaa

SEQ ID NO: 1235391 - DNA, 22 bp, Artificial Sequence
  chemically synthesized
gatattttaacctgaggttcac

SEQ ID NO: 1235392 - DNA, 22 bp, Artificial Sequence
  chemically synthesized
ttgtacagaagtgaacctcagg

SEQ ID NO: 1235393 - DNA, 22 bp, Artificial Sequence
  chemically synthesized
tacagaagtgaacctcaggtta

SEQ ID NO: 1235394 - DNA, 22 bp, Artificial Sequence
  chemically synthesized
tatattagatattttaacctga

SEQ ID NO: 1235395 - DNA, 22 bp, Artificial Sequence
  chemically synthesized
tatggtaatctatatattagat

SEQ ID NO: 1235396 - DNA, 22 bp, Artificial Sequence
  chemically synthesized
aggttaaaatatctaatatata

SEQ ID NO: 1235397 - DNA, 22 bp, Artificial Sequence
  chemically synthesized
gttatatggtaatctatatatt

SEQ ID NO: 1235398 - DNA, 22 bp, Artificial Sequence
  chemically synthesized
ttagttatatggtaatctatat

SEQ ID NO: 1235399 - DNA, 22 bp, Artificial Sequence
  chemically synthesized
aaatatctaatatatagattac

SEQ ID NO: 1235400 - DNA, 22 bp, Artificial Sequence
  chemically synthesized
caccaattattagttatatggt

SEQ ID NO: 1235401 - DNA, 22 bp, Artificial Sequence
  chemically synthesized
atatatagattaccatataact

SEQ ID NO: 1235402 - DNA, 22 bp, Artificial Sequence
  chemically synthesized
gctccaccaattattagttata

SEQ ID NO: 1235403 - DNA, 22 bp, Artificial Sequence
  chemically synthesized
ggtcctggctccaccaattatt

SEQ ID NO: 1235404 - DNA, 22 bp, Artificial Sequence
  chemically synthesized
gggtcctggctccaccaattat

SEQ ID NO: 1235405 - DNA, 22 bp, Artificial Sequence
  chemically synthesized
ccatataactaataattggtgg

SEQ ID NO: 1235406 - DNA, 22 bp, Artificial Sequence
  chemically synthesized
ataattggtggagccaggaccc

SEQ ID NO: 1235407 - DNA, 22 bp, Artificial Sequence
  chemically synthesized
gtggagccaggacccaaacttt

SEQ ID NO: 1235408 - DNA, 22 bp, Artificial Sequence
  chemically synthesized
cagacacagacaaaagtttggg

SEQ ID NO: 1235409 - DNA, 22 bp, Artificial Sequence
  chemically synthesized
tacagacacagacaaaagtttg

SEQ ID NO: 1235410 - DNA, 22 bp, Artificial Sequence
  chemically synthesized
gggctctacagacacagacaaa

SEQ ID NO: 1235411 - DNA, 22 bp, Artificial Sequence
  chemically synthesized
caagactggggctctacagaca

SEQ ID NO: 1235412 - DNA, 22 bp, Artificial Sequence
  chemically synthesized
gcaagactggggctctacagac

SEQ ID NO: 1235413 - DNA, 22 bp, Artificial Sequence
  chemically synthesized
ttgtctgtgtctgtagagcccc

SEQ ID NO: 1235414 - DNA, 22 bp, Artificial Sequence
  chemically synthesized
tgtctgtgtctgtagagcccca

SEQ ID NO: 1235415 - DNA, 22 bp, Artificial Sequence
  chemically synthesized
gtctgtgtctgtagagccccag

SEQ ID NO: 1235416 - DNA, 22 bp, Artificial Sequence
  chemically synthesized
tctgtgtctgtagagccccagt

SEQ ID NO: 1235417 - DNA, 22 bp, Artificial Sequence
  chemically synthesized
tgtctgtagagccccagtcttg

SEQ ID NO: 1235418 - DNA, 22 bp, Artificial Sequence
  chemically synthesized
tagagccccagtcttgcaaatt

SEQ ID NO: 1235419 - DNA, 22 bp, Artificial Sequence
  chemically synthesized
gagaagaaggaaataaatttgc

SEQ ID NO: 1235420 - DNA, 22 bp, Artificial Sequence
  chemically synthesized
gcaaatttatttccttcttctc

SEQ ID NO: 1235421 - DNA, 22 bp, Artificial Sequence
  chemically synthesized
caaatttatttccttcttctct

SEQ ID NO: 1235422 - DNA, 22 bp, Artificial Sequence
  chemically synthesized
atttccttcttctctaactacc

SEQ ID NO: 1235423 - DNA, 22 bp, Artificial Sequence
  chemically synthesized
gtgcatgcacaaggtagttaga

SEQ ID NO: 1235424 - DNA, 22 bp, Artificial Sequence
  chemically synthesized
tttccttcttctctaactacct

SEQ ID NO: 1235425 - DNA, 22 bp, Artificial Sequence
  chemically synthesized
ggtgcatgcacaaggtagttag

SEQ ID NO: 1235426 - DNA, 22 bp, Artificial Sequence
  chemically synthesized
ccttcttctctaactaccttgt

SEQ ID NO: 1235427 - DNA, 22 bp, Artificial Sequence
  chemically synthesized
tttggtgcatgcacaaggtagt

SEQ ID NO: 1235428 - DNA, 22 bp, Artificial Sequence
  chemically synthesized
cttcttctctaactaccttgtg

SEQ ID NO: 1235429 - DNA, 22 bp, Artificial Sequence
  chemically synthesized
gtttggtgcatgcacaaggtag

SEQ ID NO: 1235430 - DNA, 22 bp, Artificial Sequence
  chemically synthesized
cttctctaactaccttgtgcat

SEQ ID NO: 1235431 - DNA, 22 bp, Artificial Sequence
  chemically synthesized
ttctctaactaccttgtgcatg

SEQ ID NO: 1235432 - DNA, 22 bp, Artificial Sequence
  chemically synthesized
ctctaactaccttgtgcatgca

SEQ ID NO: 1235433 - DNA, 22 bp, Artificial Sequence
  chemically synthesized
tctaactaccttgtgcatgcac

SEQ ID NO: 1235434 - DNA, 22 bp, Artificial Sequence
  chemically synthesized
taactaccttgtgcatgcacca

SEQ ID NO: 1235435 - DNA, 22 bp, Artificial Sequence
  chemically synthesized
actaccttgtgcatgcaccaaa

SEQ ID NO: 1235436 - DNA, 22 bp, Artificial Sequence
  chemically synthesized
ccttgtgcatgcaccaaacaaa

SEQ ID NO: 1235437 - DNA, 22 bp, Artificial Sequence
  chemically synthesized
gtgcatgcaccaaacaaatatc

SEQ ID NO: 1235438 - DNA, 22 bp, Artificial Sequence
  chemically synthesized
tgcatgcaccaaacaaatatct

SEQ ID NO: 1235439 - DNA, 22 bp, Artificial Sequence
  chemically synthesized
aatgcaagacacagaaatatag

SEQ ID NO: 1235440 - DNA, 22 bp, Artificial Sequence
  chemically synthesized
tatttctgtgtcttgcatttaa

SEQ ID NO: 1235441 - DNA, 22 bp, Artificial Sequence
  chemically synthesized
gaaagtataggagttaaatgca

SEQ ID NO: 1235442 - DNA, 22 bp, Artificial Sequence
  chemically synthesized
ctggaaagtataggagttaaat

SEQ ID NO: 1235443 - DNA, 22 bp, Artificial Sequence
  chemically synthesized
ctgtgtcttgcatttaactcct

SEQ ID NO: 1235444 - DNA, 22 bp, Artificial Sequence
  chemically synthesized
gctggaaagtataggagttaaa

SEQ ID NO: 1235445 - DNA, 22 bp, Artificial Sequence
  chemically synthesized
tgtgtcttgcatttaactccta

SEQ ID NO: 1235446 - DNA, 22 bp, Artificial Sequence
  chemically synthesized
tgctggaaagtataggagttaa

SEQ ID NO: 1235447 - DNA, 22 bp, Artificial Sequence
  chemically synthesized
tgtcttgcatttaactcctata

SEQ ID NO: 1235448 - DNA, 22 bp, Artificial Sequence
  chemically synthesized
gcatttaactcctatactttcc

SEQ ID NO: 1235449 - DNA, 22 bp, Artificial Sequence
  chemically synthesized
catttaactcctatactttcca

SEQ ID NO: 1235450 - DNA, 22 bp, Artificial Sequence
  chemically synthesized
aactcctatactttccagcaaa

SEQ ID NO: 1235451 - DNA, 22 bp, Artificial Sequence
  chemically synthesized
actcctatactttccagcaaag

SEQ ID NO: 1235452 - DNA, 22 bp, Artificial Sequence
  chemically synthesized
agaaagaccaggagctttgctg

SEQ ID NO: 1235453 - DNA, 22 bp, Artificial Sequence
  chemically synthesized
gagaaagaccaggagctttgct

SEQ ID NO: 1235454 - DNA, 22 bp, Artificial Sequence
  chemically synthesized
ctatactttccagcaaagctcc

SEQ ID NO: 1235455 - DNA, 22 bp, Artificial Sequence
  chemically synthesized
cttgagaaagaccaggagcttt

SEQ ID NO: 1235456 - DNA, 22 bp, Artificial Sequence
  chemically synthesized
tactttccagcaaagctcctgg

SEQ ID NO: 1235457 - DNA, 22 bp, Artificial Sequence
  chemically synthesized
tccagcaaagctcctggtcttt

SEQ ID NO: 1235458 - DNA, 22 bp, Artificial Sequence
  chemically synthesized
ccagcaaagctcctggtctttc

SEQ ID NO: 1235459 - DNA, 22 bp, Artificial Sequence
  chemically synthesized
cagcaaagctcctggtctttct

SEQ ID NO: 1235460 - DNA, 22 bp, Artificial Sequence
  chemically synthesized
gggtgaggaactacttgagaaa

SEQ ID NO: 1235461 - DNA, 22 bp, Artificial Sequence
  chemically synthesized
tagggtgaggaactacttgaga

SEQ ID NO: 1235462 - DNA, 22 bp, Artificial Sequence
  chemically synthesized
ctggtctttctcaagtagttcc

SEQ ID NO: 1235463 - DNA, 22 bp, Artificial Sequence
  chemically synthesized
gtctttctcaagtagttcctca

SEQ ID NO: 1235464 - DNA, 22 bp, Artificial Sequence
  chemically synthesized
tctcaagtagttcctcacccta

SEQ ID NO: 1235465 - DNA, 22 bp, Artificial Sequence
  chemically synthesized
ctcaagtagttcctcaccctag

SEQ ID NO: 1235466 - DNA, 22 bp, Artificial Sequence
  chemically synthesized
tcaagtagttcctcaccctaga

SEQ ID NO: 1235467 - DNA, 22 bp, Artificial Sequence
  chemically synthesized
aagtagttcctcaccctagaac

SEQ ID NO: 1235468 - DNA, 22 bp, Artificial Sequence
  chemically synthesized
ctcaccctagaactccttatca

SEQ ID NO: 1235469 - DNA, 22 bp, Artificial Sequence
  chemically synthesized
accctagaactccttatcattt

SEQ ID NO: 1235470 - DNA, 22 bp, Artificial Sequence
  chemically synthesized
agcaggcagtgcaaatgataag

SEQ ID NO: 1235471 - DNA, 22 bp, Artificial Sequence
  chemically synthesized
ttcagcaggcagtgcaaatgat

SEQ ID NO: 1235472 - DNA, 22 bp, Artificial Sequence
  chemically synthesized
gaactccttatcatttgcactg

SEQ ID NO: 1235473 - DNA, 22 bp, Artificial Sequence
  chemically synthesized
ggttgttcagcaggcagtgcaa

SEQ ID NO: 1235474 - DNA, 22 bp, Artificial Sequence
  chemically synthesized
gggttgttcagcaggcagtgca

SEQ ID NO: 1235475 - DNA, 22 bp, Artificial Sequence
  chemically synthesized
cttatcatttgcactgcctgct

SEQ ID NO: 1235476 - DNA, 22 bp, Artificial Sequence
  chemically synthesized
atttgggttgttcagcaggcag

SEQ ID NO: 1235477 - DNA, 22 bp, Artificial Sequence
  chemically synthesized
aatttgggttgttcagcaggca

SEQ ID NO: 1235478 - DNA, 22 bp, Artificial Sequence
  chemically synthesized
atcatttgcactgcctgctgaa

SEQ ID NO: 1235479 - DNA, 22 bp, Artificial Sequence
  chemically synthesized
tcatttgcactgcctgctgaac

SEQ ID NO: 1235480 - DNA, 22 bp, Artificial Sequence
  chemically synthesized
gcttaatttgggttgttcagca

SEQ ID NO: 1235481 - DNA, 22 bp, Artificial Sequence
  chemically synthesized
agcttaatttgggttgttcagc

SEQ ID NO: 1235482 - DNA, 22 bp, Artificial Sequence
  chemically synthesized
tagcttaatttgggttgttcag

SEQ ID NO: 1235483 - DNA, 22 bp, Artificial Sequence
  chemically synthesized
gcactgcctgctgaacaaccca

SEQ ID NO: 1235484 - DNA, 22 bp, Artificial Sequence
  chemically synthesized
cactgcctgctgaacaacccaa

SEQ ID NO: 1235485 - DNA, 22 bp, Artificial Sequence
  chemically synthesized
cctgctgaacaacccaaattaa

SEQ ID NO: 1235486 - DNA, 22 bp, Artificial Sequence
  chemically synthesized
ctgaacaacccaaattaagcta

SEQ ID NO: 1235487 - DNA, 22 bp, Artificial Sequence
  chemically synthesized
aacaacccaaattaagctaaag

SEQ ID NO: 1235488 - DNA, 22 bp, Artificial Sequence
  chemically synthesized
gagagtaagatggctttagctt

SEQ ID NO: 1235489 - DNA, 22 bp, Artificial Sequence
  chemically synthesized
ggagagtaagatggctttagct

SEQ ID NO: 1235490 - DNA, 22 bp, Artificial Sequence
  chemically synthesized
ccttggagagtaagatggcttt

SEQ ID NO: 1235491 - DNA, 22 bp, Artificial Sequence
  chemically synthesized
agctaaagccatcttactctcc

SEQ ID NO: 1235492 - DNA, 22 bp, Artificial Sequence
  chemically synthesized
aagccatcttactctccaaggt

SEQ ID NO: 1235493 - DNA, 22 bp, Artificial Sequence
  chemically synthesized
taaaggatatcaggcaagttac

SEQ ID NO: 1235494 - DNA, 22 bp, Artificial Sequence
  chemically synthesized
actctccaaggtaacttgcctg

SEQ ID NO: 1235495 - DNA, 22 bp, Artificial Sequence
  chemically synthesized
ctctccaaggtaacttgcctga

SEQ ID NO: 1235496 - DNA, 22 bp, Artificial Sequence
  chemically synthesized
tgttataaaggatatcaggcaa

SEQ ID NO: 1235497 - DNA, 22 bp, Artificial Sequence
  chemically synthesized
tccaaggtaacttgcctgatat

SEQ ID NO: 1235498 - DNA, 22 bp, Artificial Sequence
  chemically synthesized
caaggtaacttgcctgatatcc

SEQ ID NO: 1235499 - DNA, 22 bp, Artificial Sequence
  chemically synthesized
gcctgatatcctttataacaca

SEQ ID NO: 1235500 - DNA, 22 bp, Artificial Sequence
  chemically synthesized
cctgatatcctttataacacag

SEQ ID NO: 1235501 - DNA, 22 bp, Artificial Sequence
  chemically synthesized
atatcctttataacacagtatt

SEQ ID NO: 1235502 - DNA, 22 bp, Artificial Sequence
  chemically synthesized
tataacacagtattgacatctt

SEQ ID NO: 1235503 - DNA, 22 bp, Artificial Sequence
  chemically synthesized
ataacacagtattgacatcttg

SEQ ID NO: 1235504 - DNA, 22 bp, Artificial Sequence
  chemically synthesized
taacacagtattgacatcttgt

SEQ ID NO: 1235505 - DNA, 22 bp, Artificial Sequence
  chemically synthesized
tgaaatcaaaggaacaagatgt

SEQ ID NO: 1235506 - DNA, 22 bp, Artificial Sequence
  chemically synthesized
gtgaaatcaaaggaacaagatg

SEQ ID NO: 1235507 - DNA, 22 bp, Artificial Sequence
  chemically synthesized
tgtgaaatcaaaggaacaagat

SEQ ID NO: 1235508 - DNA, 22 bp, Artificial Sequence
  chemically synthesized
atgttttgtgaaatcaaaggaa

SEQ ID NO: 1235509 - DNA, 22 bp, Artificial Sequence
  chemically synthesized
aatgttttgtgaaatcaaagga

SEQ ID NO: 1235510 - DNA, 22 bp, Artificial Sequence
  chemically synthesized
acatcttgttcctttgatttca

SEQ ID NO: 1235511 - DNA, 22 bp, Artificial Sequence
  chemically synthesized
gccttaatgttttgtgaaatca

SEQ ID NO: 1235512 - DNA, 22 bp, Artificial Sequence
  chemically synthesized
gttcctttgatttcacaaaaca

SEQ ID NO: 1235513 - DNA, 22 bp, Artificial Sequence
  chemically synthesized
ttcctttgatttcacaaaacat

SEQ ID NO: 1235514 - DNA, 22 bp, Artificial Sequence
  chemically synthesized
ctttgatttcacaaaacattaa

SEQ ID NO: 1235515 - DNA, 22 bp, Artificial Sequence
  chemically synthesized
ataaggttagccttaatgtttt

SEQ ID NO: 1235516 - DNA, 22 bp, Artificial Sequence
  chemically synthesized
tgatttcacaaaacattaaggc

SEQ ID NO: 1235517 - DNA, 22 bp, Artificial Sequence
  chemically synthesized
gatttcacaaaacattaaggct

SEQ ID NO: 1235518 - DNA, 22 bp, Artificial Sequence
  chemically synthesized
gttcataaggttagccttaatg

SEQ ID NO: 1235519 - DNA, 22 bp, Artificial Sequence
  chemically synthesized
atttcacaaaacattaaggcta

SEQ ID NO: 1235520 - DNA, 22 bp, Artificial Sequence
  chemically synthesized
tggttcataaggttagccttaa

SEQ ID NO: 1235521 - DNA, 22 bp, Artificial Sequence
  chemically synthesized
cacaaaacattaaggctaacct

SEQ ID NO: 1235522 - DNA, 22 bp, Artificial Sequence
  chemically synthesized
acaaaacattaaggctaacctt

SEQ ID NO: 1235523 - DNA, 22 bp, Artificial Sequence
  chemically synthesized
aggctaaccttatgaaccagaa

SEQ ID NO: 1235524 - DNA, 22 bp, Artificial Sequence
  chemically synthesized
agaggtaaaaatggagattctg

SEQ ID NO: 1235525 - DNA, 22 bp, Artificial Sequence
  chemically synthesized
accttatgaaccagaatctcca

SEQ ID NO: 1235526 - DNA, 22 bp, Artificial Sequence
  chemically synthesized
atgaaccagaatctccattttt

SEQ ID NO: 1235527 - DNA, 22 bp, Artificial Sequence
  chemically synthesized
tgaaccagaatctccattttta

SEQ ID NO: 1235528 - DNA, 22 bp, Artificial Sequence
  chemically synthesized
gaggaaaatctaagaggtaaaa

SEQ ID NO: 1235529 - DNA, 22 bp, Artificial Sequence
  chemically synthesized
ggaggaaaatctaagaggtaaa

SEQ ID NO: 1235530 - DNA, 22 bp, Artificial Sequence
  chemically synthesized
ttggaggaaaatctaagaggta

SEQ ID NO: 1235531 - DNA, 22 bp, Artificial Sequence
  chemically synthesized
catttttacctcttagattttc

SEQ ID NO: 1235532 - DNA, 22 bp, Artificial Sequence
  chemically synthesized
acattcttggaggaaaatctaa

SEQ ID NO: 1235533 - DNA, 22 bp, Artificial Sequence
  chemically synthesized
tgacattcttggaggaaaatct

SEQ ID NO: 1235534 - DNA, 22 bp, Artificial Sequence
  chemically synthesized
ttacctcttagattttcctcca

SEQ ID NO: 1235535 - DNA, 22 bp, Artificial Sequence
  chemically synthesized
tacctcttagattttcctccaa

SEQ ID NO: 1235536 - DNA, 22 bp, Artificial Sequence
  chemically synthesized
acctcttagattttcctccaag

SEQ ID NO: 1235537 - DNA, 22 bp, Artificial Sequence
  chemically synthesized
cctcttagattttcctccaaga

SEQ ID NO: 1235538 - DNA, 22 bp, Artificial Sequence
  chemically synthesized
ttagattttcctccaagaatgt

SEQ ID NO: 1235539 - DNA, 22 bp, Artificial Sequence
  chemically synthesized
agattttcctccaagaatgtca

SEQ ID NO: 1235540 - DNA, 22 bp, Artificial Sequence
  chemically synthesized
gattttcctccaagaatgtcag

SEQ ID NO: 1235541 - DNA, 22 bp, Artificial Sequence
  chemically synthesized
tcctccaagaatgtcagaatga

SEQ ID NO: 1235542 - DNA, 22 bp, Artificial Sequence
  chemically synthesized
cctccaagaatgtcagaatgat

SEQ ID NO: 1235543 - DNA, 22 bp, Artificial Sequence
  chemically synthesized
ctccaagaatgtcagaatgatg

SEQ ID NO: 1235544 - DNA, 22 bp, Artificial Sequence
  chemically synthesized
caagaatgtcagaatgatgttg

SEQ ID NO: 1235545 - DNA, 22 bp, Artificial Sequence
  chemically synthesized
gtggaaagtgggagaaatatca

SEQ ID NO: 1235546 - DNA, 22 bp, Artificial Sequence
  chemically synthesized
ggtggaaagtgggagaaatatc

SEQ ID NO: 1235547 - DNA, 22 bp, Artificial Sequence
  chemically synthesized
gtttacattctgatatttctcc

SEQ ID NO: 1235548 - DNA, 22 bp, Artificial Sequence
  chemically synthesized
tggtggaaagtgggagaaatat

SEQ ID NO: 1235549 - DNA, 22 bp, Artificial Sequence
  chemically synthesized
ttggtggaaagtgggagaaata

SEQ ID NO: 1235550 - DNA, 22 bp, Artificial Sequence
  chemically synthesized
tttggtggaaagtgggagaaat

SEQ ID NO: 1235551 - DNA, 22 bp, Artificial Sequence
  chemically synthesized
acattctgatatttctcccact

SEQ ID NO: 1235552 - DNA, 22 bp, Artificial Sequence
  chemically synthesized
tttttggtggaaagtgggagaa

SEQ ID NO: 1235553 - DNA, 22 bp, Artificial Sequence
  chemically synthesized
cattctgatatttctcccactt

SEQ ID NO: 1235554 - DNA, 22 bp, Artificial Sequence
  chemically synthesized
ctctttttggtggaaagtggga

SEQ ID NO: 1235555 - DNA, 22 bp, Artificial Sequence
  chemically synthesized
cctctttttggtggaaagtggg

SEQ ID NO: 1235556 - DNA, 22 bp, Artificial Sequence
  chemically synthesized
tcctctttttggtggaaagtgg

SEQ ID NO: 1235557 - DNA, 22 bp, Artificial Sequence
  chemically synthesized
tgatatttctcccactttccac

SEQ ID NO: 1235558 - DNA, 22 bp, Artificial Sequence
  chemically synthesized
ttcctctttttggtggaaagtg

SEQ ID NO: 1235559 - DNA, 22 bp, Artificial Sequence
  chemically synthesized
tttcctctttttggtggaaagt

SEQ ID NO: 1235560 - DNA, 22 bp, Artificial Sequence
  chemically synthesized
atatttctcccactttccacca

SEQ ID NO: 1235561 - DNA, 22 bp, Artificial Sequence
  chemically synthesized
ttttcctctttttggtggaaag

SEQ ID NO: 1235562 - DNA, 22 bp, Artificial Sequence
  chemically synthesized
tttttttcctctttttggtgga

SEQ ID NO: 1235563 - DNA, 22 bp, Artificial Sequence
  chemically synthesized
atttttttcctctttttggtgg

SEQ ID NO: 1235564 - DNA, 22 bp, Artificial Sequence
  chemically synthesized
ctcccactttccaccaaaaaga

SEQ ID NO: 1235565 - DNA, 22 bp, Artificial Sequence
  chemically synthesized
tcccactttccaccaaaaagag

SEQ ID NO: 1235566 - DNA, 22 bp, Artificial Sequence
  chemically synthesized
ccactttccaccaaaaagagga

SEQ ID NO: 1235567 - DNA, 22 bp, Artificial Sequence
  chemically synthesized
aagtcttatttttttcctcttt

SEQ ID NO: 1235568 - DNA, 22 bp, Artificial Sequence
  chemically synthesized
tccaccaaaaagaggaaaaaaa

SEQ ID NO: 1235569 - DNA, 22 bp, Artificial Sequence
  chemically synthesized
ccaccaaaaagaggaaaaaaat

SEQ ID NO: 1235570 - DNA, 22 bp, Artificial Sequence
  chemically synthesized
caccaaaaagaggaaaaaaata

SEQ ID NO: 1235571 - DNA, 22 bp, Artificial Sequence
  chemically synthesized
aatctaaagtcttatttttttc

SEQ ID NO: 1235572 - DNA, 22 bp, Artificial Sequence
  chemically synthesized
aaatctaaagtcttattttttt

SEQ ID NO: 1235573 - DNA, 22 bp, Artificial Sequence
  chemically synthesized
taaatctaaagtcttatttttt

SEQ ID NO: 1235574 - DNA, 22 bp, Artificial Sequence
  chemically synthesized
ttaaatctaaagtcttattttt

SEQ ID NO: 1235575 - DNA, 22 bp, Artificial Sequence
  chemically synthesized
tttaaatctaaagtcttatttt

SEQ ID NO: 1235576 - DNA, 22 bp, Artificial Sequence
  chemically synthesized
ttttaaatctaaagtcttattt

SEQ ID NO: 1235577 - DNA, 22 bp, Artificial Sequence
  chemically synthesized
tttttaaatctaaagtcttatt

SEQ ID NO: 1235578 - DNA, 22 bp, Artificial Sequence
  chemically synthesized
ttttttaaatctaaagtcttat

SEQ ID NO: 1235579 - DNA, 22 bp, Artificial Sequence
  chemically synthesized
tttttttaaatctaaagtctta

SEQ ID NO: 1235580 - DNA, 22 bp, Artificial Sequence
  chemically synthesized
ttttttttaaatctaaagtctt

SEQ ID NO: 1235581 - DNA, 22 bp, Artificial Sequence
  chemically synthesized
tttttttttaaatctaaagtct

SEQ ID NO: 1235582 - DNA, 22 bp, Artificial Sequence
  chemically synthesized
ttttttttttaaatctaaagtc

SEQ ID NO: 1235583 - DNA, 22 bp, Artificial Sequence
  chemically synthesized
tttttttttttaaatctaaagt

SEQ ID NO: 1235584 - DNA, 22 bp, Artificial Sequence
  chemically synthesized
ttttttttttttaaatctaaag

SEQ ID NO: 1235585 - DNA, 22 bp, Artificial Sequence
  chemically synthesized
tttttttttttttaaatctaaa

SEQ ID NO: 1235586 - DNA, 22 bp, Artificial Sequence
  chemically synthesized
ttttttttttttttaaatctaa

SEQ ID NO: 1235587 - DNA, 22 bp, Artificial Sequence
  chemically synthesized
tttttttttttttttaaatcta

SEQ ID NO: 1235588 - DNA, 22 bp, Artificial Sequence
  chemically synthesized
ttttttttttttttttaaatct

SEQ ID NO: 1235589 - DNA, 22 bp, Artificial Sequence
  chemically synthesized
tttttttttttttttttaaatc

SEQ ID NO: 1235590 - DNA, 22 bp, Artificial Sequence
  chemically synthesized
ttttttttttttttttttaaat

SEQ ID NO: 1235591 - DNA, 22 bp, Artificial Sequence
  chemically synthesized
tttttttttttttttttttaaa

SEQ ID NO: 1235592 - DNA, 22 bp, Artificial Sequence
  chemically synthesized
ttttttttttttttttttttaa

SEQ ID NO: 1235593 - DNA, 22 bp, Artificial Sequence
  chemically synthesized
ttttttttttttttttttttta

SEQ ID NO: 1235594 - DNA, 22 bp, Artificial Sequence
  chemically synthesized
tttttttttttttttttttttt

SEQ ID NO: 1235595 - DNA, 22 bp, Artificial Sequence
  chemically synthesized
cttttttttttttttttttttt

SEQ ID NO: 1235596 - DNA, 22 bp, Artificial Sequence
  chemically synthesized
tagatttaaaaaaaaaaaaaaa

SEQ ID NO: 1235597 - DNA, 22 bp, Artificial Sequence
  chemically synthesized
agatttaaaaaaaaaaaaaaaa

SEQ ID NO: 1235598 - DNA, 22 bp, Artificial Sequence
  chemically synthesized
ttgctttttttttttttttttt

SEQ ID NO: 1235599 - DNA, 22 bp, Artificial Sequence
  chemically synthesized
gatttaaaaaaaaaaaaaaaaa

SEQ ID NO: 1235600 - DNA, 22 bp, Artificial Sequence
  chemically synthesized
gctgttgctttttttttttttt

SEQ ID NO: 1235601 - DNA, 22 bp, Artificial Sequence
  chemically synthesized
aaaaaaaaaaaaaaaaaaaaaa

SEQ ID NO: 1235602 - DNA, 22 bp, Artificial Sequence
  chemically synthesized
aaaaaaaaaaaaaaaaaaaaaa

SEQ ID NO: 1235603 - DNA, 22 bp, Artificial Sequence
  chemically synthesized
cccaaatgtctggctgttgctt

SEQ ID NO: 1235604 - DNA, 22 bp, Artificial Sequence
  chemically synthesized
agcctccccaaatgtctggctg

SEQ ID NO: 1235605 - DNA, 22 bp, Artificial Sequence
  chemically synthesized
cctcagcctccccaaatgtctg

SEQ ID NO: 1235606 - DNA, 22 bp, Artificial Sequence
  chemically synthesized
aatgagccacctgcctcagcct

SEQ ID NO: 1235607 - DNA, 22 bp, Artificial Sequence
  chemically synthesized
atctcaatgagccacctgcctc

SEQ ID NO: 1235608 - DNA, 22 bp, Artificial Sequence
  chemically synthesized
ggggaggctgaggcaggtggct

SEQ ID NO: 1235609 - DNA, 22 bp, Artificial Sequence
  chemically synthesized
ctgatctcaatgagccacctgc

SEQ ID NO: 1235610 - DNA, 22 bp, Artificial Sequence
  chemically synthesized
gggaggctgaggcaggtggctc

SEQ ID NO: 1235611 - DNA, 22 bp, Artificial Sequence
  chemically synthesized
agctcctgatctcaatgagcca

SEQ ID NO: 1235612 - DNA, 22 bp, Artificial Sequence
  chemically synthesized
gagctcctgatctcaatgagcc

SEQ ID NO: 1235613 - DNA, 22 bp, Artificial Sequence
  chemically synthesized
aggcaggtggctcattgagatc

SEQ ID NO: 1235614 - DNA, 22 bp, Artificial Sequence
  chemically synthesized
gtcttgagctcctgatctcaat

SEQ ID NO: 1235615 - DNA, 22 bp, Artificial Sequence
  chemically synthesized
gccaggctggtcttgagctcct

SEQ ID NO: 1235616 - DNA, 22 bp, Artificial Sequence
  chemically synthesized
attgagatcaggagctcaagac

SEQ ID NO: 1235617 - DNA, 22 bp, Artificial Sequence
  chemically synthesized
agatcaggagctcaagaccagc

SEQ ID NO: 1235618 - DNA, 22 bp, Artificial Sequence
  chemically synthesized
accatgttggccaggctggtct

SEQ ID NO: 1235619 - DNA, 22 bp, Artificial Sequence
  chemically synthesized
caccatgttggccaggctggtc

SEQ ID NO: 1235620 - DNA, 22 bp, Artificial Sequence
  chemically synthesized
aagaccagcctggccaacatgg

SEQ ID NO: 1235621 - DNA, 22 bp, Artificial Sequence
  chemically synthesized
gtagacatggggtttcaccatg

SEQ ID NO: 1235622 - DNA, 22 bp, Artificial Sequence
  chemically synthesized
agtagacatggggtttcaccat

SEQ ID NO: 1235623 - DNA, 22 bp, Artificial Sequence
  chemically synthesized
tagtagacatggggtttcacca

SEQ ID NO: 1235624 - DNA, 22 bp, Artificial Sequence
  chemically synthesized
ttagtagacatggggtttcacc

SEQ ID NO: 1235625 - DNA, 22 bp, Artificial Sequence
  chemically synthesized
gccaacatggtgaaaccccatg

SEQ ID NO: 1235626 - DNA, 22 bp, Artificial Sequence
  chemically synthesized
tatttttagtagacatggggtt

SEQ ID NO: 1235627 - DNA, 22 bp, Artificial Sequence
  chemically synthesized
gtatttttagtagacatggggt

SEQ ID NO: 1235628 - DNA, 22 bp, Artificial Sequence
  chemically synthesized
tgtatttttagtagacatgggg

SEQ ID NO: 1235629 - DNA, 22 bp, Artificial Sequence
  chemically synthesized
agttttgtatttttagtagaca

SEQ ID NO: 1235630 - DNA, 22 bp, Artificial Sequence
  chemically synthesized
gctaagttttgtatttttagta

SEQ ID NO: 1235631 - DNA, 22 bp, Artificial Sequence
  chemically synthesized
catcatgcctggctaagttttg

SEQ ID NO: 1235632 - DNA, 22 bp, Artificial Sequence
  chemically synthesized
ctaaaaatacaaaacttagcca

SEQ ID NO: 1235633 - DNA, 22 bp, Artificial Sequence
  chemically synthesized
aaaatacaaaacttagccaggc

SEQ ID NO: 1235634 - DNA, 22 bp, Artificial Sequence
  chemically synthesized
caggcatgttccatcatgcctg

SEQ ID NO: 1235635 - DNA, 22 bp, Artificial Sequence
  chemically synthesized
agactacaggcatgttccatca

SEQ ID NO: 1235636 - DNA, 22 bp, Artificial Sequence
  chemically synthesized
agccaggcatgatggaacatgc

SEQ ID NO: 1235637 - DNA, 22 bp, Artificial Sequence
  chemically synthesized
gccaggcatgatggaacatgcc

SEQ ID NO: 1235638 - DNA, 22 bp, Artificial Sequence
  chemically synthesized
ccaagtagctgagactacaggc

SEQ ID NO: 1235639 - DNA, 22 bp, Artificial Sequence
  chemically synthesized
ggcctcccaagtagctgagact

SEQ ID NO: 1235640 - DNA, 22 bp, Artificial Sequence
  chemically synthesized
cctcggcctcccaagtagctga

SEQ ID NO: 1235641 - DNA, 22 bp, Artificial Sequence
  chemically synthesized
ctgcctcggcctcccaagtagc

SEQ ID NO: 1235642 - DNA, 22 bp, Artificial Sequence
  chemically synthesized
cctgcctcggcctcccaagtag

SEQ ID NO: 1235643 - DNA, 22 bp, Artificial Sequence
  chemically synthesized
tcctgcctcggcctcccaagta

SEQ ID NO: 1235644 - DNA, 22 bp, Artificial Sequence
  chemically synthesized
tagtctcagctacttgggaggc

SEQ ID NO: 1235645 - DNA, 22 bp, Artificial Sequence
  chemically synthesized
agctacttgggaggccgaggca

SEQ ID NO: 1235646 - DNA, 22 bp, Artificial Sequence
  chemically synthesized
aagcaattttcctgcctcggcc

SEQ ID NO: 1235647 - DNA, 22 bp, Artificial Sequence
  chemically synthesized
cttgggaggccgaggcaggaaa

SEQ ID NO: 1235648 - DNA, 22 bp, Artificial Sequence
  chemically synthesized
ggttcaagcaattttcctgcct

SEQ ID NO: 1235649 - DNA, 22 bp, Artificial Sequence
  chemically synthesized
gggaggccgaggcaggaaaatt

SEQ ID NO: 1235650 - DNA, 22 bp, Artificial Sequence
  chemically synthesized
ctgggttcaagcaattttcctg

SEQ ID NO: 1235651 - DNA, 22 bp, Artificial Sequence
  chemically synthesized
ggaggccgaggcaggaaaattg

SEQ ID NO: 1235652 - DNA, 22 bp, Artificial Sequence
  chemically synthesized
cctcctgggttcaagcaatttt

SEQ ID NO: 1235653 - DNA, 22 bp, Artificial Sequence
  chemically synthesized
tgcctcctgggttcaagcaatt

SEQ ID NO: 1235654 - DNA, 22 bp, Artificial Sequence
  chemically synthesized
caacctctgcctcctgggttca

SEQ ID NO: 1235655 - DNA, 22 bp, Artificial Sequence
  chemically synthesized
actgcaacctctgcctcctggg

SEQ ID NO: 1235656 - DNA, 22 bp, Artificial Sequence
  chemically synthesized
gctcactgcaacctctgcctcc

SEQ ID NO: 1235657 - DNA, 22 bp, Artificial Sequence
  chemically synthesized
ggctcactgcaacctctgcctc

SEQ ID NO: 1235658 - DNA, 22 bp, Artificial Sequence
  chemically synthesized
cttgaacccaggaggcagaggt

SEQ ID NO: 1235659 - DNA, 22 bp, Artificial Sequence
  chemically synthesized
gaacccaggaggcagaggttgc

SEQ ID NO: 1235660 - DNA, 22 bp, Artificial Sequence
  chemically synthesized
aacccaggaggcagaggttgca

SEQ ID NO: 1235661 - DNA, 22 bp, Artificial Sequence
  chemically synthesized
gagtcagcgacatgatcttggc

SEQ ID NO: 1235662 - DNA, 22 bp, Artificial Sequence
  chemically synthesized
cagtgagccaagatcatgtcgc

SEQ ID NO: 1235663 - DNA, 22 bp, Artificial Sequence
  chemically synthesized
tcgcccaggctggagtcagcga

SEQ ID NO: 1235664 - DNA, 22 bp, Artificial Sequence
  chemically synthesized
tgtcgcccaggctggagtcagc

SEQ ID NO: 1235665 - DNA, 22 bp, Artificial Sequence
  chemically synthesized
ctctgtcgcccaggctggagtc

SEQ ID NO: 1235666 - DNA, 22 bp, Artificial Sequence
  chemically synthesized
actctgtcgcccaggctggagt

SEQ ID NO: 1235667 - DNA, 22 bp, Artificial Sequence
  chemically synthesized
atggaatcttactctgtcgccc

SEQ ID NO: 1235668 - DNA, 22 bp, Artificial Sequence
  chemically synthesized
gatggaatcttactctgtcgcc

SEQ ID NO: 1235669 - DNA, 22 bp, Artificial Sequence
  chemically synthesized
actccagcctgggcgacagagt

SEQ ID NO: 1235670 - DNA, 22 bp, Artificial Sequence
  chemically synthesized
tgatggaatcttactctgtcgc

SEQ ID NO: 1235671 - DNA, 22 bp, Artificial Sequence
  chemically synthesized
ttttgatggaatcttactctgt

SEQ ID NO: 1235672 - DNA, 22 bp, Artificial Sequence
  chemically synthesized
cagcctgggcgacagagtaaga

SEQ ID NO: 1235673 - DNA, 22 bp, Artificial Sequence
  chemically synthesized
attttgatggaatcttactctg

SEQ ID NO: 1235674 - DNA, 22 bp, Artificial Sequence
  chemically synthesized
tattttgatggaatcttactct

SEQ ID NO: 1235675 - DNA, 22 bp, Artificial Sequence
  chemically synthesized
ttattttgatggaatcttactc

SEQ ID NO: 1235676 - DNA, 22 bp, Artificial Sequence
  chemically synthesized
tttattttgatggaatcttact

SEQ ID NO: 1235677 - DNA, 22 bp, Artificial Sequence
  chemically synthesized
ttttattttgatggaatcttac

SEQ ID NO: 1235678 - DNA, 22 bp, Artificial Sequence
  chemically synthesized
tttttattttgatggaatctta

SEQ ID NO: 1235679 - DNA, 22 bp, Artificial Sequence
  chemically synthesized
ttttttattttgatggaatctt

SEQ ID NO: 1235680 - DNA, 22 bp, Artificial Sequence
  chemically synthesized
ggcgacagagtaagattccatc

SEQ ID NO: 1235681 - DNA, 22 bp, Artificial Sequence
  chemically synthesized
tttttttattttgatggaatct

SEQ ID NO: 1235682 - DNA, 22 bp, Artificial Sequence
  chemically synthesized
atgtattttttttttattttga

SEQ ID NO: 1235683 - DNA, 22 bp, Artificial Sequence
  chemically synthesized
catgtattttttttttattttg

SEQ ID NO: 1235684 - DNA, 22 bp, Artificial Sequence
  chemically synthesized
tcatgtattttttttttatttt

SEQ ID NO: 1235685 - DNA, 22 bp, Artificial Sequence
  chemically synthesized
tttcatgtattttttttttatt

SEQ ID NO: 1235686 - DNA, 22 bp, Artificial Sequence
  chemically synthesized
ctttcatgtattttttttttat

SEQ ID NO: 1235687 - DNA, 22 bp, Artificial Sequence
  chemically synthesized
tctttcatgtatttttttttta

SEQ ID NO: 1235688 - DNA, 22 bp, Artificial Sequence
  chemically synthesized
ttctttcatgtatttttttttt

SEQ ID NO: 1235689 - DNA, 22 bp, Artificial Sequence
  chemically synthesized
catcaaaataaaaaaaaaatac

SEQ ID NO: 1235690 - DNA, 22 bp, Artificial Sequence
  chemically synthesized
tttttctttcatgtattttttt

SEQ ID NO: 1235691 - DNA, 22 bp, Artificial Sequence
  chemically synthesized
ctgtttttctttcatgtatttt

SEQ ID NO: 1235692 - DNA, 22 bp, Artificial Sequence
  chemically synthesized
gctgtttttctttcatgtattt

SEQ ID NO: 1235693 - DNA, 22 bp, Artificial Sequence
  chemically synthesized
tttgctgtttttctttcatgta

SEQ ID NO: 1235694 - DNA, 22 bp, Artificial Sequence
  chemically synthesized
gttatttgctgtttttctttca

SEQ ID NO: 1235695 - DNA, 22 bp, Artificial Sequence
  chemically synthesized
tatatacacaagaagattggtt

SEQ ID NO: 1235696 - DNA, 22 bp, Artificial Sequence
  chemically synthesized
tcaatctatatatacacaagaa

SEQ ID NO: 1235697 - DNA, 22 bp, Artificial Sequence
  chemically synthesized
tatactgtcaatctatatatac

SEQ ID NO: 1235698 - DNA, 22 bp, Artificial Sequence
  chemically synthesized
gtatactgtcaatctatatata

SEQ ID NO: 1235699 - DNA, 22 bp, Artificial Sequence
  chemically synthesized
aacttgtatactgtcaatctat

SEQ ID NO: 1235700 - DNA, 22 bp, Artificial Sequence
  chemically synthesized
cttgtgtatatatagattgaca

SEQ ID NO: 1235701 - DNA, 22 bp, Artificial Sequence
  chemically synthesized
ttgtgtatatatagattgacag

SEQ ID NO: 1235702 - DNA, 22 bp, Artificial Sequence
  chemically synthesized
gtgtatatatagattgacagta

SEQ ID NO: 1235703 - DNA, 22 bp, Artificial Sequence
  chemically synthesized
tgtatatatagattgacagtat

SEQ ID NO: 1235704 - DNA, 22 bp, Artificial Sequence
  chemically synthesized
ccattaaacttgtatactgtca

SEQ ID NO: 1235705 - DNA, 22 bp, Artificial Sequence
  chemically synthesized
taattaccattaaacttgtata

SEQ ID NO: 1235706 - DNA, 22 bp, Artificial Sequence
  chemically synthesized
acagtatacaagtttaatggta

SEQ ID NO: 1235707 - DNA, 22 bp, Artificial Sequence
  chemically synthesized
aagtcctataattaccattaaa

SEQ ID NO: 1235708 - DNA, 22 bp, Artificial Sequence
  chemically synthesized
aaagtcctataattaccattaa

SEQ ID NO: 1235709 - DNA, 22 bp, Artificial Sequence
  chemically synthesized
taaagtcctataattaccatta

SEQ ID NO: 1235710 - DNA, 22 bp, Artificial Sequence
  chemically synthesized
aaaactttaaagtcctataatt

SEQ ID NO: 1235711 - DNA, 22 bp, Artificial Sequence
  chemically synthesized
caaaactttaaagtcctataat

SEQ ID NO: 1235712 - DNA, 22 bp, Artificial Sequence
  chemically synthesized
tcaaaactttaaagtcctataa

SEQ ID NO: 1235713 - DNA, 22 bp, Artificial Sequence
  chemically synthesized
ttttcaaaactttaaagtccta

SEQ ID NO: 1235714 - DNA, 22 bp, Artificial Sequence
  chemically synthesized
aatggtaattataggactttaa

SEQ ID NO: 1235715 - DNA, 22 bp, Artificial Sequence
  chemically synthesized
atggtaattataggactttaaa

SEQ ID NO: 1235716 - DNA, 22 bp, Artificial Sequence
  chemically synthesized
agtaattattttcaaaacttta

SEQ ID NO: 1235717 - DNA, 22 bp, Artificial Sequence
  chemically synthesized
gagtaattattttcaaaacttt

SEQ ID NO: 1235718 - DNA, 22 bp, Artificial Sequence
  chemically synthesized
taggactttaaagttttgaaaa

SEQ ID NO: 1235719 - DNA, 22 bp, Artificial Sequence
  chemically synthesized
atttgagtaattattttcaaaa

SEQ ID NO: 1235720 - DNA, 22 bp, Artificial Sequence
  chemically synthesized
taaagttttgaaaataattact

SEQ ID NO: 1235721 - DNA, 22 bp, Artificial Sequence
  chemically synthesized
aaagttttgaaaataattactc

SEQ ID NO: 1235722 - DNA, 22 bp, Artificial Sequence
  chemically synthesized
aagttttgaaaataattactca

SEQ ID NO: 1235723 - DNA, 22 bp, Artificial Sequence
  chemically synthesized
ggcagagaactgatttgagtaa

SEQ ID NO: 1235724 - DNA, 22 bp, Artificial Sequence
  chemically synthesized
tgaaaataattactcaaatcag

SEQ ID NO: 1235725 - DNA, 22 bp, Artificial Sequence
  chemically synthesized
ctaggcagagaactgatttgag

SEQ ID NO: 1235726 - DNA, 22 bp, Artificial Sequence
  chemically synthesized
gaaaataattactcaaatcagt

SEQ ID NO: 1235727 - DNA, 22 bp, Artificial Sequence
  chemically synthesized
aaaataattactcaaatcagtt

SEQ ID NO: 1235728 - DNA, 22 bp, Artificial Sequence
  chemically synthesized
actactaggcagagaactgatt

SEQ ID NO: 1235729 - DNA, 22 bp, Artificial Sequence
  chemically synthesized
gtctaactactaggcagagaac

SEQ ID NO: 1235730 - DNA, 22 bp, Artificial Sequence
  chemically synthesized
ggtctaactactaggcagagaa

SEQ ID NO: 1235731 - DNA, 22 bp, Artificial Sequence
  chemically synthesized
tggtctaactactaggcagaga

SEQ ID NO: 1235732 - DNA, 22 bp, Artificial Sequence
  chemically synthesized
ctcaaatcagttctctgcctag

SEQ ID NO: 1235733 - DNA, 22 bp, Artificial Sequence
  chemically synthesized
aaatcagttctctgcctagtag

SEQ ID NO: 1235734 - DNA, 22 bp, Artificial Sequence
  chemically synthesized
tctgcctagtagttagaccaaa

SEQ ID NO: 1235735 - DNA, 22 bp, Artificial Sequence
  chemically synthesized
tgcctagtagttagaccaaagc

SEQ ID NO: 1235736 - DNA, 22 bp, Artificial Sequence
  chemically synthesized
cctagtagttagaccaaagcca

SEQ ID NO: 1235737 - DNA, 22 bp, Artificial Sequence
  chemically synthesized
aaaggaaatatgtggctttggt

SEQ ID NO: 1235738 - DNA, 22 bp, Artificial Sequence
  chemically synthesized
gtagttagaccaaagccacata

SEQ ID NO: 1235739 - DNA, 22 bp, Artificial Sequence
  chemically synthesized
cataattgaaaggaaatatgtg

SEQ ID NO: 1235740 - DNA, 22 bp, Artificial Sequence
  chemically synthesized
gaccaaagccacatatttcctt

SEQ ID NO: 1235741 - DNA, 22 bp, Artificial Sequence
  chemically synthesized
tataattacataattgaaagga

SEQ ID NO: 1235742 - DNA, 22 bp, Artificial Sequence
  chemically synthesized
tgactatataattacataattg

SEQ ID NO: 1235743 - DNA, 22 bp, Artificial Sequence
  chemically synthesized
gtgactatataattacataatt

SEQ ID NO: 1235744 - DNA, 22 bp, Artificial Sequence
  chemically synthesized
cctttcaattatgtaattatat

SEQ ID NO: 1235745 - DNA, 22 bp, Artificial Sequence
  chemically synthesized
aatcttgtgactatataattac

SEQ ID NO: 1235746 - DNA, 22 bp, Artificial Sequence
  chemically synthesized
ctttcaattatgtaattatata

SEQ ID NO: 1235747 - DNA, 22 bp, Artificial Sequence
  chemically synthesized
ctaaatcttgtgactatataat

SEQ ID NO: 1235748 - DNA, 22 bp, Artificial Sequence
  chemically synthesized
tcaattatgtaattatatagtc

SEQ ID NO: 1235749 - DNA, 22 bp, Artificial Sequence
  chemically synthesized
gctaaatcttgtgactatataa

SEQ ID NO: 1235750 - DNA, 22 bp, Artificial Sequence
  chemically synthesized
caattatgtaattatatagtca

SEQ ID NO: 1235751 - DNA, 22 bp, Artificial Sequence
  chemically synthesized
tgctaaatcttgtgactatata

SEQ ID NO: 1235752 - DNA, 22 bp, Artificial Sequence
  chemically synthesized
aattatgtaattatatagtcac

SEQ ID NO: 1235753 - DNA, 22 bp, Artificial Sequence
  chemically synthesized
tgtaattatatagtcacaagat

SEQ ID NO: 1235754 - DNA, 22 bp, Artificial Sequence
  chemically synthesized
tatagtcacaagatttagcaaa

SEQ ID NO: 1235755 - DNA, 22 bp, Artificial Sequence
  chemically synthesized
aatatgatacaaaggaaaattt

SEQ ID NO: 1235756 - DNA, 22 bp, Artificial Sequence
  chemically synthesized
gaatatgatacaaaggaaaatt

SEQ ID NO: 1235757 - DNA, 22 bp, Artificial Sequence
  chemically synthesized
atgtttgaatatgatacaaagg

SEQ ID NO: 1235758 - DNA, 22 bp, Artificial Sequence
  chemically synthesized
agcaaaattttcctttgtatca

SEQ ID NO: 1235759 - DNA, 22 bp, Artificial Sequence
  chemically synthesized
aatgtttgaatatgatacaaag

SEQ ID NO: 1235760 - DNA, 22 bp, Artificial Sequence
  chemically synthesized
gcaaaattttcctttgtatcat

SEQ ID NO: 1235761 - DNA, 22 bp, Artificial Sequence
  chemically synthesized
tcctttgtatcatattcaaaca

SEQ ID NO: 1235762 - DNA, 22 bp, Artificial Sequence
  chemically synthesized
cctttgtatcatattcaaacat

SEQ ID NO: 1235763 - DNA, 22 bp, Artificial Sequence
  chemically synthesized
ctttgtatcatattcaaacatt

SEQ ID NO: 1235764 - DNA, 22 bp, Artificial Sequence
  chemically synthesized
tgtatcatattcaaacattaaa

SEQ ID NO: 1235765 - DNA, 22 bp, Artificial Sequence
  chemically synthesized
gtatcatattcaaacattaaat

SEQ ID NO: 1235766 - DNA, 22 bp, Artificial Sequence
  chemically synthesized
tatcatattcaaacattaaatg

SEQ ID NO: 1235767 - DNA, 22 bp, Artificial Sequence
  chemically synthesized
atacatatgcacatgtgtacat

SEQ ID NO: 1235768 - DNA, 22 bp, Artificial Sequence
  chemically synthesized
taatacatatgcacatgtgtac

SEQ ID NO: 1235769 - DNA, 22 bp, Artificial Sequence
  chemically synthesized
aaacattaaatgtacacatgtg

SEQ ID NO: 1235770 - DNA, 22 bp, Artificial Sequence
  chemically synthesized
gttctaatacatatgcacatgt

SEQ ID NO: 1235771 - DNA, 22 bp, Artificial Sequence
  chemically synthesized
ggttctaatacatatgcacatg

SEQ ID NO: 1235772 - DNA, 22 bp, Artificial Sequence
  chemically synthesized
aatgtacacatgtgcatatgta

SEQ ID NO: 1235773 - DNA, 22 bp, Artificial Sequence
  chemically synthesized
tgtttggttctaatacatatgc

SEQ ID NO: 1235774 - DNA, 22 bp, Artificial Sequence
  chemically synthesized
aaagagtagactatgtttggtt

SEQ ID NO: 1235775 - DNA, 22 bp, Artificial Sequence
  chemically synthesized
aaaagagtagactatgtttggt

SEQ ID NO: 1235776 - DNA, 22 bp, Artificial Sequence
  chemically synthesized
taaaagagtagactatgtttgg

SEQ ID NO: 1235777 - DNA, 22 bp, Artificial Sequence
  chemically synthesized
ttaaaagagtagactatgtttg

SEQ ID NO: 1235778 - DNA, 22 bp, Artificial Sequence
  chemically synthesized
tttaaaagagtagactatgttt

SEQ ID NO: 1235779 - DNA, 22 bp, Artificial Sequence
  chemically synthesized
cagctttttaaaagagtagact

SEQ ID NO: 1235780 - DNA, 22 bp, Artificial Sequence
  chemically synthesized
gaaccaaacatagtctactctt

SEQ ID NO: 1235781 - DNA, 22 bp, Artificial Sequence
  chemically synthesized
aggatcagaaactgcagctttt

SEQ ID NO: 1235782 - DNA, 22 bp, Artificial Sequence
  chemically synthesized
caggatcagaaactgcagcttt

SEQ ID NO: 1235783 - DNA, 22 bp, Artificial Sequence
  chemically synthesized
ctcttttaaaaagctgcagttt

SEQ ID NO: 1235784 - DNA, 22 bp, Artificial Sequence
  chemically synthesized
ttttaaaaagctgcagtttctg

SEQ ID NO: 1235785 - DNA, 22 bp, Artificial Sequence
  chemically synthesized
ccacttcaggatcagaaactgc

SEQ ID NO: 1235786 - DNA, 22 bp, Artificial Sequence
  chemically synthesized
ttaaaaagctgcagtttctgat

SEQ ID NO: 1235787 - DNA, 22 bp, Artificial Sequence
  chemically synthesized
taaaaagctgcagtttctgatc

SEQ ID NO: 1235788 - DNA, 22 bp, Artificial Sequence
  chemically synthesized
aaaaagctgcagtttctgatcc

SEQ ID NO: 1235789 - DNA, 22 bp, Artificial Sequence
  chemically synthesized
aaaagctgcagtttctgatcct

SEQ ID NO: 1235790 - DNA, 22 bp, Artificial Sequence
  chemically synthesized
agttcccacttcaggatcagaa

SEQ ID NO: 1235791 - DNA, 22 bp, Artificial Sequence
  chemically synthesized
aagttcccacttcaggatcaga

SEQ ID NO: 1235792 - DNA, 22 bp, Artificial Sequence
  chemically synthesized
taagttcccacttcaggatcag

SEQ ID NO: 1235793 - DNA, 22 bp, Artificial Sequence
  chemically synthesized
cagtttctgatcctgaagtggg

SEQ ID NO: 1235794 - DNA, 22 bp, Artificial Sequence
  chemically synthesized
ctgatcctgaagtgggaactta

SEQ ID NO: 1235795 - DNA, 22 bp, Artificial Sequence
  chemically synthesized
tgatcctgaagtgggaacttaa

SEQ ID NO: 1235796 - DNA, 22 bp, Artificial Sequence
  chemically synthesized
ataggggcagattttaagttcc

SEQ ID NO: 1235797 - DNA, 22 bp, Artificial Sequence
  chemically synthesized
atcctgaagtgggaacttaaaa

SEQ ID NO: 1235798 - DNA, 22 bp, Artificial Sequence
  chemically synthesized
taataggggcagattttaagtt

SEQ ID NO: 1235799 - DNA, 22 bp, Artificial Sequence
  chemically synthesized
aagtgggaacttaaaatctgcc

SEQ ID NO: 1235800 - DNA, 22 bp, Artificial Sequence
  chemically synthesized
cccaaggagactctaatagggg

SEQ ID NO: 1235801 - DNA, 22 bp, Artificial Sequence
  chemically synthesized
aaaatctgcccctattagagtc

SEQ ID NO: 1235802 - DNA, 22 bp, Artificial Sequence
  chemically synthesized
aaatctgcccctattagagtct

SEQ ID NO: 1235803 - DNA, 22 bp, Artificial Sequence
  chemically synthesized
cccctattagagtctccttggg

SEQ ID NO: 1235804 - DNA, 22 bp, Artificial Sequence
  chemically synthesized
ttagagtctccttggggagtat

SEQ ID NO: 1235805 - DNA, 22 bp, Artificial Sequence
  chemically synthesized
gagtctccttggggagtatttc

SEQ ID NO: 1235806 - DNA, 22 bp, Artificial Sequence
  chemically synthesized
caatcataaaataagaaatact

SEQ ID NO: 1235807 - DNA, 22 bp, Artificial Sequence
  chemically synthesized
acaatcataaaataagaaatac

SEQ ID NO: 1235808 - DNA, 22 bp, Artificial Sequence
  chemically synthesized
cttggggagtatttcttatttt

SEQ ID NO: 1235809 - DNA, 22 bp, Artificial Sequence
  chemically synthesized
ccttacaatcataaaataagaa

SEQ ID NO: 1235810 - DNA, 22 bp, Artificial Sequence
  chemically synthesized
gccttacaatcataaaataaga

SEQ ID NO: 1235811 - DNA, 22 bp, Artificial Sequence
  chemically synthesized
ggggagtatttcttattttatg

SEQ ID NO: 1235812 - DNA, 22 bp, Artificial Sequence
  chemically synthesized
gggagtatttcttattttatga

SEQ ID NO: 1235813 - DNA, 22 bp, Artificial Sequence
  chemically synthesized
cttattttatgattgtaaggca

SEQ ID NO: 1235814 - DNA, 22 bp, Artificial Sequence
  chemically synthesized
ttattttatgattgtaaggcaa

SEQ ID NO: 1235815 - DNA, 22 bp, Artificial Sequence
  chemically synthesized
aaaggaaggtacttgccttaca

SEQ ID NO: 1235816 - DNA, 22 bp, Artificial Sequence
  chemically synthesized
attttatgattgtaaggcaagt

SEQ ID NO: 1235817 - DNA, 22 bp, Artificial Sequence
  chemically synthesized
ttttatgattgtaaggcaagta

SEQ ID NO: 1235818 - DNA, 22 bp, Artificial Sequence
  chemically synthesized
tatgattgtaaggcaagtacct

SEQ ID NO: 1235819 - DNA, 22 bp, Artificial Sequence
  chemically synthesized
atgattgtaaggcaagtacctt

SEQ ID NO: 1235820 - DNA, 22 bp, Artificial Sequence
  chemically synthesized
tgattgtaaggcaagtaccttc

SEQ ID NO: 1235821 - DNA, 22 bp, Artificial Sequence
  chemically synthesized
taaggcaagtaccttcctttta

SEQ ID NO: 1235822 - DNA, 22 bp, Artificial Sequence
  chemically synthesized
aggacatccccagggttaaaag

SEQ ID NO: 1235823 - DNA, 22 bp, Artificial Sequence
  chemically synthesized
gctcaggacatccccagggtta

SEQ ID NO: 1235824 - DNA, 22 bp, Artificial Sequence
  chemically synthesized
ttggctcaggacatccccaggg

SEQ ID NO: 1235825 - DNA, 22 bp, Artificial Sequence
  chemically synthesized
ccttttaaccctggggatgtcc

SEQ ID NO: 1235826 - DNA, 22 bp, Artificial Sequence
  chemically synthesized
cttttaaccctggggatgtcct

SEQ ID NO: 1235827 - DNA, 22 bp, Artificial Sequence
  chemically synthesized
gattattggctcaggacatccc

SEQ ID NO: 1235828 - DNA, 22 bp, Artificial Sequence
  chemically synthesized
ggattattggctcaggacatcc

SEQ ID NO: 1235829 - DNA, 22 bp, Artificial Sequence
  chemically synthesized
ttaaccctggggatgtcctgag

SEQ ID NO: 1235830 - DNA, 22 bp, Artificial Sequence
  chemically synthesized
taaccctggggatgtcctgagc

SEQ ID NO: 1235831 - DNA, 22 bp, Artificial Sequence
  chemically synthesized
aaccctggggatgtcctgagcc

SEQ ID NO: 1235832 - DNA, 22 bp, Artificial Sequence
  chemically synthesized
accctggggatgtcctgagcca

SEQ ID NO: 1235833 - DNA, 22 bp, Artificial Sequence
  chemically synthesized
catttggattattggctcagga

SEQ ID NO: 1235834 - DNA, 22 bp, Artificial Sequence
  chemically synthesized
gggatgtcctgagccaataatc

SEQ ID NO: 1235835 - DNA, 22 bp, Artificial Sequence
  chemically synthesized
agaagcatctgcatttggatta

SEQ ID NO: 1235836 - DNA, 22 bp, Artificial Sequence
  chemically synthesized
ctcagaagcatctgcatttgga

SEQ ID NO: 1235837 - DNA, 22 bp, Artificial Sequence
  chemically synthesized
tactcagaagcatctgcatttg

SEQ ID NO: 1235838 - DNA, 22 bp, Artificial Sequence
  chemically synthesized
agccaataatccaaatgcagat

SEQ ID NO: 1235839 - DNA, 22 bp, Artificial Sequence
  chemically synthesized
gtattctactcagaagcatctg

SEQ ID NO: 1235840 - DNA, 22 bp, Artificial Sequence
  chemically synthesized
agtattctactcagaagcatct

SEQ ID NO: 1235841 - DNA, 22 bp, Artificial Sequence
  chemically synthesized
tagtattctactcagaagcatc

SEQ ID NO: 1235842 - DNA, 22 bp, Artificial Sequence
  chemically synthesized
tagaacagaaattttagtattc

SEQ ID NO: 1235843 - DNA, 22 bp, Artificial Sequence
  chemically synthesized
ctgagtagaatactaaaatttc

SEQ ID NO: 1235844 - DNA, 22 bp, Artificial Sequence
  chemically synthesized
tgagtagaatactaaaatttct

SEQ ID NO: 1235845 - DNA, 22 bp, Artificial Sequence
  chemically synthesized
agtagaatactaaaatttctgt

SEQ ID NO: 1235846 - DNA, 22 bp, Artificial Sequence
  chemically synthesized
atgggaggcatgtatactatag

SEQ ID NO: 1235847 - DNA, 22 bp, Artificial Sequence
  chemically synthesized
aaatttctgttctatagtatac

SEQ ID NO: 1235848 - DNA, 22 bp, Artificial Sequence
  chemically synthesized
ctaatgggaggcatgtatacta

SEQ ID NO: 1235849 - DNA, 22 bp, Artificial Sequence
  chemically synthesized
ctcctaatgggaggcatgtata

SEQ ID NO: 1235850 - DNA, 22 bp, Artificial Sequence
  chemically synthesized
ctgttctatagtatacatgcct

SEQ ID NO: 1235851 - DNA, 22 bp, Artificial Sequence
  chemically synthesized
tgttctatagtatacatgcctc

SEQ ID NO: 1235852 - DNA, 22 bp, Artificial Sequence
  chemically synthesized
tactcctaatgggaggcatgta

SEQ ID NO: 1235853 - DNA, 22 bp, Artificial Sequence
  chemically synthesized
ctactcctaatgggaggcatgt

SEQ ID NO: 1235854 - DNA, 22 bp, Artificial Sequence
  chemically synthesized
ttctatagtatacatgcctccc

SEQ ID NO: 1235855 - DNA, 22 bp, Artificial Sequence
  chemically synthesized
tatagtatacatgcctcccatt

SEQ ID NO: 1235856 - DNA, 22 bp, Artificial Sequence
  chemically synthesized
tagtatacatgcctcccattag

SEQ ID NO: 1235857 - DNA, 22 bp, Artificial Sequence
  chemically synthesized
tagagatatatcttctactcct

SEQ ID NO: 1235858 - DNA, 22 bp, Artificial Sequence
  chemically synthesized
tgtagagatatatcttctactc

SEQ ID NO: 1235859 - DNA, 22 bp, Artificial Sequence
  chemically synthesized
ctgtagagatatatcttctact

SEQ ID NO: 1235860 - DNA, 22 bp, Artificial Sequence
  chemically synthesized
ccattaggagtagaagatatat

SEQ ID NO: 1235861 - DNA, 22 bp, Artificial Sequence
  chemically synthesized
atagtttctgtagagatatatc

SEQ ID NO: 1235862 - DNA, 22 bp, Artificial Sequence
  chemically synthesized
taatagtttctgtagagatata

SEQ ID NO: 1235863 - DNA, 22 bp, Artificial Sequence
  chemically synthesized
ggagtagaagatatatctctac

SEQ ID NO: 1235864 - DNA, 22 bp, Artificial Sequence
  chemically synthesized
aattctaatagtttctgtagag

SEQ ID NO: 1235865 - DNA, 22 bp, Artificial Sequence
  chemically synthesized
gaattctaatagtttctgtaga

SEQ ID NO: 1235866 - DNA, 22 bp, Artificial Sequence
  chemically synthesized
tcttgaattctaatagtttctg

SEQ ID NO: 1235867 - DNA, 22 bp, Artificial Sequence
  chemically synthesized
gtcttgaattctaatagtttct

SEQ ID NO: 1235868 - DNA, 22 bp, Artificial Sequence
  chemically synthesized
tgccttgtcttgaattctaata

SEQ ID NO: 1235869 - DNA, 22 bp, Artificial Sequence
  chemically synthesized
tacagaaactattagaattcaa

SEQ ID NO: 1235870 - DNA, 22 bp, Artificial Sequence
  chemically synthesized
gctatgccttgtcttgaattct

SEQ ID NO: 1235871 - DNA, 22 bp, Artificial Sequence
  chemically synthesized
cagaaactattagaattcaaga

SEQ ID NO: 1235872 - DNA, 22 bp, Artificial Sequence
  chemically synthesized
caattcgctatgccttgtcttg

SEQ ID NO: 1235873 - DNA, 22 bp, Artificial Sequence
  chemically synthesized
ttagaattcaagacaaggcata

SEQ ID NO: 1235874 - DNA, 22 bp, Artificial Sequence
  chemically synthesized
gaattcaagacaaggcatagcg

SEQ ID NO: 1235875 - DNA, 22 bp, Artificial Sequence
  chemically synthesized
aagacaaggcatagcgaattgg

SEQ ID NO: 1235876 - DNA, 22 bp, Artificial Sequence
  chemically synthesized
ccgatcccagaactccaattcg

SEQ ID NO: 1235877 - DNA, 22 bp, Artificial Sequence
  chemically synthesized
acaaatgctcccgatcccagaa

SEQ ID NO: 1235878 - DNA, 22 bp, Artificial Sequence
  chemically synthesized
taacaaatgctcccgatcccag

SEQ ID NO: 1235879 - DNA, 22 bp, Artificial Sequence
  chemically synthesized
gagttctgggatcgggagcatt

SEQ ID NO: 1235880 - DNA, 22 bp, Artificial Sequence
  chemically synthesized
tgggatcgggagcatttgttag

SEQ ID NO: 1235881 - DNA, 22 bp, Artificial Sequence
  chemically synthesized
ggatcgggagcatttgttagag

SEQ ID NO: 1235882 - DNA, 22 bp, Artificial Sequence
  chemically synthesized
ataaagcagaatcacctctaac

SEQ ID NO: 1235883 - DNA, 22 bp, Artificial Sequence
  chemically synthesized
tcataaagcagaatcacctcta

SEQ ID NO: 1235884 - DNA, 22 bp, Artificial Sequence
  chemically synthesized
ctcataaagcagaatcacctct

SEQ ID NO: 1235885 - DNA, 22 bp, Artificial Sequence
  chemically synthesized
tctcataaagcagaatcacctc

SEQ ID NO: 1235886 - DNA, 22 bp, Artificial Sequence
  chemically synthesized
cctttctcataaagcagaatca

SEQ ID NO: 1235887 - DNA, 22 bp, Artificial Sequence
  chemically synthesized
gcctttctcataaagcagaatc

SEQ ID NO: 1235888 - DNA, 22 bp, Artificial Sequence
  chemically synthesized
tgcctttctcataaagcagaat

SEQ ID NO: 1235889 - DNA, 22 bp, Artificial Sequence
  chemically synthesized
gttagaggtgattctgctttat

SEQ ID NO: 1235890 - DNA, 22 bp, Artificial Sequence
  chemically synthesized
ttagaggtgattctgctttatg

SEQ ID NO: 1235891 - DNA, 22 bp, Artificial Sequence
  chemically synthesized
gaggtgattctgctttatgaga

SEQ ID NO: 1235892 - DNA, 22 bp, Artificial Sequence
  chemically synthesized
aggattttgcctttctcataaa

SEQ ID NO: 1235893 - DNA, 22 bp, Artificial Sequence
  chemically synthesized
gtctgaggattttgcctttctc

SEQ ID NO: 1235894 - DNA, 22 bp, Artificial Sequence
  chemically synthesized
tgctttatgagaaaggcaaaat

SEQ ID NO: 1235895 - DNA, 22 bp, Artificial Sequence
  chemically synthesized
ctttatgagaaaggcaaaatcc

SEQ ID NO: 1235896 - DNA, 22 bp, Artificial Sequence
  chemically synthesized
tatgagaaaggcaaaatcctca

SEQ ID NO: 1235897 - DNA, 22 bp, Artificial Sequence
  chemically synthesized
tcagccctggtctgaggatttt

SEQ ID NO: 1235898 - DNA, 22 bp, Artificial Sequence
  chemically synthesized
atgagaaaggcaaaatcctcag

SEQ ID NO: 1235899 - DNA, 22 bp, Artificial Sequence
  chemically synthesized
tgagaaaggcaaaatcctcaga

SEQ ID NO: 1235900 - DNA, 22 bp, Artificial Sequence
  chemically synthesized
atcacagatctgtcagccctgg

SEQ ID NO: 1235901 - DNA, 22 bp, Artificial Sequence
  chemically synthesized
tcctaatcacagatctgtcagc

SEQ ID NO: 1235902 - DNA, 22 bp, Artificial Sequence
  chemically synthesized
gtcctaatcacagatctgtcag

SEQ ID NO: 1235903 - DNA, 22 bp, Artificial Sequence
  chemically synthesized
agaccagggctgacagatctgt

SEQ ID NO: 1235904 - DNA, 22 bp, Artificial Sequence
  chemically synthesized
tttgtcctaatcacagatctgt

SEQ ID NO: 1235905 - DNA, 22 bp, Artificial Sequence
  chemically synthesized
accattgtttgtcctaatcaca

SEQ ID NO: 1235906 - DNA, 22 bp, Artificial Sequence
  chemically synthesized
acagatctgtgattaggacaaa

SEQ ID NO: 1235907 - DNA, 22 bp, Artificial Sequence
  chemically synthesized
acagaatccattcaccattgtt

SEQ ID NO: 1235908 - DNA, 22 bp, Artificial Sequence
  chemically synthesized
tgattaggacaaacaatggtga

SEQ ID NO: 1235909 - DNA, 22 bp, Artificial Sequence
  chemically synthesized
ctaacagaatccattcaccatt

SEQ ID NO: 1235910 - DNA, 22 bp, Artificial Sequence
  chemically synthesized
ctactaacagaatccattcacc

SEQ ID NO: 1235911 - DNA, 22 bp, Artificial Sequence
  chemically synthesized
ggacaaacaatggtgaatggat

SEQ ID NO: 1235912 - DNA, 22 bp, Artificial Sequence
  chemically synthesized
agatactgctactaacagaatc

SEQ ID NO: 1235913 - DNA, 22 bp, Artificial Sequence
  chemically synthesized
cagatactgctactaacagaat

SEQ ID NO: 1235914 - DNA, 22 bp, Artificial Sequence
  chemically synthesized
cataatttcagatactgctact

SEQ ID NO: 1235915 - DNA, 22 bp, Artificial Sequence
  chemically synthesized
tgttagtagcagtatctgaaat

SEQ ID NO: 1235916 - DNA, 22 bp, Artificial Sequence
  chemically synthesized
ttagtagcagtatctgaaatta

SEQ ID NO: 1235917 - DNA, 22 bp, Artificial Sequence
  chemically synthesized
gtagcagtatctgaaattatgt

SEQ ID NO: 1235918 - DNA, 22 bp, Artificial Sequence
  chemically synthesized
cacatggcagtgtagattacat

SEQ ID NO: 1235919 - DNA, 22 bp, Artificial Sequence
  chemically synthesized
acacatggcagtgtagattaca

SEQ ID NO: 1235920 - DNA, 22 bp, Artificial Sequence
  chemically synthesized
aaattatgtaatctacactgcc

SEQ ID NO: 1235921 - DNA, 22 bp, Artificial Sequence
  chemically synthesized
tgtaatctacactgccatgtgt

SEQ ID NO: 1235922 - DNA, 22 bp, Artificial Sequence
  chemically synthesized
cactgccatgtgtaaatgtttg

SEQ ID NO: 1235923 - DNA, 22 bp, Artificial Sequence
  chemically synthesized
ccatgtgtaaatgtttggtgat

SEQ ID NO: 1235924 - DNA, 22 bp, Artificial Sequence
  chemically synthesized
gtggtagggaaaaatcaccaaa

SEQ ID NO: 1235925 - DNA, 22 bp, Artificial Sequence
  chemically synthesized
ggtgatttttccctaccactag

SEQ ID NO: 1235926 - DNA, 22 bp, Artificial Sequence
  chemically synthesized
gtgatttttccctaccactagc

SEQ ID NO: 1235927 - DNA, 22 bp, Artificial Sequence
  chemically synthesized
gccagtataaggtaagctagtg

SEQ ID NO: 1235928 - DNA, 22 bp, Artificial Sequence
  chemically synthesized
ttccctaccactagcttacctt

SEQ ID NO: 1235929 - DNA, 22 bp, Artificial Sequence
  chemically synthesized
tccctaccactagcttacctta

SEQ ID NO: 1235930 - DNA, 22 bp, Artificial Sequence
  chemically synthesized
ccctaccactagcttaccttat

SEQ ID NO: 1235931 - DNA, 22 bp, Artificial Sequence
  chemically synthesized
cctaccactagcttaccttata

SEQ ID NO: 1235932 - DNA, 22 bp, Artificial Sequence
  chemically synthesized
ccactagcttaccttatactgg

SEQ ID NO: 1235933 - DNA, 22 bp, Artificial Sequence
  chemically synthesized
gcttaccttatactggccaatc

SEQ ID NO: 1235934 - DNA, 22 bp, Artificial Sequence
  chemically synthesized
accttatactggccaatctcat

SEQ ID NO: 1235935 - DNA, 22 bp, Artificial Sequence
  chemically synthesized
ccttatactggccaatctcatg

SEQ ID NO: 1235936 - DNA, 22 bp, Artificial Sequence
  chemically synthesized
atactggccaatctcatggata

SEQ ID NO: 1235937 - DNA, 22 bp, Artificial Sequence
  chemically synthesized
tactggccaatctcatggatat

SEQ ID NO: 1235938 - DNA, 22 bp, Artificial Sequence
  chemically synthesized
gccaatctcatggatattttgt

SEQ ID NO: 1235939 - DNA, 22 bp, Artificial Sequence
  chemically synthesized
aagaaaaaaatatcaaacaaaa

SEQ ID NO: 1235940 - DNA, 22 bp, Artificial Sequence
  chemically synthesized
atggatattttgtttgatattt

SEQ ID NO: 1235941 - DNA, 22 bp, Artificial Sequence
  chemically synthesized
gtaatagcattaaagaaaaaaa

SEQ ID NO: 1235942 - DNA, 22 bp, Artificial Sequence
  chemically synthesized
tgtttgatatttttttctttaa

SEQ ID NO: 1235943 - DNA, 22 bp, Artificial Sequence
  chemically synthesized
gtttgatatttttttctttaat

SEQ ID NO: 1235944 - DNA, 22 bp, Artificial Sequence
  chemically synthesized
attagtaatagcattaaagaaa

SEQ ID NO: 1235945 - DNA, 22 bp, Artificial Sequence
  chemically synthesized
tttgatatttttttctttaatg

SEQ ID NO: 1235946 - DNA, 22 bp, Artificial Sequence
  chemically synthesized
gatatttttttctttaatgcta

SEQ ID NO: 1235947 - DNA, 22 bp, Artificial Sequence
  chemically synthesized
atatttttttctttaatgctat

SEQ ID NO: 1235948 - DNA, 22 bp, Artificial Sequence
  chemically synthesized
ttttctttaatgctattactaa

SEQ ID NO: 1235949 - DNA, 22 bp, Artificial Sequence
  chemically synthesized
tttctttaatgctattactaat

SEQ ID NO: 1235950 - DNA, 22 bp, Artificial Sequence
  chemically synthesized
ttctttaatgctattactaatt

SEQ ID NO: 1235951 - DNA, 22 bp, Artificial Sequence
  chemically synthesized
tctttaatgctattactaatta

SEQ ID NO: 1235952 - DNA, 22 bp, Artificial Sequence
  chemically synthesized
ctttaatgctattactaattag

SEQ ID NO: 1235953 - DNA, 22 bp, Artificial Sequence
  chemically synthesized
tttaatgctattactaattagg

SEQ ID NO: 1235954 - DNA, 22 bp, Artificial Sequence
  chemically synthesized
agacaaaatgaacctaattagt

SEQ ID NO: 1235955 - DNA, 22 bp, Artificial Sequence
  chemically synthesized
taatgctattactaattaggtt

SEQ ID NO: 1235956 - DNA, 22 bp, Artificial Sequence
  chemically synthesized
aatgctattactaattaggttc

SEQ ID NO: 1235957 - DNA, 22 bp, Artificial Sequence
  chemically synthesized
atgctattactaattaggttca

SEQ ID NO: 1235958 - DNA, 22 bp, Artificial Sequence
  chemically synthesized
ttactaattaggttcattttgt

SEQ ID NO: 1235959 - DNA, 22 bp, Artificial Sequence
  chemically synthesized
ctaattaggttcattttgtctt

SEQ ID NO: 1235960 - DNA, 22 bp, Artificial Sequence
  chemically synthesized
attaggttcattttgtcttagc

SEQ ID NO: 1235961 - DNA, 22 bp, Artificial Sequence
  chemically synthesized
ggttcattttgtcttagcgtct

SEQ ID NO: 1235962 - DNA, 22 bp, Artificial Sequence
  chemically synthesized
tgcatatacatacatagacgct

SEQ ID NO: 1235963 - DNA, 22 bp, Artificial Sequence
  chemically synthesized
atgcatatacatacatagacgc

SEQ ID NO: 1235964 - DNA, 22 bp, Artificial Sequence
  chemically synthesized
attttgtcttagcgtctatgta

SEQ ID NO: 1235965 - DNA, 22 bp, Artificial Sequence
  chemically synthesized
tgtcttagcgtctatgtatgta

SEQ ID NO: 1235966 - DNA, 22 bp, Artificial Sequence
  chemically synthesized
catttatgcatatacatacata

SEQ ID NO: 1235967 - DNA, 22 bp, Artificial Sequence
  chemically synthesized
gtcttagcgtctatgtatgtat

SEQ ID NO: 1235968 - DNA, 22 bp, Artificial Sequence
  chemically synthesized
gcatttatgcatatacatacat

SEQ ID NO: 1235969 - DNA, 22 bp, Artificial Sequence
  chemically synthesized
tcttagcgtctatgtatgtata

SEQ ID NO: 1235970 - DNA, 22 bp, Artificial Sequence
  chemically synthesized
agcgtctatgtatgtatatgca

SEQ ID NO: 1235971 - DNA, 22 bp, Artificial Sequence
  chemically synthesized
gcgtctatgtatgtatatgcat

SEQ ID NO: 1235972 - DNA, 22 bp, Artificial Sequence
  chemically synthesized
tgtatgtatatgcataaatgca

SEQ ID NO: 1235973 - DNA, 22 bp, Artificial Sequence
  chemically synthesized
aaaaatccacatgatttgcatt

SEQ ID NO: 1235974 - DNA, 22 bp, Artificial Sequence
  chemically synthesized
ggcaaaattaaaaaatccacat

SEQ ID NO: 1235975 - DNA, 22 bp, Artificial Sequence
  chemically synthesized
cggcaaaattaaaaaatccaca

SEQ ID NO: 1235976 - DNA, 22 bp, Artificial Sequence
  chemically synthesized
atttcggcaaaattaaaaaatc

SEQ ID NO: 1235977 - DNA, 22 bp, Artificial Sequence
  chemically synthesized
tttaattttgccgaaattagtg

SEQ ID NO: 1235978 - DNA, 22 bp, Artificial Sequence
  chemically synthesized
ttaattttgccgaaattagtgg

SEQ ID NO: 1235979 - DNA, 22 bp, Artificial Sequence
  chemically synthesized
taattttgccgaaattagtggt

SEQ ID NO: 1235980 - DNA, 22 bp, Artificial Sequence
  chemically synthesized
aattttgccgaaattagtggtt

SEQ ID NO: 1235981 - DNA, 22 bp, Artificial Sequence
  chemically synthesized
atataaagaaaaaaccactaat

SEQ ID NO: 1235982 - DNA, 22 bp, Artificial Sequence
  chemically synthesized
attttgccgaaattagtggttt

SEQ ID NO: 1235983 - DNA, 22 bp, Artificial Sequence
  chemically synthesized
gatataaagaaaaaaccactaa

SEQ ID NO: 1235984 - DNA, 22 bp, Artificial Sequence
  chemically synthesized
tgccgaaattagtggttttttc

SEQ ID NO: 1235985 - DNA, 22 bp, Artificial Sequence
  chemically synthesized
gccgaaattagtggttttttct

SEQ ID NO: 1235986 - DNA, 22 bp, Artificial Sequence
  chemically synthesized
ccgaaattagtggttttttctt

SEQ ID NO: 1235987 - DNA, 22 bp, Artificial Sequence
  chemically synthesized
cccatttgatataaagaaaaaa

SEQ ID NO: 1235988 - DNA, 22 bp, Artificial Sequence
  chemically synthesized
gtggttttttctttatatcaaa

SEQ ID NO: 1235989 - DNA, 22 bp, Artificial Sequence
  chemically synthesized
gcacactacccatttgatataa

SEQ ID NO: 1235990 - DNA, 22 bp, Artificial Sequence
  chemically synthesized
tttctttatatcaaatgggtag

SEQ ID NO: 1235991 - DNA, 22 bp, Artificial Sequence
  chemically synthesized
ttctttatatcaaatgggtagt

SEQ ID NO: 1235992 - DNA, 22 bp, Artificial Sequence
  chemically synthesized
tgatgttggcacactacccatt

SEQ ID NO: 1235993 - DNA, 22 bp, Artificial Sequence
  chemically synthesized
tctttatatcaaatgggtagtg

SEQ ID NO: 1235994 - DNA, 22 bp, Artificial Sequence
  chemically synthesized
atgatgttggcacactacccat

SEQ ID NO: 1235995 - DNA, 22 bp, Artificial Sequence
  chemically synthesized
ctttatatcaaatgggtagtgt

SEQ ID NO: 1235996 - DNA, 22 bp, Artificial Sequence
  chemically synthesized
tttatatcaaatgggtagtgtg

SEQ ID NO: 1235997 - DNA, 22 bp, Artificial Sequence
  chemically synthesized
tatatcaaatgggtagtgtgcc

SEQ ID NO: 1235998 - DNA, 22 bp, Artificial Sequence
  chemically synthesized
atatcaaatgggtagtgtgcca

SEQ ID NO: 1235999 - DNA, 22 bp, Artificial Sequence
  chemically synthesized
aacttatgatgttggcacacta

SEQ ID NO: 1236000 - DNA, 22 bp, Artificial Sequence
  chemically synthesized
tatcaaatgggtagtgtgccaa

SEQ ID NO: 1236001 - DNA, 22 bp, Artificial Sequence
  chemically synthesized
taaacttatgatgttggcacac

SEQ ID NO: 1236002 - DNA, 22 bp, Artificial Sequence
  chemically synthesized
tctaaacttatgatgttggcac

SEQ ID NO: 1236003 - DNA, 22 bp, Artificial Sequence
  chemically synthesized
ctctaaacttatgatgttggca

SEQ ID NO: 1236004 - DNA, 22 bp, Artificial Sequence
  chemically synthesized
tctctaaacttatgatgttggc

SEQ ID NO: 1236005 - DNA, 22 bp, Artificial Sequence
  chemically synthesized
agatatgagataagcctttctc

SEQ ID NO: 1236006 - DNA, 22 bp, Artificial Sequence
  chemically synthesized
tactcagatatgagataagcct

SEQ ID NO: 1236007 - DNA, 22 bp, Artificial Sequence
  chemically synthesized
atactcagatatgagataagcc

SEQ ID NO: 1236008 - DNA, 22 bp, Artificial Sequence
  chemically synthesized
agagaaaggcttatctcatatc

SEQ ID NO: 1236009 - DNA, 22 bp, Artificial Sequence
  chemically synthesized
gagaaaggcttatctcatatct

SEQ ID NO: 1236010 - DNA, 22 bp, Artificial Sequence
  chemically synthesized
ggtgtttatactcagatatgag

SEQ ID NO: 1236011 - DNA, 22 bp, Artificial Sequence
  chemically synthesized
gggtgtttatactcagatatga

SEQ ID NO: 1236012 - DNA, 22 bp, Artificial Sequence
  chemically synthesized
atctcatatctgagtataaaca

SEQ ID NO: 1236013 - DNA, 22 bp, Artificial Sequence
  chemically synthesized
tctcatatctgagtataaacac

SEQ ID NO: 1236014 - DNA, 22 bp, Artificial Sequence
  chemically synthesized
ataagcatgatttgggtgttta

SEQ ID NO: 1236015 - DNA, 22 bp, Artificial Sequence
  chemically synthesized
atatctgagtataaacacccaa

SEQ ID NO: 1236016 - DNA, 22 bp, Artificial Sequence
  chemically synthesized
gtaattcataagcatgatttgg

SEQ ID NO: 1236017 - DNA, 22 bp, Artificial Sequence
  chemically synthesized
agtataaacacccaaatcatgc

SEQ ID NO: 1236018 - DNA, 22 bp, Artificial Sequence
  chemically synthesized
cgtaattcataagcatgatttg

SEQ ID NO: 1236019 - DNA, 22 bp, Artificial Sequence
  chemically synthesized
tcgtaattcataagcatgattt

SEQ ID NO: 1236020 - DNA, 22 bp, Artificial Sequence
  chemically synthesized
agatcctttcgtaattcataag

SEQ ID NO: 1236021 - DNA, 22 bp, Artificial Sequence
  chemically synthesized
cagatcctttcgtaattcataa

SEQ ID NO: 1236022 - DNA, 22 bp, Artificial Sequence
  chemically synthesized
agataatgaatttcagatcctt

SEQ ID NO: 1236023 - DNA, 22 bp, Artificial Sequence
  chemically synthesized
atgaattacgaaaggatctgaa

SEQ ID NO: 1236024 - DNA, 22 bp, Artificial Sequence
  chemically synthesized
aagataatgaatttcagatcct

SEQ ID NO: 1236025 - DNA, 22 bp, Artificial Sequence
  chemically synthesized
tgaattacgaaaggatctgaaa

SEQ ID NO: 1236026 - DNA, 22 bp, Artificial Sequence
  chemically synthesized
cgaaaggatctgaaattcatta

SEQ ID NO: 1236027 - DNA, 22 bp, Artificial Sequence
  chemically synthesized
atacataatgtttaagataatg

SEQ ID NO: 1236028 - DNA, 22 bp, Artificial Sequence
  chemically synthesized
catacataatgtttaagataat

SEQ ID NO: 1236029 - DNA, 22 bp, Artificial Sequence
  chemically synthesized
aaattcattatcttaaacatta

SEQ ID NO: 1236030 - DNA, 22 bp, Artificial Sequence
  chemically synthesized
acaaatttcatacataatgttt

SEQ ID NO: 1236031 - DNA, 22 bp, Artificial Sequence
  chemically synthesized
attatcttaaacattatgtatg

SEQ ID NO: 1236032 - DNA, 22 bp, Artificial Sequence
  chemically synthesized
tcttaaacattatgtatgaaat

SEQ ID NO: 1236033 - DNA, 22 bp, Artificial Sequence
  chemically synthesized
gtcagggttaacaaatttcata

SEQ ID NO: 1236034 - DNA, 22 bp, Artificial Sequence
  chemically synthesized
agtcagggttaacaaatttcat

SEQ ID NO: 1236035 - DNA, 22 bp, Artificial Sequence
  chemically synthesized
aaacattatgtatgaaatttgt

SEQ ID NO: 1236036 - DNA, 22 bp, Artificial Sequence
  chemically synthesized
aacattatgtatgaaatttgtt

SEQ ID NO: 1236037 - DNA, 22 bp, Artificial Sequence
  chemically synthesized
tgtatgaaatttgttaaccctg

SEQ ID NO: 1236038 - DNA, 22 bp, Artificial Sequence
  chemically synthesized
tcacccaaagcaatttagtcag

SEQ ID NO: 1236039 - DNA, 22 bp, Artificial Sequence
  chemically synthesized
gttaaccctgactaaattgctt

SEQ ID NO: 1236040 - DNA, 22 bp, Artificial Sequence
  chemically synthesized
ttaaccctgactaaattgcttt

SEQ ID NO: 1236041 - DNA, 22 bp, Artificial Sequence
  chemically synthesized
accctgactaaattgctttggg

SEQ ID NO: 1236042 - DNA, 22 bp, Artificial Sequence
  chemically synthesized
agtcaatccatctatcacccaa

SEQ ID NO: 1236043 - DNA, 22 bp, Artificial Sequence
  chemically synthesized
actaaattgctttgggtgatag

SEQ ID NO: 1236044 - DNA, 22 bp, Artificial Sequence
  chemically synthesized
actgagtcaatccatctatcac

SEQ ID NO: 1236045 - DNA, 22 bp, Artificial Sequence
  chemically synthesized
aattgctttgggtgatagatgg

SEQ ID NO: 1236046 - DNA, 22 bp, Artificial Sequence
  chemically synthesized
cctgactgagtcaatccatcta

SEQ ID NO: 1236047 - DNA, 22 bp, Artificial Sequence
  chemically synthesized
ccctgactgagtcaatccatct

SEQ ID NO: 1236048 - DNA, 22 bp, Artificial Sequence
  chemically synthesized
ctttgggtgatagatggattga

SEQ ID NO: 1236049 - DNA, 22 bp, Artificial Sequence
  chemically synthesized
tgggtgatagatggattgactc

SEQ ID NO: 1236050 - DNA, 22 bp, Artificial Sequence
  chemically synthesized
gggtgatagatggattgactca

SEQ ID NO: 1236051 - DNA, 22 bp, Artificial Sequence
  chemically synthesized
ggtgatagatggattgactcag

SEQ ID NO: 1236052 - DNA, 22 bp, Artificial Sequence
  chemically synthesized
gtcatttccctgactgagtcaa

SEQ ID NO: 1236053 - DNA, 22 bp, Artificial Sequence
  chemically synthesized
tggtcatttccctgactgagtc

SEQ ID NO: 1236054 - DNA, 22 bp, Artificial Sequence
  chemically synthesized
caatcctctggtcatttccctg

SEQ ID NO: 1236055 - DNA, 22 bp, Artificial Sequence
  chemically synthesized
actcagtcagggaaatgaccag

SEQ ID NO: 1236056 - DNA, 22 bp, Artificial Sequence
  chemically synthesized
tgttgcaatcctctggtcattt

SEQ ID NO: 1236057 - DNA, 22 bp, Artificial Sequence
  chemically synthesized
ctgtgttgcaatcctctggtca

SEQ ID NO: 1236058 - DNA, 22 bp, Artificial Sequence
  chemically synthesized
agtcagggaaatgaccagagga

SEQ ID NO: 1236059 - DNA, 22 bp, Artificial Sequence
  chemically synthesized
tcctgtgttgcaatcctctggt

SEQ ID NO: 1236060 - DNA, 22 bp, Artificial Sequence
  chemically synthesized
ctcctgtgttgcaatcctctgg

SEQ ID NO: 1236061 - DNA, 22 bp, Artificial Sequence
  chemically synthesized
cgtgatcacttctcctgtgttg

SEQ ID NO: 1236062 - DNA, 22 bp, Artificial Sequence
  chemically synthesized
caggtatctgcgtgatcacttc

SEQ ID NO: 1236063 - DNA, 22 bp, Artificial Sequence
  chemically synthesized
ccaggtatctgcgtgatcactt

SEQ ID NO: 1236064 - DNA, 22 bp, Artificial Sequence
  chemically synthesized
caacacaggagaagtgatcacg

SEQ ID NO: 1236065 - DNA, 22 bp, Artificial Sequence
  chemically synthesized
acttccaggtatctgcgtgatc

SEQ ID NO: 1236066 - DNA, 22 bp, Artificial Sequence
  chemically synthesized
cacttccaggtatctgcgtgat

SEQ ID NO: 1236067 - DNA, 22 bp, Artificial Sequence
  chemically synthesized
ttcacttccaggtatctgcgtg

SEQ ID NO: 1236068 - DNA, 22 bp, Artificial Sequence
  chemically synthesized
tctcttcacttccaggtatctg

SEQ ID NO: 1236069 - DNA, 22 bp, Artificial Sequence
  chemically synthesized
ttgtctcttcacttccaggtat

SEQ ID NO: 1236070 - DNA, 22 bp, Artificial Sequence
  chemically synthesized
ggaggctgttgtctcttcactt

SEQ ID NO: 1236071 - DNA, 22 bp, Artificial Sequence
  chemically synthesized
ttaggaggctgttgtctcttca

SEQ ID NO: 1236072 - DNA, 22 bp, Artificial Sequence
  chemically synthesized
tgttaggaggctgttgtctctt

SEQ ID NO: 1236073 - DNA, 22 bp, Artificial Sequence
  chemically synthesized
gaagtgaagagacaacagcctc

SEQ ID NO: 1236074 - DNA, 22 bp, Artificial Sequence
  chemically synthesized
gccctctgttaggaggctgttg

SEQ ID NO: 1236075 - DNA, 22 bp, Artificial Sequence
  chemically synthesized
tcctggccctctgttaggaggc

SEQ ID NO: 1236076 - DNA, 22 bp, Artificial Sequence
  chemically synthesized
gtcctggccctctgttaggagg

SEQ ID NO: 1236077 - DNA, 22 bp, Artificial Sequence
  chemically synthesized
atcttgtcctggccctctgtta

SEQ ID NO: 1236078 - DNA, 22 bp, Artificial Sequence
  chemically synthesized
ctcatcttgtcctggccctctg

SEQ ID NO: 1236079 - DNA, 22 bp, Artificial Sequence
  chemically synthesized
actcatcttgtcctggccctct

SEQ ID NO: 1236080 - DNA, 22 bp, Artificial Sequence
  chemically synthesized
tggcttactcatcttgtcctgg

SEQ ID NO: 1236081 - DNA, 22 bp, Artificial Sequence
  chemically synthesized
ctaacagagggccaggacaaga

SEQ ID NO: 1236082 - DNA, 22 bp, Artificial Sequence
  chemically synthesized
acagagggccaggacaagatga

SEQ ID NO: 1236083 - DNA, 22 bp, Artificial Sequence
  chemically synthesized
aaagattatggcttactcatct

SEQ ID NO: 1236084 - DNA, 22 bp, Artificial Sequence
  chemically synthesized
caaagattatggcttactcatc

SEQ ID NO: 1236085 - DNA, 22 bp, Artificial Sequence
  chemically synthesized
tcaaagattatggcttactcat

SEQ ID NO: 1236086 - DNA, 22 bp, Artificial Sequence
  chemically synthesized
gtgaaaaatctttcaaagatta

SEQ ID NO: 1236087 - DNA, 22 bp, Artificial Sequence
  chemically synthesized
caaatgttcgtgaaaaatcttt

SEQ ID NO: 1236088 - DNA, 22 bp, Artificial Sequence
  chemically synthesized
ccaaatgttcgtgaaaaatctt

SEQ ID NO: 1236089 - DNA, 22 bp, Artificial Sequence
  chemically synthesized
tgaaagatttttcacgaacatt

SEQ ID NO: 1236090 - DNA, 22 bp, Artificial Sequence
  chemically synthesized
gaaagatttttcacgaacattt

SEQ ID NO: 1236091 - DNA, 22 bp, Artificial Sequence
  chemically synthesized
aaagatttttcacgaacatttg

SEQ ID NO: 1236092 - DNA, 22 bp, Artificial Sequence
  chemically synthesized
ttcacgaacatttggaagacac

SEQ ID NO: 1236093 - DNA, 22 bp, Artificial Sequence
  chemically synthesized
tcacgaacatttggaagacact

SEQ ID NO: 1236094 - DNA, 22 bp, Artificial Sequence
  chemically synthesized
cacgaacatttggaagacactg

SEQ ID NO: 1236095 - DNA, 22 bp, Artificial Sequence
  chemically synthesized
acgaacatttggaagacactgg

SEQ ID NO: 1236096 - DNA, 22 bp, Artificial Sequence
  chemically synthesized
ccgaatacagaagtcccagtgt

SEQ ID NO: 1236097 - DNA, 22 bp, Artificial Sequence
  chemically synthesized
ttaccgaatacagaagtcccag

SEQ ID NO: 1236098 - DNA, 22 bp, Artificial Sequence
  chemically synthesized
gttaccgaatacagaagtccca

SEQ ID NO: 1236099 - DNA, 22 bp, Artificial Sequence
  chemically synthesized
tgttaccgaatacagaagtccc

SEQ ID NO: 1236100 - DNA, 22 bp, Artificial Sequence
  chemically synthesized
ggaagacactgggacttctgta

SEQ ID NO: 1236101 - DNA, 22 bp, Artificial Sequence
  chemically synthesized
gaagacactgggacttctgtat

SEQ ID NO: 1236102 - DNA, 22 bp, Artificial Sequence
  chemically synthesized
ctttgttaccgaatacagaagt

SEQ ID NO: 1236103 - DNA, 22 bp, Artificial Sequence
  chemically synthesized
ggacttctgtattcggtaacaa

SEQ ID NO: 1236104 - DNA, 22 bp, Artificial Sequence
  chemically synthesized
aagtcagtcctactttgttacc

SEQ ID NO: 1236105 - DNA, 22 bp, Artificial Sequence
  chemically synthesized
tgaagtcagtcctactttgtta

SEQ ID NO: 1236106 - DNA, 22 bp, Artificial Sequence
  chemically synthesized
ctgtattcggtaacaaagtagg

SEQ ID NO: 1236107 - DNA, 22 bp, Artificial Sequence
  chemically synthesized
tgtattcggtaacaaagtagga

SEQ ID NO: 1236108 - DNA, 22 bp, Artificial Sequence
  chemically synthesized
tattcggtaacaaagtaggact

SEQ ID NO: 1236109 - DNA, 22 bp, Artificial Sequence
  chemically synthesized
tattctgaagtcagtcctactt

SEQ ID NO: 1236110 - DNA, 22 bp, Artificial Sequence
  chemically synthesized
ctgtattctgaagtcagtccta

SEQ ID NO: 1236111 - DNA, 22 bp, Artificial Sequence
  chemically synthesized
ggtaacaaagtaggactgactt

SEQ ID NO: 1236112 - DNA, 22 bp, Artificial Sequence
  chemically synthesized
tcctgtattctgaagtcagtcc

SEQ ID NO: 1236113 - DNA, 22 bp, Artificial Sequence
  chemically synthesized
ctcctgtattctgaagtcagtc

SEQ ID NO: 1236114 - DNA, 22 bp, Artificial Sequence
  chemically synthesized
gtttctcctgtattctgaagtc

SEQ ID NO: 1236115 - DNA, 22 bp, Artificial Sequence
  chemically synthesized
tgtatctcgtttctcctgtatt

SEQ ID NO: 1236116 - DNA, 22 bp, Artificial Sequence
  chemically synthesized
acttcagaatacaggagaaacg

SEQ ID NO: 1236117 - DNA, 22 bp, Artificial Sequence
  chemically synthesized
cagaatacaggagaaacgagat

SEQ ID NO: 1236118 - DNA, 22 bp, Artificial Sequence
  chemically synthesized
agaatacaggagaaacgagata

SEQ ID NO: 1236119 - DNA, 22 bp, Artificial Sequence
  chemically synthesized
atttctgtacatatgctacgta

SEQ ID NO: 1236120 - DNA, 22 bp, Artificial Sequence
  chemically synthesized
catatatatggatacgtagcat

SEQ ID NO: 1236121 - DNA, 22 bp, Artificial Sequence
  chemically synthesized
acatatatatggatacgtagca

SEQ ID NO: 1236122 - DNA, 22 bp, Artificial Sequence
  chemically synthesized
ctgtacatatgctacgtatcca

SEQ ID NO: 1236123 - DNA, 22 bp, Artificial Sequence
  chemically synthesized
tgtacatatgctacgtatccat

SEQ ID NO: 1236124 - DNA, 22 bp, Artificial Sequence
  chemically synthesized
tacatatgctacgtatccatat

SEQ ID NO: 1236125 - DNA, 22 bp, Artificial Sequence
  chemically synthesized
tgaacaatttacatatatatgg

SEQ ID NO: 1236126 - DNA, 22 bp, Artificial Sequence
  chemically synthesized
tgactgtgaacaatttacatat

SEQ ID NO: 1236127 - DNA, 22 bp, Artificial Sequence
  chemically synthesized
cgtatccatatatatgtaaatt

SEQ ID NO: 1236128 - DNA, 22 bp, Artificial Sequence
  chemically synthesized
ctatgactgtgaacaatttaca

SEQ ID NO: 1236129 - DNA, 22 bp, Artificial Sequence
  chemically synthesized
atctcctatgactgtgaacaat

SEQ ID NO: 1236130 - DNA, 22 bp, Artificial Sequence
  chemically synthesized
tgtgtaattcatctcctatgac

SEQ ID NO: 1236131 - DNA, 22 bp, Artificial Sequence
  chemically synthesized
gtgtgtaattcatctcctatga

SEQ ID NO: 1236132 - DNA, 22 bp, Artificial Sequence
  chemically synthesized
ttcacagtcataggagatgaat

SEQ ID NO: 1236133 - DNA, 22 bp, Artificial Sequence
  chemically synthesized
acagtcataggagatgaattac

SEQ ID NO: 1236134 - DNA, 22 bp, Artificial Sequence
  chemically synthesized
gagatagatttgtgtgtaattc

SEQ ID NO: 1236135 - DNA, 22 bp, Artificial Sequence
  chemically synthesized
gttagagatagatttgtgtgta

SEQ ID NO: 1236136 - DNA, 22 bp, Artificial Sequence
  chemically synthesized
actagttagagatagatttgtg

SEQ ID NO: 1236137 - DNA, 22 bp, Artificial Sequence
  chemically synthesized
cactagttagagatagatttgt

SEQ ID NO: 1236138 - DNA, 22 bp, Artificial Sequence
  chemically synthesized
atttcactagttagagatagat

SEQ ID NO: 1236139 - DNA, 22 bp, Artificial Sequence
  chemically synthesized
aatttcactagttagagataga

SEQ ID NO: 1236140 - DNA, 22 bp, Artificial Sequence
  chemically synthesized
cacacaaatctatctctaacta

SEQ ID NO: 1236141 - DNA, 22 bp, Artificial Sequence
  chemically synthesized
gtcttaatttcactagttagag

SEQ ID NO: 1236142 - DNA, 22 bp, Artificial Sequence
  chemically synthesized
ggtcttaatttcactagttaga

SEQ ID NO: 1236143 - DNA, 22 bp, Artificial Sequence
  chemically synthesized
tctctaactagtgaaattaaga

SEQ ID NO: 1236144 - DNA, 22 bp, Artificial Sequence
  chemically synthesized
taactagtgaaattaagaccaa

SEQ ID NO: 1236145 - DNA, 22 bp, Artificial Sequence
  chemically synthesized
actagtgaaattaagaccaagt

SEQ ID NO: 1236146 - DNA, 22 bp, Artificial Sequence
  chemically synthesized
aggtcatcatgtaaacttggtc

SEQ ID NO: 1236147 - DNA, 22 bp, Artificial Sequence
  chemically synthesized
gaggtcatcatgtaaacttggt

SEQ ID NO: 1236148 - DNA, 22 bp, Artificial Sequence
  chemically synthesized
gtgaaattaagaccaagtttac

SEQ ID NO: 1236149 - DNA, 22 bp, Artificial Sequence
  chemically synthesized
agaccaagtttacatgatgacc

SEQ ID NO: 1236150 - DNA, 22 bp, Artificial Sequence
  chemically synthesized
ggcgccaatttgaggtcatcat

SEQ ID NO: 1236151 - DNA, 22 bp, Artificial Sequence
  chemically synthesized
ctgggcgccaatttgaggtcat

SEQ ID NO: 1236152 - DNA, 22 bp, Artificial Sequence
  chemically synthesized
gctgggcgccaatttgaggtca

SEQ ID NO: 1236153 - DNA, 22 bp, Artificial Sequence
  chemically synthesized
tttgctgggcgccaatttgagg

SEQ ID NO: 1236154 - DNA, 22 bp, Artificial Sequence
  chemically synthesized
acatgatgacctcaaattggcg

SEQ ID NO: 1236155 - DNA, 22 bp, Artificial Sequence
  chemically synthesized
catgatgacctcaaattggcgc

SEQ ID NO: 1236156 - DNA, 22 bp, Artificial Sequence
  chemically synthesized
aactgtttgctgggcgccaatt

SEQ ID NO: 1236157 - DNA, 22 bp, Artificial Sequence
  chemically synthesized
tagctgaactgtttgctgggcg

SEQ ID NO: 1236158 - DNA, 22 bp, Artificial Sequence
  chemically synthesized
atagctgaactgtttgctgggc

SEQ ID NO: 1236159 - DNA, 22 bp, Artificial Sequence
  chemically synthesized
aaattggcgcccagcaaacagt

SEQ ID NO: 1236160 - DNA, 22 bp, Artificial Sequence
  chemically synthesized
ataccttatagctgaactgttt

SEQ ID NO: 1236161 - DNA, 22 bp, Artificial Sequence
  chemically synthesized
aataccttatagctgaactgtt

SEQ ID NO: 1236162 - DNA, 22 bp, Artificial Sequence
  chemically synthesized
gcgcccagcaaacagttcagct

SEQ ID NO: 1236163 - DNA, 22 bp, Artificial Sequence
  chemically synthesized
agctataaggtattaaatctga

SEQ ID NO: 1236164 - DNA, 22 bp, Artificial Sequence
  chemically synthesized
gtcaagggggaaaatcagattt

SEQ ID NO: 1236165 - DNA, 22 bp, Artificial Sequence
  chemically synthesized
agtcaagggggaaaatcagatt

SEQ ID NO: 1236166 - DNA, 22 bp, Artificial Sequence
  chemically synthesized
tagtcaagggggaaaatcagat

SEQ ID NO: 1236167 - DNA, 22 bp, Artificial Sequence
  chemically synthesized
taaggtattaaatctgattttc

SEQ ID NO: 1236168 - DNA, 22 bp, Artificial Sequence
  chemically synthesized
aatctgattttcccccttgact

SEQ ID NO: 1236169 - DNA, 22 bp, Artificial Sequence
  chemically synthesized
aaataataactttagtcaaggg

SEQ ID NO: 1236170 - DNA, 22 bp, Artificial Sequence
  chemically synthesized
attttcccccttgactaaagtt

SEQ ID NO: 1236171 - DNA, 22 bp, Artificial Sequence
  chemically synthesized
tcccccttgactaaagttatta

SEQ ID NO: 1236172 - DNA, 22 bp, Artificial Sequence
  chemically synthesized
cccccttgactaaagttattat

SEQ ID NO: 1236173 - DNA, 22 bp, Artificial Sequence
  chemically synthesized
ccccttgactaaagttattatt

SEQ ID NO: 1236174 - DNA, 22 bp, Artificial Sequence
  chemically synthesized
atgacatattgaaataataact

SEQ ID NO: 1236175 - DNA, 22 bp, Artificial Sequence
  chemically synthesized
gatgacatattgaaataataac

SEQ ID NO: 1236176 - DNA, 22 bp, Artificial Sequence
  chemically synthesized
gactaaagttattatttcaata

SEQ ID NO: 1236177 - DNA, 22 bp, Artificial Sequence
  chemically synthesized
actaaagttattatttcaatat

SEQ ID NO: 1236178 - DNA, 22 bp, Artificial Sequence
  chemically synthesized
aagttattatttcaatatgtca

SEQ ID NO: 1236179 - DNA, 22 bp, Artificial Sequence
  chemically synthesized
atagaagaacaacttgatgaca

SEQ ID NO: 1236180 - DNA, 22 bp, Artificial Sequence
  chemically synthesized
ttatttcaatatgtcatcaagt

SEQ ID NO: 1236181 - DNA, 22 bp, Artificial Sequence
  chemically synthesized
tttcaatatgtcatcaagttgt

SEQ ID NO: 1236182 - DNA, 22 bp, Artificial Sequence
  chemically synthesized
tactaatagaagaacaacttga

SEQ ID NO: 1236183 - DNA, 22 bp, Artificial Sequence
  chemically synthesized
gtactaatagaagaacaacttg

SEQ ID NO: 1236184 - DNA, 22 bp, Artificial Sequence
  chemically synthesized
caatatgtcatcaagttgttct

SEQ ID NO: 1236185 - DNA, 22 bp, Artificial Sequence
  chemically synthesized
aatatgtcatcaagttgttctt

SEQ ID NO: 1236186 - DNA, 22 bp, Artificial Sequence
  chemically synthesized
aacttgtactaatagaagaaca

SEQ ID NO: 1236187 - DNA, 22 bp, Artificial Sequence
  chemically synthesized
aagaagtctgaacttgtactaa

SEQ ID NO: 1236188 - DNA, 22 bp, Artificial Sequence
  chemically synthesized
caagaagtctgaacttgtacta

SEQ ID NO: 1236189 - DNA, 22 bp, Artificial Sequence
  chemically synthesized
tcaagaagtctgaacttgtact

SEQ ID NO: 1236190 - DNA, 22 bp, Artificial Sequence
  chemically synthesized
ttcaagaagtctgaacttgtac

SEQ ID NO: 1236191 - DNA, 22 bp, Artificial Sequence
  chemically synthesized
ttcttctattagtacaagttca

SEQ ID NO: 1236192 - DNA, 22 bp, Artificial Sequence
  chemically synthesized
tttcaagaagtctgaacttgta

SEQ ID NO: 1236193 - DNA, 22 bp, Artificial Sequence
  chemically synthesized
ttttcaagaagtctgaacttgt

SEQ ID NO: 1236194 - DNA, 22 bp, Artificial Sequence
  chemically synthesized
ttctattagtacaagttcagac

SEQ ID NO: 1236195 - DNA, 22 bp, Artificial Sequence
  chemically synthesized
ctattagtacaagttcagactt

SEQ ID NO: 1236196 - DNA, 22 bp, Artificial Sequence
  chemically synthesized
tattagtacaagttcagacttc

SEQ ID NO: 1236197 - DNA, 22 bp, Artificial Sequence
  chemically synthesized
ttagtacaagttcagacttctt

SEQ ID NO: 1236198 - DNA, 22 bp, Artificial Sequence
  chemically synthesized
gtacaagttcagacttcttgaa

SEQ ID NO: 1236199 - DNA, 22 bp, Artificial Sequence
  chemically synthesized
aaacggatccatttttttcaag

SEQ ID NO: 1236200 - DNA, 22 bp, Artificial Sequence
  chemically synthesized
agacttcttgaaaaaaatggat

SEQ ID NO: 1236201 - DNA, 22 bp, Artificial Sequence
  chemically synthesized
atactaaaacggatccattttt

SEQ ID NO: 1236202 - DNA, 22 bp, Artificial Sequence
  chemically synthesized
cttgaaaaaaatggatccgttt

SEQ ID NO: 1236203 - DNA, 22 bp, Artificial Sequence
  chemically synthesized
ttgaaaaaaatggatccgtttt

SEQ ID NO: 1236204 - DNA, 22 bp, Artificial Sequence
  chemically synthesized
gaaaaaaatggatccgttttag

SEQ ID NO: 1236205 - DNA, 22 bp, Artificial Sequence
  chemically synthesized
aaaaaaatggatccgttttagt

SEQ ID NO: 1236206 - DNA, 22 bp, Artificial Sequence
  chemically synthesized
tgtgagattaatactaaaacgg

SEQ ID NO: 1236207 - DNA, 22 bp, Artificial Sequence
  chemically synthesized
agctatgtgagattaatactaa

SEQ ID NO: 1236208 - DNA, 22 bp, Artificial Sequence
  chemically synthesized
cagctatgtgagattaatacta

SEQ ID NO: 1236209 - DNA, 22 bp, Artificial Sequence
  chemically synthesized
tcttcagctatgtgagattaat

SEQ ID NO: 1236210 - DNA, 22 bp, Artificial Sequence
  chemically synthesized
atcttcagctatgtgagattaa

SEQ ID NO: 1236211 - DNA, 22 bp, Artificial Sequence
  chemically synthesized
tatcttcagctatgtgagatta

SEQ ID NO: 1236212 - DNA, 22 bp, Artificial Sequence
  chemically synthesized
ttatcttcagctatgtgagatt

SEQ ID NO: 1236213 - DNA, 22 bp, Artificial Sequence
  chemically synthesized
tttatcttcagctatgtgagat

SEQ ID NO: 1236214 - DNA, 22 bp, Artificial Sequence
  chemically synthesized
tagtattaatctcacatagctg

SEQ ID NO: 1236215 - DNA, 22 bp, Artificial Sequence
  chemically synthesized
attttttatcttcagctatgtg

SEQ ID NO: 1236216 - DNA, 22 bp, Artificial Sequence
  chemically synthesized
agtattaatctcacatagctga

SEQ ID NO: 1236217 - DNA, 22 bp, Artificial Sequence
  chemically synthesized
cattttttatcttcagctatgt

SEQ ID NO: 1236218 - DNA, 22 bp, Artificial Sequence
  chemically synthesized
gtattaatctcacatagctgaa

SEQ ID NO: 1236219 - DNA, 22 bp, Artificial Sequence
  chemically synthesized
tcattttttatcttcagctatg

SEQ ID NO: 1236220 - DNA, 22 bp, Artificial Sequence
  chemically synthesized
tgctttcattttttatcttcag

SEQ ID NO: 1236221 - DNA, 22 bp, Artificial Sequence
  chemically synthesized
atctcacatagctgaagataaa

SEQ ID NO: 1236222 - DNA, 22 bp, Artificial Sequence
  chemically synthesized
acatagctgaagataaaaaatg

SEQ ID NO: 1236223 - DNA, 22 bp, Artificial Sequence
  chemically synthesized
aagataaaaaatgaaagcatag

SEQ ID NO: 1236224 - DNA, 22 bp, Artificial Sequence
  chemically synthesized
tacagaagagacatacctatgc

SEQ ID NO: 1236225 - DNA, 22 bp, Artificial Sequence
  chemically synthesized
aagtcctatacagaagagacat

SEQ ID NO: 1236226 - DNA, 22 bp, Artificial Sequence
  chemically synthesized
tgaagtcctatacagaagagac

SEQ ID NO: 1236227 - DNA, 22 bp, Artificial Sequence
  chemically synthesized
aattctgaagtcctatacagaa

SEQ ID NO: 1236228 - DNA, 22 bp, Artificial Sequence
  chemically synthesized
aattaaattctgaagtcctata

SEQ ID NO: 1236229 - DNA, 22 bp, Artificial Sequence
  chemically synthesized
ctcaattaaattctgaagtcct

SEQ ID NO: 1236230 - DNA, 22 bp, Artificial Sequence
  chemically synthesized
ttctgtataggacttcagaatt

SEQ ID NO: 1236231 - DNA, 22 bp, Artificial Sequence
  chemically synthesized
ctgtataggacttcagaattta

SEQ ID NO: 1236232 - DNA, 22 bp, Artificial Sequence
  chemically synthesized
tgtataggacttcagaatttaa

SEQ ID NO: 1236233 - DNA, 22 bp, Artificial Sequence
  chemically synthesized
tataggacttcagaatttaatt

SEQ ID NO: 1236234 - DNA, 22 bp, Artificial Sequence
  chemically synthesized
acatccctcctcaattaaattc

SEQ ID NO: 1236235 - DNA, 22 bp, Artificial Sequence
  chemically synthesized
cagaatttaattgaggagggat

SEQ ID NO: 1236236 - DNA, 22 bp, Artificial Sequence
  chemically synthesized
agaatttaattgaggagggatg

SEQ ID NO: 1236237 - DNA, 22 bp, Artificial Sequence
  chemically synthesized
gtgtatgtatgactgacatccc

SEQ ID NO: 1236238 - DNA, 22 bp, Artificial Sequence
  chemically synthesized
agtgtatgtatgactgacatcc

SEQ ID NO: 1236239 - DNA, 22 bp, Artificial Sequence
  chemically synthesized
tagtgtatgtatgactgacatc

SEQ ID NO: 1236240 - DNA, 22 bp, Artificial Sequence
  chemically synthesized
aattgaggagggatgtcagtca

SEQ ID NO: 1236241 - DNA, 22 bp, Artificial Sequence
  chemically synthesized
ttagtgtatgtatgactgacat

SEQ ID NO: 1236242 - DNA, 22 bp, Artificial Sequence
  chemically synthesized
attgaggagggatgtcagtcat

SEQ ID NO: 1236243 - DNA, 22 bp, Artificial Sequence
  chemically synthesized
tttttagtgtatgtatgactga

SEQ ID NO: 1236244 - DNA, 22 bp, Artificial Sequence
  chemically synthesized
gtttttagtgtatgtatgactg

SEQ ID NO: 1236245 - DNA, 22 bp, Artificial Sequence
  chemically synthesized
aggagggatgtcagtcatacat

SEQ ID NO: 1236246 - DNA, 22 bp, Artificial Sequence
  chemically synthesized
tcttgtttttagtgtatgtatg

SEQ ID NO: 1236247 - DNA, 22 bp, Artificial Sequence
  chemically synthesized
gtcttgtttttagtgtatgtat

SEQ ID NO: 1236248 - DNA, 22 bp, Artificial Sequence
  chemically synthesized
tgtcttgtttttagtgtatgta

SEQ ID NO: 1236249 - DNA, 22 bp, Artificial Sequence
  chemically synthesized
ttgtcttgtttttagtgtatgt

SEQ ID NO: 1236250 - DNA, 22 bp, Artificial Sequence
  chemically synthesized
cacagaaggcccatttttgtct

SEQ ID NO: 1236251 - DNA, 22 bp, Artificial Sequence
  chemically synthesized
aaaacaagacaaaaatgggcct

SEQ ID NO: 1236252 - DNA, 22 bp, Artificial Sequence
  chemically synthesized
ccaaattccacagaaggcccat

SEQ ID NO: 1236253 - DNA, 22 bp, Artificial Sequence
  chemically synthesized
cctcccaaattccacagaaggc

SEQ ID NO: 1236254 - DNA, 22 bp, Artificial Sequence
  chemically synthesized
ccctcccaaattccacagaagg

SEQ ID NO: 1236255 - DNA, 22 bp, Artificial Sequence
  chemically synthesized
tccctcccaaattccacagaag

SEQ ID NO: 1236256 - DNA, 22 bp, Artificial Sequence
  chemically synthesized
ttccctcccaaattccacagaa

SEQ ID NO: 1236257 - DNA, 22 bp, Artificial Sequence
  chemically synthesized
atttttccctcccaaattccac

SEQ ID NO: 1236258 - DNA, 22 bp, Artificial Sequence
  chemically synthesized
ctaatttttccctcccaaattc

SEQ ID NO: 1236259 - DNA, 22 bp, Artificial Sequence
  chemically synthesized
gctaatttttccctcccaaatt

SEQ ID NO: 1236260 - DNA, 22 bp, Artificial Sequence
  chemically synthesized
tgctaatttttccctcccaaat

SEQ ID NO: 1236261 - DNA, 22 bp, Artificial Sequence
  chemically synthesized
cctttgctaatttttccctccc

SEQ ID NO: 1236262 - DNA, 22 bp, Artificial Sequence
  chemically synthesized
ctgtggaatttgggagggaaaa

SEQ ID NO: 1236263 - DNA, 22 bp, Artificial Sequence
  chemically synthesized
tgtggaatttgggagggaaaaa

SEQ ID NO: 1236264 - DNA, 22 bp, Artificial Sequence
  chemically synthesized
tggaatttgggagggaaaaatt

SEQ ID NO: 1236265 - DNA, 22 bp, Artificial Sequence
  chemically synthesized
ccaaattacctttgctaatttt

SEQ ID NO: 1236266 - DNA, 22 bp, Artificial Sequence
  chemically synthesized
cccaaattacctttgctaattt

SEQ ID NO: 1236267 - DNA, 22 bp, Artificial Sequence
  chemically synthesized
tcccaaattacctttgctaatt

SEQ ID NO: 1236268 - DNA, 22 bp, Artificial Sequence
  chemically synthesized
ttcccaaattacctttgctaat

SEQ ID NO: 1236269 - DNA, 22 bp, Artificial Sequence
  chemically synthesized
gggagggaaaaattagcaaagg

SEQ ID NO: 1236270 - DNA, 22 bp, Artificial Sequence
  chemically synthesized
ggagggaaaaattagcaaaggt

SEQ ID NO: 1236271 - DNA, 22 bp, Artificial Sequence
  chemically synthesized
agtaaagcttttcccaaattac

SEQ ID NO: 1236272 - DNA, 22 bp, Artificial Sequence
  chemically synthesized
acctcagtaaagcttttcccaa

SEQ ID NO: 1236273 - DNA, 22 bp, Artificial Sequence
  chemically synthesized
gcaaaggtaatttgggaaaagc

SEQ ID NO: 1236274 - DNA, 22 bp, Artificial Sequence
  chemically synthesized
cacctcagtaaagcttttccca

SEQ ID NO: 1236275 - DNA, 22 bp, Artificial Sequence
  chemically synthesized
atttcacctcagtaaagctttt

SEQ ID NO: 1236276 - DNA, 22 bp, Artificial Sequence
  chemically synthesized
gatttcacctcagtaaagcttt

SEQ ID NO: 1236277 - DNA, 22 bp, Artificial Sequence
  chemically synthesized
gggaaaagctttactgaggtga

SEQ ID NO: 1236278 - DNA, 22 bp, Artificial Sequence
  chemically synthesized
ggaaaagctttactgaggtgaa

SEQ ID NO: 1236279 - DNA, 22 bp, Artificial Sequence
  chemically synthesized
ccagaaaccttgatttcacctc

SEQ ID NO: 1236280 - DNA, 22 bp, Artificial Sequence
  chemically synthesized
tctgccagaaaccttgatttca

SEQ ID NO: 1236281 - DNA, 22 bp, Artificial Sequence
  chemically synthesized
tactgaggtgaaatcaaggttt

SEQ ID NO: 1236282 - DNA, 22 bp, Artificial Sequence
  chemically synthesized
actgaggtgaaatcaaggtttc

SEQ ID NO: 1236283 - DNA, 22 bp, Artificial Sequence
  chemically synthesized
ctgaggtgaaatcaaggtttct

SEQ ID NO: 1236284 - DNA, 22 bp, Artificial Sequence
  chemically synthesized
aggtgaaatcaaggtttctggc

SEQ ID NO: 1236285 - DNA, 22 bp, Artificial Sequence
  chemically synthesized
ccccaactgtctgccagaaacc

SEQ ID NO: 1236286 - DNA, 22 bp, Artificial Sequence
  chemically synthesized
tctaccccaactgtctgccaga

SEQ ID NO: 1236287 - DNA, 22 bp, Artificial Sequence
  chemically synthesized
tgtctaccccaactgtctgcca

SEQ ID NO: 1236288 - DNA, 22 bp, Artificial Sequence
  chemically synthesized
ctgtctaccccaactgtctgcc

SEQ ID NO: 1236289 - DNA, 22 bp, Artificial Sequence
  chemically synthesized
tacttctgtctaccccaactgt

SEQ ID NO: 1236290 - DNA, 22 bp, Artificial Sequence
  chemically synthesized
gtacttctgtctaccccaactg

SEQ ID NO: 1236291 - DNA, 22 bp, Artificial Sequence
  chemically synthesized
tgtacttctgtctaccccaact

SEQ ID NO: 1236292 - DNA, 22 bp, Artificial Sequence
  chemically synthesized
ttgtacttctgtctaccccaac

SEQ ID NO: 1236293 - DNA, 22 bp, Artificial Sequence
  chemically synthesized
tttgtacttctgtctaccccaa

SEQ ID NO: 1236294 - DNA, 22 bp, Artificial Sequence
  chemically synthesized
ctggcagacagttggggtagac

SEQ ID NO: 1236295 - DNA, 22 bp, Artificial Sequence
  chemically synthesized
tggcagacagttggggtagaca

SEQ ID NO: 1236296 - DNA, 22 bp, Artificial Sequence
  chemically synthesized
tttttgtacttctgtctacccc

SEQ ID NO: 1236297 - DNA, 22 bp, Artificial Sequence
  chemically synthesized
ctttttgtacttctgtctaccc

SEQ ID NO: 1236298 - DNA, 22 bp, Artificial Sequence
  chemically synthesized
gcagacagttggggtagacaga

SEQ ID NO: 1236299 - DNA, 22 bp, Artificial Sequence
  chemically synthesized
tatttctttttgtacttctgtc

SEQ ID NO: 1236300 - DNA, 22 bp, Artificial Sequence
  chemically synthesized
cctgtatttctttttgtacttc

SEQ ID NO: 1236301 - DNA, 22 bp, Artificial Sequence
  chemically synthesized
gcctgtatttctttttgtactt

SEQ ID NO: 1236302 - DNA, 22 bp, Artificial Sequence
  chemically synthesized
gggtagacagaagtacaaaaag

SEQ ID NO: 1236303 - DNA, 22 bp, Artificial Sequence
  chemically synthesized
cttgcctgtatttctttttgta

SEQ ID NO: 1236304 - DNA, 22 bp, Artificial Sequence
  chemically synthesized
acttgcctgtatttctttttgt

SEQ ID NO: 1236305 - DNA, 22 bp, Artificial Sequence
  chemically synthesized
tacttgcctgtatttctttttg

SEQ ID NO: 1236306 - DNA, 22 bp, Artificial Sequence
  chemically synthesized
ttttacttgcctgtatttcttt

SEQ ID NO: 1236307 - DNA, 22 bp, Artificial Sequence
  chemically synthesized
tattattttacttgcctgtatt

SEQ ID NO: 1236308 - DNA, 22 bp, Artificial Sequence
  chemically synthesized
cctgtattattttacttgcctg

SEQ ID NO: 1236309 - DNA, 22 bp, Artificial Sequence
  chemically synthesized
gcctgtattattttacttgcct

SEQ ID NO: 1236310 - DNA, 22 bp, Artificial Sequence
  chemically synthesized
tgcctgtattattttacttgcc

SEQ ID NO: 1236311 - DNA, 22 bp, Artificial Sequence
  chemically synthesized
ttgcctgtattattttacttgc

SEQ ID NO: 1236312 - DNA, 22 bp, Artificial Sequence
  chemically synthesized
ggtttttgcctgtattatttta

SEQ ID NO: 1236313 - DNA, 22 bp, Artificial Sequence
  chemically synthesized
tgggtttttgcctgtattattt

SEQ ID NO: 1236314 - DNA, 22 bp, Artificial Sequence
  chemically synthesized
tcagatatctctgggtttttgc

SEQ ID NO: 1236315 - DNA, 22 bp, Artificial Sequence
  chemically synthesized
ggtatatattgtcagatatctc

SEQ ID NO: 1236316 - DNA, 22 bp, Artificial Sequence
  chemically synthesized
tcggtatatattgtcagatatc

SEQ ID NO: 1236317 - DNA, 22 bp, Artificial Sequence
  chemically synthesized
ctcggtatatattgtcagatat

SEQ ID NO: 1236318 - DNA, 22 bp, Artificial Sequence
  chemically synthesized
tctcggtatatattgtcagata

SEQ ID NO: 1236319 - DNA, 22 bp, Artificial Sequence
  chemically synthesized
ttctcggtatatattgtcagat

SEQ ID NO: 1236320 - DNA, 22 bp, Artificial Sequence
  chemically synthesized
ttttctcggtatatattgtcag

SEQ ID NO: 1236321 - DNA, 22 bp, Artificial Sequence
  chemically synthesized
agccactcttttctcggtatat

SEQ ID NO: 1236322 - DNA, 22 bp, Artificial Sequence
  chemically synthesized
acgctaagccactcttttctcg

SEQ ID NO: 1236323 - DNA, 22 bp, Artificial Sequence
  chemically synthesized
acaatatataccgagaaaagag

SEQ ID NO: 1236324 - DNA, 22 bp, Artificial Sequence
  chemically synthesized
aacgctaagccactcttttctc

SEQ ID NO: 1236325 - DNA, 22 bp, Artificial Sequence
  chemically synthesized
taacacttaacgctaagccact

SEQ ID NO: 1236326 - DNA, 22 bp, Artificial Sequence
  chemically synthesized
ctgtaacacttaacgctaagcc

SEQ ID NO: 1236327 - DNA, 22 bp, Artificial Sequence
  chemically synthesized
cctcctgtaacacttaacgcta

SEQ ID NO: 1236328 - DNA, 22 bp, Artificial Sequence
  chemically synthesized
ccccagcctgcctcctgtaaca

SEQ ID NO: 1236329 - DNA, 22 bp, Artificial Sequence
  chemically synthesized
agcgttaagtgttacaggaggc

SEQ ID NO: 1236330 - DNA, 22 bp, Artificial Sequence
  chemically synthesized
gcgttaagtgttacaggaggca

SEQ ID NO: 1236331 - DNA, 22 bp, Artificial Sequence
  chemically synthesized
tctaccccagcctgcctcctgt

SEQ ID NO: 1236332 - DNA, 22 bp, Artificial Sequence
  chemically synthesized
agtgttacaggaggcaggctgg

SEQ ID NO: 1236333 - DNA, 22 bp, Artificial Sequence
  chemically synthesized
gcaaaaatcctatctaccccag

SEQ ID NO: 1236334 - DNA, 22 bp, Artificial Sequence
  chemically synthesized
caggaggcaggctggggtagat

SEQ ID NO: 1236335 - DNA, 22 bp, Artificial Sequence
  chemically synthesized
aaagtcagttagcaaaaatcct

SEQ ID NO: 1236336 - DNA, 22 bp, Artificial Sequence
  chemically synthesized
gggtagataggatttttgctaa

SEQ ID NO: 1236337 - DNA, 22 bp, Artificial Sequence
  chemically synthesized
tcgttcaaagtcagttagcaaa

SEQ ID NO: 1236338 - DNA, 22 bp, Artificial Sequence
  chemically synthesized
aagctgtcgttcaaagtcagtt

SEQ ID NO: 1236339 - DNA, 22 bp, Artificial Sequence
  chemically synthesized
ttgctaactgactttgaacgac

SEQ ID NO: 1236340 - DNA, 22 bp, Artificial Sequence
  chemically synthesized
tgctaactgactttgaacgaca

SEQ ID NO: 1236341 - DNA, 22 bp, Artificial Sequence
  chemically synthesized
gctaactgactttgaacgacag

SEQ ID NO: 1236342 - DNA, 22 bp, Artificial Sequence
  chemically synthesized
tacaaactgaagctgtcgttca

SEQ ID NO: 1236343 - DNA, 22 bp, Artificial Sequence
  chemically synthesized
ctaactgactttgaacgacagc

SEQ ID NO: 1236344 - DNA, 22 bp, Artificial Sequence
  chemically synthesized
actgactttgaacgacagcttc

SEQ ID NO: 1236345 - DNA, 22 bp, Artificial Sequence
  chemically synthesized
actttgaacgacagcttcagtt

SEQ ID NO: 1236346 - DNA, 22 bp, Artificial Sequence
  chemically synthesized
tcatattatacaaactgaagct

SEQ ID NO: 1236347 - DNA, 22 bp, Artificial Sequence
  chemically synthesized
gtcatattatacaaactgaagc

SEQ ID NO: 1236348 - DNA, 22 bp, Artificial Sequence
  chemically synthesized
tgtcatattatacaaactgaag

SEQ ID NO: 1236349 - DNA, 22 bp, Artificial Sequence
  chemically synthesized
tgaacgacagcttcagtttgta

SEQ ID NO: 1236350 - DNA, 22 bp, Artificial Sequence
  chemically synthesized
gaacgacagcttcagtttgtat

SEQ ID NO: 1236351 - DNA, 22 bp, Artificial Sequence
  chemically synthesized
aacgacagcttcagtttgtata

SEQ ID NO: 1236352 - DNA, 22 bp, Artificial Sequence
  chemically synthesized
cagtttgtataatatgacaaaa

SEQ ID NO: 1236353 - DNA, 22 bp, Artificial Sequence
  chemically synthesized
agtttgtataatatgacaaaat

SEQ ID NO: 1236354 - DNA, 22 bp, Artificial Sequence
  chemically synthesized
gtataatatgacaaaatctgtg

SEQ ID NO: 1236355 - DNA, 22 bp, Artificial Sequence
  chemically synthesized
tataatatgacaaaatctgtgt

SEQ ID NO: 1236356 - DNA, 22 bp, Artificial Sequence
  chemically synthesized
cccagcacatgcacatacacac

SEQ ID NO: 1236357 - DNA, 22 bp, Artificial Sequence
  chemically synthesized
tgtgtgtctgtgtgtgtatgtg

SEQ ID NO: 1236358 - DNA, 22 bp, Artificial Sequence
  chemically synthesized
caactccccagcacatgcacat

SEQ ID NO: 1236359 - DNA, 22 bp, Artificial Sequence
  chemically synthesized
attacaactccccagcacatgc

SEQ ID NO: 1236360 - DNA, 22 bp, Artificial Sequence
  chemically synthesized
tgtgtgtatgtgcatgtgctgg

SEQ ID NO: 1236361 - DNA, 22 bp, Artificial Sequence
  chemically synthesized
cattacaactccccagcacatg

SEQ ID NO: 1236362 - DNA, 22 bp, Artificial Sequence
  chemically synthesized
cccttcattacaactccccagc

SEQ ID NO: 1236363 - DNA, 22 bp, Artificial Sequence
  chemically synthesized
gcccttcattacaactccccag

SEQ ID NO: 1236364 - DNA, 22 bp, Artificial Sequence
  chemically synthesized
tgcccttcattacaactcccca

SEQ ID NO: 1236365 - DNA, 22 bp, Artificial Sequence
  chemically synthesized
tctttgcccttcattacaactc

SEQ ID NO: 1236366 - DNA, 22 bp, Artificial Sequence
  chemically synthesized
atctttgcccttcattacaact

SEQ ID NO: 1236367 - DNA, 22 bp, Artificial Sequence
  chemically synthesized
ttatctttgcccttcattacaa

SEQ ID NO: 1236368 - DNA, 22 bp, Artificial Sequence
  chemically synthesized
gtctcttatctttgcccttcat

SEQ ID NO: 1236369 - DNA, 22 bp, Artificial Sequence
  chemically synthesized
cgtctcttatctttgcccttca

SEQ ID NO: 1236370 - DNA, 22 bp, Artificial Sequence
  chemically synthesized
gggagttgtaatgaagggcaaa

SEQ ID NO: 1236371 - DNA, 22 bp, Artificial Sequence
  chemically synthesized
taatgaagggcaaagataagag

SEQ ID NO: 1236372 - DNA, 22 bp, Artificial Sequence
  chemically synthesized
aatcatagccttcgtctcttat

SEQ ID NO: 1236373 - DNA, 22 bp, Artificial Sequence
  chemically synthesized
ctaaatcatagccttcgtctct

SEQ ID NO: 1236374 - DNA, 22 bp, Artificial Sequence
  chemically synthesized
tgctaaatcatagccttcgtct

SEQ ID NO: 1236375 - DNA, 22 bp, Artificial Sequence
  chemically synthesized
tcaaattctgctaaatcatagc

SEQ ID NO: 1236376 - DNA, 22 bp, Artificial Sequence
  chemically synthesized
cctatcaaattctgctaaatca

SEQ ID NO: 1236377 - DNA, 22 bp, Artificial Sequence
  chemically synthesized
tacctatcaaattctgctaaat

SEQ ID NO: 1236378 - DNA, 22 bp, Artificial Sequence
  chemically synthesized
ttctacctatcaaattctgcta

SEQ ID NO: 1236379 - DNA, 22 bp, Artificial Sequence
  chemically synthesized
tgatttagcagaatttgatagg

SEQ ID NO: 1236380 - DNA, 22 bp, Artificial Sequence
  chemically synthesized
agcagaatttgataggtagaac

SEQ ID NO: 1236381 - DNA, 22 bp, Artificial Sequence
  chemically synthesized
gcagaatttgataggtagaaca

SEQ ID NO: 1236382 - DNA, 22 bp, Artificial Sequence
  chemically synthesized
tagtcataaataactgttctac

SEQ ID NO: 1236383 - DNA, 22 bp, Artificial Sequence
  chemically synthesized
gataggtagaacagttatttat

SEQ ID NO: 1236384 - DNA, 22 bp, Artificial Sequence
  chemically synthesized
ataggtagaacagttatttatg

SEQ ID NO: 1236385 - DNA, 22 bp, Artificial Sequence
  chemically synthesized
agcccccagtctatagtcataa

SEQ ID NO: 1236386 - DNA, 22 bp, Artificial Sequence
  chemically synthesized
aagcccccagtctatagtcata

SEQ ID NO: 1236387 - DNA, 22 bp, Artificial Sequence
  chemically synthesized
tttatgactatagactgggggc

SEQ ID NO: 1236388 - DNA, 22 bp, Artificial Sequence
  chemically synthesized
atgactatagactgggggctta

SEQ ID NO: 1236389 - DNA, 22 bp, Artificial Sequence
  chemically synthesized
aaaagtagagtttaagccccca

SEQ ID NO: 1236390 - DNA, 22 bp, Artificial Sequence
  chemically synthesized
tgactatagactgggggcttaa

SEQ ID NO: 1236391 - DNA, 22 bp, Artificial Sequence
  chemically synthesized
taaaaagtagagtttaagcccc

SEQ ID NO: 1236392 - DNA, 22 bp, Artificial Sequence
  chemically synthesized
ttctaaaaagtagagtttaagc

SEQ ID NO: 1236393 - DNA, 22 bp, Artificial Sequence
  chemically synthesized
tagactgggggcttaaactcta

SEQ ID NO: 1236394 - DNA, 22 bp, Artificial Sequence
  chemically synthesized
ctattctaaaaagtagagttta

SEQ ID NO: 1236395 - DNA, 22 bp, Artificial Sequence
  chemically synthesized
gattgctattctaaaaagtaga

SEQ ID NO: 1236396 - DNA, 22 bp, Artificial Sequence
  chemically synthesized
ggggcttaaactctacttttta

SEQ ID NO: 1236397 - DNA, 22 bp, Artificial Sequence
  chemically synthesized
agattgctattctaaaaagtag

SEQ ID NO: 1236398 - DNA, 22 bp, Artificial Sequence
  chemically synthesized
aaactctactttttagaatagc

SEQ ID NO: 1236399 - DNA, 22 bp, Artificial Sequence
  chemically synthesized
aactctactttttagaatagca

SEQ ID NO: 1236400 - DNA, 22 bp, Artificial Sequence
  chemically synthesized
tactttttagaatagcaatcta

SEQ ID NO: 1236401 - DNA, 22 bp, Artificial Sequence
  chemically synthesized
aaataatcgtcttagattgcta

SEQ ID NO: 1236402 - DNA, 22 bp, Artificial Sequence
  chemically synthesized
ctttttagaatagcaatctaag

SEQ ID NO: 1236403 - DNA, 22 bp, Artificial Sequence
  chemically synthesized
actgaaataatcgtcttagatt

SEQ ID NO: 1236404 - DNA, 22 bp, Artificial Sequence
  chemically synthesized
tttagaatagcaatctaagacg

SEQ ID NO: 1236405 - DNA, 22 bp, Artificial Sequence
  chemically synthesized
ttagaatagcaatctaagacga

SEQ ID NO: 1236406 - DNA, 22 bp, Artificial Sequence
  chemically synthesized
tagaatagcaatctaagacgat

SEQ ID NO: 1236407 - DNA, 22 bp, Artificial Sequence
  chemically synthesized
agaatagcaatctaagacgatt

SEQ ID NO: 1236408 - DNA, 22 bp, Artificial Sequence
  chemically synthesized
gaatagcaatctaagacgatta

SEQ ID NO: 1236409 - DNA, 22 bp, Artificial Sequence
  chemically synthesized
aaatcccctgactgaaataatc

SEQ ID NO: 1236410 - DNA, 22 bp, Artificial Sequence
  chemically synthesized
aaattgaaatcccctgactgaa

SEQ ID NO: 1236411 - DNA, 22 bp, Artificial Sequence
  chemically synthesized
agacgattatttcagtcagggg

SEQ ID NO: 1236412 - DNA, 22 bp, Artificial Sequence
  chemically synthesized
tttcagtcaggggatttcaatt

SEQ ID NO: 1236413 - DNA, 22 bp, Artificial Sequence
  chemically synthesized
cagtcaggggatttcaatttga

SEQ ID NO: 1236414 - DNA, 22 bp, Artificial Sequence
  chemically synthesized
agtcaggggatttcaatttgag

SEQ ID NO: 1236415 - DNA, 22 bp, Artificial Sequence
  chemically synthesized
gggggggaaagaactcaaattg

SEQ ID NO: 1236416 - DNA, 22 bp, Artificial Sequence
  chemically synthesized
cactggggggggaaagaactca

SEQ ID NO: 1236417 - DNA, 22 bp, Artificial Sequence
  chemically synthesized
acactggggggggaaagaactc

SEQ ID NO: 1236418 - DNA, 22 bp, Artificial Sequence
  chemically synthesized
caatttgagttctttccccccc

SEQ ID NO: 1236419 - DNA, 22 bp, Artificial Sequence
  chemically synthesized
aatttgagttctttcccccccc

SEQ ID NO: 1236420 - DNA, 22 bp, Artificial Sequence
  chemically synthesized
atcaaggtcttacactgggggg

SEQ ID NO: 1236421 - DNA, 22 bp, Artificial Sequence
  chemically synthesized
gagttctttccccccccagtgt

SEQ ID NO: 1236422 - DNA, 22 bp, Artificial Sequence
  chemically synthesized
agttctttccccccccagtgta

SEQ ID NO: 1236423 - DNA, 22 bp, Artificial Sequence
  chemically synthesized
tttccccccccagtgtaagacc

SEQ ID NO: 1236424 - DNA, 22 bp, Artificial Sequence
  chemically synthesized
tccccccccagtgtaagacctt

SEQ ID NO: 1236425 - DNA, 22 bp, Artificial Sequence
  chemically synthesized
ccccccccagtgtaagaccttg

SEQ ID NO: 1236426 - DNA, 22 bp, Artificial Sequence
  chemically synthesized
cccccccagtgtaagaccttga

SEQ ID NO: 1236427 - DNA, 22 bp, Artificial Sequence
  chemically synthesized
cagatcagtgaagtcatgttga

SEQ ID NO: 1236428 - DNA, 22 bp, Artificial Sequence
  chemically synthesized
gatcaacatgacttcactgatc

SEQ ID NO: 1236429 - DNA, 22 bp, Artificial Sequence
  chemically synthesized
atcaacatgacttcactgatct

SEQ ID NO: 1236430 - DNA, 22 bp, Artificial Sequence
  chemically synthesized
atatacatgattacagatcagt

SEQ ID NO: 1236431 - DNA, 22 bp, Artificial Sequence
  chemically synthesized
cactgatctgtaatcatgtata

SEQ ID NO: 1236432 - DNA, 22 bp, Artificial Sequence
  chemically synthesized
actgatctgtaatcatgtatat

SEQ ID NO: 1236433 - DNA, 22 bp, Artificial Sequence
  chemically synthesized
atctgtaatcatgtatatcaat

SEQ ID NO: 1236434 - DNA, 22 bp, Artificial Sequence
  chemically synthesized
tgaagatacatgattgatatac

SEQ ID NO: 1236435 - DNA, 22 bp, Artificial Sequence
  chemically synthesized
ctgtgaagatacatgattgata

SEQ ID NO: 1236436 - DNA, 22 bp, Artificial Sequence
  chemically synthesized
taatcatgtatatcaatcatgt

SEQ ID NO: 1236437 - DNA, 22 bp, Artificial Sequence
  chemically synthesized
agagcattcctgtgaagataca

SEQ ID NO: 1236438 - DNA, 22 bp, Artificial Sequence
  chemically synthesized
cagagcattcctgtgaagatac

SEQ ID NO: 1236439 - DNA, 22 bp, Artificial Sequence
  chemically synthesized
acttcagagcattcctgtgaag

SEQ ID NO: 1236440 - DNA, 22 bp, Artificial Sequence
  chemically synthesized
tctaacttcagagcattcctgt

SEQ ID NO: 1236441 - DNA, 22 bp, Artificial Sequence
  chemically synthesized
gtctaacttcagagcattcctg

SEQ ID NO: 1236442 - DNA, 22 bp, Artificial Sequence
  chemically synthesized
tcttgtctaacttcagagcatt

SEQ ID NO: 1236443 - DNA, 22 bp, Artificial Sequence
  chemically synthesized
ttatcttgtctaacttcagagc

SEQ ID NO: 1236444 - DNA, 22 bp, Artificial Sequence
  chemically synthesized
cacaggaatgctctgaagttag

SEQ ID NO: 1236445 - DNA, 22 bp, Artificial Sequence
  chemically synthesized
acaggaatgctctgaagttaga

SEQ ID NO: 1236446 - DNA, 22 bp, Artificial Sequence
  chemically synthesized
aactattatcttgtctaacttc

SEQ ID NO: 1236447 - DNA, 22 bp, Artificial Sequence
  chemically synthesized
gaactattatcttgtctaactt

SEQ ID NO: 1236448 - DNA, 22 bp, Artificial Sequence
  chemically synthesized
ttgaactattatcttgtctaac

SEQ ID NO: 1236449 - DNA, 22 bp, Artificial Sequence
  chemically synthesized
ctcttgaactattatcttgtct

SEQ ID NO: 1236450 - DNA, 22 bp, Artificial Sequence
  chemically synthesized
cctcttgaactattatcttgtc

SEQ ID NO: 1236451 - DNA, 22 bp, Artificial Sequence
  chemically synthesized
tgaagttagacaagataatagt

SEQ ID NO: 1236452 - DNA, 22 bp, Artificial Sequence
  chemically synthesized
aagttagacaagataatagttc

SEQ ID NO: 1236453 - DNA, 22 bp, Artificial Sequence
  chemically synthesized
gacaagataatagttcaagagg

SEQ ID NO: 1236454 - DNA, 22 bp, Artificial Sequence
  chemically synthesized
aagaggaagtgatattttcatc

SEQ ID NO: 1236455 - DNA, 22 bp, Artificial Sequence
  chemically synthesized
tagtgtaatacgtgatagcata

SEQ ID NO: 1236456 - DNA, 22 bp, Artificial Sequence
  chemically synthesized
tcatcacatatgctatcacgta

SEQ ID NO: 1236457 - DNA, 22 bp, Artificial Sequence
  chemically synthesized
catcacatatgctatcacgtat

SEQ ID NO: 1236458 - DNA, 22 bp, Artificial Sequence
  chemically synthesized
atcacatatgctatcacgtatt

SEQ ID NO: 1236459 - DNA, 22 bp, Artificial Sequence
  chemically synthesized
tcacgtattacactataatgcc

SEQ ID NO: 1236460 - DNA, 22 bp, Artificial Sequence
  chemically synthesized
cactataatgcctgtaccttat

SEQ ID NO: 1236461 - DNA, 22 bp, Artificial Sequence
  chemically synthesized
taatgcctgtaccttattttgc

SEQ ID NO: 1236462 - DNA, 22 bp, Artificial Sequence
  chemically synthesized
tacatgtgggatagcaaaataa

SEQ ID NO: 1236463 - DNA, 22 bp, Artificial Sequence
  chemically synthesized
atacatgtgggatagcaaaata

SEQ ID NO: 1236464 - DNA, 22 bp, Artificial Sequence
  chemically synthesized
taccttattttgctatcccaca

SEQ ID NO: 1236465 - DNA, 22 bp, Artificial Sequence
  chemically synthesized
tatgagtttatacatgtgggat

SEQ ID NO: 1236466 - DNA, 22 bp, Artificial Sequence
  chemically synthesized
attttgctatcccacatgtata

SEQ ID NO: 1236467 - DNA, 22 bp, Artificial Sequence
  chemically synthesized
ttttgctatcccacatgtataa

SEQ ID NO: 1236468 - DNA, 22 bp, Artificial Sequence
  chemically synthesized
tgctatcccacatgtataaact

SEQ ID NO: 1236469 - DNA, 22 bp, Artificial Sequence
  chemically synthesized
gctatcccacatgtataaactc

SEQ ID NO: 1236470 - DNA, 22 bp, Artificial Sequence
  chemically synthesized
ctatcccacatgtataaactca

SEQ ID NO: 1236471 - DNA, 22 bp, Artificial Sequence
  chemically synthesized
caaggaacctgtatgagtttat

SEQ ID NO: 1236472 - DNA, 22 bp, Artificial Sequence
  chemically synthesized
acaaggaacctgtatgagttta

SEQ ID NO: 1236473 - DNA, 22 bp, Artificial Sequence
  chemically synthesized
tcccacatgtataaactcatac

SEQ ID NO: 1236474 - DNA, 22 bp, Artificial Sequence
  chemically synthesized
tacaaggaacctgtatgagttt

SEQ ID NO: 1236475 - DNA, 22 bp, Artificial Sequence
  chemically synthesized
ttttacaaggaacctgtatgag

SEQ ID NO: 1236476 - DNA, 22 bp, Artificial Sequence
  chemically synthesized
aagttattttacaaggaacctg

SEQ ID NO: 1236477 - DNA, 22 bp, Artificial Sequence
  chemically synthesized
gaagttattttacaaggaacct

SEQ ID NO: 1236478 - DNA, 22 bp, Artificial Sequence
  chemically synthesized
tgaagttattttacaaggaacc

SEQ ID NO: 1236479 - DNA, 22 bp, Artificial Sequence
  chemically synthesized
ttgaagttattttacaaggaac

SEQ ID NO: 1236480 - DNA, 22 bp, Artificial Sequence
  chemically synthesized
atacaggttccttgtaaaataa

SEQ ID NO: 1236481 - DNA, 22 bp, Artificial Sequence
  chemically synthesized
tgtatttttgaagttattttac

SEQ ID NO: 1236482 - DNA, 22 bp, Artificial Sequence
  chemically synthesized
gtgtatttttgaagttatttta

SEQ ID NO: 1236483 - DNA, 22 bp, Artificial Sequence
  chemically synthesized
tgtgtatttttgaagttatttt

SEQ ID NO: 1236484 - DNA, 22 bp, Artificial Sequence
  chemically synthesized
ttgtgtatttttgaagttattt

SEQ ID NO: 1236485 - DNA, 22 bp, Artificial Sequence
  chemically synthesized
tacttttgtgtatttttgaagt

SEQ ID NO: 1236486 - DNA, 22 bp, Artificial Sequence
  chemically synthesized
cttgtaaaataacttcaaaaat

SEQ ID NO: 1236487 - DNA, 22 bp, Artificial Sequence
  chemically synthesized
gtacttttgtgtatttttgaag

SEQ ID NO: 1236488 - DNA, 22 bp, Artificial Sequence
  chemically synthesized
tgtacttttgtgtatttttgaa

SEQ ID NO: 1236489 - DNA, 22 bp, Artificial Sequence
  chemically synthesized
gtaaaataacttcaaaaataca

SEQ ID NO: 1236490 - DNA, 22 bp, Artificial Sequence
  chemically synthesized
taaaataacttcaaaaatacac

SEQ ID NO: 1236491 - DNA, 22 bp, Artificial Sequence
  chemically synthesized
tctttgtacttttgtgtatttt

SEQ ID NO: 1236492 - DNA, 22 bp, Artificial Sequence
  chemically synthesized
agaaattatctttgtacttttg

SEQ ID NO: 1236493 - DNA, 22 bp, Artificial Sequence
  chemically synthesized
gagaaattatctttgtactttt

SEQ ID NO: 1236494 - DNA, 22 bp, Artificial Sequence
  chemically synthesized
caaaaatacacaaaagtacaaa

SEQ ID NO: 1236495 - DNA, 22 bp, Artificial Sequence
  chemically synthesized
aaaaatacacaaaagtacaaag

SEQ ID NO: 1236496 - DNA, 22 bp, Artificial Sequence
  chemically synthesized
tacataatgacttgagaaatta

SEQ ID NO: 1236497 - DNA, 22 bp, Artificial Sequence
  chemically synthesized
atacataatgacttgagaaatt

SEQ ID NO: 1236498 - DNA, 22 bp, Artificial Sequence
  chemically synthesized
tatacataatgacttgagaaat

SEQ ID NO: 1236499 - DNA, 22 bp, Artificial Sequence
  chemically synthesized
ttatacataatgacttgagaaa

SEQ ID NO: 1236500 - DNA, 22 bp, Artificial Sequence
  chemically synthesized
atgaaggcttttatacataatg

SEQ ID NO: 1236501 - DNA, 22 bp, Artificial Sequence
  chemically synthesized
aatgaaggcttttatacataat

SEQ ID NO: 1236502 - DNA, 22 bp, Artificial Sequence
  chemically synthesized
ctcaagtcattatgtataaaag

SEQ ID NO: 1236503 - DNA, 22 bp, Artificial Sequence
  chemically synthesized
tcaagtcattatgtataaaagc

SEQ ID NO: 1236504 - DNA, 22 bp, Artificial Sequence
  chemically synthesized
aagtcattatgtataaaagcct

SEQ ID NO: 1236505 - DNA, 22 bp, Artificial Sequence
  chemically synthesized
tcaaatatcttaatgaaggctt

SEQ ID NO: 1236506 - DNA, 22 bp, Artificial Sequence
  chemically synthesized
atcaaatatcttaatgaaggct

SEQ ID NO: 1236507 - DNA, 22 bp, Artificial Sequence
  chemically synthesized
tgtataaaagccttcattaaga

SEQ ID NO: 1236508 - DNA, 22 bp, Artificial Sequence
  chemically synthesized
tcttatcaaatatcttaatgaa

SEQ ID NO: 1236509 - DNA, 22 bp, Artificial Sequence
  chemically synthesized
gtatctatcttatcaaatatct

SEQ ID NO: 1236510 - DNA, 22 bp, Artificial Sequence
  chemically synthesized
ggtatctatcttatcaaatatc

SEQ ID NO: 1236511 - DNA, 22 bp, Artificial Sequence
  chemically synthesized
cttggtatctatcttatcaaat

SEQ ID NO: 1236512 - DNA, 22 bp, Artificial Sequence
  chemically synthesized
cattaagatatttgataagata

SEQ ID NO: 1236513 - DNA, 22 bp, Artificial Sequence
  chemically synthesized
ctacttggtatctatcttatca

SEQ ID NO: 1236514 - DNA, 22 bp, Artificial Sequence
  chemically synthesized
attaagatatttgataagatag

SEQ ID NO: 1236515 - DNA, 22 bp, Artificial Sequence
  chemically synthesized
actacttggtatctatcttatc

SEQ ID NO: 1236516 - DNA, 22 bp, Artificial Sequence
  chemically synthesized
tactacttggtatctatcttat

SEQ ID NO: 1236517 - DNA, 22 bp, Artificial Sequence
  chemically synthesized
agatatttgataagatagatac

SEQ ID NO: 1236518 - DNA, 22 bp, Artificial Sequence
  chemically synthesized
agttttactacttggtatctat

SEQ ID NO: 1236519 - DNA, 22 bp, Artificial Sequence
  chemically synthesized
ttcagttttactacttggtatc

SEQ ID NO: 1236520 - DNA, 22 bp, Artificial Sequence
  chemically synthesized
gataagatagataccaagtagt

SEQ ID NO: 1236521 - DNA, 22 bp, Artificial Sequence
  chemically synthesized
ataagatagataccaagtagta

SEQ ID NO: 1236522 - DNA, 22 bp, Artificial Sequence
  chemically synthesized
atagatattattcagttttact

SEQ ID NO: 1236523 - DNA, 22 bp, Artificial Sequence
  chemically synthesized
tattaatagatattattcagtt

SEQ ID NO: 1236524 - DNA, 22 bp, Artificial Sequence
  chemically synthesized
atattaatagatattattcagt

SEQ ID NO: 1236525 - DNA, 22 bp, Artificial Sequence
  chemically synthesized
agtaatacaatttatattaata

SEQ ID NO: 1236526 - DNA, 22 bp, Artificial Sequence
  chemically synthesized
cagtaatacaatttatattaat

SEQ ID NO: 1236527 - DNA, 22 bp, Artificial Sequence
  chemically synthesized
aataatatctattaatataaat

SEQ ID NO: 1236528 - DNA, 22 bp, Artificial Sequence
  chemically synthesized
ttaatataaattgtattactga

SEQ ID NO: 1236529 - DNA, 22 bp, Artificial Sequence
  chemically synthesized
atataaattgtattactgaaat

SEQ ID NO: 1236530 - DNA, 22 bp, Artificial Sequence
  chemically synthesized
cagaaaaagtaaaaatttcagt

SEQ ID NO: 1236531 - DNA, 22 bp, Artificial Sequence
  chemically synthesized
ccgcctgcagaaaaagtaaaaa

SEQ ID NO: 1236532 - DNA, 22 bp, Artificial Sequence
  chemically synthesized
tattactgaaatttttactttt

SEQ ID NO: 1236533 - DNA, 22 bp, Artificial Sequence
  chemically synthesized
taccgcctgcagaaaaagtaaa

SEQ ID NO: 1236534 - DNA, 22 bp, Artificial Sequence
  chemically synthesized
ctgaaatttttactttttctgc

SEQ ID NO: 1236535 - DNA, 22 bp, Artificial Sequence
  chemically synthesized
aaatttttactttttctgcagg

SEQ ID NO: 1236536 - DNA, 22 bp, Artificial Sequence
  chemically synthesized
gcatactctaccgcctgcagaa

SEQ ID NO: 1236537 - DNA, 22 bp, Artificial Sequence
  chemically synthesized
ggcatactctaccgcctgcaga

SEQ ID NO: 1236538 - DNA, 22 bp, Artificial Sequence
  chemically synthesized
ttactttttctgcaggcggtag

SEQ ID NO: 1236539 - DNA, 22 bp, Artificial Sequence
  chemically synthesized
atttggcatactctaccgcctg

SEQ ID NO: 1236540 - DNA, 22 bp, Artificial Sequence
  chemically synthesized
tactttttctgcaggcggtaga

SEQ ID NO: 1236541 - DNA, 22 bp, Artificial Sequence
  chemically synthesized
catttggcatactctaccgcct

SEQ ID NO: 1236542 - DNA, 22 bp, Artificial Sequence
  chemically synthesized
actttttctgcaggcggtagag

SEQ ID NO: 1236543 - DNA, 22 bp, Artificial Sequence
  chemically synthesized
tcatttggcatactctaccgcc

SEQ ID NO: 1236544 - DNA, 22 bp, Artificial Sequence
  chemically synthesized
ctttttctgcaggcggtagagt

SEQ ID NO: 1236545 - DNA, 22 bp, Artificial Sequence
  chemically synthesized
tttctgcaggcggtagagtatg

SEQ ID NO: 1236546 - DNA, 22 bp, Artificial Sequence
  chemically synthesized
ttctgcaggcggtagagtatgc

SEQ ID NO: 1236547 - DNA, 22 bp, Artificial Sequence
  chemically synthesized
tctgcaggcggtagagtatgcc

SEQ ID NO: 1236548 - DNA, 22 bp, Artificial Sequence
  chemically synthesized
ctgcaggcggtagagtatgcca

SEQ ID NO: 1236549 - DNA, 22 bp, Artificial Sequence
  chemically synthesized
tgcaggcggtagagtatgccaa

SEQ ID NO: 1236550 - DNA, 22 bp, Artificial Sequence
  chemically synthesized
gtatgattttcatttggcatac

SEQ ID NO: 1236551 - DNA, 22 bp, Artificial Sequence
  chemically synthesized
caggcggtagagtatgccaaat

SEQ ID NO: 1236552 - DNA, 22 bp, Artificial Sequence
  chemically synthesized
gtaaagcaacctcgtatgattt

SEQ ID NO: 1236553 - DNA, 22 bp, Artificial Sequence
  chemically synthesized
agtaaagcaacctcgtatgatt

SEQ ID NO: 1236554 - DNA, 22 bp, Artificial Sequence
  chemically synthesized
cttagtaaagcaacctcgtatg

SEQ ID NO: 1236555 - DNA, 22 bp, Artificial Sequence
  chemically synthesized
ttccttagtaaagcaacctcgt

SEQ ID NO: 1236556 - DNA, 22 bp, Artificial Sequence
  chemically synthesized
aaacagcaatacctattcctta

SEQ ID NO: 1236557 - DNA, 22 bp, Artificial Sequence
  chemically synthesized
attgaaacagcaatacctattc

SEQ ID NO: 1236558 - DNA, 22 bp, Artificial Sequence
  chemically synthesized
ctttactaaggaataggtattg

SEQ ID NO: 1236559 - DNA, 22 bp, Artificial Sequence
  chemically synthesized
tactaaggaataggtattgctg

SEQ ID NO: 1236560 - DNA, 22 bp, Artificial Sequence
  chemically synthesized
actaaggaataggtattgctgt

SEQ ID NO: 1236561 - DNA, 22 bp, Artificial Sequence
  chemically synthesized
ctaaggaataggtattgctgtt

SEQ ID NO: 1236562 - DNA, 22 bp, Artificial Sequence
  chemically synthesized
ggtactgattgaaacagcaata

SEQ ID NO: 1236563 - DNA, 22 bp, Artificial Sequence
  chemically synthesized
aggaataggtattgctgtttca

SEQ ID NO: 1236564 - DNA, 22 bp, Artificial Sequence
  chemically synthesized
gtagaatgactaggtactgatt

SEQ ID NO: 1236565 - DNA, 22 bp, Artificial Sequence
  chemically synthesized
ctgtttcaatcagtacctagtc

SEQ ID NO: 1236566 - DNA, 22 bp, Artificial Sequence
  chemically synthesized
tttcaatcagtacctagtcatt

SEQ ID NO: 1236567 - DNA, 22 bp, Artificial Sequence
  chemically synthesized
tgacatctagtagaatgactag

SEQ ID NO: 1236568 - DNA, 22 bp, Artificial Sequence
  chemically synthesized
atgacatctagtagaatgacta

SEQ ID NO: 1236569 - DNA, 22 bp, Artificial Sequence
  chemically synthesized
caatcagtacctagtcattcta

SEQ ID NO: 1236570 - DNA, 22 bp, Artificial Sequence
  chemically synthesized
tatgacatctagtagaatgact

SEQ ID NO: 1236571 - DNA, 22 bp, Artificial Sequence
  chemically synthesized
aatcagtacctagtcattctac

SEQ ID NO: 1236572 - DNA, 22 bp, Artificial Sequence
  chemically synthesized
acaacatagttttatgacatct

SEQ ID NO: 1236573 - DNA, 22 bp, Artificial Sequence
  chemically synthesized
gtcattctactagatgtcataa

SEQ ID NO: 1236574 - DNA, 22 bp, Artificial Sequence
  chemically synthesized
tactagatgtcataaaactatg

SEQ ID NO: 1236575 - DNA, 22 bp, Artificial Sequence
  chemically synthesized
ctagatgtcataaaactatgtt

SEQ ID NO: 1236576 - DNA, 22 bp, Artificial Sequence
  chemically synthesized
gatgtcataaaactatgttgtc

SEQ ID NO: 1236577 - DNA, 22 bp, Artificial Sequence
  chemically synthesized
agaccagaaactgacaacatag

SEQ ID NO: 1236578 - DNA, 22 bp, Artificial Sequence
  chemically synthesized
cagaccagaaactgacaacata

SEQ ID NO: 1236579 - DNA, 22 bp, Artificial Sequence
  chemically synthesized
gtagaatttcagaccagaaact

SEQ ID NO: 1236580 - DNA, 22 bp, Artificial Sequence
  chemically synthesized
agtagaatttcagaccagaaac

SEQ ID NO: 1236581 - DNA, 22 bp, Artificial Sequence
  chemically synthesized
tgttgtcagtttctggtctgaa

SEQ ID NO: 1236582 - DNA, 22 bp, Artificial Sequence
  chemically synthesized
aacttagtagaatttcagacca

SEQ ID NO: 1236583 - DNA, 22 bp, Artificial Sequence
  chemically synthesized
aaacttagtagaatttcagacc

SEQ ID NO: 1236584 - DNA, 22 bp, Artificial Sequence
  chemically synthesized
taaacttagtagaatttcagac

SEQ ID NO: 1236585 - DNA, 22 bp, Artificial Sequence
  chemically synthesized
tcagtttctggtctgaaattct

SEQ ID NO: 1236586 - DNA, 22 bp, Artificial Sequence
  chemically synthesized
actttaaacttagtagaatttc

SEQ ID NO: 1236587 - DNA, 22 bp, Artificial Sequence
  chemically synthesized
ctggtctgaaattctactaagt

SEQ ID NO: 1236588 - DNA, 22 bp, Artificial Sequence
  chemically synthesized
tggtctgaaattctactaagtt

SEQ ID NO: 1236589 - DNA, 22 bp, Artificial Sequence
  chemically synthesized
gtctgaaattctactaagttta

SEQ ID NO: 1236590 - DNA, 22 bp, Artificial Sequence
  chemically synthesized
agaaagttaactttaaacttag

SEQ ID NO: 1236591 - DNA, 22 bp, Artificial Sequence
  chemically synthesized
aagaaagttaactttaaactta

SEQ ID NO: 1236592 - DNA, 22 bp, Artificial Sequence
  chemically synthesized
taagaaagttaactttaaactt

SEQ ID NO: 1236593 - DNA, 22 bp, Artificial Sequence
  chemically synthesized
ttaagaaagttaactttaaact

SEQ ID NO: 1236594 - DNA, 22 bp, Artificial Sequence
  chemically synthesized
aaattctactaagtttaaagtt

SEQ ID NO: 1236595 - DNA, 22 bp, Artificial Sequence
  chemically synthesized
tttttaagaaagttaactttaa

SEQ ID NO: 1236596 - DNA, 22 bp, Artificial Sequence
  chemically synthesized
atttttaagaaagttaacttta

SEQ ID NO: 1236597 - DNA, 22 bp, Artificial Sequence
  chemically synthesized
tactaagtttaaagttaacttt

SEQ ID NO: 1236598 - DNA, 22 bp, Artificial Sequence
  chemically synthesized
ctaagtttaaagttaactttct

SEQ ID NO: 1236599 - DNA, 22 bp, Artificial Sequence
  chemically synthesized
agtttaaagttaactttcttaa

SEQ ID NO: 1236600 - DNA, 22 bp, Artificial Sequence
  chemically synthesized
gtatgtgacttatttttaagaa

SEQ ID NO: 1236601 - DNA, 22 bp, Artificial Sequence
  chemically synthesized
aaagttaactttcttaaaaata

SEQ ID NO: 1236602 - DNA, 22 bp, Artificial Sequence
  chemically synthesized
aagttaactttcttaaaaataa

SEQ ID NO: 1236603 - DNA, 22 bp, Artificial Sequence
  chemically synthesized
actttcttaaaaataagtcaca

SEQ ID NO: 1236604 - DNA, 22 bp, Artificial Sequence
  chemically synthesized
tcttaaaaataagtcacatacc

SEQ ID NO: 1236605 - DNA, 22 bp, Artificial Sequence
  chemically synthesized
cttaaaaataagtcacatacca

SEQ ID NO: 1236606 - DNA, 22 bp, Artificial Sequence
  chemically synthesized
ttaaaaataagtcacataccag

SEQ ID NO: 1236607 - DNA, 22 bp, Artificial Sequence
  chemically synthesized
acagggcaaaaactggtatgtg

SEQ ID NO: 1236608 - DNA, 22 bp, Artificial Sequence
  chemically synthesized
aaaaataagtcacataccagtt

SEQ ID NO: 1236609 - DNA, 22 bp, Artificial Sequence
  chemically synthesized
aaaataagtcacataccagttt

SEQ ID NO: 1236610 - DNA, 22 bp, Artificial Sequence
  chemically synthesized
gaaggcctgacagggcaaaaac

SEQ ID NO: 1236611 - DNA, 22 bp, Artificial Sequence
  chemically synthesized
ctcgaaggcctgacagggcaaa

SEQ ID NO: 1236612 - DNA, 22 bp, Artificial Sequence
  chemically synthesized
gacctcctcgaaggcctgacag

SEQ ID NO: 1236613 - DNA, 22 bp, Artificial Sequence
  chemically synthesized
ctagacctcctcgaaggcctga

SEQ ID NO: 1236614 - DNA, 22 bp, Artificial Sequence
  chemically synthesized
ttgccctgtcaggccttcgagg

SEQ ID NO: 1236615 - DNA, 22 bp, Artificial Sequence
  chemically synthesized
tgccctgtcaggccttcgagga

SEQ ID NO: 1236616 - DNA, 22 bp, Artificial Sequence
  chemically synthesized
gccctgtcaggccttcgaggag

SEQ ID NO: 1236617 - DNA, 22 bp, Artificial Sequence
  chemically synthesized
ccctgtcaggccttcgaggagg

SEQ ID NO: 1236618 - DNA, 22 bp, Artificial Sequence
  chemically synthesized
tcaggccttcgaggaggtctag

SEQ ID NO: 1236619 - DNA, 22 bp, Artificial Sequence
  chemically synthesized
caggatgggaggcgcctcctag

SEQ ID NO: 1236620 - DNA, 22 bp, Artificial Sequence
  chemically synthesized
cgaggaggtctaggaggcgcct

SEQ ID NO: 1236621 - DNA, 22 bp, Artificial Sequence
  chemically synthesized
gaggaggtctaggaggcgcctc

SEQ ID NO: 1236622 - DNA, 22 bp, Artificial Sequence
  chemically synthesized
agtgacctacaggatgggaggc

SEQ ID NO: 1236623 - DNA, 22 bp, Artificial Sequence
  chemically synthesized
cagtgacctacaggatgggagg

SEQ ID NO: 1236624 - DNA, 22 bp, Artificial Sequence
  chemically synthesized
ttcagtgacctacaggatggga

SEQ ID NO: 1236625 - DNA, 22 bp, Artificial Sequence
  chemically synthesized
ggaggcgcctcccatcctgtag

SEQ ID NO: 1236626 - DNA, 22 bp, Artificial Sequence
  chemically synthesized
agaacctcttcagtgacctaca

SEQ ID NO: 1236627 - DNA, 22 bp, Artificial Sequence
  chemically synthesized
ccatcctgtaggtcactgaaga

SEQ ID NO: 1236628 - DNA, 22 bp, Artificial Sequence
  chemically synthesized
taggtcactgaagaggttctca

SEQ ID NO: 1236629 - DNA, 22 bp, Artificial Sequence
  chemically synthesized
ggaagcagcatattgagaacct

SEQ ID NO: 1236630 - DNA, 22 bp, Artificial Sequence
  chemically synthesized
gggaagcagcatattgagaacc

SEQ ID NO: 1236631 - DNA, 22 bp, Artificial Sequence
  chemically synthesized
agtttgggaagcagcatattga

SEQ ID NO: 1236632 - DNA, 22 bp, Artificial Sequence
  chemically synthesized
cagtttgggaagcagcatattg

SEQ ID NO: 1236633 - DNA, 22 bp, Artificial Sequence
  chemically synthesized
aagaggttctcaatatgctgct

SEQ ID NO: 1236634 - DNA, 22 bp, Artificial Sequence
  chemically synthesized
atttcagtttgggaagcagcat

SEQ ID NO: 1236635 - DNA, 22 bp, Artificial Sequence
  chemically synthesized
aatttcagtttgggaagcagca

SEQ ID NO: 1236636 - DNA, 22 bp, Artificial Sequence
  chemically synthesized
taatttcagtttgggaagcagc

SEQ ID NO: 1236637 - DNA, 22 bp, Artificial Sequence
  chemically synthesized
ttaatttcagtttgggaagcag

SEQ ID NO: 1236638 - DNA, 22 bp, Artificial Sequence
  chemically synthesized
tttaatttcagtttgggaagca

SEQ ID NO: 1236639 - DNA, 22 bp, Artificial Sequence
  chemically synthesized
ttttaatttcagtttgggaagc

SEQ ID NO: 1236640 - DNA, 22 bp, Artificial Sequence
  chemically synthesized
tttttaatttcagtttgggaag

SEQ ID NO: 1236641 - DNA, 22 bp, Artificial Sequence
  chemically synthesized
tcaatatgctgcttcccaaact

SEQ ID NO: 1236642 - DNA, 22 bp, Artificial Sequence
  chemically synthesized
aatatgctgcttcccaaactga

SEQ ID NO: 1236643 - DNA, 22 bp, Artificial Sequence
  chemically synthesized
agtgtattttttttaatttcag

SEQ ID NO: 1236644 - DNA, 22 bp, Artificial Sequence
  chemically synthesized
cttcccaaactgaaattaaaaa

SEQ ID NO: 1236645 - DNA, 22 bp, Artificial Sequence
  chemically synthesized
aattgagtgtattttttttaat

SEQ ID NO: 1236646 - DNA, 22 bp, Artificial Sequence
  chemically synthesized
cccaaactgaaattaaaaaaaa

SEQ ID NO: 1236647 - DNA, 22 bp, Artificial Sequence
  chemically synthesized
ccaaactgaaattaaaaaaaat

SEQ ID NO: 1236648 - DNA, 22 bp, Artificial Sequence
  chemically synthesized
ttaaattgagtgtatttttttt

SEQ ID NO: 1236649 - DNA, 22 bp, Artificial Sequence
  chemically synthesized
gttaaattgagtgtattttttt

SEQ ID NO: 1236650 - DNA, 22 bp, Artificial Sequence
  chemically synthesized
tgttaaattgagtgtatttttt

SEQ ID NO: 1236651 - DNA, 22 bp, Artificial Sequence
  chemically synthesized
aaattaaaaaaaatacactcaa

SEQ ID NO: 1236652 - DNA, 22 bp, Artificial Sequence
  chemically synthesized
aaaaaaatacactcaatttaac

SEQ ID NO: 1236653 - DNA, 22 bp, Artificial Sequence
  chemically synthesized
gaagtgtgctttgttaaattga

SEQ ID NO: 1236654 - DNA, 22 bp, Artificial Sequence
  chemically synthesized
aatttaacaaagcacacttcca

SEQ ID NO: 1236655 - DNA, 22 bp, Artificial Sequence
  chemically synthesized
aacaaagcacacttccaatgat

SEQ ID NO: 1236656 - DNA, 22 bp, Artificial Sequence
  chemically synthesized
acaaagcacacttccaatgata

SEQ ID NO: 1236657 - DNA, 22 bp, Artificial Sequence
  chemically synthesized
aaaaggggataatcgtgaaaat

SEQ ID NO: 1236658 - DNA, 22 bp, Artificial Sequence
  chemically synthesized
caaaaggggataatcgtgaaaa

SEQ ID NO: 1236659 - DNA, 22 bp, Artificial Sequence
  chemically synthesized
ccaatgatacattttcacgatt

SEQ ID NO: 1236660 - DNA, 22 bp, Artificial Sequence
  chemically synthesized
tcaaaaggggataatcgtgaaa

SEQ ID NO: 1236661 - DNA, 22 bp, Artificial Sequence
  chemically synthesized
caatgatacattttcacgatta

SEQ ID NO: 1236662 - DNA, 22 bp, Artificial Sequence
  chemically synthesized
gttttcaaaaggggataatcgt

SEQ ID NO: 1236663 - DNA, 22 bp, Artificial Sequence
  chemically synthesized
agttttcaaaaggggataatcg

SEQ ID NO: 1236664 - DNA, 22 bp, Artificial Sequence
  chemically synthesized
tagttttcaaaaggggataatc

SEQ ID NO: 1236665 - DNA, 22 bp, Artificial Sequence
  chemically synthesized
tcacgattatccccttttgaaa

SEQ ID NO: 1236666 - DNA, 22 bp, Artificial Sequence
  chemically synthesized
cacgattatccccttttgaaaa

SEQ ID NO: 1236667 - DNA, 22 bp, Artificial Sequence
  chemically synthesized
acgattatccccttttgaaaac

SEQ ID NO: 1236668 - DNA, 22 bp, Artificial Sequence
  chemically synthesized
aatatagctttagttttcaaaa

SEQ ID NO: 1236669 - DNA, 22 bp, Artificial Sequence
  chemically synthesized
aaatatagctttagttttcaaa

SEQ ID NO: 1236670 - DNA, 22 bp, Artificial Sequence
  chemically synthesized
tccttaaatatagctttagttt

SEQ ID NO: 1236671 - DNA, 22 bp, Artificial Sequence
  chemically synthesized
tccccttttgaaaactaaagct

SEQ ID NO: 1236672 - DNA, 22 bp, Artificial Sequence
  chemically synthesized
attatccttaaatatagcttta

SEQ ID NO: 1236673 - DNA, 22 bp, Artificial Sequence
  chemically synthesized
ttgaaaactaaagctatattta

SEQ ID NO: 1236674 - DNA, 22 bp, Artificial Sequence
  chemically synthesized
tgaaaactaaagctatatttaa

SEQ ID NO: 1236675 - DNA, 22 bp, Artificial Sequence
  chemically synthesized
gaaaactaaagctatatttaag

SEQ ID NO: 1236676 - DNA, 22 bp, Artificial Sequence
  chemically synthesized
aaaactaaagctatatttaagg

SEQ ID NO: 1236677 - DNA, 22 bp, Artificial Sequence
  chemically synthesized
tgcacactaattatccttaaat

SEQ ID NO: 1236678 - DNA, 22 bp, Artificial Sequence
  chemically synthesized
attatgcacactaattatcctt

SEQ ID NO: 1236679 - DNA, 22 bp, Artificial Sequence
  chemically synthesized
aagctatatttaaggataatta

SEQ ID NO: 1236680 - DNA, 22 bp, Artificial Sequence
  chemically synthesized
tatttaaggataattagtgtgc

SEQ ID NO: 1236681 - DNA, 22 bp, Artificial Sequence
  chemically synthesized
ggcagattaattatgcacacta

SEQ ID NO: 1236682 - DNA, 22 bp, Artificial Sequence
  chemically synthesized
cggcagattaattatgcacact

SEQ ID NO: 1236683 - DNA, 22 bp, Artificial Sequence
  chemically synthesized
aaggataattagtgtgcataat

SEQ ID NO: 1236684 - DNA, 22 bp, Artificial Sequence
  chemically synthesized
aggataattagtgtgcataatt

SEQ ID NO: 1236685 - DNA, 22 bp, Artificial Sequence
  chemically synthesized
atccgtcatcttcggcagatta

SEQ ID NO: 1236686 - DNA, 22 bp, Artificial Sequence
  chemically synthesized
gtgtgcataattaatctgccga

SEQ ID NO: 1236687 - DNA, 22 bp, Artificial Sequence
  chemically synthesized
catccgtcatcttcggcagatt

SEQ ID NO: 1236688 - DNA, 22 bp, Artificial Sequence
  chemically synthesized
tcatccgtcatcttcggcagat

SEQ ID NO: 1236689 - DNA, 22 bp, Artificial Sequence
  chemically synthesized
ttcatccgtcatcttcggcaga

SEQ ID NO: 1236690 - DNA, 22 bp, Artificial Sequence
  chemically synthesized
tttcatccgtcatcttcggcag

SEQ ID NO: 1236691 - DNA, 22 bp, Artificial Sequence
  chemically synthesized
ttttcatccgtcatcttcggca

SEQ ID NO: 1236692 - DNA, 22 bp, Artificial Sequence
  chemically synthesized
cttttttcatccgtcatcttcg

SEQ ID NO: 1236693 - DNA, 22 bp, Artificial Sequence
  chemically synthesized
ccttttttcatccgtcatcttc

SEQ ID NO: 1236694 - DNA, 22 bp, Artificial Sequence
  chemically synthesized
tccttttttcatccgtcatctt

SEQ ID NO: 1236695 - DNA, 22 bp, Artificial Sequence
  chemically synthesized
atctgccgaagatgacggatga

SEQ ID NO: 1236696 - DNA, 22 bp, Artificial Sequence
  chemically synthesized
aactttccttttttcatccgtc

SEQ ID NO: 1236697 - DNA, 22 bp, Artificial Sequence
  chemically synthesized
gaactttccttttttcatccgt

SEQ ID NO: 1236698 - DNA, 22 bp, Artificial Sequence
  chemically synthesized
ccgaagatgacggatgaaaaaa

SEQ ID NO: 1236699 - DNA, 22 bp, Artificial Sequence
  chemically synthesized
tcatttgaactttccttttttc

SEQ ID NO: 1236700 - DNA, 22 bp, Artificial Sequence
  chemically synthesized
gtcatttgaactttcctttttt

SEQ ID NO: 1236701 - DNA, 22 bp, Artificial Sequence
  chemically synthesized
tgtcatttgaactttccttttt

SEQ ID NO: 1236702 - DNA, 22 bp, Artificial Sequence
  chemically synthesized
ttgtcatttgaactttcctttt

SEQ ID NO: 1236703 - DNA, 22 bp, Artificial Sequence
  chemically synthesized
tttgtcatttgaactttccttt

SEQ ID NO: 1236704 - DNA, 22 bp, Artificial Sequence
  chemically synthesized
ttttgtcatttgaactttcctt

SEQ ID NO: 1236705 - DNA, 22 bp, Artificial Sequence
  chemically synthesized
tttttgtcatttgaactttcct

SEQ ID NO: 1236706 - DNA, 22 bp, Artificial Sequence
  chemically synthesized
aattttttttgtcatttgaact

SEQ ID NO: 1236707 - DNA, 22 bp, Artificial Sequence
  chemically synthesized
aaattttttttgtcatttgaac

SEQ ID NO: 1236708 - DNA, 22 bp, Artificial Sequence
  chemically synthesized
taaattttttttgtcatttgaa

SEQ ID NO: 1236709 - DNA, 22 bp, Artificial Sequence
  chemically synthesized
ttaaattttttttgtcatttga

SEQ ID NO: 1236710 - DNA, 22 bp, Artificial Sequence
  chemically synthesized
tgataaaatttttaaatttttt

SEQ ID NO: 1236711 - DNA, 22 bp, Artificial Sequence
  chemically synthesized
aaatgacaaaaaaaatttaaaa

SEQ ID NO: 1236712 - DNA, 22 bp, Artificial Sequence
  chemically synthesized
acctatgataaaatttttaaat

SEQ ID NO: 1236713 - DNA, 22 bp, Artificial Sequence
  chemically synthesized
gacctatgataaaatttttaaa

SEQ ID NO: 1236714 - DNA, 22 bp, Artificial Sequence
  chemically synthesized
aaatagacttgacctatgataa

SEQ ID NO: 1236715 - DNA, 22 bp, Artificial Sequence
  chemically synthesized
attcaaatagacttgacctatg

SEQ ID NO: 1236716 - DNA, 22 bp, Artificial Sequence
  chemically synthesized
aaaaattttatcataggtcaag

SEQ ID NO: 1236717 - DNA, 22 bp, Artificial Sequence
  chemically synthesized
aaaattttatcataggtcaagt

SEQ ID NO: 1236718 - DNA, 22 bp, Artificial Sequence
  chemically synthesized
aaactaattcaaatagacttga

SEQ ID NO: 1236719 - DNA, 22 bp, Artificial Sequence
  chemically synthesized
tatcataggtcaagtctatttg

SEQ ID NO: 1236720 - DNA, 22 bp, Artificial Sequence
  chemically synthesized
ttcaaactaattcaaatagact

SEQ ID NO: 1236721 - DNA, 22 bp, Artificial Sequence
  chemically synthesized
atcataggtcaagtctatttga

SEQ ID NO: 1236722 - DNA, 22 bp, Artificial Sequence
  chemically synthesized
tcataggtcaagtctatttgaa

SEQ ID NO: 1236723 - DNA, 22 bp, Artificial Sequence
  chemically synthesized
ctattcaaactaattcaaatag

SEQ ID NO: 1236724 - DNA, 22 bp, Artificial Sequence
  chemically synthesized
gctattcaaactaattcaaata

SEQ ID NO: 1236725 - DNA, 22 bp, Artificial Sequence
  chemically synthesized
ttgctattcaaactaattcaaa

SEQ ID NO: 1236726 - DNA, 22 bp, Artificial Sequence
  chemically synthesized
ctcttgctattcaaactaattc

SEQ ID NO: 1236727 - DNA, 22 bp, Artificial Sequence
  chemically synthesized
actcttgctattcaaactaatt

SEQ ID NO: 1236728 - DNA, 22 bp, Artificial Sequence
  chemically synthesized
ttactcttgctattcaaactaa

SEQ ID NO: 1236729 - DNA, 22 bp, Artificial Sequence
  chemically synthesized
tttgaattagtttgaatagcaa

SEQ ID NO: 1236730 - DNA, 22 bp, Artificial Sequence
  chemically synthesized
gaattagtttgaatagcaagag

SEQ ID NO: 1236731 - DNA, 22 bp, Artificial Sequence
  chemically synthesized
aattagtttgaatagcaagagt

SEQ ID NO: 1236732 - DNA, 22 bp, Artificial Sequence
  chemically synthesized
gggtataaatctcttactcttg

SEQ ID NO: 1236733 - DNA, 22 bp, Artificial Sequence
  chemically synthesized
agggtataaatctcttactctt

SEQ ID NO: 1236734 - DNA, 22 bp, Artificial Sequence
  chemically synthesized
gtttgaatagcaagagtaagag

SEQ ID NO: 1236735 - DNA, 22 bp, Artificial Sequence
  chemically synthesized
gaatagcaagagtaagagattt

SEQ ID NO: 1236736 - DNA, 22 bp, Artificial Sequence
  chemically synthesized
aatagcaagagtaagagattta

SEQ ID NO: 1236737 - DNA, 22 bp, Artificial Sequence
  chemically synthesized
gatcatttagggtataaatctc

SEQ ID NO: 1236738 - DNA, 22 bp, Artificial Sequence
  chemically synthesized
attagatcatttagggtataaa

SEQ ID NO: 1236739 - DNA, 22 bp, Artificial Sequence
  chemically synthesized
agtgaattaattagatcattta

SEQ ID NO: 1236740 - DNA, 22 bp, Artificial Sequence
  chemically synthesized
cagtgaattaattagatcattt

SEQ ID NO: 1236741 - DNA, 22 bp, Artificial Sequence
  chemically synthesized
atttcagtgaattaattagatc

SEQ ID NO: 1236742 - DNA, 22 bp, Artificial Sequence
  chemically synthesized
ataccctaaatgatctaattaa

SEQ ID NO: 1236743 - DNA, 22 bp, Artificial Sequence
  chemically synthesized
taccctaaatgatctaattaat

SEQ ID NO: 1236744 - DNA, 22 bp, Artificial Sequence
  chemically synthesized
tattcatttcagtgaattaatt

SEQ ID NO: 1236745 - DNA, 22 bp, Artificial Sequence
  chemically synthesized
aatgatctaattaattcactga

SEQ ID NO: 1236746 - DNA, 22 bp, Artificial Sequence
  chemically synthesized
atagaatctatattcatttcag

SEQ ID NO: 1236747 - DNA, 22 bp, Artificial Sequence
  chemically synthesized
catagaatctatattcatttca

SEQ ID NO: 1236748 - DNA, 22 bp, Artificial Sequence
  chemically synthesized
attaattcactgaaatgaatat

SEQ ID NO: 1236749 - DNA, 22 bp, Artificial Sequence
  chemically synthesized
cttcatagaatctatattcatt

SEQ ID NO: 1236750 - DNA, 22 bp, Artificial Sequence
  chemically synthesized
tccttcatagaatctatattca

SEQ ID NO: 1236751 - DNA, 22 bp, Artificial Sequence
  chemically synthesized
attcactgaaatgaatatagat

SEQ ID NO: 1236752 - DNA, 22 bp, Artificial Sequence
  chemically synthesized
tctccttcatagaatctatatt

SEQ ID NO: 1236753 - DNA, 22 bp, Artificial Sequence
  chemically synthesized
ctctccttcatagaatctatat

SEQ ID NO: 1236754 - DNA, 22 bp, Artificial Sequence
  chemically synthesized
tctctccttcatagaatctata

SEQ ID NO: 1236755 - DNA, 22 bp, Artificial Sequence
  chemically synthesized
actgaaatgaatatagattcta

SEQ ID NO: 1236756 - DNA, 22 bp, Artificial Sequence
  chemically synthesized
ttctctccttcatagaatctat

SEQ ID NO: 1236757 - DNA, 22 bp, Artificial Sequence
  chemically synthesized
tttctctccttcatagaatcta

SEQ ID NO: 1236758 - DNA, 22 bp, Artificial Sequence
  chemically synthesized
aaatgaatatagattctatgaa

SEQ ID NO: 1236759 - DNA, 22 bp, Artificial Sequence
  chemically synthesized
tattttttctctccttcataga

SEQ ID NO: 1236760 - DNA, 22 bp, Artificial Sequence
  chemically synthesized
atcatgcctgtattttttctct

SEQ ID NO: 1236761 - DNA, 22 bp, Artificial Sequence
  chemically synthesized
gatcatgcctgtattttttctc

SEQ ID NO: 1236762 - DNA, 22 bp, Artificial Sequence
  chemically synthesized
tatgaaggagagaaaaaataca

SEQ ID NO: 1236763 - DNA, 22 bp, Artificial Sequence
  chemically synthesized
ccttgatcatgcctgtattttt

SEQ ID NO: 1236764 - DNA, 22 bp, Artificial Sequence
  chemically synthesized
tgaaggagagaaaaaatacagg

SEQ ID NO: 1236765 - DNA, 22 bp, Artificial Sequence
  chemically synthesized
cccgtaactgccttgatcatgc

SEQ ID NO: 1236766 - DNA, 22 bp, Artificial Sequence
  chemically synthesized
acccgtaactgccttgatcatg

SEQ ID NO: 1236767 - DNA, 22 bp, Artificial Sequence
  chemically synthesized
tacccgtaactgccttgatcat

SEQ ID NO: 1236768 - DNA, 22 bp, Artificial Sequence
  chemically synthesized
cctttacccgtaactgccttga

SEQ ID NO: 1236769 - DNA, 22 bp, Artificial Sequence
  chemically synthesized
ccctttacccgtaactgccttg

SEQ ID NO: 1236770 - DNA, 22 bp, Artificial Sequence
  chemically synthesized
tccctttacccgtaactgcctt

SEQ ID NO: 1236771 - DNA, 22 bp, Artificial Sequence
  chemically synthesized
ttccctttacccgtaactgcct

SEQ ID NO: 1236772 - DNA, 22 bp, Artificial Sequence
  chemically synthesized
cttttccctttacccgtaactg

SEQ ID NO: 1236773 - DNA, 22 bp, Artificial Sequence
  chemically synthesized
acttttccctttacccgtaact

SEQ ID NO: 1236774 - DNA, 22 bp, Artificial Sequence
  chemically synthesized
tgtatttacttttccctttacc

SEQ ID NO: 1236775 - DNA, 22 bp, Artificial Sequence
  chemically synthesized
gtgtatttacttttccctttac

SEQ ID NO: 1236776 - DNA, 22 bp, Artificial Sequence
  chemically synthesized
tgtgtatttacttttcccttta

SEQ ID NO: 1236777 - DNA, 22 bp, Artificial Sequence
  chemically synthesized
tttgtgtatttacttttccctt

SEQ ID NO: 1236778 - DNA, 22 bp, Artificial Sequence
  chemically synthesized
ctttgtgtatttacttttccct

SEQ ID NO: 1236779 - DNA, 22 bp, Artificial Sequence
  chemically synthesized
cttctttgtgtatttacttttc

SEQ ID NO: 1236780 - DNA, 22 bp, Artificial Sequence
  chemically synthesized
gcttctttgtgtatttactttt

SEQ ID NO: 1236781 - DNA, 22 bp, Artificial Sequence
  chemically synthesized
cgggtaaagggaaaagtaaata

SEQ ID NO: 1236782 - DNA, 22 bp, Artificial Sequence
  chemically synthesized
tgcttctttgtgtatttacttt

SEQ ID NO: 1236783 - DNA, 22 bp, Artificial Sequence
  chemically synthesized
ttgcttctttgtgtatttactt

SEQ ID NO: 1236784 - DNA, 22 bp, Artificial Sequence
  chemically synthesized
tggtcttttgcttctttgtgta

SEQ ID NO: 1236785 - DNA, 22 bp, Artificial Sequence
  chemically synthesized
tgtacccacccaggtagattgt

SEQ ID NO: 1236786 - DNA, 22 bp, Artificial Sequence
  chemically synthesized
atgtacccacccaggtagattg

SEQ ID NO: 1236787 - DNA, 22 bp, Artificial Sequence
  chemically synthesized
tatgtacccacccaggtagatt

SEQ ID NO: 1236788 - DNA, 22 bp, Artificial Sequence
  chemically synthesized
aactttatgtacccacccaggt

SEQ ID NO: 1236789 - DNA, 22 bp, Artificial Sequence
  chemically synthesized
caagaatggttaaactttatgt

SEQ ID NO: 1236790 - DNA, 22 bp, Artificial Sequence
  chemically synthesized
cctgggtgggtacataaagttt

SEQ ID NO: 1236791 - DNA, 22 bp, Artificial Sequence
  chemically synthesized
ggtgggtacataaagtttaacc

SEQ ID NO: 1236792 - DNA, 22 bp, Artificial Sequence
  chemically synthesized
gtatattccaagaatggttaaa

SEQ ID NO: 1236793 - DNA, 22 bp, Artificial Sequence
  chemically synthesized
actggtatattccaagaatggt

SEQ ID NO: 1236794 - DNA, 22 bp, Artificial Sequence
  chemically synthesized
tgactggtatattccaagaatg

SEQ ID NO: 1236795 - DNA, 22 bp, Artificial Sequence
  chemically synthesized
aaccattcttggaatataccag

SEQ ID NO: 1236796 - DNA, 22 bp, Artificial Sequence
  chemically synthesized
accattcttggaatataccagt

SEQ ID NO: 1236797 - DNA, 22 bp, Artificial Sequence
  chemically synthesized
ttggaatataccagtcagagtg

SEQ ID NO: 1236798 - DNA, 22 bp, Artificial Sequence
  chemically synthesized
ggaatataccagtcagagtggt

SEQ ID NO: 1236799 - DNA, 22 bp, Artificial Sequence
  chemically synthesized
gaatataccagtcagagtggtt

SEQ ID NO: 1236800 - DNA, 22 bp, Artificial Sequence
  chemically synthesized
agtgataaggatgtcgaaccac

SEQ ID NO: 1236801 - DNA, 22 bp, Artificial Sequence
  chemically synthesized
gagtgataaggatgtcgaacca

SEQ ID NO: 1236802 - DNA, 22 bp, Artificial Sequence
  chemically synthesized
tgagtgataaggatgtcgaacc

SEQ ID NO: 1236803 - DNA, 22 bp, Artificial Sequence
  chemically synthesized
gacatccttatcactcaaaaca

SEQ ID NO: 1236804 - DNA, 22 bp, Artificial Sequence
  chemically synthesized
atcactcaaaacatgcttgctg

SEQ ID NO: 1236805 - DNA, 22 bp, Artificial Sequence
  chemically synthesized
tcactcaaaacatgcttgctgt

SEQ ID NO: 1236806 - DNA, 22 bp, Artificial Sequence
  chemically synthesized
aaaacatgcttgctgtgcatac

SEQ ID NO: 1236807 - DNA, 22 bp, Artificial Sequence
  chemically synthesized
gctgtgcatacacattttgcat

SEQ ID NO: 1236808 - DNA, 22 bp, Artificial Sequence
  chemically synthesized
ctgtgcatacacattttgcatg

SEQ ID NO: 1236809 - DNA, 22 bp, Artificial Sequence
  chemically synthesized
tgcatacacattttgcatgcta

SEQ ID NO: 1236810 - DNA, 22 bp, Artificial Sequence
  chemically synthesized
tccagtatgagaataggtcata

SEQ ID NO: 1236811 - DNA, 22 bp, Artificial Sequence
  chemically synthesized
tgcatgctatgacctattctca

SEQ ID NO: 1236812 - DNA, 22 bp, Artificial Sequence
  chemically synthesized
agttatccagtatgagaatagg

SEQ ID NO: 1236813 - DNA, 22 bp, Artificial Sequence
  chemically synthesized
gcatgctatgacctattctcat

SEQ ID NO: 1236814 - DNA, 22 bp, Artificial Sequence
  chemically synthesized
gagttatccagtatgagaatag

SEQ ID NO: 1236815 - DNA, 22 bp, Artificial Sequence
  chemically synthesized
catgctatgacctattctcata

SEQ ID NO: 1236816 - DNA, 22 bp, Artificial Sequence
  chemically synthesized
aaatttgagttatccagtatga

SEQ ID NO: 1236817 - DNA, 22 bp, Artificial Sequence
  chemically synthesized
tgacctattctcatactggata

SEQ ID NO: 1236818 - DNA, 22 bp, Artificial Sequence
  chemically synthesized
ctaaaatttgagttatccagta

SEQ ID NO: 1236819 - DNA, 22 bp, Artificial Sequence
  chemically synthesized
ttctcatactggataactcaaa

SEQ ID NO: 1236820 - DNA, 22 bp, Artificial Sequence
  chemically synthesized
tcatactggataactcaaattt

SEQ ID NO: 1236821 - DNA, 22 bp, Artificial Sequence
  chemically synthesized
atactggataactcaaatttta

SEQ ID NO: 1236822 - DNA, 22 bp, Artificial Sequence
  chemically synthesized
aacccgatattcctaaaatttg

SEQ ID NO: 1236823 - DNA, 22 bp, Artificial Sequence
  chemically synthesized
attaaacccgatattcctaaaa

SEQ ID NO: 1236824 - DNA, 22 bp, Artificial Sequence
  chemically synthesized
gataactcaaattttaggaata

SEQ ID NO: 1236825 - DNA, 22 bp, Artificial Sequence
  chemically synthesized
aaacctaattaaacccgatatt

SEQ ID NO: 1236826 - DNA, 22 bp, Artificial Sequence
  chemically synthesized
caaacctaattaaacccgatat

SEQ ID NO: 1236827 - DNA, 22 bp, Artificial Sequence
  chemically synthesized
aaattttaggaatatcgggttt

SEQ ID NO: 1236828 - DNA, 22 bp, Artificial Sequence
  chemically synthesized
tttcaaacctaattaaacccga

SEQ ID NO: 1236829 - DNA, 22 bp, Artificial Sequence
  chemically synthesized
taggaatatcgggtttaattag

SEQ ID NO: 1236830 - DNA, 22 bp, Artificial Sequence
  chemically synthesized
aggaatatcgggtttaattagg

SEQ ID NO: 1236831 - DNA, 22 bp, Artificial Sequence
  chemically synthesized
ggaatatcgggtttaattaggt

SEQ ID NO: 1236832 - DNA, 22 bp, Artificial Sequence
  chemically synthesized
acagggttgtttcaaacctaat

SEQ ID NO: 1236833 - DNA, 22 bp, Artificial Sequence
  chemically synthesized
tcacagggttgtttcaaaccta

SEQ ID NO: 1236834 - DNA, 22 bp, Artificial Sequence
  chemically synthesized
aattaggtttgaaacaaccctg

SEQ ID NO: 1236835 - DNA, 22 bp, Artificial Sequence
  chemically synthesized
attaggtttgaaacaaccctgt

SEQ ID NO: 1236836 - DNA, 22 bp, Artificial Sequence
  chemically synthesized
ggtttgaaacaaccctgtgaga

SEQ ID NO: 1236837 - DNA, 22 bp, Artificial Sequence
  chemically synthesized
gaaacaaccctgtgagagcttt

SEQ ID NO: 1236838 - DNA, 22 bp, Artificial Sequence
  chemically synthesized
aaacaaccctgtgagagctttt

SEQ ID NO: 1236839 - DNA, 22 bp, Artificial Sequence
  chemically synthesized
agtaaaatagatgaaaagctct

SEQ ID NO: 1236840 - DNA, 22 bp, Artificial Sequence
  chemically synthesized
tgagagcttttcatctatttta

SEQ ID NO: 1236841 - DNA, 22 bp, Artificial Sequence
  chemically synthesized
agcaaagaactgagtaaaatag

SEQ ID NO: 1236842 - DNA, 22 bp, Artificial Sequence
  chemically synthesized
ctgagcaaagaactgagtaaaa

SEQ ID NO: 1236843 - DNA, 22 bp, Artificial Sequence
  chemically synthesized
ttcatctattttactcagttct

SEQ ID NO: 1236844 - DNA, 22 bp, Artificial Sequence
  chemically synthesized
tcatctattttactcagttctt

SEQ ID NO: 1236845 - DNA, 22 bp, Artificial Sequence
  chemically synthesized
catctattttactcagttcttt

SEQ ID NO: 1236846 - DNA, 22 bp, Artificial Sequence
  chemically synthesized
atctattttactcagttctttg

SEQ ID NO: 1236847 - DNA, 22 bp, Artificial Sequence
  chemically synthesized
gtataattcctgagcaaagaac

SEQ ID NO: 1236848 - DNA, 22 bp, Artificial Sequence
  chemically synthesized
agtataattcctgagcaaagaa

SEQ ID NO: 1236849 - DNA, 22 bp, Artificial Sequence
  chemically synthesized
ttttactcagttctttgctcag

SEQ ID NO: 1236850 - DNA, 22 bp, Artificial Sequence
  chemically synthesized
cttagtataattcctgagcaaa

SEQ ID NO: 1236851 - DNA, 22 bp, Artificial Sequence
  chemically synthesized
ccttagtataattcctgagcaa

SEQ ID NO: 1236852 - DNA, 22 bp, Artificial Sequence
  chemically synthesized
tactcagttctttgctcaggaa

SEQ ID NO: 1236853 - DNA, 22 bp, Artificial Sequence
  chemically synthesized
tccttagtataattcctgagca

SEQ ID NO: 1236854 - DNA, 22 bp, Artificial Sequence
  chemically synthesized
actcagttctttgctcaggaat

SEQ ID NO: 1236855 - DNA, 22 bp, Artificial Sequence
  chemically synthesized
ttccttagtataattcctgagc

SEQ ID NO: 1236856 - DNA, 22 bp, Artificial Sequence
  chemically synthesized
ctcagttctttgctcaggaatt

SEQ ID NO: 1236857 - DNA, 22 bp, Artificial Sequence
  chemically synthesized
tttttccttagtataattcctg

SEQ ID NO: 1236858 - DNA, 22 bp, Artificial Sequence
  chemically synthesized
agttctttgctcaggaattata

SEQ ID NO: 1236859 - DNA, 22 bp, Artificial Sequence
  chemically synthesized
ttatttttccttagtataattc

SEQ ID NO: 1236860 - DNA, 22 bp, Artificial Sequence
  chemically synthesized
tttgctcaggaattatactaag

SEQ ID NO: 1236861 - DNA, 22 bp, Artificial Sequence
  chemically synthesized
actattatttttccttagtata

SEQ ID NO: 1236862 - DNA, 22 bp, Artificial Sequence
  chemically synthesized
tgctcaggaattatactaagga

SEQ ID NO: 1236863 - DNA, 22 bp, Artificial Sequence
  chemically synthesized
gctcaggaattatactaaggaa

SEQ ID NO: 1236864 - DNA, 22 bp, Artificial Sequence
  chemically synthesized
ctcaggaattatactaaggaaa

SEQ ID NO: 1236865 - DNA, 22 bp, Artificial Sequence
  chemically synthesized
ttgactattatttttccttagt

SEQ ID NO: 1236866 - DNA, 22 bp, Artificial Sequence
  chemically synthesized
attgactattatttttccttag

SEQ ID NO: 1236867 - DNA, 22 bp, Artificial Sequence
  chemically synthesized
aggaattatactaaggaaaaat

SEQ ID NO: 1236868 - DNA, 22 bp, Artificial Sequence
  chemically synthesized
tttattgactattatttttcct

SEQ ID NO: 1236869 - DNA, 22 bp, Artificial Sequence
  chemically synthesized
tactaaggaaaaataatagtca

SEQ ID NO: 1236870 - DNA, 22 bp, Artificial Sequence
  chemically synthesized
aatattatttattgactattat

SEQ ID NO: 1236871 - DNA, 22 bp, Artificial Sequence
  chemically synthesized
aggaaaaataatagtcaataaa

SEQ ID NO: 1236872 - DNA, 22 bp, Artificial Sequence
  chemically synthesized
aaaatgttaaatattatttatt

SEQ ID NO: 1236873 - DNA, 22 bp, Artificial Sequence
  chemically synthesized
cgttaaaaatgttaaatattat

SEQ ID NO: 1236874 - DNA, 22 bp, Artificial Sequence
  chemically synthesized
acgttaaaaatgttaaatatta

SEQ ID NO: 1236875 - DNA, 22 bp, Artificial Sequence
  chemically synthesized
atgagtatttacgttaaaaatg

SEQ ID NO: 1236876 - DNA, 22 bp, Artificial Sequence
  chemically synthesized
aacatttttaacgtaaatactc

SEQ ID NO: 1236877 - DNA, 22 bp, Artificial Sequence
  chemically synthesized
acatttttaacgtaaatactca

SEQ ID NO: 1236878 - DNA, 22 bp, Artificial Sequence
  chemically synthesized
atagtgtgtctcatgagtattt

SEQ ID NO: 1236879 - DNA, 22 bp, Artificial Sequence
  chemically synthesized
aatagtgtgtctcatgagtatt

SEQ ID NO: 1236880 - DNA, 22 bp, Artificial Sequence
  chemically synthesized
ttaacgtaaatactcatgagac

SEQ ID NO: 1236881 - DNA, 22 bp, Artificial Sequence
  chemically synthesized
atttaatagtgtgtctcatgag

SEQ ID NO: 1236882 - DNA, 22 bp, Artificial Sequence
  chemically synthesized
taacgtaaatactcatgagaca

SEQ ID NO: 1236883 - DNA, 22 bp, Artificial Sequence
  chemically synthesized
aacgtaaatactcatgagacac

SEQ ID NO: 1236884 - DNA, 22 bp, Artificial Sequence
  chemically synthesized
acgtaaatactcatgagacaca

SEQ ID NO: 1236885 - DNA, 22 bp, Artificial Sequence
  chemically synthesized
tgaaatccactcatttaatagt

SEQ ID NO: 1236886 - DNA, 22 bp, Artificial Sequence
  chemically synthesized
atgagacacactattaaatgag

SEQ ID NO: 1236887 - DNA, 22 bp, Artificial Sequence
  chemically synthesized
ttaaatgagtggatttcataac

SEQ ID NO: 1236888 - DNA, 22 bp, Artificial Sequence
  chemically synthesized
aatgagtggatttcataaccgt

SEQ ID NO: 1236889 - DNA, 22 bp, Artificial Sequence
  chemically synthesized
agaaatgccacaacggttatga

SEQ ID NO: 1236890 - DNA, 22 bp, Artificial Sequence
  chemically synthesized
atctcagaaatgccacaacggt

SEQ ID NO: 1236891 - DNA, 22 bp, Artificial Sequence
  chemically synthesized
ctaatctcagaaatgccacaac

SEQ ID NO: 1236892 - DNA, 22 bp, Artificial Sequence
  chemically synthesized
ctgctaatctcagaaatgccac

SEQ ID NO: 1236893 - DNA, 22 bp, Artificial Sequence
  chemically synthesized
cataaccgttgtggcatttctg

SEQ ID NO: 1236894 - DNA, 22 bp, Artificial Sequence
  chemically synthesized
ataaccgttgtggcatttctga

SEQ ID NO: 1236895 - DNA, 22 bp, Artificial Sequence
  chemically synthesized
agtatgttactgctaatctcag

SEQ ID NO: 1236896 - DNA, 22 bp, Artificial Sequence
  chemically synthesized
tggcatttctgagattagcagt

SEQ ID NO: 1236897 - DNA, 22 bp, Artificial Sequence
  chemically synthesized
gaggttaagtatgttactgcta

SEQ ID NO: 1236898 - DNA, 22 bp, Artificial Sequence
  chemically synthesized
agaggttaagtatgttactgct

SEQ ID NO: 1236899 - DNA, 22 bp, Artificial Sequence
  chemically synthesized
ctgagattagcagtaacatact

SEQ ID NO: 1236900 - DNA, 22 bp, Artificial Sequence
  chemically synthesized
tgagattagcagtaacatactt

SEQ ID NO: 1236901 - DNA, 22 bp, Artificial Sequence
  chemically synthesized
agattagcagtaacatacttaa

SEQ ID NO: 1236902 - DNA, 22 bp, Artificial Sequence
  chemically synthesized
catgagatacttagaggttaag

SEQ ID NO: 1236903 - DNA, 22 bp, Artificial Sequence
  chemically synthesized
gcagtaacatacttaacctcta

SEQ ID NO: 1236904 - DNA, 22 bp, Artificial Sequence
  chemically synthesized
acatgagatacttagaggttaa

SEQ ID NO: 1236905 - DNA, 22 bp, Artificial Sequence
  chemically synthesized
atcttacatgagatacttagag

SEQ ID NO: 1236906 - DNA, 22 bp, Artificial Sequence
  chemically synthesized
aacctctaagtatctcatgtaa

SEQ ID NO: 1236907 - DNA, 22 bp, Artificial Sequence
  chemically synthesized
acctctaagtatctcatgtaag

SEQ ID NO: 1236908 - DNA, 22 bp, Artificial Sequence
  chemically synthesized
taagtatctcatgtaagatgag

SEQ ID NO: 1236909 - DNA, 22 bp, Artificial Sequence
  chemically synthesized
agtatctcatgtaagatgagta

SEQ ID NO: 1236910 - DNA, 22 bp, Artificial Sequence
  chemically synthesized
atgacaaagagccacatactca

SEQ ID NO: 1236911 - DNA, 22 bp, Artificial Sequence
  chemically synthesized
catgacaaagagccacatactc

SEQ ID NO: 1236912 - DNA, 22 bp, Artificial Sequence
  chemically synthesized
atgtaagatgagtatgtggctc

SEQ ID NO: 1236913 - DNA, 22 bp, Artificial Sequence
  chemically synthesized
gtttcatgacaaagagccacat

SEQ ID NO: 1236914 - DNA, 22 bp, Artificial Sequence
  chemically synthesized
tagtttcatgacaaagagccac

SEQ ID NO: 1236915 - DNA, 22 bp, Artificial Sequence
  chemically synthesized
ccccattctagtttcatgacaa

SEQ ID NO: 1236916 - DNA, 22 bp, Artificial Sequence
  chemically synthesized
accccattctagtttcatgaca

SEQ ID NO: 1236917 - DNA, 22 bp, Artificial Sequence
  chemically synthesized
taccccattctagtttcatgac

SEQ ID NO: 1236918 - DNA, 22 bp, Artificial Sequence
  chemically synthesized
gctttaccccattctagtttca

SEQ ID NO: 1236919 - DNA, 22 bp, Artificial Sequence
  chemically synthesized
ggctttaccccattctagtttc

SEQ ID NO: 1236920 - DNA, 22 bp, Artificial Sequence
  chemically synthesized
tggctttaccccattctagttt

SEQ ID NO: 1236921 - DNA, 22 bp, Artificial Sequence
  chemically synthesized
tttgtcatgaaactagaatggg

SEQ ID NO: 1236922 - DNA, 22 bp, Artificial Sequence
  chemically synthesized
tgtcatgaaactagaatggggt

SEQ ID NO: 1236923 - DNA, 22 bp, Artificial Sequence
  chemically synthesized
gtcatgaaactagaatggggta

SEQ ID NO: 1236924 - DNA, 22 bp, Artificial Sequence
  chemically synthesized
tcatgaaactagaatggggtaa

SEQ ID NO: 1236925 - DNA, 22 bp, Artificial Sequence
  chemically synthesized
agccataattttggctttaccc

SEQ ID NO: 1236926 - DNA, 22 bp, Artificial Sequence
  chemically synthesized
gaatggggtaaagccaaaatta

SEQ ID NO: 1236927 - DNA, 22 bp, Artificial Sequence
  chemically synthesized
gacagatctgagccataatttt

SEQ ID NO: 1236928 - DNA, 22 bp, Artificial Sequence
  chemically synthesized
tggctcagatctgtctaattct

SEQ ID NO: 1236929 - DNA, 22 bp, Artificial Sequence
  chemically synthesized
aaagaacaagaacccagaatta

SEQ ID NO: 1236930 - DNA, 22 bp, Artificial Sequence
  chemically synthesized
agatctgtctaattctgggttc

SEQ ID NO: 1236931 - DNA, 22 bp, Artificial Sequence
  chemically synthesized
tctaattctgggttcttgttct

SEQ ID NO: 1236932 - DNA, 22 bp, Artificial Sequence
  chemically synthesized
attctgggttcttgttctttca

SEQ ID NO: 1236933 - DNA, 22 bp, Artificial Sequence
  chemically synthesized
tgggttcttgttctttcaatct

SEQ ID NO: 1236934 - DNA, 22 bp, Artificial Sequence
  chemically synthesized
ggttcttgttctttcaatctta

SEQ ID NO: 1236935 - DNA, 22 bp, Artificial Sequence
  chemically synthesized
ttgttctttcaatcttatgttg

SEQ ID NO: 1236936 - DNA, 22 bp, Artificial Sequence
  chemically synthesized
gttctttcaatcttatgttgct

SEQ ID NO: 1236937 - DNA, 22 bp, Artificial Sequence
  chemically synthesized
ttctttcaatcttatgttgctt

SEQ ID NO: 1236938 - DNA, 22 bp, Artificial Sequence
  chemically synthesized
taaaaggacaaggaagcaacat

SEQ ID NO: 1236939 - DNA, 22 bp, Artificial Sequence
  chemically synthesized
tttcaatcttatgttgcttcct

SEQ ID NO: 1236940 - DNA, 22 bp, Artificial Sequence
  chemically synthesized
tcaatcttatgttgcttccttg

SEQ ID NO: 1236941 - DNA, 22 bp, Artificial Sequence
  chemically synthesized
caatcttatgttgcttccttgt

SEQ ID NO: 1236942 - DNA, 22 bp, Artificial Sequence
  chemically synthesized
aatcttatgttgcttccttgtc

SEQ ID NO: 1236943 - DNA, 22 bp, Artificial Sequence
  chemically synthesized
atgttgcttccttgtcctttta

SEQ ID NO: 1236944 - DNA, 22 bp, Artificial Sequence
  chemically synthesized
tgttgcttccttgtccttttat

SEQ ID NO: 1236945 - DNA, 22 bp, Artificial Sequence
  chemically synthesized
cttccttgtccttttataacct

SEQ ID NO: 1236946 - DNA, 22 bp, Artificial Sequence
  chemically synthesized
ccttgtccttttataacctact

SEQ ID NO: 1236947 - DNA, 22 bp, Artificial Sequence
  chemically synthesized
cttgtccttttataacctacta

SEQ ID NO: 1236948 - DNA, 22 bp, Artificial Sequence
  chemically synthesized
gaaagataatcaaatagtaggt

SEQ ID NO: 1236949 - DNA, 22 bp, Artificial Sequence
  chemically synthesized
gtccttttataacctactattt

SEQ ID NO: 1236950 - DNA, 22 bp, Artificial Sequence
  chemically synthesized
tccttttataacctactatttg

SEQ ID NO: 1236951 - DNA, 22 bp, Artificial Sequence
  chemically synthesized
ttataacctactatttgattat

SEQ ID NO: 1236952 - DNA, 22 bp, Artificial Sequence
  chemically synthesized
tataacctactatttgattatc

SEQ ID NO: 1236953 - DNA, 22 bp, Artificial Sequence
  chemically synthesized
ataacctactatttgattatct

SEQ ID NO: 1236954 - DNA, 22 bp, Artificial Sequence
  chemically synthesized
taacctactatttgattatctt

SEQ ID NO: 1236955 - DNA, 22 bp, Artificial Sequence
  chemically synthesized
ctatttgattatctttctaaca

SEQ ID NO: 1236956 - DNA, 22 bp, Artificial Sequence
  chemically synthesized
tttgattatctttctaacattt

SEQ ID NO: 1236957 - DNA, 22 bp, Artificial Sequence
  chemically synthesized
gattatctttctaacatttgtc

SEQ ID NO: 1236958 - DNA, 22 bp, Artificial Sequence
  chemically synthesized
attatctttctaacatttgtct

SEQ ID NO: 1236959 - DNA, 22 bp, Artificial Sequence
  chemically synthesized
tctttctaacatttgtctttct

SEQ ID NO: 1236960 - DNA, 22 bp, Artificial Sequence
  chemically synthesized
gtgaagtatgacaaaagaaaga

SEQ ID NO: 1236961 - DNA, 22 bp, Artificial Sequence
  chemically synthesized
tctaacatttgtctttcttttg

SEQ ID NO: 1236962 - DNA, 22 bp, Artificial Sequence
  chemically synthesized
ggtgaagtatgacaaaagaaag

SEQ ID NO: 1236963 - DNA, 22 bp, Artificial Sequence
  chemically synthesized
ctaacatttgtctttcttttgt

SEQ ID NO: 1236964 - DNA, 22 bp, Artificial Sequence
  chemically synthesized
taacatttgtctttcttttgtc

SEQ ID NO: 1236965 - DNA, 22 bp, Artificial Sequence
  chemically synthesized
acatttgtctttcttttgtcat

SEQ ID NO: 1236966 - DNA, 22 bp, Artificial Sequence
  chemically synthesized
gtctttcttttgtcatacttca

SEQ ID NO: 1236967 - DNA, 22 bp, Artificial Sequence
  chemically synthesized
tctttcttttgtcatacttcac

SEQ ID NO: 1236968 - DNA, 22 bp, Artificial Sequence
  chemically synthesized
tcttttgtcatacttcaccaaa

SEQ ID NO: 1236969 - DNA, 22 bp, Artificial Sequence
  chemically synthesized
agcagaaaacgatttggtgaag

SEQ ID NO: 1236970 - DNA, 22 bp, Artificial Sequence
  chemically synthesized
cttttgtcatacttcaccaaat

SEQ ID NO: 1236971 - DNA, 22 bp, Artificial Sequence
  chemically synthesized
aagcagaaaacgatttggtgaa

SEQ ID NO: 1236972 - DNA, 22 bp, Artificial Sequence
  chemically synthesized
ttttgtcatacttcaccaaatc

SEQ ID NO: 1236973 - DNA, 22 bp, Artificial Sequence
  chemically synthesized
taagcagaaaacgatttggtga

SEQ ID NO: 1236974 - DNA, 22 bp, Artificial Sequence
  chemically synthesized
ttgtcatacttcaccaaatcgt

SEQ ID NO: 1236975 - DNA, 22 bp, Artificial Sequence
  chemically synthesized
tgtcatacttcaccaaatcgtt

SEQ ID NO: 1236976 - DNA, 22 bp, Artificial Sequence
  chemically synthesized
gtcatacttcaccaaatcgttt

SEQ ID NO: 1236977 - DNA, 22 bp, Artificial Sequence
  chemically synthesized
tcatacttcaccaaatcgtttt

SEQ ID NO: 1236978 - DNA, 22 bp, Artificial Sequence
  chemically synthesized
tagggttttaagcagaaaacga

SEQ ID NO: 1236979 - DNA, 22 bp, Artificial Sequence
  chemically synthesized
caccaaatcgttttctgcttaa

SEQ ID NO: 1236980 - DNA, 22 bp, Artificial Sequence
  chemically synthesized
accaaatcgttttctgcttaaa

SEQ ID NO: 1236981 - DNA, 22 bp, Artificial Sequence
  chemically synthesized
atgaggggattgtagggtttta

SEQ ID NO: 1236982 - DNA, 22 bp, Artificial Sequence
  chemically synthesized
cctcatgaggggattgtagggt

SEQ ID NO: 1236983 - DNA, 22 bp, Artificial Sequence
  chemically synthesized
tctgcttaaaaccctacaatcc

SEQ ID NO: 1236984 - DNA, 22 bp, Artificial Sequence
  chemically synthesized
ctgcttaaaaccctacaatccc

SEQ ID NO: 1236985 - DNA, 22 bp, Artificial Sequence
  chemically synthesized
tgcttaaaaccctacaatcccc

SEQ ID NO: 1236986 - DNA, 22 bp, Artificial Sequence
  chemically synthesized
cttaaaaccctacaatcccctc

SEQ ID NO: 1236987 - DNA, 22 bp, Artificial Sequence
  chemically synthesized
ggaattacctcatgaggggatt

SEQ ID NO: 1236988 - DNA, 22 bp, Artificial Sequence
  chemically synthesized
aaaaccctacaatcccctcatg

SEQ ID NO: 1236989 - DNA, 22 bp, Artificial Sequence
  chemically synthesized
aaaccctacaatcccctcatga

SEQ ID NO: 1236990 - DNA, 22 bp, Artificial Sequence
  chemically synthesized
caatcccctcatgaggtaattc

SEQ ID NO: 1236991 - DNA, 22 bp, Artificial Sequence
  chemically synthesized
atgaggtaattcccagcttttt

SEQ ID NO: 1236992 - DNA, 22 bp, Artificial Sequence
  chemically synthesized
cagataggtgatgaaaaagctg

SEQ ID NO: 1236993 - DNA, 22 bp, Artificial Sequence
  chemically synthesized
ccagataggtgatgaaaaagct

SEQ ID NO: 1236994 - DNA, 22 bp, Artificial Sequence
  chemically synthesized
gggatttccagataggtgatga

SEQ ID NO: 1236995 - DNA, 22 bp, Artificial Sequence
  chemically synthesized
ccagctttttcatcacctatct

SEQ ID NO: 1236996 - DNA, 22 bp, Artificial Sequence
  chemically synthesized
aattagggatttccagataggt

SEQ ID NO: 1236997 - DNA, 22 bp, Artificial Sequence
  chemically synthesized
attaaattagggatttccagat

SEQ ID NO: 1236998 - DNA, 22 bp, Artificial Sequence
  chemically synthesized
tttcatcacctatctggaaatc

SEQ ID NO: 1236999 - DNA, 22 bp, Artificial Sequence
  chemically synthesized
ttcatcacctatctggaaatcc

SEQ ID NO: 1237000 - DNA, 22 bp, Artificial Sequence
  chemically synthesized
tcatcacctatctggaaatccc

SEQ ID NO: 1237001 - DNA, 22 bp, Artificial Sequence
  chemically synthesized
catcacctatctggaaatccct

SEQ ID NO: 1237002 - DNA, 22 bp, Artificial Sequence
  chemically synthesized
actgattaaattagggatttcc

SEQ ID NO: 1237003 - DNA, 22 bp, Artificial Sequence
  chemically synthesized
atcacctatctggaaatcccta

SEQ ID NO: 1237004 - DNA, 22 bp, Artificial Sequence
  chemically synthesized
gactgattaaattagggatttc

SEQ ID NO: 1237005 - DNA, 22 bp, Artificial Sequence
  chemically synthesized
tgactgattaaattagggattt

SEQ ID NO: 1237006 - DNA, 22 bp, Artificial Sequence
  chemically synthesized
tctggaaatccctaatttaatc

SEQ ID NO: 1237007 - DNA, 22 bp, Artificial Sequence
  chemically synthesized
aatatgtctttgactgattaaa

SEQ ID NO: 1237008 - DNA, 22 bp, Artificial Sequence
  chemically synthesized
gaaatccctaatttaatcagtc

SEQ ID NO: 1237009 - DNA, 22 bp, Artificial Sequence
  chemically synthesized
atgctcaatatgtctttgactg

SEQ ID NO: 1237010 - DNA, 22 bp, Artificial Sequence
  chemically synthesized
ttcatgctcaatatgtctttga

SEQ ID NO: 1237011 - DNA, 22 bp, Artificial Sequence
  chemically synthesized
attcatgctcaatatgtctttg

SEQ ID NO: 1237012 - DNA, 22 bp, Artificial Sequence
  chemically synthesized
atttaatcagtcaaagacatat

SEQ ID NO: 1237013 - DNA, 22 bp, Artificial Sequence
  chemically synthesized
aatcagtcaaagacatattgag

SEQ ID NO: 1237014 - DNA, 22 bp, Artificial Sequence
  chemically synthesized
atcagtcaaagacatattgagc

SEQ ID NO: 1237015 - DNA, 22 bp, Artificial Sequence
  chemically synthesized
aggtttattcatgctcaatatg

SEQ ID NO: 1237016 - DNA, 22 bp, Artificial Sequence
  chemically synthesized
gctcaggtttattcatgctcaa

SEQ ID NO: 1237017 - DNA, 22 bp, Artificial Sequence
  chemically synthesized
agtacctagctcaggtttattc

SEQ ID NO: 1237018 - DNA, 22 bp, Artificial Sequence
  chemically synthesized
agcatgaataaacctgagctag

SEQ ID NO: 1237019 - DNA, 22 bp, Artificial Sequence
  chemically synthesized
gcatatgattcagtacctagct

SEQ ID NO: 1237020 - DNA, 22 bp, Artificial Sequence
  chemically synthesized
atgtactagcatatgattcagt

SEQ ID NO: 1237021 - DNA, 22 bp, Artificial Sequence
  chemically synthesized
agctaggtactgaatcatatgc

SEQ ID NO: 1237022 - DNA, 22 bp, Artificial Sequence
  chemically synthesized
tgtctgatgtactagcatatga

SEQ ID NO: 1237023 - DNA, 22 bp, Artificial Sequence
  chemically synthesized
ggtactgaatcatatgctagta

SEQ ID NO: 1237024 - DNA, 22 bp, Artificial Sequence
  chemically synthesized
ggcctatgtctgatgtactagc

SEQ ID NO: 1237025 - DNA, 22 bp, Artificial Sequence
  chemically synthesized
aatcatatgctagtacatcaga

SEQ ID NO: 1237026 - DNA, 22 bp, Artificial Sequence
  chemically synthesized
tagggtctgggcctatgtctga

SEQ ID NO: 1237027 - DNA, 22 bp, Artificial Sequence
  chemically synthesized
tatagggtctgggcctatgtct

SEQ ID NO: 1237028 - DNA, 22 bp, Artificial Sequence
  chemically synthesized
gtacatcagacataggcccaga

SEQ ID NO: 1237029 - DNA, 22 bp, Artificial Sequence
  chemically synthesized
agttctatagggtctgggccta

SEQ ID NO: 1237030 - DNA, 22 bp, Artificial Sequence
  chemically synthesized
taagttctatagggtctgggcc

SEQ ID NO: 1237031 - DNA, 22 bp, Artificial Sequence
  chemically synthesized
gactctaagttctatagggtct

SEQ ID NO: 1237032 - DNA, 22 bp, Artificial Sequence
  chemically synthesized
ctggactctaagttctataggg

SEQ ID NO: 1237033 - DNA, 22 bp, Artificial Sequence
  chemically synthesized
gctggactctaagttctatagg

SEQ ID NO: 1237034 - DNA, 22 bp, Artificial Sequence
  chemically synthesized
tgctggactctaagttctatag

SEQ ID NO: 1237035 - DNA, 22 bp, Artificial Sequence
  chemically synthesized
tttgctggactctaagttctat

SEQ ID NO: 1237036 - DNA, 22 bp, Artificial Sequence
  chemically synthesized
ctttgctggactctaagttcta

SEQ ID NO: 1237037 - DNA, 22 bp, Artificial Sequence
  chemically synthesized
tctttgctggactctaagttct

SEQ ID NO: 1237038 - DNA, 22 bp, Artificial Sequence
  chemically synthesized
ggaatattttctttgctggact

SEQ ID NO: 1237039 - DNA, 22 bp, Artificial Sequence
  chemically synthesized
aggaatattttctttgctggac

SEQ ID NO: 1237040 - DNA, 22 bp, Artificial Sequence
  chemically synthesized
tagaacttagagtccagcaaag

SEQ ID NO: 1237041 - DNA, 22 bp, Artificial Sequence
  chemically synthesized
taggaatattttctttgctgga

SEQ ID NO: 1237042 - DNA, 22 bp, Artificial Sequence
  chemically synthesized
ttaggaatattttctttgctgg

SEQ ID NO: 1237043 - DNA, 22 bp, Artificial Sequence
  chemically synthesized
agagtccagcaaagaaaatatt

SEQ ID NO: 1237044 - DNA, 22 bp, Artificial Sequence
  chemically synthesized
gagtccagcaaagaaaatattc

SEQ ID NO: 1237045 - DNA, 22 bp, Artificial Sequence
  chemically synthesized
tgtaatagtaccttttaggaat

SEQ ID NO: 1237046 - DNA, 22 bp, Artificial Sequence
  chemically synthesized
tatgtaatagtaccttttagga

SEQ ID NO: 1237047 - DNA, 22 bp, Artificial Sequence
  chemically synthesized
ctatgtaatagtaccttttagg

SEQ ID NO: 1237048 - DNA, 22 bp, Artificial Sequence
  chemically synthesized
atgcttctatgtaatagtacct

SEQ ID NO: 1237049 - DNA, 22 bp, Artificial Sequence
  chemically synthesized
taatgcttctatgtaatagtac

SEQ ID NO: 1237050 - DNA, 22 bp, Artificial Sequence
  chemically synthesized
ctaatgcttctatgtaatagta

SEQ ID NO: 1237051 - DNA, 22 bp, Artificial Sequence
  chemically synthesized
tctaatgcttctatgtaatagt

SEQ ID NO: 1237052 - DNA, 22 bp, Artificial Sequence
  chemically synthesized
ctaaaaggtactattacataga

SEQ ID NO: 1237053 - DNA, 22 bp, Artificial Sequence
  chemically synthesized
aaaggtactattacatagaagc

SEQ ID NO: 1237054 - DNA, 22 bp, Artificial Sequence
  chemically synthesized
gtcctttctaatgcttctatgt

SEQ ID NO: 1237055 - DNA, 22 bp, Artificial Sequence
  chemically synthesized
agtcctttctaatgcttctatg

SEQ ID NO: 1237056 - DNA, 22 bp, Artificial Sequence
  chemically synthesized
tagtcctttctaatgcttctat

SEQ ID NO: 1237057 - DNA, 22 bp, Artificial Sequence
  chemically synthesized
tttagtcctttctaatgcttct

SEQ ID NO: 1237058 - DNA, 22 bp, Artificial Sequence
  chemically synthesized
ttacatagaagcattagaaagg

SEQ ID NO: 1237059 - DNA, 22 bp, Artificial Sequence
  chemically synthesized
catgttctttagtcctttctaa

SEQ ID NO: 1237060 - DNA, 22 bp, Artificial Sequence
  chemically synthesized
catagaagcattagaaaggact

SEQ ID NO: 1237061 - DNA, 22 bp, Artificial Sequence
  chemically synthesized
ttacatgttctttagtcctttc

SEQ ID NO: 1237062 - DNA, 22 bp, Artificial Sequence
  chemically synthesized
ccactgttacatgttctttagt

SEQ ID NO: 1237063 - DNA, 22 bp, Artificial Sequence
  chemically synthesized
gaaaggactaaagaacatgtaa

SEQ ID NO: 1237064 - DNA, 22 bp, Artificial Sequence
  chemically synthesized
tgagagctcccactgttacatg

SEQ ID NO: 1237065 - DNA, 22 bp, Artificial Sequence
  chemically synthesized
gtgagagctcccactgttacat

SEQ ID NO: 1237066 - DNA, 22 bp, Artificial Sequence
  chemically synthesized
aagaacatgtaacagtgggagc

SEQ ID NO: 1237067 - DNA, 22 bp, Artificial Sequence
  chemically synthesized
atcccaaggcttgtgagagctc

SEQ ID NO: 1237068 - DNA, 22 bp, Artificial Sequence
  chemically synthesized
ttgatcccaaggcttgtgagag

SEQ ID NO: 1237069 - DNA, 22 bp, Artificial Sequence
  chemically synthesized
gttgatcccaaggcttgtgaga

SEQ ID NO: 1237070 - DNA, 22 bp, Artificial Sequence
  chemically synthesized
gaaagtatttgttgatcccaag

SEQ ID NO: 1237071 - DNA, 22 bp, Artificial Sequence
  chemically synthesized
ggaaagtatttgttgatcccaa

SEQ ID NO: 1237072 - DNA, 22 bp, Artificial Sequence
  chemically synthesized
tggaaagtatttgttgatccca

SEQ ID NO: 1237073 - DNA, 22 bp, Artificial Sequence
  chemically synthesized
ttggaaagtatttgttgatccc

SEQ ID NO: 1237074 - DNA, 22 bp, Artificial Sequence
  chemically synthesized
tcacaagccttgggatcaacaa

SEQ ID NO: 1237075 - DNA, 22 bp, Artificial Sequence
  chemically synthesized
tttggaaagtatttgttgatcc

SEQ ID NO: 1237076 - DNA, 22 bp, Artificial Sequence
  chemically synthesized
acaagccttgggatcaacaaat

SEQ ID NO: 1237077 - DNA, 22 bp, Artificial Sequence
  chemically synthesized
acgttttttggaaagtatttgt

SEQ ID NO: 1237078 - DNA, 22 bp, Artificial Sequence
  chemically synthesized
gggatcaacaaatactttccaa

SEQ ID NO: 1237079 - DNA, 22 bp, Artificial Sequence
  chemically synthesized
ggatcaacaaatactttccaaa

SEQ ID NO: 1237080 - DNA, 22 bp, Artificial Sequence
  chemically synthesized
gacccatcacctgacgtttttt

SEQ ID NO: 1237081 - DNA, 22 bp, Artificial Sequence
  chemically synthesized
atgttagacccatcacctgacg

SEQ ID NO: 1237082 - DNA, 22 bp, Artificial Sequence
  chemically synthesized
tccaaaaaacgtcaggtgatgg

SEQ ID NO: 1237083 - DNA, 22 bp, Artificial Sequence
  chemically synthesized
ccaaaaaacgtcaggtgatggg

SEQ ID NO: 1237084 - DNA, 22 bp, Artificial Sequence
  chemically synthesized
caaaaaacgtcaggtgatgggt

SEQ ID NO: 1237085 - DNA, 22 bp, Artificial Sequence
  chemically synthesized
acattagcctttgggtgactgt

SEQ ID NO: 1237086 - DNA, 22 bp, Artificial Sequence
  chemically synthesized
gcctttgggtgactgtgctctt

SEQ ID NO: 1237087 - DNA, 22 bp, Artificial Sequence
  chemically synthesized
tgggtgactgtgctctttacat

SEQ ID NO: 1237088 - DNA, 22 bp, Artificial Sequence
  chemically synthesized
gggtgactgtgctctttacata

SEQ ID NO: 1237089 - DNA, 22 bp, Artificial Sequence
  chemically synthesized
ggtgactgtgctctttacatac

SEQ ID NO: 1237090 - DNA, 22 bp, Artificial Sequence
  chemically synthesized
tatgtgatccaaggagtgtatg

SEQ ID NO: 1237091 - DNA, 22 bp, Artificial Sequence
  chemically synthesized
atatgtgatccaaggagtgtat

SEQ ID NO: 1237092 - DNA, 22 bp, Artificial Sequence
  chemically synthesized
tgctctttacatacactccttg

SEQ ID NO: 1237093 - DNA, 22 bp, Artificial Sequence
  chemically synthesized
tttacatacactccttggatca

SEQ ID NO: 1237094 - DNA, 22 bp, Artificial Sequence
  chemically synthesized
aaagtttatatgtgatccaagg

SEQ ID NO: 1237095 - DNA, 22 bp, Artificial Sequence
  chemically synthesized
tacatacactccttggatcaca

SEQ ID NO: 1237096 - DNA, 22 bp, Artificial Sequence
  chemically synthesized
acatacactccttggatcacat

SEQ ID NO: 1237097 - DNA, 22 bp, Artificial Sequence
  chemically synthesized
catacactccttggatcacata

SEQ ID NO: 1237098 - DNA, 22 bp, Artificial Sequence
  chemically synthesized
tgtgaaattcaaagtttatatg

SEQ ID NO: 1237099 - DNA, 22 bp, Artificial Sequence
  chemically synthesized
gtgtgaaattcaaagtttatat

SEQ ID NO: 1237100 - DNA, 22 bp, Artificial Sequence
  chemically synthesized
cttggatcacatataaactttg

SEQ ID NO: 1237101 - DNA, 22 bp, Artificial Sequence
  chemically synthesized
acttgtgtgaaattcaaagttt

SEQ ID NO: 1237102 - DNA, 22 bp, Artificial Sequence
  chemically synthesized
ggatcacatataaactttgaat

SEQ ID NO: 1237103 - DNA, 22 bp, Artificial Sequence
  chemically synthesized
gacttgtgtgaaattcaaagtt

SEQ ID NO: 1237104 - DNA, 22 bp, Artificial Sequence
  chemically synthesized
gatcacatataaactttgaatt

SEQ ID NO: 1237105 - DNA, 22 bp, Artificial Sequence
  chemically synthesized
ttgacttgtgtgaaattcaaag

SEQ ID NO: 1237106 - DNA, 22 bp, Artificial Sequence
  chemically synthesized
cttgacttgtgtgaaattcaaa

SEQ ID NO: 1237107 - DNA, 22 bp, Artificial Sequence
  chemically synthesized
tcttgacttgtgtgaaattcaa

SEQ ID NO: 1237108 - DNA, 22 bp, Artificial Sequence
  chemically synthesized
tgaatttcacacaagtcaagaa

SEQ ID NO: 1237109 - DNA, 22 bp, Artificial Sequence
  chemically synthesized
gaatttcacacaagtcaagaaa

SEQ ID NO: 1237110 - DNA, 22 bp, Artificial Sequence
  chemically synthesized
gaaaccagggattttcttgact

SEQ ID NO: 1237111 - DNA, 22 bp, Artificial Sequence
  chemically synthesized
aatttcacacaagtcaagaaaa

SEQ ID NO: 1237112 - DNA, 22 bp, Artificial Sequence
  chemically synthesized
cctggaaaccagggattttctt

SEQ ID NO: 1237113 - DNA, 22 bp, Artificial Sequence
  chemically synthesized
gcctggaaaccagggattttct

SEQ ID NO: 1237114 - DNA, 22 bp, Artificial Sequence
  chemically synthesized
cacacaagtcaagaaaatccct

SEQ ID NO: 1237115 - DNA, 22 bp, Artificial Sequence
  chemically synthesized
tgcctggaaaccagggattttc

SEQ ID NO: 1237116 - DNA, 22 bp, Artificial Sequence
  chemically synthesized
acacaagtcaagaaaatccctg

SEQ ID NO: 1237117 - DNA, 22 bp, Artificial Sequence
  chemically synthesized
ttgcctggaaaccagggatttt

SEQ ID NO: 1237118 - DNA, 22 bp, Artificial Sequence
  chemically synthesized
agggatgtcttttgcctggaaa

SEQ ID NO: 1237119 - DNA, 22 bp, Artificial Sequence
  chemically synthesized
aagggatgtcttttgcctggaa

SEQ ID NO: 1237120 - DNA, 22 bp, Artificial Sequence
  chemically synthesized
gtttccaggcaaaagacatccc

SEQ ID NO: 1237121 - DNA, 22 bp, Artificial Sequence
  chemically synthesized
atcgtggaagtttaagggatgt

SEQ ID NO: 1237122 - DNA, 22 bp, Artificial Sequence
  chemically synthesized
ccaggcaaaagacatcccttaa

SEQ ID NO: 1237123 - DNA, 22 bp, Artificial Sequence
  chemically synthesized
aatcgtggaagtttaagggatg

SEQ ID NO: 1237124 - DNA, 22 bp, Artificial Sequence
  chemically synthesized
caggcaaaagacatcccttaaa

SEQ ID NO: 1237125 - DNA, 22 bp, Artificial Sequence
  chemically synthesized
taatcgtggaagtttaagggat

SEQ ID NO: 1237126 - DNA, 22 bp, Artificial Sequence
  chemically synthesized
ttaatcgtggaagtttaaggga

SEQ ID NO: 1237127 - DNA, 22 bp, Artificial Sequence
  chemically synthesized
tgtttttaatcgtggaagttta

SEQ ID NO: 1237128 - DNA, 22 bp, Artificial Sequence
  chemically synthesized
aatcctatgtttttaatcgtgg

SEQ ID NO: 1237129 - DNA, 22 bp, Artificial Sequence
  chemically synthesized
aaacttccacgattaaaaacat

SEQ ID NO: 1237130 - DNA, 22 bp, Artificial Sequence
  chemically synthesized
aacttccacgattaaaaacata

SEQ ID NO: 1237131 - DNA, 22 bp, Artificial Sequence
  chemically synthesized
ccacgattaaaaacataggatt

SEQ ID NO: 1237132 - DNA, 22 bp, Artificial Sequence
  chemically synthesized
cacgattaaaaacataggattt

SEQ ID NO: 1237133 - DNA, 22 bp, Artificial Sequence
  chemically synthesized
taggaatagtctaaatcctatg

SEQ ID NO: 1237134 - DNA, 22 bp, Artificial Sequence
  chemically synthesized
gttgtaggaatagtctaaatcc

SEQ ID NO: 1237135 - DNA, 22 bp, Artificial Sequence
  chemically synthesized
aaaacataggatttagactatt

SEQ ID NO: 1237136 - DNA, 22 bp, Artificial Sequence
  chemically synthesized
cctggttgtaggaatagtctaa

SEQ ID NO: 1237137 - DNA, 22 bp, Artificial Sequence
  chemically synthesized
acatggctacctggttgtagga

SEQ ID NO: 1237138 - DNA, 22 bp, Artificial Sequence
  chemically synthesized
agactattcctacaaccaggta

SEQ ID NO: 1237139 - DNA, 22 bp, Artificial Sequence
  chemically synthesized
gactattcctacaaccaggtag

SEQ ID NO: 1237140 - DNA, 22 bp, Artificial Sequence
  chemically synthesized
tcattgacatggctacctggtt

SEQ ID NO: 1237141 - DNA, 22 bp, Artificial Sequence
  chemically synthesized
gtcattgacatggctacctggt

SEQ ID NO: 1237142 - DNA, 22 bp, Artificial Sequence
  chemically synthesized
ttcctacaaccaggtagccatg

SEQ ID NO: 1237143 - DNA, 22 bp, Artificial Sequence
  chemically synthesized
ctacaaccaggtagccatgtca

SEQ ID NO: 1237144 - DNA, 22 bp, Artificial Sequence
  chemically synthesized
caggtcttgtcattgacatggc

SEQ ID NO: 1237145 - DNA, 22 bp, Artificial Sequence
  chemically synthesized
acaggtcttgtcattgacatgg

SEQ ID NO: 1237146 - DNA, 22 bp, Artificial Sequence
  chemically synthesized
caaccaggtagccatgtcaatg

SEQ ID NO: 1237147 - DNA, 22 bp, Artificial Sequence
  chemically synthesized
aagtacccgggcatttacaggt

SEQ ID NO: 1237148 - DNA, 22 bp, Artificial Sequence
  chemically synthesized
gaagtacccgggcatttacagg

SEQ ID NO: 1237149 - DNA, 22 bp, Artificial Sequence
  chemically synthesized
cttgaagtacccgggcatttac

SEQ ID NO: 1237150 - DNA, 22 bp, Artificial Sequence
  chemically synthesized
cctgcttgaagtacccgggcat

SEQ ID NO: 1237151 - DNA, 22 bp, Artificial Sequence
  chemically synthesized
ttccctgcttgaagtacccggg

SEQ ID NO: 1237152 - DNA, 22 bp, Artificial Sequence
  chemically synthesized
taaatgcccgggtacttcaagc

SEQ ID NO: 1237153 - DNA, 22 bp, Artificial Sequence
  chemically synthesized
ccgcaggtatcattgttccctg

SEQ ID NO: 1237154 - DNA, 22 bp, Artificial Sequence
  chemically synthesized
gttgccgcaggtatcattgttc

SEQ ID NO: 1237155 - DNA, 22 bp, Artificial Sequence
  chemically synthesized
caagcagggaacaatgatacct

SEQ ID NO: 1237156 - DNA, 22 bp, Artificial Sequence
  chemically synthesized
gttggttgccgcaggtatcatt

SEQ ID NO: 1237157 - DNA, 22 bp, Artificial Sequence
  chemically synthesized
aagcagggaacaatgatacctg

SEQ ID NO: 1237158 - DNA, 22 bp, Artificial Sequence
  chemically synthesized
ggcacacagggactggttggtt

SEQ ID NO: 1237159 - DNA, 22 bp, Artificial Sequence
  chemically synthesized
cggcaaccaaccagtccctgtg

SEQ ID NO: 1237160 - DNA, 22 bp, Artificial Sequence
  chemically synthesized
acaaagctgggcacacagggac

SEQ ID NO: 1237161 - DNA, 22 bp, Artificial Sequence
  chemically synthesized
gattcacaaagctgggcacaca

SEQ ID NO: 1237162 - DNA, 22 bp, Artificial Sequence
  chemically synthesized
tgtgcccagctttgtgaatcca

SEQ ID NO: 1237163 - DNA, 22 bp, Artificial Sequence
  chemically synthesized
agtatatatgtggctggattca

SEQ ID NO: 1237164 - DNA, 22 bp, Artificial Sequence
  chemically synthesized
tctaagtatatatgtggctgga

SEQ ID NO: 1237165 - DNA, 22 bp, Artificial Sequence
  chemically synthesized
gtctaagtatatatgtggctgg

SEQ ID NO: 1237166 - DNA, 22 bp, Artificial Sequence
  chemically synthesized
tgtctaagtatatatgtggctg

SEQ ID NO: 1237167 - DNA, 22 bp, Artificial Sequence
  chemically synthesized
ttgtctaagtatatatgtggct

SEQ ID NO: 1237168 - DNA, 22 bp, Artificial Sequence
  chemically synthesized
tgtgaatccagccacatatata

SEQ ID NO: 1237169 - DNA, 22 bp, Artificial Sequence
  chemically synthesized
gtgaatccagccacatatatac

SEQ ID NO: 1237170 - DNA, 22 bp, Artificial Sequence
  chemically synthesized
tgaatccagccacatatatact

SEQ ID NO: 1237171 - DNA, 22 bp, Artificial Sequence
  chemically synthesized
ataatttttgtctaagtatata

SEQ ID NO: 1237172 - DNA, 22 bp, Artificial Sequence
  chemically synthesized
aaaagaataactcataattttt

SEQ ID NO: 1237173 - DNA, 22 bp, Artificial Sequence
  chemically synthesized
caaaagaataactcataatttt

SEQ ID NO: 1237174 - DNA, 22 bp, Artificial Sequence
  chemically synthesized
agacaaaaattatgagttattc

SEQ ID NO: 1237175 - DNA, 22 bp, Artificial Sequence
  chemically synthesized
gacaaaaattatgagttattct

SEQ ID NO: 1237176 - DNA, 22 bp, Artificial Sequence
  chemically synthesized
agtagaatttcaaaagaataac

SEQ ID NO: 1237177 - DNA, 22 bp, Artificial Sequence
  chemically synthesized
gagtagaatttcaaaagaataa

SEQ ID NO: 1237178 - DNA, 22 bp, Artificial Sequence
  chemically synthesized
tttgagtagaatttcaaaagaa

SEQ ID NO: 1237179 - DNA, 22 bp, Artificial Sequence
  chemically synthesized
tgagttattcttttgaaattct

SEQ ID NO: 1237180 - DNA, 22 bp, Artificial Sequence
  chemically synthesized
ttcttttgaaattctactcaaa

SEQ ID NO: 1237181 - DNA, 22 bp, Artificial Sequence
  chemically synthesized
aaaatggatctatttgagtaga

SEQ ID NO: 1237182 - DNA, 22 bp, Artificial Sequence
  chemically synthesized
gaaaatggatctatttgagtag

SEQ ID NO: 1237183 - DNA, 22 bp, Artificial Sequence
  chemically synthesized
ttttgaaattctactcaaatag

SEQ ID NO: 1237184 - DNA, 22 bp, Artificial Sequence
  chemically synthesized
ttgaaattctactcaaatagat

SEQ ID NO: 1237185 - DNA, 22 bp, Artificial Sequence
  chemically synthesized
tgaaattctactcaaatagatc

SEQ ID NO: 1237186 - DNA, 22 bp, Artificial Sequence
  chemically synthesized
gaaattctactcaaatagatcc

SEQ ID NO: 1237187 - DNA, 22 bp, Artificial Sequence
  chemically synthesized
aaattctactcaaatagatcca

SEQ ID NO: 1237188 - DNA, 22 bp, Artificial Sequence
  chemically synthesized
ccatggaatttgaaaatggatc

SEQ ID NO: 1237189 - DNA, 22 bp, Artificial Sequence
  chemically synthesized
cccatggaatttgaaaatggat

SEQ ID NO: 1237190 - DNA, 22 bp, Artificial Sequence
  chemically synthesized
tactcaaatagatccattttca

SEQ ID NO: 1237191 - DNA, 22 bp, Artificial Sequence
  chemically synthesized
tcccatggaatttgaaaatgga

SEQ ID NO: 1237192 - DNA, 22 bp, Artificial Sequence
  chemically synthesized
ttcccatggaatttgaaaatgg

SEQ ID NO: 1237193 - DNA, 22 bp, Artificial Sequence
  chemically synthesized
ctcaaatagatccattttcaaa

SEQ ID NO: 1237194 - DNA, 22 bp, Artificial Sequence
  chemically synthesized
tttcccatggaatttgaaaatg

SEQ ID NO: 1237195 - DNA, 22 bp, Artificial Sequence
  chemically synthesized
tttttcccatggaatttgaaaa

SEQ ID NO: 1237196 - DNA, 22 bp, Artificial Sequence
  chemically synthesized
aaatagatccattttcaaattc

SEQ ID NO: 1237197 - DNA, 22 bp, Artificial Sequence
  chemically synthesized
tgttctttttcccatggaattt

SEQ ID NO: 1237198 - DNA, 22 bp, Artificial Sequence
  chemically synthesized
tgttatgttctttttcccatgg

SEQ ID NO: 1237199 - DNA, 22 bp, Artificial Sequence
  chemically synthesized
gtgttatgttctttttcccatg

SEQ ID NO: 1237200 - DNA, 22 bp, Artificial Sequence
  chemically synthesized
tgtgttatgttctttttcccat

SEQ ID NO: 1237201 - DNA, 22 bp, Artificial Sequence
  chemically synthesized
tcaaattccatgggaaaaagaa

SEQ ID NO: 1237202 - DNA, 22 bp, Artificial Sequence
  chemically synthesized
caaattccatgggaaaaagaac

SEQ ID NO: 1237203 - DNA, 22 bp, Artificial Sequence
  chemically synthesized
aaattccatgggaaaaagaaca

SEQ ID NO: 1237204 - DNA, 22 bp, Artificial Sequence
  chemically synthesized
gggttttgtgttatgttctttt

SEQ ID NO: 1237205 - DNA, 22 bp, Artificial Sequence
  chemically synthesized
catgggaaaaagaacataacac

SEQ ID NO: 1237206 - DNA, 22 bp, Artificial Sequence
  chemically synthesized
gcatgttagggttttgtgttat

SEQ ID NO: 1237207 - DNA, 22 bp, Artificial Sequence
  chemically synthesized
tagcatgttagggttttgtgtt

SEQ ID NO: 1237208 - DNA, 22 bp, Artificial Sequence
  chemically synthesized
aaaattctagcatgttagggtt

SEQ ID NO: 1237209 - DNA, 22 bp, Artificial Sequence
  chemically synthesized
aaaaattctagcatgttagggt

SEQ ID NO: 1237210 - DNA, 22 bp, Artificial Sequence
  chemically synthesized
taaaaattctagcatgttaggg

SEQ ID NO: 1237211 - DNA, 22 bp, Artificial Sequence
  chemically synthesized
tttaaaaattctagcatgttag

SEQ ID NO: 1237212 - DNA, 22 bp, Artificial Sequence
  chemically synthesized
ttctttaaaaattctagcatgt

SEQ ID NO: 1237213 - DNA, 22 bp, Artificial Sequence
  chemically synthesized
gtaaagctattctttaaaaatt

SEQ ID NO: 1237214 - DNA, 22 bp, Artificial Sequence
  chemically synthesized
acatgctagaatttttaaagaa

SEQ ID NO: 1237215 - DNA, 22 bp, Artificial Sequence
  chemically synthesized
ctagtaaagctattctttaaaa

SEQ ID NO: 1237216 - DNA, 22 bp, Artificial Sequence
  chemically synthesized
cctcctagtaaagctattcttt

SEQ ID NO: 1237217 - DNA, 22 bp, Artificial Sequence
  chemically synthesized
gaatttttaaagaatagcttta

SEQ ID NO: 1237218 - DNA, 22 bp, Artificial Sequence
  chemically synthesized
cctccctcctagtaaagctatt

SEQ ID NO: 1237219 - DNA, 22 bp, Artificial Sequence
  chemically synthesized
tgcctccctcctagtaaagcta

SEQ ID NO: 1237220 - DNA, 22 bp, Artificial Sequence
  chemically synthesized
ttctgcctccctcctagtaaag

SEQ ID NO: 1237221 - DNA, 22 bp, Artificial Sequence
  chemically synthesized
ttaaagaatagctttactagga

SEQ ID NO: 1237222 - DNA, 22 bp, Artificial Sequence
  chemically synthesized
gttctgcctccctcctagtaaa

SEQ ID NO: 1237223 - DNA, 22 bp, Artificial Sequence
  chemically synthesized
taaagaatagctttactaggag

SEQ ID NO: 1237224 - DNA, 22 bp, Artificial Sequence
  chemically synthesized
aaagaatagctttactaggagg

SEQ ID NO: 1237225 - DNA, 22 bp, Artificial Sequence
  chemically synthesized
aagaatagctttactaggaggg

SEQ ID NO: 1237226 - DNA, 22 bp, Artificial Sequence
  chemically synthesized
accgtcttgttctgcctccctc

SEQ ID NO: 1237227 - DNA, 22 bp, Artificial Sequence
  chemically synthesized
gaccgtcttgttctgcctccct

SEQ ID NO: 1237228 - DNA, 22 bp, Artificial Sequence
  chemically synthesized
tactaggagggaggcagaacaa

SEQ ID NO: 1237229 - DNA, 22 bp, Artificial Sequence
  chemically synthesized
actaggagggaggcagaacaag

SEQ ID NO: 1237230 - DNA, 22 bp, Artificial Sequence
  chemically synthesized
ctaggagggaggcagaacaaga

SEQ ID NO: 1237231 - DNA, 22 bp, Artificial Sequence
  chemically synthesized
catgtatttgaccgtcttgttc

SEQ ID NO: 1237232 - DNA, 22 bp, Artificial Sequence
  chemically synthesized
ggagggaggcagaacaagacgg

SEQ ID NO: 1237233 - DNA, 22 bp, Artificial Sequence
  chemically synthesized
gaaggttccatgtatttgaccg

SEQ ID NO: 1237234 - DNA, 22 bp, Artificial Sequence
  chemically synthesized
ctggaaggttccatgtatttga

SEQ ID NO: 1237235 - DNA, 22 bp, Artificial Sequence
  chemically synthesized
tagcagcggtagcgggaaagat

SEQ ID NO: 1237236 - DNA, 22 bp, Artificial Sequence
  chemically synthesized
tatagcagcggtagcgggaaag

SEQ ID NO: 1237237 - DNA, 22 bp, Artificial Sequence
  chemically synthesized
ccagcaatcatctttcccgcta

SEQ ID NO: 1237238 - DNA, 22 bp, Artificial Sequence
  chemically synthesized
ctatagcagcggtagcgggaaa

SEQ ID NO: 1237239 - DNA, 22 bp, Artificial Sequence
  chemically synthesized
cagcaatcatctttcccgctac

SEQ ID NO: 1237240 - DNA, 22 bp, Artificial Sequence
  chemically synthesized
gtgtttctatagcagcggtagc

SEQ ID NO: 1237241 - DNA, 22 bp, Artificial Sequence
  chemically synthesized
ggtgtttctatagcagcggtag

SEQ ID NO: 1237242 - DNA, 22 bp, Artificial Sequence
  chemically synthesized
agtttggtgtttctatagcagc

SEQ ID NO: 1237243 - DNA, 22 bp, Artificial Sequence
  chemically synthesized
tcccgctaccgctgctatagaa

SEQ ID NO: 1237244 - DNA, 22 bp, Artificial Sequence
  chemically synthesized
cccgctaccgctgctatagaaa

SEQ ID NO: 1237245 - DNA, 22 bp, Artificial Sequence
  chemically synthesized
ttcagtttggtgtttctatagc

SEQ ID NO: 1237246 - DNA, 22 bp, Artificial Sequence
  chemically synthesized
ccgctaccgctgctatagaaac

SEQ ID NO: 1237247 - DNA, 22 bp, Artificial Sequence
  chemically synthesized
tctgttcagtttggtgtttcta

SEQ ID NO: 1237248 - DNA, 22 bp, Artificial Sequence
  chemically synthesized
ccgctgctatagaaacaccaaa

SEQ ID NO: 1237249 - DNA, 22 bp, Artificial Sequence
  chemically synthesized
tgtggctatctgttcagtttgg

SEQ ID NO: 1237250 - DNA, 22 bp, Artificial Sequence
  chemically synthesized
ctatagaaacaccaaactgaac

SEQ ID NO: 1237251 - DNA, 22 bp, Artificial Sequence
  chemically synthesized
gtgtggctatctgttcagtttg

SEQ ID NO: 1237252 - DNA, 22 bp, Artificial Sequence
  chemically synthesized
tagaaacaccaaactgaacaga

SEQ ID NO: 1237253 - DNA, 22 bp, Artificial Sequence
  chemically synthesized
cttgtgtggctatctgttcagt

SEQ ID NO: 1237254 - DNA, 22 bp, Artificial Sequence
  chemically synthesized
gcttgtgtggctatctgttcag

SEQ ID NO: 1237255 - DNA, 22 bp, Artificial Sequence
  chemically synthesized
tgtaggtgcttgcttgtgtggc

SEQ ID NO: 1237256 - DNA, 22 bp, Artificial Sequence
  chemically synthesized
atgtaggtgcttgcttgtgtgg

SEQ ID NO: 1237257 - DNA, 22 bp, Artificial Sequence
  chemically synthesized
tatgtaggtgcttgcttgtgtg

SEQ ID NO: 1237258 - DNA, 22 bp, Artificial Sequence
  chemically synthesized
ttatgtaggtgcttgcttgtgt

SEQ ID NO: 1237259 - DNA, 22 bp, Artificial Sequence
  chemically synthesized
aacagatagccacacaagcaag

SEQ ID NO: 1237260 - DNA, 22 bp, Artificial Sequence
  chemically synthesized
gtttttatgtaggtgcttgctt

SEQ ID NO: 1237261 - DNA, 22 bp, Artificial Sequence
  chemically synthesized
ggtttttatgtaggtgcttgct

SEQ ID NO: 1237262 - DNA, 22 bp, Artificial Sequence
  chemically synthesized
tggtttttatgtaggtgcttgc

SEQ ID NO: 1237263 - DNA, 22 bp, Artificial Sequence
  chemically synthesized
ttggtttttatgtaggtgcttg

SEQ ID NO: 1237264 - DNA, 22 bp, Artificial Sequence
  chemically synthesized
atttttggtttttatgtaggtg

SEQ ID NO: 1237265 - DNA, 22 bp, Artificial Sequence
  chemically synthesized
gatttttggtttttatgtaggt

SEQ ID NO: 1237266 - DNA, 22 bp, Artificial Sequence
  chemically synthesized
acttgatttttggtttttatgt

SEQ ID NO: 1237267 - DNA, 22 bp, Artificial Sequence
  chemically synthesized
ctcacttgatttttggttttta

SEQ ID NO: 1237268 - DNA, 22 bp, Artificial Sequence
  chemically synthesized
tgattgctcacttgatttttgg

SEQ ID NO: 1237269 - DNA, 22 bp, Artificial Sequence
  chemically synthesized
cataaaaaccaaaaatcaagtg

SEQ ID NO: 1237270 - DNA, 22 bp, Artificial Sequence
  chemically synthesized
aaatcaagtactgtgattgctc

SEQ ID NO: 1237271 - DNA, 22 bp, Artificial Sequence
  chemically synthesized
atatgatattaaaatcaagtac

SEQ ID NO: 1237272 - DNA, 22 bp, Artificial Sequence
  chemically synthesized
gatatgatattaaaatcaagta

SEQ ID NO: 1237273 - DNA, 22 bp, Artificial Sequence
  chemically synthesized
cttgatatgatattaaaatcaa

SEQ ID NO: 1237274 - DNA, 22 bp, Artificial Sequence
  chemically synthesized
ccttgatatgatattaaaatca

SEQ ID NO: 1237275 - DNA, 22 bp, Artificial Sequence
  chemically synthesized
tccttgatatgatattaaaatc

SEQ ID NO: 1237276 - DNA, 22 bp, Artificial Sequence
  chemically synthesized
tttccttgatatgatattaaaa

SEQ ID NO: 1237277 - DNA, 22 bp, Artificial Sequence
  chemically synthesized
agtgcctctttccttgatatga

SEQ ID NO: 1237278 - DNA, 22 bp, Artificial Sequence
  chemically synthesized
cagtgcctctttccttgatatg

SEQ ID NO: 1237279 - DNA, 22 bp, Artificial Sequence
  chemically synthesized
gattttaatatcatatcaagga

SEQ ID NO: 1237280 - DNA, 22 bp, Artificial Sequence
  chemically synthesized
attttaatatcatatcaaggaa

SEQ ID NO: 1237281 - DNA, 22 bp, Artificial Sequence
  chemically synthesized
taatatcatatcaaggaaagag

SEQ ID NO: 1237282 - DNA, 22 bp, Artificial Sequence
  chemically synthesized
aatatcatatcaaggaaagagg

SEQ ID NO: 1237283 - DNA, 22 bp, Artificial Sequence
  chemically synthesized
ccatcttcagtgcctctttcct

SEQ ID NO: 1237284 - DNA, 22 bp, Artificial Sequence
  chemically synthesized
atatcatatcaaggaaagaggc

SEQ ID NO: 1237285 - DNA, 22 bp, Artificial Sequence
  chemically synthesized
ctaccatcttcagtgcctcttt

SEQ ID NO: 1237286 - DNA, 22 bp, Artificial Sequence
  chemically synthesized
cctaccatcttcagtgcctctt

SEQ ID NO: 1237287 - DNA, 22 bp, Artificial Sequence
  chemically synthesized
tcctaccatcttcagtgcctct

SEQ ID NO: 1237288 - DNA, 22 bp, Artificial Sequence
  chemically synthesized
tctttcctaccatcttcagtgc

SEQ ID NO: 1237289 - DNA, 22 bp, Artificial Sequence
  chemically synthesized
gtaactgtctttcctaccatct

SEQ ID NO: 1237290 - DNA, 22 bp, Artificial Sequence
  chemically synthesized
gcaattcgtaactgtctttcct

SEQ ID NO: 1237291 - DNA, 22 bp, Artificial Sequence
  chemically synthesized
aagatggtaggaaagacagtta

SEQ ID NO: 1237292 - DNA, 22 bp, Artificial Sequence
  chemically synthesized
cgaattgccaacaccacccctc

SEQ ID NO: 1237293 - DNA, 22 bp, Artificial Sequence
  chemically synthesized
ccaggggatgggggaggggtgg

SEQ ID NO: 1237294 - DNA, 22 bp, Artificial Sequence
  chemically synthesized
tgccaggggatgggggaggggt

SEQ ID NO: 1237295 - DNA, 22 bp, Artificial Sequence
  chemically synthesized
ccaacaccacccctcccccatc

SEQ ID NO: 1237296 - DNA, 22 bp, Artificial Sequence
  chemically synthesized
catgagacatggcctctgccag

SEQ ID NO: 1237297 - DNA, 22 bp, Artificial Sequence
  chemically synthesized
ccccatcccctggcagaggcca

SEQ ID NO: 1237298 - DNA, 22 bp, Artificial Sequence
  chemically synthesized
gcagaggccatgtctcatgtag

SEQ ID NO: 1237299 - DNA, 22 bp, Artificial Sequence
  chemically synthesized
caagcacacagatcgtctacat

SEQ ID NO: 1237300 - DNA, 22 bp, Artificial Sequence
  chemically synthesized
ctgcaagcacacagatcgtcta

SEQ ID NO: 1237301 - DNA, 22 bp, Artificial Sequence
  chemically synthesized
cctcctgcaagcacacagatcg

SEQ ID NO: 1237302 - DNA, 22 bp, Artificial Sequence
  chemically synthesized
atgtagacgatctgtgtgcttg

SEQ ID NO: 1237303 - DNA, 22 bp, Artificial Sequence
  chemically synthesized
cgccctccctcctgcaagcaca

SEQ ID NO: 1237304 - DNA, 22 bp, Artificial Sequence
  chemically synthesized
acaatcctgcgccctccctcct

SEQ ID NO: 1237305 - DNA, 22 bp, Artificial Sequence
  chemically synthesized
cacaatcctgcgccctccctcc

SEQ ID NO: 1237306 - DNA, 22 bp, Artificial Sequence
  chemically synthesized
tgtgcttgcaggagggagggcg

SEQ ID NO: 1237307 - DNA, 22 bp, Artificial Sequence
  chemically synthesized
gcaggagggagggcgcaggatt

SEQ ID NO: 1237308 - DNA, 22 bp, Artificial Sequence
  chemically synthesized
caggagggagggcgcaggattg

SEQ ID NO: 1237309 - DNA, 22 bp, Artificial Sequence
  chemically synthesized
caatgcaacgtttcacaatcct

SEQ ID NO: 1237310 - DNA, 22 bp, Artificial Sequence
  chemically synthesized
ggttccaatgcaacgtttcaca

SEQ ID NO: 1237311 - DNA, 22 bp, Artificial Sequence
  chemically synthesized
tgaaacgttgcattggaaccca

SEQ ID NO: 1237312 - DNA, 22 bp, Artificial Sequence
  chemically synthesized
tgacagggcagcactgggttcc

SEQ ID NO: 1237313 - DNA, 22 bp, Artificial Sequence
  chemically synthesized
ccactgtgacagggcagcactg

SEQ ID NO: 1237314 - DNA, 22 bp, Artificial Sequence
  chemically synthesized
cccactgtgacagggcagcact

SEQ ID NO: 1237315 - DNA, 22 bp, Artificial Sequence
  chemically synthesized
cattggaacccagtgctgccct

SEQ ID NO: 1237316 - DNA, 22 bp, Artificial Sequence
  chemically synthesized
cttcccactgtgacagggcagc

SEQ ID NO: 1237317 - DNA, 22 bp, Artificial Sequence
  chemically synthesized
gaacccagtgctgccctgtcac

SEQ ID NO: 1237318 - DNA, 22 bp, Artificial Sequence
  chemically synthesized
tgttgcttcccactgtgacagg

SEQ ID NO: 1237319 - DNA, 22 bp, Artificial Sequence
  chemically synthesized
ccctgtgttgcttcccactgtg

SEQ ID NO: 1237320 - DNA, 22 bp, Artificial Sequence
  chemically synthesized
tgccctgtgttgcttcccactg

SEQ ID NO: 1237321 - DNA, 22 bp, Artificial Sequence
  chemically synthesized
ccctgtcacagtgggaagcaac

SEQ ID NO: 1237322 - DNA, 22 bp, Artificial Sequence
  chemically synthesized
atgaattctgccctgtgttgct

SEQ ID NO: 1237323 - DNA, 22 bp, Artificial Sequence
  chemically synthesized
tcacagtgggaagcaacacagg

SEQ ID NO: 1237324 - DNA, 22 bp, Artificial Sequence
  chemically synthesized
gatgaattctgccctgtgttgc

SEQ ID NO: 1237325 - DNA, 22 bp, Artificial Sequence
  chemically synthesized
tgtgcgcttgatgaattctgcc

SEQ ID NO: 1237326 - DNA, 22 bp, Artificial Sequence
  chemically synthesized
tatgtgcgcttgatgaattctg

SEQ ID NO: 1237327 - DNA, 22 bp, Artificial Sequence
  chemically synthesized
aatgtgccctctatgtgcgctt

SEQ ID NO: 1237328 - DNA, 22 bp, Artificial Sequence
  chemically synthesized
gtctaaatgtgccctctatgtg

SEQ ID NO: 1237329 - DNA, 22 bp, Artificial Sequence
  chemically synthesized
atcaagcgcacatagagggcac

SEQ ID NO: 1237330 - DNA, 22 bp, Artificial Sequence
  chemically synthesized
gatagggctggtctaaatgtgc

SEQ ID NO: 1237331 - DNA, 22 bp, Artificial Sequence
  chemically synthesized
cctggatagggctggtctaaat

SEQ ID NO: 1237332 - DNA, 22 bp, Artificial Sequence
  chemically synthesized
agaccagccctatccagggagg

SEQ ID NO: 1237333 - DNA, 22 bp, Artificial Sequence
  chemically synthesized
agatgggtgatacctccctgga

SEQ ID NO: 1237334 - DNA, 22 bp, Artificial Sequence
  chemically synthesized
gaccagccctatccagggaggt

SEQ ID NO: 1237335 - DNA, 22 bp, Artificial Sequence
  chemically synthesized
ctgagatgggtgatacctccct

SEQ ID NO: 1237336 - DNA, 22 bp, Artificial Sequence
  chemically synthesized
actgctgagatgggtgatacct

SEQ ID NO: 1237337 - DNA, 22 bp, Artificial Sequence
  chemically synthesized
taactgctgagatgggtgatac

SEQ ID NO: 1237338 - DNA, 22 bp, Artificial Sequence
  chemically synthesized
ctaactgctgagatgggtgata

SEQ ID NO: 1237339 - DNA, 22 bp, Artificial Sequence
  chemically synthesized
tccagggaggtatcacccatct

SEQ ID NO: 1237340 - DNA, 22 bp, Artificial Sequence
  chemically synthesized
agcttctaactgctgagatggg

SEQ ID NO: 1237341 - DNA, 22 bp, Artificial Sequence
  chemically synthesized
gaactcagcttctaactgctga

SEQ ID NO: 1237342 - DNA, 22 bp, Artificial Sequence
  chemically synthesized
gctggaactcagcttctaactg

SEQ ID NO: 1237343 - DNA, 22 bp, Artificial Sequence
  chemically synthesized
gtgagactagctggaactcagc

SEQ ID NO: 1237344 - DNA, 22 bp, Artificial Sequence
  chemically synthesized
agcagttagaagctgagttcca

SEQ ID NO: 1237345 - DNA, 22 bp, Artificial Sequence
  chemically synthesized
acactggtgagactagctggaa

SEQ ID NO: 1237346 - DNA, 22 bp, Artificial Sequence
  chemically synthesized
gaagctgagttccagctagtct

SEQ ID NO: 1237347 - DNA, 22 bp, Artificial Sequence
  chemically synthesized
agctcacactggtgagactagc

SEQ ID NO: 1237348 - DNA, 22 bp, Artificial Sequence
  chemically synthesized
gagctcacactggtgagactag

SEQ ID NO: 1237349 - DNA, 22 bp, Artificial Sequence
  chemically synthesized
agttccagctagtctcaccagt

SEQ ID NO: 1237350 - DNA, 22 bp, Artificial Sequence
  chemically synthesized
cagctagtctcaccagtgtgag

SEQ ID NO: 1237351 - DNA, 22 bp, Artificial Sequence
  chemically synthesized
gtctcaccagtgtgagctcaag

SEQ ID NO: 1237352 - DNA, 22 bp, Artificial Sequence
  chemically synthesized
ggaccccaaagtgcttgagctc

SEQ ID NO: 1237353 - DNA, 22 bp, Artificial Sequence
  chemically synthesized
aggaccccaaagtgcttgagct

SEQ ID NO: 1237354 - DNA, 22 bp, Artificial Sequence
  chemically synthesized
accagtgtgagctcaagcactt

SEQ ID NO: 1237355 - DNA, 22 bp, Artificial Sequence
  chemically synthesized
tttaggaccccaaagtgcttga

SEQ ID NO: 1237356 - DNA, 22 bp, Artificial Sequence
  chemically synthesized
atttaggaccccaaagtgcttg

SEQ ID NO: 1237357 - DNA, 22 bp, Artificial Sequence
  chemically synthesized
aagtttatttaggaccccaaag

SEQ ID NO: 1237358 - DNA, 22 bp, Artificial Sequence
  chemically synthesized
gaagtttatttaggaccccaaa

SEQ ID NO: 1237359 - DNA, 22 bp, Artificial Sequence
  chemically synthesized
tgaagtttatttaggaccccaa

SEQ ID NO: 1237360 - DNA, 22 bp, Artificial Sequence
  chemically synthesized
cctttgaagtttatttaggacc

SEQ ID NO: 1237361 - DNA, 22 bp, Artificial Sequence
  chemically synthesized
aagcactttggggtcctaaata

SEQ ID NO: 1237362 - DNA, 22 bp, Artificial Sequence
  chemically synthesized
gactccctttgaagtttattta

SEQ ID NO: 1237363 - DNA, 22 bp, Artificial Sequence
  chemically synthesized
tggggtcctaaataaacttcaa

SEQ ID NO: 1237364 - DNA, 22 bp, Artificial Sequence
  chemically synthesized
ggggtcctaaataaacttcaaa

SEQ ID NO: 1237365 - DNA, 22 bp, Artificial Sequence
  chemically synthesized
gggtcctaaataaacttcaaag

SEQ ID NO: 1237366 - DNA, 22 bp, Artificial Sequence
  chemically synthesized
tagcctagactccctttgaagt

SEQ ID NO: 1237367 - DNA, 22 bp, Artificial Sequence
  chemically synthesized
gtagcctagactccctttgaag

SEQ ID NO: 1237368 - DNA, 22 bp, Artificial Sequence
  chemically synthesized
tgtagcctagactccctttgaa

SEQ ID NO: 1237369 - DNA, 22 bp, Artificial Sequence
  chemically synthesized
ttgtagcctagactccctttga

SEQ ID NO: 1237370 - DNA, 22 bp, Artificial Sequence
  chemically synthesized
aataaacttcaaagggagtcta

SEQ ID NO: 1237371 - DNA, 22 bp, Artificial Sequence
  chemically synthesized
cagtttttgtagcctagactcc

SEQ ID NO: 1237372 - DNA, 22 bp, Artificial Sequence
  chemically synthesized
caaagggagtctaggctacaaa

SEQ ID NO: 1237373 - DNA, 22 bp, Artificial Sequence
  chemically synthesized
aaagggagtctaggctacaaaa

SEQ ID NO: 1237374 - DNA, 22 bp, Artificial Sequence
  chemically synthesized
cccaggaattgcagtttttgta

SEQ ID NO: 1237375 - DNA, 22 bp, Artificial Sequence
  chemically synthesized
gcccaggaattgcagtttttgt

SEQ ID NO: 1237376 - DNA, 22 bp, Artificial Sequence
  chemically synthesized
ggctacaaaaactgcaattcct

SEQ ID NO: 1237377 - DNA, 22 bp, Artificial Sequence
  chemically synthesized
caaaaactgcaattcctgggca

SEQ ID NO: 1237378 - DNA, 22 bp, Artificial Sequence
  chemically synthesized
caattcctgggcaagtcttggt

SEQ ID NO: 1237379 - DNA, 22 bp, Artificial Sequence
  chemically synthesized
gagtccagcacgacaccaagac

SEQ ID NO: 1237380 - DNA, 22 bp, Artificial Sequence
  chemically synthesized
cgagtccagcacgacaccaaga

SEQ ID NO: 1237381 - DNA, 22 bp, Artificial Sequence
  chemically synthesized
ctgggcaagtcttggtgtcgtg

SEQ ID NO: 1237382 - DNA, 22 bp, Artificial Sequence
  chemically synthesized
acttcgagtccagcacgacacc

SEQ ID NO: 1237383 - DNA, 22 bp, Artificial Sequence
  chemically synthesized
ggcaagtcttggtgtcgtgctg

SEQ ID NO: 1237384 - DNA, 22 bp, Artificial Sequence
  chemically synthesized
ggtgtcgtgctggactcgaagt

SEQ ID NO: 1237385 - DNA, 22 bp, Artificial Sequence
  chemically synthesized
gtgtcgtgctggactcgaagtc

SEQ ID NO: 1237386 - DNA, 22 bp, Artificial Sequence
  chemically synthesized
tgtgcccaccaagtcccctgac

SEQ ID NO: 1237387 - DNA, 22 bp, Artificial Sequence
  chemically synthesized
gactcgaagtcaggggacttgg

SEQ ID NO: 1237388 - DNA, 22 bp, Artificial Sequence
  chemically synthesized
ggttgtgtgcccaccaagtccc

SEQ ID NO: 1237389 - DNA, 22 bp, Artificial Sequence
  chemically synthesized
ctgggttgtgtgcccaccaagt

SEQ ID NO: 1237390 - DNA, 22 bp, Artificial Sequence
  chemically synthesized
gaagtcaggggacttggtgggc

SEQ ID NO: 1237391 - DNA, 22 bp, Artificial Sequence
  chemically synthesized
actgggttgtgtgcccaccaag

SEQ ID NO: 1237392 - DNA, 22 bp, Artificial Sequence
  chemically synthesized
gtgtcttactgggttgtgtgcc

SEQ ID NO: 1237393 - DNA, 22 bp, Artificial Sequence
  chemically synthesized
ggtgggcacacaacccagtaag

SEQ ID NO: 1237394 - DNA, 22 bp, Artificial Sequence
  chemically synthesized
gtgggcacacaacccagtaaga

SEQ ID NO: 1237395 - DNA, 22 bp, Artificial Sequence
  chemically synthesized
gaggatggggtggtacaagcac

SEQ ID NO: 1237396 - DNA, 22 bp, Artificial Sequence
  chemically synthesized
ggggttagaggatggggtggta

SEQ ID NO: 1237397 - DNA, 22 bp, Artificial Sequence
  chemically synthesized
ttaggggttagaggatggggtg

SEQ ID NO: 1237398 - DNA, 22 bp, Artificial Sequence
  chemically synthesized
cactgttaggggttagaggatg

SEQ ID NO: 1237399 - DNA, 22 bp, Artificial Sequence
  chemically synthesized
gtaccaccccatcctctaaccc

SEQ ID NO: 1237400 - DNA, 22 bp, Artificial Sequence
  chemically synthesized
taccaccccatcctctaacccc

SEQ ID NO: 1237401 - DNA, 22 bp, Artificial Sequence
  chemically synthesized
tcagctgcactgttaggggtta

SEQ ID NO: 1237402 - DNA, 22 bp, Artificial Sequence
  chemically synthesized
aaagctgtcagctgcactgtta

SEQ ID NO: 1237403 - DNA, 22 bp, Artificial Sequence
  chemically synthesized
tcaaagctgtcagctgcactgt

SEQ ID NO: 1237404 - DNA, 22 bp, Artificial Sequence
  chemically synthesized
tctcaaagctgtcagctgcact

SEQ ID NO: 1237405 - DNA, 22 bp, Artificial Sequence
  chemically synthesized
taacccctaacagtgcagctga

SEQ ID NO: 1237406 - DNA, 22 bp, Artificial Sequence
  chemically synthesized
acccctaacagtgcagctgaca

SEQ ID NO: 1237407 - DNA, 22 bp, Artificial Sequence
  chemically synthesized
acagtgcagctgacagctttga

SEQ ID NO: 1237408 - DNA, 22 bp, Artificial Sequence
  chemically synthesized
aagtggaagaagcagtctctct

SEQ ID NO: 1237409 - DNA, 22 bp, Artificial Sequence
  chemically synthesized
acagctttgagagagactgctt

SEQ ID NO: 1237410 - DNA, 22 bp, Artificial Sequence
  chemically synthesized
ctcaagtggaagaagcagtctc

SEQ ID NO: 1237411 - DNA, 22 bp, Artificial Sequence
  chemically synthesized
tcctcaagtggaagaagcagtc

SEQ ID NO: 1237412 - DNA, 22 bp, Artificial Sequence
  chemically synthesized
tgagagagactgcttcttccac

SEQ ID NO: 1237413 - DNA, 22 bp, Artificial Sequence
  chemically synthesized
tcctctcctcaagtggaagaag

SEQ ID NO: 1237414 - DNA, 22 bp, Artificial Sequence
  chemically synthesized
gagagagactgcttcttccact

SEQ ID NO: 1237415 - DNA, 22 bp, Artificial Sequence
  chemically synthesized
agagagactgcttcttccactt

SEQ ID NO: 1237416 - DNA, 22 bp, Artificial Sequence
  chemically synthesized
tccctatcctctcctcaagtgg

SEQ ID NO: 1237417 - DNA, 22 bp, Artificial Sequence
  chemically synthesized
ctgtccctatcctctcctcaag

SEQ ID NO: 1237418 - DNA, 22 bp, Artificial Sequence
  chemically synthesized
actgtccctatcctctcctcaa

SEQ ID NO: 1237419 - DNA, 22 bp, Artificial Sequence
  chemically synthesized
tactgtccctatcctctcctca

SEQ ID NO: 1237420 - DNA, 22 bp, Artificial Sequence
  chemically synthesized
cttcttccacttgaggagagga

SEQ ID NO: 1237421 - DNA, 22 bp, Artificial Sequence
  chemically synthesized
cttccacttgaggagaggatag

SEQ ID NO: 1237422 - DNA, 22 bp, Artificial Sequence
  chemically synthesized
ttccacttgaggagaggatagg

SEQ ID NO: 1237423 - DNA, 22 bp, Artificial Sequence
  chemically synthesized
ccacttgaggagaggataggga

SEQ ID NO: 1237424 - DNA, 22 bp, Artificial Sequence
  chemically synthesized
cacttgaggagaggatagggac

SEQ ID NO: 1237425 - DNA, 22 bp, Artificial Sequence
  chemically synthesized
gaggagaggatagggacagtaa

SEQ ID NO: 1237426 - DNA, 22 bp, Artificial Sequence
  chemically synthesized
aggagaggatagggacagtaaa

SEQ ID NO: 1237427 - DNA, 22 bp, Artificial Sequence
  chemically synthesized
caagacaatgtcatctttactg

SEQ ID NO: 1237428 - DNA, 22 bp, Artificial Sequence
  chemically synthesized
tgtccaagttgcaagacaatgt

SEQ ID NO: 1237429 - DNA, 22 bp, Artificial Sequence
  chemically synthesized
gtgtccaagttgcaagacaatg

SEQ ID NO: 1237430 - DNA, 22 bp, Artificial Sequence
  chemically synthesized
agcttgtgtccaagttgcaaga

SEQ ID NO: 1237431 - DNA, 22 bp, Artificial Sequence
  chemically synthesized
tggttgagcttgtgtccaagtt

SEQ ID NO: 1237432 - DNA, 22 bp, Artificial Sequence
  chemically synthesized
ctgtggttgagcttgtgtccaa

SEQ ID NO: 1237433 - DNA, 22 bp, Artificial Sequence
  chemically synthesized
tcttgcaacttggacacaagct

SEQ ID NO: 1237434 - DNA, 22 bp, Artificial Sequence
  chemically synthesized
tcctactgtggttgagcttgtg

SEQ ID NO: 1237435 - DNA, 22 bp, Artificial Sequence
  chemically synthesized
atcctactgtggttgagcttgt

SEQ ID NO: 1237436 - DNA, 22 bp, Artificial Sequence
  chemically synthesized
gcaacttggacacaagctcaac

SEQ ID NO: 1237437 - DNA, 22 bp, Artificial Sequence
  chemically synthesized
caacttggacacaagctcaacc

SEQ ID NO: 1237438 - DNA, 22 bp, Artificial Sequence
  chemically synthesized
atgccttatcctactgtggttg

SEQ ID NO: 1237439 - DNA, 22 bp, Artificial Sequence
  chemically synthesized
ggacacaagctcaaccacagta

SEQ ID NO: 1237440 - DNA, 22 bp, Artificial Sequence
  chemically synthesized
gacacaagctcaaccacagtag

SEQ ID NO: 1237441 - DNA, 22 bp, Artificial Sequence
  chemically synthesized
cctgatgccttatcctactgtg

SEQ ID NO: 1237442 - DNA, 22 bp, Artificial Sequence
  chemically synthesized
tgcctgatgccttatcctactg

SEQ ID NO: 1237443 - DNA, 22 bp, Artificial Sequence
  chemically synthesized
aaccacagtaggataaggcatc

SEQ ID NO: 1237444 - DNA, 22 bp, Artificial Sequence
  chemically synthesized
aggactctgcctgatgccttat

SEQ ID NO: 1237445 - DNA, 22 bp, Artificial Sequence
  chemically synthesized
gaatggggggtctcaggactct

SEQ ID NO: 1237446 - DNA, 22 bp, Artificial Sequence
  chemically synthesized
aggagccagggcctggaatggg

SEQ ID NO: 1237447 - DNA, 22 bp, Artificial Sequence
  chemically synthesized
agaccccccattccaggccctg

SEQ ID NO: 1237448 - DNA, 22 bp, Artificial Sequence
  chemically synthesized
agaatgtcactcaggagccagg

SEQ ID NO: 1237449 - DNA, 22 bp, Artificial Sequence
  chemically synthesized
aagaatgtcactcaggagccag

SEQ ID NO: 1237450 - DNA, 22 bp, Artificial Sequence
  chemically synthesized
caggccctggctcctgagtgac

SEQ ID NO: 1237451 - DNA, 22 bp, Artificial Sequence
  chemically synthesized
ggtgtatttaagaatgtcactc

SEQ ID NO: 1237452 - DNA, 22 bp, Artificial Sequence
  chemically synthesized
gctcctgagtgacattcttaaa

SEQ ID NO: 1237453 - DNA, 22 bp, Artificial Sequence
  chemically synthesized
gccctgggtgtatttaagaatg

SEQ ID NO: 1237454 - DNA, 22 bp, Artificial Sequence
  chemically synthesized
tggccctgggtgtatttaagaa

SEQ ID NO: 1237455 - DNA, 22 bp, Artificial Sequence
  chemically synthesized
ctggccctgggtgtatttaaga

SEQ ID NO: 1237456 - DNA, 22 bp, Artificial Sequence
  chemically synthesized
ctgagtgacattcttaaataca

SEQ ID NO: 1237457 - DNA, 22 bp, Artificial Sequence
  chemically synthesized
agtgacattcttaaatacaccc

SEQ ID NO: 1237458 - DNA, 22 bp, Artificial Sequence
  chemically synthesized
ccttctggccctgggtgtattt

SEQ ID NO: 1237459 - DNA, 22 bp, Artificial Sequence
  chemically synthesized
ttaaatacacccagggccagaa

SEQ ID NO: 1237460 - DNA, 22 bp, Artificial Sequence
  chemically synthesized
aaatacacccagggccagaagg

SEQ ID NO: 1237461 - DNA, 22 bp, Artificial Sequence
  chemically synthesized
aatacacccagggccagaaggg

SEQ ID NO: 1237462 - DNA, 22 bp, Artificial Sequence
  chemically synthesized
aaggtagcaagttcccttctgg

SEQ ID NO: 1237463 - DNA, 22 bp, Artificial Sequence
  chemically synthesized
caaggtagcaagttcccttctg

SEQ ID NO: 1237464 - DNA, 22 bp, Artificial Sequence
  chemically synthesized
ttcaaggtagcaagttcccttc

SEQ ID NO: 1237465 - DNA, 22 bp, Artificial Sequence
  chemically synthesized
tcttcaaggtagcaagttccct

SEQ ID NO: 1237466 - DNA, 22 bp, Artificial Sequence
  chemically synthesized
ctcttcaaggtagcaagttccc

SEQ ID NO: 1237467 - DNA, 22 bp, Artificial Sequence
  chemically synthesized
ttctcttcaaggtagcaagttc

SEQ ID NO: 1237468 - DNA, 22 bp, Artificial Sequence
  chemically synthesized
gattcttctcttcaaggtagca

SEQ ID NO: 1237469 - DNA, 22 bp, Artificial Sequence
  chemically synthesized
ccaggactggattcttctcttc

SEQ ID NO: 1237470 - DNA, 22 bp, Artificial Sequence
  chemically synthesized
taccaggactggattcttctct

SEQ ID NO: 1237471 - DNA, 22 bp, Artificial Sequence
  chemically synthesized
gctaccttgaagagaagaatcc

SEQ ID NO: 1237472 - DNA, 22 bp, Artificial Sequence
  chemically synthesized
ctaccttgaagagaagaatcca

SEQ ID NO: 1237473 - DNA, 22 bp, Artificial Sequence
  chemically synthesized
ccttgaagagaagaatccagtc

SEQ ID NO: 1237474 - DNA, 22 bp, Artificial Sequence
  chemically synthesized
gaagagaagaatccagtcctgg

SEQ ID NO: 1237475 - DNA, 22 bp, Artificial Sequence
  chemically synthesized
aagagaagaatccagtcctggt

SEQ ID NO: 1237476 - DNA, 22 bp, Artificial Sequence
  chemically synthesized
gtcagcaggtgacgaattctac

SEQ ID NO: 1237477 - DNA, 22 bp, Artificial Sequence
  chemically synthesized
agtcagcaggtgacgaattcta

SEQ ID NO: 1237478 - DNA, 22 bp, Artificial Sequence
  chemically synthesized
tagtcagcaggtgacgaattct

SEQ ID NO: 1237479 - DNA, 22 bp, Artificial Sequence
  chemically synthesized
tttagtcagcaggtgacgaatt

SEQ ID NO: 1237480 - DNA, 22 bp, Artificial Sequence
  chemically synthesized
gtagaattcgtcacctgctgac

SEQ ID NO: 1237481 - DNA, 22 bp, Artificial Sequence
  chemically synthesized
aggacccagggactctttagtc

SEQ ID NO: 1237482 - DNA, 22 bp, Artificial Sequence
  chemically synthesized
gtcacctgctgactaaagagtc

SEQ ID NO: 1237483 - DNA, 22 bp, Artificial Sequence
  chemically synthesized
ttcaggacccagggactcttta

SEQ ID NO: 1237484 - DNA, 22 bp, Artificial Sequence
  chemically synthesized
attcaggacccagggactcttt

SEQ ID NO: 1237485 - DNA, 22 bp, Artificial Sequence
  chemically synthesized
cttattcaggacccagggactc

SEQ ID NO: 1237486 - DNA, 22 bp, Artificial Sequence
  chemically synthesized
ctgactaaagagtccctgggtc

SEQ ID NO: 1237487 - DNA, 22 bp, Artificial Sequence
  chemically synthesized
ctgcttattcaggacccaggga

SEQ ID NO: 1237488 - DNA, 22 bp, Artificial Sequence
  chemically synthesized
actaaagagtccctgggtcctg

SEQ ID NO: 1237489 - DNA, 22 bp, Artificial Sequence
  chemically synthesized
ctgctgcttattcaggacccag

SEQ ID NO: 1237490 - DNA, 22 bp, Artificial Sequence
  chemically synthesized
ctactgctgcttattcaggacc

SEQ ID NO: 1237491 - DNA, 22 bp, Artificial Sequence
  chemically synthesized
aagagtccctgggtcctgaata

SEQ ID NO: 1237492 - DNA, 22 bp, Artificial Sequence
  chemically synthesized
gctactactgctgcttattcag

SEQ ID NO: 1237493 - DNA, 22 bp, Artificial Sequence
  chemically synthesized
cctggctactactgctgcttat

SEQ ID NO: 1237494 - DNA, 22 bp, Artificial Sequence
  chemically synthesized
ggtcctgaataagcagcagtag

SEQ ID NO: 1237495 - DNA, 22 bp, Artificial Sequence
  chemically synthesized
gtgaatactgcctggctactac

SEQ ID NO: 1237496 - DNA, 22 bp, Artificial Sequence
  chemically synthesized
aataagcagcagtagtagccag

SEQ ID NO: 1237497 - DNA, 22 bp, Artificial Sequence
  chemically synthesized
ggtgaatactgcctggctacta

SEQ ID NO: 1237498 - DNA, 22 bp, Artificial Sequence
  chemically synthesized
cccaagacttggtgaatactgc

SEQ ID NO: 1237499 - DNA, 22 bp, Artificial Sequence
  chemically synthesized
acccaagacttggtgaatactg

SEQ ID NO: 1237500 - DNA, 22 bp, Artificial Sequence
  chemically synthesized
agtcttacccaagacttggtga

SEQ ID NO: 1237501 - DNA, 22 bp, Artificial Sequence
  chemically synthesized
tgagtcttacccaagacttggt

SEQ ID NO: 1237502 - DNA, 22 bp, Artificial Sequence
  chemically synthesized
accaagtcttgggtaagactca

SEQ ID NO: 1237503 - DNA, 22 bp, Artificial Sequence
  chemically synthesized
gggtaagactcagagccatgct

SEQ ID NO: 1237504 - DNA, 22 bp, Artificial Sequence
  chemically synthesized
ggtaagactcagagccatgctg

SEQ ID NO: 1237505 - DNA, 22 bp, Artificial Sequence
  chemically synthesized
ggccacacccaaagacagcatg

SEQ ID NO: 1237506 - DNA, 22 bp, Artificial Sequence
  chemically synthesized
agagccatgctgtctttgggtg

SEQ ID NO: 1237507 - DNA, 22 bp, Artificial Sequence
  chemically synthesized
ggaatgcattgggccacaccca

SEQ ID NO: 1237508 - DNA, 22 bp, Artificial Sequence
  chemically synthesized
gggaatgcattgggccacaccc

SEQ ID NO: 1237509 - DNA, 22 bp, Artificial Sequence
  chemically synthesized
tctttgggtgtggcccaatgca

SEQ ID NO: 1237510 - DNA, 22 bp, Artificial Sequence
  chemically synthesized
tgggtgtggcccaatgcattcc

SEQ ID NO: 1237511 - DNA, 22 bp, Artificial Sequence
  chemically synthesized
gggtgtggcccaatgcattccc

SEQ ID NO: 1237512 - DNA, 22 bp, Artificial Sequence
  chemically synthesized
ggtgtggcccaatgcattccca

SEQ ID NO: 1237513 - DNA, 22 bp, Artificial Sequence
  chemically synthesized
ccaagtgtggtggccatgggga

SEQ ID NO: 1237514 - DNA, 22 bp, Artificial Sequence
  chemically synthesized
caaaagcacaaggagtatatcc

SEQ ID NO: 1237515 - DNA, 22 bp, Artificial Sequence
  chemically synthesized
ccaaaagcacaaggagtatatc

SEQ ID NO: 1237516 - DNA, 22 bp, Artificial Sequence
  chemically synthesized
tccaaaagcacaaggagtatat

SEQ ID NO: 1237517 - DNA, 22 bp, Artificial Sequence
  chemically synthesized
ctttccaaaagcacaaggagta

SEQ ID NO: 1237518 - DNA, 22 bp, Artificial Sequence
  chemically synthesized
tcctttccaaaagcacaaggag

SEQ ID NO: 1237519 - DNA, 22 bp, Artificial Sequence
  chemically synthesized
cctctcctttccaaaagcacaa

SEQ ID NO: 1237520 - DNA, 22 bp, Artificial Sequence
  chemically synthesized
ttgcctctcctttccaaaagca

SEQ ID NO: 1237521 - DNA, 22 bp, Artificial Sequence
  chemically synthesized
tattgcctctcctttccaaaag

SEQ ID NO: 1237522 - DNA, 22 bp, Artificial Sequence
  chemically synthesized
cttgtgcttttggaaaggagag

SEQ ID NO: 1237523 - DNA, 22 bp, Artificial Sequence
  chemically synthesized
gtgcttttggaaaggagaggca

SEQ ID NO: 1237524 - DNA, 22 bp, Artificial Sequence
  chemically synthesized
tgcttttggaaaggagaggcaa

SEQ ID NO: 1237525 - DNA, 22 bp, Artificial Sequence
  chemically synthesized
ttggaaaggagaggcaatagag

SEQ ID NO: 1237526 - DNA, 22 bp, Artificial Sequence
  chemically synthesized
tggaaaggagaggcaatagagt

SEQ ID NO: 1237527 - DNA, 22 bp, Artificial Sequence
  chemically synthesized
ggaaaggagaggcaatagagtg

SEQ ID NO: 1237528 - DNA, 22 bp, Artificial Sequence
  chemically synthesized
caagacaaagtccactctattg

SEQ ID NO: 1237529 - DNA, 22 bp, Artificial Sequence
  chemically synthesized
gaaaggagaggcaatagagtgg

SEQ ID NO: 1237530 - DNA, 22 bp, Artificial Sequence
  chemically synthesized
gtacccaagctgcaagacaaag

SEQ ID NO: 1237531 - DNA, 22 bp, Artificial Sequence
  chemically synthesized
agctagtacccaagctgcaaga

SEQ ID NO: 1237532 - DNA, 22 bp, Artificial Sequence
  chemically synthesized
tggttgagctagtacccaagct

SEQ ID NO: 1237533 - DNA, 22 bp, Artificial Sequence
  chemically synthesized
tgtcttgcagcttgggtactag

SEQ ID NO: 1237534 - DNA, 22 bp, Artificial Sequence
  chemically synthesized
actgtggttgagctagtaccca

SEQ ID NO: 1237535 - DNA, 22 bp, Artificial Sequence
  chemically synthesized
gtcttgcagcttgggtactagc

SEQ ID NO: 1237536 - DNA, 22 bp, Artificial Sequence
  chemically synthesized
tcttgcagcttgggtactagct

SEQ ID NO: 1237537 - DNA, 22 bp, Artificial Sequence
  chemically synthesized
cctgactgtggttgagctagta

SEQ ID NO: 1237538 - DNA, 22 bp, Artificial Sequence
  chemically synthesized
gcagcttgggtactagctcaac

SEQ ID NO: 1237539 - DNA, 22 bp, Artificial Sequence
  chemically synthesized
cagcttgggtactagctcaacc

SEQ ID NO: 1237540 - DNA, 22 bp, Artificial Sequence
  chemically synthesized
atggtctacctgactgtggttg

SEQ ID NO: 1237541 - DNA, 22 bp, Artificial Sequence
  chemically synthesized
gggtactagctcaaccacagtc

SEQ ID NO: 1237542 - DNA, 22 bp, Artificial Sequence
  chemically synthesized
gatggtctacctgactgtggtt

SEQ ID NO: 1237543 - DNA, 22 bp, Artificial Sequence
  chemically synthesized
ggtactagctcaaccacagtca

SEQ ID NO: 1237544 - DNA, 22 bp, Artificial Sequence
  chemically synthesized
cttgatggtctacctgactgtg

SEQ ID NO: 1237545 - DNA, 22 bp, Artificial Sequence
  chemically synthesized
gcttgatggtctacctgactgt

SEQ ID NO: 1237546 - DNA, 22 bp, Artificial Sequence
  chemically synthesized
gctcaaccacagtcaggtagac

SEQ ID NO: 1237547 - DNA, 22 bp, Artificial Sequence
  chemically synthesized
aaccacagtcaggtagaccatc

SEQ ID NO: 1237548 - DNA, 22 bp, Artificial Sequence
  chemically synthesized
caatcagagaacccaggagctt

SEQ ID NO: 1237549 - DNA, 22 bp, Artificial Sequence
  chemically synthesized
ctgggttctctgattgcaggcc

SEQ ID NO: 1237550 - DNA, 22 bp, Artificial Sequence
  chemically synthesized
ggttctctgattgcaggccttg

SEQ ID NO: 1237551 - DNA, 22 bp, Artificial Sequence
  chemically synthesized
tctgattgcaggccttggctcc

SEQ ID NO: 1237552 - DNA, 22 bp, Artificial Sequence
  chemically synthesized
tgattgcaggccttggctcctg

SEQ ID NO: 1237553 - DNA, 22 bp, Artificial Sequence
  chemically synthesized
attgcaggccttggctcctgga

SEQ ID NO: 1237554 - DNA, 22 bp, Artificial Sequence
  chemically synthesized
caggccttggctcctggatggc

SEQ ID NO: 1237555 - DNA, 22 bp, Artificial Sequence
  chemically synthesized
ggctcctggatggcatttctgg

SEQ ID NO: 1237556 - DNA, 22 bp, Artificial Sequence
  chemically synthesized
gctcctggatggcatttctgga

SEQ ID NO: 1237557 - DNA, 22 bp, Artificial Sequence
  chemically synthesized
aggccccaggtgagtccagaaa

SEQ ID NO: 1237558 - DNA, 22 bp, Artificial Sequence
  chemically synthesized
ctggatggcatttctggactca

SEQ ID NO: 1237559 - DNA, 22 bp, Artificial Sequence
  chemically synthesized
ctcaggccccaggtgagtccag

SEQ ID NO: 1237560 - DNA, 22 bp, Artificial Sequence
  chemically synthesized
gatggcatttctggactcacct

SEQ ID NO: 1237561 - DNA, 22 bp, Artificial Sequence
  chemically synthesized
tcctcaggccccaggtgagtcc

SEQ ID NO: 1237562 - DNA, 22 bp, Artificial Sequence
  chemically synthesized
ctggactcacctggggcctgag

SEQ ID NO: 1237563 - DNA, 22 bp, Artificial Sequence
  chemically synthesized
tggactcacctggggcctgagg

SEQ ID NO: 1237564 - DNA, 22 bp, Artificial Sequence
  chemically synthesized
tgcagtgggttctcctcaggcc

SEQ ID NO: 1237565 - DNA, 22 bp, Artificial Sequence
  chemically synthesized
gactcacctggggcctgaggag

SEQ ID NO: 1237566 - DNA, 22 bp, Artificial Sequence
  chemically synthesized
tgtgcagtgggttctcctcagg

SEQ ID NO: 1237567 - DNA, 22 bp, Artificial Sequence
  chemically synthesized
acctggggcctgaggagaaccc

SEQ ID NO: 1237568 - DNA, 22 bp, Artificial Sequence
  chemically synthesized
cgttctgtgcagtgggttctcc

SEQ ID NO: 1237569 - DNA, 22 bp, Artificial Sequence
  chemically synthesized
tccgttctgtgcagtgggttct

SEQ ID NO: 1237570 - DNA, 22 bp, Artificial Sequence
  chemically synthesized
gggcctgaggagaacccactgc

SEQ ID NO: 1237571 - DNA, 22 bp, Artificial Sequence
  chemically synthesized
ggtctctccgttctgtgcagtg

SEQ ID NO: 1237572 - DNA, 22 bp, Artificial Sequence
  chemically synthesized
aggagaacccactgcacagaac

SEQ ID NO: 1237573 - DNA, 22 bp, Artificial Sequence
  chemically synthesized
cgaggcctgggtctctccgttc

SEQ ID NO: 1237574 - DNA, 22 bp, Artificial Sequence
  chemically synthesized
cacagaacggagagacccaggc

SEQ ID NO: 1237575 - DNA, 22 bp, Artificial Sequence
  chemically synthesized
ggagtaaacgctgcgaggcctg

SEQ ID NO: 1237576 - DNA, 22 bp, Artificial Sequence
  chemically synthesized
actaggagtaaacgctgcgagg

SEQ ID NO: 1237577 - DNA, 22 bp, Artificial Sequence
  chemically synthesized
gttaactaggagtaaacgctgc

SEQ ID NO: 1237578 - DNA, 22 bp, Artificial Sequence
  chemically synthesized
agttaactaggagtaaacgctg

SEQ ID NO: 1237579 - DNA, 22 bp, Artificial Sequence
  chemically synthesized
tagttaactaggagtaaacgct

SEQ ID NO: 1237580 - DNA, 22 bp, Artificial Sequence
  chemically synthesized
ttagttaactaggagtaaacgc

SEQ ID NO: 1237581 - DNA, 22 bp, Artificial Sequence
  chemically synthesized
tttagttaactaggagtaaacg

SEQ ID NO: 1237582 - DNA, 22 bp, Artificial Sequence
  chemically synthesized
gcagcgtttactcctagttaac

SEQ ID NO: 1237583 - DNA, 22 bp, Artificial Sequence
  chemically synthesized
aaggcccaagagctttttagtt

SEQ ID NO: 1237584 - DNA, 22 bp, Artificial Sequence
  chemically synthesized
actcctagttaactaaaaagct

SEQ ID NO: 1237585 - DNA, 22 bp, Artificial Sequence
  chemically synthesized
ctcctagttaactaaaaagctc

SEQ ID NO: 1237586 - DNA, 22 bp, Artificial Sequence
  chemically synthesized
actcaaggcccaagagcttttt

SEQ ID NO: 1237587 - DNA, 22 bp, Artificial Sequence
  chemically synthesized
ctagttaactaaaaagctcttg

SEQ ID NO: 1237588 - DNA, 22 bp, Artificial Sequence
  chemically synthesized
gttaactaaaaagctcttgggc

SEQ ID NO: 1237589 - DNA, 22 bp, Artificial Sequence
  chemically synthesized
atgttcactcaaggcccaagag

SEQ ID NO: 1237590 - DNA, 22 bp, Artificial Sequence
  chemically synthesized
actaaaaagctcttgggccttg

SEQ ID NO: 1237591 - DNA, 22 bp, Artificial Sequence
  chemically synthesized
ccactgatgttcactcaaggcc

SEQ ID NO: 1237592 - DNA, 22 bp, Artificial Sequence
  chemically synthesized
aaaagctcttgggccttgagtg

SEQ ID NO: 1237593 - DNA, 22 bp, Artificial Sequence
  chemically synthesized
gctaccactgatgttcactcaa

SEQ ID NO: 1237594 - DNA, 22 bp, Artificial Sequence
  chemically synthesized
cctggctaccactgatgttcac

SEQ ID NO: 1237595 - DNA, 22 bp, Artificial Sequence
  chemically synthesized
ttgggccttgagtgaacatcag

SEQ ID NO: 1237596 - DNA, 22 bp, Artificial Sequence
  chemically synthesized
gggccttgagtgaacatcagtg

SEQ ID NO: 1237597 - DNA, 22 bp, Artificial Sequence
  chemically synthesized
ggccttgagtgaacatcagtgg

SEQ ID NO: 1237598 - DNA, 22 bp, Artificial Sequence
  chemically synthesized
gagtgaacatcagtggtagcca

SEQ ID NO: 1237599 - DNA, 22 bp, Artificial Sequence
  chemically synthesized
agtgaacatcagtggtagccag

SEQ ID NO: 1237600 - DNA, 22 bp, Artificial Sequence
  chemically synthesized
atggtgagtactgcctggctac

SEQ ID NO: 1237601 - DNA, 22 bp, Artificial Sequence
  chemically synthesized
aggctcatggtgagtactgcct

SEQ ID NO: 1237602 - DNA, 22 bp, Artificial Sequence
  chemically synthesized
cctcaggctcatggtgagtact

SEQ ID NO: 1237603 - DNA, 22 bp, Artificial Sequence
  chemically synthesized
ccactgcctcaggctcatggtg

SEQ ID NO: 1237604 - DNA, 22 bp, Artificial Sequence
  chemically synthesized
cccatggctaccactgcctcag

SEQ ID NO: 1237605 - DNA, 22 bp, Artificial Sequence
  chemically synthesized
ccccatggctaccactgcctca

SEQ ID NO: 1237606 - DNA, 22 bp, Artificial Sequence
  chemically synthesized
tccccatggctaccactgcctc

SEQ ID NO: 1237607 - DNA, 22 bp, Artificial Sequence
  chemically synthesized
accatgagcctgaggcagtggt

SEQ ID NO: 1237608 - DNA, 22 bp, Artificial Sequence
  chemically synthesized
ttccccatggctaccactgcct

SEQ ID NO: 1237609 - DNA, 22 bp, Artificial Sequence
  chemically synthesized
aggcagtggtagccatggggaa

SEQ ID NO: 1237610 - DNA, 22 bp, Artificial Sequence
  chemically synthesized
ataagcagaggaatttttcccc

SEQ ID NO: 1237611 - DNA, 22 bp, Artificial Sequence
  chemically synthesized
cataagcagaggaatttttccc

SEQ ID NO: 1237612 - DNA, 22 bp, Artificial Sequence
  chemically synthesized
ccatttcataagcagaggaatt

SEQ ID NO: 1237613 - DNA, 22 bp, Artificial Sequence
  chemically synthesized
cccatttcataagcagaggaat

SEQ ID NO: 1237614 - DNA, 22 bp, Artificial Sequence
  chemically synthesized
tcccatttcataagcagaggaa

SEQ ID NO: 1237615 - DNA, 22 bp, Artificial Sequence
  chemically synthesized
ctttcccatttcataagcagag

SEQ ID NO: 1237616 - DNA, 22 bp, Artificial Sequence
  chemically synthesized
cctttcccatttcataagcaga

SEQ ID NO: 1237617 - DNA, 22 bp, Artificial Sequence
  chemically synthesized
ttcctttcccatttcataagca

SEQ ID NO: 1237618 - DNA, 22 bp, Artificial Sequence
  chemically synthesized
tcccattcttcctttcccattt

SEQ ID NO: 1237619 - DNA, 22 bp, Artificial Sequence
  chemically synthesized
ctctgcttatgaaatgggaaag

SEQ ID NO: 1237620 - DNA, 22 bp, Artificial Sequence
  chemically synthesized
gtcccattcttcctttcccatt

SEQ ID NO: 1237621 - DNA, 22 bp, Artificial Sequence
  chemically synthesized
tgcttatgaaatgggaaaggaa

SEQ ID NO: 1237622 - DNA, 22 bp, Artificial Sequence
  chemically synthesized
cttatgaaatgggaaaggaaga

SEQ ID NO: 1237623 - DNA, 22 bp, Artificial Sequence
  chemically synthesized
atgaaatgggaaaggaagaatg

SEQ ID NO: 1237624 - DNA, 22 bp, Artificial Sequence
  chemically synthesized
tgaaatgggaaaggaagaatgg

SEQ ID NO: 1237625 - DNA, 22 bp, Artificial Sequence
  chemically synthesized
gcacccaagccacaatacaaag

SEQ ID NO: 1237626 - DNA, 22 bp, Artificial Sequence
  chemically synthesized
tggcagagctggcacccaagcc

SEQ ID NO: 1237627 - DNA, 22 bp, Artificial Sequence
  chemically synthesized
ttgtggcagagctggcacccaa

SEQ ID NO: 1237628 - DNA, 22 bp, Artificial Sequence
  chemically synthesized
tgtattgtggcttgggtgccag

SEQ ID NO: 1237629 - DNA, 22 bp, Artificial Sequence
  chemically synthesized
gtattgtggcttgggtgccagc

SEQ ID NO: 1237630 - DNA, 22 bp, Artificial Sequence
  chemically synthesized
tattgtggcagagctggcaccc

SEQ ID NO: 1237631 - DNA, 22 bp, Artificial Sequence
  chemically synthesized
tattgtggcttgggtgccagct

SEQ ID NO: 1237632 - DNA, 22 bp, Artificial Sequence
  chemically synthesized
ctattgtggcagagctggcacc

SEQ ID NO: 1237633 - DNA, 22 bp, Artificial Sequence
  chemically synthesized
ttctattgtggcagagctggca

SEQ ID NO: 1237634 - DNA, 22 bp, Artificial Sequence
  chemically synthesized
tcttctattgtggcagagctgg

SEQ ID NO: 1237635 - DNA, 22 bp, Artificial Sequence
  chemically synthesized
tggcttgggtgccagctctgcc

SEQ ID NO: 1237636 - DNA, 22 bp, Artificial Sequence
  chemically synthesized
gtgctctcttctattgtggcag

SEQ ID NO: 1237637 - DNA, 22 bp, Artificial Sequence
  chemically synthesized
gggtgccagctctgccacaata

SEQ ID NO: 1237638 - DNA, 22 bp, Artificial Sequence
  chemically synthesized
ggtgccagctctgccacaatag

SEQ ID NO: 1237639 - DNA, 22 bp, Artificial Sequence
  chemically synthesized
tctggtgctctcttctattgtg

SEQ ID NO: 1237640 - DNA, 22 bp, Artificial Sequence
  chemically synthesized
tgaatctatctggtgctctctt

SEQ ID NO: 1237641 - DNA, 22 bp, Artificial Sequence
  chemically synthesized
tgccacaatagaagagagcacc

SEQ ID NO: 1237642 - DNA, 22 bp, Artificial Sequence
  chemically synthesized
atgaatctatctggtgctctct

SEQ ID NO: 1237643 - DNA, 22 bp, Artificial Sequence
  chemically synthesized
tatgaatctatctggtgctctc

SEQ ID NO: 1237644 - DNA, 22 bp, Artificial Sequence
  chemically synthesized
ccacaatagaagagagcaccag

SEQ ID NO: 1237645 - DNA, 22 bp, Artificial Sequence
  chemically synthesized
catctttatgaatctatctggt

SEQ ID NO: 1237646 - DNA, 22 bp, Artificial Sequence
  chemically synthesized
aagttgcatctttatgaatcta

SEQ ID NO: 1237647 - DNA, 22 bp, Artificial Sequence
  chemically synthesized
ggagccaaggcctgaagttgca

SEQ ID NO: 1237648 - DNA, 22 bp, Artificial Sequence
  chemically synthesized
ataaagatgcaacttcaggcct

SEQ ID NO: 1237649 - DNA, 22 bp, Artificial Sequence
  chemically synthesized
ccatctaggagccaaggcctga

SEQ ID NO: 1237650 - DNA, 22 bp, Artificial Sequence
  chemically synthesized
gccatctaggagccaaggcctg

SEQ ID NO: 1237651 - DNA, 22 bp, Artificial Sequence
  chemically synthesized
atgcttgccatctaggagccaa

SEQ ID NO: 1237652 - DNA, 22 bp, Artificial Sequence
  chemically synthesized
gatgcttgccatctaggagcca

SEQ ID NO: 1237653 - DNA, 22 bp, Artificial Sequence
  chemically synthesized
tgatgcttgccatctaggagcc

SEQ ID NO: 1237654 - DNA, 22 bp, Artificial Sequence
  chemically synthesized
ttgatgcttgccatctaggagc

SEQ ID NO: 1237655 - DNA, 22 bp, Artificial Sequence
  chemically synthesized
caggccttggctcctagatggc

SEQ ID NO: 1237656 - DNA, 22 bp, Artificial Sequence
  chemically synthesized
aggccttggctcctagatggca

SEQ ID NO: 1237657 - DNA, 22 bp, Artificial Sequence
  chemically synthesized
acttttgatgcttgccatctag

SEQ ID NO: 1237658 - DNA, 22 bp, Artificial Sequence
  chemically synthesized
gacttttgatgcttgccatcta

SEQ ID NO: 1237659 - DNA, 22 bp, Artificial Sequence
  chemically synthesized
tccttgacttttgatgcttgcc

SEQ ID NO: 1237660 - DNA, 22 bp, Artificial Sequence
  chemically synthesized
ggctcctagatggcaagcatca

SEQ ID NO: 1237661 - DNA, 22 bp, Artificial Sequence
  chemically synthesized
atccttgacttttgatgcttgc

SEQ ID NO: 1237662 - DNA, 22 bp, Artificial Sequence
  chemically synthesized
gctcctagatggcaagcatcaa

SEQ ID NO: 1237663 - DNA, 22 bp, Artificial Sequence
  chemically synthesized
tatccttgacttttgatgcttg

SEQ ID NO: 1237664 - DNA, 22 bp, Artificial Sequence
  chemically synthesized
ctagatggcaagcatcaaaagt

SEQ ID NO: 1237665 - DNA, 22 bp, Artificial Sequence
  chemically synthesized
tctttatccttgacttttgatg

SEQ ID NO: 1237666 - DNA, 22 bp, Artificial Sequence
  chemically synthesized
gatggcaagcatcaaaagtcaa

SEQ ID NO: 1237667 - DNA, 22 bp, Artificial Sequence
  chemically synthesized
ggatcctgtctttatccttgac

SEQ ID NO: 1237668 - DNA, 22 bp, Artificial Sequence
  chemically synthesized
aggatcctgtctttatccttga

SEQ ID NO: 1237669 - DNA, 22 bp, Artificial Sequence
  chemically synthesized
taggatcctgtctttatccttg

SEQ ID NO: 1237670 - DNA, 22 bp, Artificial Sequence
  chemically synthesized
ttaggatcctgtctttatcctt

SEQ ID NO: 1237671 - DNA, 22 bp, Artificial Sequence
  chemically synthesized
cttttaggatcctgtctttatc

SEQ ID NO: 1237672 - DNA, 22 bp, Artificial Sequence
  chemically synthesized
ctgcttttaggatcctgtcttt

SEQ ID NO: 1237673 - DNA, 22 bp, Artificial Sequence
  chemically synthesized
gctgcttttaggatcctgtctt

SEQ ID NO: 1237674 - DNA, 22 bp, Artificial Sequence
  chemically synthesized
ttgctgcttttaggatcctgtc

SEQ ID NO: 1237675 - DNA, 22 bp, Artificial Sequence
  chemically synthesized
tcttgctgcttttaggatcctg

SEQ ID NO: 1237676 - DNA, 22 bp, Artificial Sequence
  chemically synthesized
ctcttgctgcttttaggatcct

SEQ ID NO: 1237677 - DNA, 22 bp, Artificial Sequence
  chemically synthesized
tctcttgctgcttttaggatcc

SEQ ID NO: 1237678 - DNA, 22 bp, Artificial Sequence
  chemically synthesized
ttctcttgctgcttttaggatc

SEQ ID NO: 1237679 - DNA, 22 bp, Artificial Sequence
  chemically synthesized
gaatgtatcttttctcttgctg

SEQ ID NO: 1237680 - DNA, 22 bp, Artificial Sequence
  chemically synthesized
ggaatgtatcttttctcttgct

SEQ ID NO: 1237681 - DNA, 22 bp, Artificial Sequence
  chemically synthesized
tggaatgtatcttttctcttgc

SEQ ID NO: 1237682 - DNA, 22 bp, Artificial Sequence
  chemically synthesized
ttggaatgtatcttttctcttg

SEQ ID NO: 1237683 - DNA, 22 bp, Artificial Sequence
  chemically synthesized
tttggaatgtatcttttctctt

SEQ ID NO: 1237684 - DNA, 22 bp, Artificial Sequence
  chemically synthesized
aaagcagcaagagaaaagatac

SEQ ID NO: 1237685 - DNA, 22 bp, Artificial Sequence
  chemically synthesized
agctttttggaatgtatctttt

SEQ ID NO: 1237686 - DNA, 22 bp, Artificial Sequence
  chemically synthesized
ttaagctttttggaatgtatct

SEQ ID NO: 1237687 - DNA, 22 bp, Artificial Sequence
  chemically synthesized
ttgttaagctttttggaatgta

SEQ ID NO: 1237688 - DNA, 22 bp, Artificial Sequence
  chemically synthesized
gttgttgttaagctttttggaa

SEQ ID NO: 1237689 - DNA, 22 bp, Artificial Sequence
  chemically synthesized
ctagttgttgttaagctttttg

SEQ ID NO: 1237690 - DNA, 22 bp, Artificial Sequence
  chemically synthesized
ttactagttgttgttaagcttt

SEQ ID NO: 1237691 - DNA, 22 bp, Artificial Sequence
  chemically synthesized
caaaaagcttaacaacaactag

SEQ ID NO: 1237692 - DNA, 22 bp, Artificial Sequence
  chemically synthesized
agaagcctgttactagttgttg

SEQ ID NO: 1237693 - DNA, 22 bp, Artificial Sequence
  chemically synthesized
ctgagaagcctgttactagttg

SEQ ID NO: 1237694 - DNA, 22 bp, Artificial Sequence
  chemically synthesized
tgctgagaagcctgttactagt

SEQ ID NO: 1237695 - DNA, 22 bp, Artificial Sequence
  chemically synthesized
ctgctgagaagcctgttactag

SEQ ID NO: 1237696 - DNA, 22 bp, Artificial Sequence
  chemically synthesized
tctgctgagaagcctgttacta

SEQ ID NO: 1237697 - DNA, 22 bp, Artificial Sequence
  chemically synthesized
aacaacaactagtaacaggctt

SEQ ID NO: 1237698 - DNA, 22 bp, Artificial Sequence
  chemically synthesized
acaacaactagtaacaggcttc

SEQ ID NO: 1237699 - DNA, 22 bp, Artificial Sequence
  chemically synthesized
taagttttctgctgagaagcct

SEQ ID NO: 1237700 - DNA, 22 bp, Artificial Sequence
  chemically synthesized
gcctgtaagttttctgctgaga

SEQ ID NO: 1237701 - DNA, 22 bp, Artificial Sequence
  chemically synthesized
agcctgtaagttttctgctgag

SEQ ID NO: 1237702 - DNA, 22 bp, Artificial Sequence
  chemically synthesized
gtaacaggcttctcagcagaaa

SEQ ID NO: 1237703 - DNA, 22 bp, Artificial Sequence
  chemically synthesized
ctcagcagaaaacttacaggct

SEQ ID NO: 1237704 - DNA, 22 bp, Artificial Sequence
  chemically synthesized
tcagcagaaaacttacaggcta

SEQ ID NO: 1237705 - DNA, 22 bp, Artificial Sequence
  chemically synthesized
agcagaaaacttacaggctaag

SEQ ID NO: 1237706 - DNA, 22 bp, Artificial Sequence
  chemically synthesized
aatatggcatgacatgtcttag

SEQ ID NO: 1237707 - DNA, 22 bp, Artificial Sequence
  chemically synthesized
aaatatggcatgacatgtctta

SEQ ID NO: 1237708 - DNA, 22 bp, Artificial Sequence
  chemically synthesized
taaatatggcatgacatgtctt

SEQ ID NO: 1237709 - DNA, 22 bp, Artificial Sequence
  chemically synthesized
acaggctaagacatgtcatgcc

SEQ ID NO: 1237710 - DNA, 22 bp, Artificial Sequence
  chemically synthesized
caggctaagacatgtcatgcca

SEQ ID NO: 1237711 - DNA, 22 bp, Artificial Sequence
  chemically synthesized
agcactttaaatatggcatgac

SEQ ID NO: 1237712 - DNA, 22 bp, Artificial Sequence
  chemically synthesized
cagcactttaaatatggcatga

SEQ ID NO: 1237713 - DNA, 22 bp, Artificial Sequence
  chemically synthesized
cttcagcactttaaatatggca

SEQ ID NO: 1237714 - DNA, 22 bp, Artificial Sequence
  chemically synthesized
ccttcagcactttaaatatggc

SEQ ID NO: 1237715 - DNA, 22 bp, Artificial Sequence
  chemically synthesized
agacatgtcatgccatatttaa

SEQ ID NO: 1237716 - DNA, 22 bp, Artificial Sequence
  chemically synthesized
tccttcagcactttaaatatgg

SEQ ID NO: 1237717 - DNA, 22 bp, Artificial Sequence
  chemically synthesized
ttccttcagcactttaaatatg

SEQ ID NO: 1237718 - DNA, 22 bp, Artificial Sequence
  chemically synthesized
gcataaagggtcttttccttca

SEQ ID NO: 1237719 - DNA, 22 bp, Artificial Sequence
  chemically synthesized
aaagtgctgaaggaaaagaccc

SEQ ID NO: 1237720 - DNA, 22 bp, Artificial Sequence
  chemically synthesized
tcctagcataaagggtcttttc

SEQ ID NO: 1237721 - DNA, 22 bp, Artificial Sequence
  chemically synthesized
aagtgctgaaggaaaagaccct

SEQ ID NO: 1237722 - DNA, 22 bp, Artificial Sequence
  chemically synthesized
aaggaaaagaccctttatgcta

SEQ ID NO: 1237723 - DNA, 22 bp, Artificial Sequence
  chemically synthesized
gatgcactatcctagcataaag

SEQ ID NO: 1237724 - DNA, 22 bp, Artificial Sequence
  chemically synthesized
actggatgcactatcctagcat

SEQ ID NO: 1237725 - DNA, 22 bp, Artificial Sequence
  chemically synthesized
cactggatgcactatcctagca

SEQ ID NO: 1237726 - DNA, 22 bp, Artificial Sequence
  chemically synthesized
tcactggatgcactatcctagc

SEQ ID NO: 1237727 - DNA, 22 bp, Artificial Sequence
  chemically synthesized
tatgctaggatagtgcatccag

SEQ ID NO: 1237728 - DNA, 22 bp, Artificial Sequence
  chemically synthesized
atgctaggatagtgcatccagt

SEQ ID NO: 1237729 - DNA, 22 bp, Artificial Sequence
  chemically synthesized
tgctaggatagtgcatccagtg

SEQ ID NO: 1237730 - DNA, 22 bp, Artificial Sequence
  chemically synthesized
gaaggagattttcactggatgc

SEQ ID NO: 1237731 - DNA, 22 bp, Artificial Sequence
  chemically synthesized
ttggaaggagattttcactgga

SEQ ID NO: 1237732 - DNA, 22 bp, Artificial Sequence
  chemically synthesized
gttggaaggagattttcactgg

SEQ ID NO: 1237733 - DNA, 22 bp, Artificial Sequence
  chemically synthesized
ggatagtgcatccagtgaaaat

SEQ ID NO: 1237734 - DNA, 22 bp, Artificial Sequence
  chemically synthesized
ttgttggaaggagattttcact

SEQ ID NO: 1237735 - DNA, 22 bp, Artificial Sequence
  chemically synthesized
cttgttggaaggagattttcac

SEQ ID NO: 1237736 - DNA, 22 bp, Artificial Sequence
  chemically synthesized
tcttgttggaaggagattttca

SEQ ID NO: 1237737 - DNA, 22 bp, Artificial Sequence
  chemically synthesized
tctttcttgttggaaggagatt

SEQ ID NO: 1237738 - DNA, 22 bp, Artificial Sequence
  chemically synthesized
atctttcttgttggaaggagat

SEQ ID NO: 1237739 - DNA, 22 bp, Artificial Sequence
  chemically synthesized
tatctttcttgttggaaggaga

SEQ ID NO: 1237740 - DNA, 22 bp, Artificial Sequence
  chemically synthesized
gaaggtctttatctttcttgtt

SEQ ID NO: 1237741 - DNA, 22 bp, Artificial Sequence
  chemically synthesized
ggaaggtctttatctttcttgt

SEQ ID NO: 1237742 - DNA, 22 bp, Artificial Sequence
  chemically synthesized
tcttggaaggtctttatctttc

SEQ ID NO: 1237743 - DNA, 22 bp, Artificial Sequence
  chemically synthesized
cttccaacaagaaagataaaga

SEQ ID NO: 1237744 - DNA, 22 bp, Artificial Sequence
  chemically synthesized
tgtcttggaaggtctttatctt

SEQ ID NO: 1237745 - DNA, 22 bp, Artificial Sequence
  chemically synthesized
ctgtcttggaaggtctttatct

SEQ ID NO: 1237746 - DNA, 22 bp, Artificial Sequence
  chemically synthesized
ccaacaagaaagataaagacct

SEQ ID NO: 1237747 - DNA, 22 bp, Artificial Sequence
  chemically synthesized
caacaagaaagataaagacctt

SEQ ID NO: 1237748 - DNA, 22 bp, Artificial Sequence
  chemically synthesized
atgaaatcccacagcttctgtc

SEQ ID NO: 1237749 - DNA, 22 bp, Artificial Sequence
  chemically synthesized
gtgttgatgaaatcccacagct

SEQ ID NO: 1237750 - DNA, 22 bp, Artificial Sequence
  chemically synthesized
ccaagacagaagctgtgggatt

SEQ ID NO: 1237751 - DNA, 22 bp, Artificial Sequence
  chemically synthesized
caagacagaagctgtgggattt

SEQ ID NO: 1237752 - DNA, 22 bp, Artificial Sequence
  chemically synthesized
tagaacaggtctggtgttgatg

SEQ ID NO: 1237753 - DNA, 22 bp, Artificial Sequence
  chemically synthesized
gtagaacaggtctggtgttgat

SEQ ID NO: 1237754 - DNA, 22 bp, Artificial Sequence
  chemically synthesized
ttgtagaacaggtctggtgttg

SEQ ID NO: 1237755 - DNA, 22 bp, Artificial Sequence
  chemically synthesized
tgggatttcatcaacaccagac

SEQ ID NO: 1237756 - DNA, 22 bp, Artificial Sequence
  chemically synthesized
cttgtagaacaggtctggtgtt

SEQ ID NO: 1237757 - DNA, 22 bp, Artificial Sequence
  chemically synthesized
gcatttcttgtagaacaggtct

SEQ ID NO: 1237758 - DNA, 22 bp, Artificial Sequence
  chemically synthesized
agcatttcttgtagaacaggtc

SEQ ID NO: 1237759 - DNA, 22 bp, Artificial Sequence
  chemically synthesized
catcaacaccagacctgttcta

SEQ ID NO: 1237760 - DNA, 22 bp, Artificial Sequence
  chemically synthesized
tagcatttcttgtagaacaggt

SEQ ID NO: 1237761 - DNA, 22 bp, Artificial Sequence
  chemically synthesized
atcaacaccagacctgttctac

SEQ ID NO: 1237762 - DNA, 22 bp, Artificial Sequence
  chemically synthesized
tttagcatttcttgtagaacag

SEQ ID NO: 1237763 - DNA, 22 bp, Artificial Sequence
  chemically synthesized
tctttagcatttcttgtagaac

SEQ ID NO: 1237764 - DNA, 22 bp, Artificial Sequence
  chemically synthesized
ataaattctctttagcatttct

SEQ ID NO: 1237765 - DNA, 22 bp, Artificial Sequence
  chemically synthesized
ttctacaagaaatgctaaagag

SEQ ID NO: 1237766 - DNA, 22 bp, Artificial Sequence
  chemically synthesized
cagttgataaattctctttagc

SEQ ID NO: 1237767 - DNA, 22 bp, Artificial Sequence
  chemically synthesized
ccagttgataaattctctttag

SEQ ID NO: 1237768 - DNA, 22 bp, Artificial Sequence
  chemically synthesized
tacaagaaatgctaaagagaat

SEQ ID NO: 1237769 - DNA, 22 bp, Artificial Sequence
  chemically synthesized
tccagttgataaattctcttta

SEQ ID NO: 1237770 - DNA, 22 bp, Artificial Sequence
  chemically synthesized
caagaaatgctaaagagaattt

SEQ ID NO: 1237771 - DNA, 22 bp, Artificial Sequence
  chemically synthesized
tttccagttgataaattctctt

SEQ ID NO: 1237772 - DNA, 22 bp, Artificial Sequence
  chemically synthesized
ctttccagttgataaattctct

SEQ ID NO: 1237773 - DNA, 22 bp, Artificial Sequence
  chemically synthesized
ttctttccagttgataaattct

SEQ ID NO: 1237774 - DNA, 22 bp, Artificial Sequence
  chemically synthesized
aggtcctcttctttccagttga

SEQ ID NO: 1237775 - DNA, 22 bp, Artificial Sequence
  chemically synthesized
aagagaatttatcaactggaaa

SEQ ID NO: 1237776 - DNA, 22 bp, Artificial Sequence
  chemically synthesized
gttaaggtcctcttctttccag

SEQ ID NO: 1237777 - DNA, 22 bp, Artificial Sequence
  chemically synthesized
gctagttaaggtcctcttcttt

SEQ ID NO: 1237778 - DNA, 22 bp, Artificial Sequence
  chemically synthesized
tggctagttaaggtcctcttct

SEQ ID NO: 1237779 - DNA, 22 bp, Artificial Sequence
  chemically synthesized
atcaactggaaagaagaggacc

SEQ ID NO: 1237780 - DNA, 22 bp, Artificial Sequence
  chemically synthesized
ctggctagttaaggtcctcttc

SEQ ID NO: 1237781 - DNA, 22 bp, Artificial Sequence
  chemically synthesized
tcaactggaaagaagaggacct

SEQ ID NO: 1237782 - DNA, 22 bp, Artificial Sequence
  chemically synthesized
tctggctagttaaggtcctctt

SEQ ID NO: 1237783 - DNA, 22 bp, Artificial Sequence
  chemically synthesized
ttctggctagttaaggtcctct

SEQ ID NO: 1237784 - DNA, 22 bp, Artificial Sequence
  chemically synthesized
gaaagaagaggaccttaactag

SEQ ID NO: 1237785 - DNA, 22 bp, Artificial Sequence
  chemically synthesized
agatggtttttctggctagtta

SEQ ID NO: 1237786 - DNA, 22 bp, Artificial Sequence
  chemically synthesized
cagatggtttttctggctagtt

SEQ ID NO: 1237787 - DNA, 22 bp, Artificial Sequence
  chemically synthesized
tgccttcagatggtttttctgg

SEQ ID NO: 1237788 - DNA, 22 bp, Artificial Sequence
  chemically synthesized
gtgccttcagatggtttttctg

SEQ ID NO: 1237789 - DNA, 22 bp, Artificial Sequence
  chemically synthesized
tgtgccttcagatggtttttct

SEQ ID NO: 1237790 - DNA, 22 bp, Artificial Sequence
  chemically synthesized
aactagccagaaaaaccatctg

SEQ ID NO: 1237791 - DNA, 22 bp, Artificial Sequence
  chemically synthesized
actagccagaaaaaccatctga

SEQ ID NO: 1237792 - DNA, 22 bp, Artificial Sequence
  chemically synthesized
agttttgtgccttcagatggtt

SEQ ID NO: 1237793 - DNA, 22 bp, Artificial Sequence
  chemically synthesized
ctgagttttgtgccttcagatg

SEQ ID NO: 1237794 - DNA, 22 bp, Artificial Sequence
  chemically synthesized
gccagaaaaaccatctgaaggc

SEQ ID NO: 1237795 - DNA, 22 bp, Artificial Sequence
  chemically synthesized
actgagttttgtgccttcagat

SEQ ID NO: 1237796 - DNA, 22 bp, Artificial Sequence
  chemically synthesized
tacttactgagttttgtgcctt

SEQ ID NO: 1237797 - DNA, 22 bp, Artificial Sequence
  chemically synthesized
tctgtacttactgagttttgtg

SEQ ID NO: 1237798 - DNA, 22 bp, Artificial Sequence
  chemically synthesized
gtctgtacttactgagttttgt

SEQ ID NO: 1237799 - DNA, 22 bp, Artificial Sequence
  chemically synthesized
tgtttgtctgtacttactgagt

SEQ ID NO: 1237800 - DNA, 22 bp, Artificial Sequence
  chemically synthesized
gtgtttgtctgtacttactgag

SEQ ID NO: 1237801 - DNA, 22 bp, Artificial Sequence
  chemically synthesized
aaggcacaaaactcagtaagta

SEQ ID NO: 1237802 - DNA, 22 bp, Artificial Sequence
  chemically synthesized
caatagtttgtgtttgtctgta

SEQ ID NO: 1237803 - DNA, 22 bp, Artificial Sequence
  chemically synthesized
agtaagtacagacaaacacaaa

SEQ ID NO: 1237804 - DNA, 22 bp, Artificial Sequence
  chemically synthesized
cagtattacaatagtttgtgtt

SEQ ID NO: 1237805 - DNA, 22 bp, Artificial Sequence
  chemically synthesized
atacatcacaattacagtatta

SEQ ID NO: 1237806 - DNA, 22 bp, Artificial Sequence
  chemically synthesized
ttgtaatactgtaattgtgatg

SEQ ID NO: 1237807 - DNA, 22 bp, Artificial Sequence
  chemically synthesized
taatactgtaattgtgatgtat

SEQ ID NO: 1237808 - DNA, 22 bp, Artificial Sequence
  chemically synthesized
aagatatgagtagttcatacat

SEQ ID NO: 1237809 - DNA, 22 bp, Artificial Sequence
  chemically synthesized
ttcaagatatgagtagttcata

SEQ ID NO: 1237810 - DNA, 22 bp, Artificial Sequence
  chemically synthesized
taattgtgatgtatgaactact

SEQ ID NO: 1237811 - DNA, 22 bp, Artificial Sequence
  chemically synthesized
attcaagatatgagtagttcat

SEQ ID NO: 1237812 - DNA, 22 bp, Artificial Sequence
  chemically synthesized
ttattcaagatatgagtagttc

SEQ ID NO: 1237813 - DNA, 22 bp, Artificial Sequence
  chemically synthesized
cttattcaagatatgagtagtt

SEQ ID NO: 1237814 - DNA, 22 bp, Artificial Sequence
  chemically synthesized
ttcttattcaagatatgagtag

SEQ ID NO: 1237815 - DNA, 22 bp, Artificial Sequence
  chemically synthesized
tgatgtatgaactactcatatc

SEQ ID NO: 1237816 - DNA, 22 bp, Artificial Sequence
  chemically synthesized
ctcttcttattcaagatatgag

SEQ ID NO: 1237817 - DNA, 22 bp, Artificial Sequence
  chemically synthesized
actcttcttattcaagatatga

SEQ ID NO: 1237818 - DNA, 22 bp, Artificial Sequence
  chemically synthesized
tactcttcttattcaagatatg

SEQ ID NO: 1237819 - DNA, 22 bp, Artificial Sequence
  chemically synthesized
ttactcttcttattcaagatat

SEQ ID NO: 1237820 - DNA, 22 bp, Artificial Sequence
  chemically synthesized
tttactcttcttattcaagata

SEQ ID NO: 1237821 - DNA, 22 bp, Artificial Sequence
  chemically synthesized
ttttactcttcttattcaagat

SEQ ID NO: 1237822 - DNA, 22 bp, Artificial Sequence
  chemically synthesized
tttttactcttcttattcaaga

SEQ ID NO: 1237823 - DNA, 22 bp, Artificial Sequence
  chemically synthesized
ctttttttactcttcttattca

SEQ ID NO: 1237824 - DNA, 22 bp, Artificial Sequence
  chemically synthesized
cctttttttactcttcttattc

SEQ ID NO: 1237825 - DNA, 22 bp, Artificial Sequence
  chemically synthesized
ctcatatcttgaataagaagag

SEQ ID NO: 1237826 - DNA, 22 bp, Artificial Sequence
  chemically synthesized
atatcttgaataagaagagtaa

SEQ ID NO: 1237827 - DNA, 22 bp, Artificial Sequence
  chemically synthesized
aaagcttcctttttttactctt

SEQ ID NO: 1237828 - DNA, 22 bp, Artificial Sequence
  chemically synthesized
actgaaagcttcctttttttac

SEQ ID NO: 1237829 - DNA, 22 bp, Artificial Sequence
  chemically synthesized
gaataagaagagtaaaaaaagg

SEQ ID NO: 1237830 - DNA, 22 bp, Artificial Sequence
  chemically synthesized
aataagaagagtaaaaaaagga

SEQ ID NO: 1237831 - DNA, 22 bp, Artificial Sequence
  chemically synthesized
ttaactgaaagcttcctttttt

SEQ ID NO: 1237832 - DNA, 22 bp, Artificial Sequence
  chemically synthesized
gttaactgaaagcttccttttt

SEQ ID NO: 1237833 - DNA, 22 bp, Artificial Sequence
  chemically synthesized
tttgttaactgaaagcttcctt

SEQ ID NO: 1237834 - DNA, 22 bp, Artificial Sequence
  chemically synthesized
gagttatttgttaactgaaagc

SEQ ID NO: 1237835 - DNA, 22 bp, Artificial Sequence
  chemically synthesized
ttagagttatttgttaactgaa

SEQ ID NO: 1237836 - DNA, 22 bp, Artificial Sequence
  chemically synthesized
aagttattagagttatttgtta

SEQ ID NO: 1237837 - DNA, 22 bp, Artificial Sequence
  chemically synthesized
aaagttattagagttatttgtt

SEQ ID NO: 1237838 - DNA, 22 bp, Artificial Sequence
  chemically synthesized
tcagttaacaaataactctaat

SEQ ID NO: 1237839 - DNA, 22 bp, Artificial Sequence
  chemically synthesized
tgtcttaaagttattagagtta

SEQ ID NO: 1237840 - DNA, 22 bp, Artificial Sequence
  chemically synthesized
cagttaacaaataactctaata

SEQ ID NO: 1237841 - DNA, 22 bp, Artificial Sequence
  chemically synthesized
agttaacaaataactctaataa

SEQ ID NO: 1237842 - DNA, 22 bp, Artificial Sequence
  chemically synthesized
tctatgtcttaaagttattaga

SEQ ID NO: 1237843 - DNA, 22 bp, Artificial Sequence
  chemically synthesized
acaaataactctaataacttta

SEQ ID NO: 1237844 - DNA, 22 bp, Artificial Sequence
  chemically synthesized
tactgtctatgtcttaaagtta

SEQ ID NO: 1237845 - DNA, 22 bp, Artificial Sequence
  chemically synthesized
attatactgtctatgtcttaaa

SEQ ID NO: 1237846 - DNA, 22 bp, Artificial Sequence
  chemically synthesized
taataactttaagacatagaca

SEQ ID NO: 1237847 - DNA, 22 bp, Artificial Sequence
  chemically synthesized
tatctcattatactgtctatgt

SEQ ID NO: 1237848 - DNA, 22 bp, Artificial Sequence
  chemically synthesized
ataactttaagacatagacagt

SEQ ID NO: 1237849 - DNA, 22 bp, Artificial Sequence
  chemically synthesized
atatctcattatactgtctatg

SEQ ID NO: 1237850 - DNA, 22 bp, Artificial Sequence
  chemically synthesized
tttatatctcattatactgtct

SEQ ID NO: 1237851 - DNA, 22 bp, Artificial Sequence
  chemically synthesized
gtttatatctcattatactgtc

SEQ ID NO: 1237852 - DNA, 22 bp, Artificial Sequence
  chemically synthesized
taagacatagacagtataatga

SEQ ID NO: 1237853 - DNA, 22 bp, Artificial Sequence
  chemically synthesized
tttgtttatatctcattatact

SEQ ID NO: 1237854 - DNA, 22 bp, Artificial Sequence
  chemically synthesized
aagacatagacagtataatgag

SEQ ID NO: 1237855 - DNA, 22 bp, Artificial Sequence
  chemically synthesized
agacatagacagtataatgaga

SEQ ID NO: 1237856 - DNA, 22 bp, Artificial Sequence
  chemically synthesized
ttgtttgtttatatctcattat

SEQ ID NO: 1237857 - DNA, 22 bp, Artificial Sequence
  chemically synthesized
gttgtttgtttatatctcatta

SEQ ID NO: 1237858 - DNA, 22 bp, Artificial Sequence
  chemically synthesized
tgttgtttgtttatatctcatt

SEQ ID NO: 1237859 - DNA, 22 bp, Artificial Sequence
  chemically synthesized
ttgttgtttgtttatatctcat

SEQ ID NO: 1237860 - DNA, 22 bp, Artificial Sequence
  chemically synthesized
tttgttgtttgtttatatctca

SEQ ID NO: 1237861 - DNA, 22 bp, Artificial Sequence
  chemically synthesized
atctttttgttgtttgtttata

SEQ ID NO: 1237862 - DNA, 22 bp, Artificial Sequence
  chemically synthesized
aatctttttgttgtttgtttat

SEQ ID NO: 1237863 - DNA, 22 bp, Artificial Sequence
  chemically synthesized
taatctttttgttgtttgttta

SEQ ID NO: 1237864 - DNA, 22 bp, Artificial Sequence
  chemically synthesized
ttaatctttttgttgtttgttt

SEQ ID NO: 1237865 - DNA, 22 bp, Artificial Sequence
  chemically synthesized
ttttaatctttttgttgtttgt

SEQ ID NO: 1237866 - DNA, 22 bp, Artificial Sequence
  chemically synthesized
gtctcttttaatctttttgttg

SEQ ID NO: 1237867 - DNA, 22 bp, Artificial Sequence
  chemically synthesized
cgtctcttttaatctttttgtt

SEQ ID NO: 1237868 - DNA, 22 bp, Artificial Sequence
  chemically synthesized
aaacttcgtctcttttaatctt

SEQ ID NO: 1237869 - DNA, 22 bp, Artificial Sequence
  chemically synthesized
aaaactcaaacttcgtctcttt

SEQ ID NO: 1237870 - DNA, 22 bp, Artificial Sequence
  chemically synthesized
attaaaaactcaaacttcgtct

SEQ ID NO: 1237871 - DNA, 22 bp, Artificial Sequence
  chemically synthesized
aaagagacgaagtttgagtttt

SEQ ID NO: 1237872 - DNA, 22 bp, Artificial Sequence
  chemically synthesized
gagtttttaattagttttctct

SEQ ID NO: 1237873 - DNA, 22 bp, Artificial Sequence
  chemically synthesized
agtttttaattagttttctctt

SEQ ID NO: 1237874 - DNA, 22 bp, Artificial Sequence
  chemically synthesized
cataaacaagaaagcaaagaga

SEQ ID NO: 1237875 - DNA, 22 bp, Artificial Sequence
  chemically synthesized
ttaattagttttctctttgctt

SEQ ID NO: 1237876 - DNA, 22 bp, Artificial Sequence
  chemically synthesized
taattagttttctctttgcttt

SEQ ID NO: 1237877 - DNA, 22 bp, Artificial Sequence
  chemically synthesized
aattagttttctctttgctttc

SEQ ID NO: 1237878 - DNA, 22 bp, Artificial Sequence
  chemically synthesized
attagttttctctttgctttct

SEQ ID NO: 1237879 - DNA, 22 bp, Artificial Sequence
  chemically synthesized
gttgcataaacaagaaagcaaa

SEQ ID NO: 1237880 - DNA, 22 bp, Artificial Sequence
  chemically synthesized
gttttctctttgctttcttgtt

SEQ ID NO: 1237881 - DNA, 22 bp, Artificial Sequence
  chemically synthesized
tctctttgctttcttgtttatg

SEQ ID NO: 1237882 - DNA, 22 bp, Artificial Sequence
  chemically synthesized
ctctttgctttcttgtttatgc

SEQ ID NO: 1237883 - DNA, 22 bp, Artificial Sequence
  chemically synthesized
tctttgctttcttgtttatgca

SEQ ID NO: 1237884 - DNA, 22 bp, Artificial Sequence
  chemically synthesized
tttgctttcttgtttatgcaac

SEQ ID NO: 1237885 - DNA, 22 bp, Artificial Sequence
  chemically synthesized
tgctttcttgtttatgcaacca

SEQ ID NO: 1237886 - DNA, 22 bp, Artificial Sequence
  chemically synthesized
gctttcttgtttatgcaaccag

SEQ ID NO: 1237887 - DNA, 22 bp, Artificial Sequence
  chemically synthesized
aaacagacaacactggttgcat

SEQ ID NO: 1237888 - DNA, 22 bp, Artificial Sequence
  chemically synthesized
ctttcttgtttatgcaaccagt

SEQ ID NO: 1237889 - DNA, 22 bp, Artificial Sequence
  chemically synthesized
caaacagacaacactggttgca

SEQ ID NO: 1237890 - DNA, 22 bp, Artificial Sequence
  chemically synthesized
tcttgtttatgcaaccagtgtt

SEQ ID NO: 1237891 - DNA, 22 bp, Artificial Sequence
  chemically synthesized
tttcaaacagacaacactggtt

SEQ ID NO: 1237892 - DNA, 22 bp, Artificial Sequence
  chemically synthesized
cttgtttatgcaaccagtgttg

SEQ ID NO: 1237893 - DNA, 22 bp, Artificial Sequence
  chemically synthesized
ttgtttatgcaaccagtgttgt

SEQ ID NO: 1237894 - DNA, 22 bp, Artificial Sequence
  chemically synthesized
gtttatgcaaccagtgttgtct

SEQ ID NO: 1237895 - DNA, 22 bp, Artificial Sequence
  chemically synthesized
tttatgcaaccagtgttgtctg

SEQ ID NO: 1237896 - DNA, 22 bp, Artificial Sequence
  chemically synthesized
atgcaaccagtgttgtctgttt

SEQ ID NO: 1237897 - DNA, 22 bp, Artificial Sequence
  chemically synthesized
tgcaaccagtgttgtctgtttg

SEQ ID NO: 1237898 - DNA, 22 bp, Artificial Sequence
  chemically synthesized
taacccattatttcaaacagac

SEQ ID NO: 1237899 - DNA, 22 bp, Artificial Sequence
  chemically synthesized
caaacactataacccattattt

SEQ ID NO: 1237900 - DNA, 22 bp, Artificial Sequence
  chemically synthesized
acaaacactataacccattatt

SEQ ID NO: 1237901 - DNA, 22 bp, Artificial Sequence
  chemically synthesized
tctgtttgaaataatgggttat

SEQ ID NO: 1237902 - DNA, 22 bp, Artificial Sequence
  chemically synthesized
tttgaaataatgggttatagtg

SEQ ID NO: 1237903 - DNA, 22 bp, Artificial Sequence
  chemically synthesized
gaaataatgggttatagtgttt

SEQ ID NO: 1237904 - DNA, 22 bp, Artificial Sequence
  chemically synthesized
aaataatgggttatagtgtttg

SEQ ID NO: 1237905 - DNA, 22 bp, Artificial Sequence
  chemically synthesized
ccatgaggtttacaaacactat

SEQ ID NO: 1237906 - DNA, 22 bp, Artificial Sequence
  chemically synthesized
aggctaccatgaggtttacaaa

SEQ ID NO: 1237907 - DNA, 22 bp, Artificial Sequence
  chemically synthesized
gaggctaccatgaggtttacaa

SEQ ID NO: 1237908 - DNA, 22 bp, Artificial Sequence
  chemically synthesized
tttgaggctaccatgaggttta

SEQ ID NO: 1237909 - DNA, 22 bp, Artificial Sequence
  chemically synthesized
atttgaggctaccatgaggttt

SEQ ID NO: 1237910 - DNA, 22 bp, Artificial Sequence
  chemically synthesized
tagtgtttgtaaacctcatggt

SEQ ID NO: 1237911 - DNA, 22 bp, Artificial Sequence
  chemically synthesized
ttatttgaggctaccatgaggt

SEQ ID NO: 1237912 - DNA, 22 bp, Artificial Sequence
  chemically synthesized
cttatttgaggctaccatgagg

SEQ ID NO: 1237913 - DNA, 22 bp, Artificial Sequence
  chemically synthesized
gtaaacctcatggtagcctcaa

SEQ ID NO: 1237914 - DNA, 22 bp, Artificial Sequence
  chemically synthesized
taaacctcatggtagcctcaaa

SEQ ID NO: 1237915 - DNA, 22 bp, Artificial Sequence
  chemically synthesized
gtatatcttcttatttgaggct

SEQ ID NO: 1237916 - DNA, 22 bp, Artificial Sequence
  chemically synthesized
agtatatcttcttatttgaggc

SEQ ID NO: 1237917 - DNA, 22 bp, Artificial Sequence
  chemically synthesized
atggtagcctcaaataagaaga

SEQ ID NO: 1237918 - DNA, 22 bp, Artificial Sequence
  chemically synthesized
tgaatcttagtatatcttctta

SEQ ID NO: 1237919 - DNA, 22 bp, Artificial Sequence
  chemically synthesized
gtgaatcttagtatatcttctt

SEQ ID NO: 1237920 - DNA, 22 bp, Artificial Sequence
  chemically synthesized
tgtgaatcttagtatatcttct

SEQ ID NO: 1237921 - DNA, 22 bp, Artificial Sequence
  chemically synthesized
aattttgtgaatcttagtatat

SEQ ID NO: 1237922 - DNA, 22 bp, Artificial Sequence
  chemically synthesized
aaattttgtgaatcttagtata

SEQ ID NO: 1237923 - DNA, 22 bp, Artificial Sequence
  chemically synthesized
aaataagaagatatactaagat

SEQ ID NO: 1237924 - DNA, 22 bp, Artificial Sequence
  chemically synthesized
taaattttgtgaatcttagtat

SEQ ID NO: 1237925 - DNA, 22 bp, Artificial Sequence
  chemically synthesized
ttaaattttgtgaatcttagta

SEQ ID NO: 1237926 - DNA, 22 bp, Artificial Sequence
  chemically synthesized
tttaaattttgtgaatcttagt

SEQ ID NO: 1237927 - DNA, 22 bp, Artificial Sequence
  chemically synthesized
ctttttaaattttgtgaatctt

SEQ ID NO: 1237928 - DNA, 22 bp, Artificial Sequence
  chemically synthesized
gctttttaaattttgtgaatct

SEQ ID NO: 1237929 - DNA, 22 bp, Artificial Sequence
  chemically synthesized
ttgctttttaaattttgtgaat

SEQ ID NO: 1237930 - DNA, 22 bp, Artificial Sequence
  chemically synthesized
cttgctttttaaattttgtgaa

SEQ ID NO: 1237931 - DNA, 22 bp, Artificial Sequence
  chemically synthesized
tttcttgctttttaaattttgt

SEQ ID NO: 1237932 - DNA, 22 bp, Artificial Sequence
  chemically synthesized
atttcttgctttttaaattttg

SEQ ID NO: 1237933 - DNA, 22 bp, Artificial Sequence
  chemically synthesized
tatttcttgctttttaaatttt

SEQ ID NO: 1237934 - DNA, 22 bp, Artificial Sequence
  chemically synthesized
ttatttcttgctttttaaattt

SEQ ID NO: 1237935 - DNA, 22 bp, Artificial Sequence
  chemically synthesized
agattcacaaaatttaaaaagc

SEQ ID NO: 1237936 - DNA, 22 bp, Artificial Sequence
  chemically synthesized
acaaaatttaaaaagcaagaaa

SEQ ID NO: 1237937 - DNA, 22 bp, Artificial Sequence
  chemically synthesized
gtggcatgcttttatttcttgc

SEQ ID NO: 1237938 - DNA, 22 bp, Artificial Sequence
  chemically synthesized
tagtggcatgcttttatttctt

SEQ ID NO: 1237939 - DNA, 22 bp, Artificial Sequence
  chemically synthesized
tctagtggcatgcttttatttc

SEQ ID NO: 1237940 - DNA, 22 bp, Artificial Sequence
  chemically synthesized
ctctagtggcatgcttttattt

SEQ ID NO: 1237941 - DNA, 22 bp, Artificial Sequence
  chemically synthesized
tctctagtggcatgcttttatt

SEQ ID NO: 1237942 - DNA, 22 bp, Artificial Sequence
  chemically synthesized
aaaaagcaagaaataaaagcat

SEQ ID NO: 1237943 - DNA, 22 bp, Artificial Sequence
  chemically synthesized
ttctctagtggcatgcttttat

SEQ ID NO: 1237944 - DNA, 22 bp, Artificial Sequence
  chemically synthesized
aaaagcaagaaataaaagcatg

SEQ ID NO: 1237945 - DNA, 22 bp, Artificial Sequence
  chemically synthesized
gtgaaggcgatttttctctagt

SEQ ID NO: 1237946 - DNA, 22 bp, Artificial Sequence
  chemically synthesized
agtgaaggcgatttttctctag

SEQ ID NO: 1237947 - DNA, 22 bp, Artificial Sequence
  chemically synthesized
tagtgaaggcgatttttctcta

SEQ ID NO: 1237948 - DNA, 22 bp, Artificial Sequence
  chemically synthesized
ttagtgaaggcgatttttctct

SEQ ID NO: 1237949 - DNA, 22 bp, Artificial Sequence
  chemically synthesized
tttagtgaaggcgatttttctc

SEQ ID NO: 1237950 - DNA, 22 bp, Artificial Sequence
  chemically synthesized
ctttttagtgaaggcgattttt

SEQ ID NO: 1237951 - DNA, 22 bp, Artificial Sequence
  chemically synthesized
cctttttagtgaaggcgatttt

SEQ ID NO: 1237952 - DNA, 22 bp, Artificial Sequence
  chemically synthesized
tcttcctttttagtgaaggcga

SEQ ID NO: 1237953 - DNA, 22 bp, Artificial Sequence
  chemically synthesized
gagaaaaatcgccttcactaaa

SEQ ID NO: 1237954 - DNA, 22 bp, Artificial Sequence
  chemically synthesized
catcctgtcttcctttttagtg

SEQ ID NO: 1237955 - DNA, 22 bp, Artificial Sequence
  chemically synthesized
ccatcctgtcttcctttttagt

SEQ ID NO: 1237956 - DNA, 22 bp, Artificial Sequence
  chemically synthesized
ttccatcctgtcttccttttta

SEQ ID NO: 1237957 - DNA, 22 bp, Artificial Sequence
  chemically synthesized
tcttccatcctgtcttcctttt

SEQ ID NO: 1237958 - DNA, 22 bp, Artificial Sequence
  chemically synthesized
ctcttccatcctgtcttccttt

SEQ ID NO: 1237959 - DNA, 22 bp, Artificial Sequence
  chemically synthesized
tctcttccatcctgtcttcctt

SEQ ID NO: 1237960 - DNA, 22 bp, Artificial Sequence
  chemically synthesized
cactaaaaaggaagacaggatg

SEQ ID NO: 1237961 - DNA, 22 bp, Artificial Sequence
  chemically synthesized
actaaaaaggaagacaggatgg

SEQ ID NO: 1237962 - DNA, 22 bp, Artificial Sequence
  chemically synthesized
tggctttctcttccatcctgtc

SEQ ID NO: 1237963 - DNA, 22 bp, Artificial Sequence
  chemically synthesized
gtggctttctcttccatcctgt

SEQ ID NO: 1237964 - DNA, 22 bp, Artificial Sequence
  chemically synthesized
tgtggctttctcttccatcctg

SEQ ID NO: 1237965 - DNA, 22 bp, Artificial Sequence
  chemically synthesized
aaaaggaagacaggatggaaga

SEQ ID NO: 1237966 - DNA, 22 bp, Artificial Sequence
  chemically synthesized
ttttgtggctttctcttccatc

SEQ ID NO: 1237967 - DNA, 22 bp, Artificial Sequence
  chemically synthesized
gttgttttgtggctttctcttc

SEQ ID NO: 1237968 - DNA, 22 bp, Artificial Sequence
  chemically synthesized
tggttgttttgtggctttctct

SEQ ID NO: 1237969 - DNA, 22 bp, Artificial Sequence
  chemically synthesized
ctggttgttttgtggctttctc

SEQ ID NO: 1237970 - DNA, 22 bp, Artificial Sequence
  chemically synthesized
tctggttgttttgtggctttct

SEQ ID NO: 1237971 - DNA, 22 bp, Artificial Sequence
  chemically synthesized
ttttctggttgttttgtggctt

SEQ ID NO: 1237972 - DNA, 22 bp, Artificial Sequence
  chemically synthesized
gttttctggttgttttgtggct

SEQ ID NO: 1237973 - DNA, 22 bp, Artificial Sequence
  chemically synthesized
tgttttctggttgttttgtggc

SEQ ID NO: 1237974 - DNA, 22 bp, Artificial Sequence
  chemically synthesized
ccattttgttttctggttgttt

SEQ ID NO: 1237975 - DNA, 22 bp, Artificial Sequence
  chemically synthesized
ctaccattttgttttctggttg

SEQ ID NO: 1237976 - DNA, 22 bp, Artificial Sequence
  chemically synthesized
ttcctaccattttgttttctgg

SEQ ID NO: 1237977 - DNA, 22 bp, Artificial Sequence
  chemically synthesized
attcctaccattttgttttctg

SEQ ID NO: 1237978 - DNA, 22 bp, Artificial Sequence
  chemically synthesized
agaacttattcctaccattttg

SEQ ID NO: 1237979 - DNA, 22 bp, Artificial Sequence
  chemically synthesized
ttaagaacttattcctaccatt

SEQ ID NO: 1237980 - DNA, 22 bp, Artificial Sequence
  chemically synthesized
ttattaagaacttattcctacc

SEQ ID NO: 1237981 - DNA, 22 bp, Artificial Sequence
  chemically synthesized
attattaagaacttattcctac

SEQ ID NO: 1237982 - DNA, 22 bp, Artificial Sequence
  chemically synthesized
tattattaagaacttattccta

SEQ ID NO: 1237983 - DNA, 22 bp, Artificial Sequence
  chemically synthesized
agttttattattaagaacttat

SEQ ID NO: 1237984 - DNA, 22 bp, Artificial Sequence
  chemically synthesized
tgttcagttttattattaagaa

SEQ ID NO: 1237985 - DNA, 22 bp, Artificial Sequence
  chemically synthesized
atgttcagttttattattaaga

SEQ ID NO: 1237986 - DNA, 22 bp, Artificial Sequence
  chemically synthesized
atttatgttcagttttattatt

SEQ ID NO: 1237987 - DNA, 22 bp, Artificial Sequence
  chemically synthesized
catttatgttcagttttattat

SEQ ID NO: 1237988 - DNA, 22 bp, Artificial Sequence
  chemically synthesized
tttcatttatgttcagttttat

SEQ ID NO: 1237989 - DNA, 22 bp, Artificial Sequence
  chemically synthesized
atttcatttatgttcagtttta

SEQ ID NO: 1237990 - DNA, 22 bp, Artificial Sequence
  chemically synthesized
ttaataataaaactgaacataa

SEQ ID NO: 1237991 - DNA, 22 bp, Artificial Sequence
  chemically synthesized
aataataaaactgaacataaat

SEQ ID NO: 1237992 - DNA, 22 bp, Artificial Sequence
  chemically synthesized
ataataaaactgaacataaatg

SEQ ID NO: 1237993 - DNA, 22 bp, Artificial Sequence
  chemically synthesized
gagagtttatttcatttatgtt

SEQ ID NO: 1237994 - DNA, 22 bp, Artificial Sequence
  chemically synthesized
attggagagtttatttcattta

SEQ ID NO: 1237995 - DNA, 22 bp, Artificial Sequence
  chemically synthesized
gattggagagtttatttcattt

SEQ ID NO: 1237996 - DNA, 22 bp, Artificial Sequence
  chemically synthesized
tgattggagagtttatttcatt

SEQ ID NO: 1237997 - DNA, 22 bp, Artificial Sequence
  chemically synthesized
tgttttgattggagagtttatt

SEQ ID NO: 1237998 - DNA, 22 bp, Artificial Sequence
  chemically synthesized
aacataaatgaaataaactctc

SEQ ID NO: 1237999 - DNA, 22 bp, Artificial Sequence
  chemically synthesized
tcactgtgttttgattggagag

SEQ ID NO: 1238000 - DNA, 22 bp, Artificial Sequence
  chemically synthesized
tgtcactgtgttttgattggag

SEQ ID NO: 1238001 - DNA, 22 bp, Artificial Sequence
  chemically synthesized
ctgtcactgtgttttgattgga

SEQ ID NO: 1238002 - DNA, 22 bp, Artificial Sequence
  chemically synthesized
tctgtcactgtgttttgattgg

SEQ ID NO: 1238003 - DNA, 22 bp, Artificial Sequence
  chemically synthesized
ttctgtcactgtgttttgattg

SEQ ID NO: 1238004 - DNA, 22 bp, Artificial Sequence
  chemically synthesized
tttctgtcactgtgttttgatt

SEQ ID NO: 1238005 - DNA, 22 bp, Artificial Sequence
  chemically synthesized
ttttctgtcactgtgttttgat

SEQ ID NO: 1238006 - DNA, 22 bp, Artificial Sequence
  chemically synthesized
tttttctgtcactgtgttttga

SEQ ID NO: 1238007 - DNA, 22 bp, Artificial Sequence
  chemically synthesized
ttttttctgtcactgtgttttg

SEQ ID NO: 1238008 - DNA, 22 bp, Artificial Sequence
  chemically synthesized
tttttttctgtcactgtgtttt

SEQ ID NO: 1238009 - DNA, 22 bp, Artificial Sequence
  chemically synthesized
ttttttttctgtcactgtgttt

SEQ ID NO: 1238010 - DNA, 22 bp, Artificial Sequence
  chemically synthesized
tttttttttctgtcactgtgtt

SEQ ID NO: 1238011 - DNA, 22 bp, Artificial Sequence
  chemically synthesized
ttttttttttctgtcactgtgt

SEQ ID NO: 1238012 - DNA, 22 bp, Artificial Sequence
  chemically synthesized
tttttttttttctgtcactgtg

SEQ ID NO: 1238013 - DNA, 22 bp, Artificial Sequence
  chemically synthesized
tccaatcaaaacacagtgacag

SEQ ID NO: 1238014 - DNA, 22 bp, Artificial Sequence
  chemically synthesized
ttttttttttttctgtcactgt

SEQ ID NO: 1238015 - DNA, 22 bp, Artificial Sequence
  chemically synthesized
tttttttttttttctgtcactg

SEQ ID NO: 1238016 - DNA, 22 bp, Artificial Sequence
  chemically synthesized
caatcaaaacacagtgacagaa

SEQ ID NO: 1238017 - DNA, 22 bp, Artificial Sequence
  chemically synthesized
ttttttttttttttctgtcact

SEQ ID NO: 1238018 - DNA, 22 bp, Artificial Sequence
  chemically synthesized
tttttttttttttttttctgtc

SEQ ID NO: 1238019 - DNA, 22 bp, Artificial Sequence
  chemically synthesized
gtttttttttttttttttctgt

SEQ ID NO: 1238020 - DNA, 22 bp, Artificial Sequence
  chemically synthesized
tttgtttttttttttttttttc

SEQ ID NO: 1238021 - DNA, 22 bp, Artificial Sequence
  chemically synthesized
ttgtttgttttttttttttttt

SEQ ID NO: 1238022 - DNA, 22 bp, Artificial Sequence
  chemically synthesized
ttgttgtttgtttttttttttt

SEQ ID NO: 1238023 - DNA, 22 bp, Artificial Sequence
  chemically synthesized
ttgttgttgtttgttttttttt

SEQ ID NO: 1238024 - DNA, 22 bp, Artificial Sequence
  chemically synthesized
ttgttgttgttgtttgtttttt

SEQ ID NO: 1238025 - DNA, 22 bp, Artificial Sequence
  chemically synthesized
ttgttgttgttgttgtttgttt

SEQ ID NO: 1238026 - DNA, 22 bp, Artificial Sequence
  chemically synthesized
gttgttgttgttgttgtttgtt

SEQ ID NO: 1238027 - DNA, 22 bp, Artificial Sequence
  chemically synthesized
gtgtttgttgttgttgttgttg

SEQ ID NO: 1238028 - DNA, 22 bp, Artificial Sequence
  chemically synthesized
ggtgtttgttgttgttgttgtt

SEQ ID NO: 1238029 - DNA, 22 bp, Artificial Sequence
  chemically synthesized
agtcttggtgtttgttgttgtt

SEQ ID NO: 1238030 - DNA, 22 bp, Artificial Sequence
  chemically synthesized
taggcaacagattgagtcttgg

SEQ ID NO: 1238031 - DNA, 22 bp, Artificial Sequence
  chemically synthesized
gtaggcaacagattgagtcttg

SEQ ID NO: 1238032 - DNA, 22 bp, Artificial Sequence
  chemically synthesized
ttgtaggcaacagattgagtct

SEQ ID NO: 1238033 - DNA, 22 bp, Artificial Sequence
  chemically synthesized
cttgtaggcaacagattgagtc

SEQ ID NO: 1238034 - DNA, 22 bp, Artificial Sequence
  chemically synthesized
taggtgaagcgtgtttcttgta

SEQ ID NO: 1238035 - DNA, 22 bp, Artificial Sequence
  chemically synthesized
aatctgttgcctacaagaaaca

SEQ ID NO: 1238036 - DNA, 22 bp, Artificial Sequence
  chemically synthesized
gtaggtgaagcgtgtttcttgt

SEQ ID NO: 1238037 - DNA, 22 bp, Artificial Sequence
  chemically synthesized
tgtaggtgaagcgtgtttcttg

SEQ ID NO: 1238038 - DNA, 22 bp, Artificial Sequence
  chemically synthesized
gctttgtaggtgaagcgtgttt

SEQ ID NO: 1238039 - DNA, 22 bp, Artificial Sequence
  chemically synthesized
ttgcctacaagaaacacgcttc

SEQ ID NO: 1238040 - DNA, 22 bp, Artificial Sequence
  chemically synthesized
cctacaagaaacacgcttcacc

SEQ ID NO: 1238041 - DNA, 22 bp, Artificial Sequence
  chemically synthesized
agtctggctttgtaggtgaagc

SEQ ID NO: 1238042 - DNA, 22 bp, Artificial Sequence
  chemically synthesized
aagtctggctttgtaggtgaag

SEQ ID NO: 1238043 - DNA, 22 bp, Artificial Sequence
  chemically synthesized
caagaaacacgcttcacctaca

SEQ ID NO: 1238044 - DNA, 22 bp, Artificial Sequence
  chemically synthesized
taagtctggctttgtaggtgaa

SEQ ID NO: 1238045 - DNA, 22 bp, Artificial Sequence
  chemically synthesized
attttaagtctggctttgtagg

SEQ ID NO: 1238046 - DNA, 22 bp, Artificial Sequence
  chemically synthesized
aattttaagtctggctttgtag

SEQ ID NO: 1238047 - DNA, 22 bp, Artificial Sequence
  chemically synthesized
catcccttaattttaagtctgg

SEQ ID NO: 1238048 - DNA, 22 bp, Artificial Sequence
  chemically synthesized
cacctacaaagccagacttaaa

SEQ ID NO: 1238049 - DNA, 22 bp, Artificial Sequence
  chemically synthesized
acatcccttaattttaagtctg

SEQ ID NO: 1238050 - DNA, 22 bp, Artificial Sequence
  chemically synthesized
acctacaaagccagacttaaaa

SEQ ID NO: 1238051 - DNA, 22 bp, Artificial Sequence
  chemically synthesized
tacatcccttaattttaagtct

SEQ ID NO: 1238052 - DNA, 22 bp, Artificial Sequence
  chemically synthesized
ttacatcccttaattttaagtc

SEQ ID NO: 1238053 - DNA, 22 bp, Artificial Sequence
  chemically synthesized
tttacatcccttaattttaagt

SEQ ID NO: 1238054 - DNA, 22 bp, Artificial Sequence
  chemically synthesized
caaagccagacttaaaattaag

SEQ ID NO: 1238055 - DNA, 22 bp, Artificial Sequence
  chemically synthesized
aaaattaagggatgtaaaaaga

SEQ ID NO: 1238056 - DNA, 22 bp, Artificial Sequence
  chemically synthesized
aaattaagggatgtaaaaagat

SEQ ID NO: 1238057 - DNA, 22 bp, Artificial Sequence
  chemically synthesized
tcgacatggaatatctttttac

SEQ ID NO: 1238058 - DNA, 22 bp, Artificial Sequence
  chemically synthesized
ctatcgacatggaatatctttt

SEQ ID NO: 1238059 - DNA, 22 bp, Artificial Sequence
  chemically synthesized
agggatgtaaaaagatattcca

SEQ ID NO: 1238060 - DNA, 22 bp, Artificial Sequence
  chemically synthesized
gttgctatcgacatggaatatc

SEQ ID NO: 1238061 - DNA, 22 bp, Artificial Sequence
  chemically synthesized
ggttgctatcgacatggaatat

SEQ ID NO: 1238062 - DNA, 22 bp, Artificial Sequence
  chemically synthesized
tggttgctatcgacatggaata

SEQ ID NO: 1238063 - DNA, 22 bp, Artificial Sequence
  chemically synthesized
ttggttgctatcgacatggaat

SEQ ID NO: 1238064 - DNA, 22 bp, Artificial Sequence
  chemically synthesized
tttggttgctatcgacatggaa

SEQ ID NO: 1238065 - DNA, 22 bp, Artificial Sequence
  chemically synthesized
ttttggttgctatcgacatgga

SEQ ID NO: 1238066 - DNA, 22 bp, Artificial Sequence
  chemically synthesized
ttttttggttgctatcgacatg

SEQ ID NO: 1238067 - DNA, 22 bp, Artificial Sequence
  chemically synthesized
ttcttttttggttgctatcgac

SEQ ID NO: 1238068 - DNA, 22 bp, Artificial Sequence
  chemically synthesized
ctgttcttttttggttgctatc

SEQ ID NO: 1238069 - DNA, 22 bp, Artificial Sequence
  chemically synthesized
ctcctgttcttttttggttgct

SEQ ID NO: 1238070 - DNA, 22 bp, Artificial Sequence
  chemically synthesized
catgtcgatagcaaccaaaaaa

SEQ ID NO: 1238071 - DNA, 22 bp, Artificial Sequence
  chemically synthesized
atgtaagaatagctactcctgt

SEQ ID NO: 1238072 - DNA, 22 bp, Artificial Sequence
  chemically synthesized
gatgtaagaatagctactcctg

SEQ ID NO: 1238073 - DNA, 22 bp, Artificial Sequence
  chemically synthesized
tttgatgtaagaatagctactc

SEQ ID NO: 1238074 - DNA, 22 bp, Artificial Sequence
  chemically synthesized
gtttgatgtaagaatagctact

SEQ ID NO: 1238075 - DNA, 22 bp, Artificial Sequence
  chemically synthesized
tgtttgatgtaagaatagctac

SEQ ID NO: 1238076 - DNA, 22 bp, Artificial Sequence
  chemically synthesized
aaatatattttgtttgatgtaa

SEQ ID NO: 1238077 - DNA, 22 bp, Artificial Sequence
  chemically synthesized
gaaatatattttgtttgatgta

SEQ ID NO: 1238078 - DNA, 22 bp, Artificial Sequence
  chemically synthesized
tcttgaaatatattttgtttga

SEQ ID NO: 1238079 - DNA, 22 bp, Artificial Sequence
  chemically synthesized
gtcttgaaatatattttgtttg

SEQ ID NO: 1238080 - DNA, 22 bp, Artificial Sequence
  chemically synthesized
ttcttacatcaaacaaaatata

SEQ ID NO: 1238081 - DNA, 22 bp, Artificial Sequence
  chemically synthesized
ttacatcaaacaaaatatattt

SEQ ID NO: 1238082 - DNA, 22 bp, Artificial Sequence
  chemically synthesized
cagtttgtcttgaaatatattt

SEQ ID NO: 1238083 - DNA, 22 bp, Artificial Sequence
  chemically synthesized
acagtttgtcttgaaatatatt

SEQ ID NO: 1238084 - DNA, 22 bp, Artificial Sequence
  chemically synthesized
acatcaaacaaaatatatttca

SEQ ID NO: 1238085 - DNA, 22 bp, Artificial Sequence
  chemically synthesized
catcaaacaaaatatatttcaa

SEQ ID NO: 1238086 - DNA, 22 bp, Artificial Sequence
  chemically synthesized
ttacagtttgtcttgaaatata

SEQ ID NO: 1238087 - DNA, 22 bp, Artificial Sequence
  chemically synthesized
cttacagtttgtcttgaaatat

SEQ ID NO: 1238088 - DNA, 22 bp, Artificial Sequence
  chemically synthesized
ttcttacagtttgtcttgaaat

SEQ ID NO: 1238089 - DNA, 22 bp, Artificial Sequence
  chemically synthesized
tctcttcttacagtttgtcttg

SEQ ID NO: 1238090 - DNA, 22 bp, Artificial Sequence
  chemically synthesized
gtctcttcttacagtttgtctt

SEQ ID NO: 1238091 - DNA, 22 bp, Artificial Sequence
  chemically synthesized
tgtctcttcttacagtttgtct

SEQ ID NO: 1238092 - DNA, 22 bp, Artificial Sequence
  chemically synthesized
atctttgtctcttcttacagtt

SEQ ID NO: 1238093 - DNA, 22 bp, Artificial Sequence
  chemically synthesized
caagacaaactgtaagaagaga

SEQ ID NO: 1238094 - DNA, 22 bp, Artificial Sequence
  chemically synthesized
aagacaaactgtaagaagagac

SEQ ID NO: 1238095 - DNA, 22 bp, Artificial Sequence
  chemically synthesized
tatgttgatctttgtctcttct

SEQ ID NO: 1238096 - DNA, 22 bp, Artificial Sequence
  chemically synthesized
ttatatgttgatctttgtctct

SEQ ID NO: 1238097 - DNA, 22 bp, Artificial Sequence
  chemically synthesized
attatatgttgatctttgtctc

SEQ ID NO: 1238098 - DNA, 22 bp, Artificial Sequence
  chemically synthesized
tattatatgttgatctttgtct

SEQ ID NO: 1238099 - DNA, 22 bp, Artificial Sequence
  chemically synthesized
ctttattatatgttgatctttg

SEQ ID NO: 1238100 - DNA, 22 bp, Artificial Sequence
  chemically synthesized
taagaagagacaaagatcaaca

SEQ ID NO: 1238101 - DNA, 22 bp, Artificial Sequence
  chemically synthesized
aaatgattcctttattatatgt

SEQ ID NO: 1238102 - DNA, 22 bp, Artificial Sequence
  chemically synthesized
ctgaaatgattcctttattata

SEQ ID NO: 1238103 - DNA, 22 bp, Artificial Sequence
  chemically synthesized
ttgctgaaatgattcctttatt

SEQ ID NO: 1238104 - DNA, 22 bp, Artificial Sequence
  chemically synthesized
attgctgaaatgattcctttat

SEQ ID NO: 1238105 - DNA, 22 bp, Artificial Sequence
  chemically synthesized
gtatatcttattgctgaaatga

SEQ ID NO: 1238106 - DNA, 22 bp, Artificial Sequence
  chemically synthesized
caattggtatatcttattgctg

SEQ ID NO: 1238107 - DNA, 22 bp, Artificial Sequence
  chemically synthesized
acaattggtatatcttattgct

SEQ ID NO: 1238108 - DNA, 22 bp, Artificial Sequence
  chemically synthesized
cagcaataagatataccaattg

SEQ ID NO: 1238109 - DNA, 22 bp, Artificial Sequence
  chemically synthesized
agcaataagatataccaattgt

SEQ ID NO: 1238110 - DNA, 22 bp, Artificial Sequence
  chemically synthesized
ggtacgtatatatttacaattg

SEQ ID NO: 1238111 - DNA, 22 bp, Artificial Sequence
  chemically synthesized
cggtgttcggtacgtatatatt

SEQ ID NO: 1238112 - DNA, 22 bp, Artificial Sequence
  chemically synthesized
ggtgctccggtgttcggtacgt

SEQ ID NO: 1238113 - DNA, 22 bp, Artificial Sequence
  chemically synthesized
taaatatatacgtaccgaacac

SEQ ID NO: 1238114 - DNA, 22 bp, Artificial Sequence
  chemically synthesized
tatatctgggtgctccggtgtt

SEQ ID NO: 1238115 - DNA, 22 bp, Artificial Sequence
  chemically synthesized
atatatctgggtgctccggtgt

SEQ ID NO: 1238116 - DNA, 22 bp, Artificial Sequence
  chemically synthesized
tatatatctgggtgctccggtg

SEQ ID NO: 1238117 - DNA, 22 bp, Artificial Sequence
  chemically synthesized
ctttatatatctgggtgctccg

SEQ ID NO: 1238118 - DNA, 22 bp, Artificial Sequence
  chemically synthesized
ataatgttgctttatatatctg

SEQ ID NO: 1238119 - DNA, 22 bp, Artificial Sequence
  chemically synthesized
ggtctaataatgttgctttata

SEQ ID NO: 1238120 - DNA, 22 bp, Artificial Sequence
  chemically synthesized
aggtctaataatgttgctttat

SEQ ID NO: 1238121 - DNA, 22 bp, Artificial Sequence
  chemically synthesized
taggtctaataatgttgcttta

SEQ ID NO: 1238122 - DNA, 22 bp, Artificial Sequence
  chemically synthesized
tttaggtctaataatgttgctt

SEQ ID NO: 1238123 - DNA, 22 bp, Artificial Sequence
  chemically synthesized
tctttaggtctaataatgttgc

SEQ ID NO: 1238124 - DNA, 22 bp, Artificial Sequence
  chemically synthesized
cagctctctttaggtctaataa

SEQ ID NO: 1238125 - DNA, 22 bp, Artificial Sequence
  chemically synthesized
ccagctctctttaggtctaata

SEQ ID NO: 1238126 - DNA, 22 bp, Artificial Sequence
  chemically synthesized
aggtttccagctctctttaggt

SEQ ID NO: 1238127 - DNA, 22 bp, Artificial Sequence
  chemically synthesized
ttagacctaaagagagctggaa

SEQ ID NO: 1238128 - DNA, 22 bp, Artificial Sequence
  chemically synthesized
gacctaaagagagctggaaacc

SEQ ID NO: 1238129 - DNA, 22 bp, Artificial Sequence
  chemically synthesized
aaagtggggtattgaggtttcc

SEQ ID NO: 1238130 - DNA, 22 bp, Artificial Sequence
  chemically synthesized
aagagagctggaaacctcaata

SEQ ID NO: 1238131 - DNA, 22 bp, Artificial Sequence
  chemically synthesized
gaaacctcaataccccactttc

SEQ ID NO: 1238132 - DNA, 22 bp, Artificial Sequence
  chemically synthesized
atgacgtccaaggctgaaagtg

SEQ ID NO: 1238133 - DNA, 22 bp, Artificial Sequence
  chemically synthesized
cctgatgacgtccaaggctgaa

SEQ ID NO: 1238134 - DNA, 22 bp, Artificial Sequence
  chemically synthesized
aataccccactttcagccttgg

SEQ ID NO: 1238135 - DNA, 22 bp, Artificial Sequence
  chemically synthesized
gcctgatgacgtccaaggctga

SEQ ID NO: 1238136 - DNA, 22 bp, Artificial Sequence
  chemically synthesized
tgcctgatgacgtccaaggctg

SEQ ID NO: 1238137 - DNA, 22 bp, Artificial Sequence
  chemically synthesized
ttgcctgatgacgtccaaggct

SEQ ID NO: 1238138 - DNA, 22 bp, Artificial Sequence
  chemically synthesized
tttgcctgatgacgtccaaggc

SEQ ID NO: 1238139 - DNA, 22 bp, Artificial Sequence
  chemically synthesized
actttttgcctgatgacgtcca

SEQ ID NO: 1238140 - DNA, 22 bp, Artificial Sequence
  chemically synthesized
gttgactttttgcctgatgacg

SEQ ID NO: 1238141 - DNA, 22 bp, Artificial Sequence
  chemically synthesized
tcagccttggacgtcatcaggc

SEQ ID NO: 1238142 - DNA, 22 bp, Artificial Sequence
  chemically synthesized
cagccttggacgtcatcaggca

SEQ ID NO: 1238143 - DNA, 22 bp, Artificial Sequence
  chemically synthesized
agccttggacgtcatcaggcaa

SEQ ID NO: 1238144 - DNA, 22 bp, Artificial Sequence
  chemically synthesized
ctagttgactttttgcctgatg

SEQ ID NO: 1238145 - DNA, 22 bp, Artificial Sequence
  chemically synthesized
cctagttgactttttgcctgat

SEQ ID NO: 1238146 - DNA, 22 bp, Artificial Sequence
  chemically synthesized
ggacgtcatcaggcaaaaagtc

SEQ ID NO: 1238147 - DNA, 22 bp, Artificial Sequence
  chemically synthesized
gacgtcatcaggcaaaaagtca

SEQ ID NO: 1238148 - DNA, 22 bp, Artificial Sequence
  chemically synthesized
aatgtttcctagttgacttttt

SEQ ID NO: 1238149 - DNA, 22 bp, Artificial Sequence
  chemically synthesized
agttcaatgtttcctagttgac

SEQ ID NO: 1238150 - DNA, 22 bp, Artificial Sequence
  chemically synthesized
tagtacagattaagttcaatgt

SEQ ID NO: 1238151 - DNA, 22 bp, Artificial Sequence
  chemically synthesized
gtctgtagtacagattaagttc

SEQ ID NO: 1238152 - DNA, 22 bp, Artificial Sequence
  chemically synthesized
agtctgtagtacagattaagtt

SEQ ID NO: 1238153 - DNA, 22 bp, Artificial Sequence
  chemically synthesized
ggaaacattgaacttaatctgt

SEQ ID NO: 1238154 - DNA, 22 bp, Artificial Sequence
  chemically synthesized
ggtacatttagtctgtagtaca

SEQ ID NO: 1238155 - DNA, 22 bp, Artificial Sequence
  chemically synthesized
aacttaatctgtactacagact

SEQ ID NO: 1238156 - DNA, 22 bp, Artificial Sequence
  chemically synthesized
ttaggtacatttagtctgtagt

SEQ ID NO: 1238157 - DNA, 22 bp, Artificial Sequence
  chemically synthesized
attaggtacatttagtctgtag

SEQ ID NO: 1238158 - DNA, 22 bp, Artificial Sequence
  chemically synthesized
aatctgtactacagactaaatg

SEQ ID NO: 1238159 - DNA, 22 bp, Artificial Sequence
  chemically synthesized
atctgtactacagactaaatgt

SEQ ID NO: 1238160 - DNA, 22 bp, Artificial Sequence
  chemically synthesized
taaatatttattaggtacattt

SEQ ID NO: 1238161 - DNA, 22 bp, Artificial Sequence
  chemically synthesized
tactacagactaaatgtaccta

SEQ ID NO: 1238162 - DNA, 22 bp, Artificial Sequence
  chemically synthesized
tgtaaatatttattaggtacat

SEQ ID NO: 1238163 - DNA, 22 bp, Artificial Sequence
  chemically synthesized
cagactaaatgtacctaataaa

SEQ ID NO: 1238164 - DNA, 22 bp, Artificial Sequence
  chemically synthesized
aaatgttctgtaaatatttatt

SEQ ID NO: 1238165 - DNA, 22 bp, Artificial Sequence
  chemically synthesized
aatgtacctaataaatatttac

SEQ ID NO: 1238166 - DNA, 22 bp, Artificial Sequence
  chemically synthesized
gttgaaatgttctgtaaatatt

SEQ ID NO: 1238167 - DNA, 22 bp, Artificial Sequence
  chemically synthesized
ttggttgaaatgttctgtaaat

SEQ ID NO: 1238168 - DNA, 22 bp, Artificial Sequence
  chemically synthesized
ataaatatttacagaacatttc

SEQ ID NO: 1238169 - DNA, 22 bp, Artificial Sequence
  chemically synthesized
cagctgttggttgaaatgttct

SEQ ID NO: 1238170 - DNA, 22 bp, Artificial Sequence
  chemically synthesized
tgcagctgttggttgaaatgtt

SEQ ID NO: 1238171 - DNA, 22 bp, Artificial Sequence
  chemically synthesized
acagaacatttcaaccaacagc

SEQ ID NO: 1238172 - DNA, 22 bp, Artificial Sequence
  chemically synthesized
cagaacatttcaaccaacagct

SEQ ID NO: 1238173 - DNA, 22 bp, Artificial Sequence
  chemically synthesized
caaccaacagctgcagagtgta

SEQ ID NO: 1238174 - DNA, 22 bp, Artificial Sequence
  chemically synthesized
aaccaacagctgcagagtgtac

SEQ ID NO: 1238175 - DNA, 22 bp, Artificial Sequence
  chemically synthesized
catgtggtgatgagaggaatgt

SEQ ID NO: 1238176 - DNA, 22 bp, Artificial Sequence
  chemically synthesized
cagagtgtacattcctctcatc

SEQ ID NO: 1238177 - DNA, 22 bp, Artificial Sequence
  chemically synthesized
agaatcctccatgtggtgatga

SEQ ID NO: 1238178 - DNA, 22 bp, Artificial Sequence
  chemically synthesized
gagaatcctccatgtggtgatg

SEQ ID NO: 1238179 - DNA, 22 bp, Artificial Sequence
  chemically synthesized
ctctcatcaccacatggaggat

SEQ ID NO: 1238180 - DNA, 22 bp, Artificial Sequence
  chemically synthesized
tcatcaccacatggaggattct

SEQ ID NO: 1238181 - DNA, 22 bp, Artificial Sequence
  chemically synthesized
atcaccacatggaggattctca

SEQ ID NO: 1238182 - DNA, 22 bp, Artificial Sequence
  chemically synthesized
acatatggcccatccttgagaa

SEQ ID NO: 1238183 - DNA, 22 bp, Artificial Sequence
  chemically synthesized
tggcctaacatatggcccatcc

SEQ ID NO: 1238184 - DNA, 22 bp, Artificial Sequence
  chemically synthesized
gtggcctaacatatggcccatc

SEQ ID NO: 1238185 - DNA, 22 bp, Artificial Sequence
  chemically synthesized
tgtggcctaacatatggcccat

SEQ ID NO: 1238186 - DNA, 22 bp, Artificial Sequence
  chemically synthesized
ttttgtggcctaacatatggcc

SEQ ID NO: 1238187 - DNA, 22 bp, Artificial Sequence
  chemically synthesized
gttttgtggcctaacatatggc

SEQ ID NO: 1238188 - DNA, 22 bp, Artificial Sequence
  chemically synthesized
tcaaggatgggccatatgttag

SEQ ID NO: 1238189 - DNA, 22 bp, Artificial Sequence
  chemically synthesized
aaggatgggccatatgttaggc

SEQ ID NO: 1238190 - DNA, 22 bp, Artificial Sequence
  chemically synthesized
aggcttgttttgtggcctaaca

SEQ ID NO: 1238191 - DNA, 22 bp, Artificial Sequence
  chemically synthesized
aaggcttgttttgtggcctaac

SEQ ID NO: 1238192 - DNA, 22 bp, Artificial Sequence
  chemically synthesized
aatttaaggcttgttttgtggc

SEQ ID NO: 1238193 - DNA, 22 bp, Artificial Sequence
  chemically synthesized
gaatttaaggcttgttttgtgg

SEQ ID NO: 1238194 - DNA, 22 bp, Artificial Sequence
  chemically synthesized
tgaatttaaggcttgttttgtg

SEQ ID NO: 1238195 - DNA, 22 bp, Artificial Sequence
  chemically synthesized
ttgaatttaaggcttgttttgt

SEQ ID NO: 1238196 - DNA, 22 bp, Artificial Sequence
  chemically synthesized
tttgaatttaaggcttgttttg

SEQ ID NO: 1238197 - DNA, 22 bp, Artificial Sequence
  chemically synthesized
aattttttgaatttaaggcttg

SEQ ID NO: 1238198 - DNA, 22 bp, Artificial Sequence
  chemically synthesized
caattttttgaatttaaggctt

SEQ ID NO: 1238199 - DNA, 22 bp, Artificial Sequence
  chemically synthesized
ggccacaaaacaagccttaaat

SEQ ID NO: 1238200 - DNA, 22 bp, Artificial Sequence
  chemically synthesized
tatttcaattttttgaatttaa

SEQ ID NO: 1238201 - DNA, 22 bp, Artificial Sequence
  chemically synthesized
atatttcaattttttgaattta

SEQ ID NO: 1238202 - DNA, 22 bp, Artificial Sequence
  chemically synthesized
tatatttcaattttttgaattt

SEQ ID NO: 1238203 - DNA, 22 bp, Artificial Sequence
  chemically synthesized
aaattcaaaaaattgaaatata

SEQ ID NO: 1238204 - DNA, 22 bp, Artificial Sequence
  chemically synthesized
aattcaaaaaattgaaatataa

SEQ ID NO: 1238205 - DNA, 22 bp, Artificial Sequence
  chemically synthesized
aaaaaattgaaatataaagtat

SEQ ID NO: 1238206 - DNA, 22 bp, Artificial Sequence
  chemically synthesized
tggtcagataagatactttata

SEQ ID NO: 1238207 - DNA, 22 bp, Artificial Sequence
  chemically synthesized
aactgtggtcagataagatact

SEQ ID NO: 1238208 - DNA, 22 bp, Artificial Sequence
  chemically synthesized
aaatataaagtatcttatctga

SEQ ID NO: 1238209 - DNA, 22 bp, Artificial Sequence
  chemically synthesized
attcaactgtggtcagataaga

SEQ ID NO: 1238210 - DNA, 22 bp, Artificial Sequence
  chemically synthesized
agttcattcaactgtggtcaga

SEQ ID NO: 1238211 - DNA, 22 bp, Artificial Sequence
  chemically synthesized
tcagttcattcaactgtggtca

SEQ ID NO: 1238212 - DNA, 22 bp, Artificial Sequence
  chemically synthesized
ctcagttcattcaactgtggtc

SEQ ID NO: 1238213 - DNA, 22 bp, Artificial Sequence
  chemically synthesized
atttctcagttcattcaactgt

SEQ ID NO: 1238214 - DNA, 22 bp, Artificial Sequence
  chemically synthesized
ctgatttctcagttcattcaac

SEQ ID NO: 1238215 - DNA, 22 bp, Artificial Sequence
  chemically synthesized
atctgaccacagttgaatgaac

SEQ ID NO: 1238216 - DNA, 22 bp, Artificial Sequence
  chemically synthesized
tctgaccacagttgaatgaact

SEQ ID NO: 1238217 - DNA, 22 bp, Artificial Sequence
  chemically synthesized
attactgatttctcagttcatt

SEQ ID NO: 1238218 - DNA, 22 bp, Artificial Sequence
  chemically synthesized
accacagttgaatgaactgaga

SEQ ID NO: 1238219 - DNA, 22 bp, Artificial Sequence
  chemically synthesized
ctcattactgatttctcagttc

SEQ ID NO: 1238220 - DNA, 22 bp, Artificial Sequence
  chemically synthesized
aaaattcctcattactgatttc

SEQ ID NO: 1238221 - DNA, 22 bp, Artificial Sequence
  chemically synthesized
caaaattcctcattactgattt

SEQ ID NO: 1238222 - DNA, 22 bp, Artificial Sequence
  chemically synthesized
aatgaactgagaaatcagtaat

SEQ ID NO: 1238223 - DNA, 22 bp, Artificial Sequence
  chemically synthesized
tcaaaattcctcattactgatt

SEQ ID NO: 1238224 - DNA, 22 bp, Artificial Sequence
  chemically synthesized
tataattttcaaaattcctcat

SEQ ID NO: 1238225 - DNA, 22 bp, Artificial Sequence
  chemically synthesized
agaaatcagtaatgaggaattt

SEQ ID NO: 1238226 - DNA, 22 bp, Artificial Sequence
  chemically synthesized
gtataattttcaaaattcctca

SEQ ID NO: 1238227 - DNA, 22 bp, Artificial Sequence
  chemically synthesized
tgtataattttcaaaattcctc

SEQ ID NO: 1238228 - DNA, 22 bp, Artificial Sequence
  chemically synthesized
tgttttgtataattttcaaaat

SEQ ID NO: 1238229 - DNA, 22 bp, Artificial Sequence
  chemically synthesized
gtgttttgtataattttcaaaa

SEQ ID NO: 1238230 - DNA, 22 bp, Artificial Sequence
  chemically synthesized
ccttgtgttttgtataattttc

SEQ ID NO: 1238231 - DNA, 22 bp, Artificial Sequence
  chemically synthesized
attcccttgtgttttgtataat

SEQ ID NO: 1238232 - DNA, 22 bp, Artificial Sequence
  chemically synthesized
tgaaaattatacaaaacacaag

SEQ ID NO: 1238233 - DNA, 22 bp, Artificial Sequence
  chemically synthesized
gaaaattatacaaaacacaagg

SEQ ID NO: 1238234 - DNA, 22 bp, Artificial Sequence
  chemically synthesized
aaaattatacaaaacacaaggg

SEQ ID NO: 1238235 - DNA, 22 bp, Artificial Sequence
  chemically synthesized
tacaaaacacaagggaattaat

SEQ ID NO: 1238236 - DNA, 22 bp, Artificial Sequence
  chemically synthesized
aagagaatatagattaattccc

SEQ ID NO: 1238237 - DNA, 22 bp, Artificial Sequence
  chemically synthesized
atcattcaagagaatatagatt

SEQ ID NO: 1238238 - DNA, 22 bp, Artificial Sequence
  chemically synthesized
acccactgatcattcaagagaa

SEQ ID NO: 1238239 - DNA, 22 bp, Artificial Sequence
  chemically synthesized
attgacccactgatcattcaag

SEQ ID NO: 1238240 - DNA, 22 bp, Artificial Sequence
  chemically synthesized
atctatattctcttgaatgatc

SEQ ID NO: 1238241 - DNA, 22 bp, Artificial Sequence
  chemically synthesized
cattgacccactgatcattcaa

SEQ ID NO: 1238242 - DNA, 22 bp, Artificial Sequence
  chemically synthesized
ttcattgacccactgatcattc

SEQ ID NO: 1238243 - DNA, 22 bp, Artificial Sequence
  chemically synthesized
cttcattgacccactgatcatt

SEQ ID NO: 1238244 - DNA, 22 bp, Artificial Sequence
  chemically synthesized
tattctcttgaatgatcagtgg

SEQ ID NO: 1238245 - DNA, 22 bp, Artificial Sequence
  chemically synthesized
tcttgaatgatcagtgggtcaa

SEQ ID NO: 1238246 - DNA, 22 bp, Artificial Sequence
  chemically synthesized
tgaatttcttcattgacccact

SEQ ID NO: 1238247 - DNA, 22 bp, Artificial Sequence
  chemically synthesized
atgaatttcttcattgacccac

SEQ ID NO: 1238248 - DNA, 22 bp, Artificial Sequence
  chemically synthesized
ttgaatgatcagtgggtcaatg

SEQ ID NO: 1238249 - DNA, 22 bp, Artificial Sequence
  chemically synthesized
gaatgatcagtgggtcaatgaa

SEQ ID NO: 1238250 - DNA, 22 bp, Artificial Sequence
  chemically synthesized
cttatgaatttcttcattgacc

SEQ ID NO: 1238251 - DNA, 22 bp, Artificial Sequence
  chemically synthesized
aatgatcagtgggtcaatgaag

SEQ ID NO: 1238252 - DNA, 22 bp, Artificial Sequence
  chemically synthesized
ccttatgaatttcttcattgac

SEQ ID NO: 1238253 - DNA, 22 bp, Artificial Sequence
  chemically synthesized
taacttccttatgaatttcttc

SEQ ID NO: 1238254 - DNA, 22 bp, Artificial Sequence
  chemically synthesized
ataacttccttatgaatttctt

SEQ ID NO: 1238255 - DNA, 22 bp, Artificial Sequence
  chemically synthesized
tataacttccttatgaatttct

SEQ ID NO: 1238256 - DNA, 22 bp, Artificial Sequence
  chemically synthesized
aagaaattttataacttcctta

SEQ ID NO: 1238257 - DNA, 22 bp, Artificial Sequence
  chemically synthesized
caagaaattttataacttcctt

SEQ ID NO: 1238258 - DNA, 22 bp, Artificial Sequence
  chemically synthesized
tttcaagaaattttataacttc

SEQ ID NO: 1238259 - DNA, 22 bp, Artificial Sequence
  chemically synthesized
gtttcaagaaattttataactt

SEQ ID NO: 1238260 - DNA, 22 bp, Artificial Sequence
  chemically synthesized
tgtttcaagaaattttataact

SEQ ID NO: 1238261 - DNA, 22 bp, Artificial Sequence
  chemically synthesized
ataaggaagttataaaatttct

SEQ ID NO: 1238262 - DNA, 22 bp, Artificial Sequence
  chemically synthesized
cagttttgtttcaagaaatttt

SEQ ID NO: 1238263 - DNA, 22 bp, Artificial Sequence
  chemically synthesized
acagttttgtttcaagaaattt

SEQ ID NO: 1238264 - DNA, 22 bp, Artificial Sequence
  chemically synthesized
tgtttacagttttgtttcaaga

SEQ ID NO: 1238265 - DNA, 22 bp, Artificial Sequence
  chemically synthesized
taaaatttcttgaaacaaaact

SEQ ID NO: 1238266 - DNA, 22 bp, Artificial Sequence
  chemically synthesized
gtatgctgtgtttacagttttg

SEQ ID NO: 1238267 - DNA, 22 bp, Artificial Sequence
  chemically synthesized
agtatgctgtgtttacagtttt

SEQ ID NO: 1238268 - DNA, 22 bp, Artificial Sequence
  chemically synthesized
tagtatgctgtgtttacagttt

SEQ ID NO: 1238269 - DNA, 22 bp, Artificial Sequence
  chemically synthesized
cttgaaacaaaactgtaaacac

SEQ ID NO: 1238270 - DNA, 22 bp, Artificial Sequence
  chemically synthesized
ttgaaacaaaactgtaaacaca

SEQ ID NO: 1238271 - DNA, 22 bp, Artificial Sequence
  chemically synthesized
gaaacaaaactgtaaacacagc

SEQ ID NO: 1238272 - DNA, 22 bp, Artificial Sequence
  chemically synthesized
aaacaaaactgtaaacacagca

SEQ ID NO: 1238273 - DNA, 22 bp, Artificial Sequence
  chemically synthesized
tagcccacaagttttagtatgc

SEQ ID NO: 1238274 - DNA, 22 bp, Artificial Sequence
  chemically synthesized
taaacacagcatactaaaactt

SEQ ID NO: 1238275 - DNA, 22 bp, Artificial Sequence
  chemically synthesized
tctgtagcccacaagttttagt

SEQ ID NO: 1238276 - DNA, 22 bp, Artificial Sequence
  chemically synthesized
atctgtagcccacaagttttag

SEQ ID NO: 1238277 - DNA, 22 bp, Artificial Sequence
  chemically synthesized
atttatctgtagcccacaagtt

SEQ ID NO: 1238278 - DNA, 22 bp, Artificial Sequence
  chemically synthesized
gtactgatttatctgtagccca

SEQ ID NO: 1238279 - DNA, 22 bp, Artificial Sequence
  chemically synthesized
ctagtactgatttatctgtagc

SEQ ID NO: 1238280 - DNA, 22 bp, Artificial Sequence
  chemically synthesized
gctagtactgatttatctgtag

SEQ ID NO: 1238281 - DNA, 22 bp, Artificial Sequence
  chemically synthesized
aaacttgtgggctacagataaa

SEQ ID NO: 1238282 - DNA, 22 bp, Artificial Sequence
  chemically synthesized
tgctagtactgatttatctgta

SEQ ID NO: 1238283 - DNA, 22 bp, Artificial Sequence
  chemically synthesized
gtgggctacagataaatcagta

SEQ ID NO: 1238284 - DNA, 22 bp, Artificial Sequence
  chemically synthesized
tgggctacagataaatcagtac

SEQ ID NO: 1238285 - DNA, 22 bp, Artificial Sequence
  chemically synthesized
taaactttgctagtactgattt

SEQ ID NO: 1238286 - DNA, 22 bp, Artificial Sequence
  chemically synthesized
ctgtaaactttgctagtactga

SEQ ID NO: 1238287 - DNA, 22 bp, Artificial Sequence
  chemically synthesized
ttgctgtaaactttgctagtac

SEQ ID NO: 1238288 - DNA, 22 bp, Artificial Sequence
  chemically synthesized
cagataaatcagtactagcaaa

SEQ ID NO: 1238289 - DNA, 22 bp, Artificial Sequence
  chemically synthesized
attgctgtaaactttgctagta

SEQ ID NO: 1238290 - DNA, 22 bp, Artificial Sequence
  chemically synthesized
atacaagtgcttattgctgtaa

SEQ ID NO: 1238291 - DNA, 22 bp, Artificial Sequence
  chemically synthesized
gatacaagtgcttattgctgta

SEQ ID NO: 1238292 - DNA, 22 bp, Artificial Sequence
  chemically synthesized
tgatacaagtgcttattgctgt

SEQ ID NO: 1238293 - DNA, 22 bp, Artificial Sequence
  chemically synthesized
ttgatacaagtgcttattgctg

SEQ ID NO: 1238294 - DNA, 22 bp, Artificial Sequence
  chemically synthesized
tttgatacaagtgcttattgct

SEQ ID NO: 1238295 - DNA, 22 bp, Artificial Sequence
  chemically synthesized
gcaaagtttacagcaataagca

SEQ ID NO: 1238296 - DNA, 22 bp, Artificial Sequence
  chemically synthesized
ttttgatacaagtgcttattgc

SEQ ID NO: 1238297 - DNA, 22 bp, Artificial Sequence
  chemically synthesized
tttttgatacaagtgcttattg

SEQ ID NO: 1238298 - DNA, 22 bp, Artificial Sequence
  chemically synthesized
ttttttgatacaagtgcttatt

SEQ ID NO: 1238299 - DNA, 22 bp, Artificial Sequence
  chemically synthesized
tttttttgatacaagtgcttat

SEQ ID NO: 1238300 - DNA, 22 bp, Artificial Sequence
  chemically synthesized
ttttttttgatacaagtgctta

SEQ ID NO: 1238301 - DNA, 22 bp, Artificial Sequence
  chemically synthesized
tttttttttgatacaagtgctt

SEQ ID NO: 1238302 - DNA, 22 bp, Artificial Sequence
  chemically synthesized
ttttttttttgatacaagtgct

SEQ ID NO: 1238303 - DNA, 22 bp, Artificial Sequence
  chemically synthesized
tttttttttttgatacaagtgc

SEQ ID NO: 1238304 - DNA, 22 bp, Artificial Sequence
  chemically synthesized
ttttttttttttgatacaagtg

SEQ ID NO: 1238305 - DNA, 22 bp, Artificial Sequence
  chemically synthesized
acagcaataagcacttgtatca

SEQ ID NO: 1238306 - DNA, 22 bp, Artificial Sequence
  chemically synthesized
tttttttttttttgatacaagt

SEQ ID NO: 1238307 - DNA, 22 bp, Artificial Sequence
  chemically synthesized
cagcaataagcacttgtatcaa

SEQ ID NO: 1238308 - DNA, 22 bp, Artificial Sequence
  chemically synthesized
ttttttttttttttgatacaag

SEQ ID NO: 1238309 - DNA, 22 bp, Artificial Sequence
  chemically synthesized
ttttttttttttttttgataca

SEQ ID NO: 1238310 - DNA, 22 bp, Artificial Sequence
  chemically synthesized
tcttttttttttttttttgata

SEQ ID NO: 1238311 - DNA, 22 bp, Artificial Sequence
  chemically synthesized
ctcttttttttttttttttgat

SEQ ID NO: 1238312 - DNA, 22 bp, Artificial Sequence
  chemically synthesized
tttctctttttttttttttttt

SEQ ID NO: 1238313 - DNA, 22 bp, Artificial Sequence
  chemically synthesized
gtatcaaaaaaaaaaaaaaaag

SEQ ID NO: 1238314 - DNA, 22 bp, Artificial Sequence
  chemically synthesized
tatcaaaaaaaaaaaaaaaaga

SEQ ID NO: 1238315 - DNA, 22 bp, Artificial Sequence
  chemically synthesized
agatgtattgtttctctttttt

SEQ ID NO: 1238316 - DNA, 22 bp, Artificial Sequence
  chemically synthesized
aagatgtattgtttctcttttt

SEQ ID NO: 1238317 - DNA, 22 bp, Artificial Sequence
  chemically synthesized
taagatgtattgtttctctttt

SEQ ID NO: 1238318 - DNA, 22 bp, Artificial Sequence
  chemically synthesized
tttaagatgtattgtttctctt

SEQ ID NO: 1238319 - DNA, 22 bp, Artificial Sequence
  chemically synthesized
gttctttaagatgtattgtttc

SEQ ID NO: 1238320 - DNA, 22 bp, Artificial Sequence
  chemically synthesized
tagttctttaagatgtattgtt

SEQ ID NO: 1238321 - DNA, 22 bp, Artificial Sequence
  chemically synthesized
ttctagttctttaagatgtatt

SEQ ID NO: 1238322 - DNA, 22 bp, Artificial Sequence
  chemically synthesized
ctattctagttctttaagatgt

SEQ ID NO: 1238323 - DNA, 22 bp, Artificial Sequence
  chemically synthesized
gctattctagttctttaagatg

SEQ ID NO: 1238324 - DNA, 22 bp, Artificial Sequence
  chemically synthesized
gtttgctattctagttctttaa

SEQ ID NO: 1238325 - DNA, 22 bp, Artificial Sequence
  chemically synthesized
ggtttgctattctagttcttta

SEQ ID NO: 1238326 - DNA, 22 bp, Artificial Sequence
  chemically synthesized
agtttggtttgctattctagtt

SEQ ID NO: 1238327 - DNA, 22 bp, Artificial Sequence
  chemically synthesized
gagtttggtttgctattctagt

SEQ ID NO: 1238328 - DNA, 22 bp, Artificial Sequence
  chemically synthesized
tgagtttggtttgctattctag

SEQ ID NO: 1238329 - DNA, 22 bp, Artificial Sequence
  chemically synthesized
attttgagtttggtttgctatt

SEQ ID NO: 1238330 - DNA, 22 bp, Artificial Sequence
  chemically synthesized
aaagaactagaatagcaaacca

SEQ ID NO: 1238331 - DNA, 22 bp, Artificial Sequence
  chemically synthesized
aagaactagaatagcaaaccaa

SEQ ID NO: 1238332 - DNA, 22 bp, Artificial Sequence
  chemically synthesized
gaatagcaaaccaaactcaaaa

SEQ ID NO: 1238333 - DNA, 22 bp, Artificial Sequence
  chemically synthesized
atgacacaatctaattttgagt

SEQ ID NO: 1238334 - DNA, 22 bp, Artificial Sequence
  chemically synthesized
catgacacaatctaattttgag

SEQ ID NO: 1238335 - DNA, 22 bp, Artificial Sequence
  chemically synthesized
catgtcttcatgacacaatcta

SEQ ID NO: 1238336 - DNA, 22 bp, Artificial Sequence
  chemically synthesized
gcatgtcttcatgacacaatct

SEQ ID NO: 1238337 - DNA, 22 bp, Artificial Sequence
  chemically synthesized
tgcatgtcttcatgacacaatc

SEQ ID NO: 1238338 - DNA, 22 bp, Artificial Sequence
  chemically synthesized
aaaattagattgtgtcatgaag

SEQ ID NO: 1238339 - DNA, 22 bp, Artificial Sequence
  chemically synthesized
gggttttgcatgtcttcatgac

SEQ ID NO: 1238340 - DNA, 22 bp, Artificial Sequence
  chemically synthesized
ttcgggttttgcatgtcttcat

SEQ ID NO: 1238341 - DNA, 22 bp, Artificial Sequence
  chemically synthesized
gattgtgtcatgaagacatgca

SEQ ID NO: 1238342 - DNA, 22 bp, Artificial Sequence
  chemically synthesized
gtctgttcgggttttgcatgtc

SEQ ID NO: 1238343 - DNA, 22 bp, Artificial Sequence
  chemically synthesized
tgtcatgaagacatgcaaaacc

SEQ ID NO: 1238344 - DNA, 22 bp, Artificial Sequence
  chemically synthesized
ttggtctgttcgggttttgcat

SEQ ID NO: 1238345 - DNA, 22 bp, Artificial Sequence
  chemically synthesized
ttgttggtctgttcgggttttg

SEQ ID NO: 1238346 - DNA, 22 bp, Artificial Sequence
  chemically synthesized
gttgttggtctgttcgggtttt

SEQ ID NO: 1238347 - DNA, 22 bp, Artificial Sequence
  chemically synthesized
cttgttgttggtctgttcgggt

SEQ ID NO: 1238348 - DNA, 22 bp, Artificial Sequence
  chemically synthesized
attacttgttgttggtctgttc

SEQ ID NO: 1238349 - DNA, 22 bp, Artificial Sequence
  chemically synthesized
atctcattacttgttgttggtc

SEQ ID NO: 1238350 - DNA, 22 bp, Artificial Sequence
  chemically synthesized
gatctcattacttgttgttggt

SEQ ID NO: 1238351 - DNA, 22 bp, Artificial Sequence
  chemically synthesized
tgatctcattacttgttgttgg

SEQ ID NO: 1238352 - DNA, 22 bp, Artificial Sequence
  chemically synthesized
catctttgatctcattacttgt

SEQ ID NO: 1238353 - DNA, 22 bp, Artificial Sequence
  chemically synthesized
acatctttgatctcattacttg

SEQ ID NO: 1238354 - DNA, 22 bp, Artificial Sequence
  chemically synthesized
tacatctttgatctcattactt

SEQ ID NO: 1238355 - DNA, 22 bp, Artificial Sequence
  chemically synthesized
ttacatctttgatctcattact

SEQ ID NO: 1238356 - DNA, 22 bp, Artificial Sequence
  chemically synthesized
tttacatctttgatctcattac

SEQ ID NO: 1238357 - DNA, 22 bp, Artificial Sequence
  chemically synthesized
ggagactttttacatctttgat

SEQ ID NO: 1238358 - DNA, 22 bp, Artificial Sequence
  chemically synthesized
actgggagactttttacatctt

SEQ ID NO: 1238359 - DNA, 22 bp, Artificial Sequence
  chemically synthesized
cactgggagactttttacatct

SEQ ID NO: 1238360 - DNA, 22 bp, Artificial Sequence
  chemically synthesized
ttcactgggagactttttacat

SEQ ID NO: 1238361 - DNA, 22 bp, Artificial Sequence
  chemically synthesized
cttcactgggagactttttaca

SEQ ID NO: 1238362 - DNA, 22 bp, Artificial Sequence
  chemically synthesized
tcttcactgggagactttttac

SEQ ID NO: 1238363 - DNA, 22 bp, Artificial Sequence
  chemically synthesized
ttcttcactgggagacttttta

SEQ ID NO: 1238364 - DNA, 22 bp, Artificial Sequence
  chemically synthesized
gggcttttcttcactgggagac

SEQ ID NO: 1238365 - DNA, 22 bp, Artificial Sequence
  chemically synthesized
ccagtgaagaaaagcccgagac

SEQ ID NO: 1238366 - DNA, 22 bp, Artificial Sequence
  chemically synthesized
agcagtgaagccatcaggtctc

SEQ ID NO: 1238367 - DNA, 22 bp, Artificial Sequence
  chemically synthesized
gtaacattcagcagtgaagcca

SEQ ID NO: 1238368 - DNA, 22 bp, Artificial Sequence
  chemically synthesized
ggtaacattcagcagtgaagcc

SEQ ID NO: 1238369 - DNA, 22 bp, Artificial Sequence
  chemically synthesized
aatgtttggtaacattcagcag

SEQ ID NO: 1238370 - DNA, 22 bp, Artificial Sequence
  chemically synthesized
caatgtttggtaacattcagca

SEQ ID NO: 1238371 - DNA, 22 bp, Artificial Sequence
  chemically synthesized
atggcttcactgctgaatgtta

SEQ ID NO: 1238372 - DNA, 22 bp, Artificial Sequence
  chemically synthesized
ggtgtttcaatgtttggtaaca

SEQ ID NO: 1238373 - DNA, 22 bp, Artificial Sequence
  chemically synthesized
cactgctgaatgttaccaaaca

SEQ ID NO: 1238374 - DNA, 22 bp, Artificial Sequence
  chemically synthesized
actgctgaatgttaccaaacat

SEQ ID NO: 1238375 - DNA, 22 bp, Artificial Sequence
  chemically synthesized
ctgaatgttaccaaacattgaa

SEQ ID NO: 1238376 - DNA, 22 bp, Artificial Sequence
  chemically synthesized
agtattaggtgtttcaatgttt

SEQ ID NO: 1238377 - DNA, 22 bp, Artificial Sequence
  chemically synthesized
gagtattaggtgtttcaatgtt

SEQ ID NO: 1238378 - DNA, 22 bp, Artificial Sequence
  chemically synthesized
aatgttaccaaacattgaaaca

SEQ ID NO: 1238379 - DNA, 22 bp, Artificial Sequence
  chemically synthesized
ccaaacattgaaacacctaata

SEQ ID NO: 1238380 - DNA, 22 bp, Artificial Sequence
  chemically synthesized
acaatagtttgagtattaggtg

SEQ ID NO: 1238381 - DNA, 22 bp, Artificial Sequence
  chemically synthesized
cacaatagtttgagtattaggt

SEQ ID NO: 1238382 - DNA, 22 bp, Artificial Sequence
  chemically synthesized
tcacaatagtttgagtattagg

SEQ ID NO: 1238383 - DNA, 22 bp, Artificial Sequence
  chemically synthesized
ttcacaatagtttgagtattag

SEQ ID NO: 1238384 - DNA, 22 bp, Artificial Sequence
  chemically synthesized
tttcacaatagtttgagtatta

SEQ ID NO: 1238385 - DNA, 22 bp, Artificial Sequence
  chemically synthesized
tttttcacaatagtttgagtat

SEQ ID NO: 1238386 - DNA, 22 bp, Artificial Sequence
  chemically synthesized
aaacacctaatactcaaactat

SEQ ID NO: 1238387 - DNA, 22 bp, Artificial Sequence
  chemically synthesized
ctctttttcacaatagtttgag

SEQ ID NO: 1238388 - DNA, 22 bp, Artificial Sequence
  chemically synthesized
ctcctctttttcacaatagttt

SEQ ID NO: 1238389 - DNA, 22 bp, Artificial Sequence
  chemically synthesized
ctcctcctctttttcacaatag

SEQ ID NO: 1238390 - DNA, 22 bp, Artificial Sequence
  chemically synthesized
cctcctcctctttttcacaata

SEQ ID NO: 1238391 - DNA, 22 bp, Artificial Sequence
  chemically synthesized
atactcaaactattgtgaaaaa

SEQ ID NO: 1238392 - DNA, 22 bp, Artificial Sequence
  chemically synthesized
aaactattgtgaaaaagaggag

SEQ ID NO: 1238393 - DNA, 22 bp, Artificial Sequence
  chemically synthesized
agaagtacttcctcctcctctt

SEQ ID NO: 1238394 - DNA, 22 bp, Artificial Sequence
  chemically synthesized
ttgtgaaaaagaggaggaggaa

SEQ ID NO: 1238395 - DNA, 22 bp, Artificial Sequence
  chemically synthesized
tgaaaaagaggaggaggaagta

SEQ ID NO: 1238396 - DNA, 22 bp, Artificial Sequence
  chemically synthesized
acagaatgagttcagaagtact

SEQ ID NO: 1238397 - DNA, 22 bp, Artificial Sequence
  chemically synthesized
gcctcacagaatgagttcagaa

SEQ ID NO: 1238398 - DNA, 22 bp, Artificial Sequence
  chemically synthesized
atattggcctcacagaatgagt

SEQ ID NO: 1238399 - DNA, 22 bp, Artificial Sequence
  chemically synthesized
ctgaactcattctgtgaggcca

SEQ ID NO: 1238400 - DNA, 22 bp, Artificial Sequence
  chemically synthesized
tgaactcattctgtgaggccaa

SEQ ID NO: 1238401 - DNA, 22 bp, Artificial Sequence
  chemically synthesized
aactcattctgtgaggccaata

SEQ ID NO: 1238402 - DNA, 22 bp, Artificial Sequence
  chemically synthesized
gtgtcaggctaatattggcctc

SEQ ID NO: 1238403 - DNA, 22 bp, Artificial Sequence
  chemically synthesized
cgtgtcaggctaatattggcct

SEQ ID NO: 1238404 - DNA, 22 bp, Artificial Sequence
  chemically synthesized
tcgtgtcaggctaatattggcc

SEQ ID NO: 1238405 - DNA, 22 bp, Artificial Sequence
  chemically synthesized
attctgtgaggccaatattagc

SEQ ID NO: 1238406 - DNA, 22 bp, Artificial Sequence
  chemically synthesized
gttttcgtgtcaggctaatatt

SEQ ID NO: 1238407 - DNA, 22 bp, Artificial Sequence
  chemically synthesized
tgtgaggccaatattagcctga

SEQ ID NO: 1238408 - DNA, 22 bp, Artificial Sequence
  chemically synthesized
tctggttttcgtgtcaggctaa

SEQ ID NO: 1238409 - DNA, 22 bp, Artificial Sequence
  chemically synthesized
tgaggccaatattagcctgaca

SEQ ID NO: 1238410 - DNA, 22 bp, Artificial Sequence
  chemically synthesized
gatatctgtctggttttcgtgt

SEQ ID NO: 1238411 - DNA, 22 bp, Artificial Sequence
  chemically synthesized
tggatatctgtctggttttcgt

SEQ ID NO: 1238412 - DNA, 22 bp, Artificial Sequence
  chemically synthesized
ctggatatctgtctggttttcg

SEQ ID NO: 1238413 - DNA, 22 bp, Artificial Sequence
  chemically synthesized
tctggatatctgtctggttttc

SEQ ID NO: 1238414 - DNA, 22 bp, Artificial Sequence
  chemically synthesized
gcctgacacgaaaaccagacag

SEQ ID NO: 1238415 - DNA, 22 bp, Artificial Sequence
  chemically synthesized
ttttctggatatctgtctggtt

SEQ ID NO: 1238416 - DNA, 22 bp, Artificial Sequence
  chemically synthesized
gttttctggatatctgtctggt

SEQ ID NO: 1238417 - DNA, 22 bp, Artificial Sequence
  chemically synthesized
tgttttctggatatctgtctgg

SEQ ID NO: 1238418 - DNA, 22 bp, Artificial Sequence
  chemically synthesized
acacgaaaaccagacagatatc

SEQ ID NO: 1238419 - DNA, 22 bp, Artificial Sequence
  chemically synthesized
cagttttgttttctggatatct

SEQ ID NO: 1238420 - DNA, 22 bp, Artificial Sequence
  chemically synthesized
tcagagataatagcctgcagtt

SEQ ID NO: 1238421 - DNA, 22 bp, Artificial Sequence
  chemically synthesized
gtcagagataatagcctgcagt

SEQ ID NO: 1238422 - DNA, 22 bp, Artificial Sequence
  chemically synthesized
tatcagtatttgtcagagataa

SEQ ID NO: 1238423 - DNA, 22 bp, Artificial Sequence
  chemically synthesized
gtatcagtatttgtcagagata

SEQ ID NO: 1238424 - DNA, 22 bp, Artificial Sequence
  chemically synthesized
tgtatcagtatttgtcagagat

SEQ ID NO: 1238425 - DNA, 22 bp, Artificial Sequence
  chemically synthesized
ttgtatcagtatttgtcagaga

SEQ ID NO: 1238426 - DNA, 22 bp, Artificial Sequence
  chemically synthesized
caggctattatctctgacaaat

SEQ ID NO: 1238427 - DNA, 22 bp, Artificial Sequence
  chemically synthesized
aggatttttgtatcagtatttg

SEQ ID NO: 1238428 - DNA, 22 bp, Artificial Sequence
  chemically synthesized
ttatctctgacaaatactgata

SEQ ID NO: 1238429 - DNA, 22 bp, Artificial Sequence
  chemically synthesized
ttgaggatttttgtatcagtat

SEQ ID NO: 1238430 - DNA, 22 bp, Artificial Sequence
  chemically synthesized
gttgaggatttttgtatcagta

SEQ ID NO: 1238431 - DNA, 22 bp, Artificial Sequence
  chemically synthesized
tctctgacaaatactgatacaa

SEQ ID NO: 1238432 - DNA, 22 bp, Artificial Sequence
  chemically synthesized
tgttgaggatttttgtatcagt

SEQ ID NO: 1238433 - DNA, 22 bp, Artificial Sequence
  chemically synthesized
tgacaaatactgatacaaaaat

SEQ ID NO: 1238434 - DNA, 22 bp, Artificial Sequence
  chemically synthesized
acaaatactgatacaaaaatcc

SEQ ID NO: 1238435 - DNA, 22 bp, Artificial Sequence
  chemically synthesized
gtattttgttgaggatttttgt

SEQ ID NO: 1238436 - DNA, 22 bp, Artificial Sequence
  chemically synthesized
ctagtattttgttgaggatttt

SEQ ID NO: 1238437 - DNA, 22 bp, Artificial Sequence
  chemically synthesized
gctagtattttgttgaggattt

SEQ ID NO: 1238438 - DNA, 22 bp, Artificial Sequence
  chemically synthesized
gtttgctagtattttgttgagg

SEQ ID NO: 1238439 - DNA, 22 bp, Artificial Sequence
  chemically synthesized
ggtttgctagtattttgttgag

SEQ ID NO: 1238440 - DNA, 22 bp, Artificial Sequence
  chemically synthesized
atacaaaaatcctcaacaaaat

SEQ ID NO: 1238441 - DNA, 22 bp, Artificial Sequence
  chemically synthesized
aatttggtttgctagtattttg

SEQ ID NO: 1238442 - DNA, 22 bp, Artificial Sequence
  chemically synthesized
tgttgaatttggtttgctagta

SEQ ID NO: 1238443 - DNA, 22 bp, Artificial Sequence
  chemically synthesized
aacaaaatactagcaaaccaaa

SEQ ID NO: 1238444 - DNA, 22 bp, Artificial Sequence
  chemically synthesized
atgttgtgttgaatttggtttg

SEQ ID NO: 1238445 - DNA, 22 bp, Artificial Sequence
  chemically synthesized
aatgttgtgttgaatttggttt

SEQ ID NO: 1238446 - DNA, 22 bp, Artificial Sequence
  chemically synthesized
taatgttgtgttgaatttggtt

SEQ ID NO: 1238447 - DNA, 22 bp, Artificial Sequence
  chemically synthesized
ttaatgttgtgttgaatttggt

SEQ ID NO: 1238448 - DNA, 22 bp, Artificial Sequence
  chemically synthesized
tttaatgttgtgttgaatttgg

SEQ ID NO: 1238449 - DNA, 22 bp, Artificial Sequence
  chemically synthesized
gcaaaccaaattcaacacaaca

SEQ ID NO: 1238450 - DNA, 22 bp, Artificial Sequence
  chemically synthesized
taacgaatgacctttttaatgt

SEQ ID NO: 1238451 - DNA, 22 bp, Artificial Sequence
  chemically synthesized
gttataacgaatgaccttttta

SEQ ID NO: 1238452 - DNA, 22 bp, Artificial Sequence
  chemically synthesized
ggttataacgaatgaccttttt

SEQ ID NO: 1238453 - DNA, 22 bp, Artificial Sequence
  chemically synthesized
aacacaacattaaaaaggtcat

SEQ ID NO: 1238454 - DNA, 22 bp, Artificial Sequence
  chemically synthesized
aaaaggtcattcgttataacca

SEQ ID NO: 1238455 - DNA, 22 bp, Artificial Sequence
  chemically synthesized
ggacaaataccacttggttata

SEQ ID NO: 1238456 - DNA, 22 bp, Artificial Sequence
  chemically synthesized
gcatccctaggacaaataccac

SEQ ID NO: 1238457 - DNA, 22 bp, Artificial Sequence
  chemically synthesized
gttataaccaagtggtatttgt

SEQ ID NO: 1238458 - DNA, 22 bp, Artificial Sequence
  chemically synthesized
ggcatccctaggacaaatacca

SEQ ID NO: 1238459 - DNA, 22 bp, Artificial Sequence
  chemically synthesized
taaccaagtggtatttgtccta

SEQ ID NO: 1238460 - DNA, 22 bp, Artificial Sequence
  chemically synthesized
catatggtgacccatcttggca

SEQ ID NO: 1238461 - DNA, 22 bp, Artificial Sequence
  chemically synthesized
gcatatggtgacccatcttggc

SEQ ID NO: 1238462 - DNA, 22 bp, Artificial Sequence
  chemically synthesized
gtcctagggatgccaagatggg

SEQ ID NO: 1238463 - DNA, 22 bp, Artificial Sequence
  chemically synthesized
tgcatatggtgacccatcttgg

SEQ ID NO: 1238464 - DNA, 22 bp, Artificial Sequence
  chemically synthesized
tcctagggatgccaagatgggt

SEQ ID NO: 1238465 - DNA, 22 bp, Artificial Sequence
  chemically synthesized
ttgcatatggtgacccatcttg

SEQ ID NO: 1238466 - DNA, 22 bp, Artificial Sequence
  chemically synthesized
tttgcatatggtgacccatctt

SEQ ID NO: 1238467 - DNA, 22 bp, Artificial Sequence
  chemically synthesized
gggatgccaagatgggtcacca

SEQ ID NO: 1238468 - DNA, 22 bp, Artificial Sequence
  chemically synthesized
attttttgcatatggtgaccca

SEQ ID NO: 1238469 - DNA, 22 bp, Artificial Sequence
  chemically synthesized
tcacattgattttttgcatatg

SEQ ID NO: 1238470 - DNA, 22 bp, Artificial Sequence
  chemically synthesized
atacgatctatcacattgattt

SEQ ID NO: 1238471 - DNA, 22 bp, Artificial Sequence
  chemically synthesized
ttcatacgatctatcacattga

SEQ ID NO: 1238472 - DNA, 22 bp, Artificial Sequence
  chemically synthesized
tgttcatacgatctatcacatt

SEQ ID NO: 1238473 - DNA, 22 bp, Artificial Sequence
  chemically synthesized
attctgttcatacgatctatca

SEQ ID NO: 1238474 - DNA, 22 bp, Artificial Sequence
  chemically synthesized
cattctgttcatacgatctatc

SEQ ID NO: 1238475 - DNA, 22 bp, Artificial Sequence
  chemically synthesized
tccttcattctgttcatacgat

SEQ ID NO: 1238476 - DNA, 22 bp, Artificial Sequence
  chemically synthesized
gtccttcattctgttcatacga

SEQ ID NO: 1238477 - DNA, 22 bp, Artificial Sequence
  chemically synthesized
tgtccttcattctgttcatacg

SEQ ID NO: 1238478 - DNA, 22 bp, Artificial Sequence
  chemically synthesized
ttgtccttcattctgttcatac

SEQ ID NO: 1238479 - DNA, 22 bp, Artificial Sequence
  chemically synthesized
aaatgatatggtttttgtcctt

SEQ ID NO: 1238480 - DNA, 22 bp, Artificial Sequence
  chemically synthesized
ttgaaatgatatggtttttgtc

SEQ ID NO: 1238481 - DNA, 22 bp, Artificial Sequence
  chemically synthesized
agcatctattgaaatgatatgg

SEQ ID NO: 1238482 - DNA, 22 bp, Artificial Sequence
  chemically synthesized
cagcatctattgaaatgatatg

SEQ ID NO: 1238483 - DNA, 22 bp, Artificial Sequence
  chemically synthesized
tcagcatctattgaaatgatat

SEQ ID NO: 1238484 - DNA, 22 bp, Artificial Sequence
  chemically synthesized
ttcagcatctattgaaatgata

SEQ ID NO: 1238485 - DNA, 22 bp, Artificial Sequence
  chemically synthesized
tttcagcatctattgaaatgat

SEQ ID NO: 1238486 - DNA, 22 bp, Artificial Sequence
  chemically synthesized
tcaaatgctttttcagcatcta

SEQ ID NO: 1238487 - DNA, 22 bp, Artificial Sequence
  chemically synthesized
atcaaatgctttttcagcatct

SEQ ID NO: 1238488 - DNA, 22 bp, Artificial Sequence
  chemically synthesized
tatcaaatgctttttcagcatc

SEQ ID NO: 1238489 - DNA, 22 bp, Artificial Sequence
  chemically synthesized
ttatcaaatgctttttcagcat

SEQ ID NO: 1238490 - DNA, 22 bp, Artificial Sequence
  chemically synthesized
aatttttatcaaatgctttttc

SEQ ID NO: 1238491 - DNA, 22 bp, Artificial Sequence
  chemically synthesized
caatagatgctgaaaaagcatt

SEQ ID NO: 1238492 - DNA, 22 bp, Artificial Sequence
  chemically synthesized
aatagatgctgaaaaagcattt

SEQ ID NO: 1238493 - DNA, 22 bp, Artificial Sequence
  chemically synthesized
aaaaagcatttgataaaaattc

SEQ ID NO: 1238494 - DNA, 22 bp, Artificial Sequence
  chemically synthesized
tcatgaaggcatgttgaatttt

SEQ ID NO: 1238495 - DNA, 22 bp, Artificial Sequence
  chemically synthesized
atcatgaaggcatgttgaattt

SEQ ID NO: 1238496 - DNA, 22 bp, Artificial Sequence
  chemically synthesized
tatcatgaaggcatgttgaatt

SEQ ID NO: 1238497 - DNA, 22 bp, Artificial Sequence
  chemically synthesized
ttatcatgaaggcatgttgaat

SEQ ID NO: 1238498 - DNA, 22 bp, Artificial Sequence
  chemically synthesized
gataaaaattcaacatgccttc

SEQ ID NO: 1238499 - DNA, 22 bp, Artificial Sequence
  chemically synthesized
ataaaaattcaacatgccttca

SEQ ID NO: 1238500 - DNA, 22 bp, Artificial Sequence
  chemically synthesized
agagtttttatcatgaaggcat

SEQ ID NO: 1238501 - DNA, 22 bp, Artificial Sequence
  chemically synthesized
gagagtttttatcatgaaggca

SEQ ID NO: 1238502 - DNA, 22 bp, Artificial Sequence
  chemically synthesized
tgagagtttttatcatgaaggc

SEQ ID NO: 1238503 - DNA, 22 bp, Artificial Sequence
  chemically synthesized
aacatgccttcatgataaaaac

SEQ ID NO: 1238504 - DNA, 22 bp, Artificial Sequence
  chemically synthesized
tacccagttttgagagttttta

SEQ ID NO: 1238505 - DNA, 22 bp, Artificial Sequence
  chemically synthesized
tatacccagttttgagagtttt

SEQ ID NO: 1238506 - DNA, 22 bp, Artificial Sequence
  chemically synthesized
ctatacccagttttgagagttt

SEQ ID NO: 1238507 - DNA, 22 bp, Artificial Sequence
  chemically synthesized
cttctatacccagttttgagag

SEQ ID NO: 1238508 - DNA, 22 bp, Artificial Sequence
  chemically synthesized
catgataaaaactctcaaaact

SEQ ID NO: 1238509 - DNA, 22 bp, Artificial Sequence
  chemically synthesized
atgataaaaactctcaaaactg

SEQ ID NO: 1238510 - DNA, 22 bp, Artificial Sequence
  chemically synthesized
aggtatgctgcttctataccca

SEQ ID NO: 1238511 - DNA, 22 bp, Artificial Sequence
  chemically synthesized
tcaaaactgggtatagaagcag

SEQ ID NO: 1238512 - DNA, 22 bp, Artificial Sequence
  chemically synthesized
tgttaaggtatgctgcttctat

SEQ ID NO: 1238513 - DNA, 22 bp, Artificial Sequence
  chemically synthesized
aaaactgggtatagaagcagca

SEQ ID NO: 1238514 - DNA, 22 bp, Artificial Sequence
  chemically synthesized
ctgtgttaaggtatgctgcttc

SEQ ID NO: 1238515 - DNA, 22 bp, Artificial Sequence
  chemically synthesized
actgtgttaaggtatgctgctt

SEQ ID NO: 1238516 - DNA, 22 bp, Artificial Sequence
  chemically synthesized
tactgtgttaaggtatgctgct

SEQ ID NO: 1238517 - DNA, 22 bp, Artificial Sequence
  chemically synthesized
ttactgtgttaaggtatgctgc

SEQ ID NO: 1238518 - DNA, 22 bp, Artificial Sequence
  chemically synthesized
ggtatagaagcagcatacctta

SEQ ID NO: 1238519 - DNA, 22 bp, Artificial Sequence
  chemically synthesized
atatgtggcttttactgtgtta

SEQ ID NO: 1238520 - DNA, 22 bp, Artificial Sequence
  chemically synthesized
tcatatgtggcttttactgtgt

SEQ ID NO: 1238521 - DNA, 22 bp, Artificial Sequence
  chemically synthesized
ctcatatgtggcttttactgtg

SEQ ID NO: 1238522 - DNA, 22 bp, Artificial Sequence
  chemically synthesized
tgggtttctcatatgtggcttt

SEQ ID NO: 1238523 - DNA, 22 bp, Artificial Sequence
  chemically synthesized
aacacagtaaaagccacatatg

SEQ ID NO: 1238524 - DNA, 22 bp, Artificial Sequence
  chemically synthesized
acacagtaaaagccacatatga

SEQ ID NO: 1238525 - DNA, 22 bp, Artificial Sequence
  chemically synthesized
gctgtgggtttctcatatgtgg

SEQ ID NO: 1238526 - DNA, 22 bp, Artificial Sequence
  chemically synthesized
agtatgaaattagctgtgggtt

SEQ ID NO: 1238527 - DNA, 22 bp, Artificial Sequence
  chemically synthesized
cccattcagtatgaaattagct

SEQ ID NO: 1238528 - DNA, 22 bp, Artificial Sequence
  chemically synthesized
ccccattcagtatgaaattagc

SEQ ID NO: 1238529 - DNA, 22 bp, Artificial Sequence
  chemically synthesized
tccccattcagtatgaaattag

SEQ ID NO: 1238530 - DNA, 22 bp, Artificial Sequence
  chemically synthesized
ttccccattcagtatgaaatta

SEQ ID NO: 1238531 - DNA, 22 bp, Artificial Sequence
  chemically synthesized
tagtttttccccattcagtatg

SEQ ID NO: 1238532 - DNA, 22 bp, Artificial Sequence
  chemically synthesized
gtagtttttccccattcagtat

SEQ ID NO: 1238533 - DNA, 22 bp, Artificial Sequence
  chemically synthesized
atttcatactgaatggggaaaa

SEQ ID NO: 1238534 - DNA, 22 bp, Artificial Sequence
  chemically synthesized
catactgaatggggaaaaacta

SEQ ID NO: 1238535 - DNA, 22 bp, Artificial Sequence
  chemically synthesized
atactgaatggggaaaaactac

SEQ ID NO: 1238536 - DNA, 22 bp, Artificial Sequence
  chemically synthesized
gagaaaagtcttgtagtttttc

SEQ ID NO: 1238537 - DNA, 22 bp, Artificial Sequence
  chemically synthesized
agagaaaagtcttgtagttttt

SEQ ID NO: 1238538 - DNA, 22 bp, Artificial Sequence
  chemically synthesized
aatggggaaaaactacaagact

SEQ ID NO: 1238539 - DNA, 22 bp, Artificial Sequence
  chemically synthesized
cagatcttagagaaaagtcttg

SEQ ID NO: 1238540 - DNA, 22 bp, Artificial Sequence
  chemically synthesized
ttacagatcttagagaaaagtc

SEQ ID NO: 1238541 - DNA, 22 bp, Artificial Sequence
  chemically synthesized
gttacagatcttagagaaaagt

SEQ ID NO: 1238542 - DNA, 22 bp, Artificial Sequence
  chemically synthesized
caagacttttctctaagatctg

SEQ ID NO: 1238543 - DNA, 22 bp, Artificial Sequence
  chemically synthesized
ttctctaagatctgtaacaagg

SEQ ID NO: 1238544 - DNA, 22 bp, Artificial Sequence
  chemically synthesized
tctctaagatctgtaacaagga

SEQ ID NO: 1238545 - DNA, 22 bp, Artificial Sequence
  chemically synthesized
ctctaagatctgtaacaaggat

SEQ ID NO: 1238546 - DNA, 22 bp, Artificial Sequence
  chemically synthesized
tctaagatctgtaacaaggatg

SEQ ID NO: 1238547 - DNA, 22 bp, Artificial Sequence
  chemically synthesized
taagatctgtaacaaggatgcc

SEQ ID NO: 1238548 - DNA, 22 bp, Artificial Sequence
  chemically synthesized
agatctgtaacaaggatgccca

SEQ ID NO: 1238549 - DNA, 22 bp, Artificial Sequence
  chemically synthesized
aacaacagtagtgaaagtgggc

SEQ ID NO: 1238550 - DNA, 22 bp, Artificial Sequence
  chemically synthesized
taacaaggatgcccactttcac

SEQ ID NO: 1238551 - DNA, 22 bp, Artificial Sequence
  chemically synthesized
tagtaatatgttaaacaacagt

SEQ ID NO: 1238552 - DNA, 22 bp, Artificial Sequence
  chemically synthesized
gtagtaatatgttaaacaacag

SEQ ID NO: 1238553 - DNA, 22 bp, Artificial Sequence
  chemically synthesized
tcactactgttgtttaacatat

SEQ ID NO: 1238554 - DNA, 22 bp, Artificial Sequence
  chemically synthesized
ggacttgtagtaatatgttaaa

SEQ ID NO: 1238555 - DNA, 22 bp, Artificial Sequence
  chemically synthesized
cactactgttgtttaacatatt

SEQ ID NO: 1238556 - DNA, 22 bp, Artificial Sequence
  chemically synthesized
actactgttgtttaacatatta

SEQ ID NO: 1238557 - DNA, 22 bp, Artificial Sequence
  chemically synthesized
gctaggacttgtagtaatatgt

SEQ ID NO: 1238558 - DNA, 22 bp, Artificial Sequence
  chemically synthesized
ctgttgtttaacatattactac

SEQ ID NO: 1238559 - DNA, 22 bp, Artificial Sequence
  chemically synthesized
ttgtttaacatattactacaag

SEQ ID NO: 1238560 - DNA, 22 bp, Artificial Sequence
  chemically synthesized
atctagctaggacttgtagtaa

SEQ ID NO: 1238561 - DNA, 22 bp, Artificial Sequence
  chemically synthesized
gatctagctaggacttgtagta

SEQ ID NO: 1238562 - DNA, 22 bp, Artificial Sequence
  chemically synthesized
tgatctagctaggacttgtagt

SEQ ID NO: 1238563 - DNA, 22 bp, Artificial Sequence
  chemically synthesized
tttaacatattactacaagtcc

SEQ ID NO: 1238564 - DNA, 22 bp, Artificial Sequence
  chemically synthesized
tttgatctagctaggacttgta

SEQ ID NO: 1238565 - DNA, 22 bp, Artificial Sequence
  chemically synthesized
ctttgatctagctaggacttgt

SEQ ID NO: 1238566 - DNA, 22 bp, Artificial Sequence
  chemically synthesized
aacatattactacaagtcctag

SEQ ID NO: 1238567 - DNA, 22 bp, Artificial Sequence
  chemically synthesized
tctttgatctagctaggacttg

SEQ ID NO: 1238568 - DNA, 22 bp, Artificial Sequence
  chemically synthesized
acatattactacaagtcctagc

SEQ ID NO: 1238569 - DNA, 22 bp, Artificial Sequence
  chemically synthesized
tttctttgatctagctaggact

SEQ ID NO: 1238570 - DNA, 22 bp, Artificial Sequence
  chemically synthesized
ctttctttgatctagctaggac

SEQ ID NO: 1238571 - DNA, 22 bp, Artificial Sequence
  chemically synthesized
tttctttctttgatctagctag

SEQ ID NO: 1238572 - DNA, 22 bp, Artificial Sequence
  chemically synthesized
gtttctttctttgatctagcta

SEQ ID NO: 1238573 - DNA, 22 bp, Artificial Sequence
  chemically synthesized
tgtttctttctttgatctagct

SEQ ID NO: 1238574 - DNA, 22 bp, Artificial Sequence
  chemically synthesized
ctacaagtcctagctagatcaa

SEQ ID NO: 1238575 - DNA, 22 bp, Artificial Sequence
  chemically synthesized
caagtcctagctagatcaaaga

SEQ ID NO: 1238576 - DNA, 22 bp, Artificial Sequence
  chemically synthesized
gatgccctttgtttctttcttt

SEQ ID NO: 1238577 - DNA, 22 bp, Artificial Sequence
  chemically synthesized
gctagatcaaagaaagaaacaa

SEQ ID NO: 1238578 - DNA, 22 bp, Artificial Sequence
  chemically synthesized
aatctggatgccctttgtttct

SEQ ID NO: 1238579 - DNA, 22 bp, Artificial Sequence
  chemically synthesized
caatctggatgccctttgtttc

SEQ ID NO: 1238580 - DNA, 22 bp, Artificial Sequence
  chemically synthesized
gatcaaagaaagaaacaaaggg

SEQ ID NO: 1238581 - DNA, 22 bp, Artificial Sequence
  chemically synthesized
tcaatctggatgccctttgttt

SEQ ID NO: 1238582 - DNA, 22 bp, Artificial Sequence
  chemically synthesized
ttcaatctggatgccctttgtt

SEQ ID NO: 1238583 - DNA, 22 bp, Artificial Sequence
  chemically synthesized
cttttcaatctggatgcccttt

SEQ ID NO: 1238584 - DNA, 22 bp, Artificial Sequence
  chemically synthesized
ccttttcaatctggatgccctt

SEQ ID NO: 1238585 - DNA, 22 bp, Artificial Sequence
  chemically synthesized
ttccttttcaatctggatgccc

SEQ ID NO: 1238586 - DNA, 22 bp, Artificial Sequence
  chemically synthesized
attcttccttttcaatctggat

SEQ ID NO: 1238587 - DNA, 22 bp, Artificial Sequence
  chemically synthesized
gattcttccttttcaatctgga

SEQ ID NO: 1238588 - DNA, 22 bp, Artificial Sequence
  chemically synthesized
taaacaaggatcatttgattct

SEQ ID NO: 1238589 - DNA, 22 bp, Artificial Sequence
  chemically synthesized
gtaaacaaggatcatttgattc

SEQ ID NO: 1238590 - DNA, 22 bp, Artificial Sequence
  chemically synthesized
tgtaaacaaggatcatttgatt

SEQ ID NO: 1238591 - DNA, 22 bp, Artificial Sequence
  chemically synthesized
aaaaggaagaatcaaatgatcc

SEQ ID NO: 1238592 - DNA, 22 bp, Artificial Sequence
  chemically synthesized
gttttgtaaacaaggatcattt

SEQ ID NO: 1238593 - DNA, 22 bp, Artificial Sequence
  chemically synthesized
ctagttttgtaaacaaggatca

SEQ ID NO: 1238594 - DNA, 22 bp, Artificial Sequence
  chemically synthesized
aagtcaggtaatgggattccta

SEQ ID NO: 1238595 - DNA, 22 bp, Artificial Sequence
  chemically synthesized
gtttacaaaactaggaatccca

SEQ ID NO: 1238596 - DNA, 22 bp, Artificial Sequence
  chemically synthesized
gaagtcaggtaatgggattcct

SEQ ID NO: 1238597 - DNA, 22 bp, Artificial Sequence
  chemically synthesized
tttacaaaactaggaatcccat

SEQ ID NO: 1238598 - DNA, 22 bp, Artificial Sequence
  chemically synthesized
acaaaactaggaatcccattac

SEQ ID NO: 1238599 - DNA, 22 bp, Artificial Sequence
  chemically synthesized
caaaactaggaatcccattacc

SEQ ID NO: 1238600 - DNA, 22 bp, Artificial Sequence
  chemically synthesized
tagtataatttgaagtcaggta

SEQ ID NO: 1238601 - DNA, 22 bp, Artificial Sequence
  chemically synthesized
ggaatcccattacctgacttca

SEQ ID NO: 1238602 - DNA, 22 bp, Artificial Sequence
  chemically synthesized
tgtagtataatttgaagtcagg

SEQ ID NO: 1238603 - DNA, 22 bp, Artificial Sequence
  chemically synthesized
gtatagctctgtagtataattt

SEQ ID NO: 1238604 - DNA, 22 bp, Artificial Sequence
  chemically synthesized
cctgacttcaaattatactaca

SEQ ID NO: 1238605 - DNA, 22 bp, Artificial Sequence
  chemically synthesized
gttagtatagctctgtagtata

SEQ ID NO: 1238606 - DNA, 22 bp, Artificial Sequence
  chemically synthesized
ggttagtatagctctgtagtat

SEQ ID NO: 1238607 - DNA, 22 bp, Artificial Sequence
  chemically synthesized
tggttagtatagctctgtagta

SEQ ID NO: 1238608 - DNA, 22 bp, Artificial Sequence
  chemically synthesized
acttcaaattatactacagagc

SEQ ID NO: 1238609 - DNA, 22 bp, Artificial Sequence
  chemically synthesized
ttggttagtatagctctgtagt

SEQ ID NO: 1238610 - DNA, 22 bp, Artificial Sequence
  chemically synthesized
caaattatactacagagctata

SEQ ID NO: 1238611 - DNA, 22 bp, Artificial Sequence
  chemically synthesized
aaattatactacagagctatac

SEQ ID NO: 1238612 - DNA, 22 bp, Artificial Sequence
  chemically synthesized
gcatgcatttttggttagtata

SEQ ID NO: 1238613 - DNA, 22 bp, Artificial Sequence
  chemically synthesized
tactacagagctatactaacca

SEQ ID NO: 1238614 - DNA, 22 bp, Artificial Sequence
  chemically synthesized
cagagctatactaaccaaaaat

SEQ ID NO: 1238615 - DNA, 22 bp, Artificial Sequence
  chemically synthesized
tgccattagcatgcatttttgg

SEQ ID NO: 1238616 - DNA, 22 bp, Artificial Sequence
  chemically synthesized
atgccattagcatgcatttttg

SEQ ID NO: 1238617 - DNA, 22 bp, Artificial Sequence
  chemically synthesized
tatgccattagcatgcattttt

SEQ ID NO: 1238618 - DNA, 22 bp, Artificial Sequence
  chemically synthesized
ttatgccattagcatgcatttt

SEQ ID NO: 1238619 - DNA, 22 bp, Artificial Sequence
  chemically synthesized
tactaaccaaaaatgcatgcta

SEQ ID NO: 1238620 - DNA, 22 bp, Artificial Sequence
  chemically synthesized
tttttatgccattagcatgcat

SEQ ID NO: 1238621 - DNA, 22 bp, Artificial Sequence
  chemically synthesized
accaaaaatgcatgctaatggc

SEQ ID NO: 1238622 - DNA, 22 bp, Artificial Sequence
  chemically synthesized
tgtgtctgtttttatgccatta

SEQ ID NO: 1238623 - DNA, 22 bp, Artificial Sequence
  chemically synthesized
gtctatgtgtctgtttttatgc

SEQ ID NO: 1238624 - DNA, 22 bp, Artificial Sequence
  chemically synthesized
cattggtctatgtgtctgtttt

SEQ ID NO: 1238625 - DNA, 22 bp, Artificial Sequence
  chemically synthesized
ttccattggtctatgtgtctgt

SEQ ID NO: 1238626 - DNA, 22 bp, Artificial Sequence
  chemically synthesized
atggcataaaaacagacacata

SEQ ID NO: 1238627 - DNA, 22 bp, Artificial Sequence
  chemically synthesized
tgttccattggtctatgtgtct

SEQ ID NO: 1238628 - DNA, 22 bp, Artificial Sequence
  chemically synthesized
ttctgttccattggtctatgtg

SEQ ID NO: 1238629 - DNA, 22 bp, Artificial Sequence
  chemically synthesized
tattctgttccattggtctatg

SEQ ID NO: 1238630 - DNA, 22 bp, Artificial Sequence
  chemically synthesized
ggctctattctgttccattggt

SEQ ID NO: 1238631 - DNA, 22 bp, Artificial Sequence
  chemically synthesized
tgtctgggctctattctgttcc

SEQ ID NO: 1238632 - DNA, 22 bp, Artificial Sequence
  chemically synthesized
tggagttgtgtctgggctctat

SEQ ID NO: 1238633 - DNA, 22 bp, Artificial Sequence
  chemically synthesized
ggtctgtggagttgtgtctggg

SEQ ID NO: 1238634 - DNA, 22 bp, Artificial Sequence
  chemically synthesized
aggtctgtggagttgtgtctgg

SEQ ID NO: 1238635 - DNA, 22 bp, Artificial Sequence
  chemically synthesized
taggtctgtggagttgtgtctg

SEQ ID NO: 1238636 - DNA, 22 bp, Artificial Sequence
  chemically synthesized
ctttaggtctgtggagttgtgt

SEQ ID NO: 1238637 - DNA, 22 bp, Artificial Sequence
  chemically synthesized
actttaggtctgtggagttgtg

SEQ ID NO: 1238638 - DNA, 22 bp, Artificial Sequence
  chemically synthesized
aaaatgagtttactttaggtct

SEQ ID NO: 1238639 - DNA, 22 bp, Artificial Sequence
  chemically synthesized
ttaaaaatgagtttactttagg

SEQ ID NO: 1238640 - DNA, 22 bp, Artificial Sequence
  chemically synthesized
gttaaaaatgagtttactttag

SEQ ID NO: 1238641 - DNA, 22 bp, Artificial Sequence
  chemically synthesized
tgttaaaaatgagtttacttta

SEQ ID NO: 1238642 - DNA, 22 bp, Artificial Sequence
  chemically synthesized
cacagacctaaagtaaactcat

SEQ ID NO: 1238643 - DNA, 22 bp, Artificial Sequence
  chemically synthesized
gcacctttgttaaaaatgagtt

SEQ ID NO: 1238644 - DNA, 22 bp, Artificial Sequence
  chemically synthesized
ggcacctttgttaaaaatgagt

SEQ ID NO: 1238645 - DNA, 22 bp, Artificial Sequence
  chemically synthesized
ttggcacctttgttaaaaatga

SEQ ID NO: 1238646 - DNA, 22 bp, Artificial Sequence
  chemically synthesized
aagtaaactcatttttaacaaa

SEQ ID NO: 1238647 - DNA, 22 bp, Artificial Sequence
  chemically synthesized
agtgtatgttcttggcaccttt

SEQ ID NO: 1238648 - DNA, 22 bp, Artificial Sequence
  chemically synthesized
cagtgtatgttcttggcacctt

SEQ ID NO: 1238649 - DNA, 22 bp, Artificial Sequence
  chemically synthesized
atttttaacaaaggtgccaaga

SEQ ID NO: 1238650 - DNA, 22 bp, Artificial Sequence
  chemically synthesized
ttcagtgtatgttcttggcacc

SEQ ID NO: 1238651 - DNA, 22 bp, Artificial Sequence
  chemically synthesized
cttcagtgtatgttcttggcac

SEQ ID NO: 1238652 - DNA, 22 bp, Artificial Sequence
  chemically synthesized
tcttcagtgtatgttcttggca

SEQ ID NO: 1238653 - DNA, 22 bp, Artificial Sequence
  chemically synthesized
ttcttcagtgtatgttcttggc

SEQ ID NO: 1238654 - DNA, 22 bp, Artificial Sequence
  chemically synthesized
ttaacaaaggtgccaagaacat

SEQ ID NO: 1238655 - DNA, 22 bp, Artificial Sequence
  chemically synthesized
taacaaaggtgccaagaacata

SEQ ID NO: 1238656 - DNA, 22 bp, Artificial Sequence
  chemically synthesized
aacaaaggtgccaagaacatac

SEQ ID NO: 1238657 - DNA, 22 bp, Artificial Sequence
  chemically synthesized
acaaaggtgccaagaacataca

SEQ ID NO: 1238658 - DNA, 22 bp, Artificial Sequence
  chemically synthesized
aaaagatggtcttttcttcagt

SEQ ID NO: 1238659 - DNA, 22 bp, Artificial Sequence
  chemically synthesized
ttgaaaagatggtcttttcttc

SEQ ID NO: 1238660 - DNA, 22 bp, Artificial Sequence
  chemically synthesized
attgaaaagatggtcttttctt

SEQ ID NO: 1238661 - DNA, 22 bp, Artificial Sequence
  chemically synthesized
agcaccatttattgaaaagatg

SEQ ID NO: 1238662 - DNA, 22 bp, Artificial Sequence
  chemically synthesized
aagaaaagaccatcttttcaat

SEQ ID NO: 1238663 - DNA, 22 bp, Artificial Sequence
  chemically synthesized
tcagcaccatttattgaaaaga

SEQ ID NO: 1238664 - DNA, 22 bp, Artificial Sequence
  chemically synthesized
ctcagcaccatttattgaaaag

SEQ ID NO: 1238665 - DNA, 22 bp, Artificial Sequence
  chemically synthesized
tctcagcaccatttattgaaaa

SEQ ID NO: 1238666 - DNA, 22 bp, Artificial Sequence
  chemically synthesized
ttcaataaatggtgctgagaaa

SEQ ID NO: 1238667 - DNA, 22 bp, Artificial Sequence
  chemically synthesized
tcaataaatggtgctgagaaaa

SEQ ID NO: 1238668 - DNA, 22 bp, Artificial Sequence
  chemically synthesized
caataaatggtgctgagaaaac

SEQ ID NO: 1238669 - DNA, 22 bp, Artificial Sequence
  chemically synthesized
aataaatggtgctgagaaaact

SEQ ID NO: 1238670 - DNA, 22 bp, Artificial Sequence
  chemically synthesized
catatccatatccagttttctc

SEQ ID NO: 1238671 - DNA, 22 bp, Artificial Sequence
  chemically synthesized
gcatatccatatccagttttct

SEQ ID NO: 1238672 - DNA, 22 bp, Artificial Sequence
  chemically synthesized
tgcatatccatatccagttttc

SEQ ID NO: 1238673 - DNA, 22 bp, Artificial Sequence
  chemically synthesized
ttgcatatccatatccagtttt

SEQ ID NO: 1238674 - DNA, 22 bp, Artificial Sequence
  chemically synthesized
ttttgcatatccatatccagtt

SEQ ID NO: 1238675 - DNA, 22 bp, Artificial Sequence
  chemically synthesized
attcttttgcatatccatatcc

SEQ ID NO: 1238676 - DNA, 22 bp, Artificial Sequence
  chemically synthesized
cattcttttgcatatccatatc

SEQ ID NO: 1238677 - DNA, 22 bp, Artificial Sequence
  chemically synthesized
agaaaactggatatggatatgc

SEQ ID NO: 1238678 - DNA, 22 bp, Artificial Sequence
  chemically synthesized
atttcattcttttgcatatcca

SEQ ID NO: 1238679 - DNA, 22 bp, Artificial Sequence
  chemically synthesized
gatatggatatgcaaaagaatg

SEQ ID NO: 1238680 - DNA, 22 bp, Artificial Sequence
  chemically synthesized
tatatggcgagagataagggtc

SEQ ID NO: 1238681 - DNA, 22 bp, Artificial Sequence
  chemically synthesized
gtatatggcgagagataagggt

SEQ ID NO: 1238682 - DNA, 22 bp, Artificial Sequence
  chemically synthesized
tgtatatggcgagagataaggg

SEQ ID NO: 1238683 - DNA, 22 bp, Artificial Sequence
  chemically synthesized
ttgtatatggcgagagataagg

SEQ ID NO: 1238684 - DNA, 22 bp, Artificial Sequence
  chemically synthesized
atacttttgtatatggcgagag

SEQ ID NO: 1238685 - DNA, 22 bp, Artificial Sequence
  chemically synthesized
gacccttatctctcgccatata

SEQ ID NO: 1238686 - DNA, 22 bp, Artificial Sequence
  chemically synthesized
gattgatacttttgtatatggc

SEQ ID NO: 1238687 - DNA, 22 bp, Artificial Sequence
  chemically synthesized
agattgatacttttgtatatgg

SEQ ID NO: 1238688 - DNA, 22 bp, Artificial Sequence
  chemically synthesized
atctctcgccatatacaaaagt

SEQ ID NO: 1238689 - DNA, 22 bp, Artificial Sequence
  chemically synthesized
tctctcgccatatacaaaagta

SEQ ID NO: 1238690 - DNA, 22 bp, Artificial Sequence
  chemically synthesized
cacttagattgatacttttgta

SEQ ID NO: 1238691 - DNA, 22 bp, Artificial Sequence
  chemically synthesized
ttccacttagattgatactttt

SEQ ID NO: 1238692 - DNA, 22 bp, Artificial Sequence
  chemically synthesized
tcgccatatacaaaagtatcaa

SEQ ID NO: 1238693 - DNA, 22 bp, Artificial Sequence
  chemically synthesized
gttccacttagattgatacttt

SEQ ID NO: 1238694 - DNA, 22 bp, Artificial Sequence
  chemically synthesized
tgttccacttagattgatactt

SEQ ID NO: 1238695 - DNA, 22 bp, Artificial Sequence
  chemically synthesized
gccatatacaaaagtatcaatc

SEQ ID NO: 1238696 - DNA, 22 bp, Artificial Sequence
  chemically synthesized
agtctttgttccacttagattg

SEQ ID NO: 1238697 - DNA, 22 bp, Artificial Sequence
  chemically synthesized
aagtctttgttccacttagatt

SEQ ID NO: 1238698 - DNA, 22 bp, Artificial Sequence
  chemically synthesized
gatttaagtctttgttccactt

SEQ ID NO: 1238699 - DNA, 22 bp, Artificial Sequence
  chemically synthesized
agatttaagtctttgttccact

SEQ ID NO: 1238700 - DNA, 22 bp, Artificial Sequence
  chemically synthesized
aggccttagatttaagtctttg

SEQ ID NO: 1238701 - DNA, 22 bp, Artificial Sequence
  chemically synthesized
gaggccttagatttaagtcttt

SEQ ID NO: 1238702 - DNA, 22 bp, Artificial Sequence
  chemically synthesized
agtggaacaaagacttaaatct

SEQ ID NO: 1238703 - DNA, 22 bp, Artificial Sequence
  chemically synthesized
atagtttgaggccttagattta

SEQ ID NO: 1238704 - DNA, 22 bp, Artificial Sequence
  chemically synthesized
catagtttgaggccttagattt

SEQ ID NO: 1238705 - DNA, 22 bp, Artificial Sequence
  chemically synthesized
tagtagtttcatagtttgaggc

SEQ ID NO: 1238706 - DNA, 22 bp, Artificial Sequence
  chemically synthesized
gtagtagtttcatagtttgagg

SEQ ID NO: 1238707 - DNA, 22 bp, Artificial Sequence
  chemically synthesized
aaatctaaggcctcaaactatg

SEQ ID NO: 1238708 - DNA, 22 bp, Artificial Sequence
  chemically synthesized
ttgtagtagtttcatagtttga

SEQ ID NO: 1238709 - DNA, 22 bp, Artificial Sequence
  chemically synthesized
aatctaaggcctcaaactatga

SEQ ID NO: 1238710 - DNA, 22 bp, Artificial Sequence
  chemically synthesized
cttgtagtagtttcatagtttg

SEQ ID NO: 1238711 - DNA, 22 bp, Artificial Sequence
  chemically synthesized
aggcctcaaactatgaaactac

SEQ ID NO: 1238712 - DNA, 22 bp, Artificial Sequence
  chemically synthesized
tcccaatgatttcttgtagtag

SEQ ID NO: 1238713 - DNA, 22 bp, Artificial Sequence
  chemically synthesized
aaactatgaaactactacaaga

SEQ ID NO: 1238714 - DNA, 22 bp, Artificial Sequence
  chemically synthesized
atcccaatgatttcttgtagta

SEQ ID NO: 1238715 - DNA, 22 bp, Artificial Sequence
  chemically synthesized
tatcccaatgatttcttgtagt

SEQ ID NO: 1238716 - DNA, 22 bp, Artificial Sequence
  chemically synthesized
tgaaactactacaagaaatcat

SEQ ID NO: 1238717 - DNA, 22 bp, Artificial Sequence
  chemically synthesized
gagattttatcccaatgatttc

SEQ ID NO: 1238718 - DNA, 22 bp, Artificial Sequence
  chemically synthesized
ggagattttatcccaatgattt

SEQ ID NO: 1238719 - DNA, 22 bp, Artificial Sequence
  chemically synthesized
ctacaagaaatcattgggataa

SEQ ID NO: 1238720 - DNA, 22 bp, Artificial Sequence
  chemically synthesized
caagaaatcattgggataaaat

SEQ ID NO: 1238721 - DNA, 22 bp, Artificial Sequence
  chemically synthesized
gaccagtgtcttggagatttta

SEQ ID NO: 1238722 - DNA, 22 bp, Artificial Sequence
  chemically synthesized
cctagaccagtgtcttggagat

SEQ ID NO: 1238723 - DNA, 22 bp, Artificial Sequence
  chemically synthesized
gcctagaccagtgtcttggaga

SEQ ID NO: 1238724 - DNA, 22 bp, Artificial Sequence
  chemically synthesized
ggataaaatctccaagacactg

SEQ ID NO: 1238725 - DNA, 22 bp, Artificial Sequence
  chemically synthesized
aagaaatatttgcctagaccag

SEQ ID NO: 1238726 - DNA, 22 bp, Artificial Sequence
  chemically synthesized
ctcaagaaatatttgcctagac

SEQ ID NO: 1238727 - DNA, 22 bp, Artificial Sequence
  chemically synthesized
caagacactggtctaggcaaat

SEQ ID NO: 1238728 - DNA, 22 bp, Artificial Sequence
  chemically synthesized
gtagggtattgctcaagaaata

SEQ ID NO: 1238729 - DNA, 22 bp, Artificial Sequence
  chemically synthesized
gtctaggcaaatatttcttgag

SEQ ID NO: 1238730 - DNA, 22 bp, Artificial Sequence
  chemically synthesized
ggtagggtattgctcaagaaat

SEQ ID NO: 1238731 - DNA, 22 bp, Artificial Sequence
  chemically synthesized
ggcaaatatttcttgagcaata

SEQ ID NO: 1238732 - DNA, 22 bp, Artificial Sequence
  chemically synthesized
tgcttggtagggtattgctcaa

SEQ ID NO: 1238733 - DNA, 22 bp, Artificial Sequence
  chemically synthesized
gtgcttggtagggtattgctca

SEQ ID NO: 1238734 - DNA, 22 bp, Artificial Sequence
  chemically synthesized
cttgtgcttggtagggtattgc

SEQ ID NO: 1238735 - DNA, 22 bp, Artificial Sequence
  chemically synthesized
attgcttgtgcttggtagggta

SEQ ID NO: 1238736 - DNA, 22 bp, Artificial Sequence
  chemically synthesized
gattgcttgtgcttggtagggt

SEQ ID NO: 1238737 - DNA, 22 bp, Artificial Sequence
  chemically synthesized
tgattgcttgtgcttggtaggg

SEQ ID NO: 1238738 - DNA, 22 bp, Artificial Sequence
  chemically synthesized
cttgagcaataccctaccaagc

SEQ ID NO: 1238739 - DNA, 22 bp, Artificial Sequence
  chemically synthesized
ttgagcaataccctaccaagca

SEQ ID NO: 1238740 - DNA, 22 bp, Artificial Sequence
  chemically synthesized
ctttgattgcttgtgcttggta

SEQ ID NO: 1238741 - DNA, 22 bp, Artificial Sequence
  chemically synthesized
gagcaataccctaccaagcaca

SEQ ID NO: 1238742 - DNA, 22 bp, Artificial Sequence
  chemically synthesized
gctttgattgcttgtgcttggt

SEQ ID NO: 1238743 - DNA, 22 bp, Artificial Sequence
  chemically synthesized
agcaataccctaccaagcacaa

SEQ ID NO: 1238744 - DNA, 22 bp, Artificial Sequence
  chemically synthesized
tgcatgtttgctttgattgctt

SEQ ID NO: 1238745 - DNA, 22 bp, Artificial Sequence
  chemically synthesized
gtgcatgtttgctttgattgct

SEQ ID NO: 1238746 - DNA, 22 bp, Artificial Sequence
  chemically synthesized
ccaagcacaagcaatcaaagca

SEQ ID NO: 1238747 - DNA, 22 bp, Artificial Sequence
  chemically synthesized
atttgtgcatgtttgctttgat

SEQ ID NO: 1238748 - DNA, 22 bp, Artificial Sequence
  chemically synthesized
atgtctcatttgtgcatgtttg

SEQ ID NO: 1238749 - DNA, 22 bp, Artificial Sequence
  chemically synthesized
gatgtctcatttgtgcatgttt

SEQ ID NO: 1238750 - DNA, 22 bp, Artificial Sequence
  chemically synthesized
acttgatgtctcatttgtgcat

SEQ ID NO: 1238751 - DNA, 22 bp, Artificial Sequence
  chemically synthesized
aacttgatgtctcatttgtgca

SEQ ID NO: 1238752 - DNA, 22 bp, Artificial Sequence
  chemically synthesized
taacttgatgtctcatttgtgc

SEQ ID NO: 1238753 - DNA, 22 bp, Artificial Sequence
  chemically synthesized
ttaacttgatgtctcatttgtg

SEQ ID NO: 1238754 - DNA, 22 bp, Artificial Sequence
  chemically synthesized
tttaacttgatgtctcatttgt

SEQ ID NO: 1238755 - DNA, 22 bp, Artificial Sequence
  chemically synthesized
tgtagaagctttttaacttgat

SEQ ID NO: 1238756 - DNA, 22 bp, Artificial Sequence
  chemically synthesized
ctgtgtagaagctttttaactt

SEQ ID NO: 1238757 - DNA, 22 bp, Artificial Sequence
  chemically synthesized
gctgtgtagaagctttttaact

SEQ ID NO: 1238758 - DNA, 22 bp, Artificial Sequence
  chemically synthesized
cttgctgtgtagaagcttttta

SEQ ID NO: 1238759 - DNA, 22 bp, Artificial Sequence
  chemically synthesized
tattccttgctgtgtagaagct

SEQ ID NO: 1238760 - DNA, 22 bp, Artificial Sequence
  chemically synthesized
attgtattccttgctgtgtaga

SEQ ID NO: 1238761 - DNA, 22 bp, Artificial Sequence
  chemically synthesized
ttgattgtattccttgctgtgt

SEQ ID NO: 1238762 - DNA, 22 bp, Artificial Sequence
  chemically synthesized
gttgattgtattccttgctgtg

SEQ ID NO: 1238763 - DNA, 22 bp, Artificial Sequence
  chemically synthesized
aaaagcttctacacagcaagga

SEQ ID NO: 1238764 - DNA, 22 bp, Artificial Sequence
  chemically synthesized
tgttgattgtattccttgctgt

SEQ ID NO: 1238765 - DNA, 22 bp, Artificial Sequence
  chemically synthesized
actttgttgattgtattccttg

SEQ ID NO: 1238766 - DNA, 22 bp, Artificial Sequence
  chemically synthesized
cactttgttgattgtattcctt

SEQ ID NO: 1238767 - DNA, 22 bp, Artificial Sequence
  chemically synthesized
ctacacagcaaggaatacaatc

SEQ ID NO: 1238768 - DNA, 22 bp, Artificial Sequence
  chemically synthesized
tacacagcaaggaatacaatca

SEQ ID NO: 1238769 - DNA, 22 bp, Artificial Sequence
  chemically synthesized
cacagcaaggaatacaatcaac

SEQ ID NO: 1238770 - DNA, 22 bp, Artificial Sequence
  chemically synthesized
tgtcttcactttgttgattgta

SEQ ID NO: 1238771 - DNA, 22 bp, Artificial Sequence
  chemically synthesized
tgtgttgtgtcttcactttgtt

SEQ ID NO: 1238772 - DNA, 22 bp, Artificial Sequence
  chemically synthesized
tgtgtgttgtgtcttcactttg

SEQ ID NO: 1238773 - DNA, 22 bp, Artificial Sequence
  chemically synthesized
ctctgtgtgttgtgtcttcact

SEQ ID NO: 1238774 - DNA, 22 bp, Artificial Sequence
  chemically synthesized
ctactctgtgtgttgtgtcttc

SEQ ID NO: 1238775 - DNA, 22 bp, Artificial Sequence
  chemically synthesized
tcctactctgtgtgttgtgtct

SEQ ID NO: 1238776 - DNA, 22 bp, Artificial Sequence
  chemically synthesized
tctcctactctgtgtgttgtgt

SEQ ID NO: 1238777 - DNA, 22 bp, Artificial Sequence
  chemically synthesized
gccagtattctctcctactctg

SEQ ID NO: 1238778 - DNA, 22 bp, Artificial Sequence
  chemically synthesized
tcaggtgggtagttggccagta

SEQ ID NO: 1238779 - DNA, 22 bp, Artificial Sequence
  chemically synthesized
gtcaggtgggtagttggccagt

SEQ ID NO: 1238780 - DNA, 22 bp, Artificial Sequence
  chemically synthesized
cttgtcaggtgggtagttggcc

SEQ ID NO: 1238781 - DNA, 22 bp, Artificial Sequence
  chemically synthesized
ttccttgtcaggtgggtagttg

SEQ ID NO: 1238782 - DNA, 22 bp, Artificial Sequence
  chemically synthesized
gttattccttgtcaggtgggta

SEQ ID NO: 1238783 - DNA, 22 bp, Artificial Sequence
  chemically synthesized
ggttattccttgtcaggtgggt

SEQ ID NO: 1238784 - DNA, 22 bp, Artificial Sequence
  chemically synthesized
tggttattccttgtcaggtggg

SEQ ID NO: 1238785 - DNA, 22 bp, Artificial Sequence
  chemically synthesized
gccaactacccacctgacaagg

SEQ ID NO: 1238786 - DNA, 22 bp, Artificial Sequence
  chemically synthesized
tagattttggttattccttgtc

SEQ ID NO: 1238787 - DNA, 22 bp, Artificial Sequence
  chemically synthesized
atagattttggttattccttgt

SEQ ID NO: 1238788 - DNA, 22 bp, Artificial Sequence
  chemically synthesized
cccacctgacaaggaataacca

SEQ ID NO: 1238789 - DNA, 22 bp, Artificial Sequence
  chemically synthesized
agccccttatagattttggtta

SEQ ID NO: 1238790 - DNA, 22 bp, Artificial Sequence
  chemically synthesized
gagccccttatagattttggtt

SEQ ID NO: 1238791 - DNA, 22 bp, Artificial Sequence
  chemically synthesized
acaaggaataaccaaaatctat

SEQ ID NO: 1238792 - DNA, 22 bp, Artificial Sequence
  chemically synthesized
tttgagccccttatagattttg

SEQ ID NO: 1238793 - DNA, 22 bp, Artificial Sequence
  chemically synthesized
tggagttgtttgagccccttat

SEQ ID NO: 1238794 - DNA, 22 bp, Artificial Sequence
  chemically synthesized
tatggagttgtttgagcccctt

SEQ ID NO: 1238795 - DNA, 22 bp, Artificial Sequence
  chemically synthesized
ctatggagttgtttgagcccct

SEQ ID NO: 1238796 - DNA, 22 bp, Artificial Sequence
  chemically synthesized
tctatggagttgtttgagcccc

SEQ ID NO: 1238797 - DNA, 22 bp, Artificial Sequence
  chemically synthesized
ttctatggagttgtttgagccc

SEQ ID NO: 1238798 - DNA, 22 bp, Artificial Sequence
  chemically synthesized
tttctatggagttgtttgagcc

SEQ ID NO: 1238799 - DNA, 22 bp, Artificial Sequence
  chemically synthesized
ttttctatggagttgtttgagc

SEQ ID NO: 1238800 - DNA, 22 bp, Artificial Sequence
  chemically synthesized
taaggggctcaaacaactccat

SEQ ID NO: 1238801 - DNA, 22 bp, Artificial Sequence
  chemically synthesized
tatatatttttttctatggagt

SEQ ID NO: 1238802 - DNA, 22 bp, Artificial Sequence
  chemically synthesized
aaacaactccatagaaaaaaat

SEQ ID NO: 1238803 - DNA, 22 bp, Artificial Sequence
  chemically synthesized
aatcagatgattatatatattt

SEQ ID NO: 1238804 - DNA, 22 bp, Artificial Sequence
  chemically synthesized
caatcagatgattatatatatt

SEQ ID NO: 1238805 - DNA, 22 bp, Artificial Sequence
  chemically synthesized
tcaatcagatgattatatatat

SEQ ID NO: 1238806 - DNA, 22 bp, Artificial Sequence
  chemically synthesized
catagaaaaaaatatatataat

SEQ ID NO: 1238807 - DNA, 22 bp, Artificial Sequence
  chemically synthesized
tttcaatcagatgattatatat

SEQ ID NO: 1238808 - DNA, 22 bp, Artificial Sequence
  chemically synthesized
ctttcaatcagatgattatata

SEQ ID NO: 1238809 - DNA, 22 bp, Artificial Sequence
  chemically synthesized
cccttctttcaatcagatgatt

SEQ ID NO: 1238810 - DNA, 22 bp, Artificial Sequence
  chemically synthesized
gcccttctttcaatcagatgat

SEQ ID NO: 1238811 - DNA, 22 bp, Artificial Sequence
  chemically synthesized
tgcccttctttcaatcagatga

SEQ ID NO: 1238812 - DNA, 22 bp, Artificial Sequence
  chemically synthesized
ttgcccttctttcaatcagatg

SEQ ID NO: 1238813 - DNA, 22 bp, Artificial Sequence
  chemically synthesized
aaatttttgcccttctttcaat

SEQ ID NO: 1238814 - DNA, 22 bp, Artificial Sequence
  chemically synthesized
ttcaaatttttgcccttctttc

SEQ ID NO: 1238815 - DNA, 22 bp, Artificial Sequence
  chemically synthesized
tattcaaatttttgcccttctt

SEQ ID NO: 1238816 - DNA, 22 bp, Artificial Sequence
  chemically synthesized
attgaaagaagggcaaaaattt

SEQ ID NO: 1238817 - DNA, 22 bp, Artificial Sequence
  chemically synthesized
agaaatctctattcaaattttt

SEQ ID NO: 1238818 - DNA, 22 bp, Artificial Sequence
  chemically synthesized
gagaaatctctattcaaatttt

SEQ ID NO: 1238819 - DNA, 22 bp, Artificial Sequence
  chemically synthesized
aaagaagggcaaaaatttgaat

SEQ ID NO: 1238820 - DNA, 22 bp, Artificial Sequence
  chemically synthesized
ttgagaaatctctattcaaatt

SEQ ID NO: 1238821 - DNA, 22 bp, Artificial Sequence
  chemically synthesized
tgtcatctcttgagaaatctct

SEQ ID NO: 1238822 - DNA, 22 bp, Artificial Sequence
  chemically synthesized
gtgtcatctcttgagaaatctc

SEQ ID NO: 1238823 - DNA, 22 bp, Artificial Sequence
  chemically synthesized
acatttgtgtcatctcttgaga

SEQ ID NO: 1238824 - DNA, 22 bp, Artificial Sequence
  chemically synthesized
gaatagagatttctcaagagat

SEQ ID NO: 1238825 - DNA, 22 bp, Artificial Sequence
  chemically synthesized
gacatttgtgtcatctcttgag

SEQ ID NO: 1238826 - DNA, 22 bp, Artificial Sequence
  chemically synthesized
aatagagatttctcaagagatg

SEQ ID NO: 1238827 - DNA, 22 bp, Artificial Sequence
  chemically synthesized
tgacatttgtgtcatctcttga

SEQ ID NO: 1238828 - DNA, 22 bp, Artificial Sequence
  chemically synthesized
tttgacatttgtgtcatctctt

SEQ ID NO: 1238829 - DNA, 22 bp, Artificial Sequence
  chemically synthesized
ctctttgacatttgtgtcatct

SEQ ID NO: 1238830 - DNA, 22 bp, Artificial Sequence
  chemically synthesized
ctcaagagatgacacaaatgtc

SEQ ID NO: 1238831 - DNA, 22 bp, Artificial Sequence
  chemically synthesized
atattcctctttgacatttgtg

SEQ ID NO: 1238832 - DNA, 22 bp, Artificial Sequence
  chemically synthesized
tcaagagatgacacaaatgtca

SEQ ID NO: 1238833 - DNA, 22 bp, Artificial Sequence
  chemically synthesized
catattcctctttgacatttgt

SEQ ID NO: 1238834 - DNA, 22 bp, Artificial Sequence
  chemically synthesized
tcatattcctctttgacatttg

SEQ ID NO: 1238835 - DNA, 22 bp, Artificial Sequence
  chemically synthesized
aagagatgacacaaatgtcaaa

SEQ ID NO: 1238836 - DNA, 22 bp, Artificial Sequence
  chemically synthesized
ttcatattcctctttgacattt

SEQ ID NO: 1238837 - DNA, 22 bp, Artificial Sequence
  chemically synthesized
atcaatgatagtgacaaccttt

SEQ ID NO: 1238838 - DNA, 22 bp, Artificial Sequence
  chemically synthesized
tgatcaatgatagtgacaacct

SEQ ID NO: 1238839 - DNA, 22 bp, Artificial Sequence
  chemically synthesized
tctgatcaatgatagtgacaac

SEQ ID NO: 1238840 - DNA, 22 bp, Artificial Sequence
  chemically synthesized
ctctgatcaatgatagtgacaa

SEQ ID NO: 1238841 - DNA, 22 bp, Artificial Sequence
  chemically synthesized
catttctctgatcaatgatagt

SEQ ID NO: 1238842 - DNA, 22 bp, Artificial Sequence
  chemically synthesized
acatttctctgatcaatgatag

SEQ ID NO: 1238843 - DNA, 22 bp, Artificial Sequence
  chemically synthesized
atttacatttctctgatcaatg

SEQ ID NO: 1238844 - DNA, 22 bp, Artificial Sequence
  chemically synthesized
gatttacatttctctgatcaat

SEQ ID NO: 1238845 - DNA, 22 bp, Artificial Sequence
  chemically synthesized
tgatttacatttctctgatcaa

SEQ ID NO: 1238846 - DNA, 22 bp, Artificial Sequence
  chemically synthesized
tcactatcattgatcagagaaa

SEQ ID NO: 1238847 - DNA, 22 bp, Artificial Sequence
  chemically synthesized
tagttttgatttacatttctct

SEQ ID NO: 1238848 - DNA, 22 bp, Artificial Sequence
  chemically synthesized
tcattgatcagagaaatgtaaa

SEQ ID NO: 1238849 - DNA, 22 bp, Artificial Sequence
  chemically synthesized
attgtagttttgatttacattt

SEQ ID NO: 1238850 - DNA, 22 bp, Artificial Sequence
  chemically synthesized
atcagagaaatgtaaatcaaaa

SEQ ID NO: 1238851 - DNA, 22 bp, Artificial Sequence
  chemically synthesized
gggtgagatgatacctcattgt

SEQ ID NO: 1238852 - DNA, 22 bp, Artificial Sequence
  chemically synthesized
actggggtgagatgatacctca

SEQ ID NO: 1238853 - DNA, 22 bp, Artificial Sequence
  chemically synthesized
aactggggtgagatgatacctc

SEQ ID NO: 1238854 - DNA, 22 bp, Artificial Sequence
  chemically synthesized
taactggggtgagatgatacct

SEQ ID NO: 1238855 - DNA, 22 bp, Artificial Sequence
  chemically synthesized
caatgaggtatcatctcacccc

SEQ ID NO: 1238856 - DNA, 22 bp, Artificial Sequence
  chemically synthesized
gatataagccattttaactggg

SEQ ID NO: 1238857 - DNA, 22 bp, Artificial Sequence
  chemically synthesized
ttggatataagccattttaact

SEQ ID NO: 1238858 - DNA, 22 bp, Artificial Sequence
  chemically synthesized
tctgttggatataagccatttt

SEQ ID NO: 1238859 - DNA, 22 bp, Artificial Sequence
  chemically synthesized
accccagttaaaatggcttata

SEQ ID NO: 1238860 - DNA, 22 bp, Artificial Sequence
  chemically synthesized
cctgtctgttggatataagcca

SEQ ID NO: 1238861 - DNA, 22 bp, Artificial Sequence
  chemically synthesized
atgttgcctgtctgttggatat

SEQ ID NO: 1238862 - DNA, 22 bp, Artificial Sequence
  chemically synthesized
aaatggcttatatccaacagac

SEQ ID NO: 1238863 - DNA, 22 bp, Artificial Sequence
  chemically synthesized
atatccaacagacaggcaacat

SEQ ID NO: 1238864 - DNA, 22 bp, Artificial Sequence
  chemically synthesized
tatccaacagacaggcaacatc

SEQ ID NO: 1238865 - DNA, 22 bp, Artificial Sequence
  chemically synthesized
cacacagccgcatcagcattga

SEQ ID NO: 1238866 - DNA, 22 bp, Artificial Sequence
  chemically synthesized
ccacacagccgcatcagcattg

SEQ ID NO: 1238867 - DNA, 22 bp, Artificial Sequence
  chemically synthesized
tccacacagccgcatcagcatt

SEQ ID NO: 1238868 - DNA, 22 bp, Artificial Sequence
  chemically synthesized
ttccacacagccgcatcagcat

SEQ ID NO: 1238869 - DNA, 22 bp, Artificial Sequence
  chemically synthesized
ccttttccacacagccgcatca

SEQ ID NO: 1238870 - DNA, 22 bp, Artificial Sequence
  chemically synthesized
atgcggctgtgtggaaaaggga

SEQ ID NO: 1238871 - DNA, 22 bp, Artificial Sequence
  chemically synthesized
tgtggaaaagggaaccttggta

SEQ ID NO: 1238872 - DNA, 22 bp, Artificial Sequence
  chemically synthesized
catccccaacaacgatgtacca

SEQ ID NO: 1238873 - DNA, 22 bp, Artificial Sequence
  chemically synthesized
acatccccaacaacgatgtacc

SEQ ID NO: 1238874 - DNA, 22 bp, Artificial Sequence
  chemically synthesized
tacatccccaacaacgatgtac

SEQ ID NO: 1238875 - DNA, 22 bp, Artificial Sequence
  chemically synthesized
ctttacatccccaacaacgatg

SEQ ID NO: 1238876 - DNA, 22 bp, Artificial Sequence
  chemically synthesized
ctactttacatccccaacaacg

SEQ ID NO: 1238877 - DNA, 22 bp, Artificial Sequence
  chemically synthesized
tactactttacatccccaacaa

SEQ ID NO: 1238878 - DNA, 22 bp, Artificial Sequence
  chemically synthesized
ggtacatcgttgttggggatgt

SEQ ID NO: 1238879 - DNA, 22 bp, Artificial Sequence
  chemically synthesized
gtacatcgttgttggggatgta

SEQ ID NO: 1238880 - DNA, 22 bp, Artificial Sequence
  chemically synthesized
acagtggttctactactttaca

SEQ ID NO: 1238881 - DNA, 22 bp, Artificial Sequence
  chemically synthesized
cacagtggttctactactttac

SEQ ID NO: 1238882 - DNA, 22 bp, Artificial Sequence
  chemically synthesized
ttcacagtggttctactacttt

SEQ ID NO: 1238883 - DNA, 22 bp, Artificial Sequence
  chemically synthesized
ttggggatgtaaagtagtagaa

SEQ ID NO: 1238884 - DNA, 22 bp, Artificial Sequence
  chemically synthesized
gggatgtaaagtagtagaacca

SEQ ID NO: 1238885 - DNA, 22 bp, Artificial Sequence
  chemically synthesized
aaacagttcttcacagtggttc

SEQ ID NO: 1238886 - DNA, 22 bp, Artificial Sequence
  chemically synthesized
aagaacctcaaacagttcttca

SEQ ID NO: 1238887 - DNA, 22 bp, Artificial Sequence
  chemically synthesized
gaagaacctcaaacagttcttc

SEQ ID NO: 1238888 - DNA, 22 bp, Artificial Sequence
  chemically synthesized
tgaagaacctcaaacagttctt

SEQ ID NO: 1238889 - DNA, 22 bp, Artificial Sequence
  chemically synthesized
ttgaagaacctcaaacagttct

SEQ ID NO: 1238890 - DNA, 22 bp, Artificial Sequence
  chemically synthesized
tttgaagaacctcaaacagttc

SEQ ID NO: 1238891 - DNA, 22 bp, Artificial Sequence
  chemically synthesized
ttttgaagaacctcaaacagtt

SEQ ID NO: 1238892 - DNA, 22 bp, Artificial Sequence
  chemically synthesized
agtttttttgaagaacctcaaa

SEQ ID NO: 1238893 - DNA, 22 bp, Artificial Sequence
  chemically synthesized
cagtttttttgaagaacctcaa

SEQ ID NO: 1238894 - DNA, 22 bp, Artificial Sequence
  chemically synthesized
tgaagaactgtttgaggttctt

SEQ ID NO: 1238895 - DNA, 22 bp, Artificial Sequence
  chemically synthesized
tcagtttttttgaagaacctca

SEQ ID NO: 1238896 - DNA, 22 bp, Artificial Sequence
  chemically synthesized
ttttcagtttttttgaagaacc

SEQ ID NO: 1238897 - DNA, 22 bp, Artificial Sequence
  chemically synthesized
tgttttcagtttttttgaagaa

SEQ ID NO: 1238898 - DNA, 22 bp, Artificial Sequence
  chemically synthesized
tttgaggttcttcaaaaaaact

SEQ ID NO: 1238899 - DNA, 22 bp, Artificial Sequence
  chemically synthesized
gaggttcttcaaaaaaactgaa

SEQ ID NO: 1238900 - DNA, 22 bp, Artificial Sequence
  chemically synthesized
aggttcttcaaaaaaactgaaa

SEQ ID NO: 1238901 - DNA, 22 bp, Artificial Sequence
  chemically synthesized
tatggtagttctgttttcagtt

SEQ ID NO: 1238902 - DNA, 22 bp, Artificial Sequence
  chemically synthesized
ttcaaaaaaactgaaaacagaa

SEQ ID NO: 1238903 - DNA, 22 bp, Artificial Sequence
  chemically synthesized
gattatatggtagttctgtttt

SEQ ID NO: 1238904 - DNA, 22 bp, Artificial Sequence
  chemically synthesized
caaaaaaactgaaaacagaact

SEQ ID NO: 1238905 - DNA, 22 bp, Artificial Sequence
  chemically synthesized
aaaaaaactgaaaacagaacta

SEQ ID NO: 1238906 - DNA, 22 bp, Artificial Sequence
  chemically synthesized
ctggattatatggtagttctgt

SEQ ID NO: 1238907 - DNA, 22 bp, Artificial Sequence
  chemically synthesized
aaaacagaactaccatataatc

SEQ ID NO: 1238908 - DNA, 22 bp, Artificial Sequence
  chemically synthesized
ccatataatccagcaatcctac

SEQ ID NO: 1238909 - DNA, 22 bp, Artificial Sequence
  chemically synthesized
ggtatatacccggcagtaggat

SEQ ID NO: 1238910 - DNA, 22 bp, Artificial Sequence
  chemically synthesized
gggtatatacccggcagtagga

SEQ ID NO: 1238911 - DNA, 22 bp, Artificial Sequence
  chemically synthesized
tgggtatatacccggcagtagg

SEQ ID NO: 1238912 - DNA, 22 bp, Artificial Sequence
  chemically synthesized
ttgggtatatacccggcagtag

SEQ ID NO: 1238913 - DNA, 22 bp, Artificial Sequence
  chemically synthesized
ttttgggtatatacccggcagt

SEQ ID NO: 1238914 - DNA, 22 bp, Artificial Sequence
  chemically synthesized
cttttgggtatatacccggcag

SEQ ID NO: 1238915 - DNA, 22 bp, Artificial Sequence
  chemically synthesized
tcttttgggtatatacccggca

SEQ ID NO: 1238916 - DNA, 22 bp, Artificial Sequence
  chemically synthesized
ctttcttttgggtatatacccg

SEQ ID NO: 1238917 - DNA, 22 bp, Artificial Sequence
  chemically synthesized
cctttcttttgggtatataccc

SEQ ID NO: 1238918 - DNA, 22 bp, Artificial Sequence
  chemically synthesized
atttcctttcttttgggtatat

SEQ ID NO: 1238919 - DNA, 22 bp, Artificial Sequence
  chemically synthesized
ctgccgggtatatacccaaaag

SEQ ID NO: 1238920 - DNA, 22 bp, Artificial Sequence
  chemically synthesized
ccgggtatatacccaaaagaaa

SEQ ID NO: 1238921 - DNA, 22 bp, Artificial Sequence
  chemically synthesized
acaaactgatttcctttctttt

SEQ ID NO: 1238922 - DNA, 22 bp, Artificial Sequence
  chemically synthesized
gacaaactgatttcctttcttt

SEQ ID NO: 1238923 - DNA, 22 bp, Artificial Sequence
  chemically synthesized
tgacaaactgatttcctttctt

SEQ ID NO: 1238924 - DNA, 22 bp, Artificial Sequence
  chemically synthesized
tttgacaaactgatttcctttc

SEQ ID NO: 1238925 - DNA, 22 bp, Artificial Sequence
  chemically synthesized
ctttgacaaactgatttccttt

SEQ ID NO: 1238926 - DNA, 22 bp, Artificial Sequence
  chemically synthesized
caataaacatgagggtgcagat

SEQ ID NO: 1238927 - DNA, 22 bp, Artificial Sequence
  chemically synthesized
gtcaaagaaatatctgcaccct

SEQ ID NO: 1238928 - DNA, 22 bp, Artificial Sequence
  chemically synthesized
tcaaagaaatatctgcaccctc

SEQ ID NO: 1238929 - DNA, 22 bp, Artificial Sequence
  chemically synthesized
tgaatagggttgcaataaacat

SEQ ID NO: 1238930 - DNA, 22 bp, Artificial Sequence
  chemically synthesized
ttgtgaatagggttgcaataaa

SEQ ID NO: 1238931 - DNA, 22 bp, Artificial Sequence
  chemically synthesized
caccctcatgtttattgcaacc

SEQ ID NO: 1238932 - DNA, 22 bp, Artificial Sequence
  chemically synthesized
gctattgtgaatagggttgcaa

SEQ ID NO: 1238933 - DNA, 22 bp, Artificial Sequence
  chemically synthesized
ggctattgtgaatagggttgca

SEQ ID NO: 1238934 - DNA, 22 bp, Artificial Sequence
  chemically synthesized
atgtttattgcaaccctattca

SEQ ID NO: 1238935 - DNA, 22 bp, Artificial Sequence
  chemically synthesized
caaatcttggctattgtgaata

SEQ ID NO: 1238936 - DNA, 22 bp, Artificial Sequence
  chemically synthesized
ccaaatcttggctattgtgaat

SEQ ID NO: 1238937 - DNA, 22 bp, Artificial Sequence
  chemically synthesized
attgcaaccctattcacaatag

SEQ ID NO: 1238938 - DNA, 22 bp, Artificial Sequence
  chemically synthesized
ttgcaaccctattcacaatagc

SEQ ID NO: 1238939 - DNA, 22 bp, Artificial Sequence
  chemically synthesized
cttccaaatcttggctattgtg

SEQ ID NO: 1238940 - DNA, 22 bp, Artificial Sequence
  chemically synthesized
caaccctattcacaatagccaa

SEQ ID NO: 1238941 - DNA, 22 bp, Artificial Sequence
  chemically synthesized
gattgcttccaaatcttggcta

SEQ ID NO: 1238942 - DNA, 22 bp, Artificial Sequence
  chemically synthesized
ggattgcttccaaatcttggct

SEQ ID NO: 1238943 - DNA, 22 bp, Artificial Sequence
  chemically synthesized
ttcacaatagccaagatttgga

SEQ ID NO: 1238944 - DNA, 22 bp, Artificial Sequence
  chemically synthesized
acaatagccaagatttggaagc

SEQ ID NO: 1238945 - DNA, 22 bp, Artificial Sequence
  chemically synthesized
atggatacttggattgcttcca

SEQ ID NO: 1238946 - DNA, 22 bp, Artificial Sequence
  chemically synthesized
ttaatggatacttggattgctt

SEQ ID NO: 1238947 - DNA, 22 bp, Artificial Sequence
  chemically synthesized
gttaatggatacttggattgct

SEQ ID NO: 1238948 - DNA, 22 bp, Artificial Sequence
  chemically synthesized
atttgttaatggatacttggat

SEQ ID NO: 1238949 - DNA, 22 bp, Artificial Sequence
  chemically synthesized
ggaagcaatccaagtatccatt

SEQ ID NO: 1238950 - DNA, 22 bp, Artificial Sequence
  chemically synthesized
gaagcaatccaagtatccatta

SEQ ID NO: 1238951 - DNA, 22 bp, Artificial Sequence
  chemically synthesized
tccattcatttgttaatggata

SEQ ID NO: 1238952 - DNA, 22 bp, Artificial Sequence
  chemically synthesized
atccattcatttgttaatggat

SEQ ID NO: 1238953 - DNA, 22 bp, Artificial Sequence
  chemically synthesized
tatccattcatttgttaatgga

SEQ ID NO: 1238954 - DNA, 22 bp, Artificial Sequence
  chemically synthesized
tttatccattcatttgttaatg

SEQ ID NO: 1238955 - DNA, 22 bp, Artificial Sequence
  chemically synthesized
ctttatccattcatttgttaat

SEQ ID NO: 1238956 - DNA, 22 bp, Artificial Sequence
  chemically synthesized
tctttatccattcatttgttaa

SEQ ID NO: 1238957 - DNA, 22 bp, Artificial Sequence
  chemically synthesized
acaaatgaatggataaagaaaa

SEQ ID NO: 1238958 - DNA, 22 bp, Artificial Sequence
  chemically synthesized
cgtatatatgtaccacattttc

SEQ ID NO: 1238959 - DNA, 22 bp, Artificial Sequence
  chemically synthesized
cactacgtatatatgtaccaca

SEQ ID NO: 1238960 - DNA, 22 bp, Artificial Sequence
  chemically synthesized
agtagtactccactacgtatat

SEQ ID NO: 1238961 - DNA, 22 bp, Artificial Sequence
  chemically synthesized
tgactgagtagtactccactac

SEQ ID NO: 1238962 - DNA, 22 bp, Artificial Sequence
  chemically synthesized
atgactgagtagtactccacta

SEQ ID NO: 1238963 - DNA, 22 bp, Artificial Sequence
  chemically synthesized
tatgactgagtagtactccact

SEQ ID NO: 1238964 - DNA, 22 bp, Artificial Sequence
  chemically synthesized
ttatgactgagtagtactccac

SEQ ID NO: 1238965 - DNA, 22 bp, Artificial Sequence
  chemically synthesized
tttatgactgagtagtactcca

SEQ ID NO: 1238966 - DNA, 22 bp, Artificial Sequence
  chemically synthesized
ttttatgactgagtagtactcc

SEQ ID NO: 1238967 - DNA, 22 bp, Artificial Sequence
  chemically synthesized
tttttatgactgagtagtactc

SEQ ID NO: 1238968 - DNA, 22 bp, Artificial Sequence
  chemically synthesized
ttttttatgactgagtagtact

SEQ ID NO: 1238969 - DNA, 22 bp, Artificial Sequence
  chemically synthesized
atttttttttatgactgagtag

SEQ ID NO: 1238970 - DNA, 22 bp, Artificial Sequence
  chemically synthesized
ctcagtcataaaaaaaaatgag

SEQ ID NO: 1238971 - DNA, 22 bp, Artificial Sequence
  chemically synthesized
caaatgacagcgtctcattttt

SEQ ID NO: 1238972 - DNA, 22 bp, Artificial Sequence
  chemically synthesized
agtcataaaaaaaaatgagacg

SEQ ID NO: 1238973 - DNA, 22 bp, Artificial Sequence
  chemically synthesized
ttgcaaatgacagcgtctcatt

SEQ ID NO: 1238974 - DNA, 22 bp, Artificial Sequence
  chemically synthesized
catccacgttgttgcaaatgac

SEQ ID NO: 1238975 - DNA, 22 bp, Artificial Sequence
  chemically synthesized
cagttccatccacgttgttgca

SEQ ID NO: 1238976 - DNA, 22 bp, Artificial Sequence
  chemically synthesized
tcatttgcaacaacgtggatgg

SEQ ID NO: 1238977 - DNA, 22 bp, Artificial Sequence
  chemically synthesized
gcaacaacgtggatggaactgg

SEQ ID NO: 1238978 - DNA, 22 bp, Artificial Sequence
  chemically synthesized
atacaatgtattccagttccat

SEQ ID NO: 1238979 - DNA, 22 bp, Artificial Sequence
  chemically synthesized
caacaacgtggatggaactgga

SEQ ID NO: 1238980 - DNA, 22 bp, Artificial Sequence
  chemically synthesized
aatacaatgtattccagttcca

SEQ ID NO: 1238981 - DNA, 22 bp, Artificial Sequence
  chemically synthesized
acttaatacaatgtattccagt

SEQ ID NO: 1238982 - DNA, 22 bp, Artificial Sequence
  chemically synthesized
cacttaatacaatgtattccag

SEQ ID NO: 1238983 - DNA, 22 bp, Artificial Sequence
  chemically synthesized
tttcacttaatacaatgtattc

SEQ ID NO: 1238984 - DNA, 22 bp, Artificial Sequence
  chemically synthesized
atttcacttaatacaatgtatt

SEQ ID NO: 1238985 - DNA, 22 bp, Artificial Sequence
  chemically synthesized
gcttatttcacttaatacaatg

SEQ ID NO: 1238986 - DNA, 22 bp, Artificial Sequence
  chemically synthesized
tgcctggcttatttcacttaat

SEQ ID NO: 1238987 - DNA, 22 bp, Artificial Sequence
  chemically synthesized
gaatacattgtattaagtgaaa

SEQ ID NO: 1238988 - DNA, 22 bp, Artificial Sequence
  chemically synthesized
gtgcctggcttatttcacttaa

SEQ ID NO: 1238989 - DNA, 22 bp, Artificial Sequence
  chemically synthesized
tgtgcctggcttatttcactta

SEQ ID NO: 1238990 - DNA, 22 bp, Artificial Sequence
  chemically synthesized
ttgtgcctggcttatttcactt

SEQ ID NO: 1238991 - DNA, 22 bp, Artificial Sequence
  chemically synthesized
tttttgtgcctggcttatttca

SEQ ID NO: 1238992 - DNA, 22 bp, Artificial Sequence
  chemically synthesized
gtttttgtgcctggcttatttc

SEQ ID NO: 1238993 - DNA, 22 bp, Artificial Sequence
  chemically synthesized
tattaagtgaaataagccaggc

SEQ ID NO: 1238994 - DNA, 22 bp, Artificial Sequence
  chemically synthesized
agtgaaataagccaggcacaaa

SEQ ID NO: 1238995 - DNA, 22 bp, Artificial Sequence
  chemically synthesized
catatgagtgagcccatgcaaa

SEQ ID NO: 1238996 - DNA, 22 bp, Artificial Sequence
  chemically synthesized
ctgcatatgagtgagcccatgc

SEQ ID NO: 1238997 - DNA, 22 bp, Artificial Sequence
  chemically synthesized
gttactgcatatgagtgagccc

SEQ ID NO: 1238998 - DNA, 22 bp, Artificial Sequence
  chemically synthesized
agttactgcatatgagtgagcc

SEQ ID NO: 1238999 - DNA, 22 bp, Artificial Sequence
  chemically synthesized
tagttactgcatatgagtgagc

SEQ ID NO: 1239000 - DNA, 22 bp, Artificial Sequence
  chemically synthesized
ttagttactgcatatgagtgag

SEQ ID NO: 1239001 - DNA, 22 bp, Artificial Sequence
  chemically synthesized
tgcatgggctcactcatatgca

SEQ ID NO: 1239002 - DNA, 22 bp, Artificial Sequence
  chemically synthesized
atttttagttactgcatatgag

SEQ ID NO: 1239003 - DNA, 22 bp, Artificial Sequence
  chemically synthesized
gcatgggctcactcatatgcag

SEQ ID NO: 1239004 - DNA, 22 bp, Artificial Sequence
  chemically synthesized
aatttttagttactgcatatga

SEQ ID NO: 1239005 - DNA, 22 bp, Artificial Sequence
  chemically synthesized
catgggctcactcatatgcagt

SEQ ID NO: 1239006 - DNA, 22 bp, Artificial Sequence
  chemically synthesized
taatttttagttactgcatatg

SEQ ID NO: 1239007 - DNA, 22 bp, Artificial Sequence
  chemically synthesized
ctttaatttttagttactgcat

SEQ ID NO: 1239008 - DNA, 22 bp, Artificial Sequence
  chemically synthesized
aattgctttaatttttagttac

SEQ ID NO: 1239009 - DNA, 22 bp, Artificial Sequence
  chemically synthesized
actcatatgcagtaactaaaaa

SEQ ID NO: 1239010 - DNA, 22 bp, Artificial Sequence
  chemically synthesized
atatgcagtaactaaaaattaa

SEQ ID NO: 1239011 - DNA, 22 bp, Artificial Sequence
  chemically synthesized
catgagttcaattgctttaatt

SEQ ID NO: 1239012 - DNA, 22 bp, Artificial Sequence
  chemically synthesized
tctccatgagttcaattgcttt

SEQ ID NO: 1239013 - DNA, 22 bp, Artificial Sequence
  chemically synthesized
tgtctccatgagttcaattgct

SEQ ID NO: 1239014 - DNA, 22 bp, Artificial Sequence
  chemically synthesized
tctgtctccatgagttcaattg

SEQ ID NO: 1239015 - DNA, 22 bp, Artificial Sequence
  chemically synthesized
aaaattaaagcaattgaactca

SEQ ID NO: 1239016 - DNA, 22 bp, Artificial Sequence
  chemically synthesized
ctctctgtctccatgagttcaa

SEQ ID NO: 1239017 - DNA, 22 bp, Artificial Sequence
  chemically synthesized
tactctctgtctccatgagttc

SEQ ID NO: 1239018 - DNA, 22 bp, Artificial Sequence
  chemically synthesized
aagcaattgaactcatggagac

SEQ ID NO: 1239019 - DNA, 22 bp, Artificial Sequence
  chemically synthesized
aactcatggagacagagagtag

SEQ ID NO: 1239020 - DNA, 22 bp, Artificial Sequence
  chemically synthesized
gtaaacatcattctactctctg

SEQ ID NO: 1239021 - DNA, 22 bp, Artificial Sequence
  chemically synthesized
tggtaaacatcattctactctc

SEQ ID NO: 1239022 - DNA, 22 bp, Artificial Sequence
  chemically synthesized
atggagacagagagtagaatga

SEQ ID NO: 1239023 - DNA, 22 bp, Artificial Sequence
  chemically synthesized
cactctggtaaacatcattcta

SEQ ID NO: 1239024 - DNA, 22 bp, Artificial Sequence
  chemically synthesized
cccatactacactctggtaaac

SEQ ID NO: 1239025 - DNA, 22 bp, Artificial Sequence
  chemically synthesized
tccccaactacccatactacac

SEQ ID NO: 1239026 - DNA, 22 bp, Artificial Sequence
  chemically synthesized
ctgtccccaactacccatacta

SEQ ID NO: 1239027 - DNA, 22 bp, Artificial Sequence
  chemically synthesized
accagagtgtagtatgggtagt

SEQ ID NO: 1239028 - DNA, 22 bp, Artificial Sequence
  chemically synthesized
ctcctgtccccaactacccata

SEQ ID NO: 1239029 - DNA, 22 bp, Artificial Sequence
  chemically synthesized
ccagagtgtagtatgggtagtt

SEQ ID NO: 1239030 - DNA, 22 bp, Artificial Sequence
  chemically synthesized
ccactcctcctgtccccaacta

SEQ ID NO: 1239031 - DNA, 22 bp, Artificial Sequence
  chemically synthesized
aacattcccactcctcctgtcc

SEQ ID NO: 1239032 - DNA, 22 bp, Artificial Sequence
  chemically synthesized
tacccactaaacattcccactc

SEQ ID NO: 1239033 - DNA, 22 bp, Artificial Sequence
  chemically synthesized
gtacccactaaacattcccact

SEQ ID NO: 1239034 - DNA, 22 bp, Artificial Sequence
  chemically synthesized
gggacaggaggagtgggaatgt

SEQ ID NO: 1239035 - DNA, 22 bp, Artificial Sequence
  chemically synthesized
tgtacccactaaacattcccac

SEQ ID NO: 1239036 - DNA, 22 bp, Artificial Sequence
  chemically synthesized
ttgtacccactaaacattccca

SEQ ID NO: 1239037 - DNA, 22 bp, Artificial Sequence
  chemically synthesized
gatttttgtacccactaaacat

SEQ ID NO: 1239038 - DNA, 22 bp, Artificial Sequence
  chemically synthesized
actagatttttgtacccactaa

SEQ ID NO: 1239039 - DNA, 22 bp, Artificial Sequence
  chemically synthesized
taactagatttttgtacccact

SEQ ID NO: 1239040 - DNA, 22 bp, Artificial Sequence
  chemically synthesized
attctaactagatttttgtacc

SEQ ID NO: 1239041 - DNA, 22 bp, Artificial Sequence
  chemically synthesized
ctcattctaactagatttttgt

SEQ ID NO: 1239042 - DNA, 22 bp, Artificial Sequence
  chemically synthesized
actcattctaactagatttttg

SEQ ID NO: 1239043 - DNA, 22 bp, Artificial Sequence
  chemically synthesized
agtgggtacaaaaatctagtta

SEQ ID NO: 1239044 - DNA, 22 bp, Artificial Sequence
  chemically synthesized
gtgggtacaaaaatctagttag

SEQ ID NO: 1239045 - DNA, 22 bp, Artificial Sequence
  chemically synthesized
ccaaatagatcttactcattct

SEQ ID NO: 1239046 - DNA, 22 bp, Artificial Sequence
  chemically synthesized
tgttgccaaatagatcttactc

SEQ ID NO: 1239047 - DNA, 22 bp, Artificial Sequence
  chemically synthesized
gtgttgccaaatagatcttact

SEQ ID NO: 1239048 - DNA, 22 bp, Artificial Sequence
  chemically synthesized
ttgtgttgccaaatagatctta

SEQ ID NO: 1239049 - DNA, 22 bp, Artificial Sequence
  chemically synthesized
gttagaatgagtaagatctatt

SEQ ID NO: 1239050 - DNA, 22 bp, Artificial Sequence
  chemically synthesized
gaatgagtaagatctatttggc

SEQ ID NO: 1239051 - DNA, 22 bp, Artificial Sequence
  chemically synthesized
taatcaccctcttgtgttgcca

SEQ ID NO: 1239052 - DNA, 22 bp, Artificial Sequence
  chemically synthesized
actgtaatcaccctcttgtgtt

SEQ ID NO: 1239053 - DNA, 22 bp, Artificial Sequence
  chemically synthesized
ttgactgtaatcaccctcttgt

SEQ ID NO: 1239054 - DNA, 22 bp, Artificial Sequence
  chemically synthesized
tttggcaacacaagagggtgat

SEQ ID NO: 1239055 - DNA, 22 bp, Artificial Sequence
  chemically synthesized
ggcaacacaagagggtgattac

SEQ ID NO: 1239056 - DNA, 22 bp, Artificial Sequence
  chemically synthesized
gcaacacaagagggtgattaca

SEQ ID NO: 1239057 - DNA, 22 bp, Artificial Sequence
  chemically synthesized
aatgtacagtaaattgttgact

SEQ ID NO: 1239058 - DNA, 22 bp, Artificial Sequence
  chemically synthesized
aaatgtacagtaaattgttgac

SEQ ID NO: 1239059 - DNA, 22 bp, Artificial Sequence
  chemically synthesized
ttaaatgtacagtaaattgttg

SEQ ID NO: 1239060 - DNA, 22 bp, Artificial Sequence
  chemically synthesized
cagtcaacaatttactgtacat

SEQ ID NO: 1239061 - DNA, 22 bp, Artificial Sequence
  chemically synthesized
gcccaaattcttaaatgtacag

SEQ ID NO: 1239062 - DNA, 22 bp, Artificial Sequence
  chemically synthesized
actgtacatttaagaatttggg

SEQ ID NO: 1239063 - DNA, 22 bp, Artificial Sequence
  chemically synthesized
ctgtacatttaagaatttgggc

SEQ ID NO: 1239064 - DNA, 22 bp, Artificial Sequence
  chemically synthesized
tacatttaagaatttgggccag

SEQ ID NO: 1239065 - DNA, 22 bp, Artificial Sequence
  chemically synthesized
aagaatttgggccaggcacggt

SEQ ID NO: 1239066 - DNA, 22 bp, Artificial Sequence
  chemically synthesized
caggcgtgagccaccgtgcctg

SEQ ID NO: 1239067 - DNA, 22 bp, Artificial Sequence
  chemically synthesized
agaatttgggccaggcacggtg

SEQ ID NO: 1239068 - DNA, 22 bp, Artificial Sequence
  chemically synthesized
ggattacaggcgtgagccaccg

SEQ ID NO: 1239069 - DNA, 22 bp, Artificial Sequence
  chemically synthesized
gggccaggcacggtggctcacg

SEQ ID NO: 1239070 - DNA, 22 bp, Artificial Sequence
  chemically synthesized
ggccaggcacggtggctcacgc

SEQ ID NO: 1239071 - DNA, 22 bp, Artificial Sequence
  chemically synthesized
ccaaagtgttgggattacaggc

SEQ ID NO: 1239072 - DNA, 22 bp, Artificial Sequence
  chemically synthesized
ggcctcccaaagtgttgggatt

SEQ ID NO: 1239073 - DNA, 22 bp, Artificial Sequence
  chemically synthesized
acgcctgtaatcccaacacttt

SEQ ID NO: 1239074 - DNA, 22 bp, Artificial Sequence
  chemically synthesized
cctcggcctcccaaagtgttgg

SEQ ID NO: 1239075 - DNA, 22 bp, Artificial Sequence
  chemically synthesized
taatcccaacactttgggaggc

SEQ ID NO: 1239076 - DNA, 22 bp, Artificial Sequence
  chemically synthesized
atgatccgcctgcctcggcctc

SEQ ID NO: 1239077 - DNA, 22 bp, Artificial Sequence
  chemically synthesized
acctcatgatccgcctgcctcg

SEQ ID NO: 1239078 - DNA, 22 bp, Artificial Sequence
  chemically synthesized
ctgacctcatgatccgcctgcc

SEQ ID NO: 1239079 - DNA, 22 bp, Artificial Sequence
  chemically synthesized
tgggaggccgaggcaggcggat

SEQ ID NO: 1239080 - DNA, 22 bp, Artificial Sequence
  chemically synthesized
gggaggccgaggcaggcggatc

SEQ ID NO: 1239081 - DNA, 22 bp, Artificial Sequence
  chemically synthesized
ggaggccgaggcaggcggatca

SEQ ID NO: 1239082 - DNA, 22 bp, Artificial Sequence
  chemically synthesized
gatctcctgacctcatgatccg

SEQ ID NO: 1239083 - DNA, 22 bp, Artificial Sequence
  chemically synthesized
gccaggatggtctcgatctcct

SEQ ID NO: 1239084 - DNA, 22 bp, Artificial Sequence
  chemically synthesized
tgttagccaggatggtctcgat

SEQ ID NO: 1239085 - DNA, 22 bp, Artificial Sequence
  chemically synthesized
actgtgttagccaggatggtct

SEQ ID NO: 1239086 - DNA, 22 bp, Artificial Sequence
  chemically synthesized
cactgtgttagccaggatggtc

SEQ ID NO: 1239087 - DNA, 22 bp, Artificial Sequence
  chemically synthesized
gtagagacggggtttcactgtg

SEQ ID NO: 1239088 - DNA, 22 bp, Artificial Sequence
  chemically synthesized
agtagagacggggtttcactgt

SEQ ID NO: 1239089 - DNA, 22 bp, Artificial Sequence
  chemically synthesized
tagtagagacggggtttcactg

SEQ ID NO: 1239090 - DNA, 22 bp, Artificial Sequence
  chemically synthesized
ttagtagagacggggtttcact

SEQ ID NO: 1239091 - DNA, 22 bp, Artificial Sequence
  chemically synthesized
gctaacacagtgaaaccccgtc

SEQ ID NO: 1239092 - DNA, 22 bp, Artificial Sequence
  chemically synthesized
tatttttagtagagacggggtt

SEQ ID NO: 1239093 - DNA, 22 bp, Artificial Sequence
  chemically synthesized
gtatttttagtagagacggggt

SEQ ID NO: 1239094 - DNA, 22 bp, Artificial Sequence
  chemically synthesized
tgtatttttagtagagacgggg

SEQ ID NO: 1239095 - DNA, 22 bp, Artificial Sequence
  chemically synthesized
acacagtgaaaccccgtctcta

SEQ ID NO: 1239096 - DNA, 22 bp, Artificial Sequence
  chemically synthesized
ttgtatttttagtagagacggg

SEQ ID NO: 1239097 - DNA, 22 bp, Artificial Sequence
  chemically synthesized
tttgtatttttagtagagacgg

SEQ ID NO: 1239098 - DNA, 22 bp, Artificial Sequence
  chemically synthesized
attttttgtatttttagtagag

SEQ ID NO: 1239099 - DNA, 22 bp, Artificial Sequence
  chemically synthesized
tactaaaaatacaaaaaattag

SEQ ID NO: 1239100 - DNA, 22 bp, Artificial Sequence
  chemically synthesized
ctaaaaatacaaaaaattaggt

SEQ ID NO: 1239101 - DNA, 22 bp, Artificial Sequence
  chemically synthesized
aaaatacaaaaaattaggtggg

SEQ ID NO: 1239102 - DNA, 22 bp, Artificial Sequence
  chemically synthesized
caggtgcccgccaccaagccca

SEQ ID NO: 1239103 - DNA, 22 bp, Artificial Sequence
  chemically synthesized
ggactgcaggtgcccgccacca

SEQ ID NO: 1239104 - DNA, 22 bp, Artificial Sequence
  chemically synthesized
ggtgggcttggtggcgggcacc

SEQ ID NO: 1239105 - DNA, 22 bp, Artificial Sequence
  chemically synthesized
ccaagtagctgggactgcaggt

SEQ ID NO: 1239106 - DNA, 22 bp, Artificial Sequence
  chemically synthesized
ggtggcgggcacctgcagtccc

SEQ ID NO: 1239107 - DNA, 22 bp, Artificial Sequence
  chemically synthesized
gtggcgggcacctgcagtccca

SEQ ID NO: 1239108 - DNA, 22 bp, Artificial Sequence
  chemically synthesized
agcctcccaagtagctgggact

SEQ ID NO: 1239109 - DNA, 22 bp, Artificial Sequence
  chemically synthesized
cctcagcctcccaagtagctgg

SEQ ID NO: 1239110 - DNA, 22 bp, Artificial Sequence
  chemically synthesized
ctgcctcagcctcccaagtagc

SEQ ID NO: 1239111 - DNA, 22 bp, Artificial Sequence
  chemically synthesized
tcctgcctcagcctcccaagta

SEQ ID NO: 1239112 - DNA, 22 bp, Artificial Sequence
  chemically synthesized
cagtcccagctacttgggaggc

SEQ ID NO: 1239113 - DNA, 22 bp, Artificial Sequence
  chemically synthesized
acgccgttctcctgcctcagcc

SEQ ID NO: 1239114 - DNA, 22 bp, Artificial Sequence
  chemically synthesized
cttgggaggctgaggcaggaga

SEQ ID NO: 1239115 - DNA, 22 bp, Artificial Sequence
  chemically synthesized
gggaggctgaggcaggagaacg

SEQ ID NO: 1239116 - DNA, 22 bp, Artificial Sequence
  chemically synthesized
ccgggttcacgccgttctcctg

SEQ ID NO: 1239117 - DNA, 22 bp, Artificial Sequence
  chemically synthesized
ggaggctgaggcaggagaacgg

SEQ ID NO: 1239118 - DNA, 22 bp, Artificial Sequence
  chemically synthesized
cgcctcccgggttcacgccgtt

SEQ ID NO: 1239119 - DNA, 22 bp, Artificial Sequence
  chemically synthesized
aggcaggagaacggcgtgaacc

SEQ ID NO: 1239120 - DNA, 22 bp, Artificial Sequence
  chemically synthesized
caagctccgcctcccgggttca

SEQ ID NO: 1239121 - DNA, 22 bp, Artificial Sequence
  chemically synthesized
attgcaagctccgcctcccggg

SEQ ID NO: 1239122 - DNA, 22 bp, Artificial Sequence
  chemically synthesized
ggctcattgcaagctccgcctc

SEQ ID NO: 1239123 - DNA, 22 bp, Artificial Sequence
  chemically synthesized
tctgggctcattgcaagctccg

SEQ ID NO: 1239124 - DNA, 22 bp, Artificial Sequence
  chemically synthesized
gcaatgagcccagatagcatca

SEQ ID NO: 1239125 - DNA, 22 bp, Artificial Sequence
  chemically synthesized
caatgagcccagatagcatcac

SEQ ID NO: 1239126 - DNA, 22 bp, Artificial Sequence
  chemically synthesized
tcacccagggtggagtgcagtg

SEQ ID NO: 1239127 - DNA, 22 bp, Artificial Sequence
  chemically synthesized
tgtcacccagggtggagtgcag

SEQ ID NO: 1239128 - DNA, 22 bp, Artificial Sequence
  chemically synthesized
ctctgtcacccagggtggagtg

SEQ ID NO: 1239129 - DNA, 22 bp, Artificial Sequence
  chemically synthesized
gctctgtcacccagggtggagt

SEQ ID NO: 1239130 - DNA, 22 bp, Artificial Sequence
  chemically synthesized
cactccaccctgggtgacagag

SEQ ID NO: 1239131 - DNA, 22 bp, Artificial Sequence
  chemically synthesized
agacgcagtcttgctctgtcac

SEQ ID NO: 1239132 - DNA, 22 bp, Artificial Sequence
  chemically synthesized
gagacgcagtcttgctctgtca

SEQ ID NO: 1239133 - DNA, 22 bp, Artificial Sequence
  chemically synthesized
tgagacgcagtcttgctctgtc

SEQ ID NO: 1239134 - DNA, 22 bp, Artificial Sequence
  chemically synthesized
ttgagacgcagtcttgctctgt

SEQ ID NO: 1239135 - DNA, 22 bp, Artificial Sequence
  chemically synthesized
caccctgggtgacagagcaaga

SEQ ID NO: 1239136 - DNA, 22 bp, Artificial Sequence
  chemically synthesized
tttgagacgcagtcttgctctg

SEQ ID NO: 1239137 - DNA, 22 bp, Artificial Sequence
  chemically synthesized
ttttgagacgcagtcttgctct

SEQ ID NO: 1239138 - DNA, 22 bp, Artificial Sequence
  chemically synthesized
tttttgagacgcagtcttgctc

SEQ ID NO: 1239139 - DNA, 22 bp, Artificial Sequence
  chemically synthesized
ttttttgagacgcagtcttgct

SEQ ID NO: 1239140 - DNA, 22 bp, Artificial Sequence
  chemically synthesized
tttttttgagacgcagtcttgc

SEQ ID NO: 1239141 - DNA, 22 bp, Artificial Sequence
  chemically synthesized
ttttttttgagacgcagtcttg

SEQ ID NO: 1239142 - DNA, 22 bp, Artificial Sequence
  chemically synthesized
tttttttttgagacgcagtctt

SEQ ID NO: 1239143 - DNA, 22 bp, Artificial Sequence
  chemically synthesized
ggtgacagagcaagactgcgtc

SEQ ID NO: 1239144 - DNA, 22 bp, Artificial Sequence
  chemically synthesized
ttttttttttgagacgcagtct

SEQ ID NO: 1239145 - DNA, 22 bp, Artificial Sequence
  chemically synthesized
tttttttttttgagacgcagtc

SEQ ID NO: 1239146 - DNA, 22 bp, Artificial Sequence
  chemically synthesized
ttttttttttttgagacgcagt

SEQ ID NO: 1239147 - DNA, 22 bp, Artificial Sequence
  chemically synthesized
aaatttttttttttttttgaga

SEQ ID NO: 1239148 - DNA, 22 bp, Artificial Sequence
  chemically synthesized
caaatttttttttttttttgag

SEQ ID NO: 1239149 - DNA, 22 bp, Artificial Sequence
  chemically synthesized
cacttcaaattttttttttttt

SEQ ID NO: 1239150 - DNA, 22 bp, Artificial Sequence
  chemically synthesized
cgtctcaaaaaaaaaaaaaaat

SEQ ID NO: 1239151 - DNA, 22 bp, Artificial Sequence
  chemically synthesized
aaaaaaaaaaaaaaatttgaag

SEQ ID NO: 1239152 - DNA, 22 bp, Artificial Sequence
  chemically synthesized
tgccacaaacattccacttcaa

SEQ ID NO: 1239153 - DNA, 22 bp, Artificial Sequence
  chemically synthesized
gtgccacaaacattccacttca

SEQ ID NO: 1239154 - DNA, 22 bp, Artificial Sequence
  chemically synthesized
tgtgccacaaacattccacttc

SEQ ID NO: 1239155 - DNA, 22 bp, Artificial Sequence
  chemically synthesized
tttgtgccacaaacattccact

SEQ ID NO: 1239156 - DNA, 22 bp, Artificial Sequence
  chemically synthesized
ctttgtgccacaaacattccac

SEQ ID NO: 1239157 - DNA, 22 bp, Artificial Sequence
  chemically synthesized
tctttgtgccacaaacattcca

SEQ ID NO: 1239158 - DNA, 22 bp, Artificial Sequence
  chemically synthesized
gaagtggaatgtttgtggcaca

SEQ ID NO: 1239159 - DNA, 22 bp, Artificial Sequence
  chemically synthesized
aagtggaatgtttgtggcacaa

SEQ ID NO: 1239160 - DNA, 22 bp, Artificial Sequence
  chemically synthesized
aagaatgtatcctttctttgtg

SEQ ID NO: 1239161 - DNA, 22 bp, Artificial Sequence
  chemically synthesized
tcacctcaagaatgtatccttt

SEQ ID NO: 1239162 - DNA, 22 bp, Artificial Sequence
  chemically synthesized
gtggcacaaagaaaggatacat

SEQ ID NO: 1239163 - DNA, 22 bp, Artificial Sequence
  chemically synthesized
tggcacaaagaaaggatacatt

SEQ ID NO: 1239164 - DNA, 22 bp, Artificial Sequence
  chemically synthesized
ttgaggtgacagatacttcact

SEQ ID NO: 1239165 - DNA, 22 bp, Artificial Sequence
  chemically synthesized
gaggtgacagatacttcactta

SEQ ID NO: 1239166 - DNA, 22 bp, Artificial Sequence
  chemically synthesized
aggtgacagatacttcacttac

SEQ ID NO: 1239167 - DNA, 22 bp, Artificial Sequence
  chemically synthesized
cacttaccctgatatgattatg

SEQ ID NO: 1239168 - DNA, 22 bp, Artificial Sequence
  chemically synthesized
acttaccctgatatgattatgc

SEQ ID NO: 1239169 - DNA, 22 bp, Artificial Sequence
  chemically synthesized
atacaggcatgcgaagcataat

SEQ ID NO: 1239170 - DNA, 22 bp, Artificial Sequence
  chemically synthesized
accctgatatgattatgcttcg

SEQ ID NO: 1239171 - DNA, 22 bp, Artificial Sequence
  chemically synthesized
ccctgatatgattatgcttcgc

SEQ ID NO: 1239172 - DNA, 22 bp, Artificial Sequence
  chemically synthesized
atatgattatgcttcgcatgcc

SEQ ID NO: 1239173 - DNA, 22 bp, Artificial Sequence
  chemically synthesized
tgcttcgcatgcctgtatcaat

SEQ ID NO: 1239174 - DNA, 22 bp, Artificial Sequence
  chemically synthesized
gggggtaaatagatatattgat

SEQ ID NO: 1239175 - DNA, 22 bp, Artificial Sequence
  chemically synthesized
cgcatgcctgtatcaatatatc

SEQ ID NO: 1239176 - DNA, 22 bp, Artificial Sequence
  chemically synthesized
agggggtaaatagatatattga

SEQ ID NO: 1239177 - DNA, 22 bp, Artificial Sequence
  chemically synthesized
gcatgcctgtatcaatatatct

SEQ ID NO: 1239178 - DNA, 22 bp, Artificial Sequence
  chemically synthesized
tatcaatatatctatttacccc

SEQ ID NO: 1239179 - DNA, 22 bp, Artificial Sequence
  chemically synthesized
tggatacatagtatatttaggg

SEQ ID NO: 1239180 - DNA, 22 bp, Artificial Sequence
  chemically synthesized
atggatacatagtatatttagg

SEQ ID NO: 1239181 - DNA, 22 bp, Artificial Sequence
  chemically synthesized
tttaccccctaaatatactatg

SEQ ID NO: 1239182 - DNA, 22 bp, Artificial Sequence
  chemically synthesized
aatttatggatacatagtatat

SEQ ID NO: 1239183 - DNA, 22 bp, Artificial Sequence
  chemically synthesized
accccctaaatatactatgtat

SEQ ID NO: 1239184 - DNA, 22 bp, Artificial Sequence
  chemically synthesized
ccccctaaatatactatgtatc

SEQ ID NO: 1239185 - DNA, 22 bp, Artificial Sequence
  chemically synthesized
gattaaatttatggatacatag

SEQ ID NO: 1239186 - DNA, 22 bp, Artificial Sequence
  chemically synthesized
agattaaatttatggatacata

SEQ ID NO: 1239187 - DNA, 22 bp, Artificial Sequence
  chemically synthesized
tagattaaatttatggatacat

SEQ ID NO: 1239188 - DNA, 22 bp, Artificial Sequence
  chemically synthesized
ttttagattaaatttatggata

SEQ ID NO: 1239189 - DNA, 22 bp, Artificial Sequence
  chemically synthesized
aatatactatgtatccataaat

SEQ ID NO: 1239190 - DNA, 22 bp, Artificial Sequence
  chemically synthesized
gttttagattaaatttatggat

SEQ ID NO: 1239191 - DNA, 22 bp, Artificial Sequence
  chemically synthesized
tgttttagattaaatttatgga

SEQ ID NO: 1239192 - DNA, 22 bp, Artificial Sequence
  chemically synthesized
ctttgttttagattaaatttat

SEQ ID NO: 1239193 - DNA, 22 bp, Artificial Sequence
  chemically synthesized
tgtatccataaatttaatctaa

SEQ ID NO: 1239194 - DNA, 22 bp, Artificial Sequence
  chemically synthesized
tgtatagtaaagttgctttgtt

SEQ ID NO: 1239195 - DNA, 22 bp, Artificial Sequence
  chemically synthesized
aatctaaaacaaagcaacttta

SEQ ID NO: 1239196 - DNA, 22 bp, Artificial Sequence
  chemically synthesized
atctaaaacaaagcaactttac

SEQ ID NO: 1239197 - DNA, 22 bp, Artificial Sequence
  chemically synthesized
aaacaaagcaactttactatac

SEQ ID NO: 1239198 - DNA, 22 bp, Artificial Sequence
  chemically synthesized
tgtgtatattatgtatagtaaa

SEQ ID NO: 1239199 - DNA, 22 bp, Artificial Sequence
  chemically synthesized
atgtgtatattatgtatagtaa

SEQ ID NO: 1239200 - DNA, 22 bp, Artificial Sequence
  chemically synthesized
agatttatgtgtatattatgta

SEQ ID NO: 1239201 - DNA, 22 bp, Artificial Sequence
  chemically synthesized
aagatttatgtgtatattatgt

SEQ ID NO: 1239202 - DNA, 22 bp, Artificial Sequence
  chemically synthesized
taagatttatgtgtatattatg

SEQ ID NO: 1239203 - DNA, 22 bp, Artificial Sequence
  chemically synthesized
ttttaagatttatgtgtatatt

SEQ ID NO: 1239204 - DNA, 22 bp, Artificial Sequence
  chemically synthesized
tactatacataatatacacata

SEQ ID NO: 1239205 - DNA, 22 bp, Artificial Sequence
  chemically synthesized
actatacataatatacacataa

SEQ ID NO: 1239206 - DNA, 22 bp, Artificial Sequence
  chemically synthesized
ctatacataatatacacataaa

SEQ ID NO: 1239207 - DNA, 22 bp, Artificial Sequence
  chemically synthesized
tacataatatacacataaatct

SEQ ID NO: 1239208 - DNA, 22 bp, Artificial Sequence
  chemically synthesized
aaatggcactgttttaagattt

SEQ ID NO: 1239209 - DNA, 22 bp, Artificial Sequence
  chemically synthesized
attaaaatggcactgttttaag

SEQ ID NO: 1239210 - DNA, 22 bp, Artificial Sequence
  chemically synthesized
cattaaaatggcactgttttaa

SEQ ID NO: 1239211 - DNA, 22 bp, Artificial Sequence
  chemically synthesized
aagtttcattaaaatggcactg

SEQ ID NO: 1239212 - DNA, 22 bp, Artificial Sequence
  chemically synthesized
aaagtttcattaaaatggcact

SEQ ID NO: 1239213 - DNA, 22 bp, Artificial Sequence
  chemically synthesized
cttaaagtttcattaaaatggc

SEQ ID NO: 1239214 - DNA, 22 bp, Artificial Sequence
  chemically synthesized
ccttaaagtttcattaaaatgg

SEQ ID NO: 1239215 - DNA, 22 bp, Artificial Sequence
  chemically synthesized
tccttaaagtttcattaaaatg

SEQ ID NO: 1239216 - DNA, 22 bp, Artificial Sequence
  chemically synthesized
aaaacagtgccattttaatgaa

SEQ ID NO: 1239217 - DNA, 22 bp, Artificial Sequence
  chemically synthesized
aaacagtgccattttaatgaaa

SEQ ID NO: 1239218 - DNA, 22 bp, Artificial Sequence
  chemically synthesized
gagagctttccttaaagtttca

SEQ ID NO: 1239219 - DNA, 22 bp, Artificial Sequence
  chemically synthesized
ctagagagctttccttaaagtt

SEQ ID NO: 1239220 - DNA, 22 bp, Artificial Sequence
  chemically synthesized
ttactagagagctttccttaaa

SEQ ID NO: 1239221 - DNA, 22 bp, Artificial Sequence
  chemically synthesized
attactagagagctttccttaa

SEQ ID NO: 1239222 - DNA, 22 bp, Artificial Sequence
  chemically synthesized
taatgaaactttaaggaaagct

SEQ ID NO: 1239223 - DNA, 22 bp, Artificial Sequence
  chemically synthesized
ttattactagagagctttcctt

SEQ ID NO: 1239224 - DNA, 22 bp, Artificial Sequence
  chemically synthesized
aatgaaactttaaggaaagctc

SEQ ID NO: 1239225 - DNA, 22 bp, Artificial Sequence
  chemically synthesized
cttattactagagagctttcct

SEQ ID NO: 1239226 - DNA, 22 bp, Artificial Sequence
  chemically synthesized
atgaaactttaaggaaagctct

SEQ ID NO: 1239227 - DNA, 22 bp, Artificial Sequence
  chemically synthesized
tcttattactagagagctttcc

SEQ ID NO: 1239228 - DNA, 22 bp, Artificial Sequence
  chemically synthesized
ttttcttattactagagagctt

SEQ ID NO: 1239229 - DNA, 22 bp, Artificial Sequence
  chemically synthesized
attttcttattactagagagct

SEQ ID NO: 1239230 - DNA, 22 bp, Artificial Sequence
  chemically synthesized
taaggaaagctctctagtaata

SEQ ID NO: 1239231 - DNA, 22 bp, Artificial Sequence
  chemically synthesized
aaggaaagctctctagtaataa

SEQ ID NO: 1239232 - DNA, 22 bp, Artificial Sequence
  chemically synthesized
aggaaagctctctagtaataag

SEQ ID NO: 1239233 - DNA, 22 bp, Artificial Sequence
  chemically synthesized
gaaagtgtaaatttattttctt

SEQ ID NO: 1239234 - DNA, 22 bp, Artificial Sequence
  chemically synthesized
tctagtaataagaaaataaatt

SEQ ID NO: 1239235 - DNA, 22 bp, Artificial Sequence
  chemically synthesized
ttagaaagtgtaaatttatttt

SEQ ID NO: 1239236 - DNA, 22 bp, Artificial Sequence
  chemically synthesized
tagtaataagaaaataaattta

SEQ ID NO: 1239237 - DNA, 22 bp, Artificial Sequence
  chemically synthesized
gtaataagaaaataaatttaca

SEQ ID NO: 1239238 - DNA, 22 bp, Artificial Sequence
  chemically synthesized
gcagcactattagaaagtgtaa

SEQ ID NO: 1239239 - DNA, 22 bp, Artificial Sequence
  chemically synthesized
ggcagcactattagaaagtgta

SEQ ID NO: 1239240 - DNA, 22 bp, Artificial Sequence
  chemically synthesized
ttggcagcactattagaaagtg

SEQ ID NO: 1239241 - DNA, 22 bp, Artificial Sequence
  chemically synthesized
acactttctaatagtgctgcca

SEQ ID NO: 1239242 - DNA, 22 bp, Artificial Sequence
  chemically synthesized
cactttctaatagtgctgccaa

SEQ ID NO: 1239243 - DNA, 22 bp, Artificial Sequence
  chemically synthesized
gatatgaagttcttggcagcac

SEQ ID NO: 1239244 - DNA, 22 bp, Artificial Sequence
  chemically synthesized
tctaatagtgctgccaagaact

SEQ ID NO: 1239245 - DNA, 22 bp, Artificial Sequence
  chemically synthesized
ctaatagtgctgccaagaactt

SEQ ID NO: 1239246 - DNA, 22 bp, Artificial Sequence
  chemically synthesized
taatagtgctgccaagaacttc

SEQ ID NO: 1239247 - DNA, 22 bp, Artificial Sequence
  chemically synthesized
caggttagatatgaagttcttg

SEQ ID NO: 1239248 - DNA, 22 bp, Artificial Sequence
  chemically synthesized
atagtgctgccaagaacttcat

SEQ ID NO: 1239249 - DNA, 22 bp, Artificial Sequence
  chemically synthesized
ttccaggttagatatgaagttc

SEQ ID NO: 1239250 - DNA, 22 bp, Artificial Sequence
  chemically synthesized
ccaagaacttcatatctaacct

SEQ ID NO: 1239251 - DNA, 22 bp, Artificial Sequence
  chemically synthesized
aaaataccaaattattccaggt

SEQ ID NO: 1239252 - DNA, 22 bp, Artificial Sequence
  chemically synthesized
catatctaacctggaataattt

SEQ ID NO: 1239253 - DNA, 22 bp, Artificial Sequence
  chemically synthesized
atatctaacctggaataatttg

SEQ ID NO: 1239254 - DNA, 22 bp, Artificial Sequence
  chemically synthesized
cactcaaaataccaaattattc

SEQ ID NO: 1239255 - DNA, 22 bp, Artificial Sequence
  chemically synthesized
ttacactcaaaataccaaatta

SEQ ID NO: 1239256 - DNA, 22 bp, Artificial Sequence
  chemically synthesized
acctggaataatttggtatttt

SEQ ID NO: 1239257 - DNA, 22 bp, Artificial Sequence
  chemically synthesized
gaataatttggtattttgagtg

SEQ ID NO: 1239258 - DNA, 22 bp, Artificial Sequence
  chemically synthesized
aaaaacaaattattacactcaa

SEQ ID NO: 1239259 - DNA, 22 bp, Artificial Sequence
  chemically synthesized
gaaaaacaaattattacactca

SEQ ID NO: 1239260 - DNA, 22 bp, Artificial Sequence
  chemically synthesized
ggtattttgagtgtaataattt

SEQ ID NO: 1239261 - DNA, 22 bp, Artificial Sequence
  chemically synthesized
aatttgaaaaacaaattattac

SEQ ID NO: 1239262 - DNA, 22 bp, Artificial Sequence
  chemically synthesized
gtattttgagtgtaataatttg

SEQ ID NO: 1239263 - DNA, 22 bp, Artificial Sequence
  chemically synthesized
attcaatttgaaaaacaaatta

SEQ ID NO: 1239264 - DNA, 22 bp, Artificial Sequence
  chemically synthesized
cattcaatttgaaaaacaaatt

SEQ ID NO: 1239265 - DNA, 22 bp, Artificial Sequence
  chemically synthesized
tgagtgtaataatttgtttttc

SEQ ID NO: 1239266 - DNA, 22 bp, Artificial Sequence
  chemically synthesized
gagtgtaataatttgtttttca

SEQ ID NO: 1239267 - DNA, 22 bp, Artificial Sequence
  chemically synthesized
agtgtaataatttgtttttcaa

SEQ ID NO: 1239268 - DNA, 22 bp, Artificial Sequence
  chemically synthesized
tataccttcattcaatttgaaa

SEQ ID NO: 1239269 - DNA, 22 bp, Artificial Sequence
  chemically synthesized
gtttttcaaattgaatgaaggt

SEQ ID NO: 1239270 - DNA, 22 bp, Artificial Sequence
  chemically synthesized
atggcattgtataccttcattc

SEQ ID NO: 1239271 - DNA, 22 bp, Artificial Sequence
  chemically synthesized
tttttcaaattgaatgaaggta

SEQ ID NO: 1239272 - DNA, 22 bp, Artificial Sequence
  chemically synthesized
aatggcattgtataccttcatt

SEQ ID NO: 1239273 - DNA, 22 bp, Artificial Sequence
  chemically synthesized
taatggcattgtataccttcat

SEQ ID NO: 1239274 - DNA, 22 bp, Artificial Sequence
  chemically synthesized
ttcaaattgaatgaaggtatac

SEQ ID NO: 1239275 - DNA, 22 bp, Artificial Sequence
  chemically synthesized
tcaaattgaatgaaggtataca

SEQ ID NO: 1239276 - DNA, 22 bp, Artificial Sequence
  chemically synthesized
caaattgaatgaaggtatacaa

SEQ ID NO: 1239277 - DNA, 22 bp, Artificial Sequence
  chemically synthesized
aaattgaatgaaggtatacaat

SEQ ID NO: 1239278 - DNA, 22 bp, Artificial Sequence
  chemically synthesized
aatgaaggtatacaatgccatt

SEQ ID NO: 1239279 - DNA, 22 bp, Artificial Sequence
  chemically synthesized
gccaaaggagggaaaaaaacac

SEQ ID NO: 1239280 - DNA, 22 bp, Artificial Sequence
  chemically synthesized
ctggccaaaggagggaaaaaaa

SEQ ID NO: 1239281 - DNA, 22 bp, Artificial Sequence
  chemically synthesized
aaatgatgtgtttttttccctc

SEQ ID NO: 1239282 - DNA, 22 bp, Artificial Sequence
  chemically synthesized
ctcctggccaaaggagggaaaa

SEQ ID NO: 1239283 - DNA, 22 bp, Artificial Sequence
  chemically synthesized
gctcctggccaaaggagggaaa

SEQ ID NO: 1239284 - DNA, 22 bp, Artificial Sequence
  chemically synthesized
tgctcctggccaaaggagggaa

SEQ ID NO: 1239285 - DNA, 22 bp, Artificial Sequence
  chemically synthesized
ttttccctcctttggccaggag

SEQ ID NO: 1239286 - DNA, 22 bp, Artificial Sequence
  chemically synthesized
tttccctcctttggccaggagc

SEQ ID NO: 1239287 - DNA, 22 bp, Artificial Sequence
  chemically synthesized
ttccctcctttggccaggagca

SEQ ID NO: 1239288 - DNA, 22 bp, Artificial Sequence
  chemically synthesized
tccctcctttggccaggagcaa

SEQ ID NO: 1239289 - DNA, 22 bp, Artificial Sequence
  chemically synthesized
ccctcctttggccaggagcaaa

SEQ ID NO: 1239290 - DNA, 22 bp, Artificial Sequence
  chemically synthesized
cctcctttggccaggagcaaaa

SEQ ID NO: 1239291 - DNA, 22 bp, Artificial Sequence
  chemically synthesized
agataagtgtgaaattttgctc

SEQ ID NO: 1239292 - DNA, 22 bp, Artificial Sequence
  chemically synthesized
ctttggccaggagcaaaatttc

SEQ ID NO: 1239293 - DNA, 22 bp, Artificial Sequence
  chemically synthesized
ctcagataagtgtgaaattttg

SEQ ID NO: 1239294 - DNA, 22 bp, Artificial Sequence
  chemically synthesized
gctcagataagtgtgaaatttt

SEQ ID NO: 1239295 - DNA, 22 bp, Artificial Sequence
  chemically synthesized
tggccaggagcaaaatttcaca

SEQ ID NO: 1239296 - DNA, 22 bp, Artificial Sequence
  chemically synthesized
tgctcagataagtgtgaaattt

SEQ ID NO: 1239297 - DNA, 22 bp, Artificial Sequence
  chemically synthesized
ggccaggagcaaaatttcacac

SEQ ID NO: 1239298 - DNA, 22 bp, Artificial Sequence
  chemically synthesized
gccaggagcaaaatttcacact

SEQ ID NO: 1239299 - DNA, 22 bp, Artificial Sequence
  chemically synthesized
aaagtcatgctttgctcagata

SEQ ID NO: 1239300 - DNA, 22 bp, Artificial Sequence
  chemically synthesized
aaaagtcatgctttgctcagat

SEQ ID NO: 1239301 - DNA, 22 bp, Artificial Sequence
  chemically synthesized
cacacttatctgagcaaagcat

SEQ ID NO: 1239302 - DNA, 22 bp, Artificial Sequence
  chemically synthesized
acacttatctgagcaaagcatg

SEQ ID NO: 1239303 - DNA, 22 bp, Artificial Sequence
  chemically synthesized
atgagtttaaaagtcatgcttt

SEQ ID NO: 1239304 - DNA, 22 bp, Artificial Sequence
  chemically synthesized
gatgagtttaaaagtcatgctt

SEQ ID NO: 1239305 - DNA, 22 bp, Artificial Sequence
  chemically synthesized
tgatgagtttaaaagtcatgct

SEQ ID NO: 1239306 - DNA, 22 bp, Artificial Sequence
  chemically synthesized
ttgatgagtttaaaagtcatgc

SEQ ID NO: 1239307 - DNA, 22 bp, Artificial Sequence
  chemically synthesized
atctgagcaaagcatgactttt

SEQ ID NO: 1239308 - DNA, 22 bp, Artificial Sequence
  chemically synthesized
tttgatgagtttaaaagtcatg

SEQ ID NO: 1239309 - DNA, 22 bp, Artificial Sequence
  chemically synthesized
tctgagcaaagcatgactttta

SEQ ID NO: 1239310 - DNA, 22 bp, Artificial Sequence
  chemically synthesized
ttttttgatgagtttaaaagtc

SEQ ID NO: 1239311 - DNA, 22 bp, Artificial Sequence
  chemically synthesized
agcaaagcatgacttttaaact

SEQ ID NO: 1239312 - DNA, 22 bp, Artificial Sequence
  chemically synthesized
cagtgcataagattattttttg

SEQ ID NO: 1239313 - DNA, 22 bp, Artificial Sequence
  chemically synthesized
ttaaactcatcaaaaaataatc

SEQ ID NO: 1239314 - DNA, 22 bp, Artificial Sequence
  chemically synthesized
taaactcatcaaaaaataatct

SEQ ID NO: 1239315 - DNA, 22 bp, Artificial Sequence
  chemically synthesized
aaactcatcaaaaaataatctt

SEQ ID NO: 1239316 - DNA, 22 bp, Artificial Sequence
  chemically synthesized
aactcatcaaaaaataatctta

SEQ ID NO: 1239317 - DNA, 22 bp, Artificial Sequence
  chemically synthesized
atcaaaaaataatcttatgcac

SEQ ID NO: 1239318 - DNA, 22 bp, Artificial Sequence
  chemically synthesized
aacaatggacacattgcagtgc

SEQ ID NO: 1239319 - DNA, 22 bp, Artificial Sequence
  chemically synthesized
caacaatggacacattgcagtg

SEQ ID NO: 1239320 - DNA, 22 bp, Artificial Sequence
  chemically synthesized
ttcaacaatggacacattgcag

SEQ ID NO: 1239321 - DNA, 22 bp, Artificial Sequence
  chemically synthesized
cttcaacaatggacacattgca

SEQ ID NO: 1239322 - DNA, 22 bp, Artificial Sequence
  chemically synthesized
tcttcaacaatggacacattgc

SEQ ID NO: 1239323 - DNA, 22 bp, Artificial Sequence
  chemically synthesized
atgcactgcaatgtgtccattg

SEQ ID NO: 1239324 - DNA, 22 bp, Artificial Sequence
  chemically synthesized
tattttcttcaacaatggacac

SEQ ID NO: 1239325 - DNA, 22 bp, Artificial Sequence
  chemically synthesized
tgcactgcaatgtgtccattgt

SEQ ID NO: 1239326 - DNA, 22 bp, Artificial Sequence
  chemically synthesized
actatattttcttcaacaatgg

SEQ ID NO: 1239327 - DNA, 22 bp, Artificial Sequence
  chemically synthesized
caatgtgtccattgttgaagaa

SEQ ID NO: 1239328 - DNA, 22 bp, Artificial Sequence
  chemically synthesized
acagttaactatattttcttca

SEQ ID NO: 1239329 - DNA, 22 bp, Artificial Sequence
  chemically synthesized
tcagttaacagttaactatatt

SEQ ID NO: 1239330 - DNA, 22 bp, Artificial Sequence
  chemically synthesized
tgtcagttaacagttaactata

SEQ ID NO: 1239331 - DNA, 22 bp, Artificial Sequence
  chemically synthesized
ttgaagaaaatatagttaactg

SEQ ID NO: 1239332 - DNA, 22 bp, Artificial Sequence
  chemically synthesized
aagaaaatatagttaactgtta

SEQ ID NO: 1239333 - DNA, 22 bp, Artificial Sequence
  chemically synthesized
ataaaaacaagtatctctgtca

SEQ ID NO: 1239334 - DNA, 22 bp, Artificial Sequence
  chemically synthesized
cataaaaacaagtatctctgtc

SEQ ID NO: 1239335 - DNA, 22 bp, Artificial Sequence
  chemically synthesized
tcataaaaacaagtatctctgt

SEQ ID NO: 1239336 - DNA, 22 bp, Artificial Sequence
  chemically synthesized
actgttaactgacagagatact

SEQ ID NO: 1239337 - DNA, 22 bp, Artificial Sequence
  chemically synthesized
ttcataaaaacaagtatctctg

SEQ ID NO: 1239338 - DNA, 22 bp, Artificial Sequence
  chemically synthesized
ttttcataaaaacaagtatctc

SEQ ID NO: 1239339 - DNA, 22 bp, Artificial Sequence
  chemically synthesized
cttttcataaaaacaagtatct

SEQ ID NO: 1239340 - DNA, 22 bp, Artificial Sequence
  chemically synthesized
ttaactgacagagatacttgtt

SEQ ID NO: 1239341 - DNA, 22 bp, Artificial Sequence
  chemically synthesized
tcttttcataaaaacaagtatc

SEQ ID NO: 1239342 - DNA, 22 bp, Artificial Sequence
  chemically synthesized
ttcttttcataaaaacaagtat

SEQ ID NO: 1239343 - DNA, 22 bp, Artificial Sequence
  chemically synthesized
tttcttttcataaaaacaagta

SEQ ID NO: 1239344 - DNA, 22 bp, Artificial Sequence
  chemically synthesized
actgacagagatacttgttttt

SEQ ID NO: 1239345 - DNA, 22 bp, Artificial Sequence
  chemically synthesized
acagagatacttgtttttatga

SEQ ID NO: 1239346 - DNA, 22 bp, Artificial Sequence
  chemically synthesized
gattttttcttttcataaaaac

SEQ ID NO: 1239347 - DNA, 22 bp, Artificial Sequence
  chemically synthesized
ccctggattttttcttttcata

SEQ ID NO: 1239348 - DNA, 22 bp, Artificial Sequence
  chemically synthesized
taccctggattttttcttttca

SEQ ID NO: 1239349 - DNA, 22 bp, Artificial Sequence
  chemically synthesized
ctaccctggattttttcttttc

SEQ ID NO: 1239350 - DNA, 22 bp, Artificial Sequence
  chemically synthesized
tctaccctggattttttctttt

SEQ ID NO: 1239351 - DNA, 22 bp, Artificial Sequence
  chemically synthesized
gtttttatgaaaagaaaaaatc

SEQ ID NO: 1239352 - DNA, 22 bp, Artificial Sequence
  chemically synthesized
tttttatgaaaagaaaaaatcc

SEQ ID NO: 1239353 - DNA, 22 bp, Artificial Sequence
  chemically synthesized
aactttctaccctggatttttt

SEQ ID NO: 1239354 - DNA, 22 bp, Artificial Sequence
  chemically synthesized
caactttctaccctggattttt

SEQ ID NO: 1239355 - DNA, 22 bp, Artificial Sequence
  chemically synthesized
ttatgaaaagaaaaaatccagg

SEQ ID NO: 1239356 - DNA, 22 bp, Artificial Sequence
  chemically synthesized
tatgaaaagaaaaaatccaggg

SEQ ID NO: 1239357 - DNA, 22 bp, Artificial Sequence
  chemically synthesized
atgaaaagaaaaaatccagggt

SEQ ID NO: 1239358 - DNA, 22 bp, Artificial Sequence
  chemically synthesized
tgaaaagaaaaaatccagggta

SEQ ID NO: 1239359 - DNA, 22 bp, Artificial Sequence
  chemically synthesized
acagacttcaactttctaccct

SEQ ID NO: 1239360 - DNA, 22 bp, Artificial Sequence
  chemically synthesized
gtctgacagacttcaactttct

SEQ ID NO: 1239361 - DNA, 22 bp, Artificial Sequence
  chemically synthesized
ggtctgacagacttcaactttc

SEQ ID NO: 1239362 - DNA, 22 bp, Artificial Sequence
  chemically synthesized
ttggtctgacagacttcaactt

SEQ ID NO: 1239363 - DNA, 22 bp, Artificial Sequence
  chemically synthesized
cttggtctgacagacttcaact

SEQ ID NO: 1239364 - DNA, 22 bp, Artificial Sequence
  chemically synthesized
tcacgcacatacttcttggtct

SEQ ID NO: 1239365 - DNA, 22 bp, Artificial Sequence
  chemically synthesized
atcacgcacatacttcttggtc

SEQ ID NO: 1239366 - DNA, 22 bp, Artificial Sequence
  chemically synthesized
aagtctgtcagaccaagaagta

SEQ ID NO: 1239367 - DNA, 22 bp, Artificial Sequence
  chemically synthesized
tcagaccaagaagtatgtgcgt

SEQ ID NO: 1239368 - DNA, 22 bp, Artificial Sequence
  chemically synthesized
aataaacagcagtttatcacgc

SEQ ID NO: 1239369 - DNA, 22 bp, Artificial Sequence
  chemically synthesized
gaataaacagcagtttatcacg

SEQ ID NO: 1239370 - DNA, 22 bp, Artificial Sequence
  chemically synthesized
tgaataaacagcagtttatcac

SEQ ID NO: 1239371 - DNA, 22 bp, Artificial Sequence
  chemically synthesized
ttgaataaacagcagtttatca

SEQ ID NO: 1239372 - DNA, 22 bp, Artificial Sequence
  chemically synthesized
tttgaataaacagcagtttatc

SEQ ID NO: 1239373 - DNA, 22 bp, Artificial Sequence
  chemically synthesized
tttttgaataaacagcagttta

SEQ ID NO: 1239374 - DNA, 22 bp, Artificial Sequence
  chemically synthesized
ctctttttgaataaacagcagt

SEQ ID NO: 1239375 - DNA, 22 bp, Artificial Sequence
  chemically synthesized
ctcctctttttgaataaacagc

SEQ ID NO: 1239376 - DNA, 22 bp, Artificial Sequence
  chemically synthesized
tgctcctctttttgaataaaca

SEQ ID NO: 1239377 - DNA, 22 bp, Artificial Sequence
  chemically synthesized
ccagtctctgctcctctttttg

SEQ ID NO: 1239378 - DNA, 22 bp, Artificial Sequence
  chemically synthesized
cccagtctctgctcctcttttt

SEQ ID NO: 1239379 - DNA, 22 bp, Artificial Sequence
  chemically synthesized
tcccagtctctgctcctctttt

SEQ ID NO: 1239380 - DNA, 22 bp, Artificial Sequence
  chemically synthesized
ctgtttattcaaaaagaggagc

SEQ ID NO: 1239381 - DNA, 22 bp, Artificial Sequence
  chemically synthesized
tttattcaaaaagaggagcaga

SEQ ID NO: 1239382 - DNA, 22 bp, Artificial Sequence
  chemically synthesized
acctttcccagtctctgctcct

SEQ ID NO: 1239383 - DNA, 22 bp, Artificial Sequence
  chemically synthesized
attcaaaaagaggagcagagac

SEQ ID NO: 1239384 - DNA, 22 bp, Artificial Sequence
  chemically synthesized
tcacctttcccagtctctgctc

SEQ ID NO: 1239385 - DNA, 22 bp, Artificial Sequence
  chemically synthesized
ttcaaaaagaggagcagagact

SEQ ID NO: 1239386 - DNA, 22 bp, Artificial Sequence
  chemically synthesized
tctcacctttcccagtctctgc

SEQ ID NO: 1239387 - DNA, 22 bp, Artificial Sequence
  chemically synthesized
ctctcacctttcccagtctctg

SEQ ID NO: 1239388 - DNA, 22 bp, Artificial Sequence
  chemically synthesized
aaaaagaggagcagagactggg

SEQ ID NO: 1239389 - DNA, 22 bp, Artificial Sequence
  chemically synthesized
caagacttctctcacctttccc

SEQ ID NO: 1239390 - DNA, 22 bp, Artificial Sequence
  chemically synthesized
tactccaagacttctctcacct

SEQ ID NO: 1239391 - DNA, 22 bp, Artificial Sequence
  chemically synthesized
tgtactccaagacttctctcac

SEQ ID NO: 1239392 - DNA, 22 bp, Artificial Sequence
  chemically synthesized
ttctgtactccaagacttctct

SEQ ID NO: 1239393 - DNA, 22 bp, Artificial Sequence
  chemically synthesized
attctgtactccaagacttctc

SEQ ID NO: 1239394 - DNA, 22 bp, Artificial Sequence
  chemically synthesized
tattctgtactccaagacttct

SEQ ID NO: 1239395 - DNA, 22 bp, Artificial Sequence
  chemically synthesized
ggaaaggtgagagaagtcttgg

SEQ ID NO: 1239396 - DNA, 22 bp, Artificial Sequence
  chemically synthesized
atgttttattctgtactccaag

SEQ ID NO: 1239397 - DNA, 22 bp, Artificial Sequence
  chemically synthesized
ggattcatgttttattctgtac

SEQ ID NO: 1239398 - DNA, 22 bp, Artificial Sequence
  chemically synthesized
gggattcatgttttattctgta

SEQ ID NO: 1239399 - DNA, 22 bp, Artificial Sequence
  chemically synthesized
tgggattcatgttttattctgt

SEQ ID NO: 1239400 - DNA, 22 bp, Artificial Sequence
  chemically synthesized
ggagtacagaataaaacatgaa

SEQ ID NO: 1239401 - DNA, 22 bp, Artificial Sequence
  chemically synthesized
atggctttgggattcatgtttt

SEQ ID NO: 1239402 - DNA, 22 bp, Artificial Sequence
  chemically synthesized
gagtacagaataaaacatgaat

SEQ ID NO: 1239403 - DNA, 22 bp, Artificial Sequence
  chemically synthesized
tatgatcctgatggctttggga

SEQ ID NO: 1239404 - DNA, 22 bp, Artificial Sequence
  chemically synthesized
gatgctatatgatcctgatggc

SEQ ID NO: 1239405 - DNA, 22 bp, Artificial Sequence
  chemically synthesized
ggatgctatatgatcctgatgg

SEQ ID NO: 1239406 - DNA, 22 bp, Artificial Sequence
  chemically synthesized
tgtcttggatgctatatgatcc

SEQ ID NO: 1239407 - DNA, 22 bp, Artificial Sequence
  chemically synthesized
gtgtcttggatgctatatgatc

SEQ ID NO: 1239408 - DNA, 22 bp, Artificial Sequence
  chemically synthesized
caaacccaaacgtagtccttgt

SEQ ID NO: 1239409 - DNA, 22 bp, Artificial Sequence
  chemically synthesized
tctccaaacccaaacgtagtcc

SEQ ID NO: 1239410 - DNA, 22 bp, Artificial Sequence
  chemically synthesized
gtctccaaacccaaacgtagtc

SEQ ID NO: 1239411 - DNA, 22 bp, Artificial Sequence
  chemically synthesized
tgtctccaaacccaaacgtagt

SEQ ID NO: 1239412 - DNA, 22 bp, Artificial Sequence
  chemically synthesized
gactttgtctccaaacccaaac

SEQ ID NO: 1239413 - DNA, 22 bp, Artificial Sequence
  chemically synthesized
cctagactttgtctccaaaccc

SEQ ID NO: 1239414 - DNA, 22 bp, Artificial Sequence
  chemically synthesized
gcctagactttgtctccaaacc

SEQ ID NO: 1239415 - DNA, 22 bp, Artificial Sequence
  chemically synthesized
tgcctagactttgtctccaaac

SEQ ID NO: 1239416 - DNA, 22 bp, Artificial Sequence
  chemically synthesized
cgtttgggtttggagacaaagt

SEQ ID NO: 1239417 - DNA, 22 bp, Artificial Sequence
  chemically synthesized
acctttgcctagactttgtctc

SEQ ID NO: 1239418 - DNA, 22 bp, Artificial Sequence
  chemically synthesized
gacctttgcctagactttgtct

SEQ ID NO: 1239419 - DNA, 22 bp, Artificial Sequence
  chemically synthesized
tgacctttgcctagactttgtc

SEQ ID NO: 1239420 - DNA, 22 bp, Artificial Sequence
  chemically synthesized
ttgacctttgcctagactttgt

SEQ ID NO: 1239421 - DNA, 22 bp, Artificial Sequence
  chemically synthesized
gggtttggagacaaagtctagg

SEQ ID NO: 1239422 - DNA, 22 bp, Artificial Sequence
  chemically synthesized
ggtttggagacaaagtctaggc

SEQ ID NO: 1239423 - DNA, 22 bp, Artificial Sequence
  chemically synthesized
cgtttttgacctttgcctagac

SEQ ID NO: 1239424 - DNA, 22 bp, Artificial Sequence
  chemically synthesized
ggagacaaagtctaggcaaagg

SEQ ID NO: 1239425 - DNA, 22 bp, Artificial Sequence
  chemically synthesized
gagacaaagtctaggcaaaggt

SEQ ID NO: 1239426 - DNA, 22 bp, Artificial Sequence
  chemically synthesized
tctgcgtttttgacctttgcct

SEQ ID NO: 1239427 - DNA, 22 bp, Artificial Sequence
  chemically synthesized
tgtctgcgtttttgacctttgc

SEQ ID NO: 1239428 - DNA, 22 bp, Artificial Sequence
  chemically synthesized
ggcaaaggtcaaaaacgcagac

SEQ ID NO: 1239429 - DNA, 22 bp, Artificial Sequence
  chemically synthesized
gcccacaaagcaagattctgtc

SEQ ID NO: 1239430 - DNA, 22 bp, Artificial Sequence
  chemically synthesized
ggcccacaaagcaagattctgt

SEQ ID NO: 1239431 - DNA, 22 bp, Artificial Sequence
  chemically synthesized
agtttggcccacaaagcaagat

SEQ ID NO: 1239432 - DNA, 22 bp, Artificial Sequence
  chemically synthesized
aagtttggcccacaaagcaaga

SEQ ID NO: 1239433 - DNA, 22 bp, Artificial Sequence
  chemically synthesized
tgtatttaagtttggcccacaa

SEQ ID NO: 1239434 - DNA, 22 bp, Artificial Sequence
  chemically synthesized
gtctatgtatttaagtttggcc

SEQ ID NO: 1239435 - DNA, 22 bp, Artificial Sequence
  chemically synthesized
ggtctatgtatttaagtttggc

SEQ ID NO: 1239436 - DNA, 22 bp, Artificial Sequence
  chemically synthesized
gctttgtgggccaaacttaaat

SEQ ID NO: 1239437 - DNA, 22 bp, Artificial Sequence
  chemically synthesized
ctttgtgggccaaacttaaata

SEQ ID NO: 1239438 - DNA, 22 bp, Artificial Sequence
  chemically synthesized
tgtgggccaaacttaaatacat

SEQ ID NO: 1239439 - DNA, 22 bp, Artificial Sequence
  chemically synthesized
gtgggccaaacttaaatacata

SEQ ID NO: 1239440 - DNA, 22 bp, Artificial Sequence
  chemically synthesized
tgggccaaacttaaatacatag

SEQ ID NO: 1239441 - DNA, 22 bp, Artificial Sequence
  chemically synthesized
taaaagaccttggtctatgtat

SEQ ID NO: 1239442 - DNA, 22 bp, Artificial Sequence
  chemically synthesized
ataaaagaccttggtctatgta

SEQ ID NO: 1239443 - DNA, 22 bp, Artificial Sequence
  chemically synthesized
aaatacatagaccaaggtcttt

SEQ ID NO: 1239444 - DNA, 22 bp, Artificial Sequence
  chemically synthesized
aatacatagaccaaggtctttt

SEQ ID NO: 1239445 - DNA, 22 bp, Artificial Sequence
  chemically synthesized
aaagaagacttataaaagacct

SEQ ID NO: 1239446 - DNA, 22 bp, Artificial Sequence
  chemically synthesized
aaaagaagacttataaaagacc

SEQ ID NO: 1239447 - DNA, 22 bp, Artificial Sequence
  chemically synthesized
taaaagaagacttataaaagac

SEQ ID NO: 1239448 - DNA, 22 bp, Artificial Sequence
  chemically synthesized
cagttttaaaagaagacttata

SEQ ID NO: 1239449 - DNA, 22 bp, Artificial Sequence
  chemically synthesized
cctccagttttaaaagaagact

SEQ ID NO: 1239450 - DNA, 22 bp, Artificial Sequence
  chemically synthesized
gttacctccagttttaaaagaa

SEQ ID NO: 1239451 - DNA, 22 bp, Artificial Sequence
  chemically synthesized
ggttacctccagttttaaaaga

SEQ ID NO: 1239452 - DNA, 22 bp, Artificial Sequence
  chemically synthesized
tggttacctccagttttaaaag

SEQ ID NO: 1239453 - DNA, 22 bp, Artificial Sequence
  chemically synthesized
ttataagtcttcttttaaaact

SEQ ID NO: 1239454 - DNA, 22 bp, Artificial Sequence
  chemically synthesized
tataagtcttcttttaaaactg

SEQ ID NO: 1239455 - DNA, 22 bp, Artificial Sequence
  chemically synthesized
ataagtcttcttttaaaactgg

SEQ ID NO: 1239456 - DNA, 22 bp, Artificial Sequence
  chemically synthesized
taagtcttcttttaaaactgga

SEQ ID NO: 1239457 - DNA, 22 bp, Artificial Sequence
  chemically synthesized
cattttggttacctccagtttt

SEQ ID NO: 1239458 - DNA, 22 bp, Artificial Sequence
  chemically synthesized
tccattttggttacctccagtt

SEQ ID NO: 1239459 - DNA, 22 bp, Artificial Sequence
  chemically synthesized
cctctccattttggttacctcc

SEQ ID NO: 1239460 - DNA, 22 bp, Artificial Sequence
  chemically synthesized
cttttaaaactggaggtaacca

SEQ ID NO: 1239461 - DNA, 22 bp, Artificial Sequence
  chemically synthesized
ttttaaaactggaggtaaccaa

SEQ ID NO: 1239462 - DNA, 22 bp, Artificial Sequence
  chemically synthesized
ctccctctccattttggttacc

SEQ ID NO: 1239463 - DNA, 22 bp, Artificial Sequence
  chemically synthesized
ttaaaactggaggtaaccaaaa

SEQ ID NO: 1239464 - DNA, 22 bp, Artificial Sequence
  chemically synthesized
actccctctccattttggttac

SEQ ID NO: 1239465 - DNA, 22 bp, Artificial Sequence
  chemically synthesized
taaaactggaggtaaccaaaat

SEQ ID NO: 1239466 - DNA, 22 bp, Artificial Sequence
  chemically synthesized
tactccctctccattttggtta

SEQ ID NO: 1239467 - DNA, 22 bp, Artificial Sequence
  chemically synthesized
aaaactggaggtaaccaaaatg

SEQ ID NO: 1239468 - DNA, 22 bp, Artificial Sequence
  chemically synthesized
aaactggaggtaaccaaaatgg

SEQ ID NO: 1239469 - DNA, 22 bp, Artificial Sequence
  chemically synthesized
gaggtaaccaaaatggagaggg

SEQ ID NO: 1239470 - DNA, 22 bp, Artificial Sequence
  chemically synthesized
taatcctttactccctctccat

SEQ ID NO: 1239471 - DNA, 22 bp, Artificial Sequence
  chemically synthesized
acctataatcctttactccctc

SEQ ID NO: 1239472 - DNA, 22 bp, Artificial Sequence
  chemically synthesized
cctgacctataatcctttactc

SEQ ID NO: 1239473 - DNA, 22 bp, Artificial Sequence
  chemically synthesized
ggtgtacatggaatcccctacc

SEQ ID NO: 1239474 - DNA, 22 bp, Artificial Sequence
  chemically synthesized
taggtcaggtaggggattccat

SEQ ID NO: 1239475 - DNA, 22 bp, Artificial Sequence
  chemically synthesized
ggtgccccagctaggtgtacat

SEQ ID NO: 1239476 - DNA, 22 bp, Artificial Sequence
  chemically synthesized
tcggtgccccagctaggtgtac

SEQ ID NO: 1239477 - DNA, 22 bp, Artificial Sequence
  chemically synthesized
tctcggtgccccagctaggtgt

SEQ ID NO: 1239478 - DNA, 22 bp, Artificial Sequence
  chemically synthesized
tctctcggtgccccagctaggt

SEQ ID NO: 1239479 - DNA, 22 bp, Artificial Sequence
  chemically synthesized
tctctctcggtgccccagctag

SEQ ID NO: 1239480 - DNA, 22 bp, Artificial Sequence
  chemically synthesized
ctctctctcggtgccccagcta

SEQ ID NO: 1239481 - DNA, 22 bp, Artificial Sequence
  chemically synthesized
tctctctctcggtgccccagct

SEQ ID NO: 1239482 - DNA, 22 bp, Artificial Sequence
  chemically synthesized
catgtacacctagctggggcac

SEQ ID NO: 1239483 - DNA, 22 bp, Artificial Sequence
  chemically synthesized
ctttctctctctcggtgcccca

SEQ ID NO: 1239484 - DNA, 22 bp, Artificial Sequence
  chemically synthesized
actgctttctctctctcggtgc

SEQ ID NO: 1239485 - DNA, 22 bp, Artificial Sequence
  chemically synthesized
gctggggcaccgagagagagaa

SEQ ID NO: 1239486 - DNA, 22 bp, Artificial Sequence
  chemically synthesized
tcacctcactgctttctctctc

SEQ ID NO: 1239487 - DNA, 22 bp, Artificial Sequence
  chemically synthesized
tatcacctcactgctttctctc

SEQ ID NO: 1239488 - DNA, 22 bp, Artificial Sequence
  chemically synthesized
gggcaccgagagagagaaagca

SEQ ID NO: 1239489 - DNA, 22 bp, Artificial Sequence
  chemically synthesized
tctatcacctcactgctttctc

SEQ ID NO: 1239490 - DNA, 22 bp, Artificial Sequence
  chemically synthesized
ctctatcacctcactgctttct

SEQ ID NO: 1239491 - DNA, 22 bp, Artificial Sequence
  chemically synthesized
tttctctatcacctcactgctt

SEQ ID NO: 1239492 - DNA, 22 bp, Artificial Sequence
  chemically synthesized
gaaaataatacgatagcaggaa

SEQ ID NO: 1239493 - DNA, 22 bp, Artificial Sequence
  chemically synthesized
cgaaaataatacgatagcagga

SEQ ID NO: 1239494 - DNA, 22 bp, Artificial Sequence
  chemically synthesized
tgagtttcgaaaataatacgat

SEQ ID NO: 1239495 - DNA, 22 bp, Artificial Sequence
  chemically synthesized
tgtgagtttcgaaaataatacg

SEQ ID NO: 1239496 - DNA, 22 bp, Artificial Sequence
  chemically synthesized
actctgtgagtttcgaaaataa

SEQ ID NO: 1239497 - DNA, 22 bp, Artificial Sequence
  chemically synthesized
ctgctatcgtattattttcgaa

SEQ ID NO: 1239498 - DNA, 22 bp, Artificial Sequence
  chemically synthesized
ctatcgtattattttcgaaact

SEQ ID NO: 1239499 - DNA, 22 bp, Artificial Sequence
  chemically synthesized
tcgtattattttcgaaactcac

SEQ ID NO: 1239500 - DNA, 22 bp, Artificial Sequence
  chemically synthesized
atatatcattgactctgtgagt

SEQ ID NO: 1239501 - DNA, 22 bp, Artificial Sequence
  chemically synthesized
aatatatcattgactctgtgag

SEQ ID NO: 1239502 - DNA, 22 bp, Artificial Sequence
  chemically synthesized
taatatatcattgactctgtga

SEQ ID NO: 1239503 - DNA, 22 bp, Artificial Sequence
  chemically synthesized
ttttcgaaactcacagagtcaa

SEQ ID NO: 1239504 - DNA, 22 bp, Artificial Sequence
  chemically synthesized
tcgaaactcacagagtcaatga

SEQ ID NO: 1239505 - DNA, 22 bp, Artificial Sequence
  chemically synthesized
cgaaactcacagagtcaatgat

SEQ ID NO: 1239506 - DNA, 22 bp, Artificial Sequence
  chemically synthesized
gaaactcacagagtcaatgata

SEQ ID NO: 1239507 - DNA, 22 bp, Artificial Sequence
  chemically synthesized
tgatactttaatatatcattga

SEQ ID NO: 1239508 - DNA, 22 bp, Artificial Sequence
  chemically synthesized
aattgtgatactttaatatatc

SEQ ID NO: 1239509 - DNA, 22 bp, Artificial Sequence
  chemically synthesized
acagagtcaatgatatattaaa

SEQ ID NO: 1239510 - DNA, 22 bp, Artificial Sequence
  chemically synthesized
caattgtgatactttaatatat

SEQ ID NO: 1239511 - DNA, 22 bp, Artificial Sequence
  chemically synthesized
gatttcaattgtgatactttaa

SEQ ID NO: 1239512 - DNA, 22 bp, Artificial Sequence
  chemically synthesized
atagaaattggatttcaattgt

SEQ ID NO: 1239513 - DNA, 22 bp, Artificial Sequence
  chemically synthesized
aagtatcacaattgaaatccaa

SEQ ID NO: 1239514 - DNA, 22 bp, Artificial Sequence
  chemically synthesized
aaatccaatttctattagtcat

SEQ ID NO: 1239515 - DNA, 22 bp, Artificial Sequence
  chemically synthesized
gagaatatggtgaatatgacta

SEQ ID NO: 1239516 - DNA, 22 bp, Artificial Sequence
  chemically synthesized
ttagagaatatggtgaatatga

SEQ ID NO: 1239517 - DNA, 22 bp, Artificial Sequence
  chemically synthesized
tattagagaatatggtgaatat

SEQ ID NO: 1239518 - DNA, 22 bp, Artificial Sequence
  chemically synthesized
ctattagtcatattcaccatat

SEQ ID NO: 1239519 - DNA, 22 bp, Artificial Sequence
  chemically synthesized
tattagtcatattcaccatatt

SEQ ID NO: 1239520 - DNA, 22 bp, Artificial Sequence
  chemically synthesized
ttagtcatattcaccatattct

SEQ ID NO: 1239521 - DNA, 22 bp, Artificial Sequence
  chemically synthesized
gtcatattcaccatattctcta

SEQ ID NO: 1239522 - DNA, 22 bp, Artificial Sequence
  chemically synthesized
agaagcactctattagagaata

SEQ ID NO: 1239523 - DNA, 22 bp, Artificial Sequence
  chemically synthesized
tgagaagcactctattagagaa

SEQ ID NO: 1239524 - DNA, 22 bp, Artificial Sequence
  chemically synthesized
accatattctctaatagagtgc

SEQ ID NO: 1239525 - DNA, 22 bp, Artificial Sequence
  chemically synthesized
gtagaatattctgagaagcact

SEQ ID NO: 1239526 - DNA, 22 bp, Artificial Sequence
  chemically synthesized
tggtagaatattctgagaagca

SEQ ID NO: 1239527 - DNA, 22 bp, Artificial Sequence
  chemically synthesized
tctaatagagtgcttctcagaa

SEQ ID NO: 1239528 - DNA, 22 bp, Artificial Sequence
  chemically synthesized
taatagagtgcttctcagaata

SEQ ID NO: 1239529 - DNA, 22 bp, Artificial Sequence
  chemically synthesized
atagagtgcttctcagaatatt

SEQ ID NO: 1239530 - DNA, 22 bp, Artificial Sequence
  chemically synthesized
gaaggatgctctggtagaatat

SEQ ID NO: 1239531 - DNA, 22 bp, Artificial Sequence
  chemically synthesized
ctggaaggatgctctggtagaa

SEQ ID NO: 1239532 - DNA, 22 bp, Artificial Sequence
  chemically synthesized
cctggaaggatgctctggtaga

SEQ ID NO: 1239533 - DNA, 22 bp, Artificial Sequence
  chemically synthesized
ctcagaatattctaccagagca

SEQ ID NO: 1239534 - DNA, 22 bp, Artificial Sequence
  chemically synthesized
tcagaatattctaccagagcat

SEQ ID NO: 1239535 - DNA, 22 bp, Artificial Sequence
  chemically synthesized
atttcctggaaggatgctctgg

SEQ ID NO: 1239536 - DNA, 22 bp, Artificial Sequence
  chemically synthesized
agaatattctaccagagcatcc

SEQ ID NO: 1239537 - DNA, 22 bp, Artificial Sequence
  chemically synthesized
catttcctggaaggatgctctg

SEQ ID NO: 1239538 - DNA, 22 bp, Artificial Sequence
  chemically synthesized
aatttcatttcctggaaggatg

SEQ ID NO: 1239539 - DNA, 22 bp, Artificial Sequence
  chemically synthesized
caatttcatttcctggaaggat

SEQ ID NO: 1239540 - DNA, 22 bp, Artificial Sequence
  chemically synthesized
taccagagcatccttccaggaa

SEQ ID NO: 1239541 - DNA, 22 bp, Artificial Sequence
  chemically synthesized
cttcaatttcatttcctggaag

SEQ ID NO: 1239542 - DNA, 22 bp, Artificial Sequence
  chemically synthesized
ccagagcatccttccaggaaat

SEQ ID NO: 1239543 - DNA, 22 bp, Artificial Sequence
  chemically synthesized
cagggtaaattccttcaatttc

SEQ ID NO: 1239544 - DNA, 22 bp, Artificial Sequence
  chemically synthesized
ccaggaaatgaaattgaaggaa

SEQ ID NO: 1239545 - DNA, 22 bp, Artificial Sequence
  chemically synthesized
caggaaatgaaattgaaggaat

SEQ ID NO: 1239546 - DNA, 22 bp, Artificial Sequence
  chemically synthesized
ccagactccagggtaaattcct

SEQ ID NO: 1239547 - DNA, 22 bp, Artificial Sequence
  chemically synthesized
tactgccagactccagggtaaa

SEQ ID NO: 1239548 - DNA, 22 bp, Artificial Sequence
  chemically synthesized
atactgccagactccagggtaa

SEQ ID NO: 1239549 - DNA, 22 bp, Artificial Sequence
  chemically synthesized
aaggaatttaccctggagtctg

SEQ ID NO: 1239550 - DNA, 22 bp, Artificial Sequence
  chemically synthesized
tgtaatttatactgccagactc

SEQ ID NO: 1239551 - DNA, 22 bp, Artificial Sequence
  chemically synthesized
accctggagtctggcagtataa

SEQ ID NO: 1239552 - DNA, 22 bp, Artificial Sequence
  chemically synthesized
ccctggagtctggcagtataaa

SEQ ID NO: 1239553 - DNA, 22 bp, Artificial Sequence
  chemically synthesized
caggcactgtgtaatttatact

SEQ ID NO: 1239554 - DNA, 22 bp, Artificial Sequence
  chemically synthesized
gagtctggcagtataaattaca

SEQ ID NO: 1239555 - DNA, 22 bp, Artificial Sequence
  chemically synthesized
aaacctgcaggcactgtgtaat

SEQ ID NO: 1239556 - DNA, 22 bp, Artificial Sequence
  chemically synthesized
aaaacctgcaggcactgtgtaa

SEQ ID NO: 1239557 - DNA, 22 bp, Artificial Sequence
  chemically synthesized
gcagtataaattacacagtgcc

SEQ ID NO: 1239558 - DNA, 22 bp, Artificial Sequence
  chemically synthesized
aaagaaatttaaaacctgcagg

SEQ ID NO: 1239559 - DNA, 22 bp, Artificial Sequence
  chemically synthesized
caaagaaatttaaaacctgcag

SEQ ID NO: 1239560 - DNA, 22 bp, Artificial Sequence
  chemically synthesized
tcaaagaaatttaaaacctgca

SEQ ID NO: 1239561 - DNA, 22 bp, Artificial Sequence
  chemically synthesized
cacagtgcctgcaggttttaaa

SEQ ID NO: 1239562 - DNA, 22 bp, Artificial Sequence
  chemically synthesized
caggttttaaatttctttgaaa

SEQ ID NO: 1239563 - DNA, 22 bp, Artificial Sequence
  chemically synthesized
gcataaagtatatgctttcaaa

SEQ ID NO: 1239564 - DNA, 22 bp, Artificial Sequence
  chemically synthesized
agcataaagtatatgctttcaa

SEQ ID NO: 1239565 - DNA, 22 bp, Artificial Sequence
  chemically synthesized
tagcataaagtatatgctttca

SEQ ID NO: 1239566 - DNA, 22 bp, Artificial Sequence
  chemically synthesized
ttagcataaagtatatgctttc

SEQ ID NO: 1239567 - DNA, 22 bp, Artificial Sequence
  chemically synthesized
taaatttctttgaaagcatata

SEQ ID NO: 1239568 - DNA, 22 bp, Artificial Sequence
  chemically synthesized
aaatttctttgaaagcatatac

SEQ ID NO: 1239569 - DNA, 22 bp, Artificial Sequence
  chemically synthesized
aatttctttgaaagcatatact

SEQ ID NO: 1239570 - DNA, 22 bp, Artificial Sequence
  chemically synthesized
ggaatttttagcataaagtata

SEQ ID NO: 1239571 - DNA, 22 bp, Artificial Sequence
  chemically synthesized
ctttgaaagcatatactttatg

SEQ ID NO: 1239572 - DNA, 22 bp, Artificial Sequence
  chemically synthesized
tttgaaagcatatactttatgc

SEQ ID NO: 1239573 - DNA, 22 bp, Artificial Sequence
  chemically synthesized
taggaatttttagcataaagta

SEQ ID NO: 1239574 - DNA, 22 bp, Artificial Sequence
  chemically synthesized
tgaaagcatatactttatgcta

SEQ ID NO: 1239575 - DNA, 22 bp, Artificial Sequence
  chemically synthesized
gaaagcatatactttatgctaa

SEQ ID NO: 1239576 - DNA, 22 bp, Artificial Sequence
  chemically synthesized
aaagcatatactttatgctaaa

SEQ ID NO: 1239577 - DNA, 22 bp, Artificial Sequence
  chemically synthesized
tatgctaaaaattcctagagat

SEQ ID NO: 1239578 - DNA, 22 bp, Artificial Sequence
  chemically synthesized
atgctaaaaattcctagagatt

SEQ ID NO: 1239579 - DNA, 22 bp, Artificial Sequence
  chemically synthesized
tgctaaaaattcctagagattt

SEQ ID NO: 1239580 - DNA, 22 bp, Artificial Sequence
  chemically synthesized
aaagaagaaggcaaaatctcta

SEQ ID NO: 1239581 - DNA, 22 bp, Artificial Sequence
  chemically synthesized
aaaattcctagagattttgcct

SEQ ID NO: 1239582 - DNA, 22 bp, Artificial Sequence
  chemically synthesized
ctagagattttgccttcttctt

SEQ ID NO: 1239583 - DNA, 22 bp, Artificial Sequence
  chemically synthesized
gagattttgccttcttctttta

SEQ ID NO: 1239584 - DNA, 22 bp, Artificial Sequence
  chemically synthesized
aaacaagcatatattaaaagaa

SEQ ID NO: 1239585 - DNA, 22 bp, Artificial Sequence
  chemically synthesized
tgccttcttcttttaatatatg

SEQ ID NO: 1239586 - DNA, 22 bp, Artificial Sequence
  chemically synthesized
cgttgaaacaagcatatattaa

SEQ ID NO: 1239587 - DNA, 22 bp, Artificial Sequence
  chemically synthesized
gccttcttcttttaatatatgc

SEQ ID NO: 1239588 - DNA, 22 bp, Artificial Sequence
  chemically synthesized
acgttgaaacaagcatatatta

SEQ ID NO: 1239589 - DNA, 22 bp, Artificial Sequence
  chemically synthesized
ccttcttcttttaatatatgct

SEQ ID NO: 1239590 - DNA, 22 bp, Artificial Sequence
  chemically synthesized
tacgttgaaacaagcatatatt

SEQ ID NO: 1239591 - DNA, 22 bp, Artificial Sequence
  chemically synthesized
cttcttttaatatatgcttgtt

SEQ ID NO: 1239592 - DNA, 22 bp, Artificial Sequence
  chemically synthesized
ttcttttaatatatgcttgttt

SEQ ID NO: 1239593 - DNA, 22 bp, Artificial Sequence
  chemically synthesized
cttttaatatatgcttgtttca

SEQ ID NO: 1239594 - DNA, 22 bp, Artificial Sequence
  chemically synthesized
ttttaatatatgcttgtttcaa

SEQ ID NO: 1239595 - DNA, 22 bp, Artificial Sequence
  chemically synthesized
ttaatatatgcttgtttcaacg

SEQ ID NO: 1239596 - DNA, 22 bp, Artificial Sequence
  chemically synthesized
taatatatgcttgtttcaacgt

SEQ ID NO: 1239597 - DNA, 22 bp, Artificial Sequence
  chemically synthesized
aatatatgcttgtttcaacgta

SEQ ID NO: 1239598 - DNA, 22 bp, Artificial Sequence
  chemically synthesized
atatatgcttgtttcaacgtaa

SEQ ID NO: 1239599 - DNA, 22 bp, Artificial Sequence
  chemically synthesized
gtttcaacgtaaaactatttat

SEQ ID NO: 1239600 - DNA, 22 bp, Artificial Sequence
  chemically synthesized
tttcaacgtaaaactatttatt

SEQ ID NO: 1239601 - DNA, 22 bp, Artificial Sequence
  chemically synthesized
caacgtaaaactatttatttat

SEQ ID NO: 1239602 - DNA, 22 bp, Artificial Sequence
  chemically synthesized
aaaaaataaatgataaataaat

SEQ ID NO: 1239603 - DNA, 22 bp, Artificial Sequence
  chemically synthesized
aacgtaaaactatttatttatc

SEQ ID NO: 1239604 - DNA, 22 bp, Artificial Sequence
  chemically synthesized
tctcaaaaaataaatgataaat

SEQ ID NO: 1239605 - DNA, 22 bp, Artificial Sequence
  chemically synthesized
tgtctcaaaaaataaatgataa

SEQ ID NO: 1239606 - DNA, 22 bp, Artificial Sequence
  chemically synthesized
tttatttatcatttattttttg

SEQ ID NO: 1239607 - DNA, 22 bp, Artificial Sequence
  chemically synthesized
atttatcatttattttttgaga

SEQ ID NO: 1239608 - DNA, 22 bp, Artificial Sequence
  chemically synthesized
tttatcatttattttttgagac

SEQ ID NO: 1239609 - DNA, 22 bp, Artificial Sequence
  chemically synthesized
atcatttattttttgagacaga

SEQ ID NO: 1239610 - DNA, 22 bp, Artificial Sequence
  chemically synthesized
tcatttattttttgagacagag

SEQ ID NO: 1239611 - DNA, 22 bp, Artificial Sequence
  chemically synthesized
gcaacagagcgagactctgtct

SEQ ID NO: 1239612 - DNA, 22 bp, Artificial Sequence
  chemically synthesized
attttttgagacagagtctcgc

SEQ ID NO: 1239613 - DNA, 22 bp, Artificial Sequence
  chemically synthesized
ttttttgagacagagtctcgct

SEQ ID NO: 1239614 - DNA, 22 bp, Artificial Sequence
  chemically synthesized
cagcctggcaacagagcgagac

SEQ ID NO: 1239615 - DNA, 22 bp, Artificial Sequence
  chemically synthesized
tttgagacagagtctcgctctg

SEQ ID NO: 1239616 - DNA, 22 bp, Artificial Sequence
  chemically synthesized
ttgagacagagtctcgctctgt

SEQ ID NO: 1239617 - DNA, 22 bp, Artificial Sequence
  chemically synthesized
tgagacagagtctcgctctgtt

SEQ ID NO: 1239618 - DNA, 22 bp, Artificial Sequence
  chemically synthesized
gagacagagtctcgctctgttg

SEQ ID NO: 1239619 - DNA, 22 bp, Artificial Sequence
  chemically synthesized
agacagagtctcgctctgttgc

SEQ ID NO: 1239620 - DNA, 22 bp, Artificial Sequence
  chemically synthesized
cactccagcctggcaacagagc

SEQ ID NO: 1239621 - DNA, 22 bp, Artificial Sequence
  chemically synthesized
cgccactgcactccagcctggc

SEQ ID NO: 1239622 - DNA, 22 bp, Artificial Sequence
  chemically synthesized
gctctgttgccaggctggagtg

SEQ ID NO: 1239623 - DNA, 22 bp, Artificial Sequence
  chemically synthesized
tgttgccaggctggagtgcagt

SEQ ID NO: 1239624 - DNA, 22 bp, Artificial Sequence
  chemically synthesized
ttgccaggctggagtgcagtgg

SEQ ID NO: 1239625 - DNA, 22 bp, Artificial Sequence
  chemically synthesized
ccaggctggagtgcagtggcgc

SEQ ID NO: 1239626 - DNA, 22 bp, Artificial Sequence
  chemically synthesized
cagtgagccaagattgcgccac

SEQ ID NO: 1239627 - DNA, 22 bp, Artificial Sequence
  chemically synthesized
gagtgcagtggcgcaatcttgg

SEQ ID NO: 1239628 - DNA, 22 bp, Artificial Sequence
  chemically synthesized
ggaggcggaggttgcagtgagc

SEQ ID NO: 1239629 - DNA, 22 bp, Artificial Sequence
  chemically synthesized
aacctgggaggcggaggttgca

SEQ ID NO: 1239630 - DNA, 22 bp, Artificial Sequence
  chemically synthesized
gaacctgggaggcggaggttgc

SEQ ID NO: 1239631 - DNA, 22 bp, Artificial Sequence
  chemically synthesized
ggctcactgcaacctccgcctc

SEQ ID NO: 1239632 - DNA, 22 bp, Artificial Sequence
  chemically synthesized
gctcactgcaacctccgcctcc

SEQ ID NO: 1239633 - DNA, 22 bp, Artificial Sequence
  chemically synthesized
actgcaacctccgcctcccagg

SEQ ID NO: 1239634 - DNA, 22 bp, Artificial Sequence
  chemically synthesized
caacctccgcctcccaggttca

SEQ ID NO: 1239635 - DNA, 22 bp, Artificial Sequence
  chemically synthesized
aggcaggagaatcacttgaacc

SEQ ID NO: 1239636 - DNA, 22 bp, Artificial Sequence
  chemically synthesized
cgcctcccaggttcaagtgatt

SEQ ID NO: 1239637 - DNA, 22 bp, Artificial Sequence
  chemically synthesized
ggaggctgaggcaggagaatca

SEQ ID NO: 1239638 - DNA, 22 bp, Artificial Sequence
  chemically synthesized
ccaggttcaagtgattctcctg

SEQ ID NO: 1239639 - DNA, 22 bp, Artificial Sequence
  chemically synthesized
gggaggctgaggcaggagaatc

SEQ ID NO: 1239640 - DNA, 22 bp, Artificial Sequence
  chemically synthesized
cttgggaggctgaggcaggaga

SEQ ID NO: 1239641 - DNA, 22 bp, Artificial Sequence
  chemically synthesized
aagtgattctcctgcctcagcc

SEQ ID NO: 1239642 - DNA, 22 bp, Artificial Sequence
  chemically synthesized
tagtcccagctacttgggaggc

SEQ ID NO: 1239643 - DNA, 22 bp, Artificial Sequence
  chemically synthesized
tcctgcctcagcctcccaagta

SEQ ID NO: 1239644 - DNA, 22 bp, Artificial Sequence
  chemically synthesized
ctgcctcagcctcccaagtagc

SEQ ID NO: 1239645 - DNA, 22 bp, Artificial Sequence
  chemically synthesized
cctcagcctcccaagtagctgg

SEQ ID NO: 1239646 - DNA, 22 bp, Artificial Sequence
  chemically synthesized
agcctcccaagtagctgggact

SEQ ID NO: 1239647 - DNA, 22 bp, Artificial Sequence
  chemically synthesized
ccaagtagctgggactacaggc

SEQ ID NO: 1239648 - DNA, 22 bp, Artificial Sequence
  chemically synthesized
gacgtgatgacacatgcctgta

SEQ ID NO: 1239649 - DNA, 22 bp, Artificial Sequence
  chemically synthesized
agctggacgtgatgacacatgc

SEQ ID NO: 1239650 - DNA, 22 bp, Artificial Sequence
  chemically synthesized
ggactacaggcatgtgtcatca

SEQ ID NO: 1239651 - DNA, 22 bp, Artificial Sequence
  chemically synthesized
caggcatgtgtcatcacgtcca

SEQ ID NO: 1239652 - DNA, 22 bp, Artificial Sequence
  chemically synthesized
aaaatacaaaactgagctggac

SEQ ID NO: 1239653 - DNA, 22 bp, Artificial Sequence
  chemically synthesized
ctaaaaatacaaaactgagctg

SEQ ID NO: 1239654 - DNA, 22 bp, Artificial Sequence
  chemically synthesized
tactaaaaatacaaaactgagc

SEQ ID NO: 1239655 - DNA, 22 bp, Artificial Sequence
  chemically synthesized
agttttgtatttttagtagaga

SEQ ID NO: 1239656 - DNA, 22 bp, Artificial Sequence
  chemically synthesized
tgtatttttagtagagacgggg

SEQ ID NO: 1239657 - DNA, 22 bp, Artificial Sequence
  chemically synthesized
gtatttttagtagagacggggt

SEQ ID NO: 1239658 - DNA, 22 bp, Artificial Sequence
  chemically synthesized
tatttttagtagagacggggtt

SEQ ID NO: 1239659 - DNA, 22 bp, Artificial Sequence
  chemically synthesized
accaacatagtgaaaccccgtc

SEQ ID NO: 1239660 - DNA, 22 bp, Artificial Sequence
  chemically synthesized
ttagtagagacggggtttcact

SEQ ID NO: 1239661 - DNA, 22 bp, Artificial Sequence
  chemically synthesized
tagtagagacggggtttcacta

SEQ ID NO: 1239662 - DNA, 22 bp, Artificial Sequence
  chemically synthesized
agtagagacggggtttcactat

SEQ ID NO: 1239663 - DNA, 22 bp, Artificial Sequence
  chemically synthesized
gtagagacggggtttcactatg

SEQ ID NO: 1239664 - DNA, 22 bp, Artificial Sequence
  chemically synthesized
cactatgttggtcaggcttgtc

SEQ ID NO: 1239665 - DNA, 22 bp, Artificial Sequence
  chemically synthesized
actatgttggtcaggcttgtct

SEQ ID NO: 1239666 - DNA, 22 bp, Artificial Sequence
  chemically synthesized
tgttggtcaggcttgtctccat

SEQ ID NO: 1239667 - DNA, 22 bp, Artificial Sequence
  chemically synthesized
gtcaggcttgtctccatctctt

SEQ ID NO: 1239668 - DNA, 22 bp, Artificial Sequence
  chemically synthesized
gtctccatctcttgaccttgtg

SEQ ID NO: 1239669 - DNA, 22 bp, Artificial Sequence
  chemically synthesized
agggaggcggatcacaaggtca

SEQ ID NO: 1239670 - DNA, 22 bp, Artificial Sequence
  chemically synthesized
tctccatctcttgaccttgtga

SEQ ID NO: 1239671 - DNA, 22 bp, Artificial Sequence
  chemically synthesized
catctcttgaccttgtgatccg

SEQ ID NO: 1239672 - DNA, 22 bp, Artificial Sequence
  chemically synthesized
ggaagctgagggaggcggatca

SEQ ID NO: 1239673 - DNA, 22 bp, Artificial Sequence
  chemically synthesized
gggaagctgagggaggcggatc

SEQ ID NO: 1239674 - DNA, 22 bp, Artificial Sequence
  chemically synthesized
tgggaagctgagggaggcggat

SEQ ID NO: 1239675 - DNA, 22 bp, Artificial Sequence
  chemically synthesized
ttgaccttgtgatccgcctccc

SEQ ID NO: 1239676 - DNA, 22 bp, Artificial Sequence
  chemically synthesized
gaccttgtgatccgcctccctc

SEQ ID NO: 1239677 - DNA, 22 bp, Artificial Sequence
  chemically synthesized
accttgtgatccgcctccctca

SEQ ID NO: 1239678 - DNA, 22 bp, Artificial Sequence
  chemically synthesized
gtgatccgcctccctcagcttc

SEQ ID NO: 1239679 - DNA, 22 bp, Artificial Sequence
  chemically synthesized
tgatccgcctccctcagcttcc

SEQ ID NO: 1239680 - DNA, 22 bp, Artificial Sequence
  chemically synthesized
taatcccagtactttgggaagc

SEQ ID NO: 1239681 - DNA, 22 bp, Artificial Sequence
  chemically synthesized
cctcagcttcccaaagtactgg

SEQ ID NO: 1239682 - DNA, 22 bp, Artificial Sequence
  chemically synthesized
atgcctgtaatcccagtacttt

SEQ ID NO: 1239683 - DNA, 22 bp, Artificial Sequence
  chemically synthesized
agcttcccaaagtactgggatt

SEQ ID NO: 1239684 - DNA, 22 bp, Artificial Sequence
  chemically synthesized
cccaaagtactgggattacagg

SEQ ID NO: 1239685 - DNA, 22 bp, Artificial Sequence
  chemically synthesized
ccaaagtactgggattacaggc

SEQ ID NO: 1239686 - DNA, 22 bp, Artificial Sequence
  chemically synthesized
ggattacaggcatgagccatca

SEQ ID NO: 1239687 - DNA, 22 bp, Artificial Sequence
  chemically synthesized
cataagtccaggtgtgatggct

SEQ ID NO: 1239688 - DNA, 22 bp, Artificial Sequence
  chemically synthesized
acataagtccaggtgtgatggc

SEQ ID NO: 1239689 - DNA, 22 bp, Artificial Sequence
  chemically synthesized
tacataagtccaggtgtgatgg

SEQ ID NO: 1239690 - DNA, 22 bp, Artificial Sequence
  chemically synthesized
ttacataagtccaggtgtgatg

SEQ ID NO: 1239691 - DNA, 22 bp, Artificial Sequence
  chemically synthesized
caggcatgagccatcacacctg

SEQ ID NO: 1239692 - DNA, 22 bp, Artificial Sequence
  chemically synthesized
cttttacataagtccaggtgtg

SEQ ID NO: 1239693 - DNA, 22 bp, Artificial Sequence
  chemically synthesized
aaattacttttacataagtcca

SEQ ID NO: 1239694 - DNA, 22 bp, Artificial Sequence
  chemically synthesized
aaaattacttttacataagtcc

SEQ ID NO: 1239695 - DNA, 22 bp, Artificial Sequence
  chemically synthesized
aaaagtacttaaaattactttt

SEQ ID NO: 1239696 - DNA, 22 bp, Artificial Sequence
  chemically synthesized
gacttatgtaaaagtaatttta

SEQ ID NO: 1239697 - DNA, 22 bp, Artificial Sequence
  chemically synthesized
ctcaaaagtacttaaaattact

SEQ ID NO: 1239698 - DNA, 22 bp, Artificial Sequence
  chemically synthesized
actcaaaagtacttaaaattac

SEQ ID NO: 1239699 - DNA, 22 bp, Artificial Sequence
  chemically synthesized
tactcaaaagtacttaaaatta

SEQ ID NO: 1239700 - DNA, 22 bp, Artificial Sequence
  chemically synthesized
ttactcaaaagtacttaaaatt

SEQ ID NO: 1239701 - DNA, 22 bp, Artificial Sequence
  chemically synthesized
atgtaaaagtaattttaagtac

SEQ ID NO: 1239702 - DNA, 22 bp, Artificial Sequence
  chemically synthesized
tgtaaaagtaattttaagtact

SEQ ID NO: 1239703 - DNA, 22 bp, Artificial Sequence
  chemically synthesized
taagtacttttgagtaaaaatc

SEQ ID NO: 1239704 - DNA, 22 bp, Artificial Sequence
  chemically synthesized
aagtacttttgagtaaaaatct

SEQ ID NO: 1239705 - DNA, 22 bp, Artificial Sequence
  chemically synthesized
agtacttttgagtaaaaatctc

SEQ ID NO: 1239706 - DNA, 22 bp, Artificial Sequence
  chemically synthesized
ttgagtaaaaatctcccccacc

SEQ ID NO: 1239707 - DNA, 22 bp, Artificial Sequence
  chemically synthesized
tgagtaaaaatctcccccaccc

SEQ ID NO: 1239708 - DNA, 22 bp, Artificial Sequence
  chemically synthesized
gagtaaaaatctcccccacccc

SEQ ID NO: 1239709 - DNA, 22 bp, Artificial Sequence
  chemically synthesized
agtaaaaatctcccccaccccc

SEQ ID NO: 1239710 - DNA, 22 bp, Artificial Sequence
  chemically synthesized
ccccacccccgttcccacggtc

SEQ ID NO: 1239711 - DNA, 22 bp, Artificial Sequence
  chemically synthesized
aaaaaaaaaccacatcagaccg

SEQ ID NO: 1239712 - DNA, 22 bp, Artificial Sequence
  chemically synthesized
actaaaaaaaaaaccacatcag

SEQ ID NO: 1239713 - DNA, 22 bp, Artificial Sequence
  chemically synthesized
cactaaaaaaaaaaccacatca

SEQ ID NO: 1239714 - DNA, 22 bp, Artificial Sequence
  chemically synthesized
ccacggtctgatgtggtttttt

SEQ ID NO: 1239715 - DNA, 22 bp, Artificial Sequence
  chemically synthesized
atgtggttttttttttagtgaa

SEQ ID NO: 1239716 - DNA, 22 bp, Artificial Sequence
  chemically synthesized
aatgtagcacatttcactaaaa

SEQ ID NO: 1239717 - DNA, 22 bp, Artificial Sequence
  chemically synthesized
caggctaaatgtagcacatttc

SEQ ID NO: 1239718 - DNA, 22 bp, Artificial Sequence
  chemically synthesized
tttttttagtgaaatgtgctac

SEQ ID NO: 1239719 - DNA, 22 bp, Artificial Sequence
  chemically synthesized
ttttttagtgaaatgtgctaca

SEQ ID NO: 1239720 - DNA, 22 bp, Artificial Sequence
  chemically synthesized
tttttagtgaaatgtgctacat

SEQ ID NO: 1239721 - DNA, 22 bp, Artificial Sequence
  chemically synthesized
ttttagtgaaatgtgctacatt

SEQ ID NO: 1239722 - DNA, 22 bp, Artificial Sequence
  chemically synthesized
tttagtgaaatgtgctacattt

SEQ ID NO: 1239723 - DNA, 22 bp, Artificial Sequence
  chemically synthesized
ttagtgaaatgtgctacattta

SEQ ID NO: 1239724 - DNA, 22 bp, Artificial Sequence
  chemically synthesized
tagtgaaatgtgctacatttag

SEQ ID NO: 1239725 - DNA, 22 bp, Artificial Sequence
  chemically synthesized
taaagttacaggctaaatgtag

SEQ ID NO: 1239726 - DNA, 22 bp, Artificial Sequence
  chemically synthesized
agtgaaatgtgctacatttagc

SEQ ID NO: 1239727 - DNA, 22 bp, Artificial Sequence
  chemically synthesized
gtgaaatgtgctacatttagcc

SEQ ID NO: 1239728 - DNA, 22 bp, Artificial Sequence
  chemically synthesized
catttagcctgtaactttatag

SEQ ID NO: 1239729 - DNA, 22 bp, Artificial Sequence
  chemically synthesized
agcaccgaaaggtctataaagt

SEQ ID NO: 1239730 - DNA, 22 bp, Artificial Sequence
  chemically synthesized
agcctgtaactttatagacctt

SEQ ID NO: 1239731 - DNA, 22 bp, Artificial Sequence
  chemically synthesized
gcctgtaactttatagaccttt

SEQ ID NO: 1239732 - DNA, 22 bp, Artificial Sequence
  chemically synthesized
taactttatagacctttcggtg

SEQ ID NO: 1239733 - DNA, 22 bp, Artificial Sequence
  chemically synthesized
tatagacctttcggtgctcagt

SEQ ID NO: 1239734 - DNA, 22 bp, Artificial Sequence
  chemically synthesized
atagacctttcggtgctcagtt

SEQ ID NO: 1239735 - DNA, 22 bp, Artificial Sequence
  chemically synthesized
cagggagaataaaactgagcac

SEQ ID NO: 1239736 - DNA, 22 bp, Artificial Sequence
  chemically synthesized
tagacctttcggtgctcagttt

SEQ ID NO: 1239737 - DNA, 22 bp, Artificial Sequence
  chemically synthesized
atactacagggagaataaaact

SEQ ID NO: 1239738 - DNA, 22 bp, Artificial Sequence
  chemically synthesized
tcggtgctcagttttattctcc

SEQ ID NO: 1239739 - DNA, 22 bp, Artificial Sequence
  chemically synthesized
cggtgctcagttttattctccc

SEQ ID NO: 1239740 - DNA, 22 bp, Artificial Sequence
  chemically synthesized
ggtgctcagttttattctccct

SEQ ID NO: 1239741 - DNA, 22 bp, Artificial Sequence
  chemically synthesized
gggtattcatactacagggaga

SEQ ID NO: 1239742 - DNA, 22 bp, Artificial Sequence
  chemically synthesized
agttttattctccctgtagtat

SEQ ID NO: 1239743 - DNA, 22 bp, Artificial Sequence
  chemically synthesized
cctggggtattcatactacagg

SEQ ID NO: 1239744 - DNA, 22 bp, Artificial Sequence
  chemically synthesized
acctggggtattcatactacag

SEQ ID NO: 1239745 - DNA, 22 bp, Artificial Sequence
  chemically synthesized
tacctggggtattcatactaca

SEQ ID NO: 1239746 - DNA, 22 bp, Artificial Sequence
  chemically synthesized
tattctccctgtagtatgaata

SEQ ID NO: 1239747 - DNA, 22 bp, Artificial Sequence
  chemically synthesized
attctccctgtagtatgaatac

SEQ ID NO: 1239748 - DNA, 22 bp, Artificial Sequence
  chemically synthesized
ttctccctgtagtatgaatacc

SEQ ID NO: 1239749 - DNA, 22 bp, Artificial Sequence
  chemically synthesized
gattttacctggggtattcata

SEQ ID NO: 1239750 - DNA, 22 bp, Artificial Sequence
  chemically synthesized
tccctgtagtatgaatacccca

SEQ ID NO: 1239751 - DNA, 22 bp, Artificial Sequence
  chemically synthesized
cctgtagtatgaataccccagg

SEQ ID NO: 1239752 - DNA, 22 bp, Artificial Sequence
  chemically synthesized
tagtatgaataccccaggtaaa

SEQ ID NO: 1239753 - DNA, 22 bp, Artificial Sequence
  chemically synthesized
gaaccatccaagagaaatagta

SEQ ID NO: 1239754 - DNA, 22 bp, Artificial Sequence
  chemically synthesized
acatactatttctcttggatgg

SEQ ID NO: 1239755 - DNA, 22 bp, Artificial Sequence
  chemically synthesized
caggcaggaaaattagaaccat

SEQ ID NO: 1239756 - DNA, 22 bp, Artificial Sequence
  chemically synthesized
tttctcttggatggttctaatt

SEQ ID NO: 1239757 - DNA, 22 bp, Artificial Sequence
  chemically synthesized
ctcttggatggttctaattttc

SEQ ID NO: 1239758 - DNA, 22 bp, Artificial Sequence
  chemically synthesized
tcttggatggttctaattttcc

SEQ ID NO: 1239759 - DNA, 22 bp, Artificial Sequence
  chemically synthesized
ttggatggttctaattttcctg

SEQ ID NO: 1239760 - DNA, 22 bp, Artificial Sequence
  chemically synthesized
ggatggttctaattttcctgcc

SEQ ID NO: 1239761 - DNA, 22 bp, Artificial Sequence
  chemically synthesized
gatggttctaattttcctgcct

SEQ ID NO: 1239762 - DNA, 22 bp, Artificial Sequence
  chemically synthesized
tagagtaagttgcaggcaggaa

SEQ ID NO: 1239763 - DNA, 22 bp, Artificial Sequence
  chemically synthesized
tatagagtaagttgcaggcagg

SEQ ID NO: 1239764 - DNA, 22 bp, Artificial Sequence
  chemically synthesized
taattttcctgcctgcaactta

SEQ ID NO: 1239765 - DNA, 22 bp, Artificial Sequence
  chemically synthesized
taattctatagagtaagttgca

SEQ ID NO: 1239766 - DNA, 22 bp, Artificial Sequence
  chemically synthesized
attttcctgcctgcaacttact

SEQ ID NO: 1239767 - DNA, 22 bp, Artificial Sequence
  chemically synthesized
tcctgcctgcaacttactctat

SEQ ID NO: 1239768 - DNA, 22 bp, Artificial Sequence
  chemically synthesized
cctgcctgcaacttactctata

SEQ ID NO: 1239769 - DNA, 22 bp, Artificial Sequence
  chemically synthesized
ctgcctgcaacttactctatag

SEQ ID NO: 1239770 - DNA, 22 bp, Artificial Sequence
  chemically synthesized
tagtatctataattctatagag

SEQ ID NO: 1239771 - DNA, 22 bp, Artificial Sequence
  chemically synthesized
cctgcaacttactctatagaat

SEQ ID NO: 1239772 - DNA, 22 bp, Artificial Sequence
  chemically synthesized
ctatagtatctataattctata

SEQ ID NO: 1239773 - DNA, 22 bp, Artificial Sequence
  chemically synthesized
gctatagtatctataattctat

SEQ ID NO: 1239774 - DNA, 22 bp, Artificial Sequence
  chemically synthesized
caacttactctatagaattata

SEQ ID NO: 1239775 - DNA, 22 bp, Artificial Sequence
  chemically synthesized
tgctatagtatctataattcta

SEQ ID NO: 1239776 - DNA, 22 bp, Artificial Sequence
  chemically synthesized
ttgctatagtatctataattct

SEQ ID NO: 1239777 - DNA, 22 bp, Artificial Sequence
  chemically synthesized
cttttgctatagtatctataat

SEQ ID NO: 1239778 - DNA, 22 bp, Artificial Sequence
  chemically synthesized
actctatagaattatagatact

SEQ ID NO: 1239779 - DNA, 22 bp, Artificial Sequence
  chemically synthesized
ctctatagaattatagatacta

SEQ ID NO: 1239780 - DNA, 22 bp, Artificial Sequence
  chemically synthesized
ggttacttttgctatagtatct

SEQ ID NO: 1239781 - DNA, 22 bp, Artificial Sequence
  chemically synthesized
tatagaattatagatactatag

SEQ ID NO: 1239782 - DNA, 22 bp, Artificial Sequence
  chemically synthesized
gggttacttttgctatagtatc

SEQ ID NO: 1239783 - DNA, 22 bp, Artificial Sequence
  chemically synthesized
tagaattatagatactatagca

SEQ ID NO: 1239784 - DNA, 22 bp, Artificial Sequence
  chemically synthesized
aaacttgggttacttttgctat

SEQ ID NO: 1239785 - DNA, 22 bp, Artificial Sequence
  chemically synthesized
tgaaacttgggttacttttgct

SEQ ID NO: 1239786 - DNA, 22 bp, Artificial Sequence
  chemically synthesized
ctgaaacttgggttacttttgc

SEQ ID NO: 1239787 - DNA, 22 bp, Artificial Sequence
  chemically synthesized
tagatactatagcaaaagtaac

SEQ ID NO: 1239788 - DNA, 22 bp, Artificial Sequence
  chemically synthesized
cttctgaaacttgggttacttt

SEQ ID NO: 1239789 - DNA, 22 bp, Artificial Sequence
  chemically synthesized
tgcttctgaaacttgggttact

SEQ ID NO: 1239790 - DNA, 22 bp, Artificial Sequence
  chemically synthesized
ctgcttctgaaacttgggttac

SEQ ID NO: 1239791 - DNA, 22 bp, Artificial Sequence
  chemically synthesized
tttctgcttctgaaacttgggt

SEQ ID NO: 1239792 - DNA, 22 bp, Artificial Sequence
  chemically synthesized
tagcaaaagtaacccaagtttc

SEQ ID NO: 1239793 - DNA, 22 bp, Artificial Sequence
  chemically synthesized
gctatttctgcttctgaaactt

SEQ ID NO: 1239794 - DNA, 22 bp, Artificial Sequence
  chemically synthesized
agaagttagctatttctgcttc

SEQ ID NO: 1239795 - DNA, 22 bp, Artificial Sequence
  chemically synthesized
agttcagaagttagctatttct

SEQ ID NO: 1239796 - DNA, 22 bp, Artificial Sequence
  chemically synthesized
cagaagcagaaatagctaactt

SEQ ID NO: 1239797 - DNA, 22 bp, Artificial Sequence
  chemically synthesized
agaagcagaaatagctaacttc

SEQ ID NO: 1239798 - DNA, 22 bp, Artificial Sequence
  chemically synthesized
gtgagtgagtgagagacctgag

SEQ ID NO: 1239799 - DNA, 22 bp, Artificial Sequence
  chemically synthesized
acttctgaactcaggtctctca

SEQ ID NO: 1239800 - DNA, 22 bp, Artificial Sequence
  chemically synthesized
ctgaactcaggtctctcactca

SEQ ID NO: 1239801 - DNA, 22 bp, Artificial Sequence
  chemically synthesized
tgaactcaggtctctcactcac

SEQ ID NO: 1239802 - DNA, 22 bp, Artificial Sequence
  chemically synthesized
aactcaggtctctcactcactc

SEQ ID NO: 1239803 - DNA, 22 bp, Artificial Sequence
  chemically synthesized
aggtctctcactcactcactag

SEQ ID NO: 1239804 - DNA, 22 bp, Artificial Sequence
  chemically synthesized
cccaagataacacagctagtga

SEQ ID NO: 1239805 - DNA, 22 bp, Artificial Sequence
  chemically synthesized
gcccaagataacacagctagtg

SEQ ID NO: 1239806 - DNA, 22 bp, Artificial Sequence
  chemically synthesized
tcactcactcactagctgtgtt

SEQ ID NO: 1239807 - DNA, 22 bp, Artificial Sequence
  chemically synthesized
actcactcactagctgtgttat

SEQ ID NO: 1239808 - DNA, 22 bp, Artificial Sequence
  chemically synthesized
tcacttgcccaagataacacag

SEQ ID NO: 1239809 - DNA, 22 bp, Artificial Sequence
  chemically synthesized
actcactagctgtgttatcttg

SEQ ID NO: 1239810 - DNA, 22 bp, Artificial Sequence
  chemically synthesized
actagctgtgttatcttgggca

SEQ ID NO: 1239811 - DNA, 22 bp, Artificial Sequence
  chemically synthesized
agaaaggctgtcacttgcccaa

SEQ ID NO: 1239812 - DNA, 22 bp, Artificial Sequence
  chemically synthesized
gctgtgttatcttgggcaagtg

SEQ ID NO: 1239813 - DNA, 22 bp, Artificial Sequence
  chemically synthesized
tgttatcttgggcaagtgacag

SEQ ID NO: 1239814 - DNA, 22 bp, Artificial Sequence
  chemically synthesized
tgcctcagaaaggctgtcactt

SEQ ID NO: 1239815 - DNA, 22 bp, Artificial Sequence
  chemically synthesized
tcttgggcaagtgacagccttt

SEQ ID NO: 1239816 - DNA, 22 bp, Artificial Sequence
  chemically synthesized
gggcaagtgacagcctttctga

SEQ ID NO: 1239817 - DNA, 22 bp, Artificial Sequence
  chemically synthesized
ggcaagtgacagcctttctgag

SEQ ID NO: 1239818 - DNA, 22 bp, Artificial Sequence
  chemically synthesized
atagtgaataaattgtgcctca

SEQ ID NO: 1239819 - DNA, 22 bp, Artificial Sequence
  chemically synthesized
taatagtgaataaattgtgcct

SEQ ID NO: 1239820 - DNA, 22 bp, Artificial Sequence
  chemically synthesized
tctgaggcacaatttattcact

SEQ ID NO: 1239821 - DNA, 22 bp, Artificial Sequence
  chemically synthesized
ctgaggcacaatttattcacta

SEQ ID NO: 1239822 - DNA, 22 bp, Artificial Sequence
  chemically synthesized
tgaggcacaatttattcactat

SEQ ID NO: 1239823 - DNA, 22 bp, Artificial Sequence
  chemically synthesized
agccccattctaatagtgaata

SEQ ID NO: 1239824 - DNA, 22 bp, Artificial Sequence
  chemically synthesized
gagccccattctaatagtgaat

SEQ ID NO: 1239825 - DNA, 22 bp, Artificial Sequence
  chemically synthesized
aggcacaatttattcactatta

SEQ ID NO: 1239826 - DNA, 22 bp, Artificial Sequence
  chemically synthesized
attcactattagaatggggctc

SEQ ID NO: 1239827 - DNA, 22 bp, Artificial Sequence
  chemically synthesized
gagtaataatttgagccccatt

SEQ ID NO: 1239828 - DNA, 22 bp, Artificial Sequence
  chemically synthesized
ttcactattagaatggggctca

SEQ ID NO: 1239829 - DNA, 22 bp, Artificial Sequence
  chemically synthesized
tggagtaataatttgagcccca

SEQ ID NO: 1239830 - DNA, 22 bp, Artificial Sequence
  chemically synthesized
actattagaatggggctcaaat

SEQ ID NO: 1239831 - DNA, 22 bp, Artificial Sequence
  chemically synthesized
ttagaatggggctcaaattatt

SEQ ID NO: 1239832 - DNA, 22 bp, Artificial Sequence
  chemically synthesized
gaatggggctcaaattattact

SEQ ID NO: 1239833 - DNA, 22 bp, Artificial Sequence
  chemically synthesized
acgggagtgctctggagtaata

SEQ ID NO: 1239834 - DNA, 22 bp, Artificial Sequence
  chemically synthesized
aacctcacgggagtgctctgga

SEQ ID NO: 1239835 - DNA, 22 bp, Artificial Sequence
  chemically synthesized
aaattattactccagagcactc

SEQ ID NO: 1239836 - DNA, 22 bp, Artificial Sequence
  chemically synthesized
cagttgaacctcacgggagtgc

SEQ ID NO: 1239837 - DNA, 22 bp, Artificial Sequence
  chemically synthesized
ttactccagagcactcccgtga

SEQ ID NO: 1239838 - DNA, 22 bp, Artificial Sequence
  chemically synthesized
ctccagagcactcccgtgaggt

SEQ ID NO: 1239839 - DNA, 22 bp, Artificial Sequence
  chemically synthesized
tgtgttgcagttgaacctcacg

SEQ ID NO: 1239840 - DNA, 22 bp, Artificial Sequence
  chemically synthesized
cagagcactcccgtgaggttca

SEQ ID NO: 1239841 - DNA, 22 bp, Artificial Sequence
  chemically synthesized
ctatgtgttgcagttgaacctc

SEQ ID NO: 1239842 - DNA, 22 bp, Artificial Sequence
  chemically synthesized
ccgtgaggttcaactgcaacac

SEQ ID NO: 1239843 - DNA, 22 bp, Artificial Sequence
  chemically synthesized
tataacgttcctatgtgttgca

SEQ ID NO: 1239844 - DNA, 22 bp, Artificial Sequence
  chemically synthesized
aactgcaacacataggaacgtt

SEQ ID NO: 1239845 - DNA, 22 bp, Artificial Sequence
  chemically synthesized
ccaaatctgtataacgttccta

SEQ ID NO: 1239846 - DNA, 22 bp, Artificial Sequence
  chemically synthesized
gccaaatctgtataacgttcct

SEQ ID NO: 1239847 - DNA, 22 bp, Artificial Sequence
  chemically synthesized
caacacataggaacgttataca

SEQ ID NO: 1239848 - DNA, 22 bp, Artificial Sequence
  chemically synthesized
agtgcatacgatttgccaaatc

SEQ ID NO: 1239849 - DNA, 22 bp, Artificial Sequence
  chemically synthesized
ttgagtgcatacgatttgccaa

SEQ ID NO: 1239850 - DNA, 22 bp, Artificial Sequence
  chemically synthesized
attgagtgcatacgatttgcca

SEQ ID NO: 1239851 - DNA, 22 bp, Artificial Sequence
  chemically synthesized
tacagatttggcaaatcgtatg

SEQ ID NO: 1239852 - DNA, 22 bp, Artificial Sequence
  chemically synthesized
tatttattgagtgcatacgatt

SEQ ID NO: 1239853 - DNA, 22 bp, Artificial Sequence
  chemically synthesized
ggcaaatcgtatgcactcaata

SEQ ID NO: 1239854 - DNA, 22 bp, Artificial Sequence
  chemically synthesized
gcaaatcgtatgcactcaataa

SEQ ID NO: 1239855 - DNA, 22 bp, Artificial Sequence
  chemically synthesized
aaatgaaacataaaaatcaatc

SEQ ID NO: 1239856 - DNA, 22 bp, Artificial Sequence
  chemically synthesized
aataaatatagattgattttta

SEQ ID NO: 1239857 - DNA, 22 bp, Artificial Sequence
  chemically synthesized
atttttatgtttcattttaaca

SEQ ID NO: 1239858 - DNA, 22 bp, Artificial Sequence
  chemically synthesized
ttatgtttcattttaacactat

SEQ ID NO: 1239859 - DNA, 22 bp, Artificial Sequence
  chemically synthesized
tatgtttcattttaacactatt

SEQ ID NO: 1239860 - DNA, 22 bp, Artificial Sequence
  chemically synthesized
atgtttcattttaacactattt

SEQ ID NO: 1239861 - DNA, 22 bp, Artificial Sequence
  chemically synthesized
tgtttcattttaacactatttg

SEQ ID NO: 1239862 - DNA, 22 bp, Artificial Sequence
  chemically synthesized
cattttaacactatttgtctgc

SEQ ID NO: 1239863 - DNA, 22 bp, Artificial Sequence
  chemically synthesized
attttaacactatttgtctgca

SEQ ID NO: 1239864 - DNA, 22 bp, Artificial Sequence
  chemically synthesized
gtcaaagaaagagatgcagaca

SEQ ID NO: 1239865 - DNA, 22 bp, Artificial Sequence
  chemically synthesized
ggtcaaagaaagagatgcagac

SEQ ID NO: 1239866 - DNA, 22 bp, Artificial Sequence
  chemically synthesized
taacactatttgtctgcatctc

SEQ ID NO: 1239867 - DNA, 22 bp, Artificial Sequence
  chemically synthesized
aacactatttgtctgcatctct

SEQ ID NO: 1239868 - DNA, 22 bp, Artificial Sequence
  chemically synthesized
acactatttgtctgcatctctt

SEQ ID NO: 1239869 - DNA, 22 bp, Artificial Sequence
  chemically synthesized
gaatttggtcaaagaaagagat

SEQ ID NO: 1239870 - DNA, 22 bp, Artificial Sequence
  chemically synthesized
tttgtctgcatctctttctttg

SEQ ID NO: 1239871 - DNA, 22 bp, Artificial Sequence
  chemically synthesized
gtctgcatctctttctttgacc

SEQ ID NO: 1239872 - DNA, 22 bp, Artificial Sequence
  chemically synthesized
cacctagaatttggtcaaagaa

SEQ ID NO: 1239873 - DNA, 22 bp, Artificial Sequence
  chemically synthesized
tctgcatctctttctttgacca

SEQ ID NO: 1239874 - DNA, 22 bp, Artificial Sequence
  chemically synthesized
acacctagaatttggtcaaaga

SEQ ID NO: 1239875 - DNA, 22 bp, Artificial Sequence
  chemically synthesized
tacacctagaatttggtcaaag

SEQ ID NO: 1239876 - DNA, 22 bp, Artificial Sequence
  chemically synthesized
ttacacctagaatttggtcaaa

SEQ ID NO: 1239877 - DNA, 22 bp, Artificial Sequence
  chemically synthesized
catctctttctttgaccaaatt

SEQ ID NO: 1239878 - DNA, 22 bp, Artificial Sequence
  chemically synthesized
aacgtttttacacctagaattt

SEQ ID NO: 1239879 - DNA, 22 bp, Artificial Sequence
  chemically synthesized
tttctttgaccaaattctaggt

SEQ ID NO: 1239880 - DNA, 22 bp, Artificial Sequence
  chemically synthesized
tctttgaccaaattctaggtgt

SEQ ID NO: 1239881 - DNA, 22 bp, Artificial Sequence
  chemically synthesized
ctttgaccaaattctaggtgta

SEQ ID NO: 1239882 - DNA, 22 bp, Artificial Sequence
  chemically synthesized
tttgaccaaattctaggtgtaa

SEQ ID NO: 1239883 - DNA, 22 bp, Artificial Sequence
  chemically synthesized
tgaccaaattctaggtgtaaaa

SEQ ID NO: 1239884 - DNA, 22 bp, Artificial Sequence
  chemically synthesized
gaccaaattctaggtgtaaaaa

SEQ ID NO: 1239885 - DNA, 22 bp, Artificial Sequence
  chemically synthesized
accaaattctaggtgtaaaaac

SEQ ID NO: 1239886 - DNA, 22 bp, Artificial Sequence
  chemically synthesized
gccgagttaaacgtttttacac

SEQ ID NO: 1239887 - DNA, 22 bp, Artificial Sequence
  chemically synthesized
cacctggccgagttaaacgttt

SEQ ID NO: 1239888 - DNA, 22 bp, Artificial Sequence
  chemically synthesized
taggtgtaaaaacgtttaactc

SEQ ID NO: 1239889 - DNA, 22 bp, Artificial Sequence
  chemically synthesized
ggtgtaaaaacgtttaactcgg

SEQ ID NO: 1239890 - DNA, 22 bp, Artificial Sequence
  chemically synthesized
caggtgtgagccactgcacctg

SEQ ID NO: 1239891 - DNA, 22 bp, Artificial Sequence
  chemically synthesized
aactcggccaggtgcagtggct

SEQ ID NO: 1239892 - DNA, 22 bp, Artificial Sequence
  chemically synthesized
actcggccaggtgcagtggctc

SEQ ID NO: 1239893 - DNA, 22 bp, Artificial Sequence
  chemically synthesized
ggattacaggtgtgagccactg

SEQ ID NO: 1239894 - DNA, 22 bp, Artificial Sequence
  chemically synthesized
ggccaggtgcagtggctcacac

SEQ ID NO: 1239895 - DNA, 22 bp, Artificial Sequence
  chemically synthesized
agcgtcccaaagtgctaggatt

SEQ ID NO: 1239896 - DNA, 22 bp, Artificial Sequence
  chemically synthesized
acacctgtaatcctagcacttt

SEQ ID NO: 1239897 - DNA, 22 bp, Artificial Sequence
  chemically synthesized
cctcagcgtcccaaagtgctag

SEQ ID NO: 1239898 - DNA, 22 bp, Artificial Sequence
  chemically synthesized
taatcctagcactttgggacgc

SEQ ID NO: 1239899 - DNA, 22 bp, Artificial Sequence
  chemically synthesized
agtgagccacctgcctcagcgt

SEQ ID NO: 1239900 - DNA, 22 bp, Artificial Sequence
  chemically synthesized
aagtgagccacctgcctcagcg

SEQ ID NO: 1239901 - DNA, 22 bp, Artificial Sequence
  chemically synthesized
gcactttgggacgctgaggcag

SEQ ID NO: 1239902 - DNA, 22 bp, Artificial Sequence
  chemically synthesized
accttaagtgagccacctgcct

SEQ ID NO: 1239903 - DNA, 22 bp, Artificial Sequence
  chemically synthesized
tgggacgctgaggcaggtggct

SEQ ID NO: 1239904 - DNA, 22 bp, Artificial Sequence
  chemically synthesized
gggacgctgaggcaggtggctc

SEQ ID NO: 1239905 - DNA, 22 bp, Artificial Sequence
  chemically synthesized
ctgaccttaagtgagccacctg

SEQ ID NO: 1239906 - DNA, 22 bp, Artificial Sequence
  chemically synthesized
ggacgctgaggcaggtggctca

SEQ ID NO: 1239907 - DNA, 22 bp, Artificial Sequence
  chemically synthesized
gaactcctgaccttaagtgagc

SEQ ID NO: 1239908 - DNA, 22 bp, Artificial Sequence
  chemically synthesized
aggcaggtggctcacttaaggt

SEQ ID NO: 1239909 - DNA, 22 bp, Artificial Sequence
  chemically synthesized
gtctcgaactcctgaccttaag

SEQ ID NO: 1239910 - DNA, 22 bp, Artificial Sequence
  chemically synthesized
gccaggctggtctcgaactcct

SEQ ID NO: 1239911 - DNA, 22 bp, Artificial Sequence
  chemically synthesized
acttaaggtcaggagttcgaga

SEQ ID NO: 1239912 - DNA, 22 bp, Artificial Sequence
  chemically synthesized
aaggtcaggagttcgagaccag

SEQ ID NO: 1239913 - DNA, 22 bp, Artificial Sequence
  chemically synthesized
aggtcaggagttcgagaccagc

SEQ ID NO: 1239914 - DNA, 22 bp, Artificial Sequence
  chemically synthesized
accatgttggccaggctggtct

SEQ ID NO: 1239915 - DNA, 22 bp, Artificial Sequence
  chemically synthesized
gaccatgttggccaggctggtc

SEQ ID NO: 1239916 - DNA, 22 bp, Artificial Sequence
  chemically synthesized
gagaccagcctggccaacatgg

SEQ ID NO: 1239917 - DNA, 22 bp, Artificial Sequence
  chemically synthesized
gtagagacatggtttgaccatg

SEQ ID NO: 1239918 - DNA, 22 bp, Artificial Sequence
  chemically synthesized
agtagagacatggtttgaccat

SEQ ID NO: 1239919 - DNA, 22 bp, Artificial Sequence
  chemically synthesized
tagtagagacatggtttgacca

SEQ ID NO: 1239920 - DNA, 22 bp, Artificial Sequence
  chemically synthesized
ttagtagagacatggtttgacc

SEQ ID NO: 1239921 - DNA, 22 bp, Artificial Sequence
  chemically synthesized
gccaacatggtcaaaccatgtc

SEQ ID NO: 1239922 - DNA, 22 bp, Artificial Sequence
  chemically synthesized
tatttttagtagagacatggtt

SEQ ID NO: 1239923 - DNA, 22 bp, Artificial Sequence
  chemically synthesized
gtatttttagtagagacatggt

SEQ ID NO: 1239924 - DNA, 22 bp, Artificial Sequence
  chemically synthesized
ttgtatttttagtagagacatg

SEQ ID NO: 1239925 - DNA, 22 bp, Artificial Sequence
  chemically synthesized
attcttgtatttttagtagaga

SEQ ID NO: 1239926 - DNA, 22 bp, Artificial Sequence
  chemically synthesized
tactaaaaatacaagaattagc

SEQ ID NO: 1239927 - DNA, 22 bp, Artificial Sequence
  chemically synthesized
ctaaaaatacaagaattagctg

SEQ ID NO: 1239928 - DNA, 22 bp, Artificial Sequence
  chemically synthesized
aaaatacaagaattagctgggc

SEQ ID NO: 1239929 - DNA, 22 bp, Artificial Sequence
  chemically synthesized
ggatcacaggtgtgtgccacca

SEQ ID NO: 1239930 - DNA, 22 bp, Artificial Sequence
  chemically synthesized
gctgggcgtggtggcacacacc

SEQ ID NO: 1239931 - DNA, 22 bp, Artificial Sequence
  chemically synthesized
ggcgtggtggcacacacctgtg

SEQ ID NO: 1239932 - DNA, 22 bp, Artificial Sequence
  chemically synthesized
gagtagttgggatcacaggtgt

SEQ ID NO: 1239933 - DNA, 22 bp, Artificial Sequence
  chemically synthesized
tcgagtagttgggatcacaggt

SEQ ID NO: 1239934 - DNA, 22 bp, Artificial Sequence
  chemically synthesized
agcctctcgagtagttgggatc

SEQ ID NO: 1239935 - DNA, 22 bp, Artificial Sequence
  chemically synthesized
cctcagcctctcgagtagttgg

SEQ ID NO: 1239936 - DNA, 22 bp, Artificial Sequence
  chemically synthesized
ctgcctcagcctctcgagtagt

SEQ ID NO: 1239937 - DNA, 22 bp, Artificial Sequence
  chemically synthesized
tcctgcctcagcctctcgagta

SEQ ID NO: 1239938 - DNA, 22 bp, Artificial Sequence
  chemically synthesized
tgatcccaactactcgagaggc

SEQ ID NO: 1239939 - DNA, 22 bp, Artificial Sequence
  chemically synthesized
gcgattctcctgcctcagcctc

SEQ ID NO: 1239940 - DNA, 22 bp, Artificial Sequence
  chemically synthesized
tagcgattctcctgcctcagcc

SEQ ID NO: 1239941 - DNA, 22 bp, Artificial Sequence
  chemically synthesized
gttctagcgattctcctgcctc

SEQ ID NO: 1239942 - DNA, 22 bp, Artificial Sequence
  chemically synthesized
ctcgagaggctgaggcaggaga

SEQ ID NO: 1239943 - DNA, 22 bp, Artificial Sequence
  chemically synthesized
ctagttctagcgattctcctgc

SEQ ID NO: 1239944 - DNA, 22 bp, Artificial Sequence
  chemically synthesized
gagaggctgaggcaggagaatc

SEQ ID NO: 1239945 - DNA, 22 bp, Artificial Sequence
  chemically synthesized
cctagttctagcgattctcctg

SEQ ID NO: 1239946 - DNA, 22 bp, Artificial Sequence
  chemically synthesized
caccttcctagttctagcgatt

SEQ ID NO: 1239947 - DNA, 22 bp, Artificial Sequence
  chemically synthesized
aggcaggagaatcgctagaact

SEQ ID NO: 1239948 - DNA, 22 bp, Artificial Sequence
  chemically synthesized
caacctccaccttcctagttct

SEQ ID NO: 1239949 - DNA, 22 bp, Artificial Sequence
  chemically synthesized
actgcaacctccaccttcctag

SEQ ID NO: 1239950 - DNA, 22 bp, Artificial Sequence
  chemically synthesized
ggctcactgcaacctccacctt

SEQ ID NO: 1239951 - DNA, 22 bp, Artificial Sequence
  chemically synthesized
gaactaggaaggtggaggttgc

SEQ ID NO: 1239952 - DNA, 22 bp, Artificial Sequence
  chemically synthesized
ggaaggtggaggttgcagtgag

SEQ ID NO: 1239953 - DNA, 22 bp, Artificial Sequence
  chemically synthesized
cagtgagccgagatcgtgccac

SEQ ID NO: 1239954 - DNA, 22 bp, Artificial Sequence
  chemically synthesized
gtcacaaaggccggagtgcagt

SEQ ID NO: 1239955 - DNA, 22 bp, Artificial Sequence
  chemically synthesized
cgtcacaaaggccggagtgcag

SEQ ID NO: 1239956 - DNA, 22 bp, Artificial Sequence
  chemically synthesized
cttcgtcacaaaggccggagtg

SEQ ID NO: 1239957 - DNA, 22 bp, Artificial Sequence
  chemically synthesized
gcttcgtcacaaaggccggagt

SEQ ID NO: 1239958 - DNA, 22 bp, Artificial Sequence
  chemically synthesized
cactccggcctttgtgacgaag

SEQ ID NO: 1239959 - DNA, 22 bp, Artificial Sequence
  chemically synthesized
cggcctttgtgacgaagcaaga

SEQ ID NO: 1239960 - DNA, 22 bp, Artificial Sequence
  chemically synthesized
tgtgacgaagcaagatctcaca

SEQ ID NO: 1239961 - DNA, 22 bp, Artificial Sequence
  chemically synthesized
gtgacgaagcaagatctcacac

SEQ ID NO: 1239962 - DNA, 22 bp, Artificial Sequence
  chemically synthesized
tgacgaagcaagatctcacaca

SEQ ID NO: 1239963 - DNA, 22 bp, Artificial Sequence
  chemically synthesized
acacacacacacacacacacac

SEQ ID NO: 1239964 - DNA, 22 bp, Artificial Sequence
  chemically synthesized
tgtgtgtgtgtgtgtgtgtgtg

SEQ ID NO: 1239965 - DNA, 22 bp, Artificial Sequence
  chemically synthesized
gtgtgtgtgtgtgtgtgtgtgt

SEQ ID NO: 1239966 - DNA, 22 bp, Artificial Sequence
  chemically synthesized
acttgtgtgtgtgtgtgtgtgt

SEQ ID NO: 1239967 - DNA, 22 bp, Artificial Sequence
  chemically synthesized
aacttgtgtgtgtgtgtgtgtg

SEQ ID NO: 1239968 - DNA, 22 bp, Artificial Sequence
  chemically synthesized
taacttgtgtgtgtgtgtgtgt

SEQ ID NO: 1239969 - DNA, 22 bp, Artificial Sequence
  chemically synthesized
tcgaaaagactttaacttgtgt

SEQ ID NO: 1239970 - DNA, 22 bp, Artificial Sequence
  chemically synthesized
tattatcgaaaagactttaact

SEQ ID NO: 1239971 - DNA, 22 bp, Artificial Sequence
  chemically synthesized
atattatcgaaaagactttaac

SEQ ID NO: 1239972 - DNA, 22 bp, Artificial Sequence
  chemically synthesized
tatattatcgaaaagactttaa

SEQ ID NO: 1239973 - DNA, 22 bp, Artificial Sequence
  chemically synthesized
ttatattatcgaaaagacttta

SEQ ID NO: 1239974 - DNA, 22 bp, Artificial Sequence
  chemically synthesized
atataatatttttatattatcg

SEQ ID NO: 1239975 - DNA, 22 bp, Artificial Sequence
  chemically synthesized
taatataatatttttatattat

SEQ ID NO: 1239976 - DNA, 22 bp, Artificial Sequence
  chemically synthesized
aagtcttttcgataatataaaa

SEQ ID NO: 1239977 - DNA, 22 bp, Artificial Sequence
  chemically synthesized
ctaatataatatttttatatta

SEQ ID NO: 1239978 - DNA, 22 bp, Artificial Sequence
  chemically synthesized
tctaatataatatttttatatt

SEQ ID NO: 1239979 - DNA, 22 bp, Artificial Sequence
  chemically synthesized
cactttctaatataatattttt

SEQ ID NO: 1239980 - DNA, 22 bp, Artificial Sequence
  chemically synthesized
ttcgataatataaaaatattat

SEQ ID NO: 1239981 - DNA, 22 bp, Artificial Sequence
  chemically synthesized
tcgataatataaaaatattata

SEQ ID NO: 1239982 - DNA, 22 bp, Artificial Sequence
  chemically synthesized
tgcactttctaatataatattt

SEQ ID NO: 1239983 - DNA, 22 bp, Artificial Sequence
  chemically synthesized
cgataatataaaaatattatat

SEQ ID NO: 1239984 - DNA, 22 bp, Artificial Sequence
  chemically synthesized
gataatataaaaatattatatt

SEQ ID NO: 1239985 - DNA, 22 bp, Artificial Sequence
  chemically synthesized
catgtattctgcactttctaat

SEQ ID NO: 1239986 - DNA, 22 bp, Artificial Sequence
  chemically synthesized
acatgtattctgcactttctaa

SEQ ID NO: 1239987 - DNA, 22 bp, Artificial Sequence
  chemically synthesized
tacatgtattctgcactttcta

SEQ ID NO: 1239988 - DNA, 22 bp, Artificial Sequence
  chemically synthesized
tattagaaagtgcagaatacat

SEQ ID NO: 1239989 - DNA, 22 bp, Artificial Sequence
  chemically synthesized
atagaaaacattttacatgtat

SEQ ID NO: 1239990 - DNA, 22 bp, Artificial Sequence
  chemically synthesized
gaaagtgcagaatacatgtaaa

SEQ ID NO: 1239991 - DNA, 22 bp, Artificial Sequence
  chemically synthesized
ccacagggatgccaaactaata

SEQ ID NO: 1239992 - DNA, 22 bp, Artificial Sequence
  chemically synthesized
cactcccacagggatgccaaac

SEQ ID NO: 1239993 - DNA, 22 bp, Artificial Sequence
  chemically synthesized
gcactcccacagggatgccaaa

SEQ ID NO: 1239994 - DNA, 22 bp, Artificial Sequence
  chemically synthesized
tctattagtttggcatccctgt

SEQ ID NO: 1239995 - DNA, 22 bp, Artificial Sequence
  chemically synthesized
acttgcactcccacagggatgc

SEQ ID NO: 1239996 - DNA, 22 bp, Artificial Sequence
  chemically synthesized
ctattagtttggcatccctgtg

SEQ ID NO: 1239997 - DNA, 22 bp, Artificial Sequence
  chemically synthesized
tattagtttggcatccctgtgg

SEQ ID NO: 1239998 - DNA, 22 bp, Artificial Sequence
  chemically synthesized
ttgacttgcactcccacaggga

SEQ ID NO: 1239999 - DNA, 22 bp, Artificial Sequence
  chemically synthesized
ttagtttggcatccctgtggga

SEQ ID NO: 1240000 - DNA, 22 bp, Artificial Sequence
  chemically synthesized
gtttggcatccctgtgggagtg

SEQ ID NO: 1240001 - DNA, 22 bp, Artificial Sequence
  chemically synthesized
ccctattgacttgcactcccac

SEQ ID NO: 1240002 - DNA, 22 bp, Artificial Sequence
  chemically synthesized
cccctattgacttgcactccca

SEQ ID NO: 1240003 - DNA, 22 bp, Artificial Sequence
  chemically synthesized
ggcatccctgtgggagtgcaag

SEQ ID NO: 1240004 - DNA, 22 bp, Artificial Sequence
  chemically synthesized
gcatccctgtgggagtgcaagt

SEQ ID NO: 1240005 - DNA, 22 bp, Artificial Sequence
  chemically synthesized
tgggagtgcaagtcaatagggg

SEQ ID NO: 1240006 - DNA, 22 bp, Artificial Sequence
  chemically synthesized
tatagggaataatgccttcccc

SEQ ID NO: 1240007 - DNA, 22 bp, Artificial Sequence
  chemically synthesized
gtaattgtatagggaataatgc

SEQ ID NO: 1240008 - DNA, 22 bp, Artificial Sequence
  chemically synthesized
agtaattgtatagggaataatg

SEQ ID NO: 1240009 - DNA, 22 bp, Artificial Sequence
  chemically synthesized
tagtaattgtatagggaataat

SEQ ID NO: 1240010 - DNA, 22 bp, Artificial Sequence
  chemically synthesized
accagttttagtaattgtatag

SEQ ID NO: 1240011 - DNA, 22 bp, Artificial Sequence
  chemically synthesized
cattcaccagttttagtaattg

SEQ ID NO: 1240012 - DNA, 22 bp, Artificial Sequence
  chemically synthesized
ttccctatacaattactaaaac

SEQ ID NO: 1240013 - DNA, 22 bp, Artificial Sequence
  chemically synthesized
cctatacaattactaaaactgg

SEQ ID NO: 1240014 - DNA, 22 bp, Artificial Sequence
  chemically synthesized
taccatctgcattcaccagttt

SEQ ID NO: 1240015 - DNA, 22 bp, Artificial Sequence
  chemically synthesized
tacaattactaaaactggtgaa

SEQ ID NO: 1240016 - DNA, 22 bp, Artificial Sequence
  chemically synthesized
tgtaccatctgcattcaccagt

SEQ ID NO: 1240017 - DNA, 22 bp, Artificial Sequence
  chemically synthesized
ctaaaactggtgaatgcagatg

SEQ ID NO: 1240018 - DNA, 22 bp, Artificial Sequence
  chemically synthesized
aaactggtgaatgcagatggta

SEQ ID NO: 1240019 - DNA, 22 bp, Artificial Sequence
  chemically synthesized
agtgcatcctctgtaccatctg

SEQ ID NO: 1240020 - DNA, 22 bp, Artificial Sequence
  chemically synthesized
taagtgcatcctctgtaccatc

SEQ ID NO: 1240021 - DNA, 22 bp, Artificial Sequence
  chemically synthesized
ctaagtgcatcctctgtaccat

SEQ ID NO: 1240022 - DNA, 22 bp, Artificial Sequence
  chemically synthesized
gtgaatgcagatggtacagagg

SEQ ID NO: 1240023 - DNA, 22 bp, Artificial Sequence
  chemically synthesized
agaaacttgctttttcctccct

SEQ ID NO: 1240024 - DNA, 22 bp, Artificial Sequence
  chemically synthesized
gaaacttgctttttcctccctt

SEQ ID NO: 1240025 - DNA, 22 bp, Artificial Sequence
  chemically synthesized
gctttttcctcccttttcttgt

SEQ ID NO: 1240026 - DNA, 22 bp, Artificial Sequence
  chemically synthesized
ctttttcctcccttttcttgtt

SEQ ID NO: 1240027 - DNA, 22 bp, Artificial Sequence
  chemically synthesized
aaaatagtcaaaagaacaagaa

SEQ ID NO: 1240028 - DNA, 22 bp, Artificial Sequence
  chemically synthesized
tttcctcccttttcttgttctt

SEQ ID NO: 1240029 - DNA, 22 bp, Artificial Sequence
  chemically synthesized
aaaaatagtcaaaagaacaaga

SEQ ID NO: 1240030 - DNA, 22 bp, Artificial Sequence
  chemically synthesized
ttcctcccttttcttgttcttt

SEQ ID NO: 1240031 - DNA, 22 bp, Artificial Sequence
  chemically synthesized
tcctcccttttcttgttctttt

SEQ ID NO: 1240032 - DNA, 22 bp, Artificial Sequence
  chemically synthesized
cctcccttttcttgttcttttg

SEQ ID NO: 1240033 - DNA, 22 bp, Artificial Sequence
  chemically synthesized
ctcccttttcttgttcttttga

SEQ ID NO: 1240034 - DNA, 22 bp, Artificial Sequence
  chemically synthesized
ccttttcttgttcttttgacta

SEQ ID NO: 1240035 - DNA, 22 bp, Artificial Sequence
  chemically synthesized
ttcttgttcttttgactatttt

SEQ ID NO: 1240036 - DNA, 22 bp, Artificial Sequence
  chemically synthesized
tcttgttcttttgactattttt

SEQ ID NO: 1240037 - DNA, 22 bp, Artificial Sequence
  chemically synthesized
cttgttcttttgactattttta

SEQ ID NO: 1240038 - DNA, 22 bp, Artificial Sequence
  chemically synthesized
ttgttcttttgactatttttaa

SEQ ID NO: 1240039 - DNA, 22 bp, Artificial Sequence
  chemically synthesized
gttcttttgactatttttaagt

SEQ ID NO: 1240040 - DNA, 22 bp, Artificial Sequence
  chemically synthesized
ttcttttgactatttttaagta

SEQ ID NO: 1240041 - DNA, 22 bp, Artificial Sequence
  chemically synthesized
ttttgactatttttaagtattc

SEQ ID NO: 1240042 - DNA, 22 bp, Artificial Sequence
  chemically synthesized
ttgactatttttaagtattctt

SEQ ID NO: 1240043 - DNA, 22 bp, Artificial Sequence
  chemically synthesized
tgactatttttaagtattcttt

SEQ ID NO: 1240044 - DNA, 22 bp, Artificial Sequence
  chemically synthesized
gactatttttaagtattctttt

SEQ ID NO: 1240045 - DNA, 22 bp, Artificial Sequence
  chemically synthesized
actatttttaagtattcttttg

SEQ ID NO: 1240046 - DNA, 22 bp, Artificial Sequence
  chemically synthesized
tttttaagtattcttttgttgt

SEQ ID NO: 1240047 - DNA, 22 bp, Artificial Sequence
  chemically synthesized
ttaagtattcttttgttgttct

SEQ ID NO: 1240048 - DNA, 22 bp, Artificial Sequence
  chemically synthesized
taagtattcttttgttgttctc

SEQ ID NO: 1240049 - DNA, 22 bp, Artificial Sequence
  chemically synthesized
aagatgaaaggggagaacaaca

SEQ ID NO: 1240050 - DNA, 22 bp, Artificial Sequence
  chemically synthesized
aagtattcttttgttgttctcc

SEQ ID NO: 1240051 - DNA, 22 bp, Artificial Sequence
  chemically synthesized
agtattcttttgttgttctccc

SEQ ID NO: 1240052 - DNA, 22 bp, Artificial Sequence
  chemically synthesized
ttttgttgttctcccctttcat

SEQ ID NO: 1240053 - DNA, 22 bp, Artificial Sequence
  chemically synthesized
ttgttgttctcccctttcatct

SEQ ID NO: 1240054 - DNA, 22 bp, Artificial Sequence
  chemically synthesized
tgttgttctcccctttcatctt

SEQ ID NO: 1240055 - DNA, 22 bp, Artificial Sequence
  chemically synthesized
gttgttctcccctttcatcttc

SEQ ID NO: 1240056 - DNA, 22 bp, Artificial Sequence
  chemically synthesized
ttgttctcccctttcatcttca

SEQ ID NO: 1240057 - DNA, 22 bp, Artificial Sequence
  chemically synthesized
ttctcccctttcatcttcaaca

SEQ ID NO: 1240058 - DNA, 22 bp, Artificial Sequence
  chemically synthesized
tcccctttcatcttcaacatac

SEQ ID NO: 1240059 - DNA, 22 bp, Artificial Sequence
  chemically synthesized
ccctttcatcttcaacatacac

SEQ ID NO: 1240060 - DNA, 22 bp, Artificial Sequence
  chemically synthesized
caacaaagacatggtgtatgtt

SEQ ID NO: 1240061 - DNA, 22 bp, Artificial Sequence
  chemically synthesized
tcatcttcaacatacaccatgt

SEQ ID NO: 1240062 - DNA, 22 bp, Artificial Sequence
  chemically synthesized
catcttcaacatacaccatgtc

SEQ ID NO: 1240063 - DNA, 22 bp, Artificial Sequence
  chemically synthesized
atcttcaacatacaccatgtct

SEQ ID NO: 1240064 - DNA, 22 bp, Artificial Sequence
  chemically synthesized
caacatacaccatgtctttgtt

SEQ ID NO: 1240065 - DNA, 22 bp, Artificial Sequence
  chemically synthesized
aacatacaccatgtctttgttg

SEQ ID NO: 1240066 - DNA, 22 bp, Artificial Sequence
  chemically synthesized
ggatataaaatgccacctgcaa

SEQ ID NO: 1240067 - DNA, 22 bp, Artificial Sequence
  chemically synthesized
aggatataaaatgccacctgca

SEQ ID NO: 1240068 - DNA, 22 bp, Artificial Sequence
  chemically synthesized
ttaggatataaaatgccacctg

SEQ ID NO: 1240069 - DNA, 22 bp, Artificial Sequence
  chemically synthesized
ttcttaggatataaaatgccac

SEQ ID NO: 1240070 - DNA, 22 bp, Artificial Sequence
  chemically synthesized
tgttgcaggtggcattttatat

SEQ ID NO: 1240071 - DNA, 22 bp, Artificial Sequence
  chemically synthesized
gttgcaggtggcattttatatc

SEQ ID NO: 1240072 - DNA, 22 bp, Artificial Sequence
  chemically synthesized
ttgcaggtggcattttatatcc

SEQ ID NO: 1240073 - DNA, 22 bp, Artificial Sequence
  chemically synthesized
caggtggcattttatatcctaa

SEQ ID NO: 1240074 - DNA, 22 bp, Artificial Sequence
  chemically synthesized
aagaaaaaatattgttcttagg

SEQ ID NO: 1240075 - DNA, 22 bp, Artificial Sequence
  chemically synthesized
aaagaaaaaatattgttcttag

SEQ ID NO: 1240076 - DNA, 22 bp, Artificial Sequence
  chemically synthesized
taaagaaaaaatattgttctta

SEQ ID NO: 1240077 - DNA, 22 bp, Artificial Sequence
  chemically synthesized
tatatcctaagaacaatatttt

SEQ ID NO: 1240078 - DNA, 22 bp, Artificial Sequence
  chemically synthesized
aattttaaagaaaaaatattgt

SEQ ID NO: 1240079 - DNA, 22 bp, Artificial Sequence
  chemically synthesized
atatcctaagaacaatattttt

SEQ ID NO: 1240080 - DNA, 22 bp, Artificial Sequence
  chemically synthesized
tatcctaagaacaatatttttt

SEQ ID NO: 1240081 - DNA, 22 bp, Artificial Sequence
  chemically synthesized
aaggttgaattttaaagaaaaa

SEQ ID NO: 1240082 - DNA, 22 bp, Artificial Sequence
  chemically synthesized
agaacaatattttttctttaaa

SEQ ID NO: 1240083 - DNA, 22 bp, Artificial Sequence
  chemically synthesized
tttctttaaaattcaaccttta

SEQ ID NO: 1240084 - DNA, 22 bp, Artificial Sequence
  chemically synthesized
ttctttaaaattcaacctttaa

SEQ ID NO: 1240085 - DNA, 22 bp, Artificial Sequence
  chemically synthesized
aaaaggaagccattaaaggttg

SEQ ID NO: 1240086 - DNA, 22 bp, Artificial Sequence
  chemically synthesized
tctttaaaattcaacctttaat

SEQ ID NO: 1240087 - DNA, 22 bp, Artificial Sequence
  chemically synthesized
gaaaaggaagccattaaaggtt

SEQ ID NO: 1240088 - DNA, 22 bp, Artificial Sequence
  chemically synthesized
ctttaaaattcaacctttaatg

SEQ ID NO: 1240089 - DNA, 22 bp, Artificial Sequence
  chemically synthesized
tttaaaattcaacctttaatgg

SEQ ID NO: 1240090 - DNA, 22 bp, Artificial Sequence
  chemically synthesized
taaaattcaacctttaatggct

SEQ ID NO: 1240091 - DNA, 22 bp, Artificial Sequence
  chemically synthesized
aaaattcaacctttaatggctt

SEQ ID NO: 1240092 - DNA, 22 bp, Artificial Sequence
  chemically synthesized
aaattcaacctttaatggcttc

SEQ ID NO: 1240093 - DNA, 22 bp, Artificial Sequence
  chemically synthesized
atacacttgaaaaggaagccat

SEQ ID NO: 1240094 - DNA, 22 bp, Artificial Sequence
  chemically synthesized
tcatacacttgaaaaggaagcc

SEQ ID NO: 1240095 - DNA, 22 bp, Artificial Sequence
  chemically synthesized
aacctttaatggcttccttttc

SEQ ID NO: 1240096 - DNA, 22 bp, Artificial Sequence
  chemically synthesized
taatggcttccttttcaagtgt

SEQ ID NO: 1240097 - DNA, 22 bp, Artificial Sequence
  chemically synthesized
aatggcttccttttcaagtgta

SEQ ID NO: 1240098 - DNA, 22 bp, Artificial Sequence
  chemically synthesized
atggcttccttttcaagtgtat

SEQ ID NO: 1240099 - DNA, 22 bp, Artificial Sequence
  chemically synthesized
acaaaatagttctcatacactt

SEQ ID NO: 1240100 - DNA, 22 bp, Artificial Sequence
  chemically synthesized
cacaaaatagttctcatacact

SEQ ID NO: 1240101 - DNA, 22 bp, Artificial Sequence
  chemically synthesized
ccttttcaagtgtatgagaact

SEQ ID NO: 1240102 - DNA, 22 bp, Artificial Sequence
  chemically synthesized
cttttcaagtgtatgagaacta

SEQ ID NO: 1240103 - DNA, 22 bp, Artificial Sequence
  chemically synthesized
tgtgcttcacaaaatagttctc

SEQ ID NO: 1240104 - DNA, 22 bp, Artificial Sequence
  chemically synthesized
ttcaagtgtatgagaactattt

SEQ ID NO: 1240105 - DNA, 22 bp, Artificial Sequence
  chemically synthesized
gtgtgcttcacaaaatagttct

SEQ ID NO: 1240106 - DNA, 22 bp, Artificial Sequence
  chemically synthesized
tcaagtgtatgagaactatttt

SEQ ID NO: 1240107 - DNA, 22 bp, Artificial Sequence
  chemically synthesized
tgtgtgcttcacaaaatagttc

SEQ ID NO: 1240108 - DNA, 22 bp, Artificial Sequence
  chemically synthesized
caagtgtatgagaactattttg

SEQ ID NO: 1240109 - DNA, 22 bp, Artificial Sequence
  chemically synthesized
aagtgtatgagaactattttgt

SEQ ID NO: 1240110 - DNA, 22 bp, Artificial Sequence
  chemically synthesized
atgttttgtgtgcttcacaaaa

SEQ ID NO: 1240111 - DNA, 22 bp, Artificial Sequence
  chemically synthesized
ttttgtgaagcacacaaaacat

SEQ ID NO: 1240112 - DNA, 22 bp, Artificial Sequence
  chemically synthesized
tgtgaagcacacaaaacatgaa

SEQ ID NO: 1240113 - DNA, 22 bp, Artificial Sequence
  chemically synthesized
gtgaagcacacaaaacatgaat

SEQ ID NO: 1240114 - DNA, 22 bp, Artificial Sequence
  chemically synthesized
gcccaaggaggaattcatgttt

SEQ ID NO: 1240115 - DNA, 22 bp, Artificial Sequence
  chemically synthesized
tgaagcacacaaaacatgaatt

SEQ ID NO: 1240116 - DNA, 22 bp, Artificial Sequence
  chemically synthesized
cagggtcgcctggcccaaggag

SEQ ID NO: 1240117 - DNA, 22 bp, Artificial Sequence
  chemically synthesized
ctccttgggccaggcgaccctg

SEQ ID NO: 1240118 - DNA, 22 bp, Artificial Sequence
  chemically synthesized
aagacagagagctacagggtcg

SEQ ID NO: 1240119 - DNA, 22 bp, Artificial Sequence
  chemically synthesized
cttgggccaggcgaccctgtag

SEQ ID NO: 1240120 - DNA, 22 bp, Artificial Sequence
  chemically synthesized
gggccaggcgaccctgtagctc

SEQ ID NO: 1240121 - DNA, 22 bp, Artificial Sequence
  chemically synthesized
ggccaggcgaccctgtagctct

SEQ ID NO: 1240122 - DNA, 22 bp, Artificial Sequence
  chemically synthesized
gtcataaaatgaactgaagaca

SEQ ID NO: 1240123 - DNA, 22 bp, Artificial Sequence
  chemically synthesized
agtcataaaatgaactgaagac

SEQ ID NO: 1240124 - DNA, 22 bp, Artificial Sequence
  chemically synthesized
tagctctctgtcttcagttcat

SEQ ID NO: 1240125 - DNA, 22 bp, Artificial Sequence
  chemically synthesized
tctgtcttcagttcattttatg

SEQ ID NO: 1240126 - DNA, 22 bp, Artificial Sequence
  chemically synthesized
tgtcttcagttcattttatgac

SEQ ID NO: 1240127 - DNA, 22 bp, Artificial Sequence
  chemically synthesized
tcttcagttcattttatgacta

SEQ ID NO: 1240128 - DNA, 22 bp, Artificial Sequence
  chemically synthesized
ataagggaaatcttagtcataa

SEQ ID NO: 1240129 - DNA, 22 bp, Artificial Sequence
  chemically synthesized
gataagggaaatcttagtcata

SEQ ID NO: 1240130 - DNA, 22 bp, Artificial Sequence
  chemically synthesized
cagttcattttatgactaagat

SEQ ID NO: 1240131 - DNA, 22 bp, Artificial Sequence
  chemically synthesized
agttcattttatgactaagatt

SEQ ID NO: 1240132 - DNA, 22 bp, Artificial Sequence
  chemically synthesized
acttgataagggaaatcttagt

SEQ ID NO: 1240133 - DNA, 22 bp, Artificial Sequence
  chemically synthesized
attttatgactaagatttccct

SEQ ID NO: 1240134 - DNA, 22 bp, Artificial Sequence
  chemically synthesized
agttcacttgataagggaaatc

SEQ ID NO: 1240135 - DNA, 22 bp, Artificial Sequence
  chemically synthesized
tatgactaagatttcccttatc

SEQ ID NO: 1240136 - DNA, 22 bp, Artificial Sequence
  chemically synthesized
atgactaagatttcccttatca

SEQ ID NO: 1240137 - DNA, 22 bp, Artificial Sequence
  chemically synthesized
tgactaagatttcccttatcaa

SEQ ID NO: 1240138 - DNA, 22 bp, Artificial Sequence
  chemically synthesized
agatttcccttatcaagtgaac

SEQ ID NO: 1240139 - DNA, 22 bp, Artificial Sequence
  chemically synthesized
cccttatcaagtgaactgagtg

SEQ ID NO: 1240140 - DNA, 22 bp, Artificial Sequence
  chemically synthesized
ccttatcaagtgaactgagtgg

SEQ ID NO: 1240141 - DNA, 22 bp, Artificial Sequence
  chemically synthesized
agtaatatcagatatccactca

SEQ ID NO: 1240142 - DNA, 22 bp, Artificial Sequence
  chemically synthesized
atcaagtgaactgagtggatat

SEQ ID NO: 1240143 - DNA, 22 bp, Artificial Sequence
  chemically synthesized
tcaagtgaactgagtggatatc

SEQ ID NO: 1240144 - DNA, 22 bp, Artificial Sequence
  chemically synthesized
aactgagtaatatcagatatcc

SEQ ID NO: 1240145 - DNA, 22 bp, Artificial Sequence
  chemically synthesized
agtggatatctgatattactca

SEQ ID NO: 1240146 - DNA, 22 bp, Artificial Sequence
  chemically synthesized
atattactcagtttaatgtatc

SEQ ID NO: 1240147 - DNA, 22 bp, Artificial Sequence
  chemically synthesized
ctcagtttaatgtatctgcata

SEQ ID NO: 1240148 - DNA, 22 bp, Artificial Sequence
  chemically synthesized
acaaagacaatatatatgcaga

SEQ ID NO: 1240149 - DNA, 22 bp, Artificial Sequence
  chemically synthesized
agtttaatgtatctgcatatat

SEQ ID NO: 1240150 - DNA, 22 bp, Artificial Sequence
  chemically synthesized
ggttaacaaagacaatatatat

SEQ ID NO: 1240151 - DNA, 22 bp, Artificial Sequence
  chemically synthesized
aatgtatctgcatatatattgt

SEQ ID NO: 1240152 - DNA, 22 bp, Artificial Sequence
  chemically synthesized
gggttaacaaagacaatatata

SEQ ID NO: 1240153 - DNA, 22 bp, Artificial Sequence
  chemically synthesized
atgtatctgcatatatattgtc

SEQ ID NO: 1240154 - DNA, 22 bp, Artificial Sequence
  chemically synthesized
tggtttgggttaacaaagacaa

SEQ ID NO: 1240155 - DNA, 22 bp, Artificial Sequence
  chemically synthesized
catatatattgtctttgttaac

SEQ ID NO: 1240156 - DNA, 22 bp, Artificial Sequence
  chemically synthesized
gtgttgtggtttgggttaacaa

SEQ ID NO: 1240157 - DNA, 22 bp, Artificial Sequence
  chemically synthesized
cgtgttgtggtttgggttaaca

SEQ ID NO: 1240158 - DNA, 22 bp, Artificial Sequence
  chemically synthesized
tcgtgttgtggtttgggttaac

SEQ ID NO: 1240159 - DNA, 22 bp, Artificial Sequence
  chemically synthesized
tctttgttaacccaaaccacaa

SEQ ID NO: 1240160 - DNA, 22 bp, Artificial Sequence
  chemically synthesized
ggtcctttcgtgttgtggtttg

SEQ ID NO: 1240161 - DNA, 22 bp, Artificial Sequence
  chemically synthesized
aggtcctttcgtgttgtggttt

SEQ ID NO: 1240162 - DNA, 22 bp, Artificial Sequence
  chemically synthesized
taggtcctttcgtgttgtggtt

SEQ ID NO: 1240163 - DNA, 22 bp, Artificial Sequence
  chemically synthesized
ttaggtcctttcgtgttgtggt

SEQ ID NO: 1240164 - DNA, 22 bp, Artificial Sequence
  chemically synthesized
tgttaacccaaaccacaacacg

SEQ ID NO: 1240165 - DNA, 22 bp, Artificial Sequence
  chemically synthesized
gttaacccaaaccacaacacga

SEQ ID NO: 1240166 - DNA, 22 bp, Artificial Sequence
  chemically synthesized
ttaacccaaaccacaacacgaa

SEQ ID NO: 1240167 - DNA, 22 bp, Artificial Sequence
  chemically synthesized
gtttttaggtcctttcgtgttg

SEQ ID NO: 1240168 - DNA, 22 bp, Artificial Sequence
  chemically synthesized
acccaaaccacaacacgaaagg

SEQ ID NO: 1240169 - DNA, 22 bp, Artificial Sequence
  chemically synthesized
tctcgtttttaggtcctttcgt

SEQ ID NO: 1240170 - DNA, 22 bp, Artificial Sequence
  chemically synthesized
gaaggaatactgtctcgttttt

SEQ ID NO: 1240171 - DNA, 22 bp, Artificial Sequence
  chemically synthesized
ggaaggaatactgtctcgtttt

SEQ ID NO: 1240172 - DNA, 22 bp, Artificial Sequence
  chemically synthesized
aaaaggatttggaaggaatact

SEQ ID NO: 1240173 - DNA, 22 bp, Artificial Sequence
  chemically synthesized
aaaacgagacagtattccttcc

SEQ ID NO: 1240174 - DNA, 22 bp, Artificial Sequence
  chemically synthesized
atactaaaaaggatttggaagg

SEQ ID NO: 1240175 - DNA, 22 bp, Artificial Sequence
  chemically synthesized
catactaaaaaggatttggaag

SEQ ID NO: 1240176 - DNA, 22 bp, Artificial Sequence
  chemically synthesized
tttcatactaaaaaggatttgg

SEQ ID NO: 1240177 - DNA, 22 bp, Artificial Sequence
  chemically synthesized
atttcatactaaaaaggatttg

SEQ ID NO: 1240178 - DNA, 22 bp, Artificial Sequence
  chemically synthesized
tatttcatactaaaaaggattt

SEQ ID NO: 1240179 - DNA, 22 bp, Artificial Sequence
  chemically synthesized
tttatttcatactaaaaaggat

SEQ ID NO: 1240180 - DNA, 22 bp, Artificial Sequence
  chemically synthesized
ctttatttcatactaaaaagga

SEQ ID NO: 1240181 - DNA, 22 bp, Artificial Sequence
  chemically synthesized
cttccaaatcctttttagtatg

SEQ ID NO: 1240182 - DNA, 22 bp, Artificial Sequence
  chemically synthesized
ccaaatcctttttagtatgaaa

SEQ ID NO: 1240183 - DNA, 22 bp, Artificial Sequence
  chemically synthesized
cgtatttctttatttcatacta

SEQ ID NO: 1240184 - DNA, 22 bp, Artificial Sequence
  chemically synthesized
caaatcctttttagtatgaaat

SEQ ID NO: 1240185 - DNA, 22 bp, Artificial Sequence
  chemically synthesized
ccgtatttctttatttcatact

SEQ ID NO: 1240186 - DNA, 22 bp, Artificial Sequence
  chemically synthesized
tgcttccgtatttctttatttc

SEQ ID NO: 1240187 - DNA, 22 bp, Artificial Sequence
  chemically synthesized
gtgcttccgtatttctttattt

SEQ ID NO: 1240188 - DNA, 22 bp, Artificial Sequence
  chemically synthesized
tttagtatgaaataaagaaata

SEQ ID NO: 1240189 - DNA, 22 bp, Artificial Sequence
  chemically synthesized
tttgtgcttccgtatttcttta

SEQ ID NO: 1240190 - DNA, 22 bp, Artificial Sequence
  chemically synthesized
ttagtatgaaataaagaaatac

SEQ ID NO: 1240191 - DNA, 22 bp, Artificial Sequence
  chemically synthesized
tagtatgaaataaagaaatacg

SEQ ID NO: 1240192 - DNA, 22 bp, Artificial Sequence
  chemically synthesized
agtatgaaataaagaaatacgg

SEQ ID NO: 1240193 - DNA, 22 bp, Artificial Sequence
  chemically synthesized
gtatgaaataaagaaatacgga

SEQ ID NO: 1240194 - DNA, 22 bp, Artificial Sequence
  chemically synthesized
aacactgtttgtgcttccgtat

SEQ ID NO: 1240195 - DNA, 22 bp, Artificial Sequence
  chemically synthesized
gaacactgtttgtgcttccgta

SEQ ID NO: 1240196 - DNA, 22 bp, Artificial Sequence
  chemically synthesized
tgaacactgtttgtgcttccgt

SEQ ID NO: 1240197 - DNA, 22 bp, Artificial Sequence
  chemically synthesized
ttgaacactgtttgtgcttccg

SEQ ID NO: 1240198 - DNA, 22 bp, Artificial Sequence
  chemically synthesized
tttgaacactgtttgtgcttcc

SEQ ID NO: 1240199 - DNA, 22 bp, Artificial Sequence
  chemically synthesized
tttttgaacactgtttgtgctt

SEQ ID NO: 1240200 - DNA, 22 bp, Artificial Sequence
  chemically synthesized
ctttttgaacactgtttgtgct

SEQ ID NO: 1240201 - DNA, 22 bp, Artificial Sequence
  chemically synthesized
tgtttctttttgaacactgttt

SEQ ID NO: 1240202 - DNA, 22 bp, Artificial Sequence
  chemically synthesized
tctgtgtttctttttgaacact

SEQ ID NO: 1240203 - DNA, 22 bp, Artificial Sequence
  chemically synthesized
cctatctgtgtttctttttgaa

SEQ ID NO: 1240204 - DNA, 22 bp, Artificial Sequence
  chemically synthesized
tcaacctacctatctgtgtttc

SEQ ID NO: 1240205 - DNA, 22 bp, Artificial Sequence
  chemically synthesized
gtcaacctacctatctgtgttt

SEQ ID NO: 1240206 - DNA, 22 bp, Artificial Sequence
  chemically synthesized
aaaaagaaacacagataggtag

SEQ ID NO: 1240207 - DNA, 22 bp, Artificial Sequence
  chemically synthesized
tgccacttgtcaacctacctat

SEQ ID NO: 1240208 - DNA, 22 bp, Artificial Sequence
  chemically synthesized
atgccacttgtcaacctaccta

SEQ ID NO: 1240209 - DNA, 22 bp, Artificial Sequence
  chemically synthesized
tttatgccacttgtcaacctac

SEQ ID NO: 1240210 - DNA, 22 bp, Artificial Sequence
  chemically synthesized
atttatgccacttgtcaaccta

SEQ ID NO: 1240211 - DNA, 22 bp, Artificial Sequence
  chemically synthesized
tatttatgccacttgtcaacct

SEQ ID NO: 1240212 - DNA, 22 bp, Artificial Sequence
  chemically synthesized
actttatttatgccacttgtca

SEQ ID NO: 1240213 - DNA, 22 bp, Artificial Sequence
  chemically synthesized
gttcactttatttatgccactt

SEQ ID NO: 1240214 - DNA, 22 bp, Artificial Sequence
  chemically synthesized
ggttcactttatttatgccact

SEQ ID NO: 1240215 - DNA, 22 bp, Artificial Sequence
  chemically synthesized
atttggttcactttatttatgc

SEQ ID NO: 1240216 - DNA, 22 bp, Artificial Sequence
  chemically synthesized
gatttggttcactttatttatg

SEQ ID NO: 1240217 - DNA, 22 bp, Artificial Sequence
  chemically synthesized
tgatttggttcactttatttat

SEQ ID NO: 1240218 - DNA, 22 bp, Artificial Sequence
  chemically synthesized
acaagtggcataaataaagtga

SEQ ID NO: 1240219 - DNA, 22 bp, Artificial Sequence
  chemically synthesized
cactttgatttggttcacttta

SEQ ID NO: 1240220 - DNA, 22 bp, Artificial Sequence
  chemically synthesized
ttccactttgatttggttcact

SEQ ID NO: 1240221 - DNA, 22 bp, Artificial Sequence
  chemically synthesized
gttccactttgatttggttcac

SEQ ID NO: 1240222 - DNA, 22 bp, Artificial Sequence
  chemically synthesized
atttgttccactttgatttggt

SEQ ID NO: 1240223 - DNA, 22 bp, Artificial Sequence
  chemically synthesized
gatttgttccactttgatttgg

SEQ ID NO: 1240224 - DNA, 22 bp, Artificial Sequence
  chemically synthesized
tgatttgttccactttgatttg

SEQ ID NO: 1240225 - DNA, 22 bp, Artificial Sequence
  chemically synthesized
ctttgatttgttccactttgat

SEQ ID NO: 1240226 - DNA, 22 bp, Artificial Sequence
  chemically synthesized
actttgatttgttccactttga

SEQ ID NO: 1240227 - DNA, 22 bp, Artificial Sequence
  chemically synthesized
tactttgatttgttccactttg

SEQ ID NO: 1240228 - DNA, 22 bp, Artificial Sequence
  chemically synthesized
ttactttgatttgttccacttt

SEQ ID NO: 1240229 - DNA, 22 bp, Artificial Sequence
  chemically synthesized
tttactttgatttgttccactt

SEQ ID NO: 1240230 - DNA, 22 bp, Artificial Sequence
  chemically synthesized
ttttactttgatttgttccact

SEQ ID NO: 1240231 - DNA, 22 bp, Artificial Sequence
  chemically synthesized
aaatttttttactttgatttgt

SEQ ID NO: 1240232 - DNA, 22 bp, Artificial Sequence
  chemically synthesized
tcaaatttttttactttgattt

SEQ ID NO: 1240233 - DNA, 22 bp, Artificial Sequence
  chemically synthesized
ctcaaatttttttactttgatt

SEQ ID NO: 1240234 - DNA, 22 bp, Artificial Sequence
  chemically synthesized
tctcaaatttttttactttgat

SEQ ID NO: 1240235 - DNA, 22 bp, Artificial Sequence
  chemically synthesized
ctttctcaaatttttttacttt

SEQ ID NO: 1240236 - DNA, 22 bp, Artificial Sequence
  chemically synthesized
cctttctcaaatttttttactt

SEQ ID NO: 1240237 - DNA, 22 bp, Artificial Sequence
  chemically synthesized
acaaatgcatttcctttctcaa

SEQ ID NO: 1240238 - DNA, 22 bp, Artificial Sequence
  chemically synthesized
cacaaatgcatttcctttctca

SEQ ID NO: 1240239 - DNA, 22 bp, Artificial Sequence
  chemically synthesized
aacaccttcacaaatgcatttc

SEQ ID NO: 1240240 - DNA, 22 bp, Artificial Sequence
  chemically synthesized
aaacaccttcacaaatgcattt

SEQ ID NO: 1240241 - DNA, 22 bp, Artificial Sequence
  chemically synthesized
gagaaaggaaatgcatttgtga

SEQ ID NO: 1240242 - DNA, 22 bp, Artificial Sequence
  chemically synthesized
agaaaggaaatgcatttgtgaa

SEQ ID NO: 1240243 - DNA, 22 bp, Artificial Sequence
  chemically synthesized
aagaatcagaaaccacttaaac

SEQ ID NO: 1240244 - DNA, 22 bp, Artificial Sequence
  chemically synthesized
tgaagaatcagaaaccacttaa

SEQ ID NO: 1240245 - DNA, 22 bp, Artificial Sequence
  chemically synthesized
gtgaaggtgtttaagtggtttc

SEQ ID NO: 1240246 - DNA, 22 bp, Artificial Sequence
  chemically synthesized
tgaaggtgtttaagtggtttct

SEQ ID NO: 1240247 - DNA, 22 bp, Artificial Sequence
  chemically synthesized
aagtggtttctgattcttcaga

SEQ ID NO: 1240248 - DNA, 22 bp, Artificial Sequence
  chemically synthesized
agtggtttctgattcttcagag

SEQ ID NO: 1240249 - DNA, 22 bp, Artificial Sequence
  chemically synthesized
aaagaccaatacaactctgaag

SEQ ID NO: 1240250 - DNA, 22 bp, Artificial Sequence
  chemically synthesized
ctgattcttcagagttgtattg

SEQ ID NO: 1240251 - DNA, 22 bp, Artificial Sequence
  chemically synthesized
aggttaaaagaccaatacaact

SEQ ID NO: 1240252 - DNA, 22 bp, Artificial Sequence
  chemically synthesized
tgattcttcagagttgtattgg

SEQ ID NO: 1240253 - DNA, 22 bp, Artificial Sequence
  chemically synthesized
caggttaaaagaccaatacaac

SEQ ID NO: 1240254 - DNA, 22 bp, Artificial Sequence
  chemically synthesized
tcaggttaaaagaccaatacaa

SEQ ID NO: 1240255 - DNA, 22 bp, Artificial Sequence
  chemically synthesized
attcttcagagttgtattggtc

SEQ ID NO: 1240256 - DNA, 22 bp, Artificial Sequence
  chemically synthesized
ttcagagttgtattggtctttt

SEQ ID NO: 1240257 - DNA, 22 bp, Artificial Sequence
  chemically synthesized
gattttcaggttaaaagaccaa

SEQ ID NO: 1240258 - DNA, 22 bp, Artificial Sequence
  chemically synthesized
ggattttcaggttaaaagacca

SEQ ID NO: 1240259 - DNA, 22 bp, Artificial Sequence
  chemically synthesized
cagagttgtattggtcttttaa

SEQ ID NO: 1240260 - DNA, 22 bp, Artificial Sequence
  chemically synthesized
tggattttcaggttaaaagacc

SEQ ID NO: 1240261 - DNA, 22 bp, Artificial Sequence
  chemically synthesized
agagttgtattggtcttttaac

SEQ ID NO: 1240262 - DNA, 22 bp, Artificial Sequence
  chemically synthesized
atccctttggattttcaggtta

SEQ ID NO: 1240263 - DNA, 22 bp, Artificial Sequence
  chemically synthesized
tattggtcttttaacctgaaaa

SEQ ID NO: 1240264 - DNA, 22 bp, Artificial Sequence
  chemically synthesized
gtcttttaacctgaaaatccaa

SEQ ID NO: 1240265 - DNA, 22 bp, Artificial Sequence
  chemically synthesized
aaacgtattgatccctttggat

SEQ ID NO: 1240266 - DNA, 22 bp, Artificial Sequence
  chemically synthesized
ttaacctgaaaatccaaaggga

SEQ ID NO: 1240267 - DNA, 22 bp, Artificial Sequence
  chemically synthesized
taacctgaaaatccaaagggat

SEQ ID NO: 1240268 - DNA, 22 bp, Artificial Sequence
  chemically synthesized
aacctgaaaatccaaagggatc

SEQ ID NO: 1240269 - DNA, 22 bp, Artificial Sequence
  chemically synthesized
ctgaaacgtattgatccctttg

SEQ ID NO: 1240270 - DNA, 22 bp, Artificial Sequence
  chemically synthesized
acctgaaaatccaaagggatca

SEQ ID NO: 1240271 - DNA, 22 bp, Artificial Sequence
  chemically synthesized
tactgaaacgtattgatccctt

SEQ ID NO: 1240272 - DNA, 22 bp, Artificial Sequence
  chemically synthesized
ctactgaaacgtattgatccct

SEQ ID NO: 1240273 - DNA, 22 bp, Artificial Sequence
  chemically synthesized
tctactgaaacgtattgatccc

SEQ ID NO: 1240274 - DNA, 22 bp, Artificial Sequence
  chemically synthesized
aaaatccaaagggatcaatacg

SEQ ID NO: 1240275 - DNA, 22 bp, Artificial Sequence
  chemically synthesized
ctttctactgaaacgtattgat

SEQ ID NO: 1240276 - DNA, 22 bp, Artificial Sequence
  chemically synthesized
actttctactgaaacgtattga

SEQ ID NO: 1240277 - DNA, 22 bp, Artificial Sequence
  chemically synthesized
tactttctactgaaacgtattg

SEQ ID NO: 1240278 - DNA, 22 bp, Artificial Sequence
  chemically synthesized
tttactttctactgaaacgtat

SEQ ID NO: 1240279 - DNA, 22 bp, Artificial Sequence
  chemically synthesized
tgttctttactttctactgaaa

SEQ ID NO: 1240280 - DNA, 22 bp, Artificial Sequence
  chemically synthesized
tccctgtgttctttactttcta

SEQ ID NO: 1240281 - DNA, 22 bp, Artificial Sequence
  chemically synthesized
aattatccctgtgttctttact

SEQ ID NO: 1240282 - DNA, 22 bp, Artificial Sequence
  chemically synthesized
cagtagaaagtaaagaacacag

SEQ ID NO: 1240283 - DNA, 22 bp, Artificial Sequence
  chemically synthesized
agtagaaagtaaagaacacagg

SEQ ID NO: 1240284 - DNA, 22 bp, Artificial Sequence
  chemically synthesized
taatcagaaggtcatgctaaat

SEQ ID NO: 1240285 - DNA, 22 bp, Artificial Sequence
  chemically synthesized
gtaatcagaaggtcatgctaaa

SEQ ID NO: 1240286 - DNA, 22 bp, Artificial Sequence
  chemically synthesized
tgtaatcagaaggtcatgctaa

SEQ ID NO: 1240287 - DNA, 22 bp, Artificial Sequence
  chemically synthesized
ttgtaatcagaaggtcatgcta

SEQ ID NO: 1240288 - DNA, 22 bp, Artificial Sequence
  chemically synthesized
tttgtaatcagaaggtcatgct

SEQ ID NO: 1240289 - DNA, 22 bp, Artificial Sequence
  chemically synthesized
tcctttttgtaatcagaaggtc

SEQ ID NO: 1240290 - DNA, 22 bp, Artificial Sequence
  chemically synthesized
gtcctttttgtaatcagaaggt

SEQ ID NO: 1240291 - DNA, 22 bp, Artificial Sequence
  chemically synthesized
agcatgaccttctgattacaaa

SEQ ID NO: 1240292 - DNA, 22 bp, Artificial Sequence
  chemically synthesized
gcatgaccttctgattacaaaa

SEQ ID NO: 1240293 - DNA, 22 bp, Artificial Sequence
  chemically synthesized
tgtccatggcttgtcctttttg

SEQ ID NO: 1240294 - DNA, 22 bp, Artificial Sequence
  chemically synthesized
ctgattacaaaaaggacaagcc

SEQ ID NO: 1240295 - DNA, 22 bp, Artificial Sequence
  chemically synthesized
tgattacaaaaaggacaagcca

SEQ ID NO: 1240296 - DNA, 22 bp, Artificial Sequence
  chemically synthesized
attacaaaaaggacaagccatg

SEQ ID NO: 1240297 - DNA, 22 bp, Artificial Sequence
  chemically synthesized
gcgacagttatgtccatggctt

SEQ ID NO: 1240298 - DNA, 22 bp, Artificial Sequence
  chemically synthesized
agcgacagttatgtccatggct

SEQ ID NO: 1240299 - DNA, 22 bp, Artificial Sequence
  chemically synthesized
caaaaaggacaagccatggaca

SEQ ID NO: 1240300 - DNA, 22 bp, Artificial Sequence
  chemically synthesized
ttagcgacagttatgtccatgg

SEQ ID NO: 1240301 - DNA, 22 bp, Artificial Sequence
  chemically synthesized
cttagcgacagttatgtccatg

SEQ ID NO: 1240302 - DNA, 22 bp, Artificial Sequence
  chemically synthesized
tcttagcgacagttatgtccat

SEQ ID NO: 1240303 - DNA, 22 bp, Artificial Sequence
  chemically synthesized
actttcttagcgacagttatgt

SEQ ID NO: 1240304 - DNA, 22 bp, Artificial Sequence
  chemically synthesized
gactttcttagcgacagttatg

SEQ ID NO: 1240305 - DNA, 22 bp, Artificial Sequence
  chemically synthesized
cagaagtatcttgactttctta

SEQ ID NO: 1240306 - DNA, 22 bp, Artificial Sequence
  chemically synthesized
taattgcagaagtatcttgact

SEQ ID NO: 1240307 - DNA, 22 bp, Artificial Sequence
  chemically synthesized
gtaattgcagaagtatcttgac

SEQ ID NO: 1240308 - DNA, 22 bp, Artificial Sequence
  chemically synthesized
tcgctaagaaagtcaagatact

SEQ ID NO: 1240309 - DNA, 22 bp, Artificial Sequence
  chemically synthesized
agaaagtcaagatacttctgca

SEQ ID NO: 1240310 - DNA, 22 bp, Artificial Sequence
  chemically synthesized
gggatttgtaattgcagaagta

SEQ ID NO: 1240311 - DNA, 22 bp, Artificial Sequence
  chemically synthesized
caatgtctagggatttgtaatt

SEQ ID NO: 1240312 - DNA, 22 bp, Artificial Sequence
  chemically synthesized
ccaatgtctagggatttgtaat

SEQ ID NO: 1240313 - DNA, 22 bp, Artificial Sequence
  chemically synthesized
gtgtttccaatgtctagggatt

SEQ ID NO: 1240314 - DNA, 22 bp, Artificial Sequence
  chemically synthesized
ctgcaattacaaatccctagac

SEQ ID NO: 1240315 - DNA, 22 bp, Artificial Sequence
  chemically synthesized
ggtgtttccaatgtctagggat

SEQ ID NO: 1240316 - DNA, 22 bp, Artificial Sequence
  chemically synthesized
tgcaattacaaatccctagaca

SEQ ID NO: 1240317 - DNA, 22 bp, Artificial Sequence
  chemically synthesized
tggtgtttccaatgtctaggga

SEQ ID NO: 1240318 - DNA, 22 bp, Artificial Sequence
  chemically synthesized
ttggtgtttccaatgtctaggg

SEQ ID NO: 1240319 - DNA, 22 bp, Artificial Sequence
  chemically synthesized
caattacaaatccctagacatt

SEQ ID NO: 1240320 - DNA, 22 bp, Artificial Sequence
  chemically synthesized
caaatccctagacattggaaac

SEQ ID NO: 1240321 - DNA, 22 bp, Artificial Sequence
  chemically synthesized
cgatatttttggtgtttccaat

SEQ ID NO: 1240322 - DNA, 22 bp, Artificial Sequence
  chemically synthesized
gcgatatttttggtgtttccaa

SEQ ID NO: 1240323 - DNA, 22 bp, Artificial Sequence
  chemically synthesized
gacattggaaacaccaaaaata

SEQ ID NO: 1240324 - DNA, 22 bp, Artificial Sequence
  chemically synthesized
tggtatttgcgatatttttggt

SEQ ID NO: 1240325 - DNA, 22 bp, Artificial Sequence
  chemically synthesized
gtggtatttgcgatatttttgg

SEQ ID NO: 1240326 - DNA, 22 bp, Artificial Sequence
  chemically synthesized
tgtggtatttgcgatatttttg

SEQ ID NO: 1240327 - DNA, 22 bp, Artificial Sequence
  chemically synthesized
tttgtggtatttgcgatatttt

SEQ ID NO: 1240328 - DNA, 22 bp, Artificial Sequence
  chemically synthesized
gaaacaccaaaaatatcgcaaa

SEQ ID NO: 1240329 - DNA, 22 bp, Artificial Sequence
  chemically synthesized
caattctttgtggtatttgcga

SEQ ID NO: 1240330 - DNA, 22 bp, Artificial Sequence
  chemically synthesized
gcaattctttgtggtatttgcg

SEQ ID NO: 1240331 - DNA, 22 bp, Artificial Sequence
  chemically synthesized
tgcaattctttgtggtatttgc

SEQ ID NO: 1240332 - DNA, 22 bp, Artificial Sequence
  chemically synthesized
aatccccagttttgcaattctt

SEQ ID NO: 1240333 - DNA, 22 bp, Artificial Sequence
  chemically synthesized
gaatccccagttttgcaattct

SEQ ID NO: 1240334 - DNA, 22 bp, Artificial Sequence
  chemically synthesized
tgaatccccagttttgcaattc

SEQ ID NO: 1240335 - DNA, 22 bp, Artificial Sequence
  chemically synthesized
agtaagttttgaatccccagtt

SEQ ID NO: 1240336 - DNA, 22 bp, Artificial Sequence
  chemically synthesized
cagtaagttttgaatccccagt

SEQ ID NO: 1240337 - DNA, 22 bp, Artificial Sequence
  chemically synthesized
ttcagtaagttttgaatcccca

SEQ ID NO: 1240338 - DNA, 22 bp, Artificial Sequence
  chemically synthesized
caaaactggggattcaaaactt

SEQ ID NO: 1240339 - DNA, 22 bp, Artificial Sequence
  chemically synthesized
gtcagcagcgttcttcagtaag

SEQ ID NO: 1240340 - DNA, 22 bp, Artificial Sequence
  chemically synthesized
gggattcaaaacttactgaaga

SEQ ID NO: 1240341 - DNA, 22 bp, Artificial Sequence
  chemically synthesized
ggagctggtcagcagcgttctt

SEQ ID NO: 1240342 - DNA, 22 bp, Artificial Sequence
  chemically synthesized
aaaacttactgaagaacgctgc

SEQ ID NO: 1240343 - DNA, 22 bp, Artificial Sequence
  chemically synthesized
tgggagctggtcagcagcgttc

SEQ ID NO: 1240344 - DNA, 22 bp, Artificial Sequence
  chemically synthesized
ctgggagctggtcagcagcgtt

SEQ ID NO: 1240345 - DNA, 22 bp, Artificial Sequence
  chemically synthesized
tctgggagctggtcagcagcgt

SEQ ID NO: 1240346 - DNA, 22 bp, Artificial Sequence
  chemically synthesized
ttctgggagctggtcagcagcg

SEQ ID NO: 1240347 - DNA, 22 bp, Artificial Sequence
  chemically synthesized
actgaagaacgctgctgaccag

SEQ ID NO: 1240348 - DNA, 22 bp, Artificial Sequence
  chemically synthesized
tttttctgggagctggtcagca

SEQ ID NO: 1240349 - DNA, 22 bp, Artificial Sequence
  chemically synthesized
ctgaagaacgctgctgaccagc

SEQ ID NO: 1240350 - DNA, 22 bp, Artificial Sequence
  chemically synthesized
atttttctgggagctggtcagc

SEQ ID NO: 1240351 - DNA, 22 bp, Artificial Sequence
  chemically synthesized
aagaacgctgctgaccagctcc

SEQ ID NO: 1240352 - DNA, 22 bp, Artificial Sequence
  chemically synthesized
ccttatttttctgggagctggt

SEQ ID NO: 1240353 - DNA, 22 bp, Artificial Sequence
  chemically synthesized
ctgaccagctcccagaaaaata

SEQ ID NO: 1240354 - DNA, 22 bp, Artificial Sequence
  chemically synthesized
accagctcccagaaaaataagg

SEQ ID NO: 1240355 - DNA, 22 bp, Artificial Sequence
  chemically synthesized
catgaaaatgggttgccttatt

SEQ ID NO: 1240356 - DNA, 22 bp, Artificial Sequence
  chemically synthesized
acatgaaaatgggttgccttat

SEQ ID NO: 1240357 - DNA, 22 bp, Artificial Sequence
  chemically synthesized
tttacatgaaaatgggttgcct

SEQ ID NO: 1240358 - DNA, 22 bp, Artificial Sequence
  chemically synthesized
ccagaaaaataaggcaacccat

SEQ ID NO: 1240359 - DNA, 22 bp, Artificial Sequence
  chemically synthesized
ctatttacatgaaaatgggttg

SEQ ID NO: 1240360 - DNA, 22 bp, Artificial Sequence
  chemically synthesized
cctatttacatgaaaatgggtt

SEQ ID NO: 1240361 - DNA, 22 bp, Artificial Sequence
  chemically synthesized
ggaaagcttcctatttacatga

SEQ ID NO: 1240362 - DNA, 22 bp, Artificial Sequence
  chemically synthesized
tcatgtaaataggaagctttcc

SEQ ID NO: 1240363 - DNA, 22 bp, Artificial Sequence
  chemically synthesized
catgtaaataggaagctttccg

SEQ ID NO: 1240364 - DNA, 22 bp, Artificial Sequence
  chemically synthesized
atgtaaataggaagctttccga

SEQ ID NO: 1240365 - DNA, 22 bp, Artificial Sequence
  chemically synthesized
agaaaacaaaaaaaaaatcaac

SEQ ID NO: 1240366 - DNA, 22 bp, Artificial Sequence
  chemically synthesized
aagaaaacaaaaaaaaaatcaa

SEQ ID NO: 1240367 - DNA, 22 bp, Artificial Sequence
  chemically synthesized
tccgagttgattttttttttgt

SEQ ID NO: 1240368 - DNA, 22 bp, Artificial Sequence
  chemically synthesized
atatttaagaaaacaaaaaaaa

SEQ ID NO: 1240369 - DNA, 22 bp, Artificial Sequence
  chemically synthesized
ccgagttgattttttttttgtt

SEQ ID NO: 1240370 - DNA, 22 bp, Artificial Sequence
  chemically synthesized
cgagttgattttttttttgttt

SEQ ID NO: 1240371 - DNA, 22 bp, Artificial Sequence
  chemically synthesized
caactcatatttaagaaaacaa

SEQ ID NO: 1240372 - DNA, 22 bp, Artificial Sequence
  chemically synthesized
ccaactcatatttaagaaaaca

SEQ ID NO: 1240373 - DNA, 22 bp, Artificial Sequence
  chemically synthesized
tccaactcatatttaagaaaac

SEQ ID NO: 1240374 - DNA, 22 bp, Artificial Sequence
  chemically synthesized
attttttttttgttttcttaaa

SEQ ID NO: 1240375 - DNA, 22 bp, Artificial Sequence
  chemically synthesized
ttccaactcatatttaagaaaa

SEQ ID NO: 1240376 - DNA, 22 bp, Artificial Sequence
  chemically synthesized
tttttttgttttcttaaatatg

SEQ ID NO: 1240377 - DNA, 22 bp, Artificial Sequence
  chemically synthesized
ttttttgttttcttaaatatga

SEQ ID NO: 1240378 - DNA, 22 bp, Artificial Sequence
  chemically synthesized
tttttgttttcttaaatatgag

SEQ ID NO: 1240379 - DNA, 22 bp, Artificial Sequence
  chemically synthesized
ttttgttttcttaaatatgagt

SEQ ID NO: 1240380 - DNA, 22 bp, Artificial Sequence
  chemically synthesized
tttgttttcttaaatatgagtt

SEQ ID NO: 1240381 - DNA, 22 bp, Artificial Sequence
  chemically synthesized
ttgttttcttaaatatgagttg

SEQ ID NO: 1240382 - DNA, 22 bp, Artificial Sequence
  chemically synthesized
tgttttcttaaatatgagttgg

SEQ ID NO: 1240383 - DNA, 22 bp, Artificial Sequence
  chemically synthesized
gttttcttaaatatgagttgga

SEQ ID NO: 1240384 - DNA, 22 bp, Artificial Sequence
  chemically synthesized
tacaataccttttccaactcat

SEQ ID NO: 1240385 - DNA, 22 bp, Artificial Sequence
  chemically synthesized
ttttcttaaatatgagttggaa

SEQ ID NO: 1240386 - DNA, 22 bp, Artificial Sequence
  chemically synthesized
ttatacaataccttttccaact

SEQ ID NO: 1240387 - DNA, 22 bp, Artificial Sequence
  chemically synthesized
tcttaaatatgagttggaaaag

SEQ ID NO: 1240388 - DNA, 22 bp, Artificial Sequence
  chemically synthesized
attatacaataccttttccaac

SEQ ID NO: 1240389 - DNA, 22 bp, Artificial Sequence
  chemically synthesized
cttaaatatgagttggaaaagg

SEQ ID NO: 1240390 - DNA, 22 bp, Artificial Sequence
  chemically synthesized
tattatacaataccttttccaa

SEQ ID NO: 1240391 - DNA, 22 bp, Artificial Sequence
  chemically synthesized
ttaaatatgagttggaaaaggt

SEQ ID NO: 1240392 - DNA, 22 bp, Artificial Sequence
  chemically synthesized
aaatatgagttggaaaaggtat

SEQ ID NO: 1240393 - DNA, 22 bp, Artificial Sequence
  chemically synthesized
ctttattatacaataccttttc

SEQ ID NO: 1240394 - DNA, 22 bp, Artificial Sequence
  chemically synthesized
aatatgagttggaaaaggtatt

SEQ ID NO: 1240395 - DNA, 22 bp, Artificial Sequence
  chemically synthesized
gaaaaggtattgtataataaag

SEQ ID NO: 1240396 - DNA, 22 bp, Artificial Sequence
  chemically synthesized
cgcaacagaatactgctttatt

SEQ ID NO: 1240397 - DNA, 22 bp, Artificial Sequence
  chemically synthesized
ttccgcaacagaatactgcttt

SEQ ID NO: 1240398 - DNA, 22 bp, Artificial Sequence
  chemically synthesized
tataataaagcagtattctgtt

SEQ ID NO: 1240399 - DNA, 22 bp, Artificial Sequence
  chemically synthesized
tgtatattattccgcaacagaa

SEQ ID NO: 1240400 - DNA, 22 bp, Artificial Sequence
  chemically synthesized
tatgtatattattccgcaacag

SEQ ID NO: 1240401 - DNA, 22 bp, Artificial Sequence
  chemically synthesized
ctctatgtatattattccgcaa

SEQ ID NO: 1240402 - DNA, 22 bp, Artificial Sequence
  chemically synthesized
cctctatgtatattattccgca

SEQ ID NO: 1240403 - DNA, 22 bp, Artificial Sequence
  chemically synthesized
tcctctatgtatattattccgc

SEQ ID NO: 1240404 - DNA, 22 bp, Artificial Sequence
  chemically synthesized
tgttgcggaataatatacatag

SEQ ID NO: 1240405 - DNA, 22 bp, Artificial Sequence
  chemically synthesized
ttgcggaataatatacatagag

SEQ ID NO: 1240406 - DNA, 22 bp, Artificial Sequence
  chemically synthesized
agacgtgtactttcctctatgt

SEQ ID NO: 1240407 - DNA, 22 bp, Artificial Sequence
  chemically synthesized
cggaataatatacatagaggaa

SEQ ID NO: 1240408 - DNA, 22 bp, Artificial Sequence
  chemically synthesized
aagacgtgtactttcctctatg

SEQ ID NO: 1240409 - DNA, 22 bp, Artificial Sequence
  chemically synthesized
tacacttaagacgtgtactttc

SEQ ID NO: 1240410 - DNA, 22 bp, Artificial Sequence
  chemically synthesized
agctgtacacttaagacgtgta

SEQ ID NO: 1240411 - DNA, 22 bp, Artificial Sequence
  chemically synthesized
attgagctgtacacttaagacg

SEQ ID NO: 1240412 - DNA, 22 bp, Artificial Sequence
  chemically synthesized
tgacaattcattgagctgtaca

SEQ ID NO: 1240413 - DNA, 22 bp, Artificial Sequence
  chemically synthesized
gtgacaattcattgagctgtac

SEQ ID NO: 1240414 - DNA, 22 bp, Artificial Sequence
  chemically synthesized
ggtttgtgacaattcattgagc

SEQ ID NO: 1240415 - DNA, 22 bp, Artificial Sequence
  chemically synthesized
aagtgtacagctcaatgaattg

SEQ ID NO: 1240416 - DNA, 22 bp, Artificial Sequence
  chemically synthesized
agtgtacagctcaatgaattgt

SEQ ID NO: 1240417 - DNA, 22 bp, Artificial Sequence
  chemically synthesized
aatgaattgtcacaaaccgaac

SEQ ID NO: 1240418 - DNA, 22 bp, Artificial Sequence
  chemically synthesized
gtaatataaatatgttcggttt

SEQ ID NO: 1240419 - DNA, 22 bp, Artificial Sequence
  chemically synthesized
gatgctggtaatataaatatgt

SEQ ID NO: 1240420 - DNA, 22 bp, Artificial Sequence
  chemically synthesized
tcacaaaccgaacatatttata

SEQ ID NO: 1240421 - DNA, 22 bp, Artificial Sequence
  chemically synthesized
aatctcgatgctggtaatataa

SEQ ID NO: 1240422 - DNA, 22 bp, Artificial Sequence
  chemically synthesized
aaatctcgatgctggtaatata

SEQ ID NO: 1240423 - DNA, 22 bp, Artificial Sequence
  chemically synthesized
ttaaatctcgatgctggtaata

SEQ ID NO: 1240424 - DNA, 22 bp, Artificial Sequence
  chemically synthesized
cttaaatctcgatgctggtaat

SEQ ID NO: 1240425 - DNA, 22 bp, Artificial Sequence
  chemically synthesized
tttcttaaatctcgatgctggt

SEQ ID NO: 1240426 - DNA, 22 bp, Artificial Sequence
  chemically synthesized
tgtttcttaaatctcgatgctg

SEQ ID NO: 1240427 - DNA, 22 bp, Artificial Sequence
  chemically synthesized
atattaccagcatcgagattta

SEQ ID NO: 1240428 - DNA, 22 bp, Artificial Sequence
  chemically synthesized
tattaccagcatcgagatttaa

SEQ ID NO: 1240429 - DNA, 22 bp, Artificial Sequence
  chemically synthesized
atcatattctgtttcttaaatc

SEQ ID NO: 1240430 - DNA, 22 bp, Artificial Sequence
  chemically synthesized
ccagcatcgagatttaagaaac

SEQ ID NO: 1240431 - DNA, 22 bp, Artificial Sequence
  chemically synthesized
gggtgttgatcatattctgttt

SEQ ID NO: 1240432 - DNA, 22 bp, Artificial Sequence
  chemically synthesized
ctagggtgttgatcatattctg

SEQ ID NO: 1240433 - DNA, 22 bp, Artificial Sequence
  chemically synthesized
aagaaacagaatatgatcaaca

SEQ ID NO: 1240434 - DNA, 22 bp, Artificial Sequence
  chemically synthesized
agaaacagaatatgatcaacac

SEQ ID NO: 1240435 - DNA, 22 bp, Artificial Sequence
  chemically synthesized
cacatagggggtgtgaggaagc

SEQ ID NO: 1240436 - DNA, 22 bp, Artificial Sequence
  chemically synthesized
ccacatagggggtgtgaggaag

SEQ ID NO: 1240437 - DNA, 22 bp, Artificial Sequence
  chemically synthesized
gcagcttcctcacaccccctat

SEQ ID NO: 1240438 - DNA, 22 bp, Artificial Sequence
  chemically synthesized
aggggagcttccacataggggg

SEQ ID NO: 1240439 - DNA, 22 bp, Artificial Sequence
  chemically synthesized
gaggggagcttccacatagggg

SEQ ID NO: 1240440 - DNA, 22 bp, Artificial Sequence
  chemically synthesized
ttgaggggagcttccacatagg

SEQ ID NO: 1240441 - DNA, 22 bp, Artificial Sequence
  chemically synthesized
cctcacaccccctatgtggaag

SEQ ID NO: 1240442 - DNA, 22 bp, Artificial Sequence
  chemically synthesized
ctcacaccccctatgtggaagc

SEQ ID NO: 1240443 - DNA, 22 bp, Artificial Sequence
  chemically synthesized
acaccccctatgtggaagctcc

SEQ ID NO: 1240444 - DNA, 22 bp, Artificial Sequence
  chemically synthesized
tgtggaagctcccctcaagaat

SEQ ID NO: 1240445 - DNA, 22 bp, Artificial Sequence
  chemically synthesized
ccctcaagaatggccactatga

SEQ ID NO: 1240446 - DNA, 22 bp, Artificial Sequence
  chemically synthesized
tgatgccacaagtcgtcatagt

SEQ ID NO: 1240447 - DNA, 22 bp, Artificial Sequence
  chemically synthesized
aagaatggccactatgacgact

SEQ ID NO: 1240448 - DNA, 22 bp, Artificial Sequence
  chemically synthesized
acctatgatgccacaagtcgtc

SEQ ID NO: 1240449 - DNA, 22 bp, Artificial Sequence
  chemically synthesized
tgacgacttgtggcatcatagg

SEQ ID NO: 1240450 - DNA, 22 bp, Artificial Sequence
  chemically synthesized
aagagaaaactaacctatgatg

SEQ ID NO: 1240451 - DNA, 22 bp, Artificial Sequence
  chemically synthesized
caagagaaaactaacctatgat

SEQ ID NO: 1240452 - DNA, 22 bp, Artificial Sequence
  chemically synthesized
tcaagagaaaactaacctatga

SEQ ID NO: 1240453 - DNA, 22 bp, Artificial Sequence
  chemically synthesized
ctttcaagagaaaactaaccta

SEQ ID NO: 1240454 - DNA, 22 bp, Artificial Sequence
  chemically synthesized
gtggcatcataggttagttttc

SEQ ID NO: 1240455 - DNA, 22 bp, Artificial Sequence
  chemically synthesized
tggcatcataggttagttttct

SEQ ID NO: 1240456 - DNA, 22 bp, Artificial Sequence
  chemically synthesized
ggtgactcctttcaagagaaaa

SEQ ID NO: 1240457 - DNA, 22 bp, Artificial Sequence
  chemically synthesized
aggtgactcctttcaagagaaa

SEQ ID NO: 1240458 - DNA, 22 bp, Artificial Sequence
  chemically synthesized
taggtgactcctttcaagagaa

SEQ ID NO: 1240459 - DNA, 22 bp, Artificial Sequence
  chemically synthesized
tctttaggtgactcctttcaag

SEQ ID NO: 1240460 - DNA, 22 bp, Artificial Sequence
  chemically synthesized
tatctttaggtgactcctttca

SEQ ID NO: 1240461 - DNA, 22 bp, Artificial Sequence
  chemically synthesized
ctatctttaggtgactcctttc

SEQ ID NO: 1240462 - DNA, 22 bp, Artificial Sequence
  chemically synthesized
tctatctttaggtgactccttt

SEQ ID NO: 1240463 - DNA, 22 bp, Artificial Sequence
  chemically synthesized
gttttctcttgaaaggagtcac

SEQ ID NO: 1240464 - DNA, 22 bp, Artificial Sequence
  chemically synthesized
ttctatctttaggtgactcctt

SEQ ID NO: 1240465 - DNA, 22 bp, Artificial Sequence
  chemically synthesized
tctcttgaaaggagtcacctaa

SEQ ID NO: 1240466 - DNA, 22 bp, Artificial Sequence
  chemically synthesized
ctcttgaaaggagtcacctaaa

SEQ ID NO: 1240467 - DNA, 22 bp, Artificial Sequence
  chemically synthesized
tcttgaaaggagtcacctaaag

SEQ ID NO: 1240468 - DNA, 22 bp, Artificial Sequence
  chemically synthesized
ttgaaaggagtcacctaaagat

SEQ ID NO: 1240469 - DNA, 22 bp, Artificial Sequence
  chemically synthesized
gaaaggagtcacctaaagatag

SEQ ID NO: 1240470 - DNA, 22 bp, Artificial Sequence
  chemically synthesized
aaaggagtcacctaaagataga

SEQ ID NO: 1240471 - DNA, 22 bp, Artificial Sequence
  chemically synthesized
aaaatacaaaaccagcattttt

SEQ ID NO: 1240472 - DNA, 22 bp, Artificial Sequence
  chemically synthesized
actcaaaatacaaaaccagcat

SEQ ID NO: 1240473 - DNA, 22 bp, Artificial Sequence
  chemically synthesized
aagatagaaaaatgctggtttt

SEQ ID NO: 1240474 - DNA, 22 bp, Artificial Sequence
  chemically synthesized
taactcaaaatacaaaaccagc

SEQ ID NO: 1240475 - DNA, 22 bp, Artificial Sequence
  chemically synthesized
gtattctaactcaaaatacaaa

SEQ ID NO: 1240476 - DNA, 22 bp, Artificial Sequence
  chemically synthesized
agtcactagtattctaactcaa

SEQ ID NO: 1240477 - DNA, 22 bp, Artificial Sequence
  chemically synthesized
cagtcactagtattctaactca

SEQ ID NO: 1240478 - DNA, 22 bp, Artificial Sequence
  chemically synthesized
gttttgtattttgagttagaat

SEQ ID NO: 1240479 - DNA, 22 bp, Artificial Sequence
  chemically synthesized
tgtattttgagttagaatacta

SEQ ID NO: 1240480 - DNA, 22 bp, Artificial Sequence
  chemically synthesized
gtattttgagttagaatactag

SEQ ID NO: 1240481 - DNA, 22 bp, Artificial Sequence
  chemically synthesized
tattttgagttagaatactagt

SEQ ID NO: 1240482 - DNA, 22 bp, Artificial Sequence
  chemically synthesized
atgtatttcagtcactagtatt

SEQ ID NO: 1240483 - DNA, 22 bp, Artificial Sequence
  chemically synthesized
tgagttagaatactagtgactg

SEQ ID NO: 1240484 - DNA, 22 bp, Artificial Sequence
  chemically synthesized
gagttagaatactagtgactga

SEQ ID NO: 1240485 - DNA, 22 bp, Artificial Sequence
  chemically synthesized
agttagaatactagtgactgaa

SEQ ID NO: 1240486 - DNA, 22 bp, Artificial Sequence
  chemically synthesized
cataaatctaatgtatttcagt

SEQ ID NO: 1240487 - DNA, 22 bp, Artificial Sequence
  chemically synthesized
gaatactagtgactgaaataca

SEQ ID NO: 1240488 - DNA, 22 bp, Artificial Sequence
  chemically synthesized
tgcataaatctaatgtatttca

SEQ ID NO: 1240489 - DNA, 22 bp, Artificial Sequence
  chemically synthesized
cctctgcataaatctaatgtat

SEQ ID NO: 1240490 - DNA, 22 bp, Artificial Sequence
  chemically synthesized
gtgactgaaatacattagattt

SEQ ID NO: 1240491 - DNA, 22 bp, Artificial Sequence
  chemically synthesized
aattccctctgcataaatctaa

SEQ ID NO: 1240492 - DNA, 22 bp, Artificial Sequence
  chemically synthesized
taaattccctctgcataaatct

SEQ ID NO: 1240493 - DNA, 22 bp, Artificial Sequence
  chemically synthesized
ctaaattccctctgcataaatc

SEQ ID NO: 1240494 - DNA, 22 bp, Artificial Sequence
  chemically synthesized
tctaaattccctctgcataaat

SEQ ID NO: 1240495 - DNA, 22 bp, Artificial Sequence
  chemically synthesized
aaatacattagatttatgcaga

SEQ ID NO: 1240496 - DNA, 22 bp, Artificial Sequence
  chemically synthesized
ttctaaattccctctgcataaa

SEQ ID NO: 1240497 - DNA, 22 bp, Artificial Sequence
  chemically synthesized
tttctaaattccctctgcataa

SEQ ID NO: 1240498 - DNA, 22 bp, Artificial Sequence
  chemically synthesized
ttttctaaattccctctgcata

SEQ ID NO: 1240499 - DNA, 22 bp, Artificial Sequence
  chemically synthesized
gatttatgcagagggaatttag

SEQ ID NO: 1240500 - DNA, 22 bp, Artificial Sequence
  chemically synthesized
tcagtgtgacttttttctaaat

SEQ ID NO: 1240501 - DNA, 22 bp, Artificial Sequence
  chemically synthesized
atgcagagggaatttagaaaaa

SEQ ID NO: 1240502 - DNA, 22 bp, Artificial Sequence
  chemically synthesized
atcagtgtgacttttttctaaa

SEQ ID NO: 1240503 - DNA, 22 bp, Artificial Sequence
  chemically synthesized
tgcagagggaatttagaaaaaa

SEQ ID NO: 1240504 - DNA, 22 bp, Artificial Sequence
  chemically synthesized
tatcagtgtgacttttttctaa

SEQ ID NO: 1240505 - DNA, 22 bp, Artificial Sequence
  chemically synthesized
caaagcatattttatcagtgtg

SEQ ID NO: 1240506 - DNA, 22 bp, Artificial Sequence
  chemically synthesized
ccaaagcatattttatcagtgt

SEQ ID NO: 1240507 - DNA, 22 bp, Artificial Sequence
  chemically synthesized
agaaaaaagtcacactgataaa

SEQ ID NO: 1240508 - DNA, 22 bp, Artificial Sequence
  chemically synthesized
tccaaagcatattttatcagtg

SEQ ID NO: 1240509 - DNA, 22 bp, Artificial Sequence
  chemically synthesized
gaaaaaagtcacactgataaaa

SEQ ID NO: 1240510 - DNA, 22 bp, Artificial Sequence
  chemically synthesized
ccccgtgttttccaaagcatat

SEQ ID NO: 1240511 - DNA, 22 bp, Artificial Sequence
  chemically synthesized
ataaaatatgctttggaaaaca

SEQ ID NO: 1240512 - DNA, 22 bp, Artificial Sequence
  chemically synthesized
atggcatcataccattcccccg

SEQ ID NO: 1240513 - DNA, 22 bp, Artificial Sequence
  chemically synthesized
tggaaaacacgggggaatggta

SEQ ID NO: 1240514 - DNA, 22 bp, Artificial Sequence
  chemically synthesized
ttcatggcatcataccattccc

SEQ ID NO: 1240515 - DNA, 22 bp, Artificial Sequence
  chemically synthesized
ggaaaacacgggggaatggtat

SEQ ID NO: 1240516 - DNA, 22 bp, Artificial Sequence
  chemically synthesized
attcatggcatcataccattcc

SEQ ID NO: 1240517 - DNA, 22 bp, Artificial Sequence
  chemically synthesized
gaaaacacgggggaatggtatg

SEQ ID NO: 1240518 - DNA, 22 bp, Artificial Sequence
  chemically synthesized
ttattcatggcatcataccatt

SEQ ID NO: 1240519 - DNA, 22 bp, Artificial Sequence
  chemically synthesized
ggtgtacagtcaacattcttat

SEQ ID NO: 1240520 - DNA, 22 bp, Artificial Sequence
  chemically synthesized
tgggtgtacagtcaacattctt

SEQ ID NO: 1240521 - DNA, 22 bp, Artificial Sequence
  chemically synthesized
aacccaaggcattctgggtgta

SEQ ID NO: 1240522 - DNA, 22 bp, Artificial Sequence
  chemically synthesized
ggagttgaacccaaggcattct

SEQ ID NO: 1240523 - DNA, 22 bp, Artificial Sequence
  chemically synthesized
actgtacacccagaatgccttg

SEQ ID NO: 1240524 - DNA, 22 bp, Artificial Sequence
  chemically synthesized
tacacccagaatgccttgggtt

SEQ ID NO: 1240525 - DNA, 22 bp, Artificial Sequence
  chemically synthesized
cagagctgggagttgaacccaa

SEQ ID NO: 1240526 - DNA, 22 bp, Artificial Sequence
  chemically synthesized
gggttcaactcccagctctgca

SEQ ID NO: 1240527 - DNA, 22 bp, Artificial Sequence
  chemically synthesized
ggttcaactcccagctctgcag

SEQ ID NO: 1240528 - DNA, 22 bp, Artificial Sequence
  chemically synthesized
cccaagatcacactgcagagct

SEQ ID NO: 1240529 - DNA, 22 bp, Artificial Sequence
  chemically synthesized
gcccaagatcacactgcagagc

SEQ ID NO: 1240530 - DNA, 22 bp, Artificial Sequence
  chemically synthesized
cttgcccaagatcacactgcag

SEQ ID NO: 1240531 - DNA, 22 bp, Artificial Sequence
  chemically synthesized
aactcccagctctgcagtgtga

SEQ ID NO: 1240532 - DNA, 22 bp, Artificial Sequence
  chemically synthesized
ccagctctgcagtgtgatcttg

SEQ ID NO: 1240533 - DNA, 22 bp, Artificial Sequence
  chemically synthesized
tgcagtgtgatcttgggcaagt

SEQ ID NO: 1240534 - DNA, 22 bp, Artificial Sequence
  chemically synthesized
cagtgtgatcttgggcaagtaa

SEQ ID NO: 1240535 - DNA, 22 bp, Artificial Sequence
  chemically synthesized
gggcaagtaacttctccgtgcc

SEQ ID NO: 1240536 - DNA, 22 bp, Artificial Sequence
  chemically synthesized
ggcaagtaacttctccgtgcct

SEQ ID NO: 1240537 - DNA, 22 bp, Artificial Sequence
  chemically synthesized
tagatgaaaagagtaaggcacg

SEQ ID NO: 1240538 - DNA, 22 bp, Artificial Sequence
  chemically synthesized
tatagatgaaaagagtaaggca

SEQ ID NO: 1240539 - DNA, 22 bp, Artificial Sequence
  chemically synthesized
ctatagatgaaaagagtaaggc

SEQ ID NO: 1240540 - DNA, 22 bp, Artificial Sequence
  chemically synthesized
tctatagatgaaaagagtaagg

SEQ ID NO: 1240541 - DNA, 22 bp, Artificial Sequence
  chemically synthesized
tttctatagatgaaaagagtaa

SEQ ID NO: 1240542 - DNA, 22 bp, Artificial Sequence
  chemically synthesized
ctccgtgccttactcttttcat

SEQ ID NO: 1240543 - DNA, 22 bp, Artificial Sequence
  chemically synthesized
tccgtgccttactcttttcatc

SEQ ID NO: 1240544 - DNA, 22 bp, Artificial Sequence
  chemically synthesized
cgtgccttactcttttcatcta

SEQ ID NO: 1240545 - DNA, 22 bp, Artificial Sequence
  chemically synthesized
actcttttcatctatagaaaga

SEQ ID NO: 1240546 - DNA, 22 bp, Artificial Sequence
  chemically synthesized
ctcttttcatctatagaaagag

SEQ ID NO: 1240547 - DNA, 22 bp, Artificial Sequence
  chemically synthesized
ttttcatctatagaaagagcat

SEQ ID NO: 1240548 - DNA, 22 bp, Artificial Sequence
  chemically synthesized
ttcatctatagaaagagcatgt

SEQ ID NO: 1240549 - DNA, 22 bp, Artificial Sequence
  chemically synthesized
tcatctatagaaagagcatgta

SEQ ID NO: 1240550 - DNA, 22 bp, Artificial Sequence
  chemically synthesized
catctatagaaagagcatgtat

SEQ ID NO: 1240551 - DNA, 22 bp, Artificial Sequence
  chemically synthesized
atctatagaaagagcatgtatc

SEQ ID NO: 1240552 - DNA, 22 bp, Artificial Sequence
  chemically synthesized
tagaaagagcatgtatcattac

SEQ ID NO: 1240553 - DNA, 22 bp, Artificial Sequence
  chemically synthesized
caatatcaccacaacataggta

SEQ ID NO: 1240554 - DNA, 22 bp, Artificial Sequence
  chemically synthesized
gcaatatcaccacaacataggt

SEQ ID NO: 1240555 - DNA, 22 bp, Artificial Sequence
  chemically synthesized
tgcaatatcaccacaacatagg

SEQ ID NO: 1240556 - DNA, 22 bp, Artificial Sequence
  chemically synthesized
aatctttgcaatatcaccacaa

SEQ ID NO: 1240557 - DNA, 22 bp, Artificial Sequence
  chemically synthesized
aaatctttgcaatatcaccaca

SEQ ID NO: 1240558 - DNA, 22 bp, Artificial Sequence
  chemically synthesized
acttaaatctttgcaatatcac

SEQ ID NO: 1240559 - DNA, 22 bp, Artificial Sequence
  chemically synthesized
cctatgttgtggtgatattgca

SEQ ID NO: 1240560 - DNA, 22 bp, Artificial Sequence
  chemically synthesized
tgttgtggtgatattgcaaaga

SEQ ID NO: 1240561 - DNA, 22 bp, Artificial Sequence
  chemically synthesized
agttcacttaaatctttgcaat

SEQ ID NO: 1240562 - DNA, 22 bp, Artificial Sequence
  chemically synthesized
tggtgatattgcaaagatttaa

SEQ ID NO: 1240563 - DNA, 22 bp, Artificial Sequence
  chemically synthesized
caaagtgccatactaagttcac

SEQ ID NO: 1240564 - DNA, 22 bp, Artificial Sequence
  chemically synthesized
caaagatttaagtgaacttagt

SEQ ID NO: 1240565 - DNA, 22 bp, Artificial Sequence
  chemically synthesized
acaaagtgccatactaagttca

SEQ ID NO: 1240566 - DNA, 22 bp, Artificial Sequence
  chemically synthesized
aagtgaacttagtatggcactt

SEQ ID NO: 1240567 - DNA, 22 bp, Artificial Sequence
  chemically synthesized
agtgaacttagtatggcacttt

SEQ ID NO: 1240568 - DNA, 22 bp, Artificial Sequence
  chemically synthesized
cagaatatatcttacaaagtgc

SEQ ID NO: 1240569 - DNA, 22 bp, Artificial Sequence
  chemically synthesized
acagaatatatcttacaaagtg

SEQ ID NO: 1240570 - DNA, 22 bp, Artificial Sequence
  chemically synthesized
agtatggcactttgtaagatat

SEQ ID NO: 1240571 - DNA, 22 bp, Artificial Sequence
  chemically synthesized
gtatggcactttgtaagatata

SEQ ID NO: 1240572 - DNA, 22 bp, Artificial Sequence
  chemically synthesized
acacttacagaatatatcttac

SEQ ID NO: 1240573 - DNA, 22 bp, Artificial Sequence
  chemically synthesized
tgtaagatatattctgtaagtg

SEQ ID NO: 1240574 - DNA, 22 bp, Artificial Sequence
  chemically synthesized
gtaagatatattctgtaagtgt

SEQ ID NO: 1240575 - DNA, 22 bp, Artificial Sequence
  chemically synthesized
taagatatattctgtaagtgtt

SEQ ID NO: 1240576 - DNA, 22 bp, Artificial Sequence
  chemically synthesized
gaataaacgtgtgatagctaac

SEQ ID NO: 1240577 - DNA, 22 bp, Artificial Sequence
  chemically synthesized
ggaataaacgtgtgatagctaa

SEQ ID NO: 1240578 - DNA, 22 bp, Artificial Sequence
  chemically synthesized
tgtaagtgttagctatcacacg

SEQ ID NO: 1240579 - DNA, 22 bp, Artificial Sequence
  chemically synthesized
taagtgttagctatcacacgtt

SEQ ID NO: 1240580 - DNA, 22 bp, Artificial Sequence
  chemically synthesized
gaaagtttggaataaacgtgtg

SEQ ID NO: 1240581 - DNA, 22 bp, Artificial Sequence
  chemically synthesized
agaaagtttggaataaacgtgt

SEQ ID NO: 1240582 - DNA, 22 bp, Artificial Sequence
  chemically synthesized
gcttagaaagtttggaataaac

SEQ ID NO: 1240583 - DNA, 22 bp, Artificial Sequence
  chemically synthesized
ggcttagaaagtttggaataaa

SEQ ID NO: 1240584 - DNA, 22 bp, Artificial Sequence
  chemically synthesized
gctatcacacgtttattccaaa

SEQ ID NO: 1240585 - DNA, 22 bp, Artificial Sequence
  chemically synthesized
tttggcttagaaagtttggaat

SEQ ID NO: 1240586 - DNA, 22 bp, Artificial Sequence
  chemically synthesized
tcacacgtttattccaaacttt

SEQ ID NO: 1240587 - DNA, 22 bp, Artificial Sequence
  chemically synthesized
attccaaactttctaagccaaa

SEQ ID NO: 1240588 - DNA, 22 bp, Artificial Sequence
  chemically synthesized
ttccaaactttctaagccaaat

SEQ ID NO: 1240589 - DNA, 22 bp, Artificial Sequence
  chemically synthesized
caaactttctaagccaaataat

SEQ ID NO: 1240590 - DNA, 22 bp, Artificial Sequence
  chemically synthesized
tagacgatatggattatttggc

SEQ ID NO: 1240591 - DNA, 22 bp, Artificial Sequence
  chemically synthesized
tctaagccaaataatccatatc

SEQ ID NO: 1240592 - DNA, 22 bp, Artificial Sequence
  chemically synthesized
ctaagccaaataatccatatcg

SEQ ID NO: 1240593 - DNA, 22 bp, Artificial Sequence
  chemically synthesized
taagccaaataatccatatcgt

SEQ ID NO: 1240594 - DNA, 22 bp, Artificial Sequence
  chemically synthesized
agccaaataatccatatcgtct

SEQ ID NO: 1240595 - DNA, 22 bp, Artificial Sequence
  chemically synthesized
caaggaaagttatagacgatat

SEQ ID NO: 1240596 - DNA, 22 bp, Artificial Sequence
  chemically synthesized
aggccaacattacaaggaaagt

SEQ ID NO: 1240597 - DNA, 22 bp, Artificial Sequence
  chemically synthesized
gaggccaacattacaaggaaag

SEQ ID NO: 1240598 - DNA, 22 bp, Artificial Sequence
  chemically synthesized
tgaggccaacattacaaggaaa

SEQ ID NO: 1240599 - DNA, 22 bp, Artificial Sequence
  chemically synthesized
ctttgaggccaacattacaagg

SEQ ID NO: 1240600 - DNA, 22 bp, Artificial Sequence
  chemically synthesized
ttactttgaggccaacattaca

SEQ ID NO: 1240601 - DNA, 22 bp, Artificial Sequence
  chemically synthesized
taactttccttgtaatgttggc

SEQ ID NO: 1240602 - DNA, 22 bp, Artificial Sequence
  chemically synthesized
tgttactttgaggccaacatta

SEQ ID NO: 1240603 - DNA, 22 bp, Artificial Sequence
  chemically synthesized
ctgttactttgaggccaacatt

SEQ ID NO: 1240604 - DNA, 22 bp, Artificial Sequence
  chemically synthesized
tccttgtaatgttggcctcaaa

SEQ ID NO: 1240605 - DNA, 22 bp, Artificial Sequence
  chemically synthesized
ccttgtaatgttggcctcaaag

SEQ ID NO: 1240606 - DNA, 22 bp, Artificial Sequence
  chemically synthesized
cttgtaatgttggcctcaaagt

SEQ ID NO: 1240607 - DNA, 22 bp, Artificial Sequence
  chemically synthesized
gtcccttctgttactttgaggc

SEQ ID NO: 1240608 - DNA, 22 bp, Artificial Sequence
  chemically synthesized
gtaatgttggcctcaaagtaac

SEQ ID NO: 1240609 - DNA, 22 bp, Artificial Sequence
  chemically synthesized
taatgttggcctcaaagtaaca

SEQ ID NO: 1240610 - DNA, 22 bp, Artificial Sequence
  chemically synthesized
aagttggtcccttctgttactt

SEQ ID NO: 1240611 - DNA, 22 bp, Artificial Sequence
  chemically synthesized
gaagttggtcccttctgttact

SEQ ID NO: 1240612 - DNA, 22 bp, Artificial Sequence
  chemically synthesized
tgaagttggtcccttctgttac

SEQ ID NO: 1240613 - DNA, 22 bp, Artificial Sequence
  chemically synthesized
gcctcaaagtaacagaagggac

SEQ ID NO: 1240614 - DNA, 22 bp, Artificial Sequence
  chemically synthesized
atattttgaagttggtcccttc

SEQ ID NO: 1240615 - DNA, 22 bp, Artificial Sequence
  chemically synthesized
tcatattttgaagttggtccct

SEQ ID NO: 1240616 - DNA, 22 bp, Artificial Sequence
  chemically synthesized
aaagtaacagaagggaccaact

SEQ ID NO: 1240617 - DNA, 22 bp, Artificial Sequence
  chemically synthesized
attctcatattttgaagttggt

SEQ ID NO: 1240618 - DNA, 22 bp, Artificial Sequence
  chemically synthesized
aattctcatattttgaagttgg

SEQ ID NO: 1240619 - DNA, 22 bp, Artificial Sequence
  chemically synthesized
taattctcatattttgaagttg

SEQ ID NO: 1240620 - DNA, 22 bp, Artificial Sequence
  chemically synthesized
ttaattctcatattttgaagtt

SEQ ID NO: 1240621 - DNA, 22 bp, Artificial Sequence
  chemically synthesized
acccttttaattctcatatttt

SEQ ID NO: 1240622 - DNA, 22 bp, Artificial Sequence
  chemically synthesized
ttaacccttttaattctcatat

SEQ ID NO: 1240623 - DNA, 22 bp, Artificial Sequence
  chemically synthesized
attaacccttttaattctcata

SEQ ID NO: 1240624 - DNA, 22 bp, Artificial Sequence
  chemically synthesized
catttattaacccttttaattc

SEQ ID NO: 1240625 - DNA, 22 bp, Artificial Sequence
  chemically synthesized
acatttattaacccttttaatt

SEQ ID NO: 1240626 - DNA, 22 bp, Artificial Sequence
  chemically synthesized
caaaatatgagaattaaaaggg

SEQ ID NO: 1240627 - DNA, 22 bp, Artificial Sequence
  chemically synthesized
aaaatatgagaattaaaagggt

SEQ ID NO: 1240628 - DNA, 22 bp, Artificial Sequence
  chemically synthesized
aaagggttaataaatgtaagat

SEQ ID NO: 1240629 - DNA, 22 bp, Artificial Sequence
  chemically synthesized
ggtaccataccagacatcttac

SEQ ID NO: 1240630 - DNA, 22 bp, Artificial Sequence
  chemically synthesized
tgctaggtaccataccagacat

SEQ ID NO: 1240631 - DNA, 22 bp, Artificial Sequence
  chemically synthesized
ataaatgtaagatgtctggtat

SEQ ID NO: 1240632 - DNA, 22 bp, Artificial Sequence
  chemically synthesized
tatgctaggtaccataccagac

SEQ ID NO: 1240633 - DNA, 22 bp, Artificial Sequence
  chemically synthesized
ctatgctaggtaccataccaga

SEQ ID NO: 1240634 - DNA, 22 bp, Artificial Sequence
  chemically synthesized
tctatgctaggtaccataccag

SEQ ID NO: 1240635 - DNA, 22 bp, Artificial Sequence
  chemically synthesized
agcattttctatgctaggtacc

SEQ ID NO: 1240636 - DNA, 22 bp, Artificial Sequence
  chemically synthesized
ttgagcattttctatgctaggt

SEQ ID NO: 1240637 - DNA, 22 bp, Artificial Sequence
  chemically synthesized
attgagcattttctatgctagg

SEQ ID NO: 1240638 - DNA, 22 bp, Artificial Sequence
  chemically synthesized
tattgagcattttctatgctag

SEQ ID NO: 1240639 - DNA, 22 bp, Artificial Sequence
  chemically synthesized
ttattgagcattttctatgcta

SEQ ID NO: 1240640 - DNA, 22 bp, Artificial Sequence
  chemically synthesized
gtatggtacctagcatagaaaa

SEQ ID NO: 1240641 - DNA, 22 bp, Artificial Sequence
  chemically synthesized
atgtttttattgagcattttct

SEQ ID NO: 1240642 - DNA, 22 bp, Artificial Sequence
  chemically synthesized
aatgtttttattgagcattttc

SEQ ID NO: 1240643 - DNA, 22 bp, Artificial Sequence
  chemically synthesized
tttaatgtttttattgagcatt

SEQ ID NO: 1240644 - DNA, 22 bp, Artificial Sequence
  chemically synthesized
atttaatgtttttattgagcat

SEQ ID NO: 1240645 - DNA, 22 bp, Artificial Sequence
  chemically synthesized
gcatagaaaatgctcaataaaa

SEQ ID NO: 1240646 - DNA, 22 bp, Artificial Sequence
  chemically synthesized
aataaaaacattaaataaatta

SEQ ID NO: 1240647 - DNA, 22 bp, Artificial Sequence
  chemically synthesized
acaggagggaatgtaatttatt

SEQ ID NO: 1240648 - DNA, 22 bp, Artificial Sequence
  chemically synthesized
aacaggagggaatgtaatttat

SEQ ID NO: 1240649 - DNA, 22 bp, Artificial Sequence
  chemically synthesized
aataaattacattccctcctgt

SEQ ID NO: 1240650 - DNA, 22 bp, Artificial Sequence
  chemically synthesized
caggtgataacatttaacagga

SEQ ID NO: 1240651 - DNA, 22 bp, Artificial Sequence
  chemically synthesized
cattccctcctgttaaatgtta

SEQ ID NO: 1240652 - DNA, 22 bp, Artificial Sequence
  chemically synthesized
cacctccaggtgataacattta

SEQ ID NO: 1240653 - DNA, 22 bp, Artificial Sequence
  chemically synthesized
tccacctccaggtgataacatt

SEQ ID NO: 1240654 - DNA, 22 bp, Artificial Sequence
  chemically synthesized
cctcctgttaaatgttatcacc

SEQ ID NO: 1240655 - DNA, 22 bp, Artificial Sequence
  chemically synthesized
ctgttaaatgttatcacctgga

SEQ ID NO: 1240656 - DNA, 22 bp, Artificial Sequence
  chemically synthesized
ttaaatgttatcacctggaggt

SEQ ID NO: 1240657 - DNA, 22 bp, Artificial Sequence
  chemically synthesized
aatgttatcacctggaggtgga

SEQ ID NO: 1240658 - DNA, 22 bp, Artificial Sequence
  chemically synthesized
aaaggagagtgtcattctccac

SEQ ID NO: 1240659 - DNA, 22 bp, Artificial Sequence
  chemically synthesized
caaaggagagtgtcattctcca

SEQ ID NO: 1240660 - DNA, 22 bp, Artificial Sequence
  chemically synthesized
tcacctggaggtggagaatgac

SEQ ID NO: 1240661 - DNA, 22 bp, Artificial Sequence
  chemically synthesized
gaggtggagaatgacactctcc

SEQ ID NO: 1240662 - DNA, 22 bp, Artificial Sequence
  chemically synthesized
tggccatataaatttcaaagga

SEQ ID NO: 1240663 - DNA, 22 bp, Artificial Sequence
  chemically synthesized
ctatggccatataaatttcaaa

SEQ ID NO: 1240664 - DNA, 22 bp, Artificial Sequence
  chemically synthesized
tcctttgaaatttatatggcca

SEQ ID NO: 1240665 - DNA, 22 bp, Artificial Sequence
  chemically synthesized
ctttgaaatttatatggccata

SEQ ID NO: 1240666 - DNA, 22 bp, Artificial Sequence
  chemically synthesized
ccaaagtcctgctatggccata

SEQ ID NO: 1240667 - DNA, 22 bp, Artificial Sequence
  chemically synthesized
tgaaatttatatggccatagca

SEQ ID NO: 1240668 - DNA, 22 bp, Artificial Sequence
  chemically synthesized
gaaatttatatggccatagcag

SEQ ID NO: 1240669 - DNA, 22 bp, Artificial Sequence
  chemically synthesized
aaatttatatggccatagcagg

SEQ ID NO: 1240670 - DNA, 22 bp, Artificial Sequence
  chemically synthesized
agattaccaaagtcctgctatg

SEQ ID NO: 1240671 - DNA, 22 bp, Artificial Sequence
  chemically synthesized
tcagattaccaaagtcctgcta

SEQ ID NO: 1240672 - DNA, 22 bp, Artificial Sequence
  chemically synthesized
ctcagattaccaaagtcctgct

SEQ ID NO: 1240673 - DNA, 22 bp, Artificial Sequence
  chemically synthesized
atatggccatagcaggactttg

SEQ ID NO: 1240674 - DNA, 22 bp, Artificial Sequence
  chemically synthesized
ttctcagattaccaaagtcctg

SEQ ID NO: 1240675 - DNA, 22 bp, Artificial Sequence
  chemically synthesized
tatggccatagcaggactttgg

SEQ ID NO: 1240676 - DNA, 22 bp, Artificial Sequence
  chemically synthesized
aactcttctcagattaccaaag

SEQ ID NO: 1240677 - DNA, 22 bp, Artificial Sequence
  chemically synthesized
ttaaactcttctcagattacca

SEQ ID NO: 1240678 - DNA, 22 bp, Artificial Sequence
  chemically synthesized
attaaactcttctcagattacc

SEQ ID NO: 1240679 - DNA, 22 bp, Artificial Sequence
  chemically synthesized
tggtaatctgagaagagtttaa

SEQ ID NO: 1240680 - DNA, 22 bp, Artificial Sequence
  chemically synthesized
ggtaatctgagaagagtttaat

SEQ ID NO: 1240681 - DNA, 22 bp, Artificial Sequence
  chemically synthesized
gtaatctgagaagagtttaata

SEQ ID NO: 1240682 - DNA, 22 bp, Artificial Sequence
  chemically synthesized
taaacagtcccttattaaactc

SEQ ID NO: 1240683 - DNA, 22 bp, Artificial Sequence
  chemically synthesized
ataaacagtcccttattaaact

SEQ ID NO: 1240684 - DNA, 22 bp, Artificial Sequence
  chemically synthesized
tataaacagtcccttattaaac

SEQ ID NO: 1240685 - DNA, 22 bp, Artificial Sequence
  chemically synthesized
ttataaacagtcccttattaaa

SEQ ID NO: 1240686 - DNA, 22 bp, Artificial Sequence
  chemically synthesized
atttttataaacagtcccttat

SEQ ID NO: 1240687 - DNA, 22 bp, Artificial Sequence
  chemically synthesized
agaagagtttaataagggactg

SEQ ID NO: 1240688 - DNA, 22 bp, Artificial Sequence
  chemically synthesized
cctcatttttataaacagtccc

SEQ ID NO: 1240689 - DNA, 22 bp, Artificial Sequence
  chemically synthesized
ccctcatttttataaacagtcc

SEQ ID NO: 1240690 - DNA, 22 bp, Artificial Sequence
  chemically synthesized
aataagggactgtttataaaaa

SEQ ID NO: 1240691 - DNA, 22 bp, Artificial Sequence
  chemically synthesized
taccttccctcatttttataaa

SEQ ID NO: 1240692 - DNA, 22 bp, Artificial Sequence
  chemically synthesized
ataagggactgtttataaaaat

SEQ ID NO: 1240693 - DNA, 22 bp, Artificial Sequence
  chemically synthesized
attataccttccctcattttta

SEQ ID NO: 1240694 - DNA, 22 bp, Artificial Sequence
  chemically synthesized
cattataccttccctcattttt

SEQ ID NO: 1240695 - DNA, 22 bp, Artificial Sequence
  chemically synthesized
tttataaaaatgagggaaggta

SEQ ID NO: 1240696 - DNA, 22 bp, Artificial Sequence
  chemically synthesized
cagtggtttcattataccttcc

SEQ ID NO: 1240697 - DNA, 22 bp, Artificial Sequence
  chemically synthesized
ataaaaatgagggaaggtataa

SEQ ID NO: 1240698 - DNA, 22 bp, Artificial Sequence
  chemically synthesized
taaaaatgagggaaggtataat

SEQ ID NO: 1240699 - DNA, 22 bp, Artificial Sequence
  chemically synthesized
gttccagtggtttcattatacc

SEQ ID NO: 1240700 - DNA, 22 bp, Artificial Sequence
  chemically synthesized
ctagttccagtggtttcattat

SEQ ID NO: 1240701 - DNA, 22 bp, Artificial Sequence
  chemically synthesized
ttactagttccagtggtttcat

SEQ ID NO: 1240702 - DNA, 22 bp, Artificial Sequence
  chemically synthesized
tattactagttccagtggtttc

SEQ ID NO: 1240703 - DNA, 22 bp, Artificial Sequence
  chemically synthesized
tctattactagttccagtggtt

SEQ ID NO: 1240704 - DNA, 22 bp, Artificial Sequence
  chemically synthesized
ctctattactagttccagtggt

SEQ ID NO: 1240705 - DNA, 22 bp, Artificial Sequence
  chemically synthesized
agagtagtagtgacacttctct

SEQ ID NO: 1240706 - DNA, 22 bp, Artificial Sequence
  chemically synthesized
gaactagtaatagagaagtgtc

SEQ ID NO: 1240707 - DNA, 22 bp, Artificial Sequence
  chemically synthesized
gtaatagagaagtgtcactact

SEQ ID NO: 1240708 - DNA, 22 bp, Artificial Sequence
  chemically synthesized
ggagtctaagagtagtagtgac

SEQ ID NO: 1240709 - DNA, 22 bp, Artificial Sequence
  chemically synthesized
aggagtctaagagtagtagtga

SEQ ID NO: 1240710 - DNA, 22 bp, Artificial Sequence
  chemically synthesized
ttaggagtctaagagtagtagt

SEQ ID NO: 1240711 - DNA, 22 bp, Artificial Sequence
  chemically synthesized
attcttaggagtctaagagtag

SEQ ID NO: 1240712 - DNA, 22 bp, Artificial Sequence
  chemically synthesized
cattcttaggagtctaagagta

SEQ ID NO: 1240713 - DNA, 22 bp, Artificial Sequence
  chemically synthesized
tcattcttaggagtctaagagt

SEQ ID NO: 1240714 - DNA, 22 bp, Artificial Sequence
  chemically synthesized
ttcattcttaggagtctaagag

SEQ ID NO: 1240715 - DNA, 22 bp, Artificial Sequence
  chemically synthesized
ttttcattcttaggagtctaag

SEQ ID NO: 1240716 - DNA, 22 bp, Artificial Sequence
  chemically synthesized
cttttcattcttaggagtctaa

SEQ ID NO: 1240717 - DNA, 22 bp, Artificial Sequence
  chemically synthesized
cttcttttcattcttaggagtc

SEQ ID NO: 1240718 - DNA, 22 bp, Artificial Sequence
  chemically synthesized
tccttcttttcattcttaggag

SEQ ID NO: 1240719 - DNA, 22 bp, Artificial Sequence
  chemically synthesized
ctactcttagactcctaagaat

SEQ ID NO: 1240720 - DNA, 22 bp, Artificial Sequence
  chemically synthesized
ctcttagactcctaagaatgaa

SEQ ID NO: 1240721 - DNA, 22 bp, Artificial Sequence
  chemically synthesized
ttagactcctaagaatgaaaag

SEQ ID NO: 1240722 - DNA, 22 bp, Artificial Sequence
  chemically synthesized
agactcctaagaatgaaaagaa

SEQ ID NO: 1240723 - DNA, 22 bp, Artificial Sequence
  chemically synthesized
gactcctaagaatgaaaagaag

SEQ ID NO: 1240724 - DNA, 22 bp, Artificial Sequence
  chemically synthesized
gaaaccactctccttcttttca

SEQ ID NO: 1240725 - DNA, 22 bp, Artificial Sequence
  chemically synthesized
ctaagaatgaaaagaaggagag

SEQ ID NO: 1240726 - DNA, 22 bp, Artificial Sequence
  chemically synthesized
agaatgaaaagaaggagagtgg

SEQ ID NO: 1240727 - DNA, 22 bp, Artificial Sequence
  chemically synthesized
tgtagtaactagaaaccactct

SEQ ID NO: 1240728 - DNA, 22 bp, Artificial Sequence
  chemically synthesized
tatgtagtaactagaaaccact

SEQ ID NO: 1240729 - DNA, 22 bp, Artificial Sequence
  chemically synthesized
tctatgtagtaactagaaacca

SEQ ID NO: 1240730 - DNA, 22 bp, Artificial Sequence
  chemically synthesized
tctctatgtagtaactagaaac

SEQ ID NO: 1240731 - DNA, 22 bp, Artificial Sequence
  chemically synthesized
tctctctatgtagtaactagaa

SEQ ID NO: 1240732 - DNA, 22 bp, Artificial Sequence
  chemically synthesized
agttctctctctatgtagtaac

SEQ ID NO: 1240733 - DNA, 22 bp, Artificial Sequence
  chemically synthesized
tcagttctctctctatgtagta

SEQ ID NO: 1240734 - DNA, 22 bp, Artificial Sequence
  chemically synthesized
ctcagttctctctctatgtagt

SEQ ID NO: 1240735 - DNA, 22 bp, Artificial Sequence
  chemically synthesized
ttctcagttctctctctatgta

SEQ ID NO: 1240736 - DNA, 22 bp, Artificial Sequence
  chemically synthesized
tcttctcagttctctctctatg

SEQ ID NO: 1240737 - DNA, 22 bp, Artificial Sequence
  chemically synthesized
ctcttctcagttctctctctat

SEQ ID NO: 1240738 - DNA, 22 bp, Artificial Sequence
  chemically synthesized
ctagttactacatagagagaga

SEQ ID NO: 1240739 - DNA, 22 bp, Artificial Sequence
  chemically synthesized
tagttactacatagagagagaa

SEQ ID NO: 1240740 - DNA, 22 bp, Artificial Sequence
  chemically synthesized
gttactacatagagagagaact

SEQ ID NO: 1240741 - DNA, 22 bp, Artificial Sequence
  chemically synthesized
ctacatagagagagaactgaga

SEQ ID NO: 1240742 - DNA, 22 bp, Artificial Sequence
  chemically synthesized
catagagagagaactgagaaga

SEQ ID NO: 1240743 - DNA, 22 bp, Artificial Sequence
  chemically synthesized
tcagataatcttctcttctcag

SEQ ID NO: 1240744 - DNA, 22 bp, Artificial Sequence
  chemically synthesized
ctgtcagataatcttctcttct

SEQ ID NO: 1240745 - DNA, 22 bp, Artificial Sequence
  chemically synthesized
agaagagaagattatctgacag

SEQ ID NO: 1240746 - DNA, 22 bp, Artificial Sequence
  chemically synthesized
catcacccaatatcaaagctcc

SEQ ID NO: 1240747 - DNA, 22 bp, Artificial Sequence
  chemically synthesized
tctgacaggagctttgatattg

SEQ ID NO: 1240748 - DNA, 22 bp, Artificial Sequence
  chemically synthesized
acaggagctttgatattgggtg

SEQ ID NO: 1240749 - DNA, 22 bp, Artificial Sequence
  chemically synthesized
tgatattgggtgatggaatttc

SEQ ID NO: 1240750 - DNA, 22 bp, Artificial Sequence
  chemically synthesized
gatattgggtgatggaatttct

SEQ ID NO: 1240751 - DNA, 22 bp, Artificial Sequence
  chemically synthesized
atattgggtgatggaatttctt

SEQ ID NO: 1240752 - DNA, 22 bp, Artificial Sequence
  chemically synthesized
ggtgatggaatttctttcctct

SEQ ID NO: 1240753 - DNA, 22 bp, Artificial Sequence
  chemically synthesized
gtaagagagggagagaggaaag

SEQ ID NO: 1240754 - DNA, 22 bp, Artificial Sequence
  chemically synthesized
ggtaagagagggagagaggaaa

SEQ ID NO: 1240755 - DNA, 22 bp, Artificial Sequence
  chemically synthesized
ctttcctctctccctctcttac

SEQ ID NO: 1240756 - DNA, 22 bp, Artificial Sequence
  chemically synthesized
tttcctctctccctctcttacc

SEQ ID NO: 1240757 - DNA, 22 bp, Artificial Sequence
  chemically synthesized
tcctctctccctctcttaccaa

SEQ ID NO: 1240758 - DNA, 22 bp, Artificial Sequence
  chemically synthesized
cctctctccctctcttaccaag

SEQ ID NO: 1240759 - DNA, 22 bp, Artificial Sequence
  chemically synthesized
gccaatgagagccttggtaaga

SEQ ID NO: 1240760 - DNA, 22 bp, Artificial Sequence
  chemically synthesized
ctctctccctctcttaccaagg

SEQ ID NO: 1240761 - DNA, 22 bp, Artificial Sequence
  chemically synthesized
ggccaatgagagccttggtaag

SEQ ID NO: 1240762 - DNA, 22 bp, Artificial Sequence
  chemically synthesized
tctccctctcttaccaaggctc

SEQ ID NO: 1240763 - DNA, 22 bp, Artificial Sequence
  chemically synthesized
tccctctcttaccaaggctctc

SEQ ID NO: 1240764 - DNA, 22 bp, Artificial Sequence
  chemically synthesized
gatttggccaatgagagccttg

SEQ ID NO: 1240765 - DNA, 22 bp, Artificial Sequence
  chemically synthesized
cctctcttaccaaggctctcat

SEQ ID NO: 1240766 - DNA, 22 bp, Artificial Sequence
  chemically synthesized
gttggatttggccaatgagagc

SEQ ID NO: 1240767 - DNA, 22 bp, Artificial Sequence
  chemically synthesized
tcttaccaaggctctcattggc

SEQ ID NO: 1240768 - DNA, 22 bp, Artificial Sequence
  chemically synthesized
ctagttggatttggccaatgag

SEQ ID NO: 1240769 - DNA, 22 bp, Artificial Sequence
  chemically synthesized
ttaccaaggctctcattggcca

SEQ ID NO: 1240770 - DNA, 22 bp, Artificial Sequence
  chemically synthesized
accaaggctctcattggccaaa

SEQ ID NO: 1240771 - DNA, 22 bp, Artificial Sequence
  chemically synthesized
ccaaggctctcattggccaaat

SEQ ID NO: 1240772 - DNA, 22 bp, Artificial Sequence
  chemically synthesized
gctactagttggatttggccaa

SEQ ID NO: 1240773 - DNA, 22 bp, Artificial Sequence
  chemically synthesized
tggctactagttggatttggcc

SEQ ID NO: 1240774 - DNA, 22 bp, Artificial Sequence
  chemically synthesized
ccctctggctactagttggatt

SEQ ID NO: 1240775 - DNA, 22 bp, Artificial Sequence
  chemically synthesized
gccctctggctactagttggat

SEQ ID NO: 1240776 - DNA, 22 bp, Artificial Sequence
  chemically synthesized
tcattggccaaatccaactagt

SEQ ID NO: 1240777 - DNA, 22 bp, Artificial Sequence
  chemically synthesized
tgccctctggctactagttgga

SEQ ID NO: 1240778 - DNA, 22 bp, Artificial Sequence
  chemically synthesized
attggccaaatccaactagtag

SEQ ID NO: 1240779 - DNA, 22 bp, Artificial Sequence
  chemically synthesized
ctttgccctctggctactagtt

SEQ ID NO: 1240780 - DNA, 22 bp, Artificial Sequence
  chemically synthesized
gccaaatccaactagtagccag

SEQ ID NO: 1240781 - DNA, 22 bp, Artificial Sequence
  chemically synthesized
catcaacaggctcctttgccct

SEQ ID NO: 1240782 - DNA, 22 bp, Artificial Sequence
  chemically synthesized
gtagccagagggcaaaggagcc

SEQ ID NO: 1240783 - DNA, 22 bp, Artificial Sequence
  chemically synthesized
tggactacatcaacaggctcct

SEQ ID NO: 1240784 - DNA, 22 bp, Artificial Sequence
  chemically synthesized
atgtctgtggactacatcaaca

SEQ ID NO: 1240785 - DNA, 22 bp, Artificial Sequence
  chemically synthesized
ggaggctgatgtctgtggacta

SEQ ID NO: 1240786 - DNA, 22 bp, Artificial Sequence
  chemically synthesized
gggaggctgatgtctgtggact

SEQ ID NO: 1240787 - DNA, 22 bp, Artificial Sequence
  chemically synthesized
cttgggaggctgatgtctgtgg

SEQ ID NO: 1240788 - DNA, 22 bp, Artificial Sequence
  chemically synthesized
ccttgggaggctgatgtctgtg

SEQ ID NO: 1240789 - DNA, 22 bp, Artificial Sequence
  chemically synthesized
ttgatgtagtccacagacatca

SEQ ID NO: 1240790 - DNA, 22 bp, Artificial Sequence
  chemically synthesized
atgtagtccacagacatcagcc

SEQ ID NO: 1240791 - DNA, 22 bp, Artificial Sequence
  chemically synthesized
tcttccttgggaggctgatgtc

SEQ ID NO: 1240792 - DNA, 22 bp, Artificial Sequence
  chemically synthesized
gtcttccttgggaggctgatgt

SEQ ID NO: 1240793 - DNA, 22 bp, Artificial Sequence
  chemically synthesized
tgtcttccttgggaggctgatg

SEQ ID NO: 1240794 - DNA, 22 bp, Artificial Sequence
  chemically synthesized
ttgtcttccttgggaggctgat

SEQ ID NO: 1240795 - DNA, 22 bp, Artificial Sequence
  chemically synthesized
cacttttgtcttccttgggagg

SEQ ID NO: 1240796 - DNA, 22 bp, Artificial Sequence
  chemically synthesized
tccacttttgtcttccttggga

SEQ ID NO: 1240797 - DNA, 22 bp, Artificial Sequence
  chemically synthesized
ctctccacttttgtcttccttg

SEQ ID NO: 1240798 - DNA, 22 bp, Artificial Sequence
  chemically synthesized
gccctactctccacttttgtct

SEQ ID NO: 1240799 - DNA, 22 bp, Artificial Sequence
  chemically synthesized
ggccctactctccacttttgtc

SEQ ID NO: 1240800 - DNA, 22 bp, Artificial Sequence
  chemically synthesized
tggccctactctccacttttgt

SEQ ID NO: 1240801 - DNA, 22 bp, Artificial Sequence
  chemically synthesized
tttggccctactctccactttt

SEQ ID NO: 1240802 - DNA, 22 bp, Artificial Sequence
  chemically synthesized
ccaaggaagacaaaagtggaga

SEQ ID NO: 1240803 - DNA, 22 bp, Artificial Sequence
  chemically synthesized
ctttggccctactctccacttt

SEQ ID NO: 1240804 - DNA, 22 bp, Artificial Sequence
  chemically synthesized
tttctttggccctactctccac

SEQ ID NO: 1240805 - DNA, 22 bp, Artificial Sequence
  chemically synthesized
atttctttggccctactctcca

SEQ ID NO: 1240806 - DNA, 22 bp, Artificial Sequence
  chemically synthesized
gcttatttctttggccctactc

SEQ ID NO: 1240807 - DNA, 22 bp, Artificial Sequence
  chemically synthesized
ggcttatttctttggccctact

SEQ ID NO: 1240808 - DNA, 22 bp, Artificial Sequence
  chemically synthesized
tggcttatttctttggccctac

SEQ ID NO: 1240809 - DNA, 22 bp, Artificial Sequence
  chemically synthesized
gggtggtgaatgtctttggctt

SEQ ID NO: 1240810 - DNA, 22 bp, Artificial Sequence
  chemically synthesized
catgtctagggtggtgaatgtc

SEQ ID NO: 1240811 - DNA, 22 bp, Artificial Sequence
  chemically synthesized
ccatgtctagggtggtgaatgt

SEQ ID NO: 1240812 - DNA, 22 bp, Artificial Sequence
  chemically synthesized
cttccatgtctagggtggtgaa

SEQ ID NO: 1240813 - DNA, 22 bp, Artificial Sequence
  chemically synthesized
gcttccatgtctagggtggtga

SEQ ID NO: 1240814 - DNA, 22 bp, Artificial Sequence
  chemically synthesized
aaaggaaatttgcttccatgtc

SEQ ID NO: 1240815 - DNA, 22 bp, Artificial Sequence
  chemically synthesized
accaccctagacatggaagcaa

SEQ ID NO: 1240816 - DNA, 22 bp, Artificial Sequence
  chemically synthesized
gctcaaaggaaatttgcttcca

SEQ ID NO: 1240817 - DNA, 22 bp, Artificial Sequence
  chemically synthesized
ggctcaaaggaaatttgcttcc

SEQ ID NO: 1240818 - DNA, 22 bp, Artificial Sequence
  chemically synthesized
cttggctcaaaggaaatttgct

SEQ ID NO: 1240819 - DNA, 22 bp, Artificial Sequence
  chemically synthesized
gacatggaagcaaatttccttt

SEQ ID NO: 1240820 - DNA, 22 bp, Artificial Sequence
  chemically synthesized
atctccttggctcaaaggaaat

SEQ ID NO: 1240821 - DNA, 22 bp, Artificial Sequence
  chemically synthesized
gcattgatctccttggctcaaa

SEQ ID NO: 1240822 - DNA, 22 bp, Artificial Sequence
  chemically synthesized
cctttgagccaaggagatcaat

SEQ ID NO: 1240823 - DNA, 22 bp, Artificial Sequence
  chemically synthesized
ctttgagccaaggagatcaatg

SEQ ID NO: 1240824 - DNA, 22 bp, Artificial Sequence
  chemically synthesized
tgagccaaggagatcaatgcca

SEQ ID NO: 1240825 - DNA, 22 bp, Artificial Sequence
  chemically synthesized
gagccaaggagatcaatgccag

SEQ ID NO: 1240826 - DNA, 22 bp, Artificial Sequence
  chemically synthesized
atatggacatccctggcattga

SEQ ID NO: 1240827 - DNA, 22 bp, Artificial Sequence
  chemically synthesized
agccaaggagatcaatgccagg

SEQ ID NO: 1240828 - DNA, 22 bp, Artificial Sequence
  chemically synthesized
tgatatggacatccctggcatt

SEQ ID NO: 1240829 - DNA, 22 bp, Artificial Sequence
  chemically synthesized
ctgatatggacatccctggcat

SEQ ID NO: 1240830 - DNA, 22 bp, Artificial Sequence
  chemically synthesized
tctgatatggacatccctggca

SEQ ID NO: 1240831 - DNA, 22 bp, Artificial Sequence
  chemically synthesized
ttttctgatatggacatccctg

SEQ ID NO: 1240832 - DNA, 22 bp, Artificial Sequence
  chemically synthesized
attttctgatatggacatccct

SEQ ID NO: 1240833 - DNA, 22 bp, Artificial Sequence
  chemically synthesized
atttattttctgatatggacat

SEQ ID NO: 1240834 - DNA, 22 bp, Artificial Sequence
  chemically synthesized
catttattttctgatatggaca

SEQ ID NO: 1240835 - DNA, 22 bp, Artificial Sequence
  chemically synthesized
cgtgttacttcccatgcctcat

SEQ ID NO: 1240836 - DNA, 22 bp, Artificial Sequence
  chemically synthesized
cttcccatgcctcatatttcta

SEQ ID NO: 1240837 - DNA, 22 bp, Artificial Sequence
  chemically synthesized
cccatgcctcatatttctatct

SEQ ID NO: 1240838 - DNA, 22 bp, Artificial Sequence
  chemically synthesized
ccatgcctcatatttctatctc

SEQ ID NO: 1240839 - DNA, 22 bp, Artificial Sequence
  chemically synthesized
caatgacatcaccagagataga

SEQ ID NO: 1240840 - DNA, 22 bp, Artificial Sequence
  chemically synthesized
acaatgacatcaccagagatag

SEQ ID NO: 1240841 - DNA, 22 bp, Artificial Sequence
  chemically synthesized
cttacaatgacatcaccagaga

SEQ ID NO: 1240842 - DNA, 22 bp, Artificial Sequence
  chemically synthesized
atatttctatctctggtgatgt

SEQ ID NO: 1240843 - DNA, 22 bp, Artificial Sequence
  chemically synthesized
ctatctctggtgatgtcattgt

SEQ ID NO: 1240844 - DNA, 22 bp, Artificial Sequence
  chemically synthesized
tatctctggtgatgtcattgta

SEQ ID NO: 1240845 - DNA, 22 bp, Artificial Sequence
  chemically synthesized
tctctggtgatgtcattgtaag

SEQ ID NO: 1240846 - DNA, 22 bp, Artificial Sequence
  chemically synthesized
tggtgatgtcattgtaaggaat

SEQ ID NO: 1240847 - DNA, 22 bp, Artificial Sequence
  chemically synthesized
gtgatgtcattgtaaggaatca

SEQ ID NO: 1240848 - DNA, 22 bp, Artificial Sequence
  chemically synthesized
cagtgatacatatgattcctta

SEQ ID NO: 1240849 - DNA, 22 bp, Artificial Sequence
  chemically synthesized
taaggaatcatatgtatcactg

SEQ ID NO: 1240850 - DNA, 22 bp, Artificial Sequence
  chemically synthesized
aagaagacgacggtgttccagt

SEQ ID NO: 1240851 - DNA, 22 bp, Artificial Sequence
  chemically synthesized
ttaaagaagacgacggtgttcc

SEQ ID NO: 1240852 - DNA, 22 bp, Artificial Sequence
  chemically synthesized
atatcactattaaagaagacga

SEQ ID NO: 1240853 - DNA, 22 bp, Artificial Sequence
  chemically synthesized
gatatcactattaaagaagacg

SEQ ID NO: 1240854 - DNA, 22 bp, Artificial Sequence
  chemically synthesized
tgatatcactattaaagaagac

SEQ ID NO: 1240855 - DNA, 22 bp, Artificial Sequence
  chemically synthesized
gaacaccgtcgtcttctttaat

SEQ ID NO: 1240856 - DNA, 22 bp, Artificial Sequence
  chemically synthesized
cagtattttgatatcactatta

SEQ ID NO: 1240857 - DNA, 22 bp, Artificial Sequence
  chemically synthesized
ctttaatagtgatatcaaaata

SEQ ID NO: 1240858 - DNA, 22 bp, Artificial Sequence
  chemically synthesized
tttaatagtgatatcaaaatac

SEQ ID NO: 1240859 - DNA, 22 bp, Artificial Sequence
  chemically synthesized
taatagtgatatcaaaatactg

SEQ ID NO: 1240860 - DNA, 22 bp, Artificial Sequence
  chemically synthesized
aatagtgatatcaaaatactgg

SEQ ID NO: 1240861 - DNA, 22 bp, Artificial Sequence
  chemically synthesized
atagtgatatcaaaatactgga

SEQ ID NO: 1240862 - DNA, 22 bp, Artificial Sequence
  chemically synthesized
aggtccacaaaacattccagta

SEQ ID NO: 1240863 - DNA, 22 bp, Artificial Sequence
  chemically synthesized
ctaaggtccacaaaacattcca

SEQ ID NO: 1240864 - DNA, 22 bp, Artificial Sequence
  chemically synthesized
tctgctaaggtccacaaaacat

SEQ ID NO: 1240865 - DNA, 22 bp, Artificial Sequence
  chemically synthesized
atctgctaaggtccacaaaaca

SEQ ID NO: 1240866 - DNA, 22 bp, Artificial Sequence
  chemically synthesized
tatctgctaaggtccacaaaac

SEQ ID NO: 1240867 - DNA, 22 bp, Artificial Sequence
  chemically synthesized
attttatctgctaaggtccaca

SEQ ID NO: 1240868 - DNA, 22 bp, Artificial Sequence
  chemically synthesized
ctgattttatctgctaaggtcc

SEQ ID NO: 1240869 - DNA, 22 bp, Artificial Sequence
  chemically synthesized
gaatgttttgtggaccttagca

SEQ ID NO: 1240870 - DNA, 22 bp, Artificial Sequence
  chemically synthesized
tgtggaccttagcagataaaat

SEQ ID NO: 1240871 - DNA, 22 bp, Artificial Sequence
  chemically synthesized
gtggaccttagcagataaaatc

SEQ ID NO: 1240872 - DNA, 22 bp, Artificial Sequence
  chemically synthesized
tggaccttagcagataaaatca

SEQ ID NO: 1240873 - DNA, 22 bp, Artificial Sequence
  chemically synthesized
agcagataaaatcagtaggtat

SEQ ID NO: 1240874 - DNA, 22 bp, Artificial Sequence
  chemically synthesized
gcagataaaatcagtaggtatt

SEQ ID NO: 1240875 - DNA, 22 bp, Artificial Sequence
  chemically synthesized
aggaataatgaataaataccta

SEQ ID NO: 1240876 - DNA, 22 bp, Artificial Sequence
  chemically synthesized
acgctaaggaataatgaataaa

SEQ ID NO: 1240877 - DNA, 22 bp, Artificial Sequence
  chemically synthesized
gacgctaaggaataatgaataa

SEQ ID NO: 1240878 - DNA, 22 bp, Artificial Sequence
  chemically synthesized
caagtatttgacgctaaggaat

SEQ ID NO: 1240879 - DNA, 22 bp, Artificial Sequence
  chemically synthesized
tacaagtatttgacgctaagga

SEQ ID NO: 1240880 - DNA, 22 bp, Artificial Sequence
  chemically synthesized
attcattattccttagcgtcaa

SEQ ID NO: 1240881 - DNA, 22 bp, Artificial Sequence
  chemically synthesized
ttcattattccttagcgtcaaa

SEQ ID NO: 1240882 - DNA, 22 bp, Artificial Sequence
  chemically synthesized
attattccttagcgtcaaatac

SEQ ID NO: 1240883 - DNA, 22 bp, Artificial Sequence
  chemically synthesized
ttccttagcgtcaaatacttgt

SEQ ID NO: 1240884 - DNA, 22 bp, Artificial Sequence
  chemically synthesized
cttagcgtcaaatacttgtaga

SEQ ID NO: 1240885 - DNA, 22 bp, Artificial Sequence
  chemically synthesized
gtagagagaagtctctacaagt

SEQ ID NO: 1240886 - DNA, 22 bp, Artificial Sequence
  chemically synthesized
ggtagagagaagtctctacaag

SEQ ID NO: 1240887 - DNA, 22 bp, Artificial Sequence
  chemically synthesized
agcgtcaaatacttgtagagac

SEQ ID NO: 1240888 - DNA, 22 bp, Artificial Sequence
  chemically synthesized
tggtagagagaagtctctacaa

SEQ ID NO: 1240889 - DNA, 22 bp, Artificial Sequence
  chemically synthesized
gcgtcaaatacttgtagagact

SEQ ID NO: 1240890 - DNA, 22 bp, Artificial Sequence
  chemically synthesized
ttggtagagagaagtctctaca

SEQ ID NO: 1240891 - DNA, 22 bp, Artificial Sequence
  chemically synthesized
tttggtagagagaagtctctac

SEQ ID NO: 1240892 - DNA, 22 bp, Artificial Sequence
  chemically synthesized
ttttggtagagagaagtctcta

SEQ ID NO: 1240893 - DNA, 22 bp, Artificial Sequence
  chemically synthesized
tttttggtagagagaagtctct

SEQ ID NO: 1240894 - DNA, 22 bp, Artificial Sequence
  chemically synthesized
gtgctttttttggtagagagaa

SEQ ID NO: 1240895 - DNA, 22 bp, Artificial Sequence
  chemically synthesized
cgtgctttttttggtagagaga

SEQ ID NO: 1240896 - DNA, 22 bp, Artificial Sequence
  chemically synthesized
tcgtgctttttttggtagagag

SEQ ID NO: 1240897 - DNA, 22 bp, Artificial Sequence
  chemically synthesized
gtagagacttctctctaccaaa

SEQ ID NO: 1240898 - DNA, 22 bp, Artificial Sequence
  chemically synthesized
tagagacttctctctaccaaaa

SEQ ID NO: 1240899 - DNA, 22 bp, Artificial Sequence
  chemically synthesized
ctctctaccaaaaaaagcacga

SEQ ID NO: 1240900 - DNA, 22 bp, Artificial Sequence
  chemically synthesized
atagccagattttcgtgctttt

SEQ ID NO: 1240901 - DNA, 22 bp, Artificial Sequence
  chemically synthesized
tctctaccaaaaaaagcacgaa

SEQ ID NO: 1240902 - DNA, 22 bp, Artificial Sequence
  chemically synthesized
catagccagattttcgtgcttt

SEQ ID NO: 1240903 - DNA, 22 bp, Artificial Sequence
  chemically synthesized
tctaccaaaaaaagcacgaaaa

SEQ ID NO: 1240904 - DNA, 22 bp, Artificial Sequence
  chemically synthesized
taccaaaaaaagcacgaaaatc

SEQ ID NO: 1240905 - DNA, 22 bp, Artificial Sequence
  chemically synthesized
ccaaaaaaagcacgaaaatctg

SEQ ID NO: 1240906 - DNA, 22 bp, Artificial Sequence
  chemically synthesized
atgatcttcatagccagatttt

SEQ ID NO: 1240907 - DNA, 22 bp, Artificial Sequence
  chemically synthesized
gatgatcttcatagccagattt

SEQ ID NO: 1240908 - DNA, 22 bp, Artificial Sequence
  chemically synthesized
ttgatgatcttcatagccagat

SEQ ID NO: 1240909 - DNA, 22 bp, Artificial Sequence
  chemically synthesized
cttgatgatcttcatagccaga

SEQ ID NO: 1240910 - DNA, 22 bp, Artificial Sequence
  chemically synthesized
tcttgatgatcttcatagccag

SEQ ID NO: 1240911 - DNA, 22 bp, Artificial Sequence
  chemically synthesized
ttcttgatgatcttcatagcca

SEQ ID NO: 1240912 - DNA, 22 bp, Artificial Sequence
  chemically synthesized
tttcttgatgatcttcatagcc

SEQ ID NO: 1240913 - DNA, 22 bp, Artificial Sequence
  chemically synthesized
gctttttcttgatgatcttcat

SEQ ID NO: 1240914 - DNA, 22 bp, Artificial Sequence
  chemically synthesized
ggctttttcttgatgatcttca

SEQ ID NO: 1240915 - DNA, 22 bp, Artificial Sequence
  chemically synthesized
gctatgaagatcatcaagaaaa

SEQ ID NO: 1240916 - DNA, 22 bp, Artificial Sequence
  chemically synthesized
tgaagatcatcaagaaaaagcc

SEQ ID NO: 1240917 - DNA, 22 bp, Artificial Sequence
  chemically synthesized
caaggaataacttggctttttc

SEQ ID NO: 1240918 - DNA, 22 bp, Artificial Sequence
  chemically synthesized
gctgcaaggaataacttggctt

SEQ ID NO: 1240919 - DNA, 22 bp, Artificial Sequence
  chemically synthesized
ctagctgcaaggaataacttgg

SEQ ID NO: 1240920 - DNA, 22 bp, Artificial Sequence
  chemically synthesized
gctagctgcaaggaataacttg

SEQ ID NO: 1240921 - DNA, 22 bp, Artificial Sequence
  chemically synthesized
aacacttgctagctgcaaggaa

SEQ ID NO: 1240922 - DNA, 22 bp, Artificial Sequence
  chemically synthesized
gaacacttgctagctgcaagga

SEQ ID NO: 1240923 - DNA, 22 bp, Artificial Sequence
  chemically synthesized
ttgaacacttgctagctgcaag

SEQ ID NO: 1240924 - DNA, 22 bp, Artificial Sequence
  chemically synthesized
ctcttgaacacttgctagctgc

SEQ ID NO: 1240925 - DNA, 22 bp, Artificial Sequence
  chemically synthesized
gctcttgaacacttgctagctg

SEQ ID NO: 1240926 - DNA, 22 bp, Artificial Sequence
  chemically synthesized
tgctcttgaacacttgctagct

SEQ ID NO: 1240927 - DNA, 22 bp, Artificial Sequence
  chemically synthesized
ttccttgcagctagcaagtgtt

SEQ ID NO: 1240928 - DNA, 22 bp, Artificial Sequence
  chemically synthesized
tagctttgctcttgaacacttg

SEQ ID NO: 1240929 - DNA, 22 bp, Artificial Sequence
  chemically synthesized
cttgcagctagcaagtgttcaa

SEQ ID NO: 1240930 - DNA, 22 bp, Artificial Sequence
  chemically synthesized
gtagctttgctcttgaacactt

SEQ ID NO: 1240931 - DNA, 22 bp, Artificial Sequence
  chemically synthesized
tgtagctttgctcttgaacact

SEQ ID NO: 1240932 - DNA, 22 bp, Artificial Sequence
  chemically synthesized
gcagctagcaagtgttcaagag

SEQ ID NO: 1240933 - DNA, 22 bp, Artificial Sequence
  chemically synthesized
cagctagcaagtgttcaagagc

SEQ ID NO: 1240934 - DNA, 22 bp, Artificial Sequence
  chemically synthesized
tattttgtagctttgctcttga

SEQ ID NO: 1240935 - DNA, 22 bp, Artificial Sequence
  chemically synthesized
gtattttgtagctttgctcttg

SEQ ID NO: 1240936 - DNA, 22 bp, Artificial Sequence
  chemically synthesized
gcaagtgttcaagagcaaagct

SEQ ID NO: 1240937 - DNA, 22 bp, Artificial Sequence
  chemically synthesized
taaaaacttgtattttgtagct

SEQ ID NO: 1240938 - DNA, 22 bp, Artificial Sequence
  chemically synthesized
aagagcaaagctacaaaataca

SEQ ID NO: 1240939 - DNA, 22 bp, Artificial Sequence
  chemically synthesized
gagagattataaaaacttgtat

SEQ ID NO: 1240940 - DNA, 22 bp, Artificial Sequence
  chemically synthesized
tatctggagagattataaaaac

SEQ ID NO: 1240941 - DNA, 22 bp, Artificial Sequence
  chemically synthesized
atatctggagagattataaaaa

SEQ ID NO: 1240942 - DNA, 22 bp, Artificial Sequence
  chemically synthesized
caaaatacaagtttttataatc

SEQ ID NO: 1240943 - DNA, 22 bp, Artificial Sequence
  chemically synthesized
tatatctggagagattataaaa

SEQ ID NO: 1240944 - DNA, 22 bp, Artificial Sequence
  chemically synthesized
ttataatctctccagatataaa

SEQ ID NO: 1240945 - DNA, 22 bp, Artificial Sequence
  chemically synthesized
tataatctctccagatataaaa

SEQ ID NO: 1240946 - DNA, 22 bp, Artificial Sequence
  chemically synthesized
ataatctctccagatataaaat

SEQ ID NO: 1240947 - DNA, 22 bp, Artificial Sequence
  chemically synthesized
taatctctccagatataaaatg

SEQ ID NO: 1240948 - DNA, 22 bp, Artificial Sequence
  chemically synthesized
taaaatgccaaataacatttta

SEQ ID NO: 1240949 - DNA, 22 bp, Artificial Sequence
  chemically synthesized
ataaaatgccaaataacatttt

SEQ ID NO: 1240950 - DNA, 22 bp, Artificial Sequence
  chemically synthesized
tataaaatgccaaataacattt

SEQ ID NO: 1240951 - DNA, 22 bp, Artificial Sequence
  chemically synthesized
tccagatataaaatgttatttg

SEQ ID NO: 1240952 - DNA, 22 bp, Artificial Sequence
  chemically synthesized
cagatataaaatgttatttggc

SEQ ID NO: 1240953 - DNA, 22 bp, Artificial Sequence
  chemically synthesized
agatgctttataaaatgccaaa

SEQ ID NO: 1240954 - DNA, 22 bp, Artificial Sequence
  chemically synthesized
gttaagatgctttataaaatgc

SEQ ID NO: 1240955 - DNA, 22 bp, Artificial Sequence
  chemically synthesized
tagttaagatgctttataaaat

SEQ ID NO: 1240956 - DNA, 22 bp, Artificial Sequence
  chemically synthesized
ggttctagttaagatgctttat

SEQ ID NO: 1240957 - DNA, 22 bp, Artificial Sequence
  chemically synthesized
tttggcattttataaagcatct

SEQ ID NO: 1240958 - DNA, 22 bp, Artificial Sequence
  chemically synthesized
ggcattttataaagcatcttaa

SEQ ID NO: 1240959 - DNA, 22 bp, Artificial Sequence
  chemically synthesized
gcattttataaagcatcttaac

SEQ ID NO: 1240960 - DNA, 22 bp, Artificial Sequence
  chemically synthesized
tataaagcatcttaactagaac

SEQ ID NO: 1240961 - DNA, 22 bp, Artificial Sequence
  chemically synthesized
ataaagcatcttaactagaacc

SEQ ID NO: 1240962 - DNA, 22 bp, Artificial Sequence
  chemically synthesized
taaagcatcttaactagaaccc

SEQ ID NO: 1240963 - DNA, 22 bp, Artificial Sequence
  chemically synthesized
atagagtaacatacatattggg

SEQ ID NO: 1240964 - DNA, 22 bp, Artificial Sequence
  chemically synthesized
aatagagtaacatacatattgg

SEQ ID NO: 1240965 - DNA, 22 bp, Artificial Sequence
  chemically synthesized
aactagaacccaatatgtatgt

SEQ ID NO: 1240966 - DNA, 22 bp, Artificial Sequence
  chemically synthesized
actagaacccaatatgtatgtt

SEQ ID NO: 1240967 - DNA, 22 bp, Artificial Sequence
  chemically synthesized
gaacccaatatgtatgttactc

SEQ ID NO: 1240968 - DNA, 22 bp, Artificial Sequence
  chemically synthesized
gtgtacttaatagagtaacata

SEQ ID NO: 1240969 - DNA, 22 bp, Artificial Sequence
  chemically synthesized
tagtgtacttaatagagtaaca

SEQ ID NO: 1240970 - DNA, 22 bp, Artificial Sequence
  chemically synthesized
ctagtgtacttaatagagtaac

SEQ ID NO: 1240971 - DNA, 22 bp, Artificial Sequence
  chemically synthesized
aatcatttctagtgtacttaat

SEQ ID NO: 1240972 - DNA, 22 bp, Artificial Sequence
  chemically synthesized
gaatcatttctagtgtacttaa

SEQ ID NO: 1240973 - DNA, 22 bp, Artificial Sequence
  chemically synthesized
tttgaatcatttctagtgtact

SEQ ID NO: 1240974 - DNA, 22 bp, Artificial Sequence
  chemically synthesized
ctctattaagtacactagaaat

SEQ ID NO: 1240975 - DNA, 22 bp, Artificial Sequence
  chemically synthesized
tattaagtacactagaaatgat

SEQ ID NO: 1240976 - DNA, 22 bp, Artificial Sequence
  chemically synthesized
ttaagtacactagaaatgattc

SEQ ID NO: 1240977 - DNA, 22 bp, Artificial Sequence
  chemically synthesized
agtacactagaaatgattcaaa

SEQ ID NO: 1240978 - DNA, 22 bp, Artificial Sequence
  chemically synthesized
gaatgcacatctgtttgaatca

SEQ ID NO: 1240979 - DNA, 22 bp, Artificial Sequence
  chemically synthesized
aagttcgaatgcacatctgttt

SEQ ID NO: 1240980 - DNA, 22 bp, Artificial Sequence
  chemically synthesized
aaagttcgaatgcacatctgtt

SEQ ID NO: 1240981 - DNA, 22 bp, Artificial Sequence
  chemically synthesized
gaaatgattcaaacagatgtgc

SEQ ID NO: 1240982 - DNA, 22 bp, Artificial Sequence
  chemically synthesized
tttaaagttcgaatgcacatct

SEQ ID NO: 1240983 - DNA, 22 bp, Artificial Sequence
  chemically synthesized
ctatttaaagttcgaatgcaca

SEQ ID NO: 1240984 - DNA, 22 bp, Artificial Sequence
  chemically synthesized
cctatttaaagttcgaatgcac

SEQ ID NO: 1240985 - DNA, 22 bp, Artificial Sequence
  chemically synthesized
aaacagatgtgcattcgaactt

SEQ ID NO: 1240986 - DNA, 22 bp, Artificial Sequence
  chemically synthesized
acgatggtgtggtttcctattt

SEQ ID NO: 1240987 - DNA, 22 bp, Artificial Sequence
  chemically synthesized
gaactttaaataggaaaccaca

SEQ ID NO: 1240988 - DNA, 22 bp, Artificial Sequence
  chemically synthesized
cattaacgatggtgtggtttcc

SEQ ID NO: 1240989 - DNA, 22 bp, Artificial Sequence
  chemically synthesized
ccattaacgatggtgtggtttc

SEQ ID NO: 1240990 - DNA, 22 bp, Artificial Sequence
  chemically synthesized
atttccattaacgatggtgtgg

SEQ ID NO: 1240991 - DNA, 22 bp, Artificial Sequence
  chemically synthesized
taaataggaaaccacaccatcg

SEQ ID NO: 1240992 - DNA, 22 bp, Artificial Sequence
  chemically synthesized
gatttccattaacgatggtgtg

SEQ ID NO: 1240993 - DNA, 22 bp, Artificial Sequence
  chemically synthesized
aaataggaaaccacaccatcgt

SEQ ID NO: 1240994 - DNA, 22 bp, Artificial Sequence
  chemically synthesized
aataggaaaccacaccatcgtt

SEQ ID NO: 1240995 - DNA, 22 bp, Artificial Sequence
  chemically synthesized
catataacaacttgatttccat

SEQ ID NO: 1240996 - DNA, 22 bp, Artificial Sequence
  chemically synthesized
acatataacaacttgatttcca

SEQ ID NO: 1240997 - DNA, 22 bp, Artificial Sequence
  chemically synthesized
atggaaatcaagttgttatatg

SEQ ID NO: 1240998 - DNA, 22 bp, Artificial Sequence
  chemically synthesized
ataacatcccacttacatataa

SEQ ID NO: 1240999 - DNA, 22 bp, Artificial Sequence
  chemically synthesized
ggttcataacatcccacttaca

SEQ ID NO: 1241000 - DNA, 22 bp, Artificial Sequence
  chemically synthesized
tgggttcataacatcccactta

SEQ ID NO: 1241001 - DNA, 22 bp, Artificial Sequence
  chemically synthesized
ctgggttcataacatcccactt

SEQ ID NO: 1241002 - DNA, 22 bp, Artificial Sequence
  chemically synthesized
ttatatgtaagtgggatgttat

SEQ ID NO: 1241003 - DNA, 22 bp, Artificial Sequence
  chemically synthesized
tatgtaagtgggatgttatgaa

SEQ ID NO: 1241004 - DNA, 22 bp, Artificial Sequence
  chemically synthesized
agcatacttctgggttcataac

SEQ ID NO: 1241005 - DNA, 22 bp, Artificial Sequence
  chemically synthesized
ttaagcatacttctgggttcat

SEQ ID NO: 1241006 - DNA, 22 bp, Artificial Sequence
  chemically synthesized
gttaagcatacttctgggttca

SEQ ID NO: 1241007 - DNA, 22 bp, Artificial Sequence
  chemically synthesized
tgttaagcatacttctgggttc

SEQ ID NO: 1241008 - DNA, 22 bp, Artificial Sequence
  chemically synthesized
ttgttaagcatacttctgggtt

SEQ ID NO: 1241009 - DNA, 22 bp, Artificial Sequence
  chemically synthesized
tttgttaagcatacttctgggt

SEQ ID NO: 1241010 - DNA, 22 bp, Artificial Sequence
  chemically synthesized
actttttgttaagcatacttct

SEQ ID NO: 1241011 - DNA, 22 bp, Artificial Sequence
  chemically synthesized
tgaacccagaagtatgcttaac

SEQ ID NO: 1241012 - DNA, 22 bp, Artificial Sequence
  chemically synthesized
atcagacaatgaatcatgctga

SEQ ID NO: 1241013 - DNA, 22 bp, Artificial Sequence
  chemically synthesized
aacaaaaagtcagcatgattca

SEQ ID NO: 1241014 - DNA, 22 bp, Artificial Sequence
  chemically synthesized
acaaaaagtcagcatgattcat

SEQ ID NO: 1241015 - DNA, 22 bp, Artificial Sequence
  chemically synthesized
aggatagacctgatcagacaat

SEQ ID NO: 1241016 - DNA, 22 bp, Artificial Sequence
  chemically synthesized
attgtctgatcaggtctatcct

SEQ ID NO: 1241017 - DNA, 22 bp, Artificial Sequence
  chemically synthesized
caaaacatgttaaggatagacc

SEQ ID NO: 1241018 - DNA, 22 bp, Artificial Sequence
  chemically synthesized
ttacaaaacatgttaaggatag

SEQ ID NO: 1241019 - DNA, 22 bp, Artificial Sequence
  chemically synthesized
tctgatcaggtctatccttaac

SEQ ID NO: 1241020 - DNA, 22 bp, Artificial Sequence
  chemically synthesized
attacaaaacatgttaaggata

SEQ ID NO: 1241021 - DNA, 22 bp, Artificial Sequence
  chemically synthesized
tattacaaaacatgttaaggat

SEQ ID NO: 1241022 - DNA, 22 bp, Artificial Sequence
  chemically synthesized
atcaggtctatccttaacatgt

SEQ ID NO: 1241023 - DNA, 22 bp, Artificial Sequence
  chemically synthesized
gttttattacaaaacatgttaa

SEQ ID NO: 1241024 - DNA, 22 bp, Artificial Sequence
  chemically synthesized
gaagttagttttattacaaaac

SEQ ID NO: 1241025 - DNA, 22 bp, Artificial Sequence
  chemically synthesized
agaagttagttttattacaaaa

SEQ ID NO: 1241026 - DNA, 22 bp, Artificial Sequence
  chemically synthesized
tccttaacatgttttgtaataa

SEQ ID NO: 1241027 - DNA, 22 bp, Artificial Sequence
  chemically synthesized
tagaagttagttttattacaaa

SEQ ID NO: 1241028 - DNA, 22 bp, Artificial Sequence
  chemically synthesized
gctttagaagttagttttatta

SEQ ID NO: 1241029 - DNA, 22 bp, Artificial Sequence
  chemically synthesized
aacatgttttgtaataaaacta

SEQ ID NO: 1241030 - DNA, 22 bp, Artificial Sequence
  chemically synthesized
acatgttttgtaataaaactaa

SEQ ID NO: 1241031 - DNA, 22 bp, Artificial Sequence
  chemically synthesized
agacctagctttagaagttagt

SEQ ID NO: 1241032 - DNA, 22 bp, Artificial Sequence
  chemically synthesized
tgtaataaaactaacttctaaa

SEQ ID NO: 1241033 - DNA, 22 bp, Artificial Sequence
  chemically synthesized
gtaataaaactaacttctaaag

SEQ ID NO: 1241034 - DNA, 22 bp, Artificial Sequence
  chemically synthesized
taataaaactaacttctaaagc

SEQ ID NO: 1241035 - DNA, 22 bp, Artificial Sequence
  chemically synthesized
aagataaaacaattgagaccta

SEQ ID NO: 1241036 - DNA, 22 bp, Artificial Sequence
  chemically synthesized
acttctaaagctaggtctcaat

SEQ ID NO: 1241037 - DNA, 22 bp, Artificial Sequence
  chemically synthesized
aaagataaaacaattgagacct

SEQ ID NO: 1241038 - DNA, 22 bp, Artificial Sequence
  chemically synthesized
ctaaagctaggtctcaattgtt

SEQ ID NO: 1241039 - DNA, 22 bp, Artificial Sequence
  chemically synthesized
acttaaagataaaacaattgag

SEQ ID NO: 1241040 - DNA, 22 bp, Artificial Sequence
  chemically synthesized
taaagctaggtctcaattgttt

SEQ ID NO: 1241041 - DNA, 22 bp, Artificial Sequence
  chemically synthesized
aagctaggtctcaattgtttta

SEQ ID NO: 1241042 - DNA, 22 bp, Artificial Sequence
  chemically synthesized
acctaacttaaagataaaacaa

SEQ ID NO: 1241043 - DNA, 22 bp, Artificial Sequence
  chemically synthesized
ggtctcaattgttttatcttta

SEQ ID NO: 1241044 - DNA, 22 bp, Artificial Sequence
  chemically synthesized
aattgttttatctttaagttag

SEQ ID NO: 1241045 - DNA, 22 bp, Artificial Sequence
  chemically synthesized
ttttatctttaagttaggtcag

SEQ ID NO: 1241046 - DNA, 22 bp, Artificial Sequence
  chemically synthesized
tatctttaagttaggtcagtac

SEQ ID NO: 1241047 - DNA, 22 bp, Artificial Sequence
  chemically synthesized
atctttaagttaggtcagtact

SEQ ID NO: 1241048 - DNA, 22 bp, Artificial Sequence
  chemically synthesized
gtaaaatgaatgagtactgacc

SEQ ID NO: 1241049 - DNA, 22 bp, Artificial Sequence
  chemically synthesized
tctttaagttaggtcagtactc

SEQ ID NO: 1241050 - DNA, 22 bp, Artificial Sequence
  chemically synthesized
taagttaggtcagtactcattc

SEQ ID NO: 1241051 - DNA, 22 bp, Artificial Sequence
  chemically synthesized
aagttaggtcagtactcattca

SEQ ID NO: 1241052 - DNA, 22 bp, Artificial Sequence
  chemically synthesized
agttaggtcagtactcattcat

SEQ ID NO: 1241053 - DNA, 22 bp, Artificial Sequence
  chemically synthesized
gaatacctggtaaaatgaatga

SEQ ID NO: 1241054 - DNA, 22 bp, Artificial Sequence
  chemically synthesized
agaatacctggtaaaatgaatg

SEQ ID NO: 1241055 - DNA, 22 bp, Artificial Sequence
  chemically synthesized
tagaatacctggtaaaatgaat

SEQ ID NO: 1241056 - DNA, 22 bp, Artificial Sequence
  chemically synthesized
ggtcagtactcattcattttac

SEQ ID NO: 1241057 - DNA, 22 bp, Artificial Sequence
  chemically synthesized
ctttagaatacctggtaaaatg

SEQ ID NO: 1241058 - DNA, 22 bp, Artificial Sequence
  chemically synthesized
cctttagaatacctggtaaaat

SEQ ID NO: 1241059 - DNA, 22 bp, Artificial Sequence
  chemically synthesized
atatttcctttagaatacctgg

SEQ ID NO: 1241060 - DNA, 22 bp, Artificial Sequence
  chemically synthesized
attcattttaccaggtattcta

SEQ ID NO: 1241061 - DNA, 22 bp, Artificial Sequence
  chemically synthesized
ttaatatttcctttagaatacc

SEQ ID NO: 1241062 - DNA, 22 bp, Artificial Sequence
  chemically synthesized
attaatatttcctttagaatac

SEQ ID NO: 1241063 - DNA, 22 bp, Artificial Sequence
  chemically synthesized
tattaatatttcctttagaata

SEQ ID NO: 1241064 - DNA, 22 bp, Artificial Sequence
  chemically synthesized
attttaccaggtattctaaagg

SEQ ID NO: 1241065 - DNA, 22 bp, Artificial Sequence
  chemically synthesized
taccaggtattctaaaggaaat

SEQ ID NO: 1241066 - DNA, 22 bp, Artificial Sequence
  chemically synthesized
accaggtattctaaaggaaata

SEQ ID NO: 1241067 - DNA, 22 bp, Artificial Sequence
  chemically synthesized
ccaggtattctaaaggaaatat

SEQ ID NO: 1241068 - DNA, 22 bp, Artificial Sequence
  chemically synthesized
ccataattttattaatatttcc

SEQ ID NO: 1241069 - DNA, 22 bp, Artificial Sequence
  chemically synthesized
accataattttattaatatttc

SEQ ID NO: 1241070 - DNA, 22 bp, Artificial Sequence
  chemically synthesized
taaaggaaatattaataaaatt

SEQ ID NO: 1241071 - DNA, 22 bp, Artificial Sequence
  chemically synthesized
aaggaaatattaataaaattat

SEQ ID NO: 1241072 - DNA, 22 bp, Artificial Sequence
  chemically synthesized
ataaaattatggtaaatgcttt

SEQ ID NO: 1241073 - DNA, 22 bp, Artificial Sequence
  chemically synthesized
atacataaaaatataagataaa

SEQ ID NO: 1241074 - DNA, 22 bp, Artificial Sequence
  chemically synthesized
tggtaaatgctttatcttatat

SEQ ID NO: 1241075 - DNA, 22 bp, Artificial Sequence
  chemically synthesized
cattaatacataaaaatataag

SEQ ID NO: 1241076 - DNA, 22 bp, Artificial Sequence
  chemically synthesized
tgaattacattaatacataaaa

SEQ ID NO: 1241077 - DNA, 22 bp, Artificial Sequence
  chemically synthesized
gtgaattacattaatacataaa

SEQ ID NO: 1241078 - DNA, 22 bp, Artificial Sequence
  chemically synthesized
tatcttatatttttatgtatta

SEQ ID NO: 1241079 - DNA, 22 bp, Artificial Sequence
  chemically synthesized
tgtgaattacattaatacataa

SEQ ID NO: 1241080 - DNA, 22 bp, Artificial Sequence
  chemically synthesized
atcttatatttttatgtattaa

SEQ ID NO: 1241081 - DNA, 22 bp, Artificial Sequence
  chemically synthesized
tcttatatttttatgtattaat

SEQ ID NO: 1241082 - DNA, 22 bp, Artificial Sequence
  chemically synthesized
atatttttatgtattaatgtaa

SEQ ID NO: 1241083 - DNA, 22 bp, Artificial Sequence
  chemically synthesized
tatttttatgtattaatgtaat

SEQ ID NO: 1241084 - DNA, 22 bp, Artificial Sequence
  chemically synthesized
aaataactttgtgaattacatt

SEQ ID NO: 1241085 - DNA, 22 bp, Artificial Sequence
  chemically synthesized
aaaataactttgtgaattacat

SEQ ID NO: 1241086 - DNA, 22 bp, Artificial Sequence
  chemically synthesized
taaaataactttgtgaattaca

SEQ ID NO: 1241087 - DNA, 22 bp, Artificial Sequence
  chemically synthesized
ttatgtattaatgtaattcaca

SEQ ID NO: 1241088 - DNA, 22 bp, Artificial Sequence
  chemically synthesized
tatgtattaatgtaattcacaa

SEQ ID NO: 1241089 - DNA, 22 bp, Artificial Sequence
  chemically synthesized
atgtattaatgtaattcacaaa

SEQ ID NO: 1241090 - DNA, 22 bp, Artificial Sequence
  chemically synthesized
tgtattaatgtaattcacaaag

SEQ ID NO: 1241091 - DNA, 22 bp, Artificial Sequence
  chemically synthesized
cacaaattttaaaataactttg

SEQ ID NO: 1241092 - DNA, 22 bp, Artificial Sequence
  chemically synthesized
atgtaattcacaaagttatttt

SEQ ID NO: 1241093 - DNA, 22 bp, Artificial Sequence
  chemically synthesized
taatcattccacaaattttaaa

SEQ ID NO: 1241094 - DNA, 22 bp, Artificial Sequence
  chemically synthesized
acaaagttattttaaaatttgt

SEQ ID NO: 1241095 - DNA, 22 bp, Artificial Sequence
  chemically synthesized
ttttaaaatttgtggaatgatt

SEQ ID NO: 1241096 - DNA, 22 bp, Artificial Sequence
  chemically synthesized
taaaatttgtggaatgattaca

SEQ ID NO: 1241097 - DNA, 22 bp, Artificial Sequence
  chemically synthesized
aaaatttgtggaatgattacaa

SEQ ID NO: 1241098 - DNA, 22 bp, Artificial Sequence
  chemically synthesized
aaatttgtggaatgattacaat

SEQ ID NO: 1241099 - DNA, 22 bp, Artificial Sequence
  chemically synthesized
gtataatcatggattgtaatca

SEQ ID NO: 1241100 - DNA, 22 bp, Artificial Sequence
  chemically synthesized
gtggaatgattacaatccatga

SEQ ID NO: 1241101 - DNA, 22 bp, Artificial Sequence
  chemically synthesized
tggaatgattacaatccatgat

SEQ ID NO: 1241102 - DNA, 22 bp, Artificial Sequence
  chemically synthesized
aaggtggtgtaattagtataat

SEQ ID NO: 1241103 - DNA, 22 bp, Artificial Sequence
  chemically synthesized
aaaggtggtgtaattagtataa

SEQ ID NO: 1241104 - DNA, 22 bp, Artificial Sequence
  chemically synthesized
caatccatgattatactaatta

SEQ ID NO: 1241105 - DNA, 22 bp, Artificial Sequence
  chemically synthesized
taggggatatttaaaggtggtg

SEQ ID NO: 1241106 - DNA, 22 bp, Artificial Sequence
  chemically synthesized
ataggggatatttaaaggtggt

SEQ ID NO: 1241107 - DNA, 22 bp, Artificial Sequence
  chemically synthesized
tataggggatatttaaaggtgg

SEQ ID NO: 1241108 - DNA, 22 bp, Artificial Sequence
  chemically synthesized
tactaattacaccacctttaaa

SEQ ID NO: 1241109 - DNA, 22 bp, Artificial Sequence
  chemically synthesized
aattttataggggatatttaaa

SEQ ID NO: 1241110 - DNA, 22 bp, Artificial Sequence
  chemically synthesized
attacaccacctttaaatatcc

SEQ ID NO: 1241111 - DNA, 22 bp, Artificial Sequence
  chemically synthesized
caccacctttaaatatccccta

SEQ ID NO: 1241112 - DNA, 22 bp, Artificial Sequence
  chemically synthesized
agaatgttcaattttatagggg

SEQ ID NO: 1241113 - DNA, 22 bp, Artificial Sequence
  chemically synthesized
cagaatgttcaattttataggg

SEQ ID NO: 1241114 - DNA, 22 bp, Artificial Sequence
  chemically synthesized
tcagaatgttcaattttatagg

SEQ ID NO: 1241115 - DNA, 22 bp, Artificial Sequence
  chemically synthesized
taaatatcccctataaaattga

SEQ ID NO: 1241116 - DNA, 22 bp, Artificial Sequence
  chemically synthesized
aaatatcccctataaaattgaa

SEQ ID NO: 1241117 - DNA, 22 bp, Artificial Sequence
  chemically synthesized
actttcagaatgttcaatttta

SEQ ID NO: 1241118 - DNA, 22 bp, Artificial Sequence
  chemically synthesized
aatatcccctataaaattgaac

SEQ ID NO: 1241119 - DNA, 22 bp, Artificial Sequence
  chemically synthesized
aactttcagaatgttcaatttt

SEQ ID NO: 1241120 - DNA, 22 bp, Artificial Sequence
  chemically synthesized
ggtttaactttcagaatgttca

SEQ ID NO: 1241121 - DNA, 22 bp, Artificial Sequence
  chemically synthesized
taaaattgaacattctgaaagt

SEQ ID NO: 1241122 - DNA, 22 bp, Artificial Sequence
  chemically synthesized
aacattctgaaagttaaaccca

SEQ ID NO: 1241123 - DNA, 22 bp, Artificial Sequence
  chemically synthesized
aacaacaacaaaaaactgggtt

SEQ ID NO: 1241124 - DNA, 22 bp, Artificial Sequence
  chemically synthesized
tgaaagttaaacccagtttttt

SEQ ID NO: 1241125 - DNA, 22 bp, Artificial Sequence
  chemically synthesized
aaagttaaacccagttttttgt

SEQ ID NO: 1241126 - DNA, 22 bp, Artificial Sequence
  chemically synthesized
aacccagttttttgttgttgtt

SEQ ID NO: 1241127 - DNA, 22 bp, Artificial Sequence
  chemically synthesized
cagccaaggtgacagagtctca

SEQ ID NO: 1241128 - DNA, 22 bp, Artificial Sequence
  chemically synthesized
tttgttgttgttgagactctgt

SEQ ID NO: 1241129 - DNA, 22 bp, Artificial Sequence
  chemically synthesized
ttgttgttgttgagactctgtc

SEQ ID NO: 1241130 - DNA, 22 bp, Artificial Sequence
  chemically synthesized
tgttgttgttgagactctgtca

SEQ ID NO: 1241131 - DNA, 22 bp, Artificial Sequence
  chemically synthesized
gttgttgttgagactctgtcac

SEQ ID NO: 1241132 - DNA, 22 bp, Artificial Sequence
  chemically synthesized
ttgttgttgagactctgtcacc

SEQ ID NO: 1241133 - DNA, 22 bp, Artificial Sequence
  chemically synthesized
cactccagccaaggtgacagag

SEQ ID NO: 1241134 - DNA, 22 bp, Artificial Sequence
  chemically synthesized
ttgttgagactctgtcaccttg

SEQ ID NO: 1241135 - DNA, 22 bp, Artificial Sequence
  chemically synthesized
ttgagactctgtcaccttggct

SEQ ID NO: 1241136 - DNA, 22 bp, Artificial Sequence
  chemically synthesized
agactctgtcaccttggctgga

SEQ ID NO: 1241137 - DNA, 22 bp, Artificial Sequence
  chemically synthesized
tgtcaccttggctggagtgtag

SEQ ID NO: 1241138 - DNA, 22 bp, Artificial Sequence
  chemically synthesized
tcaccttggctggagtgtagtg

SEQ ID NO: 1241139 - DNA, 22 bp, Artificial Sequence
  chemically synthesized
ggctggagtgtagtggcgtgat

SEQ ID NO: 1241140 - DNA, 22 bp, Artificial Sequence
  chemically synthesized
cagtgagccaagatcacgccac

SEQ ID NO: 1241141 - DNA, 22 bp, Artificial Sequence
  chemically synthesized
gctggagtgtagtggcgtgatc

SEQ ID NO: 1241142 - DNA, 22 bp, Artificial Sequence
  chemically synthesized
gagtgtagtggcgtgatcttgg

SEQ ID NO: 1241143 - DNA, 22 bp, Artificial Sequence
  chemically synthesized
ggaggcggaggttgcagtgagc

SEQ ID NO: 1241144 - DNA, 22 bp, Artificial Sequence
  chemically synthesized
aacctgggaggcggaggttgca

SEQ ID NO: 1241145 - DNA, 22 bp, Artificial Sequence
  chemically synthesized
gaacctgggaggcggaggttgc

SEQ ID NO: 1241146 - DNA, 22 bp, Artificial Sequence
  chemically synthesized
ggctcactgcaacctccgcctc

SEQ ID NO: 1241147 - DNA, 22 bp, Artificial Sequence
  chemically synthesized
gctcactgcaacctccgcctcc

SEQ ID NO: 1241148 - DNA, 22 bp, Artificial Sequence
  chemically synthesized
actgcaacctccgcctcccagg

SEQ ID NO: 1241149 - DNA, 22 bp, Artificial Sequence
  chemically synthesized
caacctccgcctcccaggttca

SEQ ID NO: 1241150 - DNA, 22 bp, Artificial Sequence
  chemically synthesized
cgcctcccaggttcaagcgatt

SEQ ID NO: 1241151 - DNA, 22 bp, Artificial Sequence
  chemically synthesized
ccaggttcaagcgattctcctg

SEQ ID NO: 1241152 - DNA, 22 bp, Artificial Sequence
  chemically synthesized
gggacgcggaggcaggagaatc

SEQ ID NO: 1241153 - DNA, 22 bp, Artificial Sequence
  chemically synthesized
ctagggacgcggaggcaggaga

SEQ ID NO: 1241154 - DNA, 22 bp, Artificial Sequence
  chemically synthesized
aagcgattctcctgcctccgcg

SEQ ID NO: 1241155 - DNA, 22 bp, Artificial Sequence
  chemically synthesized
taatcccagctactagggacgc

SEQ ID NO: 1241156 - DNA, 22 bp, Artificial Sequence
  chemically synthesized
tcctgcctccgcgtccctagta

SEQ ID NO: 1241157 - DNA, 22 bp, Artificial Sequence
  chemically synthesized
ctgcctccgcgtccctagtagc

SEQ ID NO: 1241158 - DNA, 22 bp, Artificial Sequence
  chemically synthesized
cctccgcgtccctagtagctgg

SEQ ID NO: 1241159 - DNA, 22 bp, Artificial Sequence
  chemically synthesized
gcgcctgtaatcccagctacta

SEQ ID NO: 1241160 - DNA, 22 bp, Artificial Sequence
  chemically synthesized
cgcgtccctagtagctgggatt

SEQ ID NO: 1241161 - DNA, 22 bp, Artificial Sequence
  chemically synthesized
gtagctgggattacaggcgcga

SEQ ID NO: 1241162 - DNA, 22 bp, Artificial Sequence
  chemically synthesized
gccaagcgtagtggctcgcgcc

SEQ ID NO: 1241163 - DNA, 22 bp, Artificial Sequence
  chemically synthesized
ggattacaggcgcgagccacta

SEQ ID NO: 1241164 - DNA, 22 bp, Artificial Sequence
  chemically synthesized
caggcgcgagccactacgcttg

SEQ ID NO: 1241165 - DNA, 22 bp, Artificial Sequence
  chemically synthesized
aaaatataaaaaaattagccaa

SEQ ID NO: 1241166 - DNA, 22 bp, Artificial Sequence
  chemically synthesized
ctaaaaatataaaaaaattagc

SEQ ID NO: 1241167 - DNA, 22 bp, Artificial Sequence
  chemically synthesized
tactaaaaatataaaaaaatta

SEQ ID NO: 1241168 - DNA, 22 bp, Artificial Sequence
  chemically synthesized
cgcttggctaatttttttatat

SEQ ID NO: 1241169 - DNA, 22 bp, Artificial Sequence
  chemically synthesized
ggctaatttttttatattttta

SEQ ID NO: 1241170 - DNA, 22 bp, Artificial Sequence
  chemically synthesized
gctaatttttttatatttttag

SEQ ID NO: 1241171 - DNA, 22 bp, Artificial Sequence
  chemically synthesized
atttttttatatttttagtaga

SEQ ID NO: 1241172 - DNA, 22 bp, Artificial Sequence
  chemically synthesized
ttttatatttttagtagagacg

SEQ ID NO: 1241173 - DNA, 22 bp, Artificial Sequence
  chemically synthesized
tttatatttttagtagagacgg

SEQ ID NO: 1241174 - DNA, 22 bp, Artificial Sequence
  chemically synthesized
ttatatttttagtagagacggg

SEQ ID NO: 1241175 - DNA, 22 bp, Artificial Sequence
  chemically synthesized
acaaggtgaaaccccgtctcta

SEQ ID NO: 1241176 - DNA, 22 bp, Artificial Sequence
  chemically synthesized
tatatttttagtagagacgggg

SEQ ID NO: 1241177 - DNA, 22 bp, Artificial Sequence
  chemically synthesized
atatttttagtagagacggggt

SEQ ID NO: 1241178 - DNA, 22 bp, Artificial Sequence
  chemically synthesized
tatttttagtagagacggggtt

SEQ ID NO: 1241179 - DNA, 22 bp, Artificial Sequence
  chemically synthesized
gctaacaaggtgaaaccccgtc

SEQ ID NO: 1241180 - DNA, 22 bp, Artificial Sequence
  chemically synthesized
ttagtagagacggggtttcacc

SEQ ID NO: 1241181 - DNA, 22 bp, Artificial Sequence
  chemically synthesized
tagtagagacggggtttcacct

SEQ ID NO: 1241182 - DNA, 22 bp, Artificial Sequence
  chemically synthesized
agtagagacggggtttcacctt

SEQ ID NO: 1241183 - DNA, 22 bp, Artificial Sequence
  chemically synthesized
gtagagacggggtttcaccttg

SEQ ID NO: 1241184 - DNA, 22 bp, Artificial Sequence
  chemically synthesized
caccttgttagccaggctggtc

SEQ ID NO: 1241185 - DNA, 22 bp, Artificial Sequence
  chemically synthesized
accttgttagccaggctggtct

SEQ ID NO: 1241186 - DNA, 22 bp, Artificial Sequence
  chemically synthesized
gttagccaggctggtctcgacc

SEQ ID NO: 1241187 - DNA, 22 bp, Artificial Sequence
  chemically synthesized
ttagccaggctggtctcgacct

SEQ ID NO: 1241188 - DNA, 22 bp, Artificial Sequence
  chemically synthesized
gccaggctggtctcgacctcct

SEQ ID NO: 1241189 - DNA, 22 bp, Artificial Sequence
  chemically synthesized
gtctcgacctcctgacctcgtg

SEQ ID NO: 1241190 - DNA, 22 bp, Artificial Sequence
  chemically synthesized
aggcaggtggatcacgaggtca

SEQ ID NO: 1241191 - DNA, 22 bp, Artificial Sequence
  chemically synthesized
gacctcctgacctcgtgatcca

SEQ ID NO: 1241192 - DNA, 22 bp, Artificial Sequence
  chemically synthesized
ggaggctgaggcaggtggatca

SEQ ID NO: 1241193 - DNA, 22 bp, Artificial Sequence
  chemically synthesized
gggaggctgaggcaggtggatc

SEQ ID NO: 1241194 - DNA, 22 bp, Artificial Sequence
  chemically synthesized
tgggaggctgaggcaggtggat

SEQ ID NO: 1241195 - DNA, 22 bp, Artificial Sequence
  chemically synthesized
ctgacctcgtgatccacctgcc

SEQ ID NO: 1241196 - DNA, 22 bp, Artificial Sequence
  chemically synthesized
acctcgtgatccacctgcctca

SEQ ID NO: 1241197 - DNA, 22 bp, Artificial Sequence
  chemically synthesized
agcactttgggaggctgaggca

SEQ ID NO: 1241198 - DNA, 22 bp, Artificial Sequence
  chemically synthesized
gtgatccacctgcctcagcctc

SEQ ID NO: 1241199 - DNA, 22 bp, Artificial Sequence
  chemically synthesized
taaatctcagcactttgggagg

SEQ ID NO: 1241200 - DNA, 22 bp, Artificial Sequence
  chemically synthesized
cctcagcctcccaaagtgctga

SEQ ID NO: 1241201 - DNA, 22 bp, Artificial Sequence
  chemically synthesized
atgcctgtaaatctcagcactt

SEQ ID NO: 1241202 - DNA, 22 bp, Artificial Sequence
  chemically synthesized
agcctcccaaagtgctgagatt

SEQ ID NO: 1241203 - DNA, 22 bp, Artificial Sequence
  chemically synthesized
ccaaagtgctgagatttacagg

SEQ ID NO: 1241204 - DNA, 22 bp, Artificial Sequence
  chemically synthesized
gtgcagtggctcatgcctgtaa

SEQ ID NO: 1241205 - DNA, 22 bp, Artificial Sequence
  chemically synthesized
ggcctggtgcagtggctcatgc

SEQ ID NO: 1241206 - DNA, 22 bp, Artificial Sequence
  chemically synthesized
aggcctggtgcagtggctcatg

SEQ ID NO: 1241207 - DNA, 22 bp, Artificial Sequence
  chemically synthesized
agatttacaggcatgagccact

SEQ ID NO: 1241208 - DNA, 22 bp, Artificial Sequence
  chemically synthesized
gatttaggcctggtgcagtggc

SEQ ID NO: 1241209 - DNA, 22 bp, Artificial Sequence
  chemically synthesized
acaggcatgagccactgcacca

SEQ ID NO: 1241210 - DNA, 22 bp, Artificial Sequence
  chemically synthesized
caggcatgagccactgcaccag

SEQ ID NO: 1241211 - DNA, 22 bp, Artificial Sequence
  chemically synthesized
caccaggcctaaatccagtttt

SEQ ID NO: 1241212 - DNA, 22 bp, Artificial Sequence
  chemically synthesized
tgtgaatcaaaagaaaaactgg

SEQ ID NO: 1241213 - DNA, 22 bp, Artificial Sequence
  chemically synthesized
aatccagtttttcttttgattc

SEQ ID NO: 1241214 - DNA, 22 bp, Artificial Sequence
  chemically synthesized
ttcttttgattcacatagatac

SEQ ID NO: 1241215 - DNA, 22 bp, Artificial Sequence
  chemically synthesized
tcttttgattcacatagataca

SEQ ID NO: 1241216 - DNA, 22 bp, Artificial Sequence
  chemically synthesized
aaatgcaaatcatgtatctatg

SEQ ID NO: 1241217 - DNA, 22 bp, Artificial Sequence
  chemically synthesized
cttttgattcacatagatacat

SEQ ID NO: 1241218 - DNA, 22 bp, Artificial Sequence
  chemically synthesized
ttttgattcacatagatacatg

SEQ ID NO: 1241219 - DNA, 22 bp, Artificial Sequence
  chemically synthesized
ttgattcacatagatacatgat

SEQ ID NO: 1241220 - DNA, 22 bp, Artificial Sequence
  chemically synthesized
tctcaaatgcaaatcatgtatc

SEQ ID NO: 1241221 - DNA, 22 bp, Artificial Sequence
  chemically synthesized
tgattcacatagatacatgatt

SEQ ID NO: 1241222 - DNA, 22 bp, Artificial Sequence
  chemically synthesized
gattcacatagatacatgattt

SEQ ID NO: 1241223 - DNA, 22 bp, Artificial Sequence
  chemically synthesized
attcacatagatacatgatttg

SEQ ID NO: 1241224 - DNA, 22 bp, Artificial Sequence
  chemically synthesized
gctatctcaaatgcaaatcatg

SEQ ID NO: 1241225 - DNA, 22 bp, Artificial Sequence
  chemically synthesized
acatagatacatgatttgcatt

SEQ ID NO: 1241226 - DNA, 22 bp, Artificial Sequence
  chemically synthesized
catcactggctatctcaaatgc

SEQ ID NO: 1241227 - DNA, 22 bp, Artificial Sequence
  chemically synthesized
ccatcactggctatctcaaatg

SEQ ID NO: 1241228 - DNA, 22 bp, Artificial Sequence
  chemically synthesized
atttccatcactggctatctca

SEQ ID NO: 1241229 - DNA, 22 bp, Artificial Sequence
  chemically synthesized
catttccatcactggctatctc

SEQ ID NO: 1241230 - DNA, 22 bp, Artificial Sequence
  chemically synthesized
gccttcatttccatcactggct

SEQ ID NO: 1241231 - DNA, 22 bp, Artificial Sequence
  chemically synthesized
gcatttgagatagccagtgatg

SEQ ID NO: 1241232 - DNA, 22 bp, Artificial Sequence
  chemically synthesized
catttgagatagccagtgatgg

SEQ ID NO: 1241233 - DNA, 22 bp, Artificial Sequence
  chemically synthesized
taattagccttcatttccatca

SEQ ID NO: 1241234 - DNA, 22 bp, Artificial Sequence
  chemically synthesized
gagatagccagtgatggaaatg

SEQ ID NO: 1241235 - DNA, 22 bp, Artificial Sequence
  chemically synthesized
agatagccagtgatggaaatga

SEQ ID NO: 1241236 - DNA, 22 bp, Artificial Sequence
  chemically synthesized
ggatagattgtaattagccttc

SEQ ID NO: 1241237 - DNA, 22 bp, Artificial Sequence
  chemically synthesized
tcagaaaagcaaccattgggat

SEQ ID NO: 1241238 - DNA, 22 bp, Artificial Sequence
  chemically synthesized
attacaatctatcccaatggtt

SEQ ID NO: 1241239 - DNA, 22 bp, Artificial Sequence
  chemically synthesized
tgtcagaaaagcaaccattggg

SEQ ID NO: 1241240 - DNA, 22 bp, Artificial Sequence
  chemically synthesized
ctgtcagaaaagcaaccattgg

SEQ ID NO: 1241241 - DNA, 22 bp, Artificial Sequence
  chemically synthesized
caatctatcccaatggttgctt

SEQ ID NO: 1241242 - DNA, 22 bp, Artificial Sequence
  chemically synthesized
tcccaatggttgcttttctgac

SEQ ID NO: 1241243 - DNA, 22 bp, Artificial Sequence
  chemically synthesized
taccataccgtttctgtcagaa

SEQ ID NO: 1241244 - DNA, 22 bp, Artificial Sequence
  chemically synthesized
gtaccataccgtttctgtcaga

SEQ ID NO: 1241245 - DNA, 22 bp, Artificial Sequence
  chemically synthesized
cttttctgacagaaacggtatg

SEQ ID NO: 1241246 - DNA, 22 bp, Artificial Sequence
  chemically synthesized
ccaaccttgtaccataccgttt

SEQ ID NO: 1241247 - DNA, 22 bp, Artificial Sequence
  chemically synthesized
gccaaccttgtaccataccgtt

SEQ ID NO: 1241248 - DNA, 22 bp, Artificial Sequence
  chemically synthesized
ttctgacagaaacggtatggta

SEQ ID NO: 1241249 - DNA, 22 bp, Artificial Sequence
  chemically synthesized
tctgacagaaacggtatggtac

SEQ ID NO: 1241250 - DNA, 22 bp, Artificial Sequence
  chemically synthesized
ctgacagaaacggtatggtaca

SEQ ID NO: 1241251 - DNA, 22 bp, Artificial Sequence
  chemically synthesized
tgacagaaacggtatggtacaa

SEQ ID NO: 1241252 - DNA, 22 bp, Artificial Sequence
  chemically synthesized
atcttgccaaccttgtaccata

SEQ ID NO: 1241253 - DNA, 22 bp, Artificial Sequence
  chemically synthesized
catcttgccaaccttgtaccat

SEQ ID NO: 1241254 - DNA, 22 bp, Artificial Sequence
  chemically synthesized
acagaaacggtatggtacaagg

SEQ ID NO: 1241255 - DNA, 22 bp, Artificial Sequence
  chemically synthesized
aaacaaagtgcttcatcttgcc

SEQ ID NO: 1241256 - DNA, 22 bp, Artificial Sequence
  chemically synthesized
gaaacaaagtgcttcatcttgc

SEQ ID NO: 1241257 - DNA, 22 bp, Artificial Sequence
  chemically synthesized
tgaaacaaagtgcttcatcttg

SEQ ID NO: 1241258 - DNA, 22 bp, Artificial Sequence
  chemically synthesized
catgctttgaaacaaagtgctt

SEQ ID NO: 1241259 - DNA, 22 bp, Artificial Sequence
  chemically synthesized
gcatgctttgaaacaaagtgct

SEQ ID NO: 1241260 - DNA, 22 bp, Artificial Sequence
  chemically synthesized
gcaagatgaagcactttgtttc

SEQ ID NO: 1241261 - DNA, 22 bp, Artificial Sequence
  chemically synthesized
tttgcatgctttgaaacaaagt

SEQ ID NO: 1241262 - DNA, 22 bp, Artificial Sequence
  chemically synthesized
aagaatcagtgttatttgcatg

SEQ ID NO: 1241263 - DNA, 22 bp, Artificial Sequence
  chemically synthesized
gaagaatcagtgttatttgcat

SEQ ID NO: 1241264 - DNA, 22 bp, Artificial Sequence
  chemically synthesized
tgtttcaaagcatgcaaataac

SEQ ID NO: 1241265 - DNA, 22 bp, Artificial Sequence
  chemically synthesized
tgaagaatcagtgttatttgca

SEQ ID NO: 1241266 - DNA, 22 bp, Artificial Sequence
  chemically synthesized
gtttcaaagcatgcaaataaca

SEQ ID NO: 1241267 - DNA, 22 bp, Artificial Sequence
  chemically synthesized
ttgaagaatcagtgttatttgc

SEQ ID NO: 1241268 - DNA, 22 bp, Artificial Sequence
  chemically synthesized
tttcaaagcatgcaaataacac

SEQ ID NO: 1241269 - DNA, 22 bp, Artificial Sequence
  chemically synthesized
tttgaagaatcagtgttatttg

SEQ ID NO: 1241270 - DNA, 22 bp, Artificial Sequence
  chemically synthesized
ttttgaagaatcagtgttattt

SEQ ID NO: 1241271 - DNA, 22 bp, Artificial Sequence
  chemically synthesized
caaagcatgcaaataacactga

SEQ ID NO: 1241272 - DNA, 22 bp, Artificial Sequence
  chemically synthesized
ttttttgaagaatcagtgttat

SEQ ID NO: 1241273 - DNA, 22 bp, Artificial Sequence
  chemically synthesized
aaagcatgcaaataacactgat

SEQ ID NO: 1241274 - DNA, 22 bp, Artificial Sequence
  chemically synthesized
cttttttgaagaatcagtgtta

SEQ ID NO: 1241275 - DNA, 22 bp, Artificial Sequence
  chemically synthesized
tagatttcttttttgaagaatc

SEQ ID NO: 1241276 - DNA, 22 bp, Artificial Sequence
  chemically synthesized
gcctatagatttcttttttgaa

SEQ ID NO: 1241277 - DNA, 22 bp, Artificial Sequence
  chemically synthesized
cgcctagcctatagatttcttt

SEQ ID NO: 1241278 - DNA, 22 bp, Artificial Sequence
  chemically synthesized
attcttcaaaaaagaaatctat

SEQ ID NO: 1241279 - DNA, 22 bp, Artificial Sequence
  chemically synthesized
ttcaaaaaagaaatctataggc

SEQ ID NO: 1241280 - DNA, 22 bp, Artificial Sequence
  chemically synthesized
caaaaaagaaatctataggcta

SEQ ID NO: 1241281 - DNA, 22 bp, Artificial Sequence
  chemically synthesized
aaaaaagaaatctataggctag

SEQ ID NO: 1241282 - DNA, 22 bp, Artificial Sequence
  chemically synthesized
caggcatgagccactgcgccta

SEQ ID NO: 1241283 - DNA, 22 bp, Artificial Sequence
  chemically synthesized
gggttacaggcatgagccactg

SEQ ID NO: 1241284 - DNA, 22 bp, Artificial Sequence
  chemically synthesized
taggctaggcgcagtggctcat

SEQ ID NO: 1241285 - DNA, 22 bp, Artificial Sequence
  chemically synthesized
ggcgcagtggctcatgcctgta

SEQ ID NO: 1241286 - DNA, 22 bp, Artificial Sequence
  chemically synthesized
ccaaagtactggggttacaggc

SEQ ID NO: 1241287 - DNA, 22 bp, Artificial Sequence
  chemically synthesized
ggcctcccaaagtactggggtt

SEQ ID NO: 1241288 - DNA, 22 bp, Artificial Sequence
  chemically synthesized
tcggcctcccaaagtactgggg

SEQ ID NO: 1241289 - DNA, 22 bp, Artificial Sequence
  chemically synthesized
ctcggcctcccaaagtactggg

SEQ ID NO: 1241290 - DNA, 22 bp, Artificial Sequence
  chemically synthesized
atgcctgtaaccccagtacttt

SEQ ID NO: 1241291 - DNA, 22 bp, Artificial Sequence
  chemically synthesized
cccttctcggcctcccaaagta

SEQ ID NO: 1241292 - DNA, 22 bp, Artificial Sequence
  chemically synthesized
taaccccagtactttgggaggc

SEQ ID NO: 1241293 - DNA, 22 bp, Artificial Sequence
  chemically synthesized
aagtgatctgcccttctcggcc

SEQ ID NO: 1241294 - DNA, 22 bp, Artificial Sequence
  chemically synthesized
caagtgatctgcccttctcggc

SEQ ID NO: 1241295 - DNA, 22 bp, Artificial Sequence
  chemically synthesized
gcttcaagtgatctgcccttct

SEQ ID NO: 1241296 - DNA, 22 bp, Artificial Sequence
  chemically synthesized
tgggaggccgagaagggcagat

SEQ ID NO: 1241297 - DNA, 22 bp, Artificial Sequence
  chemically synthesized
gggaggccgagaagggcagatc

SEQ ID NO: 1241298 - DNA, 22 bp, Artificial Sequence
  chemically synthesized
ctggcttcaagtgatctgccct

SEQ ID NO: 1241299 - DNA, 22 bp, Artificial Sequence
  chemically synthesized
ggaggccgagaagggcagatca

SEQ ID NO: 1241300 - DNA, 22 bp, Artificial Sequence
  chemically synthesized
aaactcctggcttcaagtgatc

SEQ ID NO: 1241301 - DNA, 22 bp, Artificial Sequence
  chemically synthesized
gtctcaaactcctggcttcaag

SEQ ID NO: 1241302 - DNA, 22 bp, Artificial Sequence
  chemically synthesized
gccaggctggtctcaaactcct

SEQ ID NO: 1241303 - DNA, 22 bp, Artificial Sequence
  chemically synthesized
gaagccaggagtttgagaccag

SEQ ID NO: 1241304 - DNA, 22 bp, Artificial Sequence
  chemically synthesized
aagccaggagtttgagaccagc

SEQ ID NO: 1241305 - DNA, 22 bp, Artificial Sequence
  chemically synthesized
gccacgttggccaggctggtct

SEQ ID NO: 1241306 - DNA, 22 bp, Artificial Sequence
  chemically synthesized
cgccacgttggccaggctggtc

SEQ ID NO: 1241307 - DNA, 22 bp, Artificial Sequence
  chemically synthesized
gagaccagcctggccaacgtgg

SEQ ID NO: 1241308 - DNA, 22 bp, Artificial Sequence
  chemically synthesized
agaccagcctggccaacgtggc

SEQ ID NO: 1241309 - DNA, 22 bp, Artificial Sequence
  chemically synthesized
gtaaaggtggagtttcgccacg

SEQ ID NO: 1241310 - DNA, 22 bp, Artificial Sequence
  chemically synthesized
agtaaaggtggagtttcgccac

SEQ ID NO: 1241311 - DNA, 22 bp, Artificial Sequence
  chemically synthesized
tagtaaaggtggagtttcgcca

SEQ ID NO: 1241312 - DNA, 22 bp, Artificial Sequence
  chemically synthesized
ttagtaaaggtggagtttcgcc

SEQ ID NO: 1241313 - DNA, 22 bp, Artificial Sequence
  chemically synthesized
gccaacgtggcgaaactccacc

SEQ ID NO: 1241314 - DNA, 22 bp, Artificial Sequence
  chemically synthesized
tatttttagtaaaggtggagtt

SEQ ID NO: 1241315 - DNA, 22 bp, Artificial Sequence
  chemically synthesized
gtatttttagtaaaggtggagt

SEQ ID NO: 1241316 - DNA, 22 bp, Artificial Sequence
  chemically synthesized
tgtatttttagtaaaggtggag

SEQ ID NO: 1241317 - DNA, 22 bp, Artificial Sequence
  chemically synthesized
ttgtatttttagtaaaggtgga

SEQ ID NO: 1241318 - DNA, 22 bp, Artificial Sequence
  chemically synthesized
acttttgtatttttagtaaagg

SEQ ID NO: 1241319 - DNA, 22 bp, Artificial Sequence
  chemically synthesized
cacctttactaaaaatacaaaa

SEQ ID NO: 1241320 - DNA, 22 bp, Artificial Sequence
  chemically synthesized
tactaaaaatacaaaagttagc

SEQ ID NO: 1241321 - DNA, 22 bp, Artificial Sequence
  chemically synthesized
actaaaaatacaaaagttagct

SEQ ID NO: 1241322 - DNA, 22 bp, Artificial Sequence
  chemically synthesized
ctaaaaatacaaaagttagctg

SEQ ID NO: 1241323 - DNA, 22 bp, Artificial Sequence
  chemically synthesized
aaaatacaaaagttagctgggc

SEQ ID NO: 1241324 - DNA, 22 bp, Artificial Sequence
  chemically synthesized
aggcgcgtgccaccatgcccag

SEQ ID NO: 1241325 - DNA, 22 bp, Artificial Sequence
  chemically synthesized
caggcgcgtgccaccatgccca

SEQ ID NO: 1241326 - DNA, 22 bp, Artificial Sequence
  chemically synthesized
ggacttcaggcgcgtgccacca

SEQ ID NO: 1241327 - DNA, 22 bp, Artificial Sequence
  chemically synthesized
gctgggcatggtggcacgcgcc

SEQ ID NO: 1241328 - DNA, 22 bp, Artificial Sequence
  chemically synthesized
ggcatggtggcacgcgcctgaa

SEQ ID NO: 1241329 - DNA, 22 bp, Artificial Sequence
  chemically synthesized
ccaagtagctgggacttcaggc

SEQ ID NO: 1241330 - DNA, 22 bp, Artificial Sequence
  chemically synthesized
gcctcccaagtagctgggactt

SEQ ID NO: 1241331 - DNA, 22 bp, Artificial Sequence
  chemically synthesized
agcctcccaagtagctgggact

SEQ ID NO: 1241332 - DNA, 22 bp, Artificial Sequence
  chemically synthesized
ccaccttagcctcccaagtagc

SEQ ID NO: 1241333 - DNA, 22 bp, Artificial Sequence
  chemically synthesized
tcccaccttagcctcccaagta

SEQ ID NO: 1241334 - DNA, 22 bp, Artificial Sequence
  chemically synthesized
aagtcccagctacttgggaggc

SEQ ID NO: 1241335 - DNA, 22 bp, Artificial Sequence
  chemically synthesized
tctcccaccttagcctcccaag

SEQ ID NO: 1241336 - DNA, 22 bp, Artificial Sequence
  chemically synthesized
ccagattctctcccaccttagc

SEQ ID NO: 1241337 - DNA, 22 bp, Artificial Sequence
  chemically synthesized
cttgggaggctaaggtgggaga

SEQ ID NO: 1241338 - DNA, 22 bp, Artificial Sequence
  chemically synthesized
cctcccagattctctcccacct

SEQ ID NO: 1241339 - DNA, 22 bp, Artificial Sequence
  chemically synthesized
tgcctcccagattctctcccac

SEQ ID NO: 1241340 - DNA, 22 bp, Artificial Sequence
  chemically synthesized
gggaggctaaggtgggagagaa

SEQ ID NO: 1241341 - DNA, 22 bp, Artificial Sequence
  chemically synthesized
ggaggctaaggtgggagagaat

SEQ ID NO: 1241342 - DNA, 22 bp, Artificial Sequence
  chemically synthesized
caacctctgcctcccagattct

SEQ ID NO: 1241343 - DNA, 22 bp, Artificial Sequence
  chemically synthesized
aggtgggagagaatctgggagg

SEQ ID NO: 1241344 - DNA, 22 bp, Artificial Sequence
  chemically synthesized
actgcaacctctgcctcccaga

SEQ ID NO: 1241345 - DNA, 22 bp, Artificial Sequence
  chemically synthesized
gctcactgcaacctctgcctcc

SEQ ID NO: 1241346 - DNA, 22 bp, Artificial Sequence
  chemically synthesized
ggctcactgcaacctctgcctc

SEQ ID NO: 1241347 - DNA, 22 bp, Artificial Sequence
  chemically synthesized
ggaggcagaggttgcagtgagc

SEQ ID NO: 1241348 - DNA, 22 bp, Artificial Sequence
  chemically synthesized
gagtgcagtggtgcaatcttgg

SEQ ID NO: 1241349 - DNA, 22 bp, Artificial Sequence
  chemically synthesized
cagtgagccaagattgcaccac

SEQ ID NO: 1241350 - DNA, 22 bp, Artificial Sequence
  chemically synthesized
ccacccaggctggagtgcagtg

SEQ ID NO: 1241351 - DNA, 22 bp, Artificial Sequence
  chemically synthesized
tgccacccaggctggagtgcag

SEQ ID NO: 1241352 - DNA, 22 bp, Artificial Sequence
  chemically synthesized
actctgccacccaggctggagt

SEQ ID NO: 1241353 - DNA, 22 bp, Artificial Sequence
  chemically synthesized
caccactgcactccagcctggg

SEQ ID NO: 1241354 - DNA, 22 bp, Artificial Sequence
  chemically synthesized
cactccagcctgggtggcagag

SEQ ID NO: 1241355 - DNA, 22 bp, Artificial Sequence
  chemically synthesized
agacggagtctcactctgccac

SEQ ID NO: 1241356 - DNA, 22 bp, Artificial Sequence
  chemically synthesized
gagacggagtctcactctgcca

SEQ ID NO: 1241357 - DNA, 22 bp, Artificial Sequence
  chemically synthesized
tgagacggagtctcactctgcc

SEQ ID NO: 1241358 - DNA, 22 bp, Artificial Sequence
  chemically synthesized
ttgagacggagtctcactctgc

SEQ ID NO: 1241359 - DNA, 22 bp, Artificial Sequence
  chemically synthesized
cagcctgggtggcagagtgaga

SEQ ID NO: 1241360 - DNA, 22 bp, Artificial Sequence
  chemically synthesized
tttgagacggagtctcactctg

SEQ ID NO: 1241361 - DNA, 22 bp, Artificial Sequence
  chemically synthesized
ttttgagacggagtctcactct

SEQ ID NO: 1241362 - DNA, 22 bp, Artificial Sequence
  chemically synthesized
tttttgagacggagtctcactc

SEQ ID NO: 1241363 - DNA, 22 bp, Artificial Sequence
  chemically synthesized
ttttttgagacggagtctcact

SEQ ID NO: 1241364 - DNA, 22 bp, Artificial Sequence
  chemically synthesized
tttttttgagacggagtctcac

SEQ ID NO: 1241365 - DNA, 22 bp, Artificial Sequence
  chemically synthesized
ttttttttgagacggagtctca

SEQ ID NO: 1241366 - DNA, 22 bp, Artificial Sequence
  chemically synthesized
tttttttttgagacggagtctc

SEQ ID NO: 1241367 - DNA, 22 bp, Artificial Sequence
  chemically synthesized
ggtggcagagtgagactccgtc

SEQ ID NO: 1241368 - DNA, 22 bp, Artificial Sequence
  chemically synthesized
ttttttttttgagacggagtct

SEQ ID NO: 1241369 - DNA, 22 bp, Artificial Sequence
  chemically synthesized
tttttttttttgagacggagtc

SEQ ID NO: 1241370 - DNA, 22 bp, Artificial Sequence
  chemically synthesized
ttttttttttttgagacggagt

SEQ ID NO: 1241371 - DNA, 22 bp, Artificial Sequence
  chemically synthesized
tttttttttttttgagacggag

SEQ ID NO: 1241372 - DNA, 22 bp, Artificial Sequence
  chemically synthesized
ttttttttttttttgagacgga

SEQ ID NO: 1241373 - DNA, 22 bp, Artificial Sequence
  chemically synthesized
cgtctcaaaaaaaaaaaaaaaa

SEQ ID NO: 1241374 - DNA, 22 bp, Artificial Sequence
  chemically synthesized
aaaaaaaaaaaaaaaagattgt

SEQ ID NO: 1241375 - DNA, 22 bp, Artificial Sequence
  chemically synthesized
tgtttatacacacacacacaca

SEQ ID NO: 1241376 - DNA, 22 bp, Artificial Sequence
  chemically synthesized
atacacacacacacacacacac

SEQ ID NO: 1241377 - DNA, 22 bp, Artificial Sequence
  chemically synthesized
tacacacacacacacacacaca

SEQ ID NO: 1241378 - DNA, 22 bp, Artificial Sequence
  chemically synthesized
tgtgtgtgtgtgtgtgtgtgtg

SEQ ID NO: 1241379 - DNA, 22 bp, Artificial Sequence
  chemically synthesized
gtgtgtgtgtgtgtgtgtgtgt

SEQ ID NO: 1241380 - DNA, 22 bp, Artificial Sequence
  chemically synthesized
tgtcatggtatatgtgtgtatt

SEQ ID NO: 1241381 - DNA, 22 bp, Artificial Sequence
  chemically synthesized
cattatgtcatggtatatgtgt

SEQ ID NO: 1241382 - DNA, 22 bp, Artificial Sequence
  chemically synthesized
gtgagccattccattatgtcat

SEQ ID NO: 1241383 - DNA, 22 bp, Artificial Sequence
  chemically synthesized
tctagtgagccattccattatg

SEQ ID NO: 1241384 - DNA, 22 bp, Artificial Sequence
  chemically synthesized
gtctagtgagccattccattat

SEQ ID NO: 1241385 - DNA, 22 bp, Artificial Sequence
  chemically synthesized
atagatgtttgtctagtgagcc

SEQ ID NO: 1241386 - DNA, 22 bp, Artificial Sequence
  chemically synthesized
agtactcatagatgtttgtcta

SEQ ID NO: 1241387 - DNA, 22 bp, Artificial Sequence
  chemically synthesized
gaactgagtactcatagatgtt

SEQ ID NO: 1241388 - DNA, 22 bp, Artificial Sequence
  chemically synthesized
actagacaaacatctatgagta

SEQ ID NO: 1241389 - DNA, 22 bp, Artificial Sequence
  chemically synthesized
cctggaactgagtactcataga

SEQ ID NO: 1241390 - DNA, 22 bp, Artificial Sequence
  chemically synthesized
ccctggaactgagtactcatag

SEQ ID NO: 1241391 - DNA, 22 bp, Artificial Sequence
  chemically synthesized
gacaaacatctatgagtactca

SEQ ID NO: 1241392 - DNA, 22 bp, Artificial Sequence
  chemically synthesized
caatttccctggaactgagtac

SEQ ID NO: 1241393 - DNA, 22 bp, Artificial Sequence
  chemically synthesized
tgcaatttccctggaactgagt

SEQ ID NO: 1241394 - DNA, 22 bp, Artificial Sequence
  chemically synthesized
tctgcaatttccctggaactga

SEQ ID NO: 1241395 - DNA, 22 bp, Artificial Sequence
  chemically synthesized
ctctgcaatttccctggaactg

SEQ ID NO: 1241396 - DNA, 22 bp, Artificial Sequence
  chemically synthesized
ttctctgcaatttccctggaac

SEQ ID NO: 1241397 - DNA, 22 bp, Artificial Sequence
  chemically synthesized
cttctctgcaatttccctggaa

SEQ ID NO: 1241398 - DNA, 22 bp, Artificial Sequence
  chemically synthesized
tgagtactcagttccagggaaa

SEQ ID NO: 1241399 - DNA, 22 bp, Artificial Sequence
  chemically synthesized
tcttctctgcaatttccctgga

SEQ ID NO: 1241400 - DNA, 22 bp, Artificial Sequence
  chemically synthesized
ttcttctctgcaatttccctgg

SEQ ID NO: 1241401 - DNA, 22 bp, Artificial Sequence
  chemically synthesized
agttccagggaaattgcagaga

SEQ ID NO: 1241402 - DNA, 22 bp, Artificial Sequence
  chemically synthesized
aatatcacttttcttctctgca

SEQ ID NO: 1241403 - DNA, 22 bp, Artificial Sequence
  chemically synthesized
cagggaaattgcagagaagaaa

SEQ ID NO: 1241404 - DNA, 22 bp, Artificial Sequence
  chemically synthesized
aagcctaaatatcacttttctt

SEQ ID NO: 1241405 - DNA, 22 bp, Artificial Sequence
  chemically synthesized
gatctgaagcctaaatatcact

SEQ ID NO: 1241406 - DNA, 22 bp, Artificial Sequence
  chemically synthesized
cagagaagaaaagtgatattta

SEQ ID NO: 1241407 - DNA, 22 bp, Artificial Sequence
  chemically synthesized
ctagatctgaagcctaaatatc

SEQ ID NO: 1241408 - DNA, 22 bp, Artificial Sequence
  chemically synthesized
tactagatctgaagcctaaata

SEQ ID NO: 1241409 - DNA, 22 bp, Artificial Sequence
  chemically synthesized
ctctactagatctgaagcctaa

SEQ ID NO: 1241410 - DNA, 22 bp, Artificial Sequence
  chemically synthesized
cctctactagatctgaagccta

SEQ ID NO: 1241411 - DNA, 22 bp, Artificial Sequence
  chemically synthesized
tccataatgtttcctctactag

SEQ ID NO: 1241412 - DNA, 22 bp, Artificial Sequence
  chemically synthesized
aggcttcagatctagtagagga

SEQ ID NO: 1241413 - DNA, 22 bp, Artificial Sequence
  chemically synthesized
gtccataatgtttcctctacta

SEQ ID NO: 1241414 - DNA, 22 bp, Artificial Sequence
  chemically synthesized
ggcttcagatctagtagaggaa

SEQ ID NO: 1241415 - DNA, 22 bp, Artificial Sequence
  chemically synthesized
tgtccataatgtttcctctact

SEQ ID NO: 1241416 - DNA, 22 bp, Artificial Sequence
  chemically synthesized
cagatctagtagaggaaacatt

SEQ ID NO: 1241417 - DNA, 22 bp, Artificial Sequence
  chemically synthesized
agatctagtagaggaaacatta

SEQ ID NO: 1241418 - DNA, 22 bp, Artificial Sequence
  chemically synthesized
gatgccctttgtccataatgtt

SEQ ID NO: 1241419 - DNA, 22 bp, Artificial Sequence
  chemically synthesized
ggatgccctttgtccataatgt

SEQ ID NO: 1241420 - DNA, 22 bp, Artificial Sequence
  chemically synthesized
tggatgccctttgtccataatg

SEQ ID NO: 1241421 - DNA, 22 bp, Artificial Sequence
  chemically synthesized
gtagaggaaacattatggacaa

SEQ ID NO: 1241422 - DNA, 22 bp, Artificial Sequence
  chemically synthesized
aagtcatctttggatgcccttt

SEQ ID NO: 1241423 - DNA, 22 bp, Artificial Sequence
  chemically synthesized
attaaagtcatctttggatgcc

SEQ ID NO: 1241424 - DNA, 22 bp, Artificial Sequence
  chemically synthesized
tggacaaagggcatccaaagat

SEQ ID NO: 1241425 - DNA, 22 bp, Artificial Sequence
  chemically synthesized
attaattaaagtcatctttgga

SEQ ID NO: 1241426 - DNA, 22 bp, Artificial Sequence
  chemically synthesized
cattcattaattaaagtcatct

SEQ ID NO: 1241427 - DNA, 22 bp, Artificial Sequence
  chemically synthesized
acattcattaattaaagtcatc

SEQ ID NO: 1241428 - DNA, 22 bp, Artificial Sequence
  chemically synthesized
tacattcattaattaaagtcat

SEQ ID NO: 1241429 - DNA, 22 bp, Artificial Sequence
  chemically synthesized
taattaatgaatgtaaaacgta

SEQ ID NO: 1241430 - DNA, 22 bp, Artificial Sequence
  chemically synthesized
aattaatgaatgtaaaacgtat

SEQ ID NO: 1241431 - DNA, 22 bp, Artificial Sequence
  chemically synthesized
attaatgaatgtaaaacgtatt

SEQ ID NO: 1241432 - DNA, 22 bp, Artificial Sequence
  chemically synthesized
taagaatggtaataaatacgtt

SEQ ID NO: 1241433 - DNA, 22 bp, Artificial Sequence
  chemically synthesized
atgaatgtaaaacgtatttatt

SEQ ID NO: 1241434 - DNA, 22 bp, Artificial Sequence
  chemically synthesized
agaaattataagaatggtaata

SEQ ID NO: 1241435 - DNA, 22 bp, Artificial Sequence
  chemically synthesized
attaccattcttataatttctc

SEQ ID NO: 1241436 - DNA, 22 bp, Artificial Sequence
  chemically synthesized
ttaccattcttataatttctca

SEQ ID NO: 1241437 - DNA, 22 bp, Artificial Sequence
  chemically synthesized
caccgtagggtaattgagaaat

SEQ ID NO: 1241438 - DNA, 22 bp, Artificial Sequence
  chemically synthesized
ccattcttataatttctcaatt

SEQ ID NO: 1241439 - DNA, 22 bp, Artificial Sequence
  chemically synthesized
ttataatttctcaattacccta

SEQ ID NO: 1241440 - DNA, 22 bp, Artificial Sequence
  chemically synthesized
ataatttctcaattaccctacg

SEQ ID NO: 1241441 - DNA, 22 bp, Artificial Sequence
  chemically synthesized
taatttctcaattaccctacgg

SEQ ID NO: 1241442 - DNA, 22 bp, Artificial Sequence
  chemically synthesized
tccatacacaactgcaccgtag

SEQ ID NO: 1241443 - DNA, 22 bp, Artificial Sequence
  chemically synthesized
ctcaattaccctacggtgcagt

SEQ ID NO: 1241444 - DNA, 22 bp, Artificial Sequence
  chemically synthesized
tcaattaccctacggtgcagtt

SEQ ID NO: 1241445 - DNA, 22 bp, Artificial Sequence
  chemically synthesized
aattaccctacggtgcagttgt

SEQ ID NO: 1241446 - DNA, 22 bp, Artificial Sequence
  chemically synthesized
tattgtccatacacaactgcac

SEQ ID NO: 1241447 - DNA, 22 bp, Artificial Sequence
  chemically synthesized
ccctacggtgcagttgtgtatg

SEQ ID NO: 1241448 - DNA, 22 bp, Artificial Sequence
  chemically synthesized
tcacctatattgtccatacaca

SEQ ID NO: 1241449 - DNA, 22 bp, Artificial Sequence
  chemically synthesized
gtcacctatattgtccatacac

SEQ ID NO: 1241450 - DNA, 22 bp, Artificial Sequence
  chemically synthesized
cggtgcagttgtgtatggacaa

SEQ ID NO: 1241451 - DNA, 22 bp, Artificial Sequence
  chemically synthesized
tgtcttgtcacctatattgtcc

SEQ ID NO: 1241452 - DNA, 22 bp, Artificial Sequence
  chemically synthesized
tgtatggacaatataggtgaca

SEQ ID NO: 1241453 - DNA, 22 bp, Artificial Sequence
  chemically synthesized
ggaagaagctgtgtcttgtcac

SEQ ID NO: 1241454 - DNA, 22 bp, Artificial Sequence
  chemically synthesized
ccagtaggtggaggatgggaat

SEQ ID NO: 1241455 - DNA, 22 bp, Artificial Sequence
  chemically synthesized
cccagtaggtggaggatgggaa

SEQ ID NO: 1241456 - DNA, 22 bp, Artificial Sequence
  chemically synthesized
cttcctaattattcccatcctc

SEQ ID NO: 1241457 - DNA, 22 bp, Artificial Sequence
  chemically synthesized
ttcctaattattcccatcctcc

SEQ ID NO: 1241458 - DNA, 22 bp, Artificial Sequence
  chemically synthesized
cctaattattcccatcctccac

SEQ ID NO: 1241459 - DNA, 22 bp, Artificial Sequence
  chemically synthesized
ctaattattcccatcctccacc

SEQ ID NO: 1241460 - DNA, 22 bp, Artificial Sequence
  chemically synthesized
attattcccatcctccacctac

SEQ ID NO: 1241461 - DNA, 22 bp, Artificial Sequence
  chemically synthesized
ttcccatcctccacctactggg

SEQ ID NO: 1241462 - DNA, 22 bp, Artificial Sequence
  chemically synthesized
ccatcctccacctactgggaag

SEQ ID NO: 1241463 - DNA, 22 bp, Artificial Sequence
  chemically synthesized
cacctactgggaagtcatcctt

SEQ ID NO: 1241464 - DNA, 22 bp, Artificial Sequence
  chemically synthesized
ctgggaagtcatccttggttta

SEQ ID NO: 1241465 - DNA, 22 bp, Artificial Sequence
  chemically synthesized
ggaagtcatccttggtttattc

SEQ ID NO: 1241466 - DNA, 22 bp, Artificial Sequence
  chemically synthesized
caggcatggaagaagaaagaat

SEQ ID NO: 1241467 - DNA, 22 bp, Artificial Sequence
  chemically synthesized
acaggcatggaagaagaaagaa

SEQ ID NO: 1241468 - DNA, 22 bp, Artificial Sequence
  chemically synthesized
ggtttattcattctttcttctt

SEQ ID NO: 1241469 - DNA, 22 bp, Artificial Sequence
  chemically synthesized
gtttattcattctttcttcttc

SEQ ID NO: 1241470 - DNA, 22 bp, Artificial Sequence
  chemically synthesized
attcattctttcttcttccatg

SEQ ID NO: 1241471 - DNA, 22 bp, Artificial Sequence
  chemically synthesized
ttcattctttcttcttccatgc

SEQ ID NO: 1241472 - DNA, 22 bp, Artificial Sequence
  chemically synthesized
attctttcttcttccatgcctg

SEQ ID NO: 1241473 - DNA, 22 bp, Artificial Sequence
  chemically synthesized
tagacagacccttacaggcatg

SEQ ID NO: 1241474 - DNA, 22 bp, Artificial Sequence
  chemically synthesized
tttcttcttccatgcctgtaag

SEQ ID NO: 1241475 - DNA, 22 bp, Artificial Sequence
  chemically synthesized
ctgtagacagacccttacaggc

SEQ ID NO: 1241476 - DNA, 22 bp, Artificial Sequence
  chemically synthesized
tcttcttccatgcctgtaaggg

SEQ ID NO: 1241477 - DNA, 22 bp, Artificial Sequence
  chemically synthesized
cctgtagacagacccttacagg

SEQ ID NO: 1241478 - DNA, 22 bp, Artificial Sequence
  chemically synthesized
cttcttccatgcctgtaagggt

SEQ ID NO: 1241479 - DNA, 22 bp, Artificial Sequence
  chemically synthesized
ttcttccatgcctgtaagggtc

SEQ ID NO: 1241480 - DNA, 22 bp, Artificial Sequence
  chemically synthesized
cttccatgcctgtaagggtctg

SEQ ID NO: 1241481 - DNA, 22 bp, Artificial Sequence
  chemically synthesized
ttccatgcctgtaagggtctgt

SEQ ID NO: 1241482 - DNA, 22 bp, Artificial Sequence
  chemically synthesized
gaacttcctgtagacagaccct

SEQ ID NO: 1241483 - DNA, 22 bp, Artificial Sequence
  chemically synthesized
ccatgcctgtaagggtctgtct

SEQ ID NO: 1241484 - DNA, 22 bp, Artificial Sequence
  chemically synthesized
ggaacttcctgtagacagaccc

SEQ ID NO: 1241485 - DNA, 22 bp, Artificial Sequence
  chemically synthesized
catgcctgtaagggtctgtcta

SEQ ID NO: 1241486 - DNA, 22 bp, Artificial Sequence
  chemically synthesized
atttggaacttcctgtagacag

SEQ ID NO: 1241487 - DNA, 22 bp, Artificial Sequence
  chemically synthesized
gatttggaacttcctgtagaca

SEQ ID NO: 1241488 - DNA, 22 bp, Artificial Sequence
  chemically synthesized
tgatttggaacttcctgtagac

SEQ ID NO: 1241489 - DNA, 22 bp, Artificial Sequence
  chemically synthesized
tttgatttggaacttcctgtag

SEQ ID NO: 1241490 - DNA, 22 bp, Artificial Sequence
  chemically synthesized
taagggtctgtctacaggaagt

SEQ ID NO: 1241491 - DNA, 22 bp, Artificial Sequence
  chemically synthesized
ctttgatttggaacttcctgta

SEQ ID NO: 1241492 - DNA, 22 bp, Artificial Sequence
  chemically synthesized
caatttctttgatttggaactt

SEQ ID NO: 1241493 - DNA, 22 bp, Artificial Sequence
  chemically synthesized
ccaatttctttgatttggaact

SEQ ID NO: 1241494 - DNA, 22 bp, Artificial Sequence
  chemically synthesized
tctacaggaagttccaaatcaa

SEQ ID NO: 1241495 - DNA, 22 bp, Artificial Sequence
  chemically synthesized
tgtttccaatttctttgatttg

SEQ ID NO: 1241496 - DNA, 22 bp, Artificial Sequence
  chemically synthesized
caggaagttccaaatcaaagaa

SEQ ID NO: 1241497 - DNA, 22 bp, Artificial Sequence
  chemically synthesized
tgtgtttccaatttctttgatt

SEQ ID NO: 1241498 - DNA, 22 bp, Artificial Sequence
  chemically synthesized
ctgtgtttccaatttctttgat

SEQ ID NO: 1241499 - DNA, 22 bp, Artificial Sequence
  chemically synthesized
tctgtgtttccaatttctttga

SEQ ID NO: 1241500 - DNA, 22 bp, Artificial Sequence
  chemically synthesized
ttctgtgtttccaatttctttg

SEQ ID NO: 1241501 - DNA, 22 bp, Artificial Sequence
  chemically synthesized
tcttttctgtgtttccaatttc

SEQ ID NO: 1241502 - DNA, 22 bp, Artificial Sequence
  chemically synthesized
atcttttctgtgtttccaattt

SEQ ID NO: 1241503 - DNA, 22 bp, Artificial Sequence
  chemically synthesized
caaatcaaagaaattggaaaca

SEQ ID NO: 1241504 - DNA, 22 bp, Artificial Sequence
  chemically synthesized
tgtgacatttatcttttctgtg

SEQ ID NO: 1241505 - DNA, 22 bp, Artificial Sequence
  chemically synthesized
tatcctatgtgacatttatctt

SEQ ID NO: 1241506 - DNA, 22 bp, Artificial Sequence
  chemically synthesized
gaaacacagaaaagataaatgt

SEQ ID NO: 1241507 - DNA, 22 bp, Artificial Sequence
  chemically synthesized
aatattgtatcctatgtgacat

SEQ ID NO: 1241508 - DNA, 22 bp, Artificial Sequence
  chemically synthesized
aaatattgtatcctatgtgaca

SEQ ID NO: 1241509 - DNA, 22 bp, Artificial Sequence
  chemically synthesized
taaatattgtatcctatgtgac

SEQ ID NO: 1241510 - DNA, 22 bp, Artificial Sequence
  chemically synthesized
tttaaatattgtatcctatgtg

SEQ ID NO: 1241511 - DNA, 22 bp, Artificial Sequence
  chemically synthesized
ctttaaatattgtatcctatgt

SEQ ID NO: 1241512 - DNA, 22 bp, Artificial Sequence
  chemically synthesized
acagaagatcttctttaaatat

SEQ ID NO: 1241513 - DNA, 22 bp, Artificial Sequence
  chemically synthesized
gacagaagatcttctttaaata

SEQ ID NO: 1241514 - DNA, 22 bp, Artificial Sequence
  chemically synthesized
tgacagaagatcttctttaaat

SEQ ID NO: 1241515 - DNA, 22 bp, Artificial Sequence
  chemically synthesized
ttgacagaagatcttctttaaa

SEQ ID NO: 1241516 - DNA, 22 bp, Artificial Sequence
  chemically synthesized
tgacttttgacagaagatcttc

SEQ ID NO: 1241517 - DNA, 22 bp, Artificial Sequence
  chemically synthesized
tgtgacttttgacagaagatct

SEQ ID NO: 1241518 - DNA, 22 bp, Artificial Sequence
  chemically synthesized
tcctctgtgacttttgacagaa

SEQ ID NO: 1241519 - DNA, 22 bp, Artificial Sequence
  chemically synthesized
atcctctgtgacttttgacaga

SEQ ID NO: 1241520 - DNA, 22 bp, Artificial Sequence
  chemically synthesized
aaagaagatcttctgtcaaaag

SEQ ID NO: 1241521 - DNA, 22 bp, Artificial Sequence
  chemically synthesized
tatcctctgtgacttttgacag

SEQ ID NO: 1241522 - DNA, 22 bp, Artificial Sequence
  chemically synthesized
aagaagatcttctgtcaaaagt

SEQ ID NO: 1241523 - DNA, 22 bp, Artificial Sequence
  chemically synthesized
aatattttatcctctgtgactt

SEQ ID NO: 1241524 - DNA, 22 bp, Artificial Sequence
  chemically synthesized
aaatattttatcctctgtgact

SEQ ID NO: 1241525 - DNA, 22 bp, Artificial Sequence
  chemically synthesized
taaatattttatcctctgtgac

SEQ ID NO: 1241526 - DNA, 22 bp, Artificial Sequence
  chemically synthesized
ctgtcaaaagtcacagaggata

SEQ ID NO: 1241527 - DNA, 22 bp, Artificial Sequence
  chemically synthesized
ctttaaatattttatcctctgt

SEQ ID NO: 1241528 - DNA, 22 bp, Artificial Sequence
  chemically synthesized
tgtcaaaagtcacagaggataa

SEQ ID NO: 1241529 - DNA, 22 bp, Artificial Sequence
  chemically synthesized
tcctttaaatattttatcctct

SEQ ID NO: 1241530 - DNA, 22 bp, Artificial Sequence
  chemically synthesized
tcaaaagtcacagaggataaaa

SEQ ID NO: 1241531 - DNA, 22 bp, Artificial Sequence
  chemically synthesized
aaaggagaacgtctgtcactgc

SEQ ID NO: 1241532 - DNA, 22 bp, Artificial Sequence
  chemically synthesized
aaggagaacgtctgtcactgct

SEQ ID NO: 1241533 - DNA, 22 bp, Artificial Sequence
  chemically synthesized
aaaggaaataaagcatagcagt

SEQ ID NO: 1241534 - DNA, 22 bp, Artificial Sequence
  chemically synthesized
gaccactaaaaggaaataaagc

SEQ ID NO: 1241535 - DNA, 22 bp, Artificial Sequence
  chemically synthesized
tcactgctatgctttatttcct

SEQ ID NO: 1241536 - DNA, 22 bp, Artificial Sequence
  chemically synthesized
ctatgctttatttccttttagt

SEQ ID NO: 1241537 - DNA, 22 bp, Artificial Sequence
  chemically synthesized
cataaagttggaccactaaaag

SEQ ID NO: 1241538 - DNA, 22 bp, Artificial Sequence
  chemically synthesized
tgctttatttccttttagtggt

SEQ ID NO: 1241539 - DNA, 22 bp, Artificial Sequence
  chemically synthesized
tatttccttttagtggtccaac

SEQ ID NO: 1241540 - DNA, 22 bp, Artificial Sequence
  chemically synthesized
atttccttttagtggtccaact

SEQ ID NO: 1241541 - DNA, 22 bp, Artificial Sequence
  chemically synthesized
gaaattgcataaagttggacca

SEQ ID NO: 1241542 - DNA, 22 bp, Artificial Sequence
  chemically synthesized
tttccttttagtggtccaactt

SEQ ID NO: 1241543 - DNA, 22 bp, Artificial Sequence
  chemically synthesized
ccttttagtggtccaactttat

SEQ ID NO: 1241544 - DNA, 22 bp, Artificial Sequence
  chemically synthesized
cttttagtggtccaactttatg

SEQ ID NO: 1241545 - DNA, 22 bp, Artificial Sequence
  chemically synthesized
agaattggaaattgcataaagt

SEQ ID NO: 1241546 - DNA, 22 bp, Artificial Sequence
  chemically synthesized
ttagtggtccaactttatgcaa

SEQ ID NO: 1241547 - DNA, 22 bp, Artificial Sequence
  chemically synthesized
cagaattggaaattgcataaag

SEQ ID NO: 1241548 - DNA, 22 bp, Artificial Sequence
  chemically synthesized
tagtggtccaactttatgcaat

SEQ ID NO: 1241549 - DNA, 22 bp, Artificial Sequence
  chemically synthesized
agtggtccaactttatgcaatt

SEQ ID NO: 1241550 - DNA, 22 bp, Artificial Sequence
  chemically synthesized
gtggtccaactttatgcaattt

SEQ ID NO: 1241551 - DNA, 22 bp, Artificial Sequence
  chemically synthesized
acttcagaattggaaattgcat

SEQ ID NO: 1241552 - DNA, 22 bp, Artificial Sequence
  chemically synthesized
gacttcagaattggaaattgca

SEQ ID NO: 1241553 - DNA, 22 bp, Artificial Sequence
  chemically synthesized
acaatatttgacttcagaattg

SEQ ID NO: 1241554 - DNA, 22 bp, Artificial Sequence
  chemically synthesized
tatgcaatttccaattctgaag

SEQ ID NO: 1241555 - DNA, 22 bp, Artificial Sequence
  chemically synthesized
gacaatatttgacttcagaatt

SEQ ID NO: 1241556 - DNA, 22 bp, Artificial Sequence
  chemically synthesized
atgcaatttccaattctgaagt

SEQ ID NO: 1241557 - DNA, 22 bp, Artificial Sequence
  chemically synthesized
tgcaatttccaattctgaagtc

SEQ ID NO: 1241558 - DNA, 22 bp, Artificial Sequence
  chemically synthesized
taatatttgacaatatttgact

SEQ ID NO: 1241559 - DNA, 22 bp, Artificial Sequence
  chemically synthesized
ccaattctgaagtcaaatattg

SEQ ID NO: 1241560 - DNA, 22 bp, Artificial Sequence
  chemically synthesized
caattctgaagtcaaatattgt

SEQ ID NO: 1241561 - DNA, 22 bp, Artificial Sequence
  chemically synthesized
tgaagtcaaatattgtcaaata

SEQ ID NO: 1241562 - DNA, 22 bp, Artificial Sequence
  chemically synthesized
aagtcaaatattgtcaaatatt

SEQ ID NO: 1241563 - DNA, 22 bp, Artificial Sequence
  chemically synthesized
tcaaatattacaatttttatat

SEQ ID NO: 1241564 - DNA, 22 bp, Artificial Sequence
  chemically synthesized
atacatgaggtagagtcatata

SEQ ID NO: 1241565 - DNA, 22 bp, Artificial Sequence
  chemically synthesized
tgatacatgaggtagagtcata

SEQ ID NO: 1241566 - DNA, 22 bp, Artificial Sequence
  chemically synthesized
ctgatacatgaggtagagtcat

SEQ ID NO: 1241567 - DNA, 22 bp, Artificial Sequence
  chemically synthesized
tctgatacatgaggtagagtca

SEQ ID NO: 1241568 - DNA, 22 bp, Artificial Sequence
  chemically synthesized
caatttttatatgactctacct

SEQ ID NO: 1241569 - DNA, 22 bp, Artificial Sequence
  chemically synthesized
ttatatgactctacctcatgta

SEQ ID NO: 1241570 - DNA, 22 bp, Artificial Sequence
  chemically synthesized
gcatctttctgatacatgaggt

SEQ ID NO: 1241571 - DNA, 22 bp, Artificial Sequence
  chemically synthesized
tatatgactctacctcatgtat

SEQ ID NO: 1241572 - DNA, 22 bp, Artificial Sequence
  chemically synthesized
atatgactctacctcatgtatc

SEQ ID NO: 1241573 - DNA, 22 bp, Artificial Sequence
  chemically synthesized
tatgactctacctcatgtatca

SEQ ID NO: 1241574 - DNA, 22 bp, Artificial Sequence
  chemically synthesized
tacctcatgtatcagaaagatg

SEQ ID NO: 1241575 - DNA, 22 bp, Artificial Sequence
  chemically synthesized
cctcatgtatcagaaagatgcg

SEQ ID NO: 1241576 - DNA, 22 bp, Artificial Sequence
  chemically synthesized
atgtatcagaaagatgcgagtt

SEQ ID NO: 1241577 - DNA, 22 bp, Artificial Sequence
  chemically synthesized
acataaaccagtcgatgtgtgt

SEQ ID NO: 1241578 - DNA, 22 bp, Artificial Sequence
  chemically synthesized
cacacatcgactggtttatgtc

SEQ ID NO: 1241579 - DNA, 22 bp, Artificial Sequence
  chemically synthesized
gtttatgtcagcgctacttctg

SEQ ID NO: 1241580 - DNA, 22 bp, Artificial Sequence
  chemically synthesized
atgtcagcgctacttctgtgta

SEQ ID NO: 1241581 - DNA, 22 bp, Artificial Sequence
  chemically synthesized
tgtcagcgctacttctgtgtac

SEQ ID NO: 1241582 - DNA, 22 bp, Artificial Sequence
  chemically synthesized
aaacaacccacaaaaagtacac

SEQ ID NO: 1241583 - DNA, 22 bp, Artificial Sequence
  chemically synthesized
cttctgtgtactttttgtgggt

SEQ ID NO: 1241584 - DNA, 22 bp, Artificial Sequence
  chemically synthesized
tgaacattaaaacaacccacaa

SEQ ID NO: 1241585 - DNA, 22 bp, Artificial Sequence
  chemically synthesized
ctgtgtactttttgtgggttgt

SEQ ID NO: 1241586 - DNA, 22 bp, Artificial Sequence
  chemically synthesized
tgtgtactttttgtgggttgtt

SEQ ID NO: 1241587 - DNA, 22 bp, Artificial Sequence
  chemically synthesized
tgtactttttgtgggttgtttt

SEQ ID NO: 1241588 - DNA, 22 bp, Artificial Sequence
  chemically synthesized
tttgtgggttgttttaatgttc

SEQ ID NO: 1241589 - DNA, 22 bp, Artificial Sequence
  chemically synthesized
ttgtgggttgttttaatgttca

SEQ ID NO: 1241590 - DNA, 22 bp, Artificial Sequence
  chemically synthesized
tgtgggttgttttaatgttcac

SEQ ID NO: 1241591 - DNA, 22 bp, Artificial Sequence
  chemically synthesized
gtgggttgttttaatgttcaca

SEQ ID NO: 1241592 - DNA, 22 bp, Artificial Sequence
  chemically synthesized
tgggttgttttaatgttcacag

SEQ ID NO: 1241593 - DNA, 22 bp, Artificial Sequence
  chemically synthesized
taaaatgggggtgactgtgaac

SEQ ID NO: 1241594 - DNA, 22 bp, Artificial Sequence
  chemically synthesized
ttttaatgttcacagtcacccc

SEQ ID NO: 1241595 - DNA, 22 bp, Artificial Sequence
  chemically synthesized
taatgttcacagtcacccccat

SEQ ID NO: 1241596 - DNA, 22 bp, Artificial Sequence
  chemically synthesized
atcagttgtaaaatgggggtga

SEQ ID NO: 1241597 - DNA, 22 bp, Artificial Sequence
  chemically synthesized
aatgttcacagtcacccccatt

SEQ ID NO: 1241598 - DNA, 22 bp, Artificial Sequence
  chemically synthesized
catcagttgtaaaatgggggtg

SEQ ID NO: 1241599 - DNA, 22 bp, Artificial Sequence
  chemically synthesized
atgttcacagtcacccccattt

SEQ ID NO: 1241600 - DNA, 22 bp, Artificial Sequence
  chemically synthesized
tttcatcagttgtaaaatgggg

SEQ ID NO: 1241601 - DNA, 22 bp, Artificial Sequence
  chemically synthesized
acagtcacccccattttacaac

SEQ ID NO: 1241602 - DNA, 22 bp, Artificial Sequence
  chemically synthesized
tgtctgtttcatcagttgtaaa

SEQ ID NO: 1241603 - DNA, 22 bp, Artificial Sequence
  chemically synthesized
tattgtgtctgtttcatcagtt

SEQ ID NO: 1241604 - DNA, 22 bp, Artificial Sequence
  chemically synthesized
atattgtgtctgtttcatcagt

SEQ ID NO: 1241605 - DNA, 22 bp, Artificial Sequence
  chemically synthesized
cttatattgtgtctgtttcatc

SEQ ID NO: 1241606 - DNA, 22 bp, Artificial Sequence
  chemically synthesized
tacaactgatgaaacagacaca

SEQ ID NO: 1241607 - DNA, 22 bp, Artificial Sequence
  chemically synthesized
acaactgatgaaacagacacaa

SEQ ID NO: 1241608 - DNA, 22 bp, Artificial Sequence
  chemically synthesized
aagttacttatattgtgtctgt

SEQ ID NO: 1241609 - DNA, 22 bp, Artificial Sequence
  chemically synthesized
caactgatgaaacagacacaat

SEQ ID NO: 1241610 - DNA, 22 bp, Artificial Sequence
  chemically synthesized
ttcaagttacttatattgtgtc

SEQ ID NO: 1241611 - DNA, 22 bp, Artificial Sequence
  chemically synthesized
attcaagttacttatattgtgt

SEQ ID NO: 1241612 - DNA, 22 bp, Artificial Sequence
  chemically synthesized
atgaaacagacacaatataagt

SEQ ID NO: 1241613 - DNA, 22 bp, Artificial Sequence
  chemically synthesized
tgtgaccttattcaagttactt

SEQ ID NO: 1241614 - DNA, 22 bp, Artificial Sequence
  chemically synthesized
ctgtgtgaccttattcaagtta

SEQ ID NO: 1241615 - DNA, 22 bp, Artificial Sequence
  chemically synthesized
gctgtgtgaccttattcaagtt

SEQ ID NO: 1241616 - DNA, 22 bp, Artificial Sequence
  chemically synthesized
cttgctgtgtgaccttattcaa

SEQ ID NO: 1241617 - DNA, 22 bp, Artificial Sequence
  chemically synthesized
acttgctgtgtgaccttattca

SEQ ID NO: 1241618 - DNA, 22 bp, Artificial Sequence
  chemically synthesized
gcacttacttgctgtgtgacct

SEQ ID NO: 1241619 - DNA, 22 bp, Artificial Sequence
  chemically synthesized
gaataaggtcacacagcaagta

SEQ ID NO: 1241620 - DNA, 22 bp, Artificial Sequence
  chemically synthesized
gtatctagcacttacttgctgt

SEQ ID NO: 1241621 - DNA, 22 bp, Artificial Sequence
  chemically synthesized
aataaggtcacacagcaagtaa

SEQ ID NO: 1241622 - DNA, 22 bp, Artificial Sequence
  chemically synthesized
agtccaaattagtatctagcac

SEQ ID NO: 1241623 - DNA, 22 bp, Artificial Sequence
  chemically synthesized
cctaagtccaaattagtatcta

SEQ ID NO: 1241624 - DNA, 22 bp, Artificial Sequence
  chemically synthesized
tagatacactgcctaagtccaa

SEQ ID NO: 1241625 - DNA, 22 bp, Artificial Sequence
  chemically synthesized
gatactaatttggacttaggca

SEQ ID NO: 1241626 - DNA, 22 bp, Artificial Sequence
  chemically synthesized
atttggacttaggcagtgtatc

SEQ ID NO: 1241627 - DNA, 22 bp, Artificial Sequence
  chemically synthesized
ggacttaggcagtgtatctaca

SEQ ID NO: 1241628 - DNA, 22 bp, Artificial Sequence
  chemically synthesized
gacttaggcagtgtatctacag

SEQ ID NO: 1241629 - DNA, 22 bp, Artificial Sequence
  chemically synthesized
aggcagtgtatctacagatctc

SEQ ID NO: 1241630 - DNA, 22 bp, Artificial Sequence
  chemically synthesized
ggcagtgtatctacagatctct

SEQ ID NO: 1241631 - DNA, 22 bp, Artificial Sequence
  chemically synthesized
caaagtaaagaatggtgtagag

SEQ ID NO: 1241632 - DNA, 22 bp, Artificial Sequence
  chemically synthesized
cagatctctacaccattcttta

SEQ ID NO: 1241633 - DNA, 22 bp, Artificial Sequence
  chemically synthesized
aacagcagttgcaaagtaaaga

SEQ ID NO: 1241634 - DNA, 22 bp, Artificial Sequence
  chemically synthesized
aaacagcagttgcaaagtaaag

SEQ ID NO: 1241635 - DNA, 22 bp, Artificial Sequence
  chemically synthesized
tacaccattctttactttgcaa

SEQ ID NO: 1241636 - DNA, 22 bp, Artificial Sequence
  chemically synthesized
caccattctttactttgcaact

SEQ ID NO: 1241637 - DNA, 22 bp, Artificial Sequence
  chemically synthesized
tttactttgcaactgctgttta

SEQ ID NO: 1241638 - DNA, 22 bp, Artificial Sequence
  chemically synthesized
tactttgcaactgctgtttaag

SEQ ID NO: 1241639 - DNA, 22 bp, Artificial Sequence
  chemically synthesized
actttgcaactgctgtttaagc

SEQ ID NO: 1241640 - DNA, 22 bp, Artificial Sequence
  chemically synthesized
ctttgcaactgctgtttaagct

SEQ ID NO: 1241641 - DNA, 22 bp, Artificial Sequence
  chemically synthesized
tgcaactgctgtttaagctggg

SEQ ID NO: 1241642 - DNA, 22 bp, Artificial Sequence
  chemically synthesized
gcaactgctgtttaagctgggc

SEQ ID NO: 1241643 - DNA, 22 bp, Artificial Sequence
  chemically synthesized
caactgctgtttaagctgggct

SEQ ID NO: 1241644 - DNA, 22 bp, Artificial Sequence
  chemically synthesized
aatgtgatgatagtcaagccca

SEQ ID NO: 1241645 - DNA, 22 bp, Artificial Sequence
  chemically synthesized
ctgtttaagctgggcttgacta

SEQ ID NO: 1241646 - DNA, 22 bp, Artificial Sequence
  chemically synthesized
tttaagctgggcttgactatca

SEQ ID NO: 1241647 - DNA, 22 bp, Artificial Sequence
  chemically synthesized
cccctgaatgtgatgatagtca

SEQ ID NO: 1241648 - DNA, 22 bp, Artificial Sequence
  chemically synthesized
gcccctgaatgtgatgatagtc

SEQ ID NO: 1241649 - DNA, 22 bp, Artificial Sequence
  chemically synthesized
aagctgggcttgactatcatca

SEQ ID NO: 1241650 - DNA, 22 bp, Artificial Sequence
  chemically synthesized
agctgggcttgactatcatcac

SEQ ID NO: 1241651 - DNA, 22 bp, Artificial Sequence
  chemically synthesized
acccttgcccctgaatgtgatg

SEQ ID NO: 1241652 - DNA, 22 bp, Artificial Sequence
  chemically synthesized
ggcttgactatcatcacattca

SEQ ID NO: 1241653 - DNA, 22 bp, Artificial Sequence
  chemically synthesized
acctaacccttgcccctgaatg

SEQ ID NO: 1241654 - DNA, 22 bp, Artificial Sequence
  chemically synthesized
gactatcatcacattcaggggc

SEQ ID NO: 1241655 - DNA, 22 bp, Artificial Sequence
  chemically synthesized
actatcatcacattcaggggca

SEQ ID NO: 1241656 - DNA, 22 bp, Artificial Sequence
  chemically synthesized
tcatcacattcaggggcaaggg

SEQ ID NO: 1241657 - DNA, 22 bp, Artificial Sequence
  chemically synthesized
aagtaaaactcacctaaccctt

SEQ ID NO: 1241658 - DNA, 22 bp, Artificial Sequence
  chemically synthesized
aggggcaagggttaggtgagtt

SEQ ID NO: 1241659 - DNA, 22 bp, Artificial Sequence
  chemically synthesized
ggtgagttttacttgagccttt

SEQ ID NO: 1241660 - DNA, 22 bp, Artificial Sequence
  chemically synthesized
tagaaaagatgacgtaaaggct

SEQ ID NO: 1241661 - DNA, 22 bp, Artificial Sequence
  chemically synthesized
gtagaaaagatgacgtaaaggc

SEQ ID NO: 1241662 - DNA, 22 bp, Artificial Sequence
  chemically synthesized
tgtagaaaagatgacgtaaagg

SEQ ID NO: 1241663 - DNA, 22 bp, Artificial Sequence
  chemically synthesized
tacttgagcctttacgtcatct

SEQ ID NO: 1241664 - DNA, 22 bp, Artificial Sequence
  chemically synthesized
tctttgtagaaaagatgacgta

SEQ ID NO: 1241665 - DNA, 22 bp, Artificial Sequence
  chemically synthesized
acttgagcctttacgtcatctt

SEQ ID NO: 1241666 - DNA, 22 bp, Artificial Sequence
  chemically synthesized
cttgagcctttacgtcatcttt

SEQ ID NO: 1241667 - DNA, 22 bp, Artificial Sequence
  chemically synthesized
gagcctttacgtcatcttttct

SEQ ID NO: 1241668 - DNA, 22 bp, Artificial Sequence
  chemically synthesized
aactatctttgtagaaaagatg

SEQ ID NO: 1241669 - DNA, 22 bp, Artificial Sequence
  chemically synthesized
agcctttacgtcatcttttcta

SEQ ID NO: 1241670 - DNA, 22 bp, Artificial Sequence
  chemically synthesized
tacgtcatcttttctacaaaga

SEQ ID NO: 1241671 - DNA, 22 bp, Artificial Sequence
  chemically synthesized
acgtcatcttttctacaaagat

SEQ ID NO: 1241672 - DNA, 22 bp, Artificial Sequence
  chemically synthesized
cgtcatcttttctacaaagata

SEQ ID NO: 1241673 - DNA, 22 bp, Artificial Sequence
  chemically synthesized
ttctacaaagatagtttaatat

SEQ ID NO: 1241674 - DNA, 22 bp, Artificial Sequence
  chemically synthesized
tctacaaagatagtttaatata

SEQ ID NO: 1241675 - DNA, 22 bp, Artificial Sequence
  chemically synthesized
ctacaaagatagtttaatatat

SEQ ID NO: 1241676 - DNA, 22 bp, Artificial Sequence
  chemically synthesized
tacaaagatagtttaatatatc

SEQ ID NO: 1241677 - DNA, 22 bp, Artificial Sequence
  chemically synthesized
caaagatagtttaatatatctt

SEQ ID NO: 1241678 - DNA, 22 bp, Artificial Sequence
  chemically synthesized
gaaatgatagaagaaagaaaag

SEQ ID NO: 1241679 - DNA, 22 bp, Artificial Sequence
  chemically synthesized
ggaaatgatagaagaaagaaaa

SEQ ID NO: 1241680 - DNA, 22 bp, Artificial Sequence
  chemically synthesized
tggaaatgatagaagaaagaaa

SEQ ID NO: 1241681 - DNA, 22 bp, Artificial Sequence
  chemically synthesized
ttggaaatgatagaagaaagaa

SEQ ID NO: 1241682 - DNA, 22 bp, Artificial Sequence
  chemically synthesized
aatatatcttttctttcttcta

SEQ ID NO: 1241683 - DNA, 22 bp, Artificial Sequence
  chemically synthesized
atatatcttttctttcttctat

SEQ ID NO: 1241684 - DNA, 22 bp, Artificial Sequence
  chemically synthesized
accttttggaaatgatagaaga

SEQ ID NO: 1241685 - DNA, 22 bp, Artificial Sequence
  chemically synthesized
tatctgaccttttggaaatgat

SEQ ID NO: 1241686 - DNA, 22 bp, Artificial Sequence
  chemically synthesized
ttctttcttctatcatttccaa

SEQ ID NO: 1241687 - DNA, 22 bp, Artificial Sequence
  chemically synthesized
tctttcttctatcatttccaaa

SEQ ID NO: 1241688 - DNA, 22 bp, Artificial Sequence
  chemically synthesized
ctttcttctatcatttccaaaa

SEQ ID NO: 1241689 - DNA, 22 bp, Artificial Sequence
  chemically synthesized
tttcttctatcatttccaaaag

SEQ ID NO: 1241690 - DNA, 22 bp, Artificial Sequence
  chemically synthesized
tcttctatcatttccaaaaggt

SEQ ID NO: 1241691 - DNA, 22 bp, Artificial Sequence
  chemically synthesized
cttctatcatttccaaaaggtc

SEQ ID NO: 1241692 - DNA, 22 bp, Artificial Sequence
  chemically synthesized
ttctatcatttccaaaaggtca

SEQ ID NO: 1241693 - DNA, 22 bp, Artificial Sequence
  chemically synthesized
tataactgtatctgaccttttg

SEQ ID NO: 1241694 - DNA, 22 bp, Artificial Sequence
  chemically synthesized
ctatcatttccaaaaggtcaga

SEQ ID NO: 1241695 - DNA, 22 bp, Artificial Sequence
  chemically synthesized
tatcatttccaaaaggtcagat

SEQ ID NO: 1241696 - DNA, 22 bp, Artificial Sequence
  chemically synthesized
tcatttccaaaaggtcagatac

SEQ ID NO: 1241697 - DNA, 22 bp, Artificial Sequence
  chemically synthesized
gcaggctatataactgtatctg

SEQ ID NO: 1241698 - DNA, 22 bp, Artificial Sequence
  chemically synthesized
ccaaaaggtcagatacagttat

SEQ ID NO: 1241699 - DNA, 22 bp, Artificial Sequence
  chemically synthesized
ttggcaggctatataactgtat

SEQ ID NO: 1241700 - DNA, 22 bp, Artificial Sequence
  chemically synthesized
caaaaggtcagatacagttata

SEQ ID NO: 1241701 - DNA, 22 bp, Artificial Sequence
  chemically synthesized
attggcaggctatataactgta

SEQ ID NO: 1241702 - DNA, 22 bp, Artificial Sequence
  chemically synthesized
tattggcaggctatataactgt

SEQ ID NO: 1241703 - DNA, 22 bp, Artificial Sequence
  chemically synthesized
ggagcaattttattggcaggct

SEQ ID NO: 1241704 - DNA, 22 bp, Artificial Sequence
  chemically synthesized
caattaggagcaattttattgg

SEQ ID NO: 1241705 - DNA, 22 bp, Artificial Sequence
  chemically synthesized
tatagcctgccaataaaattgc

SEQ ID NO: 1241706 - DNA, 22 bp, Artificial Sequence
  chemically synthesized
ccaataaaattgctcctaattg

SEQ ID NO: 1241707 - DNA, 22 bp, Artificial Sequence
  chemically synthesized
caaatgggacctacaattagga

SEQ ID NO: 1241708 - DNA, 22 bp, Artificial Sequence
  chemically synthesized
cattacaaatgggacctacaat

SEQ ID NO: 1241709 - DNA, 22 bp, Artificial Sequence
  chemically synthesized
ccattacaaatgggacctacaa

SEQ ID NO: 1241710 - DNA, 22 bp, Artificial Sequence
  chemically synthesized
tccattacaaatgggacctaca

SEQ ID NO: 1241711 - DNA, 22 bp, Artificial Sequence
  chemically synthesized
ctcctaattgtaggtcccattt

SEQ ID NO: 1241712 - DNA, 22 bp, Artificial Sequence
  chemically synthesized
tctttccattacaaatgggacc

SEQ ID NO: 1241713 - DNA, 22 bp, Artificial Sequence
  chemically synthesized
ctaattgtaggtcccatttgta

SEQ ID NO: 1241714 - DNA, 22 bp, Artificial Sequence
  chemically synthesized
ctatctttccattacaaatggg

SEQ ID NO: 1241715 - DNA, 22 bp, Artificial Sequence
  chemically synthesized
attgtaggtcccatttgtaatg

SEQ ID NO: 1241716 - DNA, 22 bp, Artificial Sequence
  chemically synthesized
ttactatctttccattacaaat

SEQ ID NO: 1241717 - DNA, 22 bp, Artificial Sequence
  chemically synthesized
taggtcccatttgtaatggaaa

SEQ ID NO: 1241718 - DNA, 22 bp, Artificial Sequence
  chemically synthesized
tcactgttactatctttccatt

SEQ ID NO: 1241719 - DNA, 22 bp, Artificial Sequence
  chemically synthesized
gtaatggaaagatagtaacagt

SEQ ID NO: 1241720 - DNA, 22 bp, Artificial Sequence
  chemically synthesized
taatggaaagatagtaacagtg

SEQ ID NO: 1241721 - DNA, 22 bp, Artificial Sequence
  chemically synthesized
atgtatatatgtagaattatca

SEQ ID NO: 1241722 - DNA, 22 bp, Artificial Sequence
  chemically synthesized
ctaatgtatatatgtagaatta

SEQ ID NO: 1241723 - DNA, 22 bp, Artificial Sequence
  chemically synthesized
cctaatgtatatatgtagaatt

SEQ ID NO: 1241724 - DNA, 22 bp, Artificial Sequence
  chemically synthesized
tcctaatgtatatatgtagaat

SEQ ID NO: 1241725 - DNA, 22 bp, Artificial Sequence
  chemically synthesized
aagaattttcctaatgtatata

SEQ ID NO: 1241726 - DNA, 22 bp, Artificial Sequence
  chemically synthesized
gaagaattttcctaatgtatat

SEQ ID NO: 1241727 - DNA, 22 bp, Artificial Sequence
  chemically synthesized
tgaagaattttcctaatgtata

SEQ ID NO: 1241728 - DNA, 22 bp, Artificial Sequence
  chemically synthesized
tacatatatacattaggaaaat

SEQ ID NO: 1241729 - DNA, 22 bp, Artificial Sequence
  chemically synthesized
ggactttgaagaattttcctaa

SEQ ID NO: 1241730 - DNA, 22 bp, Artificial Sequence
  chemically synthesized
gggactttgaagaattttccta

SEQ ID NO: 1241731 - DNA, 22 bp, Artificial Sequence
  chemically synthesized
catatatacattaggaaaattc

SEQ ID NO: 1241732 - DNA, 22 bp, Artificial Sequence
  chemically synthesized
ggaaaattcttcaaagtcccaa

SEQ ID NO: 1241733 - DNA, 22 bp, Artificial Sequence
  chemically synthesized
ttcaaagtcccaaattcctatt

SEQ ID NO: 1241734 - DNA, 22 bp, Artificial Sequence
  chemically synthesized
caaagtcccaaattcctattgt

SEQ ID NO: 1241735 - DNA, 22 bp, Artificial Sequence
  chemically synthesized
aaagtcccaaattcctattgtt

SEQ ID NO: 1241736 - DNA, 22 bp, Artificial Sequence
  chemically synthesized
ctattgttatatcatttgacat

SEQ ID NO: 1241737 - DNA, 22 bp, Artificial Sequence
  chemically synthesized
atgaaacccccgatgtcaaatg

SEQ ID NO: 1241738 - DNA, 22 bp, Artificial Sequence
  chemically synthesized
ttgttatatcatttgacatcgg

SEQ ID NO: 1241739 - DNA, 22 bp, Artificial Sequence
  chemically synthesized
ttatatcatttgacatcggggg

SEQ ID NO: 1241740 - DNA, 22 bp, Artificial Sequence
  chemically synthesized
aggagttaatgaaacccccgat

SEQ ID NO: 1241741 - DNA, 22 bp, Artificial Sequence
  chemically synthesized
tatcatttgacatcgggggttt

SEQ ID NO: 1241742 - DNA, 22 bp, Artificial Sequence
  chemically synthesized
gagtcctgaggagttaatgaaa

SEQ ID NO: 1241743 - DNA, 22 bp, Artificial Sequence
  chemically synthesized
gacatcgggggtttcattaact

SEQ ID NO: 1241744 - DNA, 22 bp, Artificial Sequence
  chemically synthesized
acatcgggggtttcattaactc

SEQ ID NO: 1241745 - DNA, 22 bp, Artificial Sequence
  chemically synthesized
agcacactggagtcctgaggag

SEQ ID NO: 1241746 - DNA, 22 bp, Artificial Sequence
  chemically synthesized
ctgagcacactggagtcctgag

SEQ ID NO: 1241747 - DNA, 22 bp, Artificial Sequence
  chemically synthesized
cattaactcctcaggactccag

SEQ ID NO: 1241748 - DNA, 22 bp, Artificial Sequence
  chemically synthesized
attaactcctcaggactccagt

SEQ ID NO: 1241749 - DNA, 22 bp, Artificial Sequence
  chemically synthesized
agtctgctgagcacactggagt

SEQ ID NO: 1241750 - DNA, 22 bp, Artificial Sequence
  chemically synthesized
actcctcaggactccagtgtgc

SEQ ID NO: 1241751 - DNA, 22 bp, Artificial Sequence
  chemically synthesized
ctcaggactccagtgtgctcag

SEQ ID NO: 1241752 - DNA, 22 bp, Artificial Sequence
  chemically synthesized
gtaattgagtctgctgagcaca

SEQ ID NO: 1241753 - DNA, 22 bp, Artificial Sequence
  chemically synthesized
agtaattgagtctgctgagcac

SEQ ID NO: 1241754 - DNA, 22 bp, Artificial Sequence
  chemically synthesized
aggactccagtgtgctcagcag

SEQ ID NO: 1241755 - DNA, 22 bp, Artificial Sequence
  chemically synthesized
cagtgtgctcagcagactcaat

SEQ ID NO: 1241756 - DNA, 22 bp, Artificial Sequence
  chemically synthesized
aaatagtatttagtaattgagt

SEQ ID NO: 1241757 - DNA, 22 bp, Artificial Sequence
  chemically synthesized
taaaatagtatttagtaattga

SEQ ID NO: 1241758 - DNA, 22 bp, Artificial Sequence
  chemically synthesized
agcagactcaattactaaatac

SEQ ID NO: 1241759 - DNA, 22 bp, Artificial Sequence
  chemically synthesized
cagtgtgctctaaaatagtatt

SEQ ID NO: 1241760 - DNA, 22 bp, Artificial Sequence
  chemically synthesized
gcagtgtgctctaaaatagtat

SEQ ID NO: 1241761 - DNA, 22 bp, Artificial Sequence
  chemically synthesized
aattactaaatactattttaga

SEQ ID NO: 1241762 - DNA, 22 bp, Artificial Sequence
  chemically synthesized
ctaaatactattttagagcaca

SEQ ID NO: 1241763 - DNA, 22 bp, Artificial Sequence
  chemically synthesized
gaacaatttgcagtgtgctcta

SEQ ID NO: 1241764 - DNA, 22 bp, Artificial Sequence
  chemically synthesized
aatactattttagagcacactg

SEQ ID NO: 1241765 - DNA, 22 bp, Artificial Sequence
  chemically synthesized
tacattcgaacaatttgcagtg

SEQ ID NO: 1241766 - DNA, 22 bp, Artificial Sequence
  chemically synthesized
ttttagagcacactgcaaattg

SEQ ID NO: 1241767 - DNA, 22 bp, Artificial Sequence
  chemically synthesized
tagagcacactgcaaattgttc

SEQ ID NO: 1241768 - DNA, 22 bp, Artificial Sequence
  chemically synthesized
agagcacactgcaaattgttcg

SEQ ID NO: 1241769 - DNA, 22 bp, Artificial Sequence
  chemically synthesized
gagcacactgcaaattgttcga

SEQ ID NO: 1241770 - DNA, 22 bp, Artificial Sequence
  chemically synthesized
gagtgaattatacattcgaaca

SEQ ID NO: 1241771 - DNA, 22 bp, Artificial Sequence
  chemically synthesized
caaattgttcgaatgtataatt

SEQ ID NO: 1241772 - DNA, 22 bp, Artificial Sequence
  chemically synthesized
aaatacattagagtgaattata

SEQ ID NO: 1241773 - DNA, 22 bp, Artificial Sequence
  chemically synthesized
caaatacattagagtgaattat

SEQ ID NO: 1241774 - DNA, 22 bp, Artificial Sequence
  chemically synthesized
tcaaatacattagagtgaatta

SEQ ID NO: 1241775 - DNA, 22 bp, Artificial Sequence
  chemically synthesized
ttcaaatacattagagtgaatt

SEQ ID NO: 1241776 - DNA, 22 bp, Artificial Sequence
  chemically synthesized
ttcgaatgtataattcactcta

SEQ ID NO: 1241777 - DNA, 22 bp, Artificial Sequence
  chemically synthesized
gaatgtataattcactctaatg

SEQ ID NO: 1241778 - DNA, 22 bp, Artificial Sequence
  chemically synthesized
actctaatgtatttgaaaaatg

SEQ ID NO: 1241779 - DNA, 22 bp, Artificial Sequence
  chemically synthesized
atataaaaagccacatttttca

SEQ ID NO: 1241780 - DNA, 22 bp, Artificial Sequence
  chemically synthesized
taatgtatttgaaaaatgtggc

SEQ ID NO: 1241781 - DNA, 22 bp, Artificial Sequence
  chemically synthesized
gttaatataaaaagccacattt

SEQ ID NO: 1241782 - DNA, 22 bp, Artificial Sequence
  chemically synthesized
atgtatttgaaaaatgtggctt

SEQ ID NO: 1241783 - DNA, 22 bp, Artificial Sequence
  chemically synthesized
agttaatataaaaagccacatt

SEQ ID NO: 1241784 - DNA, 22 bp, Artificial Sequence
  chemically synthesized
tagttaatataaaaagccacat

SEQ ID NO: 1241785 - DNA, 22 bp, Artificial Sequence
  chemically synthesized
tttagttaatataaaaagccac

SEQ ID NO: 1241786 - DNA, 22 bp, Artificial Sequence
  chemically synthesized
ctttagttaatataaaaagcca

SEQ ID NO: 1241787 - DNA, 22 bp, Artificial Sequence
  chemically synthesized
ttctttagttaatataaaaagc

SEQ ID NO: 1241788 - DNA, 22 bp, Artificial Sequence
  chemically synthesized
cttctttagttaatataaaaag

SEQ ID NO: 1241789 - DNA, 22 bp, Artificial Sequence
  chemically synthesized
gaaaaatgtggctttttatatt

SEQ ID NO: 1241790 - DNA, 22 bp, Artificial Sequence
  chemically synthesized
aaaaatgtggctttttatatta

SEQ ID NO: 1241791 - DNA, 22 bp, Artificial Sequence
  chemically synthesized
aatgatatttcttctttagtta

SEQ ID NO: 1241792 - DNA, 22 bp, Artificial Sequence
  chemically synthesized
ttgaatgatatttcttctttag

SEQ ID NO: 1241793 - DNA, 22 bp, Artificial Sequence
  chemically synthesized
gttgaatgatatttcttcttta

SEQ ID NO: 1241794 - DNA, 22 bp, Artificial Sequence
  chemically synthesized
tttatattaactaaagaagaaa

SEQ ID NO: 1241795 - DNA, 22 bp, Artificial Sequence
  chemically synthesized
tgttgaatgatatttcttcttt

SEQ ID NO: 1241796 - DNA, 22 bp, Artificial Sequence
  chemically synthesized
ttatattaactaaagaagaaat

SEQ ID NO: 1241797 - DNA, 22 bp, Artificial Sequence
  chemically synthesized
ttgttgaatgatatttcttctt

SEQ ID NO: 1241798 - DNA, 22 bp, Artificial Sequence
  chemically synthesized
tatattaactaaagaagaaata

SEQ ID NO: 1241799 - DNA, 22 bp, Artificial Sequence
  chemically synthesized
atattaactaaagaagaaatat

SEQ ID NO: 1241800 - DNA, 22 bp, Artificial Sequence
  chemically synthesized
tattaactaaagaagaaatatc

SEQ ID NO: 1241801 - DNA, 22 bp, Artificial Sequence
  chemically synthesized
agtttttgttgaatgatatttc

SEQ ID NO: 1241802 - DNA, 22 bp, Artificial Sequence
  chemically synthesized
aagtttttgttgaatgatattt

SEQ ID NO: 1241803 - DNA, 22 bp, Artificial Sequence
  chemically synthesized
actaaagaagaaatatcattca

SEQ ID NO: 1241804 - DNA, 22 bp, Artificial Sequence
  chemically synthesized
aagaagaaatatcattcaacaa

SEQ ID NO: 1241805 - DNA, 22 bp, Artificial Sequence
  chemically synthesized
tatagccttaagtttttgttga

SEQ ID NO: 1241806 - DNA, 22 bp, Artificial Sequence
  chemically synthesized
atatagccttaagtttttgttg

SEQ ID NO: 1241807 - DNA, 22 bp, Artificial Sequence
  chemically synthesized
atttatatagccttaagttttt

SEQ ID NO: 1241808 - DNA, 22 bp, Artificial Sequence
  chemically synthesized
gatttatatagccttaagtttt

SEQ ID NO: 1241809 - DNA, 22 bp, Artificial Sequence
  chemically synthesized
tgatttatatagccttaagttt

SEQ ID NO: 1241810 - DNA, 22 bp, Artificial Sequence
  chemically synthesized
tattttgatttatatagcctta

SEQ ID NO: 1241811 - DNA, 22 bp, Artificial Sequence
  chemically synthesized
atattttgatttatatagcctt

SEQ ID NO: 1241812 - DNA, 22 bp, Artificial Sequence
  chemically synthesized
aacaaaaacttaaggctatata

SEQ ID NO: 1241813 - DNA, 22 bp, Artificial Sequence
  chemically synthesized
ttatattttgatttatatagcc

SEQ ID NO: 1241814 - DNA, 22 bp, Artificial Sequence
  chemically synthesized
cttatattttgatttatatagc

SEQ ID NO: 1241815 - DNA, 22 bp, Artificial Sequence
  chemically synthesized
tatttcttatattttgatttat

SEQ ID NO: 1241816 - DNA, 22 bp, Artificial Sequence
  chemically synthesized
aaggctatataaatcaaaatat

SEQ ID NO: 1241817 - DNA, 22 bp, Artificial Sequence
  chemically synthesized
aggctatataaatcaaaatata

SEQ ID NO: 1241818 - DNA, 22 bp, Artificial Sequence
  chemically synthesized
aaggattatatttcttatattt

SEQ ID NO: 1241819 - DNA, 22 bp, Artificial Sequence
  chemically synthesized
caaggattatatttcttatatt

SEQ ID NO: 1241820 - DNA, 22 bp, Artificial Sequence
  chemically synthesized
tataaatcaaaatataagaaat

SEQ ID NO: 1241821 - DNA, 22 bp, Artificial Sequence
  chemically synthesized
tcaacttcaaggattatatttc

SEQ ID NO: 1241822 - DNA, 22 bp, Artificial Sequence
  chemically synthesized
atcaacttcaaggattatattt

SEQ ID NO: 1241823 - DNA, 22 bp, Artificial Sequence
  chemically synthesized
atccttatcaacttcaaggatt

SEQ ID NO: 1241824 - DNA, 22 bp, Artificial Sequence
  chemically synthesized
aatccttatcaacttcaaggat

SEQ ID NO: 1241825 - DNA, 22 bp, Artificial Sequence
  chemically synthesized
atttaatccttatcaacttcaa

SEQ ID NO: 1241826 - DNA, 22 bp, Artificial Sequence
  chemically synthesized
cctcatttaatccttatcaact

SEQ ID NO: 1241827 - DNA, 22 bp, Artificial Sequence
  chemically synthesized
ctacctcatttaatccttatca

SEQ ID NO: 1241828 - DNA, 22 bp, Artificial Sequence
  chemically synthesized
ctactacctcatttaatcctta

SEQ ID NO: 1241829 - DNA, 22 bp, Artificial Sequence
  chemically synthesized
actactacctcatttaatcctt

SEQ ID NO: 1241830 - DNA, 22 bp, Artificial Sequence
  chemically synthesized
gaagttgataaggattaaatga

SEQ ID NO: 1241831 - DNA, 22 bp, Artificial Sequence
  chemically synthesized
tttactactacctcatttaatc

SEQ ID NO: 1241832 - DNA, 22 bp, Artificial Sequence
  chemically synthesized
aagttgataaggattaaatgag

SEQ ID NO: 1241833 - DNA, 22 bp, Artificial Sequence
  chemically synthesized
tgtttactactacctcatttaa

SEQ ID NO: 1241834 - DNA, 22 bp, Artificial Sequence
  chemically synthesized
ctgtttactactacctcattta

SEQ ID NO: 1241835 - DNA, 22 bp, Artificial Sequence
  chemically synthesized
ttctgtttactactacctcatt

SEQ ID NO: 1241836 - DNA, 22 bp, Artificial Sequence
  chemically synthesized
cttctgtttactactacctcat

SEQ ID NO: 1241837 - DNA, 22 bp, Artificial Sequence
  chemically synthesized
ataaggattaaatgaggtagta

SEQ ID NO: 1241838 - DNA, 22 bp, Artificial Sequence
  chemically synthesized
tcttctgtttactactacctca

SEQ ID NO: 1241839 - DNA, 22 bp, Artificial Sequence
  chemically synthesized
ttcttctgtttactactacctc

SEQ ID NO: 1241840 - DNA, 22 bp, Artificial Sequence
  chemically synthesized
tttcttctgtttactactacct

SEQ ID NO: 1241841 - DNA, 22 bp, Artificial Sequence
  chemically synthesized
aactttttcttctgtttactac

SEQ ID NO: 1241842 - DNA, 22 bp, Artificial Sequence
  chemically synthesized
aatgaggtagtagtaaacagaa

SEQ ID NO: 1241843 - DNA, 22 bp, Artificial Sequence
  chemically synthesized
gttaaactttttcttctgttta

SEQ ID NO: 1241844 - DNA, 22 bp, Artificial Sequence
  chemically synthesized
aatgccctagttaaactttttc

SEQ ID NO: 1241845 - DNA, 22 bp, Artificial Sequence
  chemically synthesized
cactaaatgccctagttaaact

SEQ ID NO: 1241846 - DNA, 22 bp, Artificial Sequence
  chemically synthesized
agaaatggctacactaaatgcc

SEQ ID NO: 1241847 - DNA, 22 bp, Artificial Sequence
  chemically synthesized
aagaaatggctacactaaatgc

SEQ ID NO: 1241848 - DNA, 22 bp, Artificial Sequence
  chemically synthesized
aactagggcatttagtgtagcc

SEQ ID NO: 1241849 - DNA, 22 bp, Artificial Sequence
  chemically synthesized
actagggcatttagtgtagcca

SEQ ID NO: 1241850 - DNA, 22 bp, Artificial Sequence
  chemically synthesized
gggcatttagtgtagccatttc

SEQ ID NO: 1241851 - DNA, 22 bp, Artificial Sequence
  chemically synthesized
agtggatcttaagaaatggcta

SEQ ID NO: 1241852 - DNA, 22 bp, Artificial Sequence
  chemically synthesized
cagtggatcttaagaaatggct

SEQ ID NO: 1241853 - DNA, 22 bp, Artificial Sequence
  chemically synthesized
tcagtggatcttaagaaatggc

SEQ ID NO: 1241854 - DNA, 22 bp, Artificial Sequence
  chemically synthesized
ttcagtggatcttaagaaatgg

SEQ ID NO: 1241855 - DNA, 22 bp, Artificial Sequence
  chemically synthesized
agtgtagccatttcttaagatc

SEQ ID NO: 1241856 - DNA, 22 bp, Artificial Sequence
  chemically synthesized
gtgtagccatttcttaagatcc

SEQ ID NO: 1241857 - DNA, 22 bp, Artificial Sequence
  chemically synthesized
gcacttttcagtggatcttaag

SEQ ID NO: 1241858 - DNA, 22 bp, Artificial Sequence
  chemically synthesized
cttaagatccactgaaaagtgc

SEQ ID NO: 1241859 - DNA, 22 bp, Artificial Sequence
  chemically synthesized
ttaagatccactgaaaagtgcc

SEQ ID NO: 1241860 - DNA, 22 bp, Artificial Sequence
  chemically synthesized
aagtaaggaactggcacttttc

SEQ ID NO: 1241861 - DNA, 22 bp, Artificial Sequence
  chemically synthesized
caagtaaggaactggcactttt

SEQ ID NO: 1241862 - DNA, 22 bp, Artificial Sequence
  chemically synthesized
aagatccactgaaaagtgccag

SEQ ID NO: 1241863 - DNA, 22 bp, Artificial Sequence
  chemically synthesized
tcaagtaaggaactggcacttt

SEQ ID NO: 1241864 - DNA, 22 bp, Artificial Sequence
  chemically synthesized
agatccactgaaaagtgccagt

SEQ ID NO: 1241865 - DNA, 22 bp, Artificial Sequence
  chemically synthesized
aaaagtgccagttccttacttg

SEQ ID NO: 1241866 - DNA, 22 bp, Artificial Sequence
  chemically synthesized
acatggaagactttcaagtaag

SEQ ID NO: 1241867 - DNA, 22 bp, Artificial Sequence
  chemically synthesized
caccgaatctcacatggaagac

SEQ ID NO: 1241868 - DNA, 22 bp, Artificial Sequence
  chemically synthesized
cttacttgaaagtcttccatgt

SEQ ID NO: 1241869 - DNA, 22 bp, Artificial Sequence
  chemically synthesized
acttgaaagtcttccatgtgag

SEQ ID NO: 1241870 - DNA, 22 bp, Artificial Sequence
  chemically synthesized
cttgaaagtcttccatgtgaga

SEQ ID NO: 1241871 - DNA, 22 bp, Artificial Sequence
  chemically synthesized
caactacaccgaatctcacatg

SEQ ID NO: 1241872 - DNA, 22 bp, Artificial Sequence
  chemically synthesized
acaactacaccgaatctcacat

SEQ ID NO: 1241873 - DNA, 22 bp, Artificial Sequence
  chemically synthesized
gaaagtcttccatgtgagattc

SEQ ID NO: 1241874 - DNA, 22 bp, Artificial Sequence
  chemically synthesized
aaagtcttccatgtgagattcg

SEQ ID NO: 1241875 - DNA, 22 bp, Artificial Sequence
  chemically synthesized
acttacaactacaccgaatctc

SEQ ID NO: 1241876 - DNA, 22 bp, Artificial Sequence
  chemically synthesized
aacttacaactacaccgaatct

SEQ ID NO: 1241877 - DNA, 22 bp, Artificial Sequence
  chemically synthesized
tttaacttacaactacaccgaa

SEQ ID NO: 1241878 - DNA, 22 bp, Artificial Sequence
  chemically synthesized
ccatgtgagattcggtgtagtt

SEQ ID NO: 1241879 - DNA, 22 bp, Artificial Sequence
  chemically synthesized
catgtgagattcggtgtagttg

SEQ ID NO: 1241880 - DNA, 22 bp, Artificial Sequence
  chemically synthesized
tattatttaacttacaactaca

SEQ ID NO: 1241881 - DNA, 22 bp, Artificial Sequence
  chemically synthesized
cagatactatattatttaactt

SEQ ID NO: 1241882 - DNA, 22 bp, Artificial Sequence
  chemically synthesized
ggtgtagttgtaagttaaataa

SEQ ID NO: 1241883 - DNA, 22 bp, Artificial Sequence
  chemically synthesized
ccagatactatattatttaact

SEQ ID NO: 1241884 - DNA, 22 bp, Artificial Sequence
  chemically synthesized
cttccagatactatattattta

SEQ ID NO: 1241885 - DNA, 22 bp, Artificial Sequence
  chemically synthesized
gcttccagatactatattattt

SEQ ID NO: 1241886 - DNA, 22 bp, Artificial Sequence
  chemically synthesized
tttgcttccagatactatatta

SEQ ID NO: 1241887 - DNA, 22 bp, Artificial Sequence
  chemically synthesized
taagttaaataatatagtatct

SEQ ID NO: 1241888 - DNA, 22 bp, Artificial Sequence
  chemically synthesized
aataatatagtatctggaagca

SEQ ID NO: 1241889 - DNA, 22 bp, Artificial Sequence
  chemically synthesized
taataaataaaggcctatttgc

SEQ ID NO: 1241890 - DNA, 22 bp, Artificial Sequence
  chemically synthesized
tagaactgtaataaataaaggc

SEQ ID NO: 1241891 - DNA, 22 bp, Artificial Sequence
  chemically synthesized
gaagcaaataggcctttattta

SEQ ID NO: 1241892 - DNA, 22 bp, Artificial Sequence
  chemically synthesized
aattatagaactgtaataaata

SEQ ID NO: 1241893 - DNA, 22 bp, Artificial Sequence
  chemically synthesized
aaattatagaactgtaataaat

SEQ ID NO: 1241894 - DNA, 22 bp, Artificial Sequence
  chemically synthesized
gcaaaatttaaattatagaact

SEQ ID NO: 1241895 - DNA, 22 bp, Artificial Sequence
  chemically synthesized
tatttattacagttctataatt

SEQ ID NO: 1241896 - DNA, 22 bp, Artificial Sequence
  chemically synthesized
atttattacagttctataattt

SEQ ID NO: 1241897 - DNA, 22 bp, Artificial Sequence
  chemically synthesized
tttattacagttctataattta

SEQ ID NO: 1241898 - DNA, 22 bp, Artificial Sequence
  chemically synthesized
attacagttctataatttaaat

SEQ ID NO: 1241899 - DNA, 22 bp, Artificial Sequence
  chemically synthesized
ttacagttctataatttaaatt

SEQ ID NO: 1241900 - DNA, 22 bp, Artificial Sequence
  chemically synthesized
acacaactggcaaaatttaaat

SEQ ID NO: 1241901 - DNA, 22 bp, Artificial Sequence
  chemically synthesized
cagttctataatttaaattttg

SEQ ID NO: 1241902 - DNA, 22 bp, Artificial Sequence
  chemically synthesized
tataatttaaattttgccagtt

SEQ ID NO: 1241903 - DNA, 22 bp, Artificial Sequence
  chemically synthesized
tcagtgttcacacaactggcaa

SEQ ID NO: 1241904 - DNA, 22 bp, Artificial Sequence
  chemically synthesized
taatttaaattttgccagttgt

SEQ ID NO: 1241905 - DNA, 22 bp, Artificial Sequence
  chemically synthesized
atcagtgttcacacaactggca

SEQ ID NO: 1241906 - DNA, 22 bp, Artificial Sequence
  chemically synthesized
aaattttgccagttgtgtgaac

SEQ ID NO: 1241907 - DNA, 22 bp, Artificial Sequence
  chemically synthesized
aattttgccagttgtgtgaaca

SEQ ID NO: 1241908 - DNA, 22 bp, Artificial Sequence
  chemically synthesized
tgtaatttatcagtgttcacac

SEQ ID NO: 1241909 - DNA, 22 bp, Artificial Sequence
  chemically synthesized
tgccagttgtgtgaacactgat

SEQ ID NO: 1241910 - DNA, 22 bp, Artificial Sequence
  chemically synthesized
gccagttgtgtgaacactgata

SEQ ID NO: 1241911 - DNA, 22 bp, Artificial Sequence
  chemically synthesized
ccagttgtgtgaacactgataa

SEQ ID NO: 1241912 - DNA, 22 bp, Artificial Sequence
  chemically synthesized
tgtgaacactgataaattacat

SEQ ID NO: 1241913 - DNA, 22 bp, Artificial Sequence
  chemically synthesized
ataaattacatagcacttggct

SEQ ID NO: 1241914 - DNA, 22 bp, Artificial Sequence
  chemically synthesized
acacataaggaaaataagccaa

SEQ ID NO: 1241915 - DNA, 22 bp, Artificial Sequence
  chemically synthesized
catagcacttggcttattttcc

SEQ ID NO: 1241916 - DNA, 22 bp, Artificial Sequence
  chemically synthesized
gtctgacacataaggaaaataa

SEQ ID NO: 1241917 - DNA, 22 bp, Artificial Sequence
  chemically synthesized
tccccctcgtctgacacataag

SEQ ID NO: 1241918 - DNA, 22 bp, Artificial Sequence
  chemically synthesized
ggcttattttccttatgtgtca

SEQ ID NO: 1241919 - DNA, 22 bp, Artificial Sequence
  chemically synthesized
gcttattttccttatgtgtcag

SEQ ID NO: 1241920 - DNA, 22 bp, Artificial Sequence
  chemically synthesized
attttccttatgtgtcagacga

SEQ ID NO: 1241921 - DNA, 22 bp, Artificial Sequence
  chemically synthesized
ttttccttatgtgtcagacgag

SEQ ID NO: 1241922 - DNA, 22 bp, Artificial Sequence
  chemically synthesized
aatgactatccccctcgtctga

SEQ ID NO: 1241923 - DNA, 22 bp, Artificial Sequence
  chemically synthesized
tccttatgtgtcagacgagggg

SEQ ID NO: 1241924 - DNA, 22 bp, Artificial Sequence
  chemically synthesized
ccttatgtgtcagacgaggggg

SEQ ID NO: 1241925 - DNA, 22 bp, Artificial Sequence
  chemically synthesized
cttatgtgtcagacgaggggga

SEQ ID NO: 1241926 - DNA, 22 bp, Artificial Sequence
  chemically synthesized
gttgaatgactatccccctcgt

SEQ ID NO: 1241927 - DNA, 22 bp, Artificial Sequence
  chemically synthesized
agttgaatgactatccccctcg

SEQ ID NO: 1241928 - DNA, 22 bp, Artificial Sequence
  chemically synthesized
atgtgtcagacgagggggatag

SEQ ID NO: 1241929 - DNA, 22 bp, Artificial Sequence
  chemically synthesized
tgtgtcagacgagggggatagt

SEQ ID NO: 1241930 - DNA, 22 bp, Artificial Sequence
  chemically synthesized
catttagttgaatgactatccc

SEQ ID NO: 1241931 - DNA, 22 bp, Artificial Sequence
  chemically synthesized
gttacatttagttgaatgacta

SEQ ID NO: 1241932 - DNA, 22 bp, Artificial Sequence
  chemically synthesized
aactaaatgtaaccagtattat

SEQ ID NO: 1241933 - DNA, 22 bp, Artificial Sequence
  chemically synthesized
ggacagtatgatgcataatact

SEQ ID NO: 1241934 - DNA, 22 bp, Artificial Sequence
  chemically synthesized
aggacagtatgatgcataatac

SEQ ID NO: 1241935 - DNA, 22 bp, Artificial Sequence
  chemically synthesized
aatgtaaccagtattatgcatc

SEQ ID NO: 1241936 - DNA, 22 bp, Artificial Sequence
  chemically synthesized
ttaggacagtatgatgcataat

SEQ ID NO: 1241937 - DNA, 22 bp, Artificial Sequence
  chemically synthesized
cttaggacagtatgatgcataa

SEQ ID NO: 1241938 - DNA, 22 bp, Artificial Sequence
  chemically synthesized
tcttaggacagtatgatgcata

SEQ ID NO: 1241939 - DNA, 22 bp, Artificial Sequence
  chemically synthesized
ttcttaggacagtatgatgcat

SEQ ID NO: 1241940 - DNA, 22 bp, Artificial Sequence
  chemically synthesized
ccatttttcttaggacagtatg

SEQ ID NO: 1241941 - DNA, 22 bp, Artificial Sequence
  chemically synthesized
cccatttttcttaggacagtat

SEQ ID NO: 1241942 - DNA, 22 bp, Artificial Sequence
  chemically synthesized
tcttcccatttttcttaggaca

SEQ ID NO: 1241943 - DNA, 22 bp, Artificial Sequence
  chemically synthesized
atcttcccatttttcttaggac

SEQ ID NO: 1241944 - DNA, 22 bp, Artificial Sequence
  chemically synthesized
tgcatcatactgtcctaagaaa

SEQ ID NO: 1241945 - DNA, 22 bp, Artificial Sequence
  chemically synthesized
tatcttcccatttttcttagga

SEQ ID NO: 1241946 - DNA, 22 bp, Artificial Sequence
  chemically synthesized
ttatcttcccatttttcttagg

SEQ ID NO: 1241947 - DNA, 22 bp, Artificial Sequence
  chemically synthesized
tcttttatcttcccatttttct

SEQ ID NO: 1241948 - DNA, 22 bp, Artificial Sequence
  chemically synthesized
atcttttatcttcccatttttc

SEQ ID NO: 1241949 - DNA, 22 bp, Artificial Sequence
  chemically synthesized
tatcttttatcttcccattttt

SEQ ID NO: 1241950 - DNA, 22 bp, Artificial Sequence
  chemically synthesized
ttatcttttatcttcccatttt

SEQ ID NO: 1241951 - DNA, 22 bp, Artificial Sequence
  chemically synthesized
tcctaagaaaaatgggaagata

SEQ ID NO: 1241952 - DNA, 22 bp, Artificial Sequence
  chemically synthesized
agaaaaatgggaagataaaaga

SEQ ID NO: 1241953 - DNA, 22 bp, Artificial Sequence
  chemically synthesized
tgaaaacagtggcagtatgttt

SEQ ID NO: 1241954 - DNA, 22 bp, Artificial Sequence
  chemically synthesized
caaaagctgtgaaaacagtggc

SEQ ID NO: 1241955 - DNA, 22 bp, Artificial Sequence
  chemically synthesized
ttacaaaagctgtgaaaacagt

SEQ ID NO: 1241956 - DNA, 22 bp, Artificial Sequence
  chemically synthesized
ggctattacaaaagctgtgaaa

SEQ ID NO: 1241957 - DNA, 22 bp, Artificial Sequence
  chemically synthesized
ctaggctattacaaaagctgtg

SEQ ID NO: 1241958 - DNA, 22 bp, Artificial Sequence
  chemically synthesized
cctaggctattacaaaagctgt

SEQ ID NO: 1241959 - DNA, 22 bp, Artificial Sequence
  chemically synthesized
ccactgttttcacagcttttgt

SEQ ID NO: 1241960 - DNA, 22 bp, Artificial Sequence
  chemically synthesized
cttcctaggctattacaaaagc

SEQ ID NO: 1241961 - DNA, 22 bp, Artificial Sequence
  chemically synthesized
ccttcctaggctattacaaaag

SEQ ID NO: 1241962 - DNA, 22 bp, Artificial Sequence
  chemically synthesized
ttttcacagcttttgtaatagc

SEQ ID NO: 1241963 - DNA, 22 bp, Artificial Sequence
  chemically synthesized
tcacagcttttgtaatagccta

SEQ ID NO: 1241964 - DNA, 22 bp, Artificial Sequence
  chemically synthesized
cacagcttttgtaatagcctag

SEQ ID NO: 1241965 - DNA, 22 bp, Artificial Sequence
  chemically synthesized
acagcttttgtaatagcctagg

SEQ ID NO: 1241966 - DNA, 22 bp, Artificial Sequence
  chemically synthesized
aatgtatatttccttcctaggc

SEQ ID NO: 1241967 - DNA, 22 bp, Artificial Sequence
  chemically synthesized
aaatgtatatttccttcctagg

SEQ ID NO: 1241968 - DNA, 22 bp, Artificial Sequence
  chemically synthesized
ttgtaatagcctaggaaggaaa

SEQ ID NO: 1241969 - DNA, 22 bp, Artificial Sequence
  chemically synthesized
tgtaatagcctaggaaggaaat

SEQ ID NO: 1241970 - DNA, 22 bp, Artificial Sequence
  chemically synthesized
gcttaaatgtatatttccttcc

SEQ ID NO: 1241971 - DNA, 22 bp, Artificial Sequence
  chemically synthesized
gtaatagcctaggaaggaaata

SEQ ID NO: 1241972 - DNA, 22 bp, Artificial Sequence
  chemically synthesized
taatagcctaggaaggaaatat

SEQ ID NO: 1241973 - DNA, 22 bp, Artificial Sequence
  chemically synthesized
tattcgcttaaatgtatatttc

SEQ ID NO: 1241974 - DNA, 22 bp, Artificial Sequence
  chemically synthesized
taattatattcgcttaaatgta

SEQ ID NO: 1241975 - DNA, 22 bp, Artificial Sequence
  chemically synthesized
ggaaggaaatatacatttaagc

SEQ ID NO: 1241976 - DNA, 22 bp, Artificial Sequence
  chemically synthesized
taacaccatgctataattatat

SEQ ID NO: 1241977 - DNA, 22 bp, Artificial Sequence
  chemically synthesized
aagcgaatataattatagcatg

SEQ ID NO: 1241978 - DNA, 22 bp, Artificial Sequence
  chemically synthesized
agcgaatataattatagcatgg

SEQ ID NO: 1241979 - DNA, 22 bp, Artificial Sequence
  chemically synthesized
ataggattataacaccatgcta

SEQ ID NO: 1241980 - DNA, 22 bp, Artificial Sequence
  chemically synthesized
ttaataggattataacaccatg

SEQ ID NO: 1241981 - DNA, 22 bp, Artificial Sequence
  chemically synthesized
tagcatggtgttataatcctat

SEQ ID NO: 1241982 - DNA, 22 bp, Artificial Sequence
  chemically synthesized
cgacaaaaaaatcactattaat

SEQ ID NO: 1241983 - DNA, 22 bp, Artificial Sequence
  chemically synthesized
acgacaaaaaaatcactattaa

SEQ ID NO: 1241984 - DNA, 22 bp, Artificial Sequence
  chemically synthesized
taatcctattaatagtgatttt

SEQ ID NO: 1241985 - DNA, 22 bp, Artificial Sequence
  chemically synthesized
ttaatagtgatttttttgtcgt

SEQ ID NO: 1241986 - DNA, 22 bp, Artificial Sequence
  chemically synthesized
atagtgatttttttgtcgtaag

SEQ ID NO: 1241987 - DNA, 22 bp, Artificial Sequence
  chemically synthesized
tgccagcaccatacttacgaca

SEQ ID NO: 1241988 - DNA, 22 bp, Artificial Sequence
  chemically synthesized
gtgccagcaccatacttacgac

SEQ ID NO: 1241989 - DNA, 22 bp, Artificial Sequence
  chemically synthesized
tttgtgccagcaccatacttac

SEQ ID NO: 1241990 - DNA, 22 bp, Artificial Sequence
  chemically synthesized
atttgtgccagcaccatactta

SEQ ID NO: 1241991 - DNA, 22 bp, Artificial Sequence
  chemically synthesized
tatttgtgccagcaccatactt

SEQ ID NO: 1241992 - DNA, 22 bp, Artificial Sequence
  chemically synthesized
ttatttgtgccagcaccatact

SEQ ID NO: 1241993 - DNA, 22 bp, Artificial Sequence
  chemically synthesized
ttttgtcgtaagtatggtgctg

SEQ ID NO: 1241994 - DNA, 22 bp, Artificial Sequence
  chemically synthesized
tttgtcgtaagtatggtgctgg

SEQ ID NO: 1241995 - DNA, 22 bp, Artificial Sequence
  chemically synthesized
ttgtcgtaagtatggtgctggc

SEQ ID NO: 1241996 - DNA, 22 bp, Artificial Sequence
  chemically synthesized
tgtcgtaagtatggtgctggca

SEQ ID NO: 1241997 - DNA, 22 bp, Artificial Sequence
  chemically synthesized
gtcgtaagtatggtgctggcac

SEQ ID NO: 1241998 - DNA, 22 bp, Artificial Sequence
  chemically synthesized
tcgtaagtatggtgctggcaca

SEQ ID NO: 1241999 - DNA, 22 bp, Artificial Sequence
  chemically synthesized
cagtgaagatatcttttatttg

SEQ ID NO: 1242000 - DNA, 22 bp, Artificial Sequence
  chemically synthesized
tccagtgaagatatcttttatt

SEQ ID NO: 1242001 - DNA, 22 bp, Artificial Sequence
  chemically synthesized
tctccagtgaagatatctttta

SEQ ID NO: 1242002 - DNA, 22 bp, Artificial Sequence
  chemically synthesized
ttctctccagtgaagatatctt

SEQ ID NO: 1242003 - DNA, 22 bp, Artificial Sequence
  chemically synthesized
gcacaaataaaagatatcttca

SEQ ID NO: 1242004 - DNA, 22 bp, Artificial Sequence
  chemically synthesized
ttgttctctccagtgaagatat

SEQ ID NO: 1242005 - DNA, 22 bp, Artificial Sequence
  chemically synthesized
tgttgttctctccagtgaagat

SEQ ID NO: 1242006 - DNA, 22 bp, Artificial Sequence
  chemically synthesized
actctgttgttctctccagtga

SEQ ID NO: 1242007 - DNA, 22 bp, Artificial Sequence
  chemically synthesized
cactctgttgttctctccagtg

SEQ ID NO: 1242008 - DNA, 22 bp, Artificial Sequence
  chemically synthesized
tcactctgttgttctctccagt

SEQ ID NO: 1242009 - DNA, 22 bp, Artificial Sequence
  chemically synthesized
agggattttcactctgttgttc

SEQ ID NO: 1242010 - DNA, 22 bp, Artificial Sequence
  chemically synthesized
cactggagagaacaacagagtg

SEQ ID NO: 1242011 - DNA, 22 bp, Artificial Sequence
  chemically synthesized
ttcagggattttcactctgttg

SEQ ID NO: 1242012 - DNA, 22 bp, Artificial Sequence
  chemically synthesized
actggagagaacaacagagtga

SEQ ID NO: 1242013 - DNA, 22 bp, Artificial Sequence
  chemically synthesized
tattcagggattttcactctgt

SEQ ID NO: 1242014 - DNA, 22 bp, Artificial Sequence
  chemically synthesized
gagagaacaacagagtgaaaat

SEQ ID NO: 1242015 - DNA, 22 bp, Artificial Sequence
  chemically synthesized
tatattctattcagggattttc

SEQ ID NO: 1242016 - DNA, 22 bp, Artificial Sequence
  chemically synthesized
gtatattctattcagggatttt

SEQ ID NO: 1242017 - DNA, 22 bp, Artificial Sequence
  chemically synthesized
aaccttgtatattctattcagg

SEQ ID NO: 1242018 - DNA, 22 bp, Artificial Sequence
  chemically synthesized
ttcaaccttgtatattctattc

SEQ ID NO: 1242019 - DNA, 22 bp, Artificial Sequence
  chemically synthesized
ataacctgttcaaccttgtata

SEQ ID NO: 1242020 - DNA, 22 bp, Artificial Sequence
  chemically synthesized
ttgataacctgttcaaccttgt

SEQ ID NO: 1242021 - DNA, 22 bp, Artificial Sequence
  chemically synthesized
aatagaatatacaaggttgaac

SEQ ID NO: 1242022 - DNA, 22 bp, Artificial Sequence
  chemically synthesized
cctgttgataacctgttcaacc

SEQ ID NO: 1242023 - DNA, 22 bp, Artificial Sequence
  chemically synthesized
tacctgttgataacctgttcaa

SEQ ID NO: 1242024 - DNA, 22 bp, Artificial Sequence
  chemically synthesized
ctacctgttgataacctgttca

SEQ ID NO: 1242025 - DNA, 22 bp, Artificial Sequence
  chemically synthesized
cacttctacctgttgataacct

SEQ ID NO: 1242026 - DNA, 22 bp, Artificial Sequence
  chemically synthesized
acacttctacctgttgataacc

SEQ ID NO: 1242027 - DNA, 22 bp, Artificial Sequence
  chemically synthesized
tacacttctacctgttgataac

SEQ ID NO: 1242028 - DNA, 22 bp, Artificial Sequence
  chemically synthesized
cctttacacttctacctgttga

SEQ ID NO: 1242029 - DNA, 22 bp, Artificial Sequence
  chemically synthesized
ccctttacacttctacctgttg

SEQ ID NO: 1242030 - DNA, 22 bp, Artificial Sequence
  chemically synthesized
aacaggttatcaacaggtagaa

SEQ ID NO: 1242031 - DNA, 22 bp, Artificial Sequence
  chemically synthesized
tcttccctttacacttctacct

SEQ ID NO: 1242032 - DNA, 22 bp, Artificial Sequence
  chemically synthesized
atcttccctttacacttctacc

SEQ ID NO: 1242033 - DNA, 22 bp, Artificial Sequence
  chemically synthesized
tatcttccctttacacttctac

SEQ ID NO: 1242034 - DNA, 22 bp, Artificial Sequence
  chemically synthesized
actttatcttccctttacactt

SEQ ID NO: 1242035 - DNA, 22 bp, Artificial Sequence
  chemically synthesized
tcaacaggtagaagtgtaaagg

SEQ ID NO: 1242036 - DNA, 22 bp, Artificial Sequence
  chemically synthesized
gactttatcttccctttacact

SEQ ID NO: 1242037 - DNA, 22 bp, Artificial Sequence
  chemically synthesized
cttgactttatcttccctttac

SEQ ID NO: 1242038 - DNA, 22 bp, Artificial Sequence
  chemically synthesized
tgcttgactttatcttcccttt

SEQ ID NO: 1242039 - DNA, 22 bp, Artificial Sequence
  chemically synthesized
ctctgcttgactttatcttccc

SEQ ID NO: 1242040 - DNA, 22 bp, Artificial Sequence
  chemically synthesized
cctctgcttgactttatcttcc

SEQ ID NO: 1242041 - DNA, 22 bp, Artificial Sequence
  chemically synthesized
gcatgtgaagtttcctctgctt

SEQ ID NO: 1242042 - DNA, 22 bp, Artificial Sequence
  chemically synthesized
agcatgtgaagtttcctctgct

SEQ ID NO: 1242043 - DNA, 22 bp, Artificial Sequence
  chemically synthesized
atccttagcatgtgaagtttcc

SEQ ID NO: 1242044 - DNA, 22 bp, Artificial Sequence
  chemically synthesized
atctgatccttagcatgtgaag

SEQ ID NO: 1242045 - DNA, 22 bp, Artificial Sequence
  chemically synthesized
catctgatccttagcatgtgaa

SEQ ID NO: 1242046 - DNA, 22 bp, Artificial Sequence
  chemically synthesized
tttcatctgatccttagcatgt

SEQ ID NO: 1242047 - DNA, 22 bp, Artificial Sequence
  chemically synthesized
cacatgctaaggatcagatgaa

SEQ ID NO: 1242048 - DNA, 22 bp, Artificial Sequence
  chemically synthesized
acatgctaaggatcagatgaaa

SEQ ID NO: 1242049 - DNA, 22 bp, Artificial Sequence
  chemically synthesized
aacagtgcgtctatttcatctg

SEQ ID NO: 1242050 - DNA, 22 bp, Artificial Sequence
  chemically synthesized
gaacagtgcgtctatttcatct

SEQ ID NO: 1242051 - DNA, 22 bp, Artificial Sequence
  chemically synthesized
cttgaacagtgcgtctatttca

SEQ ID NO: 1242052 - DNA, 22 bp, Artificial Sequence
  chemically synthesized
aggatcagatgaaatagacgca

SEQ ID NO: 1242053 - DNA, 22 bp, Artificial Sequence
  chemically synthesized
tagttccttgaacagtgcgtct

SEQ ID NO: 1242054 - DNA, 22 bp, Artificial Sequence
  chemically synthesized
atagttccttgaacagtgcgtc

SEQ ID NO: 1242055 - DNA, 22 bp, Artificial Sequence
  chemically synthesized
caagaagtggcttatagttcct

SEQ ID NO: 1242056 - DNA, 22 bp, Artificial Sequence
  chemically synthesized
cgttccaagaagtggcttatag

SEQ ID NO: 1242057 - DNA, 22 bp, Artificial Sequence
  chemically synthesized
acgttccaagaagtggcttata

SEQ ID NO: 1242058 - DNA, 22 bp, Artificial Sequence
  chemically synthesized
ttcaaggaactataagccactt

SEQ ID NO: 1242059 - DNA, 22 bp, Artificial Sequence
  chemically synthesized
aaggaactataagccacttctt

SEQ ID NO: 1242060 - DNA, 22 bp, Artificial Sequence
  chemically synthesized
catccgtccacttacgttccaa

SEQ ID NO: 1242061 - DNA, 22 bp, Artificial Sequence
  chemically synthesized
taagccacttcttggaacgtaa

SEQ ID NO: 1242062 - DNA, 22 bp, Artificial Sequence
  chemically synthesized
atgttccatccgtccacttacg

SEQ ID NO: 1242063 - DNA, 22 bp, Artificial Sequence
  chemically synthesized
cttggaacgtaagtggacggat

SEQ ID NO: 1242064 - DNA, 22 bp, Artificial Sequence
  chemically synthesized
gtctcatgttccatccgtccac

SEQ ID NO: 1242065 - DNA, 22 bp, Artificial Sequence
  chemically synthesized
ttggaacgtaagtggacggatg

SEQ ID NO: 1242066 - DNA, 22 bp, Artificial Sequence
  chemically synthesized
tagtctcatgttccatccgtcc

SEQ ID NO: 1242067 - DNA, 22 bp, Artificial Sequence
  chemically synthesized
ggaacgtaagtggacggatgga

SEQ ID NO: 1242068 - DNA, 22 bp, Artificial Sequence
  chemically synthesized
gaacgtaagtggacggatggaa

SEQ ID NO: 1242069 - DNA, 22 bp, Artificial Sequence
  chemically synthesized
tctagtctcatgttccatccgt

SEQ ID NO: 1242070 - DNA, 22 bp, Artificial Sequence
  chemically synthesized
tacctctctagtctcatgttcc

SEQ ID NO: 1242071 - DNA, 22 bp, Artificial Sequence
  chemically synthesized
gtacctctctagtctcatgttc

SEQ ID NO: 1242072 - DNA, 22 bp, Artificial Sequence
  chemically synthesized
ggatggggtgtcttgtacctct

SEQ ID NO: 1242073 - DNA, 22 bp, Artificial Sequence
  chemically synthesized
gagaggtacaagacaccccatc

SEQ ID NO: 1242074 - DNA, 22 bp, Artificial Sequence
  chemically synthesized
atcaagtcggtacactcggatg

SEQ ID NO: 1242075 - DNA, 22 bp, Artificial Sequence
  chemically synthesized
ggtggttaatcaagtcggtaca

SEQ ID NO: 1242076 - DNA, 22 bp, Artificial Sequence
  chemically synthesized
gggtggttaatcaagtcggtac

SEQ ID NO: 1242077 - DNA, 22 bp, Artificial Sequence
  chemically synthesized
tgggtggttaatcaagtcggta

SEQ ID NO: 1242078 - DNA, 22 bp, Artificial Sequence
  chemically synthesized
agcagctttgggtggttaatca

SEQ ID NO: 1242079 - DNA, 22 bp, Artificial Sequence
  chemically synthesized
cctaagcagctttgggtggtta

SEQ ID NO: 1242080 - DNA, 22 bp, Artificial Sequence
  chemically synthesized
gcctaagcagctttgggtggtt

SEQ ID NO: 1242081 - DNA, 22 bp, Artificial Sequence
  chemically synthesized
gattaaccacccaaagctgctt

SEQ ID NO: 1242082 - DNA, 22 bp, Artificial Sequence
  chemically synthesized
attaaccacccaaagctgctta

SEQ ID NO: 1242083 - DNA, 22 bp, Artificial Sequence
  chemically synthesized
accacccaaagctgcttaggca

SEQ ID NO: 1242084 - DNA, 22 bp, Artificial Sequence
  chemically synthesized
cttaggcaaatgtctgcttgtc

SEQ ID NO: 1242085 - DNA, 22 bp, Artificial Sequence
  chemically synthesized
aggcaaatgtctgcttgtcttt

SEQ ID NO: 1242086 - DNA, 22 bp, Artificial Sequence
  chemically synthesized
ggcaaatgtctgcttgtctttt

SEQ ID NO: 1242087 - DNA, 22 bp, Artificial Sequence
  chemically synthesized
aaagggtgaaaagaaaagacaa

SEQ ID NO: 1242088 - DNA, 22 bp, Artificial Sequence
  chemically synthesized
gaaagggtgaaaagaaaagaca

SEQ ID NO: 1242089 - DNA, 22 bp, Artificial Sequence
  chemically synthesized
tgtttgaaagggtgaaaagaaa

SEQ ID NO: 1242090 - DNA, 22 bp, Artificial Sequence
  chemically synthesized
gttatgtttgaaagggtgaaaa

SEQ ID NO: 1242091 - DNA, 22 bp, Artificial Sequence
  chemically synthesized
cttgtcttttcttttcaccctt

SEQ ID NO: 1242092 - DNA, 22 bp, Artificial Sequence
  chemically synthesized
gtcttttcttttcaccctttca

SEQ ID NO: 1242093 - DNA, 22 bp, Artificial Sequence
  chemically synthesized
tcttttcttttcaccctttcaa

SEQ ID NO: 1242094 - DNA, 22 bp, Artificial Sequence
  chemically synthesized
aaaattagttatgtttgaaagg

SEQ ID NO: 1242095 - DNA, 22 bp, Artificial Sequence
  chemically synthesized
ttcttttcaccctttcaaacat

SEQ ID NO: 1242096 - DNA, 22 bp, Artificial Sequence
  chemically synthesized
tcaaaattagttatgtttgaaa

SEQ ID NO: 1242097 - DNA, 22 bp, Artificial Sequence
  chemically synthesized
tcttttcaccctttcaaacata

SEQ ID NO: 1242098 - DNA, 22 bp, Artificial Sequence
  chemically synthesized
ctcaaaattagttatgtttgaa

SEQ ID NO: 1242099 - DNA, 22 bp, Artificial Sequence
  chemically synthesized
cttttcaccctttcaaacataa

SEQ ID NO: 1242100 - DNA, 22 bp, Artificial Sequence
  chemically synthesized
ttttcaccctttcaaacataac

SEQ ID NO: 1242101 - DNA, 22 bp, Artificial Sequence
  chemically synthesized
ttcaccctttcaaacataacta

SEQ ID NO: 1242102 - DNA, 22 bp, Artificial Sequence
  chemically synthesized
tcaccctttcaaacataactaa

SEQ ID NO: 1242103 - DNA, 22 bp, Artificial Sequence
  chemically synthesized
caccctttcaaacataactaat

SEQ ID NO: 1242104 - DNA, 22 bp, Artificial Sequence
  chemically synthesized
accctttcaaacataactaatt

SEQ ID NO: 1242105 - DNA, 22 bp, Artificial Sequence
  chemically synthesized
tcaaacataactaattttgaga

SEQ ID NO: 1242106 - DNA, 22 bp, Artificial Sequence
  chemically synthesized
caaacataactaattttgagaa

SEQ ID NO: 1242107 - DNA, 22 bp, Artificial Sequence
  chemically synthesized
aaacataactaattttgagaag

SEQ ID NO: 1242108 - DNA, 22 bp, Artificial Sequence
  chemically synthesized
attttgagaagctcttaccatg

SEQ ID NO: 1242109 - DNA, 22 bp, Artificial Sequence
  chemically synthesized
aaaaatgcaaaacatggtaaga

SEQ ID NO: 1242110 - DNA, 22 bp, Artificial Sequence
  chemically synthesized
tgagaagctcttaccatgtttt

SEQ ID NO: 1242111 - DNA, 22 bp, Artificial Sequence
  chemically synthesized
gagaagctcttaccatgttttg

SEQ ID NO: 1242112 - DNA, 22 bp, Artificial Sequence
  chemically synthesized
agaagctcttaccatgttttgc

SEQ ID NO: 1242113 - DNA, 22 bp, Artificial Sequence
  chemically synthesized
ttaccatgttttgcatttttta

SEQ ID NO: 1242114 - DNA, 22 bp, Artificial Sequence
  chemically synthesized
accatgttttgcattttttaat

SEQ ID NO: 1242115 - DNA, 22 bp, Artificial Sequence
  chemically synthesized
ccatgttttgcattttttaatt

SEQ ID NO: 1242116 - DNA, 22 bp, Artificial Sequence
  chemically synthesized
aagtgtcagtcaaaatatgaat

SEQ ID NO: 1242117 - DNA, 22 bp, Artificial Sequence
  chemically synthesized
tgcattttttaattcatatttt

SEQ ID NO: 1242118 - DNA, 22 bp, Artificial Sequence
  chemically synthesized
gcattttttaattcatattttg

SEQ ID NO: 1242119 - DNA, 22 bp, Artificial Sequence
  chemically synthesized
cattttttaattcatattttga

SEQ ID NO: 1242120 - DNA, 22 bp, Artificial Sequence
  chemically synthesized
tgttaaagtgtcagtcaaaata

SEQ ID NO: 1242121 - DNA, 22 bp, Artificial Sequence
  chemically synthesized
tttaattcatattttgactgac

SEQ ID NO: 1242122 - DNA, 22 bp, Artificial Sequence
  chemically synthesized
ttaattcatattttgactgaca

SEQ ID NO: 1242123 - DNA, 22 bp, Artificial Sequence
  chemically synthesized
taattcatattttgactgacac

SEQ ID NO: 1242124 - DNA, 22 bp, Artificial Sequence
  chemically synthesized
aattcatattttgactgacact

SEQ ID NO: 1242125 - DNA, 22 bp, Artificial Sequence
  chemically synthesized
attcatattttgactgacactt

SEQ ID NO: 1242126 - DNA, 22 bp, Artificial Sequence
  chemically synthesized
aacaatactatgttaaagtgtc

SEQ ID NO: 1242127 - DNA, 22 bp, Artificial Sequence
  chemically synthesized
atattttgactgacactttaac

SEQ ID NO: 1242128 - DNA, 22 bp, Artificial Sequence
  chemically synthesized
ctaaacaatactatgttaaagt

SEQ ID NO: 1242129 - DNA, 22 bp, Artificial Sequence
  chemically synthesized
cctaaacaatactatgttaaag

SEQ ID NO: 1242130 - DNA, 22 bp, Artificial Sequence
  chemically synthesized
tcctaaacaatactatgttaaa

SEQ ID NO: 1242131 - DNA, 22 bp, Artificial Sequence
  chemically synthesized
ttcctaaacaatactatgttaa

SEQ ID NO: 1242132 - DNA, 22 bp, Artificial Sequence
  chemically synthesized
tgactgacactttaacatagta

SEQ ID NO: 1242133 - DNA, 22 bp, Artificial Sequence
  chemically synthesized
gactgacactttaacatagtat

SEQ ID NO: 1242134 - DNA, 22 bp, Artificial Sequence
  chemically synthesized
actgacactttaacatagtatt

SEQ ID NO: 1242135 - DNA, 22 bp, Artificial Sequence
  chemically synthesized
gtttttcctaaacaatactatg

SEQ ID NO: 1242136 - DNA, 22 bp, Artificial Sequence
  chemically synthesized
acactttaacatagtattgttt

SEQ ID NO: 1242137 - DNA, 22 bp, Artificial Sequence
  chemically synthesized
taacatagtattgtttaggaaa

SEQ ID NO: 1242138 - DNA, 22 bp, Artificial Sequence
  chemically synthesized
aacatagtattgtttaggaaaa

SEQ ID NO: 1242139 - DNA, 22 bp, Artificial Sequence
  chemically synthesized
acatagtattgtttaggaaaaa

SEQ ID NO: 1242140 - DNA, 22 bp, Artificial Sequence
  chemically synthesized
gtaaacagtgccaatattggtt

SEQ ID NO: 1242141 - DNA, 22 bp, Artificial Sequence
  chemically synthesized
tttaggaaaaaccaatattggc

SEQ ID NO: 1242142 - DNA, 22 bp, Artificial Sequence
  chemically synthesized
aggaaaaaccaatattggcact

SEQ ID NO: 1242143 - DNA, 22 bp, Artificial Sequence
  chemically synthesized
ggaaaaaccaatattggcactg

SEQ ID NO: 1242144 - DNA, 22 bp, Artificial Sequence
  chemically synthesized
catgcaaataattggtaaacag

SEQ ID NO: 1242145 - DNA, 22 bp, Artificial Sequence
  chemically synthesized
gcatgcaaataattggtaaaca

SEQ ID NO: 1242146 - DNA, 22 bp, Artificial Sequence
  chemically synthesized
tgcatgcaaataattggtaaac

SEQ ID NO: 1242147 - DNA, 22 bp, Artificial Sequence
  chemically synthesized
ttgcatgcaaataattggtaaa

SEQ ID NO: 1242148 - DNA, 22 bp, Artificial Sequence
  chemically synthesized
gcactgtttaccaattatttgc

SEQ ID NO: 1242149 - DNA, 22 bp, Artificial Sequence
  chemically synthesized
ccaaatatttttgcatgcaaat

SEQ ID NO: 1242150 - DNA, 22 bp, Artificial Sequence
  chemically synthesized
gccaaatatttttgcatgcaaa

SEQ ID NO: 1242151 - DNA, 22 bp, Artificial Sequence
  chemically synthesized
tttaccaattatttgcatgcaa

SEQ ID NO: 1242152 - DNA, 22 bp, Artificial Sequence
  chemically synthesized
cttgccaaatatttttgcatgc

SEQ ID NO: 1242153 - DNA, 22 bp, Artificial Sequence
  chemically synthesized
accaattatttgcatgcaaaaa

SEQ ID NO: 1242154 - DNA, 22 bp, Artificial Sequence
  chemically synthesized
ccttgccaaatatttttgcatg

SEQ ID NO: 1242155 - DNA, 22 bp, Artificial Sequence
  chemically synthesized
ccaattatttgcatgcaaaaat

SEQ ID NO: 1242156 - DNA, 22 bp, Artificial Sequence
  chemically synthesized
tttgcatgcaaaaatatttggc

SEQ ID NO: 1242157 - DNA, 22 bp, Artificial Sequence
  chemically synthesized
gcatgcaaaaatatttggcaag

SEQ ID NO: 1242158 - DNA, 22 bp, Artificial Sequence
  chemically synthesized
catgcaaaaatatttggcaagg

SEQ ID NO: 1242159 - DNA, 22 bp, Artificial Sequence
  chemically synthesized
gacagtatggcttccttgccaa

SEQ ID NO: 1242160 - DNA, 22 bp, Artificial Sequence
  chemically synthesized
ctggacagtatggcttccttgc

SEQ ID NO: 1242161 - DNA, 22 bp, Artificial Sequence
  chemically synthesized
ctcctggacagtatggcttcct

SEQ ID NO: 1242162 - DNA, 22 bp, Artificial Sequence
  chemically synthesized
ggcaaggaagccatactgtcca

SEQ ID NO: 1242163 - DNA, 22 bp, Artificial Sequence
  chemically synthesized
gcaaggaagccatactgtccag

SEQ ID NO: 1242164 - DNA, 22 bp, Artificial Sequence
  chemically synthesized
cagcagttgctcctggacagta

SEQ ID NO: 1242165 - DNA, 22 bp, Artificial Sequence
  chemically synthesized
acagcagttgctcctggacagt

SEQ ID NO: 1242166 - DNA, 22 bp, Artificial Sequence
  chemically synthesized
ccatttacagcagttgctcctg

SEQ ID NO: 1242167 - DNA, 22 bp, Artificial Sequence
  chemically synthesized
accatttacagcagttgctcct

SEQ ID NO: 1242168 - DNA, 22 bp, Artificial Sequence
  chemically synthesized
acttaccatttacagcagttgc

SEQ ID NO: 1242169 - DNA, 22 bp, Artificial Sequence
  chemically synthesized
tccaggagcaactgctgtaaat

SEQ ID NO: 1242170 - DNA, 22 bp, Artificial Sequence
  chemically synthesized
tagttaacttaccatttacagc

SEQ ID NO: 1242171 - DNA, 22 bp, Artificial Sequence
  chemically synthesized
gtagttaacttaccatttacag

SEQ ID NO: 1242172 - DNA, 22 bp, Artificial Sequence
  chemically synthesized
tgtagttaacttaccatttaca

SEQ ID NO: 1242173 - DNA, 22 bp, Artificial Sequence
  chemically synthesized
ggcccaattttgtagttaactt

SEQ ID NO: 1242174 - DNA, 22 bp, Artificial Sequence
  chemically synthesized
ctgtaaatggtaagttaactac

SEQ ID NO: 1242175 - DNA, 22 bp, Artificial Sequence
  chemically synthesized
taaatggtaagttaactacaaa

SEQ ID NO: 1242176 - DNA, 22 bp, Artificial Sequence
  chemically synthesized
actacaaaattgggcctagtat

SEQ ID NO: 1242177 - DNA, 22 bp, Artificial Sequence
  chemically synthesized
aggaaaggatgaaatactaggc

SEQ ID NO: 1242178 - DNA, 22 bp, Artificial Sequence
  chemically synthesized
caaaattgggcctagtatttca

SEQ ID NO: 1242179 - DNA, 22 bp, Artificial Sequence
  chemically synthesized
ggcctagtatttcatcctttcc

SEQ ID NO: 1242180 - DNA, 22 bp, Artificial Sequence
  chemically synthesized
caaagggtatggattcaggaaa

SEQ ID NO: 1242181 - DNA, 22 bp, Artificial Sequence
  chemically synthesized
gtatttcatcctttcctgaatc

SEQ ID NO: 1242182 - DNA, 22 bp, Artificial Sequence
  chemically synthesized
cattgcaaagggtatggattca

SEQ ID NO: 1242183 - DNA, 22 bp, Artificial Sequence
  chemically synthesized
catcctttcctgaatccatacc

SEQ ID NO: 1242184 - DNA, 22 bp, Artificial Sequence
  chemically synthesized
atcctttcctgaatccataccc

SEQ ID NO: 1242185 - DNA, 22 bp, Artificial Sequence
  chemically synthesized
tcctgaatccataccctttgca

SEQ ID NO: 1242186 - DNA, 22 bp, Artificial Sequence
  chemically synthesized
cctgaatccataccctttgcaa

SEQ ID NO: 1242187 - DNA, 22 bp, Artificial Sequence
  chemically synthesized
ctgaatccataccctttgcaat

SEQ ID NO: 1242188 - DNA, 22 bp, Artificial Sequence
  chemically synthesized
aatccataccctttgcaatgta

SEQ ID NO: 1242189 - DNA, 22 bp, Artificial Sequence
  chemically synthesized
atgagaagaacagcaatgctac

SEQ ID NO: 1242190 - DNA, 22 bp, Artificial Sequence
  chemically synthesized
catgagaagaacagcaatgcta

SEQ ID NO: 1242191 - DNA, 22 bp, Artificial Sequence
  chemically synthesized
tcatgagaagaacagcaatgct

SEQ ID NO: 1242192 - DNA, 22 bp, Artificial Sequence
  chemically synthesized
ttcatgagaagaacagcaatgc

SEQ ID NO: 1242193 - DNA, 22 bp, Artificial Sequence
  chemically synthesized
tgcaatgtagcattgctgttct

SEQ ID NO: 1242194 - DNA, 22 bp, Artificial Sequence
  chemically synthesized
gcaatgtagcattgctgttctt

SEQ ID NO: 1242195 - DNA, 22 bp, Artificial Sequence
  chemically synthesized
caatgtagcattgctgttcttc

SEQ ID NO: 1242196 - DNA, 22 bp, Artificial Sequence
  chemically synthesized
ctgttcttctcatgaaaagttg

SEQ ID NO: 1242197 - DNA, 22 bp, Artificial Sequence
  chemically synthesized
ttcttctcatgaaaagttggta

SEQ ID NO: 1242198 - DNA, 22 bp, Artificial Sequence
  chemically synthesized
ttctcatgaaaagttggtatct

SEQ ID NO: 1242199 - DNA, 22 bp, Artificial Sequence
  chemically synthesized
ctcatgaaaagttggtatctat

SEQ ID NO: 1242200 - DNA, 22 bp, Artificial Sequence
  chemically synthesized
agaagcagggaaatagatacca

SEQ ID NO: 1242201 - DNA, 22 bp, Artificial Sequence
  chemically synthesized
tcatgaaaagttggtatctatt

SEQ ID NO: 1242202 - DNA, 22 bp, Artificial Sequence
  chemically synthesized
aagaagcagggaaatagatacc

SEQ ID NO: 1242203 - DNA, 22 bp, Artificial Sequence
  chemically synthesized
atgaaaagttggtatctatttc

SEQ ID NO: 1242204 - DNA, 22 bp, Artificial Sequence
  chemically synthesized
gtatctatttccctgcttctta

SEQ ID NO: 1242205 - DNA, 22 bp, Artificial Sequence
  chemically synthesized
tttccctgcttcttaaatctgg

SEQ ID NO: 1242206 - DNA, 22 bp, Artificial Sequence
  chemically synthesized
ccctgcttcttaaatctgggtt

SEQ ID NO: 1242207 - DNA, 22 bp, Artificial Sequence
  chemically synthesized
cctgcttcttaaatctgggttg

SEQ ID NO: 1242208 - DNA, 22 bp, Artificial Sequence
  chemically synthesized
cttcttaaatctgggttggcat

SEQ ID NO: 1242209 - DNA, 22 bp, Artificial Sequence
  chemically synthesized
cttaaatctgggttggcatttg

SEQ ID NO: 1242210 - DNA, 22 bp, Artificial Sequence
  chemically synthesized
gtcaaaatgagtcaaatgccaa

SEQ ID NO: 1242211 - DNA, 22 bp, Artificial Sequence
  chemically synthesized
ttaaatctgggttggcatttga

SEQ ID NO: 1242212 - DNA, 22 bp, Artificial Sequence
  chemically synthesized
aaatctgggttggcatttgact

SEQ ID NO: 1242213 - DNA, 22 bp, Artificial Sequence
  chemically synthesized
ttggtcaaaatgagtcaaatgc

SEQ ID NO: 1242214 - DNA, 22 bp, Artificial Sequence
  chemically synthesized
aatctgggttggcatttgactc

SEQ ID NO: 1242215 - DNA, 22 bp, Artificial Sequence
  chemically synthesized
tgttggtcaaaatgagtcaaat

SEQ ID NO: 1242216 - DNA, 22 bp, Artificial Sequence
  chemically synthesized
ggttggcatttgactcattttg

SEQ ID NO: 1242217 - DNA, 22 bp, Artificial Sequence
  chemically synthesized
cactctgttggtcaaaatgagt

SEQ ID NO: 1242218 - DNA, 22 bp, Artificial Sequence
  chemically synthesized
gcatttgactcattttgaccaa

SEQ ID NO: 1242219 - DNA, 22 bp, Artificial Sequence
  chemically synthesized
aattgcactctgttggtcaaaa

SEQ ID NO: 1242220 - DNA, 22 bp, Artificial Sequence
  chemically synthesized
caattgcactctgttggtcaaa

SEQ ID NO: 1242221 - DNA, 22 bp, Artificial Sequence
  chemically synthesized
gactcattttgaccaacagagt

SEQ ID NO: 1242222 - DNA, 22 bp, Artificial Sequence
  chemically synthesized
actcattttgaccaacagagtg

SEQ ID NO: 1242223 - DNA, 22 bp, Artificial Sequence
  chemically synthesized
attttgaccaacagagtgcaat

SEQ ID NO: 1242224 - DNA, 22 bp, Artificial Sequence
  chemically synthesized
tgaccaacagagtgcaattgaa

SEQ ID NO: 1242225 - DNA, 22 bp, Artificial Sequence
  chemically synthesized
gaccaacagagtgcaattgaag

SEQ ID NO: 1242226 - DNA, 22 bp, Artificial Sequence
  chemically synthesized
accaacagagtgcaattgaagt

SEQ ID NO: 1242227 - DNA, 22 bp, Artificial Sequence
  chemically synthesized
ggagaggaaatgccagcacttc

SEQ ID NO: 1242228 - DNA, 22 bp, Artificial Sequence
  chemically synthesized
gggagaggaaatgccagcactt

SEQ ID NO: 1242229 - DNA, 22 bp, Artificial Sequence
  chemically synthesized
catttgggagaggaaatgccag

SEQ ID NO: 1242230 - DNA, 22 bp, Artificial Sequence
  chemically synthesized
aagtgctggcatttcctctccc

SEQ ID NO: 1242231 - DNA, 22 bp, Artificial Sequence
  chemically synthesized
aggtctacatttgggagaggaa

SEQ ID NO: 1242232 - DNA, 22 bp, Artificial Sequence
  chemically synthesized
gaggtctacatttgggagagga

SEQ ID NO: 1242233 - DNA, 22 bp, Artificial Sequence
  chemically synthesized
tgaggtctacatttgggagagg

SEQ ID NO: 1242234 - DNA, 22 bp, Artificial Sequence
  chemically synthesized
ttgaggtctacatttgggagag

SEQ ID NO: 1242235 - DNA, 22 bp, Artificial Sequence
  chemically synthesized
gcatttcctctcccaaatgtag

SEQ ID NO: 1242236 - DNA, 22 bp, Artificial Sequence
  chemically synthesized
aagcccttttgaggtctacatt

SEQ ID NO: 1242237 - DNA, 22 bp, Artificial Sequence
  chemically synthesized
cctctcccaaatgtagacctca

SEQ ID NO: 1242238 - DNA, 22 bp, Artificial Sequence
  chemically synthesized
ctctcccaaatgtagacctcaa

SEQ ID NO: 1242239 - DNA, 22 bp, Artificial Sequence
  chemically synthesized
tcccaaatgtagacctcaaaag

SEQ ID NO: 1242240 - DNA, 22 bp, Artificial Sequence
  chemically synthesized
ccaaatgtagacctcaaaaggg

SEQ ID NO: 1242241 - DNA, 22 bp, Artificial Sequence
  chemically synthesized
aaaagggcttgaacacttttgc

SEQ ID NO: 1242242 - DNA, 22 bp, Artificial Sequence
  chemically synthesized
gaacacttttgctctcttgttc

SEQ ID NO: 1242243 - DNA, 22 bp, Artificial Sequence
  chemically synthesized
aacacttttgctctcttgttca

SEQ ID NO: 1242244 - DNA, 22 bp, Artificial Sequence
  chemically synthesized
cggtaaatgcagaggcatgaac

SEQ ID NO: 1242245 - DNA, 22 bp, Artificial Sequence
  chemically synthesized
acggtaaatgcagaggcatgaa

SEQ ID NO: 1242246 - DNA, 22 bp, Artificial Sequence
  chemically synthesized
ttgctctcttgttcatgcctct

SEQ ID NO: 1242247 - DNA, 22 bp, Artificial Sequence
  chemically synthesized
tgctctcttgttcatgcctctg

SEQ ID NO: 1242248 - DNA, 22 bp, Artificial Sequence
  chemically synthesized
ttacggtaaatgcagaggcatg

SEQ ID NO: 1242249 - DNA, 22 bp, Artificial Sequence
  chemically synthesized
gctctcttgttcatgcctctgc

SEQ ID NO: 1242250 - DNA, 22 bp, Artificial Sequence
  chemically synthesized
ctctcttgttcatgcctctgca

SEQ ID NO: 1242251 - DNA, 22 bp, Artificial Sequence
  chemically synthesized
tcttgttcatgcctctgcattt

SEQ ID NO: 1242252 - DNA, 22 bp, Artificial Sequence
  chemically synthesized
ttgttcatgcctctgcatttac

SEQ ID NO: 1242253 - DNA, 22 bp, Artificial Sequence
  chemically synthesized
atgtgctcttacggtaaatgca

SEQ ID NO: 1242254 - DNA, 22 bp, Artificial Sequence
  chemically synthesized
gttcatgcctctgcatttaccg

SEQ ID NO: 1242255 - DNA, 22 bp, Artificial Sequence
  chemically synthesized
ttcatgcctctgcatttaccgt

SEQ ID NO: 1242256 - DNA, 22 bp, Artificial Sequence
  chemically synthesized
tgatgtgctcttacggtaaatg

SEQ ID NO: 1242257 - DNA, 22 bp, Artificial Sequence
  chemically synthesized
atgcctctgcatttaccgtaag

SEQ ID NO: 1242258 - DNA, 22 bp, Artificial Sequence
  chemically synthesized
gctctgatgtgctcttacggta

SEQ ID NO: 1242259 - DNA, 22 bp, Artificial Sequence
  chemically synthesized
tctagctctgatgtgctcttac

SEQ ID NO: 1242260 - DNA, 22 bp, Artificial Sequence
  chemically synthesized
tgcatttaccgtaagagcacat

SEQ ID NO: 1242261 - DNA, 22 bp, Artificial Sequence
  chemically synthesized
ctgtctagctctgatgtgctct

SEQ ID NO: 1242262 - DNA, 22 bp, Artificial Sequence
  chemically synthesized
catttaccgtaagagcacatca

SEQ ID NO: 1242263 - DNA, 22 bp, Artificial Sequence
  chemically synthesized
ctgctgtctagctctgatgtgc

SEQ ID NO: 1242264 - DNA, 22 bp, Artificial Sequence
  chemically synthesized
accgtaagagcacatcagagct

SEQ ID NO: 1242265 - DNA, 22 bp, Artificial Sequence
  chemically synthesized
ccgtaagagcacatcagagcta

SEQ ID NO: 1242266 - DNA, 22 bp, Artificial Sequence
  chemically synthesized
atcctcctgctgtctagctctg

SEQ ID NO: 1242267 - DNA, 22 bp, Artificial Sequence
  chemically synthesized
tctcatcctcctgctgtctagc

SEQ ID NO: 1242268 - DNA, 22 bp, Artificial Sequence
  chemically synthesized
gtctcatcctcctgctgtctag

SEQ ID NO: 1242269 - DNA, 22 bp, Artificial Sequence
  chemically synthesized
cacttgtctcatcctcctgctg

SEQ ID NO: 1242270 - DNA, 22 bp, Artificial Sequence
  chemically synthesized
ggttccacttgtctcatcctcc

SEQ ID NO: 1242271 - DNA, 22 bp, Artificial Sequence
  chemically synthesized
actcggttccacttgtctcatc

SEQ ID NO: 1242272 - DNA, 22 bp, Artificial Sequence
  chemically synthesized
gacagcaggaggatgagacaag

SEQ ID NO: 1242273 - DNA, 22 bp, Artificial Sequence
  chemically synthesized
gactcggttccacttgtctcat

SEQ ID NO: 1242274 - DNA, 22 bp, Artificial Sequence
  chemically synthesized
gggcaacttgactcggttccac

SEQ ID NO: 1242275 - DNA, 22 bp, Artificial Sequence
  chemically synthesized
ggacaactagggcaacttgact

SEQ ID NO: 1242276 - DNA, 22 bp, Artificial Sequence
  chemically synthesized
atctgggacaactagggcaact

SEQ ID NO: 1242277 - DNA, 22 bp, Artificial Sequence
  chemically synthesized
catctgggacaactagggcaac

SEQ ID NO: 1242278 - DNA, 22 bp, Artificial Sequence
  chemically synthesized
ggaaaacttcatctgggacaac

SEQ ID NO: 1242279 - DNA, 22 bp, Artificial Sequence
  chemically synthesized
gtctgggaaaacttcatctggg

SEQ ID NO: 1242280 - DNA, 22 bp, Artificial Sequence
  chemically synthesized
ccctagttgtcccagatgaagt

SEQ ID NO: 1242281 - DNA, 22 bp, Artificial Sequence
  chemically synthesized
ctagtctgggaaaacttcatct

SEQ ID NO: 1242282 - DNA, 22 bp, Artificial Sequence
  chemically synthesized
gttgtcccagatgaagttttcc

SEQ ID NO: 1242283 - DNA, 22 bp, Artificial Sequence
  chemically synthesized
tctgctagtctgggaaaacttc

SEQ ID NO: 1242284 - DNA, 22 bp, Artificial Sequence
  chemically synthesized
tcccagatgaagttttcccaga

SEQ ID NO: 1242285 - DNA, 22 bp, Artificial Sequence
  chemically synthesized
gctgtctgctagtctgggaaaa

SEQ ID NO: 1242286 - DNA, 22 bp, Artificial Sequence
  chemically synthesized
cgaaatgtctggctgtctgcta

SEQ ID NO: 1242287 - DNA, 22 bp, Artificial Sequence
  chemically synthesized
tgcgaaatgtctggctgtctgc

SEQ ID NO: 1242288 - DNA, 22 bp, Artificial Sequence
  chemically synthesized
tcccagactagcagacagccag

SEQ ID NO: 1242289 - DNA, 22 bp, Artificial Sequence
  chemically synthesized
cccagactagcagacagccaga

SEQ ID NO: 1242290 - DNA, 22 bp, Artificial Sequence
  chemically synthesized
ccagactagcagacagccagac

SEQ ID NO: 1242291 - DNA, 22 bp, Artificial Sequence
  chemically synthesized
agctctgcgaaatgtctggctg

SEQ ID NO: 1242292 - DNA, 22 bp, Artificial Sequence
  chemically synthesized
agctcagctctgcgaaatgtct

SEQ ID NO: 1242293 - DNA, 22 bp, Artificial Sequence
  chemically synthesized
gcagacagccagacatttcgca

SEQ ID NO: 1242294 - DNA, 22 bp, Artificial Sequence
  chemically synthesized
atctcagctcagctctgcgaaa

SEQ ID NO: 1242295 - DNA, 22 bp, Artificial Sequence
  chemically synthesized
ctgatctcagctcagctctgcg

SEQ ID NO: 1242296 - DNA, 22 bp, Artificial Sequence
  chemically synthesized
gctgatctcagctcagctctgc

SEQ ID NO: 1242297 - DNA, 22 bp, Artificial Sequence
  chemically synthesized
tgctgatctcagctcagctctg

SEQ ID NO: 1242298 - DNA, 22 bp, Artificial Sequence
  chemically synthesized
aggggctttgctgatctcagct

SEQ ID NO: 1242299 - DNA, 22 bp, Artificial Sequence
  chemically synthesized
cgcagagctgagctgagatcag

SEQ ID NO: 1242300 - DNA, 22 bp, Artificial Sequence
  chemically synthesized
gcagagctgagctgagatcagc

SEQ ID NO: 1242301 - DNA, 22 bp, Artificial Sequence
  chemically synthesized
gctaaggggctttgctgatctc

SEQ ID NO: 1242302 - DNA, 22 bp, Artificial Sequence
  chemically synthesized
ggggttggctaaggggctttgc

SEQ ID NO: 1242303 - DNA, 22 bp, Artificial Sequence
  chemically synthesized
agctgagatcagcaaagcccct

SEQ ID NO: 1242304 - DNA, 22 bp, Artificial Sequence
  chemically synthesized
gctgggggttggctaaggggct

SEQ ID NO: 1242305 - DNA, 22 bp, Artificial Sequence
  chemically synthesized
agatcagcaaagccccttagcc

SEQ ID NO: 1242306 - DNA, 22 bp, Artificial Sequence
  chemically synthesized
gttagctgggggttggctaagg

SEQ ID NO: 1242307 - DNA, 22 bp, Artificial Sequence
  chemically synthesized
tagttagctgggggttggctaa

SEQ ID NO: 1242308 - DNA, 22 bp, Artificial Sequence
  chemically synthesized
gtgtgtctctagttagctgggg

SEQ ID NO: 1242309 - DNA, 22 bp, Artificial Sequence
  chemically synthesized
ctcgtgtgtctctagttagctg

SEQ ID NO: 1242310 - DNA, 22 bp, Artificial Sequence
  chemically synthesized
agccaacccccagctaactaga

SEQ ID NO: 1242311 - DNA, 22 bp, Artificial Sequence
  chemically synthesized
gccaacccccagctaactagag

SEQ ID NO: 1242312 - DNA, 22 bp, Artificial Sequence
  chemically synthesized
ggattactcgtgtgtctctagt

SEQ ID NO: 1242313 - DNA, 22 bp, Artificial Sequence
  chemically synthesized
ctaggattactcgtgtgtctct

SEQ ID NO: 1242314 - DNA, 22 bp, Artificial Sequence
  chemically synthesized
ctgctaggattactcgtgtgtc

SEQ ID NO: 1242315 - DNA, 22 bp, Artificial Sequence
  chemically synthesized
actgctaggattactcgtgtgt

SEQ ID NO: 1242316 - DNA, 22 bp, Artificial Sequence
  chemically synthesized
actagagacacacgagtaatcc

SEQ ID NO: 1242317 - DNA, 22 bp, Artificial Sequence
  chemically synthesized
accttactgctaggattactcg

SEQ ID NO: 1242318 - DNA, 22 bp, Artificial Sequence
  chemically synthesized
caccttactgctaggattactc

SEQ ID NO: 1242319 - DNA, 22 bp, Artificial Sequence
  chemically synthesized
ttcaccttactgctaggattac

SEQ ID NO: 1242320 - DNA, 22 bp, Artificial Sequence
  chemically synthesized
gagacacacgagtaatcctagc

SEQ ID NO: 1242321 - DNA, 22 bp, Artificial Sequence
  chemically synthesized
gccaggaagttcttcaccttac

SEQ ID NO: 1242322 - DNA, 22 bp, Artificial Sequence
  chemically synthesized
gcagtaaggtgaagaacttcct

SEQ ID NO: 1242323 - DNA, 22 bp, Artificial Sequence
  chemically synthesized
aaatacatatgttagccaggaa

SEQ ID NO: 1242324 - DNA, 22 bp, Artificial Sequence
  chemically synthesized
caaatacatatgttagccagga

SEQ ID NO: 1242325 - DNA, 22 bp, Artificial Sequence
  chemically synthesized
tttcaaatacatatgttagcca

SEQ ID NO: 1242326 - DNA, 22 bp, Artificial Sequence
  chemically synthesized
cctggctaacatatgtatttga

SEQ ID NO: 1242327 - DNA, 22 bp, Artificial Sequence
  chemically synthesized
ctggctaacatatgtatttgaa

SEQ ID NO: 1242328 - DNA, 22 bp, Artificial Sequence
  chemically synthesized
gctaacatatgtatttgaaata

SEQ ID NO: 1242329 - DNA, 22 bp, Artificial Sequence
  chemically synthesized
aaacaaccaacatactatttca

SEQ ID NO: 1242330 - DNA, 22 bp, Artificial Sequence
  chemically synthesized
acatatgtatttgaaatagtat

SEQ ID NO: 1242331 - DNA, 22 bp, Artificial Sequence
  chemically synthesized
agtaggttaaaacaaccaacat

SEQ ID NO: 1242332 - DNA, 22 bp, Artificial Sequence
  chemically synthesized
gaaatagtatgttggttgtttt

SEQ ID NO: 1242333 - DNA, 22 bp, Artificial Sequence
  chemically synthesized
aaatagtatgttggttgtttta

SEQ ID NO: 1242334 - DNA, 22 bp, Artificial Sequence
  chemically synthesized
aaactcagtaggttaaaacaac

SEQ ID NO: 1242335 - DNA, 22 bp, Artificial Sequence
  chemically synthesized
gaaactcagtaggttaaaacaa

SEQ ID NO: 1242336 - DNA, 22 bp, Artificial Sequence
  chemically synthesized
gttgttttaacctactgagttt

SEQ ID NO: 1242337 - DNA, 22 bp, Artificial Sequence
  chemically synthesized
ttttaacctactgagtttcaag

SEQ ID NO: 1242338 - DNA, 22 bp, Artificial Sequence
  chemically synthesized
tgtaataagccaccttgaaact

SEQ ID NO: 1242339 - DNA, 22 bp, Artificial Sequence
  chemically synthesized
taacctactgagtttcaaggtg

SEQ ID NO: 1242340 - DNA, 22 bp, Artificial Sequence
  chemically synthesized
aacctactgagtttcaaggtgg

SEQ ID NO: 1242341 - DNA, 22 bp, Artificial Sequence
  chemically synthesized
ctgtgtaataagccaccttgaa

SEQ ID NO: 1242342 - DNA, 22 bp, Artificial Sequence
  chemically synthesized
acctactgagtttcaaggtggc

SEQ ID NO: 1242343 - DNA, 22 bp, Artificial Sequence
  chemically synthesized
ttgctgtgtaataagccacctt

SEQ ID NO: 1242344 - DNA, 22 bp, Artificial Sequence
  chemically synthesized
ctgagtttcaaggtggcttatt

SEQ ID NO: 1242345 - DNA, 22 bp, Artificial Sequence
  chemically synthesized
gctattgctgtgtaataagcca

SEQ ID NO: 1242346 - DNA, 22 bp, Artificial Sequence
  chemically synthesized
agtttcaaggtggcttattaca

SEQ ID NO: 1242347 - DNA, 22 bp, Artificial Sequence
  chemically synthesized
caaggtggcttattacacagca

SEQ ID NO: 1242348 - DNA, 22 bp, Artificial Sequence
  chemically synthesized
aaggtggcttattacacagcaa

SEQ ID NO: 1242349 - DNA, 22 bp, Artificial Sequence
  chemically synthesized
attacacagcaatagctaatat

SEQ ID NO: 1242350 - DNA, 22 bp, Artificial Sequence
  chemically synthesized
ttacacagcaatagctaatatg

SEQ ID NO: 1242351 - DNA, 22 bp, Artificial Sequence
  chemically synthesized
atatgtatgtacacatattagc

SEQ ID NO: 1242352 - DNA, 22 bp, Artificial Sequence
  chemically synthesized
cacagcaatagctaatatgtgt

SEQ ID NO: 1242353 - DNA, 22 bp, Artificial Sequence
  chemically synthesized
atatgtgtacatacatatgaat

SEQ ID NO: 1242354 - DNA, 22 bp, Artificial Sequence
  chemically synthesized
tgtagaaacaaatattcatatg

SEQ ID NO: 1242355 - DNA, 22 bp, Artificial Sequence
  chemically synthesized
tgtgtagaaacaaatattcata

SEQ ID NO: 1242356 - DNA, 22 bp, Artificial Sequence
  chemically synthesized
ctgtgtagaaacaaatattcat

SEQ ID NO: 1242357 - DNA, 22 bp, Artificial Sequence
  chemically synthesized
agacatcttctgtgtagaaaca

SEQ ID NO: 1242358 - DNA, 22 bp, Artificial Sequence
  chemically synthesized
cagacatcttctgtgtagaaac

SEQ ID NO: 1242359 - DNA, 22 bp, Artificial Sequence
  chemically synthesized
tcagacatcttctgtgtagaaa

SEQ ID NO: 1242360 - DNA, 22 bp, Artificial Sequence
  chemically synthesized
ttcagacatcttctgtgtagaa

SEQ ID NO: 1242361 - DNA, 22 bp, Artificial Sequence
  chemically synthesized
atttttcagacatcttctgtgt

SEQ ID NO: 1242362 - DNA, 22 bp, Artificial Sequence
  chemically synthesized
aatttttcagacatcttctgtg

SEQ ID NO: 1242363 - DNA, 22 bp, Artificial Sequence
  chemically synthesized
gtttctacacagaagatgtctg

SEQ ID NO: 1242364 - DNA, 22 bp, Artificial Sequence
  chemically synthesized
tttctacacagaagatgtctga

SEQ ID NO: 1242365 - DNA, 22 bp, Artificial Sequence
  chemically synthesized
ctacacagaagatgtctgaaaa

SEQ ID NO: 1242366 - DNA, 22 bp, Artificial Sequence
  chemically synthesized
tacacagaagatgtctgaaaaa

SEQ ID NO: 1242367 - DNA, 22 bp, Artificial Sequence
  chemically synthesized
taatgtggcttaatttttcaga

SEQ ID NO: 1242368 - DNA, 22 bp, Artificial Sequence
  chemically synthesized
cacagaagatgtctgaaaaatt

SEQ ID NO: 1242369 - DNA, 22 bp, Artificial Sequence
  chemically synthesized
ataatgtggcttaatttttcag

SEQ ID NO: 1242370 - DNA, 22 bp, Artificial Sequence
  chemically synthesized
tataatgtggcttaatttttca

SEQ ID NO: 1242371 - DNA, 22 bp, Artificial Sequence
  chemically synthesized
taaatatctttataatgtggct

SEQ ID NO: 1242372 - DNA, 22 bp, Artificial Sequence
  chemically synthesized
ataaatatctttataatgtggc

SEQ ID NO: 1242373 - DNA, 22 bp, Artificial Sequence
  chemically synthesized
tataaatatctttataatgtgg

SEQ ID NO: 1242374 - DNA, 22 bp, Artificial Sequence
  chemically synthesized
aaaaattaagccacattataaa

SEQ ID NO: 1242375 - DNA, 22 bp, Artificial Sequence
  chemically synthesized
aaaatattttataaatatcttt

SEQ ID NO: 1242376 - DNA, 22 bp, Artificial Sequence
  chemically synthesized
agccacattataaagatattta

SEQ ID NO: 1242377 - DNA, 22 bp, Artificial Sequence
  chemically synthesized
aaaaatattttataaatatctt

SEQ ID NO: 1242378 - DNA, 22 bp, Artificial Sequence
  chemically synthesized
taaaaatattttataaatatct

SEQ ID NO: 1242379 - DNA, 22 bp, Artificial Sequence
  chemically synthesized
ttaaaaatattttataaatatc

SEQ ID NO: 1242380 - DNA, 22 bp, Artificial Sequence
  chemically synthesized
ttttaaaaatattttataaata

SEQ ID NO: 1242381 - DNA, 22 bp, Artificial Sequence
  chemically synthesized
taaagatatttataaaatattt

SEQ ID NO: 1242382 - DNA, 22 bp, Artificial Sequence
  chemically synthesized
gggctcttttaaaaatatttta

SEQ ID NO: 1242383 - DNA, 22 bp, Artificial Sequence
  chemically synthesized
ctagggctcttttaaaaatatt

SEQ ID NO: 1242384 - DNA, 22 bp, Artificial Sequence
  chemically synthesized
ataaaatatttttaaaagagcc

SEQ ID NO: 1242385 - DNA, 22 bp, Artificial Sequence
  chemically synthesized
taaaatatttttaaaagagccc

SEQ ID NO: 1242386 - DNA, 22 bp, Artificial Sequence
  chemically synthesized
ataaaaactcctagggctcttt

SEQ ID NO: 1242387 - DNA, 22 bp, Artificial Sequence
  chemically synthesized
tcataaaaactcctagggctct

SEQ ID NO: 1242388 - DNA, 22 bp, Artificial Sequence
  chemically synthesized
ctcataaaaactcctagggctc

SEQ ID NO: 1242389 - DNA, 22 bp, Artificial Sequence
  chemically synthesized
ttaaaagagccctaggagtttt

SEQ ID NO: 1242390 - DNA, 22 bp, Artificial Sequence
  chemically synthesized
atatttctcataaaaactccta

SEQ ID NO: 1242391 - DNA, 22 bp, Artificial Sequence
  chemically synthesized
taaaagagccctaggagttttt

SEQ ID NO: 1242392 - DNA, 22 bp, Artificial Sequence
  chemically synthesized
gatatttctcataaaaactcct

SEQ ID NO: 1242393 - DNA, 22 bp, Artificial Sequence
  chemically synthesized
aaaagagccctaggagttttta

SEQ ID NO: 1242394 - DNA, 22 bp, Artificial Sequence
  chemically synthesized
aaagagccctaggagtttttat

SEQ ID NO: 1242395 - DNA, 22 bp, Artificial Sequence
  chemically synthesized
gcttgatatttctcataaaaac

SEQ ID NO: 1242396 - DNA, 22 bp, Artificial Sequence
  chemically synthesized
tagcttgatatttctcataaaa

SEQ ID NO: 1242397 - DNA, 22 bp, Artificial Sequence
  chemically synthesized
ctagcttgatatttctcataaa

SEQ ID NO: 1242398 - DNA, 22 bp, Artificial Sequence
  chemically synthesized
ggagtttttatgagaaatatca

SEQ ID NO: 1242399 - DNA, 22 bp, Artificial Sequence
  chemically synthesized
ttatgagaaatatcaagctaga

SEQ ID NO: 1242400 - DNA, 22 bp, Artificial Sequence
  chemically synthesized
tatgagaaatatcaagctagaa

SEQ ID NO: 1242401 - DNA, 22 bp, Artificial Sequence
  chemically synthesized
atgagaaatatcaagctagaaa

SEQ ID NO: 1242402 - DNA, 22 bp, Artificial Sequence
  chemically synthesized
tgagaaatatcaagctagaaat

SEQ ID NO: 1242403 - DNA, 22 bp, Artificial Sequence
  chemically synthesized
agcagtaaaataatttctagct

SEQ ID NO: 1242404 - DNA, 22 bp, Artificial Sequence
  chemically synthesized
cagcagtaaaataatttctagc

SEQ ID NO: 1242405 - DNA, 22 bp, Artificial Sequence
  chemically synthesized
aatttcagcagtaaaataattt

SEQ ID NO: 1242406 - DNA, 22 bp, Artificial Sequence
  chemically synthesized
cccatattcaatttcagcagta

SEQ ID NO: 1242407 - DNA, 22 bp, Artificial Sequence
  chemically synthesized
gcccatattcaatttcagcagt

SEQ ID NO: 1242408 - DNA, 22 bp, Artificial Sequence
  chemically synthesized
gaaattattttactgctgaaat

SEQ ID NO: 1242409 - DNA, 22 bp, Artificial Sequence
  chemically synthesized
tgcccatattcaatttcagcag

SEQ ID NO: 1242410 - DNA, 22 bp, Artificial Sequence
  chemically synthesized
ttgcccatattcaatttcagca

SEQ ID NO: 1242411 - DNA, 22 bp, Artificial Sequence
  chemically synthesized
acttttgcccatattcaatttc

SEQ ID NO: 1242412 - DNA, 22 bp, Artificial Sequence
  chemically synthesized
ttttactgctgaaattgaatat

SEQ ID NO: 1242413 - DNA, 22 bp, Artificial Sequence
  chemically synthesized
tactgctgaaattgaatatggg

SEQ ID NO: 1242414 - DNA, 22 bp, Artificial Sequence
  chemically synthesized
actgctgaaattgaatatgggc

SEQ ID NO: 1242415 - DNA, 22 bp, Artificial Sequence
  chemically synthesized
ctgctgaaattgaatatgggca

SEQ ID NO: 1242416 - DNA, 22 bp, Artificial Sequence
  chemically synthesized
gaaactgacttttgcccatatt

SEQ ID NO: 1242417 - DNA, 22 bp, Artificial Sequence
  chemically synthesized
tagaaactgacttttgcccata

SEQ ID NO: 1242418 - DNA, 22 bp, Artificial Sequence
  chemically synthesized
ctgaaattgaatatgggcaaaa

SEQ ID NO: 1242419 - DNA, 22 bp, Artificial Sequence
  chemically synthesized
aaattgaatatgggcaaaagtc

SEQ ID NO: 1242420 - DNA, 22 bp, Artificial Sequence
  chemically synthesized
aatatgggcaaaagtcagtttc

SEQ ID NO: 1242421 - DNA, 22 bp, Artificial Sequence
  chemically synthesized
atagcacatgagtcagatctct

SEQ ID NO: 1242422 - DNA, 22 bp, Artificial Sequence
  chemically synthesized
taatagcacatgagtcagatct

SEQ ID NO: 1242423 - DNA, 22 bp, Artificial Sequence
  chemically synthesized
ctaatagcacatgagtcagatc

SEQ ID NO: 1242424 - DNA, 22 bp, Artificial Sequence
  chemically synthesized
tctaatagcacatgagtcagat

SEQ ID NO: 1242425 - DNA, 22 bp, Artificial Sequence
  chemically synthesized
ttctaatagcacatgagtcaga

SEQ ID NO: 1242426 - DNA, 22 bp, Artificial Sequence
  chemically synthesized
ttttctaatagcacatgagtca

SEQ ID NO: 1242427 - DNA, 22 bp, Artificial Sequence
  chemically synthesized
ctagagatctgactcatgtgct

SEQ ID NO: 1242428 - DNA, 22 bp, Artificial Sequence
  chemically synthesized
tagagatctgactcatgtgcta

SEQ ID NO: 1242429 - DNA, 22 bp, Artificial Sequence
  chemically synthesized
tgttcttttctaatagcacatg

SEQ ID NO: 1242430 - DNA, 22 bp, Artificial Sequence
  chemically synthesized
gagatctgactcatgtgctatt

SEQ ID NO: 1242431 - DNA, 22 bp, Artificial Sequence
  chemically synthesized
actcatgtgctattagaaaaga

SEQ ID NO: 1242432 - DNA, 22 bp, Artificial Sequence
  chemically synthesized
atgtgctattagaaaagaacac

SEQ ID NO: 1242433 - DNA, 22 bp, Artificial Sequence
  chemically synthesized
catggaatataatgactgtgtt

SEQ ID NO: 1242434 - DNA, 22 bp, Artificial Sequence
  chemically synthesized
ttagaaaagaacacagtcatta

SEQ ID NO: 1242435 - DNA, 22 bp, Artificial Sequence
  chemically synthesized
gaaaagaacacagtcattatat

SEQ ID NO: 1242436 - DNA, 22 bp, Artificial Sequence
  chemically synthesized
gaggaactgcatggaatataat

SEQ ID NO: 1242437 - DNA, 22 bp, Artificial Sequence
  chemically synthesized
cattggaggaactgcatggaat

SEQ ID NO: 1242438 - DNA, 22 bp, Artificial Sequence
  chemically synthesized
caagattgcattggaggaactg

SEQ ID NO: 1242439 - DNA, 22 bp, Artificial Sequence
  chemically synthesized
gcaagattgcattggaggaact

SEQ ID NO: 1242440 - DNA, 22 bp, Artificial Sequence
  chemically synthesized
tgcaagattgcattggaggaac

SEQ ID NO: 1242441 - DNA, 22 bp, Artificial Sequence
  chemically synthesized
tattccatgcagttcctccaat

SEQ ID NO: 1242442 - DNA, 22 bp, Artificial Sequence
  chemically synthesized
ttgcaagattgcattggaggaa

SEQ ID NO: 1242443 - DNA, 22 bp, Artificial Sequence
  chemically synthesized
tttgcaagattgcattggagga

SEQ ID NO: 1242444 - DNA, 22 bp, Artificial Sequence
  chemically synthesized
ttttgcaagattgcattggagg

SEQ ID NO: 1242445 - DNA, 22 bp, Artificial Sequence
  chemically synthesized
ttttttgcaagattgcattgga

SEQ ID NO: 1242446 - DNA, 22 bp, Artificial Sequence
  chemically synthesized
catgcagttcctccaatgcaat

SEQ ID NO: 1242447 - DNA, 22 bp, Artificial Sequence
  chemically synthesized
attcttttttgcaagattgcat

SEQ ID NO: 1242448 - DNA, 22 bp, Artificial Sequence
  chemically synthesized
gttaattcttttttgcaagatt

SEQ ID NO: 1242449 - DNA, 22 bp, Artificial Sequence
  chemically synthesized
cgttaattcttttttgcaagat

SEQ ID NO: 1242450 - DNA, 22 bp, Artificial Sequence
  chemically synthesized
ctccaatgcaatcttgcaaaaa

SEQ ID NO: 1242451 - DNA, 22 bp, Artificial Sequence
  chemically synthesized
cttcgttaattcttttttgcaa

SEQ ID NO: 1242452 - DNA, 22 bp, Artificial Sequence
  chemically synthesized
caatgcaatcttgcaaaaaaga

SEQ ID NO: 1242453 - DNA, 22 bp, Artificial Sequence
  chemically synthesized
ttgcttcgttaattcttttttg

SEQ ID NO: 1242454 - DNA, 22 bp, Artificial Sequence
  chemically synthesized
acaaaactattgcttcgttaat

SEQ ID NO: 1242455 - DNA, 22 bp, Artificial Sequence
  chemically synthesized
gcaaaaaagaattaacgaagca

SEQ ID NO: 1242456 - DNA, 22 bp, Artificial Sequence
  chemically synthesized
caaaaaagaattaacgaagcaa

SEQ ID NO: 1242457 - DNA, 22 bp, Artificial Sequence
  chemically synthesized
tgaaactgacaaaactattgct

SEQ ID NO: 1242458 - DNA, 22 bp, Artificial Sequence
  chemically synthesized
tatgaaactgacaaaactattg

SEQ ID NO: 1242459 - DNA, 22 bp, Artificial Sequence
  chemically synthesized
ctatgaaactgacaaaactatt

SEQ ID NO: 1242460 - DNA, 22 bp, Artificial Sequence
  chemically synthesized
acgaagcaatagttttgtcagt

SEQ ID NO: 1242461 - DNA, 22 bp, Artificial Sequence
  chemically synthesized
aaaaatttctatgaaactgaca

SEQ ID NO: 1242462 - DNA, 22 bp, Artificial Sequence
  chemically synthesized
aaaaaatttctatgaaactgac

SEQ ID NO: 1242463 - DNA, 22 bp, Artificial Sequence
  chemically synthesized
tatttaaaaaatttctatgaaa

SEQ ID NO: 1242464 - DNA, 22 bp, Artificial Sequence
  chemically synthesized
tgtcagtttcatagaaattttt

SEQ ID NO: 1242465 - DNA, 22 bp, Artificial Sequence
  chemically synthesized
acactgtatttaaaaaatttct

SEQ ID NO: 1242466 - DNA, 22 bp, Artificial Sequence
  chemically synthesized
gtcagtttcatagaaatttttt

SEQ ID NO: 1242467 - DNA, 22 bp, Artificial Sequence
  chemically synthesized
tcagtttcatagaaatttttta

SEQ ID NO: 1242468 - DNA, 22 bp, Artificial Sequence
  chemically synthesized
aggttgacactgtatttaaaaa

SEQ ID NO: 1242469 - DNA, 22 bp, Artificial Sequence
  chemically synthesized
catagaaattttttaaatacag

SEQ ID NO: 1242470 - DNA, 22 bp, Artificial Sequence
  chemically synthesized
atagaaattttttaaatacagt

SEQ ID NO: 1242471 - DNA, 22 bp, Artificial Sequence
  chemically synthesized
tttaaatacagtgtcaacctta

SEQ ID NO: 1242472 - DNA, 22 bp, Artificial Sequence
  chemically synthesized
ttaaatacagtgtcaaccttaa

SEQ ID NO: 1242473 - DNA, 22 bp, Artificial Sequence
  chemically synthesized
taaatacagtgtcaaccttaat

SEQ ID NO: 1242474 - DNA, 22 bp, Artificial Sequence
  chemically synthesized
aaatacagtgtcaaccttaata

SEQ ID NO: 1242475 - DNA, 22 bp, Artificial Sequence
  chemically synthesized
aatacagtgtcaaccttaatat

SEQ ID NO: 1242476 - DNA, 22 bp, Artificial Sequence
  chemically synthesized
aatatatacatacacacacttt

SEQ ID NO: 1242477 - DNA, 22 bp, Artificial Sequence
  chemically synthesized
atatatacatacacacactttt

SEQ ID NO: 1242478 - DNA, 22 bp, Artificial Sequence
  chemically synthesized
ttttttgggggggggtgggggg

SEQ ID NO: 1242479 - DNA, 22 bp, Artificial Sequence
  chemically synthesized
tttttgggggggggtggggggg

SEQ ID NO: 1242480 - DNA, 22 bp, Artificial Sequence
  chemically synthesized
ttttgggggggggtgggggggt

SEQ ID NO: 1242481 - DNA, 22 bp, Artificial Sequence
  chemically synthesized
tttgggggggggtgggggggtg

SEQ ID NO: 1242482 - DNA, 22 bp, Artificial Sequence
  chemically synthesized
tccccccccccccaccccccca

SEQ ID NO: 1242483 - DNA, 22 bp, Artificial Sequence
  chemically synthesized
ttgggggggggtgggggggtgg

SEQ ID NO: 1242484 - DNA, 22 bp, Artificial Sequence
  chemically synthesized
tgggggggggtgggggggtggg

SEQ ID NO: 1242485 - DNA, 22 bp, Artificial Sequence
  chemically synthesized
tgtccccccccccccacccccc

SEQ ID NO: 1242486 - DNA, 22 bp, Artificial Sequence
  chemically synthesized
gggggggggtgggggggtgggg

SEQ ID NO: 1242487 - DNA, 22 bp, Artificial Sequence
  chemically synthesized
ggggggggtgggggggtggggg

SEQ ID NO: 1242488 - DNA, 22 bp, Artificial Sequence
  chemically synthesized
ggcgaaagagtgaaactctgtc

SEQ ID NO: 1242489 - DNA, 22 bp, Artificial Sequence
  chemically synthesized
caggctgggcgaaagagtgaaa

SEQ ID NO: 1242490 - DNA, 22 bp, Artificial Sequence
  chemically synthesized
cgctgcaggctgggcgaaagag

SEQ ID NO: 1242491 - DNA, 22 bp, Artificial Sequence
  chemically synthesized
cactctttcgcccagcctgcag

SEQ ID NO: 1242492 - DNA, 22 bp, Artificial Sequence
  chemically synthesized
actctttcgcccagcctgcagc

SEQ ID NO: 1242493 - DNA, 22 bp, Artificial Sequence
  chemically synthesized
agaccacaccactgcgctgcag

SEQ ID NO: 1242494 - DNA, 22 bp, Artificial Sequence
  chemically synthesized
tttcgcccagcctgcagcgcag

SEQ ID NO: 1242495 - DNA, 22 bp, Artificial Sequence
  chemically synthesized
tcgcccagcctgcagcgcagtg

SEQ ID NO: 1242496 - DNA, 22 bp, Artificial Sequence
  chemically synthesized
cgcccagcctgcagcgcagtgg

SEQ ID NO: 1242497 - DNA, 22 bp, Artificial Sequence
  chemically synthesized
gcccagcctgcagcgcagtggt

SEQ ID NO: 1242498 - DNA, 22 bp, Artificial Sequence
  chemically synthesized
cagtgagctgagaccacaccac

SEQ ID NO: 1242499 - DNA, 22 bp, Artificial Sequence
  chemically synthesized
cagcgcagtggtgtggtctcag

SEQ ID NO: 1242500 - DNA, 22 bp, Artificial Sequence
  chemically synthesized
ggagacggaggttgcagtgagc

SEQ ID NO: 1242501 - DNA, 22 bp, Artificial Sequence
  chemically synthesized
acactgggagacggaggttgca

SEQ ID NO: 1242502 - DNA, 22 bp, Artificial Sequence
  chemically synthesized
gacactgggagacggaggttgc

SEQ ID NO: 1242503 - DNA, 22 bp, Artificial Sequence
  chemically synthesized
agctcactgcaacctccgtctc

SEQ ID NO: 1242504 - DNA, 22 bp, Artificial Sequence
  chemically synthesized
actgcaacctccgtctcccagt

SEQ ID NO: 1242505 - DNA, 22 bp, Artificial Sequence
  chemically synthesized
caacctccgtctcccagtgtca

SEQ ID NO: 1242506 - DNA, 22 bp, Artificial Sequence
  chemically synthesized
aggcaggagaatcgcttgacac

SEQ ID NO: 1242507 - DNA, 22 bp, Artificial Sequence
  chemically synthesized
cgtctcccagtgtcaagcgatt

SEQ ID NO: 1242508 - DNA, 22 bp, Artificial Sequence
  chemically synthesized
gaaggctgaggcaggagaatcg

SEQ ID NO: 1242509 - DNA, 22 bp, Artificial Sequence
  chemically synthesized
ccagtgtcaagcgattctcctg

SEQ ID NO: 1242510 - DNA, 22 bp, Artificial Sequence
  chemically synthesized
ggaaggctgaggcaggagaatc

SEQ ID NO: 1242511 - DNA, 22 bp, Artificial Sequence
  chemically synthesized
cttggaaggctgaggcaggaga

SEQ ID NO: 1242512 - DNA, 22 bp, Artificial Sequence
  chemically synthesized
taatcccagctacttggaaggc

SEQ ID NO: 1242513 - DNA, 22 bp, Artificial Sequence
  chemically synthesized
tcctgcctcagccttccaagta

SEQ ID NO: 1242514 - DNA, 22 bp, Artificial Sequence
  chemically synthesized
ctgcctcagccttccaagtagc

SEQ ID NO: 1242515 - DNA, 22 bp, Artificial Sequence
  chemically synthesized
cctcagccttccaagtagctgg

SEQ ID NO: 1242516 - DNA, 22 bp, Artificial Sequence
  chemically synthesized
agccttccaagtagctgggatt

SEQ ID NO: 1242517 - DNA, 22 bp, Artificial Sequence
  chemically synthesized
ccaagtagctgggattacaggc

SEQ ID NO: 1242518 - DNA, 22 bp, Artificial Sequence
  chemically synthesized
caagtagctgggattacaggcg

SEQ ID NO: 1242519 - DNA, 22 bp, Artificial Sequence
  chemically synthesized
ggcgtggtggcatgcgcctgta

SEQ ID NO: 1242520 - DNA, 22 bp, Artificial Sequence
  chemically synthesized
ggattacaggcgcatgccacca

SEQ ID NO: 1242521 - DNA, 22 bp, Artificial Sequence
  chemically synthesized
caggcgcatgccaccacgccca

SEQ ID NO: 1242522 - DNA, 22 bp, Artificial Sequence
  chemically synthesized
aaaaaatacaaaaatcagctgg

SEQ ID NO: 1242523 - DNA, 22 bp, Artificial Sequence
  chemically synthesized
ctaaaaaaatacaaaaatcagc

SEQ ID NO: 1242524 - DNA, 22 bp, Artificial Sequence
  chemically synthesized
tactaaaaaaatacaaaaatca

SEQ ID NO: 1242525 - DNA, 22 bp, Artificial Sequence
  chemically synthesized
ctactaaaaaaatacaaaaatc

SEQ ID NO: 1242526 - DNA, 22 bp, Artificial Sequence
  chemically synthesized
tttctactaaaaaaatacaaaa

SEQ ID NO: 1242527 - DNA, 22 bp, Artificial Sequence
  chemically synthesized
atttttgtatttttttagtaga

SEQ ID NO: 1242528 - DNA, 22 bp, Artificial Sequence
  chemically synthesized
ttgtatttttttagtagaaaca

SEQ ID NO: 1242529 - DNA, 22 bp, Artificial Sequence
  chemically synthesized
tgtatttttttagtagaaacag

SEQ ID NO: 1242530 - DNA, 22 bp, Artificial Sequence
  chemically synthesized
gtatttttttagtagaaacagg

SEQ ID NO: 1242531 - DNA, 22 bp, Artificial Sequence
  chemically synthesized
tatttttttagtagaaacaggg

SEQ ID NO: 1242532 - DNA, 22 bp, Artificial Sequence
  chemically synthesized
gccaatgtggtgaaaccctgtt

SEQ ID NO: 1242533 - DNA, 22 bp, Artificial Sequence
  chemically synthesized
ttttagtagaaacagggtttca

SEQ ID NO: 1242534 - DNA, 22 bp, Artificial Sequence
  chemically synthesized
tttagtagaaacagggtttcac

SEQ ID NO: 1242535 - DNA, 22 bp, Artificial Sequence
  chemically synthesized
ttagtagaaacagggtttcacc

SEQ ID NO: 1242536 - DNA, 22 bp, Artificial Sequence
  chemically synthesized
tagtagaaacagggtttcacca

SEQ ID NO: 1242537 - DNA, 22 bp, Artificial Sequence
  chemically synthesized
gcctggccaatgtggtgaaacc

SEQ ID NO: 1242538 - DNA, 22 bp, Artificial Sequence
  chemically synthesized
agtagaaacagggtttcaccac

SEQ ID NO: 1242539 - DNA, 22 bp, Artificial Sequence
  chemically synthesized
gtagaaacagggtttcaccaca

SEQ ID NO: 1242540 - DNA, 22 bp, Artificial Sequence
  chemically synthesized
agactggcctggccaatgtggt

SEQ ID NO: 1242541 - DNA, 22 bp, Artificial Sequence
  chemically synthesized
gagactggcctggccaatgtgg

SEQ ID NO: 1242542 - DNA, 22 bp, Artificial Sequence
  chemically synthesized
caccacattggccaggccagtc

SEQ ID NO: 1242543 - DNA, 22 bp, Artificial Sequence
  chemically synthesized
accacattggccaggccagtct

SEQ ID NO: 1242544 - DNA, 22 bp, Artificial Sequence
  chemically synthesized
gccaggccagtctcaaactcct

SEQ ID NO: 1242545 - DNA, 22 bp, Artificial Sequence
  chemically synthesized
aaactcctgacctcgtgatccg

SEQ ID NO: 1242546 - DNA, 22 bp, Artificial Sequence
  chemically synthesized
ggaggccgaggtgggcggatca

SEQ ID NO: 1242547 - DNA, 22 bp, Artificial Sequence
  chemically synthesized
gggaggccgaggtgggcggatc

SEQ ID NO: 1242548 - DNA, 22 bp, Artificial Sequence
  chemically synthesized
tgggaggccgaggtgggcggat

SEQ ID NO: 1242549 - DNA, 22 bp, Artificial Sequence
  chemically synthesized
ctgacctcgtgatccgcccacc

SEQ ID NO: 1242550 - DNA, 22 bp, Artificial Sequence
  chemically synthesized
acctcgtgatccgcccacctcg

SEQ ID NO: 1242551 - DNA, 22 bp, Artificial Sequence
  chemically synthesized
gtgatccgcccacctcggcctc

SEQ ID NO: 1242552 - DNA, 22 bp, Artificial Sequence
  chemically synthesized
taatcccagcactttgggaggc

SEQ ID NO: 1242553 - DNA, 22 bp, Artificial Sequence
  chemically synthesized
aggcctataatcccagcacttt

SEQ ID NO: 1242554 - DNA, 22 bp, Artificial Sequence
  chemically synthesized
ggcctcccaaagtgctgggatt

SEQ ID NO: 1242555 - DNA, 22 bp, Artificial Sequence
  chemically synthesized
ccaaagtgctgggattataggc

SEQ ID NO: 1242556 - DNA, 22 bp, Artificial Sequence
  chemically synthesized
gccgggtacggtggttcaggcc

SEQ ID NO: 1242557 - DNA, 22 bp, Artificial Sequence
  chemically synthesized
ggattataggcctgaaccaccg

SEQ ID NO: 1242558 - DNA, 22 bp, Artificial Sequence
  chemically synthesized
aaagttggccgggtacggtggt

SEQ ID NO: 1242559 - DNA, 22 bp, Artificial Sequence
  chemically synthesized
gaaagttggccgggtacggtgg

SEQ ID NO: 1242560 - DNA, 22 bp, Artificial Sequence
  chemically synthesized
taggcctgaaccaccgtacccg

SEQ ID NO: 1242561 - DNA, 22 bp, Artificial Sequence
  chemically synthesized
gaaatatttgaaagttggccgg

SEQ ID NO: 1242562 - DNA, 22 bp, Artificial Sequence
  chemically synthesized
aaccaccgtacccggccaactt

SEQ ID NO: 1242563 - DNA, 22 bp, Artificial Sequence
  chemically synthesized
agaaatatttgaaagttggccg

SEQ ID NO: 1242564 - DNA, 22 bp, Artificial Sequence
  chemically synthesized
tagaaatatttgaaagttggcc

SEQ ID NO: 1242565 - DNA, 22 bp, Artificial Sequence
  chemically synthesized
cgaaaggtagctttagaaatat

SEQ ID NO: 1242566 - DNA, 22 bp, Artificial Sequence
  chemically synthesized
acgaaaggtagctttagaaata

SEQ ID NO: 1242567 - DNA, 22 bp, Artificial Sequence
  chemically synthesized
agtcttacgaaaggtagcttta

SEQ ID NO: 1242568 - DNA, 22 bp, Artificial Sequence
  chemically synthesized
tcaaatatttctaaagctacct

SEQ ID NO: 1242569 - DNA, 22 bp, Artificial Sequence
  chemically synthesized
caaatatttctaaagctacctt

SEQ ID NO: 1242570 - DNA, 22 bp, Artificial Sequence
  chemically synthesized
aaatatttctaaagctaccttt

SEQ ID NO: 1242571 - DNA, 22 bp, Artificial Sequence
  chemically synthesized
aacactaagtcttacgaaaggt

SEQ ID NO: 1242572 - DNA, 22 bp, Artificial Sequence
  chemically synthesized
ctaaagctacctttcgtaagac

SEQ ID NO: 1242573 - DNA, 22 bp, Artificial Sequence
  chemically synthesized
taaagctacctttcgtaagact

SEQ ID NO: 1242574 - DNA, 22 bp, Artificial Sequence
  chemically synthesized
aagctacctttcgtaagactta

SEQ ID NO: 1242575 - DNA, 22 bp, Artificial Sequence
  chemically synthesized
cctttcgtaagacttagtgttt

SEQ ID NO: 1242576 - DNA, 22 bp, Artificial Sequence
  chemically synthesized
caacagaagagttaaacactaa

SEQ ID NO: 1242577 - DNA, 22 bp, Artificial Sequence
  chemically synthesized
tcgtaagacttagtgtttaact

SEQ ID NO: 1242578 - DNA, 22 bp, Artificial Sequence
  chemically synthesized
cgtaagacttagtgtttaactc

SEQ ID NO: 1242579 - DNA, 22 bp, Artificial Sequence
  chemically synthesized
gtaagacttagtgtttaactct

SEQ ID NO: 1242580 - DNA, 22 bp, Artificial Sequence
  chemically synthesized
agtgtttaactcttctgttgta

SEQ ID NO: 1242581 - DNA, 22 bp, Artificial Sequence
  chemically synthesized
caatacagtggctacaacagaa

SEQ ID NO: 1242582 - DNA, 22 bp, Artificial Sequence
  chemically synthesized
gtgtttaactcttctgttgtag

SEQ ID NO: 1242583 - DNA, 22 bp, Artificial Sequence
  chemically synthesized
acaatacagtggctacaacaga

SEQ ID NO: 1242584 - DNA, 22 bp, Artificial Sequence
  chemically synthesized
catttacaatacagtggctaca

SEQ ID NO: 1242585 - DNA, 22 bp, Artificial Sequence
  chemically synthesized
aactcttctgttgtagccactg

SEQ ID NO: 1242586 - DNA, 22 bp, Artificial Sequence
  chemically synthesized
actcttctgttgtagccactgt

SEQ ID NO: 1242587 - DNA, 22 bp, Artificial Sequence
  chemically synthesized
gttgcatttacaatacagtggc

SEQ ID NO: 1242588 - DNA, 22 bp, Artificial Sequence
  chemically synthesized
agttgcatttacaatacagtgg

SEQ ID NO: 1242589 - DNA, 22 bp, Artificial Sequence
  chemically synthesized
ttctgttgtagccactgtattg

SEQ ID NO: 1242590 - DNA, 22 bp, Artificial Sequence
  chemically synthesized
ctgttgtagccactgtattgta

SEQ ID NO: 1242591 - DNA, 22 bp, Artificial Sequence
  chemically synthesized
tgttgtagccactgtattgtaa

SEQ ID NO: 1242592 - DNA, 22 bp, Artificial Sequence
  chemically synthesized
ttgtagccactgtattgtaaat

SEQ ID NO: 1242593 - DNA, 22 bp, Artificial Sequence
  chemically synthesized
tagccactgtattgtaaatgca

SEQ ID NO: 1242594 - DNA, 22 bp, Artificial Sequence
  chemically synthesized
tattgtaaatgcaactaaggtt

SEQ ID NO: 1242595 - DNA, 22 bp, Artificial Sequence
  chemically synthesized
ggcaaggaatacaaccttagtt

SEQ ID NO: 1242596 - DNA, 22 bp, Artificial Sequence
  chemically synthesized
taaatgcaactaaggttgtatt

SEQ ID NO: 1242597 - DNA, 22 bp, Artificial Sequence
  chemically synthesized
aggttgtattccttgcccaata

SEQ ID NO: 1242598 - DNA, 22 bp, Artificial Sequence
  chemically synthesized
aacgtcaaatgaacatattggg

SEQ ID NO: 1242599 - DNA, 22 bp, Artificial Sequence
  chemically synthesized
tattccttgcccaatatgttca

SEQ ID NO: 1242600 - DNA, 22 bp, Artificial Sequence
  chemically synthesized
caattgaacgtcaaatgaacat

SEQ ID NO: 1242601 - DNA, 22 bp, Artificial Sequence
  chemically synthesized
cttgcccaatatgttcatttga

SEQ ID NO: 1242602 - DNA, 22 bp, Artificial Sequence
  chemically synthesized
tccaattgaacgtcaaatgaac

SEQ ID NO: 1242603 - DNA, 22 bp, Artificial Sequence
  chemically synthesized
ctccaattgaacgtcaaatgaa

SEQ ID NO: 1242604 - DNA, 22 bp, Artificial Sequence
  chemically synthesized
gcccaatatgttcatttgacgt

SEQ ID NO: 1242605 - DNA, 22 bp, Artificial Sequence
  chemically synthesized
cccaatatgttcatttgacgtt

SEQ ID NO: 1242606 - DNA, 22 bp, Artificial Sequence
  chemically synthesized
acttctccaattgaacgtcaaa

SEQ ID NO: 1242607 - DNA, 22 bp, Artificial Sequence
  chemically synthesized
aacttctccaattgaacgtcaa

SEQ ID NO: 1242608 - DNA, 22 bp, Artificial Sequence
  chemically synthesized
taacttctccaattgaacgtca

SEQ ID NO: 1242609 - DNA, 22 bp, Artificial Sequence
  chemically synthesized
ttaacttctccaattgaacgtc

SEQ ID NO: 1242610 - DNA, 22 bp, Artificial Sequence
  chemically synthesized
tttaacttctccaattgaacgt

SEQ ID NO: 1242611 - DNA, 22 bp, Artificial Sequence
  chemically synthesized
ttttaacttctccaattgaacg

SEQ ID NO: 1242612 - DNA, 22 bp, Artificial Sequence
  chemically synthesized
tttttaacttctccaattgaac

SEQ ID NO: 1242613 - DNA, 22 bp, Artificial Sequence
  chemically synthesized
ttttttaacttctccaattgaa

SEQ ID NO: 1242614 - DNA, 22 bp, Artificial Sequence
  chemically synthesized
tttttttaacttctccaattga

SEQ ID NO: 1242615 - DNA, 22 bp, Artificial Sequence
  chemically synthesized
ttttttttaacttctccaattg

SEQ ID NO: 1242616 - DNA, 22 bp, Artificial Sequence
  chemically synthesized
tttttttttaacttctccaatt

SEQ ID NO: 1242617 - DNA, 22 bp, Artificial Sequence
  chemically synthesized
atttgacgttcaattggagaag

SEQ ID NO: 1242618 - DNA, 22 bp, Artificial Sequence
  chemically synthesized
ttttttttttaacttctccaat

SEQ ID NO: 1242619 - DNA, 22 bp, Artificial Sequence
  chemically synthesized
tttttttttttaacttctccaa

SEQ ID NO: 1242620 - DNA, 22 bp, Artificial Sequence
  chemically synthesized
ttttttttttttaacttctcca

SEQ ID NO: 1242621 - DNA, 22 bp, Artificial Sequence
  chemically synthesized
gacgttcaattggagaagttaa

SEQ ID NO: 1242622 - DNA, 22 bp, Artificial Sequence
  chemically synthesized
acgttcaattggagaagttaaa

SEQ ID NO: 1242623 - DNA, 22 bp, Artificial Sequence
  chemically synthesized
aattggagaagttaaaaaaaaa

SEQ ID NO: 1242624 - DNA, 22 bp, Artificial Sequence
  chemically synthesized
gagaagttaaaaaaaaaaaaaa

SEQ ID NO: 1242625 - DNA, 22 bp, Artificial Sequence
  chemically synthesized
aaaaaaaaaaaaagttgacttt

SEQ ID NO: 1242626 - DNA, 22 bp, Artificial Sequence
  chemically synthesized
gcaaatgggagaaaaataaagt

SEQ ID NO: 1242627 - DNA, 22 bp, Artificial Sequence
  chemically synthesized
actttatttttctcccatttgc

SEQ ID NO: 1242628 - DNA, 22 bp, Artificial Sequence
  chemically synthesized
tatttttctcccatttgctaga

SEQ ID NO: 1242629 - DNA, 22 bp, Artificial Sequence
  chemically synthesized
atttttctcccatttgctagat

SEQ ID NO: 1242630 - DNA, 22 bp, Artificial Sequence
  chemically synthesized
tttttctcccatttgctagatt

SEQ ID NO: 1242631 - DNA, 22 bp, Artificial Sequence
  chemically synthesized
aagtgacagtaaaaatctagca

SEQ ID NO: 1242632 - DNA, 22 bp, Artificial Sequence
  chemically synthesized
ttctcccatttgctagattttt

SEQ ID NO: 1242633 - DNA, 22 bp, Artificial Sequence
  chemically synthesized
tctcccatttgctagattttta

SEQ ID NO: 1242634 - DNA, 22 bp, Artificial Sequence
  chemically synthesized
ctcccatttgctagatttttac

SEQ ID NO: 1242635 - DNA, 22 bp, Artificial Sequence
  chemically synthesized
tctaaagtgacagtaaaaatct

SEQ ID NO: 1242636 - DNA, 22 bp, Artificial Sequence
  chemically synthesized
tcccatttgctagatttttact

SEQ ID NO: 1242637 - DNA, 22 bp, Artificial Sequence
  chemically synthesized
atctaaagtgacagtaaaaatc

SEQ ID NO: 1242638 - DNA, 22 bp, Artificial Sequence
  chemically synthesized
tatctaaagtgacagtaaaaat

SEQ ID NO: 1242639 - DNA, 22 bp, Artificial Sequence
  chemically synthesized
ccatttgctagatttttactgt

SEQ ID NO: 1242640 - DNA, 22 bp, Artificial Sequence
  chemically synthesized
ttatctaaagtgacagtaaaaa

SEQ ID NO: 1242641 - DNA, 22 bp, Artificial Sequence
  chemically synthesized
tttatctaaagtgacagtaaaa

SEQ ID NO: 1242642 - DNA, 22 bp, Artificial Sequence
  chemically synthesized
gctagatttttactgtcacttt

SEQ ID NO: 1242643 - DNA, 22 bp, Artificial Sequence
  chemically synthesized
ctagatttttactgtcacttta

SEQ ID NO: 1242644 - DNA, 22 bp, Artificial Sequence
  chemically synthesized
gatttttactgtcactttagat

SEQ ID NO: 1242645 - DNA, 22 bp, Artificial Sequence
  chemically synthesized
ttactgtcactttagataaaaa

SEQ ID NO: 1242646 - DNA, 22 bp, Artificial Sequence
  chemically synthesized
tactgtcactttagataaaaag

SEQ ID NO: 1242647 - DNA, 22 bp, Artificial Sequence
  chemically synthesized
actgtcactttagataaaaagt

SEQ ID NO: 1242648 - DNA, 22 bp, Artificial Sequence
  chemically synthesized
ctgtcactttagataaaaagtg

SEQ ID NO: 1242649 - DNA, 22 bp, Artificial Sequence
  chemically synthesized
tcactttagataaaaagtgtgt

SEQ ID NO: 1242650 - DNA, 22 bp, Artificial Sequence
  chemically synthesized
tagataaaaagtgtgtttatct

SEQ ID NO: 1242651 - DNA, 22 bp, Artificial Sequence
  chemically synthesized
agataaaaagtgtgtttatctt

SEQ ID NO: 1242652 - DNA, 22 bp, Artificial Sequence
  chemically synthesized
gataaaaagtgtgtttatcttg

SEQ ID NO: 1242653 - DNA, 22 bp, Artificial Sequence
  chemically synthesized
taatgaagaaaacaagataaac

SEQ ID NO: 1242654 - DNA, 22 bp, Artificial Sequence
  chemically synthesized
ataatgaagaaaacaagataaa

SEQ ID NO: 1242655 - DNA, 22 bp, Artificial Sequence
  chemically synthesized
tagcttataatgaagaaaacaa

SEQ ID NO: 1242656 - DNA, 22 bp, Artificial Sequence
  chemically synthesized
gaaattatagcttataatgaag

SEQ ID NO: 1242657 - DNA, 22 bp, Artificial Sequence
  chemically synthesized
atcttgttttcttcattataag

SEQ ID NO: 1242658 - DNA, 22 bp, Artificial Sequence
  chemically synthesized
tcttgttttcttcattataagc

SEQ ID NO: 1242659 - DNA, 22 bp, Artificial Sequence
  chemically synthesized
gttttcttcattataagctata

SEQ ID NO: 1242660 - DNA, 22 bp, Artificial Sequence
  chemically synthesized
ttttcttcattataagctataa

SEQ ID NO: 1242661 - DNA, 22 bp, Artificial Sequence
  chemically synthesized
tcttcattataagctataattt

SEQ ID NO: 1242662 - DNA, 22 bp, Artificial Sequence
  chemically synthesized
cttcattataagctataatttc

SEQ ID NO: 1242663 - DNA, 22 bp, Artificial Sequence
  chemically synthesized
aataaaccactggaaattatag

SEQ ID NO: 1242664 - DNA, 22 bp, Artificial Sequence
  chemically synthesized
ttcattataagctataatttcc

SEQ ID NO: 1242665 - DNA, 22 bp, Artificial Sequence
  chemically synthesized
cattataagctataatttccag

SEQ ID NO: 1242666 - DNA, 22 bp, Artificial Sequence
  chemically synthesized
attataagctataatttccagt

SEQ ID NO: 1242667 - DNA, 22 bp, Artificial Sequence
  chemically synthesized
taagctataatttccagtggtt

SEQ ID NO: 1242668 - DNA, 22 bp, Artificial Sequence
  chemically synthesized
gaaatgtctgaataaaccactg

SEQ ID NO: 1242669 - DNA, 22 bp, Artificial Sequence
  chemically synthesized
ggaaatgtctgaataaaccact

SEQ ID NO: 1242670 - DNA, 22 bp, Artificial Sequence
  chemically synthesized
tggaaatgtctgaataaaccac

SEQ ID NO: 1242671 - DNA, 22 bp, Artificial Sequence
  chemically synthesized
taatttccagtggtttattcag

SEQ ID NO: 1242672 - DNA, 22 bp, Artificial Sequence
  chemically synthesized
ttttggaaatgtctgaataaac

SEQ ID NO: 1242673 - DNA, 22 bp, Artificial Sequence
  chemically synthesized
gttttggaaatgtctgaataaa

SEQ ID NO: 1242674 - DNA, 22 bp, Artificial Sequence
  chemically synthesized
tgttttggaaatgtctgaataa

SEQ ID NO: 1242675 - DNA, 22 bp, Artificial Sequence
  chemically synthesized
ttgttttggaaatgtctgaata

SEQ ID NO: 1242676 - DNA, 22 bp, Artificial Sequence
  chemically synthesized
ccagtggtttattcagacattt

SEQ ID NO: 1242677 - DNA, 22 bp, Artificial Sequence
  chemically synthesized
tttttgttttggaaatgtctga

SEQ ID NO: 1242678 - DNA, 22 bp, Artificial Sequence
  chemically synthesized
cagtggtttattcagacatttc

SEQ ID NO: 1242679 - DNA, 22 bp, Artificial Sequence
  chemically synthesized
ctatttttgttttggaaatgtc

SEQ ID NO: 1242680 - DNA, 22 bp, Artificial Sequence
  chemically synthesized
actatttttgttttggaaatgt

SEQ ID NO: 1242681 - DNA, 22 bp, Artificial Sequence
  chemically synthesized
atttactatttttgttttggaa

SEQ ID NO: 1242682 - DNA, 22 bp, Artificial Sequence
  chemically synthesized
gatttactatttttgttttgga

SEQ ID NO: 1242683 - DNA, 22 bp, Artificial Sequence
  chemically synthesized
attcagacatttccaaaacaaa

SEQ ID NO: 1242684 - DNA, 22 bp, Artificial Sequence
  chemically synthesized
tgatttactatttttgttttgg

SEQ ID NO: 1242685 - DNA, 22 bp, Artificial Sequence
  chemically synthesized
ttcagacatttccaaaacaaaa

SEQ ID NO: 1242686 - DNA, 22 bp, Artificial Sequence
  chemically synthesized
ttgatttactatttttgttttg

SEQ ID NO: 1242687 - DNA, 22 bp, Artificial Sequence
  chemically synthesized
agacatttccaaaacaaaaata

SEQ ID NO: 1242688 - DNA, 22 bp, Artificial Sequence
  chemically synthesized
tttttgatttactatttttgtt

SEQ ID NO: 1242689 - DNA, 22 bp, Artificial Sequence
  chemically synthesized
ccaaaacaaaaatagtaaatca

SEQ ID NO: 1242690 - DNA, 22 bp, Artificial Sequence
  chemically synthesized
caaaacaaaaatagtaaatcaa

SEQ ID NO: 1242691 - DNA, 22 bp, Artificial Sequence
  chemically synthesized
acagggaactatttttgattta

SEQ ID NO: 1242692 - DNA, 22 bp, Artificial Sequence
  chemically synthesized
gttcacagggaactatttttga

SEQ ID NO: 1242693 - DNA, 22 bp, Artificial Sequence
  chemically synthesized
agttcacagggaactatttttg

SEQ ID NO: 1242694 - DNA, 22 bp, Artificial Sequence
  chemically synthesized
tagttcacagggaactattttt

SEQ ID NO: 1242695 - DNA, 22 bp, Artificial Sequence
  chemically synthesized
aaggtgacagttttagttcaca

SEQ ID NO: 1242696 - DNA, 22 bp, Artificial Sequence
  chemically synthesized
actaaaggtgacagttttagtt

SEQ ID NO: 1242697 - DNA, 22 bp, Artificial Sequence
  chemically synthesized
cctgtgaactaaaactgtcacc

SEQ ID NO: 1242698 - DNA, 22 bp, Artificial Sequence
  chemically synthesized
gaaacactaactaaaggtgaca

SEQ ID NO: 1242699 - DNA, 22 bp, Artificial Sequence
  chemically synthesized
tgaactaaaactgtcaccttta

SEQ ID NO: 1242700 - DNA, 22 bp, Artificial Sequence
  chemically synthesized
tagaaacactaactaaaggtga

SEQ ID NO: 1242701 - DNA, 22 bp, Artificial Sequence
  chemically synthesized
ctagaaacactaactaaaggtg

SEQ ID NO: 1242702 - DNA, 22 bp, Artificial Sequence
  chemically synthesized
tctagaaacactaactaaaggt

SEQ ID NO: 1242703 - DNA, 22 bp, Artificial Sequence
  chemically synthesized
ttctagaaacactaactaaagg

SEQ ID NO: 1242704 - DNA, 22 bp, Artificial Sequence
  chemically synthesized
aaactgtcacctttagttagtg

SEQ ID NO: 1242705 - DNA, 22 bp, Artificial Sequence
  chemically synthesized
tcacctttagttagtgtttcta

SEQ ID NO: 1242706 - DNA, 22 bp, Artificial Sequence
  chemically synthesized
aaatgcatttttctagaaacac

SEQ ID NO: 1242707 - DNA, 22 bp, Artificial Sequence
  chemically synthesized
aaaatgcatttttctagaaaca

SEQ ID NO: 1242708 - DNA, 22 bp, Artificial Sequence
  chemically synthesized
taaaatgcatttttctagaaac

SEQ ID NO: 1242709 - DNA, 22 bp, Artificial Sequence
  chemically synthesized
ttttaaaatgcatttttctaga

SEQ ID NO: 1242710 - DNA, 22 bp, Artificial Sequence
  chemically synthesized
tagttagtgtttctagaaaaat

SEQ ID NO: 1242711 - DNA, 22 bp, Artificial Sequence
  chemically synthesized
attttaaaatgcatttttctag

SEQ ID NO: 1242712 - DNA, 22 bp, Artificial Sequence
  chemically synthesized
agttagtgtttctagaaaaatg

SEQ ID NO: 1242713 - DNA, 22 bp, Artificial Sequence
  chemically synthesized
tattttaaaatgcatttttcta

SEQ ID NO: 1242714 - DNA, 22 bp, Artificial Sequence
  chemically synthesized
gttagtgtttctagaaaaatgc

SEQ ID NO: 1242715 - DNA, 22 bp, Artificial Sequence
  chemically synthesized
gtgtttctagaaaaatgcattt

SEQ ID NO: 1242716 - DNA, 22 bp, Artificial Sequence
  chemically synthesized
aactttattttaaaatgcattt

SEQ ID NO: 1242717 - DNA, 22 bp, Artificial Sequence
  chemically synthesized
ttcaactttattttaaaatgca

SEQ ID NO: 1242718 - DNA, 22 bp, Artificial Sequence
  chemically synthesized
attcaactttattttaaaatgc

SEQ ID NO: 1242719 - DNA, 22 bp, Artificial Sequence
  chemically synthesized
ctagaaaaatgcattttaaaat

SEQ ID NO: 1242720 - DNA, 22 bp, Artificial Sequence
  chemically synthesized
ttattcaactttattttaaaat

SEQ ID NO: 1242721 - DNA, 22 bp, Artificial Sequence
  chemically synthesized
tagaaaaatgcattttaaaata

SEQ ID NO: 1242722 - DNA, 22 bp, Artificial Sequence
  chemically synthesized
gaaaaatgcattttaaaataaa

SEQ ID NO: 1242723 - DNA, 22 bp, Artificial Sequence
  chemically synthesized
gctcttattcaactttatttta

SEQ ID NO: 1242724 - DNA, 22 bp, Artificial Sequence
  chemically synthesized
ggctcttattcaactttatttt

SEQ ID NO: 1242725 - DNA, 22 bp, Artificial Sequence
  chemically synthesized
tggctcttattcaactttattt

SEQ ID NO: 1242726 - DNA, 22 bp, Artificial Sequence
  chemically synthesized
ctttggctcttattcaacttta

SEQ ID NO: 1242727 - DNA, 22 bp, Artificial Sequence
  chemically synthesized
cctttggctcttattcaacttt

SEQ ID NO: 1242728 - DNA, 22 bp, Artificial Sequence
  chemically synthesized
tcctttggctcttattcaactt

SEQ ID NO: 1242729 - DNA, 22 bp, Artificial Sequence
  chemically synthesized
ctttcctttggctcttattcaa

SEQ ID NO: 1242730 - DNA, 22 bp, Artificial Sequence
  chemically synthesized
taaaataaagttgaataagagc

SEQ ID NO: 1242731 - DNA, 22 bp, Artificial Sequence
  chemically synthesized
tactttcctttggctcttattc

SEQ ID NO: 1242732 - DNA, 22 bp, Artificial Sequence
  chemically synthesized
aaaataaagttgaataagagcc

SEQ ID NO: 1242733 - DNA, 22 bp, Artificial Sequence
  chemically synthesized
aaataaagttgaataagagcca

SEQ ID NO: 1242734 - DNA, 22 bp, Artificial Sequence
  chemically synthesized
tcaactctactttcctttggct

SEQ ID NO: 1242735 - DNA, 22 bp, Artificial Sequence
  chemically synthesized
aataagagccaaaggaaagtag

SEQ ID NO: 1242736 - DNA, 22 bp, Artificial Sequence
  chemically synthesized
taagaaaaaaattgtcaactct

SEQ ID NO: 1242737 - DNA, 22 bp, Artificial Sequence
  chemically synthesized
gtaagaaaaaaattgtcaactc

SEQ ID NO: 1242738 - DNA, 22 bp, Artificial Sequence
  chemically synthesized
tgtaagaaaaaaattgtcaact

SEQ ID NO: 1242739 - DNA, 22 bp, Artificial Sequence
  chemically synthesized
agctttgtaagaaaaaaattgt

SEQ ID NO: 1242740 - DNA, 22 bp, Artificial Sequence
  chemically synthesized
gagctttgtaagaaaaaaattg

SEQ ID NO: 1242741 - DNA, 22 bp, Artificial Sequence
  chemically synthesized
tgagctttgtaagaaaaaaatt

SEQ ID NO: 1242742 - DNA, 22 bp, Artificial Sequence
  chemically synthesized
tttgagctttgtaagaaaaaaa

SEQ ID NO: 1242743 - DNA, 22 bp, Artificial Sequence
  chemically synthesized
ctttgagctttgtaagaaaaaa

SEQ ID NO: 1242744 - DNA, 22 bp, Artificial Sequence
  chemically synthesized
tctttgagctttgtaagaaaaa

SEQ ID NO: 1242745 - DNA, 22 bp, Artificial Sequence
  chemically synthesized
ttctttgagctttgtaagaaaa

SEQ ID NO: 1242746 - DNA, 22 bp, Artificial Sequence
  chemically synthesized
tttctttgagctttgtaagaaa

SEQ ID NO: 1242747 - DNA, 22 bp, Artificial Sequence
  chemically synthesized
acaatttttttcttacaaagct

SEQ ID NO: 1242748 - DNA, 22 bp, Artificial Sequence
  chemically synthesized
aattttttctttgagctttgta

SEQ ID NO: 1242749 - DNA, 22 bp, Artificial Sequence
  chemically synthesized
aaattttttctttgagctttgt

SEQ ID NO: 1242750 - DNA, 22 bp, Artificial Sequence
  chemically synthesized
taaattttttctttgagctttg

SEQ ID NO: 1242751 - DNA, 22 bp, Artificial Sequence
  chemically synthesized
ttttcttacaaagctcaaagaa

SEQ ID NO: 1242752 - DNA, 22 bp, Artificial Sequence
  chemically synthesized
tttcttacaaagctcaaagaaa

SEQ ID NO: 1242753 - DNA, 22 bp, Artificial Sequence
  chemically synthesized
ttcttacaaagctcaaagaaaa

SEQ ID NO: 1242754 - DNA, 22 bp, Artificial Sequence
  chemically synthesized
tcttacaaagctcaaagaaaaa

SEQ ID NO: 1242755 - DNA, 22 bp, Artificial Sequence
  chemically synthesized
cttacaaagctcaaagaaaaaa

SEQ ID NO: 1242756 - DNA, 22 bp, Artificial Sequence
  chemically synthesized
ttacaaagctcaaagaaaaaat

SEQ ID NO: 1242757 - DNA, 22 bp, Artificial Sequence
  chemically synthesized
acaaagctcaaagaaaaaattt

SEQ ID NO: 1242758 - DNA, 22 bp, Artificial Sequence
  chemically synthesized
caaagctcaaagaaaaaattta

SEQ ID NO: 1242759 - DNA, 22 bp, Artificial Sequence
  chemically synthesized
atagggcaattttaaatttttt

SEQ ID NO: 1242760 - DNA, 22 bp, Artificial Sequence
  chemically synthesized
tcatagggcaattttaaatttt

SEQ ID NO: 1242761 - DNA, 22 bp, Artificial Sequence
  chemically synthesized
ctcatagggcaattttaaattt

SEQ ID NO: 1242762 - DNA, 22 bp, Artificial Sequence
  chemically synthesized
tctcatagggcaattttaaatt

SEQ ID NO: 1242763 - DNA, 22 bp, Artificial Sequence
  chemically synthesized
aaagaaaaaatttaaaattgcc

SEQ ID NO: 1242764 - DNA, 22 bp, Artificial Sequence
  chemically synthesized
agattttctcatagggcaattt

SEQ ID NO: 1242765 - DNA, 22 bp, Artificial Sequence
  chemically synthesized
ttaagattttctcatagggcaa

SEQ ID NO: 1242766 - DNA, 22 bp, Artificial Sequence
  chemically synthesized
aaaattgccctatgagaaaatc

SEQ ID NO: 1242767 - DNA, 22 bp, Artificial Sequence
  chemically synthesized
aaattgccctatgagaaaatct

SEQ ID NO: 1242768 - DNA, 22 bp, Artificial Sequence
  chemically synthesized
ccctatgagaaaatcttaatag

SEQ ID NO: 1242769 - DNA, 22 bp, Artificial Sequence
  chemically synthesized
aaatgtcaggtacctattaaga

SEQ ID NO: 1242770 - DNA, 22 bp, Artificial Sequence
  chemically synthesized
ttgaaatgtcaggtacctatta

SEQ ID NO: 1242771 - DNA, 22 bp, Artificial Sequence
  chemically synthesized
tgagaaaatcttaataggtacc

SEQ ID NO: 1242772 - DNA, 22 bp, Artificial Sequence
  chemically synthesized
ctattgaaatgtcaggtaccta

SEQ ID NO: 1242773 - DNA, 22 bp, Artificial Sequence
  chemically synthesized
cctattgaaatgtcaggtacct

SEQ ID NO: 1242774 - DNA, 22 bp, Artificial Sequence
  chemically synthesized
tcctattgaaatgtcaggtacc

SEQ ID NO: 1242775 - DNA, 22 bp, Artificial Sequence
  chemically synthesized
ttcctattgaaatgtcaggtac

SEQ ID NO: 1242776 - DNA, 22 bp, Artificial Sequence
  chemically synthesized
atttttcctattgaaatgtcag

SEQ ID NO: 1242777 - DNA, 22 bp, Artificial Sequence
  chemically synthesized
aataggtacctgacatttcaat

SEQ ID NO: 1242778 - DNA, 22 bp, Artificial Sequence
  chemically synthesized
ataggtacctgacatttcaata

SEQ ID NO: 1242779 - DNA, 22 bp, Artificial Sequence
  chemically synthesized
taactaatttttcctattgaaa

SEQ ID NO: 1242780 - DNA, 22 bp, Artificial Sequence
  chemically synthesized
agcagttataactaatttttcc

SEQ ID NO: 1242781 - DNA, 22 bp, Artificial Sequence
  chemically synthesized
acatttcaataggaaaaattag

SEQ ID NO: 1242782 - DNA, 22 bp, Artificial Sequence
  chemically synthesized
aagcagttataactaatttttc

SEQ ID NO: 1242783 - DNA, 22 bp, Artificial Sequence
  chemically synthesized
tttaagcagttataactaattt

SEQ ID NO: 1242784 - DNA, 22 bp, Artificial Sequence
  chemically synthesized
tatttaagcagttataactaat

SEQ ID NO: 1242785 - DNA, 22 bp, Artificial Sequence
  chemically synthesized
caataggaaaaattagttataa

SEQ ID NO: 1242786 - DNA, 22 bp, Artificial Sequence
  chemically synthesized
ctatttaagcagttataactaa

SEQ ID NO: 1242787 - DNA, 22 bp, Artificial Sequence
  chemically synthesized
aataggaaaaattagttataac

SEQ ID NO: 1242788 - DNA, 22 bp, Artificial Sequence
  chemically synthesized
gtaaaaacttctatttaagcag

SEQ ID NO: 1242789 - DNA, 22 bp, Artificial Sequence
  chemically synthesized
ggtaaaaacttctatttaagca

SEQ ID NO: 1242790 - DNA, 22 bp, Artificial Sequence
  chemically synthesized
ttggtaaaaacttctatttaag

SEQ ID NO: 1242791 - DNA, 22 bp, Artificial Sequence
  chemically synthesized
gttataactgcttaaatagaag

SEQ ID NO: 1242792 - DNA, 22 bp, Artificial Sequence
  chemically synthesized
taactgcttaaatagaagtttt

SEQ ID NO: 1242793 - DNA, 22 bp, Artificial Sequence
  chemically synthesized
cttaaatagaagtttttaccaa

SEQ ID NO: 1242794 - DNA, 22 bp, Artificial Sequence
  chemically synthesized
tgtaataaagctcttggtaaaa

SEQ ID NO: 1242795 - DNA, 22 bp, Artificial Sequence
  chemically synthesized
aaatagaagtttttaccaagag

SEQ ID NO: 1242796 - DNA, 22 bp, Artificial Sequence
  chemically synthesized
aatagaagtttttaccaagagc

SEQ ID NO: 1242797 - DNA, 22 bp, Artificial Sequence
  chemically synthesized
tagttatgtaataaagctcttg

SEQ ID NO: 1242798 - DNA, 22 bp, Artificial Sequence
  chemically synthesized
gtagttatgtaataaagctctt

SEQ ID NO: 1242799 - DNA, 22 bp, Artificial Sequence
  chemically synthesized
tgtagttatgtaataaagctct

SEQ ID NO: 1242800 - DNA, 22 bp, Artificial Sequence
  chemically synthesized
ttgtagttatgtaataaagctc

SEQ ID NO: 1242801 - DNA, 22 bp, Artificial Sequence
  chemically synthesized
ttaccaagagctttattacata

SEQ ID NO: 1242802 - DNA, 22 bp, Artificial Sequence
  chemically synthesized
taccaagagctttattacataa

SEQ ID NO: 1242803 - DNA, 22 bp, Artificial Sequence
  chemically synthesized
accaagagctttattacataac

SEQ ID NO: 1242804 - DNA, 22 bp, Artificial Sequence
  chemically synthesized
ccaagagctttattacataact

SEQ ID NO: 1242805 - DNA, 22 bp, Artificial Sequence
  chemically synthesized
ggtaccttttgtagttatgtaa

SEQ ID NO: 1242806 - DNA, 22 bp, Artificial Sequence
  chemically synthesized
aattaggtaccttttgtagtta

SEQ ID NO: 1242807 - DNA, 22 bp, Artificial Sequence
  chemically synthesized
tattacataactacaaaaggta

SEQ ID NO: 1242808 - DNA, 22 bp, Artificial Sequence
  chemically synthesized
attacataactacaaaaggtac

SEQ ID NO: 1242809 - DNA, 22 bp, Artificial Sequence
  chemically synthesized
ttacataactacaaaaggtacc

SEQ ID NO: 1242810 - DNA, 22 bp, Artificial Sequence
  chemically synthesized
cataactacaaaaggtacctaa

SEQ ID NO: 1242811 - DNA, 22 bp, Artificial Sequence
  chemically synthesized
ataaagatgaatcactgaatta

SEQ ID NO: 1242812 - DNA, 22 bp, Artificial Sequence
  chemically synthesized
caaaaggtacctaattcagtga

SEQ ID NO: 1242813 - DNA, 22 bp, Artificial Sequence
  chemically synthesized
ctgataaagatgaatcactgaa

SEQ ID NO: 1242814 - DNA, 22 bp, Artificial Sequence
  chemically synthesized
gctgataaagatgaatcactga

SEQ ID NO: 1242815 - DNA, 22 bp, Artificial Sequence
  chemically synthesized
attcagtgattcatctttatca

SEQ ID NO: 1242816 - DNA, 22 bp, Artificial Sequence
  chemically synthesized
gcaaatgtttgctgataaagat

SEQ ID NO: 1242817 - DNA, 22 bp, Artificial Sequence
  chemically synthesized
agtgattcatctttatcagcaa

SEQ ID NO: 1242818 - DNA, 22 bp, Artificial Sequence
  chemically synthesized
caattagcaaatgtttgctgat

SEQ ID NO: 1242819 - DNA, 22 bp, Artificial Sequence
  chemically synthesized
acaattagcaaatgtttgctga

SEQ ID NO: 1242820 - DNA, 22 bp, Artificial Sequence
  chemically synthesized
tttacaattagcaaatgtttgc

SEQ ID NO: 1242821 - DNA, 22 bp, Artificial Sequence
  chemically synthesized
atctttatcagcaaacatttgc

SEQ ID NO: 1242822 - DNA, 22 bp, Artificial Sequence
  chemically synthesized
tatcagcaaacatttgctaatt

SEQ ID NO: 1242823 - DNA, 22 bp, Artificial Sequence
  chemically synthesized
atcagcaaacatttgctaattg

SEQ ID NO: 1242824 - DNA, 22 bp, Artificial Sequence
  chemically synthesized
tcagcaaacatttgctaattgt

SEQ ID NO: 1242825 - DNA, 22 bp, Artificial Sequence
  chemically synthesized
tacaggattgtttacaattagc

SEQ ID NO: 1242826 - DNA, 22 bp, Artificial Sequence
  chemically synthesized
gtacaggattgtttacaattag

SEQ ID NO: 1242827 - DNA, 22 bp, Artificial Sequence
  chemically synthesized
tgtacaggattgtttacaatta

SEQ ID NO: 1242828 - DNA, 22 bp, Artificial Sequence
  chemically synthesized
gctaattgtaaacaatcctgta

SEQ ID NO: 1242829 - DNA, 22 bp, Artificial Sequence
  chemically synthesized
ctaattgtaaacaatcctgtac

SEQ ID NO: 1242830 - DNA, 22 bp, Artificial Sequence
  chemically synthesized
attgtaaacaatcctgtacaaa

SEQ ID NO: 1242831 - DNA, 22 bp, Artificial Sequence
  chemically synthesized
aaataaaaatattttgtacagg

SEQ ID NO: 1242832 - DNA, 22 bp, Artificial Sequence
  chemically synthesized
gaaataaaaatattttgtacag

SEQ ID NO: 1242833 - DNA, 22 bp, Artificial Sequence
  chemically synthesized
tgaaataaaaatattttgtaca

SEQ ID NO: 1242834 - DNA, 22 bp, Artificial Sequence
  chemically synthesized
taaacaatcctgtacaaaatat

SEQ ID NO: 1242835 - DNA, 22 bp, Artificial Sequence
  chemically synthesized
tttgaaataaaaatattttgta

SEQ ID NO: 1242836 - DNA, 22 bp, Artificial Sequence
  chemically synthesized
cctctttgaaataaaaatattt

SEQ ID NO: 1242837 - DNA, 22 bp, Artificial Sequence
  chemically synthesized
ctacctctttgaaataaaaata

SEQ ID NO: 1242838 - DNA, 22 bp, Artificial Sequence
  chemically synthesized
tacaaaatatttttatttcaaa

SEQ ID NO: 1242839 - DNA, 22 bp, Artificial Sequence
  chemically synthesized
gaaagttgctacctctttgaaa

SEQ ID NO: 1242840 - DNA, 22 bp, Artificial Sequence
  chemically synthesized
ggaaagttgctacctctttgaa

SEQ ID NO: 1242841 - DNA, 22 bp, Artificial Sequence
  chemically synthesized
tggaaagttgctacctctttga

SEQ ID NO: 1242842 - DNA, 22 bp, Artificial Sequence
  chemically synthesized
ttggaaagttgctacctctttg

SEQ ID NO: 1242843 - DNA, 22 bp, Artificial Sequence
  chemically synthesized
ttatttcaaagaggtagcaact

SEQ ID NO: 1242844 - DNA, 22 bp, Artificial Sequence
  chemically synthesized
tatttcaaagaggtagcaactt

SEQ ID NO: 1242845 - DNA, 22 bp, Artificial Sequence
  chemically synthesized
aatatttttggaaagttgctac

SEQ ID NO: 1242846 - DNA, 22 bp, Artificial Sequence
  chemically synthesized
atttcaaagaggtagcaacttt

SEQ ID NO: 1242847 - DNA, 22 bp, Artificial Sequence
  chemically synthesized
tttcaaagaggtagcaactttc

SEQ ID NO: 1242848 - DNA, 22 bp, Artificial Sequence
  chemically synthesized
gttcaatatttttggaaagttg

SEQ ID NO: 1242849 - DNA, 22 bp, Artificial Sequence
  chemically synthesized
caaagaggtagcaactttccaa

SEQ ID NO: 1242850 - DNA, 22 bp, Artificial Sequence
  chemically synthesized
ggttcaatatttttggaaagtt

SEQ ID NO: 1242851 - DNA, 22 bp, Artificial Sequence
  chemically synthesized
aaagaggtagcaactttccaaa

SEQ ID NO: 1242852 - DNA, 22 bp, Artificial Sequence
  chemically synthesized
tggttcaatatttttggaaagt

SEQ ID NO: 1242853 - DNA, 22 bp, Artificial Sequence
  chemically synthesized
ttggttcaatatttttggaaag

SEQ ID NO: 1242854 - DNA, 22 bp, Artificial Sequence
  chemically synthesized
cttttggttcaatatttttgga

SEQ ID NO: 1242855 - DNA, 22 bp, Artificial Sequence
  chemically synthesized
ccttttggttcaatatttttgg

SEQ ID NO: 1242856 - DNA, 22 bp, Artificial Sequence
  chemically synthesized
aatttccttttggttcaatatt

SEQ ID NO: 1242857 - DNA, 22 bp, Artificial Sequence
  chemically synthesized
caatttccttttggttcaatat

SEQ ID NO: 1242858 - DNA, 22 bp, Artificial Sequence
  chemically synthesized
tccaaaaatattgaaccaaaag

SEQ ID NO: 1242859 - DNA, 22 bp, Artificial Sequence
  chemically synthesized
ccaaaaatattgaaccaaaagg

SEQ ID NO: 1242860 - DNA, 22 bp, Artificial Sequence
  chemically synthesized
caaaaatattgaaccaaaagga

SEQ ID NO: 1242861 - DNA, 22 bp, Artificial Sequence
  chemically synthesized
aaccaaggtcatttcaatttcc

SEQ ID NO: 1242862 - DNA, 22 bp, Artificial Sequence
  chemically synthesized
aaaccaaggtcatttcaatttc

SEQ ID NO: 1242863 - DNA, 22 bp, Artificial Sequence
  chemically synthesized
taaaccaaggtcatttcaattt

SEQ ID NO: 1242864 - DNA, 22 bp, Artificial Sequence
  chemically synthesized
aaccaaaaggaaattgaaatga

SEQ ID NO: 1242865 - DNA, 22 bp, Artificial Sequence
  chemically synthesized
ataatgatattttaaaccaagg

SEQ ID NO: 1242866 - DNA, 22 bp, Artificial Sequence
  chemically synthesized
aaatgaccttggtttaaaatat

SEQ ID NO: 1242867 - DNA, 22 bp, Artificial Sequence
  chemically synthesized
aagctgataatgatattttaaa

SEQ ID NO: 1242868 - DNA, 22 bp, Artificial Sequence
  chemically synthesized
caagctgataatgatattttaa

SEQ ID NO: 1242869 - DNA, 22 bp, Artificial Sequence
  chemically synthesized
tcaagctgataatgatatttta

SEQ ID NO: 1242870 - DNA, 22 bp, Artificial Sequence
  chemically synthesized
ttcaagctgataatgatatttt

SEQ ID NO: 1242871 - DNA, 22 bp, Artificial Sequence
  chemically synthesized
cacttttcaagctgataatgat

SEQ ID NO: 1242872 - DNA, 22 bp, Artificial Sequence
  chemically synthesized
ccacttttcaagctgataatga

SEQ ID NO: 1242873 - DNA, 22 bp, Artificial Sequence
  chemically synthesized
ggtttaaaatatcattatcagc

SEQ ID NO: 1242874 - DNA, 22 bp, Artificial Sequence
  chemically synthesized
gtttaaaatatcattatcagct

SEQ ID NO: 1242875 - DNA, 22 bp, Artificial Sequence
  chemically synthesized
aaaatatcattatcagcttgaa

SEQ ID NO: 1242876 - DNA, 22 bp, Artificial Sequence
  chemically synthesized
aaatatcattatcagcttgaaa

SEQ ID NO: 1242877 - DNA, 22 bp, Artificial Sequence
  chemically synthesized
atagtttccacttttcaagctg

SEQ ID NO: 1242878 - DNA, 22 bp, Artificial Sequence
  chemically synthesized
gatagtttccacttttcaagct

SEQ ID NO: 1242879 - DNA, 22 bp, Artificial Sequence
  chemically synthesized
tttgatagtttccacttttcaa

SEQ ID NO: 1242880 - DNA, 22 bp, Artificial Sequence
  chemically synthesized
actatttgatagtttccacttt

SEQ ID NO: 1242881 - DNA, 22 bp, Artificial Sequence
  chemically synthesized
tcagcttgaaaagtggaaacta

SEQ ID NO: 1242882 - DNA, 22 bp, Artificial Sequence
  chemically synthesized
gttaactatttgatagtttcca

SEQ ID NO: 1242883 - DNA, 22 bp, Artificial Sequence
  chemically synthesized
gaaaagtggaaactatcaaata

SEQ ID NO: 1242884 - DNA, 22 bp, Artificial Sequence
  chemically synthesized
aaaagtggaaactatcaaatag

SEQ ID NO: 1242885 - DNA, 22 bp, Artificial Sequence
  chemically synthesized
aaaagttggttaactatttgat

SEQ ID NO: 1242886 - DNA, 22 bp, Artificial Sequence
  chemically synthesized
aaaaagttggttaactatttga

SEQ ID NO: 1242887 - DNA, 22 bp, Artificial Sequence
  chemically synthesized
taaaaagttggttaactatttg

SEQ ID NO: 1242888 - DNA, 22 bp, Artificial Sequence
  chemically synthesized
ttaaaaagttggttaactattt

SEQ ID NO: 1242889 - DNA, 22 bp, Artificial Sequence
  chemically synthesized
tcaaatagttaaccaacttttt

SEQ ID NO: 1242890 - DNA, 22 bp, Artificial Sequence
  chemically synthesized
accaactttttaaaagattggt

SEQ ID NO: 1242891 - DNA, 22 bp, Artificial Sequence
  chemically synthesized
agccaggtgagtgagcaccaat

SEQ ID NO: 1242892 - DNA, 22 bp, Artificial Sequence
  chemically synthesized
tttaaaagattggtgctcactc

SEQ ID NO: 1242893 - DNA, 22 bp, Artificial Sequence
  chemically synthesized
ttaaaagattggtgctcactca

SEQ ID NO: 1242894 - DNA, 22 bp, Artificial Sequence
  chemically synthesized
taaaagattggtgctcactcac

SEQ ID NO: 1242895 - DNA, 22 bp, Artificial Sequence
  chemically synthesized
aaaagattggtgctcactcacc

SEQ ID NO: 1242896 - DNA, 22 bp, Artificial Sequence
  chemically synthesized
aaagattggtgctcactcacct

SEQ ID NO: 1242897 - DNA, 22 bp, Artificial Sequence
  chemically synthesized
gtgctcactcacctggctgaat

SEQ ID NO: 1242898 - DNA, 22 bp, Artificial Sequence
  chemically synthesized
aaagaggtaggtcattcagcca

SEQ ID NO: 1242899 - DNA, 22 bp, Artificial Sequence
  chemically synthesized
actcacctggctgaatgaccta

SEQ ID NO: 1242900 - DNA, 22 bp, Artificial Sequence
  chemically synthesized
aggttcaaagaggtaggtcatt

SEQ ID NO: 1242901 - DNA, 22 bp, Artificial Sequence
  chemically synthesized
aaggttcaaagaggtaggtcat

SEQ ID NO: 1242902 - DNA, 22 bp, Artificial Sequence
  chemically synthesized
acctggctgaatgacctacctc

SEQ ID NO: 1242903 - DNA, 22 bp, Artificial Sequence
  chemically synthesized
aatttaaggttcaaagaggtag

SEQ ID NO: 1242904 - DNA, 22 bp, Artificial Sequence
  chemically synthesized
aaatttaaggttcaaagaggta

SEQ ID NO: 1242905 - DNA, 22 bp, Artificial Sequence
  chemically synthesized
gctgaatgacctacctctttga

SEQ ID NO: 1242906 - DNA, 22 bp, Artificial Sequence
  chemically synthesized
tttaaatttaaggttcaaagag

SEQ ID NO: 1242907 - DNA, 22 bp, Artificial Sequence
  chemically synthesized
aatgacctacctctttgaacct

SEQ ID NO: 1242908 - DNA, 22 bp, Artificial Sequence
  chemically synthesized
cctctttgaaccttaaatttaa

SEQ ID NO: 1242909 - DNA, 22 bp, Artificial Sequence
  chemically synthesized
tttgaaccttaaatttaaataa

SEQ ID NO: 1242910 - DNA, 22 bp, Artificial Sequence
  chemically synthesized
tgaaccttaaatttaaataatg

SEQ ID NO: 1242911 - DNA, 22 bp, Artificial Sequence
  chemically synthesized
gaaccttaaatttaaataatgg

SEQ ID NO: 1242912 - DNA, 22 bp, Artificial Sequence
  chemically synthesized
atgtggaccgagccattattta

SEQ ID NO: 1242913 - DNA, 22 bp, Artificial Sequence
  chemically synthesized
aaccttaaatttaaataatggc

SEQ ID NO: 1242914 - DNA, 22 bp, Artificial Sequence
  chemically synthesized
aaatttaaataatggctcggtc

SEQ ID NO: 1242915 - DNA, 22 bp, Artificial Sequence
  chemically synthesized
aatttaaataatggctcggtcc

SEQ ID NO: 1242916 - DNA, 22 bp, Artificial Sequence
  chemically synthesized
aaataatggctcggtccacatt

SEQ ID NO: 1242917 - DNA, 22 bp, Artificial Sequence
  chemically synthesized
aataatggctcggtccacatta

SEQ ID NO: 1242918 - DNA, 22 bp, Artificial Sequence
  chemically synthesized
aaatcaagagaaggttaatgtg

SEQ ID NO: 1242919 - DNA, 22 bp, Artificial Sequence
  chemically synthesized
cagtctaaaatcaagagaaggt

SEQ ID NO: 1242920 - DNA, 22 bp, Artificial Sequence
  chemically synthesized
ggtccacattaaccttctcttg

SEQ ID NO: 1242921 - DNA, 22 bp, Artificial Sequence
  chemically synthesized
gatattacagtctaaaatcaag

SEQ ID NO: 1242922 - DNA, 22 bp, Artificial Sequence
  chemically synthesized
accttctcttgattttagactg

SEQ ID NO: 1242923 - DNA, 22 bp, Artificial Sequence
  chemically synthesized
ccatattggatattacagtcta

SEQ ID NO: 1242924 - DNA, 22 bp, Artificial Sequence
  chemically synthesized
ctcttgattttagactgtaata

SEQ ID NO: 1242925 - DNA, 22 bp, Artificial Sequence
  chemically synthesized
tcttgattttagactgtaatat

SEQ ID NO: 1242926 - DNA, 22 bp, Artificial Sequence
  chemically synthesized
ttgattttagactgtaatatcc

SEQ ID NO: 1242927 - DNA, 22 bp, Artificial Sequence
  chemically synthesized
aattcccatattggatattaca

SEQ ID NO: 1242928 - DNA, 22 bp, Artificial Sequence
  chemically synthesized
aaattcccatattggatattac

SEQ ID NO: 1242929 - DNA, 22 bp, Artificial Sequence
  chemically synthesized
gattttagactgtaatatccaa

SEQ ID NO: 1242930 - DNA, 22 bp, Artificial Sequence
  chemically synthesized
attttagactgtaatatccaat

SEQ ID NO: 1242931 - DNA, 22 bp, Artificial Sequence
  chemically synthesized
cttaaattcccatattggatat

SEQ ID NO: 1242932 - DNA, 22 bp, Artificial Sequence
  chemically synthesized
gcttaaattcccatattggata

SEQ ID NO: 1242933 - DNA, 22 bp, Artificial Sequence
  chemically synthesized
tgcttaaattcccatattggat

SEQ ID NO: 1242934 - DNA, 22 bp, Artificial Sequence
  chemically synthesized
tagactgtaatatccaatatgg

SEQ ID NO: 1242935 - DNA, 22 bp, Artificial Sequence
  chemically synthesized
ttgcttaaattcccatattgga

SEQ ID NO: 1242936 - DNA, 22 bp, Artificial Sequence
  chemically synthesized
agactgtaatatccaatatggg

SEQ ID NO: 1242937 - DNA, 22 bp, Artificial Sequence
  chemically synthesized
gactgtaatatccaatatggga

SEQ ID NO: 1242938 - DNA, 22 bp, Artificial Sequence
  chemically synthesized
agtttttgcttaaattcccata

SEQ ID NO: 1242939 - DNA, 22 bp, Artificial Sequence
  chemically synthesized
aagtttttgcttaaattcccat

SEQ ID NO: 1242940 - DNA, 22 bp, Artificial Sequence
  chemically synthesized
taatatccaatatgggaattta

SEQ ID NO: 1242941 - DNA, 22 bp, Artificial Sequence
  chemically synthesized
taagtttttgcttaaattccca

SEQ ID NO: 1242942 - DNA, 22 bp, Artificial Sequence
  chemically synthesized
atgtaactttaagtttttgctt

SEQ ID NO: 1242943 - DNA, 22 bp, Artificial Sequence
  chemically synthesized
gatgtaactttaagtttttgct

SEQ ID NO: 1242944 - DNA, 22 bp, Artificial Sequence
  chemically synthesized
tgatgtaactttaagtttttgc

SEQ ID NO: 1242945 - DNA, 22 bp, Artificial Sequence
  chemically synthesized
ttgatgtaactttaagtttttg

SEQ ID NO: 1242946 - DNA, 22 bp, Artificial Sequence
  chemically synthesized
catttttgatgtaactttaagt

SEQ ID NO: 1242947 - DNA, 22 bp, Artificial Sequence
  chemically synthesized
ccatttttgatgtaactttaag

SEQ ID NO: 1242948 - DNA, 22 bp, Artificial Sequence
  chemically synthesized
tccatttttgatgtaactttaa

SEQ ID NO: 1242949 - DNA, 22 bp, Artificial Sequence
  chemically synthesized
ttccatttttgatgtaacttta

SEQ ID NO: 1242950 - DNA, 22 bp, Artificial Sequence
  chemically synthesized
aagcaaaaacttaaagttacat

SEQ ID NO: 1242951 - DNA, 22 bp, Artificial Sequence
  chemically synthesized
agcaaaaacttaaagttacatc

SEQ ID NO: 1242952 - DNA, 22 bp, Artificial Sequence
  chemically synthesized
catatttttccatttttgatgt

SEQ ID NO: 1242953 - DNA, 22 bp, Artificial Sequence
  chemically synthesized
tccatatttttccatttttgat

SEQ ID NO: 1242954 - DNA, 22 bp, Artificial Sequence
  chemically synthesized
tctccatatttttccatttttg

SEQ ID NO: 1242955 - DNA, 22 bp, Artificial Sequence
  chemically synthesized
aaagttacatcaaaaatggaaa

SEQ ID NO: 1242956 - DNA, 22 bp, Artificial Sequence
  chemically synthesized
aagttacatcaaaaatggaaaa

SEQ ID NO: 1242957 - DNA, 22 bp, Artificial Sequence
  chemically synthesized
gcctctctccatatttttccat

SEQ ID NO: 1242958 - DNA, 22 bp, Artificial Sequence
  chemically synthesized
ggcctctctccatatttttcca

SEQ ID NO: 1242959 - DNA, 22 bp, Artificial Sequence
  chemically synthesized
catcaaaaatggaaaaatatgg

SEQ ID NO: 1242960 - DNA, 22 bp, Artificial Sequence
  chemically synthesized
gtcatcttggcctctctccata

SEQ ID NO: 1242961 - DNA, 22 bp, Artificial Sequence
  chemically synthesized
gttggtcatcttggcctctctc

SEQ ID NO: 1242962 - DNA, 22 bp, Artificial Sequence
  chemically synthesized
ctagttggtcatcttggcctct

SEQ ID NO: 1242963 - DNA, 22 bp, Artificial Sequence
  chemically synthesized
ttcctagttggtcatcttggcc

SEQ ID NO: 1242964 - DNA, 22 bp, Artificial Sequence
  chemically synthesized
cagctgttcctagttggtcatc

SEQ ID NO: 1242965 - DNA, 22 bp, Artificial Sequence
  chemically synthesized
actgcagctgttcctagttggt

SEQ ID NO: 1242966 - DNA, 22 bp, Artificial Sequence
  chemically synthesized
tgactgcagctgttcctagttg

SEQ ID NO: 1242967 - DNA, 22 bp, Artificial Sequence
  chemically synthesized
agtgggagcctctgactgcagc

SEQ ID NO: 1242968 - DNA, 22 bp, Artificial Sequence
  chemically synthesized
tcagtgggagcctctgactgca

SEQ ID NO: 1242969 - DNA, 22 bp, Artificial Sequence
  chemically synthesized
ctcagtgggagcctctgactgc

SEQ ID NO: 1242970 - DNA, 22 bp, Artificial Sequence
  chemically synthesized
ttctcagtgggagcctctgact

SEQ ID NO: 1242971 - DNA, 22 bp, Artificial Sequence
  chemically synthesized
ggaacagctgcagtcagaggct

SEQ ID NO: 1242972 - DNA, 22 bp, Artificial Sequence
  chemically synthesized
gttcttctcagtgggagcctct

SEQ ID NO: 1242973 - DNA, 22 bp, Artificial Sequence
  chemically synthesized
ggttcttctcagtgggagcctc

SEQ ID NO: 1242974 - DNA, 22 bp, Artificial Sequence
  chemically synthesized
tggttcttctcagtgggagcct

SEQ ID NO: 1242975 - DNA, 22 bp, Artificial Sequence
  chemically synthesized
cagtcagaggctcccactgaga

SEQ ID NO: 1242976 - DNA, 22 bp, Artificial Sequence
  chemically synthesized
acggttttggttcttctcagtg

SEQ ID NO: 1242977 - DNA, 22 bp, Artificial Sequence
  chemically synthesized
actcacggttttggttcttctc

SEQ ID NO: 1242978 - DNA, 22 bp, Artificial Sequence
  chemically synthesized
ccactgagaagaaccaaaaccg

SEQ ID NO: 1242979 - DNA, 22 bp, Artificial Sequence
  chemically synthesized
gtgcaggattcactcacggttt

SEQ ID NO: 1242980 - DNA, 22 bp, Artificial Sequence
  chemically synthesized
agaagaaccaaaaccgtgagtg

SEQ ID NO: 1242981 - DNA, 22 bp, Artificial Sequence
  chemically synthesized
ctggtgcaggattcactcacgg

SEQ ID NO: 1242982 - DNA, 22 bp, Artificial Sequence
  chemically synthesized
ttgctggtgcaggattcactca

SEQ ID NO: 1242983 - DNA, 22 bp, Artificial Sequence
  chemically synthesized
tgttgctggtgcaggattcact

SEQ ID NO: 1242984 - DNA, 22 bp, Artificial Sequence
  chemically synthesized
gacacctctgttgctggtgcag

SEQ ID NO: 1242985 - DNA, 22 bp, Artificial Sequence
  chemically synthesized
caccagcaacagaggtgtccag

SEQ ID NO: 1242986 - DNA, 22 bp, Artificial Sequence
  chemically synthesized
gtcagtcccagtgagagaacct

SEQ ID NO: 1242987 - DNA, 22 bp, Artificial Sequence
  chemically synthesized
cctagtcagtcccagtgagaga

SEQ ID NO: 1242988 - DNA, 22 bp, Artificial Sequence
  chemically synthesized
atgccaactgcctagtcagtcc

SEQ ID NO: 1242989 - DNA, 22 bp, Artificial Sequence
  chemically synthesized
tcatgccaactgcctagtcagt

SEQ ID NO: 1242990 - DNA, 22 bp, Artificial Sequence
  chemically synthesized
tctcactgggactgactaggca

SEQ ID NO: 1242991 - DNA, 22 bp, Artificial Sequence
  chemically synthesized
tcactgggactgactaggcagt

SEQ ID NO: 1242992 - DNA, 22 bp, Artificial Sequence
  chemically synthesized
cgctctcatgccaactgcctag

SEQ ID NO: 1242993 - DNA, 22 bp, Artificial Sequence
  chemically synthesized
actgggactgactaggcagttg

SEQ ID NO: 1242994 - DNA, 22 bp, Artificial Sequence
  chemically synthesized
gcgctctcatgccaactgccta

SEQ ID NO: 1242995 - DNA, 22 bp, Artificial Sequence
  chemically synthesized
cttgcgctctcatgccaactgc

SEQ ID NO: 1242996 - DNA, 22 bp, Artificial Sequence
  chemically synthesized
ggactgactaggcagttggcat

SEQ ID NO: 1242997 - DNA, 22 bp, Artificial Sequence
  chemically synthesized
ccttgcgctctcatgccaactg

SEQ ID NO: 1242998 - DNA, 22 bp, Artificial Sequence
  chemically synthesized
tccttgcgctctcatgccaact

SEQ ID NO: 1242999 - DNA, 22 bp, Artificial Sequence
  chemically synthesized
ttccttgcgctctcatgccaac

SEQ ID NO: 1243000 - DNA, 22 bp, Artificial Sequence
  chemically synthesized
cttttccttgcgctctcatgcc

SEQ ID NO: 1243001 - DNA, 22 bp, Artificial Sequence
  chemically synthesized
actaggcagttggcatgagagc

SEQ ID NO: 1243002 - DNA, 22 bp, Artificial Sequence
  chemically synthesized
ggcagttggcatgagagcgcaa

SEQ ID NO: 1243003 - DNA, 22 bp, Artificial Sequence
  chemically synthesized
gcatgagagcgcaaggaaaagc

SEQ ID NO: 1243004 - DNA, 22 bp, Artificial Sequence
  chemically synthesized
ccaggtgggccatggcaccacc

SEQ ID NO: 1243005 - DNA, 22 bp, Artificial Sequence
  chemically synthesized
gctcccaggtgggccatggcac

SEQ ID NO: 1243006 - DNA, 22 bp, Artificial Sequence
  chemically synthesized
ggctcccaggtgggccatggca

SEQ ID NO: 1243007 - DNA, 22 bp, Artificial Sequence
  chemically synthesized
tcgcgtttggctcccaggtggg

SEQ ID NO: 1243008 - DNA, 22 bp, Artificial Sequence
  chemically synthesized
gtcgcgtttggctcccaggtgg

SEQ ID NO: 1243009 - DNA, 22 bp, Artificial Sequence
  chemically synthesized
ccttgtcgcgtttggctcccag

SEQ ID NO: 1243010 - DNA, 22 bp, Artificial Sequence
  chemically synthesized
cccttgtcgcgtttggctccca

SEQ ID NO: 1243011 - DNA, 22 bp, Artificial Sequence
  chemically synthesized
ggagtgggagcttcccttgtcg

SEQ ID NO: 1243012 - DNA, 22 bp, Artificial Sequence
  chemically synthesized
ggagccaaacgcgacaagggaa

SEQ ID NO: 1243013 - DNA, 22 bp, Artificial Sequence
  chemically synthesized
gctgggagtgggagcttccctt

SEQ ID NO: 1243014 - DNA, 22 bp, Artificial Sequence
  chemically synthesized
ggctgggagtgggagcttccct

SEQ ID NO: 1243015 - DNA, 22 bp, Artificial Sequence
  chemically synthesized
ccttggctgggagtgggagctt

SEQ ID NO: 1243016 - DNA, 22 bp, Artificial Sequence
  chemically synthesized
cctcccttggctgggagtggga

SEQ ID NO: 1243017 - DNA, 22 bp, Artificial Sequence
  chemically synthesized
actacctcccttggctgggagt

SEQ ID NO: 1243018 - DNA, 22 bp, Artificial Sequence
  chemically synthesized
ccactcccagccaagggaggta

SEQ ID NO: 1243019 - DNA, 22 bp, Artificial Sequence
  chemically synthesized
ccagccaagggaggtagtgagt

SEQ ID NO: 1243020 - DNA, 22 bp, Artificial Sequence
  chemically synthesized
ccaggcagggtaggacaatcac

SEQ ID NO: 1243021 - DNA, 22 bp, Artificial Sequence
  chemically synthesized
cccaggcagggtaggacaatca

SEQ ID NO: 1243022 - DNA, 22 bp, Artificial Sequence
  chemically synthesized
tggaaaaagaaagatttcccag

SEQ ID NO: 1243023 - DNA, 22 bp, Artificial Sequence
  chemically synthesized
tcctaccctgcctgggaaatct

SEQ ID NO: 1243024 - DNA, 22 bp, Artificial Sequence
  chemically synthesized
ccctgcctgggaaatctttctt

SEQ ID NO: 1243025 - DNA, 22 bp, Artificial Sequence
  chemically synthesized
cacagatctgtggaaaaagaaa

SEQ ID NO: 1243026 - DNA, 22 bp, Artificial Sequence
  chemically synthesized
cctgggaaatctttctttttcc

SEQ ID NO: 1243027 - DNA, 22 bp, Artificial Sequence
  chemically synthesized
ggaaatctttctttttccacag

SEQ ID NO: 1243028 - DNA, 22 bp, Artificial Sequence
  chemically synthesized
cgggttgcacagatctgtggaa

SEQ ID NO: 1243029 - DNA, 22 bp, Artificial Sequence
  chemically synthesized
atctgcgggttgcacagatctg

SEQ ID NO: 1243030 - DNA, 22 bp, Artificial Sequence
  chemically synthesized
tctttttccacagatctgtgca

SEQ ID NO: 1243031 - DNA, 22 bp, Artificial Sequence
  chemically synthesized
ctttttccacagatctgtgcaa

SEQ ID NO: 1243032 - DNA, 22 bp, Artificial Sequence
  chemically synthesized
ctgatctgcgggttgcacagat

SEQ ID NO: 1243033 - DNA, 22 bp, Artificial Sequence
  chemically synthesized
tttttccacagatctgtgcaac

SEQ ID NO: 1243034 - DNA, 22 bp, Artificial Sequence
  chemically synthesized
tttccacagatctgtgcaaccc

SEQ ID NO: 1243035 - DNA, 22 bp, Artificial Sequence
  chemically synthesized
ttccacagatctgtgcaacccg

SEQ ID NO: 1243036 - DNA, 22 bp, Artificial Sequence
  chemically synthesized
tccacagatctgtgcaacccgc

SEQ ID NO: 1243037 - DNA, 22 bp, Artificial Sequence
  chemically synthesized
ccacagatctgtgcaacccgca

SEQ ID NO: 1243038 - DNA, 22 bp, Artificial Sequence
  chemically synthesized
cacagatctgtgcaacccgcag

SEQ ID NO: 1243039 - DNA, 22 bp, Artificial Sequence
  chemically synthesized
gcaagtgggatctcctgatctg

SEQ ID NO: 1243040 - DNA, 22 bp, Artificial Sequence
  chemically synthesized
tgcaacccgcagatcaggagat

SEQ ID NO: 1243041 - DNA, 22 bp, Artificial Sequence
  chemically synthesized
gcatgggctcgcaagtgggatc

SEQ ID NO: 1243042 - DNA, 22 bp, Artificial Sequence
  chemically synthesized
ttggcatgggctcgcaagtggg

SEQ ID NO: 1243043 - DNA, 22 bp, Artificial Sequence
  chemically synthesized
agacccaaggccctgttggcat

SEQ ID NO: 1243044 - DNA, 22 bp, Artificial Sequence
  chemically synthesized
gagacccaaggccctgttggca

SEQ ID NO: 1243045 - DNA, 22 bp, Artificial Sequence
  chemically synthesized
tgagacccaaggccctgttggc

SEQ ID NO: 1243046 - DNA, 22 bp, Artificial Sequence
  chemically synthesized
gcgagcccatgccaacagggcc

SEQ ID NO: 1243047 - DNA, 22 bp, Artificial Sequence
  chemically synthesized
cgagcccatgccaacagggcct

SEQ ID NO: 1243048 - DNA, 22 bp, Artificial Sequence
  chemically synthesized
tgttttgagacccaaggccctg

SEQ ID NO: 1243049 - DNA, 22 bp, Artificial Sequence
  chemically synthesized
cacagctgtgttttgagaccca

SEQ ID NO: 1243050 - DNA, 22 bp, Artificial Sequence
  chemically synthesized
cgagaatctgcacagctgtgtt

SEQ ID NO: 1243051 - DNA, 22 bp, Artificial Sequence
  chemically synthesized
gggtctcaaaacacagctgtgc

SEQ ID NO: 1243052 - DNA, 22 bp, Artificial Sequence
  chemically synthesized
ggtctcaaaacacagctgtgca

SEQ ID NO: 1243053 - DNA, 22 bp, Artificial Sequence
  chemically synthesized
aaaacacagctgtgcagattct

SEQ ID NO: 1243054 - DNA, 22 bp, Artificial Sequence
  chemically synthesized
catccgagtggcctgcgagaat

SEQ ID NO: 1243055 - DNA, 22 bp, Artificial Sequence
  chemically synthesized
tgcagattctcgcaggccactc

SEQ ID NO: 1243056 - DNA, 22 bp, Artificial Sequence
  chemically synthesized
aggagtcgtctccatccgagtg

SEQ ID NO: 1243057 - DNA, 22 bp, Artificial Sequence
  chemically synthesized
aaggagtcgtctccatccgagt

SEQ ID NO: 1243058 - DNA, 22 bp, Artificial Sequence
  chemically synthesized
tcgcaggccactcggatggaga

SEQ ID NO: 1243059 - DNA, 22 bp, Artificial Sequence
  chemically synthesized
gcaggccactcggatggagacg

SEQ ID NO: 1243060 - DNA, 22 bp, Artificial Sequence
  chemically synthesized
agcagtcttaaggagtcgtctc

SEQ ID NO: 1243061 - DNA, 22 bp, Artificial Sequence
  chemically synthesized
ggatggagacgactccttaaga

SEQ ID NO: 1243062 - DNA, 22 bp, Artificial Sequence
  chemically synthesized
cttaagactgctcagtttccgg

SEQ ID NO: 1243063 - DNA, 22 bp, Artificial Sequence
  chemically synthesized
aagactgctcagtttccggggg

SEQ ID NO: 1243064 - DNA, 22 bp, Artificial Sequence
  chemically synthesized
agactgctcagtttccgggggc

SEQ ID NO: 1243065 - DNA, 22 bp, Artificial Sequence
  chemically synthesized
ctcagtttccgggggcgggggc

SEQ ID NO: 1243066 - DNA, 22 bp, Artificial Sequence
  chemically synthesized
cagtgatgatggccgcccccgc

SEQ ID NO: 1243067 - DNA, 22 bp, Artificial Sequence
  chemically synthesized
agtttccgggggcgggggcggc

SEQ ID NO: 1243068 - DNA, 22 bp, Artificial Sequence
  chemically synthesized
ccgggggcgggggcggccatca

SEQ ID NO: 1243069 - DNA, 22 bp, Artificial Sequence
  chemically synthesized
cgggggcgggggcggccatcat

SEQ ID NO: 1243070 - DNA, 22 bp, Artificial Sequence
  chemically synthesized
taacaggcagctgcagtgatga

SEQ ID NO: 1243071 - DNA, 22 bp, Artificial Sequence
  chemically synthesized
ctgtaacaggcagctgcagtga

SEQ ID NO: 1243072 - DNA, 22 bp, Artificial Sequence
  chemically synthesized
gctgtaacaggcagctgcagtg

SEQ ID NO: 1243073 - DNA, 22 bp, Artificial Sequence
  chemically synthesized
agtcatttgctgtaacaggcag

SEQ ID NO: 1243074 - DNA, 22 bp, Artificial Sequence
  chemically synthesized
cagctgcctgttacagcaaatg

SEQ ID NO: 1243075 - DNA, 22 bp, Artificial Sequence
  chemically synthesized
cccgggagagctcagtcatttg

SEQ ID NO: 1243076 - DNA, 22 bp, Artificial Sequence
  chemically synthesized
cctgttacagcaaatgactgag

SEQ ID NO: 1243077 - DNA, 22 bp, Artificial Sequence
  chemically synthesized
ttacagcaaatgactgagctct

SEQ ID NO: 1243078 - DNA, 22 bp, Artificial Sequence
  chemically synthesized
cagcaaatgactgagctctccc

SEQ ID NO: 1243079 - DNA, 22 bp, Artificial Sequence
  chemically synthesized
gatgccgcccctccccgggaga

SEQ ID NO: 1243080 - DNA, 22 bp, Artificial Sequence
  chemically synthesized
agatgccgcccctccccgggag

SEQ ID NO: 1243081 - DNA, 22 bp, Artificial Sequence
  chemically synthesized
ttagatgccgcccctccccggg

SEQ ID NO: 1243082 - DNA, 22 bp, Artificial Sequence
  chemically synthesized
tcttagatgccgcccctccccg

SEQ ID NO: 1243083 - DNA, 22 bp, Artificial Sequence
  chemically synthesized
agctctcccggggaggggcggc

SEQ ID NO: 1243084 - DNA, 22 bp, Artificial Sequence
  chemically synthesized
tcccggggaggggcggcatcta

SEQ ID NO: 1243085 - DNA, 22 bp, Artificial Sequence
  chemically synthesized
ccggggaggggcggcatctaag

SEQ ID NO: 1243086 - DNA, 22 bp, Artificial Sequence
  chemically synthesized
ggtggcagttctcttagatgcc

SEQ ID NO: 1243087 - DNA, 22 bp, Artificial Sequence
  chemically synthesized
aggtggcagttctcttagatgc

SEQ ID NO: 1243088 - DNA, 22 bp, Artificial Sequence
  chemically synthesized
ttaggtggcagttctcttagat

SEQ ID NO: 1243089 - DNA, 22 bp, Artificial Sequence
  chemically synthesized
tcttaggtggcagttctcttag

SEQ ID NO: 1243090 - DNA, 22 bp, Artificial Sequence
  chemically synthesized
agttctcttaggtggcagttct

SEQ ID NO: 1243091 - DNA, 22 bp, Artificial Sequence
  chemically synthesized
agagaactgccacctaagagaa

SEQ ID NO: 1243092 - DNA, 22 bp, Artificial Sequence
  chemically synthesized
cccacagcagctcagttctctt

SEQ ID NO: 1243093 - DNA, 22 bp, Artificial Sequence
  chemically synthesized
ccacctaagagaactgagctgc

SEQ ID NO: 1243094 - DNA, 22 bp, Artificial Sequence
  chemically synthesized
cccctccccacagcagctcagt

SEQ ID NO: 1243095 - DNA, 22 bp, Artificial Sequence
  chemically synthesized
ctgcccctccccacagcagctc

SEQ ID NO: 1243096 - DNA, 22 bp, Artificial Sequence
  chemically synthesized
agagaactgagctgctgtgggg

SEQ ID NO: 1243097 - DNA, 22 bp, Artificial Sequence
  chemically synthesized
agctgctgtggggaggggcagc

SEQ ID NO: 1243098 - DNA, 22 bp, Artificial Sequence
  chemically synthesized
ctgtggggaggggcagcagcca

SEQ ID NO: 1243099 - DNA, 22 bp, Artificial Sequence
  chemically synthesized
tggggaggggcagcagccatca

SEQ ID NO: 1243100 - DNA, 22 bp, Artificial Sequence
  chemically synthesized
agtaagccggtagccaccgtga

SEQ ID NO: 1243101 - DNA, 22 bp, Artificial Sequence
  chemically synthesized
tcagtaagccggtagccaccgt

SEQ ID NO: 1243102 - DNA, 22 bp, Artificial Sequence
  chemically synthesized
agtcctctcagtaagccggtag

SEQ ID NO: 1243103 - DNA, 22 bp, Artificial Sequence
  chemically synthesized
caggagctcagtcctctcagta

SEQ ID NO: 1243104 - DNA, 22 bp, Artificial Sequence
  chemically synthesized
cctacaggagctcagtcctctc

SEQ ID NO: 1243105 - DNA, 22 bp, Artificial Sequence
  chemically synthesized
ccggcttactgagaggactgag

SEQ ID NO: 1243106 - DNA, 22 bp, Artificial Sequence
  chemically synthesized
ccctccctacaggagctcagtc

SEQ ID NO: 1243107 - DNA, 22 bp, Artificial Sequence
  chemically synthesized
ctgccctccctacaggagctca

SEQ ID NO: 1243108 - DNA, 22 bp, Artificial Sequence
  chemically synthesized
actgagaggactgagctcctgt

SEQ ID NO: 1243109 - DNA, 22 bp, Artificial Sequence
  chemically synthesized
ctgagaggactgagctcctgta

SEQ ID NO: 1243110 - DNA, 22 bp, Artificial Sequence
  chemically synthesized
agaggactgagctcctgtaggg

SEQ ID NO: 1243111 - DNA, 22 bp, Artificial Sequence
  chemically synthesized
cagtgatggctgctgccctccc

SEQ ID NO: 1243112 - DNA, 22 bp, Artificial Sequence
  chemically synthesized
agctcctgtagggagggcagca

SEQ ID NO: 1243113 - DNA, 22 bp, Artificial Sequence
  chemically synthesized
gagctgcagtgatggctgctgc

SEQ ID NO: 1243114 - DNA, 22 bp, Artificial Sequence
  chemically synthesized
ctgtagggagggcagcagccat

SEQ ID NO: 1243115 - DNA, 22 bp, Artificial Sequence
  chemically synthesized
tagggagggcagcagccatcac

SEQ ID NO: 1243116 - DNA, 22 bp, Artificial Sequence
  chemically synthesized
aaggggaaaaatggtggactgg

SEQ ID NO: 1243117 - DNA, 22 bp, Artificial Sequence
  chemically synthesized
cagctccagtccaccatttttc

SEQ ID NO: 1243118 - DNA, 22 bp, Artificial Sequence
  chemically synthesized
aaacctgaaggggaaaaatggt

SEQ ID NO: 1243119 - DNA, 22 bp, Artificial Sequence
  chemically synthesized
cctcaaacctgaaggggaaaaa

SEQ ID NO: 1243120 - DNA, 22 bp, Artificial Sequence
  chemically synthesized
cagtccaccatttttccccttc

SEQ ID NO: 1243121 - DNA, 22 bp, Artificial Sequence
  chemically synthesized
tccagtctccctcaaacctgaa

SEQ ID NO: 1243122 - DNA, 22 bp, Artificial Sequence
  chemically synthesized
ttccccttcaggtttgagggag

SEQ ID NO: 1243123 - DNA, 22 bp, Artificial Sequence
  chemically synthesized
aaactgtccagtctccctcaaa

SEQ ID NO: 1243124 - DNA, 22 bp, Artificial Sequence
  chemically synthesized
tccccttcaggtttgagggaga

SEQ ID NO: 1243125 - DNA, 22 bp, Artificial Sequence
  chemically synthesized
ccccttcaggtttgagggagac

SEQ ID NO: 1243126 - DNA, 22 bp, Artificial Sequence
  chemically synthesized
cccttcaggtttgagggagact

SEQ ID NO: 1243127 - DNA, 22 bp, Artificial Sequence
  chemically synthesized
ggttcaaactgtccagtctccc

SEQ ID NO: 1243128 - DNA, 22 bp, Artificial Sequence
  chemically synthesized
caggtttgagggagactggaca

SEQ ID NO: 1243129 - DNA, 22 bp, Artificial Sequence
  chemically synthesized
ctgggttcaaactgtccagtct

SEQ ID NO: 1243130 - DNA, 22 bp, Artificial Sequence
  chemically synthesized
aggtttgagggagactggacag

SEQ ID NO: 1243131 - DNA, 22 bp, Artificial Sequence
  chemically synthesized
ctcctgggttcaaactgtccag

SEQ ID NO: 1243132 - DNA, 22 bp, Artificial Sequence
  chemically synthesized
gagggagactggacagtttgaa

SEQ ID NO: 1243133 - DNA, 22 bp, Artificial Sequence
  chemically synthesized
agggagactggacagtttgaac

SEQ ID NO: 1243134 - DNA, 22 bp, Artificial Sequence
  chemically synthesized
cagggaattcctcctgggttca

SEQ ID NO: 1243135 - DNA, 22 bp, Artificial Sequence
  chemically synthesized
gacagtttgaacccaggaggaa

SEQ ID NO: 1243136 - DNA, 22 bp, Artificial Sequence
  chemically synthesized
tactgcagggaattcctcctgg

SEQ ID NO: 1243137 - DNA, 22 bp, Artificial Sequence
  chemically synthesized
gaacccaggaggaattccctgc

SEQ ID NO: 1243138 - DNA, 22 bp, Artificial Sequence
  chemically synthesized
gtgtgctgtactgcagggaatt

SEQ ID NO: 1243139 - DNA, 22 bp, Artificial Sequence
  chemically synthesized
aacccaggaggaattccctgca

SEQ ID NO: 1243140 - DNA, 22 bp, Artificial Sequence
  chemically synthesized
ccatagctggtgtgctgtactg

SEQ ID NO: 1243141 - DNA, 22 bp, Artificial Sequence
  chemically synthesized
gccatagctggtgtgctgtact

SEQ ID NO: 1243142 - DNA, 22 bp, Artificial Sequence
  chemically synthesized
tttgccatagctggtgtgctgt

SEQ ID NO: 1243143 - DNA, 22 bp, Artificial Sequence
  chemically synthesized
cctgcagtacagcacaccagct

SEQ ID NO: 1243144 - DNA, 22 bp, Artificial Sequence
  chemically synthesized
gccattatttgccatagctggt

SEQ ID NO: 1243145 - DNA, 22 bp, Artificial Sequence
  chemically synthesized
cagtacagcacaccagctatgg

SEQ ID NO: 1243146 - DNA, 22 bp, Artificial Sequence
  chemically synthesized
atgaggcaatctggccattatt

SEQ ID NO: 1243147 - DNA, 22 bp, Artificial Sequence
  chemically synthesized
tggcaaataatggccagattgc

SEQ ID NO: 1243148 - DNA, 22 bp, Artificial Sequence
  chemically synthesized
cctcattaggccggactctgac

SEQ ID NO: 1243149 - DNA, 22 bp, Artificial Sequence
  chemically synthesized
attaggccggactctgacccat

SEQ ID NO: 1243150 - DNA, 22 bp, Artificial Sequence
  chemically synthesized
cccagtgaggagggatgggtca

SEQ ID NO: 1243151 - DNA, 22 bp, Artificial Sequence
  chemically synthesized
ggccggactctgacccatccct

SEQ ID NO: 1243152 - DNA, 22 bp, Artificial Sequence
  chemically synthesized
tgacccatccctcctcactggg

SEQ ID NO: 1243153 - DNA, 22 bp, Artificial Sequence
  chemically synthesized
caagcaggccctgcccagtgag

SEQ ID NO: 1243154 - DNA, 22 bp, Artificial Sequence
  chemically synthesized
acccatccctcctcactgggca

SEQ ID NO: 1243155 - DNA, 22 bp, Artificial Sequence
  chemically synthesized
ctgcaagcaggccctgcccagt

SEQ ID NO: 1243156 - DNA, 22 bp, Artificial Sequence
  chemically synthesized
gaattcctgcaagcaggccctg

SEQ ID NO: 1243157 - DNA, 22 bp, Artificial Sequence
  chemically synthesized
ctcactgggcagggcctgcttg

SEQ ID NO: 1243158 - DNA, 22 bp, Artificial Sequence
  chemically synthesized
ctggaattcctgcaagcaggcc

SEQ ID NO: 1243159 - DNA, 22 bp, Artificial Sequence
  chemically synthesized
actgggcagggcctgcttgcag

SEQ ID NO: 1243160 - DNA, 22 bp, Artificial Sequence
  chemically synthesized
gagttactggaattcctgcaag

SEQ ID NO: 1243161 - DNA, 22 bp, Artificial Sequence
  chemically synthesized
ggcagggcctgcttgcaggaat

SEQ ID NO: 1243162 - DNA, 22 bp, Artificial Sequence
  chemically synthesized
gctggagttactggaattcctg

SEQ ID NO: 1243163 - DNA, 22 bp, Artificial Sequence
  chemically synthesized
cttgcaggaattccagtaactc

SEQ ID NO: 1243164 - DNA, 22 bp, Artificial Sequence
  chemically synthesized
aacccctggctggagttactgg

SEQ ID NO: 1243165 - DNA, 22 bp, Artificial Sequence
  chemically synthesized
gcaggaattccagtaactccag

SEQ ID NO: 1243166 - DNA, 22 bp, Artificial Sequence
  chemically synthesized
caggaattccagtaactccagc

SEQ ID NO: 1243167 - DNA, 22 bp, Artificial Sequence
  chemically synthesized
cctaaacccctggctggagtta

SEQ ID NO: 1243168 - DNA, 22 bp, Artificial Sequence
  chemically synthesized
ccctaaacccctggctggagtt

SEQ ID NO: 1243169 - DNA, 22 bp, Artificial Sequence
  chemically synthesized
tccctaaacccctggctggagt

SEQ ID NO: 1243170 - DNA, 22 bp, Artificial Sequence
  chemically synthesized
tttccctaaacccctggctgga

SEQ ID NO: 1243171 - DNA, 22 bp, Artificial Sequence
  chemically synthesized
cagtaactccagccaggggttt

SEQ ID NO: 1243172 - DNA, 22 bp, Artificial Sequence
  chemically synthesized
cagccaggggtttagggaaaga

SEQ ID NO: 1243173 - DNA, 22 bp, Artificial Sequence
  chemically synthesized
aggtccaggggaatcggagttc

SEQ ID NO: 1243174 - DNA, 22 bp, Artificial Sequence
  chemically synthesized
agggaaagaactccgattcccc

SEQ ID NO: 1243175 - DNA, 22 bp, Artificial Sequence
  chemically synthesized
gggaaagaactccgattcccct

SEQ ID NO: 1243176 - DNA, 22 bp, Artificial Sequence
  chemically synthesized
ggggctcaggtccaggggaatc

SEQ ID NO: 1243177 - DNA, 22 bp, Artificial Sequence
  chemically synthesized
cccctaggggctcaggtccagg

SEQ ID NO: 1243178 - DNA, 22 bp, Artificial Sequence
  chemically synthesized
cgattcccctggacctgagccc

SEQ ID NO: 1243179 - DNA, 22 bp, Artificial Sequence
  chemically synthesized
ccctggacctgagcccctaggg

SEQ ID NO: 1243180 - DNA, 22 bp, Artificial Sequence
  chemically synthesized
gacctgagcccctagggggagg

SEQ ID NO: 1243181 - DNA, 22 bp, Artificial Sequence
  chemically synthesized
cggagaccatggccacccctcc

SEQ ID NO: 1243182 - DNA, 22 bp, Artificial Sequence
  chemically synthesized
agcccctagggggaggggtggc

SEQ ID NO: 1243183 - DNA, 22 bp, Artificial Sequence
  chemically synthesized
atctgcggagaccatggccacc

SEQ ID NO: 1243184 - DNA, 22 bp, Artificial Sequence
  chemically synthesized
gggggaggggtggccatggtct

SEQ ID NO: 1243185 - DNA, 22 bp, Artificial Sequence
  chemically synthesized
agtccgctgatctgcggagacc

SEQ ID NO: 1243186 - DNA, 22 bp, Artificial Sequence
  chemically synthesized
cgcagatcagcggacttagtct

SEQ ID NO: 1243187 - DNA, 22 bp, Artificial Sequence
  chemically synthesized
gagccagcagggtaaagactaa

SEQ ID NO: 1243188 - DNA, 22 bp, Artificial Sequence
  chemically synthesized
agagccagcagggtaaagacta

SEQ ID NO: 1243189 - DNA, 22 bp, Artificial Sequence
  chemically synthesized
tagagccagcagggtaaagact

SEQ ID NO: 1243190 - DNA, 22 bp, Artificial Sequence
  chemically synthesized
tttagagccagcagggtaaaga

SEQ ID NO: 1243191 - DNA, 22 bp, Artificial Sequence
  chemically synthesized
ccggattctttagagccagcag

SEQ ID NO: 1243192 - DNA, 22 bp, Artificial Sequence
  chemically synthesized
cccggattctttagagccagca

SEQ ID NO: 1243193 - DNA, 22 bp, Artificial Sequence
  chemically synthesized
agtctttaccctgctggctcta

SEQ ID NO: 1243194 - DNA, 22 bp, Artificial Sequence
  chemically synthesized
gtctttaccctgctggctctaa

SEQ ID NO: 1243195 - DNA, 22 bp, Artificial Sequence
  chemically synthesized
ggcttcccggattctttagagc

SEQ ID NO: 1243196 - DNA, 22 bp, Artificial Sequence
  chemically synthesized
taccctgctggctctaaagaat

SEQ ID NO: 1243197 - DNA, 22 bp, Artificial Sequence
  chemically synthesized
accctgctggctctaaagaatc

SEQ ID NO: 1243198 - DNA, 22 bp, Artificial Sequence
  chemically synthesized
ccctgctggctctaaagaatcc

SEQ ID NO: 1243199 - DNA, 22 bp, Artificial Sequence
  chemically synthesized
tctgggcttcccggattcttta

SEQ ID NO: 1243200 - DNA, 22 bp, Artificial Sequence
  chemically synthesized
gtctgggcttcccggattcttt

SEQ ID NO: 1243201 - DNA, 22 bp, Artificial Sequence
  chemically synthesized
ctggctctaaagaatccgggaa

SEQ ID NO: 1243202 - DNA, 22 bp, Artificial Sequence
  chemically synthesized
gctctaaagaatccgggaagcc

SEQ ID NO: 1243203 - DNA, 22 bp, Artificial Sequence
  chemically synthesized
taaagaatccgggaagcccaga

SEQ ID NO: 1243204 - DNA, 22 bp, Artificial Sequence
  chemically synthesized
aagaatccgggaagcccagaca

SEQ ID NO: 1243205 - DNA, 22 bp, Artificial Sequence
  chemically synthesized
ggggaatcccacttgtctgggc

SEQ ID NO: 1243206 - DNA, 22 bp, Artificial Sequence
  chemically synthesized
tcctgggggaatcccacttgtc

SEQ ID NO: 1243207 - DNA, 22 bp, Artificial Sequence
  chemically synthesized
ctgtcctgggggaatcccactt

SEQ ID NO: 1243208 - DNA, 22 bp, Artificial Sequence
  chemically synthesized
gctgtcctgggggaatcccact

SEQ ID NO: 1243209 - DNA, 22 bp, Artificial Sequence
  chemically synthesized
gtcgagggggtttgctgtcctg

SEQ ID NO: 1243210 - DNA, 22 bp, Artificial Sequence
  chemically synthesized
ggtcgagggggtttgctgtcct

SEQ ID NO: 1243211 - DNA, 22 bp, Artificial Sequence
  chemically synthesized
ccccttggtcgagggggtttgc

SEQ ID NO: 1243212 - DNA, 22 bp, Artificial Sequence
  chemically synthesized
ccccaggacagcaaaccccctc

SEQ ID NO: 1243213 - DNA, 22 bp, Artificial Sequence
  chemically synthesized
gctgccccttggtcgagggggt

SEQ ID NO: 1243214 - DNA, 22 bp, Artificial Sequence
  chemically synthesized
tggctgccccttggtcgagggg

SEQ ID NO: 1243215 - DNA, 22 bp, Artificial Sequence
  chemically synthesized
aggaagcactctggctgcccct

SEQ ID NO: 1243216 - DNA, 22 bp, Artificial Sequence
  chemically synthesized
aaggaagcactctggctgcccc

SEQ ID NO: 1243217 - DNA, 22 bp, Artificial Sequence
  chemically synthesized
gaccaaggggcagccagagtgc

SEQ ID NO: 1243218 - DNA, 22 bp, Artificial Sequence
  chemically synthesized
ccttaagtgggtcctggatccc

SEQ ID NO: 1243219 - DNA, 22 bp, Artificial Sequence
  chemically synthesized
cttaagtgggtcctggatcccg

SEQ ID NO: 1243220 - DNA, 22 bp, Artificial Sequence
  chemically synthesized
aagtgggtcctggatcccgtgc

SEQ ID NO: 1243221 - DNA, 22 bp, Artificial Sequence
  chemically synthesized
agtgggtcctggatcccgtgca

SEQ ID NO: 1243222 - DNA, 22 bp, Artificial Sequence
  chemically synthesized
acccagtcagggtgcacgggat

SEQ ID NO: 1243223 - DNA, 22 bp, Artificial Sequence
  chemically synthesized
gatcccgtgcaccctgactggg

SEQ ID NO: 1243224 - DNA, 22 bp, Artificial Sequence
  chemically synthesized
ggggtgggtctcacccagtcag

SEQ ID NO: 1243225 - DNA, 22 bp, Artificial Sequence
  chemically synthesized
ttgggggtgggtctcacccagt

SEQ ID NO: 1243226 - DNA, 22 bp, Artificial Sequence
  chemically synthesized
ctgttgggggtgggtctcaccc

SEQ ID NO: 1243227 - DNA, 22 bp, Artificial Sequence
  chemically synthesized
gcgactgctgttgggggtgggt

SEQ ID NO: 1243228 - DNA, 22 bp, Artificial Sequence
  chemically synthesized
actgggtgagacccacccccaa

SEQ ID NO: 1243229 - DNA, 22 bp, Artificial Sequence
  chemically synthesized
ggtgagacccacccccaacagc

SEQ ID NO: 1243230 - DNA, 22 bp, Artificial Sequence
  chemically synthesized
tataaggtgtctagcgactgct

SEQ ID NO: 1243231 - DNA, 22 bp, Artificial Sequence
  chemically synthesized
ctgtataaggtgtctagcgact

SEQ ID NO: 1243232 - DNA, 22 bp, Artificial Sequence
  chemically synthesized
cctgtataaggtgtctagcgac

SEQ ID NO: 1243233 - DNA, 22 bp, Artificial Sequence
  chemically synthesized
gacaccttatacaggaaggttc

SEQ ID NO: 1243234 - DNA, 22 bp, Artificial Sequence
  chemically synthesized
accagatgccagcaggaacctt

SEQ ID NO: 1243235 - DNA, 22 bp, Artificial Sequence
  chemically synthesized
atacaggaaggttcctgctggc

SEQ ID NO: 1243236 - DNA, 22 bp, Artificial Sequence
  chemically synthesized
tacaggaaggttcctgctggca

SEQ ID NO: 1243237 - DNA, 22 bp, Artificial Sequence
  chemically synthesized
agggtcactgaccagatgccag

SEQ ID NO: 1243238 - DNA, 22 bp, Artificial Sequence
  chemically synthesized
tccctgagggtcactgaccaga

SEQ ID NO: 1243239 - DNA, 22 bp, Artificial Sequence
  chemically synthesized
tgtccctgagggtcactgacca

SEQ ID NO: 1243240 - DNA, 22 bp, Artificial Sequence
  chemically synthesized
ctgctggcatctggtcagtgac

SEQ ID NO: 1243241 - DNA, 22 bp, Artificial Sequence
  chemically synthesized
ctggcatctggtcagtgaccct

SEQ ID NO: 1243242 - DNA, 22 bp, Artificial Sequence
  chemically synthesized
gcatctggtcagtgaccctcag

SEQ ID NO: 1243243 - DNA, 22 bp, Artificial Sequence
  chemically synthesized
gtatctctgtccctgagggtca

SEQ ID NO: 1243244 - DNA, 22 bp, Artificial Sequence
  chemically synthesized
tagtatctctgtccctgagggt

SEQ ID NO: 1243245 - DNA, 22 bp, Artificial Sequence
  chemically synthesized
ctctagtatctctgtccctgag

SEQ ID NO: 1243246 - DNA, 22 bp, Artificial Sequence
  chemically synthesized
cctctagtatctctgtccctga

SEQ ID NO: 1243247 - DNA, 22 bp, Artificial Sequence
  chemically synthesized
gtcagtgaccctcagggacaga

SEQ ID NO: 1243248 - DNA, 22 bp, Artificial Sequence
  chemically synthesized
cttcctctagtatctctgtccc

SEQ ID NO: 1243249 - DNA, 22 bp, Artificial Sequence
  chemically synthesized
ctccttcctctagtatctctgt

SEQ ID NO: 1243250 - DNA, 22 bp, Artificial Sequence
  chemically synthesized
cctgctccttcctctagtatct

SEQ ID NO: 1243251 - DNA, 22 bp, Artificial Sequence
  chemically synthesized
agggacagagatactagaggaa

SEQ ID NO: 1243252 - DNA, 22 bp, Artificial Sequence
  chemically synthesized
gaggaaggagcaggcagccatc

SEQ ID NO: 1243253 - DNA, 22 bp, Artificial Sequence
  chemically synthesized
cagaacagcaaagatggctgcc

SEQ ID NO: 1243254 - DNA, 22 bp, Artificial Sequence
  chemically synthesized
aggaggctgcagaacagcaaag

SEQ ID NO: 1243255 - DNA, 22 bp, Artificial Sequence
  chemically synthesized
gaaatgtcacctaaggaggctg

SEQ ID NO: 1243256 - DNA, 22 bp, Artificial Sequence
  chemically synthesized
ggaaatgtcacctaaggaggct

SEQ ID NO: 1243257 - DNA, 22 bp, Artificial Sequence
  chemically synthesized
tgctgttctgcagcctccttag

SEQ ID NO: 1243258 - DNA, 22 bp, Artificial Sequence
  chemically synthesized
gctgttctgcagcctccttagg

SEQ ID NO: 1243259 - DNA, 22 bp, Artificial Sequence
  chemically synthesized
ctgttctgcagcctccttaggt

SEQ ID NO: 1243260 - DNA, 22 bp, Artificial Sequence
  chemically synthesized
cacttggaaatgtcacctaagg

SEQ ID NO: 1243261 - DNA, 22 bp, Artificial Sequence
  chemically synthesized
ttctgcagcctccttaggtgac

SEQ ID NO: 1243262 - DNA, 22 bp, Artificial Sequence
  chemically synthesized
tgcacttggaaatgtcacctaa

SEQ ID NO: 1243263 - DNA, 22 bp, Artificial Sequence
  chemically synthesized
ctgcacttggaaatgtcaccta

SEQ ID NO: 1243264 - DNA, 22 bp, Artificial Sequence
  chemically synthesized
tgcagcctccttaggtgacatt

SEQ ID NO: 1243265 - DNA, 22 bp, Artificial Sequence
  chemically synthesized
cagcctccttaggtgacatttc

SEQ ID NO: 1243266 - DNA, 22 bp, Artificial Sequence
  chemically synthesized
ggtcccttctgcacttggaaat

SEQ ID NO: 1243267 - DNA, 22 bp, Artificial Sequence
  chemically synthesized
cttaggtgacatttccaagtgc

SEQ ID NO: 1243268 - DNA, 22 bp, Artificial Sequence
  chemically synthesized
aggtgacatttccaagtgcaga

SEQ ID NO: 1243269 - DNA, 22 bp, Artificial Sequence
  chemically synthesized
acctgggtcccttctgcacttg

SEQ ID NO: 1243270 - DNA, 22 bp, Artificial Sequence
  chemically synthesized
ggtgacatttccaagtgcagaa

SEQ ID NO: 1243271 - DNA, 22 bp, Artificial Sequence
  chemically synthesized
ccaagtgcagaagggacccagg

SEQ ID NO: 1243272 - DNA, 22 bp, Artificial Sequence
  chemically synthesized
caagtgcagaagggacccaggt

SEQ ID NO: 1243273 - DNA, 22 bp, Artificial Sequence
  chemically synthesized
cagaccccattcacctgggtcc

SEQ ID NO: 1243274 - DNA, 22 bp, Artificial Sequence
  chemically synthesized
gctccagaccccattcacctgg

SEQ ID NO: 1243275 - DNA, 22 bp, Artificial Sequence
  chemically synthesized
ggggttcgctccagaccccatt

SEQ ID NO: 1243276 - DNA, 22 bp, Artificial Sequence
  chemically synthesized
ttgggggttcgctccagacccc

SEQ ID NO: 1243277 - DNA, 22 bp, Artificial Sequence
  chemically synthesized
gttgggggttcgctccagaccc

SEQ ID NO: 1243278 - DNA, 22 bp, Artificial Sequence
  chemically synthesized
cagtttgttgggggttcgctcc

SEQ ID NO: 1243279 - DNA, 22 bp, Artificial Sequence
  chemically synthesized
ctgcagtttgttgggggttcgc

SEQ ID NO: 1243280 - DNA, 22 bp, Artificial Sequence
  chemically synthesized
tagggctgctgcagtttgttgg

SEQ ID NO: 1243281 - DNA, 22 bp, Artificial Sequence
  chemically synthesized
gagcgaacccccaacaaactgc

SEQ ID NO: 1243282 - DNA, 22 bp, Artificial Sequence
  chemically synthesized
tatagggctgctgcagtttgtt

SEQ ID NO: 1243283 - DNA, 22 bp, Artificial Sequence
  chemically synthesized
ctatagggctgctgcagtttgt

SEQ ID NO: 1243284 - DNA, 22 bp, Artificial Sequence
  chemically synthesized
ttctatagggctgctgcagttt

SEQ ID NO: 1243285 - DNA, 22 bp, Artificial Sequence
  chemically synthesized
acaggtccctcttctatagggc

SEQ ID NO: 1243286 - DNA, 22 bp, Artificial Sequence
  chemically synthesized
aacaggtccctcttctataggg

SEQ ID NO: 1243287 - DNA, 22 bp, Artificial Sequence
  chemically synthesized
taacaggtccctcttctatagg

SEQ ID NO: 1243288 - DNA, 22 bp, Artificial Sequence
  chemically synthesized
ttaacaggtccctcttctatag

SEQ ID NO: 1243289 - DNA, 22 bp, Artificial Sequence
  chemically synthesized
tttaacaggtccctcttctata

SEQ ID NO: 1243290 - DNA, 22 bp, Artificial Sequence
  chemically synthesized
ttttaacaggtccctcttctat

SEQ ID NO: 1243291 - DNA, 22 bp, Artificial Sequence
  chemically synthesized
cagcagccctatagaagaggga

SEQ ID NO: 1243292 - DNA, 22 bp, Artificial Sequence
  chemically synthesized
cttttttaacaggtccctcttc

SEQ ID NO: 1243293 - DNA, 22 bp, Artificial Sequence
  chemically synthesized
gcttttttaacaggtccctctt

SEQ ID NO: 1243294 - DNA, 22 bp, Artificial Sequence
  chemically synthesized
tttgcttttttaacaggtccct

SEQ ID NO: 1243295 - DNA, 22 bp, Artificial Sequence
  chemically synthesized
tgtttgcttttttaacaggtcc

SEQ ID NO: 1243296 - DNA, 22 bp, Artificial Sequence
  chemically synthesized
ctgtttgcttttttaacaggtc

SEQ ID NO: 1243297 - DNA, 22 bp, Artificial Sequence
  chemically synthesized
tctgtttgcttttttaacaggt

SEQ ID NO: 1243298 - DNA, 22 bp, Artificial Sequence
  chemically synthesized
tagaagagggacctgttaaaaa

SEQ ID NO: 1243299 - DNA, 22 bp, Artificial Sequence
  chemically synthesized
ctttctgtttgcttttttaaca

SEQ ID NO: 1243300 - DNA, 22 bp, Artificial Sequence
  chemically synthesized
ttgctttctgtttgctttttta

SEQ ID NO: 1243301 - DNA, 22 bp, Artificial Sequence
  chemically synthesized
ttgttgctttctgtttgctttt

SEQ ID NO: 1243302 - DNA, 22 bp, Artificial Sequence
  chemically synthesized
ttgttgttgctttctgtttgct

SEQ ID NO: 1243303 - DNA, 22 bp, Artificial Sequence
  chemically synthesized
ttaaaaaagcaaacagaaagca

SEQ ID NO: 1243304 - DNA, 22 bp, Artificial Sequence
  chemically synthesized
atgctgttgttgttgctttctg

SEQ ID NO: 1243305 - DNA, 22 bp, Artificial Sequence
  chemically synthesized
aaaaagcaaacagaaagcaaca

SEQ ID NO: 1243306 - DNA, 22 bp, Artificial Sequence
  chemically synthesized
ttgatgctgttgttgttgcttt

SEQ ID NO: 1243307 - DNA, 22 bp, Artificial Sequence
  chemically synthesized
gttgatgctgttgttgttgctt

SEQ ID NO: 1243308 - DNA, 22 bp, Artificial Sequence
  chemically synthesized
tgttgatgctgttgttgttgct

SEQ ID NO: 1243309 - DNA, 22 bp, Artificial Sequence
  chemically synthesized
ttgttgatgctgttgttgttgc

SEQ ID NO: 1243310 - DNA, 22 bp, Artificial Sequence
  chemically synthesized
tttgttgatgctgttgttgttg

SEQ ID NO: 1243311 - DNA, 22 bp, Artificial Sequence
  chemically synthesized
ttttgttgatgctgttgttgtt

SEQ ID NO: 1243312 - DNA, 22 bp, Artificial Sequence
  chemically synthesized
tttttgttgatgctgttgttgt

SEQ ID NO: 1243313 - DNA, 22 bp, Artificial Sequence
  chemically synthesized
ggattttttttgttgatgctgt

SEQ ID NO: 1243314 - DNA, 22 bp, Artificial Sequence
  chemically synthesized
attgggattttttttgttgatg

SEQ ID NO: 1243315 - DNA, 22 bp, Artificial Sequence
  chemically synthesized
aattgggattttttttgttgat

SEQ ID NO: 1243316 - DNA, 22 bp, Artificial Sequence
  chemically synthesized
taattgggattttttttgttga

SEQ ID NO: 1243317 - DNA, 22 bp, Artificial Sequence
  chemically synthesized
gatggggttttaattgggattt

SEQ ID NO: 1243318 - DNA, 22 bp, Artificial Sequence
  chemically synthesized
ggatggggttttaattgggatt

SEQ ID NO: 1243319 - DNA, 22 bp, Artificial Sequence
  chemically synthesized
tggatggggttttaattgggat

SEQ ID NO: 1243320 - DNA, 22 bp, Artificial Sequence
  chemically synthesized
acctttggatggggttttaatt

SEQ ID NO: 1243321 - DNA, 22 bp, Artificial Sequence
  chemically synthesized
ctgacctttggatggggtttta

SEQ ID NO: 1243322 - DNA, 22 bp, Artificial Sequence
  chemically synthesized
gaggctgctgacctttggatgg

SEQ ID NO: 1243323 - DNA, 22 bp, Artificial Sequence
  chemically synthesized
ggaggctgctgacctttggatg

SEQ ID NO: 1243324 - DNA, 22 bp, Artificial Sequence
  chemically synthesized
aaaccccatccaaaggtcagca

SEQ ID NO: 1243325 - DNA, 22 bp, Artificial Sequence
  chemically synthesized
aatcttggaggctgctgacctt

SEQ ID NO: 1243326 - DNA, 22 bp, Artificial Sequence
  chemically synthesized
caatcttggaggctgctgacct

SEQ ID NO: 1243327 - DNA, 22 bp, Artificial Sequence
  chemically synthesized
gtttcaatcttggaggctgctg

SEQ ID NO: 1243328 - DNA, 22 bp, Artificial Sequence
  chemically synthesized
tctagtttcaatcttggaggct

SEQ ID NO: 1243329 - DNA, 22 bp, Artificial Sequence
  chemically synthesized
gtctagtttcaatcttggaggc

SEQ ID NO: 1243330 - DNA, 22 bp, Artificial Sequence
  chemically synthesized
atgagtttgtctagtttcaatc

SEQ ID NO: 1243331 - DNA, 22 bp, Artificial Sequence
  chemically synthesized
catgagtttgtctagtttcaat

SEQ ID NO: 1243332 - DNA, 22 bp, Artificial Sequence
  chemically synthesized
atcttcatgagtttgtctagtt

SEQ ID NO: 1243333 - DNA, 22 bp, Artificial Sequence
  chemically synthesized
tcatcttcatgagtttgtctag

SEQ ID NO: 1243334 - DNA, 22 bp, Artificial Sequence
  chemically synthesized
caagattgaaactagacaaact

SEQ ID NO: 1243335 - DNA, 22 bp, Artificial Sequence
  chemically synthesized
attctcatcttcatgagtttgt

SEQ ID NO: 1243336 - DNA, 22 bp, Artificial Sequence
  chemically synthesized
gattctcatcttcatgagtttg

SEQ ID NO: 1243337 - DNA, 22 bp, Artificial Sequence
  chemically synthesized
tgattctcatcttcatgagttt

SEQ ID NO: 1243338 - DNA, 22 bp, Artificial Sequence
  chemically synthesized
ttgattctcatcttcatgagtt

SEQ ID NO: 1243339 - DNA, 22 bp, Artificial Sequence
  chemically synthesized
tttgattctcatcttcatgagt

SEQ ID NO: 1243340 - DNA, 22 bp, Artificial Sequence
  chemically synthesized
aaactagacaaactcatgaaga

SEQ ID NO: 1243341 - DNA, 22 bp, Artificial Sequence
  chemically synthesized
ttttttgattctcatcttcatg

SEQ ID NO: 1243342 - DNA, 22 bp, Artificial Sequence
  chemically synthesized
gttttttgattctcatcttcat

SEQ ID NO: 1243343 - DNA, 22 bp, Artificial Sequence
  chemically synthesized
tgttttttgattctcatcttca

SEQ ID NO: 1243344 - DNA, 22 bp, Artificial Sequence
  chemically synthesized
ttgttttttgattctcatcttc

SEQ ID NO: 1243345 - DNA, 22 bp, Artificial Sequence
  chemically synthesized
gacaaactcatgaagatgagaa

SEQ ID NO: 1243346 - DNA, 22 bp, Artificial Sequence
  chemically synthesized
agtgtttttgttttttgattct

SEQ ID NO: 1243347 - DNA, 22 bp, Artificial Sequence
  chemically synthesized
cagtgtttttgttttttgattc

SEQ ID NO: 1243348 - DNA, 22 bp, Artificial Sequence
  chemically synthesized
tcagtgtttttgttttttgatt

SEQ ID NO: 1243349 - DNA, 22 bp, Artificial Sequence
  chemically synthesized
atgaagatgagaatcaaaaaac

SEQ ID NO: 1243350 - DNA, 22 bp, Artificial Sequence
  chemically synthesized
agttttcagtgtttttgttttt

SEQ ID NO: 1243351 - DNA, 22 bp, Artificial Sequence
  chemically synthesized
gagttttcagtgtttttgtttt

SEQ ID NO: 1243352 - DNA, 22 bp, Artificial Sequence
  chemically synthesized
tgagttttcagtgtttttgttt

SEQ ID NO: 1243353 - DNA, 22 bp, Artificial Sequence
  chemically synthesized
ttgagttttcagtgtttttgtt

SEQ ID NO: 1243354 - DNA, 22 bp, Artificial Sequence
  chemically synthesized
tttgagttttcagtgtttttgt

SEQ ID NO: 1243355 - DNA, 22 bp, Artificial Sequence
  chemically synthesized
gctttttgagttttcagtgttt

SEQ ID NO: 1243356 - DNA, 22 bp, Artificial Sequence
  chemically synthesized
tggctttttgagttttcagtgt

SEQ ID NO: 1243357 - DNA, 22 bp, Artificial Sequence
  chemically synthesized
caggagaagaggcactctggct

SEQ ID NO: 1243358 - DNA, 22 bp, Artificial Sequence
  chemically synthesized
aaaactcaaaaagccagagtgc

SEQ ID NO: 1243359 - DNA, 22 bp, Artificial Sequence
  chemically synthesized
gcaggagaagaggcactctggc

SEQ ID NO: 1243360 - DNA, 22 bp, Artificial Sequence
  chemically synthesized
aaaaagccagagtgcctcttct

SEQ ID NO: 1243361 - DNA, 22 bp, Artificial Sequence
  chemically synthesized
caatcacttgcaggagaagagg

SEQ ID NO: 1243362 - DNA, 22 bp, Artificial Sequence
  chemically synthesized
gagaggagttgcaatcacttgc

SEQ ID NO: 1243363 - DNA, 22 bp, Artificial Sequence
  chemically synthesized
ctggagaggagttgcaatcact

SEQ ID NO: 1243364 - DNA, 22 bp, Artificial Sequence
  chemically synthesized
gctggagaggagttgcaatcac

SEQ ID NO: 1243365 - DNA, 22 bp, Artificial Sequence
  chemically synthesized
ttctcctgcaagtgattgcaac

SEQ ID NO: 1243366 - DNA, 22 bp, Artificial Sequence
  chemically synthesized
ctcctgcaagtgattgcaactc

SEQ ID NO: 1243367 - DNA, 22 bp, Artificial Sequence
  chemically synthesized
tcctgcaagtgattgcaactcc

SEQ ID NO: 1243368 - DNA, 22 bp, Artificial Sequence
  chemically synthesized
ctgcaagtgattgcaactcctc

SEQ ID NO: 1243369 - DNA, 22 bp, Artificial Sequence
  chemically synthesized
tgcccttgctggagaggagttg

SEQ ID NO: 1243370 - DNA, 22 bp, Artificial Sequence
  chemically synthesized
caagtgattgcaactcctctcc

SEQ ID NO: 1243371 - DNA, 22 bp, Artificial Sequence
  chemically synthesized
tgtgcccttgctggagaggagt

SEQ ID NO: 1243372 - DNA, 22 bp, Artificial Sequence
  chemically synthesized
ctgtgcccttgctggagaggag

SEQ ID NO: 1243373 - DNA, 22 bp, Artificial Sequence
  chemically synthesized
tccacttctgtgcccttgctgg

SEQ ID NO: 1243374 - DNA, 22 bp, Artificial Sequence
  chemically synthesized
caactcctctccagcaagggca

SEQ ID NO: 1243375 - DNA, 22 bp, Artificial Sequence
  chemically synthesized
tgtccacttctgtgcccttgct

SEQ ID NO: 1243376 - DNA, 22 bp, Artificial Sequence
  chemically synthesized
ctctccagcaagggcacagaag

SEQ ID NO: 1243377 - DNA, 22 bp, Artificial Sequence
  chemically synthesized
agcctctgtccacttctgtgcc

SEQ ID NO: 1243378 - DNA, 22 bp, Artificial Sequence
  chemically synthesized
tccagcaagggcacagaagtgg

SEQ ID NO: 1243379 - DNA, 22 bp, Artificial Sequence
  chemically synthesized
cagcaagggcacagaagtggac

SEQ ID NO: 1243380 - DNA, 22 bp, Artificial Sequence
  chemically synthesized
agccgtctcagcctctgtccac

SEQ ID NO: 1243381 - DNA, 22 bp, Artificial Sequence
  chemically synthesized
tcaattcagccgtctcagcctc

SEQ ID NO: 1243382 - DNA, 22 bp, Artificial Sequence
  chemically synthesized
tgtcaattcagccgtctcagcc

SEQ ID NO: 1243383 - DNA, 22 bp, Artificial Sequence
  chemically synthesized
ctgtcaattcagccgtctcagc

SEQ ID NO: 1243384 - DNA, 22 bp, Artificial Sequence
  chemically synthesized
cttctgtcaattcagccgtctc

SEQ ID NO: 1243385 - DNA, 22 bp, Artificial Sequence
  chemically synthesized
aagcctacttctgtcaattcag

SEQ ID NO: 1243386 - DNA, 22 bp, Artificial Sequence
  chemically synthesized
tgaagcctacttctgtcaattc

SEQ ID NO: 1243387 - DNA, 22 bp, Artificial Sequence
  chemically synthesized
ctgaagcctacttctgtcaatt

SEQ ID NO: 1243388 - DNA, 22 bp, Artificial Sequence
  chemically synthesized
agacggctgaattgacagaagt

SEQ ID NO: 1243389 - DNA, 22 bp, Artificial Sequence
  chemically synthesized
atcttctgaagcctacttctgt

SEQ ID NO: 1243390 - DNA, 22 bp, Artificial Sequence
  chemically synthesized
ctcatcttctgaagcctacttc

SEQ ID NO: 1243391 - DNA, 22 bp, Artificial Sequence
  chemically synthesized
ttactcatcttctgaagcctac

SEQ ID NO: 1243392 - DNA, 22 bp, Artificial Sequence
  chemically synthesized
aattgacagaagtaggcttcag

SEQ ID NO: 1243393 - DNA, 22 bp, Artificial Sequence
  chemically synthesized
gttattactcatcttctgaagc

SEQ ID NO: 1243394 - DNA, 22 bp, Artificial Sequence
  chemically synthesized
acagaagtaggcttcagaagat

SEQ ID NO: 1243395 - DNA, 22 bp, Artificial Sequence
  chemically synthesized
agtaaagttcgttattactcat

SEQ ID NO: 1243396 - DNA, 22 bp, Artificial Sequence
  chemically synthesized
gctcagtaaagttcgttattac

SEQ ID NO: 1243397 - DNA, 22 bp, Artificial Sequence
  chemically synthesized
agctcagtaaagttcgttatta

SEQ ID NO: 1243398 - DNA, 22 bp, Artificial Sequence
  chemically synthesized
cagaagatgagtaataacgaac

SEQ ID NO: 1243399 - DNA, 22 bp, Artificial Sequence
  chemically synthesized
tagctcagtaaagttcgttatt

SEQ ID NO: 1243400 - DNA, 22 bp, Artificial Sequence
  chemically synthesized
agaagatgagtaataacgaact

SEQ ID NO: 1243401 - DNA, 22 bp, Artificial Sequence
  chemically synthesized
ctttagctcagtaaagttcgtt

SEQ ID NO: 1243402 - DNA, 22 bp, Artificial Sequence
  chemically synthesized
gaccatgctcctttagctcagt

SEQ ID NO: 1243403 - DNA, 22 bp, Artificial Sequence
  chemically synthesized
ggttagaccatgctcctttagc

SEQ ID NO: 1243404 - DNA, 22 bp, Artificial Sequence
  chemically synthesized
cattgggttagaccatgctcct

SEQ ID NO: 1243405 - DNA, 22 bp, Artificial Sequence
  chemically synthesized
tactgagctaaaggagcatggt

SEQ ID NO: 1243406 - DNA, 22 bp, Artificial Sequence
  chemically synthesized
gcattgggttagaccatgctcc

SEQ ID NO: 1243407 - DNA, 22 bp, Artificial Sequence
  chemically synthesized
actgagctaaaggagcatggtc

SEQ ID NO: 1243408 - DNA, 22 bp, Artificial Sequence
  chemically synthesized
tgcattgggttagaccatgctc

SEQ ID NO: 1243409 - DNA, 22 bp, Artificial Sequence
  chemically synthesized
ctgagctaaaggagcatggtct

SEQ ID NO: 1243410 - DNA, 22 bp, Artificial Sequence
  chemically synthesized
tttgcattgggttagaccatgc

SEQ ID NO: 1243411 - DNA, 22 bp, Artificial Sequence
  chemically synthesized
ctttgcattgggttagaccatg

SEQ ID NO: 1243412 - DNA, 22 bp, Artificial Sequence
  chemically synthesized
agctaaaggagcatggtctaac

SEQ ID NO: 1243413 - DNA, 22 bp, Artificial Sequence
  chemically synthesized
acttctttgcattgggttagac

SEQ ID NO: 1243414 - DNA, 22 bp, Artificial Sequence
  chemically synthesized
aacttctttgcattgggttaga

SEQ ID NO: 1243415 - DNA, 22 bp, Artificial Sequence
  chemically synthesized
aaggagcatggtctaacccaat

SEQ ID NO: 1243416 - DNA, 22 bp, Artificial Sequence
  chemically synthesized
ttaacttctttgcattgggtta

SEQ ID NO: 1243417 - DNA, 22 bp, Artificial Sequence
  chemically synthesized
tcatggctcttaacttctttgc

SEQ ID NO: 1243418 - DNA, 22 bp, Artificial Sequence
  chemically synthesized
atcatggctcttaacttctttg

SEQ ID NO: 1243419 - DNA, 22 bp, Artificial Sequence
  chemically synthesized
tatcatggctcttaacttcttt

SEQ ID NO: 1243420 - DNA, 22 bp, Artificial Sequence
  chemically synthesized
acccaatgcaaagaagttaaga

SEQ ID NO: 1243421 - DNA, 22 bp, Artificial Sequence
  chemically synthesized
taatgttttatcatggctctta

SEQ ID NO: 1243422 - DNA, 22 bp, Artificial Sequence
  chemically synthesized
ctgtaatgttttatcatggctc

SEQ ID NO: 1243423 - DNA, 22 bp, Artificial Sequence
  chemically synthesized
acagctcctgtaatgttttatc

SEQ ID NO: 1243424 - DNA, 22 bp, Artificial Sequence
  chemically synthesized
ttaacagctcctgtaatgtttt

SEQ ID NO: 1243425 - DNA, 22 bp, Artificial Sequence
  chemically synthesized
agagccatgataaaacattaca

SEQ ID NO: 1243426 - DNA, 22 bp, Artificial Sequence
  chemically synthesized
gttaacagctcctgtaatgttt

SEQ ID NO: 1243427 - DNA, 22 bp, Artificial Sequence
  chemically synthesized
ttgttaacagctcctgtaatgt

SEQ ID NO: 1243428 - DNA, 22 bp, Artificial Sequence
  chemically synthesized
ataattcttgttaacagctcct

SEQ ID NO: 1243429 - DNA, 22 bp, Artificial Sequence
  chemically synthesized
gactgataattcttgttaacag

SEQ ID NO: 1243430 - DNA, 22 bp, Artificial Sequence
  chemically synthesized
tagactgataattcttgttaac

SEQ ID NO: 1243431 - DNA, 22 bp, Artificial Sequence
  chemically synthesized
tctagactgataattcttgtta

SEQ ID NO: 1243432 - DNA, 22 bp, Artificial Sequence
  chemically synthesized
caggagctgttaacaagaatta

SEQ ID NO: 1243433 - DNA, 22 bp, Artificial Sequence
  chemically synthesized
ctctctagactgataattcttg

SEQ ID NO: 1243434 - DNA, 22 bp, Artificial Sequence
  chemically synthesized
tgttactctctagactgataat

SEQ ID NO: 1243435 - DNA, 22 bp, Artificial Sequence
  chemically synthesized
atgttactctctagactgataa

SEQ ID NO: 1243436 - DNA, 22 bp, Artificial Sequence
  chemically synthesized
ttaacaagaattatcagtctag

SEQ ID NO: 1243437 - DNA, 22 bp, Artificial Sequence
  chemically synthesized
acaagaattatcagtctagaga

SEQ ID NO: 1243438 - DNA, 22 bp, Artificial Sequence
  chemically synthesized
ggtcatttatgttactctctag

SEQ ID NO: 1243439 - DNA, 22 bp, Artificial Sequence
  chemically synthesized
gggtcatttatgttactctcta

SEQ ID NO: 1243440 - DNA, 22 bp, Artificial Sequence
  chemically synthesized
ccttgggtcatttatgttactc

SEQ ID NO: 1243441 - DNA, 22 bp, Artificial Sequence
  chemically synthesized
tcagtctagagagtaacataaa

SEQ ID NO: 1243442 - DNA, 22 bp, Artificial Sequence
  chemically synthesized
agctcccttgggtcatttatgt

SEQ ID NO: 1243443 - DNA, 22 bp, Artificial Sequence
  chemically synthesized
cagctcccttgggtcatttatg

SEQ ID NO: 1243444 - DNA, 22 bp, Artificial Sequence
  chemically synthesized
tcagctcccttgggtcatttat

SEQ ID NO: 1243445 - DNA, 22 bp, Artificial Sequence
  chemically synthesized
ttcagctcccttgggtcattta

SEQ ID NO: 1243446 - DNA, 22 bp, Artificial Sequence
  chemically synthesized
tttcagctcccttgggtcattt

SEQ ID NO: 1243447 - DNA, 22 bp, Artificial Sequence
  chemically synthesized
gagagtaacataaatgacccaa

SEQ ID NO: 1243448 - DNA, 22 bp, Artificial Sequence
  chemically synthesized
tgttttttcagctcccttgggt

SEQ ID NO: 1243449 - DNA, 22 bp, Artificial Sequence
  chemically synthesized
gtgttttttcagctcccttggg

SEQ ID NO: 1243450 - DNA, 22 bp, Artificial Sequence
  chemically synthesized
ttgtgttttttcagctcccttg

SEQ ID NO: 1243451 - DNA, 22 bp, Artificial Sequence
  chemically synthesized
tgaagttcttgtgttttttcag

SEQ ID NO: 1243452 - DNA, 22 bp, Artificial Sequence
  chemically synthesized
cggtagcattgtgaagttcttg

SEQ ID NO: 1243453 - DNA, 22 bp, Artificial Sequence
  chemically synthesized
gcggtagcattgtgaagttctt

SEQ ID NO: 1243454 - DNA, 22 bp, Artificial Sequence
  chemically synthesized
aaaaaacacaagaacttcacaa

SEQ ID NO: 1243455 - DNA, 22 bp, Artificial Sequence
  chemically synthesized
atacttgcggtagcattgtgaa

SEQ ID NO: 1243456 - DNA, 22 bp, Artificial Sequence
  chemically synthesized
ttgatacttgcggtagcattgt

SEQ ID NO: 1243457 - DNA, 22 bp, Artificial Sequence
  chemically synthesized
gttattgatacttgcggtagca

SEQ ID NO: 1243458 - DNA, 22 bp, Artificial Sequence
  chemically synthesized
ggttattgatacttgcggtagc

SEQ ID NO: 1243459 - DNA, 22 bp, Artificial Sequence
  chemically synthesized
tttggttattgatacttgcggt

SEQ ID NO: 1243460 - DNA, 22 bp, Artificial Sequence
  chemically synthesized
cacaatgctaccgcaagtatca

SEQ ID NO: 1243461 - DNA, 22 bp, Artificial Sequence
  chemically synthesized
acaatgctaccgcaagtatcaa

SEQ ID NO: 1243462 - DNA, 22 bp, Artificial Sequence
  chemically synthesized
gtctatttggttattgatactt

SEQ ID NO: 1243463 - DNA, 22 bp, Artificial Sequence
  chemically synthesized
ggtctatttggttattgatact

SEQ ID NO: 1243464 - DNA, 22 bp, Artificial Sequence
  chemically synthesized
cttggtctatttggttattgat

SEQ ID NO: 1243465 - DNA, 22 bp, Artificial Sequence
  chemically synthesized
tgcttggtctatttggttattg

SEQ ID NO: 1243466 - DNA, 22 bp, Artificial Sequence
  chemically synthesized
ctgcttggtctatttggttatt

SEQ ID NO: 1243467 - DNA, 22 bp, Artificial Sequence
  chemically synthesized
ccgcaagtatcaataaccaaat

SEQ ID NO: 1243468 - DNA, 22 bp, Artificial Sequence
  chemically synthesized
ttctgcttggtctatttggtta

SEQ ID NO: 1243469 - DNA, 22 bp, Artificial Sequence
  chemically synthesized
attcttctgcttggtctatttg

SEQ ID NO: 1243470 - DNA, 22 bp, Artificial Sequence
  chemically synthesized
aaattcattcttctgcttggtc

SEQ ID NO: 1243471 - DNA, 22 bp, Artificial Sequence
  chemically synthesized
tgaaattcattcttctgcttgg

SEQ ID NO: 1243472 - DNA, 22 bp, Artificial Sequence
  chemically synthesized
aagctctgaaattcattcttct

SEQ ID NO: 1243473 - DNA, 22 bp, Artificial Sequence
  chemically synthesized
caagctctgaaattcattcttc

SEQ ID NO: 1243474 - DNA, 22 bp, Artificial Sequence
  chemically synthesized
agcaagataatcttcaagctct

SEQ ID NO: 1243475 - DNA, 22 bp, Artificial Sequence
  chemically synthesized
cagcaagataatcttcaagctc

SEQ ID NO: 1243476 - DNA, 22 bp, Artificial Sequence
  chemically synthesized
tttcagcaagataatcttcaag

SEQ ID NO: 1243477 - DNA, 22 bp, Artificial Sequence
  chemically synthesized
gtgttatttcagcaagataatc

SEQ ID NO: 1243478 - DNA, 22 bp, Artificial Sequence
  chemically synthesized
cagagcttgaagattatcttgc

SEQ ID NO: 1243479 - DNA, 22 bp, Artificial Sequence
  chemically synthesized
agagcttgaagattatcttgct

SEQ ID NO: 1243480 - DNA, 22 bp, Artificial Sequence
  chemically synthesized
ctggtgttatttcagcaagata

SEQ ID NO: 1243481 - DNA, 22 bp, Artificial Sequence
  chemically synthesized
tctgctggtgttatttcagcaa

SEQ ID NO: 1243482 - DNA, 22 bp, Artificial Sequence
  chemically synthesized
gtctgctggtgttatttcagca

SEQ ID NO: 1243483 - DNA, 22 bp, Artificial Sequence
  chemically synthesized
gaagattatcttgctgaaataa

SEQ ID NO: 1243484 - DNA, 22 bp, Artificial Sequence
  chemically synthesized
aagattatcttgctgaaataac

SEQ ID NO: 1243485 - DNA, 22 bp, Artificial Sequence
  chemically synthesized
atcttgtctgctggtgttattt

SEQ ID NO: 1243486 - DNA, 22 bp, Artificial Sequence
  chemically synthesized
taatcttgtctgctggtgttat

SEQ ID NO: 1243487 - DNA, 22 bp, Artificial Sequence
  chemically synthesized
tcttgctgaaataacaccagca

SEQ ID NO: 1243488 - DNA, 22 bp, Artificial Sequence
  chemically synthesized
tctaatcttgtctgctggtgtt

SEQ ID NO: 1243489 - DNA, 22 bp, Artificial Sequence
  chemically synthesized
ctctaatcttgtctgctggtgt

SEQ ID NO: 1243490 - DNA, 22 bp, Artificial Sequence
  chemically synthesized
tctctaatcttgtctgctggtg

SEQ ID NO: 1243491 - DNA, 22 bp, Artificial Sequence
  chemically synthesized
ttctctaatcttgtctgctggt

SEQ ID NO: 1243492 - DNA, 22 bp, Artificial Sequence
  chemically synthesized
gctgaaataacaccagcagaca

SEQ ID NO: 1243493 - DNA, 22 bp, Artificial Sequence
  chemically synthesized
tttctctaatcttgtctgctgg

SEQ ID NO: 1243494 - DNA, 22 bp, Artificial Sequence
  chemically synthesized
ctgaaataacaccagcagacaa

SEQ ID NO: 1243495 - DNA, 22 bp, Artificial Sequence
  chemically synthesized
ttttctctaatcttgtctgctg

SEQ ID NO: 1243496 - DNA, 22 bp, Artificial Sequence
  chemically synthesized
ttttttctctaatcttgtctgc

SEQ ID NO: 1243497 - DNA, 22 bp, Artificial Sequence
  chemically synthesized
aaataacaccagcagacaagat

SEQ ID NO: 1243498 - DNA, 22 bp, Artificial Sequence
  chemically synthesized
cattcttttttctctaatcttg

SEQ ID NO: 1243499 - DNA, 22 bp, Artificial Sequence
  chemically synthesized
gcattcttttttctctaatctt

SEQ ID NO: 1243500 - DNA, 22 bp, Artificial Sequence
  chemically synthesized
tgcattcttttttctctaatct

SEQ ID NO: 1243501 - DNA, 22 bp, Artificial Sequence
  chemically synthesized
ctttgcattcttttttctctaa

SEQ ID NO: 1243502 - DNA, 22 bp, Artificial Sequence
  chemically synthesized
attcctttgcattcttttttct

SEQ ID NO: 1243503 - DNA, 22 bp, Artificial Sequence
  chemically synthesized
ttcattcctttgcattcttttt

SEQ ID NO: 1243504 - DNA, 22 bp, Artificial Sequence
  chemically synthesized
cgtctattcattcctttgcatt

SEQ ID NO: 1243505 - DNA, 22 bp, Artificial Sequence
  chemically synthesized
gagaaaaaagaatgcaaaggaa

SEQ ID NO: 1243506 - DNA, 22 bp, Artificial Sequence
  chemically synthesized
tgcgtctattcattcctttgca

SEQ ID NO: 1243507 - DNA, 22 bp, Artificial Sequence
  chemically synthesized
ctgcgtctattcattcctttgc

SEQ ID NO: 1243508 - DNA, 22 bp, Artificial Sequence
  chemically synthesized
tctgcgtctattcattcctttg

SEQ ID NO: 1243509 - DNA, 22 bp, Artificial Sequence
  chemically synthesized
ttctgcgtctattcattccttt

SEQ ID NO: 1243510 - DNA, 22 bp, Artificial Sequence
  chemically synthesized
tcaagacttttctgcgtctatt

SEQ ID NO: 1243511 - DNA, 22 bp, Artificial Sequence
  chemically synthesized
atcaagacttttctgcgtctat

SEQ ID NO: 1243512 - DNA, 22 bp, Artificial Sequence
  chemically synthesized
tatcaagacttttctgcgtcta

SEQ ID NO: 1243513 - DNA, 22 bp, Artificial Sequence
  chemically synthesized
aattttatcaagacttttctgc

SEQ ID NO: 1243514 - DNA, 22 bp, Artificial Sequence
  chemically synthesized
acatgaaaggatgttgaatttt

SEQ ID NO: 1243515 - DNA, 22 bp, Artificial Sequence
  chemically synthesized
aacatgaaaggatgttgaattt

SEQ ID NO: 1243516 - DNA, 22 bp, Artificial Sequence
  chemically synthesized
taacatgaaaggatgttgaatt

SEQ ID NO: 1243517 - DNA, 22 bp, Artificial Sequence
  chemically synthesized
ttaacatgaaaggatgttgaat

SEQ ID NO: 1243518 - DNA, 22 bp, Artificial Sequence
  chemically synthesized
gataaaattcaacatcctttca

SEQ ID NO: 1243519 - DNA, 22 bp, Artificial Sequence
  chemically synthesized
ataaaattcaacatcctttcat

SEQ ID NO: 1243520 - DNA, 22 bp, Artificial Sequence
  chemically synthesized
aaggtttttaacatgaaaggat

SEQ ID NO: 1243521 - DNA, 22 bp, Artificial Sequence
  chemically synthesized
ctgaaggtttttaacatgaaag

SEQ ID NO: 1243522 - DNA, 22 bp, Artificial Sequence
  chemically synthesized
atctactgaaggtttttaacat

SEQ ID NO: 1243523 - DNA, 22 bp, Artificial Sequence
  chemically synthesized
aacatcctttcatgttaaaaac

SEQ ID NO: 1243524 - DNA, 22 bp, Artificial Sequence
  chemically synthesized
tcatgttaaaaaccttcagtag

SEQ ID NO: 1243525 - DNA, 22 bp, Artificial Sequence
  chemically synthesized
catgttaaaaaccttcagtaga

SEQ ID NO: 1243526 - DNA, 22 bp, Artificial Sequence
  chemically synthesized
atgttaaaaaccttcagtagat

SEQ ID NO: 1243527 - DNA, 22 bp, Artificial Sequence
  chemically synthesized
catcaatacctaatctactgaa

SEQ ID NO: 1243528 - DNA, 22 bp, Artificial Sequence
  chemically synthesized
aaaaccttcagtagattaggta

SEQ ID NO: 1243529 - DNA, 22 bp, Artificial Sequence
  chemically synthesized
gagacatgttccatcaatacct

SEQ ID NO: 1243530 - DNA, 22 bp, Artificial Sequence
  chemically synthesized
agagacatgttccatcaatacc

SEQ ID NO: 1243531 - DNA, 22 bp, Artificial Sequence
  chemically synthesized
cagtagattaggtattgatgga

SEQ ID NO: 1243532 - DNA, 22 bp, Artificial Sequence
  chemically synthesized
agtagattaggtattgatggaa

SEQ ID NO: 1243533 - DNA, 22 bp, Artificial Sequence
  chemically synthesized
tttagagacatgttccatcaat

SEQ ID NO: 1243534 - DNA, 22 bp, Artificial Sequence
  chemically synthesized
atttagagacatgttccatcaa

SEQ ID NO: 1243535 - DNA, 22 bp, Artificial Sequence
  chemically synthesized
ttatttagagacatgttccatc

SEQ ID NO: 1243536 - DNA, 22 bp, Artificial Sequence
  chemically synthesized
ggtattgatggaacatgtctct

SEQ ID NO: 1243537 - DNA, 22 bp, Artificial Sequence
  chemically synthesized
atggaacatgtctctaaataag

SEQ ID NO: 1243538 - DNA, 22 bp, Artificial Sequence
  chemically synthesized
tcataaatagctcttatttaga

SEQ ID NO: 1243539 - DNA, 22 bp, Artificial Sequence
  chemically synthesized
gtcataaatagctcttatttag

SEQ ID NO: 1243540 - DNA, 22 bp, Artificial Sequence
  chemically synthesized
taggtttgtcataaatagctct

SEQ ID NO: 1243541 - DNA, 22 bp, Artificial Sequence
  chemically synthesized
gctgtaggtttgtcataaatag

SEQ ID NO: 1243542 - DNA, 22 bp, Artificial Sequence
  chemically synthesized
taaataagagctatttatgaca

SEQ ID NO: 1243543 - DNA, 22 bp, Artificial Sequence
  chemically synthesized
aataagagctatttatgacaaa

SEQ ID NO: 1243544 - DNA, 22 bp, Artificial Sequence
  chemically synthesized
gtatgatattggctgtaggttt

SEQ ID NO: 1243545 - DNA, 22 bp, Artificial Sequence
  chemically synthesized
tttatgacaaacctacagccaa

SEQ ID NO: 1243546 - DNA, 22 bp, Artificial Sequence
  chemically synthesized
atgacaaacctacagccaatat

SEQ ID NO: 1243547 - DNA, 22 bp, Artificial Sequence
  chemically synthesized
tgacaaacctacagccaatatc

SEQ ID NO: 1243548 - DNA, 22 bp, Artificial Sequence
  chemically synthesized
cccatctagtatgatattggct

SEQ ID NO: 1243549 - DNA, 22 bp, Artificial Sequence
  chemically synthesized
gcccatctagtatgatattggc

SEQ ID NO: 1243550 - DNA, 22 bp, Artificial Sequence
  chemically synthesized
tgcccatctagtatgatattgg

SEQ ID NO: 1243551 - DNA, 22 bp, Artificial Sequence
  chemically synthesized
ttgcccatctagtatgatattg

SEQ ID NO: 1243552 - DNA, 22 bp, Artificial Sequence
  chemically synthesized
cagccaatatcatactagatgg

SEQ ID NO: 1243553 - DNA, 22 bp, Artificial Sequence
  chemically synthesized
cagccagtttttgcccatctag

SEQ ID NO: 1243554 - DNA, 22 bp, Artificial Sequence
  chemically synthesized
gatgggcaaaaactggctgtag

SEQ ID NO: 1243555 - DNA, 22 bp, Artificial Sequence
  chemically synthesized
tcataccaaaacctacagccag

SEQ ID NO: 1243556 - DNA, 22 bp, Artificial Sequence
  chemically synthesized
gtcataccaaaacctacagcca

SEQ ID NO: 1243557 - DNA, 22 bp, Artificial Sequence
  chemically synthesized
aagggtttgtcataccaaaacc

SEQ ID NO: 1243558 - DNA, 22 bp, Artificial Sequence
  chemically synthesized
caagggtttgtcataccaaaac

SEQ ID NO: 1243559 - DNA, 22 bp, Artificial Sequence
  chemically synthesized
tcaagggtttgtcataccaaaa

SEQ ID NO: 1243560 - DNA, 22 bp, Artificial Sequence
  chemically synthesized
gctgtaggttttggtatgacaa

SEQ ID NO: 1243561 - DNA, 22 bp, Artificial Sequence
  chemically synthesized
gttttcaagggtttgtcatacc

SEQ ID NO: 1243562 - DNA, 22 bp, Artificial Sequence
  chemically synthesized
taggttttggtatgacaaaccc

SEQ ID NO: 1243563 - DNA, 22 bp, Artificial Sequence
  chemically synthesized
tgctggttttcaagggtttgtc

SEQ ID NO: 1243564 - DNA, 22 bp, Artificial Sequence
  chemically synthesized
gtgctggttttcaagggtttgt

SEQ ID NO: 1243565 - DNA, 22 bp, Artificial Sequence
  chemically synthesized
tcttgtgctggttttcaagggt

SEQ ID NO: 1243566 - DNA, 22 bp, Artificial Sequence
  chemically synthesized
tggtatgacaaacccttgaaaa

SEQ ID NO: 1243567 - DNA, 22 bp, Artificial Sequence
  chemically synthesized
gtcttgtgctggttttcaaggg

SEQ ID NO: 1243568 - DNA, 22 bp, Artificial Sequence
  chemically synthesized
ggtatgacaaacccttgaaaac

SEQ ID NO: 1243569 - DNA, 22 bp, Artificial Sequence
  chemically synthesized
gtatgacaaacccttgaaaacc

SEQ ID NO: 1243570 - DNA, 22 bp, Artificial Sequence
  chemically synthesized
gaaaaccagcacaagacaagga

SEQ ID NO: 1243571 - DNA, 22 bp, Artificial Sequence
  chemically synthesized
aaaaccagcacaagacaaggat

SEQ ID NO: 1243572 - DNA, 22 bp, Artificial Sequence
  chemically synthesized
aataggaatggtaagagagggc

SEQ ID NO: 1243573 - DNA, 22 bp, Artificial Sequence
  chemically synthesized
caatacagtgttgaataggaat

SEQ ID NO: 1243574 - DNA, 22 bp, Artificial Sequence
  chemically synthesized
tcttaccattcctattcaacac

SEQ ID NO: 1243575 - DNA, 22 bp, Artificial Sequence
  chemically synthesized
ttaccattcctattcaacactg

SEQ ID NO: 1243576 - DNA, 22 bp, Artificial Sequence
  chemically synthesized
accattcctattcaacactgta

SEQ ID NO: 1243577 - DNA, 22 bp, Artificial Sequence
  chemically synthesized
ccattcctattcaacactgtat

SEQ ID NO: 1243578 - DNA, 22 bp, Artificial Sequence
  chemically synthesized
gccagaaattccaatacagtgt

SEQ ID NO: 1243579 - DNA, 22 bp, Artificial Sequence
  chemically synthesized
ctattcaacactgtattggaat

SEQ ID NO: 1243580 - DNA, 22 bp, Artificial Sequence
  chemically synthesized
ccctggccagaaattccaatac

SEQ ID NO: 1243581 - DNA, 22 bp, Artificial Sequence
  chemically synthesized
ttcaacactgtattggaatttc

SEQ ID NO: 1243582 - DNA, 22 bp, Artificial Sequence
  chemically synthesized
attgccctggccagaaattcca

SEQ ID NO: 1243583 - DNA, 22 bp, Artificial Sequence
  chemically synthesized
aacactgtattggaatttctgg

SEQ ID NO: 1243584 - DNA, 22 bp, Artificial Sequence
  chemically synthesized
cctgattgccctggccagaaat

SEQ ID NO: 1243585 - DNA, 22 bp, Artificial Sequence
  chemically synthesized
gcctgattgccctggccagaaa

SEQ ID NO: 1243586 - DNA, 22 bp, Artificial Sequence
  chemically synthesized
ttgcctgattgccctggccaga

SEQ ID NO: 1243587 - DNA, 22 bp, Artificial Sequence
  chemically synthesized
tattggaatttctggccagggc

SEQ ID NO: 1243588 - DNA, 22 bp, Artificial Sequence
  chemically synthesized
tcttgcctgattgccctggcca

SEQ ID NO: 1243589 - DNA, 22 bp, Artificial Sequence
  chemically synthesized
ctcttgcctgattgccctggcc

SEQ ID NO: 1243590 - DNA, 22 bp, Artificial Sequence
  chemically synthesized
tctcttgcctgattgccctggc

SEQ ID NO: 1243591 - DNA, 22 bp, Artificial Sequence
  chemically synthesized
tttctcttgcctgattgccctg

SEQ ID NO: 1243592 - DNA, 22 bp, Artificial Sequence
  chemically synthesized
gaatttctggccagggcaatca

SEQ ID NO: 1243593 - DNA, 22 bp, Artificial Sequence
  chemically synthesized
ctttctcttgcctgattgccct

SEQ ID NO: 1243594 - DNA, 22 bp, Artificial Sequence
  chemically synthesized
atttctttctcttgcctgattg

SEQ ID NO: 1243595 - DNA, 22 bp, Artificial Sequence
  chemically synthesized
gatttctttctcttgcctgatt

SEQ ID NO: 1243596 - DNA, 22 bp, Artificial Sequence
  chemically synthesized
ctggccagggcaatcaggcaag

SEQ ID NO: 1243597 - DNA, 22 bp, Artificial Sequence
  chemically synthesized
tggccagggcaatcaggcaaga

SEQ ID NO: 1243598 - DNA, 22 bp, Artificial Sequence
  chemically synthesized
gccagggcaatcaggcaagaga

SEQ ID NO: 1243599 - DNA, 22 bp, Artificial Sequence
  chemically synthesized
tccttgatttctttctcttgcc

SEQ ID NO: 1243600 - DNA, 22 bp, Artificial Sequence
  chemically synthesized
atccttgatttctttctcttgc

SEQ ID NO: 1243601 - DNA, 22 bp, Artificial Sequence
  chemically synthesized
tttatccttgatttctttctct

SEQ ID NO: 1243602 - DNA, 22 bp, Artificial Sequence
  chemically synthesized
ctatttatccttgatttctttc

SEQ ID NO: 1243603 - DNA, 22 bp, Artificial Sequence
  chemically synthesized
cctatttatccttgatttcttt

SEQ ID NO: 1243604 - DNA, 22 bp, Artificial Sequence
  chemically synthesized
ttcctatttatccttgatttct

SEQ ID NO: 1243605 - DNA, 22 bp, Artificial Sequence
  chemically synthesized
tcttcctatttatccttgattt

SEQ ID NO: 1243606 - DNA, 22 bp, Artificial Sequence
  chemically synthesized
ctctcttcctatttatccttga

SEQ ID NO: 1243607 - DNA, 22 bp, Artificial Sequence
  chemically synthesized
cctctcttcctatttatccttg

SEQ ID NO: 1243608 - DNA, 22 bp, Artificial Sequence
  chemically synthesized
acttcctctcttcctatttatc

SEQ ID NO: 1243609 - DNA, 22 bp, Artificial Sequence
  chemically synthesized
gacttcctctcttcctatttat

SEQ ID NO: 1243610 - DNA, 22 bp, Artificial Sequence
  chemically synthesized
gatacacagaagagacagtttg

SEQ ID NO: 1243611 - DNA, 22 bp, Artificial Sequence
  chemically synthesized
tagatacacagaagagacagtt

SEQ ID NO: 1243612 - DNA, 22 bp, Artificial Sequence
  chemically synthesized
ctagatacacagaagagacagt

SEQ ID NO: 1243613 - DNA, 22 bp, Artificial Sequence
  chemically synthesized
tctagatacacagaagagacag

SEQ ID NO: 1243614 - DNA, 22 bp, Artificial Sequence
  chemically synthesized
tctcttctgtgtatctagaaaa

SEQ ID NO: 1243615 - DNA, 22 bp, Artificial Sequence
  chemically synthesized
ttctgtgtatctagaaaactcc

SEQ ID NO: 1243616 - DNA, 22 bp, Artificial Sequence
  chemically synthesized
gggtgagacgatggagttttct

SEQ ID NO: 1243617 - DNA, 22 bp, Artificial Sequence
  chemically synthesized
ggggtgagacgatggagttttc

SEQ ID NO: 1243618 - DNA, 22 bp, Artificial Sequence
  chemically synthesized
ctgtgtatctagaaaactccat

SEQ ID NO: 1243619 - DNA, 22 bp, Artificial Sequence
  chemically synthesized
tggggtgagacgatggagtttt

SEQ ID NO: 1243620 - DNA, 22 bp, Artificial Sequence
  chemically synthesized
tgtgtatctagaaaactccatc

SEQ ID NO: 1243621 - DNA, 22 bp, Artificial Sequence
  chemically synthesized
tgtatctagaaaactccatcgt

SEQ ID NO: 1243622 - DNA, 22 bp, Artificial Sequence
  chemically synthesized
aggagattttggggtgagacga

SEQ ID NO: 1243623 - DNA, 22 bp, Artificial Sequence
  chemically synthesized
aaggagattttggggtgagacg

SEQ ID NO: 1243624 - DNA, 22 bp, Artificial Sequence
  chemically synthesized
gaaaactccatcgtctcacccc

SEQ ID NO: 1243625 - DNA, 22 bp, Artificial Sequence
  chemically synthesized
ccagcttaaggagattttgggg

SEQ ID NO: 1243626 - DNA, 22 bp, Artificial Sequence
  chemically synthesized
gccagcttaaggagattttggg

SEQ ID NO: 1243627 - DNA, 22 bp, Artificial Sequence
  chemically synthesized
catcgtctcaccccaaaatctc

SEQ ID NO: 1243628 - DNA, 22 bp, Artificial Sequence
  chemically synthesized
cttgccagcttaaggagatttt

SEQ ID NO: 1243629 - DNA, 22 bp, Artificial Sequence
  chemically synthesized
gcttgccagcttaaggagattt

SEQ ID NO: 1243630 - DNA, 22 bp, Artificial Sequence
  chemically synthesized
aatttgcttgccagcttaagga

SEQ ID NO: 1243631 - DNA, 22 bp, Artificial Sequence
  chemically synthesized
accccaaaatctccttaagctg

SEQ ID NO: 1243632 - DNA, 22 bp, Artificial Sequence
  chemically synthesized
ctgaatttgcttgccagcttaa

SEQ ID NO: 1243633 - DNA, 22 bp, Artificial Sequence
  chemically synthesized
gctgaatttgcttgccagctta

SEQ ID NO: 1243634 - DNA, 22 bp, Artificial Sequence
  chemically synthesized
tgctgaatttgcttgccagctt

SEQ ID NO: 1243635 - DNA, 22 bp, Artificial Sequence
  chemically synthesized
agactttgctgaatttgcttgc

SEQ ID NO: 1243636 - DNA, 22 bp, Artificial Sequence
  chemically synthesized
cttaagctggcaagcaaattca

SEQ ID NO: 1243637 - DNA, 22 bp, Artificial Sequence
  chemically synthesized
aagctggcaagcaaattcagca

SEQ ID NO: 1243638 - DNA, 22 bp, Artificial Sequence
  chemically synthesized
agctggcaagcaaattcagcaa

SEQ ID NO: 1243639 - DNA, 22 bp, Artificial Sequence
  chemically synthesized
tatcctgagactttgctgaatt

SEQ ID NO: 1243640 - DNA, 22 bp, Artificial Sequence
  chemically synthesized
gtatcctgagactttgctgaat

SEQ ID NO: 1243641 - DNA, 22 bp, Artificial Sequence
  chemically synthesized
tgtatcctgagactttgctgaa

SEQ ID NO: 1243642 - DNA, 22 bp, Artificial Sequence
  chemically synthesized
ttgtatcctgagactttgctga

SEQ ID NO: 1243643 - DNA, 22 bp, Artificial Sequence
  chemically synthesized
gcaagcaaattcagcaaagtct

SEQ ID NO: 1243644 - DNA, 22 bp, Artificial Sequence
  chemically synthesized
atttttgtatcctgagactttg

SEQ ID NO: 1243645 - DNA, 22 bp, Artificial Sequence
  chemically synthesized
cacattgatttttgtatcctga

SEQ ID NO: 1243646 - DNA, 22 bp, Artificial Sequence
  chemically synthesized
acacattgatttttgtatcctg

SEQ ID NO: 1243647 - DNA, 22 bp, Artificial Sequence
  chemically synthesized
tacacattgatttttgtatcct

SEQ ID NO: 1243648 - DNA, 22 bp, Artificial Sequence
  chemically synthesized
agcaaagtctcaggatacaaaa

SEQ ID NO: 1243649 - DNA, 22 bp, Artificial Sequence
  chemically synthesized
ttacacattgatttttgtatcc

SEQ ID NO: 1243650 - DNA, 22 bp, Artificial Sequence
  chemically synthesized
tgatttttacacattgattttt

SEQ ID NO: 1243651 - DNA, 22 bp, Artificial Sequence
  chemically synthesized
gtgatttttacacattgatttt

SEQ ID NO: 1243652 - DNA, 22 bp, Artificial Sequence
  chemically synthesized
aggatacaaaaatcaatgtgta

SEQ ID NO: 1243653 - DNA, 22 bp, Artificial Sequence
  chemically synthesized
taggaatgcttgtgatttttac

SEQ ID NO: 1243654 - DNA, 22 bp, Artificial Sequence
  chemically synthesized
ttgtaggaatgcttgtgatttt

SEQ ID NO: 1243655 - DNA, 22 bp, Artificial Sequence
  chemically synthesized
ttgttgtaggaatgcttgtgat

SEQ ID NO: 1243656 - DNA, 22 bp, Artificial Sequence
  chemically synthesized
tctattgttgtaggaatgcttg

SEQ ID NO: 1243657 - DNA, 22 bp, Artificial Sequence
  chemically synthesized
tgtctattgttgtaggaatgct

SEQ ID NO: 1243658 - DNA, 22 bp, Artificial Sequence
  chemically synthesized
tctgtctattgttgtaggaatg

SEQ ID NO: 1243659 - DNA, 22 bp, Artificial Sequence
  chemically synthesized
gctctctgtctattgttgtagg

SEQ ID NO: 1243660 - DNA, 22 bp, Artificial Sequence
  chemically synthesized
ggctctctgtctattgttgtag

SEQ ID NO: 1243661 - DNA, 22 bp, Artificial Sequence
  chemically synthesized
atacatgatttggctctctgtc

SEQ ID NO: 1243662 - DNA, 22 bp, Artificial Sequence
  chemically synthesized
ctacaacaatagacagagagcc

SEQ ID NO: 1243663 - DNA, 22 bp, Artificial Sequence
  chemically synthesized
caacaatagacagagagccaaa

SEQ ID NO: 1243664 - DNA, 22 bp, Artificial Sequence
  chemically synthesized
taaatgggagttcatacatgat

SEQ ID NO: 1243665 - DNA, 22 bp, Artificial Sequence
  chemically synthesized
tagccattgtaaatgggagttc

SEQ ID NO: 1243666 - DNA, 22 bp, Artificial Sequence
  chemically synthesized
gtagccattgtaaatgggagtt

SEQ ID NO: 1243667 - DNA, 22 bp, Artificial Sequence
  chemically synthesized
tgtagccattgtaaatgggagt

SEQ ID NO: 1243668 - DNA, 22 bp, Artificial Sequence
  chemically synthesized
tttgtagccattgtaaatggga

SEQ ID NO: 1243669 - DNA, 22 bp, Artificial Sequence
  chemically synthesized
tctttgtagccattgtaaatgg

SEQ ID NO: 1243670 - DNA, 22 bp, Artificial Sequence
  chemically synthesized
ttctctttgtagccattgtaaa

SEQ ID NO: 1243671 - DNA, 22 bp, Artificial Sequence
  chemically synthesized
attctctttgtagccattgtaa

SEQ ID NO: 1243672 - DNA, 22 bp, Artificial Sequence
  chemically synthesized
tattctctttgtagccattgta

SEQ ID NO: 1243673 - DNA, 22 bp, Artificial Sequence
  chemically synthesized
ctttattctctttgtagccatt

SEQ ID NO: 1243674 - DNA, 22 bp, Artificial Sequence
  chemically synthesized
actttattctctttgtagccat

SEQ ID NO: 1243675 - DNA, 22 bp, Artificial Sequence
  chemically synthesized
ccatttacaatggctacaaaga

SEQ ID NO: 1243676 - DNA, 22 bp, Artificial Sequence
  chemically synthesized
cttactttattctctttgtagc

SEQ ID NO: 1243677 - DNA, 22 bp, Artificial Sequence
  chemically synthesized
ctacttactttattctctttgt

SEQ ID NO: 1243678 - DNA, 22 bp, Artificial Sequence
  chemically synthesized
acaatggctacaaagagaataa

SEQ ID NO: 1243679 - DNA, 22 bp, Artificial Sequence
  chemically synthesized
caatggctacaaagagaataaa

SEQ ID NO: 1243680 - DNA, 22 bp, Artificial Sequence
  chemically synthesized
tattcctacttactttattctc

SEQ ID NO: 1243681 - DNA, 22 bp, Artificial Sequence
  chemically synthesized
gctgtattcctacttactttat

SEQ ID NO: 1243682 - DNA, 22 bp, Artificial Sequence
  chemically synthesized
ttagctgtattcctacttactt

SEQ ID NO: 1243683 - DNA, 22 bp, Artificial Sequence
  chemically synthesized
caaagagaataaagtaagtagg

SEQ ID NO: 1243684 - DNA, 22 bp, Artificial Sequence
  chemically synthesized
gcctgttagctgtattcctact

SEQ ID NO: 1243685 - DNA, 22 bp, Artificial Sequence
  chemically synthesized
agcctgttagctgtattcctac

SEQ ID NO: 1243686 - DNA, 22 bp, Artificial Sequence
  chemically synthesized
aagaggtggtgcacttagcctg

SEQ ID NO: 1243687 - DNA, 22 bp, Artificial Sequence
  chemically synthesized
gaagaggtggtgcacttagcct

SEQ ID NO: 1243688 - DNA, 22 bp, Artificial Sequence
  chemically synthesized
cttgaagaggtggtgcacttag

SEQ ID NO: 1243689 - DNA, 22 bp, Artificial Sequence
  chemically synthesized
tccttgaagaggtggtgcactt

SEQ ID NO: 1243690 - DNA, 22 bp, Artificial Sequence
  chemically synthesized
acaggctaagtgcaccacctct

SEQ ID NO: 1243691 - DNA, 22 bp, Artificial Sequence
  chemically synthesized
tagctctccttgaagaggtggt

SEQ ID NO: 1243692 - DNA, 22 bp, Artificial Sequence
  chemically synthesized
gtagctctccttgaagaggtgg

SEQ ID NO: 1243693 - DNA, 22 bp, Artificial Sequence
  chemically synthesized
agtgcaccacctcttcaaggag

SEQ ID NO: 1243694 - DNA, 22 bp, Artificial Sequence
  chemically synthesized
agcagtggtttgtagctctcct

SEQ ID NO: 1243695 - DNA, 22 bp, Artificial Sequence
  chemically synthesized
gagcagtggtttgtagctctcc

SEQ ID NO: 1243696 - DNA, 22 bp, Artificial Sequence
  chemically synthesized
cttgagcagtggtttgtagctc

SEQ ID NO: 1243697 - DNA, 22 bp, Artificial Sequence
  chemically synthesized
ttcaaggagagctacaaaccac

SEQ ID NO: 1243698 - DNA, 22 bp, Artificial Sequence
  chemically synthesized
gttccttgagcagtggtttgta

SEQ ID NO: 1243699 - DNA, 22 bp, Artificial Sequence
  chemically synthesized
agttccttgagcagtggtttgt

SEQ ID NO: 1243700 - DNA, 22 bp, Artificial Sequence
  chemically synthesized
caaggagagctacaaaccactg

SEQ ID NO: 1243701 - DNA, 22 bp, Artificial Sequence
  chemically synthesized
aaggagagctacaaaccactgc

SEQ ID NO: 1243702 - DNA, 22 bp, Artificial Sequence
  chemically synthesized
ttagttccttgagcagtggttt

SEQ ID NO: 1243703 - DNA, 22 bp, Artificial Sequence
  chemically synthesized
tgtcctcttagttccttgagca

SEQ ID NO: 1243704 - DNA, 22 bp, Artificial Sequence
  chemically synthesized
gtgtcctcttagttccttgagc

SEQ ID NO: 1243705 - DNA, 22 bp, Artificial Sequence
  chemically synthesized
caaaccactgctcaaggaacta

SEQ ID NO: 1243706 - DNA, 22 bp, Artificial Sequence
  chemically synthesized
tttgtgtcctcttagttccttg

SEQ ID NO: 1243707 - DNA, 22 bp, Artificial Sequence
  chemically synthesized
gtttgtgtcctcttagttcctt

SEQ ID NO: 1243708 - DNA, 22 bp, Artificial Sequence
  chemically synthesized
catttgtttgtgtcctcttagt

SEQ ID NO: 1243709 - DNA, 22 bp, Artificial Sequence
  chemically synthesized
ccatttgtttgtgtcctcttag

SEQ ID NO: 1243710 - DNA, 22 bp, Artificial Sequence
  chemically synthesized
ttccatttgtttgtgtcctctt

SEQ ID NO: 1243711 - DNA, 22 bp, Artificial Sequence
  chemically synthesized
ctcaaggaactaagaggacaca

SEQ ID NO: 1243712 - DNA, 22 bp, Artificial Sequence
  chemically synthesized
aaggaactaagaggacacaaac

SEQ ID NO: 1243713 - DNA, 22 bp, Artificial Sequence
  chemically synthesized
agaggacacaaacaaatggaag

SEQ ID NO: 1243714 - DNA, 22 bp, Artificial Sequence
  chemically synthesized
tccatgagcatggaatgttctt

SEQ ID NO: 1243715 - DNA, 22 bp, Artificial Sequence
  chemically synthesized
tatccatgagcatggaatgttc

SEQ ID NO: 1243716 - DNA, 22 bp, Artificial Sequence
  chemically synthesized
attctatccatgagcatggaat

SEQ ID NO: 1243717 - DNA, 22 bp, Artificial Sequence
  chemically synthesized
acagtattgattctatccatga

SEQ ID NO: 1243718 - DNA, 22 bp, Artificial Sequence
  chemically synthesized
cacagtattgattctatccatg

SEQ ID NO: 1243719 - DNA, 22 bp, Artificial Sequence
  chemically synthesized
tcacagtattgattctatccat

SEQ ID NO: 1243720 - DNA, 22 bp, Artificial Sequence
  chemically synthesized
catgctcatggatagaatcaat

SEQ ID NO: 1243721 - DNA, 22 bp, Artificial Sequence
  chemically synthesized
atggatagaatcaatactgtga

SEQ ID NO: 1243722 - DNA, 22 bp, Artificial Sequence
  chemically synthesized
tacagtatggccattttcacag

SEQ ID NO: 1243723 - DNA, 22 bp, Artificial Sequence
  chemically synthesized
taaattatacagtatggccatt

SEQ ID NO: 1243724 - DNA, 22 bp, Artificial Sequence
  chemically synthesized
aatctataaattatacagtatg

SEQ ID NO: 1243725 - DNA, 22 bp, Artificial Sequence
  chemically synthesized
tgaaaatggccatactgtataa

SEQ ID NO: 1243726 - DNA, 22 bp, Artificial Sequence
  chemically synthesized
tataatttatagattcaatgct

SEQ ID NO: 1243727 - DNA, 22 bp, Artificial Sequence
  chemically synthesized
atagattcaatgctattcccat

SEQ ID NO: 1243728 - DNA, 22 bp, Artificial Sequence
  chemically synthesized
tagattcaatgctattcccatt

SEQ ID NO: 1243729 - DNA, 22 bp, Artificial Sequence
  chemically synthesized
aatgctattcccatttatctac

SEQ ID NO: 1243730 - DNA, 22 bp, Artificial Sequence
  chemically synthesized
tgaataatgtcaatggtagata

SEQ ID NO: 1243731 - DNA, 22 bp, Artificial Sequence
  chemically synthesized
tgtgaataatgtcaatggtaga

SEQ ID NO: 1243732 - DNA, 22 bp, Artificial Sequence
  chemically synthesized
ttcccatttatctaccattgac

SEQ ID NO: 1243733 - DNA, 22 bp, Artificial Sequence
  chemically synthesized
attctgtgaataatgtcaatgg

SEQ ID NO: 1243734 - DNA, 22 bp, Artificial Sequence
  chemically synthesized
ccatttatctaccattgacatt

SEQ ID NO: 1243735 - DNA, 22 bp, Artificial Sequence
  chemically synthesized
taattctgtgaataatgtcaat

SEQ ID NO: 1243736 - DNA, 22 bp, Artificial Sequence
  chemically synthesized
ctaattctgtgaataatgtcaa

SEQ ID NO: 1243737 - DNA, 22 bp, Artificial Sequence
  chemically synthesized
tctaattctgtgaataatgtca

SEQ ID NO: 1243738 - DNA, 22 bp, Artificial Sequence
  chemically synthesized
ttctaattctgtgaataatgtc

SEQ ID NO: 1243739 - DNA, 22 bp, Artificial Sequence
  chemically synthesized
tttctaattctgtgaataatgt

SEQ ID NO: 1243740 - DNA, 22 bp, Artificial Sequence
  chemically synthesized
atctaccattgacattattcac

SEQ ID NO: 1243741 - DNA, 22 bp, Artificial Sequence
  chemically synthesized
ttttctaattctgtgaataatg

SEQ ID NO: 1243742 - DNA, 22 bp, Artificial Sequence
  chemically synthesized
tctaccattgacattattcaca

SEQ ID NO: 1243743 - DNA, 22 bp, Artificial Sequence
  chemically synthesized
tttttctaattctgtgaataat

SEQ ID NO: 1243744 - DNA, 22 bp, Artificial Sequence
  chemically synthesized
tttttttctaattctgtgaata

SEQ ID NO: 1243745 - DNA, 22 bp, Artificial Sequence
  chemically synthesized
ctttttttctaattctgtgaat

SEQ ID NO: 1243746 - DNA, 22 bp, Artificial Sequence
  chemically synthesized
ccattgacattattcacagaat

SEQ ID NO: 1243747 - DNA, 22 bp, Artificial Sequence
  chemically synthesized
tctttttttctaattctgtgaa

SEQ ID NO: 1243748 - DNA, 22 bp, Artificial Sequence
  chemically synthesized
acattattcacagaattagaaa

SEQ ID NO: 1243749 - DNA, 22 bp, Artificial Sequence
  chemically synthesized
aaacagttttctttttttctaa

SEQ ID NO: 1243750 - DNA, 22 bp, Artificial Sequence
  chemically synthesized
aaaacagttttctttttttcta

SEQ ID NO: 1243751 - DNA, 22 bp, Artificial Sequence
  chemically synthesized
taaaacagttttctttttttct

SEQ ID NO: 1243752 - DNA, 22 bp, Artificial Sequence
  chemically synthesized
ttcacagaattagaaaaaaaga

SEQ ID NO: 1243753 - DNA, 22 bp, Artificial Sequence
  chemically synthesized
acagaattagaaaaaaagaaaa

SEQ ID NO: 1243754 - DNA, 22 bp, Artificial Sequence
  chemically synthesized
tatgaattttaaaacagttttc

SEQ ID NO: 1243755 - DNA, 22 bp, Artificial Sequence
  chemically synthesized
tgtatgaattttaaaacagttt

SEQ ID NO: 1243756 - DNA, 22 bp, Artificial Sequence
  chemically synthesized
gaaaaaaagaaaactgttttaa

SEQ ID NO: 1243757 - DNA, 22 bp, Artificial Sequence
  chemically synthesized
gttctgtatgaattttaaaaca

SEQ ID NO: 1243758 - DNA, 22 bp, Artificial Sequence
  chemically synthesized
ggttctgtatgaattttaaaac

SEQ ID NO: 1243759 - DNA, 22 bp, Artificial Sequence
  chemically synthesized
tggttctgtatgaattttaaaa

SEQ ID NO: 1243760 - DNA, 22 bp, Artificial Sequence
  chemically synthesized
ttggttctgtatgaattttaaa

SEQ ID NO: 1243761 - DNA, 22 bp, Artificial Sequence
  chemically synthesized
tttggttctgtatgaattttaa

SEQ ID NO: 1243762 - DNA, 22 bp, Artificial Sequence
  chemically synthesized
ctttttggttctgtatgaattt

SEQ ID NO: 1243763 - DNA, 22 bp, Artificial Sequence
  chemically synthesized
ttttaaaattcatacagaacca

SEQ ID NO: 1243764 - DNA, 22 bp, Artificial Sequence
  chemically synthesized
tatgggctcctttttggttctg

SEQ ID NO: 1243765 - DNA, 22 bp, Artificial Sequence
  chemically synthesized
taaaattcatacagaaccaaaa

SEQ ID NO: 1243766 - DNA, 22 bp, Artificial Sequence
  chemically synthesized
aaaattcatacagaaccaaaaa

SEQ ID NO: 1243767 - DNA, 22 bp, Artificial Sequence
  chemically synthesized
aaattcatacagaaccaaaaag

SEQ ID NO: 1243768 - DNA, 22 bp, Artificial Sequence
  chemically synthesized
gctatatgggctcctttttggt

SEQ ID NO: 1243769 - DNA, 22 bp, Artificial Sequence
  chemically synthesized
ggctatatgggctcctttttgg

SEQ ID NO: 1243770 - DNA, 22 bp, Artificial Sequence
  chemically synthesized
atacagaaccaaaaaggagccc

SEQ ID NO: 1243771 - DNA, 22 bp, Artificial Sequence
  chemically synthesized
tcttggctatatgggctccttt

SEQ ID NO: 1243772 - DNA, 22 bp, Artificial Sequence
  chemically synthesized
ggattgtcttggctatatgggc

SEQ ID NO: 1243773 - DNA, 22 bp, Artificial Sequence
  chemically synthesized
aggattgtcttggctatatggg

SEQ ID NO: 1243774 - DNA, 22 bp, Artificial Sequence
  chemically synthesized
cttaggattgtcttggctatat

SEQ ID NO: 1243775 - DNA, 22 bp, Artificial Sequence
  chemically synthesized
gcttaggattgtcttggctata

SEQ ID NO: 1243776 - DNA, 22 bp, Artificial Sequence
  chemically synthesized
tgcttaggattgtcttggctat

SEQ ID NO: 1243777 - DNA, 22 bp, Artificial Sequence
  chemically synthesized
ttgcttaggattgtcttggcta

SEQ ID NO: 1243778 - DNA, 22 bp, Artificial Sequence
  chemically synthesized
tttttgcttaggattgtcttgg

SEQ ID NO: 1243779 - DNA, 22 bp, Artificial Sequence
  chemically synthesized
ttatttttgcttaggattgtct

SEQ ID NO: 1243780 - DNA, 22 bp, Artificial Sequence
  chemically synthesized
gttatttttgcttaggattgtc

SEQ ID NO: 1243781 - DNA, 22 bp, Artificial Sequence
  chemically synthesized
tgttatttttgcttaggattgt

SEQ ID NO: 1243782 - DNA, 22 bp, Artificial Sequence
  chemically synthesized
gctttgttatttttgcttagga

SEQ ID NO: 1243783 - DNA, 22 bp, Artificial Sequence
  chemically synthesized
tagctttgttatttttgcttag

SEQ ID NO: 1243784 - DNA, 22 bp, Artificial Sequence
  chemically synthesized
ctagctttgttatttttgctta

SEQ ID NO: 1243785 - DNA, 22 bp, Artificial Sequence
  chemically synthesized
ggcttctagctttgttattttt

SEQ ID NO: 1243786 - DNA, 22 bp, Artificial Sequence
  chemically synthesized
agcaaaaataacaaagctagaa

SEQ ID NO: 1243787 - DNA, 22 bp, Artificial Sequence
  chemically synthesized
aagtcaggtagcattaggcttc

SEQ ID NO: 1243788 - DNA, 22 bp, Artificial Sequence
  chemically synthesized
gaagcctaatgctacctgactt

SEQ ID NO: 1243789 - DNA, 22 bp, Artificial Sequence
  chemically synthesized
ggtagtatagtctgaagtcagg

SEQ ID NO: 1243790 - DNA, 22 bp, Artificial Sequence
  chemically synthesized
gggtagtatagtctgaagtcag

SEQ ID NO: 1243791 - DNA, 22 bp, Artificial Sequence
  chemically synthesized
tgggtagtatagtctgaagtca

SEQ ID NO: 1243792 - DNA, 22 bp, Artificial Sequence
  chemically synthesized
atgctacctgacttcagactat

SEQ ID NO: 1243793 - DNA, 22 bp, Artificial Sequence
  chemically synthesized
cctgacttcagactatactacc

SEQ ID NO: 1243794 - DNA, 22 bp, Artificial Sequence
  chemically synthesized
acttcagactatactacccaaa

SEQ ID NO: 1243795 - DNA, 22 bp, Artificial Sequence
  chemically synthesized
ccagtaccatgatgttttgggt

SEQ ID NO: 1243796 - DNA, 22 bp, Artificial Sequence
  chemically synthesized
cagactatactacccaaaacat

SEQ ID NO: 1243797 - DNA, 22 bp, Artificial Sequence
  chemically synthesized
agactatactacccaaaacatc

SEQ ID NO: 1243798 - DNA, 22 bp, Artificial Sequence
  chemically synthesized
taccagtaccatgatgttttgg

SEQ ID NO: 1243799 - DNA, 22 bp, Artificial Sequence
  chemically synthesized
ctaccagtaccatgatgttttg

SEQ ID NO: 1243800 - DNA, 22 bp, Artificial Sequence
  chemically synthesized
tctaccagtaccatgatgtttt

SEQ ID NO: 1243801 - DNA, 22 bp, Artificial Sequence
  chemically synthesized
ttctaccagtaccatgatgttt

SEQ ID NO: 1243802 - DNA, 22 bp, Artificial Sequence
  chemically synthesized
tactacccaaaacatcatggta

SEQ ID NO: 1243803 - DNA, 22 bp, Artificial Sequence
  chemically synthesized
tttttctaccagtaccatgatg

SEQ ID NO: 1243804 - DNA, 22 bp, Artificial Sequence
  chemically synthesized
cccaaaacatcatggtactggt

SEQ ID NO: 1243805 - DNA, 22 bp, Artificial Sequence
  chemically synthesized
tgtgtctgtttttctaccagta

SEQ ID NO: 1243806 - DNA, 22 bp, Artificial Sequence
  chemically synthesized
gtctatgtgtctgtttttctac

SEQ ID NO: 1243807 - DNA, 22 bp, Artificial Sequence
  chemically synthesized
cattggtctatgtgtctgtttt

SEQ ID NO: 1243808 - DNA, 22 bp, Artificial Sequence
  chemically synthesized
ttccattggtctatgtgtctgt

SEQ ID NO: 1243809 - DNA, 22 bp, Artificial Sequence
  chemically synthesized
tgttccattggtctatgtgtct

SEQ ID NO: 1243810 - DNA, 22 bp, Artificial Sequence
  chemically synthesized
gtagaaaaacagacacatagac

SEQ ID NO: 1243811 - DNA, 22 bp, Artificial Sequence
  chemically synthesized
gttctgttccattggtctatgt

SEQ ID NO: 1243812 - DNA, 22 bp, Artificial Sequence
  chemically synthesized
caagatgttggttctgttccat

SEQ ID NO: 1243813 - DNA, 22 bp, Artificial Sequence
  chemically synthesized
ccaagatgttggttctgttcca

SEQ ID NO: 1243814 - DNA, 22 bp, Artificial Sequence
  chemically synthesized
tttccaagatgttggttctgtt

SEQ ID NO: 1243815 - DNA, 22 bp, Artificial Sequence
  chemically synthesized
atttccaagatgttggttctgt

SEQ ID NO: 1243816 - DNA, 22 bp, Artificial Sequence
  chemically synthesized
gatgtgtgatcttatttccaag

SEQ ID NO: 1243817 - DNA, 22 bp, Artificial Sequence
  chemically synthesized
ggtattagatgtgtgatcttat

SEQ ID NO: 1243818 - DNA, 22 bp, Artificial Sequence
  chemically synthesized
gttgggtattagatgtgtgatc

SEQ ID NO: 1243819 - DNA, 22 bp, Artificial Sequence
  chemically synthesized
ggaaataagatcacacatctaa

SEQ ID NO: 1243820 - DNA, 22 bp, Artificial Sequence
  chemically synthesized
gaaataagatcacacatctaat

SEQ ID NO: 1243821 - DNA, 22 bp, Artificial Sequence
  chemically synthesized
tcaaacatcagttggttgggta

SEQ ID NO: 1243822 - DNA, 22 bp, Artificial Sequence
  chemically synthesized
gtcaaacatcagttggttgggt

SEQ ID NO: 1243823 - DNA, 22 bp, Artificial Sequence
  chemically synthesized
tcaggtttgtcaaacatcagtt

SEQ ID NO: 1243824 - DNA, 22 bp, Artificial Sequence
  chemically synthesized
gtcaggtttgtcaaacatcagt

SEQ ID NO: 1243825 - DNA, 22 bp, Artificial Sequence
  chemically synthesized
atacccaaccaactgatgtttg

SEQ ID NO: 1243826 - DNA, 22 bp, Artificial Sequence
  chemically synthesized
tgtcaggtttgtcaaacatcag

SEQ ID NO: 1243827 - DNA, 22 bp, Artificial Sequence
  chemically synthesized
ttgtcaggtttgtcaaacatca

SEQ ID NO: 1243828 - DNA, 22 bp, Artificial Sequence
  chemically synthesized
tttttgtcaggtttgtcaaaca

SEQ ID NO: 1243829 - DNA, 22 bp, Artificial Sequence
  chemically synthesized
gtttttgtcaggtttgtcaaac

SEQ ID NO: 1243830 - DNA, 22 bp, Artificial Sequence
  chemically synthesized
cttgtttttgtcaggtttgtca

SEQ ID NO: 1243831 - DNA, 22 bp, Artificial Sequence
  chemically synthesized
atgtttgacaaacctgacaaaa

SEQ ID NO: 1243832 - DNA, 22 bp, Artificial Sequence
  chemically synthesized
cccattgcttgtttttgtcagg

SEQ ID NO: 1243833 - DNA, 22 bp, Artificial Sequence
  chemically synthesized
ccccattgcttgtttttgtcag

SEQ ID NO: 1243834 - DNA, 22 bp, Artificial Sequence
  chemically synthesized
tccccattgcttgtttttgtca

SEQ ID NO: 1243835 - DNA, 22 bp, Artificial Sequence
  chemically synthesized
gacaaacctgacaaaaacaagc

SEQ ID NO: 1243836 - DNA, 22 bp, Artificial Sequence
  chemically synthesized
acaaacctgacaaaaacaagca

SEQ ID NO: 1243837 - DNA, 22 bp, Artificial Sequence
  chemically synthesized
acaaaaacaagcaatggggaaa

SEQ ID NO: 1243838 - DNA, 22 bp, Artificial Sequence
  chemically synthesized
aatagggaatcctttccccatt

SEQ ID NO: 1243839 - DNA, 22 bp, Artificial Sequence
  chemically synthesized
ttaaatagggaatcctttcccc

SEQ ID NO: 1243840 - DNA, 22 bp, Artificial Sequence
  chemically synthesized
attaaatagggaatcctttccc

SEQ ID NO: 1243841 - DNA, 22 bp, Artificial Sequence
  chemically synthesized
ccagcaccatttattaaatagg

SEQ ID NO: 1243842 - DNA, 22 bp, Artificial Sequence
  chemically synthesized
cccagcaccatttattaaatag

SEQ ID NO: 1243843 - DNA, 22 bp, Artificial Sequence
  chemically synthesized
gccagtcttcccagcaccattt

SEQ ID NO: 1243844 - DNA, 22 bp, Artificial Sequence
  chemically synthesized
cctatttaataaatggtgctgg

SEQ ID NO: 1243845 - DNA, 22 bp, Artificial Sequence
  chemically synthesized
tttaataaatggtgctgggaag

SEQ ID NO: 1243846 - DNA, 22 bp, Artificial Sequence
  chemically synthesized
aataaatggtgctgggaagact

SEQ ID NO: 1243847 - DNA, 22 bp, Artificial Sequence
  chemically synthesized
ataaatggtgctgggaagactg

SEQ ID NO: 1243848 - DNA, 22 bp, Artificial Sequence
  chemically synthesized
aatatggctagccagtcttccc

SEQ ID NO: 1243849 - DNA, 22 bp, Artificial Sequence
  chemically synthesized
tgaatatggctagccagtcttc

SEQ ID NO: 1243850 - DNA, 22 bp, Artificial Sequence
  chemically synthesized
ctgaatatggctagccagtctt

SEQ ID NO: 1243851 - DNA, 22 bp, Artificial Sequence
  chemically synthesized
tctgaatatggctagccagtct

SEQ ID NO: 1243852 - DNA, 22 bp, Artificial Sequence
  chemically synthesized
agttttctgaatatggctagcc

SEQ ID NO: 1243853 - DNA, 22 bp, Artificial Sequence
  chemically synthesized
cagttttctgaatatggctagc

SEQ ID NO: 1243854 - DNA, 22 bp, Artificial Sequence
  chemically synthesized
ggaagactggctagccatattc

SEQ ID NO: 1243855 - DNA, 22 bp, Artificial Sequence
  chemically synthesized
gctagccatattcagaaaactg

SEQ ID NO: 1243856 - DNA, 22 bp, Artificial Sequence
  chemically synthesized
gccatattcagaaaactgaaac

SEQ ID NO: 1243857 - DNA, 22 bp, Artificial Sequence
  chemically synthesized
agaaaactgaaactggacacct

SEQ ID NO: 1243858 - DNA, 22 bp, Artificial Sequence
  chemically synthesized
tataaggtgtaaggaaggtgtc

SEQ ID NO: 1243859 - DNA, 22 bp, Artificial Sequence
  chemically synthesized
gtataaggtgtaaggaaggtgt

SEQ ID NO: 1243860 - DNA, 22 bp, Artificial Sequence
  chemically synthesized
tgtataaggtgtaaggaaggtg

SEQ ID NO: 1243861 - DNA, 22 bp, Artificial Sequence
  chemically synthesized
ttgtataaggtgtaaggaaggt

SEQ ID NO: 1243862 - DNA, 22 bp, Artificial Sequence
  chemically synthesized
aaactggacaccttccttacac

SEQ ID NO: 1243863 - DNA, 22 bp, Artificial Sequence
  chemically synthesized
atttttgtataaggtgtaagga

SEQ ID NO: 1243864 - DNA, 22 bp, Artificial Sequence
  chemically synthesized
gacaccttccttacaccttata

SEQ ID NO: 1243865 - DNA, 22 bp, Artificial Sequence
  chemically synthesized
agttaatttttgtataaggtgt

SEQ ID NO: 1243866 - DNA, 22 bp, Artificial Sequence
  chemically synthesized
gagttaatttttgtataaggtg

SEQ ID NO: 1243867 - DNA, 22 bp, Artificial Sequence
  chemically synthesized
ccttacaccttatacaaaaatt

SEQ ID NO: 1243868 - DNA, 22 bp, Artificial Sequence
  chemically synthesized
cttacaccttatacaaaaatta

SEQ ID NO: 1243869 - DNA, 22 bp, Artificial Sequence
  chemically synthesized
atccatcttgagttaatttttg

SEQ ID NO: 1243870 - DNA, 22 bp, Artificial Sequence
  chemically synthesized
aatccatcttgagttaattttt

SEQ ID NO: 1243871 - DNA, 22 bp, Artificial Sequence
  chemically synthesized
acaccttatacaaaaattaact

SEQ ID NO: 1243872 - DNA, 22 bp, Artificial Sequence
  chemically synthesized
taatccatcttgagttaatttt

SEQ ID NO: 1243873 - DNA, 22 bp, Artificial Sequence
  chemically synthesized
caccttatacaaaaattaactc

SEQ ID NO: 1243874 - DNA, 22 bp, Artificial Sequence
  chemically synthesized
agtctttaatccatcttgagtt

SEQ ID NO: 1243875 - DNA, 22 bp, Artificial Sequence
  chemically synthesized
atacaaaaattaactcaagatg

SEQ ID NO: 1243876 - DNA, 22 bp, Artificial Sequence
  chemically synthesized
aagtctttaatccatcttgagt

SEQ ID NO: 1243877 - DNA, 22 bp, Artificial Sequence
  chemically synthesized
tacaaaaattaactcaagatgg

SEQ ID NO: 1243878 - DNA, 22 bp, Artificial Sequence
  chemically synthesized
tgtttaagtctttaatccatct

SEQ ID NO: 1243879 - DNA, 22 bp, Artificial Sequence
  chemically synthesized
gtgtttaagtctttaatccatc

SEQ ID NO: 1243880 - DNA, 22 bp, Artificial Sequence
  chemically synthesized
tgtgtttaagtctttaatccat

SEQ ID NO: 1243881 - DNA, 22 bp, Artificial Sequence
  chemically synthesized
actcaagatggattaaagactt

SEQ ID NO: 1243882 - DNA, 22 bp, Artificial Sequence
  chemically synthesized
gtgggttttgtgtttaagtctt

SEQ ID NO: 1243883 - DNA, 22 bp, Artificial Sequence
  chemically synthesized
aagatggattaaagacttaaac

SEQ ID NO: 1243884 - DNA, 22 bp, Artificial Sequence
  chemically synthesized
tagttagtgggttttgtgttta

SEQ ID NO: 1243885 - DNA, 22 bp, Artificial Sequence
  chemically synthesized
atagttagtgggttttgtgttt

SEQ ID NO: 1243886 - DNA, 22 bp, Artificial Sequence
  chemically synthesized
tatagttagtgggttttgtgtt

SEQ ID NO: 1243887 - DNA, 22 bp, Artificial Sequence
  chemically synthesized
ttatagttagtgggttttgtgt

SEQ ID NO: 1243888 - DNA, 22 bp, Artificial Sequence
  chemically synthesized
aagacttaaacacaaaacccac

SEQ ID NO: 1243889 - DNA, 22 bp, Artificial Sequence
  chemically synthesized
cagggtttttatagttagtggg

SEQ ID NO: 1243890 - DNA, 22 bp, Artificial Sequence
  chemically synthesized
acagggtttttatagttagtgg

SEQ ID NO: 1243891 - DNA, 22 bp, Artificial Sequence
  chemically synthesized
aaacacaaaacccactaactat

SEQ ID NO: 1243892 - DNA, 22 bp, Artificial Sequence
  chemically synthesized
aacacaaaacccactaactata

SEQ ID NO: 1243893 - DNA, 22 bp, Artificial Sequence
  chemically synthesized
ttacagggtttttatagttagt

SEQ ID NO: 1243894 - DNA, 22 bp, Artificial Sequence
  chemically synthesized
cttacagggtttttatagttag

SEQ ID NO: 1243895 - DNA, 22 bp, Artificial Sequence
  chemically synthesized
tcttacagggtttttatagtta

SEQ ID NO: 1243896 - DNA, 22 bp, Artificial Sequence
  chemically synthesized
gattttcttacagggtttttat

SEQ ID NO: 1243897 - DNA, 22 bp, Artificial Sequence
  chemically synthesized
agattttcttacagggttttta

SEQ ID NO: 1243898 - DNA, 22 bp, Artificial Sequence
  chemically synthesized
cttagattttcttacagggttt

SEQ ID NO: 1243899 - DNA, 22 bp, Artificial Sequence
  chemically synthesized
actataaaaaccctgtaagaaa

SEQ ID NO: 1243900 - DNA, 22 bp, Artificial Sequence
  chemically synthesized
taaaaaccctgtaagaaaatct

SEQ ID NO: 1243901 - DNA, 22 bp, Artificial Sequence
  chemically synthesized
aatggtattgcttagattttct

SEQ ID NO: 1243902 - DNA, 22 bp, Artificial Sequence
  chemically synthesized
taagaaaatctaagcaatacca

SEQ ID NO: 1243903 - DNA, 22 bp, Artificial Sequence
  chemically synthesized
tgcatatatcctgaatggtatt

SEQ ID NO: 1243904 - DNA, 22 bp, Artificial Sequence
  chemically synthesized
cctgtgcatatatcctgaatgg

SEQ ID NO: 1243905 - DNA, 22 bp, Artificial Sequence
  chemically synthesized
gcctgtgcatatatcctgaatg

SEQ ID NO: 1243906 - DNA, 22 bp, Artificial Sequence
  chemically synthesized
tgcctgtgcatatatcctgaat

SEQ ID NO: 1243907 - DNA, 22 bp, Artificial Sequence
  chemically synthesized
agcaataccattcaggatatat

SEQ ID NO: 1243908 - DNA, 22 bp, Artificial Sequence
  chemically synthesized
aggatatatgcacaggcaaaga

SEQ ID NO: 1243909 - DNA, 22 bp, Artificial Sequence
  chemically synthesized
tcaggaaatcaaaatctttgcc

SEQ ID NO: 1243910 - DNA, 22 bp, Artificial Sequence
  chemically synthesized
gtcaggaaatcaaaatctttgc

SEQ ID NO: 1243911 - DNA, 22 bp, Artificial Sequence
  chemically synthesized
tgtcaggaaatcaaaatctttg

SEQ ID NO: 1243912 - DNA, 22 bp, Artificial Sequence
  chemically synthesized
ttgtcaggaaatcaaaatcttt

SEQ ID NO: 1243913 - DNA, 22 bp, Artificial Sequence
  chemically synthesized
atgtttttgtcaggaaatcaaa

SEQ ID NO: 1243914 - DNA, 22 bp, Artificial Sequence
  chemically synthesized
actgatgtttttgtcaggaaat

SEQ ID NO: 1243915 - DNA, 22 bp, Artificial Sequence
  chemically synthesized
caattgactgatgtttttgtca

SEQ ID NO: 1243916 - DNA, 22 bp, Artificial Sequence
  chemically synthesized
ttgcaattgactgatgtttttg

SEQ ID NO: 1243917 - DNA, 22 bp, Artificial Sequence
  chemically synthesized
tgatttcctgacaaaaacatca

SEQ ID NO: 1243918 - DNA, 22 bp, Artificial Sequence
  chemically synthesized
gttgcaattgactgatgttttt

SEQ ID NO: 1243919 - DNA, 22 bp, Artificial Sequence
  chemically synthesized
gatttcctgacaaaaacatcag

SEQ ID NO: 1243920 - DNA, 22 bp, Artificial Sequence
  chemically synthesized
tgttgcaattgactgatgtttt

SEQ ID NO: 1243921 - DNA, 22 bp, Artificial Sequence
  chemically synthesized
atttcctgacaaaaacatcagt

SEQ ID NO: 1243922 - DNA, 22 bp, Artificial Sequence
  chemically synthesized
gttttgttgcaattgactgatg

SEQ ID NO: 1243923 - DNA, 22 bp, Artificial Sequence
  chemically synthesized
cctgacaaaaacatcagtcaat

SEQ ID NO: 1243924 - DNA, 22 bp, Artificial Sequence
  chemically synthesized
agttttgttgcaattgactgat

SEQ ID NO: 1243925 - DNA, 22 bp, Artificial Sequence
  chemically synthesized
ctgacaaaaacatcagtcaatt

SEQ ID NO: 1243926 - DNA, 22 bp, Artificial Sequence
  chemically synthesized
tagttttgttgcaattgactga

SEQ ID NO: 1243927 - DNA, 22 bp, Artificial Sequence
  chemically synthesized
ttagttttgttgcaattgactg

SEQ ID NO: 1243928 - DNA, 22 bp, Artificial Sequence
  chemically synthesized
acaaaaacatcagtcaattgca

SEQ ID NO: 1243929 - DNA, 22 bp, Artificial Sequence
  chemically synthesized
atttttagttttgttgcaattg

SEQ ID NO: 1243930 - DNA, 22 bp, Artificial Sequence
  chemically synthesized
ttaatttttagttttgttgcaa

SEQ ID NO: 1243931 - DNA, 22 bp, Artificial Sequence
  chemically synthesized
agttgttaatttttagttttgt

SEQ ID NO: 1243932 - DNA, 22 bp, Artificial Sequence
  chemically synthesized
tctcagttgttaatttttagtt

SEQ ID NO: 1243933 - DNA, 22 bp, Artificial Sequence
  chemically synthesized
tatctcagttgttaatttttag

SEQ ID NO: 1243934 - DNA, 22 bp, Artificial Sequence
  chemically synthesized
caacaaaactaaaaattaacaa

SEQ ID NO: 1243935 - DNA, 22 bp, Artificial Sequence
  chemically synthesized
gttctatctcagttgttaattt

SEQ ID NO: 1243936 - DNA, 22 bp, Artificial Sequence
  chemically synthesized
agttctatctcagttgttaatt

SEQ ID NO: 1243937 - DNA, 22 bp, Artificial Sequence
  chemically synthesized
tagttctatctcagttgttaat

SEQ ID NO: 1243938 - DNA, 22 bp, Artificial Sequence
  chemically synthesized
ttagttctatctcagttgttaa

SEQ ID NO: 1243939 - DNA, 22 bp, Artificial Sequence
  chemically synthesized
aaaattaacaactgagatagaa

SEQ ID NO: 1243940 - DNA, 22 bp, Artificial Sequence
  chemically synthesized
tacagaagccttttagttctat

SEQ ID NO: 1243941 - DNA, 22 bp, Artificial Sequence
  chemically synthesized
acaactgagatagaactaaaag

SEQ ID NO: 1243942 - DNA, 22 bp, Artificial Sequence
  chemically synthesized
ctgtacagaagccttttagttc

SEQ ID NO: 1243943 - DNA, 22 bp, Artificial Sequence
  chemically synthesized
gctgtacagaagccttttagtt

SEQ ID NO: 1243944 - DNA, 22 bp, Artificial Sequence
  chemically synthesized
tgctgtacagaagccttttagt

SEQ ID NO: 1243945 - DNA, 22 bp, Artificial Sequence
  chemically synthesized
ttgctgtacagaagccttttag

SEQ ID NO: 1243946 - DNA, 22 bp, Artificial Sequence
  chemically synthesized
tttgctgtacagaagcctttta

SEQ ID NO: 1243947 - DNA, 22 bp, Artificial Sequence
  chemically synthesized
ttttgctgtacagaagcctttt

SEQ ID NO: 1243948 - DNA, 22 bp, Artificial Sequence
  chemically synthesized
tttttgctgtacagaagccttt

SEQ ID NO: 1243949 - DNA, 22 bp, Artificial Sequence
  chemically synthesized
agatagaactaaaaggcttctg

SEQ ID NO: 1243950 - DNA, 22 bp, Artificial Sequence
  chemically synthesized
ttttttgctgtacagaagcctt

SEQ ID NO: 1243951 - DNA, 22 bp, Artificial Sequence
  chemically synthesized
tttttttgctgtacagaagcct

SEQ ID NO: 1243952 - DNA, 22 bp, Artificial Sequence
  chemically synthesized
ttttttttgctgtacagaagcc

SEQ ID NO: 1243953 - DNA, 22 bp, Artificial Sequence
  chemically synthesized
tttttttttgctgtacagaagc

SEQ ID NO: 1243954 - DNA, 22 bp, Artificial Sequence
  chemically synthesized
ttttttttttgctgtacagaag

SEQ ID NO: 1243955 - DNA, 22 bp, Artificial Sequence
  chemically synthesized
tttttttttttgctgtacagaa

SEQ ID NO: 1243956 - DNA, 22 bp, Artificial Sequence
  chemically synthesized
ttttttttttttgctgtacaga

SEQ ID NO: 1243957 - DNA, 22 bp, Artificial Sequence
  chemically synthesized
tttttttttttttgctgtacag

SEQ ID NO: 1243958 - DNA, 22 bp, Artificial Sequence
  chemically synthesized
ttttttttttttttgctgtaca

SEQ ID NO: 1243959 - DNA, 22 bp, Artificial Sequence
  chemically synthesized
tttttttttttttttgctgtac

SEQ ID NO: 1243960 - DNA, 22 bp, Artificial Sequence
  chemically synthesized
ttttttttttttttttgctgta

SEQ ID NO: 1243961 - DNA, 22 bp, Artificial Sequence
  chemically synthesized
aaaggcttctgtacagcaaaaa

SEQ ID NO: 1243962 - DNA, 22 bp, Artificial Sequence
  chemically synthesized
tttttttttttttttttgctgt

SEQ ID NO: 1243963 - DNA, 22 bp, Artificial Sequence
  chemically synthesized
ttttttttttttttttttgctg

SEQ ID NO: 1243964 - DNA, 22 bp, Artificial Sequence
  chemically synthesized
tttttttttttttttttttgct

SEQ ID NO: 1243965 - DNA, 22 bp, Artificial Sequence
  chemically synthesized
ttttttttttttttttttttgc

SEQ ID NO: 1243966 - DNA, 22 bp, Artificial Sequence
  chemically synthesized
tttttttttttttttttttttg

SEQ ID NO: 1243967 - DNA, 22 bp, Artificial Sequence
  chemically synthesized
tttttttttttttttttttttt

SEQ ID NO: 1243968 - DNA, 22 bp, Artificial Sequence
  chemically synthesized
tttttttttttttttttttttt

SEQ ID NO: 1243969 - DNA, 22 bp, Artificial Sequence
  chemically synthesized
tttttttttttttttttttttt

SEQ ID NO: 1243970 - DNA, 22 bp, Artificial Sequence
  chemically synthesized
ctgtacagcaaaaaaaaaaaaa

SEQ ID NO: 1243971 - DNA, 22 bp, Artificial Sequence
  chemically synthesized
tttttttttttttttttttttt

SEQ ID NO: 1243972 - DNA, 22 bp, Artificial Sequence
  chemically synthesized
tgtacagcaaaaaaaaaaaaaa

SEQ ID NO: 1243973 - DNA, 22 bp, Artificial Sequence
  chemically synthesized
tttttttttttttttttttttt

SEQ ID NO: 1243974 - DNA, 22 bp, Artificial Sequence
  chemically synthesized
tttttttttttttttttttttt

SEQ ID NO: 1243975 - DNA, 22 bp, Artificial Sequence
  chemically synthesized
tacagcaaaaaaaaaaaaaaaa

SEQ ID NO: 1243976 - DNA, 22 bp, Artificial Sequence
  chemically synthesized
tggttttttttttttttttttt

SEQ ID NO: 1243977 - DNA, 22 bp, Artificial Sequence
  chemically synthesized
gtggtttttttttttttttttt

SEQ ID NO: 1243978 - DNA, 22 bp, Artificial Sequence
  chemically synthesized
tgtggttttttttttttttttt

SEQ ID NO: 1243979 - DNA, 22 bp, Artificial Sequence
  chemically synthesized
atgatgggttttgtggtttttt

SEQ ID NO: 1243980 - DNA, 22 bp, Artificial Sequence
  chemically synthesized
tgatgatgggttttgtggtttt

SEQ ID NO: 1243981 - DNA, 22 bp, Artificial Sequence
  chemically synthesized
attctgatgatgggttttgtgg

SEQ ID NO: 1243982 - DNA, 22 bp, Artificial Sequence
  chemically synthesized
ttcattctgatgatgggttttg

SEQ ID NO: 1243983 - DNA, 22 bp, Artificial Sequence
  chemically synthesized
cctgttcattctgatgatgggt

SEQ ID NO: 1243984 - DNA, 22 bp, Artificial Sequence
  chemically synthesized
gcctgttcattctgatgatggg

SEQ ID NO: 1243985 - DNA, 22 bp, Artificial Sequence
  chemically synthesized
tagtttgcctgttcattctgat

SEQ ID NO: 1243986 - DNA, 22 bp, Artificial Sequence
  chemically synthesized
tgtagtttgcctgttcattctg

SEQ ID NO: 1243987 - DNA, 22 bp, Artificial Sequence
  chemically synthesized
caaaaattctgtagtttgcctg

SEQ ID NO: 1243988 - DNA, 22 bp, Artificial Sequence
  chemically synthesized
atggtaaatagattgcaaaaat

SEQ ID NO: 1243989 - DNA, 22 bp, Artificial Sequence
  chemically synthesized
ttaatggtaaatagattgcaaa

SEQ ID NO: 1243990 - DNA, 22 bp, Artificial Sequence
  chemically synthesized
gttaatggtaaatagattgcaa

SEQ ID NO: 1243991 - DNA, 22 bp, Artificial Sequence
  chemically synthesized
tgttaatggtaaatagattgca

SEQ ID NO: 1243992 - DNA, 22 bp, Artificial Sequence
  chemically synthesized
cagaatttttgcaatctattta

SEQ ID NO: 1243993 - DNA, 22 bp, Artificial Sequence
  chemically synthesized
ttgcaatctatttaccattaac

SEQ ID NO: 1243994 - DNA, 22 bp, Artificial Sequence
  chemically synthesized
tgcaatctatttaccattaaca

SEQ ID NO: 1243995 - DNA, 22 bp, Artificial Sequence
  chemically synthesized
gcaatctatttaccattaacaa

SEQ ID NO: 1243996 - DNA, 22 bp, Artificial Sequence
  chemically synthesized
caatctatttaccattaacaaa

SEQ ID NO: 1243997 - DNA, 22 bp, Artificial Sequence
  chemically synthesized
tttaccattaacaaaacattct

SEQ ID NO: 1243998 - DNA, 22 bp, Artificial Sequence
  chemically synthesized
accattaacaaaacattcttcc

SEQ ID NO: 1243999 - DNA, 22 bp, Artificial Sequence
  chemically synthesized
ccattaacaaaacattcttccc

SEQ ID NO: 1244000 - DNA, 22 bp, Artificial Sequence
  chemically synthesized
cggcaaggatgcaggggaagaa

SEQ ID NO: 1244001 - DNA, 22 bp, Artificial Sequence
  chemically synthesized
acggcaaggatgcaggggaaga

SEQ ID NO: 1244002 - DNA, 22 bp, Artificial Sequence
  chemically synthesized
acaaaacattcttcccctgcat

SEQ ID NO: 1244003 - DNA, 22 bp, Artificial Sequence
  chemically synthesized
aggtcgaagcttacggcaagga

SEQ ID NO: 1244004 - DNA, 22 bp, Artificial Sequence
  chemically synthesized
ttcccctgcatccttgccgtaa

SEQ ID NO: 1244005 - DNA, 22 bp, Artificial Sequence
  chemically synthesized
cccctgcatccttgccgtaagc

SEQ ID NO: 1244006 - DNA, 22 bp, Artificial Sequence
  chemically synthesized
ccctgcatccttgccgtaagct

SEQ ID NO: 1244007 - DNA, 22 bp, Artificial Sequence
  chemically synthesized
catccttgccgtaagcttcgac

SEQ ID NO: 1244008 - DNA, 22 bp, Artificial Sequence
  chemically synthesized
tccaaggctgaggtcgaagctt

SEQ ID NO: 1244009 - DNA, 22 bp, Artificial Sequence
  chemically synthesized
gccgtaagcttcgacctcagcc

SEQ ID NO: 1244010 - DNA, 22 bp, Artificial Sequence
  chemically synthesized
ccgtaagcttcgacctcagcct

SEQ ID NO: 1244011 - DNA, 22 bp, Artificial Sequence
  chemically synthesized
gaggagggtgggtctatccaag

SEQ ID NO: 1244012 - DNA, 22 bp, Artificial Sequence
  chemically synthesized
cgacctcagccttggatagacc

SEQ ID NO: 1244013 - DNA, 22 bp, Artificial Sequence
  chemically synthesized
gacctcagccttggatagaccc

SEQ ID NO: 1244014 - DNA, 22 bp, Artificial Sequence
  chemically synthesized
caggttggaggagggtgggtct

SEQ ID NO: 1244015 - DNA, 22 bp, Artificial Sequence
  chemically synthesized
agccttggatagacccaccctc

SEQ ID NO: 1244016 - DNA, 22 bp, Artificial Sequence
  chemically synthesized
ggatagacccaccctcctccaa

SEQ ID NO: 1244017 - DNA, 22 bp, Artificial Sequence
  chemically synthesized
gatagacccaccctcctccaac

SEQ ID NO: 1244018 - DNA, 22 bp, Artificial Sequence
  chemically synthesized
ctccaacctgcaatcttttccc

SEQ ID NO: 1244019 - DNA, 22 bp, Artificial Sequence
  chemically synthesized
caacctgcaatcttttcccgtg

SEQ ID NO: 1244020 - DNA, 22 bp, Artificial Sequence
  chemically synthesized
agagaaaaaaaacacgggaaaa

SEQ ID NO: 1244021 - DNA, 22 bp, Artificial Sequence
  chemically synthesized
caatcttttcccgtgttttttt

SEQ ID NO: 1244022 - DNA, 22 bp, Artificial Sequence
  chemically synthesized
ttcccgtgttttttttctctta

SEQ ID NO: 1244023 - DNA, 22 bp, Artificial Sequence
  chemically synthesized
tcccgtgttttttttctcttaa

SEQ ID NO: 1244024 - DNA, 22 bp, Artificial Sequence
  chemically synthesized
cccgtgttttttttctcttaat

SEQ ID NO: 1244025 - DNA, 22 bp, Artificial Sequence
  chemically synthesized
ccgtgttttttttctcttaatc

SEQ ID NO: 1244026 - DNA, 22 bp, Artificial Sequence
  chemically synthesized
tttttctcttaatcttggtcta

SEQ ID NO: 1244027 - DNA, 22 bp, Artificial Sequence
  chemically synthesized
ttttctcttaatcttggtctat

SEQ ID NO: 1244028 - DNA, 22 bp, Artificial Sequence
  chemically synthesized
tttctcttaatcttggtctatt

SEQ ID NO: 1244029 - DNA, 22 bp, Artificial Sequence
  chemically synthesized
ttctcttaatcttggtctattt

SEQ ID NO: 1244030 - DNA, 22 bp, Artificial Sequence
  chemically synthesized
tctcttaatcttggtctatttt

SEQ ID NO: 1244031 - DNA, 22 bp, Artificial Sequence
  chemically synthesized
ctcttaatcttggtctattttt

SEQ ID NO: 1244032 - DNA, 22 bp, Artificial Sequence
  chemically synthesized
tcttaatcttggtctatttttc

SEQ ID NO: 1244033 - DNA, 22 bp, Artificial Sequence
  chemically synthesized
gtgaagcagagaggaaaaatag

SEQ ID NO: 1244034 - DNA, 22 bp, Artificial Sequence
  chemically synthesized
ttaatcttggtctatttttcct

SEQ ID NO: 1244035 - DNA, 22 bp, Artificial Sequence
  chemically synthesized
aatcttggtctatttttcctct

SEQ ID NO: 1244036 - DNA, 22 bp, Artificial Sequence
  chemically synthesized
ttggtgaagcagagaggaaaaa

SEQ ID NO: 1244037 - DNA, 22 bp, Artificial Sequence
  chemically synthesized
atcttggtctatttttcctctc

SEQ ID NO: 1244038 - DNA, 22 bp, Artificial Sequence
  chemically synthesized
ggtctatttttcctctctgctt

SEQ ID NO: 1244039 - DNA, 22 bp, Artificial Sequence
  chemically synthesized
gtctatttttcctctctgcttc

SEQ ID NO: 1244040 - DNA, 22 bp, Artificial Sequence
  chemically synthesized
tttttcctctctgcttcaccaa

SEQ ID NO: 1244041 - DNA, 22 bp, Artificial Sequence
  chemically synthesized
ttcctctctgcttcaccaacag

SEQ ID NO: 1244042 - DNA, 22 bp, Artificial Sequence
  chemically synthesized
tcctctctgcttcaccaacagt

SEQ ID NO: 1244043 - DNA, 22 bp, Artificial Sequence
  chemically synthesized
cctctctgcttcaccaacagtt

SEQ ID NO: 1244044 - DNA, 22 bp, Artificial Sequence
  chemically synthesized
ctctctgcttcaccaacagttc

SEQ ID NO: 1244045 - DNA, 22 bp, Artificial Sequence
  chemically synthesized
tctgcttcaccaacagttcatc

SEQ ID NO: 1244046 - DNA, 22 bp, Artificial Sequence
  chemically synthesized
tgcttcaccaacagttcatctc

SEQ ID NO: 1244047 - DNA, 22 bp, Artificial Sequence
  chemically synthesized
aagaaagaatagggagatgaac

SEQ ID NO: 1244048 - DNA, 22 bp, Artificial Sequence
  chemically synthesized
cttcaccaacagttcatctccc

SEQ ID NO: 1244049 - DNA, 22 bp, Artificial Sequence
  chemically synthesized
caccaacagttcatctccctat

SEQ ID NO: 1244050 - DNA, 22 bp, Artificial Sequence
  chemically synthesized
accaacagttcatctccctatt

SEQ ID NO: 1244051 - DNA, 22 bp, Artificial Sequence
  chemically synthesized
agaagacactgaagaaagaata

SEQ ID NO: 1244052 - DNA, 22 bp, Artificial Sequence
  chemically synthesized
cagaagacactgaagaaagaat

SEQ ID NO: 1244053 - DNA, 22 bp, Artificial Sequence
  chemically synthesized
atctccctattctttcttcagt

SEQ ID NO: 1244054 - DNA, 22 bp, Artificial Sequence
  chemically synthesized
gggtttcagaagacactgaaga

SEQ ID NO: 1244055 - DNA, 22 bp, Artificial Sequence
  chemically synthesized
tagggtttcagaagacactgaa

SEQ ID NO: 1244056 - DNA, 22 bp, Artificial Sequence
  chemically synthesized
cctattctttcttcagtgtctt

SEQ ID NO: 1244057 - DNA, 22 bp, Artificial Sequence
  chemically synthesized
ttctagggtttcagaagacact

SEQ ID NO: 1244058 - DNA, 22 bp, Artificial Sequence
  chemically synthesized
ttctttcttcagtgtcttctga

SEQ ID NO: 1244059 - DNA, 22 bp, Artificial Sequence
  chemically synthesized
tttcttcagtgtcttctgaaac

SEQ ID NO: 1244060 - DNA, 22 bp, Artificial Sequence
  chemically synthesized
aaattattctagggtttcagaa

SEQ ID NO: 1244061 - DNA, 22 bp, Artificial Sequence
  chemically synthesized
tcttcagtgtcttctgaaaccc

SEQ ID NO: 1244062 - DNA, 22 bp, Artificial Sequence
  chemically synthesized
cttcagtgtcttctgaaaccct

SEQ ID NO: 1244063 - DNA, 22 bp, Artificial Sequence
  chemically synthesized
ttcagtgtcttctgaaacccta

SEQ ID NO: 1244064 - DNA, 22 bp, Artificial Sequence
  chemically synthesized
cagtgtcttctgaaaccctaga

SEQ ID NO: 1244065 - DNA, 22 bp, Artificial Sequence
  chemically synthesized
agtgtcttctgaaaccctagaa

SEQ ID NO: 1244066 - DNA, 22 bp, Artificial Sequence
  chemically synthesized
ctgaaaccctagaataatttga

SEQ ID NO: 1244067 - DNA, 22 bp, Artificial Sequence
  chemically synthesized
tgaaaccctagaataatttgaa

SEQ ID NO: 1244068 - DNA, 22 bp, Artificial Sequence
  chemically synthesized
aaaccctagaataatttgaatg

SEQ ID NO: 1244069 - DNA, 22 bp, Artificial Sequence
  chemically synthesized
agggcataaagacaaccattca

SEQ ID NO: 1244070 - DNA, 22 bp, Artificial Sequence
  chemically synthesized
gaataatttgaatggttgtctt

SEQ ID NO: 1244071 - DNA, 22 bp, Artificial Sequence
  chemically synthesized
agactgagggcataaagacaac

SEQ ID NO: 1244072 - DNA, 22 bp, Artificial Sequence
  chemically synthesized
gaatggttgtctttatgccctc

SEQ ID NO: 1244073 - DNA, 22 bp, Artificial Sequence
  chemically synthesized
aatggttgtctttatgccctca

SEQ ID NO: 1244074 - DNA, 22 bp, Artificial Sequence
  chemically synthesized
tggaatagctgagactgagggc

SEQ ID NO: 1244075 - DNA, 22 bp, Artificial Sequence
  chemically synthesized
ttatggaatagctgagactgag

SEQ ID NO: 1244076 - DNA, 22 bp, Artificial Sequence
  chemically synthesized
gttatggaatagctgagactga

SEQ ID NO: 1244077 - DNA, 22 bp, Artificial Sequence
  chemically synthesized
tctttatgccctcagtctcagc

SEQ ID NO: 1244078 - DNA, 22 bp, Artificial Sequence
  chemically synthesized
tatgccctcagtctcagctatt

SEQ ID NO: 1244079 - DNA, 22 bp, Artificial Sequence
  chemically synthesized
atgccctcagtctcagctattc

SEQ ID NO: 1244080 - DNA, 22 bp, Artificial Sequence
  chemically synthesized
tgccctcagtctcagctattcc

SEQ ID NO: 1244081 - DNA, 22 bp, Artificial Sequence
  chemically synthesized
agtctcagctattccataacaa

SEQ ID NO: 1244082 - DNA, 22 bp, Artificial Sequence
  chemically synthesized
agtaaggagagtttgttatgga

SEQ ID NO: 1244083 - DNA, 22 bp, Artificial Sequence
  chemically synthesized
taagtaaggagagtttgttatg

SEQ ID NO: 1244084 - DNA, 22 bp, Artificial Sequence
  chemically synthesized
agctattccataacaaactctc

SEQ ID NO: 1244085 - DNA, 22 bp, Artificial Sequence
  chemically synthesized
ttccataacaaactctccttac

SEQ ID NO: 1244086 - DNA, 22 bp, Artificial Sequence
  chemically synthesized
cataacaaactctccttactta

SEQ ID NO: 1244087 - DNA, 22 bp, Artificial Sequence
  chemically synthesized
tccttacttagaatttgatctt

SEQ ID NO: 1244088 - DNA, 22 bp, Artificial Sequence
  chemically synthesized
cttacttagaatttgatcttca

SEQ ID NO: 1244089 - DNA, 22 bp, Artificial Sequence
  chemically synthesized
caggtaaacaaacatgaagatc

SEQ ID NO: 1244090 - DNA, 22 bp, Artificial Sequence
  chemically synthesized
acttagaatttgatcttcatgt

SEQ ID NO: 1244091 - DNA, 22 bp, Artificial Sequence
  chemically synthesized
cttagaatttgatcttcatgtt

SEQ ID NO: 1244092 - DNA, 22 bp, Artificial Sequence
  chemically synthesized
agaatttgatcttcatgtttgt

SEQ ID NO: 1244093 - DNA, 22 bp, Artificial Sequence
  chemically synthesized
gaatttgatcttcatgtttgtt

SEQ ID NO: 1244094 - DNA, 22 bp, Artificial Sequence
  chemically synthesized
ccattgcaggtaaacaaacatg

SEQ ID NO: 1244095 - DNA, 22 bp, Artificial Sequence
  chemically synthesized
accattgcaggtaaacaaacat

SEQ ID NO: 1244096 - DNA, 22 bp, Artificial Sequence
  chemically synthesized
tttaccattgcaggtaaacaaa

SEQ ID NO: 1244097 - DNA, 22 bp, Artificial Sequence
  chemically synthesized
gatcttcatgtttgtttacctg

SEQ ID NO: 1244098 - DNA, 22 bp, Artificial Sequence
  chemically synthesized
atcttcatgtttgtttacctgc

SEQ ID NO: 1244099 - DNA, 22 bp, Artificial Sequence
  chemically synthesized
agcctgtttaccattgcaggta

SEQ ID NO: 1244100 - DNA, 22 bp, Artificial Sequence
  chemically synthesized
aagcctgtttaccattgcaggt

SEQ ID NO: 1244101 - DNA, 22 bp, Artificial Sequence
  chemically synthesized
catgtttgtttacctgcaatgg

SEQ ID NO: 1244102 - DNA, 22 bp, Artificial Sequence
  chemically synthesized
atgtttgtttacctgcaatggt

SEQ ID NO: 1244103 - DNA, 22 bp, Artificial Sequence
  chemically synthesized
gtttacctgcaatggtaaacag

SEQ ID NO: 1244104 - DNA, 22 bp, Artificial Sequence
  chemically synthesized
tttacctgcaatggtaaacagg

SEQ ID NO: 1244105 - DNA, 22 bp, Artificial Sequence
  chemically synthesized
acctgcaatggtaaacaggctt

SEQ ID NO: 1244106 - DNA, 22 bp, Artificial Sequence
  chemically synthesized
cctgcaatggtaaacaggctta

SEQ ID NO: 1244107 - DNA, 22 bp, Artificial Sequence
  chemically synthesized
caatggtaaacaggcttaaggc

SEQ ID NO: 1244108 - DNA, 22 bp, Artificial Sequence
  chemically synthesized
aaggcttgtctccttcccccgc

SEQ ID NO: 1244109 - DNA, 22 bp, Artificial Sequence
  chemically synthesized
agtatggggagggcgggggaag

SEQ ID NO: 1244110 - DNA, 22 bp, Artificial Sequence
  chemically synthesized
aggcttgtctccttcccccgcc

SEQ ID NO: 1244111 - DNA, 22 bp, Artificial Sequence
  chemically synthesized
aagtatggggagggcgggggaa

SEQ ID NO: 1244112 - DNA, 22 bp, Artificial Sequence
  chemically synthesized
atcttaagtatggggagggcgg

SEQ ID NO: 1244113 - DNA, 22 bp, Artificial Sequence
  chemically synthesized
gtctccttcccccgccctcccc

SEQ ID NO: 1244114 - DNA, 22 bp, Artificial Sequence
  chemically synthesized
gatcttaagtatggggagggcg

SEQ ID NO: 1244115 - DNA, 22 bp, Artificial Sequence
  chemically synthesized
tctccttcccccgccctcccca

SEQ ID NO: 1244116 - DNA, 22 bp, Artificial Sequence
  chemically synthesized
cttcccccgccctccccatact

SEQ ID NO: 1244117 - DNA, 22 bp, Artificial Sequence
  chemically synthesized
ccacttgatcttaagtatgggg

SEQ ID NO: 1244118 - DNA, 22 bp, Artificial Sequence
  chemically synthesized
cccccgccctccccatacttaa

SEQ ID NO: 1244119 - DNA, 22 bp, Artificial Sequence
  chemically synthesized
ccccgccctccccatacttaag

SEQ ID NO: 1244120 - DNA, 22 bp, Artificial Sequence
  chemically synthesized
cccatacttaagatcaagtggg

SEQ ID NO: 1244121 - DNA, 22 bp, Artificial Sequence
  chemically synthesized
aaatagaaacctcccacttgat

SEQ ID NO: 1244122 - DNA, 22 bp, Artificial Sequence
  chemically synthesized
atatgttaaaatagaaacctcc

SEQ ID NO: 1244123 - DNA, 22 bp, Artificial Sequence
  chemically synthesized
aagatcaagtgggaggtttcta

SEQ ID NO: 1244124 - DNA, 22 bp, Artificial Sequence
  chemically synthesized
agatcaagtgggaggtttctat

SEQ ID NO: 1244125 - DNA, 22 bp, Artificial Sequence
  chemically synthesized
ctattttaacatattaactgat

SEQ ID NO: 1244126 - DNA, 22 bp, Artificial Sequence
  chemically synthesized
tattttaacatattaactgatg

SEQ ID NO: 1244127 - DNA, 22 bp, Artificial Sequence
  chemically synthesized
ttttaacatattaactgatgcc

SEQ ID NO: 1244128 - DNA, 22 bp, Artificial Sequence
  chemically synthesized
caagaatgagggaaggcatcag

SEQ ID NO: 1244129 - DNA, 22 bp, Artificial Sequence
  chemically synthesized
taacatattaactgatgccttc

SEQ ID NO: 1244130 - DNA, 22 bp, Artificial Sequence
  chemically synthesized
ccaagaatgagggaaggcatca

SEQ ID NO: 1244131 - DNA, 22 bp, Artificial Sequence
  chemically synthesized
aacatattaactgatgccttcc

SEQ ID NO: 1244132 - DNA, 22 bp, Artificial Sequence
  chemically synthesized
acatattaactgatgccttccc

SEQ ID NO: 1244133 - DNA, 22 bp, Artificial Sequence
  chemically synthesized
actgatgccttccctcattctt

SEQ ID NO: 1244134 - DNA, 22 bp, Artificial Sequence
  chemically synthesized
atgccttccctcattcttggaa

SEQ ID NO: 1244135 - DNA, 22 bp, Artificial Sequence
  chemically synthesized
ccctcattcttggaagctatat

SEQ ID NO: 1244136 - DNA, 22 bp, Artificial Sequence
  chemically synthesized
cctcattcttggaagctatata

SEQ ID NO: 1244137 - DNA, 22 bp, Artificial Sequence
  chemically synthesized
aggaagtacacatatatagctt

SEQ ID NO: 1244138 - DNA, 22 bp, Artificial Sequence
  chemically synthesized
gaggaagtacacatatatagct

SEQ ID NO: 1244139 - DNA, 22 bp, Artificial Sequence
  chemically synthesized
attcttggaagctatatatgtg

SEQ ID NO: 1244140 - DNA, 22 bp, Artificial Sequence
  chemically synthesized
ttggaagctatatatgtgtact

SEQ ID NO: 1244141 - DNA, 22 bp, Artificial Sequence
  chemically synthesized
ggaagctatatatgtgtacttc

SEQ ID NO: 1244142 - DNA, 22 bp, Artificial Sequence
  chemically synthesized
gaagctatatatgtgtacttcc

SEQ ID NO: 1244143 - DNA, 22 bp, Artificial Sequence
  chemically synthesized
tagtagcacgcttgaggaagta

SEQ ID NO: 1244144 - DNA, 22 bp, Artificial Sequence
  chemically synthesized
atagtagcacgcttgaggaagt

SEQ ID NO: 1244145 - DNA, 22 bp, Artificial Sequence
  chemically synthesized
tatagtagcacgcttgaggaag

SEQ ID NO: 1244146 - DNA, 22 bp, Artificial Sequence
  chemically synthesized
ttatagtagcacgcttgaggaa

SEQ ID NO: 1244147 - DNA, 22 bp, Artificial Sequence
  chemically synthesized
tatatgtgtacttcctcaagcg

SEQ ID NO: 1244148 - DNA, 22 bp, Artificial Sequence
  chemically synthesized
tatttttatagtagcacgcttg

SEQ ID NO: 1244149 - DNA, 22 bp, Artificial Sequence
  chemically synthesized
gtatttttatagtagcacgctt

SEQ ID NO: 1244150 - DNA, 22 bp, Artificial Sequence
  chemically synthesized
cttgtatttttatagtagcacg

SEQ ID NO: 1244151 - DNA, 22 bp, Artificial Sequence
  chemically synthesized
ccttgtatttttatagtagcac

SEQ ID NO: 1244152 - DNA, 22 bp, Artificial Sequence
  chemically synthesized
tccttgtatttttatagtagca

SEQ ID NO: 1244153 - DNA, 22 bp, Artificial Sequence
  chemically synthesized
tttccttgtatttttatagtag

SEQ ID NO: 1244154 - DNA, 22 bp, Artificial Sequence
  chemically synthesized
cctcaagcgtgctactataaaa

SEQ ID NO: 1244155 - DNA, 22 bp, Artificial Sequence
  chemically synthesized
ctcaagcgtgctactataaaaa

SEQ ID NO: 1244156 - DNA, 22 bp, Artificial Sequence
  chemically synthesized
aagcgtgctactataaaaatac

SEQ ID NO: 1244157 - DNA, 22 bp, Artificial Sequence
  chemically synthesized
atgtctctttccttgtattttt

SEQ ID NO: 1244158 - DNA, 22 bp, Artificial Sequence
  chemically synthesized
gatgtctctttccttgtatttt

SEQ ID NO: 1244159 - DNA, 22 bp, Artificial Sequence
  chemically synthesized
atccttgatgtctctttccttg

SEQ ID NO: 1244160 - DNA, 22 bp, Artificial Sequence
  chemically synthesized
ctataaaaatacaaggaaagag

SEQ ID NO: 1244161 - DNA, 22 bp, Artificial Sequence
  chemically synthesized
gatccttgatgtctctttcctt

SEQ ID NO: 1244162 - DNA, 22 bp, Artificial Sequence
  chemically synthesized
taaaaatacaaggaaagagaca

SEQ ID NO: 1244163 - DNA, 22 bp, Artificial Sequence
  chemically synthesized
tttgatccttgatgtctctttc

SEQ ID NO: 1244164 - DNA, 22 bp, Artificial Sequence
  chemically synthesized
agaaacacattatttgatcctt

SEQ ID NO: 1244165 - DNA, 22 bp, Artificial Sequence
  chemically synthesized
ctgagaaacacattatttgatc

SEQ ID NO: 1244166 - DNA, 22 bp, Artificial Sequence
  chemically synthesized
cagggaattactgagaaacaca

SEQ ID NO: 1244167 - DNA, 22 bp, Artificial Sequence
  chemically synthesized
tcaatagattccagggaattac

SEQ ID NO: 1244168 - DNA, 22 bp, Artificial Sequence
  chemically synthesized
atcaatagattccagggaatta

SEQ ID NO: 1244169 - DNA, 22 bp, Artificial Sequence
  chemically synthesized
atcttatcaatagattccaggg

SEQ ID NO: 1244170 - DNA, 22 bp, Artificial Sequence
  chemically synthesized
ctcagtaattccctggaatcta

SEQ ID NO: 1244171 - DNA, 22 bp, Artificial Sequence
  chemically synthesized
taatcttatcaatagattccag

SEQ ID NO: 1244172 - DNA, 22 bp, Artificial Sequence
  chemically synthesized
tcagtaattccctggaatctat

SEQ ID NO: 1244173 - DNA, 22 bp, Artificial Sequence
  chemically synthesized
agtaattccctggaatctattg

SEQ ID NO: 1244174 - DNA, 22 bp, Artificial Sequence
  chemically synthesized
cctggaatctattgataagatt

SEQ ID NO: 1244175 - DNA, 22 bp, Artificial Sequence
  chemically synthesized
aatgcagggctctaatcttatc

SEQ ID NO: 1244176 - DNA, 22 bp, Artificial Sequence
  chemically synthesized
caatgcagggctctaatcttat

SEQ ID NO: 1244177 - DNA, 22 bp, Artificial Sequence
  chemically synthesized
tcaatgcagggctctaatctta

SEQ ID NO: 1244178 - DNA, 22 bp, Artificial Sequence
  chemically synthesized
gaatctattgataagattagag

SEQ ID NO: 1244179 - DNA, 22 bp, Artificial Sequence
  chemically synthesized
ttcaatgcagggctctaatctt

SEQ ID NO: 1244180 - DNA, 22 bp, Artificial Sequence
  chemically synthesized
ttgataagattagagccctgca

SEQ ID NO: 1244181 - DNA, 22 bp, Artificial Sequence
  chemically synthesized
aggatttttcaatgcagggctc

SEQ ID NO: 1244182 - DNA, 22 bp, Artificial Sequence
  chemically synthesized
ataagattagagccctgcattg

SEQ ID NO: 1244183 - DNA, 22 bp, Artificial Sequence
  chemically synthesized
aatatactaaggatttttcaat

SEQ ID NO: 1244184 - DNA, 22 bp, Artificial Sequence
  chemically synthesized
gagccctgcattgaaaaatcct

SEQ ID NO: 1244185 - DNA, 22 bp, Artificial Sequence
  chemically synthesized
gtgctcaatatactaaggattt

SEQ ID NO: 1244186 - DNA, 22 bp, Artificial Sequence
  chemically synthesized
cattgaaaaatccttagtatat

SEQ ID NO: 1244187 - DNA, 22 bp, Artificial Sequence
  chemically synthesized
aaaaatccttagtatattgagc

SEQ ID NO: 1244188 - DNA, 22 bp, Artificial Sequence
  chemically synthesized
agtatattgagcaccaatgaca

SEQ ID NO: 1244189 - DNA, 22 bp, Artificial Sequence
  chemically synthesized
cgagatagataatgtcattggt

SEQ ID NO: 1244190 - DNA, 22 bp, Artificial Sequence
  chemically synthesized
gtatattgagcaccaatgacat

SEQ ID NO: 1244191 - DNA, 22 bp, Artificial Sequence
  chemically synthesized
acgagatagataatgtcattgg

SEQ ID NO: 1244192 - DNA, 22 bp, Artificial Sequence
  chemically synthesized
tttacgagatagataatgtcat

SEQ ID NO: 1244193 - DNA, 22 bp, Artificial Sequence
  chemically synthesized
atttacgagatagataatgtca

SEQ ID NO: 1244194 - DNA, 22 bp, Artificial Sequence
  chemically synthesized
ttatttacgagatagataatgt

SEQ ID NO: 1244195 - DNA, 22 bp, Artificial Sequence
  chemically synthesized
agcaccaatgacattatctatc

SEQ ID NO: 1244196 - DNA, 22 bp, Artificial Sequence
  chemically synthesized
ccagctcttatttacgagatag

SEQ ID NO: 1244197 - DNA, 22 bp, Artificial Sequence
  chemically synthesized
cccagctcttatttacgagata

SEQ ID NO: 1244198 - DNA, 22 bp, Artificial Sequence
  chemically synthesized
cacaatcttcccagctcttatt

SEQ ID NO: 1244199 - DNA, 22 bp, Artificial Sequence
  chemically synthesized
tctatctcgtaaataagagctg

SEQ ID NO: 1244200 - DNA, 22 bp, Artificial Sequence
  chemically synthesized
acacaatcttcccagctcttat

SEQ ID NO: 1244201 - DNA, 22 bp, Artificial Sequence
  chemically synthesized
tctcgtaaataagagctgggaa

SEQ ID NO: 1244202 - DNA, 22 bp, Artificial Sequence
  chemically synthesized
tatcttacacaatcttcccagc

SEQ ID NO: 1244203 - DNA, 22 bp, Artificial Sequence
  chemically synthesized
gtaaataagagctgggaagatt

SEQ ID NO: 1244204 - DNA, 22 bp, Artificial Sequence
  chemically synthesized
gaatgagtcaaactgtatctta

SEQ ID NO: 1244205 - DNA, 22 bp, Artificial Sequence
  chemically synthesized
ggaagattgtgtaagatacagt

SEQ ID NO: 1244206 - DNA, 22 bp, Artificial Sequence
  chemically synthesized
ggaatgagtcaaactgtatctt

SEQ ID NO: 1244207 - DNA, 22 bp, Artificial Sequence
  chemically synthesized
tggaatgagtcaaactgtatct

SEQ ID NO: 1244208 - DNA, 22 bp, Artificial Sequence
  chemically synthesized
ctttggaatgagtcaaactgta

SEQ ID NO: 1244209 - DNA, 22 bp, Artificial Sequence
  chemically synthesized
cctttggaatgagtcaaactgt

SEQ ID NO: 1244210 - DNA, 22 bp, Artificial Sequence
  chemically synthesized
tgtaagatacagtttgactcat

SEQ ID NO: 1244211 - DNA, 22 bp, Artificial Sequence
  chemically synthesized
aaaaacatttcctttggaatga

SEQ ID NO: 1244212 - DNA, 22 bp, Artificial Sequence
  chemically synthesized
gaagttgaaaaacatttccttt

SEQ ID NO: 1244213 - DNA, 22 bp, Artificial Sequence
  chemically synthesized
gactcattccaaaggaaatgtt

SEQ ID NO: 1244214 - DNA, 22 bp, Artificial Sequence
  chemically synthesized
actcattccaaaggaaatgttt

SEQ ID NO: 1244215 - DNA, 22 bp, Artificial Sequence
  chemically synthesized
attccaaaggaaatgtttttca

SEQ ID NO: 1244216 - DNA, 22 bp, Artificial Sequence
  chemically synthesized
aacagctggaagttgaaaaaca

SEQ ID NO: 1244217 - DNA, 22 bp, Artificial Sequence
  chemically synthesized
caaaggaaatgtttttcaactt

SEQ ID NO: 1244218 - DNA, 22 bp, Artificial Sequence
  chemically synthesized
cagttgaacagctggaagttga

SEQ ID NO: 1244219 - DNA, 22 bp, Artificial Sequence
  chemically synthesized
ttccagttgaacagctggaagt

SEQ ID NO: 1244220 - DNA, 22 bp, Artificial Sequence
  chemically synthesized
gttccagttgaacagctggaag

SEQ ID NO: 1244221 - DNA, 22 bp, Artificial Sequence
  chemically synthesized
ttgttccagttgaacagctgga

SEQ ID NO: 1244222 - DNA, 22 bp, Artificial Sequence
  chemically synthesized
ttcttgttccagttgaacagct

SEQ ID NO: 1244223 - DNA, 22 bp, Artificial Sequence
  chemically synthesized
ttcaacttccagctgttcaact

SEQ ID NO: 1244224 - DNA, 22 bp, Artificial Sequence
  chemically synthesized
tcaacttccagctgttcaactg

SEQ ID NO: 1244225 - DNA, 22 bp, Artificial Sequence
  chemically synthesized
caacttccagctgttcaactgg

SEQ ID NO: 1244226 - DNA, 22 bp, Artificial Sequence
  chemically synthesized
aacttccagctgttcaactgga

SEQ ID NO: 1244227 - DNA, 22 bp, Artificial Sequence
  chemically synthesized
caatactgttcttgttccagtt

SEQ ID NO: 1244228 - DNA, 22 bp, Artificial Sequence
  chemically synthesized
ccagctgttcaactggaacaag

SEQ ID NO: 1244229 - DNA, 22 bp, Artificial Sequence
  chemically synthesized
cagctgttcaactggaacaaga

SEQ ID NO: 1244230 - DNA, 22 bp, Artificial Sequence
  chemically synthesized
ttcaactggaacaagaacagta

SEQ ID NO: 1244231 - DNA, 22 bp, Artificial Sequence
  chemically synthesized
aactggaacaagaacagtattg

SEQ ID NO: 1244232 - DNA, 22 bp, Artificial Sequence
  chemically synthesized
ccataatccattacaatactgt

SEQ ID NO: 1244233 - DNA, 22 bp, Artificial Sequence
  chemically synthesized
accataatccattacaatactg

SEQ ID NO: 1244234 - DNA, 22 bp, Artificial Sequence
  chemically synthesized
gaacaagaacagtattgtaatg

SEQ ID NO: 1244235 - DNA, 22 bp, Artificial Sequence
  chemically synthesized
tgtcttaccataatccattaca

SEQ ID NO: 1244236 - DNA, 22 bp, Artificial Sequence
  chemically synthesized
ataacaacgactgtgtcttacc

SEQ ID NO: 1244237 - DNA, 22 bp, Artificial Sequence
  chemically synthesized
taatggattatggtaagacaca

SEQ ID NO: 1244238 - DNA, 22 bp, Artificial Sequence
  chemically synthesized
tcagaagctcataacaacgact

SEQ ID NO: 1244239 - DNA, 22 bp, Artificial Sequence
  chemically synthesized
tggtaagacacagtcgttgtta

SEQ ID NO: 1244240 - DNA, 22 bp, Artificial Sequence
  chemically synthesized
gtcagaagctcataacaacgac

SEQ ID NO: 1244241 - DNA, 22 bp, Artificial Sequence
  chemically synthesized
tgtcagaagctcataacaacga

SEQ ID NO: 1244242 - DNA, 22 bp, Artificial Sequence
  chemically synthesized
ttatgagcttctgacaaagtac

SEQ ID NO: 1244243 - DNA, 22 bp, Artificial Sequence
  chemically synthesized
tgagcttctgacaaagtactgt

SEQ ID NO: 1244244 - DNA, 22 bp, Artificial Sequence
  chemically synthesized
ctgacaaagtactgtatcattc

SEQ ID NO: 1244245 - DNA, 22 bp, Artificial Sequence
  chemically synthesized
agagtgggagtggaatgataca

SEQ ID NO: 1244246 - DNA, 22 bp, Artificial Sequence
  chemically synthesized
tgacaaagtactgtatcattcc

SEQ ID NO: 1244247 - DNA, 22 bp, Artificial Sequence
  chemically synthesized
acaaagtactgtatcattccac

SEQ ID NO: 1244248 - DNA, 22 bp, Artificial Sequence
  chemically synthesized
gtctcagagtgggagtggaatg

SEQ ID NO: 1244249 - DNA, 22 bp, Artificial Sequence
  chemically synthesized
agtctcagagtgggagtggaat

SEQ ID NO: 1244250 - DNA, 22 bp, Artificial Sequence
  chemically synthesized
aaacttagtctcagagtgggag

SEQ ID NO: 1244251 - DNA, 22 bp, Artificial Sequence
  chemically synthesized
tatcattccactcccactctga

SEQ ID NO: 1244252 - DNA, 22 bp, Artificial Sequence
  chemically synthesized
tgaaacttagtctcagagtggg

SEQ ID NO: 1244253 - DNA, 22 bp, Artificial Sequence
  chemically synthesized
ctgaaacttagtctcagagtgg

SEQ ID NO: 1244254 - DNA, 22 bp, Artificial Sequence
  chemically synthesized
cactcccactctgagactaagt

SEQ ID NO: 1244255 - DNA, 22 bp, Artificial Sequence
  chemically synthesized
tatagggtttctgaaacttagt

SEQ ID NO: 1244256 - DNA, 22 bp, Artificial Sequence
  chemically synthesized
ccactctgagactaagtttcag

SEQ ID NO: 1244257 - DNA, 22 bp, Artificial Sequence
  chemically synthesized
aacctatatagggtttctgaaa

SEQ ID NO: 1244258 - DNA, 22 bp, Artificial Sequence
  chemically synthesized
tgagactaagtttcagaaaccc

SEQ ID NO: 1244259 - DNA, 22 bp, Artificial Sequence
  chemically synthesized
taaacctatatagggtttctga

SEQ ID NO: 1244260 - DNA, 22 bp, Artificial Sequence
  chemically synthesized
ctaaacctatatagggtttctg

SEQ ID NO: 1244261 - DNA, 22 bp, Artificial Sequence
  chemically synthesized
agactaagtttcagaaacccta

SEQ ID NO: 1244262 - DNA, 22 bp, Artificial Sequence
  chemically synthesized
ttctaaacctatatagggtttc

SEQ ID NO: 1244263 - DNA, 22 bp, Artificial Sequence
  chemically synthesized
agtttcagaaaccctatatagg

SEQ ID NO: 1244264 - DNA, 22 bp, Artificial Sequence
  chemically synthesized
gaattcttctaaacctatatag

SEQ ID NO: 1244265 - DNA, 22 bp, Artificial Sequence
  chemically synthesized
tggaattcttctaaacctatat

SEQ ID NO: 1244266 - DNA, 22 bp, Artificial Sequence
  chemically synthesized
cagaaaccctatataggtttag

SEQ ID NO: 1244267 - DNA, 22 bp, Artificial Sequence
  chemically synthesized
agaaaccctatataggtttaga

SEQ ID NO: 1244268 - DNA, 22 bp, Artificial Sequence
  chemically synthesized
actctggaattcttctaaacct

SEQ ID NO: 1244269 - DNA, 22 bp, Artificial Sequence
  chemically synthesized
aactctggaattcttctaaacc

SEQ ID NO: 1244270 - DNA, 22 bp, Artificial Sequence
  chemically synthesized
tataggtttagaagaattccag

SEQ ID NO: 1244271 - DNA, 22 bp, Artificial Sequence
  chemically synthesized
agaagaattccagagttaagat

SEQ ID NO: 1244272 - DNA, 22 bp, Artificial Sequence
  chemically synthesized
gaagaattccagagttaagatg

SEQ ID NO: 1244273 - DNA, 22 bp, Artificial Sequence
  chemically synthesized
gcaagcaaggtacatcttaact

SEQ ID NO: 1244274 - DNA, 22 bp, Artificial Sequence
  chemically synthesized
tagcaagcaaggtacatcttaa

SEQ ID NO: 1244275 - DNA, 22 bp, Artificial Sequence
  chemically synthesized
cagagttaagatgtaccttgct

SEQ ID NO: 1244276 - DNA, 22 bp, Artificial Sequence
  chemically synthesized
ccaaaccatattctagcaagca

SEQ ID NO: 1244277 - DNA, 22 bp, Artificial Sequence
  chemically synthesized
agatgtaccttgcttgctagaa

SEQ ID NO: 1244278 - DNA, 22 bp, Artificial Sequence
  chemically synthesized
acctcccaaaccatattctagc

SEQ ID NO: 1244279 - DNA, 22 bp, Artificial Sequence
  chemically synthesized
gacctcccaaaccatattctag

SEQ ID NO: 1244280 - DNA, 22 bp, Artificial Sequence
  chemically synthesized
gcttgctagaatatggtttggg

SEQ ID NO: 1244281 - DNA, 22 bp, Artificial Sequence
  chemically synthesized
cttgctagaatatggtttggga

SEQ ID NO: 1244282 - DNA, 22 bp, Artificial Sequence
  chemically synthesized
agtggatttgacctcccaaacc

SEQ ID NO: 1244283 - DNA, 22 bp, Artificial Sequence
  chemically synthesized
gctagaatatggtttgggaggt

SEQ ID NO: 1244284 - DNA, 22 bp, Artificial Sequence
  chemically synthesized
ctagaatatggtttgggaggtc

SEQ ID NO: 1244285 - DNA, 22 bp, Artificial Sequence
  chemically synthesized
gaatatggtttgggaggtcaaa

SEQ ID NO: 1244286 - DNA, 22 bp, Artificial Sequence
  chemically synthesized
gggaggtcaaatccactcagtc

SEQ ID NO: 1244287 - DNA, 22 bp, Artificial Sequence
  chemically synthesized
ggaggtcaaatccactcagtca

SEQ ID NO: 1244288 - DNA, 22 bp, Artificial Sequence
  chemically synthesized
tgatggggagggagggggtgac

SEQ ID NO: 1244289 - DNA, 22 bp, Artificial Sequence
  chemically synthesized
gtgttatgatggggagggaggg

SEQ ID NO: 1244290 - DNA, 22 bp, Artificial Sequence
  chemically synthesized
agtcaccccctccctccccatc

SEQ ID NO: 1244291 - DNA, 22 bp, Artificial Sequence
  chemically synthesized
tgctagtgttatgatggggagg

SEQ ID NO: 1244292 - DNA, 22 bp, Artificial Sequence
  chemically synthesized
ctgtgctagtgttatgatgggg

SEQ ID NO: 1244293 - DNA, 22 bp, Artificial Sequence
  chemically synthesized
acctactgtgctagtgttatga

SEQ ID NO: 1244294 - DNA, 22 bp, Artificial Sequence
  chemically synthesized
aacctactgtgctagtgttatg

SEQ ID NO: 1244295 - DNA, 22 bp, Artificial Sequence
  chemically synthesized
cctccccatcataacactagca

SEQ ID NO: 1244296 - DNA, 22 bp, Artificial Sequence
  chemically synthesized
cccatcataacactagcacagt

SEQ ID NO: 1244297 - DNA, 22 bp, Artificial Sequence
  chemically synthesized
atgccttaacctactgtgctag

SEQ ID NO: 1244298 - DNA, 22 bp, Artificial Sequence
  chemically synthesized
attcatgccttaacctactgtg

SEQ ID NO: 1244299 - DNA, 22 bp, Artificial Sequence
  chemically synthesized
actcattcatgccttaacctac

SEQ ID NO: 1244300 - DNA, 22 bp, Artificial Sequence
  chemically synthesized
gcacagtaggttaaggcatgaa

SEQ ID NO: 1244301 - DNA, 22 bp, Artificial Sequence
  chemically synthesized
acacctgactcattcatgcctt

SEQ ID NO: 1244302 - DNA, 22 bp, Artificial Sequence
  chemically synthesized
gacacctgactcattcatgcct

SEQ ID NO: 1244303 - DNA, 22 bp, Artificial Sequence
  chemically synthesized
tgacacctgactcattcatgcc

SEQ ID NO: 1244304 - DNA, 22 bp, Artificial Sequence
  chemically synthesized
ctttgacacctgactcattcat

SEQ ID NO: 1244305 - DNA, 22 bp, Artificial Sequence
  chemically synthesized
gcctgctttgacacctgactca

SEQ ID NO: 1244306 - DNA, 22 bp, Artificial Sequence
  chemically synthesized
aggcatgaatgagtcaggtgtc

SEQ ID NO: 1244307 - DNA, 22 bp, Artificial Sequence
  chemically synthesized
agtctcgcctgctttgacacct

SEQ ID NO: 1244308 - DNA, 22 bp, Artificial Sequence
  chemically synthesized
cagtctcgcctgctttgacacc

SEQ ID NO: 1244309 - DNA, 22 bp, Artificial Sequence
  chemically synthesized
tcagtctcgcctgctttgacac

SEQ ID NO: 1244310 - DNA, 22 bp, Artificial Sequence
  chemically synthesized
gagtgcccagaagcatactttc

SEQ ID NO: 1244311 - DNA, 22 bp, Artificial Sequence
  chemically synthesized
atcatgcctggagtgcccagaa

SEQ ID NO: 1244312 - DNA, 22 bp, Artificial Sequence
  chemically synthesized
aatcatgcctggagtgcccaga

SEQ ID NO: 1244313 - DNA, 22 bp, Artificial Sequence
  chemically synthesized
aaagtatgcttctgggcactcc

SEQ ID NO: 1244314 - DNA, 22 bp, Artificial Sequence
  chemically synthesized
ataccaatttaatcatgcctgg

SEQ ID NO: 1244315 - DNA, 22 bp, Artificial Sequence
  chemically synthesized
cataccaatttaatcatgcctg

SEQ ID NO: 1244316 - DNA, 22 bp, Artificial Sequence
  chemically synthesized
tcataccaatttaatcatgcct

SEQ ID NO: 1244317 - DNA, 22 bp, Artificial Sequence
  chemically synthesized
ctgggcactccaggcatgatta

SEQ ID NO: 1244318 - DNA, 22 bp, Artificial Sequence
  chemically synthesized
ttcataccaatttaatcatgcc

SEQ ID NO: 1244319 - DNA, 22 bp, Artificial Sequence
  chemically synthesized
tgggcactccaggcatgattaa

SEQ ID NO: 1244320 - DNA, 22 bp, Artificial Sequence
  chemically synthesized
ggcactccaggcatgattaaat

SEQ ID NO: 1244321 - DNA, 22 bp, Artificial Sequence
  chemically synthesized
gtgtccttttcataccaattta

SEQ ID NO: 1244322 - DNA, 22 bp, Artificial Sequence
  chemically synthesized
caggcatgattaaattggtatg

SEQ ID NO: 1244323 - DNA, 22 bp, Artificial Sequence
  chemically synthesized
tcgtgtccttttcataccaatt

SEQ ID NO: 1244324 - DNA, 22 bp, Artificial Sequence
  chemically synthesized
tctcgtgtccttttcataccaa

SEQ ID NO: 1244325 - DNA, 22 bp, Artificial Sequence
  chemically synthesized
aattggtatgaaaaggacacga

SEQ ID NO: 1244326 - DNA, 22 bp, Artificial Sequence
  chemically synthesized
gatatcatgtcctctctcgtgt

SEQ ID NO: 1244327 - DNA, 22 bp, Artificial Sequence
  chemically synthesized
gtatgaaaaggacacgagagag

SEQ ID NO: 1244328 - DNA, 22 bp, Artificial Sequence
  chemically synthesized
ggatatcatgtcctctctcgtg

SEQ ID NO: 1244329 - DNA, 22 bp, Artificial Sequence
  chemically synthesized
ggatccagtcaagcccttggat

SEQ ID NO: 1244330 - DNA, 22 bp, Artificial Sequence
  chemically synthesized
gactggatcccagtcatcgttg

SEQ ID NO: 1244331 - DNA, 22 bp, Artificial Sequence
  chemically synthesized
actggatcccagtcatcgttgg

SEQ ID NO: 1244332 - DNA, 22 bp, Artificial Sequence
  chemically synthesized
tccccatgtcaccaccaacgat

SEQ ID NO: 1244333 - DNA, 22 bp, Artificial Sequence
  chemically synthesized
gatcccagtcatcgttggtggt

SEQ ID NO: 1244334 - DNA, 22 bp, Artificial Sequence
  chemically synthesized
tatccccatgtcaccaccaacg

SEQ ID NO: 1244335 - DNA, 22 bp, Artificial Sequence
  chemically synthesized
gtctctatccccatgtcaccac

SEQ ID NO: 1244336 - DNA, 22 bp, Artificial Sequence
  chemically synthesized
ttggtctctatccccatgtcac

SEQ ID NO: 1244337 - DNA, 22 bp, Artificial Sequence
  chemically synthesized
agtctgttggtctctatcccca

SEQ ID NO: 1244338 - DNA, 22 bp, Artificial Sequence
  chemically synthesized
gtggtgacatggggatagagac

SEQ ID NO: 1244339 - DNA, 22 bp, Artificial Sequence
  chemically synthesized
atacaagtaatcattcagtctg

SEQ ID NO: 1244340 - DNA, 22 bp, Artificial Sequence
  chemically synthesized
ctgatacaagtaatcattcagt

SEQ ID NO: 1244341 - DNA, 22 bp, Artificial Sequence
  chemically synthesized
tgctgatacaagtaatcattca

SEQ ID NO: 1244342 - DNA, 22 bp, Artificial Sequence
  chemically synthesized
ctgctgatacaagtaatcattc

SEQ ID NO: 1244343 - DNA, 22 bp, Artificial Sequence
  chemically synthesized
aagtcttctgctgatacaagta

SEQ ID NO: 1244344 - DNA, 22 bp, Artificial Sequence
  chemically synthesized
gaagtcttctgctgatacaagt

SEQ ID NO: 1244345 - DNA, 22 bp, Artificial Sequence
  chemically synthesized
ttgaagtcttctgctgatacaa

SEQ ID NO: 1244346 - DNA, 22 bp, Artificial Sequence
  chemically synthesized
tcttgaagtcttctgctgatac

SEQ ID NO: 1244347 - DNA, 22 bp, Artificial Sequence
  chemically synthesized
aatgattacttgtatcagcaga

SEQ ID NO: 1244348 - DNA, 22 bp, Artificial Sequence
  chemically synthesized
cttgtatcagcagaagacttca

SEQ ID NO: 1244349 - DNA, 22 bp, Artificial Sequence
  chemically synthesized
tagtcatcctctcttgaagtct

SEQ ID NO: 1244350 - DNA, 22 bp, Artificial Sequence
  chemically synthesized
gtatcagcagaagacttcaaga

SEQ ID NO: 1244351 - DNA, 22 bp, Artificial Sequence
  chemically synthesized
tatcagcagaagacttcaagag

SEQ ID NO: 1244352 - DNA, 22 bp, Artificial Sequence
  chemically synthesized
caagagaggatgactataggct

SEQ ID NO: 1244353 - DNA, 22 bp, Artificial Sequence
  chemically synthesized
aagagaggatgactataggctt

SEQ ID NO: 1244354 - DNA, 22 bp, Artificial Sequence
  chemically synthesized
agtcacatccagaaatcgggga

SEQ ID NO: 1244355 - DNA, 22 bp, Artificial Sequence
  chemically synthesized
taggcttgtcatccccgatttc

SEQ ID NO: 1244356 - DNA, 22 bp, Artificial Sequence
  chemically synthesized
aagtcacatccagaaatcgggg

SEQ ID NO: 1244357 - DNA, 22 bp, Artificial Sequence
  chemically synthesized
gtcatccccgatttctggatgt

SEQ ID NO: 1244358 - DNA, 22 bp, Artificial Sequence
  chemically synthesized
tcatccccgatttctggatgtg

SEQ ID NO: 1244359 - DNA, 22 bp, Artificial Sequence
  chemically synthesized
aagggacttaagtcacatccag

SEQ ID NO: 1244360 - DNA, 22 bp, Artificial Sequence
  chemically synthesized
aaagggacttaagtcacatcca

SEQ ID NO: 1244361 - DNA, 22 bp, Artificial Sequence
  chemically synthesized
aatttaaagggacttaagtcac

SEQ ID NO: 1244362 - DNA, 22 bp, Artificial Sequence
  chemically synthesized
aaatttaaagggacttaagtca

SEQ ID NO: 1244363 - DNA, 22 bp, Artificial Sequence
  chemically synthesized
taaatttaaagggacttaagtc

SEQ ID NO: 1244364 - DNA, 22 bp, Artificial Sequence
  chemically synthesized
ctggatgtgacttaagtccctt

SEQ ID NO: 1244365 - DNA, 22 bp, Artificial Sequence
  chemically synthesized
tggatgtgacttaagtcccttt

SEQ ID NO: 1244366 - DNA, 22 bp, Artificial Sequence
  chemically synthesized
gatgtgacttaagtccctttaa

SEQ ID NO: 1244367 - DNA, 22 bp, Artificial Sequence
  chemically synthesized
gcaacctttaaatttaaaggga

SEQ ID NO: 1244368 - DNA, 22 bp, Artificial Sequence
  chemically synthesized
aagtccctttaaatttaaaggt

SEQ ID NO: 1244369 - DNA, 22 bp, Artificial Sequence
  chemically synthesized
agtccctttaaatttaaaggtt

SEQ ID NO: 1244370 - DNA, 22 bp, Artificial Sequence
  chemically synthesized
gtcatgatggcattagcaacct

SEQ ID NO: 1244371 - DNA, 22 bp, Artificial Sequence
  chemically synthesized
taaatttaaaggttgctaatgc

SEQ ID NO: 1244372 - DNA, 22 bp, Artificial Sequence
  chemically synthesized
aaatttaaaggttgctaatgcc

SEQ ID NO: 1244373 - DNA, 22 bp, Artificial Sequence
  chemically synthesized
aatttaaaggttgctaatgcca

SEQ ID NO: 1244374 - DNA, 22 bp, Artificial Sequence
  chemically synthesized
aaaggttgctaatgccatcatg

SEQ ID NO: 1244375 - DNA, 22 bp, Artificial Sequence
  chemically synthesized
aaggttgctaatgccatcatga

SEQ ID NO: 1244376 - DNA, 22 bp, Artificial Sequence
  chemically synthesized
aatggtagttggtcatgatggc

SEQ ID NO: 1244377 - DNA, 22 bp, Artificial Sequence
  chemically synthesized
ctaatgccatcatgaccaacta

SEQ ID NO: 1244378 - DNA, 22 bp, Artificial Sequence
  chemically synthesized
aaatgttcaatggtagttggtc

SEQ ID NO: 1244379 - DNA, 22 bp, Artificial Sequence
  chemically synthesized
atgccatcatgaccaactacca

SEQ ID NO: 1244380 - DNA, 22 bp, Artificial Sequence
  chemically synthesized
tgaggtcagagcatcagttaaa

SEQ ID NO: 1244381 - DNA, 22 bp, Artificial Sequence
  chemically synthesized
ccattgaacattttaactgatg

SEQ ID NO: 1244382 - DNA, 22 bp, Artificial Sequence
  chemically synthesized
aacattttaactgatgctctga

SEQ ID NO: 1244383 - DNA, 22 bp, Artificial Sequence
  chemically synthesized
taactgatgctctgacctcaca

SEQ ID NO: 1244384 - DNA, 22 bp, Artificial Sequence
  chemically synthesized
aactgatgctctgacctcacag

SEQ ID NO: 1244385 - DNA, 22 bp, Artificial Sequence
  chemically synthesized
actgatgctctgacctcacagc

SEQ ID NO: 1244386 - DNA, 22 bp, Artificial Sequence
  chemically synthesized
gcaggtcaaaaagctgtgaggt

SEQ ID NO: 1244387 - DNA, 22 bp, Artificial Sequence
  chemically synthesized
agcaggtcaaaaagctgtgagg

SEQ ID NO: 1244388 - DNA, 22 bp, Artificial Sequence
  chemically synthesized
atgctctgacctcacagctttt

SEQ ID NO: 1244389 - DNA, 22 bp, Artificial Sequence
  chemically synthesized
cagcttagcaggtcaaaaagct

SEQ ID NO: 1244390 - DNA, 22 bp, Artificial Sequence
  chemically synthesized
tgacctcacagctttttgacct

SEQ ID NO: 1244391 - DNA, 22 bp, Artificial Sequence
  chemically synthesized
acctcacagctttttgacctgc

SEQ ID NO: 1244392 - DNA, 22 bp, Artificial Sequence
  chemically synthesized
acagctttttgacctgctaagc

SEQ ID NO: 1244393 - DNA, 22 bp, Artificial Sequence
  chemically synthesized
atcaaagtcattgcagcttagc

SEQ ID NO: 1244394 - DNA, 22 bp, Artificial Sequence
  chemically synthesized
tttgacctgctaagctgcaatg

SEQ ID NO: 1244395 - DNA, 22 bp, Artificial Sequence
  chemically synthesized
ttgacctgctaagctgcaatga

SEQ ID NO: 1244396 - DNA, 22 bp, Artificial Sequence
  chemically synthesized
tgacctgctaagctgcaatgac

SEQ ID NO: 1244397 - DNA, 22 bp, Artificial Sequence
  chemically synthesized
gacctgctaagctgcaatgact

SEQ ID NO: 1244398 - DNA, 22 bp, Artificial Sequence
  chemically synthesized
acctgctaagctgcaatgactt

SEQ ID NO: 1244399 - DNA, 22 bp, Artificial Sequence
  chemically synthesized
ctaagctgcaatgactttgatc

SEQ ID NO: 1244400 - DNA, 22 bp, Artificial Sequence
  chemically synthesized
agctgcaatgactttgatcaat

SEQ ID NO: 1244401 - DNA, 22 bp, Artificial Sequence
  chemically synthesized
caatgactttgatcaatttgcg

SEQ ID NO: 1244402 - DNA, 22 bp, Artificial Sequence
  chemically synthesized
gccatgaacatggacgcaaatt

SEQ ID NO: 1244403 - DNA, 22 bp, Artificial Sequence
  chemically synthesized
tgatcaatttgcgtccatgttc

SEQ ID NO: 1244404 - DNA, 22 bp, Artificial Sequence
  chemically synthesized
gatcaatttgcgtccatgttca

SEQ ID NO: 1244405 - DNA, 22 bp, Artificial Sequence
  chemically synthesized
atcaatttgcgtccatgttcat

SEQ ID NO: 1244406 - DNA, 22 bp, Artificial Sequence
  chemically synthesized
gcgtccatgttcatggccagtt

SEQ ID NO: 1244407 - DNA, 22 bp, Artificial Sequence
  chemically synthesized
cgtccatgttcatggccagttc

SEQ ID NO: 1244408 - DNA, 22 bp, Artificial Sequence
  chemically synthesized
gaggtaggtgagaaagcatgaa

SEQ ID NO: 1244409 - DNA, 22 bp, Artificial Sequence
  chemically synthesized
atggccagttcatgctttctca

SEQ ID NO: 1244410 - DNA, 22 bp, Artificial Sequence
  chemically synthesized
atgctttctcacctacctcgaa

SEQ ID NO: 1244411 - DNA, 22 bp, Artificial Sequence
  chemically synthesized
tctcacctacctcgaaccatcc

SEQ ID NO: 1244412 - DNA, 22 bp, Artificial Sequence
  chemically synthesized
ctcacctacctcgaaccatcct

SEQ ID NO: 1244413 - DNA, 22 bp, Artificial Sequence
  chemically synthesized
tcacctacctcgaaccatccta

SEQ ID NO: 1244414 - DNA, 22 bp, Artificial Sequence
  chemically synthesized
acctacctcgaaccatcctacc

SEQ ID NO: 1244415 - DNA, 22 bp, Artificial Sequence
  chemically synthesized
tgtgtgatccatggggtaggat

SEQ ID NO: 1244416 - DNA, 22 bp, Artificial Sequence
  chemically synthesized
cctcgaaccatcctaccccatg

SEQ ID NO: 1244417 - DNA, 22 bp, Artificial Sequence
  chemically synthesized
actgtgtgtgatccatggggta

SEQ ID NO: 1244418 - DNA, 22 bp, Artificial Sequence
  chemically synthesized
gaaccatcctaccccatggatc

SEQ ID NO: 1244419 - DNA, 22 bp, Artificial Sequence
  chemically synthesized
agtgagcaattcactgtgtgtg

SEQ ID NO: 1244420 - DNA, 22 bp, Artificial Sequence
  chemically synthesized
aagtgagcaattcactgtgtgt

SEQ ID NO: 1244421 - DNA, 22 bp, Artificial Sequence
  chemically synthesized
ccccatggatcacacacagtga

SEQ ID NO: 1244422 - DNA, 22 bp, Artificial Sequence
  chemically synthesized
tggtttaagtgagcaattcact

SEQ ID NO: 1244423 - DNA, 22 bp, Artificial Sequence
  chemically synthesized
aagaacagtatactgtggttta

SEQ ID NO: 1244424 - DNA, 22 bp, Artificial Sequence
  chemically synthesized
caagaacagtatactgtggttt

SEQ ID NO: 1244425 - DNA, 22 bp, Artificial Sequence
  chemically synthesized
ctcacttaaaccacagtatact

SEQ ID NO: 1244426 - DNA, 22 bp, Artificial Sequence
  chemically synthesized
acttaaaccacagtatactgtt

SEQ ID NO: 1244427 - DNA, 22 bp, Artificial Sequence
  chemically synthesized
aaaccacagtatactgttcttg

SEQ ID NO: 1244428 - DNA, 22 bp, Artificial Sequence
  chemically synthesized
aaccacagtatactgttcttga

SEQ ID NO: 1244429 - DNA, 22 bp, Artificial Sequence
  chemically synthesized
aaaaggggacagaagtttcaag

SEQ ID NO: 1244430 - DNA, 22 bp, Artificial Sequence
  chemically synthesized
aaaaaggggacagaagtttcaa

SEQ ID NO: 1244431 - DNA, 22 bp, Artificial Sequence
  chemically synthesized
taaaaaggggacagaagtttca

SEQ ID NO: 1244432 - DNA, 22 bp, Artificial Sequence
  chemically synthesized
aattttaaaaaggggacagaag

SEQ ID NO: 1244433 - DNA, 22 bp, Artificial Sequence
  chemically synthesized
gaattttaaaaaggggacagaa

SEQ ID NO: 1244434 - DNA, 22 bp, Artificial Sequence
  chemically synthesized
ttcttgaaacttctgtcccctt

SEQ ID NO: 1244435 - DNA, 22 bp, Artificial Sequence
  chemically synthesized
ttgaaacttctgtccccttttt

SEQ ID NO: 1244436 - DNA, 22 bp, Artificial Sequence
  chemically synthesized
gaaacttctgtcccctttttaa

SEQ ID NO: 1244437 - DNA, 22 bp, Artificial Sequence
  chemically synthesized
aaacttctgtcccctttttaaa

SEQ ID NO: 1244438 - DNA, 22 bp, Artificial Sequence
  chemically synthesized
tagataatacttgaattttaaa

SEQ ID NO: 1244439 - DNA, 22 bp, Artificial Sequence
  chemically synthesized
ctgtcccctttttaaaattcaa

SEQ ID NO: 1244440 - DNA, 22 bp, Artificial Sequence
  chemically synthesized
tgtcccctttttaaaattcaag

SEQ ID NO: 1244441 - DNA, 22 bp, Artificial Sequence
  chemically synthesized
tcccctttttaaaattcaagta

SEQ ID NO: 1244442 - DNA, 22 bp, Artificial Sequence
  chemically synthesized
tcacattgtagataatacttga

SEQ ID NO: 1244443 - DNA, 22 bp, Artificial Sequence
  chemically synthesized
tttaaaattcaagtattatcta

SEQ ID NO: 1244444 - DNA, 22 bp, Artificial Sequence
  chemically synthesized
ttaaaattcaagtattatctac

SEQ ID NO: 1244445 - DNA, 22 bp, Artificial Sequence
  chemically synthesized
taaaattcaagtattatctaca

SEQ ID NO: 1244446 - DNA, 22 bp, Artificial Sequence
  chemically synthesized
aaaattcaagtattatctacaa

SEQ ID NO: 1244447 - DNA, 22 bp, Artificial Sequence
  chemically synthesized
aaattcaagtattatctacaat

SEQ ID NO: 1244448 - DNA, 22 bp, Artificial Sequence
  chemically synthesized
atgtgatatctgtcacattgta

SEQ ID NO: 1244449 - DNA, 22 bp, Artificial Sequence
  chemically synthesized
aagtattatctacaatgtgaca

SEQ ID NO: 1244450 - DNA, 22 bp, Artificial Sequence
  chemically synthesized
acctcatgtgatatctgtcaca

SEQ ID NO: 1244451 - DNA, 22 bp, Artificial Sequence
  chemically synthesized
tctacaatgtgacagatatcac

SEQ ID NO: 1244452 - DNA, 22 bp, Artificial Sequence
  chemically synthesized
aatctaacctcatgtgatatct

SEQ ID NO: 1244453 - DNA, 22 bp, Artificial Sequence
  chemically synthesized
caatgtgacagatatcacatga

SEQ ID NO: 1244454 - DNA, 22 bp, Artificial Sequence
  chemically synthesized
ttcaatctaacctcatgtgata

SEQ ID NO: 1244455 - DNA, 22 bp, Artificial Sequence
  chemically synthesized
aatcattattcaatctaacctc

SEQ ID NO: 1244456 - DNA, 22 bp, Artificial Sequence
  chemically synthesized
cagaaatgcagaaactaaatca

SEQ ID NO: 1244457 - DNA, 22 bp, Artificial Sequence
  chemically synthesized
gattgaataatgatttagtttc

SEQ ID NO: 1244458 - DNA, 22 bp, Artificial Sequence
  chemically synthesized
aataatgatttagtttctgcat

SEQ ID NO: 1244459 - DNA, 22 bp, Artificial Sequence
  chemically synthesized
agacagtaagctccagaaatgc

SEQ ID NO: 1244460 - DNA, 22 bp, Artificial Sequence
  chemically synthesized
gagacagtaagctccagaaatg

SEQ ID NO: 1244461 - DNA, 22 bp, Artificial Sequence
  chemically synthesized
ttgagacagtaagctccagaaa

SEQ ID NO: 1244462 - DNA, 22 bp, Artificial Sequence
  chemically synthesized
cttgagacagtaagctccagaa

SEQ ID NO: 1244463 - DNA, 22 bp, Artificial Sequence
  chemically synthesized
agtttctgcatttctggagctt

SEQ ID NO: 1244464 - DNA, 22 bp, Artificial Sequence
  chemically synthesized
gtttctgcatttctggagctta

SEQ ID NO: 1244465 - DNA, 22 bp, Artificial Sequence
  chemically synthesized
atcttcttgagacagtaagctc

SEQ ID NO: 1244466 - DNA, 22 bp, Artificial Sequence
  chemically synthesized
ctgcatttctggagcttactgt

SEQ ID NO: 1244467 - DNA, 22 bp, Artificial Sequence
  chemically synthesized
tgcatttctggagcttactgtc

SEQ ID NO: 1244468 - DNA, 22 bp, Artificial Sequence
  chemically synthesized
ttcatcttcttgagacagtaag

SEQ ID NO: 1244469 - DNA, 22 bp, Artificial Sequence
  chemically synthesized
catttctggagcttactgtctc

SEQ ID NO: 1244470 - DNA, 22 bp, Artificial Sequence
  chemically synthesized
ttgttcatcttcttgagacagt

SEQ ID NO: 1244471 - DNA, 22 bp, Artificial Sequence
  chemically synthesized
gttgttcatcttcttgagacag

SEQ ID NO: 1244472 - DNA, 22 bp, Artificial Sequence
  chemically synthesized
ctggagcttactgtctcaagaa

SEQ ID NO: 1244473 - DNA, 22 bp, Artificial Sequence
  chemically synthesized
tggagcttactgtctcaagaag

SEQ ID NO: 1244474 - DNA, 22 bp, Artificial Sequence
  chemically synthesized
tttgttgttcatcttcttgaga

SEQ ID NO: 1244475 - DNA, 22 bp, Artificial Sequence
  chemically synthesized
atttgttgttcatcttcttgag

SEQ ID NO: 1244476 - DNA, 22 bp, Artificial Sequence
  chemically synthesized
gagcttactgtctcaagaagat

SEQ ID NO: 1244477 - DNA, 22 bp, Artificial Sequence
  chemically synthesized
ttatttgttgttcatcttcttg

SEQ ID NO: 1244478 - DNA, 22 bp, Artificial Sequence
  chemically synthesized
actgtctcaagaagatgaacaa

SEQ ID NO: 1244479 - DNA, 22 bp, Artificial Sequence
  chemically synthesized
ctgtctcaagaagatgaacaac

SEQ ID NO: 1244480 - DNA, 22 bp, Artificial Sequence
  chemically synthesized
tcatctcttatttgttgttcat

SEQ ID NO: 1244481 - DNA, 22 bp, Artificial Sequence
  chemically synthesized
tctcaagaagatgaacaacaaa

SEQ ID NO: 1244482 - DNA, 22 bp, Artificial Sequence
  chemically synthesized
aagaagatgaacaacaaataag

SEQ ID NO: 1244483 - DNA, 22 bp, Artificial Sequence
  chemically synthesized
gcatgtaaaatgttgtcatctc

SEQ ID NO: 1244484 - DNA, 22 bp, Artificial Sequence
  chemically synthesized
agcatgtaaaatgttgtcatct

SEQ ID NO: 1244485 - DNA, 22 bp, Artificial Sequence
  chemically synthesized
ccttagcatgtaaaatgttgtc

SEQ ID NO: 1244486 - DNA, 22 bp, Artificial Sequence
  chemically synthesized
taccttagcatgtaaaatgttg

SEQ ID NO: 1244487 - DNA, 22 bp, Artificial Sequence
  chemically synthesized
ctaccttagcatgtaaaatgtt

SEQ ID NO: 1244488 - DNA, 22 bp, Artificial Sequence
  chemically synthesized
tttctaccttagcatgtaaaat

SEQ ID NO: 1244489 - DNA, 22 bp, Artificial Sequence
  chemically synthesized
atttctaccttagcatgtaaaa

SEQ ID NO: 1244490 - DNA, 22 bp, Artificial Sequence
  chemically synthesized
tatttctaccttagcatgtaaa

SEQ ID NO: 1244491 - DNA, 22 bp, Artificial Sequence
  chemically synthesized
actttatttctaccttagcatg

SEQ ID NO: 1244492 - DNA, 22 bp, Artificial Sequence
  chemically synthesized
agttgactttatttctacctta

SEQ ID NO: 1244493 - DNA, 22 bp, Artificial Sequence
  chemically synthesized
cagttgactttatttctacctt

SEQ ID NO: 1244494 - DNA, 22 bp, Artificial Sequence
  chemically synthesized
tcagttgactttatttctacct

SEQ ID NO: 1244495 - DNA, 22 bp, Artificial Sequence
  chemically synthesized
ttcagttgactttatttctacc

SEQ ID NO: 1244496 - DNA, 22 bp, Artificial Sequence
  chemically synthesized
tttcagttgactttatttctac

SEQ ID NO: 1244497 - DNA, 22 bp, Artificial Sequence
  chemically synthesized
tacatgctaaggtagaaataaa

SEQ ID NO: 1244498 - DNA, 22 bp, Artificial Sequence
  chemically synthesized
acatgctaaggtagaaataaag

SEQ ID NO: 1244499 - DNA, 22 bp, Artificial Sequence
  chemically synthesized
tttttcagttgactttatttct

SEQ ID NO: 1244500 - DNA, 22 bp, Artificial Sequence
  chemically synthesized
catgctaaggtagaaataaagt

SEQ ID NO: 1244501 - DNA, 22 bp, Artificial Sequence
  chemically synthesized
aaattctttttcagttgacttt

SEQ ID NO: 1244502 - DNA, 22 bp, Artificial Sequence
  chemically synthesized
aaaattctttttcagttgactt

SEQ ID NO: 1244503 - DNA, 22 bp, Artificial Sequence
  chemically synthesized
aggtagaaataaagtcaactga

SEQ ID NO: 1244504 - DNA, 22 bp, Artificial Sequence
  chemically synthesized
gccttaaaattctttttcagtt

SEQ ID NO: 1244505 - DNA, 22 bp, Artificial Sequence
  chemically synthesized
agccttaaaattctttttcagt

SEQ ID NO: 1244506 - DNA, 22 bp, Artificial Sequence
  chemically synthesized
tagcttagccttaaaattcttt

SEQ ID NO: 1244507 - DNA, 22 bp, Artificial Sequence
  chemically synthesized
ctatagcttagccttaaaattc

SEQ ID NO: 1244508 - DNA, 22 bp, Artificial Sequence
  chemically synthesized
cctatagcttagccttaaaatt

SEQ ID NO: 1244509 - DNA, 22 bp, Artificial Sequence
  chemically synthesized
aaaaagaattttaaggctaagc

SEQ ID NO: 1244510 - DNA, 22 bp, Artificial Sequence
  chemically synthesized
agaaagggcttcctatagctta

SEQ ID NO: 1244511 - DNA, 22 bp, Artificial Sequence
  chemically synthesized
cagaaagggcttcctatagctt

SEQ ID NO: 1244512 - DNA, 22 bp, Artificial Sequence
  chemically synthesized
ttcagaaagggcttcctatagc

SEQ ID NO: 1244513 - DNA, 22 bp, Artificial Sequence
  chemically synthesized
taaggctaagctataggaagcc

SEQ ID NO: 1244514 - DNA, 22 bp, Artificial Sequence
  chemically synthesized
aaggctaagctataggaagccc

SEQ ID NO: 1244515 - DNA, 22 bp, Artificial Sequence
  chemically synthesized
aggctaagctataggaagccct

SEQ ID NO: 1244516 - DNA, 22 bp, Artificial Sequence
  chemically synthesized
tatctcttcagaaagggcttcc

SEQ ID NO: 1244517 - DNA, 22 bp, Artificial Sequence
  chemically synthesized
agctataggaagccctttctga

SEQ ID NO: 1244518 - DNA, 22 bp, Artificial Sequence
  chemically synthesized
aattgtatctcttcagaaaggg

SEQ ID NO: 1244519 - DNA, 22 bp, Artificial Sequence
  chemically synthesized
gaattgtatctcttcagaaagg

SEQ ID NO: 1244520 - DNA, 22 bp, Artificial Sequence
  chemically synthesized
taggaagccctttctgaagaga

SEQ ID NO: 1244521 - DNA, 22 bp, Artificial Sequence
  chemically synthesized
agatcataccttgaattgtatc

SEQ ID NO: 1244522 - DNA, 22 bp, Artificial Sequence
  chemically synthesized
aagatcataccttgaattgtat

SEQ ID NO: 1244523 - DNA, 22 bp, Artificial Sequence
  chemically synthesized
taagatcataccttgaattgta

SEQ ID NO: 1244524 - DNA, 22 bp, Artificial Sequence
  chemically synthesized
ttaagatcataccttgaattgt

SEQ ID NO: 1244525 - DNA, 22 bp, Artificial Sequence
  chemically synthesized
tctgaagagatacaattcaagg

SEQ ID NO: 1244526 - DNA, 22 bp, Artificial Sequence
  chemically synthesized
tttaagatcataccttgaattg

SEQ ID NO: 1244527 - DNA, 22 bp, Artificial Sequence
  chemically synthesized
ctgaagagatacaattcaaggt

SEQ ID NO: 1244528 - DNA, 22 bp, Artificial Sequence
  chemically synthesized
tgaagagatacaattcaaggta

SEQ ID NO: 1244529 - DNA, 22 bp, Artificial Sequence
  chemically synthesized
ctttttaagatcataccttgaa

SEQ ID NO: 1244530 - DNA, 22 bp, Artificial Sequence
  chemically synthesized
aagagatacaattcaaggtatg

SEQ ID NO: 1244531 - DNA, 22 bp, Artificial Sequence
  chemically synthesized
taaaatctcctttttaagatca

SEQ ID NO: 1244532 - DNA, 22 bp, Artificial Sequence
  chemically synthesized
ataaaatctcctttttaagatc

SEQ ID NO: 1244533 - DNA, 22 bp, Artificial Sequence
  chemically synthesized
tataaaatctcctttttaagat

SEQ ID NO: 1244534 - DNA, 22 bp, Artificial Sequence
  chemically synthesized
ttataaaatctcctttttaaga

SEQ ID NO: 1244535 - DNA, 22 bp, Artificial Sequence
  chemically synthesized
tttataaaatctcctttttaag

SEQ ID NO: 1244536 - DNA, 22 bp, Artificial Sequence
  chemically synthesized
aaggtatgatcttaaaaaggag

SEQ ID NO: 1244537 - DNA, 22 bp, Artificial Sequence
  chemically synthesized
cctttttataaaatctcctttt

SEQ ID NO: 1244538 - DNA, 22 bp, Artificial Sequence
  chemically synthesized
ccctttttataaaatctccttt

SEQ ID NO: 1244539 - DNA, 22 bp, Artificial Sequence
  chemically synthesized
ttccctttttataaaatctcct

SEQ ID NO: 1244540 - DNA, 22 bp, Artificial Sequence
  chemically synthesized
taattcttccctttttataaaa

SEQ ID NO: 1244541 - DNA, 22 bp, Artificial Sequence
  chemically synthesized
aaaaaggagattttataaaaag

SEQ ID NO: 1244542 - DNA, 22 bp, Artificial Sequence
  chemically synthesized
aaaaggagattttataaaaagg

SEQ ID NO: 1244543 - DNA, 22 bp, Artificial Sequence
  chemically synthesized
tctgtaattcttccctttttat

SEQ ID NO: 1244544 - DNA, 22 bp, Artificial Sequence
  chemically synthesized
ctatctgtaattcttccctttt

SEQ ID NO: 1244545 - DNA, 22 bp, Artificial Sequence
  chemically synthesized
tgcctgctatctgtaattcttc

SEQ ID NO: 1244546 - DNA, 22 bp, Artificial Sequence
  chemically synthesized
gtgcctgctatctgtaattctt

SEQ ID NO: 1244547 - DNA, 22 bp, Artificial Sequence
  chemically synthesized
tataaaaagggaagaattacag

SEQ ID NO: 1244548 - DNA, 22 bp, Artificial Sequence
  chemically synthesized
ataaaaagggaagaattacaga

SEQ ID NO: 1244549 - DNA, 22 bp, Artificial Sequence
  chemically synthesized
taaaaagggaagaattacagat

SEQ ID NO: 1244550 - DNA, 22 bp, Artificial Sequence
  chemically synthesized
tgcatcttgtgcctgctatctg

SEQ ID NO: 1244551 - DNA, 22 bp, Artificial Sequence
  chemically synthesized
gtgcatcttgtgcctgctatct

SEQ ID NO: 1244552 - DNA, 22 bp, Artificial Sequence
  chemically synthesized
tgtgcatcttgtgcctgctatc

SEQ ID NO: 1244553 - DNA, 22 bp, Artificial Sequence
  chemically synthesized
cctttgtgcatcttgtgcctgc

SEQ ID NO: 1244554 - DNA, 22 bp, Artificial Sequence
  chemically synthesized
ccctttgtgcatcttgtgcctg

SEQ ID NO: 1244555 - DNA, 22 bp, Artificial Sequence
  chemically synthesized
cttccctttgtgcatcttgtgc

SEQ ID NO: 1244556 - DNA, 22 bp, Artificial Sequence
  chemically synthesized
cagatagcaggcacaagatgca

SEQ ID NO: 1244557 - DNA, 22 bp, Artificial Sequence
  chemically synthesized
ccctacttccctttgtgcatct

SEQ ID NO: 1244558 - DNA, 22 bp, Artificial Sequence
  chemically synthesized
cccctacttccctttgtgcatc

SEQ ID NO: 1244559 - DNA, 22 bp, Artificial Sequence
  chemically synthesized
gcatccacttcccctacttccc

SEQ ID NO: 1244560 - DNA, 22 bp, Artificial Sequence
  chemically synthesized
agcatccacttcccctacttcc

SEQ ID NO: 1244561 - DNA, 22 bp, Artificial Sequence
  chemically synthesized
atttagcatccacttcccctac

SEQ ID NO: 1244562 - DNA, 22 bp, Artificial Sequence
  chemically synthesized
catttagcatccacttccccta

SEQ ID NO: 1244563 - DNA, 22 bp, Artificial Sequence
  chemically synthesized
acttcatttagcatccacttcc

SEQ ID NO: 1244564 - DNA, 22 bp, Artificial Sequence
  chemically synthesized
cccactaacttcatttagcatc

SEQ ID NO: 1244565 - DNA, 22 bp, Artificial Sequence
  chemically synthesized
gcccactaacttcatttagcat

SEQ ID NO: 1244566 - DNA, 22 bp, Artificial Sequence
  chemically synthesized
tgcccactaacttcatttagca

SEQ ID NO: 1244567 - DNA, 22 bp, Artificial Sequence
  chemically synthesized
tttgcccactaacttcatttag

SEQ ID NO: 1244568 - DNA, 22 bp, Artificial Sequence
  chemically synthesized
ctttgcccactaacttcattta

SEQ ID NO: 1244569 - DNA, 22 bp, Artificial Sequence
  chemically synthesized
tccttctttgcccactaacttc

SEQ ID NO: 1244570 - DNA, 22 bp, Artificial Sequence
  chemically synthesized
atccttctttgcccactaactt

SEQ ID NO: 1244571 - DNA, 22 bp, Artificial Sequence
  chemically synthesized
ccccttatccttctttgcccac

SEQ ID NO: 1244572 - DNA, 22 bp, Artificial Sequence
  chemically synthesized
accccttatccttctttgccca

SEQ ID NO: 1244573 - DNA, 22 bp, Artificial Sequence
  chemically synthesized
aatgaagttagtgggcaaagaa

SEQ ID NO: 1244574 - DNA, 22 bp, Artificial Sequence
  chemically synthesized
tggcttaccccttatccttctt

SEQ ID NO: 1244575 - DNA, 22 bp, Artificial Sequence
  chemically synthesized
ctgtggcttaccccttatcctt

SEQ ID NO: 1244576 - DNA, 22 bp, Artificial Sequence
  chemically synthesized
gtgggcaaagaaggataagggg

SEQ ID NO: 1244577 - DNA, 22 bp, Artificial Sequence
  chemically synthesized
tactgtggcttaccccttatcc

SEQ ID NO: 1244578 - DNA, 22 bp, Artificial Sequence
  chemically synthesized
acatctctactgtggcttaccc

SEQ ID NO: 1244579 - DNA, 22 bp, Artificial Sequence
  chemically synthesized
aacatctctactgtggcttacc

SEQ ID NO: 1244580 - DNA, 22 bp, Artificial Sequence
  chemically synthesized
gtttaacatctctactgtggct

SEQ ID NO: 1244581 - DNA, 22 bp, Artificial Sequence
  chemically synthesized
agtttaacatctctactgtggc

SEQ ID NO: 1244582 - DNA, 22 bp, Artificial Sequence
  chemically synthesized
catttagtttaacatctctact

SEQ ID NO: 1244583 - DNA, 22 bp, Artificial Sequence
  chemically synthesized
ttacatttagtttaacatctct

SEQ ID NO: 1244584 - DNA, 22 bp, Artificial Sequence
  chemically synthesized
tattacatttagtttaacatct

SEQ ID NO: 1244585 - DNA, 22 bp, Artificial Sequence
  chemically synthesized
taaaagcatctctattacattt

SEQ ID NO: 1244586 - DNA, 22 bp, Artificial Sequence
  chemically synthesized
aactaaatgtaatagagatgct

SEQ ID NO: 1244587 - DNA, 22 bp, Artificial Sequence
  chemically synthesized
cccaaagcctgtaaaagcatct

SEQ ID NO: 1244588 - DNA, 22 bp, Artificial Sequence
  chemically synthesized
aatgtaatagagatgcttttac

SEQ ID NO: 1244589 - DNA, 22 bp, Artificial Sequence
  chemically synthesized
ctacccaaagcctgtaaaagca

SEQ ID NO: 1244590 - DNA, 22 bp, Artificial Sequence
  chemically synthesized
tcctacccaaagcctgtaaaag

SEQ ID NO: 1244591 - DNA, 22 bp, Artificial Sequence
  chemically synthesized
gatcatatctctcctacccaaa

SEQ ID NO: 1244592 - DNA, 22 bp, Artificial Sequence
  chemically synthesized
ttacaggctttgggtaggagag

SEQ ID NO: 1244593 - DNA, 22 bp, Artificial Sequence
  chemically synthesized
tacaggctttgggtaggagaga

SEQ ID NO: 1244594 - DNA, 22 bp, Artificial Sequence
  chemically synthesized
acaggctttgggtaggagagat

SEQ ID NO: 1244595 - DNA, 22 bp, Artificial Sequence
  chemically synthesized
caggctttgggtaggagagata

SEQ ID NO: 1244596 - DNA, 22 bp, Artificial Sequence
  chemically synthesized
tgggtaggagagatatgatcta

SEQ ID NO: 1244597 - DNA, 22 bp, Artificial Sequence
  chemically synthesized
taaaacacaaactagatcatat

SEQ ID NO: 1244598 - DNA, 22 bp, Artificial Sequence
  chemically synthesized
gggtaggagagatatgatctag

SEQ ID NO: 1244599 - DNA, 22 bp, Artificial Sequence
  chemically synthesized
ataaaacacaaactagatcata

SEQ ID NO: 1244600 - DNA, 22 bp, Artificial Sequence
  chemically synthesized
ggtaggagagatatgatctagt

SEQ ID NO: 1244601 - DNA, 22 bp, Artificial Sequence
  chemically synthesized
tataaaacacaaactagatcat

SEQ ID NO: 1244602 - DNA, 22 bp, Artificial Sequence
  chemically synthesized
gtttgtgttttataaagatctc

SEQ ID NO: 1244603 - DNA, 22 bp, Artificial Sequence
  chemically synthesized
acaggagccatagagatcttta

SEQ ID NO: 1244604 - DNA, 22 bp, Artificial Sequence
  chemically synthesized
tgacaggagccatagagatctt

SEQ ID NO: 1244605 - DNA, 22 bp, Artificial Sequence
  chemically synthesized
ctgacaggagccatagagatct

SEQ ID NO: 1244606 - DNA, 22 bp, Artificial Sequence
  chemically synthesized
gtgttttataaagatctctatg

SEQ ID NO: 1244607 - DNA, 22 bp, Artificial Sequence
  chemically synthesized
tgttttataaagatctctatgg

SEQ ID NO: 1244608 - DNA, 22 bp, Artificial Sequence
  chemically synthesized
tataaagatctctatggctcct

SEQ ID NO: 1244609 - DNA, 22 bp, Artificial Sequence
  chemically synthesized
atgtcttctgacaggagccata

SEQ ID NO: 1244610 - DNA, 22 bp, Artificial Sequence
  chemically synthesized
ataaagatctctatggctcctg

SEQ ID NO: 1244611 - DNA, 22 bp, Artificial Sequence
  chemically synthesized
gatgtcttctgacaggagccat

SEQ ID NO: 1244612 - DNA, 22 bp, Artificial Sequence
  chemically synthesized
taaagatctctatggctcctgt

SEQ ID NO: 1244613 - DNA, 22 bp, Artificial Sequence
  chemically synthesized
cttgatgtcttctgacaggagc

SEQ ID NO: 1244614 - DNA, 22 bp, Artificial Sequence
  chemically synthesized
ccctccttgatgtcttctgaca

SEQ ID NO: 1244615 - DNA, 22 bp, Artificial Sequence
  chemically synthesized
gccctccttgatgtcttctgac

SEQ ID NO: 1244616 - DNA, 22 bp, Artificial Sequence
  chemically synthesized
tatggctcctgtcagaagacat

SEQ ID NO: 1244617 - DNA, 22 bp, Artificial Sequence
  chemically synthesized
ttgccctccttgatgtcttctg

SEQ ID NO: 1244618 - DNA, 22 bp, Artificial Sequence
  chemically synthesized
tggctcctgtcagaagacatca

SEQ ID NO: 1244619 - DNA, 22 bp, Artificial Sequence
  chemically synthesized
tcttgccctccttgatgtcttc

SEQ ID NO: 1244620 - DNA, 22 bp, Artificial Sequence
  chemically synthesized
ctcttgccctccttgatgtctt

SEQ ID NO: 1244621 - DNA, 22 bp, Artificial Sequence
  chemically synthesized
cttctcttgccctccttgatgt

SEQ ID NO: 1244622 - DNA, 22 bp, Artificial Sequence
  chemically synthesized
ctgtcagaagacatcaaggagg

SEQ ID NO: 1244623 - DNA, 22 bp, Artificial Sequence
  chemically synthesized
tcagaagacatcaaggagggca

SEQ ID NO: 1244624 - DNA, 22 bp, Artificial Sequence
  chemically synthesized
cattgcttctcttgccctcctt

SEQ ID NO: 1244625 - DNA, 22 bp, Artificial Sequence
  chemically synthesized
ccattgcttctcttgccctcct

SEQ ID NO: 1244626 - DNA, 22 bp, Artificial Sequence
  chemically synthesized
gagtcttccattgcttctcttg

SEQ ID NO: 1244627 - DNA, 22 bp, Artificial Sequence
  chemically synthesized
aaatgaatgcatgaggcactgg

SEQ ID NO: 1244628 - DNA, 22 bp, Artificial Sequence
  chemically synthesized
aaaatgaatgcatgaggcactg

SEQ ID NO: 1244629 - DNA, 22 bp, Artificial Sequence
  chemically synthesized
taaaatgaatgcatgaggcact

SEQ ID NO: 1244630 - DNA, 22 bp, Artificial Sequence
  chemically synthesized
agagttttaaaatgaatgcatg

SEQ ID NO: 1244631 - DNA, 22 bp, Artificial Sequence
  chemically synthesized
cagtgcctcatgcattcatttt

SEQ ID NO: 1244632 - DNA, 22 bp, Artificial Sequence
  chemically synthesized
gccaccactaagagttttaaaa

SEQ ID NO: 1244633 - DNA, 22 bp, Artificial Sequence
  chemically synthesized
atgcattcattttaaaactctt

SEQ ID NO: 1244634 - DNA, 22 bp, Artificial Sequence
  chemically synthesized
aataagattagccaccactaag

SEQ ID NO: 1244635 - DNA, 22 bp, Artificial Sequence
  chemically synthesized
attttaaaactcttagtggtgg

SEQ ID NO: 1244636 - DNA, 22 bp, Artificial Sequence
  chemically synthesized
aaataagattagccaccactaa

SEQ ID NO: 1244637 - DNA, 22 bp, Artificial Sequence
  chemically synthesized
taaaactcttagtggtggctaa

SEQ ID NO: 1244638 - DNA, 22 bp, Artificial Sequence
  chemically synthesized
gtttaaataagattagccacca

SEQ ID NO: 1244639 - DNA, 22 bp, Artificial Sequence
  chemically synthesized
aaaactcttagtggtggctaat

SEQ ID NO: 1244640 - DNA, 22 bp, Artificial Sequence
  chemically synthesized
aaactcttagtggtggctaatc

SEQ ID NO: 1244641 - DNA, 22 bp, Artificial Sequence
  chemically synthesized
agattagtttaaataagattag

SEQ ID NO: 1244642 - DNA, 22 bp, Artificial Sequence
  chemically synthesized
ttagtggtggctaatcttattt

SEQ ID NO: 1244643 - DNA, 22 bp, Artificial Sequence
  chemically synthesized
agtggtggctaatcttatttaa

SEQ ID NO: 1244644 - DNA, 22 bp, Artificial Sequence
  chemically synthesized
gtggtggctaatcttatttaaa

SEQ ID NO: 1244645 - DNA, 22 bp, Artificial Sequence
  chemically synthesized
atcttatttaaactaatcttag

SEQ ID NO: 1244646 - DNA, 22 bp, Artificial Sequence
  chemically synthesized
atttaaactaatcttagtggtg

SEQ ID NO: 1244647 - DNA, 22 bp, Artificial Sequence
  chemically synthesized
tttaaactaatcttagtggtgg

SEQ ID NO: 1244648 - DNA, 22 bp, Artificial Sequence
  chemically synthesized
aaactaatcttagtggtggcta

SEQ ID NO: 1244649 - DNA, 22 bp, Artificial Sequence
  chemically synthesized
atggtgaggtggtagccaccac

SEQ ID NO: 1244650 - DNA, 22 bp, Artificial Sequence
  chemically synthesized
aactaatcttagtggtggctac

SEQ ID NO: 1244651 - DNA, 22 bp, Artificial Sequence
  chemically synthesized
cctgatggtgaggtggtagcca

SEQ ID NO: 1244652 - DNA, 22 bp, Artificial Sequence
  chemically synthesized
acctgatggtgaggtggtagcc

SEQ ID NO: 1244653 - DNA, 22 bp, Artificial Sequence
  chemically synthesized
atcttagtggtggctaccacct

SEQ ID NO: 1244654 - DNA, 22 bp, Artificial Sequence
  chemically synthesized
agtggtggctaccacctcacca

SEQ ID NO: 1244655 - DNA, 22 bp, Artificial Sequence
  chemically synthesized
gtggtggctaccacctcaccat

SEQ ID NO: 1244656 - DNA, 22 bp, Artificial Sequence
  chemically synthesized
ccacctcaccatcaggtaaatc

SEQ ID NO: 1244657 - DNA, 22 bp, Artificial Sequence
  chemically synthesized
accatcaggtaaatctccttct

SEQ ID NO: 1244658 - DNA, 22 bp, Artificial Sequence
  chemically synthesized
tgatcaacagtgagtgagagaa

SEQ ID NO: 1244659 - DNA, 22 bp, Artificial Sequence
  chemically synthesized
cttctctcactcactgttgatc

SEQ ID NO: 1244660 - DNA, 22 bp, Artificial Sequence
  chemically synthesized
ataaagcaattatgatcaacag

SEQ ID NO: 1244661 - DNA, 22 bp, Artificial Sequence
  chemically synthesized
ctctcactcactgttgatcata

SEQ ID NO: 1244662 - DNA, 22 bp, Artificial Sequence
  chemically synthesized
tctcactcactgttgatcataa

SEQ ID NO: 1244663 - DNA, 22 bp, Artificial Sequence
  chemically synthesized
tcactcactgttgatcataatt

SEQ ID NO: 1244664 - DNA, 22 bp, Artificial Sequence
  chemically synthesized
actcactgttgatcataattgc

SEQ ID NO: 1244665 - DNA, 22 bp, Artificial Sequence
  chemically synthesized
acaattgataaagcaattatga

SEQ ID NO: 1244666 - DNA, 22 bp, Artificial Sequence
  chemically synthesized
actgttgatcataattgcttta

SEQ ID NO: 1244667 - DNA, 22 bp, Artificial Sequence
  chemically synthesized
ttgatcataattgctttatcaa

SEQ ID NO: 1244668 - DNA, 22 bp, Artificial Sequence
  chemically synthesized
atcataattgctttatcaattg

SEQ ID NO: 1244669 - DNA, 22 bp, Artificial Sequence
  chemically synthesized
ggtaaaatcaggactaacaatt

SEQ ID NO: 1244670 - DNA, 22 bp, Artificial Sequence
  chemically synthesized
ctttatcaattgttagtcctga

SEQ ID NO: 1244671 - DNA, 22 bp, Artificial Sequence
  chemically synthesized
tatcaattgttagtcctgattt

SEQ ID NO: 1244672 - DNA, 22 bp, Artificial Sequence
  chemically synthesized
atcaattgttagtcctgatttt

SEQ ID NO: 1244673 - DNA, 22 bp, Artificial Sequence
  chemically synthesized
tcaattgttagtcctgatttta

SEQ ID NO: 1244674 - DNA, 22 bp, Artificial Sequence
  chemically synthesized
aaagaatcggaggctgggtaaa

SEQ ID NO: 1244675 - DNA, 22 bp, Artificial Sequence
  chemically synthesized
ttagtcctgattttacccagcc

SEQ ID NO: 1244676 - DNA, 22 bp, Artificial Sequence
  chemically synthesized
gtcctgattttacccagcctcc

SEQ ID NO: 1244677 - DNA, 22 bp, Artificial Sequence
  chemically synthesized
attttacccagcctccgattct

SEQ ID NO: 1244678 - DNA, 22 bp, Artificial Sequence
  chemically synthesized
tacccagcctccgattctttta

SEQ ID NO: 1244679 - DNA, 22 bp, Artificial Sequence
  chemically synthesized
acccagcctccgattcttttag

SEQ ID NO: 1244680 - DNA, 22 bp, Artificial Sequence
  chemically synthesized
cccagcctccgattcttttagt

SEQ ID NO: 1244681 - DNA, 22 bp, Artificial Sequence
  chemically synthesized
catagcaatcaaaaagggaact

SEQ ID NO: 1244682 - DNA, 22 bp, Artificial Sequence
  chemically synthesized
cgattcttttagttcccttttt

SEQ ID NO: 1244683 - DNA, 22 bp, Artificial Sequence
  chemically synthesized
ttttagttccctttttgattgc

SEQ ID NO: 1244684 - DNA, 22 bp, Artificial Sequence
  chemically synthesized
aggaattgcatagcaatcaaaa

SEQ ID NO: 1244685 - DNA, 22 bp, Artificial Sequence
  chemically synthesized
caggaattgcatagcaatcaaa

SEQ ID NO: 1244686 - DNA, 22 bp, Artificial Sequence
  chemically synthesized
ttagttccctttttgattgcta

SEQ ID NO: 1244687 - DNA, 22 bp, Artificial Sequence
  chemically synthesized
tagttccctttttgattgctat

SEQ ID NO: 1244688 - DNA, 22 bp, Artificial Sequence
  chemically synthesized
agttccctttttgattgctatg

SEQ ID NO: 1244689 - DNA, 22 bp, Artificial Sequence
  chemically synthesized
gttccctttttgattgctatgc

SEQ ID NO: 1244690 - DNA, 22 bp, Artificial Sequence
  chemically synthesized
cctttttgattgctatgcaatt

SEQ ID NO: 1244691 - DNA, 22 bp, Artificial Sequence
  chemically synthesized
tatgaccacttcaggaattgca

SEQ ID NO: 1244692 - DNA, 22 bp, Artificial Sequence
  chemically synthesized
tttgattgctatgcaattcctg

SEQ ID NO: 1244693 - DNA, 22 bp, Artificial Sequence
  chemically synthesized
ttgattgctatgcaattcctga

SEQ ID NO: 1244694 - DNA, 22 bp, Artificial Sequence
  chemically synthesized
tgattgctatgcaattcctgaa

SEQ ID NO: 1244695 - DNA, 22 bp, Artificial Sequence
  chemically synthesized
gattgctatgcaattcctgaag

SEQ ID NO: 1244696 - DNA, 22 bp, Artificial Sequence
  chemically synthesized
attgctatgcaattcctgaagt

SEQ ID NO: 1244697 - DNA, 22 bp, Artificial Sequence
  chemically synthesized
ggttatatgaccacttcaggaa

SEQ ID NO: 1244698 - DNA, 22 bp, Artificial Sequence
  chemically synthesized
ctatgcaattcctgaagtggtc

SEQ ID NO: 1244699 - DNA, 22 bp, Artificial Sequence
  chemically synthesized
tgcaattcctgaagtggtcata

SEQ ID NO: 1244700 - DNA, 22 bp, Artificial Sequence
  chemically synthesized
caggcctgggttatatgaccac

SEQ ID NO: 1244701 - DNA, 22 bp, Artificial Sequence
  chemically synthesized
ctgaagtggtcatataacccag

SEQ ID NO: 1244702 - DNA, 22 bp, Artificial Sequence
  chemically synthesized
aggacctacaggcctgggttat

SEQ ID NO: 1244703 - DNA, 22 bp, Artificial Sequence
  chemically synthesized
aagtggtcatataacccaggcc

SEQ ID NO: 1244704 - DNA, 22 bp, Artificial Sequence
  chemically synthesized
taggtcctcaggacacatggca

SEQ ID NO: 1244705 - DNA, 22 bp, Artificial Sequence
  chemically synthesized
aggacacatggcatttcatcac

SEQ ID NO: 1244706 - DNA, 22 bp, Artificial Sequence
  chemically synthesized
agcaaagcaggaaagggtcggt

SEQ ID NO: 1244707 - DNA, 22 bp, Artificial Sequence
  chemically synthesized
gagcaaagcaggaaagggtcgg

SEQ ID NO: 1244708 - DNA, 22 bp, Artificial Sequence
  chemically synthesized
acatttgagcaaagcaggaaag

SEQ ID NO: 1244709 - DNA, 22 bp, Artificial Sequence
  chemically synthesized
catcaccgaccctttcctgctt

SEQ ID NO: 1244710 - DNA, 22 bp, Artificial Sequence
  chemically synthesized
atcaccgaccctttcctgcttt

SEQ ID NO: 1244711 - DNA, 22 bp, Artificial Sequence
  chemically synthesized
ccctgacatttgagcaaagcag

SEQ ID NO: 1244712 - DNA, 22 bp, Artificial Sequence
  chemically synthesized
ttcccctgacatttgagcaaag

SEQ ID NO: 1244713 - DNA, 22 bp, Artificial Sequence
  chemically synthesized
attcccctgacatttgagcaaa

SEQ ID NO: 1244714 - DNA, 22 bp, Artificial Sequence
  chemically synthesized
tcctgctttgctcaaatgtcag

SEQ ID NO: 1244715 - DNA, 22 bp, Artificial Sequence
  chemically synthesized
cctgctttgctcaaatgtcagg

SEQ ID NO: 1244716 - DNA, 22 bp, Artificial Sequence
  chemically synthesized
ctgctttgctcaaatgtcaggg

SEQ ID NO: 1244717 - DNA, 22 bp, Artificial Sequence
  chemically synthesized
ctttgctcaaatgtcaggggaa

SEQ ID NO: 1244718 - DNA, 22 bp, Artificial Sequence
  chemically synthesized
tgctcaaatgtcaggggaataa

SEQ ID NO: 1244719 - DNA, 22 bp, Artificial Sequence
  chemically synthesized
gctcaaatgtcaggggaataag

SEQ ID NO: 1244720 - DNA, 22 bp, Artificial Sequence
  chemically synthesized
ctcaaatgtcaggggaataagc

SEQ ID NO: 1244721 - DNA, 22 bp, Artificial Sequence
  chemically synthesized
aaaggaggaggggggcttattc

SEQ ID NO: 1244722 - DNA, 22 bp, Artificial Sequence
  chemically synthesized
aaatgtcaggggaataagcccc

SEQ ID NO: 1244723 - DNA, 22 bp, Artificial Sequence
  chemically synthesized
aaaaggaggaggggggcttatt

SEQ ID NO: 1244724 - DNA, 22 bp, Artificial Sequence
  chemically synthesized
taaaaggaggaggggggcttat

SEQ ID NO: 1244725 - DNA, 22 bp, Artificial Sequence
  chemically synthesized
ttaaaaggaggaggggggctta

SEQ ID NO: 1244726 - DNA, 22 bp, Artificial Sequence
  chemically synthesized
ggggtcagcttttaaaaggagg

SEQ ID NO: 1244727 - DNA, 22 bp, Artificial Sequence
  chemically synthesized
aggggtcagcttttaaaaggag

SEQ ID NO: 1244728 - DNA, 22 bp, Artificial Sequence
  chemically synthesized
ctccttttaaaagctgacccct

SEQ ID NO: 1244729 - DNA, 22 bp, Artificial Sequence
  chemically synthesized
aaaagcacatatttaggggtca

SEQ ID NO: 1244730 - DNA, 22 bp, Artificial Sequence
  chemically synthesized
cttttaaaagctgacccctaaa

SEQ ID NO: 1244731 - DNA, 22 bp, Artificial Sequence
  chemically synthesized
ttaaaagctgacccctaaatat

SEQ ID NO: 1244732 - DNA, 22 bp, Artificial Sequence
  chemically synthesized
tctcaaaagcacatatttaggg

SEQ ID NO: 1244733 - DNA, 22 bp, Artificial Sequence
  chemically synthesized
taaaagctgacccctaaatatg

SEQ ID NO: 1244734 - DNA, 22 bp, Artificial Sequence
  chemically synthesized
aaaagctgacccctaaatatgt

SEQ ID NO: 1244735 - DNA, 22 bp, Artificial Sequence
  chemically synthesized
aaagctgacccctaaatatgtg

SEQ ID NO: 1244736 - DNA, 22 bp, Artificial Sequence
  chemically synthesized
acccctaaatatgtgcttttga

SEQ ID NO: 1244737 - DNA, 22 bp, Artificial Sequence
  chemically synthesized
gtagccaattatctcaaaagca

SEQ ID NO: 1244738 - DNA, 22 bp, Artificial Sequence
  chemically synthesized
aatatgtgcttttgagataatt

SEQ ID NO: 1244739 - DNA, 22 bp, Artificial Sequence
  chemically synthesized
gagatgttggtagccaattatc

SEQ ID NO: 1244740 - DNA, 22 bp, Artificial Sequence
  chemically synthesized
aatcctagagatgttggtagcc

SEQ ID NO: 1244741 - DNA, 22 bp, Artificial Sequence
  chemically synthesized
ttgagataattggctaccaaca

SEQ ID NO: 1244742 - DNA, 22 bp, Artificial Sequence
  chemically synthesized
tgagataattggctaccaacat

SEQ ID NO: 1244743 - DNA, 22 bp, Artificial Sequence
  chemically synthesized
gagataattggctaccaacatc

SEQ ID NO: 1244744 - DNA, 22 bp, Artificial Sequence
  chemically synthesized
agataattggctaccaacatct

SEQ ID NO: 1244745 - DNA, 22 bp, Artificial Sequence
  chemically synthesized
gctaccaacatctctaggattt

SEQ ID NO: 1244746 - DNA, 22 bp, Artificial Sequence
  chemically synthesized
ccaacatctctaggatttaatt

SEQ ID NO: 1244747 - DNA, 22 bp, Artificial Sequence
  chemically synthesized
taggatttaattctcttccctc

SEQ ID NO: 1244748 - DNA, 22 bp, Artificial Sequence
  chemically synthesized
ggatttaattctcttccctcct

SEQ ID NO: 1244749 - DNA, 22 bp, Artificial Sequence
  chemically synthesized
tgtgtatgtgaacgaggaggga

SEQ ID NO: 1244750 - DNA, 22 bp, Artificial Sequence
  chemically synthesized
aattctcttccctcctcgttca

SEQ ID NO: 1244751 - DNA, 22 bp, Artificial Sequence
  chemically synthesized
attctcttccctcctcgttcac

SEQ ID NO: 1244752 - DNA, 22 bp, Artificial Sequence
  chemically synthesized
gatgcctgtgtgtatgtgaacg

SEQ ID NO: 1244753 - DNA, 22 bp, Artificial Sequence
  chemically synthesized
tcttccctcctcgttcacatac

SEQ ID NO: 1244754 - DNA, 22 bp, Artificial Sequence
  chemically synthesized
ttccctcctcgttcacatacac

SEQ ID NO: 1244755 - DNA, 22 bp, Artificial Sequence
  chemically synthesized
ccctcctcgttcacatacacac

SEQ ID NO: 1244756 - DNA, 22 bp, Artificial Sequence
  chemically synthesized
cctcctcgttcacatacacaca

SEQ ID NO: 1244757 - DNA, 22 bp, Artificial Sequence
  chemically synthesized
ccatatctagatgcctgtgtgt

SEQ ID NO: 1244758 - DNA, 22 bp, Artificial Sequence
  chemically synthesized
ctcgttcacatacacacaggca

SEQ ID NO: 1244759 - DNA, 22 bp, Artificial Sequence
  chemically synthesized
gttcacatacacacaggcatct

SEQ ID NO: 1244760 - DNA, 22 bp, Artificial Sequence
  chemically synthesized
cctgccatatctagatgcctgt

SEQ ID NO: 1244761 - DNA, 22 bp, Artificial Sequence
  chemically synthesized
ctgcctgccatatctagatgcc

SEQ ID NO: 1244762 - DNA, 22 bp, Artificial Sequence
  chemically synthesized
acatacacacaggcatctagat

SEQ ID NO: 1244763 - DNA, 22 bp, Artificial Sequence
  chemically synthesized
atgcctactgcctgccatatct

SEQ ID NO: 1244764 - DNA, 22 bp, Artificial Sequence
  chemically synthesized
taatgcctactgcctgccatat

SEQ ID NO: 1244765 - DNA, 22 bp, Artificial Sequence
  chemically synthesized
actctaatgcctactgcctgcc

SEQ ID NO: 1244766 - DNA, 22 bp, Artificial Sequence
  chemically synthesized
tcactctaatgcctactgcctg

SEQ ID NO: 1244767 - DNA, 22 bp, Artificial Sequence
  chemically synthesized
tctcactctaatgcctactgcc

SEQ ID NO: 1244768 - DNA, 22 bp, Artificial Sequence
  chemically synthesized
gatatggcaggcagtaggcatt

SEQ ID NO: 1244769 - DNA, 22 bp, Artificial Sequence
  chemically synthesized
ctctctcactctaatgcctact

SEQ ID NO: 1244770 - DNA, 22 bp, Artificial Sequence
  chemically synthesized
aatgtctgctctctcactctaa

SEQ ID NO: 1244771 - DNA, 22 bp, Artificial Sequence
  chemically synthesized
caatgtctgctctctcactcta

SEQ ID NO: 1244772 - DNA, 22 bp, Artificial Sequence
  chemically synthesized
agtgtagcttcaatgtctgctc

SEQ ID NO: 1244773 - DNA, 22 bp, Artificial Sequence
  chemically synthesized
gagtgagagagcagacattgaa

SEQ ID NO: 1244774 - DNA, 22 bp, Artificial Sequence
  chemically synthesized
agaaacaggcctgagtgtagct

SEQ ID NO: 1244775 - DNA, 22 bp, Artificial Sequence
  chemically synthesized
aagtctgagaaacaggcctgag

SEQ ID NO: 1244776 - DNA, 22 bp, Artificial Sequence
  chemically synthesized
aagctacactcaggcctgtttc

SEQ ID NO: 1244777 - DNA, 22 bp, Artificial Sequence
  chemically synthesized
cactcaggcctgtttctcagac

SEQ ID NO: 1244778 - DNA, 22 bp, Artificial Sequence
  chemically synthesized
atatatactaaagtctgagaaa

SEQ ID NO: 1244779 - DNA, 22 bp, Artificial Sequence
  chemically synthesized
taatatatactaaagtctgaga

SEQ ID NO: 1244780 - DNA, 22 bp, Artificial Sequence
  chemically synthesized
aggcctgtttctcagactttag

SEQ ID NO: 1244781 - DNA, 22 bp, Artificial Sequence
  chemically synthesized
tttctcagactttagtatatat

SEQ ID NO: 1244782 - DNA, 22 bp, Artificial Sequence
  chemically synthesized
ctcagactttagtatatattag

SEQ ID NO: 1244783 - DNA, 22 bp, Artificial Sequence
  chemically synthesized
atccaggtggttctaatatata

SEQ ID NO: 1244784 - DNA, 22 bp, Artificial Sequence
  chemically synthesized
tcagactttagtatatattaga

SEQ ID NO: 1244785 - DNA, 22 bp, Artificial Sequence
  chemically synthesized
agactttagtatatattagaac

SEQ ID NO: 1244786 - DNA, 22 bp, Artificial Sequence
  chemically synthesized
tagtatatattagaaccacctg

SEQ ID NO: 1244787 - DNA, 22 bp, Artificial Sequence
  chemically synthesized
agtatatattagaaccacctgg

SEQ ID NO: 1244788 - DNA, 22 bp, Artificial Sequence
  chemically synthesized
gtatatattagaaccacctgga

SEQ ID NO: 1244789 - DNA, 22 bp, Artificial Sequence
  chemically synthesized
gaaccacctggatgagcccgtt

SEQ ID NO: 1244790 - DNA, 22 bp, Artificial Sequence
  chemically synthesized
acaggcaatgcatgtcataacg

SEQ ID NO: 1244791 - DNA, 22 bp, Artificial Sequence
  chemically synthesized
gatgagcccgttatgacatgca

SEQ ID NO: 1244792 - DNA, 22 bp, Artificial Sequence
  chemically synthesized
gatcagaattaacaggcaatgc

SEQ ID NO: 1244793 - DNA, 22 bp, Artificial Sequence
  chemically synthesized
ggatcagaattaacaggcaatg

SEQ ID NO: 1244794 - DNA, 22 bp, Artificial Sequence
  chemically synthesized
tgacatgcattgcctgttaatt

SEQ ID NO: 1244795 - DNA, 22 bp, Artificial Sequence
  chemically synthesized
tacacttggatcagaattaaca

SEQ ID NO: 1244796 - DNA, 22 bp, Artificial Sequence
  chemically synthesized
tgtacacttggatcagaattaa

SEQ ID NO: 1244797 - DNA, 22 bp, Artificial Sequence
  chemically synthesized
cctgttaattctgatccaagtg

SEQ ID NO: 1244798 - DNA, 22 bp, Artificial Sequence
  chemically synthesized
tagtcctctgtacacttggatc

SEQ ID NO: 1244799 - DNA, 22 bp, Artificial Sequence
  chemically synthesized
ttaattctgatccaagtgtaca

SEQ ID NO: 1244800 - DNA, 22 bp, Artificial Sequence
  chemically synthesized
attctgatccaagtgtacagag

SEQ ID NO: 1244801 - DNA, 22 bp, Artificial Sequence
  chemically synthesized
aaaattgtagtcctctgtacac

SEQ ID NO: 1244802 - DNA, 22 bp, Artificial Sequence
  chemically synthesized
ctcaaaattgtagtcctctgta

SEQ ID NO: 1244803 - DNA, 22 bp, Artificial Sequence
  chemically synthesized
tgatccaagtgtacagaggact

SEQ ID NO: 1244804 - DNA, 22 bp, Artificial Sequence
  chemically synthesized
cctcaaaattgtagtcctctgt

SEQ ID NO: 1244805 - DNA, 22 bp, Artificial Sequence
  chemically synthesized
atccaagtgtacagaggactac

SEQ ID NO: 1244806 - DNA, 22 bp, Artificial Sequence
  chemically synthesized
tttcctcaaaattgtagtcctc

SEQ ID NO: 1244807 - DNA, 22 bp, Artificial Sequence
  chemically synthesized
gaattatttcctcaaaattgta

SEQ ID NO: 1244808 - DNA, 22 bp, Artificial Sequence
  chemically synthesized
agcctagaattatttcctcaaa

SEQ ID NO: 1244809 - DNA, 22 bp, Artificial Sequence
  chemically synthesized
caattttgaggaaataattcta

SEQ ID NO: 1244810 - DNA, 22 bp, Artificial Sequence
  chemically synthesized
tgaggaaataattctaggctca

SEQ ID NO: 1244811 - DNA, 22 bp, Artificial Sequence
  chemically synthesized
gaggaaataattctaggctcag

SEQ ID NO: 1244812 - DNA, 22 bp, Artificial Sequence
  chemically synthesized
aggaaataattctaggctcagc

SEQ ID NO: 1244813 - DNA, 22 bp, Artificial Sequence
  chemically synthesized
atcagtggtaaagctgagccta

SEQ ID NO: 1244814 - DNA, 22 bp, Artificial Sequence
  chemically synthesized
aatcagtggtaaagctgagcct

SEQ ID NO: 1244815 - DNA, 22 bp, Artificial Sequence
  chemically synthesized
cttaatcagtggtaaagctgag

SEQ ID NO: 1244816 - DNA, 22 bp, Artificial Sequence
  chemically synthesized
atggctacttaatcagtggtaa

SEQ ID NO: 1244817 - DNA, 22 bp, Artificial Sequence
  chemically synthesized
taggctcagctttaccactgat

SEQ ID NO: 1244818 - DNA, 22 bp, Artificial Sequence
  chemically synthesized
ggctcagctttaccactgatta

SEQ ID NO: 1244819 - DNA, 22 bp, Artificial Sequence
  chemically synthesized
agctttaccactgattaagtag

SEQ ID NO: 1244820 - DNA, 22 bp, Artificial Sequence
  chemically synthesized
atgtactcatggctacttaatc

SEQ ID NO: 1244821 - DNA, 22 bp, Artificial Sequence
  chemically synthesized
gatgtactcatggctacttaat

SEQ ID NO: 1244822 - DNA, 22 bp, Artificial Sequence
  chemically synthesized
taccactgattaagtagccatg

SEQ ID NO: 1244823 - DNA, 22 bp, Artificial Sequence
  chemically synthesized
accactgattaagtagccatga

SEQ ID NO: 1244824 - DNA, 22 bp, Artificial Sequence
  chemically synthesized
ccactgattaagtagccatgag

SEQ ID NO: 1244825 - DNA, 22 bp, Artificial Sequence
  chemically synthesized
attaagtagccatgagtacatc

SEQ ID NO: 1244826 - DNA, 22 bp, Artificial Sequence
  chemically synthesized
agaaatgtgccttgatgtactc

SEQ ID NO: 1244827 - DNA, 22 bp, Artificial Sequence
  chemically synthesized
agtagccatgagtacatcaagg

SEQ ID NO: 1244828 - DNA, 22 bp, Artificial Sequence
  chemically synthesized
atataagaaatgaatgctcaga

SEQ ID NO: 1244829 - DNA, 22 bp, Artificial Sequence
  chemically synthesized
catataagaaatgaatgctcag

SEQ ID NO: 1244830 - DNA, 22 bp, Artificial Sequence
  chemically synthesized
tcatataagaaatgaatgctca

SEQ ID NO: 1244831 - DNA, 22 bp, Artificial Sequence
  chemically synthesized
attttcatataagaaatgaatg

SEQ ID NO: 1244832 - DNA, 22 bp, Artificial Sequence
  chemically synthesized
cattttcatataagaaatgaat

SEQ ID NO: 1244833 - DNA, 22 bp, Artificial Sequence
  chemically synthesized
cttcattttcatataagaaatg

SEQ ID NO: 1244834 - DNA, 22 bp, Artificial Sequence
  chemically synthesized
ctgagcattcatttcttatatg

SEQ ID NO: 1244835 - DNA, 22 bp, Artificial Sequence
  chemically synthesized
tgagcattcatttcttatatga

SEQ ID NO: 1244836 - DNA, 22 bp, Artificial Sequence
  chemically synthesized
agcattcatttcttatatgaaa

SEQ ID NO: 1244837 - DNA, 22 bp, Artificial Sequence
  chemically synthesized
taacctacttcattttcatata

SEQ ID NO: 1244838 - DNA, 22 bp, Artificial Sequence
  chemically synthesized
atttcttatatgaaaatgaagt

SEQ ID NO: 1244839 - DNA, 22 bp, Artificial Sequence
  chemically synthesized
cttatatgaaaatgaagtaggt

SEQ ID NO: 1244840 - DNA, 22 bp, Artificial Sequence
  chemically synthesized
ttatatgaaaatgaagtaggtt

SEQ ID NO: 1244841 - DNA, 22 bp, Artificial Sequence
  chemically synthesized
atatgaaaatgaagtaggttac

SEQ ID NO: 1244842 - DNA, 22 bp, Artificial Sequence
  chemically synthesized
tatgaaaatgaagtaggttaca

SEQ ID NO: 1244843 - DNA, 22 bp, Artificial Sequence
  chemically synthesized
gagaataaccactgtaacctac

SEQ ID NO: 1244844 - DNA, 22 bp, Artificial Sequence
  chemically synthesized
agagaataaccactgtaaccta

SEQ ID NO: 1244845 - DNA, 22 bp, Artificial Sequence
  chemically synthesized
agagtatccttagagaataacc

SEQ ID NO: 1244846 - DNA, 22 bp, Artificial Sequence
  chemically synthesized
cagtggttattctctaaggata

SEQ ID NO: 1244847 - DNA, 22 bp, Artificial Sequence
  chemically synthesized
tgagtgctgagagtatccttag

SEQ ID NO: 1244848 - DNA, 22 bp, Artificial Sequence
  chemically synthesized
ttctctaaggatactctcagca

SEQ ID NO: 1244849 - DNA, 22 bp, Artificial Sequence
  chemically synthesized
tctaaggatactctcagcactc

SEQ ID NO: 1244850 - DNA, 22 bp, Artificial Sequence
  chemically synthesized
taaggatactctcagcactcac

SEQ ID NO: 1244851 - DNA, 22 bp, Artificial Sequence
  chemically synthesized
aggatactctcagcactcacag

SEQ ID NO: 1244852 - DNA, 22 bp, Artificial Sequence
  chemically synthesized
gacacagaataggggactgtga

SEQ ID NO: 1244853 - DNA, 22 bp, Artificial Sequence
  chemically synthesized
tagacacagaataggggactgt

SEQ ID NO: 1244854 - DNA, 22 bp, Artificial Sequence
  chemically synthesized
tcagcactcacagtcccctatt

SEQ ID NO: 1244855 - DNA, 22 bp, Artificial Sequence
  chemically synthesized
agcactcacagtcccctattct

SEQ ID NO: 1244856 - DNA, 22 bp, Artificial Sequence
  chemically synthesized
gattctagacacagaatagggg

SEQ ID NO: 1244857 - DNA, 22 bp, Artificial Sequence
  chemically synthesized
agattctagacacagaataggg

SEQ ID NO: 1244858 - DNA, 22 bp, Artificial Sequence
  chemically synthesized
tttagattctagacacagaata

SEQ ID NO: 1244859 - DNA, 22 bp, Artificial Sequence
  chemically synthesized
atttagattctagacacagaat

SEQ ID NO: 1244860 - DNA, 22 bp, Artificial Sequence
  chemically synthesized
acagtcccctattctgtgtcta

SEQ ID NO: 1244861 - DNA, 22 bp, Artificial Sequence
  chemically synthesized
gccttatttagattctagacac

SEQ ID NO: 1244862 - DNA, 22 bp, Artificial Sequence
  chemically synthesized
ctagccttatttagattctaga

SEQ ID NO: 1244863 - DNA, 22 bp, Artificial Sequence
  chemically synthesized
cctagccttatttagattctag

SEQ ID NO: 1244864 - DNA, 22 bp, Artificial Sequence
  chemically synthesized
tcctagccttatttagattcta

SEQ ID NO: 1244865 - DNA, 22 bp, Artificial Sequence
  chemically synthesized
ttcctagccttatttagattct

SEQ ID NO: 1244866 - DNA, 22 bp, Artificial Sequence
  chemically synthesized
tttcctagccttatttagattc

SEQ ID NO: 1244867 - DNA, 22 bp, Artificial Sequence
  chemically synthesized
ttctgtgtctagaatctaaata

SEQ ID NO: 1244868 - DNA, 22 bp, Artificial Sequence
  chemically synthesized
tgtgtctagaatctaaataagg

SEQ ID NO: 1244869 - DNA, 22 bp, Artificial Sequence
  chemically synthesized
cattttttcctagccttattta

SEQ ID NO: 1244870 - DNA, 22 bp, Artificial Sequence
  chemically synthesized
tgtctagaatctaaataaggct

SEQ ID NO: 1244871 - DNA, 22 bp, Artificial Sequence
  chemically synthesized
gcattttttcctagccttattt

SEQ ID NO: 1244872 - DNA, 22 bp, Artificial Sequence
  chemically synthesized
tgtttgcattttttcctagcct

SEQ ID NO: 1244873 - DNA, 22 bp, Artificial Sequence
  chemically synthesized
gaatctaaataaggctaggaaa

SEQ ID NO: 1244874 - DNA, 22 bp, Artificial Sequence
  chemically synthesized
atgtttgcattttttcctagcc

SEQ ID NO: 1244875 - DNA, 22 bp, Artificial Sequence
  chemically synthesized
tatgtttgcattttttcctagc

SEQ ID NO: 1244876 - DNA, 22 bp, Artificial Sequence
  chemically synthesized
aataaggctaggaaaaaatgca

SEQ ID NO: 1244877 - DNA, 22 bp, Artificial Sequence
  chemically synthesized
tcattttatgtttgcatttttt

SEQ ID NO: 1244878 - DNA, 22 bp, Artificial Sequence
  chemically synthesized
caatgttatcattttatgtttg

SEQ ID NO: 1244879 - DNA, 22 bp, Artificial Sequence
  chemically synthesized
acaatgttatcattttatgttt

SEQ ID NO: 1244880 - DNA, 22 bp, Artificial Sequence
  chemically synthesized
ggaaaaaatgcaaacataaaat

SEQ ID NO: 1244881 - DNA, 22 bp, Artificial Sequence
  chemically synthesized
tacaatgttatcattttatgtt

SEQ ID NO: 1244882 - DNA, 22 bp, Artificial Sequence
  chemically synthesized
ttacaatgttatcattttatgt

SEQ ID NO: 1244883 - DNA, 22 bp, Artificial Sequence
  chemically synthesized
gcttttacaatgttatcatttt

SEQ ID NO: 1244884 - DNA, 22 bp, Artificial Sequence
  chemically synthesized
agcttttacaatgttatcattt

SEQ ID NO: 1244885 - DNA, 22 bp, Artificial Sequence
  chemically synthesized
ttagcttttacaatgttatcat

SEQ ID NO: 1244886 - DNA, 22 bp, Artificial Sequence
  chemically synthesized
ttcttagcttttacaatgttat

SEQ ID NO: 1244887 - DNA, 22 bp, Artificial Sequence
  chemically synthesized
gtaactattcttagcttttaca

SEQ ID NO: 1244888 - DNA, 22 bp, Artificial Sequence
  chemically synthesized
agtaactattcttagcttttac

SEQ ID NO: 1244889 - DNA, 22 bp, Artificial Sequence
  chemically synthesized
tagtaactattcttagctttta

SEQ ID NO: 1244890 - DNA, 22 bp, Artificial Sequence
  chemically synthesized
ttagtaactattcttagctttt

SEQ ID NO: 1244891 - DNA, 22 bp, Artificial Sequence
  chemically synthesized
atttttagtaactattcttagc

SEQ ID NO: 1244892 - DNA, 22 bp, Artificial Sequence
  chemically synthesized
gctaatttttagtaactattct

SEQ ID NO: 1244893 - DNA, 22 bp, Artificial Sequence
  chemically synthesized
ggctaatttttagtaactattc

SEQ ID NO: 1244894 - DNA, 22 bp, Artificial Sequence
  chemically synthesized
tggctaatttttagtaactatt

SEQ ID NO: 1244895 - DNA, 22 bp, Artificial Sequence
  chemically synthesized
taaaagctaagaatagttacta

SEQ ID NO: 1244896 - DNA, 22 bp, Artificial Sequence
  chemically synthesized
agaatagttactaaaaattagc

SEQ ID NO: 1244897 - DNA, 22 bp, Artificial Sequence
  chemically synthesized
gagaagcaaagggttttggcta

SEQ ID NO: 1244898 - DNA, 22 bp, Artificial Sequence
  chemically synthesized
ggagaagcaaagggttttggct

SEQ ID NO: 1244899 - DNA, 22 bp, Artificial Sequence
  chemically synthesized
tggagaagcaaagggttttggc

SEQ ID NO: 1244900 - DNA, 22 bp, Artificial Sequence
  chemically synthesized
ctaaaaattagccaaaaccctt

SEQ ID NO: 1244901 - DNA, 22 bp, Artificial Sequence
  chemically synthesized
aaaattagccaaaaccctttgc

SEQ ID NO: 1244902 - DNA, 22 bp, Artificial Sequence
  chemically synthesized
gactttggagaagcaaagggtt

SEQ ID NO: 1244903 - DNA, 22 bp, Artificial Sequence
  chemically synthesized
ttcgactttggagaagcaaagg

SEQ ID NO: 1244904 - DNA, 22 bp, Artificial Sequence
  chemically synthesized
attcgactttggagaagcaaag

SEQ ID NO: 1244905 - DNA, 22 bp, Artificial Sequence
  chemically synthesized
tattcgactttggagaagcaaa

SEQ ID NO: 1244906 - DNA, 22 bp, Artificial Sequence
  chemically synthesized
ttattcgactttggagaagcaa

SEQ ID NO: 1244907 - DNA, 22 bp, Artificial Sequence
  chemically synthesized
gccaaaaccctttgcttctcca

SEQ ID NO: 1244908 - DNA, 22 bp, Artificial Sequence
  chemically synthesized
atttttattcgactttggagaa

SEQ ID NO: 1244909 - DNA, 22 bp, Artificial Sequence
  chemically synthesized
gatttttattcgactttggaga

SEQ ID NO: 1244910 - DNA, 22 bp, Artificial Sequence
  chemically synthesized
cttgatttttattcgactttgg

SEQ ID NO: 1244911 - DNA, 22 bp, Artificial Sequence
  chemically synthesized
tgcttctccaaagtcgaataaa

SEQ ID NO: 1244912 - DNA, 22 bp, Artificial Sequence
  chemically synthesized
gcttctccaaagtcgaataaaa

SEQ ID NO: 1244913 - DNA, 22 bp, Artificial Sequence
  chemically synthesized
cttctccaaagtcgaataaaaa

SEQ ID NO: 1244914 - DNA, 22 bp, Artificial Sequence
  chemically synthesized
ctccaaagtcgaataaaaatca

SEQ ID NO: 1244915 - DNA, 22 bp, Artificial Sequence
  chemically synthesized
tccaaagtcgaataaaaatcaa

SEQ ID NO: 1244916 - DNA, 22 bp, Artificial Sequence
  chemically synthesized
caaagtcgaataaaaatcaagt

SEQ ID NO: 1244917 - DNA, 22 bp, Artificial Sequence
  chemically synthesized
tacataacatgtcattacttga

SEQ ID NO: 1244918 - DNA, 22 bp, Artificial Sequence
  chemically synthesized
atggcaattatacataacatgt

SEQ ID NO: 1244919 - DNA, 22 bp, Artificial Sequence
  chemically synthesized
gatggcaattatacataacatg

SEQ ID NO: 1244920 - DNA, 22 bp, Artificial Sequence
  chemically synthesized
tttgatggcaattatacataac

SEQ ID NO: 1244921 - DNA, 22 bp, Artificial Sequence
  chemically synthesized
atttgatggcaattatacataa

SEQ ID NO: 1244922 - DNA, 22 bp, Artificial Sequence
  chemically synthesized
tatttgatggcaattatacata

SEQ ID NO: 1244923 - DNA, 22 bp, Artificial Sequence
  chemically synthesized
ttatttgatggcaattatacat

SEQ ID NO: 1244924 - DNA, 22 bp, Artificial Sequence
  chemically synthesized
cttttatttgatggcaattata

SEQ ID NO: 1244925 - DNA, 22 bp, Artificial Sequence
  chemically synthesized
ccttttatttgatggcaattat

SEQ ID NO: 1244926 - DNA, 22 bp, Artificial Sequence
  chemically synthesized
tccttttatttgatggcaatta

SEQ ID NO: 1244927 - DNA, 22 bp, Artificial Sequence
  chemically synthesized
ctttccttttatttgatggcaa

SEQ ID NO: 1244928 - DNA, 22 bp, Artificial Sequence
  chemically synthesized
tgtataattgccatcaaataaa

SEQ ID NO: 1244929 - DNA, 22 bp, Artificial Sequence
  chemically synthesized
agataaaattcctttcctttta

SEQ ID NO: 1244930 - DNA, 22 bp, Artificial Sequence
  chemically synthesized
ccatcaaataaaaggaaaggaa

SEQ ID NO: 1244931 - DNA, 22 bp, Artificial Sequence
  chemically synthesized
ggctaagataaaattcctttcc

SEQ ID NO: 1244932 - DNA, 22 bp, Artificial Sequence
  chemically synthesized
aggctaagataaaattcctttc

SEQ ID NO: 1244933 - DNA, 22 bp, Artificial Sequence
  chemically synthesized
gcttaggctaagataaaattcc

SEQ ID NO: 1244934 - DNA, 22 bp, Artificial Sequence
  chemically synthesized
agcttaggctaagataaaattc

SEQ ID NO: 1244935 - DNA, 22 bp, Artificial Sequence
  chemically synthesized
cccttagcttaggctaagataa

SEQ ID NO: 1244936 - DNA, 22 bp, Artificial Sequence
  chemically synthesized
acccttagcttaggctaagata

SEQ ID NO: 1244937 - DNA, 22 bp, Artificial Sequence
  chemically synthesized
aaaatcttacccttagcttagg

SEQ ID NO: 1244938 - DNA, 22 bp, Artificial Sequence
  chemically synthesized
tatcttagcctaagctaagggt

SEQ ID NO: 1244939 - DNA, 22 bp, Artificial Sequence
  chemically synthesized
atcttagcctaagctaagggta

SEQ ID NO: 1244940 - DNA, 22 bp, Artificial Sequence
  chemically synthesized
tcttagcctaagctaagggtaa

SEQ ID NO: 1244941 - DNA, 22 bp, Artificial Sequence
  chemically synthesized
agattgaaaatcttacccttag

SEQ ID NO: 1244942 - DNA, 22 bp, Artificial Sequence
  chemically synthesized
cagattgaaaatcttaccctta

SEQ ID NO: 1244943 - DNA, 22 bp, Artificial Sequence
  chemically synthesized
agcctaagctaagggtaagatt

SEQ ID NO: 1244944 - DNA, 22 bp, Artificial Sequence
  chemically synthesized
gcctaagctaagggtaagattt

SEQ ID NO: 1244945 - DNA, 22 bp, Artificial Sequence
  chemically synthesized
tggacttcagattgaaaatctt

SEQ ID NO: 1244946 - DNA, 22 bp, Artificial Sequence
  chemically synthesized
agctaagggtaagattttcaat

SEQ ID NO: 1244947 - DNA, 22 bp, Artificial Sequence
  chemically synthesized
tccctgtggacttcagattgaa

SEQ ID NO: 1244948 - DNA, 22 bp, Artificial Sequence
  chemically synthesized
agggtaagattttcaatctgaa

SEQ ID NO: 1244949 - DNA, 22 bp, Artificial Sequence
  chemically synthesized
gtccctgtggacttcagattga

SEQ ID NO: 1244950 - DNA, 22 bp, Artificial Sequence
  chemically synthesized
gtcttgtccctgtggacttcag

SEQ ID NO: 1244951 - DNA, 22 bp, Artificial Sequence
  chemically synthesized
ggtcttgtccctgtggacttca

SEQ ID NO: 1244952 - DNA, 22 bp, Artificial Sequence
  chemically synthesized
ttggtcttgtccctgtggactt

SEQ ID NO: 1244953 - DNA, 22 bp, Artificial Sequence
  chemically synthesized
ttcttggtcttgtccctgtgga

SEQ ID NO: 1244954 - DNA, 22 bp, Artificial Sequence
  chemically synthesized
tcaatctgaagtccacagggac

SEQ ID NO: 1244955 - DNA, 22 bp, Artificial Sequence
  chemically synthesized
caatctgaagtccacagggaca

SEQ ID NO: 1244956 - DNA, 22 bp, Artificial Sequence
  chemically synthesized
aatctgaagtccacagggacaa

SEQ ID NO: 1244957 - DNA, 22 bp, Artificial Sequence
  chemically synthesized
ctgttcttggtcttgtccctgt

SEQ ID NO: 1244958 - DNA, 22 bp, Artificial Sequence
  chemically synthesized
ggttcctgttcttggtcttgtc

SEQ ID NO: 1244959 - DNA, 22 bp, Artificial Sequence
  chemically synthesized
aagtccacagggacaagaccaa

SEQ ID NO: 1244960 - DNA, 22 bp, Artificial Sequence
  chemically synthesized
ttaggttcctgttcttggtctt

SEQ ID NO: 1244961 - DNA, 22 bp, Artificial Sequence
  chemically synthesized
gttaggttcctgttcttggtct

SEQ ID NO: 1244962 - DNA, 22 bp, Artificial Sequence
  chemically synthesized
caaaggacttgttaggttcctg

SEQ ID NO: 1244963 - DNA, 22 bp, Artificial Sequence
  chemically synthesized
agatcattgcaaaggacttgtt

SEQ ID NO: 1244964 - DNA, 22 bp, Artificial Sequence
  chemically synthesized
ttcagatcattgcaaaggactt

SEQ ID NO: 1244965 - DNA, 22 bp, Artificial Sequence
  chemically synthesized
attattcagatcattgcaaagg

SEQ ID NO: 1244966 - DNA, 22 bp, Artificial Sequence
  chemically synthesized
cattattcagatcattgcaaag

SEQ ID NO: 1244967 - DNA, 22 bp, Artificial Sequence
  chemically synthesized
acaagtcctttgcaatgatctg

SEQ ID NO: 1244968 - DNA, 22 bp, Artificial Sequence
  chemically synthesized
agggatgtttcattattcagat

SEQ ID NO: 1244969 - DNA, 22 bp, Artificial Sequence
  chemically synthesized
tgcaatgatctgaataatgaaa

SEQ ID NO: 1244970 - DNA, 22 bp, Artificial Sequence
  chemically synthesized
atctaagggatgtttcattatt

SEQ ID NO: 1244971 - DNA, 22 bp, Artificial Sequence
  chemically synthesized
gcaatgatctgaataatgaaac

SEQ ID NO: 1244972 - DNA, 22 bp, Artificial Sequence
  chemically synthesized
caatgatctgaataatgaaaca

SEQ ID NO: 1244973 - DNA, 22 bp, Artificial Sequence
  chemically synthesized
tgatctaagggatgtttcatta

SEQ ID NO: 1244974 - DNA, 22 bp, Artificial Sequence
  chemically synthesized
agaaactctgatctaagggatg

SEQ ID NO: 1244975 - DNA, 22 bp, Artificial Sequence
  chemically synthesized
aataatgaaacatcccttagat

SEQ ID NO: 1244976 - DNA, 22 bp, Artificial Sequence
  chemically synthesized
atgtgcaaacaaatgttgagaa

SEQ ID NO: 1244977 - DNA, 22 bp, Artificial Sequence
  chemically synthesized
catgtgcaaacaaatgttgaga

SEQ ID NO: 1244978 - DNA, 22 bp, Artificial Sequence
  chemically synthesized
agatcagagtttctcaacattt

SEQ ID NO: 1244979 - DNA, 22 bp, Artificial Sequence
  chemically synthesized
gatcagagtttctcaacatttg

SEQ ID NO: 1244980 - DNA, 22 bp, Artificial Sequence
  chemically synthesized
agaggtttcatgtgcaaacaaa

SEQ ID NO: 1244981 - DNA, 22 bp, Artificial Sequence
  chemically synthesized
cagaggtttcatgtgcaaacaa

SEQ ID NO: 1244982 - DNA, 22 bp, Artificial Sequence
  chemically synthesized
ctcaacatttgtttgcacatga

SEQ ID NO: 1244983 - DNA, 22 bp, Artificial Sequence
  chemically synthesized
tcaacatttgtttgcacatgaa

SEQ ID NO: 1244984 - DNA, 22 bp, Artificial Sequence
  chemically synthesized
aacatttgtttgcacatgaaac

SEQ ID NO: 1244985 - DNA, 22 bp, Artificial Sequence
  chemically synthesized
acatcttcagaggtttcatgtg

SEQ ID NO: 1244986 - DNA, 22 bp, Artificial Sequence
  chemically synthesized
actaacatcttcagaggtttca

SEQ ID NO: 1244987 - DNA, 22 bp, Artificial Sequence
  chemically synthesized
gactaacatcttcagaggtttc

SEQ ID NO: 1244988 - DNA, 22 bp, Artificial Sequence
  chemically synthesized
gtttgcacatgaaacctctgaa

SEQ ID NO: 1244989 - DNA, 22 bp, Artificial Sequence
  chemically synthesized
tttgcacatgaaacctctgaag

SEQ ID NO: 1244990 - DNA, 22 bp, Artificial Sequence
  chemically synthesized
cacttgactaacatcttcagag

SEQ ID NO: 1244991 - DNA, 22 bp, Artificial Sequence
  chemically synthesized
gcacatgaaacctctgaagatg

SEQ ID NO: 1244992 - DNA, 22 bp, Artificial Sequence
  chemically synthesized
cacatgaaacctctgaagatgt

SEQ ID NO: 1244993 - DNA, 22 bp, Artificial Sequence
  chemically synthesized
acacgagtctgcacttgactaa

SEQ ID NO: 1244994 - DNA, 22 bp, Artificial Sequence
  chemically synthesized
tgaagatgttagtcaagtgcag

SEQ ID NO: 1244995 - DNA, 22 bp, Artificial Sequence
  chemically synthesized
aagatgttagtcaagtgcagac

SEQ ID NO: 1244996 - DNA, 22 bp, Artificial Sequence
  chemically synthesized
gacctcacacgagtctgcactt

SEQ ID NO: 1244997 - DNA, 22 bp, Artificial Sequence
  chemically synthesized
tcctagacctcacacgagtctg

SEQ ID NO: 1244998 - DNA, 22 bp, Artificial Sequence
  chemically synthesized
gtcaagtgcagactcgtgtgag

SEQ ID NO: 1244999 - DNA, 22 bp, Artificial Sequence
  chemically synthesized
aggcgctatcctagacctcaca

SEQ ID NO: 1245000 - DNA, 22 bp, Artificial Sequence
  chemically synthesized
caggcgctatcctagacctcac

SEQ ID NO: 1245001 - DNA, 22 bp, Artificial Sequence
  chemically synthesized
tcaggcgctatcctagacctca

SEQ ID NO: 1245002 - DNA, 22 bp, Artificial Sequence
  chemically synthesized
gtgtgaggtctaggatagcgcc

SEQ ID NO: 1245003 - DNA, 22 bp, Artificial Sequence
  chemically synthesized
gaaatgtacattttcaggcgct

SEQ ID NO: 1245004 - DNA, 22 bp, Artificial Sequence
  chemically synthesized
ttagaaatgtacattttcaggc

SEQ ID NO: 1245005 - DNA, 22 bp, Artificial Sequence
  chemically synthesized
gttagaaatgtacattttcagg

SEQ ID NO: 1245006 - DNA, 22 bp, Artificial Sequence
  chemically synthesized
tgttagaaatgtacattttcag

SEQ ID NO: 1245007 - DNA, 22 bp, Artificial Sequence
  chemically synthesized
ggatagcgcctgaaaatgtaca

SEQ ID NO: 1245008 - DNA, 22 bp, Artificial Sequence
  chemically synthesized
aggttttgttagaaatgtacat

SEQ ID NO: 1245009 - DNA, 22 bp, Artificial Sequence
  chemically synthesized
aaaatgtacatttctaacaaaa

SEQ ID NO: 1245010 - DNA, 22 bp, Artificial Sequence
  chemically synthesized
ggagcaccagttgaggttttgt

SEQ ID NO: 1245011 - DNA, 22 bp, Artificial Sequence
  chemically synthesized
caatctaggagcaccagttgag

SEQ ID NO: 1245012 - DNA, 22 bp, Artificial Sequence
  chemically synthesized
ctaacaaaacctcaactggtgc

SEQ ID NO: 1245013 - DNA, 22 bp, Artificial Sequence
  chemically synthesized
taacaaaacctcaactggtgct

SEQ ID NO: 1245014 - DNA, 22 bp, Artificial Sequence
  chemically synthesized
acaaaacctcaactggtgctcc

SEQ ID NO: 1245015 - DNA, 22 bp, Artificial Sequence
  chemically synthesized
tggtctgcaatctaggagcacc

SEQ ID NO: 1245016 - DNA, 22 bp, Artificial Sequence
  chemically synthesized
aaattatggtctgcaatctagg

SEQ ID NO: 1245017 - DNA, 22 bp, Artificial Sequence
  chemically synthesized
aactggtgctcctagattgcag

SEQ ID NO: 1245018 - DNA, 22 bp, Artificial Sequence
  chemically synthesized
caactcaaattatggtctgcaa

SEQ ID NO: 1245019 - DNA, 22 bp, Artificial Sequence
  chemically synthesized
gtgctcctagattgcagaccat

SEQ ID NO: 1245020 - DNA, 22 bp, Artificial Sequence
  chemically synthesized
gcaactcaaattatggtctgca

SEQ ID NO: 1245021 - DNA, 22 bp, Artificial Sequence
  chemically synthesized
ctagattgcagaccataatttg

SEQ ID NO: 1245022 - DNA, 22 bp, Artificial Sequence
  chemically synthesized
aggccttgcaactcaaattatg

SEQ ID NO: 1245023 - DNA, 22 bp, Artificial Sequence
  chemically synthesized
aaggccttgcaactcaaattat

SEQ ID NO: 1245024 - DNA, 22 bp, Artificial Sequence
  chemically synthesized
gattgcagaccataatttgagt

SEQ ID NO: 1245025 - DNA, 22 bp, Artificial Sequence
  chemically synthesized
cagaccataatttgagttgcaa

SEQ ID NO: 1245026 - DNA, 22 bp, Artificial Sequence
  chemically synthesized
tgagggatagacttaaggcctt

SEQ ID NO: 1245027 - DNA, 22 bp, Artificial Sequence
  chemically synthesized
ctgtgagggatagacttaaggc

SEQ ID NO: 1245028 - DNA, 22 bp, Artificial Sequence
  chemically synthesized
gagttgcaaggccttaagtcta

SEQ ID NO: 1245029 - DNA, 22 bp, Artificial Sequence
  chemically synthesized
agttgcaaggccttaagtctat

SEQ ID NO: 1245030 - DNA, 22 bp, Artificial Sequence
  chemically synthesized
caaggccttaagtctatccctc

SEQ ID NO: 1245031 - DNA, 22 bp, Artificial Sequence
  chemically synthesized
gtatgacagctgctgtgaggga

SEQ ID NO: 1245032 - DNA, 22 bp, Artificial Sequence
  chemically synthesized
ggtatgacagctgctgtgaggg

SEQ ID NO: 1245033 - DNA, 22 bp, Artificial Sequence
  chemically synthesized
aagtctatccctcacagcagct

SEQ ID NO: 1245034 - DNA, 22 bp, Artificial Sequence
  chemically synthesized
agtctatccctcacagcagctg

SEQ ID NO: 1245035 - DNA, 22 bp, Artificial Sequence
  chemically synthesized
tccctcacagcagctgtcatac

SEQ ID NO: 1245036 - DNA, 22 bp, Artificial Sequence
  chemically synthesized
aagtgaaaatttggtatgacag

SEQ ID NO: 1245037 - DNA, 22 bp, Artificial Sequence
  chemically synthesized
ttaaagtgaaaatttggtatga

SEQ ID NO: 1245038 - DNA, 22 bp, Artificial Sequence
  chemically synthesized
acagcagctgtcataccaaatt

SEQ ID NO: 1245039 - DNA, 22 bp, Artificial Sequence
  chemically synthesized
ttgttaaagtgaaaatttggta

SEQ ID NO: 1245040 - DNA, 22 bp, Artificial Sequence
  chemically synthesized
attgttgttaaagtgaaaattt

SEQ ID NO: 1245041 - DNA, 22 bp, Artificial Sequence
  chemically synthesized
cattgttgttaaagtgaaaatt

SEQ ID NO: 1245042 - DNA, 22 bp, Artificial Sequence
  chemically synthesized
tcattgttgttaaagtgaaaat

SEQ ID NO: 1245043 - DNA, 22 bp, Artificial Sequence
  chemically synthesized
tcataccaaattttcactttaa

SEQ ID NO: 1245044 - DNA, 22 bp, Artificial Sequence
  chemically synthesized
aggttttcattgttgttaaagt

SEQ ID NO: 1245045 - DNA, 22 bp, Artificial Sequence
  chemically synthesized
ttaaggttttcattgttgttaa

SEQ ID NO: 1245046 - DNA, 22 bp, Artificial Sequence
  chemically synthesized
tgttaaggttttcattgttgtt

SEQ ID NO: 1245047 - DNA, 22 bp, Artificial Sequence
  chemically synthesized
ctgttaaggttttcattgttgt

SEQ ID NO: 1245048 - DNA, 22 bp, Artificial Sequence
  chemically synthesized
tctgttaaggttttcattgttg

SEQ ID NO: 1245049 - DNA, 22 bp, Artificial Sequence
  chemically synthesized
tcactttaacaacaatgaaaac

SEQ ID NO: 1245050 - DNA, 22 bp, Artificial Sequence
  chemically synthesized
cactttaacaacaatgaaaacc

SEQ ID NO: 1245051 - DNA, 22 bp, Artificial Sequence
  chemically synthesized
actttaacaacaatgaaaacct

SEQ ID NO: 1245052 - DNA, 22 bp, Artificial Sequence
  chemically synthesized
taacaacaatgaaaaccttaac

SEQ ID NO: 1245053 - DNA, 22 bp, Artificial Sequence
  chemically synthesized
aacaacaatgaaaaccttaaca

SEQ ID NO: 1245054 - DNA, 22 bp, Artificial Sequence
  chemically synthesized
acaacaatgaaaaccttaacag

SEQ ID NO: 1245055 - DNA, 22 bp, Artificial Sequence
  chemically synthesized
tgaaagtgccaaacactttctg

SEQ ID NO: 1245056 - DNA, 22 bp, Artificial Sequence
  chemically synthesized
gtgaaagtgccaaacactttct

SEQ ID NO: 1245057 - DNA, 22 bp, Artificial Sequence
  chemically synthesized
tgtgaaagtgccaaacactttc

SEQ ID NO: 1245058 - DNA, 22 bp, Artificial Sequence
  chemically synthesized
ttgtgaaagtgccaaacacttt

SEQ ID NO: 1245059 - DNA, 22 bp, Artificial Sequence
  chemically synthesized
ttttgtgaaagtgccaaacact

SEQ ID NO: 1245060 - DNA, 22 bp, Artificial Sequence
  chemically synthesized
ttcttttgtgaaagtgccaaac

SEQ ID NO: 1245061 - DNA, 22 bp, Artificial Sequence
  chemically synthesized
aacagaaagtgtttggcacttt

SEQ ID NO: 1245062 - DNA, 22 bp, Artificial Sequence
  chemically synthesized
acagaaagtgtttggcactttc

SEQ ID NO: 1245063 - DNA, 22 bp, Artificial Sequence
  chemically synthesized
tctgttcttttgtgaaagtgcc

SEQ ID NO: 1245064 - DNA, 22 bp, Artificial Sequence
  chemically synthesized
atctgttcttttgtgaaagtgc

SEQ ID NO: 1245065 - DNA, 22 bp, Artificial Sequence
  chemically synthesized
ggcactttcacaaaagaacaga

SEQ ID NO: 1245066 - DNA, 22 bp, Artificial Sequence
  chemically synthesized
gcactttcacaaaagaacagat

SEQ ID NO: 1245067 - DNA, 22 bp, Artificial Sequence
  chemically synthesized
tcacaaaagaacagataagctt

SEQ ID NO: 1245068 - DNA, 22 bp, Artificial Sequence
  chemically synthesized
cacaaaagaacagataagcttt

SEQ ID NO: 1245069 - DNA, 22 bp, Artificial Sequence
  chemically synthesized
acaaaagaacagataagctttt

SEQ ID NO: 1245070 - DNA, 22 bp, Artificial Sequence
  chemically synthesized
agaaaaagacatgaaaagctta

SEQ ID NO: 1245071 - DNA, 22 bp, Artificial Sequence
  chemically synthesized
aagaaaaagacatgaaaagctt

SEQ ID NO: 1245072 - DNA, 22 bp, Artificial Sequence
  chemically synthesized
ttcatgtctttttcttaaatct

SEQ ID NO: 1245073 - DNA, 22 bp, Artificial Sequence
  chemically synthesized
tcatgtctttttcttaaatctg

SEQ ID NO: 1245074 - DNA, 22 bp, Artificial Sequence
  chemically synthesized
catgtctttttcttaaatctgt

SEQ ID NO: 1245075 - DNA, 22 bp, Artificial Sequence
  chemically synthesized
atgtctttttcttaaatctgtg

SEQ ID NO: 1245076 - DNA, 22 bp, Artificial Sequence
  chemically synthesized
aacaatgggtgaacacagattt

SEQ ID NO: 1245077 - DNA, 22 bp, Artificial Sequence
  chemically synthesized
ccctcaacaatgggtgaacaca

SEQ ID NO: 1245078 - DNA, 22 bp, Artificial Sequence
  chemically synthesized
tttcttaaatctgtgttcaccc

SEQ ID NO: 1245079 - DNA, 22 bp, Artificial Sequence
  chemically synthesized
ttcttaaatctgtgttcaccca

SEQ ID NO: 1245080 - DNA, 22 bp, Artificial Sequence
  chemically synthesized
taccctcaacaatgggtgaaca

SEQ ID NO: 1245081 - DNA, 22 bp, Artificial Sequence
  chemically synthesized
tcttaaatctgtgttcacccat

SEQ ID NO: 1245082 - DNA, 22 bp, Artificial Sequence
  chemically synthesized
cttaaatctgtgttcacccatt

SEQ ID NO: 1245083 - DNA, 22 bp, Artificial Sequence
  chemically synthesized
ttaaatctgtgttcacccattg

SEQ ID NO: 1245084 - DNA, 22 bp, Artificial Sequence
  chemically synthesized
aaatctgtgttcacccattgtt

SEQ ID NO: 1245085 - DNA, 22 bp, Artificial Sequence
  chemically synthesized
aatctgtgttcacccattgttg

SEQ ID NO: 1245086 - DNA, 22 bp, Artificial Sequence
  chemically synthesized
tcgcaatgttctaccctcaaca

SEQ ID NO: 1245087 - DNA, 22 bp, Artificial Sequence
  chemically synthesized
tgttcacccattgttgagggta

SEQ ID NO: 1245088 - DNA, 22 bp, Artificial Sequence
  chemically synthesized
gtcgcaatgttctaccctcaac

SEQ ID NO: 1245089 - DNA, 22 bp, Artificial Sequence
  chemically synthesized
acccattgttgagggtagaaca

SEQ ID NO: 1245090 - DNA, 22 bp, Artificial Sequence
  chemically synthesized
ttgagggtagaacattgcgaca

SEQ ID NO: 1245091 - DNA, 22 bp, Artificial Sequence
  chemically synthesized
taaaaatgaacttgtcgcaatg

SEQ ID NO: 1245092 - DNA, 22 bp, Artificial Sequence
  chemically synthesized
tgtaaaaatgaacttgtcgcaa

SEQ ID NO: 1245093 - DNA, 22 bp, Artificial Sequence
  chemically synthesized
agggtagaacattgcgacaagt

SEQ ID NO: 1245094 - DNA, 22 bp, Artificial Sequence
  chemically synthesized
tctgtaaaaatgaacttgtcgc

SEQ ID NO: 1245095 - DNA, 22 bp, Artificial Sequence
  chemically synthesized
gctctctgtaaaaatgaacttg

SEQ ID NO: 1245096 - DNA, 22 bp, Artificial Sequence
  chemically synthesized
ggctctctgtaaaaatgaactt

SEQ ID NO: 1245097 - DNA, 22 bp, Artificial Sequence
  chemically synthesized
tggctctctgtaaaaatgaact

SEQ ID NO: 1245098 - DNA, 22 bp, Artificial Sequence
  chemically synthesized
ctttggctctctgtaaaaatga

SEQ ID NO: 1245099 - DNA, 22 bp, Artificial Sequence
  chemically synthesized
actttggctctctgtaaaaatg

SEQ ID NO: 1245100 - DNA, 22 bp, Artificial Sequence
  chemically synthesized
cgacaagttcatttttacagag

SEQ ID NO: 1245101 - DNA, 22 bp, Artificial Sequence
  chemically synthesized
gggaatcttactttggctctct

SEQ ID NO: 1245102 - DNA, 22 bp, Artificial Sequence
  chemically synthesized
ggggaatcttactttggctctc

SEQ ID NO: 1245103 - DNA, 22 bp, Artificial Sequence
  chemically synthesized
atttttacagagagccaaagta

SEQ ID NO: 1245104 - DNA, 22 bp, Artificial Sequence
  chemically synthesized
cttggggaatcttactttggct

SEQ ID NO: 1245105 - DNA, 22 bp, Artificial Sequence
  chemically synthesized
ccttggggaatcttactttggc

SEQ ID NO: 1245106 - DNA, 22 bp, Artificial Sequence
  chemically synthesized
ttacagagagccaaagtaagat

SEQ ID NO: 1245107 - DNA, 22 bp, Artificial Sequence
  chemically synthesized
tacagagagccaaagtaagatt

SEQ ID NO: 1245108 - DNA, 22 bp, Artificial Sequence
  chemically synthesized
acagagagccaaagtaagattc

SEQ ID NO: 1245109 - DNA, 22 bp, Artificial Sequence
  chemically synthesized
cagagagccaaagtaagattcc

SEQ ID NO: 1245110 - DNA, 22 bp, Artificial Sequence
  chemically synthesized
tatcaatagagaatatcagaaa

SEQ ID NO: 1245111 - DNA, 22 bp, Artificial Sequence
  chemically synthesized
cccaaggaagttttctgatatt

SEQ ID NO: 1245112 - DNA, 22 bp, Artificial Sequence
  chemically synthesized
gtatcaatagagaatatcagaa

SEQ ID NO: 1245113 - DNA, 22 bp, Artificial Sequence
  chemically synthesized
tgtatcaatagagaatatcaga

SEQ ID NO: 1245114 - DNA, 22 bp, Artificial Sequence
  chemically synthesized
aatctttgtatcaatagagaat

SEQ ID NO: 1245115 - DNA, 22 bp, Artificial Sequence
  chemically synthesized
agctcaatctttgtatcaatag

SEQ ID NO: 1245116 - DNA, 22 bp, Artificial Sequence
  chemically synthesized
tctgatattctctattgataca

SEQ ID NO: 1245117 - DNA, 22 bp, Artificial Sequence
  chemically synthesized
ctgatattctctattgatacaa

SEQ ID NO: 1245118 - DNA, 22 bp, Artificial Sequence
  chemically synthesized
taagctcaatctttgtatcaat

SEQ ID NO: 1245119 - DNA, 22 bp, Artificial Sequence
  chemically synthesized
tgatattctctattgatacaaa

SEQ ID NO: 1245120 - DNA, 22 bp, Artificial Sequence
  chemically synthesized
ctaagctcaatctttgtatcaa

SEQ ID NO: 1245121 - DNA, 22 bp, Artificial Sequence
  chemically synthesized
tctaagctcaatctttgtatca

SEQ ID NO: 1245122 - DNA, 22 bp, Artificial Sequence
  chemically synthesized
atattctctattgatacaaaga

SEQ ID NO: 1245123 - DNA, 22 bp, Artificial Sequence
  chemically synthesized
cattttctaagctcaatctttg

SEQ ID NO: 1245124 - DNA, 22 bp, Artificial Sequence
  chemically synthesized
tctattgatacaaagattgagc

SEQ ID NO: 1245125 - DNA, 22 bp, Artificial Sequence
  chemically synthesized
tacattttctaagctcaatctt

SEQ ID NO: 1245126 - DNA, 22 bp, Artificial Sequence
  chemically synthesized
ctacattttctaagctcaatct

SEQ ID NO: 1245127 - DNA, 22 bp, Artificial Sequence
  chemically synthesized
tattgatacaaagattgagctt

SEQ ID NO: 1245128 - DNA, 22 bp, Artificial Sequence
  chemically synthesized
ttctacattttctaagctcaat

SEQ ID NO: 1245129 - DNA, 22 bp, Artificial Sequence
  chemically synthesized
ttgatacaaagattgagcttag

SEQ ID NO: 1245130 - DNA, 22 bp, Artificial Sequence
  chemically synthesized
atacaaagattgagcttagaaa

SEQ ID NO: 1245131 - DNA, 22 bp, Artificial Sequence
  chemically synthesized
attcttctacattttctaagct

SEQ ID NO: 1245132 - DNA, 22 bp, Artificial Sequence
  chemically synthesized
accgttcattcttctacatttt

SEQ ID NO: 1245133 - DNA, 22 bp, Artificial Sequence
  chemically synthesized
agcttagaaaatgtagaagaat

SEQ ID NO: 1245134 - DNA, 22 bp, Artificial Sequence
  chemically synthesized
atgctgaccgttcattcttcta

SEQ ID NO: 1245135 - DNA, 22 bp, Artificial Sequence
  chemically synthesized
agaaaatgtagaagaatgaacg

SEQ ID NO: 1245136 - DNA, 22 bp, Artificial Sequence
  chemically synthesized
gaaaatgtagaagaatgaacgg

SEQ ID NO: 1245137 - DNA, 22 bp, Artificial Sequence
  chemically synthesized
aaggctcatgctgaccgttcat

SEQ ID NO: 1245138 - DNA, 22 bp, Artificial Sequence
  chemically synthesized
atggtagccagagttcaaggct

SEQ ID NO: 1245139 - DNA, 22 bp, Artificial Sequence
  chemically synthesized
gcaggaaacaattgatggtagc

SEQ ID NO: 1245140 - DNA, 22 bp, Artificial Sequence
  chemically synthesized
ggcaggaaacaattgatggtag

SEQ ID NO: 1245141 - DNA, 22 bp, Artificial Sequence
  chemically synthesized
gaactctggctaccatcaattg

SEQ ID NO: 1245142 - DNA, 22 bp, Artificial Sequence
  chemically synthesized
aactctggctaccatcaattgt

SEQ ID NO: 1245143 - DNA, 22 bp, Artificial Sequence
  chemically synthesized
tggctaccatcaattgtttcct

SEQ ID NO: 1245144 - DNA, 22 bp, Artificial Sequence
  chemically synthesized
gctaccatcaattgtttcctgc

SEQ ID NO: 1245145 - DNA, 22 bp, Artificial Sequence
  chemically synthesized
ccatcaattgtttcctgccaag

SEQ ID NO: 1245146 - DNA, 22 bp, Artificial Sequence
  chemically synthesized
ggaaagaaaagagatgcatctt

SEQ ID NO: 1245147 - DNA, 22 bp, Artificial Sequence
  chemically synthesized
aggaaagaaaagagatgcatct

SEQ ID NO: 1245148 - DNA, 22 bp, Artificial Sequence
  chemically synthesized
taggaaagaaaagagatgcatc

SEQ ID NO: 1245149 - DNA, 22 bp, Artificial Sequence
  chemically synthesized
tttcctgccaagatgcatctct

SEQ ID NO: 1245150 - DNA, 22 bp, Artificial Sequence
  chemically synthesized
ttaggaaagaaaagagatgcat

SEQ ID NO: 1245151 - DNA, 22 bp, Artificial Sequence
  chemically synthesized
cctgccaagatgcatctctttt

SEQ ID NO: 1245152 - DNA, 22 bp, Artificial Sequence
  chemically synthesized
ctgccaagatgcatctcttttc

SEQ ID NO: 1245153 - DNA, 22 bp, Artificial Sequence
  chemically synthesized
ccaagatgcatctcttttcttt

SEQ ID NO: 1245154 - DNA, 22 bp, Artificial Sequence
  chemically synthesized
gcagtttttaggaaagaaaaga

SEQ ID NO: 1245155 - DNA, 22 bp, Artificial Sequence
  chemically synthesized
ttttctttcctaaaaactgcca

SEQ ID NO: 1245156 - DNA, 22 bp, Artificial Sequence
  chemically synthesized
ttctttcctaaaaactgccagt

SEQ ID NO: 1245157 - DNA, 22 bp, Artificial Sequence
  chemically synthesized
tctttcctaaaaactgccagtt

SEQ ID NO: 1245158 - DNA, 22 bp, Artificial Sequence
  chemically synthesized
ctttcctaaaaactgccagttt

SEQ ID NO: 1245159 - DNA, 22 bp, Artificial Sequence
  chemically synthesized
tttcctaaaaactgccagtttt

SEQ ID NO: 1245160 - DNA, 22 bp, Artificial Sequence
  chemically synthesized
tcctaaaaactgccagttttct

SEQ ID NO: 1245161 - DNA, 22 bp, Artificial Sequence
  chemically synthesized
cctaaaaactgccagttttctc

SEQ ID NO: 1245162 - DNA, 22 bp, Artificial Sequence
  chemically synthesized
ctaaaaactgccagttttctct

SEQ ID NO: 1245163 - DNA, 22 bp, Artificial Sequence
  chemically synthesized
aaaactgccagttttctctctc

SEQ ID NO: 1245164 - DNA, 22 bp, Artificial Sequence
  chemically synthesized
cacaaacaagccaggcgagaga

SEQ ID NO: 1245165 - DNA, 22 bp, Artificial Sequence
  chemically synthesized
gcacaaacaagccaggcgagag

SEQ ID NO: 1245166 - DNA, 22 bp, Artificial Sequence
  chemically synthesized
ccagttttctctctcgcctggc

SEQ ID NO: 1245167 - DNA, 22 bp, Artificial Sequence
  chemically synthesized
tctctctcgcctggcttgtttg

SEQ ID NO: 1245168 - DNA, 22 bp, Artificial Sequence
  chemically synthesized
ctctctcgcctggcttgtttgt

SEQ ID NO: 1245169 - DNA, 22 bp, Artificial Sequence
  chemically synthesized
tctctcgcctggcttgtttgtg

SEQ ID NO: 1245170 - DNA, 22 bp, Artificial Sequence
  chemically synthesized
tctcgcctggcttgtttgtgca

SEQ ID NO: 1245171 - DNA, 22 bp, Artificial Sequence
  chemically synthesized
tcgcctggcttgtttgtgcaag

SEQ ID NO: 1245172 - DNA, 22 bp, Artificial Sequence
  chemically synthesized
gcctggcttgtttgtgcaagga

SEQ ID NO: 1245173 - DNA, 22 bp, Artificial Sequence
  chemically synthesized
gcttgtttgtgcaaggatcttc

SEQ ID NO: 1245174 - DNA, 22 bp, Artificial Sequence
  chemically synthesized
gtttgtgcaaggatcttctttc

SEQ ID NO: 1245175 - DNA, 22 bp, Artificial Sequence
  chemically synthesized
agaagggcagaagaaagaagat

SEQ ID NO: 1245176 - DNA, 22 bp, Artificial Sequence
  chemically synthesized
tttgtgcaaggatcttctttct

SEQ ID NO: 1245177 - DNA, 22 bp, Artificial Sequence
  chemically synthesized
gtgcaaggatcttctttcttct

SEQ ID NO: 1245178 - DNA, 22 bp, Artificial Sequence
  chemically synthesized
gctgagaagggcagaagaaaga

SEQ ID NO: 1245179 - DNA, 22 bp, Artificial Sequence
  chemically synthesized
tgcaaggatcttctttcttctg

SEQ ID NO: 1245180 - DNA, 22 bp, Artificial Sequence
  chemically synthesized
tagctgagaagggcagaagaaa

SEQ ID NO: 1245181 - DNA, 22 bp, Artificial Sequence
  chemically synthesized
ctttcttctgcccttctcagct

SEQ ID NO: 1245182 - DNA, 22 bp, Artificial Sequence
  chemically synthesized
tttcttctgcccttctcagcta

SEQ ID NO: 1245183 - DNA, 22 bp, Artificial Sequence
  chemically synthesized
tcttctgcccttctcagctaga

SEQ ID NO: 1245184 - DNA, 22 bp, Artificial Sequence
  chemically synthesized
cttctgcccttctcagctagag

SEQ ID NO: 1245185 - DNA, 22 bp, Artificial Sequence
  chemically synthesized
ttctgcccttctcagctagagt

SEQ ID NO: 1245186 - DNA, 22 bp, Artificial Sequence
  chemically synthesized
ctgcccttctcagctagagtca

SEQ ID NO: 1245187 - DNA, 22 bp, Artificial Sequence
  chemically synthesized
tgcccttctcagctagagtcac

SEQ ID NO: 1245188 - DNA, 22 bp, Artificial Sequence
  chemically synthesized
cccttctcagctagagtcactg

SEQ ID NO: 1245189 - DNA, 22 bp, Artificial Sequence
  chemically synthesized
ctcagctagagtcactgacaca

SEQ ID NO: 1245190 - DNA, 22 bp, Artificial Sequence
  chemically synthesized
acaggaggagagtgtgtcagtg

SEQ ID NO: 1245191 - DNA, 22 bp, Artificial Sequence
  chemically synthesized
tcagctagagtcactgacacac

SEQ ID NO: 1245192 - DNA, 22 bp, Artificial Sequence
  chemically synthesized
agctagagtcactgacacactc

SEQ ID NO: 1245193 - DNA, 22 bp, Artificial Sequence
  chemically synthesized
gagtcactgacacactctcctc

SEQ ID NO: 1245194 - DNA, 22 bp, Artificial Sequence
  chemically synthesized
agtgatgcatatctcacaggag

SEQ ID NO: 1245195 - DNA, 22 bp, Artificial Sequence
  chemically synthesized
acacactctcctcctgtgagat

SEQ ID NO: 1245196 - DNA, 22 bp, Artificial Sequence
  chemically synthesized
tcctcctgtgagatatgcatca

SEQ ID NO: 1245197 - DNA, 22 bp, Artificial Sequence
  chemically synthesized
ccatggtattgagtgatgcata

SEQ ID NO: 1245198 - DNA, 22 bp, Artificial Sequence
  chemically synthesized
ctcctgtgagatatgcatcact

SEQ ID NO: 1245199 - DNA, 22 bp, Artificial Sequence
  chemically synthesized
ctaccatggtattgagtgatgc

SEQ ID NO: 1245200 - DNA, 22 bp, Artificial Sequence
  chemically synthesized
ctgtgagatatgcatcactcaa

SEQ ID NO: 1245201 - DNA, 22 bp, Artificial Sequence
  chemically synthesized
ctcctaccatggtattgagtga

SEQ ID NO: 1245202 - DNA, 22 bp, Artificial Sequence
  chemically synthesized
tgagatatgcatcactcaatac

SEQ ID NO: 1245203 - DNA, 22 bp, Artificial Sequence
  chemically synthesized
ctcctcctaccatggtattgag

SEQ ID NO: 1245204 - DNA, 22 bp, Artificial Sequence
  chemically synthesized
cctcctcctaccatggtattga

SEQ ID NO: 1245205 - DNA, 22 bp, Artificial Sequence
  chemically synthesized
taaatttcctcctcctaccatg

SEQ ID NO: 1245206 - DNA, 22 bp, Artificial Sequence
  chemically synthesized
ctgtaaatttcctcctcctacc

SEQ ID NO: 1245207 - DNA, 22 bp, Artificial Sequence
  chemically synthesized
aataccatggtaggaggaggaa

SEQ ID NO: 1245208 - DNA, 22 bp, Artificial Sequence
  chemically synthesized
gtccatcataactgctgtaaat

SEQ ID NO: 1245209 - DNA, 22 bp, Artificial Sequence
  chemically synthesized
tagtccatcataactgctgtaa

SEQ ID NO: 1245210 - DNA, 22 bp, Artificial Sequence
  chemically synthesized
ctagtccatcataactgctgta

SEQ ID NO: 1245211 - DNA, 22 bp, Artificial Sequence
  chemically synthesized
tggccatttctagtccatcata

SEQ ID NO: 1245212 - DNA, 22 bp, Artificial Sequence
  chemically synthesized
gtggccatttctagtccatcat

SEQ ID NO: 1245213 - DNA, 22 bp, Artificial Sequence
  chemically synthesized
tgtggccatttctagtccatca

SEQ ID NO: 1245214 - DNA, 22 bp, Artificial Sequence
  chemically synthesized
acagcagttatgatggactaga

SEQ ID NO: 1245215 - DNA, 22 bp, Artificial Sequence
  chemically synthesized
cagcagttatgatggactagaa

SEQ ID NO: 1245216 - DNA, 22 bp, Artificial Sequence
  chemically synthesized
tgatggactagaaatggccaca

SEQ ID NO: 1245217 - DNA, 22 bp, Artificial Sequence
  chemically synthesized
gaaatggccacaaaattatttg

SEQ ID NO: 1245218 - DNA, 22 bp, Artificial Sequence
  chemically synthesized
atgaaagaagtgtcaaataatt

SEQ ID NO: 1245219 - DNA, 22 bp, Artificial Sequence
  chemically synthesized
gatgaaagaagtgtcaaataat

SEQ ID NO: 1245220 - DNA, 22 bp, Artificial Sequence
  chemically synthesized
ttgatgaaagaagtgtcaaata

SEQ ID NO: 1245221 - DNA, 22 bp, Artificial Sequence
  chemically synthesized
cctcttgatgaaagaagtgtca

SEQ ID NO: 1245222 - DNA, 22 bp, Artificial Sequence
  chemically synthesized
gatgctgcctcttgatgaaaga

SEQ ID NO: 1245223 - DNA, 22 bp, Artificial Sequence
  chemically synthesized
tttgacacttctttcatcaaga

SEQ ID NO: 1245224 - DNA, 22 bp, Artificial Sequence
  chemically synthesized
gacacttctttcatcaagaggc

SEQ ID NO: 1245225 - DNA, 22 bp, Artificial Sequence
  chemically synthesized
acacttctttcatcaagaggca

SEQ ID NO: 1245226 - DNA, 22 bp, Artificial Sequence
  chemically synthesized
aggggagaattagatgctgcct

SEQ ID NO: 1245227 - DNA, 22 bp, Artificial Sequence
  chemically synthesized
ctttcatcaagaggcagcatct

SEQ ID NO: 1245228 - DNA, 22 bp, Artificial Sequence
  chemically synthesized
aaggggagaattagatgctgcc

SEQ ID NO: 1245229 - DNA, 22 bp, Artificial Sequence
  chemically synthesized
tttcatcaagaggcagcatcta

SEQ ID NO: 1245230 - DNA, 22 bp, Artificial Sequence
  chemically synthesized
taaggggagaattagatgctgc

SEQ ID NO: 1245231 - DNA, 22 bp, Artificial Sequence
  chemically synthesized
tcatcaagaggcagcatctaat

SEQ ID NO: 1245232 - DNA, 22 bp, Artificial Sequence
  chemically synthesized
catcaagaggcagcatctaatt

SEQ ID NO: 1245233 - DNA, 22 bp, Artificial Sequence
  chemically synthesized
atcaagaggcagcatctaattc

SEQ ID NO: 1245234 - DNA, 22 bp, Artificial Sequence
  chemically synthesized
agacaaatccgagctttaaggg

SEQ ID NO: 1245235 - DNA, 22 bp, Artificial Sequence
  chemically synthesized
ctaagacaaatccgagctttaa

SEQ ID NO: 1245236 - DNA, 22 bp, Artificial Sequence
  chemically synthesized
attctccccttaaagctcggat

SEQ ID NO: 1245237 - DNA, 22 bp, Artificial Sequence
  chemically synthesized
tccccttaaagctcggatttgt

SEQ ID NO: 1245238 - DNA, 22 bp, Artificial Sequence
  chemically synthesized
cccttaaagctcggatttgtct

SEQ ID NO: 1245239 - DNA, 22 bp, Artificial Sequence
  chemically synthesized
gcagacaagttgctaagacaaa

SEQ ID NO: 1245240 - DNA, 22 bp, Artificial Sequence
  chemically synthesized
ggcagacaagttgctaagacaa

SEQ ID NO: 1245241 - DNA, 22 bp, Artificial Sequence
  chemically synthesized
aaagctcggatttgtcttagca

SEQ ID NO: 1245242 - DNA, 22 bp, Artificial Sequence
  chemically synthesized
aagctcggatttgtcttagcaa

SEQ ID NO: 1245243 - DNA, 22 bp, Artificial Sequence
  chemically synthesized
cttggcagacaagttgctaaga

SEQ ID NO: 1245244 - DNA, 22 bp, Artificial Sequence
  chemically synthesized
tacttggcagacaagttgctaa

SEQ ID NO: 1245245 - DNA, 22 bp, Artificial Sequence
  chemically synthesized
ggatttgtcttagcaacttgtc

SEQ ID NO: 1245246 - DNA, 22 bp, Artificial Sequence
  chemically synthesized
cattctacttggcagacaagtt

SEQ ID NO: 1245247 - DNA, 22 bp, Artificial Sequence
  chemically synthesized
gtcttagcaacttgtctgccaa

SEQ ID NO: 1245248 - DNA, 22 bp, Artificial Sequence
  chemically synthesized
gttgcattctacttggcagaca

SEQ ID NO: 1245249 - DNA, 22 bp, Artificial Sequence
  chemically synthesized
tcttagcaacttgtctgccaag

SEQ ID NO: 1245250 - DNA, 22 bp, Artificial Sequence
  chemically synthesized
agcaacttgtctgccaagtaga

SEQ ID NO: 1245251 - DNA, 22 bp, Artificial Sequence
  chemically synthesized
gcaacttgtctgccaagtagaa

SEQ ID NO: 1245252 - DNA, 22 bp, Artificial Sequence
  chemically synthesized
gtctgccaagtagaatgcaacg

SEQ ID NO: 1245253 - DNA, 22 bp, Artificial Sequence
  chemically synthesized
taacatcatattcgttgcattc

SEQ ID NO: 1245254 - DNA, 22 bp, Artificial Sequence
  chemically synthesized
tctgccaagtagaatgcaacga

SEQ ID NO: 1245255 - DNA, 22 bp, Artificial Sequence
  chemically synthesized
ccaagtagaatgcaacgaatat

SEQ ID NO: 1245256 - DNA, 22 bp, Artificial Sequence
  chemically synthesized
gaagacctataacatcatattc

SEQ ID NO: 1245257 - DNA, 22 bp, Artificial Sequence
  chemically synthesized
ggaagacctataacatcatatt

SEQ ID NO: 1245258 - DNA, 22 bp, Artificial Sequence
  chemically synthesized
atcttggaagacctataacatc

SEQ ID NO: 1245259 - DNA, 22 bp, Artificial Sequence
  chemically synthesized
ataatgatctaatcttggaaga

SEQ ID NO: 1245260 - DNA, 22 bp, Artificial Sequence
  chemically synthesized
ctaataatgatctaatcttgga

SEQ ID NO: 1245261 - DNA, 22 bp, Artificial Sequence
  chemically synthesized
taggtcttccaagattagatca

SEQ ID NO: 1245262 - DNA, 22 bp, Artificial Sequence
  chemically synthesized
aaagttactaataatgatctaa

SEQ ID NO: 1245263 - DNA, 22 bp, Artificial Sequence
  chemically synthesized
ccaagattagatcattattagt

SEQ ID NO: 1245264 - DNA, 22 bp, Artificial Sequence
  chemically synthesized
caagattagatcattattagta

SEQ ID NO: 1245265 - DNA, 22 bp, Artificial Sequence
  chemically synthesized
gatcattattagtaacttttag

SEQ ID NO: 1245266 - DNA, 22 bp, Artificial Sequence
  chemically synthesized
agaaacccataaagaggctaaa

SEQ ID NO: 1245267 - DNA, 22 bp, Artificial Sequence
  chemically synthesized
taagaaacccataaagaggcta

SEQ ID NO: 1245268 - DNA, 22 bp, Artificial Sequence
  chemically synthesized
ttagtaacttttagcctcttta

SEQ ID NO: 1245269 - DNA, 22 bp, Artificial Sequence
  chemically synthesized
gtaacttttagcctctttatgg

SEQ ID NO: 1245270 - DNA, 22 bp, Artificial Sequence
  chemically synthesized
ttagcctctttatgggtttctt

SEQ ID NO: 1245271 - DNA, 22 bp, Artificial Sequence
  chemically synthesized
tagcctctttatgggtttctta

SEQ ID NO: 1245272 - DNA, 22 bp, Artificial Sequence
  chemically synthesized
agcctctttatgggtttcttag

SEQ ID NO: 1245273 - DNA, 22 bp, Artificial Sequence
  chemically synthesized
gcctctttatgggtttcttaga

SEQ ID NO: 1245274 - DNA, 22 bp, Artificial Sequence
  chemically synthesized
ccagagtgagtattctaagaaa

SEQ ID NO: 1245275 - DNA, 22 bp, Artificial Sequence
  chemically synthesized
tttatgggtttcttagaatact

SEQ ID NO: 1245276 - DNA, 22 bp, Artificial Sequence
  chemically synthesized
tatgggtttcttagaatactca

SEQ ID NO: 1245277 - DNA, 22 bp, Artificial Sequence
  chemically synthesized
gggctcccagagtgagtattct

SEQ ID NO: 1245278 - DNA, 22 bp, Artificial Sequence
  chemically synthesized
atgggtttcttagaatactcac

SEQ ID NO: 1245279 - DNA, 22 bp, Artificial Sequence
  chemically synthesized
agggctcccagagtgagtattc

SEQ ID NO: 1245280 - DNA, 22 bp, Artificial Sequence
  chemically synthesized
tgggtttcttagaatactcact

SEQ ID NO: 1245281 - DNA, 22 bp, Artificial Sequence
  chemically synthesized
cttagaatactcactctgggag

SEQ ID NO: 1245282 - DNA, 22 bp, Artificial Sequence
  chemically synthesized
ttagaatactcactctgggagc

SEQ ID NO: 1245283 - DNA, 22 bp, Artificial Sequence
  chemically synthesized
agaatactcactctgggagccc

SEQ ID NO: 1245284 - DNA, 22 bp, Artificial Sequence
  chemically synthesized
gaatactcactctgggagccct

SEQ ID NO: 1245285 - DNA, 22 bp, Artificial Sequence
  chemically synthesized
tgcatggcatcttagggctccc

SEQ ID NO: 1245286 - DNA, 22 bp, Artificial Sequence
  chemically synthesized
atgcatggcatcttagggctcc

SEQ ID NO: 1245287 - DNA, 22 bp, Artificial Sequence
  chemically synthesized
tatgcatggcatcttagggctc

SEQ ID NO: 1245288 - DNA, 22 bp, Artificial Sequence
  chemically synthesized
ttatgcatggcatcttagggct

SEQ ID NO: 1245289 - DNA, 22 bp, Artificial Sequence
  chemically synthesized
actctgggagccctaagatgcc

SEQ ID NO: 1245290 - DNA, 22 bp, Artificial Sequence
  chemically synthesized
tgggagccctaagatgccatgc

SEQ ID NO: 1245291 - DNA, 22 bp, Artificial Sequence
  chemically synthesized
ggagccctaagatgccatgcat

SEQ ID NO: 1245292 - DNA, 22 bp, Artificial Sequence
  chemically synthesized
agggtagtcagtttttatgcat

SEQ ID NO: 1245293 - DNA, 22 bp, Artificial Sequence
  chemically synthesized
cagggtagtcagtttttatgca

SEQ ID NO: 1245294 - DNA, 22 bp, Artificial Sequence
  chemically synthesized
agatgccatgcataaaaactga

SEQ ID NO: 1245295 - DNA, 22 bp, Artificial Sequence
  chemically synthesized
cagcatggtggtttcagggtag

SEQ ID NO: 1245296 - DNA, 22 bp, Artificial Sequence
  chemically synthesized
tacagcatggtggtttcagggt

SEQ ID NO: 1245297 - DNA, 22 bp, Artificial Sequence
  chemically synthesized
ctacagcatggtggtttcaggg

SEQ ID NO: 1245298 - DNA, 22 bp, Artificial Sequence
  chemically synthesized
actaccctgaaaccaccatgct

SEQ ID NO: 1245299 - DNA, 22 bp, Artificial Sequence
  chemically synthesized
tagatgtcttctacagcatggt

SEQ ID NO: 1245300 - DNA, 22 bp, Artificial Sequence
  chemically synthesized
gtagatgtcttctacagcatgg

SEQ ID NO: 1245301 - DNA, 22 bp, Artificial Sequence
  chemically synthesized
ccctgaaaccaccatgctgtag

SEQ ID NO: 1245302 - DNA, 22 bp, Artificial Sequence
  chemically synthesized
aaaccaccatgctgtagaagac

SEQ ID NO: 1245303 - DNA, 22 bp, Artificial Sequence
  chemically synthesized
tcaaccagaggacttgtagatg

SEQ ID NO: 1245304 - DNA, 22 bp, Artificial Sequence
  chemically synthesized
tagaagacatctacaagtcctc

SEQ ID NO: 1245305 - DNA, 22 bp, Artificial Sequence
  chemically synthesized
agcagggactgtcaaccagagg

SEQ ID NO: 1245306 - DNA, 22 bp, Artificial Sequence
  chemically synthesized
agttcagcagggactgtcaacc

SEQ ID NO: 1245307 - DNA, 22 bp, Artificial Sequence
  chemically synthesized
caagtcctctggttgacagtcc

SEQ ID NO: 1245308 - DNA, 22 bp, Artificial Sequence
  chemically synthesized
aaaggctcagttcagcagggac

SEQ ID NO: 1245309 - DNA, 22 bp, Artificial Sequence
  chemically synthesized
tggttgacagtccctgctgaac

SEQ ID NO: 1245310 - DNA, 22 bp, Artificial Sequence
  chemically synthesized
gttgacagtccctgctgaactg

SEQ ID NO: 1245311 - DNA, 22 bp, Artificial Sequence
  chemically synthesized
acagtccctgctgaactgagcc

SEQ ID NO: 1245312 - DNA, 22 bp, Artificial Sequence
  chemically synthesized
tgagaatggctgaaaggctcag

SEQ ID NO: 1245313 - DNA, 22 bp, Artificial Sequence
  chemically synthesized
ctgaactgagcctttcagccat

SEQ ID NO: 1245314 - DNA, 22 bp, Artificial Sequence
  chemically synthesized
atgccattgtgagaatggctga

SEQ ID NO: 1245315 - DNA, 22 bp, Artificial Sequence
  chemically synthesized
aactgagcctttcagccattct

SEQ ID NO: 1245316 - DNA, 22 bp, Artificial Sequence
  chemically synthesized
aatgccattgtgagaatggctg

SEQ ID NO: 1245317 - DNA, 22 bp, Artificial Sequence
  chemically synthesized
agcctttcagccattctcacaa

SEQ ID NO: 1245318 - DNA, 22 bp, Artificial Sequence
  chemically synthesized
atgcttaatgccattgtgagaa

SEQ ID NO: 1245319 - DNA, 22 bp, Artificial Sequence
  chemically synthesized
aatgcttaatgccattgtgaga

SEQ ID NO: 1245320 - DNA, 22 bp, Artificial Sequence
  chemically synthesized
tcagccattctcacaatggcat

SEQ ID NO: 1245321 - DNA, 22 bp, Artificial Sequence
  chemically synthesized
acttaatgcttaatgccattgt

SEQ ID NO: 1245322 - DNA, 22 bp, Artificial Sequence
  chemically synthesized
cagccattctcacaatggcatt

SEQ ID NO: 1245323 - DNA, 22 bp, Artificial Sequence
  chemically synthesized
agccattctcacaatggcatta

SEQ ID NO: 1245324 - DNA, 22 bp, Artificial Sequence
  chemically synthesized
tcacaatggcattaagcattaa

SEQ ID NO: 1245325 - DNA, 22 bp, Artificial Sequence
  chemically synthesized
aagacagattcacttaatgctt

SEQ ID NO: 1245326 - DNA, 22 bp, Artificial Sequence
  chemically synthesized
acaatggcattaagcattaagt

SEQ ID NO: 1245327 - DNA, 22 bp, Artificial Sequence
  chemically synthesized
gagggttcaagacagattcact

SEQ ID NO: 1245328 - DNA, 22 bp, Artificial Sequence
  chemically synthesized
agcattaagtgaatctgtcttg

SEQ ID NO: 1245329 - DNA, 22 bp, Artificial Sequence
  chemically synthesized
gtctggagggttcaagacagat

SEQ ID NO: 1245330 - DNA, 22 bp, Artificial Sequence
  chemically synthesized
agtgaatctgtcttgaaccctc

SEQ ID NO: 1245331 - DNA, 22 bp, Artificial Sequence
  chemically synthesized
gtggatgtgctggtctggaggg

SEQ ID NO: 1245332 - DNA, 22 bp, Artificial Sequence
  chemically synthesized
tcttgaaccctccagaccagca

SEQ ID NO: 1245333 - DNA, 22 bp, Artificial Sequence
  chemically synthesized
agctagtggatgtgctggtctg

SEQ ID NO: 1245334 - DNA, 22 bp, Artificial Sequence
  chemically synthesized
gaaccctccagaccagcacatc

SEQ ID NO: 1245335 - DNA, 22 bp, Artificial Sequence
  chemically synthesized
aaccctccagaccagcacatcc

SEQ ID NO: 1245336 - DNA, 22 bp, Artificial Sequence
  chemically synthesized
gcagaattcagctagtggatgt

SEQ ID NO: 1245337 - DNA, 22 bp, Artificial Sequence
  chemically synthesized
ggcagaattcagctagtggatg

SEQ ID NO: 1245338 - DNA, 22 bp, Artificial Sequence
  chemically synthesized
cagaccagcacatccactagct

SEQ ID NO: 1245339 - DNA, 22 bp, Artificial Sequence
  chemically synthesized
acatcacttggcagaattcagc

SEQ ID NO: 1245340 - DNA, 22 bp, Artificial Sequence
  chemically synthesized
gctgaattctgccaagtgatgt

SEQ ID NO: 1245341 - DNA, 22 bp, Artificial Sequence
  chemically synthesized
tgtggtgtcagttgacatcact

SEQ ID NO: 1245342 - DNA, 22 bp, Artificial Sequence
  chemically synthesized
aattctgccaagtgatgtcaac

SEQ ID NO: 1245343 - DNA, 22 bp, Artificial Sequence
  chemically synthesized
tgtgtggtgtcagttgacatca

SEQ ID NO: 1245344 - DNA, 22 bp, Artificial Sequence
  chemically synthesized
ctctgtgtggtgtcagttgaca

SEQ ID NO: 1245345 - DNA, 22 bp, Artificial Sequence
  chemically synthesized
tgccaagtgatgtcaactgaca

SEQ ID NO: 1245346 - DNA, 22 bp, Artificial Sequence
  chemically synthesized
tactctgtgtggtgtcagttga

SEQ ID NO: 1245347 - DNA, 22 bp, Artificial Sequence
  chemically synthesized
ctactctgtgtggtgtcagttg

SEQ ID NO: 1245348 - DNA, 22 bp, Artificial Sequence
  chemically synthesized
ccaagtgatgtcaactgacacc

SEQ ID NO: 1245349 - DNA, 22 bp, Artificial Sequence
  chemically synthesized
tctactctgtgtggtgtcagtt

SEQ ID NO: 1245350 - DNA, 22 bp, Artificial Sequence
  chemically synthesized
ttctactctgtgtggtgtcagt

SEQ ID NO: 1245351 - DNA, 22 bp, Artificial Sequence
  chemically synthesized
atttttctactctgtgtggtgt

SEQ ID NO: 1245352 - DNA, 22 bp, Artificial Sequence
  chemically synthesized
ttgatttttctactctgtgtgg

SEQ ID NO: 1245353 - DNA, 22 bp, Artificial Sequence
  chemically synthesized
attgatttttctactctgtgtg

SEQ ID NO: 1245354 - DNA, 22 bp, Artificial Sequence
  chemically synthesized
agcttattgatttttctactct

SEQ ID NO: 1245355 - DNA, 22 bp, Artificial Sequence
  chemically synthesized
acaccacacagagtagaaaaat

SEQ ID NO: 1245356 - DNA, 22 bp, Artificial Sequence
  chemically synthesized
agccgtgttcagcttattgatt

SEQ ID NO: 1245357 - DNA, 22 bp, Artificial Sequence
  chemically synthesized
tgaatcaggaattcagccgtgt

SEQ ID NO: 1245358 - DNA, 22 bp, Artificial Sequence
  chemically synthesized
gtgaatcaggaattcagccgtg

SEQ ID NO: 1245359 - DNA, 22 bp, Artificial Sequence
  chemically synthesized
tgtgaatcaggaattcagccgt

SEQ ID NO: 1245360 - DNA, 22 bp, Artificial Sequence
  chemically synthesized
attttgtgaatcaggaattcag

SEQ ID NO: 1245361 - DNA, 22 bp, Artificial Sequence
  chemically synthesized
tctgattttgtgaatcaggaat

SEQ ID NO: 1245362 - DNA, 22 bp, Artificial Sequence
  chemically synthesized
aacacggctgaattcctgattc

SEQ ID NO: 1245363 - DNA, 22 bp, Artificial Sequence
  chemically synthesized
atctgattttgtgaatcaggaa

SEQ ID NO: 1245364 - DNA, 22 bp, Artificial Sequence
  chemically synthesized
tatctgattttgtgaatcagga

SEQ ID NO: 1245365 - DNA, 22 bp, Artificial Sequence
  chemically synthesized
ttatctgattttgtgaatcagg

SEQ ID NO: 1245366 - DNA, 22 bp, Artificial Sequence
  chemically synthesized
tttatctgattttgtgaatcag

SEQ ID NO: 1245367 - DNA, 22 bp, Artificial Sequence
  chemically synthesized
tctttttatctgattttgtgaa

SEQ ID NO: 1245368 - DNA, 22 bp, Artificial Sequence
  chemically synthesized
atctttttatctgattttgtga

SEQ ID NO: 1245369 - DNA, 22 bp, Artificial Sequence
  chemically synthesized
tatctttttatctgattttgtg

SEQ ID NO: 1245370 - DNA, 22 bp, Artificial Sequence
  chemically synthesized
aattcctgattcacaaaatcag

SEQ ID NO: 1245371 - DNA, 22 bp, Artificial Sequence
  chemically synthesized
ttatctttttatctgattttgt

SEQ ID NO: 1245372 - DNA, 22 bp, Artificial Sequence
  chemically synthesized
ttttatctttttatctgatttt

SEQ ID NO: 1245373 - DNA, 22 bp, Artificial Sequence
  chemically synthesized
ctgattcacaaaatcagataaa

SEQ ID NO: 1245374 - DNA, 22 bp, Artificial Sequence
  chemically synthesized
attcacaaaatcagataaaaag

SEQ ID NO: 1245375 - DNA, 22 bp, Artificial Sequence
  chemically synthesized
acaaaatcagataaaaagataa

SEQ ID NO: 1245376 - DNA, 22 bp, Artificial Sequence
  chemically synthesized
aaataacatctcttttatcttt

SEQ ID NO: 1245377 - DNA, 22 bp, Artificial Sequence
  chemically synthesized
aaaataacatctcttttatctt

SEQ ID NO: 1245378 - DNA, 22 bp, Artificial Sequence
  chemically synthesized
ttttaagccactgtacttgggg

SEQ ID NO: 1245379 - DNA, 22 bp, Artificial Sequence
  chemically synthesized
tgtaacaaaacaccccaagtac

SEQ ID NO: 1245380 - DNA, 22 bp, Artificial Sequence
  chemically synthesized
taagccactgtacttggggtgt

SEQ ID NO: 1245381 - DNA, 22 bp, Artificial Sequence
  chemically synthesized
ctatgtaacaaaacaccccaag

SEQ ID NO: 1245382 - DNA, 22 bp, Artificial Sequence
  chemically synthesized
aagccactgtacttggggtgtt

SEQ ID NO: 1245383 - DNA, 22 bp, Artificial Sequence
  chemically synthesized
agccactgtacttggggtgttt

SEQ ID NO: 1245384 - DNA, 22 bp, Artificial Sequence
  chemically synthesized
ttactatgtaacaaaacacccc

SEQ ID NO: 1245385 - DNA, 22 bp, Artificial Sequence
  chemically synthesized
tattactatgtaacaaaacacc

SEQ ID NO: 1245386 - DNA, 22 bp, Artificial Sequence
  chemically synthesized
ctattactatgtaacaaaacac

SEQ ID NO: 1245387 - DNA, 22 bp, Artificial Sequence
  chemically synthesized
tctattactatgtaacaaaaca

SEQ ID NO: 1245388 - DNA, 22 bp, Artificial Sequence
  chemically synthesized
tacttggggtgttttgttacat

SEQ ID NO: 1245389 - DNA, 22 bp, Artificial Sequence
  chemically synthesized
gttttctattactatgtaacaa

SEQ ID NO: 1245390 - DNA, 22 bp, Artificial Sequence
  chemically synthesized
tggttttctattactatgtaac

SEQ ID NO: 1245391 - DNA, 22 bp, Artificial Sequence
  chemically synthesized
ctggttttctattactatgtaa

SEQ ID NO: 1245392 - DNA, 22 bp, Artificial Sequence
  chemically synthesized
ggggtgttttgttacatagtaa

SEQ ID NO: 1245393 - DNA, 22 bp, Artificial Sequence
  chemically synthesized
gggtgttttgttacatagtaat

SEQ ID NO: 1245394 - DNA, 22 bp, Artificial Sequence
  chemically synthesized
ttctggttttctattactatgt

SEQ ID NO: 1245395 - DNA, 22 bp, Artificial Sequence
  chemically synthesized
tgttacatagtaatagaaaacc

SEQ ID NO: 1245396 - DNA, 22 bp, Artificial Sequence
  chemically synthesized
ggatactcttctggttttctat

SEQ ID NO: 1245397 - DNA, 22 bp, Artificial Sequence
  chemically synthesized
gttacatagtaatagaaaacca

SEQ ID NO: 1245398 - DNA, 22 bp, Artificial Sequence
  chemically synthesized
aggatactcttctggttttcta

SEQ ID NO: 1245399 - DNA, 22 bp, Artificial Sequence
  chemically synthesized
ttacatagtaatagaaaaccag

SEQ ID NO: 1245400 - DNA, 22 bp, Artificial Sequence
  chemically synthesized
catagtaatagaaaaccagaag

SEQ ID NO: 1245401 - DNA, 22 bp, Artificial Sequence
  chemically synthesized
cagagggagcttaggatactct

SEQ ID NO: 1245402 - DNA, 22 bp, Artificial Sequence
  chemically synthesized
cattccagagggagcttaggat

SEQ ID NO: 1245403 - DNA, 22 bp, Artificial Sequence
  chemically synthesized
aaggcagagcctccattccaga

SEQ ID NO: 1245404 - DNA, 22 bp, Artificial Sequence
  chemically synthesized
agctccctctggaatggaggct

SEQ ID NO: 1245405 - DNA, 22 bp, Artificial Sequence
  chemically synthesized
tgattcaaggcagagcctccat

SEQ ID NO: 1245406 - DNA, 22 bp, Artificial Sequence
  chemically synthesized
cctctggaatggaggctctgcc

SEQ ID NO: 1245407 - DNA, 22 bp, Artificial Sequence
  chemically synthesized
tggaatggaggctctgccttga

SEQ ID NO: 1245408 - DNA, 22 bp, Artificial Sequence
  chemically synthesized
gaatggaggctctgccttgaat

SEQ ID NO: 1245409 - DNA, 22 bp, Artificial Sequence
  chemically synthesized
gatcgagagggctgtgattcaa

SEQ ID NO: 1245410 - DNA, 22 bp, Artificial Sequence
  chemically synthesized
tgccttgaatcacagccctctc

SEQ ID NO: 1245411 - DNA, 22 bp, Artificial Sequence
  chemically synthesized
ccttgaatcacagccctctcga

SEQ ID NO: 1245412 - DNA, 22 bp, Artificial Sequence
  chemically synthesized
gaatcacagccctctcgatcga

SEQ ID NO: 1245413 - DNA, 22 bp, Artificial Sequence
  chemically synthesized
aatcacagccctctcgatcgag

SEQ ID NO: 1245414 - DNA, 22 bp, Artificial Sequence
  chemically synthesized
tcgatcgagaccttgatacatg

SEQ ID NO: 1245415 - DNA, 22 bp, Artificial Sequence
  chemically synthesized
gatcgagaccttgatacatgtc

SEQ ID NO: 1245416 - DNA, 22 bp, Artificial Sequence
  chemically synthesized
aagagtcgatgaagagggacat

SEQ ID NO: 1245417 - DNA, 22 bp, Artificial Sequence
  chemically synthesized
gatacatgtccctcttcatcga

SEQ ID NO: 1245418 - DNA, 22 bp, Artificial Sequence
  chemically synthesized
atacatgtccctcttcatcgac

SEQ ID NO: 1245419 - DNA, 22 bp, Artificial Sequence
  chemically synthesized
ttcatcgactcttgaactcttt

SEQ ID NO: 1245420 - DNA, 22 bp, Artificial Sequence
  chemically synthesized
catcgactcttgaactctttct

SEQ ID NO: 1245421 - DNA, 22 bp, Artificial Sequence
  chemically synthesized
atcgactcttgaactctttctg

SEQ ID NO: 1245422 - DNA, 22 bp, Artificial Sequence
  chemically synthesized
ttgaactctttctggttccctg

SEQ ID NO: 1245423 - DNA, 22 bp, Artificial Sequence
  chemically synthesized
gaactctttctggttccctgat

SEQ ID NO: 1245424 - DNA, 22 bp, Artificial Sequence
  chemically synthesized
aactctttctggttccctgatt

SEQ ID NO: 1245425 - DNA, 22 bp, Artificial Sequence
  chemically synthesized
tttctggttccctgatttacta

SEQ ID NO: 1245426 - DNA, 22 bp, Artificial Sequence
  chemically synthesized
tctggttccctgatttactatt

SEQ ID NO: 1245427 - DNA, 22 bp, Artificial Sequence
  chemically synthesized
ctggttccctgatttactattg

SEQ ID NO: 1245428 - DNA, 22 bp, Artificial Sequence
  chemically synthesized
tggttccctgatttactattgc

SEQ ID NO: 1245429 - DNA, 22 bp, Artificial Sequence
  chemically synthesized
aatagaaacataggcaatagta

SEQ ID NO: 1245430 - DNA, 22 bp, Artificial Sequence
  chemically synthesized
gttccctgatttactattgcct

SEQ ID NO: 1245431 - DNA, 22 bp, Artificial Sequence
  chemically synthesized
ttaaatagaaacataggcaata

SEQ ID NO: 1245432 - DNA, 22 bp, Artificial Sequence
  chemically synthesized
cctgatttactattgcctatgt

SEQ ID NO: 1245433 - DNA, 22 bp, Artificial Sequence
  chemically synthesized
atttactattgcctatgtttct

SEQ ID NO: 1245434 - DNA, 22 bp, Artificial Sequence
  chemically synthesized
actattgcctatgtttctattt

SEQ ID NO: 1245435 - DNA, 22 bp, Artificial Sequence
  chemically synthesized
ctattgcctatgtttctattta

SEQ ID NO: 1245436 - DNA, 22 bp, Artificial Sequence
  chemically synthesized
ttgcctatgtttctatttaaca

SEQ ID NO: 1245437 - DNA, 22 bp, Artificial Sequence
  chemically synthesized
cctatgtttctatttaacagat

SEQ ID NO: 1245438 - DNA, 22 bp, Artificial Sequence
  chemically synthesized
ggagacagggtgtaatctgtta

SEQ ID NO: 1245439 - DNA, 22 bp, Artificial Sequence
  chemically synthesized
tgtttctatttaacagattaca

SEQ ID NO: 1245440 - DNA, 22 bp, Artificial Sequence
  chemically synthesized
ctatttaacagattacaccctg

SEQ ID NO: 1245441 - DNA, 22 bp, Artificial Sequence
  chemically synthesized
agtgctgggagacagggtgtaa

SEQ ID NO: 1245442 - DNA, 22 bp, Artificial Sequence
  chemically synthesized
tatttaacagattacaccctgt

SEQ ID NO: 1245443 - DNA, 22 bp, Artificial Sequence
  chemically synthesized
tttaacagattacaccctgtct

SEQ ID NO: 1245444 - DNA, 22 bp, Artificial Sequence
  chemically synthesized
aacagattacaccctgtctccc

SEQ ID NO: 1245445 - DNA, 22 bp, Artificial Sequence
  chemically synthesized
acagattacaccctgtctccca

SEQ ID NO: 1245446 - DNA, 22 bp, Artificial Sequence
  chemically synthesized
agaagagactgagtgctgggag

SEQ ID NO: 1245447 - DNA, 22 bp, Artificial Sequence
  chemically synthesized
caccctgtctcccagcactcag

SEQ ID NO: 1245448 - DNA, 22 bp, Artificial Sequence
  chemically synthesized
tctcccagcactcagtctcttc

SEQ ID NO: 1245449 - DNA, 22 bp, Artificial Sequence
  chemically synthesized
aggtgtaactaagaagagactg

SEQ ID NO: 1245450 - DNA, 22 bp, Artificial Sequence
  chemically synthesized
ccagcactcagtctcttcttag

SEQ ID NO: 1245451 - DNA, 22 bp, Artificial Sequence
  chemically synthesized
gggaaattcaggtgtaactaag

SEQ ID NO: 1245452 - DNA, 22 bp, Artificial Sequence
  chemically synthesized
agtctcttcttagttacacctg

SEQ ID NO: 1245453 - DNA, 22 bp, Artificial Sequence
  chemically synthesized
ttcttagttacacctgaatttc

SEQ ID NO: 1245454 - DNA, 22 bp, Artificial Sequence
  chemically synthesized
cttagttacacctgaatttccc

SEQ ID NO: 1245455 - DNA, 22 bp, Artificial Sequence
  chemically synthesized
ttagttacacctgaatttcccc

SEQ ID NO: 1245456 - DNA, 22 bp, Artificial Sequence
  chemically synthesized
agttacacctgaatttccccag

SEQ ID NO: 1245457 - DNA, 22 bp, Artificial Sequence
  chemically synthesized
gttacacctgaatttccccagt

SEQ ID NO: 1245458 - DNA, 22 bp, Artificial Sequence
  chemically synthesized
ggcaggacaggcactggggaaa

SEQ ID NO: 1245459 - DNA, 22 bp, Artificial Sequence
  chemically synthesized
cacctgaatttccccagtgcct

SEQ ID NO: 1245460 - DNA, 22 bp, Artificial Sequence
  chemically synthesized
aatttccccagtgcctgtcctg

SEQ ID NO: 1245461 - DNA, 22 bp, Artificial Sequence
  chemically synthesized
ccccagtgcctgtcctgcctag

SEQ ID NO: 1245462 - DNA, 22 bp, Artificial Sequence
  chemically synthesized
cccagtgcctgtcctgcctagt

SEQ ID NO: 1245463 - DNA, 22 bp, Artificial Sequence
  chemically synthesized
gaggaaaaggagaaaatacaga

SEQ ID NO: 1245464 - DNA, 22 bp, Artificial Sequence
  chemically synthesized
tcctgcctagtctgtattttct

SEQ ID NO: 1245465 - DNA, 22 bp, Artificial Sequence
  chemically synthesized
cctagtctgtattttctccttt

SEQ ID NO: 1245466 - DNA, 22 bp, Artificial Sequence
  chemically synthesized
gtctgtattttctccttttcct

SEQ ID NO: 1245467 - DNA, 22 bp, Artificial Sequence
  chemically synthesized
tagcagtgtaggctggaggaaa

SEQ ID NO: 1245468 - DNA, 22 bp, Artificial Sequence
  chemically synthesized
tattttctccttttcctccagc

SEQ ID NO: 1245469 - DNA, 22 bp, Artificial Sequence
  chemically synthesized
tctccttttcctccagcctaca

SEQ ID NO: 1245470 - DNA, 22 bp, Artificial Sequence
  chemically synthesized
aggttatagcagtgtaggctgg

SEQ ID NO: 1245471 - DNA, 22 bp, Artificial Sequence
  chemically synthesized
ctccttttcctccagcctacac

SEQ ID NO: 1245472 - DNA, 22 bp, Artificial Sequence
  chemically synthesized
tccttttcctccagcctacact

SEQ ID NO: 1245473 - DNA, 22 bp, Artificial Sequence
  chemically synthesized
cttttcctccagcctacactgc

SEQ ID NO: 1245474 - DNA, 22 bp, Artificial Sequence
  chemically synthesized
ttcctccagcctacactgctat

SEQ ID NO: 1245475 - DNA, 22 bp, Artificial Sequence
  chemically synthesized
tcctccagcctacactgctata

SEQ ID NO: 1245476 - DNA, 22 bp, Artificial Sequence
  chemically synthesized
cctccagcctacactgctataa

SEQ ID NO: 1245477 - DNA, 22 bp, Artificial Sequence
  chemically synthesized
ctccagcctacactgctataac

SEQ ID NO: 1245478 - DNA, 22 bp, Artificial Sequence
  chemically synthesized
aaagtatcctaaggttatagca

SEQ ID NO: 1245479 - DNA, 22 bp, Artificial Sequence
  chemically synthesized
cagcctacactgctataacctt

SEQ ID NO: 1245480 - DNA, 22 bp, Artificial Sequence
  chemically synthesized
cactgctataaccttaggatac

SEQ ID NO: 1245481 - DNA, 22 bp, Artificial Sequence
  chemically synthesized
acagcaggttgaaagtatccta

SEQ ID NO: 1245482 - DNA, 22 bp, Artificial Sequence
  chemically synthesized
tcacagcaggttgaaagtatcc

SEQ ID NO: 1245483 - DNA, 22 bp, Artificial Sequence
  chemically synthesized
ctataaccttaggatactttca

SEQ ID NO: 1245484 - DNA, 22 bp, Artificial Sequence
  chemically synthesized
ctcacagcaggttgaaagtatc

SEQ ID NO: 1245485 - DNA, 22 bp, Artificial Sequence
  chemically synthesized
taaccttaggatactttcaacc

SEQ ID NO: 1245486 - DNA, 22 bp, Artificial Sequence
  chemically synthesized
aggatactttcaacctgctgtg

SEQ ID NO: 1245487 - DNA, 22 bp, Artificial Sequence
  chemically synthesized
catagagtttctcacagcaggt

SEQ ID NO: 1245488 - DNA, 22 bp, Artificial Sequence
  chemically synthesized
ggatactttcaacctgctgtga

SEQ ID NO: 1245489 - DNA, 22 bp, Artificial Sequence
  chemically synthesized
gcatagagtttctcacagcagg

SEQ ID NO: 1245490 - DNA, 22 bp, Artificial Sequence
  chemically synthesized
tgcatagagtttctcacagcag

SEQ ID NO: 1245491 - DNA, 22 bp, Artificial Sequence
  chemically synthesized
tcaacctgctgtgagaaactct

SEQ ID NO: 1245492 - DNA, 22 bp, Artificial Sequence
  chemically synthesized
caacctgctgtgagaaactcta

SEQ ID NO: 1245493 - DNA, 22 bp, Artificial Sequence
  chemically synthesized
aacctgctgtgagaaactctat

SEQ ID NO: 1245494 - DNA, 22 bp, Artificial Sequence
  chemically synthesized
tcatggaaacactttgcataga

SEQ ID NO: 1245495 - DNA, 22 bp, Artificial Sequence
  chemically synthesized
ctgtgagaaactctatgcaaag

SEQ ID NO: 1245496 - DNA, 22 bp, Artificial Sequence
  chemically synthesized
tgagaaactctatgcaaagtgt

SEQ ID NO: 1245497 - DNA, 22 bp, Artificial Sequence
  chemically synthesized
tatgcaaagtgtttccatgata

SEQ ID NO: 1245498 - DNA, 22 bp, Artificial Sequence
  chemically synthesized
tgcaaagtgtttccatgataat

SEQ ID NO: 1245499 - DNA, 22 bp, Artificial Sequence
  chemically synthesized
cagaagggaaaagagcagaaaa

SEQ ID NO: 1245500 - DNA, 22 bp, Artificial Sequence
  chemically synthesized
ccatgataattttctgctcttt

SEQ ID NO: 1245501 - DNA, 22 bp, Artificial Sequence
  chemically synthesized
catgataattttctgctctttt

SEQ ID NO: 1245502 - DNA, 22 bp, Artificial Sequence
  chemically synthesized
cctacagaagggaaaagagcag

SEQ ID NO: 1245503 - DNA, 22 bp, Artificial Sequence
  chemically synthesized
tctgctcttttcccttctgtag

SEQ ID NO: 1245504 - DNA, 22 bp, Artificial Sequence
  chemically synthesized
ctgctcttttcccttctgtagg

SEQ ID NO: 1245505 - DNA, 22 bp, Artificial Sequence
  chemically synthesized
tgctcttttcccttctgtaggg

SEQ ID NO: 1245506 - DNA, 22 bp, Artificial Sequence
  chemically synthesized
ctcttttcccttctgtagggag

SEQ ID NO: 1245507 - DNA, 22 bp, Artificial Sequence
  chemically synthesized
ttttcccttctgtagggagata

SEQ ID NO: 1245508 - DNA, 22 bp, Artificial Sequence
  chemically synthesized
ttcccttctgtagggagatatg

SEQ ID NO: 1245509 - DNA, 22 bp, Artificial Sequence
  chemically synthesized
tcccttctgtagggagatatgt

SEQ ID NO: 1245510 - DNA, 22 bp, Artificial Sequence
  chemically synthesized
cccttctgtagggagatatgtt

SEQ ID NO: 1245511 - DNA, 22 bp, Artificial Sequence
  chemically synthesized
ccttctgtagggagatatgttt

SEQ ID NO: 1245512 - DNA, 22 bp, Artificial Sequence
  chemically synthesized
gtagagatagccaaaacatatc

SEQ ID NO: 1245513 - DNA, 22 bp, Artificial Sequence
  chemically synthesized
ctgtagggagatatgttttggc

SEQ ID NO: 1245514 - DNA, 22 bp, Artificial Sequence
  chemically synthesized
tgtagggagatatgttttggct

SEQ ID NO: 1245515 - DNA, 22 bp, Artificial Sequence
  chemically synthesized
tagggagatatgttttggctat

SEQ ID NO: 1245516 - DNA, 22 bp, Artificial Sequence
  chemically synthesized
gaagtagataaactggtagaga

SEQ ID NO: 1245517 - DNA, 22 bp, Artificial Sequence
  chemically synthesized
tggctatctctaccagtttatc

SEQ ID NO: 1245518 - DNA, 22 bp, Artificial Sequence
  chemically synthesized
ggctatctctaccagtttatct

SEQ ID NO: 1245519 - DNA, 22 bp, Artificial Sequence
  chemically synthesized
gctatctctaccagtttatcta

SEQ ID NO: 1245520 - DNA, 22 bp, Artificial Sequence
  chemically synthesized
aagtgaaattagaagtagataa

SEQ ID NO: 1245521 - DNA, 22 bp, Artificial Sequence
  chemically synthesized
tctctaccagtttatctacttc

SEQ ID NO: 1245522 - DNA, 22 bp, Artificial Sequence
  chemically synthesized
taccagtttatctacttctaat

SEQ ID NO: 1245523 - DNA, 22 bp, Artificial Sequence
  chemically synthesized
gattaaagtgaaattagaagta

SEQ ID NO: 1245524 - DNA, 22 bp, Artificial Sequence
  chemically synthesized
ccagtttatctacttctaattt

SEQ ID NO: 1245525 - DNA, 22 bp, Artificial Sequence
  chemically synthesized
gcactggattaaagtgaaatta

SEQ ID NO: 1245526 - DNA, 22 bp, Artificial Sequence
  chemically synthesized
atctacttctaatttcacttta

SEQ ID NO: 1245527 - DNA, 22 bp, Artificial Sequence
  chemically synthesized
tctacttctaatttcactttaa

SEQ ID NO: 1245528 - DNA, 22 bp, Artificial Sequence
  chemically synthesized
cttctaatttcactttaatcca

SEQ ID NO: 1245529 - DNA, 22 bp, Artificial Sequence
  chemically synthesized
ctaatttcactttaatccagtg

SEQ ID NO: 1245530 - DNA, 22 bp, Artificial Sequence
  chemically synthesized
taatttcactttaatccagtgc

SEQ ID NO: 1245531 - DNA, 22 bp, Artificial Sequence
  chemically synthesized
caaccgggcctggcactggatt

SEQ ID NO: 1245532 - DNA, 22 bp, Artificial Sequence
  chemically synthesized
acaaccgggcctggcactggat

SEQ ID NO: 1245533 - DNA, 22 bp, Artificial Sequence
  chemically synthesized
atttcactttaatccagtgcca

SEQ ID NO: 1245534 - DNA, 22 bp, Artificial Sequence
  chemically synthesized
cactttaatccagtgccaggcc

SEQ ID NO: 1245535 - DNA, 22 bp, Artificial Sequence
  chemically synthesized
actttaatccagtgccaggccc

SEQ ID NO: 1245536 - DNA, 22 bp, Artificial Sequence
  chemically synthesized
ggtgcttacaaccgggcctggc

SEQ ID NO: 1245537 - DNA, 22 bp, Artificial Sequence
  chemically synthesized
cggtgcttacaaccgggcctgg

SEQ ID NO: 1245538 - DNA, 22 bp, Artificial Sequence
  chemically synthesized
taatccagtgccaggcccggtt

SEQ ID NO: 1245539 - DNA, 22 bp, Artificial Sequence
  chemically synthesized
ttcggtgcttacaaccgggcct

SEQ ID NO: 1245540 - DNA, 22 bp, Artificial Sequence
  chemically synthesized
aatccagtgccaggcccggttg

SEQ ID NO: 1245541 - DNA, 22 bp, Artificial Sequence
  chemically synthesized
atccagtgccaggcccggttgt

SEQ ID NO: 1245542 - DNA, 22 bp, Artificial Sequence
  chemically synthesized
ttcttcggtgcttacaaccggg

SEQ ID NO: 1245543 - DNA, 22 bp, Artificial Sequence
  chemically synthesized
attcttcggtgcttacaaccgg

SEQ ID NO: 1245544 - DNA, 22 bp, Artificial Sequence
  chemically synthesized
atttattcttcggtgcttacaa

SEQ ID NO: 1245545 - DNA, 22 bp, Artificial Sequence
  chemically synthesized
tccaatagtcattcatttattc

SEQ ID NO: 1245546 - DNA, 22 bp, Artificial Sequence
  chemically synthesized
taagcaccgaagaataaatgaa

SEQ ID NO: 1245547 - DNA, 22 bp, Artificial Sequence
  chemically synthesized
atccaatagtcattcatttatt

SEQ ID NO: 1245548 - DNA, 22 bp, Artificial Sequence
  chemically synthesized
acttatccaatagtcattcatt

SEQ ID NO: 1245549 - DNA, 22 bp, Artificial Sequence
  chemically synthesized
attcacttatccaatagtcatt

SEQ ID NO: 1245550 - DNA, 22 bp, Artificial Sequence
  chemically synthesized
actaattcacttatccaatagt

SEQ ID NO: 1245551 - DNA, 22 bp, Artificial Sequence
  chemically synthesized
actcactaattcacttatccaa

SEQ ID NO: 1245552 - DNA, 22 bp, Artificial Sequence
  chemically synthesized
attcactcactaattcacttat

SEQ ID NO: 1245553 - DNA, 22 bp, Artificial Sequence
  chemically synthesized
ttcattcactcactaattcact

SEQ ID NO: 1245554 - DNA, 22 bp, Artificial Sequence
  chemically synthesized
attcattcactcactaattcac

SEQ ID NO: 1245555 - DNA, 22 bp, Artificial Sequence
  chemically synthesized
tttattcattcactcactaatt

SEQ ID NO: 1245556 - DNA, 22 bp, Artificial Sequence
  chemically synthesized
ttggataagtgaattagtgagt

SEQ ID NO: 1245557 - DNA, 22 bp, Artificial Sequence
  chemically synthesized
atttattcattcactcactaat

SEQ ID NO: 1245558 - DNA, 22 bp, Artificial Sequence
  chemically synthesized
gataagtgaattagtgagtgaa

SEQ ID NO: 1245559 - DNA, 22 bp, Artificial Sequence
  chemically synthesized
atgtatttatttattcattcac

SEQ ID NO: 1245560 - DNA, 22 bp, Artificial Sequence
  chemically synthesized
gtgagtgaatgaataaataaat

SEQ ID NO: 1245561 - DNA, 22 bp, Artificial Sequence
  chemically synthesized
taaatgcattgatgtatttatt

SEQ ID NO: 1245562 - DNA, 22 bp, Artificial Sequence
  chemically synthesized
agtggagtagtagaccataacc

SEQ ID NO: 1245563 - DNA, 22 bp, Artificial Sequence
  chemically synthesized
cagtggagtagtagaccataac

SEQ ID NO: 1245564 - DNA, 22 bp, Artificial Sequence
  chemically synthesized
ataggttatggtctactactcc

SEQ ID NO: 1245565 - DNA, 22 bp, Artificial Sequence
  chemically synthesized
taggttatggtctactactcca

SEQ ID NO: 1245566 - DNA, 22 bp, Artificial Sequence
  chemically synthesized
aagtaacaatttcagtggagta

SEQ ID NO: 1245567 - DNA, 22 bp, Artificial Sequence
  chemically synthesized
aaagtaacaatttcagtggagt

SEQ ID NO: 1245568 - DNA, 22 bp, Artificial Sequence
  chemically synthesized
taaagtaacaatttcagtggag

SEQ ID NO: 1245569 - DNA, 22 bp, Artificial Sequence
  chemically synthesized
tggtctactactccactgaaat

SEQ ID NO: 1245570 - DNA, 22 bp, Artificial Sequence
  chemically synthesized
attttaaagtaacaatttcagt

SEQ ID NO: 1245571 - DNA, 22 bp, Artificial Sequence
  chemically synthesized
actaattttaaagtaacaattt

SEQ ID NO: 1245572 - DNA, 22 bp, Artificial Sequence
  chemically synthesized
ctactccactgaaattgttact

SEQ ID NO: 1245573 - DNA, 22 bp, Artificial Sequence
  chemically synthesized
gactaattttaaagtaacaatt

SEQ ID NO: 1245574 - DNA, 22 bp, Artificial Sequence
  chemically synthesized
tgactaattttaaagtaacaat

SEQ ID NO: 1245575 - DNA, 22 bp, Artificial Sequence
  chemically synthesized
ctccactgaaattgttacttta

SEQ ID NO: 1245576 - DNA, 22 bp, Artificial Sequence
  chemically synthesized
ctttgactaattttaaagtaac

SEQ ID NO: 1245577 - DNA, 22 bp, Artificial Sequence
  chemically synthesized
cactgaaattgttactttaaaa

SEQ ID NO: 1245578 - DNA, 22 bp, Artificial Sequence
  chemically synthesized
gttgctttgactaattttaaag

SEQ ID NO: 1245579 - DNA, 22 bp, Artificial Sequence
  chemically synthesized
tggttgctttgactaattttaa

SEQ ID NO: 1245580 - DNA, 22 bp, Artificial Sequence
  chemically synthesized
aaattgttactttaaaattagt

SEQ ID NO: 1245581 - DNA, 22 bp, Artificial Sequence
  chemically synthesized
ctggttgctttgactaatttta

SEQ ID NO: 1245582 - DNA, 22 bp, Artificial Sequence
  chemically synthesized
tctggttgctttgactaatttt

SEQ ID NO: 1245583 - DNA, 22 bp, Artificial Sequence
  chemically synthesized
ttactttaaaattagtcaaagc

SEQ ID NO: 1245584 - DNA, 22 bp, Artificial Sequence
  chemically synthesized
ggttttctggttgctttgacta

SEQ ID NO: 1245585 - DNA, 22 bp, Artificial Sequence
  chemically synthesized
ctttaaaattagtcaaagcaac

SEQ ID NO: 1245586 - DNA, 22 bp, Artificial Sequence
  chemically synthesized
taaaattagtcaaagcaaccag

SEQ ID NO: 1245587 - DNA, 22 bp, Artificial Sequence
  chemically synthesized
aaaattagtcaaagcaaccaga

SEQ ID NO: 1245588 - DNA, 22 bp, Artificial Sequence
  chemically synthesized
aaattagtcaaagcaaccagaa

SEQ ID NO: 1245589 - DNA, 22 bp, Artificial Sequence
  chemically synthesized
gtcaaagcaaccagaaaaccga

SEQ ID NO: 1245590 - DNA, 22 bp, Artificial Sequence
  chemically synthesized
agaaaagaccattcggttttct

SEQ ID NO: 1245591 - DNA, 22 bp, Artificial Sequence
  chemically synthesized
gggtctgagaaaagaccattcg

SEQ ID NO: 1245592 - DNA, 22 bp, Artificial Sequence
  chemically synthesized
ggggtctgagaaaagaccattc

SEQ ID NO: 1245593 - DNA, 22 bp, Artificial Sequence
  chemically synthesized
cttggggtctgagaaaagacca

SEQ ID NO: 1245594 - DNA, 22 bp, Artificial Sequence
  chemically synthesized
acttggggtctgagaaaagacc

SEQ ID NO: 1245595 - DNA, 22 bp, Artificial Sequence
  chemically synthesized
aaatttacttggggtctgagaa

SEQ ID NO: 1245596 - DNA, 22 bp, Artificial Sequence
  chemically synthesized
aattgaaatttacttggggtct

SEQ ID NO: 1245597 - DNA, 22 bp, Artificial Sequence
  chemically synthesized
ttctcagaccccaagtaaattt

SEQ ID NO: 1245598 - DNA, 22 bp, Artificial Sequence
  chemically synthesized
tctcagaccccaagtaaatttc

SEQ ID NO: 1245599 - DNA, 22 bp, Artificial Sequence
  chemically synthesized
ctcagaccccaagtaaatttca

SEQ ID NO: 1245600 - DNA, 22 bp, Artificial Sequence
  chemically synthesized
tcagaccccaagtaaatttcaa

SEQ ID NO: 1245601 - DNA, 22 bp, Artificial Sequence
  chemically synthesized
agaccccaagtaaatttcaatt

SEQ ID NO: 1245602 - DNA, 22 bp, Artificial Sequence
  chemically synthesized
accaaaggcagtgattgaattg

SEQ ID NO: 1245603 - DNA, 22 bp, Artificial Sequence
  chemically synthesized
cattgaccaaaggcagtgattg

SEQ ID NO: 1245604 - DNA, 22 bp, Artificial Sequence
  chemically synthesized
caattcaatcactgcctttggt

SEQ ID NO: 1245605 - DNA, 22 bp, Artificial Sequence
  chemically synthesized
aattcaatcactgcctttggtc

SEQ ID NO: 1245606 - DNA, 22 bp, Artificial Sequence
  chemically synthesized
aggaggtgactacattgaccaa

SEQ ID NO: 1245607 - DNA, 22 bp, Artificial Sequence
  chemically synthesized
aatcactgcctttggtcaatgt

SEQ ID NO: 1245608 - DNA, 22 bp, Artificial Sequence
  chemically synthesized
aaggaggtgactacattgacca

SEQ ID NO: 1245609 - DNA, 22 bp, Artificial Sequence
  chemically synthesized
taaggaggtgactacattgacc

SEQ ID NO: 1245610 - DNA, 22 bp, Artificial Sequence
  chemically synthesized
ttaaggaggtgactacattgac

SEQ ID NO: 1245611 - DNA, 22 bp, Artificial Sequence
  chemically synthesized
cctttggtcaatgtagtcacct

SEQ ID NO: 1245612 - DNA, 22 bp, Artificial Sequence
  chemically synthesized
tggtcaatgtagtcacctcctt

SEQ ID NO: 1245613 - DNA, 22 bp, Artificial Sequence
  chemically synthesized
ggtcaatgtagtcacctcctta

SEQ ID NO: 1245614 - DNA, 22 bp, Artificial Sequence
  chemically synthesized
gtcaatgtagtcacctccttaa

SEQ ID NO: 1245615 - DNA, 22 bp, Artificial Sequence
  chemically synthesized
gtcacagaagcagcaagaaaaa

SEQ ID NO: 1245616 - DNA, 22 bp, Artificial Sequence
  chemically synthesized
cttaaaaactgtttttcttgct

SEQ ID NO: 1245617 - DNA, 22 bp, Artificial Sequence
  chemically synthesized
aaaaactgtttttcttgctgct

SEQ ID NO: 1245618 - DNA, 22 bp, Artificial Sequence
  chemically synthesized
aaaactgtttttcttgctgctt

SEQ ID NO: 1245619 - DNA, 22 bp, Artificial Sequence
  chemically synthesized
taaagtgtctggtcacagaagc

SEQ ID NO: 1245620 - DNA, 22 bp, Artificial Sequence
  chemically synthesized
tttttcttgctgcttctgtgac

SEQ ID NO: 1245621 - DNA, 22 bp, Artificial Sequence
  chemically synthesized
ttcttgctgcttctgtgaccag

SEQ ID NO: 1245622 - DNA, 22 bp, Artificial Sequence
  chemically synthesized
tcttgctgcttctgtgaccaga

SEQ ID NO: 1245623 - DNA, 22 bp, Artificial Sequence
  chemically synthesized
cttgctgcttctgtgaccagac

SEQ ID NO: 1245624 - DNA, 22 bp, Artificial Sequence
  chemically synthesized
ttgctgcttctgtgaccagaca

SEQ ID NO: 1245625 - DNA, 22 bp, Artificial Sequence
  chemically synthesized
gctgcttctgtgaccagacact

SEQ ID NO: 1245626 - DNA, 22 bp, Artificial Sequence
  chemically synthesized
ctgcttctgtgaccagacactt

SEQ ID NO: 1245627 - DNA, 22 bp, Artificial Sequence
  chemically synthesized
cttctgtgaccagacactttac

SEQ ID NO: 1245628 - DNA, 22 bp, Artificial Sequence
  chemically synthesized
ctgtgaccagacactttacagt

SEQ ID NO: 1245629 - DNA, 22 bp, Artificial Sequence
  chemically synthesized
tgtgaccagacactttacagtt

SEQ ID NO: 1245630 - DNA, 22 bp, Artificial Sequence
  chemically synthesized
tgaccagacactttacagtttc

SEQ ID NO: 1245631 - DNA, 22 bp, Artificial Sequence
  chemically synthesized
ggagaagtcacaggaaactgta

SEQ ID NO: 1245632 - DNA, 22 bp, Artificial Sequence
  chemically synthesized
tacagtttcctgtgacttctcc

SEQ ID NO: 1245633 - DNA, 22 bp, Artificial Sequence
  chemically synthesized
acagtttcctgtgacttctcct

SEQ ID NO: 1245634 - DNA, 22 bp, Artificial Sequence
  chemically synthesized
cagtttcctgtgacttctccta

SEQ ID NO: 1245635 - DNA, 22 bp, Artificial Sequence
  chemically synthesized
cctgtgacttctcctaacactt

SEQ ID NO: 1245636 - DNA, 22 bp, Artificial Sequence
  chemically synthesized
ctgtgacttctcctaacacttc

SEQ ID NO: 1245637 - DNA, 22 bp, Artificial Sequence
  chemically synthesized
tgacttctcctaacacttcttt

SEQ ID NO: 1245638 - DNA, 22 bp, Artificial Sequence
  chemically synthesized
ctcctaacacttctttgctggc

SEQ ID NO: 1245639 - DNA, 22 bp, Artificial Sequence
  chemically synthesized
tcctaacacttctttgctggct

SEQ ID NO: 1245640 - DNA, 22 bp, Artificial Sequence
  chemically synthesized
ctaacacttctttgctggcttc

SEQ ID NO: 1245641 - DNA, 22 bp, Artificial Sequence
  chemically synthesized
acacttctttgctggcttctct

SEQ ID NO: 1245642 - DNA, 22 bp, Artificial Sequence
  chemically synthesized
aatacgtgcagatatagagaag

SEQ ID NO: 1245643 - DNA, 22 bp, Artificial Sequence
  chemically synthesized
aaatacgtgcagatatagagaa

SEQ ID NO: 1245644 - DNA, 22 bp, Artificial Sequence
  chemically synthesized
ctttgctggcttctctatatct

SEQ ID NO: 1245645 - DNA, 22 bp, Artificial Sequence
  chemically synthesized
tttgctggcttctctatatctg

SEQ ID NO: 1245646 - DNA, 22 bp, Artificial Sequence
  chemically synthesized
tgctggcttctctatatctgca

SEQ ID NO: 1245647 - DNA, 22 bp, Artificial Sequence
  chemically synthesized
gctggcttctctatatctgcac

SEQ ID NO: 1245648 - DNA, 22 bp, Artificial Sequence
  chemically synthesized
acatttaaatacgtgcagatat

SEQ ID NO: 1245649 - DNA, 22 bp, Artificial Sequence
  chemically synthesized
ctggcttctctatatctgcacg

SEQ ID NO: 1245650 - DNA, 22 bp, Artificial Sequence
  chemically synthesized
gcttctctatatctgcacgtat

SEQ ID NO: 1245651 - DNA, 22 bp, Artificial Sequence
  chemically synthesized
ctctatatctgcacgtatttaa

SEQ ID NO: 1245652 - DNA, 22 bp, Artificial Sequence
  chemically synthesized
gagaattcacatttaaatacgt

SEQ ID NO: 1245653 - DNA, 22 bp, Artificial Sequence
  chemically synthesized
tctatatctgcacgtatttaaa

SEQ ID NO: 1245654 - DNA, 22 bp, Artificial Sequence
  chemically synthesized
ggagaattcacatttaaatacg

SEQ ID NO: 1245655 - DNA, 22 bp, Artificial Sequence
  chemically synthesized
tatatctgcacgtatttaaatg

SEQ ID NO: 1245656 - DNA, 22 bp, Artificial Sequence
  chemically synthesized
tatctgcacgtatttaaatgtg

SEQ ID NO: 1245657 - DNA, 22 bp, Artificial Sequence
  chemically synthesized
cacgtatttaaatgtgaattct

SEQ ID NO: 1245658 - DNA, 22 bp, Artificial Sequence
  chemically synthesized
aaatgtgaattctccaagactt

SEQ ID NO: 1245659 - DNA, 22 bp, Artificial Sequence
  chemically synthesized
aatgtgaattctccaagacttg

SEQ ID NO: 1245660 - DNA, 22 bp, Artificial Sequence
  chemically synthesized
aaaaggaacccaaaaccaagtc

SEQ ID NO: 1245661 - DNA, 22 bp, Artificial Sequence
  chemically synthesized
tccaagacttggttttgggttc

SEQ ID NO: 1245662 - DNA, 22 bp, Artificial Sequence
  chemically synthesized
caagacttggttttgggttcct

SEQ ID NO: 1245663 - DNA, 22 bp, Artificial Sequence
  chemically synthesized
tacacagttaaaaaggaaccca

SEQ ID NO: 1245664 - DNA, 22 bp, Artificial Sequence
  chemically synthesized
ggttttgggttcctttttaact

SEQ ID NO: 1245665 - DNA, 22 bp, Artificial Sequence
  chemically synthesized
gttttgggttcctttttaactg

SEQ ID NO: 1245666 - DNA, 22 bp, Artificial Sequence
  chemically synthesized
tgggttcctttttaactgtgta

SEQ ID NO: 1245667 - DNA, 22 bp, Artificial Sequence
  chemically synthesized
gggttcctttttaactgtgtat

SEQ ID NO: 1245668 - DNA, 22 bp, Artificial Sequence
  chemically synthesized
ggttcctttttaactgtgtata

SEQ ID NO: 1245669 - DNA, 22 bp, Artificial Sequence
  chemically synthesized
ctttttaactgtgtataatatc

SEQ ID NO: 1245670 - DNA, 22 bp, Artificial Sequence
  chemically synthesized
tttaactgtgtataatatcctt

SEQ ID NO: 1245671 - DNA, 22 bp, Artificial Sequence
  chemically synthesized
ttaactgtgtataatatccttt

SEQ ID NO: 1245672 - DNA, 22 bp, Artificial Sequence
  chemically synthesized
taactgtgtataatatcctttt

SEQ ID NO: 1245673 - DNA, 22 bp, Artificial Sequence
  chemically synthesized
aactgtgtataatatccttttg

SEQ ID NO: 1245674 - DNA, 22 bp, Artificial Sequence
  chemically synthesized
actgtgtataatatccttttgc

SEQ ID NO: 1245675 - DNA, 22 bp, Artificial Sequence
  chemically synthesized
tgtataatatccttttgccgta

SEQ ID NO: 1245676 - DNA, 22 bp, Artificial Sequence
  chemically synthesized
agccatgggggcagatgatacg

SEQ ID NO: 1245677 - DNA, 22 bp, Artificial Sequence
  chemically synthesized
aagccatgggggcagatgatac

SEQ ID NO: 1245678 - DNA, 22 bp, Artificial Sequence
  chemically synthesized
ttgccgtatcatctgcccccat

SEQ ID NO: 1245679 - DNA, 22 bp, Artificial Sequence
  chemically synthesized
tgccgtatcatctgcccccatg

SEQ ID NO: 1245680 - DNA, 22 bp, Artificial Sequence
  chemically synthesized
gccgtatcatctgcccccatgg

SEQ ID NO: 1245681 - DNA, 22 bp, Artificial Sequence
  chemically synthesized
ccgtatcatctgcccccatggc

SEQ ID NO: 1245682 - DNA, 22 bp, Artificial Sequence
  chemically synthesized
ggggtaatcaatatggagttta

SEQ ID NO: 1245683 - DNA, 22 bp, Artificial Sequence
  chemically synthesized
cccccatggcttaaactccata

SEQ ID NO: 1245684 - DNA, 22 bp, Artificial Sequence
  chemically synthesized
gggggtaatcaatatggagttt

SEQ ID NO: 1245685 - DNA, 22 bp, Artificial Sequence
  chemically synthesized
aaactccatattgattaccccc

SEQ ID NO: 1245686 - DNA, 22 bp, Artificial Sequence
  chemically synthesized
aactccatattgattaccccca

SEQ ID NO: 1245687 - DNA, 22 bp, Artificial Sequence
  chemically synthesized
aagaaaatggtttgggggtaat

SEQ ID NO: 1245688 - DNA, 22 bp, Artificial Sequence
  chemically synthesized
catattgattacccccaaacca

SEQ ID NO: 1245689 - DNA, 22 bp, Artificial Sequence
  chemically synthesized
attacccccaaaccattttctt

SEQ ID NO: 1245690 - DNA, 22 bp, Artificial Sequence
  chemically synthesized
cccccaaaccattttctttagt

SEQ ID NO: 1245691 - DNA, 22 bp, Artificial Sequence
  chemically synthesized
tctttagttgtggtatcttgcc

SEQ ID NO: 1245692 - DNA, 22 bp, Artificial Sequence
  chemically synthesized
ctttagttgtggtatcttgcct

SEQ ID NO: 1245693 - DNA, 22 bp, Artificial Sequence
  chemically synthesized
tttagttgtggtatcttgccta

SEQ ID NO: 1245694 - DNA, 22 bp, Artificial Sequence
  chemically synthesized
tagttgtggtatcttgcctatg

SEQ ID NO: 1245695 - DNA, 22 bp, Artificial Sequence
  chemically synthesized
agttgtggtatcttgcctatga

SEQ ID NO: 1245696 - DNA, 22 bp, Artificial Sequence
  chemically synthesized
gttgtggtatcttgcctatgat

SEQ ID NO: 1245697 - DNA, 22 bp, Artificial Sequence
  chemically synthesized
tggtatcttgcctatgatactt

SEQ ID NO: 1245698 - DNA, 22 bp, Artificial Sequence
  chemically synthesized
ataggtgtagcagtgagaaagt

SEQ ID NO: 1245699 - DNA, 22 bp, Artificial Sequence
  chemically synthesized
gataggtgtagcagtgagaaag

SEQ ID NO: 1245700 - DNA, 22 bp, Artificial Sequence
  chemically synthesized
gcctatgatactttctcactgc

SEQ ID NO: 1245701 - DNA, 22 bp, Artificial Sequence
  chemically synthesized
cctatgatactttctcactgct

SEQ ID NO: 1245702 - DNA, 22 bp, Artificial Sequence
  chemically synthesized
tgatactttctcactgctacac

SEQ ID NO: 1245703 - DNA, 22 bp, Artificial Sequence
  chemically synthesized
tctcactgctacacctatcaaa

SEQ ID NO: 1245704 - DNA, 22 bp, Artificial Sequence
  chemically synthesized
ctcactgctacacctatcaaac

SEQ ID NO: 1245705 - DNA, 22 bp, Artificial Sequence
  chemically synthesized
tcactgctacacctatcaaaca

SEQ ID NO: 1245706 - DNA, 22 bp, Artificial Sequence
  chemically synthesized
actgctacacctatcaaacaca

SEQ ID NO: 1245707 - DNA, 22 bp, Artificial Sequence
  chemically synthesized
ctacacctatcaaacacacact

SEQ ID NO: 1245708 - DNA, 22 bp, Artificial Sequence
  chemically synthesized
aggagggaaatcagtgtgtgtt

SEQ ID NO: 1245709 - DNA, 22 bp, Artificial Sequence
  chemically synthesized
cacctatcaaacacacactgat

SEQ ID NO: 1245710 - DNA, 22 bp, Artificial Sequence
  chemically synthesized
gatctgaggagggaaatcagtg

SEQ ID NO: 1245711 - DNA, 22 bp, Artificial Sequence
  chemically synthesized
tcaaacacacactgatttccct

SEQ ID NO: 1245712 - DNA, 22 bp, Artificial Sequence
  chemically synthesized
cggaaaatatgtctggatctga

SEQ ID NO: 1245713 - DNA, 22 bp, Artificial Sequence
  chemically synthesized
atttccctcctcagatccagac

SEQ ID NO: 1245714 - DNA, 22 bp, Artificial Sequence
  chemically synthesized
ccctcctcagatccagacatat

SEQ ID NO: 1245715 - DNA, 22 bp, Artificial Sequence
  chemically synthesized
cctcctcagatccagacatatt

SEQ ID NO: 1245716 - DNA, 22 bp, Artificial Sequence
  chemically synthesized
ctcagatccagacatattttcc

SEQ ID NO: 1245717 - DNA, 22 bp, Artificial Sequence
  chemically synthesized
agatccagacatattttccgga

SEQ ID NO: 1245718 - DNA, 22 bp, Artificial Sequence
  chemically synthesized
atgggatatccaataatctccg

SEQ ID NO: 1245719 - DNA, 22 bp, Artificial Sequence
  chemically synthesized
atgtattgatgggatatccaat

SEQ ID NO: 1245720 - DNA, 22 bp, Artificial Sequence
  chemically synthesized
gatgtattgatgggatatccaa

SEQ ID NO: 1245721 - DNA, 22 bp, Artificial Sequence
  chemically synthesized
tccggagattattggatatccc

SEQ ID NO: 1245722 - DNA, 22 bp, Artificial Sequence
  chemically synthesized
tgatgtattgatgggatatcca

SEQ ID NO: 1245723 - DNA, 22 bp, Artificial Sequence
  chemically synthesized
ccggagattattggatatccca

SEQ ID NO: 1245724 - DNA, 22 bp, Artificial Sequence
  chemically synthesized
cggagattattggatatcccat

SEQ ID NO: 1245725 - DNA, 22 bp, Artificial Sequence
  chemically synthesized
tctttgatgtattgatgggata

SEQ ID NO: 1245726 - DNA, 22 bp, Artificial Sequence
  chemically synthesized
ttggatatcccatcaatacatc

SEQ ID NO: 1245727 - DNA, 22 bp, Artificial Sequence
  chemically synthesized
gatatcccatcaatacatcaaa

SEQ ID NO: 1245728 - DNA, 22 bp, Artificial Sequence
  chemically synthesized
ggatatattgtctttgatgtat

SEQ ID NO: 1245729 - DNA, 22 bp, Artificial Sequence
  chemically synthesized
gggatatattgtctttgatgta

SEQ ID NO: 1245730 - DNA, 22 bp, Artificial Sequence
  chemically synthesized
tatttgggatatattgtctttg

SEQ ID NO: 1245731 - DNA, 22 bp, Artificial Sequence
  chemically synthesized
gtatttgggatatattgtcttt

SEQ ID NO: 1245732 - DNA, 22 bp, Artificial Sequence
  chemically synthesized
tgatggggaagtgatttgtatt

SEQ ID NO: 1245733 - DNA, 22 bp, Artificial Sequence
  chemically synthesized
gaaatagaaataagcaaaacta

SEQ ID NO: 1245734 - DNA, 22 bp, Artificial Sequence
  chemically synthesized
ccccatcatagttttgcttatt

SEQ ID NO: 1245735 - DNA, 22 bp, Artificial Sequence
  chemically synthesized
cccatcatagttttgcttattt

SEQ ID NO: 1245736 - DNA, 22 bp, Artificial Sequence
  chemically synthesized
gatatggttagaaatagaaata

SEQ ID NO: 1245737 - DNA, 22 bp, Artificial Sequence
  chemically synthesized
tgcttatttctatttctaacca

SEQ ID NO: 1245738 - DNA, 22 bp, Artificial Sequence
  chemically synthesized
gcttatttctatttctaaccat

SEQ ID NO: 1245739 - DNA, 22 bp, Artificial Sequence
  chemically synthesized
cttatttctatttctaaccata

SEQ ID NO: 1245740 - DNA, 22 bp, Artificial Sequence
  chemically synthesized
atttctatttctaaccatatcc

SEQ ID NO: 1245741 - DNA, 22 bp, Artificial Sequence
  chemically synthesized
tttctatttctaaccatatcca

SEQ ID NO: 1245742 - DNA, 22 bp, Artificial Sequence
  chemically synthesized
ctatttctaaccatatccaatg

SEQ ID NO: 1245743 - DNA, 22 bp, Artificial Sequence
  chemically synthesized
tatttctaaccatatccaatga

SEQ ID NO: 1245744 - DNA, 22 bp, Artificial Sequence
  chemically synthesized
tttctaaccatatccaatgata

SEQ ID NO: 1245745 - DNA, 22 bp, Artificial Sequence
  chemically synthesized
agaggatggtggtatcattgga

SEQ ID NO: 1245746 - DNA, 22 bp, Artificial Sequence
  chemically synthesized
ctaaccatatccaatgatacca

SEQ ID NO: 1245747 - DNA, 22 bp, Artificial Sequence
  chemically synthesized
taaccatatccaatgataccac

SEQ ID NO: 1245748 - DNA, 22 bp, Artificial Sequence
  chemically synthesized
accatatccaatgataccacca

SEQ ID NO: 1245749 - DNA, 22 bp, Artificial Sequence
  chemically synthesized
aaaaattgagaggatggtggta

SEQ ID NO: 1245750 - DNA, 22 bp, Artificial Sequence
  chemically synthesized
gggctgaaaaattgagaggatg

SEQ ID NO: 1245751 - DNA, 22 bp, Artificial Sequence
  chemically synthesized
agggctgaaaaattgagaggat

SEQ ID NO: 1245752 - DNA, 22 bp, Artificial Sequence
  chemically synthesized
tgtcttagggctgaaaaattga

SEQ ID NO: 1245753 - DNA, 22 bp, Artificial Sequence
  chemically synthesized
atgtcttagggctgaaaaattg

SEQ ID NO: 1245754 - DNA, 22 bp, Artificial Sequence
  chemically synthesized
tcaatttttcagccctaagaca

SEQ ID NO: 1245755 - DNA, 22 bp, Artificial Sequence
  chemically synthesized
aatttttcagccctaagacata

SEQ ID NO: 1245756 - DNA, 22 bp, Artificial Sequence
  chemically synthesized
ttcagccctaagacataagtta

SEQ ID NO: 1245757 - DNA, 22 bp, Artificial Sequence
  chemically synthesized
tcagccctaagacataagttat

SEQ ID NO: 1245758 - DNA, 22 bp, Artificial Sequence
  chemically synthesized
cagccctaagacataagttatt

SEQ ID NO: 1245759 - DNA, 22 bp, Artificial Sequence
  chemically synthesized
agccctaagacataagttattt

SEQ ID NO: 1245760 - DNA, 22 bp, Artificial Sequence
  chemically synthesized
agacataagttattttcacctc

SEQ ID NO: 1245761 - DNA, 22 bp, Artificial Sequence
  chemically synthesized
aaggatgtggcaagaatgaggt

SEQ ID NO: 1245762 - DNA, 22 bp, Artificial Sequence
  chemically synthesized
ttttcacctcattcttgccaca

SEQ ID NO: 1245763 - DNA, 22 bp, Artificial Sequence
  chemically synthesized
atgtaattaaaggatgtggcaa

SEQ ID NO: 1245764 - DNA, 22 bp, Artificial Sequence
  chemically synthesized
tcacctcattcttgccacatcc

SEQ ID NO: 1245765 - DNA, 22 bp, Artificial Sequence
  chemically synthesized
cacctcattcttgccacatcct

SEQ ID NO: 1245766 - DNA, 22 bp, Artificial Sequence
  chemically synthesized
acctcattcttgccacatcctt

SEQ ID NO: 1245767 - DNA, 22 bp, Artificial Sequence
  chemically synthesized
attcttgccacatcctttaatt

SEQ ID NO: 1245768 - DNA, 22 bp, Artificial Sequence
  chemically synthesized
ttgccacatcctttaattacat

SEQ ID NO: 1245769 - DNA, 22 bp, Artificial Sequence
  chemically synthesized
gccacatcctttaattacatca

SEQ ID NO: 1245770 - DNA, 22 bp, Artificial Sequence
  chemically synthesized
ccacatcctttaattacatcaa

SEQ ID NO: 1245771 - DNA, 22 bp, Artificial Sequence
  chemically synthesized
gagacaacagggatatcagtat

SEQ ID NO: 1245772 - DNA, 22 bp, Artificial Sequence
  chemically synthesized
taattacatcaatactgatatc

SEQ ID NO: 1245773 - DNA, 22 bp, Artificial Sequence
  chemically synthesized
aattacatcaatactgatatcc

SEQ ID NO: 1245774 - DNA, 22 bp, Artificial Sequence
  chemically synthesized
attacatcaatactgatatccc

SEQ ID NO: 1245775 - DNA, 22 bp, Artificial Sequence
  chemically synthesized
tatctagagacaacagggatat

SEQ ID NO: 1245776 - DNA, 22 bp, Artificial Sequence
  chemically synthesized
catcaatactgatatccctgtt

SEQ ID NO: 1245777 - DNA, 22 bp, Artificial Sequence
  chemically synthesized
gtatctagagacaacagggata

SEQ ID NO: 1245778 - DNA, 22 bp, Artificial Sequence
  chemically synthesized
tgtatctagagacaacagggat

SEQ ID NO: 1245779 - DNA, 22 bp, Artificial Sequence
  chemically synthesized
acattttgtatctagagacaac

SEQ ID NO: 1245780 - DNA, 22 bp, Artificial Sequence
  chemically synthesized
atatccctgttgtctctagata

SEQ ID NO: 1245781 - DNA, 22 bp, Artificial Sequence
  chemically synthesized
taactgacattttgtatctaga

SEQ ID NO: 1245782 - DNA, 22 bp, Artificial Sequence
  chemically synthesized
ttataactgacattttgtatct

SEQ ID NO: 1245783 - DNA, 22 bp, Artificial Sequence
  chemically synthesized
attataactgacattttgtatc

SEQ ID NO: 1245784 - DNA, 22 bp, Artificial Sequence
  chemically synthesized
ttgtctctagatacaaaatgtc

SEQ ID NO: 1245785 - DNA, 22 bp, Artificial Sequence
  chemically synthesized
tctctagatacaaaatgtcagt

SEQ ID NO: 1245786 - DNA, 22 bp, Artificial Sequence
  chemically synthesized
gagtttattataactgacattt

SEQ ID NO: 1245787 - DNA, 22 bp, Artificial Sequence
  chemically synthesized
agagtttattataactgacatt

SEQ ID NO: 1245788 - DNA, 22 bp, Artificial Sequence
  chemically synthesized
tagagtttattataactgacat

SEQ ID NO: 1245789 - DNA, 22 bp, Artificial Sequence
  chemically synthesized
tagatacaaaatgtcagttata

SEQ ID NO: 1245790 - DNA, 22 bp, Artificial Sequence
  chemically synthesized
gatacaaaatgtcagttataat

SEQ ID NO: 1245791 - DNA, 22 bp, Artificial Sequence
  chemically synthesized
taggtgaagaaaccattttaga

SEQ ID NO: 1245792 - DNA, 22 bp, Artificial Sequence
  chemically synthesized
taataaactctaaaatggtttc

SEQ ID NO: 1245793 - DNA, 22 bp, Artificial Sequence
  chemically synthesized
aggattataggtgaagaaacca

SEQ ID NO: 1245794 - DNA, 22 bp, Artificial Sequence
  chemically synthesized
gaggattataggtgaagaaacc

SEQ ID NO: 1245795 - DNA, 22 bp, Artificial Sequence
  chemically synthesized
taaaatggtttcttcacctata

SEQ ID NO: 1245796 - DNA, 22 bp, Artificial Sequence
  chemically synthesized
aaatggtttcttcacctataat

SEQ ID NO: 1245797 - DNA, 22 bp, Artificial Sequence
  chemically synthesized
tcaagatttgaggattataggt

SEQ ID NO: 1245798 - DNA, 22 bp, Artificial Sequence
  chemically synthesized
cttcacctataatcctcaaatc

SEQ ID NO: 1245799 - DNA, 22 bp, Artificial Sequence
  chemically synthesized
gataactgtcaagatttgagga

SEQ ID NO: 1245800 - DNA, 22 bp, Artificial Sequence
  chemically synthesized
ttcacctataatcctcaaatct

SEQ ID NO: 1245801 - DNA, 22 bp, Artificial Sequence
  chemically synthesized
cacctataatcctcaaatcttg

SEQ ID NO: 1245802 - DNA, 22 bp, Artificial Sequence
  chemically synthesized
acctataatcctcaaatcttga

SEQ ID NO: 1245803 - DNA, 22 bp, Artificial Sequence
  chemically synthesized
aattggataactgtcaagattt

SEQ ID NO: 1245804 - DNA, 22 bp, Artificial Sequence
  chemically synthesized
taatcctcaaatcttgacagtt

SEQ ID NO: 1245805 - DNA, 22 bp, Artificial Sequence
  chemically synthesized
catagactaaattggataactg

SEQ ID NO: 1245806 - DNA, 22 bp, Artificial Sequence
  chemically synthesized
aaatcttgacagttatccaatt

SEQ ID NO: 1245807 - DNA, 22 bp, Artificial Sequence
  chemically synthesized
tactacatagactaaattggat

SEQ ID NO: 1245808 - DNA, 22 bp, Artificial Sequence
  chemically synthesized
gttgtactacatagactaaatt

SEQ ID NO: 1245809 - DNA, 22 bp, Artificial Sequence
  chemically synthesized
gacagttatccaatttagtcta

SEQ ID NO: 1245810 - DNA, 22 bp, Artificial Sequence
  chemically synthesized
acagttatccaatttagtctat

SEQ ID NO: 1245811 - DNA, 22 bp, Artificial Sequence
  chemically synthesized
tccaatttagtctatgtagtac

SEQ ID NO: 1245812 - DNA, 22 bp, Artificial Sequence
  chemically synthesized
ggaaaataactagttgtactac

SEQ ID NO: 1245813 - DNA, 22 bp, Artificial Sequence
  chemically synthesized
aggaaaataactagttgtacta

SEQ ID NO: 1245814 - DNA, 22 bp, Artificial Sequence
  chemically synthesized
agtctatgtagtacaactagtt

SEQ ID NO: 1245815 - DNA, 22 bp, Artificial Sequence
  chemically synthesized
gtctatgtagtacaactagtta

SEQ ID NO: 1245816 - DNA, 22 bp, Artificial Sequence
  chemically synthesized
tgtagtacaactagttattttc

SEQ ID NO: 1245817 - DNA, 22 bp, Artificial Sequence
  chemically synthesized
caagaacggtttaggaaaataa

SEQ ID NO: 1245818 - DNA, 22 bp, Artificial Sequence
  chemically synthesized
acaagaacggtttaggaaaata

SEQ ID NO: 1245819 - DNA, 22 bp, Artificial Sequence
  chemically synthesized
gagtacttacaagaacggttta

SEQ ID NO: 1245820 - DNA, 22 bp, Artificial Sequence
  chemically synthesized
gttattttcctaaaccgttctt

SEQ ID NO: 1245821 - DNA, 22 bp, Artificial Sequence
  chemically synthesized
ttttcctaaaccgttcttgtaa

SEQ ID NO: 1245822 - DNA, 22 bp, Artificial Sequence
  chemically synthesized
tggttggagtacttacaagaac

SEQ ID NO: 1245823 - DNA, 22 bp, Artificial Sequence
  chemically synthesized
tcctaaaccgttcttgtaagta

SEQ ID NO: 1245824 - DNA, 22 bp, Artificial Sequence
  chemically synthesized
cctaaaccgttcttgtaagtac

SEQ ID NO: 1245825 - DNA, 22 bp, Artificial Sequence
  chemically synthesized
ctaaaccgttcttgtaagtact

SEQ ID NO: 1245826 - DNA, 22 bp, Artificial Sequence
  chemically synthesized
aaccgttcttgtaagtactcca

SEQ ID NO: 1245827 - DNA, 22 bp, Artificial Sequence
  chemically synthesized
gggggcaactgtggttggagta

SEQ ID NO: 1245828 - DNA, 22 bp, Artificial Sequence
  chemically synthesized
ttgtaagtactccaaccacagt

SEQ ID NO: 1245829 - DNA, 22 bp, Artificial Sequence
  chemically synthesized
gtaagtactccaaccacagttg

SEQ ID NO: 1245830 - DNA, 22 bp, Artificial Sequence
  chemically synthesized
taagtactccaaccacagttgc

SEQ ID NO: 1245831 - DNA, 22 bp, Artificial Sequence
  chemically synthesized
caaccacagttgccccctagtg

SEQ ID NO: 1245832 - DNA, 22 bp, Artificial Sequence
  chemically synthesized
cagaataagaaagcactagggg

SEQ ID NO: 1245833 - DNA, 22 bp, Artificial Sequence
  chemically synthesized
ccccctagtgctttcttattct

SEQ ID NO: 1245834 - DNA, 22 bp, Artificial Sequence
  chemically synthesized
gtgctttcttattctgtagatt

SEQ ID NO: 1245835 - DNA, 22 bp, Artificial Sequence
  chemically synthesized
gaacacaaaaatacaatctaca

SEQ ID NO: 1245836 - DNA, 22 bp, Artificial Sequence
  chemically synthesized
tcttattctgtagattgtattt

SEQ ID NO: 1245837 - DNA, 22 bp, Artificial Sequence
  chemically synthesized
cttattctgtagattgtatttt

SEQ ID NO: 1245838 - DNA, 22 bp, Artificial Sequence
  chemically synthesized
ttattctgtagattgtattttt

SEQ ID NO: 1245839 - DNA, 22 bp, Artificial Sequence
  chemically synthesized
attctgtagattgtatttttgt

SEQ ID NO: 1245840 - DNA, 22 bp, Artificial Sequence
  chemically synthesized
ttctgtagattgtatttttgtg

SEQ ID NO: 1245841 - DNA, 22 bp, Artificial Sequence
  chemically synthesized
tgtagattgtatttttgtgttc

SEQ ID NO: 1245842 - DNA, 22 bp, Artificial Sequence
  chemically synthesized
tagattgtatttttgtgttcta

SEQ ID NO: 1245843 - DNA, 22 bp, Artificial Sequence
  chemically synthesized
gtggagtggaaggctagaacac

SEQ ID NO: 1245844 - DNA, 22 bp, Artificial Sequence
  chemically synthesized
tatttttgtgttctagccttcc

SEQ ID NO: 1245845 - DNA, 22 bp, Artificial Sequence
  chemically synthesized
ttgtgttctagccttccactcc

SEQ ID NO: 1245846 - DNA, 22 bp, Artificial Sequence
  chemically synthesized
tgtgttctagccttccactcca

SEQ ID NO: 1245847 - DNA, 22 bp, Artificial Sequence
  chemically synthesized
gtgttctagccttccactccac

SEQ ID NO: 1245848 - DNA, 22 bp, Artificial Sequence
  chemically synthesized
tgttctagccttccactccacc

SEQ ID NO: 1245849 - DNA, 22 bp, Artificial Sequence
  chemically synthesized
aagaaaggtgttggtggagtgg

SEQ ID NO: 1245850 - DNA, 22 bp, Artificial Sequence
  chemically synthesized
gaagaaaggtgttggtggagtg

SEQ ID NO: 1245851 - DNA, 22 bp, Artificial Sequence
  chemically synthesized
tagccttccactccaccaacac

SEQ ID NO: 1245852 - DNA, 22 bp, Artificial Sequence
  chemically synthesized
gccttccactccaccaacacct

SEQ ID NO: 1245853 - DNA, 22 bp, Artificial Sequence
  chemically synthesized
ccactccaccaacacctttctt

SEQ ID NO: 1245854 - DNA, 22 bp, Artificial Sequence
  chemically synthesized
cactccaccaacacctttcttc

SEQ ID NO: 1245855 - DNA, 22 bp, Artificial Sequence
  chemically synthesized
aaacagagccttgaagaaaggt

SEQ ID NO: 1245856 - DNA, 22 bp, Artificial Sequence
  chemically synthesized
attcaaacagagccttgaagaa

SEQ ID NO: 1245857 - DNA, 22 bp, Artificial Sequence
  chemically synthesized
caccaacacctttcttcaaggc

SEQ ID NO: 1245858 - DNA, 22 bp, Artificial Sequence
  chemically synthesized
tcttcaaggctctgtttgaatg

SEQ ID NO: 1245859 - DNA, 22 bp, Artificial Sequence
  chemically synthesized
cttcaaggctctgtttgaatga

SEQ ID NO: 1245860 - DNA, 22 bp, Artificial Sequence
  chemically synthesized
ttcaaggctctgtttgaatgaa

SEQ ID NO: 1245861 - DNA, 22 bp, Artificial Sequence
  chemically synthesized
caaggctctgtttgaatgaatt

SEQ ID NO: 1245862 - DNA, 22 bp, Artificial Sequence
  chemically synthesized
aaggctctgtttgaatgaattc

SEQ ID NO: 1245863 - DNA, 22 bp, Artificial Sequence
  chemically synthesized
tgtttgaatgaattcttgattc

SEQ ID NO: 1245864 - DNA, 22 bp, Artificial Sequence
  chemically synthesized
tttgaatgaattcttgattccc

SEQ ID NO: 1245865 - DNA, 22 bp, Artificial Sequence
  chemically synthesized
gaatgaattcttgattcccatg

SEQ ID NO: 1245866 - DNA, 22 bp, Artificial Sequence
  chemically synthesized
aatgaattcttgattcccatgt

SEQ ID NO: 1245867 - DNA, 22 bp, Artificial Sequence
  chemically synthesized
taaaggaatggcaaggcacatg

SEQ ID NO: 1245868 - DNA, 22 bp, Artificial Sequence
  chemically synthesized
ttgattcccatgtgccttgcca

SEQ ID NO: 1245869 - DNA, 22 bp, Artificial Sequence
  chemically synthesized
gttataaaggaatggcaaggca

SEQ ID NO: 1245870 - DNA, 22 bp, Artificial Sequence
  chemically synthesized
gattcccatgtgccttgccatt

SEQ ID NO: 1245871 - DNA, 22 bp, Artificial Sequence
  chemically synthesized
attcccatgtgccttgccattc

SEQ ID NO: 1245872 - DNA, 22 bp, Artificial Sequence
  chemically synthesized
gagttggttataaaggaatggc

SEQ ID NO: 1245873 - DNA, 22 bp, Artificial Sequence
  chemically synthesized
ccatgtgccttgccattccttt

SEQ ID NO: 1245874 - DNA, 22 bp, Artificial Sequence
  chemically synthesized
ggagttggttataaaggaatgg

SEQ ID NO: 1245875 - DNA, 22 bp, Artificial Sequence
  chemically synthesized
tggagttggttataaaggaatg

SEQ ID NO: 1245876 - DNA, 22 bp, Artificial Sequence
  chemically synthesized
ttggagttggttataaaggaat

SEQ ID NO: 1245877 - DNA, 22 bp, Artificial Sequence
  chemically synthesized
tttggagttggttataaaggaa

SEQ ID NO: 1245878 - DNA, 22 bp, Artificial Sequence
  chemically synthesized
ttttggagttggttataaagga

SEQ ID NO: 1245879 - DNA, 22 bp, Artificial Sequence
  chemically synthesized
tttttggagttggttataaagg

SEQ ID NO: 1245880 - DNA, 22 bp, Artificial Sequence
  chemically synthesized
gccattcctttataaccaactc

SEQ ID NO: 1245881 - DNA, 22 bp, Artificial Sequence
  chemically synthesized
ccattcctttataaccaactcc

SEQ ID NO: 1245882 - DNA, 22 bp, Artificial Sequence
  chemically synthesized
ctttataaccaactccaaaaaa

SEQ ID NO: 1245883 - DNA, 22 bp, Artificial Sequence
  chemically synthesized
tataaccaactccaaaaaaagt

SEQ ID NO: 1245884 - DNA, 22 bp, Artificial Sequence
  chemically synthesized
ataaccaactccaaaaaaagtc

SEQ ID NO: 1245885 - DNA, 22 bp, Artificial Sequence
  chemically synthesized
taaccaactccaaaaaaagtcc

SEQ ID NO: 1245886 - DNA, 22 bp, Artificial Sequence
  chemically synthesized
caaaaaaagtccctcctgatct

SEQ ID NO: 1245887 - DNA, 22 bp, Artificial Sequence
  chemically synthesized
ctgatcttgcggtctctcggtc

SEQ ID NO: 1245888 - DNA, 22 bp, Artificial Sequence
  chemically synthesized
atcttgcggtctctcggtcatt

SEQ ID NO: 1245889 - DNA, 22 bp, Artificial Sequence
  chemically synthesized
agggacatgaacaaatgaccga

SEQ ID NO: 1245890 - DNA, 22 bp, Artificial Sequence
  chemically synthesized
gcggtctctcggtcatttgttc

SEQ ID NO: 1245891 - DNA, 22 bp, Artificial Sequence
  chemically synthesized
cggtctctcggtcatttgttca

SEQ ID NO: 1245892 - DNA, 22 bp, Artificial Sequence
  chemically synthesized
tcggtcatttgttcatgtccct

SEQ ID NO: 1245893 - DNA, 22 bp, Artificial Sequence
  chemically synthesized
ggtcatttgttcatgtccctta

SEQ ID NO: 1245894 - DNA, 22 bp, Artificial Sequence
  chemically synthesized
gttcatgtcccttaatgacata

SEQ ID NO: 1245895 - DNA, 22 bp, Artificial Sequence
  chemically synthesized
ttcatgtcccttaatgacatat

SEQ ID NO: 1245896 - DNA, 22 bp, Artificial Sequence
  chemically synthesized
atgtcccttaatgacatattgt

SEQ ID NO: 1245897 - DNA, 22 bp, Artificial Sequence
  chemically synthesized
aagtcagataatgacaatatgt

SEQ ID NO: 1245898 - DNA, 22 bp, Artificial Sequence
  chemically synthesized
caagtcagataatgacaatatg

SEQ ID NO: 1245899 - DNA, 22 bp, Artificial Sequence
  chemically synthesized
aatgacatattgtcattatctg

SEQ ID NO: 1245900 - DNA, 22 bp, Artificial Sequence
  chemically synthesized
atgacatattgtcattatctga

SEQ ID NO: 1245901 - DNA, 22 bp, Artificial Sequence
  chemically synthesized
caacaacttcaagtcagataat

SEQ ID NO: 1245902 - DNA, 22 bp, Artificial Sequence
  chemically synthesized
tcattatctgacttgaagttgt

SEQ ID NO: 1245903 - DNA, 22 bp, Artificial Sequence
  chemically synthesized
tctgacttgaagttgttgtagg

SEQ ID NO: 1245904 - DNA, 22 bp, Artificial Sequence
  chemically synthesized
acttgaagttgttgtaggtttc

SEQ ID NO: 1245905 - DNA, 22 bp, Artificial Sequence
  chemically synthesized
ataaagtagtgaggaaacctac

SEQ ID NO: 1245906 - DNA, 22 bp, Artificial Sequence
  chemically synthesized
gaagttgttgtaggtttcctca

SEQ ID NO: 1245907 - DNA, 22 bp, Artificial Sequence
  chemically synthesized
aagttgttgtaggtttcctcac

SEQ ID NO: 1245908 - DNA, 22 bp, Artificial Sequence
  chemically synthesized
ttgtaggtttcctcactacttt

SEQ ID NO: 1245909 - DNA, 22 bp, Artificial Sequence
  chemically synthesized
agccaggggctcataaagtagt

SEQ ID NO: 1245910 - DNA, 22 bp, Artificial Sequence
  chemically synthesized
taggtttcctcactactttatg

SEQ ID NO: 1245911 - DNA, 22 bp, Artificial Sequence
  chemically synthesized
cagccaggggctcataaagtag

SEQ ID NO: 1245912 - DNA, 22 bp, Artificial Sequence
  chemically synthesized
tcagccaggggctcataaagta

SEQ ID NO: 1245913 - DNA, 22 bp, Artificial Sequence
  chemically synthesized
cctcactactttatgagcccct

SEQ ID NO: 1245914 - DNA, 22 bp, Artificial Sequence
  chemically synthesized
ctcactactttatgagcccctg

SEQ ID NO: 1245915 - DNA, 22 bp, Artificial Sequence
  chemically synthesized
actactttatgagcccctggct

SEQ ID NO: 1245916 - DNA, 22 bp, Artificial Sequence
  chemically synthesized
ctttatgagcccctggctgaaa

SEQ ID NO: 1245917 - DNA, 22 bp, Artificial Sequence
  chemically synthesized
aaaaaaaatatctttcagccag

SEQ ID NO: 1245918 - DNA, 22 bp, Artificial Sequence
  chemically synthesized
tatgagcccctggctgaaagat

SEQ ID NO: 1245919 - DNA, 22 bp, Artificial Sequence
  chemically synthesized
atgagcccctggctgaaagata

SEQ ID NO: 1245920 - DNA, 22 bp, Artificial Sequence
  chemically synthesized
tgagcccctggctgaaagatat

SEQ ID NO: 1245921 - DNA, 22 bp, Artificial Sequence
  chemically synthesized
gtaggggattaaaaaaaaatat

SEQ ID NO: 1245922 - DNA, 22 bp, Artificial Sequence
  chemically synthesized
agtaggggattaaaaaaaaata

SEQ ID NO: 1245923 - DNA, 22 bp, Artificial Sequence
  chemically synthesized
tagtaggggattaaaaaaaaat

SEQ ID NO: 1245924 - DNA, 22 bp, Artificial Sequence
  chemically synthesized
gctgaaagatatttttttttaa

SEQ ID NO: 1245925 - DNA, 22 bp, Artificial Sequence
  chemically synthesized
gttttagtaggggattaaaaaa

SEQ ID NO: 1245926 - DNA, 22 bp, Artificial Sequence
  chemically synthesized
aaagatatttttttttaatccc

SEQ ID NO: 1245927 - DNA, 22 bp, Artificial Sequence
  chemically synthesized
ttttttaatcccctactaaaac

SEQ ID NO: 1245928 - DNA, 22 bp, Artificial Sequence
  chemically synthesized
tttttaatcccctactaaaact

SEQ ID NO: 1245929 - DNA, 22 bp, Artificial Sequence
  chemically synthesized
ttttaatcccctactaaaacta

SEQ ID NO: 1245930 - DNA, 22 bp, Artificial Sequence
  chemically synthesized
tttaatcccctactaaaactag

SEQ ID NO: 1245931 - DNA, 22 bp, Artificial Sequence
  chemically synthesized
ttaatcccctactaaaactagc

SEQ ID NO: 1245932 - DNA, 22 bp, Artificial Sequence
  chemically synthesized
taatcccctactaaaactagca

SEQ ID NO: 1245933 - DNA, 22 bp, Artificial Sequence
  chemically synthesized
aatcccctactaaaactagcat

SEQ ID NO: 1245934 - DNA, 22 bp, Artificial Sequence
  chemically synthesized
atcccctactaaaactagcatt

SEQ ID NO: 1245935 - DNA, 22 bp, Artificial Sequence
  chemically synthesized
tgtgcaatagacaatgctagtt

SEQ ID NO: 1245936 - DNA, 22 bp, Artificial Sequence
  chemically synthesized
actatgtgcaatagacaatgct

SEQ ID NO: 1245937 - DNA, 22 bp, Artificial Sequence
  chemically synthesized
ctaaaactagcattgtctattg

SEQ ID NO: 1245938 - DNA, 22 bp, Artificial Sequence
  chemically synthesized
aaactagcattgtctattgcac

SEQ ID NO: 1245939 - DNA, 22 bp, Artificial Sequence
  chemically synthesized
gcattgtctattgcacatagtg

SEQ ID NO: 1245940 - DNA, 22 bp, Artificial Sequence
  chemically synthesized
agaaacacggaacattcactat

SEQ ID NO: 1245941 - DNA, 22 bp, Artificial Sequence
  chemically synthesized
aagaaacacggaacattcacta

SEQ ID NO: 1245942 - DNA, 22 bp, Artificial Sequence
  chemically synthesized
tctattgcacatagtgaatgtt

SEQ ID NO: 1245943 - DNA, 22 bp, Artificial Sequence
  chemically synthesized
ttgcacatagtgaatgttccgt

SEQ ID NO: 1245944 - DNA, 22 bp, Artificial Sequence
  chemically synthesized
caaatttaagaaacacggaaca

SEQ ID NO: 1245945 - DNA, 22 bp, Artificial Sequence
  chemically synthesized
cacatagtgaatgttccgtgtt

SEQ ID NO: 1245946 - DNA, 22 bp, Artificial Sequence
  chemically synthesized
aacagctccaaatttaagaaac

SEQ ID NO: 1245947 - DNA, 22 bp, Artificial Sequence
  chemically synthesized
ttcaacagctccaaatttaaga

SEQ ID NO: 1245948 - DNA, 22 bp, Artificial Sequence
  chemically synthesized
cgtgtttcttaaatttggagct

SEQ ID NO: 1245949 - DNA, 22 bp, Artificial Sequence
  chemically synthesized
aaactgttcaacagctccaaat

SEQ ID NO: 1245950 - DNA, 22 bp, Artificial Sequence
  chemically synthesized
cttaaatttggagctgttgaac

SEQ ID NO: 1245951 - DNA, 22 bp, Artificial Sequence
  chemically synthesized
aaaactgaaactgttcaacagc

SEQ ID NO: 1245952 - DNA, 22 bp, Artificial Sequence
  chemically synthesized
ttaaatttggagctgttgaaca

SEQ ID NO: 1245953 - DNA, 22 bp, Artificial Sequence
  chemically synthesized
aaatttggagctgttgaacagt

SEQ ID NO: 1245954 - DNA, 22 bp, Artificial Sequence
  chemically synthesized
aatttggagctgttgaacagtt

SEQ ID NO: 1245955 - DNA, 22 bp, Artificial Sequence
  chemically synthesized
ggagctgttgaacagtttcagt

SEQ ID NO: 1245956 - DNA, 22 bp, Artificial Sequence
  chemically synthesized
gagctgttgaacagtttcagtt

SEQ ID NO: 1245957 - DNA, 22 bp, Artificial Sequence
  chemically synthesized
ttgaacagtttcagttttcagc

SEQ ID NO: 1245958 - DNA, 22 bp, Artificial Sequence
  chemically synthesized
aacagtttcagttttcagctac

SEQ ID NO: 1245959 - DNA, 22 bp, Artificial Sequence
  chemically synthesized
agtcaaaaagtgaatgtagctg

SEQ ID NO: 1245960 - DNA, 22 bp, Artificial Sequence
  chemically synthesized
cagttttcagctacattcactt

SEQ ID NO: 1245961 - DNA, 22 bp, Artificial Sequence
  chemically synthesized
agttttcagctacattcacttt

SEQ ID NO: 1245962 - DNA, 22 bp, Artificial Sequence
  chemically synthesized
tcagctacattcactttttgac

SEQ ID NO: 1245963 - DNA, 22 bp, Artificial Sequence
  chemically synthesized
tggtacaactcagtcaaaaagt

SEQ ID NO: 1245964 - DNA, 22 bp, Artificial Sequence
  chemically synthesized
cagctacattcactttttgact

SEQ ID NO: 1245965 - DNA, 22 bp, Artificial Sequence
  chemically synthesized
agctacattcactttttgactg

SEQ ID NO: 1245966 - DNA, 22 bp, Artificial Sequence
  chemically synthesized
cattcactttttgactgagttg

SEQ ID NO: 1245967 - DNA, 22 bp, Artificial Sequence
  chemically synthesized
gtgtcacctatggtacaactca

SEQ ID NO: 1245968 - DNA, 22 bp, Artificial Sequence
  chemically synthesized
actttttgactgagttgtacca

SEQ ID NO: 1245969 - DNA, 22 bp, Artificial Sequence
  chemically synthesized
tttgactgagttgtaccatagg

SEQ ID NO: 1245970 - DNA, 22 bp, Artificial Sequence
  chemically synthesized
ttgactgagttgtaccataggt

SEQ ID NO: 1245971 - DNA, 22 bp, Artificial Sequence
  chemically synthesized
tgactgagttgtaccataggtg

SEQ ID NO: 1245972 - DNA, 22 bp, Artificial Sequence
  chemically synthesized
gactgagttgtaccataggtga

SEQ ID NO: 1245973 - DNA, 22 bp, Artificial Sequence
  chemically synthesized
actgagttgtaccataggtgac

SEQ ID NO: 1245974 - DNA, 22 bp, Artificial Sequence
  chemically synthesized
gcacagattagtgtcacctatg

SEQ ID NO: 1245975 - DNA, 22 bp, Artificial Sequence
  chemically synthesized
ggcacagattagtgtcacctat

SEQ ID NO: 1245976 - DNA, 22 bp, Artificial Sequence
  chemically synthesized
agttgtaccataggtgacacta

SEQ ID NO: 1245977 - DNA, 22 bp, Artificial Sequence
  chemically synthesized
taccataggtgacactaatctg

SEQ ID NO: 1245978 - DNA, 22 bp, Artificial Sequence
  chemically synthesized
aatgtgccccatttggcacaga

SEQ ID NO: 1245979 - DNA, 22 bp, Artificial Sequence
  chemically synthesized
aaatgtgccccatttggcacag

SEQ ID NO: 1245980 - DNA, 22 bp, Artificial Sequence
  chemically synthesized
atctgtgccaaatggggcacat

SEQ ID NO: 1245981 - DNA, 22 bp, Artificial Sequence
  chemically synthesized
tgccaaatggggcacatttaaa

SEQ ID NO: 1245982 - DNA, 22 bp, Artificial Sequence
  chemically synthesized
aagtaatagtgtaagtagttta

SEQ ID NO: 1245983 - DNA, 22 bp, Artificial Sequence
  chemically synthesized
aaactacttacactattacttt

SEQ ID NO: 1245984 - DNA, 22 bp, Artificial Sequence
  chemically synthesized
aatgaaaacattaaagtaatag

SEQ ID NO: 1245985 - DNA, 22 bp, Artificial Sequence
  chemically synthesized
aactacttacactattacttta

SEQ ID NO: 1245986 - DNA, 22 bp, Artificial Sequence
  chemically synthesized
cgttcaatgaaaacattaaagt

SEQ ID NO: 1245987 - DNA, 22 bp, Artificial Sequence
  chemically synthesized
cttacactattactttaatgtt

SEQ ID NO: 1245988 - DNA, 22 bp, Artificial Sequence
  chemically synthesized
ctgcgttcaatgaaaacattaa

SEQ ID NO: 1245989 - DNA, 22 bp, Artificial Sequence
  chemically synthesized
acactattactttaatgttttc

SEQ ID NO: 1245990 - DNA, 22 bp, Artificial Sequence
  chemically synthesized
cactattactttaatgttttca

SEQ ID NO: 1245991 - DNA, 22 bp, Artificial Sequence
  chemically synthesized
ttactttaatgttttcattgaa

SEQ ID NO: 1245992 - DNA, 22 bp, Artificial Sequence
  chemically synthesized
caaagattcctgcgttcaatga

SEQ ID NO: 1245993 - DNA, 22 bp, Artificial Sequence
  chemically synthesized
ctttaatgttttcattgaacgc

SEQ ID NO: 1245994 - DNA, 22 bp, Artificial Sequence
  chemically synthesized
taatgttttcattgaacgcagg

SEQ ID NO: 1245995 - DNA, 22 bp, Artificial Sequence
  chemically synthesized
aatgttttcattgaacgcagga

SEQ ID NO: 1245996 - DNA, 22 bp, Artificial Sequence
  chemically synthesized
atgttttcattgaacgcaggaa

SEQ ID NO: 1245997 - DNA, 22 bp, Artificial Sequence
  chemically synthesized
gaggctacaaagattcctgcgt

SEQ ID NO: 1245998 - DNA, 22 bp, Artificial Sequence
  chemically synthesized
tcattgaacgcaggaatctttg

SEQ ID NO: 1245999 - DNA, 22 bp, Artificial Sequence
  chemically synthesized
cattgaacgcaggaatctttgt

SEQ ID NO: 1246000 - DNA, 22 bp, Artificial Sequence
  chemically synthesized
attgaacgcaggaatctttgta

SEQ ID NO: 1246001 - DNA, 22 bp, Artificial Sequence
  chemically synthesized
aatgtacctagaggctacaaag

SEQ ID NO: 1246002 - DNA, 22 bp, Artificial Sequence
  chemically synthesized
aacgcaggaatctttgtagcct

SEQ ID NO: 1246003 - DNA, 22 bp, Artificial Sequence
  chemically synthesized
aaatgtacctagaggctacaaa

SEQ ID NO: 1246004 - DNA, 22 bp, Artificial Sequence
  chemically synthesized
aagtttaaatgtacctagaggc

SEQ ID NO: 1246005 - DNA, 22 bp, Artificial Sequence
  chemically synthesized
aaagtttaaatgtacctagagg

SEQ ID NO: 1246006 - DNA, 22 bp, Artificial Sequence
  chemically synthesized
tcttaaagtttaaatgtaccta

SEQ ID NO: 1246007 - DNA, 22 bp, Artificial Sequence
  chemically synthesized
atcttaaagtttaaatgtacct

SEQ ID NO: 1246008 - DNA, 22 bp, Artificial Sequence
  chemically synthesized
tatcttaaagtttaaatgtacc

SEQ ID NO: 1246009 - DNA, 22 bp, Artificial Sequence
  chemically synthesized
tgtagcctctaggtacatttaa

SEQ ID NO: 1246010 - DNA, 22 bp, Artificial Sequence
  chemically synthesized
ttatcttaaagtttaaatgtac

SEQ ID NO: 1246011 - DNA, 22 bp, Artificial Sequence
  chemically synthesized
gtagcctctaggtacatttaaa

SEQ ID NO: 1246012 - DNA, 22 bp, Artificial Sequence
  chemically synthesized
tagcctctaggtacatttaaac

SEQ ID NO: 1246013 - DNA, 22 bp, Artificial Sequence
  chemically synthesized
taggtacatttaaactttaaga

SEQ ID NO: 1246014 - DNA, 22 bp, Artificial Sequence
  chemically synthesized
ggtacatttaaactttaagata

SEQ ID NO: 1246015 - DNA, 22 bp, Artificial Sequence
  chemically synthesized
acagaatataatttttatctta

SEQ ID NO: 1246016 - DNA, 22 bp, Artificial Sequence
  chemically synthesized
gacagaatataatttttatctt

SEQ ID NO: 1246017 - DNA, 22 bp, Artificial Sequence
  chemically synthesized
aaactttaagataaaaattata

SEQ ID NO: 1246018 - DNA, 22 bp, Artificial Sequence
  chemically synthesized
aactttaagataaaaattatat

SEQ ID NO: 1246019 - DNA, 22 bp, Artificial Sequence
  chemically synthesized
taaatcatttgacagaatataa

SEQ ID NO: 1246020 - DNA, 22 bp, Artificial Sequence
  chemically synthesized
taagataaaaattatattctgt

SEQ ID NO: 1246021 - DNA, 22 bp, Artificial Sequence
  chemically synthesized
aagataaaaattatattctgtc

SEQ ID NO: 1246022 - DNA, 22 bp, Artificial Sequence
  chemically synthesized
agataaaaattatattctgtca

SEQ ID NO: 1246023 - DNA, 22 bp, Artificial Sequence
  chemically synthesized
attataaatcatttgacagaat

SEQ ID NO: 1246024 - DNA, 22 bp, Artificial Sequence
  chemically synthesized
tattctgtcaaatgatttataa

SEQ ID NO: 1246025 - DNA, 22 bp, Artificial Sequence
  chemically synthesized
gcaatggtattgattataaatc

SEQ ID NO: 1246026 - DNA, 22 bp, Artificial Sequence
  chemically synthesized
tgtcaaatgatttataatcaat

SEQ ID NO: 1246027 - DNA, 22 bp, Artificial Sequence
  chemically synthesized
attggcaatggtattgattata

SEQ ID NO: 1246028 - DNA, 22 bp, Artificial Sequence
  chemically synthesized
aattggcaatggtattgattat

SEQ ID NO: 1246029 - DNA, 22 bp, Artificial Sequence
  chemically synthesized
tcaaatgatttataatcaatac

SEQ ID NO: 1246030 - DNA, 22 bp, Artificial Sequence
  chemically synthesized
taattggcaatggtattgatta

SEQ ID NO: 1246031 - DNA, 22 bp, Artificial Sequence
  chemically synthesized
attttaattggcaatggtattg

SEQ ID NO: 1246032 - DNA, 22 bp, Artificial Sequence
  chemically synthesized
gattttaattggcaatggtatt

SEQ ID NO: 1246033 - DNA, 22 bp, Artificial Sequence
  chemically synthesized
tttgattttaattggcaatggt

SEQ ID NO: 1246034 - DNA, 22 bp, Artificial Sequence
  chemically synthesized
ataatcaataccattgccaatt

SEQ ID NO: 1246035 - DNA, 22 bp, Artificial Sequence
  chemically synthesized
ttatttgattttaattggcaat

SEQ ID NO: 1246036 - DNA, 22 bp, Artificial Sequence
  chemically synthesized
taatcaataccattgccaatta

SEQ ID NO: 1246037 - DNA, 22 bp, Artificial Sequence
  chemically synthesized
tgtctattatttgattttaatt

SEQ ID NO: 1246038 - DNA, 22 bp, Artificial Sequence
  chemically synthesized
tgtgtctattatttgattttaa

SEQ ID NO: 1246039 - DNA, 22 bp, Artificial Sequence
  chemically synthesized
ctgtgtctattatttgatttta

SEQ ID NO: 1246040 - DNA, 22 bp, Artificial Sequence
  chemically synthesized
ccaattaaaatcaaataataga

SEQ ID NO: 1246041 - DNA, 22 bp, Artificial Sequence
  chemically synthesized
aggcacttctgtgtctattatt

SEQ ID NO: 1246042 - DNA, 22 bp, Artificial Sequence
  chemically synthesized
gaggcacttctgtgtctattat

SEQ ID NO: 1246043 - DNA, 22 bp, Artificial Sequence
  chemically synthesized
tgaggcacttctgtgtctatta

SEQ ID NO: 1246044 - DNA, 22 bp, Artificial Sequence
  chemically synthesized
aaatcaaataatagacacagaa

SEQ ID NO: 1246045 - DNA, 22 bp, Artificial Sequence
  chemically synthesized
aagctttgaggcacttctgtgt

SEQ ID NO: 1246046 - DNA, 22 bp, Artificial Sequence
  chemically synthesized
gttgaagctttgaggcacttct

SEQ ID NO: 1246047 - DNA, 22 bp, Artificial Sequence
  chemically synthesized
agttgaagctttgaggcacttc

SEQ ID NO: 1246048 - DNA, 22 bp, Artificial Sequence
  chemically synthesized
tcttagttgaagctttgaggca

SEQ ID NO: 1246049 - DNA, 22 bp, Artificial Sequence
  chemically synthesized
tgtctatcttagttgaagcttt

SEQ ID NO: 1246050 - DNA, 22 bp, Artificial Sequence
  chemically synthesized
gtgtctatcttagttgaagctt

SEQ ID NO: 1246051 - DNA, 22 bp, Artificial Sequence
  chemically synthesized
tgtgtctatcttagttgaagct

SEQ ID NO: 1246052 - DNA, 22 bp, Artificial Sequence
  chemically synthesized
gcacccctttgtgtctatctta

SEQ ID NO: 1246053 - DNA, 22 bp, Artificial Sequence
  chemically synthesized
aaagcttcaactaagatagaca

SEQ ID NO: 1246054 - DNA, 22 bp, Artificial Sequence
  chemically synthesized
tccactggcacccctttgtgtc

SEQ ID NO: 1246055 - DNA, 22 bp, Artificial Sequence
  chemically synthesized
caactaagatagacacaaaggg

SEQ ID NO: 1246056 - DNA, 22 bp, Artificial Sequence
  chemically synthesized
aactaagatagacacaaagggg

SEQ ID NO: 1246057 - DNA, 22 bp, Artificial Sequence
  chemically synthesized
ttatccactggcacccctttgt

SEQ ID NO: 1246058 - DNA, 22 bp, Artificial Sequence
  chemically synthesized
agatagacacaaaggggtgcca

SEQ ID NO: 1246059 - DNA, 22 bp, Artificial Sequence
  chemically synthesized
tgaaataacactgttatccact

SEQ ID NO: 1246060 - DNA, 22 bp, Artificial Sequence
  chemically synthesized
tgattatgaaataacactgtta

SEQ ID NO: 1246061 - DNA, 22 bp, Artificial Sequence
  chemically synthesized
gagggaaaagggaagctgtgat

SEQ ID NO: 1246062 - DNA, 22 bp, Artificial Sequence
  chemically synthesized
ctagagggaaaagggaagctgt

SEQ ID NO: 1246063 - DNA, 22 bp, Artificial Sequence
  chemically synthesized
tttcataatcacagcttccctt

SEQ ID NO: 1246064 - DNA, 22 bp, Artificial Sequence
  chemically synthesized
cataatcacagcttcccttttc

SEQ ID NO: 1246065 - DNA, 22 bp, Artificial Sequence
  chemically synthesized
ataatcacagcttcccttttcc

SEQ ID NO: 1246066 - DNA, 22 bp, Artificial Sequence
  chemically synthesized
catcagaataattgctagaggg

SEQ ID NO: 1246067 - DNA, 22 bp, Artificial Sequence
  chemically synthesized
tgcatcagaataattgctagag

SEQ ID NO: 1246068 - DNA, 22 bp, Artificial Sequence
  chemically synthesized
cccttttccctctagcaattat

SEQ ID NO: 1246069 - DNA, 22 bp, Artificial Sequence
  chemically synthesized
ccttttccctctagcaattatt

SEQ ID NO: 1246070 - DNA, 22 bp, Artificial Sequence
  chemically synthesized
attctgcatcagaataattgct

SEQ ID NO: 1246071 - DNA, 22 bp, Artificial Sequence
  chemically synthesized
ttccctctagcaattattctga

SEQ ID NO: 1246072 - DNA, 22 bp, Artificial Sequence
  chemically synthesized
tccctctagcaattattctgat

SEQ ID NO: 1246073 - DNA, 22 bp, Artificial Sequence
  chemically synthesized
ccctctagcaattattctgatg

SEQ ID NO: 1246074 - DNA, 22 bp, Artificial Sequence
  chemically synthesized
agactgattctgcatcagaata

SEQ ID NO: 1246075 - DNA, 22 bp, Artificial Sequence
  chemically synthesized
cctctagcaattattctgatgc

SEQ ID NO: 1246076 - DNA, 22 bp, Artificial Sequence
  chemically synthesized
aagactgattctgcatcagaat

SEQ ID NO: 1246077 - DNA, 22 bp, Artificial Sequence
  chemically synthesized
ttaagactgattctgcatcaga

SEQ ID NO: 1246078 - DNA, 22 bp, Artificial Sequence
  chemically synthesized
tagcaattattctgatgcagaa

SEQ ID NO: 1246079 - DNA, 22 bp, Artificial Sequence
  chemically synthesized
gcaattattctgatgcagaatc

SEQ ID NO: 1246080 - DNA, 22 bp, Artificial Sequence
  chemically synthesized
cagaaacctcttaagactgatt

SEQ ID NO: 1246081 - DNA, 22 bp, Artificial Sequence
  chemically synthesized
ttctgatgcagaatcagtctta

SEQ ID NO: 1246082 - DNA, 22 bp, Artificial Sequence
  chemically synthesized
tgatgcagaatcagtcttaaga

SEQ ID NO: 1246083 - DNA, 22 bp, Artificial Sequence
  chemically synthesized
gctgcagaaacctcttaagact

SEQ ID NO: 1246084 - DNA, 22 bp, Artificial Sequence
  chemically synthesized
atgcagaatcagtcttaagagg

SEQ ID NO: 1246085 - DNA, 22 bp, Artificial Sequence
  chemically synthesized
catctagctgcagaaacctctt

SEQ ID NO: 1246086 - DNA, 22 bp, Artificial Sequence
  chemically synthesized
acatctagctgcagaaacctct

SEQ ID NO: 1246087 - DNA, 22 bp, Artificial Sequence
  chemically synthesized
tttacatctagctgcagaaacc

SEQ ID NO: 1246088 - DNA, 22 bp, Artificial Sequence
  chemically synthesized
gtttacatctagctgcagaaac

SEQ ID NO: 1246089 - DNA, 22 bp, Artificial Sequence
  chemically synthesized
tgtttacatctagctgcagaaa

SEQ ID NO: 1246090 - DNA, 22 bp, Artificial Sequence
  chemically synthesized
tttgtttacatctagctgcaga

SEQ ID NO: 1246091 - DNA, 22 bp, Artificial Sequence
  chemically synthesized
ctttgtttacatctagctgcag

SEQ ID NO: 1246092 - DNA, 22 bp, Artificial Sequence
  chemically synthesized
aagaggtttctgcagctagatg

SEQ ID NO: 1246093 - DNA, 22 bp, Artificial Sequence
  chemically synthesized
agaggtttctgcagctagatgt

SEQ ID NO: 1246094 - DNA, 22 bp, Artificial Sequence
  chemically synthesized
taatgatacttctttgtttaca

SEQ ID NO: 1246095 - DNA, 22 bp, Artificial Sequence
  chemically synthesized
ctgcagctagatgtaaacaaag

SEQ ID NO: 1246096 - DNA, 22 bp, Artificial Sequence
  chemically synthesized
gtaatgatacttctttgtttac

SEQ ID NO: 1246097 - DNA, 22 bp, Artificial Sequence
  chemically synthesized
tgcagctagatgtaaacaaaga

SEQ ID NO: 1246098 - DNA, 22 bp, Artificial Sequence
  chemically synthesized
tgtaatgatacttctttgttta

SEQ ID NO: 1246099 - DNA, 22 bp, Artificial Sequence
  chemically synthesized
cagctagatgtaaacaaagaag

SEQ ID NO: 1246100 - DNA, 22 bp, Artificial Sequence
  chemically synthesized
gatgtaaacaaagaagtatcat

SEQ ID NO: 1246101 - DNA, 22 bp, Artificial Sequence
  chemically synthesized
caaaactcacttgactacactt

SEQ ID NO: 1246102 - DNA, 22 bp, Artificial Sequence
  chemically synthesized
cccaaccagggtgtcagaagtg

SEQ ID NO: 1246103 - DNA, 22 bp, Artificial Sequence
  chemically synthesized
ccccaaccagggtgtcagaagt

SEQ ID NO: 1246104 - DNA, 22 bp, Artificial Sequence
  chemically synthesized
acttgactacacttctgacacc

SEQ ID NO: 1246105 - DNA, 22 bp, Artificial Sequence
  chemically synthesized
gactacacttctgacaccctgg

SEQ ID NO: 1246106 - DNA, 22 bp, Artificial Sequence
  chemically synthesized
actacacttctgacaccctggt

SEQ ID NO: 1246107 - DNA, 22 bp, Artificial Sequence
  chemically synthesized
cacttctgacaccctggttggg

SEQ ID NO: 1246108 - DNA, 22 bp, Artificial Sequence
  chemically synthesized
ctgacaccctggttggggaaat

SEQ ID NO: 1246109 - DNA, 22 bp, Artificial Sequence
  chemically synthesized
tgacaccctggttggggaaatg

SEQ ID NO: 1246110 - DNA, 22 bp, Artificial Sequence
  chemically synthesized
acaccctggttggggaaatgta

SEQ ID NO: 1246111 - DNA, 22 bp, Artificial Sequence
  chemically synthesized
gttggggaaatgtatatggatt

SEQ ID NO: 1246112 - DNA, 22 bp, Artificial Sequence
  chemically synthesized
tcagtcagacatatcaatccat

SEQ ID NO: 1246113 - DNA, 22 bp, Artificial Sequence
  chemically synthesized
gggaaatgtatatggattgata

SEQ ID NO: 1246114 - DNA, 22 bp, Artificial Sequence
  chemically synthesized
gtcagtcagacatatcaatcca

SEQ ID NO: 1246115 - DNA, 22 bp, Artificial Sequence
  chemically synthesized
ttgtcagtcagacatatcaatc

SEQ ID NO: 1246116 - DNA, 22 bp, Artificial Sequence
  chemically synthesized
agttcttgtcagtcagacatat

SEQ ID NO: 1246117 - DNA, 22 bp, Artificial Sequence
  chemically synthesized
gagttcttgtcagtcagacata

SEQ ID NO: 1246118 - DNA, 22 bp, Artificial Sequence
  chemically synthesized
tgagttcttgtcagtcagacat

SEQ ID NO: 1246119 - DNA, 22 bp, Artificial Sequence
  chemically synthesized
aattttgagttcttgtcagtca

SEQ ID NO: 1246120 - DNA, 22 bp, Artificial Sequence
  chemically synthesized
aaattttgagttcttgtcagtc

SEQ ID NO: 1246121 - DNA, 22 bp, Artificial Sequence
  chemically synthesized
atatgtctgactgacaagaact

SEQ ID NO: 1246122 - DNA, 22 bp, Artificial Sequence
  chemically synthesized
actgacaagaactcaaaattta

SEQ ID NO: 1246123 - DNA, 22 bp, Artificial Sequence
  chemically synthesized
gacaagggatcatttaaatttt

SEQ ID NO: 1246124 - DNA, 22 bp, Artificial Sequence
  chemically synthesized
ggacaagggatcatttaaattt

SEQ ID NO: 1246125 - DNA, 22 bp, Artificial Sequence
  chemically synthesized
acaagaactcaaaatttaaatg

SEQ ID NO: 1246126 - DNA, 22 bp, Artificial Sequence
  chemically synthesized
ttggacaagggatcatttaaat

SEQ ID NO: 1246127 - DNA, 22 bp, Artificial Sequence
  chemically synthesized
aaaatttaaatgatcccttgtc

SEQ ID NO: 1246128 - DNA, 22 bp, Artificial Sequence
  chemically synthesized
aaatgatcccttgtccaagagc

SEQ ID NO: 1246129 - DNA, 22 bp, Artificial Sequence
  chemically synthesized
aatgatcccttgtccaagagcc

SEQ ID NO: 1246130 - DNA, 22 bp, Artificial Sequence
  chemically synthesized
aatgataaccacagggctcttg

SEQ ID NO: 1246131 - DNA, 22 bp, Artificial Sequence
  chemically synthesized
taaatgataaccacagggctct

SEQ ID NO: 1246132 - DNA, 22 bp, Artificial Sequence
  chemically synthesized
gtccaagagccctgtggttatc

SEQ ID NO: 1246133 - DNA, 22 bp, Artificial Sequence
  chemically synthesized
tccaagagccctgtggttatca

SEQ ID NO: 1246134 - DNA, 22 bp, Artificial Sequence
  chemically synthesized
tgcagatgaattctaaatgata

SEQ ID NO: 1246135 - DNA, 22 bp, Artificial Sequence
  chemically synthesized
gtgcagatgaattctaaatgat

SEQ ID NO: 1246136 - DNA, 22 bp, Artificial Sequence
  chemically synthesized
tggttatcatttagaattcatc

SEQ ID NO: 1246137 - DNA, 22 bp, Artificial Sequence
  chemically synthesized
atgacttgtgcagatgaattct

SEQ ID NO: 1246138 - DNA, 22 bp, Artificial Sequence
  chemically synthesized
aatgacttgtgcagatgaattc

SEQ ID NO: 1246139 - DNA, 22 bp, Artificial Sequence
  chemically synthesized
tcatttagaattcatctgcaca

SEQ ID NO: 1246140 - DNA, 22 bp, Artificial Sequence
  chemically synthesized
agaattcatctgcacaagtcat

SEQ ID NO: 1246141 - DNA, 22 bp, Artificial Sequence
  chemically synthesized
gaattcatctgcacaagtcatt

SEQ ID NO: 1246142 - DNA, 22 bp, Artificial Sequence
  chemically synthesized
caaagagtatacttaatgactt

SEQ ID NO: 1246143 - DNA, 22 bp, Artificial Sequence
  chemically synthesized
ccaaagagtatacttaatgact

SEQ ID NO: 1246144 - DNA, 22 bp, Artificial Sequence
  chemically synthesized
tccaaagagtatacttaatgac

SEQ ID NO: 1246145 - DNA, 22 bp, Artificial Sequence
  chemically synthesized
atctgcacaagtcattaagtat

SEQ ID NO: 1246146 - DNA, 22 bp, Artificial Sequence
  chemically synthesized
cacaagtcattaagtatactct

SEQ ID NO: 1246147 - DNA, 22 bp, Artificial Sequence
  chemically synthesized
cggaacaaaatagttttccaaa

SEQ ID NO: 1246148 - DNA, 22 bp, Artificial Sequence
  chemically synthesized
ccggaacaaaatagttttccaa

SEQ ID NO: 1246149 - DNA, 22 bp, Artificial Sequence
  chemically synthesized
tccggaacaaaatagttttcca

SEQ ID NO: 1246150 - DNA, 22 bp, Artificial Sequence
  chemically synthesized
agtatactctttggaaaactat

SEQ ID NO: 1246151 - DNA, 22 bp, Artificial Sequence
  chemically synthesized
ttccggaacaaaatagttttcc

SEQ ID NO: 1246152 - DNA, 22 bp, Artificial Sequence
  chemically synthesized
catttttccggaacaaaatagt

SEQ ID NO: 1246153 - DNA, 22 bp, Artificial Sequence
  chemically synthesized
acatttttccggaacaaaatag

SEQ ID NO: 1246154 - DNA, 22 bp, Artificial Sequence
  chemically synthesized
tacatttttccggaacaaaata

SEQ ID NO: 1246155 - DNA, 22 bp, Artificial Sequence
  chemically synthesized
tttggaaaactattttgttccg

SEQ ID NO: 1246156 - DNA, 22 bp, Artificial Sequence
  chemically synthesized
tggaaaactattttgttccgga

SEQ ID NO: 1246157 - DNA, 22 bp, Artificial Sequence
  chemically synthesized
actttacatttttccggaacaa

SEQ ID NO: 1246158 - DNA, 22 bp, Artificial Sequence
  chemically synthesized
ggaaaactattttgttccggaa

SEQ ID NO: 1246159 - DNA, 22 bp, Artificial Sequence
  chemically synthesized
gactttacatttttccggaaca

SEQ ID NO: 1246160 - DNA, 22 bp, Artificial Sequence
  chemically synthesized
gaaaactattttgttccggaaa

SEQ ID NO: 1246161 - DNA, 22 bp, Artificial Sequence
  chemically synthesized
ttgactttacatttttccggaa

SEQ ID NO: 1246162 - DNA, 22 bp, Artificial Sequence
  chemically synthesized
cttgactttacatttttccgga

SEQ ID NO: 1246163 - DNA, 22 bp, Artificial Sequence
  chemically synthesized
cttcttgactttacatttttcc

SEQ ID NO: 1246164 - DNA, 22 bp, Artificial Sequence
  chemically synthesized
ttttgttccggaaaaatgtaaa

SEQ ID NO: 1246165 - DNA, 22 bp, Artificial Sequence
  chemically synthesized
ctgcttcttgactttacatttt

SEQ ID NO: 1246166 - DNA, 22 bp, Artificial Sequence
  chemically synthesized
tgttccggaaaaatgtaaagtc

SEQ ID NO: 1246167 - DNA, 22 bp, Artificial Sequence
  chemically synthesized
gttccggaaaaatgtaaagtca

SEQ ID NO: 1246168 - DNA, 22 bp, Artificial Sequence
  chemically synthesized
ttccggaaaaatgtaaagtcaa

SEQ ID NO: 1246169 - DNA, 22 bp, Artificial Sequence
  chemically synthesized
gcattcctgcttcttgacttta

SEQ ID NO: 1246170 - DNA, 22 bp, Artificial Sequence
  chemically synthesized
cggaaaaatgtaaagtcaagaa

SEQ ID NO: 1246171 - DNA, 22 bp, Artificial Sequence
  chemically synthesized
aaatgttagcattcctgcttct

SEQ ID NO: 1246172 - DNA, 22 bp, Artificial Sequence
  chemically synthesized
caaatgttagcattcctgcttc

SEQ ID NO: 1246173 - DNA, 22 bp, Artificial Sequence
  chemically synthesized
tcaaatgttagcattcctgctt

SEQ ID NO: 1246174 - DNA, 22 bp, Artificial Sequence
  chemically synthesized
ttcaaatgttagcattcctgct

SEQ ID NO: 1246175 - DNA, 22 bp, Artificial Sequence
  chemically synthesized
tttcaaatgttagcattcctgc

SEQ ID NO: 1246176 - DNA, 22 bp, Artificial Sequence
  chemically synthesized
ttttcaaatgttagcattcctg

SEQ ID NO: 1246177 - DNA, 22 bp, Artificial Sequence
  chemically synthesized
aagaagcttttttcaaatgtta

SEQ ID NO: 1246178 - DNA, 22 bp, Artificial Sequence
  chemically synthesized
ttaaagaagcttttttcaaatg

SEQ ID NO: 1246179 - DNA, 22 bp, Artificial Sequence
  chemically synthesized
tagcattattaaagaagctttt

SEQ ID NO: 1246180 - DNA, 22 bp, Artificial Sequence
  chemically synthesized
acatttgaaaaaagcttcttta

SEQ ID NO: 1246181 - DNA, 22 bp, Artificial Sequence
  chemically synthesized
agaattatagcattattaaaga

SEQ ID NO: 1246182 - DNA, 22 bp, Artificial Sequence
  chemically synthesized
gaaaaaagcttctttaataatg

SEQ ID NO: 1246183 - DNA, 22 bp, Artificial Sequence
  chemically synthesized
aaaaaagcttctttaataatgc

SEQ ID NO: 1246184 - DNA, 22 bp, Artificial Sequence
  chemically synthesized
ctttaataatgctataattctg

SEQ ID NO: 1246185 - DNA, 22 bp, Artificial Sequence
  chemically synthesized
tttaataatgctataattctga

SEQ ID NO: 1246186 - DNA, 22 bp, Artificial Sequence
  chemically synthesized
taataatgctataattctgaac

SEQ ID NO: 1246187 - DNA, 22 bp, Artificial Sequence
  chemically synthesized
aataatgctataattctgaact

SEQ ID NO: 1246188 - DNA, 22 bp, Artificial Sequence
  chemically synthesized
atataaacaaaaagttcagaat

SEQ ID NO: 1246189 - DNA, 22 bp, Artificial Sequence
  chemically synthesized
ataatgctataattctgaactt

SEQ ID NO: 1246190 - DNA, 22 bp, Artificial Sequence
  chemically synthesized
taatataaacaaaaagttcaga

SEQ ID NO: 1246191 - DNA, 22 bp, Artificial Sequence
  chemically synthesized
ctaatataaacaaaaagttcag

SEQ ID NO: 1246192 - DNA, 22 bp, Artificial Sequence
  chemically synthesized
tctaatataaacaaaaagttca

SEQ ID NO: 1246193 - DNA, 22 bp, Artificial Sequence
  chemically synthesized
taattctgaactttttgtttat

SEQ ID NO: 1246194 - DNA, 22 bp, Artificial Sequence
  chemically synthesized
tgaactttttgtttatattaga

SEQ ID NO: 1246195 - DNA, 22 bp, Artificial Sequence
  chemically synthesized
aactttttgtttatattagaaa

SEQ ID NO: 1246196 - DNA, 22 bp, Artificial Sequence
  chemically synthesized
aaagaaaaaatattttctaata

SEQ ID NO: 1246197 - DNA, 22 bp, Artificial Sequence
  chemically synthesized
tttgtttatattagaaaatatt

SEQ ID NO: 1246198 - DNA, 22 bp, Artificial Sequence
  chemically synthesized
ttgtttatattagaaaatattt

SEQ ID NO: 1246199 - DNA, 22 bp, Artificial Sequence
  chemically synthesized
tgtttatattagaaaatatttt

SEQ ID NO: 1246200 - DNA, 22 bp, Artificial Sequence
  chemically synthesized
gagttaaaagaaaaaatatttt

SEQ ID NO: 1246201 - DNA, 22 bp, Artificial Sequence
  chemically synthesized
gtttatattagaaaatattttt

SEQ ID NO: 1246202 - DNA, 22 bp, Artificial Sequence
  chemically synthesized
tttatattagaaaatatttttt

SEQ ID NO: 1246203 - DNA, 22 bp, Artificial Sequence
  chemically synthesized
atattagaaaatattttttctt

SEQ ID NO: 1246204 - DNA, 22 bp, Artificial Sequence
  chemically synthesized
tattagaaaatattttttcttt

SEQ ID NO: 1246205 - DNA, 22 bp, Artificial Sequence
  chemically synthesized
tagctagagttaaaagaaaaaa

SEQ ID NO: 1246206 - DNA, 22 bp, Artificial Sequence
  chemically synthesized
gaaaatattttttcttttaact

SEQ ID NO: 1246207 - DNA, 22 bp, Artificial Sequence
  chemically synthesized
tactatagctagagttaaaaga

SEQ ID NO: 1246208 - DNA, 22 bp, Artificial Sequence
  chemically synthesized
attgtactatagctagagttaa

SEQ ID NO: 1246209 - DNA, 22 bp, Artificial Sequence
  chemically synthesized
taattgtactatagctagagtt

SEQ ID NO: 1246210 - DNA, 22 bp, Artificial Sequence
  chemically synthesized
tttcttttaactctagctatag

SEQ ID NO: 1246211 - DNA, 22 bp, Artificial Sequence
  chemically synthesized
ttcttttaactctagctatagt

SEQ ID NO: 1246212 - DNA, 22 bp, Artificial Sequence
  chemically synthesized
tcttttaactctagctatagta

SEQ ID NO: 1246213 - DNA, 22 bp, Artificial Sequence
  chemically synthesized
cttttaactctagctatagtac

SEQ ID NO: 1246214 - DNA, 22 bp, Artificial Sequence
  chemically synthesized
ttttaactctagctatagtaca

SEQ ID NO: 1246215 - DNA, 22 bp, Artificial Sequence
  chemically synthesized
aaacatctctaattgtactata

SEQ ID NO: 1246216 - DNA, 22 bp, Artificial Sequence
  chemically synthesized
ttaactctagctatagtacaat

SEQ ID NO: 1246217 - DNA, 22 bp, Artificial Sequence
  chemically synthesized
gaaacatctctaattgtactat

SEQ ID NO: 1246218 - DNA, 22 bp, Artificial Sequence
  chemically synthesized
taactctagctatagtacaatt

SEQ ID NO: 1246219 - DNA, 22 bp, Artificial Sequence
  chemically synthesized
tgaaacatctctaattgtacta

SEQ ID NO: 1246220 - DNA, 22 bp, Artificial Sequence
  chemically synthesized
aactctagctatagtacaatta

SEQ ID NO: 1246221 - DNA, 22 bp, Artificial Sequence
  chemically synthesized
actctagctatagtacaattag

SEQ ID NO: 1246222 - DNA, 22 bp, Artificial Sequence
  chemically synthesized
tagctatagtacaattagagat

SEQ ID NO: 1246223 - DNA, 22 bp, Artificial Sequence
  chemically synthesized
gctatagtacaattagagatgt

SEQ ID NO: 1246224 - DNA, 22 bp, Artificial Sequence
  chemically synthesized
aataattttgaaacatctctaa

SEQ ID NO: 1246225 - DNA, 22 bp, Artificial Sequence
  chemically synthesized
tagtacaattagagatgtttca

SEQ ID NO: 1246226 - DNA, 22 bp, Artificial Sequence
  chemically synthesized
cctgaataattttgaaacatct

SEQ ID NO: 1246227 - DNA, 22 bp, Artificial Sequence
  chemically synthesized
acctgaataattttgaaacatc

SEQ ID NO: 1246228 - DNA, 22 bp, Artificial Sequence
  chemically synthesized
agcacttacctgaataattttg

SEQ ID NO: 1246229 - DNA, 22 bp, Artificial Sequence
  chemically synthesized
gagatgtttcaaaattattcag

SEQ ID NO: 1246230 - DNA, 22 bp, Artificial Sequence
  chemically synthesized
caaaattattcaggtaagtgct

SEQ ID NO: 1246231 - DNA, 22 bp, Artificial Sequence
  chemically synthesized
aaaattattcaggtaagtgctt

SEQ ID NO: 1246232 - DNA, 22 bp, Artificial Sequence
  chemically synthesized
cgtggacccaattaagcactta

SEQ ID NO: 1246233 - DNA, 22 bp, Artificial Sequence
  chemically synthesized
ttcaggtaagtgcttaattggg

SEQ ID NO: 1246234 - DNA, 22 bp, Artificial Sequence
  chemically synthesized
aggtaagtgcttaattgggtcc

SEQ ID NO: 1246235 - DNA, 22 bp, Artificial Sequence
  chemically synthesized
agaagattacgtggacccaatt

SEQ ID NO: 1246236 - DNA, 22 bp, Artificial Sequence
  chemically synthesized
cagaagattacgtggacccaat

SEQ ID NO: 1246237 - DNA, 22 bp, Artificial Sequence
  chemically synthesized
tcagaagattacgtggacccaa

SEQ ID NO: 1246238 - DNA, 22 bp, Artificial Sequence
  chemically synthesized
actttcagaagattacgtggac

SEQ ID NO: 1246239 - DNA, 22 bp, Artificial Sequence
  chemically synthesized
aattgggtccacgtaatcttct

SEQ ID NO: 1246240 - DNA, 22 bp, Artificial Sequence
  chemically synthesized
attgggtccacgtaatcttctg

SEQ ID NO: 1246241 - DNA, 22 bp, Artificial Sequence
  chemically synthesized
aagggctaactttcagaagatt

SEQ ID NO: 1246242 - DNA, 22 bp, Artificial Sequence
  chemically synthesized
taaagggctaactttcagaaga

SEQ ID NO: 1246243 - DNA, 22 bp, Artificial Sequence
  chemically synthesized
ggtccacgtaatcttctgaaag

SEQ ID NO: 1246244 - DNA, 22 bp, Artificial Sequence
  chemically synthesized
taacctctaaagggctaacttt

SEQ ID NO: 1246245 - DNA, 22 bp, Artificial Sequence
  chemically synthesized
gctataacctctaaagggctaa

SEQ ID NO: 1246246 - DNA, 22 bp, Artificial Sequence
  chemically synthesized
ggctataacctctaaagggcta

SEQ ID NO: 1246247 - DNA, 22 bp, Artificial Sequence
  chemically synthesized
tggctataacctctaaagggct

SEQ ID NO: 1246248 - DNA, 22 bp, Artificial Sequence
  chemically synthesized
ttggctataacctctaaagggc

SEQ ID NO: 1246249 - DNA, 22 bp, Artificial Sequence
  chemically synthesized
tttggctataacctctaaaggg

SEQ ID NO: 1246250 - DNA, 22 bp, Artificial Sequence
  chemically synthesized
ctgaaagttagccctttagagg

SEQ ID NO: 1246251 - DNA, 22 bp, Artificial Sequence
  chemically synthesized
tgaaagttagccctttagaggt

SEQ ID NO: 1246252 - DNA, 22 bp, Artificial Sequence
  chemically synthesized
aaagttagccctttagaggtta

SEQ ID NO: 1246253 - DNA, 22 bp, Artificial Sequence
  chemically synthesized
gccctttagaggttatagccaa

SEQ ID NO: 1246254 - DNA, 22 bp, Artificial Sequence
  chemically synthesized
gataaaacacgattttttggct

SEQ ID NO: 1246255 - DNA, 22 bp, Artificial Sequence
  chemically synthesized
tagaggttatagccaaaaaatc

SEQ ID NO: 1246256 - DNA, 22 bp, Artificial Sequence
  chemically synthesized
agaggttatagccaaaaaatcg

SEQ ID NO: 1246257 - DNA, 22 bp, Artificial Sequence
  chemically synthesized
gaggttatagccaaaaaatcgt

SEQ ID NO: 1246258 - DNA, 22 bp, Artificial Sequence
  chemically synthesized
gtggatctggataaaacacgat

SEQ ID NO: 1246259 - DNA, 22 bp, Artificial Sequence
  chemically synthesized
agtggatctggataaaacacga

SEQ ID NO: 1246260 - DNA, 22 bp, Artificial Sequence
  chemically synthesized
tagccaaaaaatcgtgttttat

SEQ ID NO: 1246261 - DNA, 22 bp, Artificial Sequence
  chemically synthesized
atggaatcttagtggatctgga

SEQ ID NO: 1246262 - DNA, 22 bp, Artificial Sequence
  chemically synthesized
tatccagatccactaagattcc

SEQ ID NO: 1246263 - DNA, 22 bp, Artificial Sequence
  chemically synthesized
atccagatccactaagattcca

SEQ ID NO: 1246264 - DNA, 22 bp, Artificial Sequence
  chemically synthesized
tccagatccactaagattccat

SEQ ID NO: 1246265 - DNA, 22 bp, Artificial Sequence
  chemically synthesized
agattccattaacacttctgcg

SEQ ID NO: 1246266 - DNA, 22 bp, Artificial Sequence
  chemically synthesized
cattaacacttctgcgtgccca

SEQ ID NO: 1246267 - DNA, 22 bp, Artificial Sequence
  chemically synthesized
acacttctgcgtgcccacctcc

SEQ ID NO: 1246268 - DNA, 22 bp, Artificial Sequence
  chemically synthesized
ctgcgtgcccacctccttggct

SEQ ID NO: 1246269 - DNA, 22 bp, Artificial Sequence
  chemically synthesized
tgcgtgcccacctccttggctt

SEQ ID NO: 1246270 - DNA, 22 bp, Artificial Sequence
  chemically synthesized
cgtgcccacctccttggctttt

SEQ ID NO: 1246271 - DNA, 22 bp, Artificial Sequence
  chemically synthesized
agaagcaaagaccacaaaagcc

SEQ ID NO: 1246272 - DNA, 22 bp, Artificial Sequence
  chemically synthesized
gagaagcaaagaccacaaaagc

SEQ ID NO: 1246273 - DNA, 22 bp, Artificial Sequence
  chemically synthesized
tgagaagcaaagaccacaaaag

SEQ ID NO: 1246274 - DNA, 22 bp, Artificial Sequence
  chemically synthesized
cttggcttttgtggtctttgct

SEQ ID NO: 1246275 - DNA, 22 bp, Artificial Sequence
  chemically synthesized
ggcttttgtggtctttgcttct

SEQ ID NO: 1246276 - DNA, 22 bp, Artificial Sequence
  chemically synthesized
gcttttgtggtctttgcttctc

SEQ ID NO: 1246277 - DNA, 22 bp, Artificial Sequence
  chemically synthesized
ttgtggtctttgcttctcaaaa

SEQ ID NO: 1246278 - DNA, 22 bp, Artificial Sequence
  chemically synthesized
tgtggtctttgcttctcaaaac

SEQ ID NO: 1246279 - DNA, 22 bp, Artificial Sequence
  chemically synthesized
gtggtctttgcttctcaaaact

SEQ ID NO: 1246280 - DNA, 22 bp, Artificial Sequence
  chemically synthesized
tggtctttgcttctcaaaactt

SEQ ID NO: 1246281 - DNA, 22 bp, Artificial Sequence
  chemically synthesized
aagagatgtagatacagaagtt

SEQ ID NO: 1246282 - DNA, 22 bp, Artificial Sequence
  chemically synthesized
tgcttctcaaaacttctgtatc

SEQ ID NO: 1246283 - DNA, 22 bp, Artificial Sequence
  chemically synthesized
gcttctcaaaacttctgtatct

SEQ ID NO: 1246284 - DNA, 22 bp, Artificial Sequence
  chemically synthesized
cttctcaaaacttctgtatcta

SEQ ID NO: 1246285 - DNA, 22 bp, Artificial Sequence
  chemically synthesized
ctcaaaacttctgtatctacat

SEQ ID NO: 1246286 - DNA, 22 bp, Artificial Sequence
  chemically synthesized
tcaaaacttctgtatctacatc

SEQ ID NO: 1246287 - DNA, 22 bp, Artificial Sequence
  chemically synthesized
aaaacttctgtatctacatctc

SEQ ID NO: 1246288 - DNA, 22 bp, Artificial Sequence
  chemically synthesized
aagacagtcatctaaagagatg

SEQ ID NO: 1246289 - DNA, 22 bp, Artificial Sequence
  chemically synthesized
ctgtatctacatctctttagat

SEQ ID NO: 1246290 - DNA, 22 bp, Artificial Sequence
  chemically synthesized
tgtatctacatctctttagatg

SEQ ID NO: 1246291 - DNA, 22 bp, Artificial Sequence
  chemically synthesized
gcctgaagacagtcatctaaag

SEQ ID NO: 1246292 - DNA, 22 bp, Artificial Sequence
  chemically synthesized
tatctacatctctttagatgac

SEQ ID NO: 1246293 - DNA, 22 bp, Artificial Sequence
  chemically synthesized
ctagcctgaagacagtcatcta

SEQ ID NO: 1246294 - DNA, 22 bp, Artificial Sequence
  chemically synthesized
actagcctgaagacagtcatct

SEQ ID NO: 1246295 - DNA, 22 bp, Artificial Sequence
  chemically synthesized
tactagcctgaagacagtcatc

SEQ ID NO: 1246296 - DNA, 22 bp, Artificial Sequence
  chemically synthesized
catctctttagatgactgtctt

SEQ ID NO: 1246297 - DNA, 22 bp, Artificial Sequence
  chemically synthesized
tttagatgactgtcttcaggct

SEQ ID NO: 1246298 - DNA, 22 bp, Artificial Sequence
  chemically synthesized
tagatgactgtcttcaggctag

SEQ ID NO: 1246299 - DNA, 22 bp, Artificial Sequence
  chemically synthesized
agatgactgtcttcaggctagt

SEQ ID NO: 1246300 - DNA, 22 bp, Artificial Sequence
  chemically synthesized
gatgactgtcttcaggctagta

SEQ ID NO: 1246301 - DNA, 22 bp, Artificial Sequence
  chemically synthesized
gcaaagcagctttactagcctg

SEQ ID NO: 1246302 - DNA, 22 bp, Artificial Sequence
  chemically synthesized
ttggcaaagcagctttactagc

SEQ ID NO: 1246303 - DNA, 22 bp, Artificial Sequence
  chemically synthesized
gttggcaaagcagctttactag

SEQ ID NO: 1246304 - DNA, 22 bp, Artificial Sequence
  chemically synthesized
tgttggcaaagcagctttacta

SEQ ID NO: 1246305 - DNA, 22 bp, Artificial Sequence
  chemically synthesized
ttgttggcaaagcagctttact

SEQ ID NO: 1246306 - DNA, 22 bp, Artificial Sequence
  chemically synthesized
tcttcaggctagtaaagctgct

SEQ ID NO: 1246307 - DNA, 22 bp, Artificial Sequence
  chemically synthesized
tttttgttggcaaagcagcttt

SEQ ID NO: 1246308 - DNA, 22 bp, Artificial Sequence
  chemically synthesized
tgtttttgttggcaaagcagct

SEQ ID NO: 1246309 - DNA, 22 bp, Artificial Sequence
  chemically synthesized
caggctagtaaagctgctttgc

SEQ ID NO: 1246310 - DNA, 22 bp, Artificial Sequence
  chemically synthesized
aggctagtaaagctgctttgcc

SEQ ID NO: 1246311 - DNA, 22 bp, Artificial Sequence
  chemically synthesized
gtaaagctgctttgccaacaaa

SEQ ID NO: 1246312 - DNA, 22 bp, Artificial Sequence
  chemically synthesized
cggatctctgtttttgttggca

SEQ ID NO: 1246313 - DNA, 22 bp, Artificial Sequence
  chemically synthesized
ccggatctctgtttttgttggc

SEQ ID NO: 1246314 - DNA, 22 bp, Artificial Sequence
  chemically synthesized
ctttgccaacaaaaacagagat

SEQ ID NO: 1246315 - DNA, 22 bp, Artificial Sequence
  chemically synthesized
tgccaacaaaaacagagatccg

SEQ ID NO: 1246316 - DNA, 22 bp, Artificial Sequence
  chemically synthesized
gccaacaaaaacagagatccgg

SEQ ID NO: 1246317 - DNA, 22 bp, Artificial Sequence
  chemically synthesized
ccaacaaaaacagagatccgga

SEQ ID NO: 1246318 - DNA, 22 bp, Artificial Sequence
  chemically synthesized
aggtgacataaacaccaaggca

SEQ ID NO: 1246319 - DNA, 22 bp, Artificial Sequence
  chemically synthesized
ccctaaggtgacataaacacca

SEQ ID NO: 1246320 - DNA, 22 bp, Artificial Sequence
  chemically synthesized
agactaccctaaggtgacataa

SEQ ID NO: 1246321 - DNA, 22 bp, Artificial Sequence
  chemically synthesized
aagactaccctaaggtgacata

SEQ ID NO: 1246322 - DNA, 22 bp, Artificial Sequence
  chemically synthesized
ccttaagactaccctaaggtga

SEQ ID NO: 1246323 - DNA, 22 bp, Artificial Sequence
  chemically synthesized
ggtgtttatgtcaccttagggt

SEQ ID NO: 1246324 - DNA, 22 bp, Artificial Sequence
  chemically synthesized
gtgtttatgtcaccttagggta

SEQ ID NO: 1246325 - DNA, 22 bp, Artificial Sequence
  chemically synthesized
atgtcaccttagggtagtctta

SEQ ID NO: 1246326 - DNA, 22 bp, Artificial Sequence
  chemically synthesized
tgtcaccttagggtagtcttaa

SEQ ID NO: 1246327 - DNA, 22 bp, Artificial Sequence
  chemically synthesized
agggtagtcttaaggcaatgac

SEQ ID NO: 1246328 - DNA, 22 bp, Artificial Sequence
  chemically synthesized
cagtagtcaccagtcattgcct

SEQ ID NO: 1246329 - DNA, 22 bp, Artificial Sequence
  chemically synthesized
gggtagtcttaaggcaatgact

SEQ ID NO: 1246330 - DNA, 22 bp, Artificial Sequence
  chemically synthesized
tattccagtagtcaccagtcat

SEQ ID NO: 1246331 - DNA, 22 bp, Artificial Sequence
  chemically synthesized
gtattccagtagtcaccagtca

SEQ ID NO: 1246332 - DNA, 22 bp, Artificial Sequence
  chemically synthesized
tgtattccagtagtcaccagtc

SEQ ID NO: 1246333 - DNA, 22 bp, Artificial Sequence
  chemically synthesized
ttgtattccagtagtcaccagt

SEQ ID NO: 1246334 - DNA, 22 bp, Artificial Sequence
  chemically synthesized
aaggcaatgactggtgactact

SEQ ID NO: 1246335 - DNA, 22 bp, Artificial Sequence
  chemically synthesized
aggcaatgactggtgactactg

SEQ ID NO: 1246336 - DNA, 22 bp, Artificial Sequence
  chemically synthesized
ggcttttgtattccagtagtca

SEQ ID NO: 1246337 - DNA, 22 bp, Artificial Sequence
  chemically synthesized
gtgactactggaatacaaaagc

SEQ ID NO: 1246338 - DNA, 22 bp, Artificial Sequence
  chemically synthesized
atacagaaggagctgggctttt

SEQ ID NO: 1246339 - DNA, 22 bp, Artificial Sequence
  chemically synthesized
gatacagaaggagctgggcttt

SEQ ID NO: 1246340 - DNA, 22 bp, Artificial Sequence
  chemically synthesized
ctggaatacaaaagcccagctc

SEQ ID NO: 1246341 - DNA, 22 bp, Artificial Sequence
  chemically synthesized
gaatacaaaagcccagctcctt

SEQ ID NO: 1246342 - DNA, 22 bp, Artificial Sequence
  chemically synthesized
caacttgatacagaaggagctg

SEQ ID NO: 1246343 - DNA, 22 bp, Artificial Sequence
  chemically synthesized
ttgcaacttgatacagaaggag

SEQ ID NO: 1246344 - DNA, 22 bp, Artificial Sequence
  chemically synthesized
gttgcaacttgatacagaagga

SEQ ID NO: 1246345 - DNA, 22 bp, Artificial Sequence
  chemically synthesized
agcttgttgcaacttgatacag

SEQ ID NO: 1246346 - DNA, 22 bp, Artificial Sequence
  chemically synthesized
cagcttgttgcaacttgataca

SEQ ID NO: 1246347 - DNA, 22 bp, Artificial Sequence
  chemically synthesized
tgcttcagcttgttgcaacttg

SEQ ID NO: 1246348 - DNA, 22 bp, Artificial Sequence
  chemically synthesized
cttctgtatcaagttgcaacaa

SEQ ID NO: 1246349 - DNA, 22 bp, Artificial Sequence
  chemically synthesized
aactatgcttcagcttgttgca

SEQ ID NO: 1246350 - DNA, 22 bp, Artificial Sequence
  chemically synthesized
ctgtatcaagttgcaacaagct

SEQ ID NO: 1246351 - DNA, 22 bp, Artificial Sequence
  chemically synthesized
tgtatcaagttgcaacaagctg

SEQ ID NO: 1246352 - DNA, 22 bp, Artificial Sequence
  chemically synthesized
tatcaagttgcaacaagctgaa

SEQ ID NO: 1246353 - DNA, 22 bp, Artificial Sequence
  chemically synthesized
ggcctaaactatgcttcagctt

SEQ ID NO: 1246354 - DNA, 22 bp, Artificial Sequence
  chemically synthesized
caacaagctgaagcatagttta

SEQ ID NO: 1246355 - DNA, 22 bp, Artificial Sequence
  chemically synthesized
caggaaaacctgggcctaaact

SEQ ID NO: 1246356 - DNA, 22 bp, Artificial Sequence
  chemically synthesized
tgcaggaaaacctgggcctaaa

SEQ ID NO: 1246357 - DNA, 22 bp, Artificial Sequence
  chemically synthesized
aagcatagtttaggcccaggtt

SEQ ID NO: 1246358 - DNA, 22 bp, Artificial Sequence
  chemically synthesized
gttctgcaggaaaacctgggcc

SEQ ID NO: 1246359 - DNA, 22 bp, Artificial Sequence
  chemically synthesized
agtctggttctgcaggaaaacc

SEQ ID NO: 1246360 - DNA, 22 bp, Artificial Sequence
  chemically synthesized
aggcccaggttttcctgcagaa

SEQ ID NO: 1246361 - DNA, 22 bp, Artificial Sequence
  chemically synthesized
ggcccaggttttcctgcagaac

SEQ ID NO: 1246362 - DNA, 22 bp, Artificial Sequence
  chemically synthesized
tcctgcagaaccagactgaggc

SEQ ID NO: 1246363 - DNA, 22 bp, Artificial Sequence
  chemically synthesized
cctgcagaaccagactgaggct

SEQ ID NO: 1246364 - DNA, 22 bp, Artificial Sequence
  chemically synthesized
ctgcagaaccagactgaggctg

SEQ ID NO: 1246365 - DNA, 22 bp, Artificial Sequence
  chemically synthesized
cagaaccagactgaggctggca

SEQ ID NO: 1246366 - DNA, 22 bp, Artificial Sequence
  chemically synthesized
aggctggcactttgcctgcgat

SEQ ID NO: 1246367 - DNA, 22 bp, Artificial Sequence
  chemically synthesized
gcactttgcctgcgattgctcc

SEQ ID NO: 1246368 - DNA, 22 bp, Artificial Sequence
  chemically synthesized
tgcctgcgattgctccttgcat

SEQ ID NO: 1246369 - DNA, 22 bp, Artificial Sequence
  chemically synthesized
gcctgcgattgctccttgcatg

SEQ ID NO: 1246370 - DNA, 22 bp, Artificial Sequence
  chemically synthesized
cctgcgattgctccttgcatga

SEQ ID NO: 1246371 - DNA, 22 bp, Artificial Sequence
  chemically synthesized
cgattgctccttgcatgatttc

SEQ ID NO: 1246372 - DNA, 22 bp, Artificial Sequence
  chemically synthesized
ctccttgcatgatttcttcccc

SEQ ID NO: 1246373 - DNA, 22 bp, Artificial Sequence
  chemically synthesized
cttgcatgatttcttccccatt

SEQ ID NO: 1246374 - DNA, 22 bp, Artificial Sequence
  chemically synthesized
gcatgatttcttccccattcct

SEQ ID NO: 1246375 - DNA, 22 bp, Artificial Sequence
  chemically synthesized
catgatttcttccccattccta

SEQ ID NO: 1246376 - DNA, 22 bp, Artificial Sequence
  chemically synthesized
cttccccattcctattctactt

SEQ ID NO: 1246377 - DNA, 22 bp, Artificial Sequence
  chemically synthesized
ttccccattcctattctacttc

SEQ ID NO: 1246378 - DNA, 22 bp, Artificial Sequence
  chemically synthesized
ccccattcctattctacttctc

SEQ ID NO: 1246379 - DNA, 22 bp, Artificial Sequence
  chemically synthesized
cccattcctattctacttctct

SEQ ID NO: 1246380 - DNA, 22 bp, Artificial Sequence
  chemically synthesized
ctattctacttctcttgctcac

SEQ ID NO: 1246381 - DNA, 22 bp, Artificial Sequence
  chemically synthesized
ttctacttctcttgctcaccta

SEQ ID NO: 1246382 - DNA, 22 bp, Artificial Sequence
  chemically synthesized
agggatggcaagtaggtgagca

SEQ ID NO: 1246383 - DNA, 22 bp, Artificial Sequence
  chemically synthesized
tcagggatggcaagtaggtgag

SEQ ID NO: 1246384 - DNA, 22 bp, Artificial Sequence
  chemically synthesized
tacttctcttgctcacctactt

SEQ ID NO: 1246385 - DNA, 22 bp, Artificial Sequence
  chemically synthesized
cttctcttgctcacctacttgc

SEQ ID NO: 1246386 - DNA, 22 bp, Artificial Sequence
  chemically synthesized
ctcttgctcacctacttgccat

SEQ ID NO: 1246387 - DNA, 22 bp, Artificial Sequence
  chemically synthesized
tcttgctcacctacttgccatc

SEQ ID NO: 1246388 - DNA, 22 bp, Artificial Sequence
  chemically synthesized
ttgctcacctacttgccatccc

SEQ ID NO: 1246389 - DNA, 22 bp, Artificial Sequence
  chemically synthesized
gctcacctacttgccatccctg

SEQ ID NO: 1246390 - DNA, 22 bp, Artificial Sequence
  chemically synthesized
aggaaatgttctcagggatggc

SEQ ID NO: 1246391 - DNA, 22 bp, Artificial Sequence
  chemically synthesized
ctcacctacttgccatccctga

SEQ ID NO: 1246392 - DNA, 22 bp, Artificial Sequence
  chemically synthesized
acctacttgccatccctgagaa

SEQ ID NO: 1246393 - DNA, 22 bp, Artificial Sequence
  chemically synthesized
attaaggaaatgttctcaggga

SEQ ID NO: 1246394 - DNA, 22 bp, Artificial Sequence
  chemically synthesized
aattaaggaaatgttctcaggg

SEQ ID NO: 1246395 - DNA, 22 bp, Artificial Sequence
  chemically synthesized
cttgccatccctgagaacattt

SEQ ID NO: 1246396 - DNA, 22 bp, Artificial Sequence
  chemically synthesized
gccatccctgagaacatttcct

SEQ ID NO: 1246397 - DNA, 22 bp, Artificial Sequence
  chemically synthesized
ccatccctgagaacatttcctt

SEQ ID NO: 1246398 - DNA, 22 bp, Artificial Sequence
  chemically synthesized
catgaaagtagtttaattaagg

SEQ ID NO: 1246399 - DNA, 22 bp, Artificial Sequence
  chemically synthesized
gcatgaaagtagtttaattaag

SEQ ID NO: 1246400 - DNA, 22 bp, Artificial Sequence
  chemically synthesized
agaacatttccttaattaaact

SEQ ID NO: 1246401 - DNA, 22 bp, Artificial Sequence
  chemically synthesized
ccttaattaaactactttcatg

SEQ ID NO: 1246402 - DNA, 22 bp, Artificial Sequence
  chemically synthesized
cttaattaaactactttcatgc

SEQ ID NO: 1246403 - DNA, 22 bp, Artificial Sequence
  chemically synthesized
aattaaactactttcatgcaaa

SEQ ID NO: 1246404 - DNA, 22 bp, Artificial Sequence
  chemically synthesized
attaaactactttcatgcaaat

SEQ ID NO: 1246405 - DNA, 22 bp, Artificial Sequence
  chemically synthesized
aactactttcatgcaaattctc

SEQ ID NO: 1246406 - DNA, 22 bp, Artificial Sequence
  chemically synthesized
ctttcatgcaaattctcctctc

SEQ ID NO: 1246407 - DNA, 22 bp, Artificial Sequence
  chemically synthesized
gtaaagcccatgtggagaggag

SEQ ID NO: 1246408 - DNA, 22 bp, Artificial Sequence
  chemically synthesized
tcatgcaaattctcctctccac

SEQ ID NO: 1246409 - DNA, 22 bp, Artificial Sequence
  chemically synthesized
ggtaaagcccatgtggagagga

SEQ ID NO: 1246410 - DNA, 22 bp, Artificial Sequence
  chemically synthesized
catgcaaattctcctctccaca

SEQ ID NO: 1246411 - DNA, 22 bp, Artificial Sequence
  chemically synthesized
tggtaaagcccatgtggagagg

SEQ ID NO: 1246412 - DNA, 22 bp, Artificial Sequence
  chemically synthesized
atgcaaattctcctctccacat

SEQ ID NO: 1246413 - DNA, 22 bp, Artificial Sequence
  chemically synthesized
ggttttggtaaagcccatgtgg

SEQ ID NO: 1246414 - DNA, 22 bp, Artificial Sequence
  chemically synthesized
tcctctccacatgggctttacc

SEQ ID NO: 1246415 - DNA, 22 bp, Artificial Sequence
  chemically synthesized
aggttgggttttggtaaagccc

SEQ ID NO: 1246416 - DNA, 22 bp, Artificial Sequence
  chemically synthesized
caggttgggttttggtaaagcc

SEQ ID NO: 1246417 - DNA, 22 bp, Artificial Sequence
  chemically synthesized
ctctccacatgggctttaccaa

SEQ ID NO: 1246418 - DNA, 22 bp, Artificial Sequence
  chemically synthesized
tccacatgggctttaccaaaac

SEQ ID NO: 1246419 - DNA, 22 bp, Artificial Sequence
  chemically synthesized
tgtttcaggttgggttttggta

SEQ ID NO: 1246420 - DNA, 22 bp, Artificial Sequence
  chemically synthesized
cacatgggctttaccaaaaccc

SEQ ID NO: 1246421 - DNA, 22 bp, Artificial Sequence
  chemically synthesized
atgtttcaggttgggttttggt

SEQ ID NO: 1246422 - DNA, 22 bp, Artificial Sequence
  chemically synthesized
taccaaaacccaacctgaaaca

SEQ ID NO: 1246423 - DNA, 22 bp, Artificial Sequence
  chemically synthesized
gaggaatgcttatgtttcaggt

SEQ ID NO: 1246424 - DNA, 22 bp, Artificial Sequence
  chemically synthesized
accaaaacccaacctgaaacat

SEQ ID NO: 1246425 - DNA, 22 bp, Artificial Sequence
  chemically synthesized
ccaaaacccaacctgaaacata

SEQ ID NO: 1246426 - DNA, 22 bp, Artificial Sequence
  chemically synthesized
taattagaggaatgcttatgtt

SEQ ID NO: 1246427 - DNA, 22 bp, Artificial Sequence
  chemically synthesized
ctgtaattagaggaatgcttat

SEQ ID NO: 1246428 - DNA, 22 bp, Artificial Sequence
  chemically synthesized
ttactgtaattagaggaatgct

SEQ ID NO: 1246429 - DNA, 22 bp, Artificial Sequence
  chemically synthesized
attactgtaattagaggaatgc

SEQ ID NO: 1246430 - DNA, 22 bp, Artificial Sequence
  chemically synthesized
tattactgtaattagaggaatg

SEQ ID NO: 1246431 - DNA, 22 bp, Artificial Sequence
  chemically synthesized
aaacataagcattcctctaatt

SEQ ID NO: 1246432 - DNA, 22 bp, Artificial Sequence
  chemically synthesized
atgcctttattactgtaattag

SEQ ID NO: 1246433 - DNA, 22 bp, Artificial Sequence
  chemically synthesized
ctctaattacagtaataaaggc

SEQ ID NO: 1246434 - DNA, 22 bp, Artificial Sequence
  chemically synthesized
taattacagtaataaaggcatc

SEQ ID NO: 1246435 - DNA, 22 bp, Artificial Sequence
  chemically synthesized
aaatagaaatctgatgccttta

SEQ ID NO: 1246436 - DNA, 22 bp, Artificial Sequence
  chemically synthesized
caaatagaaatctgatgccttt

SEQ ID NO: 1246437 - DNA, 22 bp, Artificial Sequence
  chemically synthesized
attacagtaataaaggcatcag

SEQ ID NO: 1246438 - DNA, 22 bp, Artificial Sequence
  chemically synthesized
tcaaatagaaatctgatgcctt

SEQ ID NO: 1246439 - DNA, 22 bp, Artificial Sequence
  chemically synthesized
cagtaataaaggcatcagattt

SEQ ID NO: 1246440 - DNA, 22 bp, Artificial Sequence
  chemically synthesized
gtattttcaaatagaaatctga

SEQ ID NO: 1246441 - DNA, 22 bp, Artificial Sequence
  chemically synthesized
ctagtattttcaaatagaaatc

SEQ ID NO: 1246442 - DNA, 22 bp, Artificial Sequence
  chemically synthesized
ctatttgaaaatactaggaatg

SEQ ID NO: 1246443 - DNA, 22 bp, Artificial Sequence
  chemically synthesized
tatttgaaaatactaggaatgg

SEQ ID NO: 1246444 - DNA, 22 bp, Artificial Sequence
  chemically synthesized
tttgaaaatactaggaatgggc

SEQ ID NO: 1246445 - DNA, 22 bp, Artificial Sequence
  chemically synthesized
gaaaatactaggaatgggccgg

SEQ ID NO: 1246446 - DNA, 22 bp, Artificial Sequence
  chemically synthesized
aaaatactaggaatgggccggg

SEQ ID NO: 1246447 - DNA, 22 bp, Artificial Sequence
  chemically synthesized
caggcgtgagccaccgcgcccg

SEQ ID NO: 1246448 - DNA, 22 bp, Artificial Sequence
  chemically synthesized
ggaatgggccgggcgcggtggc

SEQ ID NO: 1246449 - DNA, 22 bp, Artificial Sequence
  chemically synthesized
ggattacaggcgtgagccaccg

SEQ ID NO: 1246450 - DNA, 22 bp, Artificial Sequence
  chemically synthesized
ccaaagtgctgggattacaggc

SEQ ID NO: 1246451 - DNA, 22 bp, Artificial Sequence
  chemically synthesized
ggcctcccaaagtgctgggatt

SEQ ID NO: 1246452 - DNA, 22 bp, Artificial Sequence
  chemically synthesized
ctcggcctcccaaagtgctggg

SEQ ID NO: 1246453 - DNA, 22 bp, Artificial Sequence
  chemically synthesized
acgcctgtaatcccagcacttt

SEQ ID NO: 1246454 - DNA, 22 bp, Artificial Sequence
  chemically synthesized
taatcccagcactttgggaggc

SEQ ID NO: 1246455 - DNA, 22 bp, Artificial Sequence
  chemically synthesized
gtgatccgccctcctcggcctc

SEQ ID NO: 1246456 - DNA, 22 bp, Artificial Sequence
  chemically synthesized
acctcgtgatccgccctcctcg

SEQ ID NO: 1246457 - DNA, 22 bp, Artificial Sequence
  chemically synthesized
ctgacctcgtgatccgccctcc

SEQ ID NO: 1246458 - DNA, 22 bp, Artificial Sequence
  chemically synthesized
tgggaggccgaggagggcggat

SEQ ID NO: 1246459 - DNA, 22 bp, Artificial Sequence
  chemically synthesized
gggaggccgaggagggcggatc

SEQ ID NO: 1246460 - DNA, 22 bp, Artificial Sequence
  chemically synthesized
ggaggccgaggagggcggatca

SEQ ID NO: 1246461 - DNA, 22 bp, Artificial Sequence
  chemically synthesized
atctcctgacctcgtgatccgc

SEQ ID NO: 1246462 - DNA, 22 bp, Artificial Sequence
  chemically synthesized
gatctcctgacctcgtgatccg

SEQ ID NO: 1246463 - DNA, 22 bp, Artificial Sequence
  chemically synthesized
gccaggatggtcttgatctcct

SEQ ID NO: 1246464 - DNA, 22 bp, Artificial Sequence
  chemically synthesized
accgtgttagccaggatggtct

SEQ ID NO: 1246465 - DNA, 22 bp, Artificial Sequence
  chemically synthesized
caccgtgttagccaggatggtc

SEQ ID NO: 1246466 - DNA, 22 bp, Artificial Sequence
  chemically synthesized
gagagagatggggtttcaccgt

SEQ ID NO: 1246467 - DNA, 22 bp, Artificial Sequence
  chemically synthesized
ttagagagagatggggtttcac

SEQ ID NO: 1246468 - DNA, 22 bp, Artificial Sequence
  chemically synthesized
attagagagagatggggtttca

SEQ ID NO: 1246469 - DNA, 22 bp, Artificial Sequence
  chemically synthesized
tattagagagagatggggtttc

SEQ ID NO: 1246470 - DNA, 22 bp, Artificial Sequence
  chemically synthesized
gctaacacggtgaaaccccatc

SEQ ID NO: 1246471 - DNA, 22 bp, Artificial Sequence
  chemically synthesized
ttattagagagagatggggttt

SEQ ID NO: 1246472 - DNA, 22 bp, Artificial Sequence
  chemically synthesized
tttattagagagagatggggtt

SEQ ID NO: 1246473 - DNA, 22 bp, Artificial Sequence
  chemically synthesized
acacggtgaaaccccatctctc

SEQ ID NO: 1246474 - DNA, 22 bp, Artificial Sequence
  chemically synthesized
tctttttattagagagagatgg

SEQ ID NO: 1246475 - DNA, 22 bp, Artificial Sequence
  chemically synthesized
gtctttttattagagagagatg

SEQ ID NO: 1246476 - DNA, 22 bp, Artificial Sequence
  chemically synthesized
tgtctttttattagagagagat

SEQ ID NO: 1246477 - DNA, 22 bp, Artificial Sequence
  chemically synthesized
ttgtctttttattagagagaga

SEQ ID NO: 1246478 - DNA, 22 bp, Artificial Sequence
  chemically synthesized
atttttgtctttttattagaga

SEQ ID NO: 1246479 - DNA, 22 bp, Artificial Sequence
  chemically synthesized
cacccggctaatttttgtcttt

SEQ ID NO: 1246480 - DNA, 22 bp, Artificial Sequence
  chemically synthesized
tctctaataaaaagacaaaaat

SEQ ID NO: 1246481 - DNA, 22 bp, Artificial Sequence
  chemically synthesized
tctaataaaaagacaaaaatta

SEQ ID NO: 1246482 - DNA, 22 bp, Artificial Sequence
  chemically synthesized
taataaaaagacaaaaattagc

SEQ ID NO: 1246483 - DNA, 22 bp, Artificial Sequence
  chemically synthesized
ataaaaagacaaaaattagccg

SEQ ID NO: 1246484 - DNA, 22 bp, Artificial Sequence
  chemically synthesized
caggcgcccgccactacacccg

SEQ ID NO: 1246485 - DNA, 22 bp, Artificial Sequence
  chemically synthesized
ggactacaggcgcccgccacta

SEQ ID NO: 1246486 - DNA, 22 bp, Artificial Sequence
  chemically synthesized
gccgggtgtagtggcgggcgcc

SEQ ID NO: 1246487 - DNA, 22 bp, Artificial Sequence
  chemically synthesized
ccgagtagctgggactacaggc

SEQ ID NO: 1246488 - DNA, 22 bp, Artificial Sequence
  chemically synthesized
gcctcccgagtagctgggacta

SEQ ID NO: 1246489 - DNA, 22 bp, Artificial Sequence
  chemically synthesized
agcctcccgagtagctgggact

SEQ ID NO: 1246490 - DNA, 22 bp, Artificial Sequence
  chemically synthesized
ccttagcctcccgagtagctgg

SEQ ID NO: 1246491 - DNA, 22 bp, Artificial Sequence
  chemically synthesized
ctgccttagcctcccgagtagc

SEQ ID NO: 1246492 - DNA, 22 bp, Artificial Sequence
  chemically synthesized
tcctgccttagcctcccgagta

SEQ ID NO: 1246493 - DNA, 22 bp, Artificial Sequence
  chemically synthesized
tagtcccagctactcgggaggc

SEQ ID NO: 1246494 - DNA, 22 bp, Artificial Sequence
  chemically synthesized
atgccattctcctgccttagcc

SEQ ID NO: 1246495 - DNA, 22 bp, Artificial Sequence
  chemically synthesized
ctcgggaggctaaggcaggaga

SEQ ID NO: 1246496 - DNA, 22 bp, Artificial Sequence
  chemically synthesized
gggaggctaaggcaggagaatg

SEQ ID NO: 1246497 - DNA, 22 bp, Artificial Sequence
  chemically synthesized
ccaggttcatgccattctcctg

SEQ ID NO: 1246498 - DNA, 22 bp, Artificial Sequence
  chemically synthesized
cgcctcccaggttcatgccatt

SEQ ID NO: 1246499 - DNA, 22 bp, Artificial Sequence
  chemically synthesized
aggcaggagaatggcatgaacc

SEQ ID NO: 1246500 - DNA, 22 bp, Artificial Sequence
  chemically synthesized
caagctccgcctcccaggttca

SEQ ID NO: 1246501 - DNA, 22 bp, Artificial Sequence
  chemically synthesized
actgcaagctccgcctcccagg

SEQ ID NO: 1246502 - DNA, 22 bp, Artificial Sequence
  chemically synthesized
ggctcactgcaagctccgcctc

SEQ ID NO: 1246503 - DNA, 22 bp, Artificial Sequence
  chemically synthesized
ggaggcggagcttgcagtgagc

SEQ ID NO: 1246504 - DNA, 22 bp, Artificial Sequence
  chemically synthesized
gggtgcagtggagcaatctcgg

SEQ ID NO: 1246505 - DNA, 22 bp, Artificial Sequence
  chemically synthesized
gcagtgagccgagattgctcca

SEQ ID NO: 1246506 - DNA, 22 bp, Artificial Sequence
  chemically synthesized
cagtgagccgagattgctccac

SEQ ID NO: 1246507 - DNA, 22 bp, Artificial Sequence
  chemically synthesized
tcgcccaggctggggtgcagtg

SEQ ID NO: 1246508 - DNA, 22 bp, Artificial Sequence
  chemically synthesized
tgtcgcccaggctggggtgcag

SEQ ID NO: 1246509 - DNA, 22 bp, Artificial Sequence
  chemically synthesized
actctgtcgcccaggctggggt

SEQ ID NO: 1246510 - DNA, 22 bp, Artificial Sequence
  chemically synthesized
ctccactgcaccccagcctggg

SEQ ID NO: 1246511 - DNA, 22 bp, Artificial Sequence
  chemically synthesized
cactgcaccccagcctgggcga

SEQ ID NO: 1246512 - DNA, 22 bp, Artificial Sequence
  chemically synthesized
caccccagcctgggcgacagag

SEQ ID NO: 1246513 - DNA, 22 bp, Artificial Sequence
  chemically synthesized
agacgtagtctcactctgtcgc

SEQ ID NO: 1246514 - DNA, 22 bp, Artificial Sequence
  chemically synthesized
gagacgtagtctcactctgtcg

SEQ ID NO: 1246515 - DNA, 22 bp, Artificial Sequence
  chemically synthesized
tgagacgtagtctcactctgtc

SEQ ID NO: 1246516 - DNA, 22 bp, Artificial Sequence
  chemically synthesized
ttgagacgtagtctcactctgt

SEQ ID NO: 1246517 - DNA, 22 bp, Artificial Sequence
  chemically synthesized
tttttgagacgtagtctcactc

SEQ ID NO: 1246518 - DNA, 22 bp, Artificial Sequence
  chemically synthesized
ttatttttgagacgtagtctca

SEQ ID NO: 1246519 - DNA, 22 bp, Artificial Sequence
  chemically synthesized
attatttttgagacgtagtctc

SEQ ID NO: 1246520 - DNA, 22 bp, Artificial Sequence
  chemically synthesized
ggcgacagagtgagactacgtc

SEQ ID NO: 1246521 - DNA, 22 bp, Artificial Sequence
  chemically synthesized
tattatttttgagacgtagtct

SEQ ID NO: 1246522 - DNA, 22 bp, Artificial Sequence
  chemically synthesized
ttattatttttgagacgtagtc

SEQ ID NO: 1246523 - DNA, 22 bp, Artificial Sequence
  chemically synthesized
tttttattatttttgagacgta

SEQ ID NO: 1246524 - DNA, 22 bp, Artificial Sequence
  chemically synthesized
acaccatattatttttattatt

SEQ ID NO: 1246525 - DNA, 22 bp, Artificial Sequence
  chemically synthesized
aacaccatattatttttattat

SEQ ID NO: 1246526 - DNA, 22 bp, Artificial Sequence
  chemically synthesized
cgtctcaaaaataataaaaata

SEQ ID NO: 1246527 - DNA, 22 bp, Artificial Sequence
  chemically synthesized
aaaaataataaaaataatatgg

SEQ ID NO: 1246528 - DNA, 22 bp, Artificial Sequence
  chemically synthesized
atcagtttaacaccatattatt

SEQ ID NO: 1246529 - DNA, 22 bp, Artificial Sequence
  chemically synthesized
aagattaatcagtttaacacca

SEQ ID NO: 1246530 - DNA, 22 bp, Artificial Sequence
  chemically synthesized
tcgaagttaaagattaatcagt

SEQ ID NO: 1246531 - DNA, 22 bp, Artificial Sequence
  chemically synthesized
tgtcgaagttaaagattaatca

SEQ ID NO: 1246532 - DNA, 22 bp, Artificial Sequence
  chemically synthesized
acattctgtcgaagttaaagat

SEQ ID NO: 1246533 - DNA, 22 bp, Artificial Sequence
  chemically synthesized
taacattctgtcgaagttaaag

SEQ ID NO: 1246534 - DNA, 22 bp, Artificial Sequence
  chemically synthesized
aactgattaatctttaacttcg

SEQ ID NO: 1246535 - DNA, 22 bp, Artificial Sequence
  chemically synthesized
aactctaacattctgtcgaagt

SEQ ID NO: 1246536 - DNA, 22 bp, Artificial Sequence
  chemically synthesized
attaatctttaacttcgacaga

SEQ ID NO: 1246537 - DNA, 22 bp, Artificial Sequence
  chemically synthesized
gaactctaacattctgtcgaag

SEQ ID NO: 1246538 - DNA, 22 bp, Artificial Sequence
  chemically synthesized
atctttaacttcgacagaatgt

SEQ ID NO: 1246539 - DNA, 22 bp, Artificial Sequence
  chemically synthesized
caggtttgaactctaacattct

SEQ ID NO: 1246540 - DNA, 22 bp, Artificial Sequence
  chemically synthesized
taacttcgacagaatgttagag

SEQ ID NO: 1246541 - DNA, 22 bp, Artificial Sequence
  chemically synthesized
aacttcgacagaatgttagagt

SEQ ID NO: 1246542 - DNA, 22 bp, Artificial Sequence
  chemically synthesized
acttcgacagaatgttagagtt

SEQ ID NO: 1246543 - DNA, 22 bp, Artificial Sequence
  chemically synthesized
cgacagaatgttagagttcaaa

SEQ ID NO: 1246544 - DNA, 22 bp, Artificial Sequence
  chemically synthesized
gacagaatgttagagttcaaac

SEQ ID NO: 1246545 - DNA, 22 bp, Artificial Sequence
  chemically synthesized
catagagctacaggtttgaact

SEQ ID NO: 1246546 - DNA, 22 bp, Artificial Sequence
  chemically synthesized
gagttcaaacctgtagctctat

SEQ ID NO: 1246547 - DNA, 22 bp, Artificial Sequence
  chemically synthesized
aaacctgtagctctatggaggt

SEQ ID NO: 1246548 - DNA, 22 bp, Artificial Sequence
  chemically synthesized
taatggtaatcaaaacctccat

SEQ ID NO: 1246549 - DNA, 22 bp, Artificial Sequence
  chemically synthesized
tagctctatggaggttttgatt

SEQ ID NO: 1246550 - DNA, 22 bp, Artificial Sequence
  chemically synthesized
atggattataatggtaatcaaa

SEQ ID NO: 1246551 - DNA, 22 bp, Artificial Sequence
  chemically synthesized
tatggaggttttgattaccatt

SEQ ID NO: 1246552 - DNA, 22 bp, Artificial Sequence
  chemically synthesized
tggaggttttgattaccattat

SEQ ID NO: 1246553 - DNA, 22 bp, Artificial Sequence
  chemically synthesized
tgttaatggattataatggtaa

SEQ ID NO: 1246554 - DNA, 22 bp, Artificial Sequence
  chemically synthesized
tgattaccattataatccatta

SEQ ID NO: 1246555 - DNA, 22 bp, Artificial Sequence
  chemically synthesized
gattaccattataatccattaa

SEQ ID NO: 1246556 - DNA, 22 bp, Artificial Sequence
  chemically synthesized
attaccattataatccattaac

SEQ ID NO: 1246557 - DNA, 22 bp, Artificial Sequence
  chemically synthesized
gtaacatattgtgttaatggat

SEQ ID NO: 1246558 - DNA, 22 bp, Artificial Sequence
  chemically synthesized
agtaacatattgtgttaatgga

SEQ ID NO: 1246559 - DNA, 22 bp, Artificial Sequence
  chemically synthesized
ccattataatccattaacacaa

SEQ ID NO: 1246560 - DNA, 22 bp, Artificial Sequence
  chemically synthesized
tcttagtaacatattgtgttaa

SEQ ID NO: 1246561 - DNA, 22 bp, Artificial Sequence
  chemically synthesized
taatccattaacacaatatgtt

SEQ ID NO: 1246562 - DNA, 22 bp, Artificial Sequence
  chemically synthesized
aaatgctatcttagtaacatat

SEQ ID NO: 1246563 - DNA, 22 bp, Artificial Sequence
  chemically synthesized
tgaaatgctatcttagtaacat

SEQ ID NO: 1246564 - DNA, 22 bp, Artificial Sequence
  chemically synthesized
acacaatatgttactaagatag

SEQ ID NO: 1246565 - DNA, 22 bp, Artificial Sequence
  chemically synthesized
tgctctgaaatgctatcttagt

SEQ ID NO: 1246566 - DNA, 22 bp, Artificial Sequence
  chemically synthesized
ctaagatagcatttcagagcac

SEQ ID NO: 1246567 - DNA, 22 bp, Artificial Sequence
  chemically synthesized
agatagcatttcagagcacagt

SEQ ID NO: 1246568 - DNA, 22 bp, Artificial Sequence
  chemically synthesized
caagaaaatcatactgtgctct

SEQ ID NO: 1246569 - DNA, 22 bp, Artificial Sequence
  chemically synthesized
cagagcacagtatgattttctt

SEQ ID NO: 1246570 - DNA, 22 bp, Artificial Sequence
  chemically synthesized
tagtatagctacaagaaaatca

SEQ ID NO: 1246571 - DNA, 22 bp, Artificial Sequence
  chemically synthesized
agagcacagtatgattttcttg

SEQ ID NO: 1246572 - DNA, 22 bp, Artificial Sequence
  chemically synthesized
gtagtatagctacaagaaaatc

SEQ ID NO: 1246573 - DNA, 22 bp, Artificial Sequence
  chemically synthesized
tgtagtatagctacaagaaaat

SEQ ID NO: 1246574 - DNA, 22 bp, Artificial Sequence
  chemically synthesized
tagttttgtagtatagctacaa

SEQ ID NO: 1246575 - DNA, 22 bp, Artificial Sequence
  chemically synthesized
tagtattgtagttttgtagtat

SEQ ID NO: 1246576 - DNA, 22 bp, Artificial Sequence
  chemically synthesized
tcttgtagctatactacaaaac

SEQ ID NO: 1246577 - DNA, 22 bp, Artificial Sequence
  chemically synthesized
cttgtagctatactacaaaact

SEQ ID NO: 1246578 - DNA, 22 bp, Artificial Sequence
  chemically synthesized
ttgtagctatactacaaaacta

SEQ ID NO: 1246579 - DNA, 22 bp, Artificial Sequence
  chemically synthesized
gtagctatactacaaaactaca

SEQ ID NO: 1246580 - DNA, 22 bp, Artificial Sequence
  chemically synthesized
tagctatactacaaaactacaa

SEQ ID NO: 1246581 - DNA, 22 bp, Artificial Sequence
  chemically synthesized
tactacaaaactacaatactac

SEQ ID NO: 1246582 - DNA, 22 bp, Artificial Sequence
  chemically synthesized
aagtaatacagatactgtagta

SEQ ID NO: 1246583 - DNA, 22 bp, Artificial Sequence
  chemically synthesized
caaaactacaatactacagtat

SEQ ID NO: 1246584 - DNA, 22 bp, Artificial Sequence
  chemically synthesized
taaagtaatacagatactgtag

SEQ ID NO: 1246585 - DNA, 22 bp, Artificial Sequence
  chemically synthesized
ctaaagtaatacagatactgta

SEQ ID NO: 1246586 - DNA, 22 bp, Artificial Sequence
  chemically synthesized
tctaaagtaatacagatactgt

SEQ ID NO: 1246587 - DNA, 22 bp, Artificial Sequence
  chemically synthesized
caatactacagtatctgtatta

SEQ ID NO: 1246588 - DNA, 22 bp, Artificial Sequence
  chemically synthesized
gagattttctaaagtaatacag

SEQ ID NO: 1246589 - DNA, 22 bp, Artificial Sequence
  chemically synthesized
agagattttctaaagtaataca

SEQ ID NO: 1246590 - DNA, 22 bp, Artificial Sequence
  chemically synthesized
tagagattttctaaagtaatac

SEQ ID NO: 1246591 - DNA, 22 bp, Artificial Sequence
  chemically synthesized
ttagagattttctaaagtaata

SEQ ID NO: 1246592 - DNA, 22 bp, Artificial Sequence
  chemically synthesized
tttagagattttctaaagtaat

SEQ ID NO: 1246593 - DNA, 22 bp, Artificial Sequence
  chemically synthesized
ttttagagattttctaaagtaa

SEQ ID NO: 1246594 - DNA, 22 bp, Artificial Sequence
  chemically synthesized
cagtatctgtattactttagaa

SEQ ID NO: 1246595 - DNA, 22 bp, Artificial Sequence
  chemically synthesized
acaacttttttagagattttct

SEQ ID NO: 1246596 - DNA, 22 bp, Artificial Sequence
  chemically synthesized
tattactttagaaaatctctaa

SEQ ID NO: 1246597 - DNA, 22 bp, Artificial Sequence
  chemically synthesized
ctttagaaaatctctaaaaaag

SEQ ID NO: 1246598 - DNA, 22 bp, Artificial Sequence
  chemically synthesized
tagaaaatctctaaaaaagttg

SEQ ID NO: 1246599 - DNA, 22 bp, Artificial Sequence
  chemically synthesized
agaaaatctctaaaaaagttgt

SEQ ID NO: 1246600 - DNA, 22 bp, Artificial Sequence
  chemically synthesized
gcagtataattcacaacttttt

SEQ ID NO: 1246601 - DNA, 22 bp, Artificial Sequence
  chemically synthesized
gaaaatctctaaaaaagttgtg

SEQ ID NO: 1246602 - DNA, 22 bp, Artificial Sequence
  chemically synthesized
taaaaaagttgtgaattatact

SEQ ID NO: 1246603 - DNA, 22 bp, Artificial Sequence
  chemically synthesized
aaaaagttgtgaattatactgc

SEQ ID NO: 1246604 - DNA, 22 bp, Artificial Sequence
  chemically synthesized
atcaaaccattggcagtataat

SEQ ID NO: 1246605 - DNA, 22 bp, Artificial Sequence
  chemically synthesized
tctaatcaaaccattggcagta

SEQ ID NO: 1246606 - DNA, 22 bp, Artificial Sequence
  chemically synthesized
tatctaatcaaaccattggcag

SEQ ID NO: 1246607 - DNA, 22 bp, Artificial Sequence
  chemically synthesized
tgaattatactgccaatggttt

SEQ ID NO: 1246608 - DNA, 22 bp, Artificial Sequence
  chemically synthesized
tactgccaatggtttgattaga

SEQ ID NO: 1246609 - DNA, 22 bp, Artificial Sequence
  chemically synthesized
ccaatggtttgattagatagaa

SEQ ID NO: 1246610 - DNA, 22 bp, Artificial Sequence
  chemically synthesized
aaaatcagtaagattctatcta

SEQ ID NO: 1246611 - DNA, 22 bp, Artificial Sequence
  chemically synthesized
aaaaatcagtaagattctatct

SEQ ID NO: 1246612 - DNA, 22 bp, Artificial Sequence
  chemically synthesized
tttaaaaatcagtaagattcta

SEQ ID NO: 1246613 - DNA, 22 bp, Artificial Sequence
  chemically synthesized
gattagatagaatcttactgat

SEQ ID NO: 1246614 - DNA, 22 bp, Artificial Sequence
  chemically synthesized
attagatagaatcttactgatt

SEQ ID NO: 1246615 - DNA, 22 bp, Artificial Sequence
  chemically synthesized
atattatttaaaaatcagtaag

SEQ ID NO: 1246616 - DNA, 22 bp, Artificial Sequence
  chemically synthesized
gatattatttaaaaatcagtaa

SEQ ID NO: 1246617 - DNA, 22 bp, Artificial Sequence
  chemically synthesized
gatagaatcttactgattttta

SEQ ID NO: 1246618 - DNA, 22 bp, Artificial Sequence
  chemically synthesized
actgatttttaaataatatcaa

SEQ ID NO: 1246619 - DNA, 22 bp, Artificial Sequence
  chemically synthesized
ctgatttttaaataatatcaaa

SEQ ID NO: 1246620 - DNA, 22 bp, Artificial Sequence
  chemically synthesized
gagatggaaaaatttgatatta

SEQ ID NO: 1246621 - DNA, 22 bp, Artificial Sequence
  chemically synthesized
atttttaaataatatcaaattt

SEQ ID NO: 1246622 - DNA, 22 bp, Artificial Sequence
  chemically synthesized
ttaaataatatcaaatttttcc

SEQ ID NO: 1246623 - DNA, 22 bp, Artificial Sequence
  chemically synthesized
atgattagagatggaaaaattt

SEQ ID NO: 1246624 - DNA, 22 bp, Artificial Sequence
  chemically synthesized
taaataatatcaaatttttcca

SEQ ID NO: 1246625 - DNA, 22 bp, Artificial Sequence
  chemically synthesized
catgattagagatggaaaaatt

SEQ ID NO: 1246626 - DNA, 22 bp, Artificial Sequence
  chemically synthesized
aaataatatcaaatttttccat

SEQ ID NO: 1246627 - DNA, 22 bp, Artificial Sequence
  chemically synthesized
tcatgattagagatggaaaaat

SEQ ID NO: 1246628 - DNA, 22 bp, Artificial Sequence
  chemically synthesized
aataatatcaaatttttccatc

SEQ ID NO: 1246629 - DNA, 22 bp, Artificial Sequence
  chemically synthesized
ttcatgattagagatggaaaaa

SEQ ID NO: 1246630 - DNA, 22 bp, Artificial Sequence
  chemically synthesized
ttttcatgattagagatggaaa

SEQ ID NO: 1246631 - DNA, 22 bp, Artificial Sequence
  chemically synthesized
accactcttttcatgattagag

SEQ ID NO: 1246632 - DNA, 22 bp, Artificial Sequence
  chemically synthesized
cctcaccactcttttcatgatt

SEQ ID NO: 1246633 - DNA, 22 bp, Artificial Sequence
  chemically synthesized
ttccatctctaatcatgaaaag

SEQ ID NO: 1246634 - DNA, 22 bp, Artificial Sequence
  chemically synthesized
tccatctctaatcatgaaaaga

SEQ ID NO: 1246635 - DNA, 22 bp, Artificial Sequence
  chemically synthesized
ccatctctaatcatgaaaagag

SEQ ID NO: 1246636 - DNA, 22 bp, Artificial Sequence
  chemically synthesized
catctctaatcatgaaaagagt

SEQ ID NO: 1246637 - DNA, 22 bp, Artificial Sequence
  chemically synthesized
ccctacctcaccactcttttca

SEQ ID NO: 1246638 - DNA, 22 bp, Artificial Sequence
  chemically synthesized
tcctgccctacctcaccactct

SEQ ID NO: 1246639 - DNA, 22 bp, Artificial Sequence
  chemically synthesized
taatcatgaaaagagtggtgag

SEQ ID NO: 1246640 - DNA, 22 bp, Artificial Sequence
  chemically synthesized
atcctgccctacctcaccactc

SEQ ID NO: 1246641 - DNA, 22 bp, Artificial Sequence
  chemically synthesized
atcatgaaaagagtggtgaggt

SEQ ID NO: 1246642 - DNA, 22 bp, Artificial Sequence
  chemically synthesized
cgatttatcctgccctacctca

SEQ ID NO: 1246643 - DNA, 22 bp, Artificial Sequence
  chemically synthesized
gccccaatattacgatttatcc

SEQ ID NO: 1246644 - DNA, 22 bp, Artificial Sequence
  chemically synthesized
cacctggccccaatattacgat

SEQ ID NO: 1246645 - DNA, 22 bp, Artificial Sequence
  chemically synthesized
caggcatgagccattgcacctg

SEQ ID NO: 1246646 - DNA, 22 bp, Artificial Sequence
  chemically synthesized
acaggcatgagccattgcacct

SEQ ID NO: 1246647 - DNA, 22 bp, Artificial Sequence
  chemically synthesized
ggcttacaggcatgagccattg

SEQ ID NO: 1246648 - DNA, 22 bp, Artificial Sequence
  chemically synthesized
gggccaggtgcaatggctcatg

SEQ ID NO: 1246649 - DNA, 22 bp, Artificial Sequence
  chemically synthesized
ccaaagtgttgggcttacaggc

SEQ ID NO: 1246650 - DNA, 22 bp, Artificial Sequence
  chemically synthesized
agcctcccaaagtgttgggctt

SEQ ID NO: 1246651 - DNA, 22 bp, Artificial Sequence
  chemically synthesized
atgcctgtaagcccaacacttt

SEQ ID NO: 1246652 - DNA, 22 bp, Artificial Sequence
  chemically synthesized
cctcagcctcccaaagtgttgg

SEQ ID NO: 1246653 - DNA, 22 bp, Artificial Sequence
  chemically synthesized
taagcccaacactttgggaggc

SEQ ID NO: 1246654 - DNA, 22 bp, Artificial Sequence
  chemically synthesized
gtgatccacctgcctcagcctc

SEQ ID NO: 1246655 - DNA, 22 bp, Artificial Sequence
  chemically synthesized
acctcgtgatccacctgcctca

SEQ ID NO: 1246656 - DNA, 22 bp, Artificial Sequence
  chemically synthesized
ctgacctcgtgatccacctgcc

SEQ ID NO: 1246657 - DNA, 22 bp, Artificial Sequence
  chemically synthesized
tgggaggctgaggcaggtggat

SEQ ID NO: 1246658 - DNA, 22 bp, Artificial Sequence
  chemically synthesized
gggaggctgaggcaggtggatc

SEQ ID NO: 1246659 - DNA, 22 bp, Artificial Sequence
  chemically synthesized
ggaggctgaggcaggtggatca

SEQ ID NO: 1246660 - DNA, 22 bp, Artificial Sequence
  chemically synthesized
gaactcctgacctcgtgatcca

SEQ ID NO: 1246661 - DNA, 22 bp, Artificial Sequence
  chemically synthesized
aggcaggtggatcacgaggtca

SEQ ID NO: 1246662 - DNA, 22 bp, Artificial Sequence
  chemically synthesized
gtctcgaactcctgacctcgtg

SEQ ID NO: 1246663 - DNA, 22 bp, Artificial Sequence
  chemically synthesized
ggtcaggctggtctcgaactcc

SEQ ID NO: 1246664 - DNA, 22 bp, Artificial Sequence
  chemically synthesized
catctcggtcaggctggtctcg

SEQ ID NO: 1246665 - DNA, 22 bp, Artificial Sequence
  chemically synthesized
tccatctcggtcaggctggtct

SEQ ID NO: 1246666 - DNA, 22 bp, Artificial Sequence
  chemically synthesized
ctccatctcggtcaggctggtc

SEQ ID NO: 1246667 - DNA, 22 bp, Artificial Sequence
  chemically synthesized
gagaccagcctgaccgagatgg

SEQ ID NO: 1246668 - DNA, 22 bp, Artificial Sequence
  chemically synthesized
atagagatggggtttctccatc

SEQ ID NO: 1246669 - DNA, 22 bp, Artificial Sequence
  chemically synthesized
aatagagatggggtttctccat

SEQ ID NO: 1246670 - DNA, 22 bp, Artificial Sequence
  chemically synthesized
taatagagatggggtttctcca

SEQ ID NO: 1246671 - DNA, 22 bp, Artificial Sequence
  chemically synthesized
ttaatagagatggggtttctcc

SEQ ID NO: 1246672 - DNA, 22 bp, Artificial Sequence
  chemically synthesized
accgagatggagaaaccccatc

SEQ ID NO: 1246673 - DNA, 22 bp, Artificial Sequence
  chemically synthesized
tgtttttaatagagatggggtt

SEQ ID NO: 1246674 - DNA, 22 bp, Artificial Sequence
  chemically synthesized
gtgtttttaatagagatggggt

SEQ ID NO: 1246675 - DNA, 22 bp, Artificial Sequence
  chemically synthesized
tgtgtttttaatagagatgggg

SEQ ID NO: 1246676 - DNA, 22 bp, Artificial Sequence
  chemically synthesized
ttgtgtttttaatagagatggg

SEQ ID NO: 1246677 - DNA, 22 bp, Artificial Sequence
  chemically synthesized
atttttgtgtttttaatagaga

SEQ ID NO: 1246678 - DNA, 22 bp, Artificial Sequence
  chemically synthesized
tgcccggctaatttttgtgttt

SEQ ID NO: 1246679 - DNA, 22 bp, Artificial Sequence
  chemically synthesized
tattaaaaacacaaaaattagc

SEQ ID NO: 1246680 - DNA, 22 bp, Artificial Sequence
  chemically synthesized
ccactgtgcccggctaattttt

SEQ ID NO: 1246681 - DNA, 22 bp, Artificial Sequence
  chemically synthesized
ttaaaaacacaaaaattagccg

SEQ ID NO: 1246682 - DNA, 22 bp, Artificial Sequence
  chemically synthesized
aaaacacaaaaattagccgggc

SEQ ID NO: 1246683 - DNA, 22 bp, Artificial Sequence
  chemically synthesized
caggtacctgccactgtgcccg

SEQ ID NO: 1246684 - DNA, 22 bp, Artificial Sequence
  chemically synthesized
ggattacaggtacctgccactg

SEQ ID NO: 1246685 - DNA, 22 bp, Artificial Sequence
  chemically synthesized
gccgggcacagtggcaggtacc

SEQ ID NO: 1246686 - DNA, 22 bp, Artificial Sequence
  chemically synthesized
cccagtagctgggattacaggt

SEQ ID NO: 1246687 - DNA, 22 bp, Artificial Sequence
  chemically synthesized
agcctccccagtagctgggatt

SEQ ID NO: 1246688 - DNA, 22 bp, Artificial Sequence
  chemically synthesized
cctcagcctccccagtagctgg

SEQ ID NO: 1246689 - DNA, 22 bp, Artificial Sequence
  chemically synthesized
ctgcctcagcctccccagtagc

SEQ ID NO: 1246690 - DNA, 22 bp, Artificial Sequence
  chemically synthesized
tcctgcctcagcctccccagta

SEQ ID NO: 1246691 - DNA, 22 bp, Artificial Sequence
  chemically synthesized
taatcccagctactggggaggc

SEQ ID NO: 1246692 - DNA, 22 bp, Artificial Sequence
  chemically synthesized
aagcaactctcctgcctcagcc

SEQ ID NO: 1246693 - DNA, 22 bp, Artificial Sequence
  chemically synthesized
ctggggaggctgaggcaggaga

SEQ ID NO: 1246694 - DNA, 22 bp, Artificial Sequence
  chemically synthesized
gggaggctgaggcaggagagtt

SEQ ID NO: 1246695 - DNA, 22 bp, Artificial Sequence
  chemically synthesized
ccgggttcaagcaactctcctg

SEQ ID NO: 1246696 - DNA, 22 bp, Artificial Sequence
  chemically synthesized
cgcctcccgggttcaagcaact

SEQ ID NO: 1246697 - DNA, 22 bp, Artificial Sequence
  chemically synthesized
aggcaggagagttgcttgaacc

SEQ ID NO: 1246698 - DNA, 22 bp, Artificial Sequence
  chemically synthesized
aatgcaacctccgcctcccggg

SEQ ID NO: 1246699 - DNA, 22 bp, Artificial Sequence
  chemically synthesized
aactcaatgcaacctccgcctc

SEQ ID NO: 1246700 - DNA, 22 bp, Artificial Sequence
  chemically synthesized
cttgaacccgggaggcggaggt

SEQ ID NO: 1246701 - DNA, 22 bp, Artificial Sequence
  chemically synthesized
gaacccgggaggcggaggttgc

SEQ ID NO: 1246702 - DNA, 22 bp, Artificial Sequence
  chemically synthesized
tctcaactcaatgcaacctccg

SEQ ID NO: 1246703 - DNA, 22 bp, Artificial Sequence
  chemically synthesized
aacccgggaggcggaggttgca

SEQ ID NO: 1246704 - DNA, 22 bp, Artificial Sequence
  chemically synthesized
gagtgcagtggtgctgtctcaa

SEQ ID NO: 1246705 - DNA, 22 bp, Artificial Sequence
  chemically synthesized
cattgagttgagacagcaccac

SEQ ID NO: 1246706 - DNA, 22 bp, Artificial Sequence
  chemically synthesized
ggctagagtgcagtggtgctgt

SEQ ID NO: 1246707 - DNA, 22 bp, Artificial Sequence
  chemically synthesized
agttgagacagcaccactgcac

SEQ ID NO: 1246708 - DNA, 22 bp, Artificial Sequence
  chemically synthesized
tcgcctaggctagagtgcagtg

SEQ ID NO: 1246709 - DNA, 22 bp, Artificial Sequence
  chemically synthesized
agacagcaccactgcactctag

SEQ ID NO: 1246710 - DNA, 22 bp, Artificial Sequence
  chemically synthesized
gtctgtcgcctaggctagagtg

SEQ ID NO: 1246711 - DNA, 22 bp, Artificial Sequence
  chemically synthesized
ggtctgtcgcctaggctagagt

SEQ ID NO: 1246712 - DNA, 22 bp, Artificial Sequence
  chemically synthesized
cactctagcctaggcgacagac

SEQ ID NO: 1246713 - DNA, 22 bp, Artificial Sequence
  chemically synthesized
agacgtagtcttggtctgtcgc

SEQ ID NO: 1246714 - DNA, 22 bp, Artificial Sequence
  chemically synthesized
gagacgtagtcttggtctgtcg

SEQ ID NO: 1246715 - DNA, 22 bp, Artificial Sequence
  chemically synthesized
tgagacgtagtcttggtctgtc

SEQ ID NO: 1246716 - DNA, 22 bp, Artificial Sequence
  chemically synthesized
ttgagacgtagtcttggtctgt

SEQ ID NO: 1246717 - DNA, 22 bp, Artificial Sequence
  chemically synthesized
tagcctaggcgacagaccaaga

SEQ ID NO: 1246718 - DNA, 22 bp, Artificial Sequence
  chemically synthesized
tttgagacgtagtcttggtctg

SEQ ID NO: 1246719 - DNA, 22 bp, Artificial Sequence
  chemically synthesized
ttttgagacgtagtcttggtct

SEQ ID NO: 1246720 - DNA, 22 bp, Artificial Sequence
  chemically synthesized
gcctaggcgacagaccaagact

SEQ ID NO: 1246721 - DNA, 22 bp, Artificial Sequence
  chemically synthesized
tttttgagacgtagtcttggtc

SEQ ID NO: 1246722 - DNA, 22 bp, Artificial Sequence
  chemically synthesized
ttttttgagacgtagtcttggt

SEQ ID NO: 1246723 - DNA, 22 bp, Artificial Sequence
  chemically synthesized
tttttttgagacgtagtcttgg

SEQ ID NO: 1246724 - DNA, 22 bp, Artificial Sequence
  chemically synthesized
ggcgacagaccaagactacgtc

SEQ ID NO: 1246725 - DNA, 22 bp, Artificial Sequence
  chemically synthesized
ttttttttttgagacgtagtct

SEQ ID NO: 1246726 - DNA, 22 bp, Artificial Sequence
  chemically synthesized
gttttttttttgagacgtagtc

SEQ ID NO: 1246727 - DNA, 22 bp, Artificial Sequence
  chemically synthesized
tgttttttttttgagacgtagt

SEQ ID NO: 1246728 - DNA, 22 bp, Artificial Sequence
  chemically synthesized
ttgttttttttttgagacgtag

SEQ ID NO: 1246729 - DNA, 22 bp, Artificial Sequence
  chemically synthesized
tttgttttttttttgagacgta

SEQ ID NO: 1246730 - DNA, 22 bp, Artificial Sequence
  chemically synthesized
ttttttgttttttttttgagac

SEQ ID NO: 1246731 - DNA, 22 bp, Artificial Sequence
  chemically synthesized
gttttttgttttttttttgaga

SEQ ID NO: 1246732 - DNA, 22 bp, Artificial Sequence
  chemically synthesized
tgttttttgttttttttttgag

SEQ ID NO: 1246733 - DNA, 22 bp, Artificial Sequence
  chemically synthesized
ttgttttttgttttttttttga

SEQ ID NO: 1246734 - DNA, 22 bp, Artificial Sequence
  chemically synthesized
tttgttttttgttttttttttg

SEQ ID NO: 1246735 - DNA, 22 bp, Artificial Sequence
  chemically synthesized
ttttttgttttttgtttttttt

SEQ ID NO: 1246736 - DNA, 22 bp, Artificial Sequence
  chemically synthesized
gttttttgttttttgttttttt

SEQ ID NO: 1246737 - DNA, 22 bp, Artificial Sequence
  chemically synthesized
cgtctcaaaaaaaaaacaaaaa

SEQ ID NO: 1246738 - DNA, 22 bp, Artificial Sequence
  chemically synthesized
tttgttttttgttttttgtttt

SEQ ID NO: 1246739 - DNA, 22 bp, Artificial Sequence
  chemically synthesized
gtttgttttttgttttttgttt

SEQ ID NO: 1246740 - DNA, 22 bp, Artificial Sequence
  chemically synthesized
tgtttgttttttgttttttgtt

SEQ ID NO: 1246741 - DNA, 22 bp, Artificial Sequence
  chemically synthesized
ttgtttgttttttgttttttgt

SEQ ID NO: 1246742 - DNA, 22 bp, Artificial Sequence
  chemically synthesized
tttgtttgttttttgttttttg

SEQ ID NO: 1246743 - DNA, 22 bp, Artificial Sequence
  chemically synthesized
ttttgtttgttttttgtttttt

SEQ ID NO: 1246744 - DNA, 22 bp, Artificial Sequence
  chemically synthesized
aaaaaaaaaacaaaaaacaaaa

SEQ ID NO: 1246745 - DNA, 22 bp, Artificial Sequence
  chemically synthesized
tttttgtttgttttttgttttt

SEQ ID NO: 1246746 - DNA, 22 bp, Artificial Sequence
  chemically synthesized
ttttttgtttgttttttgtttt

SEQ ID NO: 1246747 - DNA, 22 bp, Artificial Sequence
  chemically synthesized
tttttttgtttgttttttgttt

SEQ ID NO: 1246748 - DNA, 22 bp, Artificial Sequence
  chemically synthesized
ttttttttttgtttgttttttg

SEQ ID NO: 1246749 - DNA, 22 bp, Artificial Sequence
  chemically synthesized
gttgttttttttttgtttgttt

SEQ ID NO: 1246750 - DNA, 22 bp, Artificial Sequence
  chemically synthesized
atatacaaatattagttgtttt

SEQ ID NO: 1246751 - DNA, 22 bp, Artificial Sequence
  chemically synthesized
tattaatatacaaatattagtt

SEQ ID NO: 1246752 - DNA, 22 bp, Artificial Sequence
  chemically synthesized
atattaatatacaaatattagt

SEQ ID NO: 1246753 - DNA, 22 bp, Artificial Sequence
  chemically synthesized
aggagtttatattaatatacaa

SEQ ID NO: 1246754 - DNA, 22 bp, Artificial Sequence
  chemically synthesized
atatttgtatattaatataaac

SEQ ID NO: 1246755 - DNA, 22 bp, Artificial Sequence
  chemically synthesized
gtatattaatataaactcctga

SEQ ID NO: 1246756 - DNA, 22 bp, Artificial Sequence
  chemically synthesized
tatattaatataaactcctgaa

SEQ ID NO: 1246757 - DNA, 22 bp, Artificial Sequence
  chemically synthesized
tgtcatgagggattcaggagtt

SEQ ID NO: 1246758 - DNA, 22 bp, Artificial Sequence
  chemically synthesized
atataaactcctgaatccctca

SEQ ID NO: 1246759 - DNA, 22 bp, Artificial Sequence
  chemically synthesized
atacacatggatattatgtcat

SEQ ID NO: 1246760 - DNA, 22 bp, Artificial Sequence
  chemically synthesized
ctgaatccctcatgacataata

SEQ ID NO: 1246761 - DNA, 22 bp, Artificial Sequence
  chemically synthesized
gatacacatggatattatgtca

SEQ ID NO: 1246762 - DNA, 22 bp, Artificial Sequence
  chemically synthesized
aatccctcatgacataatatcc

SEQ ID NO: 1246763 - DNA, 22 bp, Artificial Sequence
  chemically synthesized
atgacataatatccatgtgtat

SEQ ID NO: 1246764 - DNA, 22 bp, Artificial Sequence
  chemically synthesized
tttattcctgcatctgttaccg

SEQ ID NO: 1246765 - DNA, 22 bp, Artificial Sequence
  chemically synthesized
ttattcctgcatctgttaccgt

SEQ ID NO: 1246766 - DNA, 22 bp, Artificial Sequence
  chemically synthesized
tattcctgcatctgttaccgtt

SEQ ID NO: 1246767 - DNA, 22 bp, Artificial Sequence
  chemically synthesized
attcctgcatctgttaccgtta

SEQ ID NO: 1246768 - DNA, 22 bp, Artificial Sequence
  chemically synthesized
ttcctgcatctgttaccgttat

SEQ ID NO: 1246769 - DNA, 22 bp, Artificial Sequence
  chemically synthesized
ctgcatctgttaccgttattct

SEQ ID NO: 1246770 - DNA, 22 bp, Artificial Sequence
  chemically synthesized
tgagaggcatagggagaataac

SEQ ID NO: 1246771 - DNA, 22 bp, Artificial Sequence
  chemically synthesized
catctgttaccgttattctccc

SEQ ID NO: 1246772 - DNA, 22 bp, Artificial Sequence
  chemically synthesized
gctgtgagaggcatagggagaa

SEQ ID NO: 1246773 - DNA, 22 bp, Artificial Sequence
  chemically synthesized
tggctgtgagaggcatagggag

SEQ ID NO: 1246774 - DNA, 22 bp, Artificial Sequence
  chemically synthesized
ttaccgttattctccctatgcc

SEQ ID NO: 1246775 - DNA, 22 bp, Artificial Sequence
  chemically synthesized
ctggctgtgagaggcataggga

SEQ ID NO: 1246776 - DNA, 22 bp, Artificial Sequence
  chemically synthesized
ccgttattctccctatgcctct

SEQ ID NO: 1246777 - DNA, 22 bp, Artificial Sequence
  chemically synthesized
cttctggctgtgagaggcatag

SEQ ID NO: 1246778 - DNA, 22 bp, Artificial Sequence
  chemically synthesized
ccttctggctgtgagaggcata

SEQ ID NO: 1246779 - DNA, 22 bp, Artificial Sequence
  chemically synthesized
tccttctggctgtgagaggcat

SEQ ID NO: 1246780 - DNA, 22 bp, Artificial Sequence
  chemically synthesized
ttctccctatgcctctcacagc

SEQ ID NO: 1246781 - DNA, 22 bp, Artificial Sequence
  chemically synthesized
agttttccttctggctgtgaga

SEQ ID NO: 1246782 - DNA, 22 bp, Artificial Sequence
  chemically synthesized
cagttttccttctggctgtgag

SEQ ID NO: 1246783 - DNA, 22 bp, Artificial Sequence
  chemically synthesized
tccctatgcctctcacagccag

SEQ ID NO: 1246784 - DNA, 22 bp, Artificial Sequence
  chemically synthesized
tcagttttccttctggctgtga

SEQ ID NO: 1246785 - DNA, 22 bp, Artificial Sequence
  chemically synthesized
cctatgcctctcacagccagaa

SEQ ID NO: 1246786 - DNA, 22 bp, Artificial Sequence
  chemically synthesized
tgcctctcacagccagaaggaa

SEQ ID NO: 1246787 - DNA, 22 bp, Artificial Sequence
  chemically synthesized
tcacagccagaaggaaaactga

SEQ ID NO: 1246788 - DNA, 22 bp, Artificial Sequence
  chemically synthesized
acagccagaaggaaaactgaaa

SEQ ID NO: 1246789 - DNA, 22 bp, Artificial Sequence
  chemically synthesized
ccaaaaggaagatagtagactt

SEQ ID NO: 1246790 - DNA, 22 bp, Artificial Sequence
  chemically synthesized
accaaaaggaagatagtagact

SEQ ID NO: 1246791 - DNA, 22 bp, Artificial Sequence
  chemically synthesized
taccaaaaggaagatagtagac

SEQ ID NO: 1246792 - DNA, 22 bp, Artificial Sequence
  chemically synthesized
ttaccaaaaggaagatagtaga

SEQ ID NO: 1246793 - DNA, 22 bp, Artificial Sequence
  chemically synthesized
aaatttttaccaaaaggaagat

SEQ ID NO: 1246794 - DNA, 22 bp, Artificial Sequence
  chemically synthesized
caaatttttaccaaaaggaaga

SEQ ID NO: 1246795 - DNA, 22 bp, Artificial Sequence
  chemically synthesized
aaagtctactatcttccttttg

SEQ ID NO: 1246796 - DNA, 22 bp, Artificial Sequence
  chemically synthesized
tcaaatttttaccaaaaggaag

SEQ ID NO: 1246797 - DNA, 22 bp, Artificial Sequence
  chemically synthesized
ttcaaatttttaccaaaaggaa

SEQ ID NO: 1246798 - DNA, 22 bp, Artificial Sequence
  chemically synthesized
ttttcaaatttttaccaaaagg

SEQ ID NO: 1246799 - DNA, 22 bp, Artificial Sequence
  chemically synthesized
cttttcaaatttttaccaaaag

SEQ ID NO: 1246800 - DNA, 22 bp, Artificial Sequence
  chemically synthesized
ctatcttccttttggtaaaaat

SEQ ID NO: 1246801 - DNA, 22 bp, Artificial Sequence
  chemically synthesized
tcttccttttggtaaaaatttg

SEQ ID NO: 1246802 - DNA, 22 bp, Artificial Sequence
  chemically synthesized
aatgcccttcttttcaaatttt

SEQ ID NO: 1246803 - DNA, 22 bp, Artificial Sequence
  chemically synthesized
ccttttggtaaaaatttgaaaa

SEQ ID NO: 1246804 - DNA, 22 bp, Artificial Sequence
  chemically synthesized
cttttggtaaaaatttgaaaag

SEQ ID NO: 1246805 - DNA, 22 bp, Artificial Sequence
  chemically synthesized
cctgaatgcccttcttttcaaa

SEQ ID NO: 1246806 - DNA, 22 bp, Artificial Sequence
  chemically synthesized
ttggtaaaaatttgaaaagaag

SEQ ID NO: 1246807 - DNA, 22 bp, Artificial Sequence
  chemically synthesized
tacctgaatgcccttcttttca

SEQ ID NO: 1246808 - DNA, 22 bp, Artificial Sequence
  chemically synthesized
tggtaaaaatttgaaaagaagg

SEQ ID NO: 1246809 - DNA, 22 bp, Artificial Sequence
  chemically synthesized
ggtaaaaatttgaaaagaaggg

SEQ ID NO: 1246810 - DNA, 22 bp, Artificial Sequence
  chemically synthesized
gtaaaaatttgaaaagaagggc

SEQ ID NO: 1246811 - DNA, 22 bp, Artificial Sequence
  chemically synthesized
gaaaagaagggcattcaggtag

SEQ ID NO: 1246812 - DNA, 22 bp, Artificial Sequence
  chemically synthesized
aaaagaagggcattcaggtaga

SEQ ID NO: 1246813 - DNA, 22 bp, Artificial Sequence
  chemically synthesized
ataaatgccatctctacctgaa

SEQ ID NO: 1246814 - DNA, 22 bp, Artificial Sequence
  chemically synthesized
gcattaataaatgccatctcta

SEQ ID NO: 1246815 - DNA, 22 bp, Artificial Sequence
  chemically synthesized
aggtagagatggcatttattaa

SEQ ID NO: 1246816 - DNA, 22 bp, Artificial Sequence
  chemically synthesized
ccgcagtcactggcattaataa

SEQ ID NO: 1246817 - DNA, 22 bp, Artificial Sequence
  chemically synthesized
attaatgccagtgactgcggca

SEQ ID NO: 1246818 - DNA, 22 bp, Artificial Sequence
  chemically synthesized
ttaatgccagtgactgcggcag

SEQ ID NO: 1246819 - DNA, 22 bp, Artificial Sequence
  chemically synthesized
atgccagtgactgcggcagact

SEQ ID NO: 1246820 - DNA, 22 bp, Artificial Sequence
  chemically synthesized
ccagcggcccaagaacagtctg

SEQ ID NO: 1246821 - DNA, 22 bp, Artificial Sequence
  chemically synthesized
cccagcggcccaagaacagtct

SEQ ID NO: 1246822 - DNA, 22 bp, Artificial Sequence
  chemically synthesized
cggcagactgttcttgggccgc

SEQ ID NO: 1246823 - DNA, 22 bp, Artificial Sequence
  chemically synthesized
tcaccacaggcttcccagcggc

SEQ ID NO: 1246824 - DNA, 22 bp, Artificial Sequence
  chemically synthesized
atcaccacaggcttcccagcgg

SEQ ID NO: 1246825 - DNA, 22 bp, Artificial Sequence
  chemically synthesized
tttatcaccacaggcttcccag

SEQ ID NO: 1246826 - DNA, 22 bp, Artificial Sequence
  chemically synthesized
ttcttgggccgctgggaagcct

SEQ ID NO: 1246827 - DNA, 22 bp, Artificial Sequence
  chemically synthesized
ttgggccgctgggaagcctgtg

SEQ ID NO: 1246828 - DNA, 22 bp, Artificial Sequence
  chemically synthesized
gggccgctgggaagcctgtggt

SEQ ID NO: 1246829 - DNA, 22 bp, Artificial Sequence
  chemically synthesized
ggccgctgggaagcctgtggtg

SEQ ID NO: 1246830 - DNA, 22 bp, Artificial Sequence
  chemically synthesized
caatgctgtttatcaccacagg

SEQ ID NO: 1246831 - DNA, 22 bp, Artificial Sequence
  chemically synthesized
ctccaatgctgtttatcaccac

SEQ ID NO: 1246832 - DNA, 22 bp, Artificial Sequence
  chemically synthesized
cctccaatgctgtttatcacca

SEQ ID NO: 1246833 - DNA, 22 bp, Artificial Sequence
  chemically synthesized
ttcctccaatgctgtttatcac

SEQ ID NO: 1246834 - DNA, 22 bp, Artificial Sequence
  chemically synthesized
ggaagcctgtggtgataaacag

SEQ ID NO: 1246835 - DNA, 22 bp, Artificial Sequence
  chemically synthesized
cttcctccaatgctgtttatca

SEQ ID NO: 1246836 - DNA, 22 bp, Artificial Sequence
  chemically synthesized
tcttcctccaatgctgtttatc

SEQ ID NO: 1246837 - DNA, 22 bp, Artificial Sequence
  chemically synthesized
tttcttcctccaatgctgttta

SEQ ID NO: 1246838 - DNA, 22 bp, Artificial Sequence
  chemically synthesized
tggtgataaacagcattggagg

SEQ ID NO: 1246839 - DNA, 22 bp, Artificial Sequence
  chemically synthesized
gaggaagaaagagtcaccattt

SEQ ID NO: 1246840 - DNA, 22 bp, Artificial Sequence
  chemically synthesized
tgatgagagtcatgtgccatat

SEQ ID NO: 1246841 - DNA, 22 bp, Artificial Sequence
  chemically synthesized
acatatggcacatgactctcat

SEQ ID NO: 1246842 - DNA, 22 bp, Artificial Sequence
  chemically synthesized
catatggcacatgactctcatc

SEQ ID NO: 1246843 - DNA, 22 bp, Artificial Sequence
  chemically synthesized
gtgaataagcaacacaagctgt

SEQ ID NO: 1246844 - DNA, 22 bp, Artificial Sequence
  chemically synthesized
tcatcacagcttgtgttgctta

SEQ ID NO: 1246845 - DNA, 22 bp, Artificial Sequence
  chemically synthesized
atcacagcttgtgttgcttatt

SEQ ID NO: 1246846 - DNA, 22 bp, Artificial Sequence
  chemically synthesized
gtgttgcttattcaccagtttg

SEQ ID NO: 1246847 - DNA, 22 bp, Artificial Sequence
  chemically synthesized
tgttgcttattcaccagtttga

SEQ ID NO: 1246848 - DNA, 22 bp, Artificial Sequence
  chemically synthesized
gcaagggcaaagtcaaactggt

SEQ ID NO: 1246849 - DNA, 22 bp, Artificial Sequence
  chemically synthesized
ggcaagggcaaagtcaaactgg

SEQ ID NO: 1246850 - DNA, 22 bp, Artificial Sequence
  chemically synthesized
tggcaagggcaaagtcaaactg

SEQ ID NO: 1246851 - DNA, 22 bp, Artificial Sequence
  chemically synthesized
ttggcaagggcaaagtcaaact

SEQ ID NO: 1246852 - DNA, 22 bp, Artificial Sequence
  chemically synthesized
cttattcaccagtttgactttg

SEQ ID NO: 1246853 - DNA, 22 bp, Artificial Sequence
  chemically synthesized
attcaccagtttgactttgccc

SEQ ID NO: 1246854 - DNA, 22 bp, Artificial Sequence
  chemically synthesized
accttttggcaagggcaaagtc

SEQ ID NO: 1246855 - DNA, 22 bp, Artificial Sequence
  chemically synthesized
ttcaccagtttgactttgccct

SEQ ID NO: 1246856 - DNA, 22 bp, Artificial Sequence
  chemically synthesized
accagtttgactttgcccttgc

SEQ ID NO: 1246857 - DNA, 22 bp, Artificial Sequence
  chemically synthesized
tctaaccttttggcaagggcaa

SEQ ID NO: 1246858 - DNA, 22 bp, Artificial Sequence
  chemically synthesized
gactttgcccttgccaaaaggt

SEQ ID NO: 1246859 - DNA, 22 bp, Artificial Sequence
  chemically synthesized
actttgcccttgccaaaaggtt

SEQ ID NO: 1246860 - DNA, 22 bp, Artificial Sequence
  chemically synthesized
tgcccttgccaaaaggttagac

SEQ ID NO: 1246861 - DNA, 22 bp, Artificial Sequence
  chemically synthesized
gcccttgccaaaaggttagaca

SEQ ID NO: 1246862 - DNA, 22 bp, Artificial Sequence
  chemically synthesized
cccttgccaaaaggttagacaa

SEQ ID NO: 1246863 - DNA, 22 bp, Artificial Sequence
  chemically synthesized
gccaaaaggttagacaacctct

SEQ ID NO: 1246864 - DNA, 22 bp, Artificial Sequence
  chemically synthesized
ccaaaaggttagacaacctctg

SEQ ID NO: 1246865 - DNA, 22 bp, Artificial Sequence
  chemically synthesized
gacaacctctgctatgccctcc

SEQ ID NO: 1246866 - DNA, 22 bp, Artificial Sequence
  chemically synthesized
ccagtaggatgaggagggcata

SEQ ID NO: 1246867 - DNA, 22 bp, Artificial Sequence
  chemically synthesized
gccagtaggatgaggagggcat

SEQ ID NO: 1246868 - DNA, 22 bp, Artificial Sequence
  chemically synthesized
tgctatgccctcctcatcctac

SEQ ID NO: 1246869 - DNA, 22 bp, Artificial Sequence
  chemically synthesized
ctatgccctcctcatcctactg

SEQ ID NO: 1246870 - DNA, 22 bp, Artificial Sequence
  chemically synthesized
tgccctcctcatcctactggca

SEQ ID NO: 1246871 - DNA, 22 bp, Artificial Sequence
  chemically synthesized
ctcatcctactggcaaattacc

SEQ ID NO: 1246872 - DNA, 22 bp, Artificial Sequence
  chemically synthesized
atcctactggcaaattaccact

SEQ ID NO: 1246873 - DNA, 22 bp, Artificial Sequence
  chemically synthesized
ataaaatgggaacaaagtggta

SEQ ID NO: 1246874 - DNA, 22 bp, Artificial Sequence
  chemically synthesized
cataaaatgggaacaaagtggt

SEQ ID NO: 1246875 - DNA, 22 bp, Artificial Sequence
  chemically synthesized
ctggcaaattaccactttgttc

SEQ ID NO: 1246876 - DNA, 22 bp, Artificial Sequence
  chemically synthesized
gcaaattaccactttgttccca

SEQ ID NO: 1246877 - DNA, 22 bp, Artificial Sequence
  chemically synthesized
aataatttcataaaatgggaac

SEQ ID NO: 1246878 - DNA, 22 bp, Artificial Sequence
  chemically synthesized
ttcaataatttcataaaatggg

SEQ ID NO: 1246879 - DNA, 22 bp, Artificial Sequence
  chemically synthesized
attcaataatttcataaaatgg

SEQ ID NO: 1246880 - DNA, 22 bp, Artificial Sequence
  chemically synthesized
ccactttgttcccattttatga

SEQ ID NO: 1246881 - DNA, 22 bp, Artificial Sequence
  chemically synthesized
tattcaataatttcataaaatg

SEQ ID NO: 1246882 - DNA, 22 bp, Artificial Sequence
  chemically synthesized
tgttcccattttatgaaattat

SEQ ID NO: 1246883 - DNA, 22 bp, Artificial Sequence
  chemically synthesized
gttcccattttatgaaattatt

SEQ ID NO: 1246884 - DNA, 22 bp, Artificial Sequence
  chemically synthesized
ttcccattttatgaaattattg

SEQ ID NO: 1246885 - DNA, 22 bp, Artificial Sequence
  chemically synthesized
ccattttatgaaattattgaat

SEQ ID NO: 1246886 - DNA, 22 bp, Artificial Sequence
  chemically synthesized
atggtgatctttattcaataat

SEQ ID NO: 1246887 - DNA, 22 bp, Artificial Sequence
  chemically synthesized
tatgaaattattgaataaagat

SEQ ID NO: 1246888 - DNA, 22 bp, Artificial Sequence
  chemically synthesized
atgaaattattgaataaagatc

SEQ ID NO: 1246889 - DNA, 22 bp, Artificial Sequence
  chemically synthesized
tgaaattattgaataaagatca

SEQ ID NO: 1246890 - DNA, 22 bp, Artificial Sequence
  chemically synthesized
ttgaataaagatcaccattaat

SEQ ID NO: 1246891 - DNA, 22 bp, Artificial Sequence
  chemically synthesized
aaaaagacaaatattaatggtg

SEQ ID NO: 1246892 - DNA, 22 bp, Artificial Sequence
  chemically synthesized
aataaagatcaccattaatatt

SEQ ID NO: 1246893 - DNA, 22 bp, Artificial Sequence
  chemically synthesized
gtattaaaaaagacaaatatta

SEQ ID NO: 1246894 - DNA, 22 bp, Artificial Sequence
  chemically synthesized
tcaataactggtattaaaaaag

SEQ ID NO: 1246895 - DNA, 22 bp, Artificial Sequence
  chemically synthesized
gtcaataactggtattaaaaaa

SEQ ID NO: 1246896 - DNA, 22 bp, Artificial Sequence
  chemically synthesized
atatttgtcttttttaatacca

SEQ ID NO: 1246897 - DNA, 22 bp, Artificial Sequence
  chemically synthesized
gtcttttttaataccagttatt

SEQ ID NO: 1246898 - DNA, 22 bp, Artificial Sequence
  chemically synthesized
tcttttttaataccagttattg

SEQ ID NO: 1246899 - DNA, 22 bp, Artificial Sequence
  chemically synthesized
ttttaataccagttattgacaa

SEQ ID NO: 1246900 - DNA, 22 bp, Artificial Sequence
  chemically synthesized
tttaataccagttattgacaag

SEQ ID NO: 1246901 - DNA, 22 bp, Artificial Sequence
  chemically synthesized
ttaataccagttattgacaagt

SEQ ID NO: 1246902 - DNA, 22 bp, Artificial Sequence
  chemically synthesized
taataccagttattgacaagtg

SEQ ID NO: 1246903 - DNA, 22 bp, Artificial Sequence
  chemically synthesized
aataccagttattgacaagtga

SEQ ID NO: 1246904 - DNA, 22 bp, Artificial Sequence
  chemically synthesized
aatgaacgacgatcacttgtca

SEQ ID NO: 1246905 - DNA, 22 bp, Artificial Sequence
  chemically synthesized
ataccagttattgacaagtgat

SEQ ID NO: 1246906 - DNA, 22 bp, Artificial Sequence
  chemically synthesized
gaatgaacgacgatcacttgtc

SEQ ID NO: 1246907 - DNA, 22 bp, Artificial Sequence
  chemically synthesized
tgaatgaacgacgatcacttgt

SEQ ID NO: 1246908 - DNA, 22 bp, Artificial Sequence
  chemically synthesized
ttgaatgaacgacgatcacttg

SEQ ID NO: 1246909 - DNA, 22 bp, Artificial Sequence
  chemically synthesized
tttgaatgaacgacgatcactt

SEQ ID NO: 1246910 - DNA, 22 bp, Artificial Sequence
  chemically synthesized
ttgacaagtgatcgtcgttcat

SEQ ID NO: 1246911 - DNA, 22 bp, Artificial Sequence
  chemically synthesized
acaagtgatcgtcgttcattca

SEQ ID NO: 1246912 - DNA, 22 bp, Artificial Sequence
  chemically synthesized
aataaatattttttgaatgaac

SEQ ID NO: 1246913 - DNA, 22 bp, Artificial Sequence
  chemically synthesized
tcattcaataaatattttttga

SEQ ID NO: 1246914 - DNA, 22 bp, Artificial Sequence
  chemically synthesized
actgtcattcaataaatatttt

SEQ ID NO: 1246915 - DNA, 22 bp, Artificial Sequence
  chemically synthesized
aactgtcattcaataaatattt

SEQ ID NO: 1246916 - DNA, 22 bp, Artificial Sequence
  chemically synthesized
taactgtcattcaataaatatt

SEQ ID NO: 1246917 - DNA, 22 bp, Artificial Sequence
  chemically synthesized
tttaactgtcattcaataaata

SEQ ID NO: 1246918 - DNA, 22 bp, Artificial Sequence
  chemically synthesized
attcaaaaaatatttattgaat

SEQ ID NO: 1246919 - DNA, 22 bp, Artificial Sequence
  chemically synthesized
aaaaaatatttattgaatgaca

SEQ ID NO: 1246920 - DNA, 22 bp, Artificial Sequence
  chemically synthesized
attgaatgacagttaaagagcc

SEQ ID NO: 1246921 - DNA, 22 bp, Artificial Sequence
  chemically synthesized
aaatacagtaaaggctctttaa

SEQ ID NO: 1246922 - DNA, 22 bp, Artificial Sequence
  chemically synthesized
ttgaatgacagttaaagagcct

SEQ ID NO: 1246923 - DNA, 22 bp, Artificial Sequence
  chemically synthesized
aatgacagttaaagagccttta

SEQ ID NO: 1246924 - DNA, 22 bp, Artificial Sequence
  chemically synthesized
gaaattaaaatacagtaaaggc

SEQ ID NO: 1246925 - DNA, 22 bp, Artificial Sequence
  chemically synthesized
ttggaaattaaaatacagtaaa

SEQ ID NO: 1246926 - DNA, 22 bp, Artificial Sequence
  chemically synthesized
attggaaattaaaatacagtaa

SEQ ID NO: 1246927 - DNA, 22 bp, Artificial Sequence
  chemically synthesized
aagagcctttactgtattttaa

SEQ ID NO: 1246928 - DNA, 22 bp, Artificial Sequence
  chemically synthesized
tactgtattttaatttccaata

SEQ ID NO: 1246929 - DNA, 22 bp, Artificial Sequence
  chemically synthesized
actgtattttaatttccaataa

SEQ ID NO: 1246930 - DNA, 22 bp, Artificial Sequence
  chemically synthesized
ctgtattttaatttccaataaa

SEQ ID NO: 1246931 - DNA, 22 bp, Artificial Sequence
  chemically synthesized
tattttaatttccaataaacat

SEQ ID NO: 1246932 - DNA, 22 bp, Artificial Sequence
  chemically synthesized
taatttccaataaacatatatg

SEQ ID NO: 1246933 - DNA, 22 bp, Artificial Sequence
  chemically synthesized
aatttccaataaacatatatgt

SEQ ID NO: 1246934 - DNA, 22 bp, Artificial Sequence
  chemically synthesized
aaaatatgtgacacatatatgt

SEQ ID NO: 1246935 - DNA, 22 bp, Artificial Sequence
  chemically synthesized
atttccaataaacatatatgtg

SEQ ID NO: 1246936 - DNA, 22 bp, Artificial Sequence
  chemically synthesized
aaaaatatgtgacacatatatg

SEQ ID NO: 1246937 - DNA, 22 bp, Artificial Sequence
  chemically synthesized
taaaaatatgtgacacatatat

SEQ ID NO: 1246938 - DNA, 22 bp, Artificial Sequence
  chemically synthesized
ttaaaaatatgtgacacatata

SEQ ID NO: 1246939 - DNA, 22 bp, Artificial Sequence
  chemically synthesized
ccaataaacatatatgtgtcac

SEQ ID NO: 1246940 - DNA, 22 bp, Artificial Sequence
  chemically synthesized
caataaacatatatgtgtcaca

SEQ ID NO: 1246941 - DNA, 22 bp, Artificial Sequence
  chemically synthesized
catatttttaaaaatatgtgac

SEQ ID NO: 1246942 - DNA, 22 bp, Artificial Sequence
  chemically synthesized
tccatatttttaaaaatatgtg

SEQ ID NO: 1246943 - DNA, 22 bp, Artificial Sequence
  chemically synthesized
ctccatatttttaaaaatatgt

SEQ ID NO: 1246944 - DNA, 22 bp, Artificial Sequence
  chemically synthesized
aacttctccatatttttaaaaa

SEQ ID NO: 1246945 - DNA, 22 bp, Artificial Sequence
  chemically synthesized
ttaaaaatatggagaagttcag

SEQ ID NO: 1246946 - DNA, 22 bp, Artificial Sequence
  chemically synthesized
taaaaatatggagaagttcagc

SEQ ID NO: 1246947 - DNA, 22 bp, Artificial Sequence
  chemically synthesized
aaaaatatggagaagttcagcg

SEQ ID NO: 1246948 - DNA, 22 bp, Artificial Sequence
  chemically synthesized
aaaatatggagaagttcagcgt

SEQ ID NO: 1246949 - DNA, 22 bp, Artificial Sequence
  chemically synthesized
ccaaagtaaagcaaaacaaaaa

SEQ ID NO: 1246950 - DNA, 22 bp, Artificial Sequence
  chemically synthesized
acctaccaaagtaaagcaaaac

SEQ ID NO: 1246951 - DNA, 22 bp, Artificial Sequence
  chemically synthesized
agcgtttttgttttgctttact

SEQ ID NO: 1246952 - DNA, 22 bp, Artificial Sequence
  chemically synthesized
ttgttttgctttactttggtag

SEQ ID NO: 1246953 - DNA, 22 bp, Artificial Sequence
  chemically synthesized
tgttttgctttactttggtagg

SEQ ID NO: 1246954 - DNA, 22 bp, Artificial Sequence
  chemically synthesized
gttttgctttactttggtaggt

SEQ ID NO: 1246955 - DNA, 22 bp, Artificial Sequence
  chemically synthesized
ttttgctttactttggtaggtt

SEQ ID NO: 1246956 - DNA, 22 bp, Artificial Sequence
  chemically synthesized
tgctttactttggtaggttaat

SEQ ID NO: 1246957 - DNA, 22 bp, Artificial Sequence
  chemically synthesized
tgaacatcaggcattaacctac

SEQ ID NO: 1246958 - DNA, 22 bp, Artificial Sequence
  chemically synthesized
gctttactttggtaggttaatg

SEQ ID NO: 1246959 - DNA, 22 bp, Artificial Sequence
  chemically synthesized
ctttactttggtaggttaatgc

SEQ ID NO: 1246960 - DNA, 22 bp, Artificial Sequence
  chemically synthesized
tactttggtaggttaatgcctg

SEQ ID NO: 1246961 - DNA, 22 bp, Artificial Sequence
  chemically synthesized
actttggtaggttaatgcctga

SEQ ID NO: 1246962 - DNA, 22 bp, Artificial Sequence
  chemically synthesized
ctttggtaggttaatgcctgat

SEQ ID NO: 1246963 - DNA, 22 bp, Artificial Sequence
  chemically synthesized
tggtaggttaatgcctgatgtt

SEQ ID NO: 1246964 - DNA, 22 bp, Artificial Sequence
  chemically synthesized
gaaaagattatgaacatcaggc

SEQ ID NO: 1246965 - DNA, 22 bp, Artificial Sequence
  chemically synthesized
ggtaggttaatgcctgatgttc

SEQ ID NO: 1246966 - DNA, 22 bp, Artificial Sequence
  chemically synthesized
gtaggttaatgcctgatgttca

SEQ ID NO: 1246967 - DNA, 22 bp, Artificial Sequence
  chemically synthesized
aactggaaaagattatgaacat

SEQ ID NO: 1246968 - DNA, 22 bp, Artificial Sequence
  chemically synthesized
ttgaactggaaaagattatgaa

SEQ ID NO: 1246969 - DNA, 22 bp, Artificial Sequence
  chemically synthesized
atgcctgatgttcataatcttt

SEQ ID NO: 1246970 - DNA, 22 bp, Artificial Sequence
  chemically synthesized
atgttcataatcttttccagtt

SEQ ID NO: 1246971 - DNA, 22 bp, Artificial Sequence
  chemically synthesized
acccagcctgttgaactggaaa

SEQ ID NO: 1246972 - DNA, 22 bp, Artificial Sequence
  chemically synthesized
ataatcttttccagttcaacag

SEQ ID NO: 1246973 - DNA, 22 bp, Artificial Sequence
  chemically synthesized
ttccagttcaacaggctgggtg

SEQ ID NO: 1246974 - DNA, 22 bp, Artificial Sequence
  chemically synthesized
tccagttcaacaggctgggtga

SEQ ID NO: 1246975 - DNA, 22 bp, Artificial Sequence
  chemically synthesized
ccagttcaacaggctgggtgag

SEQ ID NO: 1246976 - DNA, 22 bp, Artificial Sequence
  chemically synthesized
cagttcaacaggctgggtgagt

SEQ ID NO: 1246977 - DNA, 22 bp, Artificial Sequence
  chemically synthesized
tggtaccataccactcacccag

SEQ ID NO: 1246978 - DNA, 22 bp, Artificial Sequence
  chemically synthesized
atggtaccataccactcaccca

SEQ ID NO: 1246979 - DNA, 22 bp, Artificial Sequence
  chemically synthesized
tatggtaccataccactcaccc

SEQ ID NO: 1246980 - DNA, 22 bp, Artificial Sequence
  chemically synthesized
ttatggtaccataccactcacc

SEQ ID NO: 1246981 - DNA, 22 bp, Artificial Sequence
  chemically synthesized
tttatggtaccataccactcac

SEQ ID NO: 1246982 - DNA, 22 bp, Artificial Sequence
  chemically synthesized
aacaggctgggtgagtggtatg

SEQ ID NO: 1246983 - DNA, 22 bp, Artificial Sequence
  chemically synthesized
atcatcctttttatggtaccat

SEQ ID NO: 1246984 - DNA, 22 bp, Artificial Sequence
  chemically synthesized
ggtgagtggtatggtaccataa

SEQ ID NO: 1246985 - DNA, 22 bp, Artificial Sequence
  chemically synthesized
cagctgatcatcctttttatgg

SEQ ID NO: 1246986 - DNA, 22 bp, Artificial Sequence
  chemically synthesized
ccagctgatcatcctttttatg

SEQ ID NO: 1246987 - DNA, 22 bp, Artificial Sequence
  chemically synthesized
atttccagctgatcatcctttt

SEQ ID NO: 1246988 - DNA, 22 bp, Artificial Sequence
  chemically synthesized
gatttccagctgatcatccttt

SEQ ID NO: 1246989 - DNA, 22 bp, Artificial Sequence
  chemically synthesized
aaggtcttgatttccagctgat

SEQ ID NO: 1246990 - DNA, 22 bp, Artificial Sequence
  chemically synthesized
gaaatcaagaccttcaatctct

SEQ ID NO: 1246991 - DNA, 22 bp, Artificial Sequence
  chemically synthesized
gagggaatggaagtagagattg

SEQ ID NO: 1246992 - DNA, 22 bp, Artificial Sequence
  chemically synthesized
ttagagggaatggaagtagaga

SEQ ID NO: 1246993 - DNA, 22 bp, Artificial Sequence
  chemically synthesized
gttagagggaatggaagtagag

SEQ ID NO: 1246994 - DNA, 22 bp, Artificial Sequence
  chemically synthesized
tttgttagagggaatggaagta

SEQ ID NO: 1246995 - DNA, 22 bp, Artificial Sequence
  chemically synthesized
caatctctacttccattccctc

SEQ ID NO: 1246996 - DNA, 22 bp, Artificial Sequence
  chemically synthesized
aatctctacttccattccctct

SEQ ID NO: 1246997 - DNA, 22 bp, Artificial Sequence
  chemically synthesized
tacttccattccctctaacaaa

SEQ ID NO: 1246998 - DNA, 22 bp, Artificial Sequence
  chemically synthesized
cttccattccctctaacaaaca

SEQ ID NO: 1246999 - DNA, 22 bp, Artificial Sequence
  chemically synthesized
ccattccctctaacaaacagcc

SEQ ID NO: 1247000 - DNA, 22 bp, Artificial Sequence
  chemically synthesized
cattccctctaacaaacagcca

SEQ ID NO: 1247001 - DNA, 22 bp, Artificial Sequence
  chemically synthesized
aatgacaacatgccatggctgt

SEQ ID NO: 1247002 - DNA, 22 bp, Artificial Sequence
  chemically synthesized
cctctaacaaacagccatggca

SEQ ID NO: 1247003 - DNA, 22 bp, Artificial Sequence
  chemically synthesized
taacaaacagccatggcatgtt

SEQ ID NO: 1247004 - DNA, 22 bp, Artificial Sequence
  chemically synthesized
agaattaaatgacaacatgcca

SEQ ID NO: 1247005 - DNA, 22 bp, Artificial Sequence
  chemically synthesized
acaaacagccatggcatgttgt

SEQ ID NO: 1247006 - DNA, 22 bp, Artificial Sequence
  chemically synthesized
tcagaattaaatgacaacatgc

SEQ ID NO: 1247007 - DNA, 22 bp, Artificial Sequence
  chemically synthesized
tctcagaattaaatgacaacat

SEQ ID NO: 1247008 - DNA, 22 bp, Artificial Sequence
  chemically synthesized
tcatttaattctgagagagctt

SEQ ID NO: 1247009 - DNA, 22 bp, Artificial Sequence
  chemically synthesized
aagatgtggaaatgaagctctc

SEQ ID NO: 1247010 - DNA, 22 bp, Artificial Sequence
  chemically synthesized
tgaagatgtggaaatgaagctc

SEQ ID NO: 1247011 - DNA, 22 bp, Artificial Sequence
  chemically synthesized
ctgaagatgtggaaatgaagct

SEQ ID NO: 1247012 - DNA, 22 bp, Artificial Sequence
  chemically synthesized
aattctgagagagcttcatttc

SEQ ID NO: 1247013 - DNA, 22 bp, Artificial Sequence
  chemically synthesized
tctgaagatgtggaaatgaagc

SEQ ID NO: 1247014 - DNA, 22 bp, Artificial Sequence
  chemically synthesized
attctgagagagcttcatttcc

SEQ ID NO: 1247015 - DNA, 22 bp, Artificial Sequence
  chemically synthesized
tctttctgaagatgtggaaatg

SEQ ID NO: 1247016 - DNA, 22 bp, Artificial Sequence
  chemically synthesized
tgagagagcttcatttccacat

SEQ ID NO: 1247017 - DNA, 22 bp, Artificial Sequence
  chemically synthesized
tgtctttctgaagatgtggaaa

SEQ ID NO: 1247018 - DNA, 22 bp, Artificial Sequence
  chemically synthesized
agagagcttcatttccacatct

SEQ ID NO: 1247019 - DNA, 22 bp, Artificial Sequence
  chemically synthesized
ttctgtctttctgaagatgtgg

SEQ ID NO: 1247020 - DNA, 22 bp, Artificial Sequence
  chemically synthesized
gcattgttctgtctttctgaag

SEQ ID NO: 1247021 - DNA, 22 bp, Artificial Sequence
  chemically synthesized
catttccacatcttcagaaaga

SEQ ID NO: 1247022 - DNA, 22 bp, Artificial Sequence
  chemically synthesized
atttccacatcttcagaaagac

SEQ ID NO: 1247023 - DNA, 22 bp, Artificial Sequence
  chemically synthesized
ccacatcttcagaaagacagaa

SEQ ID NO: 1247024 - DNA, 22 bp, Artificial Sequence
  chemically synthesized
cacatcttcagaaagacagaac

SEQ ID NO: 1247025 - DNA, 22 bp, Artificial Sequence
  chemically synthesized
cagaaagacagaacaatgctag

SEQ ID NO: 1247026 - DNA, 22 bp, Artificial Sequence
  chemically synthesized
agaaagacagaacaatgctaga

SEQ ID NO: 1247027 - DNA, 22 bp, Artificial Sequence
  chemically synthesized
gaatacatgcaagtacatctag

SEQ ID NO: 1247028 - DNA, 22 bp, Artificial Sequence
  chemically synthesized
ttggaatacatgcaagtacatc

SEQ ID NO: 1247029 - DNA, 22 bp, Artificial Sequence
  chemically synthesized
gatgtacttgcatgtattccaa

SEQ ID NO: 1247030 - DNA, 22 bp, Artificial Sequence
  chemically synthesized
aaaggcaatcactattggaata

SEQ ID NO: 1247031 - DNA, 22 bp, Artificial Sequence
  chemically synthesized
gcatgtattccaatagtgattg

SEQ ID NO: 1247032 - DNA, 22 bp, Artificial Sequence
  chemically synthesized
catgtattccaatagtgattgc

SEQ ID NO: 1247033 - DNA, 22 bp, Artificial Sequence
  chemically synthesized
caatagtgattgcctttcagac

SEQ ID NO: 1247034 - DNA, 22 bp, Artificial Sequence
  chemically synthesized
aaatgggagaagaggaaggtct

SEQ ID NO: 1247035 - DNA, 22 bp, Artificial Sequence
  chemically synthesized
ttcaaatgggagaagaggaagg

SEQ ID NO: 1247036 - DNA, 22 bp, Artificial Sequence
  chemically synthesized
cctttcagaccttcctcttctc

SEQ ID NO: 1247037 - DNA, 22 bp, Artificial Sequence
  chemically synthesized
tcagaccttcctcttctcccat

SEQ ID NO: 1247038 - DNA, 22 bp, Artificial Sequence
  chemically synthesized
atgtctattcaaatgggagaag

SEQ ID NO: 1247039 - DNA, 22 bp, Artificial Sequence
  chemically synthesized
cagaccttcctcttctcccatt

SEQ ID NO: 1247040 - DNA, 22 bp, Artificial Sequence
  chemically synthesized
agaccttcctcttctcccattt

SEQ ID NO: 1247041 - DNA, 22 bp, Artificial Sequence
  chemically synthesized
cctcttctcccatttgaataga

SEQ ID NO: 1247042 - DNA, 22 bp, Artificial Sequence
  chemically synthesized
atgaggctaatgtctattcaaa

SEQ ID NO: 1247043 - DNA, 22 bp, Artificial Sequence
  chemically synthesized
ctcttctcccatttgaatagac

SEQ ID NO: 1247044 - DNA, 22 bp, Artificial Sequence
  chemically synthesized
ttctcccatttgaatagacatt

SEQ ID NO: 1247045 - DNA, 22 bp, Artificial Sequence
  chemically synthesized
ctcccatttgaatagacattag

SEQ ID NO: 1247046 - DNA, 22 bp, Artificial Sequence
  chemically synthesized
tcccatttgaatagacattagc

SEQ ID NO: 1247047 - DNA, 22 bp, Artificial Sequence
  chemically synthesized
ccatttgaatagacattagcct

SEQ ID NO: 1247048 - DNA, 22 bp, Artificial Sequence
  chemically synthesized
gaatagacattagcctcatgag

SEQ ID NO: 1247049 - DNA, 22 bp, Artificial Sequence
  chemically synthesized
aatagacattagcctcatgagt

SEQ ID NO: 1247050 - DNA, 22 bp, Artificial Sequence
  chemically synthesized
gcctcatgagtgacctccacac

SEQ ID NO: 1247051 - DNA, 22 bp, Artificial Sequence
  chemically synthesized
atgagtgacctccacacctgta

SEQ ID NO: 1247052 - DNA, 22 bp, Artificial Sequence
  chemically synthesized
cacacctgtactctccccatac

SEQ ID NO: 1247053 - DNA, 22 bp, Artificial Sequence
  chemically synthesized
tatgcagaatcgtgtatgggga

SEQ ID NO: 1247054 - DNA, 22 bp, Artificial Sequence
  chemically synthesized
tactctccccatacacgattct

SEQ ID NO: 1247055 - DNA, 22 bp, Artificial Sequence
  chemically synthesized
gtggctatatgcagaatcgtgt

SEQ ID NO: 1247056 - DNA, 22 bp, Artificial Sequence
  chemically synthesized
ggtggctatatgcagaatcgtg

SEQ ID NO: 1247057 - DNA, 22 bp, Artificial Sequence
  chemically synthesized
tccccatacacgattctgcata

SEQ ID NO: 1247058 - DNA, 22 bp, Artificial Sequence
  chemically synthesized
catttggtggctatatgcagaa

SEQ ID NO: 1247059 - DNA, 22 bp, Artificial Sequence
  chemically synthesized
cccatacacgattctgcatata

SEQ ID NO: 1247060 - DNA, 22 bp, Artificial Sequence
  chemically synthesized
gaaagttacatttggtggctat

SEQ ID NO: 1247061 - DNA, 22 bp, Artificial Sequence
  chemically synthesized
tgcatatagccaccaaatgtaa

SEQ ID NO: 1247062 - DNA, 22 bp, Artificial Sequence
  chemically synthesized
catattagaaagttacatttgg

SEQ ID NO: 1247063 - DNA, 22 bp, Artificial Sequence
  chemically synthesized
gcatattagaaagttacatttg

SEQ ID NO: 1247064 - DNA, 22 bp, Artificial Sequence
  chemically synthesized
catatagccaccaaatgtaact

SEQ ID NO: 1247065 - DNA, 22 bp, Artificial Sequence
  chemically synthesized
tgcatattagaaagttacattt

SEQ ID NO: 1247066 - DNA, 22 bp, Artificial Sequence
  chemically synthesized
tgttttgcatattagaaagtta

SEQ ID NO: 1247067 - DNA, 22 bp, Artificial Sequence
  chemically synthesized
atgttttgcatattagaaagtt

SEQ ID NO: 1247068 - DNA, 22 bp, Artificial Sequence
  chemically synthesized
tatgttttgcatattagaaagt

SEQ ID NO: 1247069 - DNA, 22 bp, Artificial Sequence
  chemically synthesized
ttatgttttgcatattagaaag

SEQ ID NO: 1247070 - DNA, 22 bp, Artificial Sequence
  chemically synthesized
tttatgttttgcatattagaaa

SEQ ID NO: 1247071 - DNA, 22 bp, Artificial Sequence
  chemically synthesized
ttttatgttttgcatattagaa

SEQ ID NO: 1247072 - DNA, 22 bp, Artificial Sequence
  chemically synthesized
tttttatgttttgcatattaga

SEQ ID NO: 1247073 - DNA, 22 bp, Artificial Sequence
  chemically synthesized
ttttttatgttttgcatattag

SEQ ID NO: 1247074 - DNA, 22 bp, Artificial Sequence
  chemically synthesized
tctaatatgcaaaacataaaaa

SEQ ID NO: 1247075 - DNA, 22 bp, Artificial Sequence
  chemically synthesized
ctaatatgcaaaacataaaaaa

SEQ ID NO: 1247076 - DNA, 22 bp, Artificial Sequence
  chemically synthesized
taatatgcaaaacataaaaaaa

SEQ ID NO: 1247077 - DNA, 22 bp, Artificial Sequence
  chemically synthesized
atatgcaaaacataaaaaaaaa

SEQ ID NO: 1247078 - DNA, 22 bp, Artificial Sequence
  chemically synthesized
aaaaaaaccaggaagttttttt

SEQ ID NO: 1247079 - DNA, 22 bp, Artificial Sequence
  chemically synthesized
agatgaatgtgttcaaaaaaac

SEQ ID NO: 1247080 - DNA, 22 bp, Artificial Sequence
  chemically synthesized
aattgagatgaatgtgttcaaa

SEQ ID NO: 1247081 - DNA, 22 bp, Artificial Sequence
  chemically synthesized
cctggtttttttgaacacattc

SEQ ID NO: 1247082 - DNA, 22 bp, Artificial Sequence
  chemically synthesized
ctcaattgagatgaatgtgttc

SEQ ID NO: 1247083 - DNA, 22 bp, Artificial Sequence
  chemically synthesized
ctggtttttttgaacacattca

SEQ ID NO: 1247084 - DNA, 22 bp, Artificial Sequence
  chemically synthesized
gctcaattgagatgaatgtgtt

SEQ ID NO: 1247085 - DNA, 22 bp, Artificial Sequence
  chemically synthesized
gtttttttgaacacattcatct

SEQ ID NO: 1247086 - DNA, 22 bp, Artificial Sequence
  chemically synthesized
cttgctcaattgagatgaatgt

SEQ ID NO: 1247087 - DNA, 22 bp, Artificial Sequence
  chemically synthesized
ttttgaacacattcatctcaat

SEQ ID NO: 1247088 - DNA, 22 bp, Artificial Sequence
  chemically synthesized
tttgaacacattcatctcaatt

SEQ ID NO: 1247089 - DNA, 22 bp, Artificial Sequence
  chemically synthesized
ttgaacacattcatctcaattg

SEQ ID NO: 1247090 - DNA, 22 bp, Artificial Sequence
  chemically synthesized
tgaacacattcatctcaattga

SEQ ID NO: 1247091 - DNA, 22 bp, Artificial Sequence
  chemically synthesized
gaacacattcatctcaattgag

SEQ ID NO: 1247092 - DNA, 22 bp, Artificial Sequence
  chemically synthesized
aacacattcatctcaattgagc

SEQ ID NO: 1247093 - DNA, 22 bp, Artificial Sequence
  chemically synthesized
atctcaattgagcaaggaatca

SEQ ID NO: 1247094 - DNA, 22 bp, Artificial Sequence
  chemically synthesized
aattgagcaaggaatcatccat

SEQ ID NO: 1247095 - DNA, 22 bp, Artificial Sequence
  chemically synthesized
gggatacaatgtggatggatga

SEQ ID NO: 1247096 - DNA, 22 bp, Artificial Sequence
  chemically synthesized
agcaaggaatcatccatccaca

SEQ ID NO: 1247097 - DNA, 22 bp, Artificial Sequence
  chemically synthesized
aaaaggatgcgggaaaggtgga

SEQ ID NO: 1247098 - DNA, 22 bp, Artificial Sequence
  chemically synthesized
tatccccagtccacctttcccg

SEQ ID NO: 1247099 - DNA, 22 bp, Artificial Sequence
  chemically synthesized
gcaaaaaattgaaaaggatgcg

SEQ ID NO: 1247100 - DNA, 22 bp, Artificial Sequence
  chemically synthesized
tcccgcatccttttcaattttt

SEQ ID NO: 1247101 - DNA, 22 bp, Artificial Sequence
  chemically synthesized
cccgcatccttttcaatttttt

SEQ ID NO: 1247102 - DNA, 22 bp, Artificial Sequence
  chemically synthesized
ccgcatccttttcaattttttg

SEQ ID NO: 1247103 - DNA, 22 bp, Artificial Sequence
  chemically synthesized
ggatatgggcaattggcaaaaa

SEQ ID NO: 1247104 - DNA, 22 bp, Artificial Sequence
  chemically synthesized
gggatatgggcaattggcaaaa

SEQ ID NO: 1247105 - DNA, 22 bp, Artificial Sequence
  chemically synthesized
tgggatatgggcaattggcaaa

SEQ ID NO: 1247106 - DNA, 22 bp, Artificial Sequence
  chemically synthesized
ttcaattttttgccaattgccc

SEQ ID NO: 1247107 - DNA, 22 bp, Artificial Sequence
  chemically synthesized
tcaattttttgccaattgccca

SEQ ID NO: 1247108 - DNA, 22 bp, Artificial Sequence
  chemically synthesized
caattttttgccaattgcccat

SEQ ID NO: 1247109 - DNA, 22 bp, Artificial Sequence
  chemically synthesized
aattttttgccaattgcccata

SEQ ID NO: 1247110 - DNA, 22 bp, Artificial Sequence
  chemically synthesized
tttgccaattgcccatatccca

SEQ ID NO: 1247111 - DNA, 22 bp, Artificial Sequence
  chemically synthesized
ttgccaattgcccatatcccaa

SEQ ID NO: 1247112 - DNA, 22 bp, Artificial Sequence
  chemically synthesized
tgccaattgcccatatcccaaa

SEQ ID NO: 1247113 - DNA, 22 bp, Artificial Sequence
  chemically synthesized
gccaattgcccatatcccaaaa

SEQ ID NO: 1247114 - DNA, 22 bp, Artificial Sequence
  chemically synthesized
ccaattgcccatatcccaaaac

SEQ ID NO: 1247115 - DNA, 22 bp, Artificial Sequence
  chemically synthesized
acatgaccgtaatggaggtttt

SEQ ID NO: 1247116 - DNA, 22 bp, Artificial Sequence
  chemically synthesized
gacatgaccgtaatggaggttt

SEQ ID NO: 1247117 - DNA, 22 bp, Artificial Sequence
  chemically synthesized
cccatatcccaaaacctccatt

SEQ ID NO: 1247118 - DNA, 22 bp, Artificial Sequence
  chemically synthesized
cattacggtcatgtcaaactac

SEQ ID NO: 1247119 - DNA, 22 bp, Artificial Sequence
  chemically synthesized
aggaaccagtaagtagtttgac

SEQ ID NO: 1247120 - DNA, 22 bp, Artificial Sequence
  chemically synthesized
cggtcatgtcaaactacttact

SEQ ID NO: 1247121 - DNA, 22 bp, Artificial Sequence
  chemically synthesized
agttcaggaaccagtaagtagt

SEQ ID NO: 1247122 - DNA, 22 bp, Artificial Sequence
  chemically synthesized
cttactggttcctgaactcaat

SEQ ID NO: 1247123 - DNA, 22 bp, Artificial Sequence
  chemically synthesized
actggttcctgaactcaattgg

SEQ ID NO: 1247124 - DNA, 22 bp, Artificial Sequence
  chemically synthesized
ctggttcctgaactcaattggt

SEQ ID NO: 1247125 - DNA, 22 bp, Artificial Sequence
  chemically synthesized
gttcctgaactcaattggtttg

SEQ ID NO: 1247126 - DNA, 22 bp, Artificial Sequence
  chemically synthesized
aggagtatgaagtcacaaacca

SEQ ID NO: 1247127 - DNA, 22 bp, Artificial Sequence
  chemically synthesized
ctgaactcaattggtttgtgac

SEQ ID NO: 1247128 - DNA, 22 bp, Artificial Sequence
  chemically synthesized
aactcaattggtttgtgacttc

SEQ ID NO: 1247129 - DNA, 22 bp, Artificial Sequence
  chemically synthesized
aattggtttgtgacttcatact

SEQ ID NO: 1247130 - DNA, 22 bp, Artificial Sequence
  chemically synthesized
gtttgtgacttcatactcctca

SEQ ID NO: 1247131 - DNA, 22 bp, Artificial Sequence
  chemically synthesized
gtgacttcatactcctcagcat

SEQ ID NO: 1247132 - DNA, 22 bp, Artificial Sequence
  chemically synthesized
tgacttcatactcctcagcatt

SEQ ID NO: 1247133 - DNA, 22 bp, Artificial Sequence
  chemically synthesized
aaaaaaaaaaaaaatgctgagg

SEQ ID NO: 1247134 - DNA, 22 bp, Artificial Sequence
  chemically synthesized
attaaaaaaaaaaaaaaatgct

SEQ ID NO: 1247135 - DNA, 22 bp, Artificial Sequence
  chemically synthesized
catactcctcagcatttttttt

SEQ ID NO: 1247136 - DNA, 22 bp, Artificial Sequence
  chemically synthesized
atactcctcagcattttttttt

SEQ ID NO: 1247137 - DNA, 22 bp, Artificial Sequence
  chemically synthesized
gctgattaaaaaaaaaaaaaaa

SEQ ID NO: 1247138 - DNA, 22 bp, Artificial Sequence
  chemically synthesized
ttggctgattaaaaaaaaaaaa

SEQ ID NO: 1247139 - DNA, 22 bp, Artificial Sequence
  chemically synthesized
ctcagcattttttttttttttt

SEQ ID NO: 1247140 - DNA, 22 bp, Artificial Sequence
  chemically synthesized
agcatttttttttttttttaat

SEQ ID NO: 1247141 - DNA, 22 bp, Artificial Sequence
  chemically synthesized
agcctattggctgattaaaaaa

SEQ ID NO: 1247142 - DNA, 22 bp, Artificial Sequence
  chemically synthesized
cagcctattggctgattaaaaa

SEQ ID NO: 1247143 - DNA, 22 bp, Artificial Sequence
  chemically synthesized
tcagcctattggctgattaaaa

SEQ ID NO: 1247144 - DNA, 22 bp, Artificial Sequence
  chemically synthesized
ttttttttttttaatcagccaa

SEQ ID NO: 1247145 - DNA, 22 bp, Artificial Sequence
  chemically synthesized
tttttttttttaatcagccaat

SEQ ID NO: 1247146 - DNA, 22 bp, Artificial Sequence
  chemically synthesized
ttttttttttaatcagccaata

SEQ ID NO: 1247147 - DNA, 22 bp, Artificial Sequence
  chemically synthesized
gagctttcagcctattggctga

SEQ ID NO: 1247148 - DNA, 22 bp, Artificial Sequence
  chemically synthesized
tttttttttaatcagccaatag

SEQ ID NO: 1247149 - DNA, 22 bp, Artificial Sequence
  chemically synthesized
ttttttttaatcagccaatagg

SEQ ID NO: 1247150 - DNA, 22 bp, Artificial Sequence
  chemically synthesized
tttttttaatcagccaataggc

SEQ ID NO: 1247151 - DNA, 22 bp, Artificial Sequence
  chemically synthesized
ttggagctttcagcctattggc

SEQ ID NO: 1247152 - DNA, 22 bp, Artificial Sequence
  chemically synthesized
ttttttaatcagccaataggct

SEQ ID NO: 1247153 - DNA, 22 bp, Artificial Sequence
  chemically synthesized
tttttaatcagccaataggctg

SEQ ID NO: 1247154 - DNA, 22 bp, Artificial Sequence
  chemically synthesized
ttttaatcagccaataggctga

SEQ ID NO: 1247155 - DNA, 22 bp, Artificial Sequence
  chemically synthesized
tttaatcagccaataggctgaa

SEQ ID NO: 1247156 - DNA, 22 bp, Artificial Sequence
  chemically synthesized
ttaatcagccaataggctgaaa

SEQ ID NO: 1247157 - DNA, 22 bp, Artificial Sequence
  chemically synthesized
taatcagccaataggctgaaag

SEQ ID NO: 1247158 - DNA, 22 bp, Artificial Sequence
  chemically synthesized
gccctgttggagctttcagcct

SEQ ID NO: 1247159 - DNA, 22 bp, Artificial Sequence
  chemically synthesized
aatcagccaataggctgaaagc

SEQ ID NO: 1247160 - DNA, 22 bp, Artificial Sequence
  chemically synthesized
ggccctgttggagctttcagcc

SEQ ID NO: 1247161 - DNA, 22 bp, Artificial Sequence
  chemically synthesized
atcagccaataggctgaaagct

SEQ ID NO: 1247162 - DNA, 22 bp, Artificial Sequence
  chemically synthesized
tggccctgttggagctttcagc

SEQ ID NO: 1247163 - DNA, 22 bp, Artificial Sequence
  chemically synthesized
ttggccctgttggagctttcag

SEQ ID NO: 1247164 - DNA, 22 bp, Artificial Sequence
  chemically synthesized
tttggccctgttggagctttca

SEQ ID NO: 1247165 - DNA, 22 bp, Artificial Sequence
  chemically synthesized
ttttggccctgttggagctttc

SEQ ID NO: 1247166 - DNA, 22 bp, Artificial Sequence
  chemically synthesized
tttttggccctgttggagcttt

SEQ ID NO: 1247167 - DNA, 22 bp, Artificial Sequence
  chemically synthesized
ttttttggccctgttggagctt

SEQ ID NO: 1247168 - DNA, 22 bp, Artificial Sequence
  chemically synthesized
tttttttggccctgttggagct

SEQ ID NO: 1247169 - DNA, 22 bp, Artificial Sequence
  chemically synthesized
ttttttttggccctgttggagc

SEQ ID NO: 1247170 - DNA, 22 bp, Artificial Sequence
  chemically synthesized
tttttttttggccctgttggag

SEQ ID NO: 1247171 - DNA, 22 bp, Artificial Sequence
  chemically synthesized
ttttttttttggccctgttgga

SEQ ID NO: 1247172 - DNA, 22 bp, Artificial Sequence
  chemically synthesized
aaagctccaacagggccaaaaa

SEQ ID NO: 1247173 - DNA, 22 bp, Artificial Sequence
  chemically synthesized
aaaaaggcttttttttttttgg

SEQ ID NO: 1247174 - DNA, 22 bp, Artificial Sequence
  chemically synthesized
caacagggccaaaaaaaaaaaa

SEQ ID NO: 1247175 - DNA, 22 bp, Artificial Sequence
  chemically synthesized
agctgaaaaaggcttttttttt

SEQ ID NO: 1247176 - DNA, 22 bp, Artificial Sequence
  chemically synthesized
agaagactaagctgaaaaaggc

SEQ ID NO: 1247177 - DNA, 22 bp, Artificial Sequence
  chemically synthesized
ctaagaagactaagctgaaaaa

SEQ ID NO: 1247178 - DNA, 22 bp, Artificial Sequence
  chemically synthesized
gttgctaagaagactaagctga

SEQ ID NO: 1247179 - DNA, 22 bp, Artificial Sequence
  chemically synthesized
tttcagcttagtcttcttagca

SEQ ID NO: 1247180 - DNA, 22 bp, Artificial Sequence
  chemically synthesized
ttcagcttagtcttcttagcaa

SEQ ID NO: 1247181 - DNA, 22 bp, Artificial Sequence
  chemically synthesized
tcagcttagtcttcttagcaac

SEQ ID NO: 1247182 - DNA, 22 bp, Artificial Sequence
  chemically synthesized
cagcttagtcttcttagcaact

SEQ ID NO: 1247183 - DNA, 22 bp, Artificial Sequence
  chemically synthesized
agcttagtcttcttagcaacta

SEQ ID NO: 1247184 - DNA, 22 bp, Artificial Sequence
  chemically synthesized
taggcagacaatcagttagttg

SEQ ID NO: 1247185 - DNA, 22 bp, Artificial Sequence
  chemically synthesized
agtcttcttagcaactaactga

SEQ ID NO: 1247186 - DNA, 22 bp, Artificial Sequence
  chemically synthesized
ataggcagacaatcagttagtt

SEQ ID NO: 1247187 - DNA, 22 bp, Artificial Sequence
  chemically synthesized
gtcttcttagcaactaactgat

SEQ ID NO: 1247188 - DNA, 22 bp, Artificial Sequence
  chemically synthesized
tataggcagacaatcagttagt

SEQ ID NO: 1247189 - DNA, 22 bp, Artificial Sequence
  chemically synthesized
ttataggcagacaatcagttag

SEQ ID NO: 1247190 - DNA, 22 bp, Artificial Sequence
  chemically synthesized
cttagcaactaactgattgtct

SEQ ID NO: 1247191 - DNA, 22 bp, Artificial Sequence
  chemically synthesized
ttagcaactaactgattgtctg

SEQ ID NO: 1247192 - DNA, 22 bp, Artificial Sequence
  chemically synthesized
agcaactaactgattgtctgcc

SEQ ID NO: 1247193 - DNA, 22 bp, Artificial Sequence
  chemically synthesized
gcaactaactgattgtctgcct

SEQ ID NO: 1247194 - DNA, 22 bp, Artificial Sequence
  chemically synthesized
aacatcttttataggcagacaa

SEQ ID NO: 1247195 - DNA, 22 bp, Artificial Sequence
  chemically synthesized
attaaacatcttttataggcag

SEQ ID NO: 1247196 - DNA, 22 bp, Artificial Sequence
  chemically synthesized
actgattgtctgcctataaaag

SEQ ID NO: 1247197 - DNA, 22 bp, Artificial Sequence
  chemically synthesized
attgtctgcctataaaagatgt

SEQ ID NO: 1247198 - DNA, 22 bp, Artificial Sequence
  chemically synthesized
caaacattgattaaacatcttt

SEQ ID NO: 1247199 - DNA, 22 bp, Artificial Sequence
  chemically synthesized
ccaaacattgattaaacatctt

SEQ ID NO: 1247200 - DNA, 22 bp, Artificial Sequence
  chemically synthesized
tctgcctataaaagatgtttaa

SEQ ID NO: 1247201 - DNA, 22 bp, Artificial Sequence
  chemically synthesized
ttccaaacattgattaaacatc

SEQ ID NO: 1247202 - DNA, 22 bp, Artificial Sequence
  chemically synthesized
cctataaaagatgtttaatcaa

SEQ ID NO: 1247203 - DNA, 22 bp, Artificial Sequence
  chemically synthesized
taaaagatgtttaatcaatgtt

SEQ ID NO: 1247204 - DNA, 22 bp, Artificial Sequence
  chemically synthesized
aagtccatctcttccaaacatt

SEQ ID NO: 1247205 - DNA, 22 bp, Artificial Sequence
  chemically synthesized
aatcaatgtttggaagagatgg

SEQ ID NO: 1247206 - DNA, 22 bp, Artificial Sequence
  chemically synthesized
atcaatgtttggaagagatgga

SEQ ID NO: 1247207 - DNA, 22 bp, Artificial Sequence
  chemically synthesized
ggaagagatggacttgaatggc

SEQ ID NO: 1247208 - DNA, 22 bp, Artificial Sequence
  chemically synthesized
gaagagatggacttgaatggcc

SEQ ID NO: 1247209 - DNA, 22 bp, Artificial Sequence
  chemically synthesized
atgccaacaagagtacaacagg

SEQ ID NO: 1247210 - DNA, 22 bp, Artificial Sequence
  chemically synthesized
catgccaacaagagtacaacag

SEQ ID NO: 1247211 - DNA, 22 bp, Artificial Sequence
  chemically synthesized
tcatgccaacaagagtacaaca

SEQ ID NO: 1247212 - DNA, 22 bp, Artificial Sequence
  chemically synthesized
gaatggcctgttgtactcttgt

SEQ ID NO: 1247213 - DNA, 22 bp, Artificial Sequence
  chemically synthesized
aatggcctgttgtactcttgtt

SEQ ID NO: 1247214 - DNA, 22 bp, Artificial Sequence
  chemically synthesized
aagggattttcatgccaacaag

SEQ ID NO: 1247215 - DNA, 22 bp, Artificial Sequence
  chemically synthesized
aaagggattttcatgccaacaa

SEQ ID NO: 1247216 - DNA, 22 bp, Artificial Sequence
  chemically synthesized
ttgtactcttgttggcatgaaa

SEQ ID NO: 1247217 - DNA, 22 bp, Artificial Sequence
  chemically synthesized
tactcttgttggcatgaaaatc

SEQ ID NO: 1247218 - DNA, 22 bp, Artificial Sequence
  chemically synthesized
gaaacttaaagggattttcatg

SEQ ID NO: 1247219 - DNA, 22 bp, Artificial Sequence
  chemically synthesized
ttgttggcatgaaaatcccttt

SEQ ID NO: 1247220 - DNA, 22 bp, Artificial Sequence
  chemically synthesized
gttggcatgaaaatccctttaa

SEQ ID NO: 1247221 - DNA, 22 bp, Artificial Sequence
  chemically synthesized
tagactagaaacttaaagggat

SEQ ID NO: 1247222 - DNA, 22 bp, Artificial Sequence
  chemically synthesized
ttggcatgaaaatccctttaag

SEQ ID NO: 1247223 - DNA, 22 bp, Artificial Sequence
  chemically synthesized
gcatgaaaatccctttaagttt

SEQ ID NO: 1247224 - DNA, 22 bp, Artificial Sequence
  chemically synthesized
atatcaactatagactagaaac

SEQ ID NO: 1247225 - DNA, 22 bp, Artificial Sequence
  chemically synthesized
aaattgatatcaactatagact

SEQ ID NO: 1247226 - DNA, 22 bp, Artificial Sequence
  chemically synthesized
taagtttctagtctatagttga

SEQ ID NO: 1247227 - DNA, 22 bp, Artificial Sequence
  chemically synthesized
aagtttctagtctatagttgat

SEQ ID NO: 1247228 - DNA, 22 bp, Artificial Sequence
  chemically synthesized
agtttctagtctatagttgata

SEQ ID NO: 1247229 - DNA, 22 bp, Artificial Sequence
  chemically synthesized
gggttgaaattgatatcaacta

SEQ ID NO: 1247230 - DNA, 22 bp, Artificial Sequence
  chemically synthesized
ctagtctatagttgatatcaat

SEQ ID NO: 1247231 - DNA, 22 bp, Artificial Sequence
  chemically synthesized
tagtctatagttgatatcaatt

SEQ ID NO: 1247232 - DNA, 22 bp, Artificial Sequence
  chemically synthesized
tattggggttgaaattgatatc

SEQ ID NO: 1247233 - DNA, 22 bp, Artificial Sequence
  chemically synthesized
gtctatagttgatatcaatttc

SEQ ID NO: 1247234 - DNA, 22 bp, Artificial Sequence
  chemically synthesized
gggttgtattggggttgaaatt

SEQ ID NO: 1247235 - DNA, 22 bp, Artificial Sequence
  chemically synthesized
tagttgatatcaatttcaaccc

SEQ ID NO: 1247236 - DNA, 22 bp, Artificial Sequence
  chemically synthesized
gctagggttgtattggggttga

SEQ ID NO: 1247237 - DNA, 22 bp, Artificial Sequence
  chemically synthesized
ggctagggttgtattggggttg

SEQ ID NO: 1247238 - DNA, 22 bp, Artificial Sequence
  chemically synthesized
atatcaatttcaaccccaatac

SEQ ID NO: 1247239 - DNA, 22 bp, Artificial Sequence
  chemically synthesized
cttggctagggttgtattgggg

SEQ ID NO: 1247240 - DNA, 22 bp, Artificial Sequence
  chemically synthesized
gcttggctagggttgtattggg

SEQ ID NO: 1247241 - DNA, 22 bp, Artificial Sequence
  chemically synthesized
tgcttggctagggttgtattgg

SEQ ID NO: 1247242 - DNA, 22 bp, Artificial Sequence
  chemically synthesized
caaccccaatacaaccctagcc

SEQ ID NO: 1247243 - DNA, 22 bp, Artificial Sequence
  chemically synthesized
aaccccaatacaaccctagcca

SEQ ID NO: 1247244 - DNA, 22 bp, Artificial Sequence
  chemically synthesized
gccaagcaaaattcgtctcttc

SEQ ID NO: 1247245 - DNA, 22 bp, Artificial Sequence
  chemically synthesized
gtctcttcttccttctgctccc

SEQ ID NO: 1247246 - DNA, 22 bp, Artificial Sequence
  chemically synthesized
ccacgggggtatgcatgggagc

SEQ ID NO: 1247247 - DNA, 22 bp, Artificial Sequence
  chemically synthesized
ttcttccttctgctcccatgca

SEQ ID NO: 1247248 - DNA, 22 bp, Artificial Sequence
  chemically synthesized
cttccttctgctcccatgcata

SEQ ID NO: 1247249 - DNA, 22 bp, Artificial Sequence
  chemically synthesized
ttccttctgctcccatgcatac

SEQ ID NO: 1247250 - DNA, 22 bp, Artificial Sequence
  chemically synthesized
ccttctgctcccatgcataccc

SEQ ID NO: 1247251 - DNA, 22 bp, Artificial Sequence
  chemically synthesized
cttctgctcccatgcatacccc

SEQ ID NO: 1247252 - DNA, 22 bp, Artificial Sequence
  chemically synthesized
ctgctcccatgcatacccccgt

SEQ ID NO: 1247253 - DNA, 22 bp, Artificial Sequence
  chemically synthesized
tgctcccatgcatacccccgtg

SEQ ID NO: 1247254 - DNA, 22 bp, Artificial Sequence
  chemically synthesized
ctcccatgcatacccccgtggt

SEQ ID NO: 1247255 - DNA, 22 bp, Artificial Sequence
  chemically synthesized
tatagtatgtcctaccacgggg

SEQ ID NO: 1247256 - DNA, 22 bp, Artificial Sequence
  chemically synthesized
ccatgcatacccccgtggtagg

SEQ ID NO: 1247257 - DNA, 22 bp, Artificial Sequence
  chemically synthesized
caagactatatagtatgtccta

SEQ ID NO: 1247258 - DNA, 22 bp, Artificial Sequence
  chemically synthesized
aaaagcaatcaaaagcaattac

SEQ ID NO: 1247259 - DNA, 22 bp, Artificial Sequence
  chemically synthesized
caaaagcaatcaaaagcaatta

SEQ ID NO: 1247260 - DNA, 22 bp, Artificial Sequence
  chemically synthesized
tatagtcttgtaattgcttttg

SEQ ID NO: 1247261 - DNA, 22 bp, Artificial Sequence
  chemically synthesized
gtaattgcttttgattgctttt

SEQ ID NO: 1247262 - DNA, 22 bp, Artificial Sequence
  chemically synthesized
taattgcttttgattgcttttg

SEQ ID NO: 1247263 - DNA, 22 bp, Artificial Sequence
  chemically synthesized
cttttgattgcttttgaaatac

SEQ ID NO: 1247264 - DNA, 22 bp, Artificial Sequence
  chemically synthesized
ttgattgcttttgaaataccta

SEQ ID NO: 1247265 - DNA, 22 bp, Artificial Sequence
  chemically synthesized
tgattgcttttgaaatacctat

SEQ ID NO: 1247266 - DNA, 22 bp, Artificial Sequence
  chemically synthesized
gattgcttttgaaatacctatt

SEQ ID NO: 1247267 - DNA, 22 bp, Artificial Sequence
  chemically synthesized
attgcttttgaaatacctattt

SEQ ID NO: 1247268 - DNA, 22 bp, Artificial Sequence
  chemically synthesized
cttttgaaatacctatttttcc

SEQ ID NO: 1247269 - DNA, 22 bp, Artificial Sequence
  chemically synthesized
ttgaaatacctatttttcccat

SEQ ID NO: 1247270 - DNA, 22 bp, Artificial Sequence
  chemically synthesized
tgaaatacctatttttcccatt

SEQ ID NO: 1247271 - DNA, 22 bp, Artificial Sequence
  chemically synthesized
gaaatacctatttttcccattt

SEQ ID NO: 1247272 - DNA, 22 bp, Artificial Sequence
  chemically synthesized
aaatacctatttttcccattta

SEQ ID NO: 1247273 - DNA, 22 bp, Artificial Sequence
  chemically synthesized
agagatggcatataaatgggaa

SEQ ID NO: 1247274 - DNA, 22 bp, Artificial Sequence
  chemically synthesized
tagttaagagatggcatataaa

SEQ ID NO: 1247275 - DNA, 22 bp, Artificial Sequence
  chemically synthesized
tttttcccatttatatgccatc

SEQ ID NO: 1247276 - DNA, 22 bp, Artificial Sequence
  chemically synthesized
ttcccatttatatgccatctct

SEQ ID NO: 1247277 - DNA, 22 bp, Artificial Sequence
  chemically synthesized
gcactgtagttaagagatggca

SEQ ID NO: 1247278 - DNA, 22 bp, Artificial Sequence
  chemically synthesized
tcccatttatatgccatctctt

SEQ ID NO: 1247279 - DNA, 22 bp, Artificial Sequence
  chemically synthesized
cccatttatatgccatctctta

SEQ ID NO: 1247280 - DNA, 22 bp, Artificial Sequence
  chemically synthesized
ccatttatatgccatctcttaa

SEQ ID NO: 1247281 - DNA, 22 bp, Artificial Sequence
  chemically synthesized
atatgccatctcttaactacag

SEQ ID NO: 1247282 - DNA, 22 bp, Artificial Sequence
  chemically synthesized
tatgccatctcttaactacagt

SEQ ID NO: 1247283 - DNA, 22 bp, Artificial Sequence
  chemically synthesized
ccatatacctggcactgtagtt

SEQ ID NO: 1247284 - DNA, 22 bp, Artificial Sequence
  chemically synthesized
tgccatatacctggcactgtag

SEQ ID NO: 1247285 - DNA, 22 bp, Artificial Sequence
  chemically synthesized
agattctgccatatacctggca

SEQ ID NO: 1247286 - DNA, 22 bp, Artificial Sequence
  chemically synthesized
gagattctgccatatacctggc

SEQ ID NO: 1247287 - DNA, 22 bp, Artificial Sequence
  chemically synthesized
ttaactacagtgccaggtatat

SEQ ID NO: 1247288 - DNA, 22 bp, Artificial Sequence
  chemically synthesized
tgagattctgccatatacctgg

SEQ ID NO: 1247289 - DNA, 22 bp, Artificial Sequence
  chemically synthesized
aactacagtgccaggtatatgg

SEQ ID NO: 1247290 - DNA, 22 bp, Artificial Sequence
  chemically synthesized
actacagtgccaggtatatggc

SEQ ID NO: 1247291 - DNA, 22 bp, Artificial Sequence
  chemically synthesized
agttttgagattctgccatata

SEQ ID NO: 1247292 - DNA, 22 bp, Artificial Sequence
  chemically synthesized
cagtgccaggtatatggcagaa

SEQ ID NO: 1247293 - DNA, 22 bp, Artificial Sequence
  chemically synthesized
actcagttttgagattctgcca

SEQ ID NO: 1247294 - DNA, 22 bp, Artificial Sequence
  chemically synthesized
aactcagttttgagattctgcc

SEQ ID NO: 1247295 - DNA, 22 bp, Artificial Sequence
  chemically synthesized
taactcagttttgagattctgc

SEQ ID NO: 1247296 - DNA, 22 bp, Artificial Sequence
  chemically synthesized
ttaactcagttttgagattctg

SEQ ID NO: 1247297 - DNA, 22 bp, Artificial Sequence
  chemically synthesized
tttaactcagttttgagattct

SEQ ID NO: 1247298 - DNA, 22 bp, Artificial Sequence
  chemically synthesized
gtctttttaactcagttttgag

SEQ ID NO: 1247299 - DNA, 22 bp, Artificial Sequence
  chemically synthesized
agtctttttaactcagttttga

SEQ ID NO: 1247300 - DNA, 22 bp, Artificial Sequence
  chemically synthesized
gcccagaaatcttagtcttttt

SEQ ID NO: 1247301 - DNA, 22 bp, Artificial Sequence
  chemically synthesized
aaaactgagttaaaaagactaa

SEQ ID NO: 1247302 - DNA, 22 bp, Artificial Sequence
  chemically synthesized
cgcctagcccagaaatcttagt

SEQ ID NO: 1247303 - DNA, 22 bp, Artificial Sequence
  chemically synthesized
agttaaaaagactaagatttct

SEQ ID NO: 1247304 - DNA, 22 bp, Artificial Sequence
  chemically synthesized
aaaagactaagatttctgggct

SEQ ID NO: 1247305 - DNA, 22 bp, Artificial Sequence
  chemically synthesized
agatttctgggctaggcgcagt

SEQ ID NO: 1247306 - DNA, 22 bp, Artificial Sequence
  chemically synthesized
caggcgtgagccactgcgccta

SEQ ID NO: 1247307 - DNA, 22 bp, Artificial Sequence
  chemically synthesized
ctgggctaggcgcagtggctca

SEQ ID NO: 1247308 - DNA, 22 bp, Artificial Sequence
  chemically synthesized
ggattacaggcgtgagccactg

SEQ ID NO: 1247309 - DNA, 22 bp, Artificial Sequence
  chemically synthesized
tgggctaggcgcagtggctcac

SEQ ID NO: 1247310 - DNA, 22 bp, Artificial Sequence
  chemically synthesized
ggctaggcgcagtggctcacgc

SEQ ID NO: 1247311 - DNA, 22 bp, Artificial Sequence
  chemically synthesized
ggcgcagtggctcacgcctgta

SEQ ID NO: 1247312 - DNA, 22 bp, Artificial Sequence
  chemically synthesized
aagtgctgggattacaggcgtg

SEQ ID NO: 1247313 - DNA, 22 bp, Artificial Sequence
  chemically synthesized
ggccgtctaaagtgctgggatt

SEQ ID NO: 1247314 - DNA, 22 bp, Artificial Sequence
  chemically synthesized
acgcctgtaatcccagcacttt

SEQ ID NO: 1247315 - DNA, 22 bp, Artificial Sequence
  chemically synthesized
ccacctcggccgtctaaagtgc

SEQ ID NO: 1247316 - DNA, 22 bp, Artificial Sequence
  chemically synthesized
cccacctcggccgtctaaagtg

SEQ ID NO: 1247317 - DNA, 22 bp, Artificial Sequence
  chemically synthesized
taatcccagcactttagacggc

SEQ ID NO: 1247318 - DNA, 22 bp, Artificial Sequence
  chemically synthesized
aggtggtcttcccacctcggcc

SEQ ID NO: 1247319 - DNA, 22 bp, Artificial Sequence
  chemically synthesized
tagacggccgaggtgggaagac

SEQ ID NO: 1247320 - DNA, 22 bp, Artificial Sequence
  chemically synthesized
agacggccgaggtgggaagacc

SEQ ID NO: 1247321 - DNA, 22 bp, Artificial Sequence
  chemically synthesized
ccgacctcaggtggtcttccca

SEQ ID NO: 1247322 - DNA, 22 bp, Artificial Sequence
  chemically synthesized
gacggccgaggtgggaagacca

SEQ ID NO: 1247323 - DNA, 22 bp, Artificial Sequence
  chemically synthesized
gaactcccgacctcaggtggtc

SEQ ID NO: 1247324 - DNA, 22 bp, Artificial Sequence
  chemically synthesized
gtctcgaactcccgacctcagg

SEQ ID NO: 1247325 - DNA, 22 bp, Artificial Sequence
  chemically synthesized
gtcaggctggtctcgaactccc

SEQ ID NO: 1247326 - DNA, 22 bp, Artificial Sequence
  chemically synthesized
aggtcgggagttcgagaccagc

SEQ ID NO: 1247327 - DNA, 22 bp, Artificial Sequence
  chemically synthesized
catgttggtcaggctggtctcg

SEQ ID NO: 1247328 - DNA, 22 bp, Artificial Sequence
  chemically synthesized
tccatgttggtcaggctggtct

SEQ ID NO: 1247329 - DNA, 22 bp, Artificial Sequence
  chemically synthesized
ctccatgttggtcaggctggtc

SEQ ID NO: 1247330 - DNA, 22 bp, Artificial Sequence
  chemically synthesized
gagaccagcctgaccaacatgg

SEQ ID NO: 1247331 - DNA, 22 bp, Artificial Sequence
  chemically synthesized
tagtagagatgaggtttctcca

SEQ ID NO: 1247332 - DNA, 22 bp, Artificial Sequence
  chemically synthesized
gtagtagagatgaggtttctcc

SEQ ID NO: 1247333 - DNA, 22 bp, Artificial Sequence
  chemically synthesized
accaacatggagaaacctcatc

SEQ ID NO: 1247334 - DNA, 22 bp, Artificial Sequence
  chemically synthesized
tatttgtagtagagatgaggtt

SEQ ID NO: 1247335 - DNA, 22 bp, Artificial Sequence
  chemically synthesized
gtatttgtagtagagatgaggt

SEQ ID NO: 1247336 - DNA, 22 bp, Artificial Sequence
  chemically synthesized
tgtatttgtagtagagatgagg

SEQ ID NO: 1247337 - DNA, 22 bp, Artificial Sequence
  chemically synthesized
attttgtatttgtagtagagat

SEQ ID NO: 1247338 - DNA, 22 bp, Artificial Sequence
  chemically synthesized
gctaattttgtatttgtagtag

SEQ ID NO: 1247339 - DNA, 22 bp, Artificial Sequence
  chemically synthesized
atctctactacaaatacaaaat

SEQ ID NO: 1247340 - DNA, 22 bp, Artificial Sequence
  chemically synthesized
tactacaaatacaaaattagcc

SEQ ID NO: 1247341 - DNA, 22 bp, Artificial Sequence
  chemically synthesized
ctacaaatacaaaattagccag

SEQ ID NO: 1247342 - DNA, 22 bp, Artificial Sequence
  chemically synthesized
caaatacaaaattagccaggtg

SEQ ID NO: 1247343 - DNA, 22 bp, Artificial Sequence
  chemically synthesized
caggcatgcgtcaccacacctg

SEQ ID NO: 1247344 - DNA, 22 bp, Artificial Sequence
  chemically synthesized
ggattacaggcatgcgtcacca

SEQ ID NO: 1247345 - DNA, 22 bp, Artificial Sequence
  chemically synthesized
gccaggtgtggtgacgcatgcc

SEQ ID NO: 1247346 - DNA, 22 bp, Artificial Sequence
  chemically synthesized
agtagctgggattacaggcatg

SEQ ID NO: 1247347 - DNA, 22 bp, Artificial Sequence
  chemically synthesized
ctgagtagctgggattacaggc

SEQ ID NO: 1247348 - DNA, 22 bp, Artificial Sequence
  chemically synthesized
agcctcctgagtagctgggatt

SEQ ID NO: 1247349 - DNA, 22 bp, Artificial Sequence
  chemically synthesized
cctcagcctcctgagtagctgg

SEQ ID NO: 1247350 - DNA, 22 bp, Artificial Sequence
  chemically synthesized
ctgcctcagcctcctgagtagc

SEQ ID NO: 1247351 - DNA, 22 bp, Artificial Sequence
  chemically synthesized
tcctgcctcagcctcctgagta

SEQ ID NO: 1247352 - DNA, 22 bp, Artificial Sequence
  chemically synthesized
taatcccagctactcaggaggc

SEQ ID NO: 1247353 - DNA, 22 bp, Artificial Sequence
  chemically synthesized
aagcgattctcctgcctcagcc

SEQ ID NO: 1247354 - DNA, 22 bp, Artificial Sequence
  chemically synthesized
ctcaggaggctgaggcaggaga

SEQ ID NO: 1247355 - DNA, 22 bp, Artificial Sequence
  chemically synthesized
ggttcaagcgattctcctgcct

SEQ ID NO: 1247356 - DNA, 22 bp, Artificial Sequence
  chemically synthesized
tgggttcaagcgattctcctgc

SEQ ID NO: 1247357 - DNA, 22 bp, Artificial Sequence
  chemically synthesized
aggaggctgaggcaggagaatc

SEQ ID NO: 1247358 - DNA, 22 bp, Artificial Sequence
  chemically synthesized
ctgggttcaagcgattctcctg

SEQ ID NO: 1247359 - DNA, 22 bp, Artificial Sequence
  chemically synthesized
cgccttctgggttcaagcgatt

SEQ ID NO: 1247360 - DNA, 22 bp, Artificial Sequence
  chemically synthesized
aggcaggagaatcgcttgaacc

SEQ ID NO: 1247361 - DNA, 22 bp, Artificial Sequence
  chemically synthesized
accgcaacctccgccttctggg

SEQ ID NO: 1247362 - DNA, 22 bp, Artificial Sequence
  chemically synthesized
gaacccagaaggcggaggttgc

SEQ ID NO: 1247363 - DNA, 22 bp, Artificial Sequence
  chemically synthesized
aacccagaaggcggaggttgcg

SEQ ID NO: 1247364 - DNA, 22 bp, Artificial Sequence
  chemically synthesized
gagtgcgatggcgcaatatcgg

SEQ ID NO: 1247365 - DNA, 22 bp, Artificial Sequence
  chemically synthesized
cggtgagccgatattgcgccat

SEQ ID NO: 1247366 - DNA, 22 bp, Artificial Sequence
  chemically synthesized
cccaggctggagtgcgatggcg

SEQ ID NO: 1247367 - DNA, 22 bp, Artificial Sequence
  chemically synthesized
tcgttgcccaggctggagtgcg

SEQ ID NO: 1247368 - DNA, 22 bp, Artificial Sequence
  chemically synthesized
ctgtcgttgcccaggctggagt

SEQ ID NO: 1247369 - DNA, 22 bp, Artificial Sequence
  chemically synthesized
gctgtcgttgcccaggctggag

SEQ ID NO: 1247370 - DNA, 22 bp, Artificial Sequence
  chemically synthesized
tgctgtcgttgcccaggctgga

SEQ ID NO: 1247371 - DNA, 22 bp, Artificial Sequence
  chemically synthesized
cgccatcgcactccagcctggg

SEQ ID NO: 1247372 - DNA, 22 bp, Artificial Sequence
  chemically synthesized
agatggagttttgctgtcgttg

SEQ ID NO: 1247373 - DNA, 22 bp, Artificial Sequence
  chemically synthesized
gagatggagttttgctgtcgtt

SEQ ID NO: 1247374 - DNA, 22 bp, Artificial Sequence
  chemically synthesized
tgagatggagttttgctgtcgt

SEQ ID NO: 1247375 - DNA, 22 bp, Artificial Sequence
  chemically synthesized
cagcctgggcaacgacagcaaa

SEQ ID NO: 1247376 - DNA, 22 bp, Artificial Sequence
  chemically synthesized
ttgagatggagttttgctgtcg

SEQ ID NO: 1247377 - DNA, 22 bp, Artificial Sequence
  chemically synthesized
tttgagatggagttttgctgtc

SEQ ID NO: 1247378 - DNA, 22 bp, Artificial Sequence
  chemically synthesized
ttttgagatggagttttgctgt

SEQ ID NO: 1247379 - DNA, 22 bp, Artificial Sequence
  chemically synthesized
tttttgagatggagttttgctg

SEQ ID NO: 1247380 - DNA, 22 bp, Artificial Sequence
  chemically synthesized
ttttttgagatggagttttgct

SEQ ID NO: 1247381 - DNA, 22 bp, Artificial Sequence
  chemically synthesized
ttttttttgagatggagttttg

SEQ ID NO: 1247382 - DNA, 22 bp, Artificial Sequence
  chemically synthesized
ggcaacgacagcaaaactccat

SEQ ID NO: 1247383 - DNA, 22 bp, Artificial Sequence
  chemically synthesized
cttttttttgagatggagtttt

SEQ ID NO: 1247384 - DNA, 22 bp, Artificial Sequence
  chemically synthesized
tcttttttttgagatggagttt

SEQ ID NO: 1247385 - DNA, 22 bp, Artificial Sequence
  chemically synthesized
ttcttttttttgagatggagtt

SEQ ID NO: 1247386 - DNA, 22 bp, Artificial Sequence
  chemically synthesized
tttcttttttttgagatggagt

SEQ ID NO: 1247387 - DNA, 22 bp, Artificial Sequence
  chemically synthesized
tttttcttttttttgagatgga

SEQ ID NO: 1247388 - DNA, 22 bp, Artificial Sequence
  chemically synthesized
ctttttcttttttttgagatgg

SEQ ID NO: 1247389 - DNA, 22 bp, Artificial Sequence
  chemically synthesized
tctttttcttttttttgagatg

SEQ ID NO: 1247390 - DNA, 22 bp, Artificial Sequence
  chemically synthesized
ttctttttcttttttttgagat

SEQ ID NO: 1247391 - DNA, 22 bp, Artificial Sequence
  chemically synthesized
tttctttttcttttttttgaga

SEQ ID NO: 1247392 - DNA, 22 bp, Artificial Sequence
  chemically synthesized
ttttctttttcttttttttgag

SEQ ID NO: 1247393 - DNA, 22 bp, Artificial Sequence
  chemically synthesized
gtttttttctttttcttttttt

SEQ ID NO: 1247394 - DNA, 22 bp, Artificial Sequence
  chemically synthesized
agtttttttctttttctttttt

SEQ ID NO: 1247395 - DNA, 22 bp, Artificial Sequence
  chemically synthesized
catctcaaaaaaaagaaaaaga

SEQ ID NO: 1247396 - DNA, 22 bp, Artificial Sequence
  chemically synthesized
aaaaaaaagaaaaagaaaaaaa

SEQ ID NO: 1247397 - DNA, 22 bp, Artificial Sequence
  chemically synthesized
aaagaaatcttagtttttttct

SEQ ID NO: 1247398 - DNA, 22 bp, Artificial Sequence
  chemically synthesized
gaaagaaatcttagtttttttc

SEQ ID NO: 1247399 - DNA, 22 bp, Artificial Sequence
  chemically synthesized
caggtttgaaagaaatcttagt

SEQ ID NO: 1247400 - DNA, 22 bp, Artificial Sequence
  chemically synthesized
agatttctttcaaacctgtaat

SEQ ID NO: 1247401 - DNA, 22 bp, Artificial Sequence
  chemically synthesized
catacaatcatcatcagattac

SEQ ID NO: 1247402 - DNA, 22 bp, Artificial Sequence
  chemically synthesized
ctttcaaacctgtaatctgatg

SEQ ID NO: 1247403 - DNA, 22 bp, Artificial Sequence
  chemically synthesized
tttcaaacctgtaatctgatga

SEQ ID NO: 1247404 - DNA, 22 bp, Artificial Sequence
  chemically synthesized
tcaaacctgtaatctgatgatg

SEQ ID NO: 1247405 - DNA, 22 bp, Artificial Sequence
  chemically synthesized
caaacctgtaatctgatgatga

SEQ ID NO: 1247406 - DNA, 22 bp, Artificial Sequence
  chemically synthesized
aaacctgtaatctgatgatgat

SEQ ID NO: 1247407 - DNA, 22 bp, Artificial Sequence
  chemically synthesized
aaaagaattgcatacaatcatc

SEQ ID NO: 1247408 - DNA, 22 bp, Artificial Sequence
  chemically synthesized
aaaaagaattgcatacaatcat

SEQ ID NO: 1247409 - DNA, 22 bp, Artificial Sequence
  chemically synthesized
taaaaagaattgcatacaatca

SEQ ID NO: 1247410 - DNA, 22 bp, Artificial Sequence
  chemically synthesized
taatctgatgatgattgtatgc

SEQ ID NO: 1247411 - DNA, 22 bp, Artificial Sequence
  chemically synthesized
ttaaaaagaattgcatacaatc

SEQ ID NO: 1247412 - DNA, 22 bp, Artificial Sequence
  chemically synthesized
tttaaaaagaattgcatacaat

SEQ ID NO: 1247413 - DNA, 22 bp, Artificial Sequence
  chemically synthesized
gctttttaaaaagaattgcata

SEQ ID NO: 1247414 - DNA, 22 bp, Artificial Sequence
  chemically synthesized
agctttttaaaaagaattgcat

SEQ ID NO: 1247415 - DNA, 22 bp, Artificial Sequence
  chemically synthesized
atgatgattgtatgcaattctt

SEQ ID NO: 1247416 - DNA, 22 bp, Artificial Sequence
  chemically synthesized
tagctttttaaaaagaattgca

SEQ ID NO: 1247417 - DNA, 22 bp, Artificial Sequence
  chemically synthesized
ttagctttttaaaaagaattgc

SEQ ID NO: 1247418 - DNA, 22 bp, Artificial Sequence
  chemically synthesized
agatttttagctttttaaaaag

SEQ ID NO: 1247419 - DNA, 22 bp, Artificial Sequence
  chemically synthesized
tatgcaattctttttaaaaagc

SEQ ID NO: 1247420 - DNA, 22 bp, Artificial Sequence
  chemically synthesized
aatctaagatttttagcttttt

SEQ ID NO: 1247421 - DNA, 22 bp, Artificial Sequence
  chemically synthesized
tttttaaaaagctaaaaatctt

SEQ ID NO: 1247422 - DNA, 22 bp, Artificial Sequence
  chemically synthesized
tttaaaaagctaaaaatcttag

SEQ ID NO: 1247423 - DNA, 22 bp, Artificial Sequence
  chemically synthesized
ttaaaaagctaaaaatcttaga

SEQ ID NO: 1247424 - DNA, 22 bp, Artificial Sequence
  chemically synthesized
taaaaagctaaaaatcttagat

SEQ ID NO: 1247425 - DNA, 22 bp, Artificial Sequence
  chemically synthesized
ataaataactcaatctaagatt

SEQ ID NO: 1247426 - DNA, 22 bp, Artificial Sequence
  chemically synthesized
aaaaagctaaaaatcttagatt

SEQ ID NO: 1247427 - DNA, 22 bp, Artificial Sequence
  chemically synthesized
aaaagctaaaaatcttagattg

SEQ ID NO: 1247428 - DNA, 22 bp, Artificial Sequence
  chemically synthesized
tattcataaataactcaatcta

SEQ ID NO: 1247429 - DNA, 22 bp, Artificial Sequence
  chemically synthesized
gtattcataaataactcaatct

SEQ ID NO: 1247430 - DNA, 22 bp, Artificial Sequence
  chemically synthesized
tttgtattcataaataactcaa

SEQ ID NO: 1247431 - DNA, 22 bp, Artificial Sequence
  chemically synthesized
aaaatcttagattgagttattt

SEQ ID NO: 1247432 - DNA, 22 bp, Artificial Sequence
  chemically synthesized
atacctgtttgtattcataaat

SEQ ID NO: 1247433 - DNA, 22 bp, Artificial Sequence
  chemically synthesized
catacctgtttgtattcataaa

SEQ ID NO: 1247434 - DNA, 22 bp, Artificial Sequence
  chemically synthesized
agattgagttatttatgaatac

SEQ ID NO: 1247435 - DNA, 22 bp, Artificial Sequence
  chemically synthesized
gattgagttatttatgaataca

SEQ ID NO: 1247436 - DNA, 22 bp, Artificial Sequence
  chemically synthesized
cttcatacctgtttgtattcat

SEQ ID NO: 1247437 - DNA, 22 bp, Artificial Sequence
  chemically synthesized
tgcttcatacctgtttgtattc

SEQ ID NO: 1247438 - DNA, 22 bp, Artificial Sequence
  chemically synthesized
ctgcttcatacctgtttgtatt

SEQ ID NO: 1247439 - DNA, 22 bp, Artificial Sequence
  chemically synthesized
agttatttatgaatacaaacag

SEQ ID NO: 1247440 - DNA, 22 bp, Artificial Sequence
  chemically synthesized
tttatgaatacaaacaggtatg

SEQ ID NO: 1247441 - DNA, 22 bp, Artificial Sequence
  chemically synthesized
gtggtttctgcttcatacctgt

SEQ ID NO: 1247442 - DNA, 22 bp, Artificial Sequence
  chemically synthesized
cgtggtttctgcttcatacctg

SEQ ID NO: 1247443 - DNA, 22 bp, Artificial Sequence
  chemically synthesized
atgaatacaaacaggtatgaag

SEQ ID NO: 1247444 - DNA, 22 bp, Artificial Sequence
  chemically synthesized
tgaatacaaacaggtatgaagc

SEQ ID NO: 1247445 - DNA, 22 bp, Artificial Sequence
  chemically synthesized
ccttcgtggtttctgcttcata

SEQ ID NO: 1247446 - DNA, 22 bp, Artificial Sequence
  chemically synthesized
ccagctgccttcgtggtttctg

SEQ ID NO: 1247447 - DNA, 22 bp, Artificial Sequence
  chemically synthesized
gccagctgccttcgtggtttct

SEQ ID NO: 1247448 - DNA, 22 bp, Artificial Sequence
  chemically synthesized
tgccagctgccttcgtggtttc

SEQ ID NO: 1247449 - DNA, 22 bp, Artificial Sequence
  chemically synthesized
ttgccagctgccttcgtggttt

SEQ ID NO: 1247450 - DNA, 22 bp, Artificial Sequence
  chemically synthesized
tttgccagctgccttcgtggtt

SEQ ID NO: 1247451 - DNA, 22 bp, Artificial Sequence
  chemically synthesized
gtattttttgccagctgccttc

SEQ ID NO: 1247452 - DNA, 22 bp, Artificial Sequence
  chemically synthesized
tggtattttttgccagctgcct

SEQ ID NO: 1247453 - DNA, 22 bp, Artificial Sequence
  chemically synthesized
ctctggtattttttgccagctg

SEQ ID NO: 1247454 - DNA, 22 bp, Artificial Sequence
  chemically synthesized
actctggtattttttgccagct

SEQ ID NO: 1247455 - DNA, 22 bp, Artificial Sequence
  chemically synthesized
tacttactctggtattttttgc

SEQ ID NO: 1247456 - DNA, 22 bp, Artificial Sequence
  chemically synthesized
gctgtacttactctggtatttt

SEQ ID NO: 1247457 - DNA, 22 bp, Artificial Sequence
  chemically synthesized
ctagctgtacttactctggtat

SEQ ID NO: 1247458 - DNA, 22 bp, Artificial Sequence
  chemically synthesized
gcaaaaaataccagagtaagta

SEQ ID NO: 1247459 - DNA, 22 bp, Artificial Sequence
  chemically synthesized
cagttcctagctgtacttactc

SEQ ID NO: 1247460 - DNA, 22 bp, Artificial Sequence
  chemically synthesized
gcatctacagttcctagctgta

SEQ ID NO: 1247461 - DNA, 22 bp, Artificial Sequence
  chemically synthesized
acactggcatctacagttccta

SEQ ID NO: 1247462 - DNA, 22 bp, Artificial Sequence
  chemically synthesized
ggaactgtagatgccagtgtca

SEQ ID NO: 1247463 - DNA, 22 bp, Artificial Sequence
  chemically synthesized
aaagatgtagactgacactggc

SEQ ID NO: 1247464 - DNA, 22 bp, Artificial Sequence
  chemically synthesized
tagatgccagtgtcagtctaca

SEQ ID NO: 1247465 - DNA, 22 bp, Artificial Sequence
  chemically synthesized
atacagttcaaagatgtagact

SEQ ID NO: 1247466 - DNA, 22 bp, Artificial Sequence
  chemically synthesized
catacagttcaaagatgtagac

SEQ ID NO: 1247467 - DNA, 22 bp, Artificial Sequence
  chemically synthesized
tcatacagttcaaagatgtaga

SEQ ID NO: 1247468 - DNA, 22 bp, Artificial Sequence
  chemically synthesized
tttcatacagttcaaagatgta

SEQ ID NO: 1247469 - DNA, 22 bp, Artificial Sequence
  chemically synthesized
catctttgaactgtatgaaaga

SEQ ID NO: 1247470 - DNA, 22 bp, Artificial Sequence
  chemically synthesized
gtgtccaataggctctttcata

SEQ ID NO: 1247471 - DNA, 22 bp, Artificial Sequence
  chemically synthesized
agtgtccaataggctctttcat

SEQ ID NO: 1247472 - DNA, 22 bp, Artificial Sequence
  chemically synthesized
tgaactgtatgaaagagcctat

SEQ ID NO: 1247473 - DNA, 22 bp, Artificial Sequence
  chemically synthesized
gaactgtatgaaagagcctatt

SEQ ID NO: 1247474 - DNA, 22 bp, Artificial Sequence
  chemically synthesized
aactgtatgaaagagcctattg

SEQ ID NO: 1247475 - DNA, 22 bp, Artificial Sequence
  chemically synthesized
ataaatacttagtgtccaatag

SEQ ID NO: 1247476 - DNA, 22 bp, Artificial Sequence
  chemically synthesized
tatgaaagagcctattggacac

SEQ ID NO: 1247477 - DNA, 22 bp, Artificial Sequence
  chemically synthesized
gataaatacttagtgtccaata

SEQ ID NO: 1247478 - DNA, 22 bp, Artificial Sequence
  chemically synthesized
ttggacactaagtatttatcaa

SEQ ID NO: 1247479 - DNA, 22 bp, Artificial Sequence
  chemically synthesized
aaagagaaagaatttgataaat

SEQ ID NO: 1247480 - DNA, 22 bp, Artificial Sequence
  chemically synthesized
caaagagaaagaatttgataaa

SEQ ID NO: 1247481 - DNA, 22 bp, Artificial Sequence
  chemically synthesized
gacactaagtatttatcaaatt

SEQ ID NO: 1247482 - DNA, 22 bp, Artificial Sequence
  chemically synthesized
gcttcaaagagaaagaatttga

SEQ ID NO: 1247483 - DNA, 22 bp, Artificial Sequence
  chemically synthesized
agtatttatcaaattctttctc

SEQ ID NO: 1247484 - DNA, 22 bp, Artificial Sequence
  chemically synthesized
gaactagcttcaaagagaaaga

SEQ ID NO: 1247485 - DNA, 22 bp, Artificial Sequence
  chemically synthesized
agaactagcttcaaagagaaag

SEQ ID NO: 1247486 - DNA, 22 bp, Artificial Sequence
  chemically synthesized
tagaactagcttcaaagagaaa

SEQ ID NO: 1247487 - DNA, 22 bp, Artificial Sequence
  chemically synthesized
ttagaactagcttcaaagagaa

SEQ ID NO: 1247488 - DNA, 22 bp, Artificial Sequence
  chemically synthesized
atcaaattctttctctttgaag

SEQ ID NO: 1247489 - DNA, 22 bp, Artificial Sequence
  chemically synthesized
tcaaattctttctctttgaagc

SEQ ID NO: 1247490 - DNA, 22 bp, Artificial Sequence
  chemically synthesized
tttttagaactagcttcaaaga

SEQ ID NO: 1247491 - DNA, 22 bp, Artificial Sequence
  chemically synthesized
ttgtttttagaactagcttcaa

SEQ ID NO: 1247492 - DNA, 22 bp, Artificial Sequence
  chemically synthesized
tattgtttttagaactagcttc

SEQ ID NO: 1247493 - DNA, 22 bp, Artificial Sequence
  chemically synthesized
ctattgtttttagaactagctt

SEQ ID NO: 1247494 - DNA, 22 bp, Artificial Sequence
  chemically synthesized
tttctctttgaagctagttcta

SEQ ID NO: 1247495 - DNA, 22 bp, Artificial Sequence
  chemically synthesized
tttctattgtttttagaactag

SEQ ID NO: 1247496 - DNA, 22 bp, Artificial Sequence
  chemically synthesized
tctctttgaagctagttctaaa

SEQ ID NO: 1247497 - DNA, 22 bp, Artificial Sequence
  chemically synthesized
gtttctattgtttttagaacta

SEQ ID NO: 1247498 - DNA, 22 bp, Artificial Sequence
  chemically synthesized
ctctttgaagctagttctaaaa

SEQ ID NO: 1247499 - DNA, 22 bp, Artificial Sequence
  chemically synthesized
tgtttctattgtttttagaact

SEQ ID NO: 1247500 - DNA, 22 bp, Artificial Sequence
  chemically synthesized
tctttgaagctagttctaaaaa

SEQ ID NO: 1247501 - DNA, 22 bp, Artificial Sequence
  chemically synthesized
ttgtttctattgtttttagaac

SEQ ID NO: 1247502 - DNA, 22 bp, Artificial Sequence
  chemically synthesized
tttgaagctagttctaaaaaca

SEQ ID NO: 1247503 - DNA, 22 bp, Artificial Sequence
  chemically synthesized
cttttgtttctattgtttttag

SEQ ID NO: 1247504 - DNA, 22 bp, Artificial Sequence
  chemically synthesized
tgaagctagttctaaaaacaat

SEQ ID NO: 1247505 - DNA, 22 bp, Artificial Sequence
  chemically synthesized
gaagctagttctaaaaacaata

SEQ ID NO: 1247506 - DNA, 22 bp, Artificial Sequence
  chemically synthesized
aagctagttctaaaaacaatag

SEQ ID NO: 1247507 - DNA, 22 bp, Artificial Sequence
  chemically synthesized
aaattccttttgtttctattgt

SEQ ID NO: 1247508 - DNA, 22 bp, Artificial Sequence
  chemically synthesized
gttctaaaaacaatagaaacaa

SEQ ID NO: 1247509 - DNA, 22 bp, Artificial Sequence
  chemically synthesized
gctaaaattccttttgtttcta

SEQ ID NO: 1247510 - DNA, 22 bp, Artificial Sequence
  chemically synthesized
taaaaacaatagaaacaaaagg

SEQ ID NO: 1247511 - DNA, 22 bp, Artificial Sequence
  chemically synthesized
aaaacaatagaaacaaaaggaa

SEQ ID NO: 1247512 - DNA, 22 bp, Artificial Sequence
  chemically synthesized
tagccaaggtaaagcaagttag

SEQ ID NO: 1247513 - DNA, 22 bp, Artificial Sequence
  chemically synthesized
tgtagccaaggtaaagcaagtt

SEQ ID NO: 1247514 - DNA, 22 bp, Artificial Sequence
  chemically synthesized
tagctaacttgctttaccttgg

SEQ ID NO: 1247515 - DNA, 22 bp, Artificial Sequence
  chemically synthesized
agctaacttgctttaccttggc

SEQ ID NO: 1247516 - DNA, 22 bp, Artificial Sequence
  chemically synthesized
aaatattctgtagccaaggtaa

SEQ ID NO: 1247517 - DNA, 22 bp, Artificial Sequence
  chemically synthesized
gctaacttgctttaccttggct

SEQ ID NO: 1247518 - DNA, 22 bp, Artificial Sequence
  chemically synthesized
aaaatattctgtagccaaggta

SEQ ID NO: 1247519 - DNA, 22 bp, Artificial Sequence
  chemically synthesized
acttgctttaccttggctacag

SEQ ID NO: 1247520 - DNA, 22 bp, Artificial Sequence
  chemically synthesized
gatttaaaatattctgtagcca

SEQ ID NO: 1247521 - DNA, 22 bp, Artificial Sequence
  chemically synthesized
gctttaccttggctacagaata

SEQ ID NO: 1247522 - DNA, 22 bp, Artificial Sequence
  chemically synthesized
ctttaccttggctacagaatat

SEQ ID NO: 1247523 - DNA, 22 bp, Artificial Sequence
  chemically synthesized
taccttggctacagaatatttt

SEQ ID NO: 1247524 - DNA, 22 bp, Artificial Sequence
  chemically synthesized
accttggctacagaatatttta

SEQ ID NO: 1247525 - DNA, 22 bp, Artificial Sequence
  chemically synthesized
gaatgttagatttaaaatattc

SEQ ID NO: 1247526 - DNA, 22 bp, Artificial Sequence
  chemically synthesized
ccttggctacagaatattttaa

SEQ ID NO: 1247527 - DNA, 22 bp, Artificial Sequence
  chemically synthesized
ggaatgttagatttaaaatatt

SEQ ID NO: 1247528 - DNA, 22 bp, Artificial Sequence
  chemically synthesized
tttggaatgttagatttaaaat

SEQ ID NO: 1247529 - DNA, 22 bp, Artificial Sequence
  chemically synthesized
ggctacagaatattttaaatct

SEQ ID NO: 1247530 - DNA, 22 bp, Artificial Sequence
  chemically synthesized
gctacagaatattttaaatcta

SEQ ID NO: 1247531 - DNA, 22 bp, Artificial Sequence
  chemically synthesized
cagaatattttaaatctaacat

SEQ ID NO: 1247532 - DNA, 22 bp, Artificial Sequence
  chemically synthesized
agaactatttggaatgttagat

SEQ ID NO: 1247533 - DNA, 22 bp, Artificial Sequence
  chemically synthesized
aagaactatttggaatgttaga

SEQ ID NO: 1247534 - DNA, 22 bp, Artificial Sequence
  chemically synthesized
taagaactatttggaatgttag

SEQ ID NO: 1247535 - DNA, 22 bp, Artificial Sequence
  chemically synthesized
taaatctaacattccaaatagt

SEQ ID NO: 1247536 - DNA, 22 bp, Artificial Sequence
  chemically synthesized
aaatctaacattccaaatagtt

SEQ ID NO: 1247537 - DNA, 22 bp, Artificial Sequence
  chemically synthesized
aatctaacattccaaatagttc

SEQ ID NO: 1247538 - DNA, 22 bp, Artificial Sequence
  chemically synthesized
agaatactttaagaactatttg

SEQ ID NO: 1247539 - DNA, 22 bp, Artificial Sequence
  chemically synthesized
acattccaaatagttcttaaag

SEQ ID NO: 1247540 - DNA, 22 bp, Artificial Sequence
  chemically synthesized
caaatagttcttaaagtattct

SEQ ID NO: 1247541 - DNA, 22 bp, Artificial Sequence
  chemically synthesized
acagaaagaaaccagttcagaa

SEQ ID NO: 1247542 - DNA, 22 bp, Artificial Sequence
  chemically synthesized
cacagaaagaaaccagttcaga

SEQ ID NO: 1247543 - DNA, 22 bp, Artificial Sequence
  chemically synthesized
ttaaagtattctgaactggttt

SEQ ID NO: 1247544 - DNA, 22 bp, Artificial Sequence
  chemically synthesized
tcttcacagaaagaaaccagtt

SEQ ID NO: 1247545 - DNA, 22 bp, Artificial Sequence
  chemically synthesized
aaagtattctgaactggtttct

SEQ ID NO: 1247546 - DNA, 22 bp, Artificial Sequence
  chemically synthesized
aagtattctgaactggtttctt

SEQ ID NO: 1247547 - DNA, 22 bp, Artificial Sequence
  chemically synthesized
tgaactggtttctttctgtgaa

SEQ ID NO: 1247548 - DNA, 22 bp, Artificial Sequence
  chemically synthesized
aactggtttctttctgtgaaga

SEQ ID NO: 1247549 - DNA, 22 bp, Artificial Sequence
  chemically synthesized
agaaatcataattgtcttcaca

SEQ ID NO: 1247550 - DNA, 22 bp, Artificial Sequence
  chemically synthesized
gtttctttctgtgaagacaatt

SEQ ID NO: 1247551 - DNA, 22 bp, Artificial Sequence
  chemically synthesized
ctttctgtgaagacaattatga

SEQ ID NO: 1247552 - DNA, 22 bp, Artificial Sequence
  chemically synthesized
tttctgtgaagacaattatgat

SEQ ID NO: 1247553 - DNA, 22 bp, Artificial Sequence
  chemically synthesized
atagactcagaaatcataattg

SEQ ID NO: 1247554 - DNA, 22 bp, Artificial Sequence
  chemically synthesized
tctgtgaagacaattatgattt

SEQ ID NO: 1247555 - DNA, 22 bp, Artificial Sequence
  chemically synthesized
ctgtgaagacaattatgatttc

SEQ ID NO: 1247556 - DNA, 22 bp, Artificial Sequence
  chemically synthesized
ttcatagactcagaaatcataa

SEQ ID NO: 1247557 - DNA, 22 bp, Artificial Sequence
  chemically synthesized
tgtgaagacaattatgatttct

SEQ ID NO: 1247558 - DNA, 22 bp, Artificial Sequence
  chemically synthesized
tgaagacaattatgatttctga

SEQ ID NO: 1247559 - DNA, 22 bp, Artificial Sequence
  chemically synthesized
tgatttctgagtctatgaataa

SEQ ID NO: 1247560 - DNA, 22 bp, Artificial Sequence
  chemically synthesized
cgtaagtatacaattattcata

SEQ ID NO: 1247561 - DNA, 22 bp, Artificial Sequence
  chemically synthesized
ctgagtctatgaataattgtat

SEQ ID NO: 1247562 - DNA, 22 bp, Artificial Sequence
  chemically synthesized
tgagtctatgaataattgtata

SEQ ID NO: 1247563 - DNA, 22 bp, Artificial Sequence
  chemically synthesized
acattgcgtaagtatacaatta

SEQ ID NO: 1247564 - DNA, 22 bp, Artificial Sequence
  chemically synthesized
agtctatgaataattgtatact

SEQ ID NO: 1247565 - DNA, 22 bp, Artificial Sequence
  chemically synthesized
tcctaacattgcgtaagtatac

SEQ ID NO: 1247566 - DNA, 22 bp, Artificial Sequence
  chemically synthesized
tgaataattgtatacttacgca

SEQ ID NO: 1247567 - DNA, 22 bp, Artificial Sequence
  chemically synthesized
cagataatactgtcctaacatt

SEQ ID NO: 1247568 - DNA, 22 bp, Artificial Sequence
  chemically synthesized
tatacttacgcaatgttaggac

SEQ ID NO: 1247569 - DNA, 22 bp, Artificial Sequence
  chemically synthesized
acagataatactgtcctaacat

SEQ ID NO: 1247570 - DNA, 22 bp, Artificial Sequence
  chemically synthesized
tacagataatactgtcctaaca

SEQ ID NO: 1247571 - DNA, 22 bp, Artificial Sequence
  chemically synthesized
acgcaatgttaggacagtatta

SEQ ID NO: 1247572 - DNA, 22 bp, Artificial Sequence
  chemically synthesized
cgcaatgttaggacagtattat

SEQ ID NO: 1247573 - DNA, 22 bp, Artificial Sequence
  chemically synthesized
aacatcaaatcattttacagat

SEQ ID NO: 1247574 - DNA, 22 bp, Artificial Sequence
  chemically synthesized
ggacagtattatctgtaaaatg

SEQ ID NO: 1247575 - DNA, 22 bp, Artificial Sequence
  chemically synthesized
tctgtaaaatgatttgatgttc

SEQ ID NO: 1247576 - DNA, 22 bp, Artificial Sequence
  chemically synthesized
atagtagaaatattgaacatca

SEQ ID NO: 1247577 - DNA, 22 bp, Artificial Sequence
  chemically synthesized
taaaatgatttgatgttcaata

SEQ ID NO: 1247578 - DNA, 22 bp, Artificial Sequence
  chemically synthesized
caagattaatagtagaaatatt

SEQ ID NO: 1247579 - DNA, 22 bp, Artificial Sequence
  chemically synthesized
ccaagattaatagtagaaatat

SEQ ID NO: 1247580 - DNA, 22 bp, Artificial Sequence
  chemically synthesized
tccaagattaatagtagaaata

SEQ ID NO: 1247581 - DNA, 22 bp, Artificial Sequence
  chemically synthesized
ttccaagattaatagtagaaat

SEQ ID NO: 1247582 - DNA, 22 bp, Artificial Sequence
  chemically synthesized
gatgttcaatatttctactatt

SEQ ID NO: 1247583 - DNA, 22 bp, Artificial Sequence
  chemically synthesized
atgttcaatatttctactatta

SEQ ID NO: 1247584 - DNA, 22 bp, Artificial Sequence
  chemically synthesized
cttttccaagattaatagtaga

SEQ ID NO: 1247585 - DNA, 22 bp, Artificial Sequence
  chemically synthesized
acttttccaagattaatagtag

SEQ ID NO: 1247586 - DNA, 22 bp, Artificial Sequence
  chemically synthesized
tacttttccaagattaatagta

SEQ ID NO: 1247587 - DNA, 22 bp, Artificial Sequence
  chemically synthesized
ttacttttccaagattaatagt

SEQ ID NO: 1247588 - DNA, 22 bp, Artificial Sequence
  chemically synthesized
tttacttttccaagattaatag

SEQ ID NO: 1247589 - DNA, 22 bp, Artificial Sequence
  chemically synthesized
aatatttctactattaatcttg

SEQ ID NO: 1247590 - DNA, 22 bp, Artificial Sequence
  chemically synthesized
ctactattaatcttggaaaagt

SEQ ID NO: 1247591 - DNA, 22 bp, Artificial Sequence
  chemically synthesized
tactattaatcttggaaaagta

SEQ ID NO: 1247592 - DNA, 22 bp, Artificial Sequence
  chemically synthesized
ctattaatcttggaaaagtaaa

SEQ ID NO: 1247593 - DNA, 22 bp, Artificial Sequence
  chemically synthesized
atagaagatattttttactttt

SEQ ID NO: 1247594 - DNA, 22 bp, Artificial Sequence
  chemically synthesized
ttaatcttggaaaagtaaaaaa

SEQ ID NO: 1247595 - DNA, 22 bp, Artificial Sequence
  chemically synthesized
tgatagaagatattttttactt

SEQ ID NO: 1247596 - DNA, 22 bp, Artificial Sequence
  chemically synthesized
atcttggaaaagtaaaaaatat

SEQ ID NO: 1247597 - DNA, 22 bp, Artificial Sequence
  chemically synthesized
ctctgatagaagatatttttta

SEQ ID NO: 1247598 - DNA, 22 bp, Artificial Sequence
  chemically synthesized
cctctgatagaagatatttttt

SEQ ID NO: 1247599 - DNA, 22 bp, Artificial Sequence
  chemically synthesized
ggaaaagtaaaaaatatcttct

SEQ ID NO: 1247600 - DNA, 22 bp, Artificial Sequence
  chemically synthesized
gaaaagtaaaaaatatcttcta

SEQ ID NO: 1247601 - DNA, 22 bp, Artificial Sequence
  chemically synthesized
gatttcctctgatagaagatat

SEQ ID NO: 1247602 - DNA, 22 bp, Artificial Sequence
  chemically synthesized
agagtgttagatttcctctgat

SEQ ID NO: 1247603 - DNA, 22 bp, Artificial Sequence
  chemically synthesized
gagagtgttagatttcctctga

SEQ ID NO: 1247604 - DNA, 22 bp, Artificial Sequence
  chemically synthesized
tgagagtgttagatttcctctg

SEQ ID NO: 1247605 - DNA, 22 bp, Artificial Sequence
  chemically synthesized
ttgagagtgttagatttcctct

SEQ ID NO: 1247606 - DNA, 22 bp, Artificial Sequence
  chemically synthesized
tttttgagagtgttagatttcc

SEQ ID NO: 1247607 - DNA, 22 bp, Artificial Sequence
  chemically synthesized
atttttgagagtgttagatttc

SEQ ID NO: 1247608 - DNA, 22 bp, Artificial Sequence
  chemically synthesized
ctatcagaggaaatctaacact

SEQ ID NO: 1247609 - DNA, 22 bp, Artificial Sequence
  chemically synthesized
tatcagaggaaatctaacactc

SEQ ID NO: 1247610 - DNA, 22 bp, Artificial Sequence
  chemically synthesized
acttatttttgagagtgttaga

SEQ ID NO: 1247611 - DNA, 22 bp, Artificial Sequence
  chemically synthesized
aacttatttttgagagtgttag

SEQ ID NO: 1247612 - DNA, 22 bp, Artificial Sequence
  chemically synthesized
tcagaggaaatctaacactctc

SEQ ID NO: 1247613 - DNA, 22 bp, Artificial Sequence
  chemically synthesized
tatcatatttaacttatttttg

SEQ ID NO: 1247614 - DNA, 22 bp, Artificial Sequence
  chemically synthesized
acactctcaaaaataagttaaa

SEQ ID NO: 1247615 - DNA, 22 bp, Artificial Sequence
  chemically synthesized
ccattgtatcatatttaactta

SEQ ID NO: 1247616 - DNA, 22 bp, Artificial Sequence
  chemically synthesized
tcaaaaataagttaaatatgat

SEQ ID NO: 1247617 - DNA, 22 bp, Artificial Sequence
  chemically synthesized
aaaaataagttaaatatgatac

SEQ ID NO: 1247618 - DNA, 22 bp, Artificial Sequence
  chemically synthesized
tagaactgccattgtatcatat

SEQ ID NO: 1247619 - DNA, 22 bp, Artificial Sequence
  chemically synthesized
gatgttgtagaactgccattgt

SEQ ID NO: 1247620 - DNA, 22 bp, Artificial Sequence
  chemically synthesized
aatatgatacaatggcagttct

SEQ ID NO: 1247621 - DNA, 22 bp, Artificial Sequence
  chemically synthesized
aatatctggatgttgtagaact

SEQ ID NO: 1247622 - DNA, 22 bp, Artificial Sequence
  chemically synthesized
ttgaatatctggatgttgtaga

SEQ ID NO: 1247623 - DNA, 22 bp, Artificial Sequence
  chemically synthesized
ctattgaatatctggatgttgt

SEQ ID NO: 1247624 - DNA, 22 bp, Artificial Sequence
  chemically synthesized
cctactattgaatatctggatg

SEQ ID NO: 1247625 - DNA, 22 bp, Artificial Sequence
  chemically synthesized
ctgcctactattgaatatctgg

SEQ ID NO: 1247626 - DNA, 22 bp, Artificial Sequence
  chemically synthesized
tacaacatccagatattcaata

SEQ ID NO: 1247627 - DNA, 22 bp, Artificial Sequence
  chemically synthesized
caacatccagatattcaatagt

SEQ ID NO: 1247628 - DNA, 22 bp, Artificial Sequence
  chemically synthesized
tggcaagtaataattgctgcct

SEQ ID NO: 1247629 - DNA, 22 bp, Artificial Sequence
  chemically synthesized
aatagtaggcagcaattattac

SEQ ID NO: 1247630 - DNA, 22 bp, Artificial Sequence
  chemically synthesized
aaagatgtgaattatggcaagt

SEQ ID NO: 1247631 - DNA, 22 bp, Artificial Sequence
  chemically synthesized
caaagatgtgaattatggcaag

SEQ ID NO: 1247632 - DNA, 22 bp, Artificial Sequence
  chemically synthesized
tcaaagatgtgaattatggcaa

SEQ ID NO: 1247633 - DNA, 22 bp, Artificial Sequence
  chemically synthesized
ttcaaagatgtgaattatggca

SEQ ID NO: 1247634 - DNA, 22 bp, Artificial Sequence
  chemically synthesized
aatttttcaaagatgtgaatta

SEQ ID NO: 1247635 - DNA, 22 bp, Artificial Sequence
  chemically synthesized
gaatttttcaaagatgtgaatt

SEQ ID NO: 1247636 - DNA, 22 bp, Artificial Sequence
  chemically synthesized
ttacttgccataattcacatct

SEQ ID NO: 1247637 - DNA, 22 bp, Artificial Sequence
  chemically synthesized
ttgaatttttcaaagatgtgaa

SEQ ID NO: 1247638 - DNA, 22 bp, Artificial Sequence
  chemically synthesized
cttgccataattcacatctttg

SEQ ID NO: 1247639 - DNA, 22 bp, Artificial Sequence
  chemically synthesized
gccataattcacatctttgaaa

SEQ ID NO: 1247640 - DNA, 22 bp, Artificial Sequence
  chemically synthesized
ccctcttgaatttttcaaagat

SEQ ID NO: 1247641 - DNA, 22 bp, Artificial Sequence
  chemically synthesized
ccataattcacatctttgaaaa

SEQ ID NO: 1247642 - DNA, 22 bp, Artificial Sequence
  chemically synthesized
gccctcttgaatttttcaaaga

SEQ ID NO: 1247643 - DNA, 22 bp, Artificial Sequence
  chemically synthesized
gtttgccctcttgaatttttca

SEQ ID NO: 1247644 - DNA, 22 bp, Artificial Sequence
  chemically synthesized
acatctttgaaaaattcaagag

SEQ ID NO: 1247645 - DNA, 22 bp, Artificial Sequence
  chemically synthesized
gcaaaattagtttgccctcttg

SEQ ID NO: 1247646 - DNA, 22 bp, Artificial Sequence
  chemically synthesized
tgaaaaattcaagagggcaaac

SEQ ID NO: 1247647 - DNA, 22 bp, Artificial Sequence
  chemically synthesized
gaaaaattcaagagggcaaact

SEQ ID NO: 1247648 - DNA, 22 bp, Artificial Sequence
  chemically synthesized
aaaaattcaagagggcaaacta

SEQ ID NO: 1247649 - DNA, 22 bp, Artificial Sequence
  chemically synthesized
acattggcaaaattagtttgcc

SEQ ID NO: 1247650 - DNA, 22 bp, Artificial Sequence
  chemically synthesized
cacattggcaaaattagtttgc

SEQ ID NO: 1247651 - DNA, 22 bp, Artificial Sequence
  chemically synthesized
cttcacattggcaaaattagtt

SEQ ID NO: 1247652 - DNA, 22 bp, Artificial Sequence
  chemically synthesized
aagagggcaaactaattttgcc

SEQ ID NO: 1247653 - DNA, 22 bp, Artificial Sequence
  chemically synthesized
cagctccttcacattggcaaaa

SEQ ID NO: 1247654 - DNA, 22 bp, Artificial Sequence
  chemically synthesized
acagctccttcacattggcaaa

SEQ ID NO: 1247655 - DNA, 22 bp, Artificial Sequence
  chemically synthesized
ttacagctccttcacattggca

SEQ ID NO: 1247656 - DNA, 22 bp, Artificial Sequence
  chemically synthesized
cttacagctccttcacattggc

SEQ ID NO: 1247657 - DNA, 22 bp, Artificial Sequence
  chemically synthesized
tcttacagctccttcacattgg

SEQ ID NO: 1247658 - DNA, 22 bp, Artificial Sequence
  chemically synthesized
ttcttacagctccttcacattg

SEQ ID NO: 1247659 - DNA, 22 bp, Artificial Sequence
  chemically synthesized
attttgccaatgtgaaggagct

SEQ ID NO: 1247660 - DNA, 22 bp, Artificial Sequence
  chemically synthesized
tgccaatgtgaaggagctgtaa

SEQ ID NO: 1247661 - DNA, 22 bp, Artificial Sequence
  chemically synthesized
gccaatgtgaaggagctgtaag

SEQ ID NO: 1247662 - DNA, 22 bp, Artificial Sequence
  chemically synthesized
ccaatgtgaaggagctgtaaga

SEQ ID NO: 1247663 - DNA, 22 bp, Artificial Sequence
  chemically synthesized
aagcataatttttcttacagct

SEQ ID NO: 1247664 - DNA, 22 bp, Artificial Sequence
  chemically synthesized
cattaaagcataatttttctta

SEQ ID NO: 1247665 - DNA, 22 bp, Artificial Sequence
  chemically synthesized
ccattaaagcataatttttctt

SEQ ID NO: 1247666 - DNA, 22 bp, Artificial Sequence
  chemically synthesized
tatttccattaaagcataattt

SEQ ID NO: 1247667 - DNA, 22 bp, Artificial Sequence
  chemically synthesized
atatttccattaaagcataatt

SEQ ID NO: 1247668 - DNA, 22 bp, Artificial Sequence
  chemically synthesized
taagaaaaattatgctttaatg

SEQ ID NO: 1247669 - DNA, 22 bp, Artificial Sequence
  chemically synthesized
tgctttaatggaaatataagat

SEQ ID NO: 1247670 - DNA, 22 bp, Artificial Sequence
  chemically synthesized
aggcaacaaaaacatcttatat

SEQ ID NO: 1247671 - DNA, 22 bp, Artificial Sequence
  chemically synthesized
aaggcaacaaaaacatcttata

SEQ ID NO: 1247672 - DNA, 22 bp, Artificial Sequence
  chemically synthesized
taatggaaatataagatgtttt

SEQ ID NO: 1247673 - DNA, 22 bp, Artificial Sequence
  chemically synthesized
aatggaaatataagatgttttt

SEQ ID NO: 1247674 - DNA, 22 bp, Artificial Sequence
  chemically synthesized
atggaaatataagatgtttttg

SEQ ID NO: 1247675 - DNA, 22 bp, Artificial Sequence
  chemically synthesized
aaaagcaatacttaaggcaaca

SEQ ID NO: 1247676 - DNA, 22 bp, Artificial Sequence
  chemically synthesized
aaggattaaaaagcaatactta

SEQ ID NO: 1247677 - DNA, 22 bp, Artificial Sequence
  chemically synthesized
caaggattaaaaagcaatactt

SEQ ID NO: 1247678 - DNA, 22 bp, Artificial Sequence
  chemically synthesized
ttgttgccttaagtattgcttt

SEQ ID NO: 1247679 - DNA, 22 bp, Artificial Sequence
  chemically synthesized
tgttgccttaagtattgctttt

SEQ ID NO: 1247680 - DNA, 22 bp, Artificial Sequence
  chemically synthesized
gttgccttaagtattgcttttt

SEQ ID NO: 1247681 - DNA, 22 bp, Artificial Sequence
  chemically synthesized
ttgccttaagtattgcttttta

SEQ ID NO: 1247682 - DNA, 22 bp, Artificial Sequence
  chemically synthesized
aatttcaaggattaaaaagcaa

SEQ ID NO: 1247683 - DNA, 22 bp, Artificial Sequence
  chemically synthesized
ccttaagtattgctttttaatc

SEQ ID NO: 1247684 - DNA, 22 bp, Artificial Sequence
  chemically synthesized
actgaatttcaaggattaaaaa

SEQ ID NO: 1247685 - DNA, 22 bp, Artificial Sequence
  chemically synthesized
gactgaatttcaaggattaaaa

SEQ ID NO: 1247686 - DNA, 22 bp, Artificial Sequence
  chemically synthesized
aagtattgctttttaatccttg

SEQ ID NO: 1247687 - DNA, 22 bp, Artificial Sequence
  chemically synthesized
agtattgctttttaatccttga

SEQ ID NO: 1247688 - DNA, 22 bp, Artificial Sequence
  chemically synthesized
agtatttgactgaatttcaagg

SEQ ID NO: 1247689 - DNA, 22 bp, Artificial Sequence
  chemically synthesized
ctttttaatccttgaaattcag

SEQ ID NO: 1247690 - DNA, 22 bp, Artificial Sequence
  chemically synthesized
ttaagtatttgactgaatttca

SEQ ID NO: 1247691 - DNA, 22 bp, Artificial Sequence
  chemically synthesized
tttaatccttgaaattcagtca

SEQ ID NO: 1247692 - DNA, 22 bp, Artificial Sequence
  chemically synthesized
ttaatccttgaaattcagtcaa

SEQ ID NO: 1247693 - DNA, 22 bp, Artificial Sequence
  chemically synthesized
taatccttgaaattcagtcaaa

SEQ ID NO: 1247694 - DNA, 22 bp, Artificial Sequence
  chemically synthesized
aatccttgaaattcagtcaaat

SEQ ID NO: 1247695 - DNA, 22 bp, Artificial Sequence
  chemically synthesized
atccttgaaattcagtcaaata

SEQ ID NO: 1247696 - DNA, 22 bp, Artificial Sequence
  chemically synthesized
gaaattcagtcaaatacttaat

SEQ ID NO: 1247697 - DNA, 22 bp, Artificial Sequence
  chemically synthesized
aaattcagtcaaatacttaata

SEQ ID NO: 1247698 - DNA, 22 bp, Artificial Sequence
  chemically synthesized
agtcaaatacttaataattatt

SEQ ID NO: 1247699 - DNA, 22 bp, Artificial Sequence
  chemically synthesized
ataagatatatggaaaataatt

SEQ ID NO: 1247700 - DNA, 22 bp, Artificial Sequence
  chemically synthesized
aataattattttccatatatct

SEQ ID NO: 1247701 - DNA, 22 bp, Artificial Sequence
  chemically synthesized
atatgtctaataagatatatgg

SEQ ID NO: 1247702 - DNA, 22 bp, Artificial Sequence
  chemically synthesized
ataattattttccatatatctt

SEQ ID NO: 1247703 - DNA, 22 bp, Artificial Sequence
  chemically synthesized
ttttccatatatcttattagac

SEQ ID NO: 1247704 - DNA, 22 bp, Artificial Sequence
  chemically synthesized
tccatatatcttattagacata

SEQ ID NO: 1247705 - DNA, 22 bp, Artificial Sequence
  chemically synthesized
ccatatatcttattagacatat

SEQ ID NO: 1247706 - DNA, 22 bp, Artificial Sequence
  chemically synthesized
catatatcttattagacatatt

SEQ ID NO: 1247707 - DNA, 22 bp, Artificial Sequence
  chemically synthesized
accagcatgagtgctaatatgt

SEQ ID NO: 1247708 - DNA, 22 bp, Artificial Sequence
  chemically synthesized
taaccagcatgagtgctaatat

SEQ ID NO: 1247709 - DNA, 22 bp, Artificial Sequence
  chemically synthesized
attagacatattagcactcatg

SEQ ID NO: 1247710 - DNA, 22 bp, Artificial Sequence
  chemically synthesized
ttagacatattagcactcatgc

SEQ ID NO: 1247711 - DNA, 22 bp, Artificial Sequence
  chemically synthesized
gacatattagcactcatgctgg

SEQ ID NO: 1247712 - DNA, 22 bp, Artificial Sequence
  chemically synthesized
aggaagataaaatctctaacca

SEQ ID NO: 1247713 - DNA, 22 bp, Artificial Sequence
  chemically synthesized
gcactcatgctggttagagatt

SEQ ID NO: 1247714 - DNA, 22 bp, Artificial Sequence
  chemically synthesized
tgaggaagataaaatctctaac

SEQ ID NO: 1247715 - DNA, 22 bp, Artificial Sequence
  chemically synthesized
atgctggttagagattttatct

SEQ ID NO: 1247716 - DNA, 22 bp, Artificial Sequence
  chemically synthesized
gtatggctctgaggaagataaa

SEQ ID NO: 1247717 - DNA, 22 bp, Artificial Sequence
  chemically synthesized
gttagagattttatcttcctca

SEQ ID NO: 1247718 - DNA, 22 bp, Artificial Sequence
  chemically synthesized
gagattttatcttcctcagagc

SEQ ID NO: 1247719 - DNA, 22 bp, Artificial Sequence
  chemically synthesized
gaagggtgtgttggtatggctc

SEQ ID NO: 1247720 - DNA, 22 bp, Artificial Sequence
  chemically synthesized
tatcttcctcagagccatacca

SEQ ID NO: 1247721 - DNA, 22 bp, Artificial Sequence
  chemically synthesized
agaagggtgtgttggtatggct

SEQ ID NO: 1247722 - DNA, 22 bp, Artificial Sequence
  chemically synthesized
atcttcctcagagccataccaa

SEQ ID NO: 1247723 - DNA, 22 bp, Artificial Sequence
  chemically synthesized
tcttcctcagagccataccaac

SEQ ID NO: 1247724 - DNA, 22 bp, Artificial Sequence
  chemically synthesized
cctcagagccataccaacacac

SEQ ID NO: 1247725 - DNA, 22 bp, Artificial Sequence
  chemically synthesized
ctcagagccataccaacacacc

SEQ ID NO: 1247726 - DNA, 22 bp, Artificial Sequence
  chemically synthesized
agagccataccaacacaccctt

SEQ ID NO: 1247727 - DNA, 22 bp, Artificial Sequence
  chemically synthesized
caaagtagggtttagaagggtg

SEQ ID NO: 1247728 - DNA, 22 bp, Artificial Sequence
  chemically synthesized
agcgttgcaaagtagggtttag

SEQ ID NO: 1247729 - DNA, 22 bp, Artificial Sequence
  chemically synthesized
cctcagcgttgcaaagtagggt

SEQ ID NO: 1247730 - DNA, 22 bp, Artificial Sequence
  chemically synthesized
gcctcagcgttgcaaagtaggg

SEQ ID NO: 1247731 - DNA, 22 bp, Artificial Sequence
  chemically synthesized
tgcctcagcgttgcaaagtagg

SEQ ID NO: 1247732 - DNA, 22 bp, Artificial Sequence
  chemically synthesized
ctaaaccctactttgcaacgct

SEQ ID NO: 1247733 - DNA, 22 bp, Artificial Sequence
  chemically synthesized
taaaccctactttgcaacgctg

SEQ ID NO: 1247734 - DNA, 22 bp, Artificial Sequence
  chemically synthesized
aaccctactttgcaacgctgag

SEQ ID NO: 1247735 - DNA, 22 bp, Artificial Sequence
  chemically synthesized
cagagtctttgcctcagcgttg

SEQ ID NO: 1247736 - DNA, 22 bp, Artificial Sequence
  chemically synthesized
gcagagtctttgcctcagcgtt

SEQ ID NO: 1247737 - DNA, 22 bp, Artificial Sequence
  chemically synthesized
ctttgcaacgctgaggcaaaga

SEQ ID NO: 1247738 - DNA, 22 bp, Artificial Sequence
  chemically synthesized
tgcaacgctgaggcaaagactc

SEQ ID NO: 1247739 - DNA, 22 bp, Artificial Sequence
  chemically synthesized
gcaacgctgaggcaaagactct

SEQ ID NO: 1247740 - DNA, 22 bp, Artificial Sequence
  chemically synthesized
caacgctgaggcaaagactctg

SEQ ID NO: 1247741 - DNA, 22 bp, Artificial Sequence
  chemically synthesized
aggcaaagactctgcaaaccgt

SEQ ID NO: 1247742 - DNA, 22 bp, Artificial Sequence
  chemically synthesized
tgcaaaccgtacttctggcttt

SEQ ID NO: 1247743 - DNA, 22 bp, Artificial Sequence
  chemically synthesized
agagtcagtcagtaaagccaga

SEQ ID NO: 1247744 - DNA, 22 bp, Artificial Sequence
  chemically synthesized
caaaccgtacttctggctttac

SEQ ID NO: 1247745 - DNA, 22 bp, Artificial Sequence
  chemically synthesized
tgagagtcagtcagtaaagcca

SEQ ID NO: 1247746 - DNA, 22 bp, Artificial Sequence
  chemically synthesized
gattctgagagtcagtcagtaa

SEQ ID NO: 1247747 - DNA, 22 bp, Artificial Sequence
  chemically synthesized
agattctgagagtcagtcagta

SEQ ID NO: 1247748 - DNA, 22 bp, Artificial Sequence
  chemically synthesized
tagattctgagagtcagtcagt

SEQ ID NO: 1247749 - DNA, 22 bp, Artificial Sequence
  chemically synthesized
ctggctttactgactgactctc

SEQ ID NO: 1247750 - DNA, 22 bp, Artificial Sequence
  chemically synthesized
cctttagattctgagagtcagt

SEQ ID NO: 1247751 - DNA, 22 bp, Artificial Sequence
  chemically synthesized
tggctttactgactgactctca

SEQ ID NO: 1247752 - DNA, 22 bp, Artificial Sequence
  chemically synthesized
gctttactgactgactctcaga

SEQ ID NO: 1247753 - DNA, 22 bp, Artificial Sequence
  chemically synthesized
cctacctttagattctgagagt

SEQ ID NO: 1247754 - DNA, 22 bp, Artificial Sequence
  chemically synthesized
tactgactgactctcagaatct

SEQ ID NO: 1247755 - DNA, 22 bp, Artificial Sequence
  chemically synthesized
ctccctacctttagattctgag

SEQ ID NO: 1247756 - DNA, 22 bp, Artificial Sequence
  chemically synthesized
actgactgactctcagaatcta

SEQ ID NO: 1247757 - DNA, 22 bp, Artificial Sequence
  chemically synthesized
ctgactgactctcagaatctaa

SEQ ID NO: 1247758 - DNA, 22 bp, Artificial Sequence
  chemically synthesized
ttgctccctacctttagattct

SEQ ID NO: 1247759 - DNA, 22 bp, Artificial Sequence
  chemically synthesized
actgactctcagaatctaaagg

SEQ ID NO: 1247760 - DNA, 22 bp, Artificial Sequence
  chemically synthesized
tattgctccctacctttagatt

SEQ ID NO: 1247761 - DNA, 22 bp, Artificial Sequence
  chemically synthesized
actctcagaatctaaaggtagg

SEQ ID NO: 1247762 - DNA, 22 bp, Artificial Sequence
  chemically synthesized
cctctattgctccctaccttta

SEQ ID NO: 1247763 - DNA, 22 bp, Artificial Sequence
  chemically synthesized
tcagaatctaaaggtagggagc

SEQ ID NO: 1247764 - DNA, 22 bp, Artificial Sequence
  chemically synthesized
agaatctaaaggtagggagcaa

SEQ ID NO: 1247765 - DNA, 22 bp, Artificial Sequence
  chemically synthesized
cagtctccctctattgctccct

SEQ ID NO: 1247766 - DNA, 22 bp, Artificial Sequence
  chemically synthesized
gcagtctccctctattgctccc

SEQ ID NO: 1247767 - DNA, 22 bp, Artificial Sequence
  chemically synthesized
aaggtagggagcaatagaggga

SEQ ID NO: 1247768 - DNA, 22 bp, Artificial Sequence
  chemically synthesized
caggcttgcagtctccctctat

SEQ ID NO: 1247769 - DNA, 22 bp, Artificial Sequence
  chemically synthesized
ctccaggcttgcagtctccctc

SEQ ID NO: 1247770 - DNA, 22 bp, Artificial Sequence
  chemically synthesized
tccctcctccaggcttgcagtc

SEQ ID NO: 1247771 - DNA, 22 bp, Artificial Sequence
  chemically synthesized
gtccctcctccaggcttgcagt

SEQ ID NO: 1247772 - DNA, 22 bp, Artificial Sequence
  chemically synthesized
tgtccctcctccaggcttgcag

SEQ ID NO: 1247773 - DNA, 22 bp, Artificial Sequence
  chemically synthesized
caagcctggaggagggacaaag

SEQ ID NO: 1247774 - DNA, 22 bp, Artificial Sequence
  chemically synthesized
gtgtgaatgagtaaatcctttg

SEQ ID NO: 1247775 - DNA, 22 bp, Artificial Sequence
  chemically synthesized
gaggagggacaaaggatttact

SEQ ID NO: 1247776 - DNA, 22 bp, Artificial Sequence
  chemically synthesized
actcattcacactagcttccca

SEQ ID NO: 1247777 - DNA, 22 bp, Artificial Sequence
  chemically synthesized
ctcattcacactagcttcccat

SEQ ID NO: 1247778 - DNA, 22 bp, Artificial Sequence
  chemically synthesized
attcacactagcttcccatgca

SEQ ID NO: 1247779 - DNA, 22 bp, Artificial Sequence
  chemically synthesized
ataaggacagtaagtgcatggg

SEQ ID NO: 1247780 - DNA, 22 bp, Artificial Sequence
  chemically synthesized
acactagcttcccatgcactta

SEQ ID NO: 1247781 - DNA, 22 bp, Artificial Sequence
  chemically synthesized
ctaataaggacagtaagtgcat

SEQ ID NO: 1247782 - DNA, 22 bp, Artificial Sequence
  chemically synthesized
gcttcccatgcacttactgtcc

SEQ ID NO: 1247783 - DNA, 22 bp, Artificial Sequence
  chemically synthesized
gggaactgctaataaggacagt

SEQ ID NO: 1247784 - DNA, 22 bp, Artificial Sequence
  chemically synthesized
cccatgcacttactgtccttat

SEQ ID NO: 1247785 - DNA, 22 bp, Artificial Sequence
  chemically synthesized
ccatgcacttactgtccttatt

SEQ ID NO: 1247786 - DNA, 22 bp, Artificial Sequence
  chemically synthesized
actgtccttattagcagttccc

SEQ ID NO: 1247787 - DNA, 22 bp, Artificial Sequence
  chemically synthesized
ctgtccttattagcagttccct

SEQ ID NO: 1247788 - DNA, 22 bp, Artificial Sequence
  chemically synthesized
tccttattagcagttccctaga

SEQ ID NO: 1247789 - DNA, 22 bp, Artificial Sequence
  chemically synthesized
attagcagttccctagacgtgc

SEQ ID NO: 1247790 - DNA, 22 bp, Artificial Sequence
  chemically synthesized
ttagcagttccctagacgtgct

SEQ ID NO: 1247791 - DNA, 22 bp, Artificial Sequence
  chemically synthesized
caggcatgaagaagcacgtcta

SEQ ID NO: 1247792 - DNA, 22 bp, Artificial Sequence
  chemically synthesized
gcagttccctagacgtgcttct

SEQ ID NO: 1247793 - DNA, 22 bp, Artificial Sequence
  chemically synthesized
ctgcaggcatgaagaagcacgt

SEQ ID NO: 1247794 - DNA, 22 bp, Artificial Sequence
  chemically synthesized
cctagacgtgcttcttcatgcc

SEQ ID NO: 1247795 - DNA, 22 bp, Artificial Sequence
  chemically synthesized
aaaagtgctgctgcaggcatga

SEQ ID NO: 1247796 - DNA, 22 bp, Artificial Sequence
  chemically synthesized
gacgtgcttcttcatgcctgca

SEQ ID NO: 1247797 - DNA, 22 bp, Artificial Sequence
  chemically synthesized
ctaaaaagtgctgctgcaggca

SEQ ID NO: 1247798 - DNA, 22 bp, Artificial Sequence
  chemically synthesized
ttactaaaaagtgctgctgcag

SEQ ID NO: 1247799 - DNA, 22 bp, Artificial Sequence
  chemically synthesized
gttactaaaaagtgctgctgca

SEQ ID NO: 1247800 - DNA, 22 bp, Artificial Sequence
  chemically synthesized
cttcatgcctgcagcagcactt

SEQ ID NO: 1247801 - DNA, 22 bp, Artificial Sequence
  chemically synthesized
ttcatgcctgcagcagcacttt

SEQ ID NO: 1247802 - DNA, 22 bp, Artificial Sequence
  chemically synthesized
catgcctgcagcagcacttttt

SEQ ID NO: 1247803 - DNA, 22 bp, Artificial Sequence
  chemically synthesized
atgcctgcagcagcacttttta

SEQ ID NO: 1247804 - DNA, 22 bp, Artificial Sequence
  chemically synthesized
aatagcttgttactaaaaagtg

SEQ ID NO: 1247805 - DNA, 22 bp, Artificial Sequence
  chemically synthesized
aattgaatagcttgttactaaa

SEQ ID NO: 1247806 - DNA, 22 bp, Artificial Sequence
  chemically synthesized
cagcagcactttttagtaacaa

SEQ ID NO: 1247807 - DNA, 22 bp, Artificial Sequence
  chemically synthesized
tttagtaacaagctattcaatt

SEQ ID NO: 1247808 - DNA, 22 bp, Artificial Sequence
  chemically synthesized
ttagtaacaagctattcaattt

SEQ ID NO: 1247809 - DNA, 22 bp, Artificial Sequence
  chemically synthesized
tagtaacaagctattcaattta

SEQ ID NO: 1247810 - DNA, 22 bp, Artificial Sequence
  chemically synthesized
agtaacaagctattcaatttag

SEQ ID NO: 1247811 - DNA, 22 bp, Artificial Sequence
  chemically synthesized
gtaacaagctattcaatttagc

SEQ ID NO: 1247812 - DNA, 22 bp, Artificial Sequence
  chemically synthesized
aaaaacaaaacacaagctaaat

SEQ ID NO: 1247813 - DNA, 22 bp, Artificial Sequence
  chemically synthesized
gaaaaacaaaacacaagctaaa

SEQ ID NO: 1247814 - DNA, 22 bp, Artificial Sequence
  chemically synthesized
tgaaaaacaaaacacaagctaa

SEQ ID NO: 1247815 - DNA, 22 bp, Artificial Sequence
  chemically synthesized
ttgaaaaacaaaacacaagcta

SEQ ID NO: 1247816 - DNA, 22 bp, Artificial Sequence
  chemically synthesized
ttcaatttagcttgtgttttgt

SEQ ID NO: 1247817 - DNA, 22 bp, Artificial Sequence
  chemically synthesized
agcttttgaaaaacaaaacaca

SEQ ID NO: 1247818 - DNA, 22 bp, Artificial Sequence
  chemically synthesized
taagcttttgaaaaacaaaaca

SEQ ID NO: 1247819 - DNA, 22 bp, Artificial Sequence
  chemically synthesized
aatttagcttgtgttttgtttt

SEQ ID NO: 1247820 - DNA, 22 bp, Artificial Sequence
  chemically synthesized
tctaagcttttgaaaaacaaaa

SEQ ID NO: 1247821 - DNA, 22 bp, Artificial Sequence
  chemically synthesized
agcttgtgttttgtttttcaaa

SEQ ID NO: 1247822 - DNA, 22 bp, Artificial Sequence
  chemically synthesized
attctctaagcttttgaaaaac

SEQ ID NO: 1247823 - DNA, 22 bp, Artificial Sequence
  chemically synthesized
gcttgtgttttgtttttcaaaa

SEQ ID NO: 1247824 - DNA, 22 bp, Artificial Sequence
  chemically synthesized
gtgttttgtttttcaaaagctt

SEQ ID NO: 1247825 - DNA, 22 bp, Artificial Sequence
  chemically synthesized
tgttttgtttttcaaaagctta

SEQ ID NO: 1247826 - DNA, 22 bp, Artificial Sequence
  chemically synthesized
tgtttttcaaaagcttagagaa

SEQ ID NO: 1247827 - DNA, 22 bp, Artificial Sequence
  chemically synthesized
gtttttcaaaagcttagagaat

SEQ ID NO: 1247828 - DNA, 22 bp, Artificial Sequence
  chemically synthesized
tttttcaaaagcttagagaatc

SEQ ID NO: 1247829 - DNA, 22 bp, Artificial Sequence
  chemically synthesized
ttcaaaagcttagagaatcagc

SEQ ID NO: 1247830 - DNA, 22 bp, Artificial Sequence
  chemically synthesized
tcaaaagcttagagaatcagct

SEQ ID NO: 1247831 - DNA, 22 bp, Artificial Sequence
  chemically synthesized
caaaagcttagagaatcagctt

SEQ ID NO: 1247832 - DNA, 22 bp, Artificial Sequence
  chemically synthesized
aaaagcttagagaatcagcttc

SEQ ID NO: 1247833 - DNA, 22 bp, Artificial Sequence
  chemically synthesized
cagcaggggcgatgaagctgat

SEQ ID NO: 1247834 - DNA, 22 bp, Artificial Sequence
  chemically synthesized
tgcagcaggggcgatgaagctg

SEQ ID NO: 1247835 - DNA, 22 bp, Artificial Sequence
  chemically synthesized
ctgcagcaggggcgatgaagct

SEQ ID NO: 1247836 - DNA, 22 bp, Artificial Sequence
  chemically synthesized
agagaatcagcttcatcgcccc

SEQ ID NO: 1247837 - DNA, 22 bp, Artificial Sequence
  chemically synthesized
gagaatcagcttcatcgcccct

SEQ ID NO: 1247838 - DNA, 22 bp, Artificial Sequence
  chemically synthesized
gtatttctgcagcaggggcgat

SEQ ID NO: 1247839 - DNA, 22 bp, Artificial Sequence
  chemically synthesized
catcgcccctgctgcagaaata

SEQ ID NO: 1247840 - DNA, 22 bp, Artificial Sequence
  chemically synthesized
atcgcccctgctgcagaaatac

SEQ ID NO: 1247841 - DNA, 22 bp, Artificial Sequence
  chemically synthesized
ccagccaggtggtgctggtatt

SEQ ID NO: 1247842 - DNA, 22 bp, Artificial Sequence
  chemically synthesized
tgccagccaggtggtgctggta

SEQ ID NO: 1247843 - DNA, 22 bp, Artificial Sequence
  chemically synthesized
ctgcagaaataccagcaccacc

SEQ ID NO: 1247844 - DNA, 22 bp, Artificial Sequence
  chemically synthesized
cagaaataccagcaccacctgg

SEQ ID NO: 1247845 - DNA, 22 bp, Artificial Sequence
  chemically synthesized
aggcccggacctctgccagcca

SEQ ID NO: 1247846 - DNA, 22 bp, Artificial Sequence
  chemically synthesized
gctggcagaggtccgggcctca

SEQ ID NO: 1247847 - DNA, 22 bp, Artificial Sequence
  chemically synthesized
gcagaggtccgggcctcagtcc

SEQ ID NO: 1247848 - DNA, 22 bp, Artificial Sequence
  chemically synthesized
ggatagcaggaagggcccaatg

SEQ ID NO: 1247849 - DNA, 22 bp, Artificial Sequence
  chemically synthesized
tgggatagcaggaagggcccaa

SEQ ID NO: 1247850 - DNA, 22 bp, Artificial Sequence
  chemically synthesized
tctgggatagcaggaagggccc

SEQ ID NO: 1247851 - DNA, 22 bp, Artificial Sequence
  chemically synthesized
agtcccattgggcccttcctgc

SEQ ID NO: 1247852 - DNA, 22 bp, Artificial Sequence
  chemically synthesized
ccctctctgggatagcaggaag

SEQ ID NO: 1247853 - DNA, 22 bp, Artificial Sequence
  chemically synthesized
gtgctaccctctctgggatagc

SEQ ID NO: 1247854 - DNA, 22 bp, Artificial Sequence
  chemically synthesized
ggcccttcctgctatcccagag

SEQ ID NO: 1247855 - DNA, 22 bp, Artificial Sequence
  chemically synthesized
cgtggctggtgctaccctctct

SEQ ID NO: 1247856 - DNA, 22 bp, Artificial Sequence
  chemically synthesized
cctgctatcccagagagggtag

SEQ ID NO: 1247857 - DNA, 22 bp, Artificial Sequence
  chemically synthesized
ctgctatcccagagagggtagc

SEQ ID NO: 1247858 - DNA, 22 bp, Artificial Sequence
  chemically synthesized
ctacgtggctggtgctaccctc

SEQ ID NO: 1247859 - DNA, 22 bp, Artificial Sequence
  chemically synthesized
ctatcccagagagggtagcacc

SEQ ID NO: 1247860 - DNA, 22 bp, Artificial Sequence
  chemically synthesized
tcccagagagggtagcaccagc

SEQ ID NO: 1247861 - DNA, 22 bp, Artificial Sequence
  chemically synthesized
agtagggggctgctacgtggct

SEQ ID NO: 1247862 - DNA, 22 bp, Artificial Sequence
  chemically synthesized
aggtctgagtagggggctgcta

SEQ ID NO: 1247863 - DNA, 22 bp, Artificial Sequence
  chemically synthesized
agctcaggtctgagtagggggc

SEQ ID NO: 1247864 - DNA, 22 bp, Artificial Sequence
  chemically synthesized
caaagctgagctcaggtctgag

SEQ ID NO: 1247865 - DNA, 22 bp, Artificial Sequence
  chemically synthesized
tacaaagctgagctcaggtctg

SEQ ID NO: 1247866 - DNA, 22 bp, Artificial Sequence
  chemically synthesized
ctcagacctgagctcagctttg

SEQ ID NO: 1247867 - DNA, 22 bp, Artificial Sequence
  chemically synthesized
aggaaggactctacaaagctga

SEQ ID NO: 1247868 - DNA, 22 bp, Artificial Sequence
  chemically synthesized
gaggaaggactctacaaagctg

SEQ ID NO: 1247869 - DNA, 22 bp, Artificial Sequence
  chemically synthesized
agacctgagctcagctttgtag

SEQ ID NO: 1247870 - DNA, 22 bp, Artificial Sequence
  chemically synthesized
agctcagctttgtagagtcctt

SEQ ID NO: 1247871 - DNA, 22 bp, Artificial Sequence
  chemically synthesized
gaacccttgaggaaggactcta

SEQ ID NO: 1247872 - DNA, 22 bp, Artificial Sequence
  chemically synthesized
agaacccttgaggaaggactct

SEQ ID NO: 1247873 - DNA, 22 bp, Artificial Sequence
  chemically synthesized
agctttgtagagtccttcctca

SEQ ID NO: 1247874 - DNA, 22 bp, Artificial Sequence
  chemically synthesized
acacttagaacccttgaggaag

SEQ ID NO: 1247875 - DNA, 22 bp, Artificial Sequence
  chemically synthesized
tgtagagtccttcctcaagggt

SEQ ID NO: 1247876 - DNA, 22 bp, Artificial Sequence
  chemically synthesized
ctaacacttagaacccttgagg

SEQ ID NO: 1247877 - DNA, 22 bp, Artificial Sequence
  chemically synthesized
gtagagtccttcctcaagggtt

SEQ ID NO: 1247878 - DNA, 22 bp, Artificial Sequence
  chemically synthesized
tagagtccttcctcaagggttc

SEQ ID NO: 1247879 - DNA, 22 bp, Artificial Sequence
  chemically synthesized
gaattactaacacttagaaccc

SEQ ID NO: 1247880 - DNA, 22 bp, Artificial Sequence
  chemically synthesized
cctcaagggttctaagtgttag

SEQ ID NO: 1247881 - DNA, 22 bp, Artificial Sequence
  chemically synthesized
ctcaagggttctaagtgttagt

SEQ ID NO: 1247882 - DNA, 22 bp, Artificial Sequence
  chemically synthesized
aagggttctaagtgttagtaat

SEQ ID NO: 1247883 - DNA, 22 bp, Artificial Sequence
  chemically synthesized
ggaagacaaaaggttagaatta

SEQ ID NO: 1247884 - DNA, 22 bp, Artificial Sequence
  chemically synthesized
taagtgttagtaattctaacct

SEQ ID NO: 1247885 - DNA, 22 bp, Artificial Sequence
  chemically synthesized
agtgttagtaattctaaccttt

SEQ ID NO: 1247886 - DNA, 22 bp, Artificial Sequence
  chemically synthesized
gggctgggaagacaaaaggtta

SEQ ID NO: 1247887 - DNA, 22 bp, Artificial Sequence
  chemically synthesized
ctagggctgggaagacaaaagg

SEQ ID NO: 1247888 - DNA, 22 bp, Artificial Sequence
  chemically synthesized
gtaattctaaccttttgtcttc

SEQ ID NO: 1247889 - DNA, 22 bp, Artificial Sequence
  chemically synthesized
ccgctcctagggctgggaagac

SEQ ID NO: 1247890 - DNA, 22 bp, Artificial Sequence
  chemically synthesized
taaccttttgtcttcccagccc

SEQ ID NO: 1247891 - DNA, 22 bp, Artificial Sequence
  chemically synthesized
accttttgtcttcccagcccta

SEQ ID NO: 1247892 - DNA, 22 bp, Artificial Sequence
  chemically synthesized
ttgtcttcccagccctaggagc

SEQ ID NO: 1247893 - DNA, 22 bp, Artificial Sequence
  chemically synthesized
tgtcttcccagccctaggagcg

SEQ ID NO: 1247894 - DNA, 22 bp, Artificial Sequence
  chemically synthesized
gtcttcccagccctaggagcgg

SEQ ID NO: 1247895 - DNA, 22 bp, Artificial Sequence
  chemically synthesized
tcttcccagccctaggagcggt

SEQ ID NO: 1247896 - DNA, 22 bp, Artificial Sequence
  chemically synthesized
cccagccctaggagcggtagct

SEQ ID NO: 1247897 - DNA, 22 bp, Artificial Sequence
  chemically synthesized
ccagccctaggagcggtagcta

SEQ ID NO: 1247898 - DNA, 22 bp, Artificial Sequence
  chemically synthesized
ggagcggtagctactttgtgca

SEQ ID NO: 1247899 - DNA, 22 bp, Artificial Sequence
  chemically synthesized
acaaagagaagaggtagcaagt

SEQ ID NO: 1247900 - DNA, 22 bp, Artificial Sequence
  chemically synthesized
ctttgtgcacttgctacctctt

SEQ ID NO: 1247901 - DNA, 22 bp, Artificial Sequence
  chemically synthesized
tgtgcacttgctacctcttctc

SEQ ID NO: 1247902 - DNA, 22 bp, Artificial Sequence
  chemically synthesized
gtgcacttgctacctcttctct

SEQ ID NO: 1247903 - DNA, 22 bp, Artificial Sequence
  chemically synthesized
aaaaattgacaaagagaagagg

SEQ ID NO: 1247904 - DNA, 22 bp, Artificial Sequence
  chemically synthesized
tgcacttgctacctcttctctt

SEQ ID NO: 1247905 - DNA, 22 bp, Artificial Sequence
  chemically synthesized
ggtattgaaaaattgacaaaga

SEQ ID NO: 1247906 - DNA, 22 bp, Artificial Sequence
  chemically synthesized
gctacctcttctctttgtcaat

SEQ ID NO: 1247907 - DNA, 22 bp, Artificial Sequence
  chemically synthesized
ctacctcttctctttgtcaatt

SEQ ID NO: 1247908 - DNA, 22 bp, Artificial Sequence
  chemically synthesized
cctcttctctttgtcaattttt

SEQ ID NO: 1247909 - DNA, 22 bp, Artificial Sequence
  chemically synthesized
ggatctaggtattgaaaaattg

SEQ ID NO: 1247910 - DNA, 22 bp, Artificial Sequence
  chemically synthesized
ttctctttgtcaatttttcaat

SEQ ID NO: 1247911 - DNA, 22 bp, Artificial Sequence
  chemically synthesized
ctctttgtcaatttttcaatac

SEQ ID NO: 1247912 - DNA, 22 bp, Artificial Sequence
  chemically synthesized
tctttgtcaatttttcaatacc

SEQ ID NO: 1247913 - DNA, 22 bp, Artificial Sequence
  chemically synthesized
tttgtcaatttttcaataccta

SEQ ID NO: 1247914 - DNA, 22 bp, Artificial Sequence
  chemically synthesized
tgtcaatttttcaatacctaga

SEQ ID NO: 1247915 - DNA, 22 bp, Artificial Sequence
  chemically synthesized
gtcaatttttcaatacctagat

SEQ ID NO: 1247916 - DNA, 22 bp, Artificial Sequence
  chemically synthesized
tcaatttttcaatacctagatc

SEQ ID NO: 1247917 - DNA, 22 bp, Artificial Sequence
  chemically synthesized
ttcaatacctagatcccaattc

SEQ ID NO: 1247918 - DNA, 22 bp, Artificial Sequence
  chemically synthesized
tcaatacctagatcccaattcc

SEQ ID NO: 1247919 - DNA, 22 bp, Artificial Sequence
  chemically synthesized
caatacctagatcccaattcct

SEQ ID NO: 1247920 - DNA, 22 bp, Artificial Sequence
  chemically synthesized
aatacctagatcccaattcctc

SEQ ID NO: 1247921 - DNA, 22 bp, Artificial Sequence
  chemically synthesized
gatcccaattcctcttgttaca

SEQ ID NO: 1247922 - DNA, 22 bp, Artificial Sequence
  chemically synthesized
tagcagaaaataatgtaacaag

SEQ ID NO: 1247923 - DNA, 22 bp, Artificial Sequence
  chemically synthesized
agtgactgtagcagaaaataat

SEQ ID NO: 1247924 - DNA, 22 bp, Artificial Sequence
  chemically synthesized
gagtgactgtagcagaaaataa

SEQ ID NO: 1247925 - DNA, 22 bp, Artificial Sequence
  chemically synthesized
ctcttgttacattattttctgc

SEQ ID NO: 1247926 - DNA, 22 bp, Artificial Sequence
  chemically synthesized
ttgttacattattttctgctac

SEQ ID NO: 1247927 - DNA, 22 bp, Artificial Sequence
  chemically synthesized
gttacattattttctgctacag

SEQ ID NO: 1247928 - DNA, 22 bp, Artificial Sequence
  chemically synthesized
ttacattattttctgctacagt

SEQ ID NO: 1247929 - DNA, 22 bp, Artificial Sequence
  chemically synthesized
cattattttctgctacagtcac

SEQ ID NO: 1247930 - DNA, 22 bp, Artificial Sequence
  chemically synthesized
ttttctgctacagtcactcaag

SEQ ID NO: 1247931 - DNA, 22 bp, Artificial Sequence
  chemically synthesized
acagacagaaaccacttgagtg

SEQ ID NO: 1247932 - DNA, 22 bp, Artificial Sequence
  chemically synthesized
tctgctacagtcactcaagtgg

SEQ ID NO: 1247933 - DNA, 22 bp, Artificial Sequence
  chemically synthesized
ctgctacagtcactcaagtggt

SEQ ID NO: 1247934 - DNA, 22 bp, Artificial Sequence
  chemically synthesized
tgctacagtcactcaagtggtt

SEQ ID NO: 1247935 - DNA, 22 bp, Artificial Sequence
  chemically synthesized
ctacagtcactcaagtggtttc

SEQ ID NO: 1247936 - DNA, 22 bp, Artificial Sequence
  chemically synthesized
cagtcactcaagtggtttctgt

SEQ ID NO: 1247937 - DNA, 22 bp, Artificial Sequence
  chemically synthesized
aagtggtttctgtctgttaact

SEQ ID NO: 1247938 - DNA, 22 bp, Artificial Sequence
  chemically synthesized
ctgtctgttaactgaccctggc

SEQ ID NO: 1247939 - DNA, 22 bp, Artificial Sequence
  chemically synthesized
tgtctgttaactgaccctggct

SEQ ID NO: 1247940 - DNA, 22 bp, Artificial Sequence
  chemically synthesized
ggatgatgtgtcagccagggtc

SEQ ID NO: 1247941 - DNA, 22 bp, Artificial Sequence
  chemically synthesized
gggatgatgtgtcagccagggt

SEQ ID NO: 1247942 - DNA, 22 bp, Artificial Sequence
  chemically synthesized
tctgttaactgaccctggctga

SEQ ID NO: 1247943 - DNA, 22 bp, Artificial Sequence
  chemically synthesized
ttaactgaccctggctgacaca

SEQ ID NO: 1247944 - DNA, 22 bp, Artificial Sequence
  chemically synthesized
ggtttgggatgatgtgtcagcc

SEQ ID NO: 1247945 - DNA, 22 bp, Artificial Sequence
  chemically synthesized
gggtttgggatgatgtgtcagc

SEQ ID NO: 1247946 - DNA, 22 bp, Artificial Sequence
  chemically synthesized
tgggtttgggatgatgtgtcag

SEQ ID NO: 1247947 - DNA, 22 bp, Artificial Sequence
  chemically synthesized
actgaccctggctgacacatca

SEQ ID NO: 1247948 - DNA, 22 bp, Artificial Sequence
  chemically synthesized
accctggctgacacatcatccc

SEQ ID NO: 1247949 - DNA, 22 bp, Artificial Sequence
  chemically synthesized
gctgacacatcatcccaaaccc

SEQ ID NO: 1247950 - DNA, 22 bp, Artificial Sequence
  chemically synthesized
atagtgacaagttttgggtttg

SEQ ID NO: 1247951 - DNA, 22 bp, Artificial Sequence
  chemically synthesized
acacatcatcccaaacccaaaa

SEQ ID NO: 1247952 - DNA, 22 bp, Artificial Sequence
  chemically synthesized
gatagtgacaagttttgggttt

SEQ ID NO: 1247953 - DNA, 22 bp, Artificial Sequence
  chemically synthesized
tgatagtgacaagttttgggtt

SEQ ID NO: 1247954 - DNA, 22 bp, Artificial Sequence
  chemically synthesized
cattttgatagtgacaagtttt

SEQ ID NO: 1247955 - DNA, 22 bp, Artificial Sequence
  chemically synthesized
ccattttgatagtgacaagttt

SEQ ID NO: 1247956 - DNA, 22 bp, Artificial Sequence
  chemically synthesized
atgtatttccattttgatagtg

SEQ ID NO: 1247957 - DNA, 22 bp, Artificial Sequence
  chemically synthesized
aatgtatttccattttgatagt

SEQ ID NO: 1247958 - DNA, 22 bp, Artificial Sequence
  chemically synthesized
gtcactatcaaaatggaaatac

SEQ ID NO: 1247959 - DNA, 22 bp, Artificial Sequence
  chemically synthesized
tcactatcaaaatggaaataca

SEQ ID NO: 1247960 - DNA, 22 bp, Artificial Sequence
  chemically synthesized
tcaaaatggaaatacattaagt

SEQ ID NO: 1247961 - DNA, 22 bp, Artificial Sequence
  chemically synthesized
aacacagacccaacacttaatg

SEQ ID NO: 1247962 - DNA, 22 bp, Artificial Sequence
  chemically synthesized
cccattaaacacagacccaaca

SEQ ID NO: 1247963 - DNA, 22 bp, Artificial Sequence
  chemically synthesized
acccattaaacacagacccaac

SEQ ID NO: 1247964 - DNA, 22 bp, Artificial Sequence
  chemically synthesized
agtgttgggtctgtgtttaatg

SEQ ID NO: 1247965 - DNA, 22 bp, Artificial Sequence
  chemically synthesized
ggtctgtgtttaatgggtaagg

SEQ ID NO: 1247966 - DNA, 22 bp, Artificial Sequence
  chemically synthesized
gaagaatgagaaatcatcctta

SEQ ID NO: 1247967 - DNA, 22 bp, Artificial Sequence
  chemically synthesized
tgtttaatgggtaaggatgatt

SEQ ID NO: 1247968 - DNA, 22 bp, Artificial Sequence
  chemically synthesized
ggaagaatgagaaatcatcctt

SEQ ID NO: 1247969 - DNA, 22 bp, Artificial Sequence
  chemically synthesized
tggaagaatgagaaatcatcct

SEQ ID NO: 1247970 - DNA, 22 bp, Artificial Sequence
  chemically synthesized
aatgggtaaggatgatttctca

SEQ ID NO: 1247971 - DNA, 22 bp, Artificial Sequence
  chemically synthesized
atgggtaaggatgatttctcat

SEQ ID NO: 1247972 - DNA, 22 bp, Artificial Sequence
  chemically synthesized
ctcattcttccaaagaccacat

SEQ ID NO: 1247973 - DNA, 22 bp, Artificial Sequence
  chemically synthesized
tcattcttccaaagaccacata

SEQ ID NO: 1247974 - DNA, 22 bp, Artificial Sequence
  chemically synthesized
attcttccaaagaccacatatt

SEQ ID NO: 1247975 - DNA, 22 bp, Artificial Sequence
  chemically synthesized
ttccaaagaccacatattatat

SEQ ID NO: 1247976 - DNA, 22 bp, Artificial Sequence
  chemically synthesized
ccaaagaccacatattatattc

SEQ ID NO: 1247977 - DNA, 22 bp, Artificial Sequence
  chemically synthesized
caaagaccacatattatattcc

SEQ ID NO: 1247978 - DNA, 22 bp, Artificial Sequence
  chemically synthesized
taaaagtagtagaaaacaatag

SEQ ID NO: 1247979 - DNA, 22 bp, Artificial Sequence
  chemically synthesized
ataaaagtagtagaaaacaata

SEQ ID NO: 1247980 - DNA, 22 bp, Artificial Sequence
  chemically synthesized
tataaaagtagtagaaaacaat

SEQ ID NO: 1247981 - DNA, 22 bp, Artificial Sequence
  chemically synthesized
tattccactattgttttctact

SEQ ID NO: 1247982 - DNA, 22 bp, Artificial Sequence
  chemically synthesized
ttttataaaagtagtagaaaac

SEQ ID NO: 1247983 - DNA, 22 bp, Artificial Sequence
  chemically synthesized
cactattgttttctactacttt

SEQ ID NO: 1247984 - DNA, 22 bp, Artificial Sequence
  chemically synthesized
gtcattattttataaaagtagt

SEQ ID NO: 1247985 - DNA, 22 bp, Artificial Sequence
  chemically synthesized
agtcattattttataaaagtag

SEQ ID NO: 1247986 - DNA, 22 bp, Artificial Sequence
  chemically synthesized
ttgttttctactacttttataa

SEQ ID NO: 1247987 - DNA, 22 bp, Artificial Sequence
  chemically synthesized
ttttctactacttttataaaat

SEQ ID NO: 1247988 - DNA, 22 bp, Artificial Sequence
  chemically synthesized
tatttagtcattattttataaa

SEQ ID NO: 1247989 - DNA, 22 bp, Artificial Sequence
  chemically synthesized
tctactacttttataaaataat

SEQ ID NO: 1247990 - DNA, 22 bp, Artificial Sequence
  chemically synthesized
ctactacttttataaaataatg

SEQ ID NO: 1247991 - DNA, 22 bp, Artificial Sequence
  chemically synthesized
tactacttttataaaataatga

SEQ ID NO: 1247992 - DNA, 22 bp, Artificial Sequence
  chemically synthesized
ctacttttataaaataatgact

SEQ ID NO: 1247993 - DNA, 22 bp, Artificial Sequence
  chemically synthesized
cttttataaaataatgactaaa

SEQ ID NO: 1247994 - DNA, 22 bp, Artificial Sequence
  chemically synthesized
aagtatatctatatttagtcat

SEQ ID NO: 1247995 - DNA, 22 bp, Artificial Sequence
  chemically synthesized
ttataaaataatgactaaatat

SEQ ID NO: 1247996 - DNA, 22 bp, Artificial Sequence
  chemically synthesized
tataaaataatgactaaatata

SEQ ID NO: 1247997 - DNA, 22 bp, Artificial Sequence
  chemically synthesized
ataaaataatgactaaatatag

SEQ ID NO: 1247998 - DNA, 22 bp, Artificial Sequence
  chemically synthesized
taaaataatgactaaatataga

SEQ ID NO: 1247999 - DNA, 22 bp, Artificial Sequence
  chemically synthesized
tactgaagtatatctatattta

SEQ ID NO: 1248000 - DNA, 22 bp, Artificial Sequence
  chemically synthesized
gtactgaagtatatctatattt

SEQ ID NO: 1248001 - DNA, 22 bp, Artificial Sequence
  chemically synthesized
aatatagatatacttcagtaca

SEQ ID NO: 1248002 - DNA, 22 bp, Artificial Sequence
  chemically synthesized
tccagaagatcaaatatccttg

SEQ ID NO: 1248003 - DNA, 22 bp, Artificial Sequence
  chemically synthesized
cagtacaaggatatttgatctt

SEQ ID NO: 1248004 - DNA, 22 bp, Artificial Sequence
  chemically synthesized
agtacaaggatatttgatcttc

SEQ ID NO: 1248005 - DNA, 22 bp, Artificial Sequence
  chemically synthesized
gatcttctggacagccgtatcc

SEQ ID NO: 1248006 - DNA, 22 bp, Artificial Sequence
  chemically synthesized
atcttctggacagccgtatcca

SEQ ID NO: 1248007 - DNA, 22 bp, Artificial Sequence
  chemically synthesized
ctggacagccgtatccatatgt

SEQ ID NO: 1248008 - DNA, 22 bp, Artificial Sequence
  chemically synthesized
cagaaagaatgcacatatggat

SEQ ID NO: 1248009 - DNA, 22 bp, Artificial Sequence
  chemically synthesized
tggacagccgtatccatatgtg

SEQ ID NO: 1248010 - DNA, 22 bp, Artificial Sequence
  chemically synthesized
gacagccgtatccatatgtgca

SEQ ID NO: 1248011 - DNA, 22 bp, Artificial Sequence
  chemically synthesized
catctacagaaagaatgcacat

SEQ ID NO: 1248012 - DNA, 22 bp, Artificial Sequence
  chemically synthesized
agttccatctacagaaagaatg

SEQ ID NO: 1248013 - DNA, 22 bp, Artificial Sequence
  chemically synthesized
atacaactgagttccatctaca

SEQ ID NO: 1248014 - DNA, 22 bp, Artificial Sequence
  chemically synthesized
taatacaactgagttccatcta

SEQ ID NO: 1248015 - DNA, 22 bp, Artificial Sequence
  chemically synthesized
actctaatacaactgagttcca

SEQ ID NO: 1248016 - DNA, 22 bp, Artificial Sequence
  chemically synthesized
gactctaatacaactgagttcc

SEQ ID NO: 1248017 - DNA, 22 bp, Artificial Sequence
  chemically synthesized
tttctgtagatggaactcagtt

SEQ ID NO: 1248018 - DNA, 22 bp, Artificial Sequence
  chemically synthesized
tgactctaatacaactgagttc

SEQ ID NO: 1248019 - DNA, 22 bp, Artificial Sequence
  chemically synthesized
ttgactctaatacaactgagtt

SEQ ID NO: 1248020 - DNA, 22 bp, Artificial Sequence
  chemically synthesized
tctgtagatggaactcagttgt

SEQ ID NO: 1248021 - DNA, 22 bp, Artificial Sequence
  chemically synthesized
ctgtagatggaactcagttgta

SEQ ID NO: 1248022 - DNA, 22 bp, Artificial Sequence
  chemically synthesized
tgtagatggaactcagttgtat

SEQ ID NO: 1248023 - DNA, 22 bp, Artificial Sequence
  chemically synthesized
tagatggaactcagttgtatta

SEQ ID NO: 1248024 - DNA, 22 bp, Artificial Sequence
  chemically synthesized
aaaaagtttttgactctaatac

SEQ ID NO: 1248025 - DNA, 22 bp, Artificial Sequence
  chemically synthesized
aaaaaagtttttgactctaata

SEQ ID NO: 1248026 - DNA, 22 bp, Artificial Sequence
  chemically synthesized
taaaaaagtttttgactctaat

SEQ ID NO: 1248027 - DNA, 22 bp, Artificial Sequence
  chemically synthesized
ttaaaaaagtttttgactctaa

SEQ ID NO: 1248028 - DNA, 22 bp, Artificial Sequence
  chemically synthesized
agttgtattagagtcaaaaact

SEQ ID NO: 1248029 - DNA, 22 bp, Artificial Sequence
  chemically synthesized
gaatttttaaaaaagtttttga

SEQ ID NO: 1248030 - DNA, 22 bp, Artificial Sequence
  chemically synthesized
tattagagtcaaaaactttttt

SEQ ID NO: 1248031 - DNA, 22 bp, Artificial Sequence
  chemically synthesized
gagtcaaaaacttttttaaaaa

SEQ ID NO: 1248032 - DNA, 22 bp, Artificial Sequence
  chemically synthesized
tccatggttagaatttttaaaa

SEQ ID NO: 1248033 - DNA, 22 bp, Artificial Sequence
  chemically synthesized
aactgtccatggttagaatttt

SEQ ID NO: 1248034 - DNA, 22 bp, Artificial Sequence
  chemically synthesized
attcaactgtccatggttagaa

SEQ ID NO: 1248035 - DNA, 22 bp, Artificial Sequence
  chemically synthesized
gattcaactgtccatggttaga

SEQ ID NO: 1248036 - DNA, 22 bp, Artificial Sequence
  chemically synthesized
ttttaaaaattctaaccatgga

SEQ ID NO: 1248037 - DNA, 22 bp, Artificial Sequence
  chemically synthesized
tttaaaaattctaaccatggac

SEQ ID NO: 1248038 - DNA, 22 bp, Artificial Sequence
  chemically synthesized
ttaaaaattctaaccatggaca

SEQ ID NO: 1248039 - DNA, 22 bp, Artificial Sequence
  chemically synthesized
taaaaattctaaccatggacag

SEQ ID NO: 1248040 - DNA, 22 bp, Artificial Sequence
  chemically synthesized
gatttgattcaactgtccatgg

SEQ ID NO: 1248041 - DNA, 22 bp, Artificial Sequence
  chemically synthesized
aaaaattctaaccatggacagt

SEQ ID NO: 1248042 - DNA, 22 bp, Artificial Sequence
  chemically synthesized
aaaattctaaccatggacagtt

SEQ ID NO: 1248043 - DNA, 22 bp, Artificial Sequence
  chemically synthesized
cagggctagatttgattcaact

SEQ ID NO: 1248044 - DNA, 22 bp, Artificial Sequence
  chemically synthesized
taaccatggacagttgaatcaa

SEQ ID NO: 1248045 - DNA, 22 bp, Artificial Sequence
  chemically synthesized
accatggacagttgaatcaaat

SEQ ID NO: 1248046 - DNA, 22 bp, Artificial Sequence
  chemically synthesized
aaaaataactacagggctagat

SEQ ID NO: 1248047 - DNA, 22 bp, Artificial Sequence
  chemically synthesized
gaaaaataactacagggctaga

SEQ ID NO: 1248048 - DNA, 22 bp, Artificial Sequence
  chemically synthesized
tgaaaaataactacagggctag

SEQ ID NO: 1248049 - DNA, 22 bp, Artificial Sequence
  chemically synthesized
aatcaaatctagccctgtagtt

SEQ ID NO: 1248050 - DNA, 22 bp, Artificial Sequence
  chemically synthesized
actttgaaaaataactacaggg

SEQ ID NO: 1248051 - DNA, 22 bp, Artificial Sequence
  chemically synthesized
atgttgactttgaaaaataact

SEQ ID NO: 1248052 - DNA, 22 bp, Artificial Sequence
  chemically synthesized
ttcatgttgactttgaaaaata

SEQ ID NO: 1248053 - DNA, 22 bp, Artificial Sequence
  chemically synthesized
gccctgtagttatttttcaaag

SEQ ID NO: 1248054 - DNA, 22 bp, Artificial Sequence
  chemically synthesized
ctattcatgttgactttgaaaa

SEQ ID NO: 1248055 - DNA, 22 bp, Artificial Sequence
  chemically synthesized
actattcatgttgactttgaaa

SEQ ID NO: 1248056 - DNA, 22 bp, Artificial Sequence
  chemically synthesized
tactattcatgttgactttgaa

SEQ ID NO: 1248057 - DNA, 22 bp, Artificial Sequence
  chemically synthesized
ttactattcatgttgactttga

SEQ ID NO: 1248058 - DNA, 22 bp, Artificial Sequence
  chemically synthesized
tttactattcatgttgactttg

SEQ ID NO: 1248059 - DNA, 22 bp, Artificial Sequence
  chemically synthesized
tagttatttttcaaagtcaaca

SEQ ID NO: 1248060 - DNA, 22 bp, Artificial Sequence
  chemically synthesized
ttttttactattcatgttgact

SEQ ID NO: 1248061 - DNA, 22 bp, Artificial Sequence
  chemically synthesized
attttttactattcatgttgac

SEQ ID NO: 1248062 - DNA, 22 bp, Artificial Sequence
  chemically synthesized
tattttttactattcatgttga

SEQ ID NO: 1248063 - DNA, 22 bp, Artificial Sequence
  chemically synthesized
tttttcaaagtcaacatgaata

SEQ ID NO: 1248064 - DNA, 22 bp, Artificial Sequence
  chemically synthesized
ttcaaagtcaacatgaatagta

SEQ ID NO: 1248065 - DNA, 22 bp, Artificial Sequence
  chemically synthesized
tcaaagtcaacatgaatagtaa

SEQ ID NO: 1248066 - DNA, 22 bp, Artificial Sequence
  chemically synthesized
caaagtcaacatgaatagtaaa

SEQ ID NO: 1248067 - DNA, 22 bp, Artificial Sequence
  chemically synthesized
aaagtcaacatgaatagtaaaa

SEQ ID NO: 1248068 - DNA, 22 bp, Artificial Sequence
  chemically synthesized
acaatattttattttttactat

SEQ ID NO: 1248069 - DNA, 22 bp, Artificial Sequence
  chemically synthesized
gacaatattttattttttacta

SEQ ID NO: 1248070 - DNA, 22 bp, Artificial Sequence
  chemically synthesized
tgacaatattttattttttact

SEQ ID NO: 1248071 - DNA, 22 bp, Artificial Sequence
  chemically synthesized
ttgacaatattttattttttac

SEQ ID NO: 1248072 - DNA, 22 bp, Artificial Sequence
  chemically synthesized
caggtggatttttgacaatatt

SEQ ID NO: 1248073 - DNA, 22 bp, Artificial Sequence
  chemically synthesized
ccaggtggatttttgacaatat

SEQ ID NO: 1248074 - DNA, 22 bp, Artificial Sequence
  chemically synthesized
tccaggtggatttttgacaata

SEQ ID NO: 1248075 - DNA, 22 bp, Artificial Sequence
  chemically synthesized
tcaaaaatccacctggaaaatt

SEQ ID NO: 1248076 - DNA, 22 bp, Artificial Sequence
  chemically synthesized
tgtgtatagtatggatggtata

SEQ ID NO: 1248077 - DNA, 22 bp, Artificial Sequence
  chemically synthesized
gaaaattgctataccatccata

SEQ ID NO: 1248078 - DNA, 22 bp, Artificial Sequence
  chemically synthesized
atccatattatgtgtatagtat

SEQ ID NO: 1248079 - DNA, 22 bp, Artificial Sequence
  chemically synthesized
ctataccatccatactatacac

SEQ ID NO: 1248080 - DNA, 22 bp, Artificial Sequence
  chemically synthesized
taccatccatactatacacata

SEQ ID NO: 1248081 - DNA, 22 bp, Artificial Sequence
  chemically synthesized
aaatctaatccatattatgtgt

SEQ ID NO: 1248082 - DNA, 22 bp, Artificial Sequence
  chemically synthesized
aaaatctaatccatattatgtg

SEQ ID NO: 1248083 - DNA, 22 bp, Artificial Sequence
  chemically synthesized
tacacataatatggattagatt

SEQ ID NO: 1248084 - DNA, 22 bp, Artificial Sequence
  chemically synthesized
cgcagtatttaaaatctaatcc

SEQ ID NO: 1248085 - DNA, 22 bp, Artificial Sequence
  chemically synthesized
gattttaaatactgcgtagtca

SEQ ID NO: 1248086 - DNA, 22 bp, Artificial Sequence
  chemically synthesized
gtgtgcaggaggtgactacgca

SEQ ID NO: 1248087 - DNA, 22 bp, Artificial Sequence
  chemically synthesized
ggtgtgcaggaggtgactacgc

SEQ ID NO: 1248088 - DNA, 22 bp, Artificial Sequence
  chemically synthesized
tggtgtgcaggaggtgactacg

SEQ ID NO: 1248089 - DNA, 22 bp, Artificial Sequence
  chemically synthesized
taaatactgcgtagtcacctcc

SEQ ID NO: 1248090 - DNA, 22 bp, Artificial Sequence
  chemically synthesized
aaatactgcgtagtcacctcct

SEQ ID NO: 1248091 - DNA, 22 bp, Artificial Sequence
  chemically synthesized
aatactgcgtagtcacctcctg

SEQ ID NO: 1248092 - DNA, 22 bp, Artificial Sequence
  chemically synthesized
aactttggtgtgcaggaggtga

SEQ ID NO: 1248093 - DNA, 22 bp, Artificial Sequence
  chemically synthesized
ctaaactttggtgtgcaggagg

SEQ ID NO: 1248094 - DNA, 22 bp, Artificial Sequence
  chemically synthesized
cctaaactttggtgtgcaggag

SEQ ID NO: 1248095 - DNA, 22 bp, Artificial Sequence
  chemically synthesized
cgtagtcacctcctgcacacca

SEQ ID NO: 1248096 - DNA, 22 bp, Artificial Sequence
  chemically synthesized
aatgtcttcctaaactttggtg

SEQ ID NO: 1248097 - DNA, 22 bp, Artificial Sequence
  chemically synthesized
gctcaatgtcttcctaaacttt

SEQ ID NO: 1248098 - DNA, 22 bp, Artificial Sequence
  chemically synthesized
agctcaatgtcttcctaaactt

SEQ ID NO: 1248099 - DNA, 22 bp, Artificial Sequence
  chemically synthesized
ctgcacaccaaagtttaggaag

SEQ ID NO: 1248100 - DNA, 22 bp, Artificial Sequence
  chemically synthesized
cacaccaaagtttaggaagaca

SEQ ID NO: 1248101 - DNA, 22 bp, Artificial Sequence
  chemically synthesized
agtttagctcaatgtcttccta

SEQ ID NO: 1248102 - DNA, 22 bp, Artificial Sequence
  chemically synthesized
gagtttagctcaatgtcttcct

SEQ ID NO: 1248103 - DNA, 22 bp, Artificial Sequence
  chemically synthesized
tgagtttagctcaatgtcttcc

SEQ ID NO: 1248104 - DNA, 22 bp, Artificial Sequence
  chemically synthesized
tttgagtttagctcaatgtctt

SEQ ID NO: 1248105 - DNA, 22 bp, Artificial Sequence
  chemically synthesized
ctctttgagtttagctcaatgt

SEQ ID NO: 1248106 - DNA, 22 bp, Artificial Sequence
  chemically synthesized
gctctttgagtttagctcaatg

SEQ ID NO: 1248107 - DNA, 22 bp, Artificial Sequence
  chemically synthesized
tgctctttgagtttagctcaat

SEQ ID NO: 1248108 - DNA, 22 bp, Artificial Sequence
  chemically synthesized
ttgctctttgagtttagctcaa

SEQ ID NO: 1248109 - DNA, 22 bp, Artificial Sequence
  chemically synthesized
tttgctctttgagtttagctca

SEQ ID NO: 1248110 - DNA, 22 bp, Artificial Sequence
  chemically synthesized
aggaagacattgagctaaactc

SEQ ID NO: 1248111 - DNA, 22 bp, Artificial Sequence
  chemically synthesized
ggaagacattgagctaaactca

SEQ ID NO: 1248112 - DNA, 22 bp, Artificial Sequence
  chemically synthesized
gctttttgctctttgagtttag

SEQ ID NO: 1248113 - DNA, 22 bp, Artificial Sequence
  chemically synthesized
tggctttttgctctttgagttt

SEQ ID NO: 1248114 - DNA, 22 bp, Artificial Sequence
  chemically synthesized
agctaaactcaaagagcaaaaa

SEQ ID NO: 1248115 - DNA, 22 bp, Artificial Sequence
  chemically synthesized
catacactctggctttttgctc

SEQ ID NO: 1248116 - DNA, 22 bp, Artificial Sequence
  chemically synthesized
aactcaaagagcaaaaagccag

SEQ ID NO: 1248117 - DNA, 22 bp, Artificial Sequence
  chemically synthesized
aaagagcaaaaagccagagtgt

SEQ ID NO: 1248118 - DNA, 22 bp, Artificial Sequence
  chemically synthesized
agaaagctgcatacactctggc

SEQ ID NO: 1248119 - DNA, 22 bp, Artificial Sequence
  chemically synthesized
catgttaagaaagctgcataca

SEQ ID NO: 1248120 - DNA, 22 bp, Artificial Sequence
  chemically synthesized
gaggcaggaagaattgcatgtt

SEQ ID NO: 1248121 - DNA, 22 bp, Artificial Sequence
  chemically synthesized
agaggcaggaagaattgcatgt

SEQ ID NO: 1248122 - DNA, 22 bp, Artificial Sequence
  chemically synthesized
ccttagaggcaggaagaattgc

SEQ ID NO: 1248123 - DNA, 22 bp, Artificial Sequence
  chemically synthesized
accttagaggcaggaagaattg

SEQ ID NO: 1248124 - DNA, 22 bp, Artificial Sequence
  chemically synthesized
tcttaacatgcaattcttcctg

SEQ ID NO: 1248125 - DNA, 22 bp, Artificial Sequence
  chemically synthesized
cttaacatgcaattcttcctgc

SEQ ID NO: 1248126 - DNA, 22 bp, Artificial Sequence
  chemically synthesized
ttaacatgcaattcttcctgcc

SEQ ID NO: 1248127 - DNA, 22 bp, Artificial Sequence
  chemically synthesized
aacatgcaattcttcctgcctc

SEQ ID NO: 1248128 - DNA, 22 bp, Artificial Sequence
  chemically synthesized
gggcttaccttagaggcaggaa

SEQ ID NO: 1248129 - DNA, 22 bp, Artificial Sequence
  chemically synthesized
acatgcaattcttcctgcctct

SEQ ID NO: 1248130 - DNA, 22 bp, Artificial Sequence
  chemically synthesized
ttcctgcctctaaggtaagccc

SEQ ID NO: 1248131 - DNA, 22 bp, Artificial Sequence
  chemically synthesized
cctgcctctaaggtaagcccta

SEQ ID NO: 1248132 - DNA, 22 bp, Artificial Sequence
  chemically synthesized
ctgcctctaaggtaagccctag

SEQ ID NO: 1248133 - DNA, 22 bp, Artificial Sequence
  chemically synthesized
cctctaaggtaagccctagatt

SEQ ID NO: 1248134 - DNA, 22 bp, Artificial Sequence
  chemically synthesized
caggtaaagaaaacaatctagg

SEQ ID NO: 1248135 - DNA, 22 bp, Artificial Sequence
  chemically synthesized
taaggtaagccctagattgttt

SEQ ID NO: 1248136 - DNA, 22 bp, Artificial Sequence
  chemically synthesized
aggtaagccctagattgttttc

SEQ ID NO: 1248137 - DNA, 22 bp, Artificial Sequence
  chemically synthesized
cagaaagccctgcaggtaaaga

SEQ ID NO: 1248138 - DNA, 22 bp, Artificial Sequence
  chemically synthesized
gattgttttctttacctgcagg

SEQ ID NO: 1248139 - DNA, 22 bp, Artificial Sequence
  chemically synthesized
ttttctttacctgcagggcttt

SEQ ID NO: 1248140 - DNA, 22 bp, Artificial Sequence
  chemically synthesized
agacatactgcagaaagccctg

SEQ ID NO: 1248141 - DNA, 22 bp, Artificial Sequence
  chemically synthesized
tctttacctgcagggctttctg

SEQ ID NO: 1248142 - DNA, 22 bp, Artificial Sequence
  chemically synthesized
ctttacctgcagggctttctgc

SEQ ID NO: 1248143 - DNA, 22 bp, Artificial Sequence
  chemically synthesized
ttaagacatactgcagaaagcc

SEQ ID NO: 1248144 - DNA, 22 bp, Artificial Sequence
  chemically synthesized
tttacctgcagggctttctgca

SEQ ID NO: 1248145 - DNA, 22 bp, Artificial Sequence
  chemically synthesized
tacctgcagggctttctgcagt

SEQ ID NO: 1248146 - DNA, 22 bp, Artificial Sequence
  chemically synthesized
ctattaagacatactgcagaaa

SEQ ID NO: 1248147 - DNA, 22 bp, Artificial Sequence
  chemically synthesized
acctgcagggctttctgcagta

SEQ ID NO: 1248148 - DNA, 22 bp, Artificial Sequence
  chemically synthesized
actattaagacatactgcagaa

SEQ ID NO: 1248149 - DNA, 22 bp, Artificial Sequence
  chemically synthesized
cctgcagggctttctgcagtat

SEQ ID NO: 1248150 - DNA, 22 bp, Artificial Sequence
  chemically synthesized
tactattaagacatactgcaga

SEQ ID NO: 1248151 - DNA, 22 bp, Artificial Sequence
  chemically synthesized
cagggctttctgcagtatgtct

SEQ ID NO: 1248152 - DNA, 22 bp, Artificial Sequence
  chemically synthesized
tctttactattaagacatactg

SEQ ID NO: 1248153 - DNA, 22 bp, Artificial Sequence
  chemically synthesized
gattatctttactattaagaca

SEQ ID NO: 1248154 - DNA, 22 bp, Artificial Sequence
  chemically synthesized
tctgcagtatgtcttaatagta

SEQ ID NO: 1248155 - DNA, 22 bp, Artificial Sequence
  chemically synthesized
ctgcagtatgtcttaatagtaa

SEQ ID NO: 1248156 - DNA, 22 bp, Artificial Sequence
  chemically synthesized
tgcagtatgtcttaatagtaaa

SEQ ID NO: 1248157 - DNA, 22 bp, Artificial Sequence
  chemically synthesized
tgctggattatctttactatta

SEQ ID NO: 1248158 - DNA, 22 bp, Artificial Sequence
  chemically synthesized
cagtatgtcttaatagtaaaga

SEQ ID NO: 1248159 - DNA, 22 bp, Artificial Sequence
  chemically synthesized
caaatgctgtgctggattatct

SEQ ID NO: 1248160 - DNA, 22 bp, Artificial Sequence
  chemically synthesized
aatagtaaagataatccagcac

SEQ ID NO: 1248161 - DNA, 22 bp, Artificial Sequence
  chemically synthesized
atagtaaagataatccagcaca

SEQ ID NO: 1248162 - DNA, 22 bp, Artificial Sequence
  chemically synthesized
atcacaagcatattacaaatgc

SEQ ID NO: 1248163 - DNA, 22 bp, Artificial Sequence
  chemically synthesized
gatcacaagcatattacaaatg

SEQ ID NO: 1248164 - DNA, 22 bp, Artificial Sequence
  chemically synthesized
ttgatcacaagcatattacaaa

SEQ ID NO: 1248165 - DNA, 22 bp, Artificial Sequence
  chemically synthesized
catccattcttgatcacaagca

SEQ ID NO: 1248166 - DNA, 22 bp, Artificial Sequence
  chemically synthesized
ccatccattcttgatcacaagc

SEQ ID NO: 1248167 - DNA, 22 bp, Artificial Sequence
  chemically synthesized
tttccatccattcttgatcaca

SEQ ID NO: 1248168 - DNA, 22 bp, Artificial Sequence
  chemically synthesized
gtaatatgcttgtgatcaagaa

SEQ ID NO: 1248169 - DNA, 22 bp, Artificial Sequence
  chemically synthesized
taatatgcttgtgatcaagaat

SEQ ID NO: 1248170 - DNA, 22 bp, Artificial Sequence
  chemically synthesized
taccatcctgtttccatccatt

SEQ ID NO: 1248171 - DNA, 22 bp, Artificial Sequence
  chemically synthesized
gtgatcaagaatggatggaaac

SEQ ID NO: 1248172 - DNA, 22 bp, Artificial Sequence
  chemically synthesized
tgatcaagaatggatggaaaca

SEQ ID NO: 1248173 - DNA, 22 bp, Artificial Sequence
  chemically synthesized
ggactataccatcctgtttcca

SEQ ID NO: 1248174 - DNA, 22 bp, Artificial Sequence
  chemically synthesized
agttaggactataccatcctgt

SEQ ID NO: 1248175 - DNA, 22 bp, Artificial Sequence
  chemically synthesized
aagttaggactataccatcctg

SEQ ID NO: 1248176 - DNA, 22 bp, Artificial Sequence
  chemically synthesized
catgcttaagttaggactatac

SEQ ID NO: 1248177 - DNA, 22 bp, Artificial Sequence
  chemically synthesized
acatgcttaagttaggactata

SEQ ID NO: 1248178 - DNA, 22 bp, Artificial Sequence
  chemically synthesized
atttacatgcttaagttaggac

SEQ ID NO: 1248179 - DNA, 22 bp, Artificial Sequence
  chemically synthesized
tgagatgcaattaatttacatg

SEQ ID NO: 1248180 - DNA, 22 bp, Artificial Sequence
  chemically synthesized
acttaagcatgtaaattaattg

SEQ ID NO: 1248181 - DNA, 22 bp, Artificial Sequence
  chemically synthesized
acattatgagatgcaattaatt

SEQ ID NO: 1248182 - DNA, 22 bp, Artificial Sequence
  chemically synthesized
aagcatgtaaattaattgcatc

SEQ ID NO: 1248183 - DNA, 22 bp, Artificial Sequence
  chemically synthesized
agcatgtaaattaattgcatct

SEQ ID NO: 1248184 - DNA, 22 bp, Artificial Sequence
  chemically synthesized
gctgacattatgagatgcaatt

SEQ ID NO: 1248185 - DNA, 22 bp, Artificial Sequence
  chemically synthesized
attgcatctcataatgtcagcc

SEQ ID NO: 1248186 - DNA, 22 bp, Artificial Sequence
  chemically synthesized
agagtgtggattggctgacatt

SEQ ID NO: 1248187 - DNA, 22 bp, Artificial Sequence
  chemically synthesized
catctcataatgtcagccaatc

SEQ ID NO: 1248188 - DNA, 22 bp, Artificial Sequence
  chemically synthesized
tatgactaagagtgtggattgg

SEQ ID NO: 1248189 - DNA, 22 bp, Artificial Sequence
  chemically synthesized
ataatgtcagccaatccacact

SEQ ID NO: 1248190 - DNA, 22 bp, Artificial Sequence
  chemically synthesized
atctgtatgactaagagtgtgg

SEQ ID NO: 1248191 - DNA, 22 bp, Artificial Sequence
  chemically synthesized
aatctgtatgactaagagtgtg

SEQ ID NO: 1248192 - DNA, 22 bp, Artificial Sequence
  chemically synthesized
taatctgtatgactaagagtgt

SEQ ID NO: 1248193 - DNA, 22 bp, Artificial Sequence
  chemically synthesized
tttaatctgtatgactaagagt

SEQ ID NO: 1248194 - DNA, 22 bp, Artificial Sequence
  chemically synthesized
gttctttaatctgtatgactaa

SEQ ID NO: 1248195 - DNA, 22 bp, Artificial Sequence
  chemically synthesized
ggttctttaatctgtatgacta

SEQ ID NO: 1248196 - DNA, 22 bp, Artificial Sequence
  chemically synthesized
tggttctttaatctgtatgact

SEQ ID NO: 1248197 - DNA, 22 bp, Artificial Sequence
  chemically synthesized
ttggttctttaatctgtatgac

SEQ ID NO: 1248198 - DNA, 22 bp, Artificial Sequence
  chemically synthesized
cttttggttctttaatctgtat

SEQ ID NO: 1248199 - DNA, 22 bp, Artificial Sequence
  chemically synthesized
ggttccttttggttctttaatc

SEQ ID NO: 1248200 - DNA, 22 bp, Artificial Sequence
  chemically synthesized
ttagtcatacagattaaagaac

SEQ ID NO: 1248201 - DNA, 22 bp, Artificial Sequence
  chemically synthesized
gggttccttttggttctttaat

SEQ ID NO: 1248202 - DNA, 22 bp, Artificial Sequence
  chemically synthesized
agtcatacagattaaagaacca

SEQ ID NO: 1248203 - DNA, 22 bp, Artificial Sequence
  chemically synthesized
gtcatacagattaaagaaccaa

SEQ ID NO: 1248204 - DNA, 22 bp, Artificial Sequence
  chemically synthesized
cttgggttccttttggttcttt

SEQ ID NO: 1248205 - DNA, 22 bp, Artificial Sequence
  chemically synthesized
ccttgggttccttttggttctt

SEQ ID NO: 1248206 - DNA, 22 bp, Artificial Sequence
  chemically synthesized
atttccttgggttccttttggt

SEQ ID NO: 1248207 - DNA, 22 bp, Artificial Sequence
  chemically synthesized
tgatttccttgggttccttttg

SEQ ID NO: 1248208 - DNA, 22 bp, Artificial Sequence
  chemically synthesized
ctgatttccttgggttcctttt

SEQ ID NO: 1248209 - DNA, 22 bp, Artificial Sequence
  chemically synthesized
tctgatttccttgggttccttt

SEQ ID NO: 1248210 - DNA, 22 bp, Artificial Sequence
  chemically synthesized
aagaaccaaaaggaacccaagg

SEQ ID NO: 1248211 - DNA, 22 bp, Artificial Sequence
  chemically synthesized
ccctttctgatttccttgggtt

SEQ ID NO: 1248212 - DNA, 22 bp, Artificial Sequence
  chemically synthesized
agcagaattaccctttctgatt

SEQ ID NO: 1248213 - DNA, 22 bp, Artificial Sequence
  chemically synthesized
taagcagaattaccctttctga

SEQ ID NO: 1248214 - DNA, 22 bp, Artificial Sequence
  chemically synthesized
ctaagcagaattaccctttctg

SEQ ID NO: 1248215 - DNA, 22 bp, Artificial Sequence
  chemically synthesized
tctaagcagaattaccctttct

SEQ ID NO: 1248216 - DNA, 22 bp, Artificial Sequence
  chemically synthesized
tgcttagaaagttgctcttaca

SEQ ID NO: 1248217 - DNA, 22 bp, Artificial Sequence
  chemically synthesized
cttagaaagttgctcttacatt

SEQ ID NO: 1248218 - DNA, 22 bp, Artificial Sequence
  chemically synthesized
aaccatgtatatgaaatgtaag

SEQ ID NO: 1248219 - DNA, 22 bp, Artificial Sequence
  chemically synthesized
agaaagttgctcttacatttca

SEQ ID NO: 1248220 - DNA, 22 bp, Artificial Sequence
  chemically synthesized
caaccatgtatatgaaatgtaa

SEQ ID NO: 1248221 - DNA, 22 bp, Artificial Sequence
  chemically synthesized
gaaagttgctcttacatttcat

SEQ ID NO: 1248222 - DNA, 22 bp, Artificial Sequence
  chemically synthesized
ctcttacatttcatatacatgg

SEQ ID NO: 1248223 - DNA, 22 bp, Artificial Sequence
  chemically synthesized
aggtcaaacttcaaccatgtat

SEQ ID NO: 1248224 - DNA, 22 bp, Artificial Sequence
  chemically synthesized
ttacatttcatatacatggttg

SEQ ID NO: 1248225 - DNA, 22 bp, Artificial Sequence
  chemically synthesized
gaggtcaaacttcaaccatgta

SEQ ID NO: 1248226 - DNA, 22 bp, Artificial Sequence
  chemically synthesized
tgaggtcaaacttcaaccatgt

SEQ ID NO: 1248227 - DNA, 22 bp, Artificial Sequence
  chemically synthesized
acatttcatatacatggttgaa

SEQ ID NO: 1248228 - DNA, 22 bp, Artificial Sequence
  chemically synthesized
ttgaggtcaaacttcaaccatg

SEQ ID NO: 1248229 - DNA, 22 bp, Artificial Sequence
  chemically synthesized
catttcatatacatggttgaag

SEQ ID NO: 1248230 - DNA, 22 bp, Artificial Sequence
  chemically synthesized
tttgaggtcaaacttcaaccat

SEQ ID NO: 1248231 - DNA, 22 bp, Artificial Sequence
  chemically synthesized
ttttgaggtcaaacttcaacca

SEQ ID NO: 1248232 - DNA, 22 bp, Artificial Sequence
  chemically synthesized
tttttgaggtcaaacttcaacc

SEQ ID NO: 1248233 - DNA, 22 bp, Artificial Sequence
  chemically synthesized
tttttttgaggtcaaacttcaa

SEQ ID NO: 1248234 - DNA, 22 bp, Artificial Sequence
  chemically synthesized
catatacatggttgaagtttga

SEQ ID NO: 1248235 - DNA, 22 bp, Artificial Sequence
  chemically synthesized
ctttttttgaggtcaaacttca

SEQ ID NO: 1248236 - DNA, 22 bp, Artificial Sequence
  chemically synthesized
atatacatggttgaagtttgac

SEQ ID NO: 1248237 - DNA, 22 bp, Artificial Sequence
  chemically synthesized
tctttttttgaggtcaaacttc

SEQ ID NO: 1248238 - DNA, 22 bp, Artificial Sequence
  chemically synthesized
ttctttttttgaggtcaaactt

SEQ ID NO: 1248239 - DNA, 22 bp, Artificial Sequence
  chemically synthesized
atttttctttttttgaggtcaa

SEQ ID NO: 1248240 - DNA, 22 bp, Artificial Sequence
  chemically synthesized
aaattgatttttctttttttga

SEQ ID NO: 1248241 - DNA, 22 bp, Artificial Sequence
  chemically synthesized
aagtttgacctcaaaaaaagaa

SEQ ID NO: 1248242 - DNA, 22 bp, Artificial Sequence
  chemically synthesized
gacctcaaaaaaagaaaaatca

SEQ ID NO: 1248243 - DNA, 22 bp, Artificial Sequence
  chemically synthesized
agtgcctgaaattgatttttct

SEQ ID NO: 1248244 - DNA, 22 bp, Artificial Sequence
  chemically synthesized
acctcaaaaaaagaaaaatcaa

SEQ ID NO: 1248245 - DNA, 22 bp, Artificial Sequence
  chemically synthesized
aaaaaaagaaaaatcaatttca

SEQ ID NO: 1248246 - DNA, 22 bp, Artificial Sequence
  chemically synthesized
ccgttcagtgcctgaaattgat

SEQ ID NO: 1248247 - DNA, 22 bp, Artificial Sequence
  chemically synthesized
cacaattgccgttcagtgcctg

SEQ ID NO: 1248248 - DNA, 22 bp, Artificial Sequence
  chemically synthesized
caggcactgaacggcaattgtg

SEQ ID NO: 1248249 - DNA, 22 bp, Artificial Sequence
  chemically synthesized
ataaataagttacacaattgcc

SEQ ID NO: 1248250 - DNA, 22 bp, Artificial Sequence
  chemically synthesized
aggcactgaacggcaattgtgt

SEQ ID NO: 1248251 - DNA, 22 bp, Artificial Sequence
  chemically synthesized
aataaataagttacacaattgc

SEQ ID NO: 1248252 - DNA, 22 bp, Artificial Sequence
  chemically synthesized
taaatttaataaataagttaca

SEQ ID NO: 1248253 - DNA, 22 bp, Artificial Sequence
  chemically synthesized
aacggcaattgtgtaacttatt

SEQ ID NO: 1248254 - DNA, 22 bp, Artificial Sequence
  chemically synthesized
tattataaatttaataaataag

SEQ ID NO: 1248255 - DNA, 22 bp, Artificial Sequence
  chemically synthesized
attgtattataaatttaataaa

SEQ ID NO: 1248256 - DNA, 22 bp, Artificial Sequence
  chemically synthesized
cattgtattataaatttaataa

SEQ ID NO: 1248257 - DNA, 22 bp, Artificial Sequence
  chemically synthesized
tgtaacttatttattaaattta

SEQ ID NO: 1248258 - DNA, 22 bp, Artificial Sequence
  chemically synthesized
agatttcattgtattataaatt

SEQ ID NO: 1248259 - DNA, 22 bp, Artificial Sequence
  chemically synthesized
atttattaaatttataatacaa

SEQ ID NO: 1248260 - DNA, 22 bp, Artificial Sequence
  chemically synthesized
tttattaaatttataatacaat

SEQ ID NO: 1248261 - DNA, 22 bp, Artificial Sequence
  chemically synthesized
attaaatttataatacaatgaa

SEQ ID NO: 1248262 - DNA, 22 bp, Artificial Sequence
  chemically synthesized
ttaaatttataatacaatgaaa

SEQ ID NO: 1248263 - DNA, 22 bp, Artificial Sequence
  chemically synthesized
aatttataatacaatgaaatct

SEQ ID NO: 1248264 - DNA, 22 bp, Artificial Sequence
  chemically synthesized
ataatacaatgaaatctgagtt

SEQ ID NO: 1248265 - DNA, 22 bp, Artificial Sequence
  chemically synthesized
taatacaatgaaatctgagttt

SEQ ID NO: 1248266 - DNA, 22 bp, Artificial Sequence
  chemically synthesized
agttttctattactctcatttc

SEQ ID NO: 1248267 - DNA, 22 bp, Artificial Sequence
  chemically synthesized
ccagtgtccaaataagaaatga

SEQ ID NO: 1248268 - DNA, 22 bp, Artificial Sequence
  chemically synthesized
tctattactctcatttcttatt

SEQ ID NO: 1248269 - DNA, 22 bp, Artificial Sequence
  chemically synthesized
ctattactctcatttcttattt

SEQ ID NO: 1248270 - DNA, 22 bp, Artificial Sequence
  chemically synthesized
tattactctcatttcttatttg

SEQ ID NO: 1248271 - DNA, 22 bp, Artificial Sequence
  chemically synthesized
ttactctcatttcttatttgga

SEQ ID NO: 1248272 - DNA, 22 bp, Artificial Sequence
  chemically synthesized
ctctcatttcttatttggacac

SEQ ID NO: 1248273 - DNA, 22 bp, Artificial Sequence
  chemically synthesized
tcatttcttatttggacactgg

SEQ ID NO: 1248274 - DNA, 22 bp, Artificial Sequence
  chemically synthesized
atttcttatttggacactggta

SEQ ID NO: 1248275 - DNA, 22 bp, Artificial Sequence
  chemically synthesized
cttatttggacactggtaattg

SEQ ID NO: 1248276 - DNA, 22 bp, Artificial Sequence
  chemically synthesized
ttatttggacactggtaattgc

SEQ ID NO: 1248277 - DNA, 22 bp, Artificial Sequence
  chemically synthesized
atttggacactggtaattgctt

SEQ ID NO: 1248278 - DNA, 22 bp, Artificial Sequence
  chemically synthesized
tttggacactggtaattgcttc

SEQ ID NO: 1248279 - DNA, 22 bp, Artificial Sequence
  chemically synthesized
ggacactggtaattgcttcttt

SEQ ID NO: 1248280 - DNA, 22 bp, Artificial Sequence
  chemically synthesized
aaaatgcataagaaagaagcaa

SEQ ID NO: 1248281 - DNA, 22 bp, Artificial Sequence
  chemically synthesized
gacactggtaattgcttctttc

SEQ ID NO: 1248282 - DNA, 22 bp, Artificial Sequence
  chemically synthesized
aaaaatgcataagaaagaagca

SEQ ID NO: 1248283 - DNA, 22 bp, Artificial Sequence
  chemically synthesized
taaaaatgcataagaaagaagc

SEQ ID NO: 1248284 - DNA, 22 bp, Artificial Sequence
  chemically synthesized
tactttaaaaatgcataagaaa

SEQ ID NO: 1248285 - DNA, 22 bp, Artificial Sequence
  chemically synthesized
gtaattgcttctttcttatgca

SEQ ID NO: 1248286 - DNA, 22 bp, Artificial Sequence
  chemically synthesized
atactttaaaaatgcataagaa

SEQ ID NO: 1248287 - DNA, 22 bp, Artificial Sequence
  chemically synthesized
cttctttcttatgcatttttaa

SEQ ID NO: 1248288 - DNA, 22 bp, Artificial Sequence
  chemically synthesized
ctttcttatgcatttttaaagt

SEQ ID NO: 1248289 - DNA, 22 bp, Artificial Sequence
  chemically synthesized
tttcttatgcatttttaaagta

SEQ ID NO: 1248290 - DNA, 22 bp, Artificial Sequence
  chemically synthesized
gtatcaggatttatactttaaa

SEQ ID NO: 1248291 - DNA, 22 bp, Artificial Sequence
  chemically synthesized
tcttatgcatttttaaagtata

SEQ ID NO: 1248292 - DNA, 22 bp, Artificial Sequence
  chemically synthesized
cttatgcatttttaaagtataa

SEQ ID NO: 1248293 - DNA, 22 bp, Artificial Sequence
  chemically synthesized
ttatgcatttttaaagtataaa

SEQ ID NO: 1248294 - DNA, 22 bp, Artificial Sequence
  chemically synthesized
atgcatttttaaagtataaatc

SEQ ID NO: 1248295 - DNA, 22 bp, Artificial Sequence
  chemically synthesized
tgcatttttaaagtataaatcc

SEQ ID NO: 1248296 - DNA, 22 bp, Artificial Sequence
  chemically synthesized
ttaaagtataaatcctgatact

SEQ ID NO: 1248297 - DNA, 22 bp, Artificial Sequence
  chemically synthesized
taaagtataaatcctgatacta

SEQ ID NO: 1248298 - DNA, 22 bp, Artificial Sequence
  chemically synthesized
aaagtataaatcctgatactag

SEQ ID NO: 1248299 - DNA, 22 bp, Artificial Sequence
  chemically synthesized
gggtagtgccagctagtatcag

SEQ ID NO: 1248300 - DNA, 22 bp, Artificial Sequence
  chemically synthesized
aagtataaatcctgatactagc

SEQ ID NO: 1248301 - DNA, 22 bp, Artificial Sequence
  chemically synthesized
atactagctggcactaccccaa

SEQ ID NO: 1248302 - DNA, 22 bp, Artificial Sequence
  chemically synthesized
aagggaaaaaatattggggtag

SEQ ID NO: 1248303 - DNA, 22 bp, Artificial Sequence
  chemically synthesized
gctggcactaccccaatatttt

SEQ ID NO: 1248304 - DNA, 22 bp, Artificial Sequence
  chemically synthesized
caaagttaaagggaaaaaatat

SEQ ID NO: 1248305 - DNA, 22 bp, Artificial Sequence
  chemically synthesized
gcactaccccaatattttttcc

SEQ ID NO: 1248306 - DNA, 22 bp, Artificial Sequence
  chemically synthesized
ccccaatattttttccctttaa

SEQ ID NO: 1248307 - DNA, 22 bp, Artificial Sequence
  chemically synthesized
aaaggaaaattccaaagttaaa

SEQ ID NO: 1248308 - DNA, 22 bp, Artificial Sequence
  chemically synthesized
aaaaggaaaattccaaagttaa

SEQ ID NO: 1248309 - DNA, 22 bp, Artificial Sequence
  chemically synthesized
taaaaggaaaattccaaagtta

SEQ ID NO: 1248310 - DNA, 22 bp, Artificial Sequence
  chemically synthesized
ttaaaaggaaaattccaaagtt

SEQ ID NO: 1248311 - DNA, 22 bp, Artificial Sequence
  chemically synthesized
tttaaaaggaaaattccaaagt

SEQ ID NO: 1248312 - DNA, 22 bp, Artificial Sequence
  chemically synthesized
tttccctttaactttggaattt

SEQ ID NO: 1248313 - DNA, 22 bp, Artificial Sequence
  chemically synthesized
ttccctttaactttggaatttt

SEQ ID NO: 1248314 - DNA, 22 bp, Artificial Sequence
  chemically synthesized
tccctttaactttggaattttc

SEQ ID NO: 1248315 - DNA, 22 bp, Artificial Sequence
  chemically synthesized
ccctttaactttggaattttcc

SEQ ID NO: 1248316 - DNA, 22 bp, Artificial Sequence
  chemically synthesized
cctttaactttggaattttcct

SEQ ID NO: 1248317 - DNA, 22 bp, Artificial Sequence
  chemically synthesized
taactttggaattttcctttta

SEQ ID NO: 1248318 - DNA, 22 bp, Artificial Sequence
  chemically synthesized
aactttggaattttccttttaa

SEQ ID NO: 1248319 - DNA, 22 bp, Artificial Sequence
  chemically synthesized
actttggaattttccttttaaa

SEQ ID NO: 1248320 - DNA, 22 bp, Artificial Sequence
  chemically synthesized
gaatgacaattttttaaaagga

SEQ ID NO: 1248321 - DNA, 22 bp, Artificial Sequence
  chemically synthesized
tagaatgacaattttttaaaag

SEQ ID NO: 1248322 - DNA, 22 bp, Artificial Sequence
  chemically synthesized
tggaattttccttttaaaaaat

SEQ ID NO: 1248323 - DNA, 22 bp, Artificial Sequence
  chemically synthesized
ggaattttccttttaaaaaatt

SEQ ID NO: 1248324 - DNA, 22 bp, Artificial Sequence
  chemically synthesized
gaattttccttttaaaaaattg

SEQ ID NO: 1248325 - DNA, 22 bp, Artificial Sequence
  chemically synthesized
actctagaatgacaatttttta

SEQ ID NO: 1248326 - DNA, 22 bp, Artificial Sequence
  chemically synthesized
tccttttaaaaaattgtcattc

SEQ ID NO: 1248327 - DNA, 22 bp, Artificial Sequence
  chemically synthesized
ccttttaaaaaattgtcattct

SEQ ID NO: 1248328 - DNA, 22 bp, Artificial Sequence
  chemically synthesized
cttttaaaaaattgtcattcta

SEQ ID NO: 1248329 - DNA, 22 bp, Artificial Sequence
  chemically synthesized
ttaaaaaattgtcattctagag

SEQ ID NO: 1248330 - DNA, 22 bp, Artificial Sequence
  chemically synthesized
gtagcatgttaactctagaatg

SEQ ID NO: 1248331 - DNA, 22 bp, Artificial Sequence
  chemically synthesized
taaaaaattgtcattctagagt

SEQ ID NO: 1248332 - DNA, 22 bp, Artificial Sequence
  chemically synthesized
aaaaaattgtcattctagagtt

SEQ ID NO: 1248333 - DNA, 22 bp, Artificial Sequence
  chemically synthesized
aaaaattgtcattctagagtta

SEQ ID NO: 1248334 - DNA, 22 bp, Artificial Sequence
  chemically synthesized
tgaaaagctggtagcatgttaa

SEQ ID NO: 1248335 - DNA, 22 bp, Artificial Sequence
  chemically synthesized
tcattctagagttaacatgcta

SEQ ID NO: 1248336 - DNA, 22 bp, Artificial Sequence
  chemically synthesized
gtgaaaagctggtagcatgtta

SEQ ID NO: 1248337 - DNA, 22 bp, Artificial Sequence
  chemically synthesized
atttgtgaaaagctggtagcat

SEQ ID NO: 1248338 - DNA, 22 bp, Artificial Sequence
  chemically synthesized
aatttgtgaaaagctggtagca

SEQ ID NO: 1248339 - DNA, 22 bp, Artificial Sequence
  chemically synthesized
tagagttaacatgctaccagct

SEQ ID NO: 1248340 - DNA, 22 bp, Artificial Sequence
  chemically synthesized
gagttaacatgctaccagcttt

SEQ ID NO: 1248341 - DNA, 22 bp, Artificial Sequence
  chemically synthesized
acatgctaccagcttttcacaa

SEQ ID NO: 1248342 - DNA, 22 bp, Artificial Sequence
  chemically synthesized
acaacaaatttaatttgtgaaa

SEQ ID NO: 1248343 - DNA, 22 bp, Artificial Sequence
  chemically synthesized
taacaacaaatttaatttgtga

SEQ ID NO: 1248344 - DNA, 22 bp, Artificial Sequence
  chemically synthesized
ctaacaacaaatttaatttgtg

SEQ ID NO: 1248345 - DNA, 22 bp, Artificial Sequence
  chemically synthesized
tctaacaacaaatttaatttgt

SEQ ID NO: 1248346 - DNA, 22 bp, Artificial Sequence
  chemically synthesized
ccagcttttcacaaattaaatt

SEQ ID NO: 1248347 - DNA, 22 bp, Artificial Sequence
  chemically synthesized
ttcacaaattaaatttgttgtt

SEQ ID NO: 1248348 - DNA, 22 bp, Artificial Sequence
  chemically synthesized
tcacaaattaaatttgttgtta

SEQ ID NO: 1248349 - DNA, 22 bp, Artificial Sequence
  chemically synthesized
cacaaattaaatttgttgttag

SEQ ID NO: 1248350 - DNA, 22 bp, Artificial Sequence
  chemically synthesized
acaaattaaatttgttgttaga

SEQ ID NO: 1248351 - DNA, 22 bp, Artificial Sequence
  chemically synthesized
gccatggaagccattttctaac

SEQ ID NO: 1248352 - DNA, 22 bp, Artificial Sequence
  chemically synthesized
aatttgttgttagaaaatggct

SEQ ID NO: 1248353 - DNA, 22 bp, Artificial Sequence
  chemically synthesized
gttgttagaaaatggcttccat

SEQ ID NO: 1248354 - DNA, 22 bp, Artificial Sequence
  chemically synthesized
ttgttagaaaatggcttccatg

SEQ ID NO: 1248355 - DNA, 22 bp, Artificial Sequence
  chemically synthesized
ttagaaaatggcttccatggcc

SEQ ID NO: 1248356 - DNA, 22 bp, Artificial Sequence
  chemically synthesized
gaaaatggcttccatggccagg

SEQ ID NO: 1248357 - DNA, 22 bp, Artificial Sequence
  chemically synthesized
caggcgtgagccaccgcgcctg

SEQ ID NO: 1248358 - DNA, 22 bp, Artificial Sequence
  chemically synthesized
ccatggccaggcgcggtggctc

SEQ ID NO: 1248359 - DNA, 22 bp, Artificial Sequence
  chemically synthesized
catggccaggcgcggtggctca

SEQ ID NO: 1248360 - DNA, 22 bp, Artificial Sequence
  chemically synthesized
ccaaagtgcggggattacaggc

SEQ ID NO: 1248361 - DNA, 22 bp, Artificial Sequence
  chemically synthesized
ggcctcccaaagtgcggggatt

SEQ ID NO: 1248362 - DNA, 22 bp, Artificial Sequence
  chemically synthesized
acgcctgtaatccccgcacttt

SEQ ID NO: 1248363 - DNA, 22 bp, Artificial Sequence
  chemically synthesized
gctcggcctcccaaagtgcggg

SEQ ID NO: 1248364 - DNA, 22 bp, Artificial Sequence
  chemically synthesized
taatccccgcactttgggaggc

SEQ ID NO: 1248365 - DNA, 22 bp, Artificial Sequence
  chemically synthesized
gtgatccacctggctcggcctc

SEQ ID NO: 1248366 - DNA, 22 bp, Artificial Sequence
  chemically synthesized
acctcgtgatccacctggctcg

SEQ ID NO: 1248367 - DNA, 22 bp, Artificial Sequence
  chemically synthesized
ctgacctcgtgatccacctggc

SEQ ID NO: 1248368 - DNA, 22 bp, Artificial Sequence
  chemically synthesized
tgggaggccgagccaggtggat

SEQ ID NO: 1248369 - DNA, 22 bp, Artificial Sequence
  chemically synthesized
gggaggccgagccaggtggatc

SEQ ID NO: 1248370 - DNA, 22 bp, Artificial Sequence
  chemically synthesized
ggaggccgagccaggtggatca

SEQ ID NO: 1248371 - DNA, 22 bp, Artificial Sequence
  chemically synthesized
gaactcctgacctcgtgatcca

SEQ ID NO: 1248372 - DNA, 22 bp, Artificial Sequence
  chemically synthesized
gccagggtggtctcgaactcct

SEQ ID NO: 1248373 - DNA, 22 bp, Artificial Sequence
  chemically synthesized
accgtgttagccagggtggtct

SEQ ID NO: 1248374 - DNA, 22 bp, Artificial Sequence
  chemically synthesized
caccgtgttagccagggtggtc

SEQ ID NO: 1248375 - DNA, 22 bp, Artificial Sequence
  chemically synthesized
gagaccaccctggctaacacgg

SEQ ID NO: 1248376 - DNA, 22 bp, Artificial Sequence
  chemically synthesized
gtagagacggggtttcaccgtg

SEQ ID NO: 1248377 - DNA, 22 bp, Artificial Sequence
  chemically synthesized
agtagagacggggtttcaccgt

SEQ ID NO: 1248378 - DNA, 22 bp, Artificial Sequence
  chemically synthesized
tagtagagacggggtttcaccg

SEQ ID NO: 1248379 - DNA, 22 bp, Artificial Sequence
  chemically synthesized
ttagtagagacggggtttcacc

SEQ ID NO: 1248380 - DNA, 22 bp, Artificial Sequence
  chemically synthesized
gctaacacggtgaaaccccgtc

SEQ ID NO: 1248381 - DNA, 22 bp, Artificial Sequence
  chemically synthesized
tatttttagtagagacggggtt

SEQ ID NO: 1248382 - DNA, 22 bp, Artificial Sequence
  chemically synthesized
gtatttttagtagagacggggt

SEQ ID NO: 1248383 - DNA, 22 bp, Artificial Sequence
  chemically synthesized
tgtatttttagtagagacgggg

SEQ ID NO: 1248384 - DNA, 22 bp, Artificial Sequence
  chemically synthesized
acacggtgaaaccccgtctcta

SEQ ID NO: 1248385 - DNA, 22 bp, Artificial Sequence
  chemically synthesized
ttgtatttttagtagagacggg

SEQ ID NO: 1248386 - DNA, 22 bp, Artificial Sequence
  chemically synthesized
tttgtatttttagtagagacgg

SEQ ID NO: 1248387 - DNA, 22 bp, Artificial Sequence
  chemically synthesized
attttttgtatttttagtagag

SEQ ID NO: 1248388 - DNA, 22 bp, Artificial Sequence
  chemically synthesized
tactaaaaatacaaaaaattag

SEQ ID NO: 1248389 - DNA, 22 bp, Artificial Sequence
  chemically synthesized
ctaaaaatacaaaaaattagcc

SEQ ID NO: 1248390 - DNA, 22 bp, Artificial Sequence
  chemically synthesized
aaaatacaaaaaattagccggg

SEQ ID NO: 1248391 - DNA, 22 bp, Artificial Sequence
  chemically synthesized
caggtgcccgccaccatgcccg

SEQ ID NO: 1248392 - DNA, 22 bp, Artificial Sequence
  chemically synthesized
ggactacaggtgcccgccacca

SEQ ID NO: 1248393 - DNA, 22 bp, Artificial Sequence
  chemically synthesized
gccgggcatggtggcgggcacc

SEQ ID NO: 1248394 - DNA, 22 bp, Artificial Sequence
  chemically synthesized
ccaagtagctgggactacaggt

SEQ ID NO: 1248395 - DNA, 22 bp, Artificial Sequence
  chemically synthesized
agcctcccaagtagctgggact

SEQ ID NO: 1248396 - DNA, 22 bp, Artificial Sequence
  chemically synthesized
cctcagcctcccaagtagctgg

SEQ ID NO: 1248397 - DNA, 22 bp, Artificial Sequence
  chemically synthesized
ctgcctcagcctcccaagtagc

SEQ ID NO: 1248398 - DNA, 22 bp, Artificial Sequence
  chemically synthesized
tcctgcctcagcctcccaagta

SEQ ID NO: 1248399 - DNA, 22 bp, Artificial Sequence
  chemically synthesized
tagtcccagctacttgggaggc

SEQ ID NO: 1248400 - DNA, 22 bp, Artificial Sequence
  chemically synthesized
acgccattctcctgcctcagcc

SEQ ID NO: 1248401 - DNA, 22 bp, Artificial Sequence
  chemically synthesized
cttgggaggctgaggcaggaga

SEQ ID NO: 1248402 - DNA, 22 bp, Artificial Sequence
  chemically synthesized
gggaggctgaggcaggagaatg

SEQ ID NO: 1248403 - DNA, 22 bp, Artificial Sequence
  chemically synthesized
ccgggttcacgccattctcctg

SEQ ID NO: 1248404 - DNA, 22 bp, Artificial Sequence
  chemically synthesized
ggaggctgaggcaggagaatgg

SEQ ID NO: 1248405 - DNA, 22 bp, Artificial Sequence
  chemically synthesized
cctcccgggttcacgccattct

SEQ ID NO: 1248406 - DNA, 22 bp, Artificial Sequence
  chemically synthesized
tgcctcccgggttcacgccatt

SEQ ID NO: 1248407 - DNA, 22 bp, Artificial Sequence
  chemically synthesized
aggcaggagaatggcgtgaacc

SEQ ID NO: 1248408 - DNA, 22 bp, Artificial Sequence
  chemically synthesized
caacctctgcctcccgggttca

SEQ ID NO: 1248409 - DNA, 22 bp, Artificial Sequence
  chemically synthesized
actgcaacctctgcctcccggg

SEQ ID NO: 1248410 - DNA, 22 bp, Artificial Sequence
  chemically synthesized
ggctcactgcaacctctgcctc

SEQ ID NO: 1248411 - DNA, 22 bp, Artificial Sequence
  chemically synthesized
gagtgcagtggcatgatctcgg

SEQ ID NO: 1248412 - DNA, 22 bp, Artificial Sequence
  chemically synthesized
cagtgagccgagatcatgccac

SEQ ID NO: 1248413 - DNA, 22 bp, Artificial Sequence
  chemically synthesized
tcacccaggctggagtgcagtg

SEQ ID NO: 1248414 - DNA, 22 bp, Artificial Sequence
  chemically synthesized
tgtcacccaggctggagtgcag

SEQ ID NO: 1248415 - DNA, 22 bp, Artificial Sequence
  chemically synthesized
ctctgtcacccaggctggagtg

SEQ ID NO: 1248416 - DNA, 22 bp, Artificial Sequence
  chemically synthesized
gctctgtcacccaggctggagt

SEQ ID NO: 1248417 - DNA, 22 bp, Artificial Sequence
  chemically synthesized
cactccagcctgggtgacagag

SEQ ID NO: 1248418 - DNA, 22 bp, Artificial Sequence
  chemically synthesized
aaacagagtcttgctctgtcac

SEQ ID NO: 1248419 - DNA, 22 bp, Artificial Sequence
  chemically synthesized
gaaacagagtcttgctctgtca

SEQ ID NO: 1248420 - DNA, 22 bp, Artificial Sequence
  chemically synthesized
tgaaacagagtcttgctctgtc

SEQ ID NO: 1248421 - DNA, 22 bp, Artificial Sequence
  chemically synthesized
ttgaaacagagtcttgctctgt

SEQ ID NO: 1248422 - DNA, 22 bp, Artificial Sequence
  chemically synthesized
cagcctgggtgacagagcaaga

SEQ ID NO: 1248423 - DNA, 22 bp, Artificial Sequence
  chemically synthesized
tttgaaacagagtcttgctctg

SEQ ID NO: 1248424 - DNA, 22 bp, Artificial Sequence
  chemically synthesized
ttttgaaacagagtcttgctct

SEQ ID NO: 1248425 - DNA, 22 bp, Artificial Sequence
  chemically synthesized
tttttgaaacagagtcttgctc

SEQ ID NO: 1248426 - DNA, 22 bp, Artificial Sequence
  chemically synthesized
ttttttgaaacagagtcttgct

SEQ ID NO: 1248427 - DNA, 22 bp, Artificial Sequence
  chemically synthesized
tttttttgaaacagagtcttgc

SEQ ID NO: 1248428 - DNA, 22 bp, Artificial Sequence
  chemically synthesized
ttttttttgaaacagagtcttg

SEQ ID NO: 1248429 - DNA, 22 bp, Artificial Sequence
  chemically synthesized
tttttttttgaaacagagtctt

SEQ ID NO: 1248430 - DNA, 22 bp, Artificial Sequence
  chemically synthesized
ggtgacagagcaagactctgtt

SEQ ID NO: 1248431 - DNA, 22 bp, Artificial Sequence
  chemically synthesized
ttttttttttgaaacagagtct

SEQ ID NO: 1248432 - DNA, 22 bp, Artificial Sequence
  chemically synthesized
tttttttttttgaaacagagtc

SEQ ID NO: 1248433 - DNA, 22 bp, Artificial Sequence
  chemically synthesized
ttttttttttttgaaacagagt

SEQ ID NO: 1248434 - DNA, 22 bp, Artificial Sequence
  chemically synthesized
tttttttttttttgaaacagag

SEQ ID NO: 1248435 - DNA, 22 bp, Artificial Sequence
  chemically synthesized
ttttttttttttttgaaacaga

SEQ ID NO: 1248436 - DNA, 22 bp, Artificial Sequence
  chemically synthesized
tttttttttttttttgaaacag

SEQ ID NO: 1248437 - DNA, 22 bp, Artificial Sequence
  chemically synthesized
ttttttttttttttttgaaaca

SEQ ID NO: 1248438 - DNA, 22 bp, Artificial Sequence
  chemically synthesized
tttttttttttttttttgaaac

SEQ ID NO: 1248439 - DNA, 22 bp, Artificial Sequence
  chemically synthesized
ttttttttttttttttttgaaa

SEQ ID NO: 1248440 - DNA, 22 bp, Artificial Sequence
  chemically synthesized
tttttttttttttttttttgaa

SEQ ID NO: 1248441 - DNA, 22 bp, Artificial Sequence
  chemically synthesized
ttttttttttttttttttttga

SEQ ID NO: 1248442 - DNA, 22 bp, Artificial Sequence
  chemically synthesized
tttttttttttttttttttttg

SEQ ID NO: 1248443 - DNA, 22 bp, Artificial Sequence
  chemically synthesized
tttttttttttttttttttttt

SEQ ID NO: 1248444 - DNA, 22 bp, Artificial Sequence
  chemically synthesized
tttttttttttttttttttttt

SEQ ID NO: 1248445 - DNA, 22 bp, Artificial Sequence
  chemically synthesized
tttttttttttttttttttttt

SEQ ID NO: 1248446 - DNA, 22 bp, Artificial Sequence
  chemically synthesized
tttttttttttttttttttttt

SEQ ID NO: 1248447 - DNA, 22 bp, Artificial Sequence
  chemically synthesized
tttttttttttttttttttttt

SEQ ID NO: 1248448 - DNA, 22 bp, Artificial Sequence
  chemically synthesized
tgtttcaaaaaaaaaaaaaaaa

SEQ ID NO: 1248449 - DNA, 22 bp, Artificial Sequence
  chemically synthesized
tttttttttttttttttttttt

SEQ ID NO: 1248450 - DNA, 22 bp, Artificial Sequence
  chemically synthesized
cttttttttttttttttttttt

SEQ ID NO: 1248451 - DNA, 22 bp, Artificial Sequence
  chemically synthesized
tttcaaaaaaaaaaaaaaaaaa

SEQ ID NO: 1248452 - DNA, 22 bp, Artificial Sequence
  chemically synthesized
tctttttttttttttttttttt

SEQ ID NO: 1248453 - DNA, 22 bp, Artificial Sequence
  chemically synthesized
caaaaaaaaaaaaaaaaaaaaa

SEQ ID NO: 1248454 - DNA, 22 bp, Artificial Sequence
  chemically synthesized
aaaaaaaaaaaaaaaaaaaaaa

SEQ ID NO: 1248455 - DNA, 22 bp, Artificial Sequence
  chemically synthesized
gataaaatggaagtcattttct

SEQ ID NO: 1248456 - DNA, 22 bp, Artificial Sequence
  chemically synthesized
ggataaaatggaagtcattttc

SEQ ID NO: 1248457 - DNA, 22 bp, Artificial Sequence
  chemically synthesized
tggataaaatggaagtcatttt

SEQ ID NO: 1248458 - DNA, 22 bp, Artificial Sequence
  chemically synthesized
aattttggataaaatggaagtc

SEQ ID NO: 1248459 - DNA, 22 bp, Artificial Sequence
  chemically synthesized
agagcctaaattttggataaaa

SEQ ID NO: 1248460 - DNA, 22 bp, Artificial Sequence
  chemically synthesized
aagagcctaaattttggataaa

SEQ ID NO: 1248461 - DNA, 22 bp, Artificial Sequence
  chemically synthesized
taagagcctaaattttggataa

SEQ ID NO: 1248462 - DNA, 22 bp, Artificial Sequence
  chemically synthesized
ttaagagcctaaattttggata

SEQ ID NO: 1248463 - DNA, 22 bp, Artificial Sequence
  chemically synthesized
ccattttatccaaaatttaggc

SEQ ID NO: 1248464 - DNA, 22 bp, Artificial Sequence
  chemically synthesized
cattttatccaaaatttaggct

SEQ ID NO: 1248465 - DNA, 22 bp, Artificial Sequence
  chemically synthesized
tatccaaaatttaggctcttaa

SEQ ID NO: 1248466 - DNA, 22 bp, Artificial Sequence
  chemically synthesized
atccaaaatttaggctcttaaa

SEQ ID NO: 1248467 - DNA, 22 bp, Artificial Sequence
  chemically synthesized
tccaaaatttaggctcttaaaa

SEQ ID NO: 1248468 - DNA, 22 bp, Artificial Sequence
  chemically synthesized
aggctcttaaaaatgtatccct

SEQ ID NO: 1248469 - DNA, 22 bp, Artificial Sequence
  chemically synthesized
ggctcttaaaaatgtatccctt

SEQ ID NO: 1248470 - DNA, 22 bp, Artificial Sequence
  chemically synthesized
agaatatcatgaaaagggatac

SEQ ID NO: 1248471 - DNA, 22 bp, Artificial Sequence
  chemically synthesized
ttaaaaatgtatcccttttcat

SEQ ID NO: 1248472 - DNA, 22 bp, Artificial Sequence
  chemically synthesized
aaaaatgtatcccttttcatga

SEQ ID NO: 1248473 - DNA, 22 bp, Artificial Sequence
  chemically synthesized
atattaagaatatcatgaaaag

SEQ ID NO: 1248474 - DNA, 22 bp, Artificial Sequence
  chemically synthesized
aaaatgtatcccttttcatgat

SEQ ID NO: 1248475 - DNA, 22 bp, Artificial Sequence
  chemically synthesized
cagaacattaatattaagaata

SEQ ID NO: 1248476 - DNA, 22 bp, Artificial Sequence
  chemically synthesized
ttcatgatattcttaatattaa

SEQ ID NO: 1248477 - DNA, 22 bp, Artificial Sequence
  chemically synthesized
tcatgatattcttaatattaat

SEQ ID NO: 1248478 - DNA, 22 bp, Artificial Sequence
  chemically synthesized
catgatattcttaatattaatg

SEQ ID NO: 1248479 - DNA, 22 bp, Artificial Sequence
  chemically synthesized
atgatattcttaatattaatgt

SEQ ID NO: 1248480 - DNA, 22 bp, Artificial Sequence
  chemically synthesized
tagaacatctacagaacattaa

SEQ ID NO: 1248481 - DNA, 22 bp, Artificial Sequence
  chemically synthesized
tatagaacatctacagaacatt

SEQ ID NO: 1248482 - DNA, 22 bp, Artificial Sequence
  chemically synthesized
ttaatattaatgttctgtagat

SEQ ID NO: 1248483 - DNA, 22 bp, Artificial Sequence
  chemically synthesized
aatattaatgttctgtagatgt

SEQ ID NO: 1248484 - DNA, 22 bp, Artificial Sequence
  chemically synthesized
atattaatgttctgtagatgtt

SEQ ID NO: 1248485 - DNA, 22 bp, Artificial Sequence
  chemically synthesized
aagtgcctctatagaacatcta

SEQ ID NO: 1248486 - DNA, 22 bp, Artificial Sequence
  chemically synthesized
caagtgcctctatagaacatct

SEQ ID NO: 1248487 - DNA, 22 bp, Artificial Sequence
  chemically synthesized
atgttctgtagatgttctatag

SEQ ID NO: 1248488 - DNA, 22 bp, Artificial Sequence
  chemically synthesized
tttcaagtgcctctatagaaca

SEQ ID NO: 1248489 - DNA, 22 bp, Artificial Sequence
  chemically synthesized
atttcaagtgcctctatagaac

SEQ ID NO: 1248490 - DNA, 22 bp, Artificial Sequence
  chemically synthesized
tgtagatgttctatagaggcac

SEQ ID NO: 1248491 - DNA, 22 bp, Artificial Sequence
  chemically synthesized
agtttatttcaagtgcctctat

SEQ ID NO: 1248492 - DNA, 22 bp, Artificial Sequence
  chemically synthesized
tagatgttctatagaggcactt

SEQ ID NO: 1248493 - DNA, 22 bp, Artificial Sequence
  chemically synthesized
gatatgttgagtttatttcaag

SEQ ID NO: 1248494 - DNA, 22 bp, Artificial Sequence
  chemically synthesized
tatagaggcacttgaaataaac

SEQ ID NO: 1248495 - DNA, 22 bp, Artificial Sequence
  chemically synthesized
ttagatatgttgagtttatttc

SEQ ID NO: 1248496 - DNA, 22 bp, Artificial Sequence
  chemically synthesized
tagaggcacttgaaataaactc

SEQ ID NO: 1248497 - DNA, 22 bp, Artificial Sequence
  chemically synthesized
attagatatgttgagtttattt

SEQ ID NO: 1248498 - DNA, 22 bp, Artificial Sequence
  chemically synthesized
tattagatatgttgagtttatt

SEQ ID NO: 1248499 - DNA, 22 bp, Artificial Sequence
  chemically synthesized
tctttattagatatgttgagtt

SEQ ID NO: 1248500 - DNA, 22 bp, Artificial Sequence
  chemically synthesized
tgtctttattagatatgttgag

SEQ ID NO: 1248501 - DNA, 22 bp, Artificial Sequence
  chemically synthesized
ctgtctttattagatatgttga

SEQ ID NO: 1248502 - DNA, 22 bp, Artificial Sequence
  chemically synthesized
gaaataaactcaacatatctaa

SEQ ID NO: 1248503 - DNA, 22 bp, Artificial Sequence
  chemically synthesized
aaataaactcaacatatctaat

SEQ ID NO: 1248504 - DNA, 22 bp, Artificial Sequence
  chemically synthesized
catttctgtctttattagatat

SEQ ID NO: 1248505 - DNA, 22 bp, Artificial Sequence
  chemically synthesized
ccatttctgtctttattagata

SEQ ID NO: 1248506 - DNA, 22 bp, Artificial Sequence
  chemically synthesized
tccatttctgtctttattagat

SEQ ID NO: 1248507 - DNA, 22 bp, Artificial Sequence
  chemically synthesized
cctttccatttctgtctttatt

SEQ ID NO: 1248508 - DNA, 22 bp, Artificial Sequence
  chemically synthesized
acctttccatttctgtctttat

SEQ ID NO: 1248509 - DNA, 22 bp, Artificial Sequence
  chemically synthesized
aacatatctaataaagacagaa

SEQ ID NO: 1248510 - DNA, 22 bp, Artificial Sequence
  chemically synthesized
tgtacttacctttccatttctg

SEQ ID NO: 1248511 - DNA, 22 bp, Artificial Sequence
  chemically synthesized
ataaagacagaaatggaaaggt

SEQ ID NO: 1248512 - DNA, 22 bp, Artificial Sequence
  chemically synthesized
tctggttttgatgtactctatc

SEQ ID NO: 1248513 - DNA, 22 bp, Artificial Sequence
  chemically synthesized
ctggttttgatgtactctatcc

SEQ ID NO: 1248514 - DNA, 22 bp, Artificial Sequence
  chemically synthesized
tggttttgatgtactctatccc

SEQ ID NO: 1248515 - DNA, 22 bp, Artificial Sequence
  chemically synthesized
gttttgatgtactctatccctt

SEQ ID NO: 1248516 - DNA, 22 bp, Artificial Sequence
  chemically synthesized
tgatgtactctatcccttgcct

SEQ ID NO: 1248517 - DNA, 22 bp, Artificial Sequence
  chemically synthesized
gatgtactctatcccttgcctg

SEQ ID NO: 1248518 - DNA, 22 bp, Artificial Sequence
  chemically synthesized
gtcaagaaaaaacaggcaaggg

SEQ ID NO: 1248519 - DNA, 22 bp, Artificial Sequence
  chemically synthesized
atgtactctatcccttgcctgt

SEQ ID NO: 1248520 - DNA, 22 bp, Artificial Sequence
  chemically synthesized
tatcccttgcctgttttttctt

SEQ ID NO: 1248521 - DNA, 22 bp, Artificial Sequence
  chemically synthesized
tatgtattggtcaagaaaaaac

SEQ ID NO: 1248522 - DNA, 22 bp, Artificial Sequence
  chemically synthesized
tcccttgcctgttttttcttga

SEQ ID NO: 1248523 - DNA, 22 bp, Artificial Sequence
  chemically synthesized
gcctgttttttcttgaccaata

SEQ ID NO: 1248524 - DNA, 22 bp, Artificial Sequence
  chemically synthesized
cctgttttttcttgaccaatac

SEQ ID NO: 1248525 - DNA, 22 bp, Artificial Sequence
  chemically synthesized
agtaacattgtatgtattggtc

SEQ ID NO: 1248526 - DNA, 22 bp, Artificial Sequence
  chemically synthesized
aagtaacattgtatgtattggt

SEQ ID NO: 1248527 - DNA, 22 bp, Artificial Sequence
  chemically synthesized
ttttttcttgaccaatacatac

SEQ ID NO: 1248528 - DNA, 22 bp, Artificial Sequence
  chemically synthesized
tttcttgaccaatacatacaat

SEQ ID NO: 1248529 - DNA, 22 bp, Artificial Sequence
  chemically synthesized
ttcttgaccaatacatacaatg

SEQ ID NO: 1248530 - DNA, 22 bp, Artificial Sequence
  chemically synthesized
tcttgaccaatacatacaatgt

SEQ ID NO: 1248531 - DNA, 22 bp, Artificial Sequence
  chemically synthesized
cttgaccaatacatacaatgtt

SEQ ID NO: 1248532 - DNA, 22 bp, Artificial Sequence
  chemically synthesized
ttgaccaatacatacaatgtta

SEQ ID NO: 1248533 - DNA, 22 bp, Artificial Sequence
  chemically synthesized
gaccaatacatacaatgttact

SEQ ID NO: 1248534 - DNA, 22 bp, Artificial Sequence
  chemically synthesized
accaatacatacaatgttactt

SEQ ID NO: 1248535 - DNA, 22 bp, Artificial Sequence
  chemically synthesized
aggatggcatgtttaagtaaca

SEQ ID NO: 1248536 - DNA, 22 bp, Artificial Sequence
  chemically synthesized
ggaatattgaggatggcatgtt

SEQ ID NO: 1248537 - DNA, 22 bp, Artificial Sequence
  chemically synthesized
cttaaacatgccatcctcaata

SEQ ID NO: 1248538 - DNA, 22 bp, Artificial Sequence
  chemically synthesized
aaacatgccatcctcaatattc

SEQ ID NO: 1248539 - DNA, 22 bp, Artificial Sequence
  chemically synthesized
aacatgccatcctcaatattcc

SEQ ID NO: 1248540 - DNA, 22 bp, Artificial Sequence
  chemically synthesized
gtataggggacattgggaatat

SEQ ID NO: 1248541 - DNA, 22 bp, Artificial Sequence
  chemically synthesized
agtataggggacattgggaata

SEQ ID NO: 1248542 - DNA, 22 bp, Artificial Sequence
  chemically synthesized
gtcttagtataggggacattgg

SEQ ID NO: 1248543 - DNA, 22 bp, Artificial Sequence
  chemically synthesized
aatattcccaatgtcccctata

SEQ ID NO: 1248544 - DNA, 22 bp, Artificial Sequence
  chemically synthesized
ccaatgtcccctatactaagac

SEQ ID NO: 1248545 - DNA, 22 bp, Artificial Sequence
  chemically synthesized
gggtcaagactagtcttagtat

SEQ ID NO: 1248546 - DNA, 22 bp, Artificial Sequence
  chemically synthesized
agtctggggtcaagactagtct

SEQ ID NO: 1248547 - DNA, 22 bp, Artificial Sequence
  chemically synthesized
cagtctggggtcaagactagtc

SEQ ID NO: 1248548 - DNA, 22 bp, Artificial Sequence
  chemically synthesized
cttcagtctggggtcaagacta

SEQ ID NO: 1248549 - DNA, 22 bp, Artificial Sequence
  chemically synthesized
tactaagactagtcttgacccc

SEQ ID NO: 1248550 - DNA, 22 bp, Artificial Sequence
  chemically synthesized
agttccttcagtctggggtcaa

SEQ ID NO: 1248551 - DNA, 22 bp, Artificial Sequence
  chemically synthesized
aagttccttcagtctggggtca

SEQ ID NO: 1248552 - DNA, 22 bp, Artificial Sequence
  chemically synthesized
taagttccttcagtctggggtc

SEQ ID NO: 1248553 - DNA, 22 bp, Artificial Sequence
  chemically synthesized
agactagtcttgaccccagact

SEQ ID NO: 1248554 - DNA, 22 bp, Artificial Sequence
  chemically synthesized
gtcttgaccccagactgaagga

SEQ ID NO: 1248555 - DNA, 22 bp, Artificial Sequence
  chemically synthesized
gtgggaactttaagttccttca

SEQ ID NO: 1248556 - DNA, 22 bp, Artificial Sequence
  chemically synthesized
gaccccagactgaaggaactta

SEQ ID NO: 1248557 - DNA, 22 bp, Artificial Sequence
  chemically synthesized
accccagactgaaggaacttaa

SEQ ID NO: 1248558 - DNA, 22 bp, Artificial Sequence
  chemically synthesized
ctagtgggaactttaagttcct

SEQ ID NO: 1248559 - DNA, 22 bp, Artificial Sequence
  chemically synthesized
cctagtgggaactttaagttcc

SEQ ID NO: 1248560 - DNA, 22 bp, Artificial Sequence
  chemically synthesized
tttcctagtgggaactttaagt

SEQ ID NO: 1248561 - DNA, 22 bp, Artificial Sequence
  chemically synthesized
ctatttcctagtgggaacttta

SEQ ID NO: 1248562 - DNA, 22 bp, Artificial Sequence
  chemically synthesized
aaggaacttaaagttcccacta

SEQ ID NO: 1248563 - DNA, 22 bp, Artificial Sequence
  chemically synthesized
tgtcaccctactatttcctagt

SEQ ID NO: 1248564 - DNA, 22 bp, Artificial Sequence
  chemically synthesized
aaagttcccactaggaaatagt

SEQ ID NO: 1248565 - DNA, 22 bp, Artificial Sequence
  chemically synthesized
ctatgtcaccctactatttcct

SEQ ID NO: 1248566 - DNA, 22 bp, Artificial Sequence
  chemically synthesized
aagttcccactaggaaatagta

SEQ ID NO: 1248567 - DNA, 22 bp, Artificial Sequence
  chemically synthesized
cctatgtcaccctactatttcc

SEQ ID NO: 1248568 - DNA, 22 bp, Artificial Sequence
  chemically synthesized
tcctatgtcaccctactatttc

SEQ ID NO: 1248569 - DNA, 22 bp, Artificial Sequence
  chemically synthesized
ctttcctatgtcaccctactat

SEQ ID NO: 1248570 - DNA, 22 bp, Artificial Sequence
  chemically synthesized
ccactaggaaatagtagggtga

SEQ ID NO: 1248571 - DNA, 22 bp, Artificial Sequence
  chemically synthesized
ggaaatagtagggtgacatagg

SEQ ID NO: 1248572 - DNA, 22 bp, Artificial Sequence
  chemically synthesized
ggatgagttactttcctatgtc

SEQ ID NO: 1248573 - DNA, 22 bp, Artificial Sequence
  chemically synthesized
cggatgagttactttcctatgt

SEQ ID NO: 1248574 - DNA, 22 bp, Artificial Sequence
  chemically synthesized
tcggatgagttactttcctatg

SEQ ID NO: 1248575 - DNA, 22 bp, Artificial Sequence
  chemically synthesized
ttcggatgagttactttcctat

SEQ ID NO: 1248576 - DNA, 22 bp, Artificial Sequence
  chemically synthesized
aagaaaatcttttcggatgagt

SEQ ID NO: 1248577 - DNA, 22 bp, Artificial Sequence
  chemically synthesized
aaccactaaagaaaatcttttc

SEQ ID NO: 1248578 - DNA, 22 bp, Artificial Sequence
  chemically synthesized
atccgaaaagattttctttagt

SEQ ID NO: 1248579 - DNA, 22 bp, Artificial Sequence
  chemically synthesized
tataggttgaaccactaaagaa

SEQ ID NO: 1248580 - DNA, 22 bp, Artificial Sequence
  chemically synthesized
gtataggttgaaccactaaaga

SEQ ID NO: 1248581 - DNA, 22 bp, Artificial Sequence
  chemically synthesized
tctttagtggttcaacctatac

SEQ ID NO: 1248582 - DNA, 22 bp, Artificial Sequence
  chemically synthesized
ggtggtatgtttgtataggttg

SEQ ID NO: 1248583 - DNA, 22 bp, Artificial Sequence
  chemically synthesized
ctttagtggttcaacctataca

SEQ ID NO: 1248584 - DNA, 22 bp, Artificial Sequence
  chemically synthesized
tttagtggttcaacctatacaa

SEQ ID NO: 1248585 - DNA, 22 bp, Artificial Sequence
  chemically synthesized
tagtggttcaacctatacaaac

SEQ ID NO: 1248586 - DNA, 22 bp, Artificial Sequence
  chemically synthesized
cctgggtggtatgtttgtatag

SEQ ID NO: 1248587 - DNA, 22 bp, Artificial Sequence
  chemically synthesized
agtggttcaacctatacaaaca

SEQ ID NO: 1248588 - DNA, 22 bp, Artificial Sequence
  chemically synthesized
gtggttcaacctatacaaacat

SEQ ID NO: 1248589 - DNA, 22 bp, Artificial Sequence
  chemically synthesized
tattccctgggtggtatgtttg

SEQ ID NO: 1248590 - DNA, 22 bp, Artificial Sequence
  chemically synthesized
ctgtattccctgggtggtatgt

SEQ ID NO: 1248591 - DNA, 22 bp, Artificial Sequence
  chemically synthesized
aacctatacaaacataccaccc

SEQ ID NO: 1248592 - DNA, 22 bp, Artificial Sequence
  chemically synthesized
ggcctgctgtattccctgggtg

SEQ ID NO: 1248593 - DNA, 22 bp, Artificial Sequence
  chemically synthesized
tacaaacataccacccagggaa

SEQ ID NO: 1248594 - DNA, 22 bp, Artificial Sequence
  chemically synthesized
tcactgggcctgctgtattccc

SEQ ID NO: 1248595 - DNA, 22 bp, Artificial Sequence
  chemically synthesized
gaattatcactgggcctgctgt

SEQ ID NO: 1248596 - DNA, 22 bp, Artificial Sequence
  chemically synthesized
aatatgtctagaattatcactg

SEQ ID NO: 1248597 - DNA, 22 bp, Artificial Sequence
  chemically synthesized
tgttgaatatgtctagaattat

SEQ ID NO: 1248598 - DNA, 22 bp, Artificial Sequence
  chemically synthesized
gaaatcattatgttgaatatgt

SEQ ID NO: 1248599 - DNA, 22 bp, Artificial Sequence
  chemically synthesized
attggaaatcattatgttgaat

SEQ ID NO: 1248600 - DNA, 22 bp, Artificial Sequence
  chemically synthesized
cctgattggaaatcattatgtt

SEQ ID NO: 1248601 - DNA, 22 bp, Artificial Sequence
  chemically synthesized
tagacatattcaacataatgat

SEQ ID NO: 1248602 - DNA, 22 bp, Artificial Sequence
  chemically synthesized
gacatattcaacataatgattt

SEQ ID NO: 1248603 - DNA, 22 bp, Artificial Sequence
  chemically synthesized
cctacctgattggaaatcatta

SEQ ID NO: 1248604 - DNA, 22 bp, Artificial Sequence
  chemically synthesized
ctgcctacctgattggaaatca

SEQ ID NO: 1248605 - DNA, 22 bp, Artificial Sequence
  chemically synthesized
cctgcctacctgattggaaatc

SEQ ID NO: 1248606 - DNA, 22 bp, Artificial Sequence
  chemically synthesized
aacataatgatttccaatcagg

SEQ ID NO: 1248607 - DNA, 22 bp, Artificial Sequence
  chemically synthesized
atttcctgcctacctgattgga

SEQ ID NO: 1248608 - DNA, 22 bp, Artificial Sequence
  chemically synthesized
ctcatttcctgcctacctgatt

SEQ ID NO: 1248609 - DNA, 22 bp, Artificial Sequence
  chemically synthesized
cctcatttcctgcctacctgat

SEQ ID NO: 1248610 - DNA, 22 bp, Artificial Sequence
  chemically synthesized
tcctcatttcctgcctacctga

SEQ ID NO: 1248611 - DNA, 22 bp, Artificial Sequence
  chemically synthesized
ttcctcatttcctgcctacctg

SEQ ID NO: 1248612 - DNA, 22 bp, Artificial Sequence
  chemically synthesized
ccaatcaggtaggcaggaaatg

SEQ ID NO: 1248613 - DNA, 22 bp, Artificial Sequence
  chemically synthesized
caatcaggtaggcaggaaatga

SEQ ID NO: 1248614 - DNA, 22 bp, Artificial Sequence
  chemically synthesized
aacagcttttcctcatttcctg

SEQ ID NO: 1248615 - DNA, 22 bp, Artificial Sequence
  chemically synthesized
tcactcaacagcttttcctcat

SEQ ID NO: 1248616 - DNA, 22 bp, Artificial Sequence
  chemically synthesized
actgtcactcaacagcttttcc

SEQ ID NO: 1248617 - DNA, 22 bp, Artificial Sequence
  chemically synthesized
aactgtcactcaacagcttttc

SEQ ID NO: 1248618 - DNA, 22 bp, Artificial Sequence
  chemically synthesized
ccacttaactgtcactcaacag

SEQ ID NO: 1248619 - DNA, 22 bp, Artificial Sequence
  chemically synthesized
cctgccacttaactgtcactca

SEQ ID NO: 1248620 - DNA, 22 bp, Artificial Sequence
  chemically synthesized
ccctgccacttaactgtcactc

SEQ ID NO: 1248621 - DNA, 22 bp, Artificial Sequence
  chemically synthesized
tatatttccctgccacttaact

SEQ ID NO: 1248622 - DNA, 22 bp, Artificial Sequence
  chemically synthesized
ttgagtgacagttaagtggcag

SEQ ID NO: 1248623 - DNA, 22 bp, Artificial Sequence
  chemically synthesized
attatatatttccctgccactt

SEQ ID NO: 1248624 - DNA, 22 bp, Artificial Sequence
  chemically synthesized
agtgacagttaagtggcaggga

SEQ ID NO: 1248625 - DNA, 22 bp, Artificial Sequence
  chemically synthesized
gttaattatatatttccctgcc

SEQ ID NO: 1248626 - DNA, 22 bp, Artificial Sequence
  chemically synthesized
attggttaattatatatttccc

SEQ ID NO: 1248627 - DNA, 22 bp, Artificial Sequence
  chemically synthesized
agtggcagggaaatatataatt

SEQ ID NO: 1248628 - DNA, 22 bp, Artificial Sequence
  chemically synthesized
aattgattggttaattatatat

SEQ ID NO: 1248629 - DNA, 22 bp, Artificial Sequence
  chemically synthesized
ttaaattgattggttaattata

SEQ ID NO: 1248630 - DNA, 22 bp, Artificial Sequence
  chemically synthesized
ttgttaaattgattggttaatt

SEQ ID NO: 1248631 - DNA, 22 bp, Artificial Sequence
  chemically synthesized
attgttgttaaattgattggtt

SEQ ID NO: 1248632 - DNA, 22 bp, Artificial Sequence
  chemically synthesized
actaattgttgttaaattgatt

SEQ ID NO: 1248633 - DNA, 22 bp, Artificial Sequence
  chemically synthesized
aactaattgttgttaaattgat

SEQ ID NO: 1248634 - DNA, 22 bp, Artificial Sequence
  chemically synthesized
taactaattgttgttaaattga

SEQ ID NO: 1248635 - DNA, 22 bp, Artificial Sequence
  chemically synthesized
ttaactaattgttgttaaattg

SEQ ID NO: 1248636 - DNA, 22 bp, Artificial Sequence
  chemically synthesized
accaatcaatttaacaacaatt

SEQ ID NO: 1248637 - DNA, 22 bp, Artificial Sequence
  chemically synthesized
gtaccgcttttaactaattgtt

SEQ ID NO: 1248638 - DNA, 22 bp, Artificial Sequence
  chemically synthesized
ttggtaccgcttttaactaatt

SEQ ID NO: 1248639 - DNA, 22 bp, Artificial Sequence
  chemically synthesized
aacaacaattagttaaaagcgg

SEQ ID NO: 1248640 - DNA, 22 bp, Artificial Sequence
  chemically synthesized
acaacaattagttaaaagcggt

SEQ ID NO: 1248641 - DNA, 22 bp, Artificial Sequence
  chemically synthesized
aataaaagtagctgttggtacc

SEQ ID NO: 1248642 - DNA, 22 bp, Artificial Sequence
  chemically synthesized
gttaaaagcggtaccaacagct

SEQ ID NO: 1248643 - DNA, 22 bp, Artificial Sequence
  chemically synthesized
aaagcggtaccaacagctactt

SEQ ID NO: 1248644 - DNA, 22 bp, Artificial Sequence
  chemically synthesized
gcccatagtaagggctcaataa

SEQ ID NO: 1248645 - DNA, 22 bp, Artificial Sequence
  chemically synthesized
cttttattgagcccttactatg

SEQ ID NO: 1248646 - DNA, 22 bp, Artificial Sequence
  chemically synthesized
ttattgagcccttactatgggc

SEQ ID NO: 1248647 - DNA, 22 bp, Artificial Sequence
  chemically synthesized
tattgagcccttactatgggcc

SEQ ID NO: 1248648 - DNA, 22 bp, Artificial Sequence
  chemically synthesized
attgagcccttactatgggcca

SEQ ID NO: 1248649 - DNA, 22 bp, Artificial Sequence
  chemically synthesized
ttgagcccttactatgggccag

SEQ ID NO: 1248650 - DNA, 22 bp, Artificial Sequence
  chemically synthesized
agcccttactatgggccaggca

SEQ ID NO: 1248651 - DNA, 22 bp, Artificial Sequence
  chemically synthesized
gatgatgtatataaagtgcctg

SEQ ID NO: 1248652 - DNA, 22 bp, Artificial Sequence
  chemically synthesized
actatgggccaggcactttata

SEQ ID NO: 1248653 - DNA, 22 bp, Artificial Sequence
  chemically synthesized
ctatgggccaggcactttatat

SEQ ID NO: 1248654 - DNA, 22 bp, Artificial Sequence
  chemically synthesized
agttagatgatgtatataaagt

SEQ ID NO: 1248655 - DNA, 22 bp, Artificial Sequence
  chemically synthesized
tgggccaggcactttatataca

SEQ ID NO: 1248656 - DNA, 22 bp, Artificial Sequence
  chemically synthesized
gtgaatattaagttagatgatg

SEQ ID NO: 1248657 - DNA, 22 bp, Artificial Sequence
  chemically synthesized
ggtgaatattaagttagatgat

SEQ ID NO: 1248658 - DNA, 22 bp, Artificial Sequence
  chemically synthesized
tggtgaatattaagttagatga

SEQ ID NO: 1248659 - DNA, 22 bp, Artificial Sequence
  chemically synthesized
ttggtgaatattaagttagatg

SEQ ID NO: 1248660 - DNA, 22 bp, Artificial Sequence
  chemically synthesized
tttggtgaatattaagttagat

SEQ ID NO: 1248661 - DNA, 22 bp, Artificial Sequence
  chemically synthesized
tatatacatcatctaacttaat

SEQ ID NO: 1248662 - DNA, 22 bp, Artificial Sequence
  chemically synthesized
atatacatcatctaacttaata

SEQ ID NO: 1248663 - DNA, 22 bp, Artificial Sequence
  chemically synthesized
tatacatcatctaacttaatat

SEQ ID NO: 1248664 - DNA, 22 bp, Artificial Sequence
  chemically synthesized
aattttttggtgaatattaagt

SEQ ID NO: 1248665 - DNA, 22 bp, Artificial Sequence
  chemically synthesized
ctgaattttttggtgaatatta

SEQ ID NO: 1248666 - DNA, 22 bp, Artificial Sequence
  chemically synthesized
cctgaattttttggtgaatatt

SEQ ID NO: 1248667 - DNA, 22 bp, Artificial Sequence
  chemically synthesized
ccttcctgaattttttggtgaa

SEQ ID NO: 1248668 - DNA, 22 bp, Artificial Sequence
  chemically synthesized
acttaatattcaccaaaaaatt

SEQ ID NO: 1248669 - DNA, 22 bp, Artificial Sequence
  chemically synthesized
aatattcaccaaaaaattcagg

SEQ ID NO: 1248670 - DNA, 22 bp, Artificial Sequence
  chemically synthesized
atattcaccaaaaaattcagga

SEQ ID NO: 1248671 - DNA, 22 bp, Artificial Sequence
  chemically synthesized
acaaatattgccttcctgaatt

SEQ ID NO: 1248672 - DNA, 22 bp, Artificial Sequence
  chemically synthesized
accaaaaaattcaggaaggcaa

SEQ ID NO: 1248673 - DNA, 22 bp, Artificial Sequence
  chemically synthesized
aaaatattgacaaatattgcct

SEQ ID NO: 1248674 - DNA, 22 bp, Artificial Sequence
  chemically synthesized
aggaaggcaatatttgtcaata

SEQ ID NO: 1248675 - DNA, 22 bp, Artificial Sequence
  chemically synthesized
aaaaataaaattcaaaatattg

SEQ ID NO: 1248676 - DNA, 22 bp, Artificial Sequence
  chemically synthesized
aaaaaataaaattcaaaatatt

SEQ ID NO: 1248677 - DNA, 22 bp, Artificial Sequence
  chemically synthesized
gtttaaaaaataaaattcaaaa

SEQ ID NO: 1248678 - DNA, 22 bp, Artificial Sequence
  chemically synthesized
gtcaatattttgaattttattt

SEQ ID NO: 1248679 - DNA, 22 bp, Artificial Sequence
  chemically synthesized
cattggtttaaaaaataaaatt

SEQ ID NO: 1248680 - DNA, 22 bp, Artificial Sequence
  chemically synthesized
tcaatattttgaattttatttt

SEQ ID NO: 1248681 - DNA, 22 bp, Artificial Sequence
  chemically synthesized
tccattggtttaaaaaataaaa

SEQ ID NO: 1248682 - DNA, 22 bp, Artificial Sequence
  chemically synthesized
tgaattttattttttaaaccaa

SEQ ID NO: 1248683 - DNA, 22 bp, Artificial Sequence
  chemically synthesized
tcagactctccattggtttaaa

SEQ ID NO: 1248684 - DNA, 22 bp, Artificial Sequence
  chemically synthesized
gaattttattttttaaaccaat

SEQ ID NO: 1248685 - DNA, 22 bp, Artificial Sequence
  chemically synthesized
aattttattttttaaaccaatg

SEQ ID NO: 1248686 - DNA, 22 bp, Artificial Sequence
  chemically synthesized
tgtcagactctccattggttta

SEQ ID NO: 1248687 - DNA, 22 bp, Artificial Sequence
  chemically synthesized
ctgtcagactctccattggttt

SEQ ID NO: 1248688 - DNA, 22 bp, Artificial Sequence
  chemically synthesized
tctgtcagactctccattggtt

SEQ ID NO: 1248689 - DNA, 22 bp, Artificial Sequence
  chemically synthesized
tattttttaaaccaatggagag

SEQ ID NO: 1248690 - DNA, 22 bp, Artificial Sequence
  chemically synthesized
attttttaaaccaatggagagt

SEQ ID NO: 1248691 - DNA, 22 bp, Artificial Sequence
  chemically synthesized
ttttttaaaccaatggagagtc

SEQ ID NO: 1248692 - DNA, 22 bp, Artificial Sequence
  chemically synthesized
aaattttctgtcagactctcca

SEQ ID NO: 1248693 - DNA, 22 bp, Artificial Sequence
  chemically synthesized
tttaaaccaatggagagtctga

SEQ ID NO: 1248694 - DNA, 22 bp, Artificial Sequence
  chemically synthesized
ttaaaccaatggagagtctgac

SEQ ID NO: 1248695 - DNA, 22 bp, Artificial Sequence
  chemically synthesized
ttcaaattttctgtcagactct

SEQ ID NO: 1248696 - DNA, 22 bp, Artificial Sequence
  chemically synthesized
taaaccaatggagagtctgaca

SEQ ID NO: 1248697 - DNA, 22 bp, Artificial Sequence
  chemically synthesized
gttcaaattttctgtcagactc

SEQ ID NO: 1248698 - DNA, 22 bp, Artificial Sequence
  chemically synthesized
aaaccaatggagagtctgacag

SEQ ID NO: 1248699 - DNA, 22 bp, Artificial Sequence
  chemically synthesized
aaccaatggagagtctgacaga

SEQ ID NO: 1248700 - DNA, 22 bp, Artificial Sequence
  chemically synthesized
gtgcaacttgttcaaattttct

SEQ ID NO: 1248701 - DNA, 22 bp, Artificial Sequence
  chemically synthesized
ggtgcaacttgttcaaattttc

SEQ ID NO: 1248702 - DNA, 22 bp, Artificial Sequence
  chemically synthesized
ggacttggtgcaacttgttcaa

SEQ ID NO: 1248703 - DNA, 22 bp, Artificial Sequence
  chemically synthesized
aggacttggtgcaacttgttca

SEQ ID NO: 1248704 - DNA, 22 bp, Artificial Sequence
  chemically synthesized
taggacttggtgcaacttgttc

SEQ ID NO: 1248705 - DNA, 22 bp, Artificial Sequence
  chemically synthesized
acagaaaatttgaacaagttgc

SEQ ID NO: 1248706 - DNA, 22 bp, Artificial Sequence
  chemically synthesized
gttttaggacttggtgcaactt

SEQ ID NO: 1248707 - DNA, 22 bp, Artificial Sequence
  chemically synthesized
ttagttttaggacttggtgcaa

SEQ ID NO: 1248708 - DNA, 22 bp, Artificial Sequence
  chemically synthesized
gaacaagttgcaccaagtccta

SEQ ID NO: 1248709 - DNA, 22 bp, Artificial Sequence
  chemically synthesized
aacaagttgcaccaagtcctaa

SEQ ID NO: 1248710 - DNA, 22 bp, Artificial Sequence
  chemically synthesized
cagcaacatctgttagttttag

SEQ ID NO: 1248711 - DNA, 22 bp, Artificial Sequence
  chemically synthesized
caccaagtcctaaaactaacag

SEQ ID NO: 1248712 - DNA, 22 bp, Artificial Sequence
  chemically synthesized
caattccagcaacatctgttag

SEQ ID NO: 1248713 - DNA, 22 bp, Artificial Sequence
  chemically synthesized
gttccaattccagcaacatctg

SEQ ID NO: 1248714 - DNA, 22 bp, Artificial Sequence
  chemically synthesized
aaactaacagatgttgctggaa

SEQ ID NO: 1248715 - DNA, 22 bp, Artificial Sequence
  chemically synthesized
acagatgttgctggaattggaa

SEQ ID NO: 1248716 - DNA, 22 bp, Artificial Sequence
  chemically synthesized
tagcacatggtcctggttccaa

SEQ ID NO: 1248717 - DNA, 22 bp, Artificial Sequence
  chemically synthesized
ctgtagcacatggtcctggttc

SEQ ID NO: 1248718 - DNA, 22 bp, Artificial Sequence
  chemically synthesized
ctggaattggaaccaggaccat

SEQ ID NO: 1248719 - DNA, 22 bp, Artificial Sequence
  chemically synthesized
gaattggaaccaggaccatgtg

SEQ ID NO: 1248720 - DNA, 22 bp, Artificial Sequence
  chemically synthesized
agcaagttactgtagcacatgg

SEQ ID NO: 1248721 - DNA, 22 bp, Artificial Sequence
  chemically synthesized
gagcaagttactgtagcacatg

SEQ ID NO: 1248722 - DNA, 22 bp, Artificial Sequence
  chemically synthesized
gaaccaggaccatgtgctacag

SEQ ID NO: 1248723 - DNA, 22 bp, Artificial Sequence
  chemically synthesized
gtagaaacttgagcaagttact

SEQ ID NO: 1248724 - DNA, 22 bp, Artificial Sequence
  chemically synthesized
agtagaaacttgagcaagttac

SEQ ID NO: 1248725 - DNA, 22 bp, Artificial Sequence
  chemically synthesized
cagtaacttgctcaagtttcta

SEQ ID NO: 1248726 - DNA, 22 bp, Artificial Sequence
  chemically synthesized
gctcaagtttctactaagctat

SEQ ID NO: 1248727 - DNA, 22 bp, Artificial Sequence
  chemically synthesized
ctcaagtttctactaagctatg

SEQ ID NO: 1248728 - DNA, 22 bp, Artificial Sequence
  chemically synthesized
cgtagagtggagcatagcttag

SEQ ID NO: 1248729 - DNA, 22 bp, Artificial Sequence
  chemically synthesized
aagtttctactaagctatgctc

SEQ ID NO: 1248730 - DNA, 22 bp, Artificial Sequence
  chemically synthesized
gagttgcgtagagtggagcata

SEQ ID NO: 1248731 - DNA, 22 bp, Artificial Sequence
  chemically synthesized
agagttgcgtagagtggagcat

SEQ ID NO: 1248732 - DNA, 22 bp, Artificial Sequence
  chemically synthesized
ctactaagctatgctccactct

SEQ ID NO: 1248733 - DNA, 22 bp, Artificial Sequence
  chemically synthesized
tactaagctatgctccactcta

SEQ ID NO: 1248734 - DNA, 22 bp, Artificial Sequence
  chemically synthesized
ctaagctatgctccactctacg

SEQ ID NO: 1248735 - DNA, 22 bp, Artificial Sequence
  chemically synthesized
agctatgctccactctacgcaa

SEQ ID NO: 1248736 - DNA, 22 bp, Artificial Sequence
  chemically synthesized
atgaaacttagagttgcgtaga

SEQ ID NO: 1248737 - DNA, 22 bp, Artificial Sequence
  chemically synthesized
tgctccactctacgcaactcta

SEQ ID NO: 1248738 - DNA, 22 bp, Artificial Sequence
  chemically synthesized
cactctacgcaactctaagttt

SEQ ID NO: 1248739 - DNA, 22 bp, Artificial Sequence
  chemically synthesized
cagtgtattgatgaaacttaga

SEQ ID NO: 1248740 - DNA, 22 bp, Artificial Sequence
  chemically synthesized
tacgcaactctaagtttcatca

SEQ ID NO: 1248741 - DNA, 22 bp, Artificial Sequence
  chemically synthesized
cgcaactctaagtttcatcaat

SEQ ID NO: 1248742 - DNA, 22 bp, Artificial Sequence
  chemically synthesized
taagtttcatcaatacactgga

SEQ ID NO: 1248743 - DNA, 22 bp, Artificial Sequence
  chemically synthesized
agtttcatcaatacactggaac

SEQ ID NO: 1248744 - DNA, 22 bp, Artificial Sequence
  chemically synthesized
catcaatacactggaactcatt

SEQ ID NO: 1248745 - DNA, 22 bp, Artificial Sequence
  chemically synthesized
atcaatacactggaactcattt

SEQ ID NO: 1248746 - DNA, 22 bp, Artificial Sequence
  chemically synthesized
aggggaatgagtatatgaaatg

SEQ ID NO: 1248747 - DNA, 22 bp, Artificial Sequence
  chemically synthesized
gaactcatttcatatactcatt

SEQ ID NO: 1248748 - DNA, 22 bp, Artificial Sequence
  chemically synthesized
atttcatatactcattcccctt

SEQ ID NO: 1248749 - DNA, 22 bp, Artificial Sequence
  chemically synthesized
atggtaatagactaaggggaat

SEQ ID NO: 1248750 - DNA, 22 bp, Artificial Sequence
  chemically synthesized
catggtaatagactaaggggaa

SEQ ID NO: 1248751 - DNA, 22 bp, Artificial Sequence
  chemically synthesized
catatactcattccccttagtc

SEQ ID NO: 1248752 - DNA, 22 bp, Artificial Sequence
  chemically synthesized
atatactcattccccttagtct

SEQ ID NO: 1248753 - DNA, 22 bp, Artificial Sequence
  chemically synthesized
gtgtatttcatggtaatagact

SEQ ID NO: 1248754 - DNA, 22 bp, Artificial Sequence
  chemically synthesized
attccccttagtctattaccat

SEQ ID NO: 1248755 - DNA, 22 bp, Artificial Sequence
  chemically synthesized
aacctagtgtatttcatggtaa

SEQ ID NO: 1248756 - DNA, 22 bp, Artificial Sequence
  chemically synthesized
cccttagtctattaccatgaaa

SEQ ID NO: 1248757 - DNA, 22 bp, Artificial Sequence
  chemically synthesized
gaacctagtgtatttcatggta

SEQ ID NO: 1248758 - DNA, 22 bp, Artificial Sequence
  chemically synthesized
agtctattaccatgaaatacac

SEQ ID NO: 1248759 - DNA, 22 bp, Artificial Sequence
  chemically synthesized
gtctattaccatgaaatacact

SEQ ID NO: 1248760 - DNA, 22 bp, Artificial Sequence
  chemically synthesized
caagtttgaacctagtgtattt

SEQ ID NO: 1248761 - DNA, 22 bp, Artificial Sequence
  chemically synthesized
ttgcaagtttgaacctagtgta

SEQ ID NO: 1248762 - DNA, 22 bp, Artificial Sequence
  chemically synthesized
ttaccatgaaatacactaggtt

SEQ ID NO: 1248763 - DNA, 22 bp, Artificial Sequence
  chemically synthesized
attgcaagtttgaacctagtgt

SEQ ID NO: 1248764 - DNA, 22 bp, Artificial Sequence
  chemically synthesized
ttattgcaagtttgaacctagt

SEQ ID NO: 1248765 - DNA, 22 bp, Artificial Sequence
  chemically synthesized
ccatgaaatacactaggttcaa

SEQ ID NO: 1248766 - DNA, 22 bp, Artificial Sequence
  chemically synthesized
cttattgcaagtttgaacctag

SEQ ID NO: 1248767 - DNA, 22 bp, Artificial Sequence
  chemically synthesized
atgatttcttattgcaagtttg

SEQ ID NO: 1248768 - DNA, 22 bp, Artificial Sequence
  chemically synthesized
aatgatttcttattgcaagttt

SEQ ID NO: 1248769 - DNA, 22 bp, Artificial Sequence
  chemically synthesized
ggttcaaacttgcaataagaaa

SEQ ID NO: 1248770 - DNA, 22 bp, Artificial Sequence
  chemically synthesized
aaacttgcaataagaaatcatt

SEQ ID NO: 1248771 - DNA, 22 bp, Artificial Sequence
  chemically synthesized
gcaataagaaatcattaaggga

SEQ ID NO: 1248772 - DNA, 22 bp, Artificial Sequence
  chemically synthesized
taaggtgatgagtcccttaatg

SEQ ID NO: 1248773 - DNA, 22 bp, Artificial Sequence
  chemically synthesized
caataagaaatcattaagggac

SEQ ID NO: 1248774 - DNA, 22 bp, Artificial Sequence
  chemically synthesized
gaattgtaaggtgatgagtccc

SEQ ID NO: 1248775 - DNA, 22 bp, Artificial Sequence
  chemically synthesized
ggaattgtaaggtgatgagtcc

SEQ ID NO: 1248776 - DNA, 22 bp, Artificial Sequence
  chemically synthesized
tacttggaattgtaaggtgatg

SEQ ID NO: 1248777 - DNA, 22 bp, Artificial Sequence
  chemically synthesized
tctgtacttggaattgtaaggt

SEQ ID NO: 1248778 - DNA, 22 bp, Artificial Sequence
  chemically synthesized
agggactcatcaccttacaatt

SEQ ID NO: 1248779 - DNA, 22 bp, Artificial Sequence
  chemically synthesized
gtctgtacttggaattgtaagg

SEQ ID NO: 1248780 - DNA, 22 bp, Artificial Sequence
  chemically synthesized
cacacttgtctgtacttggaat

SEQ ID NO: 1248781 - DNA, 22 bp, Artificial Sequence
  chemically synthesized
atcaccttacaattccaagtac

SEQ ID NO: 1248782 - DNA, 22 bp, Artificial Sequence
  chemically synthesized
ccacacttgtctgtacttggaa

SEQ ID NO: 1248783 - DNA, 22 bp, Artificial Sequence
  chemically synthesized
acaattccaagtacagacaagt

SEQ ID NO: 1248784 - DNA, 22 bp, Artificial Sequence
  chemically synthesized
caattccaagtacagacaagtg

SEQ ID NO: 1248785 - DNA, 22 bp, Artificial Sequence
  chemically synthesized
gtaggatcatttccacacttgt

SEQ ID NO: 1248786 - DNA, 22 bp, Artificial Sequence
  chemically synthesized
ggtaggatcatttccacacttg

SEQ ID NO: 1248787 - DNA, 22 bp, Artificial Sequence
  chemically synthesized
caagtacagacaagtgtggaaa

SEQ ID NO: 1248788 - DNA, 22 bp, Artificial Sequence
  chemically synthesized
tttggtaggatcatttccacac

SEQ ID NO: 1248789 - DNA, 22 bp, Artificial Sequence
  chemically synthesized
gtttggtaggatcatttccaca

SEQ ID NO: 1248790 - DNA, 22 bp, Artificial Sequence
  chemically synthesized
cttgtttggtaggatcatttcc

SEQ ID NO: 1248791 - DNA, 22 bp, Artificial Sequence
  chemically synthesized
tccttgtttggtaggatcattt

SEQ ID NO: 1248792 - DNA, 22 bp, Artificial Sequence
  chemically synthesized
ctccttgtttggtaggatcatt

SEQ ID NO: 1248793 - DNA, 22 bp, Artificial Sequence
  chemically synthesized
ccaaacaaggagaagtgtatca

SEQ ID NO: 1248794 - DNA, 22 bp, Artificial Sequence
  chemically synthesized
agaagatgtaaaggcgacagtg

SEQ ID NO: 1248795 - DNA, 22 bp, Artificial Sequence
  chemically synthesized
acatcctgagaagatgtaaagg

SEQ ID NO: 1248796 - DNA, 22 bp, Artificial Sequence
  chemically synthesized
tcgcctttacatcttctcagga

SEQ ID NO: 1248797 - DNA, 22 bp, Artificial Sequence
  chemically synthesized
gagataaagttaacatcctgag

SEQ ID NO: 1248798 - DNA, 22 bp, Artificial Sequence
  chemically synthesized
tacatcttctcaggatgttaac

SEQ ID NO: 1248799 - DNA, 22 bp, Artificial Sequence
  chemically synthesized
acatcttctcaggatgttaact

SEQ ID NO: 1248800 - DNA, 22 bp, Artificial Sequence
  chemically synthesized
agctggagataaagttaacatc

SEQ ID NO: 1248801 - DNA, 22 bp, Artificial Sequence
  chemically synthesized
catcttctcaggatgttaactt

SEQ ID NO: 1248802 - DNA, 22 bp, Artificial Sequence
  chemically synthesized
tcattaagctggagataaagtt

SEQ ID NO: 1248803 - DNA, 22 bp, Artificial Sequence
  chemically synthesized
ctcaggatgttaactttatctc

SEQ ID NO: 1248804 - DNA, 22 bp, Artificial Sequence
  chemically synthesized
gtcattaagctggagataaagt

SEQ ID NO: 1248805 - DNA, 22 bp, Artificial Sequence
  chemically synthesized
tcaggatgttaactttatctcc

SEQ ID NO: 1248806 - DNA, 22 bp, Artificial Sequence
  chemically synthesized
aggatgttaactttatctccag

SEQ ID NO: 1248807 - DNA, 22 bp, Artificial Sequence
  chemically synthesized
tgcttgtcattaagctggagat

SEQ ID NO: 1248808 - DNA, 22 bp, Artificial Sequence
  chemically synthesized
gtgcttgtcattaagctggaga

SEQ ID NO: 1248809 - DNA, 22 bp, Artificial Sequence
  chemically synthesized
actttatctccagcttaatgac

SEQ ID NO: 1248810 - DNA, 22 bp, Artificial Sequence
  chemically synthesized
caagaatttgtgcttgtcatta

SEQ ID NO: 1248811 - DNA, 22 bp, Artificial Sequence
  chemically synthesized
tatctccagcttaatgacaagc

SEQ ID NO: 1248812 - DNA, 22 bp, Artificial Sequence
  chemically synthesized
atctccagcttaatgacaagca

SEQ ID NO: 1248813 - DNA, 22 bp, Artificial Sequence
  chemically synthesized
tctccagcttaatgacaagcac

SEQ ID NO: 1248814 - DNA, 22 bp, Artificial Sequence
  chemically synthesized
cagcttaatgacaagcacaaat

SEQ ID NO: 1248815 - DNA, 22 bp, Artificial Sequence
  chemically synthesized
agaactacaagaatttgtgctt

SEQ ID NO: 1248816 - DNA, 22 bp, Artificial Sequence
  chemically synthesized
aagaactacaagaatttgtgct

SEQ ID NO: 1248817 - DNA, 22 bp, Artificial Sequence
  chemically synthesized
aatgacaagcacaaattcttgt

SEQ ID NO: 1248818 - DNA, 22 bp, Artificial Sequence
  chemically synthesized
atgacaagcacaaattcttgta

SEQ ID NO: 1248819 - DNA, 22 bp, Artificial Sequence
  chemically synthesized
aaatttaagaactacaagaatt

SEQ ID NO: 1248820 - DNA, 22 bp, Artificial Sequence
  chemically synthesized
aagaacagcctgaaatttaaga

SEQ ID NO: 1248821 - DNA, 22 bp, Artificial Sequence
  chemically synthesized
ttgtagttcttaaatttcaggc

SEQ ID NO: 1248822 - DNA, 22 bp, Artificial Sequence
  chemically synthesized
gtagttcttaaatttcaggctg

SEQ ID NO: 1248823 - DNA, 22 bp, Artificial Sequence
  chemically synthesized
tagttcttaaatttcaggctgt

SEQ ID NO: 1248824 - DNA, 22 bp, Artificial Sequence
  chemically synthesized
taaaactaaagaacagcctgaa

SEQ ID NO: 1248825 - DNA, 22 bp, Artificial Sequence
  chemically synthesized
ttaaatttcaggctgttcttta

SEQ ID NO: 1248826 - DNA, 22 bp, Artificial Sequence
  chemically synthesized
aaatttcaggctgttctttagt

SEQ ID NO: 1248827 - DNA, 22 bp, Artificial Sequence
  chemically synthesized
aatttcaggctgttctttagtt

SEQ ID NO: 1248828 - DNA, 22 bp, Artificial Sequence
  chemically synthesized
aatatgtactataaaactaaag

SEQ ID NO: 1248829 - DNA, 22 bp, Artificial Sequence
  chemically synthesized
caggctgttctttagttttata

SEQ ID NO: 1248830 - DNA, 22 bp, Artificial Sequence
  chemically synthesized
aggctgttctttagttttatag

SEQ ID NO: 1248831 - DNA, 22 bp, Artificial Sequence
  chemically synthesized
ttctttagttttatagtacata

SEQ ID NO: 1248832 - DNA, 22 bp, Artificial Sequence
  chemically synthesized
tttagttttatagtacatattt

SEQ ID NO: 1248833 - DNA, 22 bp, Artificial Sequence
  chemically synthesized
tagttttatagtacatatttaa

SEQ ID NO: 1248834 - DNA, 22 bp, Artificial Sequence
  chemically synthesized
agttttatagtacatatttaac

SEQ ID NO: 1248835 - DNA, 22 bp, Artificial Sequence
  chemically synthesized
gttttatagtacatatttaact

SEQ ID NO: 1248836 - DNA, 22 bp, Artificial Sequence
  chemically synthesized
tatagtacatatttaactgtat

SEQ ID NO: 1248837 - DNA, 22 bp, Artificial Sequence
  chemically synthesized
atagtacatatttaactgtatt

SEQ ID NO: 1248838 - DNA, 22 bp, Artificial Sequence
  chemically synthesized
tagtacatatttaactgtattt

SEQ ID NO: 1248839 - DNA, 22 bp, Artificial Sequence
  chemically synthesized
aggcatgggtataaatacagtt

SEQ ID NO: 1248840 - DNA, 22 bp, Artificial Sequence
  chemically synthesized
tcaggcatgggtataaatacag

SEQ ID NO: 1248841 - DNA, 22 bp, Artificial Sequence
  chemically synthesized
ctcaggcatgggtataaataca

SEQ ID NO: 1248842 - DNA, 22 bp, Artificial Sequence
  chemically synthesized
tctcaggcatgggtataaatac

SEQ ID NO: 1248843 - DNA, 22 bp, Artificial Sequence
  chemically synthesized
aactgtatttatacccatgcct

SEQ ID NO: 1248844 - DNA, 22 bp, Artificial Sequence
  chemically synthesized
actgtatttatacccatgcctg

SEQ ID NO: 1248845 - DNA, 22 bp, Artificial Sequence
  chemically synthesized
tatttatacccatgcctgagaa

SEQ ID NO: 1248846 - DNA, 22 bp, Artificial Sequence
  chemically synthesized
taagacacagcattttctcagg

SEQ ID NO: 1248847 - DNA, 22 bp, Artificial Sequence
  chemically synthesized
ataagacacagcattttctcag

SEQ ID NO: 1248848 - DNA, 22 bp, Artificial Sequence
  chemically synthesized
tataagacacagcattttctca

SEQ ID NO: 1248849 - DNA, 22 bp, Artificial Sequence
  chemically synthesized
atacccatgcctgagaaaatgc

SEQ ID NO: 1248850 - DNA, 22 bp, Artificial Sequence
  chemically synthesized
tacccatgcctgagaaaatgct

SEQ ID NO: 1248851 - DNA, 22 bp, Artificial Sequence
  chemically synthesized
tatgactttataagacacagca

SEQ ID NO: 1248852 - DNA, 22 bp, Artificial Sequence
  chemically synthesized
agaaaatgctgtgtcttataaa

SEQ ID NO: 1248853 - DNA, 22 bp, Artificial Sequence
  chemically synthesized
agcattatatgactttataaga

SEQ ID NO: 1248854 - DNA, 22 bp, Artificial Sequence
  chemically synthesized
cagcattatatgactttataag

SEQ ID NO: 1248855 - DNA, 22 bp, Artificial Sequence
  chemically synthesized
accttcagcattatatgacttt

SEQ ID NO: 1248856 - DNA, 22 bp, Artificial Sequence
  chemically synthesized
gaccttcagcattatatgactt

SEQ ID NO: 1248857 - DNA, 22 bp, Artificial Sequence
  chemically synthesized
tgtcttataaagtcatataatg

SEQ ID NO: 1248858 - DNA, 22 bp, Artificial Sequence
  chemically synthesized
cttgaccttcagcattatatga

SEQ ID NO: 1248859 - DNA, 22 bp, Artificial Sequence
  chemically synthesized
ataaagtcatataatgctgaag

SEQ ID NO: 1248860 - DNA, 22 bp, Artificial Sequence
  chemically synthesized
taaagtcatataatgctgaagg

SEQ ID NO: 1248861 - DNA, 22 bp, Artificial Sequence
  chemically synthesized
gcaagagcatattccttgacct

SEQ ID NO: 1248862 - DNA, 22 bp, Artificial Sequence
  chemically synthesized
caaatctggcaagagcatattc

SEQ ID NO: 1248863 - DNA, 22 bp, Artificial Sequence
  chemically synthesized
aaggtcaaggaatatgctcttg

SEQ ID NO: 1248864 - DNA, 22 bp, Artificial Sequence
  chemically synthesized
ggatccctacaaatctggcaag

SEQ ID NO: 1248865 - DNA, 22 bp, Artificial Sequence
  chemically synthesized
ggctaggatccctacaaatctg

SEQ ID NO: 1248866 - DNA, 22 bp, Artificial Sequence
  chemically synthesized
ttgccagatttgtagggatcct

SEQ ID NO: 1248867 - DNA, 22 bp, Artificial Sequence
  chemically synthesized
gccagatttgtagggatcctag

SEQ ID NO: 1248868 - DNA, 22 bp, Artificial Sequence
  chemically synthesized
ccagatttgtagggatcctagc

SEQ ID NO: 1248869 - DNA, 22 bp, Artificial Sequence
  chemically synthesized
cgtgtgagtggtgctaggctag

SEQ ID NO: 1248870 - DNA, 22 bp, Artificial Sequence
  chemically synthesized
gtagggatcctagcctagcacc

SEQ ID NO: 1248871 - DNA, 22 bp, Artificial Sequence
  chemically synthesized
tagggatcctagcctagcacca

SEQ ID NO: 1248872 - DNA, 22 bp, Artificial Sequence
  chemically synthesized
ataaatgattacgtgtgagtgg

SEQ ID NO: 1248873 - DNA, 22 bp, Artificial Sequence
  chemically synthesized
aataaatgattacgtgtgagtg

SEQ ID NO: 1248874 - DNA, 22 bp, Artificial Sequence
  chemically synthesized
taataaatgattacgtgtgagt

SEQ ID NO: 1248875 - DNA, 22 bp, Artificial Sequence
  chemically synthesized
ttaataaatgattacgtgtgag

SEQ ID NO: 1248876 - DNA, 22 bp, Artificial Sequence
  chemically synthesized
gcctagcaccactcacacgtaa

SEQ ID NO: 1248877 - DNA, 22 bp, Artificial Sequence
  chemically synthesized
gcaccactcacacgtaatcatt

SEQ ID NO: 1248878 - DNA, 22 bp, Artificial Sequence
  chemically synthesized
acacgtaatcatttattaaaaa

SEQ ID NO: 1248879 - DNA, 22 bp, Artificial Sequence
  chemically synthesized
gcatcatgatcagaaaaataat

SEQ ID NO: 1248880 - DNA, 22 bp, Artificial Sequence
  chemically synthesized
attaaaaattatttttctgatc

SEQ ID NO: 1248881 - DNA, 22 bp, Artificial Sequence
  chemically synthesized
ttaaaaattatttttctgatca

SEQ ID NO: 1248882 - DNA, 22 bp, Artificial Sequence
  chemically synthesized
aaaattatttttctgatcatga

SEQ ID NO: 1248883 - DNA, 22 bp, Artificial Sequence
  chemically synthesized
aacagattagcatcatgatcag

SEQ ID NO: 1248884 - DNA, 22 bp, Artificial Sequence
  chemically synthesized
tgaacagattagcatcatgatc

SEQ ID NO: 1248885 - DNA, 22 bp, Artificial Sequence
  chemically synthesized
tttttctgatcatgatgctaat

SEQ ID NO: 1248886 - DNA, 22 bp, Artificial Sequence
  chemically synthesized
tgactctgaacagattagcatc

SEQ ID NO: 1248887 - DNA, 22 bp, Artificial Sequence
  chemically synthesized
ttctgatcatgatgctaatctg

SEQ ID NO: 1248888 - DNA, 22 bp, Artificial Sequence
  chemically synthesized
tctgatcatgatgctaatctgt

SEQ ID NO: 1248889 - DNA, 22 bp, Artificial Sequence
  chemically synthesized
ctgatcatgatgctaatctgtt

SEQ ID NO: 1248890 - DNA, 22 bp, Artificial Sequence
  chemically synthesized
tgatcatgatgctaatctgttc

SEQ ID NO: 1248891 - DNA, 22 bp, Artificial Sequence
  chemically synthesized
atcatgatgctaatctgttcag

SEQ ID NO: 1248892 - DNA, 22 bp, Artificial Sequence
  chemically synthesized
tgggcctatgactctgaacaga

SEQ ID NO: 1248893 - DNA, 22 bp, Artificial Sequence
  chemically synthesized
atgggcctatgactctgaacag

SEQ ID NO: 1248894 - DNA, 22 bp, Artificial Sequence
  chemically synthesized
tatgggcctatgactctgaaca

SEQ ID NO: 1248895 - DNA, 22 bp, Artificial Sequence
  chemically synthesized
tctttatgggcctatgactctg

SEQ ID NO: 1248896 - DNA, 22 bp, Artificial Sequence
  chemically synthesized
atctgttcagagtcataggccc

SEQ ID NO: 1248897 - DNA, 22 bp, Artificial Sequence
  chemically synthesized
ttcagagtcataggcccataaa

SEQ ID NO: 1248898 - DNA, 22 bp, Artificial Sequence
  chemically synthesized
agagtcataggcccataaagac

SEQ ID NO: 1248899 - DNA, 22 bp, Artificial Sequence
  chemically synthesized
acccataggaaatattgtcttt

SEQ ID NO: 1248900 - DNA, 22 bp, Artificial Sequence
  chemically synthesized
aacccataggaaatattgtctt

SEQ ID NO: 1248901 - DNA, 22 bp, Artificial Sequence
  chemically synthesized
gcacatcttaacccataggaaa

SEQ ID NO: 1248902 - DNA, 22 bp, Artificial Sequence
  chemically synthesized
atgagattagcacatcttaacc

SEQ ID NO: 1248903 - DNA, 22 bp, Artificial Sequence
  chemically synthesized
agttaatgagattagcacatct

SEQ ID NO: 1248904 - DNA, 22 bp, Artificial Sequence
  chemically synthesized
cctatgggttaagatgtgctaa

SEQ ID NO: 1248905 - DNA, 22 bp, Artificial Sequence
  chemically synthesized
ctatgggttaagatgtgctaat

SEQ ID NO: 1248906 - DNA, 22 bp, Artificial Sequence
  chemically synthesized
ttcagttaatgagattagcaca

SEQ ID NO: 1248907 - DNA, 22 bp, Artificial Sequence
  chemically synthesized
gttcagttaatgagattagcac

SEQ ID NO: 1248908 - DNA, 22 bp, Artificial Sequence
  chemically synthesized
tgggttaagatgtgctaatctc

SEQ ID NO: 1248909 - DNA, 22 bp, Artificial Sequence
  chemically synthesized
gtttgttcagttaatgagatta

SEQ ID NO: 1248910 - DNA, 22 bp, Artificial Sequence
  chemically synthesized
tggtttgttcagttaatgagat

SEQ ID NO: 1248911 - DNA, 22 bp, Artificial Sequence
  chemically synthesized
agatgtgctaatctcattaact

SEQ ID NO: 1248912 - DNA, 22 bp, Artificial Sequence
  chemically synthesized
attctggtttgttcagttaatg

SEQ ID NO: 1248913 - DNA, 22 bp, Artificial Sequence
  chemically synthesized
aattcattctggtttgttcagt

SEQ ID NO: 1248914 - DNA, 22 bp, Artificial Sequence
  chemically synthesized
atctcattaactgaacaaacca

SEQ ID NO: 1248915 - DNA, 22 bp, Artificial Sequence
  chemically synthesized
tgattaaattcattctggtttg

SEQ ID NO: 1248916 - DNA, 22 bp, Artificial Sequence
  chemically synthesized
attaactgaacaaaccagaatg

SEQ ID NO: 1248917 - DNA, 22 bp, Artificial Sequence
  chemically synthesized
ctgtgattaaattcattctggt

SEQ ID NO: 1248918 - DNA, 22 bp, Artificial Sequence
  chemically synthesized
actgaacaaaccagaatgaatt

SEQ ID NO: 1248919 - DNA, 22 bp, Artificial Sequence
  chemically synthesized
actgctgtgattaaattcattc

SEQ ID NO: 1248920 - DNA, 22 bp, Artificial Sequence
  chemically synthesized
gactgctgtgattaaattcatt

SEQ ID NO: 1248921 - DNA, 22 bp, Artificial Sequence
  chemically synthesized
aacaaaccagaatgaatttaat

SEQ ID NO: 1248922 - DNA, 22 bp, Artificial Sequence
  chemically synthesized
ccttgactgctgtgattaaatt

SEQ ID NO: 1248923 - DNA, 22 bp, Artificial Sequence
  chemically synthesized
cccttgactgctgtgattaaat

SEQ ID NO: 1248924 - DNA, 22 bp, Artificial Sequence
  chemically synthesized
aatcacagcagtcaagggaagc

SEQ ID NO: 1248925 - DNA, 22 bp, Artificial Sequence
  chemically synthesized
atcacagcagtcaagggaagct

SEQ ID NO: 1248926 - DNA, 22 bp, Artificial Sequence
  chemically synthesized
gaatgatgcggtagcttccctt

SEQ ID NO: 1248927 - DNA, 22 bp, Artificial Sequence
  chemically synthesized
ggaatgatgcggtagcttccct

SEQ ID NO: 1248928 - DNA, 22 bp, Artificial Sequence
  chemically synthesized
tcttggaatgatgcggtagctt

SEQ ID NO: 1248929 - DNA, 22 bp, Artificial Sequence
  chemically synthesized
gtcttggaatgatgcggtagct

SEQ ID NO: 1248930 - DNA, 22 bp, Artificial Sequence
  chemically synthesized
atttgtcttggaatgatgcggt

SEQ ID NO: 1248931 - DNA, 22 bp, Artificial Sequence
  chemically synthesized
taatttgtcttggaatgatgcg

SEQ ID NO: 1248932 - DNA, 22 bp, Artificial Sequence
  chemically synthesized
ccgcatcattccaagacaaatt

SEQ ID NO: 1248933 - DNA, 22 bp, Artificial Sequence
  chemically synthesized
caagacaaattagagatattgt

SEQ ID NO: 1248934 - DNA, 22 bp, Artificial Sequence
  chemically synthesized
gagatattgtacccctgtggtg

SEQ ID NO: 1248935 - DNA, 22 bp, Artificial Sequence
  chemically synthesized
atcgaaatcaaagataacacca

SEQ ID NO: 1248936 - DNA, 22 bp, Artificial Sequence
  chemically synthesized
taatcgaaatcaaagataacac

SEQ ID NO: 1248937 - DNA, 22 bp, Artificial Sequence
  chemically synthesized
tacccctgtggtgttatctttg

SEQ ID NO: 1248938 - DNA, 22 bp, Artificial Sequence
  chemically synthesized
aaacctctaatcgaaatcaaag

SEQ ID NO: 1248939 - DNA, 22 bp, Artificial Sequence
  chemically synthesized
tggtgttatctttgatttcgat

SEQ ID NO: 1248940 - DNA, 22 bp, Artificial Sequence
  chemically synthesized
tctttgatttcgattagaggtt

SEQ ID NO: 1248941 - DNA, 22 bp, Artificial Sequence
  chemically synthesized
tgatttcgattagaggtttcag

SEQ ID NO: 1248942 - DNA, 22 bp, Artificial Sequence
  chemically synthesized
gatttcgattagaggtttcagg

SEQ ID NO: 1248943 - DNA, 22 bp, Artificial Sequence
  chemically synthesized
atttcgattagaggtttcaggc

SEQ ID NO: 1248944 - DNA, 22 bp, Artificial Sequence
  chemically synthesized
gccataggaagcagcctgaaac

SEQ ID NO: 1248945 - DNA, 22 bp, Artificial Sequence
  chemically synthesized
cgattagaggtttcaggctgct

SEQ ID NO: 1248946 - DNA, 22 bp, Artificial Sequence
  chemically synthesized
gattagaggtttcaggctgctt

SEQ ID NO: 1248947 - DNA, 22 bp, Artificial Sequence
  chemically synthesized
aatctagccataggaagcagcc

SEQ ID NO: 1248948 - DNA, 22 bp, Artificial Sequence
  chemically synthesized
gaatctagccataggaagcagc

SEQ ID NO: 1248949 - DNA, 22 bp, Artificial Sequence
  chemically synthesized
tgaatctagccataggaagcag

SEQ ID NO: 1248950 - DNA, 22 bp, Artificial Sequence
  chemically synthesized
gaggtttcaggctgcttcctat

SEQ ID NO: 1248951 - DNA, 22 bp, Artificial Sequence
  chemically synthesized
atattttgaatctagccatagg

SEQ ID NO: 1248952 - DNA, 22 bp, Artificial Sequence
  chemically synthesized
aatattttgaatctagccatag

SEQ ID NO: 1248953 - DNA, 22 bp, Artificial Sequence
  chemically synthesized
caggctgcttcctatggctaga

SEQ ID NO: 1248954 - DNA, 22 bp, Artificial Sequence
  chemically synthesized
aggctgcttcctatggctagat

SEQ ID NO: 1248955 - DNA, 22 bp, Artificial Sequence
  chemically synthesized
cttcctatggctagattcaaaa

SEQ ID NO: 1248956 - DNA, 22 bp, Artificial Sequence
  chemically synthesized
gtaggcttaatattttgaatct

SEQ ID NO: 1248957 - DNA, 22 bp, Artificial Sequence
  chemically synthesized
agtaggcttaatattttgaatc

SEQ ID NO: 1248958 - DNA, 22 bp, Artificial Sequence
  chemically synthesized
tagtaggcttaatattttgaat

SEQ ID NO: 1248959 - DNA, 22 bp, Artificial Sequence
  chemically synthesized
cctatggctagattcaaaatat

SEQ ID NO: 1248960 - DNA, 22 bp, Artificial Sequence
  chemically synthesized
ctatggctagattcaaaatatt

SEQ ID NO: 1248961 - DNA, 22 bp, Artificial Sequence
  chemically synthesized
tttagtaggcttaatattttga

SEQ ID NO: 1248962 - DNA, 22 bp, Artificial Sequence
  chemically synthesized
tctttagtaggcttaatatttt

SEQ ID NO: 1248963 - DNA, 22 bp, Artificial Sequence
  chemically synthesized
tggctagattcaaaatattaag

SEQ ID NO: 1248964 - DNA, 22 bp, Artificial Sequence
  chemically synthesized
attctctttagtaggcttaata

SEQ ID NO: 1248965 - DNA, 22 bp, Artificial Sequence
  chemically synthesized
cattctctttagtaggcttaat

SEQ ID NO: 1248966 - DNA, 22 bp, Artificial Sequence
  chemically synthesized
tcattctctttagtaggcttaa

SEQ ID NO: 1248967 - DNA, 22 bp, Artificial Sequence
  chemically synthesized
gattcaaaatattaagcctact

SEQ ID NO: 1248968 - DNA, 22 bp, Artificial Sequence
  chemically synthesized
cctttcattctctttagtaggc

SEQ ID NO: 1248969 - DNA, 22 bp, Artificial Sequence
  chemically synthesized
acctttcattctctttagtagg

SEQ ID NO: 1248970 - DNA, 22 bp, Artificial Sequence
  chemically synthesized
aaaatattaagcctactaaaga

SEQ ID NO: 1248971 - DNA, 22 bp, Artificial Sequence
  chemically synthesized
agcctactaaagagaatgaaag

SEQ ID NO: 1248972 - DNA, 22 bp, Artificial Sequence
  chemically synthesized
ctaaagagaatgaaaggtaagt

SEQ ID NO: 1248973 - DNA, 22 bp, Artificial Sequence
  chemically synthesized
aagagaatgaaaggtaagttta

SEQ ID NO: 1248974 - DNA, 22 bp, Artificial Sequence
  chemically synthesized
caagatgcaaagtcataaactt

SEQ ID NO: 1248975 - DNA, 22 bp, Artificial Sequence
  chemically synthesized
tcagtagtgcagttccaagatg

SEQ ID NO: 1248976 - DNA, 22 bp, Artificial Sequence
  chemically synthesized
atgactttgcatcttggaactg

SEQ ID NO: 1248977 - DNA, 22 bp, Artificial Sequence
  chemically synthesized
tgactttgcatcttggaactgc

SEQ ID NO: 1248978 - DNA, 22 bp, Artificial Sequence
  chemically synthesized
cagttatcagtagtgcagttcc

SEQ ID NO: 1248979 - DNA, 22 bp, Artificial Sequence
  chemically synthesized
gcagttatcagtagtgcagttc

SEQ ID NO: 1248980 - DNA, 22 bp, Artificial Sequence
  chemically synthesized
tgcagttatcagtagtgcagtt

SEQ ID NO: 1248981 - DNA, 22 bp, Artificial Sequence
  chemically synthesized
tgcatcttggaactgcactact

SEQ ID NO: 1248982 - DNA, 22 bp, Artificial Sequence
  chemically synthesized
gcatcttggaactgcactactg

SEQ ID NO: 1248983 - DNA, 22 bp, Artificial Sequence
  chemically synthesized
catcttggaactgcactactga

SEQ ID NO: 1248984 - DNA, 22 bp, Artificial Sequence
  chemically synthesized
ggctttgcagttatcagtagtg

SEQ ID NO: 1248985 - DNA, 22 bp, Artificial Sequence
  chemically synthesized
aggctttgcagttatcagtagt

SEQ ID NO: 1248986 - DNA, 22 bp, Artificial Sequence
  chemically synthesized
ggaactgcactactgataactg

SEQ ID NO: 1248987 - DNA, 22 bp, Artificial Sequence
  chemically synthesized
gaactgcactactgataactgc

SEQ ID NO: 1248988 - DNA, 22 bp, Artificial Sequence
  chemically synthesized
aaagccttaggctttgcagtta

SEQ ID NO: 1248989 - DNA, 22 bp, Artificial Sequence
  chemically synthesized
caaagccttaggctttgcagtt

SEQ ID NO: 1248990 - DNA, 22 bp, Artificial Sequence
  chemically synthesized
cactactgataactgcaaagcc

SEQ ID NO: 1248991 - DNA, 22 bp, Artificial Sequence
  chemically synthesized
ttcaaagccttaggctttgcag

SEQ ID NO: 1248992 - DNA, 22 bp, Artificial Sequence
  chemically synthesized
tcttcaaagccttaggctttgc

SEQ ID NO: 1248993 - DNA, 22 bp, Artificial Sequence
  chemically synthesized
ctcttcaaagccttaggctttg

SEQ ID NO: 1248994 - DNA, 22 bp, Artificial Sequence
  chemically synthesized
ctgataactgcaaagcctaagg

SEQ ID NO: 1248995 - DNA, 22 bp, Artificial Sequence
  chemically synthesized
ataactgcaaagcctaaggctt

SEQ ID NO: 1248996 - DNA, 22 bp, Artificial Sequence
  chemically synthesized
tcatttctcttcaaagccttag

SEQ ID NO: 1248997 - DNA, 22 bp, Artificial Sequence
  chemically synthesized
gtcatttctcttcaaagcctta

SEQ ID NO: 1248998 - DNA, 22 bp, Artificial Sequence
  chemically synthesized
tgtcatttctcttcaaagcctt

SEQ ID NO: 1248999 - DNA, 22 bp, Artificial Sequence
  chemically synthesized
ttgtcatttctcttcaaagcct

SEQ ID NO: 1249000 - DNA, 22 bp, Artificial Sequence
  chemically synthesized
tttgtcatttctcttcaaagcc

SEQ ID NO: 1249001 - DNA, 22 bp, Artificial Sequence
  chemically synthesized
ttttgtcatttctcttcaaagc

SEQ ID NO: 1249002 - DNA, 22 bp, Artificial Sequence
  chemically synthesized
caaagcctaaggctttgaagag

SEQ ID NO: 1249003 - DNA, 22 bp, Artificial Sequence
  chemically synthesized
tttttgtcatttctcttcaaag

SEQ ID NO: 1249004 - DNA, 22 bp, Artificial Sequence
  chemically synthesized
ttttttgtcatttctcttcaaa

SEQ ID NO: 1249005 - DNA, 22 bp, Artificial Sequence
  chemically synthesized
acttttttttgtcatttctctt

SEQ ID NO: 1249006 - DNA, 22 bp, Artificial Sequence
  chemically synthesized
aggctttgaagagaaatgacaa

SEQ ID NO: 1249007 - DNA, 22 bp, Artificial Sequence
  chemically synthesized
tgaagagaaatgacaaaaaaaa

SEQ ID NO: 1249008 - DNA, 22 bp, Artificial Sequence
  chemically synthesized
gaagagaaatgacaaaaaaaag

SEQ ID NO: 1249009 - DNA, 22 bp, Artificial Sequence
  chemically synthesized
aagagaaatgacaaaaaaaagt

SEQ ID NO: 1249010 - DNA, 22 bp, Artificial Sequence
  chemically synthesized
tgaaaatatgattgactttttt

SEQ ID NO: 1249011 - DNA, 22 bp, Artificial Sequence
  chemically synthesized
atgaaaatatgattgacttttt

SEQ ID NO: 1249012 - DNA, 22 bp, Artificial Sequence
  chemically synthesized
atatttatgaaaatatgattga

SEQ ID NO: 1249013 - DNA, 22 bp, Artificial Sequence
  chemically synthesized
aatatttatgaaaatatgattg

SEQ ID NO: 1249014 - DNA, 22 bp, Artificial Sequence
  chemically synthesized
ggaagcttaatatttatgaaaa

SEQ ID NO: 1249015 - DNA, 22 bp, Artificial Sequence
  chemically synthesized
tatacaattgggaagcttaata

SEQ ID NO: 1249016 - DNA, 22 bp, Artificial Sequence
  chemically synthesized
atatacaattgggaagcttaat

SEQ ID NO: 1249017 - DNA, 22 bp, Artificial Sequence
  chemically synthesized
tcataaatattaagcttcccaa

SEQ ID NO: 1249018 - DNA, 22 bp, Artificial Sequence
  chemically synthesized
cataaatattaagcttcccaat

SEQ ID NO: 1249019 - DNA, 22 bp, Artificial Sequence
  chemically synthesized
tatttatatacaattgggaagc

SEQ ID NO: 1249020 - DNA, 22 bp, Artificial Sequence
  chemically synthesized
ataaatattaagcttcccaatt

SEQ ID NO: 1249021 - DNA, 22 bp, Artificial Sequence
  chemically synthesized
atatttatatacaattgggaag

SEQ ID NO: 1249022 - DNA, 22 bp, Artificial Sequence
  chemically synthesized
tatatttatatacaattgggaa

SEQ ID NO: 1249023 - DNA, 22 bp, Artificial Sequence
  chemically synthesized
tttatatttatatacaattggg

SEQ ID NO: 1249024 - DNA, 22 bp, Artificial Sequence
  chemically synthesized
ctttatatttatatacaattgg

SEQ ID NO: 1249025 - DNA, 22 bp, Artificial Sequence
  chemically synthesized
tctttatatttatatacaattg

SEQ ID NO: 1249026 - DNA, 22 bp, Artificial Sequence
  chemically synthesized
agcttcccaattgtatataaat

SEQ ID NO: 1249027 - DNA, 22 bp, Artificial Sequence
  chemically synthesized
cccaattgtatataaatataaa

SEQ ID NO: 1249028 - DNA, 22 bp, Artificial Sequence
  chemically synthesized
ccaattgtatataaatataaag

SEQ ID NO: 1249029 - DNA, 22 bp, Artificial Sequence
  chemically synthesized
tatataaatataaagaaaacat

SEQ ID NO: 1249030 - DNA, 22 bp, Artificial Sequence
  chemically synthesized
aaaagtaatgtgcatgttttct

SEQ ID NO: 1249031 - DNA, 22 bp, Artificial Sequence
  chemically synthesized
aaaaagtaatgtgcatgttttc

SEQ ID NO: 1249032 - DNA, 22 bp, Artificial Sequence
  chemically synthesized
taaaaagtaatgtgcatgtttt

SEQ ID NO: 1249033 - DNA, 22 bp, Artificial Sequence
  chemically synthesized
aatcattttaaaaagtaatgtg

SEQ ID NO: 1249034 - DNA, 22 bp, Artificial Sequence
  chemically synthesized
ctgaatcattttaaaaagtaat

SEQ ID NO: 1249035 - DNA, 22 bp, Artificial Sequence
  chemically synthesized
tctcctgaatcattttaaaaag

SEQ ID NO: 1249036 - DNA, 22 bp, Artificial Sequence
  chemically synthesized
atctcctgaatcattttaaaaa

SEQ ID NO: 1249037 - DNA, 22 bp, Artificial Sequence
  chemically synthesized
ctttttaaaatgattcaggaga

SEQ ID NO: 1249038 - DNA, 22 bp, Artificial Sequence
  chemically synthesized
taccagtagtttatctcctgaa

SEQ ID NO: 1249039 - DNA, 22 bp, Artificial Sequence
  chemically synthesized
ataccagtagtttatctcctga

SEQ ID NO: 1249040 - DNA, 22 bp, Artificial Sequence
  chemically synthesized
tttaaaatgattcaggagataa

SEQ ID NO: 1249041 - DNA, 22 bp, Artificial Sequence
  chemically synthesized
ttaaaatgattcaggagataaa

SEQ ID NO: 1249042 - DNA, 22 bp, Artificial Sequence
  chemically synthesized
taaaatgattcaggagataaac

SEQ ID NO: 1249043 - DNA, 22 bp, Artificial Sequence
  chemically synthesized
aaaatgattcaggagataaact

SEQ ID NO: 1249044 - DNA, 22 bp, Artificial Sequence
  chemically synthesized
aaatgattcaggagataaacta

SEQ ID NO: 1249045 - DNA, 22 bp, Artificial Sequence
  chemically synthesized
aggagataaactactggtataa

SEQ ID NO: 1249046 - DNA, 22 bp, Artificial Sequence
  chemically synthesized
gtgataacatgatcacttatac

SEQ ID NO: 1249047 - DNA, 22 bp, Artificial Sequence
  chemically synthesized
agtgataacatgatcacttata

SEQ ID NO: 1249048 - DNA, 22 bp, Artificial Sequence
  chemically synthesized
ctggtataagtgatcatgttat

SEQ ID NO: 1249049 - DNA, 22 bp, Artificial Sequence
  chemically synthesized
atgagatttagtgataacatga

SEQ ID NO: 1249050 - DNA, 22 bp, Artificial Sequence
  chemically synthesized
catgagatttagtgataacatg

SEQ ID NO: 1249051 - DNA, 22 bp, Artificial Sequence
  chemically synthesized
gtataagtgatcatgttatcac

SEQ ID NO: 1249052 - DNA, 22 bp, Artificial Sequence
  chemically synthesized
tcatgagatttagtgataacat

SEQ ID NO: 1249053 - DNA, 22 bp, Artificial Sequence
  chemically synthesized
ttcatgagatttagtgataaca

SEQ ID NO: 1249054 - DNA, 22 bp, Artificial Sequence
  chemically synthesized
atatatttttcatgagatttag

SEQ ID NO: 1249055 - DNA, 22 bp, Artificial Sequence
  chemically synthesized
aatatatttttcatgagattta

SEQ ID NO: 1249056 - DNA, 22 bp, Artificial Sequence
  chemically synthesized
tagcttaatatatttttcatga

SEQ ID NO: 1249057 - DNA, 22 bp, Artificial Sequence
  chemically synthesized
tcactaaatctcatgaaaaata

SEQ ID NO: 1249058 - DNA, 22 bp, Artificial Sequence
  chemically synthesized
atcgttatagcttaatatattt

SEQ ID NO: 1249059 - DNA, 22 bp, Artificial Sequence
  chemically synthesized
aatctcatgaaaaatatattaa

SEQ ID NO: 1249060 - DNA, 22 bp, Artificial Sequence
  chemically synthesized
atgaaaaatatattaagctata

SEQ ID NO: 1249061 - DNA, 22 bp, Artificial Sequence
  chemically synthesized
aaagcaggctaatcgttatagc

SEQ ID NO: 1249062 - DNA, 22 bp, Artificial Sequence
  chemically synthesized
aaaagcaggctaatcgttatag

SEQ ID NO: 1249063 - DNA, 22 bp, Artificial Sequence
  chemically synthesized
taaaagcaggctaatcgttata

SEQ ID NO: 1249064 - DNA, 22 bp, Artificial Sequence
  chemically synthesized
ttaaaagcaggctaatcgttat

SEQ ID NO: 1249065 - DNA, 22 bp, Artificial Sequence
  chemically synthesized
agctataacgattagcctgctt

SEQ ID NO: 1249066 - DNA, 22 bp, Artificial Sequence
  chemically synthesized
atacacatttttaaaagcaggc

SEQ ID NO: 1249067 - DNA, 22 bp, Artificial Sequence
  chemically synthesized
catacacatttttaaaagcagg

SEQ ID NO: 1249068 - DNA, 22 bp, Artificial Sequence
  chemically synthesized
tcatacacatttttaaaagcag

SEQ ID NO: 1249069 - DNA, 22 bp, Artificial Sequence
  chemically synthesized
taacgattagcctgcttttaaa

SEQ ID NO: 1249070 - DNA, 22 bp, Artificial Sequence
  chemically synthesized
actttcatacacatttttaaaa

SEQ ID NO: 1249071 - DNA, 22 bp, Artificial Sequence
  chemically synthesized
gcctgcttttaaaaatgtgtat

SEQ ID NO: 1249072 - DNA, 22 bp, Artificial Sequence
  chemically synthesized
ataactgactttcatacacatt

SEQ ID NO: 1249073 - DNA, 22 bp, Artificial Sequence
  chemically synthesized
aataactgactttcatacacat

SEQ ID NO: 1249074 - DNA, 22 bp, Artificial Sequence
  chemically synthesized
taataactgactttcatacaca

SEQ ID NO: 1249075 - DNA, 22 bp, Artificial Sequence
  chemically synthesized
ttaataactgactttcatacac

SEQ ID NO: 1249076 - DNA, 22 bp, Artificial Sequence
  chemically synthesized
cttttaaaaatgtgtatgaaag

SEQ ID NO: 1249077 - DNA, 22 bp, Artificial Sequence
  chemically synthesized
ttaaaaatgtgtatgaaagtca

SEQ ID NO: 1249078 - DNA, 22 bp, Artificial Sequence
  chemically synthesized
gcttttaataactgactttcat

SEQ ID NO: 1249079 - DNA, 22 bp, Artificial Sequence
  chemically synthesized
taaaaatgtgtatgaaagtcag

SEQ ID NO: 1249080 - DNA, 22 bp, Artificial Sequence
  chemically synthesized
aaaaatgtgtatgaaagtcagt

SEQ ID NO: 1249081 - DNA, 22 bp, Artificial Sequence
  chemically synthesized
aaaatgtgtatgaaagtcagtt

SEQ ID NO: 1249082 - DNA, 22 bp, Artificial Sequence
  chemically synthesized
acaacatcatctagcttttaat

SEQ ID NO: 1249083 - DNA, 22 bp, Artificial Sequence
  chemically synthesized
aacaacatcatctagcttttaa

SEQ ID NO: 1249084 - DNA, 22 bp, Artificial Sequence
  chemically synthesized
tttaacaacatcatctagcttt

SEQ ID NO: 1249085 - DNA, 22 bp, Artificial Sequence
  chemically synthesized
atttaacaacatcatctagctt

SEQ ID NO: 1249086 - DNA, 22 bp, Artificial Sequence
  chemically synthesized
tatttaacaacatcatctagct

SEQ ID NO: 1249087 - DNA, 22 bp, Artificial Sequence
  chemically synthesized
tttatttaacaacatcatctag

SEQ ID NO: 1249088 - DNA, 22 bp, Artificial Sequence
  chemically synthesized
ctttatttaacaacatcatcta

SEQ ID NO: 1249089 - DNA, 22 bp, Artificial Sequence
  chemically synthesized
ttaaaagctagatgatgttgtt

SEQ ID NO: 1249090 - DNA, 22 bp, Artificial Sequence
  chemically synthesized
aaagctagatgatgttgttaaa

SEQ ID NO: 1249091 - DNA, 22 bp, Artificial Sequence
  chemically synthesized
taagtttctttatttaacaaca

SEQ ID NO: 1249092 - DNA, 22 bp, Artificial Sequence
  chemically synthesized
gatgatgttgttaaataaagaa

SEQ ID NO: 1249093 - DNA, 22 bp, Artificial Sequence
  chemically synthesized
aacacattgtaagtttctttat

SEQ ID NO: 1249094 - DNA, 22 bp, Artificial Sequence
  chemically synthesized
caacacattgtaagtttcttta

SEQ ID NO: 1249095 - DNA, 22 bp, Artificial Sequence
  chemically synthesized
ttaaataaagaaacttacaatg

SEQ ID NO: 1249096 - DNA, 22 bp, Artificial Sequence
  chemically synthesized
aataaagaaacttacaatgtgt

SEQ ID NO: 1249097 - DNA, 22 bp, Artificial Sequence
  chemically synthesized
caatagggaaatttcaacacat

SEQ ID NO: 1249098 - DNA, 22 bp, Artificial Sequence
  chemically synthesized
tccaatagggaaatttcaacac

SEQ ID NO: 1249099 - DNA, 22 bp, Artificial Sequence
  chemically synthesized
taattctccaatagggaaattt

SEQ ID NO: 1249100 - DNA, 22 bp, Artificial Sequence
  chemically synthesized
acaatgtgttgaaatttcccta

SEQ ID NO: 1249101 - DNA, 22 bp, Artificial Sequence
  chemically synthesized
ataattctccaatagggaaatt

SEQ ID NO: 1249102 - DNA, 22 bp, Artificial Sequence
  chemically synthesized
caatgtgttgaaatttccctat

SEQ ID NO: 1249103 - DNA, 22 bp, Artificial Sequence
  chemically synthesized
tataattctccaatagggaaat

SEQ ID NO: 1249104 - DNA, 22 bp, Artificial Sequence
  chemically synthesized
ttttataattctccaataggga

SEQ ID NO: 1249105 - DNA, 22 bp, Artificial Sequence
  chemically synthesized
gttttataattctccaataggg

SEQ ID NO: 1249106 - DNA, 22 bp, Artificial Sequence
  chemically synthesized
tttgttttataattctccaata

SEQ ID NO: 1249107 - DNA, 22 bp, Artificial Sequence
  chemically synthesized
atttgttttataattctccaat

SEQ ID NO: 1249108 - DNA, 22 bp, Artificial Sequence
  chemically synthesized
tatttgttttataattctccaa

SEQ ID NO: 1249109 - DNA, 22 bp, Artificial Sequence
  chemically synthesized
aaatttccctattggagaatta

SEQ ID NO: 1249110 - DNA, 22 bp, Artificial Sequence
  chemically synthesized
ttttatttgttttataattctc

SEQ ID NO: 1249111 - DNA, 22 bp, Artificial Sequence
  chemically synthesized
ccctattggagaattataaaac

SEQ ID NO: 1249112 - DNA, 22 bp, Artificial Sequence
  chemically synthesized
cctattggagaattataaaaca

SEQ ID NO: 1249113 - DNA, 22 bp, Artificial Sequence
  chemically synthesized
ttggagaattataaaacaaata

SEQ ID NO: 1249114 - DNA, 22 bp, Artificial Sequence
  chemically synthesized
gagaattataaaacaaataaaa

SEQ ID NO: 1249115 - DNA, 22 bp, Artificial Sequence
  chemically synthesized
taaaacaaataaaatagtgttt

SEQ ID NO: 1249116 - DNA, 22 bp, Artificial Sequence
  chemically synthesized
tgtgatgcatcagaaaaacact

SEQ ID NO: 1249117 - DNA, 22 bp, Artificial Sequence
  chemically synthesized
atgtgatgcatcagaaaaacac

SEQ ID NO: 1249118 - DNA, 22 bp, Artificial Sequence
  chemically synthesized
tatgtgatgcatcagaaaaaca

SEQ ID NO: 1249119 - DNA, 22 bp, Artificial Sequence
  chemically synthesized
cattttatgtgatgcatcagaa

SEQ ID NO: 1249120 - DNA, 22 bp, Artificial Sequence
  chemically synthesized
tacattttatgtgatgcatcag

SEQ ID NO: 1249121 - DNA, 22 bp, Artificial Sequence
  chemically synthesized
ctacattttatgtgatgcatca

SEQ ID NO: 1249122 - DNA, 22 bp, Artificial Sequence
  chemically synthesized
gcttctacattttatgtgatgc

SEQ ID NO: 1249123 - DNA, 22 bp, Artificial Sequence
  chemically synthesized
cgcttctacattttatgtgatg

SEQ ID NO: 1249124 - DNA, 22 bp, Artificial Sequence
  chemically synthesized
ttctgatgcatcacataaaatg

SEQ ID NO: 1249125 - DNA, 22 bp, Artificial Sequence
  chemically synthesized
tctgatgcatcacataaaatgt

SEQ ID NO: 1249126 - DNA, 22 bp, Artificial Sequence
  chemically synthesized
ctgatgcatcacataaaatgta

SEQ ID NO: 1249127 - DNA, 22 bp, Artificial Sequence
  chemically synthesized
aaatttcgcttctacattttat

SEQ ID NO: 1249128 - DNA, 22 bp, Artificial Sequence
  chemically synthesized
tgatgcatcacataaaatgtag

SEQ ID NO: 1249129 - DNA, 22 bp, Artificial Sequence
  chemically synthesized
atgcatcacataaaatgtagaa

SEQ ID NO: 1249130 - DNA, 22 bp, Artificial Sequence
  chemically synthesized
aaccctcaaatttcgcttctac

SEQ ID NO: 1249131 - DNA, 22 bp, Artificial Sequence
  chemically synthesized
taaaccctcaaatttcgcttct

SEQ ID NO: 1249132 - DNA, 22 bp, Artificial Sequence
  chemically synthesized
aaatattctaaaccctcaaatt

SEQ ID NO: 1249133 - DNA, 22 bp, Artificial Sequence
  chemically synthesized
ttgaaatattctaaaccctcaa

SEQ ID NO: 1249134 - DNA, 22 bp, Artificial Sequence
  chemically synthesized
attgaaatattctaaaccctca

SEQ ID NO: 1249135 - DNA, 22 bp, Artificial Sequence
  chemically synthesized
tattgaaatattctaaaccctc

SEQ ID NO: 1249136 - DNA, 22 bp, Artificial Sequence
  chemically synthesized
atattttattgaaatattctaa

SEQ ID NO: 1249137 - DNA, 22 bp, Artificial Sequence
  chemically synthesized
aatattttattgaaatattcta

SEQ ID NO: 1249138 - DNA, 22 bp, Artificial Sequence
  chemically synthesized
gagggtttagaatatttcaata

SEQ ID NO: 1249139 - DNA, 22 bp, Artificial Sequence
  chemically synthesized
agggtttagaatatttcaataa

SEQ ID NO: 1249140 - DNA, 22 bp, Artificial Sequence
  chemically synthesized
cccaggcatttaatattttatt

SEQ ID NO: 1249141 - DNA, 22 bp, Artificial Sequence
  chemically synthesized
agaatatttcaataaaatatta

SEQ ID NO: 1249142 - DNA, 22 bp, Artificial Sequence
  chemically synthesized
gaatatttcaataaaatattaa

SEQ ID NO: 1249143 - DNA, 22 bp, Artificial Sequence
  chemically synthesized
cggagactgcccaggcatttaa

SEQ ID NO: 1249144 - DNA, 22 bp, Artificial Sequence
  chemically synthesized
caataaaatattaaatgcctgg

SEQ ID NO: 1249145 - DNA, 22 bp, Artificial Sequence
  chemically synthesized
aataaaatattaaatgcctggg

SEQ ID NO: 1249146 - DNA, 22 bp, Artificial Sequence
  chemically synthesized
aagggaaacaattacggagact

SEQ ID NO: 1249147 - DNA, 22 bp, Artificial Sequence
  chemically synthesized
aatgcctgggcagtctccgtaa

SEQ ID NO: 1249148 - DNA, 22 bp, Artificial Sequence
  chemically synthesized
cccctcaagggaaacaattacg

SEQ ID NO: 1249149 - DNA, 22 bp, Artificial Sequence
  chemically synthesized
ccccctcaagggaaacaattac

SEQ ID NO: 1249150 - DNA, 22 bp, Artificial Sequence
  chemically synthesized
tccccctcaagggaaacaatta

SEQ ID NO: 1249151 - DNA, 22 bp, Artificial Sequence
  chemically synthesized
ggcagtctccgtaattgtttcc

SEQ ID NO: 1249152 - DNA, 22 bp, Artificial Sequence
  chemically synthesized
ttccccctcaagggaaacaatt

SEQ ID NO: 1249153 - DNA, 22 bp, Artificial Sequence
  chemically synthesized
tttccccctcaagggaaacaat

SEQ ID NO: 1249154 - DNA, 22 bp, Artificial Sequence
  chemically synthesized
ttttccccctcaagggaaacaa

SEQ ID NO: 1249155 - DNA, 22 bp, Artificial Sequence
  chemically synthesized
tttttccccctcaagggaaaca

SEQ ID NO: 1249156 - DNA, 22 bp, Artificial Sequence
  chemically synthesized
ttttttccccctcaagggaaac

SEQ ID NO: 1249157 - DNA, 22 bp, Artificial Sequence
  chemically synthesized
tttttttccccctcaagggaaa

SEQ ID NO: 1249158 - DNA, 22 bp, Artificial Sequence
  chemically synthesized
ttttttttccccctcaagggaa

SEQ ID NO: 1249159 - DNA, 22 bp, Artificial Sequence
  chemically synthesized
tttttttttccccctcaaggga

SEQ ID NO: 1249160 - DNA, 22 bp, Artificial Sequence
  chemically synthesized
ttttttttttccccctcaaggg

SEQ ID NO: 1249161 - DNA, 22 bp, Artificial Sequence
  chemically synthesized
cgtaattgtttcccttgagggg

SEQ ID NO: 1249162 - DNA, 22 bp, Artificial Sequence
  chemically synthesized
tttttttttttccccctcaagg

SEQ ID NO: 1249163 - DNA, 22 bp, Artificial Sequence
  chemically synthesized
ttttttttttttccccctcaag

SEQ ID NO: 1249164 - DNA, 22 bp, Artificial Sequence
  chemically synthesized
tttttttttttttccccctcaa

SEQ ID NO: 1249165 - DNA, 22 bp, Artificial Sequence
  chemically synthesized
ttttttttttttttccccctca

SEQ ID NO: 1249166 - DNA, 22 bp, Artificial Sequence
  chemically synthesized
tttttttttttttttccccctc

SEQ ID NO: 1249167 - DNA, 22 bp, Artificial Sequence
  chemically synthesized
ttttttttttttttttccccct

SEQ ID NO: 1249168 - DNA, 22 bp, Artificial Sequence
  chemically synthesized
tttttttttttttttttccccc

SEQ ID NO: 1249169 - DNA, 22 bp, Artificial Sequence
  chemically synthesized
ttttttttttttttttttcccc

SEQ ID NO: 1249170 - DNA, 22 bp, Artificial Sequence
  chemically synthesized
tttcccttgagggggaaaaaaa

SEQ ID NO: 1249171 - DNA, 22 bp, Artificial Sequence
  chemically synthesized
tttttttttttttttttttccc

SEQ ID NO: 1249172 - DNA, 22 bp, Artificial Sequence
  chemically synthesized
cccttgagggggaaaaaaaaaa

SEQ ID NO: 1249173 - DNA, 22 bp, Artificial Sequence
  chemically synthesized
ccttgagggggaaaaaaaaaaa

SEQ ID NO: 1249174 - DNA, 22 bp, Artificial Sequence
  chemically synthesized
gagggggaaaaaaaaaaaaaaa

SEQ ID NO: 1249175 - DNA, 22 bp, Artificial Sequence
  chemically synthesized
agggggaaaaaaaaaaaaaaaa

SEQ ID NO: 1249176 - DNA, 22 bp, Artificial Sequence
  chemically synthesized
aaaggaaaggtttttttttttt

SEQ ID NO: 1249177 - DNA, 22 bp, Artificial Sequence
  chemically synthesized
cctgaaaggaaaggtttttttt

SEQ ID NO: 1249178 - DNA, 22 bp, Artificial Sequence
  chemically synthesized
ctacctgaaaggaaaggttttt

SEQ ID NO: 1249179 - DNA, 22 bp, Artificial Sequence
  chemically synthesized
tgtgcctactacctgaaaggaa

SEQ ID NO: 1249180 - DNA, 22 bp, Artificial Sequence
  chemically synthesized
tcctttcaggtagtaggcacac

SEQ ID NO: 1249181 - DNA, 22 bp, Artificial Sequence
  chemically synthesized
cctttcaggtagtaggcacaca

SEQ ID NO: 1249182 - DNA, 22 bp, Artificial Sequence
  chemically synthesized
ctttcaggtagtaggcacacag

SEQ ID NO: 1249183 - DNA, 22 bp, Artificial Sequence
  chemically synthesized
tcaggtagtaggcacacagttt

SEQ ID NO: 1249184 - DNA, 22 bp, Artificial Sequence
  chemically synthesized
caggtagtaggcacacagtttt

SEQ ID NO: 1249185 - DNA, 22 bp, Artificial Sequence
  chemically synthesized
aggtagtaggcacacagtttta

SEQ ID NO: 1249186 - DNA, 22 bp, Artificial Sequence
  chemically synthesized
gagagacaaggggtgagtaaaa

SEQ ID NO: 1249187 - DNA, 22 bp, Artificial Sequence
  chemically synthesized
ggagagacaaggggtgagtaaa

SEQ ID NO: 1249188 - DNA, 22 bp, Artificial Sequence
  chemically synthesized
gatttggagagacaaggggtga

SEQ ID NO: 1249189 - DNA, 22 bp, Artificial Sequence
  chemically synthesized
gagtctagatttggagagacaa

SEQ ID NO: 1249190 - DNA, 22 bp, Artificial Sequence
  chemically synthesized
ggagtctagatttggagagaca

SEQ ID NO: 1249191 - DNA, 22 bp, Artificial Sequence
  chemically synthesized
tactcaccccttgtctctccaa

SEQ ID NO: 1249192 - DNA, 22 bp, Artificial Sequence
  chemically synthesized
actcaccccttgtctctccaaa

SEQ ID NO: 1249193 - DNA, 22 bp, Artificial Sequence
  chemically synthesized
ctcaccccttgtctctccaaat

SEQ ID NO: 1249194 - DNA, 22 bp, Artificial Sequence
  chemically synthesized
accccttgtctctccaaatcta

SEQ ID NO: 1249195 - DNA, 22 bp, Artificial Sequence
  chemically synthesized
atatatatttggagtctagatt

SEQ ID NO: 1249196 - DNA, 22 bp, Artificial Sequence
  chemically synthesized
gtctctccaaatctagactcca

SEQ ID NO: 1249197 - DNA, 22 bp, Artificial Sequence
  chemically synthesized
tctctccaaatctagactccaa

SEQ ID NO: 1249198 - DNA, 22 bp, Artificial Sequence
  chemically synthesized
tgactaatatatatttggagtc

SEQ ID NO: 1249199 - DNA, 22 bp, Artificial Sequence
  chemically synthesized
tccaaatctagactccaaatat

SEQ ID NO: 1249200 - DNA, 22 bp, Artificial Sequence
  chemically synthesized
ttgtgactaatatatatttgga

SEQ ID NO: 1249201 - DNA, 22 bp, Artificial Sequence
  chemically synthesized
caaatctagactccaaatatat

SEQ ID NO: 1249202 - DNA, 22 bp, Artificial Sequence
  chemically synthesized
attgtgactaatatatatttgg

SEQ ID NO: 1249203 - DNA, 22 bp, Artificial Sequence
  chemically synthesized
tattgtgactaatatatatttg

SEQ ID NO: 1249204 - DNA, 22 bp, Artificial Sequence
  chemically synthesized
gactccaaatatatattagtca

SEQ ID NO: 1249205 - DNA, 22 bp, Artificial Sequence
  chemically synthesized
caaatatatattagtcacaata

SEQ ID NO: 1249206 - DNA, 22 bp, Artificial Sequence
  chemically synthesized
gtcacaataaaactcacattct

SEQ ID NO: 1249207 - DNA, 22 bp, Artificial Sequence
  chemically synthesized
gtcaagcagaataagaatgtga

SEQ ID NO: 1249208 - DNA, 22 bp, Artificial Sequence
  chemically synthesized
caaattagtcaagcagaataag

SEQ ID NO: 1249209 - DNA, 22 bp, Artificial Sequence
  chemically synthesized
actacaaattagtcaagcagaa

SEQ ID NO: 1249210 - DNA, 22 bp, Artificial Sequence
  chemically synthesized
gactacaaattagtcaagcaga

SEQ ID NO: 1249211 - DNA, 22 bp, Artificial Sequence
  chemically synthesized
acattcttattctgcttgacta

SEQ ID NO: 1249212 - DNA, 22 bp, Artificial Sequence
  chemically synthesized
agcttgactacaaattagtcaa

SEQ ID NO: 1249213 - DNA, 22 bp, Artificial Sequence
  chemically synthesized
ttattctgcttgactaatttgt

SEQ ID NO: 1249214 - DNA, 22 bp, Artificial Sequence
  chemically synthesized
attctgcttgactaatttgtag

SEQ ID NO: 1249215 - DNA, 22 bp, Artificial Sequence
  chemically synthesized
tattcagcttgactacaaatta

SEQ ID NO: 1249216 - DNA, 22 bp, Artificial Sequence
  chemically synthesized
ttctgcttgactaatttgtagt

SEQ ID NO: 1249217 - DNA, 22 bp, Artificial Sequence
  chemically synthesized
tgcttgactaatttgtagtcaa

SEQ ID NO: 1249218 - DNA, 22 bp, Artificial Sequence
  chemically synthesized
aattgtattcagcttgactaca

SEQ ID NO: 1249219 - DNA, 22 bp, Artificial Sequence
  chemically synthesized
cttgactaatttgtagtcaagc

SEQ ID NO: 1249220 - DNA, 22 bp, Artificial Sequence
  chemically synthesized
gactaatttgtagtcaagctga

SEQ ID NO: 1249221 - DNA, 22 bp, Artificial Sequence
  chemically synthesized
actaatttgtagtcaagctgaa

SEQ ID NO: 1249222 - DNA, 22 bp, Artificial Sequence
  chemically synthesized
cactgaattgtattcagcttga

SEQ ID NO: 1249223 - DNA, 22 bp, Artificial Sequence
  chemically synthesized
ccactgaattgtattcagcttg

SEQ ID NO: 1249224 - DNA, 22 bp, Artificial Sequence
  chemically synthesized
atttgtagtcaagctgaataca

SEQ ID NO: 1249225 - DNA, 22 bp, Artificial Sequence
  chemically synthesized
agtttccactgaattgtattca

SEQ ID NO: 1249226 - DNA, 22 bp, Artificial Sequence
  chemically synthesized
gtagtcaagctgaatacaattc

SEQ ID NO: 1249227 - DNA, 22 bp, Artificial Sequence
  chemically synthesized
tagtcaagctgaatacaattca

SEQ ID NO: 1249228 - DNA, 22 bp, Artificial Sequence
  chemically synthesized
atattcagtttccactgaattg

SEQ ID NO: 1249229 - DNA, 22 bp, Artificial Sequence
  chemically synthesized
catattcagtttccactgaatt

SEQ ID NO: 1249230 - DNA, 22 bp, Artificial Sequence
  chemically synthesized
tttcatattcagtttccactga

SEQ ID NO: 1249231 - DNA, 22 bp, Artificial Sequence
  chemically synthesized
atttcatattcagtttccactg

SEQ ID NO: 1249232 - DNA, 22 bp, Artificial Sequence
  chemically synthesized
aatacaattcagtggaaactga

SEQ ID NO: 1249233 - DNA, 22 bp, Artificial Sequence
  chemically synthesized
gatgaatttatttcatattcag

SEQ ID NO: 1249234 - DNA, 22 bp, Artificial Sequence
  chemically synthesized
ttagatgaatttatttcatatt

SEQ ID NO: 1249235 - DNA, 22 bp, Artificial Sequence
  chemically synthesized
agtggaaactgaatatgaaata

SEQ ID NO: 1249236 - DNA, 22 bp, Artificial Sequence
  chemically synthesized
attagatgaatttatttcatat

SEQ ID NO: 1249237 - DNA, 22 bp, Artificial Sequence
  chemically synthesized
tattagatgaatttatttcata

SEQ ID NO: 1249238 - DNA, 22 bp, Artificial Sequence
  chemically synthesized
ttattagatgaatttatttcat

SEQ ID NO: 1249239 - DNA, 22 bp, Artificial Sequence
  chemically synthesized
tttattagatgaatttatttca

SEQ ID NO: 1249240 - DNA, 22 bp, Artificial Sequence
  chemically synthesized
gtacctttttattagatgaatt

SEQ ID NO: 1249241 - DNA, 22 bp, Artificial Sequence
  chemically synthesized
aatatgaaataaattcatctaa

SEQ ID NO: 1249242 - DNA, 22 bp, Artificial Sequence
  chemically synthesized
tacagtcattggtaccttttta

SEQ ID NO: 1249243 - DNA, 22 bp, Artificial Sequence
  chemically synthesized
ttatacagtcattggtaccttt

SEQ ID NO: 1249244 - DNA, 22 bp, Artificial Sequence
  chemically synthesized
atctaataaaaaggtaccaatg

SEQ ID NO: 1249245 - DNA, 22 bp, Artificial Sequence
  chemically synthesized
ataaaaaggtaccaatgactgt

SEQ ID NO: 1249246 - DNA, 22 bp, Artificial Sequence
  chemically synthesized
catatgttgttatacagtcatt

SEQ ID NO: 1249247 - DNA, 22 bp, Artificial Sequence
  chemically synthesized
tctacatatgttgttatacagt

SEQ ID NO: 1249248 - DNA, 22 bp, Artificial Sequence
  chemically synthesized
atctacatatgttgttatacag

SEQ ID NO: 1249249 - DNA, 22 bp, Artificial Sequence
  chemically synthesized
tatctacatatgttgttataca

SEQ ID NO: 1249250 - DNA, 22 bp, Artificial Sequence
  chemically synthesized
ttatctacatatgttgttatac

SEQ ID NO: 1249251 - DNA, 22 bp, Artificial Sequence
  chemically synthesized
tataacaacatatgtagataaa

SEQ ID NO: 1249252 - DNA, 22 bp, Artificial Sequence
  chemically synthesized
tatatgatacacttttatctac

SEQ ID NO: 1249253 - DNA, 22 bp, Artificial Sequence
  chemically synthesized
atatatgatacacttttatcta

SEQ ID NO: 1249254 - DNA, 22 bp, Artificial Sequence
  chemically synthesized
tatatatgatacacttttatct

SEQ ID NO: 1249255 - DNA, 22 bp, Artificial Sequence
  chemically synthesized
aatgttttatatatgatacact

SEQ ID NO: 1249256 - DNA, 22 bp, Artificial Sequence
  chemically synthesized
ccatgtgggattgaatgtttta

SEQ ID NO: 1249257 - DNA, 22 bp, Artificial Sequence
  chemically synthesized
caggaaagctgccatgtgggat

SEQ ID NO: 1249258 - DNA, 22 bp, Artificial Sequence
  chemically synthesized
tattccaggaaagctgccatgt

SEQ ID NO: 1249259 - DNA, 22 bp, Artificial Sequence
  chemically synthesized
atattccaggaaagctgccatg

SEQ ID NO: 1249260 - DNA, 22 bp, Artificial Sequence
  chemically synthesized
tatattccaggaaagctgccat

SEQ ID NO: 1249261 - DNA, 22 bp, Artificial Sequence
  chemically synthesized
aatcccacatggcagctttcct

SEQ ID NO: 1249262 - DNA, 22 bp, Artificial Sequence
  chemically synthesized
tcctggaatataaaatcatttt

SEQ ID NO: 1249263 - DNA, 22 bp, Artificial Sequence
  chemically synthesized
cctggaatataaaatcatttta

SEQ ID NO: 1249264 - DNA, 22 bp, Artificial Sequence
  chemically synthesized
ctggaatataaaatcattttat

SEQ ID NO: 1249265 - DNA, 22 bp, Artificial Sequence
  chemically synthesized
atacccataatgataaaatgat

SEQ ID NO: 1249266 - DNA, 22 bp, Artificial Sequence
  chemically synthesized
gaatataaaatcattttatcat

SEQ ID NO: 1249267 - DNA, 22 bp, Artificial Sequence
  chemically synthesized
atgagctaatacccataatgat

SEQ ID NO: 1249268 - DNA, 22 bp, Artificial Sequence
  chemically synthesized
catgagctaatacccataatga

SEQ ID NO: 1249269 - DNA, 22 bp, Artificial Sequence
  chemically synthesized
acttcatgagctaatacccata

SEQ ID NO: 1249270 - DNA, 22 bp, Artificial Sequence
  chemically synthesized
tatcattatgggtattagctca

SEQ ID NO: 1249271 - DNA, 22 bp, Artificial Sequence
  chemically synthesized
atcattatgggtattagctcat

SEQ ID NO: 1249272 - DNA, 22 bp, Artificial Sequence
  chemically synthesized
tcattatgggtattagctcatg

SEQ ID NO: 1249273 - DNA, 22 bp, Artificial Sequence
  chemically synthesized
aaataatactgacttcatgagc

SEQ ID NO: 1249274 - DNA, 22 bp, Artificial Sequence
  chemically synthesized
aaaataatactgacttcatgag

SEQ ID NO: 1249275 - DNA, 22 bp, Artificial Sequence
  chemically synthesized
taaaataatactgacttcatga

SEQ ID NO: 1249276 - DNA, 22 bp, Artificial Sequence
  chemically synthesized
tgggtattagctcatgaagtca

SEQ ID NO: 1249277 - DNA, 22 bp, Artificial Sequence
  chemically synthesized
ttaaaataatactgacttcatg

SEQ ID NO: 1249278 - DNA, 22 bp, Artificial Sequence
  chemically synthesized
gcatgtttttaaaataatactg

SEQ ID NO: 1249279 - DNA, 22 bp, Artificial Sequence
  chemically synthesized
gctcatgaagtcagtattattt

SEQ ID NO: 1249280 - DNA, 22 bp, Artificial Sequence
  chemically synthesized
agcatgtttttaaaataatact

SEQ ID NO: 1249281 - DNA, 22 bp, Artificial Sequence
  chemically synthesized
ttagcatgtttttaaaataata

SEQ ID NO: 1249282 - DNA, 22 bp, Artificial Sequence
  chemically synthesized
atgaagtcagtattattttaaa

SEQ ID NO: 1249283 - DNA, 22 bp, Artificial Sequence
  chemically synthesized
acattcttagcatgtttttaaa

SEQ ID NO: 1249284 - DNA, 22 bp, Artificial Sequence
  chemically synthesized
aagctaacattcttagcatgtt

SEQ ID NO: 1249285 - DNA, 22 bp, Artificial Sequence
  chemically synthesized
gaagctaacattcttagcatgt

SEQ ID NO: 1249286 - DNA, 22 bp, Artificial Sequence
  chemically synthesized
tgaagctaacattcttagcatg

SEQ ID NO: 1249287 - DNA, 22 bp, Artificial Sequence
  chemically synthesized
ttttaaaaacatgctaagaatg

SEQ ID NO: 1249288 - DNA, 22 bp, Artificial Sequence
  chemically synthesized
aattttgaagctaacattctta

SEQ ID NO: 1249289 - DNA, 22 bp, Artificial Sequence
  chemically synthesized
taaaaacatgctaagaatgtta

SEQ ID NO: 1249290 - DNA, 22 bp, Artificial Sequence
  chemically synthesized
aaaaacatgctaagaatgttag

SEQ ID NO: 1249291 - DNA, 22 bp, Artificial Sequence
  chemically synthesized
aaaacatgctaagaatgttagc

SEQ ID NO: 1249292 - DNA, 22 bp, Artificial Sequence
  chemically synthesized
agatattaaattttgaagctaa

SEQ ID NO: 1249293 - DNA, 22 bp, Artificial Sequence
  chemically synthesized
gagatattaaattttgaagcta

SEQ ID NO: 1249294 - DNA, 22 bp, Artificial Sequence
  chemically synthesized
tgagatattaaattttgaagct

SEQ ID NO: 1249295 - DNA, 22 bp, Artificial Sequence
  chemically synthesized
ttgagatattaaattttgaagc

SEQ ID NO: 1249296 - DNA, 22 bp, Artificial Sequence
  chemically synthesized
agaatgttagcttcaaaattta

SEQ ID NO: 1249297 - DNA, 22 bp, Artificial Sequence
  chemically synthesized
cttttgagatattaaattttga

SEQ ID NO: 1249298 - DNA, 22 bp, Artificial Sequence
  chemically synthesized
gcttcaaaatttaatatctcaa

SEQ ID NO: 1249299 - DNA, 22 bp, Artificial Sequence
  chemically synthesized
caaaatttaatatctcaaaagc

SEQ ID NO: 1249300 - DNA, 22 bp, Artificial Sequence
  chemically synthesized
aaaatttaatatctcaaaagca

SEQ ID NO: 1249301 - DNA, 22 bp, Artificial Sequence
  chemically synthesized
gtataaccaaaatcctgctttt

SEQ ID NO: 1249302 - DNA, 22 bp, Artificial Sequence
  chemically synthesized
ggtataaccaaaatcctgcttt

SEQ ID NO: 1249303 - DNA, 22 bp, Artificial Sequence
  chemically synthesized
aatatctcaaaagcaggatttt

SEQ ID NO: 1249304 - DNA, 22 bp, Artificial Sequence
  chemically synthesized
atatctcaaaagcaggattttg

SEQ ID NO: 1249305 - DNA, 22 bp, Artificial Sequence
  chemically synthesized
taaaccacttggtataaccaaa

SEQ ID NO: 1249306 - DNA, 22 bp, Artificial Sequence
  chemically synthesized
aaaagcaggattttggttatac

SEQ ID NO: 1249307 - DNA, 22 bp, Artificial Sequence
  chemically synthesized
ataaaccacttggtataaccaa

SEQ ID NO: 1249308 - DNA, 22 bp, Artificial Sequence
  chemically synthesized
tataaaccacttggtataacca

SEQ ID NO: 1249309 - DNA, 22 bp, Artificial Sequence
  chemically synthesized
ttttataaaccacttggtataa

SEQ ID NO: 1249310 - DNA, 22 bp, Artificial Sequence
  chemically synthesized
tattttataaaccacttggtat

SEQ ID NO: 1249311 - DNA, 22 bp, Artificial Sequence
  chemically synthesized
tggttataccaagtggtttata

SEQ ID NO: 1249312 - DNA, 22 bp, Artificial Sequence
  chemically synthesized
ggttataccaagtggtttataa

SEQ ID NO: 1249313 - DNA, 22 bp, Artificial Sequence
  chemically synthesized
gttataccaagtggtttataaa

SEQ ID NO: 1249314 - DNA, 22 bp, Artificial Sequence
  chemically synthesized
taccaagtggtttataaaatag

SEQ ID NO: 1249315 - DNA, 22 bp, Artificial Sequence
  chemically synthesized
tgtatggataaatatctctatt

SEQ ID NO: 1249316 - DNA, 22 bp, Artificial Sequence
  chemically synthesized
ataaaatagagatatttatcca

SEQ ID NO: 1249317 - DNA, 22 bp, Artificial Sequence
  chemically synthesized
taaaatagagatatttatccat

SEQ ID NO: 1249318 - DNA, 22 bp, Artificial Sequence
  chemically synthesized
tcacataaaactgtgtatggat

SEQ ID NO: 1249319 - DNA, 22 bp, Artificial Sequence
  chemically synthesized
aattgtcacataaaactgtgta

SEQ ID NO: 1249320 - DNA, 22 bp, Artificial Sequence
  chemically synthesized
atccatacacagttttatgtga

SEQ ID NO: 1249321 - DNA, 22 bp, Artificial Sequence
  chemically synthesized
tccatacacagttttatgtgac

SEQ ID NO: 1249322 - DNA, 22 bp, Artificial Sequence
  chemically synthesized
taaggacacctaaattgtcaca

SEQ ID NO: 1249323 - DNA, 22 bp, Artificial Sequence
  chemically synthesized
tatgtgacaatttaggtgtcct

SEQ ID NO: 1249324 - DNA, 22 bp, Artificial Sequence
  chemically synthesized
atgtgacaatttaggtgtcctt

SEQ ID NO: 1249325 - DNA, 22 bp, Artificial Sequence
  chemically synthesized
tgtgacaatttaggtgtcctta

SEQ ID NO: 1249326 - DNA, 22 bp, Artificial Sequence
  chemically synthesized
cccaccaagaagctataaggac

SEQ ID NO: 1249327 - DNA, 22 bp, Artificial Sequence
  chemically synthesized
cactgcccaccaagaagctata

SEQ ID NO: 1249328 - DNA, 22 bp, Artificial Sequence
  chemically synthesized
acactgcccaccaagaagctat

SEQ ID NO: 1249329 - DNA, 22 bp, Artificial Sequence
  chemically synthesized
aggtgtccttatagcttcttgg

SEQ ID NO: 1249330 - DNA, 22 bp, Artificial Sequence
  chemically synthesized
ggtgtccttatagcttcttggt

SEQ ID NO: 1249331 - DNA, 22 bp, Artificial Sequence
  chemically synthesized
ccagtttacactgcccaccaag

SEQ ID NO: 1249332 - DNA, 22 bp, Artificial Sequence
  chemically synthesized
accagtttacactgcccaccaa

SEQ ID NO: 1249333 - DNA, 22 bp, Artificial Sequence
  chemically synthesized
taccagtttacactgcccacca

SEQ ID NO: 1249334 - DNA, 22 bp, Artificial Sequence
  chemically synthesized
ttaccagtttacactgcccacc

SEQ ID NO: 1249335 - DNA, 22 bp, Artificial Sequence
  chemically synthesized
tttaccagtttacactgcccac

SEQ ID NO: 1249336 - DNA, 22 bp, Artificial Sequence
  chemically synthesized
atagcttcttggtgggcagtgt

SEQ ID NO: 1249337 - DNA, 22 bp, Artificial Sequence
  chemically synthesized
tagcttcttggtgggcagtgta

SEQ ID NO: 1249338 - DNA, 22 bp, Artificial Sequence
  chemically synthesized
ttttttaccagtttacactgcc

SEQ ID NO: 1249339 - DNA, 22 bp, Artificial Sequence
  chemically synthesized
ttattttttaccagtttacact

SEQ ID NO: 1249340 - DNA, 22 bp, Artificial Sequence
  chemically synthesized
cttggtgggcagtgtaaactgg

SEQ ID NO: 1249341 - DNA, 22 bp, Artificial Sequence
  chemically synthesized
ttggtgggcagtgtaaactggt

SEQ ID NO: 1249342 - DNA, 22 bp, Artificial Sequence
  chemically synthesized
ttattattttttaccagtttac

SEQ ID NO: 1249343 - DNA, 22 bp, Artificial Sequence
  chemically synthesized
ggtgggcagtgtaaactggtaa

SEQ ID NO: 1249344 - DNA, 22 bp, Artificial Sequence
  chemically synthesized
gtgggcagtgtaaactggtaaa

SEQ ID NO: 1249345 - DNA, 22 bp, Artificial Sequence
  chemically synthesized
ttattattattttttaccagtt

SEQ ID NO: 1249346 - DNA, 22 bp, Artificial Sequence
  chemically synthesized
ttattattattattttttacca

SEQ ID NO: 1249347 - DNA, 22 bp, Artificial Sequence
  chemically synthesized
gcaaaattattattattattat

SEQ ID NO: 1249348 - DNA, 22 bp, Artificial Sequence
  chemically synthesized
agcaaaattattattattatta

SEQ ID NO: 1249349 - DNA, 22 bp, Artificial Sequence
  chemically synthesized
gtaaaaaataataataataata

SEQ ID NO: 1249350 - DNA, 22 bp, Artificial Sequence
  chemically synthesized
tatgtatcgcaaaaatacttag

SEQ ID NO: 1249351 - DNA, 22 bp, Artificial Sequence
  chemically synthesized
atatgtatcgcaaaaatactta

SEQ ID NO: 1249352 - DNA, 22 bp, Artificial Sequence
  chemically synthesized
tatatgtatcgcaaaaatactt

SEQ ID NO: 1249353 - DNA, 22 bp, Artificial Sequence
  chemically synthesized
tgctaagtatttttgcgataca

SEQ ID NO: 1249354 - DNA, 22 bp, Artificial Sequence
  chemically synthesized
gctaagtatttttgcgatacat

SEQ ID NO: 1249355 - DNA, 22 bp, Artificial Sequence
  chemically synthesized
aagggtctttatatgtatcgca

SEQ ID NO: 1249356 - DNA, 22 bp, Artificial Sequence
  chemically synthesized
ctaagtatttttgcgatacata

SEQ ID NO: 1249357 - DNA, 22 bp, Artificial Sequence
  chemically synthesized
aaagggtctttatatgtatcgc

SEQ ID NO: 1249358 - DNA, 22 bp, Artificial Sequence
  chemically synthesized
taaagggtctttatatgtatcg

SEQ ID NO: 1249359 - DNA, 22 bp, Artificial Sequence
  chemically synthesized
ttaaagggtctttatatgtatc

SEQ ID NO: 1249360 - DNA, 22 bp, Artificial Sequence
  chemically synthesized
agtatttttgcgatacatataa

SEQ ID NO: 1249361 - DNA, 22 bp, Artificial Sequence
  chemically synthesized
tttaaagggtctttatatgtat

SEQ ID NO: 1249362 - DNA, 22 bp, Artificial Sequence
  chemically synthesized
acattttttaaagggtctttat

SEQ ID NO: 1249363 - DNA, 22 bp, Artificial Sequence
  chemically synthesized
ttgcgatacatataaagaccct

SEQ ID NO: 1249364 - DNA, 22 bp, Artificial Sequence
  chemically synthesized
tgcgatacatataaagaccctt

SEQ ID NO: 1249365 - DNA, 22 bp, Artificial Sequence
  chemically synthesized
gcgatacatataaagacccttt

SEQ ID NO: 1249366 - DNA, 22 bp, Artificial Sequence
  chemically synthesized
cgatacatataaagacccttta

SEQ ID NO: 1249367 - DNA, 22 bp, Artificial Sequence
  chemically synthesized
taaaaaatgttaatatcctggc

SEQ ID NO: 1249368 - DNA, 22 bp, Artificial Sequence
  chemically synthesized
aaaaaatgttaatatcctggct

SEQ ID NO: 1249369 - DNA, 22 bp, Artificial Sequence
  chemically synthesized
aaaaatgttaatatcctggctg

SEQ ID NO: 1249370 - DNA, 22 bp, Artificial Sequence
  chemically synthesized
agccaccgtgcccagccaggat

SEQ ID NO: 1249371 - DNA, 22 bp, Artificial Sequence
  chemically synthesized
gagccaccgtgcccagccagga

SEQ ID NO: 1249372 - DNA, 22 bp, Artificial Sequence
  chemically synthesized
caggcttgagccaccgtgccca

SEQ ID NO: 1249373 - DNA, 22 bp, Artificial Sequence
  chemically synthesized
atatcctggctgggcacggtgg

SEQ ID NO: 1249374 - DNA, 22 bp, Artificial Sequence
  chemically synthesized
ggattacaggcttgagccaccg

SEQ ID NO: 1249375 - DNA, 22 bp, Artificial Sequence
  chemically synthesized
gctgggcacggtggctcaagcc

SEQ ID NO: 1249376 - DNA, 22 bp, Artificial Sequence
  chemically synthesized
ggcacggtggctcaagcctgta

SEQ ID NO: 1249377 - DNA, 22 bp, Artificial Sequence
  chemically synthesized
ccaaagtgctgggattacaggc

SEQ ID NO: 1249378 - DNA, 22 bp, Artificial Sequence
  chemically synthesized
ggcctcccaaagtgctgggatt

SEQ ID NO: 1249379 - DNA, 22 bp, Artificial Sequence
  chemically synthesized
aagcctgtaatcccagcacttt

SEQ ID NO: 1249380 - DNA, 22 bp, Artificial Sequence
  chemically synthesized
ccacctcggcctcccaaagtgc

SEQ ID NO: 1249381 - DNA, 22 bp, Artificial Sequence
  chemically synthesized
cccacctcggcctcccaaagtg

SEQ ID NO: 1249382 - DNA, 22 bp, Artificial Sequence
  chemically synthesized
taatcccagcactttgggaggc

SEQ ID NO: 1249383 - DNA, 22 bp, Artificial Sequence
  chemically synthesized
taatcttcccacctcggcctcc

SEQ ID NO: 1249384 - DNA, 22 bp, Artificial Sequence
  chemically synthesized
gtaatcttcccacctcggcctc

SEQ ID NO: 1249385 - DNA, 22 bp, Artificial Sequence
  chemically synthesized
accttgtaatcttcccacctcg

SEQ ID NO: 1249386 - DNA, 22 bp, Artificial Sequence
  chemically synthesized
ctgaccttgtaatcttcccacc

SEQ ID NO: 1249387 - DNA, 22 bp, Artificial Sequence
  chemically synthesized
tgggaggccgaggtgggaagat

SEQ ID NO: 1249388 - DNA, 22 bp, Artificial Sequence
  chemically synthesized
gggaggccgaggtgggaagatt

SEQ ID NO: 1249389 - DNA, 22 bp, Artificial Sequence
  chemically synthesized
ggaggccgaggtgggaagatta

SEQ ID NO: 1249390 - DNA, 22 bp, Artificial Sequence
  chemically synthesized
gatctcctgaccttgtaatctt

SEQ ID NO: 1249391 - DNA, 22 bp, Artificial Sequence
  chemically synthesized
gccaggatggtctcgatctcct

SEQ ID NO: 1249392 - DNA, 22 bp, Artificial Sequence
  chemically synthesized
caaggtcaggagatcgagacca

SEQ ID NO: 1249393 - DNA, 22 bp, Artificial Sequence
  chemically synthesized
accgtgttcgccaggatggtct

SEQ ID NO: 1249394 - DNA, 22 bp, Artificial Sequence
  chemically synthesized
caccgtgttcgccaggatggtc

SEQ ID NO: 1249395 - DNA, 22 bp, Artificial Sequence
  chemically synthesized
gtagagacggggtttcaccgtg

SEQ ID NO: 1249396 - DNA, 22 bp, Artificial Sequence
  chemically synthesized
agtagagacggggtttcaccgt

SEQ ID NO: 1249397 - DNA, 22 bp, Artificial Sequence
  chemically synthesized
tagtagagacggggtttcaccg

SEQ ID NO: 1249398 - DNA, 22 bp, Artificial Sequence
  chemically synthesized
ttagtagagacggggtttcacc

SEQ ID NO: 1249399 - DNA, 22 bp, Artificial Sequence
  chemically synthesized
gcgaacacggtgaaaccccgtc

SEQ ID NO: 1249400 - DNA, 22 bp, Artificial Sequence
  chemically synthesized
tatttttagtagagacggggtt

SEQ ID NO: 1249401 - DNA, 22 bp, Artificial Sequence
  chemically synthesized
gtatttttagtagagacggggt

SEQ ID NO: 1249402 - DNA, 22 bp, Artificial Sequence
  chemically synthesized
tgtatttttagtagagacgggg

SEQ ID NO: 1249403 - DNA, 22 bp, Artificial Sequence
  chemically synthesized
ttgtatttttagtagagacggg

SEQ ID NO: 1249404 - DNA, 22 bp, Artificial Sequence
  chemically synthesized
tttgtatttttagtagagacgg

SEQ ID NO: 1249405 - DNA, 22 bp, Artificial Sequence
  chemically synthesized
actttttgtatttttagtagag

SEQ ID NO: 1249406 - DNA, 22 bp, Artificial Sequence
  chemically synthesized
gctaactttttgtatttttagt

SEQ ID NO: 1249407 - DNA, 22 bp, Artificial Sequence
  chemically synthesized
tactaaaaatacaaaaagttag

SEQ ID NO: 1249408 - DNA, 22 bp, Artificial Sequence
  chemically synthesized
ccaccacgcctggctaactttt

SEQ ID NO: 1249409 - DNA, 22 bp, Artificial Sequence
  chemically synthesized
ctaaaaatacaaaaagttagcc

SEQ ID NO: 1249410 - DNA, 22 bp, Artificial Sequence
  chemically synthesized
aaaatacaaaaagttagccagg

SEQ ID NO: 1249411 - DNA, 22 bp, Artificial Sequence
  chemically synthesized
ggaccacaggcgcctgccacca

SEQ ID NO: 1249412 - DNA, 22 bp, Artificial Sequence
  chemically synthesized
gccaggcgtggtggcaggcgcc

SEQ ID NO: 1249413 - DNA, 22 bp, Artificial Sequence
  chemically synthesized
ccgagtagctgggaccacaggc

SEQ ID NO: 1249414 - DNA, 22 bp, Artificial Sequence
  chemically synthesized
agcctcccgagtagctgggacc

SEQ ID NO: 1249415 - DNA, 22 bp, Artificial Sequence
  chemically synthesized
cctcagcctcccgagtagctgg

SEQ ID NO: 1249416 - DNA, 22 bp, Artificial Sequence
  chemically synthesized
ctgcctcagcctcccgagtagc

SEQ ID NO: 1249417 - DNA, 22 bp, Artificial Sequence
  chemically synthesized
tcctgcctcagcctcccgagta

SEQ ID NO: 1249418 - DNA, 22 bp, Artificial Sequence
  chemically synthesized
tggtcccagctactcgggaggc

SEQ ID NO: 1249419 - DNA, 22 bp, Artificial Sequence
  chemically synthesized
acgccattctcctgcctcagcc

SEQ ID NO: 1249420 - DNA, 22 bp, Artificial Sequence
  chemically synthesized
ctcgggaggctgaggcaggaga

SEQ ID NO: 1249421 - DNA, 22 bp, Artificial Sequence
  chemically synthesized
ggttcacgccattctcctgcct

SEQ ID NO: 1249422 - DNA, 22 bp, Artificial Sequence
  chemically synthesized
gggaggctgaggcaggagaatg

SEQ ID NO: 1249423 - DNA, 22 bp, Artificial Sequence
  chemically synthesized
ctgggttcacgccattctcctg

SEQ ID NO: 1249424 - DNA, 22 bp, Artificial Sequence
  chemically synthesized
gcctcctgggttcacgccattc

SEQ ID NO: 1249425 - DNA, 22 bp, Artificial Sequence
  chemically synthesized
cgcctcctgggttcacgccatt

SEQ ID NO: 1249426 - DNA, 22 bp, Artificial Sequence
  chemically synthesized
aggcaggagaatggcgtgaacc

SEQ ID NO: 1249427 - DNA, 22 bp, Artificial Sequence
  chemically synthesized
caagcttcgcctcctgggttca

SEQ ID NO: 1249428 - DNA, 22 bp, Artificial Sequence
  chemically synthesized
actgcaagcttcgcctcctggg

SEQ ID NO: 1249429 - DNA, 22 bp, Artificial Sequence
  chemically synthesized
ggctcactgcaagcttcgcctc

SEQ ID NO: 1249430 - DNA, 22 bp, Artificial Sequence
  chemically synthesized
gagtgcagtggcgcgatctcgg

SEQ ID NO: 1249431 - DNA, 22 bp, Artificial Sequence
  chemically synthesized
gcagtgagccgagatcgcgcca

SEQ ID NO: 1249432 - DNA, 22 bp, Artificial Sequence
  chemically synthesized
cagtgagccgagatcgcgccac

SEQ ID NO: 1249433 - DNA, 22 bp, Artificial Sequence
  chemically synthesized
tcgcccaggctggagtgcagtg

SEQ ID NO: 1249434 - DNA, 22 bp, Artificial Sequence
  chemically synthesized
tgtcgcccaggctggagtgcag

SEQ ID NO: 1249435 - DNA, 22 bp, Artificial Sequence
  chemically synthesized
ctctgtcgcccaggctggagtg

SEQ ID NO: 1249436 - DNA, 22 bp, Artificial Sequence
  chemically synthesized
gctctgtcgcccaggctggagt

SEQ ID NO: 1249437 - DNA, 22 bp, Artificial Sequence
  chemically synthesized
cactccagcctgggcgacagag

SEQ ID NO: 1249438 - DNA, 22 bp, Artificial Sequence
  chemically synthesized
agacggagtcttgctctgtcgc

SEQ ID NO: 1249439 - DNA, 22 bp, Artificial Sequence
  chemically synthesized
gagacggagtcttgctctgtcg

SEQ ID NO: 1249440 - DNA, 22 bp, Artificial Sequence
  chemically synthesized
tgagacggagtcttgctctgtc

SEQ ID NO: 1249441 - DNA, 22 bp, Artificial Sequence
  chemically synthesized
ttgagacggagtcttgctctgt

SEQ ID NO: 1249442 - DNA, 22 bp, Artificial Sequence
  chemically synthesized
cagcctgggcgacagagcaaga

SEQ ID NO: 1249443 - DNA, 22 bp, Artificial Sequence
  chemically synthesized
tttgagacggagtcttgctctg

SEQ ID NO: 1249444 - DNA, 22 bp, Artificial Sequence
  chemically synthesized
ttttgagacggagtcttgctct

SEQ ID NO: 1249445 - DNA, 22 bp, Artificial Sequence
  chemically synthesized
tttttgagacggagtcttgctc

SEQ ID NO: 1249446 - DNA, 22 bp, Artificial Sequence
  chemically synthesized
ttttttgagacggagtcttgct

SEQ ID NO: 1249447 - DNA, 22 bp, Artificial Sequence
  chemically synthesized
tttttttgagacggagtcttgc

SEQ ID NO: 1249448 - DNA, 22 bp, Artificial Sequence
  chemically synthesized
ggcgacagagcaagactccgtc

SEQ ID NO: 1249449 - DNA, 22 bp, Artificial Sequence
  chemically synthesized
cctttttttttgagacggagtc

SEQ ID NO: 1249450 - DNA, 22 bp, Artificial Sequence
  chemically synthesized
ggtcaaaggatattaccttttt

SEQ ID NO: 1249451 - DNA, 22 bp, Artificial Sequence
  chemically synthesized
cgtctcaaaaaaaaaggtaata

SEQ ID NO: 1249452 - DNA, 22 bp, Artificial Sequence
  chemically synthesized
ttaggtcaaaggatattacctt

SEQ ID NO: 1249453 - DNA, 22 bp, Artificial Sequence
  chemically synthesized
aaaaaaaaaggtaatatccttt

SEQ ID NO: 1249454 - DNA, 22 bp, Artificial Sequence
  chemically synthesized
cagcgcatgaaattattaggtc

SEQ ID NO: 1249455 - DNA, 22 bp, Artificial Sequence
  chemically synthesized
ccagcgcatgaaattattaggt

SEQ ID NO: 1249456 - DNA, 22 bp, Artificial Sequence
  chemically synthesized
gacagcttccagcgcatgaaat

SEQ ID NO: 1249457 - DNA, 22 bp, Artificial Sequence
  chemically synthesized
agacagcttccagcgcatgaaa

SEQ ID NO: 1249458 - DNA, 22 bp, Artificial Sequence
  chemically synthesized
tgacctaataatttcatgcgct

SEQ ID NO: 1249459 - DNA, 22 bp, Artificial Sequence
  chemically synthesized
tagacagcttccagcgcatgaa

SEQ ID NO: 1249460 - DNA, 22 bp, Artificial Sequence
  chemically synthesized
gacctaataatttcatgcgctg

SEQ ID NO: 1249461 - DNA, 22 bp, Artificial Sequence
  chemically synthesized
ttagacagcttccagcgcatga

SEQ ID NO: 1249462 - DNA, 22 bp, Artificial Sequence
  chemically synthesized
acctaataatttcatgcgctgg

SEQ ID NO: 1249463 - DNA, 22 bp, Artificial Sequence
  chemically synthesized
cttttagacagcttccagcgca

SEQ ID NO: 1249464 - DNA, 22 bp, Artificial Sequence
  chemically synthesized
ccttttagacagcttccagcgc

SEQ ID NO: 1249465 - DNA, 22 bp, Artificial Sequence
  chemically synthesized
ataatttcatgcgctggaagct

SEQ ID NO: 1249466 - DNA, 22 bp, Artificial Sequence
  chemically synthesized
tttccttttagacagcttccag

SEQ ID NO: 1249467 - DNA, 22 bp, Artificial Sequence
  chemically synthesized
gtttccttttagacagcttcca

SEQ ID NO: 1249468 - DNA, 22 bp, Artificial Sequence
  chemically synthesized
tgtttccttttagacagcttcc

SEQ ID NO: 1249469 - DNA, 22 bp, Artificial Sequence
  chemically synthesized
catgcgctggaagctgtctaaa

SEQ ID NO: 1249470 - DNA, 22 bp, Artificial Sequence
  chemically synthesized
atgcgctggaagctgtctaaaa

SEQ ID NO: 1249471 - DNA, 22 bp, Artificial Sequence
  chemically synthesized
gaagctgtctaaaaggaaacaa

SEQ ID NO: 1249472 - DNA, 22 bp, Artificial Sequence
  chemically synthesized
tctaaaaggaaacaaaatggtc

SEQ ID NO: 1249473 - DNA, 22 bp, Artificial Sequence
  chemically synthesized
aataacccagtagaccattttg

SEQ ID NO: 1249474 - DNA, 22 bp, Artificial Sequence
  chemically synthesized
taaataacccagtagaccattt

SEQ ID NO: 1249475 - DNA, 22 bp, Artificial Sequence
  chemically synthesized
aaaggaaacaaaatggtctact

SEQ ID NO: 1249476 - DNA, 22 bp, Artificial Sequence
  chemically synthesized
ttctaaataacccagtagacca

SEQ ID NO: 1249477 - DNA, 22 bp, Artificial Sequence
  chemically synthesized
ttgttctaaataacccagtaga

SEQ ID NO: 1249478 - DNA, 22 bp, Artificial Sequence
  chemically synthesized
gttgttctaaataacccagtag

SEQ ID NO: 1249479 - DNA, 22 bp, Artificial Sequence
  chemically synthesized
tgttgttctaaataacccagta

SEQ ID NO: 1249480 - DNA, 22 bp, Artificial Sequence
  chemically synthesized
ttgttgttctaaataacccagt

SEQ ID NO: 1249481 - DNA, 22 bp, Artificial Sequence
  chemically synthesized
tttttgttgttctaaataaccc

SEQ ID NO: 1249482 - DNA, 22 bp, Artificial Sequence
  chemically synthesized
atttttgttgttctaaataacc

SEQ ID NO: 1249483 - DNA, 22 bp, Artificial Sequence
  chemically synthesized
tatttttgttgttctaaataac

SEQ ID NO: 1249484 - DNA, 22 bp, Artificial Sequence
  chemically synthesized
ttatttttgttgttctaaataa

SEQ ID NO: 1249485 - DNA, 22 bp, Artificial Sequence
  chemically synthesized
tttatttttgttgttctaaata

SEQ ID NO: 1249486 - DNA, 22 bp, Artificial Sequence
  chemically synthesized
gttttttatttttgttgttcta

SEQ ID NO: 1249487 - DNA, 22 bp, Artificial Sequence
  chemically synthesized
agttttttatttttgttgttct

SEQ ID NO: 1249488 - DNA, 22 bp, Artificial Sequence
  chemically synthesized
ctgggttatttagaacaacaaa

SEQ ID NO: 1249489 - DNA, 22 bp, Artificial Sequence
  chemically synthesized
ggttatttagaacaacaaaaat

SEQ ID NO: 1249490 - DNA, 22 bp, Artificial Sequence
  chemically synthesized
ggcatttagttttttatttttg

SEQ ID NO: 1249491 - DNA, 22 bp, Artificial Sequence
  chemically synthesized
tttagaacaacaaaaataaaaa

SEQ ID NO: 1249492 - DNA, 22 bp, Artificial Sequence
  chemically synthesized
agaacaacaaaaataaaaaact

SEQ ID NO: 1249493 - DNA, 22 bp, Artificial Sequence
  chemically synthesized
gaacaacaaaaataaaaaacta

SEQ ID NO: 1249494 - DNA, 22 bp, Artificial Sequence
  chemically synthesized
aagttaggcatttagtttttta

SEQ ID NO: 1249495 - DNA, 22 bp, Artificial Sequence
  chemically synthesized
taaagttaggcatttagttttt

SEQ ID NO: 1249496 - DNA, 22 bp, Artificial Sequence
  chemically synthesized
ttctaaagttaggcatttagtt

SEQ ID NO: 1249497 - DNA, 22 bp, Artificial Sequence
  chemically synthesized
attctaaagttaggcatttagt

SEQ ID NO: 1249498 - DNA, 22 bp, Artificial Sequence
  chemically synthesized
acataatgaccacttattctaa

SEQ ID NO: 1249499 - DNA, 22 bp, Artificial Sequence
  chemically synthesized
aatgcctaactttagaataagt

SEQ ID NO: 1249500 - DNA, 22 bp, Artificial Sequence
  chemically synthesized
aatgttcacataatgaccactt

SEQ ID NO: 1249501 - DNA, 22 bp, Artificial Sequence
  chemically synthesized
aaatgttcacataatgaccact

SEQ ID NO: 1249502 - DNA, 22 bp, Artificial Sequence
  chemically synthesized
actttagaataagtggtcatta

SEQ ID NO: 1249503 - DNA, 22 bp, Artificial Sequence
  chemically synthesized
taaatgttcacataatgaccac

SEQ ID NO: 1249504 - DNA, 22 bp, Artificial Sequence
  chemically synthesized
tagaataagtggtcattatgtg

SEQ ID NO: 1249505 - DNA, 22 bp, Artificial Sequence
  chemically synthesized
agaataagtggtcattatgtga

SEQ ID NO: 1249506 - DNA, 22 bp, Artificial Sequence
  chemically synthesized
gaataagtggtcattatgtgaa

SEQ ID NO: 1249507 - DNA, 22 bp, Artificial Sequence
  chemically synthesized
tagacacactttaaatgttcac

SEQ ID NO: 1249508 - DNA, 22 bp, Artificial Sequence
  chemically synthesized
ttatagacacactttaaatgtt

SEQ ID NO: 1249509 - DNA, 22 bp, Artificial Sequence
  chemically synthesized
ggttattatagacacactttaa

SEQ ID NO: 1249510 - DNA, 22 bp, Artificial Sequence
  chemically synthesized
aggttattatagacacacttta

SEQ ID NO: 1249511 - DNA, 22 bp, Artificial Sequence
  chemically synthesized
taggttattatagacacacttt

SEQ ID NO: 1249512 - DNA, 22 bp, Artificial Sequence
  chemically synthesized
tgtgaacatttaaagtgtgtct

SEQ ID NO: 1249513 - DNA, 22 bp, Artificial Sequence
  chemically synthesized
aaagtgtgtctataataaccta

SEQ ID NO: 1249514 - DNA, 22 bp, Artificial Sequence
  chemically synthesized
aagtgtgtctataataacctaa

SEQ ID NO: 1249515 - DNA, 22 bp, Artificial Sequence
  chemically synthesized
tcacataagtgattttaggtta

SEQ ID NO: 1249516 - DNA, 22 bp, Artificial Sequence
  chemically synthesized
ctatcacataagtgattttagg

SEQ ID NO: 1249517 - DNA, 22 bp, Artificial Sequence
  chemically synthesized
actatcacataagtgattttag

SEQ ID NO: 1249518 - DNA, 22 bp, Artificial Sequence
  chemically synthesized
tactatcacataagtgatttta

SEQ ID NO: 1249519 - DNA, 22 bp, Artificial Sequence
  chemically synthesized
ttactatcacataagtgatttt

SEQ ID NO: 1249520 - DNA, 22 bp, Artificial Sequence
  chemically synthesized
tttactatcacataagtgattt

SEQ ID NO: 1249521 - DNA, 22 bp, Artificial Sequence
  chemically synthesized
ttttactatcacataagtgatt

SEQ ID NO: 1249522 - DNA, 22 bp, Artificial Sequence
  chemically synthesized
taataacctaaaatcacttatg

SEQ ID NO: 1249523 - DNA, 22 bp, Artificial Sequence
  chemically synthesized
acccttttttactatcacataa

SEQ ID NO: 1249524 - DNA, 22 bp, Artificial Sequence
  chemically synthesized
cacccttttttactatcacata

SEQ ID NO: 1249525 - DNA, 22 bp, Artificial Sequence
  chemically synthesized
tcacccttttttactatcacat

SEQ ID NO: 1249526 - DNA, 22 bp, Artificial Sequence
  chemically synthesized
ttcacccttttttactatcaca

SEQ ID NO: 1249527 - DNA, 22 bp, Artificial Sequence
  chemically synthesized
aaatcacttatgtgatagtaaa

SEQ ID NO: 1249528 - DNA, 22 bp, Artificial Sequence
  chemically synthesized
tgacttttcacccttttttact

SEQ ID NO: 1249529 - DNA, 22 bp, Artificial Sequence
  chemically synthesized
atgacttttcacccttttttac

SEQ ID NO: 1249530 - DNA, 22 bp, Artificial Sequence
  chemically synthesized
atgtgatagtaaaaaagggtga

SEQ ID NO: 1249531 - DNA, 22 bp, Artificial Sequence
  chemically synthesized
tgtgatagtaaaaaagggtgaa

SEQ ID NO: 1249532 - DNA, 22 bp, Artificial Sequence
  chemically synthesized
tatttatgacttttcacccttt

SEQ ID NO: 1249533 - DNA, 22 bp, Artificial Sequence
  chemically synthesized
gatgtgatcgtgctatatttat

SEQ ID NO: 1249534 - DNA, 22 bp, Artificial Sequence
  chemically synthesized
agatgtgatcgtgctatattta

SEQ ID NO: 1249535 - DNA, 22 bp, Artificial Sequence
  chemically synthesized
tttagatgtgatcgtgctatat

SEQ ID NO: 1249536 - DNA, 22 bp, Artificial Sequence
  chemically synthesized
atttagatgtgatcgtgctata

SEQ ID NO: 1249537 - DNA, 22 bp, Artificial Sequence
  chemically synthesized
tttatttagatgtgatcgtgct

SEQ ID NO: 1249538 - DNA, 22 bp, Artificial Sequence
  chemically synthesized
ctatttatttagatgtgatcgt

SEQ ID NO: 1249539 - DNA, 22 bp, Artificial Sequence
  chemically synthesized
tgctatttatttagatgtgatc

SEQ ID NO: 1249540 - DNA, 22 bp, Artificial Sequence
  chemically synthesized
ctgctatttatttagatgtgat

SEQ ID NO: 1249541 - DNA, 22 bp, Artificial Sequence
  chemically synthesized
tctgctatttatttagatgtga

SEQ ID NO: 1249542 - DNA, 22 bp, Artificial Sequence
  chemically synthesized
cccgaaatgagggttttctgct

SEQ ID NO: 1249543 - DNA, 22 bp, Artificial Sequence
  chemically synthesized
acccgaaatgagggttttctgc

SEQ ID NO: 1249544 - DNA, 22 bp, Artificial Sequence
  chemically synthesized
tacccgaaatgagggttttctg

SEQ ID NO: 1249545 - DNA, 22 bp, Artificial Sequence
  chemically synthesized
ttacccgaaatgagggttttct

SEQ ID NO: 1249546 - DNA, 22 bp, Artificial Sequence
  chemically synthesized
tttacccgaaatgagggttttc

SEQ ID NO: 1249547 - DNA, 22 bp, Artificial Sequence
  chemically synthesized
aataaatagcagaaaaccctca

SEQ ID NO: 1249548 - DNA, 22 bp, Artificial Sequence
  chemically synthesized
ctttttacccgaaatgagggtt

SEQ ID NO: 1249549 - DNA, 22 bp, Artificial Sequence
  chemically synthesized
ggttcctttttacccgaaatga

SEQ ID NO: 1249550 - DNA, 22 bp, Artificial Sequence
  chemically synthesized
attgggttcctttttacccgaa

SEQ ID NO: 1249551 - DNA, 22 bp, Artificial Sequence
  chemically synthesized
cattgggttcctttttacccga

SEQ ID NO: 1249552 - DNA, 22 bp, Artificial Sequence
  chemically synthesized
gcatatttcattgggttccttt

SEQ ID NO: 1249553 - DNA, 22 bp, Artificial Sequence
  chemically synthesized
atttcgggtaaaaaggaaccca

SEQ ID NO: 1249554 - DNA, 22 bp, Artificial Sequence
  chemically synthesized
ggcatatttcattgggttcctt

SEQ ID NO: 1249555 - DNA, 22 bp, Artificial Sequence
  chemically synthesized
tggcatatttcattgggttcct

SEQ ID NO: 1249556 - DNA, 22 bp, Artificial Sequence
  chemically synthesized
cgggtaaaaaggaacccaatga

SEQ ID NO: 1249557 - DNA, 22 bp, Artificial Sequence
  chemically synthesized
gggtaaaaaggaacccaatgaa

SEQ ID NO: 1249558 - DNA, 22 bp, Artificial Sequence
  chemically synthesized
tcattttggcatatttcattgg

SEQ ID NO: 1249559 - DNA, 22 bp, Artificial Sequence
  chemically synthesized
ttatcattttggcatatttcat

SEQ ID NO: 1249560 - DNA, 22 bp, Artificial Sequence
  chemically synthesized
aagtcattgttatcattttggc

SEQ ID NO: 1249561 - DNA, 22 bp, Artificial Sequence
  chemically synthesized
aaagtcattgttatcattttgg

SEQ ID NO: 1249562 - DNA, 22 bp, Artificial Sequence
  chemically synthesized
acttaaagtcattgttatcatt

SEQ ID NO: 1249563 - DNA, 22 bp, Artificial Sequence
  chemically synthesized
tcacttaaagtcattgttatca

SEQ ID NO: 1249564 - DNA, 22 bp, Artificial Sequence
  chemically synthesized
accatattctcacttaaagtca

SEQ ID NO: 1249565 - DNA, 22 bp, Artificial Sequence
  chemically synthesized
taagtgagaatatggttaattt

SEQ ID NO: 1249566 - DNA, 22 bp, Artificial Sequence
  chemically synthesized
aagtgagaatatggttaatttt

SEQ ID NO: 1249567 - DNA, 22 bp, Artificial Sequence
  chemically synthesized
agtgagaatatggttaattttg

SEQ ID NO: 1249568 - DNA, 22 bp, Artificial Sequence
  chemically synthesized
aatggaagaagtaaaaggaaac

SEQ ID NO: 1249569 - DNA, 22 bp, Artificial Sequence
  chemically synthesized
attttgtttccttttacttctt

SEQ ID NO: 1249570 - DNA, 22 bp, Artificial Sequence
  chemically synthesized
ccaattgaatggaagaagtaaa

SEQ ID NO: 1249571 - DNA, 22 bp, Artificial Sequence
  chemically synthesized
tgtttccttttacttcttccat

SEQ ID NO: 1249572 - DNA, 22 bp, Artificial Sequence
  chemically synthesized
gtttccttttacttcttccatt

SEQ ID NO: 1249573 - DNA, 22 bp, Artificial Sequence
  chemically synthesized
tttccttttacttcttccattc

SEQ ID NO: 1249574 - DNA, 22 bp, Artificial Sequence
  chemically synthesized
atattcccaattgaatggaaga

SEQ ID NO: 1249575 - DNA, 22 bp, Artificial Sequence
  chemically synthesized
ccttttacttcttccattcaat

SEQ ID NO: 1249576 - DNA, 22 bp, Artificial Sequence
  chemically synthesized
ttaatattcccaattgaatgga

SEQ ID NO: 1249577 - DNA, 22 bp, Artificial Sequence
  chemically synthesized
cttttacttcttccattcaatt

SEQ ID NO: 1249578 - DNA, 22 bp, Artificial Sequence
  chemically synthesized
ttacttcttccattcaattggg

SEQ ID NO: 1249579 - DNA, 22 bp, Artificial Sequence
  chemically synthesized
tacttcttccattcaattggga

SEQ ID NO: 1249580 - DNA, 22 bp, Artificial Sequence
  chemically synthesized
acttcttccattcaattgggaa

SEQ ID NO: 1249581 - DNA, 22 bp, Artificial Sequence
  chemically synthesized
cttcttccattcaattgggaat

SEQ ID NO: 1249582 - DNA, 22 bp, Artificial Sequence
  chemically synthesized
cttccattcaattgggaatatt

SEQ ID NO: 1249583 - DNA, 22 bp, Artificial Sequence
  chemically synthesized
ttccattcaattgggaatatta

SEQ ID NO: 1249584 - DNA, 22 bp, Artificial Sequence
  chemically synthesized
ccattcaattgggaatattaat

SEQ ID NO: 1249585 - DNA, 22 bp, Artificial Sequence
  chemically synthesized
cattcaattgggaatattaata

SEQ ID NO: 1249586 - DNA, 22 bp, Artificial Sequence
  chemically synthesized
taagggtccaattattaatatt

SEQ ID NO: 1249587 - DNA, 22 bp, Artificial Sequence
  chemically synthesized
aattgggaatattaataattgg

SEQ ID NO: 1249588 - DNA, 22 bp, Artificial Sequence
  chemically synthesized
ggaatattaataattggaccct

SEQ ID NO: 1249589 - DNA, 22 bp, Artificial Sequence
  chemically synthesized
ataattggacccttacagctgg

SEQ ID NO: 1249590 - DNA, 22 bp, Artificial Sequence
  chemically synthesized
gacccttacagctgggcatggt

SEQ ID NO: 1249591 - DNA, 22 bp, Artificial Sequence
  chemically synthesized
caggtgtgagccaccatgccca

SEQ ID NO: 1249592 - DNA, 22 bp, Artificial Sequence
  chemically synthesized
ggattacaggtgtgagccacca

SEQ ID NO: 1249593 - DNA, 22 bp, Artificial Sequence
  chemically synthesized
acagctgggcatggtggctcac

SEQ ID NO: 1249594 - DNA, 22 bp, Artificial Sequence
  chemically synthesized
cagctgggcatggtggctcaca

SEQ ID NO: 1249595 - DNA, 22 bp, Artificial Sequence
  chemically synthesized
ggcatggtggctcacacctgta

SEQ ID NO: 1249596 - DNA, 22 bp, Artificial Sequence
  chemically synthesized
ccaaagtgctgggattacaggt

SEQ ID NO: 1249597 - DNA, 22 bp, Artificial Sequence
  chemically synthesized
agcctcccaaagtgctgggatt

SEQ ID NO: 1249598 - DNA, 22 bp, Artificial Sequence
  chemically synthesized
acacctgtaatcccagcacttt

SEQ ID NO: 1249599 - DNA, 22 bp, Artificial Sequence
  chemically synthesized
cccgcctcagcctcccaaagtg

SEQ ID NO: 1249600 - DNA, 22 bp, Artificial Sequence
  chemically synthesized
taatcccagcactttgggaggc

SEQ ID NO: 1249601 - DNA, 22 bp, Artificial Sequence
  chemically synthesized
gtgatctgcccgcctcagcctc

SEQ ID NO: 1249602 - DNA, 22 bp, Artificial Sequence
  chemically synthesized
acctcgtgatctgcccgcctca

SEQ ID NO: 1249603 - DNA, 22 bp, Artificial Sequence
  chemically synthesized
ctgacctcgtgatctgcccgcc

SEQ ID NO: 1249604 - DNA, 22 bp, Artificial Sequence
  chemically synthesized
tgggaggctgaggcgggcagat

SEQ ID NO: 1249605 - DNA, 22 bp, Artificial Sequence
  chemically synthesized
gggaggctgaggcgggcagatc

SEQ ID NO: 1249606 - DNA, 22 bp, Artificial Sequence
  chemically synthesized
ggaggctgaggcgggcagatca

SEQ ID NO: 1249607 - DNA, 22 bp, Artificial Sequence
  chemically synthesized
gatctcctgacctcgtgatctg

SEQ ID NO: 1249608 - DNA, 22 bp, Artificial Sequence
  chemically synthesized
aggcgggcagatcacgaggtca

SEQ ID NO: 1249609 - DNA, 22 bp, Artificial Sequence
  chemically synthesized
gccaggatggtctcgatctcct

SEQ ID NO: 1249610 - DNA, 22 bp, Artificial Sequence
  chemically synthesized
accgtgttagccaggatggtct

SEQ ID NO: 1249611 - DNA, 22 bp, Artificial Sequence
  chemically synthesized
caccgtgttagccaggatggtc

SEQ ID NO: 1249612 - DNA, 22 bp, Artificial Sequence
  chemically synthesized
gtagagacggggtttcaccgtg

SEQ ID NO: 1249613 - DNA, 22 bp, Artificial Sequence
  chemically synthesized
agtagagacggggtttcaccgt

SEQ ID NO: 1249614 - DNA, 22 bp, Artificial Sequence
  chemically synthesized
tagtagagacggggtttcaccg

SEQ ID NO: 1249615 - DNA, 22 bp, Artificial Sequence
  chemically synthesized
ttagtagagacggggtttcacc

SEQ ID NO: 1249616 - DNA, 22 bp, Artificial Sequence
  chemically synthesized
gctaacacggtgaaaccccgtc

SEQ ID NO: 1249617 - DNA, 22 bp, Artificial Sequence
  chemically synthesized
tatttttagtagagacggggtt

SEQ ID NO: 1249618 - DNA, 22 bp, Artificial Sequence
  chemically synthesized
gtatttttagtagagacggggt

SEQ ID NO: 1249619 - DNA, 22 bp, Artificial Sequence
  chemically synthesized
tgtatttttagtagagacgggg

SEQ ID NO: 1249620 - DNA, 22 bp, Artificial Sequence
  chemically synthesized
acacggtgaaaccccgtctcta

SEQ ID NO: 1249621 - DNA, 22 bp, Artificial Sequence
  chemically synthesized
ttgtatttttagtagagacggg

SEQ ID NO: 1249622 - DNA, 22 bp, Artificial Sequence
  chemically synthesized
tttgtatttttagtagagacgg

SEQ ID NO: 1249623 - DNA, 22 bp, Artificial Sequence
  chemically synthesized
attttttgtatttttagtagag

SEQ ID NO: 1249624 - DNA, 22 bp, Artificial Sequence
  chemically synthesized
tactaaaaatacaaaaaattag

SEQ ID NO: 1249625 - DNA, 22 bp, Artificial Sequence
  chemically synthesized
tcagcacgcccggctaattttt

SEQ ID NO: 1249626 - DNA, 22 bp, Artificial Sequence
  chemically synthesized
ctaaaaatacaaaaaattagcc

SEQ ID NO: 1249627 - DNA, 22 bp, Artificial Sequence
  chemically synthesized
ctgtcagcacgcccggctaatt

SEQ ID NO: 1249628 - DNA, 22 bp, Artificial Sequence
  chemically synthesized
aaaatacaaaaaattagccggg

SEQ ID NO: 1249629 - DNA, 22 bp, Artificial Sequence
  chemically synthesized
caggctcctgtcagcacgcccg

SEQ ID NO: 1249630 - DNA, 22 bp, Artificial Sequence
  chemically synthesized
ggactacaggctcctgtcagca

SEQ ID NO: 1249631 - DNA, 22 bp, Artificial Sequence
  chemically synthesized
gccgggcgtgctgacaggagcc

SEQ ID NO: 1249632 - DNA, 22 bp, Artificial Sequence
  chemically synthesized
ccaagtagctgggactacaggc

SEQ ID NO: 1249633 - DNA, 22 bp, Artificial Sequence
  chemically synthesized
acaggagcctgtagtcccagct

SEQ ID NO: 1249634 - DNA, 22 bp, Artificial Sequence
  chemically synthesized
agcctcccaagtagctgggact

SEQ ID NO: 1249635 - DNA, 22 bp, Artificial Sequence
  chemically synthesized
cctcagcctcccaagtagctgg

SEQ ID NO: 1249636 - DNA, 22 bp, Artificial Sequence
  chemically synthesized
ctgcctcagcctcccaagtagc

SEQ ID NO: 1249637 - DNA, 22 bp, Artificial Sequence
  chemically synthesized
tcctgcctcagcctcccaagta

SEQ ID NO: 1249638 - DNA, 22 bp, Artificial Sequence
  chemically synthesized
tagtcccagctacttgggaggc

SEQ ID NO: 1249639 - DNA, 22 bp, Artificial Sequence
  chemically synthesized
acaccattctcctgcctcagcc

SEQ ID NO: 1249640 - DNA, 22 bp, Artificial Sequence
  chemically synthesized
cttgggaggctgaggcaggaga

SEQ ID NO: 1249641 - DNA, 22 bp, Artificial Sequence
  chemically synthesized
gggaggctgaggcaggagaatg

SEQ ID NO: 1249642 - DNA, 22 bp, Artificial Sequence
  chemically synthesized
ccgggttcacaccattctcctg

SEQ ID NO: 1249643 - DNA, 22 bp, Artificial Sequence
  chemically synthesized
ggaggctgaggcaggagaatgg

SEQ ID NO: 1249644 - DNA, 22 bp, Artificial Sequence
  chemically synthesized
cgcctcccgggttcacaccatt

SEQ ID NO: 1249645 - DNA, 22 bp, Artificial Sequence
  chemically synthesized
aggcaggagaatggtgtgaacc

SEQ ID NO: 1249646 - DNA, 22 bp, Artificial Sequence
  chemically synthesized
caagctccgcctcccgggttca

SEQ ID NO: 1249647 - DNA, 22 bp, Artificial Sequence
  chemically synthesized
actgcaagctccgcctcccggg

SEQ ID NO: 1249648 - DNA, 22 bp, Artificial Sequence
  chemically synthesized
ggctcactgcaagctccgcctc

SEQ ID NO: 1249649 - DNA, 22 bp, Artificial Sequence
  chemically synthesized
gagtgcagtgatgggatctcgg

SEQ ID NO: 1249650 - DNA, 22 bp, Artificial Sequence
  chemically synthesized
gcagtgagccgagatcccatca

SEQ ID NO: 1249651 - DNA, 22 bp, Artificial Sequence
  chemically synthesized
cagtgagccgagatcccatcac

SEQ ID NO: 1249652 - DNA, 22 bp, Artificial Sequence
  chemically synthesized
tcatccaggctggagtgcagtg

SEQ ID NO: 1249653 - DNA, 22 bp, Artificial Sequence
  chemically synthesized
tgtcatccaggctggagtgcag

SEQ ID NO: 1249654 - DNA, 22 bp, Artificial Sequence
  chemically synthesized
ctctgtcatccaggctggagtg

SEQ ID NO: 1249655 - DNA, 22 bp, Artificial Sequence
  chemically synthesized
gctctgtcatccaggctggagt

SEQ ID NO: 1249656 - DNA, 22 bp, Artificial Sequence
  chemically synthesized
ttgctctgtcatccaggctgga

SEQ ID NO: 1249657 - DNA, 22 bp, Artificial Sequence
  chemically synthesized
cactccagcctggatgacagag

SEQ ID NO: 1249658 - DNA, 22 bp, Artificial Sequence
  chemically synthesized
agatggattcttgctctgtcat

SEQ ID NO: 1249659 - DNA, 22 bp, Artificial Sequence
  chemically synthesized
gagatggattcttgctctgtca

SEQ ID NO: 1249660 - DNA, 22 bp, Artificial Sequence
  chemically synthesized
tgagatggattcttgctctgtc

SEQ ID NO: 1249661 - DNA, 22 bp, Artificial Sequence
  chemically synthesized
ttgagatggattcttgctctgt

SEQ ID NO: 1249662 - DNA, 22 bp, Artificial Sequence
  chemically synthesized
cagcctggatgacagagcaaga

SEQ ID NO: 1249663 - DNA, 22 bp, Artificial Sequence
  chemically synthesized
tttgagatggattcttgctctg

SEQ ID NO: 1249664 - DNA, 22 bp, Artificial Sequence
  chemically synthesized
ttttgagatggattcttgctct

SEQ ID NO: 1249665 - DNA, 22 bp, Artificial Sequence
  chemically synthesized
tttttgagatggattcttgctc

SEQ ID NO: 1249666 - DNA, 22 bp, Artificial Sequence
  chemically synthesized
ttttttttgagatggattcttg

SEQ ID NO: 1249667 - DNA, 22 bp, Artificial Sequence
  chemically synthesized
attttttttgagatggattctt

SEQ ID NO: 1249668 - DNA, 22 bp, Artificial Sequence
  chemically synthesized
gatgacagagcaagaatccatc

SEQ ID NO: 1249669 - DNA, 22 bp, Artificial Sequence
  chemically synthesized
tttattttttttgagatggatt

SEQ ID NO: 1249670 - DNA, 22 bp, Artificial Sequence
  chemically synthesized
atttattttttttgagatggat

SEQ ID NO: 1249671 - DNA, 22 bp, Artificial Sequence
  chemically synthesized
tttatttattttttttgagatg

SEQ ID NO: 1249672 - DNA, 22 bp, Artificial Sequence
  chemically synthesized
atttatttattttttttgagat

SEQ ID NO: 1249673 - DNA, 22 bp, Artificial Sequence
  chemically synthesized
tatttatttattttttttgaga

SEQ ID NO: 1249674 - DNA, 22 bp, Artificial Sequence
  chemically synthesized
ttatttatttattttttttgag

SEQ ID NO: 1249675 - DNA, 22 bp, Artificial Sequence
  chemically synthesized
tttatttatttattttttttga

SEQ ID NO: 1249676 - DNA, 22 bp, Artificial Sequence
  chemically synthesized
tttttatttatttatttttttt

SEQ ID NO: 1249677 - DNA, 22 bp, Artificial Sequence
  chemically synthesized
ctttttatttatttattttttt

SEQ ID NO: 1249678 - DNA, 22 bp, Artificial Sequence
  chemically synthesized
tctttttatttatttatttttt

SEQ ID NO: 1249679 - DNA, 22 bp, Artificial Sequence
  chemically synthesized
aaaaaaaataaataaataaaaa

SEQ ID NO: 1249680 - DNA, 22 bp, Artificial Sequence
  chemically synthesized
tatataacagataagggtccaa

SEQ ID NO: 1249681 - DNA, 22 bp, Artificial Sequence
  chemically synthesized
gtatataacagataagggtcca

SEQ ID NO: 1249682 - DNA, 22 bp, Artificial Sequence
  chemically synthesized
ttgtatataacagataagggtc

SEQ ID NO: 1249683 - DNA, 22 bp, Artificial Sequence
  chemically synthesized
agtcgattcttgtatataacag

SEQ ID NO: 1249684 - DNA, 22 bp, Artificial Sequence
  chemically synthesized
gagtcgattcttgtatataaca

SEQ ID NO: 1249685 - DNA, 22 bp, Artificial Sequence
  chemically synthesized
tgagtcgattcttgtatataac

SEQ ID NO: 1249686 - DNA, 22 bp, Artificial Sequence
  chemically synthesized
gacccttatctgttatatacaa

SEQ ID NO: 1249687 - DNA, 22 bp, Artificial Sequence
  chemically synthesized
atctgttatatacaagaatcga

SEQ ID NO: 1249688 - DNA, 22 bp, Artificial Sequence
  chemically synthesized
atccattttgagtcgattcttg

SEQ ID NO: 1249689 - DNA, 22 bp, Artificial Sequence
  chemically synthesized
tctgttatatacaagaatcgac

SEQ ID NO: 1249690 - DNA, 22 bp, Artificial Sequence
  chemically synthesized
aatccattttgagtcgattctt

SEQ ID NO: 1249691 - DNA, 22 bp, Artificial Sequence
  chemically synthesized
taatccattttgagtcgattct

SEQ ID NO: 1249692 - DNA, 22 bp, Artificial Sequence
  chemically synthesized
ttatatacaagaatcgactcaa

SEQ ID NO: 1249693 - DNA, 22 bp, Artificial Sequence
  chemically synthesized
tatacaagaatcgactcaaaat

SEQ ID NO: 1249694 - DNA, 22 bp, Artificial Sequence
  chemically synthesized
taagtctttaatccattttgag

SEQ ID NO: 1249695 - DNA, 22 bp, Artificial Sequence
  chemically synthesized
cctgtaagtctttaatccattt

SEQ ID NO: 1249696 - DNA, 22 bp, Artificial Sequence
  chemically synthesized
acctgtaagtctttaatccatt

SEQ ID NO: 1249697 - DNA, 22 bp, Artificial Sequence
  chemically synthesized
tacctgtaagtctttaatccat

SEQ ID NO: 1249698 - DNA, 22 bp, Artificial Sequence
  chemically synthesized
aggttttacctgtaagtcttta

SEQ ID NO: 1249699 - DNA, 22 bp, Artificial Sequence
  chemically synthesized
caggttttacctgtaagtcttt

SEQ ID NO: 1249700 - DNA, 22 bp, Artificial Sequence
  chemically synthesized
aaaatggattaaagacttacag

SEQ ID NO: 1249701 - DNA, 22 bp, Artificial Sequence
  chemically synthesized
gtttcaggttttacctgtaagt

SEQ ID NO: 1249702 - DNA, 22 bp, Artificial Sequence
  chemically synthesized
agtttcaggttttacctgtaag

SEQ ID NO: 1249703 - DNA, 22 bp, Artificial Sequence
  chemically synthesized
tagtttcaggttttacctgtaa

SEQ ID NO: 1249704 - DNA, 22 bp, Artificial Sequence
  chemically synthesized
aagacttacaggtaaaacctga

SEQ ID NO: 1249705 - DNA, 22 bp, Artificial Sequence
  chemically synthesized
gtagttttagtttcaggtttta

SEQ ID NO: 1249706 - DNA, 22 bp, Artificial Sequence
  chemically synthesized
tagtagttttagtttcaggttt

SEQ ID NO: 1249707 - DNA, 22 bp, Artificial Sequence
  chemically synthesized
ctagtagttttagtttcaggtt

SEQ ID NO: 1249708 - DNA, 22 bp, Artificial Sequence
  chemically synthesized
ttctagtagttttagtttcagg

SEQ ID NO: 1249709 - DNA, 22 bp, Artificial Sequence
  chemically synthesized
cttctagtagttttagtttcag

SEQ ID NO: 1249710 - DNA, 22 bp, Artificial Sequence
  chemically synthesized
acaggtaaaacctgaaactaaa

SEQ ID NO: 1249711 - DNA, 22 bp, Artificial Sequence
  chemically synthesized
tcttctagtagttttagtttca

SEQ ID NO: 1249712 - DNA, 22 bp, Artificial Sequence
  chemically synthesized
caggtaaaacctgaaactaaaa

SEQ ID NO: 1249713 - DNA, 22 bp, Artificial Sequence
  chemically synthesized
atagtccatgttttcttctagt

SEQ ID NO: 1249714 - DNA, 22 bp, Artificial Sequence
  chemically synthesized
aaactaaaactactagaagaaa

SEQ ID NO: 1249715 - DNA, 22 bp, Artificial Sequence
  chemically synthesized
tcatagtccatgttttcttcta

SEQ ID NO: 1249716 - DNA, 22 bp, Artificial Sequence
  chemically synthesized
aaactactagaagaaaacatgg

SEQ ID NO: 1249717 - DNA, 22 bp, Artificial Sequence
  chemically synthesized
ctagaagaaaacatggactatg

SEQ ID NO: 1249718 - DNA, 22 bp, Artificial Sequence
  chemically synthesized
gaagaaaacatggactatgaga

SEQ ID NO: 1249719 - DNA, 22 bp, Artificial Sequence
  chemically synthesized
caggcatgagccacctctcata

SEQ ID NO: 1249720 - DNA, 22 bp, Artificial Sequence
  chemically synthesized
ggattacaggcatgagccacct

SEQ ID NO: 1249721 - DNA, 22 bp, Artificial Sequence
  chemically synthesized
tgagaggtggctcatgcctgta

SEQ ID NO: 1249722 - DNA, 22 bp, Artificial Sequence
  chemically synthesized
ccaaagtactgggattacaggc

SEQ ID NO: 1249723 - DNA, 22 bp, Artificial Sequence
  chemically synthesized
aacctcccaaagtactgggatt

SEQ ID NO: 1249724 - DNA, 22 bp, Artificial Sequence
  chemically synthesized
atgcctgtaatcccagtacttt

SEQ ID NO: 1249725 - DNA, 22 bp, Artificial Sequence
  chemically synthesized
cccgcctcaacctcccaaagta

SEQ ID NO: 1249726 - DNA, 22 bp, Artificial Sequence
  chemically synthesized
taatcccagtactttgggaggt

SEQ ID NO: 1249727 - DNA, 22 bp, Artificial Sequence
  chemically synthesized
atgatctgcccgcctcaacctc

SEQ ID NO: 1249728 - DNA, 22 bp, Artificial Sequence
  chemically synthesized
acctcatgatctgcccgcctca

SEQ ID NO: 1249729 - DNA, 22 bp, Artificial Sequence
  chemically synthesized
tgggaggttgaggcgggcagat

SEQ ID NO: 1249730 - DNA, 22 bp, Artificial Sequence
  chemically synthesized
gggaggttgaggcgggcagatc

SEQ ID NO: 1249731 - DNA, 22 bp, Artificial Sequence
  chemically synthesized
ggaggttgaggcgggcagatca

SEQ ID NO: 1249732 - DNA, 22 bp, Artificial Sequence
  chemically synthesized
aaacccctgacctcatgatctg

SEQ ID NO: 1249733 - DNA, 22 bp, Artificial Sequence
  chemically synthesized
aggcgggcagatcatgaggtca

SEQ ID NO: 1249734 - DNA, 22 bp, Artificial Sequence
  chemically synthesized
gtctcaaacccctgacctcatg

SEQ ID NO: 1249735 - DNA, 22 bp, Artificial Sequence
  chemically synthesized
ccaggctggtctcaaacccctg

SEQ ID NO: 1249736 - DNA, 22 bp, Artificial Sequence
  chemically synthesized
gccaggctggtctcaaacccct

SEQ ID NO: 1249737 - DNA, 22 bp, Artificial Sequence
  chemically synthesized
gccatgtttgccaggctggtct

SEQ ID NO: 1249738 - DNA, 22 bp, Artificial Sequence
  chemically synthesized
cgccatgtttgccaggctggtc

SEQ ID NO: 1249739 - DNA, 22 bp, Artificial Sequence
  chemically synthesized
gagaccagcctggcaaacatgg

SEQ ID NO: 1249740 - DNA, 22 bp, Artificial Sequence
  chemically synthesized
agaccagcctggcaaacatggc

SEQ ID NO: 1249741 - DNA, 22 bp, Artificial Sequence
  chemically synthesized
gtagagacggggtttcgccatg

SEQ ID NO: 1249742 - DNA, 22 bp, Artificial Sequence
  chemically synthesized
agtagagacggggtttcgccat

SEQ ID NO: 1249743 - DNA, 22 bp, Artificial Sequence
  chemically synthesized
tagtagagacggggtttcgcca

SEQ ID NO: 1249744 - DNA, 22 bp, Artificial Sequence
  chemically synthesized
ttagtagagacggggtttcgcc

SEQ ID NO: 1249745 - DNA, 22 bp, Artificial Sequence
  chemically synthesized
gcaaacatggcgaaaccccgtc

SEQ ID NO: 1249746 - DNA, 22 bp, Artificial Sequence
  chemically synthesized
tatttttagtagagacggggtt

SEQ ID NO: 1249747 - DNA, 22 bp, Artificial Sequence
  chemically synthesized
gtatttttagtagagacggggt

SEQ ID NO: 1249748 - DNA, 22 bp, Artificial Sequence
  chemically synthesized
tgtatttttagtagagacgggg

SEQ ID NO: 1249749 - DNA, 22 bp, Artificial Sequence
  chemically synthesized
ttgtatttttagtagagacggg

SEQ ID NO: 1249750 - DNA, 22 bp, Artificial Sequence
  chemically synthesized
atttttgtatttttagtagaga

SEQ ID NO: 1249751 - DNA, 22 bp, Artificial Sequence
  chemically synthesized
tactaaaaatacaaaaattagc

SEQ ID NO: 1249752 - DNA, 22 bp, Artificial Sequence
  chemically synthesized
accacaacgaccggctaatttt

SEQ ID NO: 1249753 - DNA, 22 bp, Artificial Sequence
  chemically synthesized
ctaaaaatacaaaaattagccg

SEQ ID NO: 1249754 - DNA, 22 bp, Artificial Sequence
  chemically synthesized
aaaatacaaaaattagccggtc

SEQ ID NO: 1249755 - DNA, 22 bp, Artificial Sequence
  chemically synthesized
caggcgctcaccacaacgaccg

SEQ ID NO: 1249756 - DNA, 22 bp, Artificial Sequence
  chemically synthesized
ggactacaggcgctcaccacaa

SEQ ID NO: 1249757 - DNA, 22 bp, Artificial Sequence
  chemically synthesized
gccggtcgttgtggtgagcgcc

SEQ ID NO: 1249758 - DNA, 22 bp, Artificial Sequence
  chemically synthesized
agtagctgggactacaggcgct

SEQ ID NO: 1249759 - DNA, 22 bp, Artificial Sequence
  chemically synthesized
ctgagtagctgggactacaggc

SEQ ID NO: 1249760 - DNA, 22 bp, Artificial Sequence
  chemically synthesized
tggtgagcgcctgtagtcccag

SEQ ID NO: 1249761 - DNA, 22 bp, Artificial Sequence
  chemically synthesized
agcctcctgagtagctgggact

SEQ ID NO: 1249762 - DNA, 22 bp, Artificial Sequence
  chemically synthesized
cctcagcctcctgagtagctgg

SEQ ID NO: 1249763 - DNA, 22 bp, Artificial Sequence
  chemically synthesized
ctgcctcagcctcctgagtagc

SEQ ID NO: 1249764 - DNA, 22 bp, Artificial Sequence
  chemically synthesized
tcctgcctcagcctcctgagta

SEQ ID NO: 1249765 - DNA, 22 bp, Artificial Sequence
  chemically synthesized
tagtcccagctactcaggaggc

SEQ ID NO: 1249766 - DNA, 22 bp, Artificial Sequence
  chemically synthesized
cagtgattctcctgcctcagcc

SEQ ID NO: 1249767 - DNA, 22 bp, Artificial Sequence
  chemically synthesized
ctcaggaggctgaggcaggaga

SEQ ID NO: 1249768 - DNA, 22 bp, Artificial Sequence
  chemically synthesized
cgggctccagtgattctcctgc

SEQ ID NO: 1249769 - DNA, 22 bp, Artificial Sequence
  chemically synthesized
aggaggctgaggcaggagaatc

SEQ ID NO: 1249770 - DNA, 22 bp, Artificial Sequence
  chemically synthesized
ccgggctccagtgattctcctg

SEQ ID NO: 1249771 - DNA, 22 bp, Artificial Sequence
  chemically synthesized
caccttccgggctccagtgatt

SEQ ID NO: 1249772 - DNA, 22 bp, Artificial Sequence
  chemically synthesized
aggcaggagaatcactggagcc

SEQ ID NO: 1249773 - DNA, 22 bp, Artificial Sequence
  chemically synthesized
acagcaacctccaccttccggg

SEQ ID NO: 1249774 - DNA, 22 bp, Artificial Sequence
  chemically synthesized
ggctcacagcaacctccacctt

SEQ ID NO: 1249775 - DNA, 22 bp, Artificial Sequence
  chemically synthesized
gagcccggaaggtggaggttgc

SEQ ID NO: 1249776 - DNA, 22 bp, Artificial Sequence
  chemically synthesized
gaatgcaatggtgcggtctagg

SEQ ID NO: 1249777 - DNA, 22 bp, Artificial Sequence
  chemically synthesized
ctgtgagcctagaccgcaccat

SEQ ID NO: 1249778 - DNA, 22 bp, Artificial Sequence
  chemically synthesized
tgagcctagaccgcaccattgc

SEQ ID NO: 1249779 - DNA, 22 bp, Artificial Sequence
  chemically synthesized
tcacccaggctggaatgcaatg

SEQ ID NO: 1249780 - DNA, 22 bp, Artificial Sequence
  chemically synthesized
gtcacccaggctggaatgcaat

SEQ ID NO: 1249781 - DNA, 22 bp, Artificial Sequence
  chemically synthesized
tgtcacccaggctggaatgcaa

SEQ ID NO: 1249782 - DNA, 22 bp, Artificial Sequence
  chemically synthesized
gaccgcaccattgcattccagc

SEQ ID NO: 1249783 - DNA, 22 bp, Artificial Sequence
  chemically synthesized
ctttgtcacccaggctggaatg

SEQ ID NO: 1249784 - DNA, 22 bp, Artificial Sequence
  chemically synthesized
gctttgtcacccaggctggaat

SEQ ID NO: 1249785 - DNA, 22 bp, Artificial Sequence
  chemically synthesized
agacagtcttgctttgtcaccc

SEQ ID NO: 1249786 - DNA, 22 bp, Artificial Sequence
  chemically synthesized
cattccagcctgggtgacaaag

SEQ ID NO: 1249787 - DNA, 22 bp, Artificial Sequence
  chemically synthesized
gagacagtcttgctttgtcacc

SEQ ID NO: 1249788 - DNA, 22 bp, Artificial Sequence
  chemically synthesized
tgagacagtcttgctttgtcac

SEQ ID NO: 1249789 - DNA, 22 bp, Artificial Sequence
  chemically synthesized
ttgagacagtcttgctttgtca

SEQ ID NO: 1249790 - DNA, 22 bp, Artificial Sequence
  chemically synthesized
tttgagacagtcttgctttgtc

SEQ ID NO: 1249791 - DNA, 22 bp, Artificial Sequence
  chemically synthesized
ttttgagacagtcttgctttgt

SEQ ID NO: 1249792 - DNA, 22 bp, Artificial Sequence
  chemically synthesized
cagcctgggtgacaaagcaaga

SEQ ID NO: 1249793 - DNA, 22 bp, Artificial Sequence
  chemically synthesized
tttttgagacagtcttgctttg

SEQ ID NO: 1249794 - DNA, 22 bp, Artificial Sequence
  chemically synthesized
ttttttgagacagtcttgcttt

SEQ ID NO: 1249795 - DNA, 22 bp, Artificial Sequence
  chemically synthesized
tttttttgagacagtcttgctt

SEQ ID NO: 1249796 - DNA, 22 bp, Artificial Sequence
  chemically synthesized
ttttttttgagacagtcttgct

SEQ ID NO: 1249797 - DNA, 22 bp, Artificial Sequence
  chemically synthesized
tttttttttgagacagtcttgc

SEQ ID NO: 1249798 - DNA, 22 bp, Artificial Sequence
  chemically synthesized
ttttttttttgagacagtcttg

SEQ ID NO: 1249799 - DNA, 22 bp, Artificial Sequence
  chemically synthesized
tttttttttttgagacagtctt

SEQ ID NO: 1249800 - DNA, 22 bp, Artificial Sequence
  chemically synthesized
ggtgacaaagcaagactgtctc

SEQ ID NO: 1249801 - DNA, 22 bp, Artificial Sequence
  chemically synthesized
ttttttttttttgagacagtct

SEQ ID NO: 1249802 - DNA, 22 bp, Artificial Sequence
  chemically synthesized
tttttttttttttgagacagtc

SEQ ID NO: 1249803 - DNA, 22 bp, Artificial Sequence
  chemically synthesized
ttttttttttttttgagacagt

SEQ ID NO: 1249804 - DNA, 22 bp, Artificial Sequence
  chemically synthesized
tttttttttttttttgagacag

SEQ ID NO: 1249805 - DNA, 22 bp, Artificial Sequence
  chemically synthesized
ttttttttttttttttgagaca

SEQ ID NO: 1249806 - DNA, 22 bp, Artificial Sequence
  chemically synthesized
tttttttttttttttttgagac

SEQ ID NO: 1249807 - DNA, 22 bp, Artificial Sequence
  chemically synthesized
ttttttttttttttttttgaga

SEQ ID NO: 1249808 - DNA, 22 bp, Artificial Sequence
  chemically synthesized
tttttttttttttttttttgag

SEQ ID NO: 1249809 - DNA, 22 bp, Artificial Sequence
  chemically synthesized
ttttttttttttttttttttga

SEQ ID NO: 1249810 - DNA, 22 bp, Artificial Sequence
  chemically synthesized
tttttttttttttttttttttg

SEQ ID NO: 1249811 - DNA, 22 bp, Artificial Sequence
  chemically synthesized
tttttttttttttttttttttt

SEQ ID NO: 1249812 - DNA, 22 bp, Artificial Sequence
  chemically synthesized
tttttttttttttttttttttt

SEQ ID NO: 1249813 - DNA, 22 bp, Artificial Sequence
  chemically synthesized
tttttttttttttttttttttt

SEQ ID NO: 1249814 - DNA, 22 bp, Artificial Sequence
  chemically synthesized
tttttttttttttttttttttt

SEQ ID NO: 1249815 - DNA, 22 bp, Artificial Sequence
  chemically synthesized
tttttttttttttttttttttt

SEQ ID NO: 1249816 - DNA, 22 bp, Artificial Sequence
  chemically synthesized
tttttttttttttttttttttt

SEQ ID NO: 1249817 - DNA, 22 bp, Artificial Sequence
  chemically synthesized
tttttttttttttttttttttt

SEQ ID NO: 1249818 - DNA, 22 bp, Artificial Sequence
  chemically synthesized
tctcaaaaaaaaaaaaaaaaaa

SEQ ID NO: 1249819 - DNA, 22 bp, Artificial Sequence
  chemically synthesized
aaaaaaaaaaaaaaaaaaaaaa

SEQ ID NO: 1249820 - DNA, 22 bp, Artificial Sequence
  chemically synthesized
atgttttttttttttttttttt

SEQ ID NO: 1249821 - DNA, 22 bp, Artificial Sequence
  chemically synthesized
gttgatgttttttttttttttt

SEQ ID NO: 1249822 - DNA, 22 bp, Artificial Sequence
  chemically synthesized
agttgatgtttttttttttttt

SEQ ID NO: 1249823 - DNA, 22 bp, Artificial Sequence
  chemically synthesized
tagttgatgttttttttttttt

SEQ ID NO: 1249824 - DNA, 22 bp, Artificial Sequence
  chemically synthesized
ttagttgatgtttttttttttt

SEQ ID NO: 1249825 - DNA, 22 bp, Artificial Sequence
  chemically synthesized
cccagaccaatgtcataagctt

SEQ ID NO: 1249826 - DNA, 22 bp, Artificial Sequence
  chemically synthesized
gcccagaccaatgtcataagct

SEQ ID NO: 1249827 - DNA, 22 bp, Artificial Sequence
  chemically synthesized
aaagcttatgacattggtctgg

SEQ ID NO: 1249828 - DNA, 22 bp, Artificial Sequence
  chemically synthesized
atgacattggtctgggcaagga

SEQ ID NO: 1249829 - DNA, 22 bp, Artificial Sequence
  chemically synthesized
atatccaaaaaatccttgccca

SEQ ID NO: 1249830 - DNA, 22 bp, Artificial Sequence
  chemically synthesized
tgacattggtctgggcaaggat

SEQ ID NO: 1249831 - DNA, 22 bp, Artificial Sequence
  chemically synthesized
ggttcatatccaaaaaatcctt

SEQ ID NO: 1249832 - DNA, 22 bp, Artificial Sequence
  chemically synthesized
gggttcatatccaaaaaatcct

SEQ ID NO: 1249833 - DNA, 22 bp, Artificial Sequence
  chemically synthesized
ttgggttcatatccaaaaaatc

SEQ ID NO: 1249834 - DNA, 22 bp, Artificial Sequence
  chemically synthesized
gtctgggcaaggattttttgga

SEQ ID NO: 1249835 - DNA, 22 bp, Artificial Sequence
  chemically synthesized
tgctcttgggttcatatccaaa

SEQ ID NO: 1249836 - DNA, 22 bp, Artificial Sequence
  chemically synthesized
ggcaaggattttttggatatga

SEQ ID NO: 1249837 - DNA, 22 bp, Artificial Sequence
  chemically synthesized
cctatgctcttgggttcatatc

SEQ ID NO: 1249838 - DNA, 22 bp, Artificial Sequence
  chemically synthesized
ttgcctatgctcttgggttcat

SEQ ID NO: 1249839 - DNA, 22 bp, Artificial Sequence
  chemically synthesized
gttgcctatgctcttgggttca

SEQ ID NO: 1249840 - DNA, 22 bp, Artificial Sequence
  chemically synthesized
tgttgcctatgctcttgggttc

SEQ ID NO: 1249841 - DNA, 22 bp, Artificial Sequence
  chemically synthesized
ttgttgcctatgctcttgggtt

SEQ ID NO: 1249842 - DNA, 22 bp, Artificial Sequence
  chemically synthesized
tttggatatgaacccaagagca

SEQ ID NO: 1249843 - DNA, 22 bp, Artificial Sequence
  chemically synthesized
ttggatatgaacccaagagcat

SEQ ID NO: 1249844 - DNA, 22 bp, Artificial Sequence
  chemically synthesized
tttttgttgcctatgctcttgg

SEQ ID NO: 1249845 - DNA, 22 bp, Artificial Sequence
  chemically synthesized
tggatatgaacccaagagcata

SEQ ID NO: 1249846 - DNA, 22 bp, Artificial Sequence
  chemically synthesized
atttttgttgcctatgctcttg

SEQ ID NO: 1249847 - DNA, 22 bp, Artificial Sequence
  chemically synthesized
ggatatgaacccaagagcatag

SEQ ID NO: 1249848 - DNA, 22 bp, Artificial Sequence
  chemically synthesized
tatttttgttgcctatgctctt

SEQ ID NO: 1249849 - DNA, 22 bp, Artificial Sequence
  chemically synthesized
gatatgaacccaagagcatagg

SEQ ID NO: 1249850 - DNA, 22 bp, Artificial Sequence
  chemically synthesized
ttatttttgttgcctatgctct

SEQ ID NO: 1249851 - DNA, 22 bp, Artificial Sequence
  chemically synthesized
tttttatttttgttgcctatgc

SEQ ID NO: 1249852 - DNA, 22 bp, Artificial Sequence
  chemically synthesized
tctatttttatttttgttgcct

SEQ ID NO: 1249853 - DNA, 22 bp, Artificial Sequence
  chemically synthesized
gtctatttttatttttgttgcc

SEQ ID NO: 1249854 - DNA, 22 bp, Artificial Sequence
  chemically synthesized
atttgtctatttttatttttgt

SEQ ID NO: 1249855 - DNA, 22 bp, Artificial Sequence
  chemically synthesized
catttgtctatttttatttttg

SEQ ID NO: 1249856 - DNA, 22 bp, Artificial Sequence
  chemically synthesized
atgcaacttcatttgtctattt

SEQ ID NO: 1249857 - DNA, 22 bp, Artificial Sequence
  chemically synthesized
ggttgatgcaacttcatttgtc

SEQ ID NO: 1249858 - DNA, 22 bp, Artificial Sequence
  chemically synthesized
aggttgatgcaacttcatttgt

SEQ ID NO: 1249859 - DNA, 22 bp, Artificial Sequence
  chemically synthesized
tttaggttgatgcaacttcatt

SEQ ID NO: 1249860 - DNA, 22 bp, Artificial Sequence
  chemically synthesized
tgcagaagctgtttaggttgat

SEQ ID NO: 1249861 - DNA, 22 bp, Artificial Sequence
  chemically synthesized
gctgtgcagaagctgtttaggt

SEQ ID NO: 1249862 - DNA, 22 bp, Artificial Sequence
  chemically synthesized
ggctgtgcagaagctgtttagg

SEQ ID NO: 1249863 - DNA, 22 bp, Artificial Sequence
  chemically synthesized
cttggctgtgcagaagctgttt

SEQ ID NO: 1249864 - DNA, 22 bp, Artificial Sequence
  chemically synthesized
ccttggctgtgcagaagctgtt

SEQ ID NO: 1249865 - DNA, 22 bp, Artificial Sequence
  chemically synthesized
catcaacctaaacagcttctgc

SEQ ID NO: 1249866 - DNA, 22 bp, Artificial Sequence
  chemically synthesized
tttccttggctgtgcagaagct

SEQ ID NO: 1249867 - DNA, 22 bp, Artificial Sequence
  chemically synthesized
aacagcttctgcacagccaagg

SEQ ID NO: 1249868 - DNA, 22 bp, Artificial Sequence
  chemically synthesized
aaaagggattatttccttggct

SEQ ID NO: 1249869 - DNA, 22 bp, Artificial Sequence
  chemically synthesized
ctgcacagccaaggaaataatc

SEQ ID NO: 1249870 - DNA, 22 bp, Artificial Sequence
  chemically synthesized
tgcacagccaaggaaataatcc

SEQ ID NO: 1249871 - DNA, 22 bp, Artificial Sequence
  chemically synthesized
cacagccaaggaaataatccct

SEQ ID NO: 1249872 - DNA, 22 bp, Artificial Sequence
  chemically synthesized
tataccatatacctgaaaaggg

SEQ ID NO: 1249873 - DNA, 22 bp, Artificial Sequence
  chemically synthesized
gtataccatatacctgaaaagg

SEQ ID NO: 1249874 - DNA, 22 bp, Artificial Sequence
  chemically synthesized
ttcaggtatatggtatacaaat

SEQ ID NO: 1249875 - DNA, 22 bp, Artificial Sequence
  chemically synthesized
tcaggtatatggtatacaaata

SEQ ID NO: 1249876 - DNA, 22 bp, Artificial Sequence
  chemically synthesized
caggtatatggtatacaaatat

SEQ ID NO: 1249877 - DNA, 22 bp, Artificial Sequence
  chemically synthesized
aggtatatggtatacaaatatt

SEQ ID NO: 1249878 - DNA, 22 bp, Artificial Sequence
  chemically synthesized
atggagcaggagaaaatatttg

SEQ ID NO: 1249879 - DNA, 22 bp, Artificial Sequence
  chemically synthesized
tctcctgctccatgagttgtcc

SEQ ID NO: 1249880 - DNA, 22 bp, Artificial Sequence
  chemically synthesized
atcagagtgaagggacaactca

SEQ ID NO: 1249881 - DNA, 22 bp, Artificial Sequence
  chemically synthesized
ctcctgctccatgagttgtccc

SEQ ID NO: 1249882 - DNA, 22 bp, Artificial Sequence
  chemically synthesized
tcctgctccatgagttgtccct

SEQ ID NO: 1249883 - DNA, 22 bp, Artificial Sequence
  chemically synthesized
ctgctccatgagttgtcccttc

SEQ ID NO: 1249884 - DNA, 22 bp, Artificial Sequence
  chemically synthesized
ctccatgagttgtcccttcact

SEQ ID NO: 1249885 - DNA, 22 bp, Artificial Sequence
  chemically synthesized
gatattaatcagagtgaaggga

SEQ ID NO: 1249886 - DNA, 22 bp, Artificial Sequence
  chemically synthesized
ggatattaatcagagtgaaggg

SEQ ID NO: 1249887 - DNA, 22 bp, Artificial Sequence
  chemically synthesized
tggatattaatcagagtgaagg

SEQ ID NO: 1249888 - DNA, 22 bp, Artificial Sequence
  chemically synthesized
catgagttgtcccttcactctg

SEQ ID NO: 1249889 - DNA, 22 bp, Artificial Sequence
  chemically synthesized
ttggatattaatcagagtgaag

SEQ ID NO: 1249890 - DNA, 22 bp, Artificial Sequence
  chemically synthesized
tatatttttggatattaatcag

SEQ ID NO: 1249891 - DNA, 22 bp, Artificial Sequence
  chemically synthesized
atatatttttggatattaatca

SEQ ID NO: 1249892 - DNA, 22 bp, Artificial Sequence
  chemically synthesized
tcccttcactctgattaatatc

SEQ ID NO: 1249893 - DNA, 22 bp, Artificial Sequence
  chemically synthesized
ttatatatttttggatattaat

SEQ ID NO: 1249894 - DNA, 22 bp, Artificial Sequence
  chemically synthesized
cttatatatttttggatattaa

SEQ ID NO: 1249895 - DNA, 22 bp, Artificial Sequence
  chemically synthesized
cactctgattaatatccaaaaa

SEQ ID NO: 1249896 - DNA, 22 bp, Artificial Sequence
  chemically synthesized
actctgattaatatccaaaaat

SEQ ID NO: 1249897 - DNA, 22 bp, Artificial Sequence
  chemically synthesized
aggtttcttatatatttttgga

SEQ ID NO: 1249898 - DNA, 22 bp, Artificial Sequence
  chemically synthesized
aaggtttcttatatatttttgg

SEQ ID NO: 1249899 - DNA, 22 bp, Artificial Sequence
  chemically synthesized
tgattaatatccaaaaatatat

SEQ ID NO: 1249900 - DNA, 22 bp, Artificial Sequence
  chemically synthesized
attaatatccaaaaatatataa

SEQ ID NO: 1249901 - DNA, 22 bp, Artificial Sequence
  chemically synthesized
agtttaaggtttcttatatatt

SEQ ID NO: 1249902 - DNA, 22 bp, Artificial Sequence
  chemically synthesized
atatccaaaaatatataagaaa

SEQ ID NO: 1249903 - DNA, 22 bp, Artificial Sequence
  chemically synthesized
ttgagtttaaggtttcttatat

SEQ ID NO: 1249904 - DNA, 22 bp, Artificial Sequence
  chemically synthesized
ctattgagtttaaggtttctta

SEQ ID NO: 1249905 - DNA, 22 bp, Artificial Sequence
  chemically synthesized
tattgctattgagtttaaggtt

SEQ ID NO: 1249906 - DNA, 22 bp, Artificial Sequence
  chemically synthesized
ttgtattgctattgagtttaag

SEQ ID NO: 1249907 - DNA, 22 bp, Artificial Sequence
  chemically synthesized
ggttgttgtattgctattgagt

SEQ ID NO: 1249908 - DNA, 22 bp, Artificial Sequence
  chemically synthesized
attgggttgttgtattgctatt

SEQ ID NO: 1249909 - DNA, 22 bp, Artificial Sequence
  chemically synthesized
aattgggttgttgtattgctat

SEQ ID NO: 1249910 - DNA, 22 bp, Artificial Sequence
  chemically synthesized
aaactcaatagcaatacaacaa

SEQ ID NO: 1249911 - DNA, 22 bp, Artificial Sequence
  chemically synthesized
aactcaatagcaatacaacaac

SEQ ID NO: 1249912 - DNA, 22 bp, Artificial Sequence
  chemically synthesized
cccatatttaattgggttgttg

SEQ ID NO: 1249913 - DNA, 22 bp, Artificial Sequence
  chemically synthesized
gcccatatttaattgggttgtt

SEQ ID NO: 1249914 - DNA, 22 bp, Artificial Sequence
  chemically synthesized
aatagcaatacaacaacccaat

SEQ ID NO: 1249915 - DNA, 22 bp, Artificial Sequence
  chemically synthesized
tgcccatatttaattgggttgt

SEQ ID NO: 1249916 - DNA, 22 bp, Artificial Sequence
  chemically synthesized
aggtcctttgcccatatttaat

SEQ ID NO: 1249917 - DNA, 22 bp, Artificial Sequence
  chemically synthesized
ttgaggtcctttgcccatattt

SEQ ID NO: 1249918 - DNA, 22 bp, Artificial Sequence
  chemically synthesized
aatatgggcaaaggacctcaac

SEQ ID NO: 1249919 - DNA, 22 bp, Artificial Sequence
  chemically synthesized
aaaaaaaaagtctgttgaggtc

SEQ ID NO: 1249920 - DNA, 22 bp, Artificial Sequence
  chemically synthesized
caaaaaaaaagtctgttgaggt

SEQ ID NO: 1249921 - DNA, 22 bp, Artificial Sequence
  chemically synthesized
tttcaaaaaaaaagtctgttga

SEQ ID NO: 1249922 - DNA, 22 bp, Artificial Sequence
  chemically synthesized
atttcaaaaaaaaagtctgttg

SEQ ID NO: 1249923 - DNA, 22 bp, Artificial Sequence
  chemically synthesized
tatttcaaaaaaaaagtctgtt

SEQ ID NO: 1249924 - DNA, 22 bp, Artificial Sequence
  chemically synthesized
ttatttcaaaaaaaaagtctgt

SEQ ID NO: 1249925 - DNA, 22 bp, Artificial Sequence
  chemically synthesized
tttatttcaaaaaaaaagtctg

SEQ ID NO: 1249926 - DNA, 22 bp, Artificial Sequence
  chemically synthesized
ttttatttcaaaaaaaaagtct

SEQ ID NO: 1249927 - DNA, 22 bp, Artificial Sequence
  chemically synthesized
aaagcttttttatttcaaaaaa

SEQ ID NO: 1249928 - DNA, 22 bp, Artificial Sequence
  chemically synthesized
aaaagcttttttatttcaaaaa

SEQ ID NO: 1249929 - DNA, 22 bp, Artificial Sequence
  chemically synthesized
aacagactttttttttgaaata

SEQ ID NO: 1249930 - DNA, 22 bp, Artificial Sequence
  chemically synthesized
taaaagcttttttatttcaaaa

SEQ ID NO: 1249931 - DNA, 22 bp, Artificial Sequence
  chemically synthesized
tcatattttaaaagctttttta

SEQ ID NO: 1249932 - DNA, 22 bp, Artificial Sequence
  chemically synthesized
tttttttgaaataaaaaagctt

SEQ ID NO: 1249933 - DNA, 22 bp, Artificial Sequence
  chemically synthesized
gtcatattttaaaagctttttt

SEQ ID NO: 1249934 - DNA, 22 bp, Artificial Sequence
  chemically synthesized
ttttttgaaataaaaaagcttt

SEQ ID NO: 1249935 - DNA, 22 bp, Artificial Sequence
  chemically synthesized
tgtcatattttaaaagcttttt

SEQ ID NO: 1249936 - DNA, 22 bp, Artificial Sequence
  chemically synthesized
tttttgaaataaaaaagctttt

SEQ ID NO: 1249937 - DNA, 22 bp, Artificial Sequence
  chemically synthesized
ttttgaaataaaaaagctttta

SEQ ID NO: 1249938 - DNA, 22 bp, Artificial Sequence
  chemically synthesized
tttgaaataaaaaagcttttaa

SEQ ID NO: 1249939 - DNA, 22 bp, Artificial Sequence
  chemically synthesized
ctttgtcatattttaaaagctt

SEQ ID NO: 1249940 - DNA, 22 bp, Artificial Sequence
  chemically synthesized
ttgaaataaaaaagcttttaaa

SEQ ID NO: 1249941 - DNA, 22 bp, Artificial Sequence
  chemically synthesized
actttgtcatattttaaaagct

SEQ ID NO: 1249942 - DNA, 22 bp, Artificial Sequence
  chemically synthesized
tgaaataaaaaagcttttaaaa

SEQ ID NO: 1249943 - DNA, 22 bp, Artificial Sequence
  chemically synthesized
tactttgtcatattttaaaagc

SEQ ID NO: 1249944 - DNA, 22 bp, Artificial Sequence
  chemically synthesized
gaaataaaaaagcttttaaaat

SEQ ID NO: 1249945 - DNA, 22 bp, Artificial Sequence
  chemically synthesized
aaataaaaaagcttttaaaata

SEQ ID NO: 1249946 - DNA, 22 bp, Artificial Sequence
  chemically synthesized
tgattttactttgtcatatttt

SEQ ID NO: 1249947 - DNA, 22 bp, Artificial Sequence
  chemically synthesized
ccactgtgattttactttgtca

SEQ ID NO: 1249948 - DNA, 22 bp, Artificial Sequence
  chemically synthesized
ttaaaatatgacaaagtaaaat

SEQ ID NO: 1249949 - DNA, 22 bp, Artificial Sequence
  chemically synthesized
taaaatatgacaaagtaaaatc

SEQ ID NO: 1249950 - DNA, 22 bp, Artificial Sequence
  chemically synthesized
aaaatatgacaaagtaaaatca

SEQ ID NO: 1249951 - DNA, 22 bp, Artificial Sequence
  chemically synthesized
aaatatgacaaagtaaaatcac

SEQ ID NO: 1249952 - DNA, 22 bp, Artificial Sequence
  chemically synthesized
atcacagttgccactgtgattt

SEQ ID NO: 1249953 - DNA, 22 bp, Artificial Sequence
  chemically synthesized
aatcacagttgccactgtgatt

SEQ ID NO: 1249954 - DNA, 22 bp, Artificial Sequence
  chemically synthesized
cttaatcacagttgccactgtg

SEQ ID NO: 1249955 - DNA, 22 bp, Artificial Sequence
  chemically synthesized
agttccttaatcacagttgcca

SEQ ID NO: 1249956 - DNA, 22 bp, Artificial Sequence
  chemically synthesized
tgattaaggaactgaattttta

SEQ ID NO: 1249957 - DNA, 22 bp, Artificial Sequence
  chemically synthesized
aaaaaaataaaaaataaaaatt

SEQ ID NO: 1249958 - DNA, 22 bp, Artificial Sequence
  chemically synthesized
aaaaaaaataaaaaataaaaat

SEQ ID NO: 1249959 - DNA, 22 bp, Artificial Sequence
  chemically synthesized
aggaactgaatttttatttttt

SEQ ID NO: 1249960 - DNA, 22 bp, Artificial Sequence
  chemically synthesized
aatttttattttttattttttt

SEQ ID NO: 1249961 - DNA, 22 bp, Artificial Sequence
  chemically synthesized
ttattttttattttttttaagt

SEQ ID NO: 1249962 - DNA, 22 bp, Artificial Sequence
  chemically synthesized
tattttttattttttttaagtt

SEQ ID NO: 1249963 - DNA, 22 bp, Artificial Sequence
  chemically synthesized
attttttattttttttaagttc

SEQ ID NO: 1249964 - DNA, 22 bp, Artificial Sequence
  chemically synthesized
ttttttattttttttaagttct

SEQ ID NO: 1249965 - DNA, 22 bp, Artificial Sequence
  chemically synthesized
cacatgtatcccagaacttaaa

SEQ ID NO: 1249966 - DNA, 22 bp, Artificial Sequence
  chemically synthesized
tgcacatgtatcccagaactta

SEQ ID NO: 1249967 - DNA, 22 bp, Artificial Sequence
  chemically synthesized
tttattttttttaagttctggg

SEQ ID NO: 1249968 - DNA, 22 bp, Artificial Sequence
  chemically synthesized
ttattttttttaagttctggga

SEQ ID NO: 1249969 - DNA, 22 bp, Artificial Sequence
  chemically synthesized
tattttttttaagttctgggat

SEQ ID NO: 1249970 - DNA, 22 bp, Artificial Sequence
  chemically synthesized
attttttttaagttctgggata

SEQ ID NO: 1249971 - DNA, 22 bp, Artificial Sequence
  chemically synthesized
ttttttttaagttctgggatac

SEQ ID NO: 1249972 - DNA, 22 bp, Artificial Sequence
  chemically synthesized
cacgttctgcacatgtatccca

SEQ ID NO: 1249973 - DNA, 22 bp, Artificial Sequence
  chemically synthesized
tttttaagttctgggatacatg

SEQ ID NO: 1249974 - DNA, 22 bp, Artificial Sequence
  chemically synthesized
ttttaagttctgggatacatgt

SEQ ID NO: 1249975 - DNA, 22 bp, Artificial Sequence
  chemically synthesized
tttaagttctgggatacatgtg

SEQ ID NO: 1249976 - DNA, 22 bp, Artificial Sequence
  chemically synthesized
ttaagttctgggatacatgtgc

SEQ ID NO: 1249977 - DNA, 22 bp, Artificial Sequence
  chemically synthesized
taagttctgggatacatgtgca

SEQ ID NO: 1249978 - DNA, 22 bp, Artificial Sequence
  chemically synthesized
aagttctgggatacatgtgcag

SEQ ID NO: 1249979 - DNA, 22 bp, Artificial Sequence
  chemically synthesized
agttctgggatacatgtgcaga

SEQ ID NO: 1249980 - DNA, 22 bp, Artificial Sequence
  chemically synthesized
tgggatacatgtgcagaacgtg

SEQ ID NO: 1249981 - DNA, 22 bp, Artificial Sequence
  chemically synthesized
tgtaagaagcctgcacgttctg

SEQ ID NO: 1249982 - DNA, 22 bp, Artificial Sequence
  chemically synthesized
ggatacatgtgcagaacgtgca

SEQ ID NO: 1249983 - DNA, 22 bp, Artificial Sequence
  chemically synthesized
cttacataggtatacatgtgcc

SEQ ID NO: 1249984 - DNA, 22 bp, Artificial Sequence
  chemically synthesized
ttacataggtatacatgtgcca

SEQ ID NO: 1249985 - DNA, 22 bp, Artificial Sequence
  chemically synthesized
acataggtatacatgtgccatg

SEQ ID NO: 1249986 - DNA, 22 bp, Artificial Sequence
  chemically synthesized
cataggtatacatgtgccatgg

SEQ ID NO: 1249987 - DNA, 22 bp, Artificial Sequence
  chemically synthesized
atagatgcagcaaaccaccatg

SEQ ID NO: 1249988 - DNA, 22 bp, Artificial Sequence
  chemically synthesized
gatgacgggttgatagatgcag

SEQ ID NO: 1249989 - DNA, 22 bp, Artificial Sequence
  chemically synthesized
aaacctagatgacgggttgata

SEQ ID NO: 1249990 - DNA, 22 bp, Artificial Sequence
  chemically synthesized
aaaacctagatgacgggttgat

SEQ ID NO: 1249991 - DNA, 22 bp, Artificial Sequence
  chemically synthesized
gctgcatctatcaacccgtcat

SEQ ID NO: 1249992 - DNA, 22 bp, Artificial Sequence
  chemically synthesized
ctgcatctatcaacccgtcatc

SEQ ID NO: 1249993 - DNA, 22 bp, Artificial Sequence
  chemically synthesized
catctatcaacccgtcatctag

SEQ ID NO: 1249994 - DNA, 22 bp, Artificial Sequence
  chemically synthesized
tcaacccgtcatctaggtttta

SEQ ID NO: 1249995 - DNA, 22 bp, Artificial Sequence
  chemically synthesized
atgcacacaggacttaaaacct

SEQ ID NO: 1249996 - DNA, 22 bp, Artificial Sequence
  chemically synthesized
ggttttaagtcctgtgtgcatt

SEQ ID NO: 1249997 - DNA, 22 bp, Artificial Sequence
  chemically synthesized
ggacaaatacctaatgcacaca

SEQ ID NO: 1249998 - DNA, 22 bp, Artificial Sequence
  chemically synthesized
taagtcctgtgtgcattaggta

SEQ ID NO: 1249999 - DNA, 22 bp, Artificial Sequence
  chemically synthesized
aagtcctgtgtgcattaggtat

SEQ ID NO: 1250000 - DNA, 22 bp, Artificial Sequence
  chemically synthesized
agtcctgtgtgcattaggtatt

SEQ ID NO: 1250001 - DNA, 22 bp, Artificial Sequence
  chemically synthesized
tgtgcattaggtatttgtccta

SEQ ID NO: 1250002 - DNA, 22 bp, Artificial Sequence
  chemically synthesized
ggtatttgtcctaatgctctcc

SEQ ID NO: 1250003 - DNA, 22 bp, Artificial Sequence
  chemically synthesized
gtcctaatgctctccctcccct

SEQ ID NO: 1250004 - DNA, 22 bp, Artificial Sequence
  chemically synthesized
tcctaatgctctccctcccctt

SEQ ID NO: 1250005 - DNA, 22 bp, Artificial Sequence
  chemically synthesized
atgctctccctccccttgctcc

SEQ ID NO: 1250006 - DNA, 22 bp, Artificial Sequence
  chemically synthesized
tgggggtgggggcgtagggagc

SEQ ID NO: 1250007 - DNA, 22 bp, Artificial Sequence
  chemically synthesized
tccctccccttgctccctacgc

SEQ ID NO: 1250008 - DNA, 22 bp, Artificial Sequence
  chemically synthesized
cctccccttgctccctacgccc

SEQ ID NO: 1250009 - DNA, 22 bp, Artificial Sequence
  chemically synthesized
cccttgctccctacgcccccac

SEQ ID NO: 1250010 - DNA, 22 bp, Artificial Sequence
  chemically synthesized
gctccctacgcccccaccccca

SEQ ID NO: 1250011 - DNA, 22 bp, Artificial Sequence
  chemically synthesized
ctccctacgcccccacccccac

SEQ ID NO: 1250012 - DNA, 22 bp, Artificial Sequence
  chemically synthesized
cctacgcccccacccccacagg

SEQ ID NO: 1250013 - DNA, 22 bp, Artificial Sequence
  chemically synthesized
cgcccccacccccacaggctcc

SEQ ID NO: 1250014 - DNA, 22 bp, Artificial Sequence
  chemically synthesized
cggtctgtcatgttcccctccc

SEQ ID NO: 1250015 - DNA, 22 bp, Artificial Sequence
  chemically synthesized
agacatggacacggggagggga

SEQ ID NO: 1250016 - DNA, 22 bp, Artificial Sequence
  chemically synthesized
gttgagacatggacacggggag

SEQ ID NO: 1250017 - DNA, 22 bp, Artificial Sequence
  chemically synthesized
tcatgttcccctccccgtgtcc

SEQ ID NO: 1250018 - DNA, 22 bp, Artificial Sequence
  chemically synthesized
ccctccccgtgtccatgtctca

SEQ ID NO: 1250019 - DNA, 22 bp, Artificial Sequence
  chemically synthesized
agacatgctcgttgagacatgg

SEQ ID NO: 1250020 - DNA, 22 bp, Artificial Sequence
  chemically synthesized
aagacatgctcgttgagacatg

SEQ ID NO: 1250021 - DNA, 22 bp, Artificial Sequence
  chemically synthesized
cccgtgtccatgtctcaacgag

SEQ ID NO: 1250022 - DNA, 22 bp, Artificial Sequence
  chemically synthesized
ccttaagacatgctcgttgaga

SEQ ID NO: 1250023 - DNA, 22 bp, Artificial Sequence
  chemically synthesized
cccttaagacatgctcgttgag

SEQ ID NO: 1250024 - DNA, 22 bp, Artificial Sequence
  chemically synthesized
tttcccttaagacatgctcgtt

SEQ ID NO: 1250025 - DNA, 22 bp, Artificial Sequence
  chemically synthesized
gtttcccttaagacatgctcgt

SEQ ID NO: 1250026 - DNA, 22 bp, Artificial Sequence
  chemically synthesized
tccatttgtttcccttaagaca

SEQ ID NO: 1250027 - DNA, 22 bp, Artificial Sequence
  chemically synthesized
ttgtccatttgtttcccttaag

SEQ ID NO: 1250028 - DNA, 22 bp, Artificial Sequence
  chemically synthesized
aacgagcatgtcttaagggaaa

SEQ ID NO: 1250029 - DNA, 22 bp, Artificial Sequence
  chemically synthesized
tcatatacctgttgtccatttg

SEQ ID NO: 1250030 - DNA, 22 bp, Artificial Sequence
  chemically synthesized
gtcatatacctgttgtccattt

SEQ ID NO: 1250031 - DNA, 22 bp, Artificial Sequence
  chemically synthesized
tgtcatatacctgttgtccatt

SEQ ID NO: 1250032 - DNA, 22 bp, Artificial Sequence
  chemically synthesized
aagggaaacaaatggacaacag

SEQ ID NO: 1250033 - DNA, 22 bp, Artificial Sequence
  chemically synthesized
agggaaacaaatggacaacagg

SEQ ID NO: 1250034 - DNA, 22 bp, Artificial Sequence
  chemically synthesized
atgataagcattttgtcatata

SEQ ID NO: 1250035 - DNA, 22 bp, Artificial Sequence
  chemically synthesized
actaatgataagcattttgtca

SEQ ID NO: 1250036 - DNA, 22 bp, Artificial Sequence
  chemically synthesized
cctgactaatgataagcatttt

SEQ ID NO: 1250037 - DNA, 22 bp, Artificial Sequence
  chemically synthesized
cagttacctgactaatgataag

SEQ ID NO: 1250038 - DNA, 22 bp, Artificial Sequence
  chemically synthesized
gcagttacctgactaatgataa

SEQ ID NO: 1250039 - DNA, 22 bp, Artificial Sequence
  chemically synthesized
atttgcagttacctgactaatg

SEQ ID NO: 1250040 - DNA, 22 bp, Artificial Sequence
  chemically synthesized
aatttgcagttacctgactaat

SEQ ID NO: 1250041 - DNA, 22 bp, Artificial Sequence
  chemically synthesized
taatttgcagttacctgactaa

SEQ ID NO: 1250042 - DNA, 22 bp, Artificial Sequence
  chemically synthesized
ttttaatttgcagttacctgac

SEQ ID NO: 1250043 - DNA, 22 bp, Artificial Sequence
  chemically synthesized
atcattagtcaggtaactgcaa

SEQ ID NO: 1250044 - DNA, 22 bp, Artificial Sequence
  chemically synthesized
tcattagtcaggtaactgcaaa

SEQ ID NO: 1250045 - DNA, 22 bp, Artificial Sequence
  chemically synthesized
gtcaggtaactgcaaattaaaa

SEQ ID NO: 1250046 - DNA, 22 bp, Artificial Sequence
  chemically synthesized
caaattaaaacaatatgctatc

SEQ ID NO: 1250047 - DNA, 22 bp, Artificial Sequence
  chemically synthesized
acaggtgtggggtgatagcata

SEQ ID NO: 1250048 - DNA, 22 bp, Artificial Sequence
  chemically synthesized
tgacaggtgtggggtgatagca

SEQ ID NO: 1250049 - DNA, 22 bp, Artificial Sequence
  chemically synthesized
aaacaatatgctatcaccccac

SEQ ID NO: 1250050 - DNA, 22 bp, Artificial Sequence
  chemically synthesized
agaatagccattctgacaggtg

SEQ ID NO: 1250051 - DNA, 22 bp, Artificial Sequence
  chemically synthesized
gagaatagccattctgacaggt

SEQ ID NO: 1250052 - DNA, 22 bp, Artificial Sequence
  chemically synthesized
tgagaatagccattctgacagg

SEQ ID NO: 1250053 - DNA, 22 bp, Artificial Sequence
  chemically synthesized
ttgagaatagccattctgacag

SEQ ID NO: 1250054 - DNA, 22 bp, Artificial Sequence
  chemically synthesized
tcaccccacacctgtcagaatg

SEQ ID NO: 1250055 - DNA, 22 bp, Artificial Sequence
  chemically synthesized
tttgagaatagccattctgaca

SEQ ID NO: 1250056 - DNA, 22 bp, Artificial Sequence
  chemically synthesized
tctttttgagaatagccattct

SEQ ID NO: 1250057 - DNA, 22 bp, Artificial Sequence
  chemically synthesized
gtctttttgagaatagccattc

SEQ ID NO: 1250058 - DNA, 22 bp, Artificial Sequence
  chemically synthesized
tgtctttttgagaatagccatt

SEQ ID NO: 1250059 - DNA, 22 bp, Artificial Sequence
  chemically synthesized
tcctttgtctttttgagaatag

SEQ ID NO: 1250060 - DNA, 22 bp, Artificial Sequence
  chemically synthesized
tcagaatggctattctcaaaaa

SEQ ID NO: 1250061 - DNA, 22 bp, Artificial Sequence
  chemically synthesized
gttatcctttgtctttttgaga

SEQ ID NO: 1250062 - DNA, 22 bp, Artificial Sequence
  chemically synthesized
accaacactagttatcctttgt

SEQ ID NO: 1250063 - DNA, 22 bp, Artificial Sequence
  chemically synthesized
ttctcaaaaagacaaaggataa

SEQ ID NO: 1250064 - DNA, 22 bp, Artificial Sequence
  chemically synthesized
tcaccaacactagttatccttt

SEQ ID NO: 1250065 - DNA, 22 bp, Artificial Sequence
  chemically synthesized
tcaaaaagacaaaggataacta

SEQ ID NO: 1250066 - DNA, 22 bp, Artificial Sequence
  chemically synthesized
aaaaagacaaaggataactagt

SEQ ID NO: 1250067 - DNA, 22 bp, Artificial Sequence
  chemically synthesized
catattctcaccaacactagtt

SEQ ID NO: 1250068 - DNA, 22 bp, Artificial Sequence
  chemically synthesized
ccatattctcaccaacactagt

SEQ ID NO: 1250069 - DNA, 22 bp, Artificial Sequence
  chemically synthesized
tccatattctcaccaacactag

SEQ ID NO: 1250070 - DNA, 22 bp, Artificial Sequence
  chemically synthesized
ttccatattctcaccaacacta

SEQ ID NO: 1250071 - DNA, 22 bp, Artificial Sequence
  chemically synthesized
ttttccatattctcaccaacac

SEQ ID NO: 1250072 - DNA, 22 bp, Artificial Sequence
  chemically synthesized
cctcttttccatattctcacca

SEQ ID NO: 1250073 - DNA, 22 bp, Artificial Sequence
  chemically synthesized
ccctcttttccatattctcacc

SEQ ID NO: 1250074 - DNA, 22 bp, Artificial Sequence
  chemically synthesized
gtgttggtgagaatatggaaaa

SEQ ID NO: 1250075 - DNA, 22 bp, Artificial Sequence
  chemically synthesized
gtgagaatatggaaaagaggga

SEQ ID NO: 1250076 - DNA, 22 bp, Artificial Sequence
  chemically synthesized
agggtccaaggtttccctcttt

SEQ ID NO: 1250077 - DNA, 22 bp, Artificial Sequence
  chemically synthesized
ccattaagggtccaaggtttcc

SEQ ID NO: 1250078 - DNA, 22 bp, Artificial Sequence
  chemically synthesized
tgttcccattaagggtccaagg

SEQ ID NO: 1250079 - DNA, 22 bp, Artificial Sequence
  chemically synthesized
atgttcccattaagggtccaag

SEQ ID NO: 1250080 - DNA, 22 bp, Artificial Sequence
  chemically synthesized
tttatgttcccattaagggtcc

SEQ ID NO: 1250081 - DNA, 22 bp, Artificial Sequence
  chemically synthesized
tacctatttatgttcccattaa

SEQ ID NO: 1250082 - DNA, 22 bp, Artificial Sequence
  chemically synthesized
ggacccttaatgggaacataaa

SEQ ID NO: 1250083 - DNA, 22 bp, Artificial Sequence
  chemically synthesized
gacccttaatgggaacataaat

SEQ ID NO: 1250084 - DNA, 22 bp, Artificial Sequence
  chemically synthesized
cataatggctgtacctatttat

SEQ ID NO: 1250085 - DNA, 22 bp, Artificial Sequence
  chemically synthesized
ccataatggctgtacctattta

SEQ ID NO: 1250086 - DNA, 22 bp, Artificial Sequence
  chemically synthesized
tccataatggctgtacctattt

SEQ ID NO: 1250087 - DNA, 22 bp, Artificial Sequence
  chemically synthesized
aatgggaacataaataggtaca

SEQ ID NO: 1250088 - DNA, 22 bp, Artificial Sequence
  chemically synthesized
atgggaacataaataggtacag

SEQ ID NO: 1250089 - DNA, 22 bp, Artificial Sequence
  chemically synthesized
ttttccataatggctgtaccta

SEQ ID NO: 1250090 - DNA, 22 bp, Artificial Sequence
  chemically synthesized
ctgttttccataatggctgtac

SEQ ID NO: 1250091 - DNA, 22 bp, Artificial Sequence
  chemically synthesized
ctgctgttttccataatggctg

SEQ ID NO: 1250092 - DNA, 22 bp, Artificial Sequence
  chemically synthesized
cctgctgttttccataatggct

SEQ ID NO: 1250093 - DNA, 22 bp, Artificial Sequence
  chemically synthesized
aagaacttcctgctgttttcca

SEQ ID NO: 1250094 - DNA, 22 bp, Artificial Sequence
  chemically synthesized
gaagaacttcctgctgttttcc

SEQ ID NO: 1250095 - DNA, 22 bp, Artificial Sequence
  chemically synthesized
tgaagaacttcctgctgttttc

SEQ ID NO: 1250096 - DNA, 22 bp, Artificial Sequence
  chemically synthesized
ttgaagaacttcctgctgtttt

SEQ ID NO: 1250097 - DNA, 22 bp, Artificial Sequence
  chemically synthesized
tttgaagaacttcctgctgttt

SEQ ID NO: 1250098 - DNA, 22 bp, Artificial Sequence
  chemically synthesized
ttttgaagaacttcctgctgtt

SEQ ID NO: 1250099 - DNA, 22 bp, Artificial Sequence
  chemically synthesized
tttttgaagaacttcctgctgt

SEQ ID NO: 1250100 - DNA, 22 bp, Artificial Sequence
  chemically synthesized
ttttttgaagaacttcctgctg

SEQ ID NO: 1250101 - DNA, 22 bp, Artificial Sequence
  chemically synthesized
tttttttttgaagaacttcctg

SEQ ID NO: 1250102 - DNA, 22 bp, Artificial Sequence
  chemically synthesized
atttttttttgaagaacttcct

SEQ ID NO: 1250103 - DNA, 22 bp, Artificial Sequence
  chemically synthesized
tggaaaacagcaggaagttctt

SEQ ID NO: 1250104 - DNA, 22 bp, Artificial Sequence
  chemically synthesized
tatttttttttgaagaacttcc

SEQ ID NO: 1250105 - DNA, 22 bp, Artificial Sequence
  chemically synthesized
ttatttttttttgaagaacttc

SEQ ID NO: 1250106 - DNA, 22 bp, Artificial Sequence
  chemically synthesized
tttttatttttttttgaagaac

SEQ ID NO: 1250107 - DNA, 22 bp, Artificial Sequence
  chemically synthesized
tatttttatttttttttgaaga

SEQ ID NO: 1250108 - DNA, 22 bp, Artificial Sequence
  chemically synthesized
tatggtagttctatttttattt

SEQ ID NO: 1250109 - DNA, 22 bp, Artificial Sequence
  chemically synthesized
ttcaaaaaaaaataaaaataga

SEQ ID NO: 1250110 - DNA, 22 bp, Artificial Sequence
  chemically synthesized
caaaaaaaaataaaaatagaac

SEQ ID NO: 1250111 - DNA, 22 bp, Artificial Sequence
  chemically synthesized
gattgtatggtagttctatttt

SEQ ID NO: 1250112 - DNA, 22 bp, Artificial Sequence
  chemically synthesized
aaaaaaaaataaaaatagaact

SEQ ID NO: 1250113 - DNA, 22 bp, Artificial Sequence
  chemically synthesized
ctggattgtatggtagttctat

SEQ ID NO: 1250114 - DNA, 22 bp, Artificial Sequence
  chemically synthesized
ccatacaatccagcaatctcac

SEQ ID NO: 1250115 - DNA, 22 bp, Artificial Sequence
  chemically synthesized
ggtatgtacccagtagtgagat

SEQ ID NO: 1250116 - DNA, 22 bp, Artificial Sequence
  chemically synthesized
aggtatgtacccagtagtgaga

SEQ ID NO: 1250117 - DNA, 22 bp, Artificial Sequence
  chemically synthesized
cttaggtatgtacccagtagtg

SEQ ID NO: 1250118 - DNA, 22 bp, Artificial Sequence
  chemically synthesized
ccttaggtatgtacccagtagt

SEQ ID NO: 1250119 - DNA, 22 bp, Artificial Sequence
  chemically synthesized
atgtcatttccttaggtatgta

SEQ ID NO: 1250120 - DNA, 22 bp, Artificial Sequence
  chemically synthesized
actactgggtacatacctaagg

SEQ ID NO: 1250121 - DNA, 22 bp, Artificial Sequence
  chemically synthesized
ctgggtacatacctaaggaaat

SEQ ID NO: 1250122 - DNA, 22 bp, Artificial Sequence
  chemically synthesized
atatactgatgtcatttcctta

SEQ ID NO: 1250123 - DNA, 22 bp, Artificial Sequence
  chemically synthesized
gatatactgatgtcatttcctt

SEQ ID NO: 1250124 - DNA, 22 bp, Artificial Sequence
  chemically synthesized
ggtacatacctaaggaaatgac

SEQ ID NO: 1250125 - DNA, 22 bp, Artificial Sequence
  chemically synthesized
cttgatatactgatgtcatttc

SEQ ID NO: 1250126 - DNA, 22 bp, Artificial Sequence
  chemically synthesized
aggaaatgacatcagtatatca

SEQ ID NO: 1250127 - DNA, 22 bp, Artificial Sequence
  chemically synthesized
ccacaataaacacgggtgtgca

SEQ ID NO: 1250128 - DNA, 22 bp, Artificial Sequence
  chemically synthesized
atgtgaatactgccacaataaa

SEQ ID NO: 1250129 - DNA, 22 bp, Artificial Sequence
  chemically synthesized
cacacccgtgtttattgtggca

SEQ ID NO: 1250130 - DNA, 22 bp, Artificial Sequence
  chemically synthesized
tctaatgtgaatactgccacaa

SEQ ID NO: 1250131 - DNA, 22 bp, Artificial Sequence
  chemically synthesized
gtctaatgtgaatactgccaca

SEQ ID NO: 1250132 - DNA, 22 bp, Artificial Sequence
  chemically synthesized
catatcttgtctaatgtgaata

SEQ ID NO: 1250133 - DNA, 22 bp, Artificial Sequence
  chemically synthesized
attgtggcagtattcacattag

SEQ ID NO: 1250134 - DNA, 22 bp, Artificial Sequence
  chemically synthesized
ttgtggcagtattcacattaga

SEQ ID NO: 1250135 - DNA, 22 bp, Artificial Sequence
  chemically synthesized
attccatatcttgtctaatgtg

SEQ ID NO: 1250136 - DNA, 22 bp, Artificial Sequence
  chemically synthesized
tggcagtattcacattagacaa

SEQ ID NO: 1250137 - DNA, 22 bp, Artificial Sequence
  chemically synthesized
ggttgattccatatcttgtcta

SEQ ID NO: 1250138 - DNA, 22 bp, Artificial Sequence
  chemically synthesized
aggttgattccatatcttgtct

SEQ ID NO: 1250139 - DNA, 22 bp, Artificial Sequence
  chemically synthesized
cttaggttgattccatatcttg

SEQ ID NO: 1250140 - DNA, 22 bp, Artificial Sequence
  chemically synthesized
acattagacaagatatggaatc

SEQ ID NO: 1250141 - DNA, 22 bp, Artificial Sequence
  chemically synthesized
atggttacttaggttgattcca

SEQ ID NO: 1250142 - DNA, 22 bp, Artificial Sequence
  chemically synthesized
gacaagatatggaatcaaccta

SEQ ID NO: 1250143 - DNA, 22 bp, Artificial Sequence
  chemically synthesized
ttgatggttacttaggttgatt

SEQ ID NO: 1250144 - DNA, 22 bp, Artificial Sequence
  chemically synthesized
atctgttgatggttacttaggt

SEQ ID NO: 1250145 - DNA, 22 bp, Artificial Sequence
  chemically synthesized
aatccgttcatctgttgatggt

SEQ ID NO: 1250146 - DNA, 22 bp, Artificial Sequence
  chemically synthesized
gaatccgttcatctgttgatgg

SEQ ID NO: 1250147 - DNA, 22 bp, Artificial Sequence
  chemically synthesized
tgaatccgttcatctgttgatg

SEQ ID NO: 1250148 - DNA, 22 bp, Artificial Sequence
  chemically synthesized
ttgaatccgttcatctgttgat

SEQ ID NO: 1250149 - DNA, 22 bp, Artificial Sequence
  chemically synthesized
agtaaccatcaacagatgaacg

SEQ ID NO: 1250150 - DNA, 22 bp, Artificial Sequence
  chemically synthesized
cacatttttgaatccgttcatc

SEQ ID NO: 1250151 - DNA, 22 bp, Artificial Sequence
  chemically synthesized
tgtgtatattccacatttttga

SEQ ID NO: 1250152 - DNA, 22 bp, Artificial Sequence
  chemically synthesized
cattgtgtgtatattccacatt

SEQ ID NO: 1250153 - DNA, 22 bp, Artificial Sequence
  chemically synthesized
aaaaatgtggaatatacacaca

SEQ ID NO: 1250154 - DNA, 22 bp, Artificial Sequence
  chemically synthesized
aatagtgttccattgtgtgtat

SEQ ID NO: 1250155 - DNA, 22 bp, Artificial Sequence
  chemically synthesized
aagttgaatagtgttccattgt

SEQ ID NO: 1250156 - DNA, 22 bp, Artificial Sequence
  chemically synthesized
ttaaagttgaatagtgttccat

SEQ ID NO: 1250157 - DNA, 22 bp, Artificial Sequence
  chemically synthesized
attaaagttgaatagtgttcca

SEQ ID NO: 1250158 - DNA, 22 bp, Artificial Sequence
  chemically synthesized
ttattaaagttgaatagtgttc

SEQ ID NO: 1250159 - DNA, 22 bp, Artificial Sequence
  chemically synthesized
cttattaaagttgaatagtgtt

SEQ ID NO: 1250160 - DNA, 22 bp, Artificial Sequence
  chemically synthesized
tcttattaaagttgaatagtgt

SEQ ID NO: 1250161 - DNA, 22 bp, Artificial Sequence
  chemically synthesized
caggattttcttattaaagttg

SEQ ID NO: 1250162 - DNA, 22 bp, Artificial Sequence
  chemically synthesized
ccaattacaggattttcttatt

SEQ ID NO: 1250163 - DNA, 22 bp, Artificial Sequence
  chemically synthesized
ttcaactttaataagaaaatcc

SEQ ID NO: 1250164 - DNA, 22 bp, Artificial Sequence
  chemically synthesized
ttcccaattacaggattttctt

SEQ ID NO: 1250165 - DNA, 22 bp, Artificial Sequence
  chemically synthesized
aactttaataagaaaatcctgt

SEQ ID NO: 1250166 - DNA, 22 bp, Artificial Sequence
  chemically synthesized
taataagaaaatcctgtaattg

SEQ ID NO: 1250167 - DNA, 22 bp, Artificial Sequence
  chemically synthesized
aataagaaaatcctgtaattgg

SEQ ID NO: 1250168 - DNA, 22 bp, Artificial Sequence
  chemically synthesized
ataagaaaatcctgtaattggg

SEQ ID NO: 1250169 - DNA, 22 bp, Artificial Sequence
  chemically synthesized
aaccacattgttcccaattaca

SEQ ID NO: 1250170 - DNA, 22 bp, Artificial Sequence
  chemically synthesized
caggttcaaccacattgttccc

SEQ ID NO: 1250171 - DNA, 22 bp, Artificial Sequence
  chemically synthesized
taattgggaacaatgtggttga

SEQ ID NO: 1250172 - DNA, 22 bp, Artificial Sequence
  chemically synthesized
caaaatcctccaggttcaacca

SEQ ID NO: 1250173 - DNA, 22 bp, Artificial Sequence
  chemically synthesized
ggaacaatgtggttgaacctgg

SEQ ID NO: 1250174 - DNA, 22 bp, Artificial Sequence
  chemically synthesized
aaaactccaaaatcctccaggt

SEQ ID NO: 1250175 - DNA, 22 bp, Artificial Sequence
  chemically synthesized
gaaaactccaaaatcctccagg

SEQ ID NO: 1250176 - DNA, 22 bp, Artificial Sequence
  chemically synthesized
agaatttgaaaactccaaaatc

SEQ ID NO: 1250177 - DNA, 22 bp, Artificial Sequence
  chemically synthesized
gagaatttgaaaactccaaaat

SEQ ID NO: 1250178 - DNA, 22 bp, Artificial Sequence
  chemically synthesized
aacctggaggattttggagttt

SEQ ID NO: 1250179 - DNA, 22 bp, Artificial Sequence
  chemically synthesized
gacttgagaatttgaaaactcc

SEQ ID NO: 1250180 - DNA, 22 bp, Artificial Sequence
  chemically synthesized
gaggattttggagttttcaaat

SEQ ID NO: 1250181 - DNA, 22 bp, Artificial Sequence
  chemically synthesized
cgtgcctggacttgagaatttg

SEQ ID NO: 1250182 - DNA, 22 bp, Artificial Sequence
  chemically synthesized
ccgtgcctggacttgagaattt

SEQ ID NO: 1250183 - DNA, 22 bp, Artificial Sequence
  chemically synthesized
tccgtgcctggacttgagaatt

SEQ ID NO: 1250184 - DNA, 22 bp, Artificial Sequence
  chemically synthesized
tggagttttcaaattctcaagt

SEQ ID NO: 1250185 - DNA, 22 bp, Artificial Sequence
  chemically synthesized
ggagttttcaaattctcaagtc

SEQ ID NO: 1250186 - DNA, 22 bp, Artificial Sequence
  chemically synthesized
gagttttcaaattctcaagtcc

SEQ ID NO: 1250187 - DNA, 22 bp, Artificial Sequence
  chemically synthesized
taattttccgtgcctggacttg

SEQ ID NO: 1250188 - DNA, 22 bp, Artificial Sequence
  chemically synthesized
tcaaattctcaagtccaggcac

SEQ ID NO: 1250189 - DNA, 22 bp, Artificial Sequence
  chemically synthesized
caaattctcaagtccaggcacg

SEQ ID NO: 1250190 - DNA, 22 bp, Artificial Sequence
  chemically synthesized
aaattctcaagtccaggcacgg

SEQ ID NO: 1250191 - DNA, 22 bp, Artificial Sequence
  chemically synthesized
tcaagtccaggcacggaaaatt

SEQ ID NO: 1250192 - DNA, 22 bp, Artificial Sequence
  chemically synthesized
aagtccaggcacggaaaattat

SEQ ID NO: 1250193 - DNA, 22 bp, Artificial Sequence
  chemically synthesized
caaaaaaaaaaattataatttt

SEQ ID NO: 1250194 - DNA, 22 bp, Artificial Sequence
  chemically synthesized
ccaaaaaaaaaaattataattt

SEQ ID NO: 1250195 - DNA, 22 bp, Artificial Sequence
  chemically synthesized
tccaaaaaaaaaaattataatt

SEQ ID NO: 1250196 - DNA, 22 bp, Artificial Sequence
  chemically synthesized
ttccaaaaaaaaaaattataat

SEQ ID NO: 1250197 - DNA, 22 bp, Artificial Sequence
  chemically synthesized
tttccaaaaaaaaaaattataa

SEQ ID NO: 1250198 - DNA, 22 bp, Artificial Sequence
  chemically synthesized
ttttccaaaaaaaaaaattata

SEQ ID NO: 1250199 - DNA, 22 bp, Artificial Sequence
  chemically synthesized
acatttttttccaaaaaaaaaa

SEQ ID NO: 1250200 - DNA, 22 bp, Artificial Sequence
  chemically synthesized
cacatttttttccaaaaaaaaa

SEQ ID NO: 1250201 - DNA, 22 bp, Artificial Sequence
  chemically synthesized
tatttcacatttttttccaaaa

SEQ ID NO: 1250202 - DNA, 22 bp, Artificial Sequence
  chemically synthesized
taatttttttttttggaaaaaa

SEQ ID NO: 1250203 - DNA, 22 bp, Artificial Sequence
  chemically synthesized
ttttttttggaaaaaaatgtga

SEQ ID NO: 1250204 - DNA, 22 bp, Artificial Sequence
  chemically synthesized
tttttttggaaaaaaatgtgaa

SEQ ID NO: 1250205 - DNA, 22 bp, Artificial Sequence
  chemically synthesized
ttttttggaaaaaaatgtgaaa

SEQ ID NO: 1250206 - DNA, 22 bp, Artificial Sequence
  chemically synthesized
tttttggaaaaaaatgtgaaat

SEQ ID NO: 1250207 - DNA, 22 bp, Artificial Sequence
  chemically synthesized
ttttggaaaaaaatgtgaaata

SEQ ID NO: 1250208 - DNA, 22 bp, Artificial Sequence
  chemically synthesized
tttggaaaaaaatgtgaaatat

SEQ ID NO: 1250209 - DNA, 22 bp, Artificial Sequence
  chemically synthesized
ttggaaaaaaatgtgaaatata

SEQ ID NO: 1250210 - DNA, 22 bp, Artificial Sequence
  chemically synthesized
tggaaaaaaatgtgaaatatag

SEQ ID NO: 1250211 - DNA, 22 bp, Artificial Sequence
  chemically synthesized
ggaaaaaaatgtgaaatataga

SEQ ID NO: 1250212 - DNA, 22 bp, Artificial Sequence
  chemically synthesized
gaaaaaaatgtgaaatatagac

SEQ ID NO: 1250213 - DNA, 22 bp, Artificial Sequence
  chemically synthesized
agagacggagaaaatagtgtct

SEQ ID NO: 1250214 - DNA, 22 bp, Artificial Sequence
  chemically synthesized
ggctcagagacggagaaaatag

SEQ ID NO: 1250215 - DNA, 22 bp, Artificial Sequence
  chemically synthesized
ttttctccgtctctgagcctag

SEQ ID NO: 1250216 - DNA, 22 bp, Artificial Sequence
  chemically synthesized
tctccgtctctgagcctagata

SEQ ID NO: 1250217 - DNA, 22 bp, Artificial Sequence
  chemically synthesized
ctccgtctctgagcctagatac

SEQ ID NO: 1250218 - DNA, 22 bp, Artificial Sequence
  chemically synthesized
tccgtctctgagcctagatact

SEQ ID NO: 1250219 - DNA, 22 bp, Artificial Sequence
  chemically synthesized
cgtctctgagcctagatactat

SEQ ID NO: 1250220 - DNA, 22 bp, Artificial Sequence
  chemically synthesized
catccagtccaggaaaatagta

SEQ ID NO: 1250221 - DNA, 22 bp, Artificial Sequence
  chemically synthesized
tgagcctagatactattttcct

SEQ ID NO: 1250222 - DNA, 22 bp, Artificial Sequence
  chemically synthesized
tccatccagtccaggaaaatag

SEQ ID NO: 1250223 - DNA, 22 bp, Artificial Sequence
  chemically synthesized
agcctagatactattttcctgg

SEQ ID NO: 1250224 - DNA, 22 bp, Artificial Sequence
  chemically synthesized
cattctccatccagtccaggaa

SEQ ID NO: 1250225 - DNA, 22 bp, Artificial Sequence
  chemically synthesized
acattctccatccagtccagga

SEQ ID NO: 1250226 - DNA, 22 bp, Artificial Sequence
  chemically synthesized
tacattctccatccagtccagg

SEQ ID NO: 1250227 - DNA, 22 bp, Artificial Sequence
  chemically synthesized
gatactattttcctggactgga

SEQ ID NO: 1250228 - DNA, 22 bp, Artificial Sequence
  chemically synthesized
ctttacattctccatccagtcc

SEQ ID NO: 1250229 - DNA, 22 bp, Artificial Sequence
  chemically synthesized
tactttacattctccatccagt

SEQ ID NO: 1250230 - DNA, 22 bp, Artificial Sequence
  chemically synthesized
ctactttacattctccatccag

SEQ ID NO: 1250231 - DNA, 22 bp, Artificial Sequence
  chemically synthesized
ttttcctggactggatggagaa

SEQ ID NO: 1250232 - DNA, 22 bp, Artificial Sequence
  chemically synthesized
tttctactttacattctccatc

SEQ ID NO: 1250233 - DNA, 22 bp, Artificial Sequence
  chemically synthesized
gtttctactttacattctccat

SEQ ID NO: 1250234 - DNA, 22 bp, Artificial Sequence
  chemically synthesized
tcctggactggatggagaatgt

SEQ ID NO: 1250235 - DNA, 22 bp, Artificial Sequence
  chemically synthesized
cctggactggatggagaatgta

SEQ ID NO: 1250236 - DNA, 22 bp, Artificial Sequence
  chemically synthesized
ttgtttctactttacattctcc

SEQ ID NO: 1250237 - DNA, 22 bp, Artificial Sequence
  chemically synthesized
ctggactggatggagaatgtaa

SEQ ID NO: 1250238 - DNA, 22 bp, Artificial Sequence
  chemically synthesized
gactggatggagaatgtaaagt

SEQ ID NO: 1250239 - DNA, 22 bp, Artificial Sequence
  chemically synthesized
gatggagaatgtaaagtagaaa

SEQ ID NO: 1250240 - DNA, 22 bp, Artificial Sequence
  chemically synthesized
aggaacacactcttgtttctac

SEQ ID NO: 1250241 - DNA, 22 bp, Artificial Sequence
  chemically synthesized
tcaggaacacactcttgtttct

SEQ ID NO: 1250242 - DNA, 22 bp, Artificial Sequence
  chemically synthesized
ctctcaggaacacactcttgtt

SEQ ID NO: 1250243 - DNA, 22 bp, Artificial Sequence
  chemically synthesized
accatcccctcctctcaggaac

SEQ ID NO: 1250244 - DNA, 22 bp, Artificial Sequence
  chemically synthesized
caccatcccctcctctcaggaa

SEQ ID NO: 1250245 - DNA, 22 bp, Artificial Sequence
  chemically synthesized
tcaccatcccctcctctcagga

SEQ ID NO: 1250246 - DNA, 22 bp, Artificial Sequence
  chemically synthesized
tttcaccatcccctcctctcag

SEQ ID NO: 1250247 - DNA, 22 bp, Artificial Sequence
  chemically synthesized
ctgagaggaggggatggtgaaa

SEQ ID NO: 1250248 - DNA, 22 bp, Artificial Sequence
  chemically synthesized
tggtggcggttctttcaccatc

SEQ ID NO: 1250249 - DNA, 22 bp, Artificial Sequence
  chemically synthesized
agaggaggggatggtgaaagaa

SEQ ID NO: 1250250 - DNA, 22 bp, Artificial Sequence
  chemically synthesized
ttgtggtggcggttctttcacc

SEQ ID NO: 1250251 - DNA, 22 bp, Artificial Sequence
  chemically synthesized
tgttgtggtggcggttctttca

SEQ ID NO: 1250252 - DNA, 22 bp, Artificial Sequence
  chemically synthesized
tctgttgtggtggcggttcttt

SEQ ID NO: 1250253 - DNA, 22 bp, Artificial Sequence
  chemically synthesized
ctctgttgtggtggcggttctt

SEQ ID NO: 1250254 - DNA, 22 bp, Artificial Sequence
  chemically synthesized
gatacccccaaccttctctgtt

SEQ ID NO: 1250255 - DNA, 22 bp, Artificial Sequence
  chemically synthesized
cacctggatacccccaaccttc

SEQ ID NO: 1250256 - DNA, 22 bp, Artificial Sequence
  chemically synthesized
tgcacctggatacccccaacct

SEQ ID NO: 1250257 - DNA, 22 bp, Artificial Sequence
  chemically synthesized
ctgcacctggatacccccaacc

SEQ ID NO: 1250258 - DNA, 22 bp, Artificial Sequence
  chemically synthesized
cttctgcacctggataccccca

SEQ ID NO: 1250259 - DNA, 22 bp, Artificial Sequence
  chemically synthesized
ggggtatccaggtgcagaagta

SEQ ID NO: 1250260 - DNA, 22 bp, Artificial Sequence
  chemically synthesized
gaatgggacccaattacttctg

SEQ ID NO: 1250261 - DNA, 22 bp, Artificial Sequence
  chemically synthesized
tggaatgggacccaattacttc

SEQ ID NO: 1250262 - DNA, 22 bp, Artificial Sequence
  chemically synthesized
gactctggaatgggacccaatt

SEQ ID NO: 1250263 - DNA, 22 bp, Artificial Sequence
  chemically synthesized
ggctggactctggaatgggacc

SEQ ID NO: 1250264 - DNA, 22 bp, Artificial Sequence
  chemically synthesized
ctgggctggactctggaatggg

SEQ ID NO: 1250265 - DNA, 22 bp, Artificial Sequence
  chemically synthesized
cattcctgggctggactctgga

SEQ ID NO: 1250266 - DNA, 22 bp, Artificial Sequence
  chemically synthesized
ttgcattcctgggctggactct

SEQ ID NO: 1250267 - DNA, 22 bp, Artificial Sequence
  chemically synthesized
ggtcccattccagagtccagcc

SEQ ID NO: 1250268 - DNA, 22 bp, Artificial Sequence
  chemically synthesized
gttgcattcctgggctggactc

SEQ ID NO: 1250269 - DNA, 22 bp, Artificial Sequence
  chemically synthesized
gagtcttgttgcattcctgggc

SEQ ID NO: 1250270 - DNA, 22 bp, Artificial Sequence
  chemically synthesized
ggagtcttgttgcattcctggg

SEQ ID NO: 1250271 - DNA, 22 bp, Artificial Sequence
  chemically synthesized
tggagtcttgttgcattcctgg

SEQ ID NO: 1250272 - DNA, 22 bp, Artificial Sequence
  chemically synthesized
cagagtccagcccaggaatgca

SEQ ID NO: 1250273 - DNA, 22 bp, Artificial Sequence
  chemically synthesized
acataactttggagtcttgttg

SEQ ID NO: 1250274 - DNA, 22 bp, Artificial Sequence
  chemically synthesized
ggtctgacataactttggagtc

SEQ ID NO: 1250275 - DNA, 22 bp, Artificial Sequence
  chemically synthesized
cctgggtctgacataactttgg

SEQ ID NO: 1250276 - DNA, 22 bp, Artificial Sequence
  chemically synthesized
gcctgggtctgacataactttg

SEQ ID NO: 1250277 - DNA, 22 bp, Artificial Sequence
  chemically synthesized
ttgcctgggtctgacataactt

SEQ ID NO: 1250278 - DNA, 22 bp, Artificial Sequence
  chemically synthesized
acgattcttgcctgggtctgac

SEQ ID NO: 1250279 - DNA, 22 bp, Artificial Sequence
  chemically synthesized
caaagttatgtcagacccaggc

SEQ ID NO: 1250280 - DNA, 22 bp, Artificial Sequence
  chemically synthesized
tgtcagacccaggcaagaatcg

SEQ ID NO: 1250281 - DNA, 22 bp, Artificial Sequence
  chemically synthesized
agacacatgctcacgattcttg

SEQ ID NO: 1250282 - DNA, 22 bp, Artificial Sequence
  chemically synthesized
ctaagacacatgctcacgattc

SEQ ID NO: 1250283 - DNA, 22 bp, Artificial Sequence
  chemically synthesized
gctaagacacatgctcacgatt

SEQ ID NO: 1250284 - DNA, 22 bp, Artificial Sequence
  chemically synthesized
atgtccatttgctaagacacat

SEQ ID NO: 1250285 - DNA, 22 bp, Artificial Sequence
  chemically synthesized
gctcatgtccatttgctaagac

SEQ ID NO: 1250286 - DNA, 22 bp, Artificial Sequence
  chemically synthesized
ggtggctagctcatgtccattt

SEQ ID NO: 1250287 - DNA, 22 bp, Artificial Sequence
  chemically synthesized
ggtactgggtggctagctcatg

SEQ ID NO: 1250288 - DNA, 22 bp, Artificial Sequence
  chemically synthesized
agcaaatggacatgagctagcc

SEQ ID NO: 1250289 - DNA, 22 bp, Artificial Sequence
  chemically synthesized
gcaaatggacatgagctagcca

SEQ ID NO: 1250290 - DNA, 22 bp, Artificial Sequence
  chemically synthesized
aagtgcctgggtactgggtggc

SEQ ID NO: 1250291 - DNA, 22 bp, Artificial Sequence
  chemically synthesized
ctgaagtgcctgggtactgggt

SEQ ID NO: 1250292 - DNA, 22 bp, Artificial Sequence
  chemically synthesized
tatcctgctgaagtgcctgggt

SEQ ID NO: 1250293 - DNA, 22 bp, Artificial Sequence
  chemically synthesized
gccacccagtacccaggcactt

SEQ ID NO: 1250294 - DNA, 22 bp, Artificial Sequence
  chemically synthesized
taccctatatcctgctgaagtg

SEQ ID NO: 1250295 - DNA, 22 bp, Artificial Sequence
  chemically synthesized
ctgtaccctatatcctgctgaa

SEQ ID NO: 1250296 - DNA, 22 bp, Artificial Sequence
  chemically synthesized
tactgtaccctatatcctgctg

SEQ ID NO: 1250297 - DNA, 22 bp, Artificial Sequence
  chemically synthesized
ttctactgtaccctatatcctg

SEQ ID NO: 1250298 - DNA, 22 bp, Artificial Sequence
  chemically synthesized
cagcaggatatagggtacagta

SEQ ID NO: 1250299 - DNA, 22 bp, Artificial Sequence
  chemically synthesized
agcaggatatagggtacagtag

SEQ ID NO: 1250300 - DNA, 22 bp, Artificial Sequence
  chemically synthesized
gaggcatgtgggaaattattct

SEQ ID NO: 1250301 - DNA, 22 bp, Artificial Sequence
  chemically synthesized
ctggaggcatgtgggaaattat

SEQ ID NO: 1250302 - DNA, 22 bp, Artificial Sequence
  chemically synthesized
gctggaggcatgtgggaaatta

SEQ ID NO: 1250303 - DNA, 22 bp, Artificial Sequence
  chemically synthesized
tgtttgctggaggcatgtggga

SEQ ID NO: 1250304 - DNA, 22 bp, Artificial Sequence
  chemically synthesized
agcactgtgtttgctggaggca

SEQ ID NO: 1250305 - DNA, 22 bp, Artificial Sequence
  chemically synthesized
cccacatgcctccagcaaacac

SEQ ID NO: 1250306 - DNA, 22 bp, Artificial Sequence
  chemically synthesized
ccacatgcctccagcaaacaca

SEQ ID NO: 1250307 - DNA, 22 bp, Artificial Sequence
  chemically synthesized
caaaaacccattgagcactgtg

SEQ ID NO: 1250308 - DNA, 22 bp, Artificial Sequence
  chemically synthesized
cagcaaacacagtgctcaatgg

SEQ ID NO: 1250309 - DNA, 22 bp, Artificial Sequence
  chemically synthesized
atcctccaaaaacccattgagc

SEQ ID NO: 1250310 - DNA, 22 bp, Artificial Sequence
  chemically synthesized
catcctccaaaaacccattgag

SEQ ID NO: 1250311 - DNA, 22 bp, Artificial Sequence
  chemically synthesized
ttcatcctccaaaaacccattg

SEQ ID NO: 1250312 - DNA, 22 bp, Artificial Sequence
  chemically synthesized
tcattcttcatcctccaaaaac

SEQ ID NO: 1250313 - DNA, 22 bp, Artificial Sequence
  chemically synthesized
gtcattcttcatcctccaaaaa

SEQ ID NO: 1250314 - DNA, 22 bp, Artificial Sequence
  chemically synthesized
ccttgtcattcttcatcctcca

SEQ ID NO: 1250315 - DNA, 22 bp, Artificial Sequence
  chemically synthesized
aatgggtttttggaggatgaag

SEQ ID NO: 1250316 - DNA, 22 bp, Artificial Sequence
  chemically synthesized
ttggaggatgaagaatgacaag

SEQ ID NO: 1250317 - DNA, 22 bp, Artificial Sequence
  chemically synthesized
tggaggatgaagaatgacaagg

SEQ ID NO: 1250318 - DNA, 22 bp, Artificial Sequence
  chemically synthesized
ggaggatgaagaatgacaaggg

SEQ ID NO: 1250319 - DNA, 22 bp, Artificial Sequence
  chemically synthesized
gaggatgaagaatgacaaggga

SEQ ID NO: 1250320 - DNA, 22 bp, Artificial Sequence
  chemically synthesized
tacggtcaagaaacatggtggt

SEQ ID NO: 1250321 - DNA, 22 bp, Artificial Sequence
  chemically synthesized
tgtacggtcaagaaacatggtg

SEQ ID NO: 1250322 - DNA, 22 bp, Artificial Sequence
  chemically synthesized
atatctctgtacggtcaagaaa

SEQ ID NO: 1250323 - DNA, 22 bp, Artificial Sequence
  chemically synthesized
catatctctgtacggtcaagaa

SEQ ID NO: 1250324 - DNA, 22 bp, Artificial Sequence
  chemically synthesized
tcatatctctgtacggtcaaga

SEQ ID NO: 1250325 - DNA, 22 bp, Artificial Sequence
  chemically synthesized
taggccctttcatatctctgta

SEQ ID NO: 1250326 - DNA, 22 bp, Artificial Sequence
  chemically synthesized
cttgaccgtacagagatatgaa

SEQ ID NO: 1250327 - DNA, 22 bp, Artificial Sequence
  chemically synthesized
ttgaccgtacagagatatgaaa

SEQ ID NO: 1250328 - DNA, 22 bp, Artificial Sequence
  chemically synthesized
aagttgtaggccctttcatatc

SEQ ID NO: 1250329 - DNA, 22 bp, Artificial Sequence
  chemically synthesized
gaccgtacagagatatgaaagg

SEQ ID NO: 1250330 - DNA, 22 bp, Artificial Sequence
  chemically synthesized
accgtacagagatatgaaaggg

SEQ ID NO: 1250331 - DNA, 22 bp, Artificial Sequence
  chemically synthesized
gcctcaagttgtaggccctttc

SEQ ID NO: 1250332 - DNA, 22 bp, Artificial Sequence
  chemically synthesized
ggcctcaagttgtaggcccttt

SEQ ID NO: 1250333 - DNA, 22 bp, Artificial Sequence
  chemically synthesized
cttggcctcaagttgtaggccc

SEQ ID NO: 1250334 - DNA, 22 bp, Artificial Sequence
  chemically synthesized
ttccttggcctcaagttgtagg

SEQ ID NO: 1250335 - DNA, 22 bp, Artificial Sequence
  chemically synthesized
gttccttggcctcaagttgtag

SEQ ID NO: 1250336 - DNA, 22 bp, Artificial Sequence
  chemically synthesized
caacttgaggccaaggaacaag

SEQ ID NO: 1250337 - DNA, 22 bp, Artificial Sequence
  chemically synthesized
atcccatagggaccttgttcct

SEQ ID NO: 1250338 - DNA, 22 bp, Artificial Sequence
  chemically synthesized
gaggccaaggaacaaggtccct

SEQ ID NO: 1250339 - DNA, 22 bp, Artificial Sequence
  chemically synthesized
aggccaaggaacaaggtcccta

SEQ ID NO: 1250340 - DNA, 22 bp, Artificial Sequence
  chemically synthesized
atgtacaattcatcccataggg

SEQ ID NO: 1250341 - DNA, 22 bp, Artificial Sequence
  chemically synthesized
catgtacaattcatcccatagg

SEQ ID NO: 1250342 - DNA, 22 bp, Artificial Sequence
  chemically synthesized
atttcatgtacaattcatccca

SEQ ID NO: 1250343 - DNA, 22 bp, Artificial Sequence
  chemically synthesized
cctgatttcatgtacaattcat

SEQ ID NO: 1250344 - DNA, 22 bp, Artificial Sequence
  chemically synthesized
acctgatttcatgtacaattca

SEQ ID NO: 1250345 - DNA, 22 bp, Artificial Sequence
  chemically synthesized
tgggatgaattgtacatgaaat

SEQ ID NO: 1250346 - DNA, 22 bp, Artificial Sequence
  chemically synthesized
aaggcgggtgtggcttacctga

SEQ ID NO: 1250347 - DNA, 22 bp, Artificial Sequence
  chemically synthesized
gaaggcgggtgtggcttacctg

SEQ ID NO: 1250348 - DNA, 22 bp, Artificial Sequence
  chemically synthesized
tacatgaaatcaggtaagccac

SEQ ID NO: 1250349 - DNA, 22 bp, Artificial Sequence
  chemically synthesized
atacagtgccaggatttgaagg

SEQ ID NO: 1250350 - DNA, 22 bp, Artificial Sequence
  chemically synthesized
acactgatacagtgccaggatt

SEQ ID NO: 1250351 - DNA, 22 bp, Artificial Sequence
  chemically synthesized
agagtcctgacactgatacagt

SEQ ID NO: 1250352 - DNA, 22 bp, Artificial Sequence
  chemically synthesized
caaatcctggcactgtatcagt

SEQ ID NO: 1250353 - DNA, 22 bp, Artificial Sequence
  chemically synthesized
aaatcctggcactgtatcagtg

SEQ ID NO: 1250354 - DNA, 22 bp, Artificial Sequence
  chemically synthesized
gctcagagtcctgacactgata

SEQ ID NO: 1250355 - DNA, 22 bp, Artificial Sequence
  chemically synthesized
agctcagagtcctgacactgat

SEQ ID NO: 1250356 - DNA, 22 bp, Artificial Sequence
  chemically synthesized
gcactgtatcagtgtcaggact

SEQ ID NO: 1250357 - DNA, 22 bp, Artificial Sequence
  chemically synthesized
tatcagtgtcaggactctgagc

SEQ ID NO: 1250358 - DNA, 22 bp, Artificial Sequence
  chemically synthesized
tgagctaagccatcatatcccc

SEQ ID NO: 1250359 - DNA, 22 bp, Artificial Sequence
  chemically synthesized
agctaagccatcatatcccctg

SEQ ID NO: 1250360 - DNA, 22 bp, Artificial Sequence
  chemically synthesized
agccatcatatcccctgtgacc

SEQ ID NO: 1250361 - DNA, 22 bp, Artificial Sequence
  chemically synthesized
gatgtataagggcaggtcacag

SEQ ID NO: 1250362 - DNA, 22 bp, Artificial Sequence
  chemically synthesized
aggccatctggatgtataaggg

SEQ ID NO: 1250363 - DNA, 22 bp, Artificial Sequence
  chemically synthesized
caggccatctggatgtataagg

SEQ ID NO: 1250364 - DNA, 22 bp, Artificial Sequence
  chemically synthesized
cttcaggccatctggatgtata

SEQ ID NO: 1250365 - DNA, 22 bp, Artificial Sequence
  chemically synthesized
tgacctgcccttatacatccag

SEQ ID NO: 1250366 - DNA, 22 bp, Artificial Sequence
  chemically synthesized
agttgcttcaggccatctggat

SEQ ID NO: 1250367 - DNA, 22 bp, Artificial Sequence
  chemically synthesized
cagttgcttcaggccatctgga

SEQ ID NO: 1250368 - DNA, 22 bp, Artificial Sequence
  chemically synthesized
cccttatacatccagatggcct

SEQ ID NO: 1250369 - DNA, 22 bp, Artificial Sequence
  chemically synthesized
atacatccagatggcctgaagc

SEQ ID NO: 1250370 - DNA, 22 bp, Artificial Sequence
  chemically synthesized
tacatccagatggcctgaagca

SEQ ID NO: 1250371 - DNA, 22 bp, Artificial Sequence
  chemically synthesized
tggatcttcagttgcttcaggc

SEQ ID NO: 1250372 - DNA, 22 bp, Artificial Sequence
  chemically synthesized
gtggatcttcagttgcttcagg

SEQ ID NO: 1250373 - DNA, 22 bp, Artificial Sequence
  chemically synthesized
tgtggatcttcagttgcttcag

SEQ ID NO: 1250374 - DNA, 22 bp, Artificial Sequence
  chemically synthesized
ttgtggatcttcagttgcttca

SEQ ID NO: 1250375 - DNA, 22 bp, Artificial Sequence
  chemically synthesized
ttttgtggatcttcagttgctt

SEQ ID NO: 1250376 - DNA, 22 bp, Artificial Sequence
  chemically synthesized
actcttttgtggatcttcagtt

SEQ ID NO: 1250377 - DNA, 22 bp, Artificial Sequence
  chemically synthesized
cactcttttgtggatcttcagt

SEQ ID NO: 1250378 - DNA, 22 bp, Artificial Sequence
  chemically synthesized
tcactcttttgtggatcttcag

SEQ ID NO: 1250379 - DNA, 22 bp, Artificial Sequence
  chemically synthesized
ttttcactcttttgtggatctt

SEQ ID NO: 1250380 - DNA, 22 bp, Artificial Sequence
  chemically synthesized
aagcaactgaagatccacaaaa

SEQ ID NO: 1250381 - DNA, 22 bp, Artificial Sequence
  chemically synthesized
aggctattttcactcttttgtg

SEQ ID NO: 1250382 - DNA, 22 bp, Artificial Sequence
  chemically synthesized
aagatccacaaaagagtgaaaa

SEQ ID NO: 1250383 - DNA, 22 bp, Artificial Sequence
  chemically synthesized
aactgatgacattccaccattg

SEQ ID NO: 1250384 - DNA, 22 bp, Artificial Sequence
  chemically synthesized
actgatgacattccaccattgt

SEQ ID NO: 1250385 - DNA, 22 bp, Artificial Sequence
  chemically synthesized
atgacattccaccattgtgatt

SEQ ID NO: 1250386 - DNA, 22 bp, Artificial Sequence
  chemically synthesized
gggtggggcagaaacaaatcac

SEQ ID NO: 1250387 - DNA, 22 bp, Artificial Sequence
  chemically synthesized
caccattgtgatttgtttctgc

SEQ ID NO: 1250388 - DNA, 22 bp, Artificial Sequence
  chemically synthesized
atcagttagggtggggcagaaa

SEQ ID NO: 1250389 - DNA, 22 bp, Artificial Sequence
  chemically synthesized
tgatttgtttctgccccaccct

SEQ ID NO: 1250390 - DNA, 22 bp, Artificial Sequence
  chemically synthesized
gtttctgccccaccctaactga

SEQ ID NO: 1250391 - DNA, 22 bp, Artificial Sequence
  chemically synthesized
tttctgccccaccctaactgat

SEQ ID NO: 1250392 - DNA, 22 bp, Artificial Sequence
  chemically synthesized
caaagtacattgatcagttagg

SEQ ID NO: 1250393 - DNA, 22 bp, Artificial Sequence
  chemically synthesized
ctgccccaccctaactgatcaa

SEQ ID NO: 1250394 - DNA, 22 bp, Artificial Sequence
  chemically synthesized
tgccccaccctaactgatcaat

SEQ ID NO: 1250395 - DNA, 22 bp, Artificial Sequence
  chemically synthesized
ccccaccctaactgatcaatgt

SEQ ID NO: 1250396 - DNA, 22 bp, Artificial Sequence
  chemically synthesized
actgatcaatgtactttgtaat

SEQ ID NO: 1250397 - DNA, 22 bp, Artificial Sequence
  chemically synthesized
agggtgggggagattacaaagt

SEQ ID NO: 1250398 - DNA, 22 bp, Artificial Sequence
  chemically synthesized
aagggtgggggagattacaaag

SEQ ID NO: 1250399 - DNA, 22 bp, Artificial Sequence
  chemically synthesized
ttaagggtgggggagattacaa

SEQ ID NO: 1250400 - DNA, 22 bp, Artificial Sequence
  chemically synthesized
atcaatgtactttgtaatctcc

SEQ ID NO: 1250401 - DNA, 22 bp, Artificial Sequence
  chemically synthesized
cttaagggtgggggagattaca

SEQ ID NO: 1250402 - DNA, 22 bp, Artificial Sequence
  chemically synthesized
tgtaatctcccccacccttaag

SEQ ID NO: 1250403 - DNA, 22 bp, Artificial Sequence
  chemically synthesized
gtaatctcccccacccttaaga

SEQ ID NO: 1250404 - DNA, 22 bp, Artificial Sequence
  chemically synthesized
taatctcccccacccttaagaa

SEQ ID NO: 1250405 - DNA, 22 bp, Artificial Sequence
  chemically synthesized
ccccacccttaagaaggttctt

SEQ ID NO: 1250406 - DNA, 22 bp, Artificial Sequence
  chemically synthesized
aagggtggggagaatgacaaag

SEQ ID NO: 1250407 - DNA, 22 bp, Artificial Sequence
  chemically synthesized
tcaagggtggggagaatgacaa

SEQ ID NO: 1250408 - DNA, 22 bp, Artificial Sequence
  chemically synthesized
aagaaggttctttgtcattctc

SEQ ID NO: 1250409 - DNA, 22 bp, Artificial Sequence
  chemically synthesized
agaaggttctttgtcattctcc

SEQ ID NO: 1250410 - DNA, 22 bp, Artificial Sequence
  chemically synthesized
tttgtcattctccccacccttg

SEQ ID NO: 1250411 - DNA, 22 bp, Artificial Sequence
  chemically synthesized
tgtcattctccccacccttgag

SEQ ID NO: 1250412 - DNA, 22 bp, Artificial Sequence
  chemically synthesized
acaaagtacattctcaagggtg

SEQ ID NO: 1250413 - DNA, 22 bp, Artificial Sequence
  chemically synthesized
gtcattctccccacccttgaga

SEQ ID NO: 1250414 - DNA, 22 bp, Artificial Sequence
  chemically synthesized
tcattctccccacccttgagaa

SEQ ID NO: 1250415 - DNA, 22 bp, Artificial Sequence
  chemically synthesized
tccccacccttgagaatgtact

SEQ ID NO: 1250416 - DNA, 22 bp, Artificial Sequence
  chemically synthesized
cccacccttgagaatgtacttt

SEQ ID NO: 1250417 - DNA, 22 bp, Artificial Sequence
  chemically synthesized
gagaatgtactttgtgagatcc

SEQ ID NO: 1250418 - DNA, 22 bp, Artificial Sequence
  chemically synthesized
cgagcagggggtggatctcaca

SEQ ID NO: 1250419 - DNA, 22 bp, Artificial Sequence
  chemically synthesized
agaatgtactttgtgagatcca

SEQ ID NO: 1250420 - DNA, 22 bp, Artificial Sequence
  chemically synthesized
gcgagcagggggtggatctcac

SEQ ID NO: 1250421 - DNA, 22 bp, Artificial Sequence
  chemically synthesized
tgcgagcagggggtggatctca

SEQ ID NO: 1250422 - DNA, 22 bp, Artificial Sequence
  chemically synthesized
tgtgagatccaccccctgctcg

SEQ ID NO: 1250423 - DNA, 22 bp, Artificial Sequence
  chemically synthesized
gtgagatccaccccctgctcgc

SEQ ID NO: 1250424 - DNA, 22 bp, Artificial Sequence
  chemically synthesized
tgagatccaccccctgctcgca

SEQ ID NO: 1250425 - DNA, 22 bp, Artificial Sequence
  chemically synthesized
ggagcgatgttttgcgagcagg

SEQ ID NO: 1250426 - DNA, 22 bp, Artificial Sequence
  chemically synthesized
ctcgcaaaacatcgctcctaac

SEQ ID NO: 1250427 - DNA, 22 bp, Artificial Sequence
  chemically synthesized
ggataggcggtggagttaggag

SEQ ID NO: 1250428 - DNA, 22 bp, Artificial Sequence
  chemically synthesized
gcaaaacatcgctcctaactcc

SEQ ID NO: 1250429 - DNA, 22 bp, Artificial Sequence
  chemically synthesized
gggataggcggtggagttagga

SEQ ID NO: 1250430 - DNA, 22 bp, Artificial Sequence
  chemically synthesized
tgggataggcggtggagttagg

SEQ ID NO: 1250431 - DNA, 22 bp, Artificial Sequence
  chemically synthesized
caggttttgggataggcggtgg

SEQ ID NO: 1250432 - DNA, 22 bp, Artificial Sequence
  chemically synthesized
acaggttttgggataggcggtg

SEQ ID NO: 1250433 - DNA, 22 bp, Artificial Sequence
  chemically synthesized
ttacaggttttgggataggcgg

SEQ ID NO: 1250434 - DNA, 22 bp, Artificial Sequence
  chemically synthesized
ctaactccaccgcctatcccaa

SEQ ID NO: 1250435 - DNA, 22 bp, Artificial Sequence
  chemically synthesized
gttcttacaggttttgggatag

SEQ ID NO: 1250436 - DNA, 22 bp, Artificial Sequence
  chemically synthesized
actccaccgcctatcccaaaac

SEQ ID NO: 1250437 - DNA, 22 bp, Artificial Sequence
  chemically synthesized
caccgcctatcccaaaacctgt

SEQ ID NO: 1250438 - DNA, 22 bp, Artificial Sequence
  chemically synthesized
tcattagttcttacaggttttg

SEQ ID NO: 1250439 - DNA, 22 bp, Artificial Sequence
  chemically synthesized
tcccaaaacctgtaagaactaa

SEQ ID NO: 1250440 - DNA, 22 bp, Artificial Sequence
  chemically synthesized
taagaactaatgataatcccac

SEQ ID NO: 1250441 - DNA, 22 bp, Artificial Sequence
  chemically synthesized
atgataatcccaccacccttgg

SEQ ID NO: 1250442 - DNA, 22 bp, Artificial Sequence
  chemically synthesized
aaaaaggagtcagccaagggtg

SEQ ID NO: 1250443 - DNA, 22 bp, Artificial Sequence
  chemically synthesized
agtctgaaaaaggagtcagcca

SEQ ID NO: 1250444 - DNA, 22 bp, Artificial Sequence
  chemically synthesized
ggctgactcctttttcagactc

SEQ ID NO: 1250445 - DNA, 22 bp, Artificial Sequence
  chemically synthesized
gctgactcctttttcagactca

SEQ ID NO: 1250446 - DNA, 22 bp, Artificial Sequence
  chemically synthesized
ggtgcaggtgggctgagtctga

SEQ ID NO: 1250447 - DNA, 22 bp, Artificial Sequence
  chemically synthesized
actcctttttcagactcagccc

SEQ ID NO: 1250448 - DNA, 22 bp, Artificial Sequence
  chemically synthesized
acctgggtgcaggtgggctgag

SEQ ID NO: 1250449 - DNA, 22 bp, Artificial Sequence
  chemically synthesized
cacctgggtgcaggtgggctga

SEQ ID NO: 1250450 - DNA, 22 bp, Artificial Sequence
  chemically synthesized
ctttttcagactcagcccacct

SEQ ID NO: 1250451 - DNA, 22 bp, Artificial Sequence
  chemically synthesized
tttcacctgggtgcaggtgggc

SEQ ID NO: 1250452 - DNA, 22 bp, Artificial Sequence
  chemically synthesized
tttcagactcagcccacctgca

SEQ ID NO: 1250453 - DNA, 22 bp, Artificial Sequence
  chemically synthesized
atttcacctgggtgcaggtggg

SEQ ID NO: 1250454 - DNA, 22 bp, Artificial Sequence
  chemically synthesized
ttcagactcagcccacctgcac

SEQ ID NO: 1250455 - DNA, 22 bp, Artificial Sequence
  chemically synthesized
tcagactcagcccacctgcacc

SEQ ID NO: 1250456 - DNA, 22 bp, Artificial Sequence
  chemically synthesized
cagactcagcccacctgcaccc

SEQ ID NO: 1250457 - DNA, 22 bp, Artificial Sequence
  chemically synthesized
tttatttcacctgggtgcaggt

SEQ ID NO: 1250458 - DNA, 22 bp, Artificial Sequence
  chemically synthesized
agactcagcccacctgcaccca

SEQ ID NO: 1250459 - DNA, 22 bp, Artificial Sequence
  chemically synthesized
agcccacctgcacccaggtgaa

SEQ ID NO: 1250460 - DNA, 22 bp, Artificial Sequence
  chemically synthesized
cacccaggtgaaataaacagcc

SEQ ID NO: 1250461 - DNA, 22 bp, Artificial Sequence
  chemically synthesized
tgtgagcaacaaggctgtttat

SEQ ID NO: 1250462 - DNA, 22 bp, Artificial Sequence
  chemically synthesized
gtgtgagcaacaaggctgttta

SEQ ID NO: 1250463 - DNA, 22 bp, Artificial Sequence
  chemically synthesized
tgtgtgagcaacaaggctgttt

SEQ ID NO: 1250464 - DNA, 22 bp, Artificial Sequence
  chemically synthesized
gttgctcacacaaagcctgttt

SEQ ID NO: 1250465 - DNA, 22 bp, Artificial Sequence
  chemically synthesized
ttgctcacacaaagcctgtttg

SEQ ID NO: 1250466 - DNA, 22 bp, Artificial Sequence
  chemically synthesized
ctcacacaaagcctgtttggtg

SEQ ID NO: 1250467 - DNA, 22 bp, Artificial Sequence
  chemically synthesized
cgagtgaagagaccaccaaaca

SEQ ID NO: 1250468 - DNA, 22 bp, Artificial Sequence
  chemically synthesized
acacaaagcctgtttggtggtc

SEQ ID NO: 1250469 - DNA, 22 bp, Artificial Sequence
  chemically synthesized
tcacgcccctccgagtgaagag

SEQ ID NO: 1250470 - DNA, 22 bp, Artificial Sequence
  chemically synthesized
tttggtggtctcttcactcgga

SEQ ID NO: 1250471 - DNA, 22 bp, Artificial Sequence
  chemically synthesized
attgtcacgcccctccgagtga

SEQ ID NO: 1250472 - DNA, 22 bp, Artificial Sequence
  chemically synthesized
ggtggtctcttcactcggaggg

SEQ ID NO: 1250473 - DNA, 22 bp, Artificial Sequence
  chemically synthesized
gtggtctcttcactcggagggg

SEQ ID NO: 1250474 - DNA, 22 bp, Artificial Sequence
  chemically synthesized
ttcactcggaggggcgtgacaa

SEQ ID NO: 1250475 - DNA, 22 bp, Artificial Sequence
  chemically synthesized
gaggggacctgattgtcacgcc

SEQ ID NO: 1250476 - DNA, 22 bp, Artificial Sequence
  chemically synthesized
cactcggaggggcgtgacaatc

SEQ ID NO: 1250477 - DNA, 22 bp, Artificial Sequence
  chemically synthesized
tggaggggacctgattgtcacg

SEQ ID NO: 1250478 - DNA, 22 bp, Artificial Sequence
  chemically synthesized
actcggaggggcgtgacaatca

SEQ ID NO: 1250479 - DNA, 22 bp, Artificial Sequence
  chemically synthesized
ctggaggggacctgattgtcac

SEQ ID NO: 1250480 - DNA, 22 bp, Artificial Sequence
  chemically synthesized
ggaggggcgtgacaatcaggtc

SEQ ID NO: 1250481 - DNA, 22 bp, Artificial Sequence
  chemically synthesized
aatttctggaggggacctgatt

SEQ ID NO: 1250482 - DNA, 22 bp, Artificial Sequence
  chemically synthesized
aaatttctggaggggacctgat

SEQ ID NO: 1250483 - DNA, 22 bp, Artificial Sequence
  chemically synthesized
tcttaaatttctggaggggacc

SEQ ID NO: 1250484 - DNA, 22 bp, Artificial Sequence
  chemically synthesized
gtcttaaatttctggaggggac

SEQ ID NO: 1250485 - DNA, 22 bp, Artificial Sequence
  chemically synthesized
tgtcttaaatttctggagggga

SEQ ID NO: 1250486 - DNA, 22 bp, Artificial Sequence
  chemically synthesized
gggttttgtcttaaatttctgg

SEQ ID NO: 1250487 - DNA, 22 bp, Artificial Sequence
  chemically synthesized
tggggttttgtcttaaatttct

SEQ ID NO: 1250488 - DNA, 22 bp, Artificial Sequence
  chemically synthesized
tctggggttttgtcttaaattt

SEQ ID NO: 1250489 - DNA, 22 bp, Artificial Sequence
  chemically synthesized
ctctggggttttgtcttaaatt

SEQ ID NO: 1250490 - DNA, 22 bp, Artificial Sequence
  chemically synthesized
tctctggggttttgtcttaaat

SEQ ID NO: 1250491 - DNA, 22 bp, Artificial Sequence
  chemically synthesized
cagaaatttaagacaaaacccc

SEQ ID NO: 1250492 - DNA, 22 bp, Artificial Sequence
  chemically synthesized
agatgccccccctttctctggg

SEQ ID NO: 1250493 - DNA, 22 bp, Artificial Sequence
  chemically synthesized
aagacaaaaccccagagaaagg

SEQ ID NO: 1250494 - DNA, 22 bp, Artificial Sequence
  chemically synthesized
agacaaaaccccagagaaaggg

SEQ ID NO: 1250495 - DNA, 22 bp, Artificial Sequence
  chemically synthesized
ggactgagatgccccccctttc

SEQ ID NO: 1250496 - DNA, 22 bp, Artificial Sequence
  chemically synthesized
aggactgagatgcccccccttt

SEQ ID NO: 1250497 - DNA, 22 bp, Artificial Sequence
  chemically synthesized
agccaatttaggactgagatgc

SEQ ID NO: 1250498 - DNA, 22 bp, Artificial Sequence
  chemically synthesized
atctcagccaatttaggactga

SEQ ID NO: 1250499 - DNA, 22 bp, Artificial Sequence
  chemically synthesized
catctcagccaatttaggactg

SEQ ID NO: 1250500 - DNA, 22 bp, Artificial Sequence
  chemically synthesized
catatttcatctcagccaattt

SEQ ID NO: 1250501 - DNA, 22 bp, Artificial Sequence
  chemically synthesized
agtcctaaattggctgagatga

SEQ ID NO: 1250502 - DNA, 22 bp, Artificial Sequence
  chemically synthesized
cggtagatcctgcatatttcat

SEQ ID NO: 1250503 - DNA, 22 bp, Artificial Sequence
  chemically synthesized
aattggctgagatgaaatatgc

SEQ ID NO: 1250504 - DNA, 22 bp, Artificial Sequence
  chemically synthesized
ccggtagatcctgcatatttca

SEQ ID NO: 1250505 - DNA, 22 bp, Artificial Sequence
  chemically synthesized
tccggtagatcctgcatatttc

SEQ ID NO: 1250506 - DNA, 22 bp, Artificial Sequence
  chemically synthesized
ctttccggtagatcctgcatat

SEQ ID NO: 1250507 - DNA, 22 bp, Artificial Sequence
  chemically synthesized
gctgagatgaaatatgcaggat

SEQ ID NO: 1250508 - DNA, 22 bp, Artificial Sequence
  chemically synthesized
agatgaaatatgcaggatctac

SEQ ID NO: 1250509 - DNA, 22 bp, Artificial Sequence
  chemically synthesized
tatataaagcctactttccggt

SEQ ID NO: 1250510 - DNA, 22 bp, Artificial Sequence
  chemically synthesized
atatataaagcctactttccgg

SEQ ID NO: 1250511 - DNA, 22 bp, Artificial Sequence
  chemically synthesized
atttatatataaagcctacttt

SEQ ID NO: 1250512 - DNA, 22 bp, Artificial Sequence
  chemically synthesized
aatttatatataaagcctactt

SEQ ID NO: 1250513 - DNA, 22 bp, Artificial Sequence
  chemically synthesized
aacttaatttatatataaagcc

SEQ ID NO: 1250514 - DNA, 22 bp, Artificial Sequence
  chemically synthesized
ccggaaagtaggctttatatat

SEQ ID NO: 1250515 - DNA, 22 bp, Artificial Sequence
  chemically synthesized
aatctgaacttaatttatatat

SEQ ID NO: 1250516 - DNA, 22 bp, Artificial Sequence
  chemically synthesized
gaatctgaacttaatttatata

SEQ ID NO: 1250517 - DNA, 22 bp, Artificial Sequence
  chemically synthesized
ttgaatctgaacttaatttata

SEQ ID NO: 1250518 - DNA, 22 bp, Artificial Sequence
  chemically synthesized
cttgaatctgaacttaatttat

SEQ ID NO: 1250519 - DNA, 22 bp, Artificial Sequence
  chemically synthesized
tcttgaatctgaacttaattta

SEQ ID NO: 1250520 - DNA, 22 bp, Artificial Sequence
  chemically synthesized
ttcttgaatctgaacttaattt

SEQ ID NO: 1250521 - DNA, 22 bp, Artificial Sequence
  chemically synthesized
ccttttcttgaatctgaactta

SEQ ID NO: 1250522 - DNA, 22 bp, Artificial Sequence
  chemically synthesized
tatatataaattaagttcagat

SEQ ID NO: 1250523 - DNA, 22 bp, Artificial Sequence
  chemically synthesized
atatataaattaagttcagatt

SEQ ID NO: 1250524 - DNA, 22 bp, Artificial Sequence
  chemically synthesized
tatataaattaagttcagattc

SEQ ID NO: 1250525 - DNA, 22 bp, Artificial Sequence
  chemically synthesized
aataactgccttttcttgaatc

SEQ ID NO: 1250526 - DNA, 22 bp, Artificial Sequence
  chemically synthesized
agttcagattcaagaaaaggca

SEQ ID NO: 1250527 - DNA, 22 bp, Artificial Sequence
  chemically synthesized
agattcaagaaaaggcagttat

SEQ ID NO: 1250528 - DNA, 22 bp, Artificial Sequence
  chemically synthesized
aagaaaaggcagttattgagat

SEQ ID NO: 1250529 - DNA, 22 bp, Artificial Sequence
  chemically synthesized
catgcagtggcagtgaatctca

SEQ ID NO: 1250530 - DNA, 22 bp, Artificial Sequence
  chemically synthesized
ttgagattcactgccactgcat

SEQ ID NO: 1250531 - DNA, 22 bp, Artificial Sequence
  chemically synthesized
agattcactgccactgcatgta

SEQ ID NO: 1250532 - DNA, 22 bp, Artificial Sequence
  chemically synthesized
actgccactgcatgtagatcct

SEQ ID NO: 1250533 - DNA, 22 bp, Artificial Sequence
  chemically synthesized
gaaatccccacataaggatcta

SEQ ID NO: 1250534 - DNA, 22 bp, Artificial Sequence
  chemically synthesized
agaaatccccacataaggatct

SEQ ID NO: 1250535 - DNA, 22 bp, Artificial Sequence
  chemically synthesized
ccactgcatgtagatccttatg

SEQ ID NO: 1250536 - DNA, 22 bp, Artificial Sequence
  chemically synthesized
ttagaaatccccacataaggat

SEQ ID NO: 1250537 - DNA, 22 bp, Artificial Sequence
  chemically synthesized
catgtagatccttatgtgggga

SEQ ID NO: 1250538 - DNA, 22 bp, Artificial Sequence
  chemically synthesized
gacaatgattcttagaaatccc

SEQ ID NO: 1250539 - DNA, 22 bp, Artificial Sequence
  chemically synthesized
atgtggggatttctaagaatca

SEQ ID NO: 1250540 - DNA, 22 bp, Artificial Sequence
  chemically synthesized
ggtgctggacaatgattcttag

SEQ ID NO: 1250541 - DNA, 22 bp, Artificial Sequence
  chemically synthesized
tgtggggatttctaagaatcat

SEQ ID NO: 1250542 - DNA, 22 bp, Artificial Sequence
  chemically synthesized
aggtgctggacaatgattctta

SEQ ID NO: 1250543 - DNA, 22 bp, Artificial Sequence
  chemically synthesized
cagtttaggtgctggacaatga

SEQ ID NO: 1250544 - DNA, 22 bp, Artificial Sequence
  chemically synthesized
gcagtttaggtgctggacaatg

SEQ ID NO: 1250545 - DNA, 22 bp, Artificial Sequence
  chemically synthesized
tgcagtttaggtgctggacaat

SEQ ID NO: 1250546 - DNA, 22 bp, Artificial Sequence
  chemically synthesized
ctaagaatcattgtccagcacc

SEQ ID NO: 1250547 - DNA, 22 bp, Artificial Sequence
  chemically synthesized
ctttgcagtttaggtgctggac

SEQ ID NO: 1250548 - DNA, 22 bp, Artificial Sequence
  chemically synthesized
taagaatcattgtccagcacct

SEQ ID NO: 1250549 - DNA, 22 bp, Artificial Sequence
  chemically synthesized
gctttgcagtttaggtgctgga

SEQ ID NO: 1250550 - DNA, 22 bp, Artificial Sequence
  chemically synthesized
agaatcattgtccagcacctaa

SEQ ID NO: 1250551 - DNA, 22 bp, Artificial Sequence
  chemically synthesized
ccggtttgctttgcagtttagg

SEQ ID NO: 1250552 - DNA, 22 bp, Artificial Sequence
  chemically synthesized
ttaccggtttgctttgcagttt

SEQ ID NO: 1250553 - DNA, 22 bp, Artificial Sequence
  chemically synthesized
attaccggtttgctttgcagtt

SEQ ID NO: 1250554 - DNA, 22 bp, Artificial Sequence
  chemically synthesized
tccagcacctaaactgcaaagc

SEQ ID NO: 1250555 - DNA, 22 bp, Artificial Sequence
  chemically synthesized
atttattaccggtttgctttgc

SEQ ID NO: 1250556 - DNA, 22 bp, Artificial Sequence
  chemically synthesized
tctgatttattaccggtttgct

SEQ ID NO: 1250557 - DNA, 22 bp, Artificial Sequence
  chemically synthesized
ttgtctgatttattaccggttt

SEQ ID NO: 1250558 - DNA, 22 bp, Artificial Sequence
  chemically synthesized
aactgcaaagcaaaccggtaat

SEQ ID NO: 1250559 - DNA, 22 bp, Artificial Sequence
  chemically synthesized
attgttgtctgatttattaccg

SEQ ID NO: 1250560 - DNA, 22 bp, Artificial Sequence
  chemically synthesized
aattgttgtctgatttattacc

SEQ ID NO: 1250561 - DNA, 22 bp, Artificial Sequence
  chemically synthesized
caaagcaaaccggtaataaatc

SEQ ID NO: 1250562 - DNA, 22 bp, Artificial Sequence
  chemically synthesized
ttaattgttgtctgatttatta

SEQ ID NO: 1250563 - DNA, 22 bp, Artificial Sequence
  chemically synthesized
gctcttaattgttgtctgattt

SEQ ID NO: 1250564 - DNA, 22 bp, Artificial Sequence
  chemically synthesized
ggctcttaattgttgtctgatt

SEQ ID NO: 1250565 - DNA, 22 bp, Artificial Sequence
  chemically synthesized
aagatgacttggctcttaattg

SEQ ID NO: 1250566 - DNA, 22 bp, Artificial Sequence
  chemically synthesized
tctcaagatgacttggctctta

SEQ ID NO: 1250567 - DNA, 22 bp, Artificial Sequence
  chemically synthesized
gtctcaagatgacttggctctt

SEQ ID NO: 1250568 - DNA, 22 bp, Artificial Sequence
  chemically synthesized
ttgtctcaagatgacttggctc

SEQ ID NO: 1250569 - DNA, 22 bp, Artificial Sequence
  chemically synthesized
agctcttgtctcaagatgactt

SEQ ID NO: 1250570 - DNA, 22 bp, Artificial Sequence
  chemically synthesized
agagccaagtcatcttgagaca

SEQ ID NO: 1250571 - DNA, 22 bp, Artificial Sequence
  chemically synthesized
agtcctgagctcttgtctcaag

SEQ ID NO: 1250572 - DNA, 22 bp, Artificial Sequence
  chemically synthesized
tgagtcctgagctcttgtctca

SEQ ID NO: 1250573 - DNA, 22 bp, Artificial Sequence
  chemically synthesized
tctgagtcctgagctcttgtct

SEQ ID NO: 1250574 - DNA, 22 bp, Artificial Sequence
  chemically synthesized
ctctgagtcctgagctcttgtc

SEQ ID NO: 1250575 - DNA, 22 bp, Artificial Sequence
  chemically synthesized
cttctctgagtcctgagctctt

SEQ ID NO: 1250576 - DNA, 22 bp, Artificial Sequence
  chemically synthesized
gagacaagagctcaggactcag

SEQ ID NO: 1250577 - DNA, 22 bp, Artificial Sequence
  chemically synthesized
caggctgcttctctgagtcctg

SEQ ID NO: 1250578 - DNA, 22 bp, Artificial Sequence
  chemically synthesized
agacaagagctcaggactcaga

SEQ ID NO: 1250579 - DNA, 22 bp, Artificial Sequence
  chemically synthesized
gcaggctgcttctctgagtcct

SEQ ID NO: 1250580 - DNA, 22 bp, Artificial Sequence
  chemically synthesized
acatttgcaggctgcttctctg

SEQ ID NO: 1250581 - DNA, 22 bp, Artificial Sequence
  chemically synthesized
cacatttgcaggctgcttctct

SEQ ID NO: 1250582 - DNA, 22 bp, Artificial Sequence
  chemically synthesized
aggactcagagaagcagcctgc

SEQ ID NO: 1250583 - DNA, 22 bp, Artificial Sequence
  chemically synthesized
aatgtccatttcacatttgcag

SEQ ID NO: 1250584 - DNA, 22 bp, Artificial Sequence
  chemically synthesized
agagaagcagcctgcaaatgtg

SEQ ID NO: 1250585 - DNA, 22 bp, Artificial Sequence
  chemically synthesized
tgaatgtccatttcacatttgc

SEQ ID NO: 1250586 - DNA, 22 bp, Artificial Sequence
  chemically synthesized
ctgaatgtccatttcacatttg

SEQ ID NO: 1250587 - DNA, 22 bp, Artificial Sequence
  chemically synthesized
acttctgaatgtccatttcaca

SEQ ID NO: 1250588 - DNA, 22 bp, Artificial Sequence
  chemically synthesized
actgacttctgaatgtccattt

SEQ ID NO: 1250589 - DNA, 22 bp, Artificial Sequence
  chemically synthesized
caaatgtgaaatggacattcag

SEQ ID NO: 1250590 - DNA, 22 bp, Artificial Sequence
  chemically synthesized
agaaactcactgacttctgaat

SEQ ID NO: 1250591 - DNA, 22 bp, Artificial Sequence
  chemically synthesized
gttcagaaactcactgacttct

SEQ ID NO: 1250592 - DNA, 22 bp, Artificial Sequence
  chemically synthesized
ctagttcagaaactcactgact

SEQ ID NO: 1250593 - DNA, 22 bp, Artificial Sequence
  chemically synthesized
agaagtcagtgagtttctgaac

SEQ ID NO: 1250594 - DNA, 22 bp, Artificial Sequence
  chemically synthesized
gtaaccgggcactgctagttca

SEQ ID NO: 1250595 - DNA, 22 bp, Artificial Sequence
  chemically synthesized
cgtaaccgggcactgctagttc

SEQ ID NO: 1250596 - DNA, 22 bp, Artificial Sequence
  chemically synthesized
aacagcttcgtaaccgggcact

SEQ ID NO: 1250597 - DNA, 22 bp, Artificial Sequence
  chemically synthesized
caacagcttcgtaaccgggcac

SEQ ID NO: 1250598 - DNA, 22 bp, Artificial Sequence
  chemically synthesized
ctgaactagcagtgcccggtta

SEQ ID NO: 1250599 - DNA, 22 bp, Artificial Sequence
  chemically synthesized
tgaactagcagtgcccggttac

SEQ ID NO: 1250600 - DNA, 22 bp, Artificial Sequence
  chemically synthesized
ttcaacagcttcgtaaccgggc

SEQ ID NO: 1250601 - DNA, 22 bp, Artificial Sequence
  chemically synthesized
aactagcagtgcccggttacga

SEQ ID NO: 1250602 - DNA, 22 bp, Artificial Sequence
  chemically synthesized
gcagtgcccggttacgaagctg

SEQ ID NO: 1250603 - DNA, 22 bp, Artificial Sequence
  chemically synthesized
cgaagctgttgaagagccttgt

SEQ ID NO: 1250604 - DNA, 22 bp, Artificial Sequence
  chemically synthesized
ttgaagagccttgtggactgct

SEQ ID NO: 1250605 - DNA, 22 bp, Artificial Sequence
  chemically synthesized
cccagaacatataaagcagtcc

SEQ ID NO: 1250606 - DNA, 22 bp, Artificial Sequence
  chemically synthesized
aagagccttgtggactgcttta

SEQ ID NO: 1250607 - DNA, 22 bp, Artificial Sequence
  chemically synthesized
tggaactacccagaacatataa

SEQ ID NO: 1250608 - DNA, 22 bp, Artificial Sequence
  chemically synthesized
gtggactgctttatatgttctg

SEQ ID NO: 1250609 - DNA, 22 bp, Artificial Sequence
  chemically synthesized
tggactgctttatatgttctgg

SEQ ID NO: 1250610 - DNA, 22 bp, Artificial Sequence
  chemically synthesized
ctttatatgttctgggtagttc

SEQ ID NO: 1250611 - DNA, 22 bp, Artificial Sequence
  chemically synthesized
cgaggacctatggaactaccca

SEQ ID NO: 1250612 - DNA, 22 bp, Artificial Sequence
  chemically synthesized
tgcgaggacctatggaactacc

SEQ ID NO: 1250613 - DNA, 22 bp, Artificial Sequence
  chemically synthesized
tatatgttctgggtagttccat

SEQ ID NO: 1250614 - DNA, 22 bp, Artificial Sequence
  chemically synthesized
ctgcgaggacctatggaactac

SEQ ID NO: 1250615 - DNA, 22 bp, Artificial Sequence
  chemically synthesized
atatgttctgggtagttccata

SEQ ID NO: 1250616 - DNA, 22 bp, Artificial Sequence
  chemically synthesized
tctgcgaggacctatggaacta

SEQ ID NO: 1250617 - DNA, 22 bp, Artificial Sequence
  chemically synthesized
tatgttctgggtagttccatag

SEQ ID NO: 1250618 - DNA, 22 bp, Artificial Sequence
  chemically synthesized
tttctgcgaggacctatggaac

SEQ ID NO: 1250619 - DNA, 22 bp, Artificial Sequence
  chemically synthesized
tctttctgcgaggacctatgga

SEQ ID NO: 1250620 - DNA, 22 bp, Artificial Sequence
  chemically synthesized
ctctttctgcgaggacctatgg

SEQ ID NO: 1250621 - DNA, 22 bp, Artificial Sequence
  chemically synthesized
tctctttctgcgaggacctatg

SEQ ID NO: 1250622 - DNA, 22 bp, Artificial Sequence
  chemically synthesized
tgggtagttccataggtcctcg

SEQ ID NO: 1250623 - DNA, 22 bp, Artificial Sequence
  chemically synthesized
ttttctctttctgcgaggacct

SEQ ID NO: 1250624 - DNA, 22 bp, Artificial Sequence
  chemically synthesized
ggtagttccataggtcctcgca

SEQ ID NO: 1250625 - DNA, 22 bp, Artificial Sequence
  chemically synthesized
attttctctttctgcgaggacc

SEQ ID NO: 1250626 - DNA, 22 bp, Artificial Sequence
  chemically synthesized
cataggtcctcgcagaaagaga

SEQ ID NO: 1250627 - DNA, 22 bp, Artificial Sequence
  chemically synthesized
aacgaaaggtttattttctctt

SEQ ID NO: 1250628 - DNA, 22 bp, Artificial Sequence
  chemically synthesized
caacgaaaggtttattttctct

SEQ ID NO: 1250629 - DNA, 22 bp, Artificial Sequence
  chemically synthesized
atttcaacgaaaggtttatttt

SEQ ID NO: 1250630 - DNA, 22 bp, Artificial Sequence
  chemically synthesized
gcagaaagagaaaataaacctt

SEQ ID NO: 1250631 - DNA, 22 bp, Artificial Sequence
  chemically synthesized
aggttaatttcaacgaaaggtt

SEQ ID NO: 1250632 - DNA, 22 bp, Artificial Sequence
  chemically synthesized
ggtctaaggttaatttcaacga

SEQ ID NO: 1250633 - DNA, 22 bp, Artificial Sequence
  chemically synthesized
agaatctaggtctaaggttaat

SEQ ID NO: 1250634 - DNA, 22 bp, Artificial Sequence
  chemically synthesized
aagaatctaggtctaaggttaa

SEQ ID NO: 1250635 - DNA, 22 bp, Artificial Sequence
  chemically synthesized
taagaatctaggtctaaggtta

SEQ ID NO: 1250636 - DNA, 22 bp, Artificial Sequence
  chemically synthesized
tcgttgaaattaaccttagacc

SEQ ID NO: 1250637 - DNA, 22 bp, Artificial Sequence
  chemically synthesized
cgttgaaattaaccttagacct

SEQ ID NO: 1250638 - DNA, 22 bp, Artificial Sequence
  chemically synthesized
gttgaaattaaccttagaccta

SEQ ID NO: 1250639 - DNA, 22 bp, Artificial Sequence
  chemically synthesized
agtcctttaagaatctaggtct

SEQ ID NO: 1250640 - DNA, 22 bp, Artificial Sequence
  chemically synthesized
aaattaaccttagacctagatt

SEQ ID NO: 1250641 - DNA, 22 bp, Artificial Sequence
  chemically synthesized
gagtcctttaagaatctaggtc

SEQ ID NO: 1250642 - DNA, 22 bp, Artificial Sequence
  chemically synthesized
accttagacctagattcttaaa

SEQ ID NO: 1250643 - DNA, 22 bp, Artificial Sequence
  chemically synthesized
agacctagattcttaaaggact

SEQ ID NO: 1250644 - DNA, 22 bp, Artificial Sequence
  chemically synthesized
gacctagattcttaaaggactc

SEQ ID NO: 1250645 - DNA, 22 bp, Artificial Sequence
  chemically synthesized
cccgcgaaaagtttgagtcctt

SEQ ID NO: 1250646 - DNA, 22 bp, Artificial Sequence
  chemically synthesized
ccccgcgaaaagtttgagtcct

SEQ ID NO: 1250647 - DNA, 22 bp, Artificial Sequence
  chemically synthesized
gattcttaaaggactcaaactt

SEQ ID NO: 1250648 - DNA, 22 bp, Artificial Sequence
  chemically synthesized
cttccccgcgaaaagtttgagt

SEQ ID NO: 1250649 - DNA, 22 bp, Artificial Sequence
  chemically synthesized
ccttccccgcgaaaagtttgag

SEQ ID NO: 1250650 - DNA, 22 bp, Artificial Sequence
  chemically synthesized
tccttccccgcgaaaagtttga

SEQ ID NO: 1250651 - DNA, 22 bp, Artificial Sequence
  chemically synthesized
ttaaaggactcaaacttttcgc

SEQ ID NO: 1250652 - DNA, 22 bp, Artificial Sequence
  chemically synthesized
aaaggactcaaacttttcgcgg

SEQ ID NO: 1250653 - DNA, 22 bp, Artificial Sequence
  chemically synthesized
gcctttccttccccgcgaaaag

SEQ ID NO: 1250654 - DNA, 22 bp, Artificial Sequence
  chemically synthesized
aaggactcaaacttttcgcggg

SEQ ID NO: 1250655 - DNA, 22 bp, Artificial Sequence
  chemically synthesized
aaacttttcgcggggaaggaaa

SEQ ID NO: 1250656 - DNA, 22 bp, Artificial Sequence
  chemically synthesized
tcaatagactggcctttccttc

SEQ ID NO: 1250657 - DNA, 22 bp, Artificial Sequence
  chemically synthesized
ctgtcaatagactggcctttcc

SEQ ID NO: 1250658 - DNA, 22 bp, Artificial Sequence
  chemically synthesized
ttcgcggggaaggaaaggccag

SEQ ID NO: 1250659 - DNA, 22 bp, Artificial Sequence
  chemically synthesized
tcgcggggaaggaaaggccagt

SEQ ID NO: 1250660 - DNA, 22 bp, Artificial Sequence
  chemically synthesized
cgcggggaaggaaaggccagtc

SEQ ID NO: 1250661 - DNA, 22 bp, Artificial Sequence
  chemically synthesized
gcggggaaggaaaggccagtct

SEQ ID NO: 1250662 - DNA, 22 bp, Artificial Sequence
  chemically synthesized
cagctcctgtcaatagactggc

SEQ ID NO: 1250663 - DNA, 22 bp, Artificial Sequence
  chemically synthesized
atatctacagctcctgtcaata

SEQ ID NO: 1250664 - DNA, 22 bp, Artificial Sequence
  chemically synthesized
aatatctacagctcctgtcaat

SEQ ID NO: 1250665 - DNA, 22 bp, Artificial Sequence
  chemically synthesized
ttgacaggagctgtagatatta

SEQ ID NO: 1250666 - DNA, 22 bp, Artificial Sequence
  chemically synthesized
acaggagctgtagatattaagg

SEQ ID NO: 1250667 - DNA, 22 bp, Artificial Sequence
  chemically synthesized
ccccaccccccacaggccttaa

SEQ ID NO: 1250668 - DNA, 22 bp, Artificial Sequence
  chemically synthesized
tagatattaaggcctgtggggg

SEQ ID NO: 1250669 - DNA, 22 bp, Artificial Sequence
  chemically synthesized
aggcctgtggggggtgggggag

SEQ ID NO: 1250670 - DNA, 22 bp, Artificial Sequence
  chemically synthesized
ccagataatgagtccccctccc

SEQ ID NO: 1250671 - DNA, 22 bp, Artificial Sequence
  chemically synthesized
cccagataatgagtccccctcc

SEQ ID NO: 1250672 - DNA, 22 bp, Artificial Sequence
  chemically synthesized
tggggggtgggggagggggact

SEQ ID NO: 1250673 - DNA, 22 bp, Artificial Sequence
  chemically synthesized
tcccagataatgagtccccctc

SEQ ID NO: 1250674 - DNA, 22 bp, Artificial Sequence
  chemically synthesized
ttcccagataatgagtccccct

SEQ ID NO: 1250675 - DNA, 22 bp, Artificial Sequence
  chemically synthesized
agggtgtggcttttcccagata

SEQ ID NO: 1250676 - DNA, 22 bp, Artificial Sequence
  chemically synthesized
attatctgggaaaagccacacc

SEQ ID NO: 1250677 - DNA, 22 bp, Artificial Sequence
  chemically synthesized
tgatggattaagggtgtggctt

SEQ ID NO: 1250678 - DNA, 22 bp, Artificial Sequence
  chemically synthesized
atgatggattaagggtgtggct

SEQ ID NO: 1250679 - DNA, 22 bp, Artificial Sequence
  chemically synthesized
tctgggaaaagccacaccctta

SEQ ID NO: 1250680 - DNA, 22 bp, Artificial Sequence
  chemically synthesized
tttatgatggattaagggtgtg

SEQ ID NO: 1250681 - DNA, 22 bp, Artificial Sequence
  chemically synthesized
ggaaaagccacacccttaatcc

SEQ ID NO: 1250682 - DNA, 22 bp, Artificial Sequence
  chemically synthesized
tgccccaggcatcactgtttat

SEQ ID NO: 1250683 - DNA, 22 bp, Artificial Sequence
  chemically synthesized
aatccatcataaacagtgatgc

SEQ ID NO: 1250684 - DNA, 22 bp, Artificial Sequence
  chemically synthesized
atccatcataaacagtgatgcc

SEQ ID NO: 1250685 - DNA, 22 bp, Artificial Sequence
  chemically synthesized
aactgtgccccaggcatcactg

SEQ ID NO: 1250686 - DNA, 22 bp, Artificial Sequence
  chemically synthesized
caaggtgtagtctcaactgtgc

SEQ ID NO: 1250687 - DNA, 22 bp, Artificial Sequence
  chemically synthesized
ctccaaggtgtagtctcaactg

SEQ ID NO: 1250688 - DNA, 22 bp, Artificial Sequence
  chemically synthesized
cctccaaggtgtagtctcaact

SEQ ID NO: 1250689 - DNA, 22 bp, Artificial Sequence
  chemically synthesized
ttcctccaaggtgtagtctcaa

SEQ ID NO: 1250690 - DNA, 22 bp, Artificial Sequence
  chemically synthesized
gggcacagttgagactacacct

SEQ ID NO: 1250691 - DNA, 22 bp, Artificial Sequence
  chemically synthesized
gattcttcctccaaggtgtagt

SEQ ID NO: 1250692 - DNA, 22 bp, Artificial Sequence
  chemically synthesized
agactacaccttggaggaagaa

SEQ ID NO: 1250693 - DNA, 22 bp, Artificial Sequence
  chemically synthesized
gataggaaaaacctagattctt

SEQ ID NO: 1250694 - DNA, 22 bp, Artificial Sequence
  chemically synthesized
caccttggaggaagaatctagg

SEQ ID NO: 1250695 - DNA, 22 bp, Artificial Sequence
  chemically synthesized
gagttggataggaaaaacctag

SEQ ID NO: 1250696 - DNA, 22 bp, Artificial Sequence
  chemically synthesized
ggaggaagaatctaggtttttc

SEQ ID NO: 1250697 - DNA, 22 bp, Artificial Sequence
  chemically synthesized
ggagttggataggaaaaaccta

SEQ ID NO: 1250698 - DNA, 22 bp, Artificial Sequence
  chemically synthesized
gaggaagaatctaggtttttcc

SEQ ID NO: 1250699 - DNA, 22 bp, Artificial Sequence
  chemically synthesized
tggagttggataggaaaaacct

SEQ ID NO: 1250700 - DNA, 22 bp, Artificial Sequence
  chemically synthesized
ttggagttggataggaaaaacc

SEQ ID NO: 1250701 - DNA, 22 bp, Artificial Sequence
  chemically synthesized
ttttggagttggataggaaaaa

SEQ ID NO: 1250702 - DNA, 22 bp, Artificial Sequence
  chemically synthesized
cttttggagttggataggaaaa

SEQ ID NO: 1250703 - DNA, 22 bp, Artificial Sequence
  chemically synthesized
ggtttttcctatccaactccaa

SEQ ID NO: 1250704 - DNA, 22 bp, Artificial Sequence
  chemically synthesized
aaatgtgtttcttttggagttg

SEQ ID NO: 1250705 - DNA, 22 bp, Artificial Sequence
  chemically synthesized
ttcctatccaactccaaaagaa

SEQ ID NO: 1250706 - DNA, 22 bp, Artificial Sequence
  chemically synthesized
tcctatccaactccaaaagaaa

SEQ ID NO: 1250707 - DNA, 22 bp, Artificial Sequence
  chemically synthesized
cctatccaactccaaaagaaac

SEQ ID NO: 1250708 - DNA, 22 bp, Artificial Sequence
  chemically synthesized
ccattgaaatgtgtttcttttg

SEQ ID NO: 1250709 - DNA, 22 bp, Artificial Sequence
  chemically synthesized
ctatccaactccaaaagaaaca

SEQ ID NO: 1250710 - DNA, 22 bp, Artificial Sequence
  chemically synthesized
tccaactccaaaagaaacacat

SEQ ID NO: 1250711 - DNA, 22 bp, Artificial Sequence
  chemically synthesized
agcagttgccattgaaatgtgt

SEQ ID NO: 1250712 - DNA, 22 bp, Artificial Sequence
  chemically synthesized
cagcagttgccattgaaatgtg

SEQ ID NO: 1250713 - DNA, 22 bp, Artificial Sequence
  chemically synthesized
tcagcagttgccattgaaatgt

SEQ ID NO: 1250714 - DNA, 22 bp, Artificial Sequence
  chemically synthesized
ttcagcagttgccattgaaatg

SEQ ID NO: 1250715 - DNA, 22 bp, Artificial Sequence
  chemically synthesized
caaaagaaacacatttcaatgg

SEQ ID NO: 1250716 - DNA, 22 bp, Artificial Sequence
  chemically synthesized
tttttcagcagttgccattgaa

SEQ ID NO: 1250717 - DNA, 22 bp, Artificial Sequence
  chemically synthesized
gtttttcagcagttgccattga

SEQ ID NO: 1250718 - DNA, 22 bp, Artificial Sequence
  chemically synthesized
cttgtttttcagcagttgccat

SEQ ID NO: 1250719 - DNA, 22 bp, Artificial Sequence
  chemically synthesized
gcttgtttttcagcagttgcca

SEQ ID NO: 1250720 - DNA, 22 bp, Artificial Sequence
  chemically synthesized
tttgcttgtttttcagcagttg

SEQ ID NO: 1250721 - DNA, 22 bp, Artificial Sequence
  chemically synthesized
gtttgcttgtttttcagcagtt

SEQ ID NO: 1250722 - DNA, 22 bp, Artificial Sequence
  chemically synthesized
tgtttgcttgtttttcagcagt

SEQ ID NO: 1250723 - DNA, 22 bp, Artificial Sequence
  chemically synthesized
ttgtttgcttgtttttcagcag

SEQ ID NO: 1250724 - DNA, 22 bp, Artificial Sequence
  chemically synthesized
tttgtttgcttgtttttcagca

SEQ ID NO: 1250725 - DNA, 22 bp, Artificial Sequence
  chemically synthesized
caatggcaactgctgaaaaaca

SEQ ID NO: 1250726 - DNA, 22 bp, Artificial Sequence
  chemically synthesized
aatggcaactgctgaaaaacaa

SEQ ID NO: 1250727 - DNA, 22 bp, Artificial Sequence
  chemically synthesized
gtactttttgtttgcttgtttt

SEQ ID NO: 1250728 - DNA, 22 bp, Artificial Sequence
  chemically synthesized
ctgaaaaacaagcaaacaaaaa

SEQ ID NO: 1250729 - DNA, 22 bp, Artificial Sequence
  chemically synthesized
aaaaacaagcaaacaaaaagta

SEQ ID NO: 1250730 - DNA, 22 bp, Artificial Sequence
  chemically synthesized
ccaaagaaacaaaaaggtgctg

SEQ ID NO: 1250731 - DNA, 22 bp, Artificial Sequence
  chemically synthesized
accaaagaaacaaaaaggtgct

SEQ ID NO: 1250732 - DNA, 22 bp, Artificial Sequence
  chemically synthesized
ttaccaaagaaacaaaaaggtg

SEQ ID NO: 1250733 - DNA, 22 bp, Artificial Sequence
  chemically synthesized
cttaccaaagaaacaaaaaggt

SEQ ID NO: 1250734 - DNA, 22 bp, Artificial Sequence
  chemically synthesized
gccttcttaccaaagaaacaaa

SEQ ID NO: 1250735 - DNA, 22 bp, Artificial Sequence
  chemically synthesized
cgccttcttaccaaagaaacaa

SEQ ID NO: 1250736 - DNA, 22 bp, Artificial Sequence
  chemically synthesized
ggatgtttcgccttcttaccaa

SEQ ID NO: 1250737 - DNA, 22 bp, Artificial Sequence
  chemically synthesized
tttgtttctttggtaagaaggc

SEQ ID NO: 1250738 - DNA, 22 bp, Artificial Sequence
  chemically synthesized
ttgtttctttggtaagaaggcg

SEQ ID NO: 1250739 - DNA, 22 bp, Artificial Sequence
  chemically synthesized
tgtttctttggtaagaaggcga

SEQ ID NO: 1250740 - DNA, 22 bp, Artificial Sequence
  chemically synthesized
gtttctttggtaagaaggcgaa

SEQ ID NO: 1250741 - DNA, 22 bp, Artificial Sequence
  chemically synthesized
tttctttggtaagaaggcgaaa

SEQ ID NO: 1250742 - DNA, 22 bp, Artificial Sequence
  chemically synthesized
gacaatctgggatgtttcgcct

SEQ ID NO: 1250743 - DNA, 22 bp, Artificial Sequence
  chemically synthesized
ctttggtaagaaggcgaaacat

SEQ ID NO: 1250744 - DNA, 22 bp, Artificial Sequence
  chemically synthesized
agacaatctgggatgtttcgcc

SEQ ID NO: 1250745 - DNA, 22 bp, Artificial Sequence
  chemically synthesized
tttggtaagaaggcgaaacatc

SEQ ID NO: 1250746 - DNA, 22 bp, Artificial Sequence
  chemically synthesized
tagacaatctgggatgtttcgc

SEQ ID NO: 1250747 - DNA, 22 bp, Artificial Sequence
  chemically synthesized
ttagacaatctgggatgtttcg

SEQ ID NO: 1250748 - DNA, 22 bp, Artificial Sequence
  chemically synthesized
tggtaagaaggcgaaacatccc

SEQ ID NO: 1250749 - DNA, 22 bp, Artificial Sequence
  chemically synthesized
tttagacaatctgggatgtttc

SEQ ID NO: 1250750 - DNA, 22 bp, Artificial Sequence
  chemically synthesized
ggtaagaaggcgaaacatccca

SEQ ID NO: 1250751 - DNA, 22 bp, Artificial Sequence
  chemically synthesized
ttttagacaatctgggatgttt

SEQ ID NO: 1250752 - DNA, 22 bp, Artificial Sequence
  chemically synthesized
gtaagaaggcgaaacatcccag

SEQ ID NO: 1250753 - DNA, 22 bp, Artificial Sequence
  chemically synthesized
tttttagacaatctgggatgtt

SEQ ID NO: 1250754 - DNA, 22 bp, Artificial Sequence
  chemically synthesized
ttttttagacaatctgggatgt

SEQ ID NO: 1250755 - DNA, 22 bp, Artificial Sequence
  chemically synthesized
ttttttttagacaatctgggat

SEQ ID NO: 1250756 - DNA, 22 bp, Artificial Sequence
  chemically synthesized
cttttttttagacaatctggga

SEQ ID NO: 1250757 - DNA, 22 bp, Artificial Sequence
  chemically synthesized
ccgaatttcttttttttagaca

SEQ ID NO: 1250758 - DNA, 22 bp, Artificial Sequence
  chemically synthesized
cccgaatttcttttttttagac

SEQ ID NO: 1250759 - DNA, 22 bp, Artificial Sequence
  chemically synthesized
atttcccgaatttctttttttt

SEQ ID NO: 1250760 - DNA, 22 bp, Artificial Sequence
  chemically synthesized
tgatttcccgaatttctttttt

SEQ ID NO: 1250761 - DNA, 22 bp, Artificial Sequence
  chemically synthesized
tctaaaaaaaagaaattcggga

SEQ ID NO: 1250762 - DNA, 22 bp, Artificial Sequence
  chemically synthesized
aaaaaaagaaattcgggaaatc

SEQ ID NO: 1250763 - DNA, 22 bp, Artificial Sequence
  chemically synthesized
gggaaatcagaacgttttatca

SEQ ID NO: 1250764 - DNA, 22 bp, Artificial Sequence
  chemically synthesized
gacaacataaccccagatcatg

SEQ ID NO: 1250765 - DNA, 22 bp, Artificial Sequence
  chemically synthesized
ctggacaacataaccccagatc

SEQ ID NO: 1250766 - DNA, 22 bp, Artificial Sequence
  chemically synthesized
actggacaacataaccccagat

SEQ ID NO: 1250767 - DNA, 22 bp, Artificial Sequence
  chemically synthesized
tcttactggacaacataacccc

SEQ ID NO: 1250768 - DNA, 22 bp, Artificial Sequence
  chemically synthesized
tatcatgatctggggttatgtt

SEQ ID NO: 1250769 - DNA, 22 bp, Artificial Sequence
  chemically synthesized
atcatgatctggggttatgttg

SEQ ID NO: 1250770 - DNA, 22 bp, Artificial Sequence
  chemically synthesized
tcatgatctggggttatgttgt

SEQ ID NO: 1250771 - DNA, 22 bp, Artificial Sequence
  chemically synthesized
gtggctatcttactggacaaca

SEQ ID NO: 1250772 - DNA, 22 bp, Artificial Sequence
  chemically synthesized
gggttatgttgtccagtaagat

SEQ ID NO: 1250773 - DNA, 22 bp, Artificial Sequence
  chemically synthesized
tgttgtccagtaagatagccac

SEQ ID NO: 1250774 - DNA, 22 bp, Artificial Sequence
  chemically synthesized
tccagtaagatagccactagtt

SEQ ID NO: 1250775 - DNA, 22 bp, Artificial Sequence
  chemically synthesized
agtagccacatataactagtgg

SEQ ID NO: 1250776 - DNA, 22 bp, Artificial Sequence
  chemically synthesized
aaatgttcagtagccacatata

SEQ ID NO: 1250777 - DNA, 22 bp, Artificial Sequence
  chemically synthesized
caaatgttcagtagccacatat

SEQ ID NO: 1250778 - DNA, 22 bp, Artificial Sequence
  chemically synthesized
gttatatgtggctactgaacat

SEQ ID NO: 1250779 - DNA, 22 bp, Artificial Sequence
  chemically synthesized
gtcccatttcaaatgttcagta

SEQ ID NO: 1250780 - DNA, 22 bp, Artificial Sequence
  chemically synthesized
tatgtggctactgaacatttga

SEQ ID NO: 1250781 - DNA, 22 bp, Artificial Sequence
  chemically synthesized
tgctagtcccatttcaaatgtt

SEQ ID NO: 1250782 - DNA, 22 bp, Artificial Sequence
  chemically synthesized
agttatgctagtcccatttcaa

SEQ ID NO: 1250783 - DNA, 22 bp, Artificial Sequence
  chemically synthesized
ctcagttatgctagtcccattt

SEQ ID NO: 1250784 - DNA, 22 bp, Artificial Sequence
  chemically synthesized
ctgaacatttgaaatgggacta

SEQ ID NO: 1250785 - DNA, 22 bp, Artificial Sequence
  chemically synthesized
cctcagttatgctagtcccatt

SEQ ID NO: 1250786 - DNA, 22 bp, Artificial Sequence
  chemically synthesized
aacatttgaaatgggactagca

SEQ ID NO: 1250787 - DNA, 22 bp, Artificial Sequence
  chemically synthesized
gcttcctcagttatgctagtcc

SEQ ID NO: 1250788 - DNA, 22 bp, Artificial Sequence
  chemically synthesized
ggcttcctcagttatgctagtc

SEQ ID NO: 1250789 - DNA, 22 bp, Artificial Sequence
  chemically synthesized
gaaatgggactagcataactga

SEQ ID NO: 1250790 - DNA, 22 bp, Artificial Sequence
  chemically synthesized
aaatgggactagcataactgag

SEQ ID NO: 1250791 - DNA, 22 bp, Artificial Sequence
  chemically synthesized
gcataactgaggaagccaaatt

SEQ ID NO: 1250792 - DNA, 22 bp, Artificial Sequence
  chemically synthesized
aggaagccaaattttcattttg

SEQ ID NO: 1250793 - DNA, 22 bp, Artificial Sequence
  chemically synthesized
aagcaaaaataaagcaaaatga

SEQ ID NO: 1250794 - DNA, 22 bp, Artificial Sequence
  chemically synthesized
tcattttgctttatttttgctt

SEQ ID NO: 1250795 - DNA, 22 bp, Artificial Sequence
  chemically synthesized
cattttgctttatttttgcttc

SEQ ID NO: 1250796 - DNA, 22 bp, Artificial Sequence
  chemically synthesized
attttgctttatttttgcttca

SEQ ID NO: 1250797 - DNA, 22 bp, Artificial Sequence
  chemically synthesized
aatataaataaaattgaagcaa

SEQ ID NO: 1250798 - DNA, 22 bp, Artificial Sequence
  chemically synthesized
caatataaataaaattgaagca

SEQ ID NO: 1250799 - DNA, 22 bp, Artificial Sequence
  chemically synthesized
tgctttatttttgcttcaattt

SEQ ID NO: 1250800 - DNA, 22 bp, Artificial Sequence
  chemically synthesized
tcaatataaataaaattgaagc

SEQ ID NO: 1250801 - DNA, 22 bp, Artificial Sequence
  chemically synthesized
gctttatttttgcttcaatttt

SEQ ID NO: 1250802 - DNA, 22 bp, Artificial Sequence
  chemically synthesized
ctttatttttgcttcaatttta

SEQ ID NO: 1250803 - DNA, 22 bp, Artificial Sequence
  chemically synthesized
ttttcaatataaataaaattga

SEQ ID NO: 1250804 - DNA, 22 bp, Artificial Sequence
  chemically synthesized
gttttcaatataaataaaattg

SEQ ID NO: 1250805 - DNA, 22 bp, Artificial Sequence
  chemically synthesized
tatttttgcttcaattttattt

SEQ ID NO: 1250806 - DNA, 22 bp, Artificial Sequence
  chemically synthesized
atttttgcttcaattttattta

SEQ ID NO: 1250807 - DNA, 22 bp, Artificial Sequence
  chemically synthesized
tttttgcttcaattttatttat

SEQ ID NO: 1250808 - DNA, 22 bp, Artificial Sequence
  chemically synthesized
tttgttttcaatataaataaaa

SEQ ID NO: 1250809 - DNA, 22 bp, Artificial Sequence
  chemically synthesized
ttgcttcaattttatttatatt

SEQ ID NO: 1250810 - DNA, 22 bp, Artificial Sequence
  chemically synthesized
tgcttcaattttatttatattg

SEQ ID NO: 1250811 - DNA, 22 bp, Artificial Sequence
  chemically synthesized
gcttcaattttatttatattga

SEQ ID NO: 1250812 - DNA, 22 bp, Artificial Sequence
  chemically synthesized
cttcaattttatttatattgaa

SEQ ID NO: 1250813 - DNA, 22 bp, Artificial Sequence
  chemically synthesized
aaaactgtttgttttcaatata

SEQ ID NO: 1250814 - DNA, 22 bp, Artificial Sequence
  chemically synthesized
caattttatttatattgaaaac

SEQ ID NO: 1250815 - DNA, 22 bp, Artificial Sequence
  chemically synthesized
aattttatttatattgaaaaca

SEQ ID NO: 1250816 - DNA, 22 bp, Artificial Sequence
  chemically synthesized
tatttatattgaaaacaaacag

SEQ ID NO: 1250817 - DNA, 22 bp, Artificial Sequence
  chemically synthesized
atttatattgaaaacaaacagt

SEQ ID NO: 1250818 - DNA, 22 bp, Artificial Sequence
  chemically synthesized
tttatattgaaaacaaacagtt

SEQ ID NO: 1250819 - DNA, 22 bp, Artificial Sequence
  chemically synthesized
atattgaaaacaaacagttttt

SEQ ID NO: 1250820 - DNA, 22 bp, Artificial Sequence
  chemically synthesized
tattgaaaacaaacagttttta

SEQ ID NO: 1250821 - DNA, 22 bp, Artificial Sequence
  chemically synthesized
atggaagaatattaaaaactgt

SEQ ID NO: 1250822 - DNA, 22 bp, Artificial Sequence
  chemically synthesized
aaaacaaacagtttttaatatt

SEQ ID NO: 1250823 - DNA, 22 bp, Artificial Sequence
  chemically synthesized
tggttaatggaagaatattaaa

SEQ ID NO: 1250824 - DNA, 22 bp, Artificial Sequence
  chemically synthesized
ttaatattcttccattaaccat

SEQ ID NO: 1250825 - DNA, 22 bp, Artificial Sequence
  chemically synthesized
taatattcttccattaaccata

SEQ ID NO: 1250826 - DNA, 22 bp, Artificial Sequence
  chemically synthesized
aatattcttccattaaccataa

SEQ ID NO: 1250827 - DNA, 22 bp, Artificial Sequence
  chemically synthesized
atattcttccattaaccataac

SEQ ID NO: 1250828 - DNA, 22 bp, Artificial Sequence
  chemically synthesized
ccaaaccaatgaagttatggtt

SEQ ID NO: 1250829 - DNA, 22 bp, Artificial Sequence
  chemically synthesized
tcccaaaccaatgaagttatgg

SEQ ID NO: 1250830 - DNA, 22 bp, Artificial Sequence
  chemically synthesized
ttccattaaccataacttcatt

SEQ ID NO: 1250831 - DNA, 22 bp, Artificial Sequence
  chemically synthesized
ttctcccaaaccaatgaagtta

SEQ ID NO: 1250832 - DNA, 22 bp, Artificial Sequence
  chemically synthesized
gttctcccaaaccaatgaagtt

SEQ ID NO: 1250833 - DNA, 22 bp, Artificial Sequence
  chemically synthesized
ccattaaccataacttcattgg

SEQ ID NO: 1250834 - DNA, 22 bp, Artificial Sequence
  chemically synthesized
cattaaccataacttcattggt

SEQ ID NO: 1250835 - DNA, 22 bp, Artificial Sequence
  chemically synthesized
accataacttcattggtttggg

SEQ ID NO: 1250836 - DNA, 22 bp, Artificial Sequence
  chemically synthesized
aagtaaacttgttctcccaaac

SEQ ID NO: 1250837 - DNA, 22 bp, Artificial Sequence
  chemically synthesized
cattggtttgggagaacaagtt

SEQ ID NO: 1250838 - DNA, 22 bp, Artificial Sequence
  chemically synthesized
attggtttgggagaacaagttt

SEQ ID NO: 1250839 - DNA, 22 bp, Artificial Sequence
  chemically synthesized
atgggttaaagtaaacttgttc

SEQ ID NO: 1250840 - DNA, 22 bp, Artificial Sequence
  chemically synthesized
catgggttaaagtaaacttgtt

SEQ ID NO: 1250841 - DNA, 22 bp, Artificial Sequence
  chemically synthesized
tcatgggttaaagtaaacttgt

SEQ ID NO: 1250842 - DNA, 22 bp, Artificial Sequence
  chemically synthesized
gtttgggagaacaagtttactt

SEQ ID NO: 1250843 - DNA, 22 bp, Artificial Sequence
  chemically synthesized
gggagaacaagtttactttaac

SEQ ID NO: 1250844 - DNA, 22 bp, Artificial Sequence
  chemically synthesized
ggagaacaagtttactttaacc

SEQ ID NO: 1250845 - DNA, 22 bp, Artificial Sequence
  chemically synthesized
ccatattttcatgggttaaagt

SEQ ID NO: 1250846 - DNA, 22 bp, Artificial Sequence
  chemically synthesized
agttgccatattttcatgggtt

SEQ ID NO: 1250847 - DNA, 22 bp, Artificial Sequence
  chemically synthesized
aattcagttgccatattttcat

SEQ ID NO: 1250848 - DNA, 22 bp, Artificial Sequence
  chemically synthesized
actttaacccatgaaaatatgg

SEQ ID NO: 1250849 - DNA, 22 bp, Artificial Sequence
  chemically synthesized
ctttaacccatgaaaatatggc

SEQ ID NO: 1250850 - DNA, 22 bp, Artificial Sequence
  chemically synthesized
taacccatgaaaatatggcaac

SEQ ID NO: 1250851 - DNA, 22 bp, Artificial Sequence
  chemically synthesized
aacccatgaaaatatggcaact

SEQ ID NO: 1250852 - DNA, 22 bp, Artificial Sequence
  chemically synthesized
acccatgaaaatatggcaactg

SEQ ID NO: 1250853 - DNA, 22 bp, Artificial Sequence
  chemically synthesized
cagcacatctgaattcagttgc

SEQ ID NO: 1250854 - DNA, 22 bp, Artificial Sequence
  chemically synthesized
acagcacatctgaattcagttg

SEQ ID NO: 1250855 - DNA, 22 bp, Artificial Sequence
  chemically synthesized
catttacagcacatctgaattc

SEQ ID NO: 1250856 - DNA, 22 bp, Artificial Sequence
  chemically synthesized
acatttacagcacatctgaatt

SEQ ID NO: 1250857 - DNA, 22 bp, Artificial Sequence
  chemically synthesized
tacatttacagcacatctgaat

SEQ ID NO: 1250858 - DNA, 22 bp, Artificial Sequence
  chemically synthesized
gaggatattttacatttacagc

SEQ ID NO: 1250859 - DNA, 22 bp, Artificial Sequence
  chemically synthesized
aattcagatgtgctgtaaatgt

SEQ ID NO: 1250860 - DNA, 22 bp, Artificial Sequence
  chemically synthesized
agatgtgctgtaaatgtaaaat

SEQ ID NO: 1250861 - DNA, 22 bp, Artificial Sequence
  chemically synthesized
aggttggaggatattttacatt

SEQ ID NO: 1250862 - DNA, 22 bp, Artificial Sequence
  chemically synthesized
aatcattaaggttggaggatat

SEQ ID NO: 1250863 - DNA, 22 bp, Artificial Sequence
  chemically synthesized
taaatgtaaaatatcctccaac

SEQ ID NO: 1250864 - DNA, 22 bp, Artificial Sequence
  chemically synthesized
gtgaaaagaatgtactaaatca

SEQ ID NO: 1250865 - DNA, 22 bp, Artificial Sequence
  chemically synthesized
caaccttaatgatttagtacat

SEQ ID NO: 1250866 - DNA, 22 bp, Artificial Sequence
  chemically synthesized
cgttagtgaaaagaatgtacta

SEQ ID NO: 1250867 - DNA, 22 bp, Artificial Sequence
  chemically synthesized
acgttagtgaaaagaatgtact

SEQ ID NO: 1250868 - DNA, 22 bp, Artificial Sequence
  chemically synthesized
tacgttagtgaaaagaatgtac

SEQ ID NO: 1250869 - DNA, 22 bp, Artificial Sequence
  chemically synthesized
aatgatttagtacattcttttc

SEQ ID NO: 1250870 - DNA, 22 bp, Artificial Sequence
  chemically synthesized
atgatttagtacattcttttca

SEQ ID NO: 1250871 - DNA, 22 bp, Artificial Sequence
  chemically synthesized
agtacattcttttcactaacgt

SEQ ID NO: 1250872 - DNA, 22 bp, Artificial Sequence
  chemically synthesized
atgagacattttacgttagtga

SEQ ID NO: 1250873 - DNA, 22 bp, Artificial Sequence
  chemically synthesized
gtacattcttttcactaacgta

SEQ ID NO: 1250874 - DNA, 22 bp, Artificial Sequence
  chemically synthesized
aatgagacattttacgttagtg

SEQ ID NO: 1250875 - DNA, 22 bp, Artificial Sequence
  chemically synthesized
ttttcactaacgtaaaatgtct

SEQ ID NO: 1250876 - DNA, 22 bp, Artificial Sequence
  chemically synthesized
ttcactaacgtaaaatgtctca

SEQ ID NO: 1250877 - DNA, 22 bp, Artificial Sequence
  chemically synthesized
tcactaacgtaaaatgtctcat

SEQ ID NO: 1250878 - DNA, 22 bp, Artificial Sequence
  chemically synthesized
cactaacgtaaaatgtctcatt

SEQ ID NO: 1250879 - DNA, 22 bp, Artificial Sequence
  chemically synthesized
actaacgtaaaatgtctcatta

SEQ ID NO: 1250880 - DNA, 22 bp, Artificial Sequence
  chemically synthesized
acgtaaaatgtctcattaagtc

SEQ ID NO: 1250881 - DNA, 22 bp, Artificial Sequence
  chemically synthesized
aacatgtaatcaaaaaagactt

SEQ ID NO: 1250882 - DNA, 22 bp, Artificial Sequence
  chemically synthesized
caacatgtaatcaaaaaagact

SEQ ID NO: 1250883 - DNA, 22 bp, Artificial Sequence
  chemically synthesized
attaagtcttttttgattacat

SEQ ID NO: 1250884 - DNA, 22 bp, Artificial Sequence
  chemically synthesized
aaatatttcaacatgtaatcaa

SEQ ID NO: 1250885 - DNA, 22 bp, Artificial Sequence
  chemically synthesized
agtcttttttgattacatgttg

SEQ ID NO: 1250886 - DNA, 22 bp, Artificial Sequence
  chemically synthesized
gctaaaatatttcaacatgtaa

SEQ ID NO: 1250887 - DNA, 22 bp, Artificial Sequence
  chemically synthesized
agctaaaatatttcaacatgta

SEQ ID NO: 1250888 - DNA, 22 bp, Artificial Sequence
  chemically synthesized
tttagctaaaatatttcaacat

SEQ ID NO: 1250889 - DNA, 22 bp, Artificial Sequence
  chemically synthesized
atttagctaaaatatttcaaca

SEQ ID NO: 1250890 - DNA, 22 bp, Artificial Sequence
  chemically synthesized
ttttgattacatgttgaaatat

SEQ ID NO: 1250891 - DNA, 22 bp, Artificial Sequence
  chemically synthesized
tatttagctaaaatatttcaac

SEQ ID NO: 1250892 - DNA, 22 bp, Artificial Sequence
  chemically synthesized
tttgattacatgttgaaatatt

SEQ ID NO: 1250893 - DNA, 22 bp, Artificial Sequence
  chemically synthesized
ttgattacatgttgaaatattt

SEQ ID NO: 1250894 - DNA, 22 bp, Artificial Sequence
  chemically synthesized
tgattacatgttgaaatatttt

SEQ ID NO: 1250895 - DNA, 22 bp, Artificial Sequence
  chemically synthesized
gattacatgttgaaatatttta

SEQ ID NO: 1250896 - DNA, 22 bp, Artificial Sequence
  chemically synthesized
attacatgttgaaatattttag

SEQ ID NO: 1250897 - DNA, 22 bp, Artificial Sequence
  chemically synthesized
atgttttatttagctaaaatat

SEQ ID NO: 1250898 - DNA, 22 bp, Artificial Sequence
  chemically synthesized
catgttgaaatattttagctaa

SEQ ID NO: 1250899 - DNA, 22 bp, Artificial Sequence
  chemically synthesized
aaatattttagctaaataaaac

SEQ ID NO: 1250900 - DNA, 22 bp, Artificial Sequence
  chemically synthesized
tagctaaataaaacattaatgt

SEQ ID NO: 1250901 - DNA, 22 bp, Artificial Sequence
  chemically synthesized
agctaaataaaacattaatgtc

SEQ ID NO: 1250902 - DNA, 22 bp, Artificial Sequence
  chemically synthesized
gctaaataaaacattaatgtca

SEQ ID NO: 1250903 - DNA, 22 bp, Artificial Sequence
  chemically synthesized
aataaaacattaatgtcacctg

SEQ ID NO: 1250904 - DNA, 22 bp, Artificial Sequence
  chemically synthesized
aaaagtgaaaataaacaggtga

SEQ ID NO: 1250905 - DNA, 22 bp, Artificial Sequence
  chemically synthesized
aaaaagtgaaaataaacaggtg

SEQ ID NO: 1250906 - DNA, 22 bp, Artificial Sequence
  chemically synthesized
taaaaagtgaaaataaacaggt

SEQ ID NO: 1250907 - DNA, 22 bp, Artificial Sequence
  chemically synthesized
atgtcacctgtttattttcact

SEQ ID NO: 1250908 - DNA, 22 bp, Artificial Sequence
  chemically synthesized
agtagccactttaaaaagtgaa

SEQ ID NO: 1250909 - DNA, 22 bp, Artificial Sequence
  chemically synthesized
gagtagccactttaaaaagtga

SEQ ID NO: 1250910 - DNA, 22 bp, Artificial Sequence
  chemically synthesized
tgagtagccactttaaaaagtg

SEQ ID NO: 1250911 - DNA, 22 bp, Artificial Sequence
  chemically synthesized
ttgagtagccactttaaaaagt

SEQ ID NO: 1250912 - DNA, 22 bp, Artificial Sequence
  chemically synthesized
tttgagtagccactttaaaaag

SEQ ID NO: 1250913 - DNA, 22 bp, Artificial Sequence
  chemically synthesized
tttattttcactttttaaagtg

SEQ ID NO: 1250914 - DNA, 22 bp, Artificial Sequence
  chemically synthesized
attttcactttttaaagtggct

SEQ ID NO: 1250915 - DNA, 22 bp, Artificial Sequence
  chemically synthesized
aactttttgagtagccacttta

SEQ ID NO: 1250916 - DNA, 22 bp, Artificial Sequence
  chemically synthesized
ttttcactttttaaagtggcta

SEQ ID NO: 1250917 - DNA, 22 bp, Artificial Sequence
  chemically synthesized
aaactttttgagtagccacttt

SEQ ID NO: 1250918 - DNA, 22 bp, Artificial Sequence
  chemically synthesized
tcactttttaaagtggctactc

SEQ ID NO: 1250919 - DNA, 22 bp, Artificial Sequence
  chemically synthesized
cactttttaaagtggctactca

SEQ ID NO: 1250920 - DNA, 22 bp, Artificial Sequence
  chemically synthesized
actttttaaagtggctactcaa

SEQ ID NO: 1250921 - DNA, 22 bp, Artificial Sequence
  chemically synthesized
tttaaagtggctactcaaaaag

SEQ ID NO: 1250922 - DNA, 22 bp, Artificial Sequence
  chemically synthesized
ttaaagtggctactcaaaaagt

SEQ ID NO: 1250923 - DNA, 22 bp, Artificial Sequence
  chemically synthesized
taaagtggctactcaaaaagtt

SEQ ID NO: 1250924 - DNA, 22 bp, Artificial Sequence
  chemically synthesized
aaagtggctactcaaaaagttt

SEQ ID NO: 1250925 - DNA, 22 bp, Artificial Sequence
  chemically synthesized
tatatgtaatttaaactttttg

SEQ ID NO: 1250926 - DNA, 22 bp, Artificial Sequence
  chemically synthesized
aagtggctactcaaaaagttta

SEQ ID NO: 1250927 - DNA, 22 bp, Artificial Sequence
  chemically synthesized
ctcaaaaagtttaaattacata

SEQ ID NO: 1250928 - DNA, 22 bp, Artificial Sequence
  chemically synthesized
aaaaagtttaaattacatatat

SEQ ID NO: 1250929 - DNA, 22 bp, Artificial Sequence
  chemically synthesized
tccaaaagaaatataagctata

SEQ ID NO: 1250930 - DNA, 22 bp, Artificial Sequence
  chemically synthesized
aaattacatatatagcttatat

SEQ ID NO: 1250931 - DNA, 22 bp, Artificial Sequence
  chemically synthesized
aattacatatatagcttatatt

SEQ ID NO: 1250932 - DNA, 22 bp, Artificial Sequence
  chemically synthesized
catatatagcttatatttcttt

SEQ ID NO: 1250933 - DNA, 22 bp, Artificial Sequence
  chemically synthesized
caggccagtgctgtccaaaaga

SEQ ID NO: 1250934 - DNA, 22 bp, Artificial Sequence
  chemically synthesized
tactccaggccagtgctgtcca

SEQ ID NO: 1250935 - DNA, 22 bp, Artificial Sequence
  chemically synthesized
atatttcttttggacagcactg

SEQ ID NO: 1250936 - DNA, 22 bp, Artificial Sequence
  chemically synthesized
tatttcttttggacagcactgg

SEQ ID NO: 1250937 - DNA, 22 bp, Artificial Sequence
  chemically synthesized
aactgtactccaggccagtgct

SEQ ID NO: 1250938 - DNA, 22 bp, Artificial Sequence
  chemically synthesized
gaactgtactccaggccagtgc

SEQ ID NO: 1250939 - DNA, 22 bp, Artificial Sequence
  chemically synthesized
tgaactgtactccaggccagtg

SEQ ID NO: 1250940 - DNA, 22 bp, Artificial Sequence
  chemically synthesized
cttttggacagcactggcctgg

SEQ ID NO: 1250941 - DNA, 22 bp, Artificial Sequence
  chemically synthesized
ttgaactgtactccaggccagt

SEQ ID NO: 1250942 - DNA, 22 bp, Artificial Sequence
  chemically synthesized
ttttggacagcactggcctgga

SEQ ID NO: 1250943 - DNA, 22 bp, Artificial Sequence
  chemically synthesized
ttggacagcactggcctggagt

SEQ ID NO: 1250944 - DNA, 22 bp, Artificial Sequence
  chemically synthesized
tttttgaactgtactccaggcc

SEQ ID NO: 1250945 - DNA, 22 bp, Artificial Sequence
  chemically synthesized
tggacagcactggcctggagta

SEQ ID NO: 1250946 - DNA, 22 bp, Artificial Sequence
  chemically synthesized
ggacagcactggcctggagtac

SEQ ID NO: 1250947 - DNA, 22 bp, Artificial Sequence
  chemically synthesized
gacagcactggcctggagtaca

SEQ ID NO: 1250948 - DNA, 22 bp, Artificial Sequence
  chemically synthesized
ccctatttttgaactgtactcc

SEQ ID NO: 1250949 - DNA, 22 bp, Artificial Sequence
  chemically synthesized
gccctatttttgaactgtactc

SEQ ID NO: 1250950 - DNA, 22 bp, Artificial Sequence
  chemically synthesized
tgccctatttttgaactgtact

SEQ ID NO: 1250951 - DNA, 22 bp, Artificial Sequence
  chemically synthesized
ttgccctatttttgaactgtac

SEQ ID NO: 1250952 - DNA, 22 bp, Artificial Sequence
  chemically synthesized
gcctggagtacagttcaaaaat

SEQ ID NO: 1250953 - DNA, 22 bp, Artificial Sequence
  chemically synthesized
aatttttgccctatttttgaac

SEQ ID NO: 1250954 - DNA, 22 bp, Artificial Sequence
  chemically synthesized
tgaatttttgccctatttttga

SEQ ID NO: 1250955 - DNA, 22 bp, Artificial Sequence
  chemically synthesized
gagtacagttcaaaaatagggc

SEQ ID NO: 1250956 - DNA, 22 bp, Artificial Sequence
  chemically synthesized
aaaaatagggcaaaaattcaga

SEQ ID NO: 1250957 - DNA, 22 bp, Artificial Sequence
  chemically synthesized
agatgtggaagaagtaactctg

SEQ ID NO: 1250958 - DNA, 22 bp, Artificial Sequence
  chemically synthesized
gcaaaactcagatgtggaagaa

SEQ ID NO: 1250959 - DNA, 22 bp, Artificial Sequence
  chemically synthesized
agagttacttcttccacatctg

SEQ ID NO: 1250960 - DNA, 22 bp, Artificial Sequence
  chemically synthesized
cttcttccacatctgagttttg

SEQ ID NO: 1250961 - DNA, 22 bp, Artificial Sequence
  chemically synthesized
cttccacatctgagttttgcga

SEQ ID NO: 1250962 - DNA, 22 bp, Artificial Sequence
  chemically synthesized
ttccacatctgagttttgcgaa

SEQ ID NO: 1250963 - DNA, 22 bp, Artificial Sequence
  chemically synthesized
ccacatctgagttttgcgaaca

SEQ ID NO: 1250964 - DNA, 22 bp, Artificial Sequence
  chemically synthesized
cacatctgagttttgcgaacat

SEQ ID NO: 1250965 - DNA, 22 bp, Artificial Sequence
  chemically synthesized
agttttgcgaacatttattcct

SEQ ID NO: 1250966 - DNA, 22 bp, Artificial Sequence
  chemically synthesized
gtgtgtatgtagcaggaataaa

SEQ ID NO: 1250967 - DNA, 22 bp, Artificial Sequence
  chemically synthesized
tgcgaacatttattcctgctac

SEQ ID NO: 1250968 - DNA, 22 bp, Artificial Sequence
  chemically synthesized
gcgaacatttattcctgctaca

SEQ ID NO: 1250969 - DNA, 22 bp, Artificial Sequence
  chemically synthesized
cgaacatttattcctgctacat

SEQ ID NO: 1250970 - DNA, 22 bp, Artificial Sequence
  chemically synthesized
attcctgctacatacacaccag

SEQ ID NO: 1250971 - DNA, 22 bp, Artificial Sequence
  chemically synthesized
ttcctgctacatacacaccagt

SEQ ID NO: 1250972 - DNA, 22 bp, Artificial Sequence
  chemically synthesized
ctgctacatacacaccagtctg

SEQ ID NO: 1250973 - DNA, 22 bp, Artificial Sequence
  chemically synthesized
tgtgtagatacacagactggtg

SEQ ID NO: 1250974 - DNA, 22 bp, Artificial Sequence
  chemically synthesized
ctacatacacaccagtctgtgt

SEQ ID NO: 1250975 - DNA, 22 bp, Artificial Sequence
  chemically synthesized
attatgtgtagatacacagact

SEQ ID NO: 1250976 - DNA, 22 bp, Artificial Sequence
  chemically synthesized
cattatgtgtagatacacagac

SEQ ID NO: 1250977 - DNA, 22 bp, Artificial Sequence
  chemically synthesized
catacacaccagtctgtgtatc

SEQ ID NO: 1250978 - DNA, 22 bp, Artificial Sequence
  chemically synthesized
tcattatgtgtagatacacaga

SEQ ID NO: 1250979 - DNA, 22 bp, Artificial Sequence
  chemically synthesized
ttcattatgtgtagatacacag

SEQ ID NO: 1250980 - DNA, 22 bp, Artificial Sequence
  chemically synthesized
tttttcattatgtgtagataca

SEQ ID NO: 1250981 - DNA, 22 bp, Artificial Sequence
  chemically synthesized
agaaaagtctgtttttcattat

SEQ ID NO: 1250982 - DNA, 22 bp, Artificial Sequence
  chemically synthesized
tgtatctacacataatgaaaaa

SEQ ID NO: 1250983 - DNA, 22 bp, Artificial Sequence
  chemically synthesized
cacataatgaaaaacagacttt

SEQ ID NO: 1250984 - DNA, 22 bp, Artificial Sequence
  chemically synthesized
tatatgaggggattgagaaaag

SEQ ID NO: 1250985 - DNA, 22 bp, Artificial Sequence
  chemically synthesized
tgtatatgaggggattgagaaa

SEQ ID NO: 1250986 - DNA, 22 bp, Artificial Sequence
  chemically synthesized
ccctctgtatatgaggggattg

SEQ ID NO: 1250987 - DNA, 22 bp, Artificial Sequence
  chemically synthesized
acctgccctctgtatatgaggg

SEQ ID NO: 1250988 - DNA, 22 bp, Artificial Sequence
  chemically synthesized
ttctcaatcccctcatatacag

SEQ ID NO: 1250989 - DNA, 22 bp, Artificial Sequence
  chemically synthesized
tctcaatcccctcatatacaga

SEQ ID NO: 1250990 - DNA, 22 bp, Artificial Sequence
  chemically synthesized
actcacctgccctctgtatatg

SEQ ID NO: 1250991 - DNA, 22 bp, Artificial Sequence
  chemically synthesized
ctcaatcccctcatatacagag

SEQ ID NO: 1250992 - DNA, 22 bp, Artificial Sequence
  chemically synthesized
tcaatcccctcatatacagagg

SEQ ID NO: 1250993 - DNA, 22 bp, Artificial Sequence
  chemically synthesized
aatcccctcatatacagagggc

SEQ ID NO: 1250994 - DNA, 22 bp, Artificial Sequence
  chemically synthesized
gctcactcacctgccctctgta

SEQ ID NO: 1250995 - DNA, 22 bp, Artificial Sequence
  chemically synthesized
actggctcactcacctgccctc

SEQ ID NO: 1250996 - DNA, 22 bp, Artificial Sequence
  chemically synthesized
tcactggctcactcacctgccc

SEQ ID NO: 1250997 - DNA, 22 bp, Artificial Sequence
  chemically synthesized
tctcactggctcactcacctgc

SEQ ID NO: 1250998 - DNA, 22 bp, Artificial Sequence
  chemically synthesized
atatacagagggcaggtgagtg

SEQ ID NO: 1250999 - DNA, 22 bp, Artificial Sequence
  chemically synthesized
ctctcactggctcactcacctg

SEQ ID NO: 1251000 - DNA, 22 bp, Artificial Sequence
  chemically synthesized
agtcttctctcactggctcact

SEQ ID NO: 1251001 - DNA, 22 bp, Artificial Sequence
  chemically synthesized
tcagtcttctctcactggctca

SEQ ID NO: 1251002 - DNA, 22 bp, Artificial Sequence
  chemically synthesized
cctctcagtcttctctcactgg

SEQ ID NO: 1251003 - DNA, 22 bp, Artificial Sequence
  chemically synthesized
acctctcagtcttctctcactg

SEQ ID NO: 1251004 - DNA, 22 bp, Artificial Sequence
  chemically synthesized
tatgatccacttacctctcagt

SEQ ID NO: 1251005 - DNA, 22 bp, Artificial Sequence
  chemically synthesized
atatgatccacttacctctcag

SEQ ID NO: 1251006 - DNA, 22 bp, Artificial Sequence
  chemically synthesized
atttatatgatccacttacctc

SEQ ID NO: 1251007 - DNA, 22 bp, Artificial Sequence
  chemically synthesized
aatttatatgatccacttacct

SEQ ID NO: 1251008 - DNA, 22 bp, Artificial Sequence
  chemically synthesized
ggccatcttaatttatatgatc

SEQ ID NO: 1251009 - DNA, 22 bp, Artificial Sequence
  chemically synthesized
agaggtaagtggatcatataaa

SEQ ID NO: 1251010 - DNA, 22 bp, Artificial Sequence
  chemically synthesized
ttaggccatcttaatttatatg

SEQ ID NO: 1251011 - DNA, 22 bp, Artificial Sequence
  chemically synthesized
atgttgttaggccatcttaatt

SEQ ID NO: 1251012 - DNA, 22 bp, Artificial Sequence
  chemically synthesized
taatgttgttaggccatcttaa

SEQ ID NO: 1251013 - DNA, 22 bp, Artificial Sequence
  chemically synthesized
atgattctaatgttgttaggcc

SEQ ID NO: 1251014 - DNA, 22 bp, Artificial Sequence
  chemically synthesized
aatcctaatgattctaatgttg

SEQ ID NO: 1251015 - DNA, 22 bp, Artificial Sequence
  chemically synthesized
agatggcctaacaacattagaa

SEQ ID NO: 1251016 - DNA, 22 bp, Artificial Sequence
  chemically synthesized
taggattaaatcctaatgattc

SEQ ID NO: 1251017 - DNA, 22 bp, Artificial Sequence
  chemically synthesized
acaacattagaatcattaggat

SEQ ID NO: 1251018 - DNA, 22 bp, Artificial Sequence
  chemically synthesized
tcataagttataggattaaatc

SEQ ID NO: 1251019 - DNA, 22 bp, Artificial Sequence
  chemically synthesized
gaatcattaggatttaatccta

SEQ ID NO: 1251020 - DNA, 22 bp, Artificial Sequence
  chemically synthesized
ttgtcataagttataggattaa

SEQ ID NO: 1251021 - DNA, 22 bp, Artificial Sequence
  chemically synthesized
gactgttgtcataagttatagg

SEQ ID NO: 1251022 - DNA, 22 bp, Artificial Sequence
  chemically synthesized
ggactgttgtcataagttatag

SEQ ID NO: 1251023 - DNA, 22 bp, Artificial Sequence
  chemically synthesized
ggatttaatcctataacttatg

SEQ ID NO: 1251024 - DNA, 22 bp, Artificial Sequence
  chemically synthesized
catcttggactgttgtcataag

SEQ ID NO: 1251025 - DNA, 22 bp, Artificial Sequence
  chemically synthesized
gcatcttggactgttgtcataa

SEQ ID NO: 1251026 - DNA, 22 bp, Artificial Sequence
  chemically synthesized
aatcctataacttatgacaaca

SEQ ID NO: 1251027 - DNA, 22 bp, Artificial Sequence
  chemically synthesized
tgcatcttggactgttgtcata

SEQ ID NO: 1251028 - DNA, 22 bp, Artificial Sequence
  chemically synthesized
atcctataacttatgacaacag

SEQ ID NO: 1251029 - DNA, 22 bp, Artificial Sequence
  chemically synthesized
taacttatgacaacagtccaag

SEQ ID NO: 1251030 - DNA, 22 bp, Artificial Sequence
  chemically synthesized
aaaatcactttgcatcttggac

SEQ ID NO: 1251031 - DNA, 22 bp, Artificial Sequence
  chemically synthesized
aaaaatcactttgcatcttgga

SEQ ID NO: 1251032 - DNA, 22 bp, Artificial Sequence
  chemically synthesized
taaaaatcactttgcatcttgg

SEQ ID NO: 1251033 - DNA, 22 bp, Artificial Sequence
  chemically synthesized
atgacaacagtccaagatgcaa

SEQ ID NO: 1251034 - DNA, 22 bp, Artificial Sequence
  chemically synthesized
ttaaaaatcactttgcatcttg

SEQ ID NO: 1251035 - DNA, 22 bp, Artificial Sequence
  chemically synthesized
tgacaacagtccaagatgcaaa

SEQ ID NO: 1251036 - DNA, 22 bp, Artificial Sequence
  chemically synthesized
gatcacttttaaaaatcacttt

SEQ ID NO: 1251037 - DNA, 22 bp, Artificial Sequence
  chemically synthesized
agatcacttttaaaaatcactt

SEQ ID NO: 1251038 - DNA, 22 bp, Artificial Sequence
  chemically synthesized
atttagatcacttttaaaaatc

SEQ ID NO: 1251039 - DNA, 22 bp, Artificial Sequence
  chemically synthesized
aatttagatcacttttaaaaat

SEQ ID NO: 1251040 - DNA, 22 bp, Artificial Sequence
  chemically synthesized
gaaaatttaatttagatcactt

SEQ ID NO: 1251041 - DNA, 22 bp, Artificial Sequence
  chemically synthesized
ttaaaagtgatctaaattaaat

SEQ ID NO: 1251042 - DNA, 22 bp, Artificial Sequence
  chemically synthesized
taaaagtgatctaaattaaatt

SEQ ID NO: 1251043 - DNA, 22 bp, Artificial Sequence
  chemically synthesized
aaaagtgatctaaattaaattt

SEQ ID NO: 1251044 - DNA, 22 bp, Artificial Sequence
  chemically synthesized
aaagtgatctaaattaaatttt

SEQ ID NO: 1251045 - DNA, 22 bp, Artificial Sequence
  chemically synthesized
aattaaattttctagttttcct

SEQ ID NO: 1251046 - DNA, 22 bp, Artificial Sequence
  chemically synthesized
aagggaaagaaaaggaaaacta

SEQ ID NO: 1251047 - DNA, 22 bp, Artificial Sequence
  chemically synthesized
ttaaagggaaagaaaaggaaaa

SEQ ID NO: 1251048 - DNA, 22 bp, Artificial Sequence
  chemically synthesized
aattttctagttttccttttct

SEQ ID NO: 1251049 - DNA, 22 bp, Artificial Sequence
  chemically synthesized
tctagttttccttttctttccc

SEQ ID NO: 1251050 - DNA, 22 bp, Artificial Sequence
  chemically synthesized
ctagttttccttttctttccct

SEQ ID NO: 1251051 - DNA, 22 bp, Artificial Sequence
  chemically synthesized
tagttttccttttctttccctt

SEQ ID NO: 1251052 - DNA, 22 bp, Artificial Sequence
  chemically synthesized
atgaaacctattaaagggaaag

SEQ ID NO: 1251053 - DNA, 22 bp, Artificial Sequence
  chemically synthesized
gttttccttttctttcccttta

SEQ ID NO: 1251054 - DNA, 22 bp, Artificial Sequence
  chemically synthesized
catgaaacctattaaagggaaa

SEQ ID NO: 1251055 - DNA, 22 bp, Artificial Sequence
  chemically synthesized
tcatgaaacctattaaagggaa

SEQ ID NO: 1251056 - DNA, 22 bp, Artificial Sequence
  chemically synthesized
tccttttctttccctttaatag

SEQ ID NO: 1251057 - DNA, 22 bp, Artificial Sequence
  chemically synthesized
ccttttctttccctttaatagg

SEQ ID NO: 1251058 - DNA, 22 bp, Artificial Sequence
  chemically synthesized
attttcatgaaacctattaaag

SEQ ID NO: 1251059 - DNA, 22 bp, Artificial Sequence
  chemically synthesized
cttttctttccctttaataggt

SEQ ID NO: 1251060 - DNA, 22 bp, Artificial Sequence
  chemically synthesized
gattttcatgaaacctattaaa

SEQ ID NO: 1251061 - DNA, 22 bp, Artificial Sequence
  chemically synthesized
ttgattttcatgaaacctatta

SEQ ID NO: 1251062 - DNA, 22 bp, Artificial Sequence
  chemically synthesized
ttctttccctttaataggtttc

SEQ ID NO: 1251063 - DNA, 22 bp, Artificial Sequence
  chemically synthesized
tctttccctttaataggtttca

SEQ ID NO: 1251064 - DNA, 22 bp, Artificial Sequence
  chemically synthesized
ctttccctttaataggtttcat

SEQ ID NO: 1251065 - DNA, 22 bp, Artificial Sequence
  chemically synthesized
tttccctttaataggtttcatg

SEQ ID NO: 1251066 - DNA, 22 bp, Artificial Sequence
  chemically synthesized
tccctttaataggtttcatgaa

SEQ ID NO: 1251067 - DNA, 22 bp, Artificial Sequence
  chemically synthesized
taattcttgattttcatgaaac

SEQ ID NO: 1251068 - DNA, 22 bp, Artificial Sequence
  chemically synthesized
ccctttaataggtttcatgaaa

SEQ ID NO: 1251069 - DNA, 22 bp, Artificial Sequence
  chemically synthesized
ataattcttgattttcatgaaa

SEQ ID NO: 1251070 - DNA, 22 bp, Artificial Sequence
  chemically synthesized
cctttaataggtttcatgaaaa

SEQ ID NO: 1251071 - DNA, 22 bp, Artificial Sequence
  chemically synthesized
taataggtttcatgaaaatcaa

SEQ ID NO: 1251072 - DNA, 22 bp, Artificial Sequence
  chemically synthesized
aataggtttcatgaaaatcaag

SEQ ID NO: 1251073 - DNA, 22 bp, Artificial Sequence
  chemically synthesized
ataggtttcatgaaaatcaaga

SEQ ID NO: 1251074 - DNA, 22 bp, Artificial Sequence
  chemically synthesized
cccgccttataattcttgattt

SEQ ID NO: 1251075 - DNA, 22 bp, Artificial Sequence
  chemically synthesized
cctccccgccttataattcttg

SEQ ID NO: 1251076 - DNA, 22 bp, Artificial Sequence
  chemically synthesized
acctccccgccttataattctt

SEQ ID NO: 1251077 - DNA, 22 bp, Artificial Sequence
  chemically synthesized
catgaaaatcaagaattataag

SEQ ID NO: 1251078 - DNA, 22 bp, Artificial Sequence
  chemically synthesized
atgaaaatcaagaattataagg

SEQ ID NO: 1251079 - DNA, 22 bp, Artificial Sequence
  chemically synthesized
cagccttacctccccgccttat

SEQ ID NO: 1251080 - DNA, 22 bp, Artificial Sequence
  chemically synthesized
tccagccttacctccccgcctt

SEQ ID NO: 1251081 - DNA, 22 bp, Artificial Sequence
  chemically synthesized
ctccagccttacctccccgcct

SEQ ID NO: 1251082 - DNA, 22 bp, Artificial Sequence
  chemically synthesized
tcttctccagccttacctcccc

SEQ ID NO: 1251083 - DNA, 22 bp, Artificial Sequence
  chemically synthesized
gattgtcttctccagccttacc

SEQ ID NO: 1251084 - DNA, 22 bp, Artificial Sequence
  chemically synthesized
taaggcggggaggtaaggctgg

SEQ ID NO: 1251085 - DNA, 22 bp, Artificial Sequence
  chemically synthesized
ttagattgtcttctccagcctt

SEQ ID NO: 1251086 - DNA, 22 bp, Artificial Sequence
  chemically synthesized
attagattgtcttctccagcct

SEQ ID NO: 1251087 - DNA, 22 bp, Artificial Sequence
  chemically synthesized
tattagattgtcttctccagcc

SEQ ID NO: 1251088 - DNA, 22 bp, Artificial Sequence
  chemically synthesized
catcgctttattagattgtctt

SEQ ID NO: 1251089 - DNA, 22 bp, Artificial Sequence
  chemically synthesized
tcctacatcgctttattagatt

SEQ ID NO: 1251090 - DNA, 22 bp, Artificial Sequence
  chemically synthesized
gtcctacatcgctttattagat

SEQ ID NO: 1251091 - DNA, 22 bp, Artificial Sequence
  chemically synthesized
gagaagacaatctaataaagcg

SEQ ID NO: 1251092 - DNA, 22 bp, Artificial Sequence
  chemically synthesized
atttgtcctacatcgctttatt

SEQ ID NO: 1251093 - DNA, 22 bp, Artificial Sequence
  chemically synthesized
tcatttgtcctacatcgcttta

SEQ ID NO: 1251094 - DNA, 22 bp, Artificial Sequence
  chemically synthesized
ctcatttgtcctacatcgcttt

SEQ ID NO: 1251095 - DNA, 22 bp, Artificial Sequence
  chemically synthesized
tctcatttgtcctacatcgctt

SEQ ID NO: 1251096 - DNA, 22 bp, Artificial Sequence
  chemically synthesized
ttctcatttgtcctacatcgct

SEQ ID NO: 1251097 - DNA, 22 bp, Artificial Sequence
  chemically synthesized
atttttctcatttgtcctacat

SEQ ID NO: 1251098 - DNA, 22 bp, Artificial Sequence
  chemically synthesized
ataaagcgatgtaggacaaatg

SEQ ID NO: 1251099 - DNA, 22 bp, Artificial Sequence
  chemically synthesized
gagtagaataaggaagcctgat

SEQ ID NO: 1251100 - DNA, 22 bp, Artificial Sequence
  chemically synthesized
gaaagtgttggagtagaataag

SEQ ID NO: 1251101 - DNA, 22 bp, Artificial Sequence
  chemically synthesized
ccttattctactccaacacttt

SEQ ID NO: 1251102 - DNA, 22 bp, Artificial Sequence
  chemically synthesized
cttattctactccaacactttc

SEQ ID NO: 1251103 - DNA, 22 bp, Artificial Sequence
  chemically synthesized
attctactccaacactttccaa

SEQ ID NO: 1251104 - DNA, 22 bp, Artificial Sequence
  chemically synthesized
ttctactccaacactttccaac

SEQ ID NO: 1251105 - DNA, 22 bp, Artificial Sequence
  chemically synthesized
tactccaacactttccaactgt

SEQ ID NO: 1251106 - DNA, 22 bp, Artificial Sequence
  chemically synthesized
ctccaacactttccaactgtca

SEQ ID NO: 1251107 - DNA, 22 bp, Artificial Sequence
  chemically synthesized
caacactttccaactgtcatga

SEQ ID NO: 1251108 - DNA, 22 bp, Artificial Sequence
  chemically synthesized
tccaactgtcatgaccttcatg

SEQ ID NO: 1251109 - DNA, 22 bp, Artificial Sequence
  chemically synthesized
ccaactgtcatgaccttcatgg

SEQ ID NO: 1251110 - DNA, 22 bp, Artificial Sequence
  chemically synthesized
caactgtcatgaccttcatggt

SEQ ID NO: 1251111 - DNA, 22 bp, Artificial Sequence
  chemically synthesized
aggtacagacagaccatgaagg

SEQ ID NO: 1251112 - DNA, 22 bp, Artificial Sequence
  chemically synthesized
tcatgaccttcatggtctgtct

SEQ ID NO: 1251113 - DNA, 22 bp, Artificial Sequence
  chemically synthesized
atcagagaattgaggtacagac

SEQ ID NO: 1251114 - DNA, 22 bp, Artificial Sequence
  chemically synthesized
ctgatcagagaattgaggtaca

SEQ ID NO: 1251115 - DNA, 22 bp, Artificial Sequence
  chemically synthesized
catggtctgtctgtacctcaat

SEQ ID NO: 1251116 - DNA, 22 bp, Artificial Sequence
  chemically synthesized
actgatcagagaattgaggtac

SEQ ID NO: 1251117 - DNA, 22 bp, Artificial Sequence
  chemically synthesized
atggtctgtctgtacctcaatt

SEQ ID NO: 1251118 - DNA, 22 bp, Artificial Sequence
  chemically synthesized
tactgatcagagaattgaggta

SEQ ID NO: 1251119 - DNA, 22 bp, Artificial Sequence
  chemically synthesized
tctgtacctcaattctctgatc

SEQ ID NO: 1251120 - DNA, 22 bp, Artificial Sequence
  chemically synthesized
atccaaattttactgatcagag

SEQ ID NO: 1251121 - DNA, 22 bp, Artificial Sequence
  chemically synthesized
catccaaattttactgatcaga

SEQ ID NO: 1251122 - DNA, 22 bp, Artificial Sequence
  chemically synthesized
tacctcaattctctgatcagta

SEQ ID NO: 1251123 - DNA, 22 bp, Artificial Sequence
  chemically synthesized
aattctctgatcagtaaaattt

SEQ ID NO: 1251124 - DNA, 22 bp, Artificial Sequence
  chemically synthesized
tctgatcagtaaaatttggatg

SEQ ID NO: 1251125 - DNA, 22 bp, Artificial Sequence
  chemically synthesized
tgatcagtaaaatttggatgaa

SEQ ID NO: 1251126 - DNA, 22 bp, Artificial Sequence
  chemically synthesized
atcagtaaaatttggatgaaat

SEQ ID NO: 1251127 - DNA, 22 bp, Artificial Sequence
  chemically synthesized
aacagagtccagcatatttcat

SEQ ID NO: 1251128 - DNA, 22 bp, Artificial Sequence
  chemically synthesized
tctcaacagagtccagcatatt

SEQ ID NO: 1251129 - DNA, 22 bp, Artificial Sequence
  chemically synthesized
gtctcaacagagtccagcatat

SEQ ID NO: 1251130 - DNA, 22 bp, Artificial Sequence
  chemically synthesized
tgtctcaacagagtccagcata

SEQ ID NO: 1251131 - DNA, 22 bp, Artificial Sequence
  chemically synthesized
ggatgaaatatgctggactctg

SEQ ID NO: 1251132 - DNA, 22 bp, Artificial Sequence
  chemically synthesized
attttgtctcaacagagtccag

SEQ ID NO: 1251133 - DNA, 22 bp, Artificial Sequence
  chemically synthesized
gatgaaatatgctggactctgt

SEQ ID NO: 1251134 - DNA, 22 bp, Artificial Sequence
  chemically synthesized
cattttgtctcaacagagtcca

SEQ ID NO: 1251135 - DNA, 22 bp, Artificial Sequence
  chemically synthesized
tcattttgtctcaacagagtcc

SEQ ID NO: 1251136 - DNA, 22 bp, Artificial Sequence
  chemically synthesized
tgttttcattttgtctcaacag

SEQ ID NO: 1251137 - DNA, 22 bp, Artificial Sequence
  chemically synthesized
atgttttcattttgtctcaaca

SEQ ID NO: 1251138 - DNA, 22 bp, Artificial Sequence
  chemically synthesized
cttatgttttcattttgtctca

SEQ ID NO: 1251139 - DNA, 22 bp, Artificial Sequence
  chemically synthesized
tccttatgttttcattttgtct

SEQ ID NO: 1251140 - DNA, 22 bp, Artificial Sequence
  chemically synthesized
gactctgttgagacaaaatgaa

SEQ ID NO: 1251141 - DNA, 22 bp, Artificial Sequence
  chemically synthesized
tgttgagacaaaatgaaaacat

SEQ ID NO: 1251142 - DNA, 22 bp, Artificial Sequence
  chemically synthesized
ttgagacaaaatgaaaacataa

SEQ ID NO: 1251143 - DNA, 22 bp, Artificial Sequence
  chemically synthesized
agacaaaatgaaaacataagga

SEQ ID NO: 1251144 - DNA, 22 bp, Artificial Sequence
  chemically synthesized
cagatgatagactctccttatg

SEQ ID NO: 1251145 - DNA, 22 bp, Artificial Sequence
  chemically synthesized
acagatgatagactctccttat

SEQ ID NO: 1251146 - DNA, 22 bp, Artificial Sequence
  chemically synthesized
atgggtacataatgtagtgatt

SEQ ID NO: 1251147 - DNA, 22 bp, Artificial Sequence
  chemically synthesized
tcatctgtaaatcactacatta

SEQ ID NO: 1251148 - DNA, 22 bp, Artificial Sequence
  chemically synthesized
taaatcactacattatgtaccc

SEQ ID NO: 1251149 - DNA, 22 bp, Artificial Sequence
  chemically synthesized
acaataaaatactaatgggtac

SEQ ID NO: 1251150 - DNA, 22 bp, Artificial Sequence
  chemically synthesized
ctaacaataaaatactaatggg

SEQ ID NO: 1251151 - DNA, 22 bp, Artificial Sequence
  chemically synthesized
gctaacaataaaatactaatgg

SEQ ID NO: 1251152 - DNA, 22 bp, Artificial Sequence
  chemically synthesized
tgctaacaataaaatactaatg

SEQ ID NO: 1251153 - DNA, 22 bp, Artificial Sequence
  chemically synthesized
cattatgtacccattagtattt

SEQ ID NO: 1251154 - DNA, 22 bp, Artificial Sequence
  chemically synthesized
atctttgctaacaataaaatac

SEQ ID NO: 1251155 - DNA, 22 bp, Artificial Sequence
  chemically synthesized
tgtacccattagtattttattg

SEQ ID NO: 1251156 - DNA, 22 bp, Artificial Sequence
  chemically synthesized
ttaatctttgctaacaataaaa

SEQ ID NO: 1251157 - DNA, 22 bp, Artificial Sequence
  chemically synthesized
tattaatctttgctaacaataa

SEQ ID NO: 1251158 - DNA, 22 bp, Artificial Sequence
  chemically synthesized
ctattaatctttgctaacaata

SEQ ID NO: 1251159 - DNA, 22 bp, Artificial Sequence
  chemically synthesized
tctattaatctttgctaacaat

SEQ ID NO: 1251160 - DNA, 22 bp, Artificial Sequence
  chemically synthesized
gtattttattgttagcaaagat

SEQ ID NO: 1251161 - DNA, 22 bp, Artificial Sequence
  chemically synthesized
tcagttttctattaatctttgc

SEQ ID NO: 1251162 - DNA, 22 bp, Artificial Sequence
  chemically synthesized
tattgttagcaaagattaatag

SEQ ID NO: 1251163 - DNA, 22 bp, Artificial Sequence
  chemically synthesized
attgttagcaaagattaataga

SEQ ID NO: 1251164 - DNA, 22 bp, Artificial Sequence
  chemically synthesized
ttgttagcaaagattaatagaa

SEQ ID NO: 1251165 - DNA, 22 bp, Artificial Sequence
  chemically synthesized
gagttgtcagttttctattaat

SEQ ID NO: 1251166 - DNA, 22 bp, Artificial Sequence
  chemically synthesized
ggagttgtcagttttctattaa

SEQ ID NO: 1251167 - DNA, 22 bp, Artificial Sequence
  chemically synthesized
ttagcaaagattaatagaaaac

SEQ ID NO: 1251168 - DNA, 22 bp, Artificial Sequence
  chemically synthesized
gcaaagattaatagaaaactga

SEQ ID NO: 1251169 - DNA, 22 bp, Artificial Sequence
  chemically synthesized
atagaaaactgacaactccaag

SEQ ID NO: 1251170 - DNA, 22 bp, Artificial Sequence
  chemically synthesized
atgccatccagccttggagttg

SEQ ID NO: 1251171 - DNA, 22 bp, Artificial Sequence
  chemically synthesized
catgccatccagccttggagtt

SEQ ID NO: 1251172 - DNA, 22 bp, Artificial Sequence
  chemically synthesized
acaactccaaggctggatggca

SEQ ID NO: 1251173 - DNA, 22 bp, Artificial Sequence
  chemically synthesized
ggtgtagggcttcatgccatcc

SEQ ID NO: 1251174 - DNA, 22 bp, Artificial Sequence
  chemically synthesized
ctaggtgtagggcttcatgcca

SEQ ID NO: 1251175 - DNA, 22 bp, Artificial Sequence
  chemically synthesized
caaggctggatggcatgaagcc

SEQ ID NO: 1251176 - DNA, 22 bp, Artificial Sequence
  chemically synthesized
gatggcatgaagccctacacct

SEQ ID NO: 1251177 - DNA, 22 bp, Artificial Sequence
  chemically synthesized
tggcagcaactactaggtgtag

SEQ ID NO: 1251178 - DNA, 22 bp, Artificial Sequence
  chemically synthesized
aaatcagactatggcagcaact

SEQ ID NO: 1251179 - DNA, 22 bp, Artificial Sequence
  chemically synthesized
cacctagtagttgctgccatag

SEQ ID NO: 1251180 - DNA, 22 bp, Artificial Sequence
  chemically synthesized
aggaacctcaaatcagactatg

SEQ ID NO: 1251181 - DNA, 22 bp, Artificial Sequence
  chemically synthesized
gtagttgctgccatagtctgat

SEQ ID NO: 1251182 - DNA, 22 bp, Artificial Sequence
  chemically synthesized
gaggaacctcaaatcagactat

SEQ ID NO: 1251183 - DNA, 22 bp, Artificial Sequence
  chemically synthesized
ctgccatagtctgatttgaggt

SEQ ID NO: 1251184 - DNA, 22 bp, Artificial Sequence
  chemically synthesized
ccatagtctgatttgaggttcc

SEQ ID NO: 1251185 - DNA, 22 bp, Artificial Sequence
  chemically synthesized
gggaagaatgatttgaggaacc

SEQ ID NO: 1251186 - DNA, 22 bp, Artificial Sequence
  chemically synthesized
ggctggggaagaatgatttgag

SEQ ID NO: 1251187 - DNA, 22 bp, Artificial Sequence
  chemically synthesized
atttgaggttcctcaaatcatt

SEQ ID NO: 1251188 - DNA, 22 bp, Artificial Sequence
  chemically synthesized
gaggttcctcaaatcattcttc

SEQ ID NO: 1251189 - DNA, 22 bp, Artificial Sequence
  chemically synthesized
aggttcctcaaatcattcttcc

SEQ ID NO: 1251190 - DNA, 22 bp, Artificial Sequence
  chemically synthesized
ctcaaatcattcttccccagcc

SEQ ID NO: 1251191 - DNA, 22 bp, Artificial Sequence
  chemically synthesized
aaatcattcttccccagcctaa

SEQ ID NO: 1251192 - DNA, 22 bp, Artificial Sequence
  chemically synthesized
aagagaaaaaatgattaggctg

SEQ ID NO: 1251193 - DNA, 22 bp, Artificial Sequence
  chemically synthesized
ttccccagcctaatcatttttt

SEQ ID NO: 1251194 - DNA, 22 bp, Artificial Sequence
  chemically synthesized
caggtctgaagagaaaaaatga

SEQ ID NO: 1251195 - DNA, 22 bp, Artificial Sequence
  chemically synthesized
ccccagcctaatcattttttct

SEQ ID NO: 1251196 - DNA, 22 bp, Artificial Sequence
  chemically synthesized
cccagcctaatcattttttctc

SEQ ID NO: 1251197 - DNA, 22 bp, Artificial Sequence
  chemically synthesized
atcattttttctcttcagacct

SEQ ID NO: 1251198 - DNA, 22 bp, Artificial Sequence
  chemically synthesized
tttctcttcagacctggaatcc

SEQ ID NO: 1251199 - DNA, 22 bp, Artificial Sequence
  chemically synthesized
ttctcttcagacctggaatcct

SEQ ID NO: 1251200 - DNA, 22 bp, Artificial Sequence
  chemically synthesized
tctcttcagacctggaatcctg

SEQ ID NO: 1251201 - DNA, 22 bp, Artificial Sequence
  chemically synthesized
ctcttcagacctggaatcctgc

SEQ ID NO: 1251202 - DNA, 22 bp, Artificial Sequence
  chemically synthesized
tcttcagacctggaatcctgcc

SEQ ID NO: 1251203 - DNA, 22 bp, Artificial Sequence
  chemically synthesized
ttcagacctggaatcctgccat

SEQ ID NO: 1251204 - DNA, 22 bp, Artificial Sequence
  chemically synthesized
tgacgcgagaggatggcaggat

SEQ ID NO: 1251205 - DNA, 22 bp, Artificial Sequence
  chemically synthesized
cagacctggaatcctgccatcc

SEQ ID NO: 1251206 - DNA, 22 bp, Artificial Sequence
  chemically synthesized
agacctggaatcctgccatcct

SEQ ID NO: 1251207 - DNA, 22 bp, Artificial Sequence
  chemically synthesized
gaatcctgccatcctctcgcgt

SEQ ID NO: 1251208 - DNA, 22 bp, Artificial Sequence
  chemically synthesized
ccatcctctcgcgtcatagttt

SEQ ID NO: 1251209 - DNA, 22 bp, Artificial Sequence
  chemically synthesized
tcgcgtcatagtttgggggtta

SEQ ID NO: 1251210 - DNA, 22 bp, Artificial Sequence
  chemically synthesized
gcgtcatagtttgggggttact

SEQ ID NO: 1251211 - DNA, 22 bp, Artificial Sequence
  chemically synthesized
gcatatgcaggcagtaaccccc

SEQ ID NO: 1251212 - DNA, 22 bp, Artificial Sequence
  chemically synthesized
attggcatatgcaggcagtaac

SEQ ID NO: 1251213 - DNA, 22 bp, Artificial Sequence
  chemically synthesized
ttcattggcatatgcaggcagt

SEQ ID NO: 1251214 - DNA, 22 bp, Artificial Sequence
  chemically synthesized
gggggttactgcctgcatatgc

SEQ ID NO: 1251215 - DNA, 22 bp, Artificial Sequence
  chemically synthesized
tactgttcattggcatatgcag

SEQ ID NO: 1251216 - DNA, 22 bp, Artificial Sequence
  chemically synthesized
ggggttactgcctgcatatgcc

SEQ ID NO: 1251217 - DNA, 22 bp, Artificial Sequence
  chemically synthesized
ctgcctgcatatgccaatgaac

SEQ ID NO: 1251218 - DNA, 22 bp, Artificial Sequence
  chemically synthesized
cctgcatatgccaatgaacagt

SEQ ID NO: 1251219 - DNA, 22 bp, Artificial Sequence
  chemically synthesized
tgtcacgtggctatactgttca

SEQ ID NO: 1251220 - DNA, 22 bp, Artificial Sequence
  chemically synthesized
catatgccaatgaacagtatag

SEQ ID NO: 1251221 - DNA, 22 bp, Artificial Sequence
  chemically synthesized
tgtgtcacgtggctatactgtt

SEQ ID NO: 1251222 - DNA, 22 bp, Artificial Sequence
  chemically synthesized
ctgtgtcacgtggctatactgt

SEQ ID NO: 1251223 - DNA, 22 bp, Artificial Sequence
  chemically synthesized
atttctgtgtcacgtggctata

SEQ ID NO: 1251224 - DNA, 22 bp, Artificial Sequence
  chemically synthesized
catttctgtgtcacgtggctat

SEQ ID NO: 1251225 - DNA, 22 bp, Artificial Sequence
  chemically synthesized
tggccttcatttctgtgtcacg

SEQ ID NO: 1251226 - DNA, 22 bp, Artificial Sequence
  chemically synthesized
tgtggccttcatttctgtgtca

SEQ ID NO: 1251227 - DNA, 22 bp, Artificial Sequence
  chemically synthesized
tggttctgtggccttcatttct

SEQ ID NO: 1251228 - DNA, 22 bp, Artificial Sequence
  chemically synthesized
atgaattatggttctgtggcct

SEQ ID NO: 1251229 - DNA, 22 bp, Artificial Sequence
  chemically synthesized
aataactgatgaattatggttc

SEQ ID NO: 1251230 - DNA, 22 bp, Artificial Sequence
  chemically synthesized
acacattgaataactgatgaat

SEQ ID NO: 1251231 - DNA, 22 bp, Artificial Sequence
  chemically synthesized
tcagctaacacattgaataact

SEQ ID NO: 1251232 - DNA, 22 bp, Artificial Sequence
  chemically synthesized
caagttgtcagctaacacattg

SEQ ID NO: 1251233 - DNA, 22 bp, Artificial Sequence
  chemically synthesized
ccaagttgtcagctaacacatt

SEQ ID NO: 1251234 - DNA, 22 bp, Artificial Sequence
  chemically synthesized
atcagttattcaatgtgttagc

SEQ ID NO: 1251235 - DNA, 22 bp, Artificial Sequence
  chemically synthesized
tgatttccaagttgtcagctaa

SEQ ID NO: 1251236 - DNA, 22 bp, Artificial Sequence
  chemically synthesized
tatgatttccaagttgtcagct

SEQ ID NO: 1251237 - DNA, 22 bp, Artificial Sequence
  chemically synthesized
ttcaatgtgttagctgacaact

SEQ ID NO: 1251238 - DNA, 22 bp, Artificial Sequence
  chemically synthesized
aatgtgttagctgacaacttgg

SEQ ID NO: 1251239 - DNA, 22 bp, Artificial Sequence
  chemically synthesized
agtgctctatgatttccaagtt

SEQ ID NO: 1251240 - DNA, 22 bp, Artificial Sequence
  chemically synthesized
gctgacaacttggaaatcatag

SEQ ID NO: 1251241 - DNA, 22 bp, Artificial Sequence
  chemically synthesized
gagttgagtgctctatgatttc

SEQ ID NO: 1251242 - DNA, 22 bp, Artificial Sequence
  chemically synthesized
ggagttgagtgctctatgattt

SEQ ID NO: 1251243 - DNA, 22 bp, Artificial Sequence
  chemically synthesized
acaacttggaaatcatagagca

SEQ ID NO: 1251244 - DNA, 22 bp, Artificial Sequence
  chemically synthesized
ggaaatcatagagcactcaact

SEQ ID NO: 1251245 - DNA, 22 bp, Artificial Sequence
  chemically synthesized
gaaatcatagagcactcaactc

SEQ ID NO: 1251246 - DNA, 22 bp, Artificial Sequence
  chemically synthesized
aggaagtaacttggagttgagt

SEQ ID NO: 1251247 - DNA, 22 bp, Artificial Sequence
  chemically synthesized
caggaagtaacttggagttgag

SEQ ID NO: 1251248 - DNA, 22 bp, Artificial Sequence
  chemically synthesized
tcaggaagtaacttggagttga

SEQ ID NO: 1251249 - DNA, 22 bp, Artificial Sequence
  chemically synthesized
ttcaggaagtaacttggagttg

SEQ ID NO: 1251250 - DNA, 22 bp, Artificial Sequence
  chemically synthesized
cttttcaggaagtaacttggag

SEQ ID NO: 1251251 - DNA, 22 bp, Artificial Sequence
  chemically synthesized
tgcttttcaggaagtaacttgg

SEQ ID NO: 1251252 - DNA, 22 bp, Artificial Sequence
  chemically synthesized
tctgcttttcaggaagtaactt

SEQ ID NO: 1251253 - DNA, 22 bp, Artificial Sequence
  chemically synthesized
ctctgcttttcaggaagtaact

SEQ ID NO: 1251254 - DNA, 22 bp, Artificial Sequence
  chemically synthesized
aactccaagttacttcctgaaa

SEQ ID NO: 1251255 - DNA, 22 bp, Artificial Sequence
  chemically synthesized
caagttacttcctgaaaagcag

SEQ ID NO: 1251256 - DNA, 22 bp, Artificial Sequence
  chemically synthesized
aggaagcatttctctgcttttc

SEQ ID NO: 1251257 - DNA, 22 bp, Artificial Sequence
  chemically synthesized
actgaggaagcatttctctgct

SEQ ID NO: 1251258 - DNA, 22 bp, Artificial Sequence
  chemically synthesized
cttcctgaaaagcagagaaatg

SEQ ID NO: 1251259 - DNA, 22 bp, Artificial Sequence
  chemically synthesized
cctgaaaagcagagaaatgctt

SEQ ID NO: 1251260 - DNA, 22 bp, Artificial Sequence
  chemically synthesized
ctgaaaagcagagaaatgcttc

SEQ ID NO: 1251261 - DNA, 22 bp, Artificial Sequence
  chemically synthesized
tggcctcactgaggaagcattt

SEQ ID NO: 1251262 - DNA, 22 bp, Artificial Sequence
  chemically synthesized
aaaagcagagaaatgcttcctc

SEQ ID NO: 1251263 - DNA, 22 bp, Artificial Sequence
  chemically synthesized
tgtggcctcactgaggaagcat

SEQ ID NO: 1251264 - DNA, 22 bp, Artificial Sequence
  chemically synthesized
tgagttctgtggcctcactgag

SEQ ID NO: 1251265 - DNA, 22 bp, Artificial Sequence
  chemically synthesized
cctcagtgaggccacagaactc

SEQ ID NO: 1251266 - DNA, 22 bp, Artificial Sequence
  chemically synthesized
ctcagtgaggccacagaactca

SEQ ID NO: 1251267 - DNA, 22 bp, Artificial Sequence
  chemically synthesized
agtgaggccacagaactcacag

SEQ ID NO: 1251268 - DNA, 22 bp, Artificial Sequence
  chemically synthesized
taggtaaaatgtaaagctgtga

SEQ ID NO: 1251269 - DNA, 22 bp, Artificial Sequence
  chemically synthesized
acagctttacattttacctaca

SEQ ID NO: 1251270 - DNA, 22 bp, Artificial Sequence
  chemically synthesized
tacattttacctacaatttgca

SEQ ID NO: 1251271 - DNA, 22 bp, Artificial Sequence
  chemically synthesized
acattttacctacaatttgcac

SEQ ID NO: 1251272 - DNA, 22 bp, Artificial Sequence
  chemically synthesized
cattttacctacaatttgcaca

SEQ ID NO: 1251273 - DNA, 22 bp, Artificial Sequence
  chemically synthesized
tacctacaatttgcacatgatc

SEQ ID NO: 1251274 - DNA, 22 bp, Artificial Sequence
  chemically synthesized
acctacaatttgcacatgatcc

SEQ ID NO: 1251275 - DNA, 22 bp, Artificial Sequence
  chemically synthesized
cctacaatttgcacatgatcca

SEQ ID NO: 1251276 - DNA, 22 bp, Artificial Sequence
  chemically synthesized
caatttgcacatgatccacatg

SEQ ID NO: 1251277 - DNA, 22 bp, Artificial Sequence
  chemically synthesized
gcacatgatccacatgatctgg

SEQ ID NO: 1251278 - DNA, 22 bp, Artificial Sequence
  chemically synthesized
cacatgatccacatgatctggc

SEQ ID NO: 1251279 - DNA, 22 bp, Artificial Sequence
  chemically synthesized
agggaaagccgaggccagatca

SEQ ID NO: 1251280 - DNA, 22 bp, Artificial Sequence
  chemically synthesized
taaggggttgagggaaagccga

SEQ ID NO: 1251281 - DNA, 22 bp, Artificial Sequence
  chemically synthesized
gcctcggctttccctcaacccc

SEQ ID NO: 1251282 - DNA, 22 bp, Artificial Sequence
  chemically synthesized
taacagttgtaaggggttgagg

SEQ ID NO: 1251283 - DNA, 22 bp, Artificial Sequence
  chemically synthesized
ggctttccctcaaccccttaca

SEQ ID NO: 1251284 - DNA, 22 bp, Artificial Sequence
  chemically synthesized
tgaaactgtaacagttgtaagg

SEQ ID NO: 1251285 - DNA, 22 bp, Artificial Sequence
  chemically synthesized
tccctcaaccccttacaactgt

SEQ ID NO: 1251286 - DNA, 22 bp, Artificial Sequence
  chemically synthesized
ccctcaaccccttacaactgtt

SEQ ID NO: 1251287 - DNA, 22 bp, Artificial Sequence
  chemically synthesized
cctcaaccccttacaactgtta

SEQ ID NO: 1251288 - DNA, 22 bp, Artificial Sequence
  chemically synthesized
aaccccttacaactgttacagt

SEQ ID NO: 1251289 - DNA, 22 bp, Artificial Sequence
  chemically synthesized
acagaaggctatgaaactgtaa

SEQ ID NO: 1251290 - DNA, 22 bp, Artificial Sequence
  chemically synthesized
acaactgttacagtttcatagc

SEQ ID NO: 1251291 - DNA, 22 bp, Artificial Sequence
  chemically synthesized
caactgttacagtttcatagcc

SEQ ID NO: 1251292 - DNA, 22 bp, Artificial Sequence
  chemically synthesized
gtgactgacagaaggctatgaa

SEQ ID NO: 1251293 - DNA, 22 bp, Artificial Sequence
  chemically synthesized
tctagtgactgacagaaggcta

SEQ ID NO: 1251294 - DNA, 22 bp, Artificial Sequence
  chemically synthesized
ttacagtttcatagccttctgt

SEQ ID NO: 1251295 - DNA, 22 bp, Artificial Sequence
  chemically synthesized
gtctagtgactgacagaaggct

SEQ ID NO: 1251296 - DNA, 22 bp, Artificial Sequence
  chemically synthesized
tgtctagtgactgacagaaggc

SEQ ID NO: 1251297 - DNA, 22 bp, Artificial Sequence
  chemically synthesized
cagtttcatagccttctgtcag

SEQ ID NO: 1251298 - DNA, 22 bp, Artificial Sequence
  chemically synthesized
agttttgtctagtgactgacag

SEQ ID NO: 1251299 - DNA, 22 bp, Artificial Sequence
  chemically synthesized
catagccttctgtcagtcacta

SEQ ID NO: 1251300 - DNA, 22 bp, Artificial Sequence
  chemically synthesized
atagccttctgtcagtcactag

SEQ ID NO: 1251301 - DNA, 22 bp, Artificial Sequence
  chemically synthesized
ctgtcagtcactagacaaaact

SEQ ID NO: 1251302 - DNA, 22 bp, Artificial Sequence
  chemically synthesized
tgtcagtcactagacaaaactc

SEQ ID NO: 1251303 - DNA, 22 bp, Artificial Sequence
  chemically synthesized
gaaggaagtgtctgagttttgt

SEQ ID NO: 1251304 - DNA, 22 bp, Artificial Sequence
  chemically synthesized
tcagtcactagacaaaactcag

SEQ ID NO: 1251305 - DNA, 22 bp, Artificial Sequence
  chemically synthesized
ccagtactggaaggaagtgtct

SEQ ID NO: 1251306 - DNA, 22 bp, Artificial Sequence
  chemically synthesized
gacaaaactcagacacttcctt

SEQ ID NO: 1251307 - DNA, 22 bp, Artificial Sequence
  chemically synthesized
agacacttccttccagtactgg

SEQ ID NO: 1251308 - DNA, 22 bp, Artificial Sequence
  chemically synthesized
ccttccagtactggcaacatta

SEQ ID NO: 1251309 - DNA, 22 bp, Artificial Sequence
  chemically synthesized
cttccagtactggcaacattac

SEQ ID NO: 1251310 - DNA, 22 bp, Artificial Sequence
  chemically synthesized
ccagtactggcaacattactgc

SEQ ID NO: 1251311 - DNA, 22 bp, Artificial Sequence
  chemically synthesized
aaagaagaatgtgcagtaatgt

SEQ ID NO: 1251312 - DNA, 22 bp, Artificial Sequence
  chemically synthesized
cagtactggcaacattactgca

SEQ ID NO: 1251313 - DNA, 22 bp, Artificial Sequence
  chemically synthesized
aaaacctaaaagaagaatgtgc

SEQ ID NO: 1251314 - DNA, 22 bp, Artificial Sequence
  chemically synthesized
gcaacattactgcacattcttc

SEQ ID NO: 1251315 - DNA, 22 bp, Artificial Sequence
  chemically synthesized
ctgcacattcttcttttaggtt

SEQ ID NO: 1251316 - DNA, 22 bp, Artificial Sequence
  chemically synthesized
cacattcttcttttaggttttc

SEQ ID NO: 1251317 - DNA, 22 bp, Artificial Sequence
  chemically synthesized
atgtgtagccagggctgaaaac

SEQ ID NO: 1251318 - DNA, 22 bp, Artificial Sequence
  chemically synthesized
ttcttttaggttttcagccctg

SEQ ID NO: 1251319 - DNA, 22 bp, Artificial Sequence
  chemically synthesized
cttttaggttttcagccctggc

SEQ ID NO: 1251320 - DNA, 22 bp, Artificial Sequence
  chemically synthesized
ttttaggttttcagccctggct

SEQ ID NO: 1251321 - DNA, 22 bp, Artificial Sequence
  chemically synthesized
ttaggttttcagccctggctac

SEQ ID NO: 1251322 - DNA, 22 bp, Artificial Sequence
  chemically synthesized
taggttttcagccctggctaca

SEQ ID NO: 1251323 - DNA, 22 bp, Artificial Sequence
  chemically synthesized
aggttttcagccctggctacac

SEQ ID NO: 1251324 - DNA, 22 bp, Artificial Sequence
  chemically synthesized
ggttttcagccctggctacaca

SEQ ID NO: 1251325 - DNA, 22 bp, Artificial Sequence
  chemically synthesized
gggtgatgctaatgtgtagcca

SEQ ID NO: 1251326 - DNA, 22 bp, Artificial Sequence
  chemically synthesized
ctcgggtgatgctaatgtgtag

SEQ ID NO: 1251327 - DNA, 22 bp, Artificial Sequence
  chemically synthesized
tcagccctggctacacattagc

SEQ ID NO: 1251328 - DNA, 22 bp, Artificial Sequence
  chemically synthesized
cagccctggctacacattagca

SEQ ID NO: 1251329 - DNA, 22 bp, Artificial Sequence
  chemically synthesized
agccctggctacacattagcat

SEQ ID NO: 1251330 - DNA, 22 bp, Artificial Sequence
  chemically synthesized
aaagctcctcgggtgatgctaa

SEQ ID NO: 1251331 - DNA, 22 bp, Artificial Sequence
  chemically synthesized
aaaagctcctcgggtgatgcta

SEQ ID NO: 1251332 - DNA, 22 bp, Artificial Sequence
  chemically synthesized
gctacacattagcatcacccga

SEQ ID NO: 1251333 - DNA, 22 bp, Artificial Sequence
  chemically synthesized
cacattagcatcacccgaggag

SEQ ID NO: 1251334 - DNA, 22 bp, Artificial Sequence
  chemically synthesized
gcatcacccgaggagcttttaa

SEQ ID NO: 1251335 - DNA, 22 bp, Artificial Sequence
  chemically synthesized
ttaaatctgtaccattgtgtgt

SEQ ID NO: 1251336 - DNA, 22 bp, Artificial Sequence
  chemically synthesized
taaatctgtaccattgtgtgtt

SEQ ID NO: 1251337 - DNA, 22 bp, Artificial Sequence
  chemically synthesized
aaatctgtaccattgtgtgttt

SEQ ID NO: 1251338 - DNA, 22 bp, Artificial Sequence
  chemically synthesized
aatctgtaccattgtgtgtttc

SEQ ID NO: 1251339 - DNA, 22 bp, Artificial Sequence
  chemically synthesized
taccattgtgtgtttctgatgc

SEQ ID NO: 1251340 - DNA, 22 bp, Artificial Sequence
  chemically synthesized
tgtgtttctgatgccccccacg

SEQ ID NO: 1251341 - DNA, 22 bp, Artificial Sequence
  chemically synthesized
ctgatgccccccacgccatgtt

SEQ ID NO: 1251342 - DNA, 22 bp, Artificial Sequence
  chemically synthesized
tgatgccccccacgccatgttg

SEQ ID NO: 1251343 - DNA, 22 bp, Artificial Sequence
  chemically synthesized
atgccccccacgccatgttgtt

SEQ ID NO: 1251344 - DNA, 22 bp, Artificial Sequence
  chemically synthesized
ttttgtttgttttcgttttttg

SEQ ID NO: 1251345 - DNA, 22 bp, Artificial Sequence
  chemically synthesized
aaagaaacaaaaaacaaaaaac

SEQ ID NO: 1251346 - DNA, 22 bp, Artificial Sequence
  chemically synthesized
tgtttgttttcgttttttgttt

SEQ ID NO: 1251347 - DNA, 22 bp, Artificial Sequence
  chemically synthesized
gtttgttttcgttttttgtttt

SEQ ID NO: 1251348 - DNA, 22 bp, Artificial Sequence
  chemically synthesized
tttgttttcgttttttgttttt

SEQ ID NO: 1251349 - DNA, 22 bp, Artificial Sequence
  chemically synthesized
tctcaaagaaacaaaaaacaaa

SEQ ID NO: 1251350 - DNA, 22 bp, Artificial Sequence
  chemically synthesized
gttttcgttttttgttttttgt

SEQ ID NO: 1251351 - DNA, 22 bp, Artificial Sequence
  chemically synthesized
tgtctcaaagaaacaaaaaaca

SEQ ID NO: 1251352 - DNA, 22 bp, Artificial Sequence
  chemically synthesized
ttttcgttttttgttttttgtt

SEQ ID NO: 1251353 - DNA, 22 bp, Artificial Sequence
  chemically synthesized
tcgttttttgttttttgtttct

SEQ ID NO: 1251354 - DNA, 22 bp, Artificial Sequence
  chemically synthesized
cgttttttgttttttgtttctt

SEQ ID NO: 1251355 - DNA, 22 bp, Artificial Sequence
  chemically synthesized
gttttttgttttttgtttcttt

SEQ ID NO: 1251356 - DNA, 22 bp, Artificial Sequence
  chemically synthesized
tttgttttttgtttctttgaga

SEQ ID NO: 1251357 - DNA, 22 bp, Artificial Sequence
  chemically synthesized
ttgttttttgtttctttgagac

SEQ ID NO: 1251358 - DNA, 22 bp, Artificial Sequence
  chemically synthesized
tgttttttgtttctttgagaca

SEQ ID NO: 1251359 - DNA, 22 bp, Artificial Sequence
  chemically synthesized
gttttttgtttctttgagacag

SEQ ID NO: 1251360 - DNA, 22 bp, Artificial Sequence
  chemically synthesized
ttttttgtttctttgagacaga

SEQ ID NO: 1251361 - DNA, 22 bp, Artificial Sequence
  chemically synthesized
tttgtttctttgagacagagtt

SEQ ID NO: 1251362 - DNA, 22 bp, Artificial Sequence
  chemically synthesized
ttgtttctttgagacagagttc

SEQ ID NO: 1251363 - DNA, 22 bp, Artificial Sequence
  chemically synthesized
tgtttctttgagacagagttct

SEQ ID NO: 1251364 - DNA, 22 bp, Artificial Sequence
  chemically synthesized
ggcaaaaagagtagaactctgt

SEQ ID NO: 1251365 - DNA, 22 bp, Artificial Sequence
  chemically synthesized
gtttctttgagacagagttcta

SEQ ID NO: 1251366 - DNA, 22 bp, Artificial Sequence
  chemically synthesized
tttctttgagacagagttctac

SEQ ID NO: 1251367 - DNA, 22 bp, Artificial Sequence
  chemically synthesized
ctttgagacagagttctactct

SEQ ID NO: 1251368 - DNA, 22 bp, Artificial Sequence
  chemically synthesized
tttgagacagagttctactctt

SEQ ID NO: 1251369 - DNA, 22 bp, Artificial Sequence
  chemically synthesized
cagcctgggcaaaaagagtaga

SEQ ID NO: 1251370 - DNA, 22 bp, Artificial Sequence
  chemically synthesized
tgagacagagttctactctttt

SEQ ID NO: 1251371 - DNA, 22 bp, Artificial Sequence
  chemically synthesized
gagacagagttctactcttttt

SEQ ID NO: 1251372 - DNA, 22 bp, Artificial Sequence
  chemically synthesized
agacagagttctactctttttg

SEQ ID NO: 1251373 - DNA, 22 bp, Artificial Sequence
  chemically synthesized
cgctccagcctgggcaaaaaga

SEQ ID NO: 1251374 - DNA, 22 bp, Artificial Sequence
  chemically synthesized
tactctttttgcccaggctgga

SEQ ID NO: 1251375 - DNA, 22 bp, Artificial Sequence
  chemically synthesized
ctctttttgcccaggctggagc

SEQ ID NO: 1251376 - DNA, 22 bp, Artificial Sequence
  chemically synthesized
tttttgcccaggctggagcgca

SEQ ID NO: 1251377 - DNA, 22 bp, Artificial Sequence
  chemically synthesized
tttgcccaggctggagcgcaac

SEQ ID NO: 1251378 - DNA, 22 bp, Artificial Sequence
  chemically synthesized
ttgcccaggctggagcgcaacg

SEQ ID NO: 1251379 - DNA, 22 bp, Artificial Sequence
  chemically synthesized
tgcccaggctggagcgcaacgg

SEQ ID NO: 1251380 - DNA, 22 bp, Artificial Sequence
  chemically synthesized
gcccaggctggagcgcaacggt

SEQ ID NO: 1251381 - DNA, 22 bp, Artificial Sequence
  chemically synthesized
cccaggctggagcgcaacggtg

SEQ ID NO: 1251382 - DNA, 22 bp, Artificial Sequence
  chemically synthesized
cagtgagccgagatcgcaccgt

SEQ ID NO: 1251383 - DNA, 22 bp, Artificial Sequence
  chemically synthesized
gagcgcaacggtgcgatctcgg

SEQ ID NO: 1251384 - DNA, 22 bp, Artificial Sequence
  chemically synthesized
aacccaggaggcagaggttgca

SEQ ID NO: 1251385 - DNA, 22 bp, Artificial Sequence
  chemically synthesized
gaacccaggaggcagaggttgc

SEQ ID NO: 1251386 - DNA, 22 bp, Artificial Sequence
  chemically synthesized
ggctcactgcaacctctgcctc

SEQ ID NO: 1251387 - DNA, 22 bp, Artificial Sequence
  chemically synthesized
actgcaacctctgcctcctggg

SEQ ID NO: 1251388 - DNA, 22 bp, Artificial Sequence
  chemically synthesized
caacctctgcctcctgggttca

SEQ ID NO: 1251389 - DNA, 22 bp, Artificial Sequence
  chemically synthesized
tgcctcctgggttcaagcgatt

SEQ ID NO: 1251390 - DNA, 22 bp, Artificial Sequence
  chemically synthesized
cctcctgggttcaagcgattgt

SEQ ID NO: 1251391 - DNA, 22 bp, Artificial Sequence
  chemically synthesized
ggaggccgaggcatgacaatcg

SEQ ID NO: 1251392 - DNA, 22 bp, Artificial Sequence
  chemically synthesized
ctgggttcaagcgattgtcatg

SEQ ID NO: 1251393 - DNA, 22 bp, Artificial Sequence
  chemically synthesized
gggaggccgaggcatgacaatc

SEQ ID NO: 1251394 - DNA, 22 bp, Artificial Sequence
  chemically synthesized
ggttcaagcgattgtcatgcct

SEQ ID NO: 1251395 - DNA, 22 bp, Artificial Sequence
  chemically synthesized
tttgggaggccgaggcatgaca

SEQ ID NO: 1251396 - DNA, 22 bp, Artificial Sequence
  chemically synthesized
aagcgattgtcatgcctcggcc

SEQ ID NO: 1251397 - DNA, 22 bp, Artificial Sequence
  chemically synthesized
taatcccagctatttgggaggc

SEQ ID NO: 1251398 - DNA, 22 bp, Artificial Sequence
  chemically synthesized
tcatgcctcggcctcccaaata

SEQ ID NO: 1251399 - DNA, 22 bp, Artificial Sequence
  chemically synthesized
ggcctcccaaatagctgggatt

SEQ ID NO: 1251400 - DNA, 22 bp, Artificial Sequence
  chemically synthesized
ccaaatagctgggattacaggc

SEQ ID NO: 1251401 - DNA, 22 bp, Artificial Sequence
  chemically synthesized
gccgggtgtggtggcaggtgcc

SEQ ID NO: 1251402 - DNA, 22 bp, Artificial Sequence
  chemically synthesized
ggattacaggcacctgccacca

SEQ ID NO: 1251403 - DNA, 22 bp, Artificial Sequence
  chemically synthesized
caggcacctgccaccacacccg

SEQ ID NO: 1251404 - DNA, 22 bp, Artificial Sequence
  chemically synthesized
caaatacaaaaaaaaattagcc

SEQ ID NO: 1251405 - DNA, 22 bp, Artificial Sequence
  chemically synthesized
ccaccacacccggctaattttt

SEQ ID NO: 1251406 - DNA, 22 bp, Artificial Sequence
  chemically synthesized
ctacaaatacaaaaaaaaatta

SEQ ID NO: 1251407 - DNA, 22 bp, Artificial Sequence
  chemically synthesized
tactacaaatacaaaaaaaaat

SEQ ID NO: 1251408 - DNA, 22 bp, Artificial Sequence
  chemically synthesized
atttttttttgtatttgtagta

SEQ ID NO: 1251409 - DNA, 22 bp, Artificial Sequence
  chemically synthesized
ttttttgtatttgtagtagaga

SEQ ID NO: 1251410 - DNA, 22 bp, Artificial Sequence
  chemically synthesized
tttttgtatttgtagtagagac

SEQ ID NO: 1251411 - DNA, 22 bp, Artificial Sequence
  chemically synthesized
ttttgtatttgtagtagagacg

SEQ ID NO: 1251412 - DNA, 22 bp, Artificial Sequence
  chemically synthesized
tttgtatttgtagtagagacgg

SEQ ID NO: 1251413 - DNA, 22 bp, Artificial Sequence
  chemically synthesized
ttgtatttgtagtagagacggg

SEQ ID NO: 1251414 - DNA, 22 bp, Artificial Sequence
  chemically synthesized
tgtatttgtagtagagacgggg

SEQ ID NO: 1251415 - DNA, 22 bp, Artificial Sequence
  chemically synthesized
gtatttgtagtagagacggggt

SEQ ID NO: 1251416 - DNA, 22 bp, Artificial Sequence
  chemically synthesized
tatttgtagtagagacggggtt

SEQ ID NO: 1251417 - DNA, 22 bp, Artificial Sequence
  chemically synthesized
gccaacatggtgaaaccccgtc

SEQ ID NO: 1251418 - DNA, 22 bp, Artificial Sequence
  chemically synthesized
gtagtagagacggggtttcacc

SEQ ID NO: 1251419 - DNA, 22 bp, Artificial Sequence
  chemically synthesized
tagtagagacggggtttcacca

SEQ ID NO: 1251420 - DNA, 22 bp, Artificial Sequence
  chemically synthesized
agagatcaagaccatcctggcc

SEQ ID NO: 1251421 - DNA, 22 bp, Artificial Sequence
  chemically synthesized
caccatgttggccaggatggtc

SEQ ID NO: 1251422 - DNA, 22 bp, Artificial Sequence
  chemically synthesized
accatgttggccaggatggtct

SEQ ID NO: 1251423 - DNA, 22 bp, Artificial Sequence
  chemically synthesized
gccaggatggtcttgatctctt

SEQ ID NO: 1251424 - DNA, 22 bp, Artificial Sequence
  chemically synthesized
aggcgggtggatcacgaggtct

SEQ ID NO: 1251425 - DNA, 22 bp, Artificial Sequence
  chemically synthesized
gatctcttagacctcgtgatcc

SEQ ID NO: 1251426 - DNA, 22 bp, Artificial Sequence
  chemically synthesized
atctcttagacctcgtgatcca

SEQ ID NO: 1251427 - DNA, 22 bp, Artificial Sequence
  chemically synthesized
gggaggctgaggcgggtggatc

SEQ ID NO: 1251428 - DNA, 22 bp, Artificial Sequence
  chemically synthesized
ttagacctcgtgatccacccgc

SEQ ID NO: 1251429 - DNA, 22 bp, Artificial Sequence
  chemically synthesized
cgggaggctgaggcgggtggat

SEQ ID NO: 1251430 - DNA, 22 bp, Artificial Sequence
  chemically synthesized
agacctcgtgatccacccgcct

SEQ ID NO: 1251431 - DNA, 22 bp, Artificial Sequence
  chemically synthesized
gacctcgtgatccacccgcctc

SEQ ID NO: 1251432 - DNA, 22 bp, Artificial Sequence
  chemically synthesized
gtgatccacccgcctcagcctc

SEQ ID NO: 1251433 - DNA, 22 bp, Artificial Sequence
  chemically synthesized
taatcccagcacttcgggaggc

SEQ ID NO: 1251434 - DNA, 22 bp, Artificial Sequence
  chemically synthesized
acgcctgtaatcccagcacttc

SEQ ID NO: 1251435 - DNA, 22 bp, Artificial Sequence
  chemically synthesized
agcctcccgaagtgctgggatt

SEQ ID NO: 1251436 - DNA, 22 bp, Artificial Sequence
  chemically synthesized
ccgaagtgctgggattacaggc

SEQ ID NO: 1251437 - DNA, 22 bp, Artificial Sequence
  chemically synthesized
gaggccgggtggctcacgcctg

SEQ ID NO: 1251438 - DNA, 22 bp, Artificial Sequence
  chemically synthesized
ggattacaggcgtgagccaccc

SEQ ID NO: 1251439 - DNA, 22 bp, Artificial Sequence
  chemically synthesized
caggcgtgagccacccggcctc

SEQ ID NO: 1251440 - DNA, 22 bp, Artificial Sequence
  chemically synthesized
tgaaagaaagggggcattagag

SEQ ID NO: 1251441 - DNA, 22 bp, Artificial Sequence
  chemically synthesized
gtgtgtaatgttatgaaagaaa

SEQ ID NO: 1251442 - DNA, 22 bp, Artificial Sequence
  chemically synthesized
ggtgtgtaatgttatgaaagaa

SEQ ID NO: 1251443 - DNA, 22 bp, Artificial Sequence
  chemically synthesized
taatgccccctttctttcataa

SEQ ID NO: 1251444 - DNA, 22 bp, Artificial Sequence
  chemically synthesized
atgccccctttctttcataaca

SEQ ID NO: 1251445 - DNA, 22 bp, Artificial Sequence
  chemically synthesized
tctttcataacattacacacca

SEQ ID NO: 1251446 - DNA, 22 bp, Artificial Sequence
  chemically synthesized
ccaaataatacttggtgtgtaa

SEQ ID NO: 1251447 - DNA, 22 bp, Artificial Sequence
  chemically synthesized
ctttcataacattacacaccaa

SEQ ID NO: 1251448 - DNA, 22 bp, Artificial Sequence
  chemically synthesized
gccaaataatacttggtgtgta

SEQ ID NO: 1251449 - DNA, 22 bp, Artificial Sequence
  chemically synthesized
tttcataacattacacaccaag

SEQ ID NO: 1251450 - DNA, 22 bp, Artificial Sequence
  chemically synthesized
tcataacattacacaccaagta

SEQ ID NO: 1251451 - DNA, 22 bp, Artificial Sequence
  chemically synthesized
cataacattacacaccaagtat

SEQ ID NO: 1251452 - DNA, 22 bp, Artificial Sequence
  chemically synthesized
ataacattacacaccaagtatt

SEQ ID NO: 1251453 - DNA, 22 bp, Artificial Sequence
  chemically synthesized
cacaccaagtattatttggcaa

SEQ ID NO: 1251454 - DNA, 22 bp, Artificial Sequence
  chemically synthesized
tttggcaaacttctcatcccct

SEQ ID NO: 1251455 - DNA, 22 bp, Artificial Sequence
  chemically synthesized
ggcaaacttctcatcccctata

SEQ ID NO: 1251456 - DNA, 22 bp, Artificial Sequence
  chemically synthesized
gcaaacttctcatcccctatac

SEQ ID NO: 1251457 - DNA, 22 bp, Artificial Sequence
  chemically synthesized
ctcatcccctatactgtattac

SEQ ID NO: 1251458 - DNA, 22 bp, Artificial Sequence
  chemically synthesized
tcatcccctatactgtattact

SEQ ID NO: 1251459 - DNA, 22 bp, Artificial Sequence
  chemically synthesized
atcccctatactgtattactta

SEQ ID NO: 1251460 - DNA, 22 bp, Artificial Sequence
  chemically synthesized
ggaaacaatgtcaataagtaat

SEQ ID NO: 1251461 - DNA, 22 bp, Artificial Sequence
  chemically synthesized
agctgggaaacaatgtcaataa

SEQ ID NO: 1251462 - DNA, 22 bp, Artificial Sequence
  chemically synthesized
tactgtattacttattgacatt

SEQ ID NO: 1251463 - DNA, 22 bp, Artificial Sequence
  chemically synthesized
tattacttattgacattgtttc

SEQ ID NO: 1251464 - DNA, 22 bp, Artificial Sequence
  chemically synthesized
cttattgacattgtttcccagc

SEQ ID NO: 1251465 - DNA, 22 bp, Artificial Sequence
  chemically synthesized
attgacattgtttcccagctca

SEQ ID NO: 1251466 - DNA, 22 bp, Artificial Sequence
  chemically synthesized
ttgacattgtttcccagctcag

SEQ ID NO: 1251467 - DNA, 22 bp, Artificial Sequence
  chemically synthesized
acattgtttcccagctcaggcc

SEQ ID NO: 1251468 - DNA, 22 bp, Artificial Sequence
  chemically synthesized
tttcccagctcaggcctacacg

SEQ ID NO: 1251469 - DNA, 22 bp, Artificial Sequence
  chemically synthesized
cccagctcaggcctacacgctt

SEQ ID NO: 1251470 - DNA, 22 bp, Artificial Sequence
  chemically synthesized
ccagctcaggcctacacgcttg

SEQ ID NO: 1251471 - DNA, 22 bp, Artificial Sequence
  chemically synthesized
aggcctacacgcttggcacatt

SEQ ID NO: 1251472 - DNA, 22 bp, Artificial Sequence
  chemically synthesized
tggccagagagacagaatgtgc

SEQ ID NO: 1251473 - DNA, 22 bp, Artificial Sequence
  chemically synthesized
cacgcttggcacattctgtctc

SEQ ID NO: 1251474 - DNA, 22 bp, Artificial Sequence
  chemically synthesized
ggcacattctgtctctctggcc

SEQ ID NO: 1251475 - DNA, 22 bp, Artificial Sequence
  chemically synthesized
cacgatcattgtggccagagag

SEQ ID NO: 1251476 - DNA, 22 bp, Artificial Sequence
  chemically synthesized
gcacattctgtctctctggcca

SEQ ID NO: 1251477 - DNA, 22 bp, Artificial Sequence
  chemically synthesized
acacgatcattgtggccagaga

SEQ ID NO: 1251478 - DNA, 22 bp, Artificial Sequence
  chemically synthesized
cttacacgatcattgtggccag

SEQ ID NO: 1251479 - DNA, 22 bp, Artificial Sequence
  chemically synthesized
gcttacacgatcattgtggcca

SEQ ID NO: 1251480 - DNA, 22 bp, Artificial Sequence
  chemically synthesized
tgtctctctggccacaatgatc

SEQ ID NO: 1251481 - DNA, 22 bp, Artificial Sequence
  chemically synthesized
tctctctggccacaatgatcgt

SEQ ID NO: 1251482 - DNA, 22 bp, Artificial Sequence
  chemically synthesized
agccttgcttacacgatcattg

SEQ ID NO: 1251483 - DNA, 22 bp, Artificial Sequence
  chemically synthesized
cagccttgcttacacgatcatt

SEQ ID NO: 1251484 - DNA, 22 bp, Artificial Sequence
  chemically synthesized
tcagccttgcttacacgatcat

SEQ ID NO: 1251485 - DNA, 22 bp, Artificial Sequence
  chemically synthesized
tctggccacaatgatcgtgtaa

SEQ ID NO: 1251486 - DNA, 22 bp, Artificial Sequence
  chemically synthesized
tggccacaatgatcgtgtaagc

SEQ ID NO: 1251487 - DNA, 22 bp, Artificial Sequence
  chemically synthesized
gttttcagccttgcttacacga

SEQ ID NO: 1251488 - DNA, 22 bp, Artificial Sequence
  chemically synthesized
gccacaatgatcgtgtaagcaa

SEQ ID NO: 1251489 - DNA, 22 bp, Artificial Sequence
  chemically synthesized
agttggttttcagccttgctta

SEQ ID NO: 1251490 - DNA, 22 bp, Artificial Sequence
  chemically synthesized
aagttggttttcagccttgctt

SEQ ID NO: 1251491 - DNA, 22 bp, Artificial Sequence
  chemically synthesized
taagttggttttcagccttgct

SEQ ID NO: 1251492 - DNA, 22 bp, Artificial Sequence
  chemically synthesized
ctttaagttggttttcagcctt

SEQ ID NO: 1251493 - DNA, 22 bp, Artificial Sequence
  chemically synthesized
ccattcctttaagttggttttc

SEQ ID NO: 1251494 - DNA, 22 bp, Artificial Sequence
  chemically synthesized
cccattcctttaagttggtttt

SEQ ID NO: 1251495 - DNA, 22 bp, Artificial Sequence
  chemically synthesized
ttcccattcctttaagttggtt

SEQ ID NO: 1251496 - DNA, 22 bp, Artificial Sequence
  chemically synthesized
taactcttcccattcctttaag

SEQ ID NO: 1251497 - DNA, 22 bp, Artificial Sequence
  chemically synthesized
gtaactcttcccattcctttaa

SEQ ID NO: 1251498 - DNA, 22 bp, Artificial Sequence
  chemically synthesized
aaaaccaacttaaaggaatggg

SEQ ID NO: 1251499 - DNA, 22 bp, Artificial Sequence
  chemically synthesized
agtttgtaactcttcccattcc

SEQ ID NO: 1251500 - DNA, 22 bp, Artificial Sequence
  chemically synthesized
aagtttgtaactcttcccattc

SEQ ID NO: 1251501 - DNA, 22 bp, Artificial Sequence
  chemically synthesized
aaaggaatgggaagagttacaa

SEQ ID NO: 1251502 - DNA, 22 bp, Artificial Sequence
  chemically synthesized
aaggaatgggaagagttacaaa

SEQ ID NO: 1251503 - DNA, 22 bp, Artificial Sequence
  chemically synthesized
catcatgtgtgggagacttaag

SEQ ID NO: 1251504 - DNA, 22 bp, Artificial Sequence
  chemically synthesized
caaacttaagtctcccacacat

SEQ ID NO: 1251505 - DNA, 22 bp, Artificial Sequence
  chemically synthesized
aagtctcccacacatgatgcag

SEQ ID NO: 1251506 - DNA, 22 bp, Artificial Sequence
  chemically synthesized
agtctcccacacatgatgcagg

SEQ ID NO: 1251507 - DNA, 22 bp, Artificial Sequence
  chemically synthesized
ataaagtcatcatcctgcatca

SEQ ID NO: 1251508 - DNA, 22 bp, Artificial Sequence
  chemically synthesized
ccacacatgatgcaggatgatg

SEQ ID NO: 1251509 - DNA, 22 bp, Artificial Sequence
  chemically synthesized
ataaatatcataaaatcatgaa

SEQ ID NO: 1251510 - DNA, 22 bp, Artificial Sequence
  chemically synthesized
tatcagatattttcatgatttt

SEQ ID NO: 1251511 - DNA, 22 bp, Artificial Sequence
  chemically synthesized
atcagatattttcatgatttta

SEQ ID NO: 1251512 - DNA, 22 bp, Artificial Sequence
  chemically synthesized
tcagatattttcatgattttat

SEQ ID NO: 1251513 - DNA, 22 bp, Artificial Sequence
  chemically synthesized
tcatgattttatgatatttatc

SEQ ID NO: 1251514 - DNA, 22 bp, Artificial Sequence
  chemically synthesized
catgattttatgatatttatca

SEQ ID NO: 1251515 - DNA, 22 bp, Artificial Sequence
  chemically synthesized
atgattttatgatatttatcag

SEQ ID NO: 1251516 - DNA, 22 bp, Artificial Sequence
  chemically synthesized
ccaggagaaaatgtctgataaa

SEQ ID NO: 1251517 - DNA, 22 bp, Artificial Sequence
  chemically synthesized
cccaggagaaaatgtctgataa

SEQ ID NO: 1251518 - DNA, 22 bp, Artificial Sequence
  chemically synthesized
tatgatatttatcagacatttt

SEQ ID NO: 1251519 - DNA, 22 bp, Artificial Sequence
  chemically synthesized
atgatatttatcagacattttc

SEQ ID NO: 1251520 - DNA, 22 bp, Artificial Sequence
  chemically synthesized
tgatatttatcagacattttct

SEQ ID NO: 1251521 - DNA, 22 bp, Artificial Sequence
  chemically synthesized
acataaacttcccaggagaaaa

SEQ ID NO: 1251522 - DNA, 22 bp, Artificial Sequence
  chemically synthesized
taacataaacttcccaggagaa

SEQ ID NO: 1251523 - DNA, 22 bp, Artificial Sequence
  chemically synthesized
atcagacattttctcctgggaa

SEQ ID NO: 1251524 - DNA, 22 bp, Artificial Sequence
  chemically synthesized
tcagacattttctcctgggaag

SEQ ID NO: 1251525 - DNA, 22 bp, Artificial Sequence
  chemically synthesized
ctctaacataaacttcccagga

SEQ ID NO: 1251526 - DNA, 22 bp, Artificial Sequence
  chemically synthesized
actctaacataaacttcccagg

SEQ ID NO: 1251527 - DNA, 22 bp, Artificial Sequence
  chemically synthesized
tactctaacataaacttcccag

SEQ ID NO: 1251528 - DNA, 22 bp, Artificial Sequence
  chemically synthesized
ttactctaacataaacttccca

SEQ ID NO: 1251529 - DNA, 22 bp, Artificial Sequence
  chemically synthesized
tctcctgggaagtttatgttag

SEQ ID NO: 1251530 - DNA, 22 bp, Artificial Sequence
  chemically synthesized
ctcctgggaagtttatgttaga

SEQ ID NO: 1251531 - DNA, 22 bp, Artificial Sequence
  chemically synthesized
tcctgggaagtttatgttagag

SEQ ID NO: 1251532 - DNA, 22 bp, Artificial Sequence
  chemically synthesized
ctgggaagtttatgttagagta

SEQ ID NO: 1251533 - DNA, 22 bp, Artificial Sequence
  chemically synthesized
ggaagtttatgttagagtaaaa

SEQ ID NO: 1251534 - DNA, 22 bp, Artificial Sequence
  chemically synthesized
atgatacatgatttttactcta

SEQ ID NO: 1251535 - DNA, 22 bp, Artificial Sequence
  chemically synthesized
cctaatgatacatgatttttac

SEQ ID NO: 1251536 - DNA, 22 bp, Artificial Sequence
  chemically synthesized
ctccctaatgatacatgatttt

SEQ ID NO: 1251537 - DNA, 22 bp, Artificial Sequence
  chemically synthesized
atgttagagtaaaaatcatgta

SEQ ID NO: 1251538 - DNA, 22 bp, Artificial Sequence
  chemically synthesized
tgttagagtaaaaatcatgtat

SEQ ID NO: 1251539 - DNA, 22 bp, Artificial Sequence
  chemically synthesized
tactccctaatgatacatgatt

SEQ ID NO: 1251540 - DNA, 22 bp, Artificial Sequence
  chemically synthesized
cctctactccctaatgatacat

SEQ ID NO: 1251541 - DNA, 22 bp, Artificial Sequence
  chemically synthesized
gagtaaaaatcatgtatcatta

SEQ ID NO: 1251542 - DNA, 22 bp, Artificial Sequence
  chemically synthesized
gcattacctctactccctaatg

SEQ ID NO: 1251543 - DNA, 22 bp, Artificial Sequence
  chemically synthesized
agcattacctctactccctaat

SEQ ID NO: 1251544 - DNA, 22 bp, Artificial Sequence
  chemically synthesized
tagcattacctctactccctaa

SEQ ID NO: 1251545 - DNA, 22 bp, Artificial Sequence
  chemically synthesized
ttagcattacctctactcccta

SEQ ID NO: 1251546 - DNA, 22 bp, Artificial Sequence
  chemically synthesized
cttttagcattacctctactcc

SEQ ID NO: 1251547 - DNA, 22 bp, Artificial Sequence
  chemically synthesized
gcttttagcattacctctactc

SEQ ID NO: 1251548 - DNA, 22 bp, Artificial Sequence
  chemically synthesized
agtccttgcttttagcattacc

SEQ ID NO: 1251549 - DNA, 22 bp, Artificial Sequence
  chemically synthesized
tcagtccttgcttttagcatta

SEQ ID NO: 1251550 - DNA, 22 bp, Artificial Sequence
  chemically synthesized
gggagtagaggtaatgctaaaa

SEQ ID NO: 1251551 - DNA, 22 bp, Artificial Sequence
  chemically synthesized
ctctcagtccttgcttttagca

SEQ ID NO: 1251552 - DNA, 22 bp, Artificial Sequence
  chemically synthesized
actactctcagtccttgctttt

SEQ ID NO: 1251553 - DNA, 22 bp, Artificial Sequence
  chemically synthesized
atgaattaactactctcagtcc

SEQ ID NO: 1251554 - DNA, 22 bp, Artificial Sequence
  chemically synthesized
tcatgaattaactactctcagt

SEQ ID NO: 1251555 - DNA, 22 bp, Artificial Sequence
  chemically synthesized
aaagcaaggactgagagtagtt

SEQ ID NO: 1251556 - DNA, 22 bp, Artificial Sequence
  chemically synthesized
attctcatgaattaactactct

SEQ ID NO: 1251557 - DNA, 22 bp, Artificial Sequence
  chemically synthesized
catcattcattctcatgaatta

SEQ ID NO: 1251558 - DNA, 22 bp, Artificial Sequence
  chemically synthesized
agagtagttaattcatgagaat

SEQ ID NO: 1251559 - DNA, 22 bp, Artificial Sequence
  chemically synthesized
attcatgagaatgaatgatgga

SEQ ID NO: 1251560 - DNA, 22 bp, Artificial Sequence
  chemically synthesized
tcacgtcatgggattccatcat

SEQ ID NO: 1251561 - DNA, 22 bp, Artificial Sequence
  chemically synthesized
atgagaatgaatgatggaatcc

SEQ ID NO: 1251562 - DNA, 22 bp, Artificial Sequence
  chemically synthesized
atctatcacgtcatgggattcc

SEQ ID NO: 1251563 - DNA, 22 bp, Artificial Sequence
  chemically synthesized
agaccatagtgtagcagctgat

SEQ ID NO: 1251564 - DNA, 22 bp, Artificial Sequence
  chemically synthesized
ttgagaccatagtgtagcagct

SEQ ID NO: 1251565 - DNA, 22 bp, Artificial Sequence
  chemically synthesized
aactattgagaccatagtgtag

SEQ ID NO: 1251566 - DNA, 22 bp, Artificial Sequence
  chemically synthesized
tgaataattgaactattgagac

SEQ ID NO: 1251567 - DNA, 22 bp, Artificial Sequence
  chemically synthesized
atgaataattgaactattgaga

SEQ ID NO: 1251568 - DNA, 22 bp, Artificial Sequence
  chemically synthesized
ctacactatggtctcaatagtt

SEQ ID NO: 1251569 - DNA, 22 bp, Artificial Sequence
  chemically synthesized
tatgaataattgaactattgag

SEQ ID NO: 1251570 - DNA, 22 bp, Artificial Sequence
  chemically synthesized
cactatggtctcaatagttcaa

SEQ ID NO: 1251571 - DNA, 22 bp, Artificial Sequence
  chemically synthesized
tggtctcaatagttcaattatt

SEQ ID NO: 1251572 - DNA, 22 bp, Artificial Sequence
  chemically synthesized
aatagttcaattattcataaaa

SEQ ID NO: 1251573 - DNA, 22 bp, Artificial Sequence
  chemically synthesized
cgatcagtgtaattttatgaat

SEQ ID NO: 1251574 - DNA, 22 bp, Artificial Sequence
  chemically synthesized
aattattcataaaattacactg

SEQ ID NO: 1251575 - DNA, 22 bp, Artificial Sequence
  chemically synthesized
gaaaactacgatcagtgtaatt

SEQ ID NO: 1251576 - DNA, 22 bp, Artificial Sequence
  chemically synthesized
ttcataaaattacactgatcgt

SEQ ID NO: 1251577 - DNA, 22 bp, Artificial Sequence
  chemically synthesized
ataaaattacactgatcgtagt

SEQ ID NO: 1251578 - DNA, 22 bp, Artificial Sequence
  chemically synthesized
cactgatcgtagttttctaatg

SEQ ID NO: 1251579 - DNA, 22 bp, Artificial Sequence
  chemically synthesized
atcgtagttttctaatgtgaca

SEQ ID NO: 1251580 - DNA, 22 bp, Artificial Sequence
  chemically synthesized
tctaatgtgacatttttgtttt

SEQ ID NO: 1251581 - DNA, 22 bp, Artificial Sequence
  chemically synthesized
ctaatgtgacatttttgttttg

SEQ ID NO: 1251582 - DNA, 22 bp, Artificial Sequence
  chemically synthesized
taatgtgacatttttgttttga

SEQ ID NO: 1251583 - DNA, 22 bp, Artificial Sequence
  chemically synthesized
accaaccgaataatcaaaacaa

SEQ ID NO: 1251584 - DNA, 22 bp, Artificial Sequence
  chemically synthesized
atgtgacatttttgttttgatt

SEQ ID NO: 1251585 - DNA, 22 bp, Artificial Sequence
  chemically synthesized
tctgaccaaccgaataatcaaa

SEQ ID NO: 1251586 - DNA, 22 bp, Artificial Sequence
  chemically synthesized
agttgtctgaccaaccgaataa

SEQ ID NO: 1251587 - DNA, 22 bp, Artificial Sequence
  chemically synthesized
ttgttttgattattcggttggt

SEQ ID NO: 1251588 - DNA, 22 bp, Artificial Sequence
  chemically synthesized
ctcagttgtctgaccaaccgaa

SEQ ID NO: 1251589 - DNA, 22 bp, Artificial Sequence
  chemically synthesized
tgttttgattattcggttggtc

SEQ ID NO: 1251590 - DNA, 22 bp, Artificial Sequence
  chemically synthesized
gttttgattattcggttggtca

SEQ ID NO: 1251591 - DNA, 22 bp, Artificial Sequence
  chemically synthesized
ttttgattattcggttggtcag

SEQ ID NO: 1251592 - DNA, 22 bp, Artificial Sequence
  chemically synthesized
gttactcagttgtctgaccaac

SEQ ID NO: 1251593 - DNA, 22 bp, Artificial Sequence
  chemically synthesized
ggttactcagttgtctgaccaa

SEQ ID NO: 1251594 - DNA, 22 bp, Artificial Sequence
  chemically synthesized
tgattattcggttggtcagaca

SEQ ID NO: 1251595 - DNA, 22 bp, Artificial Sequence
  chemically synthesized
gattattcggttggtcagacaa

SEQ ID NO: 1251596 - DNA, 22 bp, Artificial Sequence
  chemically synthesized
attattcggttggtcagacaac

SEQ ID NO: 1251597 - DNA, 22 bp, Artificial Sequence
  chemically synthesized
ttcggttggtcagacaactgag

SEQ ID NO: 1251598 - DNA, 22 bp, Artificial Sequence
  chemically synthesized
ggttggtcagacaactgagtaa

SEQ ID NO: 1251599 - DNA, 22 bp, Artificial Sequence
  chemically synthesized
gtcagacaactgagtaaccaaa

SEQ ID NO: 1251600 - DNA, 22 bp, Artificial Sequence
  chemically synthesized
agtaaccaaatggtttcgccta

SEQ ID NO: 1251601 - DNA, 22 bp, Artificial Sequence
  chemically synthesized
aataaccaaataagtaggcgaa

SEQ ID NO: 1251602 - DNA, 22 bp, Artificial Sequence
  chemically synthesized
aacaactgaataaccaaataag

SEQ ID NO: 1251603 - DNA, 22 bp, Artificial Sequence
  chemically synthesized
cgcctacttatttggttattca

SEQ ID NO: 1251604 - DNA, 22 bp, Artificial Sequence
  chemically synthesized
gcctacttatttggttattcag

SEQ ID NO: 1251605 - DNA, 22 bp, Artificial Sequence
  chemically synthesized
cttatttggttattcagttgtt

SEQ ID NO: 1251606 - DNA, 22 bp, Artificial Sequence
  chemically synthesized
atttggttattcagttgttcag

SEQ ID NO: 1251607 - DNA, 22 bp, Artificial Sequence
  chemically synthesized
tttggttattcagttgttcagt

SEQ ID NO: 1251608 - DNA, 22 bp, Artificial Sequence
  chemically synthesized
ggttattcagttgttcagtttc

SEQ ID NO: 1251609 - DNA, 22 bp, Artificial Sequence
  chemically synthesized
gttattcagttgttcagtttct

SEQ ID NO: 1251610 - DNA, 22 bp, Artificial Sequence
  chemically synthesized
ttcagttgttcagtttcttgac

SEQ ID NO: 1251611 - DNA, 22 bp, Artificial Sequence
  chemically synthesized
agttgttcagtttcttgacctt

SEQ ID NO: 1251612 - DNA, 22 bp, Artificial Sequence
  chemically synthesized
ttcagtttcttgacctttttac

SEQ ID NO: 1251613 - DNA, 22 bp, Artificial Sequence
  chemically synthesized
aggaagcatggggtaaaaaggt

SEQ ID NO: 1251614 - DNA, 22 bp, Artificial Sequence
  chemically synthesized
agtttcttgacctttttacccc

SEQ ID NO: 1251615 - DNA, 22 bp, Artificial Sequence
  chemically synthesized
tgttaaggaagcatggggtaaa

SEQ ID NO: 1251616 - DNA, 22 bp, Artificial Sequence
  chemically synthesized
atgttaaggaagcatggggtaa

SEQ ID NO: 1251617 - DNA, 22 bp, Artificial Sequence
  chemically synthesized
cttgacctttttaccccatgct

SEQ ID NO: 1251618 - DNA, 22 bp, Artificial Sequence
  chemically synthesized
ttgacctttttaccccatgctt

SEQ ID NO: 1251619 - DNA, 22 bp, Artificial Sequence
  chemically synthesized
gacctttttaccccatgcttcc

SEQ ID NO: 1251620 - DNA, 22 bp, Artificial Sequence
  chemically synthesized
agcttatgttaaggaagcatgg

SEQ ID NO: 1251621 - DNA, 22 bp, Artificial Sequence
  chemically synthesized
acctttttaccccatgcttcct

SEQ ID NO: 1251622 - DNA, 22 bp, Artificial Sequence
  chemically synthesized
tttaccccatgcttccttaaca

SEQ ID NO: 1251623 - DNA, 22 bp, Artificial Sequence
  chemically synthesized
ttaccccatgcttccttaacat

SEQ ID NO: 1251624 - DNA, 22 bp, Artificial Sequence
  chemically synthesized
taccccatgcttccttaacata

SEQ ID NO: 1251625 - DNA, 22 bp, Artificial Sequence
  chemically synthesized
accccatgcttccttaacataa

SEQ ID NO: 1251626 - DNA, 22 bp, Artificial Sequence
  chemically synthesized
ccccatgcttccttaacataag

SEQ ID NO: 1251627 - DNA, 22 bp, Artificial Sequence
  chemically synthesized
aacagagataaattcagcttat

SEQ ID NO: 1251628 - DNA, 22 bp, Artificial Sequence
  chemically synthesized
ccttaacataagctgaatttat

SEQ ID NO: 1251629 - DNA, 22 bp, Artificial Sequence
  chemically synthesized
cattgaacagagataaattcag

SEQ ID NO: 1251630 - DNA, 22 bp, Artificial Sequence
  chemically synthesized
cttaacataagctgaatttatc

SEQ ID NO: 1251631 - DNA, 22 bp, Artificial Sequence
  chemically synthesized
aacataagctgaatttatctct

SEQ ID NO: 1251632 - DNA, 22 bp, Artificial Sequence
  chemically synthesized
acataagctgaatttatctctg

SEQ ID NO: 1251633 - DNA, 22 bp, Artificial Sequence
  chemically synthesized
tgttacattgaacagagataaa

SEQ ID NO: 1251634 - DNA, 22 bp, Artificial Sequence
  chemically synthesized
gtgttacattgaacagagataa

SEQ ID NO: 1251635 - DNA, 22 bp, Artificial Sequence
  chemically synthesized
tgtgttacattgaacagagata

SEQ ID NO: 1251636 - DNA, 22 bp, Artificial Sequence
  chemically synthesized
ttgtgttacattgaacagagat

SEQ ID NO: 1251637 - DNA, 22 bp, Artificial Sequence
  chemically synthesized
aatttatctctgttcaatgtaa

SEQ ID NO: 1251638 - DNA, 22 bp, Artificial Sequence
  chemically synthesized
aatacgggcttttgtgttacat

SEQ ID NO: 1251639 - DNA, 22 bp, Artificial Sequence
  chemically synthesized
atctctgttcaatgtaacacaa

SEQ ID NO: 1251640 - DNA, 22 bp, Artificial Sequence
  chemically synthesized
tctctgttcaatgtaacacaaa

SEQ ID NO: 1251641 - DNA, 22 bp, Artificial Sequence
  chemically synthesized
taaatacgggcttttgtgttac

SEQ ID NO: 1251642 - DNA, 22 bp, Artificial Sequence
  chemically synthesized
tgttcaatgtaacacaaaagcc

SEQ ID NO: 1251643 - DNA, 22 bp, Artificial Sequence
  chemically synthesized
gctctaaatacgggcttttgtg

SEQ ID NO: 1251644 - DNA, 22 bp, Artificial Sequence
  chemically synthesized
ttcaatgtaacacaaaagcccg

SEQ ID NO: 1251645 - DNA, 22 bp, Artificial Sequence
  chemically synthesized
aatgtaacacaaaagcccgtat

SEQ ID NO: 1251646 - DNA, 22 bp, Artificial Sequence
  chemically synthesized
gtataatctggctctaaatacg

SEQ ID NO: 1251647 - DNA, 22 bp, Artificial Sequence
  chemically synthesized
gaaactggtataatctggctct

SEQ ID NO: 1251648 - DNA, 22 bp, Artificial Sequence
  chemically synthesized
agagccagattataccagtttc

SEQ ID NO: 1251649 - DNA, 22 bp, Artificial Sequence
  chemically synthesized
gagccagattataccagtttcc

SEQ ID NO: 1251650 - DNA, 22 bp, Artificial Sequence
  chemically synthesized
agaggacacagctggaaactgg

SEQ ID NO: 1251651 - DNA, 22 bp, Artificial Sequence
  chemically synthesized
aagaggacacagctggaaactg

SEQ ID NO: 1251652 - DNA, 22 bp, Artificial Sequence
  chemically synthesized
taccagtttccagctgtgtcct

SEQ ID NO: 1251653 - DNA, 22 bp, Artificial Sequence
  chemically synthesized
ccagctgtgtcctcttaaacat

SEQ ID NO: 1251654 - DNA, 22 bp, Artificial Sequence
  chemically synthesized
cagctgtgtcctcttaaacata

SEQ ID NO: 1251655 - DNA, 22 bp, Artificial Sequence
  chemically synthesized
tgtcctcttaaacatattactc

SEQ ID NO: 1251656 - DNA, 22 bp, Artificial Sequence
  chemically synthesized
ttaaacatattactcattctct

SEQ ID NO: 1251657 - DNA, 22 bp, Artificial Sequence
  chemically synthesized
aaacatattactcattctctca

SEQ ID NO: 1251658 - DNA, 22 bp, Artificial Sequence
  chemically synthesized
aacatattactcattctctcat

SEQ ID NO: 1251659 - DNA, 22 bp, Artificial Sequence
  chemically synthesized
aggaaagaaatggaagacatga

SEQ ID NO: 1251660 - DNA, 22 bp, Artificial Sequence
  chemically synthesized
aaggaaagaaatggaagacatg

SEQ ID NO: 1251661 - DNA, 22 bp, Artificial Sequence
  chemically synthesized
taaggaaagaaatggaagacat

SEQ ID NO: 1251662 - DNA, 22 bp, Artificial Sequence
  chemically synthesized
ctcattctctcatgtcttccat

SEQ ID NO: 1251663 - DNA, 22 bp, Artificial Sequence
  chemically synthesized
ttaaggaaagaaatggaagaca

SEQ ID NO: 1251664 - DNA, 22 bp, Artificial Sequence
  chemically synthesized
tttaaggaaagaaatggaagac

SEQ ID NO: 1251665 - DNA, 22 bp, Artificial Sequence
  chemically synthesized
attctctcatgtcttccatttc

SEQ ID NO: 1251666 - DNA, 22 bp, Artificial Sequence
  chemically synthesized
attttttaaggaaagaaatgga

SEQ ID NO: 1251667 - DNA, 22 bp, Artificial Sequence
  chemically synthesized
tctcatgtcttccatttctttc

SEQ ID NO: 1251668 - DNA, 22 bp, Artificial Sequence
  chemically synthesized
tcattttttaaggaaagaaatg

SEQ ID NO: 1251669 - DNA, 22 bp, Artificial Sequence
  chemically synthesized
tcatgtcttccatttctttcct

SEQ ID NO: 1251670 - DNA, 22 bp, Artificial Sequence
  chemically synthesized
atgtcttccatttctttcctta

SEQ ID NO: 1251671 - DNA, 22 bp, Artificial Sequence
  chemically synthesized
ccatttctttccttaaaaaatg

SEQ ID NO: 1251672 - DNA, 22 bp, Artificial Sequence
  chemically synthesized
catttctttccttaaaaaatga

SEQ ID NO: 1251673 - DNA, 22 bp, Artificial Sequence
  chemically synthesized
ctttccttaaaaaatgagaata

SEQ ID NO: 1251674 - DNA, 22 bp, Artificial Sequence
  chemically synthesized
tttccttaaaaaatgagaatac

SEQ ID NO: 1251675 - DNA, 22 bp, Artificial Sequence
  chemically synthesized
tccttaaaaaatgagaatacca

SEQ ID NO: 1251676 - DNA, 22 bp, Artificial Sequence
  chemically synthesized
ccttaaaaaatgagaataccac

SEQ ID NO: 1251677 - DNA, 22 bp, Artificial Sequence
  chemically synthesized
cttaaaaaatgagaataccacc

SEQ ID NO: 1251678 - DNA, 22 bp, Artificial Sequence
  chemically synthesized
aaaaaatgagaataccacctat

SEQ ID NO: 1251679 - DNA, 22 bp, Artificial Sequence
  chemically synthesized
aaaaatgagaataccacctatc

SEQ ID NO: 1251680 - DNA, 22 bp, Artificial Sequence
  chemically synthesized
caaacatatataggagataggt

SEQ ID NO: 1251681 - DNA, 22 bp, Artificial Sequence
  chemically synthesized
gcaaacatatataggagatagg

SEQ ID NO: 1251682 - DNA, 22 bp, Artificial Sequence
  chemically synthesized
taaacatgtttgcaaacatata

SEQ ID NO: 1251683 - DNA, 22 bp, Artificial Sequence
  chemically synthesized
gtaaacatgtttgcaaacatat

SEQ ID NO: 1251684 - DNA, 22 bp, Artificial Sequence
  chemically synthesized
tctcctatatatgtttgcaaac

SEQ ID NO: 1251685 - DNA, 22 bp, Artificial Sequence
  chemically synthesized
ctatatatgtttgcaaacatgt

SEQ ID NO: 1251686 - DNA, 22 bp, Artificial Sequence
  chemically synthesized
tatatgtttgcaaacatgttta

SEQ ID NO: 1251687 - DNA, 22 bp, Artificial Sequence
  chemically synthesized
acatatatcttgtaaacatgtt

SEQ ID NO: 1251688 - DNA, 22 bp, Artificial Sequence
  chemically synthesized
gcaaacatgtttacaagatata

SEQ ID NO: 1251689 - DNA, 22 bp, Artificial Sequence
  chemically synthesized
caaacatgtttacaagatatat

SEQ ID NO: 1251690 - DNA, 22 bp, Artificial Sequence
  chemically synthesized
tgcaaggtaattcacatatatc

SEQ ID NO: 1251691 - DNA, 22 bp, Artificial Sequence
  chemically synthesized
actgtgcaaggtaattcacata

SEQ ID NO: 1251692 - DNA, 22 bp, Artificial Sequence
  chemically synthesized
acaagatatatgtgaattacct

SEQ ID NO: 1251693 - DNA, 22 bp, Artificial Sequence
  chemically synthesized
caagatatatgtgaattacctt

SEQ ID NO: 1251694 - DNA, 22 bp, Artificial Sequence
  chemically synthesized
agagatgctaactgtgcaaggt

SEQ ID NO: 1251695 - DNA, 22 bp, Artificial Sequence
  chemically synthesized
acatcctgagagatgctaactg

SEQ ID NO: 1251696 - DNA, 22 bp, Artificial Sequence
  chemically synthesized
cacatcctgagagatgctaact

SEQ ID NO: 1251697 - DNA, 22 bp, Artificial Sequence
  chemically synthesized
tcacatcctgagagatgctaac

SEQ ID NO: 1251698 - DNA, 22 bp, Artificial Sequence
  chemically synthesized
ccttgcacagttagcatctctc

SEQ ID NO: 1251699 - DNA, 22 bp, Artificial Sequence
  chemically synthesized
gcacagttagcatctctcagga

SEQ ID NO: 1251700 - DNA, 22 bp, Artificial Sequence
  chemically synthesized
cacagttagcatctctcaggat

SEQ ID NO: 1251701 - DNA, 22 bp, Artificial Sequence
  chemically synthesized
gcatctctcaggatgtgaaagt

SEQ ID NO: 1251702 - DNA, 22 bp, Artificial Sequence
  chemically synthesized
aggaggaagacggtcactttca

SEQ ID NO: 1251703 - DNA, 22 bp, Artificial Sequence
  chemically synthesized
ctgaggaggaagacggtcactt

SEQ ID NO: 1251704 - DNA, 22 bp, Artificial Sequence
  chemically synthesized
tcaggatgtgaaagtgaccgtc

SEQ ID NO: 1251705 - DNA, 22 bp, Artificial Sequence
  chemically synthesized
aggatgtgaaagtgaccgtctt

SEQ ID NO: 1251706 - DNA, 22 bp, Artificial Sequence
  chemically synthesized
ataagacaaagagtaaattact

SEQ ID NO: 1251707 - DNA, 22 bp, Artificial Sequence
  chemically synthesized
gataagacaaagagtaaattac

SEQ ID NO: 1251708 - DNA, 22 bp, Artificial Sequence
  chemically synthesized
tgataagacaaagagtaaatta

SEQ ID NO: 1251709 - DNA, 22 bp, Artificial Sequence
  chemically synthesized
cctcctcagtaatttactcttt

SEQ ID NO: 1251710 - DNA, 22 bp, Artificial Sequence
  chemically synthesized
ctcctcagtaatttactctttg

SEQ ID NO: 1251711 - DNA, 22 bp, Artificial Sequence
  chemically synthesized
ctcagtaatttactctttgtct

SEQ ID NO: 1251712 - DNA, 22 bp, Artificial Sequence
  chemically synthesized
atggctttgataagacaaagag

SEQ ID NO: 1251713 - DNA, 22 bp, Artificial Sequence
  chemically synthesized
aatggctttgataagacaaaga

SEQ ID NO: 1251714 - DNA, 22 bp, Artificial Sequence
  chemically synthesized
taatggctttgataagacaaag

SEQ ID NO: 1251715 - DNA, 22 bp, Artificial Sequence
  chemically synthesized
agtaatttactctttgtcttat

SEQ ID NO: 1251716 - DNA, 22 bp, Artificial Sequence
  chemically synthesized
aggggttttaatggctttgata

SEQ ID NO: 1251717 - DNA, 22 bp, Artificial Sequence
  chemically synthesized
actctttgtcttatcaaagcca

SEQ ID NO: 1251718 - DNA, 22 bp, Artificial Sequence
  chemically synthesized
ctctttgtcttatcaaagccat

SEQ ID NO: 1251719 - DNA, 22 bp, Artificial Sequence
  chemically synthesized
tgaggggttttaatggctttga

SEQ ID NO: 1251720 - DNA, 22 bp, Artificial Sequence
  chemically synthesized
tttgtcttatcaaagccattaa

SEQ ID NO: 1251721 - DNA, 22 bp, Artificial Sequence
  chemically synthesized
tgtcttatcaaagccattaaaa

SEQ ID NO: 1251722 - DNA, 22 bp, Artificial Sequence
  chemically synthesized
gtcttatcaaagccattaaaac

SEQ ID NO: 1251723 - DNA, 22 bp, Artificial Sequence
  chemically synthesized
tcttatcaaagccattaaaacc

SEQ ID NO: 1251724 - DNA, 22 bp, Artificial Sequence
  chemically synthesized
atcacctctgaggggttttaat

SEQ ID NO: 1251725 - DNA, 22 bp, Artificial Sequence
  chemically synthesized
aatcacctctgaggggttttaa

SEQ ID NO: 1251726 - DNA, 22 bp, Artificial Sequence
  chemically synthesized
atcaaagccattaaaacccctc

SEQ ID NO: 1251727 - DNA, 22 bp, Artificial Sequence
  chemically synthesized
tcaaagccattaaaacccctca

SEQ ID NO: 1251728 - DNA, 22 bp, Artificial Sequence
  chemically synthesized
tcacagcaaatttaatcacctc

SEQ ID NO: 1251729 - DNA, 22 bp, Artificial Sequence
  chemically synthesized
atcacagcaaatttaatcacct

SEQ ID NO: 1251730 - DNA, 22 bp, Artificial Sequence
  chemically synthesized
aaacccctcagaggtgattaaa

SEQ ID NO: 1251731 - DNA, 22 bp, Artificial Sequence
  chemically synthesized
tttatcacagcaaatttaatca

SEQ ID NO: 1251732 - DNA, 22 bp, Artificial Sequence
  chemically synthesized
agaggtgattaaatttgctgtg

SEQ ID NO: 1251733 - DNA, 22 bp, Artificial Sequence
  chemically synthesized
ataaccccactgtttatcacag

SEQ ID NO: 1251734 - DNA, 22 bp, Artificial Sequence
  chemically synthesized
aataaccccactgtttatcaca

SEQ ID NO: 1251735 - DNA, 22 bp, Artificial Sequence
  chemically synthesized
cttaataaccccactgtttatc

SEQ ID NO: 1251736 - DNA, 22 bp, Artificial Sequence
  chemically synthesized
gcttaataaccccactgtttat

SEQ ID NO: 1251737 - DNA, 22 bp, Artificial Sequence
  chemically synthesized
aatttgctgtgataaacagtgg

SEQ ID NO: 1251738 - DNA, 22 bp, Artificial Sequence
  chemically synthesized
tgcttaataaccccactgttta

SEQ ID NO: 1251739 - DNA, 22 bp, Artificial Sequence
  chemically synthesized
ctttgcttaataaccccactgt

SEQ ID NO: 1251740 - DNA, 22 bp, Artificial Sequence
  chemically synthesized
gctgtgataaacagtggggtta

SEQ ID NO: 1251741 - DNA, 22 bp, Artificial Sequence
  chemically synthesized
ctgtgataaacagtggggttat

SEQ ID NO: 1251742 - DNA, 22 bp, Artificial Sequence
  chemically synthesized
ctactttgcttaataaccccac

SEQ ID NO: 1251743 - DNA, 22 bp, Artificial Sequence
  chemically synthesized
actactttgcttaataacccca

SEQ ID NO: 1251744 - DNA, 22 bp, Artificial Sequence
  chemically synthesized
tgataaacagtggggttattaa

SEQ ID NO: 1251745 - DNA, 22 bp, Artificial Sequence
  chemically synthesized
atagtttactactttgcttaat

SEQ ID NO: 1251746 - DNA, 22 bp, Artificial Sequence
  chemically synthesized
ggtgtgttcatagtttactact

SEQ ID NO: 1251747 - DNA, 22 bp, Artificial Sequence
  chemically synthesized
aggtgtgttcatagtttactac

SEQ ID NO: 1251748 - DNA, 22 bp, Artificial Sequence
  chemically synthesized
ttaagcaaagtagtaaactatg

SEQ ID NO: 1251749 - DNA, 22 bp, Artificial Sequence
  chemically synthesized
agcaaagtagtaaactatgaac

SEQ ID NO: 1251750 - DNA, 22 bp, Artificial Sequence
  chemically synthesized
agaaaaaacttaggtgtgttca

SEQ ID NO: 1251751 - DNA, 22 bp, Artificial Sequence
  chemically synthesized
aagaaaaaacttaggtgtgttc

SEQ ID NO: 1251752 - DNA, 22 bp, Artificial Sequence
  chemically synthesized
caatatttaagaaaaaacttag

SEQ ID NO: 1251753 - DNA, 22 bp, Artificial Sequence
  chemically synthesized
tgaacacacctaagttttttct

SEQ ID NO: 1251754 - DNA, 22 bp, Artificial Sequence
  chemically synthesized
cactacaatatttaagaaaaaa

SEQ ID NO: 1251755 - DNA, 22 bp, Artificial Sequence
  chemically synthesized
cagctccactacaatatttaag

SEQ ID NO: 1251756 - DNA, 22 bp, Artificial Sequence
  chemically synthesized
ccagctccactacaatatttaa

SEQ ID NO: 1251757 - DNA, 22 bp, Artificial Sequence
  chemically synthesized
agttttttcttaaatattgtag

SEQ ID NO: 1251758 - DNA, 22 bp, Artificial Sequence
  chemically synthesized
tttcttaaatattgtagtggag

SEQ ID NO: 1251759 - DNA, 22 bp, Artificial Sequence
  chemically synthesized
ttcttaaatattgtagtggagc

SEQ ID NO: 1251760 - DNA, 22 bp, Artificial Sequence
  chemically synthesized
tcttaaatattgtagtggagct

SEQ ID NO: 1251761 - DNA, 22 bp, Artificial Sequence
  chemically synthesized
cttaaatattgtagtggagctg

SEQ ID NO: 1251762 - DNA, 22 bp, Artificial Sequence
  chemically synthesized
ttaaatattgtagtggagctgg

SEQ ID NO: 1251763 - DNA, 22 bp, Artificial Sequence
  chemically synthesized
aaaaaaaaaatttccagctcca

SEQ ID NO: 1251764 - DNA, 22 bp, Artificial Sequence
  chemically synthesized
aaatattgtagtggagctggaa

SEQ ID NO: 1251765 - DNA, 22 bp, Artificial Sequence
  chemically synthesized
aatattgtagtggagctggaaa

SEQ ID NO: 1251766 - DNA, 22 bp, Artificial Sequence
  chemically synthesized
tagtggagctggaaattttttt

SEQ ID NO: 1251767 - DNA, 22 bp, Artificial Sequence
  chemically synthesized
gaaatttttttttttaggtatt

SEQ ID NO: 1251768 - DNA, 22 bp, Artificial Sequence
  chemically synthesized
tggatatggaagaaatacctaa

SEQ ID NO: 1251769 - DNA, 22 bp, Artificial Sequence
  chemically synthesized
gtggatatggaagaaataccta

SEQ ID NO: 1251770 - DNA, 22 bp, Artificial Sequence
  chemically synthesized
tgtggatatggaagaaatacct

SEQ ID NO: 1251771 - DNA, 22 bp, Artificial Sequence
  chemically synthesized
ttgtggatatggaagaaatacc

SEQ ID NO: 1251772 - DNA, 22 bp, Artificial Sequence
  chemically synthesized
tttgtggatatggaagaaatac

SEQ ID NO: 1251773 - DNA, 22 bp, Artificial Sequence
  chemically synthesized
ttttgtggatatggaagaaata

SEQ ID NO: 1251774 - DNA, 22 bp, Artificial Sequence
  chemically synthesized
ttttttttaggtatttcttcca

SEQ ID NO: 1251775 - DNA, 22 bp, Artificial Sequence
  chemically synthesized
tttttttaggtatttcttccat

SEQ ID NO: 1251776 - DNA, 22 bp, Artificial Sequence
  chemically synthesized
ttttttaggtatttcttccata

SEQ ID NO: 1251777 - DNA, 22 bp, Artificial Sequence
  chemically synthesized
cttttttgtggatatggaagaa

SEQ ID NO: 1251778 - DNA, 22 bp, Artificial Sequence
  chemically synthesized
tttttaggtatttcttccatat

SEQ ID NO: 1251779 - DNA, 22 bp, Artificial Sequence
  chemically synthesized
ttttaggtatttcttccatatc

SEQ ID NO: 1251780 - DNA, 22 bp, Artificial Sequence
  chemically synthesized
tttaggtatttcttccatatcc

SEQ ID NO: 1251781 - DNA, 22 bp, Artificial Sequence
  chemically synthesized
ctgcttttttgtggatatggaa

SEQ ID NO: 1251782 - DNA, 22 bp, Artificial Sequence
  chemically synthesized
ttaggtatttcttccatatcca

SEQ ID NO: 1251783 - DNA, 22 bp, Artificial Sequence
  chemically synthesized
gctgcttttttgtggatatgga

SEQ ID NO: 1251784 - DNA, 22 bp, Artificial Sequence
  chemically synthesized
taggtatttcttccatatccac

SEQ ID NO: 1251785 - DNA, 22 bp, Artificial Sequence
  chemically synthesized
aggtatttcttccatatccaca

SEQ ID NO: 1251786 - DNA, 22 bp, Artificial Sequence
  chemically synthesized
ggtatttcttccatatccacaa

SEQ ID NO: 1251787 - DNA, 22 bp, Artificial Sequence
  chemically synthesized
agtgggcttgctgcttttttgt

SEQ ID NO: 1251788 - DNA, 22 bp, Artificial Sequence
  chemically synthesized
cttccatatccacaaaaaagca

SEQ ID NO: 1251789 - DNA, 22 bp, Artificial Sequence
  chemically synthesized
cagtgggcttgctgcttttttg

SEQ ID NO: 1251790 - DNA, 22 bp, Artificial Sequence
  chemically synthesized
ttccatatccacaaaaaagcag

SEQ ID NO: 1251791 - DNA, 22 bp, Artificial Sequence
  chemically synthesized
ccatatccacaaaaaagcagca

SEQ ID NO: 1251792 - DNA, 22 bp, Artificial Sequence
  chemically synthesized
catatccacaaaaaagcagcaa

SEQ ID NO: 1251793 - DNA, 22 bp, Artificial Sequence
  chemically synthesized
gtagcacaaacagatgagtttc

SEQ ID NO: 1251794 - DNA, 22 bp, Artificial Sequence
  chemically synthesized
agtagcacaaacagatgagttt

SEQ ID NO: 1251795 - DNA, 22 bp, Artificial Sequence
  chemically synthesized
tttagtagcacaaacagatgag

SEQ ID NO: 1251796 - DNA, 22 bp, Artificial Sequence
  chemically synthesized
aaactcatctgtttgtgctact

SEQ ID NO: 1251797 - DNA, 22 bp, Artificial Sequence
  chemically synthesized
atctgtttgtgctactaaataa

SEQ ID NO: 1251798 - DNA, 22 bp, Artificial Sequence
  chemically synthesized
tttgtgctactaaataatcccc

SEQ ID NO: 1251799 - DNA, 22 bp, Artificial Sequence
  chemically synthesized
cagtaggaaaagtaggggatta

SEQ ID NO: 1251800 - DNA, 22 bp, Artificial Sequence
  chemically synthesized
gtgctactaaataatcccctac

SEQ ID NO: 1251801 - DNA, 22 bp, Artificial Sequence
  chemically synthesized
tgctactaaataatcccctact

SEQ ID NO: 1251802 - DNA, 22 bp, Artificial Sequence
  chemically synthesized
ctaaataatcccctacttttcc

SEQ ID NO: 1251803 - DNA, 22 bp, Artificial Sequence
  chemically synthesized
aataatcccctacttttcctac

SEQ ID NO: 1251804 - DNA, 22 bp, Artificial Sequence
  chemically synthesized
cttttcctactgtaggttgatt

SEQ ID NO: 1251805 - DNA, 22 bp, Artificial Sequence
  chemically synthesized
ttcctactgtaggttgatttat

SEQ ID NO: 1251806 - DNA, 22 bp, Artificial Sequence
  chemically synthesized
tcctactgtaggttgatttatt

SEQ ID NO: 1251807 - DNA, 22 bp, Artificial Sequence
  chemically synthesized
cctactgtaggttgatttattg

SEQ ID NO: 1251808 - DNA, 22 bp, Artificial Sequence
  chemically synthesized
ctactgtaggttgatttattgg

SEQ ID NO: 1251809 - DNA, 22 bp, Artificial Sequence
  chemically synthesized
ctgtaggttgatttattggtcc

SEQ ID NO: 1251810 - DNA, 22 bp, Artificial Sequence
  chemically synthesized
taggttgatttattggtcccca

SEQ ID NO: 1251811 - DNA, 22 bp, Artificial Sequence
  chemically synthesized
agtaggaatgagaaagtgggga

SEQ ID NO: 1251812 - DNA, 22 bp, Artificial Sequence
  chemically synthesized
atttattggtccccactttctc

SEQ ID NO: 1251813 - DNA, 22 bp, Artificial Sequence
  chemically synthesized
ttaagtaggaatgagaaagtgg

SEQ ID NO: 1251814 - DNA, 22 bp, Artificial Sequence
  chemically synthesized
attggtccccactttctcattc

SEQ ID NO: 1251815 - DNA, 22 bp, Artificial Sequence
  chemically synthesized
ttggtccccactttctcattcc

SEQ ID NO: 1251816 - DNA, 22 bp, Artificial Sequence
  chemically synthesized
gtccccactttctcattcctac

SEQ ID NO: 1251817 - DNA, 22 bp, Artificial Sequence
  chemically synthesized
gatatgccatcctattaagtag

SEQ ID NO: 1251818 - DNA, 22 bp, Artificial Sequence
  chemically synthesized
tctcattcctacttaataggat

SEQ ID NO: 1251819 - DNA, 22 bp, Artificial Sequence
  chemically synthesized
ctcattcctacttaataggatg

SEQ ID NO: 1251820 - DNA, 22 bp, Artificial Sequence
  chemically synthesized
tcattcctacttaataggatgg

SEQ ID NO: 1251821 - DNA, 22 bp, Artificial Sequence
  chemically synthesized
attcctacttaataggatggca

SEQ ID NO: 1251822 - DNA, 22 bp, Artificial Sequence
  chemically synthesized
ctacttaataggatggcatatc

SEQ ID NO: 1251823 - DNA, 22 bp, Artificial Sequence
  chemically synthesized
ccaccataggctagatatgcca

SEQ ID NO: 1251824 - DNA, 22 bp, Artificial Sequence
  chemically synthesized
cccaccataggctagatatgcc

SEQ ID NO: 1251825 - DNA, 22 bp, Artificial Sequence
  chemically synthesized
cttaataggatggcatatctag

SEQ ID NO: 1251826 - DNA, 22 bp, Artificial Sequence
  chemically synthesized
aataggatggcatatctagcct

SEQ ID NO: 1251827 - DNA, 22 bp, Artificial Sequence
  chemically synthesized
ataggatggcatatctagccta

SEQ ID NO: 1251828 - DNA, 22 bp, Artificial Sequence
  chemically synthesized
tcacatttcccaccataggcta

SEQ ID NO: 1251829 - DNA, 22 bp, Artificial Sequence
  chemically synthesized
accaaaggctatcacatttccc

SEQ ID NO: 1251830 - DNA, 22 bp, Artificial Sequence
  chemically synthesized
gcctatggtgggaaatgtgata

SEQ ID NO: 1251831 - DNA, 22 bp, Artificial Sequence
  chemically synthesized
tggtgggaaatgtgatagcctt

SEQ ID NO: 1251832 - DNA, 22 bp, Artificial Sequence
  chemically synthesized
acaccccgttgaccaaaggcta

SEQ ID NO: 1251833 - DNA, 22 bp, Artificial Sequence
  chemically synthesized
aacaccccgttgaccaaaggct

SEQ ID NO: 1251834 - DNA, 22 bp, Artificial Sequence
  chemically synthesized
ttaacaccccgttgaccaaagg

SEQ ID NO: 1251835 - DNA, 22 bp, Artificial Sequence
  chemically synthesized
cttaacaccccgttgaccaaag

SEQ ID NO: 1251836 - DNA, 22 bp, Artificial Sequence
  chemically synthesized
tcttaacaccccgttgaccaaa

SEQ ID NO: 1251837 - DNA, 22 bp, Artificial Sequence
  chemically synthesized
tcatgttttcttaacaccccgt

SEQ ID NO: 1251838 - DNA, 22 bp, Artificial Sequence
  chemically synthesized
ctgtcatgttttcttaacaccc

SEQ ID NO: 1251839 - DNA, 22 bp, Artificial Sequence
  chemically synthesized
tggtcaacggggtgttaagaaa

SEQ ID NO: 1251840 - DNA, 22 bp, Artificial Sequence
  chemically synthesized
ctcctgtcatgttttcttaaca

SEQ ID NO: 1251841 - DNA, 22 bp, Artificial Sequence
  chemically synthesized
ggtcaacggggtgttaagaaaa

SEQ ID NO: 1251842 - DNA, 22 bp, Artificial Sequence
  chemically synthesized
gtcaacggggtgttaagaaaac

SEQ ID NO: 1251843 - DNA, 22 bp, Artificial Sequence
  chemically synthesized
tgctcctgtcatgttttcttaa

SEQ ID NO: 1251844 - DNA, 22 bp, Artificial Sequence
  chemically synthesized
aaggctctgctcctgtcatgtt

SEQ ID NO: 1251845 - DNA, 22 bp, Artificial Sequence
  chemically synthesized
agaaaacatgacaggagcagag

SEQ ID NO: 1251846 - DNA, 22 bp, Artificial Sequence
  chemically synthesized
gatagcaagcccaaacatgcca

SEQ ID NO: 1251847 - DNA, 22 bp, Artificial Sequence
  chemically synthesized
gagatgggctggcatgtttggg

SEQ ID NO: 1251848 - DNA, 22 bp, Artificial Sequence
  chemically synthesized
agatgggctggcatgtttgggc

SEQ ID NO: 1251849 - DNA, 22 bp, Artificial Sequence
  chemically synthesized
tcactagatagcaagcccaaac

SEQ ID NO: 1251850 - DNA, 22 bp, Artificial Sequence
  chemically synthesized
gcatgtttgggcttgctatcta

SEQ ID NO: 1251851 - DNA, 22 bp, Artificial Sequence
  chemically synthesized
ataggttgtcactagatagcaa

SEQ ID NO: 1251852 - DNA, 22 bp, Artificial Sequence
  chemically synthesized
cataggttgtcactagatagca

SEQ ID NO: 1251853 - DNA, 22 bp, Artificial Sequence
  chemically synthesized
tcataggttgtcactagatagc

SEQ ID NO: 1251854 - DNA, 22 bp, Artificial Sequence
  chemically synthesized
gggcttgctatctagtgacaac

SEQ ID NO: 1251855 - DNA, 22 bp, Artificial Sequence
  chemically synthesized
ggcttgctatctagtgacaacc

SEQ ID NO: 1251856 - DNA, 22 bp, Artificial Sequence
  chemically synthesized
gctatctagtgacaacctatga

SEQ ID NO: 1251857 - DNA, 22 bp, Artificial Sequence
  chemically synthesized
ctatctagtgacaacctatgaa

SEQ ID NO: 1251858 - DNA, 22 bp, Artificial Sequence
  chemically synthesized
tctagtgacaacctatgaaaac

SEQ ID NO: 1251859 - DNA, 22 bp, Artificial Sequence
  chemically synthesized
gtgacaacctatgaaaacatgc

SEQ ID NO: 1251860 - DNA, 22 bp, Artificial Sequence
  chemically synthesized
gaatggcaccggccacccagtg

SEQ ID NO: 1251861 - DNA, 22 bp, Artificial Sequence
  chemically synthesized
tgaaaacatgcactgggtggcc

SEQ ID NO: 1251862 - DNA, 22 bp, Artificial Sequence
  chemically synthesized
ggtggccggtgccattccagtg

SEQ ID NO: 1251863 - DNA, 22 bp, Artificial Sequence
  chemically synthesized
atgtgtcacgtccagaggcaca

SEQ ID NO: 1251864 - DNA, 22 bp, Artificial Sequence
  chemically synthesized
gatgtgtcacgtccagaggcac

SEQ ID NO: 1251865 - DNA, 22 bp, Artificial Sequence
  chemically synthesized
tgatgtgtcacgtccagaggca

SEQ ID NO: 1251866 - DNA, 22 bp, Artificial Sequence
  chemically synthesized
tttgatgtgtcacgtccagagg

SEQ ID NO: 1251867 - DNA, 22 bp, Artificial Sequence
  chemically synthesized
ctttgatgtgtcacgtccagag

SEQ ID NO: 1251868 - DNA, 22 bp, Artificial Sequence
  chemically synthesized
cagtgtgtgcctctggacgtga

SEQ ID NO: 1251869 - DNA, 22 bp, Artificial Sequence
  chemically synthesized
gatttctttgatgtgtcacgtc

SEQ ID NO: 1251870 - DNA, 22 bp, Artificial Sequence
  chemically synthesized
ggatttctttgatgtgtcacgt

SEQ ID NO: 1251871 - DNA, 22 bp, Artificial Sequence
  chemically synthesized
gtttggatttctttgatgtgtc

SEQ ID NO: 1251872 - DNA, 22 bp, Artificial Sequence
  chemically synthesized
ggtttggatttctttgatgtgt

SEQ ID NO: 1251873 - DNA, 22 bp, Artificial Sequence
  chemically synthesized
tggacgtgacacatcaaagaaa

SEQ ID NO: 1251874 - DNA, 22 bp, Artificial Sequence
  chemically synthesized
gacgtgacacatcaaagaaatc

SEQ ID NO: 1251875 - DNA, 22 bp, Artificial Sequence
  chemically synthesized
agcggcaggtttggtttggatt

SEQ ID NO: 1251876 - DNA, 22 bp, Artificial Sequence
  chemically synthesized
cagcggcaggtttggtttggat

SEQ ID NO: 1251877 - DNA, 22 bp, Artificial Sequence
  chemically synthesized
tcagcggcaggtttggtttgga

SEQ ID NO: 1251878 - DNA, 22 bp, Artificial Sequence
  chemically synthesized
gctttcagcggcaggtttggtt

SEQ ID NO: 1251879 - DNA, 22 bp, Artificial Sequence
  chemically synthesized
ggctttcagcggcaggtttggt

SEQ ID NO: 1251880 - DNA, 22 bp, Artificial Sequence
  chemically synthesized
ggcttggctttcagcggcaggt

SEQ ID NO: 1251881 - DNA, 22 bp, Artificial Sequence
  chemically synthesized
ctaggcttggctttcagcggca

SEQ ID NO: 1251882 - DNA, 22 bp, Artificial Sequence
  chemically synthesized
gtagttgctaggcttggctttc

SEQ ID NO: 1251883 - DNA, 22 bp, Artificial Sequence
  chemically synthesized
ccgctgaaagccaagcctagca

SEQ ID NO: 1251884 - DNA, 22 bp, Artificial Sequence
  chemically synthesized
catcaggctggtagttgctagg

SEQ ID NO: 1251885 - DNA, 22 bp, Artificial Sequence
  chemically synthesized
tgcatcaggctggtagttgcta

SEQ ID NO: 1251886 - DNA, 22 bp, Artificial Sequence
  chemically synthesized
aaagccaagcctagcaactacc

SEQ ID NO: 1251887 - DNA, 22 bp, Artificial Sequence
  chemically synthesized
gttctgcatcaggctggtagtt

SEQ ID NO: 1251888 - DNA, 22 bp, Artificial Sequence
  chemically synthesized
ggttctgcatcaggctggtagt

SEQ ID NO: 1251889 - DNA, 22 bp, Artificial Sequence
  chemically synthesized
gatttggttctgcatcaggctg

SEQ ID NO: 1251890 - DNA, 22 bp, Artificial Sequence
  chemically synthesized
gcaactaccagcctgatgcaga

SEQ ID NO: 1251891 - DNA, 22 bp, Artificial Sequence
  chemically synthesized
atctagatttggttctgcatca

SEQ ID NO: 1251892 - DNA, 22 bp, Artificial Sequence
  chemically synthesized
agttgatctagatttggttctg

SEQ ID NO: 1251893 - DNA, 22 bp, Artificial Sequence
  chemically synthesized
ccagcctgatgcagaaccaaat

SEQ ID NO: 1251894 - DNA, 22 bp, Artificial Sequence
  chemically synthesized
acctaagttgatctagatttgg

SEQ ID NO: 1251895 - DNA, 22 bp, Artificial Sequence
  chemically synthesized
atgcagaaccaaatctagatca

SEQ ID NO: 1251896 - DNA, 22 bp, Artificial Sequence
  chemically synthesized
gctgacctaagttgatctagat

SEQ ID NO: 1251897 - DNA, 22 bp, Artificial Sequence
  chemically synthesized
ggctgacctaagttgatctaga

SEQ ID NO: 1251898 - DNA, 22 bp, Artificial Sequence
  chemically synthesized
gatcaacttaggtcagccaaac

SEQ ID NO: 1251899 - DNA, 22 bp, Artificial Sequence
  chemically synthesized
atggtcatgcggggtttggctg

SEQ ID NO: 1251900 - DNA, 22 bp, Artificial Sequence
  chemically synthesized
tcatggtcatgcggggtttggc

SEQ ID NO: 1251901 - DNA, 22 bp, Artificial Sequence
  chemically synthesized
attctcatggtcatgcggggtt

SEQ ID NO: 1251902 - DNA, 22 bp, Artificial Sequence
  chemically synthesized
aggtcagccaaaccccgcatga

SEQ ID NO: 1251903 - DNA, 22 bp, Artificial Sequence
  chemically synthesized
ggtcagccaaaccccgcatgac

SEQ ID NO: 1251904 - DNA, 22 bp, Artificial Sequence
  chemically synthesized
aatagcattaattctcatggtc

SEQ ID NO: 1251905 - DNA, 22 bp, Artificial Sequence
  chemically synthesized
aaatagcattaattctcatggt

SEQ ID NO: 1251906 - DNA, 22 bp, Artificial Sequence
  chemically synthesized
taaatagcattaattctcatgg

SEQ ID NO: 1251907 - DNA, 22 bp, Artificial Sequence
  chemically synthesized
atggttttaaatagcattaatt

SEQ ID NO: 1251908 - DNA, 22 bp, Artificial Sequence
  chemically synthesized
aatggttttaaatagcattaat

SEQ ID NO: 1251909 - DNA, 22 bp, Artificial Sequence
  chemically synthesized
caacttaatggttttaaatagc

SEQ ID NO: 1251910 - DNA, 22 bp, Artificial Sequence
  chemically synthesized
cctccaacttaatggttttaaa

SEQ ID NO: 1251911 - DNA, 22 bp, Artificial Sequence
  chemically synthesized
atgctatttaaaaccattaagt

SEQ ID NO: 1251912 - DNA, 22 bp, Artificial Sequence
  chemically synthesized
tttaaaaccattaagttggagg

SEQ ID NO: 1251913 - DNA, 22 bp, Artificial Sequence
  chemically synthesized
aaaaccattaagttggaggtaa

SEQ ID NO: 1251914 - DNA, 22 bp, Artificial Sequence
  chemically synthesized
aaaccattaagttggaggtaat

SEQ ID NO: 1251915 - DNA, 22 bp, Artificial Sequence
  chemically synthesized
agttggaggtaatgattattac

SEQ ID NO: 1251916 - DNA, 22 bp, Artificial Sequence
  chemically synthesized
aaaacaataatatcaagtaata

SEQ ID NO: 1251917 - DNA, 22 bp, Artificial Sequence
  chemically synthesized
gaggtaatgattattacttgat

SEQ ID NO: 1251918 - DNA, 22 bp, Artificial Sequence
  chemically synthesized
tcaaaacaataatatcaagtaa

SEQ ID NO: 1251919 - DNA, 22 bp, Artificial Sequence
  chemically synthesized
gtcagctctcaaaacaataata

SEQ ID NO: 1251920 - DNA, 22 bp, Artificial Sequence
  chemically synthesized
ttacttgatattattgttttga

SEQ ID NO: 1251921 - DNA, 22 bp, Artificial Sequence
  chemically synthesized
cttgatattattgttttgagag

SEQ ID NO: 1251922 - DNA, 22 bp, Artificial Sequence
  chemically synthesized
gatattattgttttgagagctg

SEQ ID NO: 1251923 - DNA, 22 bp, Artificial Sequence
  chemically synthesized
atattattgttttgagagctga

SEQ ID NO: 1251924 - DNA, 22 bp, Artificial Sequence
  chemically synthesized
ggcagatgtattggtcagctct

SEQ ID NO: 1251925 - DNA, 22 bp, Artificial Sequence
  chemically synthesized
gggcagatgtattggtcagctc

SEQ ID NO: 1251926 - DNA, 22 bp, Artificial Sequence
  chemically synthesized
ttgttttgagagctgaccaata

SEQ ID NO: 1251927 - DNA, 22 bp, Artificial Sequence
  chemically synthesized
tttgggcagatgtattggtcag

SEQ ID NO: 1251928 - DNA, 22 bp, Artificial Sequence
  chemically synthesized
atttgggcagatgtattggtca

SEQ ID NO: 1251929 - DNA, 22 bp, Artificial Sequence
  chemically synthesized
ttttgagagctgaccaatacat

SEQ ID NO: 1251930 - DNA, 22 bp, Artificial Sequence
  chemically synthesized
tgagagctgaccaatacatctg

SEQ ID NO: 1251931 - DNA, 22 bp, Artificial Sequence
  chemically synthesized
gagagctgaccaatacatctgc

SEQ ID NO: 1251932 - DNA, 22 bp, Artificial Sequence
  chemically synthesized
agagctgaccaatacatctgcc

SEQ ID NO: 1251933 - DNA, 22 bp, Artificial Sequence
  chemically synthesized
accaatacatctgcccaaataa

SEQ ID NO: 1251934 - DNA, 22 bp, Artificial Sequence
  chemically synthesized
cccaaataaacgcgtttgttca

SEQ ID NO: 1251935 - DNA, 22 bp, Artificial Sequence
  chemically synthesized
agtacaacatcatgatgtgaac

SEQ ID NO: 1251936 - DNA, 22 bp, Artificial Sequence
  chemically synthesized
taggggttcagtacaacatcat

SEQ ID NO: 1251937 - DNA, 22 bp, Artificial Sequence
  chemically synthesized
gttcacatcatgatgttgtact

SEQ ID NO: 1251938 - DNA, 22 bp, Artificial Sequence
  chemically synthesized
ttcacatcatgatgttgtactg

SEQ ID NO: 1251939 - DNA, 22 bp, Artificial Sequence
  chemically synthesized
acatcatgatgttgtactgaac

SEQ ID NO: 1251940 - DNA, 22 bp, Artificial Sequence
  chemically synthesized
agggttataggggttcagtaca

SEQ ID NO: 1251941 - DNA, 22 bp, Artificial Sequence
  chemically synthesized
ttgagggttataggggttcagt

SEQ ID NO: 1251942 - DNA, 22 bp, Artificial Sequence
  chemically synthesized
gctattgagggttataggggtt

SEQ ID NO: 1251943 - DNA, 22 bp, Artificial Sequence
  chemically synthesized
cgctattgagggttataggggt

SEQ ID NO: 1251944 - DNA, 22 bp, Artificial Sequence
  chemically synthesized
tactgaacccctataaccctca

SEQ ID NO: 1251945 - DNA, 22 bp, Artificial Sequence
  chemically synthesized
atgccttcgctattgagggtta

SEQ ID NO: 1251946 - DNA, 22 bp, Artificial Sequence
  chemically synthesized
aacccctataaccctcaatagc

SEQ ID NO: 1251947 - DNA, 22 bp, Artificial Sequence
  chemically synthesized
aacctgatgccttcgctattga

SEQ ID NO: 1251948 - DNA, 22 bp, Artificial Sequence
  chemically synthesized
gaacctgatgccttcgctattg

SEQ ID NO: 1251949 - DNA, 22 bp, Artificial Sequence
  chemically synthesized
ttgaacctgatgccttcgctat

SEQ ID NO: 1251950 - DNA, 22 bp, Artificial Sequence
  chemically synthesized
taaccctcaatagcgaaggcat

SEQ ID NO: 1251951 - DNA, 22 bp, Artificial Sequence
  chemically synthesized
agtctcttgaacctgatgcctt

SEQ ID NO: 1251952 - DNA, 22 bp, Artificial Sequence
  chemically synthesized
ctcagtctcttgaacctgatgc

SEQ ID NO: 1251953 - DNA, 22 bp, Artificial Sequence
  chemically synthesized
cctcagtctcttgaacctgatg

SEQ ID NO: 1251954 - DNA, 22 bp, Artificial Sequence
  chemically synthesized
aatagcgaaggcatcaggttca

SEQ ID NO: 1251955 - DNA, 22 bp, Artificial Sequence
  chemically synthesized
ttcctcagtctcttgaacctga

SEQ ID NO: 1251956 - DNA, 22 bp, Artificial Sequence
  chemically synthesized
cttcctcagtctcttgaacctg

SEQ ID NO: 1251957 - DNA, 22 bp, Artificial Sequence
  chemically synthesized
tgggtttcttcctcagtctctt

SEQ ID NO: 1251958 - DNA, 22 bp, Artificial Sequence
  chemically synthesized
gctatgggtttcttcctcagtc

SEQ ID NO: 1251959 - DNA, 22 bp, Artificial Sequence
  chemically synthesized
ctggctatgggtttcttcctca

SEQ ID NO: 1251960 - DNA, 22 bp, Artificial Sequence
  chemically synthesized
gctggctatgggtttcttcctc

SEQ ID NO: 1251961 - DNA, 22 bp, Artificial Sequence
  chemically synthesized
aagagactgaggaagaaaccca

SEQ ID NO: 1251962 - DNA, 22 bp, Artificial Sequence
  chemically synthesized
gtttgctggctatgggtttctt

SEQ ID NO: 1251963 - DNA, 22 bp, Artificial Sequence
  chemically synthesized
aggaagaaacccatagccagca

SEQ ID NO: 1251964 - DNA, 22 bp, Artificial Sequence
  chemically synthesized
ataaaacccaatgcctcgtttg

SEQ ID NO: 1251965 - DNA, 22 bp, Artificial Sequence
  chemically synthesized
taataaaacccaatgcctcgtt

SEQ ID NO: 1251966 - DNA, 22 bp, Artificial Sequence
  chemically synthesized
tatgtaaacctctaataaaacc

SEQ ID NO: 1251967 - DNA, 22 bp, Artificial Sequence
  chemically synthesized
ccctgtatgtaaacctctaata

SEQ ID NO: 1251968 - DNA, 22 bp, Artificial Sequence
  chemically synthesized
cctcccctgtatgtaaacctct

SEQ ID NO: 1251969 - DNA, 22 bp, Artificial Sequence
  chemically synthesized
ggttttattagaggtttacata

SEQ ID NO: 1251970 - DNA, 22 bp, Artificial Sequence
  chemically synthesized
aattccctcccctgtatgtaaa

SEQ ID NO: 1251971 - DNA, 22 bp, Artificial Sequence
  chemically synthesized
tattagaggtttacatacaggg

SEQ ID NO: 1251972 - DNA, 22 bp, Artificial Sequence
  chemically synthesized
ctgaattccctcccctgtatgt

SEQ ID NO: 1251973 - DNA, 22 bp, Artificial Sequence
  chemically synthesized
attagaggtttacatacagggg

SEQ ID NO: 1251974 - DNA, 22 bp, Artificial Sequence
  chemically synthesized
ttagaggtttacatacagggga

SEQ ID NO: 1251975 - DNA, 22 bp, Artificial Sequence
  chemically synthesized
gaggtttacatacaggggaggg

SEQ ID NO: 1251976 - DNA, 22 bp, Artificial Sequence
  chemically synthesized
acatacaggggagggaattcag

SEQ ID NO: 1251977 - DNA, 22 bp, Artificial Sequence
  chemically synthesized
catacaggggagggaattcagt

SEQ ID NO: 1251978 - DNA, 22 bp, Artificial Sequence
  chemically synthesized
tccagcccaccactactgaatt

SEQ ID NO: 1251979 - DNA, 22 bp, Artificial Sequence
  chemically synthesized
ctgtccagcccaccactactga

SEQ ID NO: 1251980 - DNA, 22 bp, Artificial Sequence
  chemically synthesized
tcctgtccagcccaccactact

SEQ ID NO: 1251981 - DNA, 22 bp, Artificial Sequence
  chemically synthesized
ctcctgtccagcccaccactac

SEQ ID NO: 1251982 - DNA, 22 bp, Artificial Sequence
  chemically synthesized
agtagtggtgggctggacagga

SEQ ID NO: 1251983 - DNA, 22 bp, Artificial Sequence
  chemically synthesized
caggtaaggcacttctcctgtc

SEQ ID NO: 1251984 - DNA, 22 bp, Artificial Sequence
  chemically synthesized
tacaggtaaggcacttctcctg

SEQ ID NO: 1251985 - DNA, 22 bp, Artificial Sequence
  chemically synthesized
ctacaggtaaggcacttctcct

SEQ ID NO: 1251986 - DNA, 22 bp, Artificial Sequence
  chemically synthesized
gatcgtttctacaggtaaggca

SEQ ID NO: 1251987 - DNA, 22 bp, Artificial Sequence
  chemically synthesized
gacaggagaagtgccttacctg

SEQ ID NO: 1251988 - DNA, 22 bp, Artificial Sequence
  chemically synthesized
ccaccactggatcgtttctaca

SEQ ID NO: 1251989 - DNA, 22 bp, Artificial Sequence
  chemically synthesized
acctgtagaaacgatccagtgg

SEQ ID NO: 1251990 - DNA, 22 bp, Artificial Sequence
  chemically synthesized
tccagtctgccaccactggatc

SEQ ID NO: 1251991 - DNA, 22 bp, Artificial Sequence
  chemically synthesized
cctgtagaaacgatccagtggt

SEQ ID NO: 1251992 - DNA, 22 bp, Artificial Sequence
  chemically synthesized
gtccagtctgccaccactggat

SEQ ID NO: 1251993 - DNA, 22 bp, Artificial Sequence
  chemically synthesized
tagaaacgatccagtggtggca

SEQ ID NO: 1251994 - DNA, 22 bp, Artificial Sequence
  chemically synthesized
tcttgtccagtctgccaccact

SEQ ID NO: 1251995 - DNA, 22 bp, Artificial Sequence
  chemically synthesized
cgaggctatcttgtccagtctg

SEQ ID NO: 1251996 - DNA, 22 bp, Artificial Sequence
  chemically synthesized
tgctgcgaggctatcttgtcca

SEQ ID NO: 1251997 - DNA, 22 bp, Artificial Sequence
  chemically synthesized
ccactgtgctgcgaggctatct

SEQ ID NO: 1251998 - DNA, 22 bp, Artificial Sequence
  chemically synthesized
gacaagatagcctcgcagcaca

SEQ ID NO: 1251999 - DNA, 22 bp, Artificial Sequence
  chemically synthesized
atcccaccgccgccatcactac

SEQ ID NO: 1252000 - DNA, 22 bp, Artificial Sequence
  chemically synthesized
gcagcacagtggtagtgatggc

SEQ ID NO: 1252001 - DNA, 22 bp, Artificial Sequence
  chemically synthesized
cccgctcatcccaccgccgcca

SEQ ID NO: 1252002 - DNA, 22 bp, Artificial Sequence
  chemically synthesized
gcccgctcatcccaccgccgcc

SEQ ID NO: 1252003 - DNA, 22 bp, Artificial Sequence
  chemically synthesized
gtttgcccgctcatcccaccgc

SEQ ID NO: 1252004 - DNA, 22 bp, Artificial Sequence
  chemically synthesized
cccgcaagcagcgttggtttgc

SEQ ID NO: 1252005 - DNA, 22 bp, Artificial Sequence
  chemically synthesized
catgctgcccgcaagcagcgtt

SEQ ID NO: 1252006 - DNA, 22 bp, Artificial Sequence
  chemically synthesized
tataaactgcatgctgcccgca

SEQ ID NO: 1252007 - DNA, 22 bp, Artificial Sequence
  chemically synthesized
cttgcgggcagcatgcagttta

SEQ ID NO: 1252008 - DNA, 22 bp, Artificial Sequence
  chemically synthesized
gcgggcagcatgcagtttatat

SEQ ID NO: 1252009 - DNA, 22 bp, Artificial Sequence
  chemically synthesized
agtaaaaatgctatataaactg

SEQ ID NO: 1252010 - DNA, 22 bp, Artificial Sequence
  chemically synthesized
cgggcagcatgcagtttatata

SEQ ID NO: 1252011 - DNA, 22 bp, Artificial Sequence
  chemically synthesized
agggcagagggttaagtaaaaa

SEQ ID NO: 1252012 - DNA, 22 bp, Artificial Sequence
  chemically synthesized
atatagcatttttacttaaccc

SEQ ID NO: 1252013 - DNA, 22 bp, Artificial Sequence
  chemically synthesized
tatagcatttttacttaaccct

SEQ ID NO: 1252014 - DNA, 22 bp, Artificial Sequence
  chemically synthesized
ttacttaaccctctgcccttaa

SEQ ID NO: 1252015 - DNA, 22 bp, Artificial Sequence
  chemically synthesized
tacttaaccctctgcccttaat

SEQ ID NO: 1252016 - DNA, 22 bp, Artificial Sequence
  chemically synthesized
acttaaccctctgcccttaatg

SEQ ID NO: 1252017 - DNA, 22 bp, Artificial Sequence
  chemically synthesized
ccaggtgaacgtcattaagggc

SEQ ID NO: 1252018 - DNA, 22 bp, Artificial Sequence
  chemically synthesized
cttaaccctctgcccttaatga

SEQ ID NO: 1252019 - DNA, 22 bp, Artificial Sequence
  chemically synthesized
aaccctctgcccttaatgacgt

SEQ ID NO: 1252020 - DNA, 22 bp, Artificial Sequence
  chemically synthesized
accctctgcccttaatgacgtt

SEQ ID NO: 1252021 - DNA, 22 bp, Artificial Sequence
  chemically synthesized
tgcccttaatgacgttcacctg

SEQ ID NO: 1252022 - DNA, 22 bp, Artificial Sequence
  chemically synthesized
gatgaaggttgccaggtgaacg

SEQ ID NO: 1252023 - DNA, 22 bp, Artificial Sequence
  chemically synthesized
cccttaatgacgttcacctggc

SEQ ID NO: 1252024 - DNA, 22 bp, Artificial Sequence
  chemically synthesized
ggttggatgaaggttgccaggt

SEQ ID NO: 1252025 - DNA, 22 bp, Artificial Sequence
  chemically synthesized
gggttggatgaaggttgccagg

SEQ ID NO: 1252026 - DNA, 22 bp, Artificial Sequence
  chemically synthesized
aatgacgttcacctggcaacct

SEQ ID NO: 1252027 - DNA, 22 bp, Artificial Sequence
  chemically synthesized
tgggttggatgaaggttgccag

SEQ ID NO: 1252028 - DNA, 22 bp, Artificial Sequence
  chemically synthesized
atgacgttcacctggcaacctt

SEQ ID NO: 1252029 - DNA, 22 bp, Artificial Sequence
  chemically synthesized
acctggcaaccttcatccaacc

SEQ ID NO: 1252030 - DNA, 22 bp, Artificial Sequence
  chemically synthesized
aggccccgagttttgggttgga

SEQ ID NO: 1252031 - DNA, 22 bp, Artificial Sequence
  chemically synthesized
gcaaccttcatccaacccaaaa

SEQ ID NO: 1252032 - DNA, 22 bp, Artificial Sequence
  chemically synthesized
catccaacccaaaactcggggc

SEQ ID NO: 1252033 - DNA, 22 bp, Artificial Sequence
  chemically synthesized
atccaacccaaaactcggggcc

SEQ ID NO: 1252034 - DNA, 22 bp, Artificial Sequence
  chemically synthesized
ggggcctcaatccgctgtatgt

SEQ ID NO: 1252035 - DNA, 22 bp, Artificial Sequence
  chemically synthesized
aatccgctgtatgtatggcccg

SEQ ID NO: 1252036 - DNA, 22 bp, Artificial Sequence
  chemically synthesized
tatgtatggcccgtgttccacg

SEQ ID NO: 1252037 - DNA, 22 bp, Artificial Sequence
  chemically synthesized
agccccaagtgcatcccgtgga

SEQ ID NO: 1252038 - DNA, 22 bp, Artificial Sequence
  chemically synthesized
tgaggaacatctgagccccaag

SEQ ID NO: 1252039 - DNA, 22 bp, Artificial Sequence
  chemically synthesized
cacgggatgcacttggggctca

SEQ ID NO: 1252040 - DNA, 22 bp, Artificial Sequence
  chemically synthesized
tctatgaggaacatctgagccc

SEQ ID NO: 1252041 - DNA, 22 bp, Artificial Sequence
  chemically synthesized
gtctatgaggaacatctgagcc

SEQ ID NO: 1252042 - DNA, 22 bp, Artificial Sequence
  chemically synthesized
cttgtctatgaggaacatctga

SEQ ID NO: 1252043 - DNA, 22 bp, Artificial Sequence
  chemically synthesized
ccttgtctatgaggaacatctg

SEQ ID NO: 1252044 - DNA, 22 bp, Artificial Sequence
  chemically synthesized
ggggctcagatgttcctcatag

SEQ ID NO: 1252045 - DNA, 22 bp, Artificial Sequence
  chemically synthesized
gggctcagatgttcctcataga

SEQ ID NO: 1252046 - DNA, 22 bp, Artificial Sequence
  chemically synthesized
agatgttcctcatagacaagga

SEQ ID NO: 1252047 - DNA, 22 bp, Artificial Sequence
  chemically synthesized
ctcatagacaaggaagggctct

SEQ ID NO: 1252048 - DNA, 22 bp, Artificial Sequence
  chemically synthesized
atagacaaggaagggctctctt

SEQ ID NO: 1252049 - DNA, 22 bp, Artificial Sequence
  chemically synthesized
ggagtagcccagcaagagagcc

SEQ ID NO: 1252050 - DNA, 22 bp, Artificial Sequence
  chemically synthesized
cggaatctgggagtagcccagc

SEQ ID NO: 1252051 - DNA, 22 bp, Artificial Sequence
  chemically synthesized
cgagctacggaatctgggagta

SEQ ID NO: 1252052 - DNA, 22 bp, Artificial Sequence
  chemically synthesized
tcttgctgggctactcccagat

SEQ ID NO: 1252053 - DNA, 22 bp, Artificial Sequence
  chemically synthesized
ccgagctacggaatctgggagt

SEQ ID NO: 1252054 - DNA, 22 bp, Artificial Sequence
  chemically synthesized
tccgagctacggaatctgggag

SEQ ID NO: 1252055 - DNA, 22 bp, Artificial Sequence
  chemically synthesized
ttgctgggctactcccagattc

SEQ ID NO: 1252056 - DNA, 22 bp, Artificial Sequence
  chemically synthesized
gctgggctactcccagattccg

SEQ ID NO: 1252057 - DNA, 22 bp, Artificial Sequence
  chemically synthesized
ctgggctactcccagattccgt

SEQ ID NO: 1252058 - DNA, 22 bp, Artificial Sequence
  chemically synthesized
ggctactcccagattccgtagc

SEQ ID NO: 1252059 - DNA, 22 bp, Artificial Sequence
  chemically synthesized
aatgtgttttccgagctacgga

SEQ ID NO: 1252060 - DNA, 22 bp, Artificial Sequence
  chemically synthesized
ctcccagattccgtagctcgga

SEQ ID NO: 1252061 - DNA, 22 bp, Artificial Sequence
  chemically synthesized
ccagattccgtagctcggaaaa

SEQ ID NO: 1252062 - DNA, 22 bp, Artificial Sequence
  chemically synthesized
cagacacacctgaatgtgtttt

SEQ ID NO: 1252063 - DNA, 22 bp, Artificial Sequence
  chemically synthesized
cgtagctcggaaaacacattca

SEQ ID NO: 1252064 - DNA, 22 bp, Artificial Sequence
  chemically synthesized
tactgcagacacacctgaatgt

SEQ ID NO: 1252065 - DNA, 22 bp, Artificial Sequence
  chemically synthesized
ggaaaacacattcaggtgtgtc

SEQ ID NO: 1252066 - DNA, 22 bp, Artificial Sequence
  chemically synthesized
gaatgaccctgtactgcagaca

SEQ ID NO: 1252067 - DNA, 22 bp, Artificial Sequence
  chemically synthesized
agaatgaccctgtactgcagac

SEQ ID NO: 1252068 - DNA, 22 bp, Artificial Sequence
  chemically synthesized
aggtgtgtctgcagtacagggt

SEQ ID NO: 1252069 - DNA, 22 bp, Artificial Sequence
  chemically synthesized
cagtacagggtcattctaaggg

SEQ ID NO: 1252070 - DNA, 22 bp, Artificial Sequence
  chemically synthesized
caataatgtgcgcataccctta

SEQ ID NO: 1252071 - DNA, 22 bp, Artificial Sequence
  chemically synthesized
attgcaataatgtgcgcatacc

SEQ ID NO: 1252072 - DNA, 22 bp, Artificial Sequence
  chemically synthesized
taagggtatgcgcacattattg

SEQ ID NO: 1252073 - DNA, 22 bp, Artificial Sequence
  chemically synthesized
agggtatgcgcacattattgca

SEQ ID NO: 1252074 - DNA, 22 bp, Artificial Sequence
  chemically synthesized
ttgcaatcaggtgcatttacca

SEQ ID NO: 1252075 - DNA, 22 bp, Artificial Sequence
  chemically synthesized
caatcaggtgcatttaccatat

SEQ ID NO: 1252076 - DNA, 22 bp, Artificial Sequence
  chemically synthesized
accatatacttgattacctatc

SEQ ID NO: 1252077 - DNA, 22 bp, Artificial Sequence
  chemically synthesized
ccatatacttgattacctatct

SEQ ID NO: 1252078 - DNA, 22 bp, Artificial Sequence
  chemically synthesized
gattacctatcttactggttat

SEQ ID NO: 1252079 - DNA, 22 bp, Artificial Sequence
  chemically synthesized
attacctatcttactggttatg

SEQ ID NO: 1252080 - DNA, 22 bp, Artificial Sequence
  chemically synthesized
cctatcttactggttatgttgt

SEQ ID NO: 1252081 - DNA, 22 bp, Artificial Sequence
  chemically synthesized
tcttactggttatgttgttgtt

SEQ ID NO: 1252082 - DNA, 22 bp, Artificial Sequence
  chemically synthesized
actggttatgttgttgttttgt

SEQ ID NO: 1252083 - DNA, 22 bp, Artificial Sequence
  chemically synthesized
ctggttatgttgttgttttgtg

SEQ ID NO: 1252084 - DNA, 22 bp, Artificial Sequence
  chemically synthesized
gttatgttgttgttttgtgtgt

SEQ ID NO: 1252085 - DNA, 22 bp, Artificial Sequence
  chemically synthesized
tgttgttgttttgtgtgtacgt

SEQ ID NO: 1252086 - DNA, 22 bp, Artificial Sequence
  chemically synthesized
ttgttttgtgtgtacgtgtgtg

SEQ ID NO: 1252087 - DNA, 22 bp, Artificial Sequence
  chemically synthesized
ttttgtgtgtacgtgtgtgtat

SEQ ID NO: 1252088 - DNA, 22 bp, Artificial Sequence
  chemically synthesized
tgtgtgtacgtgtgtgtatgca

SEQ ID NO: 1252089 - DNA, 22 bp, Artificial Sequence
  chemically synthesized
taaaaacacccatgcatacaca

SEQ ID NO: 1252090 - DNA, 22 bp, Artificial Sequence
  chemically synthesized
gtgtgtacgtgtgtgtatgcat

SEQ ID NO: 1252091 - DNA, 22 bp, Artificial Sequence
  chemically synthesized
tgtgtacgtgtgtgtatgcatg

SEQ ID NO: 1252092 - DNA, 22 bp, Artificial Sequence
  chemically synthesized
tgtaaaaacacccatgcataca

SEQ ID NO: 1252093 - DNA, 22 bp, Artificial Sequence
  chemically synthesized
actctgtaaaaacacccatgca

SEQ ID NO: 1252094 - DNA, 22 bp, Artificial Sequence
  chemically synthesized
acatctgactctgtaaaaacac

SEQ ID NO: 1252095 - DNA, 22 bp, Artificial Sequence
  chemically synthesized
cggttgacatctgactctgtaa

SEQ ID NO: 1252096 - DNA, 22 bp, Artificial Sequence
  chemically synthesized
tccctgcggttgacatctgact

SEQ ID NO: 1252097 - DNA, 22 bp, Artificial Sequence
  chemically synthesized
tattgtccctgcggttgacatc

SEQ ID NO: 1252098 - DNA, 22 bp, Artificial Sequence
  chemically synthesized
ttacagagtcagatgtcaaccg

SEQ ID NO: 1252099 - DNA, 22 bp, Artificial Sequence
  chemically synthesized
gtattgtccctgcggttgacat

SEQ ID NO: 1252100 - DNA, 22 bp, Artificial Sequence
  chemically synthesized
tacagagtcagatgtcaaccgc

SEQ ID NO: 1252101 - DNA, 22 bp, Artificial Sequence
  chemically synthesized
acagagtcagatgtcaaccgca

SEQ ID NO: 1252102 - DNA, 22 bp, Artificial Sequence
  chemically synthesized
cagagtcagatgtcaaccgcag

SEQ ID NO: 1252103 - DNA, 22 bp, Artificial Sequence
  chemically synthesized
aaatgagtaagacacttgtatt

SEQ ID NO: 1252104 - DNA, 22 bp, Artificial Sequence
  chemically synthesized
cagcaggctgaaatgagtaaga

SEQ ID NO: 1252105 - DNA, 22 bp, Artificial Sequence
  chemically synthesized
ttacagcaggctgaaatgagta

SEQ ID NO: 1252106 - DNA, 22 bp, Artificial Sequence
  chemically synthesized
gttacagcaggctgaaatgagt

SEQ ID NO: 1252107 - DNA, 22 bp, Artificial Sequence
  chemically synthesized
tggtatcttgttacagcaggct

SEQ ID NO: 1252108 - DNA, 22 bp, Artificial Sequence
  chemically synthesized
actcatttcagcctgctgtaac

SEQ ID NO: 1252109 - DNA, 22 bp, Artificial Sequence
  chemically synthesized
ctcatttcagcctgctgtaaca

SEQ ID NO: 1252110 - DNA, 22 bp, Artificial Sequence
  chemically synthesized
atttcagcctgctgtaacaaga

SEQ ID NO: 1252111 - DNA, 22 bp, Artificial Sequence
  chemically synthesized
cccagtctatggtatcttgtta

SEQ ID NO: 1252112 - DNA, 22 bp, Artificial Sequence
  chemically synthesized
cagcctgctgtaacaagatacc

SEQ ID NO: 1252113 - DNA, 22 bp, Artificial Sequence
  chemically synthesized
agcctgctgtaacaagatacca

SEQ ID NO: 1252114 - DNA, 22 bp, Artificial Sequence
  chemically synthesized
agctgcccagtctatggtatct

SEQ ID NO: 1252115 - DNA, 22 bp, Artificial Sequence
  chemically synthesized
aagctgcccagtctatggtatc

SEQ ID NO: 1252116 - DNA, 22 bp, Artificial Sequence
  chemically synthesized
ctgtaacaagataccatagact

SEQ ID NO: 1252117 - DNA, 22 bp, Artificial Sequence
  chemically synthesized
tttaagctgcccagtctatggt

SEQ ID NO: 1252118 - DNA, 22 bp, Artificial Sequence
  chemically synthesized
taacaagataccatagactggg

SEQ ID NO: 1252119 - DNA, 22 bp, Artificial Sequence
  chemically synthesized
ttgtttaagctgcccagtctat

SEQ ID NO: 1252120 - DNA, 22 bp, Artificial Sequence
  chemically synthesized
tgttgtttaagctgcccagtct

SEQ ID NO: 1252121 - DNA, 22 bp, Artificial Sequence
  chemically synthesized
ctgttgtttaagctgcccagtc

SEQ ID NO: 1252122 - DNA, 22 bp, Artificial Sequence
  chemically synthesized
tgagaaaataaatttctgttgt

SEQ ID NO: 1252123 - DNA, 22 bp, Artificial Sequence
  chemically synthesized
ggcagcttaaacaacagaaatt

SEQ ID NO: 1252124 - DNA, 22 bp, Artificial Sequence
  chemically synthesized
cagaactgtgagaaaataaatt

SEQ ID NO: 1252125 - DNA, 22 bp, Artificial Sequence
  chemically synthesized
aaacaacagaaatttattttct

SEQ ID NO: 1252126 - DNA, 22 bp, Artificial Sequence
  chemically synthesized
aacaacagaaatttattttctc

SEQ ID NO: 1252127 - DNA, 22 bp, Artificial Sequence
  chemically synthesized
aagcctccagaactgtgagaaa

SEQ ID NO: 1252128 - DNA, 22 bp, Artificial Sequence
  chemically synthesized
aaagcctccagaactgtgagaa

SEQ ID NO: 1252129 - DNA, 22 bp, Artificial Sequence
  chemically synthesized
ggacttaaagcctccagaactg

SEQ ID NO: 1252130 - DNA, 22 bp, Artificial Sequence
  chemically synthesized
attttctcacagttctggaggc

SEQ ID NO: 1252131 - DNA, 22 bp, Artificial Sequence
  chemically synthesized
ttttctcacagttctggaggct

SEQ ID NO: 1252132 - DNA, 22 bp, Artificial Sequence
  chemically synthesized
acctcggacttaaagcctccag

SEQ ID NO: 1252133 - DNA, 22 bp, Artificial Sequence
  chemically synthesized
tctcacagttctggaggcttta

SEQ ID NO: 1252134 - DNA, 22 bp, Artificial Sequence
  chemically synthesized
ctcacagttctggaggctttaa

SEQ ID NO: 1252135 - DNA, 22 bp, Artificial Sequence
  chemically synthesized
tcacagttctggaggctttaag

SEQ ID NO: 1252136 - DNA, 22 bp, Artificial Sequence
  chemically synthesized
acagttctggaggctttaagtc

SEQ ID NO: 1252137 - DNA, 22 bp, Artificial Sequence
  chemically synthesized
gaacactgacctcggacttaaa

SEQ ID NO: 1252138 - DNA, 22 bp, Artificial Sequence
  chemically synthesized
tggaggctttaagtccgaggtc

SEQ ID NO: 1252139 - DNA, 22 bp, Artificial Sequence
  chemically synthesized
gaggctttaagtccgaggtcag

SEQ ID NO: 1252140 - DNA, 22 bp, Artificial Sequence
  chemically synthesized
aacacgctggaacactgacctc

SEQ ID NO: 1252141 - DNA, 22 bp, Artificial Sequence
  chemically synthesized
gaacacgctggaacactgacct

SEQ ID NO: 1252142 - DNA, 22 bp, Artificial Sequence
  chemically synthesized
taagtccgaggtcagtgttcca

SEQ ID NO: 1252143 - DNA, 22 bp, Artificial Sequence
  chemically synthesized
aagtccgaggtcagtgttccag

SEQ ID NO: 1252144 - DNA, 22 bp, Artificial Sequence
  chemically synthesized
agtccgaggtcagtgttccagc

SEQ ID NO: 1252145 - DNA, 22 bp, Artificial Sequence
  chemically synthesized
cagaacttgaacacgctggaac

SEQ ID NO: 1252146 - DNA, 22 bp, Artificial Sequence
  chemically synthesized
tccagaacttgaacacgctgga

SEQ ID NO: 1252147 - DNA, 22 bp, Artificial Sequence
  chemically synthesized
cagcgtgttcaagttctggaga

SEQ ID NO: 1252148 - DNA, 22 bp, Artificial Sequence
  chemically synthesized
catatcaggaggagagccctct

SEQ ID NO: 1252149 - DNA, 22 bp, Artificial Sequence
  chemically synthesized
acatatcaggaggagagccctc

SEQ ID NO: 1252150 - DNA, 22 bp, Artificial Sequence
  chemically synthesized
aagttctggagagggctctcct

SEQ ID NO: 1252151 - DNA, 22 bp, Artificial Sequence
  chemically synthesized
tttacatatcaggaggagagcc

SEQ ID NO: 1252152 - DNA, 22 bp, Artificial Sequence
  chemically synthesized
ttgtttacatatcaggaggaga

SEQ ID NO: 1252153 - DNA, 22 bp, Artificial Sequence
  chemically synthesized
tggagagggctctcctcctgat

SEQ ID NO: 1252154 - DNA, 22 bp, Artificial Sequence
  chemically synthesized
gagagggctctcctcctgatat

SEQ ID NO: 1252155 - DNA, 22 bp, Artificial Sequence
  chemically synthesized
tcctcctgatatgtaaacaaca

SEQ ID NO: 1252156 - DNA, 22 bp, Artificial Sequence
  chemically synthesized
ctcctgatatgtaaacaacaac

SEQ ID NO: 1252157 - DNA, 22 bp, Artificial Sequence
  chemically synthesized
ctgatatgtaaacaacaacctt

SEQ ID NO: 1252158 - DNA, 22 bp, Artificial Sequence
  chemically synthesized
atatgtaaacaacaaccttctc

SEQ ID NO: 1252159 - DNA, 22 bp, Artificial Sequence
  chemically synthesized
ccatgtgaggacacaggagaag

SEQ ID NO: 1252160 - DNA, 22 bp, Artificial Sequence
  chemically synthesized
gccatgtgaggacacaggagaa

SEQ ID NO: 1252161 - DNA, 22 bp, Artificial Sequence
  chemically synthesized
tgccatgtgaggacacaggaga

SEQ ID NO: 1252162 - DNA, 22 bp, Artificial Sequence
  chemically synthesized
ctttgccatgtgaggacacagg

SEQ ID NO: 1252163 - DNA, 22 bp, Artificial Sequence
  chemically synthesized
gctttgccatgtgaggacacag

SEQ ID NO: 1252164 - DNA, 22 bp, Artificial Sequence
  chemically synthesized
ttgctttgccatgtgaggacac

SEQ ID NO: 1252165 - DNA, 22 bp, Artificial Sequence
  chemically synthesized
ctcttgctttgccatgtgagga

SEQ ID NO: 1252166 - DNA, 22 bp, Artificial Sequence
  chemically synthesized
gctcttgctttgccatgtgagg

SEQ ID NO: 1252167 - DNA, 22 bp, Artificial Sequence
  chemically synthesized
ctcctgtgtcctcacatggcaa

SEQ ID NO: 1252168 - DNA, 22 bp, Artificial Sequence
  chemically synthesized
tcctgtgtcctcacatggcaaa

SEQ ID NO: 1252169 - DNA, 22 bp, Artificial Sequence
  chemically synthesized
ctgtgtcctcacatggcaaagc

SEQ ID NO: 1252170 - DNA, 22 bp, Artificial Sequence
  chemically synthesized
tgtcctcacatggcaaagcaag

SEQ ID NO: 1252171 - DNA, 22 bp, Artificial Sequence
  chemically synthesized
acatggcaaagcaagagcaagc

SEQ ID NO: 1252172 - DNA, 22 bp, Artificial Sequence
  chemically synthesized
atccggtggcccgtgtaaagaa

SEQ ID NO: 1252173 - DNA, 22 bp, Artificial Sequence
  chemically synthesized
tgatccggtggcccgtgtaaag

SEQ ID NO: 1252174 - DNA, 22 bp, Artificial Sequence
  chemically synthesized
tctggtgttttctttacacggg

SEQ ID NO: 1252175 - DNA, 22 bp, Artificial Sequence
  chemically synthesized
tggtgttttctttacacgggcc

SEQ ID NO: 1252176 - DNA, 22 bp, Artificial Sequence
  chemically synthesized
gtgttttctttacacgggccac

SEQ ID NO: 1252177 - DNA, 22 bp, Artificial Sequence
  chemically synthesized
tctttacacgggccaccggatc

SEQ ID NO: 1252178 - DNA, 22 bp, Artificial Sequence
  chemically synthesized
ctttacacgggccaccggatca

SEQ ID NO: 1252179 - DNA, 22 bp, Artificial Sequence
  chemically synthesized
tttacacgggccaccggatcag

SEQ ID NO: 1252180 - DNA, 22 bp, Artificial Sequence
  chemically synthesized
tacacgggccaccggatcagag

SEQ ID NO: 1252181 - DNA, 22 bp, Artificial Sequence
  chemically synthesized
acacgggccaccggatcagagc

SEQ ID NO: 1252182 - DNA, 22 bp, Artificial Sequence
  chemically synthesized
cacgggccaccggatcagagcc

SEQ ID NO: 1252183 - DNA, 22 bp, Artificial Sequence
  chemically synthesized
gggtaagataagcacatgcagg

SEQ ID NO: 1252184 - DNA, 22 bp, Artificial Sequence
  chemically synthesized
attagggtaagataagcacatg

SEQ ID NO: 1252185 - DNA, 22 bp, Artificial Sequence
  chemically synthesized
ggaattaattagggtaagataa

SEQ ID NO: 1252186 - DNA, 22 bp, Artificial Sequence
  chemically synthesized
gggaattaattagggtaagata

SEQ ID NO: 1252187 - DNA, 22 bp, Artificial Sequence
  chemically synthesized
tgggaattaattagggtaagat

SEQ ID NO: 1252188 - DNA, 22 bp, Artificial Sequence
  chemically synthesized
catgtgcttatcttaccctaat

SEQ ID NO: 1252189 - DNA, 22 bp, Artificial Sequence
  chemically synthesized
atcttaccctaattaattccca

SEQ ID NO: 1252190 - DNA, 22 bp, Artificial Sequence
  chemically synthesized
tcttaccctaattaattcccaa

SEQ ID NO: 1252191 - DNA, 22 bp, Artificial Sequence
  chemically synthesized
gagatggaacctttgggaatta

SEQ ID NO: 1252192 - DNA, 22 bp, Artificial Sequence
  chemically synthesized
ggagatggaacctttgggaatt

SEQ ID NO: 1252193 - DNA, 22 bp, Artificial Sequence
  chemically synthesized
accctaattaattcccaaaggt

SEQ ID NO: 1252194 - DNA, 22 bp, Artificial Sequence
  chemically synthesized
ccctaattaattcccaaaggtt

SEQ ID NO: 1252195 - DNA, 22 bp, Artificial Sequence
  chemically synthesized
attaattcccaaaggttccatc

SEQ ID NO: 1252196 - DNA, 22 bp, Artificial Sequence
  chemically synthesized
attcccaaaggttccatctcca

SEQ ID NO: 1252197 - DNA, 22 bp, Artificial Sequence
  chemically synthesized
ccaaaggttccatctccaaata

SEQ ID NO: 1252198 - DNA, 22 bp, Artificial Sequence
  chemically synthesized
acccccaatgggacgatatttg

SEQ ID NO: 1252199 - DNA, 22 bp, Artificial Sequence
  chemically synthesized
catctccaaatatcgtcccatt

SEQ ID NO: 1252200 - DNA, 22 bp, Artificial Sequence
  chemically synthesized
aagccctaacccccaatgggac

SEQ ID NO: 1252201 - DNA, 22 bp, Artificial Sequence
  chemically synthesized
caaatatcgtcccattgggggt

SEQ ID NO: 1252202 - DNA, 22 bp, Artificial Sequence
  chemically synthesized
atatgctgaagccctaaccccc

SEQ ID NO: 1252203 - DNA, 22 bp, Artificial Sequence
  chemically synthesized
ccccaaattcatatgctgaagc

SEQ ID NO: 1252204 - DNA, 22 bp, Artificial Sequence
  chemically synthesized
gccccaaattcatatgctgaag

SEQ ID NO: 1252205 - DNA, 22 bp, Artificial Sequence
  chemically synthesized
ggggttagggcttcagcatatg

SEQ ID NO: 1252206 - DNA, 22 bp, Artificial Sequence
  chemically synthesized
gtgtttgccccaaattcatatg

SEQ ID NO: 1252207 - DNA, 22 bp, Artificial Sequence
  chemically synthesized
gggcttcagcatatgaatttgg

SEQ ID NO: 1252208 - DNA, 22 bp, Artificial Sequence
  chemically synthesized
ttcgtgtttgccccaaattcat

SEQ ID NO: 1252209 - DNA, 22 bp, Artificial Sequence
  chemically synthesized
actattcgtgtttgccccaaat

SEQ ID NO: 1252210 - DNA, 22 bp, Artificial Sequence
  chemically synthesized
cagcatatgaatttggggcaaa

SEQ ID NO: 1252211 - DNA, 22 bp, Artificial Sequence
  chemically synthesized
agcatatgaatttggggcaaac

SEQ ID NO: 1252212 - DNA, 22 bp, Artificial Sequence
  chemically synthesized
tggactgactattcgtgtttgc

SEQ ID NO: 1252213 - DNA, 22 bp, Artificial Sequence
  chemically synthesized
ttatggactgactattcgtgtt

SEQ ID NO: 1252214 - DNA, 22 bp, Artificial Sequence
  chemically synthesized
ttgttatggactgactattcgt

SEQ ID NO: 1252215 - DNA, 22 bp, Artificial Sequence
  chemically synthesized
gttgttatggactgactattcg

SEQ ID NO: 1252216 - DNA, 22 bp, Artificial Sequence
  chemically synthesized
ggggcaaacacgaatagtcagt

SEQ ID NO: 1252217 - DNA, 22 bp, Artificial Sequence
  chemically synthesized
gggcaaacacgaatagtcagtc

SEQ ID NO: 1252218 - DNA, 22 bp, Artificial Sequence
  chemically synthesized
acttgttgttatggactgacta

SEQ ID NO: 1252219 - DNA, 22 bp, Artificial Sequence
  chemically synthesized
cacttgttgttatggactgact

SEQ ID NO: 1252220 - DNA, 22 bp, Artificial Sequence
  chemically synthesized
tagtccttcacttgttgttatg

SEQ ID NO: 1252221 - DNA, 22 bp, Artificial Sequence
  chemically synthesized
tgtagtccttcacttgttgtta

SEQ ID NO: 1252222 - DNA, 22 bp, Artificial Sequence
  chemically synthesized
tataaaatagattctgtagtcc

SEQ ID NO: 1252223 - DNA, 22 bp, Artificial Sequence
  chemically synthesized
ctgtataaaatagattctgtag

SEQ ID NO: 1252224 - DNA, 22 bp, Artificial Sequence
  chemically synthesized
cagaatctattttatacagtaa

SEQ ID NO: 1252225 - DNA, 22 bp, Artificial Sequence
  chemically synthesized
ataaaagaaaatattactgtat

SEQ ID NO: 1252226 - DNA, 22 bp, Artificial Sequence
  chemically synthesized
ttttatacagtaatattttctt

SEQ ID NO: 1252227 - DNA, 22 bp, Artificial Sequence
  chemically synthesized
atatagctcataaaagaaaata

SEQ ID NO: 1252228 - DNA, 22 bp, Artificial Sequence
  chemically synthesized
catatagctcataaaagaaaat

SEQ ID NO: 1252229 - DNA, 22 bp, Artificial Sequence
  chemically synthesized
tatacagtaatattttctttta

SEQ ID NO: 1252230 - DNA, 22 bp, Artificial Sequence
  chemically synthesized
tcatatagctcataaaagaaaa

SEQ ID NO: 1252231 - DNA, 22 bp, Artificial Sequence
  chemically synthesized
atacagtaatattttcttttat

SEQ ID NO: 1252232 - DNA, 22 bp, Artificial Sequence
  chemically synthesized
tacagtaatattttcttttatg

SEQ ID NO: 1252233 - DNA, 22 bp, Artificial Sequence
  chemically synthesized
tcactttcatatagctcataaa

SEQ ID NO: 1252234 - DNA, 22 bp, Artificial Sequence
  chemically synthesized
gtcactttcatatagctcataa

SEQ ID NO: 1252235 - DNA, 22 bp, Artificial Sequence
  chemically synthesized
tgtcactttcatatagctcata

SEQ ID NO: 1252236 - DNA, 22 bp, Artificial Sequence
  chemically synthesized
ctttgtcactttcatatagctc

SEQ ID NO: 1252237 - DNA, 22 bp, Artificial Sequence
  chemically synthesized
gctttgtcactttcatatagct

SEQ ID NO: 1252238 - DNA, 22 bp, Artificial Sequence
  chemically synthesized
tcttttatgagctatatgaaag

SEQ ID NO: 1252239 - DNA, 22 bp, Artificial Sequence
  chemically synthesized
cttttatgagctatatgaaagt

SEQ ID NO: 1252240 - DNA, 22 bp, Artificial Sequence
  chemically synthesized
ttttatgagctatatgaaagtg

SEQ ID NO: 1252241 - DNA, 22 bp, Artificial Sequence
  chemically synthesized
ttatgagctatatgaaagtgac

SEQ ID NO: 1252242 - DNA, 22 bp, Artificial Sequence
  chemically synthesized
tatgagctatatgaaagtgaca

SEQ ID NO: 1252243 - DNA, 22 bp, Artificial Sequence
  chemically synthesized
aaccacttgctttgtcactttc

SEQ ID NO: 1252244 - DNA, 22 bp, Artificial Sequence
  chemically synthesized
atgagctatatgaaagtgacaa

SEQ ID NO: 1252245 - DNA, 22 bp, Artificial Sequence
  chemically synthesized
tgagctatatgaaagtgacaaa

SEQ ID NO: 1252246 - DNA, 22 bp, Artificial Sequence
  chemically synthesized
caatactaaaccacttgctttg

SEQ ID NO: 1252247 - DNA, 22 bp, Artificial Sequence
  chemically synthesized
tatgaaagtgacaaagcaagtg

SEQ ID NO: 1252248 - DNA, 22 bp, Artificial Sequence
  chemically synthesized
tcatggtattacaatactaaac

SEQ ID NO: 1252249 - DNA, 22 bp, Artificial Sequence
  chemically synthesized
gtcatggtattacaatactaaa

SEQ ID NO: 1252250 - DNA, 22 bp, Artificial Sequence
  chemically synthesized
tgtcatggtattacaatactaa

SEQ ID NO: 1252251 - DNA, 22 bp, Artificial Sequence
  chemically synthesized
atctttgtcatggtattacaat

SEQ ID NO: 1252252 - DNA, 22 bp, Artificial Sequence
  chemically synthesized
aatctttgtcatggtattacaa

SEQ ID NO: 1252253 - DNA, 22 bp, Artificial Sequence
  chemically synthesized
ttaatctttgtcatggtattac

SEQ ID NO: 1252254 - DNA, 22 bp, Artificial Sequence
  chemically synthesized
agttcttaatctttgtcatggt

SEQ ID NO: 1252255 - DNA, 22 bp, Artificial Sequence
  chemically synthesized
agtattgtaataccatgacaaa

SEQ ID NO: 1252256 - DNA, 22 bp, Artificial Sequence
  chemically synthesized
gtattgtaataccatgacaaag

SEQ ID NO: 1252257 - DNA, 22 bp, Artificial Sequence
  chemically synthesized
agttcagttcttaatctttgtc

SEQ ID NO: 1252258 - DNA, 22 bp, Artificial Sequence
  chemically synthesized
taataccatgacaaagattaag

SEQ ID NO: 1252259 - DNA, 22 bp, Artificial Sequence
  chemically synthesized
ctcagttcagttcttaatcttt

SEQ ID NO: 1252260 - DNA, 22 bp, Artificial Sequence
  chemically synthesized
gctcagttcagttcttaatctt

SEQ ID NO: 1252261 - DNA, 22 bp, Artificial Sequence
  chemically synthesized
agaactgaactgagcaaatact

SEQ ID NO: 1252262 - DNA, 22 bp, Artificial Sequence
  chemically synthesized
aaccagaagtataaagtatttg

SEQ ID NO: 1252263 - DNA, 22 bp, Artificial Sequence
  chemically synthesized
aactgagcaaatactttatact

SEQ ID NO: 1252264 - DNA, 22 bp, Artificial Sequence
  chemically synthesized
agcaaatactttatacttctgg

SEQ ID NO: 1252265 - DNA, 22 bp, Artificial Sequence
  chemically synthesized
tgatgaactgaaccagaagtat

SEQ ID NO: 1252266 - DNA, 22 bp, Artificial Sequence
  chemically synthesized
agttatgatgaactgaaccaga

SEQ ID NO: 1252267 - DNA, 22 bp, Artificial Sequence
  chemically synthesized
tatacttctggttcagttcatc

SEQ ID NO: 1252268 - DNA, 22 bp, Artificial Sequence
  chemically synthesized
atacttctggttcagttcatca

SEQ ID NO: 1252269 - DNA, 22 bp, Artificial Sequence
  chemically synthesized
tacttctggttcagttcatcat

SEQ ID NO: 1252270 - DNA, 22 bp, Artificial Sequence
  chemically synthesized
ggtaattcagttatgatgaact

SEQ ID NO: 1252271 - DNA, 22 bp, Artificial Sequence
  chemically synthesized
gggtaattcagttatgatgaac

SEQ ID NO: 1252272 - DNA, 22 bp, Artificial Sequence
  chemically synthesized
tgggtaattcagttatgatgaa

SEQ ID NO: 1252273 - DNA, 22 bp, Artificial Sequence
  chemically synthesized
ttgggtaattcagttatgatga

SEQ ID NO: 1252274 - DNA, 22 bp, Artificial Sequence
  chemically synthesized
ctggttcagttcatcataactg

SEQ ID NO: 1252275 - DNA, 22 bp, Artificial Sequence
  chemically synthesized
tggttcagttcatcataactga

SEQ ID NO: 1252276 - DNA, 22 bp, Artificial Sequence
  chemically synthesized
gttcagttcatcataactgaat

SEQ ID NO: 1252277 - DNA, 22 bp, Artificial Sequence
  chemically synthesized
tatttttgggtaattcagttat

SEQ ID NO: 1252278 - DNA, 22 bp, Artificial Sequence
  chemically synthesized
atatttttgggtaattcagtta

SEQ ID NO: 1252279 - DNA, 22 bp, Artificial Sequence
  chemically synthesized
tatatttttgggtaattcagtt

SEQ ID NO: 1252280 - DNA, 22 bp, Artificial Sequence
  chemically synthesized
ttatatttttgggtaattcagt

SEQ ID NO: 1252281 - DNA, 22 bp, Artificial Sequence
  chemically synthesized
agttcatcataactgaattacc

SEQ ID NO: 1252282 - DNA, 22 bp, Artificial Sequence
  chemically synthesized
cttttatatttttgggtaattc

SEQ ID NO: 1252283 - DNA, 22 bp, Artificial Sequence
  chemically synthesized
tccttttatatttttgggtaat

SEQ ID NO: 1252284 - DNA, 22 bp, Artificial Sequence
  chemically synthesized
atcataactgaattacccaaaa

SEQ ID NO: 1252285 - DNA, 22 bp, Artificial Sequence
  chemically synthesized
cagctctccttttatatttttg

SEQ ID NO: 1252286 - DNA, 22 bp, Artificial Sequence
  chemically synthesized
aattacccaaaaatataaaagg

SEQ ID NO: 1252287 - DNA, 22 bp, Artificial Sequence
  chemically synthesized
gaacaactacagctctcctttt

SEQ ID NO: 1252288 - DNA, 22 bp, Artificial Sequence
  chemically synthesized
cccaaaaatataaaaggagagc

SEQ ID NO: 1252289 - DNA, 22 bp, Artificial Sequence
  chemically synthesized
tagaacaactacagctctcctt

SEQ ID NO: 1252290 - DNA, 22 bp, Artificial Sequence
  chemically synthesized
ctagaacaactacagctctcct

SEQ ID NO: 1252291 - DNA, 22 bp, Artificial Sequence
  chemically synthesized
tctagaacaactacagctctcc

SEQ ID NO: 1252292 - DNA, 22 bp, Artificial Sequence
  chemically synthesized
ttctagaacaactacagctctc

SEQ ID NO: 1252293 - DNA, 22 bp, Artificial Sequence
  chemically synthesized
cacgaaggaagatttttctaga

SEQ ID NO: 1252294 - DNA, 22 bp, Artificial Sequence
  chemically synthesized
ctacacgaaggaagatttttct

SEQ ID NO: 1252295 - DNA, 22 bp, Artificial Sequence
  chemically synthesized
tagttgttctagaaaaatcttc

SEQ ID NO: 1252296 - DNA, 22 bp, Artificial Sequence
  chemically synthesized
ttctagaaaaatcttccttcgt

SEQ ID NO: 1252297 - DNA, 22 bp, Artificial Sequence
  chemically synthesized
tagaaaaatcttccttcgtgta

SEQ ID NO: 1252298 - DNA, 22 bp, Artificial Sequence
  chemically synthesized
gaaaaatcttccttcgtgtagg

SEQ ID NO: 1252299 - DNA, 22 bp, Artificial Sequence
  chemically synthesized
ccttcgtgtaggagtgggtttg

SEQ ID NO: 1252300 - DNA, 22 bp, Artificial Sequence
  chemically synthesized
cttcgtgtaggagtgggtttgc

SEQ ID NO: 1252301 - DNA, 22 bp, Artificial Sequence
  chemically synthesized
gcacagtaacccgcaaacccac

SEQ ID NO: 1252302 - DNA, 22 bp, Artificial Sequence
  chemically synthesized
cgtgtaggagtgggtttgcggg

SEQ ID NO: 1252303 - DNA, 22 bp, Artificial Sequence
  chemically synthesized
gtgtaggagtgggtttgcgggt

SEQ ID NO: 1252304 - DNA, 22 bp, Artificial Sequence
  chemically synthesized
caggtgtggattagcacagtaa

SEQ ID NO: 1252305 - DNA, 22 bp, Artificial Sequence
  chemically synthesized
gcgggttactgtgctaatccac

SEQ ID NO: 1252306 - DNA, 22 bp, Artificial Sequence
  chemically synthesized
cgggttactgtgctaatccaca

SEQ ID NO: 1252307 - DNA, 22 bp, Artificial Sequence
  chemically synthesized
acgcccaaaactccaggtgtgg

SEQ ID NO: 1252308 - DNA, 22 bp, Artificial Sequence
  chemically synthesized
gacgcccaaaactccaggtgtg

SEQ ID NO: 1252309 - DNA, 22 bp, Artificial Sequence
  chemically synthesized
ctgtgctaatccacacctggag

SEQ ID NO: 1252310 - DNA, 22 bp, Artificial Sequence
  chemically synthesized
tgctaatccacacctggagttt

SEQ ID NO: 1252311 - DNA, 22 bp, Artificial Sequence
  chemically synthesized
tcaaccttgacgcccaaaactc

SEQ ID NO: 1252312 - DNA, 22 bp, Artificial Sequence
  chemically synthesized
atccacacctggagttttgggc

SEQ ID NO: 1252313 - DNA, 22 bp, Artificial Sequence
  chemically synthesized
atcaaccttgacgcccaaaact

SEQ ID NO: 1252314 - DNA, 22 bp, Artificial Sequence
  chemically synthesized
acccttatcaaccttgacgccc

SEQ ID NO: 1252315 - DNA, 22 bp, Artificial Sequence
  chemically synthesized
gacccttatcaaccttgacgcc

SEQ ID NO: 1252316 - DNA, 22 bp, Artificial Sequence
  chemically synthesized
gagttttgggcgtcaaggttga

SEQ ID NO: 1252317 - DNA, 22 bp, Artificial Sequence
  chemically synthesized
tgggcgtcaaggttgataaggg

SEQ ID NO: 1252318 - DNA, 22 bp, Artificial Sequence
  chemically synthesized
gggcgtcaaggttgataagggt

SEQ ID NO: 1252319 - DNA, 22 bp, Artificial Sequence
  chemically synthesized
ggcgtcaaggttgataagggtc

SEQ ID NO: 1252320 - DNA, 22 bp, Artificial Sequence
  chemically synthesized
ataagggtcaagggtttgggtt

SEQ ID NO: 1252321 - DNA, 22 bp, Artificial Sequence
  chemically synthesized
cacaagccagagccaaaaccca

SEQ ID NO: 1252322 - DNA, 22 bp, Artificial Sequence
  chemically synthesized
ccacaagccagagccaaaaccc

SEQ ID NO: 1252323 - DNA, 22 bp, Artificial Sequence
  chemically synthesized
gggttttggctctggcttgtgg

SEQ ID NO: 1252324 - DNA, 22 bp, Artificial Sequence
  chemically synthesized
ggttttggctctggcttgtgga

SEQ ID NO: 1252325 - DNA, 22 bp, Artificial Sequence
  chemically synthesized
agaaaacgatcttccacaagcc

SEQ ID NO: 1252326 - DNA, 22 bp, Artificial Sequence
  chemically synthesized
tcagaaaacgatcttccacaag

SEQ ID NO: 1252327 - DNA, 22 bp, Artificial Sequence
  chemically synthesized
tggctctggcttgtggaagatc

SEQ ID NO: 1252328 - DNA, 22 bp, Artificial Sequence
  chemically synthesized
ggctctggcttgtggaagatcg

SEQ ID NO: 1252329 - DNA, 22 bp, Artificial Sequence
  chemically synthesized
gctctggcttgtggaagatcgt

SEQ ID NO: 1252330 - DNA, 22 bp, Artificial Sequence
  chemically synthesized
tggcttgtggaagatcgttttc

SEQ ID NO: 1252331 - DNA, 22 bp, Artificial Sequence
  chemically synthesized
gcttgtggaagatcgttttctg

SEQ ID NO: 1252332 - DNA, 22 bp, Artificial Sequence
  chemically synthesized
gtggaagatcgttttctgagag

SEQ ID NO: 1252333 - DNA, 22 bp, Artificial Sequence
  chemically synthesized
tggaagatcgttttctgagagc

SEQ ID NO: 1252334 - DNA, 22 bp, Artificial Sequence
  chemically synthesized
gtgcccaagaatgctctcagaa

SEQ ID NO: 1252335 - DNA, 22 bp, Artificial Sequence
  chemically synthesized
accagctggtgcccaagaatgc

SEQ ID NO: 1252336 - DNA, 22 bp, Artificial Sequence
  chemically synthesized
tctgagagcattcttgggcacc

SEQ ID NO: 1252337 - DNA, 22 bp, Artificial Sequence
  chemically synthesized
ctgagagcattcttgggcacca

SEQ ID NO: 1252338 - DNA, 22 bp, Artificial Sequence
  chemically synthesized
tgagagcattcttgggcaccag

SEQ ID NO: 1252339 - DNA, 22 bp, Artificial Sequence
  chemically synthesized
agagcattcttgggcaccagct

SEQ ID NO: 1252340 - DNA, 22 bp, Artificial Sequence
  chemically synthesized
gaatgggagtgtctgaccagct

SEQ ID NO: 1252341 - DNA, 22 bp, Artificial Sequence
  chemically synthesized
ttgggcaccagctggtcagaca

SEQ ID NO: 1252342 - DNA, 22 bp, Artificial Sequence
  chemically synthesized
gggcaccagctggtcagacact

SEQ ID NO: 1252343 - DNA, 22 bp, Artificial Sequence
  chemically synthesized
ggcaccagctggtcagacactc

SEQ ID NO: 1252344 - DNA, 22 bp, Artificial Sequence
  chemically synthesized
tgtcccattggaatgggagtgt

SEQ ID NO: 1252345 - DNA, 22 bp, Artificial Sequence
  chemically synthesized
gtcagacactcccattccaatg

SEQ ID NO: 1252346 - DNA, 22 bp, Artificial Sequence
  chemically synthesized
aaaactatgtcccattggaatg

SEQ ID NO: 1252347 - DNA, 22 bp, Artificial Sequence
  chemically synthesized
ttgaaaactatgtcccattgga

SEQ ID NO: 1252348 - DNA, 22 bp, Artificial Sequence
  chemically synthesized
tgttgaaaactatgtcccattg

SEQ ID NO: 1252349 - DNA, 22 bp, Artificial Sequence
  chemically synthesized
tctgttgaaaactatgtcccat

SEQ ID NO: 1252350 - DNA, 22 bp, Artificial Sequence
  chemically synthesized
ctctctgttgaaaactatgtcc

SEQ ID NO: 1252351 - DNA, 22 bp, Artificial Sequence
  chemically synthesized
ccattccaatgggacatagttt

SEQ ID NO: 1252352 - DNA, 22 bp, Artificial Sequence
  chemically synthesized
ttcctctctgttgaaaactatg

SEQ ID NO: 1252353 - DNA, 22 bp, Artificial Sequence
  chemically synthesized
caatgggacatagttttcaaca

SEQ ID NO: 1252354 - DNA, 22 bp, Artificial Sequence
  chemically synthesized
gattattcctctctgttgaaaa

SEQ ID NO: 1252355 - DNA, 22 bp, Artificial Sequence
  chemically synthesized
tatacacctggattattcctct

SEQ ID NO: 1252356 - DNA, 22 bp, Artificial Sequence
  chemically synthesized
atatacacctggattattcctc

SEQ ID NO: 1252357 - DNA, 22 bp, Artificial Sequence
  chemically synthesized
tcaacagagaggaataatccag

SEQ ID NO: 1252358 - DNA, 22 bp, Artificial Sequence
  chemically synthesized
ccttatatacacctggattatt

SEQ ID NO: 1252359 - DNA, 22 bp, Artificial Sequence
  chemically synthesized
caacagagaggaataatccagg

SEQ ID NO: 1252360 - DNA, 22 bp, Artificial Sequence
  chemically synthesized
aacagagaggaataatccaggt

SEQ ID NO: 1252361 - DNA, 22 bp, Artificial Sequence
  chemically synthesized
tattgccttatatacacctgga

SEQ ID NO: 1252362 - DNA, 22 bp, Artificial Sequence
  chemically synthesized
gtattgccttatatacacctgg

SEQ ID NO: 1252363 - DNA, 22 bp, Artificial Sequence
  chemically synthesized
ttgtattgccttatatacacct

SEQ ID NO: 1252364 - DNA, 22 bp, Artificial Sequence
  chemically synthesized
cttgtattgccttatatacacc

SEQ ID NO: 1252365 - DNA, 22 bp, Artificial Sequence
  chemically synthesized
aaggtttcttgtattgccttat

SEQ ID NO: 1252366 - DNA, 22 bp, Artificial Sequence
  chemically synthesized
gaagcctcaaggtttcttgtat

SEQ ID NO: 1252367 - DNA, 22 bp, Artificial Sequence
  chemically synthesized
aggcctggaagcctcaaggttt

SEQ ID NO: 1252368 - DNA, 22 bp, Artificial Sequence
  chemically synthesized
ctaaggcctggaagcctcaagg

SEQ ID NO: 1252369 - DNA, 22 bp, Artificial Sequence
  chemically synthesized
gctaaggcctggaagcctcaag

SEQ ID NO: 1252370 - DNA, 22 bp, Artificial Sequence
  chemically synthesized
ttgctaaggcctggaagcctca

SEQ ID NO: 1252371 - DNA, 22 bp, Artificial Sequence
  chemically synthesized
cttgctaaggcctggaagcctc

SEQ ID NO: 1252372 - DNA, 22 bp, Artificial Sequence
  chemically synthesized
ttcttgctaaggcctggaagcc

SEQ ID NO: 1252373 - DNA, 22 bp, Artificial Sequence
  chemically synthesized
caattcttcttgctaaggcctg

SEQ ID NO: 1252374 - DNA, 22 bp, Artificial Sequence
  chemically synthesized
gaggcttccaggccttagcaag

SEQ ID NO: 1252375 - DNA, 22 bp, Artificial Sequence
  chemically synthesized
aggcttccaggccttagcaaga

SEQ ID NO: 1252376 - DNA, 22 bp, Artificial Sequence
  chemically synthesized
cactccaattcttcttgctaag

SEQ ID NO: 1252377 - DNA, 22 bp, Artificial Sequence
  chemically synthesized
ccactccaattcttcttgctaa

SEQ ID NO: 1252378 - DNA, 22 bp, Artificial Sequence
  chemically synthesized
ccaggccttagcaagaagaatt

SEQ ID NO: 1252379 - DNA, 22 bp, Artificial Sequence
  chemically synthesized
aacttccactccaattcttctt

SEQ ID NO: 1252380 - DNA, 22 bp, Artificial Sequence
  chemically synthesized
caggccttagcaagaagaattg

SEQ ID NO: 1252381 - DNA, 22 bp, Artificial Sequence
  chemically synthesized
aaacttccactccaattcttct

SEQ ID NO: 1252382 - DNA, 22 bp, Artificial Sequence
  chemically synthesized
taaacttccactccaattcttc

SEQ ID NO: 1252383 - DNA, 22 bp, Artificial Sequence
  chemically synthesized
ttaaacttccactccaattctt

SEQ ID NO: 1252384 - DNA, 22 bp, Artificial Sequence
  chemically synthesized
cttttaaacttccactccaatt

SEQ ID NO: 1252385 - DNA, 22 bp, Artificial Sequence
  chemically synthesized
tgcttttaaacttccactccaa

SEQ ID NO: 1252386 - DNA, 22 bp, Artificial Sequence
  chemically synthesized
agcaagaagaattggagtggaa

SEQ ID NO: 1252387 - DNA, 22 bp, Artificial Sequence
  chemically synthesized
gcaagaagaattggagtggaag

SEQ ID NO: 1252388 - DNA, 22 bp, Artificial Sequence
  chemically synthesized
cagttctgcttttaaacttcca

SEQ ID NO: 1252389 - DNA, 22 bp, Artificial Sequence
  chemically synthesized
gagtggaagtttaaaagcagaa

SEQ ID NO: 1252390 - DNA, 22 bp, Artificial Sequence
  chemically synthesized
gaaaatgttccagttctgcttt

SEQ ID NO: 1252391 - DNA, 22 bp, Artificial Sequence
  chemically synthesized
aattagaaaatgttccagttct

SEQ ID NO: 1252392 - DNA, 22 bp, Artificial Sequence
  chemically synthesized
aaaagcagaactggaacatttt

SEQ ID NO: 1252393 - DNA, 22 bp, Artificial Sequence
  chemically synthesized
aaagcagaactggaacattttc

SEQ ID NO: 1252394 - DNA, 22 bp, Artificial Sequence
  chemically synthesized
ccaccctcaattagaaaatgtt

SEQ ID NO: 1252395 - DNA, 22 bp, Artificial Sequence
  chemically synthesized
taccaccctcaattagaaaatg

SEQ ID NO: 1252396 - DNA, 22 bp, Artificial Sequence
  chemically synthesized
tctaccaccctcaattagaaaa

SEQ ID NO: 1252397 - DNA, 22 bp, Artificial Sequence
  chemically synthesized
tctctaccaccctcaattagaa

SEQ ID NO: 1252398 - DNA, 22 bp, Artificial Sequence
  chemically synthesized
gaacattttctaattgagggtg

SEQ ID NO: 1252399 - DNA, 22 bp, Artificial Sequence
  chemically synthesized
tctaattgagggtggtagagag

SEQ ID NO: 1252400 - DNA, 22 bp, Artificial Sequence
  chemically synthesized
ctaattgagggtggtagagaga

SEQ ID NO: 1252401 - DNA, 22 bp, Artificial Sequence
  chemically synthesized
taattgagggtggtagagagaa

SEQ ID NO: 1252402 - DNA, 22 bp, Artificial Sequence
  chemically synthesized
attgagggtggtagagagaatt

SEQ ID NO: 1252403 - DNA, 22 bp, Artificial Sequence
  chemically synthesized
agggtggtagagagaattctga

SEQ ID NO: 1252404 - DNA, 22 bp, Artificial Sequence
  chemically synthesized
agccgaatatataaatatcaga

SEQ ID NO: 1252405 - DNA, 22 bp, Artificial Sequence
  chemically synthesized
aacctcagccgaatatataaat

SEQ ID NO: 1252406 - DNA, 22 bp, Artificial Sequence
  chemically synthesized
tcaacctcagccgaatatataa

SEQ ID NO: 1252407 - DNA, 22 bp, Artificial Sequence
  chemically synthesized
tgatatttatatattcggctga

SEQ ID NO: 1252408 - DNA, 22 bp, Artificial Sequence
  chemically synthesized
aaagctctcaacctcagccgaa

SEQ ID NO: 1252409 - DNA, 22 bp, Artificial Sequence
  chemically synthesized
atatttatatattcggctgagg

SEQ ID NO: 1252410 - DNA, 22 bp, Artificial Sequence
  chemically synthesized
gaaagctctcaacctcagccga

SEQ ID NO: 1252411 - DNA, 22 bp, Artificial Sequence
  chemically synthesized
atatattcggctgaggttgaga

SEQ ID NO: 1252412 - DNA, 22 bp, Artificial Sequence
  chemically synthesized
tatattcggctgaggttgagag

SEQ ID NO: 1252413 - DNA, 22 bp, Artificial Sequence
  chemically synthesized
agcatccttgaaagctctcaac

SEQ ID NO: 1252414 - DNA, 22 bp, Artificial Sequence
  chemically synthesized
ggctgaggttgagagctttcaa

SEQ ID NO: 1252415 - DNA, 22 bp, Artificial Sequence
  chemically synthesized
aggttgagagctttcaaggatg

SEQ ID NO: 1252416 - DNA, 22 bp, Artificial Sequence
  chemically synthesized
agagctttcaaggatgctgagc

SEQ ID NO: 1252417 - DNA, 22 bp, Artificial Sequence
  chemically synthesized
caagccagcagccagctcagca

SEQ ID NO: 1252418 - DNA, 22 bp, Artificial Sequence
  chemically synthesized
attccaagccagcagccagctc

SEQ ID NO: 1252419 - DNA, 22 bp, Artificial Sequence
  chemically synthesized
tcaaggatgctgagctggctgc

SEQ ID NO: 1252420 - DNA, 22 bp, Artificial Sequence
  chemically synthesized
caaggatgctgagctggctgct

SEQ ID NO: 1252421 - DNA, 22 bp, Artificial Sequence
  chemically synthesized
aaggatgctgagctggctgctg

SEQ ID NO: 1252422 - DNA, 22 bp, Artificial Sequence
  chemically synthesized
agctggctgctggcttggaatg

SEQ ID NO: 1252423 - DNA, 22 bp, Artificial Sequence
  chemically synthesized
gctgctggcttggaatgaacgt

SEQ ID NO: 1252424 - DNA, 22 bp, Artificial Sequence
  chemically synthesized
ctggcttggaatgaacgtgtgt

SEQ ID NO: 1252425 - DNA, 22 bp, Artificial Sequence
  chemically synthesized
gcttggaatgaacgtgtgtgtg

SEQ ID NO: 1252426 - DNA, 22 bp, Artificial Sequence
  chemically synthesized
ggaatgaacgtgtgtgtgtgtg

SEQ ID NO: 1252427 - DNA, 22 bp, Artificial Sequence
  chemically synthesized
gaatgaacgtgtgtgtgtgtgt

SEQ ID NO: 1252428 - DNA, 22 bp, Artificial Sequence
  chemically synthesized
cacacacacacacacacacaca

SEQ ID NO: 1252429 - DNA, 22 bp, Artificial Sequence
  chemically synthesized
cactacacacacacacacacac

SEQ ID NO: 1252430 - DNA, 22 bp, Artificial Sequence
  chemically synthesized
cactacactacacacacacaca

SEQ ID NO: 1252431 - DNA, 22 bp, Artificial Sequence
  chemically synthesized
acactacactacacacacacac

SEQ ID NO: 1252432 - DNA, 22 bp, Artificial Sequence
  chemically synthesized
tttacactacactacacacaca

SEQ ID NO: 1252433 - DNA, 22 bp, Artificial Sequence
  chemically synthesized
atttacactacactacacacac

SEQ ID NO: 1252434 - DNA, 22 bp, Artificial Sequence
  chemically synthesized
cttatttacactacactacaca

SEQ ID NO: 1252435 - DNA, 22 bp, Artificial Sequence
  chemically synthesized
gcaatgttgcttatttacacta

SEQ ID NO: 1252436 - DNA, 22 bp, Artificial Sequence
  chemically synthesized
caagactagcaatgttgcttat

SEQ ID NO: 1252437 - DNA, 22 bp, Artificial Sequence
  chemically synthesized
taagattacaagactagcaatg

SEQ ID NO: 1252438 - DNA, 22 bp, Artificial Sequence
  chemically synthesized
tgaacaattataagattacaag

SEQ ID NO: 1252439 - DNA, 22 bp, Artificial Sequence
  chemically synthesized
atgaacaattataagattacaa

SEQ ID NO: 1252440 - DNA, 22 bp, Artificial Sequence
  chemically synthesized
ttatgaacaattataagattac

SEQ ID NO: 1252441 - DNA, 22 bp, Artificial Sequence
  chemically synthesized
tcttatgaacaattataagatt

SEQ ID NO: 1252442 - DNA, 22 bp, Artificial Sequence
  chemically synthesized
ctcttatgaacaattataagat

SEQ ID NO: 1252443 - DNA, 22 bp, Artificial Sequence
  chemically synthesized
ctagtcttgtaatcttataatt

SEQ ID NO: 1252444 - DNA, 22 bp, Artificial Sequence
  chemically synthesized
tctcttatgaacaattataaga

SEQ ID NO: 1252445 - DNA, 22 bp, Artificial Sequence
  chemically synthesized
gtcttgtaatcttataattgtt

SEQ ID NO: 1252446 - DNA, 22 bp, Artificial Sequence
  chemically synthesized
tattttctcttatgaacaatta

SEQ ID NO: 1252447 - DNA, 22 bp, Artificial Sequence
  chemically synthesized
gtaatcttataattgttcataa

SEQ ID NO: 1252448 - DNA, 22 bp, Artificial Sequence
  chemically synthesized
taatcttataattgttcataag

SEQ ID NO: 1252449 - DNA, 22 bp, Artificial Sequence
  chemically synthesized
gactgtattttctcttatgaac

SEQ ID NO: 1252450 - DNA, 22 bp, Artificial Sequence
  chemically synthesized
tagactgtattttctcttatga

SEQ ID NO: 1252451 - DNA, 22 bp, Artificial Sequence
  chemically synthesized
ctctagactgtattttctctta

SEQ ID NO: 1252452 - DNA, 22 bp, Artificial Sequence
  chemically synthesized
ataattgttcataagagaaaat

SEQ ID NO: 1252453 - DNA, 22 bp, Artificial Sequence
  chemically synthesized
cctctagactgtattttctctt

SEQ ID NO: 1252454 - DNA, 22 bp, Artificial Sequence
  chemically synthesized
taattgttcataagagaaaata

SEQ ID NO: 1252455 - DNA, 22 bp, Artificial Sequence
  chemically synthesized
ttcctctagactgtattttctc

SEQ ID NO: 1252456 - DNA, 22 bp, Artificial Sequence
  chemically synthesized
ttcataagagaaaatacagtct

SEQ ID NO: 1252457 - DNA, 22 bp, Artificial Sequence
  chemically synthesized
ataagagaaaatacagtctaga

SEQ ID NO: 1252458 - DNA, 22 bp, Artificial Sequence
  chemically synthesized
gatgatctcttcctctagactg

SEQ ID NO: 1252459 - DNA, 22 bp, Artificial Sequence
  chemically synthesized
ccagtaaactagatgatctctt

SEQ ID NO: 1252460 - DNA, 22 bp, Artificial Sequence
  chemically synthesized
gttcccagtaaactagatgatc

SEQ ID NO: 1252461 - DNA, 22 bp, Artificial Sequence
  chemically synthesized
ctagttcccagtaaactagatg

SEQ ID NO: 1252462 - DNA, 22 bp, Artificial Sequence
  chemically synthesized
gaggaagagatcatctagttta

SEQ ID NO: 1252463 - DNA, 22 bp, Artificial Sequence
  chemically synthesized
ggcaagataagcattactagtt

SEQ ID NO: 1252464 - DNA, 22 bp, Artificial Sequence
  chemically synthesized
gtttactgggaactagtaatgc

SEQ ID NO: 1252465 - DNA, 22 bp, Artificial Sequence
  chemically synthesized
actgggaactagtaatgcttat

SEQ ID NO: 1252466 - DNA, 22 bp, Artificial Sequence
  chemically synthesized
aacctcggcaagataagcatta

SEQ ID NO: 1252467 - DNA, 22 bp, Artificial Sequence
  chemically synthesized
ctgggaactagtaatgcttatc

SEQ ID NO: 1252468 - DNA, 22 bp, Artificial Sequence
  chemically synthesized
aaacctcggcaagataagcatt

SEQ ID NO: 1252469 - DNA, 22 bp, Artificial Sequence
  chemically synthesized
ggaactagtaatgcttatcttg

SEQ ID NO: 1252470 - DNA, 22 bp, Artificial Sequence
  chemically synthesized
atttaaacctcggcaagataag

SEQ ID NO: 1252471 - DNA, 22 bp, Artificial Sequence
  chemically synthesized
gtaatgcttatcttgccgaggt

SEQ ID NO: 1252472 - DNA, 22 bp, Artificial Sequence
  chemically synthesized
atcttgccgaggtttaaatgaa

SEQ ID NO: 1252473 - DNA, 22 bp, Artificial Sequence
  chemically synthesized
cagccgtgatcattcatttaaa

SEQ ID NO: 1252474 - DNA, 22 bp, Artificial Sequence
  chemically synthesized
tcttgccgaggtttaaatgaat

SEQ ID NO: 1252475 - DNA, 22 bp, Artificial Sequence
  chemically synthesized
gccgaggtttaaatgaatgatc

SEQ ID NO: 1252476 - DNA, 22 bp, Artificial Sequence
  chemically synthesized
ccgaggtttaaatgaatgatca

SEQ ID NO: 1252477 - DNA, 22 bp, Artificial Sequence
  chemically synthesized
taagtcattacagccgtgatca

SEQ ID NO: 1252478 - DNA, 22 bp, Artificial Sequence
  chemically synthesized
ataagtcattacagccgtgatc

SEQ ID NO: 1252479 - DNA, 22 bp, Artificial Sequence
  chemically synthesized
ttataagtcattacagccgtga

SEQ ID NO: 1252480 - DNA, 22 bp, Artificial Sequence
  chemically synthesized
cttataagtcattacagccgtg

SEQ ID NO: 1252481 - DNA, 22 bp, Artificial Sequence
  chemically synthesized
aaatgaatgatcacggctgtaa

SEQ ID NO: 1252482 - DNA, 22 bp, Artificial Sequence
  chemically synthesized
tcttataagtcattacagccgt

SEQ ID NO: 1252483 - DNA, 22 bp, Artificial Sequence
  chemically synthesized
aatgaatgatcacggctgtaat

SEQ ID NO: 1252484 - DNA, 22 bp, Artificial Sequence
  chemically synthesized
ttcttataagtcattacagccg

SEQ ID NO: 1252485 - DNA, 22 bp, Artificial Sequence
  chemically synthesized
atttttcttataagtcattaca

SEQ ID NO: 1252486 - DNA, 22 bp, Artificial Sequence
  chemically synthesized
aatttttcttataagtcattac

SEQ ID NO: 1252487 - DNA, 22 bp, Artificial Sequence
  chemically synthesized
gatttaatttttcttataagtc

SEQ ID NO: 1252488 - DNA, 22 bp, Artificial Sequence
  chemically synthesized
agatttaatttttcttataagt

SEQ ID NO: 1252489 - DNA, 22 bp, Artificial Sequence
  chemically synthesized
ttagatttaatttttcttataa

SEQ ID NO: 1252490 - DNA, 22 bp, Artificial Sequence
  chemically synthesized
taatgacttataagaaaaatta

SEQ ID NO: 1252491 - DNA, 22 bp, Artificial Sequence
  chemically synthesized
tgctcttagatttaatttttct

SEQ ID NO: 1252492 - DNA, 22 bp, Artificial Sequence
  chemically synthesized
agaggctgtgctcttagattta

SEQ ID NO: 1252493 - DNA, 22 bp, Artificial Sequence
  chemically synthesized
ataagaaaaattaaatctaaga

SEQ ID NO: 1252494 - DNA, 22 bp, Artificial Sequence
  chemically synthesized
taagaaaaattaaatctaagag

SEQ ID NO: 1252495 - DNA, 22 bp, Artificial Sequence
  chemically synthesized
ctcagaggctgtgctcttagat

SEQ ID NO: 1252496 - DNA, 22 bp, Artificial Sequence
  chemically synthesized
tgctcagaggctgtgctcttag

SEQ ID NO: 1252497 - DNA, 22 bp, Artificial Sequence
  chemically synthesized
ctgctcagaggctgtgctctta

SEQ ID NO: 1252498 - DNA, 22 bp, Artificial Sequence
  chemically synthesized
aatctaagagcacagcctctga

SEQ ID NO: 1252499 - DNA, 22 bp, Artificial Sequence
  chemically synthesized
tatacagtttctgctcagaggc

SEQ ID NO: 1252500 - DNA, 22 bp, Artificial Sequence
  chemically synthesized
tgtatacagtttctgctcagag

SEQ ID NO: 1252501 - DNA, 22 bp, Artificial Sequence
  chemically synthesized
agagcacagcctctgagcagaa

SEQ ID NO: 1252502 - DNA, 22 bp, Artificial Sequence
  chemically synthesized
tgtacataaacctctgtataca

SEQ ID NO: 1252503 - DNA, 22 bp, Artificial Sequence
  chemically synthesized
tgagcagaaactgtatacagag

SEQ ID NO: 1252504 - DNA, 22 bp, Artificial Sequence
  chemically synthesized
agcagaaactgtatacagaggt

SEQ ID NO: 1252505 - DNA, 22 bp, Artificial Sequence
  chemically synthesized
atcgcacagctgtgtacataaa

SEQ ID NO: 1252506 - DNA, 22 bp, Artificial Sequence
  chemically synthesized
catcgcacagctgtgtacataa

SEQ ID NO: 1252507 - DNA, 22 bp, Artificial Sequence
  chemically synthesized
tatacagaggtttatgtacaca

SEQ ID NO: 1252508 - DNA, 22 bp, Artificial Sequence
  chemically synthesized
tcatcgcacagctgtgtacata

SEQ ID NO: 1252509 - DNA, 22 bp, Artificial Sequence
  chemically synthesized
ttcatcgcacagctgtgtacat

SEQ ID NO: 1252510 - DNA, 22 bp, Artificial Sequence
  chemically synthesized
ttttcatcgcacagctgtgtac

SEQ ID NO: 1252511 - DNA, 22 bp, Artificial Sequence
  chemically synthesized
attcttttcatcgcacagctgt

SEQ ID NO: 1252512 - DNA, 22 bp, Artificial Sequence
  chemically synthesized
atgtacacagctgtgcgatgaa

SEQ ID NO: 1252513 - DNA, 22 bp, Artificial Sequence
  chemically synthesized
tgtacacagctgtgcgatgaaa

SEQ ID NO: 1252514 - DNA, 22 bp, Artificial Sequence
  chemically synthesized
tgcgatgaaaagaattagatgt

SEQ ID NO: 1252515 - DNA, 22 bp, Artificial Sequence
  chemically synthesized
caaaagcatcagggcacagcac

SEQ ID NO: 1252516 - DNA, 22 bp, Artificial Sequence
  chemically synthesized
ttgcaaaagcatcagggcacag

SEQ ID NO: 1252517 - DNA, 22 bp, Artificial Sequence
  chemically synthesized
attgcaaaagcatcagggcaca

SEQ ID NO: 1252518 - DNA, 22 bp, Artificial Sequence
  chemically synthesized
tattgcaaaagcatcagggcac

SEQ ID NO: 1252519 - DNA, 22 bp, Artificial Sequence
  chemically synthesized
gatgtgctgtgccctgatgctt

SEQ ID NO: 1252520 - DNA, 22 bp, Artificial Sequence
  chemically synthesized
aaccctttattgcaaaagcatc

SEQ ID NO: 1252521 - DNA, 22 bp, Artificial Sequence
  chemically synthesized
gaaccctttattgcaaaagcat

SEQ ID NO: 1252522 - DNA, 22 bp, Artificial Sequence
  chemically synthesized
tgaaccctttattgcaaaagca

SEQ ID NO: 1252523 - DNA, 22 bp, Artificial Sequence
  chemically synthesized
ttgaaccctttattgcaaaagc

SEQ ID NO: 1252524 - DNA, 22 bp, Artificial Sequence
  chemically synthesized
tgccctgatgcttttgcaataa

SEQ ID NO: 1252525 - DNA, 22 bp, Artificial Sequence
  chemically synthesized
cacagatttttgaaccctttat

SEQ ID NO: 1252526 - DNA, 22 bp, Artificial Sequence
  chemically synthesized
atgcttttgcaataaagggttc

SEQ ID NO: 1252527 - DNA, 22 bp, Artificial Sequence
  chemically synthesized
tccacagatttttgaacccttt

SEQ ID NO: 1252528 - DNA, 22 bp, Artificial Sequence
  chemically synthesized
ttgcaataaagggttcaaaaat

SEQ ID NO: 1252529 - DNA, 22 bp, Artificial Sequence
  chemically synthesized
tgcaataaagggttcaaaaatc

SEQ ID NO: 1252530 - DNA, 22 bp, Artificial Sequence
  chemically synthesized
gcaataaagggttcaaaaatct

SEQ ID NO: 1252531 - DNA, 22 bp, Artificial Sequence
  chemically synthesized
caataaagggttcaaaaatctg

SEQ ID NO: 1252532 - DNA, 22 bp, Artificial Sequence
  chemically synthesized
aggagtagggtgttctccacag

SEQ ID NO: 1252533 - DNA, 22 bp, Artificial Sequence
  chemically synthesized
tactaaggagtagggtgttctc

SEQ ID NO: 1252534 - DNA, 22 bp, Artificial Sequence
  chemically synthesized
aaaaatctgtggagaacaccct

SEQ ID NO: 1252535 - DNA, 22 bp, Artificial Sequence
  chemically synthesized
ggttgtactaaggagtagggtg

SEQ ID NO: 1252536 - DNA, 22 bp, Artificial Sequence
  chemically synthesized
tgggttgtactaaggagtaggg

SEQ ID NO: 1252537 - DNA, 22 bp, Artificial Sequence
  chemically synthesized
tggagaacaccctactccttag

SEQ ID NO: 1252538 - DNA, 22 bp, Artificial Sequence
  chemically synthesized
ctctgggttgtactaaggagta

SEQ ID NO: 1252539 - DNA, 22 bp, Artificial Sequence
  chemically synthesized
cagcagactgctctgggttgta

SEQ ID NO: 1252540 - DNA, 22 bp, Artificial Sequence
  chemically synthesized
ctccttagtacaacccagagca

SEQ ID NO: 1252541 - DNA, 22 bp, Artificial Sequence
  chemically synthesized
cttagtacaacccagagcagtc

SEQ ID NO: 1252542 - DNA, 22 bp, Artificial Sequence
  chemically synthesized
agcaggctacagcagactgctc

SEQ ID NO: 1252543 - DNA, 22 bp, Artificial Sequence
  chemically synthesized
agtacaacccagagcagtctgc

SEQ ID NO: 1252544 - DNA, 22 bp, Artificial Sequence
  chemically synthesized
gtacaacccagagcagtctgct

SEQ ID NO: 1252545 - DNA, 22 bp, Artificial Sequence
  chemically synthesized
atcatagcataccaattaagca

SEQ ID NO: 1252546 - DNA, 22 bp, Artificial Sequence
  chemically synthesized
gatcatagcataccaattaagc

SEQ ID NO: 1252547 - DNA, 22 bp, Artificial Sequence
  chemically synthesized
ctgtagcctgcttaattggtat

SEQ ID NO: 1252548 - DNA, 22 bp, Artificial Sequence
  chemically synthesized
tagcctgcttaattggtatgct

SEQ ID NO: 1252549 - DNA, 22 bp, Artificial Sequence
  chemically synthesized
cttaattggtatgctatgatca

SEQ ID NO: 1252550 - DNA, 22 bp, Artificial Sequence
  chemically synthesized
aattggtatgctatgatcaaat

SEQ ID NO: 1252551 - DNA, 22 bp, Artificial Sequence
  chemically synthesized
attggtatgctatgatcaaatc

SEQ ID NO: 1252552 - DNA, 22 bp, Artificial Sequence
  chemically synthesized
gtatgctatgatcaaatccctc

SEQ ID NO: 1252553 - DNA, 22 bp, Artificial Sequence
  chemically synthesized
ggggtgtaatcaagagggattt

SEQ ID NO: 1252554 - DNA, 22 bp, Artificial Sequence
  chemically synthesized
tgatcaaatccctcttgattac

SEQ ID NO: 1252555 - DNA, 22 bp, Artificial Sequence
  chemically synthesized
taccctaggggtgtaatcaaga

SEQ ID NO: 1252556 - DNA, 22 bp, Artificial Sequence
  chemically synthesized
ttataccctaggggtgtaatca

SEQ ID NO: 1252557 - DNA, 22 bp, Artificial Sequence
  chemically synthesized
ctattataccctaggggtgtaa

SEQ ID NO: 1252558 - DNA, 22 bp, Artificial Sequence
  chemically synthesized
cctcctattataccctaggggt

SEQ ID NO: 1252559 - DNA, 22 bp, Artificial Sequence
  chemically synthesized
ttgattacacccctagggtata

SEQ ID NO: 1252560 - DNA, 22 bp, Artificial Sequence
  chemically synthesized
gattacacccctagggtataat

SEQ ID NO: 1252561 - DNA, 22 bp, Artificial Sequence
  chemically synthesized
attacacccctagggtataata

SEQ ID NO: 1252562 - DNA, 22 bp, Artificial Sequence
  chemically synthesized
cacccctagggtataataggag

SEQ ID NO: 1252563 - DNA, 22 bp, Artificial Sequence
  chemically synthesized
aagtaaaacctgcctcctatta

SEQ ID NO: 1252564 - DNA, 22 bp, Artificial Sequence
  chemically synthesized
gggtataataggaggcaggttt

SEQ ID NO: 1252565 - DNA, 22 bp, Artificial Sequence
  chemically synthesized
tatgatgaaaggcgttaaagta

SEQ ID NO: 1252566 - DNA, 22 bp, Artificial Sequence
  chemically synthesized
tgtatgatgaaaggcgttaaag

SEQ ID NO: 1252567 - DNA, 22 bp, Artificial Sequence
  chemically synthesized
ctgtatgatgaaaggcgttaaa

SEQ ID NO: 1252568 - DNA, 22 bp, Artificial Sequence
  chemically synthesized
tctgtatgatgaaaggcgttaa

SEQ ID NO: 1252569 - DNA, 22 bp, Artificial Sequence
  chemically synthesized
ctttctgtatgatgaaaggcgt

SEQ ID NO: 1252570 - DNA, 22 bp, Artificial Sequence
  chemically synthesized
actttctgtatgatgaaaggcg

SEQ ID NO: 1252571 - DNA, 22 bp, Artificial Sequence
  chemically synthesized
tactttaacgcctttcatcata

SEQ ID NO: 1252572 - DNA, 22 bp, Artificial Sequence
  chemically synthesized
actttaacgcctttcatcatac

SEQ ID NO: 1252573 - DNA, 22 bp, Artificial Sequence
  chemically synthesized
ctttaacgcctttcatcataca

SEQ ID NO: 1252574 - DNA, 22 bp, Artificial Sequence
  chemically synthesized
taacgcctttcatcatacagaa

SEQ ID NO: 1252575 - DNA, 22 bp, Artificial Sequence
  chemically synthesized
aacgcctttcatcatacagaaa

SEQ ID NO: 1252576 - DNA, 22 bp, Artificial Sequence
  chemically synthesized
acgcctttcatcatacagaaag

SEQ ID NO: 1252577 - DNA, 22 bp, Artificial Sequence
  chemically synthesized
tccataaagcagtttactttct

SEQ ID NO: 1252578 - DNA, 22 bp, Artificial Sequence
  chemically synthesized
atccataaagcagtttactttc

SEQ ID NO: 1252579 - DNA, 22 bp, Artificial Sequence
  chemically synthesized
tatccataaagcagtttacttt

SEQ ID NO: 1252580 - DNA, 22 bp, Artificial Sequence
  chemically synthesized
tcatcatacagaaagtaaactg

SEQ ID NO: 1252581 - DNA, 22 bp, Artificial Sequence
  chemically synthesized
ttatccataaagcagtttactt

SEQ ID NO: 1252582 - DNA, 22 bp, Artificial Sequence
  chemically synthesized
catcatacagaaagtaaactgc

SEQ ID NO: 1252583 - DNA, 22 bp, Artificial Sequence
  chemically synthesized
atcatacagaaagtaaactgct

SEQ ID NO: 1252584 - DNA, 22 bp, Artificial Sequence
  chemically synthesized
tttttatccataaagcagttta

SEQ ID NO: 1252585 - DNA, 22 bp, Artificial Sequence
  chemically synthesized
tacatggctatttttatccata

SEQ ID NO: 1252586 - DNA, 22 bp, Artificial Sequence
  chemically synthesized
ctttatggataaaaatagccat

SEQ ID NO: 1252587 - DNA, 22 bp, Artificial Sequence
  chemically synthesized
tatggataaaaatagccatgta

SEQ ID NO: 1252588 - DNA, 22 bp, Artificial Sequence
  chemically synthesized
atggataaaaatagccatgtac

SEQ ID NO: 1252589 - DNA, 22 bp, Artificial Sequence
  chemically synthesized
tggataaaaatagccatgtaca

SEQ ID NO: 1252590 - DNA, 22 bp, Artificial Sequence
  chemically synthesized
gtgtcaatagtgagtctgtaca

SEQ ID NO: 1252591 - DNA, 22 bp, Artificial Sequence
  chemically synthesized
aagtcaccaggggtggctggtg

SEQ ID NO: 1252592 - DNA, 22 bp, Artificial Sequence
  chemically synthesized
gaagtcaccaggggtggctggt

SEQ ID NO: 1252593 - DNA, 22 bp, Artificial Sequence
  chemically synthesized
actattgacaccagccacccct

SEQ ID NO: 1252594 - DNA, 22 bp, Artificial Sequence
  chemically synthesized
ttgacaccagccacccctggtg

SEQ ID NO: 1252595 - DNA, 22 bp, Artificial Sequence
  chemically synthesized
atgagccttgaagtcaccaggg

SEQ ID NO: 1252596 - DNA, 22 bp, Artificial Sequence
  chemically synthesized
acaccagccacccctggtgact

SEQ ID NO: 1252597 - DNA, 22 bp, Artificial Sequence
  chemically synthesized
ctgatgagccttgaagtcacca

SEQ ID NO: 1252598 - DNA, 22 bp, Artificial Sequence
  chemically synthesized
tgcattgctgatgagccttgaa

SEQ ID NO: 1252599 - DNA, 22 bp, Artificial Sequence
  chemically synthesized
gtgacttcaaggctcatcagca

SEQ ID NO: 1252600 - DNA, 22 bp, Artificial Sequence
  chemically synthesized
aaacagttgtgcattgctgatg

SEQ ID NO: 1252601 - DNA, 22 bp, Artificial Sequence
  chemically synthesized
aaaacagttgtgcattgctgat

SEQ ID NO: 1252602 - DNA, 22 bp, Artificial Sequence
  chemically synthesized
taaaacagttgtgcattgctga

SEQ ID NO: 1252603 - DNA, 22 bp, Artificial Sequence
  chemically synthesized
caaggctcatcagcaatgcaca

SEQ ID NO: 1252604 - DNA, 22 bp, Artificial Sequence
  chemically synthesized
ttttaaaacagttgtgcattgc

SEQ ID NO: 1252605 - DNA, 22 bp, Artificial Sequence
  chemically synthesized
aaggctcatcagcaatgcacaa

SEQ ID NO: 1252606 - DNA, 22 bp, Artificial Sequence
  chemically synthesized
attttaaaacagttgtgcattg

SEQ ID NO: 1252607 - DNA, 22 bp, Artificial Sequence
  chemically synthesized
tattttaaaacagttgtgcatt

SEQ ID NO: 1252608 - DNA, 22 bp, Artificial Sequence
  chemically synthesized
ctttattttaaaacagttgtgc

SEQ ID NO: 1252609 - DNA, 22 bp, Artificial Sequence
  chemically synthesized
gctttattttaaaacagttgtg

SEQ ID NO: 1252610 - DNA, 22 bp, Artificial Sequence
  chemically synthesized
tgctttattttaaaacagttgt

SEQ ID NO: 1252611 - DNA, 22 bp, Artificial Sequence
  chemically synthesized
atcagcaatgcacaactgtttt

SEQ ID NO: 1252612 - DNA, 22 bp, Artificial Sequence
  chemically synthesized
tttgctttattttaaaacagtt

SEQ ID NO: 1252613 - DNA, 22 bp, Artificial Sequence
  chemically synthesized
catgtgactctttgctttattt

SEQ ID NO: 1252614 - DNA, 22 bp, Artificial Sequence
  chemically synthesized
tacatgtgactctttgctttat

SEQ ID NO: 1252615 - DNA, 22 bp, Artificial Sequence
  chemically synthesized
ttttaaaataaagcaaagagtc

SEQ ID NO: 1252616 - DNA, 22 bp, Artificial Sequence
  chemically synthesized
caattctacatgtgactctttg

SEQ ID NO: 1252617 - DNA, 22 bp, Artificial Sequence
  chemically synthesized
taaaataaagcaaagagtcaca

SEQ ID NO: 1252618 - DNA, 22 bp, Artificial Sequence
  chemically synthesized
aaaataaagcaaagagtcacat

SEQ ID NO: 1252619 - DNA, 22 bp, Artificial Sequence
  chemically synthesized
aaataaagcaaagagtcacatg

SEQ ID NO: 1252620 - DNA, 22 bp, Artificial Sequence
  chemically synthesized
taattccaattctacatgtgac

SEQ ID NO: 1252621 - DNA, 22 bp, Artificial Sequence
  chemically synthesized
ctgtaattccaattctacatgt

SEQ ID NO: 1252622 - DNA, 22 bp, Artificial Sequence
  chemically synthesized
ttcctgtaattccaattctaca

SEQ ID NO: 1252623 - DNA, 22 bp, Artificial Sequence
  chemically synthesized
attattcctgtaattccaattc

SEQ ID NO: 1252624 - DNA, 22 bp, Artificial Sequence
  chemically synthesized
tcattattcctgtaattccaat

SEQ ID NO: 1252625 - DNA, 22 bp, Artificial Sequence
  chemically synthesized
ctcattattcctgtaattccaa

SEQ ID NO: 1252626 - DNA, 22 bp, Artificial Sequence
  chemically synthesized
cttctcattattcctgtaattc

SEQ ID NO: 1252627 - DNA, 22 bp, Artificial Sequence
  chemically synthesized
acttctcattattcctgtaatt

SEQ ID NO: 1252628 - DNA, 22 bp, Artificial Sequence
  chemically synthesized
tttacttctcattattcctgta

SEQ ID NO: 1252629 - DNA, 22 bp, Artificial Sequence
  chemically synthesized
tgtttacttctcattattcctg

SEQ ID NO: 1252630 - DNA, 22 bp, Artificial Sequence
  chemically synthesized
ctgtttacttctcattattcct

SEQ ID NO: 1252631 - DNA, 22 bp, Artificial Sequence
  chemically synthesized
tctgtttacttctcattattcc

SEQ ID NO: 1252632 - DNA, 22 bp, Artificial Sequence
  chemically synthesized
tttctgtttacttctcattatt

SEQ ID NO: 1252633 - DNA, 22 bp, Artificial Sequence
  chemically synthesized
gaattacaggaataatgagaag

SEQ ID NO: 1252634 - DNA, 22 bp, Artificial Sequence
  chemically synthesized
caggaataatgagaagtaaaca

SEQ ID NO: 1252635 - DNA, 22 bp, Artificial Sequence
  chemically synthesized
aaggcaacgtggcctctttctg

SEQ ID NO: 1252636 - DNA, 22 bp, Artificial Sequence
  chemically synthesized
gccctcaaggcaacgtggcctc

SEQ ID NO: 1252637 - DNA, 22 bp, Artificial Sequence
  chemically synthesized
taggttagccctcaaggcaacg

SEQ ID NO: 1252638 - DNA, 22 bp, Artificial Sequence
  chemically synthesized
atctataggttagccctcaagg

SEQ ID NO: 1252639 - DNA, 22 bp, Artificial Sequence
  chemically synthesized
taatctataggttagccctcaa

SEQ ID NO: 1252640 - DNA, 22 bp, Artificial Sequence
  chemically synthesized
ctaatctataggttagccctca

SEQ ID NO: 1252641 - DNA, 22 bp, Artificial Sequence
  chemically synthesized
tctaatctataggttagccctc

SEQ ID NO: 1252642 - DNA, 22 bp, Artificial Sequence
  chemically synthesized
ttctaatctataggttagccct

SEQ ID NO: 1252643 - DNA, 22 bp, Artificial Sequence
  chemically synthesized
tttctaatctataggttagccc

SEQ ID NO: 1252644 - DNA, 22 bp, Artificial Sequence
  chemically synthesized
ttttctaatctataggttagcc

SEQ ID NO: 1252645 - DNA, 22 bp, Artificial Sequence
  chemically synthesized
ccttgagggctaacctatagat

SEQ ID NO: 1252646 - DNA, 22 bp, Artificial Sequence
  chemically synthesized
gagggctaacctatagattaga

SEQ ID NO: 1252647 - DNA, 22 bp, Artificial Sequence
  chemically synthesized
agggctaacctatagattagaa

SEQ ID NO: 1252648 - DNA, 22 bp, Artificial Sequence
  chemically synthesized
gggccccgatttttttctaatc

SEQ ID NO: 1252649 - DNA, 22 bp, Artificial Sequence
  chemically synthesized
agggccccgatttttttctaat

SEQ ID NO: 1252650 - DNA, 22 bp, Artificial Sequence
  chemically synthesized
tagggccccgatttttttctaa

SEQ ID NO: 1252651 - DNA, 22 bp, Artificial Sequence
  chemically synthesized
ttagggccccgatttttttcta

SEQ ID NO: 1252652 - DNA, 22 bp, Artificial Sequence
  chemically synthesized
acctatagattagaaaaaaatc

SEQ ID NO: 1252653 - DNA, 22 bp, Artificial Sequence
  chemically synthesized
tagattagaaaaaaatcggggc

SEQ ID NO: 1252654 - DNA, 22 bp, Artificial Sequence
  chemically synthesized
gaaaaaaatcggggccctaaaa

SEQ ID NO: 1252655 - DNA, 22 bp, Artificial Sequence
  chemically synthesized
gaccccatcagtagtgtgtctt

SEQ ID NO: 1252656 - DNA, 22 bp, Artificial Sequence
  chemically synthesized
tccctagaccccatcagtagtg

SEQ ID NO: 1252657 - DNA, 22 bp, Artificial Sequence
  chemically synthesized
tatccctagaccccatcagtag

SEQ ID NO: 1252658 - DNA, 22 bp, Artificial Sequence
  chemically synthesized
aaagacacactactgatggggt

SEQ ID NO: 1252659 - DNA, 22 bp, Artificial Sequence
  chemically synthesized
aaaatagctctatccctagacc

SEQ ID NO: 1252660 - DNA, 22 bp, Artificial Sequence
  chemically synthesized
aaaaatagctctatccctagac

SEQ ID NO: 1252661 - DNA, 22 bp, Artificial Sequence
  chemically synthesized
taaaaatagctctatccctaga

SEQ ID NO: 1252662 - DNA, 22 bp, Artificial Sequence
  chemically synthesized
ctgatggggtctagggatagag

SEQ ID NO: 1252663 - DNA, 22 bp, Artificial Sequence
  chemically synthesized
ctttaaaaatagctctatccct

SEQ ID NO: 1252664 - DNA, 22 bp, Artificial Sequence
  chemically synthesized
atggggtctagggatagagcta

SEQ ID NO: 1252665 - DNA, 22 bp, Artificial Sequence
  chemically synthesized
ccactgctttaaaaatagctct

SEQ ID NO: 1252666 - DNA, 22 bp, Artificial Sequence
  chemically synthesized
ttaccactgctttaaaaatagc

SEQ ID NO: 1252667 - DNA, 22 bp, Artificial Sequence
  chemically synthesized
gttaccactgctttaaaaatag

SEQ ID NO: 1252668 - DNA, 22 bp, Artificial Sequence
  chemically synthesized
tgttaccactgctttaaaaata

SEQ ID NO: 1252669 - DNA, 22 bp, Artificial Sequence
  chemically synthesized
gggatagagctatttttaaagc

SEQ ID NO: 1252670 - DNA, 22 bp, Artificial Sequence
  chemically synthesized
ttttgttaccactgctttaaaa

SEQ ID NO: 1252671 - DNA, 22 bp, Artificial Sequence
  chemically synthesized
tttttaaagcagtggtaacaaa

SEQ ID NO: 1252672 - DNA, 22 bp, Artificial Sequence
  chemically synthesized
ttaaagcagtggtaacaaaaca

SEQ ID NO: 1252673 - DNA, 22 bp, Artificial Sequence
  chemically synthesized
cgtgacaccaattgttttgtta

SEQ ID NO: 1252674 - DNA, 22 bp, Artificial Sequence
  chemically synthesized
taaagcagtggtaacaaaacaa

SEQ ID NO: 1252675 - DNA, 22 bp, Artificial Sequence
  chemically synthesized
aaagcagtggtaacaaaacaat

SEQ ID NO: 1252676 - DNA, 22 bp, Artificial Sequence
  chemically synthesized
aagcagtggtaacaaaacaatt

SEQ ID NO: 1252677 - DNA, 22 bp, Artificial Sequence
  chemically synthesized
gagtgttacgtgacaccaattg

SEQ ID NO: 1252678 - DNA, 22 bp, Artificial Sequence
  chemically synthesized
ctggagtgttacgtgacaccaa

SEQ ID NO: 1252679 - DNA, 22 bp, Artificial Sequence
  chemically synthesized
gttactggagtgttacgtgaca

SEQ ID NO: 1252680 - DNA, 22 bp, Artificial Sequence
  chemically synthesized
agttactggagtgttacgtgac

SEQ ID NO: 1252681 - DNA, 22 bp, Artificial Sequence
  chemically synthesized
tcttagttactggagtgttacg

SEQ ID NO: 1252682 - DNA, 22 bp, Artificial Sequence
  chemically synthesized
gtgtcacgtaacactccagtaa

SEQ ID NO: 1252683 - DNA, 22 bp, Artificial Sequence
  chemically synthesized
cagtcaagtgaattatcttagt

SEQ ID NO: 1252684 - DNA, 22 bp, Artificial Sequence
  chemically synthesized
gcagtcaagtgaattatcttag

SEQ ID NO: 1252685 - DNA, 22 bp, Artificial Sequence
  chemically synthesized
tcttgcagtcaagtgaattatc

SEQ ID NO: 1252686 - DNA, 22 bp, Artificial Sequence
  chemically synthesized
gtcttgcagtcaagtgaattat

SEQ ID NO: 1252687 - DNA, 22 bp, Artificial Sequence
  chemically synthesized
cagtaactaagataattcactt

SEQ ID NO: 1252688 - DNA, 22 bp, Artificial Sequence
  chemically synthesized
cttgtcttgcagtcaagtgaat

SEQ ID NO: 1252689 - DNA, 22 bp, Artificial Sequence
  chemically synthesized
gcttgtcttgcagtcaagtgaa

SEQ ID NO: 1252690 - DNA, 22 bp, Artificial Sequence
  chemically synthesized
tgcttgtcttgcagtcaagtga

SEQ ID NO: 1252691 - DNA, 22 bp, Artificial Sequence
  chemically synthesized
agataattcacttgactgcaag

SEQ ID NO: 1252692 - DNA, 22 bp, Artificial Sequence
  chemically synthesized
tattttgcttgtcttgcagtca

SEQ ID NO: 1252693 - DNA, 22 bp, Artificial Sequence
  chemically synthesized
acatcctatattttgcttgtct

SEQ ID NO: 1252694 - DNA, 22 bp, Artificial Sequence
  chemically synthesized
acttgactgcaagacaagcaaa

SEQ ID NO: 1252695 - DNA, 22 bp, Artificial Sequence
  chemically synthesized
aacatcctatattttgcttgtc

SEQ ID NO: 1252696 - DNA, 22 bp, Artificial Sequence
  chemically synthesized
gactgcaagacaagcaaaatat

SEQ ID NO: 1252697 - DNA, 22 bp, Artificial Sequence
  chemically synthesized
actgcaagacaagcaaaatata

SEQ ID NO: 1252698 - DNA, 22 bp, Artificial Sequence
  chemically synthesized
cacatttaacatcctatatttt

SEQ ID NO: 1252699 - DNA, 22 bp, Artificial Sequence
  chemically synthesized
caagacaagcaaaatataggat

SEQ ID NO: 1252700 - DNA, 22 bp, Artificial Sequence
  chemically synthesized
agacatagttgcacatttaaca

SEQ ID NO: 1252701 - DNA, 22 bp, Artificial Sequence
  chemically synthesized
gagacatagttgcacatttaac

SEQ ID NO: 1252702 - DNA, 22 bp, Artificial Sequence
  chemically synthesized
ggtaaccttgagacatagttgc

SEQ ID NO: 1252703 - DNA, 22 bp, Artificial Sequence
  chemically synthesized
gggtaaccttgagacatagttg

SEQ ID NO: 1252704 - DNA, 22 bp, Artificial Sequence
  chemically synthesized
acttgggtaaccttgagacata

SEQ ID NO: 1252705 - DNA, 22 bp, Artificial Sequence
  chemically synthesized
aacttgggtaaccttgagacat

SEQ ID NO: 1252706 - DNA, 22 bp, Artificial Sequence
  chemically synthesized
aatgtgcaactatgtctcaagg

SEQ ID NO: 1252707 - DNA, 22 bp, Artificial Sequence
  chemically synthesized
taacttgggtaaccttgagaca

SEQ ID NO: 1252708 - DNA, 22 bp, Artificial Sequence
  chemically synthesized
caaattttaacttgggtaacct

SEQ ID NO: 1252709 - DNA, 22 bp, Artificial Sequence
  chemically synthesized
ctccaaattttaacttgggtaa

SEQ ID NO: 1252710 - DNA, 22 bp, Artificial Sequence
  chemically synthesized
tgtctcaaggttacccaagtta

SEQ ID NO: 1252711 - DNA, 22 bp, Artificial Sequence
  chemically synthesized
gttgctccaaattttaacttgg

SEQ ID NO: 1252712 - DNA, 22 bp, Artificial Sequence
  chemically synthesized
agttgctccaaattttaacttg

SEQ ID NO: 1252713 - DNA, 22 bp, Artificial Sequence
  chemically synthesized
aaggttacccaagttaaaattt

SEQ ID NO: 1252714 - DNA, 22 bp, Artificial Sequence
  chemically synthesized
cccaagttaaaatttggagcaa

SEQ ID NO: 1252715 - DNA, 22 bp, Artificial Sequence
  chemically synthesized
taaaatgagacatgtttagttg

SEQ ID NO: 1252716 - DNA, 22 bp, Artificial Sequence
  chemically synthesized
aaatttggagcaactaaacatg

SEQ ID NO: 1252717 - DNA, 22 bp, Artificial Sequence
  chemically synthesized
tcattgtaaaatgagacatgtt

SEQ ID NO: 1252718 - DNA, 22 bp, Artificial Sequence
  chemically synthesized
gtcattgtaaaatgagacatgt

SEQ ID NO: 1252719 - DNA, 22 bp, Artificial Sequence
  chemically synthesized
ggagcaactaaacatgtctcat

SEQ ID NO: 1252720 - DNA, 22 bp, Artificial Sequence
  chemically synthesized
tgtcattgtaaaatgagacatg

SEQ ID NO: 1252721 - DNA, 22 bp, Artificial Sequence
  chemically synthesized
gagcaactaaacatgtctcatt

SEQ ID NO: 1252722 - DNA, 22 bp, Artificial Sequence
  chemically synthesized
attttgtcattgtaaaatgaga

SEQ ID NO: 1252723 - DNA, 22 bp, Artificial Sequence
  chemically synthesized
aacatgtctcattttacaatga

SEQ ID NO: 1252724 - DNA, 22 bp, Artificial Sequence
  chemically synthesized
agtgttcattttgtcattgtaa

SEQ ID NO: 1252725 - DNA, 22 bp, Artificial Sequence
  chemically synthesized
attttacaatgacaaaatgaac

SEQ ID NO: 1252726 - DNA, 22 bp, Artificial Sequence
  chemically synthesized
tacaatgacaaaatgaacactt

SEQ ID NO: 1252727 - DNA, 22 bp, Artificial Sequence
  chemically synthesized
acaatgacaaaatgaacactta

SEQ ID NO: 1252728 - DNA, 22 bp, Artificial Sequence
  chemically synthesized
caatgacaaaatgaacacttag

SEQ ID NO: 1252729 - DNA, 22 bp, Artificial Sequence
  chemically synthesized
aacacagtgaaaactaagtgtt

SEQ ID NO: 1252730 - DNA, 22 bp, Artificial Sequence
  chemically synthesized
aaacacagtgaaaactaagtgt

SEQ ID NO: 1252731 - DNA, 22 bp, Artificial Sequence
  chemically synthesized
ttaaacacagtgaaaactaagt

SEQ ID NO: 1252732 - DNA, 22 bp, Artificial Sequence
  chemically synthesized
cttaaacacagtgaaaactaag

SEQ ID NO: 1252733 - DNA, 22 bp, Artificial Sequence
  chemically synthesized
tcttaaacacagtgaaaactaa

SEQ ID NO: 1252734 - DNA, 22 bp, Artificial Sequence
  chemically synthesized
ttcttaaacacagtgaaaacta

SEQ ID NO: 1252735 - DNA, 22 bp, Artificial Sequence
  chemically synthesized
agttttcactgtgtttaagaaa

SEQ ID NO: 1252736 - DNA, 22 bp, Artificial Sequence
  chemically synthesized
gttttcactgtgtttaagaaaa

SEQ ID NO: 1252737 - DNA, 22 bp, Artificial Sequence
  chemically synthesized
atgtggcaaagacacttttctt

SEQ ID NO: 1252738 - DNA, 22 bp, Artificial Sequence
  chemically synthesized
tcactgtgtttaagaaaagtgt

SEQ ID NO: 1252739 - DNA, 22 bp, Artificial Sequence
  chemically synthesized
aatgtggcaaagacacttttct

SEQ ID NO: 1252740 - DNA, 22 bp, Artificial Sequence
  chemically synthesized
cactgtgtttaagaaaagtgtc

SEQ ID NO: 1252741 - DNA, 22 bp, Artificial Sequence
  chemically synthesized
actgtgtttaagaaaagtgtct

SEQ ID NO: 1252742 - DNA, 22 bp, Artificial Sequence
  chemically synthesized
tgtttaagaaaagtgtctttgc

SEQ ID NO: 1252743 - DNA, 22 bp, Artificial Sequence
  chemically synthesized
aagaaaagtgtctttgccacat

SEQ ID NO: 1252744 - DNA, 22 bp, Artificial Sequence
  chemically synthesized
ataatgcatttaatgtggcaaa

SEQ ID NO: 1252745 - DNA, 22 bp, Artificial Sequence
  chemically synthesized
agaaaagtgtctttgccacatt

SEQ ID NO: 1252746 - DNA, 22 bp, Artificial Sequence
  chemically synthesized
ctgataatgcatttaatgtggc

SEQ ID NO: 1252747 - DNA, 22 bp, Artificial Sequence
  chemically synthesized
tgccacattaaatgcattatca

SEQ ID NO: 1252748 - DNA, 22 bp, Artificial Sequence
  chemically synthesized
gccacattaaatgcattatcag

SEQ ID NO: 1252749 - DNA, 22 bp, Artificial Sequence
  chemically synthesized
ccacattaaatgcattatcagg

SEQ ID NO: 1252750 - DNA, 22 bp, Artificial Sequence
  chemically synthesized
tgataataatgtatctcctgat

SEQ ID NO: 1252751 - DNA, 22 bp, Artificial Sequence
  chemically synthesized
aatgcattatcaggagatacat

SEQ ID NO: 1252752 - DNA, 22 bp, Artificial Sequence
  chemically synthesized
cagctgtgataataatgtatct

SEQ ID NO: 1252753 - DNA, 22 bp, Artificial Sequence
  chemically synthesized
gcagctgtgataataatgtatc

SEQ ID NO: 1252754 - DNA, 22 bp, Artificial Sequence
  chemically synthesized
cttgcagctgtgataataatgt

SEQ ID NO: 1252755 - DNA, 22 bp, Artificial Sequence
  chemically synthesized
ccttgcagctgtgataataatg

SEQ ID NO: 1252756 - DNA, 22 bp, Artificial Sequence
  chemically synthesized
tccttgcagctgtgataataat

SEQ ID NO: 1252757 - DNA, 22 bp, Artificial Sequence
  chemically synthesized
tcaggagatacattattatcac

SEQ ID NO: 1252758 - DNA, 22 bp, Artificial Sequence
  chemically synthesized
aaaaatattttccttgcagctg

SEQ ID NO: 1252759 - DNA, 22 bp, Artificial Sequence
  chemically synthesized
ttatcacagctgcaaggaaaat

SEQ ID NO: 1252760 - DNA, 22 bp, Artificial Sequence
  chemically synthesized
aatctgaaaaatattttccttg

SEQ ID NO: 1252761 - DNA, 22 bp, Artificial Sequence
  chemically synthesized
gaatctgaaaaatattttcctt

SEQ ID NO: 1252762 - DNA, 22 bp, Artificial Sequence
  chemically synthesized
tgaatctgaaaaatattttcct

SEQ ID NO: 1252763 - DNA, 22 bp, Artificial Sequence
  chemically synthesized
tcacagctgcaaggaaaatatt

SEQ ID NO: 1252764 - DNA, 22 bp, Artificial Sequence
  chemically synthesized
aatctttgaatctgaaaaatat

SEQ ID NO: 1252765 - DNA, 22 bp, Artificial Sequence
  chemically synthesized
ttgaatctttgaatctgaaaaa

SEQ ID NO: 1252766 - DNA, 22 bp, Artificial Sequence
  chemically synthesized
caaggaaaatatttttcagatt

SEQ ID NO: 1252767 - DNA, 22 bp, Artificial Sequence
  chemically synthesized
ttcagattcaaagattcaacaa

SEQ ID NO: 1252768 - DNA, 22 bp, Artificial Sequence
  chemically synthesized
cgtaccacagtgttgttgaatc

SEQ ID NO: 1252769 - DNA, 22 bp, Artificial Sequence
  chemically synthesized
tcagattcaaagattcaacaac

SEQ ID NO: 1252770 - DNA, 22 bp, Artificial Sequence
  chemically synthesized
cagattcaaagattcaacaaca

SEQ ID NO: 1252771 - DNA, 22 bp, Artificial Sequence
  chemically synthesized
tgcgtaccacagtgttgttgaa

SEQ ID NO: 1252772 - DNA, 22 bp, Artificial Sequence
  chemically synthesized
agattcaaagattcaacaacac

SEQ ID NO: 1252773 - DNA, 22 bp, Artificial Sequence
  chemically synthesized
aagttctgcgtaccacagtgtt

SEQ ID NO: 1252774 - DNA, 22 bp, Artificial Sequence
  chemically synthesized
aaagattcaacaacactgtggt

SEQ ID NO: 1252775 - DNA, 22 bp, Artificial Sequence
  chemically synthesized
aacaacactgtggtacgcagaa

SEQ ID NO: 1252776 - DNA, 22 bp, Artificial Sequence
  chemically synthesized
acagcaattcaagttctgcgta

SEQ ID NO: 1252777 - DNA, 22 bp, Artificial Sequence
  chemically synthesized
atctgacagcaattcaagttct

SEQ ID NO: 1252778 - DNA, 22 bp, Artificial Sequence
  chemically synthesized
catctgacagcaattcaagttc

SEQ ID NO: 1252779 - DNA, 22 bp, Artificial Sequence
  chemically synthesized
tcatctgacagcaattcaagtt

SEQ ID NO: 1252780 - DNA, 22 bp, Artificial Sequence
  chemically synthesized
ttcatctgacagcaattcaagt

SEQ ID NO: 1252781 - DNA, 22 bp, Artificial Sequence
  chemically synthesized
tggtacgcagaacttgaattgc

SEQ ID NO: 1252782 - DNA, 22 bp, Artificial Sequence
  chemically synthesized
acttttcatctgacagcaattc

SEQ ID NO: 1252783 - DNA, 22 bp, Artificial Sequence
  chemically synthesized
aacttttcatctgacagcaatt

SEQ ID NO: 1252784 - DNA, 22 bp, Artificial Sequence
  chemically synthesized
acgtttaacttttcatctgaca

SEQ ID NO: 1252785 - DNA, 22 bp, Artificial Sequence
  chemically synthesized
ctgacgtttaacttttcatctg

SEQ ID NO: 1252786 - DNA, 22 bp, Artificial Sequence
  chemically synthesized
gaattgctgtcagatgaaaagt

SEQ ID NO: 1252787 - DNA, 22 bp, Artificial Sequence
  chemically synthesized
aattgctgtcagatgaaaagtt

SEQ ID NO: 1252788 - DNA, 22 bp, Artificial Sequence
  chemically synthesized
aattgctgacgtttaacttttc

SEQ ID NO: 1252789 - DNA, 22 bp, Artificial Sequence
  chemically synthesized
caattgctgacgtttaactttt

SEQ ID NO: 1252790 - DNA, 22 bp, Artificial Sequence
  chemically synthesized
ctgtcagatgaaaagttaaacg

SEQ ID NO: 1252791 - DNA, 22 bp, Artificial Sequence
  chemically synthesized
tttcaattgctgacgtttaact

SEQ ID NO: 1252792 - DNA, 22 bp, Artificial Sequence
  chemically synthesized
tcagatgaaaagttaaacgtca

SEQ ID NO: 1252793 - DNA, 22 bp, Artificial Sequence
  chemically synthesized
ttgtttcaattgctgacgttta

SEQ ID NO: 1252794 - DNA, 22 bp, Artificial Sequence
  chemically synthesized
gttgtttcaattgctgacgttt

SEQ ID NO: 1252795 - DNA, 22 bp, Artificial Sequence
  chemically synthesized
aatatttgttgtttcaattgct

SEQ ID NO: 1252796 - DNA, 22 bp, Artificial Sequence
  chemically synthesized
tcctgaatatttgttgtttcaa

SEQ ID NO: 1252797 - DNA, 22 bp, Artificial Sequence
  chemically synthesized
aacgtcagcaattgaaacaaca

SEQ ID NO: 1252798 - DNA, 22 bp, Artificial Sequence
  chemically synthesized
gtcctgaatatttgttgtttca

SEQ ID NO: 1252799 - DNA, 22 bp, Artificial Sequence
  chemically synthesized
tgtcctgaatatttgttgtttc

SEQ ID NO: 1252800 - DNA, 22 bp, Artificial Sequence
  chemically synthesized
taaacactttgtcctgaatatt

SEQ ID NO: 1252801 - DNA, 22 bp, Artificial Sequence
  chemically synthesized
aaacaacaaatattcaggacaa

SEQ ID NO: 1252802 - DNA, 22 bp, Artificial Sequence
  chemically synthesized
aaaagaaagggctataaacact

SEQ ID NO: 1252803 - DNA, 22 bp, Artificial Sequence
  chemically synthesized
aggacaaagtgtttatagccct

SEQ ID NO: 1252804 - DNA, 22 bp, Artificial Sequence
  chemically synthesized
aatgtgaaaaccctcaaaagaa

SEQ ID NO: 1252805 - DNA, 22 bp, Artificial Sequence
  chemically synthesized
ctcaatgtgaaaaccctcaaaa

SEQ ID NO: 1252806 - DNA, 22 bp, Artificial Sequence
  chemically synthesized
atagccctttcttttgagggtt

SEQ ID NO: 1252807 - DNA, 22 bp, Artificial Sequence
  chemically synthesized
cctcaatgtgaaaaccctcaaa

SEQ ID NO: 1252808 - DNA, 22 bp, Artificial Sequence
  chemically synthesized
tagccctttcttttgagggttt

SEQ ID NO: 1252809 - DNA, 22 bp, Artificial Sequence
  chemically synthesized
tcttttgagggttttcacattg

SEQ ID NO: 1252810 - DNA, 22 bp, Artificial Sequence
  chemically synthesized
cttttgagggttttcacattga

SEQ ID NO: 1252811 - DNA, 22 bp, Artificial Sequence
  chemically synthesized
ttttgagggttttcacattgag

SEQ ID NO: 1252812 - DNA, 22 bp, Artificial Sequence
  chemically synthesized
ttgagggttttcacattgagga

SEQ ID NO: 1252813 - DNA, 22 bp, Artificial Sequence
  chemically synthesized
tgagggttttcacattgaggaa

SEQ ID NO: 1252814 - DNA, 22 bp, Artificial Sequence
  chemically synthesized
gagggttttcacattgaggaag

SEQ ID NO: 1252815 - DNA, 22 bp, Artificial Sequence
  chemically synthesized
agggttttcacattgaggaagt

SEQ ID NO: 1252816 - DNA, 22 bp, Artificial Sequence
  chemically synthesized
gagaagataaaaagcatacttc

SEQ ID NO: 1252817 - DNA, 22 bp, Artificial Sequence
  chemically synthesized
tcacattgaggaagtatgcttt

SEQ ID NO: 1252818 - DNA, 22 bp, Artificial Sequence
  chemically synthesized
cacattgaggaagtatgctttt

SEQ ID NO: 1252819 - DNA, 22 bp, Artificial Sequence
  chemically synthesized
acattgaggaagtatgcttttt

SEQ ID NO: 1252820 - DNA, 22 bp, Artificial Sequence
  chemically synthesized
aggaagtatgctttttatcttc

SEQ ID NO: 1252821 - DNA, 22 bp, Artificial Sequence
  chemically synthesized
aagtatcactggagaagataaa

SEQ ID NO: 1252822 - DNA, 22 bp, Artificial Sequence
  chemically synthesized
tttatcttctccagtgatactt

SEQ ID NO: 1252823 - DNA, 22 bp, Artificial Sequence
  chemically synthesized
ttatcttctccagtgatacttt

SEQ ID NO: 1252824 - DNA, 22 bp, Artificial Sequence
  chemically synthesized
aaggcccatgttaaagtatcac

SEQ ID NO: 1252825 - DNA, 22 bp, Artificial Sequence
  chemically synthesized
tatcttctccagtgatacttta

SEQ ID NO: 1252826 - DNA, 22 bp, Artificial Sequence
  chemically synthesized
gaaggcccatgttaaagtatca

SEQ ID NO: 1252827 - DNA, 22 bp, Artificial Sequence
  chemically synthesized
atcttctccagtgatactttaa

SEQ ID NO: 1252828 - DNA, 22 bp, Artificial Sequence
  chemically synthesized
tcttctccagtgatactttaac

SEQ ID NO: 1252829 - DNA, 22 bp, Artificial Sequence
  chemically synthesized
ctccagtgatactttaacatgg

SEQ ID NO: 1252830 - DNA, 22 bp, Artificial Sequence
  chemically synthesized
tccagtgatactttaacatggg

SEQ ID NO: 1252831 - DNA, 22 bp, Artificial Sequence
  chemically synthesized
aggtgcttgaaggcccatgtta

SEQ ID NO: 1252832 - DNA, 22 bp, Artificial Sequence
  chemically synthesized
cagtgatactttaacatgggcc

SEQ ID NO: 1252833 - DNA, 22 bp, Artificial Sequence
  chemically synthesized
ttcaggtgcttgaaggcccatg

SEQ ID NO: 1252834 - DNA, 22 bp, Artificial Sequence
  chemically synthesized
ttattcaggtgcttgaaggccc

SEQ ID NO: 1252835 - DNA, 22 bp, Artificial Sequence
  chemically synthesized
ctgttattcaggtgcttgaagg

SEQ ID NO: 1252836 - DNA, 22 bp, Artificial Sequence
  chemically synthesized
taacatgggccttcaagcacct

SEQ ID NO: 1252837 - DNA, 22 bp, Artificial Sequence
  chemically synthesized
aacatgggccttcaagcacctg

SEQ ID NO: 1252838 - DNA, 22 bp, Artificial Sequence
  chemically synthesized
acatgggccttcaagcacctga

SEQ ID NO: 1252839 - DNA, 22 bp, Artificial Sequence
  chemically synthesized
taattgctgttattcaggtgct

SEQ ID NO: 1252840 - DNA, 22 bp, Artificial Sequence
  chemically synthesized
gtaattgctgttattcaggtgc

SEQ ID NO: 1252841 - DNA, 22 bp, Artificial Sequence
  chemically synthesized
tgtaattgctgttattcaggtg

SEQ ID NO: 1252842 - DNA, 22 bp, Artificial Sequence
  chemically synthesized
ttgtaattgctgttattcaggt

SEQ ID NO: 1252843 - DNA, 22 bp, Artificial Sequence
  chemically synthesized
caagcacctgaataacagcaat

SEQ ID NO: 1252844 - DNA, 22 bp, Artificial Sequence
  chemically synthesized
aagcacctgaataacagcaatt

SEQ ID NO: 1252845 - DNA, 22 bp, Artificial Sequence
  chemically synthesized
aataacagcaattacaaaaata

SEQ ID NO: 1252846 - DNA, 22 bp, Artificial Sequence
  chemically synthesized
atgaaaaaaatatatttttgta

SEQ ID NO: 1252847 - DNA, 22 bp, Artificial Sequence
  chemically synthesized
caaaaatatatttttttcatca

SEQ ID NO: 1252848 - DNA, 22 bp, Artificial Sequence
  chemically synthesized
ttttcatcaacgactgggcatt

SEQ ID NO: 1252849 - DNA, 22 bp, Artificial Sequence
  chemically synthesized
tttcatcaacgactgggcattt

SEQ ID NO: 1252850 - DNA, 22 bp, Artificial Sequence
  chemically synthesized
ttcatcaacgactgggcatttt

SEQ ID NO: 1252851 - DNA, 22 bp, Artificial Sequence
  chemically synthesized
tcatcaacgactgggcatttta

SEQ ID NO: 1252852 - DNA, 22 bp, Artificial Sequence
  chemically synthesized
catcaacgactgggcattttat

SEQ ID NO: 1252853 - DNA, 22 bp, Artificial Sequence
  chemically synthesized
atcaacgactgggcattttatg

SEQ ID NO: 1252854 - DNA, 22 bp, Artificial Sequence
  chemically synthesized
ataggcaaaataaaaaaaacgc

SEQ ID NO: 1252855 - DNA, 22 bp, Artificial Sequence
  chemically synthesized
aataggcaaaataaaaaaaacg

SEQ ID NO: 1252856 - DNA, 22 bp, Artificial Sequence
  chemically synthesized
ggcattttatgcgtttttttta

SEQ ID NO: 1252857 - DNA, 22 bp, Artificial Sequence
  chemically synthesized
tatgcgttttttttattttgcc

SEQ ID NO: 1252858 - DNA, 22 bp, Artificial Sequence
  chemically synthesized
atgcgttttttttattttgcct

SEQ ID NO: 1252859 - DNA, 22 bp, Artificial Sequence
  chemically synthesized
tgcgttttttttattttgccta

SEQ ID NO: 1252860 - DNA, 22 bp, Artificial Sequence
  chemically synthesized
agggcatatttaataggcaaaa

SEQ ID NO: 1252861 - DNA, 22 bp, Artificial Sequence
  chemically synthesized
aagggcatatttaataggcaaa

SEQ ID NO: 1252862 - DNA, 22 bp, Artificial Sequence
  chemically synthesized
taagggcatatttaataggcaa

SEQ ID NO: 1252863 - DNA, 22 bp, Artificial Sequence
  chemically synthesized
tttttattttgcctattaaata

SEQ ID NO: 1252864 - DNA, 22 bp, Artificial Sequence
  chemically synthesized
ttttattttgcctattaaatat

SEQ ID NO: 1252865 - DNA, 22 bp, Artificial Sequence
  chemically synthesized
tttattttgcctattaaatatg

SEQ ID NO: 1252866 - DNA, 22 bp, Artificial Sequence
  chemically synthesized
ttattttgcctattaaatatgc

SEQ ID NO: 1252867 - DNA, 22 bp, Artificial Sequence
  chemically synthesized
tattttgcctattaaatatgcc

SEQ ID NO: 1252868 - DNA, 22 bp, Artificial Sequence
  chemically synthesized
attttgcctattaaatatgccc

SEQ ID NO: 1252869 - DNA, 22 bp, Artificial Sequence
  chemically synthesized
ttttgcctattaaatatgccct

SEQ ID NO: 1252870 - DNA, 22 bp, Artificial Sequence
  chemically synthesized
tgcctattaaatatgcccttaa

SEQ ID NO: 1252871 - DNA, 22 bp, Artificial Sequence
  chemically synthesized
gcctattaaatatgcccttaaa

SEQ ID NO: 1252872 - DNA, 22 bp, Artificial Sequence
  chemically synthesized
cctattaaatatgcccttaaaa

SEQ ID NO: 1252873 - DNA, 22 bp, Artificial Sequence
  chemically synthesized
aggaacaagcacgattttaagg

SEQ ID NO: 1252874 - DNA, 22 bp, Artificial Sequence
  chemically synthesized
ttaaatatgcccttaaaatcgt

SEQ ID NO: 1252875 - DNA, 22 bp, Artificial Sequence
  chemically synthesized
aatatgcccttaaaatcgtgct

SEQ ID NO: 1252876 - DNA, 22 bp, Artificial Sequence
  chemically synthesized
ataagtagactgaggaacaagc

SEQ ID NO: 1252877 - DNA, 22 bp, Artificial Sequence
  chemically synthesized
taataagtagactgaggaacaa

SEQ ID NO: 1252878 - DNA, 22 bp, Artificial Sequence
  chemically synthesized
ctaataagtagactgaggaaca

SEQ ID NO: 1252879 - DNA, 22 bp, Artificial Sequence
  chemically synthesized
aaaatcgtgcttgttcctcagt

SEQ ID NO: 1252880 - DNA, 22 bp, Artificial Sequence
  chemically synthesized
aaatcgtgcttgttcctcagtc

SEQ ID NO: 1252881 - DNA, 22 bp, Artificial Sequence
  chemically synthesized
aacttctaataagtagactgag

SEQ ID NO: 1252882 - DNA, 22 bp, Artificial Sequence
  chemically synthesized
gaacttctaataagtagactga

SEQ ID NO: 1252883 - DNA, 22 bp, Artificial Sequence
  chemically synthesized
tgaacttctaataagtagactg

SEQ ID NO: 1252884 - DNA, 22 bp, Artificial Sequence
  chemically synthesized
ttttgaacttctaataagtaga

SEQ ID NO: 1252885 - DNA, 22 bp, Artificial Sequence
  chemically synthesized
gttttgaacttctaataagtag

SEQ ID NO: 1252886 - DNA, 22 bp, Artificial Sequence
  chemically synthesized
gttcctcagtctacttattaga

SEQ ID NO: 1252887 - DNA, 22 bp, Artificial Sequence
  chemically synthesized
ttcctcagtctacttattagaa

SEQ ID NO: 1252888 - DNA, 22 bp, Artificial Sequence
  chemically synthesized
ctcagtctacttattagaagtt

SEQ ID NO: 1252889 - DNA, 22 bp, Artificial Sequence
  chemically synthesized
agtctacttattagaagttcaa

SEQ ID NO: 1252890 - DNA, 22 bp, Artificial Sequence
  chemically synthesized
aaccaaagccttgttttgaact

SEQ ID NO: 1252891 - DNA, 22 bp, Artificial Sequence
  chemically synthesized
gaaccaaagccttgttttgaac

SEQ ID NO: 1252892 - DNA, 22 bp, Artificial Sequence
  chemically synthesized
cttattagaagttcaaaacaag

SEQ ID NO: 1252893 - DNA, 22 bp, Artificial Sequence
  chemically synthesized
attagaagttcaaaacaaggct

SEQ ID NO: 1252894 - DNA, 22 bp, Artificial Sequence
  chemically synthesized
gatttgaaccaaagccttgttt

SEQ ID NO: 1252895 - DNA, 22 bp, Artificial Sequence
  chemically synthesized
ttagaagttcaaaacaaggctt

SEQ ID NO: 1252896 - DNA, 22 bp, Artificial Sequence
  chemically synthesized
gaagttcaaaacaaggctttgg

SEQ ID NO: 1252897 - DNA, 22 bp, Artificial Sequence
  chemically synthesized
agaaactggatttgaaccaaag

SEQ ID NO: 1252898 - DNA, 22 bp, Artificial Sequence
  chemically synthesized
aaaacaaggctttggttcaaat

SEQ ID NO: 1252899 - DNA, 22 bp, Artificial Sequence
  chemically synthesized
tctcagaaactggatttgaacc

SEQ ID NO: 1252900 - DNA, 22 bp, Artificial Sequence
  chemically synthesized
atctcagaaactggatttgaac

SEQ ID NO: 1252901 - DNA, 22 bp, Artificial Sequence
  chemically synthesized
agaaatttatctcagaaactgg

SEQ ID NO: 1252902 - DNA, 22 bp, Artificial Sequence
  chemically synthesized
tggttcaaatccagtttctgag

SEQ ID NO: 1252903 - DNA, 22 bp, Artificial Sequence
  chemically synthesized
ggttcaaatccagtttctgaga

SEQ ID NO: 1252904 - DNA, 22 bp, Artificial Sequence
  chemically synthesized
gttcaaatccagtttctgagat

SEQ ID NO: 1252905 - DNA, 22 bp, Artificial Sequence
  chemically synthesized
aaatccagtttctgagataaat

SEQ ID NO: 1252906 - DNA, 22 bp, Artificial Sequence
  chemically synthesized
caatgaattaagaaatttatct

SEQ ID NO: 1252907 - DNA, 22 bp, Artificial Sequence
  chemically synthesized
acaatgaattaagaaatttatc

SEQ ID NO: 1252908 - DNA, 22 bp, Artificial Sequence
  chemically synthesized
tacaatgaattaagaaatttat

SEQ ID NO: 1252909 - DNA, 22 bp, Artificial Sequence
  chemically synthesized
ttacaatgaattaagaaattta

SEQ ID NO: 1252910 - DNA, 22 bp, Artificial Sequence
  chemically synthesized
tttacaatgaattaagaaattt

SEQ ID NO: 1252911 - DNA, 22 bp, Artificial Sequence
  chemically synthesized
ctgagataaatttcttaattca

SEQ ID NO: 1252912 - DNA, 22 bp, Artificial Sequence
  chemically synthesized
tgagataaatttcttaattcat

SEQ ID NO: 1252913 - DNA, 22 bp, Artificial Sequence
  chemically synthesized
atattttttacaatgaattaag

SEQ ID NO: 1252914 - DNA, 22 bp, Artificial Sequence
  chemically synthesized
agataaatttcttaattcattg

SEQ ID NO: 1252915 - DNA, 22 bp, Artificial Sequence
  chemically synthesized
gtcaccattaatattttttaca

SEQ ID NO: 1252916 - DNA, 22 bp, Artificial Sequence
  chemically synthesized
ggtcaccattaatattttttac

SEQ ID NO: 1252917 - DNA, 22 bp, Artificial Sequence
  chemically synthesized
cttaattcattgtaaaaaatat

SEQ ID NO: 1252918 - DNA, 22 bp, Artificial Sequence
  chemically synthesized
tggtcaccattaatatttttta

SEQ ID NO: 1252919 - DNA, 22 bp, Artificial Sequence
  chemically synthesized
ttaattcattgtaaaaaatatt

SEQ ID NO: 1252920 - DNA, 22 bp, Artificial Sequence
  chemically synthesized
aattcattgtaaaaaatattaa

SEQ ID NO: 1252921 - DNA, 22 bp, Artificial Sequence
  chemically synthesized
attcattgtaaaaaatattaat

SEQ ID NO: 1252922 - DNA, 22 bp, Artificial Sequence
  chemically synthesized
aaattttggtcaccattaatat

SEQ ID NO: 1252923 - DNA, 22 bp, Artificial Sequence
  chemically synthesized
attgtaaaaaatattaatggtg

SEQ ID NO: 1252924 - DNA, 22 bp, Artificial Sequence
  chemically synthesized
taaaaaatattaatggtgacca

SEQ ID NO: 1252925 - DNA, 22 bp, Artificial Sequence
  chemically synthesized
aaaacattaaaattttggtcac

SEQ ID NO: 1252926 - DNA, 22 bp, Artificial Sequence
  chemically synthesized
taaaaacattaaaattttggtc

SEQ ID NO: 1252927 - DNA, 22 bp, Artificial Sequence
  chemically synthesized
ctaaaaacattaaaattttggt

SEQ ID NO: 1252928 - DNA, 22 bp, Artificial Sequence
  chemically synthesized
tctaaaaacattaaaattttgg

SEQ ID NO: 1252929 - DNA, 22 bp, Artificial Sequence
  chemically synthesized
atggtgaccaaaattttaatgt

SEQ ID NO: 1252930 - DNA, 22 bp, Artificial Sequence
  chemically synthesized
tgatgttttctaaaaacattaa

SEQ ID NO: 1252931 - DNA, 22 bp, Artificial Sequence
  chemically synthesized
cctgtgatgttttctaaaaaca

SEQ ID NO: 1252932 - DNA, 22 bp, Artificial Sequence
  chemically synthesized
attacctgtgatgttttctaaa

SEQ ID NO: 1252933 - DNA, 22 bp, Artificial Sequence
  chemically synthesized
tgattacctgtgatgttttcta

SEQ ID NO: 1252934 - DNA, 22 bp, Artificial Sequence
  chemically synthesized
taatgtttttagaaaacatcac

SEQ ID NO: 1252935 - DNA, 22 bp, Artificial Sequence
  chemically synthesized
ttctgattacctgtgatgtttt

SEQ ID NO: 1252936 - DNA, 22 bp, Artificial Sequence
  chemically synthesized
aatgtttttagaaaacatcaca

SEQ ID NO: 1252937 - DNA, 22 bp, Artificial Sequence
  chemically synthesized
gttctgattacctgtgatgttt

SEQ ID NO: 1252938 - DNA, 22 bp, Artificial Sequence
  chemically synthesized
atgtttttagaaaacatcacag

SEQ ID NO: 1252939 - DNA, 22 bp, Artificial Sequence
  chemically synthesized
tttgttctgattacctgtgatg

SEQ ID NO: 1252940 - DNA, 22 bp, Artificial Sequence
  chemically synthesized
ctgtttgttctgattacctgtg

SEQ ID NO: 1252941 - DNA, 22 bp, Artificial Sequence
  chemically synthesized
ttagaaaacatcacaggtaatc

SEQ ID NO: 1252942 - DNA, 22 bp, Artificial Sequence
  chemically synthesized
tagaaaacatcacaggtaatca

SEQ ID NO: 1252943 - DNA, 22 bp, Artificial Sequence
  chemically synthesized
agaaaacatcacaggtaatcag

SEQ ID NO: 1252944 - DNA, 22 bp, Artificial Sequence
  chemically synthesized
ttcctgtttgttctgattacct

SEQ ID NO: 1252945 - DNA, 22 bp, Artificial Sequence
  chemically synthesized
gaaaacatcacaggtaatcaga

SEQ ID NO: 1252946 - DNA, 22 bp, Artificial Sequence
  chemically synthesized
attcctgtttgttctgattacc

SEQ ID NO: 1252947 - DNA, 22 bp, Artificial Sequence
  chemically synthesized
tattcctgtttgttctgattac

SEQ ID NO: 1252948 - DNA, 22 bp, Artificial Sequence
  chemically synthesized
ttattcctgtttgttctgatta

SEQ ID NO: 1252949 - DNA, 22 bp, Artificial Sequence
  chemically synthesized
tttattcctgtttgttctgatt

SEQ ID NO: 1252950 - DNA, 22 bp, Artificial Sequence
  chemically synthesized
tttttattcctgtttgttctga

SEQ ID NO: 1252951 - DNA, 22 bp, Artificial Sequence
  chemically synthesized
ttctttttattcctgtttgttc

SEQ ID NO: 1252952 - DNA, 22 bp, Artificial Sequence
  chemically synthesized
gttctttttattcctgtttgtt

SEQ ID NO: 1252953 - DNA, 22 bp, Artificial Sequence
  chemically synthesized
tgttctttttattcctgtttgt

SEQ ID NO: 1252954 - DNA, 22 bp, Artificial Sequence
  chemically synthesized
tttgttctttttattcctgttt

SEQ ID NO: 1252955 - DNA, 22 bp, Artificial Sequence
  chemically synthesized
ctctttgttctttttattcctg

SEQ ID NO: 1252956 - DNA, 22 bp, Artificial Sequence
  chemically synthesized
actctttgttctttttattcct

SEQ ID NO: 1252957 - DNA, 22 bp, Artificial Sequence
  chemically synthesized
tactctttgttctttttattcc

SEQ ID NO: 1252958 - DNA, 22 bp, Artificial Sequence
  chemically synthesized
ctttactctttgttctttttat

SEQ ID NO: 1252959 - DNA, 22 bp, Artificial Sequence
  chemically synthesized
cctttactctttgttcttttta

SEQ ID NO: 1252960 - DNA, 22 bp, Artificial Sequence
  chemically synthesized
cttcctttactctttgttcttt

SEQ ID NO: 1252961 - DNA, 22 bp, Artificial Sequence
  chemically synthesized
tccttcctttactctttgttct

SEQ ID NO: 1252962 - DNA, 22 bp, Artificial Sequence
  chemically synthesized
ctccttcctttactctttgttc

SEQ ID NO: 1252963 - DNA, 22 bp, Artificial Sequence
  chemically synthesized
cttctccttcctttactctttg

SEQ ID NO: 1252964 - DNA, 22 bp, Artificial Sequence
  chemically synthesized
ccttctccttcctttactcttt

SEQ ID NO: 1252965 - DNA, 22 bp, Artificial Sequence
  chemically synthesized
cttccttctccttcctttactc

SEQ ID NO: 1252966 - DNA, 22 bp, Artificial Sequence
  chemically synthesized
ccttccttctccttcctttact

SEQ ID NO: 1252967 - DNA, 22 bp, Artificial Sequence
  chemically synthesized
ttccttccttctccttccttta

SEQ ID NO: 1252968 - DNA, 22 bp, Artificial Sequence
  chemically synthesized
cttccttccttctccttccttt

SEQ ID NO: 1252969 - DNA, 22 bp, Artificial Sequence
  chemically synthesized
cttcttccttccttctccttcc

SEQ ID NO: 1252970 - DNA, 22 bp, Artificial Sequence
  chemically synthesized
ccttcttccttccttctccttc

SEQ ID NO: 1252971 - DNA, 22 bp, Artificial Sequence
  chemically synthesized
tccttcttccttccttctcctt

SEQ ID NO: 1252972 - DNA, 22 bp, Artificial Sequence
  chemically synthesized
ccctttccttcttccttccttc

SEQ ID NO: 1252973 - DNA, 22 bp, Artificial Sequence
  chemically synthesized
cccctttccttcttccttcctt

SEQ ID NO: 1252974 - DNA, 22 bp, Artificial Sequence
  chemically synthesized
tatttcccctttccttcttcct

SEQ ID NO: 1252975 - DNA, 22 bp, Artificial Sequence
  chemically synthesized
atatttcccctttccttcttcc

SEQ ID NO: 1252976 - DNA, 22 bp, Artificial Sequence
  chemically synthesized
cttatatttcccctttccttct

SEQ ID NO: 1252977 - DNA, 22 bp, Artificial Sequence
  chemically synthesized
ctccttatatttcccctttcct

SEQ ID NO: 1252978 - DNA, 22 bp, Artificial Sequence
  chemically synthesized
ctcctccttatatttccccttt

SEQ ID NO: 1252979 - DNA, 22 bp, Artificial Sequence
  chemically synthesized
tactcctccttatatttcccct

SEQ ID NO: 1252980 - DNA, 22 bp, Artificial Sequence
  chemically synthesized
tctactcctccttatatttccc

SEQ ID NO: 1252981 - DNA, 22 bp, Artificial Sequence
  chemically synthesized
attctctactcctccttatatt

SEQ ID NO: 1252982 - DNA, 22 bp, Artificial Sequence
  chemically synthesized
cattctctactcctccttatat

SEQ ID NO: 1252983 - DNA, 22 bp, Artificial Sequence
  chemically synthesized
ttcattctctactcctccttat

SEQ ID NO: 1252984 - DNA, 22 bp, Artificial Sequence
  chemically synthesized
acctcttcattctctactcctc

SEQ ID NO: 1252985 - DNA, 22 bp, Artificial Sequence
  chemically synthesized
cacctcttcattctctactcct

SEQ ID NO: 1252986 - DNA, 22 bp, Artificial Sequence
  chemically synthesized
ccttcacctcttcattctctac

SEQ ID NO: 1252987 - DNA, 22 bp, Artificial Sequence
  chemically synthesized
cccttcacctcttcattctcta

SEQ ID NO: 1252988 - DNA, 22 bp, Artificial Sequence
  chemically synthesized
tcccttcacctcttcattctct

SEQ ID NO: 1252989 - DNA, 22 bp, Artificial Sequence
  chemically synthesized
ttcccttcacctcttcattctc

SEQ ID NO: 1252990 - DNA, 22 bp, Artificial Sequence
  chemically synthesized
aaaataaaaatcacagcttttc

SEQ ID NO: 1252991 - DNA, 22 bp, Artificial Sequence
  chemically synthesized
tctgaaaataaaaatcacagct

SEQ ID NO: 1252992 - DNA, 22 bp, Artificial Sequence
  chemically synthesized
atctgaaaataaaaatcacagc

SEQ ID NO: 1252993 - DNA, 22 bp, Artificial Sequence
  chemically synthesized
tatctgaaaataaaaatcacag

SEQ ID NO: 1252994 - DNA, 22 bp, Artificial Sequence
  chemically synthesized
tgctttatctgaaaataaaaat

SEQ ID NO: 1252995 - DNA, 22 bp, Artificial Sequence
  chemically synthesized
cctgtgctttatctgaaaataa

SEQ ID NO: 1252996 - DNA, 22 bp, Artificial Sequence
  chemically synthesized
tacctgtgctttatctgaaaat

SEQ ID NO: 1252997 - DNA, 22 bp, Artificial Sequence
  chemically synthesized
tctacctgtgctttatctgaaa

SEQ ID NO: 1252998 - DNA, 22 bp, Artificial Sequence
  chemically synthesized
ctctacctgtgctttatctgaa

SEQ ID NO: 1252999 - DNA, 22 bp, Artificial Sequence
  chemically synthesized
tgatttttattttcagataaag

SEQ ID NO: 1253000 - DNA, 22 bp, Artificial Sequence
  chemically synthesized
tctctacctgtgctttatctga

SEQ ID NO: 1253001 - DNA, 22 bp, Artificial Sequence
  chemically synthesized
ttattttcagataaagcacagg

SEQ ID NO: 1253002 - DNA, 22 bp, Artificial Sequence
  chemically synthesized
tattttcagataaagcacaggt

SEQ ID NO: 1253003 - DNA, 22 bp, Artificial Sequence
  chemically synthesized
attttcagataaagcacaggta

SEQ ID NO: 1253004 - DNA, 22 bp, Artificial Sequence
  chemically synthesized
ttttcagataaagcacaggtag

SEQ ID NO: 1253005 - DNA, 22 bp, Artificial Sequence
  chemically synthesized
tcagataaagcacaggtagaga

SEQ ID NO: 1253006 - DNA, 22 bp, Artificial Sequence
  chemically synthesized
cagataaagcacaggtagagaa

SEQ ID NO: 1253007 - DNA, 22 bp, Artificial Sequence
  chemically synthesized
atgtcatagattttctctacct

SEQ ID NO: 1253008 - DNA, 22 bp, Artificial Sequence
  chemically synthesized
agataaagcacaggtagagaaa

SEQ ID NO: 1253009 - DNA, 22 bp, Artificial Sequence
  chemically synthesized
ctaatgtcatagattttctcta

SEQ ID NO: 1253010 - DNA, 22 bp, Artificial Sequence
  chemically synthesized
tcctaatgtcatagattttctc

SEQ ID NO: 1253011 - DNA, 22 bp, Artificial Sequence
  chemically synthesized
aatgaaagactctcctaatgtc

SEQ ID NO: 1253012 - DNA, 22 bp, Artificial Sequence
  chemically synthesized
aaatgaaagactctcctaatgt

SEQ ID NO: 1253013 - DNA, 22 bp, Artificial Sequence
  chemically synthesized
taaatgaaagactctcctaatg

SEQ ID NO: 1253014 - DNA, 22 bp, Artificial Sequence
  chemically synthesized
ttaaatgaaagactctcctaat

SEQ ID NO: 1253015 - DNA, 22 bp, Artificial Sequence
  chemically synthesized
tgacattaggagagtctttcat

SEQ ID NO: 1253016 - DNA, 22 bp, Artificial Sequence
  chemically synthesized
tgaggtttttaaatgaaagact

SEQ ID NO: 1253017 - DNA, 22 bp, Artificial Sequence
  chemically synthesized
aaactatgaggtttttaaatga

SEQ ID NO: 1253018 - DNA, 22 bp, Artificial Sequence
  chemically synthesized
ggagagtctttcatttaaaaac

SEQ ID NO: 1253019 - DNA, 22 bp, Artificial Sequence
  chemically synthesized
cctaaaactatgaggtttttaa

SEQ ID NO: 1253020 - DNA, 22 bp, Artificial Sequence
  chemically synthesized
ctacctaaaactatgaggtttt

SEQ ID NO: 1253021 - DNA, 22 bp, Artificial Sequence
  chemically synthesized
tcatttaaaaacctcatagttt

SEQ ID NO: 1253022 - DNA, 22 bp, Artificial Sequence
  chemically synthesized
catttaaaaacctcatagtttt

SEQ ID NO: 1253023 - DNA, 22 bp, Artificial Sequence
  chemically synthesized
atttaaaaacctcatagtttta

SEQ ID NO: 1253024 - DNA, 22 bp, Artificial Sequence
  chemically synthesized
aaaaacctcatagttttaggta

SEQ ID NO: 1253025 - DNA, 22 bp, Artificial Sequence
  chemically synthesized
aaaacctcatagttttaggtag

SEQ ID NO: 1253026 - DNA, 22 bp, Artificial Sequence
  chemically synthesized
caccaataagaaccctcctacc

SEQ ID NO: 1253027 - DNA, 22 bp, Artificial Sequence
  chemically synthesized
atagttttaggtaggagggttc

SEQ ID NO: 1253028 - DNA, 22 bp, Artificial Sequence
  chemically synthesized
taggtaggagggttcttattgg

SEQ ID NO: 1253029 - DNA, 22 bp, Artificial Sequence
  chemically synthesized
aggtaggagggttcttattggt

SEQ ID NO: 1253030 - DNA, 22 bp, Artificial Sequence
  chemically synthesized
ggtaggagggttcttattggtg

SEQ ID NO: 1253031 - DNA, 22 bp, Artificial Sequence
  chemically synthesized
aacaagtatgaaagattccacc

SEQ ID NO: 1253032 - DNA, 22 bp, Artificial Sequence
  chemically synthesized
gattgaacaagtatgaaagatt

SEQ ID NO: 1253033 - DNA, 22 bp, Artificial Sequence
  chemically synthesized
ggattgaacaagtatgaaagat

SEQ ID NO: 1253034 - DNA, 22 bp, Artificial Sequence
  chemically synthesized
ttattggtggaatctttcatac

SEQ ID NO: 1253035 - DNA, 22 bp, Artificial Sequence
  chemically synthesized
attggtggaatctttcatactt

SEQ ID NO: 1253036 - DNA, 22 bp, Artificial Sequence
  chemically synthesized
ttggtggaatctttcatacttg

SEQ ID NO: 1253037 - DNA, 22 bp, Artificial Sequence
  chemically synthesized
gtggaatctttcatacttgttc

SEQ ID NO: 1253038 - DNA, 22 bp, Artificial Sequence
  chemically synthesized
atggataatttggattgaacaa

SEQ ID NO: 1253039 - DNA, 22 bp, Artificial Sequence
  chemically synthesized
tcatacttgttcaatccaaatt

SEQ ID NO: 1253040 - DNA, 22 bp, Artificial Sequence
  chemically synthesized
catacttgttcaatccaaatta

SEQ ID NO: 1253041 - DNA, 22 bp, Artificial Sequence
  chemically synthesized
atacttgttcaatccaaattat

SEQ ID NO: 1253042 - DNA, 22 bp, Artificial Sequence
  chemically synthesized
gttcaatccaaattatccatta

SEQ ID NO: 1253043 - DNA, 22 bp, Artificial Sequence
  chemically synthesized
ttcaatccaaattatccattaa

SEQ ID NO: 1253044 - DNA, 22 bp, Artificial Sequence
  chemically synthesized
aatccaaattatccattaattg

SEQ ID NO: 1253045 - DNA, 22 bp, Artificial Sequence
  chemically synthesized
ataaatcagacagaacaattaa

SEQ ID NO: 1253046 - DNA, 22 bp, Artificial Sequence
  chemically synthesized
tccattaattgttctgtctgat

SEQ ID NO: 1253047 - DNA, 22 bp, Artificial Sequence
  chemically synthesized
atgaaagctaataaatcagaca

SEQ ID NO: 1253048 - DNA, 22 bp, Artificial Sequence
  chemically synthesized
gatgaaagctaataaatcagac

SEQ ID NO: 1253049 - DNA, 22 bp, Artificial Sequence
  chemically synthesized
tttgatgaaagctaataaatca

SEQ ID NO: 1253050 - DNA, 22 bp, Artificial Sequence
  chemically synthesized
attgttctgtctgatttattag

SEQ ID NO: 1253051 - DNA, 22 bp, Artificial Sequence
  chemically synthesized
atttgatgaaagctaataaatc

SEQ ID NO: 1253052 - DNA, 22 bp, Artificial Sequence
  chemically synthesized
ttctgtctgatttattagcttt

SEQ ID NO: 1253053 - DNA, 22 bp, Artificial Sequence
  chemically synthesized
tgtctgatttattagctttcat

SEQ ID NO: 1253054 - DNA, 22 bp, Artificial Sequence
  chemically synthesized
tctgatttattagctttcatca

SEQ ID NO: 1253055 - DNA, 22 bp, Artificial Sequence
  chemically synthesized
atttattagctttcatcaaata

SEQ ID NO: 1253056 - DNA, 22 bp, Artificial Sequence
  chemically synthesized
attagctttcatcaaataaata

SEQ ID NO: 1253057 - DNA, 22 bp, Artificial Sequence
  chemically synthesized
ttagctttcatcaaataaatat

SEQ ID NO: 1253058 - DNA, 22 bp, Artificial Sequence
  chemically synthesized
aagcatagaaaatgatatttat

SEQ ID NO: 1253059 - DNA, 22 bp, Artificial Sequence
  chemically synthesized
gctttcatcaaataaatatcat

SEQ ID NO: 1253060 - DNA, 22 bp, Artificial Sequence
  chemically synthesized
ctaaagcatagaaaatgatatt

SEQ ID NO: 1253061 - DNA, 22 bp, Artificial Sequence
  chemically synthesized
tcatcaaataaatatcattttc

SEQ ID NO: 1253062 - DNA, 22 bp, Artificial Sequence
  chemically synthesized
catcaaataaatatcattttct

SEQ ID NO: 1253063 - DNA, 22 bp, Artificial Sequence
  chemically synthesized
atcaaataaatatcattttcta

SEQ ID NO: 1253064 - DNA, 22 bp, Artificial Sequence
  chemically synthesized
aagttgctaaagcatagaaaat

SEQ ID NO: 1253065 - DNA, 22 bp, Artificial Sequence
  chemically synthesized
caagttgctaaagcatagaaaa

SEQ ID NO: 1253066 - DNA, 22 bp, Artificial Sequence
  chemically synthesized
gcaaatgatttcaagttgctaa

SEQ ID NO: 1253067 - DNA, 22 bp, Artificial Sequence
  chemically synthesized
tctatgctttagcaacttgaaa

SEQ ID NO: 1253068 - DNA, 22 bp, Artificial Sequence
  chemically synthesized
ctatgctttagcaacttgaaat

SEQ ID NO: 1253069 - DNA, 22 bp, Artificial Sequence
  chemically synthesized
tatgctttagcaacttgaaatc

SEQ ID NO: 1253070 - DNA, 22 bp, Artificial Sequence
  chemically synthesized
tgctttagcaacttgaaatcat

SEQ ID NO: 1253071 - DNA, 22 bp, Artificial Sequence
  chemically synthesized
tagcaacttgaaatcatttgcc

SEQ ID NO: 1253072 - DNA, 22 bp, Artificial Sequence
  chemically synthesized
agcaacttgaaatcatttgcca

SEQ ID NO: 1253073 - DNA, 22 bp, Artificial Sequence
  chemically synthesized
tataacaacagttggcaaatga

SEQ ID NO: 1253074 - DNA, 22 bp, Artificial Sequence
  chemically synthesized
gcaacttgaaatcatttgccaa

SEQ ID NO: 1253075 - DNA, 22 bp, Artificial Sequence
  chemically synthesized
tattatataacaacagttggca

SEQ ID NO: 1253076 - DNA, 22 bp, Artificial Sequence
  chemically synthesized
gtattatataacaacagttggc

SEQ ID NO: 1253077 - DNA, 22 bp, Artificial Sequence
  chemically synthesized
gaaatcatttgccaactgttgt

SEQ ID NO: 1253078 - DNA, 22 bp, Artificial Sequence
  chemically synthesized
aaatcatttgccaactgttgtt

SEQ ID NO: 1253079 - DNA, 22 bp, Artificial Sequence
  chemically synthesized
gacttgtattatataacaacag

SEQ ID NO: 1253080 - DNA, 22 bp, Artificial Sequence
  chemically synthesized
cgacttgtattatataacaaca

SEQ ID NO: 1253081 - DNA, 22 bp, Artificial Sequence
  chemically synthesized
tcgacttgtattatataacaac

SEQ ID NO: 1253082 - DNA, 22 bp, Artificial Sequence
  chemically synthesized
ttcgacttgtattatataacaa

SEQ ID NO: 1253083 - DNA, 22 bp, Artificial Sequence
  chemically synthesized
tttcgacttgtattatataaca

SEQ ID NO: 1253084 - DNA, 22 bp, Artificial Sequence
  chemically synthesized
gccaactgttgttatataatac

SEQ ID NO: 1253085 - DNA, 22 bp, Artificial Sequence
  chemically synthesized
ccaactgttgttatataataca

SEQ ID NO: 1253086 - DNA, 22 bp, Artificial Sequence
  chemically synthesized
ttgttatataatacaagtcgaa

SEQ ID NO: 1253087 - DNA, 22 bp, Artificial Sequence
  chemically synthesized
ggcataccaactttttcgactt

SEQ ID NO: 1253088 - DNA, 22 bp, Artificial Sequence
  chemically synthesized
ttatataatacaagtcgaaaaa

SEQ ID NO: 1253089 - DNA, 22 bp, Artificial Sequence
  chemically synthesized
gggcataccaactttttcgact

SEQ ID NO: 1253090 - DNA, 22 bp, Artificial Sequence
  chemically synthesized
tgggcataccaactttttcgac

SEQ ID NO: 1253091 - DNA, 22 bp, Artificial Sequence
  chemically synthesized
tataatacaagtcgaaaaagtt

SEQ ID NO: 1253092 - DNA, 22 bp, Artificial Sequence
  chemically synthesized
gtatgcccaaaggcttatctgg

SEQ ID NO: 1253093 - DNA, 22 bp, Artificial Sequence
  chemically synthesized
aaaatggaaaaaatgaatacaa

SEQ ID NO: 1253094 - DNA, 22 bp, Artificial Sequence
  chemically synthesized
caaaatggaaaaaatgaataca

SEQ ID NO: 1253095 - DNA, 22 bp, Artificial Sequence
  chemically synthesized
atctggattttgtattcatttt

SEQ ID NO: 1253096 - DNA, 22 bp, Artificial Sequence
  chemically synthesized
tctggattttgtattcattttt

SEQ ID NO: 1253097 - DNA, 22 bp, Artificial Sequence
  chemically synthesized
aacttcaaaatggaaaaaatga

SEQ ID NO: 1253098 - DNA, 22 bp, Artificial Sequence
  chemically synthesized
gaacttcaaaatggaaaaaatg

SEQ ID NO: 1253099 - DNA, 22 bp, Artificial Sequence
  chemically synthesized
gattttgtattcattttttcca

SEQ ID NO: 1253100 - DNA, 22 bp, Artificial Sequence
  chemically synthesized
tgaacttcaaaatggaaaaaat

SEQ ID NO: 1253101 - DNA, 22 bp, Artificial Sequence
  chemically synthesized
ttttgaacttcaaaatggaaaa

SEQ ID NO: 1253102 - DNA, 22 bp, Artificial Sequence
  chemically synthesized
gttttgaacttcaaaatggaaa

SEQ ID NO: 1253103 - DNA, 22 bp, Artificial Sequence
  chemically synthesized
tgtattcattttttccattttg

SEQ ID NO: 1253104 - DNA, 22 bp, Artificial Sequence
  chemically synthesized
gtattcattttttccattttga

SEQ ID NO: 1253105 - DNA, 22 bp, Artificial Sequence
  chemically synthesized
tattcattttttccattttgaa

SEQ ID NO: 1253106 - DNA, 22 bp, Artificial Sequence
  chemically synthesized
attttttccattttgaagttca

SEQ ID NO: 1253107 - DNA, 22 bp, Artificial Sequence
  chemically synthesized
tttccattttgaagttcaaaac

SEQ ID NO: 1253108 - DNA, 22 bp, Artificial Sequence
  chemically synthesized
ttccattttgaagttcaaaaca

SEQ ID NO: 1253109 - DNA, 22 bp, Artificial Sequence
  chemically synthesized
tccattttgaagttcaaaacaa

SEQ ID NO: 1253110 - DNA, 22 bp, Artificial Sequence
  chemically synthesized
ccattttgaagttcaaaacaag

SEQ ID NO: 1253111 - DNA, 22 bp, Artificial Sequence
  chemically synthesized
cattttgaagttcaaaacaagt

SEQ ID NO: 1253112 - DNA, 22 bp, Artificial Sequence
  chemically synthesized
tgaagttcaaaacaagtcattt

SEQ ID NO: 1253113 - DNA, 22 bp, Artificial Sequence
  chemically synthesized
gaagttcaaaacaagtcatttc

SEQ ID NO: 1253114 - DNA, 22 bp, Artificial Sequence
  chemically synthesized
aagttcaaaacaagtcatttct

SEQ ID NO: 1253115 - DNA, 22 bp, Artificial Sequence
  chemically synthesized
cagagaataaagaaaaagaaat

SEQ ID NO: 1253116 - DNA, 22 bp, Artificial Sequence
  chemically synthesized
aaaacaagtcatttctttttct

SEQ ID NO: 1253117 - DNA, 22 bp, Artificial Sequence
  chemically synthesized
attgcagagaataaagaaaaag

SEQ ID NO: 1253118 - DNA, 22 bp, Artificial Sequence
  chemically synthesized
tattgattgcagagaataaaga

SEQ ID NO: 1253119 - DNA, 22 bp, Artificial Sequence
  chemically synthesized
gtattgattgcagagaataaag

SEQ ID NO: 1253120 - DNA, 22 bp, Artificial Sequence
  chemically synthesized
tgtattgattgcagagaataaa

SEQ ID NO: 1253121 - DNA, 22 bp, Artificial Sequence
  chemically synthesized
ctttttctttattctctgcaat

SEQ ID NO: 1253122 - DNA, 22 bp, Artificial Sequence
  chemically synthesized
tttttctttattctctgcaatc

SEQ ID NO: 1253123 - DNA, 22 bp, Artificial Sequence
  chemically synthesized
tttctttattctctgcaatcaa

SEQ ID NO: 1253124 - DNA, 22 bp, Artificial Sequence
  chemically synthesized
ttctttattctctgcaatcaat

SEQ ID NO: 1253125 - DNA, 22 bp, Artificial Sequence
  chemically synthesized
tctttattctctgcaatcaata

SEQ ID NO: 1253126 - DNA, 22 bp, Artificial Sequence
  chemically synthesized
ctttattctctgcaatcaatac

SEQ ID NO: 1253127 - DNA, 22 bp, Artificial Sequence
  chemically synthesized
tttattctctgcaatcaataca

SEQ ID NO: 1253128 - DNA, 22 bp, Artificial Sequence
  chemically synthesized
tattctctgcaatcaatacaaa

SEQ ID NO: 1253129 - DNA, 22 bp, Artificial Sequence
  chemically synthesized
attctctgcaatcaatacaaaa

SEQ ID NO: 1253130 - DNA, 22 bp, Artificial Sequence
  chemically synthesized
ttctctgcaatcaatacaaaat

SEQ ID NO: 1253131 - DNA, 22 bp, Artificial Sequence
  chemically synthesized
tctgcaatcaatacaaaatgtg

SEQ ID NO: 1253132 - DNA, 22 bp, Artificial Sequence
  chemically synthesized
atagtatgaacacacattttgt

SEQ ID NO: 1253133 - DNA, 22 bp, Artificial Sequence
  chemically synthesized
aatagtatgaacacacattttg

SEQ ID NO: 1253134 - DNA, 22 bp, Artificial Sequence
  chemically synthesized
tgcaatcaatacaaaatgtgtg

SEQ ID NO: 1253135 - DNA, 22 bp, Artificial Sequence
  chemically synthesized
ttaatagtatgaacacacattt

SEQ ID NO: 1253136 - DNA, 22 bp, Artificial Sequence
  chemically synthesized
caatcaatacaaaatgtgtgtt

SEQ ID NO: 1253137 - DNA, 22 bp, Artificial Sequence
  chemically synthesized
cttaatagtatgaacacacatt

SEQ ID NO: 1253138 - DNA, 22 bp, Artificial Sequence
  chemically synthesized
ttcttaatagtatgaacacaca

SEQ ID NO: 1253139 - DNA, 22 bp, Artificial Sequence
  chemically synthesized
acagtcatgctcttcttaatag

SEQ ID NO: 1253140 - DNA, 22 bp, Artificial Sequence
  chemically synthesized
aacagtcatgctcttcttaata

SEQ ID NO: 1253141 - DNA, 22 bp, Artificial Sequence
  chemically synthesized
ttaacagtcatgctcttcttaa

SEQ ID NO: 1253142 - DNA, 22 bp, Artificial Sequence
  chemically synthesized
cttaacagtcatgctcttctta

SEQ ID NO: 1253143 - DNA, 22 bp, Artificial Sequence
  chemically synthesized
atactattaagaagagcatgac

SEQ ID NO: 1253144 - DNA, 22 bp, Artificial Sequence
  chemically synthesized
aggcttcttaacagtcatgctc

SEQ ID NO: 1253145 - DNA, 22 bp, Artificial Sequence
  chemically synthesized
ttaagaagagcatgactgttaa

SEQ ID NO: 1253146 - DNA, 22 bp, Artificial Sequence
  chemically synthesized
aactaaggcttcttaacagtca

SEQ ID NO: 1253147 - DNA, 22 bp, Artificial Sequence
  chemically synthesized
agaagagcatgactgttaagaa

SEQ ID NO: 1253148 - DNA, 22 bp, Artificial Sequence
  chemically synthesized
atccattgaactaaggcttctt

SEQ ID NO: 1253149 - DNA, 22 bp, Artificial Sequence
  chemically synthesized
ctaatccattgaactaaggctt

SEQ ID NO: 1253150 - DNA, 22 bp, Artificial Sequence
  chemically synthesized
tctactaatccattgaactaag

SEQ ID NO: 1253151 - DNA, 22 bp, Artificial Sequence
  chemically synthesized
ttaagaagccttagttcaatgg

SEQ ID NO: 1253152 - DNA, 22 bp, Artificial Sequence
  chemically synthesized
agaagccttagttcaatggatt

SEQ ID NO: 1253153 - DNA, 22 bp, Artificial Sequence
  chemically synthesized
aaaaaatggttgtctactaatc

SEQ ID NO: 1253154 - DNA, 22 bp, Artificial Sequence
  chemically synthesized
agttcaatggattagtagacaa

SEQ ID NO: 1253155 - DNA, 22 bp, Artificial Sequence
  chemically synthesized
gttcaatggattagtagacaac

SEQ ID NO: 1253156 - DNA, 22 bp, Artificial Sequence
  chemically synthesized
attaaaaaaatggttgtctact

SEQ ID NO: 1253157 - DNA, 22 bp, Artificial Sequence
  chemically synthesized
aatggattagtagacaaccatt

SEQ ID NO: 1253158 - DNA, 22 bp, Artificial Sequence
  chemically synthesized
gtagacaaccatttttttaatt

SEQ ID NO: 1253159 - DNA, 22 bp, Artificial Sequence
  chemically synthesized
agagggggaagactaattaaaa

SEQ ID NO: 1253160 - DNA, 22 bp, Artificial Sequence
  chemically synthesized
ttttaattagtcttccccctct

SEQ ID NO: 1253161 - DNA, 22 bp, Artificial Sequence
  chemically synthesized
tttaattagtcttccccctctg

SEQ ID NO: 1253162 - DNA, 22 bp, Artificial Sequence
  chemically synthesized
ttaattagtcttccccctctga

SEQ ID NO: 1253163 - DNA, 22 bp, Artificial Sequence
  chemically synthesized
taattagtcttccccctctgaa

SEQ ID NO: 1253164 - DNA, 22 bp, Artificial Sequence
  chemically synthesized
aattagtcttccccctctgaac

SEQ ID NO: 1253165 - DNA, 22 bp, Artificial Sequence
  chemically synthesized
attagtcttccccctctgaact

SEQ ID NO: 1253166 - DNA, 22 bp, Artificial Sequence
  chemically synthesized
cggaaagtggagaaaagttcag

SEQ ID NO: 1253167 - DNA, 22 bp, Artificial Sequence
  chemically synthesized
gtcttccccctctgaacttttc

SEQ ID NO: 1253168 - DNA, 22 bp, Artificial Sequence
  chemically synthesized
ctgcggaaagtggagaaaagtt

SEQ ID NO: 1253169 - DNA, 22 bp, Artificial Sequence
  chemically synthesized
gctgcggaaagtggagaaaagt

SEQ ID NO: 1253170 - DNA, 22 bp, Artificial Sequence
  chemically synthesized
ccccctctgaacttttctccac

SEQ ID NO: 1253171 - DNA, 22 bp, Artificial Sequence
  chemically synthesized
cccctctgaacttttctccact

SEQ ID NO: 1253172 - DNA, 22 bp, Artificial Sequence
  chemically synthesized
catttgctgcggaaagtggaga

SEQ ID NO: 1253173 - DNA, 22 bp, Artificial Sequence
  chemically synthesized
ccatttgctgcggaaagtggag

SEQ ID NO: 1253174 - DNA, 22 bp, Artificial Sequence
  chemically synthesized
tgaacttttctccactttccgc

SEQ ID NO: 1253175 - DNA, 22 bp, Artificial Sequence
  chemically synthesized
aacttttctccactttccgcag

SEQ ID NO: 1253176 - DNA, 22 bp, Artificial Sequence
  chemically synthesized
cgtttccatttgctgcggaaag

SEQ ID NO: 1253177 - DNA, 22 bp, Artificial Sequence
  chemically synthesized
attacgtttccatttgctgcgg

SEQ ID NO: 1253178 - DNA, 22 bp, Artificial Sequence
  chemically synthesized
ttctccactttccgcagcaaat

SEQ ID NO: 1253179 - DNA, 22 bp, Artificial Sequence
  chemically synthesized
tctccactttccgcagcaaatg

SEQ ID NO: 1253180 - DNA, 22 bp, Artificial Sequence
  chemically synthesized
tcattacgtttccatttgctgc

SEQ ID NO: 1253181 - DNA, 22 bp, Artificial Sequence
  chemically synthesized
ctccactttccgcagcaaatgg

SEQ ID NO: 1253182 - DNA, 22 bp, Artificial Sequence
  chemically synthesized
tccactttccgcagcaaatgga

SEQ ID NO: 1253183 - DNA, 22 bp, Artificial Sequence
  chemically synthesized
cactttccgcagcaaatggaaa

SEQ ID NO: 1253184 - DNA, 22 bp, Artificial Sequence
  chemically synthesized
tgagattctcattacgtttcca

SEQ ID NO: 1253185 - DNA, 22 bp, Artificial Sequence
  chemically synthesized
tccgcagcaaatggaaacgtaa

SEQ ID NO: 1253186 - DNA, 22 bp, Artificial Sequence
  chemically synthesized
ccgcagcaaatggaaacgtaat

SEQ ID NO: 1253187 - DNA, 22 bp, Artificial Sequence
  chemically synthesized
cgcagcaaatggaaacgtaatg

SEQ ID NO: 1253188 - DNA, 22 bp, Artificial Sequence
  chemically synthesized
gcagaatactatgagattctca

SEQ ID NO: 1253189 - DNA, 22 bp, Artificial Sequence
  chemically synthesized
ggcagaatactatgagattctc

SEQ ID NO: 1253190 - DNA, 22 bp, Artificial Sequence
  chemically synthesized
tggcagaatactatgagattct

SEQ ID NO: 1253191 - DNA, 22 bp, Artificial Sequence
  chemically synthesized
ttttggcagaatactatgagat

SEQ ID NO: 1253192 - DNA, 22 bp, Artificial Sequence
  chemically synthesized
attttggcagaatactatgaga

SEQ ID NO: 1253193 - DNA, 22 bp, Artificial Sequence
  chemically synthesized
tattttggcagaatactatgag

SEQ ID NO: 1253194 - DNA, 22 bp, Artificial Sequence
  chemically synthesized
acatcccctttattttggcaga

SEQ ID NO: 1253195 - DNA, 22 bp, Artificial Sequence
  chemically synthesized
cctgacatcccctttattttgg

SEQ ID NO: 1253196 - DNA, 22 bp, Artificial Sequence
  chemically synthesized
atagtattctgccaaaataaag

SEQ ID NO: 1253197 - DNA, 22 bp, Artificial Sequence
  chemically synthesized
ttgcctgacatcccctttattt

SEQ ID NO: 1253198 - DNA, 22 bp, Artificial Sequence
  chemically synthesized
attgcctgacatcccctttatt

SEQ ID NO: 1253199 - DNA, 22 bp, Artificial Sequence
  chemically synthesized
tattgcctgacatcccctttat

SEQ ID NO: 1253200 - DNA, 22 bp, Artificial Sequence
  chemically synthesized
tgccaaaataaaggggatgtca

SEQ ID NO: 1253201 - DNA, 22 bp, Artificial Sequence
  chemically synthesized
ccaaaataaaggggatgtcagg

SEQ ID NO: 1253202 - DNA, 22 bp, Artificial Sequence
  chemically synthesized
gcaaggatatgctttattgcct

SEQ ID NO: 1253203 - DNA, 22 bp, Artificial Sequence
  chemically synthesized
agcaaggatatgctttattgcc

SEQ ID NO: 1253204 - DNA, 22 bp, Artificial Sequence
  chemically synthesized
tttagcaaggatatgctttatt

SEQ ID NO: 1253205 - DNA, 22 bp, Artificial Sequence
  chemically synthesized
tgatgctatttagcaaggatat

SEQ ID NO: 1253206 - DNA, 22 bp, Artificial Sequence
  chemically synthesized
gtgatgctatttagcaaggata

SEQ ID NO: 1253207 - DNA, 22 bp, Artificial Sequence
  chemically synthesized
catatgggatttgtgatgctat

SEQ ID NO: 1253208 - DNA, 22 bp, Artificial Sequence
  chemically synthesized
tacatatgggatttgtgatgct

SEQ ID NO: 1253209 - DNA, 22 bp, Artificial Sequence
  chemically synthesized
gctaaatagcatcacaaatccc

SEQ ID NO: 1253210 - DNA, 22 bp, Artificial Sequence
  chemically synthesized
ctaaatagcatcacaaatccca

SEQ ID NO: 1253211 - DNA, 22 bp, Artificial Sequence
  chemically synthesized
aatagcatcacaaatcccatat

SEQ ID NO: 1253212 - DNA, 22 bp, Artificial Sequence
  chemically synthesized
aaaataaaatgataattctaca

SEQ ID NO: 1253213 - DNA, 22 bp, Artificial Sequence
  chemically synthesized
aaaaataaaatgataattctac

SEQ ID NO: 1253214 - DNA, 22 bp, Artificial Sequence
  chemically synthesized
ttaaaaataaaatgataattct

SEQ ID NO: 1253215 - DNA, 22 bp, Artificial Sequence
  chemically synthesized
gtggaaaaaactcttaaaaata

SEQ ID NO: 1253216 - DNA, 22 bp, Artificial Sequence
  chemically synthesized
ggtggaaaaaactcttaaaaat

SEQ ID NO: 1253217 - DNA, 22 bp, Artificial Sequence
  chemically synthesized
tggtggaaaaaactcttaaaaa

SEQ ID NO: 1253218 - DNA, 22 bp, Artificial Sequence
  chemically synthesized
ttggtggaaaaaactcttaaaa

SEQ ID NO: 1253219 - DNA, 22 bp, Artificial Sequence
  chemically synthesized
tcattttatttttaagagtttt

SEQ ID NO: 1253220 - DNA, 22 bp, Artificial Sequence
  chemically synthesized
gcttttggtggaaaaaactctt

SEQ ID NO: 1253221 - DNA, 22 bp, Artificial Sequence
  chemically synthesized
ggcttttggtggaaaaaactct

SEQ ID NO: 1253222 - DNA, 22 bp, Artificial Sequence
  chemically synthesized
ttggcttttggtggaaaaaact

SEQ ID NO: 1253223 - DNA, 22 bp, Artificial Sequence
  chemically synthesized
tatttttaagagttttttccac

SEQ ID NO: 1253224 - DNA, 22 bp, Artificial Sequence
  chemically synthesized
atttttaagagttttttccacc

SEQ ID NO: 1253225 - DNA, 22 bp, Artificial Sequence
  chemically synthesized
ttcttggcttttggtggaaaaa

SEQ ID NO: 1253226 - DNA, 22 bp, Artificial Sequence
  chemically synthesized
tttttaagagttttttccacca

SEQ ID NO: 1253227 - DNA, 22 bp, Artificial Sequence
  chemically synthesized
attcttggcttttggtggaaaa

SEQ ID NO: 1253228 - DNA, 22 bp, Artificial Sequence
  chemically synthesized
tattcttggcttttggtggaaa

SEQ ID NO: 1253229 - DNA, 22 bp, Artificial Sequence
  chemically synthesized
ttaagagttttttccaccaaaa

SEQ ID NO: 1253230 - DNA, 22 bp, Artificial Sequence
  chemically synthesized
taagagttttttccaccaaaag

SEQ ID NO: 1253231 - DNA, 22 bp, Artificial Sequence
  chemically synthesized
aagagttttttccaccaaaagc

SEQ ID NO: 1253232 - DNA, 22 bp, Artificial Sequence
  chemically synthesized
agagttttttccaccaaaagcc

SEQ ID NO: 1253233 - DNA, 22 bp, Artificial Sequence
  chemically synthesized
aaagcaattttattcttggctt

SEQ ID NO: 1253234 - DNA, 22 bp, Artificial Sequence
  chemically synthesized
caaagcaattttattcttggct

SEQ ID NO: 1253235 - DNA, 22 bp, Artificial Sequence
  chemically synthesized
tttccaccaaaagccaagaata

SEQ ID NO: 1253236 - DNA, 22 bp, Artificial Sequence
  chemically synthesized
ttccaccaaaagccaagaataa

SEQ ID NO: 1253237 - DNA, 22 bp, Artificial Sequence
  chemically synthesized
tccaccaaaagccaagaataaa

SEQ ID NO: 1253238 - DNA, 22 bp, Artificial Sequence
  chemically synthesized
ccaccaaaagccaagaataaaa

SEQ ID NO: 1253239 - DNA, 22 bp, Artificial Sequence
  chemically synthesized
caccaaaagccaagaataaaat

SEQ ID NO: 1253240 - DNA, 22 bp, Artificial Sequence
  chemically synthesized
tccttcaaagcaattttattct

SEQ ID NO: 1253241 - DNA, 22 bp, Artificial Sequence
  chemically synthesized
acaattatccttcaaagcaatt

SEQ ID NO: 1253242 - DNA, 22 bp, Artificial Sequence
  chemically synthesized
aacaattatccttcaaagcaat

SEQ ID NO: 1253243 - DNA, 22 bp, Artificial Sequence
  chemically synthesized
ctttgaaggataattgttaaat

SEQ ID NO: 1253244 - DNA, 22 bp, Artificial Sequence
  chemically synthesized
tgaaggataattgttaaatggt

SEQ ID NO: 1253245 - DNA, 22 bp, Artificial Sequence
  chemically synthesized
gaaggataattgttaaatggtt

SEQ ID NO: 1253246 - DNA, 22 bp, Artificial Sequence
  chemically synthesized
aaggataattgttaaatggtta

SEQ ID NO: 1253247 - DNA, 22 bp, Artificial Sequence
  chemically synthesized
aaatatagagccaaagcataac

SEQ ID NO: 1253248 - DNA, 22 bp, Artificial Sequence
  chemically synthesized
ttaaatggttatgctttggctc

SEQ ID NO: 1253249 - DNA, 22 bp, Artificial Sequence
  chemically synthesized
aatggttatgctttggctctat

SEQ ID NO: 1253250 - DNA, 22 bp, Artificial Sequence
  chemically synthesized
cgtggaggctcaaatatagagc

SEQ ID NO: 1253251 - DNA, 22 bp, Artificial Sequence
  chemically synthesized
acgtggaggctcaaatatagag

SEQ ID NO: 1253252 - DNA, 22 bp, Artificial Sequence
  chemically synthesized
tgctttggctctatatttgagc

SEQ ID NO: 1253253 - DNA, 22 bp, Artificial Sequence
  chemically synthesized
aagacttacgtggaggctcaaa

SEQ ID NO: 1253254 - DNA, 22 bp, Artificial Sequence
  chemically synthesized
tggctctatatttgagcctcca

SEQ ID NO: 1253255 - DNA, 22 bp, Artificial Sequence
  chemically synthesized
ggctctatatttgagcctccac

SEQ ID NO: 1253256 - DNA, 22 bp, Artificial Sequence
  chemically synthesized
gctctatatttgagcctccacg

SEQ ID NO: 1253257 - DNA, 22 bp, Artificial Sequence
  chemically synthesized
attaaagacttacgtggaggct

SEQ ID NO: 1253258 - DNA, 22 bp, Artificial Sequence
  chemically synthesized
ttaattaaagacttacgtggag

SEQ ID NO: 1253259 - DNA, 22 bp, Artificial Sequence
  chemically synthesized
tatatttgagcctccacgtaag

SEQ ID NO: 1253260 - DNA, 22 bp, Artificial Sequence
  chemically synthesized
tatttgagcctccacgtaagtc

SEQ ID NO: 1253261 - DNA, 22 bp, Artificial Sequence
  chemically synthesized
gagcctccacgtaagtctttaa

SEQ ID NO: 1253262 - DNA, 22 bp, Artificial Sequence
  chemically synthesized
agcctccacgtaagtctttaat

SEQ ID NO: 1253263 - DNA, 22 bp, Artificial Sequence
  chemically synthesized
cacgtaagtctttaattaataa

SEQ ID NO: 1253264 - DNA, 22 bp, Artificial Sequence
  chemically synthesized
taattaataatttgtgctatgg

SEQ ID NO: 1253265 - DNA, 22 bp, Artificial Sequence
  chemically synthesized
aattaataatttgtgctatgga

SEQ ID NO: 1253266 - DNA, 22 bp, Artificial Sequence
  chemically synthesized
atcagaacacggtccatagcac

SEQ ID NO: 1253267 - DNA, 22 bp, Artificial Sequence
  chemically synthesized
attaataatttgtgctatggac

SEQ ID NO: 1253268 - DNA, 22 bp, Artificial Sequence
  chemically synthesized
ataatttgtgctatggaccgtg

SEQ ID NO: 1253269 - DNA, 22 bp, Artificial Sequence
  chemically synthesized
gtgctatggaccgtgttctgat

SEQ ID NO: 1253270 - DNA, 22 bp, Artificial Sequence
  chemically synthesized
gcaaaacatctcatcagaacac

SEQ ID NO: 1253271 - DNA, 22 bp, Artificial Sequence
  chemically synthesized
tgctatggaccgtgttctgatg

SEQ ID NO: 1253272 - DNA, 22 bp, Artificial Sequence
  chemically synthesized
agcaaaacatctcatcagaaca

SEQ ID NO: 1253273 - DNA, 22 bp, Artificial Sequence
  chemically synthesized
cttagcaaaacatctcatcaga

SEQ ID NO: 1253274 - DNA, 22 bp, Artificial Sequence
  chemically synthesized
tggaccgtgttctgatgagatg

SEQ ID NO: 1253275 - DNA, 22 bp, Artificial Sequence
  chemically synthesized
tgatgagatgttttgctaagga

SEQ ID NO: 1253276 - DNA, 22 bp, Artificial Sequence
  chemically synthesized
atgagatgttttgctaaggaga

SEQ ID NO: 1253277 - DNA, 22 bp, Artificial Sequence
  chemically synthesized
tgctaaggagatatgctccctt

SEQ ID NO: 1253278 - DNA, 22 bp, Artificial Sequence
  chemically synthesized
gctaaggagatatgctcccttc

SEQ ID NO: 1253279 - DNA, 22 bp, Artificial Sequence
  chemically synthesized
ctaaggagatatgctcccttcc

SEQ ID NO: 1253280 - DNA, 22 bp, Artificial Sequence
  chemically synthesized
tgggtggcagtaagggaaggga

SEQ ID NO: 1253281 - DNA, 22 bp, Artificial Sequence
  chemically synthesized
aggagatatgctcccttccctt

SEQ ID NO: 1253282 - DNA, 22 bp, Artificial Sequence
  chemically synthesized
gtgggtggcagtaagggaaggg

SEQ ID NO: 1253283 - DNA, 22 bp, Artificial Sequence
  chemically synthesized
ttgtgggtggcagtaagggaag

SEQ ID NO: 1253284 - DNA, 22 bp, Artificial Sequence
  chemically synthesized
ctcttgtgggtggcagtaaggg

SEQ ID NO: 1253285 - DNA, 22 bp, Artificial Sequence
  chemically synthesized
actcttgtgggtggcagtaagg

SEQ ID NO: 1253286 - DNA, 22 bp, Artificial Sequence
  chemically synthesized
tttactcttgtgggtggcagta

SEQ ID NO: 1253287 - DNA, 22 bp, Artificial Sequence
  chemically synthesized
atttactcttgtgggtggcagt

SEQ ID NO: 1253288 - DNA, 22 bp, Artificial Sequence
  chemically synthesized
tatttactcttgtgggtggcag

SEQ ID NO: 1253289 - DNA, 22 bp, Artificial Sequence
  chemically synthesized
ttatttactcttgtgggtggca

SEQ ID NO: 1253290 - DNA, 22 bp, Artificial Sequence
  chemically synthesized
ccttcccttactgccacccaca

SEQ ID NO: 1253291 - DNA, 22 bp, Artificial Sequence
  chemically synthesized
cttttatttactcttgtgggtg

SEQ ID NO: 1253292 - DNA, 22 bp, Artificial Sequence
  chemically synthesized
gcttttatttactcttgtgggt

SEQ ID NO: 1253293 - DNA, 22 bp, Artificial Sequence
  chemically synthesized
cccttactgccacccacaagag

SEQ ID NO: 1253294 - DNA, 22 bp, Artificial Sequence
  chemically synthesized
ccttactgccacccacaagagt

SEQ ID NO: 1253295 - DNA, 22 bp, Artificial Sequence
  chemically synthesized
actgccacccacaagagtaaat

SEQ ID NO: 1253296 - DNA, 22 bp, Artificial Sequence
  chemically synthesized
ctgccacccacaagagtaaata

SEQ ID NO: 1253297 - DNA, 22 bp, Artificial Sequence
  chemically synthesized
ccacccacaagagtaaataaaa

SEQ ID NO: 1253298 - DNA, 22 bp, Artificial Sequence
  chemically synthesized
caaaacgccagtgtcttgcttt

SEQ ID NO: 1253299 - DNA, 22 bp, Artificial Sequence
  chemically synthesized
ccaaaacgccagtgtcttgctt

SEQ ID NO: 1253300 - DNA, 22 bp, Artificial Sequence
  chemically synthesized
acttccaaaacgccagtgtctt

SEQ ID NO: 1253301 - DNA, 22 bp, Artificial Sequence
  chemically synthesized
gacttccaaaacgccagtgtct

SEQ ID NO: 1253302 - DNA, 22 bp, Artificial Sequence
  chemically synthesized
agaatcccagtttgacttccaa

SEQ ID NO: 1253303 - DNA, 22 bp, Artificial Sequence
  chemically synthesized
cagaatcccagtttgacttcca

SEQ ID NO: 1253304 - DNA, 22 bp, Artificial Sequence
  chemically synthesized
ttcagaatcccagtttgacttc

SEQ ID NO: 1253305 - DNA, 22 bp, Artificial Sequence
  chemically synthesized
cttcagaatcccagtttgactt

SEQ ID NO: 1253306 - DNA, 22 bp, Artificial Sequence
  chemically synthesized
gcgttttggaagtcaaactggg

SEQ ID NO: 1253307 - DNA, 22 bp, Artificial Sequence
  chemically synthesized
tggaagtcaaactgggattctg

SEQ ID NO: 1253308 - DNA, 22 bp, Artificial Sequence
  chemically synthesized
ggaagtcaaactgggattctga

SEQ ID NO: 1253309 - DNA, 22 bp, Artificial Sequence
  chemically synthesized
gaagtcaaactgggattctgaa

SEQ ID NO: 1253310 - DNA, 22 bp, Artificial Sequence
  chemically synthesized
agagcccaggaacttcttcaga

SEQ ID NO: 1253311 - DNA, 22 bp, Artificial Sequence
  chemically synthesized
ggattctgaagaagttcctggg

SEQ ID NO: 1253312 - DNA, 22 bp, Artificial Sequence
  chemically synthesized
tgaagaagttcctgggctctga

SEQ ID NO: 1253313 - DNA, 22 bp, Artificial Sequence
  chemically synthesized
tgtagcatgatactcagagccc

SEQ ID NO: 1253314 - DNA, 22 bp, Artificial Sequence
  chemically synthesized
aagaagttcctgggctctgagt

SEQ ID NO: 1253315 - DNA, 22 bp, Artificial Sequence
  chemically synthesized
ctgtgtagcatgatactcagag

SEQ ID NO: 1253316 - DNA, 22 bp, Artificial Sequence
  chemically synthesized
tactgtgtagcatgatactcag

SEQ ID NO: 1253317 - DNA, 22 bp, Artificial Sequence
  chemically synthesized
tctactgtgtagcatgatactc

SEQ ID NO: 1253318 - DNA, 22 bp, Artificial Sequence
  chemically synthesized
ctgggctctgagtatcatgcta

SEQ ID NO: 1253319 - DNA, 22 bp, Artificial Sequence
  chemically synthesized
ggctctgagtatcatgctacac

SEQ ID NO: 1253320 - DNA, 22 bp, Artificial Sequence
  chemically synthesized
tgagtatcatgctacacagtag

SEQ ID NO: 1253321 - DNA, 22 bp, Artificial Sequence
  chemically synthesized
agtatcatgctacacagtagag

SEQ ID NO: 1253322 - DNA, 22 bp, Artificial Sequence
  chemically synthesized
gagaggcaggaagtgactctct

SEQ ID NO: 1253323 - DNA, 22 bp, Artificial Sequence
  chemically synthesized
cacagtagagagtcacttcctg

SEQ ID NO: 1253324 - DNA, 22 bp, Artificial Sequence
  chemically synthesized
gatattagagaggcaggaagtg

SEQ ID NO: 1253325 - DNA, 22 bp, Artificial Sequence
  chemically synthesized
agatattagagaggcaggaagt

SEQ ID NO: 1253326 - DNA, 22 bp, Artificial Sequence
  chemically synthesized
tagatattagagaggcaggaag

SEQ ID NO: 1253327 - DNA, 22 bp, Artificial Sequence
  chemically synthesized
ttttagatattagagaggcagg

SEQ ID NO: 1253328 - DNA, 22 bp, Artificial Sequence
  chemically synthesized
gttttagatattagagaggcag

SEQ ID NO: 1253329 - DNA, 22 bp, Artificial Sequence
  chemically synthesized
tgttttagatattagagaggca

SEQ ID NO: 1253330 - DNA, 22 bp, Artificial Sequence
  chemically synthesized
ttgttttagatattagagaggc

SEQ ID NO: 1253331 - DNA, 22 bp, Artificial Sequence
  chemically synthesized
aaatcttttgttttagatatta

SEQ ID NO: 1253332 - DNA, 22 bp, Artificial Sequence
  chemically synthesized
cctgcctctctaatatctaaaa

SEQ ID NO: 1253333 - DNA, 22 bp, Artificial Sequence
  chemically synthesized
ctgcctctctaatatctaaaac

SEQ ID NO: 1253334 - DNA, 22 bp, Artificial Sequence
  chemically synthesized
cctctctaatatctaaaacaaa

SEQ ID NO: 1253335 - DNA, 22 bp, Artificial Sequence
  chemically synthesized
ccagttcaaatcttttgtttta

SEQ ID NO: 1253336 - DNA, 22 bp, Artificial Sequence
  chemically synthesized
tctaatatctaaaacaaaagat

SEQ ID NO: 1253337 - DNA, 22 bp, Artificial Sequence
  chemically synthesized
taatatctaaaacaaaagattt

SEQ ID NO: 1253338 - DNA, 22 bp, Artificial Sequence
  chemically synthesized
atatctaaaacaaaagatttga

SEQ ID NO: 1253339 - DNA, 22 bp, Artificial Sequence
  chemically synthesized
gatcaatggctaccagttcaaa

SEQ ID NO: 1253340 - DNA, 22 bp, Artificial Sequence
  chemically synthesized
aaacaaaagatttgaactggta

SEQ ID NO: 1253341 - DNA, 22 bp, Artificial Sequence
  chemically synthesized
aattagatcaatggctaccagt

SEQ ID NO: 1253342 - DNA, 22 bp, Artificial Sequence
  chemically synthesized
aggcctgaattagatcaatggc

SEQ ID NO: 1253343 - DNA, 22 bp, Artificial Sequence
  chemically synthesized
gaactggtagccattgatctaa

SEQ ID NO: 1253344 - DNA, 22 bp, Artificial Sequence
  chemically synthesized
aactggtagccattgatctaat

SEQ ID NO: 1253345 - DNA, 22 bp, Artificial Sequence
  chemically synthesized
gtagccattgatctaattcagg

SEQ ID NO: 1253346 - DNA, 22 bp, Artificial Sequence
  chemically synthesized
gccaaatgtatctcaggcctga

SEQ ID NO: 1253347 - DNA, 22 bp, Artificial Sequence
  chemically synthesized
atctaattcaggcctgagatac

SEQ ID NO: 1253348 - DNA, 22 bp, Artificial Sequence
  chemically synthesized
attcaggcctgagatacatttg

SEQ ID NO: 1253349 - DNA, 22 bp, Artificial Sequence
  chemically synthesized
tatcaaactagccaaatgtatc

SEQ ID NO: 1253350 - DNA, 22 bp, Artificial Sequence
  chemically synthesized
aggcctgagatacatttggcta

SEQ ID NO: 1253351 - DNA, 22 bp, Artificial Sequence
  chemically synthesized
tcctgtatcaaactagccaaat

SEQ ID NO: 1253352 - DNA, 22 bp, Artificial Sequence
  chemically synthesized
acctgtcctgtatcaaactagc

SEQ ID NO: 1253353 - DNA, 22 bp, Artificial Sequence
  chemically synthesized
agatacatttggctagtttgat

SEQ ID NO: 1253354 - DNA, 22 bp, Artificial Sequence
  chemically synthesized
aacctgtcctgtatcaaactag

SEQ ID NO: 1253355 - DNA, 22 bp, Artificial Sequence
  chemically synthesized
gggcttaacctgtcctgtatca

SEQ ID NO: 1253356 - DNA, 22 bp, Artificial Sequence
  chemically synthesized
ggggcttaacctgtcctgtatc

SEQ ID NO: 1253357 - DNA, 22 bp, Artificial Sequence
  chemically synthesized
tggggcttaacctgtcctgtat

SEQ ID NO: 1253358 - DNA, 22 bp, Artificial Sequence
  chemically synthesized
ggctagtttgatacaggacagg

SEQ ID NO: 1253359 - DNA, 22 bp, Artificial Sequence
  chemically synthesized
gctagtttgatacaggacaggt

SEQ ID NO: 1253360 - DNA, 22 bp, Artificial Sequence
  chemically synthesized
attttggggcttaacctgtcct

SEQ ID NO: 1253361 - DNA, 22 bp, Artificial Sequence
  chemically synthesized
gtttgatacaggacaggttaag

SEQ ID NO: 1253362 - DNA, 22 bp, Artificial Sequence
  chemically synthesized
gatacaggacaggttaagcccc

SEQ ID NO: 1253363 - DNA, 22 bp, Artificial Sequence
  chemically synthesized
atacaggacaggttaagcccca

SEQ ID NO: 1253364 - DNA, 22 bp, Artificial Sequence
  chemically synthesized
ccaggccaagccctgattttgg

SEQ ID NO: 1253365 - DNA, 22 bp, Artificial Sequence
  chemically synthesized
agccccaaaatcagggcttggc

SEQ ID NO: 1253366 - DNA, 22 bp, Artificial Sequence
  chemically synthesized
ggcaaagccaagaatcctccca

SEQ ID NO: 1253367 - DNA, 22 bp, Artificial Sequence
  chemically synthesized
ctaggcaaagccaagaatcctc

SEQ ID NO: 1253368 - DNA, 22 bp, Artificial Sequence
  chemically synthesized
cctaggcaaagccaagaatcct

SEQ ID NO: 1253369 - DNA, 22 bp, Artificial Sequence
  chemically synthesized
tcctaggcaaagccaagaatcc

SEQ ID NO: 1253370 - DNA, 22 bp, Artificial Sequence
  chemically synthesized
tttcctaggcaaagccaagaat

SEQ ID NO: 1253371 - DNA, 22 bp, Artificial Sequence
  chemically synthesized
ggcctgggaggattcttggctt

SEQ ID NO: 1253372 - DNA, 22 bp, Artificial Sequence
  chemically synthesized
gcctgggaggattcttggcttt

SEQ ID NO: 1253373 - DNA, 22 bp, Artificial Sequence
  chemically synthesized
aattctttcctaggcaaagcca

SEQ ID NO: 1253374 - DNA, 22 bp, Artificial Sequence
  chemically synthesized
gaattctttcctaggcaaagcc

SEQ ID NO: 1253375 - DNA, 22 bp, Artificial Sequence
  chemically synthesized
ggaggattcttggctttgccta

SEQ ID NO: 1253376 - DNA, 22 bp, Artificial Sequence
  chemically synthesized
gcccttgaattctttcctaggc

SEQ ID NO: 1253377 - DNA, 22 bp, Artificial Sequence
  chemically synthesized
ttggctttgcctaggaaagaat

SEQ ID NO: 1253378 - DNA, 22 bp, Artificial Sequence
  chemically synthesized
gctcgcccttgaattctttcct

SEQ ID NO: 1253379 - DNA, 22 bp, Artificial Sequence
  chemically synthesized
ggctttgcctaggaaagaattc

SEQ ID NO: 1253380 - DNA, 22 bp, Artificial Sequence
  chemically synthesized
gctttgcctaggaaagaattca

SEQ ID NO: 1253381 - DNA, 22 bp, Artificial Sequence
  chemically synthesized
tgcctaggaaagaattcaaggg

SEQ ID NO: 1253382 - DNA, 22 bp, Artificial Sequence
  chemically synthesized
gcctaggaaagaattcaagggc

SEQ ID NO: 1253383 - DNA, 22 bp, Artificial Sequence
  chemically synthesized
cctaggaaagaattcaagggcg

SEQ ID NO: 1253384 - DNA, 22 bp, Artificial Sequence
  chemically synthesized
acgccactggctcgcccttgaa

SEQ ID NO: 1253385 - DNA, 22 bp, Artificial Sequence
  chemically synthesized
aacgccactggctcgcccttga

SEQ ID NO: 1253386 - DNA, 22 bp, Artificial Sequence
  chemically synthesized
ggaaagaattcaagggcgagcc

SEQ ID NO: 1253387 - DNA, 22 bp, Artificial Sequence
  chemically synthesized
tttaacgccactggctcgccct

SEQ ID NO: 1253388 - DNA, 22 bp, Artificial Sequence
  chemically synthesized
aagggcgagccagtggcgttaa

SEQ ID NO: 1253389 - DNA, 22 bp, Artificial Sequence
  chemically synthesized
aaacatagctgtttaacgccac

SEQ ID NO: 1253390 - DNA, 22 bp, Artificial Sequence
  chemically synthesized
actaaaacatagctgtttaacg

SEQ ID NO: 1253391 - DNA, 22 bp, Artificial Sequence
  chemically synthesized
aacagctatgttttagtgaaca

SEQ ID NO: 1253392 - DNA, 22 bp, Artificial Sequence
  chemically synthesized
acaaagcgcagtaatgttcact

SEQ ID NO: 1253393 - DNA, 22 bp, Artificial Sequence
  chemically synthesized
cacaaagcgcagtaatgttcac

SEQ ID NO: 1253394 - DNA, 22 bp, Artificial Sequence
  chemically synthesized
tttcacaaagcgcagtaatgtt

SEQ ID NO: 1253395 - DNA, 22 bp, Artificial Sequence
  chemically synthesized
tgttttagtgaacattactgcg

SEQ ID NO: 1253396 - DNA, 22 bp, Artificial Sequence
  chemically synthesized
tccctatttcacaaagcgcagt

SEQ ID NO: 1253397 - DNA, 22 bp, Artificial Sequence
  chemically synthesized
tagtgaacattactgcgctttg

SEQ ID NO: 1253398 - DNA, 22 bp, Artificial Sequence
  chemically synthesized
agtgaacattactgcgctttgt

SEQ ID NO: 1253399 - DNA, 22 bp, Artificial Sequence
  chemically synthesized
gtgaacattactgcgctttgtg

SEQ ID NO: 1253400 - DNA, 22 bp, Artificial Sequence
  chemically synthesized
tgagttgtccctatttcacaaa

SEQ ID NO: 1253401 - DNA, 22 bp, Artificial Sequence
  chemically synthesized
cctatgagttgtccctatttca

SEQ ID NO: 1253402 - DNA, 22 bp, Artificial Sequence
  chemically synthesized
ctgcgctttgtgaaatagggac

SEQ ID NO: 1253403 - DNA, 22 bp, Artificial Sequence
  chemically synthesized
cgctttgtgaaatagggacaac

SEQ ID NO: 1253404 - DNA, 22 bp, Artificial Sequence
  chemically synthesized
gaggcactgcctatgagttgtc

SEQ ID NO: 1253405 - DNA, 22 bp, Artificial Sequence
  chemically synthesized
tgtgaaatagggacaactcata

SEQ ID NO: 1253406 - DNA, 22 bp, Artificial Sequence
  chemically synthesized
ggaggcactgcctatgagttgt

SEQ ID NO: 1253407 - DNA, 22 bp, Artificial Sequence
  chemically synthesized
gtgaaatagggacaactcatag

SEQ ID NO: 1253408 - DNA, 22 bp, Artificial Sequence
  chemically synthesized
tggaggcactgcctatgagttg

SEQ ID NO: 1253409 - DNA, 22 bp, Artificial Sequence
  chemically synthesized
tgaaatagggacaactcatagg

SEQ ID NO: 1253410 - DNA, 22 bp, Artificial Sequence
  chemically synthesized
ccaactttggaggcactgccta

SEQ ID NO: 1253411 - DNA, 22 bp, Artificial Sequence
  chemically synthesized
ataggcagtgcctccaaagttg

SEQ ID NO: 1253412 - DNA, 22 bp, Artificial Sequence
  chemically synthesized
caaagttggcagggtatgggct

SEQ ID NO: 1253413 - DNA, 22 bp, Artificial Sequence
  chemically synthesized
gcagggtatgggctgctggcta

SEQ ID NO: 1253414 - DNA, 22 bp, Artificial Sequence
  chemically synthesized
ctggctactgtatttatatcca

SEQ ID NO: 1253415 - DNA, 22 bp, Artificial Sequence
  chemically synthesized
aaagtgggtataaatggatata

SEQ ID NO: 1253416 - DNA, 22 bp, Artificial Sequence
  chemically synthesized
gctactgtatttatatccattt

SEQ ID NO: 1253417 - DNA, 22 bp, Artificial Sequence
  chemically synthesized
ctgtatttatatccatttatac

SEQ ID NO: 1253418 - DNA, 22 bp, Artificial Sequence
  chemically synthesized
tatttatatccatttataccca

SEQ ID NO: 1253419 - DNA, 22 bp, Artificial Sequence
  chemically synthesized
catgtaattgaaagtgggtata

SEQ ID NO: 1253420 - DNA, 22 bp, Artificial Sequence
  chemically synthesized
acatgtaattgaaagtgggtat

SEQ ID NO: 1253421 - DNA, 22 bp, Artificial Sequence
  chemically synthesized
atatccatttatacccactttc

SEQ ID NO: 1253422 - DNA, 22 bp, Artificial Sequence
  chemically synthesized
tatccatttatacccactttca

SEQ ID NO: 1253423 - DNA, 22 bp, Artificial Sequence
  chemically synthesized
atttacatgtaattgaaagtgg

SEQ ID NO: 1253424 - DNA, 22 bp, Artificial Sequence
  chemically synthesized
aatttacatgtaattgaaagtg

SEQ ID NO: 1253425 - DNA, 22 bp, Artificial Sequence
  chemically synthesized
ccacttaatttacatgtaattg

SEQ ID NO: 1253426 - DNA, 22 bp, Artificial Sequence
  chemically synthesized
atacccactttcaattacatgt

SEQ ID NO: 1253427 - DNA, 22 bp, Artificial Sequence
  chemically synthesized
tacccactttcaattacatgta

SEQ ID NO: 1253428 - DNA, 22 bp, Artificial Sequence
  chemically synthesized
atctgccacttaatttacatgt

SEQ ID NO: 1253429 - DNA, 22 bp, Artificial Sequence
  chemically synthesized
cattaatctgccacttaattta

SEQ ID NO: 1253430 - DNA, 22 bp, Artificial Sequence
  chemically synthesized
tcaattacatgtaaattaagtg

SEQ ID NO: 1253431 - DNA, 22 bp, Artificial Sequence
  chemically synthesized
gcattaatctgccacttaattt

SEQ ID NO: 1253432 - DNA, 22 bp, Artificial Sequence
  chemically synthesized
caattacatgtaaattaagtgg

SEQ ID NO: 1253433 - DNA, 22 bp, Artificial Sequence
  chemically synthesized
aattacatgtaaattaagtggc

SEQ ID NO: 1253434 - DNA, 22 bp, Artificial Sequence
  chemically synthesized
aatttgcattaatctgccactt

SEQ ID NO: 1253435 - DNA, 22 bp, Artificial Sequence
  chemically synthesized
catgtaaattaagtggcagatt

SEQ ID NO: 1253436 - DNA, 22 bp, Artificial Sequence
  chemically synthesized
tcaatttgcattaatctgccac

SEQ ID NO: 1253437 - DNA, 22 bp, Artificial Sequence
  chemically synthesized
tctctcaatttgcattaatctg

SEQ ID NO: 1253438 - DNA, 22 bp, Artificial Sequence
  chemically synthesized
agtggcagattaatgcaaattg

SEQ ID NO: 1253439 - DNA, 22 bp, Artificial Sequence
  chemically synthesized
aataacctgtctctcaatttgc

SEQ ID NO: 1253440 - DNA, 22 bp, Artificial Sequence
  chemically synthesized
taaataacctgtctctcaattt

SEQ ID NO: 1253441 - DNA, 22 bp, Artificial Sequence
  chemically synthesized
atgcaaattgagagacaggtta

SEQ ID NO: 1253442 - DNA, 22 bp, Artificial Sequence
  chemically synthesized
gaaagttctaaataacctgtct

SEQ ID NO: 1253443 - DNA, 22 bp, Artificial Sequence
  chemically synthesized
ctagaaagttctaaataacctg

SEQ ID NO: 1253444 - DNA, 22 bp, Artificial Sequence
  chemically synthesized
cctagaaagttctaaataacct

SEQ ID NO: 1253445 - DNA, 22 bp, Artificial Sequence
  chemically synthesized
tcctagaaagttctaaataacc

SEQ ID NO: 1253446 - DNA, 22 bp, Artificial Sequence
  chemically synthesized
agagacaggttatttagaactt

SEQ ID NO: 1253447 - DNA, 22 bp, Artificial Sequence
  chemically synthesized
ccacccctttcctagaaagttc

SEQ ID NO: 1253448 - DNA, 22 bp, Artificial Sequence
  chemically synthesized
tttagaactttctaggaaaggg

SEQ ID NO: 1253449 - DNA, 22 bp, Artificial Sequence
  chemically synthesized
agaactttctaggaaaggggtg

SEQ ID NO: 1253450 - DNA, 22 bp, Artificial Sequence
  chemically synthesized
gaactttctaggaaaggggtgg

SEQ ID NO: 1253451 - DNA, 22 bp, Artificial Sequence
  chemically synthesized
tctaggaaaggggtggtaactt

SEQ ID NO: 1253452 - DNA, 22 bp, Artificial Sequence
  chemically synthesized
ctaggaaaggggtggtaacttc

SEQ ID NO: 1253453 - DNA, 22 bp, Artificial Sequence
  chemically synthesized
taggaaaggggtggtaacttct

SEQ ID NO: 1253454 - DNA, 22 bp, Artificial Sequence
  chemically synthesized
ggaaaggggtggtaacttctgg

SEQ ID NO: 1253455 - DNA, 22 bp, Artificial Sequence
  chemically synthesized
caaaggacatggcaataaccca

SEQ ID NO: 1253456 - DNA, 22 bp, Artificial Sequence
  chemically synthesized
acaaaggacatggcaataaccc

SEQ ID NO: 1253457 - DNA, 22 bp, Artificial Sequence
  chemically synthesized
ctgggttattgccatgtccttt

SEQ ID NO: 1253458 - DNA, 22 bp, Artificial Sequence
  chemically synthesized
tgggttattgccatgtcctttg

SEQ ID NO: 1253459 - DNA, 22 bp, Artificial Sequence
  chemically synthesized
ggttattgccatgtcctttgta

SEQ ID NO: 1253460 - DNA, 22 bp, Artificial Sequence
  chemically synthesized
ttgccatgtcctttgtaaactg

SEQ ID NO: 1253461 - DNA, 22 bp, Artificial Sequence
  chemically synthesized
ccatgtcctttgtaaactgtca

SEQ ID NO: 1253462 - DNA, 22 bp, Artificial Sequence
  chemically synthesized
ccaccagcaccatgacagttta

SEQ ID NO: 1253463 - DNA, 22 bp, Artificial Sequence
  chemically synthesized
tgtaaactgtcatggtgctggt

SEQ ID NO: 1253464 - DNA, 22 bp, Artificial Sequence
  chemically synthesized
gtaaactgtcatggtgctggtg

SEQ ID NO: 1253465 - DNA, 22 bp, Artificial Sequence
  chemically synthesized
taaactgtcatggtgctggtgg

SEQ ID NO: 1253466 - DNA, 22 bp, Artificial Sequence
  chemically synthesized
gcagaagccactcccaccagca

SEQ ID NO: 1253467 - DNA, 22 bp, Artificial Sequence
  chemically synthesized
tcatggtgctggtgggagtggc

SEQ ID NO: 1253468 - DNA, 22 bp, Artificial Sequence
  chemically synthesized
catattagcagaagccactccc

SEQ ID NO: 1253469 - DNA, 22 bp, Artificial Sequence
  chemically synthesized
attgcatattagcagaagccac

SEQ ID NO: 1253470 - DNA, 22 bp, Artificial Sequence
  chemically synthesized
gtgggagtggcttctgctaata

SEQ ID NO: 1253471 - DNA, 22 bp, Artificial Sequence
  chemically synthesized
ctgctaatatgcaatgagggct

SEQ ID NO: 1253472 - DNA, 22 bp, Artificial Sequence
  chemically synthesized
tgctaatatgcaatgagggctg

SEQ ID NO: 1253473 - DNA, 22 bp, Artificial Sequence
  chemically synthesized
ctaatatgcaatgagggctgct

SEQ ID NO: 1253474 - DNA, 22 bp, Artificial Sequence
  chemically synthesized
atatgcaatgagggctgctggg

SEQ ID NO: 1253475 - DNA, 22 bp, Artificial Sequence
  chemically synthesized
ctggggatcacttttgttgcca

SEQ ID NO: 1253476 - DNA, 22 bp, Artificial Sequence
  chemically synthesized
gggatcacttttgttgccatct

SEQ ID NO: 1253477 - DNA, 22 bp, Artificial Sequence
  chemically synthesized
ttgttgccatctgctggtttct

SEQ ID NO: 1253478 - DNA, 22 bp, Artificial Sequence
  chemically synthesized
tgttgccatctgctggtttctg

SEQ ID NO: 1253479 - DNA, 22 bp, Artificial Sequence
  chemically synthesized
gttgccatctgctggtttctgc

SEQ ID NO: 1253480 - DNA, 22 bp, Artificial Sequence
  chemically synthesized
ttgccatctgctggtttctgct

SEQ ID NO: 1253481 - DNA, 22 bp, Artificial Sequence
  chemically synthesized
ccatctgctggtttctgctgtt

SEQ ID NO: 1253482 - DNA, 22 bp, Artificial Sequence
  chemically synthesized
ctggtttctgctgtttttctca

SEQ ID NO: 1253483 - DNA, 22 bp, Artificial Sequence
  chemically synthesized
gtttctgctgtttttctcactt

SEQ ID NO: 1253484 - DNA, 22 bp, Artificial Sequence
  chemically synthesized
ctgctgtttttctcacttccgt

SEQ ID NO: 1253485 - DNA, 22 bp, Artificial Sequence
  chemically synthesized
tgctgtttttctcacttccgtt

SEQ ID NO: 1253486 - DNA, 22 bp, Artificial Sequence
  chemically synthesized
ctgtttttctcacttccgttgg

SEQ ID NO: 1253487 - DNA, 22 bp, Artificial Sequence
  chemically synthesized
tttttctcacttccgttggtcg

SEQ ID NO: 1253488 - DNA, 22 bp, Artificial Sequence
  chemically synthesized
ttctcacttccgttggtcgctg

SEQ ID NO: 1253489 - DNA, 22 bp, Artificial Sequence
  chemically synthesized
tctcacttccgttggtcgctgc

SEQ ID NO: 1253490 - DNA, 22 bp, Artificial Sequence
  chemically synthesized
ctcacttccgttggtcgctgcc

SEQ ID NO: 1253491 - DNA, 22 bp, Artificial Sequence
  chemically synthesized
tcacttccgttggtcgctgcct

SEQ ID NO: 1253492 - DNA, 22 bp, Artificial Sequence
  chemically synthesized
gcaggtaccagcaggcagcgac

SEQ ID NO: 1253493 - DNA, 22 bp, Artificial Sequence
  chemically synthesized
acttccgttggtcgctgcctgc

SEQ ID NO: 1253494 - DNA, 22 bp, Artificial Sequence
  chemically synthesized
ccgttggtcgctgcctgctggt

SEQ ID NO: 1253495 - DNA, 22 bp, Artificial Sequence
  chemically synthesized
cgttggtcgctgcctgctggta

SEQ ID NO: 1253496 - DNA, 22 bp, Artificial Sequence
  chemically synthesized
gtcgctgcctgctggtacctgc

SEQ ID NO: 1253497 - DNA, 22 bp, Artificial Sequence
  chemically synthesized
cctgctggtacctgccagtttc

SEQ ID NO: 1253498 - DNA, 22 bp, Artificial Sequence
  chemically synthesized
ctggtacctgccagtttcttca

SEQ ID NO: 1253499 - DNA, 22 bp, Artificial Sequence
  chemically synthesized
ccagaggataaagtgaagaaac

SEQ ID NO: 1253500 - DNA, 22 bp, Artificial Sequence
  chemically synthesized
gtacctgccagtttcttcactt

SEQ ID NO: 1253501 - DNA, 22 bp, Artificial Sequence
  chemically synthesized
ccattcccagaggataaagtga

SEQ ID NO: 1253502 - DNA, 22 bp, Artificial Sequence
  chemically synthesized
cccattcccagaggataaagtg

SEQ ID NO: 1253503 - DNA, 22 bp, Artificial Sequence
  chemically synthesized
ccagtttcttcactttatcctc

SEQ ID NO: 1253504 - DNA, 22 bp, Artificial Sequence
  chemically synthesized
tttcccattcccagaggataaa

SEQ ID NO: 1253505 - DNA, 22 bp, Artificial Sequence
  chemically synthesized
atttcccattcccagaggataa

SEQ ID NO: 1253506 - DNA, 22 bp, Artificial Sequence
  chemically synthesized
cttcactttatcctctgggaat

SEQ ID NO: 1253507 - DNA, 22 bp, Artificial Sequence
  chemically synthesized
ttcactttatcctctgggaatg

SEQ ID NO: 1253508 - DNA, 22 bp, Artificial Sequence
  chemically synthesized
cactttatcctctgggaatggg

SEQ ID NO: 1253509 - DNA, 22 bp, Artificial Sequence
  chemically synthesized
actttatcctctgggaatggga

SEQ ID NO: 1253510 - DNA, 22 bp, Artificial Sequence
  chemically synthesized
ggcaggacttatttcccattcc

SEQ ID NO: 1253511 - DNA, 22 bp, Artificial Sequence
  chemically synthesized
tatcctctgggaatgggaaata

SEQ ID NO: 1253512 - DNA, 22 bp, Artificial Sequence
  chemically synthesized
atcctctgggaatgggaaataa

SEQ ID NO: 1253513 - DNA, 22 bp, Artificial Sequence
  chemically synthesized
tcctctgggaatgggaaataag

SEQ ID NO: 1253514 - DNA, 22 bp, Artificial Sequence
  chemically synthesized
tgggaatgggaaataagtcctg

SEQ ID NO: 1253515 - DNA, 22 bp, Artificial Sequence
  chemically synthesized
ggaatgggaaataagtcctgcc

SEQ ID NO: 1253516 - DNA, 22 bp, Artificial Sequence
  chemically synthesized
aggtaggagttgggcaggactt

SEQ ID NO: 1253517 - DNA, 22 bp, Artificial Sequence
  chemically synthesized
tgcaagcctgaggtaggagttg

SEQ ID NO: 1253518 - DNA, 22 bp, Artificial Sequence
  chemically synthesized
tgtgcaagcctgaggtaggagt

SEQ ID NO: 1253519 - DNA, 22 bp, Artificial Sequence
  chemically synthesized
aaaattctgtgcaagcctgagg

SEQ ID NO: 1253520 - DNA, 22 bp, Artificial Sequence
  chemically synthesized
cccaactcctacctcaggcttg

SEQ ID NO: 1253521 - DNA, 22 bp, Artificial Sequence
  chemically synthesized
caattaaaaattctgtgcaagc

SEQ ID NO: 1253522 - DNA, 22 bp, Artificial Sequence
  chemically synthesized
ccaattaaaaattctgtgcaag

SEQ ID NO: 1253523 - DNA, 22 bp, Artificial Sequence
  chemically synthesized
tccaattaaaaattctgtgcaa

SEQ ID NO: 1253524 - DNA, 22 bp, Artificial Sequence
  chemically synthesized
ctacctcaggcttgcacagaat

SEQ ID NO: 1253525 - DNA, 22 bp, Artificial Sequence
  chemically synthesized
cctcaggcttgcacagaatttt

SEQ ID NO: 1253526 - DNA, 22 bp, Artificial Sequence
  chemically synthesized
aggcttgcacagaatttttaat

SEQ ID NO: 1253527 - DNA, 22 bp, Artificial Sequence
  chemically synthesized
gaaaaaggttttccaattaaaa

SEQ ID NO: 1253528 - DNA, 22 bp, Artificial Sequence
  chemically synthesized
gcacagaatttttaattggaaa

SEQ ID NO: 1253529 - DNA, 22 bp, Artificial Sequence
  chemically synthesized
cacagaatttttaattggaaaa

SEQ ID NO: 1253530 - DNA, 22 bp, Artificial Sequence
  chemically synthesized
gtgggtaactggaaaaaggttt

SEQ ID NO: 1253531 - DNA, 22 bp, Artificial Sequence
  chemically synthesized
ggtgggtaactggaaaaaggtt

SEQ ID NO: 1253532 - DNA, 22 bp, Artificial Sequence
  chemically synthesized
ttaattggaaaacctttttcca

SEQ ID NO: 1253533 - DNA, 22 bp, Artificial Sequence
  chemically synthesized
taattggaaaacctttttccag

SEQ ID NO: 1253534 - DNA, 22 bp, Artificial Sequence
  chemically synthesized
aattggaaaacctttttccagt

SEQ ID NO: 1253535 - DNA, 22 bp, Artificial Sequence
  chemically synthesized
attggaaaacctttttccagtt

SEQ ID NO: 1253536 - DNA, 22 bp, Artificial Sequence
  chemically synthesized
gaaaacctttttccagttaccc

SEQ ID NO: 1253537 - DNA, 22 bp, Artificial Sequence
  chemically synthesized
tttccagttacccaccaaatat

SEQ ID NO: 1253538 - DNA, 22 bp, Artificial Sequence
  chemically synthesized
ttccagttacccaccaaatata

SEQ ID NO: 1253539 - DNA, 22 bp, Artificial Sequence
  chemically synthesized
tccagttacccaccaaatatac

SEQ ID NO: 1253540 - DNA, 22 bp, Artificial Sequence
  chemically synthesized
ccagttacccaccaaatataca

SEQ ID NO: 1253541 - DNA, 22 bp, Artificial Sequence
  chemically synthesized
cagttacccaccaaatatacat

SEQ ID NO: 1253542 - DNA, 22 bp, Artificial Sequence
  chemically synthesized
atatatagtaggcagtgatgta

SEQ ID NO: 1253543 - DNA, 22 bp, Artificial Sequence
  chemically synthesized
cccaccaaatatacatcactgc

SEQ ID NO: 1253544 - DNA, 22 bp, Artificial Sequence
  chemically synthesized
gaacagtgcctgatatatagta

SEQ ID NO: 1253545 - DNA, 22 bp, Artificial Sequence
  chemically synthesized
ggaacagtgcctgatatatagt

SEQ ID NO: 1253546 - DNA, 22 bp, Artificial Sequence
  chemically synthesized
cctactatatatcaggcactgt

SEQ ID NO: 1253547 - DNA, 22 bp, Artificial Sequence
  chemically synthesized
ctatatatcaggcactgttcca

SEQ ID NO: 1253548 - DNA, 22 bp, Artificial Sequence
  chemically synthesized
tatatcaggcactgttccaagt

SEQ ID NO: 1253549 - DNA, 22 bp, Artificial Sequence
  chemically synthesized
gtgaatcccaagcacttggaac

SEQ ID NO: 1253550 - DNA, 22 bp, Artificial Sequence
  chemically synthesized
ctggtgaatcccaagcacttgg

SEQ ID NO: 1253551 - DNA, 22 bp, Artificial Sequence
  chemically synthesized
tctactggtgaatcccaagcac

SEQ ID NO: 1253552 - DNA, 22 bp, Artificial Sequence
  chemically synthesized
ttccaagtgcttgggattcacc

SEQ ID NO: 1253553 - DNA, 22 bp, Artificial Sequence
  chemically synthesized
caagtgcttgggattcaccagt

SEQ ID NO: 1253554 - DNA, 22 bp, Artificial Sequence
  chemically synthesized
tgtgtgcatgttgtctactggt

SEQ ID NO: 1253555 - DNA, 22 bp, Artificial Sequence
  chemically synthesized
atgtgtgcatgttgtctactgg

SEQ ID NO: 1253556 - DNA, 22 bp, Artificial Sequence
  chemically synthesized
tatgtgtgcatgttgtctactg

SEQ ID NO: 1253557 - DNA, 22 bp, Artificial Sequence
  chemically synthesized
ttatgtgtgcatgttgtctact

SEQ ID NO: 1253558 - DNA, 22 bp, Artificial Sequence
  chemically synthesized
tttatgtgtgcatgttgtctac

SEQ ID NO: 1253559 - DNA, 22 bp, Artificial Sequence
  chemically synthesized
gggattcaccagtagacaacat

SEQ ID NO: 1253560 - DNA, 22 bp, Artificial Sequence
  chemically synthesized
ttttatgtgtgcatgttgtcta

SEQ ID NO: 1253561 - DNA, 22 bp, Artificial Sequence
  chemically synthesized
ggattcaccagtagacaacatg

SEQ ID NO: 1253562 - DNA, 22 bp, Artificial Sequence
  chemically synthesized
tttttatgtgtgcatgttgtct

SEQ ID NO: 1253563 - DNA, 22 bp, Artificial Sequence
  chemically synthesized
ttttttatgtgtgcatgttgtc

SEQ ID NO: 1253564 - DNA, 22 bp, Artificial Sequence
  chemically synthesized
accagtagacaacatgcacaca

SEQ ID NO: 1253565 - DNA, 22 bp, Artificial Sequence
  chemically synthesized
agcacttttttttatgtgtgca

SEQ ID NO: 1253566 - DNA, 22 bp, Artificial Sequence
  chemically synthesized
ataagttgagcactttttttta

SEQ ID NO: 1253567 - DNA, 22 bp, Artificial Sequence
  chemically synthesized
cctcataagttgagcacttttt

SEQ ID NO: 1253568 - DNA, 22 bp, Artificial Sequence
  chemically synthesized
gcctcataagttgagcactttt

SEQ ID NO: 1253569 - DNA, 22 bp, Artificial Sequence
  chemically synthesized
tatatttgcctcataagttgag

SEQ ID NO: 1253570 - DNA, 22 bp, Artificial Sequence
  chemically synthesized
aacttatgaggcaaatatatag

SEQ ID NO: 1253571 - DNA, 22 bp, Artificial Sequence
  chemically synthesized
atgaggcaaatatatagtgcac

SEQ ID NO: 1253572 - DNA, 22 bp, Artificial Sequence
  chemically synthesized
tgaggcaaatatatagtgcact

SEQ ID NO: 1253573 - DNA, 22 bp, Artificial Sequence
  chemically synthesized
tatgtaaaacatcccagtgcac

SEQ ID NO: 1253574 - DNA, 22 bp, Artificial Sequence
  chemically synthesized
gagttgtatgtaaaacatccca

SEQ ID NO: 1253575 - DNA, 22 bp, Artificial Sequence
  chemically synthesized
agaatctggagttgtatgtaaa

SEQ ID NO: 1253576 - DNA, 22 bp, Artificial Sequence
  chemically synthesized
aagaatctggagttgtatgtaa

SEQ ID NO: 1253577 - DNA, 22 bp, Artificial Sequence
  chemically synthesized
ggatgttttacatacaactcca

SEQ ID NO: 1253578 - DNA, 22 bp, Artificial Sequence
  chemically synthesized
aagaggaacttaagaatctgga

SEQ ID NO: 1253579 - DNA, 22 bp, Artificial Sequence
  chemically synthesized
caagaggaacttaagaatctgg

SEQ ID NO: 1253580 - DNA, 22 bp, Artificial Sequence
  chemically synthesized
tacatacaactccagattctta

SEQ ID NO: 1253581 - DNA, 22 bp, Artificial Sequence
  chemically synthesized
tcaagaggaacttaagaatctg

SEQ ID NO: 1253582 - DNA, 22 bp, Artificial Sequence
  chemically synthesized
acatacaactccagattcttaa

SEQ ID NO: 1253583 - DNA, 22 bp, Artificial Sequence
  chemically synthesized
ttcaagaggaacttaagaatct

SEQ ID NO: 1253584 - DNA, 22 bp, Artificial Sequence
  chemically synthesized
catacaactccagattcttaag

SEQ ID NO: 1253585 - DNA, 22 bp, Artificial Sequence
  chemically synthesized
tttttcaagaggaacttaagaa

SEQ ID NO: 1253586 - DNA, 22 bp, Artificial Sequence
  chemically synthesized
atttttcaagaggaacttaaga

SEQ ID NO: 1253587 - DNA, 22 bp, Artificial Sequence
  chemically synthesized
tatttttcaagaggaacttaag

SEQ ID NO: 1253588 - DNA, 22 bp, Artificial Sequence
  chemically synthesized
cagattcttaagttcctcttga

SEQ ID NO: 1253589 - DNA, 22 bp, Artificial Sequence
  chemically synthesized
gccatatattttatttttcaag

SEQ ID NO: 1253590 - DNA, 22 bp, Artificial Sequence
  chemically synthesized
ggccatatattttatttttcaa

SEQ ID NO: 1253591 - DNA, 22 bp, Artificial Sequence
  chemically synthesized
ttaagttcctcttgaaaaataa

SEQ ID NO: 1253592 - DNA, 22 bp, Artificial Sequence
  chemically synthesized
tggccatatattttatttttca

SEQ ID NO: 1253593 - DNA, 22 bp, Artificial Sequence
  chemically synthesized
ttggccatatattttatttttc

SEQ ID NO: 1253594 - DNA, 22 bp, Artificial Sequence
  chemically synthesized
aagttcctcttgaaaaataaaa

SEQ ID NO: 1253595 - DNA, 22 bp, Artificial Sequence
  chemically synthesized
agttcctcttgaaaaataaaat

SEQ ID NO: 1253596 - DNA, 22 bp, Artificial Sequence
  chemically synthesized
tttttggccatatattttattt

SEQ ID NO: 1253597 - DNA, 22 bp, Artificial Sequence
  chemically synthesized
ctcttgaaaaataaaatatatg

SEQ ID NO: 1253598 - DNA, 22 bp, Artificial Sequence
  chemically synthesized
ttgaaaaataaaatatatggcc

SEQ ID NO: 1253599 - DNA, 22 bp, Artificial Sequence
  chemically synthesized
gaaaaataaaatatatggccaa

SEQ ID NO: 1253600 - DNA, 22 bp, Artificial Sequence
  chemically synthesized
aaaaataaaatatatggccaaa

SEQ ID NO: 1253601 - DNA, 22 bp, Artificial Sequence
  chemically synthesized
gcagtgtccatgtcagaatgta

SEQ ID NO: 1253602 - DNA, 22 bp, Artificial Sequence
  chemically synthesized
agtctagcagtgtccatgtcag

SEQ ID NO: 1253603 - DNA, 22 bp, Artificial Sequence
  chemically synthesized
tacattctgacatggacactgc

SEQ ID NO: 1253604 - DNA, 22 bp, Artificial Sequence
  chemically synthesized
cattctgacatggacactgcta

SEQ ID NO: 1253605 - DNA, 22 bp, Artificial Sequence
  chemically synthesized
atcaattcagtctagcagtgtc

SEQ ID NO: 1253606 - DNA, 22 bp, Artificial Sequence
  chemically synthesized
ctaatcaattcagtctagcagt

SEQ ID NO: 1253607 - DNA, 22 bp, Artificial Sequence
  chemically synthesized
tgacatggacactgctagactg

SEQ ID NO: 1253608 - DNA, 22 bp, Artificial Sequence
  chemically synthesized
acatggacactgctagactgaa

SEQ ID NO: 1253609 - DNA, 22 bp, Artificial Sequence
  chemically synthesized
aaatgggcaactgctaatcaat

SEQ ID NO: 1253610 - DNA, 22 bp, Artificial Sequence
  chemically synthesized
ctagactgaattgattagcagt

SEQ ID NO: 1253611 - DNA, 22 bp, Artificial Sequence
  chemically synthesized
gactgaattgattagcagttgc

SEQ ID NO: 1253612 - DNA, 22 bp, Artificial Sequence
  chemically synthesized
aattgattagcagttgcccatt

SEQ ID NO: 1253613 - DNA, 22 bp, Artificial Sequence
  chemically synthesized
tgcccagtctaaaatgggcaac

SEQ ID NO: 1253614 - DNA, 22 bp, Artificial Sequence
  chemically synthesized
attagcagttgcccattttaga

SEQ ID NO: 1253615 - DNA, 22 bp, Artificial Sequence
  chemically synthesized
gcagttgcccattttagactgg

SEQ ID NO: 1253616 - DNA, 22 bp, Artificial Sequence
  chemically synthesized
cccattttagactgggcacagg

SEQ ID NO: 1253617 - DNA, 22 bp, Artificial Sequence
  chemically synthesized
gcaaatggcacgcctgtgccca

SEQ ID NO: 1253618 - DNA, 22 bp, Artificial Sequence
  chemically synthesized
tagactgggcacaggcgtgcca

SEQ ID NO: 1253619 - DNA, 22 bp, Artificial Sequence
  chemically synthesized
agactgggcacaggcgtgccat

SEQ ID NO: 1253620 - DNA, 22 bp, Artificial Sequence
  chemically synthesized
gactgggcacaggcgtgccatt

SEQ ID NO: 1253621 - DNA, 22 bp, Artificial Sequence
  chemically synthesized
gaaagaatactggcaaatggca

SEQ ID NO: 1253622 - DNA, 22 bp, Artificial Sequence
  chemically synthesized
ggcacaggcgtgccatttgcca

SEQ ID NO: 1253623 - DNA, 22 bp, Artificial Sequence
  chemically synthesized
tgtaaattggaaagaatactgg

SEQ ID NO: 1253624 - DNA, 22 bp, Artificial Sequence
  chemically synthesized
gccagtattctttccaatttac

SEQ ID NO: 1253625 - DNA, 22 bp, Artificial Sequence
  chemically synthesized
ccagtattctttccaatttaca

SEQ ID NO: 1253626 - DNA, 22 bp, Artificial Sequence
  chemically synthesized
aatgcatacggacattgtgtaa

SEQ ID NO: 1253627 - DNA, 22 bp, Artificial Sequence
  chemically synthesized
tttccaatttacacaatgtccg

SEQ ID NO: 1253628 - DNA, 22 bp, Artificial Sequence
  chemically synthesized
tccaatttacacaatgtccgta

SEQ ID NO: 1253629 - DNA, 22 bp, Artificial Sequence
  chemically synthesized
ccaatttacacaatgtccgtat

SEQ ID NO: 1253630 - DNA, 22 bp, Artificial Sequence
  chemically synthesized
caatttacacaatgtccgtatg

SEQ ID NO: 1253631 - DNA, 22 bp, Artificial Sequence
  chemically synthesized
acacaatgtccgtatgcattta

SEQ ID NO: 1253632 - DNA, 22 bp, Artificial Sequence
  chemically synthesized
cacaatgtccgtatgcatttag

SEQ ID NO: 1253633 - DNA, 22 bp, Artificial Sequence
  chemically synthesized
aaagggaatggaaataggtgaa

SEQ ID NO: 1253634 - DNA, 22 bp, Artificial Sequence
  chemically synthesized
agatctttgcttcacctatttc

SEQ ID NO: 1253635 - DNA, 22 bp, Artificial Sequence
  chemically synthesized
gatctttgcttcacctatttcc

SEQ ID NO: 1253636 - DNA, 22 bp, Artificial Sequence
  chemically synthesized
tgcttcacctatttccattccc

SEQ ID NO: 1253637 - DNA, 22 bp, Artificial Sequence
  chemically synthesized
gcttcacctatttccattccct

SEQ ID NO: 1253638 - DNA, 22 bp, Artificial Sequence
  chemically synthesized
caaggacctgaaagggaatgga

SEQ ID NO: 1253639 - DNA, 22 bp, Artificial Sequence
  chemically synthesized
cttcacctatttccattccctt

SEQ ID NO: 1253640 - DNA, 22 bp, Artificial Sequence
  chemically synthesized
cacctatttccattccctttca

SEQ ID NO: 1253641 - DNA, 22 bp, Artificial Sequence
  chemically synthesized
acctatttccattccctttcag

SEQ ID NO: 1253642 - DNA, 22 bp, Artificial Sequence
  chemically synthesized
aaatacctgcaaggacctgaaa

SEQ ID NO: 1253643 - DNA, 22 bp, Artificial Sequence
  chemically synthesized
tttccattccctttcaggtcct

SEQ ID NO: 1253644 - DNA, 22 bp, Artificial Sequence
  chemically synthesized
ccattccctttcaggtccttgc

SEQ ID NO: 1253645 - DNA, 22 bp, Artificial Sequence
  chemically synthesized
cattccctttcaggtccttgca

SEQ ID NO: 1253646 - DNA, 22 bp, Artificial Sequence
  chemically synthesized
cctttcaggtccttgcaggtat

SEQ ID NO: 1253647 - DNA, 22 bp, Artificial Sequence
  chemically synthesized
tcaggtccttgcaggtatttta

SEQ ID NO: 1253648 - DNA, 22 bp, Artificial Sequence
  chemically synthesized
caggtccttgcaggtattttaa

SEQ ID NO: 1253649 - DNA, 22 bp, Artificial Sequence
  chemically synthesized
aggtccttgcaggtattttaat

SEQ ID NO: 1253650 - DNA, 22 bp, Artificial Sequence
  chemically synthesized
gcaggtattttaattgtggact

SEQ ID NO: 1253651 - DNA, 22 bp, Artificial Sequence
  chemically synthesized
caggtattttaattgtggactc

SEQ ID NO: 1253652 - DNA, 22 bp, Artificial Sequence
  chemically synthesized
taattgtggactccattcactg

SEQ ID NO: 1253653 - DNA, 22 bp, Artificial Sequence
  chemically synthesized
aattgtggactccattcactgt

SEQ ID NO: 1253654 - DNA, 22 bp, Artificial Sequence
  chemically synthesized
attgtggactccattcactgta

SEQ ID NO: 1253655 - DNA, 22 bp, Artificial Sequence
  chemically synthesized
tggactccattcactgtattat

SEQ ID NO: 1253656 - DNA, 22 bp, Artificial Sequence
  chemically synthesized
aaataaaataaaataatacagt

SEQ ID NO: 1253657 - DNA, 22 bp, Artificial Sequence
  chemically synthesized
aactgaaataaaataaaataat

SEQ ID NO: 1253658 - DNA, 22 bp, Artificial Sequence
  chemically synthesized
cattcactgtattattttattt

SEQ ID NO: 1253659 - DNA, 22 bp, Artificial Sequence
  chemically synthesized
actgtattattttattttattt

SEQ ID NO: 1253660 - DNA, 22 bp, Artificial Sequence
  chemically synthesized
tattattttattttatttcagt

SEQ ID NO: 1253661 - DNA, 22 bp, Artificial Sequence
  chemically synthesized
ttttattttatttcagttcagt

SEQ ID NO: 1253662 - DNA, 22 bp, Artificial Sequence
  chemically synthesized
aaaatgatacaaactgaactga

SEQ ID NO: 1253663 - DNA, 22 bp, Artificial Sequence
  chemically synthesized
tattttatttcagttcagtttg

SEQ ID NO: 1253664 - DNA, 22 bp, Artificial Sequence
  chemically synthesized
attttatttcagttcagtttgt

SEQ ID NO: 1253665 - DNA, 22 bp, Artificial Sequence
  chemically synthesized
ttttatttcagttcagtttgta

SEQ ID NO: 1253666 - DNA, 22 bp, Artificial Sequence
  chemically synthesized
tatttcagttcagtttgtatca

SEQ ID NO: 1253667 - DNA, 22 bp, Artificial Sequence
  chemically synthesized
atttcagttcagtttgtatcat

SEQ ID NO: 1253668 - DNA, 22 bp, Artificial Sequence
  chemically synthesized
tttcagttcagtttgtatcatt

SEQ ID NO: 1253669 - DNA, 22 bp, Artificial Sequence
  chemically synthesized
cagttcagtttgtatcattttg

SEQ ID NO: 1253670 - DNA, 22 bp, Artificial Sequence
  chemically synthesized
aaaacaggaactcaaaatgata

SEQ ID NO: 1253671 - DNA, 22 bp, Artificial Sequence
  chemically synthesized
agttcagtttgtatcattttga

SEQ ID NO: 1253672 - DNA, 22 bp, Artificial Sequence
  chemically synthesized
aattaaaaacaggaactcaaaa

SEQ ID NO: 1253673 - DNA, 22 bp, Artificial Sequence
  chemically synthesized
agtttgtatcattttgagttcc

SEQ ID NO: 1253674 - DNA, 22 bp, Artificial Sequence
  chemically synthesized
tactaaattaaaaacaggaact

SEQ ID NO: 1253675 - DNA, 22 bp, Artificial Sequence
  chemically synthesized
gtatcattttgagttcctgttt

SEQ ID NO: 1253676 - DNA, 22 bp, Artificial Sequence
  chemically synthesized
tatcattttgagttcctgtttt

SEQ ID NO: 1253677 - DNA, 22 bp, Artificial Sequence
  chemically synthesized
tgatattatactaaattaaaaa

SEQ ID NO: 1253678 - DNA, 22 bp, Artificial Sequence
  chemically synthesized
tgagttcctgtttttaatttag

SEQ ID NO: 1253679 - DNA, 22 bp, Artificial Sequence
  chemically synthesized
tatgatattatactaaattaaa

SEQ ID NO: 1253680 - DNA, 22 bp, Artificial Sequence
  chemically synthesized
gagttcctgtttttaatttagt

SEQ ID NO: 1253681 - DNA, 22 bp, Artificial Sequence
  chemically synthesized
ctatgatattatactaaattaa

SEQ ID NO: 1253682 - DNA, 22 bp, Artificial Sequence
  chemically synthesized
agttcctgtttttaatttagta

SEQ ID NO: 1253683 - DNA, 22 bp, Artificial Sequence
  chemically synthesized
tctatgatattatactaaatta

SEQ ID NO: 1253684 - DNA, 22 bp, Artificial Sequence
  chemically synthesized
ctgtttttaatttagtataata

SEQ ID NO: 1253685 - DNA, 22 bp, Artificial Sequence
  chemically synthesized
tttttaatttagtataatatca

SEQ ID NO: 1253686 - DNA, 22 bp, Artificial Sequence
  chemically synthesized
ttaatttagtataatatcatag

SEQ ID NO: 1253687 - DNA, 22 bp, Artificial Sequence
  chemically synthesized
taatttagtataatatcataga

SEQ ID NO: 1253688 - DNA, 22 bp, Artificial Sequence
  chemically synthesized
aatttagtataatatcatagaa

SEQ ID NO: 1253689 - DNA, 22 bp, Artificial Sequence
  chemically synthesized
agtacaaacactttctatgata

SEQ ID NO: 1253690 - DNA, 22 bp, Artificial Sequence
  chemically synthesized
atttagtataatatcatagaaa

SEQ ID NO: 1253691 - DNA, 22 bp, Artificial Sequence
  chemically synthesized
agtataatatcatagaaagtgt

SEQ ID NO: 1253692 - DNA, 22 bp, Artificial Sequence
  chemically synthesized
gtataatatcatagaaagtgtt

SEQ ID NO: 1253693 - DNA, 22 bp, Artificial Sequence
  chemically synthesized
gtacttaattctacggccgggt

SEQ ID NO: 1253694 - DNA, 22 bp, Artificial Sequence
  chemically synthesized
tacttaattctacggccgggtg

SEQ ID NO: 1253695 - DNA, 22 bp, Artificial Sequence
  chemically synthesized
caggcgtgagccaccgcacccg

SEQ ID NO: 1253696 - DNA, 22 bp, Artificial Sequence
  chemically synthesized
aattctacggccgggtgcggtg

SEQ ID NO: 1253697 - DNA, 22 bp, Artificial Sequence
  chemically synthesized
attctacggccgggtgcggtgg

SEQ ID NO: 1253698 - DNA, 22 bp, Artificial Sequence
  chemically synthesized
tacggccgggtgcggtggctca

SEQ ID NO: 1253699 - DNA, 22 bp, Artificial Sequence
  chemically synthesized
tgattgcaggcgtgagccaccg

SEQ ID NO: 1253700 - DNA, 22 bp, Artificial Sequence
  chemically synthesized
cggccgggtgcggtggctcacg

SEQ ID NO: 1253701 - DNA, 22 bp, Artificial Sequence
  chemically synthesized
ccaaagtgctgtgattgcaggc

SEQ ID NO: 1253702 - DNA, 22 bp, Artificial Sequence
  chemically synthesized
agcctcccaaagtgctgtgatt

SEQ ID NO: 1253703 - DNA, 22 bp, Artificial Sequence
  chemically synthesized
acgcctgcaatcacagcacttt

SEQ ID NO: 1253704 - DNA, 22 bp, Artificial Sequence
  chemically synthesized
caatcacagcactttgggaggc

SEQ ID NO: 1253705 - DNA, 22 bp, Artificial Sequence
  chemically synthesized
gtgatccgcccgcctcagcctc

SEQ ID NO: 1253706 - DNA, 22 bp, Artificial Sequence
  chemically synthesized
atctcgtgatccgcccgcctca

SEQ ID NO: 1253707 - DNA, 22 bp, Artificial Sequence
  chemically synthesized
gatctcgtgatccgcccgcctc

SEQ ID NO: 1253708 - DNA, 22 bp, Artificial Sequence
  chemically synthesized
ttgatctcgtgatccgcccgcc

SEQ ID NO: 1253709 - DNA, 22 bp, Artificial Sequence
  chemically synthesized
tgggaggctgaggcgggcggat

SEQ ID NO: 1253710 - DNA, 22 bp, Artificial Sequence
  chemically synthesized
gggaggctgaggcgggcggatc

SEQ ID NO: 1253711 - DNA, 22 bp, Artificial Sequence
  chemically synthesized
ggaggctgaggcgggcggatca

SEQ ID NO: 1253712 - DNA, 22 bp, Artificial Sequence
  chemically synthesized
gatctcttgatctcgtgatccg

SEQ ID NO: 1253713 - DNA, 22 bp, Artificial Sequence
  chemically synthesized
aggcgggcggatcacgagatca

SEQ ID NO: 1253714 - DNA, 22 bp, Artificial Sequence
  chemically synthesized
gtcaggatggtctcgatctctt

SEQ ID NO: 1253715 - DNA, 22 bp, Artificial Sequence
  chemically synthesized
accatgttggtcaggatggtct

SEQ ID NO: 1253716 - DNA, 22 bp, Artificial Sequence
  chemically synthesized
caccatgttggtcaggatggtc

SEQ ID NO: 1253717 - DNA, 22 bp, Artificial Sequence
  chemically synthesized
gtagcgacggggtttcaccatg

SEQ ID NO: 1253718 - DNA, 22 bp, Artificial Sequence
  chemically synthesized
agtagcgacggggtttcaccat

SEQ ID NO: 1253719 - DNA, 22 bp, Artificial Sequence
  chemically synthesized
tagtagcgacggggtttcacca

SEQ ID NO: 1253720 - DNA, 22 bp, Artificial Sequence
  chemically synthesized
ttagtagcgacggggtttcacc

SEQ ID NO: 1253721 - DNA, 22 bp, Artificial Sequence
  chemically synthesized
accaacatggtgaaaccccgtc

SEQ ID NO: 1253722 - DNA, 22 bp, Artificial Sequence
  chemically synthesized
tatttttagtagcgacggggtt

SEQ ID NO: 1253723 - DNA, 22 bp, Artificial Sequence
  chemically synthesized
gtatttttagtagcgacggggt

SEQ ID NO: 1253724 - DNA, 22 bp, Artificial Sequence
  chemically synthesized
tgtatttttagtagcgacgggg

SEQ ID NO: 1253725 - DNA, 22 bp, Artificial Sequence
  chemically synthesized
ttgtatttttagtagcgacggg

SEQ ID NO: 1253726 - DNA, 22 bp, Artificial Sequence
  chemically synthesized
atttttgtatttttagtagcga

SEQ ID NO: 1253727 - DNA, 22 bp, Artificial Sequence
  chemically synthesized
ctaaaaatacaaaaattagctg

SEQ ID NO: 1253728 - DNA, 22 bp, Artificial Sequence
  chemically synthesized
aaaatacaaaaattagctggtc

SEQ ID NO: 1253729 - DNA, 22 bp, Artificial Sequence
  chemically synthesized
caggcacgtgccaccacgacca

SEQ ID NO: 1253730 - DNA, 22 bp, Artificial Sequence
  chemically synthesized
ggactacaggcacgtgccacca

SEQ ID NO: 1253731 - DNA, 22 bp, Artificial Sequence
  chemically synthesized
gctggtcgtggtggcacgtgcc

SEQ ID NO: 1253732 - DNA, 22 bp, Artificial Sequence
  chemically synthesized
gtcgtggtggcacgtgcctgta

SEQ ID NO: 1253733 - DNA, 22 bp, Artificial Sequence
  chemically synthesized
agtagctgggactacaggcacg

SEQ ID NO: 1253734 - DNA, 22 bp, Artificial Sequence
  chemically synthesized
ctgagtagctgggactacaggc

SEQ ID NO: 1253735 - DNA, 22 bp, Artificial Sequence
  chemically synthesized
agcctcctgagtagctgggact

SEQ ID NO: 1253736 - DNA, 22 bp, Artificial Sequence
  chemically synthesized
cctcagcctcctgagtagctgg

SEQ ID NO: 1253737 - DNA, 22 bp, Artificial Sequence
  chemically synthesized
tgcctcagcctcctgagtagct

SEQ ID NO: 1253738 - DNA, 22 bp, Artificial Sequence
  chemically synthesized
ctgcctcagcctcctgagtagc

SEQ ID NO: 1253739 - DNA, 22 bp, Artificial Sequence
  chemically synthesized
ttctgcctcagcctcctgagta

SEQ ID NO: 1253740 - DNA, 22 bp, Artificial Sequence
  chemically synthesized
tagtcccagctactcaggaggc

SEQ ID NO: 1253741 - DNA, 22 bp, Artificial Sequence
  chemically synthesized
aagtgattcttctgcctcagcc

SEQ ID NO: 1253742 - DNA, 22 bp, Artificial Sequence
  chemically synthesized
ctcaggaggctgaggcagaaga

SEQ ID NO: 1253743 - DNA, 22 bp, Artificial Sequence
  chemically synthesized
aggaggctgaggcagaagaatc

SEQ ID NO: 1253744 - DNA, 22 bp, Artificial Sequence
  chemically synthesized
ccaggttcaagtgattcttctg

SEQ ID NO: 1253745 - DNA, 22 bp, Artificial Sequence
  chemically synthesized
cctcccaggttcaagtgattct

SEQ ID NO: 1253746 - DNA, 22 bp, Artificial Sequence
  chemically synthesized
tgcctcccaggttcaagtgatt

SEQ ID NO: 1253747 - DNA, 22 bp, Artificial Sequence
  chemically synthesized
aggcagaagaatcacttgaacc

SEQ ID NO: 1253748 - DNA, 22 bp, Artificial Sequence
  chemically synthesized
caacctctgcctcccaggttca

SEQ ID NO: 1253749 - DNA, 22 bp, Artificial Sequence
  chemically synthesized
actgcaacctctgcctcccagg

SEQ ID NO: 1253750 - DNA, 22 bp, Artificial Sequence
  chemically synthesized
ggctcactgcaacctctgcctc

SEQ ID NO: 1253751 - DNA, 22 bp, Artificial Sequence
  chemically synthesized
gaacctgggaggcagaggttgc

SEQ ID NO: 1253752 - DNA, 22 bp, Artificial Sequence
  chemically synthesized
aacctgggaggcagaggttgca

SEQ ID NO: 1253753 - DNA, 22 bp, Artificial Sequence
  chemically synthesized
ggaggcagaggttgcagtgagc

SEQ ID NO: 1253754 - DNA, 22 bp, Artificial Sequence
  chemically synthesized
gagtgcagtgacgcgatctcgg

SEQ ID NO: 1253755 - DNA, 22 bp, Artificial Sequence
  chemically synthesized
cagtgagccgagatcgcgtcac

SEQ ID NO: 1253756 - DNA, 22 bp, Artificial Sequence
  chemically synthesized
tccaggctggagtgcagtgacg

SEQ ID NO: 1253757 - DNA, 22 bp, Artificial Sequence
  chemically synthesized
ttgtccaggctggagtgcagtg

SEQ ID NO: 1253758 - DNA, 22 bp, Artificial Sequence
  chemically synthesized
tgttgtccaggctggagtgcag

SEQ ID NO: 1253759 - DNA, 22 bp, Artificial Sequence
  chemically synthesized
ctctgttgtccaggctggagtg

SEQ ID NO: 1253760 - DNA, 22 bp, Artificial Sequence
  chemically synthesized
gctctgttgtccaggctggagt

SEQ ID NO: 1253761 - DNA, 22 bp, Artificial Sequence
  chemically synthesized
cactccagcctggacaacagag

SEQ ID NO: 1253762 - DNA, 22 bp, Artificial Sequence
  chemically synthesized
agacggagtcttgctctgttgt

SEQ ID NO: 1253763 - DNA, 22 bp, Artificial Sequence
  chemically synthesized
gagacggagtcttgctctgttg

SEQ ID NO: 1253764 - DNA, 22 bp, Artificial Sequence
  chemically synthesized
tgagacggagtcttgctctgtt

SEQ ID NO: 1253765 - DNA, 22 bp, Artificial Sequence
  chemically synthesized
ttgagacggagtcttgctctgt

SEQ ID NO: 1253766 - DNA, 22 bp, Artificial Sequence
  chemically synthesized
cagcctggacaacagagcaaga

SEQ ID NO: 1253767 - DNA, 22 bp, Artificial Sequence
  chemically synthesized
tttgagacggagtcttgctctg

SEQ ID NO: 1253768 - DNA, 22 bp, Artificial Sequence
  chemically synthesized
ttttgagacggagtcttgctct

SEQ ID NO: 1253769 - DNA, 22 bp, Artificial Sequence
  chemically synthesized
tttttgagacggagtcttgctc

SEQ ID NO: 1253770 - DNA, 22 bp, Artificial Sequence
  chemically synthesized
ttttttgagacggagtcttgct

SEQ ID NO: 1253771 - DNA, 22 bp, Artificial Sequence
  chemically synthesized
tttttttgagacggagtcttgc

SEQ ID NO: 1253772 - DNA, 22 bp, Artificial Sequence
  chemically synthesized
ttttttttgagacggagtcttg

SEQ ID NO: 1253773 - DNA, 22 bp, Artificial Sequence
  chemically synthesized
tttttttttgagacggagtctt

SEQ ID NO: 1253774 - DNA, 22 bp, Artificial Sequence
  chemically synthesized
gacaacagagcaagactccgtc

SEQ ID NO: 1253775 - DNA, 22 bp, Artificial Sequence
  chemically synthesized
ttttttttttgagacggagtct

SEQ ID NO: 1253776 - DNA, 22 bp, Artificial Sequence
  chemically synthesized
tttttttttttgagacggagtc

SEQ ID NO: 1253777 - DNA, 22 bp, Artificial Sequence
  chemically synthesized
ttttttttttttgagacggagt

SEQ ID NO: 1253778 - DNA, 22 bp, Artificial Sequence
  chemically synthesized
tttttttttttttgagacggag

SEQ ID NO: 1253779 - DNA, 22 bp, Artificial Sequence
  chemically synthesized
ttttttttttttttgagacgga

SEQ ID NO: 1253780 - DNA, 22 bp, Artificial Sequence
  chemically synthesized
ttttttttttttttttgagacg

SEQ ID NO: 1253781 - DNA, 22 bp, Artificial Sequence
  chemically synthesized
cttttttttttttttttgagac

SEQ ID NO: 1253782 - DNA, 22 bp, Artificial Sequence
  chemically synthesized
tcttttttttttttttttgaga

SEQ ID NO: 1253783 - DNA, 22 bp, Artificial Sequence
  chemically synthesized
tttcttttttttttttttttga

SEQ ID NO: 1253784 - DNA, 22 bp, Artificial Sequence
  chemically synthesized
ctttcttttttttttttttttg

SEQ ID NO: 1253785 - DNA, 22 bp, Artificial Sequence
  chemically synthesized
tctttctttttttttttttttt

SEQ ID NO: 1253786 - DNA, 22 bp, Artificial Sequence
  chemically synthesized
ttctttcttttttttttttttt

SEQ ID NO: 1253787 - DNA, 22 bp, Artificial Sequence
  chemically synthesized
tttctttctttttttttttttt

SEQ ID NO: 1253788 - DNA, 22 bp, Artificial Sequence
  chemically synthesized
tttttctttctttttttttttt

SEQ ID NO: 1253789 - DNA, 22 bp, Artificial Sequence
  chemically synthesized
ctttttctttcttttttttttt

SEQ ID NO: 1253790 - DNA, 22 bp, Artificial Sequence
  chemically synthesized
cgtctcaaaaaaaaaaaaaaaa

SEQ ID NO: 1253791 - DNA, 22 bp, Artificial Sequence
  chemically synthesized
tctttttctttctttttttttt

SEQ ID NO: 1253792 - DNA, 22 bp, Artificial Sequence
  chemically synthesized
ttctttttctttcttttttttt

SEQ ID NO: 1253793 - DNA, 22 bp, Artificial Sequence
  chemically synthesized
tttctttttctttctttttttt

SEQ ID NO: 1253794 - DNA, 22 bp, Artificial Sequence
  chemically synthesized
tttttctttttctttctttttt

SEQ ID NO: 1253795 - DNA, 22 bp, Artificial Sequence
  chemically synthesized
ctttttctttttctttcttttt

SEQ ID NO: 1253796 - DNA, 22 bp, Artificial Sequence
  chemically synthesized
aaaaaaaaaaaaaaaagaaaga

SEQ ID NO: 1253797 - DNA, 22 bp, Artificial Sequence
  chemically synthesized
tctttttctttttctttctttt

SEQ ID NO: 1253798 - DNA, 22 bp, Artificial Sequence
  chemically synthesized
tttctttttctttttctttctt

SEQ ID NO: 1253799 - DNA, 22 bp, Artificial Sequence
  chemically synthesized
ctttctttttctttttctttct

SEQ ID NO: 1253800 - DNA, 22 bp, Artificial Sequence
  chemically synthesized
tctttctttttctttttctttc

SEQ ID NO: 1253801 - DNA, 22 bp, Artificial Sequence
  chemically synthesized
tttctttctttttctttttctt

SEQ ID NO: 1253802 - DNA, 22 bp, Artificial Sequence
  chemically synthesized
ctttctttctttttctttttct

SEQ ID NO: 1253803 - DNA, 22 bp, Artificial Sequence
  chemically synthesized
tctttctttctttttctttttc

SEQ ID NO: 1253804 - DNA, 22 bp, Artificial Sequence
  chemically synthesized
ttctttctttctttttcttttt

SEQ ID NO: 1253805 - DNA, 22 bp, Artificial Sequence
  chemically synthesized
tttctttctttctttttctttt

SEQ ID NO: 1253806 - DNA, 22 bp, Artificial Sequence
  chemically synthesized
agtacaaacactttttctttct

SEQ ID NO: 1253807 - DNA, 22 bp, Artificial Sequence
  chemically synthesized
gaattaagtacaaacacttttt

SEQ ID NO: 1253808 - DNA, 22 bp, Artificial Sequence
  chemically synthesized
cattagaattaagtacaaacac

SEQ ID NO: 1253809 - DNA, 22 bp, Artificial Sequence
  chemically synthesized
tgcattagaattaagtacaaac

SEQ ID NO: 1253810 - DNA, 22 bp, Artificial Sequence
  chemically synthesized
gtacttaattctaatgcagaat

SEQ ID NO: 1253811 - DNA, 22 bp, Artificial Sequence
  chemically synthesized
tacttaattctaatgcagaatg

SEQ ID NO: 1253812 - DNA, 22 bp, Artificial Sequence
  chemically synthesized
aattctaatgcagaatgttatg

SEQ ID NO: 1253813 - DNA, 22 bp, Artificial Sequence
  chemically synthesized
attctaatgcagaatgttatgg

SEQ ID NO: 1253814 - DNA, 22 bp, Artificial Sequence
  chemically synthesized
taatgcagaatgttatggattc

SEQ ID NO: 1253815 - DNA, 22 bp, Artificial Sequence
  chemically synthesized
atgcagaatgttatggattctt

SEQ ID NO: 1253816 - DNA, 22 bp, Artificial Sequence
  chemically synthesized
taccagaaccaatataagaatc

SEQ ID NO: 1253817 - DNA, 22 bp, Artificial Sequence
  chemically synthesized
ataccagaaccaatataagaat

SEQ ID NO: 1253818 - DNA, 22 bp, Artificial Sequence
  chemically synthesized
tttataccagaaccaatataag

SEQ ID NO: 1253819 - DNA, 22 bp, Artificial Sequence
  chemically synthesized
atttataccagaaccaatataa

SEQ ID NO: 1253820 - DNA, 22 bp, Artificial Sequence
  chemically synthesized
gcttatttataccagaaccaat

SEQ ID NO: 1253821 - DNA, 22 bp, Artificial Sequence
  chemically synthesized
tggattcttatattggttctgg

SEQ ID NO: 1253822 - DNA, 22 bp, Artificial Sequence
  chemically synthesized
agcttatttataccagaaccaa

SEQ ID NO: 1253823 - DNA, 22 bp, Artificial Sequence
  chemically synthesized
tttagcttatttataccagaac

SEQ ID NO: 1253824 - DNA, 22 bp, Artificial Sequence
  chemically synthesized
atttagcttatttataccagaa

SEQ ID NO: 1253825 - DNA, 22 bp, Artificial Sequence
  chemically synthesized
ttatattggttctggtataaat

SEQ ID NO: 1253826 - DNA, 22 bp, Artificial Sequence
  chemically synthesized
atattggttctggtataaataa

SEQ ID NO: 1253827 - DNA, 22 bp, Artificial Sequence
  chemically synthesized
aatttatttagcttatttatac

SEQ ID NO: 1253828 - DNA, 22 bp, Artificial Sequence
  chemically synthesized
tattggttctggtataaataag

SEQ ID NO: 1253829 - DNA, 22 bp, Artificial Sequence
  chemically synthesized
aaatttatttagcttatttata

SEQ ID NO: 1253830 - DNA, 22 bp, Artificial Sequence
  chemically synthesized
gttctggtataaataagctaaa

SEQ ID NO: 1253831 - DNA, 22 bp, Artificial Sequence
  chemically synthesized
tggtataaataagctaaataaa

SEQ ID NO: 1253832 - DNA, 22 bp, Artificial Sequence
  chemically synthesized
gtataaataagctaaataaatt

SEQ ID NO: 1253833 - DNA, 22 bp, Artificial Sequence
  chemically synthesized
aaaaacatgtttaaatttattt

SEQ ID NO: 1253834 - DNA, 22 bp, Artificial Sequence
  chemically synthesized
aaaaaacatgtttaaatttatt

SEQ ID NO: 1253835 - DNA, 22 bp, Artificial Sequence
  chemically synthesized
aataaatttaaacatgtttttt

SEQ ID NO: 1253836 - DNA, 22 bp, Artificial Sequence
  chemically synthesized
gaccacacagagtttaaaaaac

SEQ ID NO: 1253837 - DNA, 22 bp, Artificial Sequence
  chemically synthesized
ggaccacacagagtttaaaaaa

SEQ ID NO: 1253838 - DNA, 22 bp, Artificial Sequence
  chemically synthesized
aaacatgttttttaaactctgt

SEQ ID NO: 1253839 - DNA, 22 bp, Artificial Sequence
  chemically synthesized
aacatgttttttaaactctgtg

SEQ ID NO: 1253840 - DNA, 22 bp, Artificial Sequence
  chemically synthesized
agaatatatttggaccacacag

SEQ ID NO: 1253841 - DNA, 22 bp, Artificial Sequence
  chemically synthesized
ctgagaatatatttggaccaca

SEQ ID NO: 1253842 - DNA, 22 bp, Artificial Sequence
  chemically synthesized
tttaaactctgtgtggtccaaa

SEQ ID NO: 1253843 - DNA, 22 bp, Artificial Sequence
  chemically synthesized
actgagaatatatttggaccac

SEQ ID NO: 1253844 - DNA, 22 bp, Artificial Sequence
  chemically synthesized
ttaaactctgtgtggtccaaat

SEQ ID NO: 1253845 - DNA, 22 bp, Artificial Sequence
  chemically synthesized
tactgagaatatatttggacca

SEQ ID NO: 1253846 - DNA, 22 bp, Artificial Sequence
  chemically synthesized
taaactctgtgtggtccaaata

SEQ ID NO: 1253847 - DNA, 22 bp, Artificial Sequence
  chemically synthesized
aaactctgtgtggtccaaatat

SEQ ID NO: 1253848 - DNA, 22 bp, Artificial Sequence
  chemically synthesized
aactctgtgtggtccaaatata

SEQ ID NO: 1253849 - DNA, 22 bp, Artificial Sequence
  chemically synthesized
ctttactgagaatatatttgga

SEQ ID NO: 1253850 - DNA, 22 bp, Artificial Sequence
  chemically synthesized
actttactgagaatatatttgg

SEQ ID NO: 1253851 - DNA, 22 bp, Artificial Sequence
  chemically synthesized
ttactttactgagaatatattt

SEQ ID NO: 1253852 - DNA, 22 bp, Artificial Sequence
  chemically synthesized
tgtgtggtccaaatatattctc

SEQ ID NO: 1253853 - DNA, 22 bp, Artificial Sequence
  chemically synthesized
tgtggtccaaatatattctcag

SEQ ID NO: 1253854 - DNA, 22 bp, Artificial Sequence
  chemically synthesized
tcagtaaagtaagagtttgact

SEQ ID NO: 1253855 - DNA, 22 bp, Artificial Sequence
  chemically synthesized
aaacccacaaataagtcaaact

SEQ ID NO: 1253856 - DNA, 22 bp, Artificial Sequence
  chemically synthesized
agtaaagtaagagtttgactta

SEQ ID NO: 1253857 - DNA, 22 bp, Artificial Sequence
  chemically synthesized
caaacccacaaataagtcaaac

SEQ ID NO: 1253858 - DNA, 22 bp, Artificial Sequence
  chemically synthesized
aatttcaaacccacaaataagt

SEQ ID NO: 1253859 - DNA, 22 bp, Artificial Sequence
  chemically synthesized
aactcaatttcaaacccacaaa

SEQ ID NO: 1253860 - DNA, 22 bp, Artificial Sequence
  chemically synthesized
aactgaactcaatttcaaaccc

SEQ ID NO: 1253861 - DNA, 22 bp, Artificial Sequence
  chemically synthesized
gacttatttgtgggtttgaaat

SEQ ID NO: 1253862 - DNA, 22 bp, Artificial Sequence
  chemically synthesized
caactgaactcaatttcaaacc

SEQ ID NO: 1253863 - DNA, 22 bp, Artificial Sequence
  chemically synthesized
acttatttgtgggtttgaaatt

SEQ ID NO: 1253864 - DNA, 22 bp, Artificial Sequence
  chemically synthesized
atttgtgggtttgaaattgagt

SEQ ID NO: 1253865 - DNA, 22 bp, Artificial Sequence
  chemically synthesized
tttgtgggtttgaaattgagtt

SEQ ID NO: 1253866 - DNA, 22 bp, Artificial Sequence
  chemically synthesized
tgagtttcaactgaactcaatt

SEQ ID NO: 1253867 - DNA, 22 bp, Artificial Sequence
  chemically synthesized
gtgggtttgaaattgagttcag

SEQ ID NO: 1253868 - DNA, 22 bp, Artificial Sequence
  chemically synthesized
tgggtttgaaattgagttcagt

SEQ ID NO: 1253869 - DNA, 22 bp, Artificial Sequence
  chemically synthesized
aattgtgagtttcaactgaact

SEQ ID NO: 1253870 - DNA, 22 bp, Artificial Sequence
  chemically synthesized
gaaattgagttcagttgaaact

SEQ ID NO: 1253871 - DNA, 22 bp, Artificial Sequence
  chemically synthesized
aactgaattgtgagtttcaact

SEQ ID NO: 1253872 - DNA, 22 bp, Artificial Sequence
  chemically synthesized
aaattgagttcagttgaaactc

SEQ ID NO: 1253873 - DNA, 22 bp, Artificial Sequence
  chemically synthesized
agttcagttgaaactcacaatt

SEQ ID NO: 1253874 - DNA, 22 bp, Artificial Sequence
  chemically synthesized
cagcagctcaactgaattgtga

SEQ ID NO: 1253875 - DNA, 22 bp, Artificial Sequence
  chemically synthesized
agttgaaactcacaattcagtt

SEQ ID NO: 1253876 - DNA, 22 bp, Artificial Sequence
  chemically synthesized
aaattacagcagctcaactgaa

SEQ ID NO: 1253877 - DNA, 22 bp, Artificial Sequence
  chemically synthesized
aaactcacaattcagttgagct

SEQ ID NO: 1253878 - DNA, 22 bp, Artificial Sequence
  chemically synthesized
acaattcagttgagctgctgta

SEQ ID NO: 1253879 - DNA, 22 bp, Artificial Sequence
  chemically synthesized
agttgagctgctgtaatttcag

SEQ ID NO: 1253880 - DNA, 22 bp, Artificial Sequence
  chemically synthesized
agctgctgtaatttcagtttta

SEQ ID NO: 1253881 - DNA, 22 bp, Artificial Sequence
  chemically synthesized
ctgtaatttcagttttatggtt

SEQ ID NO: 1253882 - DNA, 22 bp, Artificial Sequence
  chemically synthesized
taatttcagttttatggttccg

SEQ ID NO: 1253883 - DNA, 22 bp, Artificial Sequence
  chemically synthesized
cagttttatggttccgtcttcc

SEQ ID NO: 1253884 - DNA, 22 bp, Artificial Sequence
  chemically synthesized
agttttatggttccgtcttcct

SEQ ID NO: 1253885 - DNA, 22 bp, Artificial Sequence
  chemically synthesized
aaaatatatagcataaggaaga

SEQ ID NO: 1253886 - DNA, 22 bp, Artificial Sequence
  chemically synthesized
aaaaatatatagcataaggaag

SEQ ID NO: 1253887 - DNA, 22 bp, Artificial Sequence
  chemically synthesized
tatggttccgtcttccttatgc

SEQ ID NO: 1253888 - DNA, 22 bp, Artificial Sequence
  chemically synthesized
taaaaatatatagcataaggaa

SEQ ID NO: 1253889 - DNA, 22 bp, Artificial Sequence
  chemically synthesized
atggttccgtcttccttatgct

SEQ ID NO: 1253890 - DNA, 22 bp, Artificial Sequence
  chemically synthesized
ttaaaaatatatagcataagga

SEQ ID NO: 1253891 - DNA, 22 bp, Artificial Sequence
  chemically synthesized
tggttccgtcttccttatgcta

SEQ ID NO: 1253892 - DNA, 22 bp, Artificial Sequence
  chemically synthesized
ttttaaaaatatatagcataag

SEQ ID NO: 1253893 - DNA, 22 bp, Artificial Sequence
  chemically synthesized
cgtcttccttatgctatatatt

SEQ ID NO: 1253894 - DNA, 22 bp, Artificial Sequence
  chemically synthesized
ccttatgctatatatttttaaa

SEQ ID NO: 1253895 - DNA, 22 bp, Artificial Sequence
  chemically synthesized
cttatgctatatatttttaaaa

SEQ ID NO: 1253896 - DNA, 22 bp, Artificial Sequence
  chemically synthesized
tcaacaaaacctcttttaaaaa

SEQ ID NO: 1253897 - DNA, 22 bp, Artificial Sequence
  chemically synthesized
atcaacaaaacctcttttaaaa

SEQ ID NO: 1253898 - DNA, 22 bp, Artificial Sequence
  chemically synthesized
atgctatatatttttaaaagag

SEQ ID NO: 1253899 - DNA, 22 bp, Artificial Sequence
  chemically synthesized
tatcaacaaaacctcttttaaa

SEQ ID NO: 1253900 - DNA, 22 bp, Artificial Sequence
  chemically synthesized
tgctatatatttttaaaagagg

SEQ ID NO: 1253901 - DNA, 22 bp, Artificial Sequence
  chemically synthesized
ttatcaacaaaacctcttttaa

SEQ ID NO: 1253902 - DNA, 22 bp, Artificial Sequence
  chemically synthesized
tttatcaacaaaacctctttta

SEQ ID NO: 1253903 - DNA, 22 bp, Artificial Sequence
  chemically synthesized
ttttatcaacaaaacctctttt

SEQ ID NO: 1253904 - DNA, 22 bp, Artificial Sequence
  chemically synthesized
tttttatcaacaaaacctcttt

SEQ ID NO: 1253905 - DNA, 22 bp, Artificial Sequence
  chemically synthesized
ttttttatcaacaaaacctctt

SEQ ID NO: 1253906 - DNA, 22 bp, Artificial Sequence
  chemically synthesized
tatatttttaaaagaggttttg

SEQ ID NO: 1253907 - DNA, 22 bp, Artificial Sequence
  chemically synthesized
ttttttttatcaacaaaacctc

SEQ ID NO: 1253908 - DNA, 22 bp, Artificial Sequence
  chemically synthesized
cttttttttatcaacaaaacct

SEQ ID NO: 1253909 - DNA, 22 bp, Artificial Sequence
  chemically synthesized
tcttttttttatcaacaaaacc

SEQ ID NO: 1253910 - DNA, 22 bp, Artificial Sequence
  chemically synthesized
ttaaaagaggttttgttgataa

SEQ ID NO: 1253911 - DNA, 22 bp, Artificial Sequence
  chemically synthesized
taaaagaggttttgttgataaa

SEQ ID NO: 1253912 - DNA, 22 bp, Artificial Sequence
  chemically synthesized
aaaagaggttttgttgataaaa

SEQ ID NO: 1253913 - DNA, 22 bp, Artificial Sequence
  chemically synthesized
aaagaggttttgttgataaaaa

SEQ ID NO: 1253914 - DNA, 22 bp, Artificial Sequence
  chemically synthesized
acaaactttcttttttttatca

SEQ ID NO: 1253915 - DNA, 22 bp, Artificial Sequence
  chemically synthesized
tgttgataaaaaaaagaaagtt

SEQ ID NO: 1253916 - DNA, 22 bp, Artificial Sequence
  chemically synthesized
gttgataaaaaaaagaaagttt

SEQ ID NO: 1253917 - DNA, 22 bp, Artificial Sequence
  chemically synthesized
ttgataaaaaaaagaaagtttg

SEQ ID NO: 1253918 - DNA, 22 bp, Artificial Sequence
  chemically synthesized
ataaaaaaaagaaagtttgtga

SEQ ID NO: 1253919 - DNA, 22 bp, Artificial Sequence
  chemically synthesized
gtgaaccactgggctttctgat

SEQ ID NO: 1253920 - DNA, 22 bp, Artificial Sequence
  chemically synthesized
tgaaccactgggctttctgatc

SEQ ID NO: 1253921 - DNA, 22 bp, Artificial Sequence
  chemically synthesized
taggagatcatagagatcagaa

SEQ ID NO: 1253922 - DNA, 22 bp, Artificial Sequence
  chemically synthesized
gtaggagatcatagagatcaga

SEQ ID NO: 1253923 - DNA, 22 bp, Artificial Sequence
  chemically synthesized
aatttgtaggagatcatagaga

SEQ ID NO: 1253924 - DNA, 22 bp, Artificial Sequence
  chemically synthesized
aaatttgtaggagatcatagag

SEQ ID NO: 1253925 - DNA, 22 bp, Artificial Sequence
  chemically synthesized
ggctttctgatctctatgatct

SEQ ID NO: 1253926 - DNA, 22 bp, Artificial Sequence
  chemically synthesized
tctgatctctatgatctcctac

SEQ ID NO: 1253927 - DNA, 22 bp, Artificial Sequence
  chemically synthesized
ctgatctctatgatctcctaca

SEQ ID NO: 1253928 - DNA, 22 bp, Artificial Sequence
  chemically synthesized
tgatctctatgatctcctacaa

SEQ ID NO: 1253929 - DNA, 22 bp, Artificial Sequence
  chemically synthesized
atctctatgatctcctacaaat

SEQ ID NO: 1253930 - DNA, 22 bp, Artificial Sequence
  chemically synthesized
aatcacataagtttaaatttgt

SEQ ID NO: 1253931 - DNA, 22 bp, Artificial Sequence
  chemically synthesized
tatgatctcctacaaatttaaa

SEQ ID NO: 1253932 - DNA, 22 bp, Artificial Sequence
  chemically synthesized
tgatctcctacaaatttaaact

SEQ ID NO: 1253933 - DNA, 22 bp, Artificial Sequence
  chemically synthesized
gtgttaaatcacataagtttaa

SEQ ID NO: 1253934 - DNA, 22 bp, Artificial Sequence
  chemically synthesized
ctacaaatttaaacttatgtga

SEQ ID NO: 1253935 - DNA, 22 bp, Artificial Sequence
  chemically synthesized
attagtgttaaatcacataagt

SEQ ID NO: 1253936 - DNA, 22 bp, Artificial Sequence
  chemically synthesized
gattagtgttaaatcacataag

SEQ ID NO: 1253937 - DNA, 22 bp, Artificial Sequence
  chemically synthesized
tgattagtgttaaatcacataa

SEQ ID NO: 1253938 - DNA, 22 bp, Artificial Sequence
  chemically synthesized
caaatttaaacttatgtgattt

SEQ ID NO: 1253939 - DNA, 22 bp, Artificial Sequence
  chemically synthesized
ttgattagtgttaaatcacata

SEQ ID NO: 1253940 - DNA, 22 bp, Artificial Sequence
  chemically synthesized
cttttgattagtgttaaatcac

SEQ ID NO: 1253941 - DNA, 22 bp, Artificial Sequence
  chemically synthesized
gcttttgattagtgttaaatca

SEQ ID NO: 1253942 - DNA, 22 bp, Artificial Sequence
  chemically synthesized
aaacttatgtgatttaacacta

SEQ ID NO: 1253943 - DNA, 22 bp, Artificial Sequence
  chemically synthesized
aacttatgtgatttaacactaa

SEQ ID NO: 1253944 - DNA, 22 bp, Artificial Sequence
  chemically synthesized
atgtgatttaacactaatcaaa

SEQ ID NO: 1253945 - DNA, 22 bp, Artificial Sequence
  chemically synthesized
tgtgatttaacactaatcaaaa

SEQ ID NO: 1253946 - DNA, 22 bp, Artificial Sequence
  chemically synthesized
aataggaataccgatttgcttt

SEQ ID NO: 1253947 - DNA, 22 bp, Artificial Sequence
  chemically synthesized
aacactaatcaaaagcaaatcg

SEQ ID NO: 1253948 - DNA, 22 bp, Artificial Sequence
  chemically synthesized
acactaatcaaaagcaaatcgg

SEQ ID NO: 1253949 - DNA, 22 bp, Artificial Sequence
  chemically synthesized
atcaaaagcaaatcggtattcc

SEQ ID NO: 1253950 - DNA, 22 bp, Artificial Sequence
  chemically synthesized
tatataaaaagttaaataggaa

SEQ ID NO: 1253951 - DNA, 22 bp, Artificial Sequence
  chemically synthesized
gtatataaaaagttaaatagga

SEQ ID NO: 1253952 - DNA, 22 bp, Artificial Sequence
  chemically synthesized
tgtatataaaaagttaaatagg

SEQ ID NO: 1253953 - DNA, 22 bp, Artificial Sequence
  chemically synthesized
ctatttaactttttatatacaa

SEQ ID NO: 1253954 - DNA, 22 bp, Artificial Sequence
  chemically synthesized
aggaaataagacctttgtatat

SEQ ID NO: 1253955 - DNA, 22 bp, Artificial Sequence
  chemically synthesized
tttaactttttatatacaaagg

SEQ ID NO: 1253956 - DNA, 22 bp, Artificial Sequence
  chemically synthesized
aaggaaataagacctttgtata

SEQ ID NO: 1253957 - DNA, 22 bp, Artificial Sequence
  chemically synthesized
taaggaaataagacctttgtat

SEQ ID NO: 1253958 - DNA, 22 bp, Artificial Sequence
  chemically synthesized
aactttttatatacaaaggtct

SEQ ID NO: 1253959 - DNA, 22 bp, Artificial Sequence
  chemically synthesized
actttttatatacaaaggtctt

SEQ ID NO: 1253960 - DNA, 22 bp, Artificial Sequence
  chemically synthesized
tttatatacaaaggtcttattt

SEQ ID NO: 1253961 - DNA, 22 bp, Artificial Sequence
  chemically synthesized
ttatatacaaaggtcttatttc

SEQ ID NO: 1253962 - DNA, 22 bp, Artificial Sequence
  chemically synthesized
gggaattttaaggaaataagac

SEQ ID NO: 1253963 - DNA, 22 bp, Artificial Sequence
  chemically synthesized
tatatacaaaggtcttatttcc

SEQ ID NO: 1253964 - DNA, 22 bp, Artificial Sequence
  chemically synthesized
agggaattttaaggaaataaga

SEQ ID NO: 1253965 - DNA, 22 bp, Artificial Sequence
  chemically synthesized
atatacaaaggtcttatttcct

SEQ ID NO: 1253966 - DNA, 22 bp, Artificial Sequence
  chemically synthesized
tatacaaaggtcttatttcctt

SEQ ID NO: 1253967 - DNA, 22 bp, Artificial Sequence
  chemically synthesized
caacttagggaattttaaggaa

SEQ ID NO: 1253968 - DNA, 22 bp, Artificial Sequence
  chemically synthesized
ttccaacttagggaattttaag

SEQ ID NO: 1253969 - DNA, 22 bp, Artificial Sequence
  chemically synthesized
atttccttaaaattccctaagt

SEQ ID NO: 1253970 - DNA, 22 bp, Artificial Sequence
  chemically synthesized
tttccttaaaattccctaagtt

SEQ ID NO: 1253971 - DNA, 22 bp, Artificial Sequence
  chemically synthesized
agatattattccaacttaggga

SEQ ID NO: 1253972 - DNA, 22 bp, Artificial Sequence
  chemically synthesized
aagatattattccaacttaggg

SEQ ID NO: 1253973 - DNA, 22 bp, Artificial Sequence
  chemically synthesized
taagatattattccaacttagg

SEQ ID NO: 1253974 - DNA, 22 bp, Artificial Sequence
  chemically synthesized
ccttaaaattccctaagttgga

SEQ ID NO: 1253975 - DNA, 22 bp, Artificial Sequence
  chemically synthesized
ttaagatattattccaacttag

SEQ ID NO: 1253976 - DNA, 22 bp, Artificial Sequence
  chemically synthesized
cttaaaattccctaagttggaa

SEQ ID NO: 1253977 - DNA, 22 bp, Artificial Sequence
  chemically synthesized
aaaattccctaagttggaataa

SEQ ID NO: 1253978 - DNA, 22 bp, Artificial Sequence
  chemically synthesized
aaattccctaagttggaataat

SEQ ID NO: 1253979 - DNA, 22 bp, Artificial Sequence
  chemically synthesized
cctaagttggaataatatctta

SEQ ID NO: 1253980 - DNA, 22 bp, Artificial Sequence
  chemically synthesized
tggaagaacagcttttaagata

SEQ ID NO: 1253981 - DNA, 22 bp, Artificial Sequence
  chemically synthesized
agttggaataatatcttaaaag

SEQ ID NO: 1253982 - DNA, 22 bp, Artificial Sequence
  chemically synthesized
gaataatatcttaaaagctgtt

SEQ ID NO: 1253983 - DNA, 22 bp, Artificial Sequence
  chemically synthesized
acactatggaagaacagctttt

SEQ ID NO: 1253984 - DNA, 22 bp, Artificial Sequence
  chemically synthesized
attgacactatggaagaacagc

SEQ ID NO: 1253985 - DNA, 22 bp, Artificial Sequence
  chemically synthesized
aattgacactatggaagaacag

SEQ ID NO: 1253986 - DNA, 22 bp, Artificial Sequence
  chemically synthesized
aaaagctgttcttccatagtgt

SEQ ID NO: 1253987 - DNA, 22 bp, Artificial Sequence
  chemically synthesized
tgcacttaattgacactatgga

SEQ ID NO: 1253988 - DNA, 22 bp, Artificial Sequence
  chemically synthesized
aaagctgttcttccatagtgtc

SEQ ID NO: 1253989 - DNA, 22 bp, Artificial Sequence
  chemically synthesized
ttatgcacttaattgacactat

SEQ ID NO: 1253990 - DNA, 22 bp, Artificial Sequence
  chemically synthesized
attatgcacttaattgacacta

SEQ ID NO: 1253991 - DNA, 22 bp, Artificial Sequence
  chemically synthesized
ttcttccatagtgtcaattaag

SEQ ID NO: 1253992 - DNA, 22 bp, Artificial Sequence
  chemically synthesized
gtttattatgcacttaattgac

SEQ ID NO: 1253993 - DNA, 22 bp, Artificial Sequence
  chemically synthesized
agtttattatgcacttaattga

SEQ ID NO: 1253994 - DNA, 22 bp, Artificial Sequence
  chemically synthesized
tagtttattatgcacttaattg

SEQ ID NO: 1253995 - DNA, 22 bp, Artificial Sequence
  chemically synthesized
ttccatagtgtcaattaagtgc

SEQ ID NO: 1253996 - DNA, 22 bp, Artificial Sequence
  chemically synthesized
ttagtttattatgcacttaatt

SEQ ID NO: 1253997 - DNA, 22 bp, Artificial Sequence
  chemically synthesized
ccatagtgtcaattaagtgcat

SEQ ID NO: 1253998 - DNA, 22 bp, Artificial Sequence
  chemically synthesized
catagtgtcaattaagtgcata

SEQ ID NO: 1253999 - DNA, 22 bp, Artificial Sequence
  chemically synthesized
agcaaatatttttagtttatta

SEQ ID NO: 1254000 - DNA, 22 bp, Artificial Sequence
  chemically synthesized
cagcaaatatttttagtttatt

SEQ ID NO: 1254001 - DNA, 22 bp, Artificial Sequence
  chemically synthesized
tcagcaaatatttttagtttat

SEQ ID NO: 1254002 - DNA, 22 bp, Artificial Sequence
  chemically synthesized
agtgcataataaactaaaaata

SEQ ID NO: 1254003 - DNA, 22 bp, Artificial Sequence
  chemically synthesized
ccagatgtgtatgtattttcag

SEQ ID NO: 1254004 - DNA, 22 bp, Artificial Sequence
  chemically synthesized
accagatgtgtatgtattttca

SEQ ID NO: 1254005 - DNA, 22 bp, Artificial Sequence
  chemically synthesized
aaaatatttgctgaaaatacat

SEQ ID NO: 1254006 - DNA, 22 bp, Artificial Sequence
  chemically synthesized
taccagatgtgtatgtattttc

SEQ ID NO: 1254007 - DNA, 22 bp, Artificial Sequence
  chemically synthesized
gctgaaaatacatacacatctg

SEQ ID NO: 1254008 - DNA, 22 bp, Artificial Sequence
  chemically synthesized
ctgaaaatacatacacatctgg

SEQ ID NO: 1254009 - DNA, 22 bp, Artificial Sequence
  chemically synthesized
aaaatacatacacatctggtaa

SEQ ID NO: 1254010 - DNA, 22 bp, Artificial Sequence
  chemically synthesized
ataccaacacaattttaccaga

SEQ ID NO: 1254011 - DNA, 22 bp, Artificial Sequence
  chemically synthesized
ttcataccaacacaattttacc

SEQ ID NO: 1254012 - DNA, 22 bp, Artificial Sequence
  chemically synthesized
ctattcataccaacacaatttt

SEQ ID NO: 1254013 - DNA, 22 bp, Artificial Sequence
  chemically synthesized
ttcctattcataccaacacaat

SEQ ID NO: 1254014 - DNA, 22 bp, Artificial Sequence
  chemically synthesized
ttattcctattcataccaacac

SEQ ID NO: 1254015 - DNA, 22 bp, Artificial Sequence
  chemically synthesized
attattcctattcataccaaca

SEQ ID NO: 1254016 - DNA, 22 bp, Artificial Sequence
  chemically synthesized
gtaaaattgtgttggtatgaat

SEQ ID NO: 1254017 - DNA, 22 bp, Artificial Sequence
  chemically synthesized
tatttattattcctattcatac

SEQ ID NO: 1254018 - DNA, 22 bp, Artificial Sequence
  chemically synthesized
gtatttattattcctattcata

SEQ ID NO: 1254019 - DNA, 22 bp, Artificial Sequence
  chemically synthesized
tgtatttattattcctattcat

SEQ ID NO: 1254020 - DNA, 22 bp, Artificial Sequence
  chemically synthesized
ttgtatttattattcctattca

SEQ ID NO: 1254021 - DNA, 22 bp, Artificial Sequence
  chemically synthesized
tgttggtatgaataggaataat

SEQ ID NO: 1254022 - DNA, 22 bp, Artificial Sequence
  chemically synthesized
atttttgtatttattattccta

SEQ ID NO: 1254023 - DNA, 22 bp, Artificial Sequence
  chemically synthesized
catttttgtatttattattcct

SEQ ID NO: 1254024 - DNA, 22 bp, Artificial Sequence
  chemically synthesized
tcatttttgtatttattattcc

SEQ ID NO: 1254025 - DNA, 22 bp, Artificial Sequence
  chemically synthesized
gtatgaataggaataataaata

SEQ ID NO: 1254026 - DNA, 22 bp, Artificial Sequence
  chemically synthesized
ccaattttcatttttgtattta

SEQ ID NO: 1254027 - DNA, 22 bp, Artificial Sequence
  chemically synthesized
cccaattttcatttttgtattt

SEQ ID NO: 1254028 - DNA, 22 bp, Artificial Sequence
  chemically synthesized
ttcccaattttcatttttgtat

SEQ ID NO: 1254029 - DNA, 22 bp, Artificial Sequence
  chemically synthesized
tcttcccaattttcatttttgt

SEQ ID NO: 1254030 - DNA, 22 bp, Artificial Sequence
  chemically synthesized
tctcttcccaattttcattttt

SEQ ID NO: 1254031 - DNA, 22 bp, Artificial Sequence
  chemically synthesized
ttctctcttcccaattttcatt

SEQ ID NO: 1254032 - DNA, 22 bp, Artificial Sequence
  chemically synthesized
ccaaatgcaccactattctctc

SEQ ID NO: 1254033 - DNA, 22 bp, Artificial Sequence
  chemically synthesized
cccaaatgcaccactattctct

SEQ ID NO: 1254034 - DNA, 22 bp, Artificial Sequence
  chemically synthesized
ggaagagagaatagtggtgcat

SEQ ID NO: 1254035 - DNA, 22 bp, Artificial Sequence
  chemically synthesized
cacatgccacccttcccaaatg

SEQ ID NO: 1254036 - DNA, 22 bp, Artificial Sequence
  chemically synthesized
ctccacatgccacccttcccaa

SEQ ID NO: 1254037 - DNA, 22 bp, Artificial Sequence
  chemically synthesized
gaagccctcctccacatgccac

SEQ ID NO: 1254038 - DNA, 22 bp, Artificial Sequence
  chemically synthesized
tagaagccctcctccacatgcc

SEQ ID NO: 1254039 - DNA, 22 bp, Artificial Sequence
  chemically synthesized
gggaagggtggcatgtggagga

SEQ ID NO: 1254040 - DNA, 22 bp, Artificial Sequence
  chemically synthesized
ggaagggtggcatgtggaggag

SEQ ID NO: 1254041 - DNA, 22 bp, Artificial Sequence
  chemically synthesized
atactctagaagccctcctcca

SEQ ID NO: 1254042 - DNA, 22 bp, Artificial Sequence
  chemically synthesized
gaatatgactaatactctagaa

SEQ ID NO: 1254043 - DNA, 22 bp, Artificial Sequence
  chemically synthesized
actagaatatgactaatactct

SEQ ID NO: 1254044 - DNA, 22 bp, Artificial Sequence
  chemically synthesized
ctagagtattagtcatattcta

SEQ ID NO: 1254045 - DNA, 22 bp, Artificial Sequence
  chemically synthesized
tagagtattagtcatattctag

SEQ ID NO: 1254046 - DNA, 22 bp, Artificial Sequence
  chemically synthesized
aagaaaaattgactagaatatg

SEQ ID NO: 1254047 - DNA, 22 bp, Artificial Sequence
  chemically synthesized
aaagaaaaattgactagaatat

SEQ ID NO: 1254048 - DNA, 22 bp, Artificial Sequence
  chemically synthesized
gagtattagtcatattctagtc

SEQ ID NO: 1254049 - DNA, 22 bp, Artificial Sequence
  chemically synthesized
ttaaagaaaaattgactagaat

SEQ ID NO: 1254050 - DNA, 22 bp, Artificial Sequence
  chemically synthesized
tcttaaagaaaaattgactaga

SEQ ID NO: 1254051 - DNA, 22 bp, Artificial Sequence
  chemically synthesized
ctcttaaagaaaaattgactag

SEQ ID NO: 1254052 - DNA, 22 bp, Artificial Sequence
  chemically synthesized
gtcatattctagtcaatttttc

SEQ ID NO: 1254053 - DNA, 22 bp, Artificial Sequence
  chemically synthesized
tagtcaatttttctttaagaga

SEQ ID NO: 1254054 - DNA, 22 bp, Artificial Sequence
  chemically synthesized
gtcaatttttctttaagagaag

SEQ ID NO: 1254055 - DNA, 22 bp, Artificial Sequence
  chemically synthesized
ggaaacagagtgagggcccttc

SEQ ID NO: 1254056 - DNA, 22 bp, Artificial Sequence
  chemically synthesized
ttctttaagagaagggccctca

SEQ ID NO: 1254057 - DNA, 22 bp, Artificial Sequence
  chemically synthesized
tctttaagagaagggccctcac

SEQ ID NO: 1254058 - DNA, 22 bp, Artificial Sequence
  chemically synthesized
ctttaagagaagggccctcact

SEQ ID NO: 1254059 - DNA, 22 bp, Artificial Sequence
  chemically synthesized
tttaagagaagggccctcactc

SEQ ID NO: 1254060 - DNA, 22 bp, Artificial Sequence
  chemically synthesized
agcctgggaaacagagtgaggg

SEQ ID NO: 1254061 - DNA, 22 bp, Artificial Sequence
  chemically synthesized
taagagaagggccctcactctg

SEQ ID NO: 1254062 - DNA, 22 bp, Artificial Sequence
  chemically synthesized
cagcctgggaaacagagtgagg

SEQ ID NO: 1254063 - DNA, 22 bp, Artificial Sequence
  chemically synthesized
aagagaagggccctcactctgt

SEQ ID NO: 1254064 - DNA, 22 bp, Artificial Sequence
  chemically synthesized
agagaagggccctcactctgtt

SEQ ID NO: 1254065 - DNA, 22 bp, Artificial Sequence
  chemically synthesized
aacttcagcctgggaaacagag

SEQ ID NO: 1254066 - DNA, 22 bp, Artificial Sequence
  chemically synthesized
actctgtttcccaggctgaagt

SEQ ID NO: 1254067 - DNA, 22 bp, Artificial Sequence
  chemically synthesized
tgatagtgccactaaacttcag

SEQ ID NO: 1254068 - DNA, 22 bp, Artificial Sequence
  chemically synthesized
tgtttcccaggctgaagtttag

SEQ ID NO: 1254069 - DNA, 22 bp, Artificial Sequence
  chemically synthesized
tttcccaggctgaagtttagtg

SEQ ID NO: 1254070 - DNA, 22 bp, Artificial Sequence
  chemically synthesized
cccaggctgaagtttagtggca

SEQ ID NO: 1254071 - DNA, 22 bp, Artificial Sequence
  chemically synthesized
ccaggctgaagtttagtggcac

SEQ ID NO: 1254072 - DNA, 22 bp, Artificial Sequence
  chemically synthesized
agagctatgatagtgccactaa

SEQ ID NO: 1254073 - DNA, 22 bp, Artificial Sequence
  chemically synthesized
gactgagagctatgatagtgcc

SEQ ID NO: 1254074 - DNA, 22 bp, Artificial Sequence
  chemically synthesized
aagtttagtggcactatcatag

SEQ ID NO: 1254075 - DNA, 22 bp, Artificial Sequence
  chemically synthesized
aaggttagactgagagctatga

SEQ ID NO: 1254076 - DNA, 22 bp, Artificial Sequence
  chemically synthesized
agtggcactatcatagctctca

SEQ ID NO: 1254077 - DNA, 22 bp, Artificial Sequence
  chemically synthesized
gtggcactatcatagctctcag

SEQ ID NO: 1254078 - DNA, 22 bp, Artificial Sequence
  chemically synthesized
tcatagctctcagtctaacctt

SEQ ID NO: 1254079 - DNA, 22 bp, Artificial Sequence
  chemically synthesized
agcccagaaattcaaggttaga

SEQ ID NO: 1254080 - DNA, 22 bp, Artificial Sequence
  chemically synthesized
gagcccagaaattcaaggttag

SEQ ID NO: 1254081 - DNA, 22 bp, Artificial Sequence
  chemically synthesized
tcagtctaaccttgaatttctg

SEQ ID NO: 1254082 - DNA, 22 bp, Artificial Sequence
  chemically synthesized
aatggcttgagcccagaaattc

SEQ ID NO: 1254083 - DNA, 22 bp, Artificial Sequence
  chemically synthesized
agtctaaccttgaatttctggg

SEQ ID NO: 1254084 - DNA, 22 bp, Artificial Sequence
  chemically synthesized
accttgaatttctgggctcaag

SEQ ID NO: 1254085 - DNA, 22 bp, Artificial Sequence
  chemically synthesized
aggcagttgaatggcttgagcc

SEQ ID NO: 1254086 - DNA, 22 bp, Artificial Sequence
  chemically synthesized
gaatttctgggctcaagccatt

SEQ ID NO: 1254087 - DNA, 22 bp, Artificial Sequence
  chemically synthesized
aatttctgggctcaagccattc

SEQ ID NO: 1254088 - DNA, 22 bp, Artificial Sequence
  chemically synthesized
ctgggctcaagccattcaactg

SEQ ID NO: 1254089 - DNA, 22 bp, Artificial Sequence
  chemically synthesized
aggaggctgaggcagttgaatg

SEQ ID NO: 1254090 - DNA, 22 bp, Artificial Sequence
  chemically synthesized
tgggctcaagccattcaactgc

SEQ ID NO: 1254091 - DNA, 22 bp, Artificial Sequence
  chemically synthesized
ggctcaagccattcaactgcct

SEQ ID NO: 1254092 - DNA, 22 bp, Artificial Sequence
  chemically synthesized
ctcaggaggctgaggcagttga

SEQ ID NO: 1254093 - DNA, 22 bp, Artificial Sequence
  chemically synthesized
gctactcaggaggctgaggcag

SEQ ID NO: 1254094 - DNA, 22 bp, Artificial Sequence
  chemically synthesized
aagccattcaactgcctcagcc

SEQ ID NO: 1254095 - DNA, 22 bp, Artificial Sequence
  chemically synthesized
tagtcctagctactcaggaggc

SEQ ID NO: 1254096 - DNA, 22 bp, Artificial Sequence
  chemically synthesized
aactgcctcagcctcctgagta

SEQ ID NO: 1254097 - DNA, 22 bp, Artificial Sequence
  chemically synthesized
cctcagcctcctgagtagctag

SEQ ID NO: 1254098 - DNA, 22 bp, Artificial Sequence
  chemically synthesized
agcctcctgagtagctaggact

SEQ ID NO: 1254099 - DNA, 22 bp, Artificial Sequence
  chemically synthesized
ctgagtagctaggactataggt

SEQ ID NO: 1254100 - DNA, 22 bp, Artificial Sequence
  chemically synthesized
agtagctaggactataggtgca

SEQ ID NO: 1254101 - DNA, 22 bp, Artificial Sequence
  chemically synthesized
ggcatagtggcatgcacctata

SEQ ID NO: 1254102 - DNA, 22 bp, Artificial Sequence
  chemically synthesized
tctgggcatagtggcatgcacc

SEQ ID NO: 1254103 - DNA, 22 bp, Artificial Sequence
  chemically synthesized
ggactataggtgcatgccacta

SEQ ID NO: 1254104 - DNA, 22 bp, Artificial Sequence
  chemically synthesized
aaaaattatctgggcatagtgg

SEQ ID NO: 1254105 - DNA, 22 bp, Artificial Sequence
  chemically synthesized
taggtgcatgccactatgccca

SEQ ID NO: 1254106 - DNA, 22 bp, Artificial Sequence
  chemically synthesized
tgaaaaaattaaaaaattatct

SEQ ID NO: 1254107 - DNA, 22 bp, Artificial Sequence
  chemically synthesized
agtctatgaaaaaattaaaaaa

SEQ ID NO: 1254108 - DNA, 22 bp, Artificial Sequence
  chemically synthesized
tgcccagataattttttaattt

SEQ ID NO: 1254109 - DNA, 22 bp, Artificial Sequence
  chemically synthesized
tttaattttttcatagacttaa

SEQ ID NO: 1254110 - DNA, 22 bp, Artificial Sequence
  chemically synthesized
ttaattttttcatagacttaat

SEQ ID NO: 1254111 - DNA, 22 bp, Artificial Sequence
  chemically synthesized
taattttttcatagacttaatg

SEQ ID NO: 1254112 - DNA, 22 bp, Artificial Sequence
  chemically synthesized
aattttttcatagacttaatgt

SEQ ID NO: 1254113 - DNA, 22 bp, Artificial Sequence
  chemically synthesized
attttttcatagacttaatgtc

SEQ ID NO: 1254114 - DNA, 22 bp, Artificial Sequence
  chemically synthesized
accaacatatcaagacattaag

SEQ ID NO: 1254115 - DNA, 22 bp, Artificial Sequence
  chemically synthesized
tttcatagacttaatgtcttga

SEQ ID NO: 1254116 - DNA, 22 bp, Artificial Sequence
  chemically synthesized
ttcatagacttaatgtcttgat

SEQ ID NO: 1254117 - DNA, 22 bp, Artificial Sequence
  chemically synthesized
tcatagacttaatgtcttgata

SEQ ID NO: 1254118 - DNA, 22 bp, Artificial Sequence
  chemically synthesized
catagacttaatgtcttgatat

SEQ ID NO: 1254119 - DNA, 22 bp, Artificial Sequence
  chemically synthesized
atagacttaatgtcttgatatg

SEQ ID NO: 1254120 - DNA, 22 bp, Artificial Sequence
  chemically synthesized
agtccagcctaaccaacatatc

SEQ ID NO: 1254121 - DNA, 22 bp, Artificial Sequence
  chemically synthesized
gagtccagcctaaccaacatat

SEQ ID NO: 1254122 - DNA, 22 bp, Artificial Sequence
  chemically synthesized
aatgtcttgatatgttggttag

SEQ ID NO: 1254123 - DNA, 22 bp, Artificial Sequence
  chemically synthesized
atgtcttgatatgttggttagg

SEQ ID NO: 1254124 - DNA, 22 bp, Artificial Sequence
  chemically synthesized
gatatgttggttaggctggact

SEQ ID NO: 1254125 - DNA, 22 bp, Artificial Sequence
  chemically synthesized
atatgttggttaggctggactc

SEQ ID NO: 1254126 - DNA, 22 bp, Artificial Sequence
  chemically synthesized
tgtccaggagtttgagtccagc

SEQ ID NO: 1254127 - DNA, 22 bp, Artificial Sequence
  chemically synthesized
gtgtccaggagtttgagtccag

SEQ ID NO: 1254128 - DNA, 22 bp, Artificial Sequence
  chemically synthesized
cttgtgtccaggagtttgagtc

SEQ ID NO: 1254129 - DNA, 22 bp, Artificial Sequence
  chemically synthesized
gttaggctggactcaaactcct

SEQ ID NO: 1254130 - DNA, 22 bp, Artificial Sequence
  chemically synthesized
ggctggactcaaactcctggac

SEQ ID NO: 1254131 - DNA, 22 bp, Artificial Sequence
  chemically synthesized
gactcaaactcctggacacaag

SEQ ID NO: 1254132 - DNA, 22 bp, Artificial Sequence
  chemically synthesized
aggtggtaggattgcttgtgtc

SEQ ID NO: 1254133 - DNA, 22 bp, Artificial Sequence
  chemically synthesized
aaactcctggacacaagcaatc

SEQ ID NO: 1254134 - DNA, 22 bp, Artificial Sequence
  chemically synthesized
ggaggctgaggtggtaggattg

SEQ ID NO: 1254135 - DNA, 22 bp, Artificial Sequence
  chemically synthesized
ctggacacaagcaatcctacca

SEQ ID NO: 1254136 - DNA, 22 bp, Artificial Sequence
  chemically synthesized
gggaggctgaggtggtaggatt

SEQ ID NO: 1254137 - DNA, 22 bp, Artificial Sequence
  chemically synthesized
tgggaggctgaggtggtaggat

SEQ ID NO: 1254138 - DNA, 22 bp, Artificial Sequence
  chemically synthesized
gacacaagcaatcctaccacct

SEQ ID NO: 1254139 - DNA, 22 bp, Artificial Sequence
  chemically synthesized
taatcccagagttttgggaggc

SEQ ID NO: 1254140 - DNA, 22 bp, Artificial Sequence
  chemically synthesized
gtaatcccagagttttgggagg

SEQ ID NO: 1254141 - DNA, 22 bp, Artificial Sequence
  chemically synthesized
ccacctcagcctcccaaaactc

SEQ ID NO: 1254142 - DNA, 22 bp, Artificial Sequence
  chemically synthesized
tgcttgtaatcccagagttttg

SEQ ID NO: 1254143 - DNA, 22 bp, Artificial Sequence
  chemically synthesized
gtgcttgtaatcccagagtttt

SEQ ID NO: 1254144 - DNA, 22 bp, Artificial Sequence
  chemically synthesized
agcctcccaaaactctgggatt

SEQ ID NO: 1254145 - DNA, 22 bp, Artificial Sequence
  chemically synthesized
ccaaaactctgggattacaagc

SEQ ID NO: 1254146 - DNA, 22 bp, Artificial Sequence
  chemically synthesized
ggtgtggtggcttgtgcttgta

SEQ ID NO: 1254147 - DNA, 22 bp, Artificial Sequence
  chemically synthesized
tgggattacaagcacaagccac

SEQ ID NO: 1254148 - DNA, 22 bp, Artificial Sequence
  chemically synthesized
ggattacaagcacaagccacca

SEQ ID NO: 1254149 - DNA, 22 bp, Artificial Sequence
  chemically synthesized
caagcacaagccaccacaccca

SEQ ID NO: 1254150 - DNA, 22 bp, Artificial Sequence
  chemically synthesized
agaaatagggggctgggtgtgg

SEQ ID NO: 1254151 - DNA, 22 bp, Artificial Sequence
  chemically synthesized
aagaaatagggggctgggtgtg

SEQ ID NO: 1254152 - DNA, 22 bp, Artificial Sequence
  chemically synthesized
acttaagaaatagggggctggg

SEQ ID NO: 1254153 - DNA, 22 bp, Artificial Sequence
  chemically synthesized
cacttaagaaatagggggctgg

SEQ ID NO: 1254154 - DNA, 22 bp, Artificial Sequence
  chemically synthesized
ataatcacttcacttaagaaat

SEQ ID NO: 1254155 - DNA, 22 bp, Artificial Sequence
  chemically synthesized
ctcataatcacttcacttaaga

SEQ ID NO: 1254156 - DNA, 22 bp, Artificial Sequence
  chemically synthesized
ttcctcataatcacttcactta

SEQ ID NO: 1254157 - DNA, 22 bp, Artificial Sequence
  chemically synthesized
agctattcctcataatcacttc

SEQ ID NO: 1254158 - DNA, 22 bp, Artificial Sequence
  chemically synthesized
tttcttaagtgaagtgattatg

SEQ ID NO: 1254159 - DNA, 22 bp, Artificial Sequence
  chemically synthesized
cttaagtgaagtgattatgagg

SEQ ID NO: 1254160 - DNA, 22 bp, Artificial Sequence
  chemically synthesized
ttaagtgaagtgattatgagga

SEQ ID NO: 1254161 - DNA, 22 bp, Artificial Sequence
  chemically synthesized
aagtgaagtgattatgaggaat

SEQ ID NO: 1254162 - DNA, 22 bp, Artificial Sequence
  chemically synthesized
agtgaagtgattatgaggaata

SEQ ID NO: 1254163 - DNA, 22 bp, Artificial Sequence
  chemically synthesized
tgaggaatagctcaattcatta

SEQ ID NO: 1254164 - DNA, 22 bp, Artificial Sequence
  chemically synthesized
catgtgtaaggaatatagagca

SEQ ID NO: 1254165 - DNA, 22 bp, Artificial Sequence
  chemically synthesized
acatgtgtaaggaatatagagc

SEQ ID NO: 1254166 - DNA, 22 bp, Artificial Sequence
  chemically synthesized
aattcattattgctctatattc

SEQ ID NO: 1254167 - DNA, 22 bp, Artificial Sequence
  chemically synthesized
attattgctctatattccttac

SEQ ID NO: 1254168 - DNA, 22 bp, Artificial Sequence
  chemically synthesized
ttgctctatattccttacacat

SEQ ID NO: 1254169 - DNA, 22 bp, Artificial Sequence
  chemically synthesized
ctctatattccttacacatgta

SEQ ID NO: 1254170 - DNA, 22 bp, Artificial Sequence
  chemically synthesized
tatattccttacacatgtaaat

SEQ ID NO: 1254171 - DNA, 22 bp, Artificial Sequence
  chemically synthesized
tattccttacacatgtaaatct

SEQ ID NO: 1254172 - DNA, 22 bp, Artificial Sequence
  chemically synthesized
tagatgtacatataagatttac

SEQ ID NO: 1254173 - DNA, 22 bp, Artificial Sequence
  chemically synthesized
cttacacatgtaaatcttatat

SEQ ID NO: 1254174 - DNA, 22 bp, Artificial Sequence
  chemically synthesized
ctatagatgtacatataagatt

SEQ ID NO: 1254175 - DNA, 22 bp, Artificial Sequence
  chemically synthesized
gctatagatgtacatataagat

SEQ ID NO: 1254176 - DNA, 22 bp, Artificial Sequence
  chemically synthesized
acacatgtaaatcttatatgta

SEQ ID NO: 1254177 - DNA, 22 bp, Artificial Sequence
  chemically synthesized
cacatgtaaatcttatatgtac

SEQ ID NO: 1254178 - DNA, 22 bp, Artificial Sequence
  chemically synthesized
atttgctatagatgtacatata

SEQ ID NO: 1254179 - DNA, 22 bp, Artificial Sequence
  chemically synthesized
catttgctatagatgtacatat

SEQ ID NO: 1254180 - DNA, 22 bp, Artificial Sequence
  chemically synthesized
tcatttgctatagatgtacata

SEQ ID NO: 1254181 - DNA, 22 bp, Artificial Sequence
  chemically synthesized
ttcatttgctatagatgtacat

SEQ ID NO: 1254182 - DNA, 22 bp, Artificial Sequence
  chemically synthesized
tttcatttgctatagatgtaca

SEQ ID NO: 1254183 - DNA, 22 bp, Artificial Sequence
  chemically synthesized
ttttcatttgctatagatgtac

SEQ ID NO: 1254184 - DNA, 22 bp, Artificial Sequence
  chemically synthesized
tttttcatttgctatagatgta

SEQ ID NO: 1254185 - DNA, 22 bp, Artificial Sequence
  chemically synthesized
ttttttcatttgctatagatgt

SEQ ID NO: 1254186 - DNA, 22 bp, Artificial Sequence
  chemically synthesized
cttttttttcatttgctataga

SEQ ID NO: 1254187 - DNA, 22 bp, Artificial Sequence
  chemically synthesized
atatgtacatctatagcaaatg

SEQ ID NO: 1254188 - DNA, 22 bp, Artificial Sequence
  chemically synthesized
tatgtacatctatagcaaatga

SEQ ID NO: 1254189 - DNA, 22 bp, Artificial Sequence
  chemically synthesized
tagcaaatgaaaaaaaaggaat

SEQ ID NO: 1254190 - DNA, 22 bp, Artificial Sequence
  chemically synthesized
aaggaaatatcaacgaaaattc

SEQ ID NO: 1254191 - DNA, 22 bp, Artificial Sequence
  chemically synthesized
aaaggaaatatcaacgaaaatt

SEQ ID NO: 1254192 - DNA, 22 bp, Artificial Sequence
  chemically synthesized
atttaaaggaaatatcaacgaa

SEQ ID NO: 1254193 - DNA, 22 bp, Artificial Sequence
  chemically synthesized
catttaaaggaaatatcaacga

SEQ ID NO: 1254194 - DNA, 22 bp, Artificial Sequence
  chemically synthesized
tcgttgatatttcctttaaatg

SEQ ID NO: 1254195 - DNA, 22 bp, Artificial Sequence
  chemically synthesized
caatgtgatcttcatttaaagg

SEQ ID NO: 1254196 - DNA, 22 bp, Artificial Sequence
  chemically synthesized
cgttgatatttcctttaaatga

SEQ ID NO: 1254197 - DNA, 22 bp, Artificial Sequence
  chemically synthesized
gttgatatttcctttaaatgaa

SEQ ID NO: 1254198 - DNA, 22 bp, Artificial Sequence
  chemically synthesized
acctccaatgtgatcttcattt

SEQ ID NO: 1254199 - DNA, 22 bp, Artificial Sequence
  chemically synthesized
atatttcctttaaatgaagatc

SEQ ID NO: 1254200 - DNA, 22 bp, Artificial Sequence
  chemically synthesized
gacctccaatgtgatcttcatt

SEQ ID NO: 1254201 - DNA, 22 bp, Artificial Sequence
  chemically synthesized
tgacctccaatgtgatcttcat

SEQ ID NO: 1254202 - DNA, 22 bp, Artificial Sequence
  chemically synthesized
cctttaaatgaagatcacattg

SEQ ID NO: 1254203 - DNA, 22 bp, Artificial Sequence
  chemically synthesized
ctttaaatgaagatcacattgg

SEQ ID NO: 1254204 - DNA, 22 bp, Artificial Sequence
  chemically synthesized
taaatgaagatcacattggagg

SEQ ID NO: 1254205 - DNA, 22 bp, Artificial Sequence
  chemically synthesized
aaatgaagatcacattggaggt

SEQ ID NO: 1254206 - DNA, 22 bp, Artificial Sequence
  chemically synthesized
aatgaagatcacattggaggtc

SEQ ID NO: 1254207 - DNA, 22 bp, Artificial Sequence
  chemically synthesized
gtgtgacattttgacctccaat

SEQ ID NO: 1254208 - DNA, 22 bp, Artificial Sequence
  chemically synthesized
ggtgtgacattttgacctccaa

SEQ ID NO: 1254209 - DNA, 22 bp, Artificial Sequence
  chemically synthesized
tggtgtgacattttgacctcca

SEQ ID NO: 1254210 - DNA, 22 bp, Artificial Sequence
  chemically synthesized
ttggtgtgacattttgacctcc

SEQ ID NO: 1254211 - DNA, 22 bp, Artificial Sequence
  chemically synthesized
cttttggtgtgacattttgacc

SEQ ID NO: 1254212 - DNA, 22 bp, Artificial Sequence
  chemically synthesized
ccttttggtgtgacattttgac

SEQ ID NO: 1254213 - DNA, 22 bp, Artificial Sequence
  chemically synthesized
tccttttggtgtgacattttga

SEQ ID NO: 1254214 - DNA, 22 bp, Artificial Sequence
  chemically synthesized
ctttccttttggtgtgacattt

SEQ ID NO: 1254215 - DNA, 22 bp, Artificial Sequence
  chemically synthesized
actttccttttggtgtgacatt

SEQ ID NO: 1254216 - DNA, 22 bp, Artificial Sequence
  chemically synthesized
tactttccttttggtgtgacat

SEQ ID NO: 1254217 - DNA, 22 bp, Artificial Sequence
  chemically synthesized
ttactttccttttggtgtgaca

SEQ ID NO: 1254218 - DNA, 22 bp, Artificial Sequence
  chemically synthesized
tttactttccttttggtgtgac

SEQ ID NO: 1254219 - DNA, 22 bp, Artificial Sequence
  chemically synthesized
gaggtcaaaatgtcacaccaaa

SEQ ID NO: 1254220 - DNA, 22 bp, Artificial Sequence
  chemically synthesized
agttttttactttccttttggt

SEQ ID NO: 1254221 - DNA, 22 bp, Artificial Sequence
  chemically synthesized
gagttttttactttccttttgg

SEQ ID NO: 1254222 - DNA, 22 bp, Artificial Sequence
  chemically synthesized
tgagttttttactttccttttg

SEQ ID NO: 1254223 - DNA, 22 bp, Artificial Sequence
  chemically synthesized
ctttgagttttttactttcctt

SEQ ID NO: 1254224 - DNA, 22 bp, Artificial Sequence
  chemically synthesized
actttgagttttttactttcct

SEQ ID NO: 1254225 - DNA, 22 bp, Artificial Sequence
  chemically synthesized
tactttgagttttttactttcc

SEQ ID NO: 1254226 - DNA, 22 bp, Artificial Sequence
  chemically synthesized
acaaaatatctttactttgagt

SEQ ID NO: 1254227 - DNA, 22 bp, Artificial Sequence
  chemically synthesized
aacaaaatatctttactttgag

SEQ ID NO: 1254228 - DNA, 22 bp, Artificial Sequence
  chemically synthesized
taacaaaatatctttactttga

SEQ ID NO: 1254229 - DNA, 22 bp, Artificial Sequence
  chemically synthesized
ataattttaacaaaatatcttt

SEQ ID NO: 1254230 - DNA, 22 bp, Artificial Sequence
  chemically synthesized
cataattttaacaaaatatctt

SEQ ID NO: 1254231 - DNA, 22 bp, Artificial Sequence
  chemically synthesized
aaagtaaagatattttgttaaa

SEQ ID NO: 1254232 - DNA, 22 bp, Artificial Sequence
  chemically synthesized
acacttcataattttaacaaaa

SEQ ID NO: 1254233 - DNA, 22 bp, Artificial Sequence
  chemically synthesized
aacacttcataattttaacaaa

SEQ ID NO: 1254234 - DNA, 22 bp, Artificial Sequence
  chemically synthesized
taacacttcataattttaacaa

SEQ ID NO: 1254235 - DNA, 22 bp, Artificial Sequence
  chemically synthesized
caattttaacacttcataattt

SEQ ID NO: 1254236 - DNA, 22 bp, Artificial Sequence
  chemically synthesized
gcaattttaacacttcataatt

SEQ ID NO: 1254237 - DNA, 22 bp, Artificial Sequence
  chemically synthesized
tgttaaaattatgaagtgttaa

SEQ ID NO: 1254238 - DNA, 22 bp, Artificial Sequence
  chemically synthesized
gttaaaattatgaagtgttaaa

SEQ ID NO: 1254239 - DNA, 22 bp, Artificial Sequence
  chemically synthesized
ttaaaattatgaagtgttaaaa

SEQ ID NO: 1254240 - DNA, 22 bp, Artificial Sequence
  chemically synthesized
aaattatgaagtgttaaaattg

SEQ ID NO: 1254241 - DNA, 22 bp, Artificial Sequence
  chemically synthesized
tgaagtgttaaaattgcaaatg

SEQ ID NO: 1254242 - DNA, 22 bp, Artificial Sequence
  chemically synthesized
caaatgagatgtcatttgcaat

SEQ ID NO: 1254243 - DNA, 22 bp, Artificial Sequence
  chemically synthesized
acaaatgagatgtcatttgcaa

SEQ ID NO: 1254244 - DNA, 22 bp, Artificial Sequence
  chemically synthesized
aaattgcaaatgacatctcatt

SEQ ID NO: 1254245 - DNA, 22 bp, Artificial Sequence
  chemically synthesized
caaatgacatctcatttgtaaa

SEQ ID NO: 1254246 - DNA, 22 bp, Artificial Sequence
  chemically synthesized
ataaataataatacaatattta

SEQ ID NO: 1254247 - DNA, 22 bp, Artificial Sequence
  chemically synthesized
aataaataataatacaatattt

SEQ ID NO: 1254248 - DNA, 22 bp, Artificial Sequence
  chemically synthesized
ttaataaataataatacaatat

SEQ ID NO: 1254249 - DNA, 22 bp, Artificial Sequence
  chemically synthesized
atttgtaaatattgtattatta

SEQ ID NO: 1254250 - DNA, 22 bp, Artificial Sequence
  chemically synthesized
gtaaatattgtattattattta

SEQ ID NO: 1254251 - DNA, 22 bp, Artificial Sequence
  chemically synthesized
taaatattgtattattatttat

SEQ ID NO: 1254252 - DNA, 22 bp, Artificial Sequence
  chemically synthesized
gagtaattcttaataaataata

SEQ ID NO: 1254253 - DNA, 22 bp, Artificial Sequence
  chemically synthesized
ttcgagtaattcttaataaata

SEQ ID NO: 1254254 - DNA, 22 bp, Artificial Sequence
  chemically synthesized
attcgagtaattcttaataaat

SEQ ID NO: 1254255 - DNA, 22 bp, Artificial Sequence
  chemically synthesized
gcttattcgagtaattcttaat

SEQ ID NO: 1254256 - DNA, 22 bp, Artificial Sequence
  chemically synthesized
tattattatttattaagaatta

SEQ ID NO: 1254257 - DNA, 22 bp, Artificial Sequence
  chemically synthesized
ggcttattcgagtaattcttaa

SEQ ID NO: 1254258 - DNA, 22 bp, Artificial Sequence
  chemically synthesized
tggcttattcgagtaattctta

SEQ ID NO: 1254259 - DNA, 22 bp, Artificial Sequence
  chemically synthesized
ttatttattaagaattactcga

SEQ ID NO: 1254260 - DNA, 22 bp, Artificial Sequence
  chemically synthesized
tttattaagaattactcgaata

SEQ ID NO: 1254261 - DNA, 22 bp, Artificial Sequence
  chemically synthesized
atcattttggcttattcgagta

SEQ ID NO: 1254262 - DNA, 22 bp, Artificial Sequence
  chemically synthesized
catcattttggcttattcgagt

SEQ ID NO: 1254263 - DNA, 22 bp, Artificial Sequence
  chemically synthesized
tcatcattttggcttattcgag

SEQ ID NO: 1254264 - DNA, 22 bp, Artificial Sequence
  chemically synthesized
attaagaattactcgaataagc

SEQ ID NO: 1254265 - DNA, 22 bp, Artificial Sequence
  chemically synthesized
ttaagaattactcgaataagcc

SEQ ID NO: 1254266 - DNA, 22 bp, Artificial Sequence
  chemically synthesized
agaattactcgaataagccaaa

SEQ ID NO: 1254267 - DNA, 22 bp, Artificial Sequence
  chemically synthesized
ctcgaataagccaaaatgatga

SEQ ID NO: 1254268 - DNA, 22 bp, Artificial Sequence
  chemically synthesized
tataacaagcattttcatcatt

SEQ ID NO: 1254269 - DNA, 22 bp, Artificial Sequence
  chemically synthesized
gaataagccaaaatgatgaaaa

SEQ ID NO: 1254270 - DNA, 22 bp, Artificial Sequence
  chemically synthesized
tatataacaagcattttcatca

SEQ ID NO: 1254271 - DNA, 22 bp, Artificial Sequence
  chemically synthesized
tctatataacaagcattttcat

SEQ ID NO: 1254272 - DNA, 22 bp, Artificial Sequence
  chemically synthesized
ctctatataacaagcattttca

SEQ ID NO: 1254273 - DNA, 22 bp, Artificial Sequence
  chemically synthesized
gatttctctatataacaagcat

SEQ ID NO: 1254274 - DNA, 22 bp, Artificial Sequence
  chemically synthesized
agatttctctatataacaagca

SEQ ID NO: 1254275 - DNA, 22 bp, Artificial Sequence
  chemically synthesized
tagatttctctatataacaagc

SEQ ID NO: 1254276 - DNA, 22 bp, Artificial Sequence
  chemically synthesized
cattttagatttctctatataa

SEQ ID NO: 1254277 - DNA, 22 bp, Artificial Sequence
  chemically synthesized
acattttagatttctctatata

SEQ ID NO: 1254278 - DNA, 22 bp, Artificial Sequence
  chemically synthesized
ccttacattttagatttctcta

SEQ ID NO: 1254279 - DNA, 22 bp, Artificial Sequence
  chemically synthesized
ctgccttacattttagatttct

SEQ ID NO: 1254280 - DNA, 22 bp, Artificial Sequence
  chemically synthesized
actgccttacattttagatttc

SEQ ID NO: 1254281 - DNA, 22 bp, Artificial Sequence
  chemically synthesized
gttatatagagaaatctaaaat

SEQ ID NO: 1254282 - DNA, 22 bp, Artificial Sequence
  chemically synthesized
ttatatagagaaatctaaaatg

SEQ ID NO: 1254283 - DNA, 22 bp, Artificial Sequence
  chemically synthesized
cttactgccttacattttagat

SEQ ID NO: 1254284 - DNA, 22 bp, Artificial Sequence
  chemically synthesized
tatagagaaatctaaaatgtaa

SEQ ID NO: 1254285 - DNA, 22 bp, Artificial Sequence
  chemically synthesized
gaagagtagctgcttactgcct

SEQ ID NO: 1254286 - DNA, 22 bp, Artificial Sequence
  chemically synthesized
ttggaagagtagctgcttactg

SEQ ID NO: 1254287 - DNA, 22 bp, Artificial Sequence
  chemically synthesized
aaatgtaaggcagtaagcagct

SEQ ID NO: 1254288 - DNA, 22 bp, Artificial Sequence
  chemically synthesized
gagttattggaagagtagctgc

SEQ ID NO: 1254289 - DNA, 22 bp, Artificial Sequence
  chemically synthesized
ggagttattggaagagtagctg

SEQ ID NO: 1254290 - DNA, 22 bp, Artificial Sequence
  chemically synthesized
tggagttattggaagagtagct

SEQ ID NO: 1254291 - DNA, 22 bp, Artificial Sequence
  chemically synthesized
ttggagttattggaagagtagc

SEQ ID NO: 1254292 - DNA, 22 bp, Artificial Sequence
  chemically synthesized
atcttttggagttattggaaga

SEQ ID NO: 1254293 - DNA, 22 bp, Artificial Sequence
  chemically synthesized
catcttttggagttattggaag

SEQ ID NO: 1254294 - DNA, 22 bp, Artificial Sequence
  chemically synthesized
tcatcttttggagttattggaa

SEQ ID NO: 1254295 - DNA, 22 bp, Artificial Sequence
  chemically synthesized
ctcttccaataactccaaaaga

SEQ ID NO: 1254296 - DNA, 22 bp, Artificial Sequence
  chemically synthesized
ttccaataactccaaaagatga

SEQ ID NO: 1254297 - DNA, 22 bp, Artificial Sequence
  chemically synthesized
ccaataactccaaaagatgaaa

SEQ ID NO: 1254298 - DNA, 22 bp, Artificial Sequence
  chemically synthesized
caataactccaaaagatgaaaa

SEQ ID NO: 1254299 - DNA, 22 bp, Artificial Sequence
  chemically synthesized
gtataccaaacatattttcatc

SEQ ID NO: 1254300 - DNA, 22 bp, Artificial Sequence
  chemically synthesized
agtataccaaacatattttcat

SEQ ID NO: 1254301 - DNA, 22 bp, Artificial Sequence
  chemically synthesized
tagtataccaaacatattttca

SEQ ID NO: 1254302 - DNA, 22 bp, Artificial Sequence
  chemically synthesized
ttagtataccaaacatattttc

SEQ ID NO: 1254303 - DNA, 22 bp, Artificial Sequence
  chemically synthesized
tttagtataccaaacatatttt

SEQ ID NO: 1254304 - DNA, 22 bp, Artificial Sequence
  chemically synthesized
ttttagtataccaaacatattt

SEQ ID NO: 1254305 - DNA, 22 bp, Artificial Sequence
  chemically synthesized
tttttagtataccaaacatatt

SEQ ID NO: 1254306 - DNA, 22 bp, Artificial Sequence
  chemically synthesized
caaaagatgaaaatatgtttgg

SEQ ID NO: 1254307 - DNA, 22 bp, Artificial Sequence
  chemically synthesized
gattttttttagtataccaaac

SEQ ID NO: 1254308 - DNA, 22 bp, Artificial Sequence
  chemically synthesized
cagattagattttttttagtat

SEQ ID NO: 1254309 - DNA, 22 bp, Artificial Sequence
  chemically synthesized
cattacagattagatttttttt

SEQ ID NO: 1254310 - DNA, 22 bp, Artificial Sequence
  chemically synthesized
ggtatactaaaaaaaatctaat

SEQ ID NO: 1254311 - DNA, 22 bp, Artificial Sequence
  chemically synthesized
actacattacagattagatttt

SEQ ID NO: 1254312 - DNA, 22 bp, Artificial Sequence
  chemically synthesized
gtatactaaaaaaaatctaatc

SEQ ID NO: 1254313 - DNA, 22 bp, Artificial Sequence
  chemically synthesized
aaaaaaatctaatctgtaatgt

SEQ ID NO: 1254314 - DNA, 22 bp, Artificial Sequence
  chemically synthesized
aaaatataccactgactacatt

SEQ ID NO: 1254315 - DNA, 22 bp, Artificial Sequence
  chemically synthesized
caaaatataccactgactacat

SEQ ID NO: 1254316 - DNA, 22 bp, Artificial Sequence
  chemically synthesized
tcaaaatataccactgactaca

SEQ ID NO: 1254317 - DNA, 22 bp, Artificial Sequence
  chemically synthesized
tttcaaaatataccactgacta

SEQ ID NO: 1254318 - DNA, 22 bp, Artificial Sequence
  chemically synthesized
ctttcaaaatataccactgact

SEQ ID NO: 1254319 - DNA, 22 bp, Artificial Sequence
  chemically synthesized
atctgtaatgtagtcagtggta

SEQ ID NO: 1254320 - DNA, 22 bp, Artificial Sequence
  chemically synthesized
tctttcaaaatataccactgac

SEQ ID NO: 1254321 - DNA, 22 bp, Artificial Sequence
  chemically synthesized
ttctttcaaaatataccactga

SEQ ID NO: 1254322 - DNA, 22 bp, Artificial Sequence
  chemically synthesized
cttttctttcaaaatataccac

SEQ ID NO: 1254323 - DNA, 22 bp, Artificial Sequence
  chemically synthesized
taatgtagtcagtggtatattt

SEQ ID NO: 1254324 - DNA, 22 bp, Artificial Sequence
  chemically synthesized
acttttctttcaaaatatacca

SEQ ID NO: 1254325 - DNA, 22 bp, Artificial Sequence
  chemically synthesized
tacttttctttcaaaatatacc

SEQ ID NO: 1254326 - DNA, 22 bp, Artificial Sequence
  chemically synthesized
tagttttacttttctttcaaaa

SEQ ID NO: 1254327 - DNA, 22 bp, Artificial Sequence
  chemically synthesized
tgaaagaaaagtaaaactatag

SEQ ID NO: 1254328 - DNA, 22 bp, Artificial Sequence
  chemically synthesized
gaaagaaaagtaaaactatagt

SEQ ID NO: 1254329 - DNA, 22 bp, Artificial Sequence
  chemically synthesized
taaataatcaaaactatagttt

SEQ ID NO: 1254330 - DNA, 22 bp, Artificial Sequence
  chemically synthesized
aaagaaaagtaaaactatagtt

SEQ ID NO: 1254331 - DNA, 22 bp, Artificial Sequence
  chemically synthesized
ataaataatcaaaactatagtt

SEQ ID NO: 1254332 - DNA, 22 bp, Artificial Sequence
  chemically synthesized
tataaataatcaaaactatagt

SEQ ID NO: 1254333 - DNA, 22 bp, Artificial Sequence
  chemically synthesized
ttataaataatcaaaactatag

SEQ ID NO: 1254334 - DNA, 22 bp, Artificial Sequence
  chemically synthesized
ttttataaataatcaaaactat

SEQ ID NO: 1254335 - DNA, 22 bp, Artificial Sequence
  chemically synthesized
attcttttataaataatcaaaa

SEQ ID NO: 1254336 - DNA, 22 bp, Artificial Sequence
  chemically synthesized
tagttttgattatttataaaag

SEQ ID NO: 1254337 - DNA, 22 bp, Artificial Sequence
  chemically synthesized
tgattatttataaaagaatgaa

SEQ ID NO: 1254338 - DNA, 22 bp, Artificial Sequence
  chemically synthesized
aatataaaataattcattcttt

SEQ ID NO: 1254339 - DNA, 22 bp, Artificial Sequence
  chemically synthesized
gattatttataaaagaatgaat

SEQ ID NO: 1254340 - DNA, 22 bp, Artificial Sequence
  chemically synthesized
aaatataaaataattcattctt

SEQ ID NO: 1254341 - DNA, 22 bp, Artificial Sequence
  chemically synthesized
attatttataaaagaatgaatt

SEQ ID NO: 1254342 - DNA, 22 bp, Artificial Sequence
  chemically synthesized
taaatataaaataattcattct

SEQ ID NO: 1254343 - DNA, 22 bp, Artificial Sequence
  chemically synthesized
ttttaaatataaaataattcat

SEQ ID NO: 1254344 - DNA, 22 bp, Artificial Sequence
  chemically synthesized
tttataaaagaatgaattattt

SEQ ID NO: 1254345 - DNA, 22 bp, Artificial Sequence
  chemically synthesized
ataaaagaatgaattattttat

SEQ ID NO: 1254346 - DNA, 22 bp, Artificial Sequence
  chemically synthesized
attattttaaatataaaataat

SEQ ID NO: 1254347 - DNA, 22 bp, Artificial Sequence
  chemically synthesized
taaaagaatgaattattttata

SEQ ID NO: 1254348 - DNA, 22 bp, Artificial Sequence
  chemically synthesized
aattattttaaatataaaataa

SEQ ID NO: 1254349 - DNA, 22 bp, Artificial Sequence
  chemically synthesized
acttaattattttaaatataaa

SEQ ID NO: 1254350 - DNA, 22 bp, Artificial Sequence
  chemically synthesized
tgacttaattattttaaatata

SEQ ID NO: 1254351 - DNA, 22 bp, Artificial Sequence
  chemically synthesized
actctgacttaattattttaaa

SEQ ID NO: 1254352 - DNA, 22 bp, Artificial Sequence
  chemically synthesized
aactctgacttaattattttaa

SEQ ID NO: 1254353 - DNA, 22 bp, Artificial Sequence
  chemically synthesized
tttaactctgacttaattattt

SEQ ID NO: 1254354 - DNA, 22 bp, Artificial Sequence
  chemically synthesized
ttttatatttaaaataattaag

SEQ ID NO: 1254355 - DNA, 22 bp, Artificial Sequence
  chemically synthesized
ctatttaactctgacttaatta

SEQ ID NO: 1254356 - DNA, 22 bp, Artificial Sequence
  chemically synthesized
tatatttaaaataattaagtca

SEQ ID NO: 1254357 - DNA, 22 bp, Artificial Sequence
  chemically synthesized
atatttaaaataattaagtcag

SEQ ID NO: 1254358 - DNA, 22 bp, Artificial Sequence
  chemically synthesized
tatttaaaataattaagtcaga

SEQ ID NO: 1254359 - DNA, 22 bp, Artificial Sequence
  chemically synthesized
ctactatttaactctgacttaa

SEQ ID NO: 1254360 - DNA, 22 bp, Artificial Sequence
  chemically synthesized
aaaataattaagtcagagttaa

SEQ ID NO: 1254361 - DNA, 22 bp, Artificial Sequence
  chemically synthesized
aaataattaagtcagagttaaa

SEQ ID NO: 1254362 - DNA, 22 bp, Artificial Sequence
  chemically synthesized
catgttactactatttaactct

SEQ ID NO: 1254363 - DNA, 22 bp, Artificial Sequence
  chemically synthesized
aaaattacatgttactactatt

SEQ ID NO: 1254364 - DNA, 22 bp, Artificial Sequence
  chemically synthesized
agtcagagttaaatagtagtaa

SEQ ID NO: 1254365 - DNA, 22 bp, Artificial Sequence
  chemically synthesized
aaaaattacatgttactactat

SEQ ID NO: 1254366 - DNA, 22 bp, Artificial Sequence
  chemically synthesized
taaaaattacatgttactacta

SEQ ID NO: 1254367 - DNA, 22 bp, Artificial Sequence
  chemically synthesized
tcaattttaaaaattacatgtt

SEQ ID NO: 1254368 - DNA, 22 bp, Artificial Sequence
  chemically synthesized
aatagtagtaacatgtaatttt

SEQ ID NO: 1254369 - DNA, 22 bp, Artificial Sequence
  chemically synthesized
ctatcaattttaaaaattacat

SEQ ID NO: 1254370 - DNA, 22 bp, Artificial Sequence
  chemically synthesized
cctatcaattttaaaaattaca

SEQ ID NO: 1254371 - DNA, 22 bp, Artificial Sequence
  chemically synthesized
tataatatacacttcctatcaa

SEQ ID NO: 1254372 - DNA, 22 bp, Artificial Sequence
  chemically synthesized
gtataatatacacttcctatca

SEQ ID NO: 1254373 - DNA, 22 bp, Artificial Sequence
  chemically synthesized
ttaaaattgataggaagtgtat

SEQ ID NO: 1254374 - DNA, 22 bp, Artificial Sequence
  chemically synthesized
taaaattgataggaagtgtata

SEQ ID NO: 1254375 - DNA, 22 bp, Artificial Sequence
  chemically synthesized
aaaattgataggaagtgtatat

SEQ ID NO: 1254376 - DNA, 22 bp, Artificial Sequence
  chemically synthesized
aaattgataggaagtgtatatt

SEQ ID NO: 1254377 - DNA, 22 bp, Artificial Sequence
  chemically synthesized
tcacatttgtataatatacact

SEQ ID NO: 1254378 - DNA, 22 bp, Artificial Sequence
  chemically synthesized
atcacatttgtataatatacac

SEQ ID NO: 1254379 - DNA, 22 bp, Artificial Sequence
  chemically synthesized
tttatcacatttgtataatata

SEQ ID NO: 1254380 - DNA, 22 bp, Artificial Sequence
  chemically synthesized
ataggaagtgtatattatacaa

SEQ ID NO: 1254381 - DNA, 22 bp, Artificial Sequence
  chemically synthesized
cacagtataaatgctgtttatc

SEQ ID NO: 1254382 - DNA, 22 bp, Artificial Sequence
  chemically synthesized
ccacagtataaatgctgtttat

SEQ ID NO: 1254383 - DNA, 22 bp, Artificial Sequence
  chemically synthesized
tccacagtataaatgctgttta

SEQ ID NO: 1254384 - DNA, 22 bp, Artificial Sequence
  chemically synthesized
tacaaatgtgataaacagcatt

SEQ ID NO: 1254385 - DNA, 22 bp, Artificial Sequence
  chemically synthesized
atacaaattttccacagtataa

SEQ ID NO: 1254386 - DNA, 22 bp, Artificial Sequence
  chemically synthesized
tcattgatacaaattttccaca

SEQ ID NO: 1254387 - DNA, 22 bp, Artificial Sequence
  chemically synthesized
tgtcattgatacaaattttcca

SEQ ID NO: 1254388 - DNA, 22 bp, Artificial Sequence
  chemically synthesized
ctgtcattgatacaaattttcc

SEQ ID NO: 1254389 - DNA, 22 bp, Artificial Sequence
  chemically synthesized
ccttctgtcattgatacaaatt

SEQ ID NO: 1254390 - DNA, 22 bp, Artificial Sequence
  chemically synthesized
atactgtggaaaatttgtatca

SEQ ID NO: 1254391 - DNA, 22 bp, Artificial Sequence
  chemically synthesized
tactgtggaaaatttgtatcaa

SEQ ID NO: 1254392 - DNA, 22 bp, Artificial Sequence
  chemically synthesized
tggaaaatttgtatcaatgaca

SEQ ID NO: 1254393 - DNA, 22 bp, Artificial Sequence
  chemically synthesized
gtatcaatgacagaaggtaatc

SEQ ID NO: 1254394 - DNA, 22 bp, Artificial Sequence
  chemically synthesized
tatcaatgacagaaggtaatct

SEQ ID NO: 1254395 - DNA, 22 bp, Artificial Sequence
  chemically synthesized
tagtaagaagggagattacctt

SEQ ID NO: 1254396 - DNA, 22 bp, Artificial Sequence
  chemically synthesized
aaaaagaattgtagtaagaagg

SEQ ID NO: 1254397 - DNA, 22 bp, Artificial Sequence
  chemically synthesized
aaaaaagaattgtagtaagaag

SEQ ID NO: 1254398 - DNA, 22 bp, Artificial Sequence
  chemically synthesized
taaaaaagaattgtagtaagaa

SEQ ID NO: 1254399 - DNA, 22 bp, Artificial Sequence
  chemically synthesized
cctttaaaaaagaattgtagta

SEQ ID NO: 1254400 - DNA, 22 bp, Artificial Sequence
  chemically synthesized
ccctttaaaaaagaattgtagt

SEQ ID NO: 1254401 - DNA, 22 bp, Artificial Sequence
  chemically synthesized
tccctttaaaaaagaattgtag

SEQ ID NO: 1254402 - DNA, 22 bp, Artificial Sequence
  chemically synthesized
ttccctttaaaaaagaattgta

SEQ ID NO: 1254403 - DNA, 22 bp, Artificial Sequence
  chemically synthesized
ttttccctttaaaaaagaattg

SEQ ID NO: 1254404 - DNA, 22 bp, Artificial Sequence
  chemically synthesized
ccttcttactacaattcttttt

SEQ ID NO: 1254405 - DNA, 22 bp, Artificial Sequence
  chemically synthesized
cttactacaattcttttttaaa

SEQ ID NO: 1254406 - DNA, 22 bp, Artificial Sequence
  chemically synthesized
tattcttttccctttaaaaaag

SEQ ID NO: 1254407 - DNA, 22 bp, Artificial Sequence
  chemically synthesized
ttactacaattcttttttaaag

SEQ ID NO: 1254408 - DNA, 22 bp, Artificial Sequence
  chemically synthesized
atattcttttccctttaaaaaa

SEQ ID NO: 1254409 - DNA, 22 bp, Artificial Sequence
  chemically synthesized
tatattcttttccctttaaaaa

SEQ ID NO: 1254410 - DNA, 22 bp, Artificial Sequence
  chemically synthesized
actacaattcttttttaaaggg

SEQ ID NO: 1254411 - DNA, 22 bp, Artificial Sequence
  chemically synthesized
ttatattcttttccctttaaaa

SEQ ID NO: 1254412 - DNA, 22 bp, Artificial Sequence
  chemically synthesized
ctacaattcttttttaaaggga

SEQ ID NO: 1254413 - DNA, 22 bp, Artificial Sequence
  chemically synthesized
caattcttttttaaagggaaaa

SEQ ID NO: 1254414 - DNA, 22 bp, Artificial Sequence
  chemically synthesized
atcttttatattcttttccctt

SEQ ID NO: 1254415 - DNA, 22 bp, Artificial Sequence
  chemically synthesized
ttcatcttttatattcttttcc

SEQ ID NO: 1254416 - DNA, 22 bp, Artificial Sequence
  chemically synthesized
gttcatcttttatattcttttc

SEQ ID NO: 1254417 - DNA, 22 bp, Artificial Sequence
  chemically synthesized
ttttttaaagggaaaagaatat

SEQ ID NO: 1254418 - DNA, 22 bp, Artificial Sequence
  chemically synthesized
ttttaaagggaaaagaatataa

SEQ ID NO: 1254419 - DNA, 22 bp, Artificial Sequence
  chemically synthesized
tttaaagggaaaagaatataaa

SEQ ID NO: 1254420 - DNA, 22 bp, Artificial Sequence
  chemically synthesized
ttaaagggaaaagaatataaaa

SEQ ID NO: 1254421 - DNA, 22 bp, Artificial Sequence
  chemically synthesized
taaagggaaaagaatataaaag

SEQ ID NO: 1254422 - DNA, 22 bp, Artificial Sequence
  chemically synthesized
aaagggaaaagaatataaaaga

SEQ ID NO: 1254423 - DNA, 22 bp, Artificial Sequence
  chemically synthesized
tacacttgttcatcttttatat

SEQ ID NO: 1254424 - DNA, 22 bp, Artificial Sequence
  chemically synthesized
aagggaaaagaatataaaagat

SEQ ID NO: 1254425 - DNA, 22 bp, Artificial Sequence
  chemically synthesized
agactgtacacttgttcatctt

SEQ ID NO: 1254426 - DNA, 22 bp, Artificial Sequence
  chemically synthesized
cagactgtacacttgttcatct

SEQ ID NO: 1254427 - DNA, 22 bp, Artificial Sequence
  chemically synthesized
tcagactgtacacttgttcatc

SEQ ID NO: 1254428 - DNA, 22 bp, Artificial Sequence
  chemically synthesized
ttcagactgtacacttgttcat

SEQ ID NO: 1254429 - DNA, 22 bp, Artificial Sequence
  chemically synthesized
accttttcagactgtacacttg

SEQ ID NO: 1254430 - DNA, 22 bp, Artificial Sequence
  chemically synthesized
aagaagaaaattaaccttttca

SEQ ID NO: 1254431 - DNA, 22 bp, Artificial Sequence
  chemically synthesized
aaagaagaaaattaaccttttc

SEQ ID NO: 1254432 - DNA, 22 bp, Artificial Sequence
  chemically synthesized
taaagaagaaaattaacctttt

SEQ ID NO: 1254433 - DNA, 22 bp, Artificial Sequence
  chemically synthesized
ttaaagaagaaaattaaccttt

SEQ ID NO: 1254434 - DNA, 22 bp, Artificial Sequence
  chemically synthesized
aaatttttaaagaagaaaatta

SEQ ID NO: 1254435 - DNA, 22 bp, Artificial Sequence
  chemically synthesized
aaaaggttaattttcttcttta

SEQ ID NO: 1254436 - DNA, 22 bp, Artificial Sequence
  chemically synthesized
aaagtgttgaaatttttaaaga

SEQ ID NO: 1254437 - DNA, 22 bp, Artificial Sequence
  chemically synthesized
caaagtgttgaaatttttaaag

SEQ ID NO: 1254438 - DNA, 22 bp, Artificial Sequence
  chemically synthesized
tcaaagtgttgaaatttttaaa

SEQ ID NO: 1254439 - DNA, 22 bp, Artificial Sequence
  chemically synthesized
attttcttctttaaaaatttca

SEQ ID NO: 1254440 - DNA, 22 bp, Artificial Sequence
  chemically synthesized
tcttctttaaaaatttcaacac

SEQ ID NO: 1254441 - DNA, 22 bp, Artificial Sequence
  chemically synthesized
cttctttaaaaatttcaacact

SEQ ID NO: 1254442 - DNA, 22 bp, Artificial Sequence
  chemically synthesized
ttctttaaaaatttcaacactt

SEQ ID NO: 1254443 - DNA, 22 bp, Artificial Sequence
  chemically synthesized
ctttaaaaatttcaacactttg

SEQ ID NO: 1254444 - DNA, 22 bp, Artificial Sequence
  chemically synthesized
tttaaaaatttcaacactttga

SEQ ID NO: 1254445 - DNA, 22 bp, Artificial Sequence
  chemically synthesized
aatgcaggtactttcaaagtgt

SEQ ID NO: 1254446 - DNA, 22 bp, Artificial Sequence
  chemically synthesized
taaaaatttcaacactttgaaa

SEQ ID NO: 1254447 - DNA, 22 bp, Artificial Sequence
  chemically synthesized
aaaaatttcaacactttgaaag

SEQ ID NO: 1254448 - DNA, 22 bp, Artificial Sequence
  chemically synthesized
aaaatttcaacactttgaaagt

SEQ ID NO: 1254449 - DNA, 22 bp, Artificial Sequence
  chemically synthesized
caacactttgaaagtacctgca

SEQ ID NO: 1254450 - DNA, 22 bp, Artificial Sequence
  chemically synthesized
aacactttgaaagtacctgcat

SEQ ID NO: 1254451 - DNA, 22 bp, Artificial Sequence
  chemically synthesized
aagagaagttgaatgcaggtac

SEQ ID NO: 1254452 - DNA, 22 bp, Artificial Sequence
  chemically synthesized
gaagagaagttgaatgcaggta

SEQ ID NO: 1254453 - DNA, 22 bp, Artificial Sequence
  chemically synthesized
tgaagagaagttgaatgcaggt

SEQ ID NO: 1254454 - DNA, 22 bp, Artificial Sequence
  chemically synthesized
tgaaagtacctgcattcaactt

SEQ ID NO: 1254455 - DNA, 22 bp, Artificial Sequence
  chemically synthesized
gaaagtacctgcattcaacttc

SEQ ID NO: 1254456 - DNA, 22 bp, Artificial Sequence
  chemically synthesized
aaagtacctgcattcaacttct

SEQ ID NO: 1254457 - DNA, 22 bp, Artificial Sequence
  chemically synthesized
agaagtaataattttgaagaga

SEQ ID NO: 1254458 - DNA, 22 bp, Artificial Sequence
  chemically synthesized
aagaagtaataattttgaagag

SEQ ID NO: 1254459 - DNA, 22 bp, Artificial Sequence
  chemically synthesized
cattcaacttctcttcaaaatt

SEQ ID NO: 1254460 - DNA, 22 bp, Artificial Sequence
  chemically synthesized
tagtttaagaagtaataatttt

SEQ ID NO: 1254461 - DNA, 22 bp, Artificial Sequence
  chemically synthesized
aacttctcttcaaaattattac

SEQ ID NO: 1254462 - DNA, 22 bp, Artificial Sequence
  chemically synthesized
actgtagtttaagaagtaataa

SEQ ID NO: 1254463 - DNA, 22 bp, Artificial Sequence
  chemically synthesized
ctcttcaaaattattacttctt

SEQ ID NO: 1254464 - DNA, 22 bp, Artificial Sequence
  chemically synthesized
tcttcaaaattattacttctta

SEQ ID NO: 1254465 - DNA, 22 bp, Artificial Sequence
  chemically synthesized
gctgactgtagtttaagaagta

SEQ ID NO: 1254466 - DNA, 22 bp, Artificial Sequence
  chemically synthesized
ttcaaaattattacttcttaaa

SEQ ID NO: 1254467 - DNA, 22 bp, Artificial Sequence
  chemically synthesized
ggctgactgtagtttaagaagt

SEQ ID NO: 1254468 - DNA, 22 bp, Artificial Sequence
  chemically synthesized
caaaattattacttcttaaact

SEQ ID NO: 1254469 - DNA, 22 bp, Artificial Sequence
  chemically synthesized
aaaattattacttcttaaacta

SEQ ID NO: 1254470 - DNA, 22 bp, Artificial Sequence
  chemically synthesized
cttggctgactgtagtttaaga

SEQ ID NO: 1254471 - DNA, 22 bp, Artificial Sequence
  chemically synthesized
ttacttcttaaactacagtcag

SEQ ID NO: 1254472 - DNA, 22 bp, Artificial Sequence
  chemically synthesized
cttcttaaactacagtcagcca

SEQ ID NO: 1254473 - DNA, 22 bp, Artificial Sequence
  chemically synthesized
aatagcaaattgcttggctgac

SEQ ID NO: 1254474 - DNA, 22 bp, Artificial Sequence
  chemically synthesized
cttaaactacagtcagccaagc

SEQ ID NO: 1254475 - DNA, 22 bp, Artificial Sequence
  chemically synthesized
ttaaactacagtcagccaagca

SEQ ID NO: 1254476 - DNA, 22 bp, Artificial Sequence
  chemically synthesized
tcaatagcaaattgcttggctg

SEQ ID NO: 1254477 - DNA, 22 bp, Artificial Sequence
  chemically synthesized
aaactacagtcagccaagcaat

SEQ ID NO: 1254478 - DNA, 22 bp, Artificial Sequence
  chemically synthesized
aactacagtcagccaagcaatt

SEQ ID NO: 1254479 - DNA, 22 bp, Artificial Sequence
  chemically synthesized
agagttctcaatagcaaattgc

SEQ ID NO: 1254480 - DNA, 22 bp, Artificial Sequence
  chemically synthesized
cagtcagccaagcaatttgcta

SEQ ID NO: 1254481 - DNA, 22 bp, Artificial Sequence
  chemically synthesized
gagagttctcaatagcaaattg

SEQ ID NO: 1254482 - DNA, 22 bp, Artificial Sequence
  chemically synthesized
tgagagttctcaatagcaaatt

SEQ ID NO: 1254483 - DNA, 22 bp, Artificial Sequence
  chemically synthesized
ataatggattttgagagttctc

SEQ ID NO: 1254484 - DNA, 22 bp, Artificial Sequence
  chemically synthesized
aataatggattttgagagttct

SEQ ID NO: 1254485 - DNA, 22 bp, Artificial Sequence
  chemically synthesized
gctattgagaactctcaaaatc

SEQ ID NO: 1254486 - DNA, 22 bp, Artificial Sequence
  chemically synthesized
tatttaataatggattttgaga

SEQ ID NO: 1254487 - DNA, 22 bp, Artificial Sequence
  chemically synthesized
ctattgagaactctcaaaatcc

SEQ ID NO: 1254488 - DNA, 22 bp, Artificial Sequence
  chemically synthesized
ttgagaactctcaaaatccatt

SEQ ID NO: 1254489 - DNA, 22 bp, Artificial Sequence
  chemically synthesized
agaactctcaaaatccattatt

SEQ ID NO: 1254490 - DNA, 22 bp, Artificial Sequence
  chemically synthesized
aaaattgtatttaataatggat

SEQ ID NO: 1254491 - DNA, 22 bp, Artificial Sequence
  chemically synthesized
gaaaattgtatttaataatgga

SEQ ID NO: 1254492 - DNA, 22 bp, Artificial Sequence
  chemically synthesized
tcaaaatccattattaaataca

SEQ ID NO: 1254493 - DNA, 22 bp, Artificial Sequence
  chemically synthesized
aaaatccattattaaatacaat

SEQ ID NO: 1254494 - DNA, 22 bp, Artificial Sequence
  chemically synthesized
ggtatgtttgaaaattgtattt

SEQ ID NO: 1254495 - DNA, 22 bp, Artificial Sequence
  chemically synthesized
aaaaaactgggtatgtttgaaa

SEQ ID NO: 1254496 - DNA, 22 bp, Artificial Sequence
  chemically synthesized
ttaaatacaattttcaaacata

SEQ ID NO: 1254497 - DNA, 22 bp, Artificial Sequence
  chemically synthesized
caaaaaactgggtatgtttgaa

SEQ ID NO: 1254498 - DNA, 22 bp, Artificial Sequence
  chemically synthesized
aatacaattttcaaacataccc

SEQ ID NO: 1254499 - DNA, 22 bp, Artificial Sequence
  chemically synthesized
tgtttcaaaaaactgggtatgt

SEQ ID NO: 1254500 - DNA, 22 bp, Artificial Sequence
  chemically synthesized
gtgtttcaaaaaactgggtatg

SEQ ID NO: 1254501 - DNA, 22 bp, Artificial Sequence
  chemically synthesized
aaatttgtgtttcaaaaaactg

SEQ ID NO: 1254502 - DNA, 22 bp, Artificial Sequence
  chemically synthesized
tcaaacatacccagttttttga

SEQ ID NO: 1254503 - DNA, 22 bp, Artificial Sequence
  chemically synthesized
caaacatacccagttttttgaa

SEQ ID NO: 1254504 - DNA, 22 bp, Artificial Sequence
  chemically synthesized
aaacatacccagttttttgaaa

SEQ ID NO: 1254505 - DNA, 22 bp, Artificial Sequence
  chemically synthesized
aaaagcaaagttaaaatttgtg

SEQ ID NO: 1254506 - DNA, 22 bp, Artificial Sequence
  chemically synthesized
caaaagcaaagttaaaatttgt

SEQ ID NO: 1254507 - DNA, 22 bp, Artificial Sequence
  chemically synthesized
tttgaaacacaaattttaactt

SEQ ID NO: 1254508 - DNA, 22 bp, Artificial Sequence
  chemically synthesized
ttgaaacacaaattttaacttt

SEQ ID NO: 1254509 - DNA, 22 bp, Artificial Sequence
  chemically synthesized
tgaaacacaaattttaactttg

SEQ ID NO: 1254510 - DNA, 22 bp, Artificial Sequence
  chemically synthesized
gaaacacaaattttaactttgc

SEQ ID NO: 1254511 - DNA, 22 bp, Artificial Sequence
  chemically synthesized
aaacacaaattttaactttgct

SEQ ID NO: 1254512 - DNA, 22 bp, Artificial Sequence
  chemically synthesized
atcagtcagtttcaaaagcaaa

SEQ ID NO: 1254513 - DNA, 22 bp, Artificial Sequence
  chemically synthesized
tcatcagtcagtttcaaaagca

SEQ ID NO: 1254514 - DNA, 22 bp, Artificial Sequence
  chemically synthesized
ctcatcagtcagtttcaaaagc

SEQ ID NO: 1254515 - DNA, 22 bp, Artificial Sequence
  chemically synthesized
taactttgcttttgaaactgac

SEQ ID NO: 1254516 - DNA, 22 bp, Artificial Sequence
  chemically synthesized
aactttgcttttgaaactgact

SEQ ID NO: 1254517 - DNA, 22 bp, Artificial Sequence
  chemically synthesized
actttgcttttgaaactgactg

SEQ ID NO: 1254518 - DNA, 22 bp, Artificial Sequence
  chemically synthesized
ggtaatttctcatcagtcagtt

SEQ ID NO: 1254519 - DNA, 22 bp, Artificial Sequence
  chemically synthesized
tgcttttgaaactgactgatga

SEQ ID NO: 1254520 - DNA, 22 bp, Artificial Sequence
  chemically synthesized
gcttttgaaactgactgatgag

SEQ ID NO: 1254521 - DNA, 22 bp, Artificial Sequence
  chemically synthesized
cttttgaaactgactgatgaga

SEQ ID NO: 1254522 - DNA, 22 bp, Artificial Sequence
  chemically synthesized
aaagttaggtaatttctcatca

SEQ ID NO: 1254523 - DNA, 22 bp, Artificial Sequence
  chemically synthesized
ttgaaactgactgatgagaaat

SEQ ID NO: 1254524 - DNA, 22 bp, Artificial Sequence
  chemically synthesized
caaagttaggtaatttctcatc

SEQ ID NO: 1254525 - DNA, 22 bp, Artificial Sequence
  chemically synthesized
tgaaactgactgatgagaaatt

SEQ ID NO: 1254526 - DNA, 22 bp, Artificial Sequence
  chemically synthesized
tcaaagttaggtaatttctcat

SEQ ID NO: 1254527 - DNA, 22 bp, Artificial Sequence
  chemically synthesized
gaaactgactgatgagaaatta

SEQ ID NO: 1254528 - DNA, 22 bp, Artificial Sequence
  chemically synthesized
ttcaaagttaggtaatttctca

SEQ ID NO: 1254529 - DNA, 22 bp, Artificial Sequence
  chemically synthesized
aaactgactgatgagaaattac

SEQ ID NO: 1254530 - DNA, 22 bp, Artificial Sequence
  chemically synthesized
tttcaaagttaggtaatttctc

SEQ ID NO: 1254531 - DNA, 22 bp, Artificial Sequence
  chemically synthesized
actgatgagaaattacctaact

SEQ ID NO: 1254532 - DNA, 22 bp, Artificial Sequence
  chemically synthesized
atgagaaattacctaactttga

SEQ ID NO: 1254533 - DNA, 22 bp, Artificial Sequence
  chemically synthesized
atgaatattttttcaaagttag

SEQ ID NO: 1254534 - DNA, 22 bp, Artificial Sequence
  chemically synthesized
aatgaatattttttcaaagtta

SEQ ID NO: 1254535 - DNA, 22 bp, Artificial Sequence
  chemically synthesized
taatgaatattttttcaaagtt

SEQ ID NO: 1254536 - DNA, 22 bp, Artificial Sequence
  chemically synthesized
ttaatgaatattttttcaaagt

SEQ ID NO: 1254537 - DNA, 22 bp, Artificial Sequence
  chemically synthesized
tttaatgaatattttttcaaag

SEQ ID NO: 1254538 - DNA, 22 bp, Artificial Sequence
  chemically synthesized
cctaactttgaaaaaatattca

SEQ ID NO: 1254539 - DNA, 22 bp, Artificial Sequence
  chemically synthesized
actttgaaaaaatattcattaa

SEQ ID NO: 1254540 - DNA, 22 bp, Artificial Sequence
  chemically synthesized
tgaaaaaatattcattaaaaag

SEQ ID NO: 1254541 - DNA, 22 bp, Artificial Sequence
  chemically synthesized
gaaaaaatattcattaaaaagt

SEQ ID NO: 1254542 - DNA, 22 bp, Artificial Sequence
  chemically synthesized
ggtggaatatggactttttaat

SEQ ID NO: 1254543 - DNA, 22 bp, Artificial Sequence
  chemically synthesized
aaaaaatattcattaaaaagtc

SEQ ID NO: 1254544 - DNA, 22 bp, Artificial Sequence
  chemically synthesized
gcacatgactaggtggaatatg

SEQ ID NO: 1254545 - DNA, 22 bp, Artificial Sequence
  chemically synthesized
attaaaaagtccatattccacc

SEQ ID NO: 1254546 - DNA, 22 bp, Artificial Sequence
  chemically synthesized
agcacatgactaggtggaatat

SEQ ID NO: 1254547 - DNA, 22 bp, Artificial Sequence
  chemically synthesized
aaaagtccatattccacctagt

SEQ ID NO: 1254548 - DNA, 22 bp, Artificial Sequence
  chemically synthesized
atatttagcacatgactaggtg

SEQ ID NO: 1254549 - DNA, 22 bp, Artificial Sequence
  chemically synthesized
taatgctgatatttagcacatg

SEQ ID NO: 1254550 - DNA, 22 bp, Artificial Sequence
  chemically synthesized
ataatgctgatatttagcacat

SEQ ID NO: 1254551 - DNA, 22 bp, Artificial Sequence
  chemically synthesized
cacctagtcatgtgctaaatat

SEQ ID NO: 1254552 - DNA, 22 bp, Artificial Sequence
  chemically synthesized
cttataatgctgatatttagca

SEQ ID NO: 1254553 - DNA, 22 bp, Artificial Sequence
  chemically synthesized
gtcatgtgctaaatatcagcat

SEQ ID NO: 1254554 - DNA, 22 bp, Artificial Sequence
  chemically synthesized
aaacagctgcttataatgctga

SEQ ID NO: 1254555 - DNA, 22 bp, Artificial Sequence
  chemically synthesized
gaaacagctgcttataatgctg

SEQ ID NO: 1254556 - DNA, 22 bp, Artificial Sequence
  chemically synthesized
tgaaacagctgcttataatgct

SEQ ID NO: 1254557 - DNA, 22 bp, Artificial Sequence
  chemically synthesized
ggttttgaaacagctgcttata

SEQ ID NO: 1254558 - DNA, 22 bp, Artificial Sequence
  chemically synthesized
aatatcagcattataagcagct

SEQ ID NO: 1254559 - DNA, 22 bp, Artificial Sequence
  chemically synthesized
cataaaactaggttttgaaaca

SEQ ID NO: 1254560 - DNA, 22 bp, Artificial Sequence
  chemically synthesized
taagcagctgtttcaaaaccta

SEQ ID NO: 1254561 - DNA, 22 bp, Artificial Sequence
  chemically synthesized
tttcaaaacctagttttatgca

SEQ ID NO: 1254562 - DNA, 22 bp, Artificial Sequence
  chemically synthesized
aaaagggcacatgttgcataaa

SEQ ID NO: 1254563 - DNA, 22 bp, Artificial Sequence
  chemically synthesized
caaaacctagttttatgcaaca

SEQ ID NO: 1254564 - DNA, 22 bp, Artificial Sequence
  chemically synthesized
aaaaagggcacatgttgcataa

SEQ ID NO: 1254565 - DNA, 22 bp, Artificial Sequence
  chemically synthesized
aaaacctagttttatgcaacat

SEQ ID NO: 1254566 - DNA, 22 bp, Artificial Sequence
  chemically synthesized
taaaaagggcacatgttgcata

SEQ ID NO: 1254567 - DNA, 22 bp, Artificial Sequence
  chemically synthesized
gttttatgcaacatgtgccctt

SEQ ID NO: 1254568 - DNA, 22 bp, Artificial Sequence
  chemically synthesized
tgaaaaattttaaaaagggcac

SEQ ID NO: 1254569 - DNA, 22 bp, Artificial Sequence
  chemically synthesized
atgaaaaattttaaaaagggca

SEQ ID NO: 1254570 - DNA, 22 bp, Artificial Sequence
  chemically synthesized
tatgcaacatgtgcccttttta

SEQ ID NO: 1254571 - DNA, 22 bp, Artificial Sequence
  chemically synthesized
tatgaaaaattttaaaaagggc

SEQ ID NO: 1254572 - DNA, 22 bp, Artificial Sequence
  chemically synthesized
atgcaacatgtgccctttttaa

SEQ ID NO: 1254573 - DNA, 22 bp, Artificial Sequence
  chemically synthesized
tgcaacatgtgccctttttaaa

SEQ ID NO: 1254574 - DNA, 22 bp, Artificial Sequence
  chemically synthesized
cattttatgaaaaattttaaaa

SEQ ID NO: 1254575 - DNA, 22 bp, Artificial Sequence
  chemically synthesized
tttaaaatttttcataaaatgt

SEQ ID NO: 1254576 - DNA, 22 bp, Artificial Sequence
  chemically synthesized
ccaacagatattacattttatg

SEQ ID NO: 1254577 - DNA, 22 bp, Artificial Sequence
  chemically synthesized
ttaaaatttttcataaaatgta

SEQ ID NO: 1254578 - DNA, 22 bp, Artificial Sequence
  chemically synthesized
taaaatttttcataaaatgtaa

SEQ ID NO: 1254579 - DNA, 22 bp, Artificial Sequence
  chemically synthesized
aaaatttttcataaaatgtaat

SEQ ID NO: 1254580 - DNA, 22 bp, Artificial Sequence
  chemically synthesized
aaatttttcataaaatgtaata

SEQ ID NO: 1254581 - DNA, 22 bp, Artificial Sequence
  chemically synthesized
gtagtgctaccaacagatatta

SEQ ID NO: 1254582 - DNA, 22 bp, Artificial Sequence
  chemically synthesized
ttcataaaatgtaatatctgtt

SEQ ID NO: 1254583 - DNA, 22 bp, Artificial Sequence
  chemically synthesized
tcataaaatgtaatatctgttg

SEQ ID NO: 1254584 - DNA, 22 bp, Artificial Sequence
  chemically synthesized
cataaaatgtaatatctgttgg

SEQ ID NO: 1254585 - DNA, 22 bp, Artificial Sequence
  chemically synthesized
ttagtagtgctaccaacagata

SEQ ID NO: 1254586 - DNA, 22 bp, Artificial Sequence
  chemically synthesized
ataaaatgtaatatctgttggt

SEQ ID NO: 1254587 - DNA, 22 bp, Artificial Sequence
  chemically synthesized
taatattattagtagtgctacc

SEQ ID NO: 1254588 - DNA, 22 bp, Artificial Sequence
  chemically synthesized
ctataatattattagtagtgct

SEQ ID NO: 1254589 - DNA, 22 bp, Artificial Sequence
  chemically synthesized
cctataatattattagtagtgc

SEQ ID NO: 1254590 - DNA, 22 bp, Artificial Sequence
  chemically synthesized
tcctataatattattagtagtg

SEQ ID NO: 1254591 - DNA, 22 bp, Artificial Sequence
  chemically synthesized
ttggtagcactactaataatat

SEQ ID NO: 1254592 - DNA, 22 bp, Artificial Sequence
  chemically synthesized
agcgttttcctataatattatt

SEQ ID NO: 1254593 - DNA, 22 bp, Artificial Sequence
  chemically synthesized
gtagcactactaataatattat

SEQ ID NO: 1254594 - DNA, 22 bp, Artificial Sequence
  chemically synthesized
ctaataatattataggaaaacg

SEQ ID NO: 1254595 - DNA, 22 bp, Artificial Sequence
  chemically synthesized
ataatattataggaaaacgctg

SEQ ID NO: 1254596 - DNA, 22 bp, Artificial Sequence
  chemically synthesized
tatgatcgtaattcagcgtttt

SEQ ID NO: 1254597 - DNA, 22 bp, Artificial Sequence
  chemically synthesized
tatatgatcgtaattcagcgtt

SEQ ID NO: 1254598 - DNA, 22 bp, Artificial Sequence
  chemically synthesized
ctatatgatcgtaattcagcgt

SEQ ID NO: 1254599 - DNA, 22 bp, Artificial Sequence
  chemically synthesized
tctatatgatcgtaattcagcg

SEQ ID NO: 1254600 - DNA, 22 bp, Artificial Sequence
  chemically synthesized
taggaaaacgctgaattacgat

SEQ ID NO: 1254601 - DNA, 22 bp, Artificial Sequence
  chemically synthesized
taattttctatatgatcgtaat

SEQ ID NO: 1254602 - DNA, 22 bp, Artificial Sequence
  chemically synthesized
ataattttctatatgatcgtaa

SEQ ID NO: 1254603 - DNA, 22 bp, Artificial Sequence
  chemically synthesized
tataattttctatatgatcgta

SEQ ID NO: 1254604 - DNA, 22 bp, Artificial Sequence
  chemically synthesized
ttttataattttctatatgatc

SEQ ID NO: 1254605 - DNA, 22 bp, Artificial Sequence
  chemically synthesized
tattttataattttctatatga

SEQ ID NO: 1254606 - DNA, 22 bp, Artificial Sequence
  chemically synthesized
ctattttataattttctatatg

SEQ ID NO: 1254607 - DNA, 22 bp, Artificial Sequence
  chemically synthesized
tctattttataattttctatat

SEQ ID NO: 1254608 - DNA, 22 bp, Artificial Sequence
  chemically synthesized
ttctattttataattttctata

SEQ ID NO: 1254609 - DNA, 22 bp, Artificial Sequence
  chemically synthesized
aattacgatcatatagaaaatt

SEQ ID NO: 1254610 - DNA, 22 bp, Artificial Sequence
  chemically synthesized
tttttctattttataattttct

SEQ ID NO: 1254611 - DNA, 22 bp, Artificial Sequence
  chemically synthesized
atttttctattttataattttc

SEQ ID NO: 1254612 - DNA, 22 bp, Artificial Sequence
  chemically synthesized
cgatcatatagaaaattataaa

SEQ ID NO: 1254613 - DNA, 22 bp, Artificial Sequence
  chemically synthesized
tttatttttctattttataatt

SEQ ID NO: 1254614 - DNA, 22 bp, Artificial Sequence
  chemically synthesized
tgtttatttttctattttataa

SEQ ID NO: 1254615 - DNA, 22 bp, Artificial Sequence
  chemically synthesized
aactctgtttatttttctattt

SEQ ID NO: 1254616 - DNA, 22 bp, Artificial Sequence
  chemically synthesized
tactaaactctgtttatttttc

SEQ ID NO: 1254617 - DNA, 22 bp, Artificial Sequence
  chemically synthesized
tatactaaactctgtttatttt

SEQ ID NO: 1254618 - DNA, 22 bp, Artificial Sequence
  chemically synthesized
taaaatagaaaaataaacagag

SEQ ID NO: 1254619 - DNA, 22 bp, Artificial Sequence
  chemically synthesized
agacactctatactaaactctg

SEQ ID NO: 1254620 - DNA, 22 bp, Artificial Sequence
  chemically synthesized
cacatgttcagacactctatac

SEQ ID NO: 1254621 - DNA, 22 bp, Artificial Sequence
  chemically synthesized
acacatgttcagacactctata

SEQ ID NO: 1254622 - DNA, 22 bp, Artificial Sequence
  chemically synthesized
tacacatgttcagacactctat

SEQ ID NO: 1254623 - DNA, 22 bp, Artificial Sequence
  chemically synthesized
ctttacacatgttcagacactc

SEQ ID NO: 1254624 - DNA, 22 bp, Artificial Sequence
  chemically synthesized
gctttacacatgttcagacact

SEQ ID NO: 1254625 - DNA, 22 bp, Artificial Sequence
  chemically synthesized
agtatagagtgtctgaacatgt

SEQ ID NO: 1254626 - DNA, 22 bp, Artificial Sequence
  chemically synthesized
gtatagagtgtctgaacatgtg

SEQ ID NO: 1254627 - DNA, 22 bp, Artificial Sequence
  chemically synthesized
accccttgctttacacatgttc

SEQ ID NO: 1254628 - DNA, 22 bp, Artificial Sequence
  chemically synthesized
cgcaactgaccccttgctttac

SEQ ID NO: 1254629 - DNA, 22 bp, Artificial Sequence
  chemically synthesized
aacatgtgtaaagcaaggggtc

SEQ ID NO: 1254630 - DNA, 22 bp, Artificial Sequence
  chemically synthesized
aataagtcgtcctccgcaactg

SEQ ID NO: 1254631 - DNA, 22 bp, Artificial Sequence
  chemically synthesized
caaatatctcaataagtcgtcc

SEQ ID NO: 1254632 - DNA, 22 bp, Artificial Sequence
  chemically synthesized
cggaggacgacttattgagata

SEQ ID NO: 1254633 - DNA, 22 bp, Artificial Sequence
  chemically synthesized
attgagatatttgtaatatcct

SEQ ID NO: 1254634 - DNA, 22 bp, Artificial Sequence
  chemically synthesized
ttgagatatttgtaatatcctt

SEQ ID NO: 1254635 - DNA, 22 bp, Artificial Sequence
  chemically synthesized
agatatttgtaatatcctttca

SEQ ID NO: 1254636 - DNA, 22 bp, Artificial Sequence
  chemically synthesized
taaaacagataaaagtagatga

SEQ ID NO: 1254637 - DNA, 22 bp, Artificial Sequence
  chemically synthesized
gtaatatcctttcatctacttt

SEQ ID NO: 1254638 - DNA, 22 bp, Artificial Sequence
  chemically synthesized
taatatcctttcatctactttt

SEQ ID NO: 1254639 - DNA, 22 bp, Artificial Sequence
  chemically synthesized
ggaaactataaaacagataaaa

SEQ ID NO: 1254640 - DNA, 22 bp, Artificial Sequence
  chemically synthesized
ctaggaaactataaaacagata

SEQ ID NO: 1254641 - DNA, 22 bp, Artificial Sequence
  chemically synthesized
tcatctacttttatctgtttta

SEQ ID NO: 1254642 - DNA, 22 bp, Artificial Sequence
  chemically synthesized
actaggaaactataaaacagat

SEQ ID NO: 1254643 - DNA, 22 bp, Artificial Sequence
  chemically synthesized
catctacttttatctgttttat

SEQ ID NO: 1254644 - DNA, 22 bp, Artificial Sequence
  chemically synthesized
atctacttttatctgttttata

SEQ ID NO: 1254645 - DNA, 22 bp, Artificial Sequence
  chemically synthesized
taatttactaggaaactataaa

SEQ ID NO: 1254646 - DNA, 22 bp, Artificial Sequence
  chemically synthesized
cttttatctgttttatagtttc

SEQ ID NO: 1254647 - DNA, 22 bp, Artificial Sequence
  chemically synthesized
ataatttactaggaaactataa

SEQ ID NO: 1254648 - DNA, 22 bp, Artificial Sequence
  chemically synthesized
ttatctgttttatagtttccta

SEQ ID NO: 1254649 - DNA, 22 bp, Artificial Sequence
  chemically synthesized
cttataatttactaggaaacta

SEQ ID NO: 1254650 - DNA, 22 bp, Artificial Sequence
  chemically synthesized
tatctgttttatagtttcctag

SEQ ID NO: 1254651 - DNA, 22 bp, Artificial Sequence
  chemically synthesized
atctgttttatagtttcctagt

SEQ ID NO: 1254652 - DNA, 22 bp, Artificial Sequence
  chemically synthesized
tctgttttatagtttcctagta

SEQ ID NO: 1254653 - DNA, 22 bp, Artificial Sequence
  chemically synthesized
ttttatagtttcctagtaaatt

SEQ ID NO: 1254654 - DNA, 22 bp, Artificial Sequence
  chemically synthesized
tatagtttcctagtaaattata

SEQ ID NO: 1254655 - DNA, 22 bp, Artificial Sequence
  chemically synthesized
atagtttcctagtaaattataa

SEQ ID NO: 1254656 - DNA, 22 bp, Artificial Sequence
  chemically synthesized
tagtttcctagtaaattataag

SEQ ID NO: 1254657 - DNA, 22 bp, Artificial Sequence
  chemically synthesized
agggtgtaatcactgcttataa

SEQ ID NO: 1254658 - DNA, 22 bp, Artificial Sequence
  chemically synthesized
cctagtaaattataagcagtga

SEQ ID NO: 1254659 - DNA, 22 bp, Artificial Sequence
  chemically synthesized
ctagtaaattataagcagtgat

SEQ ID NO: 1254660 - DNA, 22 bp, Artificial Sequence
  chemically synthesized
gtaaattataagcagtgattac

SEQ ID NO: 1254661 - DNA, 22 bp, Artificial Sequence
  chemically synthesized
taagcagtgattacacccttaa

SEQ ID NO: 1254662 - DNA, 22 bp, Artificial Sequence
  chemically synthesized
cataaagccaaagattaagggt

SEQ ID NO: 1254663 - DNA, 22 bp, Artificial Sequence
  chemically synthesized
ccataaagccaaagattaaggg

SEQ ID NO: 1254664 - DNA, 22 bp, Artificial Sequence
  chemically synthesized
tccataaagccaaagattaagg

SEQ ID NO: 1254665 - DNA, 22 bp, Artificial Sequence
  chemically synthesized
ttccataaagccaaagattaag

SEQ ID NO: 1254666 - DNA, 22 bp, Artificial Sequence
  chemically synthesized
tacttttccataaagccaaaga

SEQ ID NO: 1254667 - DNA, 22 bp, Artificial Sequence
  chemically synthesized
atacttttccataaagccaaag

SEQ ID NO: 1254668 - DNA, 22 bp, Artificial Sequence
  chemically synthesized
tatacttttccataaagccaaa

SEQ ID NO: 1254669 - DNA, 22 bp, Artificial Sequence
  chemically synthesized
cacccttaatctttggctttat

SEQ ID NO: 1254670 - DNA, 22 bp, Artificial Sequence
  chemically synthesized
aatctttggctttatggaaaag

SEQ ID NO: 1254671 - DNA, 22 bp, Artificial Sequence
  chemically synthesized
atctttggctttatggaaaagt

SEQ ID NO: 1254672 - DNA, 22 bp, Artificial Sequence
  chemically synthesized
aagagcgattttatacttttcc

SEQ ID NO: 1254673 - DNA, 22 bp, Artificial Sequence
  chemically synthesized
tggctttatggaaaagtataaa

SEQ ID NO: 1254674 - DNA, 22 bp, Artificial Sequence
  chemically synthesized
ggctttatggaaaagtataaaa

SEQ ID NO: 1254675 - DNA, 22 bp, Artificial Sequence
  chemically synthesized
gctttatggaaaagtataaaat

SEQ ID NO: 1254676 - DNA, 22 bp, Artificial Sequence
  chemically synthesized
tatggaaaagtataaaatcgct

SEQ ID NO: 1254677 - DNA, 22 bp, Artificial Sequence
  chemically synthesized
atggaaaagtataaaatcgctc

SEQ ID NO: 1254678 - DNA, 22 bp, Artificial Sequence
  chemically synthesized
tggaaaagtataaaatcgctct

SEQ ID NO: 1254679 - DNA, 22 bp, Artificial Sequence
  chemically synthesized
ttcagttttattatgactgtat

SEQ ID NO: 1254680 - DNA, 22 bp, Artificial Sequence
  chemically synthesized
cagttttattatgactgtatat

SEQ ID NO: 1254681 - DNA, 22 bp, Artificial Sequence
  chemically synthesized
agttttattatgactgtatatg

SEQ ID NO: 1254682 - DNA, 22 bp, Artificial Sequence
  chemically synthesized
taaatagaatatccatatacag

SEQ ID NO: 1254683 - DNA, 22 bp, Artificial Sequence
  chemically synthesized
gtaaatagaatatccatataca

SEQ ID NO: 1254684 - DNA, 22 bp, Artificial Sequence
  chemically synthesized
tgtaaatagaatatccatatac

SEQ ID NO: 1254685 - DNA, 22 bp, Artificial Sequence
  chemically synthesized
ttgtaaatagaatatccatata

SEQ ID NO: 1254686 - DNA, 22 bp, Artificial Sequence
  chemically synthesized
tattatgactgtatatggatat

SEQ ID NO: 1254687 - DNA, 22 bp, Artificial Sequence
  chemically synthesized
attatgactgtatatggatatt

SEQ ID NO: 1254688 - DNA, 22 bp, Artificial Sequence
  chemically synthesized
ttatgactgtatatggatattc

SEQ ID NO: 1254689 - DNA, 22 bp, Artificial Sequence
  chemically synthesized
tgactgtatatggatattctat

SEQ ID NO: 1254690 - DNA, 22 bp, Artificial Sequence
  chemically synthesized
tatatggatattctatttacaa

SEQ ID NO: 1254691 - DNA, 22 bp, Artificial Sequence
  chemically synthesized
gccaaaatgtaatagcatatgt

SEQ ID NO: 1254692 - DNA, 22 bp, Artificial Sequence
  chemically synthesized
tatttacaaaaacatatgctat

SEQ ID NO: 1254693 - DNA, 22 bp, Artificial Sequence
  chemically synthesized
tttacaaaaacatatgctatta

SEQ ID NO: 1254694 - DNA, 22 bp, Artificial Sequence
  chemically synthesized
acaaaaacatatgctattacat

SEQ ID NO: 1254695 - DNA, 22 bp, Artificial Sequence
  chemically synthesized
caaaaacatatgctattacatt

SEQ ID NO: 1254696 - DNA, 22 bp, Artificial Sequence
  chemically synthesized
atacaaagattggccaaaatgt

SEQ ID NO: 1254697 - DNA, 22 bp, Artificial Sequence
  chemically synthesized
caaaaattaatacaaagattgg

SEQ ID NO: 1254698 - DNA, 22 bp, Artificial Sequence
  chemically synthesized
ttacattttggccaatctttgt

SEQ ID NO: 1254699 - DNA, 22 bp, Artificial Sequence
  chemically synthesized
acaaaaattaatacaaagattg

SEQ ID NO: 1254700 - DNA, 22 bp, Artificial Sequence
  chemically synthesized
ttacaaaaattaatacaaagat

SEQ ID NO: 1254701 - DNA, 22 bp, Artificial Sequence
  chemically synthesized
cattttggccaatctttgtatt

SEQ ID NO: 1254702 - DNA, 22 bp, Artificial Sequence
  chemically synthesized
tggccaatctttgtattaattt

SEQ ID NO: 1254703 - DNA, 22 bp, Artificial Sequence
  chemically synthesized
ggccaatctttgtattaatttt

SEQ ID NO: 1254704 - DNA, 22 bp, Artificial Sequence
  chemically synthesized
gccaatctttgtattaattttt

SEQ ID NO: 1254705 - DNA, 22 bp, Artificial Sequence
  chemically synthesized
cacaatatattcttacaaaaat

SEQ ID NO: 1254706 - DNA, 22 bp, Artificial Sequence
  chemically synthesized
acacaatatattcttacaaaaa

SEQ ID NO: 1254707 - DNA, 22 bp, Artificial Sequence
  chemically synthesized
tgtattaatttttgtaagaata

SEQ ID NO: 1254708 - DNA, 22 bp, Artificial Sequence
  chemically synthesized
gtattaatttttgtaagaatat

SEQ ID NO: 1254709 - DNA, 22 bp, Artificial Sequence
  chemically synthesized
tattaatttttgtaagaatata

SEQ ID NO: 1254710 - DNA, 22 bp, Artificial Sequence
  chemically synthesized
taaatacttacacaatatattc

SEQ ID NO: 1254711 - DNA, 22 bp, Artificial Sequence
  chemically synthesized
atttttgtaagaatatattgtg

SEQ ID NO: 1254712 - DNA, 22 bp, Artificial Sequence
  chemically synthesized
ccctataaatacttacacaata

SEQ ID NO: 1254713 - DNA, 22 bp, Artificial Sequence
  chemically synthesized
ttgtaagaatatattgtgtaag

SEQ ID NO: 1254714 - DNA, 22 bp, Artificial Sequence
  chemically synthesized
tgtaagaatatattgtgtaagt

SEQ ID NO: 1254715 - DNA, 22 bp, Artificial Sequence
  chemically synthesized
gtaagaatatattgtgtaagta

SEQ ID NO: 1254716 - DNA, 22 bp, Artificial Sequence
  chemically synthesized
ttaccctataaatacttacaca

SEQ ID NO: 1254717 - DNA, 22 bp, Artificial Sequence
  chemically synthesized
taagaatatattgtgtaagtat

SEQ ID NO: 1254718 - DNA, 22 bp, Artificial Sequence
  chemically synthesized
tgtaagtatttatagggtaata

SEQ ID NO: 1254719 - DNA, 22 bp, Artificial Sequence
  chemically synthesized
gtatgatatgtattattaccct

SEQ ID NO: 1254720 - DNA, 22 bp, Artificial Sequence
  chemically synthesized
acattcgtatgatatgtattat

SEQ ID NO: 1254721 - DNA, 22 bp, Artificial Sequence
  chemically synthesized
aacattcgtatgatatgtatta

SEQ ID NO: 1254722 - DNA, 22 bp, Artificial Sequence
  chemically synthesized
ttaacattcgtatgatatgtat

SEQ ID NO: 1254723 - DNA, 22 bp, Artificial Sequence
  chemically synthesized
atagggtaataatacatatcat

SEQ ID NO: 1254724 - DNA, 22 bp, Artificial Sequence
  chemically synthesized
tagggtaataatacatatcata

SEQ ID NO: 1254725 - DNA, 22 bp, Artificial Sequence
  chemically synthesized
cactcttaacattcgtatgata

SEQ ID NO: 1254726 - DNA, 22 bp, Artificial Sequence
  chemically synthesized
ttgcactcttaacattcgtatg

SEQ ID NO: 1254727 - DNA, 22 bp, Artificial Sequence
  chemically synthesized
ctattgcactcttaacattcgt

SEQ ID NO: 1254728 - DNA, 22 bp, Artificial Sequence
  chemically synthesized
gctattgcactcttaacattcg

SEQ ID NO: 1254729 - DNA, 22 bp, Artificial Sequence
  chemically synthesized
tgctattgcactcttaacattc

SEQ ID NO: 1254730 - DNA, 22 bp, Artificial Sequence
  chemically synthesized
ttttgctattgcactcttaaca

SEQ ID NO: 1254731 - DNA, 22 bp, Artificial Sequence
  chemically synthesized
attttgctattgcactcttaac

SEQ ID NO: 1254732 - DNA, 22 bp, Artificial Sequence
  chemically synthesized
tattttgctattgcactcttaa

SEQ ID NO: 1254733 - DNA, 22 bp, Artificial Sequence
  chemically synthesized
tttattttgctattgcactctt

SEQ ID NO: 1254734 - DNA, 22 bp, Artificial Sequence
  chemically synthesized
tggttctttattttgctattgc

SEQ ID NO: 1254735 - DNA, 22 bp, Artificial Sequence
  chemically synthesized
gctatggttctttattttgcta

SEQ ID NO: 1254736 - DNA, 22 bp, Artificial Sequence
  chemically synthesized
ggctatggttctttattttgct

SEQ ID NO: 1254737 - DNA, 22 bp, Artificial Sequence
  chemically synthesized
tggctatggttctttattttgc

SEQ ID NO: 1254738 - DNA, 22 bp, Artificial Sequence
  chemically synthesized
agagtgcaatagcaaaataaag

SEQ ID NO: 1254739 - DNA, 22 bp, Artificial Sequence
  chemically synthesized
ttttggctatggttctttattt

SEQ ID NO: 1254740 - DNA, 22 bp, Artificial Sequence
  chemically synthesized
attttggctatggttctttatt

SEQ ID NO: 1254741 - DNA, 22 bp, Artificial Sequence
  chemically synthesized
tgaggaatttattttggctatg

SEQ ID NO: 1254742 - DNA, 22 bp, Artificial Sequence
  chemically synthesized
atgaggaatttattttggctat

SEQ ID NO: 1254743 - DNA, 22 bp, Artificial Sequence
  chemically synthesized
cttatgaggaatttattttggc

SEQ ID NO: 1254744 - DNA, 22 bp, Artificial Sequence
  chemically synthesized
gcttatgaggaatttattttgg

SEQ ID NO: 1254745 - DNA, 22 bp, Artificial Sequence
  chemically synthesized
tgtgtgtgtgatgcttgcttat

SEQ ID NO: 1254746 - DNA, 22 bp, Artificial Sequence
  chemically synthesized
gtgtgtgtgtgatgcttgctta

SEQ ID NO: 1254747 - DNA, 22 bp, Artificial Sequence
  chemically synthesized
ctcataagcaagcatcacacac

SEQ ID NO: 1254748 - DNA, 22 bp, Artificial Sequence
  chemically synthesized
ataagcaagcatcacacacaca

SEQ ID NO: 1254749 - DNA, 22 bp, Artificial Sequence
  chemically synthesized
cgtgtgtgtgtgtgtgtgtgtg

SEQ ID NO: 1254750 - DNA, 22 bp, Artificial Sequence
  chemically synthesized
tgcgtgtgtgtgtgtgtgtgtg

SEQ ID NO: 1254751 - DNA, 22 bp, Artificial Sequence
  chemically synthesized
ctgcgtgtgtgtgtgtgtgtgt

SEQ ID NO: 1254752 - DNA, 22 bp, Artificial Sequence
  chemically synthesized
agtcagtgaagaaaatgtccat

SEQ ID NO: 1254753 - DNA, 22 bp, Artificial Sequence
  chemically synthesized
tgagtcagtgaagaaaatgtcc

SEQ ID NO: 1254754 - DNA, 22 bp, Artificial Sequence
  chemically synthesized
ctgagtcagtgaagaaaatgtc

SEQ ID NO: 1254755 - DNA, 22 bp, Artificial Sequence
  chemically synthesized
tctgagtcagtgaagaaaatgt

SEQ ID NO: 1254756 - DNA, 22 bp, Artificial Sequence
  chemically synthesized
ttctgagtcagtgaagaaaatg

SEQ ID NO: 1254757 - DNA, 22 bp, Artificial Sequence
  chemically synthesized
tttctgagtcagtgaagaaaat

SEQ ID NO: 1254758 - DNA, 22 bp, Artificial Sequence
  chemically synthesized
aaaattttttctgagtcagtga

SEQ ID NO: 1254759 - DNA, 22 bp, Artificial Sequence
  chemically synthesized
cctgaaaattttttctgagtca

SEQ ID NO: 1254760 - DNA, 22 bp, Artificial Sequence
  chemically synthesized
acctgaaaattttttctgagtc

SEQ ID NO: 1254761 - DNA, 22 bp, Artificial Sequence
  chemically synthesized
tacctgaaaattttttctgagt

SEQ ID NO: 1254762 - DNA, 22 bp, Artificial Sequence
  chemically synthesized
tcttcactgactcagaaaaaat

SEQ ID NO: 1254763 - DNA, 22 bp, Artificial Sequence
  chemically synthesized
cttcactgactcagaaaaaatt

SEQ ID NO: 1254764 - DNA, 22 bp, Artificial Sequence
  chemically synthesized
ttcactgactcagaaaaaattt

SEQ ID NO: 1254765 - DNA, 22 bp, Artificial Sequence
  chemically synthesized
cactgactcagaaaaaattttc

SEQ ID NO: 1254766 - DNA, 22 bp, Artificial Sequence
  chemically synthesized
actgactcagaaaaaattttca

SEQ ID NO: 1254767 - DNA, 22 bp, Artificial Sequence
  chemically synthesized
caggacattttacctgaaaatt

SEQ ID NO: 1254768 - DNA, 22 bp, Artificial Sequence
  chemically synthesized
acaggacattttacctgaaaat

SEQ ID NO: 1254769 - DNA, 22 bp, Artificial Sequence
  chemically synthesized
actcagaaaaaattttcaggta

SEQ ID NO: 1254770 - DNA, 22 bp, Artificial Sequence
  chemically synthesized
agaaaaaattttcaggtaaaat

SEQ ID NO: 1254771 - DNA, 22 bp, Artificial Sequence
  chemically synthesized
gaacatttacaggacattttac

SEQ ID NO: 1254772 - DNA, 22 bp, Artificial Sequence
  chemically synthesized
tcaggtaaaatgtcctgtaaat

SEQ ID NO: 1254773 - DNA, 22 bp, Artificial Sequence
  chemically synthesized
caggtaaaatgtcctgtaaatg

SEQ ID NO: 1254774 - DNA, 22 bp, Artificial Sequence
  chemically synthesized
tgaccactcgaacatttacagg

SEQ ID NO: 1254775 - DNA, 22 bp, Artificial Sequence
  chemically synthesized
aggtaaaatgtcctgtaaatgt

SEQ ID NO: 1254776 - DNA, 22 bp, Artificial Sequence
  chemically synthesized
gtgaccactcgaacatttacag

SEQ ID NO: 1254777 - DNA, 22 bp, Artificial Sequence
  chemically synthesized
cttgtgaccactcgaacattta

SEQ ID NO: 1254778 - DNA, 22 bp, Artificial Sequence
  chemically synthesized
acttgtgaccactcgaacattt

SEQ ID NO: 1254779 - DNA, 22 bp, Artificial Sequence
  chemically synthesized
tacttgtgaccactcgaacatt

SEQ ID NO: 1254780 - DNA, 22 bp, Artificial Sequence
  chemically synthesized
ttacttgtgaccactcgaacat

SEQ ID NO: 1254781 - DNA, 22 bp, Artificial Sequence
  chemically synthesized
taaatttttacttgtgaccact

SEQ ID NO: 1254782 - DNA, 22 bp, Artificial Sequence
  chemically synthesized
gtaaatttttacttgtgaccac

SEQ ID NO: 1254783 - DNA, 22 bp, Artificial Sequence
  chemically synthesized
taaatgttcgagtggtcacaag

SEQ ID NO: 1254784 - DNA, 22 bp, Artificial Sequence
  chemically synthesized
tgtaaatttttacttgtgacca

SEQ ID NO: 1254785 - DNA, 22 bp, Artificial Sequence
  chemically synthesized
gagtggtcacaagtaaaaattt

SEQ ID NO: 1254786 - DNA, 22 bp, Artificial Sequence
  chemically synthesized
tagaaacactttgtaaattttt

SEQ ID NO: 1254787 - DNA, 22 bp, Artificial Sequence
  chemically synthesized
gaactatagaaacactttgtaa

SEQ ID NO: 1254788 - DNA, 22 bp, Artificial Sequence
  chemically synthesized
ctggaactatagaaacactttg

SEQ ID NO: 1254789 - DNA, 22 bp, Artificial Sequence
  chemically synthesized
tgctggaactatagaaacactt

SEQ ID NO: 1254790 - DNA, 22 bp, Artificial Sequence
  chemically synthesized
ctgctggaactatagaaacact

SEQ ID NO: 1254791 - DNA, 22 bp, Artificial Sequence
  chemically synthesized
tctgctggaactatagaaacac

SEQ ID NO: 1254792 - DNA, 22 bp, Artificial Sequence
  chemically synthesized
gctttctgctggaactatagaa

SEQ ID NO: 1254793 - DNA, 22 bp, Artificial Sequence
  chemically synthesized
acaaagtgtttctatagttcca

SEQ ID NO: 1254794 - DNA, 22 bp, Artificial Sequence
  chemically synthesized
caaagtgtttctatagttccag

SEQ ID NO: 1254795 - DNA, 22 bp, Artificial Sequence
  chemically synthesized
atgcacctcgctttctgctgga

SEQ ID NO: 1254796 - DNA, 22 bp, Artificial Sequence
  chemically synthesized
taatgcacctcgctttctgctg

SEQ ID NO: 1254797 - DNA, 22 bp, Artificial Sequence
  chemically synthesized
ctaatgcacctcgctttctgct

SEQ ID NO: 1254798 - DNA, 22 bp, Artificial Sequence
  chemically synthesized
ctatagttccagcagaaagcga

SEQ ID NO: 1254799 - DNA, 22 bp, Artificial Sequence
  chemically synthesized
ttctaatgcacctcgctttctg

SEQ ID NO: 1254800 - DNA, 22 bp, Artificial Sequence
  chemically synthesized
tatagttccagcagaaagcgag

SEQ ID NO: 1254801 - DNA, 22 bp, Artificial Sequence
  chemically synthesized
cttctaatgcacctcgctttct

SEQ ID NO: 1254802 - DNA, 22 bp, Artificial Sequence
  chemically synthesized
tcttctaatgcacctcgctttc

SEQ ID NO: 1254803 - DNA, 22 bp, Artificial Sequence
  chemically synthesized
tagttccagcagaaagcgaggt

SEQ ID NO: 1254804 - DNA, 22 bp, Artificial Sequence
  chemically synthesized
ttcttctaatgcacctcgcttt

SEQ ID NO: 1254805 - DNA, 22 bp, Artificial Sequence
  chemically synthesized
cagcagaaagcgaggtgcatta

SEQ ID NO: 1254806 - DNA, 22 bp, Artificial Sequence
  chemically synthesized
aatatatcatgaatatttttct

SEQ ID NO: 1254807 - DNA, 22 bp, Artificial Sequence
  chemically synthesized
taaatatatcatgaatattttt

SEQ ID NO: 1254808 - DNA, 22 bp, Artificial Sequence
  chemically synthesized
ctaaatatatcatgaatatttt

SEQ ID NO: 1254809 - DNA, 22 bp, Artificial Sequence
  chemically synthesized
tctaaatatatcatgaatattt

SEQ ID NO: 1254810 - DNA, 22 bp, Artificial Sequence
  chemically synthesized
gaagaaaaatattcatgatata

SEQ ID NO: 1254811 - DNA, 22 bp, Artificial Sequence
  chemically synthesized
gtgtctttctaaatatatcatg

SEQ ID NO: 1254812 - DNA, 22 bp, Artificial Sequence
  chemically synthesized
ggtgtctttctaaatatatcat

SEQ ID NO: 1254813 - DNA, 22 bp, Artificial Sequence
  chemically synthesized
tcaaaatttggtgtctttctaa

SEQ ID NO: 1254814 - DNA, 22 bp, Artificial Sequence
  chemically synthesized
atcaaaatttggtgtctttcta

SEQ ID NO: 1254815 - DNA, 22 bp, Artificial Sequence
  chemically synthesized
tatcaaaatttggtgtctttct

SEQ ID NO: 1254816 - DNA, 22 bp, Artificial Sequence
  chemically synthesized
atgatatatttagaaagacacc

SEQ ID NO: 1254817 - DNA, 22 bp, Artificial Sequence
  chemically synthesized
ttttatcaaaatttggtgtctt

SEQ ID NO: 1254818 - DNA, 22 bp, Artificial Sequence
  chemically synthesized
gttttatcaaaatttggtgtct

SEQ ID NO: 1254819 - DNA, 22 bp, Artificial Sequence
  chemically synthesized
ccacttgttttatcaaaatttg

SEQ ID NO: 1254820 - DNA, 22 bp, Artificial Sequence
  chemically synthesized
agaaagacaccaaattttgata

SEQ ID NO: 1254821 - DNA, 22 bp, Artificial Sequence
  chemically synthesized
gaaagacaccaaattttgataa

SEQ ID NO: 1254822 - DNA, 22 bp, Artificial Sequence
  chemically synthesized
agttaccacttgttttatcaaa

SEQ ID NO: 1254823 - DNA, 22 bp, Artificial Sequence
  chemically synthesized
aactgagttaccacttgtttta

SEQ ID NO: 1254824 - DNA, 22 bp, Artificial Sequence
  chemically synthesized
attaaactgagttaccacttgt

SEQ ID NO: 1254825 - DNA, 22 bp, Artificial Sequence
  chemically synthesized
gttaattaaactgagttaccac

SEQ ID NO: 1254826 - DNA, 22 bp, Artificial Sequence
  chemically synthesized
tgataaaacaagtggtaactca

SEQ ID NO: 1254827 - DNA, 22 bp, Artificial Sequence
  chemically synthesized
ggttaattaaactgagttacca

SEQ ID NO: 1254828 - DNA, 22 bp, Artificial Sequence
  chemically synthesized
gataaaacaagtggtaactcag

SEQ ID NO: 1254829 - DNA, 22 bp, Artificial Sequence
  chemically synthesized
ataaaacaagtggtaactcagt

SEQ ID NO: 1254830 - DNA, 22 bp, Artificial Sequence
  chemically synthesized
catgtggtatatatttggttaa

SEQ ID NO: 1254831 - DNA, 22 bp, Artificial Sequence
  chemically synthesized
gcatgtggtatatatttggtta

SEQ ID NO: 1254832 - DNA, 22 bp, Artificial Sequence
  chemically synthesized
tgcatgtggtatatatttggtt

SEQ ID NO: 1254833 - DNA, 22 bp, Artificial Sequence
  chemically synthesized
agtttaattaaccaaatatata

SEQ ID NO: 1254834 - DNA, 22 bp, Artificial Sequence
  chemically synthesized
aattaaccaaatatataccaca

SEQ ID NO: 1254835 - DNA, 22 bp, Artificial Sequence
  chemically synthesized
attaaccaaatatataccacat

SEQ ID NO: 1254836 - DNA, 22 bp, Artificial Sequence
  chemically synthesized
tgacatattttgcatgtggtat

SEQ ID NO: 1254837 - DNA, 22 bp, Artificial Sequence
  chemically synthesized
accaaatatataccacatgcaa

SEQ ID NO: 1254838 - DNA, 22 bp, Artificial Sequence
  chemically synthesized
tcagtatctatgacatattttg

SEQ ID NO: 1254839 - DNA, 22 bp, Artificial Sequence
  chemically synthesized
aattatcagtatctatgacata

SEQ ID NO: 1254840 - DNA, 22 bp, Artificial Sequence
  chemically synthesized
gaattatcagtatctatgacat

SEQ ID NO: 1254841 - DNA, 22 bp, Artificial Sequence
  chemically synthesized
tgaattatcagtatctatgaca

SEQ ID NO: 1254842 - DNA, 22 bp, Artificial Sequence
  chemically synthesized
ttttgaattatcagtatctatg

SEQ ID NO: 1254843 - DNA, 22 bp, Artificial Sequence
  chemically synthesized
attttgaattatcagtatctat

SEQ ID NO: 1254844 - DNA, 22 bp, Artificial Sequence
  chemically synthesized
gagaatacttattttgaattat

SEQ ID NO: 1254845 - DNA, 22 bp, Artificial Sequence
  chemically synthesized
caaattagagaatacttatttt

SEQ ID NO: 1254846 - DNA, 22 bp, Artificial Sequence
  chemically synthesized
ccaaattagagaatacttattt

SEQ ID NO: 1254847 - DNA, 22 bp, Artificial Sequence
  chemically synthesized
ataattcaaaataagtattctc

SEQ ID NO: 1254848 - DNA, 22 bp, Artificial Sequence
  chemically synthesized
atttccaaattagagaatactt

SEQ ID NO: 1254849 - DNA, 22 bp, Artificial Sequence
  chemically synthesized
ctaatttccaaattagagaata

SEQ ID NO: 1254850 - DNA, 22 bp, Artificial Sequence
  chemically synthesized
aaaataagtattctctaatttg

SEQ ID NO: 1254851 - DNA, 22 bp, Artificial Sequence
  chemically synthesized
tctaatttggaaattagcaaca

SEQ ID NO: 1254852 - DNA, 22 bp, Artificial Sequence
  chemically synthesized
taatttggaaattagcaacaca

SEQ ID NO: 1254853 - DNA, 22 bp, Artificial Sequence
  chemically synthesized
atttggaaattagcaacacaca

SEQ ID NO: 1254854 - DNA, 22 bp, Artificial Sequence
  chemically synthesized
ggaaattagcaacacacatttt

SEQ ID NO: 1254855 - DNA, 22 bp, Artificial Sequence
  chemically synthesized
gaaattagcaacacacattttt

SEQ ID NO: 1254856 - DNA, 22 bp, Artificial Sequence
  chemically synthesized
tccacatatatacacaaaaatg

SEQ ID NO: 1254857 - DNA, 22 bp, Artificial Sequence
  chemically synthesized
gcaacacacatttttgtgtata

SEQ ID NO: 1254858 - DNA, 22 bp, Artificial Sequence
  chemically synthesized
atatatctgtccacatatatac

SEQ ID NO: 1254859 - DNA, 22 bp, Artificial Sequence
  chemically synthesized
ttgtgtatatatgtggacagat

SEQ ID NO: 1254860 - DNA, 22 bp, Artificial Sequence
  chemically synthesized
tgtgtatatatgtggacagata

SEQ ID NO: 1254861 - DNA, 22 bp, Artificial Sequence
  chemically synthesized
gtgtatatatgtggacagatat

SEQ ID NO: 1254862 - DNA, 22 bp, Artificial Sequence
  chemically synthesized
tgtatatatgtggacagatata

SEQ ID NO: 1254863 - DNA, 22 bp, Artificial Sequence
  chemically synthesized
tgccagggatggattaatatat

SEQ ID NO: 1254864 - DNA, 22 bp, Artificial Sequence
  chemically synthesized
ctatgccagggatggattaata

SEQ ID NO: 1254865 - DNA, 22 bp, Artificial Sequence
  chemically synthesized
ggatactcctatgccagggatg

SEQ ID NO: 1254866 - DNA, 22 bp, Artificial Sequence
  chemically synthesized
gtacattgggatactcctatgc

SEQ ID NO: 1254867 - DNA, 22 bp, Artificial Sequence
  chemically synthesized
atccatccctggcataggagta

SEQ ID NO: 1254868 - DNA, 22 bp, Artificial Sequence
  chemically synthesized
aaattagtacattgggatactc

SEQ ID NO: 1254869 - DNA, 22 bp, Artificial Sequence
  chemically synthesized
gcataggagtatcccaatgtac

SEQ ID NO: 1254870 - DNA, 22 bp, Artificial Sequence
  chemically synthesized
taagagttcaaattagtacatt

SEQ ID NO: 1254871 - DNA, 22 bp, Artificial Sequence
  chemically synthesized
ataagagttcaaattagtacat

SEQ ID NO: 1254872 - DNA, 22 bp, Artificial Sequence
  chemically synthesized
tataagagttcaaattagtaca

SEQ ID NO: 1254873 - DNA, 22 bp, Artificial Sequence
  chemically synthesized
aatgctttataagagttcaaat

SEQ ID NO: 1254874 - DNA, 22 bp, Artificial Sequence
  chemically synthesized
aactgaatgctttataagagtt

SEQ ID NO: 1254875 - DNA, 22 bp, Artificial Sequence
  chemically synthesized
tattgaactgaatgctttataa

SEQ ID NO: 1254876 - DNA, 22 bp, Artificial Sequence
  chemically synthesized
atttgaactcttataaagcatt

SEQ ID NO: 1254877 - DNA, 22 bp, Artificial Sequence
  chemically synthesized
gaactcttataaagcattcagt

SEQ ID NO: 1254878 - DNA, 22 bp, Artificial Sequence
  chemically synthesized
aactcttataaagcattcagtt

SEQ ID NO: 1254879 - DNA, 22 bp, Artificial Sequence
  chemically synthesized
atgagttatattgaactgaatg

SEQ ID NO: 1254880 - DNA, 22 bp, Artificial Sequence
  chemically synthesized
aatgagttatattgaactgaat

SEQ ID NO: 1254881 - DNA, 22 bp, Artificial Sequence
  chemically synthesized
ttataaagcattcagttcaata

SEQ ID NO: 1254882 - DNA, 22 bp, Artificial Sequence
  chemically synthesized
ataaagcattcagttcaatata

SEQ ID NO: 1254883 - DNA, 22 bp, Artificial Sequence
  chemically synthesized
taaagcattcagttcaatataa

SEQ ID NO: 1254884 - DNA, 22 bp, Artificial Sequence
  chemically synthesized
tagggccatttaatgagttata

SEQ ID NO: 1254885 - DNA, 22 bp, Artificial Sequence
  chemically synthesized
agttcaatataactcattaaat

SEQ ID NO: 1254886 - DNA, 22 bp, Artificial Sequence
  chemically synthesized
ggctgtagggccatttaatgag

SEQ ID NO: 1254887 - DNA, 22 bp, Artificial Sequence
  chemically synthesized
gggctgtagggccatttaatga

SEQ ID NO: 1254888 - DNA, 22 bp, Artificial Sequence
  chemically synthesized
tgggctgtagggccatttaatg

SEQ ID NO: 1254889 - DNA, 22 bp, Artificial Sequence
  chemically synthesized
tttgggctgtagggccatttaa

SEQ ID NO: 1254890 - DNA, 22 bp, Artificial Sequence
  chemically synthesized
aatataactcattaaatggccc

SEQ ID NO: 1254891 - DNA, 22 bp, Artificial Sequence
  chemically synthesized
ctttgggctgtagggccattta

SEQ ID NO: 1254892 - DNA, 22 bp, Artificial Sequence
  chemically synthesized
ttctttgggctgtagggccatt

SEQ ID NO: 1254893 - DNA, 22 bp, Artificial Sequence
  chemically synthesized
cttctttgggctgtagggccat

SEQ ID NO: 1254894 - DNA, 22 bp, Artificial Sequence
  chemically synthesized
attaaatggccctacagcccaa

SEQ ID NO: 1254895 - DNA, 22 bp, Artificial Sequence
  chemically synthesized
aagatggcttcttctttgggct

SEQ ID NO: 1254896 - DNA, 22 bp, Artificial Sequence
  chemically synthesized
aatggccctacagcccaaagaa

SEQ ID NO: 1254897 - DNA, 22 bp, Artificial Sequence
  chemically synthesized
cagcccaaagaagaagccatct

SEQ ID NO: 1254898 - DNA, 22 bp, Artificial Sequence
  chemically synthesized
tatcatgcatactaaagatggc

SEQ ID NO: 1254899 - DNA, 22 bp, Artificial Sequence
  chemically synthesized
gtatcatgcatactaaagatgg

SEQ ID NO: 1254900 - DNA, 22 bp, Artificial Sequence
  chemically synthesized
tagaaatgaaagcttgtatcat

SEQ ID NO: 1254901 - DNA, 22 bp, Artificial Sequence
  chemically synthesized
atagaaatgaaagcttgtatca

SEQ ID NO: 1254902 - DNA, 22 bp, Artificial Sequence
  chemically synthesized
tatagaaatgaaagcttgtatc

SEQ ID NO: 1254903 - DNA, 22 bp, Artificial Sequence
  chemically synthesized
ttatagaaatgaaagcttgtat

SEQ ID NO: 1254904 - DNA, 22 bp, Artificial Sequence
  chemically synthesized
tagtatgcatgatacaagcttt

SEQ ID NO: 1254905 - DNA, 22 bp, Artificial Sequence
  chemically synthesized
tttatagaaatgaaagcttgta

SEQ ID NO: 1254906 - DNA, 22 bp, Artificial Sequence
  chemically synthesized
agtatgcatgatacaagctttc

SEQ ID NO: 1254907 - DNA, 22 bp, Artificial Sequence
  chemically synthesized
gtatgcatgatacaagctttca

SEQ ID NO: 1254908 - DNA, 22 bp, Artificial Sequence
  chemically synthesized
tttttatagaaatgaaagcttg

SEQ ID NO: 1254909 - DNA, 22 bp, Artificial Sequence
  chemically synthesized
ctttttatagaaatgaaagctt

SEQ ID NO: 1254910 - DNA, 22 bp, Artificial Sequence
  chemically synthesized
ccatttctttttatagaaatga

SEQ ID NO: 1254911 - DNA, 22 bp, Artificial Sequence
  chemically synthesized
gccatttctttttatagaaatg

SEQ ID NO: 1254912 - DNA, 22 bp, Artificial Sequence
  chemically synthesized
tgccatttctttttatagaaat

SEQ ID NO: 1254913 - DNA, 22 bp, Artificial Sequence
  chemically synthesized
ttgccatttctttttatagaaa

SEQ ID NO: 1254914 - DNA, 22 bp, Artificial Sequence
  chemically synthesized
atcttttgccatttctttttat

SEQ ID NO: 1254915 - DNA, 22 bp, Artificial Sequence
  chemically synthesized
tcatttctataaaaagaaatgg

SEQ ID NO: 1254916 - DNA, 22 bp, Artificial Sequence
  chemically synthesized
catttctataaaaagaaatggc

SEQ ID NO: 1254917 - DNA, 22 bp, Artificial Sequence
  chemically synthesized
atttctataaaaagaaatggca

SEQ ID NO: 1254918 - DNA, 22 bp, Artificial Sequence
  chemically synthesized
caaatctaatcttttgccattt

SEQ ID NO: 1254919 - DNA, 22 bp, Artificial Sequence
  chemically synthesized
gcaaatctaatcttttgccatt

SEQ ID NO: 1254920 - DNA, 22 bp, Artificial Sequence
  chemically synthesized
ctataaaaagaaatggcaaaag

SEQ ID NO: 1254921 - DNA, 22 bp, Artificial Sequence
  chemically synthesized
tgcaaatctaatcttttgccat

SEQ ID NO: 1254922 - DNA, 22 bp, Artificial Sequence
  chemically synthesized
tataaaaagaaatggcaaaaga

SEQ ID NO: 1254923 - DNA, 22 bp, Artificial Sequence
  chemically synthesized
taaaaagaaatggcaaaagatt

SEQ ID NO: 1254924 - DNA, 22 bp, Artificial Sequence
  chemically synthesized
ctttgcaaatctaatcttttgc

SEQ ID NO: 1254925 - DNA, 22 bp, Artificial Sequence
  chemically synthesized
gctttgcaaatctaatcttttg

SEQ ID NO: 1254926 - DNA, 22 bp, Artificial Sequence
  chemically synthesized
tcttgctttgcaaatctaatct

SEQ ID NO: 1254927 - DNA, 22 bp, Artificial Sequence
  chemically synthesized
atcttgctttgcaaatctaatc

SEQ ID NO: 1254928 - DNA, 22 bp, Artificial Sequence
  chemically synthesized
tatcttgctttgcaaatctaat

SEQ ID NO: 1254929 - DNA, 22 bp, Artificial Sequence
  chemically synthesized
ttatcttgctttgcaaatctaa

SEQ ID NO: 1254930 - DNA, 22 bp, Artificial Sequence
  chemically synthesized
tttatcttgctttgcaaatcta

SEQ ID NO: 1254931 - DNA, 22 bp, Artificial Sequence
  chemically synthesized
acaagtgtctttttatcttgct

SEQ ID NO: 1254932 - DNA, 22 bp, Artificial Sequence
  chemically synthesized
gatttgcaaagcaagataaaaa

SEQ ID NO: 1254933 - DNA, 22 bp, Artificial Sequence
  chemically synthesized
ggagctgacaagtgtcttttta

SEQ ID NO: 1254934 - DNA, 22 bp, Artificial Sequence
  chemically synthesized
gcaaagcaagataaaaagacac

SEQ ID NO: 1254935 - DNA, 22 bp, Artificial Sequence
  chemically synthesized
caaagcaagataaaaagacact

SEQ ID NO: 1254936 - DNA, 22 bp, Artificial Sequence
  chemically synthesized
gaagatctaggagctgacaagt

SEQ ID NO: 1254937 - DNA, 22 bp, Artificial Sequence
  chemically synthesized
ctggaagatctaggagctgaca

SEQ ID NO: 1254938 - DNA, 22 bp, Artificial Sequence
  chemically synthesized
cctggaagatctaggagctgac

SEQ ID NO: 1254939 - DNA, 22 bp, Artificial Sequence
  chemically synthesized
cttcctggaagatctaggagct

SEQ ID NO: 1254940 - DNA, 22 bp, Artificial Sequence
  chemically synthesized
gtcagctcctagatcttccagg

SEQ ID NO: 1254941 - DNA, 22 bp, Artificial Sequence
  chemically synthesized
tatatgctgcttcctggaagat

SEQ ID NO: 1254942 - DNA, 22 bp, Artificial Sequence
  chemically synthesized
tcagctcctagatcttccagga

SEQ ID NO: 1254943 - DNA, 22 bp, Artificial Sequence
  chemically synthesized
ctatatatgctgcttcctggaa

SEQ ID NO: 1254944 - DNA, 22 bp, Artificial Sequence
  chemically synthesized
tcctatatatgctgcttcctgg

SEQ ID NO: 1254945 - DNA, 22 bp, Artificial Sequence
  chemically synthesized
ctcctatatatgctgcttcctg

SEQ ID NO: 1254946 - DNA, 22 bp, Artificial Sequence
  chemically synthesized
tctcctatatatgctgcttcct

SEQ ID NO: 1254947 - DNA, 22 bp, Artificial Sequence
  chemically synthesized
ctagatcttccaggaagcagca

SEQ ID NO: 1254948 - DNA, 22 bp, Artificial Sequence
  chemically synthesized
tttctcctatatatgctgcttc

SEQ ID NO: 1254949 - DNA, 22 bp, Artificial Sequence
  chemically synthesized
gatcttccaggaagcagcatat

SEQ ID NO: 1254950 - DNA, 22 bp, Artificial Sequence
  chemically synthesized
tctttctcctatatatgctgct

SEQ ID NO: 1254951 - DNA, 22 bp, Artificial Sequence
  chemically synthesized
ctctttctcctatatatgctgc

SEQ ID NO: 1254952 - DNA, 22 bp, Artificial Sequence
  chemically synthesized
tctctttctcctatatatgctg

SEQ ID NO: 1254953 - DNA, 22 bp, Artificial Sequence
  chemically synthesized
ttctctttctcctatatatgct

SEQ ID NO: 1254954 - DNA, 22 bp, Artificial Sequence
  chemically synthesized
tttctctttctcctatatatgc

SEQ ID NO: 1254955 - DNA, 22 bp, Artificial Sequence
  chemically synthesized
ttttctctttctcctatatatg

SEQ ID NO: 1254956 - DNA, 22 bp, Artificial Sequence
  chemically synthesized
ccaggaagcagcatatatagga

SEQ ID NO: 1254957 - DNA, 22 bp, Artificial Sequence
  chemically synthesized
caggaagcagcatatataggag

SEQ ID NO: 1254958 - DNA, 22 bp, Artificial Sequence
  chemically synthesized
ccttttttctctttctcctata

SEQ ID NO: 1254959 - DNA, 22 bp, Artificial Sequence
  chemically synthesized
accttttttctctttctcctat

SEQ ID NO: 1254960 - DNA, 22 bp, Artificial Sequence
  chemically synthesized
taccttttttctctttctccta

SEQ ID NO: 1254961 - DNA, 22 bp, Artificial Sequence
  chemically synthesized
tatcaatcatgttttacctttt

SEQ ID NO: 1254962 - DNA, 22 bp, Artificial Sequence
  chemically synthesized
ctatatcaatcatgttttacct

SEQ ID NO: 1254963 - DNA, 22 bp, Artificial Sequence
  chemically synthesized
cctatatcaatcatgttttacc

SEQ ID NO: 1254964 - DNA, 22 bp, Artificial Sequence
  chemically synthesized
tcctatatcaatcatgttttac

SEQ ID NO: 1254965 - DNA, 22 bp, Artificial Sequence
  chemically synthesized
ttttcctatatcaatcatgttt

SEQ ID NO: 1254966 - DNA, 22 bp, Artificial Sequence
  chemically synthesized
taatgtaaagctgttttcctat

SEQ ID NO: 1254967 - DNA, 22 bp, Artificial Sequence
  chemically synthesized
ataatgtaaagctgttttccta

SEQ ID NO: 1254968 - DNA, 22 bp, Artificial Sequence
  chemically synthesized
atataggaaaacagctttacat

SEQ ID NO: 1254969 - DNA, 22 bp, Artificial Sequence
  chemically synthesized
tacattataaattgtatggtgt

SEQ ID NO: 1254970 - DNA, 22 bp, Artificial Sequence
  chemically synthesized
ccacgtatatagacaccataca

SEQ ID NO: 1254971 - DNA, 22 bp, Artificial Sequence
  chemically synthesized
acattataaattgtatggtgtc

SEQ ID NO: 1254972 - DNA, 22 bp, Artificial Sequence
  chemically synthesized
cccacgtatatagacaccatac

SEQ ID NO: 1254973 - DNA, 22 bp, Artificial Sequence
  chemically synthesized
cattataaattgtatggtgtct

SEQ ID NO: 1254974 - DNA, 22 bp, Artificial Sequence
  chemically synthesized
taaattgtatggtgtctatata

SEQ ID NO: 1254975 - DNA, 22 bp, Artificial Sequence
  chemically synthesized
gaaaatttcccacgtatataga

SEQ ID NO: 1254976 - DNA, 22 bp, Artificial Sequence
  chemically synthesized
agaaaatttcccacgtatatag

SEQ ID NO: 1254977 - DNA, 22 bp, Artificial Sequence
  chemically synthesized
tatggtgtctatatacgtggga

SEQ ID NO: 1254978 - DNA, 22 bp, Artificial Sequence
  chemically synthesized
atttagaaaatttcccacgtat

SEQ ID NO: 1254979 - DNA, 22 bp, Artificial Sequence
  chemically synthesized
aatttagaaaatttcccacgta

SEQ ID NO: 1254980 - DNA, 22 bp, Artificial Sequence
  chemically synthesized
taatttagaaaatttcccacgt

SEQ ID NO: 1254981 - DNA, 22 bp, Artificial Sequence
  chemically synthesized
ttaatttagaaaatttcccacg

SEQ ID NO: 1254982 - DNA, 22 bp, Artificial Sequence
  chemically synthesized
tttttaatttagaaaatttccc

SEQ ID NO: 1254983 - DNA, 22 bp, Artificial Sequence
  chemically synthesized
gtttttaatttagaaaatttcc

SEQ ID NO: 1254984 - DNA, 22 bp, Artificial Sequence
  chemically synthesized
tatacgtgggaaattttctaaa

SEQ ID NO: 1254985 - DNA, 22 bp, Artificial Sequence
  chemically synthesized
acttgtttttaatttagaaaat

SEQ ID NO: 1254986 - DNA, 22 bp, Artificial Sequence
  chemically synthesized
gacttgtttttaatttagaaaa

SEQ ID NO: 1254987 - DNA, 22 bp, Artificial Sequence
  chemically synthesized
ttgacttgtttttaatttagaa

SEQ ID NO: 1254988 - DNA, 22 bp, Artificial Sequence
  chemically synthesized
cttgacttgtttttaatttaga

SEQ ID NO: 1254989 - DNA, 22 bp, Artificial Sequence
  chemically synthesized
tagtttcttgacttgtttttaa

SEQ ID NO: 1254990 - DNA, 22 bp, Artificial Sequence
  chemically synthesized
atagtttcttgacttgttttta

SEQ ID NO: 1254991 - DNA, 22 bp, Artificial Sequence
  chemically synthesized
tatagtttcttgacttgttttt

SEQ ID NO: 1254992 - DNA, 22 bp, Artificial Sequence
  chemically synthesized
tttatagtttcttgacttgttt

SEQ ID NO: 1254993 - DNA, 22 bp, Artificial Sequence
  chemically synthesized
ctttatagtttcttgacttgtt

SEQ ID NO: 1254994 - DNA, 22 bp, Artificial Sequence
  chemically synthesized
tctaaattaaaaacaagtcaag

SEQ ID NO: 1254995 - DNA, 22 bp, Artificial Sequence
  chemically synthesized
ctaaattaaaaacaagtcaaga

SEQ ID NO: 1254996 - DNA, 22 bp, Artificial Sequence
  chemically synthesized
taaattaaaaacaagtcaagaa

SEQ ID NO: 1254997 - DNA, 22 bp, Artificial Sequence
  chemically synthesized
aattaaaaacaagtcaagaaac

SEQ ID NO: 1254998 - DNA, 22 bp, Artificial Sequence
  chemically synthesized
gccaaatttctttatagtttct

SEQ ID NO: 1254999 - DNA, 22 bp, Artificial Sequence
  chemically synthesized
aaaacaagtcaagaaactataa

SEQ ID NO: 1255000 - DNA, 22 bp, Artificial Sequence
  chemically synthesized
taaagaaatttggccaggtgcg

SEQ ID NO: 1255001 - DNA, 22 bp, Artificial Sequence
  chemically synthesized
caggtgtgaaccaccgcacctg

SEQ ID NO: 1255002 - DNA, 22 bp, Artificial Sequence
  chemically synthesized
ggattacaggtgtgaaccaccg

SEQ ID NO: 1255003 - DNA, 22 bp, Artificial Sequence
  chemically synthesized
ggccaggtgcggtggttcacac

SEQ ID NO: 1255004 - DNA, 22 bp, Artificial Sequence
  chemically synthesized
gccaggtgcggtggttcacacc

SEQ ID NO: 1255005 - DNA, 22 bp, Artificial Sequence
  chemically synthesized
ccaaagtgctgggattacaggt

SEQ ID NO: 1255006 - DNA, 22 bp, Artificial Sequence
  chemically synthesized
gcctcccaaagtgctgggatta

SEQ ID NO: 1255007 - DNA, 22 bp, Artificial Sequence
  chemically synthesized
ggcctcccaaagtgctgggatt

SEQ ID NO: 1255008 - DNA, 22 bp, Artificial Sequence
  chemically synthesized
acacctgtaatcccagcacttt

SEQ ID NO: 1255009 - DNA, 22 bp, Artificial Sequence
  chemically synthesized
taatcccagcactttgggaggc

SEQ ID NO: 1255010 - DNA, 22 bp, Artificial Sequence
  chemically synthesized
gggtgatccacccgccttggcc

SEQ ID NO: 1255011 - DNA, 22 bp, Artificial Sequence
  chemically synthesized
acctcgggtgatccacccgcct

SEQ ID NO: 1255012 - DNA, 22 bp, Artificial Sequence
  chemically synthesized
tgggaggccaaggcgggtggat

SEQ ID NO: 1255013 - DNA, 22 bp, Artificial Sequence
  chemically synthesized
gggaggccaaggcgggtggatc

SEQ ID NO: 1255014 - DNA, 22 bp, Artificial Sequence
  chemically synthesized
ctgacctcgggtgatccacccg

SEQ ID NO: 1255015 - DNA, 22 bp, Artificial Sequence
  chemically synthesized
ggaggccaaggcgggtggatca

SEQ ID NO: 1255016 - DNA, 22 bp, Artificial Sequence
  chemically synthesized
aaactcctgacctcgggtgatc

SEQ ID NO: 1255017 - DNA, 22 bp, Artificial Sequence
  chemically synthesized
gtctcaaactcctgacctcggg

SEQ ID NO: 1255018 - DNA, 22 bp, Artificial Sequence
  chemically synthesized
gccaggctggtctcaaactcct

SEQ ID NO: 1255019 - DNA, 22 bp, Artificial Sequence
  chemically synthesized
atcatgttggccaggctggtct

SEQ ID NO: 1255020 - DNA, 22 bp, Artificial Sequence
  chemically synthesized
catcatgttggccaggctggtc

SEQ ID NO: 1255021 - DNA, 22 bp, Artificial Sequence
  chemically synthesized
gagaccagcctggccaacatga

SEQ ID NO: 1255022 - DNA, 22 bp, Artificial Sequence
  chemically synthesized
agaccagcctggccaacatgat

SEQ ID NO: 1255023 - DNA, 22 bp, Artificial Sequence
  chemically synthesized
gtagagatggggtttcatcatg

SEQ ID NO: 1255024 - DNA, 22 bp, Artificial Sequence
  chemically synthesized
agtagagatggggtttcatcat

SEQ ID NO: 1255025 - DNA, 22 bp, Artificial Sequence
  chemically synthesized
tagtagagatggggtttcatca

SEQ ID NO: 1255026 - DNA, 22 bp, Artificial Sequence
  chemically synthesized
ttagtagagatggggtttcatc

SEQ ID NO: 1255027 - DNA, 22 bp, Artificial Sequence
  chemically synthesized
gccaacatgatgaaaccccatc

SEQ ID NO: 1255028 - DNA, 22 bp, Artificial Sequence
  chemically synthesized
tatttttagtagagatggggtt

SEQ ID NO: 1255029 - DNA, 22 bp, Artificial Sequence
  chemically synthesized
gtatttttagtagagatggggt

SEQ ID NO: 1255030 - DNA, 22 bp, Artificial Sequence
  chemically synthesized
tgtatttttagtagagatgggg

SEQ ID NO: 1255031 - DNA, 22 bp, Artificial Sequence
  chemically synthesized
ttgtatttttagtagagatggg

SEQ ID NO: 1255032 - DNA, 22 bp, Artificial Sequence
  chemically synthesized
atttttgtatttttagtagaga

SEQ ID NO: 1255033 - DNA, 22 bp, Artificial Sequence
  chemically synthesized
tactaaaaatacaaaaattagc

SEQ ID NO: 1255034 - DNA, 22 bp, Artificial Sequence
  chemically synthesized
ctaaaaatacaaaaattagctg

SEQ ID NO: 1255035 - DNA, 22 bp, Artificial Sequence
  chemically synthesized
aaaatacaaaaattagctgggc

SEQ ID NO: 1255036 - DNA, 22 bp, Artificial Sequence
  chemically synthesized
caggcatgagccaccaagccca

SEQ ID NO: 1255037 - DNA, 22 bp, Artificial Sequence
  chemically synthesized
ggactacaggcatgagccacca

SEQ ID NO: 1255038 - DNA, 22 bp, Artificial Sequence
  chemically synthesized
gctgggcttggtggctcatgcc

SEQ ID NO: 1255039 - DNA, 22 bp, Artificial Sequence
  chemically synthesized
ggcttggtggctcatgcctgta

SEQ ID NO: 1255040 - DNA, 22 bp, Artificial Sequence
  chemically synthesized
agtagctgggactacaggcatg

SEQ ID NO: 1255041 - DNA, 22 bp, Artificial Sequence
  chemically synthesized
ctgagtagctgggactacaggc

SEQ ID NO: 1255042 - DNA, 22 bp, Artificial Sequence
  chemically synthesized
ggtggctcatgcctgtagtccc

SEQ ID NO: 1255043 - DNA, 22 bp, Artificial Sequence
  chemically synthesized
gtggctcatgcctgtagtccca

SEQ ID NO: 1255044 - DNA, 22 bp, Artificial Sequence
  chemically synthesized
agcctcctgagtagctgggact

SEQ ID NO: 1255045 - DNA, 22 bp, Artificial Sequence
  chemically synthesized
atgcctgtagtcccagctactc

SEQ ID NO: 1255046 - DNA, 22 bp, Artificial Sequence
  chemically synthesized
cctcagcctcctgagtagctgg

SEQ ID NO: 1255047 - DNA, 22 bp, Artificial Sequence
  chemically synthesized
gcctcagcctcctgagtagctg

SEQ ID NO: 1255048 - DNA, 22 bp, Artificial Sequence
  chemically synthesized
ttgcctcagcctcctgagtagc

SEQ ID NO: 1255049 - DNA, 22 bp, Artificial Sequence
  chemically synthesized
tcttgcctcagcctcctgagta

SEQ ID NO: 1255050 - DNA, 22 bp, Artificial Sequence
  chemically synthesized
tagtcccagctactcaggaggc

SEQ ID NO: 1255051 - DNA, 22 bp, Artificial Sequence
  chemically synthesized
aagggattctcttgcctcagcc

SEQ ID NO: 1255052 - DNA, 22 bp, Artificial Sequence
  chemically synthesized
ctcaggaggctgaggcaagaga

SEQ ID NO: 1255053 - DNA, 22 bp, Artificial Sequence
  chemically synthesized
aggaggctgaggcaagagaatc

SEQ ID NO: 1255054 - DNA, 22 bp, Artificial Sequence
  chemically synthesized
ccgggttcaagggattctcttg

SEQ ID NO: 1255055 - DNA, 22 bp, Artificial Sequence
  chemically synthesized
cgcctcccgggttcaagggatt

SEQ ID NO: 1255056 - DNA, 22 bp, Artificial Sequence
  chemically synthesized
aggcaagagaatcccttgaacc

SEQ ID NO: 1255057 - DNA, 22 bp, Artificial Sequence
  chemically synthesized
caacctccgcctcccgggttca

SEQ ID NO: 1255058 - DNA, 22 bp, Artificial Sequence
  chemically synthesized
ggctgcaacctccgcctcccgg

SEQ ID NO: 1255059 - DNA, 22 bp, Artificial Sequence
  chemically synthesized
caacctgggctgcaacctccgc

SEQ ID NO: 1255060 - DNA, 22 bp, Artificial Sequence
  chemically synthesized
gaacccgggaggcggaggttgc

SEQ ID NO: 1255061 - DNA, 22 bp, Artificial Sequence
  chemically synthesized
aacccgggaggcggaggttgca

SEQ ID NO: 1255062 - DNA, 22 bp, Artificial Sequence
  chemically synthesized
ggctgcaacctgggctgcaacc

SEQ ID NO: 1255063 - DNA, 22 bp, Artificial Sequence
  chemically synthesized
tcgcccaggctgggctgcaacc

SEQ ID NO: 1255064 - DNA, 22 bp, Artificial Sequence
  chemically synthesized
tgtcgcccaggctgggctgcaa

SEQ ID NO: 1255065 - DNA, 22 bp, Artificial Sequence
  chemically synthesized
cagcccaggttgcagcccagcc

SEQ ID NO: 1255066 - DNA, 22 bp, Artificial Sequence
  chemically synthesized
actctgtcgcccaggctgggct

SEQ ID NO: 1255067 - DNA, 22 bp, Artificial Sequence
  chemically synthesized
agtctcactctgtcgcccaggc

SEQ ID NO: 1255068 - DNA, 22 bp, Artificial Sequence
  chemically synthesized
cagcccagcctgggcgacagag

SEQ ID NO: 1255069 - DNA, 22 bp, Artificial Sequence
  chemically synthesized
agactgagtctcactctgtcgc

SEQ ID NO: 1255070 - DNA, 22 bp, Artificial Sequence
  chemically synthesized
gagactgagtctcactctgtcg

SEQ ID NO: 1255071 - DNA, 22 bp, Artificial Sequence
  chemically synthesized
tgagactgagtctcactctgtc

SEQ ID NO: 1255072 - DNA, 22 bp, Artificial Sequence
  chemically synthesized
ttgagactgagtctcactctgt

SEQ ID NO: 1255073 - DNA, 22 bp, Artificial Sequence
  chemically synthesized
tttgagactgagtctcactctg

SEQ ID NO: 1255074 - DNA, 22 bp, Artificial Sequence
  chemically synthesized
ttttgagactgagtctcactct

SEQ ID NO: 1255075 - DNA, 22 bp, Artificial Sequence
  chemically synthesized
tttttgagactgagtctcactc

SEQ ID NO: 1255076 - DNA, 22 bp, Artificial Sequence
  chemically synthesized
ttttttgagactgagtctcact

SEQ ID NO: 1255077 - DNA, 22 bp, Artificial Sequence
  chemically synthesized
tttttttgagactgagtctcac

SEQ ID NO: 1255078 - DNA, 22 bp, Artificial Sequence
  chemically synthesized
ttttttttgagactgagtctca

SEQ ID NO: 1255079 - DNA, 22 bp, Artificial Sequence
  chemically synthesized
tttttttttgagactgagtctc

SEQ ID NO: 1255080 - DNA, 22 bp, Artificial Sequence
  chemically synthesized
ggcgacagagtgagactcagtc

SEQ ID NO: 1255081 - DNA, 22 bp, Artificial Sequence
  chemically synthesized
ttttttttttgagactgagtct

SEQ ID NO: 1255082 - DNA, 22 bp, Artificial Sequence
  chemically synthesized
tttttttttttgagactgagtc

SEQ ID NO: 1255083 - DNA, 22 bp, Artificial Sequence
  chemically synthesized
ttttttttttttgagactgagt

SEQ ID NO: 1255084 - DNA, 22 bp, Artificial Sequence
  chemically synthesized
tttttttttttttgagactgag

SEQ ID NO: 1255085 - DNA, 22 bp, Artificial Sequence
  chemically synthesized
ttttttttttttttgagactga

SEQ ID NO: 1255086 - DNA, 22 bp, Artificial Sequence
  chemically synthesized
tttttttttttttttgagactg

SEQ ID NO: 1255087 - DNA, 22 bp, Artificial Sequence
  chemically synthesized
ttttttttttttttttgagact

SEQ ID NO: 1255088 - DNA, 22 bp, Artificial Sequence
  chemically synthesized
tttttttttttttttttgagac

SEQ ID NO: 1255089 - DNA, 22 bp, Artificial Sequence
  chemically synthesized
ttttttttttttttttttgaga

SEQ ID NO: 1255090 - DNA, 22 bp, Artificial Sequence
  chemically synthesized
tttttttttttttttttttgag

SEQ ID NO: 1255091 - DNA, 22 bp, Artificial Sequence
  chemically synthesized
tttttttttttttttttttttg

SEQ ID NO: 1255092 - DNA, 22 bp, Artificial Sequence
  chemically synthesized
cttttttttttttttttttttt

SEQ ID NO: 1255093 - DNA, 22 bp, Artificial Sequence
  chemically synthesized
gtttcttttttttttttttttt

SEQ ID NO: 1255094 - DNA, 22 bp, Artificial Sequence
  chemically synthesized
agtttctttttttttttttttt

SEQ ID NO: 1255095 - DNA, 22 bp, Artificial Sequence
  chemically synthesized
agtctcaaaaaaaaaaaaaaaa

SEQ ID NO: 1255096 - DNA, 22 bp, Artificial Sequence
  chemically synthesized
tagtttcttttttttttttttt

SEQ ID NO: 1255097 - DNA, 22 bp, Artificial Sequence
  chemically synthesized
ttagtttctttttttttttttt

SEQ ID NO: 1255098 - DNA, 22 bp, Artificial Sequence
  chemically synthesized
tttagtttcttttttttttttt

SEQ ID NO: 1255099 - DNA, 22 bp, Artificial Sequence
  chemically synthesized
tttttagtttcttttttttttt

SEQ ID NO: 1255100 - DNA, 22 bp, Artificial Sequence
  chemically synthesized
ctttttagtttctttttttttt

SEQ ID NO: 1255101 - DNA, 22 bp, Artificial Sequence
  chemically synthesized
aaaaaaaaaaaaaaaaaaaaag

SEQ ID NO: 1255102 - DNA, 22 bp, Artificial Sequence
  chemically synthesized
ataataaatgaaaatttctttt

SEQ ID NO: 1255103 - DNA, 22 bp, Artificial Sequence
  chemically synthesized
ctgataataaatgaaaatttct

SEQ ID NO: 1255104 - DNA, 22 bp, Artificial Sequence
  chemically synthesized
gttgctgataataaatgaaaat

SEQ ID NO: 1255105 - DNA, 22 bp, Artificial Sequence
  chemically synthesized
agttgctgataataaatgaaaa

SEQ ID NO: 1255106 - DNA, 22 bp, Artificial Sequence
  chemically synthesized
tagttgctgataataaatgaaa

SEQ ID NO: 1255107 - DNA, 22 bp, Artificial Sequence
  chemically synthesized
ttagttgctgataataaatgaa

SEQ ID NO: 1255108 - DNA, 22 bp, Artificial Sequence
  chemically synthesized
aaaagaaattttcatttattat

SEQ ID NO: 1255109 - DNA, 22 bp, Artificial Sequence
  chemically synthesized
atccttttagttgctgataata

SEQ ID NO: 1255110 - DNA, 22 bp, Artificial Sequence
  chemically synthesized
aatccttttagttgctgataat

SEQ ID NO: 1255111 - DNA, 22 bp, Artificial Sequence
  chemically synthesized
tacttaatccttttagttgctg

SEQ ID NO: 1255112 - DNA, 22 bp, Artificial Sequence
  chemically synthesized
tcatttattatcagcaactaaa

SEQ ID NO: 1255113 - DNA, 22 bp, Artificial Sequence
  chemically synthesized
gtacttaatccttttagttgct

SEQ ID NO: 1255114 - DNA, 22 bp, Artificial Sequence
  chemically synthesized
catttattatcagcaactaaaa

SEQ ID NO: 1255115 - DNA, 22 bp, Artificial Sequence
  chemically synthesized
tgtacttaatccttttagttgc

SEQ ID NO: 1255116 - DNA, 22 bp, Artificial Sequence
  chemically synthesized
atttattatcagcaactaaaag

SEQ ID NO: 1255117 - DNA, 22 bp, Artificial Sequence
  chemically synthesized
tctttgtacttaatccttttag

SEQ ID NO: 1255118 - DNA, 22 bp, Artificial Sequence
  chemically synthesized
attatcagcaactaaaaggatt

SEQ ID NO: 1255119 - DNA, 22 bp, Artificial Sequence
  chemically synthesized
ttatcagcaactaaaaggatta

SEQ ID NO: 1255120 - DNA, 22 bp, Artificial Sequence
  chemically synthesized
tcagcaactaaaaggattaagt

SEQ ID NO: 1255121 - DNA, 22 bp, Artificial Sequence
  chemically synthesized
cattatctttgtacttaatcct

SEQ ID NO: 1255122 - DNA, 22 bp, Artificial Sequence
  chemically synthesized
gttacattatctttgtacttaa

SEQ ID NO: 1255123 - DNA, 22 bp, Artificial Sequence
  chemically synthesized
agttacattatctttgtactta

SEQ ID NO: 1255124 - DNA, 22 bp, Artificial Sequence
  chemically synthesized
aaaggattaagtacaaagataa

SEQ ID NO: 1255125 - DNA, 22 bp, Artificial Sequence
  chemically synthesized
aatgcttagttacattatcttt

SEQ ID NO: 1255126 - DNA, 22 bp, Artificial Sequence
  chemically synthesized
taaatgcttagttacattatct

SEQ ID NO: 1255127 - DNA, 22 bp, Artificial Sequence
  chemically synthesized
agtacaaagataatgtaactaa

SEQ ID NO: 1255128 - DNA, 22 bp, Artificial Sequence
  chemically synthesized
ccctctaaatgcttagttacat

SEQ ID NO: 1255129 - DNA, 22 bp, Artificial Sequence
  chemically synthesized
cccctctaaatgcttagttaca

SEQ ID NO: 1255130 - DNA, 22 bp, Artificial Sequence
  chemically synthesized
cacataccagtcttcccctcta

SEQ ID NO: 1255131 - DNA, 22 bp, Artificial Sequence
  chemically synthesized
acacataccagtcttcccctct

SEQ ID NO: 1255132 - DNA, 22 bp, Artificial Sequence
  chemically synthesized
agcatttagaggggaagactgg

SEQ ID NO: 1255133 - DNA, 22 bp, Artificial Sequence
  chemically synthesized
agaggggaagactggtatgtgt

SEQ ID NO: 1255134 - DNA, 22 bp, Artificial Sequence
  chemically synthesized
taccatacccttacacatacca

SEQ ID NO: 1255135 - DNA, 22 bp, Artificial Sequence
  chemically synthesized
gaggggaagactggtatgtgta

SEQ ID NO: 1255136 - DNA, 22 bp, Artificial Sequence
  chemically synthesized
ataccatacccttacacatacc

SEQ ID NO: 1255137 - DNA, 22 bp, Artificial Sequence
  chemically synthesized
tataccatacccttacacatac

SEQ ID NO: 1255138 - DNA, 22 bp, Artificial Sequence
  chemically synthesized
ttataccatacccttacacata

SEQ ID NO: 1255139 - DNA, 22 bp, Artificial Sequence
  chemically synthesized
tgatttttataccataccctta

SEQ ID NO: 1255140 - DNA, 22 bp, Artificial Sequence
  chemically synthesized
gtatgtgtaagggtatggtata

SEQ ID NO: 1255141 - DNA, 22 bp, Artificial Sequence
  chemically synthesized
aagagttatgatttttatacca

SEQ ID NO: 1255142 - DNA, 22 bp, Artificial Sequence
  chemically synthesized
tgaagagttatgatttttatac

SEQ ID NO: 1255143 - DNA, 22 bp, Artificial Sequence
  chemically synthesized
ctgaagagttatgatttttata

SEQ ID NO: 1255144 - DNA, 22 bp, Artificial Sequence
  chemically synthesized
ttctgaagagttatgattttta

SEQ ID NO: 1255145 - DNA, 22 bp, Artificial Sequence
  chemically synthesized
cttctgaagagttatgattttt

SEQ ID NO: 1255146 - DNA, 22 bp, Artificial Sequence
  chemically synthesized
tttcttctgaagagttatgatt

SEQ ID NO: 1255147 - DNA, 22 bp, Artificial Sequence
  chemically synthesized
gtttcttctgaagagttatgat

SEQ ID NO: 1255148 - DNA, 22 bp, Artificial Sequence
  chemically synthesized
tgtttcttctgaagagttatga

SEQ ID NO: 1255149 - DNA, 22 bp, Artificial Sequence
  chemically synthesized
aaaagtctttgtttcttctgaa

SEQ ID NO: 1255150 - DNA, 22 bp, Artificial Sequence
  chemically synthesized
ttcaaaagtctttgtttcttct

SEQ ID NO: 1255151 - DNA, 22 bp, Artificial Sequence
  chemically synthesized
caattattcaaaagtctttgtt

SEQ ID NO: 1255152 - DNA, 22 bp, Artificial Sequence
  chemically synthesized
ttcagaagaaacaaagactttt

SEQ ID NO: 1255153 - DNA, 22 bp, Artificial Sequence
  chemically synthesized
attgcaattattcaaaagtctt

SEQ ID NO: 1255154 - DNA, 22 bp, Artificial Sequence
  chemically synthesized
cagaagaaacaaagacttttga

SEQ ID NO: 1255155 - DNA, 22 bp, Artificial Sequence
  chemically synthesized
cattgcaattattcaaaagtct

SEQ ID NO: 1255156 - DNA, 22 bp, Artificial Sequence
  chemically synthesized
agaagaaacaaagacttttgaa

SEQ ID NO: 1255157 - DNA, 22 bp, Artificial Sequence
  chemically synthesized
catacatttcattgcaattatt

SEQ ID NO: 1255158 - DNA, 22 bp, Artificial Sequence
  chemically synthesized
cctacatacatttcattgcaat

SEQ ID NO: 1255159 - DNA, 22 bp, Artificial Sequence
  chemically synthesized
ttgaataattgcaatgaaatgt

SEQ ID NO: 1255160 - DNA, 22 bp, Artificial Sequence
  chemically synthesized
tgaataattgcaatgaaatgta

SEQ ID NO: 1255161 - DNA, 22 bp, Artificial Sequence
  chemically synthesized
gaataattgcaatgaaatgtat

SEQ ID NO: 1255162 - DNA, 22 bp, Artificial Sequence
  chemically synthesized
aataattgcaatgaaatgtatg

SEQ ID NO: 1255163 - DNA, 22 bp, Artificial Sequence
  chemically synthesized
cccaccctacctacatacattt

SEQ ID NO: 1255164 - DNA, 22 bp, Artificial Sequence
  chemically synthesized
ccccaccctacctacatacatt

SEQ ID NO: 1255165 - DNA, 22 bp, Artificial Sequence
  chemically synthesized
tccccaccctacctacatacat

SEQ ID NO: 1255166 - DNA, 22 bp, Artificial Sequence
  chemically synthesized
ttccccaccctacctacataca

SEQ ID NO: 1255167 - DNA, 22 bp, Artificial Sequence
  chemically synthesized
tttccccaccctacctacatac

SEQ ID NO: 1255168 - DNA, 22 bp, Artificial Sequence
  chemically synthesized
caatgaaatgtatgtaggtagg

SEQ ID NO: 1255169 - DNA, 22 bp, Artificial Sequence
  chemically synthesized
ccactttttccccaccctacct

SEQ ID NO: 1255170 - DNA, 22 bp, Artificial Sequence
  chemically synthesized
tcccactttttccccaccctac

SEQ ID NO: 1255171 - DNA, 22 bp, Artificial Sequence
  chemically synthesized
ctcccactttttccccacccta

SEQ ID NO: 1255172 - DNA, 22 bp, Artificial Sequence
  chemically synthesized
ttctcccactttttccccaccc

SEQ ID NO: 1255173 - DNA, 22 bp, Artificial Sequence
  chemically synthesized
cttctcccactttttccccacc

SEQ ID NO: 1255174 - DNA, 22 bp, Artificial Sequence
  chemically synthesized
ccttcttctcccactttttccc

SEQ ID NO: 1255175 - DNA, 22 bp, Artificial Sequence
  chemically synthesized
taattcccttcttctcccactt

SEQ ID NO: 1255176 - DNA, 22 bp, Artificial Sequence
  chemically synthesized
ctgtaattcccttcttctccca

SEQ ID NO: 1255177 - DNA, 22 bp, Artificial Sequence
  chemically synthesized
tgctgtaattcccttcttctcc

SEQ ID NO: 1255178 - DNA, 22 bp, Artificial Sequence
  chemically synthesized
ctctgctgtaattcccttcttc

SEQ ID NO: 1255179 - DNA, 22 bp, Artificial Sequence
  chemically synthesized
gcctcctctgctgtaattccct

SEQ ID NO: 1255180 - DNA, 22 bp, Artificial Sequence
  chemically synthesized
cctcgcctcctctgctgtaatt

SEQ ID NO: 1255181 - DNA, 22 bp, Artificial Sequence
  chemically synthesized
tacctcgcctcctctgctgtaa

SEQ ID NO: 1255182 - DNA, 22 bp, Artificial Sequence
  chemically synthesized
ctctacctcgcctcctctgctg

SEQ ID NO: 1255183 - DNA, 22 bp, Artificial Sequence
  chemically synthesized
cctctacctcgcctcctctgct

SEQ ID NO: 1255184 - DNA, 22 bp, Artificial Sequence
  chemically synthesized
ccttcctctacctcgcctcctc

SEQ ID NO: 1255185 - DNA, 22 bp, Artificial Sequence
  chemically synthesized
gccttcctctacctcgcctcct

SEQ ID NO: 1255186 - DNA, 22 bp, Artificial Sequence
  chemically synthesized
tgccttcctctacctcgcctcc

SEQ ID NO: 1255187 - DNA, 22 bp, Artificial Sequence
  chemically synthesized
ttgccttcctctacctcgcctc

SEQ ID NO: 1255188 - DNA, 22 bp, Artificial Sequence
  chemically synthesized
cagcagaggaggcgaggtagag

SEQ ID NO: 1255189 - DNA, 22 bp, Artificial Sequence
  chemically synthesized
gtttttgccttcctctacctcg

SEQ ID NO: 1255190 - DNA, 22 bp, Artificial Sequence
  chemically synthesized
ggtttttgccttcctctacctc

SEQ ID NO: 1255191 - DNA, 22 bp, Artificial Sequence
  chemically synthesized
taatttggtttttgccttcctc

SEQ ID NO: 1255192 - DNA, 22 bp, Artificial Sequence
  chemically synthesized
gtaatttggtttttgccttcct

SEQ ID NO: 1255193 - DNA, 22 bp, Artificial Sequence
  chemically synthesized
tgtaatttggtttttgccttcc

SEQ ID NO: 1255194 - DNA, 22 bp, Artificial Sequence
  chemically synthesized
cacaaaatgccctttgtaattt

SEQ ID NO: 1255195 - DNA, 22 bp, Artificial Sequence
  chemically synthesized
agcattgcacaaaatgcccttt

SEQ ID NO: 1255196 - DNA, 22 bp, Artificial Sequence
  chemically synthesized
caaagggcattttgtgcaatgc

SEQ ID NO: 1255197 - DNA, 22 bp, Artificial Sequence
  chemically synthesized
taaaaataaacccctcagcatt

SEQ ID NO: 1255198 - DNA, 22 bp, Artificial Sequence
  chemically synthesized
ttataaaaataaacccctcagc

SEQ ID NO: 1255199 - DNA, 22 bp, Artificial Sequence
  chemically synthesized
attataaaaataaacccctcag

SEQ ID NO: 1255200 - DNA, 22 bp, Artificial Sequence
  chemically synthesized
tattataaaaataaacccctca

SEQ ID NO: 1255201 - DNA, 22 bp, Artificial Sequence
  chemically synthesized
ttattataaaaataaacccctc

SEQ ID NO: 1255202 - DNA, 22 bp, Artificial Sequence
  chemically synthesized
tgtgcaatgctgaggggtttat

SEQ ID NO: 1255203 - DNA, 22 bp, Artificial Sequence
  chemically synthesized
gtgcaatgctgaggggtttatt

SEQ ID NO: 1255204 - DNA, 22 bp, Artificial Sequence
  chemically synthesized
tgcaatgctgaggggtttattt

SEQ ID NO: 1255205 - DNA, 22 bp, Artificial Sequence
  chemically synthesized
cagcttttattataaaaataaa

SEQ ID NO: 1255206 - DNA, 22 bp, Artificial Sequence
  chemically synthesized
cctacagcttttattataaaaa

SEQ ID NO: 1255207 - DNA, 22 bp, Artificial Sequence
  chemically synthesized
ccctacagcttttattataaaa

SEQ ID NO: 1255208 - DNA, 22 bp, Artificial Sequence
  chemically synthesized
aggggtttatttttataataaa

SEQ ID NO: 1255209 - DNA, 22 bp, Artificial Sequence
  chemically synthesized
acgtttccctacagcttttatt

SEQ ID NO: 1255210 - DNA, 22 bp, Artificial Sequence
  chemically synthesized
aacgtttccctacagcttttat

SEQ ID NO: 1255211 - DNA, 22 bp, Artificial Sequence
  chemically synthesized
taacgtttccctacagctttta

SEQ ID NO: 1255212 - DNA, 22 bp, Artificial Sequence
  chemically synthesized
atttttataataaaagctgtag

SEQ ID NO: 1255213 - DNA, 22 bp, Artificial Sequence
  chemically synthesized
tttttataataaaagctgtagg

SEQ ID NO: 1255214 - DNA, 22 bp, Artificial Sequence
  chemically synthesized
ttataataaaagctgtagggaa

SEQ ID NO: 1255215 - DNA, 22 bp, Artificial Sequence
  chemically synthesized
tataataaaagctgtagggaaa

SEQ ID NO: 1255216 - DNA, 22 bp, Artificial Sequence
  chemically synthesized
ataataaaagctgtagggaaac

SEQ ID NO: 1255217 - DNA, 22 bp, Artificial Sequence
  chemically synthesized
taataaaagctgtagggaaacg

SEQ ID NO: 1255218 - DNA, 22 bp, Artificial Sequence
  chemically synthesized
gaaaccaatgctttaacgtttc

SEQ ID NO: 1255219 - DNA, 22 bp, Artificial Sequence
  chemically synthesized
ggaaaccaatgctttaacgttt

SEQ ID NO: 1255220 - DNA, 22 bp, Artificial Sequence
  chemically synthesized
ggcttggaaaccaatgctttaa

SEQ ID NO: 1255221 - DNA, 22 bp, Artificial Sequence
  chemically synthesized
tagggaaacgttaaagcattgg

SEQ ID NO: 1255222 - DNA, 22 bp, Artificial Sequence
  chemically synthesized
agctaggcttggaaaccaatgc

SEQ ID NO: 1255223 - DNA, 22 bp, Artificial Sequence
  chemically synthesized
taatgctcagctaggcttggaa

SEQ ID NO: 1255224 - DNA, 22 bp, Artificial Sequence
  chemically synthesized
aagcattggtttccaagcctag

SEQ ID NO: 1255225 - DNA, 22 bp, Artificial Sequence
  chemically synthesized
ggtaactgtaatgctcagctag

SEQ ID NO: 1255226 - DNA, 22 bp, Artificial Sequence
  chemically synthesized
gtttccaagcctagctgagcat

SEQ ID NO: 1255227 - DNA, 22 bp, Artificial Sequence
  chemically synthesized
cctgggtaactgtaatgctcag

SEQ ID NO: 1255228 - DNA, 22 bp, Artificial Sequence
  chemically synthesized
ccaagcctagctgagcattaca

SEQ ID NO: 1255229 - DNA, 22 bp, Artificial Sequence
  chemically synthesized
caagcctagctgagcattacag

SEQ ID NO: 1255230 - DNA, 22 bp, Artificial Sequence
  chemically synthesized
agaaagctccctgggtaactgt

SEQ ID NO: 1255231 - DNA, 22 bp, Artificial Sequence
  chemically synthesized
aagaaagctccctgggtaactg

SEQ ID NO: 1255232 - DNA, 22 bp, Artificial Sequence
  chemically synthesized
gctgagcattacagttacccag

SEQ ID NO: 1255233 - DNA, 22 bp, Artificial Sequence
  chemically synthesized
taagaaagctccctgggtaact

SEQ ID NO: 1255234 - DNA, 22 bp, Artificial Sequence
  chemically synthesized
agcattacagttacccagggag

SEQ ID NO: 1255235 - DNA, 22 bp, Artificial Sequence
  chemically synthesized
cagttacccagggagctttctt

SEQ ID NO: 1255236 - DNA, 22 bp, Artificial Sequence
  chemically synthesized
ggagtgagcattttaagaaagc

SEQ ID NO: 1255237 - DNA, 22 bp, Artificial Sequence
  chemically synthesized
cccagggagctttcttaaaatg

SEQ ID NO: 1255238 - DNA, 22 bp, Artificial Sequence
  chemically synthesized
ggtatgagggactgggagtgag

SEQ ID NO: 1255239 - DNA, 22 bp, Artificial Sequence
  chemically synthesized
tcttaaaatgctcactcccagt

SEQ ID NO: 1255240 - DNA, 22 bp, Artificial Sequence
  chemically synthesized
tgggtatgagggactgggagtg

SEQ ID NO: 1255241 - DNA, 22 bp, Artificial Sequence
  chemically synthesized
cttaaaatgctcactcccagtc

SEQ ID NO: 1255242 - DNA, 22 bp, Artificial Sequence
  chemically synthesized
ttaaaatgctcactcccagtcc

SEQ ID NO: 1255243 - DNA, 22 bp, Artificial Sequence
  chemically synthesized
aaaatgctcactcccagtccct

SEQ ID NO: 1255244 - DNA, 22 bp, Artificial Sequence
  chemically synthesized
aaatgctcactcccagtccctc

SEQ ID NO: 1255245 - DNA, 22 bp, Artificial Sequence
  chemically synthesized
aatcagaatctctgggtatgag

SEQ ID NO: 1255246 - DNA, 22 bp, Artificial Sequence
  chemically synthesized
actcccagtccctcatacccag

SEQ ID NO: 1255247 - DNA, 22 bp, Artificial Sequence
  chemically synthesized
ccagtccctcatacccagagat

SEQ ID NO: 1255248 - DNA, 22 bp, Artificial Sequence
  chemically synthesized
atacccagagattctgatttaa

SEQ ID NO: 1255249 - DNA, 22 bp, Artificial Sequence
  chemically synthesized
cacccaagataaattaaatcag

SEQ ID NO: 1255250 - DNA, 22 bp, Artificial Sequence
  chemically synthesized
tgatttaatttatcttgggtgg

SEQ ID NO: 1255251 - DNA, 22 bp, Artificial Sequence
  chemically synthesized
atttaatttatcttgggtggag

SEQ ID NO: 1255252 - DNA, 22 bp, Artificial Sequence
  chemically synthesized
aatttatcttgggtggagcctg

SEQ ID NO: 1255253 - DNA, 22 bp, Artificial Sequence
  chemically synthesized
atttatcttgggtggagcctgg

SEQ ID NO: 1255254 - DNA, 22 bp, Artificial Sequence
  chemically synthesized
catgtgaaaatcaccaggctcc

SEQ ID NO: 1255255 - DNA, 22 bp, Artificial Sequence
  chemically synthesized
atcttgggtggagcctggtgat

SEQ ID NO: 1255256 - DNA, 22 bp, Artificial Sequence
  chemically synthesized
tcttgggtggagcctggtgatt

SEQ ID NO: 1255257 - DNA, 22 bp, Artificial Sequence
  chemically synthesized
gctacatgtgaaaatcaccagg

SEQ ID NO: 1255258 - DNA, 22 bp, Artificial Sequence
  chemically synthesized
agctacatgtgaaaatcaccag

SEQ ID NO: 1255259 - DNA, 22 bp, Artificial Sequence
  chemically synthesized
gggtggagcctggtgattttca

SEQ ID NO: 1255260 - DNA, 22 bp, Artificial Sequence
  chemically synthesized
ggtggagcctggtgattttcac

SEQ ID NO: 1255261 - DNA, 22 bp, Artificial Sequence
  chemically synthesized
gcaaccttagctacatgtgaaa

SEQ ID NO: 1255262 - DNA, 22 bp, Artificial Sequence
  chemically synthesized
gtgattttcacatgtagctaag

SEQ ID NO: 1255263 - DNA, 22 bp, Artificial Sequence
  chemically synthesized
acacagccgttagcaaccttag

SEQ ID NO: 1255264 - DNA, 22 bp, Artificial Sequence
  chemically synthesized
tcacatgtagctaaggttgcta

SEQ ID NO: 1255265 - DNA, 22 bp, Artificial Sequence
  chemically synthesized
cacatgtagctaaggttgctaa

SEQ ID NO: 1255266 - DNA, 22 bp, Artificial Sequence
  chemically synthesized
acatgtagctaaggttgctaac

SEQ ID NO: 1255267 - DNA, 22 bp, Artificial Sequence
  chemically synthesized
aaatccattaacacagccgtta

SEQ ID NO: 1255268 - DNA, 22 bp, Artificial Sequence
  chemically synthesized
aaaatccattaacacagccgtt

SEQ ID NO: 1255269 - DNA, 22 bp, Artificial Sequence
  chemically synthesized
cttaaaatccattaacacagcc

SEQ ID NO: 1255270 - DNA, 22 bp, Artificial Sequence
  chemically synthesized
aggttgctaacggctgtgttaa

SEQ ID NO: 1255271 - DNA, 22 bp, Artificial Sequence
  chemically synthesized
acttaaaatccattaacacagc

SEQ ID NO: 1255272 - DNA, 22 bp, Artificial Sequence
  chemically synthesized
ctaacggctgtgttaatggatt

SEQ ID NO: 1255273 - DNA, 22 bp, Artificial Sequence
  chemically synthesized
tgtagtttacttaaaatccatt

SEQ ID NO: 1255274 - DNA, 22 bp, Artificial Sequence
  chemically synthesized
acggctgtgttaatggatttta

SEQ ID NO: 1255275 - DNA, 22 bp, Artificial Sequence
  chemically synthesized
attgtgtagtttacttaaaatc

SEQ ID NO: 1255276 - DNA, 22 bp, Artificial Sequence
  chemically synthesized
tgttaatggattttaagtaaac

SEQ ID NO: 1255277 - DNA, 22 bp, Artificial Sequence
  chemically synthesized
atggattttaagtaaactacac

SEQ ID NO: 1255278 - DNA, 22 bp, Artificial Sequence
  chemically synthesized
cacaatataaatctgattgtgt

SEQ ID NO: 1255279 - DNA, 22 bp, Artificial Sequence
  chemically synthesized
taagtaaactacacaatcagat

SEQ ID NO: 1255280 - DNA, 22 bp, Artificial Sequence
  chemically synthesized
aagtaaactacacaatcagatt

SEQ ID NO: 1255281 - DNA, 22 bp, Artificial Sequence
  chemically synthesized
agtaaactacacaatcagattt

SEQ ID NO: 1255282 - DNA, 22 bp, Artificial Sequence
  chemically synthesized
attccacaatataaatctgatt

SEQ ID NO: 1255283 - DNA, 22 bp, Artificial Sequence
  chemically synthesized
gtgttcattccacaatataaat

SEQ ID NO: 1255284 - DNA, 22 bp, Artificial Sequence
  chemically synthesized
cacaatcagatttatattgtgg

SEQ ID NO: 1255285 - DNA, 22 bp, Artificial Sequence
  chemically synthesized
ccaggattagtgttcattccac

SEQ ID NO: 1255286 - DNA, 22 bp, Artificial Sequence
  chemically synthesized
atattgtggaatgaacactaat

SEQ ID NO: 1255287 - DNA, 22 bp, Artificial Sequence
  chemically synthesized
aatactgccaggattagtgttc

SEQ ID NO: 1255288 - DNA, 22 bp, Artificial Sequence
  chemically synthesized
tattgtggaatgaacactaatc

SEQ ID NO: 1255289 - DNA, 22 bp, Artificial Sequence
  chemically synthesized
tggaatgaacactaatcctggc

SEQ ID NO: 1255290 - DNA, 22 bp, Artificial Sequence
  chemically synthesized
caaaatcagtctaaatactgcc

SEQ ID NO: 1255291 - DNA, 22 bp, Artificial Sequence
  chemically synthesized
ttccaaaatcagtctaaatact

SEQ ID NO: 1255292 - DNA, 22 bp, Artificial Sequence
  chemically synthesized
atcctggcagtatttagactga

SEQ ID NO: 1255293 - DNA, 22 bp, Artificial Sequence
  chemically synthesized
gtctattccaaaatcagtctaa

SEQ ID NO: 1255294 - DNA, 22 bp, Artificial Sequence
  chemically synthesized
agtctattccaaaatcagtcta

SEQ ID NO: 1255295 - DNA, 22 bp, Artificial Sequence
  chemically synthesized
gcagtatttagactgattttgg

SEQ ID NO: 1255296 - DNA, 22 bp, Artificial Sequence
  chemically synthesized
agactgattttggaatagacta

SEQ ID NO: 1255297 - DNA, 22 bp, Artificial Sequence
  chemically synthesized
gactgattttggaatagactaa

SEQ ID NO: 1255298 - DNA, 22 bp, Artificial Sequence
  chemically synthesized
attttggaatagactaaactgc

SEQ ID NO: 1255299 - DNA, 22 bp, Artificial Sequence
  chemically synthesized
tggaatagactaaactgcactg

SEQ ID NO: 1255300 - DNA, 22 bp, Artificial Sequence
  chemically synthesized
ggaatagactaaactgcactgg

SEQ ID NO: 1255301 - DNA, 22 bp, Artificial Sequence
  chemically synthesized
gaatagactaaactgcactgga

SEQ ID NO: 1255302 - DNA, 22 bp, Artificial Sequence
  chemically synthesized
taatgataatatcataagaaat

SEQ ID NO: 1255303 - DNA, 22 bp, Artificial Sequence
  chemically synthesized
aactgcactggatttcttatga

SEQ ID NO: 1255304 - DNA, 22 bp, Artificial Sequence
  chemically synthesized
tattataatgataatatcataa

SEQ ID NO: 1255305 - DNA, 22 bp, Artificial Sequence
  chemically synthesized
cactggatttcttatgatatta

SEQ ID NO: 1255306 - DNA, 22 bp, Artificial Sequence
  chemically synthesized
ctatattataatgataatatca

SEQ ID NO: 1255307 - DNA, 22 bp, Artificial Sequence
  chemically synthesized
cctatattataatgataatatc

SEQ ID NO: 1255308 - DNA, 22 bp, Artificial Sequence
  chemically synthesized
tcctatattataatgataatat

SEQ ID NO: 1255309 - DNA, 22 bp, Artificial Sequence
  chemically synthesized
gatttcttatgatattatcatt

SEQ ID NO: 1255310 - DNA, 22 bp, Artificial Sequence
  chemically synthesized
tttcctatattataatgataat

SEQ ID NO: 1255311 - DNA, 22 bp, Artificial Sequence
  chemically synthesized
ctttcctatattataatgataa

SEQ ID NO: 1255312 - DNA, 22 bp, Artificial Sequence
  chemically synthesized
cttatgatattatcattataat

SEQ ID NO: 1255313 - DNA, 22 bp, Artificial Sequence
  chemically synthesized
ttatgatattatcattataata

SEQ ID NO: 1255314 - DNA, 22 bp, Artificial Sequence
  chemically synthesized
atgatattatcattataatata

SEQ ID NO: 1255315 - DNA, 22 bp, Artificial Sequence
  chemically synthesized
tgatattatcattataatatag

SEQ ID NO: 1255316 - DNA, 22 bp, Artificial Sequence
  chemically synthesized
aggtcttctttcctatattata

SEQ ID NO: 1255317 - DNA, 22 bp, Artificial Sequence
  chemically synthesized
caggtcttctttcctatattat

SEQ ID NO: 1255318 - DNA, 22 bp, Artificial Sequence
  chemically synthesized
gatcttcaggtcttctttccta

SEQ ID NO: 1255319 - DNA, 22 bp, Artificial Sequence
  chemically synthesized
tcattataatataggaaagaag

SEQ ID NO: 1255320 - DNA, 22 bp, Artificial Sequence
  chemically synthesized
agatcttcaggtcttctttcct

SEQ ID NO: 1255321 - DNA, 22 bp, Artificial Sequence
  chemically synthesized
tagatcttcaggtcttctttcc

SEQ ID NO: 1255322 - DNA, 22 bp, Artificial Sequence
  chemically synthesized
actttagatcttcaggtcttct

SEQ ID NO: 1255323 - DNA, 22 bp, Artificial Sequence
  chemically synthesized
taatataggaaagaagacctga

SEQ ID NO: 1255324 - DNA, 22 bp, Artificial Sequence
  chemically synthesized
cactttagatcttcaggtcttc

SEQ ID NO: 1255325 - DNA, 22 bp, Artificial Sequence
  chemically synthesized
gcttcactttagatcttcaggt

SEQ ID NO: 1255326 - DNA, 22 bp, Artificial Sequence
  chemically synthesized
cctggcttcactttagatcttc

SEQ ID NO: 1255327 - DNA, 22 bp, Artificial Sequence
  chemically synthesized
ctacctggcttcactttagatc

SEQ ID NO: 1255328 - DNA, 22 bp, Artificial Sequence
  chemically synthesized
actacctggcttcactttagat

SEQ ID NO: 1255329 - DNA, 22 bp, Artificial Sequence
  chemically synthesized
aagatctaaagtgaagccaggt

SEQ ID NO: 1255330 - DNA, 22 bp, Artificial Sequence
  chemically synthesized
tccatccttactacctggcttc

SEQ ID NO: 1255331 - DNA, 22 bp, Artificial Sequence
  chemically synthesized
atccatccttactacctggctt

SEQ ID NO: 1255332 - DNA, 22 bp, Artificial Sequence
  chemically synthesized
cttatccatccttactacctgg

SEQ ID NO: 1255333 - DNA, 22 bp, Artificial Sequence
  chemically synthesized
aagtgaagccaggtagtaagga

SEQ ID NO: 1255334 - DNA, 22 bp, Artificial Sequence
  chemically synthesized
ccactccttatccatccttact

SEQ ID NO: 1255335 - DNA, 22 bp, Artificial Sequence
  chemically synthesized
tgaatgccactcccactcctta

SEQ ID NO: 1255336 - DNA, 22 bp, Artificial Sequence
  chemically synthesized
aaactatgaatgccactcccac

SEQ ID NO: 1255337 - DNA, 22 bp, Artificial Sequence
  chemically synthesized
cagtcgcattaaaactatgaat

SEQ ID NO: 1255338 - DNA, 22 bp, Artificial Sequence
  chemically synthesized
gtgttccagtcgcattaaaact

SEQ ID NO: 1255339 - DNA, 22 bp, Artificial Sequence
  chemically synthesized
tcgtgttccagtcgcattaaaa

SEQ ID NO: 1255340 - DNA, 22 bp, Artificial Sequence
  chemically synthesized
ctcgtgttccagtcgcattaaa

SEQ ID NO: 1255341 - DNA, 22 bp, Artificial Sequence
  chemically synthesized
cttctcgtgttccagtcgcatt

SEQ ID NO: 1255342 - DNA, 22 bp, Artificial Sequence
  chemically synthesized
gcttctcgtgttccagtcgcat

SEQ ID NO: 1255343 - DNA, 22 bp, Artificial Sequence
  chemically synthesized
atagttttaatgcgactggaac

SEQ ID NO: 1255344 - DNA, 22 bp, Artificial Sequence
  chemically synthesized
tgatatcttgcttctcgtgttc

SEQ ID NO: 1255345 - DNA, 22 bp, Artificial Sequence
  chemically synthesized
taatgcgactggaacacgagaa

SEQ ID NO: 1255346 - DNA, 22 bp, Artificial Sequence
  chemically synthesized
aatgcgactggaacacgagaag

SEQ ID NO: 1255347 - DNA, 22 bp, Artificial Sequence
  chemically synthesized
atgcgactggaacacgagaagc

SEQ ID NO: 1255348 - DNA, 22 bp, Artificial Sequence
  chemically synthesized
taatcactatgatatcttgctt

SEQ ID NO: 1255349 - DNA, 22 bp, Artificial Sequence
  chemically synthesized
ataatcactatgatatcttgct

SEQ ID NO: 1255350 - DNA, 22 bp, Artificial Sequence
  chemically synthesized
gaacacgagaagcaagatatca

SEQ ID NO: 1255351 - DNA, 22 bp, Artificial Sequence
  chemically synthesized
gagtcaatatttataatcacta

SEQ ID NO: 1255352 - DNA, 22 bp, Artificial Sequence
  chemically synthesized
aattcgagtcaatatttataat

SEQ ID NO: 1255353 - DNA, 22 bp, Artificial Sequence
  chemically synthesized
gaattcgagtcaatatttataa

SEQ ID NO: 1255354 - DNA, 22 bp, Artificial Sequence
  chemically synthesized
taaatattgactcgaattcaaa

SEQ ID NO: 1255355 - DNA, 22 bp, Artificial Sequence
  chemically synthesized
actcgaattcaaactctactcc

SEQ ID NO: 1255356 - DNA, 22 bp, Artificial Sequence
  chemically synthesized
gaattcaaactctactcctgcc

SEQ ID NO: 1255357 - DNA, 22 bp, Artificial Sequence
  chemically synthesized
acacaacaacaaagtggcagga

SEQ ID NO: 1255358 - DNA, 22 bp, Artificial Sequence
  chemically synthesized
aaactctactcctgccactttg

SEQ ID NO: 1255359 - DNA, 22 bp, Artificial Sequence
  chemically synthesized
agttcacacaacaacaaagtgg

SEQ ID NO: 1255360 - DNA, 22 bp, Artificial Sequence
  chemically synthesized
tactcctgccactttgttgttg

SEQ ID NO: 1255361 - DNA, 22 bp, Artificial Sequence
  chemically synthesized
tctaagttcacacaacaacaaa

SEQ ID NO: 1255362 - DNA, 22 bp, Artificial Sequence
  chemically synthesized
gtctaagttcacacaacaacaa

SEQ ID NO: 1255363 - DNA, 22 bp, Artificial Sequence
  chemically synthesized
ctcctgccactttgttgttgtg

SEQ ID NO: 1255364 - DNA, 22 bp, Artificial Sequence
  chemically synthesized
ctgccactttgttgttgtgtga

SEQ ID NO: 1255365 - DNA, 22 bp, Artificial Sequence
  chemically synthesized
ccactttgttgttgtgtgaact

SEQ ID NO: 1255366 - DNA, 22 bp, Artificial Sequence
  chemically synthesized
agtaacttgtctaagttcacac

SEQ ID NO: 1255367 - DNA, 22 bp, Artificial Sequence
  chemically synthesized
tgttgttgtgtgaacttagaca

SEQ ID NO: 1255368 - DNA, 22 bp, Artificial Sequence
  chemically synthesized
gttgttgtgtgaacttagacaa

SEQ ID NO: 1255369 - DNA, 22 bp, Artificial Sequence
  chemically synthesized
ttgttgtgtgaacttagacaag

SEQ ID NO: 1255370 - DNA, 22 bp, Artificial Sequence
  chemically synthesized
gagtggttaagtaacttgtcta

SEQ ID NO: 1255371 - DNA, 22 bp, Artificial Sequence
  chemically synthesized
ttgtgtgaacttagacaagtta

SEQ ID NO: 1255372 - DNA, 22 bp, Artificial Sequence
  chemically synthesized
agagtggttaagtaacttgtct

SEQ ID NO: 1255373 - DNA, 22 bp, Artificial Sequence
  chemically synthesized
tgtgaacttagacaagttactt

SEQ ID NO: 1255374 - DNA, 22 bp, Artificial Sequence
  chemically synthesized
agacaagttacttaaccactct

SEQ ID NO: 1255375 - DNA, 22 bp, Artificial Sequence
  chemically synthesized
gacaagttacttaaccactcta

SEQ ID NO: 1255376 - DNA, 22 bp, Artificial Sequence
  chemically synthesized
cttaaccactctaagtctcttt

SEQ ID NO: 1255377 - DNA, 22 bp, Artificial Sequence
  chemically synthesized
acatatgagcaaaaagagactt

SEQ ID NO: 1255378 - DNA, 22 bp, Artificial Sequence
  chemically synthesized
cacatatgagcaaaaagagact

SEQ ID NO: 1255379 - DNA, 22 bp, Artificial Sequence
  chemically synthesized
aaccactctaagtctctttttg

SEQ ID NO: 1255380 - DNA, 22 bp, Artificial Sequence
  chemically synthesized
accactctaagtctctttttgc

SEQ ID NO: 1255381 - DNA, 22 bp, Artificial Sequence
  chemically synthesized
catttcacatatgagcaaaaag

SEQ ID NO: 1255382 - DNA, 22 bp, Artificial Sequence
  chemically synthesized
ccatttcacatatgagcaaaaa

SEQ ID NO: 1255383 - DNA, 22 bp, Artificial Sequence
  chemically synthesized
tttccatttcacatatgagcaa

SEQ ID NO: 1255384 - DNA, 22 bp, Artificial Sequence
  chemically synthesized
taagtctctttttgctcatatg

SEQ ID NO: 1255385 - DNA, 22 bp, Artificial Sequence
  chemically synthesized
agtctctttttgctcatatgtg

SEQ ID NO: 1255386 - DNA, 22 bp, Artificial Sequence
  chemically synthesized
ttatttccatttcacatatgag

SEQ ID NO: 1255387 - DNA, 22 bp, Artificial Sequence
  chemically synthesized
ttattatttccatttcacatat

SEQ ID NO: 1255388 - DNA, 22 bp, Artificial Sequence
  chemically synthesized
tttttgctcatatgtgaaatgg

SEQ ID NO: 1255389 - DNA, 22 bp, Artificial Sequence
  chemically synthesized
tttgctcatatgtgaaatggaa

SEQ ID NO: 1255390 - DNA, 22 bp, Artificial Sequence
  chemically synthesized
ttgctcatatgtgaaatggaaa

SEQ ID NO: 1255391 - DNA, 22 bp, Artificial Sequence
  chemically synthesized
tgctcatatgtgaaatggaaat

SEQ ID NO: 1255392 - DNA, 22 bp, Artificial Sequence
  chemically synthesized
gctcatatgtgaaatggaaata

SEQ ID NO: 1255393 - DNA, 22 bp, Artificial Sequence
  chemically synthesized
ctcatatgtgaaatggaaataa

SEQ ID NO: 1255394 - DNA, 22 bp, Artificial Sequence
  chemically synthesized
tggtgcagctattattatttcc

SEQ ID NO: 1255395 - DNA, 22 bp, Artificial Sequence
  chemically synthesized
atatgtgaaatggaaataataa

SEQ ID NO: 1255396 - DNA, 22 bp, Artificial Sequence
  chemically synthesized
tgtggtgcagctattattattt

SEQ ID NO: 1255397 - DNA, 22 bp, Artificial Sequence
  chemically synthesized
ctgtggtgcagctattattatt

SEQ ID NO: 1255398 - DNA, 22 bp, Artificial Sequence
  chemically synthesized
aaaatttctgtggtgcagctat

SEQ ID NO: 1255399 - DNA, 22 bp, Artificial Sequence
  chemically synthesized
acagttgaaaatttctgtggtg

SEQ ID NO: 1255400 - DNA, 22 bp, Artificial Sequence
  chemically synthesized
gacagttgaaaatttctgtggt

SEQ ID NO: 1255401 - DNA, 22 bp, Artificial Sequence
  chemically synthesized
gtttgacagttgaaaatttctg

SEQ ID NO: 1255402 - DNA, 22 bp, Artificial Sequence
  chemically synthesized
cctggtttgacagttgaaaatt

SEQ ID NO: 1255403 - DNA, 22 bp, Artificial Sequence
  chemically synthesized
acctggtttgacagttgaaaat

SEQ ID NO: 1255404 - DNA, 22 bp, Artificial Sequence
  chemically synthesized
caccacagaaattttcaactgt

SEQ ID NO: 1255405 - DNA, 22 bp, Artificial Sequence
  chemically synthesized
cttacctggtttgacagttgaa

SEQ ID NO: 1255406 - DNA, 22 bp, Artificial Sequence
  chemically synthesized
ccttacctggtttgacagttga

SEQ ID NO: 1255407 - DNA, 22 bp, Artificial Sequence
  chemically synthesized
acttccttacctggtttgacag

SEQ ID NO: 1255408 - DNA, 22 bp, Artificial Sequence
  chemically synthesized
ttaacttccttacctggtttga

SEQ ID NO: 1255409 - DNA, 22 bp, Artificial Sequence
  chemically synthesized
tcaactgtcaaaccaggtaagg

SEQ ID NO: 1255410 - DNA, 22 bp, Artificial Sequence
  chemically synthesized
caactgtcaaaccaggtaagga

SEQ ID NO: 1255411 - DNA, 22 bp, Artificial Sequence
  chemically synthesized
aactgtcaaaccaggtaaggaa

SEQ ID NO: 1255412 - DNA, 22 bp, Artificial Sequence
  chemically synthesized
tccattattaacttccttacct

SEQ ID NO: 1255413 - DNA, 22 bp, Artificial Sequence
  chemically synthesized
ttatccattattaacttcctta

SEQ ID NO: 1255414 - DNA, 22 bp, Artificial Sequence
  chemically synthesized
tcaaaccaggtaaggaagttaa

SEQ ID NO: 1255415 - DNA, 22 bp, Artificial Sequence
  chemically synthesized
atattgttatccattattaact

SEQ ID NO: 1255416 - DNA, 22 bp, Artificial Sequence
  chemically synthesized
gatattgttatccattattaac

SEQ ID NO: 1255417 - DNA, 22 bp, Artificial Sequence
  chemically synthesized
tgatattgttatccattattaa

SEQ ID NO: 1255418 - DNA, 22 bp, Artificial Sequence
  chemically synthesized
tatctttgatattgttatccat

SEQ ID NO: 1255419 - DNA, 22 bp, Artificial Sequence
  chemically synthesized
ctatatctttgatattgttatc

SEQ ID NO: 1255420 - DNA, 22 bp, Artificial Sequence
  chemically synthesized
gctatatctttgatattgttat

SEQ ID NO: 1255421 - DNA, 22 bp, Artificial Sequence
  chemically synthesized
ataatggataacaatatcaaag

SEQ ID NO: 1255422 - DNA, 22 bp, Artificial Sequence
  chemically synthesized
aatatttgctatatctttgata

SEQ ID NO: 1255423 - DNA, 22 bp, Artificial Sequence
  chemically synthesized
ttgaatatttgctatatctttg

SEQ ID NO: 1255424 - DNA, 22 bp, Artificial Sequence
  chemically synthesized
tccattgttgaatatttgctat

SEQ ID NO: 1255425 - DNA, 22 bp, Artificial Sequence
  chemically synthesized
ataatgactgtccattgttgaa

SEQ ID NO: 1255426 - DNA, 22 bp, Artificial Sequence
  chemically synthesized
cataatgactgtccattgttga

SEQ ID NO: 1255427 - DNA, 22 bp, Artificial Sequence
  chemically synthesized
tcataatgactgtccattgttg

SEQ ID NO: 1255428 - DNA, 22 bp, Artificial Sequence
  chemically synthesized
gattttcataatgactgtccat

SEQ ID NO: 1255429 - DNA, 22 bp, Artificial Sequence
  chemically synthesized
aacaatggacagtcattatgaa

SEQ ID NO: 1255430 - DNA, 22 bp, Artificial Sequence
  chemically synthesized
agacagctagattttcataatg

SEQ ID NO: 1255431 - DNA, 22 bp, Artificial Sequence
  chemically synthesized
ctgagacagctagattttcata

SEQ ID NO: 1255432 - DNA, 22 bp, Artificial Sequence
  chemically synthesized
actgagacagctagattttcat

SEQ ID NO: 1255433 - DNA, 22 bp, Artificial Sequence
  chemically synthesized
tgaaaatctagctgtctcagta

SEQ ID NO: 1255434 - DNA, 22 bp, Artificial Sequence
  chemically synthesized
atccagcacatttactgagaca

SEQ ID NO: 1255435 - DNA, 22 bp, Artificial Sequence
  chemically synthesized
ttcatccagcacatttactgag

SEQ ID NO: 1255436 - DNA, 22 bp, Artificial Sequence
  chemically synthesized
attcatccagcacatttactga

SEQ ID NO: 1255437 - DNA, 22 bp, Artificial Sequence
  chemically synthesized
ttattcatccagcacatttact

SEQ ID NO: 1255438 - DNA, 22 bp, Artificial Sequence
  chemically synthesized
gctgtctcagtaaatgtgctgg

SEQ ID NO: 1255439 - DNA, 22 bp, Artificial Sequence
  chemically synthesized
cctcttattcatccagcacatt

SEQ ID NO: 1255440 - DNA, 22 bp, Artificial Sequence
  chemically synthesized
ccctcttattcatccagcacat

SEQ ID NO: 1255441 - DNA, 22 bp, Artificial Sequence
  chemically synthesized
tccctcttattcatccagcaca

SEQ ID NO: 1255442 - DNA, 22 bp, Artificial Sequence
  chemically synthesized
tctcagtaaatgtgctggatga

SEQ ID NO: 1255443 - DNA, 22 bp, Artificial Sequence
  chemically synthesized
agtaaatgtgctggatgaataa

SEQ ID NO: 1255444 - DNA, 22 bp, Artificial Sequence
  chemically synthesized
cacctttccctcttattcatcc

SEQ ID NO: 1255445 - DNA, 22 bp, Artificial Sequence
  chemically synthesized
gaagccaagctacacctttccc

SEQ ID NO: 1255446 - DNA, 22 bp, Artificial Sequence
  chemically synthesized
gatgaataagagggaaaggtgt

SEQ ID NO: 1255447 - DNA, 22 bp, Artificial Sequence
  chemically synthesized
tagaagccaagctacacctttc

SEQ ID NO: 1255448 - DNA, 22 bp, Artificial Sequence
  chemically synthesized
catataaattctagaagccaag

SEQ ID NO: 1255449 - DNA, 22 bp, Artificial Sequence
  chemically synthesized
agaaaaaagattacatataaat

SEQ ID NO: 1255450 - DNA, 22 bp, Artificial Sequence
  chemically synthesized
aagaaaaaagattacatataaa

SEQ ID NO: 1255451 - DNA, 22 bp, Artificial Sequence
  chemically synthesized
ggcttctagaatttatatgtaa

SEQ ID NO: 1255452 - DNA, 22 bp, Artificial Sequence
  chemically synthesized
taagaaaaaagattacatataa

SEQ ID NO: 1255453 - DNA, 22 bp, Artificial Sequence
  chemically synthesized
gcttctagaatttatatgtaat

SEQ ID NO: 1255454 - DNA, 22 bp, Artificial Sequence
  chemically synthesized
ctagaatttatatgtaatcttt

SEQ ID NO: 1255455 - DNA, 22 bp, Artificial Sequence
  chemically synthesized
tattttaagaaaaaagattaca

SEQ ID NO: 1255456 - DNA, 22 bp, Artificial Sequence
  chemically synthesized
tagaatttatatgtaatctttt

SEQ ID NO: 1255457 - DNA, 22 bp, Artificial Sequence
  chemically synthesized
atattttaagaaaaaagattac

SEQ ID NO: 1255458 - DNA, 22 bp, Artificial Sequence
  chemically synthesized
tatattttaagaaaaaagatta

SEQ ID NO: 1255459 - DNA, 22 bp, Artificial Sequence
  chemically synthesized
gaatttatatgtaatctttttt

SEQ ID NO: 1255460 - DNA, 22 bp, Artificial Sequence
  chemically synthesized
atatgtaatcttttttcttaaa

SEQ ID NO: 1255461 - DNA, 22 bp, Artificial Sequence
  chemically synthesized
tatattttatattttaagaaaa

SEQ ID NO: 1255462 - DNA, 22 bp, Artificial Sequence
  chemically synthesized
tatgtaatcttttttcttaaaa

SEQ ID NO: 1255463 - DNA, 22 bp, Artificial Sequence
  chemically synthesized
tatatattttatattttaagaa

SEQ ID NO: 1255464 - DNA, 22 bp, Artificial Sequence
  chemically synthesized
tctatatattttatattttaag

SEQ ID NO: 1255465 - DNA, 22 bp, Artificial Sequence
  chemically synthesized
ctctatatattttatattttaa

SEQ ID NO: 1255466 - DNA, 22 bp, Artificial Sequence
  chemically synthesized
tctctatatattttatatttta

SEQ ID NO: 1255467 - DNA, 22 bp, Artificial Sequence
  chemically synthesized
ttttcttaaaatataaaatata

SEQ ID NO: 1255468 - DNA, 22 bp, Artificial Sequence
  chemically synthesized
tttcttaaaatataaaatatat

SEQ ID NO: 1255469 - DNA, 22 bp, Artificial Sequence
  chemically synthesized
cagattttctctatatatttta

SEQ ID NO: 1255470 - DNA, 22 bp, Artificial Sequence
  chemically synthesized
ttcttaaaatataaaatatata

SEQ ID NO: 1255471 - DNA, 22 bp, Artificial Sequence
  chemically synthesized
acagattttctctatatatttt

SEQ ID NO: 1255472 - DNA, 22 bp, Artificial Sequence
  chemically synthesized
tcttaaaatataaaatatatag

SEQ ID NO: 1255473 - DNA, 22 bp, Artificial Sequence
  chemically synthesized
cttaaaatataaaatatataga

SEQ ID NO: 1255474 - DNA, 22 bp, Artificial Sequence
  chemically synthesized
ttaaaatataaaatatatagag

SEQ ID NO: 1255475 - DNA, 22 bp, Artificial Sequence
  chemically synthesized
aaaatataaaatatatagagaa

SEQ ID NO: 1255476 - DNA, 22 bp, Artificial Sequence
  chemically synthesized
aaatataaaatatatagagaaa

SEQ ID NO: 1255477 - DNA, 22 bp, Artificial Sequence
  chemically synthesized
tgacttacagattttctctata

SEQ ID NO: 1255478 - DNA, 22 bp, Artificial Sequence
  chemically synthesized
atgacttacagattttctctat

SEQ ID NO: 1255479 - DNA, 22 bp, Artificial Sequence
  chemically synthesized
agtcacttatgacttacagatt

SEQ ID NO: 1255480 - DNA, 22 bp, Artificial Sequence
  chemically synthesized
ttgagtcacttatgacttacag

SEQ ID NO: 1255481 - DNA, 22 bp, Artificial Sequence
  chemically synthesized
attgagtcacttatgacttaca

SEQ ID NO: 1255482 - DNA, 22 bp, Artificial Sequence
  chemically synthesized
tgaaaacttattgagtcactta

SEQ ID NO: 1255483 - DNA, 22 bp, Artificial Sequence
  chemically synthesized
gtgaaaacttattgagtcactt

SEQ ID NO: 1255484 - DNA, 22 bp, Artificial Sequence
  chemically synthesized
taagtcataagtgactcaataa

SEQ ID NO: 1255485 - DNA, 22 bp, Artificial Sequence
  chemically synthesized
catttgtgaaaacttattgagt

SEQ ID NO: 1255486 - DNA, 22 bp, Artificial Sequence
  chemically synthesized
aatgggtgcattacatttgtga

SEQ ID NO: 1255487 - DNA, 22 bp, Artificial Sequence
  chemically synthesized
aataagttttcacaaatgtaat

SEQ ID NO: 1255488 - DNA, 22 bp, Artificial Sequence
  chemically synthesized
gttaaatgggtgcattacattt

SEQ ID NO: 1255489 - DNA, 22 bp, Artificial Sequence
  chemically synthesized
atactggttaaatgggtgcatt

SEQ ID NO: 1255490 - DNA, 22 bp, Artificial Sequence
  chemically synthesized
tcacaaatgtaatgcacccatt

SEQ ID NO: 1255491 - DNA, 22 bp, Artificial Sequence
  chemically synthesized
cacaaatgtaatgcacccattt

SEQ ID NO: 1255492 - DNA, 22 bp, Artificial Sequence
  chemically synthesized
acaaatgtaatgcacccattta

SEQ ID NO: 1255493 - DNA, 22 bp, Artificial Sequence
  chemically synthesized
atctgatactggttaaatgggt

SEQ ID NO: 1255494 - DNA, 22 bp, Artificial Sequence
  chemically synthesized
gatctgatactggttaaatggg

SEQ ID NO: 1255495 - DNA, 22 bp, Artificial Sequence
  chemically synthesized
ttgatctgatactggttaaatg

SEQ ID NO: 1255496 - DNA, 22 bp, Artificial Sequence
  chemically synthesized
cttgatctgatactggttaaat

SEQ ID NO: 1255497 - DNA, 22 bp, Artificial Sequence
  chemically synthesized
ggcttcttgatctgatactggt

SEQ ID NO: 1255498 - DNA, 22 bp, Artificial Sequence
  chemically synthesized
gataatgttcggcttcttgatc

SEQ ID NO: 1255499 - DNA, 22 bp, Artificial Sequence
  chemically synthesized
aaccagtatcagatcaagaagc

SEQ ID NO: 1255500 - DNA, 22 bp, Artificial Sequence
  chemically synthesized
agataatgttcggcttcttgat

SEQ ID NO: 1255501 - DNA, 22 bp, Artificial Sequence
  chemically synthesized
accagtatcagatcaagaagcc

SEQ ID NO: 1255502 - DNA, 22 bp, Artificial Sequence
  chemically synthesized
aaaggggtatgaagtttagata

SEQ ID NO: 1255503 - DNA, 22 bp, Artificial Sequence
  chemically synthesized
gaaaggggtatgaagtttagat

SEQ ID NO: 1255504 - DNA, 22 bp, Artificial Sequence
  chemically synthesized
tctaaacttcatacccctttca

SEQ ID NO: 1255505 - DNA, 22 bp, Artificial Sequence
  chemically synthesized
ggagacatgacttgaaaggggt

SEQ ID NO: 1255506 - DNA, 22 bp, Artificial Sequence
  chemically synthesized
aacttcatacccctttcaagtc

SEQ ID NO: 1255507 - DNA, 22 bp, Artificial Sequence
  chemically synthesized
catacccctttcaagtcatgtc

SEQ ID NO: 1255508 - DNA, 22 bp, Artificial Sequence
  chemically synthesized
atacccctttcaagtcatgtct

SEQ ID NO: 1255509 - DNA, 22 bp, Artificial Sequence
  chemically synthesized
tcaagtcatgtctcctagggta

SEQ ID NO: 1255510 - DNA, 22 bp, Artificial Sequence
  chemically synthesized
caagtcatgtctcctagggtat

SEQ ID NO: 1255511 - DNA, 22 bp, Artificial Sequence
  chemically synthesized
aagtcatgtctcctagggtatt

SEQ ID NO: 1255512 - DNA, 22 bp, Artificial Sequence
  chemically synthesized
gtgggccaaataaataccctag

SEQ ID NO: 1255513 - DNA, 22 bp, Artificial Sequence
  chemically synthesized
agtgggccaaataaatacccta

SEQ ID NO: 1255514 - DNA, 22 bp, Artificial Sequence
  chemically synthesized
aacatttagtgggccaaataaa

SEQ ID NO: 1255515 - DNA, 22 bp, Artificial Sequence
  chemically synthesized
taaacatttagtgggccaaata

SEQ ID NO: 1255516 - DNA, 22 bp, Artificial Sequence
  chemically synthesized
ctaaacatttagtgggccaaat

SEQ ID NO: 1255517 - DNA, 22 bp, Artificial Sequence
  chemically synthesized
ctagggtatttatttggcccac

SEQ ID NO: 1255518 - DNA, 22 bp, Artificial Sequence
  chemically synthesized
tttctaaacatttagtgggcca

SEQ ID NO: 1255519 - DNA, 22 bp, Artificial Sequence
  chemically synthesized
gggtatttatttggcccactaa

SEQ ID NO: 1255520 - DNA, 22 bp, Artificial Sequence
  chemically synthesized
ctatttctaaacatttagtggg

SEQ ID NO: 1255521 - DNA, 22 bp, Artificial Sequence
  chemically synthesized
gctatttctaaacatttagtgg

SEQ ID NO: 1255522 - DNA, 22 bp, Artificial Sequence
  chemically synthesized
ttgctatttctaaacatttagt

SEQ ID NO: 1255523 - DNA, 22 bp, Artificial Sequence
  chemically synthesized
tcttgctatttctaaacattta

SEQ ID NO: 1255524 - DNA, 22 bp, Artificial Sequence
  chemically synthesized
atttggcccactaaatgtttag

SEQ ID NO: 1255525 - DNA, 22 bp, Artificial Sequence
  chemically synthesized
ctcttgctatttctaaacattt

SEQ ID NO: 1255526 - DNA, 22 bp, Artificial Sequence
  chemically synthesized
tttggcccactaaatgtttaga

SEQ ID NO: 1255527 - DNA, 22 bp, Artificial Sequence
  chemically synthesized
tctcttgctatttctaaacatt

SEQ ID NO: 1255528 - DNA, 22 bp, Artificial Sequence
  chemically synthesized
ggcccactaaatgtttagaaat

SEQ ID NO: 1255529 - DNA, 22 bp, Artificial Sequence
  chemically synthesized
gcccactaaatgtttagaaata

SEQ ID NO: 1255530 - DNA, 22 bp, Artificial Sequence
  chemically synthesized
taatctttctcttgctatttct

SEQ ID NO: 1255531 - DNA, 22 bp, Artificial Sequence
  chemically synthesized
ataatctttctcttgctatttc

SEQ ID NO: 1255532 - DNA, 22 bp, Artificial Sequence
  chemically synthesized
ttataatctttctcttgctatt

SEQ ID NO: 1255533 - DNA, 22 bp, Artificial Sequence
  chemically synthesized
cttataatctttctcttgctat

SEQ ID NO: 1255534 - DNA, 22 bp, Artificial Sequence
  chemically synthesized
aatgtttagaaatagcaagaga

SEQ ID NO: 1255535 - DNA, 22 bp, Artificial Sequence
  chemically synthesized
ttcttataatctttctcttgct

SEQ ID NO: 1255536 - DNA, 22 bp, Artificial Sequence
  chemically synthesized
agaaatagcaagagaaagatta

SEQ ID NO: 1255537 - DNA, 22 bp, Artificial Sequence
  chemically synthesized
cacctcttcttataatctttct

SEQ ID NO: 1255538 - DNA, 22 bp, Artificial Sequence
  chemically synthesized
gaaatagcaagagaaagattat

SEQ ID NO: 1255539 - DNA, 22 bp, Artificial Sequence
  chemically synthesized
ctacacctcttcttataatctt

SEQ ID NO: 1255540 - DNA, 22 bp, Artificial Sequence
  chemically synthesized
tactacacctcttcttataatc

SEQ ID NO: 1255541 - DNA, 22 bp, Artificial Sequence
  chemically synthesized
tctactacacctcttcttataa

SEQ ID NO: 1255542 - DNA, 22 bp, Artificial Sequence
  chemically synthesized
ctctctactacacctcttctta

SEQ ID NO: 1255543 - DNA, 22 bp, Artificial Sequence
  chemically synthesized
cctctctactacacctcttctt

SEQ ID NO: 1255544 - DNA, 22 bp, Artificial Sequence
  chemically synthesized
tcttcctctctactacacctct

SEQ ID NO: 1255545 - DNA, 22 bp, Artificial Sequence
  chemically synthesized
aacctatcttcctctctactac

SEQ ID NO: 1255546 - DNA, 22 bp, Artificial Sequence
  chemically synthesized
taagaagaggtgtagtagagag

SEQ ID NO: 1255547 - DNA, 22 bp, Artificial Sequence
  chemically synthesized
tccaaaattaaacctatcttcc

SEQ ID NO: 1255548 - DNA, 22 bp, Artificial Sequence
  chemically synthesized
atccaaaattaaacctatcttc

SEQ ID NO: 1255549 - DNA, 22 bp, Artificial Sequence
  chemically synthesized
accccacttatccaaaattaaa

SEQ ID NO: 1255550 - DNA, 22 bp, Artificial Sequence
  chemically synthesized
gaccccacttatccaaaattaa

SEQ ID NO: 1255551 - DNA, 22 bp, Artificial Sequence
  chemically synthesized
ttgaccccacttatccaaaatt

SEQ ID NO: 1255552 - DNA, 22 bp, Artificial Sequence
  chemically synthesized
aattttggataagtggggtcaa

SEQ ID NO: 1255553 - DNA, 22 bp, Artificial Sequence
  chemically synthesized
attttggataagtggggtcaag

SEQ ID NO: 1255554 - DNA, 22 bp, Artificial Sequence
  chemically synthesized
aatatcccacaggctcttgacc

SEQ ID NO: 1255555 - DNA, 22 bp, Artificial Sequence
  chemically synthesized
tggataagtggggtcaagagcc

SEQ ID NO: 1255556 - DNA, 22 bp, Artificial Sequence
  chemically synthesized
gaatatcccacaggctcttgac

SEQ ID NO: 1255557 - DNA, 22 bp, Artificial Sequence
  chemically synthesized
ggataagtggggtcaagagcct

SEQ ID NO: 1255558 - DNA, 22 bp, Artificial Sequence
  chemically synthesized
gataagtggggtcaagagcctg

SEQ ID NO: 1255559 - DNA, 22 bp, Artificial Sequence
  chemically synthesized
catttgaatatcccacaggctc

SEQ ID NO: 1255560 - DNA, 22 bp, Artificial Sequence
  chemically synthesized
ccatttgaatatcccacaggct

SEQ ID NO: 1255561 - DNA, 22 bp, Artificial Sequence
  chemically synthesized
tccatttgaatatcccacaggc

SEQ ID NO: 1255562 - DNA, 22 bp, Artificial Sequence
  chemically synthesized
aattttccatttgaatatccca

SEQ ID NO: 1255563 - DNA, 22 bp, Artificial Sequence
  chemically synthesized
gaattttccatttgaatatccc

SEQ ID NO: 1255564 - DNA, 22 bp, Artificial Sequence
  chemically synthesized
ttgaattttccatttgaatatc

SEQ ID NO: 1255565 - DNA, 22 bp, Artificial Sequence
  chemically synthesized
cttgaattttccatttgaatat

SEQ ID NO: 1255566 - DNA, 22 bp, Artificial Sequence
  chemically synthesized
tgggatattcaaatggaaaatt

SEQ ID NO: 1255567 - DNA, 22 bp, Artificial Sequence
  chemically synthesized
aaaaccttcttgaattttccat

SEQ ID NO: 1255568 - DNA, 22 bp, Artificial Sequence
  chemically synthesized
ctcaaaaccttcttgaattttc

SEQ ID NO: 1255569 - DNA, 22 bp, Artificial Sequence
  chemically synthesized
tgctcaaaaccttcttgaattt

SEQ ID NO: 1255570 - DNA, 22 bp, Artificial Sequence
  chemically synthesized
ttctgctcaaaaccttcttgaa

SEQ ID NO: 1255571 - DNA, 22 bp, Artificial Sequence
  chemically synthesized
attctgctcaaaaccttcttga

SEQ ID NO: 1255572 - DNA, 22 bp, Artificial Sequence
  chemically synthesized
aaatggaaaattcaagaaggtt

SEQ ID NO: 1255573 - DNA, 22 bp, Artificial Sequence
  chemically synthesized
tattctgctcaaaaccttcttg

SEQ ID NO: 1255574 - DNA, 22 bp, Artificial Sequence
  chemically synthesized
ccctttattctgctcaaaacct

SEQ ID NO: 1255575 - DNA, 22 bp, Artificial Sequence
  chemically synthesized
accctttattctgctcaaaacc

SEQ ID NO: 1255576 - DNA, 22 bp, Artificial Sequence
  chemically synthesized
tgacttaccctttattctgctc

SEQ ID NO: 1255577 - DNA, 22 bp, Artificial Sequence
  chemically synthesized
aagaaggttttgagcagaataa

SEQ ID NO: 1255578 - DNA, 22 bp, Artificial Sequence
  chemically synthesized
agtgtctatgacttacccttta

SEQ ID NO: 1255579 - DNA, 22 bp, Artificial Sequence
  chemically synthesized
tgagcagaataaagggtaagtc

SEQ ID NO: 1255580 - DNA, 22 bp, Artificial Sequence
  chemically synthesized
gagcagaataaagggtaagtca

SEQ ID NO: 1255581 - DNA, 22 bp, Artificial Sequence
  chemically synthesized
agcagaataaagggtaagtcat

SEQ ID NO: 1255582 - DNA, 22 bp, Artificial Sequence
  chemically synthesized
tcagttcagtgtctatgactta

SEQ ID NO: 1255583 - DNA, 22 bp, Artificial Sequence
  chemically synthesized
atgtctgtcagttcagtgtcta

SEQ ID NO: 1255584 - DNA, 22 bp, Artificial Sequence
  chemically synthesized
atgctaatgtctgtcagttcag

SEQ ID NO: 1255585 - DNA, 22 bp, Artificial Sequence
  chemically synthesized
gatgctaatgtctgtcagttca

SEQ ID NO: 1255586 - DNA, 22 bp, Artificial Sequence
  chemically synthesized
tgatgctaatgtctgtcagttc

SEQ ID NO: 1255587 - DNA, 22 bp, Artificial Sequence
  chemically synthesized
ctttgatgctaatgtctgtcag

SEQ ID NO: 1255588 - DNA, 22 bp, Artificial Sequence
  chemically synthesized
ctgctttgatgctaatgtctgt

SEQ ID NO: 1255589 - DNA, 22 bp, Artificial Sequence
  chemically synthesized
aactgacagacattagcatcaa

SEQ ID NO: 1255590 - DNA, 22 bp, Artificial Sequence
  chemically synthesized
atgtcaactactgctttgatgc

SEQ ID NO: 1255591 - DNA, 22 bp, Artificial Sequence
  chemically synthesized
aatgtcaactactgctttgatg

SEQ ID NO: 1255592 - DNA, 22 bp, Artificial Sequence
  chemically synthesized
acagacattagcatcaaagcag

SEQ ID NO: 1255593 - DNA, 22 bp, Artificial Sequence
  chemically synthesized
taatgtcaactactgctttgat

SEQ ID NO: 1255594 - DNA, 22 bp, Artificial Sequence
  chemically synthesized
ttaatgtcaactactgctttga

SEQ ID NO: 1255595 - DNA, 22 bp, Artificial Sequence
  chemically synthesized
gcatcaaagcagtagttgacat

SEQ ID NO: 1255596 - DNA, 22 bp, Artificial Sequence
  chemically synthesized
acattaaaaatggttcttttca

SEQ ID NO: 1255597 - DNA, 22 bp, Artificial Sequence
  chemically synthesized
aaaatggttcttttcatatttt

SEQ ID NO: 1255598 - DNA, 22 bp, Artificial Sequence
  chemically synthesized
caaaaaaagaaaagaaaatatg

SEQ ID NO: 1255599 - DNA, 22 bp, Artificial Sequence
  chemically synthesized
catctccaaaaaaagaaaagaa

SEQ ID NO: 1255600 - DNA, 22 bp, Artificial Sequence
  chemically synthesized
ttttcatattttcttttctttt

SEQ ID NO: 1255601 - DNA, 22 bp, Artificial Sequence
  chemically synthesized
ttcatattttcttttctttttt

SEQ ID NO: 1255602 - DNA, 22 bp, Artificial Sequence
  chemically synthesized
tcatattttcttttcttttttt

SEQ ID NO: 1255603 - DNA, 22 bp, Artificial Sequence
  chemically synthesized
catattttcttttctttttttg

SEQ ID NO: 1255604 - DNA, 22 bp, Artificial Sequence
  chemically synthesized
atattttcttttctttttttgg

SEQ ID NO: 1255605 - DNA, 22 bp, Artificial Sequence
  chemically synthesized
tcttttctttttttggagatgg

SEQ ID NO: 1255606 - DNA, 22 bp, Artificial Sequence
  chemically synthesized
cttttctttttttggagatgga

SEQ ID NO: 1255607 - DNA, 22 bp, Artificial Sequence
  chemically synthesized
ttttctttttttggagatggag

SEQ ID NO: 1255608 - DNA, 22 bp, Artificial Sequence
  chemically synthesized
ttctttttttggagatggagtc

SEQ ID NO: 1255609 - DNA, 22 bp, Artificial Sequence
  chemically synthesized
tctttttttggagatggagtct

SEQ ID NO: 1255610 - DNA, 22 bp, Artificial Sequence
  chemically synthesized
ggtgacagagcgagactccatc

SEQ ID NO: 1255611 - DNA, 22 bp, Artificial Sequence
  chemically synthesized
ctttttttggagatggagtctc

SEQ ID NO: 1255612 - DNA, 22 bp, Artificial Sequence
  chemically synthesized
tttttttggagatggagtctcg

SEQ ID NO: 1255613 - DNA, 22 bp, Artificial Sequence
  chemically synthesized
tttttggagatggagtctcgct

SEQ ID NO: 1255614 - DNA, 22 bp, Artificial Sequence
  chemically synthesized
ttttggagatggagtctcgctc

SEQ ID NO: 1255615 - DNA, 22 bp, Artificial Sequence
  chemically synthesized
tttggagatggagtctcgctct

SEQ ID NO: 1255616 - DNA, 22 bp, Artificial Sequence
  chemically synthesized
ttggagatggagtctcgctctg

SEQ ID NO: 1255617 - DNA, 22 bp, Artificial Sequence
  chemically synthesized
cagcctgggtgacagagcgaga

SEQ ID NO: 1255618 - DNA, 22 bp, Artificial Sequence
  chemically synthesized
tggagatggagtctcgctctgt

SEQ ID NO: 1255619 - DNA, 22 bp, Artificial Sequence
  chemically synthesized
ggagatggagtctcgctctgtc

SEQ ID NO: 1255620 - DNA, 22 bp, Artificial Sequence
  chemically synthesized
gagatggagtctcgctctgtca

SEQ ID NO: 1255621 - DNA, 22 bp, Artificial Sequence
  chemically synthesized
cactccagcctgggtgacagag

SEQ ID NO: 1255622 - DNA, 22 bp, Artificial Sequence
  chemically synthesized
gctctgtcacccaggctggagt

SEQ ID NO: 1255623 - DNA, 22 bp, Artificial Sequence
  chemically synthesized
tgtcacccaggctggagtgcaa

SEQ ID NO: 1255624 - DNA, 22 bp, Artificial Sequence
  chemically synthesized
tcacccaggctggagtgcaatg

SEQ ID NO: 1255625 - DNA, 22 bp, Artificial Sequence
  chemically synthesized
cagtgagcagagatccgccatt

SEQ ID NO: 1255626 - DNA, 22 bp, Artificial Sequence
  chemically synthesized
gagtgcaatggcggatctctgc

SEQ ID NO: 1255627 - DNA, 22 bp, Artificial Sequence
  chemically synthesized
agcccgggaggcggaggttgca

SEQ ID NO: 1255628 - DNA, 22 bp, Artificial Sequence
  chemically synthesized
gagcccgggaggcggaggttgc

SEQ ID NO: 1255629 - DNA, 22 bp, Artificial Sequence
  chemically synthesized
cttgagcccgggaggcggaggt

SEQ ID NO: 1255630 - DNA, 22 bp, Artificial Sequence
  chemically synthesized
tgctcactgcaacctccgcctc

SEQ ID NO: 1255631 - DNA, 22 bp, Artificial Sequence
  chemically synthesized
ctcactgcaacctccgcctccc

SEQ ID NO: 1255632 - DNA, 22 bp, Artificial Sequence
  chemically synthesized
actgcaacctccgcctcccggg

SEQ ID NO: 1255633 - DNA, 22 bp, Artificial Sequence
  chemically synthesized
caacctccgcctcccgggctca

SEQ ID NO: 1255634 - DNA, 22 bp, Artificial Sequence
  chemically synthesized
aggcaggagaattgcttgagcc

SEQ ID NO: 1255635 - DNA, 22 bp, Artificial Sequence
  chemically synthesized
cgcctcccgggctcaagcaatt

SEQ ID NO: 1255636 - DNA, 22 bp, Artificial Sequence
  chemically synthesized
ggaggctgaggcaggagaattg

SEQ ID NO: 1255637 - DNA, 22 bp, Artificial Sequence
  chemically synthesized
ccgggctcaagcaattctcctg

SEQ ID NO: 1255638 - DNA, 22 bp, Artificial Sequence
  chemically synthesized
gggaggctgaggcaggagaatt

SEQ ID NO: 1255639 - DNA, 22 bp, Artificial Sequence
  chemically synthesized
cttgggaggctgaggcaggaga

SEQ ID NO: 1255640 - DNA, 22 bp, Artificial Sequence
  chemically synthesized
aagcaattctcctgcctcagcc

SEQ ID NO: 1255641 - DNA, 22 bp, Artificial Sequence
  chemically synthesized
taatcccagctacttgggaggc

SEQ ID NO: 1255642 - DNA, 22 bp, Artificial Sequence
  chemically synthesized
tcctgcctcagcctcccaagta

SEQ ID NO: 1255643 - DNA, 22 bp, Artificial Sequence
  chemically synthesized
ctgcctcagcctcccaagtagc

SEQ ID NO: 1255644 - DNA, 22 bp, Artificial Sequence
  chemically synthesized
cctcagcctcccaagtagctgg

SEQ ID NO: 1255645 - DNA, 22 bp, Artificial Sequence
  chemically synthesized
agcctcccaagtagctgggatt

SEQ ID NO: 1255646 - DNA, 22 bp, Artificial Sequence
  chemically synthesized
ccaagtagctgggattacaggc

SEQ ID NO: 1255647 - DNA, 22 bp, Artificial Sequence
  chemically synthesized
gccgggcgtgtggtggtggatg

SEQ ID NO: 1255648 - DNA, 22 bp, Artificial Sequence
  chemically synthesized
ggattacaggcatccaccacca

SEQ ID NO: 1255649 - DNA, 22 bp, Artificial Sequence
  chemically synthesized
caggcatccaccaccacacgcc

SEQ ID NO: 1255650 - DNA, 22 bp, Artificial Sequence
  chemically synthesized
ccaaaaatacaaaaattagccg

SEQ ID NO: 1255651 - DNA, 22 bp, Artificial Sequence
  chemically synthesized
taccaaaaatacaaaaattagc

SEQ ID NO: 1255652 - DNA, 22 bp, Artificial Sequence
  chemically synthesized
tctctaccaaaaatacaaaaat

SEQ ID NO: 1255653 - DNA, 22 bp, Artificial Sequence
  chemically synthesized
atttttgtatttttggtagaga

SEQ ID NO: 1255654 - DNA, 22 bp, Artificial Sequence
  chemically synthesized
ttgtatttttggtagagacagg

SEQ ID NO: 1255655 - DNA, 22 bp, Artificial Sequence
  chemically synthesized
tgtatttttggtagagacaggg

SEQ ID NO: 1255656 - DNA, 22 bp, Artificial Sequence
  chemically synthesized
gtatttttggtagagacagggt

SEQ ID NO: 1255657 - DNA, 22 bp, Artificial Sequence
  chemically synthesized
tatttttggtagagacagggtt

SEQ ID NO: 1255658 - DNA, 22 bp, Artificial Sequence
  chemically synthesized
gccaacatggtgaaaccctgtc

SEQ ID NO: 1255659 - DNA, 22 bp, Artificial Sequence
  chemically synthesized
ttggtagagacagggtttcacc

SEQ ID NO: 1255660 - DNA, 22 bp, Artificial Sequence
  chemically synthesized
tggtagagacagggtttcacca

SEQ ID NO: 1255661 - DNA, 22 bp, Artificial Sequence
  chemically synthesized
ggtagagacagggtttcaccat

SEQ ID NO: 1255662 - DNA, 22 bp, Artificial Sequence
  chemically synthesized
gtagagacagggtttcaccatg

SEQ ID NO: 1255663 - DNA, 22 bp, Artificial Sequence
  chemically synthesized
aagaccagcctggccaacatgg

SEQ ID NO: 1255664 - DNA, 22 bp, Artificial Sequence
  chemically synthesized
caccatgttggccaggctggtc

SEQ ID NO: 1255665 - DNA, 22 bp, Artificial Sequence
  chemically synthesized
accatgttggccaggctggtct

SEQ ID NO: 1255666 - DNA, 22 bp, Artificial Sequence
  chemically synthesized
aggtcaggagttcaagaccagc

SEQ ID NO: 1255667 - DNA, 22 bp, Artificial Sequence
  chemically synthesized
cctgaggtcaggagttcaagac

SEQ ID NO: 1255668 - DNA, 22 bp, Artificial Sequence
  chemically synthesized
gccaggctggtcttgaactcct

SEQ ID NO: 1255669 - DNA, 22 bp, Artificial Sequence
  chemically synthesized
gtcttgaactcctgacctcagg

SEQ ID NO: 1255670 - DNA, 22 bp, Artificial Sequence
  chemically synthesized
gaactcctgacctcaggtaatc

SEQ ID NO: 1255671 - DNA, 22 bp, Artificial Sequence
  chemically synthesized
aactcctgacctcaggtaatcc

SEQ ID NO: 1255672 - DNA, 22 bp, Artificial Sequence
  chemically synthesized
gaaggccaaggcaggtggatta

SEQ ID NO: 1255673 - DNA, 22 bp, Artificial Sequence
  chemically synthesized
ctgacctcaggtaatccacctg

SEQ ID NO: 1255674 - DNA, 22 bp, Artificial Sequence
  chemically synthesized
ggaaggccaaggcaggtggatt

SEQ ID NO: 1255675 - DNA, 22 bp, Artificial Sequence
  chemically synthesized
tggaaggccaaggcaggtggat

SEQ ID NO: 1255676 - DNA, 22 bp, Artificial Sequence
  chemically synthesized
acctcaggtaatccacctgcct

SEQ ID NO: 1255677 - DNA, 22 bp, Artificial Sequence
  chemically synthesized
aggtaatccacctgccttggcc

SEQ ID NO: 1255678 - DNA, 22 bp, Artificial Sequence
  chemically synthesized
taatcccagcactttggaaggc

SEQ ID NO: 1255679 - DNA, 22 bp, Artificial Sequence
  chemically synthesized
ccttggccttccaaagtgctgg

SEQ ID NO: 1255680 - DNA, 22 bp, Artificial Sequence
  chemically synthesized
atgcctgtaatcccagcacttt

SEQ ID NO: 1255681 - DNA, 22 bp, Artificial Sequence
  chemically synthesized
ggccttccaaagtgctgggatt

SEQ ID NO: 1255682 - DNA, 22 bp, Artificial Sequence
  chemically synthesized
gccttccaaagtgctgggatta

SEQ ID NO: 1255683 - DNA, 22 bp, Artificial Sequence
  chemically synthesized
ccaaagtgctgggattacaggc

SEQ ID NO: 1255684 - DNA, 22 bp, Artificial Sequence
  chemically synthesized
caaagtgctgggattacaggca

SEQ ID NO: 1255685 - DNA, 22 bp, Artificial Sequence
  chemically synthesized
agtgcagtggctcatgcctgta

SEQ ID NO: 1255686 - DNA, 22 bp, Artificial Sequence
  chemically synthesized
tgggctgagtgcagtggctcat

SEQ ID NO: 1255687 - DNA, 22 bp, Artificial Sequence
  chemically synthesized
ggattacaggcatgagccactg

SEQ ID NO: 1255688 - DNA, 22 bp, Artificial Sequence
  chemically synthesized
caggcatgagccactgcactca

SEQ ID NO: 1255689 - DNA, 22 bp, Artificial Sequence
  chemically synthesized
aaacattatgggctgagtgcag

SEQ ID NO: 1255690 - DNA, 22 bp, Artificial Sequence
  chemically synthesized
cactcagcccataatgttttaa

SEQ ID NO: 1255691 - DNA, 22 bp, Artificial Sequence
  chemically synthesized
aatcatacaccattaaaacatt

SEQ ID NO: 1255692 - DNA, 22 bp, Artificial Sequence
  chemically synthesized
gaatcatacaccattaaaacat

SEQ ID NO: 1255693 - DNA, 22 bp, Artificial Sequence
  chemically synthesized
agcccataatgttttaatggtg

SEQ ID NO: 1255694 - DNA, 22 bp, Artificial Sequence
  chemically synthesized
gtcacttgaatcatacaccatt

SEQ ID NO: 1255695 - DNA, 22 bp, Artificial Sequence
  chemically synthesized
tgcctagtcacttgaatcatac

SEQ ID NO: 1255696 - DNA, 22 bp, Artificial Sequence
  chemically synthesized
taatggtgtatgattcaagtga

SEQ ID NO: 1255697 - DNA, 22 bp, Artificial Sequence
  chemically synthesized
aatggtgtatgattcaagtgac

SEQ ID NO: 1255698 - DNA, 22 bp, Artificial Sequence
  chemically synthesized
atggtgtatgattcaagtgact

SEQ ID NO: 1255699 - DNA, 22 bp, Artificial Sequence
  chemically synthesized
aagtgactaggcataatatgtt

SEQ ID NO: 1255700 - DNA, 22 bp, Artificial Sequence
  chemically synthesized
agcaacgagacaagcaacatat

SEQ ID NO: 1255701 - DNA, 22 bp, Artificial Sequence
  chemically synthesized
gagcaacgagacaagcaacata

SEQ ID NO: 1255702 - DNA, 22 bp, Artificial Sequence
  chemically synthesized
tgagcaacgagacaagcaacat

SEQ ID NO: 1255703 - DNA, 22 bp, Artificial Sequence
  chemically synthesized
ttgagcaacgagacaagcaaca

SEQ ID NO: 1255704 - DNA, 22 bp, Artificial Sequence
  chemically synthesized
tttgagcaacgagacaagcaac

SEQ ID NO: 1255705 - DNA, 22 bp, Artificial Sequence
  chemically synthesized
ggcataatatgttgcttgtctc

SEQ ID NO: 1255706 - DNA, 22 bp, Artificial Sequence
  chemically synthesized
ctttttgagcaacgagacaagc

SEQ ID NO: 1255707 - DNA, 22 bp, Artificial Sequence
  chemically synthesized
actttttgagcaacgagacaag

SEQ ID NO: 1255708 - DNA, 22 bp, Artificial Sequence
  chemically synthesized
ttactttttgagcaacgagaca

SEQ ID NO: 1255709 - DNA, 22 bp, Artificial Sequence
  chemically synthesized
cttactttttgagcaacgagac

SEQ ID NO: 1255710 - DNA, 22 bp, Artificial Sequence
  chemically synthesized
tcttactttttgagcaacgaga

SEQ ID NO: 1255711 - DNA, 22 bp, Artificial Sequence
  chemically synthesized
ttcttactttttgagcaacgag

SEQ ID NO: 1255712 - DNA, 22 bp, Artificial Sequence
  chemically synthesized
tttttcttactttttgagcaac

SEQ ID NO: 1255713 - DNA, 22 bp, Artificial Sequence
  chemically synthesized
atttttcttactttttgagcaa

SEQ ID NO: 1255714 - DNA, 22 bp, Artificial Sequence
  chemically synthesized
tatttttcttactttttgagca

SEQ ID NO: 1255715 - DNA, 22 bp, Artificial Sequence
  chemically synthesized
ttatttttcttactttttgagc

SEQ ID NO: 1255716 - DNA, 22 bp, Artificial Sequence
  chemically synthesized
cttgtctcgttgctcaaaaagt

SEQ ID NO: 1255717 - DNA, 22 bp, Artificial Sequence
  chemically synthesized
ttttatttttcttactttttga

SEQ ID NO: 1255718 - DNA, 22 bp, Artificial Sequence
  chemically synthesized
cttttatttttcttactttttg

SEQ ID NO: 1255719 - DNA, 22 bp, Artificial Sequence
  chemically synthesized
gtctcgttgctcaaaaagtaag

SEQ ID NO: 1255720 - DNA, 22 bp, Artificial Sequence
  chemically synthesized
tcttttatttttcttacttttt

SEQ ID NO: 1255721 - DNA, 22 bp, Artificial Sequence
  chemically synthesized
tctcgttgctcaaaaagtaaga

SEQ ID NO: 1255722 - DNA, 22 bp, Artificial Sequence
  chemically synthesized
tttcttttatttttcttacttt

SEQ ID NO: 1255723 - DNA, 22 bp, Artificial Sequence
  chemically synthesized
gttgctcaaaaagtaagaaaaa

SEQ ID NO: 1255724 - DNA, 22 bp, Artificial Sequence
  chemically synthesized
ctcaaaaagtaagaaaaataaa

SEQ ID NO: 1255725 - DNA, 22 bp, Artificial Sequence
  chemically synthesized
aaaaagtaagaaaaataaaaga

SEQ ID NO: 1255726 - DNA, 22 bp, Artificial Sequence
  chemically synthesized
gcaaaagagtggagtctctttc

SEQ ID NO: 1255727 - DNA, 22 bp, Artificial Sequence
  chemically synthesized
aacctagcaaaagagtggagtc

SEQ ID NO: 1255728 - DNA, 22 bp, Artificial Sequence
  chemically synthesized
cactcttttgctaggtttaaca

SEQ ID NO: 1255729 - DNA, 22 bp, Artificial Sequence
  chemically synthesized
ttttgctaggtttaacattgtg

SEQ ID NO: 1255730 - DNA, 22 bp, Artificial Sequence
  chemically synthesized
ttgctaggtttaacattgtgtt

SEQ ID NO: 1255731 - DNA, 22 bp, Artificial Sequence
  chemically synthesized
tgctaggtttaacattgtgttg

SEQ ID NO: 1255732 - DNA, 22 bp, Artificial Sequence
  chemically synthesized
gctaggtttaacattgtgttgt

SEQ ID NO: 1255733 - DNA, 22 bp, Artificial Sequence
  chemically synthesized
ctaggtttaacattgtgttgtt

SEQ ID NO: 1255734 - DNA, 22 bp, Artificial Sequence
  chemically synthesized
ggtttaacattgtgttgttgta

SEQ ID NO: 1255735 - DNA, 22 bp, Artificial Sequence
  chemically synthesized
aacattgtgttgttgtatgtat

SEQ ID NO: 1255736 - DNA, 22 bp, Artificial Sequence
  chemically synthesized
acattgtgttgttgtatgtata

SEQ ID NO: 1255737 - DNA, 22 bp, Artificial Sequence
  chemically synthesized
tgttgttgtatgtatatatgta

SEQ ID NO: 1255738 - DNA, 22 bp, Artificial Sequence
  chemically synthesized
ttgtatgtatatatgtatttct

SEQ ID NO: 1255739 - DNA, 22 bp, Artificial Sequence
  chemically synthesized
tatgtatatatgtatttctgta

SEQ ID NO: 1255740 - DNA, 22 bp, Artificial Sequence
  chemically synthesized
ctgtacacatccctatattggg

SEQ ID NO: 1255741 - DNA, 22 bp, Artificial Sequence
  chemically synthesized
tgtacacatccctatattggga

SEQ ID NO: 1255742 - DNA, 22 bp, Artificial Sequence
  chemically synthesized
tacacatccctatattgggacc

SEQ ID NO: 1255743 - DNA, 22 bp, Artificial Sequence
  chemically synthesized
tggaaggtcatatggtcccaat

SEQ ID NO: 1255744 - DNA, 22 bp, Artificial Sequence
  chemically synthesized
gtggaaggtcatatggtcccaa

SEQ ID NO: 1255745 - DNA, 22 bp, Artificial Sequence
  chemically synthesized
tgtggaaggtcatatggtccca

SEQ ID NO: 1255746 - DNA, 22 bp, Artificial Sequence
  chemically synthesized
tttgtggaaggtcatatggtcc

SEQ ID NO: 1255747 - DNA, 22 bp, Artificial Sequence
  chemically synthesized
ctttgtggaaggtcatatggtc

SEQ ID NO: 1255748 - DNA, 22 bp, Artificial Sequence
  chemically synthesized
tttctttgtggaaggtcatatg

SEQ ID NO: 1255749 - DNA, 22 bp, Artificial Sequence
  chemically synthesized
tattgggaccatatgaccttcc

SEQ ID NO: 1255750 - DNA, 22 bp, Artificial Sequence
  chemically synthesized
ggaccatatgaccttccacaaa

SEQ ID NO: 1255751 - DNA, 22 bp, Artificial Sequence
  chemically synthesized
agtaagattgtttctttgtgga

SEQ ID NO: 1255752 - DNA, 22 bp, Artificial Sequence
  chemically synthesized
aagtaagattgtttctttgtgg

SEQ ID NO: 1255753 - DNA, 22 bp, Artificial Sequence
  chemically synthesized
taagtaagattgtttctttgtg

SEQ ID NO: 1255754 - DNA, 22 bp, Artificial Sequence
  chemically synthesized
aaacaattttaagtaagattgt

SEQ ID NO: 1255755 - DNA, 22 bp, Artificial Sequence
  chemically synthesized
aaaacaattttaagtaagattg

SEQ ID NO: 1255756 - DNA, 22 bp, Artificial Sequence
  chemically synthesized
ccacaaagaaacaatcttactt

SEQ ID NO: 1255757 - DNA, 22 bp, Artificial Sequence
  chemically synthesized
cacaaagaaacaatcttactta

SEQ ID NO: 1255758 - DNA, 22 bp, Artificial Sequence
  chemically synthesized
tttaaaacaattttaagtaaga

SEQ ID NO: 1255759 - DNA, 22 bp, Artificial Sequence
  chemically synthesized
atttaaaacaattttaagtaag

SEQ ID NO: 1255760 - DNA, 22 bp, Artificial Sequence
  chemically synthesized
catatttatttaaaacaatttt

SEQ ID NO: 1255761 - DNA, 22 bp, Artificial Sequence
  chemically synthesized
acatatttatttaaaacaattt

SEQ ID NO: 1255762 - DNA, 22 bp, Artificial Sequence
  chemically synthesized
tacatatttatttaaaacaatt

SEQ ID NO: 1255763 - DNA, 22 bp, Artificial Sequence
  chemically synthesized
ttacatatttatttaaaacaat

SEQ ID NO: 1255764 - DNA, 22 bp, Artificial Sequence
  chemically synthesized
tttacatatttatttaaaacaa

SEQ ID NO: 1255765 - DNA, 22 bp, Artificial Sequence
  chemically synthesized
acttaaaattgttttaaataaa

SEQ ID NO: 1255766 - DNA, 22 bp, Artificial Sequence
  chemically synthesized
cttaaaattgttttaaataaat

SEQ ID NO: 1255767 - DNA, 22 bp, Artificial Sequence
  chemically synthesized
aaaattgttttaaataaatatg

SEQ ID NO: 1255768 - DNA, 22 bp, Artificial Sequence
  chemically synthesized
tagtactttttacatatttatt

SEQ ID NO: 1255769 - DNA, 22 bp, Artificial Sequence
  chemically synthesized
aaattgttttaaataaatatgt

SEQ ID NO: 1255770 - DNA, 22 bp, Artificial Sequence
  chemically synthesized
atagtactttttacatatttat

SEQ ID NO: 1255771 - DNA, 22 bp, Artificial Sequence
  chemically synthesized
tatagtactttttacatattta

SEQ ID NO: 1255772 - DNA, 22 bp, Artificial Sequence
  chemically synthesized
ttttaaataaatatgtaaaaag

SEQ ID NO: 1255773 - DNA, 22 bp, Artificial Sequence
  chemically synthesized
taaataaatatgtaaaaagtac

SEQ ID NO: 1255774 - DNA, 22 bp, Artificial Sequence
  chemically synthesized
aaataaatatgtaaaaagtact

SEQ ID NO: 1255775 - DNA, 22 bp, Artificial Sequence
  chemically synthesized
aataaatatgtaaaaagtacta

SEQ ID NO: 1255776 - DNA, 22 bp, Artificial Sequence
  chemically synthesized
tcgcaaaataatgtaaaatttt

SEQ ID NO: 1255777 - DNA, 22 bp, Artificial Sequence
  chemically synthesized
tgtcgcaaaataatgtaaaatt

SEQ ID NO: 1255778 - DNA, 22 bp, Artificial Sequence
  chemically synthesized
ctgtcgcaaaataatgtaaaat

SEQ ID NO: 1255779 - DNA, 22 bp, Artificial Sequence
  chemically synthesized
tatttctgtcgcaaaataatgt

SEQ ID NO: 1255780 - DNA, 22 bp, Artificial Sequence
  chemically synthesized
gtatttctgtcgcaaaataatg

SEQ ID NO: 1255781 - DNA, 22 bp, Artificial Sequence
  chemically synthesized
taaaattttacattattttgcg

SEQ ID NO: 1255782 - DNA, 22 bp, Artificial Sequence
  chemically synthesized
tacattattttgcgacagaaat

SEQ ID NO: 1255783 - DNA, 22 bp, Artificial Sequence
  chemically synthesized
acattattttgcgacagaaata

SEQ ID NO: 1255784 - DNA, 22 bp, Artificial Sequence
  chemically synthesized
cattattttgcgacagaaatac

SEQ ID NO: 1255785 - DNA, 22 bp, Artificial Sequence
  chemically synthesized
atcagtaacaaaacttgtattt

SEQ ID NO: 1255786 - DNA, 22 bp, Artificial Sequence
  chemically synthesized
ttttgcgacagaaatacaagtt

SEQ ID NO: 1255787 - DNA, 22 bp, Artificial Sequence
  chemically synthesized
taatcagtaacaaaacttgtat

SEQ ID NO: 1255788 - DNA, 22 bp, Artificial Sequence
  chemically synthesized
tgcgacagaaatacaagttttg

SEQ ID NO: 1255789 - DNA, 22 bp, Artificial Sequence
  chemically synthesized
gcgacagaaatacaagttttgt

SEQ ID NO: 1255790 - DNA, 22 bp, Artificial Sequence
  chemically synthesized
cgacagaaatacaagttttgtt

SEQ ID NO: 1255791 - DNA, 22 bp, Artificial Sequence
  chemically synthesized
catctctaatcagtaacaaaac

SEQ ID NO: 1255792 - DNA, 22 bp, Artificial Sequence
  chemically synthesized
ctgcatctctaatcagtaacaa

SEQ ID NO: 1255793 - DNA, 22 bp, Artificial Sequence
  chemically synthesized
ttgctgcatctctaatcagtaa

SEQ ID NO: 1255794 - DNA, 22 bp, Artificial Sequence
  chemically synthesized
tgttactgattagagatgcagc

SEQ ID NO: 1255795 - DNA, 22 bp, Artificial Sequence
  chemically synthesized
gttactgattagagatgcagca

SEQ ID NO: 1255796 - DNA, 22 bp, Artificial Sequence
  chemically synthesized
ttactgattagagatgcagcaa

SEQ ID NO: 1255797 - DNA, 22 bp, Artificial Sequence
  chemically synthesized
aaaagcaaactgttgctgcatc

SEQ ID NO: 1255798 - DNA, 22 bp, Artificial Sequence
  chemically synthesized
ctgattagagatgcagcaacag

SEQ ID NO: 1255799 - DNA, 22 bp, Artificial Sequence
  chemically synthesized
attagagatgcagcaacagttt

SEQ ID NO: 1255800 - DNA, 22 bp, Artificial Sequence
  chemically synthesized
atgtagttgaaaagcaaactgt

SEQ ID NO: 1255801 - DNA, 22 bp, Artificial Sequence
  chemically synthesized
gagatgcagcaacagtttgctt

SEQ ID NO: 1255802 - DNA, 22 bp, Artificial Sequence
  chemically synthesized
ctaatgtagttgaaaagcaaac

SEQ ID NO: 1255803 - DNA, 22 bp, Artificial Sequence
  chemically synthesized
atagggttcctaatgtagttga

SEQ ID NO: 1255804 - DNA, 22 bp, Artificial Sequence
  chemically synthesized
gcttttcaactacattaggaac

SEQ ID NO: 1255805 - DNA, 22 bp, Artificial Sequence
  chemically synthesized
cttttcaactacattaggaacc

SEQ ID NO: 1255806 - DNA, 22 bp, Artificial Sequence
  chemically synthesized
aaaaatgctcatagggttccta

SEQ ID NO: 1255807 - DNA, 22 bp, Artificial Sequence
  chemically synthesized
ttcaactacattaggaacccta

SEQ ID NO: 1255808 - DNA, 22 bp, Artificial Sequence
  chemically synthesized
tcaactacattaggaaccctat

SEQ ID NO: 1255809 - DNA, 22 bp, Artificial Sequence
  chemically synthesized
caactacattaggaaccctatg

SEQ ID NO: 1255810 - DNA, 22 bp, Artificial Sequence
  chemically synthesized
aactacattaggaaccctatga

SEQ ID NO: 1255811 - DNA, 22 bp, Artificial Sequence
  chemically synthesized
tctaaaaaatgctcatagggtt

SEQ ID NO: 1255812 - DNA, 22 bp, Artificial Sequence
  chemically synthesized
cattaggaaccctatgagcatt

SEQ ID NO: 1255813 - DNA, 22 bp, Artificial Sequence
  chemically synthesized
tgaaattatctaaaaaatgctc

SEQ ID NO: 1255814 - DNA, 22 bp, Artificial Sequence
  chemically synthesized
ggaaccctatgagcatttttta

SEQ ID NO: 1255815 - DNA, 22 bp, Artificial Sequence
  chemically synthesized
ctatgaaattatctaaaaaatg

SEQ ID NO: 1255816 - DNA, 22 bp, Artificial Sequence
  chemically synthesized
ttactatgaaattatctaaaaa

SEQ ID NO: 1255817 - DNA, 22 bp, Artificial Sequence
  chemically synthesized
attactatgaaattatctaaaa

SEQ ID NO: 1255818 - DNA, 22 bp, Artificial Sequence
  chemically synthesized
cttattactatgaaattatcta

SEQ ID NO: 1255819 - DNA, 22 bp, Artificial Sequence
  chemically synthesized
tgagcattttttagataatttc

SEQ ID NO: 1255820 - DNA, 22 bp, Artificial Sequence
  chemically synthesized
ctacttattactatgaaattat

SEQ ID NO: 1255821 - DNA, 22 bp, Artificial Sequence
  chemically synthesized
cctacttattactatgaaatta

SEQ ID NO: 1255822 - DNA, 22 bp, Artificial Sequence
  chemically synthesized
tttagataatttcatagtaata

SEQ ID NO: 1255823 - DNA, 22 bp, Artificial Sequence
  chemically synthesized
ttagataatttcatagtaataa

SEQ ID NO: 1255824 - DNA, 22 bp, Artificial Sequence
  chemically synthesized
tgtacttcctacttattactat

SEQ ID NO: 1255825 - DNA, 22 bp, Artificial Sequence
  chemically synthesized
tagataatttcatagtaataag

SEQ ID NO: 1255826 - DNA, 22 bp, Artificial Sequence
  chemically synthesized
atgtacttcctacttattacta

SEQ ID NO: 1255827 - DNA, 22 bp, Artificial Sequence
  chemically synthesized
agataatttcatagtaataagt

SEQ ID NO: 1255828 - DNA, 22 bp, Artificial Sequence
  chemically synthesized
gataatttcatagtaataagta

SEQ ID NO: 1255829 - DNA, 22 bp, Artificial Sequence
  chemically synthesized
tgtcttatgtacttcctactta

SEQ ID NO: 1255830 - DNA, 22 bp, Artificial Sequence
  chemically synthesized
catagtaataagtaggaagtac

SEQ ID NO: 1255831 - DNA, 22 bp, Artificial Sequence
  chemically synthesized
atagtaataagtaggaagtaca

SEQ ID NO: 1255832 - DNA, 22 bp, Artificial Sequence
  chemically synthesized
gtgaatcctatgtcttatgtac

SEQ ID NO: 1255833 - DNA, 22 bp, Artificial Sequence
  chemically synthesized
accaagttagtgaatcctatgt

SEQ ID NO: 1255834 - DNA, 22 bp, Artificial Sequence
  chemically synthesized
tcaccaagttagtgaatcctat

SEQ ID NO: 1255835 - DNA, 22 bp, Artificial Sequence
  chemically synthesized
agttctcaccaagttagtgaat

SEQ ID NO: 1255836 - DNA, 22 bp, Artificial Sequence
  chemically synthesized
tgagcaattaagttctcaccaa

SEQ ID NO: 1255837 - DNA, 22 bp, Artificial Sequence
  chemically synthesized
gtgagcaattaagttctcacca

SEQ ID NO: 1255838 - DNA, 22 bp, Artificial Sequence
  chemically synthesized
ttgtgagcaattaagttctcac

SEQ ID NO: 1255839 - DNA, 22 bp, Artificial Sequence
  chemically synthesized
tcttgtgagcaattaagttctc

SEQ ID NO: 1255840 - DNA, 22 bp, Artificial Sequence
  chemically synthesized
actaacttggtgagaacttaat

SEQ ID NO: 1255841 - DNA, 22 bp, Artificial Sequence
  chemically synthesized
ctcttgtgagcaattaagttct

SEQ ID NO: 1255842 - DNA, 22 bp, Artificial Sequence
  chemically synthesized
tctcttgtgagcaattaagttc

SEQ ID NO: 1255843 - DNA, 22 bp, Artificial Sequence
  chemically synthesized
ttctcttgtgagcaattaagtt

SEQ ID NO: 1255844 - DNA, 22 bp, Artificial Sequence
  chemically synthesized
acttggtgagaacttaattgct

SEQ ID NO: 1255845 - DNA, 22 bp, Artificial Sequence
  chemically synthesized
ggtgagaacttaattgctcaca

SEQ ID NO: 1255846 - DNA, 22 bp, Artificial Sequence
  chemically synthesized
gcatttttctcttgtgagcaat

SEQ ID NO: 1255847 - DNA, 22 bp, Artificial Sequence
  chemically synthesized
gtgagaacttaattgctcacaa

SEQ ID NO: 1255848 - DNA, 22 bp, Artificial Sequence
  chemically synthesized
gtctagcatttttctcttgtga

SEQ ID NO: 1255849 - DNA, 22 bp, Artificial Sequence
  chemically synthesized
aattgctcacaagagaaaaatg

SEQ ID NO: 1255850 - DNA, 22 bp, Artificial Sequence
  chemically synthesized
attgctcacaagagaaaaatgc

SEQ ID NO: 1255851 - DNA, 22 bp, Artificial Sequence
  chemically synthesized
aggggattagtctagcattttt

SEQ ID NO: 1255852 - DNA, 22 bp, Artificial Sequence
  chemically synthesized
ctcacaagagaaaaatgctaga

SEQ ID NO: 1255853 - DNA, 22 bp, Artificial Sequence
  chemically synthesized
ctaaggggattagtctagcatt

SEQ ID NO: 1255854 - DNA, 22 bp, Artificial Sequence
  chemically synthesized
gctaaggggattagtctagcat

SEQ ID NO: 1255855 - DNA, 22 bp, Artificial Sequence
  chemically synthesized
acaagagaaaaatgctagacta

SEQ ID NO: 1255856 - DNA, 22 bp, Artificial Sequence
  chemically synthesized
tgctaaggggattagtctagca

SEQ ID NO: 1255857 - DNA, 22 bp, Artificial Sequence
  chemically synthesized
tttgctaaggggattagtctag

SEQ ID NO: 1255858 - DNA, 22 bp, Artificial Sequence
  chemically synthesized
atcatagattctttgctaaggg

SEQ ID NO: 1255859 - DNA, 22 bp, Artificial Sequence
  chemically synthesized
aatcatagattctttgctaagg

SEQ ID NO: 1255860 - DNA, 22 bp, Artificial Sequence
  chemically synthesized
taatcatagattctttgctaag

SEQ ID NO: 1255861 - DNA, 22 bp, Artificial Sequence
  chemically synthesized
ttaatcatagattctttgctaa

SEQ ID NO: 1255862 - DNA, 22 bp, Artificial Sequence
  chemically synthesized
gactaatccccttagcaaagaa

SEQ ID NO: 1255863 - DNA, 22 bp, Artificial Sequence
  chemically synthesized
atccccttagcaaagaatctat

SEQ ID NO: 1255864 - DNA, 22 bp, Artificial Sequence
  chemically synthesized
gaatcttttaatcatagattct

SEQ ID NO: 1255865 - DNA, 22 bp, Artificial Sequence
  chemically synthesized
agaatcttttaatcatagattc

SEQ ID NO: 1255866 - DNA, 22 bp, Artificial Sequence
  chemically synthesized
tagaatcttttaatcatagatt

SEQ ID NO: 1255867 - DNA, 22 bp, Artificial Sequence
  chemically synthesized
ttagaatcttttaatcatagat

SEQ ID NO: 1255868 - DNA, 22 bp, Artificial Sequence
  chemically synthesized
tttagaatcttttaatcataga

SEQ ID NO: 1255869 - DNA, 22 bp, Artificial Sequence
  chemically synthesized
agcaaagaatctatgattaaaa

SEQ ID NO: 1255870 - DNA, 22 bp, Artificial Sequence
  chemically synthesized
ttttttagaatcttttaatcat

SEQ ID NO: 1255871 - DNA, 22 bp, Artificial Sequence
  chemically synthesized
gcaaagaatctatgattaaaag

SEQ ID NO: 1255872 - DNA, 22 bp, Artificial Sequence
  chemically synthesized
aaattattttttagaatctttt

SEQ ID NO: 1255873 - DNA, 22 bp, Artificial Sequence
  chemically synthesized
ttcaaattattttttagaatct

SEQ ID NO: 1255874 - DNA, 22 bp, Artificial Sequence
  chemically synthesized
tgattaaaagattctaaaaaat

SEQ ID NO: 1255875 - DNA, 22 bp, Artificial Sequence
  chemically synthesized
gaaattgttcaaattatttttt

SEQ ID NO: 1255876 - DNA, 22 bp, Artificial Sequence
  chemically synthesized
aaagattctaaaaaataatttg

SEQ ID NO: 1255877 - DNA, 22 bp, Artificial Sequence
  chemically synthesized
tggtaactggaaattgttcaaa

SEQ ID NO: 1255878 - DNA, 22 bp, Artificial Sequence
  chemically synthesized
atggtaactggaaattgttcaa

SEQ ID NO: 1255879 - DNA, 22 bp, Artificial Sequence
  chemically synthesized
taaaaaataatttgaacaattt

SEQ ID NO: 1255880 - DNA, 22 bp, Artificial Sequence
  chemically synthesized
tatggtaactggaaattgttca

SEQ ID NO: 1255881 - DNA, 22 bp, Artificial Sequence
  chemically synthesized
ttatggtaactggaaattgttc

SEQ ID NO: 1255882 - DNA, 22 bp, Artificial Sequence
  chemically synthesized
aaaaataatttgaacaatttcc

SEQ ID NO: 1255883 - DNA, 22 bp, Artificial Sequence
  chemically synthesized
tttatggtaactggaaattgtt

SEQ ID NO: 1255884 - DNA, 22 bp, Artificial Sequence
  chemically synthesized
gaacaatttccagttaccataa

SEQ ID NO: 1255885 - DNA, 22 bp, Artificial Sequence
  chemically synthesized
aaccatgtctttttatggtaac

SEQ ID NO: 1255886 - DNA, 22 bp, Artificial Sequence
  chemically synthesized
aacaatttccagttaccataaa

SEQ ID NO: 1255887 - DNA, 22 bp, Artificial Sequence
  chemically synthesized
tcaaccatgtctttttatggta

SEQ ID NO: 1255888 - DNA, 22 bp, Artificial Sequence
  chemically synthesized
ctcaaccatgtctttttatggt

SEQ ID NO: 1255889 - DNA, 22 bp, Artificial Sequence
  chemically synthesized
tctcaaccatgtctttttatgg

SEQ ID NO: 1255890 - DNA, 22 bp, Artificial Sequence
  chemically synthesized
ttctcaaccatgtctttttatg

SEQ ID NO: 1255891 - DNA, 22 bp, Artificial Sequence
  chemically synthesized
ccagttaccataaaaagacatg

SEQ ID NO: 1255892 - DNA, 22 bp, Artificial Sequence
  chemically synthesized
cagttaccataaaaagacatgg

SEQ ID NO: 1255893 - DNA, 22 bp, Artificial Sequence
  chemically synthesized
catttttctcaaccatgtcttt

SEQ ID NO: 1255894 - DNA, 22 bp, Artificial Sequence
  chemically synthesized
ccataaaaagacatggttgaga

SEQ ID NO: 1255895 - DNA, 22 bp, Artificial Sequence
  chemically synthesized
aatatcaatagcaaaaagttgc

SEQ ID NO: 1255896 - DNA, 22 bp, Artificial Sequence
  chemically synthesized
ttgaatatcaatagcaaaaagt

SEQ ID NO: 1255897 - DNA, 22 bp, Artificial Sequence
  chemically synthesized
agaaaaatgcaactttttgcta

SEQ ID NO: 1255898 - DNA, 22 bp, Artificial Sequence
  chemically synthesized
attgaatatcaatagcaaaaag

SEQ ID NO: 1255899 - DNA, 22 bp, Artificial Sequence
  chemically synthesized
tttgctattgatattcaataaa

SEQ ID NO: 1255900 - DNA, 22 bp, Artificial Sequence
  chemically synthesized
ttgctattgatattcaataaat

SEQ ID NO: 1255901 - DNA, 22 bp, Artificial Sequence
  chemically synthesized
tgctattgatattcaataaatg

SEQ ID NO: 1255902 - DNA, 22 bp, Artificial Sequence
  chemically synthesized
gctattgatattcaataaatgt

SEQ ID NO: 1255903 - DNA, 22 bp, Artificial Sequence
  chemically synthesized
tatatatagtaaacatttattg

SEQ ID NO: 1255904 - DNA, 22 bp, Artificial Sequence
  chemically synthesized
ctattgatattcaataaatgtt

SEQ ID NO: 1255905 - DNA, 22 bp, Artificial Sequence
  chemically synthesized
atatatatagtaaacatttatt

SEQ ID NO: 1255906 - DNA, 22 bp, Artificial Sequence
  chemically synthesized
ttgatattcaataaatgtttac

SEQ ID NO: 1255907 - DNA, 22 bp, Artificial Sequence
  chemically synthesized
atattcaataaatgtttactat

SEQ ID NO: 1255908 - DNA, 22 bp, Artificial Sequence
  chemically synthesized
agccccaacttatatatatagt

SEQ ID NO: 1255909 - DNA, 22 bp, Artificial Sequence
  chemically synthesized
aataaatgtttactatatatat

SEQ ID NO: 1255910 - DNA, 22 bp, Artificial Sequence
  chemically synthesized
actatatatataagttggggct

SEQ ID NO: 1255911 - DNA, 22 bp, Artificial Sequence
  chemically synthesized
ctatatatataagttggggctg

SEQ ID NO: 1255912 - DNA, 22 bp, Artificial Sequence
  chemically synthesized
tatatataagttggggctgagt

SEQ ID NO: 1255913 - DNA, 22 bp, Artificial Sequence
  chemically synthesized
agacccaaagaatgaaagaaag

SEQ ID NO: 1255914 - DNA, 22 bp, Artificial Sequence
  chemically synthesized
gggctgagtctttctttcattc

SEQ ID NO: 1255915 - DNA, 22 bp, Artificial Sequence
  chemically synthesized
tgctaagacccaaagaatgaaa

SEQ ID NO: 1255916 - DNA, 22 bp, Artificial Sequence
  chemically synthesized
atgctaagacccaaagaatgaa

SEQ ID NO: 1255917 - DNA, 22 bp, Artificial Sequence
  chemically synthesized
agtctttctttcattctttggg

SEQ ID NO: 1255918 - DNA, 22 bp, Artificial Sequence
  chemically synthesized
tctttcattctttgggtcttag

SEQ ID NO: 1255919 - DNA, 22 bp, Artificial Sequence
  chemically synthesized
ctttcattctttgggtcttagc

SEQ ID NO: 1255920 - DNA, 22 bp, Artificial Sequence
  chemically synthesized
tttcattctttgggtcttagca

SEQ ID NO: 1255921 - DNA, 22 bp, Artificial Sequence
  chemically synthesized
tcattctttgggtcttagcata

SEQ ID NO: 1255922 - DNA, 22 bp, Artificial Sequence
  chemically synthesized
cattctttgggtcttagcataa

SEQ ID NO: 1255923 - DNA, 22 bp, Artificial Sequence
  chemically synthesized
attctttgggtcttagcataaa

SEQ ID NO: 1255924 - DNA, 22 bp, Artificial Sequence
  chemically synthesized
ggggaggtggtgtttatgctaa

SEQ ID NO: 1255925 - DNA, 22 bp, Artificial Sequence
  chemically synthesized
tttgggtcttagcataaacacc

SEQ ID NO: 1255926 - DNA, 22 bp, Artificial Sequence
  chemically synthesized
tgggtcttagcataaacaccac

SEQ ID NO: 1255927 - DNA, 22 bp, Artificial Sequence
  chemically synthesized
gggtcttagcataaacaccacc

SEQ ID NO: 1255928 - DNA, 22 bp, Artificial Sequence
  chemically synthesized
ggtcttagcataaacaccacct

SEQ ID NO: 1255929 - DNA, 22 bp, Artificial Sequence
  chemically synthesized
agcataaacaccacctccccca

SEQ ID NO: 1255930 - DNA, 22 bp, Artificial Sequence
  chemically synthesized
gcataaacaccacctcccccaa

SEQ ID NO: 1255931 - DNA, 22 bp, Artificial Sequence
  chemically synthesized
gagcaggtggtgttgggggagg

SEQ ID NO: 1255932 - DNA, 22 bp, Artificial Sequence
  chemically synthesized
agagcaggtggtgttgggggag

SEQ ID NO: 1255933 - DNA, 22 bp, Artificial Sequence
  chemically synthesized
atttagagcaggtggtgttggg

SEQ ID NO: 1255934 - DNA, 22 bp, Artificial Sequence
  chemically synthesized
ccccaacaccacctgctctaaa

SEQ ID NO: 1255935 - DNA, 22 bp, Artificial Sequence
  chemically synthesized
ctctaaattaggtttcactggc

SEQ ID NO: 1255936 - DNA, 22 bp, Artificial Sequence
  chemically synthesized
taaattaggtttcactggccac

SEQ ID NO: 1255937 - DNA, 22 bp, Artificial Sequence
  chemically synthesized
aattaggtttcactggccactc

SEQ ID NO: 1255938 - DNA, 22 bp, Artificial Sequence
  chemically synthesized
ggtttcactggccactctcttg

SEQ ID NO: 1255939 - DNA, 22 bp, Artificial Sequence
  chemically synthesized
atggacaaggggacaagagagt

SEQ ID NO: 1255940 - DNA, 22 bp, Artificial Sequence
  chemically synthesized
tcatggacaaggggacaagaga

SEQ ID NO: 1255941 - DNA, 22 bp, Artificial Sequence
  chemically synthesized
cactggccactctcttgtcccc

SEQ ID NO: 1255942 - DNA, 22 bp, Artificial Sequence
  chemically synthesized
actggccactctcttgtcccct

SEQ ID NO: 1255943 - DNA, 22 bp, Artificial Sequence
  chemically synthesized
gccactctcttgtccccttgtc

SEQ ID NO: 1255944 - DNA, 22 bp, Artificial Sequence
  chemically synthesized
ggtgctctcatggacaagggga

SEQ ID NO: 1255945 - DNA, 22 bp, Artificial Sequence
  chemically synthesized
tgttgggtgctctcatggacaa

SEQ ID NO: 1255946 - DNA, 22 bp, Artificial Sequence
  chemically synthesized
tcttgtccccttgtccatgaga

SEQ ID NO: 1255947 - DNA, 22 bp, Artificial Sequence
  chemically synthesized
ttgtccccttgtccatgagagc

SEQ ID NO: 1255948 - DNA, 22 bp, Artificial Sequence
  chemically synthesized
gtccccttgtccatgagagcac

SEQ ID NO: 1255949 - DNA, 22 bp, Artificial Sequence
  chemically synthesized
aaattatgttgggtgctctcat

SEQ ID NO: 1255950 - DNA, 22 bp, Artificial Sequence
  chemically synthesized
tccccttgtccatgagagcacc

SEQ ID NO: 1255951 - DNA, 22 bp, Artificial Sequence
  chemically synthesized
caaattatgttgggtgctctca

SEQ ID NO: 1255952 - DNA, 22 bp, Artificial Sequence
  chemically synthesized
tcaaattatgttgggtgctctc

SEQ ID NO: 1255953 - DNA, 22 bp, Artificial Sequence
  chemically synthesized
gtccatgagagcacccaacata

SEQ ID NO: 1255954 - DNA, 22 bp, Artificial Sequence
  chemically synthesized
tccatgagagcacccaacataa

SEQ ID NO: 1255955 - DNA, 22 bp, Artificial Sequence
  chemically synthesized
aatgtatactttcaaattatgt

SEQ ID NO: 1255956 - DNA, 22 bp, Artificial Sequence
  chemically synthesized
acaaacaattaaatgtatactt

SEQ ID NO: 1255957 - DNA, 22 bp, Artificial Sequence
  chemically synthesized
gctaacaaacaattaaatgtat

SEQ ID NO: 1255958 - DNA, 22 bp, Artificial Sequence
  chemically synthesized
gaaagtatacatttaattgttt

SEQ ID NO: 1255959 - DNA, 22 bp, Artificial Sequence
  chemically synthesized
aaagtatacatttaattgtttg

SEQ ID NO: 1255960 - DNA, 22 bp, Artificial Sequence
  chemically synthesized
aattgtttgttagccagcttat

SEQ ID NO: 1255961 - DNA, 22 bp, Artificial Sequence
  chemically synthesized
attgtttgttagccagcttatt

SEQ ID NO: 1255962 - DNA, 22 bp, Artificial Sequence
  chemically synthesized
aggagaagatagtcaataagct

SEQ ID NO: 1255963 - DNA, 22 bp, Artificial Sequence
  chemically synthesized
tttgttagccagcttattgact

SEQ ID NO: 1255964 - DNA, 22 bp, Artificial Sequence
  chemically synthesized
gttagccagcttattgactatc

SEQ ID NO: 1255965 - DNA, 22 bp, Artificial Sequence
  chemically synthesized
ttagccagcttattgactatct

SEQ ID NO: 1255966 - DNA, 22 bp, Artificial Sequence
  chemically synthesized
atccattaaggagaagatagtc

SEQ ID NO: 1255967 - DNA, 22 bp, Artificial Sequence
  chemically synthesized
gccagcttattgactatcttct

SEQ ID NO: 1255968 - DNA, 22 bp, Artificial Sequence
  chemically synthesized
acaaactaatccattaaggaga

SEQ ID NO: 1255969 - DNA, 22 bp, Artificial Sequence
  chemically synthesized
attgactatcttctccttaatg

SEQ ID NO: 1255970 - DNA, 22 bp, Artificial Sequence
  chemically synthesized
cacaaactaatccattaaggag

SEQ ID NO: 1255971 - DNA, 22 bp, Artificial Sequence
  chemically synthesized
ttgactatcttctccttaatgg

SEQ ID NO: 1255972 - DNA, 22 bp, Artificial Sequence
  chemically synthesized
tcacaaactaatccattaagga

SEQ ID NO: 1255973 - DNA, 22 bp, Artificial Sequence
  chemically synthesized
actatcttctccttaatggatt

SEQ ID NO: 1255974 - DNA, 22 bp, Artificial Sequence
  chemically synthesized
aactttcacaaactaatccatt

SEQ ID NO: 1255975 - DNA, 22 bp, Artificial Sequence
  chemically synthesized
tcttctccttaatggattagtt

SEQ ID NO: 1255976 - DNA, 22 bp, Artificial Sequence
  chemically synthesized
ctccttaatggattagtttgtg

SEQ ID NO: 1255977 - DNA, 22 bp, Artificial Sequence
  chemically synthesized
tccttaatggattagtttgtga

SEQ ID NO: 1255978 - DNA, 22 bp, Artificial Sequence
  chemically synthesized
cttaatggattagtttgtgaaa

SEQ ID NO: 1255979 - DNA, 22 bp, Artificial Sequence
  chemically synthesized
aatggattagtttgtgaaagtt

SEQ ID NO: 1255980 - DNA, 22 bp, Artificial Sequence
  chemically synthesized
atggattagtttgtgaaagttt

SEQ ID NO: 1255981 - DNA, 22 bp, Artificial Sequence
  chemically synthesized
gtttgtgaaagtttagaccata

SEQ ID NO: 1255982 - DNA, 22 bp, Artificial Sequence
  chemically synthesized
gtgaaagtttagaccatattca

SEQ ID NO: 1255983 - DNA, 22 bp, Artificial Sequence
  chemically synthesized
tgaaagtttagaccatattcat

SEQ ID NO: 1255984 - DNA, 22 bp, Artificial Sequence
  chemically synthesized
agaccatattcatttggttcac

SEQ ID NO: 1255985 - DNA, 22 bp, Artificial Sequence
  chemically synthesized
gaccatattcatttggttcact

SEQ ID NO: 1255986 - DNA, 22 bp, Artificial Sequence
  chemically synthesized
ggtgccaggaatatgacagtga

SEQ ID NO: 1255987 - DNA, 22 bp, Artificial Sequence
  chemically synthesized
taggtgccaggaatatgacagt

SEQ ID NO: 1255988 - DNA, 22 bp, Artificial Sequence
  chemically synthesized
ctaggtgccaggaatatgacag

SEQ ID NO: 1255989 - DNA, 22 bp, Artificial Sequence
  chemically synthesized
atttggttcactgtcatattcc

SEQ ID NO: 1255990 - DNA, 22 bp, Artificial Sequence
  chemically synthesized
ggttcactgtcatattcctggc

SEQ ID NO: 1255991 - DNA, 22 bp, Artificial Sequence
  chemically synthesized
gttcactgtcatattcctggca

SEQ ID NO: 1255992 - DNA, 22 bp, Artificial Sequence
  chemically synthesized
actgtcatattcctggcaccta

SEQ ID NO: 1255993 - DNA, 22 bp, Artificial Sequence
  chemically synthesized
tcatattcctggcacctagaag

SEQ ID NO: 1255994 - DNA, 22 bp, Artificial Sequence
  chemically synthesized
caatacgtcaacaacccttcta

SEQ ID NO: 1255995 - DNA, 22 bp, Artificial Sequence
  chemically synthesized
tgcaatacgtcaacaacccttc

SEQ ID NO: 1255996 - DNA, 22 bp, Artificial Sequence
  chemically synthesized
ctggcacctagaagggttgttg

SEQ ID NO: 1255997 - DNA, 22 bp, Artificial Sequence
  chemically synthesized
gcacctagaagggttgttgacg

SEQ ID NO: 1255998 - DNA, 22 bp, Artificial Sequence
  chemically synthesized
agaatctctgcaatacgtcaac

SEQ ID NO: 1255999 - DNA, 22 bp, Artificial Sequence
  chemically synthesized
gaagggttgttgacgtattgca

SEQ ID NO: 1256000 - DNA, 22 bp, Artificial Sequence
  chemically synthesized
ttgacgtattgcagagattctc

SEQ ID NO: 1256001 - DNA, 22 bp, Artificial Sequence
  chemically synthesized
acgtattgcagagattctcaat

SEQ ID NO: 1256002 - DNA, 22 bp, Artificial Sequence
  chemically synthesized
agtagcaccaagattgagaatc

SEQ ID NO: 1256003 - DNA, 22 bp, Artificial Sequence
  chemically synthesized
cagagattctcaatcttggtgc

SEQ ID NO: 1256004 - DNA, 22 bp, Artificial Sequence
  chemically synthesized
tgcaaaatctcagtagcaccaa

SEQ ID NO: 1256005 - DNA, 22 bp, Artificial Sequence
  chemically synthesized
gtgcaaaatctcagtagcacca

SEQ ID NO: 1256006 - DNA, 22 bp, Artificial Sequence
  chemically synthesized
tcaatcttggtgctactgagat

SEQ ID NO: 1256007 - DNA, 22 bp, Artificial Sequence
  chemically synthesized
aatcttggtgctactgagattt

SEQ ID NO: 1256008 - DNA, 22 bp, Artificial Sequence
  chemically synthesized
ggtgctactgagattttgcaca

SEQ ID NO: 1256009 - DNA, 22 bp, Artificial Sequence
  chemically synthesized
gtgctactgagattttgcacaa

SEQ ID NO: 1256010 - DNA, 22 bp, Artificial Sequence
  chemically synthesized
ctgagattttgcacaagatgat

SEQ ID NO: 1256011 - DNA, 22 bp, Artificial Sequence
  chemically synthesized
agattttgcacaagatgattct

SEQ ID NO: 1256012 - DNA, 22 bp, Artificial Sequence
  chemically synthesized
tgcacaagatgattctttatta

SEQ ID NO: 1256013 - DNA, 22 bp, Artificial Sequence
  chemically synthesized
gcacaagatgattctttattat

SEQ ID NO: 1256014 - DNA, 22 bp, Artificial Sequence
  chemically synthesized
cacaagatgattctttattatg

SEQ ID NO: 1256015 - DNA, 22 bp, Artificial Sequence
  chemically synthesized
aggtcaacccaccataataaag

SEQ ID NO: 1256016 - DNA, 22 bp, Artificial Sequence
  chemically synthesized
tttattatggtgggttgacctg

SEQ ID NO: 1256017 - DNA, 22 bp, Artificial Sequence
  chemically synthesized
tattatggtgggttgacctgaa

SEQ ID NO: 1256018 - DNA, 22 bp, Artificial Sequence
  chemically synthesized
attatggtgggttgacctgaac

SEQ ID NO: 1256019 - DNA, 22 bp, Artificial Sequence
  chemically synthesized
ttatggtgggttgacctgaaca

SEQ ID NO: 1256020 - DNA, 22 bp, Artificial Sequence
  chemically synthesized
aacatgtaataatgttcaggtc

SEQ ID NO: 1256021 - DNA, 22 bp, Artificial Sequence
  chemically synthesized
tggtgggttgacctgaacatta

SEQ ID NO: 1256022 - DNA, 22 bp, Artificial Sequence
  chemically synthesized
ctaaacatgtaataatgttcag

SEQ ID NO: 1256023 - DNA, 22 bp, Artificial Sequence
  chemically synthesized
acctgaacattattacatgttt

SEQ ID NO: 1256024 - DNA, 22 bp, Artificial Sequence
  chemically synthesized
aacattattacatgtttagcaa

SEQ ID NO: 1256025 - DNA, 22 bp, Artificial Sequence
  chemically synthesized
ttacatgtttagcaacatccct

SEQ ID NO: 1256026 - DNA, 22 bp, Artificial Sequence
  chemically synthesized
gtgggtagagaccagggatgtt

SEQ ID NO: 1256027 - DNA, 22 bp, Artificial Sequence
  chemically synthesized
catgtttagcaacatccctggt

SEQ ID NO: 1256028 - DNA, 22 bp, Artificial Sequence
  chemically synthesized
gtgtctagtgggtagagaccag

SEQ ID NO: 1256029 - DNA, 22 bp, Artificial Sequence
  chemically synthesized
agcaacatccctggtctctacc

SEQ ID NO: 1256030 - DNA, 22 bp, Artificial Sequence
  chemically synthesized
gcaacatccctggtctctaccc

SEQ ID NO: 1256031 - DNA, 22 bp, Artificial Sequence
  chemically synthesized
ctggtgtctagtgggtagagac

SEQ ID NO: 1256032 - DNA, 22 bp, Artificial Sequence
  chemically synthesized
ctactggtgtctagtgggtaga

SEQ ID NO: 1256033 - DNA, 22 bp, Artificial Sequence
  chemically synthesized
gctactggtgtctagtgggtag

SEQ ID NO: 1256034 - DNA, 22 bp, Artificial Sequence
  chemically synthesized
gtctctacccactagacaccag

SEQ ID NO: 1256035 - DNA, 22 bp, Artificial Sequence
  chemically synthesized
tacccactagacaccagtagca

SEQ ID NO: 1256036 - DNA, 22 bp, Artificial Sequence
  chemically synthesized
cccactagacaccagtagcaaa

SEQ ID NO: 1256037 - DNA, 22 bp, Artificial Sequence
  chemically synthesized
aaagaagagatgtttgctactg

SEQ ID NO: 1256038 - DNA, 22 bp, Artificial Sequence
  chemically synthesized
gacaccagtagcaaacatctct

SEQ ID NO: 1256039 - DNA, 22 bp, Artificial Sequence
  chemically synthesized
gtggcataactaaaagaagaga

SEQ ID NO: 1256040 - DNA, 22 bp, Artificial Sequence
  chemically synthesized
ctagtggcataactaaaagaag

SEQ ID NO: 1256041 - DNA, 22 bp, Artificial Sequence
  chemically synthesized
ttcttttagttatgccactagg

SEQ ID NO: 1256042 - DNA, 22 bp, Artificial Sequence
  chemically synthesized
cttttagttatgccactaggaa

SEQ ID NO: 1256043 - DNA, 22 bp, Artificial Sequence
  chemically synthesized
ttttagttatgccactaggaat

SEQ ID NO: 1256044 - DNA, 22 bp, Artificial Sequence
  chemically synthesized
ttagttatgccactaggaatct

SEQ ID NO: 1256045 - DNA, 22 bp, Artificial Sequence
  chemically synthesized
tagttatgccactaggaatctc

SEQ ID NO: 1256046 - DNA, 22 bp, Artificial Sequence
  chemically synthesized
accatgtccggagagattccta

SEQ ID NO: 1256047 - DNA, 22 bp, Artificial Sequence
  chemically synthesized
agttatgccactaggaatctct

SEQ ID NO: 1256048 - DNA, 22 bp, Artificial Sequence
  chemically synthesized
caccatgtccggagagattcct

SEQ ID NO: 1256049 - DNA, 22 bp, Artificial Sequence
  chemically synthesized
gttatgccactaggaatctctc

SEQ ID NO: 1256050 - DNA, 22 bp, Artificial Sequence
  chemically synthesized
tttcaccatgtccggagagatt

SEQ ID NO: 1256051 - DNA, 22 bp, Artificial Sequence
  chemically synthesized
tgccactaggaatctctccgga

SEQ ID NO: 1256052 - DNA, 22 bp, Artificial Sequence
  chemically synthesized
ggaatctctccggacatggtga

SEQ ID NO: 1256053 - DNA, 22 bp, Artificial Sequence
  chemically synthesized
ccgtccaggggttatttcacca

SEQ ID NO: 1256054 - DNA, 22 bp, Artificial Sequence
  chemically synthesized
gccgtccaggggttatttcacc

SEQ ID NO: 1256055 - DNA, 22 bp, Artificial Sequence
  chemically synthesized
tgccgtccaggggttatttcac

SEQ ID NO: 1256056 - DNA, 22 bp, Artificial Sequence
  chemically synthesized
tccggacatggtgaaataaccc

SEQ ID NO: 1256057 - DNA, 22 bp, Artificial Sequence
  chemically synthesized
cggacatggtgaaataacccct

SEQ ID NO: 1256058 - DNA, 22 bp, Artificial Sequence
  chemically synthesized
ggtggttttgccgtccaggggt

SEQ ID NO: 1256059 - DNA, 22 bp, Artificial Sequence
  chemically synthesized
tgggtggttttgccgtccaggg

SEQ ID NO: 1256060 - DNA, 22 bp, Artificial Sequence
  chemically synthesized
aactctgggtggttttgccgtc

SEQ ID NO: 1256061 - DNA, 22 bp, Artificial Sequence
  chemically synthesized
tcaactctgggtggttttgccg

SEQ ID NO: 1256062 - DNA, 22 bp, Artificial Sequence
  chemically synthesized
agtgattctcaactctgggtgg

SEQ ID NO: 1256063 - DNA, 22 bp, Artificial Sequence
  chemically synthesized
gacggcaaaaccacccagagtt

SEQ ID NO: 1256064 - DNA, 22 bp, Artificial Sequence
  chemically synthesized
ttcagtgattctcaactctggg

SEQ ID NO: 1256065 - DNA, 22 bp, Artificial Sequence
  chemically synthesized
aattattcagtgattctcaact

SEQ ID NO: 1256066 - DNA, 22 bp, Artificial Sequence
  chemically synthesized
tgtattaaattattcagtgatt

SEQ ID NO: 1256067 - DNA, 22 bp, Artificial Sequence
  chemically synthesized
atgtattaaattattcagtgat

SEQ ID NO: 1256068 - DNA, 22 bp, Artificial Sequence
  chemically synthesized
atttatgtattaaattattcag

SEQ ID NO: 1256069 - DNA, 22 bp, Artificial Sequence
  chemically synthesized
ttcatttatgtattaaattatt

SEQ ID NO: 1256070 - DNA, 22 bp, Artificial Sequence
  chemically synthesized
gttcatttatgtattaaattat

SEQ ID NO: 1256071 - DNA, 22 bp, Artificial Sequence
  chemically synthesized
agaatcactgaataatttaata

SEQ ID NO: 1256072 - DNA, 22 bp, Artificial Sequence
  chemically synthesized
atttgttcatttatgtattaaa

SEQ ID NO: 1256073 - DNA, 22 bp, Artificial Sequence
  chemically synthesized
actcatttgttcatttatgtat

SEQ ID NO: 1256074 - DNA, 22 bp, Artificial Sequence
  chemically synthesized
aataatttaatacataaatgaa

SEQ ID NO: 1256075 - DNA, 22 bp, Artificial Sequence
  chemically synthesized
actcactcatttgttcatttat

SEQ ID NO: 1256076 - DNA, 22 bp, Artificial Sequence
  chemically synthesized
attcactcactcatttgttcat

SEQ ID NO: 1256077 - DNA, 22 bp, Artificial Sequence
  chemically synthesized
aatacataaatgaacaaatgag

SEQ ID NO: 1256078 - DNA, 22 bp, Artificial Sequence
  chemically synthesized
atacataaatgaacaaatgagt

SEQ ID NO: 1256079 - DNA, 22 bp, Artificial Sequence
  chemically synthesized
attcattcactcactcatttgt

SEQ ID NO: 1256080 - DNA, 22 bp, Artificial Sequence
  chemically synthesized
attcattcattcactcactcat

SEQ ID NO: 1256081 - DNA, 22 bp, Artificial Sequence
  chemically synthesized
actcattcattcattcactcac

SEQ ID NO: 1256082 - DNA, 22 bp, Artificial Sequence
  chemically synthesized
attaactcattcattcattcac

SEQ ID NO: 1256083 - DNA, 22 bp, Artificial Sequence
  chemically synthesized
ttcattaactcattcattcatt

SEQ ID NO: 1256084 - DNA, 22 bp, Artificial Sequence
  chemically synthesized
agcaatcagacagttattcatt

SEQ ID NO: 1256085 - DNA, 22 bp, Artificial Sequence
  chemically synthesized
tgagcaatcagacagttattca

SEQ ID NO: 1256086 - DNA, 22 bp, Artificial Sequence
  chemically synthesized
ctgagcaatcagacagttattc

SEQ ID NO: 1256087 - DNA, 22 bp, Artificial Sequence
  chemically synthesized
tctgagcaatcagacagttatt

SEQ ID NO: 1256088 - DNA, 22 bp, Artificial Sequence
  chemically synthesized
cgttttctgagcaatcagacag

SEQ ID NO: 1256089 - DNA, 22 bp, Artificial Sequence
  chemically synthesized
ccgttttctgagcaatcagaca

SEQ ID NO: 1256090 - DNA, 22 bp, Artificial Sequence
  chemically synthesized
atgaataactgtctgattgctc

SEQ ID NO: 1256091 - DNA, 22 bp, Artificial Sequence
  chemically synthesized
cttccgttttctgagcaatcag

SEQ ID NO: 1256092 - DNA, 22 bp, Artificial Sequence
  chemically synthesized
tacttccgttttctgagcaatc

SEQ ID NO: 1256093 - DNA, 22 bp, Artificial Sequence
  chemically synthesized
ctacttccgttttctgagcaat

SEQ ID NO: 1256094 - DNA, 22 bp, Artificial Sequence
  chemically synthesized
cttctacttccgttttctgagc

SEQ ID NO: 1256095 - DNA, 22 bp, Artificial Sequence
  chemically synthesized
ctgcttctacttccgttttctg

SEQ ID NO: 1256096 - DNA, 22 bp, Artificial Sequence
  chemically synthesized
tctgattgctcagaaaacggaa

SEQ ID NO: 1256097 - DNA, 22 bp, Artificial Sequence
  chemically synthesized
ctcctgcttctacttccgtttt

SEQ ID NO: 1256098 - DNA, 22 bp, Artificial Sequence
  chemically synthesized
gctcctgcttctacttccgttt

SEQ ID NO: 1256099 - DNA, 22 bp, Artificial Sequence
  chemically synthesized
tgctcctgcttctacttccgtt

SEQ ID NO: 1256100 - DNA, 22 bp, Artificial Sequence
  chemically synthesized
attgctcagaaaacggaagtag

SEQ ID NO: 1256101 - DNA, 22 bp, Artificial Sequence
  chemically synthesized
ctcagaaaacggaagtagaagc

SEQ ID NO: 1256102 - DNA, 22 bp, Artificial Sequence
  chemically synthesized
agaaaacggaagtagaagcagg

SEQ ID NO: 1256103 - DNA, 22 bp, Artificial Sequence
  chemically synthesized
gaatgtgctttgctcctgcttc

SEQ ID NO: 1256104 - DNA, 22 bp, Artificial Sequence
  chemically synthesized
actggaatgtgctttgctcctg

SEQ ID NO: 1256105 - DNA, 22 bp, Artificial Sequence
  chemically synthesized
tctgactggaatgtgctttgct

SEQ ID NO: 1256106 - DNA, 22 bp, Artificial Sequence
  chemically synthesized
aaccatatcactatctgactgg

SEQ ID NO: 1256107 - DNA, 22 bp, Artificial Sequence
  chemically synthesized
aaaccatatcactatctgactg

SEQ ID NO: 1256108 - DNA, 22 bp, Artificial Sequence
  chemically synthesized
cagtcagatagtgatatggttt

SEQ ID NO: 1256109 - DNA, 22 bp, Artificial Sequence
  chemically synthesized
gtggggacatgaatttaaacca

SEQ ID NO: 1256110 - DNA, 22 bp, Artificial Sequence
  chemically synthesized
cgtggggacatgaatttaaacc

SEQ ID NO: 1256111 - DNA, 22 bp, Artificial Sequence
  chemically synthesized
aacatgagatttcgtggggaca

SEQ ID NO: 1256112 - DNA, 22 bp, Artificial Sequence
  chemically synthesized
aaattcatgtccccacgaaatc

SEQ ID NO: 1256113 - DNA, 22 bp, Artificial Sequence
  chemically synthesized
aattcatgtccccacgaaatct

SEQ ID NO: 1256114 - DNA, 22 bp, Artificial Sequence
  chemically synthesized
caattcaacatgagatttcgtg

SEQ ID NO: 1256115 - DNA, 22 bp, Artificial Sequence
  chemically synthesized
atgtccccacgaaatctcatgt

SEQ ID NO: 1256116 - DNA, 22 bp, Artificial Sequence
  chemically synthesized
gggattacaattcaacatgaga

SEQ ID NO: 1256117 - DNA, 22 bp, Artificial Sequence
  chemically synthesized
acattagggattacaattcaac

SEQ ID NO: 1256118 - DNA, 22 bp, Artificial Sequence
  chemically synthesized
taacattagggattacaattca

SEQ ID NO: 1256119 - DNA, 22 bp, Artificial Sequence
  chemically synthesized
atgttgaattgtaatccctaat

SEQ ID NO: 1256120 - DNA, 22 bp, Artificial Sequence
  chemically synthesized
aattgtaatccctaatgttaga

SEQ ID NO: 1256121 - DNA, 22 bp, Artificial Sequence
  chemically synthesized
ccaccaggccccacctctaaca

SEQ ID NO: 1256122 - DNA, 22 bp, Artificial Sequence
  chemically synthesized
taatccctaatgttagaggtgg

SEQ ID NO: 1256123 - DNA, 22 bp, Artificial Sequence
  chemically synthesized
atgttagaggtggggcctggtg

SEQ ID NO: 1256124 - DNA, 22 bp, Artificial Sequence
  chemically synthesized
gaggtggggcctggtggcaggt

SEQ ID NO: 1256125 - DNA, 22 bp, Artificial Sequence
  chemically synthesized
atgagaaacaccgtgatccaat

SEQ ID NO: 1256126 - DNA, 22 bp, Artificial Sequence
  chemically synthesized
gtggcaggtgattggatcacgg

SEQ ID NO: 1256127 - DNA, 22 bp, Artificial Sequence
  chemically synthesized
caccattaatgagaaacaccgt

SEQ ID NO: 1256128 - DNA, 22 bp, Artificial Sequence
  chemically synthesized
gatcacggtgtttctcattaat

SEQ ID NO: 1256129 - DNA, 22 bp, Artificial Sequence
  chemically synthesized
ctcattaatggtgtagcaccat

SEQ ID NO: 1256130 - DNA, 22 bp, Artificial Sequence
  chemically synthesized
tcattaatggtgtagcaccatc

SEQ ID NO: 1256131 - DNA, 22 bp, Artificial Sequence
  chemically synthesized
attaatggtgtagcaccatccc

SEQ ID NO: 1256132 - DNA, 22 bp, Artificial Sequence
  chemically synthesized
atggtgtagcaccatccccttg

SEQ ID NO: 1256133 - DNA, 22 bp, Artificial Sequence
  chemically synthesized
tcgcgagaacagcatcaagggg

SEQ ID NO: 1256134 - DNA, 22 bp, Artificial Sequence
  chemically synthesized
gtgagagcccactatcgcgaga

SEQ ID NO: 1256135 - DNA, 22 bp, Artificial Sequence
  chemically synthesized
gatgctgttctcgcgatagtgg

SEQ ID NO: 1256136 - DNA, 22 bp, Artificial Sequence
  chemically synthesized
atgctgttctcgcgatagtggg

SEQ ID NO: 1256137 - DNA, 22 bp, Artificial Sequence
  chemically synthesized
ttctcgcgatagtgggctctca

SEQ ID NO: 1256138 - DNA, 22 bp, Artificial Sequence
  chemically synthesized
tcgcgatagtgggctctcacga

SEQ ID NO: 1256139 - DNA, 22 bp, Artificial Sequence
  chemically synthesized
aacaaccagatctcgtgagagc

SEQ ID NO: 1256140 - DNA, 22 bp, Artificial Sequence
  chemically synthesized
aaacaaccagatctcgtgagag

SEQ ID NO: 1256141 - DNA, 22 bp, Artificial Sequence
  chemically synthesized
gcgatagtgggctctcacgaga

SEQ ID NO: 1256142 - DNA, 22 bp, Artificial Sequence
  chemically synthesized
taaacaaccagatctcgtgaga

SEQ ID NO: 1256143 - DNA, 22 bp, Artificial Sequence
  chemically synthesized
ttaaacaaccagatctcgtgag

SEQ ID NO: 1256144 - DNA, 22 bp, Artificial Sequence
  chemically synthesized
cacacttttaaacaaccagatc

SEQ ID NO: 1256145 - DNA, 22 bp, Artificial Sequence
  chemically synthesized
tcacgagatctggttgtttaaa

SEQ ID NO: 1256146 - DNA, 22 bp, Artificial Sequence
  chemically synthesized
acgagatctggttgtttaaaag

SEQ ID NO: 1256147 - DNA, 22 bp, Artificial Sequence
  chemically synthesized
gttgtttaaaagtgtgcagcac

SEQ ID NO: 1256148 - DNA, 22 bp, Artificial Sequence
  chemically synthesized
tttaaaagtgtgcagcacctcc

SEQ ID NO: 1256149 - DNA, 22 bp, Artificial Sequence
  chemically synthesized
aaaagtgtgcagcacctcccca

SEQ ID NO: 1256150 - DNA, 22 bp, Artificial Sequence
  chemically synthesized
aaagtgtgcagcacctccccac

SEQ ID NO: 1256151 - DNA, 22 bp, Artificial Sequence
  chemically synthesized
cccacttgctgtctctcttgcc

SEQ ID NO: 1256152 - DNA, 22 bp, Artificial Sequence
  chemically synthesized
agacggtgggagcaagggcaag

SEQ ID NO: 1256153 - DNA, 22 bp, Artificial Sequence
  chemically synthesized
gctgtctctcttgcccttgctc

SEQ ID NO: 1256154 - DNA, 22 bp, Artificial Sequence
  chemically synthesized
ctgtctctcttgcccttgctcc

SEQ ID NO: 1256155 - DNA, 22 bp, Artificial Sequence
  chemically synthesized
tctctcttgcccttgctcccac

SEQ ID NO: 1256156 - DNA, 22 bp, Artificial Sequence
  chemically synthesized
tcttgcccttgctcccaccgtc

SEQ ID NO: 1256157 - DNA, 22 bp, Artificial Sequence
  chemically synthesized
ttgcccttgctcccaccgtctg

SEQ ID NO: 1256158 - DNA, 22 bp, Artificial Sequence
  chemically synthesized
gcccttgctcccaccgtctgag

SEQ ID NO: 1256159 - DNA, 22 bp, Artificial Sequence
  chemically synthesized
cccttgctcccaccgtctgagt

SEQ ID NO: 1256160 - DNA, 22 bp, Artificial Sequence
  chemically synthesized
gctcccaccgtctgagtcacct

SEQ ID NO: 1256161 - DNA, 22 bp, Artificial Sequence
  chemically synthesized
ctcccaccgtctgagtcacctc

SEQ ID NO: 1256162 - DNA, 22 bp, Artificial Sequence
  chemically synthesized
ccaccgtctgagtcacctcgct

SEQ ID NO: 1256163 - DNA, 22 bp, Artificial Sequence
  chemically synthesized
agtcacctcgctccccgtctgc

SEQ ID NO: 1256164 - DNA, 22 bp, Artificial Sequence
  chemically synthesized
atcatggcagaaggcagacggg

SEQ ID NO: 1256165 - DNA, 22 bp, Artificial Sequence
  chemically synthesized
taatcatggcagaaggcagacg

SEQ ID NO: 1256166 - DNA, 22 bp, Artificial Sequence
  chemically synthesized
ctaatcatggcagaaggcagac

SEQ ID NO: 1256167 - DNA, 22 bp, Artificial Sequence
  chemically synthesized
gctccccgtctgccttctgcca

SEQ ID NO: 1256168 - DNA, 22 bp, Artificial Sequence
  chemically synthesized
cccgtctgccttctgccatgat

SEQ ID NO: 1256169 - DNA, 22 bp, Artificial Sequence
  chemically synthesized
aggaagcttctaatcatggcag

SEQ ID NO: 1256170 - DNA, 22 bp, Artificial Sequence
  chemically synthesized
ccttctgccatgattagaagct

SEQ ID NO: 1256171 - DNA, 22 bp, Artificial Sequence
  chemically synthesized
gggcggcctcaggaagcttcta

SEQ ID NO: 1256172 - DNA, 22 bp, Artificial Sequence
  chemically synthesized
ctgccatgattagaagcttcct

SEQ ID NO: 1256173 - DNA, 22 bp, Artificial Sequence
  chemically synthesized
tggggcggcctcaggaagcttc

SEQ ID NO: 1256174 - DNA, 22 bp, Artificial Sequence
  chemically synthesized
tgccatgattagaagcttcctg

SEQ ID NO: 1256175 - DNA, 22 bp, Artificial Sequence
  chemically synthesized
ctggggcggcctcaggaagctt

SEQ ID NO: 1256176 - DNA, 22 bp, Artificial Sequence
  chemically synthesized
ccatgattagaagcttcctgag

SEQ ID NO: 1256177 - DNA, 22 bp, Artificial Sequence
  chemically synthesized
cttctggggcggcctcaggaag

SEQ ID NO: 1256178 - DNA, 22 bp, Artificial Sequence
  chemically synthesized
tgcttctggggcggcctcagga

SEQ ID NO: 1256179 - DNA, 22 bp, Artificial Sequence
  chemically synthesized
ctgcttctggggcggcctcagg

SEQ ID NO: 1256180 - DNA, 22 bp, Artificial Sequence
  chemically synthesized
gaagcttcctgaggccgcccca

SEQ ID NO: 1256181 - DNA, 22 bp, Artificial Sequence
  chemically synthesized
cctgaggccgccccagaagcag

SEQ ID NO: 1256182 - DNA, 22 bp, Artificial Sequence
  chemically synthesized
ctgaggccgccccagaagcaga

SEQ ID NO: 1256183 - DNA, 22 bp, Artificial Sequence
  chemically synthesized
aggccgccccagaagcagaagc

SEQ ID NO: 1256184 - DNA, 22 bp, Artificial Sequence
  chemically synthesized
aggaagcatagcagcttctgct

SEQ ID NO: 1256185 - DNA, 22 bp, Artificial Sequence
  chemically synthesized
ttcaggaagcatagcagcttct

SEQ ID NO: 1256186 - DNA, 22 bp, Artificial Sequence
  chemically synthesized
caggctgttcaggaagcatagc

SEQ ID NO: 1256187 - DNA, 22 bp, Artificial Sequence
  chemically synthesized
tgcaggctgttcaggaagcata

SEQ ID NO: 1256188 - DNA, 22 bp, Artificial Sequence
  chemically synthesized
acggttctgcaggctgttcagg

SEQ ID NO: 1256189 - DNA, 22 bp, Artificial Sequence
  chemically synthesized
ctatgcttcctgaacagcctgc

SEQ ID NO: 1256190 - DNA, 22 bp, Artificial Sequence
  chemically synthesized
gttcacggttctgcaggctgtt

SEQ ID NO: 1256191 - DNA, 22 bp, Artificial Sequence
  chemically synthesized
tgcttcctgaacagcctgcaga

SEQ ID NO: 1256192 - DNA, 22 bp, Artificial Sequence
  chemically synthesized
gttggttcacggttctgcaggc

SEQ ID NO: 1256193 - DNA, 22 bp, Artificial Sequence
  chemically synthesized
agttggttcacggttctgcagg

SEQ ID NO: 1256194 - DNA, 22 bp, Artificial Sequence
  chemically synthesized
cctgaacagcctgcagaaccgt

SEQ ID NO: 1256195 - DNA, 22 bp, Artificial Sequence
  chemically synthesized
ctgaacagcctgcagaaccgtg

SEQ ID NO: 1256196 - DNA, 22 bp, Artificial Sequence
  chemically synthesized
aacagcctgcagaaccgtgaac

SEQ ID NO: 1256197 - DNA, 22 bp, Artificial Sequence
  chemically synthesized
cagaaccgtgaaccaactaaac

SEQ ID NO: 1256198 - DNA, 22 bp, Artificial Sequence
  chemically synthesized
taaagaaaagacgtttagttgg

SEQ ID NO: 1256199 - DNA, 22 bp, Artificial Sequence
  chemically synthesized
ataaagaaaagacgtttagttg

SEQ ID NO: 1256200 - DNA, 22 bp, Artificial Sequence
  chemically synthesized
gataatttataaagaaaagacg

SEQ ID NO: 1256201 - DNA, 22 bp, Artificial Sequence
  chemically synthesized
acactggataatttataaagaa

SEQ ID NO: 1256202 - DNA, 22 bp, Artificial Sequence
  chemically synthesized
aacgtcttttctttataaatta

SEQ ID NO: 1256203 - DNA, 22 bp, Artificial Sequence
  chemically synthesized
ttctttataaattatccagtgt

SEQ ID NO: 1256204 - DNA, 22 bp, Artificial Sequence
  chemically synthesized
tctttataaattatccagtgtc

SEQ ID NO: 1256205 - DNA, 22 bp, Artificial Sequence
  chemically synthesized
ctttataaattatccagtgtca

SEQ ID NO: 1256206 - DNA, 22 bp, Artificial Sequence
  chemically synthesized
taaagaaatacctgacactgga

SEQ ID NO: 1256207 - DNA, 22 bp, Artificial Sequence
  chemically synthesized
tttataaattatccagtgtcag

SEQ ID NO: 1256208 - DNA, 22 bp, Artificial Sequence
  chemically synthesized
tataaattatccagtgtcaggt

SEQ ID NO: 1256209 - DNA, 22 bp, Artificial Sequence
  chemically synthesized
ctgtaaagaaatacctgacact

SEQ ID NO: 1256210 - DNA, 22 bp, Artificial Sequence
  chemically synthesized
ataaattatccagtgtcaggta

SEQ ID NO: 1256211 - DNA, 22 bp, Artificial Sequence
  chemically synthesized
taaattatccagtgtcaggtat

SEQ ID NO: 1256212 - DNA, 22 bp, Artificial Sequence
  chemically synthesized
gcattgctgtaaagaaatacct

SEQ ID NO: 1256213 - DNA, 22 bp, Artificial Sequence
  chemically synthesized
tggcattgctgtaaagaaatac

SEQ ID NO: 1256214 - DNA, 22 bp, Artificial Sequence
  chemically synthesized
tccagtgtcaggtatttcttta

SEQ ID NO: 1256215 - DNA, 22 bp, Artificial Sequence
  chemically synthesized
gtccattctggcattgctgtaa

SEQ ID NO: 1256216 - DNA, 22 bp, Artificial Sequence
  chemically synthesized
tattagtccattctggcattgc

SEQ ID NO: 1256217 - DNA, 22 bp, Artificial Sequence
  chemically synthesized
tgtattagtccattctggcatt

SEQ ID NO: 1256218 - DNA, 22 bp, Artificial Sequence
  chemically synthesized
ctttacagcaatgccagaatgg

SEQ ID NO: 1256219 - DNA, 22 bp, Artificial Sequence
  chemically synthesized
tttacagcaatgccagaatgga

SEQ ID NO: 1256220 - DNA, 22 bp, Artificial Sequence
  chemically synthesized
cctctgtattagtccattctgg

SEQ ID NO: 1256221 - DNA, 22 bp, Artificial Sequence
  chemically synthesized
tacagcaatgccagaatggact

SEQ ID NO: 1256222 - DNA, 22 bp, Artificial Sequence
  chemically synthesized
acagcaatgccagaatggacta

SEQ ID NO: 1256223 - DNA, 22 bp, Artificial Sequence
  chemically synthesized
ttccctctgtattagtccattc

SEQ ID NO: 1256224 - DNA, 22 bp, Artificial Sequence
  chemically synthesized
cagcaatgccagaatggactaa

SEQ ID NO: 1256225 - DNA, 22 bp, Artificial Sequence
  chemically synthesized
ctgttccctctgtattagtcca

SEQ ID NO: 1256226 - DNA, 22 bp, Artificial Sequence
  chemically synthesized
actgttccctctgtattagtcc

SEQ ID NO: 1256227 - DNA, 22 bp, Artificial Sequence
  chemically synthesized
tttactgttccctctgtattag

SEQ ID NO: 1256228 - DNA, 22 bp, Artificial Sequence
  chemically synthesized
atttactgttccctctgtatta

SEQ ID NO: 1256229 - DNA, 22 bp, Artificial Sequence
  chemically synthesized
cttatttactgttccctctgta

SEQ ID NO: 1256230 - DNA, 22 bp, Artificial Sequence
  chemically synthesized
ggtgtctacttatttactgttc

SEQ ID NO: 1256231 - DNA, 22 bp, Artificial Sequence
  chemically synthesized
atacagagggaacagtaaataa

SEQ ID NO: 1256232 - DNA, 22 bp, Artificial Sequence
  chemically synthesized
aagtccctcggtgtctacttat

SEQ ID NO: 1256233 - DNA, 22 bp, Artificial Sequence
  chemically synthesized
caagtccctcggtgtctactta

SEQ ID NO: 1256234 - DNA, 22 bp, Artificial Sequence
  chemically synthesized
tcaagtccctcggtgtctactt

SEQ ID NO: 1256235 - DNA, 22 bp, Artificial Sequence
  chemically synthesized
catgtaataagctttcaagtcc

SEQ ID NO: 1256236 - DNA, 22 bp, Artificial Sequence
  chemically synthesized
gcatgtaataagctttcaagtc

SEQ ID NO: 1256237 - DNA, 22 bp, Artificial Sequence
  chemically synthesized
ttgcatgtaataagctttcaag

SEQ ID NO: 1256238 - DNA, 22 bp, Artificial Sequence
  chemically synthesized
gttcttgcatgtaataagcttt

SEQ ID NO: 1256239 - DNA, 22 bp, Artificial Sequence
  chemically synthesized
agttcttgcatgtaataagctt

SEQ ID NO: 1256240 - DNA, 22 bp, Artificial Sequence
  chemically synthesized
tcttagttcttgcatgtaataa

SEQ ID NO: 1256241 - DNA, 22 bp, Artificial Sequence
  chemically synthesized
tgtcttagttcttgcatgtaat

SEQ ID NO: 1256242 - DNA, 22 bp, Artificial Sequence
  chemically synthesized
gaaagcttattacatgcaagaa

SEQ ID NO: 1256243 - DNA, 22 bp, Artificial Sequence
  chemically synthesized
gctctgtcttagttcttgcatg

SEQ ID NO: 1256244 - DNA, 22 bp, Artificial Sequence
  chemically synthesized
aaagcttattacatgcaagaac

SEQ ID NO: 1256245 - DNA, 22 bp, Artificial Sequence
  chemically synthesized
attacatgcaagaactaagaca

SEQ ID NO: 1256246 - DNA, 22 bp, Artificial Sequence
  chemically synthesized
ttacatgcaagaactaagacag

SEQ ID NO: 1256247 - DNA, 22 bp, Artificial Sequence
  chemically synthesized
caggcaagctagctctgtctta

SEQ ID NO: 1256248 - DNA, 22 bp, Artificial Sequence
  chemically synthesized
catgcaagaactaagacagagc

SEQ ID NO: 1256249 - DNA, 22 bp, Artificial Sequence
  chemically synthesized
tagctccaggcaagctagctct

SEQ ID NO: 1256250 - DNA, 22 bp, Artificial Sequence
  chemically synthesized
gtagctccaggcaagctagctc

SEQ ID NO: 1256251 - DNA, 22 bp, Artificial Sequence
  chemically synthesized
ttgtagctccaggcaagctagc

SEQ ID NO: 1256252 - DNA, 22 bp, Artificial Sequence
  chemically synthesized
ctcttgtagctccaggcaagct

SEQ ID NO: 1256253 - DNA, 22 bp, Artificial Sequence
  chemically synthesized
gctcttgtagctccaggcaagc

SEQ ID NO: 1256254 - DNA, 22 bp, Artificial Sequence
  chemically synthesized
agacagagctagcttgcctgga

SEQ ID NO: 1256255 - DNA, 22 bp, Artificial Sequence
  chemically synthesized
tgctcttgtagctccaggcaag

SEQ ID NO: 1256256 - DNA, 22 bp, Artificial Sequence
  chemically synthesized
agctttgctcttgtagctccag

SEQ ID NO: 1256257 - DNA, 22 bp, Artificial Sequence
  chemically synthesized
aattcagctttgctcttgtagc

SEQ ID NO: 1256258 - DNA, 22 bp, Artificial Sequence
  chemically synthesized
gcttgcctggagctacaagagc

SEQ ID NO: 1256259 - DNA, 22 bp, Artificial Sequence
  chemically synthesized
caattcagctttgctcttgtag

SEQ ID NO: 1256260 - DNA, 22 bp, Artificial Sequence
  chemically synthesized
gcctggagctacaagagcaaag

SEQ ID NO: 1256261 - DNA, 22 bp, Artificial Sequence
  chemically synthesized
cctggagctacaagagcaaagc

SEQ ID NO: 1256262 - DNA, 22 bp, Artificial Sequence
  chemically synthesized
gcccatttcaattcagctttgc

SEQ ID NO: 1256263 - DNA, 22 bp, Artificial Sequence
  chemically synthesized
gagctacaagagcaaagctgaa

SEQ ID NO: 1256264 - DNA, 22 bp, Artificial Sequence
  chemically synthesized
cctcgcccatttcaattcagct

SEQ ID NO: 1256265 - DNA, 22 bp, Artificial Sequence
  chemically synthesized
caagagcaaagctgaattgaaa

SEQ ID NO: 1256266 - DNA, 22 bp, Artificial Sequence
  chemically synthesized
gaccatgcctccctcgcccatt

SEQ ID NO: 1256267 - DNA, 22 bp, Artificial Sequence
  chemically synthesized
aattgaaatgggcgagggaggc

SEQ ID NO: 1256268 - DNA, 22 bp, Artificial Sequence
  chemically synthesized
cataactggaccatgcctccct

SEQ ID NO: 1256269 - DNA, 22 bp, Artificial Sequence
  chemically synthesized
aaatgggcgagggaggcatggt

SEQ ID NO: 1256270 - DNA, 22 bp, Artificial Sequence
  chemically synthesized
acctacataactggaccatgcc

SEQ ID NO: 1256271 - DNA, 22 bp, Artificial Sequence
  chemically synthesized
gacctacataactggaccatgc

SEQ ID NO: 1256272 - DNA, 22 bp, Artificial Sequence
  chemically synthesized
accttgacctacataactggac

SEQ ID NO: 1256273 - DNA, 22 bp, Artificial Sequence
  chemically synthesized
aaccttgacctacataactgga

SEQ ID NO: 1256274 - DNA, 22 bp, Artificial Sequence
  chemically synthesized
taaccttgacctacataactgg

SEQ ID NO: 1256275 - DNA, 22 bp, Artificial Sequence
  chemically synthesized
ttaaccttgacctacataactg

SEQ ID NO: 1256276 - DNA, 22 bp, Artificial Sequence
  chemically synthesized
caaaccttttaaccttgaccta

SEQ ID NO: 1256277 - DNA, 22 bp, Artificial Sequence
  chemically synthesized
tgtaggtcaaggttaaaaggtt

SEQ ID NO: 1256278 - DNA, 22 bp, Artificial Sequence
  chemically synthesized
ccaagagtaaattccaaacctt

SEQ ID NO: 1256279 - DNA, 22 bp, Artificial Sequence
  chemically synthesized
taccaagagtaaattccaaacc

SEQ ID NO: 1256280 - DNA, 22 bp, Artificial Sequence
  chemically synthesized
attctaccaagagtaaattcca

SEQ ID NO: 1256281 - DNA, 22 bp, Artificial Sequence
  chemically synthesized
tcattctaccaagagtaaattc

SEQ ID NO: 1256282 - DNA, 22 bp, Artificial Sequence
  chemically synthesized
aaaggtttggaatttactcttg

SEQ ID NO: 1256283 - DNA, 22 bp, Artificial Sequence
  chemically synthesized
aaacgcctctcattctaccaag

SEQ ID NO: 1256284 - DNA, 22 bp, Artificial Sequence
  chemically synthesized
ggaatttactcttggtagaatg

SEQ ID NO: 1256285 - DNA, 22 bp, Artificial Sequence
  chemically synthesized
gaatttactcttggtagaatga

SEQ ID NO: 1256286 - DNA, 22 bp, Artificial Sequence
  chemically synthesized
attaaaacgcctctcattctac

SEQ ID NO: 1256287 - DNA, 22 bp, Artificial Sequence
  chemically synthesized
cattaaaacgcctctcattcta

SEQ ID NO: 1256288 - DNA, 22 bp, Artificial Sequence
  chemically synthesized
ttcattaaaacgcctctcattc

SEQ ID NO: 1256289 - DNA, 22 bp, Artificial Sequence
  chemically synthesized
actcttggtagaatgagaggcg

SEQ ID NO: 1256290 - DNA, 22 bp, Artificial Sequence
  chemically synthesized
ctcttggtagaatgagaggcgt

SEQ ID NO: 1256291 - DNA, 22 bp, Artificial Sequence
  chemically synthesized
acctcttcattaaaacgcctct

SEQ ID NO: 1256292 - DNA, 22 bp, Artificial Sequence
  chemically synthesized
ttggtagaatgagaggcgtttt

SEQ ID NO: 1256293 - DNA, 22 bp, Artificial Sequence
  chemically synthesized
ggtagaatgagaggcgttttaa

SEQ ID NO: 1256294 - DNA, 22 bp, Artificial Sequence
  chemically synthesized
gtagaatgagaggcgttttaat

SEQ ID NO: 1256295 - DNA, 22 bp, Artificial Sequence
  chemically synthesized
aatcatctcacctcttcattaa

SEQ ID NO: 1256296 - DNA, 22 bp, Artificial Sequence
  chemically synthesized
taatgaagaggtgagatgattt

SEQ ID NO: 1256297 - DNA, 22 bp, Artificial Sequence
  chemically synthesized
gaaagatcaattaaatcatctc

SEQ ID NO: 1256298 - DNA, 22 bp, Artificial Sequence
  chemically synthesized
aatgaagaggtgagatgattta

SEQ ID NO: 1256299 - DNA, 22 bp, Artificial Sequence
  chemically synthesized
agaaagatcaattaaatcatct

SEQ ID NO: 1256300 - DNA, 22 bp, Artificial Sequence
  chemically synthesized
atgaagaggtgagatgatttaa

SEQ ID NO: 1256301 - DNA, 22 bp, Artificial Sequence
  chemically synthesized
tagaaagatcaattaaatcatc

SEQ ID NO: 1256302 - DNA, 22 bp, Artificial Sequence
  chemically synthesized
ttagaaagatcaattaaatcat

SEQ ID NO: 1256303 - DNA, 22 bp, Artificial Sequence
  chemically synthesized
gagcaaccttttagaaagatca

SEQ ID NO: 1256304 - DNA, 22 bp, Artificial Sequence
  chemically synthesized
ggagcaaccttttagaaagatc

SEQ ID NO: 1256305 - DNA, 22 bp, Artificial Sequence
  chemically synthesized
agcatttggagcaaccttttag

SEQ ID NO: 1256306 - DNA, 22 bp, Artificial Sequence
  chemically synthesized
aattgatctttctaaaaggttg

SEQ ID NO: 1256307 - DNA, 22 bp, Artificial Sequence
  chemically synthesized
cagcatttggagcaacctttta

SEQ ID NO: 1256308 - DNA, 22 bp, Artificial Sequence
  chemically synthesized
attgatctttctaaaaggttgc

SEQ ID NO: 1256309 - DNA, 22 bp, Artificial Sequence
  chemically synthesized
atttcagcatttggagcaacct

SEQ ID NO: 1256310 - DNA, 22 bp, Artificial Sequence
  chemically synthesized
atctttctaaaaggttgctcca

SEQ ID NO: 1256311 - DNA, 22 bp, Artificial Sequence
  chemically synthesized
tctaaaaggttgctccaaatgc

SEQ ID NO: 1256312 - DNA, 22 bp, Artificial Sequence
  chemically synthesized
ctaaaaggttgctccaaatgct

SEQ ID NO: 1256313 - DNA, 22 bp, Artificial Sequence
  chemically synthesized
taaaaggttgctccaaatgctg

SEQ ID NO: 1256314 - DNA, 22 bp, Artificial Sequence
  chemically synthesized
taaatcctaatttcagcatttg

SEQ ID NO: 1256315 - DNA, 22 bp, Artificial Sequence
  chemically synthesized
aaaggttgctccaaatgctgaa

SEQ ID NO: 1256316 - DNA, 22 bp, Artificial Sequence
  chemically synthesized
ctccaaatgctgaaattaggat

SEQ ID NO: 1256317 - DNA, 22 bp, Artificial Sequence
  chemically synthesized
accccatctataaatcctaatt

SEQ ID NO: 1256318 - DNA, 22 bp, Artificial Sequence
  chemically synthesized
gaccccatctataaatcctaat

SEQ ID NO: 1256319 - DNA, 22 bp, Artificial Sequence
  chemically synthesized
caaatgctgaaattaggattta

SEQ ID NO: 1256320 - DNA, 22 bp, Artificial Sequence
  chemically synthesized
aaattaggatttatagatgggg

SEQ ID NO: 1256321 - DNA, 22 bp, Artificial Sequence
  chemically synthesized
atgtagtcttgaccccatctat

SEQ ID NO: 1256322 - DNA, 22 bp, Artificial Sequence
  chemically synthesized
tcatgtagtcttgaccccatct

SEQ ID NO: 1256323 - DNA, 22 bp, Artificial Sequence
  chemically synthesized
tctcatgtagtcttgaccccat

SEQ ID NO: 1256324 - DNA, 22 bp, Artificial Sequence
  chemically synthesized
ggatttatagatggggtcaaga

SEQ ID NO: 1256325 - DNA, 22 bp, Artificial Sequence
  chemically synthesized
tctctcatgtagtcttgacccc

SEQ ID NO: 1256326 - DNA, 22 bp, Artificial Sequence
  chemically synthesized
ctctctctcatgtagtcttgac

SEQ ID NO: 1256327 - DNA, 22 bp, Artificial Sequence
  chemically synthesized
atagatggggtcaagactacat

SEQ ID NO: 1256328 - DNA, 22 bp, Artificial Sequence
  chemically synthesized
tagatggggtcaagactacatg

SEQ ID NO: 1256329 - DNA, 22 bp, Artificial Sequence
  chemically synthesized
actgctctctctcatgtagtct

SEQ ID NO: 1256330 - DNA, 22 bp, Artificial Sequence
  chemically synthesized
aaatagcatcctaactgctctc

SEQ ID NO: 1256331 - DNA, 22 bp, Artificial Sequence
  chemically synthesized
catgagagagagcagttaggat

SEQ ID NO: 1256332 - DNA, 22 bp, Artificial Sequence
  chemically synthesized
gagtactgaaatagcatcctaa

SEQ ID NO: 1256333 - DNA, 22 bp, Artificial Sequence
  chemically synthesized
ctggagtactgaaatagcatcc

SEQ ID NO: 1256334 - DNA, 22 bp, Artificial Sequence
  chemically synthesized
cctggagtactgaaatagcatc

SEQ ID NO: 1256335 - DNA, 22 bp, Artificial Sequence
  chemically synthesized
cttcctggagtactgaaatagc

SEQ ID NO: 1256336 - DNA, 22 bp, Artificial Sequence
  chemically synthesized
ggatgctatttcagtactccag

SEQ ID NO: 1256337 - DNA, 22 bp, Artificial Sequence
  chemically synthesized
tgtaccatcagctccttcctgg

SEQ ID NO: 1256338 - DNA, 22 bp, Artificial Sequence
  chemically synthesized
tttcagtactccaggaaggagc

SEQ ID NO: 1256339 - DNA, 22 bp, Artificial Sequence
  chemically synthesized
tgtgtaccatcagctccttcct

SEQ ID NO: 1256340 - DNA, 22 bp, Artificial Sequence
  chemically synthesized
ctgtgtaccatcagctccttcc

SEQ ID NO: 1256341 - DNA, 22 bp, Artificial Sequence
  chemically synthesized
cagtactccaggaaggagctga

SEQ ID NO: 1256342 - DNA, 22 bp, Artificial Sequence
  chemically synthesized
agtactccaggaaggagctgat

SEQ ID NO: 1256343 - DNA, 22 bp, Artificial Sequence
  chemically synthesized
acacttctgtgtaccatcagct

SEQ ID NO: 1256344 - DNA, 22 bp, Artificial Sequence
  chemically synthesized
gacacttctgtgtaccatcagc

SEQ ID NO: 1256345 - DNA, 22 bp, Artificial Sequence
  chemically synthesized
tgacacttctgtgtaccatcag

SEQ ID NO: 1256346 - DNA, 22 bp, Artificial Sequence
  chemically synthesized
caggaaggagctgatggtacac

SEQ ID NO: 1256347 - DNA, 22 bp, Artificial Sequence
  chemically synthesized
aactttgacacttctgtgtacc

SEQ ID NO: 1256348 - DNA, 22 bp, Artificial Sequence
  chemically synthesized
tcaactttgacacttctgtgta

SEQ ID NO: 1256349 - DNA, 22 bp, Artificial Sequence
  chemically synthesized
atggtacacagaagtgtcaaag

SEQ ID NO: 1256350 - DNA, 22 bp, Artificial Sequence
  chemically synthesized
gtacagtccctctcaactttga

SEQ ID NO: 1256351 - DNA, 22 bp, Artificial Sequence
  chemically synthesized
caaattagtacagtccctctca

SEQ ID NO: 1256352 - DNA, 22 bp, Artificial Sequence
  chemically synthesized
gcctacaaattagtacagtccc

SEQ ID NO: 1256353 - DNA, 22 bp, Artificial Sequence
  chemically synthesized
ggcctacaaattagtacagtcc

SEQ ID NO: 1256354 - DNA, 22 bp, Artificial Sequence
  chemically synthesized
gcttggcctacaaattagtaca

SEQ ID NO: 1256355 - DNA, 22 bp, Artificial Sequence
  chemically synthesized
ggcttggcctacaaattagtac

SEQ ID NO: 1256356 - DNA, 22 bp, Artificial Sequence
  chemically synthesized
agagggactgtactaatttgta

SEQ ID NO: 1256357 - DNA, 22 bp, Artificial Sequence
  chemically synthesized
atttggcttggcctacaaatta

SEQ ID NO: 1256358 - DNA, 22 bp, Artificial Sequence
  chemically synthesized
gccgattgatttggcttggcct

SEQ ID NO: 1256359 - DNA, 22 bp, Artificial Sequence
  chemically synthesized
tactaatttgtaggccaagcca

SEQ ID NO: 1256360 - DNA, 22 bp, Artificial Sequence
  chemically synthesized
ggccgattgatttggcttggcc

SEQ ID NO: 1256361 - DNA, 22 bp, Artificial Sequence
  chemically synthesized
cttggccgattgatttggcttg

SEQ ID NO: 1256362 - DNA, 22 bp, Artificial Sequence
  chemically synthesized
gcttggccgattgatttggctt

SEQ ID NO: 1256363 - DNA, 22 bp, Artificial Sequence
  chemically synthesized
atttgtaggccaagccaaatca

SEQ ID NO: 1256364 - DNA, 22 bp, Artificial Sequence
  chemically synthesized
tgcttggccgattgatttggct

SEQ ID NO: 1256365 - DNA, 22 bp, Artificial Sequence
  chemically synthesized
gtaggccaagccaaatcaatcg

SEQ ID NO: 1256366 - DNA, 22 bp, Artificial Sequence
  chemically synthesized
taggccaagccaaatcaatcgg

SEQ ID NO: 1256367 - DNA, 22 bp, Artificial Sequence
  chemically synthesized
tatagaatccattttgcttggc

SEQ ID NO: 1256368 - DNA, 22 bp, Artificial Sequence
  chemically synthesized
atatagaatccattttgcttgg

SEQ ID NO: 1256369 - DNA, 22 bp, Artificial Sequence
  chemically synthesized
atgatcataatatttatataga

SEQ ID NO: 1256370 - DNA, 22 bp, Artificial Sequence
  chemically synthesized
ttcatgatcataatatttatat

SEQ ID NO: 1256371 - DNA, 22 bp, Artificial Sequence
  chemically synthesized
atatattgttcatgatcataat

SEQ ID NO: 1256372 - DNA, 22 bp, Artificial Sequence
  chemically synthesized
taatatattgttcatgatcata

SEQ ID NO: 1256373 - DNA, 22 bp, Artificial Sequence
  chemically synthesized
tatataaatattatgatcatga

SEQ ID NO: 1256374 - DNA, 22 bp, Artificial Sequence
  chemically synthesized
tataaatattatgatcatgaac

SEQ ID NO: 1256375 - DNA, 22 bp, Artificial Sequence
  chemically synthesized
tgatcatgaacaatatattaga

SEQ ID NO: 1256376 - DNA, 22 bp, Artificial Sequence
  chemically synthesized
tgcatataatgtcattctaata

SEQ ID NO: 1256377 - DNA, 22 bp, Artificial Sequence
  chemically synthesized
atgcatataatgtcattctaat

SEQ ID NO: 1256378 - DNA, 22 bp, Artificial Sequence
  chemically synthesized
tgtcttatgcatataatgtcat

SEQ ID NO: 1256379 - DNA, 22 bp, Artificial Sequence
  chemically synthesized
gaatgacattatatgcataaga

SEQ ID NO: 1256380 - DNA, 22 bp, Artificial Sequence
  chemically synthesized
tatgcataagacataggtttgg

SEQ ID NO: 1256381 - DNA, 22 bp, Artificial Sequence
  chemically synthesized
catgtatgtaaaataaccaaac

SEQ ID NO: 1256382 - DNA, 22 bp, Artificial Sequence
  chemically synthesized
atctacatgtatgtaaaataac

SEQ ID NO: 1256383 - DNA, 22 bp, Artificial Sequence
  chemically synthesized
catctacatgtatgtaaaataa

SEQ ID NO: 1256384 - DNA, 22 bp, Artificial Sequence
  chemically synthesized
atttcatctacatgtatgtaaa

SEQ ID NO: 1256385 - DNA, 22 bp, Artificial Sequence
  chemically synthesized
aatttcatctacatgtatgtaa

SEQ ID NO: 1256386 - DNA, 22 bp, Artificial Sequence
  chemically synthesized
taatttcatctacatgtatgta

SEQ ID NO: 1256387 - DNA, 22 bp, Artificial Sequence
  chemically synthesized
tttaatttcatctacatgtatg

SEQ ID NO: 1256388 - DNA, 22 bp, Artificial Sequence
  chemically synthesized
ggttattttacatacatgtaga

SEQ ID NO: 1256389 - DNA, 22 bp, Artificial Sequence
  chemically synthesized
gttattttacatacatgtagat

SEQ ID NO: 1256390 - DNA, 22 bp, Artificial Sequence
  chemically synthesized
gttctttaatttcatctacatg

SEQ ID NO: 1256391 - DNA, 22 bp, Artificial Sequence
  chemically synthesized
ttttacatacatgtagatgaaa

SEQ ID NO: 1256392 - DNA, 22 bp, Artificial Sequence
  chemically synthesized
tacatacatgtagatgaaatta

SEQ ID NO: 1256393 - DNA, 22 bp, Artificial Sequence
  chemically synthesized
acatacatgtagatgaaattaa

SEQ ID NO: 1256394 - DNA, 22 bp, Artificial Sequence
  chemically synthesized
catacatgtagatgaaattaaa

SEQ ID NO: 1256395 - DNA, 22 bp, Artificial Sequence
  chemically synthesized
aggaaattagttctttaatttc

SEQ ID NO: 1256396 - DNA, 22 bp, Artificial Sequence
  chemically synthesized
caggaaattagttctttaattt

SEQ ID NO: 1256397 - DNA, 22 bp, Artificial Sequence
  chemically synthesized
tcaggaaattagttctttaatt

SEQ ID NO: 1256398 - DNA, 22 bp, Artificial Sequence
  chemically synthesized
aaatctttcaggaaattagttc

SEQ ID NO: 1256399 - DNA, 22 bp, Artificial Sequence
  chemically synthesized
aaaatctttcaggaaattagtt

SEQ ID NO: 1256400 - DNA, 22 bp, Artificial Sequence
  chemically synthesized
taaaatctttcaggaaattagt

SEQ ID NO: 1256401 - DNA, 22 bp, Artificial Sequence
  chemically synthesized
ttaaaatctttcaggaaattag

SEQ ID NO: 1256402 - DNA, 22 bp, Artificial Sequence
  chemically synthesized
aagaactaatttcctgaaagat

SEQ ID NO: 1256403 - DNA, 22 bp, Artificial Sequence
  chemically synthesized
agtgatttttaaaatctttcag

SEQ ID NO: 1256404 - DNA, 22 bp, Artificial Sequence
  chemically synthesized
atttcctgaaagattttaaaaa

SEQ ID NO: 1256405 - DNA, 22 bp, Artificial Sequence
  chemically synthesized
cctgaaagattttaaaaatcac

SEQ ID NO: 1256406 - DNA, 22 bp, Artificial Sequence
  chemically synthesized
ctgaaagattttaaaaatcact

SEQ ID NO: 1256407 - DNA, 22 bp, Artificial Sequence
  chemically synthesized
aaagattttaaaaatcacttag

SEQ ID NO: 1256408 - DNA, 22 bp, Artificial Sequence
  chemically synthesized
aacaaatacagagactaagtga

SEQ ID NO: 1256409 - DNA, 22 bp, Artificial Sequence
  chemically synthesized
taaaaatcacttagtctctgta

SEQ ID NO: 1256410 - DNA, 22 bp, Artificial Sequence
  chemically synthesized
aaaaatcacttagtctctgtat

SEQ ID NO: 1256411 - DNA, 22 bp, Artificial Sequence
  chemically synthesized
aaaatcacttagtctctgtatt

SEQ ID NO: 1256412 - DNA, 22 bp, Artificial Sequence
  chemically synthesized
agtctctgtatttgttgaatga

SEQ ID NO: 1256413 - DNA, 22 bp, Artificial Sequence
  chemically synthesized
gtctctgtatttgttgaatgac

SEQ ID NO: 1256414 - DNA, 22 bp, Artificial Sequence
  chemically synthesized
gatgatatcatagtcattcaac

SEQ ID NO: 1256415 - DNA, 22 bp, Artificial Sequence
  chemically synthesized
ggatgatatcatagtcattcaa

SEQ ID NO: 1256416 - DNA, 22 bp, Artificial Sequence
  chemically synthesized
tgtatttgttgaatgactatga

SEQ ID NO: 1256417 - DNA, 22 bp, Artificial Sequence
  chemically synthesized
tatttgttgaatgactatgata

SEQ ID NO: 1256418 - DNA, 22 bp, Artificial Sequence
  chemically synthesized
gaatttggatgatatcatagtc

SEQ ID NO: 1256419 - DNA, 22 bp, Artificial Sequence
  chemically synthesized
tggaatttggatgatatcatag

SEQ ID NO: 1256420 - DNA, 22 bp, Artificial Sequence
  chemically synthesized
gttgaatgactatgatatcatc

SEQ ID NO: 1256421 - DNA, 22 bp, Artificial Sequence
  chemically synthesized
ttctggaatttggatgatatca

SEQ ID NO: 1256422 - DNA, 22 bp, Artificial Sequence
  chemically synthesized
ttgaatgactatgatatcatcc

SEQ ID NO: 1256423 - DNA, 22 bp, Artificial Sequence
  chemically synthesized
attctggaatttggatgatatc

SEQ ID NO: 1256424 - DNA, 22 bp, Artificial Sequence
  chemically synthesized
tattctggaatttggatgatat

SEQ ID NO: 1256425 - DNA, 22 bp, Artificial Sequence
  chemically synthesized
ttattctggaatttggatgata

SEQ ID NO: 1256426 - DNA, 22 bp, Artificial Sequence
  chemically synthesized
aatgactatgatatcatccaaa

SEQ ID NO: 1256427 - DNA, 22 bp, Artificial Sequence
  chemically synthesized
tgatatcatccaaattccagaa

SEQ ID NO: 1256428 - DNA, 22 bp, Artificial Sequence
  chemically synthesized
tagaatgtttttattctggaat

SEQ ID NO: 1256429 - DNA, 22 bp, Artificial Sequence
  chemically synthesized
cactatagaatgtttttattct

SEQ ID NO: 1256430 - DNA, 22 bp, Artificial Sequence
  chemically synthesized
acactatagaatgtttttattc

SEQ ID NO: 1256431 - DNA, 22 bp, Artificial Sequence
  chemically synthesized
atgaatttacactatagaatgt

SEQ ID NO: 1256432 - DNA, 22 bp, Artificial Sequence
  chemically synthesized
cagaataaaaacattctatagt

SEQ ID NO: 1256433 - DNA, 22 bp, Artificial Sequence
  chemically synthesized
tcatgaatttacactatagaat

SEQ ID NO: 1256434 - DNA, 22 bp, Artificial Sequence
  chemically synthesized
ctcatgaatttacactatagaa

SEQ ID NO: 1256435 - DNA, 22 bp, Artificial Sequence
  chemically synthesized
tctcatgaatttacactataga

SEQ ID NO: 1256436 - DNA, 22 bp, Artificial Sequence
  chemically synthesized
aatagggtattttctcatgaat

SEQ ID NO: 1256437 - DNA, 22 bp, Artificial Sequence
  chemically synthesized
tatagtgtaaattcatgagaaa

SEQ ID NO: 1256438 - DNA, 22 bp, Artificial Sequence
  chemically synthesized
tagtgtaaattcatgagaaaat

SEQ ID NO: 1256439 - DNA, 22 bp, Artificial Sequence
  chemically synthesized
atgagaaaataccctattgagt

SEQ ID NO: 1256440 - DNA, 22 bp, Artificial Sequence
  chemically synthesized
taaggccaataatactcaatag

SEQ ID NO: 1256441 - DNA, 22 bp, Artificial Sequence
  chemically synthesized
cattataaggccaataatactc

SEQ ID NO: 1256442 - DNA, 22 bp, Artificial Sequence
  chemically synthesized
gcattataaggccaataatact

SEQ ID NO: 1256443 - DNA, 22 bp, Artificial Sequence
  chemically synthesized
ttgagtattattggccttataa

SEQ ID NO: 1256444 - DNA, 22 bp, Artificial Sequence
  chemically synthesized
agtgaagcttgcattataaggc

SEQ ID NO: 1256445 - DNA, 22 bp, Artificial Sequence
  chemically synthesized
agtattattggccttataatgc

SEQ ID NO: 1256446 - DNA, 22 bp, Artificial Sequence
  chemically synthesized
taaagttaagtgaagcttgcat

SEQ ID NO: 1256447 - DNA, 22 bp, Artificial Sequence
  chemically synthesized
ttggccttataatgcaagcttc

SEQ ID NO: 1256448 - DNA, 22 bp, Artificial Sequence
  chemically synthesized
gccttataatgcaagcttcact

SEQ ID NO: 1256449 - DNA, 22 bp, Artificial Sequence
  chemically synthesized
cacaattgtaaagttaagtgaa

SEQ ID NO: 1256450 - DNA, 22 bp, Artificial Sequence
  chemically synthesized
ataatgcaagcttcacttaact

SEQ ID NO: 1256451 - DNA, 22 bp, Artificial Sequence
  chemically synthesized
taatgcaagcttcacttaactt

SEQ ID NO: 1256452 - DNA, 22 bp, Artificial Sequence
  chemically synthesized
ttccacaattgtaaagttaagt

SEQ ID NO: 1256453 - DNA, 22 bp, Artificial Sequence
  chemically synthesized
cacttaactttacaattgtgga

SEQ ID NO: 1256454 - DNA, 22 bp, Artificial Sequence
  chemically synthesized
acttaactttacaattgtggaa

SEQ ID NO: 1256455 - DNA, 22 bp, Artificial Sequence
  chemically synthesized
aactttacaattgtggaataat

SEQ ID NO: 1256456 - DNA, 22 bp, Artificial Sequence
  chemically synthesized
actttacaattgtggaataatt

SEQ ID NO: 1256457 - DNA, 22 bp, Artificial Sequence
  chemically synthesized
tacaattgtggaataattttct

SEQ ID NO: 1256458 - DNA, 22 bp, Artificial Sequence
  chemically synthesized
acaattgtggaataattttctc

SEQ ID NO: 1256459 - DNA, 22 bp, Artificial Sequence
  chemically synthesized
caattgtggaataattttctca

SEQ ID NO: 1256460 - DNA, 22 bp, Artificial Sequence
  chemically synthesized
tggaataattttctcactgtga

SEQ ID NO: 1256461 - DNA, 22 bp, Artificial Sequence
  chemically synthesized
acgcaatgaaatgaacatcaca

SEQ ID NO: 1256462 - DNA, 22 bp, Artificial Sequence
  chemically synthesized
cacgcaatgaaatgaacatcac

SEQ ID NO: 1256463 - DNA, 22 bp, Artificial Sequence
  chemically synthesized
tttcacgcaatgaaatgaacat

SEQ ID NO: 1256464 - DNA, 22 bp, Artificial Sequence
  chemically synthesized
tctcactgtgatgttcatttca

SEQ ID NO: 1256465 - DNA, 22 bp, Artificial Sequence
  chemically synthesized
ctcactgtgatgttcatttcat

SEQ ID NO: 1256466 - DNA, 22 bp, Artificial Sequence
  chemically synthesized
tcactgtgatgttcatttcatt

SEQ ID NO: 1256467 - DNA, 22 bp, Artificial Sequence
  chemically synthesized
actgtgatgttcatttcattgc

SEQ ID NO: 1256468 - DNA, 22 bp, Artificial Sequence
  chemically synthesized
aacctgtttcacgcaatgaaat

SEQ ID NO: 1256469 - DNA, 22 bp, Artificial Sequence
  chemically synthesized
tgatgttcatttcattgcgtga

SEQ ID NO: 1256470 - DNA, 22 bp, Artificial Sequence
  chemically synthesized
atttcattgcgtgaaacaggtt

SEQ ID NO: 1256471 - DNA, 22 bp, Artificial Sequence
  chemically synthesized
atgaataatgtactgaacctgt

SEQ ID NO: 1256472 - DNA, 22 bp, Artificial Sequence
  chemically synthesized
cattgcgtgaaacaggttcagt

SEQ ID NO: 1256473 - DNA, 22 bp, Artificial Sequence
  chemically synthesized
catgaataatgtactgaacctg

SEQ ID NO: 1256474 - DNA, 22 bp, Artificial Sequence
  chemically synthesized
attgcgtgaaacaggttcagta

SEQ ID NO: 1256475 - DNA, 22 bp, Artificial Sequence
  chemically synthesized
cgtgaaacaggttcagtacatt

SEQ ID NO: 1256476 - DNA, 22 bp, Artificial Sequence
  chemically synthesized
aagtagtttcatgaataatgta

SEQ ID NO: 1256477 - DNA, 22 bp, Artificial Sequence
  chemically synthesized
gaagtagtttcatgaataatgt

SEQ ID NO: 1256478 - DNA, 22 bp, Artificial Sequence
  chemically synthesized
tgaagtagtttcatgaataatg

SEQ ID NO: 1256479 - DNA, 22 bp, Artificial Sequence
  chemically synthesized
agtacattattcatgaaactac

SEQ ID NO: 1256480 - DNA, 22 bp, Artificial Sequence
  chemically synthesized
aaacaaagcattttgaagtagt

SEQ ID NO: 1256481 - DNA, 22 bp, Artificial Sequence
  chemically synthesized
ttcatgaaactacttcaaaatg

SEQ ID NO: 1256482 - DNA, 22 bp, Artificial Sequence
  chemically synthesized
aatctaaaacaaagcattttga

SEQ ID NO: 1256483 - DNA, 22 bp, Artificial Sequence
  chemically synthesized
atgaaactacttcaaaatgctt

SEQ ID NO: 1256484 - DNA, 22 bp, Artificial Sequence
  chemically synthesized
aaatctaaaacaaagcattttg

SEQ ID NO: 1256485 - DNA, 22 bp, Artificial Sequence
  chemically synthesized
taaatctaaaacaaagcatttt

SEQ ID NO: 1256486 - DNA, 22 bp, Artificial Sequence
  chemically synthesized
ttaaatctaaaacaaagcattt

SEQ ID NO: 1256487 - DNA, 22 bp, Artificial Sequence
  chemically synthesized
tttaaatctaaaacaaagcatt

SEQ ID NO: 1256488 - DNA, 22 bp, Artificial Sequence
  chemically synthesized
cttcaaaatgctttgttttaga

SEQ ID NO: 1256489 - DNA, 22 bp, Artificial Sequence
  chemically synthesized
caaaatgctttgttttagattt

SEQ ID NO: 1256490 - DNA, 22 bp, Artificial Sequence
  chemically synthesized
aaaatgctttgttttagattta

SEQ ID NO: 1256491 - DNA, 22 bp, Artificial Sequence
  chemically synthesized
tgtgaataccaatattttttaa

SEQ ID NO: 1256492 - DNA, 22 bp, Artificial Sequence
  chemically synthesized
tgttttagatttaaaaaatatt

SEQ ID NO: 1256493 - DNA, 22 bp, Artificial Sequence
  chemically synthesized
gttttagatttaaaaaatattg

SEQ ID NO: 1256494 - DNA, 22 bp, Artificial Sequence
  chemically synthesized
ttttagatttaaaaaatattgg

SEQ ID NO: 1256495 - DNA, 22 bp, Artificial Sequence
  chemically synthesized
tagatttaaaaaatattggtat

SEQ ID NO: 1256496 - DNA, 22 bp, Artificial Sequence
  chemically synthesized
agatttaaaaaatattggtatt

SEQ ID NO: 1256497 - DNA, 22 bp, Artificial Sequence
  chemically synthesized
gatttaaaaaatattggtattc

SEQ ID NO: 1256498 - DNA, 22 bp, Artificial Sequence
  chemically synthesized
gcaaagcagttatgtgaatacc

SEQ ID NO: 1256499 - DNA, 22 bp, Artificial Sequence
  chemically synthesized
aaaaaatattggtattcacata

SEQ ID NO: 1256500 - DNA, 22 bp, Artificial Sequence
  chemically synthesized
aaaaatattggtattcacataa

SEQ ID NO: 1256501 - DNA, 22 bp, Artificial Sequence
  chemically synthesized
acattggcaaagcagttatgtg

SEQ ID NO: 1256502 - DNA, 22 bp, Artificial Sequence
  chemically synthesized
gtattcacataactgctttgcc

SEQ ID NO: 1256503 - DNA, 22 bp, Artificial Sequence
  chemically synthesized
gtatgaaacctcacattggcaa

SEQ ID NO: 1256504 - DNA, 22 bp, Artificial Sequence
  chemically synthesized
acataactgctttgccaatgtg

SEQ ID NO: 1256505 - DNA, 22 bp, Artificial Sequence
  chemically synthesized
cgtatgaaacctcacattggca

SEQ ID NO: 1256506 - DNA, 22 bp, Artificial Sequence
  chemically synthesized
ctttgccaatgtgaggtttcat

SEQ ID NO: 1256507 - DNA, 22 bp, Artificial Sequence
  chemically synthesized
tgccaatgtgaggtttcatacg

SEQ ID NO: 1256508 - DNA, 22 bp, Artificial Sequence
  chemically synthesized
gccaatgtgaggtttcatacga

SEQ ID NO: 1256509 - DNA, 22 bp, Artificial Sequence
  chemically synthesized
ccaatgtgaggtttcatacgaa

SEQ ID NO: 1256510 - DNA, 22 bp, Artificial Sequence
  chemically synthesized
agaaaatcaaacaatgaatttc

SEQ ID NO: 1256511 - DNA, 22 bp, Artificial Sequence
  chemically synthesized
cagaaaatcaaacaatgaattt

SEQ ID NO: 1256512 - DNA, 22 bp, Artificial Sequence
  chemically synthesized
tcagaaaatcaaacaatgaatt

SEQ ID NO: 1256513 - DNA, 22 bp, Artificial Sequence
  chemically synthesized
catacgaaattcattgtttgat

SEQ ID NO: 1256514 - DNA, 22 bp, Artificial Sequence
  chemically synthesized
atacgaaattcattgtttgatt

SEQ ID NO: 1256515 - DNA, 22 bp, Artificial Sequence
  chemically synthesized
attgtttgattttctgaaaact

SEQ ID NO: 1256516 - DNA, 22 bp, Artificial Sequence
  chemically synthesized
tttgattttctgaaaacttatc

SEQ ID NO: 1256517 - DNA, 22 bp, Artificial Sequence
  chemically synthesized
gattttctgaaaacttatcata

SEQ ID NO: 1256518 - DNA, 22 bp, Artificial Sequence
  chemically synthesized
acacaaaatcaatatgataagt

SEQ ID NO: 1256519 - DNA, 22 bp, Artificial Sequence
  chemically synthesized
attttctgaaaacttatcatat

SEQ ID NO: 1256520 - DNA, 22 bp, Artificial Sequence
  chemically synthesized
gacacaaaatcaatatgataag

SEQ ID NO: 1256521 - DNA, 22 bp, Artificial Sequence
  chemically synthesized
tctgaaaacttatcatattgat

SEQ ID NO: 1256522 - DNA, 22 bp, Artificial Sequence
  chemically synthesized
ctgaaaacttatcatattgatt

SEQ ID NO: 1256523 - DNA, 22 bp, Artificial Sequence
  chemically synthesized
tgaaaacttatcatattgattt

SEQ ID NO: 1256524 - DNA, 22 bp, Artificial Sequence
  chemically synthesized
aaaacttatcatattgattttg

SEQ ID NO: 1256525 - DNA, 22 bp, Artificial Sequence
  chemically synthesized
ataaagatttgacacaaaatca

SEQ ID NO: 1256526 - DNA, 22 bp, Artificial Sequence
  chemically synthesized
ttcataaagatttgacacaaaa

SEQ ID NO: 1256527 - DNA, 22 bp, Artificial Sequence
  chemically synthesized
gttcataaagatttgacacaaa

SEQ ID NO: 1256528 - DNA, 22 bp, Artificial Sequence
  chemically synthesized
atcatattgattttgtgtcaaa

SEQ ID NO: 1256529 - DNA, 22 bp, Artificial Sequence
  chemically synthesized
tcatattgattttgtgtcaaat

SEQ ID NO: 1256530 - DNA, 22 bp, Artificial Sequence
  chemically synthesized
attttgtgtcaaatctttatga

SEQ ID NO: 1256531 - DNA, 22 bp, Artificial Sequence
  chemically synthesized
taaaaatgcttgttcataaaga

SEQ ID NO: 1256532 - DNA, 22 bp, Artificial Sequence
  chemically synthesized
tgtgtcaaatctttatgaacaa

SEQ ID NO: 1256533 - DNA, 22 bp, Artificial Sequence
  chemically synthesized
ttataaaaatgcttgttcataa

SEQ ID NO: 1256534 - DNA, 22 bp, Artificial Sequence
  chemically synthesized
gtgtcaaatctttatgaacaag

SEQ ID NO: 1256535 - DNA, 22 bp, Artificial Sequence
  chemically synthesized
attataaaaatgcttgttcata

SEQ ID NO: 1256536 - DNA, 22 bp, Artificial Sequence
  chemically synthesized
tgtcaaatctttatgaacaagc

SEQ ID NO: 1256537 - DNA, 22 bp, Artificial Sequence
  chemically synthesized
tattataaaaatgcttgttcat

SEQ ID NO: 1256538 - DNA, 22 bp, Artificial Sequence
  chemically synthesized
tatgaacaagcatttttataat

SEQ ID NO: 1256539 - DNA, 22 bp, Artificial Sequence
  chemically synthesized
atgaacaagcatttttataata

SEQ ID NO: 1256540 - DNA, 22 bp, Artificial Sequence
  chemically synthesized
tgaacaagcatttttataataa

SEQ ID NO: 1256541 - DNA, 22 bp, Artificial Sequence
  chemically synthesized
tgagaaaagaataaaactttat

SEQ ID NO: 1256542 - DNA, 22 bp, Artificial Sequence
  chemically synthesized
ttataataaagttttattcttt

SEQ ID NO: 1256543 - DNA, 22 bp, Artificial Sequence
  chemically synthesized
tataataaagttttattctttt

SEQ ID NO: 1256544 - DNA, 22 bp, Artificial Sequence
  chemically synthesized
ataataaagttttattcttttc

SEQ ID NO: 1256545 - DNA, 22 bp, Artificial Sequence
  chemically synthesized
taataaagttttattcttttct

SEQ ID NO: 1256546 - DNA, 22 bp, Artificial Sequence
  chemically synthesized
tattcttttctcataatctcct

SEQ ID NO: 1256547 - DNA, 22 bp, Artificial Sequence
  chemically synthesized
attcttttctcataatctcctt

SEQ ID NO: 1256548 - DNA, 22 bp, Artificial Sequence
  chemically synthesized
ttcttttctcataatctccttc

SEQ ID NO: 1256549 - DNA, 22 bp, Artificial Sequence
  chemically synthesized
ttttctcataatctccttccct

SEQ ID NO: 1256550 - DNA, 22 bp, Artificial Sequence
  chemically synthesized
tagtgagatatgaagggaagga

SEQ ID NO: 1256551 - DNA, 22 bp, Artificial Sequence
  chemically synthesized
ttctcataatctccttcccttc

SEQ ID NO: 1256552 - DNA, 22 bp, Artificial Sequence
  chemically synthesized
tctcataatctccttcccttca

SEQ ID NO: 1256553 - DNA, 22 bp, Artificial Sequence
  chemically synthesized
ctcataatctccttcccttcat

SEQ ID NO: 1256554 - DNA, 22 bp, Artificial Sequence
  chemically synthesized
tcataatctccttcccttcata

SEQ ID NO: 1256555 - DNA, 22 bp, Artificial Sequence
  chemically synthesized
ataatctccttcccttcatatc

SEQ ID NO: 1256556 - DNA, 22 bp, Artificial Sequence
  chemically synthesized
gtacaatctatagtgagatatg

SEQ ID NO: 1256557 - DNA, 22 bp, Artificial Sequence
  chemically synthesized
agtacaatctatagtgagatat

SEQ ID NO: 1256558 - DNA, 22 bp, Artificial Sequence
  chemically synthesized
cttcccttcatatctcactata

SEQ ID NO: 1256559 - DNA, 22 bp, Artificial Sequence
  chemically synthesized
cccttcatatctcactatagat

SEQ ID NO: 1256560 - DNA, 22 bp, Artificial Sequence
  chemically synthesized
ccttcatatctcactatagatt

SEQ ID NO: 1256561 - DNA, 22 bp, Artificial Sequence
  chemically synthesized
catatctcactatagattgtac

SEQ ID NO: 1256562 - DNA, 22 bp, Artificial Sequence
  chemically synthesized
atatctcactatagattgtact

SEQ ID NO: 1256563 - DNA, 22 bp, Artificial Sequence
  chemically synthesized
actatagattgtactaaatatt

SEQ ID NO: 1256564 - DNA, 22 bp, Artificial Sequence
  chemically synthesized
tagattgtactaaatattgtat

SEQ ID NO: 1256565 - DNA, 22 bp, Artificial Sequence
  chemically synthesized
tatgtacatgaaggatagatac

SEQ ID NO: 1256566 - DNA, 22 bp, Artificial Sequence
  chemically synthesized
tactaaatattgtatctatcct

SEQ ID NO: 1256567 - DNA, 22 bp, Artificial Sequence
  chemically synthesized
aatattgtatctatccttcatg

SEQ ID NO: 1256568 - DNA, 22 bp, Artificial Sequence
  chemically synthesized
gtagaactgtatgtacatgaag

SEQ ID NO: 1256569 - DNA, 22 bp, Artificial Sequence
  chemically synthesized
ctcgtagaactgtatgtacatg

SEQ ID NO: 1256570 - DNA, 22 bp, Artificial Sequence
  chemically synthesized
tatctatccttcatgtacatac

SEQ ID NO: 1256571 - DNA, 22 bp, Artificial Sequence
  chemically synthesized
cctcgtagaactgtatgtacat

SEQ ID NO: 1256572 - DNA, 22 bp, Artificial Sequence
  chemically synthesized
tttcctcgtagaactgtatgta

SEQ ID NO: 1256573 - DNA, 22 bp, Artificial Sequence
  chemically synthesized
atttcctcgtagaactgtatgt

SEQ ID NO: 1256574 - DNA, 22 bp, Artificial Sequence
  chemically synthesized
tccttcatgtacatacagttct

SEQ ID NO: 1256575 - DNA, 22 bp, Artificial Sequence
  chemically synthesized
ttatttcctcgtagaactgtat

SEQ ID NO: 1256576 - DNA, 22 bp, Artificial Sequence
  chemically synthesized
cttatttcctcgtagaactgta

SEQ ID NO: 1256577 - DNA, 22 bp, Artificial Sequence
  chemically synthesized
catgtacatacagttctacgag

SEQ ID NO: 1256578 - DNA, 22 bp, Artificial Sequence
  chemically synthesized
atgtacatacagttctacgagg

SEQ ID NO: 1256579 - DNA, 22 bp, Artificial Sequence
  chemically synthesized
aatttcttatttcctcgtagaa

SEQ ID NO: 1256580 - DNA, 22 bp, Artificial Sequence
  chemically synthesized
gaatttcttatttcctcgtaga

SEQ ID NO: 1256581 - DNA, 22 bp, Artificial Sequence
  chemically synthesized
aatgaaccgcttgaatttctta

SEQ ID NO: 1256582 - DNA, 22 bp, Artificial Sequence
  chemically synthesized
tacgaggaaataagaaattcaa

SEQ ID NO: 1256583 - DNA, 22 bp, Artificial Sequence
  chemically synthesized
cgaggaaataagaaattcaagc

SEQ ID NO: 1256584 - DNA, 22 bp, Artificial Sequence
  chemically synthesized
attcaatgaaccgcttgaattt

SEQ ID NO: 1256585 - DNA, 22 bp, Artificial Sequence
  chemically synthesized
gtgattaattcaatgaaccgct

SEQ ID NO: 1256586 - DNA, 22 bp, Artificial Sequence
  chemically synthesized
ttagtgattaattcaatgaacc

SEQ ID NO: 1256587 - DNA, 22 bp, Artificial Sequence
  chemically synthesized
ctattagtgattaattcaatga

SEQ ID NO: 1256588 - DNA, 22 bp, Artificial Sequence
  chemically synthesized
tcctattagtgattaattcaat

SEQ ID NO: 1256589 - DNA, 22 bp, Artificial Sequence
  chemically synthesized
tctcctattagtgattaattca

SEQ ID NO: 1256590 - DNA, 22 bp, Artificial Sequence
  chemically synthesized
aagcggttcattgaattaatca

SEQ ID NO: 1256591 - DNA, 22 bp, Artificial Sequence
  chemically synthesized
atcaattctctcctattagtga

SEQ ID NO: 1256592 - DNA, 22 bp, Artificial Sequence
  chemically synthesized
gatcaattctctcctattagtg

SEQ ID NO: 1256593 - DNA, 22 bp, Artificial Sequence
  chemically synthesized
attgaattaatcactaatagga

SEQ ID NO: 1256594 - DNA, 22 bp, Artificial Sequence
  chemically synthesized
tgatcaattctctcctattagt

SEQ ID NO: 1256595 - DNA, 22 bp, Artificial Sequence
  chemically synthesized
aattaatcactaataggagaga

SEQ ID NO: 1256596 - DNA, 22 bp, Artificial Sequence
  chemically synthesized
atcactaataggagagaattga

SEQ ID NO: 1256597 - DNA, 22 bp, Artificial Sequence
  chemically synthesized
cagcaaattttgatcaattctc

SEQ ID NO: 1256598 - DNA, 22 bp, Artificial Sequence
  chemically synthesized
ataggagagaattgatcaaaat

SEQ ID NO: 1256599 - DNA, 22 bp, Artificial Sequence
  chemically synthesized
aaggaagaaaattacagcaaat

SEQ ID NO: 1256600 - DNA, 22 bp, Artificial Sequence
  chemically synthesized
gaaggaagaaaattacagcaaa

SEQ ID NO: 1256601 - DNA, 22 bp, Artificial Sequence
  chemically synthesized
tgaaggaagaaaattacagcaa

SEQ ID NO: 1256602 - DNA, 22 bp, Artificial Sequence
  chemically synthesized
atcaaaatttgctgtaattttc

SEQ ID NO: 1256603 - DNA, 22 bp, Artificial Sequence
  chemically synthesized
atgattttgaaggaagaaaatt

SEQ ID NO: 1256604 - DNA, 22 bp, Artificial Sequence
  chemically synthesized
tgatgattttgaaggaagaaaa

SEQ ID NO: 1256605 - DNA, 22 bp, Artificial Sequence
  chemically synthesized
gctgtaattttcttccttcaaa

SEQ ID NO: 1256606 - DNA, 22 bp, Artificial Sequence
  chemically synthesized
ctgtaattttcttccttcaaaa

SEQ ID NO: 1256607 - DNA, 22 bp, Artificial Sequence
  chemically synthesized
taattttcttccttcaaaatca

SEQ ID NO: 1256608 - DNA, 22 bp, Artificial Sequence
  chemically synthesized
ccagaattctgatgattttgaa

SEQ ID NO: 1256609 - DNA, 22 bp, Artificial Sequence
  chemically synthesized
accagaattctgatgattttga

SEQ ID NO: 1256610 - DNA, 22 bp, Artificial Sequence
  chemically synthesized
taccagaattctgatgattttg

SEQ ID NO: 1256611 - DNA, 22 bp, Artificial Sequence
  chemically synthesized
tcttccttcaaaatcatcagaa

SEQ ID NO: 1256612 - DNA, 22 bp, Artificial Sequence
  chemically synthesized
cttccttcaaaatcatcagaat

SEQ ID NO: 1256613 - DNA, 22 bp, Artificial Sequence
  chemically synthesized
ttccttcaaaatcatcagaatt

SEQ ID NO: 1256614 - DNA, 22 bp, Artificial Sequence
  chemically synthesized
ccttcaaaatcatcagaattct

SEQ ID NO: 1256615 - DNA, 22 bp, Artificial Sequence
  chemically synthesized
cttcaaaatcatcagaattctg

SEQ ID NO: 1256616 - DNA, 22 bp, Artificial Sequence
  chemically synthesized
caaaatcatcagaattctggta

SEQ ID NO: 1256617 - DNA, 22 bp, Artificial Sequence
  chemically synthesized
aaaatcatcagaattctggtaa

SEQ ID NO: 1256618 - DNA, 22 bp, Artificial Sequence
  chemically synthesized
tgaaatacaaagctttaccaga

SEQ ID NO: 1256619 - DNA, 22 bp, Artificial Sequence
  chemically synthesized
tggtaaagctttgtatttcata

SEQ ID NO: 1256620 - DNA, 22 bp, Artificial Sequence
  chemically synthesized
gtaaagctttgtatttcataat

SEQ ID NO: 1256621 - DNA, 22 bp, Artificial Sequence
  chemically synthesized
tgtatttcataatttggactcc

SEQ ID NO: 1256622 - DNA, 22 bp, Artificial Sequence
  chemically synthesized
tcaccaatatgtggagtccaaa

SEQ ID NO: 1256623 - DNA, 22 bp, Artificial Sequence
  chemically synthesized
gtatttcataatttggactcca

SEQ ID NO: 1256624 - DNA, 22 bp, Artificial Sequence
  chemically synthesized
tatttcataatttggactccac

SEQ ID NO: 1256625 - DNA, 22 bp, Artificial Sequence
  chemically synthesized
aattgtcaccaatatgtggagt

SEQ ID NO: 1256626 - DNA, 22 bp, Artificial Sequence
  chemically synthesized
cataatttggactccacatatt

SEQ ID NO: 1256627 - DNA, 22 bp, Artificial Sequence
  chemically synthesized
ataatttggactccacatattg

SEQ ID NO: 1256628 - DNA, 22 bp, Artificial Sequence
  chemically synthesized
agtgtctgaattgtcaccaata

SEQ ID NO: 1256629 - DNA, 22 bp, Artificial Sequence
  chemically synthesized
ggactccacatattggtgacaa

SEQ ID NO: 1256630 - DNA, 22 bp, Artificial Sequence
  chemically synthesized
tcagtgtctgaattgtcaccaa

SEQ ID NO: 1256631 - DNA, 22 bp, Artificial Sequence
  chemically synthesized
gactccacatattggtgacaat

SEQ ID NO: 1256632 - DNA, 22 bp, Artificial Sequence
  chemically synthesized
cactctcagtgtctgaattgtc

SEQ ID NO: 1256633 - DNA, 22 bp, Artificial Sequence
  chemically synthesized
cacatattggtgacaattcaga

SEQ ID NO: 1256634 - DNA, 22 bp, Artificial Sequence
  chemically synthesized
tgttccactctcagtgtctgaa

SEQ ID NO: 1256635 - DNA, 22 bp, Artificial Sequence
  chemically synthesized
gtgttccactctcagtgtctga

SEQ ID NO: 1256636 - DNA, 22 bp, Artificial Sequence
  chemically synthesized
tgtgttccactctcagtgtctg

SEQ ID NO: 1256637 - DNA, 22 bp, Artificial Sequence
  chemically synthesized
gtgacaattcagacactgagag

SEQ ID NO: 1256638 - DNA, 22 bp, Artificial Sequence
  chemically synthesized
ctttgtgttccactctcagtgt

SEQ ID NO: 1256639 - DNA, 22 bp, Artificial Sequence
  chemically synthesized
cccaattcctttgtgttccact

SEQ ID NO: 1256640 - DNA, 22 bp, Artificial Sequence
  chemically synthesized
agacactgagagtggaacacaa

SEQ ID NO: 1256641 - DNA, 22 bp, Artificial Sequence
  chemically synthesized
gttacccaattcctttgtgttc

SEQ ID NO: 1256642 - DNA, 22 bp, Artificial Sequence
  chemically synthesized
agagtggaacacaaaggaattg

SEQ ID NO: 1256643 - DNA, 22 bp, Artificial Sequence
  chemically synthesized
gtgatctcgttacccaattcct

SEQ ID NO: 1256644 - DNA, 22 bp, Artificial Sequence
  chemically synthesized
agtgatctcgttacccaattcc

SEQ ID NO: 1256645 - DNA, 22 bp, Artificial Sequence
  chemically synthesized
ccttagtgatctcgttacccaa

SEQ ID NO: 1256646 - DNA, 22 bp, Artificial Sequence
  chemically synthesized
aaaattcccttagtgatctcgt

SEQ ID NO: 1256647 - DNA, 22 bp, Artificial Sequence
  chemically synthesized
ggctaaaaattcccttagtgat

SEQ ID NO: 1256648 - DNA, 22 bp, Artificial Sequence
  chemically synthesized
ggtaacgagatcactaagggaa

SEQ ID NO: 1256649 - DNA, 22 bp, Artificial Sequence
  chemically synthesized
ctaggctaaaaattcccttagt

SEQ ID NO: 1256650 - DNA, 22 bp, Artificial Sequence
  chemically synthesized
actaggctaaaaattcccttag

SEQ ID NO: 1256651 - DNA, 22 bp, Artificial Sequence
  chemically synthesized
tactaggctaaaaattccctta

SEQ ID NO: 1256652 - DNA, 22 bp, Artificial Sequence
  chemically synthesized
tctttactaggctaaaaattcc

SEQ ID NO: 1256653 - DNA, 22 bp, Artificial Sequence
  chemically synthesized
agaaactgtctttactaggcta

SEQ ID NO: 1256654 - DNA, 22 bp, Artificial Sequence
  chemically synthesized
agggaatttttagcctagtaaa

SEQ ID NO: 1256655 - DNA, 22 bp, Artificial Sequence
  chemically synthesized
aatgttgagaaactgtctttac

SEQ ID NO: 1256656 - DNA, 22 bp, Artificial Sequence
  chemically synthesized
gaatgttgagaaactgtcttta

SEQ ID NO: 1256657 - DNA, 22 bp, Artificial Sequence
  chemically synthesized
ttgaatgttgagaaactgtctt

SEQ ID NO: 1256658 - DNA, 22 bp, Artificial Sequence
  chemically synthesized
ttagcctagtaaagacagtttc

SEQ ID NO: 1256659 - DNA, 22 bp, Artificial Sequence
  chemically synthesized
tagcctagtaaagacagtttct

SEQ ID NO: 1256660 - DNA, 22 bp, Artificial Sequence
  chemically synthesized
agcctagtaaagacagtttctc

SEQ ID NO: 1256661 - DNA, 22 bp, Artificial Sequence
  chemically synthesized
ttcttgaatgttgagaaactgt

SEQ ID NO: 1256662 - DNA, 22 bp, Artificial Sequence
  chemically synthesized
gcctagtaaagacagtttctca

SEQ ID NO: 1256663 - DNA, 22 bp, Artificial Sequence
  chemically synthesized
aattattcttgaatgttgagaa

SEQ ID NO: 1256664 - DNA, 22 bp, Artificial Sequence
  chemically synthesized
gtaaagacagtttctcaacatt

SEQ ID NO: 1256665 - DNA, 22 bp, Artificial Sequence
  chemically synthesized
tgtaattgaattattcttgaat

SEQ ID NO: 1256666 - DNA, 22 bp, Artificial Sequence
  chemically synthesized
atgtaattgaattattcttgaa

SEQ ID NO: 1256667 - DNA, 22 bp, Artificial Sequence
  chemically synthesized
tatgtaattgaattattcttga

SEQ ID NO: 1256668 - DNA, 22 bp, Artificial Sequence
  chemically synthesized
ttatgtaattgaattattcttg

SEQ ID NO: 1256669 - DNA, 22 bp, Artificial Sequence
  chemically synthesized
ctcaacattcaagaataattca

SEQ ID NO: 1256670 - DNA, 22 bp, Artificial Sequence
  chemically synthesized
tcaacattcaagaataattcaa

SEQ ID NO: 1256671 - DNA, 22 bp, Artificial Sequence
  chemically synthesized
aacattcaagaataattcaatt

SEQ ID NO: 1256672 - DNA, 22 bp, Artificial Sequence
  chemically synthesized
tatgaatttttatgtaattgaa

SEQ ID NO: 1256673 - DNA, 22 bp, Artificial Sequence
  chemically synthesized
ttatatgaatttttatgtaatt

SEQ ID NO: 1256674 - DNA, 22 bp, Artificial Sequence
  chemically synthesized
aagaataattcaattacataaa

SEQ ID NO: 1256675 - DNA, 22 bp, Artificial Sequence
  chemically synthesized
ctattatatgaatttttatgta

SEQ ID NO: 1256676 - DNA, 22 bp, Artificial Sequence
  chemically synthesized
attactattatatgaattttta

SEQ ID NO: 1256677 - DNA, 22 bp, Artificial Sequence
  chemically synthesized
aattactattatatgaattttt

SEQ ID NO: 1256678 - DNA, 22 bp, Artificial Sequence
  chemically synthesized
aattacataaaaattcatataa

SEQ ID NO: 1256679 - DNA, 22 bp, Artificial Sequence
  chemically synthesized
tcatttaattactattatatga

SEQ ID NO: 1256680 - DNA, 22 bp, Artificial Sequence
  chemically synthesized
gtcatttaattactattatatg

SEQ ID NO: 1256681 - DNA, 22 bp, Artificial Sequence
  chemically synthesized
tgtcatttaattactattatat

SEQ ID NO: 1256682 - DNA, 22 bp, Artificial Sequence
  chemically synthesized
cataaaaattcatataatagta

SEQ ID NO: 1256683 - DNA, 22 bp, Artificial Sequence
  chemically synthesized
aaaagtattttgtcatttaatt

SEQ ID NO: 1256684 - DNA, 22 bp, Artificial Sequence
  chemically synthesized
atataatagtaattaaatgaca

SEQ ID NO: 1256685 - DNA, 22 bp, Artificial Sequence
  chemically synthesized
ataagtattcaaaagtattttg

SEQ ID NO: 1256686 - DNA, 22 bp, Artificial Sequence
  chemically synthesized
aatgacaaaatacttttgaata

SEQ ID NO: 1256687 - DNA, 22 bp, Artificial Sequence
  chemically synthesized
aggggtgtgcattaataagtat

SEQ ID NO: 1256688 - DNA, 22 bp, Artificial Sequence
  chemically synthesized
tgaggggtgtgcattaataagt

SEQ ID NO: 1256689 - DNA, 22 bp, Artificial Sequence
  chemically synthesized
ttgaatacttattaatgcacac

SEQ ID NO: 1256690 - DNA, 22 bp, Artificial Sequence
  chemically synthesized
tgaatacttattaatgcacacc

SEQ ID NO: 1256691 - DNA, 22 bp, Artificial Sequence
  chemically synthesized
aggtctctgaggggtgtgcatt

SEQ ID NO: 1256692 - DNA, 22 bp, Artificial Sequence
  chemically synthesized
gaatacttattaatgcacaccc

SEQ ID NO: 1256693 - DNA, 22 bp, Artificial Sequence
  chemically synthesized
caggtctctgaggggtgtgcat

SEQ ID NO: 1256694 - DNA, 22 bp, Artificial Sequence
  chemically synthesized
aatacttattaatgcacacccc

SEQ ID NO: 1256695 - DNA, 22 bp, Artificial Sequence
  chemically synthesized
caaatttcaggtctctgagggg

SEQ ID NO: 1256696 - DNA, 22 bp, Artificial Sequence
  chemically synthesized
attaatgcacacccctcagaga

SEQ ID NO: 1256697 - DNA, 22 bp, Artificial Sequence
  chemically synthesized
gcaaatttcaggtctctgaggg

SEQ ID NO: 1256698 - DNA, 22 bp, Artificial Sequence
  chemically synthesized
ttaatgcacacccctcagagac

SEQ ID NO: 1256699 - DNA, 22 bp, Artificial Sequence
  chemically synthesized
atgcacacccctcagagacctg

SEQ ID NO: 1256700 - DNA, 22 bp, Artificial Sequence
  chemically synthesized
tatagtcttgcaaatttcaggt

SEQ ID NO: 1256701 - DNA, 22 bp, Artificial Sequence
  chemically synthesized
agctatatagtcttgcaaattt

SEQ ID NO: 1256702 - DNA, 22 bp, Artificial Sequence
  chemically synthesized
agagacctgaaatttgcaagac

SEQ ID NO: 1256703 - DNA, 22 bp, Artificial Sequence
  chemically synthesized
aaattaagctatatagtcttgc

SEQ ID NO: 1256704 - DNA, 22 bp, Artificial Sequence
  chemically synthesized
aaatttgcaagactatatagct

SEQ ID NO: 1256705 - DNA, 22 bp, Artificial Sequence
  chemically synthesized
aaattcaaattaagctatatag

SEQ ID NO: 1256706 - DNA, 22 bp, Artificial Sequence
  chemically synthesized
gcaagactatatagcttaattt

SEQ ID NO: 1256707 - DNA, 22 bp, Artificial Sequence
  chemically synthesized
caagactatatagcttaatttg

SEQ ID NO: 1256708 - DNA, 22 bp, Artificial Sequence
  chemically synthesized
tatagcttaatttgaatttgaa

SEQ ID NO: 1256709 - DNA, 22 bp, Artificial Sequence
  chemically synthesized
aaataagtaagaaaattcaaat

SEQ ID NO: 1256710 - DNA, 22 bp, Artificial Sequence
  chemically synthesized
ctaaaataagtaagaaaattca

SEQ ID NO: 1256711 - DNA, 22 bp, Artificial Sequence
  chemically synthesized
gctaaaataagtaagaaaattc

SEQ ID NO: 1256712 - DNA, 22 bp, Artificial Sequence
  chemically synthesized
aatttgaatttgaattttctta

SEQ ID NO: 1256713 - DNA, 22 bp, Artificial Sequence
  chemically synthesized
tgctaaaataagtaagaaaatt

SEQ ID NO: 1256714 - DNA, 22 bp, Artificial Sequence
  chemically synthesized
atttgaatttgaattttcttac

SEQ ID NO: 1256715 - DNA, 22 bp, Artificial Sequence
  chemically synthesized
ttttgctaaaataagtaagaaa

SEQ ID NO: 1256716 - DNA, 22 bp, Artificial Sequence
  chemically synthesized
attttgctaaaataagtaagaa

SEQ ID NO: 1256717 - DNA, 22 bp, Artificial Sequence
  chemically synthesized
gaatttgaattttcttacttat

SEQ ID NO: 1256718 - DNA, 22 bp, Artificial Sequence
  chemically synthesized
aatttgaattttcttacttatt

SEQ ID NO: 1256719 - DNA, 22 bp, Artificial Sequence
  chemically synthesized
agtttattttgctaaaataagt

SEQ ID NO: 1256720 - DNA, 22 bp, Artificial Sequence
  chemically synthesized
aagtttattttgctaaaataag

SEQ ID NO: 1256721 - DNA, 22 bp, Artificial Sequence
  chemically synthesized
gaattttcttacttattttagc

SEQ ID NO: 1256722 - DNA, 22 bp, Artificial Sequence
  chemically synthesized
aattttcttacttattttagca

SEQ ID NO: 1256723 - DNA, 22 bp, Artificial Sequence
  chemically synthesized
tcttacttattttagcaaaata

SEQ ID NO: 1256724 - DNA, 22 bp, Artificial Sequence
  chemically synthesized
cttacttattttagcaaaataa

SEQ ID NO: 1256725 - DNA, 22 bp, Artificial Sequence
  chemically synthesized
tgaaccttaagtttattttgct

SEQ ID NO: 1256726 - DNA, 22 bp, Artificial Sequence
  chemically synthesized
ttacttattttagcaaaataaa

SEQ ID NO: 1256727 - DNA, 22 bp, Artificial Sequence
  chemically synthesized
atgaaccttaagtttattttgc

SEQ ID NO: 1256728 - DNA, 22 bp, Artificial Sequence
  chemically synthesized
acttattttagcaaaataaact

SEQ ID NO: 1256729 - DNA, 22 bp, Artificial Sequence
  chemically synthesized
ttatgaaccttaagtttatttt

SEQ ID NO: 1256730 - DNA, 22 bp, Artificial Sequence
  chemically synthesized
cttattttagcaaaataaactt

SEQ ID NO: 1256731 - DNA, 22 bp, Artificial Sequence
  chemically synthesized
attttagcaaaataaacttaag

SEQ ID NO: 1256732 - DNA, 22 bp, Artificial Sequence
  chemically synthesized
ttttagcaaaataaacttaagg

SEQ ID NO: 1256733 - DNA, 22 bp, Artificial Sequence
  chemically synthesized
tgttcttatgaaccttaagttt

SEQ ID NO: 1256734 - DNA, 22 bp, Artificial Sequence
  chemically synthesized
tagcaaaataaacttaaggttc

SEQ ID NO: 1256735 - DNA, 22 bp, Artificial Sequence
  chemically synthesized
agcaaaataaacttaaggttca

SEQ ID NO: 1256736 - DNA, 22 bp, Artificial Sequence
  chemically synthesized
gcaaaataaacttaaggttcat

SEQ ID NO: 1256737 - DNA, 22 bp, Artificial Sequence
  chemically synthesized
aaggttcataagaacatagctc

SEQ ID NO: 1256738 - DNA, 22 bp, Artificial Sequence
  chemically synthesized
aggttcataagaacatagctct

SEQ ID NO: 1256739 - DNA, 22 bp, Artificial Sequence
  chemically synthesized
ataagaacatagctcttcattc

SEQ ID NO: 1256740 - DNA, 22 bp, Artificial Sequence
  chemically synthesized
cgaccaagataagtgaatgaag

SEQ ID NO: 1256741 - DNA, 22 bp, Artificial Sequence
  chemically synthesized
acgaccaagataagtgaatgaa

SEQ ID NO: 1256742 - DNA, 22 bp, Artificial Sequence
  chemically synthesized
acagtatttacgaccaagataa

SEQ ID NO: 1256743 - DNA, 22 bp, Artificial Sequence
  chemically synthesized
aacagtatttacgaccaagata

SEQ ID NO: 1256744 - DNA, 22 bp, Artificial Sequence
  chemically synthesized
ttcattcacttatcttggtcgt

SEQ ID NO: 1256745 - DNA, 22 bp, Artificial Sequence
  chemically synthesized
cattcacttatcttggtcgtaa

SEQ ID NO: 1256746 - DNA, 22 bp, Artificial Sequence
  chemically synthesized
attcacttatcttggtcgtaaa

SEQ ID NO: 1256747 - DNA, 22 bp, Artificial Sequence
  chemically synthesized
tgtttaacagtatttacgacca

SEQ ID NO: 1256748 - DNA, 22 bp, Artificial Sequence
  chemically synthesized
gtgtttaacagtatttacgacc

SEQ ID NO: 1256749 - DNA, 22 bp, Artificial Sequence
  chemically synthesized
tgtgtttaacagtatttacgac

SEQ ID NO: 1256750 - DNA, 22 bp, Artificial Sequence
  chemically synthesized
acttatcttggtcgtaaatact

SEQ ID NO: 1256751 - DNA, 22 bp, Artificial Sequence
  chemically synthesized
attttgtgtttaacagtattta

SEQ ID NO: 1256752 - DNA, 22 bp, Artificial Sequence
  chemically synthesized
atcttggtcgtaaatactgtta

SEQ ID NO: 1256753 - DNA, 22 bp, Artificial Sequence
  chemically synthesized
tcttggtcgtaaatactgttaa

SEQ ID NO: 1256754 - DNA, 22 bp, Artificial Sequence
  chemically synthesized
ggtcgtaaatactgttaaacac

SEQ ID NO: 1256755 - DNA, 22 bp, Artificial Sequence
  chemically synthesized
gtcgtaaatactgttaaacaca

SEQ ID NO: 1256756 - DNA, 22 bp, Artificial Sequence
  chemically synthesized
tgggcacctgattttgtgttta

SEQ ID NO: 1256757 - DNA, 22 bp, Artificial Sequence
  chemically synthesized
tgagctgtgggcacctgatttt

SEQ ID NO: 1256758 - DNA, 22 bp, Artificial Sequence
  chemically synthesized
gtgagctgtgggcacctgattt

SEQ ID NO: 1256759 - DNA, 22 bp, Artificial Sequence
  chemically synthesized
ttaaacacaaaatcaggtgccc

SEQ ID NO: 1256760 - DNA, 22 bp, Artificial Sequence
  chemically synthesized
aacacaaaatcaggtgcccaca

SEQ ID NO: 1256761 - DNA, 22 bp, Artificial Sequence
  chemically synthesized
acaaatctacacatgacacatc

SEQ ID NO: 1256762 - DNA, 22 bp, Artificial Sequence
  chemically synthesized
cacatgacacatctctttacgt

SEQ ID NO: 1256763 - DNA, 22 bp, Artificial Sequence
  chemically synthesized
aggtaggtcaggaggaacgtaa

SEQ ID NO: 1256764 - DNA, 22 bp, Artificial Sequence
  chemically synthesized
ggctgaggtaggtcaggaggaa

SEQ ID NO: 1256765 - DNA, 22 bp, Artificial Sequence
  chemically synthesized
gggctgaggtaggtcaggagga

SEQ ID NO: 1256766 - DNA, 22 bp, Artificial Sequence
  chemically synthesized
tttacgttcctcctgacctacc

SEQ ID NO: 1256767 - DNA, 22 bp, Artificial Sequence
  chemically synthesized
tacgttcctcctgacctacctc

SEQ ID NO: 1256768 - DNA, 22 bp, Artificial Sequence
  chemically synthesized
acgttcctcctgacctacctca

SEQ ID NO: 1256769 - DNA, 22 bp, Artificial Sequence
  chemically synthesized
cgttcctcctgacctacctcag

SEQ ID NO: 1256770 - DNA, 22 bp, Artificial Sequence
  chemically synthesized
ctcctgacctacctcagcccaa

SEQ ID NO: 1256771 - DNA, 22 bp, Artificial Sequence
  chemically synthesized
ctgacctacctcagcccaaatc

SEQ ID NO: 1256772 - DNA, 22 bp, Artificial Sequence
  chemically synthesized
tgaggtagagagggatttgggc

SEQ ID NO: 1256773 - DNA, 22 bp, Artificial Sequence
  chemically synthesized
acctacctcagcccaaatccct

SEQ ID NO: 1256774 - DNA, 22 bp, Artificial Sequence
  chemically synthesized
tatgaggtagagagggatttgg

SEQ ID NO: 1256775 - DNA, 22 bp, Artificial Sequence
  chemically synthesized
cctcagcccaaatccctctcta

SEQ ID NO: 1256776 - DNA, 22 bp, Artificial Sequence
  chemically synthesized
agcccaaatccctctctacctc

SEQ ID NO: 1256777 - DNA, 22 bp, Artificial Sequence
  chemically synthesized
atatcaaattctatgaggtaga

SEQ ID NO: 1256778 - DNA, 22 bp, Artificial Sequence
  chemically synthesized
gcagaaagttaatatcaaattc

SEQ ID NO: 1256779 - DNA, 22 bp, Artificial Sequence
  chemically synthesized
tctacctcatagaatttgatat

SEQ ID NO: 1256780 - DNA, 22 bp, Artificial Sequence
  chemically synthesized
tacctcatagaatttgatatta

SEQ ID NO: 1256781 - DNA, 22 bp, Artificial Sequence
  chemically synthesized
cctcatagaatttgatattaac

SEQ ID NO: 1256782 - DNA, 22 bp, Artificial Sequence
  chemically synthesized
atagaatttgatattaactttc

SEQ ID NO: 1256783 - DNA, 22 bp, Artificial Sequence
  chemically synthesized
aaaaagttagcagaaagttaat

SEQ ID NO: 1256784 - DNA, 22 bp, Artificial Sequence
  chemically synthesized
caaaaagttagcagaaagttaa

SEQ ID NO: 1256785 - DNA, 22 bp, Artificial Sequence
  chemically synthesized
tcaaaaagttagcagaaagtta

SEQ ID NO: 1256786 - DNA, 22 bp, Artificial Sequence
  chemically synthesized
ctttcaaaaagttagcagaaag

SEQ ID NO: 1256787 - DNA, 22 bp, Artificial Sequence
  chemically synthesized
tcctttcaaaaagttagcagaa

SEQ ID NO: 1256788 - DNA, 22 bp, Artificial Sequence
  chemically synthesized
gatattaactttctgctaactt

SEQ ID NO: 1256789 - DNA, 22 bp, Artificial Sequence
  chemically synthesized
atattaactttctgctaacttt

SEQ ID NO: 1256790 - DNA, 22 bp, Artificial Sequence
  chemically synthesized
ttctcctttcaaaaagttagca

SEQ ID NO: 1256791 - DNA, 22 bp, Artificial Sequence
  chemically synthesized
actttctgctaactttttgaaa

SEQ ID NO: 1256792 - DNA, 22 bp, Artificial Sequence
  chemically synthesized
tctgctaactttttgaaaggag

SEQ ID NO: 1256793 - DNA, 22 bp, Artificial Sequence
  chemically synthesized
ctgctaactttttgaaaggaga

SEQ ID NO: 1256794 - DNA, 22 bp, Artificial Sequence
  chemically synthesized
tgctaactttttgaaaggagaa

SEQ ID NO: 1256795 - DNA, 22 bp, Artificial Sequence
  chemically synthesized
ctaactttttgaaaggagaata

SEQ ID NO: 1256796 - DNA, 22 bp, Artificial Sequence
  chemically synthesized
gtagcaacagaactattctcct

SEQ ID NO: 1256797 - DNA, 22 bp, Artificial Sequence
  chemically synthesized
actttttgaaaggagaatagtt

SEQ ID NO: 1256798 - DNA, 22 bp, Artificial Sequence
  chemically synthesized
tttgaaaggagaatagttctgt

SEQ ID NO: 1256799 - DNA, 22 bp, Artificial Sequence
  chemically synthesized
ttgaaaggagaatagttctgtt

SEQ ID NO: 1256800 - DNA, 22 bp, Artificial Sequence
  chemically synthesized
tgaaaggagaatagttctgttg

SEQ ID NO: 1256801 - DNA, 22 bp, Artificial Sequence
  chemically synthesized
gaaaggagaatagttctgttgc

SEQ ID NO: 1256802 - DNA, 22 bp, Artificial Sequence
  chemically synthesized
aaaggagaatagttctgttgct

SEQ ID NO: 1256803 - DNA, 22 bp, Artificial Sequence
  chemically synthesized
caaagggtcaagggtgactcgt

SEQ ID NO: 1256804 - DNA, 22 bp, Artificial Sequence
  chemically synthesized
gcaaagggtcaagggtgactcg

SEQ ID NO: 1256805 - DNA, 22 bp, Artificial Sequence
  chemically synthesized
tgttgctacgagtcacccttga

SEQ ID NO: 1256806 - DNA, 22 bp, Artificial Sequence
  chemically synthesized
gtcttgcaaagggtcaagggtg

SEQ ID NO: 1256807 - DNA, 22 bp, Artificial Sequence
  chemically synthesized
ttgctacgagtcacccttgacc

SEQ ID NO: 1256808 - DNA, 22 bp, Artificial Sequence
  chemically synthesized
ggtcttgcaaagggtcaagggt

SEQ ID NO: 1256809 - DNA, 22 bp, Artificial Sequence
  chemically synthesized
ctacgagtcacccttgaccctt

SEQ ID NO: 1256810 - DNA, 22 bp, Artificial Sequence
  chemically synthesized
cgagtcacccttgaccctttgc

SEQ ID NO: 1256811 - DNA, 22 bp, Artificial Sequence
  chemically synthesized
tcggcatgtttggtcttgcaaa

SEQ ID NO: 1256812 - DNA, 22 bp, Artificial Sequence
  chemically synthesized
aattatcggcatgtttggtctt

SEQ ID NO: 1256813 - DNA, 22 bp, Artificial Sequence
  chemically synthesized
aaattatcggcatgtttggtct

SEQ ID NO: 1256814 - DNA, 22 bp, Artificial Sequence
  chemically synthesized
gaccctttgcaagaccaaacat

SEQ ID NO: 1256815 - DNA, 22 bp, Artificial Sequence
  chemically synthesized
taaattatcggcatgtttggtc

SEQ ID NO: 1256816 - DNA, 22 bp, Artificial Sequence
  chemically synthesized
accctttgcaagaccaaacatg

SEQ ID NO: 1256817 - DNA, 22 bp, Artificial Sequence
  chemically synthesized
tgcaagaccaaacatgccgata

SEQ ID NO: 1256818 - DNA, 22 bp, Artificial Sequence
  chemically synthesized
gcaagaccaaacatgccgataa

SEQ ID NO: 1256819 - DNA, 22 bp, Artificial Sequence
  chemically synthesized
caagaccaaacatgccgataat

SEQ ID NO: 1256820 - DNA, 22 bp, Artificial Sequence
  chemically synthesized
catcacattttaaattatcggc

SEQ ID NO: 1256821 - DNA, 22 bp, Artificial Sequence
  chemically synthesized
gagcctacatcacattttaaat

SEQ ID NO: 1256822 - DNA, 22 bp, Artificial Sequence
  chemically synthesized
attagagcctacatcacatttt

SEQ ID NO: 1256823 - DNA, 22 bp, Artificial Sequence
  chemically synthesized
ttgattagagcctacatcacat

SEQ ID NO: 1256824 - DNA, 22 bp, Artificial Sequence
  chemically synthesized
attattgattagagcctacatc

SEQ ID NO: 1256825 - DNA, 22 bp, Artificial Sequence
  chemically synthesized
aattattgattagagcctacat

SEQ ID NO: 1256826 - DNA, 22 bp, Artificial Sequence
  chemically synthesized
aaaatgtgatgtaggctctaat

SEQ ID NO: 1256827 - DNA, 22 bp, Artificial Sequence
  chemically synthesized
aaatgtgatgtaggctctaatc

SEQ ID NO: 1256828 - DNA, 22 bp, Artificial Sequence
  chemically synthesized
atagaacaacacttaattattg

SEQ ID NO: 1256829 - DNA, 22 bp, Artificial Sequence
  chemically synthesized
taatcaataattaagtgttgtt

SEQ ID NO: 1256830 - DNA, 22 bp, Artificial Sequence
  chemically synthesized
atcaataattaagtgttgttct

SEQ ID NO: 1256831 - DNA, 22 bp, Artificial Sequence
  chemically synthesized
agtgttgttctattaacttatg

SEQ ID NO: 1256832 - DNA, 22 bp, Artificial Sequence
  chemically synthesized
ttctattaacttatgatatatc

SEQ ID NO: 1256833 - DNA, 22 bp, Artificial Sequence
  chemically synthesized
tattaacttatgatatatcaca

SEQ ID NO: 1256834 - DNA, 22 bp, Artificial Sequence
  chemically synthesized
ttaacttatgatatatcacata

SEQ ID NO: 1256835 - DNA, 22 bp, Artificial Sequence
  chemically synthesized
aatcaaataaagtatgtgatat

SEQ ID NO: 1256836 - DNA, 22 bp, Artificial Sequence
  chemically synthesized
acttatgatatatcacatactt

SEQ ID NO: 1256837 - DNA, 22 bp, Artificial Sequence
  chemically synthesized
atgatatatcacatactttatt

SEQ ID NO: 1256838 - DNA, 22 bp, Artificial Sequence
  chemically synthesized
tgatatatcacatactttattt

SEQ ID NO: 1256839 - DNA, 22 bp, Artificial Sequence
  chemically synthesized
atgtcactgaatcaaataaagt

SEQ ID NO: 1256840 - DNA, 22 bp, Artificial Sequence
  chemically synthesized
atgatgatattaatgtcactga

SEQ ID NO: 1256841 - DNA, 22 bp, Artificial Sequence
  chemically synthesized
gatgatgatattaatgtcactg

SEQ ID NO: 1256842 - DNA, 22 bp, Artificial Sequence
  chemically synthesized
tatttgattcagtgacattaat

SEQ ID NO: 1256843 - DNA, 22 bp, Artificial Sequence
  chemically synthesized
atttgattcagtgacattaata

SEQ ID NO: 1256844 - DNA, 22 bp, Artificial Sequence
  chemically synthesized
tttgattcagtgacattaatat

SEQ ID NO: 1256845 - DNA, 22 bp, Artificial Sequence
  chemically synthesized
gattcagtgacattaatatcat

SEQ ID NO: 1256846 - DNA, 22 bp, Artificial Sequence
  chemically synthesized
attcagtgacattaatatcatc

SEQ ID NO: 1256847 - DNA, 22 bp, Artificial Sequence
  chemically synthesized
taataccgtttgatgatgatat

SEQ ID NO: 1256848 - DNA, 22 bp, Artificial Sequence
  chemically synthesized
agtgacattaatatcatcatca

SEQ ID NO: 1256849 - DNA, 22 bp, Artificial Sequence
  chemically synthesized
atatcatcatcaaacggtatta

SEQ ID NO: 1256850 - DNA, 22 bp, Artificial Sequence
  chemically synthesized
aaatatgagaaattataatacc

SEQ ID NO: 1256851 - DNA, 22 bp, Artificial Sequence
  chemically synthesized
taatttctcatattttaatctc

SEQ ID NO: 1256852 - DNA, 22 bp, Artificial Sequence
  chemically synthesized
catggtagaacaggagattaaa

SEQ ID NO: 1256853 - DNA, 22 bp, Artificial Sequence
  chemically synthesized
ctgcatggtagaacaggagatt

SEQ ID NO: 1256854 - DNA, 22 bp, Artificial Sequence
  chemically synthesized
ctcatattttaatctcctgttc

SEQ ID NO: 1256855 - DNA, 22 bp, Artificial Sequence
  chemically synthesized
tgctgcatggtagaacaggaga

SEQ ID NO: 1256856 - DNA, 22 bp, Artificial Sequence
  chemically synthesized
tcatattttaatctcctgttct

SEQ ID NO: 1256857 - DNA, 22 bp, Artificial Sequence
  chemically synthesized
atattttaatctcctgttctac

SEQ ID NO: 1256858 - DNA, 22 bp, Artificial Sequence
  chemically synthesized
tgctctgctgcatggtagaaca

SEQ ID NO: 1256859 - DNA, 22 bp, Artificial Sequence
  chemically synthesized
taatctcctgttctaccatgca

SEQ ID NO: 1256860 - DNA, 22 bp, Artificial Sequence
  chemically synthesized
aatctcctgttctaccatgcag

SEQ ID NO: 1256861 - DNA, 22 bp, Artificial Sequence
  chemically synthesized
atctcctgttctaccatgcagc

SEQ ID NO: 1256862 - DNA, 22 bp, Artificial Sequence
  chemically synthesized
ctgttctaccatgcagcagagc

SEQ ID NO: 1256863 - DNA, 22 bp, Artificial Sequence
  chemically synthesized
ttctaccatgcagcagagcaca

SEQ ID NO: 1256864 - DNA, 22 bp, Artificial Sequence
  chemically synthesized
taccatgcagcagagcacagct

SEQ ID NO: 1256865 - DNA, 22 bp, Artificial Sequence
  chemically synthesized
ccatgcagcagagcacagctgc

SEQ ID NO: 1256866 - DNA, 22 bp, Artificial Sequence
  chemically synthesized
ccatggaaaatataatatgcag

SEQ ID NO: 1256867 - DNA, 22 bp, Artificial Sequence
  chemically synthesized
cccatggaaaatataatatgca

SEQ ID NO: 1256868 - DNA, 22 bp, Artificial Sequence
  chemically synthesized
atatttcccatggaaaatataa

SEQ ID NO: 1256869 - DNA, 22 bp, Artificial Sequence
  chemically synthesized
catattatattttccatgggaa

SEQ ID NO: 1256870 - DNA, 22 bp, Artificial Sequence
  chemically synthesized
tattttccatgggaaatatcag

SEQ ID NO: 1256871 - DNA, 22 bp, Artificial Sequence
  chemically synthesized
caagccatatgatggctgatat

SEQ ID NO: 1256872 - DNA, 22 bp, Artificial Sequence
  chemically synthesized
tccatgggaaatatcagccatc

SEQ ID NO: 1256873 - DNA, 22 bp, Artificial Sequence
  chemically synthesized
ccatgggaaatatcagccatca

SEQ ID NO: 1256874 - DNA, 22 bp, Artificial Sequence
  chemically synthesized
catgggaaatatcagccatcat

SEQ ID NO: 1256875 - DNA, 22 bp, Artificial Sequence
  chemically synthesized
gaagactacaagccatatgatg

SEQ ID NO: 1256876 - DNA, 22 bp, Artificial Sequence
  chemically synthesized
ggaagactacaagccatatgat

SEQ ID NO: 1256877 - DNA, 22 bp, Artificial Sequence
  chemically synthesized
aaaagtaggccagaaatttgga

SEQ ID NO: 1256878 - DNA, 22 bp, Artificial Sequence
  chemically synthesized
gaaaagtaggccagaaatttgg

SEQ ID NO: 1256879 - DNA, 22 bp, Artificial Sequence
  chemically synthesized
tgaaaagtaggccagaaatttg

SEQ ID NO: 1256880 - DNA, 22 bp, Artificial Sequence
  chemically synthesized
gtagtcttccaaatttctggcc

SEQ ID NO: 1256881 - DNA, 22 bp, Artificial Sequence
  chemically synthesized
tagtcttccaaatttctggcct

SEQ ID NO: 1256882 - DNA, 22 bp, Artificial Sequence
  chemically synthesized
attttgaaaagtaggccagaaa

SEQ ID NO: 1256883 - DNA, 22 bp, Artificial Sequence
  chemically synthesized
gattttgaaaagtaggccagaa

SEQ ID NO: 1256884 - DNA, 22 bp, Artificial Sequence
  chemically synthesized
ccaaatttctggcctacttttc

SEQ ID NO: 1256885 - DNA, 22 bp, Artificial Sequence
  chemically synthesized
caaatttctggcctacttttca

SEQ ID NO: 1256886 - DNA, 22 bp, Artificial Sequence
  chemically synthesized
tagacatttgattttgaaaagt

SEQ ID NO: 1256887 - DNA, 22 bp, Artificial Sequence
  chemically synthesized
ctggcctacttttcaaaatcaa

SEQ ID NO: 1256888 - DNA, 22 bp, Artificial Sequence
  chemically synthesized
tggcctacttttcaaaatcaaa

SEQ ID NO: 1256889 - DNA, 22 bp, Artificial Sequence
  chemically synthesized
gaaattgtagacatttgatttt

SEQ ID NO: 1256890 - DNA, 22 bp, Artificial Sequence
  chemically synthesized
gcctacttttcaaaatcaaatg

SEQ ID NO: 1256891 - DNA, 22 bp, Artificial Sequence
  chemically synthesized
ggaaattgtagacatttgattt

SEQ ID NO: 1256892 - DNA, 22 bp, Artificial Sequence
  chemically synthesized
tggaaattgtagacatttgatt

SEQ ID NO: 1256893 - DNA, 22 bp, Artificial Sequence
  chemically synthesized
ttggaaattgtagacatttgat

SEQ ID NO: 1256894 - DNA, 22 bp, Artificial Sequence
  chemically synthesized
tttggaaattgtagacatttga

SEQ ID NO: 1256895 - DNA, 22 bp, Artificial Sequence
  chemically synthesized
cttttcaaaatcaaatgtctac

SEQ ID NO: 1256896 - DNA, 22 bp, Artificial Sequence
  chemically synthesized
ttcaaaatcaaatgtctacaat

SEQ ID NO: 1256897 - DNA, 22 bp, Artificial Sequence
  chemically synthesized
tcaaaatcaaatgtctacaatt

SEQ ID NO: 1256898 - DNA, 22 bp, Artificial Sequence
  chemically synthesized
caaaatcaaatgtctacaattt

SEQ ID NO: 1256899 - DNA, 22 bp, Artificial Sequence
  chemically synthesized
agtgttttttggaaattgtaga

SEQ ID NO: 1256900 - DNA, 22 bp, Artificial Sequence
  chemically synthesized
aaaatcaaatgtctacaatttc

SEQ ID NO: 1256901 - DNA, 22 bp, Artificial Sequence
  chemically synthesized
cagtgttttttggaaattgtag

SEQ ID NO: 1256902 - DNA, 22 bp, Artificial Sequence
  chemically synthesized
tcagtgttttttggaaattgta

SEQ ID NO: 1256903 - DNA, 22 bp, Artificial Sequence
  chemically synthesized
aaaatattttcagtgttttttg

SEQ ID NO: 1256904 - DNA, 22 bp, Artificial Sequence
  chemically synthesized
aaaaatattttcagtgtttttt

SEQ ID NO: 1256905 - DNA, 22 bp, Artificial Sequence
  chemically synthesized
taaaaatattttcagtgttttt

SEQ ID NO: 1256906 - DNA, 22 bp, Artificial Sequence
  chemically synthesized
caatttccaaaaaacactgaaa

SEQ ID NO: 1256907 - DNA, 22 bp, Artificial Sequence
  chemically synthesized
ccaaaaaacactgaaaatattt

SEQ ID NO: 1256908 - DNA, 22 bp, Artificial Sequence
  chemically synthesized
caaaaaacactgaaaatatttt

SEQ ID NO: 1256909 - DNA, 22 bp, Artificial Sequence
  chemically synthesized
gtgcaaaatgtactttaaaaat

SEQ ID NO: 1256910 - DNA, 22 bp, Artificial Sequence
  chemically synthesized
ggtgcaaaatgtactttaaaaa

SEQ ID NO: 1256911 - DNA, 22 bp, Artificial Sequence
  chemically synthesized
aaaatatttttaaagtacattt

SEQ ID NO: 1256912 - DNA, 22 bp, Artificial Sequence
  chemically synthesized
aaatgtttggtgcaaaatgtac

SEQ ID NO: 1256913 - DNA, 22 bp, Artificial Sequence
  chemically synthesized
ttaaagtacattttgcaccaaa

SEQ ID NO: 1256914 - DNA, 22 bp, Artificial Sequence
  chemically synthesized
taaagtacattttgcaccaaac

SEQ ID NO: 1256915 - DNA, 22 bp, Artificial Sequence
  chemically synthesized
ataagttaaaatgtttggtgca

SEQ ID NO: 1256916 - DNA, 22 bp, Artificial Sequence
  chemically synthesized
aaagtacattttgcaccaaaca

SEQ ID NO: 1256917 - DNA, 22 bp, Artificial Sequence
  chemically synthesized
aagtacattttgcaccaaacat

SEQ ID NO: 1256918 - DNA, 22 bp, Artificial Sequence
  chemically synthesized
ctcataagttaaaatgtttggt

SEQ ID NO: 1256919 - DNA, 22 bp, Artificial Sequence
  chemically synthesized
attactcataagttaaaatgtt

SEQ ID NO: 1256920 - DNA, 22 bp, Artificial Sequence
  chemically synthesized
tgcaccaaacattttaacttat

SEQ ID NO: 1256921 - DNA, 22 bp, Artificial Sequence
  chemically synthesized
gcaccaaacattttaacttatg

SEQ ID NO: 1256922 - DNA, 22 bp, Artificial Sequence
  chemically synthesized
caccaaacattttaacttatga

SEQ ID NO: 1256923 - DNA, 22 bp, Artificial Sequence
  chemically synthesized
taaaggttgattactcataagt

SEQ ID NO: 1256924 - DNA, 22 bp, Artificial Sequence
  chemically synthesized
aaatgttgtaaaggttgattac

SEQ ID NO: 1256925 - DNA, 22 bp, Artificial Sequence
  chemically synthesized
taacttatgagtaatcaacctt

SEQ ID NO: 1256926 - DNA, 22 bp, Artificial Sequence
  chemically synthesized
aacttatgagtaatcaaccttt

SEQ ID NO: 1256927 - DNA, 22 bp, Artificial Sequence
  chemically synthesized
acttatgagtaatcaaccttta

SEQ ID NO: 1256928 - DNA, 22 bp, Artificial Sequence
  chemically synthesized
cgttcaaatgttgtaaaggttg

SEQ ID NO: 1256929 - DNA, 22 bp, Artificial Sequence
  chemically synthesized
acgttcaaatgttgtaaaggtt

SEQ ID NO: 1256930 - DNA, 22 bp, Artificial Sequence
  chemically synthesized
tacgttcaaatgttgtaaaggt

SEQ ID NO: 1256931 - DNA, 22 bp, Artificial Sequence
  chemically synthesized
atgagtaatcaacctttacaac

SEQ ID NO: 1256932 - DNA, 22 bp, Artificial Sequence
  chemically synthesized
tgagtaatcaacctttacaaca

SEQ ID NO: 1256933 - DNA, 22 bp, Artificial Sequence
  chemically synthesized
cgttttacgttcaaatgttgta

SEQ ID NO: 1256934 - DNA, 22 bp, Artificial Sequence
  chemically synthesized
ccgttttacgttcaaatgttgt

SEQ ID NO: 1256935 - DNA, 22 bp, Artificial Sequence
  chemically synthesized
gcacttccgttttacgttcaaa

SEQ ID NO: 1256936 - DNA, 22 bp, Artificial Sequence
  chemically synthesized
agcacttccgttttacgttcaa

SEQ ID NO: 1256937 - DNA, 22 bp, Artificial Sequence
  chemically synthesized
tagcacttccgttttacgttca

SEQ ID NO: 1256938 - DNA, 22 bp, Artificial Sequence
  chemically synthesized
ttagcacttccgttttacgttc

SEQ ID NO: 1256939 - DNA, 22 bp, Artificial Sequence
  chemically synthesized
tacaacatttgaacgtaaaacg

SEQ ID NO: 1256940 - DNA, 22 bp, Artificial Sequence
  chemically synthesized
acaacatttgaacgtaaaacgg

SEQ ID NO: 1256941 - DNA, 22 bp, Artificial Sequence
  chemically synthesized
caacatttgaacgtaaaacgga

SEQ ID NO: 1256942 - DNA, 22 bp, Artificial Sequence
  chemically synthesized
ccagacttttagcacttccgtt

SEQ ID NO: 1256943 - DNA, 22 bp, Artificial Sequence
  chemically synthesized
ctgccagacttttagcacttcc

SEQ ID NO: 1256944 - DNA, 22 bp, Artificial Sequence
  chemically synthesized
gaacgtaaaacggaagtgctaa

SEQ ID NO: 1256945 - DNA, 22 bp, Artificial Sequence
  chemically synthesized
gctgccagacttttagcacttc

SEQ ID NO: 1256946 - DNA, 22 bp, Artificial Sequence
  chemically synthesized
aacgtaaaacggaagtgctaaa

SEQ ID NO: 1256947 - DNA, 22 bp, Artificial Sequence
  chemically synthesized
tgctgccagacttttagcactt

SEQ ID NO: 1256948 - DNA, 22 bp, Artificial Sequence
  chemically synthesized
ttgctgccagacttttagcact

SEQ ID NO: 1256949 - DNA, 22 bp, Artificial Sequence
  chemically synthesized
tttttgctgccagacttttagc

SEQ ID NO: 1256950 - DNA, 22 bp, Artificial Sequence
  chemically synthesized
aaaggttgtttttgctgccaga

SEQ ID NO: 1256951 - DNA, 22 bp, Artificial Sequence
  chemically synthesized
aaagtctggcagcaaaaacaac

SEQ ID NO: 1256952 - DNA, 22 bp, Artificial Sequence
  chemically synthesized
ataaaatgctgaaaggttgttt

SEQ ID NO: 1256953 - DNA, 22 bp, Artificial Sequence
  chemically synthesized
tcataaaatgctgaaaggttgt

SEQ ID NO: 1256954 - DNA, 22 bp, Artificial Sequence
  chemically synthesized
gcagcaaaaacaacctttcagc

SEQ ID NO: 1256955 - DNA, 22 bp, Artificial Sequence
  chemically synthesized
tcagcattttatgagagatcct

SEQ ID NO: 1256956 - DNA, 22 bp, Artificial Sequence
  chemically synthesized
cagcattttatgagagatcctg

SEQ ID NO: 1256957 - DNA, 22 bp, Artificial Sequence
  chemically synthesized
agcattttatgagagatcctgt

SEQ ID NO: 1256958 - DNA, 22 bp, Artificial Sequence
  chemically synthesized
accaatatgacgatacaggatc

SEQ ID NO: 1256959 - DNA, 22 bp, Artificial Sequence
  chemically synthesized
tatgagagatcctgtatcgtca

SEQ ID NO: 1256960 - DNA, 22 bp, Artificial Sequence
  chemically synthesized
aattcaccaatatgacgataca

SEQ ID NO: 1256961 - DNA, 22 bp, Artificial Sequence
  chemically synthesized
atgagagatcctgtatcgtcat

SEQ ID NO: 1256962 - DNA, 22 bp, Artificial Sequence
  chemically synthesized
aaattcaccaatatgacgatac

SEQ ID NO: 1256963 - DNA, 22 bp, Artificial Sequence
  chemically synthesized
tgagagatcctgtatcgtcata

SEQ ID NO: 1256964 - DNA, 22 bp, Artificial Sequence
  chemically synthesized
taaattcaccaatatgacgata

SEQ ID NO: 1256965 - DNA, 22 bp, Artificial Sequence
  chemically synthesized
aaatcattttaaattcaccaat

SEQ ID NO: 1256966 - DNA, 22 bp, Artificial Sequence
  chemically synthesized
aaaatcattttaaattcaccaa

SEQ ID NO: 1256967 - DNA, 22 bp, Artificial Sequence
  chemically synthesized
tatcgtcatattggtgaattta

SEQ ID NO: 1256968 - DNA, 22 bp, Artificial Sequence
  chemically synthesized
gtgaatttaaaatgattttaag

SEQ ID NO: 1256969 - DNA, 22 bp, Artificial Sequence
  chemically synthesized
atgagaagaaagaaagaactta

SEQ ID NO: 1256970 - DNA, 22 bp, Artificial Sequence
  chemically synthesized
aaaatgattttaagttctttct

SEQ ID NO: 1256971 - DNA, 22 bp, Artificial Sequence
  chemically synthesized
aaatgattttaagttctttctt

SEQ ID NO: 1256972 - DNA, 22 bp, Artificial Sequence
  chemically synthesized
aagtctcatgagaagaaagaaa

SEQ ID NO: 1256973 - DNA, 22 bp, Artificial Sequence
  chemically synthesized
taagttctttctttcttctcat

SEQ ID NO: 1256974 - DNA, 22 bp, Artificial Sequence
  chemically synthesized
aagttctttctttcttctcatg

SEQ ID NO: 1256975 - DNA, 22 bp, Artificial Sequence
  chemically synthesized
gatctaaagtctcatgagaaga

SEQ ID NO: 1256976 - DNA, 22 bp, Artificial Sequence
  chemically synthesized
agttctttctttcttctcatga

SEQ ID NO: 1256977 - DNA, 22 bp, Artificial Sequence
  chemically synthesized
agatctaaagtctcatgagaag

SEQ ID NO: 1256978 - DNA, 22 bp, Artificial Sequence
  chemically synthesized
cttagatctaaagtctcatgag

SEQ ID NO: 1256979 - DNA, 22 bp, Artificial Sequence
  chemically synthesized
tttctttcttctcatgagactt

SEQ ID NO: 1256980 - DNA, 22 bp, Artificial Sequence
  chemically synthesized
tctttcttctcatgagacttta

SEQ ID NO: 1256981 - DNA, 22 bp, Artificial Sequence
  chemically synthesized
ctttcttctcatgagactttag

SEQ ID NO: 1256982 - DNA, 22 bp, Artificial Sequence
  chemically synthesized
tttcttctcatgagactttaga

SEQ ID NO: 1256983 - DNA, 22 bp, Artificial Sequence
  chemically synthesized
tcttctcatgagactttagatc

SEQ ID NO: 1256984 - DNA, 22 bp, Artificial Sequence
  chemically synthesized
cttctcatgagactttagatct

SEQ ID NO: 1256985 - DNA, 22 bp, Artificial Sequence
  chemically synthesized
ttctcatgagactttagatcta

SEQ ID NO: 1256986 - DNA, 22 bp, Artificial Sequence
  chemically synthesized
aagacagactgcttagatctaa

SEQ ID NO: 1256987 - DNA, 22 bp, Artificial Sequence
  chemically synthesized
ctcatgagactttagatctaag

SEQ ID NO: 1256988 - DNA, 22 bp, Artificial Sequence
  chemically synthesized
tcatgagactttagatctaagc

SEQ ID NO: 1256989 - DNA, 22 bp, Artificial Sequence
  chemically synthesized
atgagactttagatctaagcag

SEQ ID NO: 1256990 - DNA, 22 bp, Artificial Sequence
  chemically synthesized
gtgctaaagacagactgcttag

SEQ ID NO: 1256991 - DNA, 22 bp, Artificial Sequence
  chemically synthesized
tagatctaagcagtctgtcttt

SEQ ID NO: 1256992 - DNA, 22 bp, Artificial Sequence
  chemically synthesized
agatctaagcagtctgtcttta

SEQ ID NO: 1256993 - DNA, 22 bp, Artificial Sequence
  chemically synthesized
gatctaagcagtctgtctttag

SEQ ID NO: 1256994 - DNA, 22 bp, Artificial Sequence
  chemically synthesized
agcagtctgtctttagcactaa

SEQ ID NO: 1256995 - DNA, 22 bp, Artificial Sequence
  chemically synthesized
aagtgatcccggttagtgctaa

SEQ ID NO: 1256996 - DNA, 22 bp, Artificial Sequence
  chemically synthesized
cattgaagtgatcccggttagt

SEQ ID NO: 1256997 - DNA, 22 bp, Artificial Sequence
  chemically synthesized
tctttagcactaaccgggatca

SEQ ID NO: 1256998 - DNA, 22 bp, Artificial Sequence
  chemically synthesized
tagcactaaccgggatcacttc

SEQ ID NO: 1256999 - DNA, 22 bp, Artificial Sequence
  chemically synthesized
agcactaaccgggatcacttca

SEQ ID NO: 1257000 - DNA, 22 bp, Artificial Sequence
  chemically synthesized
gcactaaccgggatcacttcaa

SEQ ID NO: 1257001 - DNA, 22 bp, Artificial Sequence
  chemically synthesized
catgaaaatgttgcattgaagt

SEQ ID NO: 1257002 - DNA, 22 bp, Artificial Sequence
  chemically synthesized
accgggatcacttcaatgcaac

SEQ ID NO: 1257003 - DNA, 22 bp, Artificial Sequence
  chemically synthesized
tgttccatgaaaatgttgcatt

SEQ ID NO: 1257004 - DNA, 22 bp, Artificial Sequence
  chemically synthesized
caatgcaacattttcatggaac

SEQ ID NO: 1257005 - DNA, 22 bp, Artificial Sequence
  chemically synthesized
aatgcaacattttcatggaaca

SEQ ID NO: 1257006 - DNA, 22 bp, Artificial Sequence
  chemically synthesized
acagcaaatgctgtgttccatg

SEQ ID NO: 1257007 - DNA, 22 bp, Artificial Sequence
  chemically synthesized
attgacagcaaatgctgtgttc

SEQ ID NO: 1257008 - DNA, 22 bp, Artificial Sequence
  chemically synthesized
ttgattgacagcaaatgctgtg

SEQ ID NO: 1257009 - DNA, 22 bp, Artificial Sequence
  chemically synthesized
attgattgacagcaaatgctgt

SEQ ID NO: 1257010 - DNA, 22 bp, Artificial Sequence
  chemically synthesized
tcatggaacacagcatttgctg

SEQ ID NO: 1257011 - DNA, 22 bp, Artificial Sequence
  chemically synthesized
catggaacacagcatttgctgt

SEQ ID NO: 1257012 - DNA, 22 bp, Artificial Sequence
  chemically synthesized
atggaacacagcatttgctgtc

SEQ ID NO: 1257013 - DNA, 22 bp, Artificial Sequence
  chemically synthesized
taatcttattgattgacagcaa

SEQ ID NO: 1257014 - DNA, 22 bp, Artificial Sequence
  chemically synthesized
taattataatcttattgattga

SEQ ID NO: 1257015 - DNA, 22 bp, Artificial Sequence
  chemically synthesized
gtaattataatcttattgattg

SEQ ID NO: 1257016 - DNA, 22 bp, Artificial Sequence
  chemically synthesized
tgtaattataatcttattgatt

SEQ ID NO: 1257017 - DNA, 22 bp, Artificial Sequence
  chemically synthesized
ttttgtaattataatcttattg

SEQ ID NO: 1257018 - DNA, 22 bp, Artificial Sequence
  chemically synthesized
gctgtcaatcaataagattata

SEQ ID NO: 1257019 - DNA, 22 bp, Artificial Sequence
  chemically synthesized
ctgtcaatcaataagattataa

SEQ ID NO: 1257020 - DNA, 22 bp, Artificial Sequence
  chemically synthesized
tcaatcaataagattataatta

SEQ ID NO: 1257021 - DNA, 22 bp, Artificial Sequence
  chemically synthesized
taaggcatcattattttgtaat

SEQ ID NO: 1257022 - DNA, 22 bp, Artificial Sequence
  chemically synthesized
taattacaaaataatgatgcct

SEQ ID NO: 1257023 - DNA, 22 bp, Artificial Sequence
  chemically synthesized
gaatgggtctgtaaggcatcat

SEQ ID NO: 1257024 - DNA, 22 bp, Artificial Sequence
  chemically synthesized
agaatgggtctgtaaggcatca

SEQ ID NO: 1257025 - DNA, 22 bp, Artificial Sequence
  chemically synthesized
tagaatgggtctgtaaggcatc

SEQ ID NO: 1257026 - DNA, 22 bp, Artificial Sequence
  chemically synthesized
ttagaatgggtctgtaaggcat

SEQ ID NO: 1257027 - DNA, 22 bp, Artificial Sequence
  chemically synthesized
caaaataatgatgccttacaga

SEQ ID NO: 1257028 - DNA, 22 bp, Artificial Sequence
  chemically synthesized
agatgtcaaagtatttttagaa

SEQ ID NO: 1257029 - DNA, 22 bp, Artificial Sequence
  chemically synthesized
acagacccattctaaaaatact

SEQ ID NO: 1257030 - DNA, 22 bp, Artificial Sequence
  chemically synthesized
cagacccattctaaaaatactt

SEQ ID NO: 1257031 - DNA, 22 bp, Artificial Sequence
  chemically synthesized
atagattcagatgtcaaagtat

SEQ ID NO: 1257032 - DNA, 22 bp, Artificial Sequence
  chemically synthesized
catagattcagatgtcaaagta

SEQ ID NO: 1257033 - DNA, 22 bp, Artificial Sequence
  chemically synthesized
tcatagattcagatgtcaaagt

SEQ ID NO: 1257034 - DNA, 22 bp, Artificial Sequence
  chemically synthesized
taaaaatactttgacatctgaa

SEQ ID NO: 1257035 - DNA, 22 bp, Artificial Sequence
  chemically synthesized
aaaatactttgacatctgaatc

SEQ ID NO: 1257036 - DNA, 22 bp, Artificial Sequence
  chemically synthesized
agccctttcatagattcagatg

SEQ ID NO: 1257037 - DNA, 22 bp, Artificial Sequence
  chemically synthesized
gagccctttcatagattcagat

SEQ ID NO: 1257038 - DNA, 22 bp, Artificial Sequence
  chemically synthesized
gtatttgagccctttcatagat

SEQ ID NO: 1257039 - DNA, 22 bp, Artificial Sequence
  chemically synthesized
ggtatttgagccctttcataga

SEQ ID NO: 1257040 - DNA, 22 bp, Artificial Sequence
  chemically synthesized
tgacatctgaatctatgaaagg

SEQ ID NO: 1257041 - DNA, 22 bp, Artificial Sequence
  chemically synthesized
tggtatttgagccctttcatag

SEQ ID NO: 1257042 - DNA, 22 bp, Artificial Sequence
  chemically synthesized
gacatctgaatctatgaaaggg

SEQ ID NO: 1257043 - DNA, 22 bp, Artificial Sequence
  chemically synthesized
ttggtatttgagccctttcata

SEQ ID NO: 1257044 - DNA, 22 bp, Artificial Sequence
  chemically synthesized
acatctgaatctatgaaagggc

SEQ ID NO: 1257045 - DNA, 22 bp, Artificial Sequence
  chemically synthesized
tttggtatttgagccctttcat

SEQ ID NO: 1257046 - DNA, 22 bp, Artificial Sequence
  chemically synthesized
aatctatgaaagggctcaaata

SEQ ID NO: 1257047 - DNA, 22 bp, Artificial Sequence
  chemically synthesized
gaagatcctttttggtatttga

SEQ ID NO: 1257048 - DNA, 22 bp, Artificial Sequence
  chemically synthesized
tgaaagggctcaaataccaaaa

SEQ ID NO: 1257049 - DNA, 22 bp, Artificial Sequence
  chemically synthesized
atgtgaatctggaagatccttt

SEQ ID NO: 1257050 - DNA, 22 bp, Artificial Sequence
  chemically synthesized
aaataccaaaaaggatcttcca

SEQ ID NO: 1257051 - DNA, 22 bp, Artificial Sequence
  chemically synthesized
ttcatgtgaatctggaagatcc

SEQ ID NO: 1257052 - DNA, 22 bp, Artificial Sequence
  chemically synthesized
attcatgtgaatctggaagatc

SEQ ID NO: 1257053 - DNA, 22 bp, Artificial Sequence
  chemically synthesized
tattcatgtgaatctggaagat

SEQ ID NO: 1257054 - DNA, 22 bp, Artificial Sequence
  chemically synthesized
aggaactttattcatgtgaatc

SEQ ID NO: 1257055 - DNA, 22 bp, Artificial Sequence
  chemically synthesized
cctcaggaactttattcatgtg

SEQ ID NO: 1257056 - DNA, 22 bp, Artificial Sequence
  chemically synthesized
ccagattcacatgaataaagtt

SEQ ID NO: 1257057 - DNA, 22 bp, Artificial Sequence
  chemically synthesized
cagattcacatgaataaagttc

SEQ ID NO: 1257058 - DNA, 22 bp, Artificial Sequence
  chemically synthesized
aaatatcaactacctcaggaac

SEQ ID NO: 1257059 - DNA, 22 bp, Artificial Sequence
  chemically synthesized
acatgaataaagttcctgaggt

SEQ ID NO: 1257060 - DNA, 22 bp, Artificial Sequence
  chemically synthesized
aaaatatcaactacctcaggaa

SEQ ID NO: 1257061 - DNA, 22 bp, Artificial Sequence
  chemically synthesized
taaaatatcaactacctcagga

SEQ ID NO: 1257062 - DNA, 22 bp, Artificial Sequence
  chemically synthesized
ttaaaatatcaactacctcagg

SEQ ID NO: 1257063 - DNA, 22 bp, Artificial Sequence
  chemically synthesized
ctgaggtagttgatattttaaa

SEQ ID NO: 1257064 - DNA, 22 bp, Artificial Sequence
  chemically synthesized
aggtagttgatattttaaaaat

SEQ ID NO: 1257065 - DNA, 22 bp, Artificial Sequence
  chemically synthesized
gcatgacacggaatttttaaaa

SEQ ID NO: 1257066 - DNA, 22 bp, Artificial Sequence
  chemically synthesized
atattttaaaaattccgtgtca

SEQ ID NO: 1257067 - DNA, 22 bp, Artificial Sequence
  chemically synthesized
acataattggcatgacacggaa

SEQ ID NO: 1257068 - DNA, 22 bp, Artificial Sequence
  chemically synthesized
taaaaattccgtgtcatgccaa

SEQ ID NO: 1257069 - DNA, 22 bp, Artificial Sequence
  chemically synthesized
aaaaattccgtgtcatgccaat

SEQ ID NO: 1257070 - DNA, 22 bp, Artificial Sequence
  chemically synthesized
aaaattccgtgtcatgccaatt

SEQ ID NO: 1257071 - DNA, 22 bp, Artificial Sequence
  chemically synthesized
accagcataggttcacataatt

SEQ ID NO: 1257072 - DNA, 22 bp, Artificial Sequence
  chemically synthesized
cgtgtcatgccaattatgtgaa

SEQ ID NO: 1257073 - DNA, 22 bp, Artificial Sequence
  chemically synthesized
aggtgtgatctaaccagcatag

SEQ ID NO: 1257074 - DNA, 22 bp, Artificial Sequence
  chemically synthesized
caggtgtgatctaaccagcata

SEQ ID NO: 1257075 - DNA, 22 bp, Artificial Sequence
  chemically synthesized
tcaggtgtgatctaaccagcat

SEQ ID NO: 1257076 - DNA, 22 bp, Artificial Sequence
  chemically synthesized
tgtgaacctatgctggttagat

SEQ ID NO: 1257077 - DNA, 22 bp, Artificial Sequence
  chemically synthesized
aattttcaggtgtgatctaacc

SEQ ID NO: 1257078 - DNA, 22 bp, Artificial Sequence
  chemically synthesized
tgctggttagatcacacctgaa

SEQ ID NO: 1257079 - DNA, 22 bp, Artificial Sequence
  chemically synthesized
gttagatcacacctgaaaattt

SEQ ID NO: 1257080 - DNA, 22 bp, Artificial Sequence
  chemically synthesized
gatcacacctgaaaatttagga

SEQ ID NO: 1257081 - DNA, 22 bp, Artificial Sequence
  chemically synthesized
acataccatgacaatacatcct

SEQ ID NO: 1257082 - DNA, 22 bp, Artificial Sequence
  chemically synthesized
aaaatttaggatgtattgtcat

SEQ ID NO: 1257083 - DNA, 22 bp, Artificial Sequence
  chemically synthesized
tagtcagttcacataccatgac

SEQ ID NO: 1257084 - DNA, 22 bp, Artificial Sequence
  chemically synthesized
gtagtcagttcacataccatga

SEQ ID NO: 1257085 - DNA, 22 bp, Artificial Sequence
  chemically synthesized
aggatgtattgtcatggtatgt

SEQ ID NO: 1257086 - DNA, 22 bp, Artificial Sequence
  chemically synthesized
tgtagtcagttcacataccatg

SEQ ID NO: 1257087 - DNA, 22 bp, Artificial Sequence
  chemically synthesized
ggatgtattgtcatggtatgtg

SEQ ID NO: 1257088 - DNA, 22 bp, Artificial Sequence
  chemically synthesized
ttgtagtcagttcacataccat

SEQ ID NO: 1257089 - DNA, 22 bp, Artificial Sequence
  chemically synthesized
ataccttttgtagtcagttcac

SEQ ID NO: 1257090 - DNA, 22 bp, Artificial Sequence
  chemically synthesized
tcatggtatgtgaactgactac

SEQ ID NO: 1257091 - DNA, 22 bp, Artificial Sequence
  chemically synthesized
ctgataccttttgtagtcagtt

SEQ ID NO: 1257092 - DNA, 22 bp, Artificial Sequence
  chemically synthesized
actacaaaaggtatcaggaggt

SEQ ID NO: 1257093 - DNA, 22 bp, Artificial Sequence
  chemically synthesized
tgtagcaaatatcaacctcctg

SEQ ID NO: 1257094 - DNA, 22 bp, Artificial Sequence
  chemically synthesized
atgtagcaaatatcaacctcct

SEQ ID NO: 1257095 - DNA, 22 bp, Artificial Sequence
  chemically synthesized
caaaaggtatcaggaggttgat

SEQ ID NO: 1257096 - DNA, 22 bp, Artificial Sequence
  chemically synthesized
ttatgtagcaaatatcaacctc

SEQ ID NO: 1257097 - DNA, 22 bp, Artificial Sequence
  chemically synthesized
tcttatgtagcaaatatcaacc

SEQ ID NO: 1257098 - DNA, 22 bp, Artificial Sequence
  chemically synthesized
ctcttatgtagcaaatatcaac

SEQ ID NO: 1257099 - DNA, 22 bp, Artificial Sequence
  chemically synthesized
tctcttatgtagcaaatatcaa

SEQ ID NO: 1257100 - DNA, 22 bp, Artificial Sequence
  chemically synthesized
aacacatctttctcttatgtag

SEQ ID NO: 1257101 - DNA, 22 bp, Artificial Sequence
  chemically synthesized
gaacacatctttctcttatgta

SEQ ID NO: 1257102 - DNA, 22 bp, Artificial Sequence
  chemically synthesized
ttgaacacatctttctcttatg

SEQ ID NO: 1257103 - DNA, 22 bp, Artificial Sequence
  chemically synthesized
cttgaacacatctttctcttat

SEQ ID NO: 1257104 - DNA, 22 bp, Artificial Sequence
  chemically synthesized
atatttgctacataagagaaag

SEQ ID NO: 1257105 - DNA, 22 bp, Artificial Sequence
  chemically synthesized
gctacataagagaaagatgtgt

SEQ ID NO: 1257106 - DNA, 22 bp, Artificial Sequence
  chemically synthesized
ctacataagagaaagatgtgtt

SEQ ID NO: 1257107 - DNA, 22 bp, Artificial Sequence
  chemically synthesized
cataagagaaagatgtgttcaa

SEQ ID NO: 1257108 - DNA, 22 bp, Artificial Sequence
  chemically synthesized
gtgagatgcaaaggtgtgagga

SEQ ID NO: 1257109 - DNA, 22 bp, Artificial Sequence
  chemically synthesized
cctagtgagatgcaaaggtgtg

SEQ ID NO: 1257110 - DNA, 22 bp, Artificial Sequence
  chemically synthesized
gcctagtgagatgcaaaggtgt

SEQ ID NO: 1257111 - DNA, 22 bp, Artificial Sequence
  chemically synthesized
aagaaatcctcacacctttgca

SEQ ID NO: 1257112 - DNA, 22 bp, Artificial Sequence
  chemically synthesized
acccatttgcctagtgagatgc

SEQ ID NO: 1257113 - DNA, 22 bp, Artificial Sequence
  chemically synthesized
acacctttgcatctcactaggc

SEQ ID NO: 1257114 - DNA, 22 bp, Artificial Sequence
  chemically synthesized
tgcatctcactaggcaaatggg

SEQ ID NO: 1257115 - DNA, 22 bp, Artificial Sequence
  chemically synthesized
agatgtaattaacccatttgcc

SEQ ID NO: 1257116 - DNA, 22 bp, Artificial Sequence
  chemically synthesized
gcatctcactaggcaaatgggt

SEQ ID NO: 1257117 - DNA, 22 bp, Artificial Sequence
  chemically synthesized
cagatgtaattaacccatttgc

SEQ ID NO: 1257118 - DNA, 22 bp, Artificial Sequence
  chemically synthesized
catctcactaggcaaatgggtt

SEQ ID NO: 1257119 - DNA, 22 bp, Artificial Sequence
  chemically synthesized
actaggcaaatgggttaattac

SEQ ID NO: 1257120 - DNA, 22 bp, Artificial Sequence
  chemically synthesized
ggcaaatgggttaattacatct

SEQ ID NO: 1257121 - DNA, 22 bp, Artificial Sequence
  chemically synthesized
tcaaccaaatcgaaatatgatt

SEQ ID NO: 1257122 - DNA, 22 bp, Artificial Sequence
  chemically synthesized
attacatctgaaatcatatttc

SEQ ID NO: 1257123 - DNA, 22 bp, Artificial Sequence
  chemically synthesized
catctgaaatcatatttcgatt

SEQ ID NO: 1257124 - DNA, 22 bp, Artificial Sequence
  chemically synthesized
tcagactatcaaccaaatcgaa

SEQ ID NO: 1257125 - DNA, 22 bp, Artificial Sequence
  chemically synthesized
atcagactatcaaccaaatcga

SEQ ID NO: 1257126 - DNA, 22 bp, Artificial Sequence
  chemically synthesized
aaatcatatttcgatttggttg

SEQ ID NO: 1257127 - DNA, 22 bp, Artificial Sequence
  chemically synthesized
acttatcagactatcaaccaaa

SEQ ID NO: 1257128 - DNA, 22 bp, Artificial Sequence
  chemically synthesized
aattaacttatcagactatcaa

SEQ ID NO: 1257129 - DNA, 22 bp, Artificial Sequence
  chemically synthesized
aaattaacttatcagactatca

SEQ ID NO: 1257130 - DNA, 22 bp, Artificial Sequence
  chemically synthesized
cgatttggttgatagtctgata

SEQ ID NO: 1257131 - DNA, 22 bp, Artificial Sequence
  chemically synthesized
gatttggttgatagtctgataa

SEQ ID NO: 1257132 - DNA, 22 bp, Artificial Sequence
  chemically synthesized
ggttgatagtctgataagttaa

SEQ ID NO: 1257133 - DNA, 22 bp, Artificial Sequence
  chemically synthesized
gttgatagtctgataagttaat

SEQ ID NO: 1257134 - DNA, 22 bp, Artificial Sequence
  chemically synthesized
atagtctgataagttaatttaa

SEQ ID NO: 1257135 - DNA, 22 bp, Artificial Sequence
  chemically synthesized
gatggtaccagggtcaccttaa

SEQ ID NO: 1257136 - DNA, 22 bp, Artificial Sequence
  chemically synthesized
ataagttaatttaaggtgaccc

SEQ ID NO: 1257137 - DNA, 22 bp, Artificial Sequence
  chemically synthesized
atttaaggtgaccctggtacca

SEQ ID NO: 1257138 - DNA, 22 bp, Artificial Sequence
  chemically synthesized
aaggtgaccctggtaccatcta

SEQ ID NO: 1257139 - DNA, 22 bp, Artificial Sequence
  chemically synthesized
aggtgaccctggtaccatctaa

SEQ ID NO: 1257140 - DNA, 22 bp, Artificial Sequence
  chemically synthesized
gaataaaaacaaaacagttaga

SEQ ID NO: 1257141 - DNA, 22 bp, Artificial Sequence
  chemically synthesized
ggaataaaaacaaaacagttag

SEQ ID NO: 1257142 - DNA, 22 bp, Artificial Sequence
  chemically synthesized
tttggaataaaaacaaaacagt

SEQ ID NO: 1257143 - DNA, 22 bp, Artificial Sequence
  chemically synthesized
gtaccatctaactgttttgttt

SEQ ID NO: 1257144 - DNA, 22 bp, Artificial Sequence
  chemically synthesized
actgttttgtttttattccaaa

SEQ ID NO: 1257145 - DNA, 22 bp, Artificial Sequence
  chemically synthesized
ttttgtttttattccaaatagg

SEQ ID NO: 1257146 - DNA, 22 bp, Artificial Sequence
  chemically synthesized
gaaagggccaatatcctatttg

SEQ ID NO: 1257147 - DNA, 22 bp, Artificial Sequence
  chemically synthesized
tgtttttattccaaataggata

SEQ ID NO: 1257148 - DNA, 22 bp, Artificial Sequence
  chemically synthesized
agaaagggccaatatcctattt

SEQ ID NO: 1257149 - DNA, 22 bp, Artificial Sequence
  chemically synthesized
gtttttattccaaataggatat

SEQ ID NO: 1257150 - DNA, 22 bp, Artificial Sequence
  chemically synthesized
tagaaagggccaatatcctatt

SEQ ID NO: 1257151 - DNA, 22 bp, Artificial Sequence
  chemically synthesized
tttttattccaaataggatatt

SEQ ID NO: 1257152 - DNA, 22 bp, Artificial Sequence
  chemically synthesized
ttagaaagggccaatatcctat

SEQ ID NO: 1257153 - DNA, 22 bp, Artificial Sequence
  chemically synthesized
tttagaaagggccaatatccta

SEQ ID NO: 1257154 - DNA, 22 bp, Artificial Sequence
  chemically synthesized
ttattccaaataggatattggc

SEQ ID NO: 1257155 - DNA, 22 bp, Artificial Sequence
  chemically synthesized
tattccaaataggatattggcc

SEQ ID NO: 1257156 - DNA, 22 bp, Artificial Sequence
  chemically synthesized
attccaaataggatattggccc

SEQ ID NO: 1257157 - DNA, 22 bp, Artificial Sequence
  chemically synthesized
ttccaaataggatattggccct

SEQ ID NO: 1257158 - DNA, 22 bp, Artificial Sequence
  chemically synthesized
caaataggatattggccctttc

SEQ ID NO: 1257159 - DNA, 22 bp, Artificial Sequence
  chemically synthesized
cataatcctttttagaaagggc

SEQ ID NO: 1257160 - DNA, 22 bp, Artificial Sequence
  chemically synthesized
gccctttctaaaaaggattatg

SEQ ID NO: 1257161 - DNA, 22 bp, Artificial Sequence
  chemically synthesized
atatagacaagactacataatc

SEQ ID NO: 1257162 - DNA, 22 bp, Artificial Sequence
  chemically synthesized
tctaaaaaggattatgtagtct

SEQ ID NO: 1257163 - DNA, 22 bp, Artificial Sequence
  chemically synthesized
ctcatatagacaagactacata

SEQ ID NO: 1257164 - DNA, 22 bp, Artificial Sequence
  chemically synthesized
ctaaaaaggattatgtagtctt

SEQ ID NO: 1257165 - DNA, 22 bp, Artificial Sequence
  chemically synthesized
gctcatatagacaagactacat

SEQ ID NO: 1257166 - DNA, 22 bp, Artificial Sequence
  chemically synthesized
taaaaaggattatgtagtcttg

SEQ ID NO: 1257167 - DNA, 22 bp, Artificial Sequence
  chemically synthesized
tgctcatatagacaagactaca

SEQ ID NO: 1257168 - DNA, 22 bp, Artificial Sequence
  chemically synthesized
ttgctcatatagacaagactac

SEQ ID NO: 1257169 - DNA, 22 bp, Artificial Sequence
  chemically synthesized
aaaaggattatgtagtcttgtc

SEQ ID NO: 1257170 - DNA, 22 bp, Artificial Sequence
  chemically synthesized
tttgctcatatagacaagacta

SEQ ID NO: 1257171 - DNA, 22 bp, Artificial Sequence
  chemically synthesized
ttttgctcatatagacaagact

SEQ ID NO: 1257172 - DNA, 22 bp, Artificial Sequence
  chemically synthesized
tttttgctcatatagacaagac

SEQ ID NO: 1257173 - DNA, 22 bp, Artificial Sequence
  chemically synthesized
ttttttgctcatatagacaaga

SEQ ID NO: 1257174 - DNA, 22 bp, Artificial Sequence
  chemically synthesized
tttttttgctcatatagacaag

SEQ ID NO: 1257175 - DNA, 22 bp, Artificial Sequence
  chemically synthesized
ttttttttgctcatatagacaa

SEQ ID NO: 1257176 - DNA, 22 bp, Artificial Sequence
  chemically synthesized
tttttttttgctcatatagaca

SEQ ID NO: 1257177 - DNA, 22 bp, Artificial Sequence
  chemically synthesized
ttttttttttgctcatatagac

SEQ ID NO: 1257178 - DNA, 22 bp, Artificial Sequence
  chemically synthesized
tttttttttttgctcatataga

SEQ ID NO: 1257179 - DNA, 22 bp, Artificial Sequence
  chemically synthesized
ttttttttttttgctcatatag

SEQ ID NO: 1257180 - DNA, 22 bp, Artificial Sequence
  chemically synthesized
tgtagtcttgtctatatgagca

SEQ ID NO: 1257181 - DNA, 22 bp, Artificial Sequence
  chemically synthesized
tttttttttttttgctcatata

SEQ ID NO: 1257182 - DNA, 22 bp, Artificial Sequence
  chemically synthesized
ttttttttttttttgctcatat

SEQ ID NO: 1257183 - DNA, 22 bp, Artificial Sequence
  chemically synthesized
tttttttttttttttgctcata

SEQ ID NO: 1257184 - DNA, 22 bp, Artificial Sequence
  chemically synthesized
ttttttttttttttttgctcat

SEQ ID NO: 1257185 - DNA, 22 bp, Artificial Sequence
  chemically synthesized
tttttttttttttttttgctca

SEQ ID NO: 1257186 - DNA, 22 bp, Artificial Sequence
  chemically synthesized
ttttttttttttttttttgctc

SEQ ID NO: 1257187 - DNA, 22 bp, Artificial Sequence
  chemically synthesized
tttttttttttttttttttgct

SEQ ID NO: 1257188 - DNA, 22 bp, Artificial Sequence
  chemically synthesized
ttttttttttttttttttttgc

SEQ ID NO: 1257189 - DNA, 22 bp, Artificial Sequence
  chemically synthesized
tttttttttttttttttttttg

SEQ ID NO: 1257190 - DNA, 22 bp, Artificial Sequence
  chemically synthesized
gtctatatgagcaaaaaaaaaa

SEQ ID NO: 1257191 - DNA, 22 bp, Artificial Sequence
  chemically synthesized
tctatatgagcaaaaaaaaaaa

SEQ ID NO: 1257192 - DNA, 22 bp, Artificial Sequence
  chemically synthesized
cttttttttttttttttttttt

SEQ ID NO: 1257193 - DNA, 22 bp, Artificial Sequence
  chemically synthesized
tatgagcaaaaaaaaaaaaaaa

SEQ ID NO: 1257194 - DNA, 22 bp, Artificial Sequence
  chemically synthesized
aggttacttttttttttttttt

SEQ ID NO: 1257195 - DNA, 22 bp, Artificial Sequence
  chemically synthesized
tactcaggttactttttttttt

SEQ ID NO: 1257196 - DNA, 22 bp, Artificial Sequence
  chemically synthesized
gtaccatagttatactcaggtt

SEQ ID NO: 1257197 - DNA, 22 bp, Artificial Sequence
  chemically synthesized
agtaccatagttatactcaggt

SEQ ID NO: 1257198 - DNA, 22 bp, Artificial Sequence
  chemically synthesized
ttagtaccatagttatactcag

SEQ ID NO: 1257199 - DNA, 22 bp, Artificial Sequence
  chemically synthesized
cttagtaccatagttatactca

SEQ ID NO: 1257200 - DNA, 22 bp, Artificial Sequence
  chemically synthesized
tcttagtaccatagttatactc

SEQ ID NO: 1257201 - DNA, 22 bp, Artificial Sequence
  chemically synthesized
tttcttagtaccatagttatac

SEQ ID NO: 1257202 - DNA, 22 bp, Artificial Sequence
  chemically synthesized
ctttcttagtaccatagttata

SEQ ID NO: 1257203 - DNA, 22 bp, Artificial Sequence
  chemically synthesized
tctttcttagtaccatagttat

SEQ ID NO: 1257204 - DNA, 22 bp, Artificial Sequence
  chemically synthesized
attttctttcttagtaccatag

SEQ ID NO: 1257205 - DNA, 22 bp, Artificial Sequence
  chemically synthesized
agtataactatggtactaagaa

SEQ ID NO: 1257206 - DNA, 22 bp, Artificial Sequence
  chemically synthesized
tgtatactgattttctttctta

SEQ ID NO: 1257207 - DNA, 22 bp, Artificial Sequence
  chemically synthesized
cctgtgtatactgattttcttt

SEQ ID NO: 1257208 - DNA, 22 bp, Artificial Sequence
  chemically synthesized
tggtactaagaaagaaaatcag

SEQ ID NO: 1257209 - DNA, 22 bp, Artificial Sequence
  chemically synthesized
agaaagaaaatcagtatacaca

SEQ ID NO: 1257210 - DNA, 22 bp, Artificial Sequence
  chemically synthesized
tggcagataaatcctacctgtg

SEQ ID NO: 1257211 - DNA, 22 bp, Artificial Sequence
  chemically synthesized
atggcagataaatcctacctgt

SEQ ID NO: 1257212 - DNA, 22 bp, Artificial Sequence
  chemically synthesized
tatggcagataaatcctacctg

SEQ ID NO: 1257213 - DNA, 22 bp, Artificial Sequence
  chemically synthesized
tttatggcagataaatcctacc

SEQ ID NO: 1257214 - DNA, 22 bp, Artificial Sequence
  chemically synthesized
ttctttatggcagataaatcct

SEQ ID NO: 1257215 - DNA, 22 bp, Artificial Sequence
  chemically synthesized
tagcagtgaactattctttatg

SEQ ID NO: 1257216 - DNA, 22 bp, Artificial Sequence
  chemically synthesized
atagcagtgaactattctttat

SEQ ID NO: 1257217 - DNA, 22 bp, Artificial Sequence
  chemically synthesized
ttatagcagtgaactattcttt

SEQ ID NO: 1257218 - DNA, 22 bp, Artificial Sequence
  chemically synthesized
atctgccataaagaatagttca

SEQ ID NO: 1257219 - DNA, 22 bp, Artificial Sequence
  chemically synthesized
tctgccataaagaatagttcac

SEQ ID NO: 1257220 - DNA, 22 bp, Artificial Sequence
  chemically synthesized
ccataaagaatagttcactgct

SEQ ID NO: 1257221 - DNA, 22 bp, Artificial Sequence
  chemically synthesized
taagaaattcttatagcagtga

SEQ ID NO: 1257222 - DNA, 22 bp, Artificial Sequence
  chemically synthesized
gtaagaaattcttatagcagtg

SEQ ID NO: 1257223 - DNA, 22 bp, Artificial Sequence
  chemically synthesized
ttgtaagaaattcttatagcag

SEQ ID NO: 1257224 - DNA, 22 bp, Artificial Sequence
  chemically synthesized
cttgtaagaaattcttatagca

SEQ ID NO: 1257225 - DNA, 22 bp, Artificial Sequence
  chemically synthesized
actgctataagaatttcttaca

SEQ ID NO: 1257226 - DNA, 22 bp, Artificial Sequence
  chemically synthesized
tccagtagagtttcttgtaaga

SEQ ID NO: 1257227 - DNA, 22 bp, Artificial Sequence
  chemically synthesized
ctataagaatttcttacaagaa

SEQ ID NO: 1257228 - DNA, 22 bp, Artificial Sequence
  chemically synthesized
taagaatttcttacaagaaact

SEQ ID NO: 1257229 - DNA, 22 bp, Artificial Sequence
  chemically synthesized
attatccagtagagtttcttgt

SEQ ID NO: 1257230 - DNA, 22 bp, Artificial Sequence
  chemically synthesized
gaaggttgattatccagtagag

SEQ ID NO: 1257231 - DNA, 22 bp, Artificial Sequence
  chemically synthesized
cttacaagaaactctactggat

SEQ ID NO: 1257232 - DNA, 22 bp, Artificial Sequence
  chemically synthesized
ttacaagaaactctactggata

SEQ ID NO: 1257233 - DNA, 22 bp, Artificial Sequence
  chemically synthesized
acaagaaactctactggataat

SEQ ID NO: 1257234 - DNA, 22 bp, Artificial Sequence
  chemically synthesized
actagaaggttgattatccagt

SEQ ID NO: 1257235 - DNA, 22 bp, Artificial Sequence
  chemically synthesized
caagaaactctactggataatc

SEQ ID NO: 1257236 - DNA, 22 bp, Artificial Sequence
  chemically synthesized
gactagaaggttgattatccag

SEQ ID NO: 1257237 - DNA, 22 bp, Artificial Sequence
  chemically synthesized
gagtttgactagaaggttgatt

SEQ ID NO: 1257238 - DNA, 22 bp, Artificial Sequence
  chemically synthesized
tactggataatcaaccttctag

SEQ ID NO: 1257239 - DNA, 22 bp, Artificial Sequence
  chemically synthesized
cctggagtttgactagaaggtt

SEQ ID NO: 1257240 - DNA, 22 bp, Artificial Sequence
  chemically synthesized
ctggataatcaaccttctagtc

SEQ ID NO: 1257241 - DNA, 22 bp, Artificial Sequence
  chemically synthesized
gataatcaaccttctagtcaaa

SEQ ID NO: 1257242 - DNA, 22 bp, Artificial Sequence
  chemically synthesized
aattccctggagtttgactaga

SEQ ID NO: 1257243 - DNA, 22 bp, Artificial Sequence
  chemically synthesized
cattgaattccctggagtttga

SEQ ID NO: 1257244 - DNA, 22 bp, Artificial Sequence
  chemically synthesized
aactacattgaattccctggag

SEQ ID NO: 1257245 - DNA, 22 bp, Artificial Sequence
  chemically synthesized
aaactacattgaattccctgga

SEQ ID NO: 1257246 - DNA, 22 bp, Artificial Sequence
  chemically synthesized
ctagtcaaactccagggaattc

SEQ ID NO: 1257247 - DNA, 22 bp, Artificial Sequence
  chemically synthesized
tagtcaaactccagggaattca

SEQ ID NO: 1257248 - DNA, 22 bp, Artificial Sequence
  chemically synthesized
gtcaaactccagggaattcaat

SEQ ID NO: 1257249 - DNA, 22 bp, Artificial Sequence
  chemically synthesized
agtttaaactacattgaattcc

SEQ ID NO: 1257250 - DNA, 22 bp, Artificial Sequence
  chemically synthesized
cagggaattcaatgtagtttaa

SEQ ID NO: 1257251 - DNA, 22 bp, Artificial Sequence
  chemically synthesized
atatgtattgagtttaaactac

SEQ ID NO: 1257252 - DNA, 22 bp, Artificial Sequence
  chemically synthesized
cctaatatgtattgagtttaaa

SEQ ID NO: 1257253 - DNA, 22 bp, Artificial Sequence
  chemically synthesized
ccctaatatgtattgagtttaa

SEQ ID NO: 1257254 - DNA, 22 bp, Artificial Sequence
  chemically synthesized
aatgtagtttaaactcaataca

SEQ ID NO: 1257255 - DNA, 22 bp, Artificial Sequence
  chemically synthesized
tgatttccctaatatgtattga

SEQ ID NO: 1257256 - DNA, 22 bp, Artificial Sequence
  chemically synthesized
gtgatttccctaatatgtattg

SEQ ID NO: 1257257 - DNA, 22 bp, Artificial Sequence
  chemically synthesized
tgtgatttccctaatatgtatt

SEQ ID NO: 1257258 - DNA, 22 bp, Artificial Sequence
  chemically synthesized
attttgtgatttccctaatatg

SEQ ID NO: 1257259 - DNA, 22 bp, Artificial Sequence
  chemically synthesized
aaactcaatacatattagggaa

SEQ ID NO: 1257260 - DNA, 22 bp, Artificial Sequence
  chemically synthesized
aactcaatacatattagggaaa

SEQ ID NO: 1257261 - DNA, 22 bp, Artificial Sequence
  chemically synthesized
aatacatattagggaaatcaca

SEQ ID NO: 1257262 - DNA, 22 bp, Artificial Sequence
  chemically synthesized
catatgattcattttgtgattt

SEQ ID NO: 1257263 - DNA, 22 bp, Artificial Sequence
  chemically synthesized
gggaaatcacaaaatgaatcat

SEQ ID NO: 1257264 - DNA, 22 bp, Artificial Sequence
  chemically synthesized
atccatagaatgactacatatg

SEQ ID NO: 1257265 - DNA, 22 bp, Artificial Sequence
  chemically synthesized
tgaactcatccatagaatgact

SEQ ID NO: 1257266 - DNA, 22 bp, Artificial Sequence
  chemically synthesized
gattgtgaactcatccatagaa

SEQ ID NO: 1257267 - DNA, 22 bp, Artificial Sequence
  chemically synthesized
tctagattgtgaactcatccat

SEQ ID NO: 1257268 - DNA, 22 bp, Artificial Sequence
  chemically synthesized
tatggatgagttcacaatctag

SEQ ID NO: 1257269 - DNA, 22 bp, Artificial Sequence
  chemically synthesized
tggatgagttcacaatctagat

SEQ ID NO: 1257270 - DNA, 22 bp, Artificial Sequence
  chemically synthesized
cccccacggaaatactatctag

SEQ ID NO: 1257271 - DNA, 22 bp, Artificial Sequence
  chemically synthesized
attacccccacggaaatactat

SEQ ID NO: 1257272 - DNA, 22 bp, Artificial Sequence
  chemically synthesized
acaatctagatagtatttccgt

SEQ ID NO: 1257273 - DNA, 22 bp, Artificial Sequence
  chemically synthesized
ctcattacccccacggaaatac

SEQ ID NO: 1257274 - DNA, 22 bp, Artificial Sequence
  chemically synthesized
gatagtatttccgtgggggtaa

SEQ ID NO: 1257275 - DNA, 22 bp, Artificial Sequence
  chemically synthesized
acgtggcgagatactcctcatt

SEQ ID NO: 1257276 - DNA, 22 bp, Artificial Sequence
  chemically synthesized
ccgtgggggtaatgaggagtat

SEQ ID NO: 1257277 - DNA, 22 bp, Artificial Sequence
  chemically synthesized
tgacgtggcgagatactcctca

SEQ ID NO: 1257278 - DNA, 22 bp, Artificial Sequence
  chemically synthesized
cgtgggggtaatgaggagtatc

SEQ ID NO: 1257279 - DNA, 22 bp, Artificial Sequence
  chemically synthesized
ctctgacgtggcgagatactcc

SEQ ID NO: 1257280 - DNA, 22 bp, Artificial Sequence
  chemically synthesized
actcctctgacgtggcgagata

SEQ ID NO: 1257281 - DNA, 22 bp, Artificial Sequence
  chemically synthesized
gccacgtcagaggagtgagtat

SEQ ID NO: 1257282 - DNA, 22 bp, Artificial Sequence
  chemically synthesized
agaaggcagaaggatactcact

SEQ ID NO: 1257283 - DNA, 22 bp, Artificial Sequence
  chemically synthesized
aagaaggcagaaggatactcac

SEQ ID NO: 1257284 - DNA, 22 bp, Artificial Sequence
  chemically synthesized
tacttaagaaggcagaaggata

SEQ ID NO: 1257285 - DNA, 22 bp, Artificial Sequence
  chemically synthesized
tatgtgttatacttaagaaggc

SEQ ID NO: 1257286 - DNA, 22 bp, Artificial Sequence
  chemically synthesized
actatatgtgttatacttaaga

SEQ ID NO: 1257287 - DNA, 22 bp, Artificial Sequence
  chemically synthesized
tgttaactatatgtgttatact

SEQ ID NO: 1257288 - DNA, 22 bp, Artificial Sequence
  chemically synthesized
ctgccttcttaagtataacaca

SEQ ID NO: 1257289 - DNA, 22 bp, Artificial Sequence
  chemically synthesized
tgccttcttaagtataacacat

SEQ ID NO: 1257290 - DNA, 22 bp, Artificial Sequence
  chemically synthesized
ccttcttaagtataacacatat

SEQ ID NO: 1257291 - DNA, 22 bp, Artificial Sequence
  chemically synthesized
cttaagtataacacatatagtt

SEQ ID NO: 1257292 - DNA, 22 bp, Artificial Sequence
  chemically synthesized
ttaagtataacacatatagtta

SEQ ID NO: 1257293 - DNA, 22 bp, Artificial Sequence
  chemically synthesized
aagtataacacatatagttaac

SEQ ID NO: 1257294 - DNA, 22 bp, Artificial Sequence
  chemically synthesized
agtataacacatatagttaaca

SEQ ID NO: 1257295 - DNA, 22 bp, Artificial Sequence
  chemically synthesized
aagaaaatattatgttaactat

SEQ ID NO: 1257296 - DNA, 22 bp, Artificial Sequence
  chemically synthesized
caagaaaatattatgttaacta

SEQ ID NO: 1257297 - DNA, 22 bp, Artificial Sequence
  chemically synthesized
cttcaagaaaatattatgttaa

SEQ ID NO: 1257298 - DNA, 22 bp, Artificial Sequence
  chemically synthesized
ttacttcaagaaaatattatgt

SEQ ID NO: 1257299 - DNA, 22 bp, Artificial Sequence
  chemically synthesized
ctgttacttcaagaaaatatta

SEQ ID NO: 1257300 - DNA, 22 bp, Artificial Sequence
  chemically synthesized
tactgttacttcaagaaaatat

SEQ ID NO: 1257301 - DNA, 22 bp, Artificial Sequence
  chemically synthesized
tctactgttacttcaagaaaat

SEQ ID NO: 1257302 - DNA, 22 bp, Artificial Sequence
  chemically synthesized
actctctactgttacttcaaga

SEQ ID NO: 1257303 - DNA, 22 bp, Artificial Sequence
  chemically synthesized
acataatattttcttgaagtaa

SEQ ID NO: 1257304 - DNA, 22 bp, Artificial Sequence
  chemically synthesized
gactctctactgttacttcaag

SEQ ID NO: 1257305 - DNA, 22 bp, Artificial Sequence
  chemically synthesized
caaggcttgactctctactgtt

SEQ ID NO: 1257306 - DNA, 22 bp, Artificial Sequence
  chemically synthesized
tcttgaagtaacagtagagagt

SEQ ID NO: 1257307 - DNA, 22 bp, Artificial Sequence
  chemically synthesized
ctacaaggcttgactctctact

SEQ ID NO: 1257308 - DNA, 22 bp, Artificial Sequence
  chemically synthesized
cttgaagtaacagtagagagtc

SEQ ID NO: 1257309 - DNA, 22 bp, Artificial Sequence
  chemically synthesized
ttgaagtaacagtagagagtca

SEQ ID NO: 1257310 - DNA, 22 bp, Artificial Sequence
  chemically synthesized
tcctacaaggcttgactctcta

SEQ ID NO: 1257311 - DNA, 22 bp, Artificial Sequence
  chemically synthesized
gaagtaacagtagagagtcaag

SEQ ID NO: 1257312 - DNA, 22 bp, Artificial Sequence
  chemically synthesized
aagtaacagtagagagtcaagc

SEQ ID NO: 1257313 - DNA, 22 bp, Artificial Sequence
  chemically synthesized
ttctcctacaaggcttgactct

SEQ ID NO: 1257314 - DNA, 22 bp, Artificial Sequence
  chemically synthesized
gtagaaaatatctgttctccta

SEQ ID NO: 1257315 - DNA, 22 bp, Artificial Sequence
  chemically synthesized
ggtagaaaatatctgttctcct

SEQ ID NO: 1257316 - DNA, 22 bp, Artificial Sequence
  chemically synthesized
agacttggtagaaaatatctgt

SEQ ID NO: 1257317 - DNA, 22 bp, Artificial Sequence
  chemically synthesized
gtaggagaacagatattttcta

SEQ ID NO: 1257318 - DNA, 22 bp, Artificial Sequence
  chemically synthesized
taggagaacagatattttctac

SEQ ID NO: 1257319 - DNA, 22 bp, Artificial Sequence
  chemically synthesized
agctgagacttggtagaaaata

SEQ ID NO: 1257320 - DNA, 22 bp, Artificial Sequence
  chemically synthesized
agtaacagactaagctgagact

SEQ ID NO: 1257321 - DNA, 22 bp, Artificial Sequence
  chemically synthesized
tctaccaagtctcagcttagtc

SEQ ID NO: 1257322 - DNA, 22 bp, Artificial Sequence
  chemically synthesized
ctaccaagtctcagcttagtct

SEQ ID NO: 1257323 - DNA, 22 bp, Artificial Sequence
  chemically synthesized
taccaagtctcagcttagtctg

SEQ ID NO: 1257324 - DNA, 22 bp, Artificial Sequence
  chemically synthesized
ccaagtctcagcttagtctgtt

SEQ ID NO: 1257325 - DNA, 22 bp, Artificial Sequence
  chemically synthesized
tggcaagaaaactgagtaacag

SEQ ID NO: 1257326 - DNA, 22 bp, Artificial Sequence
  chemically synthesized
agcttagtctgttactcagttt

SEQ ID NO: 1257327 - DNA, 22 bp, Artificial Sequence
  chemically synthesized
agtctgttactcagttttcttg

SEQ ID NO: 1257328 - DNA, 22 bp, Artificial Sequence
  chemically synthesized
gtctgttactcagttttcttgc

SEQ ID NO: 1257329 - DNA, 22 bp, Artificial Sequence
  chemically synthesized
cagagtactatggcaagaaaac

SEQ ID NO: 1257330 - DNA, 22 bp, Artificial Sequence
  chemically synthesized
ttactcagttttcttgccatag

SEQ ID NO: 1257331 - DNA, 22 bp, Artificial Sequence
  chemically synthesized
ctcagttttcttgccatagtac

SEQ ID NO: 1257332 - DNA, 22 bp, Artificial Sequence
  chemically synthesized
agcatgttgcagagtactatgg

SEQ ID NO: 1257333 - DNA, 22 bp, Artificial Sequence
  chemically synthesized
agttttcttgccatagtactct

SEQ ID NO: 1257334 - DNA, 22 bp, Artificial Sequence
  chemically synthesized
tcttgccatagtactctgcaac

SEQ ID NO: 1257335 - DNA, 22 bp, Artificial Sequence
  chemically synthesized
cttgccatagtactctgcaaca

SEQ ID NO: 1257336 - DNA, 22 bp, Artificial Sequence
  chemically synthesized
ttgccatagtactctgcaacat

SEQ ID NO: 1257337 - DNA, 22 bp, Artificial Sequence
  chemically synthesized
gccatagtactctgcaacatgc

SEQ ID NO: 1257338 - DNA, 22 bp, Artificial Sequence
  chemically synthesized
ccatagtactctgcaacatgct

SEQ ID NO: 1257339 - DNA, 22 bp, Artificial Sequence
  chemically synthesized
caaaaaccgtggattcagcatg

SEQ ID NO: 1257340 - DNA, 22 bp, Artificial Sequence
  chemically synthesized
tacaaaaaccgtggattcagca

SEQ ID NO: 1257341 - DNA, 22 bp, Artificial Sequence
  chemically synthesized
ctacaaaaaccgtggattcagc

SEQ ID NO: 1257342 - DNA, 22 bp, Artificial Sequence
  chemically synthesized
tgcaacatgctgaatccacggt

SEQ ID NO: 1257343 - DNA, 22 bp, Artificial Sequence
  chemically synthesized
caacatgctgaatccacggttt

SEQ ID NO: 1257344 - DNA, 22 bp, Artificial Sequence
  chemically synthesized
tggacgcatttctacaaaaacc

SEQ ID NO: 1257345 - DNA, 22 bp, Artificial Sequence
  chemically synthesized
gtggacgcatttctacaaaaac

SEQ ID NO: 1257346 - DNA, 22 bp, Artificial Sequence
  chemically synthesized
tgtggacgcatttctacaaaaa

SEQ ID NO: 1257347 - DNA, 22 bp, Artificial Sequence
  chemically synthesized
aatccacggtttttgtagaaat

SEQ ID NO: 1257348 - DNA, 22 bp, Artificial Sequence
  chemically synthesized
atggcataaattttgtggacgc

SEQ ID NO: 1257349 - DNA, 22 bp, Artificial Sequence
  chemically synthesized
ttgtagaaatgcgtccacaaaa

SEQ ID NO: 1257350 - DNA, 22 bp, Artificial Sequence
  chemically synthesized
tgtagaaatgcgtccacaaaat

SEQ ID NO: 1257351 - DNA, 22 bp, Artificial Sequence
  chemically synthesized
gtagaaatgcgtccacaaaatt

SEQ ID NO: 1257352 - DNA, 22 bp, Artificial Sequence
  chemically synthesized
tagaaatgcgtccacaaaattt

SEQ ID NO: 1257353 - DNA, 22 bp, Artificial Sequence
  chemically synthesized
cattcatggcataaattttgtg

SEQ ID NO: 1257354 - DNA, 22 bp, Artificial Sequence
  chemically synthesized
ttgcattcatggcataaatttt

SEQ ID NO: 1257355 - DNA, 22 bp, Artificial Sequence
  chemically synthesized
gttgcattcatggcataaattt

SEQ ID NO: 1257356 - DNA, 22 bp, Artificial Sequence
  chemically synthesized
tgttgcattcatggcataaatt

SEQ ID NO: 1257357 - DNA, 22 bp, Artificial Sequence
  chemically synthesized
ttgttgcattcatggcataaat

SEQ ID NO: 1257358 - DNA, 22 bp, Artificial Sequence
  chemically synthesized
tttgttgcattcatggcataaa

SEQ ID NO: 1257359 - DNA, 22 bp, Artificial Sequence
  chemically synthesized
ttttgttgcattcatggcataa

SEQ ID NO: 1257360 - DNA, 22 bp, Artificial Sequence
  chemically synthesized
cttttttgttgcattcatggca

SEQ ID NO: 1257361 - DNA, 22 bp, Artificial Sequence
  chemically synthesized
atgccatgaatgcaacaaaaaa

SEQ ID NO: 1257362 - DNA, 22 bp, Artificial Sequence
  chemically synthesized
tgccatgaatgcaacaaaaaag

SEQ ID NO: 1257363 - DNA, 22 bp, Artificial Sequence
  chemically synthesized
gatgtgtgtactgcttttttgt

SEQ ID NO: 1257364 - DNA, 22 bp, Artificial Sequence
  chemically synthesized
ctggatgtgtgtactgcttttt

SEQ ID NO: 1257365 - DNA, 22 bp, Artificial Sequence
  chemically synthesized
actggatgtgtgtactgctttt

SEQ ID NO: 1257366 - DNA, 22 bp, Artificial Sequence
  chemically synthesized
ttactggatgtgtgtactgctt

SEQ ID NO: 1257367 - DNA, 22 bp, Artificial Sequence
  chemically synthesized
cttactggatgtgtgtactgct

SEQ ID NO: 1257368 - DNA, 22 bp, Artificial Sequence
  chemically synthesized
aatttcttactggatgtgtgta

SEQ ID NO: 1257369 - DNA, 22 bp, Artificial Sequence
  chemically synthesized
aattcaatttcttactggatgt

SEQ ID NO: 1257370 - DNA, 22 bp, Artificial Sequence
  chemically synthesized
attgaattcaatttcttactgg

SEQ ID NO: 1257371 - DNA, 22 bp, Artificial Sequence
  chemically synthesized
ctgattgaattcaatttcttac

SEQ ID NO: 1257372 - DNA, 22 bp, Artificial Sequence
  chemically synthesized
tctactgattgaattcaatttc

SEQ ID NO: 1257373 - DNA, 22 bp, Artificial Sequence
  chemically synthesized
atctactgattgaattcaattt

SEQ ID NO: 1257374 - DNA, 22 bp, Artificial Sequence
  chemically synthesized
gccaagcttatctactgattga

SEQ ID NO: 1257375 - DNA, 22 bp, Artificial Sequence
  chemically synthesized
ggccaagcttatctactgattg

SEQ ID NO: 1257376 - DNA, 22 bp, Artificial Sequence
  chemically synthesized
aattcaatcagtagataagctt

SEQ ID NO: 1257377 - DNA, 22 bp, Artificial Sequence
  chemically synthesized
aaatatttggccaagcttatct

SEQ ID NO: 1257378 - DNA, 22 bp, Artificial Sequence
  chemically synthesized
caaatatttggccaagcttatc

SEQ ID NO: 1257379 - DNA, 22 bp, Artificial Sequence
  chemically synthesized
aatcagtagataagcttggcca

SEQ ID NO: 1257380 - DNA, 22 bp, Artificial Sequence
  chemically synthesized
agtttcaaatatttggccaagc

SEQ ID NO: 1257381 - DNA, 22 bp, Artificial Sequence
  chemically synthesized
gagtttcaaatatttggccaag

SEQ ID NO: 1257382 - DNA, 22 bp, Artificial Sequence
  chemically synthesized
tgagtttcaaatatttggccaa

SEQ ID NO: 1257383 - DNA, 22 bp, Artificial Sequence
  chemically synthesized
ttgagtttcaaatatttggcca

SEQ ID NO: 1257384 - DNA, 22 bp, Artificial Sequence
  chemically synthesized
gtttttgagtttcaaatatttg

SEQ ID NO: 1257385 - DNA, 22 bp, Artificial Sequence
  chemically synthesized
agtttttgagtttcaaatattt

SEQ ID NO: 1257386 - DNA, 22 bp, Artificial Sequence
  chemically synthesized
atgatttagtttttgagtttca

SEQ ID NO: 1257387 - DNA, 22 bp, Artificial Sequence
  chemically synthesized
ggccaaatatttgaaactcaaa

SEQ ID NO: 1257388 - DNA, 22 bp, Artificial Sequence
  chemically synthesized
gccaaatatttgaaactcaaaa

SEQ ID NO: 1257389 - DNA, 22 bp, Artificial Sequence
  chemically synthesized
cacaattaatgatttagttttt

SEQ ID NO: 1257390 - DNA, 22 bp, Artificial Sequence
  chemically synthesized
gcacaattaatgatttagtttt

SEQ ID NO: 1257391 - DNA, 22 bp, Artificial Sequence
  chemically synthesized
tgcacaattaatgatttagttt

SEQ ID NO: 1257392 - DNA, 22 bp, Artificial Sequence
  chemically synthesized
ttgcacaattaatgatttagtt

SEQ ID NO: 1257393 - DNA, 22 bp, Artificial Sequence
  chemically synthesized
gaaactcaaaaactaaatcatt

SEQ ID NO: 1257394 - DNA, 22 bp, Artificial Sequence
  chemically synthesized
aaactcaaaaactaaatcatta

SEQ ID NO: 1257395 - DNA, 22 bp, Artificial Sequence
  chemically synthesized
cttttgcacaattaatgattta

SEQ ID NO: 1257396 - DNA, 22 bp, Artificial Sequence
  chemically synthesized
acttttgcacaattaatgattt

SEQ ID NO: 1257397 - DNA, 22 bp, Artificial Sequence
  chemically synthesized
tacttttgcacaattaatgatt

SEQ ID NO: 1257398 - DNA, 22 bp, Artificial Sequence
  chemically synthesized
tttacttttgcacaattaatga

SEQ ID NO: 1257399 - DNA, 22 bp, Artificial Sequence
  chemically synthesized
ctttacttttgcacaattaatg

SEQ ID NO: 1257400 - DNA, 22 bp, Artificial Sequence
  chemically synthesized
aaaaactaaatcattaattgtg

SEQ ID NO: 1257401 - DNA, 22 bp, Artificial Sequence
  chemically synthesized
tctttacttttgcacaattaat

SEQ ID NO: 1257402 - DNA, 22 bp, Artificial Sequence
  chemically synthesized
ttctttacttttgcacaattaa

SEQ ID NO: 1257403 - DNA, 22 bp, Artificial Sequence
  chemically synthesized
tttctttacttttgcacaatta

SEQ ID NO: 1257404 - DNA, 22 bp, Artificial Sequence
  chemically synthesized
aatcattaattgtgcaaaagta

SEQ ID NO: 1257405 - DNA, 22 bp, Artificial Sequence
  chemically synthesized
ccactttttctttacttttgca

SEQ ID NO: 1257406 - DNA, 22 bp, Artificial Sequence
  chemically synthesized
cccactttttctttacttttgc

SEQ ID NO: 1257407 - DNA, 22 bp, Artificial Sequence
  chemically synthesized
gtttcccactttttctttactt

SEQ ID NO: 1257408 - DNA, 22 bp, Artificial Sequence
  chemically synthesized
cgtttcccactttttctttact

SEQ ID NO: 1257409 - DNA, 22 bp, Artificial Sequence
  chemically synthesized
attgtgcaaaagtaaagaaaaa

SEQ ID NO: 1257410 - DNA, 22 bp, Artificial Sequence
  chemically synthesized
atttcgtttcccactttttctt

SEQ ID NO: 1257411 - DNA, 22 bp, Artificial Sequence
  chemically synthesized
tgcaaaagtaaagaaaaagtgg

SEQ ID NO: 1257412 - DNA, 22 bp, Artificial Sequence
  chemically synthesized
cattaatttcgtttcccacttt

SEQ ID NO: 1257413 - DNA, 22 bp, Artificial Sequence
  chemically synthesized
acattaatttcgtttcccactt

SEQ ID NO: 1257414 - DNA, 22 bp, Artificial Sequence
  chemically synthesized
tacattaatttcgtttcccact

SEQ ID NO: 1257415 - DNA, 22 bp, Artificial Sequence
  chemically synthesized
gaatattttacattaatttcgt

SEQ ID NO: 1257416 - DNA, 22 bp, Artificial Sequence
  chemically synthesized
ggaatattttacattaatttcg

SEQ ID NO: 1257417 - DNA, 22 bp, Artificial Sequence
  chemically synthesized
tggaatattttacattaatttc

SEQ ID NO: 1257418 - DNA, 22 bp, Artificial Sequence
  chemically synthesized
aaaatagtaagaatgttttgga

SEQ ID NO: 1257419 - DNA, 22 bp, Artificial Sequence
  chemically synthesized
atgtaaaatattccaaaacatt

SEQ ID NO: 1257420 - DNA, 22 bp, Artificial Sequence
  chemically synthesized
gttaaaaatagtaagaatgttt

SEQ ID NO: 1257421 - DNA, 22 bp, Artificial Sequence
  chemically synthesized
agttaaaaatagtaagaatgtt

SEQ ID NO: 1257422 - DNA, 22 bp, Artificial Sequence
  chemically synthesized
ttagttaaaaatagtaagaatg

SEQ ID NO: 1257423 - DNA, 22 bp, Artificial Sequence
  chemically synthesized
cttagttaaaaatagtaagaat

SEQ ID NO: 1257424 - DNA, 22 bp, Artificial Sequence
  chemically synthesized
tcttagttaaaaatagtaagaa

SEQ ID NO: 1257425 - DNA, 22 bp, Artificial Sequence
  chemically synthesized
caaaacattcttactattttta

SEQ ID NO: 1257426 - DNA, 22 bp, Artificial Sequence
  chemically synthesized
ttactatttttaactaagaaag

SEQ ID NO: 1257427 - DNA, 22 bp, Artificial Sequence
  chemically synthesized
actatttttaactaagaaagca

SEQ ID NO: 1257428 - DNA, 22 bp, Artificial Sequence
  chemically synthesized
ctatttttaactaagaaagcat

SEQ ID NO: 1257429 - DNA, 22 bp, Artificial Sequence
  chemically synthesized
tttttaactaagaaagcatatt

SEQ ID NO: 1257430 - DNA, 22 bp, Artificial Sequence
  chemically synthesized
cagacatcagtaaaatatgctt

SEQ ID NO: 1257431 - DNA, 22 bp, Artificial Sequence
  chemically synthesized
gcagacatcagtaaaatatgct

SEQ ID NO: 1257432 - DNA, 22 bp, Artificial Sequence
  chemically synthesized
ttaactaagaaagcatatttta

SEQ ID NO: 1257433 - DNA, 22 bp, Artificial Sequence
  chemically synthesized
taactaagaaagcatattttac

SEQ ID NO: 1257434 - DNA, 22 bp, Artificial Sequence
  chemically synthesized
aactaagaaagcatattttact

SEQ ID NO: 1257435 - DNA, 22 bp, Artificial Sequence
  chemically synthesized
actaagaaagcatattttactg

SEQ ID NO: 1257436 - DNA, 22 bp, Artificial Sequence
  chemically synthesized
agaaagcatattttactgatgt

SEQ ID NO: 1257437 - DNA, 22 bp, Artificial Sequence
  chemically synthesized
tactgatgtctgcaagcctttt

SEQ ID NO: 1257438 - DNA, 22 bp, Artificial Sequence
  chemically synthesized
actgatgtctgcaagccttttg

SEQ ID NO: 1257439 - DNA, 22 bp, Artificial Sequence
  chemically synthesized
ctgatgtctgcaagccttttgt

SEQ ID NO: 1257440 - DNA, 22 bp, Artificial Sequence
  chemically synthesized
aaagagtgaagaacaaaaggct

SEQ ID NO: 1257441 - DNA, 22 bp, Artificial Sequence
  chemically synthesized
atgtctgcaagccttttgttct

SEQ ID NO: 1257442 - DNA, 22 bp, Artificial Sequence
  chemically synthesized
gagaattgaaagagtgaagaac

SEQ ID NO: 1257443 - DNA, 22 bp, Artificial Sequence
  chemically synthesized
caagccttttgttcttcactct

SEQ ID NO: 1257444 - DNA, 22 bp, Artificial Sequence
  chemically synthesized
ttgttcttcactctttcaattc

SEQ ID NO: 1257445 - DNA, 22 bp, Artificial Sequence
  chemically synthesized
tgttcttcactctttcaattct

SEQ ID NO: 1257446 - DNA, 22 bp, Artificial Sequence
  chemically synthesized
gttcttcactctttcaattctc

SEQ ID NO: 1257447 - DNA, 22 bp, Artificial Sequence
  chemically synthesized
ttcttcactctttcaattctct

SEQ ID NO: 1257448 - DNA, 22 bp, Artificial Sequence
  chemically synthesized
ttcactctttcaattctctaat

SEQ ID NO: 1257449 - DNA, 22 bp, Artificial Sequence
  chemically synthesized
cactctttcaattctctaatcc

SEQ ID NO: 1257450 - DNA, 22 bp, Artificial Sequence
  chemically synthesized
actctttcaattctctaatcct

SEQ ID NO: 1257451 - DNA, 22 bp, Artificial Sequence
  chemically synthesized
tttcaattctctaatcctgcca

SEQ ID NO: 1257452 - DNA, 22 bp, Artificial Sequence
  chemically synthesized
tcaattctctaatcctgccatc

SEQ ID NO: 1257453 - DNA, 22 bp, Artificial Sequence
  chemically synthesized
caattctctaatcctgccatcc

SEQ ID NO: 1257454 - DNA, 22 bp, Artificial Sequence
  chemically synthesized
aattctctaatcctgccatcca

SEQ ID NO: 1257455 - DNA, 22 bp, Artificial Sequence
  chemically synthesized
tctaatcctgccatccacccca

SEQ ID NO: 1257456 - DNA, 22 bp, Artificial Sequence
  chemically synthesized
taatcctgccatccaccccata

SEQ ID NO: 1257457 - DNA, 22 bp, Artificial Sequence
  chemically synthesized
atcctgccatccaccccatatc

SEQ ID NO: 1257458 - DNA, 22 bp, Artificial Sequence
  chemically synthesized
caaatgaaagaaagatatgggg

SEQ ID NO: 1257459 - DNA, 22 bp, Artificial Sequence
  chemically synthesized
ccatccaccccatatctttctt

SEQ ID NO: 1257460 - DNA, 22 bp, Artificial Sequence
  chemically synthesized
taaaccaaaattccaaatgaaa

SEQ ID NO: 1257461 - DNA, 22 bp, Artificial Sequence
  chemically synthesized
agtgttgtaaaccaaaattcca

SEQ ID NO: 1257462 - DNA, 22 bp, Artificial Sequence
  chemically synthesized
tctttcatttggaattttggtt

SEQ ID NO: 1257463 - DNA, 22 bp, Artificial Sequence
  chemically synthesized
ctttcatttggaattttggttt

SEQ ID NO: 1257464 - DNA, 22 bp, Artificial Sequence
  chemically synthesized
tttcatttggaattttggttta

SEQ ID NO: 1257465 - DNA, 22 bp, Artificial Sequence
  chemically synthesized
caactgagtgttgtaaaccaaa

SEQ ID NO: 1257466 - DNA, 22 bp, Artificial Sequence
  chemically synthesized
tcatttggaattttggtttaca

SEQ ID NO: 1257467 - DNA, 22 bp, Artificial Sequence
  chemically synthesized
catttggaattttggtttacaa

SEQ ID NO: 1257468 - DNA, 22 bp, Artificial Sequence
  chemically synthesized
atttggaattttggtttacaac

SEQ ID NO: 1257469 - DNA, 22 bp, Artificial Sequence
  chemically synthesized
agtctacaactgagtgttgtaa

SEQ ID NO: 1257470 - DNA, 22 bp, Artificial Sequence
  chemically synthesized
ggaattttggtttacaacactc

SEQ ID NO: 1257471 - DNA, 22 bp, Artificial Sequence
  chemically synthesized
gaattttggtttacaacactca

SEQ ID NO: 1257472 - DNA, 22 bp, Artificial Sequence
  chemically synthesized
tggtttacaacactcagttgta

SEQ ID NO: 1257473 - DNA, 22 bp, Artificial Sequence
  chemically synthesized
tatgcctgagtctacaactgag

SEQ ID NO: 1257474 - DNA, 22 bp, Artificial Sequence
  chemically synthesized
ggtttacaacactcagttgtag

SEQ ID NO: 1257475 - DNA, 22 bp, Artificial Sequence
  chemically synthesized
gtttacaacactcagttgtaga

SEQ ID NO: 1257476 - DNA, 22 bp, Artificial Sequence
  chemically synthesized
acaacactcagttgtagactca

SEQ ID NO: 1257477 - DNA, 22 bp, Artificial Sequence
  chemically synthesized
caacactcagttgtagactcag

SEQ ID NO: 1257478 - DNA, 22 bp, Artificial Sequence
  chemically synthesized
aaacacaagttatatgcctgag

SEQ ID NO: 1257479 - DNA, 22 bp, Artificial Sequence
  chemically synthesized
agttgtagactcaggcatataa

SEQ ID NO: 1257480 - DNA, 22 bp, Artificial Sequence
  chemically synthesized
tagactcaggcatataacttgt

SEQ ID NO: 1257481 - DNA, 22 bp, Artificial Sequence
  chemically synthesized
aggcatataacttgtgttttag

SEQ ID NO: 1257482 - DNA, 22 bp, Artificial Sequence
  chemically synthesized
tgcaaaggaataagactaaaac

SEQ ID NO: 1257483 - DNA, 22 bp, Artificial Sequence
  chemically synthesized
gtgcaaaggaataagactaaaa

SEQ ID NO: 1257484 - DNA, 22 bp, Artificial Sequence
  chemically synthesized
tgtgcaaaggaataagactaaa

SEQ ID NO: 1257485 - DNA, 22 bp, Artificial Sequence
  chemically synthesized
tctttgtgcaaaggaataagac

SEQ ID NO: 1257486 - DNA, 22 bp, Artificial Sequence
  chemically synthesized
gtctttgtgcaaaggaataaga

SEQ ID NO: 1257487 - DNA, 22 bp, Artificial Sequence
  chemically synthesized
tgtctttgtgcaaaggaataag

SEQ ID NO: 1257488 - DNA, 22 bp, Artificial Sequence
  chemically synthesized
gtgttttagtcttattcctttg

SEQ ID NO: 1257489 - DNA, 22 bp, Artificial Sequence
  chemically synthesized
tgttttagtcttattcctttgc

SEQ ID NO: 1257490 - DNA, 22 bp, Artificial Sequence
  chemically synthesized
tgtattttgtctttgtgcaaag

SEQ ID NO: 1257491 - DNA, 22 bp, Artificial Sequence
  chemically synthesized
tagtcttattcctttgcacaaa

SEQ ID NO: 1257492 - DNA, 22 bp, Artificial Sequence
  chemically synthesized
agtcttattcctttgcacaaag

SEQ ID NO: 1257493 - DNA, 22 bp, Artificial Sequence
  chemically synthesized
gtcttattcctttgcacaaaga

SEQ ID NO: 1257494 - DNA, 22 bp, Artificial Sequence
  chemically synthesized
tctatgtattttgtctttgtgc

SEQ ID NO: 1257495 - DNA, 22 bp, Artificial Sequence
  chemically synthesized
attcctttgcacaaagacaaaa

SEQ ID NO: 1257496 - DNA, 22 bp, Artificial Sequence
  chemically synthesized
ttcctttgcacaaagacaaaat

SEQ ID NO: 1257497 - DNA, 22 bp, Artificial Sequence
  chemically synthesized
ctttgcacaaagacaaaataca

SEQ ID NO: 1257498 - DNA, 22 bp, Artificial Sequence
  chemically synthesized
tgcacaaagacaaaatacatag

SEQ ID NO: 1257499 - DNA, 22 bp, Artificial Sequence
  chemically synthesized
gcacaaagacaaaatacataga

SEQ ID NO: 1257500 - DNA, 22 bp, Artificial Sequence
  chemically synthesized
cacaaagacaaaatacatagac

SEQ ID NO: 1257501 - DNA, 22 bp, Artificial Sequence
  chemically synthesized
atcaatgtgtcctgtctatgta

SEQ ID NO: 1257502 - DNA, 22 bp, Artificial Sequence
  chemically synthesized
tgatcaatgtgtcctgtctatg

SEQ ID NO: 1257503 - DNA, 22 bp, Artificial Sequence
  chemically synthesized
ctgatcaatgtgtcctgtctat

SEQ ID NO: 1257504 - DNA, 22 bp, Artificial Sequence
  chemically synthesized
tctgatcaatgtgtcctgtcta

SEQ ID NO: 1257505 - DNA, 22 bp, Artificial Sequence
  chemically synthesized
gttttctgatcaatgtgtcctg

SEQ ID NO: 1257506 - DNA, 22 bp, Artificial Sequence
  chemically synthesized
tggttttctgatcaatgtgtcc

SEQ ID NO: 1257507 - DNA, 22 bp, Artificial Sequence
  chemically synthesized
ctggttttctgatcaatgtgtc

SEQ ID NO: 1257508 - DNA, 22 bp, Artificial Sequence
  chemically synthesized
tttctggttttctgatcaatgt

SEQ ID NO: 1257509 - DNA, 22 bp, Artificial Sequence
  chemically synthesized
gaaatagattatttctggtttt

SEQ ID NO: 1257510 - DNA, 22 bp, Artificial Sequence
  chemically synthesized
agaaatagattatttctggttt

SEQ ID NO: 1257511 - DNA, 22 bp, Artificial Sequence
  chemically synthesized
tagaaatagattatttctggtt

SEQ ID NO: 1257512 - DNA, 22 bp, Artificial Sequence
  chemically synthesized
atcagaaaaccagaaataatct

SEQ ID NO: 1257513 - DNA, 22 bp, Artificial Sequence
  chemically synthesized
gaaattttagaaatagattatt

SEQ ID NO: 1257514 - DNA, 22 bp, Artificial Sequence
  chemically synthesized
tgtcagggattagaaattttag

SEQ ID NO: 1257515 - DNA, 22 bp, Artificial Sequence
  chemically synthesized
atgtcagggattagaaatttta

SEQ ID NO: 1257516 - DNA, 22 bp, Artificial Sequence
  chemically synthesized
tttctaaaatttctaatccctg

SEQ ID NO: 1257517 - DNA, 22 bp, Artificial Sequence
  chemically synthesized
atacatttatgtcagggattag

SEQ ID NO: 1257518 - DNA, 22 bp, Artificial Sequence
  chemically synthesized
gatacatttatgtcagggatta

SEQ ID NO: 1257519 - DNA, 22 bp, Artificial Sequence
  chemically synthesized
tgatacatttatgtcagggatt

SEQ ID NO: 1257520 - DNA, 22 bp, Artificial Sequence
  chemically synthesized
ctaaaatttctaatccctgaca

SEQ ID NO: 1257521 - DNA, 22 bp, Artificial Sequence
  chemically synthesized
taaaatttctaatccctgacat

SEQ ID NO: 1257522 - DNA, 22 bp, Artificial Sequence
  chemically synthesized
aaatttctaatccctgacataa

SEQ ID NO: 1257523 - DNA, 22 bp, Artificial Sequence
  chemically synthesized
tgtgattttgatacatttatgt

SEQ ID NO: 1257524 - DNA, 22 bp, Artificial Sequence
  chemically synthesized
ctaatccctgacataaatgtat

SEQ ID NO: 1257525 - DNA, 22 bp, Artificial Sequence
  chemically synthesized
taatccctgacataaatgtatc

SEQ ID NO: 1257526 - DNA, 22 bp, Artificial Sequence
  chemically synthesized
ttgtgtgattttgatacattta

SEQ ID NO: 1257527 - DNA, 22 bp, Artificial Sequence
  chemically synthesized
atccctgacataaatgtatcaa

SEQ ID NO: 1257528 - DNA, 22 bp, Artificial Sequence
  chemically synthesized
aattattgtgtgattttgatac

SEQ ID NO: 1257529 - DNA, 22 bp, Artificial Sequence
  chemically synthesized
ttaaattattgtgtgattttga

SEQ ID NO: 1257530 - DNA, 22 bp, Artificial Sequence
  chemically synthesized
acataaatgtatcaaaatcaca

SEQ ID NO: 1257531 - DNA, 22 bp, Artificial Sequence
  chemically synthesized
tattaaattattgtgtgatttt

SEQ ID NO: 1257532 - DNA, 22 bp, Artificial Sequence
  chemically synthesized
attctattaaattattgtgtga

SEQ ID NO: 1257533 - DNA, 22 bp, Artificial Sequence
  chemically synthesized
tcattctattaaattattgtgt

SEQ ID NO: 1257534 - DNA, 22 bp, Artificial Sequence
  chemically synthesized
aatagaatgagaattgcacaca

SEQ ID NO: 1257535 - DNA, 22 bp, Artificial Sequence
  chemically synthesized
atagaatgagaattgcacacac

SEQ ID NO: 1257536 - DNA, 22 bp, Artificial Sequence
  chemically synthesized
tgccgcgtgtgtgtgtgtgcaa

SEQ ID NO: 1257537 - DNA, 22 bp, Artificial Sequence
  chemically synthesized
ttgtgccgcgtgtgtgtgtgtg

SEQ ID NO: 1257538 - DNA, 22 bp, Artificial Sequence
  chemically synthesized
attgtgccgcgtgtgtgtgtgt

SEQ ID NO: 1257539 - DNA, 22 bp, Artificial Sequence
  chemically synthesized
tattgtgccgcgtgtgtgtgtg

SEQ ID NO: 1257540 - DNA, 22 bp, Artificial Sequence
  chemically synthesized
ggttttattgtgccgcgtgtgt

SEQ ID NO: 1257541 - DNA, 22 bp, Artificial Sequence
  chemically synthesized
gggttttattgtgccgcgtgtg

SEQ ID NO: 1257542 - DNA, 22 bp, Artificial Sequence
  chemically synthesized
cacacacacacacgcggcacaa

SEQ ID NO: 1257543 - DNA, 22 bp, Artificial Sequence
  chemically synthesized
ccttgggttttattgtgccgcg

SEQ ID NO: 1257544 - DNA, 22 bp, Artificial Sequence
  chemically synthesized
accttgggttttattgtgccgc

SEQ ID NO: 1257545 - DNA, 22 bp, Artificial Sequence
  chemically synthesized
gtttaccttgggttttattgtg

SEQ ID NO: 1257546 - DNA, 22 bp, Artificial Sequence
  chemically synthesized
ggtttaccttgggttttattgt

SEQ ID NO: 1257547 - DNA, 22 bp, Artificial Sequence
  chemically synthesized
tggtttaccttgggttttattg

SEQ ID NO: 1257548 - DNA, 22 bp, Artificial Sequence
  chemically synthesized
tgctttggtttaccttgggttt

SEQ ID NO: 1257549 - DNA, 22 bp, Artificial Sequence
  chemically synthesized
ttgtgctttggtttaccttggg

SEQ ID NO: 1257550 - DNA, 22 bp, Artificial Sequence
  chemically synthesized
gttgtgctttggtttaccttgg

SEQ ID NO: 1257551 - DNA, 22 bp, Artificial Sequence
  chemically synthesized
agaaggacatttgttgtgcttt

SEQ ID NO: 1257552 - DNA, 22 bp, Artificial Sequence
  chemically synthesized
ttcagaaggacatttgttgtgc

SEQ ID NO: 1257553 - DNA, 22 bp, Artificial Sequence
  chemically synthesized
gttcagaaggacatttgttgtg

SEQ ID NO: 1257554 - DNA, 22 bp, Artificial Sequence
  chemically synthesized
tgttcagaaggacatttgttgt

SEQ ID NO: 1257555 - DNA, 22 bp, Artificial Sequence
  chemically synthesized
ttgttcagaaggacatttgttg

SEQ ID NO: 1257556 - DNA, 22 bp, Artificial Sequence
  chemically synthesized
tttgttcagaaggacatttgtt

SEQ ID NO: 1257557 - DNA, 22 bp, Artificial Sequence
  chemically synthesized
gaaaacctttttgttcagaagg

SEQ ID NO: 1257558 - DNA, 22 bp, Artificial Sequence
  chemically synthesized
tctggaaaacctttttgttcag

SEQ ID NO: 1257559 - DNA, 22 bp, Artificial Sequence
  chemically synthesized
agctgtctggaaaacctttttg

SEQ ID NO: 1257560 - DNA, 22 bp, Artificial Sequence
  chemically synthesized
tcagctgtctggaaaacctttt

SEQ ID NO: 1257561 - DNA, 22 bp, Artificial Sequence
  chemically synthesized
ctgaacaaaaaggttttccaga

SEQ ID NO: 1257562 - DNA, 22 bp, Artificial Sequence
  chemically synthesized
tgaacaaaaaggttttccagac

SEQ ID NO: 1257563 - DNA, 22 bp, Artificial Sequence
  chemically synthesized
aacaaaaaggttttccagacag

SEQ ID NO: 1257564 - DNA, 22 bp, Artificial Sequence
  chemically synthesized
tcatccaaaggagtagctctca

SEQ ID NO: 1257565 - DNA, 22 bp, Artificial Sequence
  chemically synthesized
tccagacagctgagagctactc

SEQ ID NO: 1257566 - DNA, 22 bp, Artificial Sequence
  chemically synthesized
tgtcatccaaaggagtagctct

SEQ ID NO: 1257567 - DNA, 22 bp, Artificial Sequence
  chemically synthesized
ccagacagctgagagctactcc

SEQ ID NO: 1257568 - DNA, 22 bp, Artificial Sequence
  chemically synthesized
cagacagctgagagctactcct

SEQ ID NO: 1257569 - DNA, 22 bp, Artificial Sequence
  chemically synthesized
aggtgttctgtcatccaaagga

SEQ ID NO: 1257570 - DNA, 22 bp, Artificial Sequence
  chemically synthesized
agagctactcctttggatgaca

SEQ ID NO: 1257571 - DNA, 22 bp, Artificial Sequence
  chemically synthesized
ctcctttggatgacagaacacc

SEQ ID NO: 1257572 - DNA, 22 bp, Artificial Sequence
  chemically synthesized
atccagaagttgaggtgttctg

SEQ ID NO: 1257573 - DNA, 22 bp, Artificial Sequence
  chemically synthesized
catccagaagttgaggtgttct

SEQ ID NO: 1257574 - DNA, 22 bp, Artificial Sequence
  chemically synthesized
ctttggatgacagaacacctca

SEQ ID NO: 1257575 - DNA, 22 bp, Artificial Sequence
  chemically synthesized
tcatccagaagttgaggtgttc

SEQ ID NO: 1257576 - DNA, 22 bp, Artificial Sequence
  chemically synthesized
tggatgacagaacacctcaact

SEQ ID NO: 1257577 - DNA, 22 bp, Artificial Sequence
  chemically synthesized
ggatgacagaacacctcaactt

SEQ ID NO: 1257578 - DNA, 22 bp, Artificial Sequence
  chemically synthesized
gatgacagaacacctcaacttc

SEQ ID NO: 1257579 - DNA, 22 bp, Artificial Sequence
  chemically synthesized
atgtaaacctttcatccagaag

SEQ ID NO: 1257580 - DNA, 22 bp, Artificial Sequence
  chemically synthesized
catgtaaacctttcatccagaa

SEQ ID NO: 1257581 - DNA, 22 bp, Artificial Sequence
  chemically synthesized
tcatgtaaacctttcatccaga

SEQ ID NO: 1257582 - DNA, 22 bp, Artificial Sequence
  chemically synthesized
aacttctggatgaaaggtttac

SEQ ID NO: 1257583 - DNA, 22 bp, Artificial Sequence
  chemically synthesized
cataatcattttcatgtaaacc

SEQ ID NO: 1257584 - DNA, 22 bp, Artificial Sequence
  chemically synthesized
ctggatgaaaggtttacatgaa

SEQ ID NO: 1257585 - DNA, 22 bp, Artificial Sequence
  chemically synthesized
tggatgaaaggtttacatgaaa

SEQ ID NO: 1257586 - DNA, 22 bp, Artificial Sequence
  chemically synthesized
gatgaaaggtttacatgaaaat

SEQ ID NO: 1257587 - DNA, 22 bp, Artificial Sequence
  chemically synthesized
tcctacataatcattttcatgt

SEQ ID NO: 1257588 - DNA, 22 bp, Artificial Sequence
  chemically synthesized
acatgaaaatgattatgtagga

SEQ ID NO: 1257589 - DNA, 22 bp, Artificial Sequence
  chemically synthesized
catgaaaatgattatgtaggac

SEQ ID NO: 1257590 - DNA, 22 bp, Artificial Sequence
  chemically synthesized
tgtaggacagctctctttccct

SEQ ID NO: 1257591 - DNA, 22 bp, Artificial Sequence
  chemically synthesized
gacataccatacataagaaggg

SEQ ID NO: 1257592 - DNA, 22 bp, Artificial Sequence
  chemically synthesized
tgttagacataccatacataag

SEQ ID NO: 1257593 - DNA, 22 bp, Artificial Sequence
  chemically synthesized
tctttcccttcttatgtatggt

SEQ ID NO: 1257594 - DNA, 22 bp, Artificial Sequence
  chemically synthesized
tttcccttcttatgtatggtat

SEQ ID NO: 1257595 - DNA, 22 bp, Artificial Sequence
  chemically synthesized
tcccttcttatgtatggtatgt

SEQ ID NO: 1257596 - DNA, 22 bp, Artificial Sequence
  chemically synthesized
cccttcttatgtatggtatgtc

SEQ ID NO: 1257597 - DNA, 22 bp, Artificial Sequence
  chemically synthesized
ccttcttatgtatggtatgtct

SEQ ID NO: 1257598 - DNA, 22 bp, Artificial Sequence
  chemically synthesized
cttatgtatggtatgtctaaca

SEQ ID NO: 1257599 - DNA, 22 bp, Artificial Sequence
  chemically synthesized
ttatgtatggtatgtctaacat

SEQ ID NO: 1257600 - DNA, 22 bp, Artificial Sequence
  chemically synthesized
atgtatggtatgtctaacataa

SEQ ID NO: 1257601 - DNA, 22 bp, Artificial Sequence
  chemically synthesized
tgtatggtatgtctaacataat

SEQ ID NO: 1257602 - DNA, 22 bp, Artificial Sequence
  chemically synthesized
aatcatcaagaaaatattatgt

SEQ ID NO: 1257603 - DNA, 22 bp, Artificial Sequence
  chemically synthesized
accctaaatcatcaagaaaata

SEQ ID NO: 1257604 - DNA, 22 bp, Artificial Sequence
  chemically synthesized
taaccctaaatcatcaagaaaa

SEQ ID NO: 1257605 - DNA, 22 bp, Artificial Sequence
  chemically synthesized
acataatattttcttgatgatt

SEQ ID NO: 1257606 - DNA, 22 bp, Artificial Sequence
  chemically synthesized
acatcataattctaaccctaaa

SEQ ID NO: 1257607 - DNA, 22 bp, Artificial Sequence
  chemically synthesized
cacatcataattctaaccctaa

SEQ ID NO: 1257608 - DNA, 22 bp, Artificial Sequence
  chemically synthesized
tcttgatgatttagggttagaa

SEQ ID NO: 1257609 - DNA, 22 bp, Artificial Sequence
  chemically synthesized
cttgatgatttagggttagaat

SEQ ID NO: 1257610 - DNA, 22 bp, Artificial Sequence
  chemically synthesized
ttgatgatttagggttagaatt

SEQ ID NO: 1257611 - DNA, 22 bp, Artificial Sequence
  chemically synthesized
gatgatttagggttagaattat

SEQ ID NO: 1257612 - DNA, 22 bp, Artificial Sequence
  chemically synthesized
atgatttagggttagaattatg

SEQ ID NO: 1257613 - DNA, 22 bp, Artificial Sequence
  chemically synthesized
agggttagaattatgatgtgaa

SEQ ID NO: 1257614 - DNA, 22 bp, Artificial Sequence
  chemically synthesized
cacagtcatatcttcacatcat

SEQ ID NO: 1257615 - DNA, 22 bp, Artificial Sequence
  chemically synthesized
gggttagaattatgatgtgaag

SEQ ID NO: 1257616 - DNA, 22 bp, Artificial Sequence
  chemically synthesized
ccacagtcatatcttcacatca

SEQ ID NO: 1257617 - DNA, 22 bp, Artificial Sequence
  chemically synthesized
gaattatgatgtgaagatatga

SEQ ID NO: 1257618 - DNA, 22 bp, Artificial Sequence
  chemically synthesized
tgatgtgaagatatgactgtgg

SEQ ID NO: 1257619 - DNA, 22 bp, Artificial Sequence
  chemically synthesized
ggatcaatccttccacagtcat

SEQ ID NO: 1257620 - DNA, 22 bp, Artificial Sequence
  chemically synthesized
tggaaggattgatcccaggtac

SEQ ID NO: 1257621 - DNA, 22 bp, Artificial Sequence
  chemically synthesized
ggggtgaacatccacatgtacc

SEQ ID NO: 1257622 - DNA, 22 bp, Artificial Sequence
  chemically synthesized
taggggtgaacatccacatgta

SEQ ID NO: 1257623 - DNA, 22 bp, Artificial Sequence
  chemically synthesized
atcccaggtacatgtggatgtt

SEQ ID NO: 1257624 - DNA, 22 bp, Artificial Sequence
  chemically synthesized
cattctaggggtgaacatccac

SEQ ID NO: 1257625 - DNA, 22 bp, Artificial Sequence
  chemically synthesized
acccctagaatgcaatttcttt

SEQ ID NO: 1257626 - DNA, 22 bp, Artificial Sequence
  chemically synthesized
aaaaaaataaaagaaaaagaaa

SEQ ID NO: 1257627 - DNA, 22 bp, Artificial Sequence
  chemically synthesized
gaatgcaatttctttttctttt

SEQ ID NO: 1257628 - DNA, 22 bp, Artificial Sequence
  chemically synthesized
tctaaaaaaaataaaagaaaaa

SEQ ID NO: 1257629 - DNA, 22 bp, Artificial Sequence
  chemically synthesized
tatctaaaaaaaataaaagaaa

SEQ ID NO: 1257630 - DNA, 22 bp, Artificial Sequence
  chemically synthesized
ctttttcttttattttttttag

SEQ ID NO: 1257631 - DNA, 22 bp, Artificial Sequence
  chemically synthesized
tttttcttttattttttttaga

SEQ ID NO: 1257632 - DNA, 22 bp, Artificial Sequence
  chemically synthesized
tttcttttattttttttagata

SEQ ID NO: 1257633 - DNA, 22 bp, Artificial Sequence
  chemically synthesized
ttcttttattttttttagatag

SEQ ID NO: 1257634 - DNA, 22 bp, Artificial Sequence
  chemically synthesized
tcttttattttttttagataga

SEQ ID NO: 1257635 - DNA, 22 bp, Artificial Sequence
  chemically synthesized
cttttattttttttagatagag

SEQ ID NO: 1257636 - DNA, 22 bp, Artificial Sequence
  chemically synthesized
ttttattttttttagatagagt

SEQ ID NO: 1257637 - DNA, 22 bp, Artificial Sequence
  chemically synthesized
ttattttttttagatagagtct

SEQ ID NO: 1257638 - DNA, 22 bp, Artificial Sequence
  chemically synthesized
tattttttttagatagagtctc

SEQ ID NO: 1257639 - DNA, 22 bp, Artificial Sequence
  chemically synthesized
attttttttagatagagtctca

SEQ ID NO: 1257640 - DNA, 22 bp, Artificial Sequence
  chemically synthesized
ttttttttagatagagtctcac

SEQ ID NO: 1257641 - DNA, 22 bp, Artificial Sequence
  chemically synthesized
tttttagatagagtctcacact

SEQ ID NO: 1257642 - DNA, 22 bp, Artificial Sequence
  chemically synthesized
ttttagatagagtctcacactg

SEQ ID NO: 1257643 - DNA, 22 bp, Artificial Sequence
  chemically synthesized
cagcccgggtgacagtgtgaga

SEQ ID NO: 1257644 - DNA, 22 bp, Artificial Sequence
  chemically synthesized
tttagatagagtctcacactgt

SEQ ID NO: 1257645 - DNA, 22 bp, Artificial Sequence
  chemically synthesized
ttagatagagtctcacactgtc

SEQ ID NO: 1257646 - DNA, 22 bp, Artificial Sequence
  chemically synthesized
tagatagagtctcacactgtca

SEQ ID NO: 1257647 - DNA, 22 bp, Artificial Sequence
  chemically synthesized
agatagagtctcacactgtcac

SEQ ID NO: 1257648 - DNA, 22 bp, Artificial Sequence
  chemically synthesized
gatagagtctcacactgtcacc

SEQ ID NO: 1257649 - DNA, 22 bp, Artificial Sequence
  chemically synthesized
cactccagcccgggtgacagtg

SEQ ID NO: 1257650 - DNA, 22 bp, Artificial Sequence
  chemically synthesized
acactgtcacccgggctggagt

SEQ ID NO: 1257651 - DNA, 22 bp, Artificial Sequence
  chemically synthesized
tcacccgggctggagtgcaatg

SEQ ID NO: 1257652 - DNA, 22 bp, Artificial Sequence
  chemically synthesized
cagtgagcccagatcacaccat

SEQ ID NO: 1257653 - DNA, 22 bp, Artificial Sequence
  chemically synthesized
gagtgcaatggtgtgatctggg

SEQ ID NO: 1257654 - DNA, 22 bp, Artificial Sequence
  chemically synthesized
ggaggcggaggttgcagtgagc

SEQ ID NO: 1257655 - DNA, 22 bp, Artificial Sequence
  chemically synthesized
ggctcactgcaacctccgcctc

SEQ ID NO: 1257656 - DNA, 22 bp, Artificial Sequence
  chemically synthesized
gcaggagaattgggaggcggag

SEQ ID NO: 1257657 - DNA, 22 bp, Artificial Sequence
  chemically synthesized
ggcaggagaattgggaggcgga

SEQ ID NO: 1257658 - DNA, 22 bp, Artificial Sequence
  chemically synthesized
actgcaacctccgcctcccaat

SEQ ID NO: 1257659 - DNA, 22 bp, Artificial Sequence
  chemically synthesized
caacctccgcctcccaattctc

SEQ ID NO: 1257660 - DNA, 22 bp, Artificial Sequence
  chemically synthesized
cgcctcccaattctcctgccaa

SEQ ID NO: 1257661 - DNA, 22 bp, Artificial Sequence
  chemically synthesized
aggcaggagaatcgcttggcag

SEQ ID NO: 1257662 - DNA, 22 bp, Artificial Sequence
  chemically synthesized
ccaattctcctgccaagcgatt

SEQ ID NO: 1257663 - DNA, 22 bp, Artificial Sequence
  chemically synthesized
aggaggctgaggcaggagaatc

SEQ ID NO: 1257664 - DNA, 22 bp, Artificial Sequence
  chemically synthesized
tcctgccaagcgattctcctgc

SEQ ID NO: 1257665 - DNA, 22 bp, Artificial Sequence
  chemically synthesized
ctgccaagcgattctcctgcct

SEQ ID NO: 1257666 - DNA, 22 bp, Artificial Sequence
  chemically synthesized
ctcaggaggctgaggcaggaga

SEQ ID NO: 1257667 - DNA, 22 bp, Artificial Sequence
  chemically synthesized
ccaagcgattctcctgcctcag

SEQ ID NO: 1257668 - DNA, 22 bp, Artificial Sequence
  chemically synthesized
gaatcccagctactcaggaggc

SEQ ID NO: 1257669 - DNA, 22 bp, Artificial Sequence
  chemically synthesized
tcctgcctcagcctcctgagta

SEQ ID NO: 1257670 - DNA, 22 bp, Artificial Sequence
  chemically synthesized
ctgcctcagcctcctgagtagc

SEQ ID NO: 1257671 - DNA, 22 bp, Artificial Sequence
  chemically synthesized
cctcagcctcctgagtagctgg

SEQ ID NO: 1257672 - DNA, 22 bp, Artificial Sequence
  chemically synthesized
agcctcctgagtagctgggatt

SEQ ID NO: 1257673 - DNA, 22 bp, Artificial Sequence
  chemically synthesized
ctgagtagctgggattccaggt

SEQ ID NO: 1257674 - DNA, 22 bp, Artificial Sequence
  chemically synthesized
agtagctgggattccaggtgcc

SEQ ID NO: 1257675 - DNA, 22 bp, Artificial Sequence
  chemically synthesized
gccaggcatggcggcgggcacc

SEQ ID NO: 1257676 - DNA, 22 bp, Artificial Sequence
  chemically synthesized
ggattccaggtgcccgccgcca

SEQ ID NO: 1257677 - DNA, 22 bp, Artificial Sequence
  chemically synthesized
caggtgcccgccgccatgcctg

SEQ ID NO: 1257678 - DNA, 22 bp, Artificial Sequence
  chemically synthesized
aaaatgcacacacagaaaaatt

SEQ ID NO: 1257679 - DNA, 22 bp, Artificial Sequence
  chemically synthesized
ctaaaaatgcacacacagaaaa

SEQ ID NO: 1257680 - DNA, 22 bp, Artificial Sequence
  chemically synthesized
tactaaaaatgcacacacagaa

SEQ ID NO: 1257681 - DNA, 22 bp, Artificial Sequence
  chemically synthesized
gctaatttttctgtgtgtgcat

SEQ ID NO: 1257682 - DNA, 22 bp, Artificial Sequence
  chemically synthesized
atttttctgtgtgtgcattttt

SEQ ID NO: 1257683 - DNA, 22 bp, Artificial Sequence
  chemically synthesized
ttctgtgtgtgcatttttagta

SEQ ID NO: 1257684 - DNA, 22 bp, Artificial Sequence
  chemically synthesized
tctgtgtgtgcatttttagtag

SEQ ID NO: 1257685 - DNA, 22 bp, Artificial Sequence
  chemically synthesized
ctgtgtgtgcatttttagtaga

SEQ ID NO: 1257686 - DNA, 22 bp, Artificial Sequence
  chemically synthesized
tgtgtgtgcatttttagtagag

SEQ ID NO: 1257687 - DNA, 22 bp, Artificial Sequence
  chemically synthesized
tgtgtgcatttttagtagagac

SEQ ID NO: 1257688 - DNA, 22 bp, Artificial Sequence
  chemically synthesized
gccaacatagtgaaaccccgtc

SEQ ID NO: 1257689 - DNA, 22 bp, Artificial Sequence
  chemically synthesized
ttagtagagacggggtttcact

SEQ ID NO: 1257690 - DNA, 22 bp, Artificial Sequence
  chemically synthesized
tagtagagacggggtttcacta

SEQ ID NO: 1257691 - DNA, 22 bp, Artificial Sequence
  chemically synthesized
agtagagacggggtttcactat

SEQ ID NO: 1257692 - DNA, 22 bp, Artificial Sequence
  chemically synthesized
gtagagacggggtttcactatg

SEQ ID NO: 1257693 - DNA, 22 bp, Artificial Sequence
  chemically synthesized
gagaccagcctggccaacatag

SEQ ID NO: 1257694 - DNA, 22 bp, Artificial Sequence
  chemically synthesized
cgagaccagcctggccaacata

SEQ ID NO: 1257695 - DNA, 22 bp, Artificial Sequence
  chemically synthesized
cactatgttggccaggctggtc

SEQ ID NO: 1257696 - DNA, 22 bp, Artificial Sequence
  chemically synthesized
actatgttggccaggctggtct

SEQ ID NO: 1257697 - DNA, 22 bp, Artificial Sequence
  chemically synthesized
tgttggccaggctggtctcgaa

SEQ ID NO: 1257698 - DNA, 22 bp, Artificial Sequence
  chemically synthesized
gccaggctggtctcgaaatcct

SEQ ID NO: 1257699 - DNA, 22 bp, Artificial Sequence
  chemically synthesized
gtctcgaaatcctgacctcgtg
